United States Patent 11,640,849 (METHODS FOR HISTOLOGICAL DIAGNOSIS AND TREATMENT OF DISEASES) - sequence listing, part 32

SEQ ID NO: 1254127 - protein, 27 aa, Mycobacterium
NPELLFSAGYAACFLGALRLQAKNNDV

SEQ ID NO: 1254128 - protein, 23 aa, Mycobacterium
NPGLQRLPLWRSLRERIEEADRL

SEQ ID NO: 1254129 - protein, 21 aa, Mycobacterium
NPLDPACRIPSAQAGRAQGRR

SEQ ID NO: 1254130 - protein, 29 aa, Mycobacterium
NPLGQGMGGMSPFGQQGMGASPFGDPFGQ

SEQ ID NO: 1254131 - protein, 25 aa, Mycobacterium
NPMAVEMCKLSLWLVSLDKTKPFSF

SEQ ID NO: 1254132 - protein, 17 aa, Mycobacterium
NPSWAWTAGGVISRADY

SEQ ID NO: 1254133 - protein, 19 aa, Mycobacterium
NPTIKRVAEQLGRTPAQVA

SEQ ID NO: 1254134 - protein, 17 aa, Mycobacterium
NPVCTAAALAVLKVLAD

SEQ ID NO: 1254135 - protein, 26 aa, Mycobacterium
NPYLRVRPTVSWSWNLGGEPLNHHKM

SEQ ID NO: 1254136 - protein, 24 aa, Mycobacterium
NPYTFRKVFRGMAIARENRLPIIN

SEQ ID NO: 1254137 - protein, 26 aa, Mycobacterium
NQFMAAWWRIVRRIALGDRARDDDEI

SEQ ID NO: 1254138 - protein, 20 aa, Mycobacterium
NQVSLEIMPAWGGAERLAGL

SEQ ID NO: 1254139 - protein, 22 aa, Mycobacterium
NRDEFTLFVAMRYLQHDDRYTP

SEQ ID NO: 1254140 - protein, 21 aa, Mycobacterium
NRGFLRCVAALARAADTIGET

SEQ ID NO: 1254141 - protein, 18 aa, Mycobacterium
NRGLKYGVKQVFSAAGAS

SEQ ID NO: 1254142 - protein, 20 aa, Mycobacterium
NRIRAAIDRLLRGEIPPDGS

SEQ ID NO: 1254143 - protein, 22 aa, Mycobacterium
NRIRQSVIDMVEKVSAYVPGYR

SEQ ID NO: 1254144 - protein, 19 aa, Mycobacterium
NRLLAHAKPADLVRDGEYQ

SEQ ID NO: 1254145 - protein, 21 aa, Mycobacterium
NRLPHAAAIAGSLAGGRWVSM

SEQ ID NO: 1254146 - protein, 21 aa, Mycobacterium
NRLPIRDLIRMAAESRHYLAV

SEQ ID NO: 1254147 - protein, 18 aa, Mycobacterium
NRVAVGMPPDVPDWRELG

SEQ ID NO: 1254148 - protein, 24 aa, Mycobacterium
NSFAEFDSRVEIAFAYEQRLRESV

SEQ ID NO: 1254149 - protein, 30 aa, Mycobacterium
NSFSKYYAMTGWRLGWLLVPQELRRAVDRL

SEQ ID NO: 1254150 - protein, 26 aa, Mycobacterium
NSGIARFAYRQHVEPAYFLKPPSALT

SEQ ID NO: 1254151 - protein, 25 aa, Mycobacterium
NSPDGYRTEVEWATQMSYSGIYVHS

SEQ ID NO: 1254152 - protein, 18 aa, Mycobacterium
NSQFPPVVFVHGALVDHR

SEQ ID NO: 1254153 - protein, 27 aa, Mycobacterium
NSQPWRWHVGADRLDLFAVPRLHLRHI

SEQ ID NO: 1254154 - protein, 17 aa, Mycobacterium
NSTLWVLEGHGFLGYWR

SEQ ID NO: 1254155 - protein, 18 aa, Mycobacterium
NSVLCTNESVLIVEDSVA

SEQ ID NO: 1254156 - protein, 17 aa, Mycobacterium
NSVVLRQRLRLRGIDAE

SEQ ID NO: 1254157 - protein, 17 aa, Mycobacterium
NSYKRLTPKLADGSVSW

SEQ ID NO: 1254158 - protein, 23 aa, Mycobacterium
NTLVCPKCKGVMRTYERNGIHLE

SEQ ID NO: 1254159 - protein, 22 aa, Mycobacterium
NTMMWTASTIKLAMVVDLLTRA

SEQ ID NO: 1254160 - protein, 24 aa, Mycobacterium
NTRARRLTVLGQFFRFARNRRVVL

SEQ ID NO: 1254161 - protein, 20 aa, Mycobacterium
NTTLRGSGWVALTTDGPPVV

SEQ ID NO: 1254162 - protein, 27 aa, Mycobacterium
NVALSALRPGPIHFLRRMKEDLVDYDG

SEQ ID NO: 1254163 - protein, 21 aa, Mycobacterium
NVDLRGVAVMGAFDHSVPGQG

SEQ ID NO: 1254164 - protein, 22 aa, Mycobacterium
NVEAYRGLAMELIEQLGAVDVL

SEQ ID NO: 1254165 - protein, 18 aa, Mycobacterium
NVELFRRLARTMEFDEES

SEQ ID NO: 1254166 - protein, 19 aa, Mycobacterium
NVGTVWWALAIDGYTDDML

SEQ ID NO: 1254167 - protein, 25 aa, Mycobacterium
NVIPAHAVLRYSMRAAESVSLRELE

SEQ ID NO: 1254168 - protein, 24 aa, Mycobacterium
NVLAFSAGLDWNIERVRGGSIATG

SEQ ID NO: 1254169 - protein, 17 aa, Mycobacterium
NVLHAAAGRVPREMIMR

SEQ ID NO: 1254170 - protein, 17 aa, Mycobacterium
NVRRTRAGEHLDLGDGD

SEQ ID NO: 1254171 - protein, 21 aa, Mycobacterium
NVVECLIVLTSRHGPIARTVF

SEQ ID NO: 1254172 - protein, 29 aa, Mycobacterium
NWKLLKWLDPPAPFYDWRANEVHPDDDAH

SEQ ID NO: 1254173 - protein, 31 aa, Mycobacterium
NWRGKAVLVKLIWRMVRARVFGDRMAAIGQS

SEQ ID NO: 1254174 - protein, 17 aa, Mycobacterium
NYAKEAPGWTVTTGDVD

SEQ ID NO: 1254175 - protein, 20 aa, Mycobacterium
NYAKEAPGWTVTTGDVDGAH

SEQ ID NO: 1254176 - protein, 23 aa, Mycobacterium
NYVSRLLAKLGMERRTQAAVFVS

SEQ ID NO: 1254177 - protein, 19 aa, Mycobacterium
PAAARVAAMAVRFIAETAS

SEQ ID NO: 1254178 - protein, 19 aa, Mycobacterium
PAAGAVLWRPGGSAPEVAV

SEQ ID NO: 1254179 - protein, 18 aa, Mycobacterium
PAALARAARHGDGFLGAG

SEQ ID NO: 1254180 - protein, 18 aa, Mycobacterium
PAALLCRLPGGGWVLSRM

SEQ ID NO: 1254181 - protein, 32 aa, Mycobacterium; identical to SEQ ID NO: 704998

SEQ ID NO: 1254182 - protein, 21 aa, Mycobacterium
PAARELTEFFAHVDGKLADPA

SEQ ID NO: 1254183 - protein, 24 aa, Mycobacterium
PADAKAVILSPTLVTSRAIQLTPG

SEQ ID NO: 1254184 - protein, 20 aa, Mycobacterium
PADVVSVAAPIAFAVPDGEI

SEQ ID NO: 1254185 - protein, 19 aa, Mycobacterium
PAEALRWYWDQYVPNDFDR

SEQ ID NO: 1254186 - protein, 27 aa, Mycobacterium
PAEARLPRTWIALLRGRIDASLAATTG

SEQ ID NO: 1254187 - protein, 19 aa, Mycobacterium
PAEAVEFGIANGFTIAEMA

SEQ ID NO: 1254188 - protein, 34 aa, Mycobacterium
PAEGIPAIMQAFLQPILFPSLALLMPVQGIITQT

SEQ ID NO: 1254189 - protein, 18 aa, Mycobacterium
PAEPRTYYLATERMLSTE

SEQ ID NO: 1254190 - protein, 24 aa, Mycobacterium
PAERGYFLDVSWRMHPAVCAAVSR

SEQ ID NO: 1254191 - protein, 24 aa, Mycobacterium
PAERIAAEFAHRFATDHIGLREDD

SEQ ID NO: 1254192 - protein, 20 aa, Mycobacterium
PAEVPARMEALGAVGGLNRG

SEQ ID NO: 1254193 - protein, 18 aa, Mycobacterium
PAGAFAMAEFDEGERRQA

SEQ ID NO: 1254194 - protein, 20 aa, Mycobacterium
PAGAIPARLYRPTSPDPDGP

SEQ ID NO: 1254195 - protein, 25 aa, Mycobacterium
PAGDLPALPAGAVWAVDVVDIPPRL

SEQ ID NO: 1254196 - protein, 19 aa, Mycobacterium
PAGTRLQTWVRLNNATAMQ

SEQ ID NO: 1254197 - protein, 18 aa, Mycobacterium
PALDVFGRVFFIGEKAGS

SEQ ID NO: 1254198 - protein, 18 aa, Mycobacterium
PALEAVRQFGRVVVFDQR

SEQ ID NO: 1254199 - protein, 18 aa, Mycobacterium
PALEEFFTGVVASLDPTN

SEQ ID NO: 1254200 - protein, 20 aa, Mycobacterium
PALIGLCLFGDGAAAVVATG

SEQ ID NO: 1254201 - protein, 25 aa, Mycobacterium
PANNVEFFFLRPKDIAIYVGSGQLD

SEQ ID NO: 1254202 - protein, 21 aa, Mycobacterium
PAPDPAVCTLVLSGKTEKRIA

SEQ ID NO: 1254203 - protein, 17 aa, Mycobacterium
PAPEFAVSVLRLDGDNV

SEQ ID NO: 1254204 - protein, 20 aa, Mycobacterium
PAPLMRWGVVAFDPTVRSPT

SEQ ID NO: 1254205 - protein, 17 aa, Mycobacterium
PAPTKSALLARAIEDGI

SEQ ID NO: 1254206 - protein, 23 aa, Mycobacterium
PAQRAQVWQAIWEFEQTLTKQEV

SEQ ID NO: 1254207 - protein, 23 aa, Mycobacterium
PARADIGLWSFLTRFAANCRRSS

SEQ ID NO: 1254208 - protein, 19 aa, Mycobacterium
PARLQPGSFYALPQSPQLF

SEQ ID NO: 1254209 - protein, 27 aa, Mycobacterium
PARPWVCLLCPLAVFAPRHAANLLRLK

SEQ ID NO: 1254210 - protein, 22 aa, Mycobacterium
PARVKDVFFYEPIILPEKSSRE

SEQ ID NO: 1254211 - protein, 26 aa, Mycobacterium
PARVRLRGGAVLVELADRFGEAVAAK

SEQ ID NO: 1254212 - protein, 26 aa, Mycobacterium
PASAEFLRVLRGCGVAAVLSGAGPAV

SEQ ID NO: 1254213 - protein, 21 aa, Mycobacterium
PASAIGRIFSPPEFRLIPIDE

SEQ ID NO: 1254214 - protein, 18 aa, Mycobacterium
PASARLLVTAALAQAGPL

SEQ ID NO: 1254215 - protein, 20 aa, Mycobacterium
PASILMLFAPGAPREHYFEG

SEQ ID NO: 1254216 - protein, 18 aa, Mycobacterium
PASSFSPAYLSVWHRTPD

SEQ ID NO: 1254217 - protein, 17 aa, Mycobacterium
PATRPAVPMSVSEAAAV

SEQ ID NO: 1254218 - protein, 18 aa, Mycobacterium
PATSRPLKLLGIADIIPL

SEQ ID NO: 1254219 - protein, 18 aa, Mycobacterium
PATTHWAYADAFAKRYPA

SEQ ID NO: 1254220 - protein, 21 aa, Mycobacterium
PATTSWQAWSQRCAELTTHPA

SEQ ID NO: 1254221 - protein, 18 aa, Mycobacterium
PATYFSAGKVQWILDNVD

SEQ ID NO: 1254222 - protein, 21 aa, Mycobacterium
PAVAVKQRWGRSGERGADVVF

SEQ ID NO: 1254223 - protein, 20 aa, Mycobacterium
PAVDTGTGWAVVDVETSGFR

SEQ ID NO: 1254224 - protein, 21 aa, Mycobacterium
PAVGLDGEWMREIADDMFASP

SEQ ID NO: 1254225 - protein, 18 aa, Mycobacterium
PAVLVFTDRGWRWGGDWR

SEQ ID NO: 1254226 - protein, 20 aa, Mycobacterium
PAVRRARLLARHVAGGRGNA

SEQ ID NO: 1254227 - protein, 20 aa, Mycobacterium
PAVSAWNWLETVPGGWRRAL

SEQ ID NO: 1254228 - protein, 20 aa, Mycobacterium
PDAARVGRRLVVRSDEVSGT

SEQ ID NO: 1254229 - protein, 25 aa, Mycobacterium
PDAELSALLALRPPALLVGRADPND

SEQ ID NO: 1254230 - protein, 17 aa, Mycobacterium
PDALPLDAAAPLLCAGI

SEQ ID NO: 1254231 - protein, 18 aa, Mycobacterium
PDAVFCANDLLAIGVLQA

SEQ ID NO: 1254232 - protein, 38 aa, Mycobacterium
PDAYKKLARLGSRGDFIPEYLCSLSLKVNGKGGQPVYV

SEQ ID NO: 1254233 - protein, 20 aa, Mycobacterium
PDDCIPDLVELGVTVVTQPN

SEQ ID NO: 1254234 - protein, 19 aa, Mycobacterium
PDDLIALLTPRRSSLGEQR

SEQ ID NO: 1254235 - protein, 19 aa, Mycobacterium
PDDSLGMRRVEVVCANCHS

SEQ ID NO: 1254236 - protein, 19 aa, Mycobacterium
PDEGLILFCGMSIGFEDRS

SEQ ID NO: 1254237 - protein, 17 aa, Mycobacterium
PDFAGETERAWFQAHVD

SEQ ID NO: 1254238 - protein, 26 aa, Mycobacterium
PDFFEFLRGGARFELLELHVTAGTDV

SEQ ID NO: 1254239 - protein, 18 aa, Mycobacterium
PDFQIRGDRMVAVLEDVS

SEQ ID NO: 1254240 - protein, 23 aa, Mycobacterium
PDGLTAWLLLSCRALHEGAREAL

SEQ ID NO: 1254241 - protein, 22 aa, Mycobacterium
PDGRWIGIRAETSYGPDGIGTT

SEQ ID NO: 1254242 - protein, 19 aa, Mycobacterium
PDGSCDITTLAREAGVDRT

SEQ ID NO: 1254243 - protein, 19 aa, Mycobacterium
PDGTLQHPPVPAVWADKDA

SEQ ID NO: 1254244 - protein, 25 aa, Mycobacterium
PDGVSWASAEPLGYNKQYTLRAEAL

SEQ ID NO: 1254245 - protein, 19 aa, Mycobacterium
PDGVTLCRTLRQRGEHTVP

SEQ ID NO: 1254246 - protein, 17 aa, Mycobacterium
PDHGGCGRLTVVALPVE

SEQ ID NO: 1254247 - protein, 17 aa, Mycobacterium
PDIGHACGHNIIAASAV

SEQ ID NO: 1254248 - protein, 21 aa, Mycobacterium
PDLAAFWSRYLLAARERGEIH

SEQ ID NO: 1254249 - protein, 17 aa, Mycobacterium
PDLKFAFSEGGIGWIPF

SEQ ID NO: 1254250 - protein, 20 aa, Mycobacterium
PDLPAAWVAALRVEESGSNG

SEQ ID NO: 1254251 - protein, 17 aa, Mycobacterium
PDLPALRVADVSSTKTE

SEQ ID NO: 1254252 - protein, 17 aa, Mycobacterium
PDLPRLRTLIQVADGSG

SEQ ID NO: 1254253 - protein, 17 aa, Mycobacterium
PDLRWRLHHQVAVRPEP

SEQ ID NO: 1254254 - protein, 31 aa, Mycobacterium
PDLWRVDRYLDFLAARRELLAASAQRFLESL

SEQ ID NO: 1254255 - protein, 20 aa, Mycobacterium
PDNKGPLLINARADKVTTSP

SEQ ID NO: 1254256 - protein, 20 aa, Mycobacterium
PDNVALRWLAAEMLHTLDSG

SEQ ID NO: 1254257 - protein, 19 aa, Mycobacterium
PDPATSGRSATRWRSSSNG

SEQ ID NO: 1254258 - protein, 32 aa, Mycobacterium
PDPDTGLPRLGWRTPPLGGFRADPDAPIVFAL

SEQ ID NO: 1254259 - protein, 22 aa, Mycobacterium
PDPLHKVLAVWANRGRIAGRCA

SEQ ID NO: 1254260 - protein, 17 aa, Mycobacterium
PDPRQWVGTLWRTSTGL

SEQ ID NO: 1254261 - protein, 21 aa, Mycobacterium
PDPWRLGNEMLRVTRPGGLAV

SEQ ID NO: 1254262 - protein, 25 aa, Mycobacterium
PDQMLAYNCSPSFNWKKHLDDATIA

SEQ ID NO: 1254263 - protein, 25 aa, Mycobacterium
PDRFAPQLKPEVWAVAFDPDSGAVV

SEQ ID NO: 1254264 - protein, 24 aa, Mycobacterium
PDSDVTVGLVFRALFGQPDLLSRL

SEQ ID NO: 1254265 - protein, 21 aa, Mycobacterium
PDSRFPAPRYWAIHTLSHLLI

SEQ ID NO: 1254266 - protein, 19 aa, Mycobacterium
PDTCREIAEKAAAQNVSVI

SEQ ID NO: 1254267 - protein, 17 aa, Mycobacterium
PDTKVIVMIGEIGGDAE

SEQ ID NO: 1254268 - protein, 17 aa, Mycobacterium
PDVRRYHATYANYVGKP

SEQ ID NO: 1254269 - protein, 18 aa, Mycobacterium
PEADRPAVLRALLDCPVH

SEQ ID NO: 1254270 - protein, 25 aa, Mycobacterium
PEAKEALGTRFGRMASNLPRLAVTS

SEQ ID NO: 1254271 - protein, 20 aa, Mycobacterium
PEALAVWQAIFAKEAAPGAN

SEQ ID NO: 1254272 - protein, 21 aa, Mycobacterium
PEALEPIGSVTRTEVGREASE

SEQ ID NO: 1254273 - protein, 17 aa, Mycobacterium
PEALNAFNEALYDATTV

SEQ ID NO: 1254274 - protein, 18 aa, Mycobacterium
PEFARGMAAQSFVGHGAE

SEQ ID NO: 1254275 - protein, 17 aa, Mycobacterium
PEFGYRYLVEEARDAGE

SEQ ID NO: 1254276 - protein, 17 aa, Mycobacterium
PEFPAYERSTGDVVDLV

SEQ ID NO: 1254277 - protein, 19 aa, Mycobacterium
PEFQVRLLAKRPGPDLGLM

SEQ ID NO: 1254278 - protein, 21 aa, Mycobacterium
PEGFLSTHLVGGVAPGTIVRL

SEQ ID NO: 1254279 - protein, 18 aa, Mycobacterium
PEGLRWLDSCQEALRASS

SEQ ID NO: 1254280 - protein, 23 aa, Mycobacterium
PEGVVLPELVQWLPTAALDEPIG

SEQ ID NO: 1254281 - protein, 23 aa, Mycobacterium
PEIAELAHLLPRPPRSATLPAVL

SEQ ID NO: 1254282 - protein, 20 aa, Mycobacterium
PEIGPSWHLGVLPMDDGSVA

SEQ ID NO: 1254283 - protein, 20 aa, Mycobacterium
PEIREFYDAFSPRFEEAIDY

SEQ ID NO: 1254284 - protein, 17 aa, Mycobacterium
PEKPVRIWNRIGRRPVL

SEQ ID NO: 1254285 - protein, 17 aa, Mycobacterium
PELAARLGFTRSAAAVD

SEQ ID NO: 1254286 - protein, 17 aa, Mycobacterium
PELAELLLSKGLGVEVG

SEQ ID NO: 1254287 - protein, 17 aa, Mycobacterium
PELARLTLNIAATHHDS

SEQ ID NO: 1254288 - protein, 20 aa, Mycobacterium
PELLTPITAAPVYLKVEAAY

SEQ ID NO: 1254289 - protein, 21 aa, Mycobacterium
PELRMREWKSNIGPDVQIHCL

SEQ ID NO: 1254290 - protein, 21 aa, Mycobacterium
PELVKSAASVKVFQRTPGWVL

SEQ ID NO: 1254291 - protein, 21 aa, Mycobacterium
PENAAGPVWWDPQMRTTSDYP

SEQ ID NO: 1254292 - protein, 18 aa, Mycobacterium
PEPAESWSPAPTPTVAAA

SEQ ID NO: 1254293 - protein, 28 aa, Mycobacterium
PEPHPLLPATPWHHAHHWIKVDPTAGID

SEQ ID NO: 1254294 - protein, 20 aa, Mycobacterium
PEPRIKVMDELGVDRSLMFP

SEQ ID NO: 1254295 - protein, 20 aa, Mycobacterium
PERAEAIAIHAACVARGAAD

SEQ ID NO: 1254296 - protein, 22 aa, Mycobacterium
PERGDMAGRSRLEVIAPGAARQ

SEQ ID NO: 1254297 - protein, 19 aa, Mycobacterium
PERLRAAWVDIPEVVSAAT

SEQ ID NO: 1254298 - protein, 19 aa, Mycobacterium
PERRLHVLAKAKANIVYRL

SEQ ID NO: 1254299 - protein, 20 aa, Mycobacterium
PERVAKLIVDFVDRVAGSTD

SEQ ID NO: 1254300 - protein, 17 aa, Mycobacterium
PETRTVTTLTVISTTTG

SEQ ID NO: 1254301 - protein, 20 aa, Mycobacterium
PEVAGRYLVDVGFGGQTLSS

SEQ ID NO: 1254302 - protein, 21 aa, Mycobacterium
PEVDGFVWHGFIPNIEPGQRY

SEQ ID NO: 1254303 - protein, 22 aa, Mycobacterium
PEVDGFVWHGFIPNIEPGQRYG

SEQ ID NO: 1254304 - protein, 21 aa, Mycobacterium
PEVGEKLGAAAQRVLRGRGVD

SEQ ID NO: 1254305 - protein, 19 aa, Mycobacterium
PEVSLWDLAAIDILVREAG

SEQ ID NO: 1254306 - protein, 17 aa, Mycobacterium
PFAGPEIATRTSAFLTH

SEQ ID NO: 1254307 - protein, 21 aa, Mycobacterium
PFAGSAPRFADPAADRASGAA

SEQ ID NO: 1254308 - protein, 19 aa, Mycobacterium
PFAPGCVRIEVGLKTGFSG

SEQ ID NO: 1254309 - protein, 46 aa, Mycobacterium
PFDEARRVSIPAGWTMAVWARVPKARFARWAPDGALLVSVPSTGEI

SEQ ID NO: 1254310 - protein, 20 aa, Mycobacterium
PFDPMTVWAYDECDLTEPSR

SEQ ID NO: 1254311 - protein, 25 aa, Mycobacterium
PFEGLRVLDLTTFWAGPSCTHILAL

SEQ ID NO: 1254312 - protein, 17 aa, Mycobacterium
PFEPFAVAAVELADEGL

SEQ ID NO: 1254313 - protein, 21 aa, Mycobacterium
PFETARTALLLGQLQRRQRRK

SEQ ID NO: 1254314 - protein, 18 aa, Mycobacterium
PFGPGFDFTDPDVLVQGI

SEQ ID NO: 1254315 - protein, 18 aa, Mycobacterium
PFHVCGTVADRLRDAGFT

SEQ ID NO: 1254316 - protein, 24 aa, Mycobacterium
PFLPWPWPRVVGAHFVAGDSDTIW

SEQ ID NO: 1254317 - protein, 18 aa, Mycobacterium
PFPGPVRQLGYVVRDFDR

SEQ ID NO: 1254318 - protein, 19 aa, Mycobacterium
PFSITGSAAPPFGAAMRRS

SEQ ID NO: 1254319 - protein, 31 aa, Mycobacterium
PFTLFPRIIVSMAWLPGPRAQRQLRDALITK

SEQ ID NO: 1254320 - protein, 17 aa, Mycobacterium
PFYHDMGLIKGVCAPLV

SEQ ID NO: 1254321 - protein, 18 aa, Mycobacterium
PGAGKSRLVALLAGALAH

SEQ ID NO: 1254322 - protein, 23 aa, Mycobacterium
PGAHYVGPGWQDGRRLWNVRSLM

SEQ ID NO: 1254323 - protein, 24 aa, Mycobacterium
PGALRPAAGSSWCEWKGRAAYYDV

SEQ ID NO: 1254324 - protein, 23 aa, Mycobacterium
PGAPDYPSLEAWTLATALLARTE

SEQ ID NO: 1254325 - protein, 18 aa, Mycobacterium
PGAQCGHRAPLTARAASE

SEQ ID NO: 1254326 - protein, 19 aa, Mycobacterium
PGAVVSRTDLLGALPGSGT

SEQ ID NO: 1254327 - protein, 22 aa, Mycobacterium
PGCRSGGLGDGIASLAFPVLHM

SEQ ID NO: 1254328 - protein, 25 aa, Mycobacterium
PGELDWPATWLDRAGRDRAPTVPGH

SEQ ID NO: 1254329 - protein, 18 aa, Mycobacterium
PGFRRLSLAGQRLPDSLG

SEQ ID NO: 1254330 - protein, 27 aa, Mycobacterium
PGHFMDDFLLYWAFLSFALVRGGRRTF

SEQ ID NO: 1254331 - protein, 18 aa, Mycobacterium
PGHLTELMTRAGVEILVA

SEQ ID NO: 1254332 - protein, 23 aa, Mycobacterium
PGKAQSIVESWTAYSKSTVMRSR

SEQ ID NO: 1254333 - protein, 23 aa, Mycobacterium
PGKRPRSTMAPTLVFDASTGPPG

SEQ ID NO: 1254334 - protein, 22 aa, Mycobacterium
PGLGEWDLRALVGHTSRSLITV

SEQ ID NO: 1254335 - protein, 22 aa, Mycobacterium
PGLHRPRTLLGQRLNDLVKTTY

SEQ ID NO: 1254336 - protein, 37 aa, Mycobacterium
PGLNGAWRTLTWLQAHGWSRLLPRTVVALNRTASHKP

SEQ ID NO: 1254337 - protein, 20 aa, Mycobacterium
PGLPPLRCGLPRLPQGINPV

SEQ ID NO: 1254338 - protein, 17 aa, Mycobacterium
PGNVFAHALLDRAAGDR

SEQ ID NO: 1254339 - protein, 23 aa, Mycobacterium
PGPIDVCVRTCIPPRVAGIQREH

SEQ ID NO: 1254340 - protein, 26 aa, Mycobacterium
PGQTRPDWQLICRIAAELGFGADFAY

SEQ ID NO: 1254341 - protein, 17 aa, Mycobacterium
PGRGRRIGIDVGSVRVG

SEQ ID NO: 1254342 - protein, 22 aa, Mycobacterium
PGRMIPQALPPIWDPNLMAEEV

SEQ ID NO: 1254343 - protein, 21 aa, Mycobacterium
PGRPRPCRRRLPQRQATRTPR

SEQ ID NO: 1254344 - protein, 23 aa, Mycobacterium
PGRRLLDGMGLPWSENSRPTITI

SEQ ID NO: 1254345 - protein, 22 aa, Mycobacterium
PGSDSLLRMRLDLAECATGVTK

SEQ ID NO: 1254346 - protein, 17 aa, Mycobacterium
PGTPVPPSGQWDRSSPA

SEQ ID NO: 1254347 - protein, 21 aa, Mycobacterium
PGVTERGWAPIVRFGVAPRLR

SEQ ID NO: 1254348 - protein, 19 aa, Mycobacterium
PHAAIAIWTADGVTMFDST

SEQ ID NO: 1254349 - protein, 31 aa, Mycobacterium
PHDVPWFPKDVDHWSVRWVALHLTEELTRHA

SEQ ID NO: 1254350 - protein, 18 aa, Mycobacterium
PHISADLAADIGRLLASG

SEQ ID NO: 1254351 - protein, 18 aa, Mycobacterium
PHPAAAVSTLIVSGKSPE

SEQ ID NO: 1254352 - protein, 21 aa, Mycobacterium
PHVAMTVSMLRDAGVEVDDTK

SEQ ID NO: 1254353 - protein, 26 aa, Mycobacterium
PHYRPSAKLAAFVRARDLFCRFPGCD

SEQ ID NO: 1254354 - protein, 26 aa, Mycobacterium
PHYRPSAKLAAFVRARDLFCRYPGCD

SEQ ID NO: 1254355 - protein, 27 aa, Mycobacterium
PIAEACAAHGAWLHVDGAFGLWAAAAP

SEQ ID NO: 1254356 - protein, 17 aa, Mycobacterium
PIGGPAFDDAVRVLAPE

SEQ ID NO: 1254357 - protein, 20 aa, Mycobacterium
PIGVNPFVGATVRPNEVTYS

SEQ ID NO: 1254358 - protein, 18 aa, Mycobacterium
PILRCVRHPGPTPPVLLI

SEQ ID NO: 1254359 - protein, 24 aa, Mycobacterium
PINAYLRPAVNPERIIYTDPKLAP

SEQ ID NO: 1254360 - protein, 26 aa, Mycobacterium
PIPGKRPRKYLRVTLGRRNPVVTATF

SEQ ID NO: 1254361 - protein, 25 aa, Mycobacterium
PIQPDRLARIVARAFGLGRVNDDRK

SEQ ID NO: 1254362 - protein, 25 aa, Mycobacterium
PITPGRHTFGIAYTRTGTVEGSHTP

SEQ ID NO: 1254363 - protein, 32 aa, Mycobacterium
PIVLVDFWAPWCGPCRAFAPVFERSSQTHPDV

SEQ ID NO: 1254364 - protein, 22 aa, Mycobacterium
PKEDHLRIAALFDDGTALSFVD

SEQ ID NO: 1254365 - protein, 17 aa, Mycobacterium
PKHPVWYHNIKKNPRVE

SEQ ID NO: 1254366 - protein, 21 aa, Mycobacterium
PKIAVHWPLIDFECGPNGGAD

SEQ ID NO: 1254367 - protein, 18 aa, Mycobacterium
PKITLACEVCKHRNYITK

SEQ ID NO: 1254368 - protein, 24 aa, Mycobacterium
PKKLLEDWLAMWSEHYQLGEKLRV

SEQ ID NO: 1254369 - protein, 21 aa, Mycobacterium
PKLADPSVRRAILGLLDVDLL

SEQ ID NO: 1254370 - protein, 24 aa, Mycobacterium
PKNTWPAVLTWRAHDVARMESVRV

SEQ ID NO: 1254371 - protein, 20 aa, Mycobacterium
PKPARPAALLCRLPGGGWVL

SEQ ID NO: 1254372 - protein, 48 aa, Mycobacterium
PKYGFISKRVFGQMFPNLWEWAEEWTERTGRPVVPALFAGDGPPDTSA

SEQ ID NO: 1254373 - protein, 18 aa, Mycobacterium
PLAARPGQPGALALDGAY

SEQ ID NO: 1254374 - protein, 18 aa, Mycobacterium
PLAWTDTYDGHWVAAGSA

SEQ ID NO: 1254375 - protein, 28 aa, Mycobacterium
PLDATHFVRWLSLWSATIDDMYRGPVAE

SEQ ID NO: 1254376 - protein, 17 aa, Mycobacterium
PLDRRYPLWEFYFADGL

SEQ ID NO: 1254377 - protein, 25 aa, Mycobacterium
PLDRSRPLWEMYFIEGLADGRIAVL

SEQ ID NO: 1254378 - protein, 21 aa, Mycobacterium
PLERYPRLSGFTEANAAYVEV

SEQ ID NO: 1254379 - protein, 18 aa, Mycobacterium
PLGDYWLAGLQVAARDHG

SEQ ID NO: 1254380 - protein, 23 aa, Mycobacterium
PLGELRFAAPVAPEPWSGVRDAL

SEQ ID NO: 1254381 - protein, 19 aa, Mycobacterium
PLGSFMHRFRMWGSSDLRR

SEQ ID NO: 1254382 - protein, 19 aa, Mycobacterium
PLGVELRGAQASGRTALER

SEQ ID NO: 1254383 - protein, 17 aa, Mycobacterium
PLITEALRGEGARLVDA

SEQ ID NO: 1254384 - protein, 21 aa, Mycobacterium
PLLHDLHRATGLVVHLAVLDG

SEQ ID NO: 1254385 - protein, 24 aa, Mycobacterium
PLLQRLRTATALYADARGNISRLI

SEQ ID NO: 1254386 - protein, 25 aa, Mycobacterium
PLNMNPHWLGAHPAYTLSKYGMTLL

SEQ ID NO: 1254387 - protein, 26 aa, Mycobacterium
PLPGTAYKWTVVFHHNEHTHPFADNL

SEQ ID NO: 1254388 - protein, 17 aa, Mycobacterium
PLRTVARAKGLRLARAQ

SEQ ID NO: 1254389 - protein, 19 aa, Mycobacterium
PLSADDWDTQMLFFVGHGY

SEQ ID NO: 1254390 - protein, 29 aa, Mycobacterium
PLSHYLGWPVPELKRAFLNPAGAPLIERG

SEQ ID NO: 1254391 - protein, 18 aa, Mycobacterium
PLSSAERRAILKFLETGV

SEQ ID NO: 1254392 - protein, 26 aa, Mycobacterium
PLTSSQMVWLWNHAVSRGGAPDIFPT

SEQ ID NO: 1254393 - protein, 24 aa, Mycobacterium
PLVEIPIQWALDDWEQYCFLPDIS

SEQ ID NO: 1254394 - protein, 19 aa, Mycobacterium
PLVRLVSWGLAGVPPKVMG

SEQ ID NO: 1254395 - protein, 18 aa, Mycobacterium
PLVRRMLDRLDLSVPALW

SEQ ID NO: 1254396 - protein, 22 aa, Mycobacterium
PLVTGLRRLGHRVDLADQSSGL

SEQ ID NO: 1254397 - protein, 24 aa, Mycobacterium
PMAQVIDWAGAVGARPVSVDPRTI

SEQ ID NO: 1254398 - protein, 17 aa, Mycobacterium
PMDGAFIDAARNLAAGR

SEQ ID NO: 1254399 - protein, 18 aa, Mycobacterium
PMPRLADAFMDLIDTAWD

SEQ ID NO: 1254400 - protein, 27 aa, Mycobacterium
PMRLAAGTLIRFVRPVADPALYLYAAV

SEQ ID NO: 1254401 - protein, 31 aa, Mycobacterium
PMTISVSFHEPVRWDGWLLYSHESTQVGAGM

SEQ ID NO: 1254402 - protein, 17 aa, Mycobacterium
PNAKLFLHYGDLSDGAR

SEQ ID NO: 1254403 - protein, 26 aa, Mycobacterium
PNAMIAGRMRIPWVPVDNARIARRHA

SEQ ID NO: 1254404 - protein, 25 aa, Mycobacterium
PNDAAAVKLLWLAICNIEDKRAAER

SEQ ID NO: 1254405 - protein, 26 aa, Mycobacterium
PNDPLRLVFVCAMWMTGFDAPSVSTI

SEQ ID NO: 1254406 - protein, 27 aa, Mycobacterium
PNFAIGAVLSMHFAQQAARFFESVEVI

SEQ ID NO: 1254407 - protein, 17 aa, Mycobacterium
PNFPGLDEFGGQVVHSA

SEQ ID NO: 1254408 - protein, 27 aa, Mycobacterium
PNGGLMSRFDGAYIPILDVSFIGPTPT

SEQ ID NO: 1254409 - protein, 18 aa, Mycobacterium
PNLSRIVARLSNPTLLCY

SEQ ID NO: 1254410 - protein, 17 aa, Mycobacterium
PNLTRVIVVLEYHPKGL

SEQ ID NO: 1254411 - protein, 26 aa, Mycobacterium
PNQTRWRIAVEKVLRGAGLRLLVPDQ

SEQ ID NO: 1254412 - protein, 20 aa, Mycobacterium
PNRRIAWTILGQIRPQIGHV

SEQ ID NO: 1254413 - protein, 17 aa, Mycobacterium
PNTELPADFGLPDCPRW

SEQ ID NO: 1254414 - protein, 25 aa, Mycobacterium
PNVFEIPGLPPIMLPWPPPPPPPPP

SEQ ID NO: 1254415 - protein, 17 aa, Mycobacterium
PPAALVLRSPFTSLADV

SEQ ID NO: 1254416 - protein, 28 aa, Mycobacterium
PPADNSLMLWFEVMKPLMSTSAERGAAH

SEQ ID NO: 1254417 - protein, 17 aa, Mycobacterium
PPAGMKFTSVAPNSEDT

SEQ ID NO: 1254418 - protein, 20 aa, Mycobacterium
PPDVGSRFTAHWKVGSVPIG

SEQ ID NO: 1254419 - protein, 26 aa, Mycobacterium
PPFGKRLLVDNGWFATLRRPNVELVA

SEQ ID NO: 1254420 - protein, 25 aa, Mycobacterium
PPFLPPELAPLIAFTTTSLSGVLLG

SEQ ID NO: 1254421 - protein, 17 aa, Mycobacterium
PPGPRHLLAVITGPSPN

SEQ ID NO: 1254422 - protein, 19 aa, Mycobacterium
PPGRLRPHRTEQLGRLTRL

SEQ ID NO: 1254423 - protein, 17 aa, Mycobacterium
PPGTRGPLYAVLGSPGG

SEQ ID NO: 1254424 - protein, 23 aa, Mycobacterium
PPGTVPDRGRAVFFVVEPDRAGL

SEQ ID NO: 1254425 - protein, 19 aa, Mycobacterium
PPHSYSYRIVRSVPAFDHE

SEQ ID NO: 1254426 - protein, 21 aa, Mycobacterium
PPMPRLADAFMDIIDTGWDAE

SEQ ID NO: 1254427 - protein, 20 aa, Mycobacterium
PPNAVAVIGMAARLPGANSV

SEQ ID NO: 1254428 - protein, 17 aa, Mycobacterium
PPNETIVLGSLTPQLKL

SEQ ID NO: 1254429 - protein, 22 aa, Mycobacterium
PPQRLRALLGKPVRNPHADLAR

SEQ ID NO: 1254430 - protein, 19 aa, Mycobacterium
PPRAARLFALADKAVGFMP

SEQ ID NO: 1254431 - protein, 18 aa, Mycobacterium
PPRRPVPLRLRDWKEVYE

SEQ ID NO: 1254432 - protein, 22 aa, Mycobacterium
PPRSSNPLVPIRDPASGSSADG

SEQ ID NO: 1254433 - protein, 17 aa, Mycobacterium
PPSQLLTQRDWIDECYA

SEQ ID NO: 1254434 - protein, 21 aa, Mycobacterium
PPTEELEHFVDLVGRIEAAAS

SEQ ID NO: 1254435 - protein, 18 aa, Mycobacterium
PPTFLLATVDKFARLARE

SEQ ID NO: 1254436 - protein, 20 aa, Mycobacterium
PPTVTVFGTPIFKLGGAPVK

SEQ ID NO: 1254437 - protein, 20 aa, Mycobacterium
PPVLAAYDFSRFRTIIDVGG

SEQ ID NO: 1254438 - protein, 17 aa, Mycobacterium
PPVSLLLQGGSLDDVTA

SEQ ID NO: 1254439 - protein, 20 aa, Mycobacterium
PPVVSVAACKSDSMYDDFDR

SEQ ID NO: 1254440 - protein, 23 aa, Mycobacterium
PQAARIWLLQALTGRRASEILML

SEQ ID NO: 1254441 - protein, 20 aa, Mycobacterium
PQAMQAFHFMNRAMRDQRIR

SEQ ID NO: 1254442 - protein, 18 aa, Mycobacterium
PQEGRWSRVVIEKPFGHD

SEQ ID NO: 1254443 - protein, 17 aa, Mycobacterium
PQHGPTCSLHPDNCVGA

SEQ ID NO: 1254444 - protein, 32 aa, Mycobacterium
PQLPRSAGPDGLRLAPHPGIGPGLALLDAPDI

SEQ ID NO: 1254445 - protein, 25 aa, Mycobacterium
PQLVPAWMIDVGWKRLCAKGSMTQD

SEQ ID NO: 1254446 - protein, 26 aa, Mycobacterium
PQNRVRRYVCLKGPDHGGCGRLTVVA

SEQ ID NO: 1254447 - protein, 18 aa, Mycobacterium
PQPQLRFLLADEPGTGKT

SEQ ID NO: 1254448 - protein, 17 aa, Mycobacterium
PQPSDLVAMLHPSSSAV

SEQ ID NO: 1254449 - protein, 24 aa, Mycobacterium
PQPTQVRITFWFDAKYPVPADAKA

SEQ ID NO: 1254450 - protein, 20 aa, Mycobacterium
PQQLPVQWASSAVYAVVNTQ

SEQ ID NO: 1254451 - protein, 17 aa, Mycobacterium
PQQRLMLETVWEGIERA

SEQ ID NO: 1254452 - protein, 19 aa, Mycobacterium
PQQVWEVLADFGAIGQWLS

SEQ ID NO: 1254453 - protein, 26 aa, Mycobacterium
PQSLVWRYFGDNRMYLIGPRPAVLQN

SEQ ID NO: 1254454 - protein, 18 aa, Mycobacterium
PQTTFGFLATGPGDNALT

SEQ ID NO: 1254455 - protein, 21 aa, Mycobacterium
PQVDVLVCGPALTYTDRSQIV

SEQ ID NO: 1254456 - protein, 25 aa, Mycobacterium
PQWLTPTAYMMAKFGMTLCALGIAE

SEQ ID NO: 1254457 - protein, 20 aa, Mycobacterium
PQWPVALAHIDCDWYDPVKL

SEQ ID NO: 1254458 - protein, 20 aa, Mycobacterium
PRAVLDPRCRVRGVDALWVV

SEQ ID NO: 1254459 - protein, 25 aa, Mycobacterium
PRAVLPRTFDFGFATGLMVKDVRLC

SEQ ID NO: 1254460 - protein, 20 aa, Mycobacterium
PRDALALALDLERTVTEQIT

SEQ ID NO: 1254461 - protein, 18 aa, Mycobacterium
PRDDRVIVELALSNDKVT

SEQ ID NO: 1254462 - protein, 24 aa, Mycobacterium
PRDFKRVLAAIAEAERTGADKNEA

SEQ ID NO: 1254463 - protein, 18 aa, Mycobacterium
PRETFAVAVESKHFEDVK

SEQ ID NO: 1254464 - protein, 21 aa, Mycobacterium
PREVFKQMGALGMLGMAIPEE

SEQ ID NO: 1254465 - protein, 20 aa, Mycobacterium
PRFHVAWGTGTGVVGPFADS

SEQ ID NO: 1254466 - protein, 17 aa, Mycobacterium
PRFSVSRVDIDRGGPTY

SEQ ID NO: 1254467 - protein, 22 aa, Mycobacterium
PRGALGNIPVRFPVSPPGDDRG

SEQ ID NO: 1254468 - protein, 19 aa, Mycobacterium
PRGKRQFRRGVFDQHTGEV

SEQ ID NO: 1254469 - protein, 27 aa, Mycobacterium
PRIFKRIRPGFRYERSLSVLTMARDYG

SEQ ID NO: 1254470 - protein, 19 aa, Mycobacterium
PRIKNLGQWRHHLIDRLRR

SEQ ID NO: 1254471 - protein, 25 aa, Mycobacterium
PRKQWPSGLTKLGLDLSGRIHDGPA

SEQ ID NO: 1254472 - protein, 17 aa, Mycobacterium
PRLHAVTSLVGVCEPDD

SEQ ID NO: 1254473 - protein, 19 aa, Mycobacterium
PRLHWCAASRVVIEENLNG

SEQ ID NO: 1254474 - protein, 20 aa, Mycobacterium
PRLLQVPMIRDGVAGSFAGT

SEQ ID NO: 1254475 - protein, 25 aa, Mycobacterium
PRLRVPGRLVHFVMTVWQKLHFRFG

SEQ ID NO: 1254476 - protein, 18 aa, Mycobacterium
PRMGQFGVVGPRCCPNCP

SEQ ID NO: 1254477 - protein, 18 aa, Mycobacterium
PRMSADELIDYLTMLSWS

SEQ ID NO: 1254478 - protein, 19 aa, Mycobacterium
PRNRGRVATMYKLTSDDTL

SEQ ID NO: 1254479 - protein, 19 aa, Mycobacterium
PRNRRKTAIGYVVSDKMEK

SEQ ID NO: 1254480 - protein, 17 aa, Mycobacterium
PRNVVVLEPGMIPKTPS

SEQ ID NO: 1254481 - protein, 19 aa, Mycobacterium
PRPAIEVSKMYVLPESHGT

SEQ ID NO: 1254482 - protein, 21 aa, Mycobacterium
PRPEVQFEIVDRCGQLWRADF

SEQ ID NO: 1254483 - protein, 17 aa, Mycobacterium
PRPGIIDALATIRIDGE

SEQ ID NO: 1254484 - protein, 21 aa, Mycobacterium
PRPRLATTAAVHDWPVLQLTR

SEQ ID NO: 1254485 - protein, 19 aa, Mycobacterium
PRPVVVLSRDVAIPRLRRV

SEQ ID NO: 1254486 - protein, 18 aa, Mycobacterium
PRQDRYPLAQAVERLREP

SEQ ID NO: 1254487 - protein, 19 aa, Mycobacterium
PRQSACPAPAFVIGAGVTN

SEQ ID NO: 1254488 - protein, 22 aa, Mycobacterium
PRRAGGEVLELGIYGERDGGEE

SEQ ID NO: 1254489 - protein, 18 aa, Mycobacterium
PRRMEAMRPAVERITNKL

SEQ ID NO: 1254490 - protein, 39 aa, Mycobacterium
PRRPSYRPAAPPARRAAGAAPQFEVMYLLGGCDADGVEV

SEQ ID NO: 1254491 - protein, 17 aa, Mycobacterium
PRRSGATPPALPTGQQA

SEQ ID NO: 1254492 - protein, 18 aa, Mycobacterium
PRSARFRSRLVGKPFDVG

SEQ ID NO: 1254493 - protein, 31 aa, Mycobacterium
PRSIAGMRVCDPPWYRPLLGVRRAATAAACT

SEQ ID NO: 1254494 - protein, 18 aa, Mycobacterium
PRSKRVLLQGWEQFDEKV

SEQ ID NO: 1254495 - protein, 17 aa, Mycobacterium
PRTDLFAKHGVPMVAHD

SEQ ID NO: 1254496 - protein, 17 aa, Mycobacterium
PRTGVHCAFTEAARRTP

SEQ ID NO: 1254497 - protein, 31 aa, Mycobacterium
PRTYLLSGLLRCGRCGNRLFSQARHNNPQNR

SEQ ID NO: 1254498 - protein, 18 aa, Mycobacterium
PRVFMLFIGGFGVYLDIC

SEQ ID NO: 1254499 - protein, 25 aa, Mycobacterium
PRVLAPSALVGRLRAVVCAPDGAVD

SEQ ID NO: 1254500 - protein, 17 aa, Mycobacterium
PRVPVEVNHEPFLTLGI

SEQ ID NO: 1254501 - protein, 18 aa, Mycobacterium
PRVRAELLPTYQQEATAI

SEQ ID NO: 1254502 - protein, 17 aa, Mycobacterium
PSADALKLLGSIAATAA

SEQ ID NO: 1254503 - protein, 19 aa, Mycobacterium
PSALRRLGLDFETLAAANP

SEQ ID NO: 1254504 - protein, 22 aa, Mycobacterium
PSAPDLGTWSGLTVDYLETVAS

SEQ ID NO: 1254505 - protein, 23 aa, Mycobacterium
PSAPQMWRWAASRSVDHRTALTV

SEQ ID NO: 1254506 - protein, 25 aa, Mycobacterium
PSATGARPPVAFAPDDTGYGAGYGE

SEQ ID NO: 1254507 - protein, 25 aa, Mycobacterium
PSDPGFRLVADRAFTDRAHARGLRV

SEQ ID NO: 1254508 - protein, 22 aa, Mycobacterium
PSDTCYLSMPLFHSNAVMAGWS

SEQ ID NO: 1254509 - protein, 26 aa, Mycobacterium
PSEPHYRPSAALQDFVRCRDLTCRFP

SEQ ID NO: 1254510 - protein, 19 aa, Mycobacterium
PSFDCDRVRMRARCRQLAT

SEQ ID NO: 1254511 - protein, 18 aa, Mycobacterium
PSGAVALAGYRRVAPTGR

SEQ ID NO: 1254512 - protein, 22 aa, Mycobacterium
PSGNWFPFAASDAIRRKPVGAS

SEQ ID NO: 1254513 - protein, 26 aa, Mycobacterium
PSHWPWTEHWLTLWRNTIGYSPPATA

SEQ ID NO: 1254514 - protein, 24 aa, Mycobacterium
PSIYDPPMRTMIAFGGKYPTTVIP

SEQ ID NO: 1254515 - protein, 18 aa, Mycobacterium
PSLRLIADTIEFCAAEVP

SEQ ID NO: 1254516 - protein, 18 aa, Mycobacterium
PSPSGRHTLGLAINANGP

SEQ ID NO: 1254517 - protein, 19 aa, Mycobacterium
PSQCGRFDAPPALPTAESD

SEQ ID NO: 1254518 - protein, 23 aa, Mycobacterium
PSRAPGLHGHTDFDIAVPTPDHF

SEQ ID NO: 1254519 - protein, 26 aa, Mycobacterium
PSRHLVKFVACDGALWAVKELPPRIA

SEQ ID NO: 1254520 - protein, 24 aa, Mycobacterium
PSTDFPNAWIRAGRRRSREAQAAT

SEQ ID NO: 1254521 - protein, 26 aa, Mycobacterium
PSTWGETPFTIGLWVGTAVSPKRFED

SEQ ID NO: 1254522 - protein, 19 aa, Mycobacterium
PSVGHPWRFLDAVPSDGAV

SEQ ID NO: 1254523 - protein, 19 aa, Mycobacterium
PSVPLRGFTSLGLTEEEAW

SEQ ID NO: 1254524 - protein, 25 aa, Mycobacterium
PSYPHPRLMPDFWEFPTVSMGLGPM

SEQ ID NO: 1254525 - protein, 17 aa, Mycobacterium
PTATLRLVCFLRDRDGH

SEQ ID NO: 1254526 - protein, 19 aa, Mycobacterium
PTAWCAEGLLIYLPPEAQD

SEQ ID NO: 1254527 - protein, 17 aa, Mycobacterium
PTDVAWPYLERAALASE

SEQ ID NO: 1254528 - protein, 26 aa, Mycobacterium
PTEGLRVIAVRSRLMSRLAGQGAVAL

SEQ ID NO: 1254529 - protein, 23 aa, Mycobacterium
PTETEVWRWYLVDKNAPDDVRDW

SEQ ID NO: 1254530 - protein, 19 aa, Mycobacterium
PTFEEWWEPYTFGVGPAGD

SEQ ID NO: 1254531 - protein, 24 aa, Mycobacterium
PTGEPLPMLLLVTAFMHSLYDGVV

SEQ ID NO: 1254532 - protein, 22 aa, Mycobacterium
PTGFHPAAWRVPGAFSNGNSNP

SEQ ID NO: 1254533 - protein, 20 aa, Mycobacterium
PTGPHVARWTARDFEAYGTT

SEQ ID NO: 1254534 - protein, 18 aa, Mycobacterium
PTGSRWELDPTLLESAEV

SEQ ID NO: 1254535 - protein, 21 aa, Mycobacterium
PTHGFGSFCSATPASGDASTI

SEQ ID NO: 1254536 - protein, 29 aa, Mycobacterium
PTIGAPRWDTAIIGLDWETTVLDERLAAR

SEQ ID NO: 1254537 - protein, 20 aa, Mycobacterium
PTLDRAVYWLTTGYEAAKGS

SEQ ID NO: 1254538 - protein, 24 aa, Mycobacterium
PTLLEWQVRPGGWVQVFSDADRAG

SEQ ID NO: 1254539 - protein, 23 aa, Mycobacterium
PTLPAEAPVPMPDPSNRQTDPAA

SEQ ID NO: 1254540 - protein, 27 aa, Mycobacterium
PTLPQWLRRRLALLLDLCYGAGARPPD

SEQ ID NO: 1254541 - protein, 17 aa, Mycobacterium
PTPDGWTTMGEVEVGDE

SEQ ID NO: 1254542 - protein, 25 aa, Mycobacterium
PTPWRTEALVLLAFSAYARGDGPLA

SEQ ID NO: 1254543 - protein, 19 aa, Mycobacterium
PTRHARAYVLDAWLRPVPD

SEQ ID NO: 1254544 - protein, 20 aa, Mycobacterium
PTRRGNWWYYGRSFEGKQYG

SEQ ID NO: 1254545 - protein, 18 aa, Mycobacterium
PTRSELGDLCEVTPAIGA

SEQ ID NO: 1254546 - protein, 18 aa, Mycobacterium
PTVEHTIEILKGLRDRYE

SEQ ID NO: 1254547 - protein, 19 aa, Mycobacterium
PTVLQDGWGVRTPTRAAIE

SEQ ID NO: 1254548 - protein, 29 aa, Mycobacterium
PVAEAWDAVYWMMARTLIELERHLYAEAG

SEQ ID NO: 1254549 - protein, 27 aa, Mycobacterium
PVALTEWLGYAWVCLADVPPSFEETVV

SEQ ID NO: 1254550 - protein, 17 aa, Mycobacterium
PVARLLRDAQVNTIWEG

SEQ ID NO: 1254551 - protein, 20 aa, Mycobacterium
PVHFVCGLIGGVANTTAPET

SEQ ID NO: 1254552 - protein, 24 aa, Mycobacterium
PVIDLKSDFLAGGEPFSRTVDSSD

SEQ ID NO: 1254553 - protein, 17 aa, Mycobacterium
PVITRAATELGHTPAQI

SEQ ID NO: 1254554 - protein, 26 aa, Mycobacterium
PVKRCDRLDIDGCDAIVALAPVLTEY

SEQ ID NO: 1254555 - protein, 18 aa, Mycobacterium
PVLDRAVCAITHGGMGVT

SEQ ID NO: 1254556 - protein, 25 aa, Mycobacterium
PVLMPLDHVVAWAEAPGTLVDHRPE

SEQ ID NO: 1254557 - protein, 18 aa, Mycobacterium
PVLPEAPPAQPTAEFNGL

SEQ ID NO: 1254558 - protein, 18 aa, Mycobacterium
PVMGDSGLPVLGHMIETF

SEQ ID NO: 1254559 - protein, 33 aa, Mycobacterium
PVPVPSAVVGPVWAVGEWAHWRVLKQAEDEQRR

SEQ ID NO: 1254560 - protein, 20 aa, Mycobacterium
PVQWRVVDWAGYEAALTLLR

SEQ ID NO: 1254561 - protein, 21 aa, Mycobacterium
PVRELMGYSWSRRDEWLHRLF

SEQ ID NO: 1254562 - protein, 24 aa, Mycobacterium
PVRQIFFRLGEVILEVVGSPETAR

SEQ ID NO: 1254563 - protein, 18 aa, Mycobacterium
PVRRECLAAALERQEPWG

SEQ ID NO: 1254564 - protein, 25 aa, Mycobacterium
PVRRWEDIPGWFGWRQAQEEAVAHF

SEQ ID NO: 1254565 - protein, 26 aa, Mycobacterium
PVRVRDGCGLIGPLVFPGRTSCLSCA

SEQ ID NO: 1254566 - protein, 20 aa, Mycobacterium
PVRYHSLLVAAWRGEPAEAM

SEQ ID NO: 1254567 - protein, 17 aa, Mycobacterium
PVSLDAPLLTAQNDGDT

SEQ ID NO: 1254568 - protein, 18 aa, Mycobacterium
PVTRTVLCKSVDDTGITF

SEQ ID NO: 1254569 - protein, 18 aa, Mycobacterium
PVTSWWYGQGRAVDVVRR

SEQ ID NO: 1254570 - protein, 29 aa, Mycobacterium
PVVCSVQGWAVGLGCNLALAADFTVAGTD

SEQ ID NO: 1254571 - protein, 19 aa, Mycobacterium
PVVEAAAVIGRRFDRDLLR

SEQ ID NO: 1254572 - protein, 19 aa, Mycobacterium
PVVHSCQLLDAGRDVRRIE

SEQ ID NO: 1254573 - protein, 31 aa, Mycobacterium
PVVRENLRTGAPIRLSAAVVASWSRYAEGVD

SEQ ID NO: 1254574 - protein, 20 aa, Mycobacterium
PVVRGEACADSFYAAFEAAV

SEQ ID NO: 1254575 - protein, 24 aa, Mycobacterium
PWHREFPGRLAGSVYAAPPAARAS

SEQ ID NO: 1254576 - protein, 24 aa, Mycobacterium
PWVAERLVEFGDFLAGQPDSIHPV

SEQ ID NO: 1254577 - protein, 20 aa, Mycobacterium
PYGPSVPALYGLIAQAWMHE

SEQ ID NO: 1254578 - protein, 19 aa, Mycobacterium
PYLDTVLFILGVTRGEIEA

SEQ ID NO: 1254579 - protein, 18 aa, Mycobacterium
PYMAQILIKAEPRPSWGN

SEQ ID NO: 1254580 - protein, 19 aa, Mycobacterium
PYRDYIGWLAGRDQAASRA

SEQ ID NO: 1254581 - protein, 24 aa, Mycobacterium
PYTSAHCCRMPIGATWAATPPAKC

SEQ ID NO: 1254582 - protein, 24 aa, Mycobacterium
QAADAAGFDAVWASEFYSRSGSIS

SEQ ID NO: 1254583 - protein, 19 aa, Mycobacterium
QAAHLMVNYDLPWNPNRIE

SEQ ID NO: 1254584 - protein, 25 aa, Mycobacterium
QAAPRKLVDWMMKFQFANDCDYFTI

SEQ ID NO: 1254585 - protein, 18 aa, Mycobacterium
QAARRLHAQLSWASAVVI

SEQ ID NO: 1254586 - protein, 23 aa, Mycobacterium
QADDVWLPLFRPVAGDPGELPAD

SEQ ID NO: 1254587 - protein, 23 aa, Mycobacterium
QAEVAEFSRSLKLMAKELDVPVV

SEQ ID NO: 1254588 - protein, 24 aa, Mycobacterium
QAGEIYFEGGYDFEYLNDPEKTAS

SEQ ID NO: 1254589 - protein, 17 aa, Mycobacterium
QAGNIVAECRRRGFLPP

SEQ ID NO: 1254590 - protein, 21 aa, Mycobacterium
QAHLALGFKTPQAYLQDVFRI

SEQ ID NO: 1254591 - protein, 24 aa, Mycobacterium
QAIARSETLLAMIDQHEHTNLAGP

SEQ ID NO: 1254592 - protein, 22 aa, Mycobacterium
QAPKGIFPWYAPGVDGQLGEFP

SEQ ID NO: 1254593 - protein, 20 aa, Mycobacterium
QAQAGGMALNGADLMGSKLL

SEQ ID NO: 1254594 - protein, 24 aa, Mycobacterium
QARVSRPTLYRWFPSKQDLLSAFV

SEQ ID NO: 1254595 - protein, 24 aa, Mycobacterium
QASAAELARLCFVTRQSLQDVSTA

SEQ ID NO: 1254596 - protein, 20 aa, Mycobacterium
QATIPSYVRYGANPYVVVIR

SEQ ID NO: 1254597 - protein, 24 aa, Mycobacterium
QAVHVLDMLRYLVGEVAEVSAYAN

SEQ ID NO: 1254598 - protein, 25 aa, Mycobacterium
QAVQRIVDHWAMFDTVRFGLNLVVA

SEQ ID NO: 1254599 - protein, 20 aa, Mycobacterium
QCARAAGAARIFVTEPSGVR

SEQ ID NO: 1254600 - protein, 17 aa, Mycobacterium
QCMDLVFTIGGYQLLAV

SEQ ID NO: 1254601 - protein, 37 aa, Mycobacterium
QCQYRRPPKRWVLKGFHGFRLTEFFAGYPDASLIWLH

SEQ ID NO: 1254602 - protein, 20 aa, Mycobacterium
QDAWLRWDALGEDWSGIADL

SEQ ID NO: 1254603 - protein, 23 aa, Mycobacterium
QDCRKLAADRGWQVGDEYVDNDV

SEQ ID NO: 1254604 - protein, 24 aa, Mycobacterium
QDDLPLPVARRIIGPSPLIGRSTH

SEQ ID NO: 1254605 - protein, 23 aa, Mycobacterium
QDEDSLRLNVWAPSGSAAGDGKP

SEQ ID NO: 1254606 - protein, 26 aa, Mycobacterium
QDGPGWWAAREAIEWTASAQRQPGLA

SEQ ID NO: 1254607 - protein, 24 aa, Mycobacterium
QDILPPEVFEKLTPEYVAPVVAHL

SEQ ID NO: 1254608 - protein, 22 aa, Mycobacterium
QDQEWRKNTLFRSATTDLSNGM

SEQ ID NO: 1254609 - protein, 20 aa, Mycobacterium
QDWVRPHLEELLGDEVGGAL

SEQ ID NO: 1254610 - protein, 29 aa, Mycobacterium
QEAKAPGWGCGRALALRNNIIIDVNTCSP

SEQ ID NO: 1254611 - protein, 30 aa, Mycobacterium
QEIQSAAAWAIIDCDLPAPAEGAGPIPDLG

SEQ ID NO: 1254612 - protein, 17 aa, Mycobacterium
QELTGLAGLDGMPHFMR

SEQ ID NO: 1254613 - protein, 21 aa, Mycobacterium
QELVTRLIVDAGILITNVAGR

SEQ ID NO: 1254614 - protein, 17 aa, Mycobacterium
QELWGYSAPGEIVHHPY

SEQ ID NO: 1254615 - protein, 25 aa, Mycobacterium
QEMLRLVEAFGYGWSDLARFTINAM

SEQ ID NO: 1254616 - protein, 20 aa, Mycobacterium
QERCGKCGGDGMYHAPSGFV

SEQ ID NO: 1254617 - protein, 17 aa, Mycobacterium
QERLRLTAGDRGQRLQH

SEQ ID NO: 1254618 - protein, 26 aa, Mycobacterium
QERYREGPCLTAAWEERTVHVPDLER

SEQ ID NO: 1254619 - protein, 21 aa, Mycobacterium
QEVDAFFARREYLHHISDTDL

SEQ ID NO: 1254620 - protein, 22 aa, Mycobacterium
QFAEFLSGVKLNAPRIPLLSNV

SEQ ID NO: 1254621 - protein, 25 aa, Mycobacterium
QFELHARAILGLAVDTIMISPGAAE

SEQ ID NO: 1254622 - protein, 26 aa, Mycobacterium
QFLSLPWFYRSGYDVLLYTLPFHGRR

SEQ ID NO: 1254623 - protein, 19 aa, Mycobacterium
QFLYREARYLDDREFEKWL

SEQ ID NO: 1254624 - protein, 19 aa, Mycobacterium
QFQDLDGSVIFGYSQGTQV

SEQ ID NO: 1254625 - protein, 23 aa, Mycobacterium
QFVELYGREALFLGAGVEIVSLR

SEQ ID NO: 1254626 - protein, 25 aa, Mycobacterium
QFYHPLDMFGEWNRAYGSNGFLQYQ

SEQ ID NO: 1254627 - protein, 17 aa, Mycobacterium
QGAKGGGSKPGLTAPAP

SEQ ID NO: 1254628 - protein, 18 aa, Mycobacterium
QGALAITGIPAFKAPFEP

SEQ ID NO: 1254629 - protein, 25 aa, Mycobacterium
QGASSEAARAWWGNFLVQKANESGV

SEQ ID NO: 1254630 - protein, 26 aa, Mycobacterium
QGIPNFSLLVSHVLVPPAISAIMESP

SEQ ID NO: 1254631 - protein, 17 aa, Mycobacterium
QGLPYAREAALAKRLGT

SEQ ID NO: 1254632 - protein, 17 aa, Mycobacterium
QGMCTAGAFYFLNEADV

SEQ ID NO: 1254633 - protein, 21 aa, Mycobacterium
QGNRRLTCFRSMGGGPTPGPV

SEQ ID NO: 1254634 - protein, 20 aa, Mycobacterium
QGRLSEVAMSHHLRDAEQMA

SEQ ID NO: 1254635 - protein, 19 aa, Mycobacterium
QGRYGRILIRGEYGHDIVD

SEQ ID NO: 1254636 - protein, 18 aa, Mycobacterium
QGWSPHWLRHTHATALLL

SEQ ID NO: 1254637 - protein, 21 aa, Mycobacterium
QGYLETLSWCRVAGGSAQAHV

SEQ ID NO: 1254638 - protein, 17 aa, Mycobacterium
QHAHFGALLARTDPDAR

SEQ ID NO: 1254639 - protein, 27 aa, Mycobacterium
QHDGRWGRATLEVCFAILQSAHEAREV

SEQ ID NO: 1254640 - protein, 25 aa, Mycobacterium
QHSGGRWADKEWLRKHNVDRISRWQ

SEQ ID NO: 1254641 - protein, 17 aa, Mycobacterium
QHVLPEEVNGYFAEMGR

SEQ ID NO: 1254642 - protein, 25 aa, Mycobacterium
QHVPCAGLVIGAWPAQPGAAEIDNR

SEQ ID NO: 1254643 - protein, 24 aa, Mycobacterium
QIDGLRAGQWVDVYDLAVGITLDV

SEQ ID NO: 1254644 - protein, 25 aa, Mycobacterium
QIEKRFGADFDRPVARMTEMIGALR

SEQ ID NO: 1254645 - protein, 26 aa, Mycobacterium
QIMGRKVVRMFPIPPIALGLRTGIAI

SEQ ID NO: 1254646 - protein, 18 aa, Mycobacterium
QIRDAVLMRLAAGVIDTV

SEQ ID NO: 1254647 - protein, 20 aa, Mycobacterium
QITDMFLAPTMIQMFVDSPA

SEQ ID NO: 1254648 - protein, 23 aa, Mycobacterium
QIVYRAGVRRVPRLHRHGNTAGS

SEQ ID NO: 1254649 - protein, 27 aa, Mycobacterium
QKVRRLRRLAGLWLAGRDERWAAVRID

SEQ ID NO: 1254650 - protein, 22 aa, Mycobacterium
QLAELRPGTPYLVSATASGLAR

SEQ ID NO: 1254651 - protein, 18 aa, Mycobacterium
QLAEMRSGLYSYADDPGF

SEQ ID NO: 1254652 - protein, 22 aa, Mycobacterium
QLAHAAWLWSGRKAVVAGLAAS

SEQ ID NO: 1254653 - protein, 30 aa, Mycobacterium
QLARTGLGHFDAWAAQFVRYKVLIETSPDG

SEQ ID NO: 1254654 - protein, 20 aa, Mycobacterium
QLDEEYARWIAGVRTLDAEA

SEQ ID NO: 1254655 - protein, 18 aa, Mycobacterium
QLEFKRVQFTPDLMPGDV

SEQ ID NO: 1254656 - protein, 27 aa, Mycobacterium
QLFPTADGYLALFITHDGFWRLFASEA

SEQ ID NO: 1254657 - protein, 19 aa, Mycobacterium
QLHKMKHQTFTASDETETV

SEQ ID NO: 1254658 - protein, 22 aa, Mycobacterium
QLKRGDTVLMAAFAHAGDFAGA

SEQ ID NO: 1254659 - protein, 17 aa, Mycobacterium
QLLDVWRPKELPTEPAP

SEQ ID NO: 1254660 - protein, 18 aa, Mycobacterium
QLPGAVEYSVRFAKPVVL

SEQ ID NO: 1254661 - protein, 23 aa, Mycobacterium
QLPKICLELGRGIRGTIGHTQPR

SEQ ID NO: 1254662 - protein, 24 aa, Mycobacterium
QLQPLRPAILYGIDTRATAEIHSL

SEQ ID NO: 1254663 - protein, 26 aa, Mycobacterium
QLTELQTAFMLSPWAARTPIDVEVPF

SEQ ID NO: 1254664 - protein, 23 aa, Mycobacterium
QLTLDRRGAWLLSNVEHYSRDPF

SEQ ID NO: 1254665 - protein, 22 aa, Mycobacterium
QLTRTAALEGIDHGIRVNAIGV

SEQ ID NO: 1254666 - protein, 28 aa, Mycobacterium
QLVLFPEATMCRFGVPLAPVAEPLDGPW

SEQ ID NO: 1254667 - protein, 20 aa, Mycobacterium
QLVRLAGGLDLWLDEEALVF

SEQ ID NO: 1254668 - protein, 24 aa, Mycobacterium
QLYLKDIPFAWSLAHSLGLDDDRT

SEQ ID NO: 1254669 - protein, 24 aa, Mycobacterium
QMPEMPLIKFIDGWETVAEMEAAL

SEQ ID NO: 1254670 - protein, 18 aa, Mycobacterium
QMPQWQYATKRSRINQRR

SEQ ID NO: 1254671 - protein, 19 aa, Mycobacterium
QMRRFGGLVSVELADASAV

SEQ ID NO: 1254672 - protein, 17 aa, Mycobacterium
QMVKDYLIFPALSRSRW

SEQ ID NO: 1254673 - protein, 18 aa, Mycobacterium
QNLAKLGPEFDAIKNEQK

SEQ ID NO: 1254674 - protein, 22 aa, Mycobacterium
QNLRLYEEWCNLADLRQGDRYL

SEQ ID NO: 1254675 - protein, 17 aa, Mycobacterium
QNMFGVWPVDGVVTDEL

SEQ ID NO: 1254676 - protein, 21 aa, Mycobacterium
QNPRLLPWRRALANVTFALAD

SEQ ID NO: 1254677 - protein, 22 aa, Mycobacterium
QNVDLIVLATEWDEYRNLDPVA

SEQ ID NO: 1254678 - protein, 26 aa, Mycobacterium
QPCDVRRGSAVSLPFRDRSISAVVTD

SEQ ID NO: 1254679 - protein, 17 aa, Mycobacterium
QPGCLHAAMDLYKWSYK

SEQ ID NO: 1254680 - protein, 17 aa, Mycobacterium
QPHCTYMTATIADGALG

SEQ ID NO: 1254681 - protein, 24 aa, Mycobacterium
QPRLGELLTGMLCEMSDRGSDSAG

SEQ ID NO: 1254682 - protein, 28 aa, Mycobacterium
QPSPGVPCLEMVQQFAASPPDFEESFAT

SEQ ID NO: 1254683 - protein, 18 aa, Mycobacterium
QPYLGAFGHLVALRDGDL

SEQ ID NO: 1254684 - protein, 21 aa, Mycobacterium
QQAALRWVRDNIAGFGGDPDK

SEQ ID NO: 1254685 - protein, 17 aa, Mycobacterium
QQAGFRLTRVVPTVAPI

SEQ ID NO: 1254686 - protein, 24 aa, Mycobacterium
QQHAELAVAGWLADRGFPVVPPSP

SEQ ID NO: 1254687 - protein, 17 aa, Mycobacterium
QQLRMKKMVDADLDVRM

SEQ ID NO: 1254688 - protein, 25 aa, Mycobacterium
QQMPAAQFMAVFGLYAQRIDQVLDR

SEQ ID NO: 1254689 - protein, 21 aa, Mycobacterium
QQPRYAVIDGAHRFEGARLRD

SEQ ID NO: 1254690 - protein, 24 aa, Mycobacterium
QQRRFLSSEGWIAWSGPAISELLK

SEQ ID NO: 1254691 - protein, 25 aa, Mycobacterium
QQVGPRVAQRFGRALLELGGNNAAI

SEQ ID NO: 1254692 - protein, 20 aa, Mycobacterium
QQVLALPVWDAFRRAHRLNF

SEQ ID NO: 1254693 - protein, 17 aa, Mycobacterium
QRAAIADWVYWQHVSVM

SEQ ID NO: 1254694 - protein, 21 aa, Mycobacterium
QRADDLTAWLGGTRVSPRFPS

SEQ ID NO: 1254695 - protein, 19 aa, Mycobacterium
QRATALVCAAELIRQEDPS

SEQ ID NO: 1254696 - protein, 18 aa, Mycobacterium
QRFDIPVRLAYGATEFAG

SEQ ID NO: 1254697 - protein, 17 aa, Mycobacterium
QRFYAKHGFAVTGTKTF

SEQ ID NO: 1254698 - protein, 22 aa, Mycobacterium
QRGCGQGPCLDAATEHLRADDL

SEQ ID NO: 1254699 - protein, 19 aa, Mycobacterium
QRIADILRRLMGRRTDVDF

SEQ ID NO: 1254700 - protein, 17 aa, Mycobacterium
QRKGTAMTGYQTGGETL

SEQ ID NO: 1254701 - protein, 21 aa, Mycobacterium
QRLQQIWCECLGVASIDPAEN

SEQ ID NO: 1254702 - protein, 17 aa, Mycobacterium
QRLSLRPETVKSYLRSA

SEQ ID NO: 1254703 - protein, 20 aa, Mycobacterium
QRLTAWVGLANIRSFRIRFT

SEQ ID NO: 1254704 - protein, 21 aa, Mycobacterium
QRPRSYTTYRAMLDKLDKCHT

SEQ ID NO: 1254705 - protein, 18 aa, Mycobacterium
QRQYVEIWVEVLRAVDPS

SEQ ID NO: 1254706 - protein, 19 aa, Mycobacterium
QRRPILHLPSHWPWTEHWL

SEQ ID NO: 1254707 - protein, 17 aa, Mycobacterium
QRRVAIEDIEIAGETIR

SEQ ID NO: 1254708 - protein, 29 aa, Mycobacterium
QRSADKFVPEWIWQSPAAVKRVFLQALFE

SEQ ID NO: 1254709 - protein, 19 aa, Mycobacterium
QRVAFVLHDGFAVSFTEIA

SEQ ID NO: 1254710 - protein, 24 aa, Mycobacterium
QRVPEAVGVLAARRFDDDTPIDRT

SEQ ID NO: 1254711 - protein, 17 aa, Mycobacterium
QRVRFLDALPDWPAVGL

SEQ ID NO: 1254712 - protein, 20 aa, Mycobacterium
QRVTSMYGVIRGTPPPFFEG

SEQ ID NO: 1254713 - protein, 23 aa, Mycobacterium
QRWPDGTPLLFPRPTKNLNGQLP

SEQ ID NO: 1254714 - protein, 19 aa, Mycobacterium
QSAHARFIEASAKINQLLD

SEQ ID NO: 1254715 - protein, 18 aa, Mycobacterium
QSDEVATFVVFLASDESR

SEQ ID NO: 1254716 - protein, 36 aa, Mycobacterium
QSGARPIWLTPQWDADFGVAHGLPVDRVEAALTAET

SEQ ID NO: 1254717 - protein, 21 aa, Mycobacterium
QSGFDAFGIMVVELENDSSPM

SEQ ID NO: 1254718 - protein, 23 aa, Mycobacterium
QSGVPAVCPAGTWNTSLFSRIAP

SEQ ID NO: 1254719 - protein, 25 aa, Mycobacterium
QSPRETWLRLLLIDAGFPRPTTQIP

SEQ ID NO: 1254720 - protein, 22 aa, Mycobacterium
QSRPGPPPAPPRPQPTNWGQPP

SEQ ID NO: 1254721 - protein, 27 aa, Mycobacterium
QTAGAELGRLGWWDGPRPHCAHEAPAP

SEQ ID NO: 1254722 - protein, 22 aa, Mycobacterium
QTAHRLVRCATAIRTADDVFHF

SEQ ID NO: 1254723 - protein, 22 aa, Mycobacterium
QTARALVKLAYAIRNLDGSPLR

SEQ ID NO: 1254724 - protein, 18 aa, Mycobacterium
QTATKHLFVTGGVVSSLG

SEQ ID NO: 1254725 - protein, 17 aa, Mycobacterium
QTFATLVGLELRPRKMR

SEQ ID NO: 1254726 - protein, 18 aa, Mycobacterium
QTFATLVGLELRPRKMRE

SEQ ID NO: 1254727 - protein, 17 aa, Mycobacterium
QTKSAVVSYTLGSESKT

SEQ ID NO: 1254728 - protein, 20 aa, Mycobacterium
QTLRAARWSGYIRSDVDLPV

SEQ ID NO: 1254729 - protein, 19 aa, Mycobacterium
QTMSQWLTVAAKEYAKTDE

SEQ ID NO: 1254730 - protein, 17 aa, Mycobacterium
QTPKAATFCLSQRAEHI

SEQ ID NO: 1254731 - protein, 29 aa, Mycobacterium
QTSFPLALECCRNALGLLGEGRWAAHLPL

SEQ ID NO: 1254732 - protein, 21 aa, Mycobacterium
QTSGCLAEWYLPDLTEELIDA

SEQ ID NO: 1254733 - protein, 18 aa, Mycobacterium
QVAFVIPVPHRFLPMMPP

SEQ ID NO: 1254734 - protein, 19 aa, Mycobacterium
QVEGFSVSPAARVEILDRL

SEQ ID NO: 1254735 - protein, 25 aa, Mycobacterium
QVGVSRRTGWSWWRHARGMKLRKGG

SEQ ID NO: 1254736 - protein, 21 aa, Mycobacterium
QVHRFLKLLGGYTYSRHSYSL

SEQ ID NO: 1254737 - protein, 23 aa, Mycobacterium
QVLDRFDPAVLHRAASTVIDRDA

SEQ ID NO: 1254738 - protein, 26 aa, Mycobacterium
QVLIKAEAIGVNFIDTYFRSGLYPRE

SEQ ID NO: 1254739 - protein, 18 aa, Mycobacterium
QVLLPLWNAYTFLALYAP

SEQ ID NO: 1254740 - protein, 19 aa, Mycobacterium
QVPLSRRGTLWSYTENRYA

SEQ ID NO: 1254741 - protein, 26 aa, Mycobacterium
QVSLLRARLGAVFAGGPKALPPMTEG

SEQ ID NO: 1254742 - protein, 17 aa, Mycobacterium
QVVRIAREFARNAEESG

SEQ ID NO: 1254743 - protein, 23 aa, Mycobacterium
QVYPRRVHRVAAARRAHELEAAG

SEQ ID NO: 1254744 - protein, 18 aa, Mycobacterium
QWLRGRIDYGGMRRNYFR

SEQ ID NO: 1254745 - protein, 26 aa, Mycobacterium
QWRRTFAVNIDSFFRVTKAALEHLPD

SEQ ID NO: 1254746 - protein, 18 aa, Mycobacterium
QYGRGRHPAALSFGDTMA

SEQ ID NO: 1254747 - protein, 25 aa, Mycobacterium
QYLAQWRMALAKEMLRTEDVSIAEV

SEQ ID NO: 1254748 - protein, 21 aa, Mycobacterium
QYRIGHSFFTPGHDTKVDDPS

SEQ ID NO: 1254749 - protein, 18 aa, Mycobacterium
QYRLGLPHAGTWREVLNT

SEQ ID NO: 1254750 - protein, 22 aa, Mycobacterium
QYVEEFAELRLDGITAGSTVLK

SEQ ID NO: 1254751 - protein, 18 aa, Mycobacterium
RAAAAWSGGYFAKSVVPV

SEQ ID NO: 1254752 - protein, 17 aa, Mycobacterium
RAAAEQCALTWPRPPVL

SEQ ID NO: 1254753 - protein, 21 aa, Mycobacterium
RAAAGALPFVPRGESLPERTL

SEQ ID NO: 1254754 - protein, 19 aa, Mycobacterium
RAACQADPALAKGLSTHAG

SEQ ID NO: 1254755 - protein, 17 aa, Mycobacterium
RAADPGAAVAAAFAAVV

SEQ ID NO: 1254756 - protein, 19 aa, Mycobacterium
RAAENEVGVLLARPRGPVD

SEQ ID NO: 1254757 - protein, 25 aa, Mycobacterium
RAAESTGRKCLVAMDLAGPKLRTGP

SEQ ID NO: 1254758 - protein, 26 aa, Mycobacterium
RAAFERRWELGGVLFSKTFRDQMIDP

SEQ ID NO: 1254759 - protein, 19 aa, Mycobacterium
RAAGLPAEPRFRPVPPPTP

SEQ ID NO: 1254760 - protein, 24 aa, Mycobacterium
RAALLDRFGMFGVRISIAVLRAGV

SEQ ID NO: 1254761 - protein, 20 aa, Mycobacterium
RAAMIAAVLDKHARLQVGPC

SEQ ID NO: 1254762 - protein, 19 aa, Mycobacterium
RAAMSPRHFTRVFSTEVGE

SEQ ID NO: 1254763 - protein, 20 aa, Mycobacterium
RAANLPVMLIGDGWNPLIPD

SEQ ID NO: 1254764 - protein, 17 aa, Mycobacterium
RAARKIDLAACLVMAHS

SEQ ID NO: 1254765 - protein, 26 aa, Mycobacterium
RAAVERQGLPYGWALTSSGRLSGVTE

SEQ ID NO: 1254766 - protein, 24 aa, Mycobacterium
RADLKAGRLTFRLAGVPTGGRGQT

SEQ ID NO: 1254767 - protein, 20 aa, Mycobacterium
RADLLLGEACDKLRDAGHDE

SEQ ID NO: 1254768 - protein, 22 aa, Mycobacterium
RADVFAGIAAGQVWVLDSRQQK

SEQ ID NO: 1254769 - protein, 18 aa, Mycobacterium
RADVPAILTFGGGAHYCL

SEQ ID NO: 1254770 - protein, 23 aa, Mycobacterium
RAEAIRLGDYCLGLYGSRDYLAE

SEQ ID NO: 1254771 - protein, 18 aa, Mycobacterium
RAEATAFGVIDADESGRI

SEQ ID NO: 1254772 - protein, 23 aa, Mycobacterium
RAEGLPLPGAREVTVMFADLVGF

SEQ ID NO: 1254773 - protein, 24 aa, Mycobacterium
RAEGVDCYKLFISGLLDITDNVDK

SEQ ID NO: 1254774 - protein, 25 aa, Mycobacterium
RAEVAAYLGDRGWRTDSITATALLE

SEQ ID NO: 1254775 - protein, 24 aa, Mycobacterium
RAGDARRPVHFEITRLRDGGVLSS

SEQ ID NO: 1254776 - protein, 27 aa, Mycobacterium
RAGELRRLKTCAAPDCEAVLVDLSRNR

SEQ ID NO: 1254777 - protein, 23 aa, Mycobacterium
RAGGDVLQCLRFDAPQMTATVSV

SEQ ID NO: 1254778 - protein, 28 aa, Mycobacterium
RAGGHAFLVDCGRGVQLRMAAAGIAANG

SEQ ID NO: 1254779 - protein, 19 aa, Mycobacterium
RAGGMKTLFGDVYAPSTIG

SEQ ID NO: 1254780 - protein, 18 aa, Mycobacterium
RAGIALAREVERRAPNAV

SEQ ID NO: 1254781 - protein, 18 aa, Mycobacterium
RAGKHRPVHLLGFGEGHT

SEQ ID NO: 1254782 - protein, 17 aa, Mycobacterium
RAGQLVICPGAWAPQLL

SEQ ID NO: 1254783 - protein, 29 aa, Mycobacterium
RAIATTLAARGWRIIVTDVNLTGAQETVA

SEQ ID NO: 1254784 - protein, 24 aa, Mycobacterium
RAIDELLRLFTLWQQDPSVSFERG

SEQ ID NO: 1254785 - protein, 23 aa, Mycobacterium
RAKDLKQRPAIIEAAAQAAGADQ

SEQ ID NO: 1254786 - protein, 22 aa, Mycobacterium
RAKGYEPMNFFAPLSRLKELDA

SEQ ID NO: 1254787 - protein, 18 aa, Mycobacterium
RAKHLCERLLSFSSPLHL

SEQ ID NO: 1254788 - protein, 21 aa, Mycobacterium
RALEPCRICGTPVNTAVLEGR

SEQ ID NO: 1254789 - protein, 26 aa, Mycobacterium
RALFRRRDDLWDRLIEACRPGMTTSG

SEQ ID NO: 1254790 - protein, 18 aa, Mycobacterium
RALITLCIGGGMGVATII

SEQ ID NO: 1254791 - protein, 17 aa, Mycobacterium
RALLPGAIEEILRYEPP

SEQ ID NO: 1254792 - protein, 20 aa, Mycobacterium
RALNIPGEHLPGSVAAVDFV

SEQ ID NO: 1254793 - protein, 18 aa, Mycobacterium
RALSGLPGVENAAIWEPE

SEQ ID NO: 1254794 - protein, 17 aa, Mycobacterium
RALTVQFGQRFAPLPEG

SEQ ID NO: 1254795 - protein, 17 aa, Mycobacterium
RALVTGGSRGIGAEIVR

SEQ ID NO: 1254796 - protein, 17 aa, Mycobacterium
RANLPHDTCSERVATLA

SEQ ID NO: 1254797 - protein, 18 aa, Mycobacterium
RANPRPGIIDALATIRID

SEQ ID NO: 1254798 - protein, 23 aa, Mycobacterium
RAPAEVRRRIGVTGQDAALDARL

SEQ ID NO: 1254799 - protein, 23 aa, Mycobacterium
RAPDARVGVVINDFGELNVDAAL

SEQ ID NO: 1254800 - protein, 24 aa, Mycobacterium
RAPGECPGAYAAEVAMDELAAACG

SEQ ID NO: 1254801 - protein, 17 aa, Mycobacterium
RAPRLARTATWTTLEQD

SEQ ID NO: 1254802 - protein, 25 aa, Mycobacterium
RARAARLRAQMAFVRSRVGESGAPA

SEQ ID NO: 1254803 - protein, 20 aa, Mycobacterium
RARCPEVLPSTHVVDTLATL

SEQ ID NO: 1254804 - protein, 23 aa, Mycobacterium
RARIERHGVLVIGPNPAFLDHIS

SEQ ID NO: 1254805 - protein, 19 aa, Mycobacterium
RARILAAARARIVASDDVK

SEQ ID NO: 1254806 - protein, 21 aa, Mycobacterium
RARIRPGEWVTVVGAGGVGLS

SEQ ID NO: 1254807 - protein, 18 aa, Mycobacterium
RARREVVLYASFDPSELR

SEQ ID NO: 1254808 - protein, 20 aa, Mycobacterium
RARTGLQLFGGPRLHRERYL

SEQ ID NO: 1254809 - protein, 21 aa, Mycobacterium
RARVHKMLAGLFGLCERHRHL

SEQ ID NO: 1254810 - protein, 23 aa, Mycobacterium
RASAYRCGEAWSVLVRHRPTAHT

SEQ ID NO: 1254811 - protein, 20 aa, Mycobacterium
RASLGEGWRTLDVVDETGST

SEQ ID NO: 1254812 - protein, 18 aa, Mycobacterium
RASRLSRIVALISEETGS

SEQ ID NO: 1254813 - protein, 25 aa, Mycobacterium
RASYESKPYRGHLMRTYGGTVHSSP

SEQ ID NO: 1254814 - protein, 25 aa, Mycobacterium
RATGCIAPGLVVRCRNDIPHSRGLG

SEQ ID NO: 1254815 - protein, 21 aa, Mycobacterium
RATKQTWALHRWNIDEYHGVF

SEQ ID NO: 1254816 - protein, 17 aa, Mycobacterium
RATSLTMLGARNHDRTA

SEQ ID NO: 1254817 - protein, 21 aa, Mycobacterium
RAVHAVYECCCSVSLAADLAR

SEQ ID NO: 1254818 - protein, 22 aa, Mycobacterium
RAVLPLQLPATSARLIGTGLSY

SEQ ID NO: 1254819 - protein, 17 aa, Mycobacterium
RAVRIGNQVLVAGTTGA

SEQ ID NO: 1254820 - protein, 19 aa, Mycobacterium
RAVTRLRLDVSYDGTDFAG

SEQ ID NO: 1254821 - protein, 27 aa, Mycobacterium
RAVVLAPRLWVPDDFGLSRYLAAGLAV

SEQ ID NO: 1254822 - protein, 17 aa, Mycobacterium
RAYAELGVRQGDYVTIL

SEQ ID NO: 1254823 - protein, 19 aa, Mycobacterium
RAYNDWNIDEWCGTYPGRM

SEQ ID NO: 1254824 - protein, 20 aa, Mycobacterium
RAYTPWYLVRYWRLLKFKLT

SEQ ID NO: 1254825 - protein, 21 aa, Mycobacterium
RAYVLDAWLRPVPDGVAGELY

SEQ ID NO: 1254826 - protein, 26 aa, Mycobacterium
RCAAQALPRRDRVVLIGQAPLGEEQW

SEQ ID NO: 1254827 - protein, 18 aa, Mycobacterium
RCDLLPGGIEQYLEGRVS

SEQ ID NO: 1254828 - protein, 17 aa, Mycobacterium
RCGMRMHHSIDIASGAK

SEQ ID NO: 1254829 - protein, 17 aa, Mycobacterium
RCHGHGISAPRFLLEDC

SEQ ID NO: 1254830 - protein, 17 aa, Mycobacterium
RCLLIVGSSQTQWYSDD

SEQ ID NO: 1254831 - protein, 18 aa, Mycobacterium
RCSERFAPHLDWIVANLD

SEQ ID NO: 1254832 - protein, 17 aa, Mycobacterium
RCSWDMRPASDASTSAS

SEQ ID NO: 1254833 - protein, 22 aa, Mycobacterium
RCTQALREGRLSLDQVGAIAER

SEQ ID NO: 1254834 - protein, 20 aa, Mycobacterium
RCVQSADKEGWLALMADDVV

SEQ ID NO: 1254835 - protein, 20 aa, Mycobacterium
RCVRHPGPTPPVLLIDEIDR

SEQ ID NO: 1254836 - protein, 23 aa, Mycobacterium
RDAAEILCLPYFLGEKSPLHDPD

SEQ ID NO: 1254837 - protein, 19 aa, Mycobacterium
RDADEWIRRLETPHAAVRP

SEQ ID NO: 1254838 - protein, 24 aa, Mycobacterium
RDALMRAVAVKWHGLRALEETTRV

SEQ ID NO: 1254839 - protein, 23 aa, Mycobacterium
RDAMPTFRQVFMAGASGMDLERR

SEQ ID NO: 1254840 - protein, 20 aa, Mycobacterium
RDAMSPRAVLLLVETVIPPG

SEQ ID NO: 1254841 - protein, 23 aa, Mycobacterium
RDDADWQALCRVLGRQDLAGDPE

SEQ ID NO: 1254842 - protein, 24 aa, Mycobacterium
RDDGRSVLIISHFVADEHRFDRIV

SEQ ID NO: 1254843 - protein, 20 aa, Mycobacterium
RDDLDLVLLTVNYAEGRPEH

SEQ ID NO: 1254844 - protein, 17 aa, Mycobacterium
RDDLGFTPVHVRYNTGL

SEQ ID NO: 1254845 - protein, 19 aa, Mycobacterium
RDDLVAWEFERAGLGSLGD

SEQ ID NO: 1254846 - protein, 21 aa, Mycobacterium
RDDVVLATKFGRPVDDNPNHR

SEQ ID NO: 1254847 - protein, 19 aa, Mycobacterium
RDEILLARNDRYWSAPAKP

SEQ ID NO: 1254848 - protein, 18 aa, Mycobacterium
RDEITAWLSEAGSEYTYT

SEQ ID NO: 1254849 - protein, 26 aa, Mycobacterium
RDGGCTKPGCTVGAYGCQGHHVEADF

SEQ ID NO: 1254850 - protein, 20 aa, Mycobacterium
RDGLLRAFLNVCRHRGAQLC

SEQ ID NO: 1254851 - protein, 27 aa, Mycobacterium
RDGRRRISIYWTWSYPWEAQRNPAEVY

SEQ ID NO: 1254852 - protein, 18 aa, Mycobacterium
RDIVYPRFESGGVPYENP

SEQ ID NO: 1254853 - protein, 26 aa, Mycobacterium
RDKGCTHPGCTVPFYWTEAHHTHDYS

SEQ ID NO: 1254854 - protein, 26 aa, Mycobacterium
RDKVLVWCHGGGYVLGSARGFQDLGH

SEQ ID NO: 1254855 - protein, 27 aa, Mycobacterium
RDKVLYWYVHSALWGRFSGSTETVLQQ

SEQ ID NO: 1254856 - protein, 29 aa, Mycobacterium
RDLERERCLLFVACTRAREELLVTWHGEP

SEQ ID NO: 1254857 - protein, 17 aa, Mycobacterium
RDLFCRYPGCDVPAEHC

SEQ ID NO: 1254858 - protein, 19 aa, Mycobacterium
RDNGWAMHVPRRLKDLHVQ

SEQ ID NO: 1254859 - protein, 26 aa, Mycobacterium
RDRGCTHPGCTVPFYWTEAHHTHDYS

SEQ ID NO: 1254860 - protein, 24 aa, Mycobacterium
RDRLRELDFEFPLAGGDVRGGAPA

SEQ ID NO: 1254861 - protein, 25 aa, Mycobacterium
RDRTCAVPGCAATRGLHAHHIQHWE

SEQ ID NO: 1254862 - protein, 30 aa, Mycobacterium
RDRWSDEVAACYPFHPMLMALAKDEWSKVT

SEQ ID NO: 1254863 - protein, 19 aa, Mycobacterium
RDSALIFLRAAADAVHEDR

SEQ ID NO: 1254864 - protein, 19 aa, Mycobacterium
RDSPRAGEADLILAKHRNG

SEQ ID NO: 1254865 - protein, 18 aa, Mycobacterium
RDTQFFWDGVNAHELRIQ

SEQ ID NO: 1254866 - protein, 17 aa, Mycobacterium
RDVCPNSRCTGRLRLYE

SEQ ID NO: 1254867 - protein, 22 aa, Mycobacterium
RDVIDARLAFLVSGGTGAGKTT

SEQ ID NO: 1254868 - protein, 19 aa, Mycobacterium
RDVILLLGYLTRLDDAEWN

SEQ ID NO: 1254869 - protein, 18 aa, Mycobacterium
RDVWVYGRAGKPCRRCGT

SEQ ID NO: 1254870 - protein, 17 aa, Mycobacterium
REAEAYDGPSIVIAYSH

SEQ ID NO: 1254871 - protein, 19 aa, Mycobacterium
REAFCSGPSELLDDMIEHW

SEQ ID NO: 1254872 - protein, 19 aa, Mycobacterium
REAFTAFFGDRCMDMPQGA

SEQ ID NO: 1254873 - protein, 19 aa, Mycobacterium
REALFAACRDGRVAVLLGS

SEQ ID NO: 1254874 - protein, 17 aa, Mycobacterium
REALIRTDVFGTQADLD

SEQ ID NO: 1254875 - protein, 24 aa, Mycobacterium
REALKSALQYPALAGPVFDALAVD

SEQ ID NO: 1254876 - protein, 20 aa, Mycobacterium
REALRQAALVRFLAQGVEDT

SEQ ID NO: 1254877 - protein, 20 aa, Mycobacterium
REANRYPALLDRINAEMAPR

SEQ ID NO: 1254878 - protein, 23 aa, Mycobacterium
REARLRRLPVLLLGRQPRHGNGG

SEQ ID NO: 1254879 - protein, 23 aa, Mycobacterium
REAVQRFLVEWLGFKYSSHDLVA

SEQ ID NO: 1254880 - protein, 32 aa, Mycobacterium
RECRRLRPDLATGLMPLRWGTGYMLGSKRFGP

SEQ ID NO: 1254881 - protein, 18 aa, Mycobacterium
RECVDAFVASWHARGFSP

SEQ ID NO: 1254882 - protein, 21 aa, Mycobacterium
REEFRASRIMLDRARANEKIT

SEQ ID NO: 1254883 - protein, 18 aa, Mycobacterium
REELSFQRCSGCDRWRHV

SEQ ID NO: 1254884 - protein, 20 aa, Mycobacterium
REFAARLLVDAADLPGGIAI

SEQ ID NO: 1254885 - protein, 24 aa, Mycobacterium
REGEAASLFGYVNEWCPRHGYRHP

SEQ ID NO: 1254886 - protein, 22 aa, Mycobacterium
REGEPCRRCGAIMRRDKFMNRS

SEQ ID NO: 1254887 - protein, 17 aa, Mycobacterium
REHGHPVAAYTGSTDPT

SEQ ID NO: 1254888 - protein, 26 aa, Mycobacterium
REHLAALCRRVELLPGSDSGVFIDID

SEQ ID NO: 1254889 - protein, 21 aa, Mycobacterium
REIMLRRNLGLTKLYNIVHDA

SEQ ID NO: 1254890 - protein, 17 aa, Mycobacterium
REKRLNELTVFLQHNPW

SEQ ID NO: 1254891 - protein, 22 aa, Mycobacterium
RELEVRFGLTEVVIAGHGVDIG

SEQ ID NO: 1254892 - protein, 21 aa, Mycobacterium
RELFMAMGVDLFANLMEIRAN

SEQ ID NO: 1254893 - protein, 20 aa, Mycobacterium
RELHAQLGIATEAWSPLGQG

SEQ ID NO: 1254894 - protein, 19 aa, Mycobacterium
RELLLLAALKNGMAQRDLV

SEQ ID NO: 1254895 - protein, 22 aa, Mycobacterium
RELQMRAAAIGPQAVEEVNRII

SEQ ID NO: 1254896 - protein, 18 aa, Mycobacterium
RELVARIRAMLRRPRIQQ

SEQ ID NO: 1254897 - protein, 21 aa, Mycobacterium
RELVVDPELLRHIAHRREADR

SEQ ID NO: 1254898 - protein, 19 aa, Mycobacterium
REMVARYLAGASIRSLTIW

SEQ ID NO: 1254899 - protein, 18 aa, Mycobacterium
REPIPVYAEMSAVNPVFL

SEQ ID NO: 1254900 - protein, 23 aa, Mycobacterium
REQLRIAIVIWIERTYHRRRRQL

SEQ ID NO: 1254901 - protein, 23 aa, Mycobacterium
RERRPDVVDSQGWRAIDAAEIAR

SEQ ID NO: 1254902 - protein, 21 aa, Mycobacterium
RETGCTPYAVLLAVFGTLIHR

SEQ ID NO: 1254903 - protein, 31 aa, Mycobacterium
REVAIRVSNRLRPWLPVLLALTANSAIYRNA

SEQ ID NO: 1254904 - protein, 20 aa, Mycobacterium
REVDALVVATGFHVTDSPMF

SEQ ID NO: 1254905 - protein, 18 aa, Mycobacterium
REVLRYLLDGGIADKRIA

SEQ ID NO: 1254906 - protein, 22 aa, Mycobacterium
REVPPELTAALAHAIPQGELRT

SEQ ID NO: 1254907 - protein, 21 aa, Mycobacterium
REVRSLVGPGWPDGSGGAPAA

SEQ ID NO: 1254908 - protein, 24 aa, Mycobacterium
REVSRLCLMSSNFATACRAYDPSI

SEQ ID NO: 1254909 - protein, 19 aa, Mycobacterium
REYRLRTGAAAGPVNSPIG

SEQ ID NO: 1254910 - protein, 24 aa, Mycobacterium
REYVQIFKGFHRFLQTRKAAEIEA

SEQ ID NO: 1254911 - protein, 19 aa, Mycobacterium
RFAEQGWYFAGDGARYDAD

SEQ ID NO: 1254912 - protein, 25 aa, Mycobacterium
RFARRFGVTVVDGFGSTEGGVAIAR

SEQ ID NO: 1254913 - protein, 19 aa, Mycobacterium
RFDAAPGQRDHSWGVRDWW

SEQ ID NO: 1254914 - protein, 24 aa, Mycobacterium
RFGTDLPPLGGIYLAAFGGGPVTL

SEQ ID NO: 1254915 - protein, 30 aa, Mycobacterium
RFLDALPDWPAVGLPRVRIAEFRPAPQEHR

SEQ ID NO: 1254916 - protein, 18 aa, Mycobacterium
RFLQLGLRGYWPDEPVLQ

SEQ ID NO: 1254917 - protein, 17 aa, Mycobacterium
RFNRVLAQLDRFRATRM

SEQ ID NO: 1254918 - protein, 18 aa, Mycobacterium
RFQLDIMGVPGIIVARTD

SEQ ID NO: 1254919 - protein, 18 aa, Mycobacterium
RFREAGVRKVWVYQALDD

SEQ ID NO: 1254920 - protein, 29 aa, Mycobacterium
RFRMWGSSDLRRWLPLDMRRPFKSTLVTL

SEQ ID NO: 1254921 - protein, 19 aa, Mycobacterium
RFRSIRIDQSWRGIVLAPA

SEQ ID NO: 1254922 - protein, 29 aa, Mycobacterium
RFSFNVKGGRCEACSGDGTIKIEMNFLPD

SEQ ID NO: 1254923 - protein, 17 aa, Mycobacterium
RFSPEVMEAEWLDGAAG

SEQ ID NO: 1254924 - protein, 18 aa, Mycobacterium
RFTARLVVRRVKDARFRD

SEQ ID NO: 1254925 - protein, 20 aa, Mycobacterium
RFVFGLARRYGPRFFEAGEL

SEQ ID NO: 1254926 - protein, 29 aa, Mycobacterium
RGAEAVKAWAEAMVAAWVAGVDREIVATQ

SEQ ID NO: 1254927 - protein, 18 aa, Mycobacterium
RGAEGLTLVGDEWNRGAE

SEQ ID NO: 1254928 - protein, 19 aa, Mycobacterium
RGAFHGRSGYTLSLTNTDP

SEQ ID NO: 1254929 - protein, 23 aa, Mycobacterium
RGAGPRFAFDVLVVDEAHHVAPA

SEQ ID NO: 1254930 - protein, 17 aa, Mycobacterium
RGAISGAVLDAGCGAGE

SEQ ID NO: 1254931 - protein, 17 aa, Mycobacterium
RGALVARLGELLVEHKA

SEQ ID NO: 1254932 - protein, 19 aa, Mycobacterium
RGARTIPDADFQAVTPDAT

SEQ ID NO: 1254933 - protein, 25 aa, Mycobacterium
RGASLDFAAVWGLAGGVQSDLSPVS

SEQ ID NO: 1254934 - protein, 17 aa, Mycobacterium
RGASMAATFAGDAAIAA

SEQ ID NO: 1254935 - protein, 19 aa, Mycobacterium
RGASTTVRSDSRFIVDVRP

SEQ ID NO: 1254936 - protein, 17 aa, Mycobacterium
RGATPRERMLGAPGDAT

SEQ ID NO: 1254937 - protein, 19 aa, Mycobacterium
RGFESLWLGEHPQIPVSAA

SEQ ID NO: 1254938 - protein, 20 aa, Mycobacterium
RGFGQIRTWWTATADAIEAC

SEQ ID NO: 1254939 - protein, 18 aa, Mycobacterium
RGGFAGMLLGSVSAAVAQ

SEQ ID NO: 1254940 - protein, 22 aa, Mycobacterium
RGGGDTDICWRIQEQSLGTIAT

SEQ ID NO: 1254941 - protein, 23 aa, Mycobacterium
RGGLDRESLRLSVVHAGNPAQRA

SEQ ID NO: 1254942 - protein, 25 aa, Mycobacterium
RGGTRVRFSLMPAETSRLVDVRTSK

SEQ ID NO: 1254943 - protein, 17 aa, Mycobacterium
RGHLSGALIDCHVTEPL

SEQ ID NO: 1254944 - protein, 28 aa, Mycobacterium
RGIGAEIVRRLAFEGAAVAFTYGSSVSD

SEQ ID NO: 1254945 - protein, 18 aa, Mycobacterium
RGIGVGFESYALYPPMSV

SEQ ID NO: 1254946 - protein, 21 aa, Mycobacterium
RGIIRVHQFDKVEGFIYCKPE

SEQ ID NO: 1254947 - protein, 18 aa, Mycobacterium
RGLAEKDLGLALTLGEEL

SEQ ID NO: 1254948 - protein, 19 aa, Mycobacterium
RGLAIAHRVLDELSYRRDS

SEQ ID NO: 1254949 - protein, 20 aa, Mycobacterium
RGLRVVPWTINDPGAMRAQI

SEQ ID NO: 1254950 - protein, 19 aa, Mycobacterium
RGLTGIEVHPDFWHEDEFG

SEQ ID NO: 1254951 - protein, 17 aa, Mycobacterium
RGLYGGVLGYLDFAGNA

SEQ ID NO: 1254952 - protein, 19 aa, Mycobacterium
RGMVARGRGAIVNITSPAG

SEQ ID NO: 1254953 - protein, 20 aa, Mycobacterium
RGNVTYRHMLAGKPAVLHTR

SEQ ID NO: 1254954 - protein, 20 aa, Mycobacterium
RGPGLDGWAATEIDRMAALL

SEQ ID NO: 1254955 - protein, 21 aa, Mycobacterium
RGPVATVLIQRGTLRVGDSIV

SEQ ID NO: 1254956 - protein, 25 aa, Mycobacterium
RGQAFRKARMAVVLESRRQPLACAD

SEQ ID NO: 1254957 - protein, 18 aa, Mycobacterium
RGRGKRTVREIVGMSTEL

SEQ ID NO: 1254958 - protein, 17 aa, Mycobacterium
RGRSVLREAGCTLLTCH

SEQ ID NO: 1254959 - protein, 18 aa, Mycobacterium
RGSLSWRQAADAFCEAVA

SEQ ID NO: 1254960 - protein, 17 aa, Mycobacterium
RGTCPECGQTVSVTSRG

SEQ ID NO: 1254961 - protein, 32 aa, Mycobacterium
RGTGKGLRSARRLGRRRPAPEEAVDEDVYDDE

SEQ ID NO: 1254962 - protein, 17 aa, Mycobacterium
RGVEEVVVIGRRGPLQA

SEQ ID NO: 1254963 - protein, 17 aa, Mycobacterium
RGVMFSFGFFSAKHLGG

SEQ ID NO: 1254964 - protein, 27 aa, Mycobacterium
RGVPYRKFIRRYPALTLLVLVGHAALE

SEQ ID NO: 1254965 - protein, 19 aa, Mycobacterium
RGVSRSKQRPDGMVDLSGH

SEQ ID NO: 1254966 - protein, 20 aa, Mycobacterium
RGVVTIDVPESVCARTEPEL

SEQ ID NO: 1254967 - protein, 18 aa, Mycobacterium
RGWLDDPTRFFAPPPPLT

SEQ ID NO: 1254968 - protein, 18 aa, Mycobacterium
RHAHSVALAAYFRHSYEQ

SEQ ID NO: 1254969 - protein, 18 aa, Mycobacterium
RHDAFAIGAFRELGGSNP

SEQ ID NO: 1254970 - protein, 18 aa, Mycobacterium
RHDEIPGWDDMPDRLKPV

SEQ ID NO: 1254971 - protein, 18 aa, Mycobacterium
RHDPSVMVYAPLRTLIYE

SEQ ID NO: 1254972 - protein, 17 aa, Mycobacterium
RHFPTREALLAELYRDD

SEQ ID NO: 1254973 - protein, 19 aa, Mycobacterium
RHGHVIKQLPGLLVVLRDG

SEQ ID NO: 1254974 - protein, 20 aa, Mycobacterium
RHHHELGWFARQALRLFDDL

SEQ ID NO: 1254975 - protein, 17 aa, Mycobacterium
RHKGCNCQPRIVVAENI

SEQ ID NO: 1254976 - protein, 18 aa, Mycobacterium
RHPAPCGASTTGATTIVE

SEQ ID NO: 1254977 - protein, 17 aa, Mycobacterium
RHPGRYAVEVDLRSLGF

SEQ ID NO: 1254978 - protein, 17 aa, Mycobacterium
RHPRAWRALRGVLERNL

SEQ ID NO: 1254979 - protein, 21 aa, Mycobacterium
RHPTPLPARVLDGATFSGHVG

SEQ ID NO: 1254980 - protein, 24 aa, Mycobacterium
RHQVTVRVPIDFSLDDCDLSDGLA

SEQ ID NO: 1254981 - protein, 18 aa, Mycobacterium
RHSTWALRELVVLHEIAH

SEQ ID NO: 1254982 - protein, 22 aa, Mycobacterium
RHVEPLRGVGMDAARTAILDGR

SEQ ID NO: 1254983 - protein, 25 aa, Mycobacterium
RHWEPKRRGIYCGTIGLASPAAGCE

SEQ ID NO: 1254984 - protein, 22 aa, Mycobacterium
RHWLAALAERYDPSGVFRTGQV

SEQ ID NO: 1254985 - protein, 19 aa, Mycobacterium
RICSEDFRIHFLNSDQDGS

SEQ ID NO: 1254986 - protein, 26 aa, Mycobacterium
RIDDRLAGLAARYAVSVGDQRLVRYD

SEQ ID NO: 1254987 - protein, 25 aa, Mycobacterium
RIDGRRNEYVVGWIKRGPSGVIGSN

SEQ ID NO: 1254988 - protein, 18 aa, Mycobacterium
RIDTRPSVLALFDGARRD

SEQ ID NO: 1254989 - protein, 19 aa, Mycobacterium
RIESMPQFREKLADSRFNP

SEQ ID NO: 1254990 - protein, 17 aa, Mycobacterium
RIFEITVEYLKTRIQFG

SEQ ID NO: 1254991 - protein, 20 aa, Mycobacterium
RIGDVLRYTQTVTLWHGVER

SEQ ID NO: 1254992 - protein, 25 aa, Mycobacterium
RIGELMGGAVARWAEETDRNPPRLE

SEQ ID NO: 1254993 - protein, 28 aa, Mycobacterium
RIIGELLPDLTLPYGVNVLWDGRASIDL

SEQ ID NO: 1254994 - protein, 17 aa, Mycobacterium
RIIRAASALFYRRGIHA

SEQ ID NO: 1254995 - protein, 19 aa, Mycobacterium
RILARRVRTSHAFHSRLMD

SEQ ID NO: 1254996 - protein, 18 aa, Mycobacterium
RILTTIGIRHPRSIREVL

SEQ ID NO: 1254997 - protein, 17 aa, Mycobacterium
RIRDALAYHDHNWGRFR

SEQ ID NO: 1254998 - protein, 30 aa, Mycobacterium
RIRRTLTVARLLAPIAVPLVYRASVAARGY

SEQ ID NO: 1254999 - protein, 20 aa, Mycobacterium
RISREWSQRWASHTAGRFTL

SEQ ID NO: 1255000 - protein, 19 aa, Mycobacterium
RISVPPEWVFRAVGVPYRP

SEQ ID NO: 1255001 - protein, 19 aa, Mycobacterium
RITAIGMGMIALRAPRVGE

SEQ ID NO: 1255002 - protein, 17 aa, Mycobacterium
RITELIVGILDVYETLT

SEQ ID NO: 1255003 - protein, 23 aa, Mycobacterium
RKAAEIEAAFGARLVCPVDEFNA

SEQ ID NO: 1255004 - protein, 22 aa, Mycobacterium
RKALLPHLAVKRIREFEPFIDD

SEQ ID NO: 1255005 - protein, 20 aa, Mycobacterium
RKDGVPLWWKSAARNKSSVA

SEQ ID NO: 1255006 - protein, 17 aa, Mycobacterium
RKEGWGLAVTEAGQHAV

SEQ ID NO: 1255007 - protein, 19 aa, Mycobacterium
RKGRMLPYVIEVDGQFAGQ

SEQ ID NO: 1255008 - protein, 17 aa, Mycobacterium
RKIEIGCYQGLRHRRGL

SEQ ID NO: 1255009 - protein, 22 aa, Mycobacterium
RKIPALFIGGVHAREWVPPDAL

SEQ ID NO: 1255010 - protein, 18 aa, Mycobacterium
RKIVELNLLGALSVSTHA

SEQ ID NO: 1255011 - protein, 20 aa, Mycobacterium
RKLIDAQLTQAGWVVQDKQD

SEQ ID NO: 1255012 - protein, 21 aa, Mycobacterium
RKPACGVCVLAKDCPSFGIGP

SEQ ID NO: 1255013 - protein, 18 aa, Mycobacterium
RKRFHKRAETELTILAPH

SEQ ID NO: 1255014 - protein, 27 aa, Mycobacterium
RKRGKLLVRERIELMLDPDTAFLELCP

SEQ ID NO: 1255015 - protein, 20 aa, Mycobacterium
RKVPGALKWIEDRRENLMSA

SEQ ID NO: 1255016 - protein, 23 aa, Mycobacterium
RKVQWSRRFPVEKVAEIDVRGYS

SEQ ID NO: 1255017 - protein, 19 aa, Mycobacterium
RKVTPNFRIGCKRMLISND

SEQ ID NO: 1255018 - protein, 22 aa, Mycobacterium
RKYLGVCAHGVRLTLAEIRIAE

SEQ ID NO: 1255019 - protein, 22 aa, Mycobacterium
RLAAGEIKACWIICTNPVATMP

SEQ ID NO: 1255020 - protein, 19 aa, Mycobacterium
RLAARLAASMQPFMLPRGG

SEQ ID NO: 1255021 - protein, 17 aa, Mycobacterium
RLASAFQGLGVRSGDRV

SEQ ID NO: 1255022 - protein, 19 aa, Mycobacterium
RLATKHLQRYPGLQQAASR

SEQ ID NO: 1255023 - protein, 24 aa, Mycobacterium
RLCPQAVVVPPRMAAYSQASAAVF

SEQ ID NO: 1255024 - protein, 21 aa, Mycobacterium
RLDAVDAFAGHLVLSYREEAL

SEQ ID NO: 1255025 - protein, 18 aa, Mycobacterium
RLDHPGVLVIEGGPGTGK

SEQ ID NO: 1255026 - protein, 21 aa, Mycobacterium
RLEAAVALSAVTSRFPDARLA

SEQ ID NO: 1255027 - protein, 18 aa, Mycobacterium
RLEAEGHRILKLNIGNPA

SEQ ID NO: 1255028 - protein, 25 aa, Mycobacterium
RLEGDRGFYAGAVGWCDAAGDGRWV

SEQ ID NO: 1255029 - protein, 19 aa, Mycobacterium
RLEPVPVLRRQGVWAVAIA

SEQ ID NO: 1255030 - protein, 18 aa, Mycobacterium
RLERLTAHLHDRWQRDPW

SEQ ID NO: 1255031 - protein, 18 aa, Mycobacterium
RLETVRALGEFISKNVAR

SEQ ID NO: 1255032 - protein, 25 aa, Mycobacterium
RLFPVIRRYALAYHVVFIPSEEVDR

SEQ ID NO: 1255033 - protein, 23 aa, Mycobacterium
RLFTETKQGFGFYHNNFGVPYAF

SEQ ID NO: 1255034 - protein, 20 aa, Mycobacterium
RLGAEAFPTLAPDDLLAAAE

SEQ ID NO: 1255035 - protein, 18 aa, Mycobacterium
RLGDAFEVIEIDSARGNP

SEQ ID NO: 1255036 - protein, 24 aa, Mycobacterium
RLGDELRVVWELEPGRRLKPPQDL

SEQ ID NO: 1255037 - protein, 24 aa, Mycobacterium
RLGEGSWKKVLITALRVSGAEAGR

SEQ ID NO: 1255038 - protein, 19 aa, Mycobacterium
RLGGLVTVTVAAWRPGGEN

SEQ ID NO: 1255039 - protein, 18 aa, Mycobacterium
RLGIDVPLARHAISSVGA

SEQ ID NO: 1255040 - protein, 20 aa, Mycobacterium
RLGRRVTEIALVFRRAPHLP

SEQ ID NO: 1255041 - protein, 21 aa, Mycobacterium
RLHAQLSWASAVVIPANESAR

SEQ ID NO: 1255042 - protein, 19 aa, Mycobacterium
RLIAEYFPAVSVLTTNFDL

SEQ ID NO: 1255043 - protein, 18 aa, Mycobacterium
RLIVVDYLQLMTSGKRVE

SEQ ID NO: 1255044 - protein, 17 aa, Mycobacterium
RLKGLFMASFEAIATRH

SEQ ID NO: 1255045 - protein, 18 aa, Mycobacterium
RLLAAMTVDAVRGLLRLP

SEQ ID NO: 1255046 - protein, 19 aa, Mycobacterium
RLLAESTLAYVDGDRFVDA

SEQ ID NO: 1255047 - protein, 25 aa, Mycobacterium
RLLDSLAVRKLWGIGPVAEDKLHRL

SEQ ID NO: 1255048 - protein, 17 aa, Mycobacterium
RLLLPTVEALAGEEVTV

SEQ ID NO: 1255049 - protein, 17 aa, Mycobacterium
RLLRFWFEKGTDLSGYT

SEQ ID NO: 1255050 - protein, 17 aa, Mycobacterium
RLLRPLFGAKFGDAFGE

SEQ ID NO: 1255051 - protein, 31 aa, Mycobacterium
RLMSAQPVLAGWVSAVVFFRSSRWHDVRRVL

SEQ ID NO: 1255052 - protein, 21 aa, Mycobacterium
RLNEVCCIYPITPSSPMAELA

SEQ ID NO: 1255053 - protein, 26 aa, Mycobacterium
RLNVAISRAKYAAVIVRSEALTEYLP

SEQ ID NO: 1255054 - protein, 17 aa, Mycobacterium
RLPDPPRVLTPVRHLHG

SEQ ID NO: 1255055 - protein, 17 aa, Mycobacterium
RLPFGVVEIKSAWVSDD

SEQ ID NO: 1255056 - protein, 28 aa, Mycobacterium
RLPRLVDWPEWLPPDWFDDRRVEPVLAG

SEQ ID NO: 1255057 - protein, 17 aa, Mycobacterium
RLQEVWVGRQIAEVKSK

SEQ ID NO: 1255058 - protein, 19 aa, Mycobacterium
RLQGKIGIDGGVLNGGDGV

SEQ ID NO: 1255059 - protein, 19 aa, Mycobacterium
RLQQRIAHLFTTDPQFAAA

SEQ ID NO: 1255060 - protein, 18 aa, Mycobacterium
RLRDGGVLSSRRVLARQD

SEQ ID NO: 1255061 - protein, 17 aa, Mycobacterium
RLRDPHSLLVATIHEGL

SEQ ID NO: 1255062 - protein, 18 aa, Mycobacterium
RLRERPHIGPNGGTAAGL

SEQ ID NO: 1255063 - protein, 18 aa, Mycobacterium
RLRGLRRAAARARADELI

SEQ ID NO: 1255064 - protein, 21 aa, Mycobacterium
RLRVAGAGLLRAWRARIAHPA

SEQ ID NO: 1255065 - protein, 18 aa, Mycobacterium
RLSDAGWDALDAAMATEE

SEQ ID NO: 1255066 - protein, 24 aa, Mycobacterium
RLSGGRFTLGIGRGIGAIYGAFGI

SEQ ID NO: 1255067 - protein, 28 aa, Mycobacterium
RLSIDPELRFRKRPLLSLEQPVKVTDSD

SEQ ID NO: 1255068 - protein, 23 aa, Mycobacterium
RLSSERMPLAGLILNRTHPTLCS

SEQ ID NO: 1255069 - protein, 23 aa, Mycobacterium
RLTCAGCGSDAWSWQRSSGRGVV

SEQ ID NO: 1255070 - protein, 24 aa, Mycobacterium
RLTGRENLVLFGRLRGLRRAAARA

SEQ ID NO: 1255071 - protein, 21 aa, Mycobacterium
RLTPHAGPCASQFTIATDGME

SEQ ID NO: 1255072 - protein, 20 aa, Mycobacterium
RLTPKLADGSVSWAPVWARY

SEQ ID NO: 1255073 - protein, 24 aa, Mycobacterium
RLTPREIDVLMALCRPLVSDDLFP

SEQ ID NO: 1255074 - protein, 19 aa, Mycobacterium
RLTSARPDLDFHWVTVDFE

SEQ ID NO: 1255075 - protein, 22 aa, Mycobacterium
RLVDLLTEIAIRIGGGEDYMKA

SEQ ID NO: 1255076 - protein, 18 aa, Mycobacterium
RLVPRKGQDMLIRAMPAI

SEQ ID NO: 1255077 - protein, 17 aa, Mycobacterium
RLWDILGAISADHRPAW

SEQ ID NO: 1255078 - protein, 20 aa, Mycobacterium
RLWEMSEDQWSAVIDVNLNG

SEQ ID NO: 1255079 - protein, 24 aa, Mycobacterium
RLWRKNRRSAVAGSCLGVDINRNY

SEQ ID NO: 1255080 - protein, 20 aa, Mycobacterium
RLYDLSAHYVWIGERTRQLD

SEQ ID NO: 1255081 - protein, 19 aa, Mycobacterium
RLYREAPLMGIWEGSGNVS

SEQ ID NO: 1255082 - protein, 25 aa, Mycobacterium
RMGFPEKGIAVAVDWSVLPRTEWET

SEQ ID NO: 1255083 - protein, 23 aa, Mycobacterium
RMIRINAVHPTNCNTHLLQNEGM

SEQ ID NO: 1255084 - protein, 19 aa, Mycobacterium
RMLIVDGRLPVGARLPSER

SEQ ID NO: 1255085 - protein, 17 aa, Mycobacterium
RMLRSFDPRSAAHPLDV

SEQ ID NO: 1255086 - protein, 18 aa, Mycobacterium
RMRKLAARSAEAGEVDAF

SEQ ID NO: 1255087 - protein, 26 aa, Mycobacterium
RMTGPRSIKAAADWISVNATDDGAAS

SEQ ID NO: 1255088 - protein, 25 aa, Mycobacterium
RMWNQAGDVMAGWDGASTGAADTIM

SEQ ID NO: 1255089 - protein, 18 aa, Mycobacterium
RNAATYWRAKAKAGDGKV

SEQ ID NO: 1255090 - protein, 22 aa, Mycobacterium
RNAGPFGMGGAQSFFDQQTVVE

SEQ ID NO: 1255091 - protein, 22 aa, Mycobacterium
RNDGRLTVRFNRPDRHNAFSTG

SEQ ID NO: 1255092 - protein, 20 aa, Mycobacterium
RNEFVTVRFCAREALGELGL

SEQ ID NO: 1255093 - protein, 18 aa, Mycobacterium
RNFIRRLGVSPDHYRKTF

SEQ ID NO: 1255094 - protein, 19 aa, Mycobacterium
RNFYALDRLWRDCPTVPVD

SEQ ID NO: 1255095 - protein, 20 aa, Mycobacterium
RNGGRYADWYFSNGKDFDGI

SEQ ID NO: 1255096 - protein, 18 aa, Mycobacterium
RNIEGWVVRKRPGSAAAR

SEQ ID NO: 1255097 - protein, 23 aa, Mycobacterium
RNLCLYPNVYLMDQFSTQIRHFR

SEQ ID NO: 1255098 - protein, 23 aa, Mycobacterium
RNLNWLKSWYEFAVPDIGRSSLI

SEQ ID NO: 1255099 - protein, 25 aa, Mycobacterium
RNLWPVARRPVELVWGLVAQTPEMG

SEQ ID NO: 1255100 - protein, 33 aa, Mycobacterium
RNPHADLARSLRCRPEDLIALLRRRGDDDLIEL

SEQ ID NO: 1255101 - protein, 21 aa, Mycobacterium
RNRGHCAAIHLNMPIAYPPAG

SEQ ID NO: 1255102 - protein, 26 aa, Mycobacterium
RNVSHGCPNLSPANAQWFYDNFGSGD

SEQ ID NO: 1255103 - protein, 18 aa, Mycobacterium
RNVYIRNGLQLTAEDRAR

SEQ ID NO: 1255104 - protein, 22 aa, Mycobacterium
RNYDIAWDFQRYYDTAAASRVK

SEQ ID NO: 1255105 - protein, 19 aa, Mycobacterium
RPADLTADWLTTVLGAGTV

SEQ ID NO: 1255106 - protein, 24 aa, Mycobacterium
RPAEFFRAARRCIAAGKPIVALKL

SEQ ID NO: 1255107 - protein, 18 aa, Mycobacterium
RPAGTRLLAFEGEIALVI

SEQ ID NO: 1255108 - protein, 24 aa, Mycobacterium
RPAKAAALREFAHQAGVPMDQTVA

SEQ ID NO: 1255109 - protein, 18 aa, Mycobacterium
RPAVPPGPTRSELGDLCE

SEQ ID NO: 1255110 - protein, 21 aa, Mycobacterium
RPDDAWLATWSRAEAAVPHPI

SEQ ID NO: 1255111 - protein, 18 aa, Mycobacterium
RPDGAVVLRDIRRTYNGV

SEQ ID NO: 1255112 - protein, 21 aa, Mycobacterium
RPETAEKWLAEAGVGAYPPVF

SEQ ID NO: 1255113 - protein, 20 aa, Mycobacterium
RPFHGYDVFAMIPPPGPNDP

SEQ ID NO: 1255114 - protein, 18 aa, Mycobacterium
RPGAEPGTIRLALLDNVA

SEQ ID NO: 1255115 - protein, 22 aa, Mycobacterium
RPGAHARPDLPVLHPDDDLISE

SEQ ID NO: 1255116 - protein, 28 aa, Mycobacterium
RPGGERRLNVAVTRARREVVLYASFDPS

SEQ ID NO: 1255117 - protein, 18 aa, Mycobacterium
RPGGLVKIVARSHQYLGV

SEQ ID NO: 1255118 - protein, 19 aa, Mycobacterium
RPGYLEYLTPLVARRRAER

SEQ ID NO: 1255119 - protein, 17 aa, Mycobacterium
RPHCAHEAPAPPHVGPG

SEQ ID NO: 1255120 - protein, 17 aa, Mycobacterium
RPHHTMPESVGDGSDRD

SEQ ID NO: 1255121 - protein, 17 aa, Mycobacterium
RPIGMVIGLEVSGNPFI

SEQ ID NO: 1255122 - protein, 23 aa, Mycobacterium
RPIPRDELIAFFVAADVMLVTPL

SEQ ID NO: 1255123 - protein, 26 aa, Mycobacterium
RPLPGPLKWDLTTGIATATTQSLANS

SEQ ID NO: 1255124 - protein, 22 aa, Mycobacterium
RPNDFYRPNHQQIYNAILDLFG

SEQ ID NO: 1255125 - protein, 24 aa, Mycobacterium
RPNLAPHWVPAALIPDSTAALAAL

SEQ ID NO: 1255126 - protein, 19 aa, Mycobacterium
RPPQARPVYHAQRLAVSTA

SEQ ID NO: 1255127 - protein, 24 aa, Mycobacterium
RPRHGLDPIRFGLAAFVVTAPTQR

SEQ ID NO: 1255128 - protein, 19 aa, Mycobacterium
RPRRGDLTPAVTLVQSLHK

SEQ ID NO: 1255129 - protein, 18 aa, Mycobacterium
RPRVAVLEAVHAHPHADT

SEQ ID NO: 1255130 - protein, 19 aa, Mycobacterium
RPSPLSLDDVVKFLLPPAA

SEQ ID NO: 1255131 - protein, 18 aa, Mycobacterium
RPSREGRRGGAGESAGGA

SEQ ID NO: 1255132 - protein, 17 aa, Mycobacterium
RPVGAGIGRVVDAPDAL

SEQ ID NO: 1255133 - protein, 33 aa, Mycobacterium
RPVIAMYRLAPPVYDVLMGVFLRTFGFTSESTE

SEQ ID NO: 1255134 - protein, 17 aa, Mycobacterium
RPVQLIVAGKSHPADDG

SEQ ID NO: 1255135 - protein, 18 aa, Mycobacterium
RPVTLLDVRWQLAQPDGR

SEQ ID NO: 1255136 - protein, 19 aa, Mycobacterium
RPVVHLKPLLAPPLLDTVG

SEQ ID NO: 1255137 - protein, 21 aa, Mycobacterium
RPWGDLSLPALQLLISSLPKF

SEQ ID NO: 1255138 - protein, 18 aa, Mycobacterium
RPYLARSGYDAVPGGVAV

SEQ ID NO: 1255139 - protein, 35 aa, Mycobacterium
RQDPNKAIARFIVRYTEAFKRYGITDDTVQAATLA

SEQ ID NO: 1255140 - protein, 18 aa, Mycobacterium
RQEDVYNPLRFVKATMKW

SEQ ID NO: 1255141 - protein, 24 aa, Mycobacterium
RQEPWGVWGGEIFERGTIVARKRP

SEQ ID NO: 1255142 - protein, 18 aa, Mycobacterium
RQLLEIVRDGPWVGNEHL

SEQ ID NO: 1255143 - protein, 17 aa, Mycobacterium
RQLRLTAAMFPADIVAD

SEQ ID NO: 1255144 - protein, 31 aa, Mycobacterium
RQRALQCRAFLLSRAGAEWASGLPGEHNIGG

SEQ ID NO: 1255145 - protein, 17 aa, Mycobacterium
RQRLAIGSALFGLLRAD

SEQ ID NO: 1255146 - protein, 19 aa, Mycobacterium
RQRLLELVWGYDFDVDTNV

SEQ ID NO: 1255147 - protein, 20 aa, Mycobacterium
RQRLLELVWGYDFDVDTNVA

SEQ ID NO: 1255148 - protein, 21 aa, Mycobacterium
RQRNGKAYVYRAAMSREERSA

SEQ ID NO: 1255149 - protein, 21 aa, Mycobacterium
RQRPEWRRQLLDDIAPVATVS

SEQ ID NO: 1255150 - protein, 21 aa, Mycobacterium
RQSAPDWIKASPLSTGDANGY

SEQ ID NO: 1255151 - protein, 19 aa, Mycobacterium
RQVSFARDEENMWLVRDQQ

SEQ ID NO: 1255152 - protein, 23 aa, Mycobacterium
RQWRKVIPLLPGYRCITPTLPMG

SEQ ID NO: 1255153 - protein, 17 aa, Mycobacterium
RRAAALITQHTSRDDTG

SEQ ID NO: 1255154 - protein, 17 aa, Mycobacterium
RRATARTRGGDRAASPV

SEQ ID NO: 1255155 - protein, 24 aa, Mycobacterium
RRDEIGFQLALSMLPAEMRPGDHL

SEQ ID NO: 1255156 - protein, 18 aa, Mycobacterium
RRDEWLHRLFGRVVNLTF

SEQ ID NO: 1255157 - protein, 18 aa, Mycobacterium
RRDGKFVVPQMFFDRHGH

SEQ ID NO: 1255158 - protein, 23 aa, Mycobacterium
RRDHGGVIFIDLRDASGVSQVVF

SEQ ID NO: 1255159 - protein, 17 aa, Mycobacterium
RRDIGMVFQHFNLFPHR

SEQ ID NO: 1255160 - protein, 21 aa, Mycobacterium
RRDKHSGLLLAARVITLAHSV

SEQ ID NO: 1255161 - protein, 20 aa, Mycobacterium
RRDLPGLDVATAWLRARRPL

SEQ ID NO: 1255162 - protein, 25 aa, Mycobacterium
RRDRIDRLTALMLDNADAIVDAMAA

SEQ ID NO: 1255163 - protein, 18 aa, Mycobacterium
RREFGWKPLPAFDDGVLA

SEQ ID NO: 1255164 - protein, 25 aa, Mycobacterium
RRELRACPADERGYLLSTHIRALVA

SEQ ID NO: 1255165 - protein, 18 aa, Mycobacterium
RRFDVDWTGLGFSDQDLD

SEQ ID NO: 1255166 - protein, 25 aa, Mycobacterium
RRGDAWRLDGFKWFASNCDGEAFVV

SEQ ID NO: 1255167 - protein, 24 aa, Mycobacterium
RRGDLVDVRFNWHTMYFRYKTIDP

SEQ ID NO: 1255168 - protein, 18 aa, Mycobacterium
RRGFRSSCAPALTLETSF

SEQ ID NO: 1255169 - protein, 23 aa, Mycobacterium
RRGFSSAHIAEFFASMRAGADLA

SEQ ID NO: 1255170 - protein, 18 aa, Mycobacterium
RRGIVKVRELVAYVDGRS

SEQ ID NO: 1255171 - protein, 19 aa, Mycobacterium
RRGLTPWLAVPDRLVQLPL

SEQ ID NO: 1255172 - protein, 21 aa, Mycobacterium
RRGPCLEAADTGRAVRVAMAS

SEQ ID NO: 1255173 - protein, 18 aa, Mycobacterium
RRHPARLAQRIAHHLSQP

SEQ ID NO: 1255174 - protein, 22 aa, Mycobacterium
RRHSHCRYSSPAIYERTLTPAT

SEQ ID NO: 1255175 - protein, 21 aa, Mycobacterium
RRHSRCRYSSPVSYERSHAPA

SEQ ID NO: 1255176 - protein, 19 aa, Mycobacterium
RRHWAKQAAAPASVVTGNQ

SEQ ID NO: 1255177 - protein, 23 aa, Mycobacterium
RRHWIDIAAEWGLRDYWQQWEQV

SEQ ID NO: 1255178 - protein, 20 aa, Mycobacterium
RRIGADLRLVHERTGESVRE

SEQ ID NO: 1255179 - protein, 25 aa, Mycobacterium
RRILEKWGGGGVFVLDETLRPVPVG

SEQ ID NO: 1255180 - protein, 21 aa, Mycobacterium
RRINEVAQRIAALAETTQVIV

SEQ ID NO: 1255181 - protein, 19 aa, Mycobacterium
RRIPFEPDNGLVMSGLHHF

SEQ ID NO: 1255182 - protein, 27 aa, Mycobacterium
RRIRAELRYGYGLAISHKRVWRCMTLV

SEQ ID NO: 1255183 - protein, 24 aa, Mycobacterium
RRITACFFGDGAVAEGVFHESLNM

SEQ ID NO: 1255184 - protein, 19 aa, Mycobacterium
RRITEKKRRGTIKEGRRGG

SEQ ID NO: 1255185 - protein, 34 aa, Mycobacterium
RRIVEGGYELTLWARRPASLEPYADTAAKTAGSP

SEQ ID NO: 1255186 - protein, 21 aa, Mycobacterium
RRKEMLHNSALRGEHMKSHAA

SEQ ID NO: 1255187 - protein, 24 aa, Mycobacterium
RRKLHLRPIFMKSYSQLTQLISEF

SEQ ID NO: 1255188 - protein, 22 aa, Mycobacterium
RRLEPDPELLYVAAMFHDLGLT

SEQ ID NO: 1255189 - protein, 29 aa, Mycobacterium
RRLGLERQWLHARSLAFAHPADGRRIEIT

SEQ ID NO: 1255190 - protein, 17 aa, Mycobacterium
RRLGVALATAPDVIIAR

SEQ ID NO: 1255191 - protein, 18 aa, Mycobacterium
RRLKPRGAAAVSVVVTRL

SEQ ID NO: 1255192 - protein, 19 aa, Mycobacterium
RRLKQRTDLRLIVVDYLQL

SEQ ID NO: 1255193 - protein, 17 aa, Mycobacterium
RRLKRMRKLAARSAEAG

SEQ ID NO: 1255194 - protein, 30 aa, Mycobacterium
RRLLDAGSVSGEFADLLGLAGSQASVVTGA

SEQ ID NO: 1255195 - protein, 20 aa, Mycobacterium
RRLQELGVIRGFYTDINPSA

SEQ ID NO: 1255196 - protein, 20 aa, Mycobacterium
RRLRLGDGVQRIDALLNATD

SEQ ID NO: 1255197 - protein, 21 aa, Mycobacterium
RRLRSALWGGERSLERVTAVV

SEQ ID NO: 1255198 - protein, 20 aa, Mycobacterium
RRLSLLEGRLSIDLVTFDAA

SEQ ID NO: 1255199 - protein, 20 aa, Mycobacterium
RRLYVRPVMQPHPFNGDEET

SEQ ID NO: 1255200 - protein, 17 aa, Mycobacterium
RRNVPPGALAVSAGSQR

SEQ ID NO: 1255201 - protein, 18 aa, Mycobacterium
RRPALVAGASSGIGAATA

SEQ ID NO: 1255202 - protein, 22 aa, Mycobacterium
RRPELVDVPGAEVLRLDITDQA

SEQ ID NO: 1255203 - protein, 18 aa, Mycobacterium
RRPGPLTAPAGFRGVDRA

SEQ ID NO: 1255204 - protein, 24 aa, Mycobacterium
RRQVFRWLVRYNLRRRHSRCRYSS

SEQ ID NO: 1255205 - protein, 25 aa, Mycobacterium
RRRAGRTHPVWDFLFTYYSLRPRHL

SEQ ID NO: 1255206 - protein, 17 aa, Mycobacterium
RRRAVLDQLTTVLAVTP

SEQ ID NO: 1255207 - protein, 23 aa, Mycobacterium
RRRIVAAAARLFVENGYGATTMD

SEQ ID NO: 1255208 - protein, 23 aa, Mycobacterium
RRRLWARHRVFGARQLDMVGDAR

SEQ ID NO: 1255209 - protein, 17 aa, Mycobacterium
RRRVAVVGRDPRASGEM

SEQ ID NO: 1255210 - protein, 24 aa, Mycobacterium
RRRYHPRARSGWDREAGRLPADHP

SEQ ID NO: 1255211 - protein, 25 aa, Mycobacterium
RRSLERRLPLLEPLRYKLVEIPGRL

SEQ ID NO: 1255212 - protein, 18 aa, Mycobacterium
RRSTVGALARIVDYADLG

SEQ ID NO: 1255213 - protein, 26 aa, Mycobacterium
RRTAGLDLLPRLLIRGGELDLTVVRS

SEQ ID NO: 1255214 - protein, 21 aa, Mycobacterium
RRTEGRFALFSTGEPETTDTG

SEQ ID NO: 1255215 - protein, 24 aa, Mycobacterium
RRTLRCPYHAWTYALDGKLVAAPN

SEQ ID NO: 1255216 - protein, 20 aa, Mycobacterium
RRTTLLRPARLAGLRAEVEP

SEQ ID NO: 1255217 - protein, 21 aa, Mycobacterium
RRTTPMRLFWAREYSDYHPEQ

SEQ ID NO: 1255218 - protein, 19 aa, Mycobacterium
RRVEAPAVCYLDEAIALES

SEQ ID NO: 1255219 - protein, 24 aa, Mycobacterium
RRVFVHLCSAAQWTAITGEVAPPT

SEQ ID NO: 1255220 - protein, 19 aa, Mycobacterium
RRYEEGWQRGGINALSAAF

SEQ ID NO: 1255221 - protein, 17 aa, Mycobacterium
RRYGKPVAIAAGAGAVG

SEQ ID NO: 1255222 - protein, 21 aa, Mycobacterium
RRYGYFCFRTADGVLERLPHG

SEQ ID NO: 1255223 - protein, 21 aa, Mycobacterium
RSAVFDLALRAHLVSEPSGAV

SEQ ID NO: 1255224 - protein, 22 aa, Mycobacterium
RSDRTAFDIADRIEGDQLGDDL

SEQ ID NO: 1255225 - protein, 20 aa, Mycobacterium
RSEAYAGFRVPGRALMSGPV

SEQ ID NO: 1255226 - protein, 17 aa, Mycobacterium
RSEGCGILVLKRLSDAV

SEQ ID NO: 1255227 - protein, 19 aa, Mycobacterium
RSGAHGMVGYTFRMPGTGV

SEQ ID NO: 1255228 - protein, 28 aa, Mycobacterium
RSGDGGFGWEVTSGSLFRDDGQGWTGIP

SEQ ID NO: 1255229 - protein, 17 aa, Mycobacterium
RSGGILISGSAAGNSPI

SEQ ID NO: 1255230 - protein, 17 aa, Mycobacterium
RSGLIALLCKTDPSATP

SEQ ID NO: 1255231 - protein, 24 aa, Mycobacterium
RSGLYPREVPFVVGTEVCGTIEAV

SEQ ID NO: 1255232 - protein, 22 aa, Mycobacterium
RSKEMIKVRGFQVAPAEVEAVL

SEQ ID NO: 1255233 - protein, 19 aa, Mycobacterium
RSLEHLVDVVLHFEGDRNS

SEQ ID NO: 1255234 - protein, 17 aa, Mycobacterium
RSLNLFTTIPFVKDNLT

SEQ ID NO: 1255235 - protein, 20 aa, Mycobacterium
RSLPLSMARLTFGEVSIAQP

SEQ ID NO: 1255236 - protein, 17 aa, Mycobacterium
RSLWRSAGIPTTAPDGY

SEQ ID NO: 1255237 - protein, 22 aa, Mycobacterium
RSPRCRRAICVLDGRSASCHRG

SEQ ID NO: 1255238 - protein, 20 aa, Mycobacterium
RSQWAPIVFGCQAPDTGNAE

SEQ ID NO: 1255239 - protein, 23 aa, Mycobacterium
RSRADVPGGDMLDLLLSATDDVG

SEQ ID NO: 1255240 - protein, 20 aa, Mycobacterium
RSRCGLEERLVWQCASLLLS

SEQ ID NO: 1255241 - protein, 19 aa, Mycobacterium
RSRNGCLERGFPMPQPQQL

SEQ ID NO: 1255242 - protein, 20 aa, Mycobacterium
RSRPWPARGASLDFAAVWGL

SEQ ID NO: 1255243 - protein, 19 aa, Mycobacterium
RSRREVWNLVSSMAAQDIT

SEQ ID NO: 1255244 - protein, 17 aa, Mycobacterium
RSRSIRQNCAWPQTNSM

SEQ ID NO: 1255245 - protein, 20 aa, Mycobacterium
RSSCAPALTLETSFVTVVSI

SEQ ID NO: 1255246 - protein, 18 aa, Mycobacterium
RSSIPMFAANYLLNQADI

SEQ ID NO: 1255247 - protein, 23 aa, Mycobacterium
RSSNPTWRRLEAALAELEGASAA

SEQ ID NO: 1255248 - protein, 24 aa, Mycobacterium
RSTLIELLRLFAPLPTQLEGDAFG

SEQ ID NO: 1255249 - protein, 22 aa, Mycobacterium
RSVECSQIEWSLMIDAGAEPGR

SEQ ID NO: 1255250 - protein, 19 aa, Mycobacterium
RSVFQPHLFSEVIAEVISL

SEQ ID NO: 1255251 - protein, 20 aa, Mycobacterium
RSVIFAAELRDLTARHPDRL

SEQ ID NO: 1255252 - protein, 19 aa, Mycobacterium
RSYCRGWPTVMANASGSWV

SEQ ID NO: 1255253 - protein, 17 aa, Mycobacterium
RSYPQLVPFSAGPAECP

SEQ ID NO: 1255254 - protein, 20 aa, Mycobacterium
RTAEHIGGWSSRPLPLPDMC

SEQ ID NO: 1255255 - protein, 24 aa, Mycobacterium
RTAFAEAMTWLFGELIAQRAEEPV

SEQ ID NO: 1255256 - protein, 25 aa, Mycobacterium
RTAGQLRLFAAVLREGSWNGVRIDT

SEQ ID NO: 1255257 - protein, 18 aa, Mycobacterium
RTAGWMLPRGQGKSTLLA

SEQ ID NO: 1255258 - protein, 20 aa, Mycobacterium
RTALMQGFNALDQWGRFEEA

SEQ ID NO: 1255259 - protein, 24 aa, Mycobacterium
RTAWRICSQQGLWSVFGKKRGKNG

SEQ ID NO: 1255260 - protein, 22 aa, Mycobacterium
RTAYDELLLQFELPAGVEPVSG

SEQ ID NO: 1255261 - protein, 21 aa, Mycobacterium
RTDEPFKWVAPQLISPNGGAA

SEQ ID NO: 1255262 - protein, 25 aa, Mycobacterium
RTELDGLVVAAGFSGHGFKIAPAVG

SEQ ID NO: 1255263 - protein, 25 aa, Mycobacterium
RTERFAGAVGLNWYTTDPTLQFTLA

SEQ ID NO: 1255264 - protein, 22 aa, Mycobacterium
RTEVLDGLGHWWMVEDPTAGAA

SEQ ID NO: 1255265 - protein, 20 aa, Mycobacterium
RTFERFGIERFVRLMAAPAG

SEQ ID NO: 1255266 - protein, 20 aa, Mycobacterium
RTFHGAVLFALSPKDIERGE

SEQ ID NO: 1255267 - protein, 20 aa, Mycobacterium
RTFPLRSSFAPSYNMTINLV

SEQ ID NO: 1255268 - protein, 27 aa, Mycobacterium
RTGAGWQPDIWRGFAEELGILGATLPE

SEQ ID NO: 1255269 - protein, 19 aa, Mycobacterium
RTGNLWRAQGRRVRLELKH

SEQ ID NO: 1255270 - protein, 19 aa, Mycobacterium
RTGRFPGVDITLVVDRPHL

SEQ ID NO: 1255271 - protein, 25 aa, Mycobacterium
RTIMSKELACLTLGDAGAALLLERA

SEQ ID NO: 1255272 - protein, 23 aa, Mycobacterium
RTLVPFGPVADAFLVPAESDGGV

SEQ ID NO: 1255273 - protein, 23 aa, Mycobacterium
RTPAGKPDYRWAKEQTESRPADE

SEQ ID NO: 1255274 - protein, 27 aa, Mycobacterium
RTPVLRKLLWLLPDRFAPQLKPEVWAV

SEQ ID NO: 1255275 - protein, 28 aa, Mycobacterium
RTPWPAAPGRVYRAPWSLVANADPNGGD

SEQ ID NO: 1255276 - protein, 22 aa, Mycobacterium
RTRGLHARWLAWDDPAVLDADL

SEQ ID NO: 1255277 - protein, 19 aa, Mycobacterium
RTRSLLLDAAEEVFAEKGF

SEQ ID NO: 1255278 - protein, 21 aa, Mycobacterium
RTSFPGVSAYSASKFALEGWS

SEQ ID NO: 1255279 - protein, 17 aa, Mycobacterium
RTSVTWTLVSSSLLKSL

SEQ ID NO: 1255280 - protein, 21 aa, Mycobacterium
RTTPPPVRGALVARLGELLVE

SEQ ID NO: 1255281 - protein, 24 aa, Mycobacterium
RTVMKVEAWRAGSPTAQIQPEVIG

SEQ ID NO: 1255282 - protein, 18 aa, Mycobacterium
RTVWIKDLGCVVAVGSET

SEQ ID NO: 1255283 - protein, 17 aa, Mycobacterium
RTYRITHRTVYRYSDVV

SEQ ID NO: 1255284 - protein, 18 aa, Mycobacterium
RVAAGLMTPMPIPDDLAD

SEQ ID NO: 1255285 - protein, 24 aa, Mycobacterium
RVAELSAAMARRGHDVTVYTRRDD

SEQ ID NO: 1255286 - protein, 20 aa, Mycobacterium
RVAEQLGRTPAQVALAWTLN

SEQ ID NO: 1255287 - protein, 19 aa, Mycobacterium
RVAGETARFLIDDMGADAM

SEQ ID NO: 1255288 - protein, 19 aa, Mycobacterium
RVALLSATRYEWPIIDFAI

SEQ ID NO: 1255289 - protein, 25 aa, Mycobacterium
RVANGLSQLGFRVVPSDANFILFGE

SEQ ID NO: 1255290 - protein, 20 aa, Mycobacterium
RVAQYLVRNGYRAINVSGGI

SEQ ID NO: 1255291 - protein, 19 aa, Mycobacterium
RVCHARKPACGVCVLAKDC

SEQ ID NO: 1255292 - protein, 20 aa, Mycobacterium
RVCHARKPACGVCVLAKDCP

SEQ ID NO: 1255293 - protein, 27 aa, Mycobacterium
RVDGWPNQRFALLFPAWLAAHPEVRDE

SEQ ID NO: 1255294 - protein, 29 aa, Mycobacterium
RVEAAEVFQSWLGGLAAWFGQLDLTEAEC

SEQ ID NO: 1255295 - protein, 20 aa, Mycobacterium
RVESGRCVLDLRTVDPEEDA

SEQ ID NO: 1255296 - protein, 25 aa, Mycobacterium
RVFRSSGELHLDWWYDTRRVPQETV

SEQ ID NO: 1255297 - protein, 18 aa, Mycobacterium
RVGLRRRYYRVSGADAYT

SEQ ID NO: 1255298 - protein, 23 aa, Mycobacterium
RVGPAPWKSVLGMTGPTTLPIEF

SEQ ID NO: 1255299 - protein, 19 aa, Mycobacterium
RVHSGIVGFNAWLVNHLEN

SEQ ID NO: 1255300 - protein, 19 aa, Mycobacterium
RVIAPHVGGGFGSKGAPHA

SEQ ID NO: 1255301 - protein, 23 aa, Mycobacterium
RVILDRIDWSIGPGARIGLVGVN

SEQ ID NO: 1255302 - protein, 18 aa, Mycobacterium
RVLIDGLAGWGLDVHTVA

SEQ ID NO: 1255303 - protein, 26 aa, Mycobacterium
RVLPNGVCLLPPLKQCDKGNACLGCG

SEQ ID NO: 1255304 - protein, 22 aa, Mycobacterium
RVLQIRALVLGTAMDWLVDNSA

SEQ ID NO: 1255305 - protein, 19 aa, Mycobacterium
RVLQYVDTVECGMCGGSGL

SEQ ID NO: 1255306 - protein, 24 aa, Mycobacterium
RVLSPSMPSGVEWTDLLRRKDVLN

SEQ ID NO: 1255307 - protein, 19 aa, Mycobacterium
RVLVAAALAGLVPVGLNPT

SEQ ID NO: 1255308 - protein, 22 aa, Mycobacterium
RVMKKAVAYLLPYIEAEKEQNG

SEQ ID NO: 1255309 - protein, 34 aa, Mycobacterium; identical to SEQ ID NO: 1127783

SEQ ID NO: 1255310 - protein, 26 aa, Mycobacterium
RVPGEQGGAVARCYSLASSPHTDAAP

SEQ ID NO: 1255311 - protein, 20 aa, Mycobacterium
RVPGFDVDWAVRISKTSREQ

SEQ ID NO: 1255312 - protein, 19 aa, Mycobacterium
RVPLHAGVVAQLKMHRTQQ

SEQ ID NO: 1255313 - protein, 18 aa, Mycobacterium
RVPRLCTPLARRGAGHVG

SEQ ID NO: 1255314 - protein, 17 aa, Mycobacterium
RVQPVIVGLQLALTKLW

SEQ ID NO: 1255315 - protein, 18 aa, Mycobacterium
RVRAHLDLAVTWPHSLPG

SEQ ID NO: 1255316 - protein, 25 aa, Mycobacterium
RVRDRGRLRYPEWVDGGVDDAQVRT

SEQ ID NO: 1255317 - protein, 19 aa, Mycobacterium
RVRMRARCRQLATVVTVTG

SEQ ID NO: 1255318 - protein, 25 aa, Mycobacterium
RVRPGTDAWCLAAMAAVLVQEDLCD

SEQ ID NO: 1255319 - protein, 20 aa, Mycobacterium
RVRRLEARGVVTGYQAKINP

SEQ ID NO: 1255320 - protein, 19 aa, Mycobacterium
RVRRRIWELEKRRHHVPWV

SEQ ID NO: 1255321 - protein, 19 aa, Mycobacterium
RVSAFTLMGGFAERVAALP

SEQ ID NO: 1255322 - protein, 31 aa, Mycobacterium
RVSDVPSLGWRAYRRCPGSAGAWRPVDGVAI

SEQ ID NO: 1255323 - protein, 19 aa, Mycobacterium
RVSLMLPYLPVDKADPEEQ

SEQ ID NO: 1255324 - protein, 26 aa, Mycobacterium
RVSPTDFRLWVCLHEVTHRVQFGANP

SEQ ID NO: 1255325 - protein, 17 aa, Mycobacterium
RVSSLPYLVPVVEHGDQ

SEQ ID NO: 1255326 - protein, 17 aa, Mycobacterium
RVTEAWTKEGMLNEAER

SEQ ID NO: 1255327 - protein, 23 aa, Mycobacterium
RVTGMDAFRAWRLLVTEYGTPAP

SEQ ID NO: 1255328 - protein, 22 aa, Mycobacterium
RVVDVAFELDRLPPIEEVGSDR

SEQ ID NO: 1255329 - protein, 25 aa, Mycobacterium
RWGPPEAPLRYVLVFNGEIYNYLEL

SEQ ID NO: 1255330 - protein, 18 aa, Mycobacterium
RWGRPPNALVGIGVDAGV

SEQ ID NO: 1255331 - protein, 21 aa, Mycobacterium
RWLEDANTLPSLRENDEYFIV

SEQ ID NO: 1255332 - protein, 20 aa, Mycobacterium
RWPAGDVRGDILALCAARPS

SEQ ID NO: 1255333 - protein, 20 aa, Mycobacterium
RWPDRASLLRDTLMQIATAA

SEQ ID NO: 1255334 - protein, 20 aa, Mycobacterium
RWPVGEVFPVAPKMSEITLE

SEQ ID NO: 1255335 - protein, 19 aa, Mycobacterium
RWSGGEVDLTRPLPSDLIV

SEQ ID NO: 1255336 - protein, 22 aa, Mycobacterium
RWVFPHLPSFEELYCGSYGQNP

SEQ ID NO: 1255337 - protein, 19 aa, Mycobacterium
RYASLDFSEAAALPATDDD

SEQ ID NO: 1255338 - protein, 25 aa, Mycobacterium
RYDKLKRFPAGFVVLGDAFCSFNPI

SEQ ID NO: 1255339 - protein, 19 aa, Mycobacterium
RYDMHPTHYFVATTGDVYS

SEQ ID NO: 1255340 - protein, 24 aa, Mycobacterium
RYEGRAGAVLAWLRRYPAAEFTPP

SEQ ID NO: 1255341 - protein, 19 aa, Mycobacterium
RYFPPDVRPGAKPPGPPVL

SEQ ID NO: 1255342 - protein, 17 aa, Mycobacterium
RYGVLRDPFGHLWSMGQ

SEQ ID NO: 1255343 - protein, 24 aa, Mycobacterium
RYLTDWAGPSARIRSIGLRLGVPW

SEQ ID NO: 1255344 - protein, 19 aa, Mycobacterium
RYNAAAAADAWKRVQEWFS

SEQ ID NO: 1255345 - protein, 22 aa, Mycobacterium
RYPGDWRVIKGLTQPELAAAAK

SEQ ID NO: 1255346 - protein, 18 aa, Mycobacterium
RYSPFPGLTHAAFPSLDP

SEQ ID NO: 1255347 - protein, 26 aa, Mycobacterium
RYVSLRAGSDIALLGGVINYILSNEL

SEQ ID NO: 1255348 - protein, 22 aa, Mycobacterium
RYWRRYFDNFAEVMSSSDHIGA

SEQ ID NO: 1255349 - protein, 18 aa, Mycobacterium
SAAADPFAAAPSTGTGAV

SEQ ID NO: 1255350 - protein, 22 aa, Mycobacterium
SAAQAFDLFRWLGPSPDALLSA

SEQ ID NO: 1255351 - protein, 47 aa, Mycobacterium
SAARRRGWTAGRFSFNVAEGRCPTCQGEGFVSVELLFLPGTYATCPT

SEQ ID NO: 1255352 - protein, 18 aa, Mycobacterium
SAAVGRFVIGGWAEVLLL

SEQ ID NO: 1255353 - protein, 35 aa, Mycobacterium
SACTEYRAQWLICRALEVVLGWIADGNSGAVPADL

SEQ ID NO: 1255354 - protein, 17 aa, Mycobacterium
SADEWAHHYHGRLTDLP

SEQ ID NO: 1255355 - protein, 19 aa, Mycobacterium
SADLVGRFLLKGGETVWVD

SEQ ID NO: 1255356 - protein, 26 aa, Mycobacterium
SAEARIKLADMRSGRMSDDDWTKMAR

SEQ ID NO: 1255357 - protein, 19 aa, Mycobacterium
SAEGARPARTVAEACQGDV

SEQ ID NO: 1255358 - protein, 20 aa, Mycobacterium
SAEPLINVARDFMSTEKLTM

SEQ ID NO: 1255359 - protein, 18 aa, Mycobacterium
SAFDEFKPLYGTSLVTGW

SEQ ID NO: 1255360 - protein, 20 aa, Mycobacterium
SAFGPTGPWAQRLGYGPLVR

SEQ ID NO: 1255361 - protein, 17 aa, Mycobacterium
SAFVCALLAQFPDVSVS

SEQ ID NO: 1255362 - protein, 22 aa, Mycobacterium
SAGEALYDWNYQRQLLSIRLAE

SEQ ID NO: 1255363 - protein, 21 aa, Mycobacterium
SAGNADLFFLLGVPSDDAVRW

SEQ ID NO: 1255364 - protein, 23 aa, Mycobacterium
SAGPPCFLDPELRHLNDDHGDPS

SEQ ID NO: 1255365 - protein, 17 aa, Mycobacterium
SAHALDAAYWRSARDGL

SEQ ID NO: 1255366 - protein, 20 aa, Mycobacterium
SAKAAEYWCDLLAEHRPDEL

SEQ ID NO: 1255367 - protein, 26 aa, Mycobacterium
SALDGLGYRGFWMGYFAARSAPLGRV

SEQ ID NO: 1255368 - protein, 25 aa, Mycobacterium
SALPDRPAVLVPAFLSRGYHVRSDI

SEQ ID NO: 1255369 - protein, 17 aa, Mycobacterium
SALPELRAKLADSQLNL

SEQ ID NO: 1255370 - protein, 17 aa, Mycobacterium
SALSGGQQDTWERLWPE

SEQ ID NO: 1255371 - protein, 18 aa, Mycobacterium
SAMASMPLKPYAHQTTAV

SEQ ID NO: 1255372 - protein, 24 aa, Mycobacterium
SANDKGVVPLNFGPLSRPGGERRL

SEQ ID NO: 1255373 - protein, 18 aa, Mycobacterium
SANIGVWVRAGASEATGN

SEQ ID NO: 1255374 - protein, 25 aa, Mycobacterium
SAPGFSDESVRVFLATGISEIDRPD

SEQ ID NO: 1255375 - protein, 23 aa, Mycobacterium
SAPRAAQLEACFEELSELAGKRN

SEQ ID NO: 1255376 - protein, 22 aa, Mycobacterium
SAPRRGPFRLMPAVSVAEAAWA

SEQ ID NO: 1255377 - protein, 22 aa, Mycobacterium
SAPRYPDLLPNGAIDSRSGERG

SEQ ID NO: 1255378 - protein, 18 aa, Mycobacterium
SAPTRLRLPDLLHATDRG

SEQ ID NO: 1255379 - protein, 17 aa, Mycobacterium
SARARIRPGEWVTVVGA

SEQ ID NO: 1255380 - protein, 21 aa, Mycobacterium
SARNRFAGLVTDVVSDTVMSQ

SEQ ID NO: 1255381 - protein, 22 aa, Mycobacterium
SASYLPLMRVLRRLAGEGRDHL

SEQ ID NO: 1255382 - protein, 23 aa, Mycobacterium
SASYRPLISPLRAAGVPRPSRRN

SEQ ID NO: 1255383 - protein, 22 aa, Mycobacterium
SATARRLLVDPVEIGPIRLVGV

SEQ ID NO: 1255384 - protein, 19 aa, Mycobacterium
SAVAFQSAHARFIEASAKI

SEQ ID NO: 1255385 - protein, 27 aa, Mycobacterium
SAVATAVWNAVCWAIIIPAGRLRTGDA

SEQ ID NO: 1255386 - protein, 26 aa, Mycobacterium
SAVGHHWRYSAAVGLVRDMLGDSVVR

SEQ ID NO: 1255387 - protein, 26 aa, Mycobacterium
SAVGMGRFALGRAVDYVKTRQVWKTP

SEQ ID NO: 1255388 - protein, 19 aa, Mycobacterium
SAVTGARVDLAFAATGRPR

SEQ ID NO: 1255389 - protein, 17 aa, Mycobacterium
SAYGALLGRSGNRGPTA

SEQ ID NO: 1255390 - protein, 20 aa, Mycobacterium
SCAQWLRWYDGEVMPTLVDA

SEQ ID NO: 1255391 - protein, 20 aa, Mycobacterium
SCGLLAAPMPARPCTDLLPG

SEQ ID NO: 1255392 - protein, 18 aa, Mycobacterium
SCGRRIGADLRLVHERTG

SEQ ID NO: 1255393 - protein, 22 aa, Mycobacterium
SCGSTSRLLLHEAIADEVIDLV

SEQ ID NO: 1255394 - protein, 20 aa, Mycobacterium
SCNAPSRMLVPSSRMDEAIE

SEQ ID NO: 1255395 - protein, 18 aa, Mycobacterium
SCVLGRRLASVSYPVEQG

SEQ ID NO: 1255396 - protein, 20 aa, Mycobacterium
SDAIYLRAFEEFIHHNLVLR

SEQ ID NO: 1255397 - protein, 17 aa, Mycobacterium
SDEGPVFITFDVSPSDK

SEQ ID NO: 1255398 - protein, 17 aa, Mycobacterium
SDELRRWADSGAIDVHL

SEQ ID NO: 1255399 - protein, 18 aa, Mycobacterium
SDEQWRRTFAVNIDSFFR

SEQ ID NO: 1255400 - protein, 24 aa, Mycobacterium
SDFLSEAVLRIALLAQSGDALGYV

SEQ ID NO: 1255401 - protein, 32 aa, Mycobacterium
SDFTVWVLRVRRVRWVGGYGRMDSCSGADYAA

SEQ ID NO: 1255402 - protein, 24 aa, Mycobacterium
SDGGRAALVLGDWPETPAGDLPAL

SEQ ID NO: 1255403 - protein, 25 aa, Mycobacterium
SDGIKDLRFGACLDDDWAEADPDEF

SEQ ID NO: 1255404 - protein, 28 aa, Mycobacterium
SDGLARARRMGIGTVDTGVQGLIEHAEF

SEQ ID NO: 1255405 - protein, 23 aa, Mycobacterium
SDGRIHGVHVWIGPPNLEPPERP

SEQ ID NO: 1255406 - protein, 17 aa, Mycobacterium
SDGRYVAVGAIEPQFYA

SEQ ID NO: 1255407 - protein, 22 aa, Mycobacterium
SDGVLCVPALAGLAAPWWDSAA

SEQ ID NO: 1255408 - protein, 21 aa, Mycobacterium
SDHARPGMVVGLDSVGGDFTM

SEQ ID NO: 1255409 - protein, 19 aa, Mycobacterium
SDHTPVWVLLAKLVAGGLL

SEQ ID NO: 1255410 - protein, 21 aa, Mycobacterium
SDHYSPWLAAQGHAPSAWTTL

SEQ ID NO: 1255411 - protein, 31 aa, Mycobacterium
SDLGCRGVGRLLWLKAFDRVSVRSTYEDETG

SEQ ID NO: 1255412 - protein, 19 aa, Mycobacterium
SDLGPAMVYESLRHYADAG

SEQ ID NO: 1255413 - protein, 19 aa, Mycobacterium
SDLPWHRVIGASGRPAPHL

SEQ ID NO: 1255414 - protein, 22 aa, Mycobacterium
SDLRHLFDALGVDWEQAVASAE

SEQ ID NO: 1255415 - protein, 25 aa, Mycobacterium
SDPDECVRLAAAVVEQTGRLDVLVA

SEQ ID NO: 1255416 - protein, 24 aa, Mycobacterium
SDPEIGLLLPCNVVVRADTTHGND

SEQ ID NO: 1255417 - protein, 17 aa, Mycobacterium
SDPMRKLLMGAPNAPEL

SEQ ID NO: 1255418 - protein, 27 aa, Mycobacterium
SDPTAWRHNEHWLAPDFLDPAADVCVS

SEQ ID NO: 1255419 - protein, 17 aa, Mycobacterium
SDPVTAWLPELADMQVL

SEQ ID NO: 1255420 - protein, 23 aa, Mycobacterium
SDQAIGEGFRSRWTGNLDPAATL

SEQ ID NO: 1255421 - protein, 22 aa, Mycobacterium
SDQLPGGSAYVIGEAGLTTALH

SEQ ID NO: 1255422 - protein, 18 aa, Mycobacterium
SDRWKDWVVRDATVVTRK

SEQ ID NO: 1255423 - protein, 23 aa, Mycobacterium
SDVTAGPTYRLFGIPVTVTNKLA

SEQ ID NO: 1255424 - protein, 17 aa, Mycobacterium
SDWCRFNSAGPLFIDPG

SEQ ID NO: 1255425 - protein, 17 aa, Mycobacterium
SDYPAGTALDLIPIRIV

SEQ ID NO: 1255426 - protein, 22 aa, Mycobacterium
SEAIPIAAALGFYEVEQEVCTR

SEQ ID NO: 1255427 - protein, 23 aa, Mycobacterium
SEAPTTLAAMTWLASGPDLGPWA

SEQ ID NO: 1255428 - protein, 31 aa, Mycobacterium; identical to SEQ ID NO: 730415

SEQ ID NO: 1255429 - protein, 24 aa, Mycobacterium
SEEVPRIAAALADFDEVEIDTDTS

SEQ ID NO: 1255430 - protein, 35 aa, Mycobacterium
SEGLDRIFIDAGAEWRQAGCSMCLGMNPDQLSPGQ

SEQ ID NO: 1255431 - protein, 28 aa, Mycobacterium
SEIMAKLVMRPRIARRYAAVEGHRALFA

SEQ ID NO: 1255432 - protein, 20 aa, Mycobacterium
SEKAKWAANELHATKSDLVE

SEQ ID NO: 1255433 - protein, 21 aa, Mycobacterium
SELRNVLEALLLVVDTPATVD

SEQ ID NO: 1255434 - protein, 21 aa, Mycobacterium
SEMGLRLASRRVVLDHAVVGT

SEQ ID NO: 1255435 - protein, 20 aa, Mycobacterium
SEPEPRWPAAPDGVLVMLIE

SEQ ID NO: 1255436 - protein, 24 aa, Mycobacterium
SETARFCTQFIKLGLGGCDIGVSY

SEQ ID NO: 1255437 - protein, 25 aa, Mycobacterium
SEVFLDRVALCFIDDEFGVENRHKL

SEQ ID NO: 1255438 - protein, 25 aa, Mycobacterium
SEVHWVAPEDAVWACRTLAATHYTS

SEQ ID NO: 1255439 - protein, 23 aa, Mycobacterium
SEVVEALAAFIVEGIDRLGGALL

SEQ ID NO: 1255440 - protein, 19 aa, Mycobacterium
SFEPNPGWTRTYSGSAEIL

SEQ ID NO: 1255441 - protein, 17 aa, Mycobacterium
SFTLGFAVSRLDASGGR

SEQ ID NO: 1255442 - protein, 25 aa, Mycobacterium
SFTPRFFGHTGLRPEAARPHAFDGD

SEQ ID NO: 1255443 - protein, 26 aa, Mycobacterium
SFVEAARRAGFRWVEDLSGLDADVPV

SEQ ID NO: 1255444 - protein, 18 aa, Mycobacterium
SFYPGRGGLLYVASKFAV

SEQ ID NO: 1255445 - protein, 17 aa, Mycobacterium
SGALRARVVDQYRQPFD

SEQ ID NO: 1255446 - protein, 20 aa, Mycobacterium
SGALSALVCGGVDVTDLPDP

SEQ ID NO: 1255447 - protein, 22 aa, Mycobacterium
SGAPIARPALDVPMADDERQSA

SEQ ID NO: 1255448 - protein, 22 aa, Mycobacterium
SGFERRGRWNVPRRLTTMALFG

SEQ ID NO: 1255449 - protein, 17 aa, Mycobacterium
SGGALWLPASQVIDGDG

SEQ ID NO: 1255450 - protein, 26 aa, Mycobacterium
SGGDLARAFWRRMIDNVEQYLDEGVR

SEQ ID NO: 1255451 - protein, 21 aa, Mycobacterium
SGGFGTLLLLGHDWASPEATY

SEQ ID NO: 1255452 - protein, 25 aa, Mycobacterium
SGGGRSEAVLSHFVAQIDAEESADL

SEQ ID NO: 1255453 - protein, 26 aa, Mycobacterium
SGGRFAVNIVNAWWVPDLERSGIGML

SEQ ID NO: 1255454 - protein, 21 aa, Mycobacterium
SGHYPAFCGTVGPGFADGAVV

SEQ ID NO: 1255455 - protein, 20 aa, Mycobacterium
SGIPRPEWSEAGVGSDSHSG

SEQ ID NO: 1255456 - protein, 19 aa, Mycobacterium
SGKDWQVWAGDQVTDFVRL

SEQ ID NO: 1255457 - protein, 17 aa, Mycobacterium
SGKSDILAGAFRRSADR

SEQ ID NO: 1255458 - protein, 26 aa, Mycobacterium
SGKSPAQVVLRWHVQRGDIIFPKSVT

SEQ ID NO: 1255459 - protein, 22 aa, Mycobacterium
SGLDVRGSFIVRLADLNGYLGA

SEQ ID NO: 1255460 - protein, 18 aa, Mycobacterium
SGLNRAILGKGWHQFALA

SEQ ID NO: 1255461 - protein, 20 aa, Mycobacterium
SGLPDALFDEWFRPAVENAA

SEQ ID NO: 1255462 - protein, 19 aa, Mycobacterium
SGMPRLYREAPLMGIWEGS

SEQ ID NO: 1255463 - protein, 23 aa, Mycobacterium
SGMPRLYREAPLMGIWEGSGNVS

SEQ ID NO: 1255464 - protein, 19 aa, Mycobacterium
SGNYLPKFGPYLSSGSNPW

SEQ ID NO: 1255465 - protein, 21 aa, Mycobacterium
SGQRLAARRLPEGLSGIRALH

SEQ ID NO: 1255466 - protein, 19 aa, Mycobacterium
SGRAFCAGAHLGSMATIGD

SEQ ID NO: 1255467 - protein, 24 aa, Mycobacterium
SGRRDMTGWLAGKRALIVGGGSGI

SEQ ID NO: 1255468 - protein, 21 aa, Mycobacterium
SGRSDAPGWLTSRGWWTDVVE

SEQ ID NO: 1255469 - protein, 25 aa, Mycobacterium
SGRTVTGLVLKWLTGESRSDSSSRF

SEQ ID NO: 1255470 - protein, 20 aa, Mycobacterium
SGSKFPELRMREWKSNIGPD

SEQ ID NO: 1255471 - protein, 25 aa, Mycobacterium
SGSRMRPDVVIKFMDRFGDVIYNNY

SEQ ID NO: 1255472 - protein, 22 aa, Mycobacterium
SGTEPIAVIGLGCRMPGGISDP

SEQ ID NO: 1255473 - protein, 19 aa, Mycobacterium
SGTPPVGMAGVAPMAPHAP

SEQ ID NO: 1255474 - protein, 25 aa, Mycobacterium
SGVEHIPCWLITDIRSFHRYVVGGH

SEQ ID NO: 1255475 - protein, 20 aa, Mycobacterium
SGVLLGLVGPVIAPVLALSA

SEQ ID NO: 1255476 - protein, 17 aa, Mycobacterium
SGYALGGGFEMALMCDI

SEQ ID NO: 1255477 - protein, 17 aa, Mycobacterium
SHDWPDRDLRVTAIDTA

SEQ ID NO: 1255478 - protein, 24 aa, Mycobacterium
SHLYPDSLRTMGWDIDASGFRLVL

SEQ ID NO: 1255479 - protein, 22 aa, Mycobacterium
SHTGLAERFRHHFGYVEDEGSA

SEQ ID NO: 1255480 - protein, 18 aa, Mycobacterium
SHVDRLAHRVFRHEHGAP

SEQ ID NO: 1255481 - protein, 31 aa, Mycobacterium
SHVPARPRPMVLRWPAVRRTARSAGTDNAVP

SEQ ID NO: 1255482 - protein, 27 aa, Mycobacterium
SIARYKLPKAVVFRAAIQRSPAGKADY

SEQ ID NO: 1255483 - protein, 19 aa, Mycobacterium
SIDSWGRYAYGNQPSIAAW

SEQ ID NO: 1255484 - protein, 24 aa, Mycobacterium
SIFDPRRLAGLLGMPDGAEPVAVL

SEQ ID NO: 1255485 - protein, 18 aa, Mycobacterium
SIGVPGIVRLLQTAHEAH

SEQ ID NO: 1255486 - protein, 25 aa, Mycobacterium
SIREVLRSPAIFEWFDIAGVDDIPP

SEQ ID NO: 1255487 - protein, 18 aa, Mycobacterium
SIRRRSFGTLSTLDSSGN

SEQ ID NO: 1255488 - protein, 18 aa, Mycobacterium
SISLLSWIMNPERGLAAS

SEQ ID NO: 1255489 - protein, 17 aa, Mycobacterium
SKAWPGSVRFVHSRIED

SEQ ID NO: 1255490 - protein, 25 aa, Mycobacterium
SKMGLFPFRRNLAFYAVDLALLTLT

SEQ ID NO: 1255491 - protein, 31 aa, Mycobacterium
SKPPLPEPWALPIKWDHWGQLFESKTLGERL

SEQ ID NO: 1255492 - protein, 27 aa, Mycobacterium
SKRCLVPMDGWYEWRPNPAEGGKKKAA

SEQ ID NO: 1255493 - protein, 18 aa, Mycobacterium
SKTASYCNYKGWATYWSA

SEQ ID NO: 1255494 - protein, 21 aa, Mycobacterium
SLAGRPSNIGTRFHNHLYEVL

SEQ ID NO: 1255495 - protein, 26 aa, Mycobacterium
SLDHVAGRPYGLWVHGNNDTVGAVNA

SEQ ID NO: 1255496 - protein, 23 aa, Mycobacterium
SLEENFGIFLWLRSLDSPPEKKY

SEQ ID NO: 1255497 - protein, 27 aa, Mycobacterium
SLLPMPDLIRLAARAHHYLYVYDQHSG

SEQ ID NO: 1255498 - protein, 28 aa, Mycobacterium
SLLPMPDLIRLAARAHHYLYVYDQHSGQ

SEQ ID NO: 1255499 - protein, 21 aa, Mycobacterium
SLLRPGGELRYLEHIAETGAR

SEQ ID NO: 1255500 - protein, 28 aa, Mycobacterium
SLNMAALWRLPVLFCCENNLYAMGTALE

SEQ ID NO: 1255501 - protein, 22 aa, Mycobacterium
SLPHRRFDAAVGNVPFSAARVH

SEQ ID NO: 1255502 - protein, 27 aa, Mycobacterium
SLPMGSEALALLRLPLVLPTLQVAGRL

SEQ ID NO: 1255503 - protein, 27 aa, Mycobacterium
SLQDHAWRIAAKLNWPDTYQAEYIALT

SEQ ID NO: 1255504 - protein, 17 aa, Mycobacterium
SLRAVIHAAAPCPVDVK

SEQ ID NO: 1255505 - protein, 17 aa, Mycobacterium
SLRLIADTIEFCAAEVP

SEQ ID NO: 1255506 - protein, 22 aa, Mycobacterium
SLRTLGLRKIRQSVVREDNAQT

SEQ ID NO: 1255507 - protein, 18 aa, Mycobacterium
SLSKLKPAFTDIGAMGGF

SEQ ID NO: 1255508 - protein, 27 aa, Mycobacterium
SLSLRLPVRRPFAYEGVFGHLAASAVP

SEQ ID NO: 1255509 - protein, 20 aa, Mycobacterium
SLTGSHVLPALIRRYDEAVA

SEQ ID NO: 1255510 - protein, 20 aa, Mycobacterium
SLVAQLVWRRHRERVDGLVL

SEQ ID NO: 1255511 - protein, 18 aa, Mycobacterium
SLVPPMTCDPAFTDLLSG

SEQ ID NO: 1255512 - protein, 26 aa, Mycobacterium
SLYAVLCARALGAGAVRYADNDPLRL

SEQ ID NO: 1255513 - protein, 18 aa, Mycobacterium
SLYTEFLERCGPGLHHVC

SEQ ID NO: 1255514 - protein, 25 aa, Mycobacterium
SLYVYARETVGFALSIDGRVHSPTS

SEQ ID NO: 1255515 - protein, 22 aa, Mycobacterium
SMGRNGGGWAHYVGQEKCRPVT

SEQ ID NO: 1255516 - protein, 19 aa, Mycobacterium
SMMRIGALLRRQSMADVDA

SEQ ID NO: 1255517 - protein, 28 aa, Mycobacterium
SMQRKRFGRIILIGSVSGMWGIGNQANY

SEQ ID NO: 1255518 - protein, 25 aa, Mycobacterium
SMRAAGRGRIVLVSSAGGVRGQPAI

SEQ ID NO: 1255519 - protein, 19 aa, Mycobacterium
SMVSRGAGVIVNISSAATR

SEQ ID NO: 1255520 - protein, 18 aa, Mycobacterium
SNATLWPLYHDLIVKPIY

SEQ ID NO: 1255521 - protein, 23 aa, Mycobacterium
SNEGLRSRFTRGITLPSYSVDEL

SEQ ID NO: 1255522 - protein, 22 aa, Mycobacterium
SNLRPTHDGLGYFGFNDNAKAY

SEQ ID NO: 1255523 - protein, 17 aa, Mycobacterium
SNPRFSVSRVDIDRGGP

SEQ ID NO: 1255524 - protein, 26 aa, Mycobacterium
SNPRLDIPRMLELFGSGRLMLDELIT

SEQ ID NO: 1255525 - protein, 27 aa, Mycobacterium
SNYLYPRVEVEVGFILADDLPGAGCTE

SEQ ID NO: 1255526 - protein, 24 aa, Mycobacterium
SPACERLLWLPDLVAAAYRRTITH

SEQ ID NO: 1255527 - protein, 25 aa, Mycobacterium
SPAGDDWLCLLEAFDQPHRSGLVRA

SEQ ID NO: 1255528 - protein, 24 aa, Mycobacterium
SPAPLDEIDRILARELVADGRATL

SEQ ID NO: 1255529 - protein, 19 aa, Mycobacterium
SPDFPRTVVDGIRDATNRV

SEQ ID NO: 1255530 - protein, 19 aa, Mycobacterium
SPDGWPQRPTYSGWLDSPD

SEQ ID NO: 1255531 - protein, 21 aa, Mycobacterium
SPEALVVLWAALRSGLYITAI

SEQ ID NO: 1255532 - protein, 25 aa, Mycobacterium
SPFDSPGRWGGPPGTPFPRQPEVPA

SEQ ID NO: 1255533 - protein, 19 aa, Mycobacterium
SPGRWTGRGLAALADTGAR

SEQ ID NO: 1255534 - protein, 25 aa, Mycobacterium
SPGTRLPTVRELAGQMGLAVNTVAR

SEQ ID NO: 1255535 - protein, 17 aa, Mycobacterium
SPLPPAVRESFRAATGV

SEQ ID NO: 1255536 - protein, 17 aa, Mycobacterium
SPLRIGLDLIGIAEGAP

SEQ ID NO: 1255537 - protein, 24 aa, Mycobacterium
SPMEAWATLRAELRRPPAELAATA

SEQ ID NO: 1255538 - protein, 23 aa, Mycobacterium
SPMELPDSALLRLKRMYPGATYR

SEQ ID NO: 1255539 - protein, 20 aa, Mycobacterium
SPRGELAEAEFAMDGLADDP

SEQ ID NO: 1255540 - protein, 27 aa, Mycobacterium
SPRPWIAEPVVKFLCPAPGYDRHFALT

SEQ ID NO: 1255541 - protein, 19 aa, Mycobacterium
SPRVARLYFATAVRLCRVR

SEQ ID NO: 1255542 - protein, 19 aa, Mycobacterium
SPSGHTWVVGGGYVAGLGD

SEQ ID NO: 1255543 - protein, 19 aa, Mycobacterium
SPSRWKATQYLMGNHTIAE

SEQ ID NO: 1255544 - protein, 32 aa, Mycobacterium
SPTEIAYILVLRTEFPNGFVATVRGVFTYQVD

SEQ ID NO: 1255545 - protein, 31 aa, Mycobacterium
SPTPSGLCSYPLRQCSDGDLYGGTEPARTWY

SEQ ID NO: 1255546 - protein, 17 aa, Mycobacterium
SPVAASLLPPGPLGPPP

SEQ ID NO: 1255547 - protein, 24 aa, Mycobacterium
SPYAAAKLYSYWITKNYREAYGLF

SEQ ID NO: 1255548 - protein, 19 aa, Mycobacterium
SQATVFNWEGSKGTPQIDL

SEQ ID NO: 1255549 - protein, 26 aa, Mycobacterium
SQGVLFPKHRTDLIGCAITVQRMLTG

SEQ ID NO: 1255550 - protein, 20 aa, Mycobacterium
SQLPAAKRGIGVGFESYALY

SEQ ID NO: 1255551 - protein, 18 aa, Mycobacterium
SQRCAELTTHPAVLAGRE

SEQ ID NO: 1255552 - protein, 24 aa, Mycobacterium
SQWSAPYANHVMPLSGDLPTGGEL

SEQ ID NO: 1255553 - protein, 17 aa, Mycobacterium
SRAAARTGAGWQPDIWR

SEQ ID NO: 1255554 - protein, 18 aa, Mycobacterium
SRAAIRTDTILGRKNIEI

SEQ ID NO: 1255555 - protein, 20 aa, Mycobacterium
SRAAKAVLISAVPPIMVQTE

SEQ ID NO: 1255556 - protein, 17 aa, Mycobacterium
SRAGDWFGSPVNLASRV

SEQ ID NO: 1255557 - protein, 24 aa, Mycobacterium
SRARCFPKGLAAFIDLRDQTCRTP

SEQ ID NO: 1255558 - protein, 22 aa, Mycobacterium
SRAREVLLTRVVDLAINRRRVA

SEQ ID NO: 1255559 - protein, 19 aa, Mycobacterium
SRASWRCVQSADKEGWLAL

SEQ ID NO: 1255560 - protein, 17 aa, Mycobacterium
SRATWQRHHVHAEALRV

SEQ ID NO: 1255561 - protein, 24 aa, Mycobacterium
SRDEWILDWRFTRDARAQRRAARH

SEQ ID NO: 1255562 - protein, 22 aa, Mycobacterium
SRDPRIAAAVAQIPFNGFPKKV

SEQ ID NO: 1255563 - protein, 23 aa, Mycobacterium
SREDLLRFARPMIHQLLLGPLPD

SEQ ID NO: 1255564 - protein, 22 aa, Mycobacterium
SREPLLWSEANPRAAERAATFI

SEQ ID NO: 1255565 - protein, 19 aa, Mycobacterium
SRFLVSIPTPFNAVNSFAE

SEQ ID NO: 1255566 - protein, 20 aa, Mycobacterium
SRFYPLLYLLTRVDGARDFG

SEQ ID NO: 1255567 - protein, 18 aa, Mycobacterium
SRGEPGAWTGDGESDHRQ

SEQ ID NO: 1255568 - protein, 22 aa, Mycobacterium
SRGFFTSRVIRTFVNEAMAMLG

SEQ ID NO: 1255569 - protein, 26 aa, Mycobacterium
SRGGGRYSVYPWALLVMALARIGLGP

SEQ ID NO: 1255570 - protein, 19 aa, Mycobacterium
SRGQVWLMPHNPAFEPIPG

SEQ ID NO: 1255571 - protein, 18 aa, Mycobacterium
SRHAPTYVYRYDYAPRTL

SEQ ID NO: 1255572 - protein, 17 aa, Mycobacterium
SRIDHVFEFARTRRCVL

SEQ ID NO: 1255573 - protein, 18 aa, Mycobacterium
SRLAGPVSIGCYSTLAAS

SEQ ID NO: 1255574 - protein, 17 aa, Mycobacterium
SRLSAPRRLFLGSTAAK

SEQ ID NO: 1255575 - protein, 30 aa, Mycobacterium
SRMLGKPGDGWRLAMDLLPYERSTCFWQRI

SEQ ID NO: 1255576 - protein, 19 aa, Mycobacterium
SRPLIPERMPVLLDDDLLF

SEQ ID NO: 1255577 - protein, 20 aa, Mycobacterium
SRPRAGTLVVPRPSGNTYAQ

SEQ ID NO: 1255578 - protein, 34 aa, Mycobacterium
SRPRSRVLHPIWEWDGTDLFGWIATVPSPVKRAH

SEQ ID NO: 1255579 - protein, 25 aa, Mycobacterium
SRPSAELRTLIGLRDAAVALVEAEA

SEQ ID NO: 1255580 - protein, 20 aa, Mycobacterium
SRPSPLSLDDVVKFLLPPAA

SEQ ID NO: 1255581 - protein, 25 aa, Mycobacterium
SRQPWMRWGGPCFDRVAAWRRRGSC

SEQ ID NO: 1255582 - protein, 21 aa, Mycobacterium
SRRALDTTIVRPGRLTDDPGT

SEQ ID NO: 1255583 - protein, 19 aa, Mycobacterium
SRRGKLWSYTENRYAPPPP

SEQ ID NO: 1255584 - protein, 19 aa, Mycobacterium
SRRGTLWSYTENRYAPPPP

SEQ ID NO: 1255585 - protein, 19 aa, Mycobacterium
SRRSAWWAGTATLGVAKIV

SEQ ID NO: 1255586 - protein, 24 aa, Mycobacterium
SRSRCFPKGLAAFIDLRDQTCRTP

SEQ ID NO: 1255587 - protein, 20 aa, Mycobacterium
SRTQLPITTWQQHFADATTG

SEQ ID NO: 1255588 - protein, 20 aa, Mycobacterium
SRVPSAIGLPLGAEEGDVNL

SEQ ID NO: 1255589 - protein, 20 aa, Mycobacterium
SRVSGWLTPEARAHWDVIAA

SEQ ID NO: 1255590 - protein, 18 aa, Mycobacterium
SRVTGWLTPEARAHWDLI

SEQ ID NO: 1255591 - protein, 17 aa, Mycobacterium
SRWPREGADLTGERVGV

SEQ ID NO: 1255592 - protein, 21 aa, Mycobacterium
SRYAFLPYYRTGAVSALRQAF

SEQ ID NO: 1255593 - protein, 18 aa, Mycobacterium
SRYGNFIGGEWVAPAGGE

SEQ ID NO: 1255594 - protein, 18 aa, Mycobacterium
SRYIPMLAGVGAARPAKD

SEQ ID NO: 1255595 - protein, 18 aa, Mycobacterium
SSCAALGAEVYGRRQVPD

SEQ ID NO: 1255596 - protein, 23 aa, Mycobacterium
SSDLRVGQDVVAIGSPLGLEGTV

SEQ ID NO: 1255597 - protein, 20 aa, Mycobacterium
SSFYPGRGGLLYVASKFAVR

SEQ ID NO: 1255598 - protein, 17 aa, Mycobacterium
SSGRLGLDHDRVLMGRY

SEQ ID NO: 1255599 - protein, 19 aa, Mycobacterium
SSGRRAWVTNSYDDSVSVI

SEQ ID NO: 1255600 - protein, 19 aa, Mycobacterium
SSLNFSFDYFEVGLADGPG

SEQ ID NO: 1255601 - protein, 18 aa, Mycobacterium
SSLQTSRMAFHAIKAGEG

SEQ ID NO: 1255602 - protein, 23 aa, Mycobacterium
SSQMRRGDMLFWGPNASQHVALY

SEQ ID NO: 1255603 - protein, 24 aa, Mycobacterium
SSRSAELGRVLARCSYLCDGVAVR

SEQ ID NO: 1255604 - protein, 19 aa, Mycobacterium
SSSGLTTSVAWRLRGQTSY

SEQ ID NO: 1255605 - protein, 27 aa, Mycobacterium
SSVLAQMMWAFRAMGMWSDERGVNMLD

SEQ ID NO: 1255606 - protein, 19 aa, Mycobacterium
STAGHARRRVAVVGRDPRA

SEQ ID NO: 1255607 - protein, 25 aa, Mycobacterium
STALRAAAVLACYRYHADAHGLVGP

SEQ ID NO: 1255608 - protein, 21 aa, Mycobacterium
STGLQSGWDLFLPHLHPLIAN

SEQ ID NO: 1255609 - protein, 19 aa, Mycobacterium
STIARGRVAAVDTDAARAI

SEQ ID NO: 1255610 - protein, 18 aa, Mycobacterium
STILLPHDYLTYWLTGRP

SEQ ID NO: 1255611 - protein, 25 aa, Mycobacterium
STKAATTIIQGWAFYETAMTGDISA

SEQ ID NO: 1255612 - protein, 29 aa, Mycobacterium
STLLVEGRAGVVVPALWTVRRITDGGGSA

SEQ ID NO: 1255613 - protein, 25 aa, Mycobacterium
STNGELRKRCVLQLHEAIEGELAEL

SEQ ID NO: 1255614 - protein, 21 aa, Mycobacterium
STPAWLGAFANPGAMDLDLPA

SEQ ID NO: 1255615 - protein, 23 aa, Mycobacterium
STRQRMVAIEFGFPAPEVEEGIV

SEQ ID NO: 1255616 - protein, 19 aa, Mycobacterium
STTVFSIAARWVFPHLPSF

SEQ ID NO: 1255617 - protein, 26 aa, Mycobacterium
STVVAADWTRLGAAYRTRAPMHILDD

SEQ ID NO: 1255618 - protein, 32 aa, Mycobacterium
STWPPAEIALAWSRDRARAMPEIEQAVERLAD

SEQ ID NO: 1255619 - protein, 27 aa, Mycobacterium
SVAAARRLGVPEGKWVYLRGHADQTEQ

SEQ ID NO: 1255620 - protein, 18 aa, Mycobacterium
SVAGKCPAVLGAPDADLL

SEQ ID NO: 1255621 - protein, 18 aa, Mycobacterium
SVALAEVVIHGWDVALAT

SEQ ID NO: 1255622 - protein, 25 aa, Mycobacterium
SVAYRLGRSAARVEAALSAPSIFGR

SEQ ID NO: 1255623 - protein, 20 aa, Mycobacterium
SVDAFIDMAGAFVGKDVDVV

SEQ ID NO: 1255624 - protein, 30 aa, Mycobacterium
SVFADKGWSKNVWDTIGATWRDRWSDEVAA

SEQ ID NO: 1255625 - protein, 26 aa, Mycobacterium
SVGHFEWLENLGFQFERSYYPGKVVV

SEQ ID NO: 1255626 - protein, 25 aa, Mycobacterium
SVGLRRIGPSAARVDGCLARLRVDR

SEQ ID NO: 1255627 - protein, 18 aa, Mycobacterium
SVHFVCVGTPQLSDSDAA

SEQ ID NO: 1255628 - protein, 18 aa, Mycobacterium
SVIRAVWTSDEFSFEGRH

SEQ ID NO: 1255629 - protein, 21 aa, Mycobacterium
SVKEFQRRWEATRNPRGGRPR

SEQ ID NO: 1255630 - protein, 17 aa, Mycobacterium
SVKHLAYAYLNGHDPGD

SEQ ID NO: 1255631 - protein, 21 aa, Mycobacterium
SVKPEILLPGGRSLHQRPPVA

SEQ ID NO: 1255632 - protein, 32 aa, Mycobacterium
SVLLPIGPRRELWARLGGALKPPHLADLSHDV

SEQ ID NO: 1255633 - protein, 19 aa, Mycobacterium
SVLLSDPWATTRFAEHEVV

SEQ ID NO: 1255634 - protein, 17 aa, Mycobacterium
SVMLMLIGAAVRDHRQF

SEQ ID NO: 1255635 - protein, 26 aa, Mycobacterium
SVQQEWLRAASLGFVATVDAQGHLDV

SEQ ID NO: 1255636 - protein, 23 aa, Mycobacterium
SVSCAIQNMWLAARAEGLGMGWV

SEQ ID NO: 1255637 - protein, 30 aa, Mycobacterium
SVSPAEQRTRFAIRLVDPLRHWKFSDMDIE

SEQ ID NO: 1255638 - protein, 19 aa, Mycobacterium
SVSPLRAAYILDADGTARF

SEQ ID NO: 1255639 - protein, 23 aa, Mycobacterium
SVVSLLPPWAIRMGARAYRKLGM

SEQ ID NO: 1255640 - protein, 17 aa, Mycobacterium
SVVSPLFSAFGPEPIVT

SEQ ID NO: 1255641 - protein, 20 aa, Mycobacterium
SWGLITCTKPAGKESEGIND

SEQ ID NO: 1255642 - protein, 18 aa, Mycobacterium
SWPAGALRLERFSSSTVE

SEQ ID NO: 1255643 - protein, 20 aa, Mycobacterium
SWSDPEIRWIMSTVPTAMIF

SEQ ID NO: 1255644 - protein, 19 aa, Mycobacterium
SWWRHARGMKLRKGGDGLG

SEQ ID NO: 1255645 - protein, 18 aa, Mycobacterium
SYAAFAEPVFAAFSQPGP

SEQ ID NO: 1255646 - protein, 17 aa, Mycobacterium
SYARKRGLPVLGLCLGL

SEQ ID NO: 1255647 - protein, 24 aa, Mycobacterium
SYDRLKAELDQLIANRPVIAAEIN

SEQ ID NO: 1255648 - protein, 18 aa, Mycobacterium
SYEEIDWDTAISEIAAGF

SEQ ID NO: 1255649 - protein, 18 aa, Mycobacterium
SYEEIDWDTAISEIATGF

SEQ ID NO: 1255650 - protein, 18 aa, Mycobacterium
SYGGVEFYAALGQGSPER

SEQ ID NO: 1255651 - protein, 21 aa, Mycobacterium
SYKPNPRWSRRYAEQPEILKY

SEQ ID NO: 1255652 - protein, 20 aa, Mycobacterium
SYPSLCLLATRLPETSKAGA

SEQ ID NO: 1255653 - protein, 21 aa, Mycobacterium
SYRMMEGFGVHTFRLTGPDGS

SEQ ID NO: 1255654 - protein, 26 aa, Mycobacterium
TAAQRWGTEWATCSGMSMPASIEKLA

SEQ ID NO: 1255655 - protein, 26 aa, Mycobacterium
TACPSTAWACGLMAVHAHTVANYSPV

SEQ ID NO: 1255656 - protein, 28 aa, Mycobacterium
TACVPIADHIAYRFVGRGEPSEDVIQVA

SEQ ID NO: 1255657 - protein, 19 aa, Mycobacterium
TADAIILARIVIGRAAARH

SEQ ID NO: 1255658 - protein, 19 aa, Mycobacterium
TADALRTVLRTVLDGHEVL

SEQ ID NO: 1255659 - protein, 24 aa, Mycobacterium
TADEVPGVLIARGLAEQSGKRIRL

SEQ ID NO: 1255660 - protein, 17 aa, Mycobacterium
TADEVREGLAILDQALD

SEQ ID NO: 1255661 - protein, 20 aa, Mycobacterium
TADGFAALFRAFYMALDERQ

SEQ ID NO: 1255662 - protein, 18 aa, Mycobacterium
TADGRPAGAMLLGAASTD

SEQ ID NO: 1255663 - protein, 22 aa, Mycobacterium
TAEDLARLWAINVDGVLWGIQA

SEQ ID NO: 1255664 - protein, 22 aa, Mycobacterium
TAEEMYKYLVAMSREPEHDKIR

SEQ ID NO: 1255665 - protein, 26 aa, Mycobacterium
TAEFEFRAGPVFTNLLLADEINRTPP

SEQ ID NO: 1255666 - protein, 18 aa, Mycobacterium
TAERTAALLAERGVAQID

SEQ ID NO: 1255667 - protein, 17 aa, Mycobacterium
TAFDGIGAMGGFDDVAL

SEQ ID NO: 1255668 - protein, 25 aa, Mycobacterium
TAGLRWPDLALRAGRVGYPALRDAL

SEQ ID NO: 1255669 - protein, 17 aa, Mycobacterium
TAHVRIIQDFVRKLPAW

SEQ ID NO: 1255670 - protein, 30 aa, Mycobacterium
TAHVRIIQDFVRKLPAWVSWERRDHYERDL

SEQ ID NO: 1255671 - protein, 19 aa, Mycobacterium
TAIDLARRYPVDKSVPAID

SEQ ID NO: 1255672 - protein, 17 aa, Mycobacterium
TAKKAGAAVALYEEPDV

SEQ ID NO: 1255673 - protein, 26 aa, Mycobacterium
TALDRSRPLWELYYAEGLANGRVAVI

SEQ ID NO: 1255674 - protein, 19 aa, Mycobacterium
TALGVFKRSDLIGQTVSIA

SEQ ID NO: 1255675 - protein, 24 aa, Mycobacterium
TALPRPTADLHRRDALWAAALQTA

SEQ ID NO: 1255676 - protein, 17 aa, Mycobacterium
TALREKRIVGVRGSDGR

SEQ ID NO: 1255677 - protein, 17 aa, Mycobacterium
TALVAWKTGVSPANAKT

SEQ ID NO: 1255678 - protein, 19 aa, Mycobacterium
TALVSRWVLELVSTHPDIT

SEQ ID NO: 1255679 - protein, 17 aa, Mycobacterium
TAMPFGLAPLRDVFELL

SEQ ID NO: 1255680 - protein, 24 aa, Mycobacterium
TANRLRARFEPRFPHVHPHRLRHS

SEQ ID NO: 1255681 - protein, 23 aa, Mycobacterium
TARKRFENITVLETRAALATTDM

SEQ ID NO: 1255682 - protein, 17 aa, Mycobacterium
TARRPELVDVPGAEVLR

SEQ ID NO: 1255683 - protein, 17 aa, Mycobacterium
TASGGGRNGHVKSSDDK

SEQ ID NO: 1255684 - protein, 24 aa, Mycobacterium
TASPRLRLVGVAGYEAACGQDVNA

SEQ ID NO: 1255685 - protein, 31 aa, Mycobacterium
TATAAALSHRVWLRPFRNLVYVMPPYICTPE

SEQ ID NO: 1255686 - protein, 19 aa, Mycobacterium
TATGFCLALTLTGCSFQGV

SEQ ID NO: 1255687 - protein, 24 aa, Mycobacterium
TATPRIVEFLGEMNLRSTVFVIGA

SEQ ID NO: 1255688 - protein, 18 aa, Mycobacterium
TATSPFDSPGRWGGPPGT

SEQ ID NO: 1255689 - protein, 19 aa, Mycobacterium
TATVIALDQVTGWVGAHDA

SEQ ID NO: 1255690 - protein, 18 aa, Mycobacterium
TAVADLIAFCAGVGVDLI

SEQ ID NO: 1255691 - protein, 20 aa, Mycobacterium
TAVDVLSRIVARDGAQVSAT

SEQ ID NO: 1255692 - protein, 24 aa, Mycobacterium
TAYQRYATLLGRWVDEHNLGRRDT

SEQ ID NO: 1255693 - protein, 22 aa, Mycobacterium
TCASMGVVAARIFTPAEMFSSP

SEQ ID NO: 1255694 - protein, 22 aa, Mycobacterium
TCGTSVPARGVLRQAYLADGVA

SEQ ID NO: 1255695 - protein, 18 aa, Mycobacterium
TCRRAYEAYVERYGALNR

SEQ ID NO: 1255696 - protein, 22 aa, Mycobacterium
TCSGMSMPASIEKLAAISDEDA

SEQ ID NO: 1255697 - protein, 18 aa, Mycobacterium
TDALERYGRPVLVHEPTS

SEQ ID NO: 1255698 - protein, 24 aa, Mycobacterium
TDAPDRLRWVIGEAGKAIEDGIGF

SEQ ID NO: 1255699 - protein, 21 aa, Mycobacterium
TDARFNLSRAALLVVALTERP

SEQ ID NO: 1255700 - protein, 19 aa, Mycobacterium
TDASNLWIIDERLAFHDYL

SEQ ID NO: 1255701 - protein, 24 aa, Mycobacterium
TDDGKSAASLFSWTHDAAAGHEAG

SEQ ID NO: 1255702 - protein, 26 aa, Mycobacterium
TDDLIPLRLAIPAQFRAEGDPDTPRR

SEQ ID NO: 1255703 - protein, 25 aa, Mycobacterium
TDEDYREAIALSRLGWAALAVGTSH

SEQ ID NO: 1255704 - protein, 23 aa, Mycobacterium
TDELWAEAGKLGFIGVNLPEEYG

SEQ ID NO: 1255705 - protein, 20 aa, Mycobacterium
TDFRSWARADLELEPGRTVF

SEQ ID NO: 1255706 - protein, 26 aa, Mycobacterium
TDGGWRLRTRAMTFIRRSGEHDSGRP

SEQ ID NO: 1255707 - protein, 22 aa, Mycobacterium
TDKVGLRKGYAVDSQRTRAVRD

SEQ ID NO: 1255708 - protein, 17 aa, Mycobacterium
TDLVNWTLVTDGDGVLL

SEQ ID NO: 1255709 - protein, 29 aa, Mycobacterium
TDPGQRLELAFDYRVLWAEPLPGKVRRRG

SEQ ID NO: 1255710 - protein, 20 aa, Mycobacterium
TDPWSPRYLRVYGTAEVVGG

SEQ ID NO: 1255711 - protein, 23 aa, Mycobacterium
TDPYPKLVCWIGTADGDTSVCSK

SEQ ID NO: 1255712 - protein, 24 aa, Mycobacterium
TDRARLVWEPRRIVPTYAVPLDAL

SEQ ID NO: 1255713 - protein, 20 aa, Mycobacterium
TDRASSLGGVLSQAAKAREG

SEQ ID NO: 1255714 - protein, 21 aa, Mycobacterium
TDRFLKEILVAFADGPVVVGP

SEQ ID NO: 1255715 - protein, 24 aa, Mycobacterium
TDTEAMDAFSLLCRTEGIIPAIES

SEQ ID NO: 1255716 - protein, 23 aa, Mycobacterium
TDTWLVHRMCGAFVTDTSTASRS

SEQ ID NO: 1255717 - protein, 21 aa, Mycobacterium
TDVDLPWRVSFDGDVRQVHPS

SEQ ID NO: 1255718 - protein, 23 aa, Mycobacterium
TDVPDMFRLLSVLSPGTPDHDRQ

SEQ ID NO: 1255719 - protein, 17 aa, Mycobacterium
TDVVLWPSVNHHLPELW

SEQ ID NO: 1255720 - protein, 25 aa, Mycobacterium
TDWWFVVGAARMFARTHVNPDVPPP

SEQ ID NO: 1255721 - protein, 24 aa, Mycobacterium
TEAGRRIRDAFVVGDGYTEVMTAD

SEQ ID NO: 1255722 - protein, 25 aa, Mycobacterium
TEAYGRLTVVTIHFAAQTPLPLLEM

SEQ ID NO: 1255723 - protein, 23 aa, Mycobacterium
TEDKEWIACLVPVFRAGQEAGLT

SEQ ID NO: 1255724 - protein, 19 aa, Mycobacterium
TEEGYAILIGYGLQTDWVK

SEQ ID NO: 1255725 - protein, 19 aa, Mycobacterium
TEFAANSAEGWDMALTSTR

SEQ ID NO: 1255726 - protein, 21 aa, Mycobacterium
TEIACVQNAFNLADRTSQPVL

SEQ ID NO: 1255727 - protein, 18 aa, Mycobacterium
TEIFPGGRLPSIPMVEER

SEQ ID NO: 1255728 - protein, 18 aa, Mycobacterium
TEIVCVQNAFNLVDRSAQ

SEQ ID NO: 1255729 - protein, 27 aa, Mycobacterium
TELLPTLEAGMVPKIEACLRAVTEGVP

SEQ ID NO: 1255730 - protein, 25 aa, Mycobacterium
TEPFGGRVPPIWIGASGPRMLDLVG

SEQ ID NO: 1255731 - protein, 26 aa, Mycobacterium
TEPGLVLSGFVDRVGDPVPLVASDGS

SEQ ID NO: 1255732 - protein, 23 aa, Mycobacterium
TEPRSLLEPGRRGVVRLFGGPGT

SEQ ID NO: 1255733 - protein, 23 aa, Mycobacterium
TERCAPFKVWKALGRIPVKGGAR

SEQ ID NO: 1255734 - protein, 18 aa, Mycobacterium
TETARIPLLDNVSTHGPT

SEQ ID NO: 1255735 - protein, 19 aa, Mycobacterium
TEVAGYRLPAGVMVVPGIG

SEQ ID NO: 1255736 - protein, 17 aa, Mycobacterium
TFADVPAGWRVVFGEAT

SEQ ID NO: 1255737 - protein, 17 aa, Mycobacterium
TFDLVIVDEAHRSIYGV

SEQ ID NO: 1255738 - protein, 22 aa, Mycobacterium
TFKTALWELIWAGWVTGDTFAP

SEQ ID NO: 1255739 - protein, 25 aa, Mycobacterium
TFRGCEGDSLLMLLDAKGIECSTGS

SEQ ID NO: 1255740 - protein, 18 aa, Mycobacterium
TFRTIHRYALPNRFTVAK

SEQ ID NO: 1255741 - protein, 30 aa, Mycobacterium
TFSQPYPAWRELFNNILPAHIVKDVPGGFG

SEQ ID NO: 1255742 - protein, 21 aa, Mycobacterium
TFTRAYLEQVQWFRQVDDDSS

SEQ ID NO: 1255743 - protein, 21 aa, Mycobacterium
TGAGAWPETDESLFTDRASSL

SEQ ID NO: 1255744 - protein, 19 aa, Mycobacterium
TGAGRGGMPFLSRVNENAV

SEQ ID NO: 1255745 - protein, 19 aa, Mycobacterium
TGARPKVLLLPLGPLAEHN

SEQ ID NO: 1255746 - protein, 18 aa, Mycobacterium
TGATCRQLIEEGVLHRDF

SEQ ID NO: 1255747 - protein, 20 aa, Mycobacterium
TGDGHGWGSWAAEIYADLGL

SEQ ID NO: 1255748 - protein, 24 aa, Mycobacterium
TGDLFATHGLPWCDGARELLEALA

SEQ ID NO: 1255749 - protein, 23 aa, Mycobacterium
TGEEFPLLPGTMYLLDGHERHRV

SEQ ID NO: 1255750 - protein, 25 aa, Mycobacterium
TGELFCARDPFGIKPLYIATGPGGT

SEQ ID NO: 1255751 - protein, 18 aa, Mycobacterium
TGEPLDFRGEFYRHTLMT

SEQ ID NO: 1255752 - protein, 29 aa, Mycobacterium
TGEPRRGDFRYAVSNSFGLGGHNIVLVFG

SEQ ID NO: 1255753 - protein, 21 aa, Mycobacterium
TGFDFPFAAMGSVHIENHITQ

SEQ ID NO: 1255754 - protein, 22 aa, Mycobacterium
TGFGEIFLDDVFVPDADVIGEV

SEQ ID NO: 1255755 - protein, 18 aa, Mycobacterium
TGGIRSVFQPHLFSEVIA

SEQ ID NO: 1255756 - protein, 17 aa, Mycobacterium
TGGSAGSYGRLIVTPDM

SEQ ID NO: 1255757 - protein, 20 aa, Mycobacterium
TGGVPVLLRCRLLRAELTPP

SEQ ID NO: 1255758 - protein, 24 aa, Mycobacterium
TGHCAAALLGSRWIPPDAPVEIAH

SEQ ID NO: 1255759 - protein, 17 aa, Mycobacterium
TGIPAFKAPFEPLTPGG

SEQ ID NO: 1255760 - protein, 21 aa, Mycobacterium
TGLFLLQNMFGVWPVDGVVTD

SEQ ID NO: 1255761 - protein, 21 aa, Mycobacterium
TGLPAAHYDGTWSLAREIADV

SEQ ID NO: 1255762 - protein, 21 aa, Mycobacterium
TGLPEGLPLIVGGADHVLSAY

SEQ ID NO: 1255763 - protein, 23 aa, Mycobacterium
TGLSDWLARKSFHALHQVRGKLA

SEQ ID NO: 1255764 - protein, 21 aa, Mycobacterium
TGMTCGHCEMSVREEVSDVDG

SEQ ID NO: 1255765 - protein, 34 aa, Mycobacterium
TGPILSGARRWCPMRRWIDIGAFDDGAPTRLPGS

SEQ ID NO: 1255766 - protein, 17 aa, Mycobacterium
TGQHGVAPFTRISIFDS

SEQ ID NO: 1255767 - protein, 17 aa, Mycobacterium
TGQPCDVRRGSAVSLPF

SEQ ID NO: 1255768 - protein, 22 aa, Mycobacterium
TGRATWDSALLLFLERSGYSEE

SEQ ID NO: 1255769 - protein, 20 aa, Mycobacterium
TGRGSVKMRGVVEIEEDSRG

SEQ ID NO: 1255770 - protein, 20 aa, Mycobacterium
TGRRGKYLWLTLDDGDEPLA

SEQ ID NO: 1255771 - protein, 22 aa, Mycobacterium
TGSLRVNFLRRLVAGGECRYSA

SEQ ID NO: 1255772 - protein, 24 aa, Mycobacterium
TGSMAAAWTRKGVRVNCIACGAIR

SEQ ID NO: 1255773 - protein, 19 aa, Mycobacterium
TGTQPLAFLSPEAKEALGT

SEQ ID NO: 1255774 - protein, 23 aa, Mycobacterium
TGVRLWPAQPLTLVAPWDGEVGS

SEQ ID NO: 1255775 - protein, 25 aa, Mycobacterium
TGVSRDRCYAILRAIGRPVGQARGR

SEQ ID NO: 1255776 - protein, 19 aa, Mycobacterium
TGYRCVWLGVNQENRRAQR

SEQ ID NO: 1255777 - protein, 17 aa, Mycobacterium
TGYSRIFKALAASRTAD

SEQ ID NO: 1255778 - protein, 17 aa, Mycobacterium
THLRAHNPVAWVDSPPY

SEQ ID NO: 1255779 - protein, 24 aa, Mycobacterium
THPEPELAAIIGRRIKAAQPEQAL

SEQ ID NO: 1255780 - protein, 27 aa, Mycobacterium
THPSSMGLRFQVPFDCGVLAVKASWGR

SEQ ID NO: 1255781 - protein, 20 aa, Mycobacterium
THRLRLAMRNLNAEDVPDLS

SEQ ID NO: 1255782 - protein, 26 aa, Mycobacterium
THYHKIHLYDAFGFRESRTVAPGSEP

SEQ ID NO: 1255783 - protein, 19 aa, Mycobacterium
TIHGYRRAFRIAGEGPAIL

SEQ ID NO: 1255784 - protein, 18 aa, Mycobacterium
TIIESGVRSGEFIDVSPE

SEQ ID NO: 1255785 - protein, 27 aa, Mycobacterium
TIPCQECSRPFPLIGRLNLRQPSTRRN

SEQ ID NO: 1255786 - protein, 23 aa, Mycobacterium
TIPRARTAVPVEFDEFRQQLERL

SEQ ID NO: 1255787 - protein, 20 aa, Mycobacterium
TIRKGRRVSAATAFLKPAMR

SEQ ID NO: 1255788 - protein, 24 aa, Mycobacterium
TIRNWPRRRYALSKTANTYARVLL

SEQ ID NO: 1255789 - protein, 26 aa, Mycobacterium
TITEFEPGRRWSWQVAGIPATAHGVE

SEQ ID NO: 1255790 - protein, 24 aa, Mycobacterium
TITRLRDDYFWQADEHMIGVVDAF

SEQ ID NO: 1255791 - protein, 19 aa, Mycobacterium
TIVGRELLGYLANRNILPK

SEQ ID NO: 1255792 - protein, 19 aa, Mycobacterium
TIYFMPFFDTRDGPVVIEI

SEQ ID NO: 1255793 - protein, 22 aa, Mycobacterium
TKALLVHAATWGPMRDELTRAI

SEQ ID NO: 1255794 - protein, 19 aa, Mycobacterium
TKDHIEAIANWDPEADPSI

SEQ ID NO: 1255795 - protein, 25 aa, Mycobacterium
TKGYFQWSAMSWFALADAGFAPEVW

SEQ ID NO: 1255796 - protein, 22 aa, Mycobacterium
TKHLKAYLEMAARGVESVTDGG

SEQ ID NO: 1255797 - protein, 25 aa, Mycobacterium
TKIERQGWHALITMRLNGDVELPAN

SEQ ID NO: 1255798 - protein, 28 aa, Mycobacterium
TKLLILPPLMHGAAQWAVMTALTTGQTV

SEQ ID NO: 1255799 - protein, 19 aa, Mycobacterium
TKLPDEVRIVAAANPPDRS

SEQ ID NO: 1255800 - protein, 33 aa, Mycobacterium
TKQALTEAVLWPLQHPDTFERLGIEPPRGVLLY

SEQ ID NO: 1255801 - protein, 20 aa, Mycobacterium
TKRMLVQAAMALWRTNGYAN

SEQ ID NO: 1255802 - protein, 17 aa, Mycobacterium
TKRPSKKAPAADNEKAS

SEQ ID NO: 1255803 - protein, 17 aa, Mycobacterium
TKRSETFTTADDNQPSV

SEQ ID NO: 1255804 - protein, 18 aa, Mycobacterium
TKRSETFTTADDNQPSVQ

SEQ ID NO: 1255805 - protein, 24 aa, Mycobacterium
TKSSGWRLTGQKVWTSAAHKAHWG

SEQ ID NO: 1255806 - protein, 17 aa, Mycobacterium
TLAARLTERYGVTVEVR

SEQ ID NO: 1255807 - protein, 22 aa, Mycobacterium
TLACQPANLLIEKTGWTTQRPG

SEQ ID NO: 1255808 - protein, 25 aa, Mycobacterium
TLADIRAAFYSAPRLPLLYEADRDL

SEQ ID NO: 1255809 - protein, 18 aa, Mycobacterium
TLARRLGLERQWLHARSL

SEQ ID NO: 1255810 - protein, 23 aa, Mycobacterium
TLARSAHCPVALVRHNTDGYVLA

SEQ ID NO: 1255811 - protein, 17 aa, Mycobacterium
TLDEVLAAVGMSRSTYY

SEQ ID NO: 1255812 - protein, 23 aa, Mycobacterium
TLDREPYALGMVTEFAANSAEGW

SEQ ID NO: 1255813 - protein, 18 aa, Mycobacterium
TLDTAWPGDVIGLANAAA

SEQ ID NO: 1255814 - protein, 18 aa, Mycobacterium
TLEPPTMLRFEGDADNAV

SEQ ID NO: 1255815 - protein, 23 aa, Mycobacterium
TLERPEILVDFEVGESVTVMDGP

SEQ ID NO: 1255816 - protein, 17 aa, Mycobacterium
TLFGSGVSPGFAELLAI

SEQ ID NO: 1255817 - protein, 19 aa, Mycobacterium
TLIELERHLYAEAGVDDGD

SEQ ID NO: 1255818 - protein, 25 aa, Mycobacterium
TLIPRPQRMYLRFAPPIDTARPARV

SEQ ID NO: 1255819 - protein, 18 aa, Mycobacterium
TLLGRLSAFFSAAMHAES

SEQ ID NO: 1255820 - protein, 24 aa, Mycobacterium
TLPDARGPLSLAVVNTLAERAPRN

SEQ ID NO: 1255821 - protein, 26 aa, Mycobacterium
TLSAWCKSAGVPIRHRRGVVVAEPVP

SEQ ID NO: 1255822 - protein, 19 aa, Mycobacterium
TLVYCCGPQGLLTAVEERC

SEQ ID NO: 1255823 - protein, 25 aa, Mycobacterium
TLWVLEGHGFLGYWRTDAALDTVSS

SEQ ID NO: 1255824 - protein, 19 aa, Mycobacterium
TMAALRFAIQGGPGLVTVV

SEQ ID NO: 1255825 - protein, 28 aa, Mycobacterium
TMARPMYRARGWVPWRGPTSVLSPGGRI

SEQ ID NO: 1255826 - protein, 23 aa, Mycobacterium
TMPGRLGDTYCRFHQYSLANQLL

SEQ ID NO: 1255827 - protein, 24 aa, Mycobacterium
TMPLLRLPIHGSYLMQLYSLSPRV

SEQ ID NO: 1255828 - protein, 23 aa, Mycobacterium
TMRQGEKVLLLFGSANRDERAFP

SEQ ID NO: 1255829 - protein, 25 aa, Mycobacterium
TNALLDAGCRTTVWNRTAARADGVR

SEQ ID NO: 1255830 - protein, 25 aa, Mycobacterium
TNGYSRLTWAVLDWNENAIALYDAV

SEQ ID NO: 1255831 - protein, 17 aa, Mycobacterium
TNKRLAADVAELVVSLG

SEQ ID NO: 1255832 - protein, 17 aa, Mycobacterium
TNLGRLVLNEPAPLPCT

SEQ ID NO: 1255833 - protein, 19 aa, Mycobacterium
TNMVHYWSLRQSDLRDLQR

SEQ ID NO: 1255834 - protein, 23 aa, Mycobacterium
TNPDCPDRIAGLVDEAVHSGLAD

SEQ ID NO: 1255835 - protein, 19 aa, Mycobacterium
TNSPGALLRGRVERMHRSC

SEQ ID NO: 1255836 - protein, 18 aa, Mycobacterium
TNVAAFRWGRAAIADPIR

SEQ ID NO: 1255837 - protein, 27 aa, Mycobacterium
TNVMPQWAGSSWYELRYTDPLNKEALC

SEQ ID NO: 1255838 - protein, 26 aa, Mycobacterium
TPAAPTRGAPLCTFRETARTLAGLAD

SEQ ID NO: 1255839 - protein, 25 aa, Mycobacterium
TPAIRSRLGLALSRATDRGSLVSTT

SEQ ID NO: 1255840 - protein, 24 aa, Mycobacterium
TPALPAWPGMEGYTGDLLHSADYR

SEQ ID NO: 1255841 - protein, 17 aa, Mycobacterium
TPAVDWASSGLRVPTRV

SEQ ID NO: 1255842 - protein, 22 aa, Mycobacterium
TPDLPATVFGERVRTWAQTADR

SEQ ID NO: 1255843 - protein, 22 aa, Mycobacterium
TPEKQFTLFFDDVRVPAANLIG

SEQ ID NO: 1255844 - protein, 21 aa, Mycobacterium
TPFITFRVWHPLSHDRMEILS

SEQ ID NO: 1255845 - protein, 27 aa, Mycobacterium
TPHRGKEWLFRHLLHLVDPAIYPDPGS

SEQ ID NO: 1255846 - protein, 23 aa, Mycobacterium
TPIGDAVGYTVRFTDQASDRTLV

SEQ ID NO: 1255847 - protein, 22 aa, Mycobacterium
TPKGRARSLLRHWEPKRRGIYC

SEQ ID NO: 1255848 - protein, 21 aa, Mycobacterium
TPNHLSWNWFGNRLRGRRYGW

SEQ ID NO: 1255849 - protein, 17 aa, Mycobacterium
TPNNVEWILAHPTGITE

SEQ ID NO: 1255850 - protein, 21 aa, Mycobacterium
TPQFRRTLAWFIARRPDGSIA

SEQ ID NO: 1255851 - protein, 17 aa, Mycobacterium
TPRHPLEGLDLLHGGAW

SEQ ID NO: 1255852 - protein, 23 aa, Mycobacterium
TPRPEYRFPGLNPGDRWCVTATN

SEQ ID NO: 1255853 - protein, 25 aa, Mycobacterium
TPTRAAIEAMWEWVTASSDTLKTVT

SEQ ID NO: 1255854 - protein, 22 aa, Mycobacterium
TPVGLVAVCRMPEVSLDEVLGA

SEQ ID NO: 1255855 - protein, 17 aa, Mycobacterium
TPVPPSGQWDRSSPAPA

SEQ ID NO: 1255856 - protein, 27 aa, Mycobacterium
TQAARCMDCGIPFCHNGCPLGNLIPEW

SEQ ID NO: 1255857 - protein, 20 aa, Mycobacterium
TQDLCAWSIFEYTDVDTGGT

SEQ ID NO: 1255858 - protein, 24 aa, Mycobacterium
TQLPKICLELGRGIRGTIGHTQPR

SEQ ID NO: 1255859 - protein, 22 aa, Mycobacterium
TQMTRLSPRATTTRTAVRGAGE

SEQ ID NO: 1255860 - protein, 19 aa, Mycobacterium
TQNGVPFLARLVYGRRTAV

SEQ ID NO: 1255861 - protein, 23 aa, Mycobacterium
TQWKNALLDLSLRNRLINYTDRA

SEQ ID NO: 1255862 - protein, 21 aa, Mycobacterium
TRAKYVPVRRLRAFEQSGMGV

SEQ ID NO: 1255863 - protein, 23 aa, Mycobacterium
TRALELLAAVAIKKFRPNYGGPI

SEQ ID NO: 1255864 - protein, 18 aa, Mycobacterium
TRAPRTYLLSGLLRCGRC

SEQ ID NO: 1255865 - protein, 24 aa, Mycobacterium
TRAPRYRPVLARIEERGITVDPSV

SEQ ID NO: 1255866 - protein, 25 aa, Mycobacterium
TRASENFEALVSYFFEQYDNDATPI

SEQ ID NO: 1255867 - protein, 18 aa, Mycobacterium
TRCLPLADHIAFRYHRKG

SEQ ID NO: 1255868 - protein, 22 aa, Mycobacterium
TRDGRLPFVFEASGVETHFTNG

SEQ ID NO: 1255869 - protein, 18 aa, Mycobacterium
TRDPVFFQNGWDLLVEGC

SEQ ID NO: 1255870 - protein, 19 aa, Mycobacterium
TREAVRLALGKRIHPDLPE

SEQ ID NO: 1255871 - protein, 23 aa, Mycobacterium
TREELRIAIVTWIERTYHRRRRQ

SEQ ID NO: 1255872 - protein, 24 aa, Mycobacterium
TRIAPELRDRIFLETGYGSDFGAT

SEQ ID NO: 1255873 - protein, 19 aa, Mycobacterium
TRKWLQRMTAVNMDRSVAQ

SEQ ID NO: 1255874 - protein, 21 aa, Mycobacterium
TRLGPGGAFLQPALERDNLDL

SEQ ID NO: 1255875 - protein, 24 aa, Mycobacterium
TRLLPNLATVLAWESCDHTGPVYE

SEQ ID NO: 1255876 - protein, 18 aa, Mycobacterium
TRLLPVARAAGVRVVHCL

SEQ ID NO: 1255877 - protein, 17 aa, Mycobacterium
TRLPSVFDFTPLTSSQM

SEQ ID NO: 1255878 - protein, 18 aa, Mycobacterium
TRLRASLGEGWRTLDVVD

SEQ ID NO: 1255879 - protein, 25 aa, Mycobacterium
TRLRKMLSREFTPRRMEAMRPAVER

SEQ ID NO: 1255880 - protein, 17 aa, Mycobacterium
TRLRTVMADLGMPLPPA

SEQ ID NO: 1255881 - protein, 18 aa, Mycobacterium
TRLTMEFMGLATHRRELR

SEQ ID NO: 1255882 - protein, 22 aa, Mycobacterium
TRNMWGLPQLGRWKWHDPDVHI

SEQ ID NO: 1255883 - protein, 19 aa, Mycobacterium
TRPAVPMSVSEAAAVPPAW

SEQ ID NO: 1255884 - protein, 17 aa, Mycobacterium
TRPGRDVWVYGRAGKPC

SEQ ID NO: 1255885 - protein, 21 aa, Mycobacterium
TRPGSALLFPTLCTPTAEAPI

SEQ ID NO: 1255886 - protein, 19 aa, Mycobacterium
TRPLAEWAETFAAEPDLFW

SEQ ID NO: 1255887 - protein, 17 aa, Mycobacterium
TRPTGPRISIQFRPHDV

SEQ ID NO: 1255888 - protein, 17 aa, Mycobacterium
TRPVSLWLEELDYAERA

SEQ ID NO: 1255889 - protein, 17 aa, Mycobacterium
TRRIFEITVEYLKTRIQ

SEQ ID NO: 1255890 - protein, 25 aa, Mycobacterium
TRTKKWSPQEWKEVVFAPSTTSPPF

SEQ ID NO: 1255891 - protein, 21 aa, Mycobacterium
TRVDGIWAEFVPPNANVPSPV

SEQ ID NO: 1255892 - protein, 20 aa, Mycobacterium
TRWAELPLTDGIRFAMVAAS

SEQ ID NO: 1255893 - protein, 21 aa, Mycobacterium
TRYEWPIIDFAILAVGALTVP

SEQ ID NO: 1255894 - protein, 22 aa, Mycobacterium
TRYFTPRFDAVPFRAASAPGSA

SEQ ID NO: 1255895 - protein, 18 aa, Mycobacterium
TSAAPRPVGLVLGDHLVR

SEQ ID NO: 1255896 - protein, 27 aa, Mycobacterium
TSASSRGWPRELLGRRTIGRLIYSGTP

SEQ ID NO: 1255897 - protein, 18 aa, Mycobacterium
TSHALLLRDGRIIAQGEA

SEQ ID NO: 1255898 - protein, 17 aa, Mycobacterium
TSIPALIGLCLFGDGAA

SEQ ID NO: 1255899 - protein, 19 aa, Mycobacterium
TSLVTGWASIHGFPVGILA

SEQ ID NO: 1255900 - protein, 17 aa, Mycobacterium
TSPRGKRQFRRGVFDQH

SEQ ID NO: 1255901 - protein, 17 aa, Mycobacterium
TSRRLGVTINDLVLATA

SEQ ID NO: 1255902 - protein, 21 aa, Mycobacterium
TSRTLLWRAAGALDENHPDKV

SEQ ID NO: 1255903 - protein, 25 aa, Mycobacterium
TSTLRLGTAVALPLEHELFTFAKQV

SEQ ID NO: 1255904 - protein, 19 aa, Mycobacterium
TTAMAALAHAWRSSGGQVL

SEQ ID NO: 1255905 - protein, 18 aa, Mycobacterium
TTAYRPVSLDAPLLTAQN

SEQ ID NO: 1255906 - protein, 23 aa, Mycobacterium
TTEPRLWLLGSSMYSARLAAAKG

SEQ ID NO: 1255907 - protein, 19 aa, Mycobacterium
TTGELLAEVALRPATGDVS

SEQ ID NO: 1255908 - protein, 30 aa, Mycobacterium
TTHVRIIQEFVRKLPAWVSWERRDHYERDL

SEQ ID NO: 1255909 - protein, 24 aa, Mycobacterium
TTLYACRAALPSMVSRGAGVIVNI

SEQ ID NO: 1255910 - protein, 39 aa, Mycobacterium
TTPAVEGAFYWLSNREVRWRPAEYWKPGTTVEVDVNAYG

SEQ ID NO: 1255911 - protein, 24 aa, Mycobacterium
TTPPQMGAKSWKEVLAVRWRISTS

SEQ ID NO: 1255912 - protein, 23 aa, Mycobacterium
TTRLDELAALYAQGAVTAREWIA

SEQ ID NO: 1255913 - protein, 22 aa, Mycobacterium
TTRPRAVVVGGGIAGLTAATGL

SEQ ID NO: 1255914 - protein, 27 aa, Mycobacterium
TTRRLCTGCGQLTAADAARCATTNCRA

SEQ ID NO: 1255915 - protein, 19 aa, Mycobacterium
TTRRVLLATGMEYCPPELP

SEQ ID NO: 1255916 - protein, 17 aa, Mycobacterium
TTTVQWRHGLVATADTA

SEQ ID NO: 1255917 - protein, 19 aa, Mycobacterium
TTVDGLLVRLLRYLPGGTL

SEQ ID NO: 1255918 - protein, 30 aa, Mycobacterium
TTWCGYCVRLKKALQVEGIAWTEVDIERDP

SEQ ID NO: 1255919 - protein, 22 aa, Mycobacterium
TTWVPGSPWLAGVDPAVVGDPI

SEQ ID NO: 1255920 - protein, 18 aa, Mycobacterium
TVAALGCSVLMEIGPQPV

SEQ ID NO: 1255921 - protein, 25 aa, Mycobacterium
TVAANRWPAVRFAVRNTIVQGPNAV

SEQ ID NO: 1255922 - protein, 19 aa, Mycobacterium
TVACGFSGHGFKFVPVVGE

SEQ ID NO: 1255923 - protein, 17 aa, Mycobacterium
TVADAPVAPAWSLGSGI

SEQ ID NO: 1255924 - protein, 25 aa, Mycobacterium
TVAQLRRSGTLTGRHLDDRAALKKS

SEQ ID NO: 1255925 - protein, 22 aa, Mycobacterium
TVFKAAYRQGLSLVLKGPTGCG

SEQ ID NO: 1255926 - protein, 19 aa, Mycobacterium
TVFTAEAWGSDAYTPLAWL

SEQ ID NO: 1255927 - protein, 17 aa, Mycobacterium
TVIPAGRGLAFRARRGD

SEQ ID NO: 1255928 - protein, 24 aa, Mycobacterium
TVKRARSGLSMAPPFVAPQTAWNA

SEQ ID NO: 1255929 - protein, 21 aa, Mycobacterium
TVLSLRYGYIPKHLNFTQLTP

SEQ ID NO: 1255930 - protein, 24 aa, Mycobacterium
TVLVRPAPVPGYRGTRSPGLPEFD

SEQ ID NO: 1255931 - protein, 22 aa, Mycobacterium
TVPKLRGMPGFEYLSENRELGE

SEQ ID NO: 1255932 - protein, 33 aa, Mycobacterium
TVRPAEKWNAFDPVLIRWRLDVGDRTALLVSLS

SEQ ID NO: 1255933 - protein, 17 aa, Mycobacterium
TVRPLRCNAPERLAMAL

SEQ ID NO: 1255934 - protein, 26 aa, Mycobacterium
TVRQRVRWLALHGFVRGMSRLGMRRG

SEQ ID NO: 1255935 - protein, 27 aa, Mycobacterium
TVSPPTKWHLIVPFLNVLPGGMFAGAA

SEQ ID NO: 1255936 - protein, 19 aa, Mycobacterium
TVVPIPFPVPSGITKGRKC

SEQ ID NO: 1255937 - protein, 21 aa, Mycobacterium
TWGLVGVELPAPVVSEESRTA

SEQ ID NO: 1255938 - protein, 18 aa, Mycobacterium
TWQGRPDPSIGEWWTGID

SEQ ID NO: 1255939 - protein, 19 aa, Mycobacterium
TWTNPWPMYAALRDHDPVH

SEQ ID NO: 1255940 - protein, 22 aa, Mycobacterium
TYDPRTAQALERFYDRRVAEWS

SEQ ID NO: 1255941 - protein, 19 aa, Mycobacterium
TYELGALGRHFARNSVGAL

SEQ ID NO: 1255942 - protein, 18 aa, Mycobacterium
TYGTGAFLLAQLGETPAR

SEQ ID NO: 1255943 - protein, 20 aa, Mycobacterium
TYLGELRRAGLIDEDAAGFT

SEQ ID NO: 1255944 - protein, 18 aa, Mycobacterium
TYLIPRADFDYWNPANRQ

SEQ ID NO: 1255945 - protein, 19 aa, Mycobacterium
TYLLAFGRVKDDLRRSQTE

SEQ ID NO: 1255946 - protein, 18 aa, Mycobacterium
TYRSEFRPSDVAAEPVTF

SEQ ID NO: 1255947 - protein, 18 aa, Mycobacterium
TYSEDWMRPDYVPPQPTL

SEQ ID NO: 1255948 - protein, 21 aa, Mycobacterium
TYTKLALCTGARARRLPTPGV

SEQ ID NO: 1255949 - protein, 18 aa, Mycobacterium
VAAAMHLKGSYVRVHDPK

SEQ ID NO: 1255950 - protein, 27 aa, Mycobacterium
VAADGGLRWLPARSRPGDAVTFEAVMD

SEQ ID NO: 1255951 - protein, 20 aa, Mycobacterium
VAAELSRRGRDVEVYRAEQR

SEQ ID NO: 1255952 - protein, 18 aa, Mycobacterium
VAAELTAALAGARIVSRG

SEQ ID NO: 1255953 - protein, 19 aa, Mycobacterium
VAAGIPWDVPALTINKMCL

SEQ ID NO: 1255954 - protein, 18 aa, Mycobacterium
VAAGPEFDADAWRTACEV

SEQ ID NO: 1255955 - protein, 21 aa, Mycobacterium
VAAHHPRLMLANVVHEGLLQS

SEQ ID NO: 1255956 - protein, 25 aa, Mycobacterium
VAALERLETLLALIEGWVQTVVTSA

SEQ ID NO: 1255957 - protein, 17 aa, Mycobacterium
VAALGDQVEIRWVDGPD

SEQ ID NO: 1255958 - protein, 19 aa, Mycobacterium
VAAMGLRYSTVTGVARDDL

SEQ ID NO: 1255959 - protein, 18 aa, Mycobacterium
VAAPIAFAVPDGEIRSAD

SEQ ID NO: 1255960 - protein, 17 aa, Mycobacterium
VAAPTKYPAGFFGVFTG

SEQ ID NO: 1255961 - protein, 19 aa, Mycobacterium
VAATCRSMGLSVTLIEKSS

SEQ ID NO: 1255962 - protein, 18 aa, Mycobacterium
VADDPVLRRCGPEFPEYW

SEQ ID NO: 1255963 - protein, 19 aa, Mycobacterium
VADEMRPRIGDIVVAARDS

SEQ ID NO: 1255964 - protein, 19 aa, Mycobacterium
VADGLDFPNGMAITEDRAT

SEQ ID NO: 1255965 - protein, 21 aa, Mycobacterium
VADLIAYFFLRAHSLVRNDGL

SEQ ID NO: 1255966 - protein, 23 aa, Mycobacterium
VADPALVPLYFIAREARKHVKVV

SEQ ID NO: 1255967 - protein, 21 aa, Mycobacterium
VADPGGGFACMVRDPDGQLLE

SEQ ID NO: 1255968 - protein, 19 aa, Mycobacterium
VADQGKRNVSHGCPNLSPA

SEQ ID NO: 1255969 - protein, 19 aa, Mycobacterium
VADRIKLVRPVAGSVVLVD

SEQ ID NO: 1255970 - protein, 19 aa, Mycobacterium
VADRYAYRRADILDAEAVA

SEQ ID NO: 1255971 - protein, 17 aa, Mycobacterium
VADTVRFAAARGLRVTV

SEQ ID NO: 1255972 - protein, 22 aa, Mycobacterium
VAEAPPWIGALDVIVLAGDDPA

SEQ ID NO: 1255973 - protein, 26 aa, Mycobacterium
VAEELGQPLPLFIKWDDAEYGLRAAE

SEQ ID NO: 1255974 - protein, 25 aa, Mycobacterium
VAFEEVLARWTDWDVDYANATRART

SEQ ID NO: 1255975 - protein, 25 aa, Mycobacterium
VAGDWQLCRRRLLLDQAVLLAKNLS

SEQ ID NO: 1255976 - protein, 19 aa, Mycobacterium
VAGLARRQARLEAKANDFG

SEQ ID NO: 1255977 - protein, 26 aa, Mycobacterium
VAGLSVRPGYVLSDGFRVPGLPMPSL

SEQ ID NO: 1255978 - protein, 19 aa, Mycobacterium
VAGMAAFLLMAGHETTGNM

SEQ ID NO: 1255979 - protein, 18 aa, Mycobacterium
VAIAEPRPLFDPTALKTT

SEQ ID NO: 1255980 - protein, 27 aa, Mycobacterium
VAIDLREDWPAALRVAGFDSAAPTAWC

SEQ ID NO: 1255981 - protein, 19 aa, Mycobacterium
VAIPHGMVGLVHPRSGLAA

SEQ ID NO: 1255982 - protein, 24 aa, Mycobacterium
VAISVDCARYWLDADRPISKDDAV

SEQ ID NO: 1255983 - protein, 27 aa, Mycobacterium
VALAAEICDGWLPIFYTPRMADTYNSW

SEQ ID NO: 1255984 - protein, 19 aa, Mycobacterium
VALERRGMELLDAVVVDQV

SEQ ID NO: 1255985 - protein, 21 aa, Mycobacterium
VALHHPDNWTVGGMAKGAGMM

SEQ ID NO: 1255986 - protein, 30 aa, Mycobacterium; identical to SEQ ID NO: 742647

SEQ ID NO: 1255987 - protein, 19 aa, Mycobacterium
VALLRAAQSIGLPVPGVVA

SEQ ID NO: 1255988 - protein, 19 aa, Mycobacterium
VALSLPLGAGRLTREWLPD

SEQ ID NO: 1255989 - protein, 25 aa, Mycobacterium
VAMILSTAMLLEWLAERHHRGALAG

SEQ ID NO: 1255990 - protein, 19 aa, Mycobacterium
VAMLVPRGGQLAVPADVPG

SEQ ID NO: 1255991 - protein, 17 aa, Mycobacterium
VANLLAFQPNERIAQVI

SEQ ID NO: 1255992 - protein, 26 aa, Mycobacterium
VAPEVIWPRARRALAAVGLNLPLRHD

SEQ ID NO: 1255993 - protein, 18 aa, Mycobacterium
VAPFTRISIFDSPCVSFH

SEQ ID NO: 1255994 - protein, 26 aa, Mycobacterium
VAPIRRGVVVAGRIGIDDVAPVVSGG

SEQ ID NO: 1255995 - protein, 19 aa, Mycobacterium
VAQHASCPVVAWRQIGQPG

SEQ ID NO: 1255996 - protein, 22 aa, Mycobacterium
VARAAGVRVVHCLVQRRPDGLG

SEQ ID NO: 1255997 - protein, 23 aa, Mycobacterium
VARAKARGLVRIDIVVPPDLQDD

SEQ ID NO: 1255998 - protein, 25 aa, Mycobacterium
VARCNPRTAPRLADTVRLHKNPDGA

SEQ ID NO: 1255999 - protein, 17 aa, Mycobacterium
VARFRMLVEAIIAEERG

SEQ ID NO: 1256000 - protein, 28 aa, Mycobacterium
VARLSNPTLLCYYLFFPAHEESVGAGAC

SEQ ID NO: 1256001 - protein, 18 aa, Mycobacterium
VARRFRLLGDRSLQDHAW

SEQ ID NO: 1256002 - protein, 21 aa, Mycobacterium
VARTEPALDLDTLLGGFRPLF

SEQ ID NO: 1256003 - protein, 27 aa, Mycobacterium
VARVIGLLCRRRLGAAVGQIVNVDGGT

SEQ ID NO: 1256004 - protein, 20 aa, Mycobacterium
VATAAMLRRTFEATLQLTGE

SEQ ID NO: 1256005 - protein, 17 aa, Mycobacterium
VATAFPHAVELLGTGAG

SEQ ID NO: 1256006 - protein, 20 aa, Mycobacterium
VATLHPRWRAELADISTGPA

SEQ ID NO: 1256007 - protein, 18 aa, Mycobacterium
VATVAALCERGHADQMVL

SEQ ID NO: 1256008 - protein, 17 aa, Mycobacterium
VAVGRAFLANPDLIERL

SEQ ID NO: 1256009 - protein, 28 aa, Mycobacterium
VAVKQGWFCCWNGANQLHVSTGVIGSDR

SEQ ID NO: 1256010 - protein, 27 aa, Mycobacterium
VAVLASRLLTDFPFRNWEDEPALPFDQ

SEQ ID NO: 1256011 - protein, 20 aa, Mycobacterium
VAVLMRYTLRLLTSQQFQRA

SEQ ID NO: 1256012 - protein, 26 aa, Mycobacterium
VAVRPEPFGALLYHFGTRKLSFLKNR

SEQ ID NO: 1256013 - protein, 17 aa, Mycobacterium
VAVTRVHHLLRQGQLLA

SEQ ID NO: 1256014 - protein, 27 aa, Mycobacterium
VAYEPPHRVVFTWDIGPTWHVESDLER

SEQ ID NO: 1256015 - protein, 18 aa, Mycobacterium
VAYFLGCALPVEDRRAHY

SEQ ID NO: 1256016 - protein, 20 aa, Mycobacterium
VCAVSGLPWIEHLVKEPQNY

SEQ ID NO: 1256017 - protein, 17 aa, Mycobacterium
VCIESHTGLAERFRHHF

SEQ ID NO: 1256018 - protein, 19 aa, Mycobacterium
VCLDCADLGHLEFLPSGEA

SEQ ID NO: 1256019 - protein, 19 aa, Mycobacterium
VCRAMNWRAEREGPEHPPP

SEQ ID NO: 1256020 - protein, 23 aa, Mycobacterium
VCSDTTSYCPYKGDAAYYHVNAA

SEQ ID NO: 1256021 - protein, 19 aa, Mycobacterium
VDACRAFCADAVTRRAGKK

SEQ ID NO: 1256022 - protein, 20 aa, Mycobacterium
VDAFERLGFEQGRALFEQAL

SEQ ID NO: 1256023 - protein, 17 aa, Mycobacterium
VDALAPFDVEIRGLAAG

SEQ ID NO: 1256024 - protein, 17 aa, Mycobacterium
VDALRVGVLPTPAVAYL

SEQ ID NO: 1256025 - protein, 20 aa, Mycobacterium
VDALSRPQAWSATTAAGQYG

SEQ ID NO: 1256026 - protein, 20 aa, Mycobacterium
VDASGLWPGKVVTEVTPAGE

SEQ ID NO: 1256027 - protein, 25 aa, Mycobacterium
VDATANSLLPQWRGQAGEAAQAALL

SEQ ID NO: 1256028 - protein, 23 aa, Mycobacterium
VDATQRYVLVGGIRSTGLTSGMA

SEQ ID NO: 1256029 - protein, 32 aa, Mycobacterium
VDDHFRQLWFGWGDPARVLIEYAQLRVETGWR

SEQ ID NO: 1256030 - protein, 22 aa, Mycobacterium
VDEMCLHLAPRMIRINAVHPTN

SEQ ID NO: 1256031 - protein, 18 aa, Mycobacterium
VDEYRRLPKLRAVQDGRV

SEQ ID NO: 1256032 - protein, 17 aa, Mycobacterium
VDFLTHIADDARGRRIV

SEQ ID NO: 1256033 - protein, 25 aa, Mycobacterium
VDGDPTGVFSWRPPASLIVALSDLL

SEQ ID NO: 1256034 - protein, 21 aa, Mycobacterium
VDGDRGGSIILISSAAGLKMQ

SEQ ID NO: 1256035 - protein, 18 aa, Mycobacterium
VDGGWWLLGVRTAAMADC

SEQ ID NO: 1256036 - protein, 17 aa, Mycobacterium
VDGMPELDNVGAGLPDA

SEQ ID NO: 1256037 - protein, 17 aa, Mycobacterium
VDIYTFLPLARAAVQEA

SEQ ID NO: 1256038 - protein, 18 aa, Mycobacterium
VDKLIRWGYSATQVVEGL

SEQ ID NO: 1256039 - protein, 24 aa, Mycobacterium
VDKRLRPVIDSGYKRNDPKSESGG

SEQ ID NO: 1256040 - protein, 24 aa, Mycobacterium
VDLAVFASGCARAVAAVDSGDWDE

SEQ ID NO: 1256041 - protein, 40 aa, Mycobacterium
VDLEVGQLLGSGWKGGAASAFGTEWEKWHSGAGQVVRGLQ

SEQ ID NO: 1256042 - protein, 18 aa, Mycobacterium
VDLPFVFDRTDVDVLRGP

SEQ ID NO: 1256043 - protein, 19 aa, Mycobacterium
VDLPGAIPVQLDITDPESI

SEQ ID NO: 1256044 - protein, 23 aa, Mycobacterium
VDPARGGAVVSLLDGGRELIAPG

SEQ ID NO: 1256045 - protein, 17 aa, Mycobacterium
VDPHARWERLYRLVNQF

SEQ ID NO: 1256046 - protein, 24 aa, Mycobacterium
VDQAKRIADELIQNGSASHASLGV

SEQ ID NO: 1256047 - protein, 22 aa, Mycobacterium
VDQRTFGGWLLADLVTVDGTDV

SEQ ID NO: 1256048 - protein, 27 aa, Mycobacterium
VDRALRFPAALGRPLLTDLARWDAGDV

SEQ ID NO: 1256049 - protein, 20 aa, Mycobacterium
VDRAVELAALVAGLSPFGVQ

SEQ ID NO: 1256050 - protein, 22 aa, Mycobacterium
VDRGGAPPARYAAASLVVVNKL

SEQ ID NO: 1256051 - protein, 24 aa, Mycobacterium
VDRSLRVAWTLADLAGRQVPGVDE

SEQ ID NO: 1256052 - protein, 24 aa, Mycobacterium
VDSIFGRLWTRECLSRRDRSLVTM

SEQ ID NO: 1256053 - protein, 20 aa, Mycobacterium
VDTLAKAGAVFVEQTDEVPE

SEQ ID NO: 1256054 - protein, 19 aa, Mycobacterium
VDYLMNFFQYHLPGVQAYH

SEQ ID NO: 1256055 - protein, 19 aa, Mycobacterium
VEAELWYRHDAAQRATAES

SEQ ID NO: 1256056 - protein, 31 aa, Mycobacterium
VEAHLISPWGTWEWMGPAAIGADLPACGSVA

SEQ ID NO: 1256057 - protein, 25 aa, Mycobacterium
VEAIGELGLDCQIIRNRGALMVLPA

SEQ ID NO: 1256058 - protein, 20 aa, Mycobacterium
VEALPAIVWYLDEPVADPAL

SEQ ID NO: 1256059 - protein, 24 aa, Mycobacterium
VEASKLYLTQMVKHHEGAITMAQN

SEQ ID NO: 1256060 - protein, 23 aa, Mycobacterium
VEDPRLSTGRLCTPVVAGTDAFA

SEQ ID NO: 1256061 - protein, 22 aa, Mycobacterium
VEELGIDVFLVMPFTADFMKLT

SEQ ID NO: 1256062 - protein, 18 aa, Mycobacterium
VEELGRLDVVVANAGVHP

SEQ ID NO: 1256063 - protein, 17 aa, Mycobacterium
VEFARRAECTVVSVDYR

SEQ ID NO: 1256064 - protein, 29 aa, Mycobacterium
VEFKGDAAASWRPFQLAFILLQIPSLTDP

SEQ ID NO: 1256065 - protein, 22 aa, Mycobacterium
VEHPLWLSTMRARSCVDEFGTT

SEQ ID NO: 1256066 - protein, 32 aa, Mycobacterium
VEIPLRRYVLWTRLRIAITRVQAGDDLTEAAH

SEQ ID NO: 1256067 - protein, 27 aa, Mycobacterium
VEIPNREDLAFLPGQYVNVAVPGTDVT

SEQ ID NO: 1256068 - protein, 25 aa, Mycobacterium
VEKARQLWFDRILPLAENIRAGEVV

SEQ ID NO: 1256069 - protein, 19 aa, Mycobacterium
VELRLGAETVVLDFPKRVV

SEQ ID NO: 1256070 - protein, 25 aa, Mycobacterium
VELVAWRGACGELRVGPASCPHLGA

SEQ ID NO: 1256071 - protein, 25 aa, Mycobacterium
VEMEREGLEIPLLIGGATTSRAHTA

SEQ ID NO: 1256072 - protein, 17 aa, Mycobacterium
VEPPVSLLLQGGSLDDV

SEQ ID NO: 1256073 - protein, 17 aa, Mycobacterium
VEQRAAIVAVDMQGYSV

SEQ ID NO: 1256074 - protein, 22 aa, Mycobacterium
VERVREVTCALGRREGADLLLE

SEQ ID NO: 1256075 - protein, 24 aa, Mycobacterium
VESAWKLAKQYFKLTGKPGKHKVV

SEQ ID NO: 1256076 - protein, 27 aa, Mycobacterium
VESKLPVPIHIGGGYGGDSDWLHGVWK

SEQ ID NO: 1256077 - protein, 19 aa, Mycobacterium
VESYVALGISEGAQLVCGG

SEQ ID NO: 1256078 - protein, 26 aa, Mycobacterium
VEVFRAAARRGLPVLLKGPTGCGKTR

SEQ ID NO: 1256079 - protein, 22 aa, Mycobacterium
VEVLQRIGGRPAPLTRADAESL

SEQ ID NO: 1256080 - protein, 35 aa, Mycobacterium
VEVRQPLCRPYRGKEICGMPPPSSGGLAVLATLGM

SEQ ID NO: 1256081 - protein, 18 aa, Mycobacterium
VEWRHPFGHHWRFEFEEI

SEQ ID NO: 1256082 - protein, 19 aa, Mycobacterium
VEYSVRFAKPVVLPAKAGL

SEQ ID NO: 1256083 - protein, 19 aa, Mycobacterium
VFDDCRVPATAILGGEPGR

SEQ ID NO: 1256084 - protein, 26 aa, Mycobacterium
VFDGEAYPQVLIRLGWAPADGTALPV

SEQ ID NO: 1256085 - protein, 25 aa, Mycobacterium
VFDPACGSGGMFVQCAKFVERHNES

SEQ ID NO: 1256086 - protein, 18 aa, Mycobacterium
VFFDRFIDRVGLFARRLG

SEQ ID NO: 1256087 - protein, 27 aa, Mycobacterium
VFFHCAKAFLRSGAWNPESWTPDAVPS

SEQ ID NO: 1256088 - protein, 18 aa, Mycobacterium
VFIRAPWVERIGDGVEVL

SEQ ID NO: 1256089 - protein, 17 aa, Mycobacterium
VFLVMPFTADFMKLTPE

SEQ ID NO: 1256090 - protein, 21 aa, Mycobacterium
VFQRTPGWVLPRVNFRHPAWA

SEQ ID NO: 1256091 - protein, 24 aa, Mycobacterium
VFSEGGGRYWGRHGAAGLLLRAPQ

SEQ ID NO: 1256092 - protein, 23 aa, Mycobacterium
VFSEYRLDHQFEVIRLVGKKTDV

SEQ ID NO: 1256093 - protein, 22 aa, Mycobacterium
VGAACQTGALGIPAAAIEEAIE

SEQ ID NO: 1256094 - protein, 29 aa, Mycobacterium
VGAADPFQLFRIMFEVIRGGGLDPQSGVA

SEQ ID NO: 1256095 - protein, 18 aa, Mycobacterium
VGAARLLLAAAHTEDGGL

SEQ ID NO: 1256096 - protein, 17 aa, Mycobacterium
VGAHLADLGVRPRDRVM

SEQ ID NO: 1256097 - protein, 21 aa, Mycobacterium
VGALRDELWRIVDAKVAAAEA

SEQ ID NO: 1256098 - protein, 23 aa, Mycobacterium
VGALRGALRNRPNLAPHWVPAAL

SEQ ID NO: 1256099 - protein, 19 aa, Mycobacterium
VGAVALVAGWAARQGDSGT

SEQ ID NO: 1256100 - protein, 18 aa, Mycobacterium
VGAYAEYTVAPADFVAYV

SEQ ID NO: 1256101 - protein, 22 aa, Mycobacterium
VGCKRPGFHNTYLATFNRSNVR

SEQ ID NO: 1256102 - protein, 17 aa, Mycobacterium
VGCTRLAIHAVTEDGKE

SEQ ID NO: 1256103 - protein, 19 aa, Mycobacterium
VGDELVRVVAGEGWSVNAT

SEQ ID NO: 1256104 - protein, 25 aa, Mycobacterium
VGDGTMCWLFVPRLRADGWVQIGGR

SEQ ID NO: 1256105 - protein, 27 aa, Mycobacterium
VGDSMVDAAICDGDWVVVRQQAVADNG

SEQ ID NO: 1256106 - protein, 17 aa, Mycobacterium
VGEAFDNYVALLEQAAA

SEQ ID NO: 1256107 - protein, 21 aa, Mycobacterium
VGEGKLAGILAEVAAPQHVVI

SEQ ID NO: 1256108 - protein, 23 aa, Mycobacterium
VGEGRWWRRWAARHAPRTLQQCC

SEQ ID NO: 1256109 - protein, 25 aa, Mycobacterium
VGEICVSGPLLSGGYWNLPDATAET

SEQ ID NO: 1256110 - protein, 25 aa, Mycobacterium
VGEICVSGPLLSGGYWNLPEATAET

SEQ ID NO: 1256111 - protein, 18 aa, Mycobacterium
VGELVTSLDMAGCSLTVM

SEQ ID NO: 1256112 - protein, 20 aa, Mycobacterium
VGGAMWGHSATTVFDELQEL

SEQ ID NO: 1256113 - protein, 32 aa, Mycobacterium
VGGPKPAGVPFLWRWHDVYAKLLKSCDVMPES

SEQ ID NO: 1256114 - protein, 17 aa, Mycobacterium
VGHELWNATATAGGANP

SEQ ID NO: 1256115 - protein, 18 aa, Mycobacterium
VGILPGGGMTARLPQVVG

SEQ ID NO: 1256116 - protein, 17 aa, Mycobacterium
VGIVVPNPPFTGMPGGL

SEQ ID NO: 1256117 - protein, 18 aa, Mycobacterium
VGLADRFGAEQAVSFSGI

SEQ ID NO: 1256118 - protein, 17 aa, Mycobacterium
VGLEVPEHLGGAGATFA

SEQ ID NO: 1256119 - protein, 36 aa, Mycobacterium
VGLKRRPGKELVRHKYRVCPTCGRFQRGQELDPADV

SEQ ID NO: 1256120 - protein, 18 aa, Mycobacterium
VGLMSAIGRRMWRRCGFL

SEQ ID NO: 1256121 - protein, 19 aa, Mycobacterium
VGLNATRLLFALGDVFVGW

SEQ ID NO: 1256122 - protein, 17 aa, Mycobacterium
VGLRIVVELKRDAVAKV

SEQ ID NO: 1256123 - protein, 22 aa, Mycobacterium
VGLSDFRVDLVIGDPDEPGKPL

SEQ ID NO: 1256124 - protein, 18 aa, Mycobacterium
VGLVHPRSGLAARVGLSI

SEQ ID NO: 1256125 - protein, 23 aa, Mycobacterium
VGNLVCPALFDLGEHGKVVVISV

SEQ ID NO: 1256126 - protein, 19 aa, Mycobacterium
VGPRPPGRLRPHRTEQLGR

SEQ ID NO: 1256127 - protein, 17 aa, Mycobacterium
VGPTLAGLEAHWLELTQ

SEQ ID NO: 1256128 - protein, 18 aa, Mycobacterium
VGQLTRYRGAKVYFATPD

SEQ ID NO: 1256129 - protein, 19 aa, Mycobacterium
VGQRNLRESLLIGLLTGGH

SEQ ID NO: 1256130 - protein, 22 aa, Mycobacterium
VGRLAAPVRYGLAATLEVAPAI

SEQ ID NO: 1256131 - protein, 24 aa, Mycobacterium
VGSAPPERRWHGGSYVETPGDDVG

SEQ ID NO: 1256132 - protein, 19 aa, Mycobacterium
VGSGAWRFIREECARTSMT

SEQ ID NO: 1256133 - protein, 25 aa, Mycobacterium
VGSYFPEFQRIGLEMIKAQGGIFGW

SEQ ID NO: 1256134 - protein, 23 aa, Mycobacterium
VGTAVLRYVMKIPPLATIPTEDL

SEQ ID NO: 1256135 - protein, 35 aa, Mycobacterium
VGTGIRRRLEEAFTAAGLMPRIAFEASTPQELADL

SEQ ID NO: 1256136 - protein, 23 aa, Mycobacterium
VGVCGDARPVLKPELDPRRTVGA

SEQ ID NO: 1256137 - protein, 25 aa, Mycobacterium
VGVDVPRLGLMLVVGQPKNTAEYIQ

SEQ ID NO: 1256138 - protein, 18 aa, Mycobacterium
VGVPMNLDRAISDGQLKR

SEQ ID NO: 1256139 - protein, 17 aa, Mycobacterium
VGVRRGKIVTVRPEDDH

SEQ ID NO: 1256140 - protein, 17 aa, Mycobacterium
VGVSVTMPGKFAALRFA

SEQ ID NO: 1256141 - protein, 17 aa, Mycobacterium
VGYAVWRAAANHFHLRR

SEQ ID NO: 1256142 - protein, 28 aa, Mycobacterium
VHAGRITLWRDYFDTVDFLKATVRGLLA

SEQ ID NO: 1256143 - protein, 29 aa, Mycobacterium
VHAKVCVIDDVWACSGSDNFNRRSWTHDS

SEQ ID NO: 1256144 - protein, 19 aa, Mycobacterium
VHGDRLWAVRDVERDITAT

SEQ ID NO: 1256145 - protein, 25 aa, Mycobacterium
VHLGCGLDGRYLRLDPGPGVEWFDV

SEQ ID NO: 1256146 - protein, 19 aa, Mycobacterium
VHLPANRLFAGRTDLVLLH

SEQ ID NO: 1256147 - protein, 25 aa, Mycobacterium
VHLVGPRARSMWVATFHSTCVRILR

SEQ ID NO: 1256148 - protein, 25 aa, Mycobacterium
VHVPSRSPIAIGIITGAAARTRATA

SEQ ID NO: 1256149 - protein, 25 aa, Mycobacterium
VHWVAPSEAVWACRTLASTHYASGG

SEQ ID NO: 1256150 - protein, 18 aa, Mycobacterium
VIAAANWVHTELDYVPGT

SEQ ID NO: 1256151 - protein, 17 aa, Mycobacterium
VIARCRTSVELLAPHAG

SEQ ID NO: 1256152 - protein, 40 aa, Mycobacterium
VIASLPGLQTGEAWVWSPAFLRLLQRVRITMSDTFDSHAT

SEQ ID NO: 1256153 - protein, 25 aa, Mycobacterium
VIATYPGAIAVRFDDPLAAFDTVTV

SEQ ID NO: 1256154 - protein, 22 aa, Mycobacterium
VIEECLKLSVDYAKSRTLWGKE

SEQ ID NO: 1256155 - protein, 18 aa, Mycobacterium
VIGDAGGTTGVFVDGERV

SEQ ID NO: 1256156 - protein, 35 aa, Mycobacterium
VIGLPPTVTVFGIPIFKLGGAPVKVVSSVTLGDLD

SEQ ID NO: 1256157 - protein, 19 aa, Mycobacterium
VIGPAAWPAIITHAERDRI

SEQ ID NO: 1256158 - protein, 20 aa, Mycobacterium
VIHQGLRKLCSWQLGHPLAP

SEQ ID NO: 1256159 - protein, 17 aa, Mycobacterium
VIPKSWDVPPRADGVYS

SEQ ID NO: 1256160 - protein, 24 aa, Mycobacterium
VIQELLLRHRARTVIIVCPAGLSV

SEQ ID NO: 1256161 - protein, 18 aa, Mycobacterium
VIVGLQLALTKLWRSYGV

SEQ ID NO: 1256162 - protein, 24 aa, Mycobacterium
VKAMARPTLRHRIALRPEAELEGA

SEQ ID NO: 1256163 - protein, 23 aa, Mycobacterium
VKAMYPIGPVFHGSGLNITVMSL

SEQ ID NO: 1256164 - protein, 21 aa, Mycobacterium
VKAQPGVTWAAAAVECGGTPA

SEQ ID NO: 1256165 - protein, 29 aa, Mycobacterium
VKDARFRDALFPVWRYHPFFTNTDLPTAD

SEQ ID NO: 1256166 - protein, 19 aa, Mycobacterium
VKGYAHGLTPYMSDLSGLA

SEQ ID NO: 1256167 - protein, 18 aa, Mycobacterium
VKHRLRTAAMPFMQDLYA

SEQ ID NO: 1256168 - protein, 27 aa, Mycobacterium
VKPRPLGKARWAGAVDCVGGATLADVL

SEQ ID NO: 1256169 - protein, 24 aa, Mycobacterium
VKPTDWKTKNLIDFAFNDAEQDYD

SEQ ID NO: 1256170 - protein, 21 aa, Mycobacterium
VKRFRGCPFHNAAVESAGALE

SEQ ID NO: 1256171 - protein, 20 aa, Mycobacterium
VKTFKRSRGQVWLMPHNPAF

SEQ ID NO: 1256172 - protein, 19 aa, Mycobacterium
VKTLPVRSWLGGRHADRLF

SEQ ID NO: 1256173 - protein, 19 aa, Mycobacterium
VKVAFFRKGVECTPDTIDR

SEQ ID NO: 1256174 - protein, 17 aa, Mycobacterium
VLAAGWPEHIPGTTVNR

SEQ ID NO: 1256175 - protein, 23 aa, Mycobacterium
VLADIEALPAWSSVYKKVTVLDR

SEQ ID NO: 1256176 - protein, 23 aa, Mycobacterium
VLAGKRFGVPRMYINADPDAGTA

SEQ ID NO: 1256177 - protein, 19 aa, Mycobacterium
VLDLHGWGDLQPELHAMSK

SEQ ID NO: 1256178 - protein, 26 aa, Mycobacterium
VLDRHRFGCTVSRAAWNPTQSQWELS

SEQ ID NO: 1256179 - protein, 17 aa, Mycobacterium
VLDSAASNGIRMTGNEV

SEQ ID NO: 1256180 - protein, 23 aa, Mycobacterium
VLDVGGGPGFFAAAFTRRGMEYV

SEQ ID NO: 1256181 - protein, 23 aa, Mycobacterium
VLESRPDLVPLFLNALPVVMADA

SEQ ID NO: 1256182 - protein, 21 aa, Mycobacterium
VLEVRRCLEVEGARLAATART

SEQ ID NO: 1256183 - protein, 17 aa, Mycobacterium
VLGEAWVGTAGDWLTSV

SEQ ID NO: 1256184 - protein, 21 aa, Mycobacterium
VLGLRLAQRLADLGARRLVLV

SEQ ID NO: 1256185 - protein, 17 aa, Mycobacterium
VLGVCRGLQALNVAAGG

SEQ ID NO: 1256186 - protein, 28 aa, Mycobacterium
VLGVDHLRKVVGWARDRGVLVASDECYL

SEQ ID NO: 1256187 - protein, 17 aa, Mycobacterium
VLLATGMEYCPPELPGL

SEQ ID NO: 1256188 - protein, 19 aa, Mycobacterium
VLLGVGVGVRAELAMTNSI

SEQ ID NO: 1256189 - protein, 20 aa, Mycobacterium
VLLQMCLEYIDRMFGEGTEL

SEQ ID NO: 1256190 - protein, 20 aa, Mycobacterium
VLMRRCPSKSFTIVGDLAQR

SEQ ID NO: 1256191 - protein, 21 aa, Mycobacterium
VLPDRVKRALLGFRSVTVDGN

SEQ ID NO: 1256192 - protein, 19 aa, Mycobacterium
VLPHDDAYAWAQRSNLSVN

SEQ ID NO: 1256193 - protein, 23 aa, Mycobacterium
VLPHMRAAGAGRIVVISSEWGLT

SEQ ID NO: 1256194 - protein, 19 aa, Mycobacterium
VLPKADVSRAFFRSQCDTL

SEQ ID NO: 1256195 - protein, 24 aa, Mycobacterium
VLPKQLRDALGLTPGSKVDISAYG

SEQ ID NO: 1256196 - protein, 22 aa, Mycobacterium
VLQALRLYQRFAPYSDHHLVES

SEQ ID NO: 1256197 - protein, 17 aa, Mycobacterium
VLQGGGPLGNEEEADAY

SEQ ID NO: 1256198 - protein, 19 aa, Mycobacterium
VLREARLHLDIADSAVGVA

SEQ ID NO: 1256199 - protein, 26 aa, Mycobacterium
VLRERGLRPAAVIGHSVGEVAANVVA

SEQ ID NO: 1256200 - protein, 22 aa, Mycobacterium
VLRFSAAVSHLMHDGRLTPHPV

SEQ ID NO: 1256201 - protein, 19 aa, Mycobacterium
VLRNEIWPLLHDGTPITKA

SEQ ID NO: 1256202 - protein, 17 aa, Mycobacterium
VLTAARRQRIIAADGPT

SEQ ID NO: 1256203 - protein, 21 aa, Mycobacterium
VLTFGELKAAAAGNDLLLRQH

SEQ ID NO: 1256204 - protein, 24 aa, Mycobacterium
VLTLPRGAAGWVTADDGPIQLLAA

SEQ ID NO: 1256205 - protein, 17 aa, Mycobacterium
VLYRRWPDRASLLRDTL

SEQ ID NO: 1256206 - protein, 19 aa, Mycobacterium
VMCREALDAGTPVKFSTTI

SEQ ID NO: 1256207 - protein, 17 aa, Mycobacterium
VMEGSWGAEATRVDDAD

SEQ ID NO: 1256208 - protein, 17 aa, Mycobacterium
VMFAGFFHGAAMVATAG

SEQ ID NO: 1256209 - protein, 20 aa, Mycobacterium
VMGVDARPLGAVSGPPLTSV

SEQ ID NO: 1256210 - protein, 20 aa, Mycobacterium
VMLIGDGWNPLIPDHAAEFE

SEQ ID NO: 1256211 - protein, 23 aa, Mycobacterium
VMREADIGFSFCYEAQRQVPAIL

SEQ ID NO: 1256212 - protein, 23 aa, Mycobacterium
VMREANIGFSFCYEAQRQVPAIL

SEQ ID NO: 1256213 - protein, 19 aa, Mycobacterium
VMRSRRCSWDMRPASDAST

SEQ ID NO: 1256214 - protein, 21 aa, Mycobacterium
VMTVRACRTCGTELLDAARFC

SEQ ID NO: 1256215 - protein, 18 aa, Mycobacterium
VMVGRPCYEVEFSDGTVI

SEQ ID NO: 1256216 - protein, 30 aa, Mycobacterium
VNAAGLDCFKRFSDVTFDRWQKVIDVNLNG

SEQ ID NO: 1256217 - protein, 28 aa, Mycobacterium
VNAEVELSWNILDPVLDYWASHGKPDPY

SEQ ID NO: 1256218 - protein, 18 aa, Mycobacterium
VNAGRLYIDGDLVGYRER

SEQ ID NO: 1256219 - protein, 25 aa, Mycobacterium
VNDSFVLPEDVRLVGAQCDEANAFW

SEQ ID NO: 1256220 - protein, 21 aa, Mycobacterium
VNGGQVCVCPDYVLVPEYLVD

SEQ ID NO: 1256221 - protein, 26 aa, Mycobacterium
VNGPCVGAGMALCLAADIRICSSAAT

SEQ ID NO: 1256222 - protein, 20 aa, Mycobacterium
VNIEYLASVVMARSDADGNT

SEQ ID NO: 1256223 - protein, 18 aa, Mycobacterium
VNLDITWLRDESLEDADN

SEQ ID NO: 1256224 - protein, 19 aa, Mycobacterium
VNLERAAAVNSRLGGHIVQ

SEQ ID NO: 1256225 - protein, 19 aa, Mycobacterium
VNPDGRWVSVTAPKENAEN

SEQ ID NO: 1256226 - protein, 20 aa, Mycobacterium
VNPIMWNAFLGWTGVDQYDE

SEQ ID NO: 1256227 - protein, 19 aa, Mycobacterium
VNRGWLVARATLGNERISI

SEQ ID NO: 1256228 - protein, 18 aa, Mycobacterium
VNRLRLQDLITRHPEILT

SEQ ID NO: 1256229 - protein, 23 aa, Mycobacterium
VNRRFAEATARAAAEGATVWVQD

SEQ ID NO: 1256230 - protein, 24 aa, Mycobacterium
VNRVPSLTAPMWVVDFYNFELEEA

SEQ ID NO: 1256231 - protein, 18 aa, Mycobacterium
VNVFAEFQRNLVPFKKVV

SEQ ID NO: 1256232 - protein, 18 aa, Mycobacterium
VNVKPKFAVDAMVATVGQ

SEQ ID NO: 1256233 - protein, 25 aa, Mycobacterium
VNYDIPWSLVRLEQRMGRIHRVGQQ

SEQ ID NO: 1256234 - protein, 23 aa, Mycobacterium
VPADAKAVIVAQNLVAERFVALT

SEQ ID NO: 1256235 - protein, 17 aa, Mycobacterium
VPADFDIVLPVAPLDPS

SEQ ID NO: 1256236 - protein, 19 aa, Mycobacterium
VPAGPACRLPEDELLVHTG

SEQ ID NO: 1256237 - protein, 18 aa, Mycobacterium
VPAKDGWSPLSGVRGEVT

SEQ ID NO: 1256238 - protein, 22 aa, Mycobacterium
VPAPRLPRLVDHIAPRTAAAAR

SEQ ID NO: 1256239 - protein, 18 aa, Mycobacterium
VPAREKYAFMQWVVATMQ

SEQ ID NO: 1256240 - protein, 18 aa, Mycobacterium
VPDAQFVATVRRFNEMAH

SEQ ID NO: 1256241 - protein, 32 aa, Mycobacterium
VPDAVGLWTYRVDGWGDPIASWRHNVIAKLDA

SEQ ID NO: 1256242 - protein, 25 aa, Mycobacterium
VPDERYGQCVAAVIARREGATLSLA

SEQ ID NO: 1256243 - protein, 32 aa, Mycobacterium
VPDGAIEAVEWPDHPFALGVHWHPEDPLMHEL

SEQ ID NO: 1256244 - protein, 22 aa, Mycobacterium
VPDGQRPSFFVRPTSSEVPQAP

SEQ ID NO: 1256245 - protein, 19 aa, Mycobacterium
VPEESRLSYLNDLPEGDDI

SEQ ID NO: 1256246 - protein, 21 aa, Mycobacterium
VPEPFAVAAHHPRLMLANVVH

SEQ ID NO: 1256247 - protein, 19 aa, Mycobacterium
VPESVCARTEPELTEELLR

SEQ ID NO: 1256248 - protein, 17 aa, Mycobacterium
VPFSDLLAPEFYKQPDV

SEQ ID NO: 1256249 - protein, 27 aa, Mycobacterium
VPGGTPAKWARNWAERHPDVPLQLCTV

SEQ ID NO: 1256250 - protein, 23 aa, Mycobacterium
VPGLMHVRFGPYHVRDVKFVAAF

SEQ ID NO: 1256251 - protein, 18 aa, Mycobacterium
VPGSMWLDVPRPRFERLT

SEQ ID NO: 1256252 - protein, 29 aa, Mycobacterium
VPGTICTREGGFLTGWEPDEFDAEFFGIS

SEQ ID NO: 1256253 - protein, 26 aa, Mycobacterium
VPIEWSAARYRRLMVLRDERQRVLAE

SEQ ID NO: 1256254 - protein, 28 aa, Mycobacterium
VPIWGDVELAWRLDRAGWFGPPRRWLVV

SEQ ID NO: 1256255 - protein, 21 aa, Mycobacterium
VPLELCTASGDLLTFISTVTT

SEQ ID NO: 1256256 - protein, 17 aa, Mycobacterium
VPMTSIMAEMFGKQEGC

SEQ ID NO: 1256257 - protein, 20 aa, Mycobacterium
VPPRAMQPMIGMLGREGLAE

SEQ ID NO: 1256258 - protein, 24 aa, Mycobacterium
VPPSVWGGVAAVRFREVVDRWNGE

SEQ ID NO: 1256259 - protein, 19 aa, Mycobacterium
VPQETVEVFAARFPAALND

SEQ ID NO: 1256260 - protein, 30 aa, Mycobacterium
VPQLDAKVLWQLKRALPGPFTRTLGLVERM

SEQ ID NO: 1256261 - protein, 38 aa, Mycobacterium
VPSYVKPVFKLGWSRRLAPLMRRWALRHGSPELTVNWT

SEQ ID NO: 1256262 - protein, 19 aa, Mycobacterium
VPTILGGVVTGFGARPSAK

SEQ ID NO: 1256263 - protein, 19 aa, Mycobacterium
VPTMFSRILKLPNEIRDKY

SEQ ID NO: 1256264 - protein, 19 aa, Mycobacterium
VPTPANFLYLPDPVTLGSS

SEQ ID NO: 1256265 - protein, 23 aa, Mycobacterium
VPTPRLFGIPAIADNLDKVAAGY

SEQ ID NO: 1256266 - protein, 20 aa, Mycobacterium
VPVDNARIARRHAHSVALAA

SEQ ID NO: 1256267 - protein, 21 aa, Mycobacterium
VPVFRLPALGSSWEQVTRGLT

SEQ ID NO: 1256268 - protein, 22 aa, Mycobacterium
VPVGDRIVFLFADPAILRDIPA

SEQ ID NO: 1256269 - protein, 17 aa, Mycobacterium
VQACVAAGVNITYKLLW

SEQ ID NO: 1256270 - protein, 19 aa, Mycobacterium
VQAKSELRWQTLASALEIT

SEQ ID NO: 1256271 - protein, 25 aa, Mycobacterium
VQALAWCRGAGVDRLGRVTLEGTTR

SEQ ID NO: 1256272 - protein, 19 aa, Mycobacterium
VQEAVSFAEAGTWEDIGDL

SEQ ID NO: 1256273 - protein, 17 aa, Mycobacterium
VQLRWLRRNGRDYELGM

SEQ ID NO: 1256274 - protein, 23 aa, Mycobacterium
VQQDRPSFGSSITGAAPSVPAAA

SEQ ID NO: 1256275 - protein, 32 aa, Mycobacterium
VQSWLPTGAVPLDFDPCPKLRKLTLAEHRAVN

SEQ ID NO: 1256276 - protein, 29 aa, Mycobacterium
VQTRIVVLGDAWGLLKFLDEGAFVLDEKA

SEQ ID NO: 1256277 - protein, 17 aa, Mycobacterium
VQYMFRRHLETTPLQYL

SEQ ID NO: 1256278 - protein, 31 aa, Mycobacterium
VRAATDVLAAWTWQQRPVAVLAMDSETHPIL

SEQ ID NO: 1256279 - protein, 23 aa, Mycobacterium
VRADEYWPTLAAQLAEAAPTNNI

SEQ ID NO: 1256280 - protein, 22 aa, Mycobacterium
VRAHLEMARRDPAYKFVLAEVD

SEQ ID NO: 1256281 - protein, 22 aa, Mycobacterium
VRAHSPLVERVLEVLRGVARTQ

SEQ ID NO: 1256282 - protein, 25 aa, Mycobacterium
VRANLFYRGLAFHRYPVLGDSLFTR

SEQ ID NO: 1256283 - protein, 20 aa, Mycobacterium
VRAVGIEFFTKVADGEFDIT

SEQ ID NO: 1256284 - protein, 26 aa, Mycobacterium
VRAYRDAGVMQVDWWFDGDRFDHATV

SEQ ID NO: 1256285 - protein, 20 aa, Mycobacterium
VRDEARLVFTAHSIPVAADD

SEQ ID NO: 1256286 - protein, 23 aa, Mycobacterium
VRDELPHSLAVVIDEVSPREDRD

SEQ ID NO: 1256287 - protein, 27 aa, Mycobacterium
VRDGLRVIAIRSRLMSRLAGQGAVALL

SEQ ID NO: 1256288 - protein, 23 aa, Mycobacterium
VRDGRLRPPPMTVCTLDEAPAAF

SEQ ID NO: 1256289 - protein, 17 aa, Mycobacterium
VRELRQNASVLLRQVAA

SEQ ID NO: 1256290 - protein, 17 aa, Mycobacterium
VRFVLRRSTFPYSNTVG

SEQ ID NO: 1256291 - protein, 20 aa, Mycobacterium
VRGAPCRGRHCLGRRRAGCS

SEQ ID NO: 1256292 - protein, 17 aa, Mycobacterium
VRGTFLLTKACLPHLRE

SEQ ID NO: 1256293 - protein, 23 aa, Mycobacterium
VRKDARPSFLLGSPVVGVSALDG

SEQ ID NO: 1256294 - protein, 22 aa, Mycobacterium
VRLAKCGPWHRGGWDPIPERPD

SEQ ID NO: 1256295 - protein, 20 aa, Mycobacterium
VRLALEAGDGLQVPLPIASL

SEQ ID NO: 1256296 - protein, 17 aa, Mycobacterium
VRLARAVERLRHVLDRA

SEQ ID NO: 1256297 - protein, 21 aa, Mycobacterium
VRLGLVIDGRYHWRAYSLTSD

SEQ ID NO: 1256298 - protein, 19 aa, Mycobacterium
VRLLRSGGAIVVHRAALGG

SEQ ID NO: 1256299 - protein, 19 aa, Mycobacterium
VRLPFPRPVDDVTGLSQAI

SEQ ID NO: 1256300 - protein, 17 aa, Mycobacterium
VRLRTPVPPARARDIQV

SEQ ID NO: 1256301 - protein, 19 aa, Mycobacterium
VRPAGVWAYEAHRVAALQP

SEQ ID NO: 1256302 - protein, 17 aa, Mycobacterium
VRRAILGLLDVDLLASV

SEQ ID NO: 1256303 - protein, 25 aa, Mycobacterium
VRRLHERGAELLRCPVSEIMTSVLV

SEQ ID NO: 1256304 - protein, 18 aa, Mycobacterium
VRRRGAEAVKAWAEAMVA

SEQ ID NO: 1256305 - protein, 18 aa, Mycobacterium
VRSGWDDLVLAGGVESMS

SEQ ID NO: 1256306 - protein, 19 aa, Mycobacterium
VRSTVIPVAHWRYEISPTA

SEQ ID NO: 1256307 - protein, 23 aa, Mycobacterium
VRTEIEQLLGLLLSQGRAVGISV

SEQ ID NO: 1256308 - protein, 24 aa, Mycobacterium
VRTFGRRRIDTILSGVAQGADGVE

SEQ ID NO: 1256309 - protein, 18 aa, Mycobacterium
VRTSHAFHSRLMDAVVPQ

SEQ ID NO: 1256310 - protein, 29 aa, Mycobacterium
VRVALWWASALHQRGWRLAACGDALARHG

SEQ ID NO: 1256311 - protein, 18 aa, Mycobacterium
VRVGTSLVGICGSDLHAA

SEQ ID NO: 1256312 - protein, 25 aa, Mycobacterium
VRYTGVSNFSGWQLMKSLAVADGAH

SEQ ID NO: 1256313 - protein, 17 aa, Mycobacterium
VSAGEWPVGTRIPTEPA

SEQ ID NO: 1256314 - protein, 22 aa, Mycobacterium
VSAKQLATVSVWRDTELFDERE

SEQ ID NO: 1256315 - protein, 23 aa, Mycobacterium
VSASRTADPWDWDGESDESWMQP

SEQ ID NO: 1256316 - protein, 20 aa, Mycobacterium
VSDARLAIVTADAPRIPSNF

SEQ ID NO: 1256317 - protein, 25 aa, Mycobacterium
VSDGKCLRSTFAYLGWLAGAAPDDA

SEQ ID NO: 1256318 - protein, 21 aa, Mycobacterium
VSDGLPVTSLWLDAAEDGEVV

SEQ ID NO: 1256319 - protein, 30 aa, Mycobacterium
VSDVLLAPTLREVWAVIAPMLAGCTPVGPG

SEQ ID NO: 1256320 - protein, 24 aa, Mycobacterium
VSGESVASWAVYRPGRGWAPHDPG

SEQ ID NO: 1256321 - protein, 17 aa, Mycobacterium
VSLDRRVDLPFPRSRGD

SEQ ID NO: 1256322 - protein, 23 aa, Mycobacterium
VSLGAEVRWASCNIFSTQDHAAA

SEQ ID NO: 1256323 - protein, 21 aa, Mycobacterium
VSPGLPIAHRFAELHQRLSDM

SEQ ID NO: 1256324 - protein, 34 aa, Mycobacterium
VSPLAVARHAWRPRWLKWSLTISGKGGTHRGGIP

SEQ ID NO: 1256325 - protein, 21 aa, Mycobacterium
VSPMAKFALKTLFHEIGHVML

SEQ ID NO: 1256326 - protein, 18 aa, Mycobacterium
VSRIIRFSGVDRVRPGGV

SEQ ID NO: 1256327 - protein, 17 aa, Mycobacterium
VSRLVTITSGLDPHGLG

SEQ ID NO: 1256328 - protein, 18 aa, Mycobacterium
VSTLGSLVNTAADNLRGQ

SEQ ID NO: 1256329 - protein, 20 aa, Mycobacterium
VSTPDGWEVSGVSPVVLGVG

SEQ ID NO: 1256330 - protein, 17 aa, Mycobacterium
VSVEFAIELGRLGGLGV

SEQ ID NO: 1256331 - protein, 21 aa, Mycobacterium
VSVGYPREWRRRKPYRWLRQI

SEQ ID NO: 1256332 - protein, 25 aa, Mycobacterium
VSVGYRLAPEHPWPAAAEDVYAVTR

SEQ ID NO: 1256333 - protein, 17 aa, Mycobacterium
VTAECMASGCPREPEFE

SEQ ID NO: 1256334 - protein, 18 aa, Mycobacterium
VTAFLQDWLDSHRSANAR

SEQ ID NO: 1256335 - protein, 19 aa, Mycobacterium
VTAGLPFLLRPALAAVGDG

SEQ ID NO: 1256336 - protein, 23 aa, Mycobacterium
VTALCAEAGFVPLVRHEVEETST

SEQ ID NO: 1256337 - protein, 18 aa, Mycobacterium
VTAMLAAFGRDIGYRIAH

SEQ ID NO: 1256338 - protein, 24 aa, Mycobacterium
VTCMSSSLPTLFRRAADYQRQITL

SEQ ID NO: 1256339 - protein, 17 aa, Mycobacterium
VTCTFHGHRRLSPDEVA

SEQ ID NO: 1256340 - protein, 17 aa, Mycobacterium
VTDAPWDPGVPDPAAPG

SEQ ID NO: 1256341 - protein, 24 aa, Mycobacterium
VTGCPAEVAVPVAVNLVITDEALL

SEQ ID NO: 1256342 - protein, 23 aa, Mycobacterium
VTGDALVRLPLGQSVRIDGVVPG

SEQ ID NO: 1256343 - protein, 19 aa, Mycobacterium
VTGEFYLNAINVMRGAEAI

SEQ ID NO: 1256344 - protein, 19 aa, Mycobacterium
VTGLAHAWEGAPGYLETVN

SEQ ID NO: 1256345 - protein, 18 aa, Mycobacterium
VTGVFRYTDTWSAAIHLV

SEQ ID NO: 1256346 - protein, 23 aa, Mycobacterium
VTIGRAGAWSTLTSEALLSTSIT

SEQ ID NO: 1256347 - protein, 19 aa, Mycobacterium
VTIGSFLRQASLVTNTLAD

SEQ ID NO: 1256348 - protein, 22 aa, Mycobacterium
VTIPGDVWRAFLAQETTLDDEH

SEQ ID NO: 1256349 - protein, 30 aa, Mycobacterium
VTLPNGRSGWRISIPAMMSYWSELARPVTV

SEQ ID NO: 1256350 - protein, 17 aa, Mycobacterium
VTLPVTLWFMDKAKAGT

SEQ ID NO: 1256351 - protein, 17 aa, Mycobacterium
VTLRLPLTRGVGIYAAC

SEQ ID NO: 1256352 - protein, 27 aa, Mycobacterium
VTLVDPRSSLPIEWVNEILSLTVRLRG

SEQ ID NO: 1256353 - protein, 32 aa, Mycobacterium
VTNRARLNWWESRALYGWTVLVPRTKDQAGEM

SEQ ID NO: 1256354 - protein, 20 aa, Mycobacterium
VTPGEVFGFLGPNGAGKSTT

SEQ ID NO: 1256355 - protein, 25 aa, Mycobacterium
VTPNRWFLNGADFIALRKLKETTGS

SEQ ID NO: 1256356 - protein, 26 aa, Mycobacterium
VTQSYRLLKHGGFERILFLVDRNNLA

SEQ ID NO: 1256357 - protein, 18 aa, Mycobacterium
VTRDAKWKPFNLGNLLYN

SEQ ID NO: 1256358 - protein, 27 aa, Mycobacterium
VTRFGEPRLGLAPALSQRSGDVVPTGV

SEQ ID NO: 1256359 - protein, 28 aa, Mycobacterium
VTRPTNLGGLGFSMKWNMGWMNDTLAFI

SEQ ID NO: 1256360 - protein, 22 aa, Mycobacterium
VTSEVWNTFGRHWDDLRPDRYA

SEQ ID NO: 1256361 - protein, 25 aa, Mycobacterium
VTTLPGIMSRWLATRLPDGQAPEVL

SEQ ID NO: 1256362 - protein, 23 aa, Mycobacterium
VTTTGLRTPIWLITRGAQRVTAT

SEQ ID NO: 1256363 - protein, 18 aa, Mycobacterium
VTVLNNWIRQGVVRRGLV

SEQ ID NO: 1256364 - protein, 20 aa, Mycobacterium
VTVRPGYNFANADAALSYGN

SEQ ID NO: 1256365 - protein, 18 aa, Mycobacterium
VTVTPEFAGAYKTWMDAE

SEQ ID NO: 1256366 - protein, 28 aa, Mycobacterium
VTVTWSLRSARAWWEMTWQGRPDPSIGE

SEQ ID NO: 1256367 - protein, 18 aa, Mycobacterium
VTVTYRLGIAGFLDIAGA

SEQ ID NO: 1256368 - protein, 24 aa, Mycobacterium
VVAFDPPCVIAWEPGQRVNGELEF

SEQ ID NO: 1256369 - protein, 22 aa, Mycobacterium
VVAMCEAYHGWTYGTDAVSTST

SEQ ID NO: 1256370 - protein, 17 aa, Mycobacterium
VVARGVSRLVTITSGLD

SEQ ID NO: 1256371 - protein, 18 aa, Mycobacterium
VVAVALPPHVPRALDADS

SEQ ID NO: 1256372 - protein, 23 aa, Mycobacterium
VVAVGITPDGSWVLTDGRPETLA

SEQ ID NO: 1256373 - protein, 19 aa, Mycobacterium
VVDRGPFGAVGRWLSRPTW

SEQ ID NO: 1256374 - protein, 21 aa, Mycobacterium
VVDYPASFWPFSDGYFVDPTY

SEQ ID NO: 1256375 - protein, 18 aa, Mycobacterium
VVECDWLYAPDVVAAGHD

SEQ ID NO: 1256376 - protein, 21 aa, Mycobacterium
VVFDLAAPVAEFARAAARVPG

SEQ ID NO: 1256377 - protein, 22 aa, Mycobacterium
VVFRRLHGPPGQGVPFVSTTVH

SEQ ID NO: 1256378 - protein, 25 aa, Mycobacterium
VVGAWGDALAVVSMALRGHTLHDVV

SEQ ID NO: 1256379 - protein, 23 aa, Mycobacterium
VVHAETFAPILYVLTYDDLDEAI

SEQ ID NO: 1256380 - protein, 18 aa, Mycobacterium
VVIGRIALMSGELGQLNG

SEQ ID NO: 1256381 - protein, 18 aa, Mycobacterium
VVLCRWVDQNFYVCIAVD

SEQ ID NO: 1256382 - protein, 25 aa, Mycobacterium
VVMTYWNPVLRWGIDAFARDLAAAG

SEQ ID NO: 1256383 - protein, 19 aa, Mycobacterium
VVNPLRWRPHPWGEDLRES

SEQ ID NO: 1256384 - protein, 29 aa, Mycobacterium
VVPESASSWFLPRLVGLTRATDWVLSGRV

SEQ ID NO: 1256385 - protein, 27 aa, Mycobacterium
VVRLPRIPVPFPMYLPGPNRVQIVNEE

SEQ ID NO: 1256386 - protein, 19 aa, Mycobacterium
VVRYCRARIGATERSGLSA

SEQ ID NO: 1256387 - protein, 30 aa, Mycobacterium
VVSAPALHRRWWAADGLGAFVTVSGESPRR

SEQ ID NO: 1256388 - protein, 19 aa, Mycobacterium
VVSVQWGDIFMRFTSAAQV

SEQ ID NO: 1256389 - protein, 17 aa, Mycobacterium
VVTEVGDFADILRRRLF

SEQ ID NO: 1256390 - protein, 17 aa, Mycobacterium
VVTEYYEKAGLWPYLEK

SEQ ID NO: 1256391 - protein, 25 aa, Mycobacterium
VVVACSAISQASRRRAQRRLPDSAV

SEQ ID NO: 1256392 - protein, 17 aa, Mycobacterium
VVVEHLKAAALQFDIGA

SEQ ID NO: 1256393 - protein, 19 aa, Mycobacterium
VVVGHDWGSPVVTNFALLY

SEQ ID NO: 1256394 - protein, 17 aa, Mycobacterium
VVVLKRLGDALADGDRV

SEQ ID NO: 1256395 - protein, 18 aa, Mycobacterium
VVVLPCDNMTPGASVQEY

SEQ ID NO: 1256396 - protein, 19 aa, Mycobacterium
VVVPAGLELLADVDESFID

SEQ ID NO: 1256397 - protein, 17 aa, Mycobacterium
VVWKPSPTQTFAAYLTM

SEQ ID NO: 1256398 - protein, 27 aa, Mycobacterium
VVYNAGGPDLLVWVAPPPAAPAGSGAG

SEQ ID NO: 1256399 - protein, 18 aa, Mycobacterium
VWDAFRRAHRLNFLRRTS

SEQ ID NO: 1256400 - protein, 25 aa, Mycobacterium
VWDGPTGALAPFWDAVHVIDPEAED

SEQ ID NO: 1256401 - protein, 18 aa, Mycobacterium
VWGDALRAGYAKRDPALG

SEQ ID NO: 1256402 - protein, 19 aa, Mycobacterium
VWGRRLVEQALWMVDVHRT

SEQ ID NO: 1256403 - protein, 19 aa, Mycobacterium
VWHEPVGVVGAIVPWNFPF

SEQ ID NO: 1256404 - protein, 25 aa, Mycobacterium
VWNRTDYRPLEGFVYAITPFNFTAI

SEQ ID NO: 1256405 - protein, 26 aa, Mycobacterium
VWNRTDYRPLEGFVYAITPFNFTAIA

SEQ ID NO: 1256406 - protein, 28 aa, Mycobacterium
VWRRHRERVDGLVLCAGAAAVSRASYER

SEQ ID NO: 1256407 - protein, 18 aa, Mycobacterium
VWRTYPVDRRRNLLHRHV

SEQ ID NO: 1256408 - protein, 17 aa, Mycobacterium
VYAEMSAVNPVFLLDGA

SEQ ID NO: 1256409 - protein, 26 aa, Mycobacterium
VYAPTFELGEWVIPRGYSIVVALAEI

SEQ ID NO: 1256410 - protein, 25 aa, Mycobacterium
VYCGERRGECPFGSEGNADGPLPIV

SEQ ID NO: 1256411 - protein, 17 aa, Mycobacterium
VYNTRPWVLLPPSQTDP

SEQ ID NO: 1256412 - protein, 25 aa, Mycobacterium
VYQRTAPWLLPRFDRPFTRAEKWAF

SEQ ID NO: 1256413 - protein, 20 aa, Mycobacterium
VYRSELLYRHRIDPYRLGTN

SEQ ID NO: 1256414 - protein, 18 aa, Mycobacterium
VYSNYGFGVLAATIERAA

SEQ ID NO: 1256415 - protein, 17 aa, Mycobacterium
WAAAIAAHIRFRGRRAA

SEQ ID NO: 1256416 - protein, 19 aa, Mycobacterium
WAAGEAKLRGSRLTLVYAA

SEQ ID NO: 1256417 - protein, 17 aa, Mycobacterium
WAAGLPWAGDLPPVQAC

SEQ ID NO: 1256418 - protein, 17 aa, Mycobacterium
WAALPRAGAVVFATGGM

SEQ ID NO: 1256419 - protein, 18 aa, Mycobacterium
WAANELHATKSDLVEIVK

SEQ ID NO: 1256420 - protein, 19 aa, Mycobacterium
WAELHRHLDYWSRKRYAAS

SEQ ID NO: 1256421 - protein, 20 aa, Mycobacterium
WAEPDGSMGQAWRQPDGSVV

SEQ ID NO: 1256422 - protein, 21 aa, Mycobacterium
WAGACRPGDGLGISGDEVLIV

SEQ ID NO: 1256423 - protein, 31 aa, Mycobacterium
WAGLSGLAPRIAVVKGRCFAGNAVIAGCADL

SEQ ID NO: 1256424 - protein, 17 aa, Mycobacterium
WAIMTLLFHLVDIGGQF

SEQ ID NO: 1256425 - protein, 29 aa, Mycobacterium
WANASDEWVRFIVRHVLQGGGPLGNEEEA

SEQ ID NO: 1256426 - protein, 20 aa, Mycobacterium
WARADLELEPGRTVFVGPNG

SEQ ID NO: 1256427 - protein, 20 aa, Mycobacterium
WARTRFAERAGILVETVRLR

SEQ ID NO: 1256428 - protein, 28 aa, Mycobacterium
WATARPDQVWAVLSGVVAWASGKGTKDA

SEQ ID NO: 1256429 - protein, 19 aa, Mycobacterium
WAVPTGWRVGDHAPTTHRL

SEQ ID NO: 1256430 - protein, 23 aa, Mycobacterium
WAVSGRRALYLTGEESAGQVRLR

SEQ ID NO: 1256431 - protein, 19 aa, Mycobacterium
WCRRTQEELGRLVWSQPSV

SEQ ID NO: 1256432 - protein, 21 aa, Mycobacterium
WDFTEVVGLPVQMSRVSRRFD

SEQ ID NO: 1256433 - protein, 17 aa, Mycobacterium
WDIGPTWHVESDLERTS

SEQ ID NO: 1256434 - protein, 24 aa, Mycobacterium
WDLFLPHLHPLIANLVREALPRSD

SEQ ID NO: 1256435 - protein, 29 aa, Mycobacterium
WDVFNDRYKPDWCRVINFPLTVAADVSDA

SEQ ID NO: 1256436 - protein, 17 aa, Mycobacterium
WEAMARVLAHLRRDDTA

SEQ ID NO: 1256437 - protein, 17 aa, Mycobacterium
WEATPFDERAAVFLRAA

SEQ ID NO: 1256438 - protein, 20 aa, Mycobacterium
WEKMPETFLAALDERFGITS

SEQ ID NO: 1256439 - protein, 19 aa, Mycobacterium
WELEDLSFAILHPKKYDEI

SEQ ID NO: 1256440 - protein, 20 aa, Mycobacterium
WEPFVDELVRACLDDHIESG

SEQ ID NO: 1256441 - protein, 18 aa, Mycobacterium
WEPWLHALPVEFETEQQV

SEQ ID NO: 1256442 - protein, 17 aa, Mycobacterium
WERRSGFARLAIANDYP

SEQ ID NO: 1256443 - protein, 25 aa, Mycobacterium
WETFLATELPDWLAANKGLAPGGHG

SEQ ID NO: 1256444 - protein, 20 aa, Mycobacterium
WETLMLRLGYQRYGAQGGDW

SEQ ID NO: 1256445 - protein, 20 aa, Mycobacterium
WEVLADFGAIGQWLSGVDHS

SEQ ID NO: 1256446 - protein, 22 aa, Mycobacterium
WEVNGGWVRWGFTVAPEGDGTR

SEQ ID NO: 1256447 - protein, 26 aa, Mycobacterium
WFAPKDLRLFYQVRQNWRGKAVLVKL

SEQ ID NO: 1256448 - protein, 18 aa, Mycobacterium
WGAACSLIQSIYDGFGSG

SEQ ID NO: 1256449 - protein, 17 aa, Mycobacterium
WGALLSALGTRLGDTGR

SEQ ID NO: 1256450 - protein, 18 aa, Mycobacterium
WGDTEAWRQSRQRTARMS

SEQ ID NO: 1256451 - protein, 24 aa, Mycobacterium
WGEWDARLRHELGLDNQQARRQLT

SEQ ID NO: 1256452 - protein, 17 aa, Mycobacterium
WGLGWEELHAANPRLIM

SEQ ID NO: 1256453 - protein, 17 aa, Mycobacterium
WGPEDRIRETGLRERWE

SEQ ID NO: 1256454 - protein, 27 aa, Mycobacterium
WGSWAAEIYADLGLRFDGARAEAVSAA

SEQ ID NO: 1256455 - protein, 17 aa, Mycobacterium
WGWDEILPIFKGFENNE

SEQ ID NO: 1256456 - protein, 17 aa, Mycobacterium
WGYAPEYVEGMWRMLQV

SEQ ID NO: 1256457 - protein, 24 aa, Mycobacterium
WHDARRATGLPGHVRVIGQIPICW

SEQ ID NO: 1256458 - protein, 25 aa, Mycobacterium
WHHKPRYRVGTVMRSRWDRASAAAR

SEQ ID NO: 1256459 - protein, 18 aa, Mycobacterium
WHPVIGPFFNRGLMMLDF

SEQ ID NO: 1256460 - protein, 19 aa, Mycobacterium
WIAACAIAKGVELFSGDAI

SEQ ID NO: 1256461 - protein, 22 aa, Mycobacterium
WIDTRLQWYVDLGIDRDNLRLY

SEQ ID NO: 1256462 - protein, 18 aa, Mycobacterium
WIGLLGPQVLWELYGGTE

SEQ ID NO: 1256463 - protein, 18 aa, Mycobacterium
WISGIPMSVIIREGTAEQ

SEQ ID NO: 1256464 - protein, 26 aa, Mycobacterium
WITKNYREAYGLFAVNGILFNHESPR

SEQ ID NO: 1256465 - protein, 17 aa, Mycobacterium
WIWKTMTSFPGSYMTAF

SEQ ID NO: 1256466 - protein, 18 aa, Mycobacterium
WKQLSRNALVSHLIESPL

SEQ ID NO: 1256467 - protein, 17 aa, Mycobacterium
WKTMTSFPGSYMTAFPS

SEQ ID NO: 1256468 - protein, 21 aa, Mycobacterium
WKYHADCLAQRGLLDGAGELT

SEQ ID NO: 1256469 - protein, 18 aa, Mycobacterium
WLAAQGHAPSAWTTLGAV

SEQ ID NO: 1256470 - protein, 24 aa, Mycobacterium
WLAAQPRPPVAVFVKDPAPELVRH

SEQ ID NO: 1256471 - protein, 24 aa, Mycobacterium
WLAKLRCERCSWVVALNRGTVEPE

SEQ ID NO: 1256472 - protein, 20 aa, Mycobacterium
WLASGPDLGPWAEARDPDAG

SEQ ID NO: 1256473 - protein, 17 aa, Mycobacterium
WLASRQGAGTWVVNSQA

SEQ ID NO: 1256474 - protein, 25 aa, Mycobacterium
WLGEPYRIAPTVAFEDLDDGGLAPD

SEQ ID NO: 1256475 - protein, 17 aa, Mycobacterium
WLNRLLEDCARDAGEDV

SEQ ID NO: 1256476 - protein, 26 aa, Mycobacterium
WLPDRSASWVVPWLWRQWSPGYHAAE

SEQ ID NO: 1256477 - protein, 20 aa, Mycobacterium
WLPGRARTFYGTDFSTWSDL

SEQ ID NO: 1256478 - protein, 19 aa, Mycobacterium
WLRPVPDGVAGELYLSGAQ

SEQ ID NO: 1256479 - protein, 17 aa, Mycobacterium
WLSDWGHSYEARPDSKL

SEQ ID NO: 1256480 - protein, 20 aa, Mycobacterium
WMFPLLDSMAEVWKKAPEAF

SEQ ID NO: 1256481 - protein, 19 aa, Mycobacterium
WMRAREALIRTDVFGTQAD

SEQ ID NO: 1256482 - protein, 27 aa, Mycobacterium
WNAAISVNLWGVIYGCETFVPRLRSNG

SEQ ID NO: 1256483 - protein, 20 aa, Mycobacterium
WNAIRHAKPIAVGLNCALGA

SEQ ID NO: 1256484 - protein, 17 aa, Mycobacterium
WNDHLNKFVMLYTNTVS

SEQ ID NO: 1256485 - protein, 17 aa, Mycobacterium
WNGDITPYFSVGACVPI

SEQ ID NO: 1256486 - protein, 18 aa, Mycobacterium
WNSMPLKLFAGGNAKFWD

SEQ ID NO: 1256487 - protein, 24 aa, Mycobacterium
WNTDKRYLVELAQRGVPTVPTRHF

SEQ ID NO: 1256488 - protein, 18 aa, Mycobacterium
WNTPMSFITERALQPVLD

SEQ ID NO: 1256489 - protein, 17 aa, Mycobacterium
WNVPRRLTTMALFGGGV

SEQ ID NO: 1256490 - protein, 17 aa, Mycobacterium
WPADRTSVTWTLVSSSL

SEQ ID NO: 1256491 - protein, 20 aa, Mycobacterium
WPDADALTILRNIRSAAGTG

SEQ ID NO: 1256492 - protein, 25 aa, Mycobacterium
WPDHGCVGCSLMADHIGNLAHLNAR

SEQ ID NO: 1256493 - protein, 19 aa, Mycobacterium
WPEFPESIEFTIGQLTEHP

SEQ ID NO: 1256494 - protein, 19 aa, Mycobacterium
WPELDELSAAAMCYTSGTT

SEQ ID NO: 1256495 - protein, 20 aa, Mycobacterium
WPGATARLEARVCGFEVAGA

SEQ ID NO: 1256496 - protein, 17 aa, Mycobacterium
WPMLTPIMRSREYLFTG

SEQ ID NO: 1256497 - protein, 23 aa, Mycobacterium
WPQDQRGLLDLKYILGAPQADTL

SEQ ID NO: 1256498 - protein, 18 aa, Mycobacterium
WPQNRRPGAELLRVGCPF

SEQ ID NO: 1256499 - protein, 20 aa, Mycobacterium
WPRVLNVWRANLLGSSSKGN

SEQ ID NO: 1256500 - protein, 24 aa, Mycobacterium
WQEDKRWTPQWSDDQRAEGYAGWQ

SEQ ID NO: 1256501 - protein, 20 aa, Mycobacterium
WQQVMVLRAYAKYLRQAGFP

SEQ ID NO: 1256502 - protein, 17 aa, Mycobacterium
WQRLLTAIRDAGLVLTG

SEQ ID NO: 1256503 - protein, 18 aa, Mycobacterium
WQRNGAEILGRIADPEVR

SEQ ID NO: 1256504 - protein, 18 aa, Mycobacterium
WQRRFPDVAVRRVAVLDQ

SEQ ID NO: 1256505 - protein, 24 aa, Mycobacterium
WRAARAVGPLCCSDGGPLAAPSAS

SEQ ID NO: 1256506 - protein, 18 aa, Mycobacterium
WRDAHAGVAHAIHTPGTI

SEQ ID NO: 1256507 - protein, 18 aa, Mycobacterium
WRDAHRMSIVLGELGDVE

SEQ ID NO: 1256508 - protein, 19 aa, Mycobacterium
WRDATVHRLAERFDEAVAD

SEQ ID NO: 1256509 - protein, 22 aa, Mycobacterium
WRDCYRVKARVLGLEGQLALAE

SEQ ID NO: 1256510 - protein, 19 aa, Mycobacterium
WRDMPKVVFSRTLESVDWN

SEQ ID NO: 1256511 - protein, 26 aa, Mycobacterium
WRMAHVIVGVFAMRIHSHFGGPPADY

SEQ ID NO: 1256512 - protein, 28 aa, Mycobacterium
WRRAFEAARPRAVWLPHYPYPLARFLPG

SEQ ID NO: 1256513 - protein, 20 aa, Mycobacterium
WRRDVRRAAIDAVTEFVTDR

SEQ ID NO: 1256514 - protein, 17 aa, Mycobacterium
WRRRRVRIAEIPDTDKP

SEQ ID NO: 1256515 - protein, 17 aa, Mycobacterium
WRSGAPLVLAPDQDDPE

SEQ ID NO: 1256516 - protein, 20 aa, Mycobacterium
WRTEYLYSRAATIYGGTAEV

SEQ ID NO: 1256517 - protein, 19 aa, Mycobacterium
WRTWYPRTRPATITLDPGL

SEQ ID NO: 1256518 - protein, 25 aa, Mycobacterium
WSACQAVGHAAWFLHVQGVLVPAAG

SEQ ID NO: 1256519 - protein, 21 aa, Mycobacterium
WSDIRLDHGFHTYRQVEGFSV

SEQ ID NO: 1256520 - protein, 26 aa, Mycobacterium
WSDISDLFAGLPAWANLRPVLGGHPI

SEQ ID NO: 1256521 - protein, 17 aa, Mycobacterium
WSLYPMGGSAVRLVRQI

SEQ ID NO: 1256522 - protein, 18 aa, Mycobacterium
WSPDEIRDGAQIVDWIVG

SEQ ID NO: 1256523 - protein, 24 aa, Mycobacterium
WSPKRLPDSLLHYMRTRGKDKVIF

SEQ ID NO: 1256524 - protein, 17 aa, Mycobacterium
WSPTRYTRWLGDSLIRQ

SEQ ID NO: 1256525 - protein, 18 aa, Mycobacterium
WSRLPDWRNQTLTPNPDT

SEQ ID NO: 1256526 - protein, 25 aa, Mycobacterium
WSSRPLPLPDMCYAAAATGELPHLR

SEQ ID NO: 1256527 - protein, 18 aa, Mycobacterium
WSTLDWNAQRLAVFDGDV

SEQ ID NO: 1256528 - protein, 20 aa, Mycobacterium
WSYLREVQSTYPLSYGPQSD

SEQ ID NO: 1256529 - protein, 22 aa, Mycobacterium
WTAENLRWLLARIGPVGIVAFG

SEQ ID NO: 1256530 - protein, 19 aa, Mycobacterium
WTAGQARFAVYAALAVTID

SEQ ID NO: 1256531 - protein, 18 aa, Mycobacterium
WTDEEWHEVLELNLSSAW

SEQ ID NO: 1256532 - protein, 31 aa, Mycobacterium
WTFLGTRPAGWWIRRRVHEVAVHRADAALAL

SEQ ID NO: 1256533 - protein, 18 aa, Mycobacterium
WTGEDGWRDEQFADGTIV

SEQ ID NO: 1256534 - protein, 18 aa, Mycobacterium
WTGENGWCDQQFTDATIV

SEQ ID NO: 1256535 - protein, 18 aa, Mycobacterium
WTGENGWRDQQFTDGTIV

SEQ ID NO: 1256536 - protein, 19 aa, Mycobacterium
WTIRWKPALNAFAITFADR

SEQ ID NO: 1256537 - protein, 18 aa, Mycobacterium
WTMFASYMPRARRAVDEI

SEQ ID NO: 1256538 - protein, 22 aa, Mycobacterium
WTPEGHIGRLFATMKPYMPPPP

SEQ ID NO: 1256539 - protein, 17 aa, Mycobacterium
WTQPVVWAADMTGAGPF

SEQ ID NO: 1256540 - protein, 22 aa, Mycobacterium
WTVPRTSIRPSWFNTVPGVQFV

SEQ ID NO: 1256541 - protein, 28 aa, Mycobacterium
WTWVLSRPCPDCGFDASAVHHSDVADMI

SEQ ID NO: 1256542 - protein, 24 aa, Mycobacterium
WVDVCSREVIGLVARRLDCQVGLL

SEQ ID NO: 1256543 - protein, 20 aa, Mycobacterium
WVLSGRDAPPDWAFGGTASY

SEQ ID NO: 1256544 - protein, 22 aa, Mycobacterium
WVRNRLAPRLLQVPMIRDGVAG

SEQ ID NO: 1256545 - protein, 25 aa, Mycobacterium
WVSALAAAGYRVWAINPMAAARYRD

SEQ ID NO: 1256546 - protein, 23 aa, Mycobacterium
WVTGDTFAPVRAMLSGSRRSTGR

SEQ ID NO: 1256547 - protein, 22 aa, Mycobacterium
WVYDLRTNQHFTLKQNRLRRHH

SEQ ID NO: 1256548 - protein, 18 aa, Mycobacterium
WWHGFSRFCPEIVDVTVP

SEQ ID NO: 1256549 - protein, 17 aa, Mycobacterium
WYASVIRHTGCRSGKTY

SEQ ID NO: 1256550 - protein, 17 aa, Mycobacterium
WYHDHLGMIVLHEEVNE

SEQ ID NO: 1256551 - protein, 26 aa, Mycobacterium
WYRMRVAPSVFAHVWAALKIACAGFN

SEQ ID NO: 1256552 - protein, 33 aa, Mycobacterium
YAAACNIYADLGWRGVIPVDPRDKGGIPAGFTG

SEQ ID NO: 1256553 - protein, 27 aa, Mycobacterium
YAADIERLEFLAARGWLIVRVSATQLR

SEQ ID NO: 1256554 - protein, 25 aa, Mycobacterium
YAALGPKGRAGFVMANSAGDAGHSE

SEQ ID NO: 1256555 - protein, 18 aa, Mycobacterium
YADALGERGVRAAVYHAG

SEQ ID NO: 1256556 - protein, 19 aa, Mycobacterium
YADAVPWNMLHTARDRGTA

SEQ ID NO: 1256557 - protein, 17 aa, Mycobacterium
YADMLARDFSPVPTPHE

SEQ ID NO: 1256558 - protein, 18 aa, Mycobacterium
YAFAVLRLAAQRNGDAPP

SEQ ID NO: 1256559 - protein, 25 aa, Mycobacterium
YAGGLRPILCLTKSDLAPAEPFAAQ

SEQ ID NO: 1256560 - protein, 24 aa, Mycobacterium
YAKALGFYCDCAVLRDSPLEPGIL

SEQ ID NO: 1256561 - protein, 20 aa, Mycobacterium
YAKEAPGWRVATSCDAEGRH

SEQ ID NO: 1256562 - protein, 21 aa, Mycobacterium
YALRWPIDRRAGAVRDEAAAD

SEQ ID NO: 1256563 - protein, 17 aa, Mycobacterium
YANRSAHDLAMYQDPNA

SEQ ID NO: 1256564 - protein, 23 aa, Mycobacterium
YAPAKVFLPWAAFSEERSAAIRA

SEQ ID NO: 1256565 - protein, 18 aa, Mycobacterium
YAPLYGEVWGDPRWRQLS

SEQ ID NO: 1256566 - protein, 19 aa, Mycobacterium
YAQAAGWRPDPRTLTWWAV

SEQ ID NO: 1256567 - protein, 23 aa, Mycobacterium
YATRDELILAALEAWMEDNRYSG

SEQ ID NO: 1256568 - protein, 20 aa, Mycobacterium
YCINSAALRFIHLDDLEAQG

SEQ ID NO: 1256569 - protein, 25 aa, Mycobacterium
YCLVEKLRTAFGLEIPGLAVPVEDA

SEQ ID NO: 1256570 - protein, 24 aa, Mycobacterium
YDDMVHVWPLFSSILPEGVDAANE

SEQ ID NO: 1256571 - protein, 19 aa, Mycobacterium
YDQDPRLGSAVVNEPALVI

SEQ ID NO: 1256572 - protein, 24 aa, Mycobacterium
YDRVLDVPRLLSFHNLVEDEAPHP

SEQ ID NO: 1256573 - protein, 23 aa, Mycobacterium
YDVCACLRMLAGHRPSRLHHVAR

SEQ ID NO: 1256574 - protein, 18 aa, Mycobacterium
YEAFCGVVSDAAAAAAAD

SEQ ID NO: 1256575 - protein, 20 aa, Mycobacterium
YEANAGFARPEMTVQAHLDL

SEQ ID NO: 1256576 - protein, 19 aa, Mycobacterium
YEAVMNWTAGTPIAHPSPS

SEQ ID NO: 1256577 - protein, 23 aa, Mycobacterium
YEAVMRRQLLPTGRVTYLPMTEY

SEQ ID NO: 1256578 - protein, 19 aa, Mycobacterium
YECCCSVSLAADLARDRPY

SEQ ID NO: 1256579 - protein, 20 aa, Mycobacterium
YEDAGRIAADPAYGRIVCFC

SEQ ID NO: 1256580 - protein, 17 aa, Mycobacterium
YEFDIDWNLTGTPEAAP

SEQ ID NO: 1256581 - protein, 19 aa, Mycobacterium
YEFHPCDIRDDDSVKSLID

SEQ ID NO: 1256582 - protein, 19 aa, Mycobacterium
YEGPKGGPGMREMLAITGA

SEQ ID NO: 1256583 - protein, 30 aa, Mycobacterium
YEIRGPGGVVWRVDFAWPDRRVVAEYESVD

SEQ ID NO: 1256584 - protein, 19 aa, Mycobacterium
YELAPKIRVNGVAPGGTVT

SEQ ID NO: 1256585 - protein, 23 aa, Mycobacterium
YELDRKHVFHSWSAQAEISPMVI

SEQ ID NO: 1256586 - protein, 23 aa, Mycobacterium
YERVKPAFKQWASVVVHAGEPGA

SEQ ID NO: 1256587 - protein, 17 aa, Mycobacterium
YFAAYNLVCGPVVDEEN

SEQ ID NO: 1256588 - protein, 24 aa, Mycobacterium
YFGDLRTGMLGVWIGAIQNMYPEL

SEQ ID NO: 1256589 - protein, 19 aa, Mycobacterium
YFSAPKMAWLRAALTRSGV

SEQ ID NO: 1256590 - protein, 21 aa, Mycobacterium
YFYRRSGALGCWFDESPHQYT

SEQ ID NO: 1256591 - protein, 18 aa, Mycobacterium
YGAITAPTLVVWTSDDPT

SEQ ID NO: 1256592 - protein, 27 aa, Mycobacterium
YGAPKELSIQFVFAYDVGEFAETLRAI

SEQ ID NO: 1256593 - protein, 17 aa, Mycobacterium
YGEDLVFTAEVDVRPEI

SEQ ID NO: 1256594 - protein, 25 aa, Mycobacterium
YGETKLIGEWLLRDMGRASGLRHTS

SEQ ID NO: 1256595 - protein, 19 aa, Mycobacterium
YGLQICAHWCRSGRADTCA

SEQ ID NO: 1256596 - protein, 19 aa, Mycobacterium
YGPLPSQLLDVWRPKELPT

SEQ ID NO: 1256597 - protein, 26 aa, Mycobacterium
YGQGRAVDVVRRLESLYTLSPPPTAP

SEQ ID NO: 1256598 - protein, 20 aa, Mycobacterium
YGRDGFLPTRLTVDLFKAAR

SEQ ID NO: 1256599 - protein, 21 aa, Mycobacterium
YGRIGRAVARRARAFDMTVLA

SEQ ID NO: 1256600 - protein, 25 aa, Mycobacterium
YGTRAVVGACRRHGAQFSVVMGRNS

SEQ ID NO: 1256601 - protein, 24 aa, Mycobacterium
YHALRASNRIAIERGTHFKGFERS

SEQ ID NO: 1256602 - protein, 31 aa, Mycobacterium
YHLYAIPRFVNRWAVSLAYLTDVFFARSVVS

SEQ ID NO: 1256603 - protein, 17 aa, Mycobacterium
YHPKGLFERTGNLWRAQ

SEQ ID NO: 1256604 - protein, 17 aa, Mycobacterium
YHRELVEHFILEEKWGR

SEQ ID NO: 1256605 - protein, 18 aa, Mycobacterium
YHRPRRESLLALCAVLDP

SEQ ID NO: 1256606 - protein, 20 aa, Mycobacterium
YIALRCATFRGYGLFRSNVA

SEQ ID NO: 1256607 - protein, 22 aa, Mycobacterium
YIDVPGLCKVATRSEIEDQGWS

SEQ ID NO: 1256608 - protein, 24 aa, Mycobacterium
YIERLDPSIFWMGMHHSRLVERDE

SEQ ID NO: 1256609 - protein, 23 aa, Mycobacterium
YIFRYGEGTVMAIMHPDNPVAEK

SEQ ID NO: 1256610 - protein, 19 aa, Mycobacterium
YKELKGLVRREGLHTVCEE

SEQ ID NO: 1256611 - protein, 21 aa, Mycobacterium
YKGVESCELVFDDCRVPATAI

SEQ ID NO: 1256612 - protein, 25 aa, Mycobacterium
YKKTTKLPAPPARSAAEKAQQTSAA

SEQ ID NO: 1256613 - protein, 26 aa, Mycobacterium
YKLQRSEYLEPRWMIGIDPESEGLAR

SEQ ID NO: 1256614 - protein, 18 aa, Mycobacterium
YKSLEWSLAEAFPSDGST

SEQ ID NO: 1256615 - protein, 23 aa, Mycobacterium
YKVPRKIWWADEIQRTPAGKPDY

SEQ ID NO: 1256616 - protein, 17 aa, Mycobacterium
YLAGASIRSLTIWLNDA

SEQ ID NO: 1256617 - protein, 17 aa, Mycobacterium
YLDAFARHRRRLGDRTT

SEQ ID NO: 1256618 - protein, 18 aa, Mycobacterium
YLDRACETAGRFVADPFL

SEQ ID NO: 1256619 - protein, 25 aa, Mycobacterium
YLGACYDAGLSWVHFPEGLGGLGVS

SEQ ID NO: 1256620 - protein, 17 aa, Mycobacterium
YLGDLRSLFAFCNERTP

SEQ ID NO: 1256621 - protein, 21 aa, Mycobacterium
YLHRREHLVTDLADQIRDHAR

SEQ ID NO: 1256622 - protein, 19 aa, Mycobacterium
YLLTSHVWRQDHNGASHQD

SEQ ID NO: 1256623 - protein, 17 aa, Mycobacterium
YLLYLDFQVDDTVHTAT

SEQ ID NO: 1256624 - protein, 17 aa, Mycobacterium
YLLYPYRATSRKNQARW

SEQ ID NO: 1256625 - protein, 20 aa, Mycobacterium
YLNAINVMRGAEAISTYAPI

SEQ ID NO: 1256626 - protein, 18 aa, Mycobacterium
YLTESVPVQLVWGTHDSV

SEQ ID NO: 1256627 - protein, 17 aa, Mycobacterium
YLTRPSLVHYTRTPDEF

SEQ ID NO: 1256628 - protein, 19 aa, Mycobacterium
YLVGVDFEGAQHWTDPKQR

SEQ ID NO: 1256629 - protein, 20 aa, Mycobacterium
YMHLGSPLLQRATRRLRSAL

SEQ ID NO: 1256630 - protein, 20 aa, Mycobacterium
YNEVLFWSRLPDWRNQTLTP

SEQ ID NO: 1256631 - protein, 19 aa, Mycobacterium
YNGKCLRASAGSIFGVSVV

SEQ ID NO: 1256632 - protein, 23 aa, Mycobacterium
YNSPEWIVALFALLLQGAVPVLG

SEQ ID NO: 1256633 - protein, 39 aa, Mycobacterium
YNVTVEWDPPAPVREWYFYTSRLTVWRVKPTDWKTKNLI

SEQ ID NO: 1256634 - protein, 19 aa, Mycobacterium
YPAGTALDLIPIRIVMRHR

SEQ ID NO: 1256635 - protein, 18 aa, Mycobacterium
YPAVGAIAGHVAFYPDKA

SEQ ID NO: 1256636 - protein, 24 aa, Mycobacterium
YPDAISRMTTWFGDDEDRPLRRPF

SEQ ID NO: 1256637 - protein, 18 aa, Mycobacterium
YPDLKFAFSEGGIGWIPF

SEQ ID NO: 1256638 - protein, 21 aa, Mycobacterium
YPDQCDGWLGLAASGAGDRHV

SEQ ID NO: 1256639 - protein, 22 aa, Mycobacterium
YPEKADAVWGDALRAGYAKRDP

SEQ ID NO: 1256640 - protein, 25 aa, Mycobacterium
YPKTARLVLDAAVLKDTMVLAYQWP

SEQ ID NO: 1256641 - protein, 25 aa, Mycobacterium
YPKVVLVTGACRFLGGYLIARLAQN

SEQ ID NO: 1256642 - protein, 17 aa, Mycobacterium
YPLLAHVVLFGGGYIRQ

SEQ ID NO: 1256643 - protein, 22 aa, Mycobacterium
YPLLQMSWKVAPALAAGCTMVM

SEQ ID NO: 1256644 - protein, 19 aa, Mycobacterium
YPMFNRIREQAPLYYNADH

SEQ ID NO: 1256645 - protein, 25 aa, Mycobacterium
YPPRLAEDWDSVGLVCGDPDEPVES

SEQ ID NO: 1256646 - protein, 25 aa, Mycobacterium
YPRDWPRPQHGWTLTIEGDPSMRTH

SEQ ID NO: 1256647 - protein, 20 aa, Mycobacterium
YPTVSALAGALGARFSTGGL

SEQ ID NO: 1256648 - protein, 20 aa, Mycobacterium
YPWREARPGRYGSDIQVLRE

SEQ ID NO: 1256649 - protein, 17 aa, Mycobacterium
YQALAATDWCGRWIVAG

SEQ ID NO: 1256650 - protein, 19 aa, Mycobacterium
YQAWPAGRFLIVTREDLHG

SEQ ID NO: 1256651 - protein, 21 aa, Mycobacterium
YQRCTYVPMVELLRYLEDNDF

SEQ ID NO: 1256652 - protein, 19 aa, Mycobacterium
YRALPSGPFYGFNRPGVEP

SEQ ID NO: 1256653 - protein, 18 aa, Mycobacterium
YRATSRKNQARWQFGVLG

SEQ ID NO: 1256654 - protein, 24 aa, Mycobacterium
YRDLPVEVPVPFAMPVLYRDDNIV

SEQ ID NO: 1256655 - protein, 24 aa, Mycobacterium
YRDRGCPEPAPIRPELLHEMMQWL

SEQ ID NO: 1256656 - protein, 24 aa, Mycobacterium
YRDRTCVVPGCGATRGLHAHHIQH

SEQ ID NO: 1256657 - protein, 18 aa, Mycobacterium
YRGADPALLRTEEGSAIV

SEQ ID NO: 1256658 - protein, 23 aa, Mycobacterium
YRGYPVGGLLMWETTSEDITVRG

SEQ ID NO: 1256659 - protein, 24 aa, Mycobacterium
YRIDIPLLAIVPCAVPASGTVYRQ

SEQ ID NO: 1256660 - protein, 22 aa, Mycobacterium
YRLGEVNGGWTVLREPLNAEHG

SEQ ID NO: 1256661 - protein, 19 aa, Mycobacterium
YRLGPSLITLGHRAQESMR

SEQ ID NO: 1256662 - protein, 25 aa, Mycobacterium
YRLNELTTRELLALTLVEAGVATRW

SEQ ID NO: 1256663 - protein, 20 aa, Mycobacterium
YRPPARPDVIAALDREGLLP

SEQ ID NO: 1256664 - protein, 21 aa, Mycobacterium
YRSTESFALDAGRMCVTLSRH

SEQ ID NO: 1256665 - protein, 18 aa, Mycobacterium
YRTVRLGDHTARVLLAKN

SEQ ID NO: 1256666 - protein, 19 aa, Mycobacterium
YRWVSELDGSVMDTPPAPE

SEQ ID NO: 1256667 - protein, 18 aa, Mycobacterium
YRYLRALDTKDWAAFADT

SEQ ID NO: 1256668 - protein, 22 aa, Mycobacterium
YSGRPGAAALRLLILHDDADRE

SEQ ID NO: 1256669 - protein, 22 aa, Mycobacterium
YSPEGYRRIVALGRELTSLRGH

SEQ ID NO: 1256670 - protein, 21 aa, Mycobacterium
YSPRMRVGVHTGRPQRIGSDW

SEQ ID NO: 1256671 - protein, 26 aa, Mycobacterium
YSTLQSGPEFGRWLAERGSAQAPETA

SEQ ID NO: 1256672 - protein, 28 aa, Mycobacterium
YSVRYDWPVRTGIIIGRLDADGSRFLAI

SEQ ID NO: 1256673 - protein, 19 aa, Mycobacterium
YTHLRAEFEHRLRQLQDTG

SEQ ID NO: 1256674 - protein, 27 aa, Mycobacterium
YTKGFKFSTYATWWIRQAITRGMADQS

SEQ ID NO: 1256675 - protein, 18 aa, Mycobacterium
YTLFFAGYVRKTWLAEPA

SEQ ID NO: 1256676 - protein, 17 aa, Mycobacterium
YTREMFCLMEGRHVHPS

SEQ ID NO: 1256677 - protein, 26 aa, Mycobacterium
YVDGKRAGLWPGLKETFNSGSTEIPL

SEQ ID NO: 1256678 - protein, 17 aa, Mycobacterium
YVHNLIHGFILAAEHLV

SEQ ID NO: 1256679 - protein, 22 aa, Mycobacterium
YVSADAFCWSMVRSLVGALIAV

SEQ ID NO: 1256680 - protein, 22 aa, Mycobacterium
YWFRRHEVVYARLADQCAGRDV

SEQ ID NO: 1256681 - protein, 20 aa, Mycobacterium
YWNHYQLTFALYSVSDRAIP

SEQ ID NO: 1256682 - protein, 21 aa, Mycobacterium
YWYANLRTMVRFDRAFESARR

SEQ ID NO: 1256683 - protein, 19 aa, Mycobacterium
YWYHAELIDTARLTRLAAG

SEQ ID NO: 1256684 - protein, 20 aa, Mycobacterium
YYIHGFLRDRMQTLQDEFAK

SEQ ID NO: 1256685 - protein, 18 aa, Mycobacterium
YYLDMGWEDLELAVEYDG

SEQ ID NO: 1256686 - protein, 26 aa, Mycobacterium
YYLVLAKWKLAIVLEQGFQRAGDDEK

SEQ ID NO: 1256687 - protein, 18 aa, Mycobacterium
YYVLEKFAYIVMDSSTYG

SEQ ID NO: 1256688 - protein, 20 aa, Mycobacterium
AAAADCPEVLSAFHELGTSL

SEQ ID NO: 1256689 - protein, 23 aa, Mycobacterium
AAAAEFFPLSGASVLLDAGTTTM

SEQ ID NO: 1256690 - protein, 25 aa, Mycobacterium
AAAAEGRASFDFSGPPLKLDDVRLL

SEQ ID NO: 1256691 - protein, 18 aa, Mycobacterium
AAAAEYTVEFSFPAGYPD

SEQ ID NO: 1256692 - protein, 19 aa, Mycobacterium
AAAAFGLRAHIVMPEETPE

SEQ ID NO: 1256693 - protein, 26 aa, Mycobacterium
AAAAGLEWEGSALLDLATGISIDTIR

SEQ ID NO: 1256694 - protein, 18 aa, Mycobacterium
AAAALGFLAGRPATDPQR

SEQ ID NO: 1256695 - protein, 19 aa, Mycobacterium
AAAAMGWMPFYPQFDRNSL

SEQ ID NO: 1256696 - protein, 18 aa, Mycobacterium
AAAARARQALLTKPAGAL

SEQ ID NO: 1256697 - protein, 21 aa, Mycobacterium
AAAARCEYALLRSFDARLGWG

SEQ ID NO: 1256698 - protein, 25 aa, Mycobacterium
AAAARPMNLLAIPWIDPVDVANASL

SEQ ID NO: 1256699 - protein, 17 aa, Mycobacterium
AAACPAPDHMECPTFRG

SEQ ID NO: 1256700 - protein, 22 aa, Mycobacterium
AAADFDGLLLLGGGDIDPTCYG

SEQ ID NO: 1256701 - protein, 23 aa, Mycobacterium
AAADGYRTSLRLVHSTVTTGHLF

SEQ ID NO: 1256702 - protein, 22 aa, Mycobacterium
AAADIGFPILVKAAFGGGGRGM

SEQ ID NO: 1256703 - protein, 22 aa, Mycobacterium
AAADLLCEGGFDAVRHRAVARR

SEQ ID NO: 1256704 - protein, 23 aa, Mycobacterium
AAADLLCEGGFDAVRHRAVARRA

SEQ ID NO: 1256705 - protein, 17 aa, Mycobacterium
AAADMFDRLGAAAMAAD

SEQ ID NO: 1256706 - protein, 17 aa, Mycobacterium
AAAEAGVPIVTGDTKVV

SEQ ID NO: 1256707 - protein, 30 aa, Mycobacterium
AAAEELRRLWRARRVLAVTFPTHGDSVESA

SEQ ID NO: 1256708 - protein, 20 aa, Mycobacterium
AAAEFGWAISPWAAEQVPLL

SEQ ID NO: 1256709 - protein, 25 aa, Mycobacterium
AAAELGEQCAFGLALIAPQLPPFDV

SEQ ID NO: 1256710 - protein, 23 aa, Mycobacterium
AAAELRNSLPLMLAGILDEVPGA

SEQ ID NO: 1256711 - protein, 17 aa, Mycobacterium
AAAELRTPIWVVTRRAQ

SEQ ID NO: 1256712 - protein, 22 aa, Mycobacterium
AAAEPAAAVVFLHGFGEHTGLY

SEQ ID NO: 1256713 - protein, 24 aa, Mycobacterium
AAAESKRPFGLWRATLPAAEKSNL

SEQ ID NO: 1256714 - protein, 19 aa, Mycobacterium
AAAFDAADHFGWVACDNRT

SEQ ID NO: 1256715 - protein, 17 aa, Mycobacterium
AAAFPEIQQIGFFADLV

SEQ ID NO: 1256716 - protein, 26 aa, Mycobacterium
AAAFPQWRATTLLERAEMIRSFAQRL

SEQ ID NO: 1256717 - protein, 17 aa, Mycobacterium
AAAFVAGQRFCYVREPV

SEQ ID NO: 1256718 - protein, 17 aa, Mycobacterium
AAAGAGHRVIAWNRTPH

SEQ ID NO: 1256719 - protein, 17 aa, Mycobacterium
AAAGRVSFRMGLQGPAV

SEQ ID NO: 1256720 - protein, 30 aa, Mycobacterium
AAAGSPNYLGTTGFPYTNVVVDNAITGNAG

SEQ ID NO: 1256721 - protein, 20 aa, Mycobacterium
AAAHRMGLPLGEVTRALIAV

SEQ ID NO: 1256722 - protein, 24 aa, Mycobacterium
AAAIGRISYRLGLQGPAVAVDTAC

SEQ ID NO: 1256723 - protein, 20 aa, Mycobacterium
AAAIPAGRLGSVADIGNAAL

SEQ ID NO: 1256724 - protein, 18 aa, Mycobacterium
AAAKAADEAGVWRNTSAQ

SEQ ID NO: 1256725 - protein, 24 aa, Mycobacterium
AAAKAGVIGLTIAAARDLSSVGIR

SEQ ID NO: 1256726 - protein, 23 aa, Mycobacterium
AAAKGLPYVFAHHFAGQGTEEAL

SEQ ID NO: 1256727 - protein, 24 aa, Mycobacterium
AAAKGLPYVFAHHFSGQGTAEALA

SEQ ID NO: 1256728 - protein, 18 aa, Mycobacterium
AAAKRFPDKSIRSVYSVF

SEQ ID NO: 1256729 - protein, 18 aa, Mycobacterium
AAALALGAQGAWTGSQWV

SEQ ID NO: 1256730 - protein, 18 aa, Mycobacterium
AAALALGAQGVWMGSAFL

SEQ ID NO: 1256731 - protein, 17 aa, Mycobacterium
AAALCRSAGYWALPYPL

SEQ ID NO: 1256732 - protein, 18 aa, Mycobacterium
AAALDFYAKAFGAEEMVR

SEQ ID NO: 1256733 - protein, 22 aa, Mycobacterium
AAALDRFGKALADNGYHPMTFD

SEQ ID NO: 1256734 - protein, 26 aa, Mycobacterium
AAALGMEAAEFLYARVDVIGDRAHAR

SEQ ID NO: 1256735 - protein, 26 aa, Mycobacterium
AAALKRRCLHLFLDYPAAERELEIVR

SEQ ID NO: 1256736 - protein, 17 aa, Mycobacterium
AAALMARFTGVRTCTNR

SEQ ID NO: 1256737 - protein, 27 aa, Mycobacterium
AAALNVGIMDFGFFWVTGVTMEGTIVV

SEQ ID NO: 1256738 - protein, 18 aa, Mycobacterium
AAALPFAGSPTILIDGTD

SEQ ID NO: 1256739 - protein, 33 aa, Mycobacterium
AAALRNRWILDLADRVPAALLLQLADVVDVQVL

SEQ ID NO: 1256740 - protein, 18 aa, Mycobacterium
AAALRPGDTLYRDVPVQY

SEQ ID NO: 1256741 - protein, 22 aa, Mycobacterium
AAALRSTFVYRHRQLADDLAAH

SEQ ID NO: 1256742 - protein, 24 aa, Mycobacterium
AAALRVIFPPGFAERIGPAAVDEL

SEQ ID NO: 1256743 - protein, 24 aa, Mycobacterium
AAALTEAFAAPGPHLIEAVVPSLV

SEQ ID NO: 1256744 - protein, 22 aa, Mycobacterium
AAALWRYALRLTGDRARAEDVV

SEQ ID NO: 1256745 - protein, 18 aa, Mycobacterium
AAALWSLGLGEPHPISAM

SEQ ID NO: 1256746 - protein, 32 aa, Mycobacterium
AAAMGHRLTIAMAWQATVRWADEPVSMELTVD

SEQ ID NO: 1256747 - protein, 18 aa, Mycobacterium
AAAMLRRDLLLSSMSVRL

SEQ ID NO: 1256748 - protein, 23 aa, Mycobacterium
AAANGLRITTIFGGVSQSRQVAA

SEQ ID NO: 1256749 - protein, 17 aa, Mycobacterium
AAAPLRVRPRRGAAAAH

SEQ ID NO: 1256750 - protein, 19 aa, Mycobacterium
AAAPRYEEAGIRAIDLTPA

SEQ ID NO: 1256751 - protein, 25 aa, Mycobacterium
AAAQVRRWLAAHLPEAEVVPANSNA

SEQ ID NO: 1256752 - protein, 17 aa, Mycobacterium
AAARAAYLAGFTGSSNL

SEQ ID NO: 1256753 - protein, 17 aa, Mycobacterium
AAARADVLAGLELAERD

SEQ ID NO: 1256754 - protein, 21 aa, Mycobacterium
AAARAFKAAALAAACGAATEP

SEQ ID NO: 1256755 - protein, 20 aa, Mycobacterium
AAARCGADVVIASRKYEACV

SEQ ID NO: 1256756 - protein, 17 aa, Mycobacterium
AAAREFDAPVALAADNL

SEQ ID NO: 1256757 - protein, 24 aa, Mycobacterium
AAARPEPIPVYAEMSSINPVFVLD

SEQ ID NO: 1256758 - protein, 17 aa, Mycobacterium
AAARPNGDRDRAGADSA

SEQ ID NO: 1256759 - protein, 23 aa, Mycobacterium
AAARRIAPMVVEYVGDEQPEEGP

SEQ ID NO: 1256760 - protein, 22 aa, Mycobacterium
AAARTARYGALRAAHGGAPVLL

SEQ ID NO: 1256761 - protein, 17 aa, Mycobacterium
AAARVALDIATRYALQR

SEQ ID NO: 1256762 - protein, 17 aa, Mycobacterium
AAARWVRDGAPAERPCL

SEQ ID NO: 1256763 - protein, 18 aa, Mycobacterium
AAATSRRVAAEAGVKQAL

SEQ ID NO: 1256764 - protein, 20 aa, Mycobacterium
AAAVARDWVSALVAALPEQL

SEQ ID NO: 1256765 - protein, 19 aa, Mycobacterium
AAAVDGFGSLDIMVNNAGI

SEQ ID NO: 1256766 - protein, 24 aa, Mycobacterium
AAAVICARAGLSVRVVEAQPTPGG

SEQ ID NO: 1256767 - protein, 21 aa, Mycobacterium
AAAVIGWRFHRAVADLVVRLA

SEQ ID NO: 1256768 - protein, 30 aa, Mycobacterium
AAAVPNCGVSWNLLAGIGRIESGHASGGAT

SEQ ID NO: 1256769 - protein, 23 aa, Mycobacterium
AAAVSRAGGLGMIGIGSAGSADR

SEQ ID NO: 1256770 - protein, 20 aa, Mycobacterium
AAAWRELLSAFADFDTQFLD

SEQ ID NO: 1256771 - protein, 22 aa, Mycobacterium
AACAHGRFAATMPRAPGRLEGR

SEQ ID NO: 1256772 - protein, 19 aa, Mycobacterium
AACDAHPAFSASYDLVTDE

SEQ ID NO: 1256773 - protein, 20 aa, Mycobacterium
AACGDGGASFHGGGIHPGYA

SEQ ID NO: 1256774 - protein, 27 aa, Mycobacterium
AACGGRFTLGLGLSHDWIINGQLGIPY

SEQ ID NO: 1256775 - protein, 25 aa, Mycobacterium
AACKSGGLLPFANFNRIHAVPPCNV

SEQ ID NO: 1256776 - protein, 19 aa, Mycobacterium
AACLADAICDPGPAERYSP

SEQ ID NO: 1256777 - protein, 17 aa, Mycobacterium
AACLADAICDPGPATAY

SEQ ID NO: 1256778 - protein, 18 aa, Mycobacterium
AACVAGVMGLEDGAVLLA

SEQ ID NO: 1256779 - protein, 17 aa, Mycobacterium
AACVWDGPTGALAPFWD

SEQ ID NO: 1256780 - protein, 24 aa, Mycobacterium
AADAHKPYRDSFCLAASNESARLH

SEQ ID NO: 1256781 - protein, 23 aa, Mycobacterium
AADAKSRRKTIDDCVKRLKLYGI

SEQ ID NO: 1256782 - protein, 31 aa, Mycobacterium
AADALALAICHCWRAPMLGRMAAAEEMAAEQ

SEQ ID NO: 1256783 - protein, 18 aa, Mycobacterium
AADAPVWLTEGVADFVGR

SEQ ID NO: 1256784 - protein, 18 aa, Mycobacterium
AADCVLALGFEQMQRGAL

SEQ ID NO: 1256785 - protein, 19 aa, Mycobacterium
AADDYLPLLAGMFLAHGEV

SEQ ID NO: 1256786 - protein, 21 aa, Mycobacterium
AADEALAWWRGPLLADLSDEP

SEQ ID NO: 1256787 - protein, 25 aa, Mycobacterium
AADEGLCALGLRFSEDPMAPAARFT

SEQ ID NO: 1256788 - protein, 22 aa, Mycobacterium
AADEIQILLARTLRGGEPTPAD

SEQ ID NO: 1256789 - protein, 24 aa, Mycobacterium
AADEVPGVLIARGLAEESGLRIRL

SEQ ID NO: 1256790 - protein, 18 aa, Mycobacterium
AADFAALPFDHLFFTGSP

SEQ ID NO: 1256791 - protein, 25 aa, Mycobacterium
AADGAEFFAAVSLRPDSVPEFAGDI

SEQ ID NO: 1256792 - protein, 26 aa, Mycobacterium
AADGGLRWLPARSRPGDAVTFEAVMD

SEQ ID NO: 1256793 - protein, 24 aa, Mycobacterium
AADGYLRLRTWLTRLYQAEFNGFI

SEQ ID NO: 1256794 - protein, 25 aa, Mycobacterium
AADHCWRTDEPFLDRLVAACLAGNA

SEQ ID NO: 1256795 - protein, 19 aa, Mycobacterium
AADHFGWVACDNRTTRAVA

SEQ ID NO: 1256796 - protein, 27 aa, Mycobacterium
AADIRSIPTLMAFKKGKLVFNQAGALP

SEQ ID NO: 1256797 - protein, 21 aa, Mycobacterium
AADIVDRWAGPDGHSCSFDWC

SEQ ID NO: 1256798 - protein, 25 aa, Mycobacterium
AADKFRVVFELTERGLLANPQAMLR

SEQ ID NO: 1256799 - protein, 29 aa, Mycobacterium
AADKMWTTSECWRQWINVGDFPDHPWRAY

SEQ ID NO: 1256800 - protein, 20 aa, Mycobacterium
AADLCAWAVTLATALTTVRG

SEQ ID NO: 1256801 - protein, 25 aa, Mycobacterium
AADLEPLKQFGFTVASYQSASFVRA

SEQ ID NO: 1256802 - protein, 18 aa, Mycobacterium
AADLGGLVRTITESVCTP

SEQ ID NO: 1256803 - protein, 21 aa, Mycobacterium
AADLLCEGGFDAVRHRAVARR

SEQ ID NO: 1256804 - protein, 24 aa, Mycobacterium
AADLPEKVREAALRELGKLERSSE

SEQ ID NO: 1256805 - protein, 18 aa, Mycobacterium
AADLWRKLTEAVGADTRD

SEQ ID NO: 1256806 - protein, 18 aa, Mycobacterium
AADMKMWFEAARATTAGA

SEQ ID NO: 1256807 - protein, 25 aa, Mycobacterium
AADMLTPFIWRMDCFGRPHLEQTPW

SEQ ID NO: 1256808 - protein, 17 aa, Mycobacterium
AADPWWAPGTAQGYHMV

SEQ ID NO: 1256809 - protein, 18 aa, Mycobacterium
AADRFVRAAFYINAVPKC

SEQ ID NO: 1256810 - protein, 23 aa, Mycobacterium
AADRLCEACVMLLGIDAAAISLV

SEQ ID NO: 1256811 - protein, 18 aa, Mycobacterium
AADRPTVLMLHGGGQNRF

SEQ ID NO: 1256812 - protein, 23 aa, Mycobacterium
AADTRNRFRAMYQRIVLDDDESE

SEQ ID NO: 1256813 - protein, 24 aa, Mycobacterium
AADVGLPVTFTLAIGNAGDPFFLD

SEQ ID NO: 1256814 - protein, 20 aa, Mycobacterium
AADVLGRLAVDGKLVRGEFT

SEQ ID NO: 1256815 - protein, 20 aa, Mycobacterium
AADVRRWRADLMAPRPRPAH

SEQ ID NO: 1256816 - protein, 27 aa, Mycobacterium
AADWAEMLMRMYIRWAEQHKYPVEVFD

SEQ ID NO: 1256817 - protein, 26 aa, Mycobacterium
AADYCRAVDVLERFYSVVLTDCGTGM

SEQ ID NO: 1256818 - protein, 23 aa, Mycobacterium
AAEAAGLARWLLDTATEYAKVRE

SEQ ID NO: 1256819 - protein, 17 aa, Mycobacterium
AAEACYRDELAAMSGVR

SEQ ID NO: 1256820 - protein, 19 aa, Mycobacterium
AAEAFRFPDDGSWRSVTWQ

SEQ ID NO: 1256821 - protein, 19 aa, Mycobacterium
AAEAFTLGLVNRVVGAADF

SEQ ID NO: 1256822 - protein, 23 aa, Mycobacterium
AAEALGFSSFWFPQVPGYLDAMT

SEQ ID NO: 1256823 - protein, 23 aa, Mycobacterium
AAEALKADFPRIDLLINNAGVMY

SEQ ID NO: 1256824 - protein, 32 aa, Mycobacterium
AAEAMVQRNCVAPMRLCHHFAPAMAARGRGGI

SEQ ID NO: 1256825 - protein, 18 aa, Mycobacterium
AAEARRQASLVARADESG

SEQ ID NO: 1256826 - protein, 17 aa, Mycobacterium
AAEAVWAELARRLPEPW

SEQ ID NO: 1256827 - protein, 17 aa, Mycobacterium
AAECADAVGISRVSARR

SEQ ID NO: 1256828 - protein, 25 aa, Mycobacterium
AAEDPRVAGLIARVQIDAAPPGPVQ

SEQ ID NO: 1256829 - protein, 17 aa, Mycobacterium
AAEGIATAGYFNAGQDC

SEQ ID NO: 1256830 - protein, 19 aa, Mycobacterium
AAEGTQLGPTEWLEITQDR

SEQ ID NO: 1256831 - protein, 21 aa, Mycobacterium
AAEHSIPVLAYFVDGQTAAVD

SEQ ID NO: 1256832 - protein, 18 aa, Mycobacterium
AAELAPPSVRRELHGRVA

SEQ ID NO: 1256833 - protein, 17 aa, Mycobacterium
AAELAPPSVRRGLHGKV

SEQ ID NO: 1256834 - protein, 22 aa, Mycobacterium
AAELGGLFVKPTVLTGVDPSMR

SEQ ID NO: 1256835 - protein, 20 aa, Mycobacterium
AAELGLDLSTAVVLDPQTSE

SEQ ID NO: 1256836 - protein, 18 aa, Mycobacterium
AAELGMAAIYCRDDVGGS

SEQ ID NO: 1256837 - protein, 18 aa, Mycobacterium
AAELGVAVANALPSVKAH

SEQ ID NO: 1256838 - protein, 18 aa, Mycobacterium
AAELNWQQAALLAGMVRS

SEQ ID NO: 1256839 - protein, 24 aa, Mycobacterium
AAELRLLPHLASHLSLQRVAEELV

SEQ ID NO: 1256840 - protein, 24 aa, Mycobacterium
AAELVRRGSAFSGLLYAGLAITSN

SEQ ID NO: 1256841 - protein, 20 aa, Mycobacterium
AAEMVVEIRQVLGLAGVEIG

SEQ ID NO: 1256842 - protein, 17 aa, Mycobacterium
AAEPLMALYRPFSGTEV

SEQ ID NO: 1256843 - protein, 23 aa, Mycobacterium
AAEPSGLGMIVAFEEMFWGDAGI

SEQ ID NO: 1256844 - protein, 22 aa, Mycobacterium
AAEQKLPLNVTWVNLTTGKSGS

SEQ ID NO: 1256845 - protein, 22 aa, Mycobacterium
AAERAVALGVRRDGILIDPTHD

SEQ ID NO: 1256846 - protein, 24 aa, Mycobacterium
AAERIPRAIGFSGSPSDPDVADAL

SEQ ID NO: 1256847 - protein, 21 aa, Mycobacterium
AAERLGYEVLLSANLPDRTEA

SEQ ID NO: 1256848 - protein, 17 aa, Mycobacterium
AAERPEPLVPRAMIRSV

SEQ ID NO: 1256849 - protein, 17 aa, Mycobacterium
AAERRVASLQARIDALS

SEQ ID NO: 1256850 - protein, 22 aa, Mycobacterium
AAERSPLLTAIRRAGLGSVSDL

SEQ ID NO: 1256851 - protein, 34 aa, Mycobacterium
AAESDPVLAEWFLRRFSLLDSLYMVPSPRLVGRT

SEQ ID NO: 1256852 - protein, 30 aa, Mycobacterium
AAETKKLPSWKVVVPPGQAVAGYYYQAINK

SEQ ID NO: 1256853 - protein, 33 aa, Mycobacterium
AAETVKTWPVRLMKFVLSVGWLATAHREYSEIN

SEQ ID NO: 1256854 - protein, 19 aa, Mycobacterium
AAEVLDWNVLRALCDAEAI

SEQ ID NO: 1256855 - protein, 17 aa, Mycobacterium
AAEVPGRDVIVHIEGGR

SEQ ID NO: 1256856 - protein, 29 aa, Mycobacterium
AAEWHRYWIETRLQWYVDLGINRDNLRLY

SEQ ID NO: 1256857 - protein, 19 aa, Mycobacterium
AAEYEKLGSAAGFFDDFQD

SEQ ID NO: 1256858 - protein, 27 aa, Mycobacterium
AAFAGVLPYGPARRWQKKKDPDQDTEG

SEQ ID NO: 1256859 - protein, 24 aa, Mycobacterium
AAFCGWVSCDADAVLGLPELTLGL

SEQ ID NO: 1256860 - protein, 17 aa, Mycobacterium
AAFDAADHFGWVACDNR

SEQ ID NO: 1256861 - protein, 19 aa, Mycobacterium
AAFDMALLDLFWTSVSGVL

SEQ ID NO: 1256862 - protein, 28 aa, Mycobacterium
AAFDRGDIDAGYSWLPTLDQLRRNGKDL

SEQ ID NO: 1256863 - protein, 19 aa, Mycobacterium
AAFELAGFATFGAAASATD

SEQ ID NO: 1256864 - protein, 22 aa, Mycobacterium
AAFERRLAEHADELAAVIVEPV

SEQ ID NO: 1256865 - protein, 25 aa, Mycobacterium
AAFERRWELGGVLFSKTFSDQMIDP

SEQ ID NO: 1256866 - protein, 21 aa, Mycobacterium
AAFGMNCHWSQGQSCGSTTRL

SEQ ID NO: 1256867 - protein, 23 aa, Mycobacterium
AAFHKRLPAWVDIETRAEADRQL

SEQ ID NO: 1256868 - protein, 22 aa, Mycobacterium
AAFKAVCPYVSEIIVYGEERPY

SEQ ID NO: 1256869 - protein, 24 aa, Mycobacterium
AAFKHGLTPIICIGEHLDVREAGN

SEQ ID NO: 1256870 - protein, 19 aa, Mycobacterium
AAFLRWCAATDTPPAITKP

SEQ ID NO: 1256871 - protein, 23 aa, Mycobacterium
AAFPAWRDASLAKRTSVLFRFRE

SEQ ID NO: 1256872 - protein, 23 aa, Mycobacterium
AAFPLGWVHDVVWARESIRGGGT

SEQ ID NO: 1256873 - protein, 44 aa, Mycobacterium
AAFSAKKPSVAWAETYPGTLSYYLASAFREVWMQPSGTVGLVGF

SEQ ID NO: 1256874 - protein, 17 aa, Mycobacterium
AAFTALLPFELDDFQRR

SEQ ID NO: 1256875 - protein, 23 aa, Mycobacterium
AAFTRLTALVKRTAGDDRTKVRT

SEQ ID NO: 1256876 - protein, 24 aa, Mycobacterium
AAFVPRVTAILADLRQLDAVASRA

SEQ ID NO: 1256877 - protein, 25 aa, Mycobacterium
AAGAGAFCAGEFADLSAYVTATEMA

SEQ ID NO: 1256878 - protein, 24 aa, Mycobacterium
AAGAKFTTAFARRGLIAEYGISWI

SEQ ID NO: 1256879 - protein, 28 aa, Mycobacterium
AAGAKVLMLRCVEYARRFDLPIHVRSSY

SEQ ID NO: 1256880 - protein, 18 aa, Mycobacterium
AAGALHGMTMRNLHPANI

SEQ ID NO: 1256881 - protein, 20 aa, Mycobacterium
AAGCLAPGGRLVFNTFMPRP

SEQ ID NO: 1256882 - protein, 31 aa, Mycobacterium
AAGDAGDPGSEAVDINGGAGGAGGAGGEGGE

SEQ ID NO: 1256883 - protein, 20 aa, Mycobacterium
AAGDHRSGCLVGFTSQTSIH

SEQ ID NO: 1256884 - protein, 26 aa, Mycobacterium
AAGDSRAAYEWHMRAAAWSQQRDIRA

SEQ ID NO: 1256885 - protein, 18 aa, Mycobacterium
AAGDWKPLAEFYTEDATY

SEQ ID NO: 1256886 - protein, 17 aa, Mycobacterium
AAGEGYSGAALIGASPE

SEQ ID NO: 1256887 - protein, 19 aa, Mycobacterium
AAGELAVRVLHVLDSIPER

SEQ ID NO: 1256888 - protein, 17 aa, Mycobacterium
AAGELIATVAAPPLVPR

SEQ ID NO: 1256889 - protein, 23 aa, Mycobacterium
AAGFPSLSAVILNGGLTLHPAIG

SEQ ID NO: 1256890 - protein, 23 aa, Mycobacterium
AAGFRACKRCRPDASPGSPEWNV

SEQ ID NO: 1256891 - protein, 20 aa, Mycobacterium
AAGGTGGWWGTSNVPQAETG

SEQ ID NO: 1256892 - protein, 27 aa, Mycobacterium
AAGGWLCDRVRAGWKVTVLVPPGHDVR

SEQ ID NO: 1256893 - protein, 24 aa, Mycobacterium
AAGHLRGSVNVGFDGRFAETAGMV

SEQ ID NO: 1256894 - protein, 22 aa, Mycobacterium
AAGIARRTLFRYYPSKSALPWG

SEQ ID NO: 1256895 - protein, 18 aa, Mycobacterium
AAGICGSDLPGYRGAKGR

SEQ ID NO: 1256896 - protein, 18 aa, Mycobacterium
AAGISWLTGYPDLNPFEP

SEQ ID NO: 1256897 - protein, 19 aa, Mycobacterium
AAGIVDPWTPFWDEHHTYE

SEQ ID NO: 1256898 - protein, 25 aa, Mycobacterium
AAGKRIFGSGAMEFSAKRTSADAVW

SEQ ID NO: 1256899 - protein, 18 aa, Mycobacterium
AAGLAMAYKLIDAAAARW

SEQ ID NO: 1256900 - protein, 25 aa, Mycobacterium
AAGLDYRPGQFLTLRVPGTDGGAVA

SEQ ID NO: 1256901 - protein, 19 aa, Mycobacterium
AAGLECRSLLGTQIAPEDV

SEQ ID NO: 1256902 - protein, 19 aa, Mycobacterium
AAGLPAERIHIEVFKSLES

SEQ ID NO: 1256903 - protein, 20 aa, Mycobacterium
AAGLPPGVINLLAGDGLAVS

SEQ ID NO: 1256904 - protein, 25 aa, Mycobacterium
AAGLRPRTGVGLGIPGVGAPAPAPV

SEQ ID NO: 1256905 - protein, 24 aa, Mycobacterium
AAGLRTVFRYHRERSGVSAGHPHA

SEQ ID NO: 1256906 - protein, 23 aa, Mycobacterium
AAGLSRAHFSRMFSKTFGESPRA

SEQ ID NO: 1256907 - protein, 18 aa, Mycobacterium
AAGMSGGIAFVLGLDPSR

SEQ ID NO: 1256908 - protein, 17 aa, Mycobacterium
AAGNLKGIRKWVWERLA

SEQ ID NO: 1256909 - protein, 32 aa, Mycobacterium
AAGNPIAWLYEQRRWVVPGNRIANTMKLAIIS

SEQ ID NO: 1256910 - protein, 27 aa, Mycobacterium
AAGPAFLLNQMMVWGFTGQVIAAMLDV

SEQ ID NO: 1256911 - protein, 38 aa, Mycobacterium
AAGQPLDHWDFYMALAYFKLAIIGAGIAYRAREAGVVD

SEQ ID NO: 1256912 - protein, 22 aa, Mycobacterium
AAGQSAEVFGRFEAPDPNELWV

SEQ ID NO: 1256913 - protein, 22 aa, Mycobacterium
AAGRAWARFDRGEVVFKAEVGS

SEQ ID NO: 1256914 - protein, 27 aa, Mycobacterium
AAGRERCIAEFSWAHIAEQTMEIYRKV

SEQ ID NO: 1256915 - protein, 24 aa, Mycobacterium
AAGRLTRAALRWNYTAIHPNIYLP

SEQ ID NO: 1256916 - protein, 26 aa, Mycobacterium
AAGRRTQVRAVWRAVSAVDEVFARCG

SEQ ID NO: 1256917 - protein, 23 aa, Mycobacterium
AAGSGLHHKICHVLGGMFNLAHA

SEQ ID NO: 1256918 - protein, 21 aa, Mycobacterium
AAGSMPGDLHKLWRMRDRKGY

SEQ ID NO: 1256919 - protein, 18 aa, Mycobacterium
AAGSRIFGDREVSFDGGP

SEQ ID NO: 1256920 - protein, 32 aa, Mycobacterium
AAGTELRYLLATSVPAWWVPYVPRLMRTPQLD

SEQ ID NO: 1256921 - protein, 19 aa, Mycobacterium
AAGTGLRVGRLTLDILGAI

SEQ ID NO: 1256922 - protein, 20 aa, Mycobacterium
AAGVLTGRRVLICGAGMLGV

SEQ ID NO: 1256923 - protein, 22 aa, Mycobacterium
AAGVRPAGVWAYEAHRVAALQP

SEQ ID NO: 1256924 - protein, 24 aa, Mycobacterium
AAGVRRIVYLGGFVPDDDSLSEHL

SEQ ID NO: 1256925 - protein, 21 aa, Mycobacterium
AAGVSRWIVDTGFKGDRITPH

SEQ ID NO: 1256926 - protein, 19 aa, Mycobacterium
AAGWLRGDTVLEFESPHSG

SEQ ID NO: 1256927 - protein, 26 aa, Mycobacterium
AAGYRFPRLRFVASVGEPLNAEAVWW

SEQ ID NO: 1256928 - protein, 17 aa, Mycobacterium
AAHAAVWGAMFNAGQTC

SEQ ID NO: 1256929 - protein, 17 aa, Mycobacterium
AAHAVDLPFVFDRTDVD

SEQ ID NO: 1256930 - protein, 17 aa, Mycobacterium
AAHFDWEGPLGVTYPGV

SEQ ID NO: 1256931 - protein, 26 aa, Mycobacterium
AAHGFIGISLPEEFGGGGAGMAELAI

SEQ ID NO: 1256932 - protein, 19 aa, Mycobacterium
AAHHVSRVLGRRVGPSTGT

SEQ ID NO: 1256933 - protein, 24 aa, Mycobacterium
AAHLVHPGDLVILIAYGTMEDAEA

SEQ ID NO: 1256934 - protein, 18 aa, Mycobacterium
AAHMPGFVDHIVGSALFK

SEQ ID NO: 1256935 - protein, 18 aa, Mycobacterium
AAHRELAPARAFAAPAGD

SEQ ID NO: 1256936 - protein, 17 aa, Mycobacterium
AAHRLESGLPIEPVYNL

SEQ ID NO: 1256937 - protein, 21 aa, Mycobacterium
AAHSVTKFARIIAEAIGAWRI

SEQ ID NO: 1256938 - protein, 25 aa, Mycobacterium
AAHTFSLPELTDWSNADFTVENVNV

SEQ ID NO: 1256939 - protein, 26 aa, Mycobacterium
AAHVGIRLSPMIKFGGLDDADGMEMG

SEQ ID NO: 1256940 - protein, 19 aa, Mycobacterium
AAIAALVYECVTFDDVRDG

SEQ ID NO: 1256941 - protein, 27 aa, Mycobacterium
AAIAGLARIVLRMTALRQRYETRDAGR

SEQ ID NO: 1256942 - protein, 20 aa, Mycobacterium
AAIAGMCLTMARDLGSLGIR

SEQ ID NO: 1256943 - protein, 23 aa, Mycobacterium
AAIARGAVHYVALGDKHSRMSVG

SEQ ID NO: 1256944 - protein, 24 aa, Mycobacterium
AAIARPELLSELSRQFGSQCIVLS

SEQ ID NO: 1256945 - protein, 24 aa, Mycobacterium
AAIARRLEAVAALFRSRKCDYAEA

SEQ ID NO: 1256946 - protein, 19 aa, Mycobacterium
AAIARRLGTPLVIHQPSYS

SEQ ID NO: 1256947 - protein, 18 aa, Mycobacterium
AAIDFNRPGIPVVAALPS

SEQ ID NO: 1256948 - protein, 21 aa, Mycobacterium
AAIDVLVRWALDSRAEARNRK

SEQ ID NO: 1256949 - protein, 18 aa, Mycobacterium
AAIGARKGVSVSLPSAAG

SEQ ID NO: 1256950 - protein, 17 aa, Mycobacterium
AAIGFPLVTGPPELTTP

SEQ ID NO: 1256951 - protein, 23 aa, Mycobacterium
AAIGVGALDDWDGAARFLTLGDA

SEQ ID NO: 1256952 - protein, 23 aa, Mycobacterium
AAIKKFCDWQQWRGNVAVSPVAL

SEQ ID NO: 1256953 - protein, 17 aa, Mycobacterium
AAIKMAVTARGGRQGIW

SEQ ID NO: 1256954 - protein, 17 aa, Mycobacterium
AAILIECRTEGGELVNE

SEQ ID NO: 1256955 - protein, 18 aa, Mycobacterium
AAILLGDVALVWADDIVA

SEQ ID NO: 1256956 - protein, 28 aa, Mycobacterium
AAIRADFPILKRVMRGGNTLAYLDSGAT

SEQ ID NO: 1256957 - protein, 24 aa, Mycobacterium
AAIRAVVPASLLMYGSHEKDLMES

SEQ ID NO: 1256958 - protein, 27 aa, Mycobacterium
AAISARHLRRLWGLPRTQLGVVAWPAD

SEQ ID NO: 1256959 - protein, 19 aa, Mycobacterium
AAISSLVLPSSFRPIPDSR

SEQ ID NO: 1256960 - protein, 18 aa, Mycobacterium
AAITTALLGAGARSAVRE

SEQ ID NO: 1256961 - protein, 22 aa, Mycobacterium
AAIYRWTWQAPTATAFVGVPTN

SEQ ID NO: 1256962 - protein, 20 aa, Mycobacterium
AAKALVAQGILSPVEVLERY

SEQ ID NO: 1256963 - protein, 18 aa, Mycobacterium
AAKFASRFADLVANDGGD

SEQ ID NO: 1256964 - protein, 17 aa, Mycobacterium
AAKLAAAGWPLAGVEVD

SEQ ID NO: 1256965 - protein, 17 aa, Mycobacterium
AAKLPDVRVLVAGGPSG

SEQ ID NO: 1256966 - protein, 30 aa, Mycobacterium
AAKLRSYELFAEYVIPHFTGQLSAPIASRD

SEQ ID NO: 1256967 - protein, 19 aa, Mycobacterium
AAKSAQWGLTNGVRIELAG

SEQ ID NO: 1256968 - protein, 19 aa, Mycobacterium
AAKSAQWGLTNGVRIELAP

SEQ ID NO: 1256969 - protein, 18 aa, Mycobacterium
AAKTGLPVDAFKTTVQRF

SEQ ID NO: 1256970 - protein, 21 aa, Mycobacterium
AAKYYIDYRDFTVWVLRVRRV

SEQ ID NO: 1256971 - protein, 20 aa, Mycobacterium
AALAAAIRLLRDVNIIEKFT

SEQ ID NO: 1256972 - protein, 38 aa, Mycobacterium
AALACKATAVADGYRINGAKAWITHGGIADFYSLFART

SEQ ID NO: 1256973 - protein, 20 aa, Mycobacterium
AALADLCGKDMVLPMNSGAE

SEQ ID NO: 1256974 - protein, 17 aa, Mycobacterium
AALALGVDHCFGPVMLH

SEQ ID NO: 1256975 - protein, 24 aa, Mycobacterium
AALALRAGALWVAANVDLTLPSER

SEQ ID NO: 1256976 - protein, 26 aa, Mycobacterium
AALAMELGCDAVLLASAVTRSADPPA

SEQ ID NO: 1256977 - protein, 17 aa, Mycobacterium
AALARDWFVRHLGTPGG

SEQ ID NO: 1256978 - protein, 18 aa, Mycobacterium
AALARELGCQLHVCDRRT

SEQ ID NO: 1256979 - protein, 18 aa, Mycobacterium
AALARLAAGEAFSKVAAE

SEQ ID NO: 1256980 - protein, 18 aa, Mycobacterium
AALARLESSIALDMLLDF

SEQ ID NO: 1256981 - protein, 18 aa, Mycobacterium
AALARRPGSESVFDAVRA

SEQ ID NO: 1256982 - protein, 18 aa, Mycobacterium
AALARTETAIALEHLLDF

SEQ ID NO: 1256983 - protein, 26 aa, Mycobacterium
AALASRARKAPGFALLGEKGESRDLT

SEQ ID NO: 1256984 - protein, 24 aa, Mycobacterium
AALAWRSEFGSVRHWDARLTDMAM

SEQ ID NO: 1256985 - protein, 28 aa, Mycobacterium
AALDACLDRYARLFAALVPWDNQTDIAV

SEQ ID NO: 1256986 - protein, 21 aa, Mycobacterium
AALDARFGIASPRDHGYDTVD

SEQ ID NO: 1256987 - protein, 23 aa, Mycobacterium
AALDGASVGTVFAPRKERMSARR

SEQ ID NO: 1256988 - protein, 25 aa, Mycobacterium
AALDIPILQGLCLTSSKAQWDENDD

SEQ ID NO: 1256989 - protein, 19 aa, Mycobacterium
AALDLPLYRAVVTARGGSQ

SEQ ID NO: 1256990 - protein, 18 aa, Mycobacterium
AALDRFGPPAGQAAWVVK

SEQ ID NO: 1256991 - protein, 17 aa, Mycobacterium
AALDRLLSIEVEATEAR

SEQ ID NO: 1256992 - protein, 18 aa, Mycobacterium
AALEALDNLTFVVNCNLQ

SEQ ID NO: 1256993 - protein, 21 aa, Mycobacterium
AALEKAKGVLRTKVGAGTGVR

SEQ ID NO: 1256994 - protein, 27 aa, Mycobacterium
AALELAAAAPFDYYPRVVSRSLANAGD

SEQ ID NO: 1256995 - protein, 22 aa, Mycobacterium
AALELTVPLSITITLAPETWAH

SEQ ID NO: 1256996 - protein, 23 aa, Mycobacterium
AALEVNWPYVLPSLLENAVKGGV

SEQ ID NO: 1256997 - protein, 25 aa, Mycobacterium
AALFELPRLAPVYPTAAGLVAAVAD

SEQ ID NO: 1256998 - protein, 24 aa, Mycobacterium
AALGFGDIEGFGFLDPPDARSIRD

SEQ ID NO: 1256999 - protein, 24 aa, Mycobacterium
AALGMEAAEFLYARVDVIGDRAHA

SEQ ID NO: 1257000 - protein, 22 aa, Mycobacterium
AALHHPCCGDLTYGADPTLAKK

SEQ ID NO: 1257001 - protein, 25 aa, Mycobacterium
AALHSRLDGLIAQWKRDHGDTDDTD

SEQ ID NO: 1257002 - protein, 17 aa, Mycobacterium
AALIGRPDLELVGVHAA

SEQ ID NO: 1257003 - protein, 18 aa, Mycobacterium
AALISAVPPLMVRTEDNP

SEQ ID NO: 1257004 - protein, 17 aa, Mycobacterium
AALKLGPALAAGCTVVL

SEQ ID NO: 1257005 - protein, 19 aa, Mycobacterium
AALKLLYLAIRNINQKRGS

SEQ ID NO: 1257006 - protein, 20 aa, Mycobacterium
AALLCRDHLLGSLDDRSLRI

SEQ ID NO: 1257007 - protein, 22 aa, Mycobacterium
AALLPDPLDTVFLVNSGSEASD

SEQ ID NO: 1257008 - protein, 19 aa, Mycobacterium
AALNCALVVMGQRLGYYRC

SEQ ID NO: 1257009 - protein, 19 aa, Mycobacterium
AALNEAWAGLQATGLDAQI

SEQ ID NO: 1257010 - protein, 23 aa, Mycobacterium
AALPLSMIERFHRDFGAESMQGW

SEQ ID NO: 1257011 - protein, 18 aa, Mycobacterium
AALPPDRRRDFLVDSGYL

SEQ ID NO: 1257012 - protein, 23 aa, Mycobacterium
AALPRLHALAPLRYQLVDIPLKF

SEQ ID NO: 1257013 - protein, 17 aa, Mycobacterium
AALPYGALDRDHLVKHL

SEQ ID NO: 1257014 - protein, 18 aa, Mycobacterium
AALQARASVFAMVETARG

SEQ ID NO: 1257015 - protein, 19 aa, Mycobacterium
AALQRLGVRAGDAVAVQLT

SEQ ID NO: 1257016 - protein, 18 aa, Mycobacterium
AALRAAGCTVGNPVDGLI

SEQ ID NO: 1257017 - protein, 17 aa, Mycobacterium
AALRAYAALAMSADKGA

SEQ ID NO: 1257018 - protein, 19 aa, Mycobacterium
AALRGSRSGVYVGVGANEY

SEQ ID NO: 1257019 - protein, 21 aa, Mycobacterium
AALRHVPVLALGDGRTEDSAD

SEQ ID NO: 1257020 - protein, 21 aa, Mycobacterium
AALRLWDAVVAWTEFPHLYEL

SEQ ID NO: 1257021 - protein, 19 aa, Mycobacterium
AALRMPAEVCGTGKHTIRE

SEQ ID NO: 1257022 - protein, 23 aa, Mycobacterium
AALRNCQYLWIGVFQATSVPVLS

SEQ ID NO: 1257023 - protein, 32 aa, Mycobacterium
AALRNRWILDLADRVPAALLLQLADVVDVQVL

SEQ ID NO: 1257024 - protein, 22 aa, Mycobacterium
AALRNWAGFLLGSDIDPVRLAM

SEQ ID NO: 1257025 - protein, 25 aa, Mycobacterium
AALRRAAAAIDRRGTGWGPYALQAA

SEQ ID NO: 1257026 - protein, 26 aa, Mycobacterium
AALRRAAKFASGWWSFLTPPEKIAER

SEQ ID NO: 1257027 - protein, 23 aa, Mycobacterium
AALSEHFHCVAIDMVGNGFSGKP

SEQ ID NO: 1257028 - protein, 18 aa, Mycobacterium
AALSVCGPMGRMVFDQRL

SEQ ID NO: 1257029 - protein, 25 aa, Mycobacterium
AALTRRGPHRVLRGDLAFAGQPGIV

SEQ ID NO: 1257030 - protein, 17 aa, Mycobacterium
AALTWRSEYGSVQHWDE

SEQ ID NO: 1257031 - protein, 18 aa, Mycobacterium
AALVGREAVRLGFDGRAG

SEQ ID NO: 1257032 - protein, 19 aa, Mycobacterium
AALVLPGGFPEEFGTELSA

SEQ ID NO: 1257033 - protein, 18 aa, Mycobacterium
AALYLATDRSRYITGTVL

SEQ ID NO: 1257034 - protein, 18 aa, Mycobacterium
AAMADAFLNGGQVLNLTP

SEQ ID NO: 1257035 - protein, 19 aa, Mycobacterium
AAMAGRPAPEFADVVATAE

SEQ ID NO: 1257036 - protein, 21 aa, Mycobacterium
AAMKAFFVYDEPFWRADGLNG

SEQ ID NO: 1257037 - protein, 24 aa, Mycobacterium
AAMKPGRGPRRYVCGGELITFDEM

SEQ ID NO: 1257038 - protein, 25 aa, Mycobacterium
AAMLISRPYLPWGGAEEFADRLMRA

SEQ ID NO: 1257039 - protein, 26 aa, Mycobacterium
AAMRRWTWLNSFGYWFWGGFVRSIFG

SEQ ID NO: 1257040 - protein, 26 aa, Mycobacterium
AANAMGRPGLTLGLGPSHEPIVRDVL

SEQ ID NO: 1257041 - protein, 17 aa, Mycobacterium
AANCSPASLAVIKAQTY

SEQ ID NO: 1257042 - protein, 18 aa, Mycobacterium
AANGYLLQQFMSVSSNHR

SEQ ID NO: 1257043 - protein, 24 aa, Mycobacterium
AANHFHLRRVGGVWQIAARTTRLL

SEQ ID NO: 1257044 - protein, 21 aa, Mycobacterium
AANIRRLRKSDPYKGKGIRYE

SEQ ID NO: 1257045 - protein, 19 aa, Mycobacterium
AANLGWKLAAVVNGQADDA

SEQ ID NO: 1257046 - protein, 22 aa, Mycobacterium
AANMMNRIPMKRWAEPSEIAGA

SEQ ID NO: 1257047 - protein, 29 aa, Mycobacterium
AANRLASDMGEFFMPFPGTRVNQSTTPLD

SEQ ID NO: 1257048 - protein, 21 aa, Mycobacterium
AANRLNIAGAILAETGSDDGS

SEQ ID NO: 1257049 - protein, 25 aa, Mycobacterium
AAPARLRAAATFNLPIPTDTRPQQT

SEQ ID NO: 1257050 - protein, 25 aa, Mycobacterium
AAPDAAWAFTSWITSPAVDAQRVAE

SEQ ID NO: 1257051 - protein, 23 aa, Mycobacterium
AAPEGRKLLRLEVRNAETPIERK

SEQ ID NO: 1257052 - protein, 25 aa, Mycobacterium
AAPEPHYRPSAALQDFVRCRDLTCR

SEQ ID NO: 1257053 - protein, 18 aa, Mycobacterium
AAPGFGLVVSYNPGYQSV

SEQ ID NO: 1257054 - protein, 24 aa, Mycobacterium
AAPGLRASRDLRYSLLDDIPVATL

SEQ ID NO: 1257055 - protein, 21 aa, Mycobacterium
AAPGPACFGFGGKQATITDVN

SEQ ID NO: 1257056 - protein, 27 aa, Mycobacterium
AAPILDRQVQVWLKLEANLFIDIHRTS

SEQ ID NO: 1257057 - protein, 25 aa, Mycobacterium
AAPKGIFPWYAPGSDTFLGEFPLSH

SEQ ID NO: 1257058 - protein, 17 aa, Mycobacterium
AAPLREALEAWSAANAD

SEQ ID NO: 1257059 - protein, 25 aa, Mycobacterium
AAPLRWCGMVHALGGTVVLAKRFDA

SEQ ID NO: 1257060 - protein, 17 aa, Mycobacterium
AAPQVYSPLVWYVVDGT

SEQ ID NO: 1257061 - protein, 17 aa, Mycobacterium
AAPRPLDGPPRIVVSRT

SEQ ID NO: 1257062 - protein, 20 aa, Mycobacterium
AAPSGAPLRMCCASASQLGP

SEQ ID NO: 1257063 - protein, 18 aa, Mycobacterium
AAPVDVWTDELFGPVLAI

SEQ ID NO: 1257064 - protein, 22 aa, Mycobacterium
AAPVHRVPILIGGNGTRVLQLA

SEQ ID NO: 1257065 - protein, 24 aa, Mycobacterium
AAPVNFPDVLLIAGRYQVSVPTPF

SEQ ID NO: 1257066 - protein, 18 aa, Mycobacterium
AAPYAVRRLFALTDQLGA

SEQ ID NO: 1257067 - protein, 21 aa, Mycobacterium
AAQKIASGWETLVIAGGVESM

SEQ ID NO: 1257068 - protein, 24 aa, Mycobacterium
AAQLARAGVNLVLVARTPEPLERT

SEQ ID NO: 1257069 - protein, 20 aa, Mycobacterium
AAQPYRLAVIRADITDRETV

SEQ ID NO: 1257070 - protein, 23 aa, Mycobacterium
AAQRAANRYACFDHTSADDGQAY

SEQ ID NO: 1257071 - protein, 24 aa, Mycobacterium
AAQRLADEGAHVFITGRKKPALDA

SEQ ID NO: 1257072 - protein, 25 aa, Mycobacterium
AAQRLIRRIGRVSARELAELDDALR

SEQ ID NO: 1257073 - protein, 22 aa, Mycobacterium
AAQRRDMMWICRDGDRAKNHLL

SEQ ID NO: 1257074 - protein, 18 aa, Mycobacterium
AAQSLGPVGARFLAALTE

SEQ ID NO: 1257075 - protein, 20 aa, Mycobacterium
AAQWSRIRLADRAHLEPWEP

SEQ ID NO: 1257076 - protein, 25 aa, Mycobacterium
AAQYRIRLGGSWKKPGTGDIQIVCA

SEQ ID NO: 1257077 - protein, 18 aa, Mycobacterium
AARALREVWVPGADLRDP

SEQ ID NO: 1257078 - protein, 23 aa, Mycobacterium
AARALYASMGFRVHHHSRYVRAQ

SEQ ID NO: 1257079 - protein, 19 aa, Mycobacterium
AARCHVLTCALRLSQGRID

SEQ ID NO: 1257080 - protein, 18 aa, Mycobacterium
AARDGLSYFAEFRSQSCI

SEQ ID NO: 1257081 - protein, 20 aa, Mycobacterium
AAREARRAQARSPLDRARIA

SEQ ID NO: 1257082 - protein, 25 aa, Mycobacterium
AAREFKPLVLVAGYSAYPRRVNFAK

SEQ ID NO: 1257083 - protein, 25 aa, Mycobacterium
AARFPGGRMMFDLPPSAFAPLVRRG

SEQ ID NO: 1257084 - protein, 17 aa, Mycobacterium
AARGHGAQLRRHGTVRP

SEQ ID NO: 1257085 - protein, 26 aa, Mycobacterium
AARGLPRRPRVLLISGDAPGPDEWEA

SEQ ID NO: 1257086 - protein, 24 aa, Mycobacterium
AARGRGVVTACLIRSDGVLAATLV

SEQ ID NO: 1257087 - protein, 21 aa, Mycobacterium
AARHGLRISFSPVPFEGAAGN

SEQ ID NO: 1257088 - protein, 22 aa, Mycobacterium
AARKLFAERGFHGTTLGDITSA

SEQ ID NO: 1257089 - protein, 23 aa, Mycobacterium
AARLLDMTVCYAGQREQFGTPIG

SEQ ID NO: 1257090 - protein, 21 aa, Mycobacterium
AARLPAGVPLVGLIESALGME

SEQ ID NO: 1257091 - protein, 24 aa, Mycobacterium
AARLPCAYLNPGRFIAGRPLVKGM

SEQ ID NO: 1257092 - protein, 17 aa, Mycobacterium
AARLTGWRIDIRSDDAA

SEQ ID NO: 1257093 - protein, 26 aa, Mycobacterium
AARLWQLRTVLALDLAIHILKTSWTV

SEQ ID NO: 1257094 - protein, 25 aa, Mycobacterium
AARMLIGRPGPYPFDPVVAALILRA

SEQ ID NO: 1257095 - protein, 24 aa, Mycobacterium
AARNGRISFFGGLPKTNPTITCDS

SEQ ID NO: 1257096 - protein, 18 aa, Mycobacterium
AARNRWRAVATAGGTVNA

SEQ ID NO: 1257097 - protein, 19 aa, Mycobacterium
AARPDPRISDAVDRDDARL

SEQ ID NO: 1257098 - protein, 26 aa, Mycobacterium
AARPELRDLAGRVAVWADRFTAPAGW

SEQ ID NO: 1257099 - protein, 19 aa, Mycobacterium
AARPWVQHCRSWEPTIAGH

SEQ ID NO: 1257100 - protein, 22 aa, Mycobacterium
AARRACEYEDLGVHSWVLAELV

SEQ ID NO: 1257101 - protein, 24 aa, Mycobacterium
AARRGGEWLDWFAAARITAIGMGM

SEQ ID NO: 1257102 - protein, 24 aa, Mycobacterium
AARRGGQWLDWFDAEGIAGVGMGM

SEQ ID NO: 1257103 - protein, 21 aa, Mycobacterium
AARRIAELVTRYGGDTPQVGI

SEQ ID NO: 1257104 - protein, 23 aa, Mycobacterium
AARSAAMLCIGARGLKHSTQGRI

SEQ ID NO: 1257105 - protein, 21 aa, Mycobacterium
AARTRLAFGSSLRRIKKRVAA

SEQ ID NO: 1257106 - protein, 17 aa, Mycobacterium
AARVGDADFYVCGPTPF

SEQ ID NO: 1257107 - protein, 21 aa, Mycobacterium
AARVRELFVDVLGPERLAALG

SEQ ID NO: 1257108 - protein, 18 aa, Mycobacterium
AARVVWLVANGYARPGEV

SEQ ID NO: 1257109 - protein, 24 aa, Mycobacterium
AARWPRAGALGPLIRDPDGAVYPS

SEQ ID NO: 1257110 - protein, 21 aa, Mycobacterium
AARWSGCIRSDVDLPVLADRM

SEQ ID NO: 1257111 - protein, 18 aa, Mycobacterium
AARWWGFGVGRRSRGWRW

SEQ ID NO: 1257112 - protein, 23 aa, Mycobacterium
AARYLCSGGLNLRDPSQVMSAIL

SEQ ID NO: 1257113 - protein, 18 aa, Mycobacterium
AASDALRLGDLELSERLG

SEQ ID NO: 1257114 - protein, 26 aa, Mycobacterium
AASDPRLRFLRCDLADRTSIESLVQQ

SEQ ID NO: 1257115 - protein, 21 aa, Mycobacterium
AASGHGGLMVRVPPDQTEELL

SEQ ID NO: 1257116 - protein, 20 aa, Mycobacterium
AASGYMLWHHRQAVAEREQT

SEQ ID NO: 1257117 - protein, 24 aa, Mycobacterium
AASIKEQVCRGTISFLSREARKPG

SEQ ID NO: 1257118 - protein, 22 aa, Mycobacterium
AASKELAYLGVRVNAIQPGLIR

SEQ ID NO: 1257119 - protein, 25 aa, Mycobacterium
AASLQEVFGALAIQSVLGIADRTQR

SEQ ID NO: 1257120 - protein, 23 aa, Mycobacterium
AASRAGVVSTMIVPADVSWNDGE

SEQ ID NO: 1257121 - protein, 18 aa, Mycobacterium
AASRLLGFMYLSRVWHAA

SEQ ID NO: 1257122 - protein, 24 aa, Mycobacterium
AASRMTGNPGLCIGTLGPGVANIA

SEQ ID NO: 1257123 - protein, 20 aa, Mycobacterium
AASSLPWYPGQVSLESPTQT

SEQ ID NO: 1257124 - protein, 28 aa, Mycobacterium
AASTDPVSWIGMPGDLPAEVLNRTLGYP

SEQ ID NO: 1257125 - protein, 32 aa, Mycobacterium
AASVIMEFADKCGISMPIAREVDGVVNHGSTV

SEQ ID NO: 1257126 - protein, 20 aa, Mycobacterium
AASVQKCIRTPDIDEVGITT

SEQ ID NO: 1257127 - protein, 26 aa, Mycobacterium
AATAPAWRVGDDVAHTDHGHGWVQGA

SEQ ID NO: 1257128 - protein, 25 aa, Mycobacterium
AATDAGYLRRFYPPGDDEVHYEATP

SEQ ID NO: 1257129 - protein, 25 aa, Mycobacterium
AATDFRLMWDNAYAVHTLTHDFVKQ

SEQ ID NO: 1257130 - protein, 19 aa, Mycobacterium
AATFSWSHTVDALLAGYGR

SEQ ID NO: 1257131 - protein, 21 aa, Mycobacterium
AATGRRLLRLQCYEGQDETKA

SEQ ID NO: 1257132 - protein, 21 aa, Mycobacterium
AATHKWPIVLDEIQERYREGP

SEQ ID NO: 1257133 - protein, 35 aa, Mycobacterium
AATIEGWMPFGRVFETLAWGRRHVVMGANQIDRYG

SEQ ID NO: 1257134 - protein, 17 aa, Mycobacterium
AATLGMTNVNFWAAGSW

SEQ ID NO: 1257135 - protein, 18 aa, Mycobacterium
AATLKKVFLELGGKSAFL

SEQ ID NO: 1257136 - protein, 18 aa, Mycobacterium
AATLLAAADLWIFLTTAA

SEQ ID NO: 1257137 - protein, 24 aa, Mycobacterium
AATLQRGGSLISNYRTQVQSKADE

SEQ ID NO: 1257138 - protein, 21 aa, Mycobacterium
AATLRARHHGAPMPAAAAILS

SEQ ID NO: 1257139 - protein, 21 aa, Mycobacterium
AATPRGGQRLLFSATLDNGVD

SEQ ID NO: 1257140 - protein, 23 aa, Mycobacterium
AATPVRTLPGFGHLAWHLVDPGT

SEQ ID NO: 1257141 - protein, 20 aa, Mycobacterium
AATQDPRSWAALPRAGAVIF

SEQ ID NO: 1257142 - protein, 24 aa, Mycobacterium
AATRARRGALTSLVLPELRAMAKE

SEQ ID NO: 1257143 - protein, 24 aa, Mycobacterium
AATRRLADRLGVTVLLKGNVTVVA

SEQ ID NO: 1257144 - protein, 24 aa, Mycobacterium
AATRYAPGGVRSFGPLRAGLGIEP

SEQ ID NO: 1257145 - protein, 27 aa, Mycobacterium
AATTDWRRLTITLAWLSPVNTATRRHR

SEQ ID NO: 1257146 - protein, 19 aa, Mycobacterium
AATVARFVKGGARVVTSGR

SEQ ID NO: 1257147 - protein, 22 aa, Mycobacterium
AATVDLAWHGRRIVFTGDLGRY

SEQ ID NO: 1257148 - protein, 28 aa, Mycobacterium
AATVLDTDCRVFRVAGLRVADASAMPTI

SEQ ID NO: 1257149 - protein, 25 aa, Mycobacterium
AATVSWCRDWRAEIRMTDLAAEVAA

SEQ ID NO: 1257150 - protein, 18 aa, Mycobacterium
AATWGIAAAMTRGDISVT

SEQ ID NO: 1257151 - protein, 20 aa, Mycobacterium
AAVAEFTASLVLVSPEVGLT

SEQ ID NO: 1257152 - protein, 24 aa, Mycobacterium
AAVAGRIRSAGAIFVGPWSPVSLG

SEQ ID NO: 1257153 - protein, 19 aa, Mycobacterium
AAVAWRAVVEQAADQAVRA

SEQ ID NO: 1257154 - protein, 27 aa, Mycobacterium
AAVCLPHDWLTWRLSGSTDIADLCTDR

SEQ ID NO: 1257155 - protein, 17 aa, Mycobacterium
AAVDTFGGLDVMVNNAG

SEQ ID NO: 1257156 - protein, 18 aa, Mycobacterium
AAVEEIRTKGTVPAKLPD

SEQ ID NO: 1257157 - protein, 24 aa, Mycobacterium
AAVGEILASLGLRLHPDKTKVVDL

SEQ ID NO: 1257158 - protein, 24 aa, Mycobacterium
AAVGHGALAYLLKPFTFAAFRDRL

SEQ ID NO: 1257159 - protein, 19 aa, Mycobacterium
AAVGQGIHKFRDPALREDF

SEQ ID NO: 1257160 - protein, 17 aa, Mycobacterium
AAVGRFVIGGWAEVLLL

SEQ ID NO: 1257161 - protein, 25 aa, Mycobacterium
AAVKEAPWLPGQVQVFIHGEAQAVM

SEQ ID NO: 1257162 - protein, 20 aa, Mycobacterium
AAVLAGRGARVVVAVRNLDK

SEQ ID NO: 1257163 - protein, 17 aa, Mycobacterium
AAVLDAGQHWILRIEGW

SEQ ID NO: 1257164 - protein, 17 aa, Mycobacterium
AAVLGSPIAHSRSPQLH

SEQ ID NO: 1257165 - protein, 30 aa, Mycobacterium
AAVLPRARRLLVGAAIRFDEDLMLRGIESA

SEQ ID NO: 1257166 - protein, 24 aa, Mycobacterium
AAVLSLRARKGMVLDAADHDTWSV

SEQ ID NO: 1257167 - protein, 29 aa, Mycobacterium
AAVLTAGLAFDWAALRAGDRVLIHAASGG

SEQ ID NO: 1257168 - protein, 24 aa, Mycobacterium
AAVNGFCVGGGIGLVGNSDVIVAS

SEQ ID NO: 1257169 - protein, 26 aa, Mycobacterium
AAVPPGRLGWGWAKFAFGSWTTLSWV

SEQ ID NO: 1257170 - protein, 18 aa, Mycobacterium
AAVPVMCLPGHRTAELGH

SEQ ID NO: 1257171 - protein, 19 aa, Mycobacterium
AAVRAEFGPVGILVTCAAI

SEQ ID NO: 1257172 - protein, 24 aa, Mycobacterium
AAVRGRFGDTLPFLVKVLAADEPL

SEQ ID NO: 1257173 - protein, 22 aa, Mycobacterium
AAVRLNHEFHRGVNVAAGSPKL

SEQ ID NO: 1257174 - protein, 18 aa, Mycobacterium
AAVRRLAQRLALTAGRRL

SEQ ID NO: 1257175 - protein, 19 aa, Mycobacterium
AAVRRPERVAPWSIVELGL

SEQ ID NO: 1257176 - protein, 18 aa, Mycobacterium
AAVRSALEIGYRHIDTAE

SEQ ID NO: 1257177 - protein, 18 aa, Mycobacterium
AAVRWAAREAHFRHARLA

SEQ ID NO: 1257178 - protein, 17 aa, Mycobacterium
AAVSIRPLLLMLSHPFY

SEQ ID NO: 1257179 - protein, 18 aa, Mycobacterium
AAVTVCYMGVNGRDGSVF

SEQ ID NO: 1257180 - protein, 19 aa, Mycobacterium
AAVTVCYMGVNGRDGSVFD

SEQ ID NO: 1257181 - protein, 26 aa, Mycobacterium
AAVWRARRVLAVTWPDGYPVDTETPV

SEQ ID NO: 1257182 - protein, 17 aa, Mycobacterium
AAWALSRRGVTDVVVAE

SEQ ID NO: 1257183 - protein, 21 aa, Mycobacterium
AAWDPEFSVRLAAAGFLGLTI

SEQ ID NO: 1257184 - protein, 24 aa, Mycobacterium
AAWLKENRSGAGLFDSLANLVKVR

SEQ ID NO: 1257185 - protein, 19 aa, Mycobacterium
AAWMLVRMVEHLCVRYILD

SEQ ID NO: 1257186 - protein, 20 aa, Mycobacterium
AAWTSIRLALAGGDRLARVR

SEQ ID NO: 1257187 - protein, 27 aa, Mycobacterium
AAYACANAWLDGLVAWRTAAGLPALAV

SEQ ID NO: 1257188 - protein, 32 aa, Mycobacterium
AAYAPRPRMLVFGAIDFAAAVAQQGSFLGYRV

SEQ ID NO: 1257189 - protein, 20 aa, Mycobacterium
AAYAPYGIRVNALAPGPVDT

SEQ ID NO: 1257190 - protein, 17 aa, Mycobacterium
AAYARQAAHDWHEFIAF

SEQ ID NO: 1257191 - protein, 24 aa, Mycobacterium
AAYERAFEAKVRWEAGRFDESGEL

SEQ ID NO: 1257192 - protein, 25 aa, Mycobacterium
AAYLAGFAWGLGRGYTVLVEMDADG

SEQ ID NO: 1257193 - protein, 29 aa, Mycobacterium
AAYLARLRWPGGFRCPSCDHDRAWQTSTQ

SEQ ID NO: 1257194 - protein, 19 aa, Mycobacterium
AAYMAFWGPDDVFRRANLE

SEQ ID NO: 1257195 - protein, 17 aa, Mycobacterium
AAYPPGLAQSWDSVGLV

SEQ ID NO: 1257196 - protein, 20 aa, Mycobacterium
AAYPRLVVATITGWGSTGPF

SEQ ID NO: 1257197 - protein, 20 aa, Mycobacterium
ACAKEIRRNAARGVHSLTFS

SEQ ID NO: 1257198 - protein, 17 aa, Mycobacterium
ACALEPINAEAWFDTVR

SEQ ID NO: 1257199 - protein, 20 aa, Mycobacterium
ACAPSPLALLSRAVLSQDWA

SEQ ID NO: 1257200 - protein, 21 aa, Mycobacterium
ACASSGVVAARIFTPAEMFSS

SEQ ID NO: 1257201 - protein, 18 aa, Mycobacterium
ACATVYIPTAIFDFPVTP

SEQ ID NO: 1257202 - protein, 20 aa, Mycobacterium
ACAWPNADHERIWADTMAAL

SEQ ID NO: 1257203 - protein, 26 aa, Mycobacterium
ACDRADAVLVLTEWREFVELDPVLLA

SEQ ID NO: 1257204 - protein, 26 aa, Mycobacterium
ACEADLCTRTELVAALDELETVGCRL

SEQ ID NO: 1257205 - protein, 22 aa, Mycobacterium
ACFLRAHPSYWHRLPAHVVWAD

SEQ ID NO: 1257206 - protein, 18 aa, Mycobacterium
ACFYGRQAMNIERARELA

SEQ ID NO: 1257207 - protein, 17 aa, Mycobacterium
ACGAARWSGAGAGSGGG

SEQ ID NO: 1257208 - protein, 17 aa, Mycobacterium
ACGARVLARKSSWEQTS

SEQ ID NO: 1257209 - protein, 19 aa, Mycobacterium
ACGPEGMLNDAEKVWEQAG

SEQ ID NO: 1257210 - protein, 24 aa, Mycobacterium
ACGPRLAARAAAAGIRRLGFESHV

SEQ ID NO: 1257211 - protein, 22 aa, Mycobacterium
ACGSMMAGLAMNISDCAAEHSL

SEQ ID NO: 1257212 - protein, 19 aa, Mycobacterium
ACLARETLLQFFLVDPHEI

SEQ ID NO: 1257213 - protein, 18 aa, Mycobacterium
ACLDRGVRVGCFRPPTVP

SEQ ID NO: 1257214 - protein, 19 aa, Mycobacterium
ACLIVEPILSDGGLVVPPD

SEQ ID NO: 1257215 - protein, 17 aa, Mycobacterium
ACLVEPILSSGGIIELP

SEQ ID NO: 1257216 - protein, 18 aa, Mycobacterium
ACNIAASMLAMFPEEVAR

SEQ ID NO: 1257217 - protein, 25 aa, Mycobacterium
ACPEREVAPCPAVRGADAEAYAAAT

SEQ ID NO: 1257218 - protein, 19 aa, Mycobacterium
ACPVFPGKRYENWELTDPA

SEQ ID NO: 1257219 - protein, 19 aa, Mycobacterium
ACRAERRAALIGYLPTGFP

SEQ ID NO: 1257220 - protein, 18 aa, Mycobacterium
ACRDDVPFLSLTSGPHGL

SEQ ID NO: 1257221 - protein, 19 aa, Mycobacterium
ACSAARYPKSIVEIGGLTA

SEQ ID NO: 1257222 - protein, 22 aa, Mycobacterium
ACSYPLTGVACVSRIYTDHAVL

SEQ ID NO: 1257223 - protein, 24 aa, Mycobacterium
ACTLRNWLGMWSLRHAQTRAEPHL

SEQ ID NO: 1257224 - protein, 25 aa, Mycobacterium
ACVIDELRGLFLFDGLTDAQLTALC

SEQ ID NO: 1257225 - protein, 19 aa, Mycobacterium
ACVRSSIAPAAYHSLVLLW

SEQ ID NO: 1257226 - protein, 17 aa, Mycobacterium
ADAAALAAELGRFDQVE

SEQ ID NO: 1257227 - protein, 22 aa, Mycobacterium
ADAAIRLREYMFPDGALNTEVV

SEQ ID NO: 1257228 - protein, 20 aa, Mycobacterium
ADAALAVWLEMWNTDSEIAR

SEQ ID NO: 1257229 - protein, 26 aa, Mycobacterium
ADAALAWLKERRSEWVGVAHGKKPLA

SEQ ID NO: 1257230 - protein, 27 aa, Mycobacterium
ADAAQQRWFRLSALAERVSATVRIASE

SEQ ID NO: 1257231 - protein, 25 aa, Mycobacterium
ADAAWRAAFDHEDICVAIIKHANPC

SEQ ID NO: 1257232 - protein, 24 aa, Mycobacterium
ADADLDSAVSWSIRAIFSNAGQVC

SEQ ID NO: 1257233 - protein, 17 aa, Mycobacterium
ADADTGTNMLFTMRAAW

SEQ ID NO: 1257234 - protein, 18 aa, Mycobacterium
ADAEFARLFPGVVATPLA

SEQ ID NO: 1257235 - protein, 27 aa, Mycobacterium
ADAEGCVREMLVLAAALSIPDPRERPA

SEQ ID NO: 1257236 - protein, 22 aa, Mycobacterium
ADAETALAMARRSGVMRMTWWP

SEQ ID NO: 1257237 - protein, 17 aa, Mycobacterium
ADAEVIWHVLRPLSGED

SEQ ID NO: 1257238 - protein, 17 aa, Mycobacterium
ADAFCWNMVRSLVGALL

SEQ ID NO: 1257239 - protein, 24 aa, Mycobacterium
ADAFQEYYHVPSLHSQQVPSAVRQ

SEQ ID NO: 1257240 - protein, 18 aa, Mycobacterium
ADAGDSWFSDWINQTVPL

SEQ ID NO: 1257241 - protein, 19 aa, Mycobacterium
ADAGMTLRIPRPRLCTDNG

SEQ ID NO: 1257242 - protein, 20 aa, Mycobacterium
ADAGRFVTTIKRRLEEGAFE

SEQ ID NO: 1257243 - protein, 20 aa, Mycobacterium
ADAIAFGLAMDRFVEAEPQF

SEQ ID NO: 1257244 - protein, 18 aa, Mycobacterium
ADAIAMGFADHFVPQDRL

SEQ ID NO: 1257245 - protein, 18 aa, Mycobacterium
ADAIRIVDMIGVHNAERV

SEQ ID NO: 1257246 - protein, 23 aa, Mycobacterium
ADAITHFAFGCGDDNPLFYDPTY

SEQ ID NO: 1257247 - protein, 25 aa, Mycobacterium
ADAKAFGTPGFRAWAAHARGAVAVR

SEQ ID NO: 1257248 - protein, 24 aa, Mycobacterium
ADAKYAVAQARRGVIGDCMSHWTL

SEQ ID NO: 1257249 - protein, 24 aa, Mycobacterium
ADALARLASRYALGDSGLDGAEYH

SEQ ID NO: 1257250 - protein, 19 aa, Mycobacterium
ADALCGAGYGERSTERTNS

SEQ ID NO: 1257251 - protein, 17 aa, Mycobacterium
ADALFHALADRTRRDIM

SEQ ID NO: 1257252 - protein, 22 aa, Mycobacterium
ADALHFPWKINAGVTAVDLMLQ

SEQ ID NO: 1257253 - protein, 19 aa, Mycobacterium
ADALKSRFDHIDLLINNAG

SEQ ID NO: 1257254 - protein, 26 aa, Mycobacterium
ADALMILPVSYWKLTDREIARHYASV

SEQ ID NO: 1257255 - protein, 29 aa, Mycobacterium
ADALMTVRWGCLRGANLFFGCGHSDGAWA

SEQ ID NO: 1257256 - protein, 21 aa, Mycobacterium
ADALRGTLFLVDSAELPPIED

SEQ ID NO: 1257257 - protein, 22 aa, Mycobacterium
ADAMSAMGGPMGMMGQLSSVTG

SEQ ID NO: 1257258 - protein, 17 aa, Mycobacterium
ADAPCGVLLDIHSGGFY

SEQ ID NO: 1257259 - protein, 19 aa, Mycobacterium
ADAPPILVLTGRPDDAWLA

SEQ ID NO: 1257260 - protein, 19 aa, Mycobacterium
ADAPPWIGALDVIVVAGDD

SEQ ID NO: 1257261 - protein, 19 aa, Mycobacterium
ADARAVLRDVLISELHPEM

SEQ ID NO: 1257262 - protein, 29 aa, Mycobacterium
ADARKLCAERGWTVVEVFCDNDRSAYDRL

SEQ ID NO: 1257263 - protein, 17 aa, Mycobacterium
ADARLAAQTAAEERHRA

SEQ ID NO: 1257264 - protein, 19 aa, Mycobacterium
ADARMRWAVHVSARLLAGA

SEQ ID NO: 1257265 - protein, 24 aa, Mycobacterium
ADASRGSLFNGIRIGAIDAAATGK

SEQ ID NO: 1257266 - protein, 24 aa, Mycobacterium
ADAVAGMAGLLGWSHGPAQALGRF

SEQ ID NO: 1257267 - protein, 18 aa, Mycobacterium
ADAVIWSRGPGMAERPEF

SEQ ID NO: 1257268 - protein, 27 aa, Mycobacterium
ADAVPGRAGVCGSVIDAVAPGAVAGAA

SEQ ID NO: 1257269 - protein, 18 aa, Mycobacterium
ADAVPLLTAVVEWDEGPR

SEQ ID NO: 1257270 - protein, 19 aa, Mycobacterium
ADAVTACFYMCDTAAGLAL

SEQ ID NO: 1257271 - protein, 23 aa, Mycobacterium
ADCAEFLNALTLGTREAAIAGQV

SEQ ID NO: 1257272 - protein, 24 aa, Mycobacterium
ADDARLPVRLQWVRAELAMVRGDG

SEQ ID NO: 1257273 - protein, 28 aa, Mycobacterium
ADDEHWRRLFALADERRAPVAGVVLGVT

SEQ ID NO: 1257274 - protein, 20 aa, Mycobacterium
ADDIAALMTLEMGKVFAESK

SEQ ID NO: 1257275 - protein, 21 aa, Mycobacterium
ADDLLKPGCLAVQASVLDNNP

SEQ ID NO: 1257276 - protein, 27 aa, Mycobacterium
ADDLRVGPHPGWRIEVDDTDVTVHADG

SEQ ID NO: 1257277 - protein, 19 aa, Mycobacterium
ADDLYHWFSQMLYEVLAPE

SEQ ID NO: 1257278 - protein, 18 aa, Mycobacterium
ADDPEWGQIIVAVVVAQP

SEQ ID NO: 1257279 - protein, 18 aa, Mycobacterium
ADDPRFVTNPARVANRDA

SEQ ID NO: 1257280 - protein, 24 aa, Mycobacterium
ADDPRRRLAAAMAKASAGECQSLV

SEQ ID NO: 1257281 - protein, 20 aa, Mycobacterium
ADDRDVFGLDEMVAAFDVVD

SEQ ID NO: 1257282 - protein, 17 aa, Mycobacterium
ADDRPDFAFAEADEMTV

SEQ ID NO: 1257283 - protein, 23 aa, Mycobacterium
ADDSRRLLLMIGKDMGLDTKRHS

SEQ ID NO: 1257284 - protein, 19 aa, Mycobacterium
ADEACHRLAIALCSSCGLA

SEQ ID NO: 1257285 - protein, 25 aa, Mycobacterium
ADEARREALPNIARLLPVARAAGAS

SEQ ID NO: 1257286 - protein, 18 aa, Mycobacterium
ADEERAASVAAQLHVGSV

SEQ ID NO: 1257287 - protein, 25 aa, Mycobacterium
ADEEVARCAAAMAEVDEAVRRHAAL

SEQ ID NO: 1257288 - protein, 18 aa, Mycobacterium
ADEGRYLVQIGAADIGTG

SEQ ID NO: 1257289 - protein, 20 aa, Mycobacterium
ADEIDFWLWLDAGFEDRAIE

SEQ ID NO: 1257290 - protein, 20 aa, Mycobacterium
ADEIQILLARTLRGGEPTPT

SEQ ID NO: 1257291 - protein, 33 aa, Mycobacterium
ADELAVVHPGWWSRRRVQAVLDAAGDICGAAVA

SEQ ID NO: 1257292 - protein, 22 aa, Mycobacterium
ADELCDRVAFVVDGRIVALDAP

SEQ ID NO: 1257293 - protein, 17 aa, Mycobacterium
ADELYAWVADQTVDEIR

SEQ ID NO: 1257294 - protein, 19 aa, Mycobacterium
ADELYQWQSELLGECMATT

SEQ ID NO: 1257295 - protein, 23 aa, Mycobacterium
ADEPASILILFAPGAPREHYFEG

SEQ ID NO: 1257296 - protein, 17 aa, Mycobacterium
ADEVIKLLPPLTTSEED

SEQ ID NO: 1257297 - protein, 30 aa, Mycobacterium; identical to SEQ ID NO: 627477

SEQ ID NO: 1257298 - protein, 26 aa, Mycobacterium
ADEWRRLRLARMAAVEAMPYFAKALF

SEQ ID NO: 1257299 - protein, 23 aa, Mycobacterium
ADEYEVFSSIVLIRSRYDEPQLE

SEQ ID NO: 1257300 - protein, 24 aa, Mycobacterium
ADFARACAQAGVIFVGPSPEAIVA

SEQ ID NO: 1257301 - protein, 19 aa, Mycobacterium
ADFAVCGGVEGGIEALPIA

SEQ ID NO: 1257302 - protein, 19 aa, Mycobacterium
ADFDRWLVQDAVFVADLLT

SEQ ID NO: 1257303 - protein, 17 aa, Mycobacterium
ADFLNELDAPPAAGGES

SEQ ID NO: 1257304 - protein, 25 aa, Mycobacterium
ADFPADPFNLLAMLNIGAGILSSVH

SEQ ID NO: 1257305 - protein, 17 aa, Mycobacterium
ADFPELTIVMAHPAVPW

SEQ ID NO: 1257306 - protein, 17 aa, Mycobacterium
ADFVKRQNLGSFTLGPI

SEQ ID NO: 1257307 - protein, 17 aa, Mycobacterium
ADFVKRQNLGSFTLGPL

SEQ ID NO: 1257308 - protein, 20 aa, Mycobacterium
ADFVPRVWAGLEALGLGHPG

SEQ ID NO: 1257309 - protein, 19 aa, Mycobacterium
ADFVRKEFRTLRVKVDEAT

SEQ ID NO: 1257310 - protein, 26 aa, Mycobacterium
ADGAKFATSFARRGLIAEYGISWILP

SEQ ID NO: 1257311 - protein, 19 aa, Mycobacterium
ADGAMTFGAVAGAPALVFV

SEQ ID NO: 1257312 - protein, 18 aa, Mycobacterium
ADGARLFGEMVRHCADRI

SEQ ID NO: 1257313 - protein, 23 aa, Mycobacterium
ADGDAFAALGAVVAGERPRLTGE

SEQ ID NO: 1257314 - protein, 17 aa, Mycobacterium
ADGDEWEAFLGKDEDLY

SEQ ID NO: 1257315 - protein, 22 aa, Mycobacterium
ADGDPWASFVTYGLLDGAPVLC

SEQ ID NO: 1257316 - protein, 22 aa, Mycobacterium
ADGEIPHALALQSNNACPTFRA

SEQ ID NO: 1257317 - protein, 27 aa, Mycobacterium
ADGEPLFMAGLWTTWRPRDAPKEAPPL

SEQ ID NO: 1257318 - protein, 21 aa, Mycobacterium
ADGFSSLWYASAVGGDPLVAM

SEQ ID NO: 1257319 - protein, 23 aa, Mycobacterium
ADGGLPWRYHPDGSVALASPPKE

SEQ ID NO: 1257320 - protein, 17 aa, Mycobacterium
ADGGMTAAFAHLTNGAD

SEQ ID NO: 1257321 - protein, 31 aa, Mycobacterium
ADGGSNWYTEFARLAPLMKPDVHYEVDIKKR

SEQ ID NO: 1257322 - protein, 25 aa, Mycobacterium
ADGKEIAGRLAARIGSGILSDVVEV

SEQ ID NO: 1257323 - protein, 25 aa, Mycobacterium
ADGKEIAGRLAARIGSGVLTDVIAV

SEQ ID NO: 1257324 - protein, 24 aa, Mycobacterium
ADGKRPRVVVVGGGIAGLAAATGL

SEQ ID NO: 1257325 - protein, 20 aa, Mycobacterium
ADGLGGLAIVVNNAGITRDR

SEQ ID NO: 1257326 - protein, 21 aa, Mycobacterium
ADGLGRFCEICVEAFAGFAIV

SEQ ID NO: 1257327 - protein, 35 aa, Mycobacterium
ADGLKVIATRSRLMKRLSGQGAMALLELDAEAAEQ

SEQ ID NO: 1257328 - protein, 19 aa, Mycobacterium
ADGLLVMPFGSKRFLHGTT

SEQ ID NO: 1257329 - protein, 28 aa, Mycobacterium
ADGMAAVLPCYWIYAEVGAELLQRGSTD

SEQ ID NO: 1257330 - protein, 19 aa, Mycobacterium
ADGMEFPLFVKAVSGGGGR

SEQ ID NO: 1257331 - protein, 18 aa, Mycobacterium
ADGNVWGATVNKTAGDAE

SEQ ID NO: 1257332 - protein, 19 aa, Mycobacterium
ADGPLTLRNRALLELLYST

SEQ ID NO: 1257333 - protein, 24 aa, Mycobacterium
ADGRAAREAYKWMRANQPVFRDRN

SEQ ID NO: 1257334 - protein, 19 aa, Mycobacterium
ADGRFARQLGADAWAPDAR

SEQ ID NO: 1257335 - protein, 23 aa, Mycobacterium
ADGRGSWGGTLVGLFQPAEETGD

SEQ ID NO: 1257336 - protein, 22 aa, Mycobacterium
ADGRIWCAMVTPANPLADRLAA

SEQ ID NO: 1257337 - protein, 20 aa, Mycobacterium
ADGRIYSDYVEWRAANPSDD

SEQ ID NO: 1257338 - protein, 23 aa, Mycobacterium
ADGRPCSAMLLGNALSDDTVLQL

SEQ ID NO: 1257339 - protein, 20 aa, Mycobacterium
ADGRPDIALINWPITAPGLV

SEQ ID NO: 1257340 - protein, 23 aa, Mycobacterium
ADGRRVRLWAGLNERFGPGRPGH

SEQ ID NO: 1257341 - protein, 18 aa, Mycobacterium
ADGRRYVLAEARLGAYAR

SEQ ID NO: 1257342 - protein, 19 aa, Mycobacterium
ADGSPGYQASVDYVAQLLR

SEQ ID NO: 1257343 - protein, 24 aa, Mycobacterium
ADGTELRRAFGCFPSGVTAVCAII

SEQ ID NO: 1257344 - protein, 23 aa, Mycobacterium
ADGTGLWPLNPVLAFAGLGAAAR

SEQ ID NO: 1257345 - protein, 26 aa, Mycobacterium
ADGTTWRPKVPLGYGRTYTLEAVGGG

SEQ ID NO: 1257346 - protein, 25 aa, Mycobacterium
ADGTVSWAPVWARYGTNNRSCMLRL

SEQ ID NO: 1257347 - protein, 20 aa, Mycobacterium
ADGTYCFWAITPTPYPIPHD

SEQ ID NO: 1257348 - protein, 18 aa, Mycobacterium
ADGVKIVNQLSMVGTVES

SEQ ID NO: 1257349 - protein, 17 aa, Mycobacterium
ADGVNLWLTRALTTGNA

SEQ ID NO: 1257350 - protein, 23 aa, Mycobacterium
ADGVPNFDFKVCGPEAGSPLRTS

SEQ ID NO: 1257351 - protein, 17 aa, Mycobacterium
ADGVRASFMPKPFAEHP

SEQ ID NO: 1257352 - protein, 17 aa, Mycobacterium
ADGYAAAAVLAMPDQHL

SEQ ID NO: 1257353 - protein, 17 aa, Mycobacterium
ADGYIDIKGLRLTLTQA

SEQ ID NO: 1257354 - protein, 21 aa, Mycobacterium
ADGYLALFITHDGFWAAFAAE

SEQ ID NO: 1257355 - protein, 22 aa, Mycobacterium
ADGYLALFITHDGFWRLFASEA

SEQ ID NO: 1257356 - protein, 20 aa, Mycobacterium
ADGYTGKAITEYLGVSRATL

SEQ ID NO: 1257357 - protein, 26 aa, Mycobacterium
ADHAAEWRGLFDAGLVASVLTVQVLG

SEQ ID NO: 1257358 - protein, 17 aa, Mycobacterium
ADHAALMAYRDRNLAFV

SEQ ID NO: 1257359 - protein, 28 aa, Mycobacterium
ADHCLDMPGLFVWRRYHPTPAPERGVVY

SEQ ID NO: 1257360 - protein, 18 aa, Mycobacterium
ADHIFEIPATTTLYQPLL

SEQ ID NO: 1257361 - protein, 18 aa, Mycobacterium
ADHLLSGLATLLVGGRRE

SEQ ID NO: 1257362 - protein, 22 aa, Mycobacterium
ADHLWYYRELLTAYRGRGLDSW

SEQ ID NO: 1257363 - protein, 20 aa, Mycobacterium
ADHRGRPFFDLLARVGADRP

SEQ ID NO: 1257364 - protein, 24 aa, Mycobacterium
ADHRRVVGELGLLDRRLADQIDRS

SEQ ID NO: 1257365 - protein, 31 aa, Mycobacterium
ADHVFSRIDIPGWLARTGFQMLDPVKTAQSR

SEQ ID NO: 1257366 - protein, 17 aa, Mycobacterium
ADIAAALALQSRNGEEF

SEQ ID NO: 1257367 - protein, 19 aa, Mycobacterium
ADIAICGGVEARIEAVPIA

SEQ ID NO: 1257368 - protein, 23 aa, Mycobacterium
ADIAMAFDRYRVVTGDESLEKDC

SEQ ID NO: 1257369 - protein, 28 aa, Mycobacterium
ADIARRAKRRPVWIKGFGEHVPFKTPTY

SEQ ID NO: 1257370 - protein, 29 aa, Mycobacterium
ADIECIYRGYRFAVVWPSTNPDAGGATYW

SEQ ID NO: 1257371 - protein, 19 aa, Mycobacterium
ADIGLPFEGAMDIAGSMNI

SEQ ID NO: 1257372 - protein, 19 aa, Mycobacterium
ADIGPDLNLALAFATAFPY

SEQ ID NO: 1257373 - protein, 17 aa, Mycobacterium
ADIGRAILERRFAASYA

SEQ ID NO: 1257374 - protein, 18 aa, Mycobacterium
ADIIAVDLCENVDTIGYP

SEQ ID NO: 1257375 - protein, 18 aa, Mycobacterium
ADILRAWGKLGYPRRAKR

SEQ ID NO: 1257376 - protein, 18 aa, Mycobacterium
ADIPPLRGIIYTDSESST

SEQ ID NO: 1257377 - protein, 17 aa, Mycobacterium
ADIRLIPDLTTLRRVPW

SEQ ID NO: 1257378 - protein, 26 aa, Mycobacterium
ADIRSIPTLMAFKKGKLVFNQAGALP

SEQ ID NO: 1257379 - protein, 24 aa, Mycobacterium
ADIWSAATELGWTGLALPEDVGGS

SEQ ID NO: 1257380 - protein, 21 aa, Mycobacterium
ADKARPHFERWFAEVAGDVAL

SEQ ID NO: 1257381 - protein, 18 aa, Mycobacterium
ADKGWRGACQADPALAKG

SEQ ID NO: 1257382 - protein, 25 aa, Mycobacterium
ADKLDLRSGITFNTRVVSTVLDEDT

SEQ ID NO: 1257383 - protein, 24 aa, Mycobacterium
ADKLDLRSGVTFNTKVTSAVLDED

SEQ ID NO: 1257384 - protein, 25 aa, Mycobacterium
ADKLDWPANLWLGVSVENTDHLDRI

SEQ ID NO: 1257385 - protein, 24 aa, Mycobacterium
ADKRELLDVFVVWERQYYERAIAR

SEQ ID NO: 1257386 - protein, 24 aa, Mycobacterium
ADKVLKNQACSRGILDYYREQDFV

SEQ ID NO: 1257387 - protein, 18 aa, Mycobacterium
ADKWVPLLQNRTPVVAAE

SEQ ID NO: 1257388 - protein, 23 aa, Mycobacterium
ADLAARLSAPRVVWVMVPSGTVT

SEQ ID NO: 1257389 - protein, 18 aa, Mycobacterium
ADLAIVVAPTFAGADAAG

SEQ ID NO: 1257390 - protein, 18 aa, Mycobacterium
ADLAKSWEDGAFEYRCIE

SEQ ID NO: 1257391 - protein, 25 aa, Mycobacterium
ADLAMARWGIAYAIGPNYNKGREAF

SEQ ID NO: 1257392 - protein, 23 aa, Mycobacterium
ADLDRLRTLLGRADVMVNTMRPT

SEQ ID NO: 1257393 - protein, 19 aa, Mycobacterium
ADLDVASAAFWAAEAGHRV

SEQ ID NO: 1257394 - protein, 24 aa, Mycobacterium
ADLEAFSDWCLRSEPERYAKRLSS

SEQ ID NO: 1257395 - protein, 25 aa, Mycobacterium
ADLEAHGGMVRCIEDGYLQGLIADE

SEQ ID NO: 1257396 - protein, 22 aa, Mycobacterium
ADLEALAGMSVLNGVPVRIEVV

SEQ ID NO: 1257397 - protein, 26 aa, Mycobacterium
ADLEELVVLLAWRVLTGVELAGTNPA

SEQ ID NO: 1257398 - protein, 22 aa, Mycobacterium
ADLERLSLRGVRAGRPDPAGPT

SEQ ID NO: 1257399 - protein, 21 aa, Mycobacterium
ADLERSWCGQPHPSGRPGWNV

SEQ ID NO: 1257400 - protein, 17 aa, Mycobacterium
ADLGRAAARIAQGRMIN

SEQ ID NO: 1257401 - protein, 27 aa, Mycobacterium
ADLGRPLTRLRVDGGLTRSTALMQAQA

SEQ ID NO: 1257402 - protein, 24 aa, Mycobacterium
ADLGRPTPCAGWDLGDLLVHMTVQ

SEQ ID NO: 1257403 - protein, 25 aa, Mycobacterium
ADLHLRRIFVLTFEVEFFGRHGFQE

SEQ ID NO: 1257404 - protein, 21 aa, Mycobacterium
ADLHYRFTLVGGLIGRLVIEP

SEQ ID NO: 1257405 - protein, 21 aa, Mycobacterium
ADLLFRLVRHFEAAYPDVTVE

SEQ ID NO: 1257406 - protein, 24 aa, Mycobacterium
ADLLRSHVFFDWFDAVGVEDLPAV

SEQ ID NO: 1257407 - protein, 19 aa, Mycobacterium
ADLLWNGGIGTYVKAETEA

SEQ ID NO: 1257408 - protein, 21 aa, Mycobacterium
ADLPEITHFVGGLGTTGTLMG

SEQ ID NO: 1257409 - protein, 21 aa, Mycobacterium
ADLPHGFAVRYQAASRPLQVG

SEQ ID NO: 1257410 - protein, 21 aa, Mycobacterium
ADLPLSLFLDEMVVPYETDDV

SEQ ID NO: 1257411 - protein, 21 aa, Mycobacterium
ADLPMGAKFGTLVHAVLETAD

SEQ ID NO: 1257412 - protein, 17 aa, Mycobacterium
ADLPRSFIVCEQDRSMP

SEQ ID NO: 1257413 - protein, 20 aa, Mycobacterium
ADLPSFAGRTVIVTGANSGL

SEQ ID NO: 1257414 - protein, 19 aa, Mycobacterium
ADLQIHPAVLQAVADVGYE

SEQ ID NO: 1257415 - protein, 23 aa, Mycobacterium
ADLRDARLRLAADDLVTRKAEFD

SEQ ID NO: 1257416 - protein, 19 aa, Mycobacterium
ADLRRSLALVKTISELDDL

SEQ ID NO: 1257417 - protein, 17 aa, Mycobacterium
ADLRRVSLELGGKSAAI

SEQ ID NO: 1257418 - protein, 25 aa, Mycobacterium
ADLRTVLRHELFHYAARADTAADAP

SEQ ID NO: 1257419 - protein, 20 aa, Mycobacterium
ADLSVISWPERYGGRDATLL

SEQ ID NO: 1257420 - protein, 26 aa, Mycobacterium
ADLTARIGAPLVIRGIGVRRVDADRG

SEQ ID NO: 1257421 - protein, 25 aa, Mycobacterium
ADLTEAFLWSEFRIVTKTATVSLHS

SEQ ID NO: 1257422 - protein, 24 aa, Mycobacterium
ADLTRLSQVIVYRRLDFSLDEIAS

SEQ ID NO: 1257423 - protein, 25 aa, Mycobacterium
ADLVARPQPLGVFGLPLGYLLIPAG

SEQ ID NO: 1257424 - protein, 24 aa, Mycobacterium
ADLVCFPEFSPGPVRAHDTFYDAG

SEQ ID NO: 1257425 - protein, 17 aa, Mycobacterium
ADLVGRFLLKGGETVWV

SEQ ID NO: 1257426 - protein, 19 aa, Mycobacterium
ADLVLDCFGIMHEPEQRAS

SEQ ID NO: 1257427 - protein, 30 aa, Mycobacterium; identical to SEQ ID NO: 627962

SEQ ID NO: 1257428 - protein, 23 aa, Mycobacterium
ADMAQRSDRRFQLGKSIFDRSGA

SEQ ID NO: 1257429 - protein, 23 aa, Mycobacterium
ADMEGRFGHDFGDVRVHTDGAAH

SEQ ID NO: 1257430 - protein, 17 aa, Mycobacterium
ADMFDRLGAAAMAADAS

SEQ ID NO: 1257431 - protein, 19 aa, Mycobacterium
ADMGRKFLTKLGILSPASA

SEQ ID NO: 1257432 - protein, 19 aa, Mycobacterium
ADMGRKFLTKLGILSPVTA

SEQ ID NO: 1257433 - protein, 21 aa, Mycobacterium
ADMLGALDWAQLGPLRLFGHC

SEQ ID NO: 1257434 - protein, 17 aa, Mycobacterium
ADMLTSLICHGTLTRFP

SEQ ID NO: 1257435 - protein, 17 aa, Mycobacterium
ADMPLVIALTDKKARVV

SEQ ID NO: 1257436 - protein, 22 aa, Mycobacterium
ADMPVAYGAMVGRVAEALAPLA

SEQ ID NO: 1257437 - protein, 27 aa, Mycobacterium
ADMYVSLELARSMAFYANMSVADGNLD

SEQ ID NO: 1257438 - protein, 34 aa, Mycobacterium
ADNASIYVAEWLGRLGSLPIALILLDARDASFAE

SEQ ID NO: 1257439 - protein, 28 aa, Mycobacterium
ADNTWRVVRYDAPYYWCLADTNGDLLTY

SEQ ID NO: 1257440 - protein, 20 aa, Mycobacterium
ADNTYYCFGTAAGPHPFPMM

SEQ ID NO: 1257441 - protein, 18 aa, Mycobacterium
ADPAARTALCDELATREI

SEQ ID NO: 1257442 - protein, 23 aa, Mycobacterium
ADPADCRRVVDTAVERHGGLDIV

SEQ ID NO: 1257443 - protein, 19 aa, Mycobacterium
ADPAFARFARTSGVEYRNL

SEQ ID NO: 1257444 - protein, 17 aa, Mycobacterium
ADPAQWYRNVVESIREV

SEQ ID NO: 1257445 - protein, 19 aa, Mycobacterium
ADPARPGIRSAQLAVADVD

SEQ ID NO: 1257446 - protein, 17 aa, Mycobacterium
ADPAYGRIVCFCERVTA

SEQ ID NO: 1257447 - protein, 23 aa, Mycobacterium
ADPDLPAGTLRYVGTPTGLAGLI

SEQ ID NO: 1257448 - protein, 26 aa, Mycobacterium
ADPDQFWLAIEALRLRHAAVLNPLLA

SEQ ID NO: 1257449 - protein, 33 aa, Mycobacterium
ADPDTLADLAFAWRTCRAVKSNAIVLARDGATV

SEQ ID NO: 1257450 - protein, 36 aa, Mycobacterium
ADPDYHLRMSWNFLSRSTSGIPEWMDRLGRGVNWDS

SEQ ID NO: 1257451 - protein, 21 aa, Mycobacterium
ADPEGVWGLGVLRAADRAEVL

SEQ ID NO: 1257452 - protein, 20 aa, Mycobacterium
ADPGQRWSVVLSNPPFGRKS

SEQ ID NO: 1257453 - protein, 28 aa, Mycobacterium
ADPHAAALFLPAGRAPRVGDVFRNPDLA

SEQ ID NO: 1257454 - protein, 25 aa, Mycobacterium
ADPHLPYMYHCHILEHEDMGMMGQF

SEQ ID NO: 1257455 - protein, 20 aa, Mycobacterium
ADPKRARRRWHIFDVATRDA

SEQ ID NO: 1257456 - protein, 19 aa, Mycobacterium
ADPLLGYTDIDGVGFVVSE

SEQ ID NO: 1257457 - protein, 28 aa, Mycobacterium
ADPLPRTLAWSAAWEMTRDAELRARDFV

SEQ ID NO: 1257458 - protein, 20 aa, Mycobacterium
ADPNGAWYTSGIRFGSPALT

SEQ ID NO: 1257459 - protein, 21 aa, Mycobacterium
ADPRASLAIVAPASESDPLAS

SEQ ID NO: 1257460 - protein, 27 aa, Mycobacterium
ADPRDRPRFWIAIEPFGNPRIQYTDGT

SEQ ID NO: 1257461 - protein, 17 aa, Mycobacterium
ADPRPLILFGASMGGML

SEQ ID NO: 1257462 - protein, 19 aa, Mycobacterium
ADPRSGRWAGLSKTECGLH

SEQ ID NO: 1257463 - protein, 20 aa, Mycobacterium
ADPRSGRWQGLNKIECGLHQ

SEQ ID NO: 1257464 - protein, 26 aa, Mycobacterium
ADPSLRIVVLEARFAGFGASGRNGGW

SEQ ID NO: 1257465 - protein, 20 aa, Mycobacterium
ADPTAVISWMGYNTPESFTD

SEQ ID NO: 1257466 - protein, 27 aa, Mycobacterium
ADPTAWRHNEHWLAPDFLDPAADVCVS

SEQ ID NO: 1257467 - protein, 24 aa, Mycobacterium
ADPVPPGACRDGVCNPTTDIPLPW

SEQ ID NO: 1257468 - protein, 18 aa, Mycobacterium
ADPVSRGAFCDELAGRNI

SEQ ID NO: 1257469 - protein, 28 aa, Mycobacterium
ADPYDVACALDWLLYDWLMAHRDGPDSA

SEQ ID NO: 1257470 - protein, 27 aa, Mycobacterium
ADQARTIRIPVHMVEVINKLGRIQREL

SEQ ID NO: 1257471 - protein, 18 aa, Mycobacterium
ADQFAKFSALTVDTVNQT

SEQ ID NO: 1257472 - protein, 22 aa, Mycobacterium
ADQLPGGSAYVIGEAGLTTALH

SEQ ID NO: 1257473 - protein, 33 aa, Mycobacterium
ADQPAQSAMAWSLLGWVRRNFFNQAPVVDYDPD

SEQ ID NO: 1257474 - protein, 28 aa, Mycobacterium
ADQPVPYGWLPARARTVFGEQLTTWSDL

SEQ ID NO: 1257475 - protein, 26 aa, Mycobacterium
ADQVPLRLLGPVVRRPAGLRHRPAPS

SEQ ID NO: 1257476 - protein, 18 aa, Mycobacterium
ADRAWTFLQSHSAMAEEN

SEQ ID NO: 1257477 - protein, 27 aa, Mycobacterium
ADRCAIGVPTPAGWRMLSGDETGWLLG

SEQ ID NO: 1257478 - protein, 20 aa, Mycobacterium
ADRCDLDHTIAYPAGPTQAS

SEQ ID NO: 1257479 - protein, 20 aa, Mycobacterium
ADRCLAVDAHGRVIDGDAIM

SEQ ID NO: 1257480 - protein, 23 aa, Mycobacterium
ADREAREQVMWAATLAGIAFGNA

SEQ ID NO: 1257481 - protein, 25 aa, Mycobacterium
ADRFAARGFAFYALDLHKCGRSHRE

SEQ ID NO: 1257482 - protein, 20 aa, Mycobacterium
ADRFRYFRPAVFFLTDGQPT

SEQ ID NO: 1257483 - protein, 19 aa, Mycobacterium
ADRGIKIVVNAGGLNPAGM

SEQ ID NO: 1257484 - protein, 23 aa, Mycobacterium
ADRGLKLTMSIVRFSKFIMDEIF

SEQ ID NO: 1257485 - protein, 24 aa, Mycobacterium
ADRIGRGRAGFVIANAADAAKFAD

SEQ ID NO: 1257486 - protein, 22 aa, Mycobacterium
ADRLEIVGGSFFDSIPAGADAY

SEQ ID NO: 1257487 - protein, 20 aa, Mycobacterium
ADRLLFTLLLSMREDAVGGV

SEQ ID NO: 1257488 - protein, 20 aa, Mycobacterium
ADRLTARLAKIDAAVRELAA

SEQ ID NO: 1257489 - protein, 17 aa, Mycobacterium
ADRLTGRIATIERHGRE

SEQ ID NO: 1257490 - protein, 18 aa, Mycobacterium
ADRPIQWWRSDGWLCPYG

SEQ ID NO: 1257491 - protein, 17 aa, Mycobacterium
ADRPTVLMLHGGGQNRF

SEQ ID NO: 1257492 - protein, 23 aa, Mycobacterium
ADRQRIATELGFSETVFITLPRE

SEQ ID NO: 1257493 - protein, 23 aa, Mycobacterium
ADRRALGEVVGFTGADRQLFDDA

SEQ ID NO: 1257494 - protein, 24 aa, Mycobacterium
ADRRRVDEALGWVDALDIADRRLS

SEQ ID NO: 1257495 - protein, 22 aa, Mycobacterium
ADRRVMLCGNIGNPVLDVLGES

SEQ ID NO: 1257496 - protein, 21 aa, Mycobacterium
ADRSRPRWLEVNSPFRPDRRW

SEQ ID NO: 1257497 - protein, 22 aa, Mycobacterium
ADRYLPGVAFVTSFDLELEMAL

SEQ ID NO: 1257498 - protein, 24 aa, Mycobacterium
ADSDELFAGFALWAESNGTPLYPA

SEQ ID NO: 1257499 - protein, 17 aa, Mycobacterium
ADSGFRMTRVIPTASPL

SEQ ID NO: 1257500 - protein, 19 aa, Mycobacterium
ADSIAFRLMYNTLRATYEP

SEQ ID NO: 1257501 - protein, 19 aa, Mycobacterium
ADSIQAWAANLADLTGQLE

SEQ ID NO: 1257502 - protein, 28 aa, Mycobacterium
ADSLVIGGGMCFTFLAAQGLSVGSSLLE

SEQ ID NO: 1257503 - protein, 17 aa, Mycobacterium
ADSPPARAADCADSEAA

SEQ ID NO: 1257504 - protein, 21 aa, Mycobacterium
ADSSRAWLALLSVLYREVSRP

SEQ ID NO: 1257505 - protein, 20 aa, Mycobacterium
ADSVTSFGAFHLGIEKVDNK

SEQ ID NO: 1257506 - protein, 21 aa, Mycobacterium
ADTALVNGLRTQVWDAVAASR

SEQ ID NO: 1257507 - protein, 27 aa, Mycobacterium
ADTDCPRLPVRFAWVSAELAMFRGEGG

SEQ ID NO: 1257508 - protein, 25 aa, Mycobacterium
ADTFGPRCRDVWLVTVGAENVTAED

SEQ ID NO: 1257509 - protein, 19 aa, Mycobacterium
ADTGTEWGLGALAGAKALL

SEQ ID NO: 1257510 - protein, 26 aa, Mycobacterium
ADTHLLRYPLPSAWGEDCDVALYLKD

SEQ ID NO: 1257511 - protein, 20 aa, Mycobacterium
ADTHPDWYRNLVAHPDVTVE

SEQ ID NO: 1257512 - protein, 19 aa, Mycobacterium
ADTIEFCAAEVPKFNAISV

SEQ ID NO: 1257513 - protein, 18 aa, Mycobacterium
ADTLALMIKVHHAAVDGV

SEQ ID NO: 1257514 - protein, 25 aa, Mycobacterium
ADTLKATVALPLWAAFVSALDPRWG

SEQ ID NO: 1257515 - protein, 21 aa, Mycobacterium
ADTMAHWVTRIAFSLAAEPGR

SEQ ID NO: 1257516 - protein, 18 aa, Mycobacterium
ADTRAFFNYIAKRDDLLP

SEQ ID NO: 1257517 - protein, 21 aa, Mycobacterium
ADTRHAPRFAGTIWLQQGSSA

SEQ ID NO: 1257518 - protein, 18 aa, Mycobacterium
ADTSFDLDPAWLSADPFY

SEQ ID NO: 1257519 - protein, 24 aa, Mycobacterium
ADTYRWPMVPALALLAAMPALGSA

SEQ ID NO: 1257520 - protein, 24 aa, Mycobacterium
ADVAAAWDRVYWIMADTLIALEHD

SEQ ID NO: 1257521 - protein, 17 aa, Mycobacterium
ADVAYLQGQVALREQME

SEQ ID NO: 1257522 - protein, 23 aa, Mycobacterium
ADVDMRCLLIVGSSRTRWHTTTD

SEQ ID NO: 1257523 - protein, 21 aa, Mycobacterium
ADVDPALVYHYFGSKEALLDA

SEQ ID NO: 1257524 - protein, 25 aa, Mycobacterium
ADVEMWKAFAEIGIEAVHTGPVKRA

SEQ ID NO: 1257525 - protein, 21 aa, Mycobacterium
ADVERRVRDGLLTPALAAQQI

SEQ ID NO: 1257526 - protein, 26 aa, Mycobacterium
ADVFSSDFFAGWGKFAATRTPTIAAV

SEQ ID NO: 1257527 - protein, 19 aa, Mycobacterium
ADVGLVIAVKRLTAAKTRL

SEQ ID NO: 1257528 - protein, 18 aa, Mycobacterium
ADVIAAAPALLGFTPTNS

SEQ ID NO: 1257529 - protein, 18 aa, Mycobacterium
ADVKQWWDSLSEQQRREL

SEQ ID NO: 1257530 - protein, 21 aa, Mycobacterium
ADVLGRLAVDGRLVRGEFTDA

SEQ ID NO: 1257531 - protein, 17 aa, Mycobacterium
ADVLRRFSVTVRSSAAR

SEQ ID NO: 1257532 - protein, 17 aa, Mycobacterium
ADVRAWIEDGLRYATIV

SEQ ID NO: 1257533 - protein, 23 aa, Mycobacterium
ADVRLRGLISLLRDDPRVQQFAE

SEQ ID NO: 1257534 - protein, 17 aa, Mycobacterium
ADVSARVGTPGVWYAGS

SEQ ID NO: 1257535 - protein, 19 aa, Mycobacterium
ADVSFAQGMIPHHQQAIEM

SEQ ID NO: 1257536 - protein, 22 aa, Mycobacterium
ADVSLPVVRAFISRIKERAKGA

SEQ ID NO: 1257537 - protein, 17 aa, Mycobacterium
ADVTGWDAMIDVNLRGV

SEQ ID NO: 1257538 - protein, 17 aa, Mycobacterium
ADVTRYQALVNVLVPFP

SEQ ID NO: 1257539 - protein, 25 aa, Mycobacterium
ADVVSLQAATGFSARAAEHQSVAAQ

SEQ ID NO: 1257540 - protein, 22 aa, Mycobacterium
ADWFRPKAMRDLKIRVDELAKR

SEQ ID NO: 1257541 - protein, 17 aa, Mycobacterium
ADWLRKVCLDAGADDVG

SEQ ID NO: 1257542 - protein, 22 aa, Mycobacterium
ADWQPRVAVLDDWVNTQPKPAA

SEQ ID NO: 1257543 - protein, 24 aa, Mycobacterium
ADYEKRPDRAVGHIHVDGRYEPLY

SEQ ID NO: 1257544 - protein, 20 aa, Mycobacterium
ADYGLLLARTDWDVPKHEGL

SEQ ID NO: 1257545 - protein, 20 aa, Mycobacterium
ADYGLLLARTDWTVPKHEGL

SEQ ID NO: 1257546 - protein, 28 aa, Mycobacterium
ADYGSYAGLFIRMSWHAAGTYRIFDGRG

SEQ ID NO: 1257547 - protein, 17 aa, Mycobacterium
ADYPALVDALRRAASDG

SEQ ID NO: 1257548 - protein, 19 aa, Mycobacterium
ADYRFTGDVDGYGEGELYF

SEQ ID NO: 1257549 - protein, 19 aa, Mycobacterium
ADYSLGWIRVLDFDDQYTS

SEQ ID NO: 1257550 - protein, 18 aa, Mycobacterium
ADYSLGWIRVLDFDEQYT

SEQ ID NO: 1257551 - protein, 17 aa, Mycobacterium
ADYYLSRGVTWVQDAWV

SEQ ID NO: 1257552 - protein, 22 aa, Mycobacterium
AEAAAALWILHPTYFGTTADIA

SEQ ID NO: 1257553 - protein, 20 aa, Mycobacterium
AEAAEPLAEWEQELLAGATA

SEQ ID NO: 1257554 - protein, 31 aa, Mycobacterium
AEAARARYGFADFKLKGGVLPAADEAKAVIA

SEQ ID NO: 1257555 - protein, 22 aa, Mycobacterium
AEAAYGCWARHQAGALLLTDEL

SEQ ID NO: 1257556 - protein, 21 aa, Mycobacterium
AEADALCGAGYGERSSERTNS

SEQ ID NO: 1257557 - protein, 17 aa, Mycobacterium
AEADALCGAGYGERSTE

SEQ ID NO: 1257558 - protein, 21 aa, Mycobacterium
AEADALCGAGYGERSTERTNS

SEQ ID NO: 1257559 - protein, 27 aa, Mycobacterium
AEADALWPMLVLRTAVLIVSGAQQSVL

SEQ ID NO: 1257560 - protein, 22 aa, Mycobacterium
AEADLFYRDFVQRVAEGRHLSV

SEQ ID NO: 1257561 - protein, 20 aa, Mycobacterium
AEAFCAAGHTVVLFDYRHFG

SEQ ID NO: 1257562 - protein, 28 aa, Mycobacterium
AEAFDWPVSLFAERTWHIARPLPERAVI

SEQ ID NO: 1257563 - protein, 23 aa, Mycobacterium
AEAFPFDHLPPLLTDADIVVTCT

SEQ ID NO: 1257564 - protein, 19 aa, Mycobacterium
AEAGARLRAILDEHGPDAV

SEQ ID NO: 1257565 - protein, 18 aa, Mycobacterium
AEAGGSIGRPKRTADKEP

SEQ ID NO: 1257566 - protein, 19 aa, Mycobacterium
AEAGIPVTVVPGVTSAIAV

SEQ ID NO: 1257567 - protein, 23 aa, Mycobacterium
AEAGLHWRQIQLVAGADTIRNGY

SEQ ID NO: 1257568 - protein, 17 aa, Mycobacterium
AEAGLPKGVLSVLPTSN

SEQ ID NO: 1257569 - protein, 21 aa, Mycobacterium
AEAGNHIRVYVPFGTQWYGYF

SEQ ID NO: 1257570 - protein, 17 aa, Mycobacterium
AEAGRLGAITVATNMAG

SEQ ID NO: 1257571 - protein, 27 aa, Mycobacterium
AEAGRRLRRAKALGPRRGLTGTPLPPL

SEQ ID NO: 1257572 - protein, 23 aa, Mycobacterium
AEAIARTEHRGVIEFVDDGSHTL

SEQ ID NO: 1257573 - protein, 23 aa, Mycobacterium
AEAIDRPLVWTISALLGQHPVPV

SEQ ID NO: 1257574 - protein, 18 aa, Mycobacterium
AEAIRLARQLAAVVDDPE

SEQ ID NO: 1257575 - protein, 22 aa, Mycobacterium
AEAKGAVRQIVFLQRATTQRPD

SEQ ID NO: 1257576 - protein, 21 aa, Mycobacterium
AEAKIKLADMRSGRMSDDDWT

SEQ ID NO: 1257577 - protein, 19 aa, Mycobacterium
AEAKLRGTGLLVINATSGE

SEQ ID NO: 1257578 - protein, 22 aa, Mycobacterium
AEAKRELVRIGVDRLTGSATGD

SEQ ID NO: 1257579 - protein, 21 aa, Mycobacterium
AEAKSGYAHRLRSVVEAHRER

SEQ ID NO: 1257580 - protein, 18 aa, Mycobacterium
AEALALAANVLADRNMVI

SEQ ID NO: 1257581 - protein, 19 aa, Mycobacterium
AEALAPLAAAVQLSRIPVT

SEQ ID NO: 1257582 - protein, 22 aa, Mycobacterium
AEALLNAFFIPLVRLRDTVPGY

SEQ ID NO: 1257583 - protein, 23 aa, Mycobacterium
AEALPRERLVALYSQEQRSLADI

SEQ ID NO: 1257584 - protein, 25 aa, Mycobacterium
AEALRASGLSAGIIDAGVSRGLAGI

SEQ ID NO: 1257585 - protein, 23 aa, Mycobacterium
AEALRSGAVVLVFPGGDYDSYRP

SEQ ID NO: 1257586 - protein, 18 aa, Mycobacterium
AEALRWYWDQYVPNDFDR

SEQ ID NO: 1257587 - protein, 20 aa, Mycobacterium
AEALVARGAKVYAAARRPET

SEQ ID NO: 1257588 - protein, 17 aa, Mycobacterium
AEALYLTSGYVYESAAA

SEQ ID NO: 1257589 - protein, 24 aa, Mycobacterium
AEAMAAGALQRFGADTAVAITGIA

SEQ ID NO: 1257590 - protein, 22 aa, Mycobacterium
AEAMWPPRGIPRSVLVEQDALD

SEQ ID NO: 1257591 - protein, 18 aa, Mycobacterium
AEAPARGLEWARGELGMW

SEQ ID NO: 1257592 - protein, 22 aa, Mycobacterium
AEAPFGYPEVHYLTSPLRAAAV

SEQ ID NO: 1257593 - protein, 23 aa, Mycobacterium
AEAQPRPWLGLAEVHSADELLRR

SEQ ID NO: 1257594 - protein, 18 aa, Mycobacterium
AEAQRWPLIGTFTASLWV

SEQ ID NO: 1257595 - protein, 21 aa, Mycobacterium
AEAQVTRFARFAEERTGKTFA

SEQ ID NO: 1257596 - protein, 17 aa, Mycobacterium
AEARELIQLAADVADKV

SEQ ID NO: 1257597 - protein, 17 aa, Mycobacterium
AEARLAADCGVDILVAQ

SEQ ID NO: 1257598 - protein, 19 aa, Mycobacterium
AEARLLVGAANSFIDDAVR

SEQ ID NO: 1257599 - protein, 22 aa, Mycobacterium
AEARPFGPPGFLFLDPPDHTRL

SEQ ID NO: 1257600 - protein, 24 aa, Mycobacterium
AEARQLAPAMAWPVVADTYLELAA

SEQ ID NO: 1257601 - protein, 21 aa, Mycobacterium
AEARSAMVVTVDRGRWGCALD

SEQ ID NO: 1257602 - protein, 21 aa, Mycobacterium
AEASHRAGMHLSIDDPARVRI

SEQ ID NO: 1257603 - protein, 17 aa, Mycobacterium
AEATAFYQKMFGVPPHK

SEQ ID NO: 1257604 - protein, 17 aa, Mycobacterium
AEAVLAAMRGCPEGVGA

SEQ ID NO: 1257605 - protein, 20 aa, Mycobacterium
AEAVLRLSFDRLTKVSRRRI

SEQ ID NO: 1257606 - protein, 24 aa, Mycobacterium
AEAVNGMAGLMAWCQAPTRAVGRF

SEQ ID NO: 1257607 - protein, 20 aa, Mycobacterium
AEAYAAFRSAGRLLLDGPVL

SEQ ID NO: 1257608 - protein, 20 aa, Mycobacterium
AEAYNGPSIVIAYSHCIAHG

SEQ ID NO: 1257609 - protein, 23 aa, Mycobacterium
AECEAVRCVDFNIAPGVEADMGD

SEQ ID NO: 1257610 - protein, 17 aa, Mycobacterium
AECLVEWYSDDDTRAAI

SEQ ID NO: 1257611 - protein, 25 aa, Mycobacterium
AEDALRRWMAAAALVRSRADGGVVA

SEQ ID NO: 1257612 - protein, 17 aa, Mycobacterium
AEDEWIWARATVLAAAY

SEQ ID NO: 1257613 - protein, 23 aa, Mycobacterium
AEDGARVPISVVHRAGLEGPAPL

SEQ ID NO: 1257614 - protein, 17 aa, Mycobacterium
AEDLHWVDSASLAALGG

SEQ ID NO: 1257615 - protein, 18 aa, Mycobacterium
AEDLRALFNAGYKRGATV

SEQ ID NO: 1257616 - protein, 29 aa, Mycobacterium
AEDLVALAVLRLGAPVRYEFSRTDEFTVA

SEQ ID NO: 1257617 - protein, 23 aa, Mycobacterium
AEDPRFASLAAMAENSETAYGIV

SEQ ID NO: 1257618 - protein, 23 aa, Mycobacterium
AEDRARAAWLWSGRRATLTGHCA

SEQ ID NO: 1257619 - protein, 23 aa, Mycobacterium
AEDRFLVAVTFRIGRLGVPVVAE

SEQ ID NO: 1257620 - protein, 20 aa, Mycobacterium
AEDRLGPGAVRGVCGDPPKT

SEQ ID NO: 1257621 - protein, 21 aa, Mycobacterium
AEDRPRLVVLADVSLSVRATS

SEQ ID NO: 1257622 - protein, 24 aa, Mycobacterium
AEDVLQEVWLRWQKCDRRAVRDPA

SEQ ID NO: 1257623 - protein, 30 aa, Mycobacterium
AEEACARLRYPRPALVLSLHAAALVDPELS

SEQ ID NO: 1257624 - protein, 24 aa, Mycobacterium
AEEAFPAMQAMPIPYIEPRDVSNA

SEQ ID NO: 1257625 - protein, 19 aa, Mycobacterium
AEEALDWGMVARVVAHDDL

SEQ ID NO: 1257626 - protein, 22 aa, Mycobacterium
AEEATRVGMPYVNQRWLGGMLT

SEQ ID NO: 1257627 - protein, 17 aa, Mycobacterium
AEEAVEDVFPLPRELVG

SEQ ID NO: 1257628 - protein, 19 aa, Mycobacterium
AEEDYDMFVAKPLAAEPDP

SEQ ID NO: 1257629 - protein, 18 aa, Mycobacterium
AEEHAGLQFEDLSANRPT

SEQ ID NO: 1257630 - protein, 17 aa, Mycobacterium
AEELVLLATRYDEFSVH

SEQ ID NO: 1257631 - protein, 22 aa, Mycobacterium
AEELWRRLGHDASLAHGPFPVA

SEQ ID NO: 1257632 - protein, 21 aa, Mycobacterium
AEEMYKYLVAMSREPEHDKIR

SEQ ID NO: 1257633 - protein, 20 aa, Mycobacterium
AEERRLLIAAFGRARRRVLV

SEQ ID NO: 1257634 - protein, 17 aa, Mycobacterium
AEERSLWQGLAQLAVGI

SEQ ID NO: 1257635 - protein, 17 aa, Mycobacterium
AEESHTWVLSRHADVQA

SEQ ID NO: 1257636 - protein, 17 aa, Mycobacterium
AEESWPSYFTNRANRAA

SEQ ID NO: 1257637 - protein, 20 aa, Mycobacterium
AEEVRRVAKKGCHAVSFSEN

SEQ ID NO: 1257638 - protein, 17 aa, Mycobacterium
AEFDALWRHGASPALRE

SEQ ID NO: 1257639 - protein, 17 aa, Mycobacterium
AEFEDFLNGTLRSVGRG

SEQ ID NO: 1257640 - protein, 23 aa, Mycobacterium
AEFGDALAPYHQVIGSIKATAAG

SEQ ID NO: 1257641 - protein, 20 aa, Mycobacterium
AEFGDKGLRVNVLSPGPIDT

SEQ ID NO: 1257642 - protein, 25 aa, Mycobacterium
AEFPPEKFRSMMRLMVEAPFLLIRA

SEQ ID NO: 1257643 - protein, 18 aa, Mycobacterium
AEGAFFLPDGRRIGYAEY

SEQ ID NO: 1257644 - protein, 20 aa, Mycobacterium
AEGARLKDAFSYPETMPDWF

SEQ ID NO: 1257645 - protein, 17 aa, Mycobacterium
AEGDAVFRTEAAAPDGS

SEQ ID NO: 1257646 - protein, 19 aa, Mycobacterium
AEGEAFGRAAEPWEVASTI

SEQ ID NO: 1257647 - protein, 21 aa, Mycobacterium
AEGFAPLRIRRVVRETADAVS

SEQ ID NO: 1257648 - protein, 22 aa, Mycobacterium
AEGFDVIATRTRLMKRLSGQGA

SEQ ID NO: 1257649 - protein, 19 aa, Mycobacterium
AEGKLAVPVLEITQAADVG

SEQ ID NO: 1257650 - protein, 21 aa, Mycobacterium
AEGLADLALYAAIGDRASEAT

SEQ ID NO: 1257651 - protein, 21 aa, Mycobacterium
AEGLADLALYAAVGPGWGSWA

SEQ ID NO: 1257652 - protein, 24 aa, Mycobacterium
AEGLDVVEFPGWRQRGHGDFKDIR

SEQ ID NO: 1257653 - protein, 28 aa, Mycobacterium
AEGLEAAKPFIAVLCDAQAALAGAAGKE

SEQ ID NO: 1257654 - protein, 17 aa, Mycobacterium
AEGLLDVAYRTVDTPVG

SEQ ID NO: 1257655 - protein, 18 aa, Mycobacterium
AEGLRHGHRVDWSIEDRN

SEQ ID NO: 1257656 - protein, 19 aa, Mycobacterium
AEGLVFNDWHYRYLLQELL

SEQ ID NO: 1257657 - protein, 19 aa, Mycobacterium
AEGLVTVPLPGARMRYGLQ

SEQ ID NO: 1257658 - protein, 19 aa, Mycobacterium
AEGPDRVRISGVRGEPPPP

SEQ ID NO: 1257659 - protein, 25 aa, Mycobacterium
AEGWDQRAPLGWNMKDPTPVAKTVC

SEQ ID NO: 1257660 - protein, 17 aa, Mycobacterium
AEGYAAAAVLAMPDQSL

SEQ ID NO: 1257661 - protein, 18 aa, Mycobacterium
AEHAELWRALPSGSSISG

SEQ ID NO: 1257662 - protein, 19 aa, Mycobacterium
AEHALERFVSLRPRRLRVI

SEQ ID NO: 1257663 - protein, 19 aa, Mycobacterium
AEHARRYDHVAARFAEAGL

SEQ ID NO: 1257664 - protein, 18 aa, Mycobacterium
AEHLPDWRPAPGKGGLSL

SEQ ID NO: 1257665 - protein, 24 aa, Mycobacterium
AEHLRIRVGAAILEMRGLNIDEDG

SEQ ID NO: 1257666 - protein, 21 aa, Mycobacterium
AEHPDRLTVIHWLESVQGLPN

SEQ ID NO: 1257667 - protein, 23 aa, Mycobacterium
AEHPEWGFAGYVHHFIDKPTIAA

SEQ ID NO: 1257668 - protein, 19 aa, Mycobacterium
AEHPLPVILLNSTVITQGA

SEQ ID NO: 1257669 - protein, 17 aa, Mycobacterium
AEHRAALDWLNEHTDPD

SEQ ID NO: 1257670 - protein, 18 aa, Mycobacterium
AEHRARREAAIALLAEQG

SEQ ID NO: 1257671 - protein, 17 aa, Mycobacterium
AEHWRSKRIILADDGVG

SEQ ID NO: 1257672 - protein, 23 aa, Mycobacterium
AEIAADNIAGWPVGETFPVAPKM

SEQ ID NO: 1257673 - protein, 23 aa, Mycobacterium
AEIAEGWQPVFFHPEKADAVWGD

SEQ ID NO: 1257674 - protein, 27 aa, Mycobacterium
AEIAEGWQPVFFYPEKADDVWGDALRA

SEQ ID NO: 1257675 - protein, 24 aa, Mycobacterium
AEIARHAVQLAVQMLVEGPPHAMD

SEQ ID NO: 1257676 - protein, 25 aa, Mycobacterium
AEIDARLRLLVGRRGGMANQENLGK

SEQ ID NO: 1257677 - protein, 25 aa, Mycobacterium
AEIDRPGIDELPRRGDWPLGATSDD

SEQ ID NO: 1257678 - protein, 17 aa, Mycobacterium
AEIGPFFADRSGGYTRI

SEQ ID NO: 1257679 - protein, 18 aa, Mycobacterium
AEILERWTKELFDADGGQ

SEQ ID NO: 1257680 - protein, 17 aa, Mycobacterium
AEIRGTDAVVCGDWNIA

SEQ ID NO: 1257681 - protein, 19 aa, Mycobacterium
AEIRTHYPPELDAEVGVIT

SEQ ID NO: 1257682 - protein, 17 aa, Mycobacterium
AEIRYLVIPQRPEGTEG

SEQ ID NO: 1257683 - protein, 22 aa, Mycobacterium
AEISPEWHLRMQAAVQRHVDAA

SEQ ID NO: 1257684 - protein, 20 aa, Mycobacterium
AEIVGAALFLMSDASSFTTG

SEQ ID NO: 1257685 - protein, 19 aa, Mycobacterium
AEIVRPALLSALTLLRSIT

SEQ ID NO: 1257686 - protein, 17 aa, Mycobacterium
AEKIKLPSIYYAHQRKV

SEQ ID NO: 1257687 - protein, 29 aa, Mycobacterium
AEKLRKKRLMTLVHLWLVHRFKADAVYYV

SEQ ID NO: 1257688 - protein, 23 aa, Mycobacterium
AEKRYQTGWKRSLTAMRSQRYFR

SEQ ID NO: 1257689 - protein, 35 aa, Mycobacterium
AEKVLRCSAEAGLAGRIRHVMIPGMIEEDGDRPIE

SEQ ID NO: 1257690 - protein, 25 aa, Mycobacterium
AEKWAFRNVQGFLRLARAGIYTSRE

SEQ ID NO: 1257691 - protein, 17 aa, Mycobacterium
AELAAKYLPAGVLNVVT

SEQ ID NO: 1257692 - protein, 18 aa, Mycobacterium
AELAALPQQCMRSDRMSL

SEQ ID NO: 1257693 - protein, 17 aa, Mycobacterium
AELAMLLLTSFEGGIVV

SEQ ID NO: 1257694 - protein, 25 aa, Mycobacterium
AELAQSCRDYKAALDDLRSTLERIL

SEQ ID NO: 1257695 - protein, 23 aa, Mycobacterium
AELARACAELAADIGVEAGPAAV

SEQ ID NO: 1257696 - protein, 24 aa, Mycobacterium
AELCRMARRVFGWDELHPEQLEAM

SEQ ID NO: 1257697 - protein, 24 aa, Mycobacterium
AELCRTARRVFGWDELHPEQLEAM

SEQ ID NO: 1257698 - protein, 24 aa, Mycobacterium
AELDLRGAAFPWRTIHGEECSAYW

SEQ ID NO: 1257699 - protein, 18 aa, Mycobacterium
AELDRLGVDVLLDDRTAS

SEQ ID NO: 1257700 - protein, 17 aa, Mycobacterium
AELDRYVWDDGSQQPWF

SEQ ID NO: 1257701 - protein, 22 aa, Mycobacterium
AELEGVLARGAQRAREVSGVTL

SEQ ID NO: 1257702 - protein, 21 aa, Mycobacterium
AELFDGGLPWCDGAREMLEGL

SEQ ID NO: 1257703 - protein, 23 aa, Mycobacterium
AELGDFDLTLGLAQLLGPLLFGR

SEQ ID NO: 1257704 - protein, 26 aa, Mycobacterium
AELGLRPLVRLVSWGVAGVAPNVMGI

SEQ ID NO: 1257705 - protein, 17 aa, Mycobacterium
AELGRLAGRLDDATAER

SEQ ID NO: 1257706 - protein, 25 aa, Mycobacterium
AELGRSNGWSGLIINGAVRDASTLR

SEQ ID NO: 1257707 - protein, 20 aa, Mycobacterium
AELHSLRLLNLRRATRAIAG

SEQ ID NO: 1257708 - protein, 23 aa, Mycobacterium
AELIAAKWGLSRTALDEFSAGSH

SEQ ID NO: 1257709 - protein, 17 aa, Mycobacterium
AELIPTSAFPLALQDTE

SEQ ID NO: 1257710 - protein, 19 aa, Mycobacterium
AELIRRFDLDLDRPGKAYS

SEQ ID NO: 1257711 - protein, 18 aa, Mycobacterium
AELKEMVDRGYSRNDIVE

SEQ ID NO: 1257712 - protein, 20 aa, Mycobacterium
AELLATFLRFLAASTSGVKR

SEQ ID NO: 1257713 - protein, 19 aa, Mycobacterium
AELLAWAGVHPDYASLGES

SEQ ID NO: 1257714 - protein, 17 aa, Mycobacterium
AELLEFAMRLGGDTDLR

SEQ ID NO: 1257715 - protein, 21 aa, Mycobacterium
AELLIMPSLYEGAGLPPLEAM

SEQ ID NO: 1257716 - protein, 17 aa, Mycobacterium
AELLKAKGIGFIDAGVS

SEQ ID NO: 1257717 - protein, 20 aa, Mycobacterium
AELLMPVIAPPPVVRVGNTL

SEQ ID NO: 1257718 - protein, 21 aa, Mycobacterium
AELLRACGRIDGLERVRFTSP

SEQ ID NO: 1257719 - protein, 17 aa, Mycobacterium
AELLRCPVSEIMTSVLV

SEQ ID NO: 1257720 - protein, 18 aa, Mycobacterium
AELLRQQLILAIDGELDV

SEQ ID NO: 1257721 - protein, 17 aa, Mycobacterium
AELLRWCEDAATQFDEA

SEQ ID NO: 1257722 - protein, 21 aa, Mycobacterium
AELMINLFWLGLKGAPSAADV

SEQ ID NO: 1257723 - protein, 20 aa, Mycobacterium
AELPERVGVAAIPMSAFCDP

SEQ ID NO: 1257724 - protein, 17 aa, Mycobacterium
AELPEWLVLARGVEGDI

SEQ ID NO: 1257725 - protein, 26 aa, Mycobacterium
AELPRTETFKVLKRHLSAEGTDCADP

SEQ ID NO: 1257726 - protein, 18 aa, Mycobacterium
AELQIVFHTLLRRIPTMK

SEQ ID NO: 1257727 - protein, 21 aa, Mycobacterium
AELRAAGARLRAVAQELPSRM

SEQ ID NO: 1257728 - protein, 20 aa, Mycobacterium
AELRARGVLVLADAKRGDIG

SEQ ID NO: 1257729 - protein, 32 aa, Mycobacterium
AELRETRGSIIFTVSNAGFWPGGGGPLYTASK

SEQ ID NO: 1257730 - protein, 17 aa, Mycobacterium
AELRPSSRRELAATMVL

SEQ ID NO: 1257731 - protein, 18 aa, Mycobacterium
AELRRRIEAGEWVVDLRN

SEQ ID NO: 1257732 - protein, 20 aa, Mycobacterium
AELSRALGLFEPTDEQAAVI

SEQ ID NO: 1257733 - protein, 26 aa, Mycobacterium
AELVARVKALLRRRGSTATFSSETIT

SEQ ID NO: 1257734 - protein, 19 aa, Mycobacterium
AELVPRYMDNDAIAVVEGD

SEQ ID NO: 1257735 - protein, 18 aa, Mycobacterium
AELVRHFGERAAHPQLYV

SEQ ID NO: 1257736 - protein, 19 aa, Mycobacterium
AELVWPWLVQMGQDRGGLY

SEQ ID NO: 1257737 - protein, 17 aa, Mycobacterium
AELVWQLRGHAQARQVE

SEQ ID NO: 1257738 - protein, 33 aa, Mycobacterium
AELYDGFTFNCLSWLEALGFCGIGEAKDFLDGG

SEQ ID NO: 1257739 - protein, 21 aa, Mycobacterium
AEMARRIDVARVYTHHVVERE

SEQ ID NO: 1257740 - protein, 24 aa, Mycobacterium
AEMDRCDAWHGGSVAAGADALVAA

SEQ ID NO: 1257741 - protein, 26 aa, Mycobacterium
AEMDRVFAGKVWGAVYLCEEVADMGL

SEQ ID NO: 1257742 - protein, 29 aa, Mycobacterium
AEMFAHGVARAGYLEVPRDPDLAYEFLPV

SEQ ID NO: 1257743 - protein, 19 aa, Mycobacterium
AEMGRVAVELGHSAQEVLI

SEQ ID NO: 1257744 - protein, 19 aa, Mycobacterium
AEMLGGWGVIASMQPNFDA

SEQ ID NO: 1257745 - protein, 17 aa, Mycobacterium
AEMLRRNGIPCEEVRKH

SEQ ID NO: 1257746 - protein, 19 aa, Mycobacterium
AENGESYFTLVHGIAHESS

SEQ ID NO: 1257747 - protein, 23 aa, Mycobacterium
AENLPALRALLVYAHEQGFSKRP

SEQ ID NO: 1257748 - protein, 18 aa, Mycobacterium
AENLRRDYGISRQEQDEL

SEQ ID NO: 1257749 - protein, 28 aa, Mycobacterium
AENSMPWRLVARLLLVRAYAALGDTKNA

SEQ ID NO: 1257750 - protein, 19 aa, Mycobacterium
AENYCLPAIQSNALYMDRY

SEQ ID NO: 1257751 - protein, 24 aa, Mycobacterium
AENYGFDFWQLFGATEQCMVDAEI

SEQ ID NO: 1257752 - protein, 25 aa, Mycobacterium
AEPAGWRLAAAATTWSDVTALMTAA

SEQ ID NO: 1257753 - protein, 21 aa, Mycobacterium
AEPDLKCGRGGLRDVQLLNAL

SEQ ID NO: 1257754 - protein, 24 aa, Mycobacterium
AEPDLPLRYTFDVISVISGGADGP

SEQ ID NO: 1257755 - protein, 27 aa, Mycobacterium
AEPDSVLHFFRRALRLRRDRCGVDGAT

SEQ ID NO: 1257756 - protein, 25 aa, Mycobacterium
AEPEKGYRPSAGLKDFLQWRDLTCR

SEQ ID NO: 1257757 - protein, 18 aa, Mycobacterium
AEPFGATTMGLIYVNPEG

SEQ ID NO: 1257758 - protein, 28 aa, Mycobacterium
AEPGRSSPWLSWSELVPCDEYVRPEVDA

SEQ ID NO: 1257759 - protein, 20 aa, Mycobacterium
AEPGWTVFMVSHFHYDPVWW

SEQ ID NO: 1257760 - protein, 24 aa, Mycobacterium
AEPIAVVGIGCRLPGGVTGPDSYW

SEQ ID NO: 1257761 - protein, 23 aa, Mycobacterium
AEPLHWLPAEDEWIWARATVLAA

SEQ ID NO: 1257762 - protein, 23 aa, Mycobacterium
AEPLRRAATFTVWQAIIEAADEL

SEQ ID NO: 1257763 - protein, 20 aa, Mycobacterium
AEPSGAVALAAYRQGVTPPG

SEQ ID NO: 1257764 - protein, 25 aa, Mycobacterium
AEPTAQRILAHFGLDGHFEVIAGAG

SEQ ID NO: 1257765 - protein, 18 aa, Mycobacterium
AEPTFTLRMCTEATGLIR

SEQ ID NO: 1257766 - protein, 26 aa, Mycobacterium
AEPVLREMYAPLLAAGVPFLIADLQT

SEQ ID NO: 1257767 - protein, 20 aa, Mycobacterium
AEPVWSHSLLSGFLEIQFDR

SEQ ID NO: 1257768 - protein, 19 aa, Mycobacterium
AEQALRERFGYDAWVLAYD

SEQ ID NO: 1257769 - protein, 24 aa, Mycobacterium
AEQKLANVINEFKKGFSASDGSSV

SEQ ID NO: 1257770 - protein, 19 aa, Mycobacterium
AEQKLPLNATWVNLTTGKS

SEQ ID NO: 1257771 - protein, 21 aa, Mycobacterium
AEQKNRFYAQSFKQIQSAVEL

SEQ ID NO: 1257772 - protein, 19 aa, Mycobacterium
AEQLDWHWTRQLRPRLDGL

SEQ ID NO: 1257773 - protein, 24 aa, Mycobacterium
AEQLHMGRDWVVRLEKGHPRLEAQ

SEQ ID NO: 1257774 - protein, 30 aa, Mycobacterium
AEQLLARRREFGIGYWTVFDELPGRESALP

SEQ ID NO: 1257775 - protein, 21 aa, Mycobacterium
AEQLPRLSAYADKLSTAMERV

SEQ ID NO: 1257776 - protein, 23 aa, Mycobacterium
AEQPELWRVASLLRAGVPVALST

SEQ ID NO: 1257777 - protein, 21 aa, Mycobacterium
AEQRVALDLLLDESVGIVSLG

SEQ ID NO: 1257778 - protein, 19 aa, Mycobacterium
AEQRWRALVEQSPAAVIVI

SEQ ID NO: 1257779 - protein, 20 aa, Mycobacterium
AEQSRPIWYLVPDGVVQYVA

SEQ ID NO: 1257780 - protein, 17 aa, Mycobacterium
AEQTCVIDDEIYDAMIA

SEQ ID NO: 1257781 - protein, 17 aa, Mycobacterium
AERAYAAAFSRSAEHLK

SEQ ID NO: 1257782 - protein, 28 aa, Mycobacterium
AERCRRLEALPGWSWNLAEARWEENFAA

SEQ ID NO: 1257783 - protein, 23 aa, Mycobacterium
AERFADAVTAIWHGNAEIDRFNE

SEQ ID NO: 1257784 - protein, 19 aa, Mycobacterium
AERFARLALDRNGDLRAAG

SEQ ID NO: 1257785 - protein, 17 aa, Mycobacterium
AERFCFEGFAPRRQAAR

SEQ ID NO: 1257786 - protein, 25 aa, Mycobacterium
AERGEPQWRNAFGYLPDGSRVPDPT

SEQ ID NO: 1257787 - protein, 19 aa, Mycobacterium
AERGLLHGRRGEYVCRVDV

SEQ ID NO: 1257788 - protein, 17 aa, Mycobacterium
AERGMLLILDEAQTGIA

SEQ ID NO: 1257789 - protein, 23 aa, Mycobacterium
AERGYFLDVSWRMHPAVCAAVSR

SEQ ID NO: 1257790 - protein, 18 aa, Mycobacterium
AERHFGRAAARCHVSQPT

SEQ ID NO: 1257791 - protein, 21 aa, Mycobacterium
AERHQLPWPKPPVLCTVTLAR

SEQ ID NO: 1257792 - protein, 24 aa, Mycobacterium
AERIGAACRAVWNTGLEQRREYRR

SEQ ID NO: 1257793 - protein, 21 aa, Mycobacterium
AERIGVPLVVRYAMTECPTIC

SEQ ID NO: 1257794 - protein, 25 aa, Mycobacterium
AERISAREAYDWGLVSSVHPAEEFD

SEQ ID NO: 1257795 - protein, 17 aa, Mycobacterium
AERLGCGTMSLYRHVAN

SEQ ID NO: 1257796 - protein, 19 aa, Mycobacterium
AERLPKVLIHHNVPGQPIH

SEQ ID NO: 1257797 - protein, 18 aa, Mycobacterium
AERLRLAAQFGAAADTGG

SEQ ID NO: 1257798 - protein, 18 aa, Mycobacterium
AERLVCRAMNWRAEREGP

SEQ ID NO: 1257799 - protein, 17 aa, Mycobacterium
AERMHDAAMAKLMFSEL

SEQ ID NO: 1257800 - protein, 18 aa, Mycobacterium
AERNLLCLAWPEEFGGGG

SEQ ID NO: 1257801 - protein, 19 aa, Mycobacterium
AERPTMAALLVKDSVNAAS

SEQ ID NO: 1257802 - protein, 25 aa, Mycobacterium
AERVRGALMGGYFAGLVDRRILGGV

SEQ ID NO: 1257803 - protein, 24 aa, Mycobacterium
AERVRNGWYWSGDLGYLDGAGFLY

SEQ ID NO: 1257804 - protein, 20 aa, Mycobacterium
AERYPLFFERAYDILPADGR

SEQ ID NO: 1257805 - protein, 19 aa, Mycobacterium
AESAAIWARLADFGSLSAW

SEQ ID NO: 1257806 - protein, 24 aa, Mycobacterium
AESAEARFGTGRLVIGGVSAGATL

SEQ ID NO: 1257807 - protein, 18 aa, Mycobacterium
AESAILWGNESVGARMSV

SEQ ID NO: 1257808 - protein, 20 aa, Mycobacterium
AESALRVAVEALYDAADDDS

SEQ ID NO: 1257809 - protein, 19 aa, Mycobacterium
AESARHWRADTDDLPAPAA

SEQ ID NO: 1257810 - protein, 23 aa, Mycobacterium
AESARLLGPLAAYLVVNVSSPNT

SEQ ID NO: 1257811 - protein, 17 aa, Mycobacterium
AESASPVFSSWPISATG

SEQ ID NO: 1257812 - protein, 29 aa, Mycobacterium
AESGAHVGMALWRDGRLVFSRNPSGAHAL

SEQ ID NO: 1257813 - protein, 22 aa, Mycobacterium
AESKRPFGLWRATLPAAEKSNL

SEQ ID NO: 1257814 - protein, 20 aa, Mycobacterium
AESLLTLGWAEEFASVPIAV

SEQ ID NO: 1257815 - protein, 26 aa, Mycobacterium
AESPKETWLRLVIIRAGFPRPETQVP

SEQ ID NO: 1257816 - protein, 24 aa, Mycobacterium
AESRGLGVSLCFAAQAGEQLDAIY

SEQ ID NO: 1257817 - protein, 17 aa, Mycobacterium
AESVAAMGLRYSTVTGV

SEQ ID NO: 1257818 - protein, 26 aa, Mycobacterium
AESVKLHPADVPFFVTLCKKPGKPVN

SEQ ID NO: 1257819 - protein, 23 aa, Mycobacterium
AESWDIDMPNQFAAAERIAKRRG

SEQ ID NO: 1257820 - protein, 22 aa, Mycobacterium
AESWPHWATVITKVTWTSPEPR

SEQ ID NO: 1257821 - protein, 28 aa, Mycobacterium
AETAAALRAGAAWLRTMFAILPLAVGVK

SEQ ID NO: 1257822 - protein, 18 aa, Mycobacterium
AETAAQWSGPGVTADGHA

SEQ ID NO: 1257823 - protein, 24 aa, Mycobacterium
AETAEAFRGGWFHSGDLVRQDADG

SEQ ID NO: 1257824 - protein, 19 aa, Mycobacterium
AETALRIGLVTEVVDENDL

SEQ ID NO: 1257825 - protein, 20 aa, Mycobacterium
AETARVAAVFAQLITPDGET

SEQ ID NO: 1257826 - protein, 17 aa, Mycobacterium
AETGGPEVLSFVERPQP

SEQ ID NO: 1257827 - protein, 25 aa, Mycobacterium
AETGRAAFPYQVHVGRWDELDGLVD

SEQ ID NO: 1257828 - protein, 24 aa, Mycobacterium
AETIRGRAPFFAGVTTLNTRDTIA

SEQ ID NO: 1257829 - protein, 25 aa, Mycobacterium
AETLGNFSFAYLVTVGDDYRAHTVA

SEQ ID NO: 1257830 - protein, 24 aa, Mycobacterium
AETLNLALLRGYRTGGTIHIIVNN

SEQ ID NO: 1257831 - protein, 18 aa, Mycobacterium
AETMFRHDPSVMVYAPLR

SEQ ID NO: 1257832 - protein, 21 aa, Mycobacterium
AETMKRMFLELGGKSAAIVLD

SEQ ID NO: 1257833 - protein, 20 aa, Mycobacterium
AETPRGGFIANMELQPEAPL

SEQ ID NO: 1257834 - protein, 20 aa, Mycobacterium
AETPRGGFIASMELQPEAPL

SEQ ID NO: 1257835 - protein, 32 aa, Mycobacterium
AETQWLRYTFQRFPFVRLGDGRLLLVKSQFGI

SEQ ID NO: 1257836 - protein, 20 aa, Mycobacterium
AETSAICDRMLDLGVIIQPT

SEQ ID NO: 1257837 - protein, 20 aa, Mycobacterium
AEVASPEWLGSEGAPGNIAV

SEQ ID NO: 1257838 - protein, 17 aa, Mycobacterium
AEVDWARRVLDTARTQR

SEQ ID NO: 1257839 - protein, 25 aa, Mycobacterium
AEVELSWEILDPVLDNWSAQGRPEP

SEQ ID NO: 1257840 - protein, 18 aa, Mycobacterium
AEVFAAWHRSGADHLPIV

SEQ ID NO: 1257841 - protein, 17 aa, Mycobacterium
AEVFALLGPNGAGKTTT

SEQ ID NO: 1257842 - protein, 24 aa, Mycobacterium
AEVGDRAAALGIHRVALFSDPTVA

SEQ ID NO: 1257843 - protein, 20 aa, Mycobacterium
AEVGRATFFRYFSAKEDAVA

SEQ ID NO: 1257844 - protein, 23 aa, Mycobacterium
AEVGSAKVGMVFGDLADGEVGVR

SEQ ID NO: 1257845 - protein, 25 aa, Mycobacterium
AEVKKAVAEYGLWYPPDPSSFEICS

SEQ ID NO: 1257846 - protein, 22 aa, Mycobacterium
AEVLAMPVAEAAAFFSEGEAKV

SEQ ID NO: 1257847 - protein, 25 aa, Mycobacterium
AEVLDRALALFLERGYENVSLNDLL

SEQ ID NO: 1257848 - protein, 24 aa, Mycobacterium
AEVMPEDLIKFGLIPEFIGRLPVV

SEQ ID NO: 1257849 - protein, 22 aa, Mycobacterium
AEVNGLPWLARLAHGLQQLVLA

SEQ ID NO: 1257850 - protein, 18 aa, Mycobacterium
AEVPDEWCCPDCAVREKV

SEQ ID NO: 1257851 - protein, 23 aa, Mycobacterium
AEVPMQMICILLGVPESERHWLF

SEQ ID NO: 1257852 - protein, 22 aa, Mycobacterium
AEVRARTGVMLQGGGAYPAARA

SEQ ID NO: 1257853 - protein, 23 aa, Mycobacterium
AEVRAWLEQNWKGLPKSTDPWVA

SEQ ID NO: 1257854 - protein, 22 aa, Mycobacterium
AEVVKSLGLIRGRYDDLMLKTA

SEQ ID NO: 1257855 - protein, 17 aa, Mycobacterium
AEVWAIDGDGCFQMTNQ

SEQ ID NO: 1257856 - protein, 24 aa, Mycobacterium
AEWKTKSPGAVAVWDRAWAEFVPF

SEQ ID NO: 1257857 - protein, 23 aa, Mycobacterium
AEWWDRAVEVWPDYADYQKKTDR

SEQ ID NO: 1257858 - protein, 24 aa, Mycobacterium
AEWWDRAVEVWPDYADYQKKTDRE

SEQ ID NO: 1257859 - protein, 26 aa, Mycobacterium
AEYLPDLRYAPAVYDYYAYFRDASGQ

SEQ ID NO: 1257860 - protein, 22 aa, Mycobacterium
AFAAGEWMHWQLLKPAESRQRR

SEQ ID NO: 1257861 - protein, 20 aa, Mycobacterium
AFAALCAQTPAVHRFPGSMA

SEQ ID NO: 1257862 - protein, 23 aa, Mycobacterium
AFADAWRAGYVPSMDRVRRGELP

SEQ ID NO: 1257863 - protein, 24 aa, Mycobacterium
AFAESPVPFCWNEDNPAFSSMANA

SEQ ID NO: 1257864 - protein, 22 aa, Mycobacterium
AFAEVKAAEPAGWRLAAAATTW

SEQ ID NO: 1257865 - protein, 26 aa, Mycobacterium
AFAGAGFRTGFVVARNPESGHALADR

SEQ ID NO: 1257866 - protein, 25 aa, Mycobacterium
AFAGVLPYGPARRWQKKKDPDQDTE

SEQ ID NO: 1257867 - protein, 23 aa, Mycobacterium
AFAQRDFPAMFAAVSEEMIDTMG

SEQ ID NO: 1257868 - protein, 22 aa, Mycobacterium
AFARVDGRPVGIIANQPMYMSG

SEQ ID NO: 1257869 - protein, 26 aa, Mycobacterium
AFATARAGVVLVPINFMLTAEEISFI

SEQ ID NO: 1257870 - protein, 24 aa, Mycobacterium
AFATMGCLYPGRIFLGVGTGEALN

SEQ ID NO: 1257871 - protein, 23 aa, Mycobacterium
AFATSFRLSGRLFRIRPQEAKLL

SEQ ID NO: 1257872 - protein, 18 aa, Mycobacterium
AFAVARDVPEEWLQVSVD

SEQ ID NO: 1257873 - protein, 24 aa, Mycobacterium
AFCAELRSRVLAVTGLVASVGAGS

SEQ ID NO: 1257874 - protein, 19 aa, Mycobacterium
AFCSEWVTMVGDYDAATRE

SEQ ID NO: 1257875 - protein, 21 aa, Mycobacterium
AFCTELGGPVVIKTVRGGYDG

SEQ ID NO: 1257876 - protein, 24 aa, Mycobacterium
AFDEGDFRWAATLLDHAMFTDENH

SEQ ID NO: 1257877 - protein, 24 aa, Mycobacterium
AFDELRRACGLARATAVESAMPPA

SEQ ID NO: 1257878 - protein, 23 aa, Mycobacterium
AFDGKGRAAVSIGNPDRASNTAV

SEQ ID NO: 1257879 - protein, 19 aa, Mycobacterium
AFDGLRLANRPVRRPDLTI

SEQ ID NO: 1257880 - protein, 19 aa, Mycobacterium
AFDKTLSELGFEYVDLFLI

SEQ ID NO: 1257881 - protein, 24 aa, Mycobacterium
AFDPCLSCATHALGQMPLIVTVHG

SEQ ID NO: 1257882 - protein, 26 aa, Mycobacterium
AFDRGGGLPSAIALADAISWQGRGQE

SEQ ID NO: 1257883 - protein, 24 aa, Mycobacterium
AFEEVLARWTDWDVDYANATRART

SEQ ID NO: 1257884 - protein, 22 aa, Mycobacterium
AFEKGRSWPRERTRARLEEILQ

SEQ ID NO: 1257885 - protein, 25 aa, Mycobacterium
AFELRPRTAEGLAEPQIRRVLAEGS

SEQ ID NO: 1257886 - protein, 25 aa, Mycobacterium
AFESPGADVLFAFTGTAANIIALAS

SEQ ID NO: 1257887 - protein, 18 aa, Mycobacterium
AFESSFHYRSAVLFGTFD

SEQ ID NO: 1257888 - protein, 18 aa, Mycobacterium
AFFDVTVVAPGHWEVVSN

SEQ ID NO: 1257889 - protein, 24 aa, Mycobacterium
AFFGHSMGAVLAFEVARRCETLSG

SEQ ID NO: 1257890 - protein, 25 aa, Mycobacterium
AFGEHAVQLACEFAGPAAVAVYHAR

SEQ ID NO: 1257891 - protein, 20 aa, Mycobacterium
AFGKLPFVLGGIELEAVGVE

SEQ ID NO: 1257892 - protein, 18 aa, Mycobacterium
AFGPRFMPNNNGIGAPGY

SEQ ID NO: 1257893 - protein, 26 aa, Mycobacterium
AFGSRGGLLGQVWLRAARRFLSEQRS

SEQ ID NO: 1257894 - protein, 32 aa, Mycobacterium
AFHESLNMAVLWRLPVLFCCENNLYAMGTALR

SEQ ID NO: 1257895 - protein, 24 aa, Mycobacterium
AFIDAGVSGGIWGLTEGYGLMVGG

SEQ ID NO: 1257896 - protein, 18 aa, Mycobacterium
AFIICASLVRQFEFAQNV

SEQ ID NO: 1257897 - protein, 18 aa, Mycobacterium
AFITGVARGQGRSHAVRL

SEQ ID NO: 1257898 - protein, 23 aa, Mycobacterium
AFKDEAPEAMGLRTAVGQLMGAV

SEQ ID NO: 1257899 - protein, 34 aa, Mycobacterium
AFKPLSRYFDRVWRPEQLPAALLGAMRVLTDPVE

SEQ ID NO: 1257900 - protein, 19 aa, Mycobacterium
AFKRIAIVTDMDWVTHTLH

SEQ ID NO: 1257901 - protein, 19 aa, Mycobacterium
AFLASRLGGQWGGAFGTLP

SEQ ID NO: 1257902 - protein, 21 aa, Mycobacterium
AFLKSAAAWLPTRDRLNKIVD

SEQ ID NO: 1257903 - protein, 17 aa, Mycobacterium
AFMTGLIDALWSMDLLG

SEQ ID NO: 1257904 - protein, 28 aa, Mycobacterium
AFNRAGGRIKLAWFLLHAARYLPPQLFA

SEQ ID NO: 1257905 - protein, 27 aa, Mycobacterium
AFQGVSMPLWLSRLVSVLIPTHDDRTD

SEQ ID NO: 1257906 - protein, 19 aa, Mycobacterium
AFRAFSYGSLYPALRRMQA

SEQ ID NO: 1257907 - protein, 17 aa, Mycobacterium
AFREAWGHDAVDTGVGG

SEQ ID NO: 1257908 - protein, 17 aa, Mycobacterium
AFRFPVWAFDRVLMPGI

SEQ ID NO: 1257909 - protein, 26 aa, Mycobacterium
AFRGDAPSGPGFWFPPTVLTPQRDDR

SEQ ID NO: 1257910 - protein, 19 aa, Mycobacterium
AFRGQCLVHRSQIMQLQGE

SEQ ID NO: 1257911 - protein, 21 aa, Mycobacterium
AFRKAFRAFIDHEAVPHVEAW

SEQ ID NO: 1257912 - protein, 18 aa, Mycobacterium
AFRNDYRALQAYHRGTDI

SEQ ID NO: 1257913 - protein, 20 aa, Mycobacterium
AFRVLRPGGRYAIHELGLTP

SEQ ID NO: 1257914 - protein, 22 aa, Mycobacterium
AFSAGGDMVMFGRLIEDEVART

SEQ ID NO: 1257915 - protein, 23 aa, Mycobacterium
AFSPSRMFSPLAMKATRQPDAAE

SEQ ID NO: 1257916 - protein, 19 aa, Mycobacterium
AFSRHATWWSRLGAPVTSL

SEQ ID NO: 1257917 - protein, 21 aa, Mycobacterium
AFSRPGLPVEYLMVPSTAMGR

SEQ ID NO: 1257918 - protein, 19 aa, Mycobacterium
AFSTWRTTPAPVRGALVAR

SEQ ID NO: 1257919 - protein, 19 aa, Mycobacterium
AFTRSRLTGYVSHIDSVAS

SEQ ID NO: 1257920 - protein, 25 aa, Mycobacterium
AFTTLRGGAYFFLPGLTALRYLTTL

SEQ ID NO: 1257921 - protein, 33 aa, Mycobacterium
AFVAARRFAIPAVEARGALLLEDVGVPLPALAE

SEQ ID NO: 1257922 - protein, 17 aa, Mycobacterium
AFVCGPGPFMAASEEAL

SEQ ID NO: 1257923 - protein, 20 aa, Mycobacterium
AFVFADVWQRPGLSRRDRHF

SEQ ID NO: 1257924 - protein, 20 aa, Mycobacterium
AFVPAYRTMDAMKVMDGTAQ

SEQ ID NO: 1257925 - protein, 19 aa, Mycobacterium
AFYSGLLFWTYEPGRIDDG

SEQ ID NO: 1257926 - protein, 26 aa, Mycobacterium
AGAAFSRGLWWSALRATDRADAGHQR

SEQ ID NO: 1257927 - protein, 21 aa, Mycobacterium
AGAAPLRLAMDLMQEQARNND

SEQ ID NO: 1257928 - protein, 21 aa, Mycobacterium
AGADAVWPGILGFEDTVIPQL

SEQ ID NO: 1257929 - protein, 17 aa, Mycobacterium
AGADFVFSGFGSIPRYD

SEQ ID NO: 1257930 - protein, 25 aa, Mycobacterium
AGADRVARLIMGFVRQAGADGRVEP

SEQ ID NO: 1257931 - protein, 23 aa, Mycobacterium
AGADSLKGLCPFHDEKSPSFHVR

SEQ ID NO: 1257932 - protein, 17 aa, Mycobacterium
AGAELLLGVRRQPAKST

SEQ ID NO: 1257933 - protein, 19 aa, Mycobacterium
AGAENFFLFGLTESQVEKV

SEQ ID NO: 1257934 - protein, 17 aa, Mycobacterium
AGAFVGSLGGSWAFGYV

SEQ ID NO: 1257935 - protein, 17 aa, Mycobacterium
AGAGALVSMAFPDALIG

SEQ ID NO: 1257936 - protein, 24 aa, Mycobacterium
AGAGVCRDFAHLVVAMLRAVNVPA

SEQ ID NO: 1257937 - protein, 18 aa, Mycobacterium
AGAILRKSVEDLGIGVHT

SEQ ID NO: 1257938 - protein, 26 aa, Mycobacterium
AGALDTRAWRLPWLNDTVIYEVEQPA

SEQ ID NO: 1257939 - protein, 19 aa, Mycobacterium
AGANSLWFMDHFFQIEPTG

SEQ ID NO: 1257940 - protein, 25 aa, Mycobacterium
AGAPPHPCPLSFIVAPTLIAHGTPQ

SEQ ID NO: 1257941 - protein, 20 aa, Mycobacterium
AGAPTWKLSAQAWRDTLDVN

SEQ ID NO: 1257942 - protein, 17 aa, Mycobacterium
AGARAPVLIAIDDVQWL

SEQ ID NO: 1257943 - protein, 17 aa, Mycobacterium
AGARAWLTELLGVVHSA

SEQ ID NO: 1257944 - protein, 31 aa, Mycobacterium
AGARLTGEVLRCPRCDAGFDVVHAGAGLEGL

SEQ ID NO: 1257945 - protein, 19 aa, Mycobacterium
AGARYAAPFVVAATGILSV

SEQ ID NO: 1257946 - protein, 25 aa, Mycobacterium
AGASFLRRDGSVWTTDKDGIILALL

SEQ ID NO: 1257947 - protein, 18 aa, Mycobacterium
AGASIIEAAGAYQAVDAS

SEQ ID NO: 1257948 - protein, 19 aa, Mycobacterium
AGASIQLLGKEGSYASLRM

SEQ ID NO: 1257949 - protein, 18 aa, Mycobacterium
AGASLAVLNHVPYPDTIA

SEQ ID NO: 1257950 - protein, 20 aa, Mycobacterium
AGASLVLFPEATICRFGVPP

SEQ ID NO: 1257951 - protein, 24 aa, Mycobacterium
AGATARRGPLCLGIDPHPELLRAW

SEQ ID NO: 1257952 - protein, 26 aa, Mycobacterium
AGATCYLRVNVPGALFSLGDGHYRQG

SEQ ID NO: 1257953 - protein, 18 aa, Mycobacterium
AGATVHWARDAEEANRIV

SEQ ID NO: 1257954 - protein, 20 aa, Mycobacterium
AGAVAVRLGPTVLRTSTAAA

SEQ ID NO: 1257955 - protein, 19 aa, Mycobacterium
AGAVEAFGRLDIVVNNVGG

SEQ ID NO: 1257956 - protein, 20 aa, Mycobacterium
AGAVLAEWGADVIKVEHAVT

SEQ ID NO: 1257957 - protein, 17 aa, Mycobacterium
AGCAVLLKPSERTPLTA

SEQ ID NO: 1257958 - protein, 25 aa, Mycobacterium
AGCDLRAGLLAFVRRVATEAFPSSD

SEQ ID NO: 1257959 - protein, 20 aa, Mycobacterium
AGCDNCYALAMAKRLKAMGS

SEQ ID NO: 1257960 - protein, 18 aa, Mycobacterium
AGCLPERFDEVVRVTTDV

SEQ ID NO: 1257961 - protein, 30 aa, Mycobacterium
AGCPEATLGLLGRYGAAVGEAFQLRDDLLG

SEQ ID NO: 1257962 - protein, 25 aa, Mycobacterium
AGCRGEVPLGTLIELLASFHGVDAD

SEQ ID NO: 1257963 - protein, 18 aa, Mycobacterium
AGCSVVIKPAEITPLTTL

SEQ ID NO: 1257964 - protein, 26 aa, Mycobacterium
AGDAPMILGALPFDLTAPTALFRPQH

SEQ ID NO: 1257965 - protein, 25 aa, Mycobacterium
AGDDEWPRYTLHLGADIAAIIQTGD

SEQ ID NO: 1257966 - protein, 24 aa, Mycobacterium
AGDERWPVCRIGMTASTGTREFNA

SEQ ID NO: 1257967 - protein, 24 aa, Mycobacterium
AGDFVKIDFGALVAGYHSDMTRTF

SEQ ID NO: 1257968 - protein, 21 aa, Mycobacterium
AGDGGLWLAILSPAALARVDA

SEQ ID NO: 1257969 - protein, 24 aa, Mycobacterium
AGDGGRGGLLFGNGGNGGIASAEF

SEQ ID NO: 1257970 - protein, 25 aa, Mycobacterium
AGDGIRIDLPVALMERAATTGWTAA

SEQ ID NO: 1257971 - protein, 17 aa, Mycobacterium
AGDIPWAVFSPYTPFLN

SEQ ID NO: 1257972 - protein, 25 aa, Mycobacterium
AGDKARNARAWHHAVAAAELHTAEL

SEQ ID NO: 1257973 - protein, 26 aa, Mycobacterium
AGDMARAKMQGWPGIMEGINNTIGEL

SEQ ID NO: 1257974 - protein, 24 aa, Mycobacterium
AGDPDAMRPFLLVASFVNPHDIVL

SEQ ID NO: 1257975 - protein, 18 aa, Mycobacterium
AGDPFFLDALRMVEKANS

SEQ ID NO: 1257976 - protein, 21 aa, Mycobacterium
AGDPRRAQVTLRMLLTHTSGL

SEQ ID NO: 1257977 - protein, 25 aa, Mycobacterium
AGDREPYRVISVLGDRFVVSETFSV

SEQ ID NO: 1257978 - protein, 21 aa, Mycobacterium
AGDRIPAYRLSAGSKLPGRPT

SEQ ID NO: 1257979 - protein, 24 aa, Mycobacterium
AGDRVEYGRALALLGATDVALIDD

SEQ ID NO: 1257980 - protein, 19 aa, Mycobacterium
AGDTLYCDVWVDSIRKAHG

SEQ ID NO: 1257981 - protein, 24 aa, Mycobacterium
AGDVGPSAYARCFHNVARAAELLS

SEQ ID NO: 1257982 - protein, 19 aa, Mycobacterium
AGDVPALTAHRGRAAALPL

SEQ ID NO: 1257983 - protein, 18 aa, Mycobacterium
AGDWQLCRRRLLLDQTVL

SEQ ID NO: 1257984 - protein, 18 aa, Mycobacterium
AGEAAWRASMAKAVCSES

SEQ ID NO: 1257985 - protein, 21 aa, Mycobacterium
AGEALYDWNYQRQLLSIRLAE

SEQ ID NO: 1257986 - protein, 25 aa, Mycobacterium
AGEFRLVGSPIRIAGYQPAYRPAPR

SEQ ID NO: 1257987 - protein, 22 aa, Mycobacterium
AGEIACSAWPAGAGALVSMAFP

SEQ ID NO: 1257988 - protein, 19 aa, Mycobacterium
AGEIALLRLACEAADAALR

SEQ ID NO: 1257989 - protein, 24 aa, Mycobacterium
AGEIARCLAELVTLDTPTVSVLLG

SEQ ID NO: 1257990 - protein, 23 aa, Mycobacterium
AGEIYFEGGYDFEYLNDPEKTAS

SEQ ID NO: 1257991 - protein, 25 aa, Mycobacterium
AGELPLWWDQFVANGFHAVHLPEEV

SEQ ID NO: 1257992 - protein, 22 aa, Mycobacterium
AGELQIDFFNWLAIKSQKSQSL

SEQ ID NO: 1257993 - protein, 26 aa, Mycobacterium
AGELRRLKTCAAPDCEAVLVDLSRNR

SEQ ID NO: 1257994 - protein, 25 aa, Mycobacterium
AGEMSDRLVGHGALPIEVPTIAVEP

SEQ ID NO: 1257995 - protein, 23 aa, Mycobacterium
AGENCIVVAPGANGHLSLSSPAV

SEQ ID NO: 1257996 - protein, 17 aa, Mycobacterium
AGENGFLGFEFASEYGG

SEQ ID NO: 1257997 - protein, 21 aa, Mycobacterium
AGEPARWSDLPAHTRERITAL

SEQ ID NO: 1257998 - protein, 26 aa, Mycobacterium
AGEPCPASFFACFTCTNAVITPTHLP

SEQ ID NO: 1257999 - protein, 24 aa, Mycobacterium
AGERARLGLWAGDRAPSPRHDPAP

SEQ ID NO: 1258000 - protein, 20 aa, Mycobacterium
AGEVGTIYVSSGLSFGGYTG

SEQ ID NO: 1258001 - protein, 18 aa, Mycobacterium
AGEVLRRFGGVPLVRAVD

SEQ ID NO: 1258002 - protein, 17 aa, Mycobacterium
AGEWDFVVIAGLQEGLW

SEQ ID NO: 1258003 - protein, 22 aa, Mycobacterium
AGFAARGFRTMDRWWEATASAI

SEQ ID NO: 1258004 - protein, 19 aa, Mycobacterium
AGFAARLAERTGRHRPDDG

SEQ ID NO: 1258005 - protein, 17 aa, Mycobacterium
AGFGVTFGSMFKKPVTE

SEQ ID NO: 1258006 - protein, 18 aa, Mycobacterium
AGFRSLGLDGFRLDITSL

SEQ ID NO: 1258007 - protein, 25 aa, Mycobacterium
AGFSHFTLLLVHALRQQFSRVRVFA

SEQ ID NO: 1258008 - protein, 18 aa, Mycobacterium
AGGAAAAYRSFASALSDR

SEQ ID NO: 1258009 - protein, 30 aa, Mycobacterium
AGGDGGLGGLGGFGGVGGTGGQGGQGGPGG

SEQ ID NO: 1258010 - protein, 19 aa, Mycobacterium
AGGEAYLCGPAPFMAAVQG

SEQ ID NO: 1258011 - protein, 20 aa, Mycobacterium
AGGEILRLLLGHPAYTDGRL

SEQ ID NO: 1258012 - protein, 27 aa, Mycobacterium
AGGGGRGMRVVRDLAELPAQVEAARRE

SEQ ID NO: 1258013 - protein, 21 aa, Mycobacterium
AGGGNNGFCGVSGSAGGGNTT

SEQ ID NO: 1258014 - protein, 18 aa, Mycobacterium
AGGGRLVGKDGSPLSMEA

SEQ ID NO: 1258015 - protein, 19 aa, Mycobacterium
AGGGRPVLAIARFAQFLAA

SEQ ID NO: 1258016 - protein, 17 aa, Mycobacterium
AGGIPWDVASLTINKMC

SEQ ID NO: 1258017 - protein, 24 aa, Mycobacterium
AGGKGGAAGLLWGSGGDGGAGGAG

SEQ ID NO: 1258018 - protein, 23 aa, Mycobacterium
AGGKGVNVAKVLTMAGVDAVAVL

SEQ ID NO: 1258019 - protein, 18 aa, Mycobacterium
AGGLPPWGSLIEVQPERT

SEQ ID NO: 1258020 - protein, 25 aa, Mycobacterium
AGGLTLHGTYRFRAEGQPAPAALLI

SEQ ID NO: 1258021 - protein, 21 aa, Mycobacterium
AGGNFGCKWLVENRPDLFDGV

SEQ ID NO: 1258022 - protein, 24 aa, Mycobacterium
AGGPGGATTPAWSTTGTPGAGGPG

SEQ ID NO: 1258023 - protein, 29 aa, Mycobacterium
AGGPRMSKFEVVTAMAFAAFADAPVDVAV

SEQ ID NO: 1258024 - protein, 32 aa, Mycobacterium
AGGQAGVAGKGGLFGGSGSAGTAGVTGASGAS

SEQ ID NO: 1258025 - protein, 24 aa, Mycobacterium
AGGRYAGLVTLEMLIDTITRLRAE

SEQ ID NO: 1258026 - protein, 29 aa, Mycobacterium
AGGSMARRLRLNSRMGLLADDARVVDTLS

SEQ ID NO: 1258027 - protein, 26 aa, Mycobacterium
AGGSVDIGQTVGFGGHGGNGGAGGTG

SEQ ID NO: 1258028 - protein, 19 aa, Mycobacterium
AGGTGGFLFGNGGAGGAGA

SEQ ID NO: 1258029 - protein, 25 aa, Mycobacterium
AGGTGIPAFFTPAGVGTPVADGGMP

SEQ ID NO: 1258030 - protein, 35 aa, Mycobacterium
AGGTGQGVTGFLALPHRYNISGDGGDGGNGAGGGL

SEQ ID NO: 1258031 - protein, 20 aa, Mycobacterium
AGGTPVRWEDETVRACFRCP

SEQ ID NO: 1258032 - protein, 30 aa, Mycobacterium
AGGYRPETPCAVVAFASWPEEIVLRGTLAD

SEQ ID NO: 1258033 - protein, 18 aa, Mycobacterium
AGHAPGAVHVRLGDLDPR

SEQ ID NO: 1258034 - protein, 24 aa, Mycobacterium
AGHGRSGFLLAPWTAESIAAELEG

SEQ ID NO: 1258035 - protein, 17 aa, Mycobacterium
AGHHVIYCNSRFRGTDS

SEQ ID NO: 1258036 - protein, 17 aa, Mycobacterium
AGHKGFTLLVVEDGMEG

SEQ ID NO: 1258037 - protein, 19 aa, Mycobacterium
AGHLRAAIMTGALRPGTFI

SEQ ID NO: 1258038 - protein, 23 aa, Mycobacterium
AGHLRAGREVRYVPPWTQPHCSR

SEQ ID NO: 1258039 - protein, 17 aa, Mycobacterium
AGHPVEQFVLFSSISGV

SEQ ID NO: 1258040 - protein, 19 aa, Mycobacterium
AGHSFVIFLREGFPVNVLN

SEQ ID NO: 1258041 - protein, 20 aa, Mycobacterium
AGHVRPAYEDPLARLVGAVR

SEQ ID NO: 1258042 - protein, 20 aa, Mycobacterium
AGHWPPTGWYAEWVSGQDIF

SEQ ID NO: 1258043 - protein, 25 aa, Mycobacterium
AGIACAELRSPAGFAQHPQLAARNR

SEQ ID NO: 1258044 - protein, 17 aa, Mycobacterium
AGIDVRWIGSIDGRDVI

SEQ ID NO: 1258045 - protein, 19 aa, Mycobacterium
AGIEAEWPQFVAAVDRAAL

SEQ ID NO: 1258046 - protein, 24 aa, Mycobacterium
AGIELPKKVFVHGFLLNRGEKMSK

SEQ ID NO: 1258047 - protein, 19 aa, Mycobacterium
AGIELRLGSAAEHLDLADR

SEQ ID NO: 1258048 - protein, 22 aa, Mycobacterium
AGIGFYIDHHRIHVGTDETAAD

SEQ ID NO: 1258049 - protein, 17 aa, Mycobacterium
AGIGKTRLWLTAIEEAR

SEQ ID NO: 1258050 - protein, 23 aa, Mycobacterium
AGIGKTRLWLTAIQEARRRGYRV

SEQ ID NO: 1258051 - protein, 25 aa, Mycobacterium
AGILDVLDNYAFVRTSGYLAGPNDV

SEQ ID NO: 1258052 - protein, 30 aa, Mycobacterium
AGILNFVFGEMWLRPALGMRERRLITVACV

SEQ ID NO: 1258053 - protein, 18 aa, Mycobacterium
AGILRDAFIAGMAEDQWD

SEQ ID NO: 1258054 - protein, 17 aa, Mycobacterium
AGIPADYAAAVIDNTLS

SEQ ID NO: 1258055 - protein, 23 aa, Mycobacterium
AGIPKLRIEEAAARTQARIDSGQ

SEQ ID NO: 1258056 - protein, 17 aa, Mycobacterium
AGIPVAVEFRHPSWDDP

SEQ ID NO: 1258057 - protein, 21 aa, Mycobacterium
AGIRSLLAYQWAHPGKQLLFM

SEQ ID NO: 1258058 - protein, 27 aa, Mycobacterium
AGISKPVGLPDWRELLAKLADKAGIPA

SEQ ID NO: 1258059 - protein, 20 aa, Mycobacterium
AGITRGALYFYFGSKQEVLT

SEQ ID NO: 1258060 - protein, 17 aa, Mycobacterium
AGITTYSPLRHWNAGPG

SEQ ID NO: 1258061 - protein, 35 aa, Mycobacterium
AGKGDSADGVWSRLKFEGGVHRVQRVPVTESQGRV

SEQ ID NO: 1258062 - protein, 25 aa, Mycobacterium
AGKLRRVMVCAPGLAHQRLTPQNCN

SEQ ID NO: 1258063 - protein, 17 aa, Mycobacterium
AGKNVWLVGGGDVAAQF

SEQ ID NO: 1258064 - protein, 20 aa, Mycobacterium
AGKPLREYRAPKRRWGSVLG

SEQ ID NO: 1258065 - protein, 19 aa, Mycobacterium
AGKQACRLLYTGQPAQAVI

SEQ ID NO: 1258066 - protein, 23 aa, Mycobacterium
AGKRLPVPLYPGFDTLGTLEYIA

SEQ ID NO: 1258067 - protein, 17 aa, Mycobacterium
AGKSSWFNATYAALAGR

SEQ ID NO: 1258068 - protein, 20 aa, Mycobacterium
AGLADDIAKMIAFEKDVKES

SEQ ID NO: 1258069 - protein, 17 aa, Mycobacterium
AGLALAGACGRLGLVTG

SEQ ID NO: 1258070 - protein, 29 aa, Mycobacterium
AGLAVKFANLPFTWSTRGAERVAEAIRSV

SEQ ID NO: 1258071 - protein, 24 aa, Mycobacterium
AGLCTRINTITCQEIFDYSTYDQP

SEQ ID NO: 1258072 - protein, 19 aa, Mycobacterium
AGLEKAKGVLRTKVGASLG

SEQ ID NO: 1258073 - protein, 25 aa, Mycobacterium
AGLEPDLRWERFITAVRLLSERLGV

SEQ ID NO: 1258074 - protein, 22 aa, Mycobacterium
AGLERRVGELQAQVVAAAADLT

SEQ ID NO: 1258075 - protein, 18 aa, Mycobacterium
AGLGPALVRAACAHAESV

SEQ ID NO: 1258076 - protein, 18 aa, Mycobacterium
AGLGWGMYPIQLLDASFV

SEQ ID NO: 1258077 - protein, 19 aa, Mycobacterium
AGLHALSGILAALHHRGRT

SEQ ID NO: 1258078 - protein, 17 aa, Mycobacterium
AGLIGAISLEVFGQYGA

SEQ ID NO: 1258079 - protein, 19 aa, Mycobacterium
AGLKPSDVALWEINEAFAS

SEQ ID NO: 1258080 - protein, 25 aa, Mycobacterium
AGLKWWTSEVQWEIIDRCLQLHGGY

SEQ ID NO: 1258081 - protein, 27 aa, Mycobacterium
AGLLAEGHGALTRLQAVWTGDGQMAYD

SEQ ID NO: 1258082 - protein, 31 aa, Mycobacterium
AGLLAEVIARDFPFLGCCYGIGTVGAAIGAV

SEQ ID NO: 1258083 - protein, 24 aa, Mycobacterium
AGLLSLPYPEEWGGGGQPYEVYLQ

SEQ ID NO: 1258084 - protein, 17 aa, Mycobacterium
AGLPAAVLAELLRALQG

SEQ ID NO: 1258085 - protein, 28 aa, Mycobacterium
AGLPEDLPFAVLMALHLPEQGPSVLAQI

SEQ ID NO: 1258086 - protein, 21 aa, Mycobacterium
AGLPEVACTVWSNVVMAAGLT

SEQ ID NO: 1258087 - protein, 25 aa, Mycobacterium
AGLPGDLPGTIAAILERARSCGELR

SEQ ID NO: 1258088 - protein, 25 aa, Mycobacterium
AGLPGVAVAPVLRFKAFTRDSVGLS

SEQ ID NO: 1258089 - protein, 17 aa, Mycobacterium
AGLPRSARFRSRLVGKP

SEQ ID NO: 1258090 - protein, 18 aa, Mycobacterium
AGLPRSARFRSRLVGKPF

SEQ ID NO: 1258091 - protein, 22 aa, Mycobacterium
AGLPSSPWYDLGKKLAPKGTGA

SEQ ID NO: 1258092 - protein, 23 aa, Mycobacterium
AGLPWETGLTWDPRVHDVVRGAI

SEQ ID NO: 1258093 - protein, 23 aa, Mycobacterium
AGLPYRPMHPWWPSADNDPDAHR

SEQ ID NO: 1258094 - protein, 19 aa, Mycobacterium
AGLPYSRHASVAKLTATDA

SEQ ID NO: 1258095 - protein, 18 aa, Mycobacterium
AGLQEFLQEIAVVPVVEH

SEQ ID NO: 1258096 - protein, 19 aa, Mycobacterium
AGLRAAGRVAGLIGTVGVR

SEQ ID NO: 1258097 - protein, 22 aa, Mycobacterium
AGLRCPADLAVMGVDARLLGAV

SEQ ID NO: 1258098 - protein, 21 aa, Mycobacterium
AGLRGLVGVAHYTAAKHGVVG

SEQ ID NO: 1258099 - protein, 20 aa, Mycobacterium
AGLRSGDCDLALAGGVCVMG

SEQ ID NO: 1258100 - protein, 25 aa, Mycobacterium
AGLRTLCLDAKLYAGGMASTVELFD

SEQ ID NO: 1258101 - protein, 17 aa, Mycobacterium
AGLSFPFLREKVHGRSN

SEQ ID NO: 1258102 - protein, 29 aa, Mycobacterium
AGLSGLVPRIAVVKGRCFAGNAVIAGCAD

SEQ ID NO: 1258103 - protein, 29 aa, Mycobacterium
AGLSHPMGPLRLSDLIGLDTMKLIADSMY

SEQ ID NO: 1258104 - protein, 20 aa, Mycobacterium
AGLTRLKRRFVITTLSNGNV

SEQ ID NO: 1258105 - protein, 18 aa, Mycobacterium
AGLVGRVGAEPVLGDLSD

SEQ ID NO: 1258106 - protein, 19 aa, Mycobacterium
AGMAPWPGLVGRVRDAGVR

SEQ ID NO: 1258107 - protein, 17 aa, Mycobacterium
AGMGRRLLADEPAFAAA

SEQ ID NO: 1258108 - protein, 24 aa, Mycobacterium
AGMKGCTLIRGHARFENPHTLRVD

SEQ ID NO: 1258109 - protein, 22 aa, Mycobacterium
AGMKGNPPMQAWTDVINTNLVG

SEQ ID NO: 1258110 - protein, 20 aa, Mycobacterium
AGMRSHPGVTATFCEALADA

SEQ ID NO: 1258111 - protein, 17 aa, Mycobacterium
AGMRVDAGLARLLGLSR

SEQ ID NO: 1258112 - protein, 17 aa, Mycobacterium
AGMVAMGAAGAWTGSVW

SEQ ID NO: 1258113 - protein, 20 aa, Mycobacterium
AGNPGRYGLTDGDVTRYQNA

SEQ ID NO: 1258114 - protein, 17 aa, Mycobacterium
AGNTWLFEAIVNAAHVS

SEQ ID NO: 1258115 - protein, 18 aa, Mycobacterium
AGPAYAELALLRGDPSDG

SEQ ID NO: 1258116 - protein, 25 aa, Mycobacterium
AGPDRSIIRASSWDIDMPNQFEAAE

SEQ ID NO: 1258117 - protein, 18 aa, Mycobacterium
AGPEIGVASTKTFLAQIA

SEQ ID NO: 1258118 - protein, 17 aa, Mycobacterium
AGPGRRHRPGAADEGIG

SEQ ID NO: 1258119 - protein, 20 aa, Mycobacterium
AGPIVRRSSPPRIAVWLATT

SEQ ID NO: 1258120 - protein, 22 aa, Mycobacterium
AGPLPLQIICDMMGIPEEDHQK

SEQ ID NO: 1258121 - protein, 19 aa, Mycobacterium
AGPMLARIAERFGSTLHAP

SEQ ID NO: 1258122 - protein, 20 aa, Mycobacterium
AGPMRWTCVEPLKKWKLEVA

SEQ ID NO: 1258123 - protein, 26 aa, Mycobacterium
AGPPLLRKLVWRLPSRVQPKPEAVVW

SEQ ID NO: 1258124 - protein, 18 aa, Mycobacterium
AGPRSCIGDHFAMLEATL

SEQ ID NO: 1258125 - protein, 19 aa, Mycobacterium
AGPRVRRLVYTSSVAAYGY

SEQ ID NO: 1258126 - protein, 18 aa, Mycobacterium
AGPRWRRRRVRIAEIPDT

SEQ ID NO: 1258127 - protein, 23 aa, Mycobacterium
AGPSCTHILALLGAEVIHVESTW

SEQ ID NO: 1258128 - protein, 29 aa, Mycobacterium
AGPTCAANLKCLCRKHHLLKTFWTGENGW

SEQ ID NO: 1258129 - protein, 20 aa, Mycobacterium
AGPTLAHRAIGYGMPGVRVD

SEQ ID NO: 1258130 - protein, 21 aa, Mycobacterium
AGPTRRGEIVTDVRLLSSRLA

SEQ ID NO: 1258131 - protein, 25 aa, Mycobacterium
AGPVARPTATLVRRVRGLVEVAADT

SEQ ID NO: 1258132 - protein, 17 aa, Mycobacterium
AGPWGRGRPVEAADAFE

SEQ ID NO: 1258133 - protein, 23 aa, Mycobacterium
AGQCGSCFNGTAAMSAAATALRD

SEQ ID NO: 1258134 - protein, 33 aa, Mycobacterium
AGQGCAAPTRMLLPRSRYDEGVALLKALYENMR

SEQ ID NO: 1258135 - protein, 23 aa, Mycobacterium
AGQGCAITTRLVVPRDRYDEAVE

SEQ ID NO: 1258136 - protein, 25 aa, Mycobacterium
AGQGFSGAHPLLGLHVELPSGTGHV

SEQ ID NO: 1258137 - protein, 17 aa, Mycobacterium
AGQGGWRTVPGSERDAG

SEQ ID NO: 1258138 - protein, 23 aa, Mycobacterium
AGQIELPSGVTLISDPETLVVNI

SEQ ID NO: 1258139 - protein, 22 aa, Mycobacterium
AGQKAFRIGRVCTKRGDRGNGH

SEQ ID NO: 1258140 - protein, 24 aa, Mycobacterium
AGQKPRTGVGLGMPAVGAPDPLPA

SEQ ID NO: 1258141 - protein, 26 aa, Mycobacterium
AGQLLERARFAAAAYADYDQAAVARI

SEQ ID NO: 1258142 - protein, 18 aa, Mycobacterium
AGQLVRLAAAAPRAATAK

SEQ ID NO: 1258143 - protein, 18 aa, Mycobacterium
AGQRWPRFVPAAREAGIV

SEQ ID NO: 1258144 - protein, 20 aa, Mycobacterium
AGQSWWAAVEDIGRLRDGVG

SEQ ID NO: 1258145 - protein, 25 aa, Mycobacterium
AGQTVKLEPWGPFTSSWEWLTSPPE

SEQ ID NO: 1258146 - protein, 23 aa, Mycobacterium
AGRAADIDTVYGLVGDTLREQTT

SEQ ID NO: 1258147 - protein, 24 aa, Mycobacterium
AGRAFGTNGVHGFDLMFAAPKSVS

SEQ ID NO: 1258148 - protein, 17 aa, Mycobacterium
AGRDDLVAWEFERAGLG

SEQ ID NO: 1258149 - protein, 25 aa, Mycobacterium
AGRGAACARALARLLGTFGVLGDDV

SEQ ID NO: 1258150 - protein, 19 aa, Mycobacterium
AGRGFCSGADFGILSVLAE

SEQ ID NO: 1258151 - protein, 25 aa, Mycobacterium
AGRGLGAAMALAFAEAGADVLIAAR

SEQ ID NO: 1258152 - protein, 27 aa, Mycobacterium
AGRHLSFSGGRHFCLGAALARAEGEVG

SEQ ID NO: 1258153 - protein, 18 aa, Mycobacterium
AGRHRCVGAAFATMQIKA

SEQ ID NO: 1258154 - protein, 19 aa, Mycobacterium
AGRHRCVGAAFATMQIKAI

SEQ ID NO: 1258155 - protein, 25 aa, Mycobacterium
AGRIVSFDAAGGWNFEEEGYQSVGS

SEQ ID NO: 1258156 - protein, 19 aa, Mycobacterium
AGRLHILEVQRLIRFMPKP

SEQ ID NO: 1258157 - protein, 21 aa, Mycobacterium
AGRLPEGWFAGDPEVIVDREE

SEQ ID NO: 1258158 - protein, 24 aa, Mycobacterium
AGRLPGNAHFTFRGCEGDSLLMLL

SEQ ID NO: 1258159 - protein, 27 aa, Mycobacterium
AGRPVLGICGGFQMLGRVIRDPHGVEG

SEQ ID NO: 1258160 - protein, 25 aa, Mycobacterium
AGRQMPRIQFSVLHLDVTDVESPPR

SEQ ID NO: 1258161 - protein, 18 aa, Mycobacterium
AGRRGIVAVRELLPHVDG

SEQ ID NO: 1258162 - protein, 17 aa, Mycobacterium
AGRRPVLVRAFNVLRQY

SEQ ID NO: 1258163 - protein, 21 aa, Mycobacterium
AGRSHPGHALFAQFAYPPNEL

SEQ ID NO: 1258164 - protein, 22 aa, Mycobacterium
AGRSLPEYRALRAKNTMMQACF

SEQ ID NO: 1258165 - protein, 19 aa, Mycobacterium
AGRTAKCAVVRKVGHEPVE

SEQ ID NO: 1258166 - protein, 24 aa, Mycobacterium
AGRTWRVPVTAFWQAHRDAPALYS

SEQ ID NO: 1258167 - protein, 22 aa, Mycobacterium
AGRVVRGRIDAVFADGDGVMVV

SEQ ID NO: 1258168 - protein, 22 aa, Mycobacterium
AGRWPVDGMYPLTRQVSKTNVG

SEQ ID NO: 1258169 - protein, 21 aa, Mycobacterium
AGSEWPSWTVPEMSADEAARL

SEQ ID NO: 1258170 - protein, 26 aa, Mycobacterium
AGSGAWCVAADFSVGMLAAGAARDVP

SEQ ID NO: 1258171 - protein, 17 aa, Mycobacterium
AGSGKTNSISWLAHRLS

SEQ ID NO: 1258172 - protein, 29 aa, Mycobacterium
AGSGSISIEWCRSGPGCRAIAFERDEARR

SEQ ID NO: 1258173 - protein, 21 aa, Mycobacterium
AGSKVKVTIMFRGREQSRPEL

SEQ ID NO: 1258174 - protein, 17 aa, Mycobacterium
AGSLLAADYEEFLDGRG

SEQ ID NO: 1258175 - protein, 21 aa, Mycobacterium
AGSLLMPPWTVTRFEADGIEL

SEQ ID NO: 1258176 - protein, 20 aa, Mycobacterium
AGSLPAEWWGADAPGSPPSH

SEQ ID NO: 1258177 - protein, 18 aa, Mycobacterium
AGSLVEVAEFCRELADSA

SEQ ID NO: 1258178 - protein, 18 aa, Mycobacterium
AGSMARRLLLNSRMGLLA

SEQ ID NO: 1258179 - protein, 21 aa, Mycobacterium
AGSPCPVEVMKRCVNELKMSE

SEQ ID NO: 1258180 - protein, 23 aa, Mycobacterium
AGSQLRGVRDFVIRRHAAPAEYT

SEQ ID NO: 1258181 - protein, 25 aa, Mycobacterium
AGSRNKLDLCAELGADITIDYHNED

SEQ ID NO: 1258182 - protein, 19 aa, Mycobacterium
AGSSCGKNLSAELTSTIGE

SEQ ID NO: 1258183 - protein, 21 aa, Mycobacterium
AGSTWRPVVRYEMGADGRVTV

SEQ ID NO: 1258184 - protein, 19 aa, Mycobacterium
AGSVARISVLPGVTLPNFD

SEQ ID NO: 1258185 - protein, 20 aa, Mycobacterium
AGSVGLPLVLVDGVTVMTGR

SEQ ID NO: 1258186 - protein, 21 aa, Mycobacterium
AGSYLEFLAPYGLQSPGMAYA

SEQ ID NO: 1258187 - protein, 17 aa, Mycobacterium
AGSYRPGRFTKTLASLQ

SEQ ID NO: 1258188 - protein, 20 aa, Mycobacterium
AGTARRFLAEGARVVIADID

SEQ ID NO: 1258189 - protein, 20 aa, Mycobacterium
AGTASFLWLEVDDVVRETMA

SEQ ID NO: 1258190 - protein, 24 aa, Mycobacterium
AGTEGFNAFNVCSGKPVSILDVAT

SEQ ID NO: 1258191 - protein, 21 aa, Mycobacterium
AGTGCRRLPATSSLLGIPALT

SEQ ID NO: 1258192 - protein, 19 aa, Mycobacterium
AGTGLAAISWGLAHERMSI

SEQ ID NO: 1258193 - protein, 20 aa, Mycobacterium
AGTGLRWLRVDHAGNRTFSV

SEQ ID NO: 1258194 - protein, 18 aa, Mycobacterium
AGTGRVVLCYANRDEASV

SEQ ID NO: 1258195 - protein, 24 aa, Mycobacterium
AGTGVRFTPTLAFVRDTVPDTAHR

SEQ ID NO: 1258196 - protein, 29 aa, Mycobacterium
AGTLLRPRACYICKNRYTVVDAFYHQLCP

SEQ ID NO: 1258197 - protein, 21 aa, Mycobacterium
AGTLTCPWHGFCYDAESGECL

SEQ ID NO: 1258198 - protein, 20 aa, Mycobacterium
AGTNRCRDCGTVVAVHQASF

SEQ ID NO: 1258199 - protein, 21 aa, Mycobacterium
AGTNSKPGWVVVEVNDSPAGE

SEQ ID NO: 1258200 - protein, 26 aa, Mycobacterium
AGTPGACPDMSMLLASMFKVPMSQLY

SEQ ID NO: 1258201 - protein, 23 aa, Mycobacterium
AGTRECVVCGASFTPSTSQVRTC

SEQ ID NO: 1258202 - protein, 27 aa, Mycobacterium
AGTRLLIPRSRRDEILAKLLARASTLR

SEQ ID NO: 1258203 - protein, 17 aa, Mycobacterium
AGTTWLFSNALMRNAPV

SEQ ID NO: 1258204 - protein, 19 aa, Mycobacterium
AGTVAEWLGHVLNVVTGRM

SEQ ID NO: 1258205 - protein, 19 aa, Mycobacterium
AGTVARAFLQQALGVEIVS

SEQ ID NO: 1258206 - protein, 18 aa, Mycobacterium
AGTVERLTFDPAAFGFAR

SEQ ID NO: 1258207 - protein, 26 aa, Mycobacterium
AGTWPAYRPLLNWLIGLMPEGGASYQ

SEQ ID NO: 1258208 - protein, 25 aa, Mycobacterium
AGVAARCRTEGGSFFEAVPAGGDAY

SEQ ID NO: 1258209 - protein, 24 aa, Mycobacterium
AGVACANILLAKGIPDVTVLDSKG

SEQ ID NO: 1258210 - protein, 19 aa, Mycobacterium
AGVAGHGVFGPRIRWRAML

SEQ ID NO: 1258211 - protein, 18 aa, Mycobacterium
AGVALGWVAATWPGLVPE

SEQ ID NO: 1258212 - protein, 17 aa, Mycobacterium
AGVAWRMTKDSGPWDIL

SEQ ID NO: 1258213 - protein, 17 aa, Mycobacterium
AGVDEYVGAVFDSSAEG

SEQ ID NO: 1258214 - protein, 19 aa, Mycobacterium
AGVDGRVLLPHLRRQDPTT

SEQ ID NO: 1258215 - protein, 18 aa, Mycobacterium
AGVDIVVACPGRLEDLMG

SEQ ID NO: 1258216 - protein, 19 aa, Mycobacterium
AGVDWSMIASRAVEQTLRD

SEQ ID NO: 1258217 - protein, 18 aa, Mycobacterium
AGVGILILTHYVPTLQPG

SEQ ID NO: 1258218 - protein, 17 aa, Mycobacterium
AGVGMLLPRWSGDQYDA

SEQ ID NO: 1258219 - protein, 18 aa, Mycobacterium
AGVGPGRTRLISGRAQEV

SEQ ID NO: 1258220 - protein, 19 aa, Mycobacterium
AGVHRCLGSNLARLEFQVG

SEQ ID NO: 1258221 - protein, 25 aa, Mycobacterium
AGVILSMICDLRVVAPEAYFQFPVA

SEQ ID NO: 1258222 - protein, 18 aa, Mycobacterium
AGVPGCIPFDRSTDPEPL

SEQ ID NO: 1258223 - protein, 26 aa, Mycobacterium
AGVPKGFRVSNRWNLEPRAHGATTVT

SEQ ID NO: 1258224 - protein, 22 aa, Mycobacterium
AGVPLLRLAAQTALLQAEALAE

SEQ ID NO: 1258225 - protein, 25 aa, Mycobacterium
AGVPPLTYLNAWRMQLARHALRDSD

SEQ ID NO: 1258226 - protein, 17 aa, Mycobacterium
AGVPPRMMVVDCDAVQH

SEQ ID NO: 1258227 - protein, 29 aa, Mycobacterium
AGVSPTVLCRHFGDRDGLVAAVLDDLVAS

SEQ ID NO: 1258228 - protein, 26 aa, Mycobacterium
AGVSRGWLYRHFPDKAELLGAAIVRL

SEQ ID NO: 1258229 - protein, 20 aa, Mycobacterium
AGVSRGWLYRHFPDKVSLLG

SEQ ID NO: 1258230 - protein, 31 aa, Mycobacterium
AGVSRGWLYRHFPDKVSLLGAAIVRLNEAYW

SEQ ID NO: 1258231 - protein, 19 aa, Mycobacterium
AGVSRPTVYRRWPSKAHVV

SEQ ID NO: 1258232 - protein, 18 aa, Mycobacterium
AGVSRWVVDTGFKGDLIT

SEQ ID NO: 1258233 - protein, 19 aa, Mycobacterium
AGVTARFNRNVLAVINREL

SEQ ID NO: 1258234 - protein, 19 aa, Mycobacterium
AGVTPAGLLHHFESKEQLL

SEQ ID NO: 1258235 - protein, 24 aa, Mycobacterium
AGVYFPRGGMRAVPDAMAAAASDA

SEQ ID NO: 1258236 - protein, 20 aa, Mycobacterium
AGVYFPSLSSRTMVYKGMLT

SEQ ID NO: 1258237 - protein, 19 aa, Mycobacterium
AGWGEFGAFVEYRPAEAAH

SEQ ID NO: 1258238 - protein, 19 aa, Mycobacterium
AGWHHVWGVRVHDVRASVD

SEQ ID NO: 1258239 - protein, 20 aa, Mycobacterium
AGWSDLLALVGIKSGSYGPH

SEQ ID NO: 1258240 - protein, 18 aa, Mycobacterium
AGWSTLFDEFSRGARPRT

SEQ ID NO: 1258241 - protein, 27 aa, Mycobacterium
AGWYRRAIEYFGEIPGQWAFVSTNSIS

SEQ ID NO: 1258242 - protein, 25 aa, Mycobacterium
AGYDEGRWSPWQWSSILIEGAHCRE

SEQ ID NO: 1258243 - protein, 28 aa, Mycobacterium
AGYEEALVRYGLQICAHWCRSGRADTCA

SEQ ID NO: 1258244 - protein, 17 aa, Mycobacterium
AGYLAAHGARHLVLTSR

SEQ ID NO: 1258245 - protein, 23 aa, Mycobacterium
AGYPGGLAAFGARSRQLAEEFGP

SEQ ID NO: 1258246 - protein, 23 aa, Mycobacterium
AGYRGEIKVSLINLDPAAPIAIR

SEQ ID NO: 1258247 - protein, 29 aa, Mycobacterium
AGYRRFLERRLRETFGFEGSPIRINVRVR

SEQ ID NO: 1258248 - protein, 28 aa, Mycobacterium
AHAARVTLGLALARLGMFAPAMSYLAEP

SEQ ID NO: 1258249 - protein, 18 aa, Mycobacterium
AHAEALDASADWVPQLWR

SEQ ID NO: 1258250 - protein, 31 aa, Mycobacterium
AHAIRRRIHAELHRRVCAVLRSEAWPEVTET

SEQ ID NO: 1258251 - protein, 20 aa, Mycobacterium
AHARIVVWELIDALRRDGVT

SEQ ID NO: 1258252 - protein, 18 aa, Mycobacterium
AHARKRLGAAVAPKTIAF

SEQ ID NO: 1258253 - protein, 24 aa, Mycobacterium
AHASPEKLLRCIEAVLECREALAV

SEQ ID NO: 1258254 - protein, 24 aa, Mycobacterium
AHATPSFEVMYLLADCHAEDIEKL

SEQ ID NO: 1258255 - protein, 23 aa, Mycobacterium
AHCIRGLGIWEWAGSEQLGTDPD

SEQ ID NO: 1258256 - protein, 23 aa, Mycobacterium
AHDIKLDPDWFVIRKSAVNVFRA

SEQ ID NO: 1258257 - protein, 25 aa, Mycobacterium
AHDLPAPGYVVWRAAANHFRLRRID

SEQ ID NO: 1258258 - protein, 20 aa, Mycobacterium
AHDLSAWLAGARVSPRFPSP

SEQ ID NO: 1258259 - protein, 18 aa, Mycobacterium
AHDLWRVFAYDPGHTEKP

SEQ ID NO: 1258260 - protein, 21 aa, Mycobacterium
AHDQCDAWVGLAAAGDVSARV

SEQ ID NO: 1258261 - protein, 34 aa, Mycobacterium
AHDRIALEWLTPRFGARVGWLAGAHVAAKRHLAA

SEQ ID NO: 1258262 - protein, 24 aa, Mycobacterium
AHDSLRPLWAAWLYSPEVPELDAG

SEQ ID NO: 1258263 - protein, 19 aa, Mycobacterium
AHDVARLLAAVAAELPPLA

SEQ ID NO: 1258264 - protein, 18 aa, Mycobacterium
AHEGLFAAPTLAAHCVWV

SEQ ID NO: 1258265 - protein, 24 aa, Mycobacterium
AHEGSLRIGDKVVLGRDNVINTYL

SEQ ID NO: 1258266 - protein, 18 aa, Mycobacterium
AHESSVWSDECHPEDPMR

SEQ ID NO: 1258267 - protein, 19 aa, Mycobacterium
AHFAAWGARERKPLTVLDL

SEQ ID NO: 1258268 - protein, 17 aa, Mycobacterium
AHFCLGAAAARMQSRVA

SEQ ID NO: 1258269 - protein, 31 aa, Mycobacterium
AHGDDAWEAIQFIPKEHWQDYLVWFRAATEP

SEQ ID NO: 1258270 - protein, 19 aa, Mycobacterium
AHGDYRFGQQIVVSHDGGD

SEQ ID NO: 1258271 - protein, 23 aa, Mycobacterium
AHGELRSRLSLFVEQAARVQFEV

SEQ ID NO: 1258272 - protein, 26 aa, Mycobacterium
AHGIASAVVLKANWQRAAKLLGATRP

SEQ ID NO: 1258273 - protein, 19 aa, Mycobacterium
AHGPVRFPGVPTGFSRTPG

SEQ ID NO: 1258274 - protein, 18 aa, Mycobacterium
AHGRLVDSPIIWASLANY

SEQ ID NO: 1258275 - protein, 19 aa, Mycobacterium
AHHEPRGAQYMGVNWVGPI

SEQ ID NO: 1258276 - protein, 21 aa, Mycobacterium
AHHRESFLYTNFEELCGILAR

SEQ ID NO: 1258277 - protein, 17 aa, Mycobacterium
AHHRLFSHVPWLPGQLL

SEQ ID NO: 1258278 - protein, 17 aa, Mycobacterium
AHHRLFSHVPWLSSQLM

SEQ ID NO: 1258279 - protein, 25 aa, Mycobacterium
AHHVPRFSRLGPRRRQLNGGGNWSR

SEQ ID NO: 1258280 - protein, 26 aa, Mycobacterium
AHIALRRGEGLAGLIVASADGQAFKL

SEQ ID NO: 1258281 - protein, 27 aa, Mycobacterium
AHIFLRRARTGLHLFGGPRLHRERYLV

SEQ ID NO: 1258282 - protein, 17 aa, Mycobacterium
AHILAFVFADVWQRPGL

SEQ ID NO: 1258283 - protein, 17 aa, Mycobacterium
AHILPRMRDRLERGMSV

SEQ ID NO: 1258284 - protein, 23 aa, Mycobacterium
AHLAGESLGGWIAAWTALEHPDR

SEQ ID NO: 1258285 - protein, 18 aa, Mycobacterium
AHLARLELNVAFRMLYAR

SEQ ID NO: 1258286 - protein, 21 aa, Mycobacterium
AHLDMGWERLMIAVEYDGKEH

SEQ ID NO: 1258287 - protein, 22 aa, Mycobacterium
AHLEMAMTLAVPAAALVGRPAV

SEQ ID NO: 1258288 - protein, 18 aa, Mycobacterium
AHLGRWGPSVGETVALLR

SEQ ID NO: 1258289 - protein, 28 aa, Mycobacterium
AHLPRAGLPTEIGPVVAFLASRRNSYMT

SEQ ID NO: 1258290 - protein, 23 aa, Mycobacterium
AHLQSARPGEDWTGSQRFSGDDP

SEQ ID NO: 1258291 - protein, 19 aa, Mycobacterium
AHLRLSARRMRLPDQGRGL

SEQ ID NO: 1258292 - protein, 17 aa, Mycobacterium
AHMGTNHLGHFALTCLL

SEQ ID NO: 1258293 - protein, 17 aa, Mycobacterium
AHPAFDWYSERISEQQA

SEQ ID NO: 1258294 - protein, 18 aa, Mycobacterium
AHPDRFAGFAALPMRDPQ

SEQ ID NO: 1258295 - protein, 31 aa, Mycobacterium
AHPDVAGPYAWWSWRGKAFDNDAGWRIDYQL

SEQ ID NO: 1258296 - protein, 20 aa, Mycobacterium
AHPEVVSWAAFLAEQKRRAE

SEQ ID NO: 1258297 - protein, 18 aa, Mycobacterium
AHPGRPDVLTAWMDASVI

SEQ ID NO: 1258298 - protein, 23 aa, Mycobacterium
AHPHGVEVVGYWGEHVATAARAR

SEQ ID NO: 1258299 - protein, 20 aa, Mycobacterium
AHPLVRRIGFIGSPGTGRHI

SEQ ID NO: 1258300 - protein, 21 aa, Mycobacterium
AHPLVRRIGFIGSPGTGRHIQ

SEQ ID NO: 1258301 - protein, 18 aa, Mycobacterium
AHPSLPRGALLQVALGER

SEQ ID NO: 1258302 - protein, 18 aa, Mycobacterium
AHPVGFQWVVEAKARGTE

SEQ ID NO: 1258303 - protein, 20 aa, Mycobacterium
AHPYAPVGIVPLFETIDDLQ

SEQ ID NO: 1258304 - protein, 26 aa, Mycobacterium
AHQIPRAGNMFSVFFGAEPVTDFAAA

SEQ ID NO: 1258305 - protein, 26 aa, Mycobacterium
AHREHFSLPALRDWLRGQRDERSGAP

SEQ ID NO: 1258306 - protein, 20 aa, Mycobacterium
AHRGVVLGTGGFEWDQRLVE

SEQ ID NO: 1258307 - protein, 17 aa, Mycobacterium
AHRHTMAALRFAIQGGP

SEQ ID NO: 1258308 - protein, 27 aa, Mycobacterium
AHRKALAAFRRAGGRIVEMVPHTTDLV

SEQ ID NO: 1258309 - protein, 19 aa, Mycobacterium
AHRLLEFLNAATIPEAPTA

SEQ ID NO: 1258310 - protein, 19 aa, Mycobacterium
AHRLLSMLQYRGFVRQDPI

SEQ ID NO: 1258311 - protein, 20 aa, Mycobacterium
AHSAVRWAVQEAALRHRPIT

SEQ ID NO: 1258312 - protein, 17 aa, Mycobacterium
AHSCPGAPLARAEAKVS

SEQ ID NO: 1258313 - protein, 21 aa, Mycobacterium
AHSLFEWLGPVPDTVVAAAAT

SEQ ID NO: 1258314 - protein, 18 aa, Mycobacterium
AHSSVAWNSARREEQFRQ

SEQ ID NO: 1258315 - protein, 25 aa, Mycobacterium
AHTAVKIAPRRGGPVVWVKDASRSV

SEQ ID NO: 1258316 - protein, 20 aa, Mycobacterium
AHTGRLWRVGFCGFAPGFAY

SEQ ID NO: 1258317 - protein, 22 aa, Mycobacterium
AHTIRLMAGHELVTEGFAPGQV

SEQ ID NO: 1258318 - protein, 17 aa, Mycobacterium
AHTLCWPDTAVDAAEAG

SEQ ID NO: 1258319 - protein, 21 aa, Mycobacterium
AHTLPVLLAGADFVFSGFGSI

SEQ ID NO: 1258320 - protein, 24 aa, Mycobacterium
AHVADVKTAIAWARANVDKFGGDR

SEQ ID NO: 1258321 - protein, 19 aa, Mycobacterium
AHVDWTWAAIEAIGLTGIT

SEQ ID NO: 1258322 - protein, 20 aa, Mycobacterium
AHVHPRLDAATGTWSTPWTW

SEQ ID NO: 1258323 - protein, 18 aa, Mycobacterium
AHVTIRLANKLRLLTLAA

SEQ ID NO: 1258324 - protein, 22 aa, Mycobacterium
AHVVDVPAFRIGRVPVTNAEWR

SEQ ID NO: 1258325 - protein, 24 aa, Mycobacterium
AHVWDLDRLMSLAVRHVQLSRDTG

SEQ ID NO: 1258326 - protein, 19 aa, Mycobacterium
AHYAAGWWMDSAPSLQEAE

SEQ ID NO: 1258327 - protein, 25 aa, Mycobacterium
AHYRCHADHAWSHTVTIPVRGLAES

SEQ ID NO: 1258328 - protein, 32 aa, Mycobacterium
AHYTRTPDEFSWRAGELLTAIADGTLDVTVSH

SEQ ID NO: 1258329 - protein, 23 aa, Mycobacterium
AHYVETLTGFKWLSRADDDLPGK

SEQ ID NO: 1258330 - protein, 19 aa, Mycobacterium
AIAALVAEYERQWIQNATI

SEQ ID NO: 1258331 - protein, 23 aa, Mycobacterium
AIAARLSTALTRHGAHILDADAA

SEQ ID NO: 1258332 - protein, 18 aa, Mycobacterium
AIAAWRAAWAGDDHEGPE

SEQ ID NO: 1258333 - protein, 29 aa, Mycobacterium
AIAEGGRFACGGGRPADRDTGFFIDPTVI

SEQ ID NO: 1258334 - protein, 18 aa, Mycobacterium
AIAEPRPLFDPTALKATA

SEQ ID NO: 1258335 - protein, 29 aa, Mycobacterium
AIAEWSVPVKEYKPMMGRQDTRVLKGTHS

SEQ ID NO: 1258336 - protein, 19 aa, Mycobacterium
AIAFAAAREGARLILGDIT

SEQ ID NO: 1258337 - protein, 20 aa, Mycobacterium
AIALACRVLAARDLAPGILG

SEQ ID NO: 1258338 - protein, 24 aa, Mycobacterium
AIALCSSCGLAQLADDDTGGQEMH

SEQ ID NO: 1258339 - protein, 17 aa, Mycobacterium
AIALKRRILVLQAVEHS

SEQ ID NO: 1258340 - protein, 20 aa, Mycobacterium
AIAPAGGWHRWSLPKYEIVF

SEQ ID NO: 1258341 - protein, 32 aa, Mycobacterium
AIAPEEARSGISYAISKSFVRWYSSSQAERFN

SEQ ID NO: 1258342 - protein, 19 aa, Mycobacterium
AIARRIGLTRARMEILPVS

SEQ ID NO: 1258343 - protein, 18 aa, Mycobacterium
AIASCPPGHVEVLANYTA

SEQ ID NO: 1258344 - protein, 30 aa, Mycobacterium
AIATANHRGCWLRVVLRFLPPGGAEPDSLR

SEQ ID NO: 1258345 - protein, 23 aa, Mycobacterium
AIAVPALRSVLVVTPDEDAADAA

SEQ ID NO: 1258346 - protein, 18 aa, Mycobacterium
AICAGLAADGHRVAVLDV

SEQ ID NO: 1258347 - protein, 17 aa, Mycobacterium
AICPGFIETPLFDAVVG

SEQ ID NO: 1258348 - protein, 17 aa, Mycobacterium
AIDALALLETCPVRDRA

SEQ ID NO: 1258349 - protein, 26 aa, Mycobacterium
AIDARKELLPLIGLIDQSAPVLDSQA

SEQ ID NO: 1258350 - protein, 20 aa, Mycobacterium
AIDGQFRRIQCTPDLLPSDI

SEQ ID NO: 1258351 - protein, 18 aa, Mycobacterium
AIDKLDFDWRELEITPKW

SEQ ID NO: 1258352 - protein, 20 aa, Mycobacterium
AIDLLPRLSPVPGDQEGSNF

SEQ ID NO: 1258353 - protein, 31 aa, Mycobacterium
AIDMSLADARAWIEYGLKRTFVFRETATWPD

SEQ ID NO: 1258354 - protein, 17 aa, Mycobacterium
AIDSGFDAVEIHLGHNY

SEQ ID NO: 1258355 - protein, 19 aa, Mycobacterium
AIDVCGPVSESITYSMPTS

SEQ ID NO: 1258356 - protein, 17 aa, Mycobacterium
AIEACARQLFVHPNTVR

SEQ ID NO: 1258357 - protein, 21 aa, Mycobacterium
AIEAHYGRPMDMEWAKDGLDG

SEQ ID NO: 1258358 - protein, 17 aa, Mycobacterium
AIEEIAAGWVLDLLGLP

SEQ ID NO: 1258359 - protein, 25 aa, Mycobacterium
AIEEMLRWTSPVNVFTRTATRDTEV

SEQ ID NO: 1258360 - protein, 21 aa, Mycobacterium
AIESGEEWVVLDAASLEIEPV

SEQ ID NO: 1258361 - protein, 26 aa, Mycobacterium
AIETPWSVLRWGRIIAEKTDIPPGVV

SEQ ID NO: 1258362 - protein, 19 aa, Mycobacterium
AIETTPARKLREIRMALTL

SEQ ID NO: 1258363 - protein, 20 aa, Mycobacterium
AIGAMMGYFAELIERRRREP

SEQ ID NO: 1258364 - protein, 19 aa, Mycobacterium
AIGARFPQIGWNITPGNSS

SEQ ID NO: 1258365 - protein, 29 aa, Mycobacterium
AIGGLAYPLPVAVICRLLGVPLEDEPQFS

SEQ ID NO: 1258366 - protein, 20 aa, Mycobacterium
AIGKAAPVGLFVETFGSETV

SEQ ID NO: 1258367 - protein, 25 aa, Mycobacterium
AIGLHARPAAIIAEAVVEAGVPVTL

SEQ ID NO: 1258368 - protein, 17 aa, Mycobacterium
AIGQHWMYDGKHVLIVF

SEQ ID NO: 1258369 - protein, 23 aa, Mycobacterium
AIGRPRVPVEVNHGPFLTLGIHI

SEQ ID NO: 1258370 - protein, 21 aa, Mycobacterium
AIHEAAGRRQTLVVTHNANLA

SEQ ID NO: 1258371 - protein, 18 aa, Mycobacterium
AIHGRVCYHPCETVCNRG

SEQ ID NO: 1258372 - protein, 33 aa, Mycobacterium
AIHYARKRGLPVLGLCLGLQCIVIEAARSVGLT

SEQ ID NO: 1258373 - protein, 32 aa, Mycobacterium
AIHYRIDQGFDHFKVSLSIGVMKMVRSDIASS

SEQ ID NO: 1258374 - protein, 28 aa, Mycobacterium
AILERLRALPLAPFRDSYAYTNFGLTAA

SEQ ID NO: 1258375 - protein, 19 aa, Mycobacterium
AILPPRLGQQTAVTGASGT

SEQ ID NO: 1258376 - protein, 21 aa, Mycobacterium
AILRGVMRVFEDFRYVREIAD

SEQ ID NO: 1258377 - protein, 24 aa, Mycobacterium
AINGICCGAGLDWVTTGDIVIASD

SEQ ID NO: 1258378 - protein, 28 aa, Mycobacterium
AIPDEKFRYGFAIAPELVRTVVRDREPD

SEQ ID NO: 1258379 - protein, 17 aa, Mycobacterium
AIPHGMVGLVHPRSGLA

SEQ ID NO: 1258380 - protein, 19 aa, Mycobacterium
AIPLWKRPQDGAVITGWDY

SEQ ID NO: 1258381 - protein, 18 aa, Mycobacterium
AIQARVSEMISLINHLEK

SEQ ID NO: 1258382 - protein, 19 aa, Mycobacterium
AIQLAVYRLAWAQLSGCPV

SEQ ID NO: 1258383 - protein, 24 aa, Mycobacterium
AIQVCAALDRALELSIEHTTSREQ

SEQ ID NO: 1258384 - protein, 19 aa, Mycobacterium
AIQVPPNGFPVILGPDHPV

SEQ ID NO: 1258385 - protein, 24 aa, Mycobacterium
AIRALCPAAKIFGVEPELAADTAE

SEQ ID NO: 1258386 - protein, 17 aa, Mycobacterium
AIRARDAVMLGLNGHRW

SEQ ID NO: 1258387 - protein, 22 aa, Mycobacterium
AIRDAFDYRIIVETGATRLAAE

SEQ ID NO: 1258388 - protein, 26 aa, Mycobacterium
AIRGISKAAAMEWARDDIRVNVVCPF

SEQ ID NO: 1258389 - protein, 17 aa, Mycobacterium
AIRHIKARHPATRILAL

SEQ ID NO: 1258390 - protein, 18 aa, Mycobacterium
AIRLALAATGRRDVVAMR

SEQ ID NO: 1258391 - protein, 24 aa, Mycobacterium
AIRLGKAFEGWVLVVVPSAEPGGH

SEQ ID NO: 1258392 - protein, 23 aa, Mycobacterium
AIRLTRPGGVVLYATCSPHLAET

SEQ ID NO: 1258393 - protein, 24 aa, Mycobacterium
AIRLTRPGGVVLYATCSPHLAETA

SEQ ID NO: 1258394 - protein, 20 aa, Mycobacterium
AIRREAFRLFETQGYANTTI

SEQ ID NO: 1258395 - protein, 19 aa, Mycobacterium
AISACRRAMRIRRDTRAPV

SEQ ID NO: 1258396 - protein, 24 aa, Mycobacterium
AISAGLMLIWACDLIVASDDARFS

SEQ ID NO: 1258397 - protein, 20 aa, Mycobacterium
AISAGTRVHAHWVDEPVGAI

SEQ ID NO: 1258398 - protein, 18 aa, Mycobacterium
AISGHIAEAMAIAGLPPS

SEQ ID NO: 1258399 - protein, 24 aa, Mycobacterium
AISSARTAAQFGIEPKVAMLSYST

SEQ ID NO: 1258400 - protein, 19 aa, Mycobacterium
AITRTLLRDLLPPQLHRLD

SEQ ID NO: 1258401 - protein, 17 aa, Mycobacterium
AITTELPERCVIDGEII

SEQ ID NO: 1258402 - protein, 24 aa, Mycobacterium
AIVIPEEMIHYGVSKTALLALSRG

SEQ ID NO: 1258403 - protein, 25 aa, Mycobacterium
AIVKGLRTGTDFEYELQMAQMNNHI

SEQ ID NO: 1258404 - protein, 18 aa, Mycobacterium
AIVLAGLARRSAAVPAAE

SEQ ID NO: 1258405 - protein, 24 aa, Mycobacterium
AIVRELRVDFDWVGTVLQSHLKRA

SEQ ID NO: 1258406 - protein, 22 aa, Mycobacterium
AIVRRAPERIGYLHLKQVDPEV

SEQ ID NO: 1258407 - protein, 17 aa, Mycobacterium
AIVRRLADGEARVVDLI

SEQ ID NO: 1258408 - protein, 32 aa, Mycobacterium
AIVWAIGYRPDYRWIEASAFDGGGRPMQNRGV

SEQ ID NO: 1258409 - protein, 19 aa, Mycobacterium
AKAAEWDAEPVVKRTIGSD

SEQ ID NO: 1258410 - protein, 22 aa, Mycobacterium
AKAALDGWVQRMGRSMAVGQRF

SEQ ID NO: 1258411 - protein, 23 aa, Mycobacterium
AKADASAGWTVMIGADFAPVFGR

SEQ ID NO: 1258412 - protein, 22 aa, Mycobacterium
AKAEDWPAVSRLIRRAGADGIG

SEQ ID NO: 1258413 - protein, 17 aa, Mycobacterium
AKAGAAVARMQGRGETL

SEQ ID NO: 1258414 - protein, 17 aa, Mycobacterium
AKAHGFDPADYLSHDDV

SEQ ID NO: 1258415 - protein, 17 aa, Mycobacterium
AKAIAKLGFGYDDVAAL

SEQ ID NO: 1258416 - protein, 19 aa, Mycobacterium
AKAKAKFAEREGVNLTYLP

SEQ ID NO: 1258417 - protein, 22 aa, Mycobacterium
AKAMAGPLLAMMSQMGGMAFGS

SEQ ID NO: 1258418 - protein, 25 aa, Mycobacterium
AKANLGWGYGVHVCLGMHLARLEMR

SEQ ID NO: 1258419 - protein, 22 aa, Mycobacterium
AKAQGIPPQFLVDILSDLRTDR

SEQ ID NO: 1258420 - protein, 21 aa, Mycobacterium
AKARLEVMDAYGIQAAAIFPN

SEQ ID NO: 1258421 - protein, 21 aa, Mycobacterium
AKATLAALVARHGVELIAIGN

SEQ ID NO: 1258422 - protein, 17 aa, Mycobacterium
AKAVIALAERFPDSRIT

SEQ ID NO: 1258423 - protein, 18 aa, Mycobacterium
AKAVLSLIVAAVIDELDL

SEQ ID NO: 1258424 - protein, 23 aa, Mycobacterium
AKAWYKLMHRDMGPVSRYLGPWV

SEQ ID NO: 1258425 - protein, 20 aa, Mycobacterium
AKAYLAHPVLGPRLRECAEL

SEQ ID NO: 1258426 - protein, 22 aa, Mycobacterium
AKDAPAPERLRVHSLARVLGTT

SEQ ID NO: 1258427 - protein, 21 aa, Mycobacterium
AKDLKQRPAVIEAAAQAAGAD

SEQ ID NO: 1258428 - protein, 18 aa, Mycobacterium
AKDPAAVWEAMTPQRRRT

SEQ ID NO: 1258429 - protein, 25 aa, Mycobacterium
AKDRALELLEAVGLPEPQMRLHAYP

SEQ ID NO: 1258430 - protein, 18 aa, Mycobacterium
AKEALNFIDIQPVNARYR

SEQ ID NO: 1258431 - protein, 17 aa, Mycobacterium
AKEAPGWHVTTTDTDGE

SEQ ID NO: 1258432 - protein, 18 aa, Mycobacterium
AKEAPGWTVTTSDDGGEH

SEQ ID NO: 1258433 - protein, 22 aa, Mycobacterium
AKELKKRGFRFVGPTTAYALMQ

SEQ ID NO: 1258434 - protein, 22 aa, Mycobacterium
AKELKRRGFRFVGPTTAYALMQ

SEQ ID NO: 1258435 - protein, 24 aa, Mycobacterium
AKERAFEVLDKLQIVDISNNLGDA

SEQ ID NO: 1258436 - protein, 20 aa, Mycobacterium
AKFAALLGAASVHLVTDKAA

SEQ ID NO: 1258437 - protein, 25 aa, Mycobacterium
AKFAANIPFPKRLGAPDEFADAAAF

SEQ ID NO: 1258438 - protein, 17 aa, Mycobacterium
AKFAEREGVNLTYLPFI

SEQ ID NO: 1258439 - protein, 17 aa, Mycobacterium
AKFASAVAKNPFVGDPI

SEQ ID NO: 1258440 - protein, 25 aa, Mycobacterium
AKFPRLKRLAEFNIDAVPGIAPATI

SEQ ID NO: 1258441 - protein, 19 aa, Mycobacterium
AKFVKRFGAVGDELRRAAS

SEQ ID NO: 1258442 - protein, 23 aa, Mycobacterium
AKGESPGRWMGRGLAALSDTGRC

SEQ ID NO: 1258443 - protein, 25 aa, Mycobacterium
AKGETSLVKFHWKPVAGVHSLVWEE

SEQ ID NO: 1258444 - protein, 25 aa, Mycobacterium
AKGMAFAVPLWFVVYDGCLHAATSA

SEQ ID NO: 1258445 - protein, 19 aa, Mycobacterium
AKGMAPVPIFTGGTDESIS

SEQ ID NO: 1258446 - protein, 19 aa, Mycobacterium
AKGMEFSRVILAGADDKHV

SEQ ID NO: 1258447 - protein, 25 aa, Mycobacterium
AKGMERRALELARAAAEIARQSGQY

SEQ ID NO: 1258448 - protein, 30 aa, Mycobacterium
AKGNVIAWLYNQRRFEVPSDQIANTMKLAI

SEQ ID NO: 1258449 - protein, 25 aa, Mycobacterium
AKHLARRCALNALAAVDALVGIDSV

SEQ ID NO: 1258450 - protein, 19 aa, Mycobacterium
AKHPLHLDIPVTIAGMSFG

SEQ ID NO: 1258451 - protein, 25 aa, Mycobacterium
AKIVAERRLWLAVLKAQAELGVGVP

SEQ ID NO: 1258452 - protein, 31 aa, Mycobacterium
AKKPMPPLVVFKWGNVTSFPAFVTQVSAKYT

SEQ ID NO: 1258453 - protein, 21 aa, Mycobacterium
AKKVDGGWRVTGQKVWTSLAH

SEQ ID NO: 1258454 - protein, 21 aa, Mycobacterium
AKLDAAAVLHRLSLAHPVRQF

SEQ ID NO: 1258455 - protein, 23 aa, Mycobacterium
AKLFAEAGFPPGVINVVTGWGPE

SEQ ID NO: 1258456 - protein, 18 aa, Mycobacterium
AKLFLADRPDEFVQVPFG

SEQ ID NO: 1258457 - protein, 21 aa, Mycobacterium
AKLLKSCDVMPESLTARRNLS

SEQ ID NO: 1258458 - protein, 18 aa, Mycobacterium
AKLLRNGTLKTYAGFPHG

SEQ ID NO: 1258459 - protein, 30 aa, Mycobacterium
AKLRADRSLIPGFVEEALRFESPIRGDFRL

SEQ ID NO: 1258460 - protein, 17 aa, Mycobacterium
AKLRWLADHEPVHADAT

SEQ ID NO: 1258461 - protein, 26 aa, Mycobacterium
AKLSAAHPKLGLLVLTTFLDEDLVVR

SEQ ID NO: 1258462 - protein, 21 aa, Mycobacterium
AKLSAKRGLHAARLLEKLQAA

SEQ ID NO: 1258463 - protein, 17 aa, Mycobacterium
AKLVRCAHGAIHDVLVD

SEQ ID NO: 1258464 - protein, 18 aa, Mycobacterium
AKMELGLAAAGRASAVER

SEQ ID NO: 1258465 - protein, 18 aa, Mycobacterium
AKMGPEYKELKGLVRREG

SEQ ID NO: 1258466 - protein, 17 aa, Mycobacterium
AKMIGAPIFHVNGDDPE

SEQ ID NO: 1258467 - protein, 17 aa, Mycobacterium
AKMPKRRRTRAADQAAR

SEQ ID NO: 1258468 - protein, 22 aa, Mycobacterium
AKPAGADRLRRFGADRLIDYID

SEQ ID NO: 1258469 - protein, 26 aa, Mycobacterium
AKPAGADRLRRFGADRLIDYIDYTTT

SEQ ID NO: 1258470 - protein, 20 aa, Mycobacterium
AKPEDIGWATAFLASDAASY

SEQ ID NO: 1258471 - protein, 22 aa, Mycobacterium
AKPEWFYIVKFAMSDLWHGYTG

SEQ ID NO: 1258472 - protein, 19 aa, Mycobacterium
AKPEYWLSQQGRLTHPVVL

SEQ ID NO: 1258473 - protein, 30 aa, Mycobacterium
AKPFPKACPAPGVMQGCLESTSGLIMLPDS

SEQ ID NO: 1258474 - protein, 17 aa, Mycobacterium
AKPGYGRVGEAMSGAVH

SEQ ID NO: 1258475 - protein, 20 aa, Mycobacterium
AKPREIHVVPELPKTRSGKI

SEQ ID NO: 1258476 - protein, 28 aa, Mycobacterium
AKPRELRRLKSLLRRSGRVLQSGPDITN

SEQ ID NO: 1258477 - protein, 20 aa, Mycobacterium
AKPTPWSICTSARHRVWSSP

SEQ ID NO: 1258478 - protein, 24 aa, Mycobacterium
AKQRGHKGLAYVLVGEDGELGGPV

SEQ ID NO: 1258479 - protein, 18 aa, Mycobacterium
AKQTPIIAAGLKTVMGMQ

SEQ ID NO: 1258480 - protein, 18 aa, Mycobacterium
AKRASASRWLRAADVSSI

SEQ ID NO: 1258481 - protein, 20 aa, Mycobacterium
AKRGLPEGIPVTSLTVDGRG

SEQ ID NO: 1258482 - protein, 20 aa, Mycobacterium
AKRGLVGLMQVWANELAQHW

SEQ ID NO: 1258483 - protein, 21 aa, Mycobacterium
AKRKAVDLMARVGIPQPESRL

SEQ ID NO: 1258484 - protein, 28 aa, Mycobacterium
AKRLAMHKMAFEVAWRILQVTPVNATAL

SEQ ID NO: 1258485 - protein, 24 aa, Mycobacterium
AKRLVDFAAGLAFALRGSFDKVAT

SEQ ID NO: 1258486 - protein, 25 aa, Mycobacterium
AKRRRRGRRGRGRGRGEQNGDESSA

SEQ ID NO: 1258487 - protein, 22 aa, Mycobacterium
AKRTLAVAVYNHYKRIQAGEKA

SEQ ID NO: 1258488 - protein, 20 aa, Mycobacterium
AKRVDQGRIVVGRKIGLTSE

SEQ ID NO: 1258489 - protein, 26 aa, Mycobacterium
AKSRPSGNWFPFAASDTIRHKPVGAS

SEQ ID NO: 1258490 - protein, 17 aa, Mycobacterium
AKTGIYYARSWREYLAG

SEQ ID NO: 1258491 - protein, 18 aa, Mycobacterium
AKTGTLIVTSSRPVDDAQ

SEQ ID NO: 1258492 - protein, 20 aa, Mycobacterium
AKTIFWNGPMGVFEFPAFAA

SEQ ID NO: 1258493 - protein, 18 aa, Mycobacterium
AKTLELFGHKGVSGKPHP

SEQ ID NO: 1258494 - protein, 23 aa, Mycobacterium
AKTLRRYRYGPGVAKVDFVLSGE

SEQ ID NO: 1258495 - protein, 20 aa, Mycobacterium
AKTLWAHRINVESGEFVEGD

SEQ ID NO: 1258496 - protein, 18 aa, Mycobacterium
AKTWEFQALLKARPAAGD

SEQ ID NO: 1258497 - protein, 25 aa, Mycobacterium
AKVAMNVMLRRTFKATLELTAPAAL

SEQ ID NO: 1258498 - protein, 21 aa, Mycobacterium
AKVDALRQCVPLVARIRDYAL

SEQ ID NO: 1258499 - protein, 17 aa, Mycobacterium
AKVESYVALGISEGARL

SEQ ID NO: 1258500 - protein, 19 aa, Mycobacterium
AKVFLPWAAFSEERSAAIR

SEQ ID NO: 1258501 - protein, 33 aa, Mycobacterium
AKVGAVGVPVNWRLAAPEMRHIIADSGAKIVVV

SEQ ID NO: 1258502 - protein, 19 aa, Mycobacterium
AKVLGGLVPAVARLHDLDP

SEQ ID NO: 1258503 - protein, 24 aa, Mycobacterium
AKVLPEPVLMRLVSLATRLTPTKE

SEQ ID NO: 1258504 - protein, 18 aa, Mycobacterium
AKVNFGFDPYFPRIDLRW

SEQ ID NO: 1258505 - protein, 19 aa, Mycobacterium
AKVPNFLPLLAERYARQQL

SEQ ID NO: 1258506 - protein, 19 aa, Mycobacterium
AKVSRQVFYRHFRDRDDAV

SEQ ID NO: 1258507 - protein, 24 aa, Mycobacterium
AKVTGIAVGAGWNLALGCDLVVAT

SEQ ID NO: 1258508 - protein, 24 aa, Mycobacterium
AKVVCVRPAPVPGVVKPRSLGDPV

SEQ ID NO: 1258509 - protein, 19 aa, Mycobacterium
AKVWRGETKLGEKYDTVEI

SEQ ID NO: 1258510 - protein, 26 aa, Mycobacterium
AKWLKVTNGIPWRRPIASLNYLLSSH

SEQ ID NO: 1258511 - protein, 26 aa, Mycobacterium
AKYEHELCAFDGLGLSDLDMDSALTY

SEQ ID NO: 1258512 - protein, 27 aa, Mycobacterium
AKYKSEPWARLGVNVEHNFEPLYIISP

SEQ ID NO: 1258513 - protein, 25 aa, Mycobacterium
AKYPDRLTAIHWLESVQGLPSVSAL

SEQ ID NO: 1258514 - protein, 20 aa, Mycobacterium
AKYTRAFRSWSRQFYPEPSL

SEQ ID NO: 1258515 - protein, 18 aa, Mycobacterium
AKYVPVARLGAFARSGMG

SEQ ID NO: 1258516 - protein, 24 aa, Mycobacterium
ALAAAFTAMAWTIVKLATLHRTVK

SEQ ID NO: 1258517 - protein, 19 aa, Mycobacterium
ALAAEGAWVRSDGDGKPPI

SEQ ID NO: 1258518 - protein, 37 aa, Mycobacterium
ALAAEICDGWLPIFYSPRIAAMYNEWLDEGFARPGAR

SEQ ID NO: 1258519 - protein, 22 aa, Mycobacterium
ALAAGAGARWASRVTGRGAGAM

SEQ ID NO: 1258520 - protein, 18 aa, Mycobacterium
ALAALNPVMEGGIHTAGT

SEQ ID NO: 1258521 - protein, 19 aa, Mycobacterium
ALAAWSLVHGFALLWLNGA

SEQ ID NO: 1258522 - protein, 20 aa, Mycobacterium
ALAAWSLVHGFIMLWLNDLI

SEQ ID NO: 1258523 - protein, 21 aa, Mycobacterium
ALACGVGSFAHHTVVHEASCV

SEQ ID NO: 1258524 - protein, 22 aa, Mycobacterium
ALACMREWKFTQADLERTNVHG

SEQ ID NO: 1258525 - protein, 18 aa, Mycobacterium
ALACNRSAGVMGVTVSAT

SEQ ID NO: 1258526 - protein, 19 aa, Mycobacterium
ALADARWDLAITASGQEPV

SEQ ID NO: 1258527 - protein, 17 aa, Mycobacterium
ALADGVIDCVATDHAPH

SEQ ID NO: 1258528 - protein, 21 aa, Mycobacterium
ALAEAALRWGPLSEARLTRAL

SEQ ID NO: 1258529 - protein, 25 aa, Mycobacterium
ALAEAGLHWRQIQLVAGADTIRNGY

SEQ ID NO: 1258530 - protein, 17 aa, Mycobacterium
ALAEARLLAPHWPPPHG

SEQ ID NO: 1258531 - protein, 17 aa, Mycobacterium
ALAEEWDERYTSLADRI

SEQ ID NO: 1258532 - protein, 17 aa, Mycobacterium
ALAEGWAVSVPDHEGTS

SEQ ID NO: 1258533 - protein, 23 aa, Mycobacterium
ALAEKEVRLMWDAASAGEPMSPL

SEQ ID NO: 1258534 - protein, 19 aa, Mycobacterium
ALAFARAGADVVISDVDEA

SEQ ID NO: 1258535 - protein, 28 aa, Mycobacterium
ALAFQEPRLFPWRDVRTNVVYGLTRARL

SEQ ID NO: 1258536 - protein, 22 aa, Mycobacterium
ALAGITGGLGWEQAADTVIVSG

SEQ ID NO: 1258537 - protein, 25 aa, Mycobacterium
ALAGLGIRPGDRVLLQLPNSVRFAV

SEQ ID NO: 1258538 - protein, 18 aa, Mycobacterium
ALAGRRADVVYLGVGQLG

SEQ ID NO: 1258539 - protein, 24 aa, Mycobacterium
ALAGYPGKLPFLAPFNDGLPDLLA

SEQ ID NO: 1258540 - protein, 19 aa, Mycobacterium
ALAHAWRSSGGHVIGLAPT

SEQ ID NO: 1258541 - protein, 25 aa, Mycobacterium
ALAHLDRIALLYAEDPDLCRAVFVL

SEQ ID NO: 1258542 - protein, 18 aa, Mycobacterium
ALAKLADQFVTAWVPEDG

SEQ ID NO: 1258543 - protein, 18 aa, Mycobacterium
ALAKMAAVEVFTRTDGVM

SEQ ID NO: 1258544 - protein, 25 aa, Mycobacterium
ALAKSGIPDAMFDEWFRPAVESAAI

SEQ ID NO: 1258545 - protein, 18 aa, Mycobacterium
ALALAERIAVNAPLSVQA

SEQ ID NO: 1258546 - protein, 19 aa, Mycobacterium
ALALKLINNLLFAANAQLL

SEQ ID NO: 1258547 - protein, 22 aa, Mycobacterium
ALALRGRIPLAPRVLGPRESAG

SEQ ID NO: 1258548 - protein, 24 aa, Mycobacterium
ALAQCLRGGTGDEVARLVLTASGG

SEQ ID NO: 1258549 - protein, 17 aa, Mycobacterium
ALARAGASVAVAARSEQ

SEQ ID NO: 1258550 - protein, 18 aa, Mycobacterium
ALARAGFHTLKLQTYLTA

SEQ ID NO: 1258551 - protein, 17 aa, Mycobacterium
ALARAGLDPADIDLIEL

SEQ ID NO: 1258552 - protein, 21 aa, Mycobacterium
ALAREAVDAFGSHELSDEEWE

SEQ ID NO: 1258553 - protein, 18 aa, Mycobacterium
ALARELAAEFDIYVLDFP

SEQ ID NO: 1258554 - protein, 23 aa, Mycobacterium
ALARHPIVMPVAGHGLRVIIDQA

SEQ ID NO: 1258555 - protein, 20 aa, Mycobacterium
ALARRGCVYVSVNYRLGPLG

SEQ ID NO: 1258556 - protein, 23 aa, Mycobacterium
ALARRIAPVPVRMADERLTTVSA

SEQ ID NO: 1258557 - protein, 17 aa, Mycobacterium
ALARSGLLAGIDRPGMP

SEQ ID NO: 1258558 - protein, 18 aa, Mycobacterium
ALASGAGADAVWPGILGF

SEQ ID NO: 1258559 - protein, 28 aa, Mycobacterium
ALAVARDRFAGAMPMLFTAQRTAEVRRV

SEQ ID NO: 1258560 - protein, 25 aa, Mycobacterium
ALAYAIGGLCEVCLGSRERGIGHIR

SEQ ID NO: 1258561 - protein, 21 aa, Mycobacterium
ALAYMDLRAGTPMRQIPVDTV

SEQ ID NO: 1258562 - protein, 17 aa, Mycobacterium
ALCADGWVQTFPAGQLC

SEQ ID NO: 1258563 - protein, 24 aa, Mycobacterium
ALCDGVVGFSGWLSAEAIDRLARA

SEQ ID NO: 1258564 - protein, 18 aa, Mycobacterium
ALCPVAIVRSHRPHRRDR

SEQ ID NO: 1258565 - protein, 19 aa, Mycobacterium
ALDAACAVQGEWAATPARK

SEQ ID NO: 1258566 - protein, 26 aa, Mycobacterium
ALDAEDSWEGFAWFVWQLCEMTATDR

SEQ ID NO: 1258567 - protein, 17 aa, Mycobacterium
ALDAGVEHFGRLDIVCA

SEQ ID NO: 1258568 - protein, 18 aa, Mycobacterium
ALDALFTHDAVIWHNYDQ

SEQ ID NO: 1258569 - protein, 19 aa, Mycobacterium
ALDAVRWAVDEAVGRSVPL

SEQ ID NO: 1258570 - protein, 23 aa, Mycobacterium
ALDDCFDGYKWLRELGYEPDQIV

SEQ ID NO: 1258571 - protein, 17 aa, Mycobacterium
ALDELAYLLGKHPCVAE

SEQ ID NO: 1258572 - protein, 18 aa, Mycobacterium
ALDGFTLHIEPGELVALL

SEQ ID NO: 1258573 - protein, 33 aa, Mycobacterium
ALDGICGPGGWVPRGALGNVPVRFPVSPPAEDR

SEQ ID NO: 1258574 - protein, 17 aa, Mycobacterium
ALDHFRVAMTAAGWNTS

SEQ ID NO: 1258575 - protein, 17 aa, Mycobacterium
ALDKAGVIPAIVAPAGG

SEQ ID NO: 1258576 - protein, 22 aa, Mycobacterium
ALDKLRLESFRNKDLDVDTSDL

SEQ ID NO: 1258577 - protein, 18 aa, Mycobacterium
ALDLAWRSLAEVGNLSSS

SEQ ID NO: 1258578 - protein, 25 aa, Mycobacterium
ALDNGKRAGKLVLMGPGGLSVNLFS

SEQ ID NO: 1258579 - protein, 17 aa, Mycobacterium
ALDPARHVIIYLANPTI

SEQ ID NO: 1258580 - protein, 20 aa, Mycobacterium
ALDPAVRVLVEMGYDRTVNP

SEQ ID NO: 1258581 - protein, 18 aa, Mycobacterium
ALDPESYAVGLPWDSYES

SEQ ID NO: 1258582 - protein, 25 aa, Mycobacterium
ALDPFLRSVIETGYDRPVGSGEYPD

SEQ ID NO: 1258583 - protein, 25 aa, Mycobacterium
ALDRLTARHDVMWAMIADMPAVEAG

SEQ ID NO: 1258584 - protein, 18 aa, Mycobacterium
ALDRSLARWLAEARVGEG

SEQ ID NO: 1258585 - protein, 22 aa, Mycobacterium
ALDSAFRSGLRNAFSGIIIGAG

SEQ ID NO: 1258586 - protein, 25 aa, Mycobacterium
ALDTARAEWWYSRAATVMGGTAEVQ

SEQ ID NO: 1258587 - protein, 18 aa, Mycobacterium
ALDTFPIEFREGMAARAD

SEQ ID NO: 1258588 - protein, 17 aa, Mycobacterium
ALEAATRHKARFGDGVW

SEQ ID NO: 1258589 - protein, 23 aa, Mycobacterium
ALEALRGVEAWDTAAIEEALKGA

SEQ ID NO: 1258590 - protein, 19 aa, Mycobacterium
ALEALTAWIDGYRLNAERN

SEQ ID NO: 1258591 - protein, 19 aa, Mycobacterium
ALEDAWRAAMWAKAAGHGI

SEQ ID NO: 1258592 - protein, 19 aa, Mycobacterium
ALEDYRRILAAGVNVVGSS

SEQ ID NO: 1258593 - protein, 17 aa, Mycobacterium
ALEEGGAMECTTIVAAP

SEQ ID NO: 1258594 - protein, 17 aa, Mycobacterium
ALEEIAEAAGFTRGAIY

SEQ ID NO: 1258595 - protein, 19 aa, Mycobacterium
ALEFATLMLMERLTPAERA

SEQ ID NO: 1258596 - protein, 26 aa, Mycobacterium
ALEGPRPPGALPFDDPGLFARVAPLA

SEQ ID NO: 1258597 - protein, 25 aa, Mycobacterium
ALEGRARRLVACWGNNDGAELRRRL

SEQ ID NO: 1258598 - protein, 22 aa, Mycobacterium
ALEHCIPYYVDLFGRMKAEAAQ

SEQ ID NO: 1258599 - protein, 19 aa, Mycobacterium
ALEIIDSRIADWRISIADT

SEQ ID NO: 1258600 - protein, 18 aa, Mycobacterium
ALEKAVAGGVDFDSAVQT

SEQ ID NO: 1258601 - protein, 20 aa, Mycobacterium
ALELARGHGDYIWVMDADDL

SEQ ID NO: 1258602 - protein, 24 aa, Mycobacterium
ALELDWYEHLGLCAKGEAEHLLRS

SEQ ID NO: 1258603 - protein, 25 aa, Mycobacterium
ALELDWYEHLGLCAKGEAEHLLRSG

SEQ ID NO: 1258604 - protein, 22 aa, Mycobacterium
ALELIKSLNYVLARGGNPSPWR

SEQ ID NO: 1258605 - protein, 21 aa, Mycobacterium
ALELRLQYGVGRPERRYRIAG

SEQ ID NO: 1258606 - protein, 24 aa, Mycobacterium
ALEMRADLITLCIGMNDMTRPGPG

SEQ ID NO: 1258607 - protein, 17 aa, Mycobacterium
ALEQHPAPALPPRPRAP

SEQ ID NO: 1258608 - protein, 20 aa, Mycobacterium
ALEQPELWGGLADVTTGDAE

SEQ ID NO: 1258609 - protein, 22 aa, Mycobacterium
ALERAGAHHIVWSTLEDTRGQF

SEQ ID NO: 1258610 - protein, 24 aa, Mycobacterium
ALERECTRLVALGATRLERHEAIS

SEQ ID NO: 1258611 - protein, 19 aa, Mycobacterium
ALERGMDALVVVGGDGIIS

SEQ ID NO: 1258612 - protein, 18 aa, Mycobacterium
ALERLDIKMVVLLHEMLR

SEQ ID NO: 1258613 - protein, 22 aa, Mycobacterium
ALERLETTLALIEGWVQTVVSD

SEQ ID NO: 1258614 - protein, 18 aa, Mycobacterium
ALESLGVLRRVVGGAIAV

SEQ ID NO: 1258615 - protein, 18 aa, Mycobacterium
ALETIEYRSPPLARDPGA

SEQ ID NO: 1258616 - protein, 18 aa, Mycobacterium
ALEWDIRNGVIARKGAAY

SEQ ID NO: 1258617 - protein, 18 aa, Mycobacterium
ALEYGLQALHAFENAGGD

SEQ ID NO: 1258618 - protein, 17 aa, Mycobacterium
ALFAANLETSFFMSQAV

SEQ ID NO: 1258619 - protein, 38 aa, Mycobacterium; identical to SEQ ID NO: 620290

SEQ ID NO: 1258620 - protein, 22 aa, Mycobacterium
ALFLEDRHRLFASYQDYDVAEL

SEQ ID NO: 1258621 - protein, 28 aa, Mycobacterium
ALFPSIREIYCLMVLLVCERGFNLSVMD

SEQ ID NO: 1258622 - protein, 18 aa, Mycobacterium
ALFTRHGYAGTSLQMIAD

SEQ ID NO: 1258623 - protein, 28 aa, Mycobacterium
ALGALPEGYRLVLYYAEVEGYTYAETAA

SEQ ID NO: 1258624 - protein, 21 aa, Mycobacterium
ALGAQGAWTGSQWVMVEESEN

SEQ ID NO: 1258625 - protein, 26 aa, Mycobacterium
ALGATCGGVRVWSLYVPNGRTVDSPH

SEQ ID NO: 1258626 - protein, 23 aa, Mycobacterium
ALGDEVLSFVMANKEALGVDHAI

SEQ ID NO: 1258627 - protein, 23 aa, Mycobacterium
ALGDLPLVYPFLVNDPGEGTQAK

SEQ ID NO: 1258628 - protein, 26 aa, Mycobacterium
ALGIRGCSVSMPFKEDVLHLVDHVEA

SEQ ID NO: 1258629 - protein, 25 aa, Mycobacterium
ALGIRGCSVSMPFKQDVLDLVDEVE

SEQ ID NO: 1258630 - protein, 25 aa, Mycobacterium
ALGIRRGNIHYGFVMMSTLFLREHN

SEQ ID NO: 1258631 - protein, 18 aa, Mycobacterium
ALGLDPRETVVAFVGRIQ

SEQ ID NO: 1258632 - protein, 17 aa, Mycobacterium
ALGNRPLTVRIGYQSPN

SEQ ID NO: 1258633 - protein, 17 aa, Mycobacterium
ALGRIRGSHGVVLKAQD

SEQ ID NO: 1258634 - protein, 17 aa, Mycobacterium
ALGRLVTTVNGWTEIFP

SEQ ID NO: 1258635 - protein, 17 aa, Mycobacterium
ALGRRYLAECLAVARAD

SEQ ID NO: 1258636 - protein, 23 aa, Mycobacterium
ALGSRSGTLAGTRTAGDTISELL

SEQ ID NO: 1258637 - protein, 17 aa, Mycobacterium
ALHALGITMFTVGVNGP

SEQ ID NO: 1258638 - protein, 18 aa, Mycobacterium
ALHLVRLSLWDTVGDVRL

SEQ ID NO: 1258639 - protein, 18 aa, Mycobacterium
ALHMARRGVEVEIFTRAT

SEQ ID NO: 1258640 - protein, 20 aa, Mycobacterium
ALHRGRGIALMRALMHDVTI

SEQ ID NO: 1258641 - protein, 24 aa, Mycobacterium
ALHSRLDGLITQWKRDHGDTDDTS

SEQ ID NO: 1258642 - protein, 24 aa, Mycobacterium
ALHTACRKHGALLIVDEAHGLGVR

SEQ ID NO: 1258643 - protein, 19 aa, Mycobacterium
ALHVLRLVATGVFDRLPEL

SEQ ID NO: 1258644 - protein, 17 aa, Mycobacterium
ALHVPPRKLSVEIREVQ

SEQ ID NO: 1258645 - protein, 19 aa, Mycobacterium
ALHVPVHNIWGLRPAVLPG

SEQ ID NO: 1258646 - protein, 23 aa, Mycobacterium
ALIAHGVAVWDVLRECRRAGSLD

SEQ ID NO: 1258647 - protein, 17 aa, Mycobacterium
ALIAILLAHRSMPAGAL

SEQ ID NO: 1258648 - protein, 17 aa, Mycobacterium
ALIDLGLGLWLTEPAAK

SEQ ID NO: 1258649 - protein, 19 aa, Mycobacterium
ALIEEIRAAGPLMRTPVVW

SEQ ID NO: 1258650 - protein, 18 aa, Mycobacterium
ALISGRRSIAGSMIGGIA

SEQ ID NO: 1258651 - protein, 28 aa, Mycobacterium
ALITRLDEWWSLACIRVLRTDTEAAECL

SEQ ID NO: 1258652 - protein, 29 aa, Mycobacterium
ALKKELRLRPGDWYVIHSYAGYENKVKAN

SEQ ID NO: 1258653 - protein, 18 aa, Mycobacterium
ALKQWADAGLQVVGLDAD

SEQ ID NO: 1258654 - protein, 19 aa, Mycobacterium
ALKRHKDKPVLFLGDTTLT

SEQ ID NO: 1258655 - protein, 18 aa, Mycobacterium
ALKRSYRDQLRRHCPDIE

SEQ ID NO: 1258656 - protein, 18 aa, Mycobacterium
ALKTPLGGFLGDFMLVAF

SEQ ID NO: 1258657 - protein, 18 aa, Mycobacterium
ALKTTCPEHESAMDQAVK

SEQ ID NO: 1258658 - protein, 17 aa, Mycobacterium
ALLAAIERAACEESRAG

SEQ ID NO: 1258659 - protein, 19 aa, Mycobacterium
ALLAESWRYGGRLSALTAK

SEQ ID NO: 1258660 - protein, 17 aa, Mycobacterium
ALLAHLIGVLARVAALG

SEQ ID NO: 1258661 - protein, 17 aa, Mycobacterium
ALLANGVRYLVDPRVVD

SEQ ID NO: 1258662 - protein, 18 aa, Mycobacterium
ALLAQRWLHVTGTGAEAL

SEQ ID NO: 1258663 - protein, 17 aa, Mycobacterium
ALLAYRLSLKGEPAPVI

SEQ ID NO: 1258664 - protein, 18 aa, Mycobacterium
ALLDACFQAVGAHSALHA

SEQ ID NO: 1258665 - protein, 19 aa, Mycobacterium
ALLDGARKVAVGAGIDDPT

SEQ ID NO: 1258666 - protein, 19 aa, Mycobacterium
ALLDGRGGLTVRRKAGRLA

SEQ ID NO: 1258667 - protein, 24 aa, Mycobacterium
ALLDIGIGWRPFRAAIDGLVDVDT

SEQ ID NO: 1258668 - protein, 19 aa, Mycobacterium
ALLDRAELVAALDELEILG

SEQ ID NO: 1258669 - protein, 25 aa, Mycobacterium
ALLDRARTAGIPVVHIQHDDGPGSP

SEQ ID NO: 1258670 - protein, 23 aa, Mycobacterium
ALLDRRLRAEIDRSAEVVRAGRR

SEQ ID NO: 1258671 - protein, 27 aa, Mycobacterium
ALLEAARWAASWGGRQPVRFVVGRRGD

SEQ ID NO: 1258672 - protein, 31 aa, Mycobacterium
ALLEAARWAASWGGRQPVRFVVGRRGDPTFE

SEQ ID NO: 1258673 - protein, 32 aa, Mycobacterium
ALLEAARWAASWGGRQPVRFVVGRRGDPTFEA

SEQ ID NO: 1258674 - protein, 31 aa, Mycobacterium
ALLEAARWAPTWGRRQPVRFVVGLRGDAPFT

SEQ ID NO: 1258675 - protein, 18 aa, Mycobacterium
ALLEAFGIYEREMFETGI

SEQ ID NO: 1258676 - protein, 22 aa, Mycobacterium
ALLELLPQITLINGYGSSETGN

SEQ ID NO: 1258677 - protein, 25 aa, Mycobacterium
ALLELRRPALLVGRPDPTGVTPDVA

SEQ ID NO: 1258678 - protein, 25 aa, Mycobacterium
ALLEPLRFPPAYRAAVLDPQATGEA

SEQ ID NO: 1258679 - protein, 21 aa, Mycobacterium
ALLERRCGITRLTEPSRRVEL

SEQ ID NO: 1258680 - protein, 19 aa, Mycobacterium
ALLGIRGRPPVSRTAGAGP

SEQ ID NO: 1258681 - protein, 21 aa, Mycobacterium
ALLILRGRAVGSFCDDDGRLC

SEQ ID NO: 1258682 - protein, 18 aa, Mycobacterium
ALLLRGKYLIDVQSVTKV

SEQ ID NO: 1258683 - protein, 26 aa, Mycobacterium
ALLNGPRYWLMSGIEKPGGTESERRT

SEQ ID NO: 1258684 - protein, 17 aa, Mycobacterium
ALLPKERLEVLFEEVAE

SEQ ID NO: 1258685 - protein, 20 aa, Mycobacterium
ALLPLLRPSDFATLPDHLPE

SEQ ID NO: 1258686 - protein, 17 aa, Mycobacterium
ALLPSPFCQELTALATD

SEQ ID NO: 1258687 - protein, 25 aa, Mycobacterium
ALLRICGGADLAAMTGFCAQAAVRR

SEQ ID NO: 1258688 - protein, 19 aa, Mycobacterium
ALLRNLGTRIARWRRAAGA

SEQ ID NO: 1258689 - protein, 25 aa, Mycobacterium
ALLRPLGERAFARLMARRSDSLLDS

SEQ ID NO: 1258690 - protein, 21 aa, Mycobacterium
ALLRQARPVLLDLGAPDAVDL

SEQ ID NO: 1258691 - protein, 25 aa, Mycobacterium
ALLSHLRDEFGLSIILITHEMEVVR

SEQ ID NO: 1258692 - protein, 26 aa, Mycobacterium
ALLSTARSWAWLSGRGYVTPDDVKAM

SEQ ID NO: 1258693 - protein, 18 aa, Mycobacterium
ALLTKHADKLESSDRDKS

SEQ ID NO: 1258694 - protein, 18 aa, Mycobacterium
ALLTRGFLLGIKRRAESR

SEQ ID NO: 1258695 - protein, 21 aa, Mycobacterium
ALLVHAASWGAMREGLTRTID

SEQ ID NO: 1258696 - protein, 17 aa, Mycobacterium
ALLVPYLLSAIRMAEAG

SEQ ID NO: 1258697 - protein, 21 aa, Mycobacterium
ALLYRMCGDRNPLHSDPDFAA

SEQ ID NO: 1258698 - protein, 18 aa, Mycobacterium
ALMAAWWHGFSRFCPEIV

SEQ ID NO: 1258699 - protein, 17 aa, Mycobacterium
ALMAYEVLRDTALQEVE

SEQ ID NO: 1258700 - protein, 23 aa, Mycobacterium
ALMKAGQFFSMIDVDALGNGGFA

SEQ ID NO: 1258701 - protein, 19 aa, Mycobacterium
ALMQGFNALDEWGRFDEAF

SEQ ID NO: 1258702 - protein, 23 aa, Mycobacterium
ALMSGWRALIVELDYERNQFHDA

SEQ ID NO: 1258703 - protein, 19 aa, Mycobacterium
ALNAQRHFHRYGTTKETLG

SEQ ID NO: 1258704 - protein, 23 aa, Mycobacterium
ALNCHLEGLVAQWKRDHNITDHT

SEQ ID NO: 1258705 - protein, 18 aa, Mycobacterium
ALNGALALAERITANGPL

SEQ ID NO: 1258706 - protein, 21 aa, Mycobacterium
ALNGVIGFKPSRGLISTVGLV

SEQ ID NO: 1258707 - protein, 23 aa, Mycobacterium
ALNNRRLSCFRAMGPAPTAGPVT

SEQ ID NO: 1258708 - protein, 21 aa, Mycobacterium
ALNRLLAERALSQEVHAMRYA

SEQ ID NO: 1258709 - protein, 20 aa, Mycobacterium
ALNVARMRLLGASVVAVESG

SEQ ID NO: 1258710 - protein, 25 aa, Mycobacterium
ALNVCAHRAAKVCRFEAGNAKTFQC

SEQ ID NO: 1258711 - protein, 23 aa, Mycobacterium
ALPCTPRGIVHLLRRYQVEIAGA

SEQ ID NO: 1258712 - protein, 24 aa, Mycobacterium
ALPDPRLTELARIFGSEKILPAPV

SEQ ID NO: 1258713 - protein, 21 aa, Mycobacterium
ALPEVAHAPAAAAAPGPAPAP

SEQ ID NO: 1258714 - protein, 22 aa, Mycobacterium
ALPFEHWLSALAEIGEAVGGDE

SEQ ID NO: 1258715 - protein, 19 aa, Mycobacterium
ALPGITRKTVFEIAGAMGI

SEQ ID NO: 1258716 - protein, 22 aa, Mycobacterium
ALPGRWPFVRGGDALRDVKSGW

SEQ ID NO: 1258717 - protein, 18 aa, Mycobacterium
ALPHLKEGAAIVATGSTA

SEQ ID NO: 1258718 - protein, 24 aa, Mycobacterium
ALPLERYPRLSGFTEANAAYVEVA

SEQ ID NO: 1258719 - protein, 22 aa, Mycobacterium
ALPLSECARLDLPPMCSADPDG

SEQ ID NO: 1258720 - protein, 25 aa, Mycobacterium
ALPMPVARDEAWRALDEHPLVEVED

SEQ ID NO: 1258721 - protein, 23 aa, Mycobacterium
ALPNGYCGLPLQQTCPHANACLT

SEQ ID NO: 1258722 - protein, 23 aa, Mycobacterium
ALPRGAALKVDRRQLLAMLEQLD

SEQ ID NO: 1258723 - protein, 23 aa, Mycobacterium
ALPRPTADLHRRDALWAAALQTA

SEQ ID NO: 1258724 - protein, 20 aa, Mycobacterium
ALPRYRLADYDNPRAPHTDS

SEQ ID NO: 1258725 - protein, 18 aa, Mycobacterium
ALPSLLLPLWDSELGKGF

SEQ ID NO: 1258726 - protein, 18 aa, Mycobacterium
ALPSYVIAELLGIPLDDG

SEQ ID NO: 1258727 - protein, 24 aa, Mycobacterium
ALPTALWTGWALRLSPPALAHSSS

SEQ ID NO: 1258728 - protein, 26 aa, Mycobacterium
ALPTYPFQRRRFWPKTSGITTDGPAV

SEQ ID NO: 1258729 - protein, 17 aa, Mycobacterium
ALPVAGIDGVYAATAPD

SEQ ID NO: 1258730 - protein, 18 aa, Mycobacterium
ALQAITFRATNYGGGLFD

SEQ ID NO: 1258731 - protein, 18 aa, Mycobacterium
ALQDGWAVRVHRAERAGA

SEQ ID NO: 1258732 - protein, 18 aa, Mycobacterium
ALQELKAVVGRQWQQMDV

SEQ ID NO: 1258733 - protein, 19 aa, Mycobacterium
ALQELKAVVGRQWQQMDVL

SEQ ID NO: 1258734 - protein, 23 aa, Mycobacterium
ALQFYTRILGFQVKHDVPMGDVR

SEQ ID NO: 1258735 - protein, 18 aa, Mycobacterium
ALQGLSYVVMDEVHFLAD

SEQ ID NO: 1258736 - protein, 23 aa, Mycobacterium
ALQKLRTRLVGAIRADCAPVIEK

SEQ ID NO: 1258737 - protein, 17 aa, Mycobacterium
ALQKYHFVEKINHVHTG

SEQ ID NO: 1258738 - protein, 22 aa, Mycobacterium
ALQRDCLALDAAVRASQDALAV

SEQ ID NO: 1258739 - protein, 19 aa, Mycobacterium
ALQVSRWTREMFCLMEGRH

SEQ ID NO: 1258740 - protein, 26 aa, Mycobacterium
ALQVSRWTREMFCLMEGRHVHPSTLY

SEQ ID NO: 1258741 - protein, 27 aa, Mycobacterium
ALRASVRPDLFAGFSVDAFPTTSMAAF

SEQ ID NO: 1258742 - protein, 22 aa, Mycobacterium
ALRAVRWFGKRSAPMTYAASKI

SEQ ID NO: 1258743 - protein, 17 aa, Mycobacterium
ALRAWATINPRVAAAQH

SEQ ID NO: 1258744 - protein, 24 aa, Mycobacterium
ALRDGLAHLGAWGILDRPVTLVPA

SEQ ID NO: 1258745 - protein, 25 aa, Mycobacterium
ALRDRLPNVFALFLAGLISDLLART

SEQ ID NO: 1258746 - protein, 20 aa, Mycobacterium
ALREDLWKALGAKADATVAG

SEQ ID NO: 1258747 - protein, 24 aa, Mycobacterium
ALRGKQMRNIMATLMLSQGTPMIA

SEQ ID NO: 1258748 - protein, 17 aa, Mycobacterium
ALRKLLLRYDGRADHAL

SEQ ID NO: 1258749 - protein, 22 aa, Mycobacterium
ALRLWDAVVAWTEFPHLYELQR

SEQ ID NO: 1258750 - protein, 18 aa, Mycobacterium
ALRMEELVMLLRRIWNLH

SEQ ID NO: 1258751 - protein, 19 aa, Mycobacterium
ALRMIRPEQVIMLGRPTLH

SEQ ID NO: 1258752 - protein, 18 aa, Mycobacterium
ALRNCGRTIVEVSDSDGI

SEQ ID NO: 1258753 - protein, 27 aa, Mycobacterium
ALRQPPVRVLGWAQAHPGRAGIRNDDF

SEQ ID NO: 1258754 - protein, 24 aa, Mycobacterium
ALRQRGMDLLEWLLGVETADGHLS

SEQ ID NO: 1258755 - protein, 18 aa, Mycobacterium
ALRQVIAAGMWFREEITA

SEQ ID NO: 1258756 - protein, 23 aa, Mycobacterium
ALRQVIGCVFQDFRLLQQKTVFE

SEQ ID NO: 1258757 - protein, 22 aa, Mycobacterium
ALRRAGLGGGEVDYLEAHGTGT

SEQ ID NO: 1258758 - protein, 17 aa, Mycobacterium
ALRRARVAATRGWDEMS

SEQ ID NO: 1258759 - protein, 22 aa, Mycobacterium
ALRREMLRDGQAFYIHNRVRTI

SEQ ID NO: 1258760 - protein, 22 aa, Mycobacterium
ALRRLLREVLRDSGRTAIVVTH

SEQ ID NO: 1258761 - protein, 23 aa, Mycobacterium
ALRRWRITELVARTRREDRWIAD

SEQ ID NO: 1258762 - protein, 17 aa, Mycobacterium
ALRSGCVVAAVRSASVG

SEQ ID NO: 1258763 - protein, 26 aa, Mycobacterium
ALRTRAIELLELVGLGHRIDHQPTKM

SEQ ID NO: 1258764 - protein, 18 aa, Mycobacterium
ALRVRRPVLRRELERAER

SEQ ID NO: 1258765 - protein, 25 aa, Mycobacterium
ALRVTRPRMAVLHAVGRHPHADTEL

SEQ ID NO: 1258766 - protein, 29 aa, Mycobacterium
ALRYPASAGPRCRDIWLVTAGAERVRTGE

SEQ ID NO: 1258767 - protein, 25 aa, Mycobacterium
ALSEPLGEQVSWWAKANLPMNAGCT

SEQ ID NO: 1258768 - protein, 26 aa, Mycobacterium
ALSEQLARSWRDVRAGDEITGPFLAG

SEQ ID NO: 1258769 - protein, 23 aa, Mycobacterium
ALSEYFSQAWALRKERLEAQGRQ

SEQ ID NO: 1258770 - protein, 33 aa, Mycobacterium
ALSGFERFPAWMWRNTVVRDFVDWLHARNSRCR

SEQ ID NO: 1258771 - protein, 20 aa, Mycobacterium
ALSGMGRLGIELDEHLNESP

SEQ ID NO: 1258772 - protein, 26 aa, Mycobacterium
ALSQARTGVFWVREMLPTPKIREILS

SEQ ID NO: 1258773 - protein, 27 aa, Mycobacterium
ALSRSEIREVVILGRRGPRDSAFSAGE

SEQ ID NO: 1258774 - protein, 24 aa, Mycobacterium
ALSTPEMFGRVAIAQTLRDITPDL

SEQ ID NO: 1258775 - protein, 24 aa, Mycobacterium
ALTARLGAAGAQVWIADRQFGVAE

SEQ ID NO: 1258776 - protein, 24 aa, Mycobacterium
ALTDEIRLGGAFILGNLERDLQYN

SEQ ID NO: 1258777 - protein, 20 aa, Mycobacterium
ALTEARIGVAPSIISLTLLP

SEQ ID NO: 1258778 - protein, 21 aa, Mycobacterium
ALTEARIGVAPSIISLTLLPK

SEQ ID NO: 1258779 - protein, 20 aa, Mycobacterium
ALTECLRLEVELAGHGHFIH

SEQ ID NO: 1258780 - protein, 25 aa, Mycobacterium
ALTERWGLAKAQGWQGVGHTRMATE

SEQ ID NO: 1258781 - protein, 19 aa, Mycobacterium
ALTGGMCWEALNNIAASRR

SEQ ID NO: 1258782 - protein, 18 aa, Mycobacterium
ALTGLRPDGEWVELLGRT

SEQ ID NO: 1258783 - protein, 21 aa, Mycobacterium
ALTGPALRWNPWSTPIPKAYL

SEQ ID NO: 1258784 - protein, 20 aa, Mycobacterium
ALTGYGLGRIEGWPDDQTID

SEQ ID NO: 1258785 - protein, 24 aa, Mycobacterium
ALTKAVGEACEFVRAAGTVEGLRE

SEQ ID NO: 1258786 - protein, 17 aa, Mycobacterium
ALTKNGWTDAFVTGAAF

SEQ ID NO: 1258787 - protein, 26 aa, Mycobacterium
ALTNALLHAGCRTTVWNRTAARADGV

SEQ ID NO: 1258788 - protein, 25 aa, Mycobacterium
ALTPDKRRTIRWVEVYMRPVTFQIV

SEQ ID NO: 1258789 - protein, 17 aa, Mycobacterium
ALTPESWYRAAHGDDAW

SEQ ID NO: 1258790 - protein, 29 aa, Mycobacterium
ALTPTLLFPFAAPRVGGDLSDAGSRSEME

SEQ ID NO: 1258791 - protein, 19 aa, Mycobacterium
ALTREWFTGTFVKPTPAQA

SEQ ID NO: 1258792 - protein, 24 aa, Mycobacterium
ALTSSAWRDAYAGTPWHKHVPARI

SEQ ID NO: 1258793 - protein, 20 aa, Mycobacterium
ALTTRARIAIAQGDPEQAER

SEQ ID NO: 1258794 - protein, 18 aa, Mycobacterium
ALTVGGPLDVEWRRRCGR

SEQ ID NO: 1258795 - protein, 17 aa, Mycobacterium
ALVARKTRRHQIEIVSR

SEQ ID NO: 1258796 - protein, 34 aa, Mycobacterium
ALVCYSHGLASYLERIAETWPRRQQPAYVGEFHA

SEQ ID NO: 1258797 - protein, 28 aa, Mycobacterium
ALVCYSHGLASYLERITAAWNRRQQPAY

SEQ ID NO: 1258798 - protein, 17 aa, Mycobacterium
ALVDFGLPGLAVDESLG

SEQ ID NO: 1258799 - protein, 19 aa, Mycobacterium
ALVFRGTPVEGGRSEIYRV

SEQ ID NO: 1258800 - protein, 17 aa, Mycobacterium
ALVRLLQFLPGGTVSES

SEQ ID NO: 1258801 - protein, 19 aa, Mycobacterium
ALVRLNQRHGFDCPGCAWP

SEQ ID NO: 1258802 - protein, 18 aa, Mycobacterium
ALVRSEVAWWMLDLAGPG

SEQ ID NO: 1258803 - protein, 23 aa, Mycobacterium
ALVSGELVASWAVYEPARPFAPL

SEQ ID NO: 1258804 - protein, 24 aa, Mycobacterium
ALVSPPYYRLVLGMPPLAAEAVDR

SEQ ID NO: 1258805 - protein, 23 aa, Mycobacterium
ALVSVEFAIEMGRCGGLGVLNGE

SEQ ID NO: 1258806 - protein, 24 aa, Mycobacterium
ALVVLAGVAAWRGDPQAEQSDVVV

SEQ ID NO: 1258807 - protein, 19 aa, Mycobacterium
ALVVPEWVGEPLIPDLGPP

SEQ ID NO: 1258808 - protein, 18 aa, Mycobacterium
ALVYYYFPTMDDLFVEVL

SEQ ID NO: 1258809 - protein, 24 aa, Mycobacterium
ALYDAGWSRYGWPEHAGGLGGPAI

SEQ ID NO: 1258810 - protein, 23 aa, Mycobacterium
ALYDEIPFGFAKEEFQQYAADKG

SEQ ID NO: 1258811 - protein, 18 aa, Mycobacterium
ALYELGMTGIPIANVNNN

SEQ ID NO: 1258812 - protein, 30 aa, Mycobacterium; identical to SEQ ID NO: 634515

SEQ ID NO: 1258813 - protein, 25 aa, Mycobacterium
AMAALRRRMPWTLVEREYRFEGPEG

SEQ ID NO: 1258814 - protein, 22 aa, Mycobacterium
AMAAPLREVRNGTTTVMLNNRD

SEQ ID NO: 1258815 - protein, 23 aa, Mycobacterium
AMAARGRGGIVIFGSGAGLAGGP

SEQ ID NO: 1258816 - protein, 22 aa, Mycobacterium
AMACADPSAVWGEHFPATDAEM

SEQ ID NO: 1258817 - protein, 17 aa, Mycobacterium
AMAEMFVEAGLPEGVLS

SEQ ID NO: 1258818 - protein, 18 aa, Mycobacterium
AMALELAALHAIERSAAE

SEQ ID NO: 1258819 - protein, 34 aa, Mycobacterium
AMAMGHVILAEFFVRQRVPFFVDYVRQYTDLPFL

SEQ ID NO: 1258820 - protein, 23 aa, Mycobacterium
AMDIFPMARRVLLTAYADTHAAI

SEQ ID NO: 1258821 - protein, 23 aa, Mycobacterium
AMDYRYPAGAVRRLDDALLAVYG

SEQ ID NO: 1258822 - protein, 19 aa, Mycobacterium
AMEKFDYAKGFKFSTYATW

SEQ ID NO: 1258823 - protein, 21 aa, Mycobacterium
AMFADVRRGLTVAAVVHGATV

SEQ ID NO: 1258824 - protein, 25 aa, Mycobacterium
AMFDRPEVRVALPGLIADTVADPQL

SEQ ID NO: 1258825 - protein, 20 aa, Mycobacterium
AMFPQRAFHALVELIEHAAE

SEQ ID NO: 1258826 - protein, 24 aa, Mycobacterium
AMFQMKFYAVALLRSRGVLPSRLR

SEQ ID NO: 1258827 - protein, 20 aa, Mycobacterium
AMFREPRQVLELDRDGDKIE

SEQ ID NO: 1258828 - protein, 26 aa, Mycobacterium
AMFRRHLSCTPKEYLRKVRLDHAHRD

SEQ ID NO: 1258829 - protein, 26 aa, Mycobacterium
AMFYPEFSLWCGTTATADWHTRYNAV

SEQ ID NO: 1258830 - protein, 20 aa, Mycobacterium
AMGAAGAWTGSVWLTTEEAE

SEQ ID NO: 1258831 - protein, 25 aa, Mycobacterium
AMGAVGFISVWGHLAASALRDMMTA

SEQ ID NO: 1258832 - protein, 24 aa, Mycobacterium
AMGFEVADDLTVWNRMGAALRRND

SEQ ID NO: 1258833 - protein, 19 aa, Mycobacterium
AMGLKVIPWTVNDEDTMRA

SEQ ID NO: 1258834 - protein, 35 aa, Mycobacterium
AMGLLRGGDSWMFVGWCRLREGIRGFHLDRIRHLE

SEQ ID NO: 1258835 - protein, 33 aa, Mycobacterium
AMGMVHCVRAALPLLRAAEWARIVNFSAHSTQR

SEQ ID NO: 1258836 - protein, 21 aa, Mycobacterium
AMHALGIPTTRALAVVATGRP

SEQ ID NO: 1258837 - protein, 26 aa, Mycobacterium
AMIAEAGDALAVFGVSIPPTARMGSL

SEQ ID NO: 1258838 - protein, 20 aa, Mycobacterium
AMIRAFAPILGRNGGGAILN

SEQ ID NO: 1258839 - protein, 29 aa, Mycobacterium
AMITAVLEKRAKLPVGMNDIYLSTVGGMR

SEQ ID NO: 1258840 - protein, 21 aa, Mycobacterium
AMIVIRLQTIVSREVAPVNSV

SEQ ID NO: 1258841 - protein, 24 aa, Mycobacterium
AMKANELALAWLVRGDINIGQGWM

SEQ ID NO: 1258842 - protein, 23 aa, Mycobacterium
AMKVKLIVVRSWTTRAPAGDVTI

SEQ ID NO: 1258843 - protein, 24 aa, Mycobacterium
AMLIRPDGHLAWRGDAGDADGVNL

SEQ ID NO: 1258844 - protein, 23 aa, Mycobacterium
AMLLMRAGREYALKRALAKISDA

SEQ ID NO: 1258845 - protein, 17 aa, Mycobacterium
AMLQRLDGLDVDRLTDI

SEQ ID NO: 1258846 - protein, 17 aa, Mycobacterium
AMLRAVNVPARVVSVYA

SEQ ID NO: 1258847 - protein, 24 aa, Mycobacterium
AMLRRGGLRLLLNVPEGGGGAGQR

SEQ ID NO: 1258848 - protein, 27 aa, Mycobacterium
AMMATSQRIVVCWAMGLTQHKHAVPSI

SEQ ID NO: 1258849 - protein, 21 aa, Mycobacterium
AMPAQRYMHDFGLTREHLGYI

SEQ ID NO: 1258850 - protein, 25 aa, Mycobacterium
AMRAAGRGRIVLVSSAGGVRGQPAI

SEQ ID NO: 1258851 - protein, 30 aa, Mycobacterium
AMRKRGVTDFSLAMIDPWPAGYYGAQDHYD

SEQ ID NO: 1258852 - protein, 21 aa, Mycobacterium
AMRLCHHLHGGMGMDITYPMD

SEQ ID NO: 1258853 - protein, 22 aa, Mycobacterium
AMRRGRVRPLGLDRYGVQLRVE

SEQ ID NO: 1258854 - protein, 24 aa, Mycobacterium
AMRRPRTGVMIARGDLAVEVGYER

SEQ ID NO: 1258855 - protein, 20 aa, Mycobacterium
AMSGTRWRRTLVANVTANVV

SEQ ID NO: 1258856 - protein, 23 aa, Mycobacterium
AMSHLLREFGLLEPLRARLAEGM

SEQ ID NO: 1258857 - protein, 17 aa, Mycobacterium
AMSPRHFTRVFSTEVGE

SEQ ID NO: 1258858 - protein, 26 aa, Mycobacterium
AMSSVPPSVWGGAAATRFREVVERWN

SEQ ID NO: 1258859 - protein, 30 aa, Mycobacterium
AMTHAWALEFAKAGIRFNCVQPGSISSGMT

SEQ ID NO: 1258860 - protein, 19 aa, Mycobacterium
AMTPWIWPTMHLNPPNWIE

SEQ ID NO: 1258861 - protein, 23 aa, Mycobacterium
AMTRAQSQVVAWWAPSNDEPNGG

SEQ ID NO: 1258862 - protein, 32 aa, Mycobacterium
AMVDHCLGVVFYPVIPAGSWVATTEFKLNLLR

SEQ ID NO: 1258863 - protein, 17 aa, Mycobacterium
AMVDQGKCLIRLVPTRW

SEQ ID NO: 1258864 - protein, 18 aa, Mycobacterium
AMVERARRALTELERARA

SEQ ID NO: 1258865 - protein, 24 aa, Mycobacterium
AMVNNQIDAVIGWHPAGGDLATSL

SEQ ID NO: 1258866 - protein, 24 aa, Mycobacterium
AMYVDKRLSGVAAVQTLSRLNRVA

SEQ ID NO: 1258867 - protein, 18 aa, Mycobacterium
ANAARLAIDSGFDAVEIH

SEQ ID NO: 1258868 - protein, 23 aa, Mycobacterium
ANAEAMIVGCEFDIETDVIVSWL

SEQ ID NO: 1258869 - protein, 22 aa, Mycobacterium
ANAGLARYAAADAMQKGAMSLH

SEQ ID NO: 1258870 - protein, 22 aa, Mycobacterium
ANAIGGFATDVFEIRDGARRAS

SEQ ID NO: 1258871 - protein, 25 aa, Mycobacterium
ANAKDCIQVLGGIGITWEHDAHLYL

SEQ ID NO: 1258872 - protein, 23 aa, Mycobacterium
ANAKRRLDELIGLEGPKEQIAVW

SEQ ID NO: 1258873 - protein, 18 aa, Mycobacterium
ANALPRRGLAVLRRPVRR

SEQ ID NO: 1258874 - protein, 22 aa, Mycobacterium
ANALRSWSVLRFEVTEDPSHGV

SEQ ID NO: 1258875 - protein, 24 aa, Mycobacterium
ANAMAGGIFVHIPMMFADLKDEYI

SEQ ID NO: 1258876 - protein, 23 aa, Mycobacterium
ANAVAEFGGRLDVVVANAGICPL

SEQ ID NO: 1258877 - protein, 21 aa, Mycobacterium
ANAVEELMRYLSIIQNGQRRV

SEQ ID NO: 1258878 - protein, 17 aa, Mycobacterium
ANAVFWLVSDAARYVTG

SEQ ID NO: 1258879 - protein, 25 aa, Mycobacterium
ANDALAIICQAWLGPRYQVTSQVNV

SEQ ID NO: 1258880 - protein, 18 aa, Mycobacterium
ANDGDCWPLLVELSDRAD

SEQ ID NO: 1258881 - protein, 19 aa, Mycobacterium
ANDGGPCPVIVHLHGGGLV

SEQ ID NO: 1258882 - protein, 25 aa, Mycobacterium
ANDPRFLFHPAIKELTLDIASEVFM

SEQ ID NO: 1258883 - protein, 18 aa, Mycobacterium
ANECCRLRKVEPLSKALR

SEQ ID NO: 1258884 - protein, 22 aa, Mycobacterium
ANEKAKELYAWVAEQTVDEIRD

SEQ ID NO: 1258885 - protein, 20 aa, Mycobacterium
ANELAQHWIRVNTIHPTGVA

SEQ ID NO: 1258886 - protein, 24 aa, Mycobacterium
ANFEGGPLLRFMSGNLSQQIEHHL

SEQ ID NO: 1258887 - protein, 20 aa, Mycobacterium
ANFEGWTALASWGEITSNAD

SEQ ID NO: 1258888 - protein, 19 aa, Mycobacterium
ANFLKRWLLVNDERARQML

SEQ ID NO: 1258889 - protein, 24 aa, Mycobacterium
ANFPRPVGDLLAAYGAVVGSREGT

SEQ ID NO: 1258890 - protein, 17 aa, Mycobacterium
ANGDAALEESIRYKSLI

SEQ ID NO: 1258891 - protein, 22 aa, Mycobacterium
ANGDCPKRLIDLIGAAVHSGVA

SEQ ID NO: 1258892 - protein, 24 aa, Mycobacterium
ANGFPEFADAEFLDLWEEGAPYNP

SEQ ID NO: 1258893 - protein, 27 aa, Mycobacterium
ANGIDAPTLWPGLPVRPVKGEVLRLRW

SEQ ID NO: 1258894 - protein, 28 aa, Mycobacterium
ANHIDKWRFTVPFVCGATNLGEALRRLT

SEQ ID NO: 1258895 - protein, 28 aa, Mycobacterium
ANIAPWLRAANRFGAKVKWAEVDIETGE

SEQ ID NO: 1258896 - protein, 17 aa, Mycobacterium
ANIGVWVRAGASEATGN

SEQ ID NO: 1258897 - protein, 24 aa, Mycobacterium
ANKCADIATVLRDTRAGQEQLVRE

SEQ ID NO: 1258898 - protein, 20 aa, Mycobacterium
ANKTRPAVIVSNDRANATAS

SEQ ID NO: 1258899 - protein, 25 aa, Mycobacterium
ANKVPGARCALAWSPETASLAREHN

SEQ ID NO: 1258900 - protein, 18 aa, Mycobacterium
ANLADYVAALAITNDVSA

SEQ ID NO: 1258901 - protein, 17 aa, Mycobacterium
ANLARMTIDLMFNAIAD

SEQ ID NO: 1258902 - protein, 26 aa, Mycobacterium
ANLARRELAEALTVLTRRLPAPRRVG

SEQ ID NO: 1258903 - protein, 26 aa, Mycobacterium
ANLDSWRLLAGNVKLPYPQELREMFA

SEQ ID NO: 1258904 - protein, 19 aa, Mycobacterium
ANLFKALAHPARIRVLEIL

SEQ ID NO: 1258905 - protein, 18 aa, Mycobacterium
ANLKRFVFLSTIGTIAVG

SEQ ID NO: 1258906 - protein, 25 aa, Mycobacterium
ANLQAEAAGLVWLPIGPSLDVAAHV

SEQ ID NO: 1258907 - protein, 36 aa, Mycobacterium
ANLQARPQIAVTFRRGWEWATVEGRAELAGPDHPQP

SEQ ID NO: 1258908 - protein, 19 aa, Mycobacterium
ANLQRVLVDLVELHLQGKQ

SEQ ID NO: 1258909 - protein, 25 aa, Mycobacterium
ANLSRVYRRLGIRSRGELARVLNAD

SEQ ID NO: 1258910 - protein, 25 aa, Mycobacterium
ANLVARAWLDPDFKQLALTEPMTAS

SEQ ID NO: 1258911 - protein, 21 aa, Mycobacterium
ANLVAYWAILATRVEAPGLAE

SEQ ID NO: 1258912 - protein, 23 aa, Mycobacterium
ANMAPDLFAGILATVPFVDPLTT

SEQ ID NO: 1258913 - protein, 19 aa, Mycobacterium
ANMGEAWWVPIVQIPGDTF

SEQ ID NO: 1258914 - protein, 23 aa, Mycobacterium
ANMKVGLHLANGWLAPLTSSAEE

SEQ ID NO: 1258915 - protein, 17 aa, Mycobacterium
ANMQRQAVPLVRSEAPL

SEQ ID NO: 1258916 - protein, 21 aa, Mycobacterium
ANNPLRLGGCLNSESAEKSAR

SEQ ID NO: 1258917 - protein, 26 aa, Mycobacterium
ANPAPPARVLLVWDAPNLDMGLGSIL

SEQ ID NO: 1258918 - protein, 29 aa, Mycobacterium
ANPEFMKNPEFAAAILPTLRGLKAIANYT

SEQ ID NO: 1258919 - protein, 20 aa, Mycobacterium
ANPHIWYSPAAVTAVADAVT

SEQ ID NO: 1258920 - protein, 24 aa, Mycobacterium
ANPKNPRPVMLWGYQPLADNGQGR

SEQ ID NO: 1258921 - protein, 34 aa, Mycobacterium
ANPNRPDGGILERFVGAYIPLLGITFNGSTPTFS

SEQ ID NO: 1258922 - protein, 17 aa, Mycobacterium
ANPRASRTVPFVSKATA

SEQ ID NO: 1258923 - protein, 21 aa, Mycobacterium
ANPTKSGAKWAGEAGTADPQA

SEQ ID NO: 1258924 - protein, 17 aa, Mycobacterium
ANPVPRLGRIEATNPCG

SEQ ID NO: 1258925 - protein, 21 aa, Mycobacterium
ANQRPRVIAVDAVPVEVGATW

SEQ ID NO: 1258926 - protein, 19 aa, Mycobacterium
ANRDALCALIVPALKAHGA

SEQ ID NO: 1258927 - protein, 24 aa, Mycobacterium
ANRGSGGLYRWEGRYLRGDDQATL

SEQ ID NO: 1258928 - protein, 21 aa, Mycobacterium
ANRLRGHTRLHTPTTSEPLFV

SEQ ID NO: 1258929 - protein, 22 aa, Mycobacterium
ANRPSTCDWVLASGRLVVTIDA

SEQ ID NO: 1258930 - protein, 18 aa, Mycobacterium
ANSAEGWDMATASAREMF

SEQ ID NO: 1258931 - protein, 24 aa, Mycobacterium
ANSFRCPYHGWTFNNTGALQGVPM

SEQ ID NO: 1258932 - protein, 31 aa, Mycobacterium
ANTKIAEWFEARWTDRFSLPITAEIIQLISE

SEQ ID NO: 1258933 - protein, 29 aa, Mycobacterium
ANTLARFSVYGTDVGVMWDNGMVDDPSTP

SEQ ID NO: 1258934 - protein, 22 aa, Mycobacterium
ANTSRPSTIGMLKTVADEYAQY

SEQ ID NO: 1258935 - protein, 17 aa, Mycobacterium
ANVAAPINAGVSANIGS

SEQ ID NO: 1258936 - protein, 28 aa, Mycobacterium
ANVGVWVRTDDQWTWLVHTLTVEKVREL

SEQ ID NO: 1258937 - protein, 33 aa, Mycobacterium
ANVLFAVELDRRWADDGVRGYSLHPGGIVSTNL

SEQ ID NO: 1258938 - protein, 17 aa, Mycobacterium
ANVRVQYAFGPTIGSAV

SEQ ID NO: 1258939 - protein, 18 aa, Mycobacterium
ANWMKHLHHANWKMVVEN

SEQ ID NO: 1258940 - protein, 22 aa, Mycobacterium
ANYCPHEGGPLCSGRARGRNIV

SEQ ID NO: 1258941 - protein, 27 aa, Mycobacterium
ANYLYPRVEVEVGFILSDDLPGAGCTE

SEQ ID NO: 1258942 - protein, 34 aa, Mycobacterium
APAARLAAEVGLAVFRVAFERWVQSPGGAPLPTL

SEQ ID NO: 1258943 - protein, 19 aa, Mycobacterium
APADKRVALVFSAYPTKHA

SEQ ID NO: 1258944 - protein, 17 aa, Mycobacterium
APAELSPVAAYRHAAAQ

SEQ ID NO: 1258945 - protein, 18 aa, Mycobacterium
APAEPFAAQFTDLDLTVI

SEQ ID NO: 1258946 - protein, 19 aa, Mycobacterium
APAGFRATGIAAGIKASGK

SEQ ID NO: 1258947 - protein, 20 aa, Mycobacterium
APAGGRAWVTALLDKVQSAA

SEQ ID NO: 1258948 - protein, 24 aa, Mycobacterium
APAGRVACCGWSYGGYLTQAALTF

SEQ ID NO: 1258949 - protein, 18 aa, Mycobacterium
APAHLGFMVDLEMLVTAG

SEQ ID NO: 1258950 - protein, 19 aa, Mycobacterium
APAIAGLLDIYAHAAGQVG

SEQ ID NO: 1258951 - protein, 26 aa, Mycobacterium
APAIEAWAKPVLLAWGDADKMFPMAH

SEQ ID NO: 1258952 - protein, 27 aa, Mycobacterium
APAIKARLAGGFCIRAQVQGPCAYANI

SEQ ID NO: 1258953 - protein, 26 aa, Mycobacterium
APAKKRRNLLKSLGIERVDYKDTSTL

SEQ ID NO: 1258954 - protein, 18 aa, Mycobacterium
APALAAGCTVVLKSAPDT

SEQ ID NO: 1258955 - protein, 25 aa, Mycobacterium
APALARALCWMIERSFYQASKVSAA

SEQ ID NO: 1258956 - protein, 20 aa, Mycobacterium
APALDRMRFQEAMAALPQAL

SEQ ID NO: 1258957 - protein, 23 aa, Mycobacterium
APALPVIRRLLVDDAMDSGVVVA

SEQ ID NO: 1258958 - protein, 17 aa, Mycobacterium
APALVFVSWPDSGPLIG

SEQ ID NO: 1258959 - protein, 23 aa, Mycobacterium
APANFALHVMRYLHESPATKEHM

SEQ ID NO: 1258960 - protein, 25 aa, Mycobacterium
APAPAGTRKAYFIGIDDPIETPVYD

SEQ ID NO: 1258961 - protein, 23 aa, Mycobacterium
APAPGRPSGLGMPRRKQTRAQAR

SEQ ID NO: 1258962 - protein, 26 aa, Mycobacterium
APAPLLWQRYLAIIFDGLRPDGAHPL

SEQ ID NO: 1258963 - protein, 21 aa, Mycobacterium
APAQMTHHVFHVGGVQEKKDL

SEQ ID NO: 1258964 - protein, 18 aa, Mycobacterium
APAQRLRALLGKPARTPL

SEQ ID NO: 1258965 - protein, 17 aa, Mycobacterium
APARAFAAPAGDPADQP

SEQ ID NO: 1258966 - protein, 32 aa, Mycobacterium
APARATVVAADWPRLAAAYHTRAQLHILDDLL

SEQ ID NO: 1258967 - protein, 22 aa, Mycobacterium
APARYEPSCATVLQAMACGAPI

SEQ ID NO: 1258968 - protein, 17 aa, Mycobacterium
APASDAAGFKWLAPYTG

SEQ ID NO: 1258969 - protein, 17 aa, Mycobacterium
APASPALASLVMSVLAA

SEQ ID NO: 1258970 - protein, 24 aa, Mycobacterium
APATLRWGEMAVWTKFIEGAAGVG

SEQ ID NO: 1258971 - protein, 27 aa, Mycobacterium
APATRPRIRLAYRLTPRRVTGAARADG

SEQ ID NO: 1258972 - protein, 17 aa, Mycobacterium
APATWRRYLDQGVLIRD

SEQ ID NO: 1258973 - protein, 20 aa, Mycobacterium
APAVCAVLLCGIQPAPGDRP

SEQ ID NO: 1258974 - protein, 18 aa, Mycobacterium
APCGVLLDIHSGGFYIGA

SEQ ID NO: 1258975 - protein, 17 aa, Mycobacterium
APCPVPRALSRAAAKQK

SEQ ID NO: 1258976 - protein, 22 aa, Mycobacterium
APDARVGVVINDFGELNVDAAL

SEQ ID NO: 1258977 - protein, 23 aa, Mycobacterium
APDDAVLIGHDWGAFTASAIAAY

SEQ ID NO: 1258978 - protein, 21 aa, Mycobacterium
APDGPALPGNEAFGISHMLPG

SEQ ID NO: 1258979 - protein, 21 aa, Mycobacterium
APDGRVVVCTDMLVENRHFRL

SEQ ID NO: 1258980 - protein, 22 aa, Mycobacterium
APDHMECPTFRGYLDLAAAGLF

SEQ ID NO: 1258981 - protein, 24 aa, Mycobacterium
APDIEILGNLGLIIGGGFDTTTAL

SEQ ID NO: 1258982 - protein, 18 aa, Mycobacterium
APDLPCEVEVDSLEQLDE

SEQ ID NO: 1258983 - protein, 19 aa, Mycobacterium
APDPAVCTLVLSGKTEKRI

SEQ ID NO: 1258984 - protein, 20 aa, Mycobacterium
APDPFSYLSALGVDLRRVLH

SEQ ID NO: 1258985 - protein, 19 aa, Mycobacterium
APDVARSVTIWAANPANND

SEQ ID NO: 1258986 - protein, 22 aa, Mycobacterium
APDVLRHVMGFGETPDKALTGP

SEQ ID NO: 1258987 - protein, 24 aa, Mycobacterium
APDVRIWARCSLLRDGTWVHADRV

SEQ ID NO: 1258988 - protein, 19 aa, Mycobacterium
APEALVVLWAAQRSGLYVT

SEQ ID NO: 1258989 - protein, 17 aa, Mycobacterium
APEARLVGDTSIVNAST

SEQ ID NO: 1258990 - protein, 17 aa, Mycobacterium
APEATRLTMEFMGLANH

SEQ ID NO: 1258991 - protein, 18 aa, Mycobacterium
APEDGRTTEPGGVGGTGG

SEQ ID NO: 1258992 - protein, 24 aa, Mycobacterium
APEGELPLTMPLRQLGVSDDVVVA

SEQ ID NO: 1258993 - protein, 21 aa, Mycobacterium
APEGLFGVECDVTDNEAVDRA

SEQ ID NO: 1258994 - protein, 20 aa, Mycobacterium
APELKRLRRDAAVKAGKMRV

SEQ ID NO: 1258995 - protein, 20 aa, Mycobacterium
APELLVEGPIQYDAAVEPSV

SEQ ID NO: 1258996 - protein, 21 aa, Mycobacterium
APELRTPWPGQALKDLLVMLA

SEQ ID NO: 1258997 - protein, 17 aa, Mycobacterium
APELSARADCHWIKSAP

SEQ ID NO: 1258998 - protein, 21 aa, Mycobacterium
APELVIPFMVPDGAHSYPDAR

SEQ ID NO: 1258999 - protein, 24 aa, Mycobacterium
APEPRYTPSQALAEFIRCRDLTCR

SEQ ID NO: 1259000 - protein, 20 aa, Mycobacterium
APEQRCVSCRPAPDNMLYVT

SEQ ID NO: 1259001 - protein, 17 aa, Mycobacterium
APERIFIAEAWVSSNAR

SEQ ID NO: 1259002 - protein, 20 aa, Mycobacterium
APERPWLATYGMWSRELPAD

SEQ ID NO: 1259003 - protein, 22 aa, Mycobacterium
APESIEGFMAFKERRSPSWVHP

SEQ ID NO: 1259004 - protein, 24 aa, Mycobacterium
APETRPASLPFLSIKKITVHYRPR

SEQ ID NO: 1259005 - protein, 18 aa, Mycobacterium
APEVPLRVIAVGPSRHLV

SEQ ID NO: 1259006 - protein, 22 aa, Mycobacterium
APFAASLIGDFGAQVIKIEDPG

SEQ ID NO: 1259007 - protein, 23 aa, Mycobacterium
APFKERLPYVAAIVELDEGPRLM

SEQ ID NO: 1259008 - protein, 17 aa, Mycobacterium
APFKVGPDFIDPGYHAL

SEQ ID NO: 1259009 - protein, 18 aa, Mycobacterium
APFSLAWMTAVGERTKRL

SEQ ID NO: 1259010 - protein, 25 aa, Mycobacterium
APGARLAWRDDARWAPHGGESRVDV

SEQ ID NO: 1259011 - protein, 17 aa, Mycobacterium
APGEGSASISIINVGRE

SEQ ID NO: 1259012 - protein, 19 aa, Mycobacterium
APGGGVWTVISTAIRLGKA

SEQ ID NO: 1259013 - protein, 18 aa, Mycobacterium
APGGSRCTAHGGRRYQRA

SEQ ID NO: 1259014 - protein, 18 aa, Mycobacterium
APGGSRYNSAICVSGDGV

SEQ ID NO: 1259015 - protein, 20 aa, Mycobacterium
APGGVAYACSFRITEAVYFV

SEQ ID NO: 1259016 - protein, 17 aa, Mycobacterium
APGLECAPFVAAPTSSE

SEQ ID NO: 1259017 - protein, 17 aa, Mycobacterium
APGPLRIAMSTKFPFTV

SEQ ID NO: 1259018 - protein, 19 aa, Mycobacterium
APGRANVAVGIPTFNRPSD

SEQ ID NO: 1259019 - protein, 25 aa, Mycobacterium
APGRLGEVETMFAMTIHKSQGSQAD

SEQ ID NO: 1259020 - protein, 20 aa, Mycobacterium
APGRLRDRLELVAAGADAAV

SEQ ID NO: 1259021 - protein, 18 aa, Mycobacterium
APGSQRGFAETKLDSLGN

SEQ ID NO: 1259022 - protein, 17 aa, Mycobacterium
APGSRLAVESVPTHHEA

SEQ ID NO: 1259023 - protein, 20 aa, Mycobacterium
APGTALRLWTEDAFAGRVTS

SEQ ID NO: 1259024 - protein, 21 aa, Mycobacterium
APGTRRIYSNYGFTVLAEKIE

SEQ ID NO: 1259025 - protein, 25 aa, Mycobacterium
APGTWGGTITPSFKERFGQAYDTEI

SEQ ID NO: 1259026 - protein, 18 aa, Mycobacterium
APGVGWAGQEFVDALQSQ

SEQ ID NO: 1259027 - protein, 18 aa, Mycobacterium
APHAAEWDAITAGAWYDA

SEQ ID NO: 1259028 - protein, 25 aa, Mycobacterium
APHSVDIDGLIGWAAGLVGDLGPAA

SEQ ID NO: 1259029 - protein, 24 aa, Mycobacterium
APHVWAIGDVASWRDNVGGQVRVE

SEQ ID NO: 1259030 - protein, 17 aa, Mycobacterium
APIAIGPLGPEILSYEL

SEQ ID NO: 1259031 - protein, 19 aa, Mycobacterium
APIAKRLYEQAGISAADID

SEQ ID NO: 1259032 - protein, 24 aa, Mycobacterium
APIASELILPIALAVQNRISVSDL

SEQ ID NO: 1259033 - protein, 17 aa, Mycobacterium
APIDAAAGANVLTYGSG

SEQ ID NO: 1259034 - protein, 23 aa, Mycobacterium
APILCGRRAELMSPVSFLEKPSR

SEQ ID NO: 1259035 - protein, 26 aa, Mycobacterium
APILDLAACKGFTRWYIGDTDLSEPP

SEQ ID NO: 1259036 - protein, 24 aa, Mycobacterium
APIPLPLKTSYAWAETEYHRGTPL

SEQ ID NO: 1259037 - protein, 25 aa, Mycobacterium
APIWVYRAGLGFVFGSRLLMLEHIG

SEQ ID NO: 1259038 - protein, 24 aa, Mycobacterium
APKELLRTAVLAFLKYIDANRASW

SEQ ID NO: 1259039 - protein, 20 aa, Mycobacterium
APKLPRMAVRPIRIVGDPVL

SEQ ID NO: 1259040 - protein, 19 aa, Mycobacterium
APKRRWGSVLGIQPDGLEV

SEQ ID NO: 1259041 - protein, 23 aa, Mycobacterium
APKYYKWTRQWLDALELKESFYT

SEQ ID NO: 1259042 - protein, 24 aa, Mycobacterium
APLAHPALVCDVAIGQSTLATQRV

SEQ ID NO: 1259043 - protein, 24 aa, Mycobacterium
APLAHPALVCDVAIGQSTLVTQRV

SEQ ID NO: 1259044 - protein, 25 aa, Mycobacterium
APLAHPALVCDVAIGQSTLVTQRVR

SEQ ID NO: 1259045 - protein, 17 aa, Mycobacterium
APLARMEMQIAFPALLR

SEQ ID NO: 1259046 - protein, 18 aa, Mycobacterium
APLHILHGMPSLGRNLTE

SEQ ID NO: 1259047 - protein, 18 aa, Mycobacterium
APLLRPVARTGPPPLSYA

SEQ ID NO: 1259048 - protein, 25 aa, Mycobacterium
APLLYPHMWSWDAAFVAIGLAPLSV

SEQ ID NO: 1259049 - protein, 18 aa, Mycobacterium
APLMARHRLAAAPRMAAP

SEQ ID NO: 1259050 - protein, 25 aa, Mycobacterium
APLNIPYKVAFVLDVAGDNEALVAR

SEQ ID NO: 1259051 - protein, 22 aa, Mycobacterium
APLPDTVAAFWALVKAGWDVEV

SEQ ID NO: 1259052 - protein, 19 aa, Mycobacterium
APLPLQYADFGAWQSALLA

SEQ ID NO: 1259053 - protein, 17 aa, Mycobacterium
APLPMTFAGVSRHIGVL

SEQ ID NO: 1259054 - protein, 17 aa, Mycobacterium
APLRLIRGLAPGMIERG

SEQ ID NO: 1259055 - protein, 20 aa, Mycobacterium
APLRRSPVRIHLGGRGWLNL

SEQ ID NO: 1259056 - protein, 27 aa, Mycobacterium
APLSSSQLRSWFGYRIEGRSPVNNIPF

SEQ ID NO: 1259057 - protein, 18 aa, Mycobacterium
APLTAGTWRDYWLAMDVR

SEQ ID NO: 1259058 - protein, 19 aa, Mycobacterium
APLTGFRVAVTSARRADEL

SEQ ID NO: 1259059 - protein, 21 aa, Mycobacterium
APMIRYPIPPMIHGATQSATW

SEQ ID NO: 1259060 - protein, 25 aa, Mycobacterium
APMYSAAEQSVWRRAFEAARPRAVW

SEQ ID NO: 1259061 - protein, 19 aa, Mycobacterium
APNAWRLPFEREWREKAPE

SEQ ID NO: 1259062 - protein, 27 aa, Mycobacterium
APNLCAEMGPGLCNIAYAAVDRHAHGP

SEQ ID NO: 1259063 - protein, 18 aa, Mycobacterium
APNLTRVIVVLEYHPKGL

SEQ ID NO: 1259064 - protein, 24 aa, Mycobacterium
APPDRQRYLVQFTVTGFADKAAED

SEQ ID NO: 1259065 - protein, 18 aa, Mycobacterium
APPDSAPGGGRWELGQAY

SEQ ID NO: 1259066 - protein, 25 aa, Mycobacterium
APPGVDARVLATVLLEFNDRMLERL

SEQ ID NO: 1259067 - protein, 28 aa, Mycobacterium
APPHGGIAFGWDRIVALLAGLDSIREVI

SEQ ID NO: 1259068 - protein, 17 aa, Mycobacterium
APPLFSLWTPENGRQGY

SEQ ID NO: 1259069 - protein, 17 aa, Mycobacterium
APPPLLQRMVEAGQLGK

SEQ ID NO: 1259070 - protein, 18 aa, Mycobacterium
APPPTQWDSATPPSGPDA

SEQ ID NO: 1259071 - protein, 26 aa, Mycobacterium
APPSCGECGGLIRPNVVWFGEPLPDD

SEQ ID NO: 1259072 - protein, 18 aa, Mycobacterium
APPSWEVLESRLVGRGTE

SEQ ID NO: 1259073 - protein, 38 aa, Mycobacterium
APPTARGWEAVVGDEVWDWAGELAELPSLLAEKVKAPS

SEQ ID NO: 1259074 - protein, 31 aa, Mycobacterium; identical to SEQ ID NO: 924623

SEQ ID NO: 1259075 - protein, 20 aa, Mycobacterium
APPTVWRMLIQSDLGERPPG

SEQ ID NO: 1259076 - protein, 23 aa, Mycobacterium
APQCLHCGCRILGHGIETDDGIF

SEQ ID NO: 1259077 - protein, 24 aa, Mycobacterium
APQDLRKRIRYHFGAGGASADGST

SEQ ID NO: 1259078 - protein, 18 aa, Mycobacterium
APQGLEYVAGFFAAVKAG

SEQ ID NO: 1259079 - protein, 18 aa, Mycobacterium
APQGPRQSPNVTYLKEIW

SEQ ID NO: 1259080 - protein, 22 aa, Mycobacterium
APQRSSAPLIRRITTVAPKDGA

SEQ ID NO: 1259081 - protein, 26 aa, Mycobacterium
APQRVGWFRFYFADERWEWSEQVQIL

SEQ ID NO: 1259082 - protein, 17 aa, Mycobacterium
APRANLLLADDVGLGKT

SEQ ID NO: 1259083 - protein, 23 aa, Mycobacterium
APRARTAMTAGVFGDAPDTTGGV

SEQ ID NO: 1259084 - protein, 23 aa, Mycobacterium
APRARTAMTAGVFGDAPELPEGA

SEQ ID NO: 1259085 - protein, 18 aa, Mycobacterium
APRGTLLHHYRAGVGGDI

SEQ ID NO: 1259086 - protein, 19 aa, Mycobacterium
APRLDYADIVCLFATHLGG

SEQ ID NO: 1259087 - protein, 23 aa, Mycobacterium
APRPGLRGDRVLVRNVSLRKTPS

SEQ ID NO: 1259088 - protein, 17 aa, Mycobacterium
APRPWAGTNPTAAPASP

SEQ ID NO: 1259089 - protein, 27 aa, Mycobacterium
APRRGEIIYRLAVQAAQAINRFGTAET

SEQ ID NO: 1259090 - protein, 18 aa, Mycobacterium
APRSLAMSTRASFLRQLG

SEQ ID NO: 1259091 - protein, 25 aa, Mycobacterium
APRWGTVIVGLDWDTTVLDERLARR

SEQ ID NO: 1259092 - protein, 20 aa, Mycobacterium
APRYRLALVKVDPRGPAHDE

SEQ ID NO: 1259093 - protein, 17 aa, Mycobacterium
APSLYAAAGRYVLDRAI

SEQ ID NO: 1259094 - protein, 23 aa, Mycobacterium
APSRLFGANGLRTGPDGRVYVAQ

SEQ ID NO: 1259095 - protein, 25 aa, Mycobacterium
APTAKPKSLFGIIGGYLRDQVRAFR

SEQ ID NO: 1259096 - protein, 24 aa, Mycobacterium
APTELRAAWKDIPEVVSAATVTGT

SEQ ID NO: 1259097 - protein, 19 aa, Mycobacterium
APTGKRLHVDLSISSLIGY

SEQ ID NO: 1259098 - protein, 23 aa, Mycobacterium
APTGLPGTVVWAGHYDMRYVEGG

SEQ ID NO: 1259099 - protein, 23 aa, Mycobacterium
APTLVRTFMKWGRQLPAEHDLSS

SEQ ID NO: 1259100 - protein, 17 aa, Mycobacterium
APTLVVWTSDDPTADVE

SEQ ID NO: 1259101 - protein, 26 aa, Mycobacterium
APTLYCLTEPIPPGSYVGIAGRLGFK

SEQ ID NO: 1259102 - protein, 18 aa, Mycobacterium
APTPAKLWILTRNAQPID

SEQ ID NO: 1259103 - protein, 18 aa, Mycobacterium
APTRANAPLISWDSAFGL

SEQ ID NO: 1259104 - protein, 21 aa, Mycobacterium
APTRFARGWHCLGLTSDLGDG

SEQ ID NO: 1259105 - protein, 17 aa, Mycobacterium
APTRLTLSALRDGDLLT

SEQ ID NO: 1259106 - protein, 19 aa, Mycobacterium
APTSPAIRFLARLAQGGAR

SEQ ID NO: 1259107 - protein, 17 aa, Mycobacterium
APTTLCRSRHSANRHGR

SEQ ID NO: 1259108 - protein, 19 aa, Mycobacterium
APVAGRCGRCGEDGPTVTS

SEQ ID NO: 1259109 - protein, 18 aa, Mycobacterium
APVAPAWSLDSGILDEVV

SEQ ID NO: 1259110 - protein, 27 aa, Mycobacterium
APVARVCSAEVPIPYARHLEQAALPQR

SEQ ID NO: 1259111 - protein, 17 aa, Mycobacterium
APVDTLAALPMNLPAGV

SEQ ID NO: 1259112 - protein, 20 aa, Mycobacterium
APVEALIGVFDKIGVKTGID

SEQ ID NO: 1259113 - protein, 17 aa, Mycobacterium
APVELEFTETHRAIMDT

SEQ ID NO: 1259114 - protein, 17 aa, Mycobacterium
APVGLFVETFGSETVDP

SEQ ID NO: 1259115 - protein, 23 aa, Mycobacterium
APVIEISDVWKLHKLGDEVVKAL

SEQ ID NO: 1259116 - protein, 19 aa, Mycobacterium
APVKPAFRLAWSQRAARLT

SEQ ID NO: 1259117 - protein, 26 aa, Mycobacterium
APVLAICAAIQVLGHWYETSSGERVD

SEQ ID NO: 1259118 - protein, 18 aa, Mycobacterium
APVLIAIDDVQWLDASSR

SEQ ID NO: 1259119 - protein, 17 aa, Mycobacterium
APVLLYDGICGFCNSAV

SEQ ID NO: 1259120 - protein, 18 aa, Mycobacterium
APVLTWVVTGAWPRPVMP

SEQ ID NO: 1259121 - protein, 21 aa, Mycobacterium
APVNRFSLRSLFSADATSGQY

SEQ ID NO: 1259122 - protein, 17 aa, Mycobacterium
APVPAEIAALWRDGLVA

SEQ ID NO: 1259123 - protein, 25 aa, Mycobacterium
APVPELRSGGLGVREVKRLTKVTGI

SEQ ID NO: 1259124 - protein, 19 aa, Mycobacterium
APVRMAAMRIWRAVEGGPM

SEQ ID NO: 1259125 - protein, 25 aa, Mycobacterium
APVRVDTWGGWLFVNMDPDCEPLAD

SEQ ID NO: 1259126 - protein, 28 aa, Mycobacterium
APVTRPRIRLAYRLTPRRVLGEERATGV

SEQ ID NO: 1259127 - protein, 17 aa, Mycobacterium
APWAEVLARRLRISVGE

SEQ ID NO: 1259128 - protein, 20 aa, Mycobacterium
APWILPKWDSRYGVLHDRVS

SEQ ID NO: 1259129 - protein, 23 aa, Mycobacterium
APYALKAAYWKAARNGVDGDGVD

SEQ ID NO: 1259130 - protein, 17 aa, Mycobacterium
APYEAARVRLRMAQACR

SEQ ID NO: 1259131 - protein, 17 aa, Mycobacterium
APYQAMILLASWCALRF

SEQ ID NO: 1259132 - protein, 18 aa, Mycobacterium
APYTEWTVITGIAGEAWA

SEQ ID NO: 1259133 - protein, 17 aa, Mycobacterium
AQAAGWRPDERALTWWA

SEQ ID NO: 1259134 - protein, 17 aa, Mycobacterium
AQAAPTRFARGWHCLGL

SEQ ID NO: 1259135 - protein, 35 aa, Mycobacterium
AQAAQMLPPRGRRWLSRKLGLDRVFLEFDTTKRQG

SEQ ID NO: 1259136 - protein, 25 aa, Mycobacterium
AQAARLRAQMEFTRRRGGDTGARPL

SEQ ID NO: 1259137 - protein, 19 aa, Mycobacterium
AQAELGVGVPDGVVADYER

SEQ ID NO: 1259138 - protein, 24 aa, Mycobacterium
AQAFPHVYCELDFTDPLELAVATI

SEQ ID NO: 1259139 - protein, 24 aa, Mycobacterium
AQAFPHVYCELDFTDPLELTVATI

SEQ ID NO: 1259140 - protein, 23 aa, Mycobacterium
AQALLGTAFHEWVQRYFQAEKLF

SEQ ID NO: 1259141 - protein, 26 aa, Mycobacterium
AQAPGGLSCFFLPRILPDGSRNRMFL

SEQ ID NO: 1259142 - protein, 20 aa, Mycobacterium
AQARDRWEALVALAELVDDE

SEQ ID NO: 1259143 - protein, 17 aa, Mycobacterium
AQARLVFTAHSIPVRAA

SEQ ID NO: 1259144 - protein, 26 aa, Mycobacterium
AQARQEWRIFVDLALAMNRPLFGVPG

SEQ ID NO: 1259145 - protein, 18 aa, Mycobacterium
AQCATAVCAVLDPATGEL

SEQ ID NO: 1259146 - protein, 17 aa, Mycobacterium
AQDAEFMAGVFTEHGAR

SEQ ID NO: 1259147 - protein, 25 aa, Mycobacterium
AQDAPLAWRTALWFWTTQKAAAAAT

SEQ ID NO: 1259148 - protein, 18 aa, Mycobacterium
AQDFFFRKIARDQGGALL

SEQ ID NO: 1259149 - protein, 26 aa, Mycobacterium
AQDPALRPPLTWEVDNPFPPPEPETY

SEQ ID NO: 1259150 - protein, 32 aa, Mycobacterium
AQDRTPAQVLIRWSLQLGNVVISRSSSPERIK

SEQ ID NO: 1259151 - protein, 18 aa, Mycobacterium
AQEALQFQHHSWPDMVAE

SEQ ID NO: 1259152 - protein, 19 aa, Mycobacterium
AQEALQWGLVGEVVADDRL

SEQ ID NO: 1259153 - protein, 26 aa, Mycobacterium
AQEATPTAAAFGGRGGNGGTGGTGAR

SEQ ID NO: 1259154 - protein, 17 aa, Mycobacterium
AQEAVGLLEGFRANYDL

SEQ ID NO: 1259155 - protein, 35 aa, Mycobacterium
AQFEDAWTVTKWVAADAERLRFDPGKIVVSGDSAG

SEQ ID NO: 1259156 - protein, 17 aa, Mycobacterium
AQFRCLTVYFGEDEIPA

SEQ ID NO: 1259157 - protein, 17 aa, Mycobacterium
AQGCTYWNDEAMGSRDF

SEQ ID NO: 1259158 - protein, 19 aa, Mycobacterium
AQGDDRWVAITVRDDADRR

SEQ ID NO: 1259159 - protein, 19 aa, Mycobacterium
AQGRLDLRAAAGVKVTAAR

SEQ ID NO: 1259160 - protein, 32 aa, Mycobacterium
AQGRRDICIYAREPHVLVARAPAELFIDPSHT

SEQ ID NO: 1259161 - protein, 23 aa, Mycobacterium
AQGVRVPHGFAITAAAYRHMLDE

SEQ ID NO: 1259162 - protein, 21 aa, Mycobacterium
AQHLLDLTVDYAKNRLQFGRP

SEQ ID NO: 1259163 - protein, 19 aa, Mycobacterium
AQHPSRLTVTVGIGPHVFD

SEQ ID NO: 1259164 - protein, 18 aa, Mycobacterium
AQHRAVLTLRYMDDCTVG

SEQ ID NO: 1259165 - protein, 24 aa, Mycobacterium
AQHSRRLKFLVAFRPGVLSPTLAA

SEQ ID NO: 1259166 - protein, 18 aa, Mycobacterium
AQIAAWVGDPARRGANIC

SEQ ID NO: 1259167 - protein, 24 aa, Mycobacterium
AQIALMRAAILTWNMGKPHTAEAV

SEQ ID NO: 1259168 - protein, 17 aa, Mycobacterium
AQIALRCGAIRSRAQMS

SEQ ID NO: 1259169 - protein, 26 aa, Mycobacterium
AQIDRWHRARVIGGFEPEDYKQFLTD

SEQ ID NO: 1259170 - protein, 24 aa, Mycobacterium
AQIEKRYGAAFDRPVERMKEMVGA

SEQ ID NO: 1259171 - protein, 17 aa, Mycobacterium
AQIGIPVFQRDEAWNKL

SEQ ID NO: 1259172 - protein, 18 aa, Mycobacterium
AQIGRRVELLVATGEGRK

SEQ ID NO: 1259173 - protein, 23 aa, Mycobacterium
AQILKFMPNFMFNPAPYPEIGTR

SEQ ID NO: 1259174 - protein, 25 aa, Mycobacterium
AQIVRRYGDVFSMTLPVFGPTVMVA

SEQ ID NO: 1259175 - protein, 27 aa, Mycobacterium
AQIYAWRKGIKTLYYIRLRQMALEGTQ

SEQ ID NO: 1259176 - protein, 34 aa, Mycobacterium
AQKFKKMSGMTWKSMITDGLAMRHGKDLTWSQVV

SEQ ID NO: 1259177 - protein, 24 aa, Mycobacterium
AQKFRIASEPLEWPALTRPRRAAV

SEQ ID NO: 1259178 - protein, 21 aa, Mycobacterium
AQKSFAAWKQGRTGFPIVDAG

SEQ ID NO: 1259179 - protein, 18 aa, Mycobacterium
AQLAEHYDVLVALATTNP

SEQ ID NO: 1259180 - protein, 24 aa, Mycobacterium
AQLAQWLREWGVPAPPVATLPIAT

SEQ ID NO: 1259181 - protein, 18 aa, Mycobacterium
AQLAREGVTWCVIASPAV

SEQ ID NO: 1259182 - protein, 21 aa, Mycobacterium
AQLASYKRPKYVTLVDVLPRN

SEQ ID NO: 1259183 - protein, 18 aa, Mycobacterium
AQLDDPYCLQGMQHWLAN

SEQ ID NO: 1259184 - protein, 19 aa, Mycobacterium
AQLDSDFGISKGLAGIADN

SEQ ID NO: 1259185 - protein, 21 aa, Mycobacterium
AQLFARIWIAQVGRIPLLLLD

SEQ ID NO: 1259186 - protein, 24 aa, Mycobacterium
AQLFPSAHAWIAHIWTPPFTSKRL

SEQ ID NO: 1259187 - protein, 20 aa, Mycobacterium
AQLIKVCCSGGVMSLTGEAG

SEQ ID NO: 1259188 - protein, 18 aa, Mycobacterium
AQLKGPVKRCDRLDIDGC

SEQ ID NO: 1259189 - protein, 18 aa, Mycobacterium
AQLLRVYAHWARRTGNPL

SEQ ID NO: 1259190 - protein, 28 aa, Mycobacterium
AQLRDLMDLHLFGPAALVRAALPIMRAQ

SEQ ID NO: 1259191 - protein, 22 aa, Mycobacterium
AQLRRRRLGYGRGARMKFEQDE

SEQ ID NO: 1259192 - protein, 20 aa, Mycobacterium
AQLRSDFDAVVLAGGATARR

SEQ ID NO: 1259193 - protein, 17 aa, Mycobacterium
AQLRSSMVPGLAAALDR

SEQ ID NO: 1259194 - protein, 17 aa, Mycobacterium
AQLTRLASDDGLISPDE

SEQ ID NO: 1259195 - protein, 20 aa, Mycobacterium
AQMEYLRRLRNAKNLRDVVR

SEQ ID NO: 1259196 - protein, 18 aa, Mycobacterium
AQMFPRPIGMVIGLEVTG

SEQ ID NO: 1259197 - protein, 18 aa, Mycobacterium
AQMVRLLVRYAASELDRN

SEQ ID NO: 1259198 - protein, 17 aa, Mycobacterium
AQMYRRFGAAVTVIERG

SEQ ID NO: 1259199 - protein, 21 aa, Mycobacterium
AQNRLRPGVVRGEHTHHPTTA

SEQ ID NO: 1259200 - protein, 18 aa, Mycobacterium
AQPRPKSTALVVWQPRNQ

SEQ ID NO: 1259201 - protein, 22 aa, Mycobacterium
AQPSERRLLIVIGDGLISDEGY

SEQ ID NO: 1259202 - protein, 18 aa, Mycobacterium
AQPWRLGDEMLRVTRPGG

SEQ ID NO: 1259203 - protein, 26 aa, Mycobacterium
AQQALQAFRKFGFQLVIVATVQNATT

SEQ ID NO: 1259204 - protein, 23 aa, Mycobacterium
AQQFYGAVFGWTFESAGPEYGGY

SEQ ID NO: 1259205 - protein, 22 aa, Mycobacterium
AQRAELCFIAVRPRRWLSTYGI

SEQ ID NO: 1259206 - protein, 22 aa, Mycobacterium
AQRDIFQWQGLDVVGGRHNDVQ

SEQ ID NO: 1259207 - protein, 19 aa, Mycobacterium
AQRGCPDLATAALADGFAA

SEQ ID NO: 1259208 - protein, 23 aa, Mycobacterium
AQRGRFPGHPSYFLKPPTSLALS

SEQ ID NO: 1259209 - protein, 26 aa, Mycobacterium
AQRIKELVIPPAWKDVWISPKPSGHI

SEQ ID NO: 1259210 - protein, 20 aa, Mycobacterium
AQRINARFPGTFVVPEAMIP

SEQ ID NO: 1259211 - protein, 18 aa, Mycobacterium
AQRLSLRPETVKSYLRSA

SEQ ID NO: 1259212 - protein, 23 aa, Mycobacterium
AQRMAEKLWQLRILDDEKSAGDI

SEQ ID NO: 1259213 - protein, 18 aa, Mycobacterium
AQRPELWNIYNGRHRKGE

SEQ ID NO: 1259214 - protein, 27 aa, Mycobacterium
AQRPIAVEAYGLFIFRDAIGALGGSTV

SEQ ID NO: 1259215 - protein, 19 aa, Mycobacterium
AQRQYVEIWVEVLRAVDPS

SEQ ID NO: 1259216 - protein, 21 aa, Mycobacterium
AQRWIAAGVFDPVVRERAGMR

SEQ ID NO: 1259217 - protein, 27 aa, Mycobacterium
AQRWRPDALLQLAEGWDSAARALGADV

SEQ ID NO: 1259218 - protein, 18 aa, Mycobacterium
AQRYPGARGMRRAVKSLS

SEQ ID NO: 1259219 - protein, 25 aa, Mycobacterium
AQSAVKPWLVTVAKLLGRIAPGAPV

SEQ ID NO: 1259220 - protein, 21 aa, Mycobacterium
AQSHGRVVLIYANRDPDAIIF

SEQ ID NO: 1259221 - protein, 25 aa, Mycobacterium
AQSIAAGWRRARPQDVLTLAPQSDG

SEQ ID NO: 1259222 - protein, 20 aa, Mycobacterium
AQSLCPDWNMRGVVDHVTSI

SEQ ID NO: 1259223 - protein, 21 aa, Mycobacterium
AQSLWRQRIFFEAQADLGGPA

SEQ ID NO: 1259224 - protein, 17 aa, Mycobacterium
AQSNGGSICRIATHCTE

SEQ ID NO: 1259225 - protein, 26 aa, Mycobacterium
AQSPKETWLRLLLIDAGFPRPTTQIP

SEQ ID NO: 1259226 - protein, 18 aa, Mycobacterium
AQSRYRIFIVDEAHMVTT

SEQ ID NO: 1259227 - protein, 18 aa, Mycobacterium
AQTAQGFGGYYASTEATT

SEQ ID NO: 1259228 - protein, 26 aa, Mycobacterium
AQTGIARTGLMYAFERDGVAPDLLTL

SEQ ID NO: 1259229 - protein, 26 aa, Mycobacterium
AQTPAGRPASMWNFASIRNLRTASRC

SEQ ID NO: 1259230 - protein, 23 aa, Mycobacterium
AQTRAEPHLARITCPALVINAEQ

SEQ ID NO: 1259231 - protein, 25 aa, Mycobacterium
AQTREMIKTGGFDAVCFTSSSTVRN

SEQ ID NO: 1259232 - protein, 17 aa, Mycobacterium
AQTRLGGGRIHHAMRTI

SEQ ID NO: 1259233 - protein, 17 aa, Mycobacterium
AQTRPALSVASGDTVTI

SEQ ID NO: 1259234 - protein, 18 aa, Mycobacterium
AQVAKELPQHGAMPYRSI

SEQ ID NO: 1259235 - protein, 23 aa, Mycobacterium
AQVELPSGVTLISDPETLVVNIV

SEQ ID NO: 1259236 - protein, 24 aa, Mycobacterium
AQVMRKLWHGELIFNHDGPLGKYQ

SEQ ID NO: 1259237 - protein, 18 aa, Mycobacterium
AQVPHRDYHLGFVPEEHL

SEQ ID NO: 1259238 - protein, 24 aa, Mycobacterium
AQVRDPRPLLGLAPLEQDGAADLL

SEQ ID NO: 1259239 - protein, 28 aa, Mycobacterium
AQVSYRDLAGFGRRFIDVSAEDLVADVM

SEQ ID NO: 1259240 - protein, 23 aa, Mycobacterium
AQWDQDLLTLFGLDDEAMPEIVG

SEQ ID NO: 1259241 - protein, 25 aa, Mycobacterium
AQWRDCVRYMVLVNVSFLQRNLRKG

SEQ ID NO: 1259242 - protein, 27 aa, Mycobacterium
AQWRGAAERVLRGFALSLLVPQRHYDA

SEQ ID NO: 1259243 - protein, 24 aa, Mycobacterium
AQWSSETLYSWAVCEPTTGELLAE

SEQ ID NO: 1259244 - protein, 17 aa, Mycobacterium
AQYADHWNFVGGPPEEF

SEQ ID NO: 1259245 - protein, 18 aa, Mycobacterium
AQYERAWGTIEELKEKDE

SEQ ID NO: 1259246 - protein, 27 aa, Mycobacterium
AQYNSDCGFFIRYCLDVGLDKYGQGVG

SEQ ID NO: 1259247 - protein, 18 aa, Mycobacterium
AQYYRRRFRHILVDEYQD

SEQ ID NO: 1259248 - protein, 30 aa, Mycobacterium
ARAAERLGLRTVWLSERWGTKDLGVIAGAV

SEQ ID NO: 1259249 - protein, 24 aa, Mycobacterium
ARAAGLAAHLGRALGRIGTDALIG

SEQ ID NO: 1259250 - protein, 21 aa, Mycobacterium
ARAAGVRVVHCLVQRRPDGLG

SEQ ID NO: 1259251 - protein, 25 aa, Mycobacterium
ARAAKAWPFEFLPAASWSAQPPTYQ

SEQ ID NO: 1259252 - protein, 18 aa, Mycobacterium
ARAALGVLDGHRLLCAHR

SEQ ID NO: 1259253 - protein, 24 aa, Mycobacterium
ARAARAGVMLRRVDDLDALKRLVN

SEQ ID NO: 1259254 - protein, 24 aa, Mycobacterium
ARAARLRAQMAFVSSRVGESGAPA

SEQ ID NO: 1259255 - protein, 28 aa, Mycobacterium
ARACGVGIRAFELAVRYAQQRSTFGKPI

SEQ ID NO: 1259256 - protein, 19 aa, Mycobacterium
ARADAKWAALAELLTSEAM

SEQ ID NO: 1259257 - protein, 20 aa, Mycobacterium
ARADARWVLDAVKNRQTSHI

SEQ ID NO: 1259258 - protein, 19 aa, Mycobacterium
ARADCAEFAASGARIRLCK

SEQ ID NO: 1259259 - protein, 19 aa, Mycobacterium
ARADCHWIKSAPSPTGSHG

SEQ ID NO: 1259260 - protein, 18 aa, Mycobacterium
ARADECWSQIQKLMTRRG

SEQ ID NO: 1259261 - protein, 21 aa, Mycobacterium
ARADRGAAIDPHLERLSDADR

SEQ ID NO: 1259262 - protein, 21 aa, Mycobacterium
ARADVLAGLELAERDGLVVAD

SEQ ID NO: 1259263 - protein, 25 aa, Mycobacterium
ARAEEEAFVLLALQAPVAGDLRAIV

SEQ ID NO: 1259264 - protein, 23 aa, Mycobacterium
ARAEELTAWLGGVQVKPRFPSPA

SEQ ID NO: 1259265 - protein, 22 aa, Mycobacterium
ARAELRARYGLGERPVVVCVSR

SEQ ID NO: 1259266 - protein, 22 aa, Mycobacterium
ARAERSWKVIARALLDGYDVGR

SEQ ID NO: 1259267 - protein, 20 aa, Mycobacterium
ARAFVNRPLVLLADEPTGNL

SEQ ID NO: 1259268 - protein, 22 aa, Mycobacterium
ARAGEMLELVAAYAADPLDPQW

SEQ ID NO: 1259269 - protein, 23 aa, Mycobacterium
ARAGSHIMLEWGDVFGPWEAGPQ

SEQ ID NO: 1259270 - protein, 18 aa, Mycobacterium
ARAGVPHQRLSTHVVARI

SEQ ID NO: 1259271 - protein, 19 aa, Mycobacterium
ARAGVVAAVHAGRVGAAAG

SEQ ID NO: 1259272 - protein, 17 aa, Mycobacterium
ARAIAWNFAYRSPAARG

SEQ ID NO: 1259273 - protein, 18 aa, Mycobacterium
ARAIEVLHAAELIGELLR

SEQ ID NO: 1259274 - protein, 17 aa, Mycobacterium
ARAILPTARVVDAGGTD

SEQ ID NO: 1259275 - protein, 20 aa, Mycobacterium
ARALAEFKAMFQMKFYAVAL

SEQ ID NO: 1259276 - protein, 19 aa, Mycobacterium
ARALAKAGAHVILAARNAA

SEQ ID NO: 1259277 - protein, 24 aa, Mycobacterium
ARALCLRLLTARARTRAELEAALA

SEQ ID NO: 1259278 - protein, 27 aa, Mycobacterium
ARALGCTIKLLAICERLTTGKGKQQVS

SEQ ID NO: 1259279 - protein, 21 aa, Mycobacterium
ARALSRFAGTGWVEGVATRIM

SEQ ID NO: 1259280 - protein, 21 aa, Mycobacterium
ARALTPPSLVARVVRALEAGH

SEQ ID NO: 1259281 - protein, 22 aa, Mycobacterium
ARALTPPSLVARVVRALEAGHS

SEQ ID NO: 1259282 - protein, 21 aa, Mycobacterium
ARAMEWPDLVPDSGAVAGDTR

SEQ ID NO: 1259283 - protein, 23 aa, Mycobacterium
ARANARGLVVVRMGSETKGSEGV

SEQ ID NO: 1259284 - protein, 20 aa, Mycobacterium
ARANLKWTPQPAMPGQLRAV

SEQ ID NO: 1259285 - protein, 18 aa, Mycobacterium
ARANWPGVDFAVGSVHTL

SEQ ID NO: 1259286 - protein, 21 aa, Mycobacterium
ARAPLAVPVADALGLALACDV

SEQ ID NO: 1259287 - protein, 19 aa, Mycobacterium
ARAPRAFLQGDPRIRRLWP

SEQ ID NO: 1259288 - protein, 20 aa, Mycobacterium
ARAPRCGVCPLQRCGWRARG

SEQ ID NO: 1259289 - protein, 19 aa, Mycobacterium
ARAPSTWPGDGVRRLFDEP

SEQ ID NO: 1259290 - protein, 26 aa, Mycobacterium
ARAQAWPHWADPDVVRAFHDRGVEAL

SEQ ID NO: 1259291 - protein, 19 aa, Mycobacterium
ARAQSFWEPLARWQPPLLV

SEQ ID NO: 1259292 - protein, 20 aa, Mycobacterium
ARARAKVSMRVAPGGDAAAH

SEQ ID NO: 1259293 - protein, 25 aa, Mycobacterium
ARARAQGLSNIWCRVMNGQDLDLAD

SEQ ID NO: 1259294 - protein, 30 aa, Mycobacterium
ARARCRRLEALPGWSWEYRARPTWEAAFDA

SEQ ID NO: 1259295 - protein, 20 aa, Mycobacterium
ARARDKGVFGTKMRSVIKMP

SEQ ID NO: 1259296 - protein, 21 aa, Mycobacterium
ARARGAKVLGRLMGASITSDG

SEQ ID NO: 1259297 - protein, 25 aa, Mycobacterium
ARARNRPVWIKGFGEQVPYKTPTYA

SEQ ID NO: 1259298 - protein, 20 aa, Mycobacterium
ARARRLKVQTTHEGVEGLLA

SEQ ID NO: 1259299 - protein, 26 aa, Mycobacterium
ARARRRFDWGVPLGVEVPRLASAVAR

SEQ ID NO: 1259300 - protein, 17 aa, Mycobacterium
ARARTWLAENMPSIDPD

SEQ ID NO: 1259301 - protein, 20 aa, Mycobacterium
ARARYSWDRIAADTLRIYER

SEQ ID NO: 1259302 - protein, 24 aa, Mycobacterium
ARASAEAFSALGYYGVSMEMIASR

SEQ ID NO: 1259303 - protein, 18 aa, Mycobacterium
ARASSTVIREVWDDARES

SEQ ID NO: 1259304 - protein, 21 aa, Mycobacterium
ARATLFPLTWNEPGGTAVIES

SEQ ID NO: 1259305 - protein, 17 aa, Mycobacterium
ARATPVMRDRGAEGYPA

SEQ ID NO: 1259306 - protein, 29 aa, Mycobacterium
ARATRRVCRDCGFYLPLGGALGVLFGVCA

SEQ ID NO: 1259307 - protein, 25 aa, Mycobacterium
ARAVIAVRGLHRFAAAEGITTVDVA

SEQ ID NO: 1259308 - protein, 19 aa, Mycobacterium
ARAVMIGRAYLWGLAANGQ

SEQ ID NO: 1259309 - protein, 25 aa, Mycobacterium
ARAVTRGRPAITWAEGTAEALPVPD

SEQ ID NO: 1259310 - protein, 24 aa, Mycobacterium
ARAVVARARQRGCTLLVTGGDWQG

SEQ ID NO: 1259311 - protein, 18 aa, Mycobacterium
ARAVWLRETLLLPTVGEP

SEQ ID NO: 1259312 - protein, 24 aa, Mycobacterium
ARAWTEPEYREWLLSDATAAIADM

SEQ ID NO: 1259313 - protein, 23 aa, Mycobacterium
ARCQGAPLFELRAALDDFVSRGE

SEQ ID NO: 1259314 - protein, 19 aa, Mycobacterium
ARCRALLLAARGDLTAAVS

SEQ ID NO: 1259315 - protein, 23 aa, Mycobacterium
ARDAADAARLWRVSEQLAGAQFA

SEQ ID NO: 1259316 - protein, 30 aa, Mycobacterium
ARDAGLPGIIAHGLCTMAFTSWAVLTEVAG

SEQ ID NO: 1259317 - protein, 25 aa, Mycobacterium
ARDAGLRLTARMVFEQPTLYDLAAA

SEQ ID NO: 1259318 - protein, 21 aa, Mycobacterium
ARDALADWVGFKAQLPSNGET

SEQ ID NO: 1259319 - protein, 20 aa, Mycobacterium
ARDFCRRRVAVGTTTALVFG

SEQ ID NO: 1259320 - protein, 28 aa, Mycobacterium
ARDGGCTKPGCPVGAYGCQGHHVEADFA

SEQ ID NO: 1259321 - protein, 18 aa, Mycobacterium
ARDGGVCVVFVTGRIAAE

SEQ ID NO: 1259322 - protein, 24 aa, Mycobacterium
ARDGLTFSGWLFRPPEGVETIGAM

SEQ ID NO: 1259323 - protein, 23 aa, Mycobacterium
ARDLPCHTGIRMLGSNSHALGRV

SEQ ID NO: 1259324 - protein, 20 aa, Mycobacterium
ARDLSRELIRVCTIAPGLFK

SEQ ID NO: 1259325 - protein, 23 aa, Mycobacterium
ARDPRFLAYPGIGEERYGAIFSV

SEQ ID NO: 1259326 - protein, 21 aa, Mycobacterium
ARDQLGWRPNFSAAETLSALA

SEQ ID NO: 1259327 - protein, 17 aa, Mycobacterium
ARDRARRSLVVVLTDGR

SEQ ID NO: 1259328 - protein, 30 aa, Mycobacterium
ARDRGCTRPGCTAPGYWCQAHHASADFVNG

SEQ ID NO: 1259329 - protein, 20 aa, Mycobacterium
ARDSYHIGVFGLKGGVGKTA

SEQ ID NO: 1259330 - protein, 20 aa, Mycobacterium
ARDVPEEWLQVSVDDVPFLY

SEQ ID NO: 1259331 - protein, 20 aa, Mycobacterium
ARDWSEQFVIGGRTTFVEEA

SEQ ID NO: 1259332 - protein, 18 aa, Mycobacterium
AREAAAAEAARRERRKVI

SEQ ID NO: 1259333 - protein, 19 aa, Mycobacterium
AREALIKTDIFGGQDLEKV

SEQ ID NO: 1259334 - protein, 23 aa, Mycobacterium
AREGVTWCVIASPAVSRVLELCD

SEQ ID NO: 1259335 - protein, 24 aa, Mycobacterium
AREILGMVCDLYALSVIEEDKAWF

SEQ ID NO: 1259336 - protein, 26 aa, Mycobacterium
ARELRERPAWITGFEHRIETPVLGAR

SEQ ID NO: 1259337 - protein, 24 aa, Mycobacterium
ARELTRPPAMVTHSIATRAVQTAG

SEQ ID NO: 1259338 - protein, 27 aa, Mycobacterium
ARELYRLGLESVPFLLAVGDLLLGWLL

SEQ ID NO: 1259339 - protein, 23 aa, Mycobacterium
AREMVRAGIPGMIVNTASMAGKQ

SEQ ID NO: 1259340 - protein, 20 aa, Mycobacterium
ARERAEYVGALWQADTGAHG

SEQ ID NO: 1259341 - protein, 23 aa, Mycobacterium
ARERISTALAIAVETGMHFHDAE

SEQ ID NO: 1259342 - protein, 18 aa, Mycobacterium
ARERLRDQVLYVDDAHLL

SEQ ID NO: 1259343 - protein, 18 aa, Mycobacterium
ARERRTAKELTRIENQLT

SEQ ID NO: 1259344 - protein, 17 aa, Mycobacterium
ARERRVSGLAGFTDPDG

SEQ ID NO: 1259345 - protein, 27 aa, Mycobacterium
AREWQRLLFDNGWLLPAQPPEFGGRNA

SEQ ID NO: 1259346 - protein, 21 aa, Mycobacterium
ARFAGPIVVIELDMKFGGLEL

SEQ ID NO: 1259347 - protein, 19 aa, Mycobacterium
ARFETRWPQPDTAIVSGLG

SEQ ID NO: 1259348 - protein, 18 aa, Mycobacterium
ARFFEVMLTIVLDNSNIT

SEQ ID NO: 1259349 - protein, 17 aa, Mycobacterium
ARFIPMTLPVIWDPEAC

SEQ ID NO: 1259350 - protein, 21 aa, Mycobacterium
ARFKNGRLYTPITVMGVTVWR

SEQ ID NO: 1259351 - protein, 20 aa, Mycobacterium
ARFLHEKRGFFLLVGGDYSA

SEQ ID NO: 1259352 - protein, 25 aa, Mycobacterium
ARFLQLCDAFGFPVVSLIDCPGYMV

SEQ ID NO: 1259353 - protein, 38 aa, Mycobacterium
ARFPGGMYRNKCWLPYPGDDVLLCLGIHGQMIYVNRPA

SEQ ID NO: 1259354 - protein, 20 aa, Mycobacterium
ARFQLDIMGVPGIIVARTDA

SEQ ID NO: 1259355 - protein, 22 aa, Mycobacterium
ARFQLDIMRVPGIIVARTDAEA

SEQ ID NO: 1259356 - protein, 28 aa, Mycobacterium
ARFRVDRPIRVTGWPPKGTDRGKGDAVA

SEQ ID NO: 1259357 - protein, 22 aa, Mycobacterium
ARFSDVVAVRMGMPGVEYYAHP

SEQ ID NO: 1259358 - protein, 20 aa, Mycobacterium
ARFVERFPVPVGGYGQPEQL

SEQ ID NO: 1259359 - protein, 17 aa, Mycobacterium
ARFYRGRDCMTWLADMG

SEQ ID NO: 1259360 - protein, 19 aa, Mycobacterium
ARGAARALASLSTETKNRA

SEQ ID NO: 1259361 - protein, 21 aa, Mycobacterium
ARGAFFEWFTDAGFTAITGHR

SEQ ID NO: 1259362 - protein, 30 aa, Mycobacterium
ARGAKGRAKVLARYAVWLGEHRAEIEDLLI

SEQ ID NO: 1259363 - protein, 20 aa, Mycobacterium
ARGAPRCAALVEQAAAVYAR

SEQ ID NO: 1259364 - protein, 30 aa, Mycobacterium
ARGASPPGFPGHAPLRVALVGKEASRFGRV

SEQ ID NO: 1259365 - protein, 19 aa, Mycobacterium
ARGATPLARLMGAGITSDA

SEQ ID NO: 1259366 - protein, 17 aa, Mycobacterium
ARGAVTATLDRSPLRTV

SEQ ID NO: 1259367 - protein, 24 aa, Mycobacterium
ARGDLLAPAGFDFDRWRFELDCEV

SEQ ID NO: 1259368 - protein, 19 aa, Mycobacterium
ARGDVWGAALLTLAVGLSK

SEQ ID NO: 1259369 - protein, 18 aa, Mycobacterium
ARGFGEEVIRQFAQDIHI

SEQ ID NO: 1259370 - protein, 18 aa, Mycobacterium
ARGFSLNTANFFTTEESI

SEQ ID NO: 1259371 - protein, 23 aa, Mycobacterium
ARGFYRHWLDMLTGKPWSEIQKW

SEQ ID NO: 1259372 - protein, 20 aa, Mycobacterium
ARGGTIIGDIVDYALHHGAP

SEQ ID NO: 1259373 - protein, 27 aa, Mycobacterium
ARGILTSRFGARWGTLHAGLDIANAVG

SEQ ID NO: 1259374 - protein, 34 aa, Mycobacterium
ARGKKLTFELARFVKFMITEIFPGGRVPTTQMMV

SEQ ID NO: 1259375 - protein, 18 aa, Mycobacterium
ARGLAPVGAGLPGAGASG

SEQ ID NO: 1259376 - protein, 19 aa, Mycobacterium
ARGLAPVGAGLPGAGASGS

SEQ ID NO: 1259377 - protein, 20 aa, Mycobacterium
ARGLDAFRADVLALLPEAAT

SEQ ID NO: 1259378 - protein, 27 aa, Mycobacterium
ARGLEWARGELGMWLRRIGAADSPVSD

SEQ ID NO: 1259379 - protein, 17 aa, Mycobacterium
ARGLTAIVKGLRTGTDF

SEQ ID NO: 1259380 - protein, 20 aa, Mycobacterium
ARGMVARGRGAIVNITSPAG

SEQ ID NO: 1259381 - protein, 23 aa, Mycobacterium
ARGRAGEAIPVLRDVRESIRRLD

SEQ ID NO: 1259382 - protein, 17 aa, Mycobacterium
ARGRFAGKHTMDVVAAA

SEQ ID NO: 1259383 - protein, 23 aa, Mycobacterium
ARGRILNALLWTAQRVPLLDPVR

SEQ ID NO: 1259384 - protein, 22 aa, Mycobacterium
ARGRLAMAMGAIRARNSIDEAA

SEQ ID NO: 1259385 - protein, 17 aa, Mycobacterium
ARGRLQEGQAWFDAALT

SEQ ID NO: 1259386 - protein, 19 aa, Mycobacterium
ARGTEVVHIDPRFTRTSAL

SEQ ID NO: 1259387 - protein, 26 aa, Mycobacterium
ARGWTNATAPAWARPLITVNPVLTAE

SEQ ID NO: 1259388 - protein, 18 aa, Mycobacterium
ARGYTGWDVTSPAYILEN

SEQ ID NO: 1259389 - protein, 18 aa, Mycobacterium
ARHAADLTAAAEAKTQMA

SEQ ID NO: 1259390 - protein, 17 aa, Mycobacterium
ARHDIRPLFVLFDSCWD

SEQ ID NO: 1259391 - protein, 24 aa, Mycobacterium
ARHEVTGAIALLRRNAELGRTLAG

SEQ ID NO: 1259392 - protein, 20 aa, Mycobacterium
ARHFDHLNVIAGFDELARKI

SEQ ID NO: 1259393 - protein, 17 aa, Mycobacterium
ARHGRSIARRIAEPYLR

SEQ ID NO: 1259394 - protein, 19 aa, Mycobacterium
ARHKVPRDVLFVDALPRNE

SEQ ID NO: 1259395 - protein, 18 aa, Mycobacterium
ARHLARCVRAVKAAVPQL

SEQ ID NO: 1259396 - protein, 18 aa, Mycobacterium
ARHLPGLSGRRDDDAQSY

SEQ ID NO: 1259397 - protein, 21 aa, Mycobacterium
ARHMISLALNMGRAMTAGGRL

SEQ ID NO: 1259398 - protein, 25 aa, Mycobacterium
ARHRLSKLLLRHGIVYYGGQAWTGA

SEQ ID NO: 1259399 - protein, 17 aa, Mycobacterium
ARHTGGTFVFRIEDTDS

SEQ ID NO: 1259400 - protein, 25 aa, Mycobacterium
ARHVKRTLDAWLRELTATISAAQAD

SEQ ID NO: 1259401 - protein, 33 aa, Mycobacterium
ARHWLARLARLRPVPAPVWRGVGAIRLPAPAAR

SEQ ID NO: 1259402 - protein, 19 aa, Mycobacterium
ARIAAHRVVDGHGDLLSQD

SEQ ID NO: 1259403 - protein, 31 aa, Mycobacterium
ARIDCGLAGTVLRFVPPVAALTTETVTFDGD

SEQ ID NO: 1259404 - protein, 17 aa, Mycobacterium
ARIDEVITRGATEIWEI

SEQ ID NO: 1259405 - protein, 26 aa, Mycobacterium
ARIEAAGWSDVRWRNLTGGIVALHAA

SEQ ID NO: 1259406 - protein, 20 aa, Mycobacterium
ARIETEIADLLSAVHTVQNG

SEQ ID NO: 1259407 - protein, 32 aa, Mycobacterium
ARIGRPLRVGHAWSFTFDAAWQPLAALLDGHS

SEQ ID NO: 1259408 - protein, 17 aa, Mycobacterium
ARIHGVRTNRDLLVNVL

SEQ ID NO: 1259409 - protein, 29 aa, Mycobacterium
ARIIGELLPDLTLPYGVNVLWDGRASIDL

SEQ ID NO: 1259410 - protein, 25 aa, Mycobacterium
ARIKLPKLGWVKFRASRDLAGEVIR

SEQ ID NO: 1259411 - protein, 28 aa, Mycobacterium
ARIKSIGLRLGVPWYAYDTITFTGEVTA

SEQ ID NO: 1259412 - protein, 17 aa, Mycobacterium
ARIKWLMADKTKDYDDI

SEQ ID NO: 1259413 - protein, 27 aa, Mycobacterium
ARIPVDAGPVALEFPGPIAELQLSRDG

SEQ ID NO: 1259414 - protein, 23 aa, Mycobacterium
ARIPYVRRRGAHLYNFWRDATNP

SEQ ID NO: 1259415 - protein, 20 aa, Mycobacterium
ARIRPGEWVTVVGAGGVGLS

SEQ ID NO: 1259416 - protein, 19 aa, Mycobacterium
ARITILEVMAEAIDTPDEM

SEQ ID NO: 1259417 - protein, 32 aa, Mycobacterium
ARIVDHWDMFETIRFDLNLVVAGDDGEHVAIV

SEQ ID NO: 1259418 - protein, 23 aa, Mycobacterium
ARKADDSLVRWRHLERAHIVSQP

SEQ ID NO: 1259419 - protein, 22 aa, Mycobacterium
ARKDVPAILTFGGGAHYCLGAN

SEQ ID NO: 1259420 - protein, 24 aa, Mycobacterium
ARKFPDFFRKQLLTMAKHRLPEGY

SEQ ID NO: 1259421 - protein, 19 aa, Mycobacterium
ARKIAAIGIRVARGTTLHG

SEQ ID NO: 1259422 - protein, 30 aa, Mycobacterium
ARKLAPRFTCSKVFCRLNIAVIALSISYSK

SEQ ID NO: 1259423 - protein, 19 aa, Mycobacterium
ARKLAVMAEIFTRRTQLPA

SEQ ID NO: 1259424 - protein, 25 aa, Mycobacterium
ARKLAVMAELFIRRTTLAPQDRLDW

SEQ ID NO: 1259425 - protein, 25 aa, Mycobacterium
ARKLREIRAALAMDAALPKAEILTR

SEQ ID NO: 1259426 - protein, 25 aa, Mycobacterium
ARKQWPSGLAKLGLDLSGRIHDGPA

SEQ ID NO: 1259427 - protein, 18 aa, Mycobacterium
ARKRGWEGVVAKKRDSTY

SEQ ID NO: 1259428 - protein, 21 aa, Mycobacterium
ARLAADCGVDILVAQGPSAGG

SEQ ID NO: 1259429 - protein, 22 aa, Mycobacterium
ARLAAGEAFSKVAAEAVQMHGG

SEQ ID NO: 1259430 - protein, 20 aa, Mycobacterium
ARLADFGSLSAWADGIDHSC

SEQ ID NO: 1259431 - protein, 17 aa, Mycobacterium
ARLDLPPMCSADPDGSH

SEQ ID NO: 1259432 - protein, 26 aa, Mycobacterium
ARLDNLPLEHWMLLSYPVLGLAPLSP

SEQ ID NO: 1259433 - protein, 27 aa, Mycobacterium
ARLDNPALLCYYLFFPAHEESVGDGAC

SEQ ID NO: 1259434 - protein, 20 aa, Mycobacterium
ARLDPAWAQELARIRLTLTA

SEQ ID NO: 1259435 - protein, 19 aa, Mycobacterium
ARLDRITFDVTFTAATGDS

SEQ ID NO: 1259436 - protein, 32 aa, Mycobacterium
ARLDSEPGRPLWPMVILRTPKGWTGPREVDGK

SEQ ID NO: 1259437 - protein, 19 aa, Mycobacterium
ARLFPGEGGIDLTGMLRAL

SEQ ID NO: 1259438 - protein, 19 aa, Mycobacterium
ARLGDAFEVIEIDSAKGNP

SEQ ID NO: 1259439 - protein, 17 aa, Mycobacterium
ARLGLRESATFDRATIA

SEQ ID NO: 1259440 - protein, 17 aa, Mycobacterium
ARLHIFRHLLIDHDPTP

SEQ ID NO: 1259441 - protein, 18 aa, Mycobacterium
ARLHRWRSATALAGAPDA

SEQ ID NO: 1259442 - protein, 21 aa, Mycobacterium
ARLKSVPILLAPPWGLAVSDM

SEQ ID NO: 1259443 - protein, 28 aa, Mycobacterium
ARLLAEVLRLRGWHVDFLGAQVPTPHLI

SEQ ID NO: 1259444 - protein, 24 aa, Mycobacterium
ARLLDRVDLAPGFSYAESTMGTNG

SEQ ID NO: 1259445 - protein, 18 aa, Mycobacterium
ARLNRLFDTVYPPGRGPH

SEQ ID NO: 1259446 - protein, 24 aa, Mycobacterium
ARLPGARCTTAFCAVLDPETGEVV

SEQ ID NO: 1259447 - protein, 18 aa, Mycobacterium
ARLPGGGFRGAFDPESGV

SEQ ID NO: 1259448 - protein, 19 aa, Mycobacterium
ARLPLDHPEVYLAAIDEER

SEQ ID NO: 1259449 - protein, 18 aa, Mycobacterium
ARLQEVWVGRQIAEVKSK

SEQ ID NO: 1259450 - protein, 23 aa, Mycobacterium
ARLQKRLGTTTVYVTHDQTEAMT

SEQ ID NO: 1259451 - protein, 18 aa, Mycobacterium
ARLQPGSFYALPQSPQLF

SEQ ID NO: 1259452 - protein, 19 aa, Mycobacterium
ARLQRPLYVMPTRGILTSG

SEQ ID NO: 1259453 - protein, 19 aa, Mycobacterium
ARLRAEIMTGALRPDSFIR

SEQ ID NO: 1259454 - protein, 18 aa, Mycobacterium
ARLRDWLVTYLTTHVECS

SEQ ID NO: 1259455 - protein, 22 aa, Mycobacterium
ARLREAVRVFGFHLSGLDMRQN

SEQ ID NO: 1259456 - protein, 19 aa, Mycobacterium
ARLRRGWVRAQARTLTTPG

SEQ ID NO: 1259457 - protein, 22 aa, Mycobacterium
ARLSALARNAADLGVVADTARL

SEQ ID NO: 1259458 - protein, 22 aa, Mycobacterium
ARLSALARNAAELGVAADTAHL

SEQ ID NO: 1259459 - protein, 20 aa, Mycobacterium
ARLSTERDILRSAAKYFAGE

SEQ ID NO: 1259460 - protein, 19 aa, Mycobacterium
ARLTAKIVMLNMANKIEWT

SEQ ID NO: 1259461 - protein, 21 aa, Mycobacterium
ARLTVDLMRPVAMAPVQVQTS

SEQ ID NO: 1259462 - protein, 20 aa, Mycobacterium
ARLVEYVIMGQVLTAGAGQM

SEQ ID NO: 1259463 - protein, 27 aa, Mycobacterium
ARLWPHPPEAIGPRYVAAMGGIDRVVE

SEQ ID NO: 1259464 - protein, 20 aa, Mycobacterium
ARLWRDSRVQRLYAGTTEIM

SEQ ID NO: 1259465 - protein, 21 aa, Mycobacterium
ARLYAEMQLRLTDLAADLAVN

SEQ ID NO: 1259466 - protein, 20 aa, Mycobacterium
ARLYEARFLFEEHGDTESVR

SEQ ID NO: 1259467 - protein, 19 aa, Mycobacterium
ARMAGVVFPGETLRVNVWK

SEQ ID NO: 1259468 - protein, 20 aa, Mycobacterium
ARMAREYPDTDVLVFGHSHI

SEQ ID NO: 1259469 - protein, 25 aa, Mycobacterium
ARMLEALDTWPLNIALLGKGNTVSA

SEQ ID NO: 1259470 - protein, 20 aa, Mycobacterium
ARMPGFGLDGPWRDNPAFAY

SEQ ID NO: 1259471 - protein, 25 aa, Mycobacterium
ARMRASLDALCRFVEDARSPSGGFQ

SEQ ID NO: 1259472 - protein, 17 aa, Mycobacterium
ARMRGDGSLVPLAEQNR

SEQ ID NO: 1259473 - protein, 18 aa, Mycobacterium
ARNAISLETMEQLDKALD

SEQ ID NO: 1259474 - protein, 21 aa, Mycobacterium
ARNAKKPPVWLVGSSNSQGGS

SEQ ID NO: 1259475 - protein, 19 aa, Mycobacterium
ARNAMTPAMYFGIKYAVKH

SEQ ID NO: 1259476 - protein, 22 aa, Mycobacterium
ARNEGVLGWLHSVARSHVEVGL

SEQ ID NO: 1259477 - protein, 20 aa, Mycobacterium
ARNLKYMRAFAAAWPDPEIV

SEQ ID NO: 1259478 - protein, 19 aa, Mycobacterium
ARNPFRVFTSMLASADIRF

SEQ ID NO: 1259479 - protein, 27 aa, Mycobacterium
ARPALLSVSFGEDWSWVRRAHEVGATA

SEQ ID NO: 1259480 - protein, 17 aa, Mycobacterium
ARPAMWPTIDAELTRRP

SEQ ID NO: 1259481 - protein, 20 aa, Mycobacterium
ARPARFAYPPNLFVVDGGAP

SEQ ID NO: 1259482 - protein, 20 aa, Mycobacterium
ARPDPTWDGAVGLVTDLLDT

SEQ ID NO: 1259483 - protein, 25 aa, Mycobacterium
ARPEFLDAALAYVRFALANPGHYEV

SEQ ID NO: 1259484 - protein, 26 aa, Mycobacterium
ARPEPEHHAAPSWLGKNGFTPFSGIH

SEQ ID NO: 1259485 - protein, 17 aa, Mycobacterium
ARPFAPLLAATKATRTD

SEQ ID NO: 1259486 - protein, 21 aa, Mycobacterium
ARPGEVLGLTFTRKAAGQLLR

SEQ ID NO: 1259487 - protein, 17 aa, Mycobacterium
ARPGKLFGRSRSFPLTN

SEQ ID NO: 1259488 - protein, 21 aa, Mycobacterium
ARPGVEVGQSYPFAPPVGLMF

SEQ ID NO: 1259489 - protein, 20 aa, Mycobacterium
ARPGYLEYLTPLVARRRAER

SEQ ID NO: 1259490 - protein, 21 aa, Mycobacterium
ARPLLAEAVDLARSMGDKWML

SEQ ID NO: 1259491 - protein, 20 aa, Mycobacterium
ARPLRQGDVIPRERTSVPAD

SEQ ID NO: 1259492 - protein, 33 aa, Mycobacterium
ARPMTLRFLDAPPRFLFFTGKGGVGKTSIACAA

SEQ ID NO: 1259493 - protein, 19 aa, Mycobacterium
ARPNRVLVVGSGFIGSEMA

SEQ ID NO: 1259494 - protein, 18 aa, Mycobacterium
ARPPFELIEPGDEPWGHG

SEQ ID NO: 1259495 - protein, 24 aa, Mycobacterium
ARPPRWPAGDVRGDILALCAARPS

SEQ ID NO: 1259496 - protein, 17 aa, Mycobacterium
ARPPTFVLFTTGFLEAG

SEQ ID NO: 1259497 - protein, 24 aa, Mycobacterium
ARPRRYVMTPPHFFAVDYVINPWM

SEQ ID NO: 1259498 - protein, 20 aa, Mycobacterium
ARPRVIATRAVVVLVSEKRQ

SEQ ID NO: 1259499 - protein, 22 aa, Mycobacterium
ARPSPWPVASGVHLLRTLDDSR

SEQ ID NO: 1259500 - protein, 22 aa, Mycobacterium
ARPTFRAMADKLAGYGYAVLVP

SEQ ID NO: 1259501 - protein, 22 aa, Mycobacterium
ARPYPIPIICALLGAPREDWQL

SEQ ID NO: 1259502 - protein, 22 aa, Mycobacterium
ARPYPIPIICALLGAPREDWRL

SEQ ID NO: 1259503 - protein, 28 aa, Mycobacterium
ARQAAHDWHEFIAFRGRELCPGGRLVVM

SEQ ID NO: 1259504 - protein, 24 aa, Mycobacterium
ARQAVKDYVMFPAMSGTRWRRTLV

SEQ ID NO: 1259505 - protein, 31 aa, Mycobacterium
ARQGFKDYALWPALSLRRWRRTLKANAVANL

SEQ ID NO: 1259506 - protein, 24 aa, Mycobacterium
ARQGMLRLVDRYGADVVTTVMTTM

SEQ ID NO: 1259507 - protein, 28 aa, Mycobacterium
ARQGRDILDPELLEWAAGTHDDAADVEE

SEQ ID NO: 1259508 - protein, 18 aa, Mycobacterium
ARQITGWVAALGASTGDR

SEQ ID NO: 1259509 - protein, 18 aa, Mycobacterium
ARQLPGRLVGVSVDADGA

SEQ ID NO: 1259510 - protein, 25 aa, Mycobacterium
ARQRLVEMRDFYAFLMAEIPAVLER

SEQ ID NO: 1259511 - protein, 17 aa, Mycobacterium
ARQRWCSRLVQGGGGAS

SEQ ID NO: 1259512 - protein, 21 aa, Mycobacterium
ARRAELVSAIDGELVALYERQ

SEQ ID NO: 1259513 - protein, 19 aa, Mycobacterium
ARRAGVRVRPLRVLVKPCR

SEQ ID NO: 1259514 - protein, 26 aa, Mycobacterium
ARRALEVLRRLYARVGDRLVLISVGG

SEQ ID NO: 1259515 - protein, 22 aa, Mycobacterium
ARRAWPELADRPGALLRQLILV

SEQ ID NO: 1259516 - protein, 17 aa, Mycobacterium
ARRERRKVIALNKLGEA

SEQ ID NO: 1259517 - protein, 20 aa, Mycobacterium
ARRGVVLAMGSFAYNEAMVA

SEQ ID NO: 1259518 - protein, 21 aa, Mycobacterium
ARRIFDMTVDYLKTRIQFGRQ

SEQ ID NO: 1259519 - protein, 17 aa, Mycobacterium
ARRLNAMESVRDEYNDY

SEQ ID NO: 1259520 - protein, 24 aa, Mycobacterium
ARRLNSVIATLSFETGLLAAEKDI

SEQ ID NO: 1259521 - protein, 23 aa, Mycobacterium
ARRLQFVGCLTLVPQLPVLADGL

SEQ ID NO: 1259522 - protein, 20 aa, Mycobacterium
ARRLSMSIVRPRSGVANLDP

SEQ ID NO: 1259523 - protein, 25 aa, Mycobacterium
ARRRAETRPGVAVRMLTSGTTGPPK

SEQ ID NO: 1259524 - protein, 23 aa, Mycobacterium
ARRRMWLPVGAIFGRLEPNANDY

SEQ ID NO: 1259525 - protein, 17 aa, Mycobacterium
ARRRPGETITLYDTRGA

SEQ ID NO: 1259526 - protein, 17 aa, Mycobacterium
ARRRRTFERFGIERFVR

SEQ ID NO: 1259527 - protein, 19 aa, Mycobacterium
ARRTLRAGFTTVRNLGLFV

SEQ ID NO: 1259528 - protein, 27 aa, Mycobacterium
ARRVDRIRVGDEWKLAARTIYFDQATL

SEQ ID NO: 1259529 - protein, 23 aa, Mycobacterium
ARRVFATCRRLGIGTVAVYTDAD

SEQ ID NO: 1259530 - protein, 26 aa, Mycobacterium
ARRVFVHLCSAAQWTAITGEVAPPTP

SEQ ID NO: 1259531 - protein, 42 aa, Mycobacterium
ARRVSIPAGWTMAVWARVPKARFARWAPDGALLVSVPSTGEI

SEQ ID NO: 1259532 - protein, 19 aa, Mycobacterium
ARRYNYEPTFILRGLTDLN

SEQ ID NO: 1259533 - protein, 27 aa, Mycobacterium
ARSALAREFLPEFGLSTECGLGRHSAE

SEQ ID NO: 1259534 - protein, 19 aa, Mycobacterium
ARSAMVVTVDRGRWGCALD

SEQ ID NO: 1259535 - protein, 19 aa, Mycobacterium
ARSAPLGAVPAEVVTAAFY

SEQ ID NO: 1259536 - protein, 19 aa, Mycobacterium
ARSELEFLQPGVLLDSLEE

SEQ ID NO: 1259537 - protein, 21 aa, Mycobacterium
ARSGAKAVLVQQGFLGVDYTA

SEQ ID NO: 1259538 - protein, 22 aa, Mycobacterium
ARSGHPRWAAPRTVPAVQPVPS

SEQ ID NO: 1259539 - protein, 23 aa, Mycobacterium
ARSILQRFDIDWKQHGFDETALD

SEQ ID NO: 1259540 - protein, 21 aa, Mycobacterium
ARSMAGYALGLVLKKCEPEQA

SEQ ID NO: 1259541 - protein, 24 aa, Mycobacterium
ARSPEALTALARRYESWLTAHPDA

SEQ ID NO: 1259542 - protein, 21 aa, Mycobacterium
ARSPRKAHLVYGVSSDADLVE

SEQ ID NO: 1259543 - protein, 22 aa, Mycobacterium
ARSRRIPVLVLAGQVTLDRAAL

SEQ ID NO: 1259544 - protein, 21 aa, Mycobacterium
ARSSSGLTTSVAWRLRGQTSY

SEQ ID NO: 1259545 - protein, 17 aa, Mycobacterium
ARSVARWTSGQVVPQRL

SEQ ID NO: 1259546 - protein, 23 aa, Mycobacterium
ARSVKVEALLQMAAYVETLTAAG

SEQ ID NO: 1259547 - protein, 27 aa, Mycobacterium
ARTAAGRPDLRFHDLRHSGAVLAAQTG

SEQ ID NO: 1259548 - protein, 20 aa, Mycobacterium
ARTAGALNLFALKPNAFDAD

SEQ ID NO: 1259549 - protein, 18 aa, Mycobacterium
ARTARRISPDGAPITVLV

SEQ ID NO: 1259550 - protein, 26 aa, Mycobacterium
ARTGKDAWRGSGWGHYVGAAELLRFL

SEQ ID NO: 1259551 - protein, 18 aa, Mycobacterium
ARTGWQLHSAAGGGQSAP

SEQ ID NO: 1259552 - protein, 20 aa, Mycobacterium
ARTLFGFPVVQAVGSAVPLA

SEQ ID NO: 1259553 - protein, 20 aa, Mycobacterium
ARTLFKSMVTAVLDRMPDYV

SEQ ID NO: 1259554 - protein, 19 aa, Mycobacterium
ARTLLGQTGAEVFVDAGAR

SEQ ID NO: 1259555 - protein, 17 aa, Mycobacterium
ARTLPLYGVPFGVKDSI

SEQ ID NO: 1259556 - protein, 19 aa, Mycobacterium
ARTLPLYGVPFGVKDSIDV

SEQ ID NO: 1259557 - protein, 18 aa, Mycobacterium
ARTPHFINENLVFVVTDA

SEQ ID NO: 1259558 - protein, 29 aa, Mycobacterium
ARTPWPAAPGRVYRAPWSLVANADPNGGD

SEQ ID NO: 1259559 - protein, 19 aa, Mycobacterium
ARTRARLHRPYGGFFDGVP

SEQ ID NO: 1259560 - protein, 18 aa, Mycobacterium
ARTSRIELGTGVVPIYTR

SEQ ID NO: 1259561 - protein, 20 aa, Mycobacterium
ARTTFPVWQMNAIGDLILHR

SEQ ID NO: 1259562 - protein, 17 aa, Mycobacterium
ARTTFQYLAVAIFGSDD

SEQ ID NO: 1259563 - protein, 20 aa, Mycobacterium
ARTTPGLPPGSMVCDIGGGT

SEQ ID NO: 1259564 - protein, 18 aa, Mycobacterium
ARTVAGISGHVRQEDSLT

SEQ ID NO: 1259565 - protein, 17 aa, Mycobacterium
ARTWLLLSTGLLTVADA

SEQ ID NO: 1259566 - protein, 21 aa, Mycobacterium
ARVADPPEWFGVIKPSRLMAA

SEQ ID NO: 1259567 - protein, 19 aa, Mycobacterium
ARVAEGHPVAWIHATALRT

SEQ ID NO: 1259568 - protein, 25 aa, Mycobacterium
ARVAGIDVAVCKPVQTGTGPVGGTG

SEQ ID NO: 1259569 - protein, 21 aa, Mycobacterium
ARVALDIATRYALQRRQFSDP

SEQ ID NO: 1259570 - protein, 20 aa, Mycobacterium
ARVAVGWWLVGSARAMLSLA

SEQ ID NO: 1259571 - protein, 18 aa, Mycobacterium
ARVDLPWQHVRARTAEEA

SEQ ID NO: 1259572 - protein, 22 aa, Mycobacterium
ARVEELLALIGMSELADRYPNQ

SEQ ID NO: 1259573 - protein, 25 aa, Mycobacterium
ARVGAELWPLVADGQVRPVIGAEFP

SEQ ID NO: 1259574 - protein, 18 aa, Mycobacterium
ARVGIGLPAADPGPVCRL

SEQ ID NO: 1259575 - protein, 23 aa, Mycobacterium
ARVGKSALYRRWPSKVEMTADLM

SEQ ID NO: 1259576 - protein, 18 aa, Mycobacterium
ARVGNVLYRDFRPVAVLD

SEQ ID NO: 1259577 - protein, 25 aa, Mycobacterium
ARVHRPRREGAPAMVHVDLYRLLDQ

SEQ ID NO: 1259578 - protein, 22 aa, Mycobacterium
ARVKDVFFYEPIILPEKASREV

SEQ ID NO: 1259579 - protein, 21 aa, Mycobacterium
ARVKDVFFYEPIILPEKSSRE

SEQ ID NO: 1259580 - protein, 35 aa, Mycobacterium
ARVKGSEIELPFATIPLRDEWRGVVEDGKLYIAGI

SEQ ID NO: 1259581 - protein, 17 aa, Mycobacterium
ARVLAALLFSEQPSVTM

SEQ ID NO: 1259582 - protein, 17 aa, Mycobacterium
ARVLHRPALLPVPALGP

SEQ ID NO: 1259583 - protein, 22 aa, Mycobacterium
ARVLQALLARWEHHPRVDLVTT

SEQ ID NO: 1259584 - protein, 27 aa, Mycobacterium
ARVLRPGGRLGLVWNNRDERLGWVKDL

SEQ ID NO: 1259585 - protein, 17 aa, Mycobacterium
ARVLRPGGVLLMSTPNR

SEQ ID NO: 1259586 - protein, 25 aa, Mycobacterium
ARVLSEKAGICLPTTYHLLRTLVHE

SEQ ID NO: 1259587 - protein, 25 aa, Mycobacterium
ARVPAPWRRPVYRIATAPFDEVFVF

SEQ ID NO: 1259588 - protein, 19 aa, Mycobacterium
ARVRIPLATLNRHGLVAGA

SEQ ID NO: 1259589 - protein, 17 aa, Mycobacterium
ARVRIRLLRELAATGES

SEQ ID NO: 1259590 - protein, 25 aa, Mycobacterium
ARVSAYRCGEAWSTLVHHRPTGVGL

SEQ ID NO: 1259591 - protein, 20 aa, Mycobacterium
ARVSEMISLINHLEKAIAWY

SEQ ID NO: 1259592 - protein, 20 aa, Mycobacterium
ARVSLPTREDQALIYRLSGD

SEQ ID NO: 1259593 - protein, 19 aa, Mycobacterium
ARVSRKSVYNHSNLLDQIH

SEQ ID NO: 1259594 - protein, 21 aa, Mycobacterium
ARVSVRAVVHRHYLEVLRPLV

SEQ ID NO: 1259595 - protein, 23 aa, Mycobacterium
ARVWVVGAACDLLAGTPLAQAAD

SEQ ID NO: 1259596 - protein, 18 aa, Mycobacterium
ARWACSALSPDAPRTRHT

SEQ ID NO: 1259597 - protein, 19 aa, Mycobacterium
ARWEENFAALAAFAATHRS

SEQ ID NO: 1259598 - protein, 22 aa, Mycobacterium
ARWFDAIGIIVLEGYGLTETAA

SEQ ID NO: 1259599 - protein, 21 aa, Mycobacterium
ARYAHVNVYGRFVVPEQVELV

SEQ ID NO: 1259600 - protein, 26 aa, Mycobacterium
ARYASLPTKALFRIPDEISLAEAAVV

SEQ ID NO: 1259601 - protein, 19 aa, Mycobacterium
ARYDYLVNMCDEMGIVTPE

SEQ ID NO: 1259602 - protein, 17 aa, Mycobacterium
ARYGALGIRGADGTWAS

SEQ ID NO: 1259603 - protein, 32 aa, Mycobacterium
ARYKLPKAVVFRPVIERSPAGKADYRWAREQA

SEQ ID NO: 1259604 - protein, 19 aa, Mycobacterium
ARYRRKVAWGVEIHSDGET

SEQ ID NO: 1259605 - protein, 20 aa, Mycobacterium
ASAALALPGVHAVFTAADLN

SEQ ID NO: 1259606 - protein, 22 aa, Mycobacterium
ASAARLAAQFPQVGAQLRQRYR

SEQ ID NO: 1259607 - protein, 43 aa, Mycobacterium
ASADAPAALAFLRRLGVAAGLAMGFPMLCAGVSAGTVVRRRGD

SEQ ID NO: 1259608 - protein, 17 aa, Mycobacterium
ASAEASASIDADRERID

SEQ ID NO: 1259609 - protein, 30 aa, Mycobacterium
ASAELGWERVIGALAERYHVLAPDMLGFGR

SEQ ID NO: 1259610 - protein, 17 aa, Mycobacterium
ASAELLIMPSLYEGAGL

SEQ ID NO: 1259611 - protein, 25 aa, Mycobacterium
ASAFKDYTERAAATLQRGGSLISNY

SEQ ID NO: 1259612 - protein, 17 aa, Mycobacterium
ASAFPIHRRVAGKNRGP

SEQ ID NO: 1259613 - protein, 34 aa, Mycobacterium
ASAGDESRPSWPMIVFRTPKGWTGPAYIDGKKTT

SEQ ID NO: 1259614 - protein, 22 aa, Mycobacterium
ASAGHIYAVIGLKDTTTGDTLC

SEQ ID NO: 1259615 - protein, 20 aa, Mycobacterium
ASAGRPMFAVQVTIRDDRDN

SEQ ID NO: 1259616 - protein, 24 aa, Mycobacterium
ASAKFADASGWLFTDDALQQATAA

SEQ ID NO: 1259617 - protein, 20 aa, Mycobacterium
ASAKFSRKIVELNLLGALSV

SEQ ID NO: 1259618 - protein, 19 aa, Mycobacterium
ASALDRAALPYVVGTIAGD

SEQ ID NO: 1259619 - protein, 17 aa, Mycobacterium
ASALDRAALPYVVGTVA

SEQ ID NO: 1259620 - protein, 21 aa, Mycobacterium
ASALIDRRWLGPVSYDELRLD

SEQ ID NO: 1259621 - protein, 21 aa, Mycobacterium
ASALRPEDFRTVADTLLGFID

SEQ ID NO: 1259622 - protein, 23 aa, Mycobacterium
ASAMPDDRWRGTAADAYTLANEQ

SEQ ID NO: 1259623 - protein, 25 aa, Mycobacterium
ASAPTYRYEFGWRSTGVGGELGAAH

SEQ ID NO: 1259624 - protein, 24 aa, Mycobacterium
ASAQRGLSEAVVRDISAKKSEPEW

SEQ ID NO: 1259625 - protein, 17 aa, Mycobacterium
ASARFSAKIVALNLLGA

SEQ ID NO: 1259626 - protein, 17 aa, Mycobacterium
ASARIGWEHTIAPLAQR

SEQ ID NO: 1259627 - protein, 19 aa, Mycobacterium
ASARSGSVLIKRFVSEKHH

SEQ ID NO: 1259628 - protein, 17 aa, Mycobacterium
ASASLFALAAMAEQGRT

SEQ ID NO: 1259629 - protein, 27 aa, Mycobacterium
ASAVGMGRFALGRAVDYVKTRQVWKTP

SEQ ID NO: 1259630 - protein, 21 aa, Mycobacterium
ASAVGMVWRAAAAIELGICDV

SEQ ID NO: 1259631 - protein, 19 aa, Mycobacterium
ASAYPFVWNVLLAARNEGF

SEQ ID NO: 1259632 - protein, 17 aa, Mycobacterium
ASCAGVDRFTRVRDVVV

SEQ ID NO: 1259633 - protein, 23 aa, Mycobacterium
ASDAAGFKWLAPYTGSAIGQHWM

SEQ ID NO: 1259634 - protein, 18 aa, Mycobacterium
ASDALRHGAMYGANPAGG

SEQ ID NO: 1259635 - protein, 17 aa, Mycobacterium
ASDEARYITGLPVTVDA

SEQ ID NO: 1259636 - protein, 18 aa, Mycobacterium
ASDITLKAVEMAGTTGYS

SEQ ID NO: 1259637 - protein, 20 aa, Mycobacterium
ASDLDWFAFLVRLRQTGMPI

SEQ ID NO: 1259638 - protein, 24 aa, Mycobacterium
ASDRAGIPAMKWTTQLTYAADGLT

SEQ ID NO: 1259639 - protein, 24 aa, Mycobacterium
ASDRYKLALFILRVLTPGPHASQT

SEQ ID NO: 1259640 - protein, 24 aa, Mycobacterium
ASEALRLGLDIMLIGVWNAFQVAI

SEQ ID NO: 1259641 - protein, 26 aa, Mycobacterium
ASEKLGIPVIDHWWQTETGWAIAANP

SEQ ID NO: 1259642 - protein, 23 aa, Mycobacterium
ASELARLRRSVVAATGRDHDRLG

SEQ ID NO: 1259643 - protein, 18 aa, Mycobacterium
ASELNWQQAALLAGMVQS

SEQ ID NO: 1259644 - protein, 25 aa, Mycobacterium
ASETARFCTQFIKLGLGGCDIGVSY

SEQ ID NO: 1259645 - protein, 19 aa, Mycobacterium
ASEVPRTANFISKVIEDHG

SEQ ID NO: 1259646 - protein, 20 aa, Mycobacterium
ASEVWAEIWDDIGPRIERVL

SEQ ID NO: 1259647 - protein, 28 aa, Mycobacterium
ASEVWAEIWPDIGPRIESVLSNGRATWD

SEQ ID NO: 1259648 - protein, 25 aa, Mycobacterium
ASEYIYRFAPLVGIYGGTLEVFRNM

SEQ ID NO: 1259649 - protein, 23 aa, Mycobacterium
ASFAESFVQIGLVPGDGGTWFLQ

SEQ ID NO: 1259650 - protein, 19 aa, Mycobacterium
ASFARDVGLYLGHGYAVEE

SEQ ID NO: 1259651 - protein, 26 aa, Mycobacterium
ASFGLPEVKRGLMAGAGGVFRIVEQL

SEQ ID NO: 1259652 - protein, 18 aa, Mycobacterium
ASFMPKPFAEHPGSAMHT

SEQ ID NO: 1259653 - protein, 23 aa, Mycobacterium
ASGCGKSTLLRLLAGFEEPSQGS

SEQ ID NO: 1259654 - protein, 24 aa, Mycobacterium
ASGCGKTTLLRLVAGFENPDGGTI

SEQ ID NO: 1259655 - protein, 17 aa, Mycobacterium
ASGEAIGCFGLTEPDFG

SEQ ID NO: 1259656 - protein, 25 aa, Mycobacterium
ASGERRPGWVGLPLQGVTTRLVADD

SEQ ID NO: 1259657 - protein, 18 aa, Mycobacterium
ASGHADLATAYLTMPMVE

SEQ ID NO: 1259658 - protein, 23 aa, Mycobacterium
ASGHWPLLRFDPVMRAAGKNPFL

SEQ ID NO: 1259659 - protein, 20 aa, Mycobacterium
ASGIPGDWALFDVDGQNGEH

SEQ ID NO: 1259660 - protein, 25 aa, Mycobacterium
ASGIYRLHFDTGAYFAARHVASFYP

SEQ ID NO: 1259661 - protein, 27 aa, Mycobacterium
ASGKSPAQVVLRWHVQRGDIIFPKSVT

SEQ ID NO: 1259662 - protein, 17 aa, Mycobacterium
ASGLPMGGDLEFADELT

SEQ ID NO: 1259663 - protein, 22 aa, Mycobacterium
ASGLPPERLAALIVETVQAAVR

SEQ ID NO: 1259664 - protein, 23 aa, Mycobacterium
ASGMRKSELIAAIRERRGEANGK

SEQ ID NO: 1259665 - protein, 26 aa, Mycobacterium
ASGPGWKLTGQKVWTSAAQKAHWGVC

SEQ ID NO: 1259666 - protein, 18 aa, Mycobacterium
ASGPWCVALSGGADSLAL

SEQ ID NO: 1259667 - protein, 19 aa, Mycobacterium
ASGRLRRRLVLPAVLPPLR

SEQ ID NO: 1259668 - protein, 17 aa, Mycobacterium
ASGRPVIATAFPHAVEL

SEQ ID NO: 1259669 - protein, 19 aa, Mycobacterium
ASGRWAAPPLKAWSGRDEV

SEQ ID NO: 1259670 - protein, 25 aa, Mycobacterium
ASGSGEMLCRWARDYLVTGTGVDIS

SEQ ID NO: 1259671 - protein, 19 aa, Mycobacterium
ASGVIRWCVHAVTEHLRTR

SEQ ID NO: 1259672 - protein, 18 aa, Mycobacterium
ASGVRMLLDAARQVSDTA

SEQ ID NO: 1259673 - protein, 19 aa, Mycobacterium
ASGYAGFRMDAVATRAGVG

SEQ ID NO: 1259674 - protein, 25 aa, Mycobacterium
ASHFRCPYHGWSYRNDGRIVGLPFH

SEQ ID NO: 1259675 - protein, 24 aa, Mycobacterium
ASHGEFYFAVGAGIEIYTSKIFNG

SEQ ID NO: 1259676 - protein, 25 aa, Mycobacterium
ASHHLRWLASANCLLELDEDTAEVA

SEQ ID NO: 1259677 - protein, 17 aa, Mycobacterium
ASHLKRLEAELDRTRAA

SEQ ID NO: 1259678 - protein, 18 aa, Mycobacterium
ASHNGMWDLSILGIVPGM

SEQ ID NO: 1259679 - protein, 17 aa, Mycobacterium
ASIADWIRGVRRAARAG

SEQ ID NO: 1259680 - protein, 19 aa, Mycobacterium
ASIDLAVATGAKWVREIFT

SEQ ID NO: 1259681 - protein, 24 aa, Mycobacterium
ASIEIAELYAPFSHQQLILKEAIG

SEQ ID NO: 1259682 - protein, 28 aa, Mycobacterium
ASILLSSRFPMWMAWGPELTFFCNDAYR

SEQ ID NO: 1259683 - protein, 23 aa, Mycobacterium
ASIRDGDVFARWGGEEFIVALPD

SEQ ID NO: 1259684 - protein, 26 aa, Mycobacterium
ASIVTRISEFLTHPAFTRYRTETEMM

SEQ ID NO: 1259685 - protein, 17 aa, Mycobacterium
ASKAAIIHFTKCAAIEL

SEQ ID NO: 1259686 - protein, 19 aa, Mycobacterium
ASKCGLTPQYGALEQLAKD

SEQ ID NO: 1259687 - protein, 23 aa, Mycobacterium
ASKELRYQLEFRGFDHNDGLEGH

SEQ ID NO: 1259688 - protein, 22 aa, Mycobacterium
ASKRIAPIVILTAFSQRELVER

SEQ ID NO: 1259689 - protein, 22 aa, Mycobacterium
ASKRLKAALAATELDDLEDGGT

SEQ ID NO: 1259690 - protein, 19 aa, Mycobacterium
ASKVARTTLYRHFHSSSHL

SEQ ID NO: 1259691 - protein, 19 aa, Mycobacterium
ASLADGPVPGWLVVEETAA

SEQ ID NO: 1259692 - protein, 23 aa, Mycobacterium
ASLARLRPAFVADGTVTAGNAST

SEQ ID NO: 1259693 - protein, 24 aa, Mycobacterium
ASLDVPVPFWFRAPGECPGTYAAE

SEQ ID NO: 1259694 - protein, 17 aa, Mycobacterium
ASLEVPGLILADPGDPM

SEQ ID NO: 1259695 - protein, 19 aa, Mycobacterium
ASLFALAAMAEQGRTGPLV

SEQ ID NO: 1259696 - protein, 18 aa, Mycobacterium
ASLFGDSHAHGMDGVQFF

SEQ ID NO: 1259697 - protein, 18 aa, Mycobacterium
ASLIGDFGAQVIKIEDPG

SEQ ID NO: 1259698 - protein, 23 aa, Mycobacterium
ASLLADDFYQVWWSDSQFADSRD

SEQ ID NO: 1259699 - protein, 18 aa, Mycobacterium
ASLLKRWNAGTHHYRVER

SEQ ID NO: 1259700 - protein, 24 aa, Mycobacterium
ASLMEPWDGPACITFTDGTLVGAV

SEQ ID NO: 1259701 - protein, 17 aa, Mycobacterium
ASLPSKFMPAPGYSAYI

SEQ ID NO: 1259702 - protein, 24 aa, Mycobacterium
ASLRVNFLRPFFAGRESRYVGTAL

SEQ ID NO: 1259703 - protein, 17 aa, Mycobacterium
ASMAAVFDRFGADLPAL

SEQ ID NO: 1259704 - protein, 25 aa, Mycobacterium
ASMIASSPGFLGWLDPSAVGAPAPT

SEQ ID NO: 1259705 - protein, 19 aa, Mycobacterium
ASMPTPFVAVGESYWDFRQ

SEQ ID NO: 1259706 - protein, 17 aa, Mycobacterium
ASMRGEQLPAGGATQAT

SEQ ID NO: 1259707 - protein, 25 aa, Mycobacterium
ASMSGVQWFKPRYVGEVAYREYHAG

SEQ ID NO: 1259708 - protein, 19 aa, Mycobacterium
ASNTLWPRTLVATAAVQNL

SEQ ID NO: 1259709 - protein, 18 aa, Mycobacterium
ASNWPGLISELNRLVPDL

SEQ ID NO: 1259710 - protein, 23 aa, Mycobacterium
ASPAAVCPHVEWALSSTLNARAN

SEQ ID NO: 1259711 - protein, 21 aa, Mycobacterium
ASPDGKWLYAVRNRRVDTTGG

SEQ ID NO: 1259712 - protein, 24 aa, Mycobacterium
ASPELLVARHGRQVICRPFAGSAP

SEQ ID NO: 1259713 - protein, 23 aa, Mycobacterium
ASPFGVGGPPVYTGAIDPYGEPT

SEQ ID NO: 1259714 - protein, 26 aa, Mycobacterium
ASPGYPCYRNILTALGCEVVELPCGP

SEQ ID NO: 1259715 - protein, 25 aa, Mycobacterium
ASPMPLPLLRQALQAWPNTDFMQAY

SEQ ID NO: 1259716 - protein, 34 aa, Mycobacterium
ASPPDMKLPIALALGWPSRVPGAAPACDFTTASR

SEQ ID NO: 1259717 - protein, 30 aa, Mycobacterium
ASPRAGLIGCAWADLAEVMAGVFATRGSSV

SEQ ID NO: 1259718 - protein, 30 aa, Mycobacterium
ASPRATIALCTAARALALLSGRNHVVPGDI

SEQ ID NO: 1259719 - protein, 25 aa, Mycobacterium
ASPSARFCTQFIKLGLGGCDIGVSY

SEQ ID NO: 1259720 - protein, 23 aa, Mycobacterium
ASPSELRAVLGIQSNLLAHHLGV

SEQ ID NO: 1259721 - protein, 17 aa, Mycobacterium
ASQALAAEGAWVRSDGD

SEQ ID NO: 1259722 - protein, 20 aa, Mycobacterium
ASQAPPAMRLCHHLHGGMGM

SEQ ID NO: 1259723 - protein, 23 aa, Mycobacterium
ASQLRAALEAGIRVVDARSVDDF

SEQ ID NO: 1259724 - protein, 25 aa, Mycobacterium
ASQYKDVILGLVFLKYVSDAYDERR

SEQ ID NO: 1259725 - protein, 17 aa, Mycobacterium
ASRCCDGPTSLSAVIRW

SEQ ID NO: 1259726 - protein, 23 aa, Mycobacterium
ASRDIPLRLVHAVTPTDGAHLDA

SEQ ID NO: 1259727 - protein, 17 aa, Mycobacterium
ASRGLKMRVTSGGGAEV

SEQ ID NO: 1259728 - protein, 18 aa, Mycobacterium
ASRLLPWARSGHLTVPRS

SEQ ID NO: 1259729 - protein, 17 aa, Mycobacterium
ASRRYREHFGFGFVMYV

SEQ ID NO: 1259730 - protein, 20 aa, Mycobacterium
ASRTVPLDWLTSIQSAPGLS

SEQ ID NO: 1259731 - protein, 26 aa, Mycobacterium
ASSAWTLGFYALHNWMLALFTEQAQS

SEQ ID NO: 1259732 - protein, 25 aa, Mycobacterium
ASSDQARAWWGNFLVQKANESGVEL

SEQ ID NO: 1259733 - protein, 19 aa, Mycobacterium
ASSEADWDSVIAVHLKGTF

SEQ ID NO: 1259734 - protein, 17 aa, Mycobacterium
ASSFSPAYLSVWHRTPD

SEQ ID NO: 1259735 - protein, 21 aa, Mycobacterium
ASSGRPGPVLVDIPKDILQGE

SEQ ID NO: 1259736 - protein, 27 aa, Mycobacterium
ASSLPTPARFMLKSAWEECHRIRIQGS

SEQ ID NO: 1259737 - protein, 23 aa, Mycobacterium
ASSPSGLDGPGWESITTPHDLAV

SEQ ID NO: 1259738 - protein, 18 aa, Mycobacterium
ASSRAVLAFAARRLKGAV

SEQ ID NO: 1259739 - protein, 27 aa, Mycobacterium
ASTDHRPEILLSFGFVPKVENRVGLIN

SEQ ID NO: 1259740 - protein, 20 aa, Mycobacterium
ASTDPVGWLGQMGNTLPGEL

SEQ ID NO: 1259741 - protein, 24 aa, Mycobacterium
ASTSLPAFPAFEHSSGDVVDLVTT

SEQ ID NO: 1259742 - protein, 18 aa, Mycobacterium
ASTVELFDGFRFEIAGSV

SEQ ID NO: 1259743 - protein, 18 aa, Mycobacterium
ASVARAKMELGLAAAGRA

SEQ ID NO: 1259744 - protein, 27 aa, Mycobacterium
ASVDARVRLRLRAEQDAVTVFAKNLKD

SEQ ID NO: 1259745 - protein, 25 aa, Mycobacterium
ASVDKFDSGSGWPSFTRPIDAVNIK

SEQ ID NO: 1259746 - protein, 25 aa, Mycobacterium
ASVDKFESGSGWPSFTRPIDAGNIK

SEQ ID NO: 1259747 - protein, 29 aa, Mycobacterium
ASVKDRWLLRHRPHLVLDGLRLAARIIGA

SEQ ID NO: 1259748 - protein, 18 aa, Mycobacterium
ASVKGTGVGGRIRKQDVL

SEQ ID NO: 1259749 - protein, 22 aa, Mycobacterium
ASVLDCTKPVIAAVHGAATGLG

SEQ ID NO: 1259750 - protein, 18 aa, Mycobacterium
ASVPPSLIRRAADYFDKA

SEQ ID NO: 1259751 - protein, 19 aa, Mycobacterium
ASVQRARVDGRTVAQSIVD

SEQ ID NO: 1259752 - protein, 17 aa, Mycobacterium
ASVRLRALKSLLADTVG

SEQ ID NO: 1259753 - protein, 20 aa, Mycobacterium
ASVSAIAARIAPLLREAANA

SEQ ID NO: 1259754 - protein, 18 aa, Mycobacterium
ASVSRLWRRDIKTGDLSP

SEQ ID NO: 1259755 - protein, 19 aa, Mycobacterium
ASVSWAAVPPGVFDAAENT

SEQ ID NO: 1259756 - protein, 18 aa, Mycobacterium
ASVTLRELVEAALLQGVP

SEQ ID NO: 1259757 - protein, 21 aa, Mycobacterium
ASYHLPRLIGIAKTKQLMLTN

SEQ ID NO: 1259758 - protein, 18 aa, Mycobacterium
ATAALLCEFTFDDLTTRR

SEQ ID NO: 1259759 - protein, 26 aa, Mycobacterium
ATACALMGLECVIYMGAVDTARQALN

SEQ ID NO: 1259760 - protein, 20 aa, Mycobacterium
ATADAARLIAAFLHILDDIK

SEQ ID NO: 1259761 - protein, 24 aa, Mycobacterium
ATAEALLRRGARVVIGDRDVALQE

SEQ ID NO: 1259762 - protein, 22 aa, Mycobacterium
ATAEAVIDCRVLPGRLADFERE

SEQ ID NO: 1259763 - protein, 24 aa, Mycobacterium
ATAEDAWDLWLYWLTPSDLLDAAR

SEQ ID NO: 1259764 - protein, 23 aa, Mycobacterium
ATAEVALRYALAAVESVERPVKI

SEQ ID NO: 1259765 - protein, 17 aa, Mycobacterium
ATAGFGWSRPSRSALAD

SEQ ID NO: 1259766 - protein, 19 aa, Mycobacterium
ATAGLPFLLRPALAAAGDG

SEQ ID NO: 1259767 - protein, 19 aa, Mycobacterium
ATAGRIDPALLYDVAGDAE

SEQ ID NO: 1259768 - protein, 17 aa, Mycobacterium
ATAHACLQHLSQFDTAG

SEQ ID NO: 1259769 - protein, 25 aa, Mycobacterium
ATAHTEFDTGLSLSAVCDLEPYWEA

SEQ ID NO: 1259770 - protein, 25 aa, Mycobacterium
ATALFDRPAFRTCVSHGIVLGNDGQ

SEQ ID NO: 1259771 - protein, 25 aa, Mycobacterium
ATALLYHAAFAPRLAEVLADLPNLK

SEQ ID NO: 1259772 - protein, 26 aa, Mycobacterium
ATALLYHACFAPRVAEVLPDLPRLRT

SEQ ID NO: 1259773 - protein, 27 aa, Mycobacterium
ATALTEIGRRGTISPALATVGLGLVPL

SEQ ID NO: 1259774 - protein, 21 aa, Mycobacterium
ATAMAPEIERFAGSDAADGYL

SEQ ID NO: 1259775 - protein, 17 aa, Mycobacterium
ATAPQMWNWAASHSTGE

SEQ ID NO: 1259776 - protein, 18 aa, Mycobacterium
ATAPRPDQMFDLTGRTAL

SEQ ID NO: 1259777 - protein, 19 aa, Mycobacterium
ATAQLARYTHTCFLATPYE

SEQ ID NO: 1259778 - protein, 17 aa, Mycobacterium
ATAQSLTLTDLVKTYAS

SEQ ID NO: 1259779 - protein, 25 aa, Mycobacterium
ATARLCREEIFGPVAVVAPFDTEAD

SEQ ID NO: 1259780 - protein, 17 aa, Mycobacterium
ATARPPTFVLFTTGFLE

SEQ ID NO: 1259781 - protein, 25 aa, Mycobacterium
ATARRPELVSVPGAEVIRLDITDQS

SEQ ID NO: 1259782 - protein, 25 aa, Mycobacterium
ATASRPARFNCFGMHEWAMVYRAPT

SEQ ID NO: 1259783 - protein, 19 aa, Mycobacterium
ATASWPNRTEPGGTRGLDD

SEQ ID NO: 1259784 - protein, 24 aa, Mycobacterium
ATATVPSIRWAACTESSKVIPLGA

SEQ ID NO: 1259785 - protein, 19 aa, Mycobacterium
ATCEVWFQRHGRPLGTGRS

SEQ ID NO: 1259786 - protein, 18 aa, Mycobacterium
ATDALTLSEVVRFKSPAE

SEQ ID NO: 1259787 - protein, 23 aa, Mycobacterium
ATDDLRKVTGFGRLLLFGGTRDK

SEQ ID NO: 1259788 - protein, 24 aa, Mycobacterium
ATDFSRPLARVVLDGAPAEVLDVP

SEQ ID NO: 1259789 - protein, 23 aa, Mycobacterium
ATDFSRPLARVVLDNAAVVTLDV

SEQ ID NO: 1259790 - protein, 19 aa, Mycobacterium
ATDMAVYFCDPASPWQRGS

SEQ ID NO: 1259791 - protein, 19 aa, Mycobacterium
ATDMSRWRQFAFGVLGFAE

SEQ ID NO: 1259792 - protein, 24 aa, Mycobacterium
ATDPRQRPVLTFVLDSGMAGLTQG

SEQ ID NO: 1259793 - protein, 19 aa, Mycobacterium
ATEALNLVSYVLGDDRSGF

SEQ ID NO: 1259794 - protein, 18 aa, Mycobacterium
ATEEFLRFFTPAPGDGRT

SEQ ID NO: 1259795 - protein, 21 aa, Mycobacterium
ATELRANPFLQRVTTDLTRLP

SEQ ID NO: 1259796 - protein, 17 aa, Mycobacterium
ATELSRSMATLMRTGLA

SEQ ID NO: 1259797 - protein, 25 aa, Mycobacterium
ATERLRSVGFPFPGARVRILGDDGR

SEQ ID NO: 1259798 - protein, 17 aa, Mycobacterium
ATFDGEWTEPTVLPAQW

SEQ ID NO: 1259799 - protein, 23 aa, Mycobacterium
ATFGCGFAPSGWETLTKHLQRKG

SEQ ID NO: 1259800 - protein, 24 aa, Mycobacterium
ATFGRERYSALGIEREDWEARQRA

SEQ ID NO: 1259801 - protein, 19 aa, Mycobacterium
ATFPDRVISVDTWRAEVAK

SEQ ID NO: 1259802 - protein, 25 aa, Mycobacterium
ATGAGKGSVLWSLIAGIAPAVKTGL

SEQ ID NO: 1259803 - protein, 19 aa, Mycobacterium
ATGAICRPGSGPMSLTGQP

SEQ ID NO: 1259804 - protein, 18 aa, Mycobacterium
ATGDPRWRQATLTHTALW

SEQ ID NO: 1259805 - protein, 36 aa, Mycobacterium
ATGFLGRYLALEWLERMALVGGKLICLVRAKDDAAA

SEQ ID NO: 1259806 - protein, 18 aa, Mycobacterium
ATGHWAGRELHEIRHDSQ

SEQ ID NO: 1259807 - protein, 24 aa, Mycobacterium
ATGLCLVPVMFDRIVDLPEDVLSR

SEQ ID NO: 1259808 - protein, 17 aa, Mycobacterium
ATGLCVVPVMFDRIMDL

SEQ ID NO: 1259809 - protein, 25 aa, Mycobacterium
ATGLLKPSRLHILPTRDFHDQALEP

SEQ ID NO: 1259810 - protein, 18 aa, Mycobacterium
ATGLPLELLVELQAKARE

SEQ ID NO: 1259811 - protein, 23 aa, Mycobacterium
ATGPQQIWSWDITDLHSPWRGVS

SEQ ID NO: 1259812 - protein, 18 aa, Mycobacterium
ATGQVLMVAWMDDDALAR

SEQ ID NO: 1259813 - protein, 19 aa, Mycobacterium
ATGRLLSFVESPRRDEVLD

SEQ ID NO: 1259814 - protein, 24 aa, Mycobacterium
ATGRRFEALSALAAGVKEVRAVID

SEQ ID NO: 1259815 - protein, 21 aa, Mycobacterium
ATGVIWLQHGFLGNKASLSKL

SEQ ID NO: 1259816 - protein, 19 aa, Mycobacterium
ATGVSFVLVSNAMRPNGGI

SEQ ID NO: 1259817 - protein, 25 aa, Mycobacterium
ATHARLGGPGRWLLALPAHHIAGLQ

SEQ ID NO: 1259818 - protein, 26 aa, Mycobacterium
ATHARLGGPGRWLLALPAHHIAGLQV

SEQ ID NO: 1259819 - protein, 32 aa, Mycobacterium
ATHARLGGPGRWLLALPAYHVAGFQVLVRSVI

SEQ ID NO: 1259820 - protein, 18 aa, Mycobacterium
ATHHWPLLLDKIQQRYLE

SEQ ID NO: 1259821 - protein, 26 aa, Mycobacterium
ATHLSRLVPQHMMRRLFFTAATVTAD

SEQ ID NO: 1259822 - protein, 24 aa, Mycobacterium
ATHPEFPTPVTFCEIFPPDDFPLY

SEQ ID NO: 1259823 - protein, 22 aa, Mycobacterium
ATIAMRVCIVIKVGGDGLINRI

SEQ ID NO: 1259824 - protein, 23 aa, Mycobacterium
ATIEIPRTGSLHGDVREMLRRTL

SEQ ID NO: 1259825 - protein, 17 aa, Mycobacterium
ATILAGLIPAGATIATD

SEQ ID NO: 1259826 - protein, 25 aa, Mycobacterium
ATILKPAEKVFWGGYSGYFADPDGH

SEQ ID NO: 1259827 - protein, 27 aa, Mycobacterium
ATIQEVRNSLGLRCRWYVSAMETAGQI

SEQ ID NO: 1259828 - protein, 17 aa, Mycobacterium
ATIRRFNQRFAQFNMPD

SEQ ID NO: 1259829 - protein, 18 aa, Mycobacterium
ATIVRAGKRMIVTAVDVT

SEQ ID NO: 1259830 - protein, 17 aa, Mycobacterium
ATIYRYAGGKAQIRDAV

SEQ ID NO: 1259831 - protein, 21 aa, Mycobacterium
ATKATEILAFINGMEIQWLLD

SEQ ID NO: 1259832 - protein, 21 aa, Mycobacterium
ATKRLSLTVTLAERERQLSIA

SEQ ID NO: 1259833 - protein, 18 aa, Mycobacterium
ATLAFPRYHRSVTADLAA

SEQ ID NO: 1259834 - protein, 17 aa, Mycobacterium
ATLDRYATRDSLEQALG

SEQ ID NO: 1259835 - protein, 17 aa, Mycobacterium
ATLDVATARRWFDEFEG

SEQ ID NO: 1259836 - protein, 23 aa, Mycobacterium
ATLEEMRHSSGLMSVLEDLSRGL

SEQ ID NO: 1259837 - protein, 18 aa, Mycobacterium
ATLFGSGVSPGFAELLAI

SEQ ID NO: 1259838 - protein, 19 aa, Mycobacterium
ATLHPRWRAELADISTGPA

SEQ ID NO: 1259839 - protein, 27 aa, Mycobacterium
ATLLAGLPVRRLWGIGPVAEDRLHRLG

SEQ ID NO: 1259840 - protein, 36 aa, Mycobacterium
ATLLIDRSASWMFDYYPLRVVRELADGACEAAMTYA

SEQ ID NO: 1259841 - protein, 19 aa, Mycobacterium
ATLLQDWTQFAAPAVFGAA

SEQ ID NO: 1259842 - protein, 31 aa, Mycobacterium
ATLNAFKVRGPESFSAPVLPAAPSPVPASDE

SEQ ID NO: 1259843 - protein, 22 aa, Mycobacterium
ATLRRVRLRSAGPLAAEVCATY

SEQ ID NO: 1259844 - protein, 31 aa, Mycobacterium
ATLSRFGVQPRRGWPALNLFYNTAFDAQHQL

SEQ ID NO: 1259845 - protein, 17 aa, Mycobacterium
ATLSWVYWHNTARLHGY

SEQ ID NO: 1259846 - protein, 17 aa, Mycobacterium
ATLTGLRSGKGRFYPEF

SEQ ID NO: 1259847 - protein, 17 aa, Mycobacterium
ATLVDHLIPPMARAETY

SEQ ID NO: 1259848 - protein, 19 aa, Mycobacterium
ATLVIKPGWGFSFDYEPGQ

SEQ ID NO: 1259849 - protein, 17 aa, Mycobacterium
ATLVIKPGWGFTFDYQP

SEQ ID NO: 1259850 - protein, 25 aa, Mycobacterium
ATLVKRAKPGLLMLSVCNSTQDPEE

SEQ ID NO: 1259851 - protein, 17 aa, Mycobacterium
ATLVPGVRICFTGTAQD

SEQ ID NO: 1259852 - protein, 25 aa, Mycobacterium
ATLVRTVCAGRRLIELDGPEVGSLR

SEQ ID NO: 1259853 - protein, 20 aa, Mycobacterium
ATMAQWCFLLARTSRVGEGA

SEQ ID NO: 1259854 - protein, 18 aa, Mycobacterium
ATMHPSRYLTLIEGVSQV

SEQ ID NO: 1259855 - protein, 19 aa, Mycobacterium
ATMPDPIITLARTFMTQPT

SEQ ID NO: 1259856 - protein, 25 aa, Mycobacterium
ATNKRLPAKVAYVLNRWKSILQQSV

SEQ ID NO: 1259857 - protein, 25 aa, Mycobacterium
ATNRFSERMLKLLGKTVFRQGDCSR

SEQ ID NO: 1259858 - protein, 23 aa, Mycobacterium
ATPADWRPGDAVIVPPAGSCGTA

SEQ ID NO: 1259859 - protein, 25 aa, Mycobacterium
ATPAQRWGVATAHDRILLCGSGSRR

SEQ ID NO: 1259860 - protein, 24 aa, Mycobacterium
ATPDILSPLCWSLWGNGVELASRA

SEQ ID NO: 1259861 - protein, 25 aa, Mycobacterium
ATPFFWRQRYRMVLSADGALHDTAR

SEQ ID NO: 1259862 - protein, 23 aa, Mycobacterium
ATPFPSQVFLTLFGLPMADRDRL

SEQ ID NO: 1259863 - protein, 23 aa, Mycobacterium
ATPIPRTVALTIYGDLETSILRE

SEQ ID NO: 1259864 - protein, 24 aa, Mycobacterium
ATPLDRFIGLVVIDRGHPRVADLA

SEQ ID NO: 1259865 - protein, 23 aa, Mycobacterium
ATPLEFREYWKANYGPTIATYRF

SEQ ID NO: 1259866 - protein, 25 aa, Mycobacterium
ATPLIVDFAHIWRGMPKVVFSRTLE

SEQ ID NO: 1259867 - protein, 21 aa, Mycobacterium
ATPPRGRRIAVLADMLELGPR

SEQ ID NO: 1259868 - protein, 24 aa, Mycobacterium
ATPPSGPDAGLWDTTLPMVPSANV

SEQ ID NO: 1259869 - protein, 25 aa, Mycobacterium
ATPRLRVNRSAAWVELRKRVEAATK

SEQ ID NO: 1259870 - protein, 31 aa, Mycobacterium
ATPRRVSDLIGMVRPRIVDIPLGAHFHNTRG

SEQ ID NO: 1259871 - protein, 24 aa, Mycobacterium
ATPSEVRAPIIAWIGIQIDSMHEV

SEQ ID NO: 1259872 - protein, 30 aa, Mycobacterium; identical to SEQ ID NO: 78315

SEQ ID NO: 1259873 - protein, 19 aa, Mycobacterium
ATPTGRRRPLLIDDADYST

SEQ ID NO: 1259874 - protein, 18 aa, Mycobacterium
ATPTWSPQYQKAEILDRY

SEQ ID NO: 1259875 - protein, 28 aa, Mycobacterium
ATPWPLPAGCRVLLVSLDEYRHWFPTKR

SEQ ID NO: 1259876 - protein, 19 aa, Mycobacterium
ATPYRLIDVWQQHRAPVED

SEQ ID NO: 1259877 - protein, 18 aa, Mycobacterium
ATQLGYGVESVRTWVRQA

SEQ ID NO: 1259878 - protein, 18 aa, Mycobacterium
ATQLLIYHSAFFAPELIP

SEQ ID NO: 1259879 - protein, 27 aa, Mycobacterium
ATQRAKAAWLWSRRHGVVAGQSAAALH

SEQ ID NO: 1259880 - protein, 26 aa, Mycobacterium
ATQRTRLPLPWAQARLLSTIEDQGEA

SEQ ID NO: 1259881 - protein, 28 aa, Mycobacterium
ATQRVKANLFYRGLTFYRYPVIGDSLFT

SEQ ID NO: 1259882 - protein, 19 aa, Mycobacterium
ATQSRFALVQNEFRRFGMD

SEQ ID NO: 1259883 - protein, 17 aa, Mycobacterium
ATQVAVAVVEGYPGGVW

SEQ ID NO: 1259884 - protein, 18 aa, Mycobacterium
ATRAWAVHHPARWALLYG

SEQ ID NO: 1259885 - protein, 26 aa, Mycobacterium
ATREEGVACYRLFIAGLLDITDNVDK

SEQ ID NO: 1259886 - protein, 24 aa, Mycobacterium
ATRFRAEVPGADMIDPSDHSYYYT

SEQ ID NO: 1259887 - protein, 31 aa, Mycobacterium
ATRHKARFGDGVWWCELAALADDAAVGHAVA

SEQ ID NO: 1259888 - protein, 18 aa, Mycobacterium
ATRIRTSGLLMVAPYIAR

SEQ ID NO: 1259889 - protein, 24 aa, Mycobacterium
ATRPEVRGGLGGFAGLFALRGDYR

SEQ ID NO: 1259890 - protein, 25 aa, Mycobacterium
ATRQPDGGWGRFVADLEVVPIGGEH

SEQ ID NO: 1259891 - protein, 17 aa, Mycobacterium
ATRRIVFRFRTSPIEIK

SEQ ID NO: 1259892 - protein, 18 aa, Mycobacterium
ATRRLALTGTPFRSDDSP

SEQ ID NO: 1259893 - protein, 17 aa, Mycobacterium
ATRRPARDLKFYAFYGE

SEQ ID NO: 1259894 - protein, 19 aa, Mycobacterium
ATRRPGGRPDRRGRPGDRR

SEQ ID NO: 1259895 - protein, 23 aa, Mycobacterium
ATRSYRYVDYWGTAVTAFDLHAP

SEQ ID NO: 1259896 - protein, 20 aa, Mycobacterium
ATRVLGQWLTEVIRLNPDNF

SEQ ID NO: 1259897 - protein, 22 aa, Mycobacterium
ATRYEWPIIDFAILAVGALTVP

SEQ ID NO: 1259898 - protein, 21 aa, Mycobacterium
ATRYEWPILDYAILSVGAVTV

SEQ ID NO: 1259899 - protein, 17 aa, Mycobacterium
ATSCAWETSREAVVVNS

SEQ ID NO: 1259900 - protein, 17 aa, Mycobacterium
ATSRPLKITGIADYVDL

SEQ ID NO: 1259901 - protein, 17 aa, Mycobacterium
ATSRPLKLLGIADIIPL

SEQ ID NO: 1259902 - protein, 17 aa, Mycobacterium
ATSRPLKLVGIADIVAL

SEQ ID NO: 1259903 - protein, 18 aa, Mycobacterium
ATSSFLLTPTWRHRSPAA

SEQ ID NO: 1259904 - protein, 25 aa, Mycobacterium
ATSYVPDWFSRVGPDTLIVVDEAGK

SEQ ID NO: 1259905 - protein, 25 aa, Mycobacterium
ATTGRGLEQWYGWIEFLANPSKNPI

SEQ ID NO: 1259906 - protein, 27 aa, Mycobacterium
ATTHSRLRPPWVTDIDVVFGTALAEII

SEQ ID NO: 1259907 - protein, 24 aa, Mycobacterium
ATTKGEADCARWVADQLAEVGYVT

SEQ ID NO: 1259908 - protein, 18 aa, Mycobacterium
ATTRELDAWLARAKSELA

SEQ ID NO: 1259909 - protein, 22 aa, Mycobacterium
ATTRPPLGPGMIAKYEHELCAF

SEQ ID NO: 1259910 - protein, 17 aa, Mycobacterium
ATTRPVARIVAGEALEL

SEQ ID NO: 1259911 - protein, 23 aa, Mycobacterium
ATTRRPRIAAVRADYDKVVRQRT

SEQ ID NO: 1259912 - protein, 18 aa, Mycobacterium
ATTVFLAPPSWEVLESRL

SEQ ID NO: 1259913 - protein, 18 aa, Mycobacterium
ATVARFVAGGARVVTSGR

SEQ ID NO: 1259914 - protein, 24 aa, Mycobacterium
ATVLTRNTFHWVLAFSPGGLSTAK

SEQ ID NO: 1259915 - protein, 23 aa, Mycobacterium
ATVPKLRGMPGFEYLSENRELGE

SEQ ID NO: 1259916 - protein, 26 aa, Mycobacterium
ATVPVFFEPRLIKVALAQGVTEDDLD

SEQ ID NO: 1259917 - protein, 19 aa, Mycobacterium
ATVSVCYMGVNGRDGSVFD

SEQ ID NO: 1259918 - protein, 26 aa, Mycobacterium
ATVTRWVAVMDCGRVLNPKLATNQVM

SEQ ID NO: 1259919 - protein, 19 aa, Mycobacterium
ATVVRAGRKLSVIAVDVTD

SEQ ID NO: 1259920 - protein, 22 aa, Mycobacterium
ATWPAHSRPPVGWIEQDDGRIA

SEQ ID NO: 1259921 - protein, 26 aa, Mycobacterium
ATYDRLRETPLQWPVPPDDGADRHPI

SEQ ID NO: 1259922 - protein, 18 aa, Mycobacterium
ATYFGPAYMINWLHNDLA

SEQ ID NO: 1259923 - protein, 33 aa, Mycobacterium
ATYPALAAWVCRRLAGISYSFTVHAHDLYVDMS

SEQ ID NO: 1259924 - protein, 24 aa, Mycobacterium
ATYPKIVAIAPVFAEYQAKTDRAI

SEQ ID NO: 1259925 - protein, 19 aa, Mycobacterium
ATYRSEFRPSDVAAEPVTF

SEQ ID NO: 1259926 - protein, 23 aa, Mycobacterium
AVAAARLGHRSALISGVGDDPFG

SEQ ID NO: 1259927 - protein, 27 aa, Mycobacterium
AVAAARPRVLAGWERLDAPIRWVHTSE

SEQ ID NO: 1259928 - protein, 19 aa, Mycobacterium
AVAACAPHGVPVIADGGLQ

SEQ ID NO: 1259929 - protein, 18 aa, Mycobacterium
AVAACRDAIEDAGLSTAD

SEQ ID NO: 1259930 - protein, 17 aa, Mycobacterium
AVAADFRSAQQVSGPAD

SEQ ID NO: 1259931 - protein, 24 aa, Mycobacterium
AVAAELPPLAGIVHAAGEIGTTPL

SEQ ID NO: 1259932 - protein, 23 aa, Mycobacterium
AVAAEVAAGWGLHPTVIPNGVRA

SEQ ID NO: 1259933 - protein, 20 aa, Mycobacterium
AVAAGIPWDVPALTINKMCL

SEQ ID NO: 1259934 - protein, 31 aa, Mycobacterium
AVAAHAWQPRWLKWSLTLIRKGGLDRTGIPT

SEQ ID NO: 1259935 - protein, 19 aa, Mycobacterium
AVAALLAAKGRGRNMPVPV

SEQ ID NO: 1259936 - protein, 21 aa, Mycobacterium
AVAAPRALGRFGVTNEAAALY

SEQ ID NO: 1259937 - protein, 24 aa, Mycobacterium
AVAARMAVLLARSVEDGRHAVLSG

SEQ ID NO: 1259938 - protein, 23 aa, Mycobacterium
AVACPPGHPMLRVDRLYADDEGH

SEQ ID NO: 1259939 - protein, 26 aa, Mycobacterium
AVADIRLRWAESMADAAREIRSGRPD

SEQ ID NO: 1259940 - protein, 18 aa, Mycobacterium
AVADLLGALFWGLVFHAG

SEQ ID NO: 1259941 - protein, 19 aa, Mycobacterium
AVADTRAAAELDRAAATIE

SEQ ID NO: 1259942 - protein, 17 aa, Mycobacterium
AVAERAPVCVAMTSGTA

SEQ ID NO: 1259943 - protein, 25 aa, Mycobacterium
AVAERGAAAALEYGAAFDGIRPDQV

SEQ ID NO: 1259944 - protein, 25 aa, Mycobacterium
AVAERLLARNGWRSTSLAQIAREAG

SEQ ID NO: 1259945 - protein, 18 aa, Mycobacterium
AVAESGLPQARITGELGR

SEQ ID NO: 1259946 - protein, 27 aa, Mycobacterium
AVAGLSLRPGYVLSDGFRVPGLPMPSL

SEQ ID NO: 1259947 - protein, 23 aa, Mycobacterium
AVAGSLRSQVHWVASTQSSRSIP

SEQ ID NO: 1259948 - protein, 18 aa, Mycobacterium
AVAHPRALLAAFRGYAKI

SEQ ID NO: 1259949 - protein, 27 aa, Mycobacterium
AVAKALAPLFCKNCDLDNLYDNPWLYD

SEQ ID NO: 1259950 - protein, 17 aa, Mycobacterium
AVAKAPFGLREPHPPWL

SEQ ID NO: 1259951 - protein, 19 aa, Mycobacterium
AVALAEARRPEFRAYAQAV

SEQ ID NO: 1259952 - protein, 27 aa, Mycobacterium
AVALGARAVMIGRAYLWGLAAGGQAGV

SEQ ID NO: 1259953 - protein, 32 aa, Mycobacterium
AVALQEARRALKLSWRYVEAFEQEAAALYAAP

SEQ ID NO: 1259954 - protein, 17 aa, Mycobacterium
AVALRPVQTVAAPTEER

SEQ ID NO: 1259955 - protein, 18 aa, Mycobacterium
AVAPELLPRMTQYEPASP

SEQ ID NO: 1259956 - protein, 19 aa, Mycobacterium
AVAPIEFTVGAGITVTVDV

SEQ ID NO: 1259957 - protein, 23 aa, Mycobacterium
AVAPNILRPSFRNWDHPIRRQIF

SEQ ID NO: 1259958 - protein, 26 aa, Mycobacterium
AVAQFKAGDIGAAFTTLASTVITGPI

SEQ ID NO: 1259959 - protein, 20 aa, Mycobacterium
AVAQRLQRRLPRRPDAQALL

SEQ ID NO: 1259960 - protein, 20 aa, Mycobacterium
AVAQSWYKLVGDTGEIISIE

SEQ ID NO: 1259961 - protein, 26 aa, Mycobacterium
AVARFKGVRQFARWMADEGEIDGDPL

SEQ ID NO: 1259962 - protein, 26 aa, Mycobacterium
AVARFKRLDGFDVRFLTGTDVHGLKM

SEQ ID NO: 1259963 - protein, 17 aa, Mycobacterium
AVARLRRAGAVVVGMTT

SEQ ID NO: 1259964 - protein, 18 aa, Mycobacterium
AVARVMIVRCEFAYPIYD

SEQ ID NO: 1259965 - protein, 27 aa, Mycobacterium
AVASSMPICIWHMTQLAGHSARAAETL

SEQ ID NO: 1259966 - protein, 31 aa, Mycobacterium
AVATGMARHVLCFRTLWEATFNQLMKEGRVS

SEQ ID NO: 1259967 - protein, 25 aa, Mycobacterium
AVATGRWPAVRFAVRNTVVQGPNAV

SEQ ID NO: 1259968 - protein, 25 aa, Mycobacterium
AVATRATIRRRWRAESRRRSMSESG

SEQ ID NO: 1259969 - protein, 18 aa, Mycobacterium
AVAVGRAFLANPDLIERL

SEQ ID NO: 1259970 - protein, 17 aa, Mycobacterium
AVAVKWHGLRALEETTR

SEQ ID NO: 1259971 - protein, 24 aa, Mycobacterium
AVCGSAVCGLGVMRTGTSRGSTTR

SEQ ID NO: 1259972 - protein, 24 aa, Mycobacterium
AVCPHADDVWLHFAAVANGIPIRQ

SEQ ID NO: 1259973 - protein, 18 aa, Mycobacterium
AVCSAELDDHAAVVLDGI

SEQ ID NO: 1259974 - protein, 17 aa, Mycobacterium
AVCTAMLDLYQNEGIIA

SEQ ID NO: 1259975 - protein, 19 aa, Mycobacterium
AVCVGIAPDLFDLDDDDYA

SEQ ID NO: 1259976 - protein, 24 aa, Mycobacterium
AVDALRGSGLLGLVVPEEAGGLGA

SEQ ID NO: 1259977 - protein, 18 aa, Mycobacterium
AVDAPAPVAGRCGRCGED

SEQ ID NO: 1259978 - protein, 17 aa, Mycobacterium
AVDAVAISLVFDGANAG

SEQ ID NO: 1259979 - protein, 19 aa, Mycobacterium
AVDAVCPHRGGPLADGLAD

SEQ ID NO: 1259980 - protein, 24 aa, Mycobacterium
AVDEARALALWDLSERLCTRSSPS

SEQ ID NO: 1259981 - protein, 25 aa, Mycobacterium
AVDEFLRLTSPVQMLGRTVTHDVTI

SEQ ID NO: 1259982 - protein, 26 aa, Mycobacterium
AVDGGYRLTGSWSFGSGTGHAEYVAA

SEQ ID NO: 1259983 - protein, 25 aa, Mycobacterium
AVDGHVRAGGLGLVGACDIAVAGDS

SEQ ID NO: 1259984 - protein, 18 aa, Mycobacterium
AVDIRYASSDAKFSVREV

SEQ ID NO: 1259985 - protein, 19 aa, Mycobacterium
AVDKLPAWVDTATREQFEI

SEQ ID NO: 1259986 - protein, 18 aa, Mycobacterium
AVDLPRVRIAEFRPAPQE

SEQ ID NO: 1259987 - protein, 24 aa, Mycobacterium
AVDPGLPALLLVSGGTTGLPKLIA

SEQ ID NO: 1259988 - protein, 19 aa, Mycobacterium
AVDPPRKWWQAGPGEGCIG

SEQ ID NO: 1259989 - protein, 19 aa, Mycobacterium
AVDTGTGWAVVDVETSGFR

SEQ ID NO: 1259990 - protein, 19 aa, Mycobacterium
AVEAGERLGFLPGTLYEKI

SEQ ID NO: 1259991 - protein, 19 aa, Mycobacterium
AVEDVFPLPRELVGEGSLF

SEQ ID NO: 1259992 - protein, 23 aa, Mycobacterium
AVEEFIRWATPLLTFTRTAAVET

SEQ ID NO: 1259993 - protein, 21 aa, Mycobacterium
AVEEIIRWTTPVKEFMRTATA

SEQ ID NO: 1259994 - protein, 20 aa, Mycobacterium
AVEEIVRWASPVAYMRRTAT

SEQ ID NO: 1259995 - protein, 19 aa, Mycobacterium
AVEGIRVARGLGFRVRVAA

SEQ ID NO: 1259996 - protein, 26 aa, Mycobacterium
AVEHGVWLRPFRNLVYVMPPYICTAA

SEQ ID NO: 1259997 - protein, 19 aa, Mycobacterium
AVEIECWHDGTVHELLVPV

SEQ ID NO: 1259998 - protein, 20 aa, Mycobacterium
AVELRPGMYADEETLRQHCR

SEQ ID NO: 1259999 - protein, 30 aa, Mycobacterium
AVELRVYRAAGVLHLDWWYDNRRLGPTDVE

SEQ ID NO: 1260000 - protein, 24 aa, Mycobacterium
AVENALKVAFDWKSRLNEARGLDP

SEQ ID NO: 1260001 - protein, 24 aa, Mycobacterium
AVEPDLSNAVPFLAAAVISGGTVR

SEQ ID NO: 1260002 - protein, 19 aa, Mycobacterium
AVEPLPGGWLVRPAKGDDA

SEQ ID NO: 1260003 - protein, 17 aa, Mycobacterium
AVERARPVLAAYGDPIL

SEQ ID NO: 1260004 - protein, 17 aa, Mycobacterium
AVERLYLGLAADLKPDN

SEQ ID NO: 1260005 - protein, 25 aa, Mycobacterium
AVESGIKVARKWGVDVKGVKTPNIV

SEQ ID NO: 1260006 - protein, 23 aa, Mycobacterium
AVESHAWQLTGFLLTEVVPSVLR

SEQ ID NO: 1260007 - protein, 21 aa, Mycobacterium
AVESILTLLALRDGVIPATRN

SEQ ID NO: 1260008 - protein, 19 aa, Mycobacterium
AVEYDRLLIATGVRARQWP

SEQ ID NO: 1260009 - protein, 19 aa, Mycobacterium
AVFAEHFVEFLGARPQDGA

SEQ ID NO: 1260010 - protein, 17 aa, Mycobacterium
AVFGPALEKAHLYARIL

SEQ ID NO: 1260011 - protein, 19 aa, Mycobacterium
AVFIRAPWVERIGDGVEVL

SEQ ID NO: 1260012 - protein, 22 aa, Mycobacterium
AVFSSMPLRLLVDALEPAPPKH

SEQ ID NO: 1260013 - protein, 20 aa, Mycobacterium
AVGALLCVLAKLTGARAVVE

SEQ ID NO: 1260014 - protein, 32 aa, Mycobacterium
AVGARRPRFGVPMAVVYGFAWLADAVGSILPV

SEQ ID NO: 1260015 - protein, 24 aa, Mycobacterium
AVGATLLAGHGFRTDRRAHDEVAA

SEQ ID NO: 1260016 - protein, 18 aa, Mycobacterium
AVGCMRKVLADTVEYCKQ

SEQ ID NO: 1260017 - protein, 18 aa, Mycobacterium
AVGDGWRVAMTTLMNERS

SEQ ID NO: 1260018 - protein, 19 aa, Mycobacterium
AVGDPDWRLVASHYENAGR

SEQ ID NO: 1260019 - protein, 24 aa, Mycobacterium
AVGDRVGIAWLRHTCGTCRYCLRG

SEQ ID NO: 1260020 - protein, 23 aa, Mycobacterium
AVGHPPVGKGLLGFLRQGTDPVR

SEQ ID NO: 1260021 - protein, 17 aa, Mycobacterium
AVGIDRLTTSIGMSKRT

SEQ ID NO: 1260022 - protein, 18 aa, Mycobacterium
AVGLADHRSEFGANLSGG

SEQ ID NO: 1260023 - protein, 20 aa, Mycobacterium
AVGLARLGRDVDFLTHIGTD

SEQ ID NO: 1260024 - protein, 19 aa, Mycobacterium
AVGLPAVYVPLPIGNGEQR

SEQ ID NO: 1260025 - protein, 23 aa, Mycobacterium
AVGLSRLGRRVDFLTHIADDARG

SEQ ID NO: 1260026 - protein, 20 aa, Mycobacterium
AVGLWDVYHRHPWILHATVI

SEQ ID NO: 1260027 - protein, 20 aa, Mycobacterium
AVGMAIRGLVPVPEIQFDGF

SEQ ID NO: 1260028 - protein, 17 aa, Mycobacterium
AVGPSRHLVKFVDCDGA

SEQ ID NO: 1260029 - protein, 24 aa, Mycobacterium
AVGTRVSAIFVRLGKPEASMVDRL

SEQ ID NO: 1260030 - protein, 27 aa, Mycobacterium
AVGTSAAMGWRLRPRRDVRAAVDRAHD

SEQ ID NO: 1260031 - protein, 25 aa, Mycobacterium
AVGVARAAYEYALDYACEREQFGRK

SEQ ID NO: 1260032 - protein, 24 aa, Mycobacterium
AVHANKAAFQWGRVAVAVPEVFRT

SEQ ID NO: 1260033 - protein, 22 aa, Mycobacterium
AVHCSRATIYRHVGGKAQIREA

SEQ ID NO: 1260034 - protein, 25 aa, Mycobacterium
AVHHPARWALLYGSPVPGYHAPREQ

SEQ ID NO: 1260035 - protein, 17 aa, Mycobacterium
AVHLALAAGGKCFYTTP

SEQ ID NO: 1260036 - protein, 17 aa, Mycobacterium
AVHPAVLGRGALAHVSV

SEQ ID NO: 1260037 - protein, 18 aa, Mycobacterium
AVHVALWQSGELVAGAVA

SEQ ID NO: 1260038 - protein, 23 aa, Mycobacterium
AVIAGIEKLRFFPLEVQSGQGCT

SEQ ID NO: 1260039 - protein, 18 aa, Mycobacterium
AVIDARRGKMFAKLIKNI

SEQ ID NO: 1260040 - protein, 22 aa, Mycobacterium
AVIESLASVSGHVWLSQNGGGT

SEQ ID NO: 1260041 - protein, 20 aa, Mycobacterium
AVIGMAGRFPGAGSVSEFWR

SEQ ID NO: 1260042 - protein, 17 aa, Mycobacterium
AVIGRHRALQCRAFLLS

SEQ ID NO: 1260043 - protein, 17 aa, Mycobacterium
AVIPVPVDPVAVVAKLG

SEQ ID NO: 1260044 - protein, 23 aa, Mycobacterium
AVKEYNVRFTAVVPVPNDGKGAD

SEQ ID NO: 1260045 - protein, 27 aa, Mycobacterium
AVKKHARTPFRQEVWDRLAEGFRFVQG

SEQ ID NO: 1260046 - protein, 23 aa, Mycobacterium
AVKPSDLLVVFFGSRNDINVDPT

SEQ ID NO: 1260047 - protein, 19 aa, Mycobacterium
AVKQCLRSSLRLTTDEERA

SEQ ID NO: 1260048 - protein, 20 aa, Mycobacterium
AVKRAMVRAANYVVVAADSS

SEQ ID NO: 1260049 - protein, 24 aa, Mycobacterium
AVLAADDRAVWTWLTQIRSAVPNV

SEQ ID NO: 1260050 - protein, 25 aa, Mycobacterium
AVLAERIAALLLEINRRFGTPIPPE

SEQ ID NO: 1260051 - protein, 19 aa, Mycobacterium
AVLAGWRMLLDDGRLQDGE

SEQ ID NO: 1260052 - protein, 24 aa, Mycobacterium
AVLARLKRDLGVTVLVVAHDLNPL

SEQ ID NO: 1260053 - protein, 26 aa, Mycobacterium
AVLDEIRRYLSYFPSSAWSYPPSSPA

SEQ ID NO: 1260054 - protein, 17 aa, Mycobacterium
AVLDFASPFGGFKQSGI

SEQ ID NO: 1260055 - protein, 18 aa, Mycobacterium
AVLDLAQRGASLARQHSS

SEQ ID NO: 1260056 - protein, 22 aa, Mycobacterium
AVLDRNGLRPSRIWVTSDGLVV

SEQ ID NO: 1260057 - protein, 19 aa, Mycobacterium
AVLEARLTAWAQELNAAAG

SEQ ID NO: 1260058 - protein, 24 aa, Mycobacterium
AVLGLAGDGGWWVLGVRDAGFAEC

SEQ ID NO: 1260059 - protein, 26 aa, Mycobacterium
AVLGVFCRRWGVPLIDGGTVRLPRLI

SEQ ID NO: 1260060 - protein, 17 aa, Mycobacterium
AVLGVLGGPLGMLGGSV

SEQ ID NO: 1260061 - protein, 17 aa, Mycobacterium
AVLHAGYPVRYWDHDLG

SEQ ID NO: 1260062 - protein, 17 aa, Mycobacterium
AVLHAWRSWSVELPETV

SEQ ID NO: 1260063 - protein, 20 aa, Mycobacterium
AVLLAERGRLFGSLPEGGRM

SEQ ID NO: 1260064 - protein, 21 aa, Mycobacterium
AVLLQLRWLGLEGRSDPVDEL

SEQ ID NO: 1260065 - protein, 21 aa, Mycobacterium
AVLPLQLPATSARLIGTGLSY

SEQ ID NO: 1260066 - protein, 23 aa, Mycobacterium
AVLPSHYEPFGIVALEAAATGTP

SEQ ID NO: 1260067 - protein, 24 aa, Mycobacterium
AVLQDLYRRWPFFATVLSNMAQVL

SEQ ID NO: 1260068 - protein, 33 aa, Mycobacterium
AVLQRVGIDLSLPWRNFTGFKSYWLQNDGYGSY

SEQ ID NO: 1260069 - protein, 17 aa, Mycobacterium
AVLQSGLSVPQLVKTAW

SEQ ID NO: 1260070 - protein, 17 aa, Mycobacterium
AVLRERGSGAVGWYMGN

SEQ ID NO: 1260071 - protein, 22 aa, Mycobacterium
AVLRFQYRLARTPLQLIERRFL

SEQ ID NO: 1260072 - protein, 23 aa, Mycobacterium
AVLRFSAAVSHLMHDGRLTPHPV

SEQ ID NO: 1260073 - protein, 22 aa, Mycobacterium
AVLRLDRELPMPARAHDGDAGV

SEQ ID NO: 1260074 - protein, 18 aa, Mycobacterium
AVLRQARRLQSLMDEQLD

SEQ ID NO: 1260075 - protein, 30 aa, Mycobacterium
AVLRRAARFGDGWAPWLTKPEELPAKLDYL

SEQ ID NO: 1260076 - protein, 22 aa, Mycobacterium
AVLRRLEGHFTLVFAHADDPGT

SEQ ID NO: 1260077 - protein, 18 aa, Mycobacterium
AVLRVCRDAGVNVTVQGG

SEQ ID NO: 1260078 - protein, 25 aa, Mycobacterium
AVLSRAQLLELVWGYDFAADTNVVD

SEQ ID NO: 1260079 - protein, 18 aa, Mycobacterium
AVMEGSWGAEATRVDDAD

SEQ ID NO: 1260080 - protein, 18 aa, Mycobacterium
AVMGDFALNCTWDDHGAD

SEQ ID NO: 1260081 - protein, 33 aa, Mycobacterium
AVMKLAAASSPWPGSGVTSLFDFVENLAASFYD

SEQ ID NO: 1260082 - protein, 17 aa, Mycobacterium
AVMPQTPSLVLITFRPE

SEQ ID NO: 1260083 - protein, 17 aa, Mycobacterium
AVMRRLTKVMIDNGRSV

SEQ ID NO: 1260084 - protein, 19 aa, Mycobacterium
AVMTDGFFSRPSHLSVAAR

SEQ ID NO: 1260085 - protein, 18 aa, Mycobacterium
AVNAIDWVCRAPAGLVAL

SEQ ID NO: 1260086 - protein, 23 aa, Mycobacterium
AVNDLRPGWVTALDLPLIAGAGT

SEQ ID NO: 1260087 - protein, 17 aa, Mycobacterium
AVNGALGTIAFVRGEMA

SEQ ID NO: 1260088 - protein, 25 aa, Mycobacterium
AVNPIAGVIGIFIGNGDEPGENGGL

SEQ ID NO: 1260089 - protein, 17 aa, Mycobacterium
AVNSVQWMGPDAERFKA

SEQ ID NO: 1260090 - protein, 18 aa, Mycobacterium
AVPAAMGAKMGRPEAEVW

SEQ ID NO: 1260091 - protein, 23 aa, Mycobacterium
AVPAHRGVSILLVEKGPGFEVSR

SEQ ID NO: 1260092 - protein, 23 aa, Mycobacterium
AVPALRMPVVFFVGCRDHWVPPA

SEQ ID NO: 1260093 - protein, 26 aa, Mycobacterium
AVPDGKVCWWGGWGGSLVVMDLDRRA

SEQ ID NO: 1260094 - protein, 17 aa, Mycobacterium
AVPDRFSLMHGDYRLDN

SEQ ID NO: 1260095 - protein, 26 aa, Mycobacterium
AVPDRPVVLRAWDYHTVWCNSAALQR

SEQ ID NO: 1260096 - protein, 17 aa, Mycobacterium
AVPDYLKLLAAGINVVS

SEQ ID NO: 1260097 - protein, 23 aa, Mycobacterium
AVPELPEGAKIVYGDFECAAGSG

SEQ ID NO: 1260098 - protein, 24 aa, Mycobacterium
AVPEVPWTYGRPVGTGGLDLVDRF

SEQ ID NO: 1260099 - protein, 22 aa, Mycobacterium
AVPHMYRNEFGRVINISSIHGL

SEQ ID NO: 1260100 - protein, 17 aa, Mycobacterium
AVPIIVGGSMMYVQALL

SEQ ID NO: 1260101 - protein, 25 aa, Mycobacterium
AVPLAKACARIMLGATIAQLREEGV

SEQ ID NO: 1260102 - protein, 18 aa, Mycobacterium
AVPRDAADDLAYWRRVMA

SEQ ID NO: 1260103 - protein, 22 aa, Mycobacterium
AVPTIRELLAILSWAIVGTASC

SEQ ID NO: 1260104 - protein, 25 aa, Mycobacterium
AVPVHRRRVGLMPQEGALFPHLSVG

SEQ ID NO: 1260105 - protein, 20 aa, Mycobacterium
AVPVYRGREVVGVRQDGAGV

SEQ ID NO: 1260106 - protein, 43 aa, Mycobacterium
AVQAALSRIGSPYSWGGSGPNAFDCSGLVMWAFQQEGISLPHS

SEQ ID NO: 1260107 - protein, 18 aa, Mycobacterium
AVQAELNPLLAALDEADS

SEQ ID NO: 1260108 - protein, 33 aa, Mycobacterium; identical to SEQ ID NO: 640323

SEQ ID NO: 1260109 - protein, 17 aa, Mycobacterium
AVQLVRPGGHVANIGVH

SEQ ID NO: 1260110 - protein, 17 aa, Mycobacterium
AVQLVWPDADGVLPWEQ

SEQ ID NO: 1260111 - protein, 34 aa, Mycobacterium
AVQRRIFELEIGRAHTPWFHWGTTSMVARALDQF

SEQ ID NO: 1260112 - protein, 17 aa, Mycobacterium
AVRAELGLPDMPRSRTS

SEQ ID NO: 1260113 - protein, 23 aa, Mycobacterium
AVRASMSIPFLFRPSTLKDAAGQ

SEQ ID NO: 1260114 - protein, 17 aa, Mycobacterium
AVRDMARALGFSQGQQD

SEQ ID NO: 1260115 - protein, 22 aa, Mycobacterium
AVRDWIDMFTMWPQKPTPGMRT

SEQ ID NO: 1260116 - protein, 17 aa, Mycobacterium
AVRELGGTLLFGVPTVW

SEQ ID NO: 1260117 - protein, 20 aa, Mycobacterium
AVRGLAIRAFDAIDCQGLAR

SEQ ID NO: 1260118 - protein, 18 aa, Mycobacterium
AVRIQYEAANGFAPPGAE

SEQ ID NO: 1260119 - protein, 19 aa, Mycobacterium
AVRKLKDGEFVGVYPEATI

SEQ ID NO: 1260120 - protein, 26 aa, Mycobacterium
AVRNALTGLIGWEWMHRDEFVTELKD

SEQ ID NO: 1260121 - protein, 25 aa, Mycobacterium
AVRPEPFGALLYHFGTRKLSFLKNR

SEQ ID NO: 1260122 - protein, 23 aa, Mycobacterium
AVRPEVVVLLGATAAKALLGNDF

SEQ ID NO: 1260123 - protein, 20 aa, Mycobacterium
AVRPRRWLSTYGIGMSALDI

SEQ ID NO: 1260124 - protein, 23 aa, Mycobacterium
AVRPRRWLSTYGIGMSALDIVRH

SEQ ID NO: 1260125 - protein, 25 aa, Mycobacterium
AVRSRGAAAIGAWARMENAAAARRL

SEQ ID NO: 1260126 - protein, 17 aa, Mycobacterium
AVRSRRALDTTIVRPGR

SEQ ID NO: 1260127 - protein, 18 aa, Mycobacterium
AVRTALALSDHVPLITVD

SEQ ID NO: 1260128 - protein, 25 aa, Mycobacterium
AVRTFARRRIDTILSGVEHVDGGEG

SEQ ID NO: 1260129 - protein, 20 aa, Mycobacterium
AVRWRISTSEAHRRLTEAAV

SEQ ID NO: 1260130 - protein, 19 aa, Mycobacterium
AVRYGGNPKRAFAVAERRT

SEQ ID NO: 1260131 - protein, 21 aa, Mycobacterium
AVSAAEWWCRTGTMTRAELVE

SEQ ID NO: 1260132 - protein, 18 aa, Mycobacterium
AVSAGLRYDVPVDVLNVV

SEQ ID NO: 1260133 - protein, 18 aa, Mycobacterium
AVSEAFSAADYCRAVDVL

SEQ ID NO: 1260134 - protein, 20 aa, Mycobacterium
AVSGAVRFATRPLKLVNVVP

SEQ ID NO: 1260135 - protein, 20 aa, Mycobacterium
AVSPAVIVLLNLSRDQLDRV

SEQ ID NO: 1260136 - protein, 19 aa, Mycobacterium
AVSPLARIILPRPGEPLDV

SEQ ID NO: 1260137 - protein, 19 aa, Mycobacterium
AVSPLFCAMADTAEQEVME

SEQ ID NO: 1260138 - protein, 34 aa, Mycobacterium
AVSRIRQRFGAGGWPRGWLSPGMNQTDESLRIMR

SEQ ID NO: 1260139 - protein, 20 aa, Mycobacterium
AVSRRPVIRPIPVDETAFSV

SEQ ID NO: 1260140 - protein, 28 aa, Mycobacterium
AVSVAYRLNEVCCIYPITPSSPMAELAD

SEQ ID NO: 1260141 - protein, 29 aa, Mycobacterium
AVTAGAPAQAWLRRCAEANRHAVDAVRGQ

SEQ ID NO: 1260142 - protein, 18 aa, Mycobacterium
AVTDFALPDPTGDGANTF

SEQ ID NO: 1260143 - protein, 18 aa, Mycobacterium
AVTEWLLDGHRAWVRISA

SEQ ID NO: 1260144 - protein, 20 aa, Mycobacterium
AVTFAGRIDAAIARLAGLDI

SEQ ID NO: 1260145 - protein, 24 aa, Mycobacterium
AVTFSATGGILFVRGISVSVSDDT

SEQ ID NO: 1260146 - protein, 23 aa, Mycobacterium
AVTGMTCSHCIAAVSAELGALTG

SEQ ID NO: 1260147 - protein, 17 aa, Mycobacterium
AVTGVSFQARRGETLAL

SEQ ID NO: 1260148 - protein, 24 aa, Mycobacterium
AVTIGRAGAWSTLTSEALLSTSIT

SEQ ID NO: 1260149 - protein, 24 aa, Mycobacterium
AVTPEKQFTLFFDDVRVPAANLIG

SEQ ID NO: 1260150 - protein, 27 aa, Mycobacterium
AVTPTGLIGRLLVPPVVPAGPPTPTPL

SEQ ID NO: 1260151 - protein, 25 aa, Mycobacterium
AVTPWRSVLLFDLDEGVADVALRVL

SEQ ID NO: 1260152 - protein, 24 aa, Mycobacterium
AVTQQWAGAGIRLNALAPGAIMTP

SEQ ID NO: 1260153 - protein, 24 aa, Mycobacterium
AVTRAKGAWLWSGRDAVAAGLSAS

SEQ ID NO: 1260154 - protein, 20 aa, Mycobacterium
AVTRARRAGVSSFGVSGTNA

SEQ ID NO: 1260155 - protein, 19 aa, Mycobacterium
AVTRGAWRAGGTRDGVTGT

SEQ ID NO: 1260156 - protein, 27 aa, Mycobacterium
AVTSLQNWVRPHLEELLGDEVGGALAD

SEQ ID NO: 1260157 - protein, 17 aa, Mycobacterium
AVTTVLYPGLPSHPNHD

SEQ ID NO: 1260158 - protein, 28 aa, Mycobacterium
AVTVNWPKALMMCRRMIGAGTTVADCLS

SEQ ID NO: 1260159 - protein, 18 aa, Mycobacterium
AVVAARWVLAEAHAGDGE

SEQ ID NO: 1260160 - protein, 17 aa, Mycobacterium
AVVAREYGLPCVVNTLV

SEQ ID NO: 1260161 - protein, 18 aa, Mycobacterium
AVVARLAERAALYRDLVM

SEQ ID NO: 1260162 - protein, 20 aa, Mycobacterium
AVVDLGSRRRALLFMRADPL

SEQ ID NO: 1260163 - protein, 24 aa, Mycobacterium
AVVDMTVQWAFDRHSFGRPLASYQ

SEQ ID NO: 1260164 - protein, 18 aa, Mycobacterium
AVVDRGVAELGRLDIILA

SEQ ID NO: 1260165 - protein, 17 aa, Mycobacterium
AVVERFLAEGACVGVLD

SEQ ID NO: 1260166 - protein, 25 aa, Mycobacterium
AVVGGRDEVVEWFAANFGVIPWSMH

SEQ ID NO: 1260167 - protein, 19 aa, Mycobacterium
AVVGRAPLVLDYQINDKAV

SEQ ID NO: 1260168 - protein, 18 aa, Mycobacterium
AVVGRLWQHMDVLVVPTI

SEQ ID NO: 1260169 - protein, 17 aa, Mycobacterium
AVVIDWCYTFYNHQRRH

SEQ ID NO: 1260170 - protein, 20 aa, Mycobacterium
AVVIHRGRVLGVVPKSYLPT

SEQ ID NO: 1260171 - protein, 17 aa, Mycobacterium
AVVKLRLAIDGLVDLAR

SEQ ID NO: 1260172 - protein, 24 aa, Mycobacterium
AVVLSELVLRAGIEPDVVDDVIWG

SEQ ID NO: 1260173 - protein, 18 aa, Mycobacterium
AVVLVGGMGTRLRPLTLS

SEQ ID NO: 1260174 - protein, 23 aa, Mycobacterium
AVVPQMRARRSGVVVNVTSSVTL

SEQ ID NO: 1260175 - protein, 24 aa, Mycobacterium
AVVPRAHGSALFERGETQIMGVTT

SEQ ID NO: 1260176 - protein, 18 aa, Mycobacterium
AVVRQRRSLLPAGITALS

SEQ ID NO: 1260177 - protein, 19 aa, Mycobacterium
AVVRVRLVPGTGQFNLDGR

SEQ ID NO: 1260178 - protein, 20 aa, Mycobacterium
AVVSRWKAETSWAQRVSLAH

SEQ ID NO: 1260179 - protein, 26 aa, Mycobacterium
AVVYLCAPGSSWLTGEVLDINGGAHL

SEQ ID NO: 1260180 - protein, 18 aa, Mycobacterium
AVWGPRWAGSTAKLHVHI

SEQ ID NO: 1260181 - protein, 18 aa, Mycobacterium
AVYGRRYLELDGNSHRPT

SEQ ID NO: 1260182 - protein, 17 aa, Mycobacterium
AVYTAWGGFAYGRGLDG

SEQ ID NO: 1260183 - protein, 23 aa, Mycobacterium
AVYVCGPPALVDAVREVYPDAAS

SEQ ID NO: 1260184 - protein, 22 aa, Mycobacterium
AVYVPRLVRRAGRPAGKPLQLR

SEQ ID NO: 1260185 - protein, 22 aa, Mycobacterium
AWAASLRPGWQEERKRNFHNWS

SEQ ID NO: 1260186 - protein, 22 aa, Mycobacterium
AWANAALGFIYVHNGYYNDVEI

SEQ ID NO: 1260187 - protein, 18 aa, Mycobacterium
AWATALLENGHGRYHAAA

SEQ ID NO: 1260188 - protein, 18 aa, Mycobacterium
AWDLRGRDPFDTSVITFP

SEQ ID NO: 1260189 - protein, 23 aa, Mycobacterium
AWDSWRVDFAWPEVLVAAEYESV

SEQ ID NO: 1260190 - protein, 18 aa, Mycobacterium
AWEMKGRFPDILNNPATG

SEQ ID NO: 1260191 - protein, 23 aa, Mycobacterium
AWEPKTGAVGSLWDVVRDRRLTH

SEQ ID NO: 1260192 - protein, 24 aa, Mycobacterium
AWGGPPIGALVFRDPAVIDAFGSV

SEQ ID NO: 1260193 - protein, 18 aa, Mycobacterium
AWGRKMFVTPGVVVDGKL

SEQ ID NO: 1260194 - protein, 18 aa, Mycobacterium
AWGSRFPTISIRDQVAAD

SEQ ID NO: 1260195 - protein, 22 aa, Mycobacterium
AWHPMKPLPLHGMRRRRRIDVY

SEQ ID NO: 1260196 - protein, 19 aa, Mycobacterium
AWHRICVDRGILPGMQELV

SEQ ID NO: 1260197 - protein, 22 aa, Mycobacterium
AWHRPLPEPGMRSEYTPDRVGI

SEQ ID NO: 1260198 - protein, 18 aa, Mycobacterium
AWIADRIGLRVTPKTRVL

SEQ ID NO: 1260199 - protein, 20 aa, Mycobacterium
AWIEKMKQIGIFGLAIPESE

SEQ ID NO: 1260200 - protein, 17 aa, Mycobacterium
AWIPFGGGMMRCIGASF

SEQ ID NO: 1260201 - protein, 18 aa, Mycobacterium
AWKADYRGLTPATDYNVD

SEQ ID NO: 1260202 - protein, 26 aa, Mycobacterium
AWKTALDPKGEWMPAVIAAADKRLQG

SEQ ID NO: 1260203 - protein, 18 aa, Mycobacterium
AWLAEGLLMYLPADAQDR

SEQ ID NO: 1260204 - protein, 21 aa, Mycobacterium
AWLDCPHYLALSARVEDGTMP

SEQ ID NO: 1260205 - protein, 25 aa, Mycobacterium
AWLIKSLYLGPLVPRSVLELLRRRE

SEQ ID NO: 1260206 - protein, 40 aa, Mycobacterium
AWLMADFDGRIGAAVEEFVRWSSPVLQFARFATRDTEING

SEQ ID NO: 1260207 - protein, 17 aa, Mycobacterium
AWLRCMHTAVAEIDSRT

SEQ ID NO: 1260208 - protein, 21 aa, Mycobacterium
AWNPEFLREGFAVADTLHPDR

SEQ ID NO: 1260209 - protein, 22 aa, Mycobacterium
AWPAVKQRFPTAVLALTGGGEL

SEQ ID NO: 1260210 - protein, 19 aa, Mycobacterium
AWPNTDFMQAYGLTELCGV

SEQ ID NO: 1260211 - protein, 19 aa, Mycobacterium
AWPSAAGDYFTVRAGSLVA

SEQ ID NO: 1260212 - protein, 25 aa, Mycobacterium
AWPVQAADVVDGWPRMSQDRISAQI

SEQ ID NO: 1260213 - protein, 21 aa, Mycobacterium
AWQLPMSPLGLGYVRTPDGAS

SEQ ID NO: 1260214 - protein, 18 aa, Mycobacterium
AWSGTPWTTLPSLPIPGR

SEQ ID NO: 1260215 - protein, 22 aa, Mycobacterium
AWSSHRAALVIQTRIADLDPGV

SEQ ID NO: 1260216 - protein, 39 aa, Mycobacterium
AWTLAMGHAMIRAGLVLADWRPDIVHAHDWLVATPAVAL

SEQ ID NO: 1260217 - protein, 26 aa, Mycobacterium
AWVAEARPVLGTGIAERIRAAASVTD

SEQ ID NO: 1260218 - protein, 18 aa, Mycobacterium
AWVLAPEPIRDGAVVIAG

SEQ ID NO: 1260219 - protein, 17 aa, Mycobacterium
AWVVVRMVHNAVWELQQ

SEQ ID NO: 1260220 - protein, 19 aa, Mycobacterium
AYAARAGITCAVLIPQGKI

SEQ ID NO: 1260221 - protein, 17 aa, Mycobacterium
AYAARAGITCAVLVPQG

SEQ ID NO: 1260222 - protein, 22 aa, Mycobacterium
AYAEGLRALYLYTATHQDAEVA

SEQ ID NO: 1260223 - protein, 24 aa, Mycobacterium
AYAELDRWLDWYLAEASATSPQSD

SEQ ID NO: 1260224 - protein, 26 aa, Mycobacterium
AYAGGLRPVLCLTKSDLAPAEPFAAQ

SEQ ID NO: 1260225 - protein, 26 aa, Mycobacterium
AYAGHQFGGFAPRLGDGRALLLGELV

SEQ ID NO: 1260226 - protein, 19 aa, Mycobacterium
AYALFARKHMIDYGTTSEQ

SEQ ID NO: 1260227 - protein, 17 aa, Mycobacterium
AYDESWDDLLLRRLRAA

SEQ ID NO: 1260228 - protein, 17 aa, Mycobacterium
AYDGADFDGIFERLAAG

SEQ ID NO: 1260229 - protein, 18 aa, Mycobacterium
AYDLGRFRPDHEALGRLD

SEQ ID NO: 1260230 - protein, 23 aa, Mycobacterium
AYDLSSIRRFWHLAAPCPPAVKH

SEQ ID NO: 1260231 - protein, 28 aa, Mycobacterium
AYDLSSIRRFWHVGAPCPPAVKEAWIGL

SEQ ID NO: 1260232 - protein, 17 aa, Mycobacterium
AYEAWEMGTIGGARALR

SEQ ID NO: 1260233 - protein, 17 aa, Mycobacterium
AYEGIVPAWEWARRTGD

SEQ ID NO: 1260234 - protein, 24 aa, Mycobacterium
AYELDRKHVFHSWSAQAQINPMTV

SEQ ID NO: 1260235 - protein, 26 aa, Mycobacterium
AYEPPDRVVFTWDIGPTWQVEADLER

SEQ ID NO: 1260236 - protein, 24 aa, Mycobacterium
AYGDLPAIAGVAFLVKRVRADYQT

SEQ ID NO: 1260237 - protein, 17 aa, Mycobacterium
AYGGGMLKIEPREADVL

SEQ ID NO: 1260238 - protein, 24 aa, Mycobacterium
AYGSAGKVFGGMGVLGPTRMDYPG

SEQ ID NO: 1260239 - protein, 24 aa, Mycobacterium
AYGWSSLRSRPALRDQVAAAIAGA

SEQ ID NO: 1260240 - protein, 19 aa, Mycobacterium
AYIARSVWQKMGDDFLDTT

SEQ ID NO: 1260241 - protein, 26 aa, Mycobacterium
AYLARLRWPDGFRCPSCDHDRAWQTS

SEQ ID NO: 1260242 - protein, 21 aa, Mycobacterium
AYLCGPAPFMAAVQGALADAG

SEQ ID NO: 1260243 - protein, 18 aa, Mycobacterium
AYLDAFARHRRRLGDRTT

SEQ ID NO: 1260244 - protein, 18 aa, Mycobacterium
AYLDRTPTLFIVGGPPLR

SEQ ID NO: 1260245 - protein, 17 aa, Mycobacterium
AYLGAAPDVRIWARCSL

SEQ ID NO: 1260246 - protein, 22 aa, Mycobacterium
AYLGDLRSLFAFVDERTPGADL

SEQ ID NO: 1260247 - protein, 21 aa, Mycobacterium
AYMATGFSSPWNVEANEILTA

SEQ ID NO: 1260248 - protein, 18 aa, Mycobacterium
AYNDWNIDEWCGTYPGRM

SEQ ID NO: 1260249 - protein, 23 aa, Mycobacterium
AYPDELRAGLRVDKLTNRSVTYG

SEQ ID NO: 1260250 - protein, 20 aa, Mycobacterium
AYPFATWRVYLHPTQRAVVQ

SEQ ID NO: 1260251 - protein, 24 aa, Mycobacterium
AYRDAGVLHVDWWFDGDRFDHATV

SEQ ID NO: 1260252 - protein, 47 aa, Mycobacterium
AYRDRCAACTGSLAGTRLTGSVLRCPRCGAGFDVIRAGAGVGGDGHL

SEQ ID NO: 1260253 - protein, 17 aa, Mycobacterium
AYRGYRPLPPFNYVPEL

SEQ ID NO: 1260254 - protein, 20 aa, Mycobacterium
AYRILRPGGRYAIHELGLAP

SEQ ID NO: 1260255 - protein, 17 aa, Mycobacterium
AYRPVLDAHGWGDLQPE

SEQ ID NO: 1260256 - protein, 30 aa, Mycobacterium
AYRVPAVVRWPGRIPAGTVLNGIVSHNDWF

SEQ ID NO: 1260257 - protein, 22 aa, Mycobacterium
AYSAAKAAGWAMTDALRAELAP

SEQ ID NO: 1260258 - protein, 19 aa, Mycobacterium
AYSAWKFYQVTGDLAYLID

SEQ ID NO: 1260259 - protein, 18 aa, Mycobacterium
AYSLPPHRAAVLTRAAGP

SEQ ID NO: 1260260 - protein, 23 aa, Mycobacterium
AYSPESAKFFGLVETRYEGPTGI

SEQ ID NO: 1260261 - protein, 30 aa, Mycobacterium
AYSPRLRPGTPVSFPVAWSDLDRVRPADFT

SEQ ID NO: 1260262 - protein, 17 aa, Mycobacterium
AYTRSMTAWLCVESGRL

SEQ ID NO: 1260263 - protein, 18 aa, Mycobacterium
AYTVSWAQVQWGGETGYA

SEQ ID NO: 1260264 - protein, 26 aa, Mycobacterium
AYVALNPAAGWAVGVFRSPSGTETVI

SEQ ID NO: 1260265 - protein, 22 aa, Mycobacterium
AYVCGAPMALLSFVDATRQWIK

SEQ ID NO: 1260266 - protein, 18 aa, Mycobacterium
AYVLHARRYLADGGPVHP

SEQ ID NO: 1260267 - protein, 25 aa, Mycobacterium
AYVPSRPQLEWQIRRRTIAIPNVTV

SEQ ID NO: 1260268 - protein, 17 aa, Mycobacterium
AYWPEFRRVDFLRALRD

SEQ ID NO: 1260269 - protein, 24 aa, Mycobacterium
CAAAGLRPRIAFEATSPLELADLA

SEQ ID NO: 1260270 - protein, 19 aa, Mycobacterium
CAACAKPLELEQDICDGCG

SEQ ID NO: 1260271 - protein, 17 aa, Mycobacterium
CAAEHSLGQAIGGLTGA

SEQ ID NO: 1260272 - protein, 17 aa, Mycobacterium
CAAGLPVIVDGGVTEDV

SEQ ID NO: 1260273 - protein, 24 aa, Mycobacterium
CAANLKCLCRKHHLLKTFWTGENG

SEQ ID NO: 1260274 - protein, 18 aa, Mycobacterium
CAARRWTAAAEHWESSFG

SEQ ID NO: 1260275 - protein, 19 aa, Mycobacterium
CAATCGLHAHHIQHWEDGG

SEQ ID NO: 1260276 - protein, 19 aa, Mycobacterium
CAATKRLIAHRAVAAELTE

SEQ ID NO: 1260277 - protein, 17 aa, Mycobacterium
CAAVSAGINARVADLFR

SEQ ID NO: 1260278 - protein, 18 aa, Mycobacterium
CACSQPKECARLRDHADN

SEQ ID NO: 1260279 - protein, 20 aa, Mycobacterium
CADHPEALADGGYRQSKEAI

SEQ ID NO: 1260280 - protein, 27 aa, Mycobacterium
CADLLDWPAKLRILEGFRHRENLGWNA

SEQ ID NO: 1260281 - protein, 23 aa, Mycobacterium
CADPDMPGTVAVTVADALGSAIA

SEQ ID NO: 1260282 - protein, 18 aa, Mycobacterium
CAEGGVLGILCASVGSVM

SEQ ID NO: 1260283 - protein, 20 aa, Mycobacterium
CAELERRKRRLGILHYDDLL

SEQ ID NO: 1260284 - protein, 26 aa, Mycobacterium
CAEVALKRDMFAGIRVGRGGRAVGPR

SEQ ID NO: 1260285 - protein, 32 aa, Mycobacterium
CAEYRGQWLICRALEVVLGWIADDNCGAMQAD

SEQ ID NO: 1260286 - protein, 18 aa, Mycobacterium
CAFMEAFDPATVFSSIDS

SEQ ID NO: 1260287 - protein, 22 aa, Mycobacterium
CAGGWVYDRVMAGWDVTVLVGA

SEQ ID NO: 1260288 - protein, 17 aa, Mycobacterium
CAGILRDSFLGELDEAK

SEQ ID NO: 1260289 - protein, 39 aa, Mycobacterium
CAGSVSHFDWLVGCGVPFKAEFFGEPGWEPMGDQGLMFS

SEQ ID NO: 1260290 - protein, 28 aa, Mycobacterium
CAGVDRFTRVRDVVVSDFVSVPVGTDPR

SEQ ID NO: 1260291 - protein, 26 aa, Mycobacterium
CAGYRRAADPPANWDTWCTRVEAALN

SEQ ID NO: 1260292 - protein, 18 aa, Mycobacterium
CAHCPVRAMCPAQNRSDT

SEQ ID NO: 1260293 - protein, 19 aa, Mycobacterium
CAIIARMSRDLGKANQLAP

SEQ ID NO: 1260294 - protein, 20 aa, Mycobacterium
CALTTRLLLPRHRYDEGIAV

SEQ ID NO: 1260295 - protein, 24 aa, Mycobacterium
CALVPDSMQFCFGLATEGTVAEGA

SEQ ID NO: 1260296 - protein, 21 aa, Mycobacterium
CANLHLAECNWLVQKGPIAKL

SEQ ID NO: 1260297 - protein, 18 aa, Mycobacterium
CAPRDDVRLSRVVVDLLG

SEQ ID NO: 1260298 - protein, 19 aa, Mycobacterium
CAQAARLIFDALPRAYRDP

SEQ ID NO: 1260299 - protein, 18 aa, Mycobacterium
CAQPGCPELQTETRCTEH

SEQ ID NO: 1260300 - protein, 25 aa, Mycobacterium
CAQRAEVMASILLTELVRRGVLRAP

SEQ ID NO: 1260301 - protein, 19 aa, Mycobacterium
CAQWLRWYDSEVMPTLVDA

SEQ ID NO: 1260302 - protein, 26 aa, Mycobacterium
CARFSSSGQFVGWAITKIMAGCVEVY

SEQ ID NO: 1260303 - protein, 19 aa, Mycobacterium
CARLGWPVQDTEVISLVTA

SEQ ID NO: 1260304 - protein, 19 aa, Mycobacterium
CARSRILVQRNVFDRFMDL

SEQ ID NO: 1260305 - protein, 25 aa, Mycobacterium
CASMPTPFRAVGESFWDFTQVSDDD

SEQ ID NO: 1260306 - protein, 19 aa, Mycobacterium
CATALAAIHRADPAGIGLT

SEQ ID NO: 1260307 - protein, 18 aa, Mycobacterium
CATFDGFYTLLVSNRDSF

SEQ ID NO: 1260308 - protein, 20 aa, Mycobacterium
CAVALNVLGALGLITLGRAD

SEQ ID NO: 1260309 - protein, 19 aa, Mycobacterium
CAVASDWGIDMVPVPTGSM

SEQ ID NO: 1260310 - protein, 18 aa, Mycobacterium
CAVQGEWAATPARKRGEI

SEQ ID NO: 1260311 - protein, 19 aa, Mycobacterium
CAWHPGPRGMPILDAAAGW

SEQ ID NO: 1260312 - protein, 22 aa, Mycobacterium
CCKAALRHMVPAQKGSIINTAS

SEQ ID NO: 1260313 - protein, 18 aa, Mycobacterium
CCLTWKHLAGIDIHADGL

SEQ ID NO: 1260314 - protein, 18 aa, Mycobacterium
CCPTGIGTVRFRIGGDGK

SEQ ID NO: 1260315 - protein, 19 aa, Mycobacterium
CCRARACGYGSARGGLCQL

SEQ ID NO: 1260316 - protein, 23 aa, Mycobacterium
CDAAATAWCPACARELTVKPDQP

SEQ ID NO: 1260317 - protein, 17 aa, Mycobacterium
CDADLPFGCPAGEDAYF

SEQ ID NO: 1260318 - protein, 30 aa, Mycobacterium
CDAFDKFPPFPFNVVFAMLRGQVSIKVLTE

SEQ ID NO: 1260319 - protein, 21 aa, Mycobacterium
CDAGAPFGLKPEAIVPAYGMA

SEQ ID NO: 1260320 - protein, 21 aa, Mycobacterium
CDAGDCGACSVLVDGAAVHSC

SEQ ID NO: 1260321 - protein, 24 aa, Mycobacterium
CDGFVLGASISPFTLLLIRDELVP

SEQ ID NO: 1260322 - protein, 25 aa, Mycobacterium
CDGPTSLSAVIRWLAGTAETELLLT

SEQ ID NO: 1260323 - protein, 21 aa, Mycobacterium
CDHGLCGACTVEVDHERVLSC

SEQ ID NO: 1260324 - protein, 24 aa, Mycobacterium
CDIPSLLYSFSFVRNPSWSRAYPT

SEQ ID NO: 1260325 - protein, 27 aa, Mycobacterium
CDISLWRRLCTELELPGLHLSQECGGA

SEQ ID NO: 1260326 - protein, 19 aa, Mycobacterium
CDLIPYLPFSTAAGVSLLT

SEQ ID NO: 1260327 - protein, 18 aa, Mycobacterium
CDLQRPGAVNQLQIVGER

SEQ ID NO: 1260328 - protein, 20 aa, Mycobacterium
CDLWFPPTTIPVGYGQTRTP

SEQ ID NO: 1260329 - protein, 23 aa, Mycobacterium
CDLWFPPTTIPVGYGQTRTPTQL

SEQ ID NO: 1260330 - protein, 24 aa, Mycobacterium
CDRFAEQYAKLRAHKGVTVEQAHE

SEQ ID NO: 1260331 - protein, 25 aa, Mycobacterium
CDRPIADVCPVEWARMENRSVLQWD

SEQ ID NO: 1260332 - protein, 19 aa, Mycobacterium
CDTHWPWKTEDVVKDGALA

SEQ ID NO: 1260333 - protein, 26 aa, Mycobacterium
CDTRGLLRRMLSGFTDRTGLELRTGC

SEQ ID NO: 1260334 - protein, 20 aa, Mycobacterium
CDYAPVVMVNWDFFDNQTPS

SEQ ID NO: 1260335 - protein, 23 aa, Mycobacterium
CEADGIAFIPWFPLAAGPLAAAD

SEQ ID NO: 1260336 - protein, 17 aa, Mycobacterium
CEAGTRLLIPRSRRDEI

SEQ ID NO: 1260337 - protein, 18 aa, Mycobacterium
CEAHEGLSAVSCDVADPA

SEQ ID NO: 1260338 - protein, 20 aa, Mycobacterium
CEARGLPANRIGVVDQGPDG

SEQ ID NO: 1260339 - protein, 25 aa, Mycobacterium
CEDGHAAEVYYRHLVPPGSPRSDTG

SEQ ID NO: 1260340 - protein, 28 aa, Mycobacterium
CEDLGVDVAFNWDHFFPLYGDPDGAHFE

SEQ ID NO: 1260341 - protein, 20 aa, Mycobacterium
CEGGSFDFLLSATRPAPETL

SEQ ID NO: 1260342 - protein, 19 aa, Mycobacterium
CEHCPNFRTDTGYLPVLAA

SEQ ID NO: 1260343 - protein, 24 aa, Mycobacterium
CEHPGWRTSQAHSFCRALERRLIG

SEQ ID NO: 1260344 - protein, 25 aa, Mycobacterium
CEICVEAFAGFAIVKPQVAFFEAYG

SEQ ID NO: 1260345 - protein, 24 aa, Mycobacterium
CEIFPPDDFPLYFYRKPSAPDLQI

SEQ ID NO: 1260346 - protein, 22 aa, Mycobacterium
CEIGEARLKYRGWGVPYDHARL

SEQ ID NO: 1260347 - protein, 19 aa, Mycobacterium
CELCCKLTPTRVLDSLGQF

SEQ ID NO: 1260348 - protein, 20 aa, Mycobacterium
CELPAYAEFCDRVRVVRDLT

SEQ ID NO: 1260349 - protein, 23 aa, Mycobacterium
CELSGLWLTTALAMSGNRAAAQD

SEQ ID NO: 1260350 - protein, 21 aa, Mycobacterium
CEMRVRIEGRKGGLIESEAFW

SEQ ID NO: 1260351 - protein, 17 aa, Mycobacterium
CEPAELMPTAFDYAERL

SEQ ID NO: 1260352 - protein, 23 aa, Mycobacterium
CEPQLKPTTEWQAIARAHRMGQL

SEQ ID NO: 1260353 - protein, 17 aa, Mycobacterium
CEQCWPHIAADLAAGEQ

SEQ ID NO: 1260354 - protein, 18 aa, Mycobacterium
CEQCWPHIAADLAAGEQY

SEQ ID NO: 1260355 - protein, 28 aa, Mycobacterium
CESLYHFAWDEFCDWYLELAKVQLGQEE

SEQ ID NO: 1260356 - protein, 24 aa, Mycobacterium
CESVRCVDHNLLPGVEADMGPGDE

SEQ ID NO: 1260357 - protein, 17 aa, Mycobacterium
CETHRKVAEEAAKLSAK

SEQ ID NO: 1260358 - protein, 17 aa, Mycobacterium
CETVHPLLFPTADGTGL

SEQ ID NO: 1260359 - protein, 18 aa, Mycobacterium
CEYEWRHHVAMGRDAGLS

SEQ ID NO: 1260360 - protein, 19 aa, Mycobacterium
CEYWRAQSKAGNPIDAHIV

SEQ ID NO: 1260361 - protein, 24 aa, Mycobacterium
CFAQLLRPGLRTERHRHTSSAVYY

SEQ ID NO: 1260362 - protein, 18 aa, Mycobacterium
CFATSSGMSAVFTALGAL

SEQ ID NO: 1260363 - protein, 18 aa, Mycobacterium
CFDVCPVRIDIPSMLVHL

SEQ ID NO: 1260364 - protein, 20 aa, Mycobacterium
CFECRIWRYSYELESTRRGR

SEQ ID NO: 1260365 - protein, 18 aa, Mycobacterium
CFFGIGMSEPDSGSDLAS

SEQ ID NO: 1260366 - protein, 19 aa, Mycobacterium
CFWHGCPDHHTVAVTNGEF

SEQ ID NO: 1260367 - protein, 26 aa, Mycobacterium
CGALSEWRATLIVRESACLSVQHRRE

SEQ ID NO: 1260368 - protein, 19 aa, Mycobacterium
CGDVSRLAGWGNKRIEAEA

SEQ ID NO: 1260369 - protein, 21 aa, Mycobacterium
CGECGFCKQGAEALCGTVGFI

SEQ ID NO: 1260370 - protein, 19 aa, Mycobacterium
CGEVADGLLAHAFSTQRYV

SEQ ID NO: 1260371 - protein, 24 aa, Mycobacterium
CGGQGGGEPVEWGRRSHAVDGPLY

SEQ ID NO: 1260372 - protein, 20 aa, Mycobacterium
CGGQPMLPLGAERPAGATLD

SEQ ID NO: 1260373 - protein, 18 aa, Mycobacterium
CGGRARFVSEPVAAPTCS

SEQ ID NO: 1260374 - protein, 18 aa, Mycobacterium
CGHAELSLALAADGYTVV

SEQ ID NO: 1260375 - protein, 25 aa, Mycobacterium
CGIDPEVYSGFAFGMGLERTLQFRN

SEQ ID NO: 1260376 - protein, 18 aa, Mycobacterium
CGILVLKRLGDAVRDGDR

SEQ ID NO: 1260377 - protein, 18 aa, Mycobacterium
CGIVPDTDALLLLSLLQV

SEQ ID NO: 1260378 - protein, 17 aa, Mycobacterium
CGIYCATANPVDVVVAV

SEQ ID NO: 1260379 - protein, 25 aa, Mycobacterium
CGKTRLVEHMGLLLGRPVVTISCHD

SEQ ID NO: 1260380 - protein, 17 aa, Mycobacterium
CGLITPREVAALRARVV

SEQ ID NO: 1260381 - protein, 17 aa, Mycobacterium
CGMVNPNVLRACGIDPD

SEQ ID NO: 1260382 - protein, 17 aa, Mycobacterium
CGPAPVTHLRDLIRAGR

SEQ ID NO: 1260383 - protein, 17 aa, Mycobacterium
CGPEAGSPLRTSVGATI

SEQ ID NO: 1260384 - protein, 19 aa, Mycobacterium
CGPKTRFQPTLQMLTELDP

SEQ ID NO: 1260385 - protein, 18 aa, Mycobacterium
CGPLGGVRRALRRAERLG

SEQ ID NO: 1260386 - protein, 17 aa, Mycobacterium
CGPMGRMVFDQRLAAPV

SEQ ID NO: 1260387 - protein, 23 aa, Mycobacterium
CGPRRMRGTAIGWAAAPHDGVPA

SEQ ID NO: 1260388 - protein, 19 aa, Mycobacterium
CGQRLSFENSVCLNCGSAL

SEQ ID NO: 1260389 - protein, 22 aa, Mycobacterium
CGRIGDVLRYTQTVTLWHGVER

SEQ ID NO: 1260390 - protein, 20 aa, Mycobacterium
CGRLTAQPGVRLRWPDGVVT

SEQ ID NO: 1260391 - protein, 23 aa, Mycobacterium
CGRVKELITVAGRNIFPSEVERV

SEQ ID NO: 1260392 - protein, 20 aa, Mycobacterium
CGSDLPGYRGAKGRLAGDTG

SEQ ID NO: 1260393 - protein, 20 aa, Mycobacterium
CGSTTRLFLHESLHDQVVSG

SEQ ID NO: 1260394 - protein, 20 aa, Mycobacterium
CGTELLDAARFCHGCGSELV

SEQ ID NO: 1260395 - protein, 19 aa, Mycobacterium
CGTGKTFTALKICEQIADD

SEQ ID NO: 1260396 - protein, 24 aa, Mycobacterium
CGTLICPWHGLRLSGERREFGWKP

SEQ ID NO: 1260397 - protein, 21 aa, Mycobacterium
CGVGVFGCGECGFCKQGAEAL

SEQ ID NO: 1260398 - protein, 18 aa, Mycobacterium
CGVPRSTTVRVVDPDSLV

SEQ ID NO: 1260399 - protein, 18 aa, Mycobacterium
CHAHLFGIDLSDWLALRL

SEQ ID NO: 1260400 - protein, 20 aa, Mycobacterium
CHELGRRGCKVAVLDLDGQA

SEQ ID NO: 1260401 - protein, 26 aa, Mycobacterium
CHHHRCFPVLAGAPGDRDLMLISPII

SEQ ID NO: 1260402 - protein, 24 aa, Mycobacterium
CIAACTRLAFDYDRDHPFLHSGTG

SEQ ID NO: 1260403 - protein, 20 aa, Mycobacterium
CIDSYGGGQLLDWLQHCIFP

SEQ ID NO: 1260404 - protein, 23 aa, Mycobacterium
CIECGSCMTGCRYGAKNTLLKNY

SEQ ID NO: 1260405 - protein, 17 aa, Mycobacterium
CILDRPRHEQLIADVRD

SEQ ID NO: 1260406 - protein, 18 aa, Mycobacterium
CILDRPRHEQLIADVRDS

SEQ ID NO: 1260407 - protein, 30 aa, Mycobacterium
CILPSRILLPRSRYDEGIEILKTMMEGFPV

SEQ ID NO: 1260408 - protein, 20 aa, Mycobacterium
CIRCSACLNVCPVYERTGGH

SEQ ID NO: 1260409 - protein, 20 aa, Mycobacterium
CIRPNRFGREHDVIDAETVD

SEQ ID NO: 1260410 - protein, 24 aa, Mycobacterium
CISACGACRYCRQGQYGQCLGGGG

SEQ ID NO: 1260411 - protein, 19 aa, Mycobacterium
CKARLAELNEAYRADYRAY

SEQ ID NO: 1260412 - protein, 24 aa, Mycobacterium
CKAVCAHCPVLAQCRTWGLTKGRD

SEQ ID NO: 1260413 - protein, 17 aa, Mycobacterium
CKECGAVLVYEKPCPCT

SEQ ID NO: 1260414 - protein, 18 aa, Mycobacterium
CKFPDGGTLSLRHVAGTS

SEQ ID NO: 1260415 - protein, 18 aa, Mycobacterium
CKLLVEIGPRPVLTAAAL

SEQ ID NO: 1260416 - protein, 17 aa, Mycobacterium
CKSDVKYKGALQGDPDS

SEQ ID NO: 1260417 - protein, 20 aa, Mycobacterium
CLAHIGGLLSRQRSGMRVMH

SEQ ID NO: 1260418 - protein, 18 aa, Mycobacterium
CLATATAVMQLYEQGKVA

SEQ ID NO: 1260419 - protein, 25 aa, Mycobacterium
CLDAPDVRAAHAFWSTVFSAKVSDW

SEQ ID NO: 1260420 - protein, 18 aa, Mycobacterium
CLDCADLGHLEFLPSGEA

SEQ ID NO: 1260421 - protein, 18 aa, Mycobacterium
CLDLGAITYLAKSEGRAH

SEQ ID NO: 1260422 - protein, 19 aa, Mycobacterium
CLDVGRWQQAGWQVFALGR

SEQ ID NO: 1260423 - protein, 19 aa, Mycobacterium
CLEQGLRVGCFRPPTVPAG

SEQ ID NO: 1260424 - protein, 22 aa, Mycobacterium
CLGANLARSMLRAELRELLLRI

SEQ ID NO: 1260425 - protein, 17 aa, Mycobacterium
CLGQLGHGFAMQAFLAV

SEQ ID NO: 1260426 - protein, 18 aa, Mycobacterium
CLGSPYLPPPVMAPPPAM

SEQ ID NO: 1260427 - protein, 23 aa, Mycobacterium
CLHHYAWTRDRLVVVTLADVASR

SEQ ID NO: 1260428 - protein, 19 aa, Mycobacterium
CLNVSPANAIWFYDNTKRG

SEQ ID NO: 1260429 - protein, 19 aa, Mycobacterium
CLRGVNTLTGFALAVEIGD

SEQ ID NO: 1260430 - protein, 18 aa, Mycobacterium
CLTLDYDKMRGMDNDEFR

SEQ ID NO: 1260431 - protein, 26 aa, Mycobacterium
CLTMARDLGSLGIRALAIAPSLFATG

SEQ ID NO: 1260432 - protein, 27 aa, Mycobacterium
CLTVAGSLRASRQWGLDHEVLDADEIR

SEQ ID NO: 1260433 - protein, 18 aa, Mycobacterium
CLVQMYLADERFTRHYDD

SEQ ID NO: 1260434 - protein, 24 aa, Mycobacterium
CMGYEIAGGIGVRMAAPDRDVFVM

SEQ ID NO: 1260435 - protein, 17 aa, Mycobacterium
CMPTYLAAQAAGVARAK

SEQ ID NO: 1260436 - protein, 19 aa, Mycobacterium
CNCQPRIVLAENIQSTGYT

SEQ ID NO: 1260437 - protein, 19 aa, Mycobacterium
CNLCMPTIYSHTYCVRTGS

SEQ ID NO: 1260438 - protein, 20 aa, Mycobacterium
CNLFDMCAIAVPAGTAGGAQ

SEQ ID NO: 1260439 - protein, 24 aa, Mycobacterium
CNNTCTFCIVPALRGREVDRRPGD

SEQ ID NO: 1260440 - protein, 21 aa, Mycobacterium
CNPYLTFAVLLAAGLRGIEKN

SEQ ID NO: 1260441 - protein, 23 aa, Mycobacterium
CNRCPVTAECLSWALESGQDAGV

SEQ ID NO: 1260442 - protein, 19 aa, Mycobacterium
CNSALCWTHPTMGANAIPA

SEQ ID NO: 1260443 - protein, 19 aa, Mycobacterium
CNVLHAAAGRVPREMIMRS

SEQ ID NO: 1260444 - protein, 23 aa, Mycobacterium
CPADRFEVVATFAGRGDQLNDLR

SEQ ID NO: 1260445 - protein, 27 aa, Mycobacterium
CPAVPLVDESWVWLPALLAGRIFTHRV

SEQ ID NO: 1260446 - protein, 18 aa, Mycobacterium
CPDCAALNRAKRDARTDL

SEQ ID NO: 1260447 - protein, 19 aa, Mycobacterium
CPDQFLGAHVRRVTGRKNL

SEQ ID NO: 1260448 - protein, 21 aa, Mycobacterium
CPFCEATCGLTLTVDDGRVTG

SEQ ID NO: 1260449 - protein, 17 aa, Mycobacterium
CPPCSHNTLNFATDSAG

SEQ ID NO: 1260450 - protein, 31 aa, Mycobacterium
CPRAEGVSVQLRRFIAAILMGALAAACSSNA

SEQ ID NO: 1260451 - protein, 21 aa, Mycobacterium
CPRCGGMLKPDIVYFGESVPK

SEQ ID NO: 1260452 - protein, 18 aa, Mycobacterium
CPTIRPAELHPHVLRHTC

SEQ ID NO: 1260453 - protein, 17 aa, Mycobacterium
CPVDRTMWNYAADAEIN

SEQ ID NO: 1260454 - protein, 18 aa, Mycobacterium
CPYCWSENVAPVQASGTG

SEQ ID NO: 1260455 - protein, 19 aa, Mycobacterium
CQAHAFGITLQEWLSIEQE

SEQ ID NO: 1260456 - protein, 20 aa, Mycobacterium
CQDFARLAIACLRANGLAAS

SEQ ID NO: 1260457 - protein, 25 aa, Mycobacterium
CQDHGQCVIAAPAVFSLNDDGHLEY

SEQ ID NO: 1260458 - protein, 18 aa, Mycobacterium
CQGLCPECGVRLADAEPG

SEQ ID NO: 1260459 - protein, 29 aa, Mycobacterium
CQIGVAPVKPAEFVIFRLAQYSGGTSLVA

SEQ ID NO: 1260460 - protein, 20 aa, Mycobacterium
CQLPTMNHRLLARLQAESTP

SEQ ID NO: 1260461 - protein, 18 aa, Mycobacterium
CQNGRVRAVLWDMDGTLV

SEQ ID NO: 1260462 - protein, 22 aa, Mycobacterium
CQSILGYVVRWIDAGVGCSKVP

SEQ ID NO: 1260463 - protein, 24 aa, Mycobacterium
CQTFVTWLGIPGWIKTFTAAGLPG

SEQ ID NO: 1260464 - protein, 36 aa, Mycobacterium
CQYRRPRKRWVLKGFHGFRLTEFFAGYPDASLIWLH

SEQ ID NO: 1260465 - protein, 20 aa, Mycobacterium
CRAEELLLSALRPVDTATAP

SEQ ID NO: 1260466 - protein, 17 aa, Mycobacterium
CRAPITLVGAADQHDRT

SEQ ID NO: 1260467 - protein, 18 aa, Mycobacterium
CRAPSLHNSQPWRWVVVD

SEQ ID NO: 1260468 - protein, 19 aa, Mycobacterium
CRCGSPPPPAPDSIAHREW

SEQ ID NO: 1260469 - protein, 17 aa, Mycobacterium
CRDFRRPLLTEAGDYFT

SEQ ID NO: 1260470 - protein, 21 aa, Mycobacterium
CREGHCGACAVLKKSGDTEME

SEQ ID NO: 1260471 - protein, 22 aa, Mycobacterium
CREGHCGACAVLKKSGEVEMEV

SEQ ID NO: 1260472 - protein, 25 aa, Mycobacterium
CREGQCGSCAATLRSGRVDMPDTDI

SEQ ID NO: 1260473 - protein, 20 aa, Mycobacterium
CREHRLSPKLVEVAEGQKST

SEQ ID NO: 1260474 - protein, 17 aa, Mycobacterium
CRFPGGGWVLSRMLGTR

SEQ ID NO: 1260475 - protein, 17 aa, Mycobacterium
CRIGICHTCVGTLKSGR

SEQ ID NO: 1260476 - protein, 18 aa, Mycobacterium
CRILEYYCPGCGTQIECE

SEQ ID NO: 1260477 - protein, 21 aa, Mycobacterium
CRMGICQSCVVPLVDGHVRDL

SEQ ID NO: 1260478 - protein, 20 aa, Mycobacterium
CRPMPQARYIWSYGADGGTF

SEQ ID NO: 1260479 - protein, 19 aa, Mycobacterium
CRQFLSGNLVGVWNSVAAT

SEQ ID NO: 1260480 - protein, 27 aa, Mycobacterium
CRQFTCKYHAWRYALDGELTFIQQEDE

SEQ ID NO: 1260481 - protein, 20 aa, Mycobacterium
CRQFTCKYHGWRYNLTGDLT

SEQ ID NO: 1260482 - protein, 18 aa, Mycobacterium
CRSITSATAGARTEVANN

SEQ ID NO: 1260483 - protein, 26 aa, Mycobacterium
CRTVTHVGFRWGFLVGDTVICNGVTD

SEQ ID NO: 1260484 - protein, 18 aa, Mycobacterium
CRVCATPIRTVELEGRNL

SEQ ID NO: 1260485 - protein, 17 aa, Mycobacterium
CRVHEGCIEEDFIGEPQ

SEQ ID NO: 1260486 - protein, 17 aa, Mycobacterium
CRVWQLFNGSTSFAVTL

SEQ ID NO: 1260487 - protein, 19 aa, Mycobacterium
CRYRCWLGRRHRVMRRCGL

SEQ ID NO: 1260488 - protein, 23 aa, Mycobacterium
CRYRRWLAMAARDGNEMVVDAVG

SEQ ID NO: 1260489 - protein, 18 aa, Mycobacterium
CSAARCSPVNQVFLDSVG

SEQ ID NO: 1260490 - protein, 24 aa, Mycobacterium
CSAEGSPSRIAFVFPGQGTQWPSM

SEQ ID NO: 1260491 - protein, 19 aa, Mycobacterium
CSAGRWEVYAGPYPSSDRW

SEQ ID NO: 1260492 - protein, 31 aa, Mycobacterium
CSAGTFYWPFGFAILGDRFWVADTGNRRVLG

SEQ ID NO: 1260493 - protein, 17 aa, Mycobacterium
CSAVHPLALASPFFAEF

SEQ ID NO: 1260494 - protein, 18 aa, Mycobacterium
CSEAAGYVTGSWIEVDGG

SEQ ID NO: 1260495 - protein, 19 aa, Mycobacterium
CSELRIAVEYDGDYHRTNR

SEQ ID NO: 1260496 - protein, 33 aa, Mycobacterium
CSHCGGPSCGLRLCQSCRNAVGTVQGRLRTIGV

SEQ ID NO: 1260497 - protein, 18 aa, Mycobacterium
CSIEESLRAGATTAVKRP

SEQ ID NO: 1260498 - protein, 19 aa, Mycobacterium
CSLDARLLIRESKFGKSRI

SEQ ID NO: 1260499 - protein, 18 aa, Mycobacterium
CSNGRLSWHRGLATGRHR

SEQ ID NO: 1260500 - protein, 19 aa, Mycobacterium
CSPEQLEGVFTPPAEASLS

SEQ ID NO: 1260501 - protein, 25 aa, Mycobacterium
CSQGRVIPDLIEWWCERDGVRPDKS

SEQ ID NO: 1260502 - protein, 19 aa, Mycobacterium
CSSSLVAVHLACQSLLNGE

SEQ ID NO: 1260503 - protein, 19 aa, Mycobacterium
CSTTLDFTSAVLQSPVVHI

SEQ ID NO: 1260504 - protein, 19 aa, Mycobacterium
CSTTPLLRKRKPFTTGKSP

SEQ ID NO: 1260505 - protein, 18 aa, Mycobacterium
CSVGHNAVLHGCTIEDNS

SEQ ID NO: 1260506 - protein, 17 aa, Mycobacterium
CSVGQIVWGWPHCVQDA

SEQ ID NO: 1260507 - protein, 18 aa, Mycobacterium
CSVLMEIGPQPFLIAAAL

SEQ ID NO: 1260508 - protein, 24 aa, Mycobacterium
CSYLNKMLWILTGNFAKRGAQHLH

SEQ ID NO: 1260509 - protein, 28 aa, Mycobacterium
CTAAPNLRPQPCLDLYTAVRDGERSRAQ

SEQ ID NO: 1260510 - protein, 19 aa, Mycobacterium
CTAVRFGLWEGSGIVDAAE

SEQ ID NO: 1260511 - protein, 23 aa, Mycobacterium
CTEPEFPHFDLAPGTLFKTQKVS

SEQ ID NO: 1260512 - protein, 17 aa, Mycobacterium
CTGRRSPAQLARMDWSA

SEQ ID NO: 1260513 - protein, 21 aa, Mycobacterium
CTHCNKCMATIYSHTHCVVTG

SEQ ID NO: 1260514 - protein, 20 aa, Mycobacterium
CTHYTRAYLHHLFKAKEMLS

SEQ ID NO: 1260515 - protein, 22 aa, Mycobacterium
CTIAPGLFKTPLLGSLPEEAQA

SEQ ID NO: 1260516 - protein, 20 aa, Mycobacterium
CTIKGRPGPVPTDLNEEQIR

SEQ ID NO: 1260517 - protein, 19 aa, Mycobacterium
CTLFDKWRLLPVLDADDRV

SEQ ID NO: 1260518 - protein, 18 aa, Mycobacterium
CTMCAGALVMARVARVVF

SEQ ID NO: 1260519 - protein, 18 aa, Mycobacterium
CTQPEFVDAATLAAHHDD

SEQ ID NO: 1260520 - protein, 24 aa, Mycobacterium
CTRIWKDGRVEQLGWPRVKIHYRS

SEQ ID NO: 1260521 - protein, 21 aa, Mycobacterium
CTRLGVTKGSFYWHFADMAAY

SEQ ID NO: 1260522 - protein, 19 aa, Mycobacterium
CTSLNEVICHGIPDDTVVE

SEQ ID NO: 1260523 - protein, 19 aa, Mycobacterium
CTTLRRLIVHRSVADDLVE

SEQ ID NO: 1260524 - protein, 29 aa, Mycobacterium
CTVGDPLLDLGWMLICWPDGPNPIDVGSE

SEQ ID NO: 1260525 - protein, 19 aa, Mycobacterium
CTVLDVVARDGLVDRAERL

SEQ ID NO: 1260526 - protein, 25 aa, Mycobacterium
CTVVHLGCGLDCRVFRVDPGPDVRW

SEQ ID NO: 1260527 - protein, 18 aa, Mycobacterium
CTVVLKPAPDTPWSGTEL

SEQ ID NO: 1260528 - protein, 20 aa, Mycobacterium
CVAVADHGRAVFGQIGDGVI

SEQ ID NO: 1260529 - protein, 19 aa, Mycobacterium
CVCDMAWVIGLSQGLVSHH

SEQ ID NO: 1260530 - protein, 19 aa, Mycobacterium
CVCRGCYLLFTDTHAALRY

SEQ ID NO: 1260531 - protein, 19 aa, Mycobacterium
CVDYARGRFDAAVPEEVQR

SEQ ID NO: 1260532 - protein, 18 aa, Mycobacterium
CVEECPVDCIYEGGRSLY

SEQ ID NO: 1260533 - protein, 18 aa, Mycobacterium
CVEFARRAACTVVSVDYR

SEQ ID NO: 1260534 - protein, 20 aa, Mycobacterium
CVEPLKKWKLEVAPNDSGIS

SEQ ID NO: 1260535 - protein, 18 aa, Mycobacterium
CVEVYRGRFPAAVSSLEQ

SEQ ID NO: 1260536 - protein, 17 aa, Mycobacterium
CVGAAFAQMQIKAIFSV

SEQ ID NO: 1260537 - protein, 17 aa, Mycobacterium
CVGIFDFYRRIQDIPAE

SEQ ID NO: 1260538 - protein, 25 aa, Mycobacterium
CVGQTRILAPRSRYDEVVEKLAAAA

SEQ ID NO: 1260539 - protein, 19 aa, Mycobacterium
CVHAGMDLYKWAVKLGPLI

SEQ ID NO: 1260540 - protein, 18 aa, Mycobacterium
CVHCCQLNEVMPIDRLGY

SEQ ID NO: 1260541 - protein, 18 aa, Mycobacterium
CVIDPTFATRDLVRTLHH

SEQ ID NO: 1260542 - protein, 20 aa, Mycobacterium
CVLADPRWDHIQDIGDVSDF

SEQ ID NO: 1260543 - protein, 18 aa, Mycobacterium
CVLNAGAVFDQRDDDGVV

SEQ ID NO: 1260544 - protein, 19 aa, Mycobacterium
CVLPDTFDAFGGHKEAVSS

SEQ ID NO: 1260545 - protein, 20 aa, Mycobacterium
CVPAARVLDEAMVIARDIAT

SEQ ID NO: 1260546 - protein, 25 aa, Mycobacterium
CVQAGIPAVTFWAAVPHYVSQPPSP

SEQ ID NO: 1260547 - protein, 19 aa, Mycobacterium
CVQCNATFRALDKAGVDYA

SEQ ID NO: 1260548 - protein, 18 aa, Mycobacterium
CVSACPVGAIAPETGLAP

SEQ ID NO: 1260549 - protein, 17 aa, Mycobacterium
CVSAGSILRNLDPQRFE

SEQ ID NO: 1260550 - protein, 17 aa, Mycobacterium
CVTAANWLRAHRDGCGA

SEQ ID NO: 1260551 - protein, 27 aa, Mycobacterium
CVVEDGIQCPFHGWVWNGEGRNVRIPY

SEQ ID NO: 1260552 - protein, 23 aa, Mycobacterium
CVVPLGWPRGRYGPTTRRPVDEV

SEQ ID NO: 1260553 - protein, 20 aa, Mycobacterium
CWEQTDWVTICAAYDRLLGI

SEQ ID NO: 1260554 - protein, 19 aa, Mycobacterium
CWLEDGRVRGDIEVTVTGA

SEQ ID NO: 1260555 - protein, 17 aa, Mycobacterium
CYDRGGLKPTVTDADLL

SEQ ID NO: 1260556 - protein, 21 aa, Mycobacterium
CYGFCAFHRRYLELLELSATG

SEQ ID NO: 1260557 - protein, 19 aa, Mycobacterium
CYQFGDAKPVYALEGSIAV

SEQ ID NO: 1260558 - protein, 17 aa, Mycobacterium
CYQGLRHRRGLPVRGQR

SEQ ID NO: 1260559 - protein, 18 aa, Mycobacterium
CYRGRDFQTLFCGHDPLL

SEQ ID NO: 1260560 - protein, 21 aa, Mycobacterium
CYTGADFEAVIALMGQGKYDT

SEQ ID NO: 1260561 - protein, 20 aa, Mycobacterium
DAAAGWFVGRVLRRFDVGDH

SEQ ID NO: 1260562 - protein, 24 aa, Mycobacterium
DAAAKAAILASIAFHTRVTADDVY

SEQ ID NO: 1260563 - protein, 20 aa, Mycobacterium
DAAARYAADPAQALADANLV

SEQ ID NO: 1260564 - protein, 25 aa, Mycobacterium
DAAAVQIMTVWVSKGLQFPVVYLPF

SEQ ID NO: 1260565 - protein, 29 aa, Mycobacterium
DAADARYALDMAPRLVAFSEDVDRRVSDG

SEQ ID NO: 1260566 - protein, 20 aa, Mycobacterium
DAADHFGWVACDNRTTRAVS

SEQ ID NO: 1260567 - protein, 22 aa, Mycobacterium
DAADLLRWGWLITAIDDDDPPR

SEQ ID NO: 1260568 - protein, 17 aa, Mycobacterium
DAAEALIALGRHDDAEQ

SEQ ID NO: 1260569 - protein, 20 aa, Mycobacterium
DAAELRKRLAGVLENLPQAL

SEQ ID NO: 1260570 - protein, 21 aa, Mycobacterium
DAAGCRQIIDAAGKWVIPGML

SEQ ID NO: 1260571 - protein, 24 aa, Mycobacterium
DAAHAMPPWIGQGMCAGVRDVGNL

SEQ ID NO: 1260572 - protein, 17 aa, Mycobacterium
DAAIPDSRFRWVSIDLE

SEQ ID NO: 1260573 - protein, 30 aa, Mycobacterium
DAALAREFLLTWFVYTAWELADAKRLTGAG

SEQ ID NO: 1260574 - protein, 17 aa, Mycobacterium
DAALMCVYRHPMFNMVH

SEQ ID NO: 1260575 - protein, 20 aa, Mycobacterium
DAALRVIVEYQLSYPGLRMV

SEQ ID NO: 1260576 - protein, 23 aa, Mycobacterium
DAALVVGVGAWWHNWQPTDYDAL

SEQ ID NO: 1260577 - protein, 18 aa, Mycobacterium
DAANGWLPTDIHVRVYDS

SEQ ID NO: 1260578 - protein, 19 aa, Mycobacterium
DAAPEQRNLLGLIEANPEL

SEQ ID NO: 1260579 - protein, 24 aa, Mycobacterium
DAAPRYAEAGIRAIDLTPAAVGPG

SEQ ID NO: 1260580 - protein, 25 aa, Mycobacterium
DAAQRLGLVPLQWAVASLLADIGAD

SEQ ID NO: 1260581 - protein, 17 aa, Mycobacterium
DAARAAMIAAVLDKHAR

SEQ ID NO: 1260582 - protein, 25 aa, Mycobacterium
DAARAGGHPWWTLSQLDSGAGESTA

SEQ ID NO: 1260583 - protein, 20 aa, Mycobacterium
DAARELADWSADRGADYLDG

SEQ ID NO: 1260584 - protein, 17 aa, Mycobacterium
DAASESFVPPVLSGESS

SEQ ID NO: 1260585 - protein, 19 aa, Mycobacterium
DAASFARLDAPTGISASTD

SEQ ID NO: 1260586 - protein, 19 aa, Mycobacterium
DAASLAGLDSREKIPHVLR

SEQ ID NO: 1260587 - protein, 22 aa, Mycobacterium
DAAVALGRRVSFVGRSMVRNMG

SEQ ID NO: 1260588 - protein, 17 aa, Mycobacterium
DAAVARWIRLVCRPTQW

SEQ ID NO: 1260589 - protein, 18 aa, Mycobacterium
DAAVILKLGRSYPAVRQA

SEQ ID NO: 1260590 - protein, 25 aa, Mycobacterium
DAAVLPSHYEPFGIVALEAAATGTP

SEQ ID NO: 1260591 - protein, 18 aa, Mycobacterium
DAAVPPGFFAERQPPALL

SEQ ID NO: 1260592 - protein, 19 aa, Mycobacterium
DAAVPRWGKPEEMAELLAF

SEQ ID NO: 1260593 - protein, 17 aa, Mycobacterium
DAAVRFLREHGVDDGRA

SEQ ID NO: 1260594 - protein, 25 aa, Mycobacterium
DACRGGCMAAKFFTGLPMDGPDPEC

SEQ ID NO: 1260595 - protein, 19 aa, Mycobacterium
DADEGGYVQSARPVEGRVA

SEQ ID NO: 1260596 - protein, 27 aa, Mycobacterium
DADEHRRRIGMALARLRDPDDALQKVV

SEQ ID NO: 1260597 - protein, 18 aa, Mycobacterium
DADELIRWAGGFVTAPRQ

SEQ ID NO: 1260598 - protein, 24 aa, Mycobacterium
DADEVVDVVLLWWRDGDGDLVDTL

SEQ ID NO: 1260599 - protein, 18 aa, Mycobacterium
DADEWIRRLETPHAAVRP

SEQ ID NO: 1260600 - protein, 18 aa, Mycobacterium
DADFYICGPGPFMDTVEG

SEQ ID NO: 1260601 - protein, 17 aa, Mycobacterium
DADFYVCGPTPFMDTVE

SEQ ID NO: 1260602 - protein, 22 aa, Mycobacterium
DADGFLWILGRADQAIIRGGFK

SEQ ID NO: 1260603 - protein, 25 aa, Mycobacterium
DADGRLRIAAAVGINGDVGAKARDL

SEQ ID NO: 1260604 - protein, 26 aa, Mycobacterium
DADGSWYRAMLWDRYHQVPDHVPADR

SEQ ID NO: 1260605 - protein, 19 aa, Mycobacterium
DADGWGCQHALSAVSNLTV

SEQ ID NO: 1260606 - protein, 24 aa, Mycobacterium
DADKLTAPALIVWGSRDTAIPLPI

SEQ ID NO: 1260607 - protein, 22 aa, Mycobacterium
DADLGQRIIAFVVGDAQPDELI

SEQ ID NO: 1260608 - protein, 24 aa, Mycobacterium
DADLLAGELWNIFPNVTIPCNAGN

SEQ ID NO: 1260609 - protein, 24 aa, Mycobacterium
DADLRGVRALPVLILAGDVDAVVC

SEQ ID NO: 1260610 - protein, 24 aa, Mycobacterium
DADLSVPTAWLFGPEAHGLPADVA

SEQ ID NO: 1260611 - protein, 17 aa, Mycobacterium
DADLVFFFDRSELPRVV

SEQ ID NO: 1260612 - protein, 25 aa, Mycobacterium
DADMTLRAGDTWAAAVGTATGIDLP

SEQ ID NO: 1260613 - protein, 23 aa, Mycobacterium
DADPEMLRYFDAVGINLDSRLRV

SEQ ID NO: 1260614 - protein, 30 aa, Mycobacterium
DADPFPEFKEGLGLMLELPAPTTLGSVEVD

SEQ ID NO: 1260615 - protein, 31 aa, Mycobacterium
DADPPIWRRIDLRSDVTLDFVHQVLQVAFDW

SEQ ID NO: 1260616 - protein, 18 aa, Mycobacterium
DADRGFWAKLEGFNPGGM

SEQ ID NO: 1260617 - protein, 28 aa, Mycobacterium
DADVALLLRRLEHVPIATVVRLPGVDAA

SEQ ID NO: 1260618 - protein, 25 aa, Mycobacterium
DADVLPYLRWFTFLSADELVELEQA

SEQ ID NO: 1260619 - protein, 20 aa, Mycobacterium
DADVPYTRIHEFRHFHPERA

SEQ ID NO: 1260620 - protein, 23 aa, Mycobacterium
DADVVNYLRWFTFLEAGELGELE

SEQ ID NO: 1260621 - protein, 18 aa, Mycobacterium
DADYIWLACRTDPEAAKH

SEQ ID NO: 1260622 - protein, 23 aa, Mycobacterium
DAEALVYRIGRFGIDMLDTTPSM

SEQ ID NO: 1260623 - protein, 19 aa, Mycobacterium
DAEAPCWLCGSTTSYRVPT

SEQ ID NO: 1260624 - protein, 23 aa, Mycobacterium
DAEARWMLAFELIFTQFGDPLAG

SEQ ID NO: 1260625 - protein, 17 aa, Mycobacterium
DAEATWKSLLDGHSGIR

SEQ ID NO: 1260626 - protein, 27 aa, Mycobacterium
DAEFPRLRVGLAVGQAVSRAGDWFGSP

SEQ ID NO: 1260627 - protein, 22 aa, Mycobacterium
DAEFRVGTMGLGWDSEAQTVVV

SEQ ID NO: 1260628 - protein, 28 aa, Mycobacterium
DAEHHLVRYGGSFIPRIIERACGSYVYD

SEQ ID NO: 1260629 - protein, 23 aa, Mycobacterium
DAEKFLLSWLGFDLERAEARPVD

SEQ ID NO: 1260630 - protein, 23 aa, Mycobacterium
DAEKYRRLHVIVGDSNMSESTTM

SEQ ID NO: 1260631 - protein, 17 aa, Mycobacterium
DAELCGDVSRLAGWGNK

SEQ ID NO: 1260632 - protein, 21 aa, Mycobacterium
DAELLELADLVKVARQVRDSG

SEQ ID NO: 1260633 - protein, 23 aa, Mycobacterium
DAELPLADAVLMLRVQAERMNGG

SEQ ID NO: 1260634 - protein, 27 aa, Mycobacterium
DAELRIAQAQLVGWLEGLFHGIQTALF

SEQ ID NO: 1260635 - protein, 26 aa, Mycobacterium
DAEPFDAVVCSLVLCSVDKPEDVVAE

SEQ ID NO: 1260636 - protein, 17 aa, Mycobacterium
DAEQDRGLQFGFISDAA

SEQ ID NO: 1260637 - protein, 20 aa, Mycobacterium
DAEQYFRTALYGDPVEVTGT

SEQ ID NO: 1260638 - protein, 22 aa, Mycobacterium
DAERFKADWQGQHVPQLRQVVT

SEQ ID NO: 1260639 - protein, 23 aa, Mycobacterium
DAERIAMEFAHRFATEHTALRDD

SEQ ID NO: 1260640 - protein, 17 aa, Mycobacterium
DAERLRAAVGRRTDGYL

SEQ ID NO: 1260641 - protein, 19 aa, Mycobacterium
DAEVAGSWHIRRYGFHGTS

SEQ ID NO: 1260642 - protein, 31 aa, Mycobacterium
DAEVDRIWFAPNVWPREVPALQPLLTEYTAQ

SEQ ID NO: 1260643 - protein, 26 aa, Mycobacterium
DAEVEGRPGLALGWGATLGTVERRAI

SEQ ID NO: 1260644 - protein, 29 aa, Mycobacterium
DAEVPIELIWRCGRPPPGVVVRNERIDGD

SEQ ID NO: 1260645 - protein, 20 aa, Mycobacterium
DAFGGSLCHGLLQGWPLEKT

SEQ ID NO: 1260646 - protein, 27 aa, Mycobacterium
DAFGQWRTTPAPVRGALVARLGELLVE

SEQ ID NO: 1260647 - protein, 20 aa, Mycobacterium
DAFNALPMRRAVHAVFECCY

SEQ ID NO: 1260648 - protein, 18 aa, Mycobacterium
DAFQEFYHAPVLHANQSP

SEQ ID NO: 1260649 - protein, 23 aa, Mycobacterium
DAFRPGVADAMFAYHLAELERLA

SEQ ID NO: 1260650 - protein, 30 aa, Mycobacterium
DAFTRHLPKEFKRRGVQMLTEGKRTFAVMG

SEQ ID NO: 1260651 - protein, 18 aa, Mycobacterium
DAGAMLMLPFFNYAEGDH

SEQ ID NO: 1260652 - protein, 21 aa, Mycobacterium
DAGAVTLRLGGRGDVDLTTAD

SEQ ID NO: 1260653 - protein, 23 aa, Mycobacterium
DAGCPCLIVRPGTHSRFTGVAFR

SEQ ID NO: 1260654 - protein, 24 aa, Mycobacterium
DAGEICGLGHPIGVTATDDVDALI

SEQ ID NO: 1260655 - protein, 22 aa, Mycobacterium
DAGEIYKRFGGQIDPSVLVTLP

SEQ ID NO: 1260656 - protein, 22 aa, Mycobacterium
DAGESLPVMPPWHVQENKWRAA

SEQ ID NO: 1260657 - protein, 19 aa, Mycobacterium
DAGFCEKGKGMEFVSQHDL

SEQ ID NO: 1260658 - protein, 17 aa, Mycobacterium
DAGGATYWWFPPGTTPN

SEQ ID NO: 1260659 - protein, 22 aa, Mycobacterium
DAGHKGFSLLVVERGMPGFERG

SEQ ID NO: 1260660 - protein, 24 aa, Mycobacterium
DAGHLRLGDRADLVIVDPERLDDT

SEQ ID NO: 1260661 - protein, 25 aa, Mycobacterium
DAGHPRWVAADVMAGRLNQVGVAKA

SEQ ID NO: 1260662 - protein, 25 aa, Mycobacterium
DAGIPLRFQLLWYPSTTFDTSLPSF

SEQ ID NO: 1260663 - protein, 25 aa, Mycobacterium
DAGLLAGAVTLVWQAGEVRQVNELG

SEQ ID NO: 1260664 - protein, 20 aa, Mycobacterium
DAGLVLGGRVFRPLDVDLRW

SEQ ID NO: 1260665 - protein, 18 aa, Mycobacterium
DAGPGFCHINFQVGTLDD

SEQ ID NO: 1260666 - protein, 19 aa, Mycobacterium
DAGPLARHLRFLGQVDDAE

SEQ ID NO: 1260667 - protein, 20 aa, Mycobacterium
DAGQHWILRIEGWQQADCDA

SEQ ID NO: 1260668 - protein, 22 aa, Mycobacterium
DAGRKRPAGAVLVFTDEDGQTY

SEQ ID NO: 1260669 - protein, 25 aa, Mycobacterium
DAGSLRPGDLAVWDGHVAMVVGDGV

SEQ ID NO: 1260670 - protein, 22 aa, Mycobacterium
DAGSVPLQFLFSGTIFTQGERG

SEQ ID NO: 1260671 - protein, 20 aa, Mycobacterium
DAGSWTRHAVGTVKAAAGPA

SEQ ID NO: 1260672 - protein, 20 aa, Mycobacterium
DAGVELGQWVHDLRRPSRRA

SEQ ID NO: 1260673 - protein, 18 aa, Mycobacterium
DAGVKWPNDILVGTGKLA

SEQ ID NO: 1260674 - protein, 30 aa, Mycobacterium
DAGVLLASRRSWWRIAAVIDQSLRPVAPTR

SEQ ID NO: 1260675 - protein, 21 aa, Mycobacterium
DAHAPIGLVVRNRLSHAAAIA

SEQ ID NO: 1260676 - protein, 19 aa, Mycobacterium
DAHLEAVGFFETVQTAHGP

SEQ ID NO: 1260677 - protein, 17 aa, Mycobacterium
DAHLRRLYTDVKKLGSP

SEQ ID NO: 1260678 - protein, 18 aa, Mycobacterium
DAHLTVIGRDASPRLLAL

SEQ ID NO: 1260679 - protein, 22 aa, Mycobacterium
DAHMGMAIGIYGRDVRALQLVW

SEQ ID NO: 1260680 - protein, 22 aa, Mycobacterium
DAHPIPGHWLPNGCMATSGSLI

SEQ ID NO: 1260681 - protein, 24 aa, Mycobacterium
DAHRCFTDALGVAYTTGHRLDFAG

SEQ ID NO: 1260682 - protein, 17 aa, Mycobacterium
DAICDPGPATAYSEAGH

SEQ ID NO: 1260683 - protein, 28 aa, Mycobacterium
DAIGRLCTRGSAGLVPFSDRLAAEEWRS

SEQ ID NO: 1260684 - protein, 28 aa, Mycobacterium
DAILAKAIVMRAWLAGWNPVVDQYAVNH

SEQ ID NO: 1260685 - protein, 25 aa, Mycobacterium
DAILVRRPAHFDGIHFVQKQIGHLA

SEQ ID NO: 1260686 - protein, 26 aa, Mycobacterium
DAIPELIKPAAVEVFERYGVFSEREL

SEQ ID NO: 1260687 - protein, 17 aa, Mycobacterium
DAIRLLIIDGRLPVGAR

SEQ ID NO: 1260688 - protein, 33 aa, Mycobacterium
DAIRRLLDRISLGGAWDMVKGVFTGEADDILRE

SEQ ID NO: 1260689 - protein, 17 aa, Mycobacterium
DAIVALAPVLTEYAKGR

SEQ ID NO: 1260690 - protein, 21 aa, Mycobacterium
DAKALTGEWARAMTERARRHG

SEQ ID NO: 1260691 - protein, 31 aa, Mycobacterium
DAKIGYPPTRVWGVPAAGMWAHRLGDQRAKR

SEQ ID NO: 1260692 - protein, 20 aa, Mycobacterium
DAKPGHVLQLCFYADAIEAL

SEQ ID NO: 1260693 - protein, 19 aa, Mycobacterium
DAKPPVCKIMDYGKFKYET

SEQ ID NO: 1260694 - protein, 21 aa, Mycobacterium
DAKRMFACFDQPDLKAFFDVT

SEQ ID NO: 1260695 - protein, 18 aa, Mycobacterium
DALAEGILAAVKRLYLLG

SEQ ID NO: 1260696 - protein, 26 aa, Mycobacterium
DALEQTPIRSIMAFQLFIADETIGAI

SEQ ID NO: 1260697 - protein, 22 aa, Mycobacterium
DALGLQVCDVLSPVPSGPALDK

SEQ ID NO: 1260698 - protein, 18 aa, Mycobacterium
DALGRWLLARTADLSAEY

SEQ ID NO: 1260699 - protein, 21 aa, Mycobacterium
DALHFPWKINAGVTAVDLMLQ

SEQ ID NO: 1260700 - protein, 26 aa, Mycobacterium
DALHVRLGPFLAYWPAGLMLRCALQG

SEQ ID NO: 1260701 - protein, 25 aa, Mycobacterium
DALIDTCVREFGRIDILVNCAGTAE

SEQ ID NO: 1260702 - protein, 18 aa, Mycobacterium
DALITGWHSHDVHQIEYA

SEQ ID NO: 1260703 - protein, 24 aa, Mycobacterium
DALKSADASAVFAELIRAGLQQLI

SEQ ID NO: 1260704 - protein, 24 aa, Mycobacterium
DALKSILDRTPWRAEEVTVIVAPM

SEQ ID NO: 1260705 - protein, 17 aa, Mycobacterium
DALLALKPDVVVYNPMW

SEQ ID NO: 1260706 - protein, 36 aa, Mycobacterium
DALLAVPAHGWVNLHFSVLPAWRGAAPVQAALAAGD

SEQ ID NO: 1260707 - protein, 26 aa, Mycobacterium
DALLEWLPPRGMRGEFERFDGRAGGS

SEQ ID NO: 1260708 - protein, 25 aa, Mycobacterium
DALLLTLRTDRDWIADVVRFVASRR

SEQ ID NO: 1260709 - protein, 18 aa, Mycobacterium
DALLSRLIALLGGEPPEL

SEQ ID NO: 1260710 - protein, 20 aa, Mycobacterium
DALMKITHVLRGEDLLPSTP

SEQ ID NO: 1260711 - protein, 36 aa, Mycobacterium
DALPWYLAMACFKLAVVIEGTWSRYLAGRATREAGE

SEQ ID NO: 1260712 - protein, 20 aa, Mycobacterium
DALQSRGLYQYKPAMPYTPG

SEQ ID NO: 1260713 - protein, 17 aa, Mycobacterium
DALRGILVVSFVDRDLD

SEQ ID NO: 1260714 - protein, 30 aa, Mycobacterium
DALRLPECKVEVWAGFVFINMDPDAVPLTE

SEQ ID NO: 1260715 - protein, 24 aa, Mycobacterium
DALRPKWLFGATVHEGCDRAGYYE

SEQ ID NO: 1260716 - protein, 23 aa, Mycobacterium
DALRPTAKFYEEVRVWMAKFDAN

SEQ ID NO: 1260717 - protein, 21 aa, Mycobacterium
DALRRAGWRNYSLFVHPEDGL

SEQ ID NO: 1260718 - protein, 26 aa, Mycobacterium
DALSKARFEFRWEDQFNLSLDPDTAR

SEQ ID NO: 1260719 - protein, 24 aa, Mycobacterium
DALSRARAAGVCFGVGDEHDAVPE

SEQ ID NO: 1260720 - protein, 17 aa, Mycobacterium
DALSVLVRLLASLHDDD

SEQ ID NO: 1260721 - protein, 21 aa, Mycobacterium
DALTDWAVGLWDVYHRHPWIL

SEQ ID NO: 1260722 - protein, 17 aa, Mycobacterium
DALTRARIHGVRTNRDL

SEQ ID NO: 1260723 - protein, 27 aa, Mycobacterium
DALTRLSMRTLLLDLWREHGFGVLLVT

SEQ ID NO: 1260724 - protein, 19 aa, Mycobacterium
DALVRKAVLGLLDVDLLAA

SEQ ID NO: 1260725 - protein, 21 aa, Mycobacterium
DAMAARTRFFDDFFAEAMRAG

SEQ ID NO: 1260726 - protein, 24 aa, Mycobacterium
DAMARIRSEFGWLDSCFANAGVRG

SEQ ID NO: 1260727 - protein, 17 aa, Mycobacterium
DAMGLYFELIAQRREDP

SEQ ID NO: 1260728 - protein, 25 aa, Mycobacterium
DAMVYLCGPSGRYLTGATLPLDAGQ

SEQ ID NO: 1260729 - protein, 18 aa, Mycobacterium
DANFGWSARDACYAYGSF

SEQ ID NO: 1260730 - protein, 26 aa, Mycobacterium
DANGVRRWLALDGQPLHRVTVAASEL

SEQ ID NO: 1260731 - protein, 24 aa, Mycobacterium
DANSRIVAFVGRIQPLKAPDVLLR

SEQ ID NO: 1260732 - protein, 22 aa, Mycobacterium
DAPELVIPFLVPDGAHDYPDDT

SEQ ID NO: 1260733 - protein, 19 aa, Mycobacterium
DAPGCKRVLFSNDYYPAIA

SEQ ID NO: 1260734 - protein, 26 aa, Mycobacterium
DAPHPAAARLWQEFLYSDEGQNLYLG

SEQ ID NO: 1260735 - protein, 17 aa, Mycobacterium
DAPKRLGSFMDSRLWRM

SEQ ID NO: 1260736 - protein, 18 aa, Mycobacterium
DAPKRLGSFMDSRLWRML

SEQ ID NO: 1260737 - protein, 35 aa, Mycobacterium
DAPLLPGQCKALARRVPLGLARTGTTGSHFSGDIF

SEQ ID NO: 1260738 - protein, 20 aa, Mycobacterium
DAPLRIECIDISHVQGTDVV

SEQ ID NO: 1260739 - protein, 18 aa, Mycobacterium
DAPLSFPIPGWNVCVDFQ

SEQ ID NO: 1260740 - protein, 23 aa, Mycobacterium
DAPMPDDSFIVFGYSQSAVIASL

SEQ ID NO: 1260741 - protein, 18 aa, Mycobacterium
DAPMSEEILRFERTLAKA

SEQ ID NO: 1260742 - protein, 20 aa, Mycobacterium
DAPPAYAAVVERVRRAVALG

SEQ ID NO: 1260743 - protein, 21 aa, Mycobacterium
DAPPEFAYWQFGGIGVCQLIA

SEQ ID NO: 1260744 - protein, 21 aa, Mycobacterium
DAPTCPVALAFPEGAQSPLVE

SEQ ID NO: 1260745 - protein, 23 aa, Mycobacterium
DAPVVGPLIRRSTVVIRYTGRRS

SEQ ID NO: 1260746 - protein, 18 aa, Mycobacterium
DAPWKDIEAQGWIAPAEC

SEQ ID NO: 1260747 - protein, 23 aa, Mycobacterium
DAQIYLCGNNGFVQAVRAQLLDR

SEQ ID NO: 1260748 - protein, 26 aa, Mycobacterium
DAQLDWPLTESLRYPTALVDDFDWAR

SEQ ID NO: 1260749 - protein, 28 aa, Mycobacterium
DAQPLVRLRVPFSLKRIDIDDVERGSQD

SEQ ID NO: 1260750 - protein, 20 aa, Mycobacterium
DAQQAEWRRGSLPPGRLGWR

SEQ ID NO: 1260751 - protein, 24 aa, Mycobacterium
DAQQATWDRLWPELGRQVRDGDAP

SEQ ID NO: 1260752 - protein, 23 aa, Mycobacterium
DAQRRTAIFGGFLSSAAVRRQAV

SEQ ID NO: 1260753 - protein, 19 aa, Mycobacterium
DARAWLRDPAPLFRTNVDG

SEQ ID NO: 1260754 - protein, 24 aa, Mycobacterium
DARFEPRLRGPREFDRTPPRFGGL

SEQ ID NO: 1260755 - protein, 20 aa, Mycobacterium
DARIGRRFLNAGLGFGGGCL

SEQ ID NO: 1260756 - protein, 19 aa, Mycobacterium
DARPDGVSLAERFGTLLDE

SEQ ID NO: 1260757 - protein, 24 aa, Mycobacterium
DARVDASMVLYLFGSKEQLFREAL

SEQ ID NO: 1260758 - protein, 28 aa, Mycobacterium
DASAPFEIKIQNWEGVAAEAAYIKFKSF

SEQ ID NO: 1260759 - protein, 22 aa, Mycobacterium
DASDPLAGLAARDVADVLAHNR

SEQ ID NO: 1260760 - protein, 25 aa, Mycobacterium
DASELRAALVSARREAASAFGDDTL

SEQ ID NO: 1260761 - protein, 23 aa, Mycobacterium
DASFRSAGHLGFDDLIHPEETRD

SEQ ID NO: 1260762 - protein, 25 aa, Mycobacterium
DASKRWVTVAFTWTGLRALGVPPHA

SEQ ID NO: 1260763 - protein, 28 aa, Mycobacterium
DASPVRWPERLRPALSTVGFATELRDLM

SEQ ID NO: 1260764 - protein, 17 aa, Mycobacterium
DASSFPSGGLRSTFEAR

SEQ ID NO: 1260765 - protein, 25 aa, Mycobacterium
DATLFPRANSWYMGANVPGKPRVFM

SEQ ID NO: 1260766 - protein, 19 aa, Mycobacterium
DATLTWGQDPYRYPRNLPI

SEQ ID NO: 1260767 - protein, 22 aa, Mycobacterium
DATNPKGLWRRTTLESYLTEKP

SEQ ID NO: 1260768 - protein, 21 aa, Mycobacterium
DATSMGEAGATGGKGGNGGNG

SEQ ID NO: 1260769 - protein, 19 aa, Mycobacterium
DATVPWSITHPNLRVTVIE

SEQ ID NO: 1260770 - protein, 17 aa, Mycobacterium
DATVTWTRLEVVDSVAG

SEQ ID NO: 1260771 - protein, 19 aa, Mycobacterium
DAVAHARATVAIRSLSAAE

SEQ ID NO: 1260772 - protein, 26 aa, Mycobacterium
DAVLAWQAARCVARWDGAAKVDKGLR

SEQ ID NO: 1260773 - protein, 20 aa, Mycobacterium
DAVLCAYVGLYWYHRPEDVT

SEQ ID NO: 1260774 - protein, 24 aa, Mycobacterium
DAVLPSFLEFCRGAVLVAHNAGFD

SEQ ID NO: 1260775 - protein, 20 aa, Mycobacterium
DAVLYTRAGPEIGVASTKTF

SEQ ID NO: 1260776 - protein, 23 aa, Mycobacterium
DAVMKLAPVLAELVKDVPGVEVV

SEQ ID NO: 1260777 - protein, 17 aa, Mycobacterium
DAVPGCIPFDRTTDPEP

SEQ ID NO: 1260778 - protein, 19 aa, Mycobacterium
DAVRLARAIGVIYLPATER

SEQ ID NO: 1260779 - protein, 17 aa, Mycobacterium
DAVSGFVDRMMGRRRGF

SEQ ID NO: 1260780 - protein, 23 aa, Mycobacterium
DAVSRKRLAAAYVSAPHHDPETY

SEQ ID NO: 1260781 - protein, 22 aa, Mycobacterium
DAVTAVHLKGHFATMKHAAAYW

SEQ ID NO: 1260782 - protein, 17 aa, Mycobacterium
DAVTIVFDPPNGCDVGY

SEQ ID NO: 1260783 - protein, 18 aa, Mycobacterium
DAVTRLVGLTGITFTNVF

SEQ ID NO: 1260784 - protein, 23 aa, Mycobacterium
DAWFYLDELEAIIREWIAVIYHH

SEQ ID NO: 1260785 - protein, 18 aa, Mycobacterium
DAWGLPTGATEEWAGGTA

SEQ ID NO: 1260786 - protein, 17 aa, Mycobacterium
DAWHQAQNPYGMGMPDQ

SEQ ID NO: 1260787 - protein, 25 aa, Mycobacterium
DAWLDSWRALGRDGAAMDRVNPVYT

SEQ ID NO: 1260788 - protein, 21 aa, Mycobacterium
DAYARIGALVFDVTVEMVESL

SEQ ID NO: 1260789 - protein, 24 aa, Mycobacterium
DAYARRILGWRVASTMATTMVLDS

SEQ ID NO: 1260790 - protein, 19 aa, Mycobacterium
DAYRYWTRDAIIADIDARR

SEQ ID NO: 1260791 - protein, 18 aa, Mycobacterium
DAYSHYDGIVAFSQTDFT

SEQ ID NO: 1260792 - protein, 20 aa, Mycobacterium
DAYSVGLGMLERVNHAQTMA

SEQ ID NO: 1260793 - protein, 30 aa, Mycobacterium
DAYVFRCANLYLRYEVANCHSSRGNYERGV

SEQ ID NO: 1260794 - protein, 22 aa, Mycobacterium
DCAHGAASLAAPRAYRAAGANV

SEQ ID NO: 1260795 - protein, 24 aa, Mycobacterium
DCAREVAEVVAPLLGWSAEDVDRE

SEQ ID NO: 1260796 - protein, 27 aa, Mycobacterium
DCDQLMPPYLRFVKGVVDAQDMSLNVS

SEQ ID NO: 1260797 - protein, 25 aa, Mycobacterium
DCEAPMEIVGRFLALLELYRARAVA

SEQ ID NO: 1260798 - protein, 22 aa, Mycobacterium
DCEGKILLPGFVDLHTHLREPG

SEQ ID NO: 1260799 - protein, 18 aa, Mycobacterium
DCGAGLFQPGARGVLSTV

SEQ ID NO: 1260800 - protein, 25 aa, Mycobacterium
DCIRCLRPTLDARIAFCEQSSPNLR

SEQ ID NO: 1260801 - protein, 28 aa, Mycobacterium
DCLGSPWEALAWLAATSLEYGAPLRSGD

SEQ ID NO: 1260802 - protein, 21 aa, Mycobacterium
DCLIGVALPKPGVTSNVIVDT

SEQ ID NO: 1260803 - protein, 17 aa, Mycobacterium
DCPPGLLMSLGFAPQWV

SEQ ID NO: 1260804 - protein, 18 aa, Mycobacterium
DCQELMLAAYDDQFARAL

SEQ ID NO: 1260805 - protein, 23 aa, Mycobacterium
DCRLSADDSDLWAAVGDVEYHRH

SEQ ID NO: 1260806 - protein, 29 aa, Mycobacterium
DCRTPTIASVHGWCIGGGVDLISAVDIRY

SEQ ID NO: 1260807 - protein, 25 aa, Mycobacterium
DCSGLTRFAFAGVGMLLPRWSGDQY

SEQ ID NO: 1260808 - protein, 23 aa, Mycobacterium
DCTGLLPLASVAAMQGRIAMYHA

SEQ ID NO: 1260809 - protein, 19 aa, Mycobacterium
DCTSAGWALIELVEAGSRT

SEQ ID NO: 1260810 - protein, 18 aa, Mycobacterium
DCVHIGRSQVGVVTSGIR

SEQ ID NO: 1260811 - protein, 21 aa, Mycobacterium
DCVSCGVEAELYSGGRCQRCV

SEQ ID NO: 1260812 - protein, 20 aa, Mycobacterium
DCWVAIAVATDAHWAGLCQA

SEQ ID NO: 1260813 - protein, 25 aa, Mycobacterium
DDADFNAALPLAAMMACVMSGQSCI

SEQ ID NO: 1260814 - protein, 24 aa, Mycobacterium
DDAEVYLCGGNGFVQAVRAQLQER

SEQ ID NO: 1260815 - protein, 25 aa, Mycobacterium
DDAFVWPESMPQWFTEDDLDFYVNE

SEQ ID NO: 1260816 - protein, 20 aa, Mycobacterium
DDAGRLIGTHGFYVDITPTD

SEQ ID NO: 1260817 - protein, 19 aa, Mycobacterium
DDAHAWAAAVNDVRLALGT

SEQ ID NO: 1260818 - protein, 18 aa, Mycobacterium
DDALHLIEVPALAISSTD

SEQ ID NO: 1260819 - protein, 27 aa, Mycobacterium
DDALLSVCELHIRLAASLVQVSTPVLD

SEQ ID NO: 1260820 - protein, 21 aa, Mycobacterium
DDALPRLAVAAPEPSRFGAYA

SEQ ID NO: 1260821 - protein, 20 aa, Mycobacterium
DDAMQLCLVQMYLADERFTR

SEQ ID NO: 1260822 - protein, 17 aa, Mycobacterium
DDARFAQRLADARIRTD

SEQ ID NO: 1260823 - protein, 23 aa, Mycobacterium
DDARLGPPLRIVVTTARSLLQPM

SEQ ID NO: 1260824 - protein, 34 aa, Mycobacterium
DDARRAWSCVVNAFLHPTMERFLYSAERRLQAYK

SEQ ID NO: 1260825 - protein, 18 aa, Mycobacterium
DDAWLARWSRAEAAVPHP

SEQ ID NO: 1260826 - protein, 19 aa, Mycobacterium
DDAYRAWREQPLEARVDVV

SEQ ID NO: 1260827 - protein, 23 aa, Mycobacterium
DDDDLTCAIVLTRLVRSELEAFG

SEQ ID NO: 1260828 - protein, 18 aa, Mycobacterium
DDDGYFWFVGRADDVIKS

SEQ ID NO: 1260829 - protein, 19 aa, Mycobacterium
DDDIDVELIYKCPRPPTGI

SEQ ID NO: 1260830 - protein, 30 aa, Mycobacterium
DDDSAWASADWRLRRGRIVLLDGDSPAGLR

SEQ ID NO: 1260831 - protein, 24 aa, Mycobacterium
DDDWPRALTAAGFDHTEPTVWAAE

SEQ ID NO: 1260832 - protein, 20 aa, Mycobacterium
DDEDHAAPPMTGFSVRTLRS

SEQ ID NO: 1260833 - protein, 27 aa, Mycobacterium
DDEIRRWLPEFAEPAVLREVTGPLSDT

SEQ ID NO: 1260834 - protein, 26 aa, Mycobacterium
DDELATSAHFVWPRETLRLGEKYPLK

SEQ ID NO: 1260835 - protein, 23 aa, Mycobacterium
DDERFASAVVRFGNRKDCIAELR

SEQ ID NO: 1260836 - protein, 23 aa, Mycobacterium
DDERLRRIAVFDVLVNNADRKGG

SEQ ID NO: 1260837 - protein, 24 aa, Mycobacterium
DDEYLRTPRGWRFHGRALTINAIE

SEQ ID NO: 1260838 - protein, 18 aa, Mycobacterium
DDFALAYAVRLCDTDAYE

SEQ ID NO: 1260839 - protein, 23 aa, Mycobacterium
DDFGMCLRAFVVPAAGADIDADQ

SEQ ID NO: 1260840 - protein, 17 aa, Mycobacterium
DDFHDFAARLDVHDVTT

SEQ ID NO: 1260841 - protein, 23 aa, Mycobacterium
DDFRTEQRWPLYSAAAAELGVLS

SEQ ID NO: 1260842 - protein, 19 aa, Mycobacterium
DDGDHLVCTGSKIWTTHAR

SEQ ID NO: 1260843 - protein, 17 aa, Mycobacterium
DDGFVAAVHRWASTGDL

SEQ ID NO: 1260844 - protein, 27 aa, Mycobacterium
DDGGPWPDRRAAVVCFDRGANATYKCV

SEQ ID NO: 1260845 - protein, 19 aa, Mycobacterium
DDGHLRFSVDRDDLDRVMA

SEQ ID NO: 1260846 - protein, 18 aa, Mycobacterium
DDGIFCCAHCARKDTNAD

SEQ ID NO: 1260847 - protein, 25 aa, Mycobacterium
DDGIGLDEYVDWLIDAGHPIRRVGD

SEQ ID NO: 1260848 - protein, 25 aa, Mycobacterium
DDGLLRRRPSGFFPAPGLDPHPAVD

SEQ ID NO: 1260849 - protein, 23 aa, Mycobacterium
DDGPVALALVKRGLPADTPLTTG

SEQ ID NO: 1260850 - protein, 18 aa, Mycobacterium
DDGPVKPVRIWDRTGRRP

SEQ ID NO: 1260851 - protein, 25 aa, Mycobacterium
DDGRNGDAPKVWIGDTGFSTDHARH

SEQ ID NO: 1260852 - protein, 22 aa, Mycobacterium
DDGRWQDEWLYARAYTIAGGSS

SEQ ID NO: 1260853 - protein, 24 aa, Mycobacterium
DDGRYRLGDQLTFVAQLESRARSL

SEQ ID NO: 1260854 - protein, 19 aa, Mycobacterium
DDGTWTWRYDSFRKGDGFE

SEQ ID NO: 1260855 - protein, 28 aa, Mycobacterium
DDGTWTWRYDSIRTGEGFENLWDDVPRL

SEQ ID NO: 1260856 - protein, 25 aa, Mycobacterium
DDGWRLRTRAMTFIRRSGEHDSGRP

SEQ ID NO: 1260857 - protein, 22 aa, Mycobacterium
DDHRRAAALMALRSYGDPSSVV

SEQ ID NO: 1260858 - protein, 21 aa, Mycobacterium
DDHRSVMHFEWTDDPRWLIYL

SEQ ID NO: 1260859 - protein, 23 aa, Mycobacterium
DDHTIGWADFRGNLQYISTGNVN

SEQ ID NO: 1260860 - protein, 27 aa, Mycobacterium
DDIAPICQMFHTMPRPWVEVEDITNAV

SEQ ID NO: 1260861 - protein, 19 aa, Mycobacterium
DDIDPAWFDGVTTVGVTSG

SEQ ID NO: 1260862 - protein, 17 aa, Mycobacterium
DDINAQLDVPVTINING

SEQ ID NO: 1260863 - protein, 17 aa, Mycobacterium
DDITVLLLRGADGVFST

SEQ ID NO: 1260864 - protein, 21 aa, Mycobacterium
DDKWRSIKAPVMIVASGKDHG

SEQ ID NO: 1260865 - protein, 22 aa, Mycobacterium
DDLDSWRAAVRPNTKAFFGETI

SEQ ID NO: 1260866 - protein, 26 aa, Mycobacterium
DDLEFALRLGVDLVALSFVRSPADVE

SEQ ID NO: 1260867 - protein, 23 aa, Mycobacterium
DDLESWRAAARPNTKAFFGETIS

SEQ ID NO: 1260868 - protein, 19 aa, Mycobacterium
DDLIPFAIVKGQRFKQLLV

SEQ ID NO: 1260869 - protein, 17 aa, Mycobacterium
DDLLLVAGMRVSQRARF

SEQ ID NO: 1260870 - protein, 17 aa, Mycobacterium
DDLLRAIYRLRALGDEF

SEQ ID NO: 1260871 - protein, 18 aa, Mycobacterium
DDLLRWCQKRRITFTRSR

SEQ ID NO: 1260872 - protein, 26 aa, Mycobacterium
DDLPCANGITVHRGRLFVGECRDGGR

SEQ ID NO: 1260873 - protein, 23 aa, Mycobacterium
DDLPRLARTALQDACMSTNPRPA

SEQ ID NO: 1260874 - protein, 28 aa, Mycobacterium
DDLQLPRALPWAVLPVFARNTVRYQVLS

SEQ ID NO: 1260875 - protein, 17 aa, Mycobacterium
DDLRIAVDGGFLSVTEE

SEQ ID NO: 1260876 - protein, 19 aa, Mycobacterium
DDLRLVGARVYSDDKDGTD

SEQ ID NO: 1260877 - protein, 23 aa, Mycobacterium
DDLWRSRLPKRLAELTPHAEKDP

SEQ ID NO: 1260878 - protein, 26 aa, Mycobacterium
DDMARAQLEAGFGLRTLIHMDDPHHR

SEQ ID NO: 1260879 - protein, 18 aa, Mycobacterium
DDMFAGPTAIAFINGEPV

SEQ ID NO: 1260880 - protein, 28 aa, Mycobacterium
DDMFLPPDVLDWPLNVVVVRTGGQTILV

SEQ ID NO: 1260881 - protein, 24 aa, Mycobacterium
DDNEILGLCFMFVLAGLDTVTSAV

SEQ ID NO: 1260882 - protein, 20 aa, Mycobacterium
DDNFVFPSGMLLVFEPVVWE

SEQ ID NO: 1260883 - protein, 20 aa, Mycobacterium
DDNWSLKVSGGWPDDPEEDV

SEQ ID NO: 1260884 - protein, 23 aa, Mycobacterium
DDNYRAIASLVDRPPHTVMHGDA

SEQ ID NO: 1260885 - protein, 17 aa, Mycobacterium
DDNYSLRGKKAAIIGTG

SEQ ID NO: 1260886 - protein, 25 aa, Mycobacterium
DDPAFTGWHRLEYLLFSQNTTEGGA

SEQ ID NO: 1260887 - protein, 26 aa, Mycobacterium
DDPASDWARYALRAPVMLVHSPDPTP

SEQ ID NO: 1260888 - protein, 23 aa, Mycobacterium
DDPAWSLQCDIARQVLALDGIPA

SEQ ID NO: 1260889 - protein, 26 aa, Mycobacterium
DDPDLRFELCLGVSGVHYPDDADREL

SEQ ID NO: 1260890 - protein, 24 aa, Mycobacterium
DDPEWLRWNYATVVWGIATAHELY

SEQ ID NO: 1260891 - protein, 17 aa, Mycobacterium
DDPGTWTEPGVRHLAAD

SEQ ID NO: 1260892 - protein, 20 aa, Mycobacterium
DDPKTIPFVPFIGGSGPNPL

SEQ ID NO: 1260893 - protein, 27 aa, Mycobacterium
DDPPFEGMWWLYVPMAFDDFGIVIIIQ

SEQ ID NO: 1260894 - protein, 19 aa, Mycobacterium
DDPRTTLAYINDNRRRIKS

SEQ ID NO: 1260895 - protein, 23 aa, Mycobacterium
DDPTCPEWEPITAALNTELGNGW

SEQ ID NO: 1260896 - protein, 26 aa, Mycobacterium
DDPVHPLEVGMEWVSAAPCAALRTVT

SEQ ID NO: 1260897 - protein, 21 aa, Mycobacterium
DDPWCRYLAANAGVVVVNPDY

SEQ ID NO: 1260898 - protein, 21 aa, Mycobacterium
DDQDFTAWLALFATECAYEVR

SEQ ID NO: 1260899 - protein, 24 aa, Mycobacterium
DDQRRWRAELGRYVLAVGGIEPRK

SEQ ID NO: 1260900 - protein, 19 aa, Mycobacterium
DDRAPFGILEMKSAFVTDD

SEQ ID NO: 1260901 - protein, 17 aa, Mycobacterium
DDRAYVCVAAESHDAVC

SEQ ID NO: 1260902 - protein, 17 aa, Mycobacterium
DDRCGPVLVDWLNDRGI

SEQ ID NO: 1260903 - protein, 24 aa, Mycobacterium
DDREFAYGVLRGWLHTLRDRLTVE

SEQ ID NO: 1260904 - protein, 18 aa, Mycobacterium
DDRGRLRMQAFLLQAHKE

SEQ ID NO: 1260905 - protein, 17 aa, Mycobacterium
DDRGRPVTRTVLCKSVD

SEQ ID NO: 1260906 - protein, 21 aa, Mycobacterium
DDRHPIELAHRISDLMPAAQV

SEQ ID NO: 1260907 - protein, 21 aa, Mycobacterium
DDRIALRQARAIREVGVHVVV

SEQ ID NO: 1260908 - protein, 25 aa, Mycobacterium
DDRPVEFWPTAAIRAALENDDLAVW

SEQ ID NO: 1260909 - protein, 22 aa, Mycobacterium
DDRREGFPHWNEHMLSTVDKRP

SEQ ID NO: 1260910 - protein, 19 aa, Mycobacterium
DDRRFGFGIVTSSDVYYQG

SEQ ID NO: 1260911 - protein, 17 aa, Mycobacterium
DDRRLTGRIARPVIWGR

SEQ ID NO: 1260912 - protein, 19 aa, Mycobacterium
DDRRSFLIRIGRPGRNFLR

SEQ ID NO: 1260913 - protein, 19 aa, Mycobacterium
DDRVAIIAVDYAQRRRLKI

SEQ ID NO: 1260914 - protein, 23 aa, Mycobacterium
DDRVYKRGALTLHALRNHIGDTE

SEQ ID NO: 1260915 - protein, 25 aa, Mycobacterium
DDRVYKRGALTLHVLRTRIGDEKFF

SEQ ID NO: 1260916 - protein, 17 aa, Mycobacterium
DDSLGMRRVEVLCANCH

SEQ ID NO: 1260917 - protein, 19 aa, Mycobacterium
DDTAVAFARQVQTGQLDIN

SEQ ID NO: 1260918 - protein, 24 aa, Mycobacterium
DDTEWRTEYLYSRAATIYGGTAEV

SEQ ID NO: 1260919 - protein, 24 aa, Mycobacterium
DDTLPMLTGIRVEISGEKVVLAAT

SEQ ID NO: 1260920 - protein, 22 aa, Mycobacterium
DDTPWGGKPVKRLELPRDATLV

SEQ ID NO: 1260921 - protein, 19 aa, Mycobacterium
DDTVRRWIDDGSLAASADA

SEQ ID NO: 1260922 - protein, 18 aa, Mycobacterium
DDTVRRWIDSGSLPSYKD

SEQ ID NO: 1260923 - protein, 17 aa, Mycobacterium
DDTWKGPGRPLSSGYAE

SEQ ID NO: 1260924 - protein, 24 aa, Mycobacterium
DDVALRFLVTMICAPGVPMLVIVD

SEQ ID NO: 1260925 - protein, 19 aa, Mycobacterium
DDVDYCCMPLFHGNAIMAL

SEQ ID NO: 1260926 - protein, 19 aa, Mycobacterium
DDVEPAWRHATAAGNLKRV

SEQ ID NO: 1260927 - protein, 26 aa, Mycobacterium
DDVIRARTSLLATIVRPGLLTDDEPT

SEQ ID NO: 1260928 - protein, 23 aa, Mycobacterium
DDVKPRLLGHWGTTPGLNFLYAH

SEQ ID NO: 1260929 - protein, 17 aa, Mycobacterium
DDVLTVRYCRGAGDDGV

SEQ ID NO: 1260930 - protein, 33 aa, Mycobacterium
DDVPDHRRWLNAHVPFYANWIRLKSFWGTADNN

SEQ ID NO: 1260931 - protein, 21 aa, Mycobacterium
DDVPFRSFHFIYGLKSLEVTW

SEQ ID NO: 1260932 - protein, 25 aa, Mycobacterium
DDVVARCLVLWAALVGAISLEVFGQ

SEQ ID NO: 1260933 - protein, 23 aa, Mycobacterium
DDVYARAAAVFSDRELGQVIAMV

SEQ ID NO: 1260934 - protein, 23 aa, Mycobacterium
DDVYWCTADPGWVTGMSYGVIAP

SEQ ID NO: 1260935 - protein, 24 aa, Mycobacterium
DDWARHNWIPFGRFRGLDKVRTVH

SEQ ID NO: 1260936 - protein, 19 aa, Mycobacterium
DDWFWIKVPVGYLYTIANP

SEQ ID NO: 1260937 - protein, 19 aa, Mycobacterium
DDYCRAHGLLDAAPPRHPA

SEQ ID NO: 1260938 - protein, 19 aa, Mycobacterium
DDYLRFARMLLAGGEVDGV

SEQ ID NO: 1260939 - protein, 17 aa, Mycobacterium
DDYTAWRLLEGLDDIGL

SEQ ID NO: 1260940 - protein, 17 aa, Mycobacterium
DEAAGLVRALLTADRNQ

SEQ ID NO: 1260941 - protein, 23 aa, Mycobacterium
DEACCPPGALLREPLSAAEAADM

SEQ ID NO: 1260942 - protein, 23 aa, Mycobacterium
DEAEILSRIALVLYGIGYDADPA

SEQ ID NO: 1260943 - protein, 25 aa, Mycobacterium
DEAFDRWKGLGARFVEARPMTQLHW

SEQ ID NO: 1260944 - protein, 19 aa, Mycobacterium
DEAFPRFSTVRTPRTDCAV

SEQ ID NO: 1260945 - protein, 17 aa, Mycobacterium
DEAHRAGAVLAEEAKTI

SEQ ID NO: 1260946 - protein, 24 aa, Mycobacterium
DEAKAICRSCPRRWLCAREACESP

SEQ ID NO: 1260947 - protein, 21 aa, Mycobacterium
DEAKLVFGGEALIVAGGADRT

SEQ ID NO: 1260948 - protein, 19 aa, Mycobacterium
DEALIRMDLAEMLRDEGYE

SEQ ID NO: 1260949 - protein, 17 aa, Mycobacterium
DEALPLGYSIAGEVVEV

SEQ ID NO: 1260950 - protein, 17 aa, Mycobacterium
DEALSLPSKHEYGNGVA

SEQ ID NO: 1260951 - protein, 20 aa, Mycobacterium
DEALVPLVLAGTSHRETPRL

SEQ ID NO: 1260952 - protein, 17 aa, Mycobacterium
DEAMAGFATKVDVRILE

SEQ ID NO: 1260953 - protein, 21 aa, Mycobacterium
DEANPALGVRGVRIAANNPGL

SEQ ID NO: 1260954 - protein, 21 aa, Mycobacterium
DEAQAIWYLQDRVIAPDFNFM

SEQ ID NO: 1260955 - protein, 21 aa, Mycobacterium
DEARDKFGFLLDAFTFGAPPH

SEQ ID NO: 1260956 - protein, 19 aa, Mycobacterium
DEARIERLIAHFREVVDAL

SEQ ID NO: 1260957 - protein, 22 aa, Mycobacterium
DEARIQTFVPILVEHIVNNRIH

SEQ ID NO: 1260958 - protein, 25 aa, Mycobacterium
DEARPRAGILRGREFLMKDSYSFDI

SEQ ID NO: 1260959 - protein, 25 aa, Mycobacterium
DEARSAGLPDVFAHGMLSMAYLGRL

SEQ ID NO: 1260960 - protein, 18 aa, Mycobacterium
DEASALSVRNLPGVHVIS

SEQ ID NO: 1260961 - protein, 18 aa, Mycobacterium
DEATSILGSAAWTGHEGQ

SEQ ID NO: 1260962 - protein, 20 aa, Mycobacterium
DECPGAGMIAGIGRVSGREC

SEQ ID NO: 1260963 - protein, 17 aa, Mycobacterium
DECRQAKERLSADTATA

SEQ ID NO: 1260964 - protein, 24 aa, Mycobacterium
DEDRELLESFDLTYGEDEGGEEDL

SEQ ID NO: 1260965 - protein, 25 aa, Mycobacterium
DEDSGRLLGFHWTKVHSATLGEVYV

SEQ ID NO: 1260966 - protein, 21 aa, Mycobacterium
DEDSLRLNVWAPSGSAAGDGK

SEQ ID NO: 1260967 - protein, 19 aa, Mycobacterium
DEDTLRWTVTTDTGTVVNA

SEQ ID NO: 1260968 - protein, 18 aa, Mycobacterium
DEDWPVDRYPIAAGNHGA

SEQ ID NO: 1260969 - protein, 26 aa, Mycobacterium
DEEIDWSAGDSFVVPNWMWHAHMNRS

SEQ ID NO: 1260970 - protein, 18 aa, Mycobacterium
DEEIGAFLILLASAGNDT

SEQ ID NO: 1260971 - protein, 24 aa, Mycobacterium
DEERSEGVLGWLHSVARSHVEVAL

SEQ ID NO: 1260972 - protein, 23 aa, Mycobacterium
DEESRLLTRELFYTAVTRAKAKV

SEQ ID NO: 1260973 - protein, 23 aa, Mycobacterium
DEEWGEVVVAFIVGAASAADLDA

SEQ ID NO: 1260974 - protein, 18 aa, Mycobacterium
DEFAELWKQHLVGTAHEL

SEQ ID NO: 1260975 - protein, 18 aa, Mycobacterium
DEFCRAVGHPGVYAVGDV

SEQ ID NO: 1260976 - protein, 20 aa, Mycobacterium
DEFGEAIAASAPLRRIGRDD

SEQ ID NO: 1260977 - protein, 17 aa, Mycobacterium
DEFQRLRQRAGLRRIHL

SEQ ID NO: 1260978 - protein, 20 aa, Mycobacterium
DEFQVELNFMYDRADLTADR

SEQ ID NO: 1260979 - protein, 20 aa, Mycobacterium
DEFRARLAGGKEDLDDVMPE

SEQ ID NO: 1260980 - protein, 20 aa, Mycobacterium
DEFRPLKALAARMPCAYANP

SEQ ID NO: 1260981 - protein, 19 aa, Mycobacterium
DEFTLPMDIGKAIDERIRR

SEQ ID NO: 1260982 - protein, 24 aa, Mycobacterium
DEFVWDRRIERLLAFGRGQHFCLG

SEQ ID NO: 1260983 - protein, 18 aa, Mycobacterium
DEFWCQGFSEPGAGSDLS

SEQ ID NO: 1260984 - protein, 17 aa, Mycobacterium
DEFWPGARRGLTQRESE

SEQ ID NO: 1260985 - protein, 18 aa, Mycobacterium
DEGFSARLGAAGFVGLTV

SEQ ID NO: 1260986 - protein, 25 aa, Mycobacterium
DEGGPRLFAQVLMYPGLDRDMAAPS

SEQ ID NO: 1260987 - protein, 27 aa, Mycobacterium
DEGGVWDSLWVYDHFHTVPVPTAEATH

SEQ ID NO: 1260988 - protein, 23 aa, Mycobacterium
DEGPFRREWLTAGIGDHYMADAG

SEQ ID NO: 1260989 - protein, 17 aa, Mycobacterium
DEGRALYDTALEYLGDG

SEQ ID NO: 1260990 - protein, 17 aa, Mycobacterium
DEGRASMGASVEIGEID

SEQ ID NO: 1260991 - protein, 18 aa, Mycobacterium
DEGREWIDQLAVDAGDAA

SEQ ID NO: 1260992 - protein, 18 aa, Mycobacterium
DEGRRLAHRLVEQSDVVL

SEQ ID NO: 1260993 - protein, 24 aa, Mycobacterium
DEHADALWRYALQLTGDAATAEDV

SEQ ID NO: 1260994 - protein, 17 aa, Mycobacterium
DEHFAGGRAVAWEDEHV

SEQ ID NO: 1260995 - protein, 23 aa, Mycobacterium
DEHRRAGLDWGTFAERSERLAET

SEQ ID NO: 1260996 - protein, 25 aa, Mycobacterium
DEIADRAGVSKPVLYQHFTSKVELY

SEQ ID NO: 1260997 - protein, 22 aa, Mycobacterium
DEIARRAGVGAGTIYRHFPTKE

SEQ ID NO: 1260998 - protein, 18 aa, Mycobacterium
DEIEAAVGLAERDPQVKV

SEQ ID NO: 1260999 - protein, 19 aa, Mycobacterium
DEIFEAFFSLVRVGGDGHD

SEQ ID NO: 1261000 - protein, 20 aa, Mycobacterium
DEIIGFMFLMVIAGNETTTK

SEQ ID NO: 1261001 - protein, 23 aa, Mycobacterium
DEIIKMVDLMIGRVSKQLAAKDM

SEQ ID NO: 1261002 - protein, 18 aa, Mycobacterium
DEIRDGAQIVDWIVSQPW

SEQ ID NO: 1261003 - protein, 25 aa, Mycobacterium
DEITLAVVKPVFDDIEHLLRITETL

SEQ ID NO: 1261004 - protein, 25 aa, Mycobacterium
DEKAPRPALQLLLYPVTHYDAETRS

SEQ ID NO: 1261005 - protein, 24 aa, Mycobacterium
DELAAFCRPYLSRLWARLHGRDVW

SEQ ID NO: 1261006 - protein, 23 aa, Mycobacterium
DELARRMGLSLFATGPLERFNGV

SEQ ID NO: 1261007 - protein, 20 aa, Mycobacterium
DELCLTVAPLLLGGGSARIV

SEQ ID NO: 1261008 - protein, 22 aa, Mycobacterium
DELDHLRSLLAKELANAYAGSN

SEQ ID NO: 1261009 - protein, 19 aa, Mycobacterium
DELGDLVIAAAARASVALR

SEQ ID NO: 1261010 - protein, 18 aa, Mycobacterium
DELGTGWSRFSVDLIPAM

SEQ ID NO: 1261011 - protein, 31 aa, Mycobacterium
DELIRGGVRDVVLCPGSRNAPLAFALHDADR

SEQ ID NO: 1261012 - protein, 22 aa, Mycobacterium
DELKIAALSAYWELPAMIGQFA

SEQ ID NO: 1261013 - protein, 21 aa, Mycobacterium
DELKPGVADRSWSQVSVSARE

SEQ ID NO: 1261014 - protein, 28 aa, Mycobacterium
DELLAAGVEECRRAGWGVHTHLAEVREE

SEQ ID NO: 1261015 - protein, 17 aa, Mycobacterium
DELLDNVMLYWATGTGA

SEQ ID NO: 1261016 - protein, 19 aa, Mycobacterium
DELLKFSLLPWPDYFGKAP

SEQ ID NO: 1261017 - protein, 24 aa, Mycobacterium
DELLRGFLDWLFERYHQIVATEPN

SEQ ID NO: 1261018 - protein, 17 aa, Mycobacterium
DELNRIAAMGVQLTCDH

SEQ ID NO: 1261019 - protein, 36 aa, Mycobacterium
DELPDVPLLCAEEVDRACAPWGLLGEDRQATVIAGI

SEQ ID NO: 1261020 - protein, 24 aa, Mycobacterium
DELPLPRPKFEIFVYSPRVEGVHL

SEQ ID NO: 1261021 - protein, 25 aa, Mycobacterium
DELQMKYRQGPCLEAALDSLIVRTD

SEQ ID NO: 1261022 - protein, 18 aa, Mycobacterium
DELQQEWTWTEKYATQGE

SEQ ID NO: 1261023 - protein, 21 aa, Mycobacterium
DELRAAKARPLGVLPRPDPLP

SEQ ID NO: 1261024 - protein, 25 aa, Mycobacterium
DELREILDRLGYRFLPEQVPKMVDY

SEQ ID NO: 1261025 - protein, 20 aa, Mycobacterium
DELRGGLDGELGDLVETVLD

SEQ ID NO: 1261026 - protein, 24 aa, Mycobacterium
DELRILRLHLLHLLQTVSLNTADL

SEQ ID NO: 1261027 - protein, 27 aa, Mycobacterium
DELRKAEVFVGSRFTAEMARLAENLRL

SEQ ID NO: 1261028 - protein, 28 aa, Mycobacterium
DELRRIIPPWVTLGSRLAVLPTPHRTYG

SEQ ID NO: 1261029 - protein, 21 aa, Mycobacterium
DELRTLADILALPPPEVDTAA

SEQ ID NO: 1261030 - protein, 21 aa, Mycobacterium
DELVALRWALYQSEESRSALT

SEQ ID NO: 1261031 - protein, 25 aa, Mycobacterium
DELVGDGYLRFMRSFFESMFVPSSD

SEQ ID NO: 1261032 - protein, 24 aa, Mycobacterium
DELVPELQRRGLFRRHYTGSTLRE

SEQ ID NO: 1261033 - protein, 23 aa, Mycobacterium
DELWAEAGKLGFIGVNLPEEYGG

SEQ ID NO: 1261034 - protein, 26 aa, Mycobacterium
DELYLHVPGLPPIVVLPDRAPADAPI

SEQ ID NO: 1261035 - protein, 32 aa, Mycobacterium
DEMGDGFVSRICGWLLGIAHHFQGDLDAALAL

SEQ ID NO: 1261036 - protein, 29 aa, Mycobacterium
DEMMLTMLHRGCRAIRELASIDLVRSYQV

SEQ ID NO: 1261037 - protein, 18 aa, Mycobacterium
DEMVNFAVEMEREGLEIP

SEQ ID NO: 1261038 - protein, 24 aa, Mycobacterium
DEPPPRAFGPLAIDVAGRQVFIDD

SEQ ID NO: 1261039 - protein, 23 aa, Mycobacterium
DEPPPRAFGPLSIDVAGRQVFID

SEQ ID NO: 1261040 - protein, 21 aa, Mycobacterium
DEPRVSSFVRKGLSSNGYSVT

SEQ ID NO: 1261041 - protein, 18 aa, Mycobacterium
DEPYRRALRVIHGRLTAT

SEQ ID NO: 1261042 - protein, 18 aa, Mycobacterium
DEPYRRALRVVHARLTAT

SEQ ID NO: 1261043 - protein, 23 aa, Mycobacterium
DEQRARLLPVRFRAPDGSLVATD

SEQ ID NO: 1261044 - protein, 22 aa, Mycobacterium
DEQVWRWPARRSKDNSTSTRLT

SEQ ID NO: 1261045 - protein, 19 aa, Mycobacterium
DEQWFDPDGFFLAFDEDSG

SEQ ID NO: 1261046 - protein, 17 aa, Mycobacterium
DEQWRRTFAVNIDSFFR

SEQ ID NO: 1261047 - protein, 25 aa, Mycobacterium
DERDRPLLELSWDYVMDGDEPSGED

SEQ ID NO: 1261048 - protein, 20 aa, Mycobacterium
DERDVLCASTFGVGQLMAHA

SEQ ID NO: 1261049 - protein, 19 aa, Mycobacterium
DERELGILVSRLHSNHLDL

SEQ ID NO: 1261050 - protein, 22 aa, Mycobacterium
DERGSAFFAVMQGRGGRVASDG

SEQ ID NO: 1261051 - protein, 20 aa, Mycobacterium
DERLDQVREWLAATPGASVL

SEQ ID NO: 1261052 - protein, 24 aa, Mycobacterium
DERLGEVGKAFVVRLPSAELDEKT

SEQ ID NO: 1261053 - protein, 23 aa, Mycobacterium
DERLPAVLADLGLDSDAVRPDST

SEQ ID NO: 1261054 - protein, 25 aa, Mycobacterium
DERLPRYIGGVLARLQEVWIGRQIA

SEQ ID NO: 1261055 - protein, 19 aa, Mycobacterium
DERWCLWFVDAHLDELESS

SEQ ID NO: 1261056 - protein, 23 aa, Mycobacterium
DERYWSARLGQFAGGTAAVESLR

SEQ ID NO: 1261057 - protein, 18 aa, Mycobacterium
DESFCPPGSISQPMDHVA

SEQ ID NO: 1261058 - protein, 18 aa, Mycobacterium
DESIDPGPQFEWVDQHGD

SEQ ID NO: 1261059 - protein, 24 aa, Mycobacterium
DESRSPWPTWPIVLRTRLSPAHAE

SEQ ID NO: 1261060 - protein, 20 aa, Mycobacterium
DESRYATGAEFVMDGGLTND

SEQ ID NO: 1261061 - protein, 19 aa, Mycobacterium
DESSWPLYPIRPGHTYVNV

SEQ ID NO: 1261062 - protein, 18 aa, Mycobacterium
DESVRVFLATGLRDVERP

SEQ ID NO: 1261063 - protein, 22 aa, Mycobacterium
DETEVRYPARYALDARSVPSDS

SEQ ID NO: 1261064 - protein, 24 aa, Mycobacterium
DETEWRTEYLYSRAATIYGGTAEV

SEQ ID NO: 1261065 - protein, 23 aa, Mycobacterium
DETGLRAGTALVVGGADHVLSAY

SEQ ID NO: 1261066 - protein, 30 aa, Mycobacterium; identical to SEQ ID NO: 644438

SEQ ID NO: 1261067 - protein, 24 aa, Mycobacterium
DETRSIAGFFSFDPVRAEVSAALP

SEQ ID NO: 1261068 - protein, 18 aa, Mycobacterium
DEVACPFHDWRWGGDGRC

SEQ ID NO: 1261069 - protein, 22 aa, Mycobacterium
DEVADHVWVPWQHMRAAAEFGW

SEQ ID NO: 1261070 - protein, 18 aa, Mycobacterium
DEVDVLRLADKVHAPVQP

SEQ ID NO: 1261071 - protein, 21 aa, Mycobacterium
DEVEECWQLLRQSLHSVSYET

SEQ ID NO: 1261072 - protein, 27 aa, Mycobacterium
DEVICAFGRIGSMFACDDFGYVPDIIT

SEQ ID NO: 1261073 - protein, 25 aa, Mycobacterium
DEVLFGWRSFEIYPLQVRTAGATPV

SEQ ID NO: 1261074 - protein, 27 aa, Mycobacterium
DEVMAGFGRSGKWFSIDHFDVTPDLLT

SEQ ID NO: 1261075 - protein, 29 aa, Mycobacterium
DEVMAGFGRTGTWFAIENFDVVPDLITFA

SEQ ID NO: 1261076 - protein, 17 aa, Mycobacterium
DEVPRDGLLRLLVDVQY

SEQ ID NO: 1261077 - protein, 17 aa, Mycobacterium
DEVPVRTPGTLAFAPTV

SEQ ID NO: 1261078 - protein, 20 aa, Mycobacterium
DEVRAAKGYREMRERLHAER

SEQ ID NO: 1261079 - protein, 25 aa, Mycobacterium
DEVRPWIWKTMESFPGSYMTSFPSL

SEQ ID NO: 1261080 - protein, 17 aa, Mycobacterium
DEVYLALYGVWRDAADD

SEQ ID NO: 1261081 - protein, 25 aa, Mycobacterium
DEWAESRRYLGLDVLSKSRAVNDTS

SEQ ID NO: 1261082 - protein, 24 aa, Mycobacterium
DEWIWARATVLAAAYLTGLAAAAA

SEQ ID NO: 1261083 - protein, 19 aa, Mycobacterium
DEWNWKFIFIGANIDEGGD

SEQ ID NO: 1261084 - protein, 22 aa, Mycobacterium
DEWPARIAETAMFLVDRQCDLK

SEQ ID NO: 1261085 - protein, 20 aa, Mycobacterium
DEYAPLQALTTWLAEAVAAG

SEQ ID NO: 1261086 - protein, 18 aa, Mycobacterium
DEYLLNAYIGRYPKPYVA

SEQ ID NO: 1261087 - protein, 25 aa, Mycobacterium
DEYRKLDEEFIWYGRIPRAKLAGYV

SEQ ID NO: 1261088 - protein, 26 aa, Mycobacterium
DFDDCGFGWYFYDFGTAVSFFEDHPS

SEQ ID NO: 1261089 - protein, 24 aa, Mycobacterium
DFDGIKNLFDISGKRNFTAPHLAE

SEQ ID NO: 1261090 - protein, 26 aa, Mycobacterium
DFDRARPLWKITLIEGLPEGEAAVLC

SEQ ID NO: 1261091 - protein, 24 aa, Mycobacterium
DFDRVGGFTADFPFLSDIHLWVRL

SEQ ID NO: 1261092 - protein, 24 aa, Mycobacterium
DFDRWRFELDCEVLKRRYDLDDDD

SEQ ID NO: 1261093 - protein, 21 aa, Mycobacterium
DFELAPGYVPEITWPSATCTL

SEQ ID NO: 1261094 - protein, 26 aa, Mycobacterium
DFELKRLGFVTAMPLGVELRGTRVSG

SEQ ID NO: 1261095 - protein, 19 aa, Mycobacterium
DFFAAEASDPGWGYDAVLD

SEQ ID NO: 1261096 - protein, 25 aa, Mycobacterium
DFFEFLRGGARFELLELHVTAGTDV

SEQ ID NO: 1261097 - protein, 24 aa, Mycobacterium
DFGCKRPTYSNSYYRTFASPHVHL

SEQ ID NO: 1261098 - protein, 19 aa, Mycobacterium
DFGGCLLVVSHDRVLLDRM

SEQ ID NO: 1261099 - protein, 19 aa, Mycobacterium
DFGISRAPLREALRRLAQQ

SEQ ID NO: 1261100 - protein, 19 aa, Mycobacterium
DFGLIPAFGAAPIDSEAFR

SEQ ID NO: 1261101 - protein, 22 aa, Mycobacterium
DFIAFRQALRTDFTPFANDLGY

SEQ ID NO: 1261102 - protein, 20 aa, Mycobacterium
DFITRPAAHHALATADTEFL

SEQ ID NO: 1261103 - protein, 23 aa, Mycobacterium
DFKQCPLLYRFRAIDRLPEPSSA

SEQ ID NO: 1261104 - protein, 17 aa, Mycobacterium
DFLAFAVPTMMGEVRRY

SEQ ID NO: 1261105 - protein, 21 aa, Mycobacterium
DFLGPINWMRPLRAIAGRHEV

SEQ ID NO: 1261106 - protein, 18 aa, Mycobacterium
DFLREIHTLAAMFTTVRI

SEQ ID NO: 1261107 - protein, 19 aa, Mycobacterium
DFMGFTVTGGDEFLASGHP

SEQ ID NO: 1261108 - protein, 26 aa, Mycobacterium
DFMPVVWAMFEWGRSHLPNNGRLRLT

SEQ ID NO: 1261109 - protein, 19 aa, Mycobacterium
DFMSCSYGFRPKRSATQAM

SEQ ID NO: 1261110 - protein, 18 aa, Mycobacterium
DFNRRPWPTSELRSTSGP

SEQ ID NO: 1261111 - protein, 26 aa, Mycobacterium
DFPAEEFDRLVAINIGGVYWAVRSAI

SEQ ID NO: 1261112 - protein, 22 aa, Mycobacterium
DFPALAKRFPAPPASKGVVVTP

SEQ ID NO: 1261113 - protein, 26 aa, Mycobacterium
DFQIGFRGGHQWKGRDGLQVYLNQRD

SEQ ID NO: 1261114 - protein, 20 aa, Mycobacterium
DFQPRQGMFVQLAALGKLPF

SEQ ID NO: 1261115 - protein, 17 aa, Mycobacterium
DFQPYWRRLQGQLAAAL

SEQ ID NO: 1261116 - protein, 20 aa, Mycobacterium
DFQRRACEALAQGHGVLVCA

SEQ ID NO: 1261117 - protein, 22 aa, Mycobacterium
DFRARCRDIAAAFGGGEHVRYA

SEQ ID NO: 1261118 - protein, 24 aa, Mycobacterium
DFREVRAAGSMRVLERVSGQAGAL

SEQ ID NO: 1261119 - protein, 17 aa, Mycobacterium
DFRKVADTLLGFIDQDG

SEQ ID NO: 1261120 - protein, 21 aa, Mycobacterium
DFRLERDGVLVSWAVPKNLPD

SEQ ID NO: 1261121 - protein, 17 aa, Mycobacterium
DFSTEWTAYHRDGAPQL

SEQ ID NO: 1261122 - protein, 22 aa, Mycobacterium
DFTGLDDWTIWWGANLGAPGER

SEQ ID NO: 1261123 - protein, 22 aa, Mycobacterium
DFTTGADVIMFWSAAPPGEMER

SEQ ID NO: 1261124 - protein, 18 aa, Mycobacterium
DFVPRVWAGLEALGLGHP

SEQ ID NO: 1261125 - protein, 19 aa, Mycobacterium
DFVVIAGLQEGLWPNTIPR

SEQ ID NO: 1261126 - protein, 24 aa, Mycobacterium
DFVWCAVCITGQVVRGWVGEDNLT

SEQ ID NO: 1261127 - protein, 17 aa, Mycobacterium
DGAAMARRGCVYVSVNY

SEQ ID NO: 1261128 - protein, 23 aa, Mycobacterium
DGADIGARCELLRGARVWPGITI

SEQ ID NO: 1261129 - protein, 22 aa, Mycobacterium
DGADSLTLEWSRSVKGDLGAAV

SEQ ID NO: 1261130 - protein, 23 aa, Mycobacterium
DGAEVLVPFVSAIVVSVSLADNA

SEQ ID NO: 1261131 - protein, 26 aa, Mycobacterium
DGAHFECWTMLGAWAEQTSRIEIGAL

SEQ ID NO: 1261132 - protein, 30 aa, Mycobacterium
DGAIEAVEWPDHPFALGVHWHPEDPLMHEL

SEQ ID NO: 1261133 - protein, 18 aa, Mycobacterium
DGALARRNVVLDTMIENL

SEQ ID NO: 1261134 - protein, 19 aa, Mycobacterium
DGALLLAVCSAELDDHAAV

SEQ ID NO: 1261135 - protein, 20 aa, Mycobacterium
DGALPLLAPMSEVAGRLSAQ

SEQ ID NO: 1261136 - protein, 17 aa, Mycobacterium
DGAPLIPYFRQLTEAPV

SEQ ID NO: 1261137 - protein, 20 aa, Mycobacterium
DGARVPFDILVVATGADARP

SEQ ID NO: 1261138 - protein, 17 aa, Mycobacterium
DGASAHFVAADLGGADE

SEQ ID NO: 1261139 - protein, 24 aa, Mycobacterium
DGDAGPGWYGGGPLSVRPDRQRAG

SEQ ID NO: 1261140 - protein, 18 aa, Mycobacterium
DGDAHCIIRMETRDFIAL

SEQ ID NO: 1261141 - protein, 21 aa, Mycobacterium
DGDAIMVVLALAMRESGELAS

SEQ ID NO: 1261142 - protein, 17 aa, Mycobacterium
DGDARARIWAHLAPGQQ

SEQ ID NO: 1261143 - protein, 23 aa, Mycobacterium
DGDEVWVLPGGLTRVALPEGSLV

SEQ ID NO: 1261144 - protein, 20 aa, Mycobacterium
DGDGRIGIDAMFRDTYVRTD

SEQ ID NO: 1261145 - protein, 20 aa, Mycobacterium
DGDLLKGVQYYGGGCTTQSI

SEQ ID NO: 1261146 - protein, 26 aa, Mycobacterium
DGDLPQRYAFNASWLAHRKIYSKIRQ

SEQ ID NO: 1261147 - protein, 24 aa, Mycobacterium
DGDLRNDIAFNFVFSDPSAGLSGP

SEQ ID NO: 1261148 - protein, 25 aa, Mycobacterium
DGDRLSCGLLDWGCVGQMNLAMAIW

SEQ ID NO: 1261149 - protein, 18 aa, Mycobacterium
DGDVCVKLVLGAIWIATA

SEQ ID NO: 1261150 - protein, 17 aa, Mycobacterium
DGECIDLALYESLFRGI

SEQ ID NO: 1261151 - protein, 19 aa, Mycobacterium
DGEDIDWAGWLRDGIVCPA

SEQ ID NO: 1261152 - protein, 25 aa, Mycobacterium
DGEFRPELTAAWLTEMFYSLVGGTA

SEQ ID NO: 1261153 - protein, 25 aa, Mycobacterium
DGEFVKFGPSWAWPKPVQAHIPVLV

SEQ ID NO: 1261154 - protein, 33 aa, Mycobacterium
DGEHFRRVIASPKPKRIFEIGPIRTLVEHGTMV

SEQ ID NO: 1261155 - protein, 19 aa, Mycobacterium
DGEPDEWWIVHGRLSAEPV

SEQ ID NO: 1261156 - protein, 19 aa, Mycobacterium
DGEPIPGLFAAGRSTAGLA

SEQ ID NO: 1261157 - protein, 25 aa, Mycobacterium
DGEPLFMAGLWSTWRPKGADKDVKP

SEQ ID NO: 1261158 - protein, 25 aa, Mycobacterium
DGEPRAPLSALLPMGGAVSGVAGPN

SEQ ID NO: 1261159 - protein, 23 aa, Mycobacterium
DGEPRGAGPLADVVASVAFLQGA

SEQ ID NO: 1261160 - protein, 25 aa, Mycobacterium
DGESARLLALESFEILDTVPETPFD

SEQ ID NO: 1261161 - protein, 18 aa, Mycobacterium
DGEVLACYVLDPRLKSSS

SEQ ID NO: 1261162 - protein, 23 aa, Mycobacterium
DGEVLVCKFVDPGWTALVSLAGA

SEQ ID NO: 1261163 - protein, 19 aa, Mycobacterium
DGEVSAWRVVDQMDTYRSP

SEQ ID NO: 1261164 - protein, 24 aa, Mycobacterium
DGEVYWKRRCEFGPDELATTMLPA

SEQ ID NO: 1261165 - protein, 40 aa, Mycobacterium
DGEWTEPTWLPARWPVLLCNGAVGIAEGWATKVPAHNPRE

SEQ ID NO: 1261166 - protein, 30 aa, Mycobacterium
DGFAKRFHRAYGRFLDECWFTSTVEDYGAV

SEQ ID NO: 1261167 - protein, 17 aa, Mycobacterium
DGFASPLLQRAWKAMRR

SEQ ID NO: 1261168 - protein, 18 aa, Mycobacterium
DGFCGWPTALHLSDAGHD

SEQ ID NO: 1261169 - protein, 25 aa, Mycobacterium
DGFGIPEQLRYAAMMDPKELLTAEP

SEQ ID NO: 1261170 - protein, 24 aa, Mycobacterium
DGFLNRLDLAFSRDQARRVYVQHK

SEQ ID NO: 1261171 - protein, 28 aa, Mycobacterium
DGFMIFPPRVPYGIGAFVDLVVPELQRR

SEQ ID NO: 1261172 - protein, 20 aa, Mycobacterium
DGFMTRDEVVDWLSGWLDTF

SEQ ID NO: 1261173 - protein, 17 aa, Mycobacterium
DGFSHLYERAVLLERLR

SEQ ID NO: 1261174 - protein, 21 aa, Mycobacterium
DGFVFGEAGVMMIIETEEHAK

SEQ ID NO: 1261175 - protein, 22 aa, Mycobacterium
DGGAHYGMICDASFPTYMLTHW

SEQ ID NO: 1261176 - protein, 21 aa, Mycobacterium
DGGDARVLLFYRAEDLGLARF

SEQ ID NO: 1261177 - protein, 17 aa, Mycobacterium
DGGDWILNGQKVYISGV

SEQ ID NO: 1261178 - protein, 17 aa, Mycobacterium
DGGFAEFMIVPRQVLKV

SEQ ID NO: 1261179 - protein, 17 aa, Mycobacterium
DGGGAVFYSVVSRDSLD

SEQ ID NO: 1261180 - protein, 24 aa, Mycobacterium
DGGPRIAGVSSFGFAGTNAHVILE

SEQ ID NO: 1261181 - protein, 23 aa, Mycobacterium
DGGRWTFGYLMSRATTIGAGTAE

SEQ ID NO: 1261182 - protein, 21 aa, Mycobacterium
DGGSRLRGRWPRGHALYGDGG

SEQ ID NO: 1261183 - protein, 21 aa, Mycobacterium
DGGTWFLQRAIGYERAAEMTL

SEQ ID NO: 1261184 - protein, 24 aa, Mycobacterium
DGGVLPDEAIDWVIDAYTRGQVAD

SEQ ID NO: 1261185 - protein, 24 aa, Mycobacterium
DGGVLSDDAIDWVIDAYTHGRVAE

SEQ ID NO: 1261186 - protein, 33 aa, Mycobacterium; identical to SEQ ID NO: 644969

SEQ ID NO: 1261187 - protein, 21 aa, Mycobacterium
DGHALGALCVMDREPRTLSDP

SEQ ID NO: 1261188 - protein, 17 aa, Mycobacterium
DGHGLLHVVDRKKDMIK

SEQ ID NO: 1261189 - protein, 24 aa, Mycobacterium
DGHLYRIFAKLSIEDREQLARLFR

SEQ ID NO: 1261190 - protein, 20 aa, Mycobacterium
DGHPLMFAAQAWNYMFPLGE

SEQ ID NO: 1261191 - protein, 19 aa, Mycobacterium
DGHRWCHTPQLGLWSGAMS

SEQ ID NO: 1261192 - protein, 17 aa, Mycobacterium
DGINMGSRFMCTVESCI

SEQ ID NO: 1261193 - protein, 18 aa, Mycobacterium
DGINPKRMAAMTMQTVMF

SEQ ID NO: 1261194 - protein, 21 aa, Mycobacterium
DGIPPKWAAVRRLVMGAINGN

SEQ ID NO: 1261195 - protein, 20 aa, Mycobacterium
DGIRLGDYDIGIAVGLDKHP

SEQ ID NO: 1261196 - protein, 17 aa, Mycobacterium
DGIRPPAIIVIGAVAGF

SEQ ID NO: 1261197 - protein, 24 aa, Mycobacterium
DGIRRALAAWVVFDPGEIFHYSDI

SEQ ID NO: 1261198 - protein, 24 aa, Mycobacterium
DGKAEWYRNRWVRSPRVAEALGET

SEQ ID NO: 1261199 - protein, 25 aa, Mycobacterium
DGKATCPPVSIAMAGALNGPDAALG

SEQ ID NO: 1261200 - protein, 17 aa, Mycobacterium
DGKAYVYRASMSREERS

SEQ ID NO: 1261201 - protein, 20 aa, Mycobacterium
DGKIGAVVAWDLDRLHRRPI

SEQ ID NO: 1261202 - protein, 25 aa, Mycobacterium
DGKLHKHWGFGGGPHRCLGSHLARM

SEQ ID NO: 1261203 - protein, 28 aa, Mycobacterium
DGLANLRRWLHEWADVYDAHAAVFAEFP

SEQ ID NO: 1261204 - protein, 19 aa, Mycobacterium
DGLAPYLAFEERLAPISRE

SEQ ID NO: 1261205 - protein, 19 aa, Mycobacterium
DGLCRRYHGAPGATIEALR

SEQ ID NO: 1261206 - protein, 22 aa, Mycobacterium
DGLDRFEARFAVRQALADEGRI

SEQ ID NO: 1261207 - protein, 23 aa, Mycobacterium
DGLELIKSLNYVLARGGNPSPWR

SEQ ID NO: 1261208 - protein, 24 aa, Mycobacterium
DGLGGACVLYDCVPSKTFIASTGV

SEQ ID NO: 1261209 - protein, 17 aa, Mycobacterium
DGLGLAIAREYAGGTVF

SEQ ID NO: 1261210 - protein, 20 aa, Mycobacterium
DGLLDRMIENVIDYLDDGVR

SEQ ID NO: 1261211 - protein, 21 aa, Mycobacterium
DGLPEGFSFHDLRHYLASLLI

SEQ ID NO: 1261212 - protein, 18 aa, Mycobacterium
DGLPGTVDVVLFLGATSR

SEQ ID NO: 1261213 - protein, 21 aa, Mycobacterium
DGLPIRAAEEFLQFLRDDEAS

SEQ ID NO: 1261214 - protein, 25 aa, Mycobacterium
DGLPNYQRLFSLRVGQTVREQFEAD

SEQ ID NO: 1261215 - protein, 25 aa, Mycobacterium
DGLPRFKNGGVRKIWVYRAFDDGQE

SEQ ID NO: 1261216 - protein, 17 aa, Mycobacterium
DGLPVLFDSGIRSGADI

SEQ ID NO: 1261217 - protein, 19 aa, Mycobacterium
DGLPWHWETFPEFLDALDA

SEQ ID NO: 1261218 - protein, 24 aa, Mycobacterium
DGLQRPQGLHVRGERLYIVDAGAG

SEQ ID NO: 1261219 - protein, 17 aa, Mycobacterium
DGLRELWDKVLEHRDVL

SEQ ID NO: 1261220 - protein, 21 aa, Mycobacterium
DGLRLVRKIVHLVDAGGPVET

SEQ ID NO: 1261221 - protein, 23 aa, Mycobacterium
DGLRRSDTLTGRHLDDRTSLKQS

SEQ ID NO: 1261222 - protein, 17 aa, Mycobacterium
DGLSEICATVFTTTAHA

SEQ ID NO: 1261223 - protein, 22 aa, Mycobacterium
DGLSEICATVFTTTAHAFDQRL

SEQ ID NO: 1261224 - protein, 22 aa, Mycobacterium
DGLSEICATVFTTTAHAFDRRL

SEQ ID NO: 1261225 - protein, 17 aa, Mycobacterium
DGLTDILLRRPPRTRSG

SEQ ID NO: 1261226 - protein, 26 aa, Mycobacterium
DGMADFPDRWWNFVAVANAMAGGIFV

SEQ ID NO: 1261227 - protein, 25 aa, Mycobacterium
DGNALFFGHGLNIHFGLIKPPANVT

SEQ ID NO: 1261228 - protein, 21 aa, Mycobacterium
DGNALKLARRTICVDESVLRM

SEQ ID NO: 1261229 - protein, 26 aa, Mycobacterium
DGNKRTAWAAAWTFLHINGIQLADDF

SEQ ID NO: 1261230 - protein, 26 aa, Mycobacterium
DGNMPMAWAAAWIFLHINGISLGEFD

SEQ ID NO: 1261231 - protein, 23 aa, Mycobacterium
DGPDGTWGRPAVLMSPVAFLQKP

SEQ ID NO: 1261232 - protein, 18 aa, Mycobacterium
DGPDRGGEVIVTLHGEKI

SEQ ID NO: 1261233 - protein, 18 aa, Mycobacterium
DGPEELDAALARAREQHP

SEQ ID NO: 1261234 - protein, 18 aa, Mycobacterium
DGPGSWRKAPDFASDPDR

SEQ ID NO: 1261235 - protein, 34 aa, Mycobacterium
DGPLRFSFAEVVHRIRCAAGAFADLGIGKGDRVA

SEQ ID NO: 1261236 - protein, 17 aa, Mycobacterium
DGPRAAFAAAQRWRRRA

SEQ ID NO: 1261237 - protein, 31 aa, Mycobacterium
DGPRAQGGLRYCINSAALRFIHLDDLEAQGY

SEQ ID NO: 1261238 - protein, 25 aa, Mycobacterium
DGPRDRGGLRYCVNSAALRFIHLDD

SEQ ID NO: 1261239 - protein, 25 aa, Mycobacterium
DGPVAEAWLPFHVPMSYHGTFTSRV

SEQ ID NO: 1261240 - protein, 19 aa, Mycobacterium
DGPVPEWFCQSADLEELGE

SEQ ID NO: 1261241 - protein, 18 aa, Mycobacterium
DGQAFYIHNRVRTIDSAA

SEQ ID NO: 1261242 - protein, 23 aa, Mycobacterium
DGQARALRRVCAVLTAARRSARE

SEQ ID NO: 1261243 - protein, 17 aa, Mycobacterium
DGQDFIVDLTVWMELAA

SEQ ID NO: 1261244 - protein, 24 aa, Mycobacterium
DGQIGTACAVAFGSAFAATARHAG

SEQ ID NO: 1261245 - protein, 17 aa, Mycobacterium
DGQLKGKIQALGNALGS

SEQ ID NO: 1261246 - protein, 18 aa, Mycobacterium
DGQLPNMQAIVGFAAETG

SEQ ID NO: 1261247 - protein, 24 aa, Mycobacterium
DGQNFASQWDRLGFGVQLSALVTF

SEQ ID NO: 1261248 - protein, 18 aa, Mycobacterium
DGQNWVWAGADVIEPDHS

SEQ ID NO: 1261249 - protein, 25 aa, Mycobacterium
DGQPGRFLLVTNFEYATPQFMFPGY

SEQ ID NO: 1261250 - protein, 24 aa, Mycobacterium
DGQRAEGYAGWQKAVQRTLDWVDV

SEQ ID NO: 1261251 - protein, 17 aa, Mycobacterium
DGQRRWEAFTDWPDPWV

SEQ ID NO: 1261252 - protein, 21 aa, Mycobacterium
DGQTIPGRLYLPAEEAAALPL

SEQ ID NO: 1261253 - protein, 26 aa, Mycobacterium
DGQTLFEICARLTTKHGITASRQSTS

SEQ ID NO: 1261254 - protein, 26 aa, Mycobacterium
DGQVYTAASAVRWAVELGLVPAADQI

SEQ ID NO: 1261255 - protein, 31 aa, Mycobacterium
DGRARAMLYGAYRSGAPFGGRVTELVIESAR

SEQ ID NO: 1261256 - protein, 19 aa, Mycobacterium
DGRARVAAVHKIIGSTPRM

SEQ ID NO: 1261257 - protein, 25 aa, Mycobacterium
DGRCKVMGEVALCIGPRVARTQVDV

SEQ ID NO: 1261258 - protein, 19 aa, Mycobacterium
DGRELPLPVAGVFEITEGR

SEQ ID NO: 1261259 - protein, 22 aa, Mycobacterium
DGRGPLTVPIWYQYTPGGDLWF

SEQ ID NO: 1261260 - protein, 20 aa, Mycobacterium
DGRGPVLIHALEGFSDAGHA

SEQ ID NO: 1261261 - protein, 24 aa, Mycobacterium
DGRHLLASWIRLVALTAHHPGTDW

SEQ ID NO: 1261262 - protein, 20 aa, Mycobacterium
DGRILGYAMMIRGLPDDPDV

SEQ ID NO: 1261263 - protein, 21 aa, Mycobacterium
DGRLTTALLRPSRDAEPVATD

SEQ ID NO: 1261264 - protein, 18 aa, Mycobacterium
DGRNWGAVTVMFATRRPR

SEQ ID NO: 1261265 - protein, 24 aa, Mycobacterium
DGRPRARGAGIGFSGQPGPLNALT

SEQ ID NO: 1261266 - protein, 26 aa, Mycobacterium
DGRPRRAGVSSFGFTGTNAHVLIEEA

SEQ ID NO: 1261267 - protein, 17 aa, Mycobacterium
DGRPVNALRGFLDAVAT

SEQ ID NO: 1261268 - protein, 22 aa, Mycobacterium
DGRPWSSAHLARCYTTGARRFG

SEQ ID NO: 1261269 - protein, 21 aa, Mycobacterium
DGRQGRRGRRFRDRRRRERGG

SEQ ID NO: 1261270 - protein, 17 aa, Mycobacterium
DGRWVVSIRCAQLSADR

SEQ ID NO: 1261271 - protein, 18 aa, Mycobacterium
DGSCALTVTAAWANLDTG

SEQ ID NO: 1261272 - protein, 20 aa, Mycobacterium
DGSCVYACPVNCIHPTPDEP

SEQ ID NO: 1261273 - protein, 18 aa, Mycobacterium
DGSDPDWDARVAGHRTRR

SEQ ID NO: 1261274 - protein, 21 aa, Mycobacterium
DGSDVPVEFLVQGTLYPDVVE

SEQ ID NO: 1261275 - protein, 17 aa, Mycobacterium
DGSFLIQVQMPDVSNIE

SEQ ID NO: 1261276 - protein, 18 aa, Mycobacterium
DGSGKLPSMGSFRGSGTW

SEQ ID NO: 1261277 - protein, 18 aa, Mycobacterium
DGSGKLPTAGAFRGTGTW

SEQ ID NO: 1261278 - protein, 18 aa, Mycobacterium
DGSLAGVLTRTGAVRAGI

SEQ ID NO: 1261279 - protein, 24 aa, Mycobacterium
DGSLRLPTERGLTLLGDFRADPVA

SEQ ID NO: 1261280 - protein, 17 aa, Mycobacterium
DGSRIALDGALPINTSG

SEQ ID NO: 1261281 - protein, 19 aa, Mycobacterium
DGSVWGRRRVLLLNSTYEP

SEQ ID NO: 1261282 - protein, 28 aa, Mycobacterium
DGTCDELGRLCCWILLDAAAPVSLTLAC

SEQ ID NO: 1261283 - protein, 19 aa, Mycobacterium
DGTFHKMEFANWDAVLKVH

SEQ ID NO: 1261284 - protein, 19 aa, Mycobacterium
DGTGGWRLANRAGGANVNQ

SEQ ID NO: 1261285 - protein, 18 aa, Mycobacterium
DGTITWTAPTGHTYTTHP

SEQ ID NO: 1261286 - protein, 18 aa, Mycobacterium
DGTIVFAELGTGRLLALR

SEQ ID NO: 1261287 - protein, 27 aa, Mycobacterium
DGTKARYAFGYGDFRRVHRTGLIACVF

SEQ ID NO: 1261288 - protein, 20 aa, Mycobacterium
DGTLRLALDAALSSPAGLGV

SEQ ID NO: 1261289 - protein, 23 aa, Mycobacterium
DGTMPRPELRFGSFAELLLNKGL

SEQ ID NO: 1261290 - protein, 18 aa, Mycobacterium
DGTNRMVVYLGGTNPRNW

SEQ ID NO: 1261291 - protein, 22 aa, Mycobacterium
DGTPCLRHRVELGSGSPADDEI

SEQ ID NO: 1261292 - protein, 24 aa, Mycobacterium
DGTPSAFLSWRVWVPRGPEHFELF

SEQ ID NO: 1261293 - protein, 18 aa, Mycobacterium
DGTPWRPLVHAQDIAVAF

SEQ ID NO: 1261294 - protein, 23 aa, Mycobacterium
DGTQTSADWGRRAAQRAERRMLI

SEQ ID NO: 1261295 - protein, 22 aa, Mycobacterium
DGTRLEPGAALLTLDAPTRGLL

SEQ ID NO: 1261296 - protein, 17 aa, Mycobacterium
DGTRPMATLTFSGAQAV

SEQ ID NO: 1261297 - protein, 20 aa, Mycobacterium
DGTRVAYKVLNRADNPQPGG

SEQ ID NO: 1261298 - protein, 18 aa, Mycobacterium
DGTVGFVDFGCVRILPEH

SEQ ID NO: 1261299 - protein, 20 aa, Mycobacterium
DGTVTLPFWMIYDDSEGLVP

SEQ ID NO: 1261300 - protein, 25 aa, Mycobacterium
DGVDARTAAAFGVAHRTAYHALRST

SEQ ID NO: 1261301 - protein, 17 aa, Mycobacterium
DGVEEFGYIDTVVANAG

SEQ ID NO: 1261302 - protein, 21 aa, Mycobacterium
DGVLCVPALAGLAAPWWDSAA

SEQ ID NO: 1261303 - protein, 17 aa, Mycobacterium
DGVLHGLGIDFDRFERE

SEQ ID NO: 1261304 - protein, 18 aa, Mycobacterium
DGVLQWRGSAGPGTTVDL

SEQ ID NO: 1261305 - protein, 22 aa, Mycobacterium
DGVPAVCPAGTWNTSLFTRIAP

SEQ ID NO: 1261306 - protein, 24 aa, Mycobacterium
DGVPERLELATAFGADAVIDITAT

SEQ ID NO: 1261307 - protein, 23 aa, Mycobacterium
DGVPRVETHLEWQMTPHTDPSWD

SEQ ID NO: 1261308 - protein, 22 aa, Mycobacterium
DGVPVRLHFAGPITEKDVEPRL

SEQ ID NO: 1261309 - protein, 26 aa, Mycobacterium
DGVQSALCFPSFPGFGGGTFIRAQDK

SEQ ID NO: 1261310 - protein, 18 aa, Mycobacterium
DGVRFGVVPRTGWGRSSD

SEQ ID NO: 1261311 - protein, 19 aa, Mycobacterium
DGVRIAVSVYLPADTTRQT

SEQ ID NO: 1261312 - protein, 22 aa, Mycobacterium
DGVRRLCADGVLVAVSTRVPGG

SEQ ID NO: 1261313 - protein, 17 aa, Mycobacterium
DGVVPGFQKAIAGQKVG

SEQ ID NO: 1261314 - protein, 18 aa, Mycobacterium
DGVWKSKVEGSGRAAHTG

SEQ ID NO: 1261315 - protein, 18 aa, Mycobacterium
DGVYAAWFTVLGHGPVMG

SEQ ID NO: 1261316 - protein, 22 aa, Mycobacterium
DGVYQCRACGAELFRSSEKFES

SEQ ID NO: 1261317 - protein, 31 aa, Mycobacterium
DGWKRRLQWSEVWNRISPMVAEILVTGAIAV

SEQ ID NO: 1261318 - protein, 24 aa, Mycobacterium
DGWNVQWQKWSLRVGFNPREGLVL

SEQ ID NO: 1261319 - protein, 24 aa, Mycobacterium
DGWSLPLFMGELLTLYRAGGDVTA

SEQ ID NO: 1261320 - protein, 22 aa, Mycobacterium
DGWWRDRHRAMVTLVESLERWA

SEQ ID NO: 1261321 - protein, 18 aa, Mycobacterium
DGYLFPAGTFVFVNTFAA

SEQ ID NO: 1261322 - protein, 18 aa, Mycobacterium
DGYLLIGRRHLRSNNSWM

SEQ ID NO: 1261323 - protein, 21 aa, Mycobacterium
DGYPQRFGIPDGLNAEPVAVK

SEQ ID NO: 1261324 - protein, 23 aa, Mycobacterium
DGYPQRFGIPEGLYAEPVAVKQG

SEQ ID NO: 1261325 - protein, 23 aa, Mycobacterium
DGYRARVSVISMIGLPSDEQRQS

SEQ ID NO: 1261326 - protein, 21 aa, Mycobacterium
DHACGLGTGGLFVDDVAAPVV

SEQ ID NO: 1261327 - protein, 21 aa, Mycobacterium
DHAILRQGLRSVLERADDLIV

SEQ ID NO: 1261328 - protein, 22 aa, Mycobacterium
DHAQLRVGWQVTDDTAAAATET

SEQ ID NO: 1261329 - protein, 17 aa, Mycobacterium
DHARIDEVITRGATEIW

SEQ ID NO: 1261330 - protein, 28 aa, Mycobacterium
DHAWINGLWCAPGGPTIAVLDFEAPLPE

SEQ ID NO: 1261331 - protein, 17 aa, Mycobacterium
DHDEARDKFGFLLDAFT

SEQ ID NO: 1261332 - protein, 18 aa, Mycobacterium
DHDFELWLTRVQLVADQV

SEQ ID NO: 1261333 - protein, 17 aa, Mycobacterium
DHDLWFCSDRCARRFAA

SEQ ID NO: 1261334 - protein, 17 aa, Mycobacterium
DHDPHLPESLAAFGGPA

SEQ ID NO: 1261335 - protein, 25 aa, Mycobacterium
DHDTFLLALGQLWAADVEVDFNQGA

SEQ ID NO: 1261336 - protein, 24 aa, Mycobacterium
DHEGGDGWLKRLYCSADPGRPTNV

SEQ ID NO: 1261337 - protein, 18 aa, Mycobacterium
DHEYLRGLLRAGISEGTI

SEQ ID NO: 1261338 - protein, 22 aa, Mycobacterium
DHGDIPLGIFCRKSLAEYMDAE

SEQ ID NO: 1261339 - protein, 23 aa, Mycobacterium
DHGEMLQAFLTRDVERLLGAAER

SEQ ID NO: 1261340 - protein, 20 aa, Mycobacterium
DHGKLCLKSRSGRDVTSEYP

SEQ ID NO: 1261341 - protein, 22 aa, Mycobacterium
DHGLEIARRFAHLTYRGETELD

SEQ ID NO: 1261342 - protein, 17 aa, Mycobacterium
DHGRRFVNESAPYDRLG

SEQ ID NO: 1261343 - protein, 25 aa, Mycobacterium
DHHRVWYRYHHLFGDVLRGRLRDLA

SEQ ID NO: 1261344 - protein, 20 aa, Mycobacterium
DHHSRRGLLLLVGRRRRLLK

SEQ ID NO: 1261345 - protein, 25 aa, Mycobacterium
DHIAARPAITLSWIRELPALGAQAT

SEQ ID NO: 1261346 - protein, 18 aa, Mycobacterium
DHIHLEVFQSLHGDPFAD

SEQ ID NO: 1261347 - protein, 17 aa, Mycobacterium
DHINEAFAAADGKRDVR

SEQ ID NO: 1261348 - protein, 26 aa, Mycobacterium
DHKSLRYFFESALSPNTFWVDLKNLD

SEQ ID NO: 1261349 - protein, 17 aa, Mycobacterium
DHLAGGTPVRWEDETVR

SEQ ID NO: 1261350 - protein, 25 aa, Mycobacterium
DHLATRAAHQFDFRGPALSVATACS

SEQ ID NO: 1261351 - protein, 17 aa, Mycobacterium
DHLEHVRHNSARTRNLR

SEQ ID NO: 1261352 - protein, 20 aa, Mycobacterium
DHLENFMIAGLLGIPQATVE

SEQ ID NO: 1261353 - protein, 17 aa, Mycobacterium
DHLFRLAGHNAPARTPA

SEQ ID NO: 1261354 - protein, 19 aa, Mycobacterium
DHLMSCWRDGRTSLRRPLD

SEQ ID NO: 1261355 - protein, 18 aa, Mycobacterium
DHLRRLEAELDRTRAAVV

SEQ ID NO: 1261356 - protein, 27 aa, Mycobacterium
DHLRSSMKIGEHWKMLDVNNSDWAKVG

SEQ ID NO: 1261357 - protein, 26 aa, Mycobacterium
DHLVKHLLELARRVGVENVTMRALAT

SEQ ID NO: 1261358 - protein, 26 aa, Mycobacterium
DHMADLGFLPGVTRILAATPRGGQRL

SEQ ID NO: 1261359 - protein, 22 aa, Mycobacterium
DHPESLVNWDALAAMNGTIVLL

SEQ ID NO: 1261360 - protein, 27 aa, Mycobacterium
DHPLFAAAVGFAARGAWNRGEDNRVRS

SEQ ID NO: 1261361 - protein, 25 aa, Mycobacterium
DHQIWQCPVVLLADVRSVGVQGDGR

SEQ ID NO: 1261362 - protein, 25 aa, Mycobacterium
DHRIDAIVPTIAWNSLVDAIFPRQA

SEQ ID NO: 1261363 - protein, 18 aa, Mycobacterium
DHRKIISRFLRWNLEKRL

SEQ ID NO: 1261364 - protein, 21 aa, Mycobacterium
DHRRIEGLIATGAFNVDPTAA

SEQ ID NO: 1261365 - protein, 17 aa, Mycobacterium
DHRSLANLVNWQLASGS

SEQ ID NO: 1261366 - protein, 27 aa, Mycobacterium
DHTIKATKLVAEWPIRDHIPDPDPIGT

SEQ ID NO: 1261367 - protein, 24 aa, Mycobacterium
DHTRFRRMLDPFFSPKRMAEREPE

SEQ ID NO: 1261368 - protein, 24 aa, Mycobacterium
DHTTRWPFGVTHASGLKHYCRTHH

SEQ ID NO: 1261369 - protein, 26 aa, Mycobacterium
DHVAARIGALAAMALLLRRERTGAGG

SEQ ID NO: 1261370 - protein, 17 aa, Mycobacterium
DHVAVLLSVELCSLTLQ

SEQ ID NO: 1261371 - protein, 18 aa, Mycobacterium
DHVDAVVVGAGFAGLYAL

SEQ ID NO: 1261372 - protein, 18 aa, Mycobacterium
DHVSDGFARISLGIEDTD

SEQ ID NO: 1261373 - protein, 25 aa, Mycobacterium
DHYRRTAFDIGEWGLGFMTTSLELG

SEQ ID NO: 1261374 - protein, 25 aa, Mycobacterium
DIADRVGRIIAIEWELDGRFTTALR

SEQ ID NO: 1261375 - protein, 25 aa, Mycobacterium
DIAHLRRRVMVVLPFLTPTIASLWV

SEQ ID NO: 1261376 - protein, 19 aa, Mycobacterium
DIAILRCGPLGGVRRALRR

SEQ ID NO: 1261377 - protein, 22 aa, Mycobacterium
DIAKAVSRRSLLHAGGVAVLAV

SEQ ID NO: 1261378 - protein, 24 aa, Mycobacterium
DIALRRPSLDEVFLALTGDHPRTR

SEQ ID NO: 1261379 - protein, 25 aa, Mycobacterium
DIAPRTVLILVEWESREAFDSYRDD

SEQ ID NO: 1261380 - protein, 24 aa, Mycobacterium
DIARAQSALTRWPYPDPSQRAAIA

SEQ ID NO: 1261381 - protein, 27 aa, Mycobacterium
DIARLRMLEALGWIVIRVIAEDRPAHW

SEQ ID NO: 1261382 - protein, 23 aa, Mycobacterium
DIARTAALSAGWPETVAGVTVDR

SEQ ID NO: 1261383 - protein, 33 aa, Mycobacterium
DIATFDLYSCFPFPVFVICEALGLSADDPRGLT

SEQ ID NO: 1261384 - protein, 20 aa, Mycobacterium
DIAVAASFSPTGPRGAGRHG

SEQ ID NO: 1261385 - protein, 27 aa, Mycobacterium
DIAVEAARIAINYHTPVMILSDGAIAN

SEQ ID NO: 1261386 - protein, 19 aa, Mycobacterium
DICQFAVGLSRQLYGRTIA

SEQ ID NO: 1261387 - protein, 20 aa, Mycobacterium
DICQFAVGLSRQLYGRTIAS

SEQ ID NO: 1261388 - protein, 19 aa, Mycobacterium
DICTCRPYLTHAIEECIQG

SEQ ID NO: 1261389 - protein, 24 aa, Mycobacterium
DIDDLKAPLLAAVGAADLALERVN

SEQ ID NO: 1261390 - protein, 18 aa, Mycobacterium
DIDFGRIRLKAGGGVAGH

SEQ ID NO: 1261391 - protein, 24 aa, Mycobacterium
DIDGCVYREGLSAVRIDGGVAGNV

SEQ ID NO: 1261392 - protein, 17 aa, Mycobacterium
DIDLFEVNEAFAPVVLA

SEQ ID NO: 1261393 - protein, 22 aa, Mycobacterium
DIEALGYGAVWVGGSPPAELDW

SEQ ID NO: 1261394 - protein, 18 aa, Mycobacterium
DIEAQGWIAPAECVEVRV

SEQ ID NO: 1261395 - protein, 25 aa, Mycobacterium
DIEDVCNRWAAGRFDTGVFKEDGWR

SEQ ID NO: 1261396 - protein, 25 aa, Mycobacterium
DIEDVCNRWAAGRFDTGVFKVDGWR

SEQ ID NO: 1261397 - protein, 18 aa, Mycobacterium
DIEKLPIDSAEFSKALIH

SEQ ID NO: 1261398 - protein, 19 aa, Mycobacterium
DIEVGMAVEVFFEDWTALS

SEQ ID NO: 1261399 - protein, 28 aa, Mycobacterium
DIFCTAEGPMLLDCLEFDDRLRYVDGID

SEQ ID NO: 1261400 - protein, 23 aa, Mycobacterium
DIFRCARHPRSFVSLEGADHLLT

SEQ ID NO: 1261401 - protein, 22 aa, Mycobacterium
DIGCGDGLLAQRLLPVSRSVTL

SEQ ID NO: 1261402 - protein, 24 aa, Mycobacterium
DIGCGVGSDAIWLAAQGWKSTALD

SEQ ID NO: 1261403 - protein, 19 aa, Mycobacterium
DIGKAIDERIRRGADVTET

SEQ ID NO: 1261404 - protein, 20 aa, Mycobacterium
DIHDVCRRHGALLIVDEAHG

SEQ ID NO: 1261405 - protein, 24 aa, Mycobacterium
DIHRRYAEAIPLGRIGSADEVAVA

SEQ ID NO: 1261406 - protein, 24 aa, Mycobacterium
DIIDMRGRTGLHRKAEVPVKGRLV

SEQ ID NO: 1261407 - protein, 21 aa, Mycobacterium
DIKGLRLTLTQAAWRLSEDLP

SEQ ID NO: 1261408 - protein, 24 aa, Mycobacterium
DIKRITERCAIGFIEGGVANEDNI

SEQ ID NO: 1261409 - protein, 18 aa, Mycobacterium
DILARGGGHIDKTRVHHE

SEQ ID NO: 1261410 - protein, 19 aa, Mycobacterium
DILTGMWATPVGEMFDYSG

SEQ ID NO: 1261411 - protein, 26 aa, Mycobacterium
DIPLAVDHFRYFAGAIRAQEGSLSEI

SEQ ID NO: 1261412 - protein, 22 aa, Mycobacterium
DIPTLRPGTAHRIMTGAPLPAG

SEQ ID NO: 1261413 - protein, 25 aa, Mycobacterium
DIPVKGRGGAGVGFHPFVKGEDAVL

SEQ ID NO: 1261414 - protein, 21 aa, Mycobacterium
DIRFVRLWFTDVLGYLKSVAI

SEQ ID NO: 1261415 - protein, 19 aa, Mycobacterium
DIRHADCRLIVTDAAGADR

SEQ ID NO: 1261416 - protein, 23 aa, Mycobacterium
DIRKAVPNWLVWTHGCPGGETSA

SEQ ID NO: 1261417 - protein, 20 aa, Mycobacterium
DIRMPPTFTDEGLVAAVSLR

SEQ ID NO: 1261418 - protein, 17 aa, Mycobacterium
DIRRERDLELALTDHVE

SEQ ID NO: 1261419 - protein, 30 aa, Mycobacterium
DIRVAAASARFGATFARMGLGPDYGLSKTL

SEQ ID NO: 1261420 - protein, 20 aa, Mycobacterium
DISNAILWLVSDEARYVTGM

SEQ ID NO: 1261421 - protein, 17 aa, Mycobacterium
DISPALHFGQWFCTGKV

SEQ ID NO: 1261422 - protein, 18 aa, Mycobacterium
DISRLRAGNFYVAAEGEA

SEQ ID NO: 1261423 - protein, 23 aa, Mycobacterium
DITLRGYKAFKHLSPQVYAPGIV

SEQ ID NO: 1261424 - protein, 20 aa, Mycobacterium
DITMSLKMGDRVGLVGHNGA

SEQ ID NO: 1261425 - protein, 19 aa, Mycobacterium
DITTRFSIGDVVIATADDN

SEQ ID NO: 1261426 - protein, 27 aa, Mycobacterium
DIVCWAADEARDWDGTRLCVGGQSAGG

SEQ ID NO: 1261427 - protein, 21 aa, Mycobacterium
DIVLRRLRIAARVGRTPQRGP

SEQ ID NO: 1261428 - protein, 17 aa, Mycobacterium
DIVRGVSFTVERDKTLG

SEQ ID NO: 1261429 - protein, 24 aa, Mycobacterium
DIWGRRRLAYEIAKHAEGIYAIVD

SEQ ID NO: 1261430 - protein, 19 aa, Mycobacterium
DKEGWLALMADDVVIEDPI

SEQ ID NO: 1261431 - protein, 22 aa, Mycobacterium
DKFDSGSGWPSFTRPIDAVNIK

SEQ ID NO: 1261432 - protein, 22 aa, Mycobacterium
DKFDSGSGWPSFTRPIEKENVL

SEQ ID NO: 1261433 - protein, 18 aa, Mycobacterium
DKFVKDFVAAWVNVMDAD

SEQ ID NO: 1261434 - protein, 17 aa, Mycobacterium
DKGARWDPAELGSVVPD

SEQ ID NO: 1261435 - protein, 21 aa, Mycobacterium
DKGNACLSCGHFATDATHLGE

SEQ ID NO: 1261436 - protein, 17 aa, Mycobacterium
DKHYIVRNGEVFIVDEF

SEQ ID NO: 1261437 - protein, 20 aa, Mycobacterium
DKITPGMLMAALRLNIPTVF

SEQ ID NO: 1261438 - protein, 17 aa, Mycobacterium
DKIWAPKAAGALRLHEV

SEQ ID NO: 1261439 - protein, 17 aa, Mycobacterium
DKKLRFIQVRNDVEFAL

SEQ ID NO: 1261440 - protein, 19 aa, Mycobacterium
DKLATWSMGILRESGRMLA

SEQ ID NO: 1261441 - protein, 23 aa, Mycobacterium
DKLDEALQIIVPMLKGERPTFTG

SEQ ID NO: 1261442 - protein, 17 aa, Mycobacterium
DKLIRWGYSATQVVEGL

SEQ ID NO: 1261443 - protein, 21 aa, Mycobacterium
DKLKDAGFYWATRSGVTVSMA

SEQ ID NO: 1261444 - protein, 18 aa, Mycobacterium
DKLLPAGWAAKIAGQITG

SEQ ID NO: 1261445 - protein, 20 aa, Mycobacterium
DKLNKKFAYRHSGYPGGLRK

SEQ ID NO: 1261446 - protein, 17 aa, Mycobacterium
DKLRRSFGRLPWTTNQK

SEQ ID NO: 1261447 - protein, 17 aa, Mycobacterium
DKMFPMAHAQRLAEAFA

SEQ ID NO: 1261448 - protein, 32 aa, Mycobacterium
DKMLYFVSPEWWRPRMHASHQALGKAPASAEG

SEQ ID NO: 1261449 - protein, 17 aa, Mycobacterium
DKPARWLIDESRQAQLV

SEQ ID NO: 1261450 - protein, 20 aa, Mycobacterium
DKPGSVVLWTNCHHPFYDRN

SEQ ID NO: 1261451 - protein, 25 aa, Mycobacterium
DKPLKYPHMFAAAGLVLINKSDLLP

SEQ ID NO: 1261452 - protein, 20 aa, Mycobacterium
DKPVIFAYHGYPWLIHRLAY

SEQ ID NO: 1261453 - protein, 20 aa, Mycobacterium
DKPWFAIGGIDAERLPEVLD

SEQ ID NO: 1261454 - protein, 17 aa, Mycobacterium
DKPWFSYVCPGAGHAPH

SEQ ID NO: 1261455 - protein, 17 aa, Mycobacterium
DKQGIQWMLVDSEVELR

SEQ ID NO: 1261456 - protein, 19 aa, Mycobacterium
DKQREILILRVVVGMSAEE

SEQ ID NO: 1261457 - protein, 18 aa, Mycobacterium
DKRKRGFDLCIYMLGADH

SEQ ID NO: 1261458 - protein, 18 aa, Mycobacterium
DKRLPGNPTRSFRTREPV

SEQ ID NO: 1261459 - protein, 20 aa, Mycobacterium
DKRLRYKVVASYQGGIAVRF

SEQ ID NO: 1261460 - protein, 24 aa, Mycobacterium
DKSAAVKSVMNWVKLHPTNISQKV

SEQ ID NO: 1261461 - protein, 33 aa, Mycobacterium
DKSIPGMLMAAARLDLASVFLYNGSIMPGVAKL

SEQ ID NO: 1261462 - protein, 25 aa, Mycobacterium
DKVKTGAKWGGPAIGLATMAYNMVS

SEQ ID NO: 1261463 - protein, 19 aa, Mycobacterium
DKVPFPGFDNVLLTFHDLG

SEQ ID NO: 1261464 - protein, 22 aa, Mycobacterium
DKVRMGMRVQAVWKPEDQWGLG

SEQ ID NO: 1261465 - protein, 24 aa, Mycobacterium
DKVRQRIGMVFQHFNLFPHMTVIE

SEQ ID NO: 1261466 - protein, 18 aa, Mycobacterium
DKVSLWYGSANRDESKFE

SEQ ID NO: 1261467 - protein, 25 aa, Mycobacterium
DKVSRDGWHLNIRIENEVVNSIPNL

SEQ ID NO: 1261468 - protein, 24 aa, Mycobacterium
DLAAELRQSWNVEFDDAGAIGRRY

SEQ ID NO: 1261469 - protein, 23 aa, Mycobacterium
DLAALDAFAGYGLSDEPEPEPLF

SEQ ID NO: 1261470 - protein, 24 aa, Mycobacterium
DLAARVGAPLVLRGVGVRRVAGDR

SEQ ID NO: 1261471 - protein, 17 aa, Mycobacterium
DLACAAIKMAVTARGGR

SEQ ID NO: 1261472 - protein, 28 aa, Mycobacterium
DLADARTRFGITVSDVLLAPTLREAWAV

SEQ ID NO: 1261473 - protein, 19 aa, Mycobacterium
DLADRVRRSAAAALEAYRV

SEQ ID NO: 1261474 - protein, 19 aa, Mycobacterium
DLAELPAQVEAARREAQSA

SEQ ID NO: 1261475 - protein, 26 aa, Mycobacterium
DLAEWSHDDPVRWGVWVAPCPVPRAL

SEQ ID NO: 1261476 - protein, 22 aa, Mycobacterium
DLAGACSMAAFTASMHAGQGCA

SEQ ID NO: 1261477 - protein, 17 aa, Mycobacterium
DLAGLPPAWVGVGTLDL

SEQ ID NO: 1261478 - protein, 25 aa, Mycobacterium
DLAGLRPRRFVVLPWLTPTLASHWV

SEQ ID NO: 1261479 - protein, 26 aa, Mycobacterium
DLAGPAGRRWPVYGPAMLAMRIHGVS

SEQ ID NO: 1261480 - protein, 26 aa, Mycobacterium
DLAGPKLRTGPIRPGPRVVKLHPKRD

SEQ ID NO: 1261481 - protein, 18 aa, Mycobacterium
DLAIARVWAKTGAKPTAL

SEQ ID NO: 1261482 - protein, 20 aa, Mycobacterium
DLAKMLWRRMIDNVEQYLDE

SEQ ID NO: 1261483 - protein, 19 aa, Mycobacterium
DLALSRYIERHPRAWESLR

SEQ ID NO: 1261484 - protein, 26 aa, Mycobacterium
DLALYESLFRGIDWQVILYDQLNFVA

SEQ ID NO: 1261485 - protein, 20 aa, Mycobacterium
DLAPPERSAMFLSELADLVL

SEQ ID NO: 1261486 - protein, 24 aa, Mycobacterium
DLARVPLWVEETLRFDTSSQILAR

SEQ ID NO: 1261487 - protein, 24 aa, Mycobacterium
DLASRAAGGAVVWADDELFAEKEN

SEQ ID NO: 1261488 - protein, 24 aa, Mycobacterium
DLATCPPLRAELCRIDDGNHILRL

SEQ ID NO: 1261489 - protein, 18 aa, Mycobacterium
DLAVAVEYLGLWDTFAVP

SEQ ID NO: 1261490 - protein, 26 aa, Mycobacterium
DLAVMLRAALKYPLIAQIMRSPTAPF

SEQ ID NO: 1261491 - protein, 17 aa, Mycobacterium
DLAVTFRFGEEVTGVDV

SEQ ID NO: 1261492 - protein, 18 aa, Mycobacterium
DLCDVETKVAAAREPVLA

SEQ ID NO: 1261493 - protein, 21 aa, Mycobacterium
DLCDVVPMIVVYATSAVMAAR

SEQ ID NO: 1261494 - protein, 24 aa, Mycobacterium
DLCNLRCTYCMPAEGLDWLPSDEK

SEQ ID NO: 1261495 - protein, 17 aa, Mycobacterium
DLDDLLLTTYGELRKYS

SEQ ID NO: 1261496 - protein, 23 aa, Mycobacterium
DLDETACLVAEVGVRVVTEVVDV

SEQ ID NO: 1261497 - protein, 18 aa, Mycobacterium
DLDGAFVAPAFVDTHVHT

SEQ ID NO: 1261498 - protein, 26 aa, Mycobacterium
DLDKSRYGLVPVHCDVWEGFIFVNFA

SEQ ID NO: 1261499 - protein, 25 aa, Mycobacterium
DLDPWCEFAKTAGRGKRLWSSQRRP

SEQ ID NO: 1261500 - protein, 17 aa, Mycobacterium
DLDRDLVLWAGGSGITP

SEQ ID NO: 1261501 - protein, 18 aa, Mycobacterium
DLDRLGDQLLHQFSLTDA

SEQ ID NO: 1261502 - protein, 19 aa, Mycobacterium
DLEAARKVLKLVDALEDSD

SEQ ID NO: 1261503 - protein, 25 aa, Mycobacterium
DLEHWPAFLTSFLRLSALIRAAASR

SEQ ID NO: 1261504 - protein, 23 aa, Mycobacterium
DLEHWPAFVKSFLRLTTMIRKAA

SEQ ID NO: 1261505 - protein, 19 aa, Mycobacterium
DLEKFLAWEDMILHQSGVG

SEQ ID NO: 1261506 - protein, 17 aa, Mycobacterium
DLEKIVIIDGDGDGEFV

SEQ ID NO: 1261507 - protein, 25 aa, Mycobacterium
DLELRLGDQVAKGFASHGESWSMAL

SEQ ID NO: 1261508 - protein, 31 aa, Mycobacterium
DLEPPADDSARLWFEVAKPLMSTNPQRSGPH

SEQ ID NO: 1261509 - protein, 18 aa, Mycobacterium
DLEVFICGGASVPPSLIR

SEQ ID NO: 1261510 - protein, 23 aa, Mycobacterium
DLEVLEPLSSYRVVLRGRGEAHD

SEQ ID NO: 1261511 - protein, 26 aa, Mycobacterium
DLEYELEGLLGRPAVRPLNITHSMDL

SEQ ID NO: 1261512 - protein, 25 aa, Mycobacterium
DLFEVNEAFAPVVLAWARDTGADLA

SEQ ID NO: 1261513 - protein, 25 aa, Mycobacterium
DLFEVNEAFAPVVLAWARDTGADLD

SEQ ID NO: 1261514 - protein, 27 aa, Mycobacterium
DLFPALKELLGRRAGLLSGGQRQQLAI

SEQ ID NO: 1261515 - protein, 22 aa, Mycobacterium
DLFPHAVKWRGNVYLEDGLHRA

SEQ ID NO: 1261516 - protein, 26 aa, Mycobacterium
DLFQRWPTDWTDHWRALTMPAVAVRA

SEQ ID NO: 1261517 - protein, 23 aa, Mycobacterium
DLGAEDGLMAWLIGGLEKTTQNS

SEQ ID NO: 1261518 - protein, 25 aa, Mycobacterium
DLGARLTVGYSLAWQGRGREADAVL

SEQ ID NO: 1261519 - protein, 19 aa, Mycobacterium
DLGATGWSLDPGHLDMRTR

SEQ ID NO: 1261520 - protein, 22 aa, Mycobacterium
DLGDGHPLLGLRMPDLDLETAH

SEQ ID NO: 1261521 - protein, 26 aa, Mycobacterium
DLGEWPGPEWVTPIRARFRGVDVYEM

SEQ ID NO: 1261522 - protein, 18 aa, Mycobacterium
DLGGASAVGMVWRAAAAI

SEQ ID NO: 1261523 - protein, 23 aa, Mycobacterium
DLGGLPMELGAQWIGDTHHRMFA

SEQ ID NO: 1261524 - protein, 24 aa, Mycobacterium
DLGIGLPTLIPGHLSPGVRVILHS

SEQ ID NO: 1261525 - protein, 25 aa, Mycobacterium
DLGITMSDIGFWCSGSSDYLAGRAF

SEQ ID NO: 1261526 - protein, 27 aa, Mycobacterium
DLGKPLYTVRGWVPWTGPTSVLALDGA

SEQ ID NO: 1261527 - protein, 17 aa, Mycobacterium
DLGLAYRYAELVEDEAL

SEQ ID NO: 1261528 - protein, 20 aa, Mycobacterium
DLGLPVVVRPSFTMGGLGSG

SEQ ID NO: 1261529 - protein, 18 aa, Mycobacterium
DLGQEWDDNFVFPSGMLL

SEQ ID NO: 1261530 - protein, 25 aa, Mycobacterium
DLGRKGFPRLLRISAKLPATGSNKV

SEQ ID NO: 1261531 - protein, 17 aa, Mycobacterium
DLGRVCRPGTVKVEDYS

SEQ ID NO: 1261532 - protein, 27 aa, Mycobacterium
DLGVQRLRMVAGWSLGGMQSLEFASRY

SEQ ID NO: 1261533 - protein, 18 aa, Mycobacterium
DLHAIAILFSRTDEQYRA

SEQ ID NO: 1261534 - protein, 25 aa, Mycobacterium
DLHKWCFELPRAPILHVQGKQDGAM

SEQ ID NO: 1261535 - protein, 28 aa, Mycobacterium
DLHLRSRRWSSFPAYARSKLAVMLWGLE

SEQ ID NO: 1261536 - protein, 24 aa, Mycobacterium
DLHLTLKHVHWNVVGPNFIGVHEM

SEQ ID NO: 1261537 - protein, 20 aa, Mycobacterium
DLHRAISTFARMDAVVITAV

SEQ ID NO: 1261538 - protein, 30 aa, Mycobacterium
DLIDDRFWLHLGMGWQFFAPDDYIRRLTSV

SEQ ID NO: 1261539 - protein, 24 aa, Mycobacterium
DLIDPALLRPGRLEKLVFVEPPDA

SEQ ID NO: 1261540 - protein, 25 aa, Mycobacterium
DLIDPALLRPGRLERLVFVEPPDAE

SEQ ID NO: 1261541 - protein, 28 aa, Mycobacterium
DLIDPSAWAFTWVVDWPLFEPADDATAS

SEQ ID NO: 1261542 - protein, 18 aa, Mycobacterium
DLIEAMPVQRIRDICDYH

SEQ ID NO: 1261543 - protein, 19 aa, Mycobacterium
DLILCTLPTSAARHRFFEA

SEQ ID NO: 1261544 - protein, 20 aa, Mycobacterium
DLILFRRGGAPAALADSIRN

SEQ ID NO: 1261545 - protein, 24 aa, Mycobacterium
DLIRDAWDAIAPRFDEFVTPESMQ

SEQ ID NO: 1261546 - protein, 19 aa, Mycobacterium
DLKFMRFIGTEIFPGGQLP

SEQ ID NO: 1261547 - protein, 33 aa, Mycobacterium
DLKPGMTLLEVGCGWGLTLQRAMEKYDVNVIGL

SEQ ID NO: 1261548 - protein, 26 aa, Mycobacterium
DLKVKRRMAGMLARRGYSQSMALDVV

SEQ ID NO: 1261549 - protein, 17 aa, Mycobacterium
DLLAALCDILSCTPNDL

SEQ ID NO: 1261550 - protein, 20 aa, Mycobacterium
DLLAFTAFPKQIWRQIWSNN

SEQ ID NO: 1261551 - protein, 26 aa, Mycobacterium
DLLAKDRVVDWSVLVDAGWTGLEVPD

SEQ ID NO: 1261552 - protein, 24 aa, Mycobacterium
DLLDSWPGTLIVVSHDRYFLERVT

SEQ ID NO: 1261553 - protein, 24 aa, Mycobacterium
DLLDSWPGTLIVVSHDRYLLERIT

SEQ ID NO: 1261554 - protein, 21 aa, Mycobacterium
DLLEFPALVAELGYEYLQLTP

SEQ ID NO: 1261555 - protein, 18 aa, Mycobacterium
DLLEGLQYLAGCVAACTH

SEQ ID NO: 1261556 - protein, 18 aa, Mycobacterium
DLLFWVAEYRRLPKLRAV

SEQ ID NO: 1261557 - protein, 23 aa, Mycobacterium
DLLGEYRRTGVWRRIGLMDCGER

SEQ ID NO: 1261558 - protein, 24 aa, Mycobacterium
DLLGLPWAELNTHPLYHPSKGLPP

SEQ ID NO: 1261559 - protein, 26 aa, Mycobacterium
DLLHLVDFPLSLGIRPNIPYEDQRKI

SEQ ID NO: 1261560 - protein, 18 aa, Mycobacterium
DLLICGGGHGTVAKSLLA

SEQ ID NO: 1261561 - protein, 19 aa, Mycobacterium
DLLILGALVHDIGKGRGGD

SEQ ID NO: 1261562 - protein, 18 aa, Mycobacterium
DLLPMAFSECARTVDKGL

SEQ ID NO: 1261563 - protein, 22 aa, Mycobacterium
DLLRRRPWRAVRDAIAEADRLL

SEQ ID NO: 1261564 - protein, 23 aa, Mycobacterium
DLLRRVDPQLSMLIPVEDYPLID

SEQ ID NO: 1261565 - protein, 18 aa, Mycobacterium
DLLTRPDLVAALDELETL

SEQ ID NO: 1261566 - protein, 19 aa, Mycobacterium
DLLTRPDLVAALDELETLG

SEQ ID NO: 1261567 - protein, 18 aa, Mycobacterium
DLLTRPDLVAALDELETV

SEQ ID NO: 1261568 - protein, 20 aa, Mycobacterium
DLLTSILTYHVVPGQAAPDQ

SEQ ID NO: 1261569 - protein, 21 aa, Mycobacterium
DLLVIGGGYTGLWSALHAARR

SEQ ID NO: 1261570 - protein, 18 aa, Mycobacterium
DLLVPRAQVADWRDRLTA

SEQ ID NO: 1261571 - protein, 23 aa, Mycobacterium
DLLWEPTDLYPAEVLTGALSAPG

SEQ ID NO: 1261572 - protein, 17 aa, Mycobacterium
DLLWRNRRGELDMSVVM

SEQ ID NO: 1261573 - protein, 19 aa, Mycobacterium
DLLWSRPIKEYPDLKIALS

SEQ ID NO: 1261574 - protein, 24 aa, Mycobacterium
DLMAAVRLPSGYFRQSGTDVVADV

SEQ ID NO: 1261575 - protein, 19 aa, Mycobacterium
DLMAKRGLKEIGVLVEQSL

SEQ ID NO: 1261576 - protein, 21 aa, Mycobacterium
DLMCQTLMPALGVAAPADIDG

SEQ ID NO: 1261577 - protein, 18 aa, Mycobacterium
DLNIPAVHLQYGQDIVTS

SEQ ID NO: 1261578 - protein, 22 aa, Mycobacterium
DLPACGSVTLSFDVRPPRWLPP

SEQ ID NO: 1261579 - protein, 18 aa, Mycobacterium
DLPAWVDVDTRAHADRQL

SEQ ID NO: 1261580 - protein, 24 aa, Mycobacterium
DLPCYAAELNQVWTHLIANALDAL

SEQ ID NO: 1261581 - protein, 23 aa, Mycobacterium
DLPDLEAVTAMYLTHREERLDQV

SEQ ID NO: 1261582 - protein, 20 aa, Mycobacterium
DLPFACGPVPEWLTHADVVS

SEQ ID NO: 1261583 - protein, 21 aa, Mycobacterium
DLPHGEALLFDGRVHTYEAVD

SEQ ID NO: 1261584 - protein, 26 aa, Mycobacterium
DLPLLRPGDDVFVSWAPDASLVLPGA

SEQ ID NO: 1261585 - protein, 18 aa, Mycobacterium
DLPPRPGQPESWPQWAHP

SEQ ID NO: 1261586 - protein, 17 aa, Mycobacterium
DLPPRRARAQAWPHWAD

SEQ ID NO: 1261587 - protein, 17 aa, Mycobacterium
DLPPSRRAPSDVNPVLP

SEQ ID NO: 1261588 - protein, 24 aa, Mycobacterium
DLPPVGVVVFCDFGGNPATLDGTD

SEQ ID NO: 1261589 - protein, 19 aa, Mycobacterium
DLPRCTAAMSCIDIISDEG

SEQ ID NO: 1261590 - protein, 19 aa, Mycobacterium
DLPRFPFTPADPLIVARTN

SEQ ID NO: 1261591 - protein, 22 aa, Mycobacterium
DLPRIEAALAHLYEYCDELIAD

SEQ ID NO: 1261592 - protein, 18 aa, Mycobacterium
DLPRRLFEELPLAEVDFD

SEQ ID NO: 1261593 - protein, 22 aa, Mycobacterium
DLPRTDFLFMLGANPLVSHGSG

SEQ ID NO: 1261594 - protein, 18 aa, Mycobacterium
DLQAFRDGLVVQRAAAGP

SEQ ID NO: 1261595 - protein, 26 aa, Mycobacterium
DLQAQMMALADAWDGAGSEAARDEAS

SEQ ID NO: 1261596 - protein, 18 aa, Mycobacterium
DLQMWVAACLFVGLEDTY

SEQ ID NO: 1261597 - protein, 20 aa, Mycobacterium
DLQQRMGLTAIWVTHDQEEA

SEQ ID NO: 1261598 - protein, 25 aa, Mycobacterium
DLRAGEPVAICLGTAAAAYGFDTED

SEQ ID NO: 1261599 - protein, 33 aa, Mycobacterium
DLRDWRQWWTWSPGACWRHPFGPESSWHDRPDH

SEQ ID NO: 1261600 - protein, 19 aa, Mycobacterium
DLREPGCAKRIVAAAVDAF

SEQ ID NO: 1261601 - protein, 20 aa, Mycobacterium
DLRKLEALAARAMRHSQGSP

SEQ ID NO: 1261602 - protein, 20 aa, Mycobacterium
DLRLVVIDYLQLMTSGKKVE

SEQ ID NO: 1261603 - protein, 23 aa, Mycobacterium
DLRRELEKLGFHRFFETADSVKH

SEQ ID NO: 1261604 - protein, 17 aa, Mycobacterium
DLRRSRGDRQRDAIIAA

SEQ ID NO: 1261605 - protein, 20 aa, Mycobacterium
DLRTALDLLAERGLVRVLTE

SEQ ID NO: 1261606 - protein, 19 aa, Mycobacterium
DLRTGERACAVIVAADSAA

SEQ ID NO: 1261607 - protein, 20 aa, Mycobacterium
DLRVGGGLGPAAGARVDCGL

SEQ ID NO: 1261608 - protein, 25 aa, Mycobacterium
DLRVTYASFQWEWCNDQGDPPFHGR

SEQ ID NO: 1261609 - protein, 24 aa, Mycobacterium
DLSALRYILCGGSAVPKALSEEYR

SEQ ID NO: 1261610 - protein, 34 aa, Mycobacterium
DLSARPGLSYQLAEGIALLSKVDWRARGLADLGR

SEQ ID NO: 1261611 - protein, 19 aa, Mycobacterium
DLSDEFFRLFLDPTQTYSC

SEQ ID NO: 1261612 - protein, 23 aa, Mycobacterium
DLSEGRFELGLGTGYVKEEFDAA

SEQ ID NO: 1261613 - protein, 20 aa, Mycobacterium
DLSKHPGLYGNLAVDHLWVN

SEQ ID NO: 1261614 - protein, 22 aa, Mycobacterium
DLSRDGAFLVTTWQGPAPGAAL

SEQ ID NO: 1261615 - protein, 24 aa, Mycobacterium
DLSTLRFALSGAEPVEPADVEDLL

SEQ ID NO: 1261616 - protein, 19 aa, Mycobacterium
DLSTVAMLWNLHGASELQI

SEQ ID NO: 1261617 - protein, 19 aa, Mycobacterium
DLSVPTRRGDWWYYGRSFE

SEQ ID NO: 1261618 - protein, 19 aa, Mycobacterium
DLSVPTRRGDWWYYGRSFQ

SEQ ID NO: 1261619 - protein, 23 aa, Mycobacterium
DLTAKGFAGTIFLTTDDCRASYE

SEQ ID NO: 1261620 - protein, 23 aa, Mycobacterium
DLTDYLLEMGIRVRYLHSEVDTL

SEQ ID NO: 1261621 - protein, 24 aa, Mycobacterium
DLTGWSLGALIAMRVARDDDTRVR

SEQ ID NO: 1261622 - protein, 26 aa, Mycobacterium
DLTPARSWGASTLIPFFGGLTSVPVS

SEQ ID NO: 1261623 - protein, 24 aa, Mycobacterium
DLTPPALMKAILKAPADLLWNGGI

SEQ ID NO: 1261624 - protein, 23 aa, Mycobacterium
DLTQRIYTDFTYRSGSTTVSTKV

SEQ ID NO: 1261625 - protein, 20 aa, Mycobacterium
DLTRGLAIVRRGKGSKGRVV

SEQ ID NO: 1261626 - protein, 22 aa, Mycobacterium
DLTRTDFLVVMGANPVVSHGSF

SEQ ID NO: 1261627 - protein, 22 aa, Mycobacterium
DLVCGFCSRALDPLRDAEGFDF

SEQ ID NO: 1261628 - protein, 24 aa, Mycobacterium
DLVDAIGVDAARYALIRSSVDTPI

SEQ ID NO: 1261629 - protein, 24 aa, Mycobacterium
DLVDRGGGELVFLSGEVRARTDVV

SEQ ID NO: 1261630 - protein, 24 aa, Mycobacterium
DLVEAIGVDAARYSLIRSSVDTPI

SEQ ID NO: 1261631 - protein, 29 aa, Mycobacterium
DLVFSRAKVAVFLDGCFWHGCPDHHTVAV

SEQ ID NO: 1261632 - protein, 17 aa, Mycobacterium
DLVKAKDPAAVWEAMTP

SEQ ID NO: 1261633 - protein, 26 aa, Mycobacterium
DLVKHFPIKSGIVIEREVGRVRAVDG

SEQ ID NO: 1261634 - protein, 24 aa, Mycobacterium
DLVKRYARVRFDGVEVGESAAVGT

SEQ ID NO: 1261635 - protein, 20 aa, Mycobacterium
DLVLLRAGKILAHTTPARLR

SEQ ID NO: 1261636 - protein, 24 aa, Mycobacterium
DLVRDYAYHTAIAIVIARARGTAN

SEQ ID NO: 1261637 - protein, 23 aa, Mycobacterium
DLVRGSDGWQIVPEMSPDDGEPV

SEQ ID NO: 1261638 - protein, 24 aa, Mycobacterium
DLVRYRPGGVIEFVGRADHRIKIS

SEQ ID NO: 1261639 - protein, 23 aa, Mycobacterium
DLVSPRGKRQFRRGVFDPVTDTV

SEQ ID NO: 1261640 - protein, 18 aa, Mycobacterium
DLVTCNPPYVPHAPEADR

SEQ ID NO: 1261641 - protein, 17 aa, Mycobacterium
DLVVSHVVEMVLTGRLR

SEQ ID NO: 1261642 - protein, 25 aa, Mycobacterium
DLYGPRWAMVRAFNAANDIDRIEVD

SEQ ID NO: 1261643 - protein, 17 aa, Mycobacterium
DLYWAARGSGPGFFAVV

SEQ ID NO: 1261644 - protein, 21 aa, Mycobacterium
DMAGEGWLNHELYVRAIPSVS

SEQ ID NO: 1261645 - protein, 19 aa, Mycobacterium
DMEIWLRVDAGQFDRARAL

SEQ ID NO: 1261646 - protein, 20 aa, Mycobacterium
DMFTLGFRFKPWTSDKAIAD

SEQ ID NO: 1261647 - protein, 28 aa, Mycobacterium
DMGSGRYRLKCVIGERIRVLEWLPDDPY

SEQ ID NO: 1261648 - protein, 26 aa, Mycobacterium
DMIAEAGDWLSCWTMGLNQSTHGTWN

SEQ ID NO: 1261649 - protein, 20 aa, Mycobacterium
DMPAMLAAFHRAHPAVEITL

SEQ ID NO: 1261650 - protein, 23 aa, Mycobacterium
DMPGMPGMGDMPGMEGMMSEEDM

SEQ ID NO: 1261651 - protein, 20 aa, Mycobacterium
DMPMNLPVVGGHEGAGVVAE

SEQ ID NO: 1261652 - protein, 20 aa, Mycobacterium
DMPMNLPVVGGHEGAGVVVD

SEQ ID NO: 1261653 - protein, 21 aa, Mycobacterium
DMVPMRRVGHVDEMASAAVFL

SEQ ID NO: 1261654 - protein, 24 aa, Mycobacterium
DMYRSVLEAIAFGFRHHVDVFAEI

SEQ ID NO: 1261655 - protein, 18 aa, Mycobacterium
DNAGGAWPERARAACRYF

SEQ ID NO: 1261656 - protein, 26 aa, Mycobacterium
DNAYLGHVIVLWSWALKQPNDGRPAS

SEQ ID NO: 1261657 - protein, 19 aa, Mycobacterium
DNCWYPPRTLRAVVETLAE

SEQ ID NO: 1261658 - protein, 24 aa, Mycobacterium
DNDRKPCGYGRMLRKEDPRFVRGR

SEQ ID NO: 1261659 - protein, 20 aa, Mycobacterium
DNEFTRSWLDGMAQQSEGGP

SEQ ID NO: 1261660 - protein, 21 aa, Mycobacterium
DNELRDAMVLLIFGGFDTTRN

SEQ ID NO: 1261661 - protein, 25 aa, Mycobacterium
DNEVYRLAKHLDEKVARIHVEALGG

SEQ ID NO: 1261662 - protein, 19 aa, Mycobacterium
DNFVFPAGMLLVFEPVVWQ

SEQ ID NO: 1261663 - protein, 21 aa, Mycobacterium
DNGIKIFGPGGHKLDDATEDR

SEQ ID NO: 1261664 - protein, 18 aa, Mycobacterium
DNGTFCAGADLKAMGTEN

SEQ ID NO: 1261665 - protein, 24 aa, Mycobacterium
DNLLPAITFIFSRAGCDAAVKQCL

SEQ ID NO: 1261666 - protein, 24 aa, Mycobacterium
DNLRLETLAAHWGVTQMKPHDALD

SEQ ID NO: 1261667 - protein, 25 aa, Mycobacterium
DNLTGWLALLAPDIIYRAPVRTTRD

SEQ ID NO: 1261668 - protein, 24 aa, Mycobacterium
DNQRTCFVTALGDRAFRVSAAVFI

SEQ ID NO: 1261669 - protein, 18 aa, Mycobacterium
DNQVARARRRFDWGVPLG

SEQ ID NO: 1261670 - protein, 18 aa, Mycobacterium
DNVALRWLAAEMLHTLDS

SEQ ID NO: 1261671 - protein, 24 aa, Mycobacterium
DPAAIRLGLFAGHYRDDRFWSPAV

SEQ ID NO: 1261672 - protein, 19 aa, Mycobacterium
DPAAPIAIRRGDRIAQLLV

SEQ ID NO: 1261673 - protein, 22 aa, Mycobacterium
DPAEVADAYFALMDHLGTDGLL

SEQ ID NO: 1261674 - protein, 23 aa, Mycobacterium
DPAEWKVFLSLVREGFEKDKTKW

SEQ ID NO: 1261675 - protein, 24 aa, Mycobacterium
DPAGLDFGLKYGDQAQEFASALAD

SEQ ID NO: 1261676 - protein, 22 aa, Mycobacterium
DPAGTFRRLFAMDVADEQSALR

SEQ ID NO: 1261677 - protein, 21 aa, Mycobacterium
DPAGVRRALMLTGQHAALDDL

SEQ ID NO: 1261678 - protein, 23 aa, Mycobacterium
DPAKLKRLIVDLIDKENWSASGT

SEQ ID NO: 1261679 - protein, 22 aa, Mycobacterium
DPAKRLAQALGIRDLGNTPQRV

SEQ ID NO: 1261680 - protein, 20 aa, Mycobacterium
DPALLRFAAARTDLSADTLP

SEQ ID NO: 1261681 - protein, 20 aa, Mycobacterium
DPALLRFAAARTDLSAETLP

SEQ ID NO: 1261682 - protein, 20 aa, Mycobacterium
DPANFCGPLVSAKQRDRVME

SEQ ID NO: 1261683 - protein, 23 aa, Mycobacterium
DPAPKGIFPWYAPGVDGQLGEFP

SEQ ID NO: 1261684 - protein, 23 aa, Mycobacterium
DPARAADVLGFRAVVDPADGLCE

SEQ ID NO: 1261685 - protein, 23 aa, Mycobacterium
DPASNVGQVFGLRVGNAITTVPA

SEQ ID NO: 1261686 - protein, 35 aa, Mycobacterium
DPAWDLARPAGFWAAGLIPDVDWQTFLEAYRARGP

SEQ ID NO: 1261687 - protein, 17 aa, Mycobacterium
DPAWPGLVAAISAADPQ

SEQ ID NO: 1261688 - protein, 18 aa, Mycobacterium
DPAWSFGPEGQRYEMEVR

SEQ ID NO: 1261689 - protein, 25 aa, Mycobacterium
DPAYPQDRLEFILGDCDAKVVVREP

SEQ ID NO: 1261690 - protein, 28 aa, Mycobacterium
DPCAEAFRAEWLLAFLAADLRGGIPEGL

SEQ ID NO: 1261691 - protein, 24 aa, Mycobacterium
DPDAPKHKGISCFIVDMSSPGIEA

SEQ ID NO: 1261692 - protein, 17 aa, Mycobacterium
DPDEMNGVIPLRTGEYD

SEQ ID NO: 1261693 - protein, 25 aa, Mycobacterium
DPDERGMRTVMCILNGQLRPVVVRD

SEQ ID NO: 1261694 - protein, 23 aa, Mycobacterium
DPDGPCGCGRGFAGAASHRATTT

SEQ ID NO: 1261695 - protein, 24 aa, Mycobacterium
DPDHPAHLQPGVAVDVRDPDLTAR

SEQ ID NO: 1261696 - protein, 26 aa, Mycobacterium
DPDLLRTVLMLLRTAALAASTRRGAK

SEQ ID NO: 1261697 - protein, 20 aa, Mycobacterium
DPDLPGWLRARRPAHGLTLL

SEQ ID NO: 1261698 - protein, 18 aa, Mycobacterium
DPDLPPSHHYLAAYRWLD

SEQ ID NO: 1261699 - protein, 23 aa, Mycobacterium
DPDLRGVFAGMHLGHTRADMYRS

SEQ ID NO: 1261700 - protein, 32 aa, Mycobacterium
DPDLVELPGWYRPNPGLARDLAFIGFSTISGE

SEQ ID NO: 1261701 - protein, 22 aa, Mycobacterium
DPDRLAAPLIRRDGVLTEATWD

SEQ ID NO: 1261702 - protein, 20 aa, Mycobacterium
DPDVPPALRRLVLEGRAGVE

SEQ ID NO: 1261703 - protein, 29 aa, Mycobacterium
DPEAAWELGIGVLLTGVWNTLQIASAHMV

SEQ ID NO: 1261704 - protein, 31 aa, Mycobacterium
DPEARGLGVLVSFAGTVRRPLGLRKVATEDL

SEQ ID NO: 1261705 - protein, 22 aa, Mycobacterium
DPEAVVTPGIYVDDLVQIPRPR

SEQ ID NO: 1261706 - protein, 19 aa, Mycobacterium
DPEGLIPATTIPSVRGAKP

SEQ ID NO: 1261707 - protein, 21 aa, Mycobacterium
DPEGYKLTVYDAVRITWGGVY

SEQ ID NO: 1261708 - protein, 28 aa, Mycobacterium
DPEGYLIKGEYGVRVTWGGVYVHSAPWS

SEQ ID NO: 1261709 - protein, 21 aa, Mycobacterium
DPEIGPSWHLGVLPMDDGSVA

SEQ ID NO: 1261710 - protein, 24 aa, Mycobacterium
DPEIVRALDMLFILHADHEQNCST

SEQ ID NO: 1261711 - protein, 23 aa, Mycobacterium
DPEKGRWALPGGHLGPDEDLTSS

SEQ ID NO: 1261712 - protein, 23 aa, Mycobacterium
DPELFLPLRYGRVEVRERMPRRF

SEQ ID NO: 1261713 - protein, 23 aa, Mycobacterium
DPELIPKLMTAGVIEVAPLAFMR

SEQ ID NO: 1261714 - protein, 25 aa, Mycobacterium
DPERAVLASLRWDEQFGDRHISLTA

SEQ ID NO: 1261715 - protein, 19 aa, Mycobacterium
DPERIAVIDLDGWEGYGTR

SEQ ID NO: 1261716 - protein, 25 aa, Mycobacterium
DPERLKSGWLNGIKHWQVDYTGQCP

SEQ ID NO: 1261717 - protein, 18 aa, Mycobacterium
DPESLVLDALAERPGDDG

SEQ ID NO: 1261718 - protein, 30 aa, Mycobacterium
DPETIAYGLIPRAHRGIVAVNELPDLAERI

SEQ ID NO: 1261719 - protein, 21 aa, Mycobacterium
DPEWAGWCSVLVNVNDLSAMG

SEQ ID NO: 1261720 - protein, 18 aa, Mycobacterium
DPFGKLSLLAATSEQARE

SEQ ID NO: 1261721 - protein, 19 aa, Mycobacterium
DPFHGAGILNFVFGEMWLR

SEQ ID NO: 1261722 - protein, 17 aa, Mycobacterium
DPFLPLLLAADRSTSLQ

SEQ ID NO: 1261723 - protein, 18 aa, Mycobacterium
DPFRGMKKYQGWDDPVRT

SEQ ID NO: 1261724 - protein, 19 aa, Mycobacterium
DPGAALRLVGATDIHHRDL

SEQ ID NO: 1261725 - protein, 27 aa, Mycobacterium
DPGEALFDFLRAIAVEWGAADRVLIDG

SEQ ID NO: 1261726 - protein, 30 aa, Mycobacterium
DPGETRFYVSLCDELMRRSATFDLEKLMSR

SEQ ID NO: 1261727 - protein, 26 aa, Mycobacterium
DPGFEFMVLPWPDYYGSAPGARDDGY

SEQ ID NO: 1261728 - protein, 17 aa, Mycobacterium
DPGKLILGSVAWSQVAR

SEQ ID NO: 1261729 - protein, 20 aa, Mycobacterium
DPGKLPAIRQQIWTLMRAAK

SEQ ID NO: 1261730 - protein, 18 aa, Mycobacterium
DPGQLAWLDAGLAALSGT

SEQ ID NO: 1261731 - protein, 21 aa, Mycobacterium
DPGRGRRLGVDVGTVRIGVAV

SEQ ID NO: 1261732 - protein, 21 aa, Mycobacterium
DPGRIATILARQAPPELRAVY

SEQ ID NO: 1261733 - protein, 17 aa, Mycobacterium
DPGRLRIGVRVPTAITP

SEQ ID NO: 1261734 - protein, 25 aa, Mycobacterium
DPGSRSTICGLQLEHSDVITFHSYG

SEQ ID NO: 1261735 - protein, 17 aa, Mycobacterium
DPGVRLIGYEAAGDGVE

SEQ ID NO: 1261736 - protein, 17 aa, Mycobacterium
DPGVSIDTITGVFLAAL

SEQ ID NO: 1261737 - protein, 19 aa, Mycobacterium
DPHAPIVIRRGDRIAQLLV

SEQ ID NO: 1261738 - protein, 17 aa, Mycobacterium
DPHLLRFVGDRNDSLDG

SEQ ID NO: 1261739 - protein, 19 aa, Mycobacterium
DPHVSIGLVAADGGPLVWG

SEQ ID NO: 1261740 - protein, 20 aa, Mycobacterium
DPIAIVGMACRFPGADDTDA

SEQ ID NO: 1261741 - protein, 24 aa, Mycobacterium
DPIPRPRIDLEVGSWYVSTYPESV

SEQ ID NO: 1261742 - protein, 17 aa, Mycobacterium
DPIVCAPLTAGTWRDYW

SEQ ID NO: 1261743 - protein, 19 aa, Mycobacterium
DPKAWGRYCADRIAEAIEF

SEQ ID NO: 1261744 - protein, 24 aa, Mycobacterium
DPLALERQVCFALAATNRAVLAIY

SEQ ID NO: 1261745 - protein, 24 aa, Mycobacterium
DPLALERQVCFALAVANRAVLGVY

SEQ ID NO: 1261746 - protein, 21 aa, Mycobacterium
DPLAQVATAWSRCTRIVDPTR

SEQ ID NO: 1261747 - protein, 18 aa, Mycobacterium
DPLDALLWLAERPGEPSW

SEQ ID NO: 1261748 - protein, 23 aa, Mycobacterium
DPLGGASVDYWAAISERHNLQLT

SEQ ID NO: 1261749 - protein, 17 aa, Mycobacterium
DPLIMRRALEYASGLGV

SEQ ID NO: 1261750 - protein, 19 aa, Mycobacterium
DPLLACVLTGFGVTSLSAA

SEQ ID NO: 1261751 - protein, 24 aa, Mycobacterium
DPLLADLDCGRWRGDVLGGVEPAE

SEQ ID NO: 1261752 - protein, 17 aa, Mycobacterium
DPLLGLSSQERVLLDLL

SEQ ID NO: 1261753 - protein, 18 aa, Mycobacterium
DPLLLLPLLRTMPPVPVL

SEQ ID NO: 1261754 - protein, 17 aa, Mycobacterium
DPLLRLATFFDDGTVEL

SEQ ID NO: 1261755 - protein, 17 aa, Mycobacterium
DPLPLWQNGDWSVSWDR

SEQ ID NO: 1261756 - protein, 25 aa, Mycobacterium
DPLVEIPIQWALDDWEQYCFLPDIS

SEQ ID NO: 1261757 - protein, 21 aa, Mycobacterium
DPLVRACMLTFLSDFGPVPVA

SEQ ID NO: 1261758 - protein, 18 aa, Mycobacterium
DPLYKFVLRQFVGYIVEK

SEQ ID NO: 1261759 - protein, 17 aa, Mycobacterium
DPLYMAMVEKLSAATPD

SEQ ID NO: 1261760 - protein, 19 aa, Mycobacterium
DPMPMLTLFDKQIQVRMGQ

SEQ ID NO: 1261761 - protein, 22 aa, Mycobacterium
DPNELWVGDALHGPRVGDRKTY

SEQ ID NO: 1261762 - protein, 18 aa, Mycobacterium
DPPEALLRLRAHAYSTGR

SEQ ID NO: 1261763 - protein, 18 aa, Mycobacterium
DPQAEFTTVWPRRDSVEY

SEQ ID NO: 1261764 - protein, 18 aa, Mycobacterium
DPQGCLTFSLGQDPDKLP

SEQ ID NO: 1261765 - protein, 21 aa, Mycobacterium
DPQGSAVWWASRINALPFHIA

SEQ ID NO: 1261766 - protein, 23 aa, Mycobacterium
DPQHRLFLQTVFHAMEDAGYDPK

SEQ ID NO: 1261767 - protein, 31 aa, Mycobacterium
DPQLPGGISRLRFRLRWRGFRVTVDADHDAV

SEQ ID NO: 1261768 - protein, 24 aa, Mycobacterium
DPQPTDLVLYRWHGLGPMGGTDLD

SEQ ID NO: 1261769 - protein, 17 aa, Mycobacterium
DPQQRLVLETAWEGLER

SEQ ID NO: 1261770 - protein, 25 aa, Mycobacterium
DPQQRMALELTWEALEDARIPASSL

SEQ ID NO: 1261771 - protein, 19 aa, Mycobacterium
DPQRWPVPCDRCGRHYQLV

SEQ ID NO: 1261772 - protein, 21 aa, Mycobacterium
DPQWPVALAHIDCDWYDPVKL

SEQ ID NO: 1261773 - protein, 24 aa, Mycobacterium
DPREIANAVAFLASDLASYAVGAV

SEQ ID NO: 1261774 - protein, 24 aa, Mycobacterium
DPREVCIGLSPAWGRSVWLTLCGL

SEQ ID NO: 1261775 - protein, 18 aa, Mycobacterium
DPRHPSWYFNVKANPAVT

SEQ ID NO: 1261776 - protein, 24 aa, Mycobacterium
DPRIRRLWPDFRTAERAYFDVTQV

SEQ ID NO: 1261777 - protein, 20 aa, Mycobacterium
DPRKVFDLLEHAPVDVAVLT

SEQ ID NO: 1261778 - protein, 20 aa, Mycobacterium
DPRLRSTVVTLILLDKSPDW

SEQ ID NO: 1261779 - protein, 24 aa, Mycobacterium
DPRNEWLFDESWGVDVAVSTPRML

SEQ ID NO: 1261780 - protein, 22 aa, Mycobacterium
DPRRGLAVGERVVWSVTAACGQ

SEQ ID NO: 1261781 - protein, 18 aa, Mycobacterium
DPRRSGATPPALPIGQQA

SEQ ID NO: 1261782 - protein, 26 aa, Mycobacterium
DPRTVAWLRAHHVAAFDGPLAAAPIL

SEQ ID NO: 1261783 - protein, 17 aa, Mycobacterium
DPRVRRLRAGDPLLAET

SEQ ID NO: 1261784 - protein, 24 aa, Mycobacterium
DPRWDLSQIDLFRGWMRCHEQTLR

SEQ ID NO: 1261785 - protein, 19 aa, Mycobacterium
DPRYRDWQVALSQVQGIYL

SEQ ID NO: 1261786 - protein, 24 aa, Mycobacterium
DPRYRTKMMWWDRSTFIRHAEPAQ

SEQ ID NO: 1261787 - protein, 23 aa, Mycobacterium
DPRYTRSRLRTEVLPLLEDVLAG

SEQ ID NO: 1261788 - protein, 24 aa, Mycobacterium
DPRYTRSRLRTEVLPLLEDVLAGG

SEQ ID NO: 1261789 - protein, 21 aa, Mycobacterium
DPSAADGWQLRRLTAPSRLFG

SEQ ID NO: 1261790 - protein, 18 aa, Mycobacterium
DPSARFTFGLHLLVDGIA

SEQ ID NO: 1261791 - protein, 19 aa, Mycobacterium
DPSLPRYTASAAHLHERAG

SEQ ID NO: 1261792 - protein, 17 aa, Mycobacterium
DPSPRAGEVVIEVARAG

SEQ ID NO: 1261793 - protein, 18 aa, Mycobacterium
DPSRVGLWGASFSGGHVL

SEQ ID NO: 1261794 - protein, 18 aa, Mycobacterium
DPSSPSFSPASPPTGASG

SEQ ID NO: 1261795 - protein, 22 aa, Mycobacterium
DPSVLGGPVFDPAWELAAAQRH

SEQ ID NO: 1261796 - protein, 23 aa, Mycobacterium
DPTAAWDAQAWRSRVRSSFDAGL

SEQ ID NO: 1261797 - protein, 19 aa, Mycobacterium
DPTKVVAVLDWEMSTLGDP

SEQ ID NO: 1261798 - protein, 22 aa, Mycobacterium
DPTRLAFCTILYGLSVVDEVSD

SEQ ID NO: 1261799 - protein, 21 aa, Mycobacterium
DPTVSALVYIAARAPDAGEDF

SEQ ID NO: 1261800 - protein, 22 aa, Mycobacterium
DPTWSDRCYFFAASPDGTMLLA

SEQ ID NO: 1261801 - protein, 17 aa, Mycobacterium
DPVALHHYMTFHSVVPA

SEQ ID NO: 1261802 - protein, 25 aa, Mycobacterium
DPVCWNDEHEFWALLKYEDIRYVST

SEQ ID NO: 1261803 - protein, 24 aa, Mycobacterium
DPVHPLEVGIEWVSAAPRAALRTL

SEQ ID NO: 1261804 - protein, 18 aa, Mycobacterium
DPVIGPFFEGGLMLLDFD

SEQ ID NO: 1261805 - protein, 20 aa, Mycobacterium
DPVKLTWEVYRDTVIEQCEQ

SEQ ID NO: 1261806 - protein, 23 aa, Mycobacterium
DPVPETLPEWFVREHNLMSEDEA

SEQ ID NO: 1261807 - protein, 24 aa, Mycobacterium
DPVQPCGLTGLLVADLSSMWAGPL

SEQ ID NO: 1261808 - protein, 19 aa, Mycobacterium
DPVRQWKLSPTDLASLDKW

SEQ ID NO: 1261809 - protein, 25 aa, Mycobacterium
DPVSARGSLRLSLGHTSTDADIDAV

SEQ ID NO: 1261810 - protein, 24 aa, Mycobacterium
DPVTPRAAGAIAHLNADHADSLAA

SEQ ID NO: 1261811 - protein, 19 aa, Mycobacterium
DPVVLAAMIVVRLQTVVSR

SEQ ID NO: 1261812 - protein, 18 aa, Mycobacterium
DPVWCPLPGTKIEGLHIA

SEQ ID NO: 1261813 - protein, 17 aa, Mycobacterium
DPWVMIGAIALATTRLR

SEQ ID NO: 1261814 - protein, 27 aa, Mycobacterium
DPWYRMRVAPSIFKHVMGIIRMVSEEF

SEQ ID NO: 1261815 - protein, 27 aa, Mycobacterium
DPYCSSGVNMFAHWSYPWNGMVNEAAT

SEQ ID NO: 1261816 - protein, 25 aa, Mycobacterium
DPYEISSADGWRANPEKVWAWYLWR

SEQ ID NO: 1261817 - protein, 17 aa, Mycobacterium
DPYQLAPVKARGGMFEH

SEQ ID NO: 1261818 - protein, 20 aa, Mycobacterium
DQAAAVGILQNWLDQRRAAL

SEQ ID NO: 1261819 - protein, 20 aa, Mycobacterium
DQARCVASLAALAALDTEVL

SEQ ID NO: 1261820 - protein, 24 aa, Mycobacterium
DQAVREVFRLLALAEDTTRPPSLL

SEQ ID NO: 1261821 - protein, 20 aa, Mycobacterium
DQAWWSPGMTHPDGRSAFAL

SEQ ID NO: 1261822 - protein, 24 aa, Mycobacterium
DQGLRPPEPVRFSLSDGVAALQAF

SEQ ID NO: 1261823 - protein, 21 aa, Mycobacterium
DQGRPFLAFVYGIAAHKIADA

SEQ ID NO: 1261824 - protein, 21 aa, Mycobacterium
DQGRPFLAFVYGIAAHKVADA

SEQ ID NO: 1261825 - protein, 17 aa, Mycobacterium
DQILKNVVKIVAVEGPV

SEQ ID NO: 1261826 - protein, 17 aa, Mycobacterium
DQIPWRAERRQMYDRVL

SEQ ID NO: 1261827 - protein, 24 aa, Mycobacterium
DQIVYRAGVRRVPRLHRHGNTAGS

SEQ ID NO: 1261828 - protein, 24 aa, Mycobacterium
DQLDALCALGLQSRIVAAALPDGR

SEQ ID NO: 1261829 - protein, 19 aa, Mycobacterium
DQLDRWWRAANYLSVGQIY

SEQ ID NO: 1261830 - protein, 25 aa, Mycobacterium
DQLNRWRRLGCWVSGHGEGWALYAE

SEQ ID NO: 1261831 - protein, 25 aa, Mycobacterium
DQLRQRIGMVFQHFQLFPHRTVLDN

SEQ ID NO: 1261832 - protein, 21 aa, Mycobacterium
DQLYSSLWLYLAGVRPIVFGV

SEQ ID NO: 1261833 - protein, 21 aa, Mycobacterium
DQLYSSLWLYLAGVRPVVFGV

SEQ ID NO: 1261834 - protein, 25 aa, Mycobacterium
DQMAEPKWVLAMGVCASSGGMFNNY

SEQ ID NO: 1261835 - protein, 24 aa, Mycobacterium
DQMPKHVSLGLMFGSPVAFTVPDL

SEQ ID NO: 1261836 - protein, 19 aa, Mycobacterium
DQMRRFAGELVDVDGAESK

SEQ ID NO: 1261837 - protein, 17 aa, Mycobacterium
DQNLALVDIRRADTAID

SEQ ID NO: 1261838 - protein, 17 aa, Mycobacterium
DQPGRRVAAKSGLNRAI

SEQ ID NO: 1261839 - protein, 18 aa, Mycobacterium
DQQFKFTAALARREVTVW

SEQ ID NO: 1261840 - protein, 17 aa, Mycobacterium
DQQVALLRQLKTDRAAD

SEQ ID NO: 1261841 - protein, 25 aa, Mycobacterium
DQRDWDFATEFGLPIIEVVRPVADR

SEQ ID NO: 1261842 - protein, 20 aa, Mycobacterium
DQREAFAWHIDLAKRTGKPL

SEQ ID NO: 1261843 - protein, 18 aa, Mycobacterium
DQRFAVGEGQLFERPSSN

SEQ ID NO: 1261844 - protein, 18 aa, Mycobacterium
DQRIAVGDIIISRENDIS

SEQ ID NO: 1261845 - protein, 19 aa, Mycobacterium
DQRRCVLMLTDAGRDALAA

SEQ ID NO: 1261846 - protein, 17 aa, Mycobacterium
DQRRLAKELKRYGVESQ

SEQ ID NO: 1261847 - protein, 23 aa, Mycobacterium
DQRRLGELIDLFNSARFSRQGDG

SEQ ID NO: 1261848 - protein, 21 aa, Mycobacterium
DQRVAFVLHDGFAVPFAEIAE

SEQ ID NO: 1261849 - protein, 22 aa, Mycobacterium
DQTRATAWLVWDERDVTGVGLA

SEQ ID NO: 1261850 - protein, 23 aa, Mycobacterium
DQTRSEGFITVWVANRDLGSAEP

SEQ ID NO: 1261851 - protein, 25 aa, Mycobacterium
DQTRWRIAVEKVLRGAGLRLLVPDQ

SEQ ID NO: 1261852 - protein, 19 aa, Mycobacterium
DQVAAVGILQSWLDQRRAA

SEQ ID NO: 1261853 - protein, 23 aa, Mycobacterium
DQYDLSSLFLLASTAALFSTSLK

SEQ ID NO: 1261854 - protein, 29 aa, Mycobacterium
DQYEIKGCIAHGGLGWVYLAFDKNVNDRP

SEQ ID NO: 1261855 - protein, 20 aa, Mycobacterium
DRAALPYVVGTIAGDDTIMV

SEQ ID NO: 1261856 - protein, 20 aa, Mycobacterium
DRAALPYVVGTVAGDDTILV

SEQ ID NO: 1261857 - protein, 18 aa, Mycobacterium
DRAESVANPVQWATIRYG

SEQ ID NO: 1261858 - protein, 26 aa, Mycobacterium
DRAGELGLVPLRWALASLLADIGSAA

SEQ ID NO: 1261859 - protein, 23 aa, Mycobacterium
DRAIQVFGGIGFTWEHDAQLYLK

SEQ ID NO: 1261860 - protein, 22 aa, Mycobacterium
DRAKPAVPFGGGYRLIDFVLSN

SEQ ID NO: 1261861 - protein, 30 aa, Mycobacterium
DRAPADAPIGWRRPLSPQPGRDLVVPVPYV

SEQ ID NO: 1261862 - protein, 20 aa, Mycobacterium
DRAPFVWDGAPGVRPFLLFG

SEQ ID NO: 1261863 - protein, 20 aa, Mycobacterium
DRAQLAAGRAVRVAADAQDA

SEQ ID NO: 1261864 - protein, 17 aa, Mycobacterium
DRARAWVVVRMVHNAVW

SEQ ID NO: 1261865 - protein, 27 aa, Mycobacterium
DRARFAEAVQQQWFSIGMVQPGWEDER

SEQ ID NO: 1261866 - protein, 23 aa, Mycobacterium
DRARLVWEPRRIVPTYAVPLDAL

SEQ ID NO: 1261867 - protein, 19 aa, Mycobacterium
DRASALRMVRGIKNRFGAA

SEQ ID NO: 1261868 - protein, 18 aa, Mycobacterium
DRAVLRRAVITGAGTGRS

SEQ ID NO: 1261869 - protein, 22 aa, Mycobacterium
DRAVRRFALRKVLRNLDLAAEL

SEQ ID NO: 1261870 - protein, 18 aa, Mycobacterium
DRAWDLLAAHCAQSEKTR

SEQ ID NO: 1261871 - protein, 21 aa, Mycobacterium
DRDALTIDVVWNKDLQDADWQ

SEQ ID NO: 1261872 - protein, 22 aa, Mycobacterium
DRDAYVNAGLPWFDYYDADARD

SEQ ID NO: 1261873 - protein, 20 aa, Mycobacterium
DRDDCIRIVDDFFVTHQPGA

SEQ ID NO: 1261874 - protein, 18 aa, Mycobacterium
DRDDWAVHVALWQSGELV

SEQ ID NO: 1261875 - protein, 19 aa, Mycobacterium
DRDGFVFGEGGALLVIETA

SEQ ID NO: 1261876 - protein, 19 aa, Mycobacterium
DRDGRFMALTGIGYYPRLG

SEQ ID NO: 1261877 - protein, 19 aa, Mycobacterium
DRDPAWPAVAAQLCRTVGS

SEQ ID NO: 1261878 - protein, 17 aa, Mycobacterium
DRDRLAEVVARGVAEFG

SEQ ID NO: 1261879 - protein, 19 aa, Mycobacterium
DRDRLVVIVAGYRKDLDTF

SEQ ID NO: 1261880 - protein, 21 aa, Mycobacterium
DRDSAVMYLIYPYDTPGRMDV

SEQ ID NO: 1261881 - protein, 17 aa, Mycobacterium
DRDTRDVFGPDIDVYDL

SEQ ID NO: 1261882 - protein, 19 aa, Mycobacterium
DRDVRGMFELNFFSVVSVI

SEQ ID NO: 1261883 - protein, 17 aa, Mycobacterium
DRDVWLEAGKQGFLGMA

SEQ ID NO: 1261884 - protein, 17 aa, Mycobacterium
DREADYRLASPCELVDI

SEQ ID NO: 1261885 - protein, 19 aa, Mycobacterium
DREAMAAAVDRVVDQFGKL

SEQ ID NO: 1261886 - protein, 18 aa, Mycobacterium
DREIKVLRLIAEGHDTSE

SEQ ID NO: 1261887 - protein, 22 aa, Mycobacterium
DRELRVPLHYYRDPKITEIEES

SEQ ID NO: 1261888 - protein, 22 aa, Mycobacterium
DREPEVVMAEFLERVMSGKLSL

SEQ ID NO: 1261889 - protein, 21 aa, Mycobacterium
DRERFGIKGVIGPDEFHSGYP

SEQ ID NO: 1261890 - protein, 24 aa, Mycobacterium
DRERPLWECWIVEGLPDDRWAMIM

SEQ ID NO: 1261891 - protein, 24 aa, Mycobacterium
DRFAELAGPFLRKDIAACREAAAE

SEQ ID NO: 1261892 - protein, 26 aa, Mycobacterium
DRFFGDPSWRRLFFEARTSDDGTAAS

SEQ ID NO: 1261893 - protein, 25 aa, Mycobacterium
DRFGDDGVRCTWLQTSHAFHSELLD

SEQ ID NO: 1261894 - protein, 17 aa, Mycobacterium
DRFGPPAGQAAWVVKDD

SEQ ID NO: 1261895 - protein, 20 aa, Mycobacterium
DRFLKEILVAFADGPVVVGP

SEQ ID NO: 1261896 - protein, 17 aa, Mycobacterium
DRFPLRAIIGAPMVFGG

SEQ ID NO: 1261897 - protein, 21 aa, Mycobacterium
DRFRFLAGFLAGRPVGVAEVP

SEQ ID NO: 1261898 - protein, 26 aa, Mycobacterium
DRFRRWMLDYVRFHRSYRGVIRAWFD

SEQ ID NO: 1261899 - protein, 26 aa, Mycobacterium
DRFTAEFLGDCVLLPCTVTGGIATSA

SEQ ID NO: 1261900 - protein, 21 aa, Mycobacterium
DRFTDRPVWITGVGLGLDSVM

SEQ ID NO: 1261901 - protein, 21 aa, Mycobacterium
DRGAAGIALLASMPPRPGERD

SEQ ID NO: 1261902 - protein, 28 aa, Mycobacterium
DRGALAPSRRTAWVDLIAADSAMADVLA

SEQ ID NO: 1261903 - protein, 19 aa, Mycobacterium
DRGARIVVLTGDPGRRVEI

SEQ ID NO: 1261904 - protein, 21 aa, Mycobacterium
DRGGAPPARYAAASLVVVNKL

SEQ ID NO: 1261905 - protein, 25 aa, Mycobacterium
DRGLLHPPLRVGRIALFNDTHLTRL

SEQ ID NO: 1261906 - protein, 19 aa, Mycobacterium
DRGLRILLDGVFNHVGTDF

SEQ ID NO: 1261907 - protein, 21 aa, Mycobacterium
DRGPLTVPVWYQYSPGGQPWV

SEQ ID NO: 1261908 - protein, 29 aa, Mycobacterium
DRGRAATTPRLLKFHAPEIVFGIDSMVEA

SEQ ID NO: 1261909 - protein, 22 aa, Mycobacterium
DRGRRCITGAADVRDFDGLAAT

SEQ ID NO: 1261910 - protein, 19 aa, Mycobacterium
DRGRRWPVIISGTITDASG

SEQ ID NO: 1261911 - protein, 27 aa, Mycobacterium
DRGTLRRFIPFDVDASVLKDAGASIEA

SEQ ID NO: 1261912 - protein, 18 aa, Mycobacterium
DRGVDKFICAMGVGDGQL

SEQ ID NO: 1261913 - protein, 23 aa, Mycobacterium
DRGVDPVDWRGWRAIDAAERKRG

SEQ ID NO: 1261914 - protein, 27 aa, Mycobacterium
DRGVQLPPWPSAGEAFMELVEAGWDAE

SEQ ID NO: 1261915 - protein, 18 aa, Mycobacterium
DRGVRIVANAGGLNPAGL

SEQ ID NO: 1261916 - protein, 20 aa, Mycobacterium
DRGWSLRALFDGSRRDGFKR

SEQ ID NO: 1261917 - protein, 19 aa, Mycobacterium
DRGWYIGRTIPLSMAGGQR

SEQ ID NO: 1261918 - protein, 24 aa, Mycobacterium
DRHFRPEFFAAMRALCDEFDALLI

SEQ ID NO: 1261919 - protein, 18 aa, Mycobacterium
DRHFRPQFFAAMRQLCDE

SEQ ID NO: 1261920 - protein, 19 aa, Mycobacterium
DRHGDGVYTVVIRVPDAAA

SEQ ID NO: 1261921 - protein, 27 aa, Mycobacterium
DRHHVVKCAPGIDFAVLEQLGFDGEIE

SEQ ID NO: 1261922 - protein, 21 aa, Mycobacterium
DRHPAGGWSRQRAVLAVVDGD

SEQ ID NO: 1261923 - protein, 23 aa, Mycobacterium
DRHPELFRKASPMARVHPEAPPF

SEQ ID NO: 1261924 - protein, 23 aa, Mycobacterium
DRHPRPAPRPAYSALSPVKSAEA

SEQ ID NO: 1261925 - protein, 17 aa, Mycobacterium
DRHWIPVHRDWRLNERH

SEQ ID NO: 1261926 - protein, 19 aa, Mycobacterium
DRHWREAFRDLTFFDQASG

SEQ ID NO: 1261927 - protein, 18 aa, Mycobacterium
DRIEPVHAVTYFAPEARA

SEQ ID NO: 1261928 - protein, 24 aa, Mycobacterium
DRIGRLAVRLDVSRLIVVGSGRPM

SEQ ID NO: 1261929 - protein, 21 aa, Mycobacterium
DRILEHVDFLSIGTNDLAQYT

SEQ ID NO: 1261930 - protein, 19 aa, Mycobacterium
DRIQLLLADLADSLARGET

SEQ ID NO: 1261931 - protein, 20 aa, Mycobacterium
DRIQRCLDEGALVGDAVDIA

SEQ ID NO: 1261932 - protein, 17 aa, Mycobacterium
DRIRAGLGSYWVYQHLG

SEQ ID NO: 1261933 - protein, 24 aa, Mycobacterium
DRIRVFVNSCAHRGTLLEQRRCGV

SEQ ID NO: 1261934 - protein, 20 aa, Mycobacterium
DRIRVNAVAPTNCATPMITE

SEQ ID NO: 1261935 - protein, 23 aa, Mycobacterium
DRIVSIEAFEHFGFERYDDFFKT

SEQ ID NO: 1261936 - protein, 20 aa, Mycobacterium
DRIVSIGAFEAFKAERYPLF

SEQ ID NO: 1261937 - protein, 20 aa, Mycobacterium
DRIVSIGAFEHFGRDRYDEF

SEQ ID NO: 1261938 - protein, 26 aa, Mycobacterium
DRIWPDVLDNLRWLEHETARTFGQGP

SEQ ID NO: 1261939 - protein, 19 aa, Mycobacterium
DRKCREELEINKATLDIFS

SEQ ID NO: 1261940 - protein, 22 aa, Mycobacterium
DRKPRPGNLVRRIPHAANRVVE

SEQ ID NO: 1261941 - protein, 20 aa, Mycobacterium
DRKRPARANLVFTDEDGETY

SEQ ID NO: 1261942 - protein, 21 aa, Mycobacterium
DRKTYLFAFLDDHSRLVVGHR

SEQ ID NO: 1261943 - protein, 20 aa, Mycobacterium
DRLAEAFAERMHERVRKEFW

SEQ ID NO: 1261944 - protein, 19 aa, Mycobacterium
DRLAELRPGDAILGEEEGG

SEQ ID NO: 1261945 - protein, 17 aa, Mycobacterium
DRLAEVVARGVAEFGRL

SEQ ID NO: 1261946 - protein, 17 aa, Mycobacterium
DRLAGVVLIGRDRAVVA

SEQ ID NO: 1261947 - protein, 17 aa, Mycobacterium
DRLALLAHNCWQYAVLA

SEQ ID NO: 1261948 - protein, 18 aa, Mycobacterium
DRLARLGVEDALLKLGAR

SEQ ID NO: 1261949 - protein, 28 aa, Mycobacterium
DRLATLLRFPAAFFTTAPVSRVFAHDLL

SEQ ID NO: 1261950 - protein, 28 aa, Mycobacterium
DRLDRRAVREVHALWSGLTAYRAMRRGP

SEQ ID NO: 1261951 - protein, 17 aa, Mycobacterium
DRLELVAAGADAAVSTK

SEQ ID NO: 1261952 - protein, 21 aa, Mycobacterium
DRLEPVPVLRRQGVWAVAIAE

SEQ ID NO: 1261953 - protein, 21 aa, Mycobacterium
DRLERALAWAEEDYHEFVVRP

SEQ ID NO: 1261954 - protein, 25 aa, Mycobacterium
DRLFPRSIFYSLRLAEHSLDELMNR

SEQ ID NO: 1261955 - protein, 20 aa, Mycobacterium
DRLGANVVPIQLPIGSEGDF

SEQ ID NO: 1261956 - protein, 22 aa, Mycobacterium
DRLGLRDRVRFLGSCSEEAVRA

SEQ ID NO: 1261957 - protein, 23 aa, Mycobacterium
DRLLAGSGRTCFDLFAAQSASRL

SEQ ID NO: 1261958 - protein, 24 aa, Mycobacterium
DRLLRLRWPCPIPGAMPVSEVGNA

SEQ ID NO: 1261959 - protein, 19 aa, Mycobacterium
DRLLVDLIHEAFRRLFERH

SEQ ID NO: 1261960 - protein, 27 aa, Mycobacterium
DRLNVADAGLCFGRLDSLTGERLYIGR

SEQ ID NO: 1261961 - protein, 22 aa, Mycobacterium
DRLPDLRYVFVIDDRAGDQHSP

SEQ ID NO: 1261962 - protein, 17 aa, Mycobacterium
DRLPLAAPPDWERLTDT

SEQ ID NO: 1261963 - protein, 19 aa, Mycobacterium
DRLRALHAVAIVNENDTVA

SEQ ID NO: 1261964 - protein, 21 aa, Mycobacterium
DRLRCAIDALIERYDPDAVIR

SEQ ID NO: 1261965 - protein, 21 aa, Mycobacterium
DRLREARRIAVPGCYPTAALL

SEQ ID NO: 1261966 - protein, 23 aa, Mycobacterium
DRLREMEFEFPLAGGDRRVEVPD

SEQ ID NO: 1261967 - protein, 21 aa, Mycobacterium
DRLRKVLVPHALRLREAAILG

SEQ ID NO: 1261968 - protein, 17 aa, Mycobacterium
DRLRLEAYRRLAAAPDD

SEQ ID NO: 1261969 - protein, 23 aa, Mycobacterium
DRLRNWRFYDGFRVDATAPARHP

SEQ ID NO: 1261970 - protein, 21 aa, Mycobacterium
DRLRRRLRIVGERFRVNVRAY

SEQ ID NO: 1261971 - protein, 17 aa, Mycobacterium
DRLSALVAHLVGADALI

SEQ ID NO: 1261972 - protein, 23 aa, Mycobacterium
DRLTKGRTVWFTGLSGSGKSSVA

SEQ ID NO: 1261973 - protein, 21 aa, Mycobacterium
DRLVDALAPFDVETRGLAAGL

SEQ ID NO: 1261974 - protein, 22 aa, Mycobacterium
DRMGALALHVAKIARRRHPQHA

SEQ ID NO: 1261975 - protein, 18 aa, Mycobacterium
DRMGRRPGARWAADLVAA

SEQ ID NO: 1261976 - protein, 18 aa, Mycobacterium
DRMLIRLQGVGDRDAADA

SEQ ID NO: 1261977 - protein, 22 aa, Mycobacterium
DRNEKLMGFGHRVYRAEDPRAR

SEQ ID NO: 1261978 - protein, 27 aa, Mycobacterium
DRNGDLRAAGLLSRALLWQGRAAEADD

SEQ ID NO: 1261979 - protein, 25 aa, Mycobacterium
DRNGRPPADHERGWKDTVIVDPLEK

SEQ ID NO: 1261980 - protein, 23 aa, Mycobacterium
DRPADFIGLHFFSPVERMDLVEI

SEQ ID NO: 1261981 - protein, 25 aa, Mycobacterium
DRPAEVWEALIAVADNAGGAWPERA

SEQ ID NO: 1261982 - protein, 17 aa, Mycobacterium
DRPAGRGHMAFGRGAHF

SEQ ID NO: 1261983 - protein, 20 aa, Mycobacterium
DRPALKDPPFVPATPSAFGE

SEQ ID NO: 1261984 - protein, 22 aa, Mycobacterium
DRPATEFTLQAWSGGIVGLGRG

SEQ ID NO: 1261985 - protein, 17 aa, Mycobacterium
DRPDFAFAEADEMTVRA

SEQ ID NO: 1261986 - protein, 21 aa, Mycobacterium
DRPFHGYDVFAMIPPPGPNDP

SEQ ID NO: 1261987 - protein, 28 aa, Mycobacterium
DRPFVALPIFPSRLFRHSSVYVGADADV

SEQ ID NO: 1261988 - protein, 21 aa, Mycobacterium
DRPGARISLMTAEMLTDRPDG

SEQ ID NO: 1261989 - protein, 17 aa, Mycobacterium
DRPHARNAISLETMEQL

SEQ ID NO: 1261990 - protein, 17 aa, Mycobacterium
DRPLTVTGGLTFAGGPW

SEQ ID NO: 1261991 - protein, 19 aa, Mycobacterium
DRPMILKRFVKGIEQEAVF

SEQ ID NO: 1261992 - protein, 22 aa, Mycobacterium
DRPRGPAAYAHREYAADTVAVL

SEQ ID NO: 1261993 - protein, 22 aa, Mycobacterium
DRPRVPHLVITRGARGATYVGE

SEQ ID NO: 1261994 - protein, 20 aa, Mycobacterium
DRPRWGWRRAAKMARKAGWK

SEQ ID NO: 1261995 - protein, 21 aa, Mycobacterium
DRPTTIVSRVWLALRAAGAPV

SEQ ID NO: 1261996 - protein, 25 aa, Mycobacterium
DRQKRAALNEVNWRMLSVVSDDVRK

SEQ ID NO: 1261997 - protein, 19 aa, Mycobacterium
DRQLEAIAAAGQRTGNPPW

SEQ ID NO: 1261998 - protein, 37 aa, Mycobacterium
DRQLLSAGFVERVLEAWPRHDLGYAITDLIARGTAAN

SEQ ID NO: 1261999 - protein, 23 aa, Mycobacterium
DRQRELLRLMTLIEGLDDATPRL

SEQ ID NO: 1262000 - protein, 20 aa, Mycobacterium
DRQRRVFVGIVFEQIPADTL

SEQ ID NO: 1262001 - protein, 23 aa, Mycobacterium
DRQTIGWRALRDITRAFPPEQTQ

SEQ ID NO: 1262002 - protein, 24 aa, Mycobacterium
DRQWAMSTVERFAGIGVSQALSYG

SEQ ID NO: 1262003 - protein, 17 aa, Mycobacterium
DRRAFTAIGTRLAPGTA

SEQ ID NO: 1262004 - protein, 20 aa, Mycobacterium
DRRALFFMGRLSVEGDWALA

SEQ ID NO: 1262005 - protein, 20 aa, Mycobacterium
DRRGPALAGQLLLYPVIAAN

SEQ ID NO: 1262006 - protein, 18 aa, Mycobacterium
DRRIEVHFDQGFTAAQVF

SEQ ID NO: 1262007 - protein, 18 aa, Mycobacterium
DRRLPDFAPAPATDDELI

SEQ ID NO: 1262008 - protein, 19 aa, Mycobacterium
DRRLRVSVAGTVLVDTADT

SEQ ID NO: 1262009 - protein, 20 aa, Mycobacterium
DRRSCAVGAIIHGQDQLSCR

SEQ ID NO: 1262010 - protein, 19 aa, Mycobacterium
DRRSTVGALARIVDYADLG

SEQ ID NO: 1262011 - protein, 21 aa, Mycobacterium
DRRTIWRRGINVFFETFGAHR

SEQ ID NO: 1262012 - protein, 24 aa, Mycobacterium
DRRVLKLLRLWLQAGVMVDGVVSR

SEQ ID NO: 1262013 - protein, 25 aa, Mycobacterium
DRSLTYRELWLWRNRIANALIAAGV

SEQ ID NO: 1262014 - protein, 20 aa, Mycobacterium
DRSPLRTVQFPRGFDAAVLE

SEQ ID NO: 1262015 - protein, 25 aa, Mycobacterium
DRSRIPIFVEEALRMDAPVKSQFRL

SEQ ID NO: 1262016 - protein, 23 aa, Mycobacterium
DRSVVPVRVFWIPGGLPTRSKVV

SEQ ID NO: 1262017 - protein, 18 aa, Mycobacterium
DRTANLLVVRYLDGSLVM

SEQ ID NO: 1262018 - protein, 18 aa, Mycobacterium
DRTGRPAWALSLTGVETR

SEQ ID NO: 1262019 - protein, 24 aa, Mycobacterium
DRTLTRLAAVLGYADSSALNPAVP

SEQ ID NO: 1262020 - protein, 19 aa, Mycobacterium
DRTPLAVLAYVSFQELATR

SEQ ID NO: 1262021 - protein, 21 aa, Mycobacterium
DRTVYRLTAGYALEAAGDGVR

SEQ ID NO: 1262022 - protein, 19 aa, Mycobacterium
DRTWLRTGDLGFYLDGELY

SEQ ID NO: 1262023 - protein, 25 aa, Mycobacterium
DRVADAWIKAQAYRLHTFGTVTRVS

SEQ ID NO: 1262024 - protein, 18 aa, Mycobacterium
DRVAIHWEGEPVGDARDI

SEQ ID NO: 1262025 - protein, 19 aa, Mycobacterium
DRVAKLIVDFVDQVAGSAD

SEQ ID NO: 1262026 - protein, 23 aa, Mycobacterium
DRVARCGIGLLGMGSTPERGTPA

SEQ ID NO: 1262027 - protein, 26 aa, Mycobacterium
DRVAVIPLLACEPVGIPALEALAGSR

SEQ ID NO: 1262028 - protein, 23 aa, Mycobacterium
DRVAVLCTLGLDVVDSLAVDARP

SEQ ID NO: 1262029 - protein, 19 aa, Mycobacterium
DRVGIWAPNCPEWTIVQYA

SEQ ID NO: 1262030 - protein, 21 aa, Mycobacterium
DRVKPVFKQWASMVVRAGEPG

SEQ ID NO: 1262031 - protein, 33 aa, Mycobacterium
DRVLEVAAAKWWRKPLVRRWYGFAEMQKQVARQ

SEQ ID NO: 1262032 - protein, 23 aa, Mycobacterium
DRVLPHRRCFTFDDTHSIFVSNE

SEQ ID NO: 1262033 - protein, 25 aa, Mycobacterium
DRVLRRDREGCWWHESLSGTTAPAW

SEQ ID NO: 1262034 - protein, 21 aa, Mycobacterium
DRVLVPWSSVFAAGDVTVVNS

SEQ ID NO: 1262035 - protein, 24 aa, Mycobacterium
DRVMPGNCFAPFHFNDEHGEYLTV

SEQ ID NO: 1262036 - protein, 23 aa, Mycobacterium
DRVPRGALERILPKVGTGPSEQT

SEQ ID NO: 1262037 - protein, 23 aa, Mycobacterium
DRVPRPAPRPAYSALSGAGSAAC

SEQ ID NO: 1262038 - protein, 22 aa, Mycobacterium
DRVQPGNTWVPFHWNDEHGDHL

SEQ ID NO: 1262039 - protein, 17 aa, Mycobacterium
DRVRFASSLPALLAGGE

SEQ ID NO: 1262040 - protein, 17 aa, Mycobacterium
DRVRPFRPFQVNADMLA

SEQ ID NO: 1262041 - protein, 24 aa, Mycobacterium
DRVSDTIALPGQRLVHVRGTRILA

SEQ ID NO: 1262042 - protein, 25 aa, Mycobacterium
DRVTRLVLCGAYARGRVVRAMNDDE

SEQ ID NO: 1262043 - protein, 17 aa, Mycobacterium
DRVWELETYGALFDRTK

SEQ ID NO: 1262044 - protein, 17 aa, Mycobacterium
DRVYRLAYRLSGNQHDA

SEQ ID NO: 1262045 - protein, 21 aa, Mycobacterium
DRYDPIWGDKGGLFTIARAIM

SEQ ID NO: 1262046 - protein, 24 aa, Mycobacterium
DRYPWLESIGEWLARHPQGGVMSC

SEQ ID NO: 1262047 - protein, 20 aa, Mycobacterium
DRYRALAGLTIRGVDPRYLV

SEQ ID NO: 1262048 - protein, 24 aa, Mycobacterium
DRYRRTPDGWKICATGYDRTYDAS

SEQ ID NO: 1262049 - protein, 17 aa, Mycobacterium
DRYSKTDLWDFEANLQG

SEQ ID NO: 1262050 - protein, 26 aa, Mycobacterium
DRYVVLPFWLVCDVSASMGPHIGTLN

SEQ ID NO: 1262051 - protein, 23 aa, Mycobacterium
DRYWRRYFDNFAEVMSSSDHIGA

SEQ ID NO: 1262052 - protein, 25 aa, Mycobacterium
DSAADRWRVAPGPIAARHWAVEPDL

SEQ ID NO: 1262053 - protein, 18 aa, Mycobacterium
DSAEPGTDVGWHYVASRA

SEQ ID NO: 1262054 - protein, 18 aa, Mycobacterium
DSALIFLRAAADAVHEDR

SEQ ID NO: 1262055 - protein, 19 aa, Mycobacterium
DSALPGVSMFALFTCALHE

SEQ ID NO: 1262056 - protein, 22 aa, Mycobacterium
DSALQAARWAGAVAATCGAPLH

SEQ ID NO: 1262057 - protein, 26 aa, Mycobacterium
DSALRVRGVRNLRIMDCSVMPTMVSG

SEQ ID NO: 1262058 - protein, 25 aa, Mycobacterium
DSAPGGGRWELGQAYPPGPGGGPPM

SEQ ID NO: 1262059 - protein, 20 aa, Mycobacterium
DSARIELVYYPEFLRESSAV

SEQ ID NO: 1262060 - protein, 17 aa, Mycobacterium
DSARRLWDLSAELTGCA

SEQ ID NO: 1262061 - protein, 23 aa, Mycobacterium
DSAVWTACVAHSALFTEPTPPLS

SEQ ID NO: 1262062 - protein, 17 aa, Mycobacterium
DSCRAAMAITEQGGTAT

SEQ ID NO: 1262063 - protein, 18 aa, Mycobacterium
DSCRECDACRDGEEQYCT

SEQ ID NO: 1262064 - protein, 21 aa, Mycobacterium
DSCRECDNCRAGIEQYCTGSG

SEQ ID NO: 1262065 - protein, 23 aa, Mycobacterium
DSDNQARCDAVAPLIAALQHTDL

SEQ ID NO: 1262066 - protein, 17 aa, Mycobacterium
DSDYVWRTWYPRTRPAT

SEQ ID NO: 1262067 - protein, 19 aa, Mycobacterium
DSELLDFTTLARVFGYPST

SEQ ID NO: 1262068 - protein, 21 aa, Mycobacterium
DSEPAESIWTTSITIFEIRTG

SEQ ID NO: 1262069 - protein, 20 aa, Mycobacterium
DSFARLLIRGTPGRMVTLID

SEQ ID NO: 1262070 - protein, 22 aa, Mycobacterium
DSGDDLPITWRHRSERYTEKLA

SEQ ID NO: 1262071 - protein, 22 aa, Mycobacterium
DSGIGRAVAIAFAKEGADVAIA

SEQ ID NO: 1262072 - protein, 23 aa, Mycobacterium
DSGQFAPAIEMARQIISSQQKEI

SEQ ID NO: 1262073 - protein, 17 aa, Mycobacterium
DSGRLLIAPRLDDRYPT

SEQ ID NO: 1262074 - protein, 17 aa, Mycobacterium
DSGRPDLTIPRRFLPGL

SEQ ID NO: 1262075 - protein, 21 aa, Mycobacterium
DSHFPGDFIVEYIGQTRGWFY

SEQ ID NO: 1262076 - protein, 26 aa, Mycobacterium
DSHLYLRRARTLAALMADGVDPLLDI

SEQ ID NO: 1262077 - protein, 24 aa, Mycobacterium
DSHRPALEVLLLGGRPIREPVFQY

SEQ ID NO: 1262078 - protein, 17 aa, Mycobacterium
DSIGWVEAEGDYARLHS

SEQ ID NO: 1262079 - protein, 26 aa, Mycobacterium
DSIGYRLGRSIARLEAALSTPEMFGR

SEQ ID NO: 1262080 - protein, 18 aa, Mycobacterium
DSILTVLGPAEWAQPVPP

SEQ ID NO: 1262081 - protein, 28 aa, Mycobacterium
DSIRMMTLSGRWRRQGVDVGFAALAANP

SEQ ID NO: 1262082 - protein, 26 aa, Mycobacterium
DSKMGLFPFRRNLAFYAVDLALLTLT

SEQ ID NO: 1262083 - protein, 25 aa, Mycobacterium
DSKWRAHLYEMDYLAAGIGMRALAG

SEQ ID NO: 1262084 - protein, 19 aa, Mycobacterium
DSLAARLAAIVEHAESATQ

SEQ ID NO: 1262085 - protein, 17 aa, Mycobacterium
DSLAGGSTPAWIRACGD

SEQ ID NO: 1262086 - protein, 24 aa, Mycobacterium
DSLARALMAIGIEKGDRVGIWAPN

SEQ ID NO: 1262087 - protein, 25 aa, Mycobacterium
DSLESRLAWEPTSLAATVERTKALS

SEQ ID NO: 1262088 - protein, 19 aa, Mycobacterium
DSLGGLWAQGKLADKVYAG

SEQ ID NO: 1262089 - protein, 30 aa, Mycobacterium
DSLLALDLRKRFRRVLGRTVPLATLLGGVT

SEQ ID NO: 1262090 - protein, 19 aa, Mycobacterium
DSLPDSWDSPVATDVVRGH

SEQ ID NO: 1262091 - protein, 30 aa, Mycobacterium
DSLPYGGTWRGHGGLERFFLAMSRTWSAFD

SEQ ID NO: 1262092 - protein, 17 aa, Mycobacterium
DSLRHAVLAFLAAREDA

SEQ ID NO: 1262093 - protein, 17 aa, Mycobacterium
DSLRYVVPAGVTTQPVY

SEQ ID NO: 1262094 - protein, 17 aa, Mycobacterium
DSLTWGWVPVEDGVPTE

SEQ ID NO: 1262095 - protein, 18 aa, Mycobacterium
DSMFQAILPLRGKIINVE

SEQ ID NO: 1262096 - protein, 41 aa, Mycobacterium
DSMLVKLTCRGRDFATAVARAHRALAEFRVRGVSTNIPFLQ

SEQ ID NO: 1262097 - protein, 26 aa, Mycobacterium
DSMPKSVVINPFFDWGVDRPPNHEYA

SEQ ID NO: 1262098 - protein, 23 aa, Mycobacterium
DSMRAGLKALAWMSRGGASKGRS

SEQ ID NO: 1262099 - protein, 18 aa, Mycobacterium
DSNVAFFREYKNVGLTPQ

SEQ ID NO: 1262100 - protein, 25 aa, Mycobacterium
DSPCPLLAGCRLRRAMAAAKEAFYA

SEQ ID NO: 1262101 - protein, 26 aa, Mycobacterium
DSPDFLRLGLMLALERRPVEPKARAM

SEQ ID NO: 1262102 - protein, 17 aa, Mycobacterium
DSPECQALMGALPEVLG

SEQ ID NO: 1262103 - protein, 21 aa, Mycobacterium
DSPEFQVRLLAKRPGPDLGLM

SEQ ID NO: 1262104 - protein, 19 aa, Mycobacterium
DSPFPGLTTHAYLWTPANI

SEQ ID NO: 1262105 - protein, 25 aa, Mycobacterium
DSPKPPPRRITLTLPAITRSREVWL

SEQ ID NO: 1262106 - protein, 28 aa, Mycobacterium
DSPKTGRLSGRFWKLLGASTDKDQARSM

SEQ ID NO: 1262107 - protein, 24 aa, Mycobacterium
DSPLLPTIFKYVGKAHVWVYRRTG

SEQ ID NO: 1262108 - protein, 20 aa, Mycobacterium
DSPVSVGDRVVWSVTVSCGE

SEQ ID NO: 1262109 - protein, 25 aa, Mycobacterium
DSRITLDPNGGWLLADAIRTCRELK

SEQ ID NO: 1262110 - protein, 24 aa, Mycobacterium
DSRLRWLRRGEVPTLGNWLRAAGY

SEQ ID NO: 1262111 - protein, 17 aa, Mycobacterium
DSRWDNFTLVTPNWHCR

SEQ ID NO: 1262112 - protein, 20 aa, Mycobacterium
DSSGRRAWVTNSYDDSVSVI

SEQ ID NO: 1262113 - protein, 24 aa, Mycobacterium
DSTDILAPGSFSWHVLSSLTDDVK

SEQ ID NO: 1262114 - protein, 18 aa, Mycobacterium
DSTFELMKHVSRPVQTLY

SEQ ID NO: 1262115 - protein, 18 aa, Mycobacterium
DSTVTCQAGLLGRPGEVA

SEQ ID NO: 1262116 - protein, 25 aa, Mycobacterium
DSVDAVLVAQAWHWFDPERAVKEVA

SEQ ID NO: 1262117 - protein, 17 aa, Mycobacterium
DSVIFSEPLARLAEQHA

SEQ ID NO: 1262118 - protein, 19 aa, Mycobacterium
DSVIPVWQARSFVDKLKAK

SEQ ID NO: 1262119 - protein, 24 aa, Mycobacterium
DSVLRRLKQYSGRLAIEAVASMQD

SEQ ID NO: 1262120 - protein, 17 aa, Mycobacterium
DSVVNWCPGLGTVLANE

SEQ ID NO: 1262121 - protein, 28 aa, Mycobacterium
DSWQQQQARLFGGGAWSGAAANAAETAI

SEQ ID NO: 1262122 - protein, 25 aa, Mycobacterium
DTAASLPVMVWIPGGAFVYGAGQFQ

SEQ ID NO: 1262123 - protein, 21 aa, Mycobacterium
DTAAVLAEWLGMPADEIAHLA

SEQ ID NO: 1262124 - protein, 26 aa, Mycobacterium
DTAEGLRLGHRVDWPVGDRNRTIADG

SEQ ID NO: 1262125 - protein, 20 aa, Mycobacterium
DTAFRALLTVSRRYDVKLRH

SEQ ID NO: 1262126 - protein, 24 aa, Mycobacterium
DTALAAYLVRPGQRSFALDDLSLR

SEQ ID NO: 1262127 - protein, 24 aa, Mycobacterium
DTAPRFSVALMEFGATVCTARAPR

SEQ ID NO: 1262128 - protein, 25 aa, Mycobacterium
DTAPTLGAGLDWKSSLQELTASRGL

SEQ ID NO: 1262129 - protein, 25 aa, Mycobacterium
DTARACAEWAHLVAGTSSIREGSRL

SEQ ID NO: 1262130 - protein, 17 aa, Mycobacterium
DTARRLVFVAGERVELT

SEQ ID NO: 1262131 - protein, 23 aa, Mycobacterium
DTAWFKGNYPPTVSIDAIEVDGY

SEQ ID NO: 1262132 - protein, 20 aa, Mycobacterium
DTCYLSMPLFHSNAIMAGWA

SEQ ID NO: 1262133 - protein, 23 aa, Mycobacterium
DTDEFRYSTALFDGEALVGVMDG

SEQ ID NO: 1262134 - protein, 19 aa, Mycobacterium
DTDFELMAVALVGAGEAIA

SEQ ID NO: 1262135 - protein, 18 aa, Mycobacterium
DTDIPWATDQARIRGFHQ

SEQ ID NO: 1262136 - protein, 23 aa, Mycobacterium
DTDLKALLPESARRAYDVHPLIE

SEQ ID NO: 1262137 - protein, 23 aa, Mycobacterium
DTDLPGMDGFAVLRRLRADGSPL

SEQ ID NO: 1262138 - protein, 25 aa, Mycobacterium
DTDPRVEGSWYWLDDHTAHWRPRQY

SEQ ID NO: 1262139 - protein, 21 aa, Mycobacterium
DTDRLAAVNLRVFGSAGGAGP

SEQ ID NO: 1262140 - protein, 18 aa, Mycobacterium
DTDSELFTRYWPADLHMV

SEQ ID NO: 1262141 - protein, 25 aa, Mycobacterium
DTEFLRLTLRTTLELGVDPASLVHA

SEQ ID NO: 1262142 - protein, 23 aa, Mycobacterium
DTEIPSPAAGVLKKIVAQEDDTV

SEQ ID NO: 1262143 - protein, 20 aa, Mycobacterium
DTELLDFTRMVSRLRAEHPV

SEQ ID NO: 1262144 - protein, 26 aa, Mycobacterium
DTENLSARCLLSLAISYIAVATDAAD

SEQ ID NO: 1262145 - protein, 18 aa, Mycobacterium
DTEPVDWDSFLRVNLYGV

SEQ ID NO: 1262146 - protein, 24 aa, Mycobacterium
DTERWWLDRMVSVIASSAGIRVED

SEQ ID NO: 1262147 - protein, 25 aa, Mycobacterium
DTERWWLDRMVSVIASSAGIRVEDL

SEQ ID NO: 1262148 - protein, 21 aa, Mycobacterium
DTFAYRKAMLVNIGDEKGALL

SEQ ID NO: 1262149 - protein, 19 aa, Mycobacterium
DTFERRGGVVLLSEDHSRI

SEQ ID NO: 1262150 - protein, 19 aa, Mycobacterium
DTFILTGFGVGIDFPQEER

SEQ ID NO: 1262151 - protein, 25 aa, Mycobacterium
DTFKELRGRFDLILNTVSANLNLED

SEQ ID NO: 1262152 - protein, 19 aa, Mycobacterium
DTGGPRGSFAMNNFANPVT

SEQ ID NO: 1262153 - protein, 25 aa, Mycobacterium
DTGHASWRSVLWARWPSAGPPPHFD

SEQ ID NO: 1262154 - protein, 24 aa, Mycobacterium
DTGHIPGAVKIDWHIDLNDPHVRD

SEQ ID NO: 1262155 - protein, 20 aa, Mycobacterium
DTGLLDRRAPDYAPVAVSDA

SEQ ID NO: 1262156 - protein, 24 aa, Mycobacterium
DTGNAKRGFLCQYHLWSYDLEGKL

SEQ ID NO: 1262157 - protein, 27 aa, Mycobacterium
DTGSVTYRYTWHLPKNRTWTYDGQLNL

SEQ ID NO: 1262158 - protein, 25 aa, Mycobacterium
DTGVPRPGLSTVFSRSRSTFGVDLL

SEQ ID NO: 1262159 - protein, 27 aa, Mycobacterium
DTHLLRYPLPASWSADVALYLKDETTH

SEQ ID NO: 1262160 - protein, 22 aa, Mycobacterium
DTIEKLTALPIFGGSKQRRSAA

SEQ ID NO: 1262161 - protein, 17 aa, Mycobacterium
DTILGRKNIEIEPRGSE

SEQ ID NO: 1262162 - protein, 17 aa, Mycobacterium
DTILGRKNIEIEPRGST

SEQ ID NO: 1262163 - protein, 22 aa, Mycobacterium
DTLARWVTRVNFSLMSEPAGAE

SEQ ID NO: 1262164 - protein, 17 aa, Mycobacterium
DTLDTAAAFGFAPAGAT

SEQ ID NO: 1262165 - protein, 24 aa, Mycobacterium
DTLHWLAALADRYDPSRVLATGQV

SEQ ID NO: 1262166 - protein, 23 aa, Mycobacterium
DTLLEHADLLAVLVTGLDGFVRR

SEQ ID NO: 1262167 - protein, 20 aa, Mycobacterium
DTLLLARWVAAVCQGIAIQA

SEQ ID NO: 1262168 - protein, 25 aa, Mycobacterium
DTLRRRLDREFGWQATVPRPNQQFS

SEQ ID NO: 1262169 - protein, 29 aa, Mycobacterium
DTLRVPLLEVCTRLRAAGRAVTFGVSQPV

SEQ ID NO: 1262170 - protein, 17 aa, Mycobacterium
DTLRWTVTTDGGEVVTS

SEQ ID NO: 1262171 - protein, 20 aa, Mycobacterium
DTLTMFGAIGFTWEHDLHLY

SEQ ID NO: 1262172 - protein, 24 aa, Mycobacterium
DTLVIPYGICDSAIGLATVPLPDL

SEQ ID NO: 1262173 - protein, 18 aa, Mycobacterium
DTLVLCTGFDIWEANIPA

SEQ ID NO: 1262174 - protein, 17 aa, Mycobacterium
DTLVLLESMKMEIPVLA

SEQ ID NO: 1262175 - protein, 24 aa, Mycobacterium
DTLVNCVGIFDFYRRIQDIPAELI

SEQ ID NO: 1262176 - protein, 24 aa, Mycobacterium
DTMIEMWLPLSWALNMVNRSMGKD

SEQ ID NO: 1262177 - protein, 19 aa, Mycobacterium
DTMNLGFVGCRDRLPRLQR

SEQ ID NO: 1262178 - protein, 38 aa, Mycobacterium; identical to SEQ ID NO: 649187

SEQ ID NO: 1262179 - protein, 26 aa, Mycobacterium
DTMRGGKFLNNWRMAELHAQEAPDRV

SEQ ID NO: 1262180 - protein, 25 aa, Mycobacterium
DTNVYYRRALVLAASFGRASDYPQR

SEQ ID NO: 1262181 - protein, 18 aa, Mycobacterium
DTPADWDAGIPRTGVEVF

SEQ ID NO: 1262182 - protein, 22 aa, Mycobacterium
DTPELRAGTTVYLGVNVDGALF

SEQ ID NO: 1262183 - protein, 24 aa, Mycobacterium
DTPKALAALDGWATDALTYGGHDA

SEQ ID NO: 1262184 - protein, 17 aa, Mycobacterium
DTPPFGVAWQPERGLDY

SEQ ID NO: 1262185 - protein, 17 aa, Mycobacterium
DTPRWAQRFDLVSDPHR

SEQ ID NO: 1262186 - protein, 25 aa, Mycobacterium
DTPWQREMEDAFGFTETVDQLTAIT

SEQ ID NO: 1262187 - protein, 17 aa, Mycobacterium
DTRAMLAAGLRLAVGTD

SEQ ID NO: 1262188 - protein, 18 aa, Mycobacterium
DTRDVFGPDIDVYDLTRA

SEQ ID NO: 1262189 - protein, 23 aa, Mycobacterium
DTRLALMRLEIESVVVADATGAE

SEQ ID NO: 1262190 - protein, 18 aa, Mycobacterium
DTRLCISLAGRPSNIGTR

SEQ ID NO: 1262191 - protein, 20 aa, Mycobacterium
DTRRSVGFALVVLQRRLASS

SEQ ID NO: 1262192 - protein, 21 aa, Mycobacterium
DTRWHPVSELPAMAFDHGPMV

SEQ ID NO: 1262193 - protein, 17 aa, Mycobacterium
DTSPEGYSWIDANDSTN

SEQ ID NO: 1262194 - protein, 24 aa, Mycobacterium
DTTMRMLCVFNPPVTGREIHDENG

SEQ ID NO: 1262195 - protein, 24 aa, Mycobacterium
DTTPRVAQMFGVQAVPTVVALAAG

SEQ ID NO: 1262196 - protein, 26 aa, Mycobacterium
DTVAPDQSCLWGFGRAAALELPQLWG

SEQ ID NO: 1262197 - protein, 25 aa, Mycobacterium
DTVDLRVAVKLSPFFSATAEMALRL

SEQ ID NO: 1262198 - protein, 25 aa, Mycobacterium
DTVFPIVLGALGTVMAPMQALGGSL

SEQ ID NO: 1262199 - protein, 20 aa, Mycobacterium
DTVFTAEAWGSDAYTPLAWL

SEQ ID NO: 1262200 - protein, 20 aa, Mycobacterium
DTVFTAEAWGSDAYTPLAWW

SEQ ID NO: 1262201 - protein, 18 aa, Mycobacterium
DTVILEWAVSGVAVKTGK

SEQ ID NO: 1262202 - protein, 25 aa, Mycobacterium
DTVKRARSGLSMAPPFVAPQTAWNA

SEQ ID NO: 1262203 - protein, 21 aa, Mycobacterium
DTVRGGAFVRLSFAGPASDLE

SEQ ID NO: 1262204 - protein, 20 aa, Mycobacterium
DTVTDWPRYSGHAIAGVSGF

SEQ ID NO: 1262205 - protein, 17 aa, Mycobacterium
DTVVRLDPFALGAFNDC

SEQ ID NO: 1262206 - protein, 21 aa, Mycobacterium
DTWIPGWRPRDLAMSNFPQLR

SEQ ID NO: 1262207 - protein, 21 aa, Mycobacterium
DTWLVHRLCGAFVTDASTASR

SEQ ID NO: 1262208 - protein, 24 aa, Mycobacterium
DVAADVWSVTSWGELNRDGVAIER

SEQ ID NO: 1262209 - protein, 21 aa, Mycobacterium
DVAALAPLLGTWVGEGSGEYP

SEQ ID NO: 1262210 - protein, 26 aa, Mycobacterium
DVAANWWPQLGVAGIGLWAENVLHHA

SEQ ID NO: 1262211 - protein, 23 aa, Mycobacterium
DVAAVLRAVVRAIATPVVNLAKV

SEQ ID NO: 1262212 - protein, 19 aa, Mycobacterium
DVAEFIIAFRHERPEDFGL

SEQ ID NO: 1262213 - protein, 25 aa, Mycobacterium
DVAEMPLGTGWVVAIAWPENDTDRS

SEQ ID NO: 1262214 - protein, 23 aa, Mycobacterium
DVAGIRADFPILQRVMRGGNQLA

SEQ ID NO: 1262215 - protein, 32 aa, Mycobacterium
DVAGRPGACWPLADIPLDWVLDGAVRAGVRLR

SEQ ID NO: 1262216 - protein, 25 aa, Mycobacterium
DVAIRWGGEEFLVFLPNTPLDDAVP

SEQ ID NO: 1262217 - protein, 28 aa, Mycobacterium
DVAKSLRASLRFAQDMYALIPLILMERK

SEQ ID NO: 1262218 - protein, 27 aa, Mycobacterium
DVALALVLPCWTLLGILDRAVALTVAH

SEQ ID NO: 1262219 - protein, 20 aa, Mycobacterium
DVANHSWVLYGLRSGLPRLA

SEQ ID NO: 1262220 - protein, 22 aa, Mycobacterium
DVAPKLPELWGGSADLAGSNNT

SEQ ID NO: 1262221 - protein, 20 aa, Mycobacterium
DVAPPVFAIVPVFESMMMPT

SEQ ID NO: 1262222 - protein, 26 aa, Mycobacterium
DVARGLRIARQLLLDIIDIGLPVGCE

SEQ ID NO: 1262223 - protein, 18 aa, Mycobacterium
DVARVVVRLIHTCGQVDV

SEQ ID NO: 1262224 - protein, 22 aa, Mycobacterium
DVASIKVLAHLLAAAEATTMTP

SEQ ID NO: 1262225 - protein, 29 aa, Mycobacterium
DVAVPPVRWLERRGDVLGRPFFLMDRVEG

SEQ ID NO: 1262226 - protein, 18 aa, Mycobacterium
DVAYRPGDVLMFGPEPTG

SEQ ID NO: 1262227 - protein, 18 aa, Mycobacterium
DVDAAIALGGRYLVSAQR

SEQ ID NO: 1262228 - protein, 22 aa, Mycobacterium
DVDAALHYLARMLVAGEDPRFV

SEQ ID NO: 1262229 - protein, 18 aa, Mycobacterium
DVDACTRYAQSLNPGVGV

SEQ ID NO: 1262230 - protein, 26 aa, Mycobacterium
DVDCSATLPGAIGWLKYTIDNELLMN

SEQ ID NO: 1262231 - protein, 19 aa, Mycobacterium
DVDDIVWQVPYLPIDPKDV

SEQ ID NO: 1262232 - protein, 26 aa, Mycobacterium
DVDFYKWTQWIFLQIYNAWFDTAQNK

SEQ ID NO: 1262233 - protein, 20 aa, Mycobacterium
DVDGRRIICETGDSGEKFVL

SEQ ID NO: 1262234 - protein, 25 aa, Mycobacterium
DVDGVLIPGGFGIRGIEGKIGAIHY

SEQ ID NO: 1262235 - protein, 26 aa, Mycobacterium
DVDKPKLVFVFDEAHLLFADASKAFL

SEQ ID NO: 1262236 - protein, 20 aa, Mycobacterium
DVEARLPVLSTYLGHRDPRW

SEQ ID NO: 1262237 - protein, 28 aa, Mycobacterium
DVEDLGRLCVYLATRDCYATNSIFHVDG

SEQ ID NO: 1262238 - protein, 23 aa, Mycobacterium
DVEEVLAWFARYDALAVARDIEA

SEQ ID NO: 1262239 - protein, 30 aa, Mycobacterium
DVEFRLRKNLIHDWFTFPFLPEAHEDRPGV

SEQ ID NO: 1262240 - protein, 17 aa, Mycobacterium
DVEGWQRYPECVADLPS

SEQ ID NO: 1262241 - protein, 26 aa, Mycobacterium
DVEHWRWMWEANVLGTLHVTRALLPK

SEQ ID NO: 1262242 - protein, 19 aa, Mycobacterium
DVEMLRGWLEQEAAAGHTV

SEQ ID NO: 1262243 - protein, 19 aa, Mycobacterium
DVEPAWQRAVAAGRITHNR

SEQ ID NO: 1262244 - protein, 24 aa, Mycobacterium
DVEPCAAVGLELARRGHEVRTAVP

SEQ ID NO: 1262245 - protein, 22 aa, Mycobacterium
DVEPGDVCIIMYSSGTTGRPKG

SEQ ID NO: 1262246 - protein, 29 aa, Mycobacterium
DVERPWRLALWRLRHNVVGAGPRLRPLQQ

SEQ ID NO: 1262247 - protein, 24 aa, Mycobacterium
DVEVLEFFRSAAFQSLAPGSQESY

SEQ ID NO: 1262248 - protein, 19 aa, Mycobacterium
DVEVTFPLIDDVTMEVARK

SEQ ID NO: 1262249 - protein, 20 aa, Mycobacterium
DVFDGFKMVDLIADLAKSDR

SEQ ID NO: 1262250 - protein, 28 aa, Mycobacterium
DVFNDRYKPDWCRVIDFPLTVAADVSDA

SEQ ID NO: 1262251 - protein, 18 aa, Mycobacterium
DVFVPRHRFLSYKAMNDG

SEQ ID NO: 1262252 - protein, 18 aa, Mycobacterium
DVGAPAAVGRLVLGEREV

SEQ ID NO: 1262253 - protein, 27 aa, Mycobacterium
DVGAYNPCFPQYRFDDIGNETASGSVT

SEQ ID NO: 1262254 - protein, 17 aa, Mycobacterium
DVGDPTVVPGFNSVVPQ

SEQ ID NO: 1262255 - protein, 19 aa, Mycobacterium
DVGGGFSFESCNDQGEPPY

SEQ ID NO: 1262256 - protein, 18 aa, Mycobacterium
DVGLLLVIGRLIAGAMHQ

SEQ ID NO: 1262257 - protein, 24 aa, Mycobacterium
DVGLRSAYIASWHAAPLLTAQQRG

SEQ ID NO: 1262258 - protein, 23 aa, Mycobacterium
DVGNLCWKLEAVLTGALSESVLD

SEQ ID NO: 1262259 - protein, 19 aa, Mycobacterium
DVGVPRGLAELGVAEDDLP

SEQ ID NO: 1262260 - protein, 17 aa, Mycobacterium
DVHAIAVVFARDDEEHA

SEQ ID NO: 1262261 - protein, 29 aa, Mycobacterium
DVHLAVRPGQDWALLLAMVKVVLDEGLEH

SEQ ID NO: 1262262 - protein, 23 aa, Mycobacterium
DVHLKAPFHILRAAQPVISGLVK

SEQ ID NO: 1262263 - protein, 24 aa, Mycobacterium
DVHLRGAFHVVRPAFPSMCDAGYG

SEQ ID NO: 1262264 - protein, 24 aa, Mycobacterium
DVHLWDWAAAALIATEAGAHVRPP

SEQ ID NO: 1262265 - protein, 26 aa, Mycobacterium
DVHPIEAGRPCWLLCLLFDDADGCAG

SEQ ID NO: 1262266 - protein, 29 aa, Mycobacterium
DVHRAGGIPAILGELWRGGHLHETVHSVH

SEQ ID NO: 1262267 - protein, 17 aa, Mycobacterium
DVHVELVAAGTGRQYHR

SEQ ID NO: 1262268 - protein, 19 aa, Mycobacterium
DVIAEGGVGGLRVRAISER

SEQ ID NO: 1262269 - protein, 25 aa, Mycobacterium
DVIDFAWADARVGVAIDGSGEADGW

SEQ ID NO: 1262270 - protein, 18 aa, Mycobacterium
DVIVPLGASWPVYDESLR

SEQ ID NO: 1262271 - protein, 24 aa, Mycobacterium
DVKEGRRIASMIPGARFEVMPGCG

SEQ ID NO: 1262272 - protein, 25 aa, Mycobacterium
DVKLKWRISLGALILHLRESKLIDN

SEQ ID NO: 1262273 - protein, 25 aa, Mycobacterium
DVKLLRLAQAYSLVVSAEVTAELFD

SEQ ID NO: 1262274 - protein, 33 aa, Mycobacterium
DVKRLLGQIKAIWRVNELLNWQVAASGETIAVA

SEQ ID NO: 1262275 - protein, 19 aa, Mycobacterium
DVKSGWKVAETFPAVPSSA

SEQ ID NO: 1262276 - protein, 19 aa, Mycobacterium
DVLEATGIPHTEVDLIVVN

SEQ ID NO: 1262277 - protein, 20 aa, Mycobacterium
DVLERMREQAARLGTATLTR

SEQ ID NO: 1262278 - protein, 19 aa, Mycobacterium
DVLGPGFAVVCWSNNLRAV

SEQ ID NO: 1262279 - protein, 29 aa, Mycobacterium
DVLLAPTLREAWAVIAPMLAGCTPVGAGV

SEQ ID NO: 1262280 - protein, 19 aa, Mycobacterium
DVLLFKYIIKNTAWQNGKT

SEQ ID NO: 1262281 - protein, 21 aa, Mycobacterium
DVLLQMCLEYIDRMFGEGTEL

SEQ ID NO: 1262282 - protein, 17 aa, Mycobacterium
DVLQGFVQRYLDTVVSG

SEQ ID NO: 1262283 - protein, 24 aa, Mycobacterium
DVLRCGICGSDLHAKDHADELTEV

SEQ ID NO: 1262284 - protein, 23 aa, Mycobacterium
DVLRGFVNACRHRGNALCTTDTG

SEQ ID NO: 1262285 - protein, 26 aa, Mycobacterium
DVLRLDRRPHPILLGAGRRARLTALP

SEQ ID NO: 1262286 - protein, 20 aa, Mycobacterium
DVLRSPAIFEWFDISGADDI

SEQ ID NO: 1262287 - protein, 17 aa, Mycobacterium
DVLRTYLELVLDGLVAR

SEQ ID NO: 1262288 - protein, 24 aa, Mycobacterium
DVLVNCVGVFDFYRSIEEIDADVL

SEQ ID NO: 1262289 - protein, 17 aa, Mycobacterium
DVMAALFGEPPVTTREE

SEQ ID NO: 1262290 - protein, 19 aa, Mycobacterium
DVMLQLSLIGGYRFGGPTD

SEQ ID NO: 1262291 - protein, 20 aa, Mycobacterium
DVNKGWLVARATLGNERISI

SEQ ID NO: 1262292 - protein, 18 aa, Mycobacterium
DVNVKGVFLLTRALVPLL

SEQ ID NO: 1262293 - protein, 24 aa, Mycobacterium
DVPADLAIDCARAVLDSDVDVAVS

SEQ ID NO: 1262294 - protein, 22 aa, Mycobacterium
DVPAENLLVLALDGQCPTGTVA

SEQ ID NO: 1262295 - protein, 23 aa, Mycobacterium
DVPDERRGAGFVSACALVDGTHE

SEQ ID NO: 1262296 - protein, 21 aa, Mycobacterium
DVPGFCKSATLAEIKAADYAL

SEQ ID NO: 1262297 - protein, 23 aa, Mycobacterium
DVPGIPVPVFLGGAKVLAQYGFG

SEQ ID NO: 1262298 - protein, 17 aa, Mycobacterium
DVPGVLCRRCVQHMRDE

SEQ ID NO: 1262299 - protein, 17 aa, Mycobacterium
DVPMLGWAGLGVAMGNA

SEQ ID NO: 1262300 - protein, 18 aa, Mycobacterium
DVPMPWATMHKIAAPTLL

SEQ ID NO: 1262301 - protein, 20 aa, Mycobacterium
DVPSGRRWTYAELNAEIDSL

SEQ ID NO: 1262302 - protein, 29 aa, Mycobacterium
DVPSVGWRSYRMVPGHPPSSWEPLAGRQI

SEQ ID NO: 1262303 - protein, 23 aa, Mycobacterium
DVPVDLRLADGFRRSVVEHLRDI

SEQ ID NO: 1262304 - protein, 32 aa, Mycobacterium
DVPVREFTKVMPPLLRPGVRILGKGVMGSYPY

SEQ ID NO: 1262305 - protein, 24 aa, Mycobacterium
DVQIMGGAALHFGNVAEMKTGEGK

SEQ ID NO: 1262306 - protein, 22 aa, Mycobacterium
DVQQRYLLVGGIRSTGLTSGMA

SEQ ID NO: 1262307 - protein, 28 aa, Mycobacterium
DVQRRLRADPGLIPAFLEEVLRFEPPFR

SEQ ID NO: 1262308 - protein, 22 aa, Mycobacterium
DVRARAGGVVRRADGTVTYGPI

SEQ ID NO: 1262309 - protein, 19 aa, Mycobacterium
DVREGAFLSAGREDLLRLE

SEQ ID NO: 1262310 - protein, 23 aa, Mycobacterium
DVREMLRRTLAVLSTPAARAALP

SEQ ID NO: 1262311 - protein, 25 aa, Mycobacterium
DVRGRGGASLGRFWAEEGPLSYLGL

SEQ ID NO: 1262312 - protein, 22 aa, Mycobacterium
DVRIPGRLIVGGKEKFDARIAK

SEQ ID NO: 1262313 - protein, 25 aa, Mycobacterium
DVRLITLFATRVWRSDRADADPAAR

SEQ ID NO: 1262314 - protein, 17 aa, Mycobacterium
DVRPAFAAIGADRDVDE

SEQ ID NO: 1262315 - protein, 29 aa, Mycobacterium
DVRPPRWLPPGRWWALIRVAAAGRLVYSP

SEQ ID NO: 1262316 - protein, 23 aa, Mycobacterium
DVRTARIVTPRVMHLTLRAQQPM

SEQ ID NO: 1262317 - protein, 17 aa, Mycobacterium
DVSLLSTAWWAAGASVT

SEQ ID NO: 1262318 - protein, 33 aa, Mycobacterium
DVSRIVVHLPPWLEPEPLCWDINNVDVVVGPGY

SEQ ID NO: 1262319 - protein, 17 aa, Mycobacterium
DVTAERVGTIGIGSGPA

SEQ ID NO: 1262320 - protein, 22 aa, Mycobacterium
DVTAGPTYRLFGIPVTVTNKLA

SEQ ID NO: 1262321 - protein, 18 aa, Mycobacterium
DVTLSCPIHAFYGDDDEI

SEQ ID NO: 1262322 - protein, 24 aa, Mycobacterium
DVTPEQIEKLWAINVNGVLWGTQA

SEQ ID NO: 1262323 - protein, 24 aa, Mycobacterium
DVTPRLEFQGARRVVTFMAAHPDG

SEQ ID NO: 1262324 - protein, 22 aa, Mycobacterium
DVTRSIAILEHWNDAWLEGQWL

SEQ ID NO: 1262325 - protein, 21 aa, Mycobacterium
DVVAVDAMLPAAHGEDAAPPD

SEQ ID NO: 1262326 - protein, 24 aa, Mycobacterium
DVVDIEGLITLAGREFAPVDIYVA

SEQ ID NO: 1262327 - protein, 29 aa, Mycobacterium
DVVFASHHWPTWGKDRIVEFLSLQRDLYA

SEQ ID NO: 1262328 - protein, 22 aa, Mycobacterium
DVVLERRITLGRGPVGDIAAGQ

SEQ ID NO: 1262329 - protein, 20 aa, Mycobacterium
DVVNELRAAGAEAIQIQGSP

SEQ ID NO: 1262330 - protein, 18 aa, Mycobacterium
DVVQECYTTLAGRSDEDG

SEQ ID NO: 1262331 - protein, 18 aa, Mycobacterium
DVVQRLHWDAARAQALGI

SEQ ID NO: 1262332 - protein, 24 aa, Mycobacterium
DVVVALRYAQMVTFTPLQLTHSEA

SEQ ID NO: 1262333 - protein, 31 aa, Mycobacterium
DVWFPGKKGGPGWVEWGGCGMVNPNVLRACG

SEQ ID NO: 1262334 - protein, 17 aa, Mycobacterium
DVWPWLAQIGEDRGGFY

SEQ ID NO: 1262335 - protein, 19 aa, Mycobacterium
DVWQPRYDEINAFERELVN

SEQ ID NO: 1262336 - protein, 17 aa, Mycobacterium
DVWRDLAALVLDHRDGW

SEQ ID NO: 1262337 - protein, 20 aa, Mycobacterium
DVYEFLIRAGHFGLVVGSKA

SEQ ID NO: 1262338 - protein, 17 aa, Mycobacterium
DVYRRMGYGEVVDDVTK

SEQ ID NO: 1262339 - protein, 18 aa, Mycobacterium
DVYRRTRVVSRVDDPSGA

SEQ ID NO: 1262340 - protein, 27 aa, Mycobacterium
DWADKPRLLATFPFPHVLTMSVTLADR

SEQ ID NO: 1262341 - protein, 21 aa, Mycobacterium
DWAGAVPELVMVRERLRDWRF

SEQ ID NO: 1262342 - protein, 22 aa, Mycobacterium
DWDEFFGGLGKLGFYDRDDTVM

SEQ ID NO: 1262343 - protein, 18 aa, Mycobacterium
DWDEVRDRFDIIARAVPM

SEQ ID NO: 1262344 - protein, 26 aa, Mycobacterium
DWDTQMLFFLQRGYRVIAHDRRGHGR

SEQ ID NO: 1262345 - protein, 20 aa, Mycobacterium
DWFRPKAMRALKVRVDELAK

SEQ ID NO: 1262346 - protein, 21 aa, Mycobacterium
DWFSSRAVIAPSLIAGEVAPR

SEQ ID NO: 1262347 - protein, 20 aa, Mycobacterium
DWHARFSATVAEGKHDPSSV

SEQ ID NO: 1262348 - protein, 25 aa, Mycobacterium
DWHERETYDFFGLIFDGHPALTRIE

SEQ ID NO: 1262349 - protein, 19 aa, Mycobacterium
DWLFNNPWELVSITSDLDG

SEQ ID NO: 1262350 - protein, 19 aa, Mycobacterium
DWLNFLVGIHKRLHVDIPE

SEQ ID NO: 1262351 - protein, 22 aa, Mycobacterium
DWLRGPDGLGLLTGTVVPSDAT

SEQ ID NO: 1262352 - protein, 23 aa, Mycobacterium
DWNPGRFEGRWSLAGAQPKIALF

SEQ ID NO: 1262353 - protein, 23 aa, Mycobacterium
DWNRAGSARAWWVLTAAGVADVR

SEQ ID NO: 1262354 - protein, 22 aa, Mycobacterium
DWPMAGSPAWCLLDDRDPVKWA

SEQ ID NO: 1262355 - protein, 18 aa, Mycobacterium
DWQAYFHLRNRLVVAALH

SEQ ID NO: 1262356 - protein, 27 aa, Mycobacterium
DWQLFSRWAEDIFKIVSFDCDLAEEEP

SEQ ID NO: 1262357 - protein, 22 aa, Mycobacterium
DWRMFAERAPLYTAREKAKELG

SEQ ID NO: 1262358 - protein, 22 aa, Mycobacterium
DWRPRLERLLADLRRRRDEAAR

SEQ ID NO: 1262359 - protein, 22 aa, Mycobacterium
DWSHRWGREPNALIGVDVDPDA

SEQ ID NO: 1262360 - protein, 20 aa, Mycobacterium
DWSIVGALFLRETAAGRDLM

SEQ ID NO: 1262361 - protein, 19 aa, Mycobacterium
DWVCRAPAGLVALENIPPT

SEQ ID NO: 1262362 - protein, 28 aa, Mycobacterium
DYAKGFKFSTYATWWIRQAITRGMADQS

SEQ ID NO: 1262363 - protein, 23 aa, Mycobacterium
DYAKLGIDEVIVFPPTGSPALWI

SEQ ID NO: 1262364 - protein, 18 aa, Mycobacterium
DYAPRPLHWSGMGATHAT

SEQ ID NO: 1262365 - protein, 17 aa, Mycobacterium
DYARAVERLGLAPDARA

SEQ ID NO: 1262366 - protein, 19 aa, Mycobacterium
DYARDVARDFCRRRVAVGT

SEQ ID NO: 1262367 - protein, 20 aa, Mycobacterium
DYDAVDAFDLITAFDSIHDQ

SEQ ID NO: 1262368 - protein, 21 aa, Mycobacterium
DYEKSATFPMPGVKPPIGPPD

SEQ ID NO: 1262369 - protein, 25 aa, Mycobacterium
DYFKFRYYEKWLGGITQFFIDKGYV

SEQ ID NO: 1262370 - protein, 26 aa, Mycobacterium
DYGADVWRWLDDGAHFYVCGDATRMA

SEQ ID NO: 1262371 - protein, 17 aa, Mycobacterium
DYGDVAYGWAMEDSTGF

SEQ ID NO: 1262372 - protein, 28 aa, Mycobacterium
DYGPAVARRVARWMVVFLQRPGGQAQFS

SEQ ID NO: 1262373 - protein, 18 aa, Mycobacterium
DYIDRLDEFKVWTRQVRN

SEQ ID NO: 1262374 - protein, 23 aa, Mycobacterium
DYIDRLDEFKVWTRQVRNLLNSP

SEQ ID NO: 1262375 - protein, 25 aa, Mycobacterium
DYIETLPAFGRRAAVVELRGHGHSR

SEQ ID NO: 1262376 - protein, 23 aa, Mycobacterium
DYLDMPPLRVDPATVLTDNPQGI

SEQ ID NO: 1262377 - protein, 21 aa, Mycobacterium
DYLDMPPLRVNPATVLSDNPH

SEQ ID NO: 1262378 - protein, 23 aa, Mycobacterium
DYLGEKICAAVVFRGKQLTLAEL

SEQ ID NO: 1262379 - protein, 22 aa, Mycobacterium
DYLRAGAIAKFAPVMGEVIEAA

SEQ ID NO: 1262380 - protein, 24 aa, Mycobacterium
DYLSADEALRCGLVTQVVPHAELL

SEQ ID NO: 1262381 - protein, 21 aa, Mycobacterium
DYLSEAILKIATLAQSGDVLG

SEQ ID NO: 1262382 - protein, 23 aa, Mycobacterium
DYPGPRWLVGDLAELDLPARGIT

SEQ ID NO: 1262383 - protein, 26 aa, Mycobacterium
DYPRGNLAFRWFLADQVPARPEVMLV

SEQ ID NO: 1262384 - protein, 21 aa, Mycobacterium
DYQDPWFPFSHPPTEDAPALD

SEQ ID NO: 1262385 - protein, 18 aa, Mycobacterium
DYRAWFATLPTEFADAVV

SEQ ID NO: 1262386 - protein, 17 aa, Mycobacterium
DYRKVSADPDITATTFA

SEQ ID NO: 1262387 - protein, 24 aa, Mycobacterium
DYRMPQMSGIEFLEAAMDIFPMAR

SEQ ID NO: 1262388 - protein, 19 aa, Mycobacterium
DYRRHSLTLGREVTATLPG

SEQ ID NO: 1262389 - protein, 19 aa, Mycobacterium
DYRVPIGEALRLWYELLSS

SEQ ID NO: 1262390 - protein, 28 aa, Mycobacterium
DYSPCLECKLCVAACPVGAIKKNGDFDF

SEQ ID NO: 1262391 - protein, 19 aa, Mycobacterium
DYSSAGAVVGGRDEVVEWF

SEQ ID NO: 1262392 - protein, 25 aa, Mycobacterium
DYTEDFRSSWLCRYLEDAHNAGEDV

SEQ ID NO: 1262393 - protein, 25 aa, Mycobacterium
DYTLFYRLLAGAARGDAEPVRGEFI

SEQ ID NO: 1262394 - protein, 25 aa, Mycobacterium
DYVNARPAPLVAYWFGPDDTDFRSF

SEQ ID NO: 1262395 - protein, 20 aa, Mycobacterium
DYVSDGRFRLGLGTSGPQVV

SEQ ID NO: 1262396 - protein, 19 aa, Mycobacterium
DYYCNDWGADLILDVDPPG

SEQ ID NO: 1262397 - protein, 27 aa, Mycobacterium
DYYLVLARWKLAIVLEQGFQRAGDDEK

SEQ ID NO: 1262398 - protein, 24 aa, Mycobacterium
EAAAEAGVDCFVAGSAVYSAQDPA

SEQ ID NO: 1262399 - protein, 24 aa, Mycobacterium
EAAAEAGVGLGLLGTAVREGPLAL

SEQ ID NO: 1262400 - protein, 17 aa, Mycobacterium
EAAALPLTVYYHGGGWL

SEQ ID NO: 1262401 - protein, 18 aa, Mycobacterium
EAACAAVVRHLRGAGPCT

SEQ ID NO: 1262402 - protein, 17 aa, Mycobacterium
EAADPGPGFGRFLTAMR

SEQ ID NO: 1262403 - protein, 19 aa, Mycobacterium
EAAECLRALVAGRVQISLD

SEQ ID NO: 1262404 - protein, 20 aa, Mycobacterium
EAAEIAELLTLAGDPASVRH

SEQ ID NO: 1262405 - protein, 22 aa, Mycobacterium
EAAFKITRLTGRTKVVAAEGAF

SEQ ID NO: 1262406 - protein, 23 aa, Mycobacterium
EAAGFRQLRRWARGFYPDAEPAE

SEQ ID NO: 1262407 - protein, 22 aa, Mycobacterium
EAAGVPRYVMVSSMGADAAAPD

SEQ ID NO: 1262408 - protein, 26 aa, Mycobacterium
EAAHPGRFLLGIGVGHPEAHQEYVKP

SEQ ID NO: 1262409 - protein, 24 aa, Mycobacterium
EAAIERLRTQPALEEAASRVEEYT

SEQ ID NO: 1262410 - protein, 24 aa, Mycobacterium
EAALAIRSGALWVAANVDKTLPSE

SEQ ID NO: 1262411 - protein, 20 aa, Mycobacterium
EAALARERVGQLLSLVERRM

SEQ ID NO: 1262412 - protein, 31 aa, Mycobacterium
EAALGVALRIAWRALTFAGLRGSDRMRQLER

SEQ ID NO: 1262413 - protein, 24 aa, Mycobacterium
EAALPRLDAMIAVDSWLNETTRHA

SEQ ID NO: 1262414 - protein, 19 aa, Mycobacterium
EAALRRGLVHEVFATEGAA

SEQ ID NO: 1262415 - protein, 25 aa, Mycobacterium
EAAQRLSAVSDFGLNDLLPPATADL

SEQ ID NO: 1262416 - protein, 17 aa, Mycobacterium
EAARIAATAKREYEATT

SEQ ID NO: 1262417 - protein, 17 aa, Mycobacterium
EAARIAKIYSARAAMTV

SEQ ID NO: 1262418 - protein, 23 aa, Mycobacterium
EAARLCGAAEAIRGRTGAVRFRI

SEQ ID NO: 1262419 - protein, 26 aa, Mycobacterium
EAARRIGARPQRCVVVENSAAGVAAG

SEQ ID NO: 1262420 - protein, 23 aa, Mycobacterium
EAARRRFGFDIAVRVGVHRGPVY

SEQ ID NO: 1262421 - protein, 17 aa, Mycobacterium
EAAVRKHVGGIFAKLPL

SEQ ID NO: 1262422 - protein, 21 aa, Mycobacterium
EAAYGCWARHQAGALLLTDEL

SEQ ID NO: 1262423 - protein, 26 aa, Mycobacterium
EAAYIKFKSFGGWLQTLAGKWTQLAA

SEQ ID NO: 1262424 - protein, 23 aa, Mycobacterium
EACECPGGCPSCVQSPKCGNGND

SEQ ID NO: 1262425 - protein, 24 aa, Mycobacterium
EACECPSGCPSCVQSPKCGNGNDP

SEQ ID NO: 1262426 - protein, 34 aa, Mycobacterium
EACEDPRFSIARLSLLDRGMIFAVAHVRGGGELG

SEQ ID NO: 1262427 - protein, 18 aa, Mycobacterium
EACICDLTAPLGLSQPTV

SEQ ID NO: 1262428 - protein, 23 aa, Mycobacterium
EACQAAGLDTEWVDGSHGAHVPF

SEQ ID NO: 1262429 - protein, 21 aa, Mycobacterium
EACSLAMLVERGAKLQLAAMA

SEQ ID NO: 1262430 - protein, 26 aa, Mycobacterium
EADAAPTRFARGWHCLGLTRDFGDGK

SEQ ID NO: 1262431 - protein, 19 aa, Mycobacterium
EADAIIARIGRLLGSVWTD

SEQ ID NO: 1262432 - protein, 19 aa, Mycobacterium
EADGADVVQFFLGDPQSWK

SEQ ID NO: 1262433 - protein, 19 aa, Mycobacterium
EADGADVVQFFLGNPQSWK

SEQ ID NO: 1262434 - protein, 26 aa, Mycobacterium
EADGPVVVVGHSFGGAIALNLAAVRP

SEQ ID NO: 1262435 - protein, 20 aa, Mycobacterium
EADKFYGFAATEFGRYADSA

SEQ ID NO: 1262436 - protein, 17 aa, Mycobacterium
EADLVLLAMGFVGPEKD

SEQ ID NO: 1262437 - protein, 19 aa, Mycobacterium
EADPLRLLIYTSGSTGAPK

SEQ ID NO: 1262438 - protein, 18 aa, Mycobacterium
EADPPIELVGSFLRPSEY

SEQ ID NO: 1262439 - protein, 23 aa, Mycobacterium
EADPRAVVWLLVRPMANSIANGE

SEQ ID NO: 1262440 - protein, 20 aa, Mycobacterium
EADVAVRIGPAPARQSYLSV

SEQ ID NO: 1262441 - protein, 20 aa, Mycobacterium
EADYPAVQYIPLRDVNDSAL

SEQ ID NO: 1262442 - protein, 22 aa, Mycobacterium
EADYRTRWTIPVGVRESDLTVA

SEQ ID NO: 1262443 - protein, 27 aa, Mycobacterium
EAEAPFSPADIRVWVGHYFDYMDHHGA

SEQ ID NO: 1262444 - protein, 24 aa, Mycobacterium
EAECVPASAALQMFLGDPGRPATP

SEQ ID NO: 1262445 - protein, 25 aa, Mycobacterium
EAEDFAALLIYRLGRLPSDRSSIVQ

SEQ ID NO: 1262446 - protein, 31 aa, Mycobacterium
EAEEIVRASSLEWVVLRLGGVLSVDPKAMPL

SEQ ID NO: 1262447 - protein, 24 aa, Mycobacterium
EAEGLPHVPVRLHARSWHRYPEPS

SEQ ID NO: 1262448 - protein, 19 aa, Mycobacterium
EAEGVLWSWTLDLATGTVR

SEQ ID NO: 1262449 - protein, 21 aa, Mycobacterium
EAEGVVSTWFVADGDHVEEGD

SEQ ID NO: 1262450 - protein, 25 aa, Mycobacterium
EAELECPLIQVGFMRRFDDEYMRLK

SEQ ID NO: 1262451 - protein, 22 aa, Mycobacterium
EAELGVRLIQVGFMRRFDDEYR

SEQ ID NO: 1262452 - protein, 18 aa, Mycobacterium
EAELGWIATAFDPDVLTI

SEQ ID NO: 1262453 - protein, 18 aa, Mycobacterium
EAELPELLDRALPRIGLV

SEQ ID NO: 1262454 - protein, 21 aa, Mycobacterium
EAELRAAVERCERLKSQAAAA

SEQ ID NO: 1262455 - protein, 23 aa, Mycobacterium
EAEPGLRIAVPLPNADGAKVTTV

SEQ ID NO: 1262456 - protein, 25 aa, Mycobacterium
EAEPGLRVAVPLANAAGETRTAVDG

SEQ ID NO: 1262457 - protein, 19 aa, Mycobacterium
EAEPMIIGKAFAVKINANI

SEQ ID NO: 1262458 - protein, 19 aa, Mycobacterium
EAFDGCVTVAVSDQCPTPA

SEQ ID NO: 1262459 - protein, 25 aa, Mycobacterium
EAFEMQRFELIAGVLNARLVVVEVP

SEQ ID NO: 1262460 - protein, 17 aa, Mycobacterium
EAFNEVRSELGLAQAPR

SEQ ID NO: 1262461 - protein, 20 aa, Mycobacterium
EAFRAVYECAVPVVAAVNGF

SEQ ID NO: 1262462 - protein, 21 aa, Mycobacterium
EAFSSARGCDLGMVRSEDGPV

SEQ ID NO: 1262463 - protein, 17 aa, Mycobacterium
EAFTRLRTMLAVHETAE

SEQ ID NO: 1262464 - protein, 20 aa, Mycobacterium
EAFTRPARLFGLAKLGYTQS

SEQ ID NO: 1262465 - protein, 24 aa, Mycobacterium
EAGAILRRQIIAIGAQILGVEESE

SEQ ID NO: 1262466 - protein, 24 aa, Mycobacterium
EAGARLPLTLSMLLYDSSGTNKDA

SEQ ID NO: 1262467 - protein, 19 aa, Mycobacterium
EAGARTWRVVPGSAPQVGQ

SEQ ID NO: 1262468 - protein, 21 aa, Mycobacterium
EAGDGPALLLLHGSGPGVTGW

SEQ ID NO: 1262469 - protein, 19 aa, Mycobacterium
EAGDGVWAIYTTDATGGAH

SEQ ID NO: 1262470 - protein, 24 aa, Mycobacterium
EAGDRVRAKFGFACTSAAATAEAV

SEQ ID NO: 1262471 - protein, 20 aa, Mycobacterium
EAGEAPGYDAFTVVATDPQG

SEQ ID NO: 1262472 - protein, 33 aa, Mycobacterium
EAGGGWRMYTRSRYAPYVERLLLDGARSKLTRA

SEQ ID NO: 1262473 - protein, 24 aa, Mycobacterium
EAGGYGFDPERLWATVYLDDDEAI

SEQ ID NO: 1262474 - protein, 18 aa, Mycobacterium
EAGIKHVTLELGGKNAMI

SEQ ID NO: 1262475 - protein, 24 aa, Mycobacterium
EAGLPLPYRTWEAIFSTANDRCQT

SEQ ID NO: 1262476 - protein, 18 aa, Mycobacterium
EAGMEVCCGGILGMGETL

SEQ ID NO: 1262477 - protein, 19 aa, Mycobacterium
EAGPTFFEAYGQWMGTPPP

SEQ ID NO: 1262478 - protein, 23 aa, Mycobacterium
EAGPTFRPGLRADDVGQFLVTTS

SEQ ID NO: 1262479 - protein, 17 aa, Mycobacterium
EAGRPAPRIVAGIPVCL

SEQ ID NO: 1262480 - protein, 18 aa, Mycobacterium
EAGRRLRRAKTLGPRRGL

SEQ ID NO: 1262481 - protein, 23 aa, Mycobacterium
EAGSKVKVTIMFRGREQSRPELG

SEQ ID NO: 1262482 - protein, 23 aa, Mycobacterium
EAGTEPGLRYVLGRNEQAMVHTA

SEQ ID NO: 1262483 - protein, 18 aa, Mycobacterium
EAGVMMIIETEEHAKARG

SEQ ID NO: 1262484 - protein, 22 aa, Mycobacterium
EAGWKWKTGRFPGEDAEPAHVR

SEQ ID NO: 1262485 - protein, 19 aa, Mycobacterium
EAHCKHLGAHIGHGGTVVG

SEQ ID NO: 1262486 - protein, 21 aa, Mycobacterium
EAHHRPLVLVSAGIGITPMVG

SEQ ID NO: 1262487 - protein, 30 aa, Mycobacterium
EAHLISPWGTWEWMGPAAIGADLPACGSVT

SEQ ID NO: 1262488 - protein, 24 aa, Mycobacterium
EAHSHLDIAPAHFDRVVDHLAETL

SEQ ID NO: 1262489 - protein, 21 aa, Mycobacterium
EAIAGMNAVAGWAGAPRPVSA

SEQ ID NO: 1262490 - protein, 25 aa, Mycobacterium
EAIDAEIPLLVVITEGIPVQDTAYA

SEQ ID NO: 1262491 - protein, 24 aa, Mycobacterium
EAIGELGLDCQIIRNRGALMVLPA

SEQ ID NO: 1262492 - protein, 20 aa, Mycobacterium
EAIGVLGLDCQIIRNREALM

SEQ ID NO: 1262493 - protein, 20 aa, Mycobacterium
EAIHCFERALELDADLAMAR

SEQ ID NO: 1262494 - protein, 19 aa, Mycobacterium
EAIIQNWWRQGMMGGAKAH

SEQ ID NO: 1262495 - protein, 21 aa, Mycobacterium
EAIKQLKARYSRFLDTKDWDS

SEQ ID NO: 1262496 - protein, 24 aa, Mycobacterium
EAIRAGAAIKILWLPGPDPEPHYR

SEQ ID NO: 1262497 - protein, 30 aa, Mycobacterium
EAIRLRVPVPSIAASLFARFESRQEDSPTM

SEQ ID NO: 1262498 - protein, 19 aa, Mycobacterium
EAITWLAEHLKRRWSPSAG

SEQ ID NO: 1262499 - protein, 27 aa, Mycobacterium
EAIVRASSLEWVVLRLGGVLSTDPNAI

SEQ ID NO: 1262500 - protein, 19 aa, Mycobacterium
EAKGALWNEHVKAIRVLTT

SEQ ID NO: 1262501 - protein, 31 aa, Mycobacterium
EAKGLGSGGARGCPPATWCVQNAGNYRGTMN

SEQ ID NO: 1262502 - protein, 20 aa, Mycobacterium
EAKIKLADMRSGRMNDDDWT

SEQ ID NO: 1262503 - protein, 26 aa, Mycobacterium
EAKLETICRLIMLYHLDRAWADHLAF

SEQ ID NO: 1262504 - protein, 17 aa, Mycobacterium
EAKRHHHELGWFARQAL

SEQ ID NO: 1262505 - protein, 22 aa, Mycobacterium
EAKTRFLETFERLILRPRGLDY

SEQ ID NO: 1262506 - protein, 23 aa, Mycobacterium
EALADAGAHVVITGRTRARGEQV

SEQ ID NO: 1262507 - protein, 19 aa, Mycobacterium
EALAIWQAIFAKEAAPGAN

SEQ ID NO: 1262508 - protein, 25 aa, Mycobacterium
EALARSRRALAEFNVEGLATVIPFH

SEQ ID NO: 1262509 - protein, 18 aa, Mycobacterium
EALCADTLAVLRQIGRPT

SEQ ID NO: 1262510 - protein, 19 aa, Mycobacterium
EALDAAGIAFIGPPVAAIQ

SEQ ID NO: 1262511 - protein, 17 aa, Mycobacterium
EALDRGTPVRFSTTIAN

SEQ ID NO: 1262512 - protein, 21 aa, Mycobacterium
EALEAGTLAAWLAEHSNGQRF

SEQ ID NO: 1262513 - protein, 19 aa, Mycobacterium
EALELPPERHVDTFDECGN

SEQ ID NO: 1262514 - protein, 26 aa, Mycobacterium
EALERGGLRVARRAPLAAAARRVLEV

SEQ ID NO: 1262515 - protein, 27 aa, Mycobacterium
EALGAEQRWGIAESRRLAETLRLVAQA

SEQ ID NO: 1262516 - protein, 19 aa, Mycobacterium
EALGKLYVQRHFPPNAKAR

SEQ ID NO: 1262517 - protein, 18 aa, Mycobacterium
EALGPGWAELDGELLTDR

SEQ ID NO: 1262518 - protein, 21 aa, Mycobacterium
EALHEAIRWRRTVHIDEIATL

SEQ ID NO: 1262519 - protein, 20 aa, Mycobacterium
EALIARAVAESGLPQARITG

SEQ ID NO: 1262520 - protein, 22 aa, Mycobacterium
EALIGDFHTRWFAADLSARDLF

SEQ ID NO: 1262521 - protein, 18 aa, Mycobacterium
EALIRLDLAEMLREEGYE

SEQ ID NO: 1262522 - protein, 28 aa, Mycobacterium
EALKPYYRFMCKRPCSSEQYLATFNRPN

SEQ ID NO: 1262523 - protein, 17 aa, Mycobacterium
EALLAYEGATRSRAPFQ

SEQ ID NO: 1262524 - protein, 19 aa, Mycobacterium
EALLDLDLVAAFNAVTNLP

SEQ ID NO: 1262525 - protein, 18 aa, Mycobacterium
EALLGWADSVGVDGSDPY

SEQ ID NO: 1262526 - protein, 21 aa, Mycobacterium
EALPEAAWQHSVHAVLTADVV

SEQ ID NO: 1262527 - protein, 24 aa, Mycobacterium
EALPSRPVQVIGFTSVPGAGDNFL

SEQ ID NO: 1262528 - protein, 24 aa, Mycobacterium
EALQKRFGTLTGVDRAAEDGDFVS

SEQ ID NO: 1262529 - protein, 19 aa, Mycobacterium
EALQTAGVSKVFSDVMSGA

SEQ ID NO: 1262530 - protein, 27 aa, Mycobacterium
EALRDEFDFRYLVGVVSVMGDKDVDGI

SEQ ID NO: 1262531 - protein, 17 aa, Mycobacterium
EALRELFELDQHAVDAV

SEQ ID NO: 1262532 - protein, 18 aa, Mycobacterium
EALRSGGVVVVFPGGDYD

SEQ ID NO: 1262533 - protein, 25 aa, Mycobacterium
EALSARPGIVLSRRQLLEIIRDEPW

SEQ ID NO: 1262534 - protein, 17 aa, Mycobacterium
EALSCLKTIQKYHDSDD

SEQ ID NO: 1262535 - protein, 20 aa, Mycobacterium
EALSLADSVALLIDGVIAQH

SEQ ID NO: 1262536 - protein, 19 aa, Mycobacterium
EALTAPAPHHTRPVRFVWV

SEQ ID NO: 1262537 - protein, 21 aa, Mycobacterium
EALTIAAVCYCLINDTVRAGI

SEQ ID NO: 1262538 - protein, 17 aa, Mycobacterium
EALVTERDVARVVASGQ

SEQ ID NO: 1262539 - protein, 36 aa, Mycobacterium
EAMGLLRGGDSWMFVGWCRLREGIRGFHLDRILHLE

SEQ ID NO: 1262540 - protein, 18 aa, Mycobacterium
EAMLRSGATITHHHAVGA

SEQ ID NO: 1262541 - protein, 17 aa, Mycobacterium
EAMQKAWGPVRVAIAAE

SEQ ID NO: 1262542 - protein, 23 aa, Mycobacterium
EANAPVLLGLIGLWYSNFFGAET

SEQ ID NO: 1262543 - protein, 20 aa, Mycobacterium
EAPAALPAHRYICNPDKRQY

SEQ ID NO: 1262544 - protein, 22 aa, Mycobacterium
EAPLYYNGRYDFWALSRHADVE

SEQ ID NO: 1262545 - protein, 23 aa, Mycobacterium
EAPQRVAGLIAEIVGVPQPPSKT

SEQ ID NO: 1262546 - protein, 22 aa, Mycobacterium
EAPRVRVLPSRIHLHELDPTPP

SEQ ID NO: 1262547 - protein, 19 aa, Mycobacterium
EAPSLPGLAELWGRSVFHC

SEQ ID NO: 1262548 - protein, 26 aa, Mycobacterium
EAQAMCAADGLGLLRMVLGGRLEVGG

SEQ ID NO: 1262549 - protein, 21 aa, Mycobacterium
EAQGIWRLALDTADGPATLSA

SEQ ID NO: 1262550 - protein, 23 aa, Mycobacterium
EAQLRFLAGQGVDLIITSGGLGP

SEQ ID NO: 1262551 - protein, 20 aa, Mycobacterium
EAQMSALLMAIFLRGMTNGE

SEQ ID NO: 1262552 - protein, 22 aa, Mycobacterium
EAQNLLGGIAEYFTTDQASVTY

SEQ ID NO: 1262553 - protein, 23 aa, Mycobacterium
EAQRCKADLVIRSHARDMVLPSR

SEQ ID NO: 1262554 - protein, 20 aa, Mycobacterium
EAQRGNVIPVEITVYEDRSF

SEQ ID NO: 1262555 - protein, 21 aa, Mycobacterium
EARAAELGPDCVFKYTDVASR

SEQ ID NO: 1262556 - protein, 18 aa, Mycobacterium
EARAHWDVIAAKYAAPGA

SEQ ID NO: 1262557 - protein, 19 aa, Mycobacterium
EARAHWDVIAAKYAAPGAN

SEQ ID NO: 1262558 - protein, 26 aa, Mycobacterium
EARAKIKKALREMQRKGLTINPNALA

SEQ ID NO: 1262559 - protein, 24 aa, Mycobacterium
EARARRLQPHFIRDAFTEAFRQLG

SEQ ID NO: 1262560 - protein, 19 aa, Mycobacterium
EAREAMAIGSGLDNPNGVF

SEQ ID NO: 1262561 - protein, 20 aa, Mycobacterium
EARELWSRSMQRWIDHIAAV

SEQ ID NO: 1262562 - protein, 21 aa, Mycobacterium
EAREVVALGGLYVLGTERHES

SEQ ID NO: 1262563 - protein, 21 aa, Mycobacterium
EARFRPSWLPIPMRSIDRILG

SEQ ID NO: 1262564 - protein, 24 aa, Mycobacterium
EARKVGFEPLPPVYTTGVLAKYTK

SEQ ID NO: 1262565 - protein, 20 aa, Mycobacterium
EARLPMQRDTIFRIASMTKP

SEQ ID NO: 1262566 - protein, 18 aa, Mycobacterium
EARMPGAEPLRVDTPARP

SEQ ID NO: 1262567 - protein, 21 aa, Mycobacterium
EARNAMTPAMYFGIRYAISRV

SEQ ID NO: 1262568 - protein, 31 aa, Mycobacterium
EARQSSRIPFRYAWSEVRAALDTHRHSDGSP

SEQ ID NO: 1262569 - protein, 20 aa, Mycobacterium
EARRQSWDAPLFDETYAFGG

SEQ ID NO: 1262570 - protein, 28 aa, Mycobacterium
EASEKRLKRWASRRYPVSILDGRTEPWA

SEQ ID NO: 1262571 - protein, 17 aa, Mycobacterium
EASGFDASGFHDGGDHD

SEQ ID NO: 1262572 - protein, 23 aa, Mycobacterium
EASLPRDCLLIFGQEGPGITDDA

SEQ ID NO: 1262573 - protein, 24 aa, Mycobacterium
EASQLRFSLGLMEIVGLRLAGALE

SEQ ID NO: 1262574 - protein, 23 aa, Mycobacterium
EASRKMALVIAGKGRAAGMQRTG

SEQ ID NO: 1262575 - protein, 22 aa, Mycobacterium
EASYFGPSFMINWLHNKYGDFK

SEQ ID NO: 1262576 - protein, 22 aa, Mycobacterium
EATARLLGTRGARLVLGARRAD

SEQ ID NO: 1262577 - protein, 20 aa, Mycobacterium
EATARWAFERLGPERFGDTT

SEQ ID NO: 1262578 - protein, 18 aa, Mycobacterium
EATLLVLRGKVQIGTATD

SEQ ID NO: 1262579 - protein, 17 aa, Mycobacterium
EATLRLTGETALLEDTD

SEQ ID NO: 1262580 - protein, 23 aa, Mycobacterium
EATRAAAGIGLLPCFMADRHPDL

SEQ ID NO: 1262581 - protein, 23 aa, Mycobacterium
EATRVPFVIARTGVNATAARTVT

SEQ ID NO: 1262582 - protein, 25 aa, Mycobacterium
EATRVPFVIARVGARPTTARTVTAP

SEQ ID NO: 1262583 - protein, 21 aa, Mycobacterium
EAVADRRSRYVLESDEPAALL

SEQ ID NO: 1262584 - protein, 27 aa, Mycobacterium
EAVAKLGRHRFPIVLTESVEQFLTAVG

SEQ ID NO: 1262585 - protein, 20 aa, Mycobacterium
EAVALLGRLDGIAITMGTAG

SEQ ID NO: 1262586 - protein, 23 aa, Mycobacterium
EAVAYAEWMSRNGYLPVETTHVN

SEQ ID NO: 1262587 - protein, 23 aa, Mycobacterium
EAVGAKLSAFVAITPLDPSQPDD

SEQ ID NO: 1262588 - protein, 27 aa, Mycobacterium
EAVGIPDEWFLAGHIVVGWPRGHHGPV

SEQ ID NO: 1262589 - protein, 20 aa, Mycobacterium
EAVGVSWAALDMAVGYAKVR

SEQ ID NO: 1262590 - protein, 25 aa, Mycobacterium
EAVLARLDGVRGWQEDCYRDLHRHP

SEQ ID NO: 1262591 - protein, 21 aa, Mycobacterium
EAVSARTGATWVTAYGASELP

SEQ ID NO: 1262592 - protein, 21 aa, Mycobacterium
EAVSFRFGDRTQVNGVPREQA

SEQ ID NO: 1262593 - protein, 26 aa, Mycobacterium
EAVSPWMAPGRWGWTGGSGTSAHVHP

SEQ ID NO: 1262594 - protein, 18 aa, Mycobacterium
EAVSRYWIIDDIRPALID

SEQ ID NO: 1262595 - protein, 19 aa, Mycobacterium
EAVYSARADAKWAALAELL

SEQ ID NO: 1262596 - protein, 18 aa, Mycobacterium
EAWCDEFNEPLPALTSFV

SEQ ID NO: 1262597 - protein, 21 aa, Mycobacterium
EAWRVLRPGGRLHIVDVGGAD

SEQ ID NO: 1262598 - protein, 22 aa, Mycobacterium
EAYCAIPSMGAVLHTLNIRLAP

SEQ ID NO: 1262599 - protein, 27 aa, Mycobacterium
EAYPPRLAEDWDSVGLVCGDPDEPVES

SEQ ID NO: 1262600 - protein, 17 aa, Mycobacterium
EAYRFLVDVWTPGDQIY

SEQ ID NO: 1262601 - protein, 24 aa, Mycobacterium
EAYTEVFDRFAGRIDPGGALVVCV

SEQ ID NO: 1262602 - protein, 20 aa, Mycobacterium
ECAHEALPLGDAVFDATAGT

SEQ ID NO: 1262603 - protein, 19 aa, Mycobacterium
ECCSHRFQYKAGQFLTLRV

SEQ ID NO: 1262604 - protein, 19 aa, Mycobacterium
ECDACRDGEEQYCTGGGMV

SEQ ID NO: 1262605 - protein, 22 aa, Mycobacterium
ECDAICQVVRVFADDDVVHVDG

SEQ ID NO: 1262606 - protein, 19 aa, Mycobacterium
ECDCYTCTHYTRAYLHHLF

SEQ ID NO: 1262607 - protein, 19 aa, Mycobacterium
ECELCGAAGDFFLRGRTSG

SEQ ID NO: 1262608 - protein, 24 aa, Mycobacterium
ECGDPPKTAWLFTGQGSQYPGMGR

SEQ ID NO: 1262609 - protein, 30 aa, Mycobacterium
ECGGCGRPSSRWCEPCAAALTVRADEPHLV

SEQ ID NO: 1262610 - protein, 24 aa, Mycobacterium
ECHECRKGWMAVCQNQTSMGYQYD

SEQ ID NO: 1262611 - protein, 26 aa, Mycobacterium
ECHGLQCGFCTPGFVTSITALLRDNP

SEQ ID NO: 1262612 - protein, 21 aa, Mycobacterium
ECKKLGLLPFANYNRIHVVPP

SEQ ID NO: 1262613 - protein, 20 aa, Mycobacterium
ECLAEELRRLDADEIYHEAL

SEQ ID NO: 1262614 - protein, 31 aa, Mycobacterium
ECRRLRPDLATGLMPLRWGTGYMLGSKRFGP

SEQ ID NO: 1262615 - protein, 18 aa, Mycobacterium
ECYDYAGHVLFTWGLLHD

SEQ ID NO: 1262616 - protein, 22 aa, Mycobacterium
EDAGFCEKGKGMAFVSDHDLTF

SEQ ID NO: 1262617 - protein, 18 aa, Mycobacterium
EDAGRYPAEFSGGQKQRI

SEQ ID NO: 1262618 - protein, 24 aa, Mycobacterium
EDAKMGINYGLNKVRFLSAVTAGS

SEQ ID NO: 1262619 - protein, 19 aa, Mycobacterium
EDAPARVAGALDEVSSPIS

SEQ ID NO: 1262620 - protein, 25 aa, Mycobacterium
EDCVRFGDRLARLFKAGVPVKEAAV

SEQ ID NO: 1262621 - protein, 19 aa, Mycobacterium
EDDAHAWAAAVNDVRLALG

SEQ ID NO: 1262622 - protein, 23 aa, Mycobacterium
EDDVPGLVLIPAAADKIEIPMIA

SEQ ID NO: 1262623 - protein, 22 aa, Mycobacterium
EDDVRATLALRDWLVGHRPPGL

SEQ ID NO: 1262624 - protein, 23 aa, Mycobacterium
EDEADLGVIFGDFGSASDDDGEM

SEQ ID NO: 1262625 - protein, 18 aa, Mycobacterium
EDEDGFYFIVDRTKDMIV

SEQ ID NO: 1262626 - protein, 19 aa, Mycobacterium
EDEQRTPLLHAEGAEDGTN

SEQ ID NO: 1262627 - protein, 25 aa, Mycobacterium
EDERFTWSFAGGKHLKGFKSDVKTF

SEQ ID NO: 1262628 - protein, 26 aa, Mycobacterium
EDFLARPADYFALLAELGFITEDDEK

SEQ ID NO: 1262629 - protein, 17 aa, Mycobacterium
EDFLRRLPASMVASGDM

SEQ ID NO: 1262630 - protein, 21 aa, Mycobacterium
EDFRDAIQIVARVARSIADAR

SEQ ID NO: 1262631 - protein, 23 aa, Mycobacterium
EDGARLVADRGRLFGGLPVGGRM

SEQ ID NO: 1262632 - protein, 23 aa, Mycobacterium
EDGDLIITPAYSWHDHHNESDKR

SEQ ID NO: 1262633 - protein, 19 aa, Mycobacterium
EDGEKRIPLDVSEGDVVIY

SEQ ID NO: 1262634 - protein, 30 aa, Mycobacterium
EDGFQCGYCTPGQICSAVGMLDEVKSGAPS

SEQ ID NO: 1262635 - protein, 22 aa, Mycobacterium
EDGGEFRAHLELANLAIALKRR

SEQ ID NO: 1262636 - protein, 28 aa, Mycobacterium
EDGGERLICRAMNWRSVREGASLQHDLL

SEQ ID NO: 1262637 - protein, 18 aa, Mycobacterium
EDGGRPIIRVTPRRVISF

SEQ ID NO: 1262638 - protein, 24 aa, Mycobacterium
EDGHAAEVYYRHLVPPGSPRSDTG

SEQ ID NO: 1262639 - protein, 19 aa, Mycobacterium
EDGPRGLSHLKVDRRAGVP

SEQ ID NO: 1262640 - protein, 18 aa, Mycobacterium
EDGYPIVLAHGITCSLRV

SEQ ID NO: 1262641 - protein, 18 aa, Mycobacterium
EDHCLLDLLWRNRRGELD

SEQ ID NO: 1262642 - protein, 22 aa, Mycobacterium
EDIAGAVAWLVSDEAKFITGVA

SEQ ID NO: 1262643 - protein, 21 aa, Mycobacterium
EDIQTAILYDHFTPYTLIQLE

SEQ ID NO: 1262644 - protein, 27 aa, Mycobacterium
EDKHWSARIAMGWEWARVGVSFDPGGS

SEQ ID NO: 1262645 - protein, 25 aa, Mycobacterium
EDKPLKYPVMFRAVDVVLLNKIDLA

SEQ ID NO: 1262646 - protein, 20 aa, Mycobacterium
EDLAEIRALLARRDALDARD

SEQ ID NO: 1262647 - protein, 18 aa, Mycobacterium
EDLAEIRATLARRDALDA

SEQ ID NO: 1262648 - protein, 18 aa, Mycobacterium
EDLDRWATDLDRDLTNGM

SEQ ID NO: 1262649 - protein, 24 aa, Mycobacterium
EDLEIRPPVVTVMGHVDHGKTRLL

SEQ ID NO: 1262650 - protein, 21 aa, Mycobacterium
EDLGVAGFLGRLVKGRITHAN

SEQ ID NO: 1262651 - protein, 19 aa, Mycobacterium
EDLINRWTWIPFGAGKHRC

SEQ ID NO: 1262652 - protein, 23 aa, Mycobacterium
EDLKAWLTTVVSRLALDRLRSAA

SEQ ID NO: 1262653 - protein, 24 aa, Mycobacterium
EDLLKQVWLWDFGDLSTVTVHVKR

SEQ ID NO: 1262654 - protein, 24 aa, Mycobacterium
EDLPWFRKRAVELISYAVNYKKAF

SEQ ID NO: 1262655 - protein, 20 aa, Mycobacterium
EDLRGWLWGLTYTVSGDGMI

SEQ ID NO: 1262656 - protein, 26 aa, Mycobacterium
EDLRQRLDAALARPALQQPSWDAGQA

SEQ ID NO: 1262657 - protein, 17 aa, Mycobacterium
EDLRYGPDVTTLATVAA

SEQ ID NO: 1262658 - protein, 18 aa, Mycobacterium
EDLVSLIYFYEANHDALV

SEQ ID NO: 1262659 - protein, 19 aa, Mycobacterium
EDMPFNWIDKGGAYIRSRV

SEQ ID NO: 1262660 - protein, 31 aa, Mycobacterium
EDNPRPADRLQIVVDVMLRFWLENPATVQIG

SEQ ID NO: 1262661 - protein, 20 aa, Mycobacterium
EDPDEHFLAVTAAVPSKPGD

SEQ ID NO: 1262662 - protein, 20 aa, Mycobacterium
EDPDKFYLGVQWHPEDDDGP

SEQ ID NO: 1262663 - protein, 27 aa, Mycobacterium
EDPEVRVPWNLPPKRRTREPESKSLLR

SEQ ID NO: 1262664 - protein, 20 aa, Mycobacterium
EDPHPVWSLAPESLIVAPAA

SEQ ID NO: 1262665 - protein, 20 aa, Mycobacterium
EDPLGFPYEFFYDVVHVERM

SEQ ID NO: 1262666 - protein, 17 aa, Mycobacterium
EDPRIAAVIAQAPFTDA

SEQ ID NO: 1262667 - protein, 19 aa, Mycobacterium
EDPRLNVLLLEAGGGDRNL

SEQ ID NO: 1262668 - protein, 22 aa, Mycobacterium
EDPRYLSVVLIGRVVERLGGIE

SEQ ID NO: 1262669 - protein, 25 aa, Mycobacterium
EDPTASKIAGRWGAVSLPVGGANTT

SEQ ID NO: 1262670 - protein, 18 aa, Mycobacterium
EDQSWRYKDLQYWTDLAK

SEQ ID NO: 1262671 - protein, 25 aa, Mycobacterium
EDRAARRFGRCLLLNSGETAQLQRR

SEQ ID NO: 1262672 - protein, 19 aa, Mycobacterium
EDRPEAGEAPGYDAFTVVA

SEQ ID NO: 1262673 - protein, 18 aa, Mycobacterium
EDRWEWCEDGTPEGAAAL

SEQ ID NO: 1262674 - protein, 22 aa, Mycobacterium
EDRYRALAGLTIRGVDPRYLVP

SEQ ID NO: 1262675 - protein, 18 aa, Mycobacterium
EDSPRKGIAIGDAAVLAG

SEQ ID NO: 1262676 - protein, 23 aa, Mycobacterium
EDSRGRTSLVITELPYQVNHDNF

SEQ ID NO: 1262677 - protein, 19 aa, Mycobacterium
EDSRLLTGHGRFVDDISRP

SEQ ID NO: 1262678 - protein, 20 aa, Mycobacterium
EDTHPLWIVRRTMIDMIEPV

SEQ ID NO: 1262679 - protein, 19 aa, Mycobacterium
EDTPNGWDPFGPDMSGYRV

SEQ ID NO: 1262680 - protein, 19 aa, Mycobacterium
EDTRAALDDDDWPIDEADL

SEQ ID NO: 1262681 - protein, 25 aa, Mycobacterium
EDVAMKLFWERGFGGVSISDVTAAT

SEQ ID NO: 1262682 - protein, 18 aa, Mycobacterium
EDVARKGGVYGVTRGLQQ

SEQ ID NO: 1262683 - protein, 22 aa, Mycobacterium
EDVDGRLVGPLNAYLYNTIIGK

SEQ ID NO: 1262684 - protein, 25 aa, Mycobacterium
EDVELATARWVDWFNHRRLYEYCGD

SEQ ID NO: 1262685 - protein, 29 aa, Mycobacterium
EDVIAWRGGTRYVERLSRATLPATPGQLV

SEQ ID NO: 1262686 - protein, 18 aa, Mycobacterium
EDVRARIGVLSQVPSLWA

SEQ ID NO: 1262687 - protein, 23 aa, Mycobacterium
EDYQRYGGVEFYSALAQGSPERD

SEQ ID NO: 1262688 - protein, 22 aa, Mycobacterium
EEAAEFFAPISSIHRYLKTLVD

SEQ ID NO: 1262689 - protein, 19 aa, Mycobacterium
EEAALVVAEDLHWVDSASL

SEQ ID NO: 1262690 - protein, 19 aa, Mycobacterium
EEACQVLKGLLSQDTTTFD

SEQ ID NO: 1262691 - protein, 20 aa, Mycobacterium
EEADRVAIMYAGHIVETGTV

SEQ ID NO: 1262692 - protein, 22 aa, Mycobacterium
EEAGRCQRGYFVESLGGAQFAT

SEQ ID NO: 1262693 - protein, 17 aa, Mycobacterium
EEAHDLLVRALESVEKG

SEQ ID NO: 1262694 - protein, 24 aa, Mycobacterium
EEAIGLCFLFILAGLDTVMDSLGF

SEQ ID NO: 1262695 - protein, 19 aa, Mycobacterium
EEAIKRVVSVTGDVVGVLA

SEQ ID NO: 1262696 - protein, 30 aa, Mycobacterium
EEALERLGIGGGFFSFGIMHYYLTGMHTPG

SEQ ID NO: 1262697 - protein, 23 aa, Mycobacterium
EEALPRLVRRRALTYNVSLLLVL

SEQ ID NO: 1262698 - protein, 20 aa, Mycobacterium
EEAQLAAGFDPDFHRRDMAD

SEQ ID NO: 1262699 - protein, 17 aa, Mycobacterium
EEARPRVIATRAVVVLV

SEQ ID NO: 1262700 - protein, 20 aa, Mycobacterium
EEAWPMLHAEATRLRATPTD

SEQ ID NO: 1262701 - protein, 20 aa, Mycobacterium
EEAYLPAAVFPGMLSKNLQA

SEQ ID NO: 1262702 - protein, 18 aa, Mycobacterium
EEDAVLGVFCRRWGVPLI

SEQ ID NO: 1262703 - protein, 20 aa, Mycobacterium
EEDVYWGAEHEWLGSQDRYA

SEQ ID NO: 1262704 - protein, 21 aa, Mycobacterium
EEELKHFVKVMPRDFRRVLAA

SEQ ID NO: 1262705 - protein, 20 aa, Mycobacterium
EEFARTALCLNEGSQYRYHA

SEQ ID NO: 1262706 - protein, 23 aa, Mycobacterium
EEFDLSNLFLLASTAALFSPALK

SEQ ID NO: 1262707 - protein, 24 aa, Mycobacterium
EEFEAWKYGMADSYDDQGNYIFPE

SEQ ID NO: 1262708 - protein, 26 aa, Mycobacterium
EEFLAWEPFTRMAFRFNESSTGSISA

SEQ ID NO: 1262709 - protein, 21 aa, Mycobacterium
EEFLDADLAEFGRVVDLNVTA

SEQ ID NO: 1262710 - protein, 26 aa, Mycobacterium
EEFPRCVTALGEGRLSLDQVAVIAEH

SEQ ID NO: 1262711 - protein, 20 aa, Mycobacterium
EEFRASRIMLDRARANEKIT

SEQ ID NO: 1262712 - protein, 33 aa, Mycobacterium
EEFVLRGGKRLRPAFAYWGWRAVAGTEPGPEAL

SEQ ID NO: 1262713 - protein, 22 aa, Mycobacterium
EEGENFAFLGGRDWDPSQVTLP

SEQ ID NO: 1262714 - protein, 18 aa, Mycobacterium
EEGIKGIVEDVKGKAKET

SEQ ID NO: 1262715 - protein, 17 aa, Mycobacterium
EEGIKGVVEDVKGKAKE

SEQ ID NO: 1262716 - protein, 30 aa, Mycobacterium
EEGLDFLYRRGAYTDAPRPDLVLLDLNLPK

SEQ ID NO: 1262717 - protein, 24 aa, Mycobacterium
EEGLLLSLRHRWVNMLAAKLDQAA

SEQ ID NO: 1262718 - protein, 24 aa, Mycobacterium
EEGPRIGADLSDLALARPVHAVHV

SEQ ID NO: 1262719 - protein, 34 aa, Mycobacterium; identical to SEQ ID NO: 651583

SEQ ID NO: 1262720 - protein, 25 aa, Mycobacterium
EEHLRWQEHQILWGPPNPTADGPFT

SEQ ID NO: 1262721 - protein, 19 aa, Mycobacterium
EEHPRPRLFTAVRQEPDHP

SEQ ID NO: 1262722 - protein, 23 aa, Mycobacterium
EEHRCTLMGLAAAIVAQAEHYQL

SEQ ID NO: 1262723 - protein, 25 aa, Mycobacterium
EEHRRIVLDFCDFLAGKTDRLIREM

SEQ ID NO: 1262724 - protein, 23 aa, Mycobacterium
EEIARVVPFIEWLRATFPDRVIS

SEQ ID NO: 1262725 - protein, 23 aa, Mycobacterium
EEIEAKFGWPVFEISTVAREGLR

SEQ ID NO: 1262726 - protein, 19 aa, Mycobacterium
EEIGAFLILLASAGNDTTK

SEQ ID NO: 1262727 - protein, 22 aa, Mycobacterium
EEIPVPPHWGGYLIAAEVVEFW

SEQ ID NO: 1262728 - protein, 20 aa, Mycobacterium
EEISGRIALGSSADVDLAVT

SEQ ID NO: 1262729 - protein, 17 aa, Mycobacterium
EEITDWQLAANAEHSST

SEQ ID NO: 1262730 - protein, 18 aa, Mycobacterium
EEKAMFGGLAFLINGNMA

SEQ ID NO: 1262731 - protein, 29 aa, Mycobacterium
EEKFDRVLELSVLLPQWRAQIAGDLTRRG

SEQ ID NO: 1262732 - protein, 18 aa, Mycobacterium
EEKPDWLVAERESYQNVL

SEQ ID NO: 1262733 - protein, 19 aa, Mycobacterium
EELARKGLSILIAPEGTRL

SEQ ID NO: 1262734 - protein, 20 aa, Mycobacterium
EELEPALAPLRSELSSLQAE

SEQ ID NO: 1262735 - protein, 17 aa, Mycobacterium
EELEWCLERGAKTVLVR

SEQ ID NO: 1262736 - protein, 20 aa, Mycobacterium
EELFGPVAVVYRVRDEEEAV

SEQ ID NO: 1262737 - protein, 24 aa, Mycobacterium
EELGLTWLCEIGAHGVVAGPDSTL

SEQ ID NO: 1262738 - protein, 21 aa, Mycobacterium
EELIENLFLPAFGSQPGPSRD

SEQ ID NO: 1262739 - protein, 19 aa, Mycobacterium
EELLAEPLLDVFVDSRLSV

SEQ ID NO: 1262740 - protein, 34 aa, Mycobacterium
EELLAESALALPDKEVVSILDLNADVDVAIDAAS

SEQ ID NO: 1262741 - protein, 24 aa, Mycobacterium
EELLNLAQAYSFVVSTEVGTRLAD

SEQ ID NO: 1262742 - protein, 21 aa, Mycobacterium
EELLRGADMVFVTAGEGGGTG

SEQ ID NO: 1262743 - protein, 24 aa, Mycobacterium
EELRDRFTPYMGWMRNRPARCSQA

SEQ ID NO: 1262744 - protein, 20 aa, Mycobacterium
EELRHGVLVGQLPADGEHLE

SEQ ID NO: 1262745 - protein, 24 aa, Mycobacterium
EELRMMPSFLLAMGTQVGRGLQVS

SEQ ID NO: 1262746 - protein, 25 aa, Mycobacterium
EELRRRWGGLLSYRYIGRSYAQMDL

SEQ ID NO: 1262747 - protein, 27 aa, Mycobacterium
EELRSALLAHARKRLGAAVAPKEIEFA

SEQ ID NO: 1262748 - protein, 19 aa, Mycobacterium
EELTRRALRHAVDKTTDMA

SEQ ID NO: 1262749 - protein, 30 aa, Mycobacterium
EELTYVICEVLAWRGIWLSEERRRIGNVDV

SEQ ID NO: 1262750 - protein, 24 aa, Mycobacterium
EEMAAELATVWARVRDDDDIRVAV

SEQ ID NO: 1262751 - protein, 17 aa, Mycobacterium
EEMDVWAVRSHQRAVAA

SEQ ID NO: 1262752 - protein, 22 aa, Mycobacterium
EEMHRAGAPGGVFASLFTSGIA

SEQ ID NO: 1262753 - protein, 29 aa, Mycobacterium
EEMQTKCPMAWSDTYGGHWVAADSKHVFE

SEQ ID NO: 1262754 - protein, 17 aa, Mycobacterium
EENFDLFDFELGEADVD

SEQ ID NO: 1262755 - protein, 25 aa, Mycobacterium
EEPDFRLILLTHNFDFFRTLESRAV

SEQ ID NO: 1262756 - protein, 23 aa, Mycobacterium
EEPEAFTACVGLGVRGLIPEIAA

SEQ ID NO: 1262757 - protein, 22 aa, Mycobacterium
EEPFWKQTFGEFSTLLKTEDAM

SEQ ID NO: 1262758 - protein, 20 aa, Mycobacterium
EEPHWYLAIIGSDPTVRGAG

SEQ ID NO: 1262759 - protein, 23 aa, Mycobacterium
EEPMPPDLNTFVAEAKALYDRMI

SEQ ID NO: 1262760 - protein, 22 aa, Mycobacterium
EEPRTWRGHLSPACPGAPSPGV

SEQ ID NO: 1262761 - protein, 24 aa, Mycobacterium
EEPSLRGIDGIERMRIIRDDISAR

SEQ ID NO: 1262762 - protein, 18 aa, Mycobacterium
EEPVAFLAQLGRDHRKYG

SEQ ID NO: 1262763 - protein, 21 aa, Mycobacterium
EEQAGAILFLLSDLSSYITGQ

SEQ ID NO: 1262764 - protein, 27 aa, Mycobacterium
EEQELLAAKFMGRWRSGAPLVLCPDAD

SEQ ID NO: 1262765 - protein, 26 aa, Mycobacterium
EEQKKRWIPGIADGSLTMAFAITEPD

SEQ ID NO: 1262766 - protein, 24 aa, Mycobacterium
EEQSLPGPDGWQVIGAAVRRPGGP

SEQ ID NO: 1262767 - protein, 28 aa, Mycobacterium
EERAKFGLPEVKRGLIAGAGGVFRIVEQ

SEQ ID NO: 1262768 - protein, 25 aa, Mycobacterium
EERLDDLRLFAGLVSAAGDYAWHKI

SEQ ID NO: 1262769 - protein, 30 aa, Mycobacterium; identical to SEQ ID NO: 620916

SEQ ID NO: 1262770 - protein, 20 aa, Mycobacterium
EERVKKLIAAKCSGERAPDG

SEQ ID NO: 1262771 - protein, 23 aa, Mycobacterium
EERWVRRGGYVLSSFAPATLPAD

SEQ ID NO: 1262772 - protein, 31 aa, Mycobacterium; identical to SEQ ID NO: 651756

SEQ ID NO: 1262773 - protein, 19 aa, Mycobacterium
EESTQWLANERFFGSYRRQ

SEQ ID NO: 1262774 - protein, 18 aa, Mycobacterium
EESVFRIDHYLGKETVQN

SEQ ID NO: 1262775 - protein, 22 aa, Mycobacterium
EESWEEIEDTLLIADLGPVVTE

SEQ ID NO: 1262776 - protein, 21 aa, Mycobacterium
EESYRRARIRLGEATVQTLAR

SEQ ID NO: 1262777 - protein, 24 aa, Mycobacterium
EETGRALWRRHLAGVDGPTLLTPA

SEQ ID NO: 1262778 - protein, 20 aa, Mycobacterium
EETYHTFSYSPLRDDDGRVV

SEQ ID NO: 1262779 - protein, 18 aa, Mycobacterium
EEVCRLVKQRFVRGDSHF

SEQ ID NO: 1262780 - protein, 19 aa, Mycobacterium
EEVIACAEAGIPVTVVPGV

SEQ ID NO: 1262781 - protein, 25 aa, Mycobacterium
EEVPLKRFDLMNGIQVRGTYAVSQA

SEQ ID NO: 1262782 - protein, 25 aa, Mycobacterium
EEVPLKRFDLMNGIQVRGTYTVSQA

SEQ ID NO: 1262783 - protein, 27 aa, Mycobacterium
EEVQRAGGVTLTLGFAVSRDLSSRRLV

SEQ ID NO: 1262784 - protein, 25 aa, Mycobacterium
EEVRELMAQLGFRTVNEMVGQVGAL

SEQ ID NO: 1262785 - protein, 22 aa, Mycobacterium
EEVVLRLRALLRRTGVSTDTSG

SEQ ID NO: 1262786 - protein, 19 aa, Mycobacterium
EEWASSSPFQFFSSHPEPE

SEQ ID NO: 1262787 - protein, 21 aa, Mycobacterium
EEYQHRLPFDRLAAARYSLDD

SEQ ID NO: 1262788 - protein, 19 aa, Mycobacterium
EEYTLQWQGRSGFALLCVE

SEQ ID NO: 1262789 - protein, 18 aa, Mycobacterium
EFAANSAEGWDMALTSTR

SEQ ID NO: 1262790 - protein, 23 aa, Mycobacterium
EFAASGARIRLCKGAYAEPASVA

SEQ ID NO: 1262791 - protein, 20 aa, Mycobacterium
EFAAVGFEYGYSVGNPNALV

SEQ ID NO: 1262792 - protein, 21 aa, Mycobacterium
EFADRALVMYAGRAVETAPVA

SEQ ID NO: 1262793 - protein, 23 aa, Mycobacterium
EFAEALPAPAHRILELLTVSDPL

SEQ ID NO: 1262794 - protein, 27 aa, Mycobacterium
EFAGPVGDPGWFGPGSAVWHVHSHMET

SEQ ID NO: 1262795 - protein, 18 aa, Mycobacterium
EFAHVFSSLGSRVTIVLR

SEQ ID NO: 1262796 - protein, 25 aa, Mycobacterium
EFARRFGCQVWDGFGSTENAVTVTR

SEQ ID NO: 1262797 - protein, 21 aa, Mycobacterium
EFARRLRARLESAARLFEQQP

SEQ ID NO: 1262798 - protein, 19 aa, Mycobacterium
EFASVPIAVNSLWPATTIA

SEQ ID NO: 1262799 - protein, 17 aa, Mycobacterium
EFCTRGYSVMLGYWNDP

SEQ ID NO: 1262800 - protein, 23 aa, Mycobacterium
EFDAKLTERGWWFNEDEEDSGDD

SEQ ID NO: 1262801 - protein, 24 aa, Mycobacterium
EFDAYLGDMAFYFDAIVDRFDSGL

SEQ ID NO: 1262802 - protein, 24 aa, Mycobacterium
EFDGRIITMPFSFKEIDSEGLISY

SEQ ID NO: 1262803 - protein, 26 aa, Mycobacterium
EFDLLAALSARPGVVLSRRQLLETVR

SEQ ID NO: 1262804 - protein, 26 aa, Mycobacterium
EFDSRAVTPGGLFLALPGARSDGHDF

SEQ ID NO: 1262805 - protein, 19 aa, Mycobacterium
EFDVAWISFAHMVFQELTK

SEQ ID NO: 1262806 - protein, 26 aa, Mycobacterium
EFEKEAWLSMVMLEWGSCGQLVVEHR

SEQ ID NO: 1262807 - protein, 21 aa, Mycobacterium
EFELLRLLMRNQRKALSRTDI

SEQ ID NO: 1262808 - protein, 17 aa, Mycobacterium
EFFEAWTAAYLGMHDKP

SEQ ID NO: 1262809 - protein, 22 aa, Mycobacterium
EFGEPDLLFSTFVHGVKRLPAV

SEQ ID NO: 1262810 - protein, 23 aa, Mycobacterium
EFGRGLVDVPFLGPVLADDLQRR

SEQ ID NO: 1262811 - protein, 17 aa, Mycobacterium
EFGTFYVDVHYRIRGDN

SEQ ID NO: 1262812 - protein, 29 aa, Mycobacterium
EFHVCDGKPEFARRLAVSFRDHNAEVGAH

SEQ ID NO: 1262813 - protein, 20 aa, Mycobacterium
EFIDLAAFDEWLGRWRALEP

SEQ ID NO: 1262814 - protein, 21 aa, Mycobacterium
EFIDQRLCLGFKRSDIAKATL

SEQ ID NO: 1262815 - protein, 17 aa, Mycobacterium
EFKDPSGKIVGFDVDLM

SEQ ID NO: 1262816 - protein, 19 aa, Mycobacterium
EFKTRTLAGLGAHPTATHR

SEQ ID NO: 1262817 - protein, 18 aa, Mycobacterium
EFLALPRVAGLAVSPDGT

SEQ ID NO: 1262818 - protein, 24 aa, Mycobacterium
EFLAPCRDWLDVRFCAEDDDDTFY

SEQ ID NO: 1262819 - protein, 24 aa, Mycobacterium
EFLEYHWGDDWVVWDAERTSRQRC

SEQ ID NO: 1262820 - protein, 22 aa, Mycobacterium
EFLGAAMLRVRMLDNLRVLRGE

SEQ ID NO: 1262821 - protein, 29 aa, Mycobacterium
EFLPKIAAGKCFFGIGMSEPDSGSDLASV

SEQ ID NO: 1262822 - protein, 26 aa, Mycobacterium
EFLPVVWRVIQHYGIDVGGRRYKGDI

SEQ ID NO: 1262823 - protein, 26 aa, Mycobacterium
EFPAEQFDRLVAINIGGMYWTTRTAI

SEQ ID NO: 1262824 - protein, 28 aa, Mycobacterium
EFPPHELGAIPVLLGHQVSGRKGEYVRA

SEQ ID NO: 1262825 - protein, 25 aa, Mycobacterium
EFPRCTRALRMGRLSLDQVGAIADG

SEQ ID NO: 1262826 - protein, 24 aa, Mycobacterium
EFPWLKSRLPSLWTNSYFVATVGG

SEQ ID NO: 1262827 - protein, 31 aa, Mycobacterium
EFRAAGVGPFSRRRIIMLLGGLRELTASTVE

SEQ ID NO: 1262828 - protein, 21 aa, Mycobacterium
EFRDIYRLGVITIPPNRPVVR

SEQ ID NO: 1262829 - protein, 19 aa, Mycobacterium
EFRMWWAEHRVFQRTYGTK

SEQ ID NO: 1262830 - protein, 25 aa, Mycobacterium
EFRQMCGTANWYGGTIIDDIVPGHT

SEQ ID NO: 1262831 - protein, 27 aa, Mycobacterium
EFRRELRACPADERGYLLSTHIRALVA

SEQ ID NO: 1262832 - protein, 23 aa, Mycobacterium
EFSEAFRAILVAYRRQAIDALAI

SEQ ID NO: 1262833 - protein, 24 aa, Mycobacterium
EFSRISDVLLPFLVTRQLICGAGK

SEQ ID NO: 1262834 - protein, 18 aa, Mycobacterium
EFSRLGMFLDEITNTPLP

SEQ ID NO: 1262835 - protein, 35 aa, Mycobacterium
EFTGAEPWVMVKGFRIKIDGCVGESFIRSYAVLTR

SEQ ID NO: 1262836 - protein, 24 aa, Mycobacterium
EFTGSAFRTWLIRIADDEMRVKRV

SEQ ID NO: 1262837 - protein, 18 aa, Mycobacterium
EFTLPMDIGKAIDERIRR

SEQ ID NO: 1262838 - protein, 20 aa, Mycobacterium
EFTLRTGFASRQWGGTEWHI

SEQ ID NO: 1262839 - protein, 18 aa, Mycobacterium
EFVCKNFGALQVLKGVTL

SEQ ID NO: 1262840 - protein, 22 aa, Mycobacterium
EFVRRLWWRATVDLPDDPLLHT

SEQ ID NO: 1262841 - protein, 18 aa, Mycobacterium
EFYELPKTISGKIRRVEL

SEQ ID NO: 1262842 - protein, 22 aa, Mycobacterium
EFYGPRGAQHVRLALTATDERI

SEQ ID NO: 1262843 - protein, 19 aa, Mycobacterium
EGAAVHLMYGAANRDPRRF

SEQ ID NO: 1262844 - protein, 23 aa, Mycobacterium
EGADIIAIDVCKNVDNVQLDLAT

SEQ ID NO: 1262845 - protein, 20 aa, Mycobacterium
EGADVILFDICHDIETNEYP

SEQ ID NO: 1262846 - protein, 19 aa, Mycobacterium
EGAIAPWSMGHTAEYFTRM

SEQ ID NO: 1262847 - protein, 20 aa, Mycobacterium
EGAKTPRLGGVFTGIVEELG

SEQ ID NO: 1262848 - protein, 17 aa, Mycobacterium
EGALKLKELAYMHAEGF

SEQ ID NO: 1262849 - protein, 17 aa, Mycobacterium
EGALYLRMDEFPARLVI

SEQ ID NO: 1262850 - protein, 19 aa, Mycobacterium
EGAPDDAMWVRTGDLGAFH

SEQ ID NO: 1262851 - protein, 22 aa, Mycobacterium
EGARLIAERGRLFANLPSGGRM

SEQ ID NO: 1262852 - protein, 17 aa, Mycobacterium
EGARRSWSAEQQLDHWA

SEQ ID NO: 1262853 - protein, 24 aa, Mycobacterium
EGASRPGHFAGVLTVVCKLLHIVR

SEQ ID NO: 1262854 - protein, 26 aa, Mycobacterium
EGAVIVEVRLSLPPVIALRDTDGTVS

SEQ ID NO: 1262855 - protein, 22 aa, Mycobacterium
EGCSGCSMMADHIGPLSHLYAK

SEQ ID NO: 1262856 - protein, 24 aa, Mycobacterium
EGDELRPAHPLFLDAIRDALGGPD

SEQ ID NO: 1262857 - protein, 20 aa, Mycobacterium
EGDHGLIMCMGKGGVGKTTI

SEQ ID NO: 1262858 - protein, 19 aa, Mycobacterium
EGDLAKLRASIVNTQALAD

SEQ ID NO: 1262859 - protein, 24 aa, Mycobacterium
EGDLTELEMQWGRTIGQFPSPYTQ

SEQ ID NO: 1262860 - protein, 18 aa, Mycobacterium
EGDPHAWAIPRLTGQAKA

SEQ ID NO: 1262861 - protein, 26 aa, Mycobacterium
EGDRGVSWLPFFHDMGLITVLLPTVI

SEQ ID NO: 1262862 - protein, 26 aa, Mycobacterium
EGDRRLLVRPEFKAMFLDDLLNGSRR

SEQ ID NO: 1262863 - protein, 36 aa, Mycobacterium
EGDRVAVEPIYKCGHCGPCRAGNYNVCQQIGFHGLM

SEQ ID NO: 1262864 - protein, 26 aa, Mycobacterium
EGEAMLFGEYIRLMALVEYSAEEIVS

SEQ ID NO: 1262865 - protein, 24 aa, Mycobacterium
EGELALKPGWPSMFRGYLHQEERY

SEQ ID NO: 1262866 - protein, 26 aa, Mycobacterium
EGEPFVLHPGEFVLGATLERCTLPDD

SEQ ID NO: 1262867 - protein, 20 aa, Mycobacterium
EGESMLYPAISRGSGEIVDI

SEQ ID NO: 1262868 - protein, 19 aa, Mycobacterium
EGFAAGWRTIARSLAGRPA

SEQ ID NO: 1262869 - protein, 20 aa, Mycobacterium
EGFDRTAFAAVQFAVTQIGS

SEQ ID NO: 1262870 - protein, 19 aa, Mycobacterium
EGFELQARVGGVWESLYLL

SEQ ID NO: 1262871 - protein, 19 aa, Mycobacterium
EGFGAPKNRHGHAAEGGLT

SEQ ID NO: 1262872 - protein, 21 aa, Mycobacterium
EGFIDAAAFGRPFIANPDLPR

SEQ ID NO: 1262873 - protein, 17 aa, Mycobacterium
EGFMRDVPCPECDGTRL

SEQ ID NO: 1262874 - protein, 23 aa, Mycobacterium
EGFMRDVPCPECDGTRLKPEILA

SEQ ID NO: 1262875 - protein, 17 aa, Mycobacterium
EGGASYQRPEWDPHDID

SEQ ID NO: 1262876 - protein, 20 aa, Mycobacterium
EGGEGLDFLGCHFRARMSGR

SEQ ID NO: 1262877 - protein, 25 aa, Mycobacterium
EGGLIKAAWIDTWRLPAAPPGTVKI

SEQ ID NO: 1262878 - protein, 19 aa, Mycobacterium
EGGLNVARAEWLRALAELC

SEQ ID NO: 1262879 - protein, 18 aa, Mycobacterium
EGGPRPPTPFYTDISGAI

SEQ ID NO: 1262880 - protein, 20 aa, Mycobacterium
EGHAPWGAKVTVTPGDVGEP

SEQ ID NO: 1262881 - protein, 26 aa, Mycobacterium
EGHPFWRADTGLFFLFGLIEQSEDRW

SEQ ID NO: 1262882 - protein, 20 aa, Mycobacterium
EGHPGVAMAVVVGLPDPEYG

SEQ ID NO: 1262883 - protein, 21 aa, Mycobacterium
EGHVYRACFKLDVADRDELAK

SEQ ID NO: 1262884 - protein, 20 aa, Mycobacterium
EGIDLQDYCHRLVNFDIPFN

SEQ ID NO: 1262885 - protein, 21 aa, Mycobacterium
EGIDLQDYCHRLVNFDIPFNP

SEQ ID NO: 1262886 - protein, 19 aa, Mycobacterium
EGIEILKTMMEGFPVGDPW

SEQ ID NO: 1262887 - protein, 24 aa, Mycobacterium
EGIIAAAAIRCMGGAIQAKLAPTD

SEQ ID NO: 1262888 - protein, 23 aa, Mycobacterium
EGIPAGPVRPPLVMPGTDDLTEL

SEQ ID NO: 1262889 - protein, 23 aa, Mycobacterium
EGIRKIRAAFGVLDQFREHDLTV

SEQ ID NO: 1262890 - protein, 18 aa, Mycobacterium
EGIRRAGADIALSYWAVD

SEQ ID NO: 1262891 - protein, 19 aa, Mycobacterium
EGIRTTWLDTSHAFHSALL

SEQ ID NO: 1262892 - protein, 17 aa, Mycobacterium
EGIRVAVDLRRTTPGLP

SEQ ID NO: 1262893 - protein, 27 aa, Mycobacterium
EGKAVKRYKITAAWPKSLEISSLKAGD

SEQ ID NO: 1262894 - protein, 25 aa, Mycobacterium
EGKEFPRATYWRFIPDTTGTGDPHA

SEQ ID NO: 1262895 - protein, 18 aa, Mycobacterium
EGKLTLKRGNRIDLAHAT

SEQ ID NO: 1262896 - protein, 24 aa, Mycobacterium
EGKLYLCAIKDVFSNRIVGYSIDS

SEQ ID NO: 1262897 - protein, 25 aa, Mycobacterium
EGKLYLCAIKDVFSNRIVGYSIDSR

SEQ ID NO: 1262898 - protein, 19 aa, Mycobacterium
EGLAETFGAGSGHGPATMP

SEQ ID NO: 1262899 - protein, 17 aa, Mycobacterium
EGLDRLEPVPVLRRQGV

SEQ ID NO: 1262900 - protein, 22 aa, Mycobacterium
EGLEARELCKLSDADRRKAVLA

SEQ ID NO: 1262901 - protein, 17 aa, Mycobacterium
EGLELLLRRDWGEQFVI

SEQ ID NO: 1262902 - protein, 19 aa, Mycobacterium
EGLFDARWLDAAVPDRPVV

SEQ ID NO: 1262903 - protein, 18 aa, Mycobacterium
EGLGQLYIRLLTSNFEEA

SEQ ID NO: 1262904 - protein, 17 aa, Mycobacterium
EGLGQLYVRLLTANFEE

SEQ ID NO: 1262905 - protein, 28 aa, Mycobacterium
EGLIAWCRDRMAGFKVPRYVEFLDELPL

SEQ ID NO: 1262906 - protein, 19 aa, Mycobacterium
EGLIDFHLDFVFGEPDLIR

SEQ ID NO: 1262907 - protein, 21 aa, Mycobacterium
EGLKGLYQFFTPLMRNLGHSG

SEQ ID NO: 1262908 - protein, 17 aa, Mycobacterium
EGLKKSFGDHVVLDGIS

SEQ ID NO: 1262909 - protein, 17 aa, Mycobacterium
EGLPIRDYVPLFVERNA

SEQ ID NO: 1262910 - protein, 24 aa, Mycobacterium
EGLSNGGIGRRLWVTEGTVEKHVR

SEQ ID NO: 1262911 - protein, 18 aa, Mycobacterium
EGLVAITQEGSWKVKRIR

SEQ ID NO: 1262912 - protein, 25 aa, Mycobacterium
EGMEVPLRVAVMGCVVNGPGEAREA

SEQ ID NO: 1262913 - protein, 18 aa, Mycobacterium
EGMLRCGLQAAAQRLPFL

SEQ ID NO: 1262914 - protein, 25 aa, Mycobacterium
EGMRRLFRQFSFPGGIPSHVAPETP

SEQ ID NO: 1262915 - protein, 21 aa, Mycobacterium
EGMRRPCCWPGCKHRTRNGKA

SEQ ID NO: 1262916 - protein, 20 aa, Mycobacterium
EGMSYSAGSGYGVFDTPIGR

SEQ ID NO: 1262917 - protein, 19 aa, Mycobacterium
EGMTAHWLDLITAAIAAQP

SEQ ID NO: 1262918 - protein, 28 aa, Mycobacterium
EGNRAWRLYRRLGFTDVIRGYHFAGDPR

SEQ ID NO: 1262919 - protein, 22 aa, Mycobacterium
EGPAVKYVACSRAEAMNAGDDE

SEQ ID NO: 1262920 - protein, 23 aa, Mycobacterium
EGPFADWFAGWILNKEGEEHHRL

SEQ ID NO: 1262921 - protein, 17 aa, Mycobacterium
EGPFATWLEKWDPDEDL

SEQ ID NO: 1262922 - protein, 28 aa, Mycobacterium
EGPFFTARVLPGWSFRLTAAGDLLLNDK

SEQ ID NO: 1262923 - protein, 26 aa, Mycobacterium
EGPRFCGHPDLRYACIPSTSPVSRDF

SEQ ID NO: 1262924 - protein, 19 aa, Mycobacterium
EGQHLYWVVGDNTQGVVNS

SEQ ID NO: 1262925 - protein, 23 aa, Mycobacterium
EGRAKTGRNGAVWQSTTVTALQD

SEQ ID NO: 1262926 - protein, 22 aa, Mycobacterium
EGRGRPAKRYQLTSAGRAKLEH

SEQ ID NO: 1262927 - protein, 26 aa, Mycobacterium
EGRIPVRRPACWPAAARSGRGSPSSA

SEQ ID NO: 1262928 - protein, 17 aa, Mycobacterium
EGRKLFPERRAETVPYE

SEQ ID NO: 1262929 - protein, 30 aa, Mycobacterium
EGRRLEQIEALRLVLERGWTAQRAAERVAA

SEQ ID NO: 1262930 - protein, 31 aa, Mycobacterium
EGRRLEQIEALRLVLERGWTAQRAAERVAAE

SEQ ID NO: 1262931 - protein, 17 aa, Mycobacterium
EGRSVAGAAHFLEHLLF

SEQ ID NO: 1262932 - protein, 24 aa, Mycobacterium
EGSDRPERFIAMVNAERSPTFYRF

SEQ ID NO: 1262933 - protein, 19 aa, Mycobacterium
EGSDWKAAVISLLDSRSPY

SEQ ID NO: 1262934 - protein, 18 aa, Mycobacterium
EGSLWAVLRSRYGVELAR

SEQ ID NO: 1262935 - protein, 27 aa, Mycobacterium
EGSPDRWDFVAAYGRDGRVIAVLSTIP

SEQ ID NO: 1262936 - protein, 20 aa, Mycobacterium
EGSQGISCFLVPRDTEGLTF

SEQ ID NO: 1262937 - protein, 22 aa, Mycobacterium
EGSTRVPVFVFHPAGGTTVVYE

SEQ ID NO: 1262938 - protein, 21 aa, Mycobacterium
EGTEFRAGVNVGVDITAAQLR

SEQ ID NO: 1262939 - protein, 24 aa, Mycobacterium
EGTEIGIAFGGLLSPGGSIFNALD

SEQ ID NO: 1262940 - protein, 23 aa, Mycobacterium
EGTGTRFTWLVAIEPAGVMRWPF

SEQ ID NO: 1262941 - protein, 19 aa, Mycobacterium
EGTLLGRLSAFFSAAMHAE

SEQ ID NO: 1262942 - protein, 25 aa, Mycobacterium
EGTNLKAWLYRILTNTYINSYRKKQ

SEQ ID NO: 1262943 - protein, 24 aa, Mycobacterium
EGTNLVGWLYRIMVNTHISAYRRQ

SEQ ID NO: 1262944 - protein, 24 aa, Mycobacterium
EGTPNGCFNEMCTLNGLAGIETPE

SEQ ID NO: 1262945 - protein, 19 aa, Mycobacterium
EGVAALKVGDRVVTDKSLG

SEQ ID NO: 1262946 - protein, 22 aa, Mycobacterium
EGVADRVAALVAELGSDAQVGF

SEQ ID NO: 1262947 - protein, 24 aa, Mycobacterium
EGVAGYAGELGHTFVGGGEQCHCG

SEQ ID NO: 1262948 - protein, 21 aa, Mycobacterium
EGVAVRGWWHTRVLRQADIKI

SEQ ID NO: 1262949 - protein, 17 aa, Mycobacterium
EGVEHMALLDKLGLTLS

SEQ ID NO: 1262950 - protein, 17 aa, Mycobacterium
EGVEIAFTPTVGDMYPY

SEQ ID NO: 1262951 - protein, 19 aa, Mycobacterium
EGVIALALLKRGLPADTAL

SEQ ID NO: 1262952 - protein, 20 aa, Mycobacterium
EGVKSEFPDQMLAYNCSPSF

SEQ ID NO: 1262953 - protein, 18 aa, Mycobacterium
EGVPRIPDDLALPPSDSL

SEQ ID NO: 1262954 - protein, 17 aa, Mycobacterium
EGVTTRFVLGTDTGQAV

SEQ ID NO: 1262955 - protein, 20 aa, Mycobacterium
EGVVRRIVRNGGNPIGAPVA

SEQ ID NO: 1262956 - protein, 22 aa, Mycobacterium
EGVYQCRACGAELFRSSEKFES

SEQ ID NO: 1262957 - protein, 24 aa, Mycobacterium
EGWGNRRIEAEAKKIAARLDAAAL

SEQ ID NO: 1262958 - protein, 25 aa, Mycobacterium
EHACTRCRFLRVDPAQLGRINEMTE

SEQ ID NO: 1262959 - protein, 23 aa, Mycobacterium
EHARARGATPLARVMGASITSDG

SEQ ID NO: 1262960 - protein, 23 aa, Mycobacterium
EHARSTAYHAVWALTDGSDDAAL

SEQ ID NO: 1262961 - protein, 23 aa, Mycobacterium
EHARSTAYHAVWALTDGSDDPAL

SEQ ID NO: 1262962 - protein, 19 aa, Mycobacterium
EHATRLGAVQTVRIKGSDE

SEQ ID NO: 1262963 - protein, 26 aa, Mycobacterium
EHCNFSYKDMEAWGRKMFVTPGVVVD

SEQ ID NO: 1262964 - protein, 18 aa, Mycobacterium
EHCPKPLTDIAFAFVGDG

SEQ ID NO: 1262965 - protein, 25 aa, Mycobacterium
EHCPMCAAAHAWVGLGRVVYAASSA

SEQ ID NO: 1262966 - protein, 27 aa, Mycobacterium
EHCVCWRDLLCWERLSGDLLCGRVMDR

SEQ ID NO: 1262967 - protein, 26 aa, Mycobacterium
EHDAQLYLKRLLSFSRFMGGPGTYLQ

SEQ ID NO: 1262968 - protein, 20 aa, Mycobacterium
EHDRRFDIVLYLNGMPIAFF

SEQ ID NO: 1262969 - protein, 24 aa, Mycobacterium
EHFARLETTLALATVVRACRIESL

SEQ ID NO: 1262970 - protein, 28 aa, Mycobacterium
EHFPAGEMQLDFWSRFGSRAQQKNNTVV

SEQ ID NO: 1262971 - protein, 25 aa, Mycobacterium
EHFSVKWQLVRRLVTFVEFSRGAFC

SEQ ID NO: 1262972 - protein, 19 aa, Mycobacterium
EHGCDVIVAVGGGSVIDAA

SEQ ID NO: 1262973 - protein, 17 aa, Mycobacterium
EHGFPVRLLIPGFYGTN

SEQ ID NO: 1262974 - protein, 23 aa, Mycobacterium
EHGFRIPPDYLDHAHAFAAAARV

SEQ ID NO: 1262975 - protein, 20 aa, Mycobacterium
EHGIYLPGQEQPEWREHGTA

SEQ ID NO: 1262976 - protein, 20 aa, Mycobacterium
EHGRRGVLIERVYDIAEALG

SEQ ID NO: 1262977 - protein, 24 aa, Mycobacterium
EHGTRPRALYSFQDLVALRTFARL

SEQ ID NO: 1262978 - protein, 22 aa, Mycobacterium
EHGYRVLMAIELLRVVASGLPD

SEQ ID NO: 1262979 - protein, 18 aa, Mycobacterium
EHHPHLLPLADRTLEPTE

SEQ ID NO: 1262980 - protein, 17 aa, Mycobacterium
EHILLRTVRCVSGTVEL

SEQ ID NO: 1262981 - protein, 22 aa, Mycobacterium
EHKAELLGFAVLAMYSNTPNFR

SEQ ID NO: 1262982 - protein, 22 aa, Mycobacterium
EHKMGLKASATCELTFGQHGVP

SEQ ID NO: 1262983 - protein, 22 aa, Mycobacterium
EHKRLECLEVTLSGKSQTYPLF

SEQ ID NO: 1262984 - protein, 23 aa, Mycobacterium
EHLKIQWAQAAARHGIALDPKFS

SEQ ID NO: 1262985 - protein, 17 aa, Mycobacterium
EHLRPGSTVEALSKLSP

SEQ ID NO: 1262986 - protein, 23 aa, Mycobacterium
EHLSHCVSHAVTVGGSEADAKLA

SEQ ID NO: 1262987 - protein, 24 aa, Mycobacterium
EHLTALCWDGGAALPFVDDDIKAI

SEQ ID NO: 1262988 - protein, 24 aa, Mycobacterium
EHLYITSGHLEWYADGMFPAMHID

SEQ ID NO: 1262989 - protein, 19 aa, Mycobacterium
EHMGRAADMAISFDPNLYT

SEQ ID NO: 1262990 - protein, 18 aa, Mycobacterium
EHNCDFSALLPAARAVRE

SEQ ID NO: 1262991 - protein, 26 aa, Mycobacterium
EHNLREIDVAFPLGVLTSVTGVSGSG

SEQ ID NO: 1262992 - protein, 19 aa, Mycobacterium
EHPDLKTTLLDTGSDGAAL

SEQ ID NO: 1262993 - protein, 17 aa, Mycobacterium
EHPRLGAVRNPWHTDHT

SEQ ID NO: 1262994 - protein, 17 aa, Mycobacterium
EHPTVAAPRTWEEISDP

SEQ ID NO: 1262995 - protein, 25 aa, Mycobacterium
EHQESRAGAVLSRILALTDDEVRAA

SEQ ID NO: 1262996 - protein, 19 aa, Mycobacterium
EHRAEVIASHLKRLEAELD

SEQ ID NO: 1262997 - protein, 19 aa, Mycobacterium
EHRARRLAGATVHDATCSI

SEQ ID NO: 1262998 - protein, 24 aa, Mycobacterium
EHRCFALQFRLDRPVGYNRQLSTP

SEQ ID NO: 1262999 - protein, 19 aa, Mycobacterium
EHRDEALSALPTIRAQIAK

SEQ ID NO: 1263000 - protein, 19 aa, Mycobacterium
EHRDRFVSPTGARFVTGAA

SEQ ID NO: 1263001 - protein, 26 aa, Mycobacterium
EHRDRTCVVPGCGATRGLHAHHLVHW

SEQ ID NO: 1263002 - protein, 21 aa, Mycobacterium
EHRFDRIVKLCDGRLCEGQYG

SEQ ID NO: 1263003 - protein, 26 aa, Mycobacterium
EHRRRIGELWAQFSAVAADNPHAWNR

SEQ ID NO: 1263004 - protein, 28 aa, Mycobacterium
EHTAALVERCGRRSLLLPGDLAEAEQCR

SEQ ID NO: 1263005 - protein, 17 aa, Mycobacterium
EHVLTGYARLAAANRAL

SEQ ID NO: 1263006 - protein, 18 aa, Mycobacterium
EHVRTWFAGLGTEHDTRN

SEQ ID NO: 1263007 - protein, 19 aa, Mycobacterium
EHVVAYVGGCIRGHQGSHH

SEQ ID NO: 1263008 - protein, 20 aa, Mycobacterium
EIAAGWVLDLLGLPATASVG

SEQ ID NO: 1263009 - protein, 25 aa, Mycobacterium
EIAAHNKLLGSFELTGIPPAPRGVP

SEQ ID NO: 1263010 - protein, 20 aa, Mycobacterium
EIACDTVVFTGDWIPDHELA

SEQ ID NO: 1263011 - protein, 17 aa, Mycobacterium
EIADALIERCVGEFGRI

SEQ ID NO: 1263012 - protein, 18 aa, Mycobacterium
EIADLGIVGDLFKVTPQL

SEQ ID NO: 1263013 - protein, 19 aa, Mycobacterium
EIAEAAWFTRAEIREALAQ

SEQ ID NO: 1263014 - protein, 21 aa, Mycobacterium
EIAEKGHLPAEVLDAAAVTIA

SEQ ID NO: 1263015 - protein, 20 aa, Mycobacterium
EIALRMDTLIAVGGFVEVIT

SEQ ID NO: 1263016 - protein, 19 aa, Mycobacterium
EIAPFSAVLLRSESAASSN

SEQ ID NO: 1263017 - protein, 21 aa, Mycobacterium
EIAQAVLFLASPRSSFVTGAV

SEQ ID NO: 1263018 - protein, 26 aa, Mycobacterium
EIARDRATVCLVGITGTEFPYRPYMQ

SEQ ID NO: 1263019 - protein, 21 aa, Mycobacterium
EIARRAGVGAGTVYRHFPTKQ

SEQ ID NO: 1263020 - protein, 23 aa, Mycobacterium
EIASAVFNPAPGLERFFGNLSTY

SEQ ID NO: 1263021 - protein, 23 aa, Mycobacterium
EIATGFGRTGAMFAADHAGVSPD

SEQ ID NO: 1263022 - protein, 23 aa, Mycobacterium
EIATRVVPGAGLAVERVGSSAHD

SEQ ID NO: 1263023 - protein, 18 aa, Mycobacterium
EICATVFTTTAHAFDRRL

SEQ ID NO: 1263024 - protein, 23 aa, Mycobacterium
EIDEFAMPVAPWMFGAAGREHMR

SEQ ID NO: 1263025 - protein, 24 aa, Mycobacterium
EIDLLEFFAELTIYTSTACLIGLK

SEQ ID NO: 1263026 - protein, 35 aa, Mycobacterium
EIDRFNELVLRAGLSWQQVMVLRAYAKYLRQAGFP

SEQ ID NO: 1263027 - protein, 22 aa, Mycobacterium
EIDRGLRFMSACRVDDRNLDTA

SEQ ID NO: 1263028 - protein, 19 aa, Mycobacterium
EIDRGRLALDGSLVDAINA

SEQ ID NO: 1263029 - protein, 25 aa, Mycobacterium
EIEPEYGADCPVVVVYRASQPQELV

SEQ ID NO: 1263030 - protein, 22 aa, Mycobacterium
EIEPGHGLKIGYFAQEHDTLDN

SEQ ID NO: 1263031 - protein, 18 aa, Mycobacterium
EIEPRTGRHLGNFPQAFT

SEQ ID NO: 1263032 - protein, 18 aa, Mycobacterium
EIERQAAAESTQWERVID

SEQ ID NO: 1263033 - protein, 19 aa, Mycobacterium
EIEYFGARVLPLVREIENS

SEQ ID NO: 1263034 - protein, 25 aa, Mycobacterium
EIFRREMDTIFKTGWVYVAHESEVS

SEQ ID NO: 1263035 - protein, 19 aa, Mycobacterium
EIFVGGILHRIVSKCPHLT

SEQ ID NO: 1263036 - protein, 20 aa, Mycobacterium
EIGALIAFLLSDVCGFVTGQ

SEQ ID NO: 1263037 - protein, 24 aa, Mycobacterium
EIGNTEWPKWETVMAPDPVDPAVL

SEQ ID NO: 1263038 - protein, 28 aa, Mycobacterium
EIGRPSRLKGAGFYSYIDGKRVGLWEGL

SEQ ID NO: 1263039 - protein, 23 aa, Mycobacterium
EIGRSLAPVPWIDHICAARLLAR

SEQ ID NO: 1263040 - protein, 21 aa, Mycobacterium
EIGTWRGVDAVVEFMTATHEM

SEQ ID NO: 1263041 - protein, 19 aa, Mycobacterium
EIHNRVAAGLGSLAAASPG

SEQ ID NO: 1263042 - protein, 34 aa, Mycobacterium
EIHRDWNARYTWPRFVCGLPREFFAAVRAEMYDR

SEQ ID NO: 1263043 - protein, 18 aa, Mycobacterium
EIHTLAAMFTTVRIEGPD

SEQ ID NO: 1263044 - protein, 19 aa, Mycobacterium
EIIAKIAVPAVRERLTEAI

SEQ ID NO: 1263045 - protein, 21 aa, Mycobacterium
EIIDRVAPVELIRLVNSGTEA

SEQ ID NO: 1263046 - protein, 18 aa, Mycobacterium
EIISKIAVPAVRERLTDA

SEQ ID NO: 1263047 - protein, 20 aa, Mycobacterium
EIKKALRLKAAFSDMLDQMQ

SEQ ID NO: 1263048 - protein, 21 aa, Mycobacterium
EILAARLARGLSWQQLAEAID

SEQ ID NO: 1263049 - protein, 19 aa, Mycobacterium
EILETGAARMAACRTLSAT

SEQ ID NO: 1263050 - protein, 20 aa, Mycobacterium
EILGRLSAGGGRPLSRTAYV

SEQ ID NO: 1263051 - protein, 22 aa, Mycobacterium
EILIPGMPPLAVGYVQRDGESL

SEQ ID NO: 1263052 - protein, 22 aa, Mycobacterium
EILRSRRALLLALLAEHLPDWR

SEQ ID NO: 1263053 - protein, 21 aa, Mycobacterium
EILRYSSPVIHMRRTVTRDGV

SEQ ID NO: 1263054 - protein, 22 aa, Mycobacterium
EILTRYLNLVSFGNNAFGVQDA

SEQ ID NO: 1263055 - protein, 17 aa, Mycobacterium
EILYGNEWELFKSPAGA

SEQ ID NO: 1263056 - protein, 19 aa, Mycobacterium
EIMGALPVIEHTRSHVAKW

SEQ ID NO: 1263057 - protein, 18 aa, Mycobacterium
EIMGRDILPEFIERDEKA

SEQ ID NO: 1263058 - protein, 27 aa, Mycobacterium
EINAKPWWRDRIRAGLASYWVYQHMGN

SEQ ID NO: 1263059 - protein, 18 aa, Mycobacterium
EIPHQNLYGFAWNPMTLV

SEQ ID NO: 1263060 - protein, 20 aa, Mycobacterium
EIPPGFSHGLILSEGKVVAS

SEQ ID NO: 1263061 - protein, 20 aa, Mycobacterium
EIPRALGVPYTYWGVGCVDP

SEQ ID NO: 1263062 - protein, 23 aa, Mycobacterium
EIPTNWPGPTLVYRLLTRKPHSG

SEQ ID NO: 1263063 - protein, 24 aa, Mycobacterium
EIQQLQGWLTDWGVSAAPTSGSGM

SEQ ID NO: 1263064 - protein, 24 aa, Mycobacterium
EIQQRLGAAASAFAAGAITLPQLT

SEQ ID NO: 1263065 - protein, 22 aa, Mycobacterium
EIRAAGPLMRTPVVWATADYDV

SEQ ID NO: 1263066 - protein, 25 aa, Mycobacterium
EIRARWDRYALFAQRTFNVEIPAIP

SEQ ID NO: 1263067 - protein, 23 aa, Mycobacterium
EIRGVEHFIRFPGPNGLLQELYV

SEQ ID NO: 1263068 - protein, 23 aa, Mycobacterium
EIRLHPRAVAAYRRAEGKIPADA

SEQ ID NO: 1263069 - protein, 32 aa, Mycobacterium; identical to SEQ ID NO: 79290

SEQ ID NO: 1263070 - protein, 37 aa, Mycobacterium
EISSADGWRAHPDRVWAWYLWRHHMMSAVAPNNAHRA

SEQ ID NO: 1263071 - protein, 25 aa, Mycobacterium
EISVCRACPRLVQWREDVAVEKRRS

SEQ ID NO: 1263072 - protein, 20 aa, Mycobacterium
EITALGVSRVMVIAADEEAD

SEQ ID NO: 1263073 - protein, 28 aa, Mycobacterium
EITAQMQARCPLAWTDTYGGHWVAAGNR

SEQ ID NO: 1263074 - protein, 21 aa, Mycobacterium
EITDRILLLDGLPNYQRLFSL

SEQ ID NO: 1263075 - protein, 22 aa, Mycobacterium
EITELFGPGLPEIRVIRNGIEA

SEQ ID NO: 1263076 - protein, 22 aa, Mycobacterium
EITKEFYRRMFGAHPELLRNLF

SEQ ID NO: 1263077 - protein, 25 aa, Mycobacterium
EITSIPTMMAFRDGVLLYRQPGAMH

SEQ ID NO: 1263078 - protein, 27 aa, Mycobacterium
EITTAFGVSVATPFLLTGLIAPAMVQR

SEQ ID NO: 1263079 - protein, 20 aa, Mycobacterium
EIVARPAGLLLELSGATIAD

SEQ ID NO: 1263080 - protein, 21 aa, Mycobacterium
EIVEARVVYVGGELKNFTSDG

SEQ ID NO: 1263081 - protein, 29 aa, Mycobacterium
EIVGMSAKLMERWSSRRAAIKARTAELAK

SEQ ID NO: 1263082 - protein, 21 aa, Mycobacterium
EIVMPCLGGAAVVVAGAEVAA

SEQ ID NO: 1263083 - protein, 26 aa, Mycobacterium
EIVRRLHNAGAPLQCGALYDGINKST

SEQ ID NO: 1263084 - protein, 21 aa, Mycobacterium
EIVSPEFQFQVFLDEVRLPAD

SEQ ID NO: 1263085 - protein, 19 aa, Mycobacterium
EIVSTGWLGLHVDEQFGGQ

SEQ ID NO: 1263086 - protein, 25 aa, Mycobacterium
EIYGRFGYGPATIWQRLSVDRVAAR

SEQ ID NO: 1263087 - protein, 24 aa, Mycobacterium
EIYTMWRPSPLIRARRFEKALNTS

SEQ ID NO: 1263088 - protein, 25 aa, Mycobacterium
EIYTMWRPSPLIRARRFEKALNTSA

SEQ ID NO: 1263089 - protein, 17 aa, Mycobacterium
EKADDVWGDALRAGASR

SEQ ID NO: 1263090 - protein, 18 aa, Mycobacterium
EKAGLWPYLEKLGFFLVG

SEQ ID NO: 1263091 - protein, 20 aa, Mycobacterium
EKAIKTQLLMDSIADKLEIQ

SEQ ID NO: 1263092 - protein, 22 aa, Mycobacterium
EKAKELGCKPLAKVHTAVLAGA

SEQ ID NO: 1263093 - protein, 18 aa, Mycobacterium
EKALRWEALSDDKLTAAL

SEQ ID NO: 1263094 - protein, 17 aa, Mycobacterium
EKAMEFCAADECVEVTP

SEQ ID NO: 1263095 - protein, 25 aa, Mycobacterium
EKATPELVAFMVRYTSGYLCVPLAG

SEQ ID NO: 1263096 - protein, 24 aa, Mycobacterium
EKDHPGTEVTFNFAGSADLVAQLS

SEQ ID NO: 1263097 - protein, 29 aa, Mycobacterium
EKDPRWTQGRLRWDHVIVLPNTELPADFG

SEQ ID NO: 1263098 - protein, 20 aa, Mycobacterium
EKDYGLAPVHCDVWNGFVFI

SEQ ID NO: 1263099 - protein, 24 aa, Mycobacterium
EKELDRLRLAGARSAAVNAAAGAE

SEQ ID NO: 1263100 - protein, 17 aa, Mycobacterium
EKERCTGVYGVPTMFIA

SEQ ID NO: 1263101 - protein, 19 aa, Mycobacterium
EKEVFDFLAHVARNPRSLR

SEQ ID NO: 1263102 - protein, 21 aa, Mycobacterium
EKFTGFDAWPFGSRRLCVPCA

SEQ ID NO: 1263103 - protein, 29 aa, Mycobacterium
EKHDLAFGTSRWSSKLVHGGLRYLASGNV

SEQ ID NO: 1263104 - protein, 21 aa, Mycobacterium
EKHEVTNYFAPPTVWISLLRS

SEQ ID NO: 1263105 - protein, 20 aa, Mycobacterium
EKHVERLAALHARDDLQIVV

SEQ ID NO: 1263106 - protein, 24 aa, Mycobacterium
EKHVQRGGGLPMLTAQSVDDIGKA

SEQ ID NO: 1263107 - protein, 22 aa, Mycobacterium
EKHYRRARGRLAEITLTDGSVL

SEQ ID NO: 1263108 - protein, 23 aa, Mycobacterium
EKISSLPDLLPLLEKVAEAGKPL

SEQ ID NO: 1263109 - protein, 20 aa, Mycobacterium
EKITRIAPDFADLITRHTTF

SEQ ID NO: 1263110 - protein, 21 aa, Mycobacterium
EKKLFTGLVGDRFLTVDPEAD

SEQ ID NO: 1263111 - protein, 20 aa, Mycobacterium
EKLAGLKPAFTEDGVIHAGN

SEQ ID NO: 1263112 - protein, 23 aa, Mycobacterium
EKLAVTCRALFDAGHDSGLAGQI

SEQ ID NO: 1263113 - protein, 26 aa, Mycobacterium
EKLLQPWGIVHGGVYCAVIESLASVS

SEQ ID NO: 1263114 - protein, 19 aa, Mycobacterium
EKLNALSYELVEAFHSTLD

SEQ ID NO: 1263115 - protein, 21 aa, Mycobacterium
EKLRPARRPVVAAGGSDEDDV

SEQ ID NO: 1263116 - protein, 19 aa, Mycobacterium
EKMEKAVAVARDDLASIRT

SEQ ID NO: 1263117 - protein, 22 aa, Mycobacterium
EKMLARIAALLRQAEGTDNPHE

SEQ ID NO: 1263118 - protein, 30 aa, Mycobacterium
EKPGAAIGIGGAWYPEWDVYRGGYRQDWCR

SEQ ID NO: 1263119 - protein, 30 aa, Mycobacterium
EKPTPSRSGALCTFRETARILAGLSNPGDA

SEQ ID NO: 1263120 - protein, 25 aa, Mycobacterium
EKPWLPHFYLGHGIGTSAAEMPMIG

SEQ ID NO: 1263121 - protein, 19 aa, Mycobacterium
EKQCHWSHGQRCHRLLRAS

SEQ ID NO: 1263122 - protein, 17 aa, Mycobacterium
EKRADLVVISFLHLPID

SEQ ID NO: 1263123 - protein, 20 aa, Mycobacterium
EKRATIRWQAIRRNLEDSGA

SEQ ID NO: 1263124 - protein, 22 aa, Mycobacterium
EKRFRTAWEAAREAIGQPQLHF

SEQ ID NO: 1263125 - protein, 34 aa, Mycobacterium; identical to SEQ ID NO: 653221

SEQ ID NO: 1263126 - protein, 25 aa, Mycobacterium
EKSQPWALARAHRAMALTAGEPGVC

SEQ ID NO: 1263127 - protein, 25 aa, Mycobacterium
EKTACLIAASGRFGATFSGADDEQI

SEQ ID NO: 1263128 - protein, 17 aa, Mycobacterium
EKVAPLRILTGIEVDIL

SEQ ID NO: 1263129 - protein, 25 aa, Mycobacterium
EKVLARSGLSLSDIDLFEVNEAFAP

SEQ ID NO: 1263130 - protein, 25 aa, Mycobacterium
EKVNLAPGVPWVFETTMADPNWAIL

SEQ ID NO: 1263131 - protein, 21 aa, Mycobacterium
EKWRVGDRVTTPFVCGCGRCQ

SEQ ID NO: 1263132 - protein, 17 aa, Mycobacterium
ELAALASFTPRFDEDAD

SEQ ID NO: 1263133 - protein, 20 aa, Mycobacterium
ELAALWRDGKFRSEVLDAGC

SEQ ID NO: 1263134 - protein, 26 aa, Mycobacterium
ELAAMMPMRVIGMLLGIPESEQVSVR

SEQ ID NO: 1263135 - protein, 27 aa, Mycobacterium
ELAARLGIDPFEFRRRNVVVPGDTFVD

SEQ ID NO: 1263136 - protein, 20 aa, Mycobacterium
ELAARTPLGVALSGEDHAWS

SEQ ID NO: 1263137 - protein, 22 aa, Mycobacterium
ELACGAGAASVWLAKRGLSVWA

SEQ ID NO: 1263138 - protein, 19 aa, Mycobacterium
ELADAAARCDTAATKVVVI

SEQ ID NO: 1263139 - protein, 22 aa, Mycobacterium
ELADCILRYAAMVLLLPSAQPL

SEQ ID NO: 1263140 - protein, 20 aa, Mycobacterium
ELAEEAGLAAEHWRTLIDVD

SEQ ID NO: 1263141 - protein, 19 aa, Mycobacterium
ELAELAARCAATVASGADV

SEQ ID NO: 1263142 - protein, 25 aa, Mycobacterium
ELAELGIHVHLDWDRGIELISPIPG

SEQ ID NO: 1263143 - protein, 18 aa, Mycobacterium
ELAELLSIEHGKTVPDAK

SEQ ID NO: 1263144 - protein, 25 aa, Mycobacterium
ELAERLGNAGFRWLVQSAPVDDPIV

SEQ ID NO: 1263145 - protein, 18 aa, Mycobacterium
ELAEVPAVEVITRSAVML

SEQ ID NO: 1263146 - protein, 18 aa, Mycobacterium
ELAFTVQTGNRWGIAVAK

SEQ ID NO: 1263147 - protein, 18 aa, Mycobacterium
ELAFTWRHQVRALADAGF

SEQ ID NO: 1263148 - protein, 20 aa, Mycobacterium
ELAGAGVCRTVRVASGPVQG

SEQ ID NO: 1263149 - protein, 19 aa, Mycobacterium
ELAGFTAIREWAKKFYPDG

SEQ ID NO: 1263150 - protein, 25 aa, Mycobacterium
ELALCQLVGPLAFARMTGLRTITHN

SEQ ID NO: 1263151 - protein, 17 aa, Mycobacterium
ELAPKIRVNGVAPGGTV

SEQ ID NO: 1263152 - protein, 25 aa, Mycobacterium
ELARFGDLRLRLRVNGDERQNALVE

SEQ ID NO: 1263153 - protein, 20 aa, Mycobacterium
ELARVGARTILAVRNLDKGN

SEQ ID NO: 1263154 - protein, 20 aa, Mycobacterium
ELASAGLRRTHWWTDDAGDF

SEQ ID NO: 1263155 - protein, 24 aa, Mycobacterium
ELCEIRSAGAVFGLLDIDDEFFVI

SEQ ID NO: 1263156 - protein, 21 aa, Mycobacterium
ELCRRFCRELGITVASVDYRL

SEQ ID NO: 1263157 - protein, 21 aa, Mycobacterium
ELCVCDMAWVVGLPQGLVSHH

SEQ ID NO: 1263158 - protein, 19 aa, Mycobacterium
ELCVCDVAWVVGLSQGLVS

SEQ ID NO: 1263159 - protein, 19 aa, Mycobacterium
ELDAAGLPEELSPLDQILH

SEQ ID NO: 1263160 - protein, 29 aa, Mycobacterium
ELDALRIGRRIVARLNWRKQGPAPRPVVV

SEQ ID NO: 1263161 - protein, 29 aa, Mycobacterium
ELDAVVLRDEVRGLGPLLATGRGLRAAAE

SEQ ID NO: 1263162 - protein, 19 aa, Mycobacterium
ELDDGASWRRLLGPLADDC

SEQ ID NO: 1263163 - protein, 20 aa, Mycobacterium
ELDEEYARWIAGVRTLDADA

SEQ ID NO: 1263164 - protein, 17 aa, Mycobacterium
ELDELSAAAMCYTSGTT

SEQ ID NO: 1263165 - protein, 19 aa, Mycobacterium
ELDERRSAVLASIKEQGKL

SEQ ID NO: 1263166 - protein, 29 aa, Mycobacterium
ELDFAARPGLLASFPFPHLLTLDVTLLDR

SEQ ID NO: 1263167 - protein, 25 aa, Mycobacterium
ELDGEVIGAFAAWTPPRRTLDATDG

SEQ ID NO: 1263168 - protein, 18 aa, Mycobacterium
ELDLAVDGSFEWRFTPNS

SEQ ID NO: 1263169 - protein, 24 aa, Mycobacterium
ELDLPAGSILRQVDYFGLGTTVAT

SEQ ID NO: 1263170 - protein, 17 aa, Mycobacterium
ELDRAHVFHSWSAQAEI

SEQ ID NO: 1263171 - protein, 17 aa, Mycobacterium
ELDRIKAAVWAVPSVEH

SEQ ID NO: 1263172 - protein, 18 aa, Mycobacterium
ELDRRLRDSGVRAFAVHP

SEQ ID NO: 1263173 - protein, 24 aa, Mycobacterium
ELDRRSRHAGWGITSNVAHPGVTA

SEQ ID NO: 1263174 - protein, 25 aa, Mycobacterium
ELDWMLHWRKMFDGLQTVGAIPMAI

SEQ ID NO: 1263175 - protein, 23 aa, Mycobacterium
ELEELQAAFALSPWAARTPIDVE

SEQ ID NO: 1263176 - protein, 17 aa, Mycobacterium
ELEGWQRYPECVADKPD

SEQ ID NO: 1263177 - protein, 21 aa, Mycobacterium
ELEIEAAIGRNVRLLRLQQGL

SEQ ID NO: 1263178 - protein, 20 aa, Mycobacterium
ELELARSWHRACVGQTTTAR

SEQ ID NO: 1263179 - protein, 18 aa, Mycobacterium
ELELRLRTLGARRISGLL

SEQ ID NO: 1263180 - protein, 18 aa, Mycobacterium
ELEPETFAGLASVRLPTD

SEQ ID NO: 1263181 - protein, 19 aa, Mycobacterium
ELEPETFAGLATVRLPTDE

SEQ ID NO: 1263182 - protein, 23 aa, Mycobacterium
ELEPETFAGLATVRLPTDEELRE

SEQ ID NO: 1263183 - protein, 19 aa, Mycobacterium
ELEPFVLVVEGSIPNEKIK

SEQ ID NO: 1263184 - protein, 19 aa, Mycobacterium
ELEQIWRGRVSRIDELIAT

SEQ ID NO: 1263185 - protein, 23 aa, Mycobacterium
ELEQRFPAMRGYTEMQRQHTIED

SEQ ID NO: 1263186 - protein, 27 aa, Mycobacterium
ELEQTFMFYLPRICEHCLNPSCVASCP

SEQ ID NO: 1263187 - protein, 24 aa, Mycobacterium
ELERKIRAGEFFEGSTINYRKDGL

SEQ ID NO: 1263188 - protein, 24 aa, Mycobacterium
ELESLRLAIPAALEVLRPHGRIAV

SEQ ID NO: 1263189 - protein, 19 aa, Mycobacterium
ELEVDFDLHGFLGLDDSVR

SEQ ID NO: 1263190 - protein, 20 aa, Mycobacterium
ELFDGFRFEIAGSVQVPTSA

SEQ ID NO: 1263191 - protein, 18 aa, Mycobacterium
ELFEKAGRDLEAQDYSEA

SEQ ID NO: 1263192 - protein, 17 aa, Mycobacterium
ELFLAASDRYWRRYFDN

SEQ ID NO: 1263193 - protein, 18 aa, Mycobacterium
ELFRAALTRYLEGPGGYL

SEQ ID NO: 1263194 - protein, 26 aa, Mycobacterium
ELFTHGAGAFAVFRPVRNPKPAGRIR

SEQ ID NO: 1263195 - protein, 17 aa, Mycobacterium
ELGAKFSDLRFTNSSTL

SEQ ID NO: 1263196 - protein, 17 aa, Mycobacterium
ELGALGIDEFVNKQVYV

SEQ ID NO: 1263197 - protein, 20 aa, Mycobacterium
ELGFHKKIRCRVERTSSDTD

SEQ ID NO: 1263198 - protein, 25 aa, Mycobacterium
ELGKGMLLAIHLGRIKDAEGVRPEQ

SEQ ID NO: 1263199 - protein, 19 aa, Mycobacterium
ELGLSWDTVNTIAMDATQV

SEQ ID NO: 1263200 - protein, 18 aa, Mycobacterium
ELGPLNWAIAKIGARGIR

SEQ ID NO: 1263201 - protein, 21 aa, Mycobacterium
ELGPLPATWISSARVDGTSGI

SEQ ID NO: 1263202 - protein, 19 aa, Mycobacterium
ELGQVIAMVVTINAWNRIN

SEQ ID NO: 1263203 - protein, 21 aa, Mycobacterium
ELGRTDWAVHVALWERNGSSG

SEQ ID NO: 1263204 - protein, 25 aa, Mycobacterium
ELGSGLPVFHPKGGVVRRELEEYSR

SEQ ID NO: 1263205 - protein, 31 aa, Mycobacterium
ELHDCFYNARFLDMAKSYWGAEYAKPQMMLF

SEQ ID NO: 1263206 - protein, 18 aa, Mycobacterium
ELHELLDAMGYRPAGPDG

SEQ ID NO: 1263207 - protein, 18 aa, Mycobacterium
ELHPRISKLVERAQRDGY

SEQ ID NO: 1263208 - protein, 17 aa, Mycobacterium
ELIAGLLERRPQWLEAR

SEQ ID NO: 1263209 - protein, 17 aa, Mycobacterium
ELIEHGRTIPVARVAAM

SEQ ID NO: 1263210 - protein, 19 aa, Mycobacterium
ELIERFGDLGFDVVEMVLA

SEQ ID NO: 1263211 - protein, 22 aa, Mycobacterium
ELIGCGALHVMWSDLGEVRTVA

SEQ ID NO: 1263212 - protein, 20 aa, Mycobacterium
ELIPEAGGLPIRRYAFPNLK

SEQ ID NO: 1263213 - protein, 19 aa, Mycobacterium
ELIQDAWLSRASKRRAQQW

SEQ ID NO: 1263214 - protein, 23 aa, Mycobacterium
ELIRLGRYPLLVVDEVGYIPFEP

SEQ ID NO: 1263215 - protein, 26 aa, Mycobacterium
ELIRLHYPGTGWLRLTRDTIDALAAY

SEQ ID NO: 1263216 - protein, 22 aa, Mycobacterium
ELISALPLFPYMDIHVTPLARH

SEQ ID NO: 1263217 - protein, 17 aa, Mycobacterium
ELISWLRDRLAHYKCPR

SEQ ID NO: 1263218 - protein, 17 aa, Mycobacterium
ELIWHARGRLEEIDRKA

SEQ ID NO: 1263219 - protein, 24 aa, Mycobacterium
ELKGLAELLERVSVPIHVNAHEAD

SEQ ID NO: 1263220 - protein, 26 aa, Mycobacterium
ELKLDRKIAERRVFPAVDVNPSGTRK

SEQ ID NO: 1263221 - protein, 22 aa, Mycobacterium
ELKVLDRHGNPVLADALFHSGD

SEQ ID NO: 1263222 - protein, 19 aa, Mycobacterium
ELLDRALPRIGLVQVSDYV

SEQ ID NO: 1263223 - protein, 17 aa, Mycobacterium
ELLEHADEILASLEDGR

SEQ ID NO: 1263224 - protein, 19 aa, Mycobacterium
ELLERRAADLVAYQDDHAA

SEQ ID NO: 1263225 - protein, 20 aa, Mycobacterium
ELLERSGLPALREVIDQQFA

SEQ ID NO: 1263226 - protein, 19 aa, Mycobacterium
ELLGCFAMTETGHGSDVQS

SEQ ID NO: 1263227 - protein, 19 aa, Mycobacterium
ELLGIPVPNLIAGNNASLE

SEQ ID NO: 1263228 - protein, 22 aa, Mycobacterium
ELLGRITRHLLLMTATPHSGKE

SEQ ID NO: 1263229 - protein, 22 aa, Mycobacterium
ELLKMLVRQYLSGVAARSQTSA

SEQ ID NO: 1263230 - protein, 20 aa, Mycobacterium
ELLLQRGFDGLSIEAVAARA

SEQ ID NO: 1263231 - protein, 19 aa, Mycobacterium
ELLMRAPEVIQLYADGPNG

SEQ ID NO: 1263232 - protein, 18 aa, Mycobacterium
ELLPHAQGIVGILPPIVD

SEQ ID NO: 1263233 - protein, 17 aa, Mycobacterium
ELLPRLKSVELAGRPEH

SEQ ID NO: 1263234 - protein, 17 aa, Mycobacterium
ELLRFMMRNAKRVLSKT

SEQ ID NO: 1263235 - protein, 23 aa, Mycobacterium
ELLRKAGERFGFAVDSLSLVAEH

SEQ ID NO: 1263236 - protein, 17 aa, Mycobacterium
ELLRLRWPCPVPGARPL

SEQ ID NO: 1263237 - protein, 21 aa, Mycobacterium
ELLVGISTRLLAGAREVLTDS

SEQ ID NO: 1263238 - protein, 22 aa, Mycobacterium
ELLVRGGVVFNGYWRNEKATRE

SEQ ID NO: 1263239 - protein, 21 aa, Mycobacterium
ELLWQRGFDGLSIEAVAARAG

SEQ ID NO: 1263240 - protein, 20 aa, Mycobacterium
ELMDEIQSQIGLRPTPLTWP

SEQ ID NO: 1263241 - protein, 19 aa, Mycobacterium
ELMKALWSPGWTEFSGEFY

SEQ ID NO: 1263242 - protein, 20 aa, Mycobacterium
ELMRMRLTPAAFQRGASMAA

SEQ ID NO: 1263243 - protein, 18 aa, Mycobacterium
ELMRRLTAPTGHSVSMTP

SEQ ID NO: 1263244 - protein, 19 aa, Mycobacterium
ELNRRGMLDDVSYQGALDA

SEQ ID NO: 1263245 - protein, 25 aa, Mycobacterium
ELPACPKHWTLLISLKRLAEVQTGL

SEQ ID NO: 1263246 - protein, 21 aa, Mycobacterium
ELPADFGLPDCPRWKVIDRTD

SEQ ID NO: 1263247 - protein, 31 aa, Mycobacterium
ELPALDGKGLRLAIVASTWHETICDALLDGA

SEQ ID NO: 1263248 - protein, 22 aa, Mycobacterium
ELPARGVGVIEVRGEPVTKGYT

SEQ ID NO: 1263249 - protein, 23 aa, Mycobacterium
ELPDRACWALQHLLTRRYISAES

SEQ ID NO: 1263250 - protein, 19 aa, Mycobacterium
ELPEHLVIVGSGVTGAEFC

SEQ ID NO: 1263251 - protein, 26 aa, Mycobacterium
ELPERLAEELVRIIGVLRGMALKKLP

SEQ ID NO: 1263252 - protein, 18 aa, Mycobacterium
ELPHIKAEVAAEAKDVIA

SEQ ID NO: 1263253 - protein, 26 aa, Mycobacterium
ELPLALSCLITPLLFTGRFGEAARAI

SEQ ID NO: 1263254 - protein, 20 aa, Mycobacterium
ELPLDRLVTTFPFEQFDAAW

SEQ ID NO: 1263255 - protein, 21 aa, Mycobacterium
ELPLMEARALLDLGDVAKATR

SEQ ID NO: 1263256 - protein, 19 aa, Mycobacterium
ELPLMFEPYDRKSLRKRAT

SEQ ID NO: 1263257 - protein, 21 aa, Mycobacterium
ELPLPGGQHLVGFEFAYDGGG

SEQ ID NO: 1263258 - protein, 25 aa, Mycobacterium
ELPLPYAGNGWVVWDRGGASEATGD

SEQ ID NO: 1263259 - protein, 19 aa, Mycobacterium
ELPPGGRLGIYGFGGSAHL

SEQ ID NO: 1263260 - protein, 24 aa, Mycobacterium
ELQAGAHRWLRWDEAVECEVAIDA

SEQ ID NO: 1263261 - protein, 19 aa, Mycobacterium
ELQALTFISGDQWLTHPGS

SEQ ID NO: 1263262 - protein, 20 aa, Mycobacterium
ELQALTFISGDQWLTHRGSV

SEQ ID NO: 1263263 - protein, 20 aa, Mycobacterium
ELQCYPGDLNQVWTNIIDNA

SEQ ID NO: 1263264 - protein, 24 aa, Mycobacterium
ELQFGTNHLGHFAFTGLLLDKLLD

SEQ ID NO: 1263265 - protein, 18 aa, Mycobacterium
ELQLVRWGTPRASHLFWA

SEQ ID NO: 1263266 - protein, 19 aa, Mycobacterium
ELQRPERRNALNAELVDGL

SEQ ID NO: 1263267 - protein, 19 aa, Mycobacterium
ELQTRAAAIGPQAVEEVQR

SEQ ID NO: 1263268 - protein, 20 aa, Mycobacterium
ELQVLKGVSFTVPRGTATAI

SEQ ID NO: 1263269 - protein, 23 aa, Mycobacterium
ELRAAVSDTEWRRVDVVEETGST

SEQ ID NO: 1263270 - protein, 20 aa, Mycobacterium
ELRAAVVVDAAGLWRPLART

SEQ ID NO: 1263271 - protein, 19 aa, Mycobacterium
ELRAEGVNLIINYDDQPGA

SEQ ID NO: 1263272 - protein, 23 aa, Mycobacterium
ELRELRSAGAVFGILDIDDEFFV

SEQ ID NO: 1263273 - protein, 20 aa, Mycobacterium
ELRERAVRMVAEISDQHESE

SEQ ID NO: 1263274 - protein, 20 aa, Mycobacterium
ELRGLPELVVGGLTDDDSRE

SEQ ID NO: 1263275 - protein, 18 aa, Mycobacterium
ELRGRLQAALGTPVPASL

SEQ ID NO: 1263276 - protein, 21 aa, Mycobacterium
ELRIARGRRVVRVEYRSPRGE

SEQ ID NO: 1263277 - protein, 21 aa, Mycobacterium
ELRIGLATADDIRNWSFGEVK

SEQ ID NO: 1263278 - protein, 23 aa, Mycobacterium
ELRKRLTGLLGAFRAFSYGSLYP

SEQ ID NO: 1263279 - protein, 17 aa, Mycobacterium
ELRRAPGTVGRPPIGCT

SEQ ID NO: 1263280 - protein, 21 aa, Mycobacterium
ELRRCAPIWWNEQTSGGAGPF

SEQ ID NO: 1263281 - protein, 20 aa, Mycobacterium
ELRRTAPVWWNEQADSIFDD

SEQ ID NO: 1263282 - protein, 18 aa, Mycobacterium
ELRRWLVERLGLAPATSG

SEQ ID NO: 1263283 - protein, 22 aa, Mycobacterium
ELRRWQDSGAVWAVVSRTPDRV

SEQ ID NO: 1263284 - protein, 20 aa, Mycobacterium
ELRSRCLAQLQAAIEAEKQD

SEQ ID NO: 1263285 - protein, 20 aa, Mycobacterium
ELRTLFLFEALTDEQLATLC

SEQ ID NO: 1263286 - protein, 19 aa, Mycobacterium
ELRWAMPDEPLSQVELRAV

SEQ ID NO: 1263287 - protein, 17 aa, Mycobacterium
ELSAEHQVILFSQEDEV

SEQ ID NO: 1263288 - protein, 19 aa, Mycobacterium
ELSDILRPVAPPREVDNVY

SEQ ID NO: 1263289 - protein, 21 aa, Mycobacterium
ELSGLAMAGADFAISVTPLPA

SEQ ID NO: 1263290 - protein, 26 aa, Mycobacterium
ELSKLRLLPFRLSFDGDAEFDTELTL

SEQ ID NO: 1263291 - protein, 21 aa, Mycobacterium
ELSQRALAVGKRVHSETGIDA

SEQ ID NO: 1263292 - protein, 23 aa, Mycobacterium
ELSRLRPGVMKSSFPMPVTGADY

SEQ ID NO: 1263293 - protein, 25 aa, Mycobacterium
ELTAIVAHAGFPMVVKPVAAAPGEG

SEQ ID NO: 1263294 - protein, 24 aa, Mycobacterium
ELTARTVIYYVLGFTADEQSRLQW

SEQ ID NO: 1263295 - protein, 22 aa, Mycobacterium
ELTDLPLVVGIGARSSTGADEV

SEQ ID NO: 1263296 - protein, 18 aa, Mycobacterium
ELTGLALQRIYLDRVAKL

SEQ ID NO: 1263297 - protein, 23 aa, Mycobacterium
ELTLELAEKLFATPQEGRSLGVD

SEQ ID NO: 1263298 - protein, 19 aa, Mycobacterium
ELTLHFAAYYGWPKAAHLS

SEQ ID NO: 1263299 - protein, 25 aa, Mycobacterium
ELTMGHTVIMGRLTWESLPAKFRPL

SEQ ID NO: 1263300 - protein, 24 aa, Mycobacterium
ELTPGFHGIHIHSVGKCEADSVAP

SEQ ID NO: 1263301 - protein, 19 aa, Mycobacterium
ELTPRYFAFWNKWDPGAIS

SEQ ID NO: 1263302 - protein, 24 aa, Mycobacterium
ELVAARPGQFVGVTLAGGSHADAL

SEQ ID NO: 1263303 - protein, 24 aa, Mycobacterium
ELVAEALGGGTLRTAVTDSMPALH

SEQ ID NO: 1263304 - protein, 20 aa, Mycobacterium
ELVAHPWWHDALRLRRYDDA

SEQ ID NO: 1263305 - protein, 19 aa, Mycobacterium
ELVARLIADSGVFITNVAG

SEQ ID NO: 1263306 - protein, 18 aa, Mycobacterium
ELVCKDFGALKVLKGITL

SEQ ID NO: 1263307 - protein, 25 aa, Mycobacterium
ELVDIPFKFHHPMWRENCEVDLEYH

SEQ ID NO: 1263308 - protein, 25 aa, Mycobacterium
ELVESCGFDRAVLFRVHEGRMVMES

SEQ ID NO: 1263309 - protein, 26 aa, Mycobacterium
ELVHRLDCAQLPAGLLDGLADTQWPA

SEQ ID NO: 1263310 - protein, 20 aa, Mycobacterium
ELVKSAASVKVFQRTPGWVL

SEQ ID NO: 1263311 - protein, 17 aa, Mycobacterium
ELVMSGVALTPWRGTTR

SEQ ID NO: 1263312 - protein, 20 aa, Mycobacterium
ELVSLCRAELAGYKQPRRFV

SEQ ID NO: 1263313 - protein, 24 aa, Mycobacterium
ELVSMALRYEGWEISTAGDGATAI

SEQ ID NO: 1263314 - protein, 17 aa, Mycobacterium
ELVSWHAKPVAGVGMGW

SEQ ID NO: 1263315 - protein, 18 aa, Mycobacterium
ELVYAVLNLYPYNPGHLM

SEQ ID NO: 1263316 - protein, 25 aa, Mycobacterium
ELWALKELPPRIAGREYDVLIRLEQ

SEQ ID NO: 1263317 - protein, 23 aa, Mycobacterium
ELYLRGRVGERFAARNSGALAVV

SEQ ID NO: 1263318 - protein, 24 aa, Mycobacterium
EMAEVPVSPPLSWLPRSAALAAVF

SEQ ID NO: 1263319 - protein, 18 aa, Mycobacterium
EMAFKVAGSQVLKKAAQS

SEQ ID NO: 1263320 - protein, 19 aa, Mycobacterium
EMENGYLLLMRVGDGSNLA

SEQ ID NO: 1263321 - protein, 24 aa, Mycobacterium
EMGCKEALFTLGDRPEARWPEARR

SEQ ID NO: 1263322 - protein, 21 aa, Mycobacterium
EMGIPIVMSDLKFMRFIAKEI

SEQ ID NO: 1263323 - protein, 18 aa, Mycobacterium
EMGLAGFEEYLEIKAIAT

SEQ ID NO: 1263324 - protein, 25 aa, Mycobacterium
EMGLARLWQSWGIEPDVVLGHSVGQ

SEQ ID NO: 1263325 - protein, 26 aa, Mycobacterium
EMGLARLWQSWGIEPDVVLGHSVGQY

SEQ ID NO: 1263326 - protein, 25 aa, Mycobacterium
EMHDCRPGFLLPGFIDTHIHYPQTH

SEQ ID NO: 1263327 - protein, 17 aa, Mycobacterium
EMIDICQFAVGLSRQLY

SEQ ID NO: 1263328 - protein, 25 aa, Mycobacterium
EMIRYCAPAQWFARTLRRPFTLHDT

SEQ ID NO: 1263329 - protein, 23 aa, Mycobacterium
EMKPKLDVLDFWNMIRPELPGIK

SEQ ID NO: 1263330 - protein, 19 aa, Mycobacterium
EMLARADSVGVFQVESRAQ

SEQ ID NO: 1263331 - protein, 18 aa, Mycobacterium
EMMRKADVPMPWATMHKI

SEQ ID NO: 1263332 - protein, 27 aa, Mycobacterium
EMNAASRALVRFGFAAGDGLRRLAGTP

SEQ ID NO: 1263333 - protein, 21 aa, Mycobacterium
EMNGSAGFNRWSSRTIKDIPG

SEQ ID NO: 1263334 - protein, 33 aa, Mycobacterium
EMPEQYQAMILLAAWCALRFGELTELRRKDIVL

SEQ ID NO: 1263335 - protein, 24 aa, Mycobacterium
EMQFATNYLGHFALTVGLYPALEA

SEQ ID NO: 1263336 - protein, 17 aa, Mycobacterium
EMRARAAQHARASARAD

SEQ ID NO: 1263337 - protein, 31 aa, Mycobacterium
EMRERLPNLRLWNFYGQTEMAPLASALGPDE

SEQ ID NO: 1263338 - protein, 19 aa, Mycobacterium
EMRERVVGLIGPRARSMWV

SEQ ID NO: 1263339 - protein, 23 aa, Mycobacterium
EMRMAHNAFRAQLRRTHTVVEVS

SEQ ID NO: 1263340 - protein, 28 aa, Mycobacterium
EMRRRADAAGWLRYGLPSQFGGRDGSNI

SEQ ID NO: 1263341 - protein, 20 aa, Mycobacterium
EMRRVLGHFCTGIAVVTAHD

SEQ ID NO: 1263342 - protein, 18 aa, Mycobacterium
EMRSRFWMGGPYVGIRHG

SEQ ID NO: 1263343 - protein, 24 aa, Mycobacterium
EMRVLRGETDFSWAESPRSRTRHF

SEQ ID NO: 1263344 - protein, 19 aa, Mycobacterium
EMSPFVVRPGRTFTTHPHP

SEQ ID NO: 1263345 - protein, 18 aa, Mycobacterium
EMVTRILALQAKPTPADA

SEQ ID NO: 1263346 - protein, 18 aa, Mycobacterium
ENAACARKLAVMAEIFTR

SEQ ID NO: 1263347 - protein, 25 aa, Mycobacterium
ENAIWPDLFIVGGGISRKADKWVPL

SEQ ID NO: 1263348 - protein, 25 aa, Mycobacterium
ENAQARLAALSILIGAVGATGPGVV

SEQ ID NO: 1263349 - protein, 28 aa, Mycobacterium
ENDPRWSQGRLRWDHVVVLPNTDLPDDF

SEQ ID NO: 1263350 - protein, 26 aa, Mycobacterium
ENEDFMWRLADEVLDDIISRDPVGRC

SEQ ID NO: 1263351 - protein, 29 aa, Mycobacterium
ENFRPGTLEKWGLGYDVLRERNRGIILVR

SEQ ID NO: 1263352 - protein, 17 aa, Mycobacterium
ENGGLLFGNGADGAPGQ

SEQ ID NO: 1263353 - protein, 22 aa, Mycobacterium
ENGIELYAQFAARPFGMLLGFP

SEQ ID NO: 1263354 - protein, 25 aa, Mycobacterium
ENGRAAWYRNRWVRTDSFVDPFPLY

SEQ ID NO: 1263355 - protein, 18 aa, Mycobacterium
ENHPAVLLFSHRSYLDGA

SEQ ID NO: 1263356 - protein, 25 aa, Mycobacterium
ENKHQKYPLGYVRWTEHENLREVAR

SEQ ID NO: 1263357 - protein, 25 aa, Mycobacterium
ENKYRLVFEKLRLKPGDRLLDVGCG

SEQ ID NO: 1263358 - protein, 25 aa, Mycobacterium
ENKYRLVFEKLRLQPGDRLLDVGCG

SEQ ID NO: 1263359 - protein, 17 aa, Mycobacterium
ENLKGAWTDMAKGGWQR

SEQ ID NO: 1263360 - protein, 22 aa, Mycobacterium
ENLQLLKGWHAAASVSNGQKRW

SEQ ID NO: 1263361 - protein, 22 aa, Mycobacterium
ENLQPIGAFKVRGAFNAIGAVR

SEQ ID NO: 1263362 - protein, 27 aa, Mycobacterium
ENLRFELDRYLGWPGQAPSYAIGQRIW

SEQ ID NO: 1263363 - protein, 20 aa, Mycobacterium
ENMFPFRADRFFGAGQTSIE

SEQ ID NO: 1263364 - protein, 17 aa, Mycobacterium
ENMGFKTAGFAFGRPDY

SEQ ID NO: 1263365 - protein, 19 aa, Mycobacterium
ENMMSGSVWVKGDASQSAG

SEQ ID NO: 1263366 - protein, 21 aa, Mycobacterium
ENMRARMNAALGITEQGFSSG

SEQ ID NO: 1263367 - protein, 23 aa, Mycobacterium
ENMRARMYAALGITEQGFSADAC

SEQ ID NO: 1263368 - protein, 18 aa, Mycobacterium
ENPARLVEYVIMGQVLTA

SEQ ID NO: 1263369 - protein, 28 aa, Mycobacterium
ENPELKRFSFAWLTDFVGWLPMPDGGPR

SEQ ID NO: 1263370 - protein, 25 aa, Mycobacterium
ENPFDRRGFGFGFGPEGRRTVHERR

SEQ ID NO: 1263371 - protein, 22 aa, Mycobacterium
ENPGEGGLIQALFVTLPKALAA

SEQ ID NO: 1263372 - protein, 22 aa, Mycobacterium
ENPSAMGYPSFHDFEHWKPMWD

SEQ ID NO: 1263373 - protein, 21 aa, Mycobacterium
ENRLTDHGPLWVGAGGKTFGY

SEQ ID NO: 1263374 - protein, 23 aa, Mycobacterium
ENRMISFPYPKLMNSNNMVDQGA

SEQ ID NO: 1263375 - protein, 24 aa, Mycobacterium
ENRPEIVELMFAIWAAECVFVPLN

SEQ ID NO: 1263376 - protein, 19 aa, Mycobacterium
ENSPWLSVSACTGSPGCER

SEQ ID NO: 1263377 - protein, 28 aa, Mycobacterium
ENTGLRLAAKLTPWPAVNGARTGAVSAF

SEQ ID NO: 1263378 - protein, 23 aa, Mycobacterium
ENTLKYCYNFFGIEYYFVTAELP

SEQ ID NO: 1263379 - protein, 22 aa, Mycobacterium
ENTRALDLLTKWGDAPTAPPVQ

SEQ ID NO: 1263380 - protein, 19 aa, Mycobacterium
ENVADTFVAMGWELAEGPE

SEQ ID NO: 1263381 - protein, 24 aa, Mycobacterium
ENVPLHLPSTFTLWKALSHNPNVR

SEQ ID NO: 1263382 - protein, 20 aa, Mycobacterium
ENYFRFIAEDIRKYLAELGF

SEQ ID NO: 1263383 - protein, 19 aa, Mycobacterium
ENYQLQWERRSGFARLAVA

SEQ ID NO: 1263384 - protein, 18 aa, Mycobacterium
EPAAFPWGIAENRAVADT

SEQ ID NO: 1263385 - protein, 23 aa, Mycobacterium
EPADIANAVAFLLSDQAGYITGS

SEQ ID NO: 1263386 - protein, 20 aa, Mycobacterium
EPARTWFTAMTPIATAFGDV

SEQ ID NO: 1263387 - protein, 21 aa, Mycobacterium
EPASILMLFAPGAPREHYFEG

SEQ ID NO: 1263388 - protein, 21 aa, Mycobacterium
EPCSALDPISTLAIEDLISEL

SEQ ID NO: 1263389 - protein, 22 aa, Mycobacterium
EPCTECRGSGSIIEHPCDECRG

SEQ ID NO: 1263390 - protein, 23 aa, Mycobacterium
EPDAGDVFLDFEGHPFWRADTGL

SEQ ID NO: 1263391 - protein, 20 aa, Mycobacterium
EPDEGLILFCGMSIGFEDRS

SEQ ID NO: 1263392 - protein, 26 aa, Mycobacterium
EPDFTAMGWPHPRRAAQLWIGMTAEA

SEQ ID NO: 1263393 - protein, 19 aa, Mycobacterium
EPDPRYRGSLQETRDAILT

SEQ ID NO: 1263394 - protein, 17 aa, Mycobacterium
EPDRLERALAWAEEDYH

SEQ ID NO: 1263395 - protein, 30 aa, Mycobacterium
EPDWVNTIFLSTRFTAWRVGGYNEYLYTFF

SEQ ID NO: 1263396 - protein, 17 aa, Mycobacterium
EPEPDRDPGRDCDPEAE

SEQ ID NO: 1263397 - protein, 18 aa, Mycobacterium
EPEPRWPAAPDGVLVMLI

SEQ ID NO: 1263398 - protein, 20 aa, Mycobacterium
EPEVSLWDLAAIDILVREAG

SEQ ID NO: 1263399 - protein, 25 aa, Mycobacterium
EPFADFRPGQYVSVGVTLPDGARQL

SEQ ID NO: 1263400 - protein, 19 aa, Mycobacterium
EPFDGPWASAVRGIAARAG

SEQ ID NO: 1263401 - protein, 17 aa, Mycobacterium
EPFDLVIADEAWEVDYF

SEQ ID NO: 1263402 - protein, 17 aa, Mycobacterium
EPFGEWLPRGQGEDVVS

SEQ ID NO: 1263403 - protein, 25 aa, Mycobacterium
EPFVAFEGLEYAPLHIAHERLGDTV

SEQ ID NO: 1263404 - protein, 17 aa, Mycobacterium
EPGEPPPAFPVSEVVSA

SEQ ID NO: 1263405 - protein, 18 aa, Mycobacterium
EPGFSADMVWLDRDPRLT

SEQ ID NO: 1263406 - protein, 17 aa, Mycobacterium
EPGGCVWTDRHPSGVLV

SEQ ID NO: 1263407 - protein, 24 aa, Mycobacterium
EPGGGMSATFGSFVAGQLTHATDI

SEQ ID NO: 1263408 - protein, 21 aa, Mycobacterium
EPGKFVKAADWVGREKAEAEV

SEQ ID NO: 1263409 - protein, 24 aa, Mycobacterium
EPGLQEKPLSIAMREIHGDLLEHT

SEQ ID NO: 1263410 - protein, 18 aa, Mycobacterium
EPGMRVLLVDDVISTGGS

SEQ ID NO: 1263411 - protein, 19 aa, Mycobacterium
EPGNPCGQPGAAACQPGPS

SEQ ID NO: 1263412 - protein, 19 aa, Mycobacterium
EPGQFRIGPHTDFGTVTIL

SEQ ID NO: 1263413 - protein, 28 aa, Mycobacterium
EPGRRFAWEVNHGWAYWGYEMAAEDGGT

SEQ ID NO: 1263414 - protein, 24 aa, Mycobacterium
EPGRVHLPGVFVQRVVHTGPQTKR

SEQ ID NO: 1263415 - protein, 19 aa, Mycobacterium
EPGSLLAPMPGSVVRVEVD

SEQ ID NO: 1263416 - protein, 20 aa, Mycobacterium
EPGWAHALMRHYRDPRVAAV

SEQ ID NO: 1263417 - protein, 18 aa, Mycobacterium
EPHLLVGVVEEVADATGA

SEQ ID NO: 1263418 - protein, 19 aa, Mycobacterium
EPHPAAAVSTLIVSGKSPE

SEQ ID NO: 1263419 - protein, 27 aa, Mycobacterium
EPHPLLPATPWHHAHHWIKVDPTAGID

SEQ ID NO: 1263420 - protein, 18 aa, Mycobacterium
EPHRDAALTAQRDYVEEW

SEQ ID NO: 1263421 - protein, 18 aa, Mycobacterium
EPHWYLGVIGSDPDMRGA

SEQ ID NO: 1263422 - protein, 18 aa, Mycobacterium
EPIAIVAVSCRFPGAPDP

SEQ ID NO: 1263423 - protein, 28 aa, Mycobacterium
EPITRSGQMFRMAMYFANPAFADGHYEV

SEQ ID NO: 1263424 - protein, 20 aa, Mycobacterium
EPIVRPGSWIGGDRDGNPNV

SEQ ID NO: 1263425 - protein, 20 aa, Mycobacterium
EPKALVAADGYLFGGKYRDK

SEQ ID NO: 1263426 - protein, 27 aa, Mycobacterium
EPKKKPRSAWRRFVYPAPNACWQLDAT

SEQ ID NO: 1263427 - protein, 19 aa, Mycobacterium
EPKPLKGMPPFSGPQGPFA

SEQ ID NO: 1263428 - protein, 18 aa, Mycobacterium
EPKRRYWAKEVVDTGNPA

SEQ ID NO: 1263429 - protein, 17 aa, Mycobacterium
EPLARLWHTTTLLREHR

SEQ ID NO: 1263430 - protein, 24 aa, Mycobacterium
EPLELPDELDWLAIQRSGLLDEDS

SEQ ID NO: 1263431 - protein, 19 aa, Mycobacterium
EPLLGTWQSLVLVDLNRDN

SEQ ID NO: 1263432 - protein, 23 aa, Mycobacterium
EPLLRRRHGAWIGWPGVPEDADD

SEQ ID NO: 1263433 - protein, 18 aa, Mycobacterium
EPLRELFEPIMLASDQIC

SEQ ID NO: 1263434 - protein, 22 aa, Mycobacterium
EPLRLLDCARPVNGAVAVVLTG

SEQ ID NO: 1263435 - protein, 25 aa, Mycobacterium
EPLRLLFKDEVRAVGRELGLPEEIV

SEQ ID NO: 1263436 - protein, 33 aa, Mycobacterium
EPLSAEGLIAWSRERMAGFKVPRYVEFLDELPL

SEQ ID NO: 1263437 - protein, 26 aa, Mycobacterium
EPLVDAFAAALGRLGADVQTGVFGAD

SEQ ID NO: 1263438 - protein, 24 aa, Mycobacterium
EPLVEITDLIGLRVITYLREDVAT

SEQ ID NO: 1263439 - protein, 19 aa, Mycobacterium
EPMAALSRMSRGEHRSITL

SEQ ID NO: 1263440 - protein, 20 aa, Mycobacterium
EPMGPLINSLWWAVPKSGGR

SEQ ID NO: 1263441 - protein, 23 aa, Mycobacterium
EPMIPIYIFYSMFGFQRTGDGLW

SEQ ID NO: 1263442 - protein, 20 aa, Mycobacterium
EPMRPWKAEQLGGGYRISSW

SEQ ID NO: 1263443 - protein, 23 aa, Mycobacterium
EPNARTRFVLVGRPGPPPKCTGA

SEQ ID NO: 1263444 - protein, 21 aa, Mycobacterium
EPNRRIAWTILGQIRPQIGHV

SEQ ID NO: 1263445 - protein, 19 aa, Mycobacterium
EPPAGYRPAEVTADRAAYI

SEQ ID NO: 1263446 - protein, 20 aa, Mycobacterium
EPPPRTGVHCAFTEAARRTP

SEQ ID NO: 1263447 - protein, 20 aa, Mycobacterium
EPPYRGLVEMSAQLPPGTDT

SEQ ID NO: 1263448 - protein, 22 aa, Mycobacterium
EPRGRKGPWWDRSETKWVAEAL

SEQ ID NO: 1263449 - protein, 24 aa, Mycobacterium
EPRLWEMSTVLPILQDTTIVAAGP

SEQ ID NO: 1263450 - protein, 19 aa, Mycobacterium
EPRPSWGNPKYDPIWAAAA

SEQ ID NO: 1263451 - protein, 19 aa, Mycobacterium
EPRPSWGNPKYDPIWAAAT

SEQ ID NO: 1263452 - protein, 26 aa, Mycobacterium
EPSDRQLLFGAFGEWITRPTAQAAAL

SEQ ID NO: 1263453 - protein, 19 aa, Mycobacterium
EPSGAVALAGYRRVAPTGR

SEQ ID NO: 1263454 - protein, 25 aa, Mycobacterium
EPSLRLRAALRRRFAGLQVASSPSD

SEQ ID NO: 1263455 - protein, 17 aa, Mycobacterium
EPTFILRGLTDLNITFT

SEQ ID NO: 1263456 - protein, 20 aa, Mycobacterium
EPTFRRSVIYVVEHNDGGTL

SEQ ID NO: 1263457 - protein, 21 aa, Mycobacterium
EPTFVPVLGRIAAGGPILAEE

SEQ ID NO: 1263458 - protein, 24 aa, Mycobacterium
EPTVLPSRFPNLLANGSGGIAVGM

SEQ ID NO: 1263459 - protein, 19 aa, Mycobacterium
EPVAAPLCRNTRLTPQGAA

SEQ ID NO: 1263460 - protein, 25 aa, Mycobacterium
EPVDFPLDGVVPGFQKAIAGQKVGS

SEQ ID NO: 1263461 - protein, 23 aa, Mycobacterium
EPVDISNAVLFLASDEARYITGL

SEQ ID NO: 1263462 - protein, 17 aa, Mycobacterium
EPVFAAFGQPGPVTTAE

SEQ ID NO: 1263463 - protein, 17 aa, Mycobacterium
EPVHFGVGMAEFHQRAS

SEQ ID NO: 1263464 - protein, 19 aa, Mycobacterium
EPVIRRIDVLASQGHEGAQ

SEQ ID NO: 1263465 - protein, 24 aa, Mycobacterium
EPVKDIKGARVLALLGDSVTTDHI

SEQ ID NO: 1263466 - protein, 26 aa, Mycobacterium
EPVMRIRPGTVLTLWTEDAYGGRITS

SEQ ID NO: 1263467 - protein, 25 aa, Mycobacterium
EPVPEAPGFVVVPWAAVDAWWEEGR

SEQ ID NO: 1263468 - protein, 21 aa, Mycobacterium
EPVTPRTGIQITSAALELAAA

SEQ ID NO: 1263469 - protein, 20 aa, Mycobacterium
EPVVDVWTGWADRRGTRRWT

SEQ ID NO: 1263470 - protein, 19 aa, Mycobacterium
EPWARAIAADIARRNAGRD

SEQ ID NO: 1263471 - protein, 26 aa, Mycobacterium
EPWERHPAMLAAYFRARTGPSGKRLL

SEQ ID NO: 1263472 - protein, 24 aa, Mycobacterium
EPWSRPGDYVLLRACSDLVCASSA

SEQ ID NO: 1263473 - protein, 24 aa, Mycobacterium
EPWVPRSRSHVVTFPQDLTDRSEM

SEQ ID NO: 1263474 - protein, 20 aa, Mycobacterium
EPYIPLRAVRHLEKGRVVIF

SEQ ID NO: 1263475 - protein, 31 aa, Mycobacterium
EPYMTRTVEPWGVVTDRGRWYLVGHDRDRDA

SEQ ID NO: 1263476 - protein, 26 aa, Mycobacterium
EPYTELRAPKLFNLRTDPYERADITS

SEQ ID NO: 1263477 - protein, 19 aa, Mycobacterium
EPYVSRLNFEPSLGNAIRA

SEQ ID NO: 1263478 - protein, 21 aa, Mycobacterium
EQAAAMAFRMRSICDRIAGFP

SEQ ID NO: 1263479 - protein, 18 aa, Mycobacterium
EQAAMLIFLGSRAAGYLT

SEQ ID NO: 1263480 - protein, 25 aa, Mycobacterium
EQAFLKFLRSQVAAIGEVLQSGTLT

SEQ ID NO: 1263481 - protein, 24 aa, Mycobacterium
EQAGDPVEVMWMIFDQRYRNSYLL

SEQ ID NO: 1263482 - protein, 20 aa, Mycobacterium
EQAILPAWREQGWLDQHTVV

SEQ ID NO: 1263483 - protein, 28 aa, Mycobacterium
EQAKRLPDALARFPITRLVSSPQVRAIE

SEQ ID NO: 1263484 - protein, 23 aa, Mycobacterium
EQCTGRLAVVFGAGGNRDQGKRE

SEQ ID NO: 1263485 - protein, 26 aa, Mycobacterium
EQDAAMGPGCRRLLLTAGPSVTKGVE

SEQ ID NO: 1263486 - protein, 18 aa, Mycobacterium
EQEARWAASVSGGHVGRA

SEQ ID NO: 1263487 - protein, 21 aa, Mycobacterium
EQEKLCLLVMIGVRSDGRKEL

SEQ ID NO: 1263488 - protein, 29 aa, Mycobacterium
EQFRTAFDASRPVFGFAPYPGVQPGDPAR

SEQ ID NO: 1263489 - protein, 25 aa, Mycobacterium
EQGDPRFSDVSSRIFGTPHDVDVGA

SEQ ID NO: 1263490 - protein, 24 aa, Mycobacterium
EQGDPRFSDVSSRVFGTPHDVDVG

SEQ ID NO: 1263491 - protein, 23 aa, Mycobacterium
EQGELWFRSPQLMKGYHNKPEAT

SEQ ID NO: 1263492 - protein, 18 aa, Mycobacterium
EQGLGWKAGVEAALELLL

SEQ ID NO: 1263493 - protein, 25 aa, Mycobacterium
EQGMPCAECAAAFGDHLRQTNGPPM

SEQ ID NO: 1263494 - protein, 25 aa, Mycobacterium
EQGQRIDPVLARSWLLVNGSHYDRF

SEQ ID NO: 1263495 - protein, 18 aa, Mycobacterium
EQGRRRLGELVADSHALL

SEQ ID NO: 1263496 - protein, 17 aa, Mycobacterium
EQHARVLGRLALSAADP

SEQ ID NO: 1263497 - protein, 25 aa, Mycobacterium
EQHLAEYKGAVLAVTHDRYFLDNVA

SEQ ID NO: 1263498 - protein, 22 aa, Mycobacterium
EQHPIPEWIVVGAGTGGTSATI

SEQ ID NO: 1263499 - protein, 18 aa, Mycobacterium
EQIIAGWLAGVSVDQSFA

SEQ ID NO: 1263500 - protein, 24 aa, Mycobacterium
EQIIARLIEWVAFTPLQNATGEPA

SEQ ID NO: 1263501 - protein, 24 aa, Mycobacterium
EQIYEMYRLLALAKYDERYVIPTA

SEQ ID NO: 1263502 - protein, 26 aa, Mycobacterium
EQKKWAKLAADRGWGSTMVLTEPDAG

SEQ ID NO: 1263503 - protein, 20 aa, Mycobacterium
EQKRRLAARLERPDKYWKYN

SEQ ID NO: 1263504 - protein, 26 aa, Mycobacterium
EQLAPLPKRRLAATLDEYPNAEQYFW

SEQ ID NO: 1263505 - protein, 18 aa, Mycobacterium
EQLARFAFDRGGGLPSAI

SEQ ID NO: 1263506 - protein, 31 aa, Mycobacterium
EQLFAVGYAACFHSALRLVGRQEKVDVTDSA

SEQ ID NO: 1263507 - protein, 17 aa, Mycobacterium
EQLGGGYRISSWVEKTA

SEQ ID NO: 1263508 - protein, 17 aa, Mycobacterium
EQLPRSLPRGTVAVLAG

SEQ ID NO: 1263509 - protein, 21 aa, Mycobacterium
EQLPRSLPRGTVAVLAGARSL

SEQ ID NO: 1263510 - protein, 28 aa, Mycobacterium
EQLPVYRPPLDMARLFGEPAIGARGELG

SEQ ID NO: 1263511 - protein, 20 aa, Mycobacterium
EQLTRLNVRIAMVADKLPWS

SEQ ID NO: 1263512 - protein, 20 aa, Mycobacterium
EQMASMLLDLCDVETKVAAA

SEQ ID NO: 1263513 - protein, 19 aa, Mycobacterium
EQMLAATVDYVLVRHQFGR

SEQ ID NO: 1263514 - protein, 22 aa, Mycobacterium
EQMQGWLTQWGMSTMPMMPGMD

SEQ ID NO: 1263515 - protein, 17 aa, Mycobacterium
EQMRRFEVEAGAQVLMA

SEQ ID NO: 1263516 - protein, 34 aa, Mycobacterium
EQNVRWVTRWPVVPDARRGPLGFVHQETSPAKTV

SEQ ID NO: 1263517 - protein, 18 aa, Mycobacterium
EQPCRTVPELAEVRRRVD

SEQ ID NO: 1263518 - protein, 21 aa, Mycobacterium
EQPTHIAAAFDVSRQTFRKDK

SEQ ID NO: 1263519 - protein, 18 aa, Mycobacterium
EQQDRFWVRDEISGDEYQ

SEQ ID NO: 1263520 - protein, 23 aa, Mycobacterium
EQQKLKVLVSIFGRETPVELTFN

SEQ ID NO: 1263521 - protein, 25 aa, Mycobacterium
EQQRRFLASEGWIAWSGPAISELLK

SEQ ID NO: 1263522 - protein, 25 aa, Mycobacterium
EQQRRFLSSEGWIAWSGPAISELLK

SEQ ID NO: 1263523 - protein, 22 aa, Mycobacterium
EQRKAYGGKVFDVLGEAFSETP

SEQ ID NO: 1263524 - protein, 25 aa, Mycobacterium
EQRQRWLPEMLGGSTIGAYSLSEPQ

SEQ ID NO: 1263525 - protein, 18 aa, Mycobacterium
EQRQRWWSDYQGMAPTAV

SEQ ID NO: 1263526 - protein, 26 aa, Mycobacterium
EQTDGRVGWRISIPATLSYWSELTRA

SEQ ID NO: 1263527 - protein, 17 aa, Mycobacterium
EQTGSVARCYSLASSPH

SEQ ID NO: 1263528 - protein, 26 aa, Mycobacterium
EQTMKVGLWSVWWGMQTAFPLMKARG

SEQ ID NO: 1263529 - protein, 24 aa, Mycobacterium
EQTRLLCHKAAWTIDQQGNKSKDA

SEQ ID NO: 1263530 - protein, 19 aa, Mycobacterium
EQVATAWLALGPSIVVVTF

SEQ ID NO: 1263531 - protein, 18 aa, Mycobacterium
EQVDAVIYDEEFAPSVAQ

SEQ ID NO: 1263532 - protein, 18 aa, Mycobacterium
EQVEWVWYVETLRETPGF

SEQ ID NO: 1263533 - protein, 18 aa, Mycobacterium
EQVFPVLTPLAVDPAHPF

SEQ ID NO: 1263534 - protein, 18 aa, Mycobacterium
EQVGACERVLEIATDYAR

SEQ ID NO: 1263535 - protein, 23 aa, Mycobacterium
EQVLRINLIGTFLVTREAVTALH

SEQ ID NO: 1263536 - protein, 17 aa, Mycobacterium
EQVWDTIGWQGRETLGD

SEQ ID NO: 1263537 - protein, 22 aa, Mycobacterium
EQWEPRIDVVNVRVGFSQTEFG

SEQ ID NO: 1263538 - protein, 27 aa, Mycobacterium
EQWQDELFFKFGLRFDLLTNQLIDANV

SEQ ID NO: 1263539 - protein, 18 aa, Mycobacterium
EQYCLPAIKSNALYMDRY

SEQ ID NO: 1263540 - protein, 18 aa, Mycobacterium
EQYISVGVGRDYSDVTPL

SEQ ID NO: 1263541 - protein, 26 aa, Mycobacterium
EQYTYWRIALPHAEAAVFDAALRSHH

SEQ ID NO: 1263542 - protein, 19 aa, Mycobacterium
EQYTYWRIALPHDEAATFD

SEQ ID NO: 1263543 - protein, 19 aa, Mycobacterium
EQYTYWRIALPHEEAATFD

SEQ ID NO: 1263544 - protein, 30 aa, Mycobacterium
ERADGALRRSVKFPAFLDGIEAVRRVAERA

SEQ ID NO: 1263545 - protein, 21 aa, Mycobacterium
ERADIAFTVCDAGWKYLSTGA

SEQ ID NO: 1263546 - protein, 22 aa, Mycobacterium
ERAELIRWLVGRGVGIDQIRGN

SEQ ID NO: 1263547 - protein, 17 aa, Mycobacterium
ERAFWQFHASLMEPWDG

SEQ ID NO: 1263548 - protein, 17 aa, Mycobacterium
ERAGLRFDIPGFIVNDP

SEQ ID NO: 1263549 - protein, 22 aa, Mycobacterium
ERAKEIGLVWRLVEPDRLQSEA

SEQ ID NO: 1263550 - protein, 31 aa, Mycobacterium
ERALCARPALLSVSFGEDWSWVRRAQEVGAA

SEQ ID NO: 1263551 - protein, 18 aa, Mycobacterium
ERALELTASYAREREQFD

SEQ ID NO: 1263552 - protein, 18 aa, Mycobacterium
ERALPARVLRHLKSQVYE

SEQ ID NO: 1263553 - protein, 17 aa, Mycobacterium
ERALRLASSLREFGPGA

SEQ ID NO: 1263554 - protein, 17 aa, Mycobacterium
ERALTWWAVQSLTKTAI

SEQ ID NO: 1263555 - protein, 19 aa, Mycobacterium
ERAPRVDIVTTYPGGDAAA

SEQ ID NO: 1263556 - protein, 24 aa, Mycobacterium
ERARTEFSATAWLARLRTTYLEAM

SEQ ID NO: 1263557 - protein, 18 aa, Mycobacterium
ERARVLGEAVALLRDMLN

SEQ ID NO: 1263558 - protein, 19 aa, Mycobacterium
ERARWLRGTGKTWQQIADS

SEQ ID NO: 1263559 - protein, 21 aa, Mycobacterium
ERAVFVLREVFGFDYDEIAGA

SEQ ID NO: 1263560 - protein, 20 aa, Mycobacterium
ERAVFVLREVFGFGHDEIAA

SEQ ID NO: 1263561 - protein, 25 aa, Mycobacterium
ERDFYLKWFWTQPLWLDLGDIRVIH

SEQ ID NO: 1263562 - protein, 17 aa, Mycobacterium
ERDLRATVYGWLAFTFE

SEQ ID NO: 1263563 - protein, 17 aa, Mycobacterium
ERDNCPQRAFPALGRAL

SEQ ID NO: 1263564 - protein, 25 aa, Mycobacterium
ERDRIWSGRVNRWLAEVAASEKPGH

SEQ ID NO: 1263565 - protein, 17 aa, Mycobacterium
ERDWLRRQPTIPLRTDT

SEQ ID NO: 1263566 - protein, 25 aa, Mycobacterium
EREAIFKRAWLNVARVEELPRAGSY

SEQ ID NO: 1263567 - protein, 28 aa, Mycobacterium
EREEFRCGRMFIFIGAEPRTEWLDGVVV

SEQ ID NO: 1263568 - protein, 25 aa, Mycobacterium
ERELWSGDATFVFTRTTAGEIGILP

SEQ ID NO: 1263569 - protein, 23 aa, Mycobacterium
EREPELRRQAGELIDAIVAKGEC

SEQ ID NO: 1263570 - protein, 23 aa, Mycobacterium
EREQGFADLIAWLKEALSDHVKE

SEQ ID NO: 1263571 - protein, 19 aa, Mycobacterium
EREQPWLAIAPVAKAVAVM

SEQ ID NO: 1263572 - protein, 23 aa, Mycobacterium
ERERVCAFAADWNQRTWNPKAVV

SEQ ID NO: 1263573 - protein, 19 aa, Mycobacterium
ERESAKWTKASREITTALL

SEQ ID NO: 1263574 - protein, 20 aa, Mycobacterium
ERFAVSRYTIREALRRLRDD

SEQ ID NO: 1263575 - protein, 22 aa, Mycobacterium
ERFFAEEVYREFGYAGPADVVE

SEQ ID NO: 1263576 - protein, 27 aa, Mycobacterium
ERFPDMRIPWHSRWRHFEAGGVDRRAE

SEQ ID NO: 1263577 - protein, 17 aa, Mycobacterium
ERFPRKLIEHLGAAGVF

SEQ ID NO: 1263578 - protein, 23 aa, Mycobacterium
ERFTVLRPLLFTIAYEILGSATE

SEQ ID NO: 1263579 - protein, 19 aa, Mycobacterium
ERFVGFGIMGLPFAGGHYL

SEQ ID NO: 1263580 - protein, 25 aa, Mycobacterium
ERGIGFSGVVWRAAAPSADESSTAM

SEQ ID NO: 1263581 - protein, 17 aa, Mycobacterium
ERGKAYAARVLAKRVAA

SEQ ID NO: 1263582 - protein, 35 aa, Mycobacterium
ERGKKLTFELARFIKFMITEIFPGGRLPTTQMMIE

SEQ ID NO: 1263583 - protein, 19 aa, Mycobacterium
ERGLLLSTLWYIREVDPSV

SEQ ID NO: 1263584 - protein, 20 aa, Mycobacterium
ERGLPTFCEKPIAATAAESA

SEQ ID NO: 1263585 - protein, 19 aa, Mycobacterium
ERGQWAVDVVVVFDDGVVR

SEQ ID NO: 1263586 - protein, 21 aa, Mycobacterium
ERGSIWMRTWQIAGRVEDLPK

SEQ ID NO: 1263587 - protein, 24 aa, Mycobacterium
ERGTPGEFCTRGYSVMLGYWRDEE

SEQ ID NO: 1263588 - protein, 25 aa, Mycobacterium
ERGYSRLSWAVLDWNVNAIALYDSV

SEQ ID NO: 1263589 - protein, 20 aa, Mycobacterium
ERGYTFPVLSDFWPHGEIAR

SEQ ID NO: 1263590 - protein, 21 aa, Mycobacterium
ERHPEAPLQLRTLAAADAAAE

SEQ ID NO: 1263591 - protein, 18 aa, Mycobacterium
ERHPLVGTVHGFGLYLGV

SEQ ID NO: 1263592 - protein, 18 aa, Mycobacterium
ERHPRAWESLRTVLEGAL

SEQ ID NO: 1263593 - protein, 19 aa, Mycobacterium
ERIAPLGVVVTGVIPMVDR

SEQ ID NO: 1263594 - protein, 19 aa, Mycobacterium
ERIDAARAWHAELVDHGLA

SEQ ID NO: 1263595 - protein, 21 aa, Mycobacterium
ERIDELLPFQVNDTLMAAAGN

SEQ ID NO: 1263596 - protein, 25 aa, Mycobacterium
ERIFPVYGRKAWKSRLRAHPDVAAA

SEQ ID NO: 1263597 - protein, 17 aa, Mycobacterium
ERIKEHLWRAAHTASSH

SEQ ID NO: 1263598 - protein, 24 aa, Mycobacterium
ERILRGRTGALIVIGYDDSVETIC

SEQ ID NO: 1263599 - protein, 27 aa, Mycobacterium
ERILTWRHVYDLDELPEHLVIVGSGVT

SEQ ID NO: 1263600 - protein, 19 aa, Mycobacterium
ERISNALVAMAIESLGAEA

SEQ ID NO: 1263601 - protein, 18 aa, Mycobacterium
ERITAAWNRRQQPAYVGE

SEQ ID NO: 1263602 - protein, 20 aa, Mycobacterium
ERITEALAIRRATDMIEADL

SEQ ID NO: 1263603 - protein, 18 aa, Mycobacterium
ERKAFDLTGKVVVVVGAG

SEQ ID NO: 1263604 - protein, 21 aa, Mycobacterium
ERKLSPELTRPFTPPPTFMNH

SEQ ID NO: 1263605 - protein, 26 aa, Mycobacterium
ERKLVGGTCVNYGCIPTKTLVASAHA

SEQ ID NO: 1263606 - protein, 30 aa, Mycobacterium
ERKNKVRGGAIFRPVFNQLNVEVGFHTPRL

SEQ ID NO: 1263607 - protein, 21 aa, Mycobacterium
ERKRPSSGWASLTPTELDVVG

SEQ ID NO: 1263608 - protein, 19 aa, Mycobacterium
ERKTLRLVAQYGDACNLFG

SEQ ID NO: 1263609 - protein, 26 aa, Mycobacterium
ERLAALKLIDGRDVWAAGAKLADLLA

SEQ ID NO: 1263610 - protein, 17 aa, Mycobacterium
ERLALGFGSSTFRYAAP

SEQ ID NO: 1263611 - protein, 19 aa, Mycobacterium
ERLERGWRALGDRGGPLLV

SEQ ID NO: 1263612 - protein, 22 aa, Mycobacterium
ERLGEAFPALGEFFGSSLPSLT

SEQ ID NO: 1263613 - protein, 23 aa, Mycobacterium
ERLGLDYVDLYLIHWPAGDHGKY

SEQ ID NO: 1263614 - protein, 17 aa, Mycobacterium
ERLGLPALVNFTGATSI

SEQ ID NO: 1263615 - protein, 26 aa, Mycobacterium
ERLGWAVMLCDKWSPPRTFEAADLIE

SEQ ID NO: 1263616 - protein, 20 aa, Mycobacterium
ERLHLVLVFRSVGLPLEEIR

SEQ ID NO: 1263617 - protein, 18 aa, Mycobacterium
ERLKGLFMASFEAIATRH

SEQ ID NO: 1263618 - protein, 23 aa, Mycobacterium
ERLKRLQSLPGWSPEARRFDAAW

SEQ ID NO: 1263619 - protein, 22 aa, Mycobacterium
ERLKVAIQLLFESSRPDPAAKR

SEQ ID NO: 1263620 - protein, 22 aa, Mycobacterium
ERLLALGRRTAQRMTSATKNLD

SEQ ID NO: 1263621 - protein, 39 aa, Mycobacterium
ERLLGGGARRFADINARAGELLGELGLRPERHNDALMTF

SEQ ID NO: 1263622 - protein, 19 aa, Mycobacterium
ERLLPRLPCSVLAVKLDRL

SEQ ID NO: 1263623 - protein, 17 aa, Mycobacterium
ERLMRDAPFLLIGEGTS

SEQ ID NO: 1263624 - protein, 23 aa, Mycobacterium
ERLPAGAAMTIAVRYGGTPRPIR

SEQ ID NO: 1263625 - protein, 19 aa, Mycobacterium
ERLPVWKHQFFADGSDEWV

SEQ ID NO: 1263626 - protein, 19 aa, Mycobacterium
ERLSGSGLRVLRYGSTGTG

SEQ ID NO: 1263627 - protein, 24 aa, Mycobacterium
ERLTEGRFALFSGEADAARASASD

SEQ ID NO: 1263628 - protein, 17 aa, Mycobacterium
ERLTFDEAVGLQWGLVV

SEQ ID NO: 1263629 - protein, 21 aa, Mycobacterium
ERLTFDPAAFGFARAHVSELT

SEQ ID NO: 1263630 - protein, 20 aa, Mycobacterium
ERLTGRRVYGTLPWHPDLWL

SEQ ID NO: 1263631 - protein, 26 aa, Mycobacterium
ERLTRSWAGLKAMRSYALATMDVEQP

SEQ ID NO: 1263632 - protein, 25 aa, Mycobacterium
ERLVDLGIRLGPWGDDLGRRPEGLT

SEQ ID NO: 1263633 - protein, 35 aa, Mycobacterium
ERLYPQTAAELFSWGQSWLQICHNAFAGLGVDPDR

SEQ ID NO: 1263634 - protein, 21 aa, Mycobacterium
ERMGLAWKVCEPDDLLPEARR

SEQ ID NO: 1263635 - protein, 17 aa, Mycobacterium
ERMKRSWSPEQLAIVGT

SEQ ID NO: 1263636 - protein, 20 aa, Mycobacterium
ERMPEVAEALVIGAEQPDGG

SEQ ID NO: 1263637 - protein, 26 aa, Mycobacterium
ERMPGARLWMYTNFHCNLACDYCCVE

SEQ ID NO: 1263638 - protein, 24 aa, Mycobacterium
ERMPRRFYCRARWQTGGIDSETQV

SEQ ID NO: 1263639 - protein, 19 aa, Mycobacterium
ERMRARWVSFAAHGAPTGP

SEQ ID NO: 1263640 - protein, 20 aa, Mycobacterium
ERNAERWGLELATEEGKTRA

SEQ ID NO: 1263641 - protein, 20 aa, Mycobacterium
ERNFYALDRLWRDCPTVPVD

SEQ ID NO: 1263642 - protein, 26 aa, Mycobacterium
ERNGRPRIAGVSSFGFAGTNAHVILE

SEQ ID NO: 1263643 - protein, 25 aa, Mycobacterium
ERNLAWRAAELMADHVGRSPDVAIS

SEQ ID NO: 1263644 - protein, 20 aa, Mycobacterium
ERNRLALACEVFDGEAHPQA

SEQ ID NO: 1263645 - protein, 24 aa, Mycobacterium
ERNYREAIALSRLGWAALAVGTSH

SEQ ID NO: 1263646 - protein, 26 aa, Mycobacterium
ERPAPETPRAHVCVLASLNYPDISAE

SEQ ID NO: 1263647 - protein, 28 aa, Mycobacterium
ERPDLAILDVRMPPTFTDEGIRAAALLR

SEQ ID NO: 1263648 - protein, 34 aa, Mycobacterium
ERPEAAVDEIVRWATPVHCFQRTALADVELGGVT

SEQ ID NO: 1263649 - protein, 20 aa, Mycobacterium
ERPEPLVPRAMIRSVKERVN

SEQ ID NO: 1263650 - protein, 25 aa, Mycobacterium
ERPFPLDLVPRVISAAEWTRLERGI

SEQ ID NO: 1263651 - protein, 19 aa, Mycobacterium
ERPGAPALVVGDRTVTYGE

SEQ ID NO: 1263652 - protein, 19 aa, Mycobacterium
ERPIPGWLQVVGERQRILV

SEQ ID NO: 1263653 - protein, 19 aa, Mycobacterium
ERPNTPVWHRLQTDYLDNL

SEQ ID NO: 1263654 - protein, 21 aa, Mycobacterium
ERPRVRWKILDAWQNAAAQLG

SEQ ID NO: 1263655 - protein, 19 aa, Mycobacterium
ERPVGAGIGRVVDAPDALD

SEQ ID NO: 1263656 - protein, 17 aa, Mycobacterium
ERQDWHALLTVTLDGDV

SEQ ID NO: 1263657 - protein, 22 aa, Mycobacterium
ERQNLPLIVGRVHQARPDVDIL

SEQ ID NO: 1263658 - protein, 25 aa, Mycobacterium
ERQRARGGVGAGVLQGRRCGACRIE

SEQ ID NO: 1263659 - protein, 19 aa, Mycobacterium
ERQVRRWGSQWDLVRRADD

SEQ ID NO: 1263660 - protein, 20 aa, Mycobacterium
ERQVSFARDEENMWLVRDQQ

SEQ ID NO: 1263661 - protein, 26 aa, Mycobacterium
ERRARRDLYEALGFERYAGTRADRLS

SEQ ID NO: 1263662 - protein, 27 aa, Mycobacterium
ERRDKNWRPTMLWAYDPQAFDGKGRAA

SEQ ID NO: 1263663 - protein, 18 aa, Mycobacterium
ERRDVRVGAVDWWTCDDQ

SEQ ID NO: 1263664 - protein, 19 aa, Mycobacterium
ERRDVRVGAVDWWTCDDQV

SEQ ID NO: 1263665 - protein, 22 aa, Mycobacterium
ERRFANRRVDVMQKGQLLTTAM

SEQ ID NO: 1263666 - protein, 23 aa, Mycobacterium
ERRFARHYVHAGMIGWDGHKMSK

SEQ ID NO: 1263667 - protein, 20 aa, Mycobacterium
ERRFHGAPVPQEYIDRAQYE

SEQ ID NO: 1263668 - protein, 24 aa, Mycobacterium
ERRFQRVSYRWVPRAQNSRADRLA

SEQ ID NO: 1263669 - protein, 25 aa, Mycobacterium
ERRGECYRLGLPAGSVIDVVEFGAA

SEQ ID NO: 1263670 - protein, 20 aa, Mycobacterium
ERRKQICGRAYRILTEEVGF

SEQ ID NO: 1263671 - protein, 19 aa, Mycobacterium
ERRLAGAGLDVFADEPQVP

SEQ ID NO: 1263672 - protein, 24 aa, Mycobacterium
ERRLDMMLRIGAYGDAFGARPDGL

SEQ ID NO: 1263673 - protein, 21 aa, Mycobacterium
ERRLKGQLVELLRRRELSTAA

SEQ ID NO: 1263674 - protein, 21 aa, Mycobacterium
ERRLPLLEPLRYKLVEIPGRL

SEQ ID NO: 1263675 - protein, 19 aa, Mycobacterium
ERRSPVAFVVDGVHAHDVG

SEQ ID NO: 1263676 - protein, 20 aa, Mycobacterium
ERRTAVPIPEAIRAALTSLV

SEQ ID NO: 1263677 - protein, 22 aa, Mycobacterium
ERRTEGRFALFSTGEPETTDTG

SEQ ID NO: 1263678 - protein, 23 aa, Mycobacterium
ERRTNWLNNFYFGGEHGADGSIA

SEQ ID NO: 1263679 - protein, 18 aa, Mycobacterium
ERRTVVLVAPHRVYTNPG

SEQ ID NO: 1263680 - protein, 24 aa, Mycobacterium
ERRVREGLLDIGQKLGIPPLATND

SEQ ID NO: 1263681 - protein, 23 aa, Mycobacterium
ERRVTLQACRFAQVGSWQGWIEI

SEQ ID NO: 1263682 - protein, 20 aa, Mycobacterium
ERRYEEGWQRGGINALSAAF

SEQ ID NO: 1263683 - protein, 27 aa, Mycobacterium
ERSDELVCLTQLCPQLASAGMLTLGYG

SEQ ID NO: 1263684 - protein, 23 aa, Mycobacterium
ERSEFEGMKVWTLTPRKNATEKT

SEQ ID NO: 1263685 - protein, 22 aa, Mycobacterium
ERSEGDAFGRLILLHDPEGAEA

SEQ ID NO: 1263686 - protein, 17 aa, Mycobacterium
ERSGFAGGLAFYHNVDA

SEQ ID NO: 1263687 - protein, 26 aa, Mycobacterium
ERSLHFAMGLARGYSLAVVEGSTPLA

SEQ ID NO: 1263688 - protein, 22 aa, Mycobacterium
ERSSHTWFVLTHLLGKPGVRNY

SEQ ID NO: 1263689 - protein, 33 aa, Mycobacterium
ERSTCAPWLDAEWRLTAGHVRVIVALGGFAWQV

SEQ ID NO: 1263690 - protein, 33 aa, Mycobacterium
ERTDALVFGKLRLQFWVCGTFELNDAGQVTLWR

SEQ ID NO: 1263691 - protein, 23 aa, Mycobacterium
ERTELADRLIVKGAREHNLRSVD

SEQ ID NO: 1263692 - protein, 19 aa, Mycobacterium
ERTGIELTESMAMWPGAAV

SEQ ID NO: 1263693 - protein, 20 aa, Mycobacterium
ERTGNLWRAQGRRVRLELKH

SEQ ID NO: 1263694 - protein, 27 aa, Mycobacterium
ERTQWRPAAEIVRMLLERILGSLEAPA

SEQ ID NO: 1263695 - protein, 26 aa, Mycobacterium
ERTREFGDAIAPVLARVPSHRMSTVA

SEQ ID NO: 1263696 - protein, 23 aa, Mycobacterium
ERTREIAPLNGFRDLDTARLLDN

SEQ ID NO: 1263697 - protein, 21 aa, Mycobacterium
ERTRSLLLDAAEEVFAEKGFM

SEQ ID NO: 1263698 - protein, 24 aa, Mycobacterium
ERTVMTVEAWRAGSPTAPIQPEVI

SEQ ID NO: 1263699 - protein, 22 aa, Mycobacterium
ERTWPAVIRVARRLYDTGEATH

SEQ ID NO: 1263700 - protein, 18 aa, Mycobacterium
ERVAELLATVSLDQSYAA

SEQ ID NO: 1263701 - protein, 18 aa, Mycobacterium
ERVCAPLSALPIVMVPDR

SEQ ID NO: 1263702 - protein, 23 aa, Mycobacterium
ERVGPRGGPLYVLQSDFEKYGDN

SEQ ID NO: 1263703 - protein, 19 aa, Mycobacterium
ERVGQLLSLVERRMLLPDA

SEQ ID NO: 1263704 - protein, 19 aa, Mycobacterium
ERVLSCLTLAVSIDGAAVG

SEQ ID NO: 1263705 - protein, 26 aa, Mycobacterium
ERVLVHPRPRLSVMCVGGELVDISRT

SEQ ID NO: 1263706 - protein, 28 aa, Mycobacterium
ERVVRALRHGTVWLNDFGYYTAAAEWGG

SEQ ID NO: 1263707 - protein, 18 aa, Mycobacterium
ERYAPIPVVEVILPAVRR

SEQ ID NO: 1263708 - protein, 19 aa, Mycobacterium
ERYIPLAILPVWDIDATVA

SEQ ID NO: 1263709 - protein, 21 aa, Mycobacterium
ERYLDMFTFFASSALGMNHPA

SEQ ID NO: 1263710 - protein, 18 aa, Mycobacterium
ERYLPYAVGDGGEHTLNI

SEQ ID NO: 1263711 - protein, 28 aa, Mycobacterium
ERYPRARGLKGLRIALPLVDAGAASPKE

SEQ ID NO: 1263712 - protein, 29 aa, Mycobacterium
ERYPRARGLKGLRIALPLVDAGAASPKET

SEQ ID NO: 1263713 - protein, 22 aa, Mycobacterium
ERYPRDVRWTGVLADELGADYT

SEQ ID NO: 1263714 - protein, 25 aa, Mycobacterium
ERYREGPCLTAAWEERTVHVPDLER

SEQ ID NO: 1263715 - protein, 20 aa, Mycobacterium
ESAELRWVAEDEVADLPLHP

SEQ ID NO: 1263716 - protein, 23 aa, Mycobacterium
ESAHACGDPGLVFLDTVNRANPV

SEQ ID NO: 1263717 - protein, 20 aa, Mycobacterium
ESAIAFAGLRSVDWERAEPD

SEQ ID NO: 1263718 - protein, 24 aa, Mycobacterium
ESAKRLWCRLGDFAPSTDRISAAH

SEQ ID NO: 1263719 - protein, 21 aa, Mycobacterium
ESALARYPGPLLAQSVSPAIA

SEQ ID NO: 1263720 - protein, 18 aa, Mycobacterium
ESALPRQLFVKTQLSTVH

SEQ ID NO: 1263721 - protein, 17 aa, Mycobacterium
ESANRKLSIFGAEKTDD

SEQ ID NO: 1263722 - protein, 18 aa, Mycobacterium
ESANRKLSIFGAEKTDDT

SEQ ID NO: 1263723 - protein, 17 aa, Mycobacterium
ESAPEFTADGDLLFLAA

SEQ ID NO: 1263724 - protein, 19 aa, Mycobacterium
ESARALALDGAHIIAALSA

SEQ ID NO: 1263725 - protein, 23 aa, Mycobacterium
ESARARNVLSLKLNPQLIDELPL

SEQ ID NO: 1263726 - protein, 24 aa, Mycobacterium
ESARGTGLAGVMLDTLVDRVRRDR

SEQ ID NO: 1263727 - protein, 22 aa, Mycobacterium
ESARLRDDLGLLVEELQEAVDK

SEQ ID NO: 1263728 - protein, 29 aa, Mycobacterium
ESARRTGIRLRLFHGRGGTVGRGGGPSYD

SEQ ID NO: 1263729 - protein, 19 aa, Mycobacterium
ESASFTMAYTRVGLSPDGS

SEQ ID NO: 1263730 - protein, 29 aa, Mycobacterium
ESDLLVAECLRAGVWEGLDSAELAAALSA

SEQ ID NO: 1263731 - protein, 21 aa, Mycobacterium
ESDPWPGAGDHFAVRAGSLIA

SEQ ID NO: 1263732 - protein, 22 aa, Mycobacterium
ESELLWLDALRRDSDVTVPTVL

SEQ ID NO: 1263733 - protein, 24 aa, Mycobacterium
ESELPRAVFTGALYGDELAAAYAS

SEQ ID NO: 1263734 - protein, 24 aa, Mycobacterium
ESELRAMFELNFFAVLSVLRAALP

SEQ ID NO: 1263735 - protein, 18 aa, Mycobacterium
ESEPSMDSVLSWQPSTHT

SEQ ID NO: 1263736 - protein, 21 aa, Mycobacterium
ESETPGALVLKLRQEEPEAFT

SEQ ID NO: 1263737 - protein, 23 aa, Mycobacterium
ESEWNALNLFTGWVDVDLTEKGR

SEQ ID NO: 1263738 - protein, 30 aa, Mycobacterium
ESFARLRAGDGLSWHAPFPSLFPMEEPGYW

SEQ ID NO: 1263739 - protein, 27 aa, Mycobacterium
ESFEFWREFLASLKARGLSGVHLVISD

SEQ ID NO: 1263740 - protein, 20 aa, Mycobacterium
ESFGLPGLAAYCREAIHANA

SEQ ID NO: 1263741 - protein, 18 aa, Mycobacterium
ESFRDCQELMLAAYDDQF

SEQ ID NO: 1263742 - protein, 19 aa, Mycobacterium
ESFRGGWFHSGDLGYYDGH

SEQ ID NO: 1263743 - protein, 20 aa, Mycobacterium
ESFSSCVSVTGPFPGFPVSL

SEQ ID NO: 1263744 - protein, 19 aa, Mycobacterium
ESFTLRTNKTFQEQYLAAG

SEQ ID NO: 1263745 - protein, 23 aa, Mycobacterium
ESGCDLIEVGIAYSDPGMDGPTI

SEQ ID NO: 1263746 - protein, 23 aa, Mycobacterium
ESGEQVFLCPLELASFTLATPED

SEQ ID NO: 1263747 - protein, 18 aa, Mycobacterium
ESGIAWAGGSYVRRPVSV

SEQ ID NO: 1263748 - protein, 36 aa, Mycobacterium
ESGLRGFGGAGFRTGLKWRLCRAAPGEDKYVICNAD

SEQ ID NO: 1263749 - protein, 25 aa, Mycobacterium
ESGSTRLQQDWARPAIAGEKVLTIA

SEQ ID NO: 1263750 - protein, 17 aa, Mycobacterium
ESGTRLLVHESIHDEFV

SEQ ID NO: 1263751 - protein, 17 aa, Mycobacterium
ESGWTFDHFYPIFSDPS

SEQ ID NO: 1263752 - protein, 23 aa, Mycobacterium
ESGYEWIELGPYGYLPTDPAKLS

SEQ ID NO: 1263753 - protein, 24 aa, Mycobacterium
ESHARGGGELVEISMAAVAAGYAG

SEQ ID NO: 1263754 - protein, 24 aa, Mycobacterium
ESHLRFGPHPIRAPYLVTAANFIG

SEQ ID NO: 1263755 - protein, 18 aa, Mycobacterium
ESHLRLLLQNDGAERVTI

SEQ ID NO: 1263756 - protein, 17 aa, Mycobacterium
ESIAEWVKRQNLGSFTL

SEQ ID NO: 1263757 - protein, 22 aa, Mycobacterium
ESIRLGQFLKLANLIDTGADAK

SEQ ID NO: 1263758 - protein, 24 aa, Mycobacterium
ESIRRRARQGFAVRRVGPDKVAKA

SEQ ID NO: 1263759 - protein, 19 aa, Mycobacterium
ESITAVWPQAIIQTCVVHL

SEQ ID NO: 1263760 - protein, 22 aa, Mycobacterium
ESIYGWKEYELELMRDGHDNVV

SEQ ID NO: 1263761 - protein, 18 aa, Mycobacterium
ESLADFVKRQNLGSFTLG

SEQ ID NO: 1263762 - protein, 19 aa, Mycobacterium
ESLADRLAEAFAERMHERV

SEQ ID NO: 1263763 - protein, 19 aa, Mycobacterium
ESLCEDIHYLMPVRVTTAL

SEQ ID NO: 1263764 - protein, 21 aa, Mycobacterium
ESLMSLPSRVTRQIHRLEVQG

SEQ ID NO: 1263765 - protein, 24 aa, Mycobacterium
ESLPSGWVMLVAAWLAQAEAARGN

SEQ ID NO: 1263766 - protein, 18 aa, Mycobacterium
ESLQLGARAARAAHREFA

SEQ ID NO: 1263767 - protein, 24 aa, Mycobacterium
ESLQNFPFLIARLDQFSRSSELTA

SEQ ID NO: 1263768 - protein, 19 aa, Mycobacterium
ESLQRFQYAPLRFFPSQAH

SEQ ID NO: 1263769 - protein, 20 aa, Mycobacterium
ESLRPYLLSVAYRLTGSVTD

SEQ ID NO: 1263770 - protein, 24 aa, Mycobacterium
ESLRTLGLRKIRQSVVREDNAQTR

SEQ ID NO: 1263771 - protein, 17 aa, Mycobacterium
ESLSRLRDAGIKVALTT

SEQ ID NO: 1263772 - protein, 19 aa, Mycobacterium
ESLYTEFLERCGPGLHHVC

SEQ ID NO: 1263773 - protein, 17 aa, Mycobacterium
ESMAAALHFLRSESPMH

SEQ ID NO: 1263774 - protein, 18 aa, Mycobacterium
ESMPEFLAGYPPDRVAAI

SEQ ID NO: 1263775 - protein, 24 aa, Mycobacterium
ESMPRPESRAAIGAFVEGLSHGVP

SEQ ID NO: 1263776 - protein, 18 aa, Mycobacterium
ESNFALVVHLGMSGQMLL

SEQ ID NO: 1263777 - protein, 17 aa, Mycobacterium
ESPGEPLTCRHLQAILW

SEQ ID NO: 1263778 - protein, 22 aa, Mycobacterium
ESPGLMAALVSFWMHPDAVYLS

SEQ ID NO: 1263779 - protein, 19 aa, Mycobacterium
ESPHAPSLDGVRYTVLGIG

SEQ ID NO: 1263780 - protein, 25 aa, Mycobacterium
ESPQETWLRLFLIEEEFPRPSTQIP

SEQ ID NO: 1263781 - protein, 25 aa, Mycobacterium
ESPRETWLRLLVIRNGFPPPTTQIP

SEQ ID NO: 1263782 - protein, 25 aa, Mycobacterium
ESPYGATVAHGFLTLSLIPALSKDN

SEQ ID NO: 1263783 - protein, 17 aa, Mycobacterium
ESPYLAAVAGRKPLRVP

SEQ ID NO: 1263784 - protein, 17 aa, Mycobacterium
ESQCGWLKDRYGLSWQI

SEQ ID NO: 1263785 - protein, 20 aa, Mycobacterium
ESQVALRWAATEAQTSGRPV

SEQ ID NO: 1263786 - protein, 21 aa, Mycobacterium
ESQVALRWAATEAQTSGRPVT

SEQ ID NO: 1263787 - protein, 21 aa, Mycobacterium
ESRAAKAVLISAVPPIMVQTE

SEQ ID NO: 1263788 - protein, 25 aa, Mycobacterium
ESRARCFPKGLAAFIDLRDQTCRTP

SEQ ID NO: 1263789 - protein, 20 aa, Mycobacterium
ESRAVRKCVRSLGWTIDQYD

SEQ ID NO: 1263790 - protein, 18 aa, Mycobacterium
ESRGQWYLRQMLGSANFE

SEQ ID NO: 1263791 - protein, 25 aa, Mycobacterium
ESRLRRRLEHLAERWEAPRGPEAAP

SEQ ID NO: 1263792 - protein, 21 aa, Mycobacterium
ESRNYPAILAMTSLNDTRVYY

SEQ ID NO: 1263793 - protein, 30 aa, Mycobacterium
ESRRWSHLCDRLWLIAAIEHYTAVMGDFAL

SEQ ID NO: 1263794 - protein, 23 aa, Mycobacterium
ESRSRPGEGIVTFAHTGRNQHGD

SEQ ID NO: 1263795 - protein, 17 aa, Mycobacterium
ESRTFTGGHDWLADNGV

SEQ ID NO: 1263796 - protein, 19 aa, Mycobacterium
ESRTRLLLVKAGLPPERSQ

SEQ ID NO: 1263797 - protein, 25 aa, Mycobacterium
ESSAAFQAAHARFVEASAKINALLD

SEQ ID NO: 1263798 - protein, 25 aa, Mycobacterium
ESSGIIFEFWRAVRDGETWTTAFGA

SEQ ID NO: 1263799 - protein, 20 aa, Mycobacterium
ESSIVTALREQLRTQKQRYQ

SEQ ID NO: 1263800 - protein, 20 aa, Mycobacterium
ESSWLRHLVMQGARERYGPP

SEQ ID NO: 1263801 - protein, 18 aa, Mycobacterium
ESSWPLYPIRPGHTYVNV

SEQ ID NO: 1263802 - protein, 17 aa, Mycobacterium
ESTRFTALDGVGHIPMF

SEQ ID NO: 1263803 - protein, 19 aa, Mycobacterium
ESTWHRWIAQYGGMKANEA

SEQ ID NO: 1263804 - protein, 17 aa, Mycobacterium
ESVDLIKSGGFRIGAGE

SEQ ID NO: 1263805 - protein, 19 aa, Mycobacterium
ESVGFLFNVTVEAAPPAPS

SEQ ID NO: 1263806 - protein, 19 aa, Mycobacterium
ESVLPDEFFTDPLPTLAAG

SEQ ID NO: 1263807 - protein, 25 aa, Mycobacterium
ESVPKPRVEQAFAMVDDADVLLVAG

SEQ ID NO: 1263808 - protein, 27 aa, Mycobacterium
ESVPVDSWRIHRCIGMDGTTLVRALAG

SEQ ID NO: 1263809 - protein, 24 aa, Mycobacterium
ESVRRLRTRLARIWEAADDETRAV

SEQ ID NO: 1263810 - protein, 21 aa, Mycobacterium
ESVYAMAVLFAMDRAGARDEI

SEQ ID NO: 1263811 - protein, 21 aa, Mycobacterium
ESWQLLGSVALGRLVTTVNGW

SEQ ID NO: 1263812 - protein, 26 aa, Mycobacterium
ESYANRFGYNVVRDFTGHGIGTTFHN

SEQ ID NO: 1263813 - protein, 19 aa, Mycobacterium
ESYLCVGVRTATPGPVSDY

SEQ ID NO: 1263814 - protein, 21 aa, Mycobacterium
ESYRNLLVAPYGVRKGIIERI

SEQ ID NO: 1263815 - protein, 22 aa, Mycobacterium
ETAAVTVCYMGVNGRDGSVFDS

SEQ ID NO: 1263816 - protein, 19 aa, Mycobacterium
ETASLLAPLPGARDLLRRV

SEQ ID NO: 1263817 - protein, 24 aa, Mycobacterium
ETATKFYTALGFTEVKRLTVPDQV

SEQ ID NO: 1263818 - protein, 26 aa, Mycobacterium
ETATWPDCRPLVQWLVGRLPDGGDLH

SEQ ID NO: 1263819 - protein, 25 aa, Mycobacterium
ETDDPFWSGLRLRDALADVDVPVLL

SEQ ID NO: 1263820 - protein, 23 aa, Mycobacterium
ETDHLRLVGLHSHIGSQIFDVAG

SEQ ID NO: 1263821 - protein, 27 aa, Mycobacterium
ETDKPFLMPVEDVFTITGRGTVVTGRV

SEQ ID NO: 1263822 - protein, 24 aa, Mycobacterium
ETDVYWCTADIGWVTGHTYIVYGP

SEQ ID NO: 1263823 - protein, 17 aa, Mycobacterium
ETEFRRELRACPADERG

SEQ ID NO: 1263824 - protein, 20 aa, Mycobacterium
ETEIMLSLVVADQMAQDRVF

SEQ ID NO: 1263825 - protein, 20 aa, Mycobacterium
ETEREWAFDHARQLASDRPG

SEQ ID NO: 1263826 - protein, 23 aa, Mycobacterium
ETFARAYLEQVQWFRQVDDDSSF

SEQ ID NO: 1263827 - protein, 17 aa, Mycobacterium
ETFGRIKIEGICESGLG

SEQ ID NO: 1263828 - protein, 25 aa, Mycobacterium
ETFPARLQRGAGVPAVERLAYFAEG

SEQ ID NO: 1263829 - protein, 17 aa, Mycobacterium
ETFPFPFAADEYRYSTN

SEQ ID NO: 1263830 - protein, 30 aa, Mycobacterium
ETFQWPRITGTFNWATDWFDAVARDNDGVA

SEQ ID NO: 1263831 - protein, 18 aa, Mycobacterium
ETFRARAVILAMGAAARH

SEQ ID NO: 1263832 - protein, 24 aa, Mycobacterium
ETGDEFPLLPGTMYLLDGHERHRV

SEQ ID NO: 1263833 - protein, 18 aa, Mycobacterium
ETGSCGTCMARIVEGSAR

SEQ ID NO: 1263834 - protein, 17 aa, Mycobacterium
ETHCTKCGHELIRPESR

SEQ ID NO: 1263835 - protein, 21 aa, Mycobacterium
ETHPVPEWIVVGAGTGGTSAT

SEQ ID NO: 1263836 - protein, 33 aa, Mycobacterium
ETIGQHRICWARTAGVCALPVWFDATTVRPPRD

SEQ ID NO: 1263837 - protein, 28 aa, Mycobacterium
ETIIARMLAVMLRRRMVSAGMDTGGAEP

SEQ ID NO: 1263838 - protein, 34 aa, Mycobacterium
ETKQALTEAVLWPLQHPDTFERLGIEPPRGVLLY

SEQ ID NO: 1263839 - protein, 23 aa, Mycobacterium
ETKSKMALMAHALKRGYRHLGEV

SEQ ID NO: 1263840 - protein, 19 aa, Mycobacterium
ETLAVVNLMSMFGLHRRLR

SEQ ID NO: 1263841 - protein, 21 aa, Mycobacterium
ETLCGFGKFGVESTKQVLWAN

SEQ ID NO: 1263842 - protein, 17 aa, Mycobacterium
ETLEFAPGLNVVHGPNE

SEQ ID NO: 1263843 - protein, 20 aa, Mycobacterium
ETLLCSPFVLLGTHEQMAEQ

SEQ ID NO: 1263844 - protein, 18 aa, Mycobacterium
ETLLRAWRHPEVTADVDR

SEQ ID NO: 1263845 - protein, 17 aa, Mycobacterium
ETLLRLPVDGILFAVEW

SEQ ID NO: 1263846 - protein, 30 aa, Mycobacterium
ETLRGGAIHAKWEALGGMNSYLGRPTSPEA

SEQ ID NO: 1263847 - protein, 34 aa, Mycobacterium
ETLSCAHAVVATGGYPIPVLPSFAGALAPSVTQI

SEQ ID NO: 1263848 - protein, 24 aa, Mycobacterium
ETLSFPEILALAAEALRIKSETDG

SEQ ID NO: 1263849 - protein, 20 aa, Mycobacterium
ETLSPFAEKMIEVLWAGTPH

SEQ ID NO: 1263850 - protein, 20 aa, Mycobacterium
ETLTTLVIRGEGGFGGRPGQ

SEQ ID NO: 1263851 - protein, 26 aa, Mycobacterium
ETLVALGAEVRWASCNIFSTQDHAAA

SEQ ID NO: 1263852 - protein, 17 aa, Mycobacterium
ETMASFMLVEHANGAMF

SEQ ID NO: 1263853 - protein, 24 aa, Mycobacterium
ETMDVCFELATKLVAAMGAITVVD

SEQ ID NO: 1263854 - protein, 17 aa, Mycobacterium
ETMGFYSISFVETDDEC

SEQ ID NO: 1263855 - protein, 19 aa, Mycobacterium
ETMPARAAAITAPLLIVHG

SEQ ID NO: 1263856 - protein, 25 aa, Mycobacterium
ETMVKAYSGFRSFREGTNLKAWLYR

SEQ ID NO: 1263857 - protein, 20 aa, Mycobacterium
ETPACFEPTLDYVVVKAPRF

SEQ ID NO: 1263858 - protein, 23 aa, Mycobacterium
ETPEEMLEVFTPINDAAGALGEL

SEQ ID NO: 1263859 - protein, 24 aa, Mycobacterium
ETPLLATAPLYWGGSDIERSHLLA

SEQ ID NO: 1263860 - protein, 19 aa, Mycobacterium
ETREIWSYGSGYGGNALLG

SEQ ID NO: 1263861 - protein, 35 aa, Mycobacterium
ETRLKAIDSELGWSRDVWKQLAEVGVLGLGFDEDA

SEQ ID NO: 1263862 - protein, 31 aa, Mycobacterium
ETRPKEFAKVLAPLHRLVADILRRGIDEGTF

SEQ ID NO: 1263863 - protein, 21 aa, Mycobacterium
ETRTGDIWLFRGRSGPDRAIQ

SEQ ID NO: 1263864 - protein, 24 aa, Mycobacterium
ETRVRAHVTFARYHLGGNGAATGG

SEQ ID NO: 1263865 - protein, 24 aa, Mycobacterium
ETSDRIGGNWAFGNPNGHSSAYRS

SEQ ID NO: 1263866 - protein, 26 aa, Mycobacterium
ETSHEGVDWLLARDELPDMVFEATSA

SEQ ID NO: 1263867 - protein, 23 aa, Mycobacterium
ETTARLALEQGKAALEVNWPYVL

SEQ ID NO: 1263868 - protein, 21 aa, Mycobacterium
ETTGATALWALHPTYYGTTGD

SEQ ID NO: 1263869 - protein, 18 aa, Mycobacterium
ETTLEFSNVVTRVHEDPR

SEQ ID NO: 1263870 - protein, 24 aa, Mycobacterium
ETTRARVPLPLNIIGMNNIAPAII

SEQ ID NO: 1263871 - protein, 21 aa, Mycobacterium
ETTTRLIGWAGKTLADYPEQR

SEQ ID NO: 1263872 - protein, 23 aa, Mycobacterium
ETTWQTPTGWVIVRDALVMGPWH

SEQ ID NO: 1263873 - protein, 23 aa, Mycobacterium
ETTWVPGSPWLAGIDPAVVGDPL

SEQ ID NO: 1263874 - protein, 31 aa, Mycobacterium
ETVLHEMAHMWFGDLVTMQWWDDLWLNESFA

SEQ ID NO: 1263875 - protein, 18 aa, Mycobacterium
ETVLRDRLLVDLIHEAFR

SEQ ID NO: 1263876 - protein, 23 aa, Mycobacterium
ETVPGRWALTREGGHTRRRIIHS

SEQ ID NO: 1263877 - protein, 23 aa, Mycobacterium
ETVRRYLRFGGSLTGDIVYYQLL

SEQ ID NO: 1263878 - protein, 29 aa, Mycobacterium
ETVVGYEALARWPALNGMNPEEVFDRAQR

SEQ ID NO: 1263879 - protein, 27 aa, Mycobacterium
ETVWLTPEPRYSWGLGSCELPAYAEFC

SEQ ID NO: 1263880 - protein, 23 aa, Mycobacterium
ETYLRAWKSFKGFQGKSSVRTWL

SEQ ID NO: 1263881 - protein, 19 aa, Mycobacterium
EVAAAAPAHTLCWPDTAVD

SEQ ID NO: 1263882 - protein, 26 aa, Mycobacterium
EVADGWSRLATALALTGADVGQRVAS

SEQ ID NO: 1263883 - protein, 24 aa, Mycobacterium
EVADRICALYLGRVAAEVKASEVS

SEQ ID NO: 1263884 - protein, 22 aa, Mycobacterium
EVAEAIAAGSAERERAGAVLTP

SEQ ID NO: 1263885 - protein, 26 aa, Mycobacterium
EVAEAVEFLLSPRASFITAQTLLVDG

SEQ ID NO: 1263886 - protein, 22 aa, Mycobacterium
EVAEFCRELADSAAIAVTPRTE

SEQ ID NO: 1263887 - protein, 38 aa, Mycobacterium; identical to SEQ ID NO: 656567

SEQ ID NO: 1263888 - protein, 19 aa, Mycobacterium
EVAERAGAIALQTRQRIAG

SEQ ID NO: 1263889 - protein, 19 aa, Mycobacterium
EVAERSGAVVLELAGSEFH

SEQ ID NO: 1263890 - protein, 21 aa, Mycobacterium
EVAESRFLLFPTVAHSHAERV

SEQ ID NO: 1263891 - protein, 18 aa, Mycobacterium
EVAFVVPVPHRFLPAFPP

SEQ ID NO: 1263892 - protein, 23 aa, Mycobacterium
EVAGAWDAVYWMMARTLIELERN

SEQ ID NO: 1263893 - protein, 18 aa, Mycobacterium
EVAGFDASVVLNRKDFGI

SEQ ID NO: 1263894 - protein, 18 aa, Mycobacterium
EVAGYRLPAGVMVVPGIG

SEQ ID NO: 1263895 - protein, 29 aa, Mycobacterium
EVAKLWPFADLTPFAAFGWEARGGYGDAY

SEQ ID NO: 1263896 - protein, 22 aa, Mycobacterium
EVAKMLAAEGARVAVMARTKTD

SEQ ID NO: 1263897 - protein, 24 aa, Mycobacterium
EVALSLPLGAGRLTREWLPDDPPG

SEQ ID NO: 1263898 - protein, 24 aa, Mycobacterium
EVARCGVRLPARRLSAPRLRAAVQ

SEQ ID NO: 1263899 - protein, 17 aa, Mycobacterium
EVARFARRHLAGTQRWC

SEQ ID NO: 1263900 - protein, 27 aa, Mycobacterium
EVASAFKAELVKGVPIGRLGRPEEVAA

SEQ ID NO: 1263901 - protein, 24 aa, Mycobacterium
EVASYLVSAAMGWNVVPYTIIRDG

SEQ ID NO: 1263902 - protein, 26 aa, Mycobacterium
EVAVNFPLYVIMSLLGIPESDFQRML

SEQ ID NO: 1263903 - protein, 25 aa, Mycobacterium
EVCNFAYKDMERWGDAMFVTPGVVI

SEQ ID NO: 1263904 - protein, 34 aa, Mycobacterium
EVDADRVAAIGFCFGGLCVLDLARAGHPLVGVAS

SEQ ID NO: 1263905 - protein, 19 aa, Mycobacterium
EVDAGSKAVDWGYLTVEPE

SEQ ID NO: 1263906 - protein, 18 aa, Mycobacterium
EVDARARRLAGFLTGRGL

SEQ ID NO: 1263907 - protein, 18 aa, Mycobacterium
EVDRRPGDVLAEVQSLVD

SEQ ID NO: 1263908 - protein, 27 aa, Mycobacterium
EVDRVFAGKVWGAWHLSEAAADLQLDF

SEQ ID NO: 1263909 - protein, 18 aa, Mycobacterium
EVDVRPRNVVVLAPGTIP

SEQ ID NO: 1263910 - protein, 21 aa, Mycobacterium
EVDYLKPFWDTHPEDRADLRR

SEQ ID NO: 1263911 - protein, 30 aa, Mycobacterium
EVEAIREWLHREGTCLLLAPHHDVGFTDDL

SEQ ID NO: 1263912 - protein, 19 aa, Mycobacterium
EVECSCVGLTPGQPYTTRQ

SEQ ID NO: 1263913 - protein, 20 aa, Mycobacterium
EVEFSASIFEFYADHAAALL

SEQ ID NO: 1263914 - protein, 25 aa, Mycobacterium
EVEGGKIRVAEGWAHGPEIDKGARW

SEQ ID NO: 1263915 - protein, 20 aa, Mycobacterium
EVELWFRRDAARRAVAETTV

SEQ ID NO: 1263916 - protein, 18 aa, Mycobacterium
EVEQRLGPLDVMVNNAGI

SEQ ID NO: 1263917 - protein, 24 aa, Mycobacterium
EVERRRELSGGKRSFILVPGIDVP

SEQ ID NO: 1263918 - protein, 28 aa, Mycobacterium
EVESKLPVPIHVGGGYGGDSDWLHGVWK

SEQ ID NO: 1263919 - protein, 29 aa, Mycobacterium
EVEVLKLSALRGLFSAVIEHPVTFVNAPA

SEQ ID NO: 1263920 - protein, 21 aa, Mycobacterium
EVEVRRSRRLVISMICTVGNY

SEQ ID NO: 1263921 - protein, 23 aa, Mycobacterium
EVFDVAQALGCRYSIGLYSSSGA

SEQ ID NO: 1263922 - protein, 18 aa, Mycobacterium
EVFFNCIGPTPARGDEPP

SEQ ID NO: 1263923 - protein, 21 aa, Mycobacterium
EVFGASSLIVRCADFEELRTV

SEQ ID NO: 1263924 - protein, 25 aa, Mycobacterium
EVFGERGRPGFLFDRLAADGTVHAH

SEQ ID NO: 1263925 - protein, 19 aa, Mycobacterium
EVFGPVLVLLPFDDDDHAV

SEQ ID NO: 1263926 - protein, 23 aa, Mycobacterium
EVFGSSSLIVRCADFEQMRAVAE

SEQ ID NO: 1263927 - protein, 19 aa, Mycobacterium
EVFRRNCWVSPFWEGSVAD

SEQ ID NO: 1263928 - protein, 19 aa, Mycobacterium
EVFSSRIAYDDMISPVPLV

SEQ ID NO: 1263929 - protein, 19 aa, Mycobacterium
EVFTDCLRDGFDEVLALAD

SEQ ID NO: 1263930 - protein, 19 aa, Mycobacterium
EVFVDRGYHAAGMDEIADR

SEQ ID NO: 1263931 - protein, 28 aa, Mycobacterium
EVGEIVYLGPLVMKEYWNKAAETAEAFR

SEQ ID NO: 1263932 - protein, 21 aa, Mycobacterium
EVGEKLGAAAHRVLRGRGVDV

SEQ ID NO: 1263933 - protein, 17 aa, Mycobacterium
EVGELAGALDEDFDGMR

SEQ ID NO: 1263934 - protein, 19 aa, Mycobacterium
EVGEPRLPQIPATDEQVEE

SEQ ID NO: 1263935 - protein, 21 aa, Mycobacterium
EVGFRSALRNCGRTIVEVSDS

SEQ ID NO: 1263936 - protein, 22 aa, Mycobacterium
EVGHKLPELQIYGDPTFIVSTA

SEQ ID NO: 1263937 - protein, 24 aa, Mycobacterium
EVGQDHPHEFIAMCPVSLREDGDS

SEQ ID NO: 1263938 - protein, 17 aa, Mycobacterium
EVGRKALDIYLNLANYL

SEQ ID NO: 1263939 - protein, 18 aa, Mycobacterium
EVGVRIWIHPSHRKQGYG

SEQ ID NO: 1263940 - protein, 25 aa, Mycobacterium
EVHRYEVVDLLTLLVDKSLLIAENT

SEQ ID NO: 1263941 - protein, 26 aa, Mycobacterium
EVHWVAPAEAVWACRTLAATHYASGG

SEQ ID NO: 1263942 - protein, 19 aa, Mycobacterium
EVIAAALQRTADLWLEHGP

SEQ ID NO: 1263943 - protein, 25 aa, Mycobacterium
EVIHSVVASGAWPSAELIEGGPTRD

SEQ ID NO: 1263944 - protein, 18 aa, Mycobacterium
EVILHLPEEVRLVSLSAT

SEQ ID NO: 1263945 - protein, 26 aa, Mycobacterium
EVIVDALGALVFWRLIALGKPVSARH

SEQ ID NO: 1263946 - protein, 19 aa, Mycobacterium
EVKAEFVVVAGDVFEHNQL

SEQ ID NO: 1263947 - protein, 24 aa, Mycobacterium
EVKAMYPIGPVFHGSGLNITVMSL

SEQ ID NO: 1263948 - protein, 25 aa, Mycobacterium
EVKKWLAEVLPNFPAYSHLVGNFDV

SEQ ID NO: 1263949 - protein, 22 aa, Mycobacterium
EVKPFVAGPVATDWLTAVQQAV

SEQ ID NO: 1263950 - protein, 18 aa, Mycobacterium
EVKRRDRALLSKDATIRE

SEQ ID NO: 1263951 - protein, 22 aa, Mycobacterium
EVLAQREFGRPFDLGAESPLRI

SEQ ID NO: 1263952 - protein, 19 aa, Mycobacterium
EVLARLSGYPQFDGAAFCE

SEQ ID NO: 1263953 - protein, 20 aa, Mycobacterium
EVLEGRFGINLADLGDRAEL

SEQ ID NO: 1263954 - protein, 17 aa, Mycobacterium
EVLFCPDQFLGAHVRRV

SEQ ID NO: 1263955 - protein, 27 aa, Mycobacterium
EVLGAGIPLFGICFGNQILGRALGLST

SEQ ID NO: 1263956 - protein, 17 aa, Mycobacterium
EVLGEAEAAEAIPFFEL

SEQ ID NO: 1263957 - protein, 30 aa, Mycobacterium; identical to SEQ ID NO: 656849

SEQ ID NO: 1263958 - protein, 20 aa, Mycobacterium
EVLPDPSLLELGRINRSLRG

SEQ ID NO: 1263959 - protein, 17 aa, Mycobacterium
EVLRCLPPRATLSEAHF

SEQ ID NO: 1263960 - protein, 20 aa, Mycobacterium
EVLRDALARRGIDIVPAMTK

SEQ ID NO: 1263961 - protein, 22 aa, Mycobacterium
EVLRILRRRSLAALRAQIEPVS

SEQ ID NO: 1263962 - protein, 27 aa, Mycobacterium
EVLRVVKFWVSHGVKVFRVDNPHTKPP

SEQ ID NO: 1263963 - protein, 23 aa, Mycobacterium
EVLSECMHIFGGAGYLVDETPLG

SEQ ID NO: 1263964 - protein, 20 aa, Mycobacterium
EVLSQLGARIQHALRAFTPD

SEQ ID NO: 1263965 - protein, 20 aa, Mycobacterium
EVMLPFCAACAKPLELEQDI

SEQ ID NO: 1263966 - protein, 22 aa, Mycobacterium
EVMPEDLIKFGLIPEFIGRLPV

SEQ ID NO: 1263967 - protein, 18 aa, Mycobacterium
EVMRSRLAPGGLIVDGTC

SEQ ID NO: 1263968 - protein, 20 aa, Mycobacterium
EVPAELAALAGRDEDRDVDV

SEQ ID NO: 1263969 - protein, 21 aa, Mycobacterium
EVPAELSAPLLTSAVVLVVCV

SEQ ID NO: 1263970 - protein, 18 aa, Mycobacterium
EVPARVLVVDALPRGAAL

SEQ ID NO: 1263971 - protein, 24 aa, Mycobacterium
EVPDTLECLARVVGDGGSHHEAAR

SEQ ID NO: 1263972 - protein, 19 aa, Mycobacterium
EVPEGAIVVFSAHGVAPTV

SEQ ID NO: 1263973 - protein, 23 aa, Mycobacterium
EVPEHLVVIGGSYIALEFAQMYR

SEQ ID NO: 1263974 - protein, 27 aa, Mycobacterium
EVPGAMARLGVWSGRGPQLDLHQPTFD

SEQ ID NO: 1263975 - protein, 17 aa, Mycobacterium
EVPIRFLSVIAFPDSQV

SEQ ID NO: 1263976 - protein, 24 aa, Mycobacterium
EVPPDEAYEAWSVSGPNGALVVCT

SEQ ID NO: 1263977 - protein, 20 aa, Mycobacterium
EVQRLIRFMPKPVICLVNGW

SEQ ID NO: 1263978 - protein, 25 aa, Mycobacterium
EVQTGIARTGAWFACEHDGIVPDLI

SEQ ID NO: 1263979 - protein, 27 aa, Mycobacterium
EVQVGYGRLGEWFWGFQQQDAVPDIVS

SEQ ID NO: 1263980 - protein, 20 aa, Mycobacterium
EVREALPRAEIVELGENDDV

SEQ ID NO: 1263981 - protein, 21 aa, Mycobacterium
EVRGAEVVDLLTALNTGHDGG

SEQ ID NO: 1263982 - protein, 18 aa, Mycobacterium
EVRGHVVVNATGVWTDEI

SEQ ID NO: 1263983 - protein, 20 aa, Mycobacterium
EVRGPRELGQLANLLQANGY

SEQ ID NO: 1263984 - protein, 23 aa, Mycobacterium
EVRPLRGGFTINVLAEQIVNGDV

SEQ ID NO: 1263985 - protein, 24 aa, Mycobacterium
EVRRFARERSRWIFSNPDMIHLSM

SEQ ID NO: 1263986 - protein, 40 aa, Mycobacterium
EVRRIALGFPEAFEKVSWGRPVFCAPKMFAMYGGSVKGAT

SEQ ID NO: 1263987 - protein, 19 aa, Mycobacterium
EVRRPRIPINATVPAVAAH

SEQ ID NO: 1263988 - protein, 24 aa, Mycobacterium
EVRRSELLVLLGLSGSGKSTLLRC

SEQ ID NO: 1263989 - protein, 25 aa, Mycobacterium
EVRRYILECALRWMRDFHADGLRLD

SEQ ID NO: 1263990 - protein, 19 aa, Mycobacterium
EVRTFSGLIERFGSGKGCD

SEQ ID NO: 1263991 - protein, 19 aa, Mycobacterium
EVRTWIWKTMTSFPGSYMT

SEQ ID NO: 1263992 - protein, 23 aa, Mycobacterium
EVRTWIWKTMTSFPGSYMTAFPS

SEQ ID NO: 1263993 - protein, 23 aa, Mycobacterium
EVRVPDARIQPIAADDVAAEVFR

SEQ ID NO: 1263994 - protein, 23 aa, Mycobacterium
EVRVPKNALWRAQTQRAVENFPI

SEQ ID NO: 1263995 - protein, 17 aa, Mycobacterium
EVRWGHRMAECEETADG

SEQ ID NO: 1263996 - protein, 21 aa, Mycobacterium
EVSAPVIVVGLGLNVSFTADE

SEQ ID NO: 1263997 - protein, 23 aa, Mycobacterium
EVSDGLPVTSLWLDAAEDGEVVR

SEQ ID NO: 1263998 - protein, 20 aa, Mycobacterium
EVSEIPRLIEDYRRATRNAR

SEQ ID NO: 1263999 - protein, 22 aa, Mycobacterium
EVSFKDGWHVQGLKGTGSYDYS

SEQ ID NO: 1264000 - protein, 18 aa, Mycobacterium
EVSHLIRQRERVMSRLDE

SEQ ID NO: 1264001 - protein, 19 aa, Mycobacterium
EVSHRGMLVLVHQLHEEGR

SEQ ID NO: 1264002 - protein, 20 aa, Mycobacterium
EVSPDFVISSAFQGNSAVHR

SEQ ID NO: 1264003 - protein, 23 aa, Mycobacterium
EVSPHPLLGYAIKDTLAGTHHHS

SEQ ID NO: 1264004 - protein, 19 aa, Mycobacterium
EVSRPSLLGDYRDAARYGA

SEQ ID NO: 1264005 - protein, 21 aa, Mycobacterium
EVTAACLDRGLHMNIVQLPGM

SEQ ID NO: 1264006 - protein, 28 aa, Mycobacterium
EVTAGSDLDWWVGFSSIVSLLGSPGQAA

SEQ ID NO: 1264007 - protein, 17 aa, Mycobacterium
EVTCALGRREGADLLLE

SEQ ID NO: 1264008 - protein, 22 aa, Mycobacterium
EVTECLRLMVRHRLSIDHPGYD

SEQ ID NO: 1264009 - protein, 33 aa, Mycobacterium
EVTELKPAFEWLQQIPVLGRFVVTPIVHLIHAI

SEQ ID NO: 1264010 - protein, 21 aa, Mycobacterium
EVTGVPILFASAGEKLEDFDV

SEQ ID NO: 1264011 - protein, 17 aa, Mycobacterium
EVTGWLPRTQALAELAR

SEQ ID NO: 1264012 - protein, 28 aa, Mycobacterium
EVTVIVAPMFHAWGFGQLVFAAMMACTI

SEQ ID NO: 1264013 - protein, 19 aa, Mycobacterium
EVVAAHLVNLCWNGLTHLE

SEQ ID NO: 1264014 - protein, 23 aa, Mycobacterium
EVVARAGASLDIVVLPKVTDASH

SEQ ID NO: 1264015 - protein, 24 aa, Mycobacterium
EVVARLKPGIILCREKGDATSANL

SEQ ID NO: 1264016 - protein, 20 aa, Mycobacterium
EVVARPAGLLLALSGTSLTD

SEQ ID NO: 1264017 - protein, 17 aa, Mycobacterium
EVVEALAAFIVEGIDRL

SEQ ID NO: 1264018 - protein, 25 aa, Mycobacterium
EVVESLRPMMRLVVTNGTAEDLQGA

SEQ ID NO: 1264019 - protein, 18 aa, Mycobacterium
EVVGFHLNRGVLASASRP

SEQ ID NO: 1264020 - protein, 19 aa, Mycobacterium
EVVIHGWDVAVATGQNYDC

SEQ ID NO: 1264021 - protein, 24 aa, Mycobacterium
EVVKEIKAAGGRAVANYDSVAEPE

SEQ ID NO: 1264022 - protein, 18 aa, Mycobacterium
EVVKSLRAGLAKRQWFRP

SEQ ID NO: 1264023 - protein, 18 aa, Mycobacterium
EVVRRLRAAGAVIVGKTN

SEQ ID NO: 1264024 - protein, 27 aa, Mycobacterium
EVVTCQPFAGSAPRFADPAADRASGAA

SEQ ID NO: 1264025 - protein, 24 aa, Mycobacterium
EVVVCGRLKDVIIMAGRNIYPTDI

SEQ ID NO: 1264026 - protein, 20 aa, Mycobacterium
EVYDYLRLLYARAGMPHCPV

SEQ ID NO: 1264027 - protein, 35 aa, Mycobacterium; identical to SEQ ID NO: 657147

SEQ ID NO: 1264028 - protein, 24 aa, Mycobacterium
EVYVLRPCIVAGPKATALADAMPW

SEQ ID NO: 1264029 - protein, 19 aa, Mycobacterium
EWAASRWGTAYFLPALFAD

SEQ ID NO: 1264030 - protein, 25 aa, Mycobacterium
EWAEGRRYLGLDILARCRLTTITND

SEQ ID NO: 1264031 - protein, 24 aa, Mycobacterium
EWAESRRYLGLDVLSKSRADQNST

SEQ ID NO: 1264032 - protein, 18 aa, Mycobacterium
EWALKPGTVTSWHPTPAA

SEQ ID NO: 1264033 - protein, 29 aa, Mycobacterium
EWDAVIAVHLRGHFLLTRNAATYWRSKAK

SEQ ID NO: 1264034 - protein, 20 aa, Mycobacterium
EWDECLHKAASIVGPCSPAP

SEQ ID NO: 1264035 - protein, 19 aa, Mycobacterium
EWDRICGSLSHQRCSAAHP

SEQ ID NO: 1264036 - protein, 20 aa, Mycobacterium
EWDSAAPAGVLWAAGMHASR

SEQ ID NO: 1264037 - protein, 30 aa, Mycobacterium
EWDVYRGGYRQDWCRVIDFPVTAAAGATVA

SEQ ID NO: 1264038 - protein, 18 aa, Mycobacterium
EWEECLHKAAPIVNAVPV

SEQ ID NO: 1264039 - protein, 19 aa, Mycobacterium
EWEKACAWDPETNSRRRYP

SEQ ID NO: 1264040 - protein, 17 aa, Mycobacterium
EWGICGVGVLPGDRKMA

SEQ ID NO: 1264041 - protein, 18 aa, Mycobacterium
EWGRAMAARARRPVTVST

SEQ ID NO: 1264042 - protein, 20 aa, Mycobacterium
EWKHLVRFAFCKREDTLDEA

SEQ ID NO: 1264043 - protein, 18 aa, Mycobacterium
EWLIPRVLNDCFKVHISE

SEQ ID NO: 1264044 - protein, 23 aa, Mycobacterium
EWLPREKYIGLIMVPGRSTHVQS

SEQ ID NO: 1264045 - protein, 19 aa, Mycobacterium
EWLRAVSVGPTFDTPPATI

SEQ ID NO: 1264046 - protein, 18 aa, Mycobacterium
EWLSAKRYDAVLIGAGVR

SEQ ID NO: 1264047 - protein, 24 aa, Mycobacterium
EWMLDIRLKALRTFDKKPMPNWGS

SEQ ID NO: 1264048 - protein, 22 aa, Mycobacterium
EWMNRPHLAEAWEYDRPVEWWH

SEQ ID NO: 1264049 - protein, 27 aa, Mycobacterium
EWRRGSLPPGRLGWRKAQEIASRSAAL

SEQ ID NO: 1264050 - protein, 36 aa, Mycobacterium
EWRTLLHGWPGVRARELVKLSGRIARRGAVDRFDPR

SEQ ID NO: 1264051 - protein, 19 aa, Mycobacterium
EWTVITGIAGEAWAGAADK

SEQ ID NO: 1264052 - protein, 29 aa, Mycobacterium
EYADAGIGFSCLWPETYIATSAVSNLADG

SEQ ID NO: 1264053 - protein, 25 aa, Mycobacterium
EYAKAWFKLLHRDMGPVQRYLGPLV

SEQ ID NO: 1264054 - protein, 27 aa, Mycobacterium
EYARPGLRETGFWRFVSDPGDPEESQA

SEQ ID NO: 1264055 - protein, 24 aa, Mycobacterium
EYAVDRFGGLDVMMNNAGISGRMQ

SEQ ID NO: 1264056 - protein, 23 aa, Mycobacterium
EYDAAWAEVRREVAAESRTEARE

SEQ ID NO: 1264057 - protein, 17 aa, Mycobacterium
EYELELMRDGHDNVVVV

SEQ ID NO: 1264058 - protein, 26 aa, Mycobacterium
EYLGHLRESMAFHRWLIERALSEDNP

SEQ ID NO: 1264059 - protein, 19 aa, Mycobacterium
EYLLLGLRFDRVEEGYVDS

SEQ ID NO: 1264060 - protein, 18 aa, Mycobacterium
EYLPPGHPPAVDMLIDVA

SEQ ID NO: 1264061 - protein, 18 aa, Mycobacterium
EYLRGIESTYPLSYGPQS

SEQ ID NO: 1264062 - protein, 19 aa, Mycobacterium
EYLSGEWAKAYGFPDMPVD

SEQ ID NO: 1264063 - protein, 32 aa, Mycobacterium
EYLSGRWSQAYGFPVMPVDGILVGTAAMAALE

SEQ ID NO: 1264064 - protein, 36 aa, Mycobacterium
EYNALKAWLIGVGEDGEWPLFLDAWVEHAVEDVATS

SEQ ID NO: 1264065 - protein, 28 aa, Mycobacterium
EYNRYDCRSTRRLRDWLMARAIECGVPP

SEQ ID NO: 1264066 - protein, 22 aa, Mycobacterium
EYRALEIPVIFTGMPEPVAAGD

SEQ ID NO: 1264067 - protein, 25 aa, Mycobacterium
EYRDRTCVVPGCAATCGLHAHHIQH

SEQ ID NO: 1264068 - protein, 25 aa, Mycobacterium
EYRDRTCVVPGCGATRGLHAHHIQH

SEQ ID NO: 1264069 - protein, 19 aa, Mycobacterium
EYRFPGLNPGDRWCVTAAN

SEQ ID NO: 1264070 - protein, 24 aa, Mycobacterium
EYRRRAERAWPQIKIADVDSYGLP

SEQ ID NO: 1264071 - protein, 24 aa, Mycobacterium
EYRRSDLPSHVRFVGPVSPLPGSD

SEQ ID NO: 1264072 - protein, 23 aa, Mycobacterium
EYRVARAYVDGRIQTIFGGTTEI

SEQ ID NO: 1264073 - protein, 21 aa, Mycobacterium
EYVDIRFCDLPGVVQHFSIPA

SEQ ID NO: 1264074 - protein, 22 aa, Mycobacterium
EYWQCRRHLVELLHRHAGFQLV

SEQ ID NO: 1264075 - protein, 25 aa, Mycobacterium
EYYCPGCGTQIECEYLPPGHPPAVD

SEQ ID NO: 1264076 - protein, 26 aa, Mycobacterium
EYYFSEPFPIIGATLENYAQAFEDAV

SEQ ID NO: 1264077 - protein, 18 aa, Mycobacterium
EYYRVVGEILADAAPLSQ

SEQ ID NO: 1264078 - protein, 17 aa, Mycobacterium
FAAAGYDYVGFDVQHGY

SEQ ID NO: 1264079 - protein, 24 aa, Mycobacterium
FAACADHGALVFVHPWQVLGSDRL

SEQ ID NO: 1264080 - protein, 17 aa, Mycobacterium
FAAEGIQTLGINALAQE

SEQ ID NO: 1264081 - protein, 17 aa, Mycobacterium
FAAEILPRVQVLSQRAE

SEQ ID NO: 1264082 - protein, 19 aa, Mycobacterium
FAAFAAGLAMPVAGRGDEF

SEQ ID NO: 1264083 - protein, 17 aa, Mycobacterium
FAAFRTGKLDHHGQFYN

SEQ ID NO: 1264084 - protein, 17 aa, Mycobacterium
FAALNRLLAERALSQEV

SEQ ID NO: 1264085 - protein, 17 aa, Mycobacterium
FAALRSWDEQGLLVHRE

SEQ ID NO: 1264086 - protein, 25 aa, Mycobacterium
FAALSSHYRRAYAMALPSYGLPDTH

SEQ ID NO: 1264087 - protein, 18 aa, Mycobacterium
FAALVPWDNQTDIAVMPA

SEQ ID NO: 1264088 - protein, 22 aa, Mycobacterium
FAAMAGPDFDYVIARQRLLYAL

SEQ ID NO: 1264089 - protein, 21 aa, Mycobacterium
FAANGYAGFRMESVAARAGVG

SEQ ID NO: 1264090 - protein, 19 aa, Mycobacterium
FAAQALACMREWKFTQADL

SEQ ID NO: 1264091 - protein, 17 aa, Mycobacterium
FAAQAWNYMFPLGEPPN

SEQ ID NO: 1264092 - protein, 18 aa, Mycobacterium
FAAQGFSVTLMFAAVPTP

SEQ ID NO: 1264093 - protein, 19 aa, Mycobacterium
FAARAGSTAVYAWGDEAVP

SEQ ID NO: 1264094 - protein, 18 aa, Mycobacterium
FAARAYRLLPEKPAYTAV

SEQ ID NO: 1264095 - protein, 17 aa, Mycobacterium
FAARKPVLDRALETIPD

SEQ ID NO: 1264096 - protein, 17 aa, Mycobacterium
FAASLIGDFGAQVIKIE

SEQ ID NO: 1264097 - protein, 18 aa, Mycobacterium
FAASYAGTLARWSTSRHF

SEQ ID NO: 1264098 - protein, 30 aa, Mycobacterium
FAAVRQFRASVCVLGPLVGRCKKAKVALPG

SEQ ID NO: 1264099 - protein, 17 aa, Mycobacterium
FAAWRNDPSFVLNLAPF

SEQ ID NO: 1264100 - protein, 18 aa, Mycobacterium
FADAAARATKKWRETYWA

SEQ ID NO: 1264101 - protein, 19 aa, Mycobacterium
FADAAARTSLRAVMADVDQ

SEQ ID NO: 1264102 - protein, 18 aa, Mycobacterium
FADATVWPRLLGNCHTHR

SEQ ID NO: 1264103 - protein, 19 aa, Mycobacterium
FADDARVLLVFGGSQGAQS

SEQ ID NO: 1264104 - protein, 17 aa, Mycobacterium
FADDWRAGYVPAMDRVR

SEQ ID NO: 1264105 - protein, 25 aa, Mycobacterium
FADERWEWSEQVQILHGYEPGTVTP

SEQ ID NO: 1264106 - protein, 26 aa, Mycobacterium
FADESCGICVPCRAGTVDLHDTMRRI

SEQ ID NO: 1264107 - protein, 21 aa, Mycobacterium
FADGLTYVGLVPFVMRHTKLG

SEQ ID NO: 1264108 - protein, 18 aa, Mycobacterium
FADGSWRTAFGCDASVQG

SEQ ID NO: 1264109 - protein, 17 aa, Mycobacterium
FADHARLSAGEALPMDT

SEQ ID NO: 1264110 - protein, 26 aa, Mycobacterium
FADKDVFVGAVFDWVVADIAATTQAA

SEQ ID NO: 1264111 - protein, 18 aa, Mycobacterium
FADLARAVLARRGADKTV

SEQ ID NO: 1264112 - protein, 20 aa, Mycobacterium
FADLVGRLPATGWDGPGLGE

SEQ ID NO: 1264113 - protein, 18 aa, Mycobacterium
FADRAYRPDGQLVSRRER

SEQ ID NO: 1264114 - protein, 19 aa, Mycobacterium
FADRWRVGRIFLAGDAAHA

SEQ ID NO: 1264115 - protein, 21 aa, Mycobacterium
FADSRVIAMAVELPTAYLGAA

SEQ ID NO: 1264116 - protein, 17 aa, Mycobacterium
FADTQGYAYSRRDVTGR

SEQ ID NO: 1264117 - protein, 22 aa, Mycobacterium
FADVLPREGVDLMISIDDGSGA

SEQ ID NO: 1264118 - protein, 19 aa, Mycobacterium
FADVMMSFHRLSDVDIDEL

SEQ ID NO: 1264119 - protein, 17 aa, Mycobacterium
FAECDVILLPKVQAEDL

SEQ ID NO: 1264120 - protein, 22 aa, Mycobacterium
FAEFDSRVEIAFAYEQRLRESV

SEQ ID NO: 1264121 - protein, 24 aa, Mycobacterium
FAEHPWCADALRLRRYDDAAKDPD

SEQ ID NO: 1264122 - protein, 18 aa, Mycobacterium
FAEKMIEVLWAGTPHDRP

SEQ ID NO: 1264123 - protein, 23 aa, Mycobacterium
FAEKRLAPYALEWDETHHFPADV

SEQ ID NO: 1264124 - protein, 34 aa, Mycobacterium
FAELVARVQALGRRSRPATPPVLERQGIRADTHR

SEQ ID NO: 1264125 - protein, 25 aa, Mycobacterium
FAERIGAACRAVWNTGLEQRREYRR

SEQ ID NO: 1264126 - protein, 21 aa, Mycobacterium
FAEVSGAVALIVPDEAGGFDY

SEQ ID NO: 1264127 - protein, 26 aa, Mycobacterium
FAEYWNEICSLPIALITSLVKQAQRE

SEQ ID NO: 1264128 - protein, 22 aa, Mycobacterium
FAFAGVGVLLPRWSGDQYNAGR

SEQ ID NO: 1264129 - protein, 17 aa, Mycobacterium
FAFASWRLGHIKESSRA

SEQ ID NO: 1264130 - protein, 36 aa, Mycobacterium
FAFGPDMMAWTLAMGHAMIRAGLAIKDHGRPWRPEV

SEQ ID NO: 1264131 - protein, 25 aa, Mycobacterium
FAGADFELGMMWRDVYKLRQRVLLI

SEQ ID NO: 1264132 - protein, 18 aa, Mycobacterium
FAGANLIPLRGGAGDLNA

SEQ ID NO: 1264133 - protein, 21 aa, Mycobacterium
FAGDWPLSGGYAEHILLPAGT

SEQ ID NO: 1264134 - protein, 18 aa, Mycobacterium
FAGFAALPMRDPQAAAVE

SEQ ID NO: 1264135 - protein, 23 aa, Mycobacterium
FAGGAVSAVFDWEMTTIGDPLTD

SEQ ID NO: 1264136 - protein, 20 aa, Mycobacterium
FAGGPRACIGQHFAMLEATL

SEQ ID NO: 1264137 - protein, 17 aa, Mycobacterium
FAGGTVLVIRRIRSELD

SEQ ID NO: 1264138 - protein, 17 aa, Mycobacterium
FAGISGELVDGRFSEKE

SEQ ID NO: 1264139 - protein, 18 aa, Mycobacterium
FAGLPAYQQHLGRKVRFM

SEQ ID NO: 1264140 - protein, 18 aa, Mycobacterium
FAGLRSVDWERAEPDADR

SEQ ID NO: 1264141 - protein, 20 aa, Mycobacterium
FAGPVNPGWTLSPLRRGRGD

SEQ ID NO: 1264142 - protein, 25 aa, Mycobacterium
FAGRAAAWLQALLPALAEYAEFIDG

SEQ ID NO: 1264143 - protein, 28 aa, Mycobacterium
FAGRAAAWLQALLPALAEYAEFIDGGDY

SEQ ID NO: 1264144 - protein, 17 aa, Mycobacterium
FAGRIAAQIVRRRANTP

SEQ ID NO: 1264145 - protein, 17 aa, Mycobacterium
FAGRVALMTALEELAIT

SEQ ID NO: 1264146 - protein, 17 aa, Mycobacterium
FAGTVVVATGVWTRPFL

SEQ ID NO: 1264147 - protein, 22 aa, Mycobacterium
FAHDGCGPWNAKLPTPTATRTI

SEQ ID NO: 1264148 - protein, 17 aa, Mycobacterium
FAHGRDWGSPKIPERMD

SEQ ID NO: 1264149 - protein, 22 aa, Mycobacterium
FAIELSDFIDPRCQEVGRVTAF

SEQ ID NO: 1264150 - protein, 19 aa, Mycobacterium
FAKAANWPGDLELLRDQGF

SEQ ID NO: 1264151 - protein, 27 aa, Mycobacterium
FAKAVAGRLGWPFVEIFPSRLATPDVA

SEQ ID NO: 1264152 - protein, 24 aa, Mycobacterium
FAKLREPLEVPGLLDVQTESFEWL

SEQ ID NO: 1264153 - protein, 17 aa, Mycobacterium
FAKMREIADEVGATLMV

SEQ ID NO: 1264154 - protein, 18 aa, Mycobacterium
FAKQRHWVEHNANAAWLA

SEQ ID NO: 1264155 - protein, 28 aa, Mycobacterium
FAKRPGLVRPSLGISEWILPTLISSAPE

SEQ ID NO: 1264156 - protein, 19 aa, Mycobacterium
FAKVTLRRNGRVLVGPVTW

SEQ ID NO: 1264157 - protein, 23 aa, Mycobacterium
FALACRSMGVHGRVYVPAKTPKQ

SEQ ID NO: 1264158 - protein, 17 aa, Mycobacterium
FALAPPPVPPFHISIPG

SEQ ID NO: 1264159 - protein, 17 aa, Mycobacterium
FALAPRGVLFLGHAEML

SEQ ID NO: 1264160 - protein, 17 aa, Mycobacterium
FALNCTWDDHGADPTLV

SEQ ID NO: 1264161 - protein, 24 aa, Mycobacterium
FALPEPRPAGYVIVGDTASLPAVN

SEQ ID NO: 1264162 - protein, 17 aa, Mycobacterium
FALSRKDFQQWACQRTR

SEQ ID NO: 1264163 - protein, 19 aa, Mycobacterium
FALTCLLGDRIRDRVVSVA

SEQ ID NO: 1264164 - protein, 21 aa, Mycobacterium
FALTELKWFADHVGAAPPDQR

SEQ ID NO: 1264165 - protein, 22 aa, Mycobacterium
FALTGVRIKAQRAVELGLANHV

SEQ ID NO: 1264166 - protein, 33 aa, Mycobacterium
FALWARLSGVVPRIAIVKGRCFAGNAVIAGASD

SEQ ID NO: 1264167 - protein, 30 aa, Mycobacterium
FAMTIWQFLHFRFGLPKPLLEPLAVERLYL

SEQ ID NO: 1264168 - protein, 24 aa, Mycobacterium
FANRASTILADLRKLEALAARAMR

SEQ ID NO: 1264169 - protein, 20 aa, Mycobacterium
FAPANGVGYFEQLGWRTREV

SEQ ID NO: 1264170 - protein, 29 aa, Mycobacterium
FAPEAIRRPRWLLEFARSGRVPDLTAPNL

SEQ ID NO: 1264171 - protein, 18 aa, Mycobacterium
FAPGCVRIEVGLKTGFSG

SEQ ID NO: 1264172 - protein, 20 aa, Mycobacterium
FAPHRPRPGPAELLYFGRLE

SEQ ID NO: 1264173 - protein, 29 aa, Mycobacterium
FAPIVRLCRSRLVGAALMRLLTTPPGLRV

SEQ ID NO: 1264174 - protein, 24 aa, Mycobacterium
FAPKDLRLFYQVRQNWRGKAVLVK

SEQ ID NO: 1264175 - protein, 27 aa, Mycobacterium
FAPKDLRLFYQVRQSWRGKAVLLKLIW

SEQ ID NO: 1264176 - protein, 17 aa, Mycobacterium
FAPLNSWPDNANLDKAR

SEQ ID NO: 1264177 - protein, 24 aa, Mycobacterium
FAPLRPGHVSIYLCGATVQGLPHI

SEQ ID NO: 1264178 - protein, 30 aa, Mycobacterium
FAPPTLHAMGIRVATSFSARLFNLLITNAP

SEQ ID NO: 1264179 - protein, 17 aa, Mycobacterium
FAPRLKNPLNYITNPGH

SEQ ID NO: 1264180 - protein, 17 aa, Mycobacterium
FAPRLKNPLNYVTNPGH

SEQ ID NO: 1264181 - protein, 27 aa, Mycobacterium
FAPSRLPWERIEPLAGLVEEIDGKVDA

SEQ ID NO: 1264182 - protein, 17 aa, Mycobacterium
FAPTYVIGGLEGARLGD

SEQ ID NO: 1264183 - protein, 27 aa, Mycobacterium
FAPVPTGWKVPRAWLDSGVVKEAHSWD

SEQ ID NO: 1264184 - protein, 18 aa, Mycobacterium
FAPVRAGLAIAEVGLGMA

SEQ ID NO: 1264185 - protein, 19 aa, Mycobacterium
FAQALCWLCDELIAQRAEE

SEQ ID NO: 1264186 - protein, 22 aa, Mycobacterium
FAQRDFPAMFAAVSEEMIDAMG

SEQ ID NO: 1264187 - protein, 18 aa, Mycobacterium
FAQRRPRSGPAQLLYLGR

SEQ ID NO: 1264188 - protein, 18 aa, Mycobacterium
FAQSLGYDGFTDLQVALR

SEQ ID NO: 1264189 - protein, 18 aa, Mycobacterium
FAQVGTWSGLLSIDGEDI

SEQ ID NO: 1264190 - protein, 23 aa, Mycobacterium
FAREGGVESAMWAGPEHLGGARR

SEQ ID NO: 1264191 - protein, 23 aa, Mycobacterium
FARGKRLGRAPVIVDREVVRAIR

SEQ ID NO: 1264192 - protein, 21 aa, Mycobacterium
FARLFKKRFGAPPHAYVQRRR

SEQ ID NO: 1264193 - protein, 20 aa, Mycobacterium
FARQRLRALAKVEGKSQDGK

SEQ ID NO: 1264194 - protein, 18 aa, Mycobacterium
FARRGIAGGATYDGLVAL

SEQ ID NO: 1264195 - protein, 30 aa, Mycobacterium
FARSGMGVSPSWSVFCVDSGIAFTPTIGVA

SEQ ID NO: 1264196 - protein, 25 aa, Mycobacterium
FARVFPRPLNWALLTAGRFFLRQYP

SEQ ID NO: 1264197 - protein, 18 aa, Mycobacterium
FASRIGVEVDEFQSYIDG

SEQ ID NO: 1264198 - protein, 19 aa, Mycobacterium
FASRIGVPADDFAAYLRGS

SEQ ID NO: 1264199 - protein, 22 aa, Mycobacterium
FASRLPSYFPATLRDQFSPEIR

SEQ ID NO: 1264200 - protein, 18 aa, Mycobacterium
FATAFPYGPYYGDRITRG

SEQ ID NO: 1264201 - protein, 29 aa, Mycobacterium
FATAPLVVSGCIMMRVCHLDTCPVGVATQ

SEQ ID NO: 1264202 - protein, 29 aa, Mycobacterium
FATAPLVVTGCIMMRVCHLDTCPVGVATQ

SEQ ID NO: 1264203 - protein, 17 aa, Mycobacterium
FATAVLLAQMFGAGCRR

SEQ ID NO: 1264204 - protein, 22 aa, Mycobacterium
FATDFYAKFGYDRPVYTLSHDI

SEQ ID NO: 1264205 - protein, 17 aa, Mycobacterium
FATFASVLCQAEATEYT

SEQ ID NO: 1264206 - protein, 22 aa, Mycobacterium
FATGAISYRLARTVVKRTRLIA

SEQ ID NO: 1264207 - protein, 18 aa, Mycobacterium
FATIPVVREDGWSDDGMQ

SEQ ID NO: 1264208 - protein, 26 aa, Mycobacterium
FATIRAEADLSRFPEDVARVVVRLIH

SEQ ID NO: 1264209 - protein, 26 aa, Mycobacterium
FATTSMNVWANLRLVRQMISRTPRLE

SEQ ID NO: 1264210 - protein, 19 aa, Mycobacterium
FATVCARDGVDAVAALQAL

SEQ ID NO: 1264211 - protein, 30 aa, Mycobacterium
FATYLREFPMAFRFAVLNVISDGLTARYGT

SEQ ID NO: 1264212 - protein, 21 aa, Mycobacterium
FAVAHVRGGGELGRPWYEHGK

SEQ ID NO: 1264213 - protein, 18 aa, Mycobacterium
FAVAWEWGNTALVSELIE

SEQ ID NO: 1264214 - protein, 21 aa, Mycobacterium
FAVELARRGGRVVCADKDPVT

SEQ ID NO: 1264215 - protein, 23 aa, Mycobacterium
FAVLEPRADGFRNFARPGEKTPL

SEQ ID NO: 1264216 - protein, 20 aa, Mycobacterium
FAVLRLAPYRLRVMPGTVMT

SEQ ID NO: 1264217 - protein, 20 aa, Mycobacterium
FAVNGGRLAGRAGFVPDAVG

SEQ ID NO: 1264218 - protein, 17 aa, Mycobacterium
FAVRAGRWFYVDGDLFD

SEQ ID NO: 1264219 - protein, 17 aa, Mycobacterium
FAVTEGGRHSVTHYDTL

SEQ ID NO: 1264220 - protein, 20 aa, Mycobacterium
FAVTRAWLYAPYLPEAERLV

SEQ ID NO: 1264221 - protein, 21 aa, Mycobacterium
FAYHGYPWLIHRLTYRRAGHA

SEQ ID NO: 1264222 - protein, 19 aa, Mycobacterium
FAYLAAQYRRGYAAALPDY

SEQ ID NO: 1264223 - protein, 18 aa, Mycobacterium
FAYPPNLFVVDGGAPQVN

SEQ ID NO: 1264224 - protein, 19 aa, Mycobacterium
FCAEPEVFVPGAPPAGGSD

SEQ ID NO: 1264225 - protein, 24 aa, Mycobacterium
FCAIPEHADHAAITQSIKDVVAEV

SEQ ID NO: 1264226 - protein, 27 aa, Mycobacterium
FCAVLAFSRWRFVRFAANERASTTLAL

SEQ ID NO: 1264227 - protein, 23 aa, Mycobacterium
FCDPEIVESLKFHLRDLAVTFRF

SEQ ID NO: 1264228 - protein, 18 aa, Mycobacterium
FCGESLTYFASRVGEGDE

SEQ ID NO: 1264229 - protein, 29 aa, Mycobacterium
FCHNGCPLGNLIPEWNDLVFKDRWRDAIE

SEQ ID NO: 1264230 - protein, 27 aa, Mycobacterium
FCHNGCPLGNLIPEWNDLVRTGRWHDA

SEQ ID NO: 1264231 - protein, 23 aa, Mycobacterium
FCLDSPRLAQVMFSRPFADFDPG

SEQ ID NO: 1264232 - protein, 26 aa, Mycobacterium
FCQVFRNAHHSWGWDRDTEVPVDLAV

SEQ ID NO: 1264233 - protein, 17 aa, Mycobacterium
FCSTCDRSRLTADGQVR

SEQ ID NO: 1264234 - protein, 19 aa, Mycobacterium
FCTENDPYPSARCPEVTVD

SEQ ID NO: 1264235 - protein, 19 aa, Mycobacterium
FCTIHGYRRAFRVAGSGPA

SEQ ID NO: 1264236 - protein, 19 aa, Mycobacterium
FCVTESAPRKWIFSPTRSR

SEQ ID NO: 1264237 - protein, 18 aa, Mycobacterium
FDAAALLQQMRRAGVSTF

SEQ ID NO: 1264238 - protein, 18 aa, Mycobacterium
FDAAPGRRLFDAARTLVD

SEQ ID NO: 1264239 - protein, 17 aa, Mycobacterium
FDAEGFFRTGDLGHLTD

SEQ ID NO: 1264240 - protein, 22 aa, Mycobacterium
FDAERRFGVGHLQVAESSDCRS

SEQ ID NO: 1264241 - protein, 17 aa, Mycobacterium
FDAFNWLGIKAQWSNAV

SEQ ID NO: 1264242 - protein, 17 aa, Mycobacterium
FDAGVQMLANRGYAVLQ

SEQ ID NO: 1264243 - protein, 17 aa, Mycobacterium
FDAHLLPWEGACHAEQV

SEQ ID NO: 1264244 - protein, 20 aa, Mycobacterium
FDALCAHLATMHPSRYLTLI

SEQ ID NO: 1264245 - protein, 23 aa, Mycobacterium
FDALRKVGGCWVLTNHPFLTGRP

SEQ ID NO: 1264246 - protein, 19 aa, Mycobacterium
FDALTGLFLAEGFAHLTLD

SEQ ID NO: 1264247 - protein, 18 aa, Mycobacterium
FDAVELHFGHLYLPSSFL

SEQ ID NO: 1264248 - protein, 17 aa, Mycobacterium
FDAVVALFGNGVTELEE

SEQ ID NO: 1264249 - protein, 17 aa, Mycobacterium
FDCAYYQLLDATRGRPF

SEQ ID NO: 1264250 - protein, 26 aa, Mycobacterium
FDCGDPGALAGFWAHVLGYVLQPPPA

SEQ ID NO: 1264251 - protein, 19 aa, Mycobacterium
FDCPGRPDLSLLRAAATAG

SEQ ID NO: 1264252 - protein, 22 aa, Mycobacterium
FDCSGLTRFAFAGVGVLLPRWS

SEQ ID NO: 1264253 - protein, 17 aa, Mycobacterium
FDCTDLFFVIGSNMADC

SEQ ID NO: 1264254 - protein, 18 aa, Mycobacterium
FDDARPVLERASARETAA

SEQ ID NO: 1264255 - protein, 20 aa, Mycobacterium
FDDEVLLFIELGKRLAPGPF

SEQ ID NO: 1264256 - protein, 18 aa, Mycobacterium
FDDTTAELKRIWTDARYR

SEQ ID NO: 1264257 - protein, 29 aa, Mycobacterium
FDEASWRGADLLALHVCKDADAPASHDAQ

SEQ ID NO: 1264258 - protein, 22 aa, Mycobacterium
FDEAVGLQWGLVVRRHSELSAS

SEQ ID NO: 1264259 - protein, 18 aa, Mycobacterium
FDEHPWNWAAHADPDVVR

SEQ ID NO: 1264260 - protein, 24 aa, Mycobacterium
FDELYAAGATAIFPPGTVIADAAI

SEQ ID NO: 1264261 - protein, 22 aa, Mycobacterium
FDELYRTGRVELELVPQGNLAE

SEQ ID NO: 1264262 - protein, 20 aa, Mycobacterium
FDENYSWVMSPRWFDGKDHL

SEQ ID NO: 1264263 - protein, 20 aa, Mycobacterium
FDEVARMGAQVTIFRLGSDP

SEQ ID NO: 1264264 - protein, 18 aa, Mycobacterium
FDEVPVRTPGTLAFAPIV

SEQ ID NO: 1264265 - protein, 18 aa, Mycobacterium
FDEYLALERGRSEHTRRA

SEQ ID NO: 1264266 - protein, 19 aa, Mycobacterium
FDFHTPLLRLVRLHAAHAT

SEQ ID NO: 1264267 - protein, 18 aa, Mycobacterium
FDGAWPYLQAIADCAGVA

SEQ ID NO: 1264268 - protein, 23 aa, Mycobacterium
FDGDGMIHIVEFGGGKAAYRNRF

SEQ ID NO: 1264269 - protein, 23 aa, Mycobacterium
FDGDGRSAVFFDYPPHPRTIAHT

SEQ ID NO: 1264270 - protein, 18 aa, Mycobacterium
FDGFDPGAARVILTPDDI

SEQ ID NO: 1264271 - protein, 18 aa, Mycobacterium
FDGIYGVETIELFLHSSY

SEQ ID NO: 1264272 - protein, 20 aa, Mycobacterium
FDGKMVETILRFEATVYAEL

SEQ ID NO: 1264273 - protein, 20 aa, Mycobacterium
FDGLRLPSTALLGAEGGAWP

SEQ ID NO: 1264274 - protein, 18 aa, Mycobacterium
FDGLTCGVNIGIGKQSPD

SEQ ID NO: 1264275 - protein, 33 aa, Mycobacterium
FDGRIGTAVEEFVRWSTPVLQFARFATADTEIN

SEQ ID NO: 1264276 - protein, 25 aa, Mycobacterium
FDGRKAVVLDDRWASAREDLARIWL

SEQ ID NO: 1264277 - protein, 23 aa, Mycobacterium
FDGTDTVMLVWLGQRRIPGIESG

SEQ ID NO: 1264278 - protein, 17 aa, Mycobacterium
FDGVRPASVRVPAERLA

SEQ ID NO: 1264279 - protein, 25 aa, Mycobacterium
FDGWARWVDVGGVLVIHDVFPDPAD

SEQ ID NO: 1264280 - protein, 22 aa, Mycobacterium
FDGWWRKQRHRTPGLLTMTRDD

SEQ ID NO: 1264281 - protein, 26 aa, Mycobacterium
FDHAMCYPKPAARVPIHIGGHSRAAA

SEQ ID NO: 1264282 - protein, 24 aa, Mycobacterium
FDHRCPICGEPVDWALVGEGAPLR

SEQ ID NO: 1264283 - protein, 26 aa, Mycobacterium
FDIAIDLSVPLPGFIIKRTIKGGVET

SEQ ID NO: 1264284 - protein, 22 aa, Mycobacterium
FDIDSGYPWPDHLPERVLTDGA

SEQ ID NO: 1264285 - protein, 23 aa, Mycobacterium
FDIDSGYPWPDHLPERVLTDGAG

SEQ ID NO: 1264286 - protein, 26 aa, Mycobacterium
FDIGAGPLLRARLFGVGDQRHVLVVT

SEQ ID NO: 1264287 - protein, 20 aa, Mycobacterium
FDIMCPYAYQTSRWIRAVRD

SEQ ID NO: 1264288 - protein, 17 aa, Mycobacterium
FDIPEALPMGVASEAGL

SEQ ID NO: 1264289 - protein, 23 aa, Mycobacterium
FDISSLLRGYGWQVPAYTMPDNA

SEQ ID NO: 1264290 - protein, 17 aa, Mycobacterium
FDITKPAALIRPQSVRF

SEQ ID NO: 1264291 - protein, 17 aa, Mycobacterium
FDKDRDGFVFGEAGVMM

SEQ ID NO: 1264292 - protein, 18 aa, Mycobacterium
FDKGVVRIHVVWQGDAAI

SEQ ID NO: 1264293 - protein, 19 aa, Mycobacterium
FDKPYLLAMANAGPGTNGS

SEQ ID NO: 1264294 - protein, 26 aa, Mycobacterium
FDLEEDWPIRAAVFTVGAVSPASDGG

SEQ ID NO: 1264295 - protein, 20 aa, Mycobacterium
FDLGELVARLHALLRRAHHS

SEQ ID NO: 1264296 - protein, 26 aa, Mycobacterium
FDLLPIPEFYGGAVYFDGADAPAVVR

SEQ ID NO: 1264297 - protein, 20 aa, Mycobacterium
FDLSFGPRTQRIFAKFPATQ

SEQ ID NO: 1264298 - protein, 17 aa, Mycobacterium
FDMLNLRLKPSARTSVP

SEQ ID NO: 1264299 - protein, 20 aa, Mycobacterium
FDMVEIHAANGYLLQQFMSV

SEQ ID NO: 1264300 - protein, 20 aa, Mycobacterium
FDNDAGWRIDYQLATPGLAG

SEQ ID NO: 1264301 - protein, 27 aa, Mycobacterium
FDNLNWWLGEWSWVFEKYSTMFVQWTA

SEQ ID NO: 1264302 - protein, 17 aa, Mycobacterium
FDPDAPTASGFWHWAVF

SEQ ID NO: 1264303 - protein, 26 aa, Mycobacterium
FDPERALECIERYGVTHGQFVPAMFV

SEQ ID NO: 1264304 - protein, 17 aa, Mycobacterium
FDPFVSLSFAAAATSRI

SEQ ID NO: 1264305 - protein, 21 aa, Mycobacterium
FDPTHRLFRGRHTTSYTQITA

SEQ ID NO: 1264306 - protein, 24 aa, Mycobacterium
FDPTRAMPAYNWMTVAKSALESVN

SEQ ID NO: 1264307 - protein, 27 aa, Mycobacterium
FDPYFPRIDLRWALRGVSGAERRRRLR

SEQ ID NO: 1264308 - protein, 25 aa, Mycobacterium
FDQARRIAAEIGYPVLVRPSYVLGG

SEQ ID NO: 1264309 - protein, 28 aa, Mycobacterium
FDQWDPPKLKAFVDMLVPFKPFSSVLGE

SEQ ID NO: 1264310 - protein, 17 aa, Mycobacterium
FDRGEVVFKAEVGSQSP

SEQ ID NO: 1264311 - protein, 19 aa, Mycobacterium
FDRHLRPGGVIDVQNEIDK

SEQ ID NO: 1264312 - protein, 21 aa, Mycobacterium
FDRSGLPLATVVQEGIVKHFP

SEQ ID NO: 1264313 - protein, 26 aa, Mycobacterium
FDRVSDSFARYGVPTGDRIHLHKGLF

SEQ ID NO: 1264314 - protein, 24 aa, Mycobacterium
FDRYGIPILVVYGATEFSGAVAGW

SEQ ID NO: 1264315 - protein, 27 aa, Mycobacterium
FDSGVSYRPGARFGPTHVREASRLLRP

SEQ ID NO: 1264316 - protein, 26 aa, Mycobacterium
FDSGVTYRPGARFGPAAIRQASRLLK

SEQ ID NO: 1264317 - protein, 24 aa, Mycobacterium
FDSIERILGCGVRDHCDPELCRYD

SEQ ID NO: 1264318 - protein, 18 aa, Mycobacterium
FDTAILLTRYLVGSWQYR

SEQ ID NO: 1264319 - protein, 17 aa, Mycobacterium
FDTLLVYENFPPGGLVG

SEQ ID NO: 1264320 - protein, 28 aa, Mycobacterium
FDTSWLDPFTEFRFPRIGTAVLGGVELE

SEQ ID NO: 1264321 - protein, 24 aa, Mycobacterium
FDTVVCTFGLCAIPDHAQALTEMA

SEQ ID NO: 1264322 - protein, 30 aa, Mycobacterium
FDVAPPVWAEPGRWWALVRVACAGELVYSP

SEQ ID NO: 1264323 - protein, 19 aa, Mycobacterium
FDVDACTRYAQSLNPGVGV

SEQ ID NO: 1264324 - protein, 19 aa, Mycobacterium
FDVDFSELVFLGERADVTD

SEQ ID NO: 1264325 - protein, 17 aa, Mycobacterium
FDVIRWVTGQNVVDVYA

SEQ ID NO: 1264326 - protein, 20 aa, Mycobacterium
FDVLELRAKPQLRDSPPLPA

SEQ ID NO: 1264327 - protein, 21 aa, Mycobacterium
FDVLMKPGPGFALVARDNLRL

SEQ ID NO: 1264328 - protein, 18 aa, Mycobacterium
FDVSLAMFTHVAAAAPGD

SEQ ID NO: 1264329 - protein, 25 aa, Mycobacterium
FDYAEGRLGWRTLDFELEVLQTGDF

SEQ ID NO: 1264330 - protein, 23 aa, Mycobacterium
FDYDKCTGCAVCADQCPVHAIEM

SEQ ID NO: 1264331 - protein, 23 aa, Mycobacterium
FEAEVGYSRAVRVGPHVAVAGTT

SEQ ID NO: 1264332 - protein, 21 aa, Mycobacterium
FEAGGFPMEFGTISVSDGISM

SEQ ID NO: 1264333 - protein, 19 aa, Mycobacterium
FEAIRCLRNVENQRYTSVE

SEQ ID NO: 1264334 - protein, 18 aa, Mycobacterium
FEALAGFRPAARSVELMR

SEQ ID NO: 1264335 - protein, 22 aa, Mycobacterium
FEALGADFGRRGALLDEAIAAW

SEQ ID NO: 1264336 - protein, 27 aa, Mycobacterium
FEAMNHWRPDGGFSLHVFHKNNELAGY

SEQ ID NO: 1264337 - protein, 25 aa, Mycobacterium
FEAMTIDCPEEFVGAITQLMAARKG

SEQ ID NO: 1264338 - protein, 17 aa, Mycobacterium
FEARGYTGWDVTSPAYI

SEQ ID NO: 1264339 - protein, 26 aa, Mycobacterium
FEAVGACARGLMPREDVDAIERAICP

SEQ ID NO: 1264340 - protein, 17 aa, Mycobacterium
FEAVIALMGQGKYDTTG

SEQ ID NO: 1264341 - protein, 21 aa, Mycobacterium
FEAVRVIGRAAGIEFTLRAGR

SEQ ID NO: 1264342 - protein, 18 aa, Mycobacterium
FEDEAGFILNGTETTVAN

SEQ ID NO: 1264343 - protein, 18 aa, Mycobacterium
FEDGGWIWFDITTDAKST

SEQ ID NO: 1264344 - protein, 17 aa, Mycobacterium
FEDGNRILLSVGTQSDT

SEQ ID NO: 1264345 - protein, 20 aa, Mycobacterium
FEDGQPWGKDQVSGIMGAGG

SEQ ID NO: 1264346 - protein, 25 aa, Mycobacterium
FEDHGADCPHCWELANPALDDFLHR

SEQ ID NO: 1264347 - protein, 24 aa, Mycobacterium
FEDPVYRTAFEWMTDYRREYGTHP

SEQ ID NO: 1264348 - protein, 18 aa, Mycobacterium
FEDYHVWVVRSPRLRGIN

SEQ ID NO: 1264349 - protein, 19 aa, Mycobacterium
FEEAGRPIAALFVSAVAAP

SEQ ID NO: 1264350 - protein, 25 aa, Mycobacterium
FEEFQSRWAPSIVVGLGRLAGRTVG

SEQ ID NO: 1264351 - protein, 17 aa, Mycobacterium
FEGAQHWTDPKQRSGDV

SEQ ID NO: 1264352 - protein, 25 aa, Mycobacterium
FEGELAAVIGRPCKDVPASRAAENI

SEQ ID NO: 1264353 - protein, 24 aa, Mycobacterium
FEGLRVLDLTTFWAGPSCTHILAL

SEQ ID NO: 1264354 - protein, 21 aa, Mycobacterium
FEHLPQLLLTAMRRPRVGVMI

SEQ ID NO: 1264355 - protein, 19 aa, Mycobacterium
FEIAALRAGQTILVNGAGG

SEQ ID NO: 1264356 - protein, 17 aa, Mycobacterium
FEIIANLHLHRFNAAAD

SEQ ID NO: 1264357 - protein, 31 aa, Mycobacterium
FEINEAFASVVLRFMKDLGLPHDIVNVNGGA

SEQ ID NO: 1264358 - protein, 17 aa, Mycobacterium
FEKAGKLYDAFNVNVAI

SEQ ID NO: 1264359 - protein, 17 aa, Mycobacterium
FEKDVKESIAFATGSGV

SEQ ID NO: 1264360 - protein, 17 aa, Mycobacterium
FELAERITGFMPADEGR

SEQ ID NO: 1264361 - protein, 26 aa, Mycobacterium
FELPGDPPGAFGPMFDLMMRVETEGR

SEQ ID NO: 1264362 - protein, 24 aa, Mycobacterium
FELQWGTNHLGHFALTARLLPLLT

SEQ ID NO: 1264363 - protein, 26 aa, Mycobacterium
FELRAALDEFEWRGAGARDVLDAAAR

SEQ ID NO: 1264364 - protein, 24 aa, Mycobacterium
FELRRPAPRMDFTFTSHAISVPAI

SEQ ID NO: 1264365 - protein, 20 aa, Mycobacterium
FEMPGFDWEEIRPEVEQEAA

SEQ ID NO: 1264366 - protein, 18 aa, Mycobacterium
FENKAAAVAALLEPMYDD

SEQ ID NO: 1264367 - protein, 23 aa, Mycobacterium
FENTRRWRNLRKITIAEVHGMVL

SEQ ID NO: 1264368 - protein, 20 aa, Mycobacterium
FEPAEHWLRFGEPRTAHRTT

SEQ ID NO: 1264369 - protein, 17 aa, Mycobacterium
FEPHPMFVAAAETRAHR

SEQ ID NO: 1264370 - protein, 22 aa, Mycobacterium
FEPIAALCRTDLTPTDGMIRFM

SEQ ID NO: 1264371 - protein, 18 aa, Mycobacterium
FEPNPGWTRTYSGSAEIL

SEQ ID NO: 1264372 - protein, 17 aa, Mycobacterium
FEPNPYWSRLYAPGSEL

SEQ ID NO: 1264373 - protein, 28 aa, Mycobacterium
FEPPSRVVFSWDIGPTWQVESDASRTSE

SEQ ID NO: 1264374 - protein, 18 aa, Mycobacterium
FEPTLDYVVVKAPRFAFE

SEQ ID NO: 1264375 - protein, 23 aa, Mycobacterium
FEQAAAEGMRWGMLRGAGLRVEA

SEQ ID NO: 1264376 - protein, 22 aa, Mycobacterium
FEQHLRAVLDYPLGDTSALAPT

SEQ ID NO: 1264377 - protein, 23 aa, Mycobacterium
FEQPSPQPGVHWSKDVRMDKIAE

SEQ ID NO: 1264378 - protein, 30 aa, Mycobacterium
FERFRDELAKRIPALPEFRAKLADSQLNLD

SEQ ID NO: 1264379 - protein, 18 aa, Mycobacterium
FERLILRPRGLDYKVQFP

SEQ ID NO: 1264380 - protein, 21 aa, Mycobacterium
FERRPRVGDHVSIVEEIASIS

SEQ ID NO: 1264381 - protein, 17 aa, Mycobacterium
FERVLRLARDFFTQPPE

SEQ ID NO: 1264382 - protein, 31 aa, Mycobacterium
FETACRWHLRAADWLRMRDLLAARNQWEIAM

SEQ ID NO: 1264383 - protein, 17 aa, Mycobacterium
FETARTTLLLGQLQRRQ

SEQ ID NO: 1264384 - protein, 19 aa, Mycobacterium
FETDPTYALHFVNAYEDGD

SEQ ID NO: 1264385 - protein, 21 aa, Mycobacterium
FETFPGVWRHGDWITITDHGS

SEQ ID NO: 1264386 - protein, 18 aa, Mycobacterium
FETTMADPNWAILQVSST

SEQ ID NO: 1264387 - protein, 18 aa, Mycobacterium
FETVRTMARIIKAVEENS

SEQ ID NO: 1264388 - protein, 23 aa, Mycobacterium
FEVCSSTIWARRVVAGSPFRDAE

SEQ ID NO: 1264389 - protein, 18 aa, Mycobacterium
FEVDYLDHFVFVLTEGPD

SEQ ID NO: 1264390 - protein, 17 aa, Mycobacterium
FEVEFFGRHGFQEIEGT

SEQ ID NO: 1264391 - protein, 20 aa, Mycobacterium
FEVGCASLGTFSTRFTELVG

SEQ ID NO: 1264392 - protein, 20 aa, Mycobacterium
FEVGNAFASSSLSSRIKEIV

SEQ ID NO: 1264393 - protein, 20 aa, Mycobacterium
FEVRAAKYLLALDAGSVPLQ

SEQ ID NO: 1264394 - protein, 18 aa, Mycobacterium
FEVYADGIDLVIFEEFGS

SEQ ID NO: 1264395 - protein, 24 aa, Mycobacterium
FEWDEFKAHLIAAIEDSGVGETCD

SEQ ID NO: 1264396 - protein, 18 aa, Mycobacterium
FEYPNMWMDHCDPDKKDL

SEQ ID NO: 1264397 - protein, 17 aa, Mycobacterium
FFAELTIYTSTACLIGL

SEQ ID NO: 1264398 - protein, 17 aa, Mycobacterium
FFAFLTDLLDVWVAYFA

SEQ ID NO: 1264399 - protein, 18 aa, Mycobacterium
FFDDKYVDGWDFVTIDDF

SEQ ID NO: 1264400 - protein, 18 aa, Mycobacterium
FFDGMPIFTVLPVVAAIV

SEQ ID NO: 1264401 - protein, 19 aa, Mycobacterium
FFEFIRSGAVLQLLELDVT

SEQ ID NO: 1264402 - protein, 22 aa, Mycobacterium
FFEGVMMPELFMADATGATGKP

SEQ ID NO: 1264403 - protein, 20 aa, Mycobacterium
FFFLEMNTRLQVEHPVTELT

SEQ ID NO: 1264404 - protein, 25 aa, Mycobacterium
FFGHSMGGLLAFEVARRFEEAGRPI

SEQ ID NO: 1264405 - protein, 25 aa, Mycobacterium
FFHCAKAFLRSGAWNPESWTPDAVP

SEQ ID NO: 1264406 - protein, 20 aa, Mycobacterium
FFIPLVRLRDTVPGYAVSLV

SEQ ID NO: 1264407 - protein, 17 aa, Mycobacterium
FFLDALRMVEKANSNGG

SEQ ID NO: 1264408 - protein, 17 aa, Mycobacterium
FFLGATVDLDEAYHWAL

SEQ ID NO: 1264409 - protein, 28 aa, Mycobacterium
FFLHIPFPPVELFMQMPWRTEIIEGLLG

SEQ ID NO: 1264410 - protein, 25 aa, Mycobacterium
FFLPKIAAGDLHFSIGYSEPGAGTD

SEQ ID NO: 1264411 - protein, 17 aa, Mycobacterium
FFLPRAKQTPIIAAGLK

SEQ ID NO: 1264412 - protein, 24 aa, Mycobacterium
FFLVPPERIHTWVFAGLRAATTAE

SEQ ID NO: 1264413 - protein, 23 aa, Mycobacterium
FFNTLLSVAFEWGVGLQHLELGK

SEQ ID NO: 1264414 - protein, 22 aa, Mycobacterium
FFPDGQCLFGPVLIDPPAGEAA

SEQ ID NO: 1264415 - protein, 20 aa, Mycobacterium
FFPDPWPKARHHKRRLLQPD

SEQ ID NO: 1264416 - protein, 21 aa, Mycobacterium
FFRAVCEKEGFDLPEAGSYAT

SEQ ID NO: 1264417 - protein, 24 aa, Mycobacterium
FFRHFPTKEAVLFQDYETQVEWLA

SEQ ID NO: 1264418 - protein, 26 aa, Mycobacterium
FFRYFPTKESVLFFGEYDFIDAVGGV

SEQ ID NO: 1264419 - protein, 24 aa, Mycobacterium
FFRYFPTKESVLFSDDLLTPIIEA

SEQ ID NO: 1264420 - protein, 25 aa, Mycobacterium
FFTAGGMVRTVSWLYLGQTMVIHQR

SEQ ID NO: 1264421 - protein, 25 aa, Mycobacterium
FFWYTSPSWMMWNFQVAGLLVGATI

SEQ ID NO: 1264422 - protein, 18 aa, Mycobacterium
FGAAAVAVSPGWLRSEMM

SEQ ID NO: 1264423 - protein, 20 aa, Mycobacterium
FGACLNRELGRFVDEVNSNI

SEQ ID NO: 1264424 - protein, 21 aa, Mycobacterium
FGADLPPLKGVYLAAMSGGPV

SEQ ID NO: 1264425 - protein, 18 aa, Mycobacterium
FGAFAKRHGVLLVEQPHF

SEQ ID NO: 1264426 - protein, 17 aa, Mycobacterium
FGAGLVAAPLIRPLMRH

SEQ ID NO: 1264427 - protein, 24 aa, Mycobacterium
FGAGPIGIGLWFALRGKGLDDVFV

SEQ ID NO: 1264428 - protein, 18 aa, Mycobacterium
FGAGSGHGPATMPLQDMI

SEQ ID NO: 1264429 - protein, 23 aa, Mycobacterium
FGAKGITEPVAWGPTRNPWDVTR

SEQ ID NO: 1264430 - protein, 24 aa, Mycobacterium
FGALRIVGNMIRRPAARRRVLGMR

SEQ ID NO: 1264431 - protein, 22 aa, Mycobacterium
FGAPAALFCYIDRDLGRPQWSD

SEQ ID NO: 1264432 - protein, 20 aa, Mycobacterium
FGAPVGYKLMPKDIVPVMVQ

SEQ ID NO: 1264433 - protein, 17 aa, Mycobacterium
FGAQAQWFRNVMADARV

SEQ ID NO: 1264434 - protein, 23 aa, Mycobacterium
FGASNFPLAFSVAGGDTASALAA

SEQ ID NO: 1264435 - protein, 18 aa, Mycobacterium
FGASSAFGGPCATPTAER

SEQ ID NO: 1264436 - protein, 19 aa, Mycobacterium
FGASSAFGGPCRTPVAERL

SEQ ID NO: 1264437 - protein, 19 aa, Mycobacterium
FGAVAGAPALVFVSWPDSG

SEQ ID NO: 1264438 - protein, 21 aa, Mycobacterium
FGAVAGAPALVFVSWPDSGPL

SEQ ID NO: 1264439 - protein, 24 aa, Mycobacterium
FGCGDSRVAAEIIFDQGLGDMFVV

SEQ ID NO: 1264440 - protein, 17 aa, Mycobacterium
FGCSETDLRRALFEETG

SEQ ID NO: 1264441 - protein, 19 aa, Mycobacterium
FGDADGFWAAVLHRTAERR

SEQ ID NO: 1264442 - protein, 23 aa, Mycobacterium
FGDADPWAAMRAAVFRRTPAGHV

SEQ ID NO: 1264443 - protein, 17 aa, Mycobacterium
FGDARVVLTTGFPGLSP

SEQ ID NO: 1264444 - protein, 24 aa, Mycobacterium
FGDDGSMMACVFNFSGSEHTRYRL

SEQ ID NO: 1264445 - protein, 21 aa, Mycobacterium
FGDDLSVVALFDWETAGTGPP

SEQ ID NO: 1264446 - protein, 19 aa, Mycobacterium
FGDGDPWAAMRAAVHRRTP

SEQ ID NO: 1264447 - protein, 19 aa, Mycobacterium
FGDNAFRVVVAIFIADFVP

SEQ ID NO: 1264448 - protein, 17 aa, Mycobacterium
FGDRCMDMPQGAASEDF

SEQ ID NO: 1264449 - protein, 18 aa, Mycobacterium
FGDRGYWLVTKHADVKEV

SEQ ID NO: 1264450 - protein, 18 aa, Mycobacterium
FGDTEPWNVTRTVTNAVL

SEQ ID NO: 1264451 - protein, 17 aa, Mycobacterium
FGDWAYERWPTISDGVL

SEQ ID NO: 1264452 - protein, 25 aa, Mycobacterium
FGDYFKKGAIEFAWTLLTNPVDQSG

SEQ ID NO: 1264453 - protein, 25 aa, Mycobacterium
FGDYFKKGAIEFAWTLLTNPVEAGG

SEQ ID NO: 1264454 - protein, 18 aa, Mycobacterium
FGEEPVELTTGWDRWPTS

SEQ ID NO: 1264455 - protein, 24 aa, Mycobacterium
FGEGPRWFEGLVWFSDMLGEAVHT

SEQ ID NO: 1264456 - protein, 23 aa, Mycobacterium
FGEIDGRLYVDMRLIEGRDLEHL

SEQ ID NO: 1264457 - protein, 26 aa, Mycobacterium
FGELLGCAVPDGWPEFPESIEFTIDQ

SEQ ID NO: 1264458 - protein, 36 aa, Mycobacterium
FGELTQLAGVFGFLECIDLLSDYVLVCIDEFELDDP

SEQ ID NO: 1264459 - protein, 21 aa, Mycobacterium
FGEPARWERWFTASAQGSWLW

SEQ ID NO: 1264460 - protein, 18 aa, Mycobacterium
FGERCVELPQGVGSEDFS

SEQ ID NO: 1264461 - protein, 32 aa, Mycobacterium; identical to SEQ ID NO: 659050

SEQ ID NO: 1264462 - protein, 31 aa, Mycobacterium
FGEVMPAPIMSWMYECGNYRRFTQNVLVSLP

SEQ ID NO: 1264463 - protein, 23 aa, Mycobacterium
FGEVPEPFAVYAHHPGLMLTGAV

SEQ ID NO: 1264464 - protein, 17 aa, Mycobacterium
FGEWLPRGQGEDVVSGG

SEQ ID NO: 1264465 - protein, 26 aa, Mycobacterium
FGFAPLRLPPDLDFAALFHGVDERVP

SEQ ID NO: 1264466 - protein, 24 aa, Mycobacterium
FGFDRFRQTLARRLHLLEPLRYQL

SEQ ID NO: 1264467 - protein, 26 aa, Mycobacterium
FGGECHLDAPMVHRALAGLNLAGLDL

SEQ ID NO: 1264468 - protein, 18 aa, Mycobacterium
FGGEVERGLSMVDGVVLL

SEQ ID NO: 1264469 - protein, 22 aa, Mycobacterium
FGGGMMRCIGASFATMEMEVTL

SEQ ID NO: 1264470 - protein, 19 aa, Mycobacterium
FGGSTALSGGGIWVPGAPS

SEQ ID NO: 1264471 - protein, 18 aa, Mycobacterium
FGGTAVFSGRQWVIDPID

SEQ ID NO: 1264472 - protein, 26 aa, Mycobacterium
FGGVKRSGFGRELGALGIDEFVNKQV

SEQ ID NO: 1264473 - protein, 17 aa, Mycobacterium
FGHLCLDAPDVRAAHAF

SEQ ID NO: 1264474 - protein, 31 aa, Mycobacterium; identical to SEQ ID NO: 96675

SEQ ID NO: 1264475 - protein, 25 aa, Mycobacterium
FGHSITRELARLGVLGDRLTVAHAI

SEQ ID NO: 1264476 - protein, 18 aa, Mycobacterium
FGHTGLTDIVVWADPQRA

SEQ ID NO: 1264477 - protein, 25 aa, Mycobacterium
FGIDTANMFGFWDWVGGRYSVDSAI

SEQ ID NO: 1264478 - protein, 18 aa, Mycobacterium
FGIEYPLFVFTPSEKVAA

SEQ ID NO: 1264479 - protein, 17 aa, Mycobacterium
FGIITRVRVRVHPVPEA

SEQ ID NO: 1264480 - protein, 19 aa, Mycobacterium
FGINLADLGDRAELEARVG

SEQ ID NO: 1264481 - protein, 20 aa, Mycobacterium
FGIPEVKRGLVAAGGGLLRL

SEQ ID NO: 1264482 - protein, 22 aa, Mycobacterium
FGIPGGAVLPVYDPLFDSQKLR

SEQ ID NO: 1264483 - protein, 26 aa, Mycobacterium
FGISGEASFDYGAAFDRSRKVADGRV

SEQ ID NO: 1264484 - protein, 17 aa, Mycobacterium
FGIVKGLMTTVHAYTQD

SEQ ID NO: 1264485 - protein, 17 aa, Mycobacterium
FGIVLVEAMAAGTAVVA

SEQ ID NO: 1264486 - protein, 17 aa, Mycobacterium
FGIWALVIGHGDLGDVD

SEQ ID NO: 1264487 - protein, 27 aa, Mycobacterium
FGKNTYHGLSLLRHVKDLVNTGWPVLM

SEQ ID NO: 1264488 - protein, 21 aa, Mycobacterium
FGKVMLALPLLVGFPTAIDGR

SEQ ID NO: 1264489 - protein, 21 aa, Mycobacterium
FGLARVLDGLAPVIGDRARGS

SEQ ID NO: 1264490 - protein, 17 aa, Mycobacterium
FGLAYLFVSHDLSVVRH

SEQ ID NO: 1264491 - protein, 17 aa, Mycobacterium
FGLDKFPLWTGQPYDID

SEQ ID NO: 1264492 - protein, 22 aa, Mycobacterium
FGLDPGRIRPLFADYVAHARRW

SEQ ID NO: 1264493 - protein, 22 aa, Mycobacterium
FGLERLESGLARNTVSASDVDD

SEQ ID NO: 1264494 - protein, 17 aa, Mycobacterium
FGLGAADTCYLSMPLFH

SEQ ID NO: 1264495 - protein, 18 aa, Mycobacterium
FGLGCVAGAAGIARMHDY

SEQ ID NO: 1264496 - protein, 17 aa, Mycobacterium
FGLGCVAGAAGMARVHD

SEQ ID NO: 1264497 - protein, 27 aa, Mycobacterium
FGLGPSDVCYLSMPLFHSNAVMAGWAV

SEQ ID NO: 1264498 - protein, 19 aa, Mycobacterium
FGLLGPRFVDALGQNVFEG

SEQ ID NO: 1264499 - protein, 18 aa, Mycobacterium
FGLLPTFAPALADLQPLL

SEQ ID NO: 1264500 - protein, 18 aa, Mycobacterium
FGLLRAAAVPVMCLPGHR

SEQ ID NO: 1264501 - protein, 17 aa, Mycobacterium
FGLSGFGEEGDEFDPAL

SEQ ID NO: 1264502 - protein, 18 aa, Mycobacterium
FGMDSWFPNLKIYNRNGQ

SEQ ID NO: 1264503 - protein, 26 aa, Mycobacterium
FGMLLGFPGYHAFTHRPTFRAVSAGS

SEQ ID NO: 1264504 - protein, 19 aa, Mycobacterium
FGNVHIFAGYEFRTGYARK

SEQ ID NO: 1264505 - protein, 17 aa, Mycobacterium
FGPATVDDLKWWFGATL

SEQ ID NO: 1264506 - protein, 21 aa, Mycobacterium
FGPEPDAAVLMTRDYQADPSV

SEQ ID NO: 1264507 - protein, 25 aa, Mycobacterium
FGPEVLRRAAPLITDPRVRAVDYGI

SEQ ID NO: 1264508 - protein, 20 aa, Mycobacterium
FGPGCDRCVELTGEAAGTNR

SEQ ID NO: 1264509 - protein, 31 aa, Mycobacterium
FGPGDRLCIPVPFYHCFGMVMGNLGCTTHGA

SEQ ID NO: 1264510 - protein, 25 aa, Mycobacterium
FGPGGGKFGPGFGFGPGGRGGRRGG

SEQ ID NO: 1264511 - protein, 18 aa, Mycobacterium
FGPLEAREEIEVLATLAD

SEQ ID NO: 1264512 - protein, 25 aa, Mycobacterium
FGPQGRTRFRPHFFPFTEPSAEVDI

SEQ ID NO: 1264513 - protein, 26 aa, Mycobacterium
FGPVMSVRAPWLMRAGLLPRGSRQER

SEQ ID NO: 1264514 - protein, 20 aa, Mycobacterium
FGQRLEAFVVLTADAAATPE

SEQ ID NO: 1264515 - protein, 26 aa, Mycobacterium
FGRELFIDKVWDWKRESGGTIGGQMR

SEQ ID NO: 1264516 - protein, 23 aa, Mycobacterium
FGRPAEFAFRHPLIRAVAYESQL

SEQ ID NO: 1264517 - protein, 24 aa, Mycobacterium
FGRSEVRNFLVANALYWLQEYHID

SEQ ID NO: 1264518 - protein, 21 aa, Mycobacterium
FGRVDGRPVGIVANQPTQFAG

SEQ ID NO: 1264519 - protein, 27 aa, Mycobacterium
FGSFLIPRTEYRIDDVWNVVGLKATGS

SEQ ID NO: 1264520 - protein, 18 aa, Mycobacterium
FGSGIKLKVFEALRRSLP

SEQ ID NO: 1264521 - protein, 30 aa, Mycobacterium
FGSGVSPGFAELLAIVAATACDRVDKVTIA

SEQ ID NO: 1264522 - protein, 19 aa, Mycobacterium
FGSGYGGDSSWAHGTWKGG

SEQ ID NO: 1264523 - protein, 19 aa, Mycobacterium
FGSIPRYDNAFALSNFNSD

SEQ ID NO: 1264524 - protein, 29 aa, Mycobacterium
FGSLNLVGGLARSMAKAGYCDLKEFQKVG

SEQ ID NO: 1264525 - protein, 22 aa, Mycobacterium
FGSLPEGGRMAAVFAPADRVES

SEQ ID NO: 1264526 - protein, 23 aa, Mycobacterium
FGSLPEGGRMVAVFTTAERAEAM

SEQ ID NO: 1264527 - protein, 23 aa, Mycobacterium
FGSRQGLAQGYAMRLADRLVDQI

SEQ ID NO: 1264528 - protein, 18 aa, Mycobacterium
FGSYRRQLSLGDGVDTAA

SEQ ID NO: 1264529 - protein, 18 aa, Mycobacterium
FGTAAGPHPFPMMVRDFQ

SEQ ID NO: 1264530 - protein, 19 aa, Mycobacterium
FGTEAQKQEWLPLLASGKA

SEQ ID NO: 1264531 - protein, 21 aa, Mycobacterium
FGTEVDIVSGIGWDKVDPDNP

SEQ ID NO: 1264532 - protein, 18 aa, Mycobacterium
FGTGQAWVDTDGDGRWDV

SEQ ID NO: 1264533 - protein, 21 aa, Mycobacterium
FGTKIMRYMHDHGISEQTLAR

SEQ ID NO: 1264534 - protein, 20 aa, Mycobacterium
FGTPIFKLGGSPVKVVSSVS

SEQ ID NO: 1264535 - protein, 22 aa, Mycobacterium
FGTRFPGPLGLAAGFDKDGIGV

SEQ ID NO: 1264536 - protein, 26 aa, Mycobacterium
FGTTQRFGVPMGFGGPHAGYLAVHSK

SEQ ID NO: 1264537 - protein, 19 aa, Mycobacterium
FGTWHYWWQAHLLDNLVDA

SEQ ID NO: 1264538 - protein, 18 aa, Mycobacterium
FGVDSHIDDVRWTDIVSR

SEQ ID NO: 1264539 - protein, 22 aa, Mycobacterium
FGVEPPVALLLQGATLADLALD

SEQ ID NO: 1264540 - protein, 21 aa, Mycobacterium
FGVEPPVSLLLQGGSLDDVTA

SEQ ID NO: 1264541 - protein, 19 aa, Mycobacterium
FGVGQWRPGESVAAFVERI

SEQ ID NO: 1264542 - protein, 17 aa, Mycobacterium
FGVHAGMPLRSAARRCP

SEQ ID NO: 1264543 - protein, 23 aa, Mycobacterium
FGVQLSALVTFGSPITKNPNVPT

SEQ ID NO: 1264544 - protein, 18 aa, Mycobacterium
FGVQRLVGRVIWMHDDDT

SEQ ID NO: 1264545 - protein, 24 aa, Mycobacterium
FGVVAREAAALGVNIDFIRGVSDY

SEQ ID NO: 1264546 - protein, 18 aa, Mycobacterium
FGYACPLGSHARRLNPRD

SEQ ID NO: 1264547 - protein, 27 aa, Mycobacterium
FGYAEHRELLCASGADVVEFDPLCDPL

SEQ ID NO: 1264548 - protein, 19 aa, Mycobacterium
FGYRDCVGHPAWFEPAEWL

SEQ ID NO: 1264549 - protein, 25 aa, Mycobacterium
FGYRVSRYELELEYKVTINRLSGAA

SEQ ID NO: 1264550 - protein, 20 aa, Mycobacterium
FHAAPGCVRSASAFSQSQRW

SEQ ID NO: 1264551 - protein, 17 aa, Mycobacterium
FHAAWCWERTIDALQAL

SEQ ID NO: 1264552 - protein, 25 aa, Mycobacterium
FHAMYPRIDEWIALRRKVDPDGVFA

SEQ ID NO: 1264553 - protein, 17 aa, Mycobacterium
FHAWIFDMLAGVDLGPD

SEQ ID NO: 1264554 - protein, 20 aa, Mycobacterium
FHCAKAFLRSDAWQPETWNP

SEQ ID NO: 1264555 - protein, 20 aa, Mycobacterium
FHCDRCRSTFPDKVPDMPEP

SEQ ID NO: 1264556 - protein, 17 aa, Mycobacterium
FHCNLACDYCCVESSPQ

SEQ ID NO: 1264557 - protein, 18 aa, Mycobacterium
FHGDFDFSQALYSYDLRA

SEQ ID NO: 1264558 - protein, 17 aa, Mycobacterium
FHGRRLAEIDARHGGSV

SEQ ID NO: 1264559 - protein, 19 aa, Mycobacterium
FHGRVDMAFEVPPGADSQG

SEQ ID NO: 1264560 - protein, 17 aa, Mycobacterium
FHGSRFRRLAMVMEERN

SEQ ID NO: 1264561 - protein, 17 aa, Mycobacterium
FHLAGRMAAIVTSEAGR

SEQ ID NO: 1264562 - protein, 26 aa, Mycobacterium
FHLRNRLVVAALHWDGKISGLLASHL

SEQ ID NO: 1264563 - protein, 22 aa, Mycobacterium
FHMAGSGWALAGLWQGATTVVL

SEQ ID NO: 1264564 - protein, 18 aa, Mycobacterium
FHNFGYKAGILACLQTGA

SEQ ID NO: 1264565 - protein, 18 aa, Mycobacterium
FHNICRHRGNKLVWNDYP

SEQ ID NO: 1264566 - protein, 26 aa, Mycobacterium
FHNVARAAELLSWWRSTTPDYVEIAY

SEQ ID NO: 1264567 - protein, 28 aa, Mycobacterium
FHPDDWDSAEILECWTKELFDADGRQQA

SEQ ID NO: 1264568 - protein, 22 aa, Mycobacterium
FHPEHTEWGFAGYVRHFIDKPT

SEQ ID NO: 1264569 - protein, 19 aa, Mycobacterium
FHPELQFDKPYLLAMANAG

SEQ ID NO: 1264570 - protein, 18 aa, Mycobacterium
FHPSYRHAGAVRREIGVP

SEQ ID NO: 1264571 - protein, 24 aa, Mycobacterium
FHPTRLTVDLFRAARNALTTLEIR

SEQ ID NO: 1264572 - protein, 17 aa, Mycobacterium
FHQPAAVLIDLATLESL

SEQ ID NO: 1264573 - protein, 25 aa, Mycobacterium
FHQRASVRAALWPQAMTTLTTHDTK

SEQ ID NO: 1264574 - protein, 19 aa, Mycobacterium
FHREGFGAVGIDRLTTSIG

SEQ ID NO: 1264575 - protein, 23 aa, Mycobacterium
FHSSSHLLAATFERLLPQVTTPA

SEQ ID NO: 1264576 - protein, 25 aa, Mycobacterium
FHTFGYKAGLIASFIRGATMLPVSV

SEQ ID NO: 1264577 - protein, 17 aa, Mycobacterium
FHTLKLQTYLTAGPKEA

SEQ ID NO: 1264578 - protein, 19 aa, Mycobacterium
FHTRCPWASEVCASDEPAM

SEQ ID NO: 1264579 - protein, 18 aa, Mycobacterium
FHYTRRWLQKMTAIELDK

SEQ ID NO: 1264580 - protein, 17 aa, Mycobacterium
FIAEAWVSSNARLARYL

SEQ ID NO: 1264581 - protein, 21 aa, Mycobacterium
FIAEVLPKVGIARRLVDAGEL

SEQ ID NO: 1264582 - protein, 18 aa, Mycobacterium
FIAKEIFPGGSVPSEENI

SEQ ID NO: 1264583 - protein, 20 aa, Mycobacterium
FIALANRWPAELSLADHMAA

SEQ ID NO: 1264584 - protein, 27 aa, Mycobacterium
FIASIPAPVVTCLCGVINTVTKFFDNV

SEQ ID NO: 1264585 - protein, 18 aa, Mycobacterium
FIASIRASPELDEVEKDG

SEQ ID NO: 1264586 - protein, 21 aa, Mycobacterium
FIDAFVEFYHAPILHMKQATA

SEQ ID NO: 1264587 - protein, 24 aa, Mycobacterium
FIEMFTKLGGLMAERVTDLRDIRD

SEQ ID NO: 1264588 - protein, 17 aa, Mycobacterium
FIGRSGGAVVRVRSPRL

SEQ ID NO: 1264589 - protein, 27 aa, Mycobacterium
FILAGPDLRDVSGWTLDRPPHHLESSV

SEQ ID NO: 1264590 - protein, 24 aa, Mycobacterium
FILERKWGRWMGRWTAEEHLHAIA

SEQ ID NO: 1264591 - protein, 23 aa, Mycobacterium
FIMDEIYPGGRLPLAAQVTDAAT

SEQ ID NO: 1264592 - protein, 28 aa, Mycobacterium
FINCTNCGPRFTIIAALPYDRSSTTMAD

SEQ ID NO: 1264593 - protein, 18 aa, Mycobacterium
FINDDLLRWCQKRRITFT

SEQ ID NO: 1264594 - protein, 20 aa, Mycobacterium
FINEARWVRGAVPFQGDIGS

SEQ ID NO: 1264595 - protein, 21 aa, Mycobacterium
FIPDVGGTFILSRTPGLLGVH

SEQ ID NO: 1264596 - protein, 25 aa, Mycobacterium
FIPDVRRFGATYANYVGKPLSYILA

SEQ ID NO: 1264597 - protein, 25 aa, Mycobacterium
FIPPGVFLPSSARLVFSDPGLDKDF

SEQ ID NO: 1264598 - protein, 20 aa, Mycobacterium
FIPTRVAPSITERVPLMGAD

SEQ ID NO: 1264599 - protein, 18 aa, Mycobacterium
FIQRGSRWLAYKHQVSGE

SEQ ID NO: 1264600 - protein, 17 aa, Mycobacterium
FIRVPEVIAEMSTNRVL

SEQ ID NO: 1264601 - protein, 19 aa, Mycobacterium
FITPLPYGTGVDWLRNVQA

SEQ ID NO: 1264602 - protein, 18 aa, Mycobacterium
FIVADRAGKVFIDATRAG

SEQ ID NO: 1264603 - protein, 24 aa, Mycobacterium
FIVDEFTGRMLVGRRYNEGLHQAI

SEQ ID NO: 1264604 - protein, 32 aa, Mycobacterium
FIVFDFTISRLKSGIFLGTRWGEPGASMVPAP

SEQ ID NO: 1264605 - protein, 25 aa, Mycobacterium
FKAAFTRLGGRIAKRERGRYEIANV

SEQ ID NO: 1264606 - protein, 22 aa, Mycobacterium
FKAASYKAYLMCFGSTGMFEQD

SEQ ID NO: 1264607 - protein, 24 aa, Mycobacterium
FKADSYKAYLMCFGSTGMFEQDDV

SEQ ID NO: 1264608 - protein, 26 aa, Mycobacterium
FKALTRRGPHRVLRGDLGFAGLPGVV

SEQ ID NO: 1264609 - protein, 18 aa, Mycobacterium
FKATGSYSTYTVTLTVSD

SEQ ID NO: 1264610 - protein, 17 aa, Mycobacterium
FKDRPADVVSEVYTEGA

SEQ ID NO: 1264611 - protein, 23 aa, Mycobacterium
FKDVNCLPFAPARDDPFHGAGIL

SEQ ID NO: 1264612 - protein, 20 aa, Mycobacterium
FKDYDLAELREYIDWQPFFN

SEQ ID NO: 1264613 - protein, 17 aa, Mycobacterium
FKFAPANGVGYFEQLGW

SEQ ID NO: 1264614 - protein, 21 aa, Mycobacterium
FKFASELEFFLSATPPRQAWE

SEQ ID NO: 1264615 - protein, 22 aa, Mycobacterium
FKFTAALARREVTVWASDRSIH

SEQ ID NO: 1264616 - protein, 19 aa, Mycobacterium
FKGDERWRSLPTPEGNTFE

SEQ ID NO: 1264617 - protein, 21 aa, Mycobacterium
FKGGLRFHPSVYLGIVKFLGF

SEQ ID NO: 1264618 - protein, 21 aa, Mycobacterium
FKGLIFACWDPAAPDFDEYVG

SEQ ID NO: 1264619 - protein, 22 aa, Mycobacterium
FKGPEFDRRTVLDFDATPVSAG

SEQ ID NO: 1264620 - protein, 20 aa, Mycobacterium
FKGPEFDRRTVLDFEATPIT

SEQ ID NO: 1264621 - protein, 17 aa, Mycobacterium
FKHHGHRTAVSQRALQA

SEQ ID NO: 1264622 - protein, 17 aa, Mycobacterium
FKHPRPQLEVNLNRLGG

SEQ ID NO: 1264623 - protein, 21 aa, Mycobacterium
FKHVAEMFAELEAAALRSYPR

SEQ ID NO: 1264624 - protein, 23 aa, Mycobacterium
FKIARMEARAHAARAAYYDAAAL

SEQ ID NO: 1264625 - protein, 20 aa, Mycobacterium
FKKYRTALDYAQADRTELEE

SEQ ID NO: 1264626 - protein, 17 aa, Mycobacterium
FKLAAQGVRANTVSPGN

SEQ ID NO: 1264627 - protein, 18 aa, Mycobacterium
FKLAEAIRDAVPSTLLMT

SEQ ID NO: 1264628 - protein, 17 aa, Mycobacterium
FKLHEDWGTTPAAIDAC

SEQ ID NO: 1264629 - protein, 17 aa, Mycobacterium
FKLPKSVDFVDVLPRNP

SEQ ID NO: 1264630 - protein, 20 aa, Mycobacterium
FKLTGEIKPGVTATDVVLTV

SEQ ID NO: 1264631 - protein, 19 aa, Mycobacterium
FKPGSTVVAFPLMRAHGGV

SEQ ID NO: 1264632 - protein, 25 aa, Mycobacterium
FKPLYGGSLVTGWATLHGYPLGILA

SEQ ID NO: 1264633 - protein, 23 aa, Mycobacterium
FKPRNMLRLQDWIQGHARDLISE

SEQ ID NO: 1264634 - protein, 22 aa, Mycobacterium
FKPSELTPLMGQRLVEALLAGG

SEQ ID NO: 1264635 - protein, 22 aa, Mycobacterium
FKRGESAYDRYYGDPTNKPNPN

SEQ ID NO: 1264636 - protein, 19 aa, Mycobacterium
FKRIRGYEVDEANAVRVHS

SEQ ID NO: 1264637 - protein, 17 aa, Mycobacterium
FKRLTALQFEFGSTDHH

SEQ ID NO: 1264638 - protein, 19 aa, Mycobacterium
FKTCFDILPDDGRMTIQSS

SEQ ID NO: 1264639 - protein, 22 aa, Mycobacterium
FKTKTLQAALRRVYGSSTTTGE

SEQ ID NO: 1264640 - protein, 25 aa, Mycobacterium
FKVLLKELQSLCLNVEVLSSDGAAI

SEQ ID NO: 1264641 - protein, 25 aa, Mycobacterium
FKVPMSQLYEGYTFPEAGEQGSTNP

SEQ ID NO: 1264642 - protein, 18 aa, Mycobacterium
FLADNGYPLADIERVILG

SEQ ID NO: 1264643 - protein, 17 aa, Mycobacterium
FLAEGACVGVLDRSEGD

SEQ ID NO: 1264644 - protein, 17 aa, Mycobacterium
FLAEGARVVIADIDRER

SEQ ID NO: 1264645 - protein, 26 aa, Mycobacterium
FLAEMPGYRGWQWAVVVAACPGAAHA

SEQ ID NO: 1264646 - protein, 18 aa, Mycobacterium
FLALAAIRTKAVRQGDPL

SEQ ID NO: 1264647 - protein, 21 aa, Mycobacterium
FLANVVRLYRGEAVETVAGSD

SEQ ID NO: 1264648 - protein, 24 aa, Mycobacterium
FLAPEPMAPWPGVREAREHGPLPP

SEQ ID NO: 1264649 - protein, 19 aa, Mycobacterium
FLAPVFRDALGVTWGGGRQ

SEQ ID NO: 1264650 - protein, 23 aa, Mycobacterium
FLARNRLYSTWFRADEAKGRQLL

SEQ ID NO: 1264651 - protein, 23 aa, Mycobacterium
FLARNRLYYTWFRSDEPRGAQLL

SEQ ID NO: 1264652 - protein, 18 aa, Mycobacterium
FLASWDWPAYLQRFRRTH

SEQ ID NO: 1264653 - protein, 17 aa, Mycobacterium
FLCGSVIFVDGGSDAYF

SEQ ID NO: 1264654 - protein, 18 aa, Mycobacterium
FLCGSVIFVDGGTDSLFR

SEQ ID NO: 1264655 - protein, 23 aa, Mycobacterium
FLDDRLTPELRRAGRLMTSVYAD

SEQ ID NO: 1264656 - protein, 17 aa, Mycobacterium
FLDELPLNATGKVMKDR

SEQ ID NO: 1264657 - protein, 18 aa, Mycobacterium
FLDELQEAVIRGVQVRLG

SEQ ID NO: 1264658 - protein, 19 aa, Mycobacterium
FLDELRAAGADVVPIRVYR

SEQ ID NO: 1264659 - protein, 18 aa, Mycobacterium
FLDELRAAGAEVVPIRVY

SEQ ID NO: 1264660 - protein, 19 aa, Mycobacterium
FLDERIAHWAQVKPDDEAM

SEQ ID NO: 1264661 - protein, 19 aa, Mycobacterium
FLDGLAWRLREQGISGVSI

SEQ ID NO: 1264662 - protein, 25 aa, Mycobacterium
FLDRCGPGLHHVCVALAADEFDAAV

SEQ ID NO: 1264663 - protein, 24 aa, Mycobacterium
FLDSLVDSIRLCLIVVDQQMRVVV

SEQ ID NO: 1264664 - protein, 21 aa, Mycobacterium
FLDTVARRVGFELKMREDKLD

SEQ ID NO: 1264665 - protein, 25 aa, Mycobacterium
FLDTVPIEPIWLCPLRLRDDRDWPL

SEQ ID NO: 1264666 - protein, 18 aa, Mycobacterium
FLEELAVFRDAVVQHAEL

SEQ ID NO: 1264667 - protein, 17 aa, Mycobacterium
FLEEYQHRLPFDRLAAA

SEQ ID NO: 1264668 - protein, 24 aa, Mycobacterium
FLEGFTLRTNRTFQEQYLAGGGRN

SEQ ID NO: 1264669 - protein, 32 aa, Mycobacterium
FLEHGLRDIGRWRIPVILGLRSDVGEDDVRAV

SEQ ID NO: 1264670 - protein, 21 aa, Mycobacterium
FLEKIALPAFVGMQEPITVFA

SEQ ID NO: 1264671 - protein, 28 aa, Mycobacterium
FLEKLSPWLEFVWKPGYADYYPELPGGS

SEQ ID NO: 1264672 - protein, 19 aa, Mycobacterium
FLERCGPGLHHVCREATDP

SEQ ID NO: 1264673 - protein, 17 aa, Mycobacterium
FLERLRVPTRVVMLANC

SEQ ID NO: 1264674 - protein, 17 aa, Mycobacterium
FLFKLDLDEETRRRAEI

SEQ ID NO: 1264675 - protein, 31 aa, Mycobacterium
FLGGWLGPFLWLRERMPGINRQVYRLLGRLK

SEQ ID NO: 1264676 - protein, 25 aa, Mycobacterium
FLHGGRFSVLLAHHLGAHLEQLRPG

SEQ ID NO: 1264677 - protein, 30 aa, Mycobacterium
FLHPEQRKYVDLDFSGAFRLSGGAGTGKTV

SEQ ID NO: 1264678 - protein, 17 aa, Mycobacterium
FLHRARLRTIQHPGNAP

SEQ ID NO: 1264679 - protein, 25 aa, Mycobacterium
FLIDNLRMALNYGVNKARFPQAVPV

SEQ ID NO: 1264680 - protein, 17 aa, Mycobacterium
FLIGGVIGRFHRVGDIQ

SEQ ID NO: 1264681 - protein, 30 aa, Mycobacterium
FLIGYAIAHLRYFAGLARTYAFQSSGPLME

SEQ ID NO: 1264682 - protein, 18 aa, Mycobacterium
FLLGIGVSHAPLIDSNEP

SEQ ID NO: 1264683 - protein, 18 aa, Mycobacterium
FLLGLKLARNLLASGEGR

SEQ ID NO: 1264684 - protein, 21 aa, Mycobacterium
FLLNRNRLNVAVSRAKYLAVI

SEQ ID NO: 1264685 - protein, 21 aa, Mycobacterium
FLLPGEWRIQGHVAYVDDVAA

SEQ ID NO: 1264686 - protein, 17 aa, Mycobacterium
FLLTRPLLTAIRRTEPT

SEQ ID NO: 1264687 - protein, 23 aa, Mycobacterium
FLMSVGDLVLGWLLQQQAAVAIE

SEQ ID NO: 1264688 - protein, 33 aa, Mycobacterium
FLNGGQTCMAWTRMLVPESRYGEALDLIGAAVS

SEQ ID NO: 1264689 - protein, 18 aa, Mycobacterium
FLPHGYDFTDPDVLLKGI

SEQ ID NO: 1264690 - protein, 32 aa, Mycobacterium
FLPNDVVGVGMLRKAGYNVVTWDPRGEWHSEG

SEQ ID NO: 1264691 - protein, 22 aa, Mycobacterium
FLPSVPNLLLLASEMEAQRNHV

SEQ ID NO: 1264692 - protein, 23 aa, Mycobacterium
FLQLRGAIAAVFRSWHSARAGAY

SEQ ID NO: 1264693 - protein, 23 aa, Mycobacterium
FLQPRVEPEIALIMKRDLAGPGV

SEQ ID NO: 1264694 - protein, 22 aa, Mycobacterium
FLRAADLARAITFVAETPRGGF

SEQ ID NO: 1264695 - protein, 17 aa, Mycobacterium
FLRGVLGFKKSDEIYTF

SEQ ID NO: 1264696 - protein, 17 aa, Mycobacterium
FLRLARAGIYTSREVQV

SEQ ID NO: 1264697 - protein, 19 aa, Mycobacterium
FLRLSALIRAAASRPSHGP

SEQ ID NO: 1264698 - protein, 19 aa, Mycobacterium
FLRRARRALPGDPDFGDPL

SEQ ID NO: 1264699 - protein, 20 aa, Mycobacterium
FLRTRREALTPADVGLPTGR

SEQ ID NO: 1264700 - protein, 20 aa, Mycobacterium
FLRVFPTFAAPMLRDELARR

SEQ ID NO: 1264701 - protein, 21 aa, Mycobacterium
FLSADCIYLDVPVGPAAAARG

SEQ ID NO: 1264702 - protein, 26 aa, Mycobacterium
FLSATPPRQAWELGYQDLKMLSDYRS

SEQ ID NO: 1264703 - protein, 28 aa, Mycobacterium
FLSDIHLWVRLLGCGDFYGIPATHASFR

SEQ ID NO: 1264704 - protein, 23 aa, Mycobacterium
FLSDILLWPRLIDKYRGTMTAAP

SEQ ID NO: 1264705 - protein, 17 aa, Mycobacterium
FLSGRPGRAAALRDFIA

SEQ ID NO: 1264706 - protein, 19 aa, Mycobacterium
FLSVQGIDWRTATFEHLAD

SEQ ID NO: 1264707 - protein, 23 aa, Mycobacterium
FLTELFDLPSPKPFGHFLVVSVG

SEQ ID NO: 1264708 - protein, 28 aa, Mycobacterium
FLTPDGRPFFCGTYYPKASFLQLLAAVV

SEQ ID NO: 1264709 - protein, 17 aa, Mycobacterium
FLTRLAAAAPHIRGIGP

SEQ ID NO: 1264710 - protein, 18 aa, Mycobacterium
FLVESGYLVPHWPQPWGR

SEQ ID NO: 1264711 - protein, 18 aa, Mycobacterium
FLYFPSENHWVLSPQHAK

SEQ ID NO: 1264712 - protein, 20 aa, Mycobacterium
FLYFSPREYLVVFGSPTGTQ

SEQ ID NO: 1264713 - protein, 18 aa, Mycobacterium
FLYLDRLIGRHARAAKRA

SEQ ID NO: 1264714 - protein, 33 aa, Mycobacterium
FLYTNFEELCGILARYDVTFSLGDGLRPGSIAD

SEQ ID NO: 1264715 - protein, 19 aa, Mycobacterium
FMALTGIGYYPRLGVKDAY

SEQ ID NO: 1264716 - protein, 27 aa, Mycobacterium
FMEVAKLRAGRLLWSELVSQFEPKSAK

SEQ ID NO: 1264717 - protein, 23 aa, Mycobacterium
FMFSPDNRPAFSGFRDDVKTIEI

SEQ ID NO: 1264718 - protein, 21 aa, Mycobacterium
FMHVLPVGWVEPVDISNAVLF

SEQ ID NO: 1264719 - protein, 25 aa, Mycobacterium
FMLKQARVPAARMGRPDEIASLIAY

SEQ ID NO: 1264720 - protein, 17 aa, Mycobacterium
FMQCERMQVPSWQYPGG

SEQ ID NO: 1264721 - protein, 21 aa, Mycobacterium
FMRDVPCPECDGTRLKPEILA

SEQ ID NO: 1264722 - protein, 25 aa, Mycobacterium
FMRGPGEAPGLFALEMAMDELAYAL

SEQ ID NO: 1264723 - protein, 18 aa, Mycobacterium
FMRQWQFGEFRGEDAGTP

SEQ ID NO: 1264724 - protein, 19 aa, Mycobacterium
FMRSFFESMFVPSSDPAIR

SEQ ID NO: 1264725 - protein, 17 aa, Mycobacterium
FMSAYARMQQFVIDAIQ

SEQ ID NO: 1264726 - protein, 18 aa, Mycobacterium
FMVNWPYVLAAARSAAEE

SEQ ID NO: 1264727 - protein, 22 aa, Mycobacterium
FMWRLADRHIDEFIADGKCEFL

SEQ ID NO: 1264728 - protein, 30 aa, Mycobacterium
FNAFPASYWRRWSILEAVVLRVELTGSARV

SEQ ID NO: 1264729 - protein, 25 aa, Mycobacterium
FNAFPASYWRRWSTLTSVVLRVELT

SEQ ID NO: 1264730 - protein, 22 aa, Mycobacterium
FNAGEKVVLWYPAANRDPAVFD

SEQ ID NO: 1264731 - protein, 20 aa, Mycobacterium
FNALDEWGRFDEAFAALRGW

SEQ ID NO: 1264732 - protein, 21 aa, Mycobacterium
FNALDIELDFALAPPPVPPFH

SEQ ID NO: 1264733 - protein, 27 aa, Mycobacterium
FNDGEVVWRETMEWLDRHVKGDESIDP

SEQ ID NO: 1264734 - protein, 19 aa, Mycobacterium
FNDVVRWCADVGVSIQGST

SEQ ID NO: 1264735 - protein, 20 aa, Mycobacterium
FNDWHYRYLLQELLETGTGD

SEQ ID NO: 1264736 - protein, 20 aa, Mycobacterium
FNEPLPALNSFILPGGTPLS

SEQ ID NO: 1264737 - protein, 18 aa, Mycobacterium
FNETIAWRHELARLETHG

SEQ ID NO: 1264738 - protein, 20 aa, Mycobacterium
FNGDKGFGFIAPDGGAPDVF

SEQ ID NO: 1264739 - protein, 17 aa, Mycobacterium
FNGPRMSIAKLVATADG

SEQ ID NO: 1264740 - protein, 26 aa, Mycobacterium
FNIEPRPDQSFEFTVDVPGQVDIELH

SEQ ID NO: 1264741 - protein, 24 aa, Mycobacterium
FNLCSGSIGMCEHAFYEAINHANN

SEQ ID NO: 1264742 - protein, 17 aa, Mycobacterium
FNLDEMPNPVASIYRTR

SEQ ID NO: 1264743 - protein, 19 aa, Mycobacterium
FNMPVAYKRFADIAQAMGV

SEQ ID NO: 1264744 - protein, 20 aa, Mycobacterium
FNNLEVCVYAAPTQSVIGGP

SEQ ID NO: 1264745 - protein, 20 aa, Mycobacterium
FNPHGGFVYLLWGEDPNTPL

SEQ ID NO: 1264746 - protein, 18 aa, Mycobacterium
FNRLPRKLVDRVLPAPGT

SEQ ID NO: 1264747 - protein, 17 aa, Mycobacterium
FNSLFLDPYLWKLQVGG

SEQ ID NO: 1264748 - protein, 18 aa, Mycobacterium
FNSSIFTEQVWFLGDALN

SEQ ID NO: 1264749 - protein, 17 aa, Mycobacterium
FNVEGLATVIPFHRAVV

SEQ ID NO: 1264750 - protein, 18 aa, Mycobacterium
FNVMLPWSKEVSLPAPGE

SEQ ID NO: 1264751 - protein, 17 aa, Mycobacterium
FNVQQIVTFGSPVRNDL

SEQ ID NO: 1264752 - protein, 21 aa, Mycobacterium
FNYEAVVEFSERLAALLPDPL

SEQ ID NO: 1264753 - protein, 19 aa, Mycobacterium
FPADAGRHGMSVDRLRAAL

SEQ ID NO: 1264754 - protein, 24 aa, Mycobacterium
FPAEQFDRLVAINIGGMYWTTRTA

SEQ ID NO: 1264755 - protein, 20 aa, Mycobacterium
FPAGMLLVFEPVVWQDGTGG

SEQ ID NO: 1264756 - protein, 22 aa, Mycobacterium
FPARTCSNGVFKRHSQIDRPCL

SEQ ID NO: 1264757 - protein, 17 aa, Mycobacterium
FPAVALAREAGRGGGCL

SEQ ID NO: 1264758 - protein, 18 aa, Mycobacterium
FPDAKGFSARNLKYMRAF

SEQ ID NO: 1264759 - protein, 21 aa, Mycobacterium
FPDAKLGIGPPITDGFYYDFE

SEQ ID NO: 1264760 - protein, 17 aa, Mycobacterium
FPDARLAAEPVYKPNLT

SEQ ID NO: 1264761 - protein, 21 aa, Mycobacterium
FPDGPAPAGLVIEDIVVGDGP

SEQ ID NO: 1264762 - protein, 24 aa, Mycobacterium
FPDKAELLGAAIVRLNDAFWSESR

SEQ ID NO: 1264763 - protein, 17 aa, Mycobacterium
FPDMPVDGILVGTAAMA

SEQ ID NO: 1264764 - protein, 26 aa, Mycobacterium
FPDQMLAYNCSPSFNWKKHLDDATIA

SEQ ID NO: 1264765 - protein, 27 aa, Mycobacterium
FPDQMLAYNCSPSFNWRKHLDDATIAK

SEQ ID NO: 1264766 - protein, 28 aa, Mycobacterium
FPDRIGRLEALPGWAWNTFDAQWDRGFR

SEQ ID NO: 1264767 - protein, 20 aa, Mycobacterium
FPEEIGKMGFVFNFITYGGH

SEQ ID NO: 1264768 - protein, 22 aa, Mycobacterium
FPEELKGAAPRIWYEDGAYMVG

SEQ ID NO: 1264769 - protein, 20 aa, Mycobacterium
FPEFQRVGLEMIKAQGGIFG

SEQ ID NO: 1264770 - protein, 17 aa, Mycobacterium
FPEGKRPAYPLKEIRHW

SEQ ID NO: 1264771 - protein, 17 aa, Mycobacterium
FPELDWTSRSKFEQAEC

SEQ ID NO: 1264772 - protein, 23 aa, Mycobacterium
FPELGLDSMMAMNLLRDAKALVR

SEQ ID NO: 1264773 - protein, 20 aa, Mycobacterium
FPEMSLTAALARWAEDVLAD

SEQ ID NO: 1264774 - protein, 17 aa, Mycobacterium
FPFTPADPLIVARTNPV

SEQ ID NO: 1264775 - protein, 26 aa, Mycobacterium
FPGACAGCGETPYLKLLSQLFGDRLM

SEQ ID NO: 1264776 - protein, 20 aa, Mycobacterium
FPGMARELFETEPVFADAVT

SEQ ID NO: 1264777 - protein, 21 aa, Mycobacterium
FPGMRLMESCVLNIKNKSHSV

SEQ ID NO: 1264778 - protein, 20 aa, Mycobacterium
FPGPEAIVVACAMRAADGFI

SEQ ID NO: 1264779 - protein, 17 aa, Mycobacterium
FPGPQLSSPDGRGPVLI

SEQ ID NO: 1264780 - protein, 18 aa, Mycobacterium
FPGVAAVALVADINGNAG

SEQ ID NO: 1264781 - protein, 17 aa, Mycobacterium
FPHHEFSAAHAECVTGE

SEQ ID NO: 1264782 - protein, 25 aa, Mycobacterium
FPIVSRVASLTGLPVRLGGDGLCMA

SEQ ID NO: 1264783 - protein, 23 aa, Mycobacterium
FPLFKPKPLFYRQPIYYMSNHLS

SEQ ID NO: 1264784 - protein, 21 aa, Mycobacterium
FPLIRRYALAYHVVFIPSQEV

SEQ ID NO: 1264785 - protein, 24 aa, Mycobacterium
FPLMKARGGGRIINFYSIDADNGN

SEQ ID NO: 1264786 - protein, 24 aa, Mycobacterium
FPLPRELVGEGSLFLLKVVGESMI

SEQ ID NO: 1264787 - protein, 17 aa, Mycobacterium
FPLSGLVSAGLPDYSTR

SEQ ID NO: 1264788 - protein, 18 aa, Mycobacterium
FPMDEFDTAYDVFGDAAH

SEQ ID NO: 1264789 - protein, 26 aa, Mycobacterium
FPMMVRDFQRVIGLEARAQMLDQAGR

SEQ ID NO: 1264790 - protein, 17 aa, Mycobacterium
FPNCGHWVMIEAKAAFE

SEQ ID NO: 1264791 - protein, 25 aa, Mycobacterium
FPNLEILIYHGWYLLYRYWPTSHST

SEQ ID NO: 1264792 - protein, 21 aa, Mycobacterium
FPNYRRDALEQTPIRSIMAFQ

SEQ ID NO: 1264793 - protein, 22 aa, Mycobacterium
FPPERELAARFGVARETVRQAL

SEQ ID NO: 1264794 - protein, 18 aa, Mycobacterium
FPPIRTWHEPNLRNPGGG

SEQ ID NO: 1264795 - protein, 20 aa, Mycobacterium
FPPPNKYVAPIAFNVVPLAG

SEQ ID NO: 1264796 - protein, 21 aa, Mycobacterium
FPQIGRVSLWNNRRSMNEPWL

SEQ ID NO: 1264797 - protein, 20 aa, Mycobacterium
FPQVEGRRVVISGDRASLEP

SEQ ID NO: 1264798 - protein, 20 aa, Mycobacterium
FPRAMMGPGAHEMVGPEALK

SEQ ID NO: 1264799 - protein, 25 aa, Mycobacterium
FPRCSRDLCEGRLSLDQVGVIAERA

SEQ ID NO: 1264800 - protein, 19 aa, Mycobacterium
FPSGMLLVFEPVVWEDGTG

SEQ ID NO: 1264801 - protein, 23 aa, Mycobacterium
FPSSREYSVRYGLSEKRQSRLAE

SEQ ID NO: 1264802 - protein, 18 aa, Mycobacterium
FPTLPSWISLRLLENRTF

SEQ ID NO: 1264803 - protein, 18 aa, Mycobacterium
FPTPAPCGKTPLTAKGLT

SEQ ID NO: 1264804 - protein, 18 aa, Mycobacterium
FPTQVFLTLFGLPLEMRD

SEQ ID NO: 1264805 - protein, 19 aa, Mycobacterium
FPVIGHPGASLGAAVIAAI

SEQ ID NO: 1264806 - protein, 20 aa, Mycobacterium
FPVLSDFWPHGEIARAYGVF

SEQ ID NO: 1264807 - protein, 17 aa, Mycobacterium
FPVTVGWIHAIRRAQSR

SEQ ID NO: 1264808 - protein, 17 aa, Mycobacterium
FPVVLEAVRECLQDVYD

SEQ ID NO: 1264809 - protein, 17 aa, Mycobacterium
FPWLKSRLPSLWTNSYF

SEQ ID NO: 1264810 - protein, 24 aa, Mycobacterium
FQAEARQLLDLMIHSVYSNKDSFL

SEQ ID NO: 1264811 - protein, 23 aa, Mycobacterium
FQAELRGFLARVVTDDVIERDRR

SEQ ID NO: 1264812 - protein, 23 aa, Mycobacterium
FQAKKGSLNQAWVVSTEDELNRA

SEQ ID NO: 1264813 - protein, 19 aa, Mycobacterium
FQALLKARPAAGDMELGNR

SEQ ID NO: 1264814 - protein, 18 aa, Mycobacterium
FQDYLIKMAQVITWFSHD

SEQ ID NO: 1264815 - protein, 28 aa, Mycobacterium
FQELMPDVLHWLGIRKIHRFVSMSNMKY

SEQ ID NO: 1264816 - protein, 20 aa, Mycobacterium
FQELNGFWRDDGFVPADAVH

SEQ ID NO: 1264817 - protein, 22 aa, Mycobacterium
FQGDQLPGYGWVFPMGNGIFNI

SEQ ID NO: 1264818 - protein, 18 aa, Mycobacterium
FQHFNLVGRLSCLENVLI

SEQ ID NO: 1264819 - protein, 25 aa, Mycobacterium
FQKLLHGVARLFGLAQRDNITVTIP

SEQ ID NO: 1264820 - protein, 17 aa, Mycobacterium
FQNIRLFGEMTALENVM

SEQ ID NO: 1264821 - protein, 25 aa, Mycobacterium
FQPDVARDFMVRAASLFHVDITMRG

SEQ ID NO: 1264822 - protein, 17 aa, Mycobacterium
FQPGYEGVTLTQPDGNV

SEQ ID NO: 1264823 - protein, 18 aa, Mycobacterium
FQQFNLVGRLSCLENVLI

SEQ ID NO: 1264824 - protein, 17 aa, Mycobacterium
FQRHGRPLGTGRSTRTI

SEQ ID NO: 1264825 - protein, 19 aa, Mycobacterium
FQRMLEVVARVGIAVTGSR

SEQ ID NO: 1264826 - protein, 20 aa, Mycobacterium
FQRTPGWVLPRVNFRHPAWA

SEQ ID NO: 1264827 - protein, 17 aa, Mycobacterium
FQSTYKRNTLYFVDPTG

SEQ ID NO: 1264828 - protein, 21 aa, Mycobacterium
FQTCRAAAPLMARQGSGAIVN

SEQ ID NO: 1264829 - protein, 18 aa, Mycobacterium
FQTFGFAFGREDIWEPEE

SEQ ID NO: 1264830 - protein, 20 aa, Mycobacterium
FQTPTIPVLYFLDTRTNRGY

SEQ ID NO: 1264831 - protein, 22 aa, Mycobacterium
FQVHSLHGYFLRAGDARSPSVY

SEQ ID NO: 1264832 - protein, 19 aa, Mycobacterium
FQWSEIRDGIYGQTLVTRE

SEQ ID NO: 1264833 - protein, 19 aa, Mycobacterium
FQYAPLRFFPSQAHILGIA

SEQ ID NO: 1264834 - protein, 19 aa, Mycobacterium
FQYRLGQLDIRLASVRALA

SEQ ID NO: 1264835 - protein, 25 aa, Mycobacterium
FQYRTRELLPWGNLRRLLRTAHHST

SEQ ID NO: 1264836 - protein, 21 aa, Mycobacterium
FRAAARRGSPVLLKGPTGCGK

SEQ ID NO: 1264837 - protein, 18 aa, Mycobacterium
FRADAGPMVGEPSYTALV

SEQ ID NO: 1264838 - protein, 18 aa, Mycobacterium
FRADVIAVARKGEAPLRQ

SEQ ID NO: 1264839 - protein, 21 aa, Mycobacterium
FRAGPWAAAPRRAHTTSPDDS

SEQ ID NO: 1264840 - protein, 19 aa, Mycobacterium
FRAHCLRQLHEGLCAEQER

SEQ ID NO: 1264841 - protein, 19 aa, Mycobacterium
FRAHGYRSTSVDDIVEAAA

SEQ ID NO: 1264842 - protein, 23 aa, Mycobacterium
FRANPWLADHMSKALAVLTEDAG

SEQ ID NO: 1264843 - protein, 19 aa, Mycobacterium
FRASQWRHKAVELAAHDLL

SEQ ID NO: 1264844 - protein, 25 aa, Mycobacterium
FRATNYGGGLFDVLGVTRTLSVYVT

SEQ ID NO: 1264845 - protein, 18 aa, Mycobacterium
FRDALALLAGGEHLFLTG

SEQ ID NO: 1264846 - protein, 17 aa, Mycobacterium
FRDAQRIPVSDEQLEAD

SEQ ID NO: 1264847 - protein, 24 aa, Mycobacterium
FRDELKLPLILLGGITNRDTMDRA

SEQ ID NO: 1264848 - protein, 17 aa, Mycobacterium
FRDELRTFYRTKIPAEI

SEQ ID NO: 1264849 - protein, 24 aa, Mycobacterium
FRDGLPWRYVGVLHEYAECGGPCT

SEQ ID NO: 1264850 - protein, 26 aa, Mycobacterium
FRDLAAAIARCRRLLDLDADPEAVVD

SEQ ID NO: 1264851 - protein, 17 aa, Mycobacterium
FRDPWTFDVRRHPNPHV

SEQ ID NO: 1264852 - protein, 28 aa, Mycobacterium
FRDRRIGWSDSWVKAAPGANPYARLLSG

SEQ ID NO: 1264853 - protein, 17 aa, Mycobacterium
FRDYFKAVYGPTIAAYR

SEQ ID NO: 1264854 - protein, 17 aa, Mycobacterium
FREHLHGLLAGAVAVLP

SEQ ID NO: 1264855 - protein, 18 aa, Mycobacterium
FREYWKRNYGPTIAAYRF

SEQ ID NO: 1264856 - protein, 23 aa, Mycobacterium
FRFFAAPGTWTLRALSPAGNGDA

SEQ ID NO: 1264857 - protein, 19 aa, Mycobacterium
FRFNAIIDEEMAKSGVHGP

SEQ ID NO: 1264858 - protein, 17 aa, Mycobacterium
FRFNAVIDEEIARYGGP

SEQ ID NO: 1264859 - protein, 17 aa, Mycobacterium
FRGAEMIAEKWDISRED

SEQ ID NO: 1264860 - protein, 18 aa, Mycobacterium
FRGITDWIIGGIRGGEYL

SEQ ID NO: 1264861 - protein, 22 aa, Mycobacterium
FRGKYRGSEAFRYAEDAVAQIE

SEQ ID NO: 1264862 - protein, 26 aa, Mycobacterium
FRGTGKYYSGVKWTWYRPIYAGRPVL

SEQ ID NO: 1264863 - protein, 22 aa, Mycobacterium
FRIKIDGCVGQSFIRSYAILTH

SEQ ID NO: 1264864 - protein, 21 aa, Mycobacterium
FRKCIECFLCQNVCHVNRDHE

SEQ ID NO: 1264865 - protein, 21 aa, Mycobacterium
FRLEEDESWFAGMELDTPLSP

SEQ ID NO: 1264866 - protein, 23 aa, Mycobacterium
FRLLQRLGADVAEYGFVETSAKQ

SEQ ID NO: 1264867 - protein, 21 aa, Mycobacterium
FRLSAYADRLLALYADHPEFI

SEQ ID NO: 1264868 - protein, 17 aa, Mycobacterium
FRLTRVVPTVAPISLIE

SEQ ID NO: 1264869 - protein, 20 aa, Mycobacterium
FRMIGATGRVYLSGSESDVR

SEQ ID NO: 1264870 - protein, 17 aa, Mycobacterium
FRMTRVIPTASPLSIVE

SEQ ID NO: 1264871 - protein, 29 aa, Mycobacterium
FRMWGSSDLRRWLPLDMRRPFKSTLVTLD

SEQ ID NO: 1264872 - protein, 32 aa, Mycobacterium
FRNRHKPWSGSKWAVGLAVTLDDDRRLAITQD

SEQ ID NO: 1264873 - protein, 17 aa, Mycobacterium
FRNVAIVAHVDHGKTTL

SEQ ID NO: 1264874 - protein, 18 aa, Mycobacterium
FRPADVVIYGTGFRATDF

SEQ ID NO: 1264875 - protein, 18 aa, Mycobacterium
FRPDRRWGGDNTDAIYYM

SEQ ID NO: 1264876 - protein, 21 aa, Mycobacterium
FRPERRGEMGALLLELAHELT

SEQ ID NO: 1264877 - protein, 24 aa, Mycobacterium
FRPGPGRRLGVLVDHLVAGSKEAR

SEQ ID NO: 1264878 - protein, 20 aa, Mycobacterium
FRPGSSPAYHIEHLERNRPI

SEQ ID NO: 1264879 - protein, 30 aa, Mycobacterium; identical to SEQ ID NO: 619259

SEQ ID NO: 1264880 - protein, 20 aa, Mycobacterium
FRPMAPDPDGSIAFQAAQEL

SEQ ID NO: 1264881 - protein, 20 aa, Mycobacterium
FRPQFFAAMRQLCDEFDSLL

SEQ ID NO: 1264882 - protein, 20 aa, Mycobacterium
FRPRKSFGQNFVHDANTVRR

SEQ ID NO: 1264883 - protein, 18 aa, Mycobacterium
FRQRYWARNHVGWRHMAA

SEQ ID NO: 1264884 - protein, 18 aa, Mycobacterium
FRRAAALITQHTSRDDTG

SEQ ID NO: 1264885 - protein, 19 aa, Mycobacterium
FRRAFSWLPSQLASQSDDP

SEQ ID NO: 1264886 - protein, 21 aa, Mycobacterium
FRRARDSAPSLVFLDEIDALA

SEQ ID NO: 1264887 - protein, 17 aa, Mycobacterium
FRRCVYVAPFWEDDFKK

SEQ ID NO: 1264888 - protein, 18 aa, Mycobacterium
FRRFCLDSPRLAQVMFSR

SEQ ID NO: 1264889 - protein, 18 aa, Mycobacterium
FRRGMPRSSMTVEQFLTD

SEQ ID NO: 1264890 - protein, 17 aa, Mycobacterium
FRRHRVLHQMIIDEPGL

SEQ ID NO: 1264891 - protein, 24 aa, Mycobacterium
FRRIFADRFFYILYFQDRGPADAE

SEQ ID NO: 1264892 - protein, 23 aa, Mycobacterium
FRRIGNLGLNWLVNCLFGTEFSD

SEQ ID NO: 1264893 - protein, 22 aa, Mycobacterium
FRRNIWVSPFWEGCVSDVVNTV

SEQ ID NO: 1264894 - protein, 19 aa, Mycobacterium
FRRQVAPAYLRRNQEDVLT

SEQ ID NO: 1264895 - protein, 20 aa, Mycobacterium
FRRRFAAELFEGYGSSEGGA

SEQ ID NO: 1264896 - protein, 19 aa, Mycobacterium
FRRRVFADAVLTWVTVNSA

SEQ ID NO: 1264897 - protein, 21 aa, Mycobacterium
FRRVVRRGGMLVVGFFEGACV

SEQ ID NO: 1264898 - protein, 17 aa, Mycobacterium
FRSALEPHEAALLQSLV

SEQ ID NO: 1264899 - protein, 26 aa, Mycobacterium
FRSARAEPFPVFTFFRDYNRYLSRGA

SEQ ID NO: 1264900 - protein, 24 aa, Mycobacterium
FRSESWPAPVPARMLPRYAQRFLG

SEQ ID NO: 1264901 - protein, 21 aa, Mycobacterium
FRSIWARHEVQGFEDRVKTIE

SEQ ID NO: 1264902 - protein, 24 aa, Mycobacterium
FRSLNGRSGRRFGREWSSGQTVGG

SEQ ID NO: 1264903 - protein, 19 aa, Mycobacterium
FRSVLFFPVTPMTPSGAVD

SEQ ID NO: 1264904 - protein, 18 aa, Mycobacterium
FRTADGVLERLPHGVFVQ

SEQ ID NO: 1264905 - protein, 17 aa, Mycobacterium
FRTIHRYALPNRFTVAK

SEQ ID NO: 1264906 - protein, 24 aa, Mycobacterium
FRTKESCVEPVLALSAKRFIALAN

SEQ ID NO: 1264907 - protein, 26 aa, Mycobacterium
FRTKILPVSFGFPFGLSVVLPLNVPL

SEQ ID NO: 1264908 - protein, 17 aa, Mycobacterium
FRTLAALVCEALDHEAP

SEQ ID NO: 1264909 - protein, 17 aa, Mycobacterium
FRTLCRELEVARAGTVS

SEQ ID NO: 1264910 - protein, 19 aa, Mycobacterium
FRTRCWKATDVCATTTPSA

SEQ ID NO: 1264911 - protein, 21 aa, Mycobacterium
FRTREPVRIVGEITDWTGHSD

SEQ ID NO: 1264912 - protein, 19 aa, Mycobacterium
FRVAMAAAGWKCNVDRFPN

SEQ ID NO: 1264913 - protein, 21 aa, Mycobacterium
FRVDGDRAVLFGSRRRSTGVV

SEQ ID NO: 1264914 - protein, 21 aa, Mycobacterium
FRYAVSNSFGLGGHNIVLVFG

SEQ ID NO: 1264915 - protein, 20 aa, Mycobacterium
FRYGEGTVMAIMHPDNPVAK

SEQ ID NO: 1264916 - protein, 18 aa, Mycobacterium
FRYGSAVSVLERSADGRV

SEQ ID NO: 1264917 - protein, 28 aa, Mycobacterium
FRYQLIDIPFKFHHPMWRENAEVDLEYH

SEQ ID NO: 1264918 - protein, 18 aa, Mycobacterium
FRYYPSKSALPWGDFDAH

SEQ ID NO: 1264919 - protein, 17 aa, Mycobacterium
FSAADYCRAVDVLERFY

SEQ ID NO: 1264920 - protein, 17 aa, Mycobacterium
FSADANQDFVFVTEPVF

SEQ ID NO: 1264921 - protein, 22 aa, Mycobacterium
FSADIAGFGYRDCVGHPAWFEP

SEQ ID NO: 1264922 - protein, 18 aa, Mycobacterium
FSADMVWLDRDPRLTPPL

SEQ ID NO: 1264923 - protein, 17 aa, Mycobacterium
FSAKFASAVAKNPFVGD

SEQ ID NO: 1264924 - protein, 17 aa, Mycobacterium
FSALLPAARAVRESVDW

SEQ ID NO: 1264925 - protein, 23 aa, Mycobacterium
FSASNFPLAFSVAGGDTASALAA

SEQ ID NO: 1264926 - protein, 19 aa, Mycobacterium
FSATGGALLVRGISITVTD

SEQ ID NO: 1264927 - protein, 18 aa, Mycobacterium
FSAVAARVAASVAPGDVV

SEQ ID NO: 1264928 - protein, 27 aa, Mycobacterium
FSAVSLYWGILAAMGMHVAEDLVDDMR

SEQ ID NO: 1264929 - protein, 26 aa, Mycobacterium
FSDALKAIGRQGVRVHDLRHFAGTQT

SEQ ID NO: 1264930 - protein, 18 aa, Mycobacterium
FSDEGYWLARLSDSGADH

SEQ ID NO: 1264931 - protein, 17 aa, Mycobacterium
FSDELQQEWTWTEKYAT

SEQ ID NO: 1264932 - protein, 20 aa, Mycobacterium
FSDGSLIVGIGSPPRTPDVE

SEQ ID NO: 1264933 - protein, 32 aa, Mycobacterium
FSDLCYGYNAFWRRNLECLDLPATDLTAPQWG

SEQ ID NO: 1264934 - protein, 17 aa, Mycobacterium
FSDLRFTNSSTLGLEGA

SEQ ID NO: 1264935 - protein, 25 aa, Mycobacterium
FSDPSGPCLEGWVTLTALAQATTRL

SEQ ID NO: 1264936 - protein, 21 aa, Mycobacterium
FSDWRKVRRNKAFRRGPTILG

SEQ ID NO: 1264937 - protein, 26 aa, Mycobacterium
FSEDIAGFGYADCAGHPTWFEPTEWL

SEQ ID NO: 1264938 - protein, 24 aa, Mycobacterium
FSELPDFELIAGQVLHNLEAAVAV

SEQ ID NO: 1264939 - protein, 21 aa, Mycobacterium
FSETPLRELLLDAIRYGERDD

SEQ ID NO: 1264940 - protein, 26 aa, Mycobacterium
FSEVHWVAPEDAVWACRTLAATHYTS

SEQ ID NO: 1264941 - protein, 25 aa, Mycobacterium
FSFEPKPDWTHMWSFQPEIQDYLLG

SEQ ID NO: 1264942 - protein, 35 aa, Mycobacterium
FSFNVADGRCPTCQGEGFVSVELLFLPGTYATCPT

SEQ ID NO: 1264943 - protein, 25 aa, Mycobacterium
FSGACAGCGETPYVKLLSQLFGDRL

SEQ ID NO: 1264944 - protein, 22 aa, Mycobacterium
FSGDIRDAMTIDRLLDGCDAVL

SEQ ID NO: 1264945 - protein, 27 aa, Mycobacterium
FSGGMRQRLLIAMAVALNPSVLIADEP

SEQ ID NO: 1264946 - protein, 25 aa, Mycobacterium
FSGGYDFGGGFAHWGEAMNTDGRWD

SEQ ID NO: 1264947 - protein, 25 aa, Mycobacterium
FSGHGFKFVPVVGEILADLATTGAT

SEQ ID NO: 1264948 - protein, 26 aa, Mycobacterium
FSGHGFKIAPAVGRLVADIVVDGHSS

SEQ ID NO: 1264949 - protein, 19 aa, Mycobacterium
FSGKILAPAHLPQEQSQRA

SEQ ID NO: 1264950 - protein, 18 aa, Mycobacterium
FSGKSDILAGAFRRSADR

SEQ ID NO: 1264951 - protein, 23 aa, Mycobacterium
FSGKSDILATIFRRAADRVSAEL

SEQ ID NO: 1264952 - protein, 17 aa, Mycobacterium
FSGLGMGIELQRRGVDF

SEQ ID NO: 1264953 - protein, 19 aa, Mycobacterium
FSGLIERFGSGKGCDICKP

SEQ ID NO: 1264954 - protein, 24 aa, Mycobacterium
FSGPLPLPPSRHVAVVACMDARLD

SEQ ID NO: 1264955 - protein, 23 aa, Mycobacterium
FSGRAQIGKGMWAMTDLMADMVE

SEQ ID NO: 1264956 - protein, 19 aa, Mycobacterium
FSHPQSQYFVVGRLAQDQV

SEQ ID NO: 1264957 - protein, 18 aa, Mycobacterium
FSHRFGIGYWHLGQDSRA

SEQ ID NO: 1264958 - protein, 22 aa, Mycobacterium
FSIDECLDYVVARMPLAAGDIV

SEQ ID NO: 1264959 - protein, 26 aa, Mycobacterium
FSIEPRPDQTFEFTVDVPGQVDIELH

SEQ ID NO: 1264960 - protein, 17 aa, Mycobacterium
FSIPGLQAPYVVAQVAI

SEQ ID NO: 1264961 - protein, 36 aa, Mycobacterium
FSLFQVLRYGFRPSKVAFLAFHAWSDASHGDWPPGF

SEQ ID NO: 1264962 - protein, 20 aa, Mycobacterium
FSLLVSHVLVPPAISAIMES

SEQ ID NO: 1264963 - protein, 24 aa, Mycobacterium
FSNTFASAGSWPVPGDSVVNLVIE

SEQ ID NO: 1264964 - protein, 18 aa, Mycobacterium
FSPENVKARDRWQFLPFL

SEQ ID NO: 1264965 - protein, 17 aa, Mycobacterium
FSPPLSHDELAFYDAVA

SEQ ID NO: 1264966 - protein, 20 aa, Mycobacterium
FSPTGPRGAGRHGIGMLSIA

SEQ ID NO: 1264967 - protein, 20 aa, Mycobacterium
FSPVCGPDCQGLCPECGVRL

SEQ ID NO: 1264968 - protein, 18 aa, Mycobacterium
FSQRAWDPVIGPFFEGGL

SEQ ID NO: 1264969 - protein, 24 aa, Mycobacterium
FSRARRLQEELGFNVALPVQPGCG

SEQ ID NO: 1264970 - protein, 18 aa, Mycobacterium
FSRGAFCTVQRDHPDVLC

SEQ ID NO: 1264971 - protein, 17 aa, Mycobacterium
FSRGNVTYRHMLAGKPA

SEQ ID NO: 1264972 - protein, 17 aa, Mycobacterium
FSSCTAVTGPFPGFPVP

SEQ ID NO: 1264973 - protein, 29 aa, Mycobacterium
FSSEQRLRIGEAWGRLPHEWVEQYEANHE

SEQ ID NO: 1264974 - protein, 19 aa, Mycobacterium
FSSEVGGPVVLKTVRGGYD

SEQ ID NO: 1264975 - protein, 31 aa, Mycobacterium
FSSGAAMARACIDEGWLLSLSGTVSFKNARD

SEQ ID NO: 1264976 - protein, 17 aa, Mycobacterium
FSSIYGMYGGYGCGTYP

SEQ ID NO: 1264977 - protein, 19 aa, Mycobacterium
FSSSLDWNIERVKGGSMVA

SEQ ID NO: 1264978 - protein, 18 aa, Mycobacterium
FSSSRGCDLGMVRSEEAP

SEQ ID NO: 1264979 - protein, 18 aa, Mycobacterium
FSTLVPFFADDVILHQAD

SEQ ID NO: 1264980 - protein, 17 aa, Mycobacterium
FSVHSWAPLGELVAIDD

SEQ ID NO: 1264981 - protein, 23 aa, Mycobacterium
FSVNLAMLYGCPLPKIDNRTQAP

SEQ ID NO: 1264982 - protein, 18 aa, Mycobacterium
FSVPYYWWTFNMPTDHGE

SEQ ID NO: 1264983 - protein, 23 aa, Mycobacterium
FSYSHVLSILAFIKGLGRHTHFY

SEQ ID NO: 1264984 - protein, 17 aa, Mycobacterium
FTAAFGVQFDDLLAAGL

SEQ ID NO: 1264985 - protein, 23 aa, Mycobacterium
FTAAGLTPRIAFEASTPQELADL

SEQ ID NO: 1264986 - protein, 19 aa, Mycobacterium
FTADGDLLFLAARPTGDDD

SEQ ID NO: 1264987 - protein, 22 aa, Mycobacterium
FTAEFANAGFLRPYTEEETSRL

SEQ ID NO: 1264988 - protein, 23 aa, Mycobacterium
FTAFPKAHWQKIWSNNPIERLNK

SEQ ID NO: 1264989 - protein, 17 aa, Mycobacterium
FTAGCPVVAAAIGSAED

SEQ ID NO: 1264990 - protein, 24 aa, Mycobacterium
FTAIKLKGGVFPPEEEMAAIEALS

SEQ ID NO: 1264991 - protein, 17 aa, Mycobacterium
FTAIREWAKKFYPDGKG

SEQ ID NO: 1264992 - protein, 17 aa, Mycobacterium
FTALDWLSERLSRQRFL

SEQ ID NO: 1264993 - protein, 27 aa, Mycobacterium
FTALPEVRSQLALTWGTETFIVPHIDT

SEQ ID NO: 1264994 - protein, 25 aa, Mycobacterium
FTALPPQRLKGIHDPICLVEVRRRI

SEQ ID NO: 1264995 - protein, 25 aa, Mycobacterium
FTAPLNWYRCFDLNWELTADPPAPT

SEQ ID NO: 1264996 - protein, 17 aa, Mycobacterium
FTAYKLLIADVIDGELR

SEQ ID NO: 1264997 - protein, 17 aa, Mycobacterium
FTDAGFTAITGHRLDLR

SEQ ID NO: 1264998 - protein, 20 aa, Mycobacterium
FTDANWKMVGHLYKDGIVAV

SEQ ID NO: 1264999 - protein, 18 aa, Mycobacterium
FTDEGGNFFAGILTVSDD

SEQ ID NO: 1265000 - protein, 32 aa, Mycobacterium
FTDHFRREFAPRILVCGAAFKGDPPTRDTRNA

SEQ ID NO: 1265001 - protein, 19 aa, Mycobacterium
FTDLGLRAMMILSAGEFDD

SEQ ID NO: 1265002 - protein, 24 aa, Mycobacterium
FTDPVRADWLWRVVGESAHSAIVS

SEQ ID NO: 1265003 - protein, 17 aa, Mycobacterium
FTEAFLAAVGANPGLGK

SEQ ID NO: 1265004 - protein, 22 aa, Mycobacterium
FTEDLVMWWNFVGRSHEDIARF

SEQ ID NO: 1265005 - protein, 18 aa, Mycobacterium
FTEFTGYQHRVFALHNGQ

SEQ ID NO: 1265006 - protein, 27 aa, Mycobacterium
FTEKVLIECCLELYAADLVVGIQDLGG

SEQ ID NO: 1265007 - protein, 22 aa, Mycobacterium
FTEPSAEVDIWFPNKKGGPGWV

SEQ ID NO: 1265008 - protein, 22 aa, Mycobacterium
FTGAEIIAAFGQTECSPITCLL

SEQ ID NO: 1265009 - protein, 22 aa, Mycobacterium
FTGFLQKMLQLFTDLDENTAAA

SEQ ID NO: 1265010 - protein, 24 aa, Mycobacterium
FTGKRATVSLFWPLSSTNGAKLAS

SEQ ID NO: 1265011 - protein, 17 aa, Mycobacterium
FTGLTVSGDHAWKTIND

SEQ ID NO: 1265012 - protein, 23 aa, Mycobacterium
FTGSLALELGFFGVRAKLVEPGY

SEQ ID NO: 1265013 - protein, 24 aa, Mycobacterium
FTGSTRAGIEIARNAAPTVKRVTQ

SEQ ID NO: 1265014 - protein, 23 aa, Mycobacterium
FTGVPCIVDLATMREAVAALGGD

SEQ ID NO: 1265015 - protein, 17 aa, Mycobacterium
FTHLAVPVMTRLRQPER

SEQ ID NO: 1265016 - protein, 18 aa, Mycobacterium
FTHTCFMVTPYEGYVAVA

SEQ ID NO: 1265017 - protein, 18 aa, Mycobacterium
FTLNLVHGLQDLFTQVRS

SEQ ID NO: 1265018 - protein, 21 aa, Mycobacterium
FTLPELIGLTSTCEVVLDPAD

SEQ ID NO: 1265019 - protein, 18 aa, Mycobacterium
FTLPPKKFATAWQPVVSS

SEQ ID NO: 1265020 - protein, 19 aa, Mycobacterium
FTLSILKFRRHRVLHQMII

SEQ ID NO: 1265021 - protein, 17 aa, Mycobacterium
FTMATDMAVYFCDPASP

SEQ ID NO: 1265022 - protein, 18 aa, Mycobacterium
FTNHMFLPAPAEAVPAPD

SEQ ID NO: 1265023 - protein, 17 aa, Mycobacterium
FTPDGVRVMQARVKEEL

SEQ ID NO: 1265024 - protein, 19 aa, Mycobacterium
FTPGCKRMLISSDYYPALQ

SEQ ID NO: 1265025 - protein, 17 aa, Mycobacterium
FTPGYPGFLRGLTPVGG

SEQ ID NO: 1265026 - protein, 19 aa, Mycobacterium
FTPLNLKYRIFHKVLTAGA

SEQ ID NO: 1265027 - protein, 17 aa, Mycobacterium
FTPRVLESMGLTYDAVR

SEQ ID NO: 1265028 - protein, 22 aa, Mycobacterium
FTPSELMRWVHPSLVASTQGTG

SEQ ID NO: 1265029 - protein, 17 aa, Mycobacterium
FTPTLAFARDTVPDTAH

SEQ ID NO: 1265030 - protein, 18 aa, Mycobacterium
FTQVFATLFPGGEGRLLL

SEQ ID NO: 1265031 - protein, 23 aa, Mycobacterium
FTRAELTAAFATFEETVAHAAQT

SEQ ID NO: 1265032 - protein, 19 aa, Mycobacterium
FTRAGYRCVTFDNRGIGAT

SEQ ID NO: 1265033 - protein, 20 aa, Mycobacterium
FTRGCLDLLVIEEAGQFSLA

SEQ ID NO: 1265034 - protein, 19 aa, Mycobacterium
FTRRLDLIVDFPVPDEAAR

SEQ ID NO: 1265035 - protein, 18 aa, Mycobacterium
FTRTRLAGYVEHIDRVAS

SEQ ID NO: 1265036 - protein, 18 aa, Mycobacterium
FTRVGAKVPHLADVKPFG

SEQ ID NO: 1265037 - protein, 19 aa, Mycobacterium
FTRVRLRTEVLPLLEDVLG

SEQ ID NO: 1265038 - protein, 25 aa, Mycobacterium
FTSKVELYLAVLQRHVDNLVSGVRQ

SEQ ID NO: 1265039 - protein, 17 aa, Mycobacterium
FTSPAADDWMCLLEAFD

SEQ ID NO: 1265040 - protein, 17 aa, Mycobacterium
FTTCPDCDGTRLSETAR

SEQ ID NO: 1265041 - protein, 30 aa, Mycobacterium
FTTDQEVRWCPGCGDYVILNTIRNFLPELG

SEQ ID NO: 1265042 - protein, 22 aa, Mycobacterium
FTTDRPIIFAYHGYPWLIHRLT

SEQ ID NO: 1265043 - protein, 22 aa, Mycobacterium
FTVEEGRLWLLQTRVAKRSAQA

SEQ ID NO: 1265044 - protein, 21 aa, Mycobacterium
FTVEERGPWGLRSAPASAQEC

SEQ ID NO: 1265045 - protein, 17 aa, Mycobacterium
FTVEGGLTCSIVTFSGG

SEQ ID NO: 1265046 - protein, 25 aa, Mycobacterium
FTVEPRSGQEFQFRTEVPGNVEIEL

SEQ ID NO: 1265047 - protein, 17 aa, Mycobacterium
FTVGDGFALTVDQTAAG

SEQ ID NO: 1265048 - protein, 25 aa, Mycobacterium
FTVGDKLWAPTFVRDFPVETTPLTR

SEQ ID NO: 1265049 - protein, 21 aa, Mycobacterium
FTVPFEFPRALELRYQPEFAE

SEQ ID NO: 1265050 - protein, 17 aa, Mycobacterium
FTVTGGDEFLASGHPDP

SEQ ID NO: 1265051 - protein, 24 aa, Mycobacterium
FTVVRPDGLPVWIYQFKVSPHRGI

SEQ ID NO: 1265052 - protein, 19 aa, Mycobacterium
FTWTDRDTLLYALGVGAGT

SEQ ID NO: 1265053 - protein, 25 aa, Mycobacterium
FTYSERKKLAALAFRHTAEYDVAVA

SEQ ID NO: 1265054 - protein, 26 aa, Mycobacterium
FVAAKPVDLAACLGATWIGGGVAGTV

SEQ ID NO: 1265055 - protein, 26 aa, Mycobacterium
FVADVGAAFARLVADVATQIVIGHDM

SEQ ID NO: 1265056 - protein, 18 aa, Mycobacterium
FVAEPRVRFHVGSFSEEV

SEQ ID NO: 1265057 - protein, 18 aa, Mycobacterium
FVAGLPVYLVAKLLGERA

SEQ ID NO: 1265058 - protein, 18 aa, Mycobacterium
FVAGRPDPWAGIDDTAQS

SEQ ID NO: 1265059 - protein, 17 aa, Mycobacterium
FVAGRPLIEVLLDLTQR

SEQ ID NO: 1265060 - protein, 25 aa, Mycobacterium
FVAGRTQTYLPWDSWKKPYTEPPDP

SEQ ID NO: 1265061 - protein, 18 aa, Mycobacterium
FVALAGRVATAAVTETRG

SEQ ID NO: 1265062 - protein, 27 aa, Mycobacterium
FVARRLLAEPIAMVFAARDTGAEALSG

SEQ ID NO: 1265063 - protein, 26 aa, Mycobacterium
FVARRLLAEPVVMVFAVRDNADVLSG

SEQ ID NO: 1265064 - protein, 17 aa, Mycobacterium
FVAVPAFAELEDVVRGL

SEQ ID NO: 1265065 - protein, 19 aa, Mycobacterium
FVCLLTCPEGIAAMAEAHP

SEQ ID NO: 1265066 - protein, 19 aa, Mycobacterium
FVCLLTCPEGIAAMQEAHP

SEQ ID NO: 1265067 - protein, 40 aa, Mycobacterium
FVCSHAPRPKMLVFGAIDFASALARQATFLGYRVTVCDAR

SEQ ID NO: 1265068 - protein, 21 aa, Mycobacterium
FVDAIGAVGFHVNVLDYSEHA

SEQ ID NO: 1265069 - protein, 22 aa, Mycobacterium
FVDFAVEAIRAMSFESEDVDRR

SEQ ID NO: 1265070 - protein, 22 aa, Mycobacterium
FVDFGWPDFLVAFEYDGDHHQS

SEQ ID NO: 1265071 - protein, 18 aa, Mycobacterium
FVDVIGPYLKWGGDNSDA

SEQ ID NO: 1265072 - protein, 20 aa, Mycobacterium
FVEASAKINALLDVAQANIG

SEQ ID NO: 1265073 - protein, 24 aa, Mycobacterium
FVECQSRLLAAYAVGRYALPSADE

SEQ ID NO: 1265074 - protein, 23 aa, Mycobacterium
FVEDARLPGGGFRGAFDPESGVH

SEQ ID NO: 1265075 - protein, 22 aa, Mycobacterium
FVEDRLKDMIISGGENIYSIEV

SEQ ID NO: 1265076 - protein, 17 aa, Mycobacterium
FVEEGARVVLGDVNLDA

SEQ ID NO: 1265077 - protein, 25 aa, Mycobacterium
FVEHLRLPHYAGFTAYLSQAASKEQ

SEQ ID NO: 1265078 - protein, 26 aa, Mycobacterium
FVEILPTPFLPAGIFDQWGLDADDPR

SEQ ID NO: 1265079 - protein, 19 aa, Mycobacterium
FVERAVTFTTCPDCDGTRL

SEQ ID NO: 1265080 - protein, 23 aa, Mycobacterium
FVERMAALVAPVFGTARQRQTSS

SEQ ID NO: 1265081 - protein, 22 aa, Mycobacterium
FVESRLSPRLHRRNQYVTVSLP

SEQ ID NO: 1265082 - protein, 19 aa, Mycobacterium
FVGECRDGGRLMELPLDGG

SEQ ID NO: 1265083 - protein, 19 aa, Mycobacterium
FVHRFRLWGSSDFRRWLPL

SEQ ID NO: 1265084 - protein, 21 aa, Mycobacterium
FVIGASNRFAHAASLAIAEAP

SEQ ID NO: 1265085 - protein, 17 aa, Mycobacterium
FVIPTFIRGGTNVMLPG

SEQ ID NO: 1265086 - protein, 25 aa, Mycobacterium
FVKEAWPVLRDVWLFRDRDSRTLVV

SEQ ID NO: 1265087 - protein, 24 aa, Mycobacterium
FVLPELRAGLHFNALSLSGITPIE

SEQ ID NO: 1265088 - protein, 17 aa, Mycobacterium
FVLPPPALHAASLRPDR

SEQ ID NO: 1265089 - protein, 17 aa, Mycobacterium
FVLPPPVLDKMRFIHHV

SEQ ID NO: 1265090 - protein, 25 aa, Mycobacterium
FVLRELRAGLHFNALSLSGLTPVEA

SEQ ID NO: 1265091 - protein, 25 aa, Mycobacterium
FVLVLRLLVVALRRHPVLNATWVDT

SEQ ID NO: 1265092 - protein, 17 aa, Mycobacterium
FVMERLEGVVPMPHNVS

SEQ ID NO: 1265093 - protein, 17 aa, Mycobacterium
FVMSNSFSNQVIAQIEL

SEQ ID NO: 1265094 - protein, 18 aa, Mycobacterium
FVMSRGFTEESWGEALWQ

SEQ ID NO: 1265095 - protein, 28 aa, Mycobacterium
FVNETNMRGRLALHHVRARLYGAEPVEP

SEQ ID NO: 1265096 - protein, 25 aa, Mycobacterium
FVNLAGRPMLERAIAGLRDSGVVDS

SEQ ID NO: 1265097 - protein, 25 aa, Mycobacterium
FVNLAGRPMLERAIAGLRNSGVVDS

SEQ ID NO: 1265098 - protein, 25 aa, Mycobacterium
FVPAFSGLFAPYWRSDARGAIVGLS

SEQ ID NO: 1265099 - protein, 20 aa, Mycobacterium
FVPPTLRGELTWCQLFSEPG

SEQ ID NO: 1265100 - protein, 18 aa, Mycobacterium
FVPSAGAVLAEWGADVIK

SEQ ID NO: 1265101 - protein, 17 aa, Mycobacterium
FVRAALEPLGLTAEPPP

SEQ ID NO: 1265102 - protein, 25 aa, Mycobacterium
FVRDVGAAFARLVRDAAQPASQIVI

SEQ ID NO: 1265103 - protein, 22 aa, Mycobacterium
FVRGEGAGVVVLKRLTDAVRDG

SEQ ID NO: 1265104 - protein, 18 aa, Mycobacterium
FVRRMLGQRVPYPERVDI

SEQ ID NO: 1265105 - protein, 17 aa, Mycobacterium
FVSFLAGPESGYITGAN

SEQ ID NO: 1265106 - protein, 18 aa, Mycobacterium
FVSFWRAVGLYVYQTHYD

SEQ ID NO: 1265107 - protein, 19 aa, Mycobacterium
FVSQLGFAVAPRVRRALQE

SEQ ID NO: 1265108 - protein, 18 aa, Mycobacterium
FVTCCYDQSKALCHPDRQ

SEQ ID NO: 1265109 - protein, 17 aa, Mycobacterium
FVTPLGGYNAWFSAPDT

SEQ ID NO: 1265110 - protein, 25 aa, Mycobacterium
FVTPWPRPLDVAAMAAAARELVGLH

SEQ ID NO: 1265111 - protein, 18 aa, Mycobacterium
FVTRGEYKSAANLFTQDS

SEQ ID NO: 1265112 - protein, 21 aa, Mycobacterium
FVTRRHRLLQGWAYMQDGQLH

SEQ ID NO: 1265113 - protein, 17 aa, Mycobacterium
FVTVAARHADKASALVE

SEQ ID NO: 1265114 - protein, 27 aa, Mycobacterium
FVVCNEILPRWGVETVFVDGDDLSQWE

SEQ ID NO: 1265115 - protein, 17 aa, Mycobacterium
FVVFMPCAPEVPMMTFL

SEQ ID NO: 1265116 - protein, 17 aa, Mycobacterium
FVVKPMVFPGGSIGDLA

SEQ ID NO: 1265117 - protein, 31 aa, Mycobacterium
FVVLNWRAVCGQCRACKRGRPHLCFDTFNAE

SEQ ID NO: 1265118 - protein, 18 aa, Mycobacterium
FVVLRLWLDRPVRHDRAA

SEQ ID NO: 1265119 - protein, 17 aa, Mycobacterium
FVVPNWMWHAHMNRSSD

SEQ ID NO: 1265120 - protein, 23 aa, Mycobacterium
FVVPRLRPPQARVLLMAALAAGA

SEQ ID NO: 1265121 - protein, 27 aa, Mycobacterium
FVVPVPHRFLPAFPPRAIQFLGTATIV

SEQ ID NO: 1265122 - protein, 23 aa, Mycobacterium
FWDACVKAGIPVAMHASDSGYAQ

SEQ ID NO: 1265123 - protein, 30 aa, Mycobacterium
FWFDPLCPWAWITSRWVLEVEKVRDIEVNF

SEQ ID NO: 1265124 - protein, 17 aa, Mycobacterium
FWHGCPEHATWPKRNAE

SEQ ID NO: 1265125 - protein, 18 aa, Mycobacterium
FWLVGLQGERHWPALCAA

SEQ ID NO: 1265126 - protein, 17 aa, Mycobacterium
FWMGGPYVGIRHGNLLA

SEQ ID NO: 1265127 - protein, 20 aa, Mycobacterium
FWPHGEIARAYGVFNDASGF

SEQ ID NO: 1265128 - protein, 21 aa, Mycobacterium
FWREVEAAGLPIVLHASQPPL

SEQ ID NO: 1265129 - protein, 24 aa, Mycobacterium
FWSESRTRLDAVAGLDQQIAVGVE

SEQ ID NO: 1265130 - protein, 17 aa, Mycobacterium
FWVAEYRRLPKLRAVQD

SEQ ID NO: 1265131 - protein, 22 aa, Mycobacterium
FYAEMLKGIGLDGADLPDQNDM

SEQ ID NO: 1265132 - protein, 20 aa, Mycobacterium
FYAGWDPAAVPIKFDAKAYT

SEQ ID NO: 1265133 - protein, 27 aa, Mycobacterium
FYAKHGFAVTGTKTFRLGAGVENDFVM

SEQ ID NO: 1265134 - protein, 18 aa, Mycobacterium
FYAQCAIDAGVAFVNALP

SEQ ID NO: 1265135 - protein, 24 aa, Mycobacterium
FYAQLLEAYPLVSIEDPLSEDDWD

SEQ ID NO: 1265136 - protein, 20 aa, Mycobacterium
FYATIAGLVVKCWMFVMRLS

SEQ ID NO: 1265137 - protein, 18 aa, Mycobacterium
FYDDVRIPLSNVVGELGG

SEQ ID NO: 1265138 - protein, 26 aa, Mycobacterium
FYDGVIFHRVIEGFMIQGGDPTGTGR

SEQ ID NO: 1265139 - protein, 18 aa, Mycobacterium
FYEEVRVWMAKFDANDRQ

SEQ ID NO: 1265140 - protein, 17 aa, Mycobacterium
FYGAGGGMAHRLGMKPN

SEQ ID NO: 1265141 - protein, 21 aa, Mycobacterium
FYHPLDMVGDWNRAYGSVGFA

SEQ ID NO: 1265142 - protein, 17 aa, Mycobacterium
FYICGPGPFMDTVEGAL

SEQ ID NO: 1265143 - protein, 17 aa, Mycobacterium
FYNAELLDRYKVAPPTT

SEQ ID NO: 1265144 - protein, 17 aa, Mycobacterium
FYPEFRVTAQRLDRVLA

SEQ ID NO: 1265145 - protein, 26 aa, Mycobacterium
FYQVTRLIGALPRLEGTVHVNVAQIL

SEQ ID NO: 1265146 - protein, 24 aa, Mycobacterium
FYRQCATVTSALWPTLTEPLRTRS

SEQ ID NO: 1265147 - protein, 18 aa, Mycobacterium
FYSGVTLPELGYTYREYR

SEQ ID NO: 1265148 - protein, 21 aa, Mycobacterium
FYTAAPIRFGTYVAKLSVSPA

SEQ ID NO: 1265149 - protein, 20 aa, Mycobacterium
GAAALLHRIEVDAGCRAEEL

SEQ ID NO: 1265150 - protein, 17 aa, Mycobacterium
GAAAMAGGFIYLGGGTA

SEQ ID NO: 1265151 - protein, 25 aa, Mycobacterium
GAAARLPALGSRGFAGVITALKPAL

SEQ ID NO: 1265152 - protein, 25 aa, Mycobacterium
GAAARRARAKVLAISREDQLAPVDE

SEQ ID NO: 1265153 - protein, 18 aa, Mycobacterium
GAAASAFAAGAITLPQLT

SEQ ID NO: 1265154 - protein, 18 aa, Mycobacterium
GAAAVSRASYERLATGIF

SEQ ID NO: 1265155 - protein, 20 aa, Mycobacterium
GAAAVVMCRADIAHRYTNKP

SEQ ID NO: 1265156 - protein, 18 aa, Mycobacterium
GAADARALIAEGAKVVIG

SEQ ID NO: 1265157 - protein, 18 aa, Mycobacterium
GAADGFMIFPPRVPYGIG

SEQ ID NO: 1265158 - protein, 19 aa, Mycobacterium
GAADYRRWPVTDAGDSIYW

SEQ ID NO: 1265159 - protein, 20 aa, Mycobacterium
GAAEALRWAMMAGEPHVVLA

SEQ ID NO: 1265160 - protein, 18 aa, Mycobacterium
GAAEIVGYLALNDDDVSV

SEQ ID NO: 1265161 - protein, 20 aa, Mycobacterium
GAAEKICKAGFLRSGAETDV

SEQ ID NO: 1265162 - protein, 24 aa, Mycobacterium
GAAELKALGPDGVLINVGRGPLVQ

SEQ ID NO: 1265163 - protein, 21 aa, Mycobacterium
GAAELLRFLADNGYPLADIER

SEQ ID NO: 1265164 - protein, 25 aa, Mycobacterium
GAAERALALMIDRVQTRIAFGKPLA

SEQ ID NO: 1265165 - protein, 19 aa, Mycobacterium
GAAGGRLAAAVSRAGGLGM

SEQ ID NO: 1265166 - protein, 24 aa, Mycobacterium
GAAGGRLAAAVSRAGGLGVVGMGS

SEQ ID NO: 1265167 - protein, 25 aa, Mycobacterium
GAAGGRLAAAVSRAGGLGVVGMGSA

SEQ ID NO: 1265168 - protein, 19 aa, Mycobacterium
GAAGLRMRMLSLVSAENLA

SEQ ID NO: 1265169 - protein, 20 aa, Mycobacterium
GAAGRFWFDIPHFVMEQKML

SEQ ID NO: 1265170 - protein, 19 aa, Mycobacterium
GAAGRGHEALQLDVTDAAA

SEQ ID NO: 1265171 - protein, 26 aa, Mycobacterium
GAAGVCFPDLLMLRGEYQMKVPAPFV

SEQ ID NO: 1265172 - protein, 29 aa, Mycobacterium
GAAGVYLELMIRQHRFTISVARDELQSGS

SEQ ID NO: 1265173 - protein, 20 aa, Mycobacterium
GAAGWCTAAPNLRPQPCLDL

SEQ ID NO: 1265174 - protein, 18 aa, Mycobacterium
GAAHGGAVAHLFDSLLGF

SEQ ID NO: 1265175 - protein, 20 aa, Mycobacterium
GAAHLEAMVSYANHAQELAL

SEQ ID NO: 1265176 - protein, 18 aa, Mycobacterium
GAAIKSLWLPGPDPEPHY

SEQ ID NO: 1265177 - protein, 23 aa, Mycobacterium
GAALARFEARIVIDLLLRHTSWV

SEQ ID NO: 1265178 - protein, 20 aa, Mycobacterium
GAALEPGEFILGYPDEAGPV

SEQ ID NO: 1265179 - protein, 21 aa, Mycobacterium
GAALSGHRWLLSPAALGSFLA

SEQ ID NO: 1265180 - protein, 18 aa, Mycobacterium
GAAPATWMPSTRVTRDDW

SEQ ID NO: 1265181 - protein, 20 aa, Mycobacterium
GAAPVPRPIFIVGQPRTGTT

SEQ ID NO: 1265182 - protein, 20 aa, Mycobacterium
GAARAFLTFVHRAPGTVNLR

SEQ ID NO: 1265183 - protein, 17 aa, Mycobacterium
GAARLYAEMQLRLTDLA

SEQ ID NO: 1265184 - protein, 17 aa, Mycobacterium
GAARVWVPAARALREVW

SEQ ID NO: 1265185 - protein, 20 aa, Mycobacterium
GAATRYLGGIGMSAVEEHEH

SEQ ID NO: 1265186 - protein, 21 aa, Mycobacterium
GAAVHSCVYPAFRADGRTVTT

SEQ ID NO: 1265187 - protein, 32 aa, Mycobacterium
GAAVVRFIGVDGYRWMVRCVVNGPYERMAELA

SEQ ID NO: 1265188 - protein, 24 aa, Mycobacterium
GAAWIDPRVHGHVAALADPDTGYA

SEQ ID NO: 1265189 - protein, 19 aa, Mycobacterium
GACDSTLLIAERVQSYADV

SEQ ID NO: 1265190 - protein, 20 aa, Mycobacterium
GADAAYVCRGRVCDLPVTTV

SEQ ID NO: 1265191 - protein, 31 aa, Mycobacterium
GADADSASEAMLWRRPRWSVRLQTGPIGDML

SEQ ID NO: 1265192 - protein, 29 aa, Mycobacterium
GADASRLFLTQMIQHHRGAIMMAQKEIDN

SEQ ID NO: 1265193 - protein, 24 aa, Mycobacterium
GADATRLIYRVGWRETSPPVRDDG

SEQ ID NO: 1265194 - protein, 18 aa, Mycobacterium
GADAWALQDALALGVTAG

SEQ ID NO: 1265195 - protein, 25 aa, Mycobacterium
GADERCGRCDNCAGSSYSADVDAAV

SEQ ID NO: 1265196 - protein, 24 aa, Mycobacterium
GADEVFAGYHWYPPMGEPAAASVE

SEQ ID NO: 1265197 - protein, 26 aa, Mycobacterium
GADGPQLRTSWRWSTALSTSTEVDRL

SEQ ID NO: 1265198 - protein, 25 aa, Mycobacterium
GADGSGLFMKYLRRGSGYYIDVGAC

SEQ ID NO: 1265199 - protein, 18 aa, Mycobacterium
GADHSIAAMAARAAVSER

SEQ ID NO: 1265200 - protein, 25 aa, Mycobacterium
GADIALSAAMCLRAYAVTRTRGVVA

SEQ ID NO: 1265201 - protein, 18 aa, Mycobacterium
GADIIALDICGPVDDTVV

SEQ ID NO: 1265202 - protein, 18 aa, Mycobacterium
GADIIAVDICKQIDSVLI

SEQ ID NO: 1265203 - protein, 21 aa, Mycobacterium
GADLILVDICESLPEIEYPLA

SEQ ID NO: 1265204 - protein, 22 aa, Mycobacterium
GADLPALEGVYLASLAGGEALL

SEQ ID NO: 1265205 - protein, 26 aa, Mycobacterium
GADPARPYVSISIAHGIRRFEFMIHP

SEQ ID NO: 1265206 - protein, 19 aa, Mycobacterium
GADPDDWPAAGAVGREATV

SEQ ID NO: 1265207 - protein, 21 aa, Mycobacterium
GADPLRPAARVNPGPRYQAME

SEQ ID NO: 1265208 - protein, 30 aa, Mycobacterium; identical to SEQ ID NO: 88250

SEQ ID NO: 1265209 - protein, 17 aa, Mycobacterium
GADRLRRFGADRLIDYI

SEQ ID NO: 1265210 - protein, 24 aa, Mycobacterium
GADRSRGALMLHGHLDVVPAEASD

SEQ ID NO: 1265211 - protein, 22 aa, Mycobacterium
GADSIAFRLMFNTLRATYEPAL

SEQ ID NO: 1265212 - protein, 19 aa, Mycobacterium
GADTLKDWGGHVITGGVLP

SEQ ID NO: 1265213 - protein, 26 aa, Mycobacterium
GADVRSRIQLARFMTCSDAEPDLELI

SEQ ID NO: 1265214 - protein, 22 aa, Mycobacterium
GADWFRPKAMRDLKTRVDELAK

SEQ ID NO: 1265215 - protein, 28 aa, Mycobacterium
GADWVVMSGSLPPGVPASWYGDVVASLA

SEQ ID NO: 1265216 - protein, 27 aa, Mycobacterium
GADYQCISCGLVPNATKAKALYDNQRI

SEQ ID NO: 1265217 - protein, 40 aa, Mycobacterium
GADYRWLNLMARAPRKSWPRIMLRAAQGIGGLALRRRYAA

SEQ ID NO: 1265218 - protein, 20 aa, Mycobacterium
GADYRWLNLMSRVPRKGIPL

SEQ ID NO: 1265219 - protein, 33 aa, Mycobacterium
GADYRWLNLMSRVPRKGIPLVAKRLGQGIGGLL

SEQ ID NO: 1265220 - protein, 34 aa, Mycobacterium
GADYRWLNLMSRVPRKGIPLVAKRLGQGIGGLLL

SEQ ID NO: 1265221 - protein, 18 aa, Mycobacterium
GAEARTVRRLDELNSVDA

SEQ ID NO: 1265222 - protein, 25 aa, Mycobacterium
GAEASRLFLTQMIEHHKGAIMMAQQ

SEQ ID NO: 1265223 - protein, 22 aa, Mycobacterium
GAEASRLLGYMYLSRVWHAALR

SEQ ID NO: 1265224 - protein, 20 aa, Mycobacterium
GAEFGYAGVIVSRKCGVPFL

SEQ ID NO: 1265225 - protein, 19 aa, Mycobacterium
GAEIVRRLAADGAAVAFTY

SEQ ID NO: 1265226 - protein, 17 aa, Mycobacterium
GAELPEWNGTALHGVVP

SEQ ID NO: 1265227 - protein, 28 aa, Mycobacterium
GAENQLRFRAPRMLDLSLLVAALPEAYR

SEQ ID NO: 1265228 - protein, 25 aa, Mycobacterium
GAEPRRGNGSSVRRLVIVESPTKAR

SEQ ID NO: 1265229 - protein, 21 aa, Mycobacterium
GAEPRTEWLDGVVVRDDHGFI

SEQ ID NO: 1265230 - protein, 32 aa, Mycobacterium
GAERMTRVSFGFRSRDRFGFTPPGVTCERADL

SEQ ID NO: 1265231 - protein, 22 aa, Mycobacterium
GAETALRIGLVTEIVARERLWE

SEQ ID NO: 1265232 - protein, 22 aa, Mycobacterium
GAEVARRLHAKGARLVLTDLDE

SEQ ID NO: 1265233 - protein, 26 aa, Mycobacterium
GAEVLRRLKALPGFGEQKAKIFLALL

SEQ ID NO: 1265234 - protein, 17 aa, Mycobacterium
GAEVVKIEHPVTGDAQR

SEQ ID NO: 1265235 - protein, 25 aa, Mycobacterium
GAEWRQAGCSMCLGMNPDQLAPGER

SEQ ID NO: 1265236 - protein, 18 aa, Mycobacterium
GAFAPWVTVTAARDPIAL

SEQ ID NO: 1265237 - protein, 18 aa, Mycobacterium
GAFASRVNVPVQFLAPVP

SEQ ID NO: 1265238 - protein, 30 aa, Mycobacterium
GAFDQCATSPCSGKNVFINYPREFGIMTGL

SEQ ID NO: 1265239 - protein, 27 aa, Mycobacterium
GAFEVNEAFAPVPMAWLKDIGADEKKL

SEQ ID NO: 1265240 - protein, 18 aa, Mycobacterium
GAFHGRTMGSLALTGQPS

SEQ ID NO: 1265241 - protein, 20 aa, Mycobacterium
GAFLALLPRIERFWENSSTA

SEQ ID NO: 1265242 - protein, 19 aa, Mycobacterium
GAFLGLWQPTGHRGYGIVG

SEQ ID NO: 1265243 - protein, 18 aa, Mycobacterium
GAFRHQLHGLPLPTRRLL

SEQ ID NO: 1265244 - protein, 18 aa, Mycobacterium
GAGCAMCADEHRRLANTL

SEQ ID NO: 1265245 - protein, 24 aa, Mycobacterium
GAGCHLDALMVRRALEALDPDPGT

SEQ ID NO: 1265246 - protein, 27 aa, Mycobacterium
GAGDKARNARAWHHAVAAAELHTAELK

SEQ ID NO: 1265247 - protein, 18 aa, Mycobacterium
GAGFPCFSAMPTPGDALL

SEQ ID NO: 1265248 - protein, 23 aa, Mycobacterium
GAGGLGGAFARGGDGGRGGAAIG

SEQ ID NO: 1265249 - protein, 26 aa, Mycobacterium
GAGGPGGATRPAWSPTGAPGAGGAGG

SEQ ID NO: 1265250 - protein, 25 aa, Mycobacterium
GAGISRPTFYFYFASKDAVLLTLLE

SEQ ID NO: 1265251 - protein, 21 aa, Mycobacterium
GAGLARHAAALGMTVVLADID

SEQ ID NO: 1265252 - protein, 18 aa, Mycobacterium
GAGLLGRAPVGRFPHDRG

SEQ ID NO: 1265253 - protein, 20 aa, Mycobacterium
GAGLRDAMNLAWKLAGVHHG

SEQ ID NO: 1265254 - protein, 32 aa, Mycobacterium
GAGLVRMVRPWNEWLIVWGYDINDEPPALDED

SEQ ID NO: 1265255 - protein, 17 aa, Mycobacterium
GAGMCRTDFQLIDGYFD

SEQ ID NO: 1265256 - protein, 18 aa, Mycobacterium
GAGNCSRQVHNFGTATAF

SEQ ID NO: 1265257 - protein, 29 aa, Mycobacterium
GAGPEYSHLTLSWVYDWMAQGVPVVAMHR

SEQ ID NO: 1265258 - protein, 25 aa, Mycobacterium
GAGPIGCMHIRIARGVHNCGPVYLV

SEQ ID NO: 1265259 - protein, 24 aa, Mycobacterium
GAGPLAFTCVREFDTWTMAFDGTL

SEQ ID NO: 1265260 - protein, 17 aa, Mycobacterium
GAGRGSSYVGTPYGSAG

SEQ ID NO: 1265261 - protein, 19 aa, Mycobacterium
GAGRRARLTALPPYTTVQP

SEQ ID NO: 1265262 - protein, 30 aa, Mycobacterium
GAGSGSIGIEWCRSGPGCRAIAFERDETRR

SEQ ID NO: 1265263 - protein, 18 aa, Mycobacterium
GAGSHWAPTVAFDRFVES

SEQ ID NO: 1265264 - protein, 21 aa, Mycobacterium
GAGTFPWVLAITPPYSDRSQR

SEQ ID NO: 1265265 - protein, 18 aa, Mycobacterium
GAGTRPRLLYAAIEEAAK

SEQ ID NO: 1265266 - protein, 24 aa, Mycobacterium
GAGVLRGFKSFLWNVPIDDENHMM

SEQ ID NO: 1265267 - protein, 19 aa, Mycobacterium
GAGYCTRGNRGSVFEDLTV

SEQ ID NO: 1265268 - protein, 18 aa, Mycobacterium
GAHARSAVGVSELPRNAP

SEQ ID NO: 1265269 - protein, 19 aa, Mycobacterium
GAHFCLGAPLARLEATLAL

SEQ ID NO: 1265270 - protein, 19 aa, Mycobacterium
GAHFKVPGIHLSEPSPQRT

SEQ ID NO: 1265271 - protein, 19 aa, Mycobacterium
GAHGPFFTRNLVIVEDSEG

SEQ ID NO: 1265272 - protein, 17 aa, Mycobacterium
GAHGYVDSVRWWNVKHP

SEQ ID NO: 1265273 - protein, 30 aa, Mycobacterium
GAHTIALGLRVGWSRPEGRLSIPAGATLML

SEQ ID NO: 1265274 - protein, 17 aa, Mycobacterium
GAHWYSTGCDFKRPTPD

SEQ ID NO: 1265275 - protein, 25 aa, Mycobacterium
GAHYPGDVLAGFGIGAGIAVLGARV

SEQ ID NO: 1265276 - protein, 19 aa, Mycobacterium
GAIEACARKLFVHPNTVRY

SEQ ID NO: 1265277 - protein, 18 aa, Mycobacterium
GAIEACARQLFVHPNTVR

SEQ ID NO: 1265278 - protein, 18 aa, Mycobacterium
GAIFAYWVANPSAYGVVE

SEQ ID NO: 1265279 - protein, 19 aa, Mycobacterium
GAIGLEIAGYLAAHGAGNV

SEQ ID NO: 1265280 - protein, 22 aa, Mycobacterium
GAIGRPRVPVEVNHEPFLTLGI

SEQ ID NO: 1265281 - protein, 18 aa, Mycobacterium
GAIIEWISAVMTLLPGDL

SEQ ID NO: 1265282 - protein, 21 aa, Mycobacterium
GAIKAAAVDVWYRYPADGTGC

SEQ ID NO: 1265283 - protein, 19 aa, Mycobacterium
GAILAFPRTQWIRWRKPVI

SEQ ID NO: 1265284 - protein, 24 aa, Mycobacterium
GAILNVLSVLSWLHPPTSGAYSAA

SEQ ID NO: 1265285 - protein, 18 aa, Mycobacterium
GAINVLFDRADSIELVVN

SEQ ID NO: 1265286 - protein, 18 aa, Mycobacterium
GAIQQTWHPPASVNAETP

SEQ ID NO: 1265287 - protein, 18 aa, Mycobacterium
GAIRLIYPRETLWRPPVL

SEQ ID NO: 1265288 - protein, 17 aa, Mycobacterium
GAITAPTLVVWTSDDPT

SEQ ID NO: 1265289 - protein, 18 aa, Mycobacterium
GAIVPWNTPLFIAALKLG

SEQ ID NO: 1265290 - protein, 17 aa, Mycobacterium
GAKALGSFAQFEFLLVA

SEQ ID NO: 1265291 - protein, 18 aa, Mycobacterium
GAKKFLADFNRLVNDRQI

SEQ ID NO: 1265292 - protein, 19 aa, Mycobacterium
GAKSLCRACPRRWQCARDA

SEQ ID NO: 1265293 - protein, 19 aa, Mycobacterium
GAKSVAHLMAWKTGSSSRN

SEQ ID NO: 1265294 - protein, 18 aa, Mycobacterium
GALAEAREAMAIGSGLDN

SEQ ID NO: 1265295 - protein, 24 aa, Mycobacterium
GALAEDRPAPGLVRGESHDTPKTA

SEQ ID NO: 1265296 - protein, 26 aa, Mycobacterium
GALAEDRPGPGLARGECGDPPKTAWL

SEQ ID NO: 1265297 - protein, 24 aa, Mycobacterium
GALAEMGFGQIVLFTHDRCSDQTL

SEQ ID NO: 1265298 - protein, 18 aa, Mycobacterium
GALARPTEIANLSLAEIQ

SEQ ID NO: 1265299 - protein, 17 aa, Mycobacterium
GALARYASLPTKALFRI

SEQ ID NO: 1265300 - protein, 17 aa, Mycobacterium
GALDEWSLNPGSVTSWH

SEQ ID NO: 1265301 - protein, 19 aa, Mycobacterium
GALELRWPPIDAAGQTVVY

SEQ ID NO: 1265302 - protein, 18 aa, Mycobacterium
GALGALVCGGVDVTDLPD

SEQ ID NO: 1265303 - protein, 27 aa, Mycobacterium
GALHKRGVGFGDRVLILMLNRTEFIEA

SEQ ID NO: 1265304 - protein, 21 aa, Mycobacterium
GALHLTMPISLRASSDAPGGN

SEQ ID NO: 1265305 - protein, 18 aa, Mycobacterium
GALLRAKFANPLPFTTPL

SEQ ID NO: 1265306 - protein, 22 aa, Mycobacterium
GALLVCPMCGHEWSADEVSDVD

SEQ ID NO: 1265307 - protein, 20 aa, Mycobacterium
GALNRPALAAIAFSDEEKRA

SEQ ID NO: 1265308 - protein, 19 aa, Mycobacterium
GALPDASPNPAFREALARF

SEQ ID NO: 1265309 - protein, 25 aa, Mycobacterium
GALPGGDILDVWRTYPVDRRRNLLH

SEQ ID NO: 1265310 - protein, 17 aa, Mycobacterium
GALPGLMVKAERNGYRA

SEQ ID NO: 1265311 - protein, 24 aa, Mycobacterium
GALRAAGLPEEWSPESESSRELLH

SEQ ID NO: 1265312 - protein, 28 aa, Mycobacterium
GALRDYDQRRAVSWPAQARPYTGAADMT

SEQ ID NO: 1265313 - protein, 17 aa, Mycobacterium
GALRLAIARALILVQPE

SEQ ID NO: 1265314 - protein, 25 aa, Mycobacterium
GALRRVVVMAHGFGGTKDSGLEPFA

SEQ ID NO: 1265315 - protein, 22 aa, Mycobacterium
GALRVAYGDGVTGWVAATKQSY

SEQ ID NO: 1265316 - protein, 23 aa, Mycobacterium
GALRVPPNFHCEIAVDSVVVVQS

SEQ ID NO: 1265317 - protein, 20 aa, Mycobacterium
GALRVYGVAGLRVADGSIMP

SEQ ID NO: 1265318 - protein, 17 aa, Mycobacterium
GALVVLVDGALAWFVER

SEQ ID NO: 1265319 - protein, 17 aa, Mycobacterium
GALYADLPRDFPSAVKH

SEQ ID NO: 1265320 - protein, 21 aa, Mycobacterium
GALYPPLIIRGLGTRQVYSAS

SEQ ID NO: 1265321 - protein, 18 aa, Mycobacterium
GALYWHFANKQQLLGAVA

SEQ ID NO: 1265322 - protein, 17 aa, Mycobacterium
GAMAQCSIEEALELRLG

SEQ ID NO: 1265323 - protein, 18 aa, Mycobacterium
GAMDIAGSMNITFKADIA

SEQ ID NO: 1265324 - protein, 24 aa, Mycobacterium
GAMQRCGATWGVGLTGVAGPEPHG

SEQ ID NO: 1265325 - protein, 23 aa, Mycobacterium
GAMVRDRLEAIASQYEGVSARGR

SEQ ID NO: 1265326 - protein, 19 aa, Mycobacterium
GANALRLAEKCGGATTPAI

SEQ ID NO: 1265327 - protein, 18 aa, Mycobacterium
GANEPFGEWLPRGQGEDV

SEQ ID NO: 1265328 - protein, 18 aa, Mycobacterium
GANLARLELRVLFEELLA

SEQ ID NO: 1265329 - protein, 22 aa, Mycobacterium
GANLGASFAKWSPESGETIGER

SEQ ID NO: 1265330 - protein, 22 aa, Mycobacterium
GANPAVSAWNWLESVPGGWRRA

SEQ ID NO: 1265331 - protein, 18 aa, Mycobacterium
GANPDGWLSALRTELRLA

SEQ ID NO: 1265332 - protein, 25 aa, Mycobacterium
GANPRELAGWLAAALVAKDGIAAAD

SEQ ID NO: 1265333 - protein, 18 aa, Mycobacterium
GAPCTHGTPFRRASEQGL

SEQ ID NO: 1265334 - protein, 24 aa, Mycobacterium
GAPDTPWRVSIISFPSREATTPLP

SEQ ID NO: 1265335 - protein, 20 aa, Mycobacterium
GAPDYRSWRDAVLAADDLGV

SEQ ID NO: 1265336 - protein, 19 aa, Mycobacterium
GAPFAEFPESGFDRVFDVN

SEQ ID NO: 1265337 - protein, 21 aa, Mycobacterium
GAPHAVACHRLQVAVSSVRNL

SEQ ID NO: 1265338 - protein, 21 aa, Mycobacterium
GAPIARPALDVPMADEKRQSE

SEQ ID NO: 1265339 - protein, 20 aa, Mycobacterium
GAPITWPVTPYLGADGRTID

SEQ ID NO: 1265340 - protein, 19 aa, Mycobacterium
GAPLAPGEFILGYPDENGP

SEQ ID NO: 1265341 - protein, 19 aa, Mycobacterium
GAPLARAEAKVSINRLLDR

SEQ ID NO: 1265342 - protein, 25 aa, Mycobacterium
GAPLARLEATLALTALTSRFPDAKL

SEQ ID NO: 1265343 - protein, 27 aa, Mycobacterium
GAPMAKRLVDWPGGLIVFDVRTEAMTP

SEQ ID NO: 1265344 - protein, 32 aa, Mycobacterium
GAPMATTAVCARITRRARYLAEIAWVGDSAAY

SEQ ID NO: 1265345 - protein, 24 aa, Mycobacterium
GAPPFPGALWLQVRDIAAAQEQLR

SEQ ID NO: 1265346 - protein, 17 aa, Mycobacterium
GAPRFGDIVADLAELLR

SEQ ID NO: 1265347 - protein, 20 aa, Mycobacterium
GAPRPGCGRISRVRLAMRAR

SEQ ID NO: 1265348 - protein, 22 aa, Mycobacterium
GAPVCAAGQCMLTSTATGSRMT

SEQ ID NO: 1265349 - protein, 27 aa, Mycobacterium
GAPVLAICAAIQVLGHWYETSAGERVD

SEQ ID NO: 1265350 - protein, 26 aa, Mycobacterium
GAQFPAWVRQLERIFGVSASTYAGHQ

SEQ ID NO: 1265351 - protein, 26 aa, Mycobacterium
GAQGGRPEALAGLGGARRGQLLPAVS

SEQ ID NO: 1265352 - protein, 24 aa, Mycobacterium
GAQGGRPEALGGLGGARPGQLLPT

SEQ ID NO: 1265353 - protein, 23 aa, Mycobacterium
GAQLPDRPAVALAAGKLNGTKVG

SEQ ID NO: 1265354 - protein, 24 aa, Mycobacterium
GAQMPMRVIGMLLGIPEEDQRRVT

SEQ ID NO: 1265355 - protein, 18 aa, Mycobacterium
GAQRAVVVGHDWGSPVVT

SEQ ID NO: 1265356 - protein, 24 aa, Mycobacterium
GAQYSEWGALLARTDPSAPKHAGI

SEQ ID NO: 1265357 - protein, 22 aa, Mycobacterium
GARADCIAAGLAALGDGDGPVL

SEQ ID NO: 1265358 - protein, 20 aa, Mycobacterium
GARAKVALASRIYVEGRHDA

SEQ ID NO: 1265359 - protein, 23 aa, Mycobacterium
GARDWEYSTGRYWKVVNPSKLNE

SEQ ID NO: 1265360 - protein, 22 aa, Mycobacterium
GAREHALLLALRRDPEVEALSV

SEQ ID NO: 1265361 - protein, 23 aa, Mycobacterium
GAREVAEAVELIRQAERPILLVG

SEQ ID NO: 1265362 - protein, 23 aa, Mycobacterium
GARFRPGGFTARFGGDASTMTGR

SEQ ID NO: 1265363 - protein, 18 aa, Mycobacterium
GARGDLKGVRIGVVKQLR

SEQ ID NO: 1265364 - protein, 18 aa, Mycobacterium
GARIDEMFLIPADDPSGR

SEQ ID NO: 1265365 - protein, 17 aa, Mycobacterium
GARIFNDVVRWCADVGV

SEQ ID NO: 1265366 - protein, 23 aa, Mycobacterium
GARLRLEPQRSWEANEPSELDKV

SEQ ID NO: 1265367 - protein, 27 aa, Mycobacterium
GARPDPFCGMESCWLQHMESAHRDVVD

SEQ ID NO: 1265368 - protein, 22 aa, Mycobacterium
GARRPLIGSMTMRLSTEVDGEV

SEQ ID NO: 1265369 - protein, 27 aa, Mycobacterium
GARSPWPTWRAHPLLSPFLHGHHDGIL

SEQ ID NO: 1265370 - protein, 31 aa, Mycobacterium
GARVIESWTPVPGRFPSYLVEHMTGVEEKVR

SEQ ID NO: 1265371 - protein, 28 aa, Mycobacterium
GASAGYWGSLLPAVWSFMLALRSRGLGS

SEQ ID NO: 1265372 - protein, 18 aa, Mycobacterium
GASAKRATALPAYAEAHA

SEQ ID NO: 1265373 - protein, 18 aa, Mycobacterium
GASAPAPDQGWFFEDGAH

SEQ ID NO: 1265374 - protein, 20 aa, Mycobacterium
GASERPRVLAAIAPDTGFRD

SEQ ID NO: 1265375 - protein, 17 aa, Mycobacterium
GASGGWLGTAFAACPES

SEQ ID NO: 1265376 - protein, 24 aa, Mycobacterium
GASMSAGDFVRWCRQVLDLADQVR

SEQ ID NO: 1265377 - protein, 17 aa, Mycobacterium
GASRYVLPVFAPLVRAV

SEQ ID NO: 1265378 - protein, 20 aa, Mycobacterium
GASVLKQLVAYVGLDAFLAG

SEQ ID NO: 1265379 - protein, 24 aa, Mycobacterium
GASVPEILVRGVLDRLAEHGYDVV

SEQ ID NO: 1265380 - protein, 17 aa, Mycobacterium
GASWAPRLPTYGGNDRT

SEQ ID NO: 1265381 - protein, 28 aa, Mycobacterium
GATAPAGWAVGEGMAVAMIATIPPRGHF

SEQ ID NO: 1265382 - protein, 30 aa, Mycobacterium; identical to SEQ ID NO: 97057

SEQ ID NO: 1265383 - protein, 24 aa, Mycobacterium
GATFPRSTLDKMLDAAMAACDQLF

SEQ ID NO: 1265384 - protein, 32 aa, Mycobacterium
GATLPRNRFCAPRVEPEVAFLLDQPLRGPGIT

SEQ ID NO: 1265385 - protein, 18 aa, Mycobacterium
GATLRVVSIADWADDVVH

SEQ ID NO: 1265386 - protein, 23 aa, Mycobacterium
GATPDRFLVGLAVLSLMAAASTG

SEQ ID NO: 1265387 - protein, 27 aa, Mycobacterium
GATPPGMTFVSWLPFYHDMGLIKGVCA

SEQ ID NO: 1265388 - protein, 24 aa, Mycobacterium
GATSLKRLLADRLRISDKTAGERL

SEQ ID NO: 1265389 - protein, 20 aa, Mycobacterium
GATVRLPVKAQWLVVDPAKA

SEQ ID NO: 1265390 - protein, 18 aa, Mycobacterium
GAVAHLFDSLLGFTAYKL

SEQ ID NO: 1265391 - protein, 17 aa, Mycobacterium
GAVALALAAARPDLVSG

SEQ ID NO: 1265392 - protein, 17 aa, Mycobacterium
GAVALVAGWAARNSPPA

SEQ ID NO: 1265393 - protein, 23 aa, Mycobacterium
GAVESLAALSARVLYVTNNASRS

SEQ ID NO: 1265394 - protein, 18 aa, Mycobacterium
GAVGHVFNLGHGVLPATD

SEQ ID NO: 1265395 - protein, 20 aa, Mycobacterium
GAVGQLLLSHFVVAQAISGL

SEQ ID NO: 1265396 - protein, 23 aa, Mycobacterium
GAVKLPGGLWIVTERAVATESGE

SEQ ID NO: 1265397 - protein, 26 aa, Mycobacterium
GAVLACPCGPATGSFAEEYTAKFNQE

SEQ ID NO: 1265398 - protein, 19 aa, Mycobacterium
GAVLADWGADVIKIEHPET

SEQ ID NO: 1265399 - protein, 19 aa, Mycobacterium
GAVLADWGADVVKIENPVT

SEQ ID NO: 1265400 - protein, 18 aa, Mycobacterium
GAVLPMAGVSWVAVAPTH

SEQ ID NO: 1265401 - protein, 19 aa, Mycobacterium
GAVLSDWGAEVVKIEHPVT

SEQ ID NO: 1265402 - protein, 19 aa, Mycobacterium
GAVMVHPYVASKWAVRGLT

SEQ ID NO: 1265403 - protein, 20 aa, Mycobacterium
GAVPVMCLPGHRTAELGHFA

SEQ ID NO: 1265404 - protein, 17 aa, Mycobacterium
GAVRPGPDDVRRAVREG

SEQ ID NO: 1265405 - protein, 26 aa, Mycobacterium
GAVSGARFHPKYAVAPLAALATVMPM

SEQ ID NO: 1265406 - protein, 19 aa, Mycobacterium
GAVSRLRGVAHLRGHETDR

SEQ ID NO: 1265407 - protein, 18 aa, Mycobacterium
GAVTATLDRSPLRTVQFP

SEQ ID NO: 1265408 - protein, 19 aa, Mycobacterium
GAVTRYFAAYNLVCGPVVD

SEQ ID NO: 1265409 - protein, 20 aa, Mycobacterium
GAVTRYTVRLSQPAVVSAKE

SEQ ID NO: 1265410 - protein, 18 aa, Mycobacterium
GAVVSRTDLLGALPGSGT

SEQ ID NO: 1265411 - protein, 24 aa, Mycobacterium
GAYAEYCLAPADFVAYVPDGVAPE

SEQ ID NO: 1265412 - protein, 19 aa, Mycobacterium
GAYFAARHVASFYPEVVIA

SEQ ID NO: 1265413 - protein, 26 aa, Mycobacterium
GAYTQLPFKLAWAITIHKSQGQTLER

SEQ ID NO: 1265414 - protein, 19 aa, Mycobacterium
GAYVTGWIKRGARGVIGTN

SEQ ID NO: 1265415 - protein, 24 aa, Mycobacterium
GAYWAAQACGRVMAPGSSIVNISS

SEQ ID NO: 1265416 - protein, 18 aa, Mycobacterium
GAYYLPSQLLKNLFGAAI

SEQ ID NO: 1265417 - protein, 17 aa, Mycobacterium
GCADPLYRRAVRVSMGH

SEQ ID NO: 1265418 - protein, 24 aa, Mycobacterium
GCAGDACLHWGAMWGPASRADYVD

SEQ ID NO: 1265419 - protein, 19 aa, Mycobacterium
GCAIARALSGTGLSVTLLE

SEQ ID NO: 1265420 - protein, 22 aa, Mycobacterium
GCAKRIVAAAVDAFGAVHGLVN

SEQ ID NO: 1265421 - protein, 17 aa, Mycobacterium
GCASSAWTLGFYALHNW

SEQ ID NO: 1265422 - protein, 17 aa, Mycobacterium
GCAYCGKTAGTMQRDCV

SEQ ID NO: 1265423 - protein, 24 aa, Mycobacterium
GCCALCGIKNTWNGLTLALIIDHI

SEQ ID NO: 1265424 - protein, 33 aa, Mycobacterium
GCDGVVIGRGCLGRPWLFAELSAAFNGTAPATP

SEQ ID NO: 1265425 - protein, 19 aa, Mycobacterium
GCDHEIRPATSHLVVWPAD

SEQ ID NO: 1265426 - protein, 25 aa, Mycobacterium
GCDVGYRPGQFLTLRVPSERTGFVA

SEQ ID NO: 1265427 - protein, 18 aa, Mycobacterium
GCDWSLTQHYIFSRESTL

SEQ ID NO: 1265428 - protein, 22 aa, Mycobacterium
GCEGCSMMADHLGPLSHLHAKD

SEQ ID NO: 1265429 - protein, 23 aa, Mycobacterium
GCEVKDACLEYALANDERFGIWG

SEQ ID NO: 1265430 - protein, 23 aa, Mycobacterium
GCGDACPIFPGKRYENWELPDPA

SEQ ID NO: 1265431 - protein, 23 aa, Mycobacterium
GCGDACPVFPGRRYEEWKLDDPA

SEQ ID NO: 1265432 - protein, 23 aa, Mycobacterium
GCGDSRVAAEIIFDQGLGDMFVV

SEQ ID NO: 1265433 - protein, 19 aa, Mycobacterium
GCGHAELSLALAADGYTVT

SEQ ID NO: 1265434 - protein, 19 aa, Mycobacterium
GCGHMGPPADPECALDELT

SEQ ID NO: 1265435 - protein, 21 aa, Mycobacterium
GCGKTTLLRILAGFEDPDSGT

SEQ ID NO: 1265436 - protein, 18 aa, Mycobacterium
GCGMVNPNVLRACGIDPE

SEQ ID NO: 1265437 - protein, 21 aa, Mycobacterium
GCGPGRLVAHLVQRGVPALGV

SEQ ID NO: 1265438 - protein, 22 aa, Mycobacterium
GCGSCKELVGQIVEWAAGGAVT

SEQ ID NO: 1265439 - protein, 18 aa, Mycobacterium
GCHNHLKINPQLQLAAQW

SEQ ID NO: 1265440 - protein, 25 aa, Mycobacterium
GCIGCGCLSLKVCALANPGDVLSEE

SEQ ID NO: 1265441 - protein, 20 aa, Mycobacterium
GCINLSPANAQWFFDNFGSG

SEQ ID NO: 1265442 - protein, 19 aa, Mycobacterium
GCPPWQGPNPREFRDDVVR

SEQ ID NO: 1265443 - protein, 31 aa, Mycobacterium
GCRGRWCRCGRWGRSTRWCRRGIGGRASRWR

SEQ ID NO: 1265444 - protein, 25 aa, Mycobacterium
GCRGWQWQRFSTAWTPSQPGTVEVA

SEQ ID NO: 1265445 - protein, 22 aa, Mycobacterium
GCRMGICQSCVVGLLDGHVRDL

SEQ ID NO: 1265446 - protein, 18 aa, Mycobacterium
GCRVQPLGVMRYVPVATE

SEQ ID NO: 1265447 - protein, 19 aa, Mycobacterium
GCRVQSLGVMRYLSVASAG

SEQ ID NO: 1265448 - protein, 23 aa, Mycobacterium
GCSAIGGYVRYHAILGASRHCIA

SEQ ID NO: 1265449 - protein, 17 aa, Mycobacterium
GCSGEGIRTTWLDTSHA

SEQ ID NO: 1265450 - protein, 19 aa, Mycobacterium
GCSPEHIERGASMHDLGVG

SEQ ID NO: 1265451 - protein, 18 aa, Mycobacterium
GCSRGRGGSMHLFDADRR

SEQ ID NO: 1265452 - protein, 19 aa, Mycobacterium
GCSVDRWLENKTWNDVLAW

SEQ ID NO: 1265453 - protein, 26 aa, Mycobacterium
GCVRILPEHIRRGWIAMGRAAIEGRK

SEQ ID NO: 1265454 - protein, 17 aa, Mycobacterium
GDAFCVGADFGAQEDPF

SEQ ID NO: 1265455 - protein, 21 aa, Mycobacterium
GDAFMSGLIDALWTHGLLGAE

SEQ ID NO: 1265456 - protein, 17 aa, Mycobacterium
GDAGYKFADEFHPELQF

SEQ ID NO: 1265457 - protein, 21 aa, Mycobacterium
GDAHRGASLIVWAIAEGRSAA

SEQ ID NO: 1265458 - protein, 23 aa, Mycobacterium
GDAHRGASLIVWAIAEGRSAAHA

SEQ ID NO: 1265459 - protein, 26 aa, Mycobacterium
GDAKERVCSAAHTVAMAVQRQTNANI

SEQ ID NO: 1265460 - protein, 20 aa, Mycobacterium
GDALLARFPAAGVSLDVSRL

SEQ ID NO: 1265461 - protein, 19 aa, Mycobacterium
GDALLARFPGAGVSLETSR

SEQ ID NO: 1265462 - protein, 17 aa, Mycobacterium
GDALRDVKSGWKVAEAF

SEQ ID NO: 1265463 - protein, 23 aa, Mycobacterium
GDALTRWNAFTATPAVAMDITRP

SEQ ID NO: 1265464 - protein, 20 aa, Mycobacterium
GDALVGLTFGPTVAADGDAL

SEQ ID NO: 1265465 - protein, 21 aa, Mycobacterium
GDAPVGLIVRNRLQHAAAIAG

SEQ ID NO: 1265466 - protein, 17 aa, Mycobacterium
GDARAALGVLDGHRLLC

SEQ ID NO: 1265467 - protein, 18 aa, Mycobacterium
GDARRIGDRLVLTHDGVS

SEQ ID NO: 1265468 - protein, 20 aa, Mycobacterium
GDASTLWRAAEVLGIETNAA

SEQ ID NO: 1265469 - protein, 23 aa, Mycobacterium
GDAWEIELYKDWGETKIAEQGLL

SEQ ID NO: 1265470 - protein, 19 aa, Mycobacterium
GDAWQVGYVPTRLRDQFGS

SEQ ID NO: 1265471 - protein, 19 aa, Mycobacterium
GDAYAGPLIDELRRRPYDL

SEQ ID NO: 1265472 - protein, 21 aa, Mycobacterium
GDCACWGGIPAMEPNPSGSTG

SEQ ID NO: 1265473 - protein, 19 aa, Mycobacterium
GDCGVKSNCLSVQPVETEL

SEQ ID NO: 1265474 - protein, 28 aa, Mycobacterium
GDCLPERDFPTLISLYLQGRFPLDKFVS

SEQ ID NO: 1265475 - protein, 17 aa, Mycobacterium
GDCTELNSLAATYGAGA

SEQ ID NO: 1265476 - protein, 25 aa, Mycobacterium
GDDAMLPSSFCHELAALATEPQSQP

SEQ ID NO: 1265477 - protein, 22 aa, Mycobacterium
GDDARPGAVFVGRNRNGSRSWS

SEQ ID NO: 1265478 - protein, 22 aa, Mycobacterium
GDDAWMFGVRICPDLDTCMYTL

SEQ ID NO: 1265479 - protein, 18 aa, Mycobacterium
GDDDLEWLRAVSVGPTFD

SEQ ID NO: 1265480 - protein, 17 aa, Mycobacterium
GDDGLSVLAERVTVDPR

SEQ ID NO: 1265481 - protein, 18 aa, Mycobacterium
GDDGVQVCGRMRTVSDAH

SEQ ID NO: 1265482 - protein, 26 aa, Mycobacterium
GDDIAEVLALLGVRPIWDDASRRVVD

SEQ ID NO: 1265483 - protein, 33 aa, Mycobacterium
GDDKLRPAMAIGKEIDLRFVFGYTPLEFRDTLH

SEQ ID NO: 1265484 - protein, 24 aa, Mycobacterium
GDDNPLPFAIALAGAAGLRMRMLS

SEQ ID NO: 1265485 - protein, 22 aa, Mycobacterium
GDDPYRLVVEALPGDGPLAVAV

SEQ ID NO: 1265486 - protein, 18 aa, Mycobacterium
GDDTFCFTYGDGVSDLDV

SEQ ID NO: 1265487 - protein, 24 aa, Mycobacterium
GDDWPPLQAGLFGGSIHRLSDALQ

SEQ ID NO: 1265488 - protein, 34 aa, Mycobacterium
GDEKWAAEVRRLLKLRGATLLAHNYQLPAIQDVA

SEQ ID NO: 1265489 - protein, 30 aa, Mycobacterium
GDELDRTVALWRKRFDDVHIYPVAFHGDVA

SEQ ID NO: 1265490 - protein, 24 aa, Mycobacterium
GDELPDLVAVLSRLIGPIRRVVYD

SEQ ID NO: 1265491 - protein, 22 aa, Mycobacterium
GDELRRAASDYAREVATGAFPA

SEQ ID NO: 1265492 - protein, 22 aa, Mycobacterium
GDEPPTLAAMLLAALESGIEPA

SEQ ID NO: 1265493 - protein, 17 aa, Mycobacterium
GDERWLWGGPDGAGETL

SEQ ID NO: 1265494 - protein, 21 aa, Mycobacterium
GDEVACPFHDWRWGGDGKCKL

SEQ ID NO: 1265495 - protein, 25 aa, Mycobacterium
GDEVRVGRSRMIFWQGHGTGEGPGD

SEQ ID NO: 1265496 - protein, 24 aa, Mycobacterium
GDEYSVKDLRTWHGTVLAAAAFAD

SEQ ID NO: 1265497 - protein, 18 aa, Mycobacterium
GDFAHQWIRGELKNLGVS

SEQ ID NO: 1265498 - protein, 23 aa, Mycobacterium
GDFDGVGLLLARGSFAGVAGAGP

SEQ ID NO: 1265499 - protein, 17 aa, Mycobacterium
GDFRYAVSNSFGLGGHN

SEQ ID NO: 1265500 - protein, 22 aa, Mycobacterium
GDGALGFWKAMREVFPATREQR

SEQ ID NO: 1265501 - protein, 30 aa, Mycobacterium
GDGHLRWIQRDGSWYQAQWIDYELEANHLQ

SEQ ID NO: 1265502 - protein, 19 aa, Mycobacterium
GDGISVLIDLGRVNHVNAE

SEQ ID NO: 1265503 - protein, 20 aa, Mycobacterium
GDGPLAVAVTDSMPALHLLP

SEQ ID NO: 1265504 - protein, 21 aa, Mycobacterium
GDGPLGFLRDAWHQAQNPYGM

SEQ ID NO: 1265505 - protein, 26 aa, Mycobacterium
GDGPVAGLVKFEWDALTWFEEDEPIY

SEQ ID NO: 1265506 - protein, 19 aa, Mycobacterium
GDGPVLLHDLTWPLIADAT

SEQ ID NO: 1265507 - protein, 18 aa, Mycobacterium
GDGRCKQVPYSKRAPRLA

SEQ ID NO: 1265508 - protein, 17 aa, Mycobacterium
GDGRWAAELFGVTAAGT

SEQ ID NO: 1265509 - protein, 18 aa, Mycobacterium
GDGRWTDSAVRRYVTDAG

SEQ ID NO: 1265510 - protein, 20 aa, Mycobacterium
GDGSCSGWIINGQKRFITNA

SEQ ID NO: 1265511 - protein, 18 aa, Mycobacterium
GDGTGWSGSGGRGGDGGA

SEQ ID NO: 1265512 - protein, 25 aa, Mycobacterium
GDGTYSLRGHKWFTSAPMCDIFLVL

SEQ ID NO: 1265513 - protein, 21 aa, Mycobacterium
GDGVALAMWAGLPVSDLEFIQ

SEQ ID NO: 1265514 - protein, 18 aa, Mycobacterium
GDGVPAYNLAVVVDDAAT

SEQ ID NO: 1265515 - protein, 24 aa, Mycobacterium
GDGWWAQRLVDHAARLGISDAVTF

SEQ ID NO: 1265516 - protein, 17 aa, Mycobacterium
GDGYAIVGYALRFPGAA

SEQ ID NO: 1265517 - protein, 18 aa, Mycobacterium
GDGYVIDGEFTLKGVTKP

SEQ ID NO: 1265518 - protein, 17 aa, Mycobacterium
GDHAWKTINDYVTAVAP

SEQ ID NO: 1265519 - protein, 18 aa, Mycobacterium
GDHGLDELVDHIRELDLE

SEQ ID NO: 1265520 - protein, 24 aa, Mycobacterium
GDHHPHLLPLAGRVLEATDAETLS

SEQ ID NO: 1265521 - protein, 23 aa, Mycobacterium
GDHPRWPAFDDWVASHPPVDPGV

SEQ ID NO: 1265522 - protein, 23 aa, Mycobacterium
GDIAAIEGWRILGMLRGGDGLTM

SEQ ID NO: 1265523 - protein, 19 aa, Mycobacterium
GDIADVMLVGFSQGGIDGQ

SEQ ID NO: 1265524 - protein, 17 aa, Mycobacterium
GDIAEWGAAAAEGRASF

SEQ ID NO: 1265525 - protein, 25 aa, Mycobacterium
GDIDRGGVFAAFFGTVALLSPEDQA

SEQ ID NO: 1265526 - protein, 17 aa, Mycobacterium
GDIEMLQFTAAGTGPSM

SEQ ID NO: 1265527 - protein, 24 aa, Mycobacterium
GDIHIFHAKAIVFATGGSGRMYKT

SEQ ID NO: 1265528 - protein, 23 aa, Mycobacterium
GDIIPRLVADGMAAVYDFNDNEV

SEQ ID NO: 1265529 - protein, 17 aa, Mycobacterium
GDILAVLTAIAPEVEPD

SEQ ID NO: 1265530 - protein, 24 aa, Mycobacterium
GDIPIRPGTRVRIGEVELEVVRIL

SEQ ID NO: 1265531 - protein, 24 aa, Mycobacterium
GDIPLLLDMPMAYTARALEDSTCL

SEQ ID NO: 1265532 - protein, 20 aa, Mycobacterium
GDISGVLSILAFTFTMVTGG

SEQ ID NO: 1265533 - protein, 17 aa, Mycobacterium
GDITTPMFLSVDSPTRS

SEQ ID NO: 1265534 - protein, 20 aa, Mycobacterium
GDKAGYLPGFGVLPAEEVRA

SEQ ID NO: 1265535 - protein, 19 aa, Mycobacterium
GDKAVKMILVEGETKNTTR

SEQ ID NO: 1265536 - protein, 21 aa, Mycobacterium
GDKLWFDSYLDSVTESHGAVL

SEQ ID NO: 1265537 - protein, 19 aa, Mycobacterium
GDKVSLWYGSANRDESKFR

SEQ ID NO: 1265538 - protein, 18 aa, Mycobacterium
GDLAAAHGEIHRLGATGE

SEQ ID NO: 1265539 - protein, 17 aa, Mycobacterium
GDLAAAHRVFTALIDAM

SEQ ID NO: 1265540 - protein, 17 aa, Mycobacterium
GDLANWMVPGKMVKGMG

SEQ ID NO: 1265541 - protein, 29 aa, Mycobacterium
GDLAYRDADGWIYLAGRTADWMRVDGENM

SEQ ID NO: 1265542 - protein, 33 aa, Mycobacterium
GDLAYRDERGFAYFAGRLGDWMRVDGENLGTAP

SEQ ID NO: 1265543 - protein, 22 aa, Mycobacterium
GDLDFLRRPLLGFLSMAAGPTP

SEQ ID NO: 1265544 - protein, 21 aa, Mycobacterium
GDLDGLMAMLAPDVVWTADSD

SEQ ID NO: 1265545 - protein, 24 aa, Mycobacterium
GDLDILETITRWRPYLTGERNSYA

SEQ ID NO: 1265546 - protein, 19 aa, Mycobacterium
GDLELLRDQGFRLLAMTPD

SEQ ID NO: 1265547 - protein, 21 aa, Mycobacterium
GDLFAVLFLLAGRRTAGLAAA

SEQ ID NO: 1265548 - protein, 17 aa, Mycobacterium
GDLGVMFDDELYIIGRI

SEQ ID NO: 1265549 - protein, 19 aa, Mycobacterium
GDLHKLWRMRDRKGYHVEY

SEQ ID NO: 1265550 - protein, 27 aa, Mycobacterium
GDLLEYWSGRRWPSGRHRVLPPQPGAP

SEQ ID NO: 1265551 - protein, 23 aa, Mycobacterium
GDLLFGAAMPDVFAASIRDVSGF

SEQ ID NO: 1265552 - protein, 28 aa, Mycobacterium
GDLLRYWLDEWRAYIAPKKVKLAADPLD

SEQ ID NO: 1265553 - protein, 17 aa, Mycobacterium
GDLNQVWTNIIDNAIQA

SEQ ID NO: 1265554 - protein, 19 aa, Mycobacterium
GDLPATVEFVGPVLPAGPE

SEQ ID NO: 1265555 - protein, 24 aa, Mycobacterium
GDLRGRFRWWGLYTQRKPGYDGTW

SEQ ID NO: 1265556 - protein, 33 aa, Mycobacterium
GDLRLDTVIRLTCGRALRLLPLPVEVDLFDGKS

SEQ ID NO: 1265557 - protein, 23 aa, Mycobacterium
GDLTALRYDNWKIVFLEQRAAGT

SEQ ID NO: 1265558 - protein, 23 aa, Mycobacterium
GDLTRPGTQVVVCAPQVPCGSAA

SEQ ID NO: 1265559 - protein, 17 aa, Mycobacterium
GDLYCRVPQDSPLSVRG

SEQ ID NO: 1265560 - protein, 27 aa, Mycobacterium
GDLYRIDPRTGAALGKEDWHGTFPSDW

SEQ ID NO: 1265561 - protein, 24 aa, Mycobacterium
GDMAARIAQHLGYQVFAVDLVPER

SEQ ID NO: 1265562 - protein, 21 aa, Mycobacterium
GDMLAVLRAWAALFTGDSAAL

SEQ ID NO: 1265563 - protein, 17 aa, Mycobacterium
GDMTIAVDPPRKWWQAG

SEQ ID NO: 1265564 - protein, 23 aa, Mycobacterium
GDMTYLQWLQRYIELAIGDGDST

SEQ ID NO: 1265565 - protein, 18 aa, Mycobacterium
GDMVRLGWDGTIEYRGRA

SEQ ID NO: 1265566 - protein, 17 aa, Mycobacterium
GDPAHAALTAWLSDGRP

SEQ ID NO: 1265567 - protein, 17 aa, Mycobacterium
GDPAIVFIDRAAQQAET

SEQ ID NO: 1265568 - protein, 21 aa, Mycobacterium
GDPARMFGRMLGIDGGVNPPF

SEQ ID NO: 1265569 - protein, 17 aa, Mycobacterium
GDPARVLVEYAQLRAQW

SEQ ID NO: 1265570 - protein, 27 aa, Mycobacterium
GDPASGEAFISGWRQVAGSARDASAAV

SEQ ID NO: 1265571 - protein, 18 aa, Mycobacterium
GDPCSYTPPADGLPTPGN

SEQ ID NO: 1265572 - protein, 19 aa, Mycobacterium
GDPCSYTPPADGLPTPGNP

SEQ ID NO: 1265573 - protein, 22 aa, Mycobacterium
GDPDRGWAWQVPLLELPDAQFL

SEQ ID NO: 1265574 - protein, 24 aa, Mycobacterium
GDPEAFTALAARFLGPTLDGVRPV

SEQ ID NO: 1265575 - protein, 26 aa, Mycobacterium
GDPGESRFYLSLADELMRRFNGATLE

SEQ ID NO: 1265576 - protein, 25 aa, Mycobacterium
GDPLEALLWLARTARQYGRPLRGGQ

SEQ ID NO: 1265577 - protein, 22 aa, Mycobacterium
GDPMPWGNAVIGVRNPCAPPLV

SEQ ID NO: 1265578 - protein, 21 aa, Mycobacterium
GDPNRCIWHVASYMYVPQDFR

SEQ ID NO: 1265579 - protein, 17 aa, Mycobacterium
GDPPLFFVHGLACDGTD

SEQ ID NO: 1265580 - protein, 24 aa, Mycobacterium
GDPQRARVTVRMLLTHTSGEVPDV

SEQ ID NO: 1265581 - protein, 22 aa, Mycobacterium
GDPQRPYVLGGLHNGTDLPDAA

SEQ ID NO: 1265582 - protein, 23 aa, Mycobacterium
GDPRGMAAMCLLITQSTIQSAQM

SEQ ID NO: 1265583 - protein, 21 aa, Mycobacterium
GDPSLFLRAAEKLGIAVDELA

SEQ ID NO: 1265584 - protein, 20 aa, Mycobacterium
GDPSRPVVYEDFLPASAAGI

SEQ ID NO: 1265585 - protein, 20 aa, Mycobacterium
GDPSSVVAFLSDPETAARGV

SEQ ID NO: 1265586 - protein, 17 aa, Mycobacterium
GDPTGIGDLAFGDLGTG

SEQ ID NO: 1265587 - protein, 21 aa, Mycobacterium
GDPTVVPGFNSVVPQLVPPAI

SEQ ID NO: 1265588 - protein, 20 aa, Mycobacterium
GDPVLRYARTHPATIPPGED

SEQ ID NO: 1265589 - protein, 17 aa, Mycobacterium
GDPVWLADVLRAEGLDV

SEQ ID NO: 1265590 - protein, 18 aa, Mycobacterium
GDPWGGGLDLVLGSETEP

SEQ ID NO: 1265591 - protein, 17 aa, Mycobacterium
GDPYLRTYGDYIVNLPN

SEQ ID NO: 1265592 - protein, 21 aa, Mycobacterium
GDQFMTEFLPGHYDFLQRLFA

SEQ ID NO: 1265593 - protein, 22 aa, Mycobacterium
GDQLPGGSAYVIGEAGLTTALH

SEQ ID NO: 1265594 - protein, 18 aa, Mycobacterium
GDQPRLQAPGAIQGAVPG

SEQ ID NO: 1265595 - protein, 27 aa, Mycobacterium
GDQQFKFTAALARREVTVWASDRSIHI

SEQ ID NO: 1265596 - protein, 21 aa, Mycobacterium
GDQTMFRKVFESVLAGHVKVL

SEQ ID NO: 1265597 - protein, 24 aa, Mycobacterium
GDQTMFRKVFESVLAGHVKVLVGN

SEQ ID NO: 1265598 - protein, 22 aa, Mycobacterium
GDRAWISMMALSDRWRDRGIGS

SEQ ID NO: 1265599 - protein, 26 aa, Mycobacterium
GDRDPRLAAAVVYRAWELGAVVYYVG

SEQ ID NO: 1265600 - protein, 17 aa, Mycobacterium
GDRELLALFDVALASRH

SEQ ID NO: 1265601 - protein, 20 aa, Mycobacterium
GDRFLLLPMPEWSANPIDPI

SEQ ID NO: 1265602 - protein, 19 aa, Mycobacterium
GDRGLCAGGDVVAIYHDAR

SEQ ID NO: 1265603 - protein, 17 aa, Mycobacterium
GDRLFLFGAGRGAACAR

SEQ ID NO: 1265604 - protein, 24 aa, Mycobacterium
GDRLRLALDGELAAAVTGSTSPLA

SEQ ID NO: 1265605 - protein, 19 aa, Mycobacterium
GDRLRRCGTVPVQELGGRI

SEQ ID NO: 1265606 - protein, 35 aa, Mycobacterium; identical to SEQ ID NO: 664232

SEQ ID NO: 1265607 - protein, 20 aa, Mycobacterium
GDRPEARWPEARRWLDERGY

SEQ ID NO: 1265608 - protein, 27 aa, Mycobacterium
GDRVAIWSPNTWHWVVACLAIHHAGGV

SEQ ID NO: 1265609 - protein, 20 aa, Mycobacterium
GDRVMVIARNCIEWPEISFG

SEQ ID NO: 1265610 - protein, 17 aa, Mycobacterium
GDRWCVTATNWLRAHRD

SEQ ID NO: 1265611 - protein, 24 aa, Mycobacterium
GDSDFYAVCGWDAITEAVARPGDF

SEQ ID NO: 1265612 - protein, 21 aa, Mycobacterium
GDSGFRPLMSVLLDTLDELAG

SEQ ID NO: 1265613 - protein, 19 aa, Mycobacterium
GDSNVRWLQEHGVTIWDEW

SEQ ID NO: 1265614 - protein, 21 aa, Mycobacterium
GDSPLMRAMCSEVVDVDTLTD

SEQ ID NO: 1265615 - protein, 26 aa, Mycobacterium
GDSVGRLAYLLGEVGGNIPIVALFVR

SEQ ID NO: 1265616 - protein, 18 aa, Mycobacterium
GDTAPGRKVWSQLADLGV

SEQ ID NO: 1265617 - protein, 26 aa, Mycobacterium
GDTDISWSRITYWRALLASAIDDPPH

SEQ ID NO: 1265618 - protein, 23 aa, Mycobacterium
GDTEVRPILLWHALEECEHKAVA

SEQ ID NO: 1265619 - protein, 24 aa, Mycobacterium
GDTEVRPILLWHALEECEHKAVAF

SEQ ID NO: 1265620 - protein, 25 aa, Mycobacterium
GDTFPLAPIQHAMWIGRNEDQQLGG

SEQ ID NO: 1265621 - protein, 24 aa, Mycobacterium
GDTLPRPLLEVLFDTDGDNGQTLR

SEQ ID NO: 1265622 - protein, 18 aa, Mycobacterium
GDTLSVRLIRRLAGLGIL

SEQ ID NO: 1265623 - protein, 20 aa, Mycobacterium
GDTPLPVRTPLPVQLPEPMA

SEQ ID NO: 1265624 - protein, 21 aa, Mycobacterium
GDTRVPTWVVVGDKATVGEAT

SEQ ID NO: 1265625 - protein, 19 aa, Mycobacterium
GDTRWIHRAAHDLMGVNPA

SEQ ID NO: 1265626 - protein, 18 aa, Mycobacterium
GDTTRTWYVIDATDVVLG

SEQ ID NO: 1265627 - protein, 23 aa, Mycobacterium
GDTVDLMALFALHGQALYDTALR

SEQ ID NO: 1265628 - protein, 18 aa, Mycobacterium
GDTVRLALHLGRRQRLSG

SEQ ID NO: 1265629 - protein, 24 aa, Mycobacterium
GDVAEKLGYERGIPQTPYDEDELV

SEQ ID NO: 1265630 - protein, 19 aa, Mycobacterium
GDVAGHLVELGFDADAADV

SEQ ID NO: 1265631 - protein, 20 aa, Mycobacterium
GDVAYGWAMEDSTGFAKLIV

SEQ ID NO: 1265632 - protein, 24 aa, Mycobacterium
GDVDPGVIFYLWRTAGMSVEDIEA

SEQ ID NO: 1265633 - protein, 24 aa, Mycobacterium
GDVEARAMLAFSLVIGNHLIAAEH

SEQ ID NO: 1265634 - protein, 26 aa, Mycobacterium
GDVILPFTILRRLDCILEPTKDEVLA

SEQ ID NO: 1265635 - protein, 24 aa, Mycobacterium
GDVIPAEWRCELVWHAEPPTTPAD

SEQ ID NO: 1265636 - protein, 19 aa, Mycobacterium
GDVIPEVLGPVVDLRDGSE

SEQ ID NO: 1265637 - protein, 19 aa, Mycobacterium
GDVLRRARVEQGRTLREVS

SEQ ID NO: 1265638 - protein, 18 aa, Mycobacterium
GDVLTQYGGITVEVLNTD

SEQ ID NO: 1265639 - protein, 22 aa, Mycobacterium
GDVPGGLPERIIGPLARAALDN

SEQ ID NO: 1265640 - protein, 19 aa, Mycobacterium
GDVRALFDFLAERRPGTGL

SEQ ID NO: 1265641 - protein, 18 aa, Mycobacterium
GDVRRVHRLLAYVPADVA

SEQ ID NO: 1265642 - protein, 19 aa, Mycobacterium
GDVRTVLRVLYLVFNEGYS

SEQ ID NO: 1265643 - protein, 18 aa, Mycobacterium
GDVSVGIVHFGVGGFHRA

SEQ ID NO: 1265644 - protein, 18 aa, Mycobacterium
GDVTRTAHDAGWDVVHVT

SEQ ID NO: 1265645 - protein, 26 aa, Mycobacterium
GDVVDWSFHGGGGWGDPLDADPDEVL

SEQ ID NO: 1265646 - protein, 25 aa, Mycobacterium
GDVVVCGRLKDVIIMAGRNIYPTDI

SEQ ID NO: 1265647 - protein, 20 aa, Mycobacterium
GDVYARPGLAPAQRQLVTLG

SEQ ID NO: 1265648 - protein, 22 aa, Mycobacterium
GDWRQCHRGVYFVDDRPYTDAA

SEQ ID NO: 1265649 - protein, 17 aa, Mycobacterium
GDYHLSGVVGWTLLGYP

SEQ ID NO: 1265650 - protein, 17 aa, Mycobacterium
GEAAAGVVMLRPASPGT

SEQ ID NO: 1265651 - protein, 18 aa, Mycobacterium
GEAAKWLYALTARLPMGQ

SEQ ID NO: 1265652 - protein, 22 aa, Mycobacterium
GEAAQDWPLLVADASQPSTLNA

SEQ ID NO: 1265653 - protein, 19 aa, Mycobacterium
GEAAVLCTFHHALSDGVGG

SEQ ID NO: 1265654 - protein, 21 aa, Mycobacterium
GEAAVSWLSPLVPLVDAEPTT

SEQ ID NO: 1265655 - protein, 21 aa, Mycobacterium
GEADLGLPHQVWQRLADTVDL

SEQ ID NO: 1265656 - protein, 23 aa, Mycobacterium
GEAHSRHAPTFVYRYDYAPRPLH

SEQ ID NO: 1265657 - protein, 26 aa, Mycobacterium
GEAKDFIAGGAIEIGGRLPINTHGGQ

SEQ ID NO: 1265658 - protein, 21 aa, Mycobacterium
GEAKFKVGDRVLVRDLPVLFY

SEQ ID NO: 1265659 - protein, 17 aa, Mycobacterium
GEALALQYFHSAPWVAW

SEQ ID NO: 1265660 - protein, 19 aa, Mycobacterium
GEALAPVLADGWHLASAAP

SEQ ID NO: 1265661 - protein, 24 aa, Mycobacterium
GEALAVELAERGHHLIITARREEV

SEQ ID NO: 1265662 - protein, 28 aa, Mycobacterium
GEALLGEVGRAWPSIARARDEGAAAVCA

SEQ ID NO: 1265663 - protein, 25 aa, Mycobacterium
GEALREFGVRVLVIRPGQVRTTTTM

SEQ ID NO: 1265664 - protein, 19 aa, Mycobacterium
GEALVIPSVDVWRFNADGT

SEQ ID NO: 1265665 - protein, 19 aa, Mycobacterium
GEAMLRERSLLYVASSRAR

SEQ ID NO: 1265666 - protein, 25 aa, Mycobacterium
GEAPECRNFFVGAGFNSVGIATAGG

SEQ ID NO: 1265667 - protein, 18 aa, Mycobacterium
GEAQPCIAGPRVGVSKAA

SEQ ID NO: 1265668 - protein, 27 aa, Mycobacterium
GEASDIAEAIAFLASDRAAWITGSNLI

SEQ ID NO: 1265669 - protein, 19 aa, Mycobacterium
GEATALILRLTSAPPPSVR

SEQ ID NO: 1265670 - protein, 25 aa, Mycobacterium
GEAYEPFFRDSWQHVRAGARADQFA

SEQ ID NO: 1265671 - protein, 21 aa, Mycobacterium
GEAYREARIEQARRLGVADSV

SEQ ID NO: 1265672 - protein, 17 aa, Mycobacterium
GECLVAGGVPAHLRRAI

SEQ ID NO: 1265673 - protein, 21 aa, Mycobacterium
GEDDVARVCGPVFGDLPLPPL

SEQ ID NO: 1265674 - protein, 18 aa, Mycobacterium
GEDFFIRSVREYRDHISD

SEQ ID NO: 1265675 - protein, 17 aa, Mycobacterium
GEDFPALAKRFPAPPAS

SEQ ID NO: 1265676 - protein, 24 aa, Mycobacterium
GEDGRYRSAAALAVLGASFDNNVR

SEQ ID NO: 1265677 - protein, 19 aa, Mycobacterium
GEDGVAHIVAGRCAHRGVL

SEQ ID NO: 1265678 - protein, 25 aa, Mycobacterium
GEDLSWLWDVRFEHFESVPVVAAGE

SEQ ID NO: 1265679 - protein, 26 aa, Mycobacterium
GEDPCPLVAACRLRKALSDAKEAFYR

SEQ ID NO: 1265680 - protein, 19 aa, Mycobacterium
GEEIRRLIDGAAYLFTNDY

SEQ ID NO: 1265681 - protein, 36 aa, Mycobacterium
GEELANYRAHWLVARAAEHIGGWANRPLPLPDMCYA

SEQ ID NO: 1265682 - protein, 25 aa, Mycobacterium
GEELVLRYARERGLPAVAMCVSTTY

SEQ ID NO: 1265683 - protein, 30 aa, Mycobacterium
GEEPGPLPWYKRPPVLFGAAAAAALAALSG

SEQ ID NO: 1265684 - protein, 30 aa, Mycobacterium
GEESLLDTCRRCFASLFTDRAIHYRIDQGF

SEQ ID NO: 1265685 - protein, 28 aa, Mycobacterium
GEEVAPWLDLVRKLGLLVGVLSSEPPVS

SEQ ID NO: 1265686 - protein, 25 aa, Mycobacterium
GEFAPRLAGTLSYFECTPWAEYDAG

SEQ ID NO: 1265687 - protein, 20 aa, Mycobacterium
GEFGNPFAMLVIADLLGVPE

SEQ ID NO: 1265688 - protein, 19 aa, Mycobacterium
GEFIKGFAGPFTLRVIADL

SEQ ID NO: 1265689 - protein, 25 aa, Mycobacterium
GEFLRRLESRVGRIRDRMVSAVSGR

SEQ ID NO: 1265690 - protein, 25 aa, Mycobacterium
GEFLRRLESRVGRIRDRMVSAVTGR

SEQ ID NO: 1265691 - protein, 21 aa, Mycobacterium
GEFQALGFGRQFGGLPEAPPP

SEQ ID NO: 1265692 - protein, 25 aa, Mycobacterium
GEGELYFPGSPVLSVHGTFGECVLL

SEQ ID NO: 1265693 - protein, 20 aa, Mycobacterium
GEGIGSILLGLHRDDGELQM

SEQ ID NO: 1265694 - protein, 19 aa, Mycobacterium
GEGKTVLLHCVEAHSRTPS

SEQ ID NO: 1265695 - protein, 21 aa, Mycobacterium
GEGLRRLGFESHVVTVDGHRG

SEQ ID NO: 1265696 - protein, 21 aa, Mycobacterium
GEGNGAATLLDWMTEDSQRPI

SEQ ID NO: 1265697 - protein, 17 aa, Mycobacterium
GEGSRLVTTLTRHPGGA

SEQ ID NO: 1265698 - protein, 21 aa, Mycobacterium
GEGSWKKVLTTALRISGAEAG

SEQ ID NO: 1265699 - protein, 22 aa, Mycobacterium
GEGTADWYRWIDAQREHPGADP

SEQ ID NO: 1265700 - protein, 17 aa, Mycobacterium
GEGVLRLVYSRGRESGG

SEQ ID NO: 1265701 - protein, 26 aa, Mycobacterium
GEGWRQIRGGREFPIEPVRQAREACY

SEQ ID NO: 1265702 - protein, 25 aa, Mycobacterium
GEGYPIVMLHGSGPGATGWSNFGSN

SEQ ID NO: 1265703 - protein, 29 aa, Mycobacterium
GEHHGRVAMITDVWGRIDALYDVEVIPRE

SEQ ID NO: 1265704 - protein, 18 aa, Mycobacterium
GEHIRAFPLSNWTEFDIW

SEQ ID NO: 1265705 - protein, 27 aa, Mycobacterium
GEHRDRFGYRPGQFLTLRIPSEQTGSV

SEQ ID NO: 1265706 - protein, 17 aa, Mycobacterium
GEHTEHYRSLSVPRNSI

SEQ ID NO: 1265707 - protein, 20 aa, Mycobacterium
GEIDIRIGLGHIDVERRELW

SEQ ID NO: 1265708 - protein, 17 aa, Mycobacterium
GEIDLAAARDLPCHTGV

SEQ ID NO: 1265709 - protein, 25 aa, Mycobacterium
GEIDWSKVHIYWGDERFVAHDDDER

SEQ ID NO: 1265710 - protein, 20 aa, Mycobacterium
GEKLELRRATYFDGTTETYL

SEQ ID NO: 1265711 - protein, 24 aa, Mycobacterium
GEKRRVALCKLLLSKPDLLLLDEP

SEQ ID NO: 1265712 - protein, 19 aa, Mycobacterium
GEKVLAVAFDGEMGEGPVL

SEQ ID NO: 1265713 - protein, 20 aa, Mycobacterium
GELAARIALSRGPRNPVAES

SEQ ID NO: 1265714 - protein, 19 aa, Mycobacterium
GELAGILGRHGRLSVLVIR

SEQ ID NO: 1265715 - protein, 34 aa, Mycobacterium; identical to SEQ ID NO: 664732

SEQ ID NO: 1265716 - protein, 25 aa, Mycobacterium
GELAVALHAGFPAERIALHGNNKSV

SEQ ID NO: 1265717 - protein, 17 aa, Mycobacterium
GELDGFVRILRARPEGS

SEQ ID NO: 1265718 - protein, 20 aa, Mycobacterium
GELEKFQWFVRAHLENSGGE

SEQ ID NO: 1265719 - protein, 19 aa, Mycobacterium
GELEVGYQIGCGIDMSTSN

SEQ ID NO: 1265720 - protein, 24 aa, Mycobacterium
GELGEPFTTAGLCLYRDGNDSVAW

SEQ ID NO: 1265721 - protein, 24 aa, Mycobacterium
GELGEPFVTAGLCLYRDGDDSVAW

SEQ ID NO: 1265722 - protein, 20 aa, Mycobacterium
GELIQRLTASTMKRNLMELG

SEQ ID NO: 1265723 - protein, 22 aa, Mycobacterium
GELLPRTPLRFLLADDPGAGKT

SEQ ID NO: 1265724 - protein, 20 aa, Mycobacterium
GELLPYSDLDLMLLHDNMPP

SEQ ID NO: 1265725 - protein, 17 aa, Mycobacterium
GELLTAAGVPVELHHAE

SEQ ID NO: 1265726 - protein, 17 aa, Mycobacterium
GELLTIALTHRSYSYEN

SEQ ID NO: 1265727 - protein, 20 aa, Mycobacterium
GELPPCRRPGVGTGQSDDVR

SEQ ID NO: 1265728 - protein, 22 aa, Mycobacterium
GELPPWLGDEAFHRSHRAALVK

SEQ ID NO: 1265729 - protein, 30 aa, Mycobacterium
GELPTWQWEGLVTRPTRLVAITSASSTLGT

SEQ ID NO: 1265730 - protein, 20 aa, Mycobacterium
GELQRRLAAAGSPVRAVAAH

SEQ ID NO: 1265731 - protein, 22 aa, Mycobacterium
GELRNVNKWYGVHHVLTDVSVR

SEQ ID NO: 1265732 - protein, 22 aa, Mycobacterium
GEMKTPMGVFTLDFAFGTEPNP

SEQ ID NO: 1265733 - protein, 21 aa, Mycobacterium
GENCRRISVALKNGGPSAKIG

SEQ ID NO: 1265734 - protein, 20 aa, Mycobacterium
GENIPAWLVFDQRYRDRYIF

SEQ ID NO: 1265735 - protein, 24 aa, Mycobacterium
GENLRPDNLMNWARIAYNSAPGVA

SEQ ID NO: 1265736 - protein, 17 aa, Mycobacterium
GENVYPREIEEFLHTHP

SEQ ID NO: 1265737 - protein, 21 aa, Mycobacterium
GEPALRRRLQTAARDAWARIA

SEQ ID NO: 1265738 - protein, 23 aa, Mycobacterium
GEPARLPFWRGDGVGRPAELGAA

SEQ ID NO: 1265739 - protein, 21 aa, Mycobacterium
GEPDAAMDFVLYSNYGRLVTS

SEQ ID NO: 1265740 - protein, 17 aa, Mycobacterium
GEPETEWVYTPKDSPNW

SEQ ID NO: 1265741 - protein, 27 aa, Mycobacterium
GEPFRTVAGVIARLALPVVSGALAAGA

SEQ ID NO: 1265742 - protein, 18 aa, Mycobacterium
GEPGEFCTRGYSVMLGYW

SEQ ID NO: 1265743 - protein, 25 aa, Mycobacterium
GEPLHPFGAITPSVCNLRPTSRGYV

SEQ ID NO: 1265744 - protein, 23 aa, Mycobacterium
GEPPEVLAYAPIRRLVGMIDNDP

SEQ ID NO: 1265745 - protein, 23 aa, Mycobacterium
GEPPEVLAYAPIRRLVSMIDNDP

SEQ ID NO: 1265746 - protein, 19 aa, Mycobacterium
GEPPVYIPENLYIIGTMNL

SEQ ID NO: 1265747 - protein, 28 aa, Mycobacterium
GEPSWSYLYRRMIPVLVDAGLRAVAIDL

SEQ ID NO: 1265748 - protein, 18 aa, Mycobacterium
GEPTRCSVRHSWMGRVPA

SEQ ID NO: 1265749 - protein, 29 aa, Mycobacterium
GEPWPTFRVSGRLVWFAMTIWQFLHFRFG

SEQ ID NO: 1265750 - protein, 21 aa, Mycobacterium
GEPYVPFDAGADYQRFVDGKR

SEQ ID NO: 1265751 - protein, 22 aa, Mycobacterium
GEQKAKIFLALLGKQYGVTPKG

SEQ ID NO: 1265752 - protein, 17 aa, Mycobacterium
GERALICSGVWDVDELP

SEQ ID NO: 1265753 - protein, 18 aa, Mycobacterium
GERALICSGVWDVDELPH

SEQ ID NO: 1265754 - protein, 21 aa, Mycobacterium
GERALICSGVWDVGELPHAAH

SEQ ID NO: 1265755 - protein, 19 aa, Mycobacterium
GEREPRAVLYQSVVVTASE

SEQ ID NO: 1265756 - protein, 18 aa, Mycobacterium
GERFSLLPLSARTPSALV

SEQ ID NO: 1265757 - protein, 24 aa, Mycobacterium
GERHKFFAGCLGIFGHGNVAGIGQ

SEQ ID NO: 1265758 - protein, 18 aa, Mycobacterium
GERLRIVLAEDAPLLRAG

SEQ ID NO: 1265759 - protein, 22 aa, Mycobacterium
GERNRLNLALTLKEGGNLLLLD

SEQ ID NO: 1265760 - protein, 17 aa, Mycobacterium
GERQGFWSGSLHADVDG

SEQ ID NO: 1265761 - protein, 23 aa, Mycobacterium
GERRIPIDEFYRLPGDEPHRDTV

SEQ ID NO: 1265762 - protein, 21 aa, Mycobacterium
GERRISYAAFRGALGPVGAHL

SEQ ID NO: 1265763 - protein, 17 aa, Mycobacterium
GERRYSVDSGRRDMTGW

SEQ ID NO: 1265764 - protein, 25 aa, Mycobacterium
GERSRLMLDIAQWRRRRRDELAALG

SEQ ID NO: 1265765 - protein, 19 aa, Mycobacterium
GERVICAPAPQPGERLVDA

SEQ ID NO: 1265766 - protein, 17 aa, Mycobacterium
GERVPRAVLGIAGCPGA

SEQ ID NO: 1265767 - protein, 20 aa, Mycobacterium
GERWTLLIVRELGSGPKRYG

SEQ ID NO: 1265768 - protein, 17 aa, Mycobacterium
GERYQFLRWGQGAFDDF

SEQ ID NO: 1265769 - protein, 24 aa, Mycobacterium
GESGCGKSTLARTLMMLERPDEGT

SEQ ID NO: 1265770 - protein, 17 aa, Mycobacterium
GESKLIGEWLLRDIGVA

SEQ ID NO: 1265771 - protein, 20 aa, Mycobacterium
GESLGEVEFAFFVILLAVAG

SEQ ID NO: 1265772 - protein, 20 aa, Mycobacterium
GESLIGPLYRHGSDDADIAV

SEQ ID NO: 1265773 - protein, 25 aa, Mycobacterium
GESLLQRILHAVPIVRRAMPELHFL

SEQ ID NO: 1265774 - protein, 27 aa, Mycobacterium
GESMPVPILTLRQWRPLDAARMEVWSW

SEQ ID NO: 1265775 - protein, 20 aa, Mycobacterium
GESSGRVVAVARDFSPQQGL

SEQ ID NO: 1265776 - protein, 19 aa, Mycobacterium
GESSLAYIPGNLINALLSI

SEQ ID NO: 1265777 - protein, 17 aa, Mycobacterium
GESVQLNPWDPVYSVAN

SEQ ID NO: 1265778 - protein, 19 aa, Mycobacterium
GESVTEGTVTRWLKQEGDT

SEQ ID NO: 1265779 - protein, 26 aa, Mycobacterium
GESWSMALALRLAAYELLRVEGSDPV

SEQ ID NO: 1265780 - protein, 18 aa, Mycobacterium
GETASIFLPSVPNLLLLA

SEQ ID NO: 1265781 - protein, 23 aa, Mycobacterium
GETCELTAGLVLTSIGYRGKPIR

SEQ ID NO: 1265782 - protein, 23 aa, Mycobacterium
GETDLAALVKAAAAVVLPDAKLT

SEQ ID NO: 1265783 - protein, 25 aa, Mycobacterium
GETELWQLAHRVVCEHPGPLEIDKT

SEQ ID NO: 1265784 - protein, 36 aa, Mycobacterium
GETFDRFGPGFGQFGSPVGTAFPERALPPHSLEAGY

SEQ ID NO: 1265785 - protein, 18 aa, Mycobacterium
GETLFVRECIDLYHKQAA

SEQ ID NO: 1265786 - protein, 18 aa, Mycobacterium
GETLVEIETLWTVGGDYP

SEQ ID NO: 1265787 - protein, 22 aa, Mycobacterium
GETPRWGKMVAPGMYGPNHQHF

SEQ ID NO: 1265788 - protein, 18 aa, Mycobacterium
GETPSGIVHLMVEVENSD

SEQ ID NO: 1265789 - protein, 26 aa, Mycobacterium
GETPYDPRMMVAVLLYGYAVGVCSSR

SEQ ID NO: 1265790 - protein, 20 aa, Mycobacterium
GETRGAFSMSEPELGSDVAA

SEQ ID NO: 1265791 - protein, 18 aa, Mycobacterium
GETRMWAAFLRFEPDLLD

SEQ ID NO: 1265792 - protein, 25 aa, Mycobacterium
GETTDRLAVLPAWRETDYFTPAERA

SEQ ID NO: 1265793 - protein, 26 aa, Mycobacterium
GEVFDLRPGAIVRDLDLLRPIYAPTA

SEQ ID NO: 1265794 - protein, 26 aa, Mycobacterium
GEVGGNIPIVALFVRNGSAEDPNAGL

SEQ ID NO: 1265795 - protein, 25 aa, Mycobacterium
GEVHPLRPGTMYLLNGHERHRVTCD

SEQ ID NO: 1265796 - protein, 20 aa, Mycobacterium
GEVILSGSFTKPVFAEPGDT

SEQ ID NO: 1265797 - protein, 20 aa, Mycobacterium
GEVKFKIRLKHINFHNSPNV

SEQ ID NO: 1265798 - protein, 28 aa, Mycobacterium
GEVLDGLLPRPLLEVIFDTGPEAEHNLR

SEQ ID NO: 1265799 - protein, 19 aa, Mycobacterium
GEVLERSLVHLGLKHYFLV

SEQ ID NO: 1265800 - protein, 24 aa, Mycobacterium
GEVLQCPFHGWQWNQQGRNVCIPY

SEQ ID NO: 1265801 - protein, 25 aa, Mycobacterium
GEVLTDLRLLGPRIAEAAAGPDARI

SEQ ID NO: 1265802 - protein, 20 aa, Mycobacterium
GEVLTDVRLLGPRIAEAAAG

SEQ ID NO: 1265803 - protein, 17 aa, Mycobacterium
GEVNGGWTVLREPLNAE

SEQ ID NO: 1265804 - protein, 19 aa, Mycobacterium
GEVPAPAAVLIRPDGHVAW

SEQ ID NO: 1265805 - protein, 29 aa, Mycobacterium
GEVPEPFAVAAHHPRLMLANVVHEGLLQS

SEQ ID NO: 1265806 - protein, 21 aa, Mycobacterium
GEVPISAPIGLDPALGSYPVL

SEQ ID NO: 1265807 - protein, 21 aa, Mycobacterium
GEVRGAGVFWAVELVADQTTR

SEQ ID NO: 1265808 - protein, 22 aa, Mycobacterium
GEVRGLGVFWAIELVANRETRE

SEQ ID NO: 1265809 - protein, 25 aa, Mycobacterium
GEVRVIGQLPICWDTDRDAAIDRAH

SEQ ID NO: 1265810 - protein, 25 aa, Mycobacterium
GEVTGRTALPGFGRHLQLARPGGPV

SEQ ID NO: 1265811 - protein, 31 aa, Mycobacterium
GEVTYGAEFFRWFAEEAVRIEGRYTPAPAGT

SEQ ID NO: 1265812 - protein, 22 aa, Mycobacterium
GEVVEAPDGFMLVCSYNPAYRS

SEQ ID NO: 1265813 - protein, 26 aa, Mycobacterium
GEVVNWPRRRLVLSRTANGYSRILLG

SEQ ID NO: 1265814 - protein, 22 aa, Mycobacterium
GEWGSRQWTRGCYNANCGPLVW

SEQ ID NO: 1265815 - protein, 17 aa, Mycobacterium
GEWLPEPVVTGFDGVDP

SEQ ID NO: 1265816 - protein, 20 aa, Mycobacterium
GEWLPEPVVTGFDRTDPLSA

SEQ ID NO: 1265817 - protein, 17 aa, Mycobacterium
GEWLRSRCIEIPEELLP

SEQ ID NO: 1265818 - protein, 40 aa, Mycobacterium; identical to SEQ ID NO: 665147

SEQ ID NO: 1265819 - protein, 20 aa, Mycobacterium
GEYAGLLAIRAYHAARGDTD

SEQ ID NO: 1265820 - protein, 29 aa, Mycobacterium
GEYDGLADFPDRWWNLTAVANALAGAAVR

SEQ ID NO: 1265821 - protein, 18 aa, Mycobacterium
GEYRSCAKTQALVAEYGF

SEQ ID NO: 1265822 - protein, 20 aa, Mycobacterium
GFAAALGGYAGRRTVVLGSP

SEQ ID NO: 1265823 - protein, 19 aa, Mycobacterium
GFACAEAYETIAMNAIQMH

SEQ ID NO: 1265824 - protein, 18 aa, Mycobacterium
GFADPYCPSLRAAVTGLP

SEQ ID NO: 1265825 - protein, 22 aa, Mycobacterium
GFAGGRGHWALTRYDDVHHASR

SEQ ID NO: 1265826 - protein, 20 aa, Mycobacterium
GFAIAQRFVEEGARVVLGDV

SEQ ID NO: 1265827 - protein, 18 aa, Mycobacterium
GFAMLGPYSATKFAVRAL

SEQ ID NO: 1265828 - protein, 18 aa, Mycobacterium
GFAPEVWGRRLVEQALWM

SEQ ID NO: 1265829 - protein, 19 aa, Mycobacterium
GFAPEVWGRRLVEQALWMV

SEQ ID NO: 1265830 - protein, 23 aa, Mycobacterium
GFAQDPRTAWQLRGDAAIQMELA

SEQ ID NO: 1265831 - protein, 22 aa, Mycobacterium
GFARSSADTVVFMDHGQVVETG

SEQ ID NO: 1265832 - protein, 17 aa, Mycobacterium
GFARYQKVLSRLQTDAP

SEQ ID NO: 1265833 - protein, 17 aa, Mycobacterium
GFCKAGEAADFVLDGCI

SEQ ID NO: 1265834 - protein, 24 aa, Mycobacterium
GFCPEDDARLVAVALVSMLNQFCY

SEQ ID NO: 1265835 - protein, 18 aa, Mycobacterium
GFDAFGFDISVSRRAMAD

SEQ ID NO: 1265836 - protein, 26 aa, Mycobacterium
GFDASRPTAWLAEGLLIYLPPEAQDQ

SEQ ID NO: 1265837 - protein, 19 aa, Mycobacterium
GFDCSGLMLYAFAGVGIKL

SEQ ID NO: 1265838 - protein, 20 aa, Mycobacterium
GFDCSGLMLYAFAGVGIKLD

SEQ ID NO: 1265839 - protein, 19 aa, Mycobacterium
GFDKNLWERLCAMDATTMA

SEQ ID NO: 1265840 - protein, 26 aa, Mycobacterium
GFDPTRPTAWIAEGLLIYLPPDAQDR

SEQ ID NO: 1265841 - protein, 20 aa, Mycobacterium
GFDVAACRDIGLDHAFAQPV

SEQ ID NO: 1265842 - protein, 18 aa, Mycobacterium
GFELPTLYLQAAGAKLNV

SEQ ID NO: 1265843 - protein, 34 aa, Mycobacterium
GFELSGSFVSYFGWLYEWGAPVTLIGESPDQIAE

SEQ ID NO: 1265844 - protein, 28 aa, Mycobacterium
GFETTLWARRPASLEPYADTPAKTAATP

SEQ ID NO: 1265845 - protein, 24 aa, Mycobacterium
GFFRALDFTLPWDVDAVEDAMPVE

SEQ ID NO: 1265846 - protein, 18 aa, Mycobacterium
GFGATMLEYRDWLEAELE

SEQ ID NO: 1265847 - protein, 19 aa, Mycobacterium
GFGCPLALACDLVVAAPSA

SEQ ID NO: 1265848 - protein, 20 aa, Mycobacterium
GFGCVWEYRDPLPPRNTASE

SEQ ID NO: 1265849 - protein, 21 aa, Mycobacterium
GFGEIFLDDVFVPGADVIGEV

SEQ ID NO: 1265850 - protein, 24 aa, Mycobacterium
GFGEQRLRPQIAEWFEAGQVPVRE

SEQ ID NO: 1265851 - protein, 27 aa, Mycobacterium
GFGKFDYIFVWRVEVRNHRELPERGPQ

SEQ ID NO: 1265852 - protein, 23 aa, Mycobacterium
GFGKFTGGMGYEMIVAAEGTPQW

SEQ ID NO: 1265853 - protein, 19 aa, Mycobacterium
GFGSMVMSLLGFDNQSATF

SEQ ID NO: 1265854 - protein, 18 aa, Mycobacterium
GFHFVDYVVHGWDVAATL

SEQ ID NO: 1265855 - protein, 20 aa, Mycobacterium
GFHIYARIHRRWPFKLVRLA

SEQ ID NO: 1265856 - protein, 24 aa, Mycobacterium
GFHLRPVVRPVVLVAGGTGLSAIL

SEQ ID NO: 1265857 - protein, 17 aa, Mycobacterium
GFIGWQLGLCPEETKVI

SEQ ID NO: 1265858 - protein, 17 aa, Mycobacterium
GFIIKRTIKGGVETATE

SEQ ID NO: 1265859 - protein, 17 aa, Mycobacterium
GFIRKSGSWFTYDGEQL

SEQ ID NO: 1265860 - protein, 22 aa, Mycobacterium
GFLARRTPTPSGRVAVISGGGS

SEQ ID NO: 1265861 - protein, 19 aa, Mycobacterium
GFLRAVAEFCRERGILLVA

SEQ ID NO: 1265862 - protein, 19 aa, Mycobacterium
GFLSAAARLGVDPEEMYMV

SEQ ID NO: 1265863 - protein, 19 aa, Mycobacterium
GFLTGWEPDEFDAEFFGIS

SEQ ID NO: 1265864 - protein, 20 aa, Mycobacterium
GFLYFAGRRGDWLRVDGENI

SEQ ID NO: 1265865 - protein, 19 aa, Mycobacterium
GFPLPAMRDDVTWAADVLE

SEQ ID NO: 1265866 - protein, 20 aa, Mycobacterium
GFPLPAMRDDVTWAADVLEL

SEQ ID NO: 1265867 - protein, 23 aa, Mycobacterium
GFPNFFTVFGPYGYVGSSYFALI

SEQ ID NO: 1265868 - protein, 19 aa, Mycobacterium
GFPPFPGARSIRSLRKHAP

SEQ ID NO: 1265869 - protein, 21 aa, Mycobacterium
GFPPICTIWGLKNKIVSPEAG

SEQ ID NO: 1265870 - protein, 23 aa, Mycobacterium
GFQCGYCTPGQLCSARAMLREHA

SEQ ID NO: 1265871 - protein, 20 aa, Mycobacterium
GFQLLRPVKGDNRYFVVTQW

SEQ ID NO: 1265872 - protein, 23 aa, Mycobacterium
GFRAALRDLTLMLVYEATRDLEV

SEQ ID NO: 1265873 - protein, 23 aa, Mycobacterium
GFRFDLASTLAREFYDVDRLSTF

SEQ ID NO: 1265874 - protein, 23 aa, Mycobacterium
GFRRAGVMAFGLAATTAGYLRAK

SEQ ID NO: 1265875 - protein, 23 aa, Mycobacterium
GFRVDECPRETTLEKMAGLKTLV

SEQ ID NO: 1265876 - protein, 32 aa, Mycobacterium
GFSEIFATLGPLRRGDGFVLFCTENDPYPSAR

SEQ ID NO: 1265877 - protein, 25 aa, Mycobacterium
GFTAWPPWRPGVLFTGDSLGAGKPA

SEQ ID NO: 1265878 - protein, 24 aa, Mycobacterium
GFTGELPTRVVLAGHSAGGGLVVG

SEQ ID NO: 1265879 - protein, 21 aa, Mycobacterium
GFTGGGFYWHSDFETWHAEDG

SEQ ID NO: 1265880 - protein, 19 aa, Mycobacterium
GFTGTGFYWHSDFETWHAE

SEQ ID NO: 1265881 - protein, 19 aa, Mycobacterium
GFVDFGQLFSATALMPSHV

SEQ ID NO: 1265882 - protein, 29 aa, Mycobacterium
GFVIGPMVKLGWGRPVSFVTAEVALILSL

SEQ ID NO: 1265883 - protein, 20 aa, Mycobacterium
GFVKIFCRPATGVVIGGVVV

SEQ ID NO: 1265884 - protein, 18 aa, Mycobacterium
GFVLPVLTYTAPRAAADA

SEQ ID NO: 1265885 - protein, 18 aa, Mycobacterium
GFVLRPLPNTQFMRDNSS

SEQ ID NO: 1265886 - protein, 19 aa, Mycobacterium
GFVPFPPDRAEVYRRAGYW

SEQ ID NO: 1265887 - protein, 24 aa, Mycobacterium
GFVPPSGPGRCPACGCHVATQGHS

SEQ ID NO: 1265888 - protein, 32 aa, Mycobacterium
GFVSVWRAGAFGVLEWASLMFASIYLGMQQRI

SEQ ID NO: 1265889 - protein, 17 aa, Mycobacterium
GFYRTGDRVRIFADGPL

SEQ ID NO: 1265890 - protein, 24 aa, Mycobacterium
GFYYDFEVAEPFTPEDLEALEKRM

SEQ ID NO: 1265891 - protein, 17 aa, Mycobacterium
GGAAEIIGGLLRPSPTS

SEQ ID NO: 1265892 - protein, 19 aa, Mycobacterium
GGAAFPLAVKLSTVRRAHQ

SEQ ID NO: 1265893 - protein, 25 aa, Mycobacterium
GGAALPYKRRLFGQIIRAAVAATEG

SEQ ID NO: 1265894 - protein, 20 aa, Mycobacterium
GGAARAMFDPLLARLRDLGA

SEQ ID NO: 1265895 - protein, 24 aa, Mycobacterium
GGAASGLRAAMRILDGIDDIHFAE

SEQ ID NO: 1265896 - protein, 17 aa, Mycobacterium
GGAAYAFEGLSGARDPG

SEQ ID NO: 1265897 - protein, 18 aa, Mycobacterium
GGADVKLLFNIVPESAQY

SEQ ID NO: 1265898 - protein, 20 aa, Mycobacterium
GGAEALVFAYDGLRERGLRS

SEQ ID NO: 1265899 - protein, 24 aa, Mycobacterium
GGAELGCVAALKTLEISSRPEVRS

SEQ ID NO: 1265900 - protein, 20 aa, Mycobacterium
GGAGDGLGGTGGTGGTGGFG

SEQ ID NO: 1265901 - protein, 23 aa, Mycobacterium
GGAGGEGGEGGAGGAGGDGSEGG

SEQ ID NO: 1265902 - protein, 25 aa, Mycobacterium
GGAGYRRYPNWPAMDMTSFTQDKTP

SEQ ID NO: 1265903 - protein, 21 aa, Mycobacterium
GGAHCGLICDASYPTFLLTHW

SEQ ID NO: 1265904 - protein, 20 aa, Mycobacterium
GGAHYCLGANLARRELAEAL

SEQ ID NO: 1265905 - protein, 18 aa, Mycobacterium
GGAIHWDDLQWERSYSRM

SEQ ID NO: 1265906 - protein, 19 aa, Mycobacterium
GGAIPLLFDEVLGRLANSG

SEQ ID NO: 1265907 - protein, 18 aa, Mycobacterium
GGALPSYYINNLGGADKV

SEQ ID NO: 1265908 - protein, 18 aa, Mycobacterium
GGAMCIDPSDGALYVTDR

SEQ ID NO: 1265909 - protein, 20 aa, Mycobacterium
GGAMLPLLLFASARAAVPVT

SEQ ID NO: 1265910 - protein, 18 aa, Mycobacterium
GGAMLVVSVHPRLTGHPA

SEQ ID NO: 1265911 - protein, 17 aa, Mycobacterium
GGANVRVQYAFGPTIGS

SEQ ID NO: 1265912 - protein, 19 aa, Mycobacterium
GGAPADFNSAGGHFQVSGH

SEQ ID NO: 1265913 - protein, 23 aa, Mycobacterium
GGAPAWPRFEHDDALITVGSARP

SEQ ID NO: 1265914 - protein, 30 aa, Mycobacterium
GGAPLGARLGHFFRGVGLTIYEGYGMTETS

SEQ ID NO: 1265915 - protein, 18 aa, Mycobacterium
GGAPMMLPPGSMGPPAGA

SEQ ID NO: 1265916 - protein, 19 aa, Mycobacterium
GGARKCSARAKGAVLDPVI

SEQ ID NO: 1265917 - protein, 18 aa, Mycobacterium
GGASWEFENRKSLPLTVV

SEQ ID NO: 1265918 - protein, 24 aa, Mycobacterium
GGATVLRAIWGFRGTERPHGDRLL

SEQ ID NO: 1265919 - protein, 17 aa, Mycobacterium
GGATYWWFPPGTTPNAG

SEQ ID NO: 1265920 - protein, 18 aa, Mycobacterium
GGAVALALAAARPDLVSG

SEQ ID NO: 1265921 - protein, 19 aa, Mycobacterium
GGAVALALAAARPDLVSGL

SEQ ID NO: 1265922 - protein, 18 aa, Mycobacterium
GGAVLPVYDPLFDSKKLR

SEQ ID NO: 1265923 - protein, 24 aa, Mycobacterium
GGCLPKDIRAFMARAGELGANHAL

SEQ ID NO: 1265924 - protein, 21 aa, Mycobacterium
GGDATRLLYTLGWHEVPAPAS

SEQ ID NO: 1265925 - protein, 18 aa, Mycobacterium
GGDAYVMKAIIHDWGDDQ

SEQ ID NO: 1265926 - protein, 19 aa, Mycobacterium
GGDELDRTVALWRKRFDDV

SEQ ID NO: 1265927 - protein, 31 aa, Mycobacterium
GGDELDRTVALWRKRFDDVHIYPVAFHGDVA

SEQ ID NO: 1265928 - protein, 18 aa, Mycobacterium
GGDGGRGGDGGFGGLGGD

SEQ ID NO: 1265929 - protein, 22 aa, Mycobacterium
GGDGKCKLVPYAKRTPRLARTR

SEQ ID NO: 1265930 - protein, 21 aa, Mycobacterium
GGDGRCKLVPYAKRTPRMART

SEQ ID NO: 1265931 - protein, 24 aa, Mycobacterium
GGDIIPRLVGDGMAAVYDFSNNEV

SEQ ID NO: 1265932 - protein, 21 aa, Mycobacterium
GGDIRAALRGDLHVHSNWSDG

SEQ ID NO: 1265933 - protein, 17 aa, Mycobacterium
GGDLEFADELTLGRALA

SEQ ID NO: 1265934 - protein, 18 aa, Mycobacterium
GGDLTKLVGRKGEVLDAL

SEQ ID NO: 1265935 - protein, 19 aa, Mycobacterium
GGDRARILAVSPLIREMMI

SEQ ID NO: 1265936 - protein, 20 aa, Mycobacterium
GGDTRWIHRAAHDLMGVNPT

SEQ ID NO: 1265937 - protein, 17 aa, Mycobacterium
GGEAARDLLRRHGAASA

SEQ ID NO: 1265938 - protein, 28 aa, Mycobacterium
GGEAIRFPELRAVLTYVTPSPVSREVQQ

SEQ ID NO: 1265939 - protein, 19 aa, Mycobacterium
GGEFDEWQRLYLFSRSDTI

SEQ ID NO: 1265940 - protein, 24 aa, Mycobacterium
GGEGKRLYPLTADRAKPAVPFGGG

SEQ ID NO: 1265941 - protein, 18 aa, Mycobacterium
GGEIGCNGPLPGVSGGEN

SEQ ID NO: 1265942 - protein, 19 aa, Mycobacterium
GGEPICFTEDAAFERLSCL

SEQ ID NO: 1265943 - protein, 19 aa, Mycobacterium
GGESTRPGATRVDPEVEAA

SEQ ID NO: 1265944 - protein, 32 aa, Mycobacterium
GGFAEFLRSNGFSIIRMFLELPYKQALLDATG

SEQ ID NO: 1265945 - protein, 17 aa, Mycobacterium
GGFALVVGIDGTEVADE

SEQ ID NO: 1265946 - protein, 22 aa, Mycobacterium
GGFAQACALSLQEYQGGSPEVM

SEQ ID NO: 1265947 - protein, 17 aa, Mycobacterium
GGFDIPEALPMGVASEA

SEQ ID NO: 1265948 - protein, 17 aa, Mycobacterium
GGFGGMLLGSVGSQVVQ

SEQ ID NO: 1265949 - protein, 20 aa, Mycobacterium
GGFGHLLILGFDYRDDPGPW

SEQ ID NO: 1265950 - protein, 20 aa, Mycobacterium
GGFGTLLLLGHDWASPEATY

SEQ ID NO: 1265951 - protein, 19 aa, Mycobacterium
GGFGVYLDICMEVANAGYK

SEQ ID NO: 1265952 - protein, 27 aa, Mycobacterium
GGFNHNTWGVAMLGNFDVVPPTPIQLR

SEQ ID NO: 1265953 - protein, 17 aa, Mycobacterium
GGFPEEFGTELSANEVV

SEQ ID NO: 1265954 - protein, 19 aa, Mycobacterium
GGGAHKCIGMVFGQLEIKT

SEQ ID NO: 1265955 - protein, 26 aa, Mycobacterium
GGGAYPRPGLFGKFFDSRARPLVEVV

SEQ ID NO: 1265956 - protein, 19 aa, Mycobacterium
GGGDGFAGISGELVDGRFS

SEQ ID NO: 1265957 - protein, 24 aa, Mycobacterium
GGGGHAPGGFGVVIALVSDANDPA

SEQ ID NO: 1265958 - protein, 18 aa, Mycobacterium
GGGGMWFPCNPVAQRAGI

SEQ ID NO: 1265959 - protein, 19 aa, Mycobacterium
GGGGMWFPCNPVLTRAGAD

SEQ ID NO: 1265960 - protein, 20 aa, Mycobacterium
GGGGSWPAGGGAAFGSAGGG

SEQ ID NO: 1265961 - protein, 18 aa, Mycobacterium
GGGLCLALAADIRVAASG

SEQ ID NO: 1265962 - protein, 17 aa, Mycobacterium
GGGLCLALAADIRVAGS

SEQ ID NO: 1265963 - protein, 24 aa, Mycobacterium
GGGLDPKSGVALMLDQCHNVEAKI

SEQ ID NO: 1265964 - protein, 24 aa, Mycobacterium
GGGLLRLQKRIPYQKALELALTGD

SEQ ID NO: 1265965 - protein, 21 aa, Mycobacterium
GGGLPCILKATAGFSYVRLHG

SEQ ID NO: 1265966 - protein, 18 aa, Mycobacterium
GGGLPIGACLAIGDTADL

SEQ ID NO: 1265967 - protein, 23 aa, Mycobacterium
GGGLPIGACLAVGAVGDLLTPGL

SEQ ID NO: 1265968 - protein, 21 aa, Mycobacterium
GGGLRVTRTGKWLAAMTSREI

SEQ ID NO: 1265969 - protein, 19 aa, Mycobacterium
GGGLYRCLGLSIAVGPTAD

SEQ ID NO: 1265970 - protein, 18 aa, Mycobacterium
GGGPARPRLMPLHLDGPA

SEQ ID NO: 1265971 - protein, 31 aa, Mycobacterium
GGGPDPVRVFWPLMSAQLWDTNGAWVAEARP

SEQ ID NO: 1265972 - protein, 19 aa, Mycobacterium
GGGPWRGIVMYPDAGGARP

SEQ ID NO: 1265973 - protein, 22 aa, Mycobacterium
GGGRLVSRLASWYLGKVTEMTW

SEQ ID NO: 1265974 - protein, 21 aa, Mycobacterium
GGGSLIGIGGGNAVGGDGGNG

SEQ ID NO: 1265975 - protein, 19 aa, Mycobacterium
GGGTRRCVGAAFANVEMDI

SEQ ID NO: 1265976 - protein, 19 aa, Mycobacterium
GGGTWYPCNPVLRRAGTDD

SEQ ID NO: 1265977 - protein, 30 aa, Mycobacterium
GGGVEAFAGRAGRKRWAEIEKIVAKGWDNV

SEQ ID NO: 1265978 - protein, 20 aa, Mycobacterium
GGGVHHCLGHFVARSDMSEA

SEQ ID NO: 1265979 - protein, 21 aa, Mycobacterium
GGGVHYCLGANLARSMLRAEL

SEQ ID NO: 1265980 - protein, 26 aa, Mycobacterium
GGGVKLKEKAGVFVGLQIEIEASVLY

SEQ ID NO: 1265981 - protein, 23 aa, Mycobacterium
GGHAVALLWSMRHIYDIEPGDVF

SEQ ID NO: 1265982 - protein, 17 aa, Mycobacterium
GGHFAAFEQPGPFVEEV

SEQ ID NO: 1265983 - protein, 20 aa, Mycobacterium
GGHHSWEDLDDLLLTTYGEL

SEQ ID NO: 1265984 - protein, 24 aa, Mycobacterium
GGHLAVVSCHRWKAPLNPRPNGPS

SEQ ID NO: 1265985 - protein, 17 aa, Mycobacterium
GGHQLTCAVAIARDGGA

SEQ ID NO: 1265986 - protein, 18 aa, Mycobacterium
GGIARFTASAVFIVVSPE

SEQ ID NO: 1265987 - protein, 19 aa, Mycobacterium
GGIARFTASAVFIVVSPEH

SEQ ID NO: 1265988 - protein, 24 aa, Mycobacterium
GGIEPWGITNFQIFPNLEILIYHG

SEQ ID NO: 1265989 - protein, 19 aa, Mycobacterium
GGIERPVIEVDFEVGESVT

SEQ ID NO: 1265990 - protein, 17 aa, Mycobacterium
GGIGFTWEHPAHLLLRR

SEQ ID NO: 1265991 - protein, 17 aa, Mycobacterium
GGIGFTWEHQAHLYYKR

SEQ ID NO: 1265992 - protein, 18 aa, Mycobacterium
GGIGWVPYILERSDYVWE

SEQ ID NO: 1265993 - protein, 17 aa, Mycobacterium
GGIRSVFQPHLFSEVIA

SEQ ID NO: 1265994 - protein, 21 aa, Mycobacterium
GGISRKADKWVPLLQNRTPVV

SEQ ID NO: 1265995 - protein, 18 aa, Mycobacterium
GGKGCGFVALHQLAVEHL

SEQ ID NO: 1265996 - protein, 20 aa, Mycobacterium
GGKLQWLLENVDGLRADAEK

SEQ ID NO: 1265997 - protein, 20 aa, Mycobacterium
GGKRSVCAVAQPGVEIADSI

SEQ ID NO: 1265998 - protein, 23 aa, Mycobacterium
GGKTFPLPSPFLVMATQNPIEQE

SEQ ID NO: 1265999 - protein, 19 aa, Mycobacterium
GGKVKMRGLEVGRVGDVNA

SEQ ID NO: 1266000 - protein, 17 aa, Mycobacterium
GGLARNNIASWVPAVTW

SEQ ID NO: 1266001 - protein, 17 aa, Mycobacterium
GGLDEWALKPGTVTSWH

SEQ ID NO: 1266002 - protein, 20 aa, Mycobacterium
GGLDGPALRRAVELEGADGD

SEQ ID NO: 1266003 - protein, 20 aa, Mycobacterium
GGLDLRWAAVDLDGRRALVT

SEQ ID NO: 1266004 - protein, 22 aa, Mycobacterium
GGLDTSVAISWIGKETGSEVVA

SEQ ID NO: 1266005 - protein, 24 aa, Mycobacterium
GGLELALWCDLRIVEQDAVMGVFC

SEQ ID NO: 1266006 - protein, 18 aa, Mycobacterium
GGLELALWCDLRVVEEDA

SEQ ID NO: 1266007 - protein, 19 aa, Mycobacterium
GGLELTTRLLAAARIGGSD

SEQ ID NO: 1266008 - protein, 20 aa, Mycobacterium
GGLFNGILARYLALVATALP

SEQ ID NO: 1266009 - protein, 23 aa, Mycobacterium
GGLGHLGVQFARAMGFETVAIAR

SEQ ID NO: 1266010 - protein, 17 aa, Mycobacterium
GGLGIAVTKSWGMIDNR

SEQ ID NO: 1266011 - protein, 20 aa, Mycobacterium
GGLILPEVGDEVLVAFEQGD

SEQ ID NO: 1266012 - protein, 18 aa, Mycobacterium
GGLLRYGIPEFKMEKRHI

SEQ ID NO: 1266013 - protein, 21 aa, Mycobacterium
GGLNLKWSHLAADNTSLFLKD

SEQ ID NO: 1266014 - protein, 17 aa, Mycobacterium
GGLPGFDFDIRIQLGAG

SEQ ID NO: 1266015 - protein, 27 aa, Mycobacterium
GGLPIRRYAFPNLKALNFVIVGYLGEG

SEQ ID NO: 1266016 - protein, 25 aa, Mycobacterium
GGLPPRARMLLGLPWTDKQERRYQR

SEQ ID NO: 1266017 - protein, 19 aa, Mycobacterium
GGLPVGGRMVAVFTDAEVV

SEQ ID NO: 1266018 - protein, 17 aa, Mycobacterium
GGLRADFSVGQPVLISD

SEQ ID NO: 1266019 - protein, 17 aa, Mycobacterium
GGLRRRHVGSLAGLDVA

SEQ ID NO: 1266020 - protein, 27 aa, Mycobacterium
GGLRSFPVLVMVAAYSRFIAAIMIPSR

SEQ ID NO: 1266021 - protein, 17 aa, Mycobacterium
GGMAFVYDPAGALPDNL

SEQ ID NO: 1266022 - protein, 17 aa, Mycobacterium
GGMPWRYAADGSVAIAS

SEQ ID NO: 1266023 - protein, 24 aa, Mycobacterium
GGMRRRLDLAVSLLASPPVLFLDE

SEQ ID NO: 1266024 - protein, 29 aa, Mycobacterium
GGMTAYLPQVVGAAMARRLSMTGEVVDAA

SEQ ID NO: 1266025 - protein, 23 aa, Mycobacterium
GGMWCPPNPIAEVRDRYGELVSV

SEQ ID NO: 1266026 - protein, 24 aa, Mycobacterium
GGMWCPPSPIDTVFDRHGGEVALE

SEQ ID NO: 1266027 - protein, 19 aa, Mycobacterium
GGNAGWFGNGGIGGFTGFD

SEQ ID NO: 1266028 - protein, 28 aa, Mycobacterium
GGNCNRCVPCRRGFFMQCERMQVPSWQY

SEQ ID NO: 1266029 - protein, 19 aa, Mycobacterium
GGNGGNGGRALLTGAGGDG

SEQ ID NO: 1266030 - protein, 19 aa, Mycobacterium
GGNQVRYVLRPNLEEDNRG

SEQ ID NO: 1266031 - protein, 20 aa, Mycobacterium
GGNRARILAVSPLIREMMIY

SEQ ID NO: 1266032 - protein, 17 aa, Mycobacterium
GGNRQGLYRCALRVDNV

SEQ ID NO: 1266033 - protein, 17 aa, Mycobacterium
GGNWSINTGNGYSGGLQ

SEQ ID NO: 1266034 - protein, 23 aa, Mycobacterium
GGPARASRRLLNYGHIHDLFDLA

SEQ ID NO: 1266035 - protein, 18 aa, Mycobacterium
GGPCRPAPSTLLLAILTG

SEQ ID NO: 1266036 - protein, 18 aa, Mycobacterium
GGPDASCLDRLLQTDRQE

SEQ ID NO: 1266037 - protein, 31 aa, Mycobacterium
GGPDGTGWPIGRPVQRHELAAALAWTPGVDM

SEQ ID NO: 1266038 - protein, 22 aa, Mycobacterium
GGPGMREMLAITGAIKGAGLGK

SEQ ID NO: 1266039 - protein, 25 aa, Mycobacterium
GGPGSEVPRVIGLKIDAARKKLEDA

SEQ ID NO: 1266040 - protein, 23 aa, Mycobacterium
GGPHIWQSGSFTFFAGARSDASF

SEQ ID NO: 1266041 - protein, 19 aa, Mycobacterium
GGPLAISAHVPRYANRYEN

SEQ ID NO: 1266042 - protein, 25 aa, Mycobacterium
GGPLARLEVNLALEIFLRRVHRPRL

SEQ ID NO: 1266043 - protein, 18 aa, Mycobacterium
GGPLARVEGRVSIERILD

SEQ ID NO: 1266044 - protein, 34 aa, Mycobacterium
GGPLASWNAWHWRWNPWVMAARGYAVLLPDPALS

SEQ ID NO: 1266045 - protein, 20 aa, Mycobacterium
GGPLWPGIAEPLELARRDYG

SEQ ID NO: 1266046 - protein, 21 aa, Mycobacterium
GGPPPRLALSLGDSLAGMFAA

SEQ ID NO: 1266047 - protein, 19 aa, Mycobacterium
GGPQAWQLPMSPLGLGYVR

SEQ ID NO: 1266048 - protein, 26 aa, Mycobacterium
GGPSPAPAVVYCHSGAFVLGNLDTDH

SEQ ID NO: 1266049 - protein, 25 aa, Mycobacterium
GGPVKRDAALCLATLRVGIDPAGVD

SEQ ID NO: 1266050 - protein, 27 aa, Mycobacterium
GGQAIRAITCLPALVGAWRHVGGGTME

SEQ ID NO: 1266051 - protein, 26 aa, Mycobacterium
GGQHSQCLWGTFAHLPGMKVVVPSSP

SEQ ID NO: 1266052 - protein, 19 aa, Mycobacterium
GGQLCLPFYGALVTNCELD

SEQ ID NO: 1266053 - protein, 19 aa, Mycobacterium
GGQLLDWLQHCIFPAEAKL

SEQ ID NO: 1266054 - protein, 23 aa, Mycobacterium
GGQLRVLHTFGLSIAALEERLRM

SEQ ID NO: 1266055 - protein, 20 aa, Mycobacterium
GGQMKLRGATALVTGANRGI

SEQ ID NO: 1266056 - protein, 18 aa, Mycobacterium
GGQPVSMDQMQPGDLVTY

SEQ ID NO: 1266057 - protein, 22 aa, Mycobacterium
GGQRYTAVDAFAALQALQELKA

SEQ ID NO: 1266058 - protein, 21 aa, Mycobacterium
GGRALRPAPVGAYPQSASAYG

SEQ ID NO: 1266059 - protein, 21 aa, Mycobacterium
GGRAMKVLAAMAVQALDFAQL

SEQ ID NO: 1266060 - protein, 24 aa, Mycobacterium
GGRDLRRCYSMSSAPVEDELRITV

SEQ ID NO: 1266061 - protein, 25 aa, Mycobacterium
GGRGHLWKLVRSFDDPGTWTEPGVR

SEQ ID NO: 1266062 - protein, 24 aa, Mycobacterium
GGRGIGVMIARGLLQAGASVYLSS

SEQ ID NO: 1266063 - protein, 27 aa, Mycobacterium
GGRGRWCSRRGGLLRYRRAGLGAGPAL

SEQ ID NO: 1266064 - protein, 24 aa, Mycobacterium
GGRHRGFVVVRWLDNPAAPVVRTT

SEQ ID NO: 1266065 - protein, 24 aa, Mycobacterium
GGRLELGVGVGWCREEFELLGQQF

SEQ ID NO: 1266066 - protein, 26 aa, Mycobacterium
GGRLGSGRQWLSWIGLDDLVEVYHRA

SEQ ID NO: 1266067 - protein, 17 aa, Mycobacterium
GGRLHIVDVGGADQPEG

SEQ ID NO: 1266068 - protein, 18 aa, Mycobacterium
GGRLVFNTFMPRPGYLSD

SEQ ID NO: 1266069 - protein, 19 aa, Mycobacterium
GGRQPVRFVVGRRGDPTFE

SEQ ID NO: 1266070 - protein, 31 aa, Mycobacterium
GGRVFRPLDVDLRWVAALLLRNGAIEESGVA

SEQ ID NO: 1266071 - protein, 19 aa, Mycobacterium
GGSCGMAAVAAIKVAEREG

SEQ ID NO: 1266072 - protein, 34 aa, Mycobacterium
GGSGPGRCQQVWCPVCALAALISGEQHPLLSVVA

SEQ ID NO: 1266073 - protein, 19 aa, Mycobacterium
GGSHLLVAVGRRPNTDDLN

SEQ ID NO: 1266074 - protein, 19 aa, Mycobacterium
GGSHPRFARNLGTGEPPIS

SEQ ID NO: 1266075 - protein, 18 aa, Mycobacterium
GGSKDTWVLASRTSIADR

SEQ ID NO: 1266076 - protein, 33 aa, Mycobacterium
GGSKVPLPLVRKALSLLPAVGFVNAYGLTETSS

SEQ ID NO: 1266077 - protein, 26 aa, Mycobacterium
GGSLKEAICKGTLWGLRRGARKPGSA

SEQ ID NO: 1266078 - protein, 20 aa, Mycobacterium
GGSLPPPVSPTMGPGGGMMP

SEQ ID NO: 1266079 - protein, 24 aa, Mycobacterium
GGSLYGIPMPPGLVSHAPQGVHHG

SEQ ID NO: 1266080 - protein, 28 aa, Mycobacterium
GGSMARRLRLNSRMGLLADDVRVVDTLS

SEQ ID NO: 1266081 - protein, 22 aa, Mycobacterium
GGSPRWGRWRDAIGVGAQEAEV

SEQ ID NO: 1266082 - protein, 18 aa, Mycobacterium
GGSQLSALREEILSTTSQ

SEQ ID NO: 1266083 - protein, 24 aa, Mycobacterium
GGSRTEWRRSQGIADDSDQPHTTL

SEQ ID NO: 1266084 - protein, 20 aa, Mycobacterium
GGSSLRIPHHVGYWYEQGAM

SEQ ID NO: 1266085 - protein, 27 aa, Mycobacterium
GGSSLTWKALLPHLATRYRVIAPDLLG

SEQ ID NO: 1266086 - protein, 23 aa, Mycobacterium
GGSTPAMMWCCNGNMMMPMQMPM

SEQ ID NO: 1266087 - protein, 17 aa, Mycobacterium
GGSVRRWIGHGSQVTAG

SEQ ID NO: 1266088 - protein, 18 aa, Mycobacterium
GGSVWCALATVALVEALI

SEQ ID NO: 1266089 - protein, 19 aa, Mycobacterium
GGTATRVVLYNALADPERF

SEQ ID NO: 1266090 - protein, 19 aa, Mycobacterium
GGTAVRFALDNGKRAGKLV

SEQ ID NO: 1266091 - protein, 21 aa, Mycobacterium
GGTCPLWNVYETFANPGKISV

SEQ ID NO: 1266092 - protein, 22 aa, Mycobacterium
GGTFTDCFFVWDDIYVDAKALT

SEQ ID NO: 1266093 - protein, 24 aa, Mycobacterium
GGTGFAFSRLRPAGDRIASTGGRA

SEQ ID NO: 1266094 - protein, 20 aa, Mycobacterium
GGTGGFGDRGYWLVTKHADV

SEQ ID NO: 1266095 - protein, 18 aa, Mycobacterium
GGTGWIPYFLERVDRTYE

SEQ ID NO: 1266096 - protein, 25 aa, Mycobacterium
GGTIAHGLLTLSLLPYFTHQLYTVD

SEQ ID NO: 1266097 - protein, 18 aa, Mycobacterium
GGTPEFYAAQGLSSIPLD

SEQ ID NO: 1266098 - protein, 20 aa, Mycobacterium
GGTPVRSRVGHSYIKGLMAE

SEQ ID NO: 1266099 - protein, 21 aa, Mycobacterium
GGTRFRPHFFPFTEPSAEVDV

SEQ ID NO: 1266100 - protein, 23 aa, Mycobacterium
GGTRVRFSLMPAETSRLVDVRTS

SEQ ID NO: 1266101 - protein, 19 aa, Mycobacterium
GGTTGRPKGVMWRQSDTYV

SEQ ID NO: 1266102 - protein, 19 aa, Mycobacterium
GGTTVVYEPLMKRLPADTP

SEQ ID NO: 1266103 - protein, 23 aa, Mycobacterium
GGTVFCCRFGLALHGGREEDLIE

SEQ ID NO: 1266104 - protein, 21 aa, Mycobacterium
GGTVWSTGGCRSWYLDEHGVN

SEQ ID NO: 1266105 - protein, 20 aa, Mycobacterium
GGTWCPPSPIDKVLDRNGDE

SEQ ID NO: 1266106 - protein, 26 aa, Mycobacterium
GGTWDLFKYPGIRSDSDMFTLGFRFK

SEQ ID NO: 1266107 - protein, 23 aa, Mycobacterium
GGVADARTALRLHAAAGGPGSAP

SEQ ID NO: 1266108 - protein, 20 aa, Mycobacterium
GGVADARTGWQLHSAAGGGQ

SEQ ID NO: 1266109 - protein, 18 aa, Mycobacterium
GGVAGPWQFDADAVSLAV

SEQ ID NO: 1266110 - protein, 23 aa, Mycobacterium
GGVCDARSGAAAVVLGAEGVQMG

SEQ ID NO: 1266111 - protein, 20 aa, Mycobacterium
GGVDDFRFNAVIDEEIARYG

SEQ ID NO: 1266112 - protein, 27 aa, Mycobacterium
GGVDTMLAGAAERWFAPGFVDREPGTA

SEQ ID NO: 1266113 - protein, 18 aa, Mycobacterium
GGVFRIVEQLPRKVALEL

SEQ ID NO: 1266114 - protein, 23 aa, Mycobacterium
GGVGGRGALLFGRGGDGGDGGSA

SEQ ID NO: 1266115 - protein, 18 aa, Mycobacterium
GGVHHCLGANLARLELAE

SEQ ID NO: 1266116 - protein, 24 aa, Mycobacterium
GGVHLKAGTIVMLCLGAANRDPRK

SEQ ID NO: 1266117 - protein, 19 aa, Mycobacterium
GGVHYCLGANLARRELAEA

SEQ ID NO: 1266118 - protein, 28 aa, Mycobacterium
GGVKHYDFLPTIDRWLVSVPMVHLDTLG

SEQ ID NO: 1266119 - protein, 21 aa, Mycobacterium
GGVKVAFFRKGVECTPDTIDR

SEQ ID NO: 1266120 - protein, 17 aa, Mycobacterium
GGVKVKLMGKIRPSEQE

SEQ ID NO: 1266121 - protein, 18 aa, Mycobacterium
GGVLGNLLENALRHTPPG

SEQ ID NO: 1266122 - protein, 18 aa, Mycobacterium
GGVLLEHLKAVALQSDIG

SEQ ID NO: 1266123 - protein, 24 aa, Mycobacterium
GGVSIGAAVAVEWALAHPTQVVAV

SEQ ID NO: 1266124 - protein, 28 aa, Mycobacterium
GGVSRPGMIDACWERLGPGGRLVANAVT

SEQ ID NO: 1266125 - protein, 26 aa, Mycobacterium
GGVVPRRGTLALAFDVAPPVWAEPGR

SEQ ID NO: 1266126 - protein, 20 aa, Mycobacterium
GGVWYSADMPFGGYKQSGIG

SEQ ID NO: 1266127 - protein, 25 aa, Mycobacterium
GGYDMTAFWCRAGTAATITPPGTPG

SEQ ID NO: 1266128 - protein, 22 aa, Mycobacterium
GGYGCGTYPLAMVKGTNVYEHF

SEQ ID NO: 1266129 - protein, 26 aa, Mycobacterium
GGYNVANCLLAIALLDAVGVSPEQAA

SEQ ID NO: 1266130 - protein, 19 aa, Mycobacterium
GGYQRFVAGVGRPLSESSQ

SEQ ID NO: 1266131 - protein, 24 aa, Mycobacterium
GGYTETEIVRWLFTPDASLTIRRD

SEQ ID NO: 1266132 - protein, 19 aa, Mycobacterium
GGYTYGGRIAALADAAREG

SEQ ID NO: 1266133 - protein, 18 aa, Mycobacterium
GGYYADWYFSNGKDFDGV

SEQ ID NO: 1266134 - protein, 42 aa, Mycobacterium
GHAARRPSYRPAAPPARRAAGAAPQFEVMYLLGGCDADGVEV

SEQ ID NO: 1266135 - protein, 21 aa, Mycobacterium
GHAAWALGVAKSMLDDVSELA

SEQ ID NO: 1266136 - protein, 26 aa, Mycobacterium
GHACVAVDAGHRWLLHAGDSFYHPGT

SEQ ID NO: 1266137 - protein, 23 aa, Mycobacterium
GHAGKIVFRQAFGSRKLAGEPGL

SEQ ID NO: 1266138 - protein, 20 aa, Mycobacterium
GHANHYLAVFDRATGSALNL

SEQ ID NO: 1266139 - protein, 24 aa, Mycobacterium
GHAPETWGRRLIEQALWMVDVHRT

SEQ ID NO: 1266140 - protein, 24 aa, Mycobacterium
GHDALDPFVAMGFAAAHTSTLRLI

SEQ ID NO: 1266141 - protein, 25 aa, Mycobacterium
GHDLDMRTLFPLPADRPVDPATDYA

SEQ ID NO: 1266142 - protein, 19 aa, Mycobacterium
GHDLSELIDRLLIAEALET

SEQ ID NO: 1266143 - protein, 17 aa, Mycobacterium
GHDPHVWPELTQHFHER

SEQ ID NO: 1266144 - protein, 17 aa, Mycobacterium
GHDQLRAAAALTAAVPG

SEQ ID NO: 1266145 - protein, 18 aa, Mycobacterium
GHEVRLLVGHSFGGAAVI

SEQ ID NO: 1266146 - protein, 19 aa, Mycobacterium
GHFAMLHHAAAYWKEQSKA

SEQ ID NO: 1266147 - protein, 20 aa, Mycobacterium
GHFKKVMPRDFKRVLQAIAE

SEQ ID NO: 1266148 - protein, 17 aa, Mycobacterium
GHFSRAVITRWAELPLA

SEQ ID NO: 1266149 - protein, 17 aa, Mycobacterium
GHFYRGVGLTIYEGYGL

SEQ ID NO: 1266150 - protein, 25 aa, Mycobacterium
GHGFKIAPAAGRLVADIVVDGRSGD

SEQ ID NO: 1266151 - protein, 23 aa, Mycobacterium
GHGGQALVWGRDPLDWGPRYYQR

SEQ ID NO: 1266152 - protein, 18 aa, Mycobacterium
GHGLRRGPDLSAMLEPIF

SEQ ID NO: 1266153 - protein, 18 aa, Mycobacterium
GHGLRVIIDQACARATVS

SEQ ID NO: 1266154 - protein, 19 aa, Mycobacterium
GHGRSSWDAPWTIDANVAA

SEQ ID NO: 1266155 - protein, 18 aa, Mycobacterium
GHGVPAMVGVDWRTSLTD

SEQ ID NO: 1266156 - protein, 19 aa, Mycobacterium
GHHAFDPFVSLSFAAAATS

SEQ ID NO: 1266157 - protein, 21 aa, Mycobacterium
GHHGSPEAWAAYRRVIGAAEA

SEQ ID NO: 1266158 - protein, 36 aa, Mycobacterium
GHHGTNFNGLVSLVLSLPVLRQLYIGLSEAFAPAIY

SEQ ID NO: 1266159 - protein, 37 aa, Mycobacterium
GHIEDAAGFPFRTLHDAYRALQAWGLPVSPHTAQVTG

SEQ ID NO: 1266160 - protein, 24 aa, Mycobacterium
GHKGARLTTQVSLAGRYLVYVPGA

SEQ ID NO: 1266161 - protein, 26 aa, Mycobacterium
GHLDHPRLGWSHAPVGPVLAESLGLP

SEQ ID NO: 1266162 - protein, 19 aa, Mycobacterium
GHLDVCVLGAFQVSERGDL

SEQ ID NO: 1266163 - protein, 19 aa, Mycobacterium
GHLEAAAGVAGFIKTVLSL

SEQ ID NO: 1266164 - protein, 24 aa, Mycobacterium
GHLLEIRGTCVLVDGTVKELSPSA

SEQ ID NO: 1266165 - protein, 24 aa, Mycobacterium
GHLMWTDRVALLSVTDEAGFAAVL

SEQ ID NO: 1266166 - protein, 22 aa, Mycobacterium
GHLRKFGLSRVRVRELAHQGQL

SEQ ID NO: 1266167 - protein, 18 aa, Mycobacterium
GHLRVGYEASEWAERAFA

SEQ ID NO: 1266168 - protein, 23 aa, Mycobacterium
GHLTVHDCTRWITGERRVLAAYL

SEQ ID NO: 1266169 - protein, 24 aa, Mycobacterium
GHNFLARLAVDWEAATIVAARAGV

SEQ ID NO: 1266170 - protein, 18 aa, Mycobacterium
GHPEPVYAHVPLVLNGDG

SEQ ID NO: 1266171 - protein, 19 aa, Mycobacterium
GHPLFAHITLLRSERSPIA

SEQ ID NO: 1266172 - protein, 25 aa, Mycobacterium
GHQWLKDVYIQDGLLRLGAEEVEQR

SEQ ID NO: 1266173 - protein, 19 aa, Mycobacterium
GHRGAMFLAAIDQLLQQPD

SEQ ID NO: 1266174 - protein, 25 aa, Mycobacterium
GHRLMETWHPLGVVGVITAFNFPVA

SEQ ID NO: 1266175 - protein, 27 aa, Mycobacterium
GHRLMETWHPLGVVGVITAFNFPVAVW

SEQ ID NO: 1266176 - protein, 28 aa, Mycobacterium
GHRLMETWHPLGVVGVITAFNFPVAVWS

SEQ ID NO: 1266177 - protein, 25 aa, Mycobacterium
GHRNGAVVLLMWAGILAYLDHSGYD

SEQ ID NO: 1266178 - protein, 24 aa, Mycobacterium
GHRPPGLPWRPAVTEPNPEQPELD

SEQ ID NO: 1266179 - protein, 25 aa, Mycobacterium
GHRVAFAPATGWITRLAEAHRIDRL

SEQ ID NO: 1266180 - protein, 21 aa, Mycobacterium
GHRVGTVFLGLAGPVDTDVVR

SEQ ID NO: 1266181 - protein, 19 aa, Mycobacterium
GHSDGAWAALATVRERVAS

SEQ ID NO: 1266182 - protein, 26 aa, Mycobacterium
GHSDLTYTVAHVWHGNIFRLGDHLDR

SEQ ID NO: 1266183 - protein, 26 aa, Mycobacterium
GHSLGGGVAMQFAYQFPQLVNRLILV

SEQ ID NO: 1266184 - protein, 23 aa, Mycobacterium
GHSLGGGVAMQFVHQHPDYCERL

SEQ ID NO: 1266185 - protein, 22 aa, Mycobacterium
GHSMGACLTMMVQAMGHPYDAV

SEQ ID NO: 1266186 - protein, 20 aa, Mycobacterium
GHSPDTGWQHLAEAALAIRS

SEQ ID NO: 1266187 - protein, 21 aa, Mycobacterium
GHSSVSWVKYPFLESHPQYDL

SEQ ID NO: 1266188 - protein, 17 aa, Mycobacterium
GHTAEYFTRMLSGLGDQ

SEQ ID NO: 1266189 - protein, 23 aa, Mycobacterium
GHTATRLVLYNALADAERLERYG

SEQ ID NO: 1266190 - protein, 20 aa, Mycobacterium
GHTSRISLGLLVTGVTYRHP

SEQ ID NO: 1266191 - protein, 17 aa, Mycobacterium
GHVLIEINKKVGYRLLT

SEQ ID NO: 1266192 - protein, 22 aa, Mycobacterium
GHVPLTAWARATLAFLEVSLGE

SEQ ID NO: 1266193 - protein, 25 aa, Mycobacterium
GHVRDRARLSWWKSDATTLRGLAEI

SEQ ID NO: 1266194 - protein, 17 aa, Mycobacterium
GHVRPKVMYEFRKHSGS

SEQ ID NO: 1266195 - protein, 25 aa, Mycobacterium
GHVRVVGQIPICWDPDREAAVARAH

SEQ ID NO: 1266196 - protein, 27 aa, Mycobacterium
GHWLLARLGKRVLRPGGLELTSRVLAA

SEQ ID NO: 1266197 - protein, 26 aa, Mycobacterium
GHWLLARLGKRVLRPGGLELTTRLLA

SEQ ID NO: 1266198 - protein, 23 aa, Mycobacterium
GIADGCVLAGCALLGGETAEHPG

SEQ ID NO: 1266199 - protein, 19 aa, Mycobacterium
GIAGVGMGMVTLRAPRVGE

SEQ ID NO: 1266200 - protein, 19 aa, Mycobacterium
GIAKHYFAPALAALGLGHV

SEQ ID NO: 1266201 - protein, 24 aa, Mycobacterium
GIAPPAALLGDWFSSRAVIAPSLI

SEQ ID NO: 1266202 - protein, 18 aa, Mycobacterium
GIARRLRTGTVGVNGGVW

SEQ ID NO: 1266203 - protein, 23 aa, Mycobacterium
GIASVLPVLRWSGPDEDAREAAV

SEQ ID NO: 1266204 - protein, 23 aa, Mycobacterium
GIATALAGRGWRVYGTGRTVADA

SEQ ID NO: 1266205 - protein, 19 aa, Mycobacterium
GIAVADLIAEYGPDVPLPP

SEQ ID NO: 1266206 - protein, 17 aa, Mycobacterium
GIAVRLPGGHVVAISVP

SEQ ID NO: 1266207 - protein, 26 aa, Mycobacterium
GICDVVLCAIPARYLTPTSPKKPKPL

SEQ ID NO: 1266208 - protein, 18 aa, Mycobacterium
GICFPREYGGLGLDHAYQ

SEQ ID NO: 1266209 - protein, 20 aa, Mycobacterium
GICPLGDKLPVQAFADAFDV

SEQ ID NO: 1266210 - protein, 18 aa, Mycobacterium
GICSYCVHCCQLNEVMPI

SEQ ID NO: 1266211 - protein, 18 aa, Mycobacterium
GIDAELMAQAAAIRDAVN

SEQ ID NO: 1266212 - protein, 22 aa, Mycobacterium
GIDARLSRYSYLVSLLPRRIVD

SEQ ID NO: 1266213 - protein, 20 aa, Mycobacterium
GIDATHAWASVWTPQNLWLG

SEQ ID NO: 1266214 - protein, 18 aa, Mycobacterium
GIDAWYSTGGALSIIANR

SEQ ID NO: 1266215 - protein, 23 aa, Mycobacterium
GIDEALRLVWAVRGSDREPTVQQ

SEQ ID NO: 1266216 - protein, 18 aa, Mycobacterium
GIDFARVAAVDFHTHVEV

SEQ ID NO: 1266217 - protein, 18 aa, Mycobacterium
GIDIALPFERPLYQTPVA

SEQ ID NO: 1266218 - protein, 19 aa, Mycobacterium
GIDLCGGVDTVVIPPSTPD

SEQ ID NO: 1266219 - protein, 24 aa, Mycobacterium
GIDLRAGVRVVRLDAFAHLVHADD

SEQ ID NO: 1266220 - protein, 19 aa, Mycobacterium
GIDNFSLLVSHVLVPPAIS

SEQ ID NO: 1266221 - protein, 19 aa, Mycobacterium
GIDQERFVDIAINPEGTRL

SEQ ID NO: 1266222 - protein, 19 aa, Mycobacterium
GIEEFARGFNPASLTDPSE

SEQ ID NO: 1266223 - protein, 40 aa, Mycobacterium
GIELPDCPVPGVPDCSSSGFDWLAAGFVRSGSSGSRSTSP

SEQ ID NO: 1266224 - protein, 26 aa, Mycobacterium
GIELRFVAAELRPVRPAVARRYEALR

SEQ ID NO: 1266225 - protein, 34 aa, Mycobacterium
GIEPAWLREGLRFWLRSALTYDLLTWSSVTDRCR

SEQ ID NO: 1266226 - protein, 19 aa, Mycobacterium
GIEPRAGYEPAAAAGDELY

SEQ ID NO: 1266227 - protein, 24 aa, Mycobacterium
GIETEFGVTCTFHGHRRLSPDEVA

SEQ ID NO: 1266228 - protein, 18 aa, Mycobacterium
GIEWPFDGELVLSDRDAA

SEQ ID NO: 1266229 - protein, 20 aa, Mycobacterium
GIFRDVWHPYSVSHRVINLL

SEQ ID NO: 1266230 - protein, 17 aa, Mycobacterium
GIFTEVIIAPAYEPGAV

SEQ ID NO: 1266231 - protein, 20 aa, Mycobacterium
GIGCSCHGSAFDLETGEPIS

SEQ ID NO: 1266232 - protein, 18 aa, Mycobacterium
GIGEEFAVQLARRGANLI

SEQ ID NO: 1266233 - protein, 18 aa, Mycobacterium
GIGGALLEKLAYDDAGNP

SEQ ID NO: 1266234 - protein, 18 aa, Mycobacterium
GIGGLALRRRYAAGGQAL

SEQ ID NO: 1266235 - protein, 26 aa, Mycobacterium
GIGHIRLATELARAMSPVSFSAVSLY

SEQ ID NO: 1266236 - protein, 19 aa, Mycobacterium
GIGRAFAVELARRGGRVVC

SEQ ID NO: 1266237 - protein, 22 aa, Mycobacterium
GIGTIVVGWGYGGRDFADGDGG

SEQ ID NO: 1266238 - protein, 24 aa, Mycobacterium
GIGVHAWGALGFGYAEVGTVTAQA

SEQ ID NO: 1266239 - protein, 21 aa, Mycobacterium
GIGVLYGRRELLAEMPPFLTG

SEQ ID NO: 1266240 - protein, 19 aa, Mycobacterium
GIGVRRVDADRGVPVELLT

SEQ ID NO: 1266241 - protein, 18 aa, Mycobacterium
GIHSCPGAPLARAETRVG

SEQ ID NO: 1266242 - protein, 18 aa, Mycobacterium
GIHVAALHVGFMDTDMVS

SEQ ID NO: 1266243 - protein, 24 aa, Mycobacterium
GIIGPDRRYVMAISSLDPTGDAAA

SEQ ID NO: 1266244 - protein, 19 aa, Mycobacterium
GIIRVHQFDKVEGFIYCKP

SEQ ID NO: 1266245 - protein, 17 aa, Mycobacterium
GIISLALQVLAQTDIPL

SEQ ID NO: 1266246 - protein, 23 aa, Mycobacterium
GIKDLRFGACLDDDWAEADPDEF

SEQ ID NO: 1266247 - protein, 23 aa, Mycobacterium
GIKSREIYEAPGAMVLITAHTEL

SEQ ID NO: 1266248 - protein, 17 aa, Mycobacterium
GILACLQTGATLFPELT

SEQ ID NO: 1266249 - protein, 18 aa, Mycobacterium
GILADWGADVVKIEPPGG

SEQ ID NO: 1266250 - protein, 17 aa, Mycobacterium
GILDWAGFMSSVDTGTA

SEQ ID NO: 1266251 - protein, 19 aa, Mycobacterium
GILGRGVAYQARFDPQAKG

SEQ ID NO: 1266252 - protein, 24 aa, Mycobacterium
GILGRHGRLSVLVIRTRPDGSAGS

SEQ ID NO: 1266253 - protein, 25 aa, Mycobacterium
GILHRLSATAARVGVFRPITRMGES

SEQ ID NO: 1266254 - protein, 23 aa, Mycobacterium
GILNEIREGVLLGHAQEQLNARA

SEQ ID NO: 1266255 - protein, 24 aa, Mycobacterium
GILRLEVPAARRPFWDAGVAALQA

SEQ ID NO: 1266256 - protein, 17 aa, Mycobacterium
GILRQRGYEADRVAVID

SEQ ID NO: 1266257 - protein, 18 aa, Mycobacterium
GILRQRGYEADRVAVIDG

SEQ ID NO: 1266258 - protein, 18 aa, Mycobacterium
GILSEVFCAEPVMVGLRA

SEQ ID NO: 1266259 - protein, 19 aa, Mycobacterium
GILTLVSRATCVVLDGEQR

SEQ ID NO: 1266260 - protein, 28 aa, Mycobacterium
GILTRFPKGTYLPIIGVSFGDGVSTTDP

SEQ ID NO: 1266261 - protein, 21 aa, Mycobacterium
GIMVDAPVLRRAERIVELAPH

SEQ ID NO: 1266262 - protein, 24 aa, Mycobacterium
GINDEFPFLLGHEAAGTVESVGAG

SEQ ID NO: 1266263 - protein, 22 aa, Mycobacterium
GIPADELAEWVAVARQRAGEAV

SEQ ID NO: 1266264 - protein, 18 aa, Mycobacterium
GIPGMAVAVVHGGKTVYA

SEQ ID NO: 1266265 - protein, 17 aa, Mycobacterium
GIPGVVPRRCLVRSVFG

SEQ ID NO: 1266266 - protein, 18 aa, Mycobacterium
GIPLRRYVLWSRLRAAIT

SEQ ID NO: 1266267 - protein, 23 aa, Mycobacterium
GIPPDRVLDSLVHVWTCAVYGEC

SEQ ID NO: 1266268 - protein, 20 aa, Mycobacterium
GIPPKWAAVRRLVMGVINGN

SEQ ID NO: 1266269 - protein, 17 aa, Mycobacterium
GIPVAWEVAAALGAPLD

SEQ ID NO: 1266270 - protein, 19 aa, Mycobacterium
GIQLCHRWSARRGRCQESP

SEQ ID NO: 1266271 - protein, 18 aa, Mycobacterium
GIRALTAYCVAKGGLEAL

SEQ ID NO: 1266272 - protein, 25 aa, Mycobacterium
GIRGGYLSEVFPITFPHTPGIDVAG

SEQ ID NO: 1266273 - protein, 19 aa, Mycobacterium
GIRPEHLEDAAVIDAYARI

SEQ ID NO: 1266274 - protein, 18 aa, Mycobacterium
GIRRELPHLAPVDAPSIL

SEQ ID NO: 1266275 - protein, 23 aa, Mycobacterium
GIRRPRFSLMNVLGQHRLLFLTW

SEQ ID NO: 1266276 - protein, 23 aa, Mycobacterium
GIRRRVAADLQILKRGARLVEFA

SEQ ID NO: 1266277 - protein, 25 aa, Mycobacterium
GIRYFRVPAGLTFRGQVAADIECIY

SEQ ID NO: 1266278 - protein, 28 aa, Mycobacterium
GIRYLHSWEAARPCPPPSTVAGDDPRIP

SEQ ID NO: 1266279 - protein, 19 aa, Mycobacterium
GISAPRFLLEDCADDVAAV

SEQ ID NO: 1266280 - protein, 19 aa, Mycobacterium
GISDIPVGVGLGVRSREQA

SEQ ID NO: 1266281 - protein, 22 aa, Mycobacterium
GISEACLHRWLKIADRDDGVDR

SEQ ID NO: 1266282 - protein, 18 aa, Mycobacterium
GISEKFPLMLSAMSTGVT

SEQ ID NO: 1266283 - protein, 18 aa, Mycobacterium
GISFRLEPDLEEYSGGWQ

SEQ ID NO: 1266284 - protein, 17 aa, Mycobacterium
GITAPVFYVRYPESEIT

SEQ ID NO: 1266285 - protein, 24 aa, Mycobacterium
GITEVKVRSVLTCGTGTGVCAMCY

SEQ ID NO: 1266286 - protein, 21 aa, Mycobacterium
GITLRCLRNGLDTATSTGRIV

SEQ ID NO: 1266287 - protein, 26 aa, Mycobacterium
GITNGRIPRLYGRQASEFVIRRAMSQ

SEQ ID NO: 1266288 - protein, 17 aa, Mycobacterium
GITPHLLVMTATPIPRT

SEQ ID NO: 1266289 - protein, 20 aa, Mycobacterium
GITRLRLPADNEVVSLVADP

SEQ ID NO: 1266290 - protein, 19 aa, Mycobacterium
GIVALPWHAAYSASKYGLR

SEQ ID NO: 1266291 - protein, 25 aa, Mycobacterium
GIVHFNGPFLYRSAFHAETEEQETQ

SEQ ID NO: 1266292 - protein, 18 aa, Mycobacterium
GIVLGALGLFGSRPGALN

SEQ ID NO: 1266293 - protein, 27 aa, Mycobacterium
GIVMARYILELEPFKSLPVEQIVDTVA

SEQ ID NO: 1266294 - protein, 28 aa, Mycobacterium
GIVSRGGSIMAAWCLAHHRESFLYTNFE

SEQ ID NO: 1266295 - protein, 23 aa, Mycobacterium
GIVTGLRLMARMAQTGRSLAGLA

SEQ ID NO: 1266296 - protein, 23 aa, Mycobacterium
GIWAPNCPEWTMLQYATAKIGAI

SEQ ID NO: 1266297 - protein, 26 aa, Mycobacterium
GIYPDGRFSYQLTIYIFRYGEGTVMA

SEQ ID NO: 1266298 - protein, 17 aa, Mycobacterium
GKAAGLWTLSEQLTGTE

SEQ ID NO: 1266299 - protein, 19 aa, Mycobacterium
GKAALSPCVIRGAGTSRRV

SEQ ID NO: 1266300 - protein, 27 aa, Mycobacterium
GKAGQPFFPEFRRNEAGQYVPVNAQGQ

SEQ ID NO: 1266301 - protein, 21 aa, Mycobacterium
GKAHWAAVVDCVGGATLAYAL

SEQ ID NO: 1266302 - protein, 24 aa, Mycobacterium
GKAIDARPALTAAIDAVESAQAAV

SEQ ID NO: 1266303 - protein, 19 aa, Mycobacterium
GKAKEGVGTVTGRDDMVRE

SEQ ID NO: 1266304 - protein, 22 aa, Mycobacterium
GKAPLSRPVAVVLLGGLRELTA

SEQ ID NO: 1266305 - protein, 19 aa, Mycobacterium
GKATVPLAQYRAAWREAVK

SEQ ID NO: 1266306 - protein, 19 aa, Mycobacterium
GKDEAYGGWGGDGGPAGVT

SEQ ID NO: 1266307 - protein, 18 aa, Mycobacterium
GKDWQVWSGEQVADLVQL

SEQ ID NO: 1266308 - protein, 18 aa, Mycobacterium
GKEFKPGSTVVAFPLMRA

SEQ ID NO: 1266309 - protein, 21 aa, Mycobacterium
GKEGWAAEEFEYLRTVEATPT

SEQ ID NO: 1266310 - protein, 17 aa, Mycobacterium
GKERAAMNWLEQVHVEG

SEQ ID NO: 1266311 - protein, 25 aa, Mycobacterium
GKFAIFVGGFPLVFNGQIVGGVGIS

SEQ ID NO: 1266312 - protein, 20 aa, Mycobacterium
GKFDDGWDVLRESMLDNQKA

SEQ ID NO: 1266313 - protein, 17 aa, Mycobacterium
GKFDVLATFIADDMRYL

SEQ ID NO: 1266314 - protein, 17 aa, Mycobacterium
GKFPFETVRTMARIIKA

SEQ ID NO: 1266315 - protein, 18 aa, Mycobacterium
GKFSEQLLADHLQKVSLS

SEQ ID NO: 1266316 - protein, 20 aa, Mycobacterium
GKGEVPCALGAVKTNMGHLE

SEQ ID NO: 1266317 - protein, 20 aa, Mycobacterium
GKGFAGTMKRHGFRGQGASH

SEQ ID NO: 1266318 - protein, 22 aa, Mycobacterium
GKGGSAGLFGRPGSGGRGGDSH

SEQ ID NO: 1266319 - protein, 19 aa, Mycobacterium
GKGLRWRTTISNHRPEVLR

SEQ ID NO: 1266320 - protein, 24 aa, Mycobacterium
GKGQWLAEQVMEWAGLDLLILRVA

SEQ ID NO: 1266321 - protein, 22 aa, Mycobacterium
GKGTALITMCAGGALSTGTIIE

SEQ ID NO: 1266322 - protein, 18 aa, Mycobacterium
GKGVGIAGPGLYRSFSSK

SEQ ID NO: 1266323 - protein, 17 aa, Mycobacterium
GKGVMHIGVDTLPTLPT

SEQ ID NO: 1266324 - protein, 23 aa, Mycobacterium
GKHLGVGVTSIYWYFRKKDDLLN

SEQ ID NO: 1266325 - protein, 18 aa, Mycobacterium
GKIGVAIEELLRYDAPVQ

SEQ ID NO: 1266326 - protein, 17 aa, Mycobacterium
GKINFRVDKQANLHFVI

SEQ ID NO: 1266327 - protein, 26 aa, Mycobacterium
GKKCYSLRIASAMAHDEGWLAEHMLI

SEQ ID NO: 1266328 - protein, 18 aa, Mycobacterium
GKKLSWSDLIVYAGNRAM

SEQ ID NO: 1266329 - protein, 23 aa, Mycobacterium
GKLADLVLWEPAFFGVRPHAVVK

SEQ ID NO: 1266330 - protein, 28 aa, Mycobacterium
GKLGVGWPKEYGGLGFGPVEQQIFVNEA

SEQ ID NO: 1266331 - protein, 20 aa, Mycobacterium
GKLGVPCRWPEDAVTVCSFG

SEQ ID NO: 1266332 - protein, 25 aa, Mycobacterium
GKLLTAVAVAAGWPGGDGGEFLDNY

SEQ ID NO: 1266333 - protein, 20 aa, Mycobacterium
GKLPATWRYTAEGLQRVRRS

SEQ ID NO: 1266334 - protein, 21 aa, Mycobacterium
GKLPPHLEWVAPFGALSAANW

SEQ ID NO: 1266335 - protein, 28 aa, Mycobacterium
GKLRLSDRIATWLPELADMRVLVDPRGG

SEQ ID NO: 1266336 - protein, 19 aa, Mycobacterium
GKLRVALDAAGSRIDVHSD

SEQ ID NO: 1266337 - protein, 25 aa, Mycobacterium
GKNGIKSAFMSYGLVDGRRMSHPDH

SEQ ID NO: 1266338 - protein, 17 aa, Mycobacterium
GKNLLVAIMPWEGHNYE

SEQ ID NO: 1266339 - protein, 25 aa, Mycobacterium
GKNLPGVAFAHDWITSADRYRGTLE

SEQ ID NO: 1266340 - protein, 31 aa, Mycobacterium
GKPLMPPQMLHMILPRKDYEIVEDSWDVVGL

SEQ ID NO: 1266341 - protein, 28 aa, Mycobacterium
GKPPRKVPEIPVATRLAGLEPLNITDDS

SEQ ID NO: 1266342 - protein, 20 aa, Mycobacterium
GKQGRVPFLSDYVASKFGVV

SEQ ID NO: 1266343 - protein, 27 aa, Mycobacterium
GKQTIYRWWPSRHALVADVTLEDADRI

SEQ ID NO: 1266344 - protein, 17 aa, Mycobacterium
GKRAQCFGGAKNHMIVM

SEQ ID NO: 1266345 - protein, 17 aa, Mycobacterium
GKRCITTTVLADVPTDD

SEQ ID NO: 1266346 - protein, 20 aa, Mycobacterium
GKRKRTRSGFGQRKSTKRAI

SEQ ID NO: 1266347 - protein, 20 aa, Mycobacterium
GKRKRTRTGFGQRKATKRAI

SEQ ID NO: 1266348 - protein, 20 aa, Mycobacterium
GKRLTVPAFRSLGLSGAGIN

SEQ ID NO: 1266349 - protein, 19 aa, Mycobacterium
GKRLVVPGLVPKLTGLGGR

SEQ ID NO: 1266350 - protein, 20 aa, Mycobacterium
GKRMDECIDIIRGLTSGDYF

SEQ ID NO: 1266351 - protein, 18 aa, Mycobacterium
GKRSIGLDMSVPEGREVL

SEQ ID NO: 1266352 - protein, 23 aa, Mycobacterium
GKRYRSAYFETFPGVWRHGDWIT

SEQ ID NO: 1266353 - protein, 21 aa, Mycobacterium
GKSATTAWLIERLQRPTLVMA

SEQ ID NO: 1266354 - protein, 25 aa, Mycobacterium
GKSKRQHVTCVHKCADACSKPVPNK

SEQ ID NO: 1266355 - protein, 20 aa, Mycobacterium
GKSPAVFYRYFADKEDLLAA

SEQ ID NO: 1266356 - protein, 22 aa, Mycobacterium
GKSTLLMLIAGLLRPDVGRIEL

SEQ ID NO: 1266357 - protein, 24 aa, Mycobacterium
GKSTLLRCLVRLAEPTSGTVTLAG

SEQ ID NO: 1266358 - protein, 25 aa, Mycobacterium
GKSTVWRAGIERARTRGFRVLAAHP

SEQ ID NO: 1266359 - protein, 23 aa, Mycobacterium
GKTAGEIHALFNRHSKTPVPQAL

SEQ ID NO: 1266360 - protein, 39 aa, Mycobacterium
GKTIMAGLFIKEALARGWIRRCLIVVPGSLVEQWQNELR

SEQ ID NO: 1266361 - protein, 20 aa, Mycobacterium
GKTLAAFLWAIDGLAREPAA

SEQ ID NO: 1266362 - protein, 24 aa, Mycobacterium
GKTLACVMPAYLNAIGGKGVHIVT

SEQ ID NO: 1266363 - protein, 20 aa, Mycobacterium
GKTRLWLTAIEEARRRGYRV

SEQ ID NO: 1266364 - protein, 20 aa, Mycobacterium
GKTSLLRLLCTDLAVAADQP

SEQ ID NO: 1266365 - protein, 18 aa, Mycobacterium
GKTTCFNAITGVYRPTSG

SEQ ID NO: 1266366 - protein, 20 aa, Mycobacterium
GKTTLWLTVRQRAGDLGFRV

SEQ ID NO: 1266367 - protein, 26 aa, Mycobacterium
GKTVIDINVRWKKGQTLDPDWQLDGD

SEQ ID NO: 1266368 - protein, 19 aa, Mycobacterium
GKVRRASCVELYRNDKFSR

SEQ ID NO: 1266369 - protein, 28 aa, Mycobacterium
GKVVLINVWGSWCAPCRTETPELETVYA

SEQ ID NO: 1266370 - protein, 17 aa, Mycobacterium
GKWAYYRVNTEALDRIA

SEQ ID NO: 1266371 - protein, 30 aa, Mycobacterium
GKWYPGEPLPRWQIGLFWRTDGEPLWADES

SEQ ID NO: 1266372 - protein, 30 aa, Mycobacterium
GKWYPGEPLPRWQIGLYWRTDGAPLWTDAS

SEQ ID NO: 1266373 - protein, 29 aa, Mycobacterium
GLADAFRDGRPHGVDAFGTMLVVFADTGG

SEQ ID NO: 1266374 - protein, 19 aa, Mycobacterium
GLADCTLALGFEKMQPGSL

SEQ ID NO: 1266375 - protein, 18 aa, Mycobacterium
GLADIEWTVQLLQLRFAH

SEQ ID NO: 1266376 - protein, 18 aa, Mycobacterium
GLADRFRVIAADMPGWGQ

SEQ ID NO: 1266377 - protein, 19 aa, Mycobacterium
GLAEIMRLGIALGAKPATL

SEQ ID NO: 1266378 - protein, 24 aa, Mycobacterium
GLAELCQRREILLIVDDVQMGCGR

SEQ ID NO: 1266379 - protein, 32 aa, Mycobacterium
GLAELWGRSVFHCPFCHGWEVRDRPLAVLANG

SEQ ID NO: 1266380 - protein, 25 aa, Mycobacterium
GLAFFPVLVCALAWAQRWLPSPEGP

SEQ ID NO: 1266381 - protein, 18 aa, Mycobacterium
GLAFKLAAQGVRANTVSP

SEQ ID NO: 1266382 - protein, 20 aa, Mycobacterium
GLAGDLRRVTGMDRRLAEAA

SEQ ID NO: 1266383 - protein, 25 aa, Mycobacterium
GLAGETYCATAFLYDGRGGRGGCAL

SEQ ID NO: 1266384 - protein, 20 aa, Mycobacterium
GLAICERYLRDAPARIVLAA

SEQ ID NO: 1266385 - protein, 18 aa, Mycobacterium
GLAIGLELVDPASGDRDP

SEQ ID NO: 1266386 - protein, 19 aa, Mycobacterium
GLAKTRLAAALGADVAADI

SEQ ID NO: 1266387 - protein, 26 aa, Mycobacterium
GLALAEGFALAGARVVVASRKPDAYE

SEQ ID NO: 1266388 - protein, 18 aa, Mycobacterium
GLAPAQRQLVTLGMLTAL

SEQ ID NO: 1266389 - protein, 17 aa, Mycobacterium
GLAPRGTQSLVLEVYQN

SEQ ID NO: 1266390 - protein, 27 aa, Mycobacterium
GLAQAPRVDNYGGFVFASLAAEGVSLR

SEQ ID NO: 1266391 - protein, 20 aa, Mycobacterium
GLAQLWPRLNEDLDARAAVI

SEQ ID NO: 1266392 - protein, 19 aa, Mycobacterium
GLAQRVEVQVAYAIGKAAP

SEQ ID NO: 1266393 - protein, 23 aa, Mycobacterium
GLARAGGDALAWDVNGLNVTHEA

SEQ ID NO: 1266394 - protein, 22 aa, Mycobacterium
GLASRFNFTLTFTSYTADEIVA

SEQ ID NO: 1266395 - protein, 25 aa, Mycobacterium
GLAVAELLAALGAGVVVNGRDEVAA

SEQ ID NO: 1266396 - protein, 19 aa, Mycobacterium
GLAVLRAYNDWNIDEWCGT

SEQ ID NO: 1266397 - protein, 20 aa, Mycobacterium
GLCGELRLADFDDLELSNLN

SEQ ID NO: 1266398 - protein, 24 aa, Mycobacterium
GLCTYGMTCKALVDNLLDGDVSGL

SEQ ID NO: 1266399 - protein, 26 aa, Mycobacterium
GLDARAYRLSWPQDMVLFEIDQPEVL

SEQ ID NO: 1266400 - protein, 26 aa, Mycobacterium
GLDDDVRRALGFTFERFDGGGLPDGA

SEQ ID NO: 1266401 - protein, 17 aa, Mycobacterium
GLDDLLIRGADFYEKQH

SEQ ID NO: 1266402 - protein, 18 aa, Mycobacterium
GLDDLLIRGADFYEKQHI

SEQ ID NO: 1266403 - protein, 25 aa, Mycobacterium
GLDDMIRVAEWLRDSGIAVDDIGLS

SEQ ID NO: 1266404 - protein, 23 aa, Mycobacterium
GLDERYVREWLGGMVAGRIVDYD

SEQ ID NO: 1266405 - protein, 19 aa, Mycobacterium
GLDEVKRALDAAGTPYKEL

SEQ ID NO: 1266406 - protein, 24 aa, Mycobacterium
GLDFFEVFCDTPLEDCERRDPKGL

SEQ ID NO: 1266407 - protein, 17 aa, Mycobacterium
GLDFLRHIERCAVLVHV

SEQ ID NO: 1266408 - protein, 25 aa, Mycobacterium
GLDGRFVKRLFDSHYLKASMEVSAN

SEQ ID NO: 1266409 - protein, 19 aa, Mycobacterium
GLDHCFGPVMLHRVEATVR

SEQ ID NO: 1266410 - protein, 25 aa, Mycobacterium
GLDKPSLGLGEWVVPTLLQHGSAEQ

SEQ ID NO: 1266411 - protein, 19 aa, Mycobacterium
GLDLKWTHLGADNTSLFLK

SEQ ID NO: 1266412 - protein, 23 aa, Mycobacterium
GLDLRVGDRFDPLVGLSPFSLVS

SEQ ID NO: 1266413 - protein, 18 aa, Mycobacterium
GLDPGFRTGVKVAVVDGT

SEQ ID NO: 1266414 - protein, 23 aa, Mycobacterium
GLDREADDFFAFIADVSGANNGD

SEQ ID NO: 1266415 - protein, 22 aa, Mycobacterium
GLDREDDDFFAFIADVSGANNG

SEQ ID NO: 1266416 - protein, 19 aa, Mycobacterium
GLDRLRARMAELVVPTDTV

SEQ ID NO: 1266417 - protein, 23 aa, Mycobacterium
GLDRNKMRVVPGITSKAMSAASG

SEQ ID NO: 1266418 - protein, 25 aa, Mycobacterium
GLDRPFGIGLVHWVVEARPDLLERA

SEQ ID NO: 1266419 - protein, 18 aa, Mycobacterium
GLDSFRDGIRGMRDDFVG

SEQ ID NO: 1266420 - protein, 27 aa, Mycobacterium
GLDVATAWLRARRPLDFIPGLMHGDYQ

SEQ ID NO: 1266421 - protein, 25 aa, Mycobacterium
GLDVPGIVWFRGLLRQLADTGCVVV

SEQ ID NO: 1266422 - protein, 18 aa, Mycobacterium
GLDYEIWDDDWTVVTKDK

SEQ ID NO: 1266423 - protein, 31 aa, Mycobacterium
GLEAELPRGLPPVRLIAGAQLDGWQSYPDCV

SEQ ID NO: 1266424 - protein, 20 aa, Mycobacterium
GLEAHFRPGSSPAYHIEHLE

SEQ ID NO: 1266425 - protein, 24 aa, Mycobacterium
GLEGGRFALYMKIHHALVDGYTAM

SEQ ID NO: 1266426 - protein, 23 aa, Mycobacterium
GLEGLRKIVRRVLDAGSVSGEFA

SEQ ID NO: 1266427 - protein, 20 aa, Mycobacterium
GLEHRAAWVEAESDGTVTSM

SEQ ID NO: 1266428 - protein, 20 aa, Mycobacterium
GLEIALACHHRIAADTKGVV

SEQ ID NO: 1266429 - protein, 18 aa, Mycobacterium
GLEILKTMMEGFPVGDPW

SEQ ID NO: 1266430 - protein, 28 aa, Mycobacterium
GLEKCIGCELCAWACPADAIFVEGADNT

SEQ ID NO: 1266431 - protein, 25 aa, Mycobacterium
GLEMIKAQGGIFGWVADTSSVIPAL

SEQ ID NO: 1266432 - protein, 22 aa, Mycobacterium
GLEPLVRLVSWGLAGVPPKVMG

SEQ ID NO: 1266433 - protein, 19 aa, Mycobacterium
GLEPWMVWLSEAGLPLPYR

SEQ ID NO: 1266434 - protein, 20 aa, Mycobacterium
GLETLSLRIERHVQNARQVA

SEQ ID NO: 1266435 - protein, 19 aa, Mycobacterium
GLEVCRTAVFDWVMVSRVA

SEQ ID NO: 1266436 - protein, 19 aa, Mycobacterium
GLEVGVWEMTEGVMADTEV

SEQ ID NO: 1266437 - protein, 18 aa, Mycobacterium
GLFDRIGMQTSLFGPEAR

SEQ ID NO: 1266438 - protein, 29 aa, Mycobacterium
GLFFSLPWFYRCGYDVMLYTLPFHGRRAE

SEQ ID NO: 1266439 - protein, 17 aa, Mycobacterium
GLFIELAEHMWRRRDRH

SEQ ID NO: 1266440 - protein, 19 aa, Mycobacterium
GLFLAEGFAHLTLDEIAAR

SEQ ID NO: 1266441 - protein, 28 aa, Mycobacterium
GLGAAYLAGFAWGLGRQYTVLVEMDADG

SEQ ID NO: 1266442 - protein, 20 aa, Mycobacterium
GLGAPEFASRIGVEVDEFQS

SEQ ID NO: 1266443 - protein, 23 aa, Mycobacterium
GLGARWGDTFARDQHPDVQMDYV

SEQ ID NO: 1266444 - protein, 23 aa, Mycobacterium
GLGDAVGVLAGFPVEIAPTAQGL

SEQ ID NO: 1266445 - protein, 17 aa, Mycobacterium
GLGEDLLSDPFPVLNQI

SEQ ID NO: 1266446 - protein, 19 aa, Mycobacterium
GLGEIFTAAGAEWRQAGCS

SEQ ID NO: 1266447 - protein, 25 aa, Mycobacterium
GLGEKDLRLALGLGESTGVELPLAE

SEQ ID NO: 1266448 - protein, 17 aa, Mycobacterium
GLGESLLTYALCVEELA

SEQ ID NO: 1266449 - protein, 20 aa, Mycobacterium
GLGFSMKWNMGWMNDTLEFI

SEQ ID NO: 1266450 - protein, 19 aa, Mycobacterium
GLGGCPFAPGASGNIATED

SEQ ID NO: 1266451 - protein, 19 aa, Mycobacterium
GLGGCPFAPGASGNIAVED

SEQ ID NO: 1266452 - protein, 25 aa, Mycobacterium
GLGGDGLGTCWGRDLATSMLADAGF

SEQ ID NO: 1266453 - protein, 17 aa, Mycobacterium
GLGHDWFEVSLIPTTLG

SEQ ID NO: 1266454 - protein, 17 aa, Mycobacterium
GLGHIGLDRSLRSLSGG

SEQ ID NO: 1266455 - protein, 18 aa, Mycobacterium
GLGIIFRKGLPLEDMEFH

SEQ ID NO: 1266456 - protein, 21 aa, Mycobacterium
GLGLDLAWRIVVEKHHGHLTV

SEQ ID NO: 1266457 - protein, 24 aa, Mycobacterium
GLGPALRILRAVAHMTRRTVEGQA

SEQ ID NO: 1266458 - protein, 21 aa, Mycobacterium
GLGPMVTKSPLLTTLVSLIPP

SEQ ID NO: 1266459 - protein, 18 aa, Mycobacterium
GLGREYALTLAREGASVV

SEQ ID NO: 1266460 - protein, 23 aa, Mycobacterium
GLGRIGAAIALRLKAFGCTISYH

SEQ ID NO: 1266461 - protein, 17 aa, Mycobacterium
GLGRRRPDIAVTILRLA

SEQ ID NO: 1266462 - protein, 32 aa, Mycobacterium
GLGRTLVEVPVGFKWFVDGLIGGSIGFGGEES

SEQ ID NO: 1266463 - protein, 18 aa, Mycobacterium
GLGSVLRLGDKHLADLPH

SEQ ID NO: 1266464 - protein, 20 aa, Mycobacterium
GLGTYKFFLDFVGHIEDPPV

SEQ ID NO: 1266465 - protein, 18 aa, Mycobacterium
GLHFCLGSALARLEARVA

SEQ ID NO: 1266466 - protein, 18 aa, Mycobacterium
GLHLASLAGSWTALVAGF

SEQ ID NO: 1266467 - protein, 19 aa, Mycobacterium
GLHRLRMMVPNSPGGGYDL

SEQ ID NO: 1266468 - protein, 19 aa, Mycobacterium
GLHRLWPPVIDLVRHLVDD

SEQ ID NO: 1266469 - protein, 24 aa, Mycobacterium
GLHSCPQMAWSQVRSTVAQVLSPP

SEQ ID NO: 1266470 - protein, 17 aa, Mycobacterium
GLHTLGFTFTLTGTAEG

SEQ ID NO: 1266471 - protein, 19 aa, Mycobacterium
GLHVDEQFGGQGYGLPELT

SEQ ID NO: 1266472 - protein, 18 aa, Mycobacterium
GLHYAYPGGHEALGGIDL

SEQ ID NO: 1266473 - protein, 17 aa, Mycobacterium
GLIAVPVNIRLAPDEVA

SEQ ID NO: 1266474 - protein, 17 aa, Mycobacterium
GLIDFWRFDEFRDSRLW

SEQ ID NO: 1266475 - protein, 25 aa, Mycobacterium
GLIGLKTHCKTCLVVRREGSTIRRY

SEQ ID NO: 1266476 - protein, 19 aa, Mycobacterium
GLIGSRWLAHYTATTTFLD

SEQ ID NO: 1266477 - protein, 18 aa, Mycobacterium
GLIQEVFLIDNLRMALNY

SEQ ID NO: 1266478 - protein, 17 aa, Mycobacterium
GLITARAPLAVPVADAL

SEQ ID NO: 1266479 - protein, 27 aa, Mycobacterium
GLKARGKRGGVIACALAHRATRIAHAL

SEQ ID NO: 1266480 - protein, 27 aa, Mycobacterium
GLKARLRPDLRIHLAAAEAEFWAAPDF

SEQ ID NO: 1266481 - protein, 33 aa, Mycobacterium
GLKGRDLRDAFATDEYQVMLVANKFQTGFDQPL

SEQ ID NO: 1266482 - protein, 19 aa, Mycobacterium
GLKSYRGDMVNGFAPDAAV

SEQ ID NO: 1266483 - protein, 19 aa, Mycobacterium
GLKTPIVHGMWLSAAAQHA

SEQ ID NO: 1266484 - protein, 21 aa, Mycobacterium
GLKVRGNHGVFDHERRDGQDF

SEQ ID NO: 1266485 - protein, 20 aa, Mycobacterium
GLKVRYFTAADLVETLYRGL

SEQ ID NO: 1266486 - protein, 32 aa, Mycobacterium; identical to SEQ ID NO: 619315

SEQ ID NO: 1266487 - protein, 18 aa, Mycobacterium
GLLAPESREANGIGSTAQ

SEQ ID NO: 1266488 - protein, 17 aa, Mycobacterium
GLLARHAAAFAAGDAAA

SEQ ID NO: 1266489 - protein, 19 aa, Mycobacterium
GLLAWLRGLVRTGYVAEDA

SEQ ID NO: 1266490 - protein, 20 aa, Mycobacterium
GLLDGRWRGSPVRDRVDPAA

SEQ ID NO: 1266491 - protein, 17 aa, Mycobacterium
GLLELPGADAFRDAEGT

SEQ ID NO: 1266492 - protein, 25 aa, Mycobacterium
GLLEPARAAFEWSRTQQRPDGTWPI

SEQ ID NO: 1266493 - protein, 27 aa, Mycobacterium
GLLERRPQWLEARWVRAVLHYRTARWN

SEQ ID NO: 1266494 - protein, 25 aa, Mycobacterium
GLLEVPVKMAQNFTDAVAALLNPTT

SEQ ID NO: 1266495 - protein, 17 aa, Mycobacterium
GLLGPGKGVERVIDVMS

SEQ ID NO: 1266496 - protein, 22 aa, Mycobacterium
GLLGRYGAAVGEAFQLRDDLLG

SEQ ID NO: 1266497 - protein, 25 aa, Mycobacterium
GLLGSLRVGNRFVHTGKPKPAAYAR

SEQ ID NO: 1266498 - protein, 29 aa, Mycobacterium
GLLKRYLDVDGAWRDHLLVAITVEELSGS

SEQ ID NO: 1266499 - protein, 18 aa, Mycobacterium
GLLLMIPNMYKIAGELTS

SEQ ID NO: 1266500 - protein, 18 aa, Mycobacterium
GLLLMPPYLVEVPQAGLV

SEQ ID NO: 1266501 - protein, 19 aa, Mycobacterium
GLLPPSFALVGFARRDWAD

SEQ ID NO: 1266502 - protein, 21 aa, Mycobacterium
GLLQTEFNVMLPWSKEVSLPA

SEQ ID NO: 1266503 - protein, 18 aa, Mycobacterium
GLLRKGERLLVFLPLAHV

SEQ ID NO: 1266504 - protein, 25 aa, Mycobacterium
GLLSDLRLGLMHGRLSGDEKAAVMS

SEQ ID NO: 1266505 - protein, 19 aa, Mycobacterium
GLLTLPHPEEWGGGGQPYE

SEQ ID NO: 1266506 - protein, 18 aa, Mycobacterium
GLLTSDRHPAVGWLIPQP

SEQ ID NO: 1266507 - protein, 24 aa, Mycobacterium
GLMDQAWWFPAFAPLPGGDPTVML

SEQ ID NO: 1266508 - protein, 24 aa, Mycobacterium
GLMGALRLAGHRVAPFKVGPDFID

SEQ ID NO: 1266509 - protein, 21 aa, Mycobacterium
GLMLGEYWDLGPLAADCAADG

SEQ ID NO: 1266510 - protein, 18 aa, Mycobacterium
GLMLYAFAGVGIKLDHYS

SEQ ID NO: 1266511 - protein, 20 aa, Mycobacterium
GLMMNFDLVPMLTKAEVERS

SEQ ID NO: 1266512 - protein, 18 aa, Mycobacterium
GLMQPELDDIGTEDLALD

SEQ ID NO: 1266513 - protein, 28 aa, Mycobacterium
GLNNAIALPRVWAFNMPVAYKRFADIAQ

SEQ ID NO: 1266514 - protein, 18 aa, Mycobacterium
GLNRKGVHRIVRTTNQRG

SEQ ID NO: 1266515 - protein, 26 aa, Mycobacterium
GLPAAWEIITTSSLYSEIASAVFNPA

SEQ ID NO: 1266516 - protein, 24 aa, Mycobacterium
GLPACAINWGLWKSLADAQTGFER

SEQ ID NO: 1266517 - protein, 19 aa, Mycobacterium
GLPAPRLVVEPGRAIAGPG

SEQ ID NO: 1266518 - protein, 18 aa, Mycobacterium
GLPDDWYAEVVARLVPLR

SEQ ID NO: 1266519 - protein, 24 aa, Mycobacterium
GLPDQGVVVLVDLGGSGSSISLAD

SEQ ID NO: 1266520 - protein, 23 aa, Mycobacterium
GLPDVPGYAAQVFRAVADADVNI

SEQ ID NO: 1266521 - protein, 21 aa, Mycobacterium
GLPEDRLRALLTDAARAVLGL

SEQ ID NO: 1266522 - protein, 19 aa, Mycobacterium
GLPEDWPILIDEQVLTQPH

SEQ ID NO: 1266523 - protein, 18 aa, Mycobacterium
GLPEFGWTLFAGVVRPKS

SEQ ID NO: 1266524 - protein, 21 aa, Mycobacterium
GLPGVFVVDMERILREPTARA

SEQ ID NO: 1266525 - protein, 19 aa, Mycobacterium
GLPIIGHMIEIFRGGPDFI

SEQ ID NO: 1266526 - protein, 22 aa, Mycobacterium
GLPLDVGYRLTVNNAVRLSHNG

SEQ ID NO: 1266527 - protein, 19 aa, Mycobacterium
GLPPLRCGLPRLPQGINPV

SEQ ID NO: 1266528 - protein, 23 aa, Mycobacterium
GLPPSSSPLGWLRNSALTTLTHR

SEQ ID NO: 1266529 - protein, 26 aa, Mycobacterium
GLPQEFLESLTLRTNITFQERYIAAG

SEQ ID NO: 1266530 - protein, 22 aa, Mycobacterium
GLPTAVGMALAFKKQGSDRVAI

SEQ ID NO: 1266531 - protein, 25 aa, Mycobacterium
GLPTEAAELQWLLAGAKTLSYAVNM

SEQ ID NO: 1266532 - protein, 20 aa, Mycobacterium
GLPVGSALLVVKRGPNAGSR

SEQ ID NO: 1266533 - protein, 23 aa, Mycobacterium
GLQLALTELWRSYGVTPDAVIGH

SEQ ID NO: 1266534 - protein, 22 aa, Mycobacterium
GLQRAVADHHQLASNFASPFSP

SEQ ID NO: 1266535 - protein, 23 aa, Mycobacterium
GLQRPDTGLTFVVRGRDGALIGS

SEQ ID NO: 1266536 - protein, 24 aa, Mycobacterium
GLQSYEIPRDFLLETTPFTLENGL

SEQ ID NO: 1266537 - protein, 18 aa, Mycobacterium
GLQVTRKLDKMGWRSSDT

SEQ ID NO: 1266538 - protein, 19 aa, Mycobacterium
GLRAARLLLAAAHTEDGGL

SEQ ID NO: 1266539 - protein, 21 aa, Mycobacterium
GLRANELVKQFGAAVNGRGGG

SEQ ID NO: 1266540 - protein, 25 aa, Mycobacterium
GLRAVGRGVLRPDLTVFDGDTAVGV

SEQ ID NO: 1266541 - protein, 23 aa, Mycobacterium
GLRCRRRVRIAGFFDRVAVDAAR

SEQ ID NO: 1266542 - protein, 22 aa, Mycobacterium
GLRDHWLLRSCEPEEVAAGVVA

SEQ ID NO: 1266543 - protein, 19 aa, Mycobacterium
GLRELRLHNGTVWRWNRPV

SEQ ID NO: 1266544 - protein, 19 aa, Mycobacterium
GLRGGRPGTGESIYQAVDF

SEQ ID NO: 1266545 - protein, 26 aa, Mycobacterium
GLRGLTLPVLRSWLAAQATAGAARST

SEQ ID NO: 1266546 - protein, 18 aa, Mycobacterium
GLRGRAAIYNELLRAITD

SEQ ID NO: 1266547 - protein, 21 aa, Mycobacterium
GLRTLWRMDLTRDKRLRRLPN

SEQ ID NO: 1266548 - protein, 24 aa, Mycobacterium
GLRTRLFAAPGWNVSQGALTALPR

SEQ ID NO: 1266549 - protein, 17 aa, Mycobacterium
GLRVFAGAVTRNGIDAQ

SEQ ID NO: 1266550 - protein, 23 aa, Mycobacterium
GLRVGRSAAMAVGMLGILKAGGV

SEQ ID NO: 1266551 - protein, 27 aa, Mycobacterium
GLRVHARTGLPCPVCGDTVREVSFADK

SEQ ID NO: 1266552 - protein, 25 aa, Mycobacterium
GLRYAADAMSWFGLFADAEDAEFTP

SEQ ID NO: 1266553 - protein, 21 aa, Mycobacterium
GLRYKEIALILDIPVGTVMSR

SEQ ID NO: 1266554 - protein, 18 aa, Mycobacterium
GLSEALADRASRIRDLGL

SEQ ID NO: 1266555 - protein, 37 aa, Mycobacterium
GLSEALRGFPPVPSRWIDPASVPGWLVPESFPGPVGS

SEQ ID NO: 1266556 - protein, 17 aa, Mycobacterium
GLSEGLPGLAENLTKFI

SEQ ID NO: 1266557 - protein, 19 aa, Mycobacterium
GLSIPVVAAVAVFTDVVSA

SEQ ID NO: 1266558 - protein, 24 aa, Mycobacterium
GLSPEIMGLGPIEAVKKALANAKM

SEQ ID NO: 1266559 - protein, 22 aa, Mycobacterium
GLSSDAKWVPAWESGLARAKDA

SEQ ID NO: 1266560 - protein, 17 aa, Mycobacterium
GLSSRAFYRHFLSKDDL

SEQ ID NO: 1266561 - protein, 18 aa, Mycobacterium
GLSTKPWVKTNMAPGSQV

SEQ ID NO: 1266562 - protein, 18 aa, Mycobacterium
GLSWGHDRIFAVTTNHSV

SEQ ID NO: 1266563 - protein, 18 aa, Mycobacterium
GLSYFAEFRSQSCIAAVA

SEQ ID NO: 1266564 - protein, 17 aa, Mycobacterium
GLTAAQRARARQAALDA

SEQ ID NO: 1266565 - protein, 26 aa, Mycobacterium
GLTARTELMASFGIPADIGAAIAEHQ

SEQ ID NO: 1266566 - protein, 25 aa, Mycobacterium
GLTELCGVISHLLPEAHRDPGREER

SEQ ID NO: 1266567 - protein, 27 aa, Mycobacterium
GLTIWPTGFHPAAWRVPGAFSNGNSNP

SEQ ID NO: 1266568 - protein, 18 aa, Mycobacterium
GLTKSFGAQRIWEDVTFD

SEQ ID NO: 1266569 - protein, 17 aa, Mycobacterium
GLTLIGFAVCNIDREGA

SEQ ID NO: 1266570 - protein, 21 aa, Mycobacterium
GLTLPMTLTLPGTVNRGNATQ

SEQ ID NO: 1266571 - protein, 21 aa, Mycobacterium
GLTRAGMRGVVAYGAEDLPLL

SEQ ID NO: 1266572 - protein, 23 aa, Mycobacterium
GLTWATTEPLGYNKSYTLTAKSM

SEQ ID NO: 1266573 - protein, 19 aa, Mycobacterium
GLTYPGIGFVVWRNAEHLP

SEQ ID NO: 1266574 - protein, 23 aa, Mycobacterium
GLVAADGGPLVWGSQISLLQAKE

SEQ ID NO: 1266575 - protein, 23 aa, Mycobacterium
GLVADIPFGALVGTLSGGQRRRV

SEQ ID NO: 1266576 - protein, 22 aa, Mycobacterium
GLVAGALRLTADYVATREQFGR

SEQ ID NO: 1266577 - protein, 26 aa, Mycobacterium
GLVAGYRPELDLAQAGIATQAFIGLE

SEQ ID NO: 1266578 - protein, 17 aa, Mycobacterium
GLVCALEPIGLMRRVGL

SEQ ID NO: 1266579 - protein, 24 aa, Mycobacterium
GLVEGRRLAPVVGLPGADRGTQRI

SEQ ID NO: 1266580 - protein, 17 aa, Mycobacterium
GLVFAAHSSVAWNSARR

SEQ ID NO: 1266581 - protein, 27 aa, Mycobacterium
GLVGQLCAQFARLAGARVIVLDFNTER

SEQ ID NO: 1266582 - protein, 19 aa, Mycobacterium
GLVHACAAARTPLLGVCLG

SEQ ID NO: 1266583 - protein, 18 aa, Mycobacterium
GLVIGAWPAQPGVAEIDN

SEQ ID NO: 1266584 - protein, 33 aa, Mycobacterium
GLVMARAGGMLSRLRPLFSLGLGARLGNGRQYL

SEQ ID NO: 1266585 - protein, 24 aa, Mycobacterium
GLVMDLLFRVCIEEKLTVVCTLHQ

SEQ ID NO: 1266586 - protein, 23 aa, Mycobacterium
GLVNDRAVSVSAWGMSPGREITC

SEQ ID NO: 1266587 - protein, 26 aa, Mycobacterium
GLVNEIRINWVWNPPWGPDKITDDGR

SEQ ID NO: 1266588 - protein, 25 aa, Mycobacterium
GLVPASVVIRGDLAYIANFGGNSLS

SEQ ID NO: 1266589 - protein, 18 aa, Mycobacterium
GLVPKLTGLGGRFTPRAL

SEQ ID NO: 1266590 - protein, 18 aa, Mycobacterium
GLVPVPEIQFDGFAAPAF

SEQ ID NO: 1266591 - protein, 19 aa, Mycobacterium
GLVSISVDSARYWLNNDRP

SEQ ID NO: 1266592 - protein, 26 aa, Mycobacterium
GLVTDWKVGSTFDWRDGDLNISNPEQ

SEQ ID NO: 1266593 - protein, 18 aa, Mycobacterium
GLVVKCWMFVMRLSHSGK

SEQ ID NO: 1266594 - protein, 18 aa, Mycobacterium
GLVYAVVDHSEWTAARSE

SEQ ID NO: 1266595 - protein, 17 aa, Mycobacterium
GLYDMAGNVWEWTTDWY

SEQ ID NO: 1266596 - protein, 33 aa, Mycobacterium
GLYEAKTTFGRIGVKVWIYKGDIVGGKRELTAA

SEQ ID NO: 1266597 - protein, 17 aa, Mycobacterium
GLYPRLGAASNVAERLL

SEQ ID NO: 1266598 - protein, 19 aa, Mycobacterium
GMAATDCVLRAVLRPGDHL

SEQ ID NO: 1266599 - protein, 18 aa, Mycobacterium
GMAAVAAIKVAEREGPDA

SEQ ID NO: 1266600 - protein, 19 aa, Mycobacterium
GMAEARNKIRPDWDHEVLD

SEQ ID NO: 1266601 - protein, 22 aa, Mycobacterium
GMAHRLGMKPNWVIDLHNGGCA

SEQ ID NO: 1266602 - protein, 17 aa, Mycobacterium
GMARELFDTEPVFRDTV

SEQ ID NO: 1266603 - protein, 20 aa, Mycobacterium
GMCHGAWCFDEVAASLRSAG

SEQ ID NO: 1266604 - protein, 19 aa, Mycobacterium
GMCRTDFQLIDGYFDNGLS

SEQ ID NO: 1266605 - protein, 19 aa, Mycobacterium
GMEIQWLLDPSIPLTEVYQ

SEQ ID NO: 1266606 - protein, 29 aa, Mycobacterium
GMEYCPPELPGLEPLWGKSVFQCPFCHGW

SEQ ID NO: 1266607 - protein, 18 aa, Mycobacterium
GMGELHLDILVDRMRREF

SEQ ID NO: 1266608 - protein, 17 aa, Mycobacterium
GMGRELFDTEPVYREVM

SEQ ID NO: 1266609 - protein, 19 aa, Mycobacterium
GMIELLMLRAERFGVRLAV

SEQ ID NO: 1266610 - protein, 22 aa, Mycobacterium
GMKAWREAGRPVIRDDGSAGTV

SEQ ID NO: 1266611 - protein, 25 aa, Mycobacterium
GMKDRPALHMVQRARARGELRPDAR

SEQ ID NO: 1266612 - protein, 20 aa, Mycobacterium
GMKPRTVIDLHNGGCAAFIL

SEQ ID NO: 1266613 - protein, 26 aa, Mycobacterium
GMLDAQRFRAARVVIDIGVHCGLVAP

SEQ ID NO: 1266614 - protein, 17 aa, Mycobacterium
GMLKYGFDDARPVLERA

SEQ ID NO: 1266615 - protein, 20 aa, Mycobacterium
GMLSAAWGVGVRQLAAGLGV

SEQ ID NO: 1266616 - protein, 28 aa, Mycobacterium
GMLTCSIRPSGIWGRGDQTMFRKVFESV

SEQ ID NO: 1266617 - protein, 25 aa, Mycobacterium
GMNLAVVLRATWAVARVLTDRGLGG

SEQ ID NO: 1266618 - protein, 24 aa, Mycobacterium
GMPAMRAVSCSIALTENFPYNGSL

SEQ ID NO: 1266619 - protein, 19 aa, Mycobacterium
GMPHCPVCGERIARQTPQQ

SEQ ID NO: 1266620 - protein, 18 aa, Mycobacterium
GMPHLRSGVRGDLHAHID

SEQ ID NO: 1266621 - protein, 22 aa, Mycobacterium
GMPKGVLWRQHDIFMTSFGGRS

SEQ ID NO: 1266622 - protein, 18 aa, Mycobacterium
GMPKVLGGDGDWLRRSVA

SEQ ID NO: 1266623 - protein, 27 aa, Mycobacterium
GMPYVNQRWLGGMLTNFSTVHKRLQRL

SEQ ID NO: 1266624 - protein, 20 aa, Mycobacterium
GMQTAFPLMKARGGGRIINF

SEQ ID NO: 1266625 - protein, 25 aa, Mycobacterium
GMRDLRRFMSGPAYARRLTAQALDA

SEQ ID NO: 1266626 - protein, 23 aa, Mycobacterium
GMRNLCDLGAMLLQGTAVSDNTH

SEQ ID NO: 1266627 - protein, 23 aa, Mycobacterium
GMSCAGCANSVRAELTHIPGVRE

SEQ ID NO: 1266628 - protein, 30 aa, Mycobacterium
GMSGARITLHAALELARRGGKYAVAALCGA

SEQ ID NO: 1266629 - protein, 21 aa, Mycobacterium
GMSLRSPARFLAPAERLVAEW

SEQ ID NO: 1266630 - protein, 18 aa, Mycobacterium
GMTNGLPVRVRAAMKPIS

SEQ ID NO: 1266631 - protein, 32 aa, Mycobacterium
GMVSGGFSVRGDWFCRLEIKDPVKMIGVVCGR

SEQ ID NO: 1266632 - protein, 23 aa, Mycobacterium
GNAALVLSFLGQFFVEDNRGACS

SEQ ID NO: 1266633 - protein, 19 aa, Mycobacterium
GNAGGRGKDAAAGTNQSGG

SEQ ID NO: 1266634 - protein, 25 aa, Mycobacterium
GNALARLEGKIALEEILKRFPTWEV

SEQ ID NO: 1266635 - protein, 21 aa, Mycobacterium
GNALFDFFAQLVAGFSPPGNT

SEQ ID NO: 1266636 - protein, 20 aa, Mycobacterium
GNALKLARRTICVDESVLRM

SEQ ID NO: 1266637 - protein, 18 aa, Mycobacterium
GNAMLAFAQVYRAAGTTP

SEQ ID NO: 1266638 - protein, 18 aa, Mycobacterium
GNATRFYEGASWHAGGRY

SEQ ID NO: 1266639 - protein, 21 aa, Mycobacterium
GNAVGGGWFGYLSYPDPGADG

SEQ ID NO: 1266640 - protein, 21 aa, Mycobacterium
GNCGVGFAPCRPADHDVLVDV

SEQ ID NO: 1266641 - protein, 25 aa, Mycobacterium
GNDHYRLSVDLARGGGVSSLVAGGR

SEQ ID NO: 1266642 - protein, 31 aa, Mycobacterium
GNDIRVNPGIGFPGWANYFPVTRAVPEPPSI

SEQ ID NO: 1266643 - protein, 18 aa, Mycobacterium
GNDPPAAMRYCLTGDSMV

SEQ ID NO: 1266644 - protein, 23 aa, Mycobacterium
GNDRCALGILDVFTRAGVDVPAQ

SEQ ID NO: 1266645 - protein, 28 aa, Mycobacterium
GNEEQRHWAALMIERNWGATMVLTEPDA

SEQ ID NO: 1266646 - protein, 19 aa, Mycobacterium
GNFASGYRGKTWTFRQYSG

SEQ ID NO: 1266647 - protein, 22 aa, Mycobacterium
GNFCAGMDLKAFMAGEVPAIEG

SEQ ID NO: 1266648 - protein, 19 aa, Mycobacterium
GNFPSWTLHVQIMPFEDAK

SEQ ID NO: 1266649 - protein, 17 aa, Mycobacterium
GNFSRAVMTRWIEQPVY

SEQ ID NO: 1266650 - protein, 17 aa, Mycobacterium
GNGAWQYIADDGFVAKV

SEQ ID NO: 1266651 - protein, 22 aa, Mycobacterium
GNGDCVAFFWFADAPDRVPGIS

SEQ ID NO: 1266652 - protein, 17 aa, Mycobacterium
GNGDGWGFWFLGRWIRL

SEQ ID NO: 1266653 - protein, 23 aa, Mycobacterium
GNGDTRPGVLYTTISTAYDEVAT

SEQ ID NO: 1266654 - protein, 26 aa, Mycobacterium
GNGDVRWFEVEPCYVFHPMNAFDDGD

SEQ ID NO: 1266655 - protein, 21 aa, Mycobacterium
GNGGMPGRITVQYKFTQPGEG

SEQ ID NO: 1266656 - protein, 32 aa, Mycobacterium
GNGGRGGDAYAISTAVAGWGGHAHGIGNGGAG

SEQ ID NO: 1266657 - protein, 18 aa, Mycobacterium
GNGPDGQVYAGRGGDGGD

SEQ ID NO: 1266658 - protein, 20 aa, Mycobacterium
GNGTARPSVVAVWKNGGQIG

SEQ ID NO: 1266659 - protein, 24 aa, Mycobacterium
GNHILRLRVHRILADGYTMRLLLS

SEQ ID NO: 1266660 - protein, 22 aa, Mycobacterium
GNHLGPTLSMRGIDNAAYYRLV

SEQ ID NO: 1266661 - protein, 17 aa, Mycobacterium
GNIRRIRATQRNHVAEY

SEQ ID NO: 1266662 - protein, 24 aa, Mycobacterium
GNKRTAWAAAWTFLHINGIQLADD

SEQ ID NO: 1266663 - protein, 25 aa, Mycobacterium
GNLDIPVYLGCDWENVPLHLPSTFT

SEQ ID NO: 1266664 - protein, 23 aa, Mycobacterium
GNLDRAGGMLFAVRSFPSRTWGR

SEQ ID NO: 1266665 - protein, 20 aa, Mycobacterium
GNLFPLFARLRLDRAKLEYE

SEQ ID NO: 1266666 - protein, 27 aa, Mycobacterium
GNLKGIRKWVWERLAGTLFAQKATDAL

SEQ ID NO: 1266667 - protein, 34 aa, Mycobacterium
GNLMQRTRCPYFMDPRFERCNKRYPGSGCAARDG

SEQ ID NO: 1266668 - protein, 29 aa, Mycobacterium
GNMADPGSVAYLFTRKGVITLEKNDLTED

SEQ ID NO: 1266669 - protein, 18 aa, Mycobacterium
GNNDPCFELGNIWSECGL

SEQ ID NO: 1266670 - protein, 19 aa, Mycobacterium
GNPEIDFVVVREGTEGPYT

SEQ ID NO: 1266671 - protein, 25 aa, Mycobacterium
GNPRVKFMHCLPAFHNCETKVGAQI

SEQ ID NO: 1266672 - protein, 26 aa, Mycobacterium
GNPTDLGNRAWGMTFGPKGDTLYVRR

SEQ ID NO: 1266673 - protein, 21 aa, Mycobacterium
GNPTMRVLRTGLAARIDEHPA

SEQ ID NO: 1266674 - protein, 23 aa, Mycobacterium
GNPVILPTVWDAWSAKLATDAGF

SEQ ID NO: 1266675 - protein, 25 aa, Mycobacterium
GNQLARLELRLMLTKILQRLPDLRL

SEQ ID NO: 1266676 - protein, 19 aa, Mycobacterium
GNRIFTWHLAIAMRPKLWM

SEQ ID NO: 1266677 - protein, 29 aa, Mycobacterium
GNRSPRYARFGWAAARFDDLLNLAPARLT

SEQ ID NO: 1266678 - protein, 22 aa, Mycobacterium
GNSFGAFVPKGITLRVYGDAND

SEQ ID NO: 1266679 - protein, 18 aa, Mycobacterium
GNSLPLQEGMAFSVEPGI

SEQ ID NO: 1266680 - protein, 26 aa, Mycobacterium
GNSLYATVNCWGRLVTGVGAGLGKGD

SEQ ID NO: 1266681 - protein, 24 aa, Mycobacterium
GNSVPRFHVAWGTGTGVVGPFADS

SEQ ID NO: 1266682 - protein, 26 aa, Mycobacterium
GNTWECLAHIYLRRVLAATETWPAKL

SEQ ID NO: 1266683 - protein, 21 aa, Mycobacterium
GNVFPNLSFLNAFIAKDGESM

SEQ ID NO: 1266684 - protein, 17 aa, Mycobacterium
GNVHIFAGYEFRTGYAR

SEQ ID NO: 1266685 - protein, 18 aa, Mycobacterium
GNVLEITPPLVLTESQAA

SEQ ID NO: 1266686 - protein, 18 aa, Mycobacterium
GNVLLRLCEDTELRQKFI

SEQ ID NO: 1266687 - protein, 27 aa, Mycobacterium
GNVMPPRGVGVIELRGECVTPGYMTMG

SEQ ID NO: 1266688 - protein, 19 aa, Mycobacterium
GNVVVCGRVKDVIIMAGRN

SEQ ID NO: 1266689 - protein, 18 aa, Mycobacterium
GNVWEWTTDWYGDRRDYQ

SEQ ID NO: 1266690 - protein, 20 aa, Mycobacterium
GNYPPAGFPLGPRVVTRPPA

SEQ ID NO: 1266691 - protein, 18 aa, Mycobacterium
GPAAIFLARYDDRLRRAQ

SEQ ID NO: 1266692 - protein, 22 aa, Mycobacterium
GPADLAKVYAFLASDDSRGING

SEQ ID NO: 1266693 - protein, 27 aa, Mycobacterium
GPAERYRRWLAVLRGDARFVIGTRSAV

SEQ ID NO: 1266694 - protein, 18 aa, Mycobacterium
GPAILYRLHLDLASLSIA

SEQ ID NO: 1266695 - protein, 17 aa, Mycobacterium
GPALLLGARGRRLDPRQ

SEQ ID NO: 1266696 - protein, 23 aa, Mycobacterium
GPALMVSDLFDFSVYVDARIEDI

SEQ ID NO: 1266697 - protein, 24 aa, Mycobacterium
GPALRRPCGRIHWAGTESSALMYG

SEQ ID NO: 1266698 - protein, 22 aa, Mycobacterium
GPAPDRFLVGLAVLSLMSAAAR

SEQ ID NO: 1266699 - protein, 19 aa, Mycobacterium
GPAPFPVMTTIAMATTTLR

SEQ ID NO: 1266700 - protein, 18 aa, Mycobacterium
GPAPLLLYGYGAYEACED

SEQ ID NO: 1266701 - protein, 17 aa, Mycobacterium
GPAPLSFGHGPHYCLGA

SEQ ID NO: 1266702 - protein, 21 aa, Mycobacterium
GPAPTAGPVTFDFGDQIQDLC

SEQ ID NO: 1266703 - protein, 20 aa, Mycobacterium
GPAQALGRFDVCTPPKTIDE

SEQ ID NO: 1266704 - protein, 23 aa, Mycobacterium
GPARAPFGSRVRVERSSLTVGEG

SEQ ID NO: 1266705 - protein, 22 aa, Mycobacterium
GPARARYLMLRLLERSREKRVA

SEQ ID NO: 1266706 - protein, 20 aa, Mycobacterium
GPASFRWPHAIAGTSELLLV

SEQ ID NO: 1266707 - protein, 23 aa, Mycobacterium
GPATAAALVAPVWERLLAEQPSL

SEQ ID NO: 1266708 - protein, 19 aa, Mycobacterium
GPATLSARFLVNAGGVLTV

SEQ ID NO: 1266709 - protein, 20 aa, Mycobacterium
GPATRWSRRLGELTRTTARD

SEQ ID NO: 1266710 - protein, 19 aa, Mycobacterium
GPAWPRLETDTHLMCVGSG

SEQ ID NO: 1266711 - protein, 26 aa, Mycobacterium
GPDEVLRIAPNVWPRNAVRGADGVVS

SEQ ID NO: 1266712 - protein, 17 aa, Mycobacterium
GPDGASHNGMWDLSILG

SEQ ID NO: 1266713 - protein, 20 aa, Mycobacterium
GPDGIALCRNLRKGGDYSVP

SEQ ID NO: 1266714 - protein, 29 aa, Mycobacterium
GPDGRDCPDWVPGELWVGGRGVARGYCAR

SEQ ID NO: 1266715 - protein, 18 aa, Mycobacterium
GPDGVVFTERIDVGRTGA

SEQ ID NO: 1266716 - protein, 19 aa, Mycobacterium
GPDHYRWTLHAGPVETTWE

SEQ ID NO: 1266717 - protein, 23 aa, Mycobacterium
GPDLARCIIRIESRRYPEPVPAA

SEQ ID NO: 1266718 - protein, 18 aa, Mycobacterium
GPDLERFVRDAASSYWHQ

SEQ ID NO: 1266719 - protein, 17 aa, Mycobacterium
GPDLSAMLEPIFGADGL

SEQ ID NO: 1266720 - protein, 20 aa, Mycobacterium
GPDSLEWTAKYGSVVATAYD

SEQ ID NO: 1266721 - protein, 22 aa, Mycobacterium
GPDVVHCHGWVYGMAAQLAARR

SEQ ID NO: 1266722 - protein, 17 aa, Mycobacterium
GPEAFARWMRESKSVGV

SEQ ID NO: 1266723 - protein, 24 aa, Mycobacterium
GPEARLKFAGIHVHPQVIAENAVD

SEQ ID NO: 1266724 - protein, 18 aa, Mycobacterium
GPEFDTVVLGLTLALFRT

SEQ ID NO: 1266725 - protein, 18 aa, Mycobacterium
GPEKPVRIWNRIGRRPVL

SEQ ID NO: 1266726 - protein, 21 aa, Mycobacterium
GPESLLFPAARGGHMNDRVFS

SEQ ID NO: 1266727 - protein, 21 aa, Mycobacterium
GPEVLSYEMARAVLRDTRFTI

SEQ ID NO: 1266728 - protein, 20 aa, Mycobacterium
GPEYSEFLDLCRDFEQLHLD

SEQ ID NO: 1266729 - protein, 23 aa, Mycobacterium
GPFAGRLLGDMGAEVIKIEPPGA

SEQ ID NO: 1266730 - protein, 22 aa, Mycobacterium
GPFAGRLLGDMGAEVLKIEPPG

SEQ ID NO: 1266731 - protein, 18 aa, Mycobacterium
GPFHFLDPKLGYANDPAW

SEQ ID NO: 1266732 - protein, 17 aa, Mycobacterium
GPFKAVADKLVAILEGF

SEQ ID NO: 1266733 - protein, 21 aa, Mycobacterium
GPFLTDISDAWTFTDGDTNPF

SEQ ID NO: 1266734 - protein, 24 aa, Mycobacterium
GPFSSLCWGERIAFDNPESLTLLG

SEQ ID NO: 1266735 - protein, 19 aa, Mycobacterium
GPFTEAGARTWRVVPGSAP

SEQ ID NO: 1266736 - protein, 24 aa, Mycobacterium
GPGAPDYPSLEAWTLATALLARTE

SEQ ID NO: 1266737 - protein, 17 aa, Mycobacterium
GPGEIGGLVALNPGRAS

SEQ ID NO: 1266738 - protein, 21 aa, Mycobacterium
GPGFEVSRDLPKLGYKGVESC

SEQ ID NO: 1266739 - protein, 21 aa, Mycobacterium
GPGGRVPVRIYRPANDGGPCP

SEQ ID NO: 1266740 - protein, 25 aa, Mycobacterium
GPGKGNAMGPAFWAELPVVFHELDA

SEQ ID NO: 1266741 - protein, 24 aa, Mycobacterium
GPGLGEWDLRALVGHTSRSLITVS

SEQ ID NO: 1266742 - protein, 21 aa, Mycobacterium
GPGMGHGMMGPGMGHGTMGPG

SEQ ID NO: 1266743 - protein, 18 aa, Mycobacterium
GPGQLSWNYNYRAAGDAL

SEQ ID NO: 1266744 - protein, 17 aa, Mycobacterium
GPGQLWEAAAGTLAHNG

SEQ ID NO: 1266745 - protein, 18 aa, Mycobacterium
GPGRLVADLVRRGVPALG

SEQ ID NO: 1266746 - protein, 19 aa, Mycobacterium
GPGSFYRPTLIADVSEQSE

SEQ ID NO: 1266747 - protein, 24 aa, Mycobacterium
GPGVQRLRIAVCTQSILHEASPEV

SEQ ID NO: 1266748 - protein, 18 aa, Mycobacterium
GPGWGHRGSKHYRKQGFG

SEQ ID NO: 1266749 - protein, 18 aa, Mycobacterium
GPHFPLSGLVSAGLPDYS

SEQ ID NO: 1266750 - protein, 25 aa, Mycobacterium
GPHGPRAATISQFFSPPAADPDRDN

SEQ ID NO: 1266751 - protein, 31 aa, Mycobacterium
GPHPFPLMVRDFQRIIGLEARAQIQAQAGRL

SEQ ID NO: 1266752 - protein, 17 aa, Mycobacterium
GPHPFPMMVRDFQRVIG

SEQ ID NO: 1266753 - protein, 19 aa, Mycobacterium
GPIALARLIPAGVDVRGDS

SEQ ID NO: 1266754 - protein, 29 aa, Mycobacterium
GPIERYRIDGASMPTEWATGQLATRAAFI

SEQ ID NO: 1266755 - protein, 32 aa, Mycobacterium
GPILSGARRWCPMRRWIDIGAFDDGAPTRLPG

SEQ ID NO: 1266756 - protein, 29 aa, Mycobacterium
GPILSGARRWCPPRRWVDIGVFDDHTPAQ

SEQ ID NO: 1266757 - protein, 23 aa, Mycobacterium
GPINDLSEAFAFARGLGIDAAVQ

SEQ ID NO: 1266758 - protein, 25 aa, Mycobacterium
GPITLCAKGTPAMQWMMISAERTGI

SEQ ID NO: 1266759 - protein, 25 aa, Mycobacterium
GPKAPALAEVMPWNQLPGPVRRVTQ

SEQ ID NO: 1266760 - protein, 17 aa, Mycobacterium
GPKARYITGTALPVDAG

SEQ ID NO: 1266761 - protein, 24 aa, Mycobacterium
GPKRIWTCDLGPLVAGTEQSAFTR

SEQ ID NO: 1266762 - protein, 17 aa, Mycobacterium
GPKTVRSAAAWADGLAG

SEQ ID NO: 1266763 - protein, 18 aa, Mycobacterium
GPLARAALDNALRRGQAA

SEQ ID NO: 1266764 - protein, 25 aa, Mycobacterium
GPLERFNGVLSWLDRRGFGRMTPRR

SEQ ID NO: 1266765 - protein, 18 aa, Mycobacterium
GPLFERGYHDVRLTPLGQ

SEQ ID NO: 1266766 - protein, 24 aa, Mycobacterium
GPLHPVSIVLAGLVEAPGGHEQTI

SEQ ID NO: 1266767 - protein, 24 aa, Mycobacterium
GPLIEAMGLTIGWITADSTAAERR

SEQ ID NO: 1266768 - protein, 24 aa, Mycobacterium
GPLMRRSGVIFLRRKLDDPLYKFV

SEQ ID NO: 1266769 - protein, 32 aa, Mycobacterium; identical to SEQ ID NO: 669632

SEQ ID NO: 1266770 - protein, 27 aa, Mycobacterium
GPLPRQARLADFRLPQRGICVVGQGLF

SEQ ID NO: 1266771 - protein, 17 aa, Mycobacterium
GPLRLIRGLAPGMLERG

SEQ ID NO: 1266772 - protein, 17 aa, Mycobacterium
GPLRPHIACPTTSGTGS

SEQ ID NO: 1266773 - protein, 19 aa, Mycobacterium
GPLVRSSYRAGKLYAQTIA

SEQ ID NO: 1266774 - protein, 17 aa, Mycobacterium
GPMGMLGQRGKSGGNKP

SEQ ID NO: 1266775 - protein, 19 aa, Mycobacterium
GPMMPGMGGMPGMGGMAGM

SEQ ID NO: 1266776 - protein, 21 aa, Mycobacterium
GPNAPVTQDFLYPSISNGCLS

SEQ ID NO: 1266777 - protein, 32 aa, Mycobacterium
GPNQLRAFLWWLLRLRPDLEIYLLKSNLGLIP

SEQ ID NO: 1266778 - protein, 18 aa, Mycobacterium
GPPDAALRRNRIDRLMAL

SEQ ID NO: 1266779 - protein, 25 aa, Mycobacterium
GPPEHLEWIGQWGIFDALRAGPDVV

SEQ ID NO: 1266780 - protein, 18 aa, Mycobacterium
GPPLYSPFKVLDPIANVA

SEQ ID NO: 1266781 - protein, 17 aa, Mycobacterium
GPPMDFSRFDGLAGNRF

SEQ ID NO: 1266782 - protein, 19 aa, Mycobacterium
GPPSARPPGNYWIVDLDPD

SEQ ID NO: 1266783 - protein, 26 aa, Mycobacterium
GPQAARAALLFGMRFDAESAVRHGLA

SEQ ID NO: 1266784 - protein, 18 aa, Mycobacterium
GPQFPFTEAVSFTVACRD

SEQ ID NO: 1266785 - protein, 24 aa, Mycobacterium
GPQQLRISVAVGIHRQNPTTNQLH

SEQ ID NO: 1266786 - protein, 27 aa, Mycobacterium
GPQSLVWKYFGDNRMYLIGPRPAVLQN

SEQ ID NO: 1266787 - protein, 17 aa, Mycobacterium
GPQSPLLEEFIGIVRGR

SEQ ID NO: 1266788 - protein, 18 aa, Mycobacterium
GPQSPLLEEFIGIVRGRK

SEQ ID NO: 1266789 - protein, 18 aa, Mycobacterium
GPRASARPARFAYPPNLF

SEQ ID NO: 1266790 - protein, 22 aa, Mycobacterium
GPRATFELMQAVYPVFVGNGGG

SEQ ID NO: 1266791 - protein, 21 aa, Mycobacterium
GPRFCGHPDLAYALIPSTSPV

SEQ ID NO: 1266792 - protein, 24 aa, Mycobacterium
GPRGCGKTSSARILARSLNCAEGP

SEQ ID NO: 1266793 - protein, 24 aa, Mycobacterium
GPRGCGKTSSARILARSLNCEQGP

SEQ ID NO: 1266794 - protein, 22 aa, Mycobacterium
GPRKVSPLAVQMIMPNGAAAVA

SEQ ID NO: 1266795 - protein, 17 aa, Mycobacterium
GPRRRLVSFRVDSPEPM

SEQ ID NO: 1266796 - protein, 19 aa, Mycobacterium
GPRVKRTLTASGLRQLINF

SEQ ID NO: 1266797 - protein, 24 aa, Mycobacterium
GPRVKRTLTATGLRQLIAFISRMT

SEQ ID NO: 1266798 - protein, 18 aa, Mycobacterium
GPSALAEFERAGADIVLL

SEQ ID NO: 1266799 - protein, 17 aa, Mycobacterium
GPSARIKSIGLRLGVPW

SEQ ID NO: 1266800 - protein, 23 aa, Mycobacterium
GPSDAILAGGTWLFSEPQPQVSR

SEQ ID NO: 1266801 - protein, 17 aa, Mycobacterium
GPSMLGDIVLCPEFAAK

SEQ ID NO: 1266802 - protein, 20 aa, Mycobacterium
GPSRRTGELDNRGSQFYLAM

SEQ ID NO: 1266803 - protein, 19 aa, Mycobacterium
GPSSMWFDALGRRLPAPYL

SEQ ID NO: 1266804 - protein, 23 aa, Mycobacterium
GPSSRELLCELIWSPPGQPALRD

SEQ ID NO: 1266805 - protein, 25 aa, Mycobacterium
GPSTGTNIWGAFGLLAEMAAQGCSG

SEQ ID NO: 1266806 - protein, 17 aa, Mycobacterium
GPTAIAFINGEPVDAAK

SEQ ID NO: 1266807 - protein, 22 aa, Mycobacterium
GPTALLAPKWVPWDERIRPGDL

SEQ ID NO: 1266808 - protein, 21 aa, Mycobacterium
GPTGCGKTYLAQTLAKMLNVP

SEQ ID NO: 1266809 - protein, 20 aa, Mycobacterium
GPTGDLFKRTGFIPASHENA

SEQ ID NO: 1266810 - protein, 24 aa, Mycobacterium
GPTGRVGVIVPRVDAWFYSTILAG

SEQ ID NO: 1266811 - protein, 19 aa, Mycobacterium
GPTMLLPHSQRFTGGYVAF

SEQ ID NO: 1266812 - protein, 18 aa, Mycobacterium
GPTRGWGVFAHGFTLGKD

SEQ ID NO: 1266813 - protein, 20 aa, Mycobacterium
GPTRRGEVLTDVRLLGPRIA

SEQ ID NO: 1266814 - protein, 18 aa, Mycobacterium
GPTTLTAIVDTGSGSIMS

SEQ ID NO: 1266815 - protein, 17 aa, Mycobacterium
GPVAHSLLNEVARRIVA

SEQ ID NO: 1266816 - protein, 18 aa, Mycobacterium
GPVAHSLLNEVARRIVAA

SEQ ID NO: 1266817 - protein, 19 aa, Mycobacterium
GPVGGGWFGYLSYPDGGAD

SEQ ID NO: 1266818 - protein, 18 aa, Mycobacterium
GPVGGQTWYKPFTPAPVT

SEQ ID NO: 1266819 - protein, 24 aa, Mycobacterium
GPVIGCTLPELFDNARVGDRIYFD

SEQ ID NO: 1266820 - protein, 24 aa, Mycobacterium
GPVKRAGGISGWELTPSVDGHFDR

SEQ ID NO: 1266821 - protein, 17 aa, Mycobacterium
GPVPGWLVVEETAAAGA

SEQ ID NO: 1266822 - protein, 20 aa, Mycobacterium
GPVRHDHVLGIGGASVSLAH

SEQ ID NO: 1266823 - protein, 24 aa, Mycobacterium
GPVRLQFWVCGVFEVHAGRITLWR

SEQ ID NO: 1266824 - protein, 19 aa, Mycobacterium
GPVRRLAHALPLLKPPFPD

SEQ ID NO: 1266825 - protein, 19 aa, Mycobacterium
GPVRVRFLGVNQRHHSLAL

SEQ ID NO: 1266826 - protein, 18 aa, Mycobacterium
GPVTFDFGDQIQDLCAWS

SEQ ID NO: 1266827 - protein, 25 aa, Mycobacterium
GPVTRLKLAPKWLMPPMVVATSPQG

SEQ ID NO: 1266828 - protein, 26 aa, Mycobacterium
GPVTWSVELDERWVIIGPNGAGKTSL

SEQ ID NO: 1266829 - protein, 19 aa, Mycobacterium
GPVWPSNPWTTAYRQERAD

SEQ ID NO: 1266830 - protein, 24 aa, Mycobacterium
GPWLADRLLELGVELGHITLCGDR

SEQ ID NO: 1266831 - protein, 18 aa, Mycobacterium
GPWREKIAAATMLGQSKT

SEQ ID NO: 1266832 - protein, 22 aa, Mycobacterium
GQAAETFAILNLANHGDHIVSS

SEQ ID NO: 1266833 - protein, 24 aa, Mycobacterium
GQAAHLWTRTSLRPADVDVAELYD

SEQ ID NO: 1266834 - protein, 17 aa, Mycobacterium
GQAICRRLLQGGYVPVA

SEQ ID NO: 1266835 - protein, 17 aa, Mycobacterium
GQAPSYAIGQRIWQQLR

SEQ ID NO: 1266836 - protein, 32 aa, Mycobacterium
GQAVADKACWSRWWPDLRLVVVEDRGEAGHRW

SEQ ID NO: 1266837 - protein, 20 aa, Mycobacterium
GQAYWSFGGLFFVDSPEQRR

SEQ ID NO: 1266838 - protein, 21 aa, Mycobacterium
GQAYWSFGGLFLVDSPEQRRM

SEQ ID NO: 1266839 - protein, 18 aa, Mycobacterium
GQCGIGGDAFAVVREPDG

SEQ ID NO: 1266840 - protein, 19 aa, Mycobacterium
GQCISLGRSAGLIQIAHLD

SEQ ID NO: 1266841 - protein, 17 aa, Mycobacterium
GQDFKGKLPSEVFREHF

SEQ ID NO: 1266842 - protein, 24 aa, Mycobacterium
GQDLRWLSLAFPIVHECCAAELYD

SEQ ID NO: 1266843 - protein, 26 aa, Mycobacterium
GQDPYRYPRNLPIVGAKGGPGGKPGC

SEQ ID NO: 1266844 - protein, 23 aa, Mycobacterium
GQEEVCRLWNLVASNTREGAVFE

SEQ ID NO: 1266845 - protein, 17 aa, Mycobacterium
GQEHLRETLLIGLLTGG

SEQ ID NO: 1266846 - protein, 22 aa, Mycobacterium
GQELATRLIVDAGILITNVAGR

SEQ ID NO: 1266847 - protein, 20 aa, Mycobacterium
GQELGWRLARPDDWARHNWI

SEQ ID NO: 1266848 - protein, 22 aa, Mycobacterium
GQFEGFPLLLLTSTGAKSGQPR

SEQ ID NO: 1266849 - protein, 24 aa, Mycobacterium
GQFQDLDGSVIFGYSQGTQVATLY

SEQ ID NO: 1266850 - protein, 17 aa, Mycobacterium
GQFSPDEVGLWTFRVDG

SEQ ID NO: 1266851 - protein, 25 aa, Mycobacterium
GQFVPVMFTRMLKLPEAVRKSYDVS

SEQ ID NO: 1266852 - protein, 24 aa, Mycobacterium
GQGALRMRFNLALYADPRHFDAQV

SEQ ID NO: 1266853 - protein, 27 aa, Mycobacterium
GQGAYLGHVIVLWSWALKQPNEHEAPS

SEQ ID NO: 1266854 - protein, 18 aa, Mycobacterium
GQGLSHPILLSFTDDGSI

SEQ ID NO: 1266855 - protein, 23 aa, Mycobacterium
GQGNWRLLRESALRANDAPESTL

SEQ ID NO: 1266856 - protein, 23 aa, Mycobacterium
GQGRVRLTFPWLSDEYVSDWART

SEQ ID NO: 1266857 - protein, 23 aa, Mycobacterium
GQHFRVGPKRVWLVSDTTATVHG

SEQ ID NO: 1266858 - protein, 18 aa, Mycobacterium
GQHLVGFEFAYDGGGLGK

SEQ ID NO: 1266859 - protein, 18 aa, Mycobacterium
GQHLYWVVGDNTQGVVNS

SEQ ID NO: 1266860 - protein, 17 aa, Mycobacterium
GQKRWTIRWKPALNAFA

SEQ ID NO: 1266861 - protein, 21 aa, Mycobacterium
GQLACRACTSACTICGSACVP

SEQ ID NO: 1266862 - protein, 25 aa, Mycobacterium
GQLAEFRLPVIESRHAHVPIELDGE

SEQ ID NO: 1266863 - protein, 20 aa, Mycobacterium
GQLGHGFAMQAFLAVQSSRV

SEQ ID NO: 1266864 - protein, 18 aa, Mycobacterium
GQLLAEDKWDLIVVDTPP

SEQ ID NO: 1266865 - protein, 20 aa, Mycobacterium
GQLLRAAAIGELAGQPPLQW

SEQ ID NO: 1266866 - protein, 17 aa, Mycobacterium
GQLPAGAAWAVDLVDPA

SEQ ID NO: 1266867 - protein, 26 aa, Mycobacterium
GQLPLTRPLLDLGVPPEIVRALDPLL

SEQ ID NO: 1266868 - protein, 17 aa, Mycobacterium
GQLRVWHPGHGVFLDGA

SEQ ID NO: 1266869 - protein, 25 aa, Mycobacterium
GQLVRAGTEFGAYWYANLRNTIRFD

SEQ ID NO: 1266870 - protein, 23 aa, Mycobacterium
GQMAQMPMQVMGAVAAVPQGIMQ

SEQ ID NO: 1266871 - protein, 23 aa, Mycobacterium
GQMQGRSRLEVIAPEAAQRLSAV

SEQ ID NO: 1266872 - protein, 18 aa, Mycobacterium
GQMRTAANGLDSFRDGIR

SEQ ID NO: 1266873 - protein, 25 aa, Mycobacterium
GQMSECYRVALSYADDGAGPATVVL

SEQ ID NO: 1266874 - protein, 18 aa, Mycobacterium
GQNVKLDPTSPFASFYDS

SEQ ID NO: 1266875 - protein, 18 aa, Mycobacterium
GQPCGARIVVVTHRATDA

SEQ ID NO: 1266876 - protein, 19 aa, Mycobacterium
GQPDLFWSPINSMEDVIAD

SEQ ID NO: 1266877 - protein, 20 aa, Mycobacterium
GQPESWPQWAHPDVVRAFVD

SEQ ID NO: 1266878 - protein, 22 aa, Mycobacterium
GQPEVIALMARNHRGFVDALIA

SEQ ID NO: 1266879 - protein, 18 aa, Mycobacterium
GQPGHWTAHVTLARRLPL

SEQ ID NO: 1266880 - protein, 21 aa, Mycobacterium
GQPGPVSVLFLDLDRLKTVND

SEQ ID NO: 1266881 - protein, 18 aa, Mycobacterium
GQPLRFEVLPVMFSIQLT

SEQ ID NO: 1266882 - protein, 19 aa, Mycobacterium
GQPPLQWRDGAAVTVVVAA

SEQ ID NO: 1266883 - protein, 26 aa, Mycobacterium
GQPVCALLAGGGYAEFVAVPAGQVLP

SEQ ID NO: 1266884 - protein, 19 aa, Mycobacterium
GQPYQEWLDAGLFHLDELP

SEQ ID NO: 1266885 - protein, 24 aa, Mycobacterium
GQQLPLTMGHEFSGTIAAVGDGVT

SEQ ID NO: 1266886 - protein, 23 aa, Mycobacterium
GQQRGLVEVCGIAAAHQPRRRQM

SEQ ID NO: 1266887 - protein, 17 aa, Mycobacterium
GQRAHVLLSHLAQALTD

SEQ ID NO: 1266888 - protein, 17 aa, Mycobacterium
GQRFCYVREPVGCTATA

SEQ ID NO: 1266889 - protein, 21 aa, Mycobacterium
GQRIPKKWLESGVIVKADTLE

SEQ ID NO: 1266890 - protein, 23 aa, Mycobacterium
GQRQRVLLAQAFVQQAPLLLLDE

SEQ ID NO: 1266891 - protein, 19 aa, Mycobacterium
GQRRARRLYARAMLGADAR

SEQ ID NO: 1266892 - protein, 23 aa, Mycobacterium
GQRRFWFMWDDLVRGAIGAIILV

SEQ ID NO: 1266893 - protein, 17 aa, Mycobacterium
GQRRGRVGGRVGRPAGP

SEQ ID NO: 1266894 - protein, 24 aa, Mycobacterium
GQSPLARWEAGFDRLGHPAALPTA

SEQ ID NO: 1266895 - protein, 20 aa, Mycobacterium
GQSYPFAPPVGLMFVLWDDE

SEQ ID NO: 1266896 - protein, 22 aa, Mycobacterium
GQSYPFAPPVGLMFVLWDEEAE

SEQ ID NO: 1266897 - protein, 20 aa, Mycobacterium
GQTDWEFLDTVARRVGFELK

SEQ ID NO: 1266898 - protein, 17 aa, Mycobacterium
GQTLDWLAARGLTDLLQ

SEQ ID NO: 1266899 - protein, 18 aa, Mycobacterium
GQTLLLVSHVTPIKTLLR

SEQ ID NO: 1266900 - protein, 23 aa, Mycobacterium
GQTWRRLGVRYPDTIATHSADQV

SEQ ID NO: 1266901 - protein, 24 aa, Mycobacterium
GQVAQRYAAVYGYDERAMAKIVVD

SEQ ID NO: 1266902 - protein, 20 aa, Mycobacterium
GQVCVCPDYVFVPADRMEKF

SEQ ID NO: 1266903 - protein, 23 aa, Mycobacterium
GQVFCPPGNVLVEPTFVPRPGGD

SEQ ID NO: 1266904 - protein, 19 aa, Mycobacterium
GQVLPAFVSAMIWGYGDSG

SEQ ID NO: 1266905 - protein, 29 aa, Mycobacterium
GQVLPELIRRAVVVKAEVVAADEKESQLR

SEQ ID NO: 1266906 - protein, 18 aa, Mycobacterium
GQVLRLGPAAGTGTPTAD

SEQ ID NO: 1266907 - protein, 22 aa, Mycobacterium
GQWGSALSFAGVQFGLEIEVWQ

SEQ ID NO: 1266908 - protein, 24 aa, Mycobacterium
GQWRSATCRVVVAATGARSANAGP

SEQ ID NO: 1266909 - protein, 18 aa, Mycobacterium
GQYAAGWQGSEKVPGLLE

SEQ ID NO: 1266910 - protein, 21 aa, Mycobacterium
GRAAAAVAHRGWQAVTVDMRG

SEQ ID NO: 1266911 - protein, 21 aa, Mycobacterium
GRAAAEVFAAQGFSVTLMFAA

SEQ ID NO: 1266912 - protein, 19 aa, Mycobacterium
GRAATAGLARINFDIESIF

SEQ ID NO: 1266913 - protein, 25 aa, Mycobacterium
GRAAYTVMSRFFLGATVDLDEAYHW

SEQ ID NO: 1266914 - protein, 21 aa, Mycobacterium
GRADEPLLCGVPLSIDTSPDR

SEQ ID NO: 1266915 - protein, 24 aa, Mycobacterium
GRAEFLRRDFGFVYQVRPKFLDRA

SEQ ID NO: 1266916 - protein, 18 aa, Mycobacterium
GRAFCAGAHLGSMATIGD

SEQ ID NO: 1266917 - protein, 23 aa, Mycobacterium
GRAGEIRAAVPINPPTAPPRVLW

SEQ ID NO: 1266918 - protein, 19 aa, Mycobacterium
GRAGLPCRRCGTPIETDKG

SEQ ID NO: 1266919 - protein, 26 aa, Mycobacterium
GRAKIGMYIALRLLRDGAHTTITTRF

SEQ ID NO: 1266920 - protein, 24 aa, Mycobacterium
GRAKIVKFSGCYHGHSDALLADAG

SEQ ID NO: 1266921 - protein, 19 aa, Mycobacterium
GRALDFPSLTALSDIFYPR

SEQ ID NO: 1266922 - protein, 18 aa, Mycobacterium
GRAMAAGGQAVFEVAPQG

SEQ ID NO: 1266923 - protein, 20 aa, Mycobacterium
GRAPMKPIVGFTVKDDGVGF

SEQ ID NO: 1266924 - protein, 25 aa, Mycobacterium
GRAPMWEVPDGLRVLGEHIHDRDYF

SEQ ID NO: 1266925 - protein, 20 aa, Mycobacterium
GRARLILRRETFDDLLSLEV

SEQ ID NO: 1266926 - protein, 20 aa, Mycobacterium
GRARPGVNLLDLELRARTLL

SEQ ID NO: 1266927 - protein, 26 aa, Mycobacterium
GRAVFTPGLAGLVLGEFRRIERDSPA

SEQ ID NO: 1266928 - protein, 18 aa, Mycobacterium
GRAVIGFGAGREYEYPQF

SEQ ID NO: 1266929 - protein, 22 aa, Mycobacterium
GRAVPDREIRAVLADALAVAES

SEQ ID NO: 1266930 - protein, 21 aa, Mycobacterium
GRAVVIPPHIREDVINHLAEN

SEQ ID NO: 1266931 - protein, 19 aa, Mycobacterium
GRAVVMLMLVRYVDGDLGK

SEQ ID NO: 1266932 - protein, 20 aa, Mycobacterium
GRAWLGIGAAWFEREHRGLG

SEQ ID NO: 1266933 - protein, 25 aa, Mycobacterium
GRAYDPRFLFAWPSAKSAVMGGTQL

SEQ ID NO: 1266934 - protein, 25 aa, Mycobacterium
GRAYDPRFMFSWVNAKLAVMGAAQL

SEQ ID NO: 1266935 - protein, 20 aa, Mycobacterium
GRCAGCRTQDPVKCVQGPQI

SEQ ID NO: 1266936 - protein, 37 aa, Mycobacterium
GRDASFKSFVALDWALCLASGTPWQGKAVDRVKVLYV

SEQ ID NO: 1266937 - protein, 22 aa, Mycobacterium
GRDDILAVLAYWARKDRDMVIT

SEQ ID NO: 1266938 - protein, 30 aa, Mycobacterium
GRDGADLHGEWGRRPFAYLGITVPKFPNFF

SEQ ID NO: 1266939 - protein, 23 aa, Mycobacterium
GRDHRASFVQIHFALDGLPEFAP

SEQ ID NO: 1266940 - protein, 24 aa, Mycobacterium
GRDLDALRARWAQLAASPLLENGI

SEQ ID NO: 1266941 - protein, 20 aa, Mycobacterium
GRDTLCWPYGVSLHGDLLAV

SEQ ID NO: 1266942 - protein, 29 aa, Mycobacterium
GRDVASIRRLRCANGEPLALMTNYLPAEI

SEQ ID NO: 1266943 - protein, 26 aa, Mycobacterium
GRDVIGGLLGDLAWDAVLGTLSGGQR

SEQ ID NO: 1266944 - protein, 20 aa, Mycobacterium
GREAIVATNLSANAIAELAA

SEQ ID NO: 1266945 - protein, 19 aa, Mycobacterium
GREAVRALVREHRELGALL

SEQ ID NO: 1266946 - protein, 24 aa, Mycobacterium
GREGEPCRRCGAIMRRDKFMNRSS

SEQ ID NO: 1266947 - protein, 21 aa, Mycobacterium
GREGTTVFSLGNFVFNSPGRY

SEQ ID NO: 1266948 - protein, 24 aa, Mycobacterium
GRELAEAMIPLAMWGARHQMSHAD

SEQ ID NO: 1266949 - protein, 19 aa, Mycobacterium
GRELCPGGRLVVMTTAVGD

SEQ ID NO: 1266950 - protein, 20 aa, Mycobacterium
GRELECGVLEFPDGHLEAST

SEQ ID NO: 1266951 - protein, 24 aa, Mycobacterium
GREQLAALARRFAGGEAYLCGPAP

SEQ ID NO: 1266952 - protein, 19 aa, Mycobacterium
GREQWLIELMEGVEDIPGS

SEQ ID NO: 1266953 - protein, 18 aa, Mycobacterium
GREVLYRLVDDHLAEIVV

SEQ ID NO: 1266954 - protein, 25 aa, Mycobacterium
GREWGQFAFDEFLEIKAALGYAPEA

SEQ ID NO: 1266955 - protein, 17 aa, Mycobacterium
GRFALTRLGHALRVDHP

SEQ ID NO: 1266956 - protein, 24 aa, Mycobacterium
GRFDEAFAALRGWEEQGLLTHREH

SEQ ID NO: 1266957 - protein, 24 aa, Mycobacterium
GRFDEPRKGMSVLLGALPAVAERF

SEQ ID NO: 1266958 - protein, 27 aa, Mycobacterium
GRFDTGVFKEDGWRFTTKVESQYLAQL

SEQ ID NO: 1266959 - protein, 27 aa, Mycobacterium
GRFDTGVFKVDGWRFTTKVESQYLAQL

SEQ ID NO: 1266960 - protein, 17 aa, Mycobacterium
GRFKHFRDFGPLDNQLV

SEQ ID NO: 1266961 - protein, 18 aa, Mycobacterium
GRFLRRGALESGLDHVDR

SEQ ID NO: 1266962 - protein, 20 aa, Mycobacterium
GRFPGAGSVSEFWRNLRNGV

SEQ ID NO: 1266963 - protein, 17 aa, Mycobacterium
GRFPGVAAVALVADING

SEQ ID NO: 1266964 - protein, 31 aa, Mycobacterium; identical to SEQ ID NO: 670540

SEQ ID NO: 1266965 - protein, 17 aa, Mycobacterium
GRFSPWGRLAAYRRQYD

SEQ ID NO: 1266966 - protein, 17 aa, Mycobacterium
GRFTRFAIEQEGAKPGD

SEQ ID NO: 1266967 - protein, 26 aa, Mycobacterium
GRGADGWRLDAAYAVPDSFWAGVLPR

SEQ ID NO: 1266968 - protein, 18 aa, Mycobacterium
GRGADVWDELHPTPAQQV

SEQ ID NO: 1266969 - protein, 24 aa, Mycobacterium
GRGEGFCAGFDLGAYAEGSSTAGT

SEQ ID NO: 1266970 - protein, 25 aa, Mycobacterium
GRGFPISVLFGSIYAARGYHVVLQS

SEQ ID NO: 1266971 - protein, 20 aa, Mycobacterium
GRGGISSMLLGSVSTAVAES

SEQ ID NO: 1266972 - protein, 22 aa, Mycobacterium
GRGHRKAMVVLMLMRYEDTDLG

SEQ ID NO: 1266973 - protein, 27 aa, Mycobacterium
GRGIAETFARAGVNVVITGRTQADIDG

SEQ ID NO: 1266974 - protein, 25 aa, Mycobacterium
GRGIARRFAREGAKVIAAELDRDAG

SEQ ID NO: 1266975 - protein, 17 aa, Mycobacterium
GRGIAVELARQGADIAL

SEQ ID NO: 1266976 - protein, 20 aa, Mycobacterium
GRGIPRERLASVAEHYLHFG

SEQ ID NO: 1266977 - protein, 32 aa, Mycobacterium; identical to SEQ ID NO: 928480

SEQ ID NO: 1266978 - protein, 22 aa, Mycobacterium
GRGKWAGAGWDRDVDACISATD

SEQ ID NO: 1266979 - protein, 25 aa, Mycobacterium
GRGMPVLGICNGFQVLCEAGLLPGA

SEQ ID NO: 1266980 - protein, 28 aa, Mycobacterium
GRGNVSGFVRTGLFKRLSSSGHSFIVSL

SEQ ID NO: 1266981 - protein, 22 aa, Mycobacterium
GRGPVATVLIQRGTLRVGDSIV

SEQ ID NO: 1266982 - protein, 32 aa, Mycobacterium
GRGRQQPRCRECWRPGKPTVLTSTRISPGTRE

SEQ ID NO: 1266983 - protein, 22 aa, Mycobacterium
GRGRRIGIDVGCVRVGVATSDP

SEQ ID NO: 1266984 - protein, 17 aa, Mycobacterium
GRGSCSEIRCPSHSWCW

SEQ ID NO: 1266985 - protein, 25 aa, Mycobacterium
GRGSIPRADVAAVLVAVLDTPDTAG

SEQ ID NO: 1266986 - protein, 20 aa, Mycobacterium
GRGSIRMRGVVEIEEDSRGR

SEQ ID NO: 1266987 - protein, 24 aa, Mycobacterium
GRGTRLPVWLTQWGFDRPHEDTVD

SEQ ID NO: 1266988 - protein, 28 aa, Mycobacterium
GRGTTCVLCPPRRMWSVPRIYAAAPPDG

SEQ ID NO: 1266989 - protein, 18 aa, Mycobacterium
GRGVFDLLQRKGLAARIT

SEQ ID NO: 1266990 - protein, 19 aa, Mycobacterium
GRGVGKFDPLPVLANGFSG

SEQ ID NO: 1266991 - protein, 17 aa, Mycobacterium
GRHRCVGAAFATMQIKA

SEQ ID NO: 1266992 - protein, 18 aa, Mycobacterium
GRHSPVLVSSARPGRQNG

SEQ ID NO: 1266993 - protein, 17 aa, Mycobacterium
GRIAFGGVATYTATKFA

SEQ ID NO: 1266994 - protein, 17 aa, Mycobacterium
GRIALEEILIRFPDWEV

SEQ ID NO: 1266995 - protein, 20 aa, Mycobacterium
GRIALIVGDCVGHGLAAAAI

SEQ ID NO: 1266996 - protein, 20 aa, Mycobacterium
GRIDDGWGVVGAHPMSGAAG

SEQ ID NO: 1266997 - protein, 27 aa, Mycobacterium
GRIERMHRSCLILTFGGGTNEIQRDII

SEQ ID NO: 1266998 - protein, 17 aa, Mycobacterium
GRIHGVQVWVGAPDESP

SEQ ID NO: 1266999 - protein, 21 aa, Mycobacterium
GRIIFIGSVSGMWGIGNQANY

SEQ ID NO: 1267000 - protein, 17 aa, Mycobacterium
GRIKKGQQVAWMREVDG

SEQ ID NO: 1267001 - protein, 31 aa, Mycobacterium
GRILGVKGRVLPMCPVGLGIEADVVGLESDP

SEQ ID NO: 1267002 - protein, 21 aa, Mycobacterium
GRINHAYLFSGPRGCGKTSSA

SEQ ID NO: 1267003 - protein, 31 aa, Mycobacterium
GRIPANARIADWIPYSALLPHVDVMITNGGY

SEQ ID NO: 1267004 - protein, 18 aa, Mycobacterium
GRIPRRIIAFDPGRASLI

SEQ ID NO: 1267005 - protein, 27 aa, Mycobacterium
GRIRRLRPWLDVRAAFLEKCAPSLHDV

SEQ ID NO: 1267006 - protein, 18 aa, Mycobacterium
GRISLRSQVPLLLDEYSR

SEQ ID NO: 1267007 - protein, 23 aa, Mycobacterium
GRIWTPVGVPLPFAISELDQGRS

SEQ ID NO: 1267008 - protein, 20 aa, Mycobacterium
GRKALDIYLNLANYLNNWKR

SEQ ID NO: 1267009 - protein, 30 aa, Mycobacterium
GRKEIRLAEHEMPGLMALRHEYAEVQPLKG

SEQ ID NO: 1267010 - protein, 20 aa, Mycobacterium
GRKHLRKIALEPWQQKIVDG

SEQ ID NO: 1267011 - protein, 20 aa, Mycobacterium
GRKMKPGRITFVGSGPGDPG

SEQ ID NO: 1267012 - protein, 33 aa, Mycobacterium
GRKNKGAMAYREFAAALLKHWKNGKPLETFTPE

SEQ ID NO: 1267013 - protein, 26 aa, Mycobacterium
GRKPLRVPVWMMRQAGRSLPEYRALR

SEQ ID NO: 1267014 - protein, 21 aa, Mycobacterium
GRKVAALCGSPSQARKHADAG

SEQ ID NO: 1267015 - protein, 18 aa, Mycobacterium
GRKVRSWPVTELNESIYV

SEQ ID NO: 1267016 - protein, 20 aa, Mycobacterium
GRLAHYEVPSEIAVVDTIPR

SEQ ID NO: 1267017 - protein, 25 aa, Mycobacterium
GRLARLLRLLGFDVWFSVDADDETL

SEQ ID NO: 1267018 - protein, 21 aa, Mycobacterium
GRLDAAVSIHAVERFLGDLAR

SEQ ID NO: 1267019 - protein, 22 aa, Mycobacterium
GRLDGEALLSAWTDIVSDMSTT

SEQ ID NO: 1267020 - protein, 17 aa, Mycobacterium
GRLDLDLAIPKEMGGTG

SEQ ID NO: 1267021 - protein, 24 aa, Mycobacterium
GRLIGYRLNPRFIRVDLNEIDAAM

SEQ ID NO: 1267022 - protein, 21 aa, Mycobacterium
GRLILADAIARACEDAPDYLI

SEQ ID NO: 1267023 - protein, 26 aa, Mycobacterium
GRLKEKAIAPIRAWLGGLTADAEQRA

SEQ ID NO: 1267024 - protein, 18 aa, Mycobacterium
GRLLELFIHEAARTSLTN

SEQ ID NO: 1267025 - protein, 27 aa, Mycobacterium
GRLLVPRLLPWSRSGQLAIPRGTDYVL

SEQ ID NO: 1267026 - protein, 19 aa, Mycobacterium
GRLPEEYAIIGSGRHSPGG

SEQ ID NO: 1267027 - protein, 24 aa, Mycobacterium
GRLPRELFVKFSRDFDDPARDLGR

SEQ ID NO: 1267028 - protein, 29 aa, Mycobacterium
GRLPRLVDWPEWLPPDWFDDRRVEPVLAG

SEQ ID NO: 1267029 - protein, 21 aa, Mycobacterium
GRLPVSYSRKVFIPVTHLCRD

SEQ ID NO: 1267030 - protein, 20 aa, Mycobacterium
GRLQPGKMFLVDTAAGRIVS

SEQ ID NO: 1267031 - protein, 23 aa, Mycobacterium
GRLRFAINGGEPVDCEGFQLFLD

SEQ ID NO: 1267032 - protein, 20 aa, Mycobacterium
GRLRLVDVGTNLGLAKSTAR

SEQ ID NO: 1267033 - protein, 24 aa, Mycobacterium
GRLSTRLIGQVTWRTRLVQDPQLL

SEQ ID NO: 1267034 - protein, 22 aa, Mycobacterium
GRLSVEGDWALAMKLKSLDELM

SEQ ID NO: 1267035 - protein, 18 aa, Mycobacterium
GRLTGDIVRPVIWGPQKA

SEQ ID NO: 1267036 - protein, 21 aa, Mycobacterium
GRLTHPVVLRPGDDHYRPIGW

SEQ ID NO: 1267037 - protein, 17 aa, Mycobacterium
GRLTLAAVRARIDESFG

SEQ ID NO: 1267038 - protein, 19 aa, Mycobacterium
GRLVLRRVAVRSGVPDYGY

SEQ ID NO: 1267039 - protein, 19 aa, Mycobacterium
GRLYLPAEEAAALPLTVYY

SEQ ID NO: 1267040 - protein, 19 aa, Mycobacterium
GRMDDLYAAVVQCVEEAVL

SEQ ID NO: 1267041 - protein, 26 aa, Mycobacterium
GRMDWAQTFASWRLHELRGVPTALQA

SEQ ID NO: 1267042 - protein, 17 aa, Mycobacterium
GRMIPQALPPIWDPNLM

SEQ ID NO: 1267043 - protein, 18 aa, Mycobacterium
GRMLAARVLEIFPVTRTP

SEQ ID NO: 1267044 - protein, 21 aa, Mycobacterium
GRMNARIVGSVAEFESEHKSE

SEQ ID NO: 1267045 - protein, 19 aa, Mycobacterium
GRMVKRLKGVADYVNTLSD

SEQ ID NO: 1267046 - protein, 19 aa, Mycobacterium
GRNQLRVGMFPAVEPDDVS

SEQ ID NO: 1267047 - protein, 27 aa, Mycobacterium
GRPAPGFGSPRPRIFVVGLAPAAHGAN

SEQ ID NO: 1267048 - protein, 19 aa, Mycobacterium
GRPAWALSLTGVETRFRPE

SEQ ID NO: 1267049 - protein, 23 aa, Mycobacterium
GRPDLTIPRRFLPGLSDDQLLRH

SEQ ID NO: 1267050 - protein, 17 aa, Mycobacterium
GRPDPWAGIDDTAQSID

SEQ ID NO: 1267051 - protein, 22 aa, Mycobacterium
GRPEDDRYLLGLDPHAPDTHSA

SEQ ID NO: 1267052 - protein, 21 aa, Mycobacterium
GRPFYLMGFVDGWSPMDTHGK

SEQ ID NO: 1267053 - protein, 34 aa, Mycobacterium
GRPGDTFWRTSPYLPLSWQRKAVQLVAPMLGTDP

SEQ ID NO: 1267054 - protein, 17 aa, Mycobacterium
GRPHAPKGAEWDAAVAV

SEQ ID NO: 1267055 - protein, 20 aa, Mycobacterium
GRPHPDLVLTALMRAGVDDV

SEQ ID NO: 1267056 - protein, 23 aa, Mycobacterium
GRPHRFQITASRFGRRGGTPDAG

SEQ ID NO: 1267057 - protein, 27 aa, Mycobacterium
GRPIIRVTPRRVISFGIDDQETEPHQL

SEQ ID NO: 1267058 - protein, 23 aa, Mycobacterium
GRPISRTAFLHVDYRKVTPIDTV

SEQ ID NO: 1267059 - protein, 21 aa, Mycobacterium
GRPITAEAFGVVAREAAALGV

SEQ ID NO: 1267060 - protein, 23 aa, Mycobacterium
GRPKPTPVWGVPHGDKLLISTDD

SEQ ID NO: 1267061 - protein, 19 aa, Mycobacterium
GRPNALLGGDFYDFVQTPD

SEQ ID NO: 1267062 - protein, 21 aa, Mycobacterium
GRPPHKRICVAVRGEVDAANA

SEQ ID NO: 1267063 - protein, 18 aa, Mycobacterium
GRPPQMFRAMPQMDRAGP

SEQ ID NO: 1267064 - protein, 17 aa, Mycobacterium
GRPQVLSSGRWDEPIRW

SEQ ID NO: 1267065 - protein, 17 aa, Mycobacterium
GRPRLDPWRSRLAADPE

SEQ ID NO: 1267066 - protein, 25 aa, Mycobacterium
GRPRRAGVSSFGFSGTNAHVVLEEP

SEQ ID NO: 1267067 - protein, 19 aa, Mycobacterium
GRPSDKWGQEVVAVVALAE

SEQ ID NO: 1267068 - protein, 24 aa, Mycobacterium
GRPSPRLDAVAERLGATTWPVDLA

SEQ ID NO: 1267069 - protein, 19 aa, Mycobacterium
GRPVAWANPAVGLRNAIAP

SEQ ID NO: 1267070 - protein, 26 aa, Mycobacterium
GRPVGKAGWHAWIRVGSDVVNPGAFR

SEQ ID NO: 1267071 - protein, 17 aa, Mycobacterium
GRPVKLVLTRDQMFTST

SEQ ID NO: 1267072 - protein, 23 aa, Mycobacterium
GRPVLALHGWPQHHWVYRSLLAD

SEQ ID NO: 1267073 - protein, 18 aa, Mycobacterium
GRPVPVLTEHGGHTLTWI

SEQ ID NO: 1267074 - protein, 19 aa, Mycobacterium
GRPVSSFGCDGVLVSTPTG

SEQ ID NO: 1267075 - protein, 22 aa, Mycobacterium
GRPVTRTVLCKSVDASGVSFYT

SEQ ID NO: 1267076 - protein, 23 aa, Mycobacterium
GRPWRPEVVHAHDWLVAHPAITL

SEQ ID NO: 1267077 - protein, 19 aa, Mycobacterium
GRPYLVEGVGEDFWPAAYD

SEQ ID NO: 1267078 - protein, 19 aa, Mycobacterium
GRPYPDHGLSHRQWAQIPP

SEQ ID NO: 1267079 - protein, 18 aa, Mycobacterium
GRQILDFTDEVFGKPRGD

SEQ ID NO: 1267080 - protein, 18 aa, Mycobacterium
GRQLKLQLDELVGDNDTD

SEQ ID NO: 1267081 - protein, 17 aa, Mycobacterium
GRQTVDVFLARGEQSRS

SEQ ID NO: 1267082 - protein, 19 aa, Mycobacterium
GRQVGPLAKFYSVAPADVV

SEQ ID NO: 1267083 - protein, 28 aa, Mycobacterium
GRRELLAEMPPFLTGGSMIETVTMEGAT

SEQ ID NO: 1267084 - protein, 18 aa, Mycobacterium
GRRIFAEMVDACAVRVIR

SEQ ID NO: 1267085 - protein, 19 aa, Mycobacterium
GRRLRAWYAAVGTLPARSG

SEQ ID NO: 1267086 - protein, 18 aa, Mycobacterium
GRRPGARWAADLVAAADA

SEQ ID NO: 1267087 - protein, 18 aa, Mycobacterium
GRRRARAAALVQLALPGT

SEQ ID NO: 1267088 - protein, 25 aa, Mycobacterium
GRRRPDIAVTILRLANMIGPAMDTA

SEQ ID NO: 1267089 - protein, 23 aa, Mycobacterium
GRRRPSQPFGIYVHVPFCAVRCG

SEQ ID NO: 1267090 - protein, 20 aa, Mycobacterium
GRRTYDIFAAYWPHQQGGED

SEQ ID NO: 1267091 - protein, 19 aa, Mycobacterium
GRRVHKTVHHYLMRFSGGE

SEQ ID NO: 1267092 - protein, 20 aa, Mycobacterium
GRRVLICGAGMLGVTAAAAC

SEQ ID NO: 1267093 - protein, 17 aa, Mycobacterium
GRRVLVVDGDPQANVTV

SEQ ID NO: 1267094 - protein, 21 aa, Mycobacterium
GRRWEMAAAEGILERSIDGAG

SEQ ID NO: 1267095 - protein, 18 aa, Mycobacterium
GRSAALGYDGKWVLHPDQ

SEQ ID NO: 1267096 - protein, 22 aa, Mycobacterium
GRSAASWTRSSTLAFASLSSNL

SEQ ID NO: 1267097 - protein, 22 aa, Mycobacterium
GRSAFFLGDSCGKGISAATVAS

SEQ ID NO: 1267098 - protein, 23 aa, Mycobacterium
GRSATNWASRVVFLNGHGGNTEA

SEQ ID NO: 1267099 - protein, 19 aa, Mycobacterium
GRSAVPPALAAELTGIDDD

SEQ ID NO: 1267100 - protein, 20 aa, Mycobacterium
GRSDAPGWLTSRGWWTDVVE

SEQ ID NO: 1267101 - protein, 18 aa, Mycobacterium
GRSFLLPPTWTQLDALNG

SEQ ID NO: 1267102 - protein, 28 aa, Mycobacterium
GRSGEPFPYPVTVGYMYILKLHHLVDDK

SEQ ID NO: 1267103 - protein, 19 aa, Mycobacterium
GRSGFALLCVENDYPIVPV

SEQ ID NO: 1267104 - protein, 24 aa, Mycobacterium
GRSKREIPHYYLANEILLDASSQW

SEQ ID NO: 1267105 - protein, 18 aa, Mycobacterium
GRSKRVLLAGWEQFDEPV

SEQ ID NO: 1267106 - protein, 22 aa, Mycobacterium
GRSLPHAVLMMIPEAWENNTTM

SEQ ID NO: 1267107 - protein, 18 aa, Mycobacterium
GRSLRLLSTPGIELLLPV

SEQ ID NO: 1267108 - protein, 17 aa, Mycobacterium
GRSPMRASHLHFMVTAP

SEQ ID NO: 1267109 - protein, 20 aa, Mycobacterium
GRSQMAMGFFTALAGDAAVA

SEQ ID NO: 1267110 - protein, 17 aa, Mycobacterium
GRSQRVAQYLARNGYDP

SEQ ID NO: 1267111 - protein, 27 aa, Mycobacterium
GRSSLRLQSGLWMWVGSYFAGLISAAP

SEQ ID NO: 1267112 - protein, 24 aa, Mycobacterium
GRSSLRTWLFTVMINIAKTRGLRD

SEQ ID NO: 1267113 - protein, 22 aa, Mycobacterium
GRTCTPRTPLGATMVSSEGACA

SEQ ID NO: 1267114 - protein, 24 aa, Mycobacterium
GRTETGGCPRGCAGAAEHYSNDGH

SEQ ID NO: 1267115 - protein, 19 aa, Mycobacterium
GRTGAFYAHQHDGITPDIV

SEQ ID NO: 1267116 - protein, 27 aa, Mycobacterium
GRTGGDFTFPMEFARTPDGGWQLTRDS

SEQ ID NO: 1267117 - protein, 21 aa, Mycobacterium
GRTGLPWPDLNGTGAVSLLQT

SEQ ID NO: 1267118 - protein, 18 aa, Mycobacterium
GRTGRALIQAMLRHKRLT

SEQ ID NO: 1267119 - protein, 17 aa, Mycobacterium
GRTHPVPLIIGTNKNEA

SEQ ID NO: 1267120 - protein, 26 aa, Mycobacterium
GRTLALEHPDIWGALIDTDESVPAVV

SEQ ID NO: 1267121 - protein, 26 aa, Mycobacterium
GRTLALEHPEFWGGIIDVDETLPPEL

SEQ ID NO: 1267122 - protein, 18 aa, Mycobacterium
GRTLASLYDPVTMPDELL

SEQ ID NO: 1267123 - protein, 17 aa, Mycobacterium
GRTQLLCEAVDYAGDRV

SEQ ID NO: 1267124 - protein, 18 aa, Mycobacterium
GRTQLLCEAVDYAGEFIA

SEQ ID NO: 1267125 - protein, 18 aa, Mycobacterium
GRTRGVVGSPHFFTEDGG

SEQ ID NO: 1267126 - protein, 31 aa, Mycobacterium
GRTRPVGSFPPNRYGLFDMAGNVWEWTTDWY

SEQ ID NO: 1267127 - protein, 18 aa, Mycobacterium
GRTVRSWMVLPHGEAAGS

SEQ ID NO: 1267128 - protein, 18 aa, Mycobacterium
GRVAPVFDLGVGMDPEIS

SEQ ID NO: 1267129 - protein, 24 aa, Mycobacterium
GRVGARFTDLFAAVRNRLHDAVER

SEQ ID NO: 1267130 - protein, 21 aa, Mycobacterium
GRVHRFLGLDVDVILGTLTPD

SEQ ID NO: 1267131 - protein, 19 aa, Mycobacterium
GRVIVACFASNVDRVQSII

SEQ ID NO: 1267132 - protein, 17 aa, Mycobacterium
GRVKRGDTVLMAAFAHA

SEQ ID NO: 1267133 - protein, 21 aa, Mycobacterium
GRVLAAVGMAPVKLDADRITV

SEQ ID NO: 1267134 - protein, 20 aa, Mycobacterium
GRVLTAMSVFFFDYLSRTAA

SEQ ID NO: 1267135 - protein, 21 aa, Mycobacterium
GRVQGVGFRWWTRSRALELGL

SEQ ID NO: 1267136 - protein, 22 aa, Mycobacterium
GRVQGVGFRWWTRSRALELGLT

SEQ ID NO: 1267137 - protein, 17 aa, Mycobacterium
GRVRIAEHTGRGSIPRA

SEQ ID NO: 1267138 - protein, 25 aa, Mycobacterium
GRVRVVPAWQIDRGFDAGAADLRRL

SEQ ID NO: 1267139 - protein, 21 aa, Mycobacterium
GRWALAVKMSPVLSGASAVRD

SEQ ID NO: 1267140 - protein, 19 aa, Mycobacterium
GRWATLMKIHHCIADGIAT

SEQ ID NO: 1267141 - protein, 21 aa, Mycobacterium
GRWRPPGLYRRPDRRGRGVAL

SEQ ID NO: 1267142 - protein, 18 aa, Mycobacterium
GRYAGAVVHQTPLPTPGW

SEQ ID NO: 1267143 - protein, 17 aa, Mycobacterium
GRYAMVASKGGDPRHPS

SEQ ID NO: 1267144 - protein, 20 aa, Mycobacterium
GRYAYLVMTPLPGWEGNHYL

SEQ ID NO: 1267145 - protein, 19 aa, Mycobacterium
GRYGRILIRGEYGHDIIDE

SEQ ID NO: 1267146 - protein, 21 aa, Mycobacterium
GRYNPAAPFGGYKKSGIGREL

SEQ ID NO: 1267147 - protein, 19 aa, Mycobacterium
GRYRKPLAATKAFLDGIDA

SEQ ID NO: 1267148 - protein, 18 aa, Mycobacterium
GRYWRIDPGDTFLVPSPI

SEQ ID NO: 1267149 - protein, 19 aa, Mycobacterium
GSAAEAVWIAAQQHGLSVQ

SEQ ID NO: 1267150 - protein, 24 aa, Mycobacterium
GSAAHAFDLFRWLGPSPDALLSAA

SEQ ID NO: 1267151 - protein, 28 aa, Mycobacterium
GSAAKRIRRRVGLVFQDPFSSLNPRARV

SEQ ID NO: 1267152 - protein, 28 aa, Mycobacterium
GSAEHFCMLATQRRPRAALDVVAVGPDA

SEQ ID NO: 1267153 - protein, 18 aa, Mycobacterium
GSAEYNWGITPGDMATIW

SEQ ID NO: 1267154 - protein, 27 aa, Mycobacterium
GSAFDYAMSGLRVVGPVADPSPILRRR

SEQ ID NO: 1267155 - protein, 18 aa, Mycobacterium
GSAGKAFIGGAVAAIVAG

SEQ ID NO: 1267156 - protein, 18 aa, Mycobacterium
GSAGRPVINVETAILDDD

SEQ ID NO: 1267157 - protein, 17 aa, Mycobacterium
GSAKLTLTRTVQVAGAF

SEQ ID NO: 1267158 - protein, 22 aa, Mycobacterium
GSALFRVARRIGPLGPDEVGFD

SEQ ID NO: 1267159 - protein, 17 aa, Mycobacterium
GSAMARATRRVCRDCGF

SEQ ID NO: 1267160 - protein, 18 aa, Mycobacterium
GSAMLMLVGSANRDHRRF

SEQ ID NO: 1267161 - protein, 19 aa, Mycobacterium
GSANVFARALGISADPIEA

SEQ ID NO: 1267162 - protein, 26 aa, Mycobacterium
GSARFARDQFWPVLKDMSMYSLRVSE

SEQ ID NO: 1267163 - protein, 20 aa, Mycobacterium
GSARMAFAFELLDDATSTSP

SEQ ID NO: 1267164 - protein, 20 aa, Mycobacterium
GSARVAIEMTDSARGGWTEY

SEQ ID NO: 1267165 - protein, 21 aa, Mycobacterium
GSATCLAFALAVPDDSTAMMT

SEQ ID NO: 1267166 - protein, 28 aa, Mycobacterium
GSAVRLPRQIPYTIACDLLLTGRHITAA

SEQ ID NO: 1267167 - protein, 17 aa, Mycobacterium
GSAVTPRRIEWWEQDVV

SEQ ID NO: 1267168 - protein, 19 aa, Mycobacterium
GSCPAHGCSHRGAGNVAGV

SEQ ID NO: 1267169 - protein, 19 aa, Mycobacterium
GSCPSCQAGMRNLCDLGAM

SEQ ID NO: 1267170 - protein, 17 aa, Mycobacterium
GSCQRTWEHAIPKTTRP

SEQ ID NO: 1267171 - protein, 18 aa, Mycobacterium
GSCQRTWEHAVPKTARPV

SEQ ID NO: 1267172 - protein, 19 aa, Mycobacterium
GSCRYCRRTSYGQCSGGGG

SEQ ID NO: 1267173 - protein, 22 aa, Mycobacterium
GSCSSCPSSSVTLELAVQDAIL

SEQ ID NO: 1267174 - protein, 24 aa, Mycobacterium
GSDASRVAVDWAARDAAMRRIPLT

SEQ ID NO: 1267175 - protein, 19 aa, Mycobacterium
GSDDFRFNAIIDEEIAKAG

SEQ ID NO: 1267176 - protein, 25 aa, Mycobacterium
GSDGQWRLSPKAMRQLGQAALRDVA

SEQ ID NO: 1267177 - protein, 23 aa, Mycobacterium
GSDPRVSPLLAEDHSGLSPALVV

SEQ ID NO: 1267178 - protein, 19 aa, Mycobacterium
GSDRPVVLVAHGGLIAALT

SEQ ID NO: 1267179 - protein, 21 aa, Mycobacterium
GSDSLLRMRLDLAECATGVTK

SEQ ID NO: 1267180 - protein, 27 aa, Mycobacterium
GSDVGRLRRFAVRFSKMVLPGDDLETS

SEQ ID NO: 1267181 - protein, 25 aa, Mycobacterium
GSDVRLYSPAYWQAVTIDTRPADER

SEQ ID NO: 1267182 - protein, 21 aa, Mycobacterium
GSEALIMWCHCKVHVVPLQDL

SEQ ID NO: 1267183 - protein, 19 aa, Mycobacterium
GSEDFRFNAIIDEEMAKSG

SEQ ID NO: 1267184 - protein, 19 aa, Mycobacterium
GSEELRQRFLPGMINGSER

SEQ ID NO: 1267185 - protein, 23 aa, Mycobacterium
GSEVKRKGVLIGDTVVIRKAGDV

SEQ ID NO: 1267186 - protein, 18 aa, Mycobacterium
GSFYWHFADMPAYRAALV

SEQ ID NO: 1267187 - protein, 19 aa, Mycobacterium
GSGALSLPAARLGADVVAV

SEQ ID NO: 1267188 - protein, 18 aa, Mycobacterium
GSGGALGAGTTRNGSDGP

SEQ ID NO: 1267189 - protein, 24 aa, Mycobacterium
GSGGVPPPIGVPAGTPGTGGAGGV

SEQ ID NO: 1267190 - protein, 20 aa, Mycobacterium
GSGKGFCAGHVIAPDAYPEF

SEQ ID NO: 1267191 - protein, 22 aa, Mycobacterium
GSGKSTFLRCINHLETVNAGRL

SEQ ID NO: 1267192 - protein, 18 aa, Mycobacterium
GSGLHWTCASWLHEHEVA

SEQ ID NO: 1267193 - protein, 21 aa, Mycobacterium
GSGLNRPAAVIVETVQGEGGL

SEQ ID NO: 1267194 - protein, 17 aa, Mycobacterium
GSGMGFVVVSELCRVCM

SEQ ID NO: 1267195 - protein, 23 aa, Mycobacterium
GSGNPFLIAIDHHRVWYRYHHLF

SEQ ID NO: 1267196 - protein, 18 aa, Mycobacterium
GSGPAYFFLMVEALVDAA

SEQ ID NO: 1267197 - protein, 19 aa, Mycobacterium
GSGPAYFFLMVEALVDAAV

SEQ ID NO: 1267198 - protein, 20 aa, Mycobacterium
GSGPLRPGAAAVFDEVARAG

SEQ ID NO: 1267199 - protein, 18 aa, Mycobacterium
GSGRKYKKCHLGKEQPAL

SEQ ID NO: 1267200 - protein, 17 aa, Mycobacterium
GSGRLGSHNGLPVTVVV

SEQ ID NO: 1267201 - protein, 25 aa, Mycobacterium
GSGRLTVRCGLRCAHQGARTRRGRC

SEQ ID NO: 1267202 - protein, 28 aa, Mycobacterium
GSGSASCCWRWIAPWSRCSRRRGVSTCR

SEQ ID NO: 1267203 - protein, 20 aa, Mycobacterium
GSGSPRRGFGIDVGGSGVKG

SEQ ID NO: 1267204 - protein, 24 aa, Mycobacterium
GSGTSGPGAALWVLVDEVADPVIT

SEQ ID NO: 1267205 - protein, 17 aa, Mycobacterium
GSGVLQWAGRVISPHIA

SEQ ID NO: 1267206 - protein, 19 aa, Mycobacterium
GSGYEVYAHEKVARLVGIP

SEQ ID NO: 1267207 - protein, 23 aa, Mycobacterium
GSHFSGDIFLAFSTAEVPDLAST

SEQ ID NO: 1267208 - protein, 17 aa, Mycobacterium
GSHGAEFDSGFAHDIDH

SEQ ID NO: 1267209 - protein, 24 aa, Mycobacterium
GSHIPLCLDTGHLLIGGTDPLALT

SEQ ID NO: 1267210 - protein, 20 aa, Mycobacterium
GSHLPHAWVGDSRTKLALMD

SEQ ID NO: 1267211 - protein, 21 aa, Mycobacterium
GSHLRAPVLIGAMTGGAALSG

SEQ ID NO: 1267212 - protein, 19 aa, Mycobacterium
GSIGLEIAGYLAAHGARHL

SEQ ID NO: 1267213 - protein, 17 aa, Mycobacterium
GSITFLPWGRMDDLYAA

SEQ ID NO: 1267214 - protein, 17 aa, Mycobacterium
GSIWTRPGLSMRDKRMM

SEQ ID NO: 1267215 - protein, 23 aa, Mycobacterium
GSIYAFECPLLLGTQAVLMQRWD

SEQ ID NO: 1267216 - protein, 25 aa, Mycobacterium
GSKDMGADVVVAWPTAQIAVMGASG

SEQ ID NO: 1267217 - protein, 23 aa, Mycobacterium
GSKMQRFFVRNALVARLVSEAAF

SEQ ID NO: 1267218 - protein, 26 aa, Mycobacterium
GSKRWRGSQPTLWRAFAPGGERRAAL

SEQ ID NO: 1267219 - protein, 28 aa, Mycobacterium
GSLALRLPVRRPFAYEGVFGHLAASAVP

SEQ ID NO: 1267220 - protein, 28 aa, Mycobacterium
GSLGWADPRSGLSFGYVHNRLLTPLVLS

SEQ ID NO: 1267221 - protein, 18 aa, Mycobacterium
GSLIPLSHSGSYPSTEET

SEQ ID NO: 1267222 - protein, 19 aa, Mycobacterium
GSLMALIRLACQKAMRTGT

SEQ ID NO: 1267223 - protein, 18 aa, Mycobacterium
GSLMRTAPVALAYLDDEA

SEQ ID NO: 1267224 - protein, 24 aa, Mycobacterium
GSLPCNARELVAFRRQRRDEYRAL

SEQ ID NO: 1267225 - protein, 23 aa, Mycobacterium
GSLPEGGRMVAVFTDAKLVEEIA

SEQ ID NO: 1267226 - protein, 19 aa, Mycobacterium
GSLTMAFAITEPDAGSNSH

SEQ ID NO: 1267227 - protein, 29 aa, Mycobacterium
GSLVAGLGLRLPVIETRLGTFETASRIAA

SEQ ID NO: 1267228 - protein, 37 aa, Mycobacterium
GSLVAQLVWRRHRERVDGLVLCAGAAAVSRASYERLA

SEQ ID NO: 1267229 - protein, 28 aa, Mycobacterium
GSLVITGRLKLLIRSGGYNLSPFEIESV

SEQ ID NO: 1267230 - protein, 19 aa, Mycobacterium
GSMGGMIAQVFAARHRART

SEQ ID NO: 1267231 - protein, 27 aa, Mycobacterium
GSMSKSFWGGLRIGWIRAERSTLATVA

SEQ ID NO: 1267232 - protein, 25 aa, Mycobacterium
GSNGCRTRWAMGWSDDATESALRAV

SEQ ID NO: 1267233 - protein, 19 aa, Mycobacterium
GSNLARLEFQVGLERVLTR

SEQ ID NO: 1267234 - protein, 28 aa, Mycobacterium
GSNMADCHPILYLRMADRLKAGAKLIVV

SEQ ID NO: 1267235 - protein, 19 aa, Mycobacterium
GSNVARTVFKSMLTAVLDR

SEQ ID NO: 1267236 - protein, 28 aa, Mycobacterium
GSPDLPATVLPFILRGVTLAGIDSVLLP

SEQ ID NO: 1267237 - protein, 25 aa, Mycobacterium
GSPELARLLLSRGLGVEVGLFHADA

SEQ ID NO: 1267238 - protein, 20 aa, Mycobacterium
GSPGMGFVVISELCRVSMGV

SEQ ID NO: 1267239 - protein, 23 aa, Mycobacterium
GSPGRIRAVLVRRRGAAGRRDRR

SEQ ID NO: 1267240 - protein, 20 aa, Mycobacterium
GSPHELRSLFVPQGPSSMEK

SEQ ID NO: 1267241 - protein, 18 aa, Mycobacterium
GSPLRLRSLTTIGTPWEG

SEQ ID NO: 1267242 - protein, 23 aa, Mycobacterium
GSPRPTVGVEWEFALVDAHTRDL

SEQ ID NO: 1267243 - protein, 17 aa, Mycobacterium
GSQAALDAVRWAVDEAV

SEQ ID NO: 1267244 - protein, 24 aa, Mycobacterium
GSQAALNAVRWAAAEALALDASLR

SEQ ID NO: 1267245 - protein, 26 aa, Mycobacterium
GSQAARPVMFSTFLMWVLADLFTTLP

SEQ ID NO: 1267246 - protein, 20 aa, Mycobacterium
GSQFVPHCRISGSDDIAVTA

SEQ ID NO: 1267247 - protein, 18 aa, Mycobacterium
GSQGGPPTLTWYILPDNG

SEQ ID NO: 1267248 - protein, 17 aa, Mycobacterium
GSQQIRLFAPLKPAGRL

SEQ ID NO: 1267249 - protein, 18 aa, Mycobacterium
GSQTLPGWVSSNRPHIRS

SEQ ID NO: 1267250 - protein, 23 aa, Mycobacterium
GSQWPGMARQLLVDEPAFANALA

SEQ ID NO: 1267251 - protein, 18 aa, Mycobacterium
GSRAWDRLFSGPRPAELH

SEQ ID NO: 1267252 - protein, 23 aa, Mycobacterium
GSRLDELTARLAASGTTVVTAAA

SEQ ID NO: 1267253 - protein, 26 aa, Mycobacterium
GSRLLFPALCRPTAPVVVSSADLAPA

SEQ ID NO: 1267254 - protein, 23 aa, Mycobacterium
GSRNALSAALRGRLFEALREAQA

SEQ ID NO: 1267255 - protein, 17 aa, Mycobacterium
GSRPAAIRYRSGVDVVE

SEQ ID NO: 1267256 - protein, 18 aa, Mycobacterium
GSRPRMWRSVIKEFDIAE

SEQ ID NO: 1267257 - protein, 20 aa, Mycobacterium
GSRPYGWLDDRVSIHPTEAA

SEQ ID NO: 1267258 - protein, 23 aa, Mycobacterium
GSRRLCVPCAWAYSRQPTTQPPL

SEQ ID NO: 1267259 - protein, 24 aa, Mycobacterium
GSRSRLNLLVGDWDDALADADAVL

SEQ ID NO: 1267260 - protein, 22 aa, Mycobacterium
GSRVRFRHPLIRSTAYRSVALS

SEQ ID NO: 1267261 - protein, 18 aa, Mycobacterium
GSRYAEFFDIDWTLDPDC

SEQ ID NO: 1267262 - protein, 18 aa, Mycobacterium
GSSAGLVLIGFEFTSEAG

SEQ ID NO: 1267263 - protein, 25 aa, Mycobacterium
GSSAVFLQHPWKVLPDELIAPIEDA

SEQ ID NO: 1267264 - protein, 20 aa, Mycobacterium
GSSEYAVRMLKGMLDSLPPD

SEQ ID NO: 1267265 - protein, 17 aa, Mycobacterium
GSSGLAWVSQTATNTVI

SEQ ID NO: 1267266 - protein, 19 aa, Mycobacterium
GSSIMPGKVNPVIPEAVTQ

SEQ ID NO: 1267267 - protein, 23 aa, Mycobacterium
GSSIPNIVFGWDIEDTLMDCFTV

SEQ ID NO: 1267268 - protein, 18 aa, Mycobacterium
GSSRPPRLVRLAHLGGGR

SEQ ID NO: 1267269 - protein, 18 aa, Mycobacterium
GSSSYIWHLFDRLDDLRP

SEQ ID NO: 1267270 - protein, 29 aa, Mycobacterium
GSSTYWYARHLRLPPGVPAHLSGYLASMG

SEQ ID NO: 1267271 - protein, 28 aa, Mycobacterium
GSSVLAQMMWAFRAMGMWSDERGVNMLD

SEQ ID NO: 1267272 - protein, 23 aa, Mycobacterium
GSSYIPAGVFVPRSVRVLATDPL

SEQ ID NO: 1267273 - protein, 27 aa, Mycobacterium
GSSYVIVWADRFGRPLVTVESAKQMAC

SEQ ID NO: 1267274 - protein, 24 aa, Mycobacterium
GSTARLRPAPRRDTRFVVDINLGR

SEQ ID NO: 1267275 - protein, 25 aa, Mycobacterium
GSTGERGLHHLIWEVVDNAVDEAMA

SEQ ID NO: 1267276 - protein, 24 aa, Mycobacterium
GSTKGDGLLVVFGYPIAHENDVRR

SEQ ID NO: 1267277 - protein, 34 aa, Mycobacterium
GSTLFGSGVSPGFAELLAIVAGTACDRIDKITIA

SEQ ID NO: 1267278 - protein, 19 aa, Mycobacterium
GSTLGGFFGAAAFDEVALV

SEQ ID NO: 1267279 - protein, 24 aa, Mycobacterium
GSVAQRLWAKPAITVIGIDTTPIA

SEQ ID NO: 1267280 - protein, 25 aa, Mycobacterium
GSVARLRFGPATHRKVKKWLQQGQF

SEQ ID NO: 1267281 - protein, 26 aa, Mycobacterium
GSVAYRLGRSVARLEASLSAPSIFGR

SEQ ID NO: 1267282 - protein, 24 aa, Mycobacterium
GSVCAWTPEMVEQFGSAKRDSVGR

SEQ ID NO: 1267283 - protein, 21 aa, Mycobacterium
GSVDAFIDMAGAFVGKDVDVV

SEQ ID NO: 1267284 - protein, 17 aa, Mycobacterium
GSVDGAGVAMVRPESVT

SEQ ID NO: 1267285 - protein, 28 aa, Mycobacterium
GSVEHFNWLEALGFQFERSYYPGKVVVP

SEQ ID NO: 1267286 - protein, 25 aa, Mycobacterium
GSVGIPMRCVFALTAMGFLPQSPDS

SEQ ID NO: 1267287 - protein, 18 aa, Mycobacterium
GSVGKWLKKLLSSARKSG

SEQ ID NO: 1267288 - protein, 27 aa, Mycobacterium
GSVGTAIAYACLIRGSAGALALYDVNS

SEQ ID NO: 1267289 - protein, 24 aa, Mycobacterium
GSVKSDFYLGAAFEGPPGHVHGGV

SEQ ID NO: 1267290 - protein, 25 aa, Mycobacterium
GSVKSWKAVRYAAAPVGELRWRAPE

SEQ ID NO: 1267291 - protein, 19 aa, Mycobacterium
GSVLSGLFGAAAFDEVALV

SEQ ID NO: 1267292 - protein, 18 aa, Mycobacterium
GSVMLMLIGAAVRDHRQF

SEQ ID NO: 1267293 - protein, 25 aa, Mycobacterium
GSVPDIAGLAWRMTKDSRPWDILLA

SEQ ID NO: 1267294 - protein, 17 aa, Mycobacterium
GSVPPILVTSARGRQPR

SEQ ID NO: 1267295 - protein, 19 aa, Mycobacterium
GSVPYGGVCDVHRLQVQVA

SEQ ID NO: 1267296 - protein, 24 aa, Mycobacterium
GSVRGRITGYGWLASTGEYGLQGL

SEQ ID NO: 1267297 - protein, 23 aa, Mycobacterium
GSVSRLRGIAHLRGHETDRLAAL

SEQ ID NO: 1267298 - protein, 22 aa, Mycobacterium
GSVTGKCPAVLGAPDADLLVLA

SEQ ID NO: 1267299 - protein, 19 aa, Mycobacterium
GSVVSPLFSAFGPEPVATR

SEQ ID NO: 1267300 - protein, 20 aa, Mycobacterium
GSVWMTGKCASWYLDAHGNN

SEQ ID NO: 1267301 - protein, 26 aa, Mycobacterium
GSWAAEIYADLGLRFDGARAEAVSAA

SEQ ID NO: 1267302 - protein, 25 aa, Mycobacterium
GSWASEIYADLGLRFDGERAETIAE

SEQ ID NO: 1267303 - protein, 17 aa, Mycobacterium
GSWDFWGLDDDYRDGAF

SEQ ID NO: 1267304 - protein, 26 aa, Mycobacterium
GSYAPKLPWPWGLLDFAARVLKPAPG

SEQ ID NO: 1267305 - protein, 22 aa, Mycobacterium
GSYGPHRRGPLLADLGAEDGLM

SEQ ID NO: 1267306 - protein, 17 aa, Mycobacterium
GSYGRLIVTPDMEPPDA

SEQ ID NO: 1267307 - protein, 18 aa, Mycobacterium
GSYPEMRVHHSLTPDRLT

SEQ ID NO: 1267308 - protein, 26 aa, Mycobacterium
GSYREARIALGIARRLGHTGAVSYQD

SEQ ID NO: 1267309 - protein, 24 aa, Mycobacterium
GTAARGGEDLDLFFRVVTAGDTIA

SEQ ID NO: 1267310 - protein, 21 aa, Mycobacterium
GTACAHNPLPVVIPCHRVVRS

SEQ ID NO: 1267311 - protein, 25 aa, Mycobacterium
GTADGLTAWLLLSCRALHEGAREAL

SEQ ID NO: 1267312 - protein, 26 aa, Mycobacterium
GTAEIPKRLAAMLTEHLVLDAPVQLI

SEQ ID NO: 1267313 - protein, 24 aa, Mycobacterium
GTAGIGLACAQLMAREGADVVITG

SEQ ID NO: 1267314 - protein, 25 aa, Mycobacterium
GTAIVLGRPGGPAFRPSEVARLGYL

SEQ ID NO: 1267315 - protein, 35 aa, Mycobacterium
GTALLCPFDPLIFFRPRVERLFGGFHYRIEIYTPA

SEQ ID NO: 1267316 - protein, 22 aa, Mycobacterium
GTAMASLICHGDLNAPGRSTQR

SEQ ID NO: 1267317 - protein, 23 aa, Mycobacterium
GTANHPLLCLVDVGGVPTLLWKL

SEQ ID NO: 1267318 - protein, 18 aa, Mycobacterium
GTAPPTCEDANAILSEMF

SEQ ID NO: 1267319 - protein, 24 aa, Mycobacterium
GTARRAVVVGAGFIGCEVAASLRK

SEQ ID NO: 1267320 - protein, 20 aa, Mycobacterium
GTAYALTWALAHQARVRSLS

SEQ ID NO: 1267321 - protein, 20 aa, Mycobacterium
GTCMAIAGGVACYGTVAGRA

SEQ ID NO: 1267322 - protein, 17 aa, Mycobacterium
GTDCFSERARGRAGDAD

SEQ ID NO: 1267323 - protein, 18 aa, Mycobacterium
GTDFPRYRDAAAGGDSAW

SEQ ID NO: 1267324 - protein, 23 aa, Mycobacterium
GTDFTWDLLLVCGDPQAADTYYG

SEQ ID NO: 1267325 - protein, 18 aa, Mycobacterium
GTDGEIWVLGRIDDVMNI

SEQ ID NO: 1267326 - protein, 24 aa, Mycobacterium
GTDLKGREGMMYAQYIAAQAFNSG

SEQ ID NO: 1267327 - protein, 19 aa, Mycobacterium
GTDVARSAADFNLDGGQVY

SEQ ID NO: 1267328 - protein, 19 aa, Mycobacterium
GTEKLEFDNAIIATGSSTR

SEQ ID NO: 1267329 - protein, 24 aa, Mycobacterium
GTELFSRPGVHYLSGFYGPLERAL

SEQ ID NO: 1267330 - protein, 17 aa, Mycobacterium
GTFDVARGLRIARQLLL

SEQ ID NO: 1267331 - protein, 26 aa, Mycobacterium
GTFGNVLRFLPPLAISDELLLEGLDV

SEQ ID NO: 1267332 - protein, 23 aa, Mycobacterium
GTFRLIDKVFSLWGISYTAVALG

SEQ ID NO: 1267333 - protein, 17 aa, Mycobacterium
GTFSLLFGSGPGLGIAL

SEQ ID NO: 1267334 - protein, 26 aa, Mycobacterium
GTGAGVSGLWLLSGMREDGVLTTIDV

SEQ ID NO: 1267335 - protein, 17 aa, Mycobacterium
GTGARIVREGTREGHEY

SEQ ID NO: 1267336 - protein, 19 aa, Mycobacterium
GTGGFEWDQRLVEAYLRGP

SEQ ID NO: 1267337 - protein, 23 aa, Mycobacterium
GTGKSTLIRRFLAETDRNVVVVA

SEQ ID NO: 1267338 - protein, 18 aa, Mycobacterium
GTGLGGAEALVFAYDGLR

SEQ ID NO: 1267339 - protein, 24 aa, Mycobacterium
GTGRFLRERVPGVQIVAAEPRYGE

SEQ ID NO: 1267340 - protein, 22 aa, Mycobacterium
GTGRNALALARRGHPVDAVELT

SEQ ID NO: 1267341 - protein, 23 aa, Mycobacterium
GTGTEVTWRWTVYPRSAAAGLVM

SEQ ID NO: 1267342 - protein, 18 aa, Mycobacterium
GTGTGVCAMCYGRSMATG

SEQ ID NO: 1267343 - protein, 17 aa, Mycobacterium
GTGWIPYFLERVDRTYE

SEQ ID NO: 1267344 - protein, 32 aa, Mycobacterium
GTGWSRFSVDLIPAMGRAIFSRGFDPNIDYDR

SEQ ID NO: 1267345 - protein, 18 aa, Mycobacterium
GTHFCLGASLARVEATAI

SEQ ID NO: 1267346 - protein, 28 aa, Mycobacterium
GTHSSGIGVLRWLPAVPEALADDPQWGA

SEQ ID NO: 1267347 - protein, 18 aa, Mycobacterium
GTIAHGYHSLALIGGLIQ

SEQ ID NO: 1267348 - protein, 20 aa, Mycobacterium
GTICNREGGFLTSWQPDEFD

SEQ ID NO: 1267349 - protein, 24 aa, Mycobacterium
GTIKKGTVAAVRFLIEGLVDGAPA

SEQ ID NO: 1267350 - protein, 25 aa, Mycobacterium
GTIRNWPRRRYALSKTANTYARVLL

SEQ ID NO: 1267351 - protein, 21 aa, Mycobacterium
GTKTFRLGGHWEQDYVMVRSV

SEQ ID NO: 1267352 - protein, 17 aa, Mycobacterium
GTKVWTFLGPRPAGWWI

SEQ ID NO: 1267353 - protein, 17 aa, Mycobacterium
GTLAPKADPPWEVAPTV

SEQ ID NO: 1267354 - protein, 17 aa, Mycobacterium
GTLHAGLDIANAVGSPI

SEQ ID NO: 1267355 - protein, 19 aa, Mycobacterium
GTLKKVFLELGGKSAAIVL

SEQ ID NO: 1267356 - protein, 23 aa, Mycobacterium
GTLPEVDGALFAAALRHAVDLVE

SEQ ID NO: 1267357 - protein, 19 aa, Mycobacterium
GTLRLYGRDSLVVNTGGEK

SEQ ID NO: 1267358 - protein, 20 aa, Mycobacterium
GTLRRLHNAVALGLIDIGEF

SEQ ID NO: 1267359 - protein, 24 aa, Mycobacterium
GTLTVFHPQSFRAFASPLSSGVFV

SEQ ID NO: 1267360 - protein, 24 aa, Mycobacterium
GTLVCPWHGLRLGERRHGAWKPYP

SEQ ID NO: 1267361 - protein, 18 aa, Mycobacterium
GTLWGVGLGPGDPELVTV

SEQ ID NO: 1267362 - protein, 19 aa, Mycobacterium
GTMQLTHPAFMVLNSASGK

SEQ ID NO: 1267363 - protein, 24 aa, Mycobacterium
GTNRRARLALDYSVGSGPATVFAK

SEQ ID NO: 1267364 - protein, 24 aa, Mycobacterium
GTPEWSMTASLWMRGILGEHHGVD

SEQ ID NO: 1267365 - protein, 26 aa, Mycobacterium
GTPGAPALVCVHGFPTSGIDYSALAR

SEQ ID NO: 1267366 - protein, 24 aa, Mycobacterium
GTPGCGECRACATTMAGTHADVRR

SEQ ID NO: 1267367 - protein, 21 aa, Mycobacterium
GTPGLDLRAGIATQLRALGVR

SEQ ID NO: 1267368 - protein, 23 aa, Mycobacterium
GTPHPPVTLALPVPGDVRGLPPG

SEQ ID NO: 1267369 - protein, 17 aa, Mycobacterium
GTPSIFQETAFRFTDGS

SEQ ID NO: 1267370 - protein, 26 aa, Mycobacterium
GTPWPERRLPVPLIVALIGTHAADTA

SEQ ID NO: 1267371 - protein, 27 aa, Mycobacterium
GTPWPERRLPVPLIVALIGTHAADTAP

SEQ ID NO: 1267372 - protein, 21 aa, Mycobacterium
GTPYARMWGAYLTGMWIYRLS

SEQ ID NO: 1267373 - protein, 18 aa, Mycobacterium
GTPYLHAYTRSMTAWLCV

SEQ ID NO: 1267374 - protein, 21 aa, Mycobacterium
GTQACRVLRAEGLQVTLINSN

SEQ ID NO: 1267375 - protein, 18 aa, Mycobacterium
GTQARVWVADGRATALRR

SEQ ID NO: 1267376 - protein, 22 aa, Mycobacterium
GTQKRLAVWLVTDPMAVPQIAS

SEQ ID NO: 1267377 - protein, 18 aa, Mycobacterium
GTQLDWLIEQARRHKVRK

SEQ ID NO: 1267378 - protein, 22 aa, Mycobacterium
GTQRLSVFFFDLLHADGVDLLD

SEQ ID NO: 1267379 - protein, 18 aa, Mycobacterium
GTQRWCVALSGGADSLAL

SEQ ID NO: 1267380 - protein, 18 aa, Mycobacterium
GTQSLVLEVYQNVGGAHP

SEQ ID NO: 1267381 - protein, 31 aa, Mycobacterium
GTRLANPPLLVPVLRAGLGMVDQAHALIPEA

SEQ ID NO: 1267382 - protein, 26 aa, Mycobacterium
GTRLPDLKVFICGGASVPPSLIRRAA

SEQ ID NO: 1267383 - protein, 28 aa, Mycobacterium
GTRLPVAEAIGFMLEILPALGHLHSIGL

SEQ ID NO: 1267384 - protein, 24 aa, Mycobacterium
GTRPELQSQAAALNWDATAPATVI

SEQ ID NO: 1267385 - protein, 24 aa, Mycobacterium
GTRPRAGTLFTEVMGMISVIEHTR

SEQ ID NO: 1267386 - protein, 25 aa, Mycobacterium
GTRRAVARVTAWLLAPSDTGDAATD

SEQ ID NO: 1267387 - protein, 23 aa, Mycobacterium
GTRRIPAAEFFTGLWETALAADE

SEQ ID NO: 1267388 - protein, 17 aa, Mycobacterium
GTRRITAAVKRWETDTT

SEQ ID NO: 1267389 - protein, 24 aa, Mycobacterium
GTRRLAEVKLRLYTQLVTRARQKS

SEQ ID NO: 1267390 - protein, 23 aa, Mycobacterium
GTRTGCLFYEFGCRGPMTHSPCN

SEQ ID NO: 1267391 - protein, 18 aa, Mycobacterium
GTRVPAPVLAAVAHGELL

SEQ ID NO: 1267392 - protein, 22 aa, Mycobacterium
GTRVPTDGSLAYRDNGNTYVMN

SEQ ID NO: 1267393 - protein, 25 aa, Mycobacterium
GTRVTELLDRVGLADRRDFYPAQLS

SEQ ID NO: 1267394 - protein, 24 aa, Mycobacterium
GTSALRLAPAFGASRTIAVVSSQD

SEQ ID NO: 1267395 - protein, 17 aa, Mycobacterium
GTSKPAIYRRWRGKAHL

SEQ ID NO: 1267396 - protein, 20 aa, Mycobacterium
GTSLKAGEKIMLMFESANFD

SEQ ID NO: 1267397 - protein, 18 aa, Mycobacterium
GTSPCGSAVCGSAVCGSA

SEQ ID NO: 1267398 - protein, 19 aa, Mycobacterium
GTSQPGYYANDWGGHQDHV

SEQ ID NO: 1267399 - protein, 23 aa, Mycobacterium
GTSRLRLTARASLSEDEMTLARR

SEQ ID NO: 1267400 - protein, 23 aa, Mycobacterium
GTSVAGRELVAWRGSDGALLVAP

SEQ ID NO: 1267401 - protein, 20 aa, Mycobacterium
GTTAAIRFEVRGMKDGEVAV

SEQ ID NO: 1267402 - protein, 20 aa, Mycobacterium
GTTDRADWRDALTDWAVGLW

SEQ ID NO: 1267403 - protein, 18 aa, Mycobacterium
GTTEFKRSPGGLVTALEP

SEQ ID NO: 1267404 - protein, 17 aa, Mycobacterium
GTTGYCMGGRTSLVLAG

SEQ ID NO: 1267405 - protein, 21 aa, Mycobacterium
GTTIVALKCPGGVVMAGDRRA

SEQ ID NO: 1267406 - protein, 20 aa, Mycobacterium
GTTLAFWTQRGVYTVMDKSD

SEQ ID NO: 1267407 - protein, 25 aa, Mycobacterium
GTTSFYYRTRVALLQGVADHLARYD

SEQ ID NO: 1267408 - protein, 29 aa, Mycobacterium
GTVCAHFNMCLHRGMQVCRAEMGNASHFR

SEQ ID NO: 1267409 - protein, 17 aa, Mycobacterium
GTVFPLQVEPLFDVHPK

SEQ ID NO: 1267410 - protein, 20 aa, Mycobacterium
GTVLNARFSHPLVGDVVRDR

SEQ ID NO: 1267411 - protein, 18 aa, Mycobacterium
GTVMAAGFDSLVTDRTNR

SEQ ID NO: 1267412 - protein, 19 aa, Mycobacterium
GTVMPIAEVIRMAGHAHHY

SEQ ID NO: 1267413 - protein, 24 aa, Mycobacterium
GTVPMSRAFASSCNTTFAELASRM

SEQ ID NO: 1267414 - protein, 19 aa, Mycobacterium
GTVPSAWSGPAVVAPVEAP

SEQ ID NO: 1267415 - protein, 19 aa, Mycobacterium
GTVRFAAAHGFTVTVQATG

SEQ ID NO: 1267416 - protein, 18 aa, Mycobacterium
GTVRPLRCNAPERLAMAL

SEQ ID NO: 1267417 - protein, 23 aa, Mycobacterium
GTVRTRLNLISAIADAVDTTVSD

SEQ ID NO: 1267418 - protein, 19 aa, Mycobacterium
GTVVNARFAIMATGPLSAA

SEQ ID NO: 1267419 - protein, 17 aa, Mycobacterium
GTVWALRAANERLVTAQ

SEQ ID NO: 1267420 - protein, 18 aa, Mycobacterium
GTWASFVCDGMEEDAARA

SEQ ID NO: 1267421 - protein, 22 aa, Mycobacterium
GTWNGLRAAAAVMREQKRGAIV

SEQ ID NO: 1267422 - protein, 33 aa, Mycobacterium
GTYERRSLAIGSHWPFEQWGRFLPEQTTAVSIL

SEQ ID NO: 1267423 - protein, 27 aa, Mycobacterium
GTYGGFLAIRVFDFWVHERDITTPLGR

SEQ ID NO: 1267424 - protein, 29 aa, Mycobacterium
GVAAALCFPSYPQFCGQYFARARDKDLGL

SEQ ID NO: 1267425 - protein, 25 aa, Mycobacterium
GVAAAWEYAMSGSRVSNTRIIVEGF

SEQ ID NO: 1267426 - protein, 18 aa, Mycobacterium
GVAAGRRGPQALSLTLID

SEQ ID NO: 1267427 - protein, 22 aa, Mycobacterium
GVADDLLALFAHALKLPANPFA

SEQ ID NO: 1267428 - protein, 20 aa, Mycobacterium
GVAEFGRLDFVLANAGILPA

SEQ ID NO: 1267429 - protein, 22 aa, Mycobacterium
GVAGTRVTLRFDVGLIHASAGN

SEQ ID NO: 1267430 - protein, 24 aa, Mycobacterium
GVAIMSVREGIDFGTVVTTDSAPL

SEQ ID NO: 1267431 - protein, 27 aa, Mycobacterium
GVAKHYGVAVAICPARRGNRKGVVEKA

SEQ ID NO: 1267432 - protein, 26 aa, Mycobacterium
GVAKHYGVSVAICPPRSGHRKGGVEK

SEQ ID NO: 1267433 - protein, 21 aa, Mycobacterium
GVALSLVYRDGRLERGATRGD

SEQ ID NO: 1267434 - protein, 18 aa, Mycobacterium
GVALTRVGAFTIWIDPSV

SEQ ID NO: 1267435 - protein, 21 aa, Mycobacterium
GVARPGLPGDWPAGYDDPDQP

SEQ ID NO: 1267436 - protein, 19 aa, Mycobacterium
GVARRFGCSETDLRRALFE

SEQ ID NO: 1267437 - protein, 27 aa, Mycobacterium
GVARVIAGGDGMRWLRIAVETLNNEPS

SEQ ID NO: 1267438 - protein, 18 aa, Mycobacterium
GVAVTRVHHLLRQGQLLA

SEQ ID NO: 1267439 - protein, 18 aa, Mycobacterium
GVCGRLSYQGHYIRDYVY

SEQ ID NO: 1267440 - protein, 26 aa, Mycobacterium
GVCNPTTDIPLPWVRNEVTVLNLTGR

SEQ ID NO: 1267441 - protein, 26 aa, Mycobacterium
GVCPLQRCGWRARGFPAGTGPARRAQ

SEQ ID NO: 1267442 - protein, 25 aa, Mycobacterium
GVCSDRPKTAWLFGGQGNQFPGMAR

SEQ ID NO: 1267443 - protein, 19 aa, Mycobacterium
GVDALRVGVLPTPAVAYLT

SEQ ID NO: 1267444 - protein, 26 aa, Mycobacterium
GVDARWASSISGYWRRGRTEETFRQW

SEQ ID NO: 1267445 - protein, 24 aa, Mycobacterium
GVDASRLFLTQMIRHHEGAITMAQ

SEQ ID NO: 1267446 - protein, 25 aa, Mycobacterium
GVDASRLFLTQMIRHHEGAITMAQN

SEQ ID NO: 1267447 - protein, 23 aa, Mycobacterium
GVDESRALYEWNHAKQILRIQAG

SEQ ID NO: 1267448 - protein, 24 aa, Mycobacterium
GVDEVWAVGGAQAVALLAYGGVDT

SEQ ID NO: 1267449 - protein, 24 aa, Mycobacterium
GVDGFPNLFLVSGPGAPAVLANMV

SEQ ID NO: 1267450 - protein, 19 aa, Mycobacterium
GVDICRQLDGVMYAMATPE

SEQ ID NO: 1267451 - protein, 25 aa, Mycobacterium
GVDKFPRMVDYVLPSGVRIADADRV

SEQ ID NO: 1267452 - protein, 42 aa, Mycobacterium
GVDLEVGQLLGSGWKGGAATAFGTEWDKWHSGAGQVVRGLQT

SEQ ID NO: 1267453 - protein, 26 aa, Mycobacterium
GVDLLARRAREILGDIDIIVNNAGAT

SEQ ID NO: 1267454 - protein, 30 aa, Mycobacterium
GVDPFSLKGADLLKFRRRVQMVFQDPYASL

SEQ ID NO: 1267455 - protein, 20 aa, Mycobacterium
GVDPHWEWNAGLLHLRGQME

SEQ ID NO: 1267456 - protein, 22 aa, Mycobacterium
GVDTGRLLPLVVDLTDAAAVDG

SEQ ID NO: 1267457 - protein, 17 aa, Mycobacterium
GVDTLLLARWVAAVCQG

SEQ ID NO: 1267458 - protein, 18 aa, Mycobacterium
GVDVCLGEGFKAAPVDPR

SEQ ID NO: 1267459 - protein, 26 aa, Mycobacterium
GVDVHLALPVIRAFTHFALLANVAED

SEQ ID NO: 1267460 - protein, 17 aa, Mycobacterium
GVDVYPLQIGVGLEDVE

SEQ ID NO: 1267461 - protein, 18 aa, Mycobacterium
GVEDALLKLGARPGCAVT

SEQ ID NO: 1267462 - protein, 19 aa, Mycobacterium
GVEIFAVLPRRLRDDFDHD

SEQ ID NO: 1267463 - protein, 23 aa, Mycobacterium
GVENGRAALMVHLSHAVTDGVGG

SEQ ID NO: 1267464 - protein, 24 aa, Mycobacterium
GVEPIAVSGSFLWAPDPGPMEVVT

SEQ ID NO: 1267465 - protein, 19 aa, Mycobacterium
GVEPLAAAAARMITAATDS

SEQ ID NO: 1267466 - protein, 19 aa, Mycobacterium
GVEPLAAAAARMITAATRT

SEQ ID NO: 1267467 - protein, 18 aa, Mycobacterium
GVEPSEAIIQNWWRQGMM

SEQ ID NO: 1267468 - protein, 23 aa, Mycobacterium
GVERLARRFGRARKLGASIQLLG

SEQ ID NO: 1267469 - protein, 19 aa, Mycobacterium
GVEVRVCRTGYTGEHGYEL

SEQ ID NO: 1267470 - protein, 17 aa, Mycobacterium
GVFATTSMNVWANLRLV

SEQ ID NO: 1267471 - protein, 28 aa, Mycobacterium
GVFERMPALKFVWADGAADMLTPFIWRM

SEQ ID NO: 1267472 - protein, 25 aa, Mycobacterium
GVFGDAVALFPSWETLPHERLSPGV

SEQ ID NO: 1267473 - protein, 22 aa, Mycobacterium
GVFGPRVRWRAMLELLVGEGFP

SEQ ID NO: 1267474 - protein, 33 aa, Mycobacterium
GVFHGVKAFLPRMIAAGAPAWVWNLSSIGGVAA

SEQ ID NO: 1267475 - protein, 27 aa, Mycobacterium
GVFREPLPRIGLDSLPEQGAWLQPFRP

SEQ ID NO: 1267476 - protein, 17 aa, Mycobacterium
GVFRGALDAGARRITEK

SEQ ID NO: 1267477 - protein, 17 aa, Mycobacterium
GVFRIVEQLPRKVALEL

SEQ ID NO: 1267478 - protein, 18 aa, Mycobacterium
GVGCTRLAIHAVTEDGKE

SEQ ID NO: 1267479 - protein, 20 aa, Mycobacterium
GVGEALQLTSWLSGDAGDDG

SEQ ID NO: 1267480 - protein, 17 aa, Mycobacterium
GVGEDFWPAAYDPSVPD

SEQ ID NO: 1267481 - protein, 26 aa, Mycobacterium
GVGFFDGAVARRWRSAAPLWGDASFA

SEQ ID NO: 1267482 - protein, 20 aa, Mycobacterium
GVGGGWLFGDGGDGWSSTLA

SEQ ID NO: 1267483 - protein, 27 aa, Mycobacterium
GVGGPVEWHKMGSGWSWTRKAGTEIDH

SEQ ID NO: 1267484 - protein, 21 aa, Mycobacterium
GVGGVRAIRAFTELEGLHAPE

SEQ ID NO: 1267485 - protein, 17 aa, Mycobacterium
GVGIELTDRSLICLPST

SEQ ID NO: 1267486 - protein, 25 aa, Mycobacterium
GVGKGDRVILMLGNQVELWESMLAV

SEQ ID NO: 1267487 - protein, 17 aa, Mycobacterium
GVGPVLVRHLWERGVPD

SEQ ID NO: 1267488 - protein, 19 aa, Mycobacterium
GVGRQCGIEGFQQYLETKT

SEQ ID NO: 1267489 - protein, 23 aa, Mycobacterium
GVGSLKPRAVVVGGAVVARPTMR

SEQ ID NO: 1267490 - protein, 28 aa, Mycobacterium
GVGSRALAMAVGWACEREQFGRPIGSFQ

SEQ ID NO: 1267491 - protein, 26 aa, Mycobacterium
GVGTFSWPGAYGTWWQADPSADVILI

SEQ ID NO: 1267492 - protein, 23 aa, Mycobacterium
GVGTLRVGIVVPNPPFTGMPGGL

SEQ ID NO: 1267493 - protein, 23 aa, Mycobacterium
GVGYEERDAFGLPGLGNDVYSET

SEQ ID NO: 1267494 - protein, 25 aa, Mycobacterium
GVHAERILALFGHDNLQKVVSFCGP

SEQ ID NO: 1267495 - protein, 18 aa, Mycobacterium
GVHPTVWRVLSIAFDPLA

SEQ ID NO: 1267496 - protein, 19 aa, Mycobacterium
GVHPTVWRVLSIAFDPLAA

SEQ ID NO: 1267497 - protein, 23 aa, Mycobacterium
GVHPTVWRVLSIVFDPLAAFLTT

SEQ ID NO: 1267498 - protein, 24 aa, Mycobacterium
GVIGPDRRYVMAISSLDPDDDASA

SEQ ID NO: 1267499 - protein, 18 aa, Mycobacterium
GVINTVTKFFDNVLKPML

SEQ ID NO: 1267500 - protein, 23 aa, Mycobacterium
GVIRALWPGVLVLNTGRETDTDF

SEQ ID NO: 1267501 - protein, 22 aa, Mycobacterium
GVIRSRGRLWLANRPGHALWLE

SEQ ID NO: 1267502 - protein, 20 aa, Mycobacterium
GVISDIWLANLVAFISGRVS

SEQ ID NO: 1267503 - protein, 20 aa, Mycobacterium
GVISGRIAYTLGLAGPAITV

SEQ ID NO: 1267504 - protein, 25 aa, Mycobacterium
GVITAIPQPLRWVARSRGLRLARAQ

SEQ ID NO: 1267505 - protein, 23 aa, Mycobacterium
GVIWGIDSFDQWGVELGKTQAKA

SEQ ID NO: 1267506 - protein, 23 aa, Mycobacterium
GVIYRSPLRHLALIGTEQGSDEL

SEQ ID NO: 1267507 - protein, 34 aa, Mycobacterium
GVKFKDAELLGVPWIVVVGRGWADGIVELRDRFG

SEQ ID NO: 1267508 - protein, 17 aa, Mycobacterium
GVKQALVYYYFPTMDDL

SEQ ID NO: 1267509 - protein, 20 aa, Mycobacterium
GVKTESPPLFGVYNASKAAL

SEQ ID NO: 1267510 - protein, 36 aa, Mycobacterium
GVLAANWPRGADYALARACAAGALSTLVHGAGDCAP

SEQ ID NO: 1267511 - protein, 17 aa, Mycobacterium
GVLAPLADRGCITLAIH

SEQ ID NO: 1267512 - protein, 20 aa, Mycobacterium
GVLARAIVRLAMSYISMPPE

SEQ ID NO: 1267513 - protein, 17 aa, Mycobacterium
GVLARTVSDAALLLDAA

SEQ ID NO: 1267514 - protein, 30 aa, Mycobacterium
GVLARYPKLRFVSVESAVGWIPFLLESLDF

SEQ ID NO: 1267515 - protein, 25 aa, Mycobacterium
GVLDGKRATSHWAALPVLKTFGVQP

SEQ ID NO: 1267516 - protein, 21 aa, Mycobacterium
GVLDLLTRLGISPLPNTAGCR

SEQ ID NO: 1267517 - protein, 27 aa, Mycobacterium
GVLDRHRFGCTVSRAAWNPTESRWELS

SEQ ID NO: 1267518 - protein, 18 aa, Mycobacterium
GVLDVLWSLPSYERLADA

SEQ ID NO: 1267519 - protein, 30 aa, Mycobacterium
GVLGFKKSDEIYTFMDLWFYHCNPRHHSVA

SEQ ID NO: 1267520 - protein, 19 aa, Mycobacterium
GVLGHGLFTDRWWTEMVEP

SEQ ID NO: 1267521 - protein, 22 aa, Mycobacterium
GVLGKVRFLYFSPREYLVVFGS

SEQ ID NO: 1267522 - protein, 21 aa, Mycobacterium
GVLGPEFWAGGAEFGHAVPET

SEQ ID NO: 1267523 - protein, 18 aa, Mycobacterium
GVLGRGGAAFPLAVKLST

SEQ ID NO: 1267524 - protein, 26 aa, Mycobacterium
GVLGSLKRQGEWVVPSRLALHRRMGS

SEQ ID NO: 1267525 - protein, 23 aa, Mycobacterium
GVLPKADVSRAFFRSQCDTLRQA

SEQ ID NO: 1267526 - protein, 18 aa, Mycobacterium
GVLREVIQAGMRFVSAGP

SEQ ID NO: 1267527 - protein, 20 aa, Mycobacterium
GVLRRLAAMRSYMRDVNLGR

SEQ ID NO: 1267528 - protein, 25 aa, Mycobacterium
GVLSEWRANLIVRESACLSVEHRRQ

SEQ ID NO: 1267529 - protein, 20 aa, Mycobacterium
GVLSLPHGWGHDRGGTGQLL

SEQ ID NO: 1267530 - protein, 20 aa, Mycobacterium
GVLWSLKNVDGILDDSTVEI

SEQ ID NO: 1267531 - protein, 25 aa, Mycobacterium
GVMATGCCRELLTITSAITSPMTVS

SEQ ID NO: 1267532 - protein, 28 aa, Mycobacterium
GVMFDRLPPLFLEMALSFLAMDPPRHDK

SEQ ID NO: 1267533 - protein, 19 aa, Mycobacterium
GVMLAQRFGLGAADTCYLS

SEQ ID NO: 1267534 - protein, 18 aa, Mycobacterium
GVMSCSALKRSYRDQLRR

SEQ ID NO: 1267535 - protein, 22 aa, Mycobacterium
GVNGRDGSVFDSSYERGEPVDF

SEQ ID NO: 1267536 - protein, 25 aa, Mycobacterium
GVNHLPVTPGWNYLVRLYRPRPEVL

SEQ ID NO: 1267537 - protein, 26 aa, Mycobacterium
GVNRTLWSGMTWQYWLATRRFNKSEY

SEQ ID NO: 1267538 - protein, 19 aa, Mycobacterium
GVPADFNFTPGIHDIPEEP

SEQ ID NO: 1267539 - protein, 27 aa, Mycobacterium
GVPAICFACGYPTMHPGLCAYCRPGPM

SEQ ID NO: 1267540 - protein, 22 aa, Mycobacterium
GVPAKFDAVIARGMAKNAAERY

SEQ ID NO: 1267541 - protein, 23 aa, Mycobacterium
GVPDLRLADYAGRTLEWINVGQP

SEQ ID NO: 1267542 - protein, 24 aa, Mycobacterium
GVPDLRLADYTGRILEWVNVGQPD

SEQ ID NO: 1267543 - protein, 23 aa, Mycobacterium
GVPDLRLADYTGRTLEWINVGQP

SEQ ID NO: 1267544 - protein, 18 aa, Mycobacterium
GVPDPGGVRVVRAAEHRG

SEQ ID NO: 1267545 - protein, 24 aa, Mycobacterium
GVPFYRMADSFKGGYSGPEYIENF

SEQ ID NO: 1267546 - protein, 20 aa, Mycobacterium
GVPGCGDCRACTTTMAGTHA

SEQ ID NO: 1267547 - protein, 23 aa, Mycobacterium
GVPGCGECRACTTTMAGTHADVR

SEQ ID NO: 1267548 - protein, 18 aa, Mycobacterium
GVPMTSIMAEMFGKVQGC

SEQ ID NO: 1267549 - protein, 25 aa, Mycobacterium
GVPQTDYFALLALLARTLSEDEVVK

SEQ ID NO: 1267550 - protein, 20 aa, Mycobacterium
GVPRLSILFWSMGDVERAHR

SEQ ID NO: 1267551 - protein, 20 aa, Mycobacterium
GVPVARIIRPLWPVKPTDVV

SEQ ID NO: 1267552 - protein, 18 aa, Mycobacterium
GVPVAWEVAHALHAPLDV

SEQ ID NO: 1267553 - protein, 25 aa, Mycobacterium
GVQAIAVCLLWSFREPSHEQRVAAI

SEQ ID NO: 1267554 - protein, 25 aa, Mycobacterium
GVQCYHRYAAERGLWVTNSIVPPQA

SEQ ID NO: 1267555 - protein, 21 aa, Mycobacterium
GVQLYVKRVFIMGDCDQLMPP

SEQ ID NO: 1267556 - protein, 19 aa, Mycobacterium
GVRALEAFGRTSAVDDLTD

SEQ ID NO: 1267557 - protein, 17 aa, Mycobacterium
GVRCDWLDTSHAFHSAL

SEQ ID NO: 1267558 - protein, 23 aa, Mycobacterium
GVRDELKLSLAAVTVLRERYLQH

SEQ ID NO: 1267559 - protein, 24 aa, Mycobacterium
GVRDELPHSLAVVIDEVSPREDRD

SEQ ID NO: 1267560 - protein, 24 aa, Mycobacterium
GVRDLGVSIGRVPSRFVDNPILEL

SEQ ID NO: 1267561 - protein, 25 aa, Mycobacterium
GVRDWGRAFAWMGMPDEYFASSGNA

SEQ ID NO: 1267562 - protein, 24 aa, Mycobacterium
GVRGFEVMEQLAFGERQLRQALSA

SEQ ID NO: 1267563 - protein, 18 aa, Mycobacterium
GVRGRPHPDLVLTALMRA

SEQ ID NO: 1267564 - protein, 24 aa, Mycobacterium
GVRGSPTVLCAKGLEGVVAETLLP

SEQ ID NO: 1267565 - protein, 21 aa, Mycobacterium
GVRIVEISSFVAVPLAGMTLT

SEQ ID NO: 1267566 - protein, 25 aa, Mycobacterium
GVRPDAWGWLPLLTGVAVRDAVAEV

SEQ ID NO: 1267567 - protein, 24 aa, Mycobacterium
GVRQRWAREYSVSPNNPFGLLAHV

SEQ ID NO: 1267568 - protein, 24 aa, Mycobacterium
GVRTELRRATGLGFDISIEDAKIS

SEQ ID NO: 1267569 - protein, 21 aa, Mycobacterium
GVRVALIDGQWVAFPTVEQLE

SEQ ID NO: 1267570 - protein, 25 aa, Mycobacterium
GVRVDGNDVLACFAVMEQAAARARE

SEQ ID NO: 1267571 - protein, 18 aa, Mycobacterium
GVRVKHCADGGVRITVGG

SEQ ID NO: 1267572 - protein, 25 aa, Mycobacterium
GVSAEAALGLLRRNKIEKLPIVDGH

SEQ ID NO: 1267573 - protein, 19 aa, Mycobacterium
GVSARFAIAAAETVAASAR

SEQ ID NO: 1267574 - protein, 24 aa, Mycobacterium
GVSCVKPKGALYAFPRLDPEVYDV

SEQ ID NO: 1267575 - protein, 22 aa, Mycobacterium
GVSFQPEWWQRAAELGWASLLV

SEQ ID NO: 1267576 - protein, 19 aa, Mycobacterium
GVSHLNWYLGGRSASLSRL

SEQ ID NO: 1267577 - protein, 17 aa, Mycobacterium
GVSKALFYFYFPRKEDV

SEQ ID NO: 1267578 - protein, 23 aa, Mycobacterium
GVSKPIYRCMAAHVIRDQASVDD

SEQ ID NO: 1267579 - protein, 18 aa, Mycobacterium
GVSRGWLYRHFPDKVSLL

SEQ ID NO: 1267580 - protein, 22 aa, Mycobacterium
GVSRPTLYRYFADKRELLDVFV

SEQ ID NO: 1267581 - protein, 27 aa, Mycobacterium
GVSVFDMAAAVWLRGILQDHYGLDRFA

SEQ ID NO: 1267582 - protein, 24 aa, Mycobacterium
GVSVGDPRAPLLALDDTGRAELKT

SEQ ID NO: 1267583 - protein, 17 aa, Mycobacterium
GVTGWSEGDRVAVEPIY

SEQ ID NO: 1267584 - protein, 25 aa, Mycobacterium
GVTMRRVELTPAFRTTLALAVGQHA

SEQ ID NO: 1267585 - protein, 17 aa, Mycobacterium
GVTPAGLLHHFESKEQL

SEQ ID NO: 1267586 - protein, 25 aa, Mycobacterium
GVTRARVHLTLSWALARKPGGRQGR

SEQ ID NO: 1267587 - protein, 22 aa, Mycobacterium
GVTRSAFYFYFENKAAAVAALL

SEQ ID NO: 1267588 - protein, 24 aa, Mycobacterium
GVTRSGTSIREWLTALREAGLDTI

SEQ ID NO: 1267589 - protein, 24 aa, Mycobacterium
GVTVLRYAIRTEIRLITSELAIDL

SEQ ID NO: 1267590 - protein, 20 aa, Mycobacterium
GVVASLFGGLVRSLAAHLDV

SEQ ID NO: 1267591 - protein, 25 aa, Mycobacterium
GVVGRLRLAALALDSDRPLPVPDTC

SEQ ID NO: 1267592 - protein, 23 aa, Mycobacterium
GVVKQLRSGEGYQPGVLASFTAA

SEQ ID NO: 1267593 - protein, 17 aa, Mycobacterium
GVVLKIETASAFQNLPQ

SEQ ID NO: 1267594 - protein, 21 aa, Mycobacterium
GVVLRPGHRADLEPGFIGDEL

SEQ ID NO: 1267595 - protein, 30 aa, Mycobacterium
GVVMARYILELEPFASLPVEQIAETIGPNL

SEQ ID NO: 1267596 - protein, 19 aa, Mycobacterium
GVVMLDGAGIIGVLSADLA

SEQ ID NO: 1267597 - protein, 19 aa, Mycobacterium
GVVNPLRWRPHPWGEDLRE

SEQ ID NO: 1267598 - protein, 19 aa, Mycobacterium
GVVRPASRGRVWLSSAQPS

SEQ ID NO: 1267599 - protein, 17 aa, Mycobacterium
GVVSGPPWRLRATSVVD

SEQ ID NO: 1267600 - protein, 17 aa, Mycobacterium
GVVVPGQRGGPGHGTGQ

SEQ ID NO: 1267601 - protein, 24 aa, Mycobacterium
GVWGEVIFPSLGMWASTFRTPELL

SEQ ID NO: 1267602 - protein, 19 aa, Mycobacterium
GVWNVLRSAVPHLRAARSG

SEQ ID NO: 1267603 - protein, 21 aa, Mycobacterium
GVWTLESWTHLDVVKESYASG

SEQ ID NO: 1267604 - protein, 25 aa, Mycobacterium
GVWTRPFLARYGIDVPIRVIREQIV

SEQ ID NO: 1267605 - protein, 23 aa, Mycobacterium
GVYAICVSPTFVAAVSLLAPDAT

SEQ ID NO: 1267606 - protein, 19 aa, Mycobacterium
GVYRLKGTVAVRYRDRARR

SEQ ID NO: 1267607 - protein, 17 aa, Mycobacterium
GVYRPAGKYLYAALGMQ

SEQ ID NO: 1267608 - protein, 20 aa, Mycobacterium
GWAPRIRRFPARDDADHLAL

SEQ ID NO: 1267609 - protein, 18 aa, Mycobacterium
GWEPMGDQGLMFSGGENS

SEQ ID NO: 1267610 - protein, 19 aa, Mycobacterium
GWHVGPRIFPAGHAVTPYG

SEQ ID NO: 1267611 - protein, 19 aa, Mycobacterium
GWIDIKVVKEHSSEFIQAR

SEQ ID NO: 1267612 - protein, 19 aa, Mycobacterium
GWLALVRLLKCGPWHNGGW

SEQ ID NO: 1267613 - protein, 27 aa, Mycobacterium
GWLERDKVGLAYHYRPAMTREEHSANL

SEQ ID NO: 1267614 - protein, 18 aa, Mycobacterium
GWLLGDYILSDRQDKAVV

SEQ ID NO: 1267615 - protein, 22 aa, Mycobacterium
GWLRARRPAHGLTLLAEALGDG

SEQ ID NO: 1267616 - protein, 25 aa, Mycobacterium
GWLTDLERLHGLEAFVDDPAFRARW

SEQ ID NO: 1267617 - protein, 24 aa, Mycobacterium
GWLTPEARAYWDVIAAKYAAPGAS

SEQ ID NO: 1267618 - protein, 17 aa, Mycobacterium
GWMSLAGAMGGHTVVAK

SEQ ID NO: 1267619 - protein, 26 aa, Mycobacterium
GWPAAGDGWVPVRLSEPGPCEDDIGE

SEQ ID NO: 1267620 - protein, 26 aa, Mycobacterium
GWPEAPPRRLVFRSDIPKLPRALPRY

SEQ ID NO: 1267621 - protein, 20 aa, Mycobacterium
GWPEFPESIEFTIDQLTEHP

SEQ ID NO: 1267622 - protein, 19 aa, Mycobacterium
GWQTYGDVVVRFEQSPNLH

SEQ ID NO: 1267623 - protein, 26 aa, Mycobacterium
GWRNNGCGYRRFFSITSLAGLRQEDR

SEQ ID NO: 1267624 - protein, 26 aa, Mycobacterium
GWRPAGDGRLSLVDGLFLDIIKKAES

SEQ ID NO: 1267625 - protein, 27 aa, Mycobacterium
GWRPAGDGRLSLVDGLFLDIIKKAESN

SEQ ID NO: 1267626 - protein, 19 aa, Mycobacterium
GWSMLPLARTALRRIGNDT

SEQ ID NO: 1267627 - protein, 18 aa, Mycobacterium
GWSYAKFLLGNERTGITQ

SEQ ID NO: 1267628 - protein, 20 aa, Mycobacterium
GWTCTACLDAYLDAGAARWA

SEQ ID NO: 1267629 - protein, 18 aa, Mycobacterium
GWTDAFVTGAAFEQFLVE

SEQ ID NO: 1267630 - protein, 32 aa, Mycobacterium
GWTGVAWGGEPVPLWPDRVGEMSVRQIDGQTV

SEQ ID NO: 1267631 - protein, 23 aa, Mycobacterium
GWVQPHLPVPWGRASSPIEQIII

SEQ ID NO: 1267632 - protein, 17 aa, Mycobacterium
GWVYAAVVLDVYSRRVV

SEQ ID NO: 1267633 - protein, 24 aa, Mycobacterium
GYAAGELIGAIAMSEPGAGSDLAG

SEQ ID NO: 1267634 - protein, 20 aa, Mycobacterium
GYAGADWPAEFGGRDDRSAE

SEQ ID NO: 1267635 - protein, 18 aa, Mycobacterium
GYAIVGYALRFPGAADAD

SEQ ID NO: 1267636 - protein, 17 aa, Mycobacterium
GYAPLPIALPVAVSPTL

SEQ ID NO: 1267637 - protein, 24 aa, Mycobacterium
GYAVPTYPAEWFGRGYPNKLANVI

SEQ ID NO: 1267638 - protein, 17 aa, Mycobacterium
GYCGLPVQQSCPHANAC

SEQ ID NO: 1267639 - protein, 17 aa, Mycobacterium
GYCNVVGRIKDMVIRGG

SEQ ID NO: 1267640 - protein, 17 aa, Mycobacterium
GYDVKWAGAEVARERRV

SEQ ID NO: 1267641 - protein, 19 aa, Mycobacterium
GYEASEWAERAFAVTGPDH

SEQ ID NO: 1267642 - protein, 27 aa, Mycobacterium
GYEGEGFPVVRAFAGVNARDLDPFVHM

SEQ ID NO: 1267643 - protein, 25 aa, Mycobacterium
GYFEGADWLWKPIATNPVLATNSAT

SEQ ID NO: 1267644 - protein, 19 aa, Mycobacterium
GYGRTGPYAARPAYDDTIQ

SEQ ID NO: 1267645 - protein, 17 aa, Mycobacterium
GYGYGRDSNNPWLNQLY

SEQ ID NO: 1267646 - protein, 18 aa, Mycobacterium
GYHFPFVHGESVIGQNTL

SEQ ID NO: 1267647 - protein, 18 aa, Mycobacterium
GYHRELVEHFILEEKWGR

SEQ ID NO: 1267648 - protein, 27 aa, Mycobacterium
GYHRYEVVRPVPIWQGSIAPAMGQPGG

SEQ ID NO: 1267649 - protein, 22 aa, Mycobacterium
GYKISVPHAVRISPDGIYLHER

SEQ ID NO: 1267650 - protein, 23 aa, Mycobacterium
GYLFLHDRIKDMIVSGGENVYPV

SEQ ID NO: 1267651 - protein, 34 aa, Mycobacterium
GYLGKQLYIGFNFGESLVASLVFNGTDMLRGEGV

SEQ ID NO: 1267652 - protein, 25 aa, Mycobacterium
GYLVPHWPQPWGRAANVLEQLVIEE

SEQ ID NO: 1267653 - protein, 23 aa, Mycobacterium
GYMIKEYFMNYFLHTSDVTIDLA

SEQ ID NO: 1267654 - protein, 26 aa, Mycobacterium
GYPKVARLVLDAAVLKDSMVLAYRWP

SEQ ID NO: 1267655 - protein, 19 aa, Mycobacterium
GYPSIGCAPCTAKPIEGAD

SEQ ID NO: 1267656 - protein, 20 aa, Mycobacterium
GYQPAYRPAPRLDEHADAAA

SEQ ID NO: 1267657 - protein, 24 aa, Mycobacterium
GYRGDMAFSALIVGGGSSEYAVRM

SEQ ID NO: 1267658 - protein, 19 aa, Mycobacterium
GYRGFWMGYVAARSAPLGA

SEQ ID NO: 1267659 - protein, 18 aa, Mycobacterium
GYRHLRKSAVIGSGRERF

SEQ ID NO: 1267660 - protein, 24 aa, Mycobacterium
GYRLKSVAAKDIWVRPPSRVTVEK

SEQ ID NO: 1267661 - protein, 21 aa, Mycobacterium
GYRNGEEGYKEYLEAKTIGMP

SEQ ID NO: 1267662 - protein, 19 aa, Mycobacterium
GYRPPVTPFAGWVHDDRGR

SEQ ID NO: 1267663 - protein, 29 aa, Mycobacterium
GYRSLREIVLPLRRLTVITGANGTGKSSL

SEQ ID NO: 1267664 - protein, 18 aa, Mycobacterium
GYSGAALIGASPELLVAR

SEQ ID NO: 1267665 - protein, 25 aa, Mycobacterium
GYSGPEYIENFVIYPRSLGALTGWG

SEQ ID NO: 1267666 - protein, 17 aa, Mycobacterium
GYSWLDIPAEPDFARLR

SEQ ID NO: 1267667 - protein, 25 aa, Mycobacterium
GYSYYGEVLLDWIVERLANQKGSPD

SEQ ID NO: 1267668 - protein, 25 aa, Mycobacterium
GYSYYGEVLLDWVVERLANQKGSAD

SEQ ID NO: 1267669 - protein, 25 aa, Mycobacterium
GYTFDRLRDGLALRIKAMPEFREKI

SEQ ID NO: 1267670 - protein, 18 aa, Mycobacterium
GYTGLWSALHAARRHPDR

SEQ ID NO: 1267671 - protein, 23 aa, Mycobacterium
GYTIPDFRRRAVTIASGGVYDPR

SEQ ID NO: 1267672 - protein, 19 aa, Mycobacterium
GYVPMLFAAGLPRPVRRVP

SEQ ID NO: 1267673 - protein, 18 aa, Mycobacterium
GYWMPLFVVLADGVELTD

SEQ ID NO: 1267674 - protein, 23 aa, Mycobacterium
GYYPRLGVKDAYFLVRRGDTQTA

SEQ ID NO: 1267675 - protein, 35 aa, Mycobacterium
HAAALGWPGTEHQWLDGWLLRHGQGVTRRANSAVP

SEQ ID NO: 1267676 - protein, 17 aa, Mycobacterium
HAAAMQVVFDSLASDGH

SEQ ID NO: 1267677 - protein, 17 aa, Mycobacterium
HAAAYWRAKSKAGESVD

SEQ ID NO: 1267678 - protein, 18 aa, Mycobacterium
HAADRGGLSLLLYDVTTL

SEQ ID NO: 1267679 - protein, 25 aa, Mycobacterium
HAAHATELPFVWGNLVAGRRDPTFA

SEQ ID NO: 1267680 - protein, 24 aa, Mycobacterium
HAAILPLHYLTRAGVPPSDLQVIR

SEQ ID NO: 1267681 - protein, 20 aa, Mycobacterium
HAAKVLNMRSTLLTLAGGDP

SEQ ID NO: 1267682 - protein, 18 aa, Mycobacterium
HAALTAWLSDGRPALVTA

SEQ ID NO: 1267683 - protein, 17 aa, Mycobacterium
HAANNPKAHFYGKPITI

SEQ ID NO: 1267684 - protein, 20 aa, Mycobacterium
HAAPSVGMSQPWDFILVRSP

SEQ ID NO: 1267685 - protein, 29 aa, Mycobacterium
HAAVTEGMWGIPWDRPVRRLNEYLDGLLP

SEQ ID NO: 1267686 - protein, 19 aa, Mycobacterium
HACGVARHAGIKRVLAPPF

SEQ ID NO: 1267687 - protein, 21 aa, Mycobacterium
HADGGLVCWATSVLHPRVVQA

SEQ ID NO: 1267688 - protein, 17 aa, Mycobacterium
HADRPAFDISFVDSSDY

SEQ ID NO: 1267689 - protein, 17 aa, Mycobacterium
HADSCAQWLRWYDSEVM

SEQ ID NO: 1267690 - protein, 24 aa, Mycobacterium
HAEACRWEHVMSVDVERRLVQVLN

SEQ ID NO: 1267691 - protein, 26 aa, Mycobacterium
HAEAVIRSQWGWKRKAFAAASRPLTD

SEQ ID NO: 1267692 - protein, 21 aa, Mycobacterium
HAERLAALMITYPSTHGVYEH

SEQ ID NO: 1267693 - protein, 29 aa, Mycobacterium
HAERYGLDMWLRVGATWLSAVAALAALAD

SEQ ID NO: 1267694 - protein, 19 aa, Mycobacterium
HAESVVLPFLLADTPVVAW

SEQ ID NO: 1267695 - protein, 17 aa, Mycobacterium
HAEYKWVTVLFADVVRS

SEQ ID NO: 1267696 - protein, 19 aa, Mycobacterium
HAFDELGCVAVEFRTHYFN

SEQ ID NO: 1267697 - protein, 18 aa, Mycobacterium
HAFEMPYGPSVPALYGLI

SEQ ID NO: 1267698 - protein, 17 aa, Mycobacterium
HAFFRQYYNLRALLRRS

SEQ ID NO: 1267699 - protein, 19 aa, Mycobacterium
HAFMADRMVDGFGSLDEVA

SEQ ID NO: 1267700 - protein, 18 aa, Mycobacterium
HAFSEMFGERCVELPQGV

SEQ ID NO: 1267701 - protein, 18 aa, Mycobacterium
HAFSSIATLGHRSDDDCW

SEQ ID NO: 1267702 - protein, 17 aa, Mycobacterium
HAGDWQCVALLLEGDGT

SEQ ID NO: 1267703 - protein, 17 aa, Mycobacterium
HAGEVVFVHYARSAHEA

SEQ ID NO: 1267704 - protein, 17 aa, Mycobacterium
HAGIYIGDGMMVHASTY

SEQ ID NO: 1267705 - protein, 24 aa, Mycobacterium
HAGQACAATSRMLIHRSLYDQAVT

SEQ ID NO: 1267706 - protein, 25 aa, Mycobacterium
HAGQGCALTSRLLVPKKHKDELVEL

SEQ ID NO: 1267707 - protein, 27 aa, Mycobacterium
HAGRITLWRDYFDTVDFLKATVRGLLA

SEQ ID NO: 1267708 - protein, 17 aa, Mycobacterium
HAHGFAGADVYLGVDGT

SEQ ID NO: 1267709 - protein, 18 aa, Mycobacterium
HAHHNLSLGVANSITAVQ

SEQ ID NO: 1267710 - protein, 22 aa, Mycobacterium
HAHPRIADTAARQLRRLNTNSR

SEQ ID NO: 1267711 - protein, 22 aa, Mycobacterium
HAIVLPHVLAFNVSNAEEAQQR

SEQ ID NO: 1267712 - protein, 24 aa, Mycobacterium
HAKAEVLKLINWELASATDAAPSP

SEQ ID NO: 1267713 - protein, 19 aa, Mycobacterium
HAKEQKAKVLAICNTNGSQ

SEQ ID NO: 1267714 - protein, 22 aa, Mycobacterium
HAKGKLTARERILALLDEGSFV

SEQ ID NO: 1267715 - protein, 24 aa, Mycobacterium
HALAAIAHPLFRDELLAAADRAAP

SEQ ID NO: 1267716 - protein, 17 aa, Mycobacterium
HALALLLAAARQIPAAD

SEQ ID NO: 1267717 - protein, 23 aa, Mycobacterium
HALEYRHGRVYGHDSQSGTVMVS

SEQ ID NO: 1267718 - protein, 23 aa, Mycobacterium
HALEYRHNRIYGHDSQSGRVMMS

SEQ ID NO: 1267719 - protein, 17 aa, Mycobacterium
HALHAPLDVCLVRKLGV

SEQ ID NO: 1267720 - protein, 21 aa, Mycobacterium
HALHSPYWWLKCAVGTEKTNH

SEQ ID NO: 1267721 - protein, 21 aa, Mycobacterium
HALLASVPVSFDFSRDRISGN

SEQ ID NO: 1267722 - protein, 23 aa, Mycobacterium
HALLPLLTARPGGLLVEITDGTT

SEQ ID NO: 1267723 - protein, 18 aa, Mycobacterium
HALNEWLHEVWGFNYQGR

SEQ ID NO: 1267724 - protein, 19 aa, Mycobacterium
HALPARLLAEVLRLRGWHV

SEQ ID NO: 1267725 - protein, 24 aa, Mycobacterium
HALRAWPTPLGVAINSADPVWDSS

SEQ ID NO: 1267726 - protein, 21 aa, Mycobacterium
HALSRPTYRLLFDHPTDDRFT

SEQ ID NO: 1267727 - protein, 28 aa, Mycobacterium
HALWQWSVDDVEAFWGALWDYFDLGERA

SEQ ID NO: 1267728 - protein, 20 aa, Mycobacterium
HANGGLLLKDLRLPDFREYG

SEQ ID NO: 1267729 - protein, 17 aa, Mycobacterium
HANLLAEKGIAFIDAGV

SEQ ID NO: 1267730 - protein, 22 aa, Mycobacterium
HANRLKRSIGLDMSVAEGREVL

SEQ ID NO: 1267731 - protein, 18 aa, Mycobacterium
HANWKMVVENNVDGYHAL

SEQ ID NO: 1267732 - protein, 23 aa, Mycobacterium
HAPDAIPVLFGHVGEGNLHLNIL

SEQ ID NO: 1267733 - protein, 20 aa, Mycobacterium
HAPGADWGVVYARTGEGRDG

SEQ ID NO: 1267734 - protein, 26 aa, Mycobacterium
HAPKGAEWDAAVAVWRQLRTDEGAQF

SEQ ID NO: 1267735 - protein, 18 aa, Mycobacterium
HAPLLPLELAREFDAAGL

SEQ ID NO: 1267736 - protein, 17 aa, Mycobacterium
HAPSRKFYETVWGTDHG

SEQ ID NO: 1267737 - protein, 25 aa, Mycobacterium
HAQPICCPGCGPTLRYRDGDGRDTD

SEQ ID NO: 1267738 - protein, 20 aa, Mycobacterium
HAQWILDFVDTINIPADANE

SEQ ID NO: 1267739 - protein, 24 aa, Mycobacterium
HARASRARLTFALDRGDHGDLARL

SEQ ID NO: 1267740 - protein, 32 aa, Mycobacterium
HARDRGCTRPGCTAPGYWCQAHHASADFVDGG

SEQ ID NO: 1267741 - protein, 20 aa, Mycobacterium
HARGLGVLIDAVFNHLGPSG

SEQ ID NO: 1267742 - protein, 24 aa, Mycobacterium
HARGSEVLGRIGALGTLPDESLRA

SEQ ID NO: 1267743 - protein, 18 aa, Mycobacterium
HATAGLALIETGAGSDED

SEQ ID NO: 1267744 - protein, 23 aa, Mycobacterium
HATEMTRKLSLRASVTSEIHLDD

SEQ ID NO: 1267745 - protein, 17 aa, Mycobacterium
HATGKWLRQLPITLEAL

SEQ ID NO: 1267746 - protein, 18 aa, Mycobacterium
HATGRVGVCMATSGPGAT

SEQ ID NO: 1267747 - protein, 30 aa, Mycobacterium
HATVEPGARLNIPWNRDFNALVYVLSGRGA

SEQ ID NO: 1267748 - protein, 17 aa, Mycobacterium
HAVADLALAGWPKPPHP

SEQ ID NO: 1267749 - protein, 17 aa, Mycobacterium
HAVALRCQVRIEPLRRT

SEQ ID NO: 1267750 - protein, 18 aa, Mycobacterium
HAVARLILDLAVEHRGYP

SEQ ID NO: 1267751 - protein, 22 aa, Mycobacterium
HAVARLRVERDLELQLVAKLEA

SEQ ID NO: 1267752 - protein, 17 aa, Mycobacterium
HAVELLGTGAGTVVDHD

SEQ ID NO: 1267753 - protein, 24 aa, Mycobacterium
HAVGDSAIRACIRAGIDCIEHGFL

SEQ ID NO: 1267754 - protein, 19 aa, Mycobacterium
HAVPMVPTFDGEWTEPTWL

SEQ ID NO: 1267755 - protein, 19 aa, Mycobacterium
HAVWGMGFIAAPFVVDGLE

SEQ ID NO: 1267756 - protein, 23 aa, Mycobacterium
HAWDEPLEVIAMKAEGTFEYQAL

SEQ ID NO: 1267757 - protein, 23 aa, Mycobacterium
HAYCLRLLTARARTRAELSGKLT

SEQ ID NO: 1267758 - protein, 20 aa, Mycobacterium
HCADMALAVEASRATLWAAA

SEQ ID NO: 1267759 - protein, 17 aa, Mycobacterium
HCAEEAFAHFAQLVDAQ

SEQ ID NO: 1267760 - protein, 25 aa, Mycobacterium
HCFAGKDRTGFTIAVVLEAAGVDRD

SEQ ID NO: 1267761 - protein, 25 aa, Mycobacterium
HCFGCGEGGDVYAFLQKIEHVSFVE

SEQ ID NO: 1267762 - protein, 18 aa, Mycobacterium
HCGAELDSAVATMSAQGG

SEQ ID NO: 1267763 - protein, 32 aa, Mycobacterium
HCGLARDWITPRFGPRVGWLAGAHVSAKRHLA

SEQ ID NO: 1267764 - protein, 26 aa, Mycobacterium
HCHPHMLRHSFALRMLVTLIYAHERK

SEQ ID NO: 1267765 - protein, 23 aa, Mycobacterium
HCLPPRDWTEPGFMDLGMIYTAM

SEQ ID NO: 1267766 - protein, 19 aa, Mycobacterium
HCLPVTKRALVLAGGGIAG

SEQ ID NO: 1267767 - protein, 17 aa, Mycobacterium
HCQQVLGGIGFTEEHHL

SEQ ID NO: 1267768 - protein, 17 aa, Mycobacterium
HCRIHTFAADVGDESAV

SEQ ID NO: 1267769 - protein, 21 aa, Mycobacterium
HCRRARLLAYRVVALQSSGRI

SEQ ID NO: 1267770 - protein, 21 aa, Mycobacterium
HCTKCGHELIRPESRGAGLCA

SEQ ID NO: 1267771 - protein, 18 aa, Mycobacterium
HCTRGLGIWEWASTTTGE

SEQ ID NO: 1267772 - protein, 17 aa, Mycobacterium
HDADGFLGVAYVGYQGQ

SEQ ID NO: 1267773 - protein, 17 aa, Mycobacterium
HDADYIWLAARTDPEAA

SEQ ID NO: 1267774 - protein, 18 aa, Mycobacterium
HDAGLRPGDVVVLLSDNA

SEQ ID NO: 1267775 - protein, 19 aa, Mycobacterium
HDAHLYLRRAYGIAQFLGG

SEQ ID NO: 1267776 - protein, 23 aa, Mycobacterium
HDARRATGLPGHVRVVGQIPICW

SEQ ID NO: 1267777 - protein, 18 aa, Mycobacterium
HDDALDLDELVAWMKDRH

SEQ ID NO: 1267778 - protein, 19 aa, Mycobacterium
HDDWKHWGPGPGRGKWAGA

SEQ ID NO: 1267779 - protein, 18 aa, Mycobacterium
HDEDRFAEQLAEQGSSRE

SEQ ID NO: 1267780 - protein, 23 aa, Mycobacterium
HDEGWLAEHMLILKLISPENKAY

SEQ ID NO: 1267781 - protein, 17 aa, Mycobacterium
HDEIPGWDDMPDRLKPV

SEQ ID NO: 1267782 - protein, 25 aa, Mycobacterium
HDEVACLRSLEALGMLDTEVMLPGH

SEQ ID NO: 1267783 - protein, 17 aa, Mycobacterium
HDFEHWKPMWDALVDTD

SEQ ID NO: 1267784 - protein, 22 aa, Mycobacterium
HDFLNTRCLTIAGGTEQILLTL

SEQ ID NO: 1267785 - protein, 24 aa, Mycobacterium
HDGLDRFREAGVRKVWVYQALDDG

SEQ ID NO: 1267786 - protein, 22 aa, Mycobacterium
HDGLKALLRRLLGSGRLGSHNG

SEQ ID NO: 1267787 - protein, 19 aa, Mycobacterium
HDGQKFAWLRETKLLVDDE

SEQ ID NO: 1267788 - protein, 19 aa, Mycobacterium
HDGYAILVGYGLRTDWLKN

SEQ ID NO: 1267789 - protein, 24 aa, Mycobacterium
HDHHIHLRAAAAALHSVRVGPDEV

SEQ ID NO: 1267790 - protein, 19 aa, Mycobacterium
HDHMLRPSYGLAEATVFVA

SEQ ID NO: 1267791 - protein, 22 aa, Mycobacterium
HDIARRWSRHLVRPTARDAATG

SEQ ID NO: 1267792 - protein, 19 aa, Mycobacterium
HDIRETFGRMAMNDEETAA

SEQ ID NO: 1267793 - protein, 21 aa, Mycobacterium
HDIRPLFVLFDSCWDPLPRLG

SEQ ID NO: 1267794 - protein, 23 aa, Mycobacterium
HDIVLFPAWARRNPLPASPLDPP

SEQ ID NO: 1267795 - protein, 30 aa, Mycobacterium
HDKTPAQVLLRWSIQLGNVVIARSANPDRI

SEQ ID NO: 1267796 - protein, 20 aa, Mycobacterium
HDLEAMPDLIARVLDTSEPV

SEQ ID NO: 1267797 - protein, 27 aa, Mycobacterium
HDLFRRAGATNVRWMWSPDAICGGEVP

SEQ ID NO: 1267798 - protein, 18 aa, Mycobacterium
HDLGGALVLSEFTGAAAE

SEQ ID NO: 1267799 - protein, 17 aa, Mycobacterium
HDLHLYLRRATLYRSLY

SEQ ID NO: 1267800 - protein, 25 aa, Mycobacterium
HDLPERIMLCAKLAHVFGMLHRAGL

SEQ ID NO: 1267801 - protein, 18 aa, Mycobacterium
HDLPRGDLDRVTRQQAVM

SEQ ID NO: 1267802 - protein, 25 aa, Mycobacterium
HDLPRRWIQFLERWDPTRWPQRPDR

SEQ ID NO: 1267803 - protein, 18 aa, Mycobacterium
HDLREGVYCPAPARRVEI

SEQ ID NO: 1267804 - protein, 23 aa, Mycobacterium
HDLSSLRLLGSVGEPINPEAWRW

SEQ ID NO: 1267805 - protein, 17 aa, Mycobacterium
HDLTFRGDFPLNTAGGQ

SEQ ID NO: 1267806 - protein, 22 aa, Mycobacterium
HDMGDPIGAARRVREVIAEDGS

SEQ ID NO: 1267807 - protein, 17 aa, Mycobacterium
HDMGLTFLLTGFLTGAE

SEQ ID NO: 1267808 - protein, 17 aa, Mycobacterium
HDMPLRLVYVVDAGEHG

SEQ ID NO: 1267809 - protein, 28 aa, Mycobacterium
HDPRRFATDLLERFRDLIVLQAVPDAAA

SEQ ID NO: 1267810 - protein, 17 aa, Mycobacterium
HDPRYLVDLRRLCDEHG

SEQ ID NO: 1267811 - protein, 17 aa, Mycobacterium
HDPSVMVYAPLRTLIYE

SEQ ID NO: 1267812 - protein, 31 aa, Mycobacterium; identical to SEQ ID NO: 674373

SEQ ID NO: 1267813 - protein, 20 aa, Mycobacterium
HDRFRLLTGGSRTAVRRQQT

SEQ ID NO: 1267814 - protein, 17 aa, Mycobacterium
HDRLISWERAERVDVRA

SEQ ID NO: 1267815 - protein, 18 aa, Mycobacterium
HDRLNPKLSISGILITRY

SEQ ID NO: 1267816 - protein, 19 aa, Mycobacterium
HDRMEVLSWFLVERDAPEW

SEQ ID NO: 1267817 - protein, 23 aa, Mycobacterium
HDRPRRLAGLPAIDDVDPESLQR

SEQ ID NO: 1267818 - protein, 19 aa, Mycobacterium
HDRYGRWRIDGVTGPDEYT

SEQ ID NO: 1267819 - protein, 18 aa, Mycobacterium
HDTLPVLLGIDGSPASEN

SEQ ID NO: 1267820 - protein, 17 aa, Mycobacterium
HDVDFCVYPGQVTALVG

SEQ ID NO: 1267821 - protein, 17 aa, Mycobacterium
HDVGRKAIAQNAADIEA

SEQ ID NO: 1267822 - protein, 17 aa, Mycobacterium
HDVRLPFAHPVDDVTGL

SEQ ID NO: 1267823 - protein, 20 aa, Mycobacterium
HDVRYRFTRDGVMIDGHDDV

SEQ ID NO: 1267824 - protein, 24 aa, Mycobacterium
HDWLAELEYGFAMVDAQSAGSLAA

SEQ ID NO: 1267825 - protein, 18 aa, Mycobacterium
HDYYVLSRHADIWAAARD

SEQ ID NO: 1267826 - protein, 20 aa, Mycobacterium
HEADGTFVFVEQWADADALQ

SEQ ID NO: 1267827 - protein, 23 aa, Mycobacterium
HEAIRAAWERGWSPTDLHEIARR

SEQ ID NO: 1267828 - protein, 33 aa, Mycobacterium; identical to SEQ ID NO: 674427

SEQ ID NO: 1267829 - protein, 18 aa, Mycobacterium
HEALRLFAECKMARTAFG

SEQ ID NO: 1267830 - protein, 17 aa, Mycobacterium
HEALVHVERRARTGRVL

SEQ ID NO: 1267831 - protein, 25 aa, Mycobacterium
HEDHDRLCAFAADWNKRTWNPKAVV

SEQ ID NO: 1267832 - protein, 23 aa, Mycobacterium
HEESLPMFIVYRHEEIQQMLRDN

SEQ ID NO: 1267833 - protein, 17 aa, Mycobacterium
HEFASRIGVPADDFAAY

SEQ ID NO: 1267834 - protein, 17 aa, Mycobacterium
HEFGRCEPNSPAPNGGP

SEQ ID NO: 1267835 - protein, 22 aa, Mycobacterium
HEFLRRLGVGAGEVKALPQRQL

SEQ ID NO: 1267836 - protein, 20 aa, Mycobacterium
HEGPCLTCMHSLRPTISGSL

SEQ ID NO: 1267837 - protein, 24 aa, Mycobacterium
HEGPCVTCMLTGRVSVSGSLGSDE

SEQ ID NO: 1267838 - protein, 24 aa, Mycobacterium
HEHGYKLLADRYWDPMWAAAQDAN

SEQ ID NO: 1267839 - protein, 22 aa, Mycobacterium
HEIGEGTAAFAPFESLTPQLPG

SEQ ID NO: 1267840 - protein, 20 aa, Mycobacterium
HEKVAFPGVMLAQRFGLGAA

SEQ ID NO: 1267841 - protein, 23 aa, Mycobacterium
HELSPRALAWLFFNMAVSTTLRY

SEQ ID NO: 1267842 - protein, 18 aa, Mycobacterium
HELYLTDVIAIFRQDGLS

SEQ ID NO: 1267843 - protein, 19 aa, Mycobacterium
HEQRVAAIIREMAPQIYLT

SEQ ID NO: 1267844 - protein, 26 aa, Mycobacterium
HERTMMWLGFADRIANCIADFKPKNP

SEQ ID NO: 1267845 - protein, 22 aa, Mycobacterium
HERWRGSICLAIEEPEKSVEEI

SEQ ID NO: 1267846 - protein, 25 aa, Mycobacterium
HESAKRICKEAGYYGAGTVEYLVGQ

SEQ ID NO: 1267847 - protein, 19 aa, Mycobacterium
HETDRLAALSAEINGLGGQ

SEQ ID NO: 1267848 - protein, 24 aa, Mycobacterium
HETDRLAALSAELNRLGGQCEETD

SEQ ID NO: 1267849 - protein, 24 aa, Mycobacterium
HETRLLLRKCMHLLRDKQINRVQR

SEQ ID NO: 1267850 - protein, 19 aa, Mycobacterium
HEVLSRVTPSIVFCADEFA

SEQ ID NO: 1267851 - protein, 21 aa, Mycobacterium
HEVSWPRRAKLLDVLLDKGLD

SEQ ID NO: 1267852 - protein, 28 aa, Mycobacterium
HFADMPAYRAALVAAWGRLRDDDCRRLD

SEQ ID NO: 1267853 - protein, 24 aa, Mycobacterium
HFAVRAGSLIAWRSPDGSRALPFR

SEQ ID NO: 1267854 - protein, 18 aa, Mycobacterium
HFDDDRWELFHIEADRSQ

SEQ ID NO: 1267855 - protein, 23 aa, Mycobacterium
HFESKSAVLVALFDRVIDELLRD

SEQ ID NO: 1267856 - protein, 27 aa, Mycobacterium
HFFRAASRLPFFTAWLRDHRWLPDARY

SEQ ID NO: 1267857 - protein, 18 aa, Mycobacterium
HFGDKVLRTVIPRSVKVS

SEQ ID NO: 1267858 - protein, 20 aa, Mycobacterium
HFGSLHVLKDINLDVGQGQV

SEQ ID NO: 1267859 - protein, 19 aa, Mycobacterium
HFLAFAVPTIRGEIRRHFR

SEQ ID NO: 1267860 - protein, 23 aa, Mycobacterium
HFLAFAVPTIRGEIRRHFRDNTW

SEQ ID NO: 1267861 - protein, 18 aa, Mycobacterium
HFMPAALLESQFETLEPL

SEQ ID NO: 1267862 - protein, 22 aa, Mycobacterium
HFPGLQWPITLGHEIAGTVAEL

SEQ ID NO: 1267863 - protein, 22 aa, Mycobacterium
HFPQSFCFATIGGFAATRSSGQ

SEQ ID NO: 1267864 - protein, 23 aa, Mycobacterium
HFPRRSDLILAVIEREIDDCIEA

SEQ ID NO: 1267865 - protein, 19 aa, Mycobacterium
HFQVSRPSLREAVRVLESD

SEQ ID NO: 1267866 - protein, 19 aa, Mycobacterium
HFRHARLAIVHVVTEGGDE

SEQ ID NO: 1267867 - protein, 18 aa, Mycobacterium
HFRMINWGRLEGVSLDPP

SEQ ID NO: 1267868 - protein, 17 aa, Mycobacterium
HFSEAVEPWSYMKFPFL

SEQ ID NO: 1267869 - protein, 17 aa, Mycobacterium
HGAAVSVGLVFAAELGR

SEQ ID NO: 1267870 - protein, 19 aa, Mycobacterium
HGAKVLLLGIAFKNASDDL

SEQ ID NO: 1267871 - protein, 17 aa, Mycobacterium
HGALRKKPKPRKRGGGG

SEQ ID NO: 1267872 - protein, 19 aa, Mycobacterium
HGALRSAWIGYWVASERIG

SEQ ID NO: 1267873 - protein, 25 aa, Mycobacterium
HGANLHGRYLLPHFLIHDIAEVAAD

SEQ ID NO: 1267874 - protein, 26 aa, Mycobacterium
HGATLRHVYRGLAGMFLIDDDQQPPA

SEQ ID NO: 1267875 - protein, 28 aa, Mycobacterium
HGATVRRFNERFAAFGLADSAMRPSYGL

SEQ ID NO: 1267876 - protein, 19 aa, Mycobacterium
HGCDIRPSLTSFSRRADGG

SEQ ID NO: 1267877 - protein, 19 aa, Mycobacterium
HGCHRAQGFLLSRPIDGAA

SEQ ID NO: 1267878 - protein, 18 aa, Mycobacterium
HGDFKDIRGVMVHHTGSN

SEQ ID NO: 1267879 - protein, 24 aa, Mycobacterium
HGDFKYAINNSFGFGGHNVSLVFG

SEQ ID NO: 1267880 - protein, 27 aa, Mycobacterium
HGDFPWRPDRGYGRTRPVGSFPPNRYG

SEQ ID NO: 1267881 - protein, 23 aa, Mycobacterium
HGDGLAGGTCNYGFGAHTDLEWI

SEQ ID NO: 1267882 - protein, 26 aa, Mycobacterium
HGDPAHAVSILRVWAATQPHLHALTV

SEQ ID NO: 1267883 - protein, 19 aa, Mycobacterium
HGDPDWRRAVTLTLAEQIR

SEQ ID NO: 1267884 - protein, 21 aa, Mycobacterium
HGDSEISLWSSVSVGGVPATE

SEQ ID NO: 1267885 - protein, 23 aa, Mycobacterium
HGEDIRRPLGIKACYDAHAAAAA

SEQ ID NO: 1267886 - protein, 24 aa, Mycobacterium
HGEFRAVGYTSIYEDVEHVALVKG

SEQ ID NO: 1267887 - protein, 21 aa, Mycobacterium
HGFGLYLGVEMIRDPQTLTPA

SEQ ID NO: 1267888 - protein, 21 aa, Mycobacterium
HGFRFFDNRDLLGFVDGTENP

SEQ ID NO: 1267889 - protein, 18 aa, Mycobacterium
HGGAVPVRALHLVEPGVG

SEQ ID NO: 1267890 - protein, 20 aa, Mycobacterium
HGGDGGKAGLFRGDGGAGGA

SEQ ID NO: 1267891 - protein, 21 aa, Mycobacterium
HGGGRRPLITEALRGEGAKLI

SEQ ID NO: 1267892 - protein, 17 aa, Mycobacterium
HGGGWVFCDLDSHDGLC

SEQ ID NO: 1267893 - protein, 19 aa, Mycobacterium
HGGIWRISAVIDYVTKYCL

SEQ ID NO: 1267894 - protein, 20 aa, Mycobacterium
HGGLSRKLLEWHPSARLTVT

SEQ ID NO: 1267895 - protein, 23 aa, Mycobacterium
HGIDARLYWPGVGEVTPDELVLR

SEQ ID NO: 1267896 - protein, 20 aa, Mycobacterium
HGIGRGHALELAKHGATVII

SEQ ID NO: 1267897 - protein, 17 aa, Mycobacterium
HGIIAYPVTPFTSNGED

SEQ ID NO: 1267898 - protein, 19 aa, Mycobacterium
HGKIALITARLLSVRGDSV

SEQ ID NO: 1267899 - protein, 22 aa, Mycobacterium
HGLAAPGWPRSVGGLELSLEDQ

SEQ ID NO: 1267900 - protein, 20 aa, Mycobacterium
HGLHSGMWGGVVPDALSVLV

SEQ ID NO: 1267901 - protein, 24 aa, Mycobacterium
HGLMVPNWPVEWGGKDWTPIQHQI

SEQ ID NO: 1267902 - protein, 24 aa, Mycobacterium
HGLPLPTRRLLALAAAEPAGDAST

SEQ ID NO: 1267903 - protein, 18 aa, Mycobacterium
HGLRWPRQSTLVDTMIAA

SEQ ID NO: 1267904 - protein, 18 aa, Mycobacterium
HGMECLFHEKPFAGVNGS

SEQ ID NO: 1267905 - protein, 17 aa, Mycobacterium
HGNLEWLPGKTLGMSAA

SEQ ID NO: 1267906 - protein, 24 aa, Mycobacterium
HGNSVPRFHITWGTGPALVDIFAR

SEQ ID NO: 1267907 - protein, 25 aa, Mycobacterium
HGPQRWRIKANWKIGAENFAGDMYH

SEQ ID NO: 1267908 - protein, 21 aa, Mycobacterium
HGPTEAWTRPDVLNAMQHLQR

SEQ ID NO: 1267909 - protein, 17 aa, Mycobacterium
HGPVPRLRETGVITRAR

SEQ ID NO: 1267910 - protein, 22 aa, Mycobacterium
HGQCLMAAPTVFDLPDGSEQVV

SEQ ID NO: 1267911 - protein, 17 aa, Mycobacterium
HGQDIYDALGIEHPPSP

SEQ ID NO: 1267912 - protein, 29 aa, Mycobacterium
HGQRGAWLLRPFHESLLWYDARKESANRA

SEQ ID NO: 1267913 - protein, 27 aa, Mycobacterium
HGRANAIFLPHVLRYNASLPSKFMPAP

SEQ ID NO: 1267914 - protein, 28 aa, Mycobacterium
HGRDLVIGMVRCRIPVVAAVNGPAVGLG

SEQ ID NO: 1267915 - protein, 24 aa, Mycobacterium
HGREVLRDIEWRIAPGERTGILGA

SEQ ID NO: 1267916 - protein, 18 aa, Mycobacterium
HGRFHAHRILGPHDRLVA

SEQ ID NO: 1267917 - protein, 23 aa, Mycobacterium
HGRPAREVVCLQAATQFGSTSSA

SEQ ID NO: 1267918 - protein, 21 aa, Mycobacterium
HGRYAPFRWTFGARVGEQMIE

SEQ ID NO: 1267919 - protein, 20 aa, Mycobacterium
HGSGGYFLPAPVVKTPEMTD

SEQ ID NO: 1267920 - protein, 25 aa, Mycobacterium
HGSPHPQCRVGVGLGIPNGRRAQLR

SEQ ID NO: 1267921 - protein, 24 aa, Mycobacterium
HGSTLRFAPPLVITADEIDWAIDR

SEQ ID NO: 1267922 - protein, 17 aa, Mycobacterium
HGTDELDVWLISWVSNR

SEQ ID NO: 1267923 - protein, 17 aa, Mycobacterium
HGVAAGALVLLRRTSQT

SEQ ID NO: 1267924 - protein, 27 aa, Mycobacterium
HGVAVLSCREGLEFGTAVASDTAPLHG

SEQ ID NO: 1267925 - protein, 24 aa, Mycobacterium
HGVEPNMRWRTFCAELLNIADKLN

SEQ ID NO: 1267926 - protein, 26 aa, Mycobacterium
HGVGRLKRPWLAGQLGPEAMELNRRI

SEQ ID NO: 1267927 - protein, 23 aa, Mycobacterium
HGVKGFKFHPSMQAFEPNDRAYY

SEQ ID NO: 1267928 - protein, 34 aa, Mycobacterium
HGVSGYDVETCWHDYRLGVLQAPLITVLGTAFAS

SEQ ID NO: 1267929 - protein, 24 aa, Mycobacterium
HGVTAVPVPADWLARRRPGETITL

SEQ ID NO: 1267930 - protein, 19 aa, Mycobacterium
HGVTLGGPIAIEIGNTEWP

SEQ ID NO: 1267931 - protein, 27 aa, Mycobacterium
HGYRFDIPAGTAIRFEPGVAQHVRLIP

SEQ ID NO: 1267932 - protein, 26 aa, Mycobacterium
HHAYFPRLRLELEQGLGWKAGVEAAL

SEQ ID NO: 1267933 - protein, 19 aa, Mycobacterium
HHDEVLSPVLRFWNVFQRR

SEQ ID NO: 1267934 - protein, 18 aa, Mycobacterium
HHEMTFSLLYAFSENFVL

SEQ ID NO: 1267935 - protein, 19 aa, Mycobacterium
HHHRLHHRGVITITGPADQ

SEQ ID NO: 1267936 - protein, 17 aa, Mycobacterium
HHLFARMPDAKVHLYGK

SEQ ID NO: 1267937 - protein, 18 aa, Mycobacterium
HHLWAETRIELFTQATDT

SEQ ID NO: 1267938 - protein, 18 aa, Mycobacterium
HHPEQFRYAASLSGFLNL

SEQ ID NO: 1267939 - protein, 19 aa, Mycobacterium
HHRDADCVAIGYRIHKSGE

SEQ ID NO: 1267940 - protein, 18 aa, Mycobacterium
HHRLRPVFDELINADRPQ

SEQ ID NO: 1267941 - protein, 25 aa, Mycobacterium
HHSFHVCVVYPWVRFLDRDPATPLR

SEQ ID NO: 1267942 - protein, 22 aa, Mycobacterium
HHVAAWRAARLLVLDAFGTAEA

SEQ ID NO: 1267943 - protein, 29 aa, Mycobacterium
HHVFKEWADRYSGVFDMGYERYREIVLEN

SEQ ID NO: 1267944 - protein, 20 aa, Mycobacterium
HIAAGIGLARSYRAQQRRAE

SEQ ID NO: 1267945 - protein, 22 aa, Mycobacterium
HIATLIPDEWLAPSATGSPQQC

SEQ ID NO: 1267946 - protein, 21 aa, Mycobacterium
HIDDVRWTDIVSRVFGRIDPL

SEQ ID NO: 1267947 - protein, 24 aa, Mycobacterium
HIEPGELVALLGPSGCGKTTALRI

SEQ ID NO: 1267948 - protein, 18 aa, Mycobacterium
HIGDYGIGFCLDTCHAWA

SEQ ID NO: 1267949 - protein, 35 aa, Mycobacterium; identical to SEQ ID NO: 675085

SEQ ID NO: 1267950 - protein, 34 aa, Mycobacterium; identical to SEQ ID NO: 675088

SEQ ID NO: 1267951 - protein, 29 aa, Mycobacterium
HIKKLVGRLEKRFSPRMRLAVTAALEHYT

SEQ ID NO: 1267952 - protein, 17 aa, Mycobacterium
HILADSRAQAWLGELPE

SEQ ID NO: 1267953 - protein, 17 aa, Mycobacterium
HILEVQRLIRFMPKPVI

SEQ ID NO: 1267954 - protein, 26 aa, Mycobacterium
HIPGSQLPGFAWLAGLVTNSPAVGSL

SEQ ID NO: 1267955 - protein, 24 aa, Mycobacterium
HIPWDRLAVEVVKETIPWERDGGP

SEQ ID NO: 1267956 - protein, 17 aa, Mycobacterium
HIQRLAAEHGVKYVTLE

SEQ ID NO: 1267957 - protein, 40 aa, Mycobacterium
HIRFRGRRAAMRLSREYRSWPVWAHDAAMIYTPGRDDTTG

SEQ ID NO: 1267958 - protein, 41 aa, Mycobacterium
HIRFRGRRAAMRLSREYRSWPVWAHDAAMIYTPGRDDTTGE

SEQ ID NO: 1267959 - protein, 22 aa, Mycobacterium
HISGESLGGWVAARFAADRPER

SEQ ID NO: 1267960 - protein, 25 aa, Mycobacterium
HISQNWRLSGLAGEYITPVPAQQRL

SEQ ID NO: 1267961 - protein, 27 aa, Mycobacterium
HISTLLLTLLFRFMKPLVENGHIFLAQ

SEQ ID NO: 1267962 - protein, 28 aa, Mycobacterium
HIVIDGWSLPLFVGELLTLYRAGGDPGA

SEQ ID NO: 1267963 - protein, 20 aa, Mycobacterium
HKADAPSGTAMRTARLIAEA

SEQ ID NO: 1267964 - protein, 18 aa, Mycobacterium
HKDAIAAAAAEFFPLSGA

SEQ ID NO: 1267965 - protein, 22 aa, Mycobacterium
HKGAVFAKGVLLWPRDRLDEAQ

SEQ ID NO: 1267966 - protein, 23 aa, Mycobacterium
HKLHLRPHTPRYLGDVLGPGDLV

SEQ ID NO: 1267967 - protein, 20 aa, Mycobacterium
HKLMTPMFVPPRHPYGDPRV

SEQ ID NO: 1267968 - protein, 19 aa, Mycobacterium
HKQRTGMPHVTWKFATSVD

SEQ ID NO: 1267969 - protein, 26 aa, Mycobacterium
HKREDKPYWWGHFDRVNNPVDEWADD

SEQ ID NO: 1267970 - protein, 19 aa, Mycobacterium
HKSVLAGLVQVGARPVWLE

SEQ ID NO: 1267971 - protein, 24 aa, Mycobacterium
HKTMGIPILYPWANRLSSNGYGVD

SEQ ID NO: 1267972 - protein, 19 aa, Mycobacterium
HKTVHHYLMRFSGGELSDE

SEQ ID NO: 1267973 - protein, 20 aa, Mycobacterium
HKVGGWRRAPGPAHLDEVRA

SEQ ID NO: 1267974 - protein, 17 aa, Mycobacterium
HKVLAVWANRGRIAGRC

SEQ ID NO: 1267975 - protein, 18 aa, Mycobacterium
HLAAAAWVGHEGEDTKNI

SEQ ID NO: 1267976 - protein, 23 aa, Mycobacterium
HLAERGWVCLSIDYRVAPHNPWP

SEQ ID NO: 1267977 - protein, 18 aa, Mycobacterium
HLAIALAHLRSGRVQLVV

SEQ ID NO: 1267978 - protein, 25 aa, Mycobacterium
HLAIAMRPKLWMFNSVGNLGHDSEG

SEQ ID NO: 1267979 - protein, 25 aa, Mycobacterium
HLAKLRLAGLVKGRREGTFVFYSAA

SEQ ID NO: 1267980 - protein, 18 aa, Mycobacterium
HLAPARAALRSWLTSARV

SEQ ID NO: 1267981 - protein, 26 aa, Mycobacterium
HLAPRPGTDAALLFAVAHVLFDENLV

SEQ ID NO: 1267982 - protein, 17 aa, Mycobacterium
HLASCEFDAALEVIGRS

SEQ ID NO: 1267983 - protein, 18 aa, Mycobacterium
HLCGPDIIVWSGIELLCL

SEQ ID NO: 1267984 - protein, 18 aa, Mycobacterium
HLDADWVLLALADGALPE

SEQ ID NO: 1267985 - protein, 24 aa, Mycobacterium
HLDDEICRILARLGVAEEFARISR

SEQ ID NO: 1267986 - protein, 17 aa, Mycobacterium
HLDFHPTMEDYFDAKAR

SEQ ID NO: 1267987 - protein, 19 aa, Mycobacterium
HLDNRVTLLDALREHLGVT

SEQ ID NO: 1267988 - protein, 31 aa, Mycobacterium
HLDQLELLWIPRAEPTRLFRIGEQPPLRGTM

SEQ ID NO: 1267989 - protein, 19 aa, Mycobacterium
HLEMARRDPVYKFVLAEVD

SEQ ID NO: 1267990 - protein, 18 aa, Mycobacterium
HLERMLSLDNVFTPDELA

SEQ ID NO: 1267991 - protein, 19 aa, Mycobacterium
HLFEFPKIDADAVDEVLIM

SEQ ID NO: 1267992 - protein, 30 aa, Mycobacterium
HLGELTSWAAWRRWRDAVVDRYRRQGQHCP

SEQ ID NO: 1267993 - protein, 23 aa, Mycobacterium
HLGSWRPGLSYIELAEQLTDYVV

SEQ ID NO: 1267994 - protein, 17 aa, Mycobacterium
HLGTFVLNAGFYRPALL

SEQ ID NO: 1267995 - protein, 17 aa, Mycobacterium
HLHARLNGLKGRGVLAV

SEQ ID NO: 1267996 - protein, 24 aa, Mycobacterium
HLHGGRFSHLLAVYLAAHLEQLRP

SEQ ID NO: 1267997 - protein, 24 aa, Mycobacterium
HLHIPRTTWYDGVRFEEVSVGYPR

SEQ ID NO: 1267998 - protein, 31 aa, Mycobacterium
HLHLRRPSPHIPWERLPVRVVAEATPWQRND

SEQ ID NO: 1267999 - protein, 17 aa, Mycobacterium
HLHPSRVAVSAGDEVRL

SEQ ID NO: 1268000 - protein, 19 aa, Mycobacterium
HLIDTARPFIFDTGLAPAA

SEQ ID NO: 1268001 - protein, 22 aa, Mycobacterium
HLIEVNAGPVLKVQPNLRYATD

SEQ ID NO: 1268002 - protein, 20 aa, Mycobacterium
HLIGVLARVAALGNGENPFA

SEQ ID NO: 1268003 - protein, 17 aa, Mycobacterium
HLITRGGGSIVLVSSIA

SEQ ID NO: 1268004 - protein, 21 aa, Mycobacterium
HLKIDFDEHARWFVMHRGALA

SEQ ID NO: 1268005 - protein, 27 aa, Mycobacterium
HLLAPLALAPRGIWFAPKDLRLFYQVR

SEQ ID NO: 1268006 - protein, 19 aa, Mycobacterium
HLLARLAALGQVYYFDQDL

SEQ ID NO: 1268007 - protein, 20 aa, Mycobacterium
HLLREFELLEPLRARLAEGM

SEQ ID NO: 1268008 - protein, 23 aa, Mycobacterium
HLMCVGSGRPLEEAWRAGQVEMI

SEQ ID NO: 1268009 - protein, 23 aa, Mycobacterium
HLMSWRPGLSYVELADQLTEYVV

SEQ ID NO: 1268010 - protein, 19 aa, Mycobacterium
HLNPFPANLGEVLARYRKV

SEQ ID NO: 1268011 - protein, 24 aa, Mycobacterium
HLNRHLYENVCWIDSRSPELLAAR

SEQ ID NO: 1268012 - protein, 21 aa, Mycobacterium
HLNSVCQRLGISIQPARLRQP

SEQ ID NO: 1268013 - protein, 21 aa, Mycobacterium
HLPEHAREAIMFRNGIETYKL

SEQ ID NO: 1268014 - protein, 20 aa, Mycobacterium
HLPGDWTIGPGCVAGIDVRW

SEQ ID NO: 1268015 - protein, 33 aa, Mycobacterium
HLPLGKWMFSRAVCLKAPYFRTIHPAIEELRPG

SEQ ID NO: 1268016 - protein, 19 aa, Mycobacterium
HLPMLAWMTEVVAKATVAA

SEQ ID NO: 1268017 - protein, 26 aa, Mycobacterium
HLPPRQRAVLVLREVLQWKAAEVGEA

SEQ ID NO: 1268018 - protein, 23 aa, Mycobacterium
HLPQARAKLRIDLDEIRRINPAI

SEQ ID NO: 1268019 - protein, 25 aa, Mycobacterium
HLPSARRLLLFKADGSVSVHADDRA

SEQ ID NO: 1268020 - protein, 22 aa, Mycobacterium
HLQRELQQILGLAQPPAATGRF

SEQ ID NO: 1268021 - protein, 23 aa, Mycobacterium
HLQRKGFEFKELEAAGLSREGRR

SEQ ID NO: 1268022 - protein, 17 aa, Mycobacterium
HLRALRSGWTVAPVLTF

SEQ ID NO: 1268023 - protein, 18 aa, Mycobacterium
HLRGHTPGSIALALHGPA

SEQ ID NO: 1268024 - protein, 19 aa, Mycobacterium
HLRIRAWPLELINGKPLDP

SEQ ID NO: 1268025 - protein, 25 aa, Mycobacterium
HLRRVRQSKTYPVWRLAHPYDPDIA

SEQ ID NO: 1268026 - protein, 20 aa, Mycobacterium
HLSGAPAMSGFRAAADKAAP

SEQ ID NO: 1268027 - protein, 19 aa, Mycobacterium
HLSSIYRKLGVSDRTAAAA

SEQ ID NO: 1268028 - protein, 17 aa, Mycobacterium
HLSYRVCLKTFSASESR

SEQ ID NO: 1268029 - protein, 19 aa, Mycobacterium
HLTHLPLGIMVEFDPDEVV

SEQ ID NO: 1268030 - protein, 19 aa, Mycobacterium
HLTLVPALRDALAEVGRPD

SEQ ID NO: 1268031 - protein, 23 aa, Mycobacterium
HLTPGMVHGFFGLDEVFPTATEA

SEQ ID NO: 1268032 - protein, 28 aa, Mycobacterium
HLTRRIRTWLSFPQWFYLNVPVNTLTAP

SEQ ID NO: 1268033 - protein, 19 aa, Mycobacterium
HLVANSWRRLARSFWGDLG

SEQ ID NO: 1268034 - protein, 24 aa, Mycobacterium
HLVEMLVAVVWGMGFYAGFVGDRS

SEQ ID NO: 1268035 - protein, 19 aa, Mycobacterium
HLVEPLGFDLSEPKLRRAG

SEQ ID NO: 1268036 - protein, 30 aa, Mycobacterium
HLVEQFRYPIGMRRWEFPQGTAPGRADLDA

SEQ ID NO: 1268037 - protein, 23 aa, Mycobacterium
HLVRRSVWIVGGDGWAYDIGSGG

SEQ ID NO: 1268038 - protein, 30 aa, Mycobacterium
HLYAIPRFVNRWAVSLAYLTDVFFARSVVS

SEQ ID NO: 1268039 - protein, 24 aa, Mycobacterium
HLYCYSFEPSNHWQHFFAEQPELA

SEQ ID NO: 1268040 - protein, 18 aa, Mycobacterium
HLYEKWSATLDFEVPSFD

SEQ ID NO: 1268041 - protein, 31 aa, Mycobacterium
HLYQLRPEYRLDGAPLWQLRTDDLDTEHPRF

SEQ ID NO: 1268042 - protein, 25 aa, Mycobacterium
HMFFHRLGPVLARRLLLTGDIIRAG

SEQ ID NO: 1268043 - protein, 21 aa, Mycobacterium
HMHVVPRWGGDANFITVIGDS

SEQ ID NO: 1268044 - protein, 21 aa, Mycobacterium
HMIFPKPGVDLSDPANFASIG

SEQ ID NO: 1268045 - protein, 17 aa, Mycobacterium
HMKEMTADAPVMLDHLS

SEQ ID NO: 1268046 - protein, 23 aa, Mycobacterium
HMKEPGRWTGWVKIDGERISVDG

SEQ ID NO: 1268047 - protein, 25 aa, Mycobacterium
HMLERARWAARAYADYDQAAVSAIT

SEQ ID NO: 1268048 - protein, 19 aa, Mycobacterium
HMNGFPGGPPPRLALSLGD

SEQ ID NO: 1268049 - protein, 20 aa, Mycobacterium
HNAGEFDAVVALFGNGVTEL

SEQ ID NO: 1268050 - protein, 24 aa, Mycobacterium
HNAGRSQMALGFLTHLAGDKVVGW

SEQ ID NO: 1268051 - protein, 21 aa, Mycobacterium
HNEGLYRVFRPDLKEPTREEA

SEQ ID NO: 1268052 - protein, 17 aa, Mycobacterium
HNFKGLIFACWDPAAPD

SEQ ID NO: 1268053 - protein, 25 aa, Mycobacterium
HNGELPAVRVGRSFRVHAKAVHDML

SEQ ID NO: 1268054 - protein, 27 aa, Mycobacterium
HNHARKVFRETVGWVLTERAVSRIGRG

SEQ ID NO: 1268055 - protein, 18 aa, Mycobacterium
HNLRELAEAVYWCLENYE

SEQ ID NO: 1268056 - protein, 18 aa, Mycobacterium
HNLVHGFILAAQHLVDGG

SEQ ID NO: 1268057 - protein, 26 aa, Mycobacterium
HNPILRMMLGHLLKPGRLREILAGHA

SEQ ID NO: 1268058 - protein, 19 aa, Mycobacterium
HNPQFAFTRVDAASGVTPD

SEQ ID NO: 1268059 - protein, 19 aa, Mycobacterium
HNRSWNCGVEGPSDDPEVL

SEQ ID NO: 1268060 - protein, 19 aa, Mycobacterium
HNRSWNCGVEGPTDDPQVN

SEQ ID NO: 1268061 - protein, 18 aa, Mycobacterium
HNRVRMITASFLVKDLHL

SEQ ID NO: 1268062 - protein, 18 aa, Mycobacterium
HNTRGAGLASAYAAVSAG

SEQ ID NO: 1268063 - protein, 20 aa, Mycobacterium
HPAFAEEKFDVWLGGTEGAV

SEQ ID NO: 1268064 - protein, 20 aa, Mycobacterium
HPAGVLARGRIERVAPPGQG

SEQ ID NO: 1268065 - protein, 19 aa, Mycobacterium
HPAHRLRVTLADRALTQTN

SEQ ID NO: 1268066 - protein, 21 aa, Mycobacterium
HPAKLALELARACREAGVEVF

SEQ ID NO: 1268067 - protein, 17 aa, Mycobacterium
HPALERPSQLALTLRLV

SEQ ID NO: 1268068 - protein, 19 aa, Mycobacterium
HPAMCRNIVPSTVNQHVLA

SEQ ID NO: 1268069 - protein, 20 aa, Mycobacterium
HPARGALAVGGRPTAMNSRT

SEQ ID NO: 1268070 - protein, 18 aa, Mycobacterium
HPAVGWLIPQPWVVDEKG

SEQ ID NO: 1268071 - protein, 18 aa, Mycobacterium
HPDEACGIIAGPEGSDRP

SEQ ID NO: 1268072 - protein, 29 aa, Mycobacterium
HPDGFVTKDRWSMEWYYPVLGGALRGPRA

SEQ ID NO: 1268073 - protein, 18 aa, Mycobacterium
HPDQWRLLAERPELGGNA

SEQ ID NO: 1268074 - protein, 20 aa, Mycobacterium
HPDRARSAARLQVQAVLSLV

SEQ ID NO: 1268075 - protein, 18 aa, Mycobacterium
HPDREFVEWVDPRIGARR

SEQ ID NO: 1268076 - protein, 25 aa, Mycobacterium
HPDRLRRLVTIGGIGTNVFSPGPSE

SEQ ID NO: 1268077 - protein, 23 aa, Mycobacterium
HPECAAVIAEVWTLLDGECTVET

SEQ ID NO: 1268078 - protein, 21 aa, Mycobacterium
HPECGCATSALYLAGEGAFPE

SEQ ID NO: 1268079 - protein, 25 aa, Mycobacterium
HPEFNRFGEFKGWAKAQGKHSNIGY

SEQ ID NO: 1268080 - protein, 21 aa, Mycobacterium
HPELFKQYFGTVIPAGDNKFS

SEQ ID NO: 1268081 - protein, 25 aa, Mycobacterium
HPEPVDGSALGWLVDGHHTLPPERG

SEQ ID NO: 1268082 - protein, 20 aa, Mycobacterium
HPFGGSWGYQVTSYYAPSSR

SEQ ID NO: 1268083 - protein, 18 aa, Mycobacterium
HPFLPPHVVDEWTETRVR

SEQ ID NO: 1268084 - protein, 25 aa, Mycobacterium
HPGIDELFALLAYGEVAAFYRLTEE

SEQ ID NO: 1268085 - protein, 19 aa, Mycobacterium
HPGLLRFTTGFGQTTALMM

SEQ ID NO: 1268086 - protein, 20 aa, Mycobacterium
HPGYEWTAMAAINAIPAVCD

SEQ ID NO: 1268087 - protein, 18 aa, Mycobacterium
HPHGILVDDDGTVYVTHP

SEQ ID NO: 1268088 - protein, 20 aa, Mycobacterium
HPHHRGLREPFAAEVHHVNP

SEQ ID NO: 1268089 - protein, 17 aa, Mycobacterium
HPHIERWAQTILGSARE

SEQ ID NO: 1268090 - protein, 18 aa, Mycobacterium
HPIPPSWFTHGVEFVMDR

SEQ ID NO: 1268091 - protein, 26 aa, Mycobacterium
HPKMARRFLTFNGWLLQCGELPLRLR

SEQ ID NO: 1268092 - protein, 29 aa, Mycobacterium
HPKRLDRGGLLHWARPIAPLILNASSRGG

SEQ ID NO: 1268093 - protein, 21 aa, Mycobacterium
HPKSIKFVCLLTCPEGIAAMA

SEQ ID NO: 1268094 - protein, 23 aa, Mycobacterium
HPLKRWPELGVPITMTDLRFMRF

SEQ ID NO: 1268095 - protein, 19 aa, Mycobacterium
HPMPGTALERARQIAGAVT

SEQ ID NO: 1268096 - protein, 25 aa, Mycobacterium
HPNRTARNHLRWIAATNGIGATRPD

SEQ ID NO: 1268097 - protein, 19 aa, Mycobacterium
HPPFSYAHDHFGFRDRLSQ

SEQ ID NO: 1268098 - protein, 17 aa, Mycobacterium
HPPRFITGASAFCSEWV

SEQ ID NO: 1268099 - protein, 17 aa, Mycobacterium
HPPRYTWDGRQWVFNYN

SEQ ID NO: 1268100 - protein, 25 aa, Mycobacterium
HPPTYYLPRSCFADGVLREAAGASW

SEQ ID NO: 1268101 - protein, 21 aa, Mycobacterium
HPQMLLRVGWAPVNADPLPAT

SEQ ID NO: 1268102 - protein, 23 aa, Mycobacterium
HPQRWASVQLNLANSLVYSPTRH

SEQ ID NO: 1268103 - protein, 19 aa, Mycobacterium
HPRFARMYERISAESEQRG

SEQ ID NO: 1268104 - protein, 17 aa, Mycobacterium
HPRVRAGCEAMVAATPA

SEQ ID NO: 1268105 - protein, 22 aa, Mycobacterium
HPSFEVPKSYVATVLGSVPKGL

SEQ ID NO: 1268106 - protein, 36 aa, Mycobacterium
HPSLQWIPDWMWRLNLKVLGPFAVWVTVGLYDPPVR

SEQ ID NO: 1268107 - protein, 19 aa, Mycobacterium
HPSRVAGVVGVDGPYPDGW

SEQ ID NO: 1268108 - protein, 19 aa, Mycobacterium
HPSRVRTPLLVLGAADDGA

SEQ ID NO: 1268109 - protein, 17 aa, Mycobacterium
HPTHLGQEFIFVHSGRV

SEQ ID NO: 1268110 - protein, 17 aa, Mycobacterium
HPTPGWWDGVAGPGAPI

SEQ ID NO: 1268111 - protein, 20 aa, Mycobacterium
HPVDVARLMADFHAEHPGVE

SEQ ID NO: 1268112 - protein, 21 aa, Mycobacterium
HPVLHYLHRPIPREDLVAFFV

SEQ ID NO: 1268113 - protein, 17 aa, Mycobacterium
HPVRGHPGASLGAAVIA

SEQ ID NO: 1268114 - protein, 31 aa, Mycobacterium
HPWEREWSYGWSMMRIGALLRRQSMVDVDAW

SEQ ID NO: 1268115 - protein, 25 aa, Mycobacterium
HPWEREWSYGWSMMRIGALLRRRSM

SEQ ID NO: 1268116 - protein, 26 aa, Mycobacterium
HPYAHLRAFVLMPWLAAEPEATLTVA

SEQ ID NO: 1268117 - protein, 20 aa, Mycobacterium
HPYLDTVLFILGVTRGEIEA

SEQ ID NO: 1268118 - protein, 24 aa, Mycobacterium
HQACQALRLGECDLALAGGANVLL

SEQ ID NO: 1268119 - protein, 19 aa, Mycobacterium
HQAMEFLPWANRFAAGDLK

SEQ ID NO: 1268120 - protein, 20 aa, Mycobacterium
HQASALTWWYALLIWGATAS

SEQ ID NO: 1268121 - protein, 23 aa, Mycobacterium
HQEITRLLSAISLTRRNVSSCGT

SEQ ID NO: 1268122 - protein, 24 aa, Mycobacterium
HQGRGVGRGDEISRSGRIGTDNTA

SEQ ID NO: 1268123 - protein, 27 aa, Mycobacterium
HQILIAVGDTFGAKGMTGRHIYNTLFR

SEQ ID NO: 1268124 - protein, 17 aa, Mycobacterium
HQLELRASWTATDLELG

SEQ ID NO: 1268125 - protein, 24 aa, Mycobacterium
HQLKVPQKHSVLYFCAERRHYGMG

SEQ ID NO: 1268126 - protein, 24 aa, Mycobacterium
HQLLRPALHLIDRLPAPQCDALAV

SEQ ID NO: 1268127 - protein, 18 aa, Mycobacterium
HQLSWPVRELPAGSTEVS

SEQ ID NO: 1268128 - protein, 17 aa, Mycobacterium
HQMRYDLNAGFPLITTK

SEQ ID NO: 1268129 - protein, 19 aa, Mycobacterium
HQNMGVIYWIYPNLILANS

SEQ ID NO: 1268130 - protein, 19 aa, Mycobacterium
HQRPDQRRLLAGDPGLIAD

SEQ ID NO: 1268131 - protein, 23 aa, Mycobacterium
HQVREVLTAAGAVEVKAPRVNDK

SEQ ID NO: 1268132 - protein, 23 aa, Mycobacterium
HQVRGKLAVPFGVDETARERAEY

SEQ ID NO: 1268133 - protein, 17 aa, Mycobacterium
HRADADALAGANAELAP

SEQ ID NO: 1268134 - protein, 19 aa, Mycobacterium
HRADFPTVTLTTVFRQLGD

SEQ ID NO: 1268135 - protein, 23 aa, Mycobacterium
HRADGLTVRSGRLCAFRSDVDCA

SEQ ID NO: 1268136 - protein, 22 aa, Mycobacterium
HRAKAGAAIARMQGRGETLTTI

SEQ ID NO: 1268137 - protein, 19 aa, Mycobacterium
HRARHLCERLLSFASPLHL

SEQ ID NO: 1268138 - protein, 22 aa, Mycobacterium
HRDAEVAIWGWAWADGGVSQVD

SEQ ID NO: 1268139 - protein, 20 aa, Mycobacterium
HRDALTGLFTVWFSAHTADE

SEQ ID NO: 1268140 - protein, 24 aa, Mycobacterium
HRDLRLLAADMVFDMPMVGQAARK

SEQ ID NO: 1268141 - protein, 20 aa, Mycobacterium
HRDQKLIFHRPILAGDKLWF

SEQ ID NO: 1268142 - protein, 23 aa, Mycobacterium
HRDRIAYARVCSGTFERGDVLTH

SEQ ID NO: 1268143 - protein, 23 aa, Mycobacterium
HRDRTCVVPGCGATRGLHAHHIR

SEQ ID NO: 1268144 - protein, 26 aa, Mycobacterium
HRDRTCVVPGCGATRGLHAHHIRHWE

SEQ ID NO: 1268145 - protein, 19 aa, Mycobacterium
HRDVLHTVIVRRSATGLYH

SEQ ID NO: 1268146 - protein, 24 aa, Mycobacterium
HRFADKPTILFLGRHVGYPVALEG

SEQ ID NO: 1268147 - protein, 18 aa, Mycobacterium
HRFAHSPTGIWAPECAYS

SEQ ID NO: 1268148 - protein, 20 aa, Mycobacterium
HRFDRIVKPCDGRLCEGQYG

SEQ ID NO: 1268149 - protein, 20 aa, Mycobacterium
HRFGFPELPPPYVVAQVAID

SEQ ID NO: 1268150 - protein, 24 aa, Mycobacterium
HRFQYKAGQFLTLRVSVGGRDLRR

SEQ ID NO: 1268151 - protein, 21 aa, Mycobacterium
HRFYDSCRVLPQGDETPGDLH

SEQ ID NO: 1268152 - protein, 17 aa, Mycobacterium
HRGACGVSASPADGHPS

SEQ ID NO: 1268153 - protein, 25 aa, Mycobacterium
HRGDLSLVRKEIWTPVSEQRASAVV

SEQ ID NO: 1268154 - protein, 22 aa, Mycobacterium
HRGEATALCTLCVDPRPQRAEH

SEQ ID NO: 1268155 - protein, 19 aa, Mycobacterium
HRGELRAFLHRWVAPAVEL

SEQ ID NO: 1268156 - protein, 25 aa, Mycobacterium
HRGHDWKFAVVEGGRHSVTHYDTLE

SEQ ID NO: 1268157 - protein, 26 aa, Mycobacterium
HRGRLRLRPGRCGPVGMRRARLRPGH

SEQ ID NO: 1268158 - protein, 25 aa, Mycobacterium
HRHGRWYWHWDPAFLTKPNEDPFVR

SEQ ID NO: 1268159 - protein, 26 aa, Mycobacterium
HRHLFTVLMDREWKHGVAAAVDVTLL

SEQ ID NO: 1268160 - protein, 17 aa, Mycobacterium
HRHMRSLLNKAFTPRAI

SEQ ID NO: 1268161 - protein, 20 aa, Mycobacterium
HRHSARLGICTNADHADAAA

SEQ ID NO: 1268162 - protein, 29 aa, Mycobacterium
HRIEKAFPGRFLLGIGVGHPEHTQEYVKP

SEQ ID NO: 1268163 - protein, 25 aa, Mycobacterium
HRIGKPLAGIYAMFHTLRRDEPVRI

SEQ ID NO: 1268164 - protein, 17 aa, Mycobacterium
HRIKISGYRVELGEVES

SEQ ID NO: 1268165 - protein, 22 aa, Mycobacterium
HRITNMLLVPAVIQFLLDTDGV

SEQ ID NO: 1268166 - protein, 19 aa, Mycobacterium
HRLALWSRRLLGEAITQAQ

SEQ ID NO: 1268167 - protein, 28 aa, Mycobacterium
HRLAVLWPEVYPRLLRVMDADPICQDRI

SEQ ID NO: 1268168 - protein, 26 aa, Mycobacterium
HRLFSHVPWLPGQLLNAVEAFARGTK

SEQ ID NO: 1268169 - protein, 18 aa, Mycobacterium
HRLLGPTLLPSWLAYLPP

SEQ ID NO: 1268170 - protein, 17 aa, Mycobacterium
HRLLLVLSDGFPYDDGY

SEQ ID NO: 1268171 - protein, 21 aa, Mycobacterium
HRLPTAIARLARMRRVTSRLQ

SEQ ID NO: 1268172 - protein, 23 aa, Mycobacterium
HRLQARLGVDFADLPTPEDPPID

SEQ ID NO: 1268173 - protein, 19 aa, Mycobacterium
HRLRRPVPQPAHRGPGVRN

SEQ ID NO: 1268174 - protein, 24 aa, Mycobacterium
HRLRVRGVDGLRVVDCSVMPTIVA

SEQ ID NO: 1268175 - protein, 23 aa, Mycobacterium
HRMAAEFSAPIALESLPYTIARI

SEQ ID NO: 1268176 - protein, 18 aa, Mycobacterium
HRPAVAGLPPAAIRSVLD

SEQ ID NO: 1268177 - protein, 17 aa, Mycobacterium
HRPELVRSWVSDVVGLF

SEQ ID NO: 1268178 - protein, 18 aa, Mycobacterium
HRPGRKAGALVVLVDGAL

SEQ ID NO: 1268179 - protein, 20 aa, Mycobacterium
HRPIPREDLVAFFVAADVML

SEQ ID NO: 1268180 - protein, 22 aa, Mycobacterium
HRPVSIAPRIAVTAHAINSIAP

SEQ ID NO: 1268181 - protein, 18 aa, Mycobacterium
HRQNLALWVCLGGAEEQR

SEQ ID NO: 1268182 - protein, 23 aa, Mycobacterium
HRQNLRLYQEWCDLADLRQGDRY

SEQ ID NO: 1268183 - protein, 21 aa, Mycobacterium
HRRAGLPWGSFAERSEQLGET

SEQ ID NO: 1268184 - protein, 19 aa, Mycobacterium
HRRAWKAMFDEYLRSRAED

SEQ ID NO: 1268185 - protein, 22 aa, Mycobacterium
HRRDPDVWARLVERHGVTVLHF

SEQ ID NO: 1268186 - protein, 19 aa, Mycobacterium
HRRGVEEVVVIGRRGPLQA

SEQ ID NO: 1268187 - protein, 25 aa, Mycobacterium
HRRIPIITVVNKWDRPGRHALELMD

SEQ ID NO: 1268188 - protein, 24 aa, Mycobacterium
HRRLAPLCRFSRSRTKAEAGCTIG

SEQ ID NO: 1268189 - protein, 19 aa, Mycobacterium
HRRNWPDAQYFALVGSCAA

SEQ ID NO: 1268190 - protein, 20 aa, Mycobacterium
HRRRADGFLAPHLQRRRAGQ

SEQ ID NO: 1268191 - protein, 21 aa, Mycobacterium
HRRRGRSRLLGHMRGLSRGAA

SEQ ID NO: 1268192 - protein, 24 aa, Mycobacterium
HRRRIVKQLSGWDVLLLNSETPNV

SEQ ID NO: 1268193 - protein, 19 aa, Mycobacterium
HRSEMLVLLGLSGSGKSTL

SEQ ID NO: 1268194 - protein, 21 aa, Mycobacterium
HRSGADHLPIVLGLNLTENVA

SEQ ID NO: 1268195 - protein, 18 aa, Mycobacterium
HRSSALIIYDAVVDDPWY

SEQ ID NO: 1268196 - protein, 25 aa, Mycobacterium
HRTAWTHLWERLSIDFDDFTDELRI

SEQ ID NO: 1268197 - protein, 26 aa, Mycobacterium
HRVAAKLRAGTVWVNAYRVVAPHVPF

SEQ ID NO: 1268198 - protein, 20 aa, Mycobacterium
HRVIRRCRADGYLVERLTPG

SEQ ID NO: 1268199 - protein, 22 aa, Mycobacterium
HRVLQHRLILGFEAASAGITPD

SEQ ID NO: 1268200 - protein, 20 aa, Mycobacterium
HRVPSMMFPKITSLPLGVPR

SEQ ID NO: 1268201 - protein, 27 aa, Mycobacterium
HRVTRCGVQPAVIRMLLDADVPKEDLA

SEQ ID NO: 1268202 - protein, 19 aa, Mycobacterium
HRWWVGGHWRQQACGPNHA

SEQ ID NO: 1268203 - protein, 22 aa, Mycobacterium
HRYAPMFVGLGWTDEGGCVVAG

SEQ ID NO: 1268204 - protein, 17 aa, Mycobacterium
HSALQLIRCEDAPLLWA

SEQ ID NO: 1268205 - protein, 17 aa, Mycobacterium
HSCLLASFDDGSGAQTT

SEQ ID NO: 1268206 - protein, 33 aa, Mycobacterium
HSCSFDWCRCRWRSESGHWWIEYVAATLRLGDP

SEQ ID NO: 1268207 - protein, 29 aa, Mycobacterium
HSDLVGANPLEWLDEKFIGYLEDRRKEPR

SEQ ID NO: 1268208 - protein, 22 aa, Mycobacterium
HSDMPLKEVVGVTGFCDQSHLT

SEQ ID NO: 1268209 - protein, 25 aa, Mycobacterium
HSDPDFAAAAGFPRPILHGLCTYGM

SEQ ID NO: 1268210 - protein, 20 aa, Mycobacterium
HSDYGHAFVSFLDKFPNVLS

SEQ ID NO: 1268211 - protein, 22 aa, Mycobacterium
HSEAGLYLWATRAEPCRQTVDR

SEQ ID NO: 1268212 - protein, 22 aa, Mycobacterium
HSEAGLYLWATRGEPCRDTVTW

SEQ ID NO: 1268213 - protein, 17 aa, Mycobacterium
HSEKIVPAPVTFVDIAG

SEQ ID NO: 1268214 - protein, 17 aa, Mycobacterium
HSERPGVDDVTRLSTAL

SEQ ID NO: 1268215 - protein, 26 aa, Mycobacterium
HSFRGPGLRNSVMFGPPGRLYTYRSH

SEQ ID NO: 1268216 - protein, 25 aa, Mycobacterium
HSGQGCALTTRMLVPRQHYEAAVEM

SEQ ID NO: 1268217 - protein, 23 aa, Mycobacterium
HSGSWLPLVAVFGYHPAPGSDAD

SEQ ID NO: 1268218 - protein, 19 aa, Mycobacterium
HSHCASAAMLAERIGLDDD

SEQ ID NO: 1268219 - protein, 19 aa, Mycobacterium
HSHGDVALCDQVSGRVVDD

SEQ ID NO: 1268220 - protein, 22 aa, Mycobacterium
HSHYRLGLPHAGTWREVLNTDA

SEQ ID NO: 1268221 - protein, 18 aa, Mycobacterium
HSLQLIMDSLRYWVTEMH

SEQ ID NO: 1268222 - protein, 28 aa, Mycobacterium
HSMGALHSWCLAAARPELVAGVVVEDMA

SEQ ID NO: 1268223 - protein, 25 aa, Mycobacterium
HSPAFYAGDPFPVYRELRATDPVCW

SEQ ID NO: 1268224 - protein, 30 aa, Mycobacterium
HSPFGRSVNRYRLAGWLGTLPLPAGKKNPP

SEQ ID NO: 1268225 - protein, 20 aa, Mycobacterium
HSPGSVCWHAPELNAVFSGD

SEQ ID NO: 1268226 - protein, 30 aa, Mycobacterium
HSPMAGTGWLHGWRLTFGGADIAWEGALAT

SEQ ID NO: 1268227 - protein, 28 aa, Mycobacterium
HSRDHLAPYLKVRRLEFYELPKTISGKI

SEQ ID NO: 1268228 - protein, 28 aa, Mycobacterium
HSRSLAQWLRRWDIRGGSASPEAVELFH

SEQ ID NO: 1268229 - protein, 21 aa, Mycobacterium
HSSSHLLAATFERLLPQVTTP

SEQ ID NO: 1268230 - protein, 22 aa, Mycobacterium
HSSVVRDGRRLRLVDAVMTQND

SEQ ID NO: 1268231 - protein, 33 aa, Mycobacterium
HSTRVCAVRSGLPARAPSGLGLREPPGVRPRAG

SEQ ID NO: 1268232 - protein, 24 aa, Mycobacterium
HSVACTGLMTWYPALEAVRQFGRV

SEQ ID NO: 1268233 - protein, 30 aa, Mycobacterium; identical to SEQ ID NO: 621863

SEQ ID NO: 1268234 - protein, 19 aa, Mycobacterium
HSVGAVILGEFEKIEQGQQ

SEQ ID NO: 1268235 - protein, 24 aa, Mycobacterium
HSVSAWPSVCSGLRSEARKGRMLP

SEQ ID NO: 1268236 - protein, 19 aa, Mycobacterium
HSWKRSSFSGTEIFGKTVG

SEQ ID NO: 1268237 - protein, 20 aa, Mycobacterium
HSYVAAPVMPTGKVIGFLHA

SEQ ID NO: 1268238 - protein, 20 aa, Mycobacterium
HTADSMSFLVGDAVLTADTI

SEQ ID NO: 1268239 - protein, 17 aa, Mycobacterium
HTAELFDGGLPWCDGAR

SEQ ID NO: 1268240 - protein, 23 aa, Mycobacterium
HTDLPRECLLIFGQEGPGITDDA

SEQ ID NO: 1268241 - protein, 17 aa, Mycobacterium
HTEKEFQSQVSWKGALE

SEQ ID NO: 1268242 - protein, 24 aa, Mycobacterium
HTELFKLSTPYLLILNHIAGIPRL

SEQ ID NO: 1268243 - protein, 18 aa, Mycobacterium
HTEQVIGVRPRRRGAAED

SEQ ID NO: 1268244 - protein, 17 aa, Mycobacterium
HTERPRRTAMLTEDLVS

SEQ ID NO: 1268245 - protein, 17 aa, Mycobacterium
HTETGQSPLARWEAGFD

SEQ ID NO: 1268246 - protein, 20 aa, Mycobacterium
HTFNLCVSNVPGPREPLYFN

SEQ ID NO: 1268247 - protein, 26 aa, Mycobacterium
HTGASRPDAPWGLFPAQGDDRWVAIT

SEQ ID NO: 1268248 - protein, 25 aa, Mycobacterium
HTGDLFATHGLPWCDGARELLEALA

SEQ ID NO: 1268249 - protein, 28 aa, Mycobacterium
HTGDRFRFPYAIDLDGDCVVVADTANNR

SEQ ID NO: 1268250 - protein, 19 aa, Mycobacterium
HTGITWVICDMRTPGIDVR

SEQ ID NO: 1268251 - protein, 20 aa, Mycobacterium
HTGMAERFRHHFSYVEDEGS

SEQ ID NO: 1268252 - protein, 21 aa, Mycobacterium
HTGRWTFLILDGAAFMMQAMH

SEQ ID NO: 1268253 - protein, 28 aa, Mycobacterium
HTHSFRWDHAIAFARWALGDACPTDITV

SEQ ID NO: 1268254 - protein, 17 aa, Mycobacterium
HTIALPLLRAAHATHGP

SEQ ID NO: 1268255 - protein, 22 aa, Mycobacterium
HTIEWYPAFHGFAVPDNGPYDE

SEQ ID NO: 1268256 - protein, 17 aa, Mycobacterium
HTISSVGALSFKIGDLS

SEQ ID NO: 1268257 - protein, 23 aa, Mycobacterium
HTKSIVYELLWFLRGDSNVRWLQ

SEQ ID NO: 1268258 - protein, 19 aa, Mycobacterium
HTLDEAFALLTALGDPLLW

SEQ ID NO: 1268259 - protein, 22 aa, Mycobacterium
HTLIWPNLFLAEMNVMFVEPQA

SEQ ID NO: 1268260 - protein, 17 aa, Mycobacterium
HTLWQAWHRSGLQKRWL

SEQ ID NO: 1268261 - protein, 19 aa, Mycobacterium
HTNLGLAIDLPGKDGKRSL

SEQ ID NO: 1268262 - protein, 24 aa, Mycobacterium
HTNRGDIKIALFGNHAPKTVSNFV

SEQ ID NO: 1268263 - protein, 23 aa, Mycobacterium
HTPRGIWAPECAYAPGMEADYAA

SEQ ID NO: 1268264 - protein, 19 aa, Mycobacterium
HTQGSVVFRVEQGTEPVAF

SEQ ID NO: 1268265 - protein, 25 aa, Mycobacterium
HTREALKAMIPRAKGSIVNIGSYAC

SEQ ID NO: 1268266 - protein, 24 aa, Mycobacterium
HTRFGTEVEALWWDDDRQEWQIHA

SEQ ID NO: 1268267 - protein, 17 aa, Mycobacterium
HTRGRLGTVDYRAADLG

SEQ ID NO: 1268268 - protein, 22 aa, Mycobacterium
HTRYRLGLPHAGRWREVLNTDS

SEQ ID NO: 1268269 - protein, 30 aa, Mycobacterium
HTSGRIERFLLLWAEGSMTIAMPSTPANYF

SEQ ID NO: 1268270 - protein, 18 aa, Mycobacterium
HTSPAIRIAGRRALELAG

SEQ ID NO: 1268271 - protein, 17 aa, Mycobacterium
HTTAGRCALILDYIDAH

SEQ ID NO: 1268272 - protein, 24 aa, Mycobacterium
HTTFPLPAPSAWPAERDRRELTGQ

SEQ ID NO: 1268273 - protein, 17 aa, Mycobacterium
HTVAQLRSRPVLARPLA

SEQ ID NO: 1268274 - protein, 17 aa, Mycobacterium
HTVRRAAGLVGDLRDRA

SEQ ID NO: 1268275 - protein, 17 aa, Mycobacterium
HTVWFELHEELILAAGL

SEQ ID NO: 1268276 - protein, 25 aa, Mycobacterium
HVAAEGIEPFGFYYEKFALAAPAAE

SEQ ID NO: 1268277 - protein, 24 aa, Mycobacterium
HVAARLAHRGGFELVLAGPVGPYA

SEQ ID NO: 1268278 - protein, 24 aa, Mycobacterium
HVADRAKWRLVGPMHLAETREQAE

SEQ ID NO: 1268279 - protein, 18 aa, Mycobacterium
HVADRVAVMYLGRIIENG

SEQ ID NO: 1268280 - protein, 20 aa, Mycobacterium
HVAEAMGVVAAETIAGAETL

SEQ ID NO: 1268281 - protein, 26 aa, Mycobacterium
HVAGAFTLNGLGGWFVDRIEGDPSNV

SEQ ID NO: 1268282 - protein, 17 aa, Mycobacterium
HVALMGMAVTMVGACQR

SEQ ID NO: 1268283 - protein, 19 aa, Mycobacterium
HVANLLAFQPNERIAQVIQ

SEQ ID NO: 1268284 - protein, 25 aa, Mycobacterium
HVASFYPEVVIAFEITDPSGHYHVP

SEQ ID NO: 1268285 - protein, 24 aa, Mycobacterium
HVDEEWRFLTGWPDARSDDPDRMA

SEQ ID NO: 1268286 - protein, 19 aa, Mycobacterium
HVDGAFGLWAAAAPRTRHL

SEQ ID NO: 1268287 - protein, 20 aa, Mycobacterium
HVDPGFAMDSAWRGVLPPDA

SEQ ID NO: 1268288 - protein, 19 aa, Mycobacterium
HVDPGFPVRVGAGCSVGHN

SEQ ID NO: 1268289 - protein, 17 aa, Mycobacterium
HVDVCLGQHVMPFPAGT

SEQ ID NO: 1268290 - protein, 27 aa, Mycobacterium
HVFEFARTRRCVLFFDEFDTIAKERSD

SEQ ID NO: 1268291 - protein, 20 aa, Mycobacterium
HVGCLRDCGLVIGRPEGRQV

SEQ ID NO: 1268292 - protein, 34 aa, Mycobacterium
HVHGGVCALLLDHVLSATAHRRGEPAFTGTLNVR

SEQ ID NO: 1268293 - protein, 23 aa, Mycobacterium
HVIDLLVLAGWPRAAARARRLRQ

SEQ ID NO: 1268294 - protein, 22 aa, Mycobacterium
HVIWWQIYPLGFVGAFPADPPP

SEQ ID NO: 1268295 - protein, 22 aa, Mycobacterium
HVKEVRLSTRLTDSPACLITDT

SEQ ID NO: 1268296 - protein, 31 aa, Mycobacterium
HVKKLVGRLEKRFSPKMRLAVTAALEHYTAT

SEQ ID NO: 1268297 - protein, 19 aa, Mycobacterium
HVKLALKDDLLAGDLPDQE

SEQ ID NO: 1268298 - protein, 17 aa, Mycobacterium
HVLAAFGLSGVQPAPLG

SEQ ID NO: 1268299 - protein, 17 aa, Mycobacterium
HVLARAITIAAFANKVT

SEQ ID NO: 1268300 - protein, 23 aa, Mycobacterium
HVLGFKGLERRAVVLVVNEEAAF

SEQ ID NO: 1268301 - protein, 18 aa, Mycobacterium
HVMGRGLLYGTLDAGGTA

SEQ ID NO: 1268302 - protein, 24 aa, Mycobacterium
HVNELQALLLDWGFAPMTVGSRPP

SEQ ID NO: 1268303 - protein, 18 aa, Mycobacterium
HVNGRWLAEYEIPADRAA

SEQ ID NO: 1268304 - protein, 27 aa, Mycobacterium
HVNRFLLGLPQEHRFAVLVDTIERWSH

SEQ ID NO: 1268305 - protein, 23 aa, Mycobacterium
HVNRWFYDCPPAFHRKLGDMYVS

SEQ ID NO: 1268306 - protein, 17 aa, Mycobacterium
HVPKRLQPLATDRVSQS

SEQ ID NO: 1268307 - protein, 23 aa, Mycobacterium
HVPQANGALEFDRAAAHGYRFDI

SEQ ID NO: 1268308 - protein, 30 aa, Mycobacterium; identical to SEQ ID NO: 676757

SEQ ID NO: 1268309 - protein, 18 aa, Mycobacterium
HVQRGDIIFPKSVTPERI

SEQ ID NO: 1268310 - protein, 19 aa, Mycobacterium
HVQRGDIIFPKSVTPKRIE

SEQ ID NO: 1268311 - protein, 18 aa, Mycobacterium
HVRADRDGVRFGVVPRTG

SEQ ID NO: 1268312 - protein, 17 aa, Mycobacterium
HVRAKFLGAEPVDPEPN

SEQ ID NO: 1268313 - protein, 18 aa, Mycobacterium
HVRPVAWLCVGPVAELPD

SEQ ID NO: 1268314 - protein, 26 aa, Mycobacterium
HVSGHAYAGELLFLYNGVRPRNVMPV

SEQ ID NO: 1268315 - protein, 18 aa, Mycobacterium
HVTRAESTLIGFTDHDFF

SEQ ID NO: 1268316 - protein, 26 aa, Mycobacterium
HVTRLREDLCPDWPQPAQPGGSYRIE

SEQ ID NO: 1268317 - protein, 24 aa, Mycobacterium
HVTSFRDVLAPAWQQATGGALDVT

SEQ ID NO: 1268318 - protein, 23 aa, Mycobacterium
HVVAAETGLSCSVGISDNKQRAK

SEQ ID NO: 1268319 - protein, 18 aa, Mycobacterium
HVVAPFKVGPDFIDPGYH

SEQ ID NO: 1268320 - protein, 17 aa, Mycobacterium
HVVCRSCGTIADVDCAV

SEQ ID NO: 1268321 - protein, 28 aa, Mycobacterium
HVVDIPSPLEWGCFTFGVIQHDGHFTFF

SEQ ID NO: 1268322 - protein, 31 aa, Mycobacterium
HVVLKIRSSVWLGEDGWVIDRFLGGNAPLVL

SEQ ID NO: 1268323 - protein, 24 aa, Mycobacterium
HVVPELPKTRSGKIMRRLLRDVAE

SEQ ID NO: 1268324 - protein, 25 aa, Mycobacterium
HVVRRFGELTARLYALEALLARGTA

SEQ ID NO: 1268325 - protein, 22 aa, Mycobacterium
HVVVIPEMWRDPATGEVLEDRN

SEQ ID NO: 1268326 - protein, 21 aa, Mycobacterium
HVVWWQVYPLGFVGAYPADPP

SEQ ID NO: 1268327 - protein, 19 aa, Mycobacterium
HVYTKLCLASRVQLAQEAA

SEQ ID NO: 1268328 - protein, 17 aa, Mycobacterium
HWADPRGAHPGEINHND

SEQ ID NO: 1268329 - protein, 20 aa, Mycobacterium
HWETFPEFLDALDAGARDID

SEQ ID NO: 1268330 - protein, 19 aa, Mycobacterium
HWEVRRILKAYVDAQTLND

SEQ ID NO: 1268331 - protein, 19 aa, Mycobacterium
HWGPPPGELFVDRSHDPDG

SEQ ID NO: 1268332 - protein, 23 aa, Mycobacterium
HWHGMHLPARFDGGPHQPIAPGA

SEQ ID NO: 1268333 - protein, 19 aa, Mycobacterium
HWKAHKLDLAPVLHEPESA

SEQ ID NO: 1268334 - protein, 26 aa, Mycobacterium
HWLGRDRFVLSCGHSSLTLYIQLYLG

SEQ ID NO: 1268335 - protein, 19 aa, Mycobacterium
HWTARIGEMSGHFTDATDL

SEQ ID NO: 1268336 - protein, 24 aa, Mycobacterium
HYADYAIWERSWLTGAALQRRIDH

SEQ ID NO: 1268337 - protein, 44 aa, Mycobacterium
HYAKLPAALQTAWDFVLQGQFTKAFATITSWSIFGLGELGWPLE

SEQ ID NO: 1268338 - protein, 25 aa, Mycobacterium
HYFASWFERYCRSFGGTIAGGTSEI

SEQ ID NO: 1268339 - protein, 27 aa, Mycobacterium
HYGYPDGLQSCWVRANMIASVDGGATS

SEQ ID NO: 1268340 - protein, 17 aa, Mycobacterium
HYLMPVRVTTALAAGYD

SEQ ID NO: 1268341 - protein, 27 aa, Mycobacterium
HYRPIGWDEAYRLIADELNALDDPDQA

SEQ ID NO: 1268342 - protein, 21 aa, Mycobacterium
HYRTIHGYRRAFRIAGEGPAI

SEQ ID NO: 1268343 - protein, 29 aa, Mycobacterium
IAAAARARGRFAKELAMSFPAHTTAMETQ

SEQ ID NO: 1268344 - protein, 26 aa, Mycobacterium
IAAAARPAEGDWMYFVTVDRQATTVF

SEQ ID NO: 1268345 - protein, 20 aa, Mycobacterium
IAAAEPWWAPGTAQGYHMVT

SEQ ID NO: 1268346 - protein, 27 aa, Mycobacterium
IAAAGRWVPEFLSLPIAIENSLKNQTY

SEQ ID NO: 1268347 - protein, 18 aa, Mycobacterium
IAAAVFGAMEVWMLGEDR

SEQ ID NO: 1268348 - protein, 27 aa, Mycobacterium
IAAAWDELMVRLGYRRYGAQGGDWGGA

SEQ ID NO: 1268349 - protein, 19 aa, Mycobacterium
IAACGWTVIAVFPTAQDQG

SEQ ID NO: 1268350 - protein, 17 aa, Mycobacterium
IAAEGARFTDYYGEQSC

SEQ ID NO: 1268351 - protein, 23 aa, Mycobacterium
IAAELMLPFYVIRYEGVVSSFLG

SEQ ID NO: 1268352 - protein, 17 aa, Mycobacterium
IAAEPGPLVVIAGAGAG

SEQ ID NO: 1268353 - protein, 29 aa, Mycobacterium
IAAGLKTVMGMQVLCGWTNPPDRGEGYDT

SEQ ID NO: 1268354 - protein, 30 aa, Mycobacterium
IAAGNRTHTKWRLKLVLSGANPVTGTFGAI

SEQ ID NO: 1268355 - protein, 23 aa, Mycobacterium
IAAGPPPIYFGFGSMPLHNPTDT

SEQ ID NO: 1268356 - protein, 17 aa, Mycobacterium
IAAGQGFVVMANAGDDS

SEQ ID NO: 1268357 - protein, 24 aa, Mycobacterium
IAAHWRYKEAKGRNGVPPSHAATE

SEQ ID NO: 1268358 - protein, 18 aa, Mycobacterium
IAALGVRLTCGHHVEDLA

SEQ ID NO: 1268359 - protein, 17 aa, Mycobacterium
IAALGVRLTCGHQVEDL

SEQ ID NO: 1268360 - protein, 18 aa, Mycobacterium
IAALGVRLTCGHQVEDLA

SEQ ID NO: 1268361 - protein, 20 aa, Mycobacterium
IAALKAKYLTREDVPADIVA

SEQ ID NO: 1268362 - protein, 17 aa, Mycobacterium
IAALRLRGVEHVVAADF

SEQ ID NO: 1268363 - protein, 24 aa, Mycobacterium
IAALSRLGAVAVLMPPDADLAEAA

SEQ ID NO: 1268364 - protein, 20 aa, Mycobacterium
IAALSRLGAVAVLMPPDVDL

SEQ ID NO: 1268365 - protein, 21 aa, Mycobacterium
IAALSRLGAVAVLMPPDVDLA

SEQ ID NO: 1268366 - protein, 21 aa, Mycobacterium
IAALSRLGAVAVLMPPDVDLV

SEQ ID NO: 1268367 - protein, 25 aa, Mycobacterium
IAAMDRLGFHEAWVGEHHSAGFEII

SEQ ID NO: 1268368 - protein, 26 aa, Mycobacterium
IAAPKELPIVPAYRHAVGTVFDGLTQ

SEQ ID NO: 1268369 - protein, 17 aa, Mycobacterium
IAAPTLLTWGRDDRVSP

SEQ ID NO: 1268370 - protein, 17 aa, Mycobacterium
IAARALSMQTFRASMLN

SEQ ID NO: 1268371 - protein, 24 aa, Mycobacterium
IAARASGAAYRWANPSRLVDGELE

SEQ ID NO: 1268372 - protein, 19 aa, Mycobacterium
IAARLPAGAIITRKLEHFF

SEQ ID NO: 1268373 - protein, 24 aa, Mycobacterium
IAARSKVNAGLIFRHIGNKEAVVA

SEQ ID NO: 1268374 - protein, 17 aa, Mycobacterium
IAASDPGARFSIDGLPY

SEQ ID NO: 1268375 - protein, 25 aa, Mycobacterium
IAATSLYLVCLRIVTSGHARALSSV

SEQ ID NO: 1268376 - protein, 18 aa, Mycobacterium
IAAVIAQAPFTDALATLR

SEQ ID NO: 1268377 - protein, 17 aa, Mycobacterium
IAAYRFNAGHADRIGAL

SEQ ID NO: 1268378 - protein, 19 aa, Mycobacterium
IACGIEAMSRVGLGANAGP

SEQ ID NO: 1268379 - protein, 21 aa, Mycobacterium
IACPDCGTKGQWTEPRDFNMM

SEQ ID NO: 1268380 - protein, 23 aa, Mycobacterium
IACTAEVLANIALREGADADIGL

SEQ ID NO: 1268381 - protein, 19 aa, Mycobacterium
IADAVAWGAIGARTTESQV

SEQ ID NO: 1268382 - protein, 20 aa, Mycobacterium
IADELLVFPSTVLRGTPEDA

SEQ ID NO: 1268383 - protein, 21 aa, Mycobacterium
IADFVPRVWAGLEALGLGHPG

SEQ ID NO: 1268384 - protein, 19 aa, Mycobacterium
IADGGARFHRIAIAHEVDP

SEQ ID NO: 1268385 - protein, 19 aa, Mycobacterium
IADHWRSGSIFLLGDAAHL

SEQ ID NO: 1268386 - protein, 19 aa, Mycobacterium
IADLIEWRRKHEKHIARVA

SEQ ID NO: 1268387 - protein, 27 aa, Mycobacterium
IADNLVRFLGALALAGPVAKLQQISDA

SEQ ID NO: 1268388 - protein, 19 aa, Mycobacterium
IADQPDLELIGVHCYSPDK

SEQ ID NO: 1268389 - protein, 26 aa, Mycobacterium
IAEACAAHGAWLHVDGAFGLWAAAAP

SEQ ID NO: 1268390 - protein, 23 aa, Mycobacterium
IAEAEGLQVLGWRDVPTDDSSLG

SEQ ID NO: 1268391 - protein, 29 aa, Mycobacterium
IAEAGLIAPHWPRPWGVDATQLQQLIIDE

SEQ ID NO: 1268392 - protein, 26 aa, Mycobacterium
IAEKEAFFAEAWLSLADSVRTGRPRL

SEQ ID NO: 1268393 - protein, 24 aa, Mycobacterium
IAEKSLKGANLWNEVKDRLDKPGG

SEQ ID NO: 1268394 - protein, 21 aa, Mycobacterium
IAELRSGLLTDEIARLEADGA

SEQ ID NO: 1268395 - protein, 22 aa, Mycobacterium
IAELTRRFGVSAAETGSQDLHR

SEQ ID NO: 1268396 - protein, 23 aa, Mycobacterium
IAEPGMVLTVRFDDTGDTETFLL

SEQ ID NO: 1268397 - protein, 17 aa, Mycobacterium
IAEPLRLLDCARPVNGA

SEQ ID NO: 1268398 - protein, 25 aa, Mycobacterium
IAEPLRRLECRIAPTHTGGIYYTGP

SEQ ID NO: 1268399 - protein, 18 aa, Mycobacterium
IAERCPGLPGALYRAFGT

SEQ ID NO: 1268400 - protein, 22 aa, Mycobacterium
IAETASCLRARYADEVPTLDEC

SEQ ID NO: 1268401 - protein, 24 aa, Mycobacterium
IAETLCHYGKFGLESTKQVLWANL

SEQ ID NO: 1268402 - protein, 17 aa, Mycobacterium
IAEVKRASPSRGALASI

SEQ ID NO: 1268403 - protein, 17 aa, Mycobacterium
IAFARERLAAYKCPKTV

SEQ ID NO: 1268404 - protein, 17 aa, Mycobacterium
IAFGGVATYTATKFAVV

SEQ ID NO: 1268405 - protein, 18 aa, Mycobacterium
IAGALPVAAWHHDVAMHV

SEQ ID NO: 1268406 - protein, 17 aa, Mycobacterium
IAGAMQRENMAITSGFA

SEQ ID NO: 1268407 - protein, 20 aa, Mycobacterium
IAGARYTGWDGLLTAQREYL

SEQ ID NO: 1268408 - protein, 24 aa, Mycobacterium
IAGDRLGSVALTWEAGGDSGTLTY

SEQ ID NO: 1268409 - protein, 18 aa, Mycobacterium
IAGEAWAGAADKVGHELG

SEQ ID NO: 1268410 - protein, 17 aa, Mycobacterium
IAGEVTFRRFYLGRNGA

SEQ ID NO: 1268411 - protein, 18 aa, Mycobacterium
IAGFAQMRIVMSANNDDP

SEQ ID NO: 1268412 - protein, 17 aa, Mycobacterium
IAGGGLRPGRTEKQVRR

SEQ ID NO: 1268413 - protein, 19 aa, Mycobacterium
IAGGTCFFGIGMSEPDSGS

SEQ ID NO: 1268414 - protein, 17 aa, Mycobacterium
IAGIHPIDTGTYLFEGK

SEQ ID NO: 1268415 - protein, 17 aa, Mycobacterium
IAGIPVTEDKWWERSPI

SEQ ID NO: 1268416 - protein, 18 aa, Mycobacterium
IAGKVCRPDPGGRRLIDD

SEQ ID NO: 1268417 - protein, 37 aa, Mycobacterium
IAGLRARLPYLARLGVDAMWINPWYPSPMADAGYDVA

SEQ ID NO: 1268418 - protein, 23 aa, Mycobacterium
IAGLRGLVGVAHYTAAKHGVVGL

SEQ ID NO: 1268419 - protein, 17 aa, Mycobacterium
IAGMTLRELHFRVRQEL

SEQ ID NO: 1268420 - protein, 28 aa, Mycobacterium
IAGPAALFDPRFQKLGIHPGGGATWMLQ

SEQ ID NO: 1268421 - protein, 20 aa, Mycobacterium
IAGPYARWDDVYSDDHGDIP

SEQ ID NO: 1268422 - protein, 23 aa, Mycobacterium
IAGQRLRVGRSYQGRTVAVAIDD

SEQ ID NO: 1268423 - protein, 17 aa, Mycobacterium
IAGRVAQIRAEIENSDS

SEQ ID NO: 1268424 - protein, 19 aa, Mycobacterium
IAGTHGWAVASMREDWIRI

SEQ ID NO: 1268425 - protein, 18 aa, Mycobacterium
IAGVAWRMTKDSGPWDIL

SEQ ID NO: 1268426 - protein, 24 aa, Mycobacterium
IAGYKVPRSLWLVDEVKRSPAGKP

SEQ ID NO: 1268427 - protein, 20 aa, Mycobacterium
IAHDQCDAWVGLAAAGDDAP

SEQ ID NO: 1268428 - protein, 23 aa, Mycobacterium
IAHTLHALAWMIPGEVALFGLDE

SEQ ID NO: 1268429 - protein, 17 aa, Mycobacterium
IAIEPYAAGLLAENGSQ

SEQ ID NO: 1268430 - protein, 24 aa, Mycobacterium
IAKGSLRGGLVLGLEDSASRMNRI

SEQ ID NO: 1268431 - protein, 20 aa, Mycobacterium
IAKRELRGVPTHAVKSPADL

SEQ ID NO: 1268432 - protein, 25 aa, Mycobacterium
IAKSFAAALGLEFTRVQFTPDLLPA

SEQ ID NO: 1268433 - protein, 19 aa, Mycobacterium
IAKVADWYAERGLPALVSA

SEQ ID NO: 1268434 - protein, 17 aa, Mycobacterium
IALAESWDNGKPIRETL

SEQ ID NO: 1268435 - protein, 24 aa, Mycobacterium
IALAEWRAGAGRGFDDLLVVKAST

SEQ ID NO: 1268436 - protein, 23 aa, Mycobacterium
IALEHLLDFMPRYEVDFDGLERV

SEQ ID NO: 1268437 - protein, 17 aa, Mycobacterium
IALEMPDMLGEVRALTA

SEQ ID NO: 1268438 - protein, 18 aa, Mycobacterium
IALIGQVCANWFASTGGI

SEQ ID NO: 1268439 - protein, 19 aa, Mycobacterium
IALLCKTDPAATPRHKGIS

SEQ ID NO: 1268440 - protein, 20 aa, Mycobacterium
IALLMPGVWIERPRLSDGEL

SEQ ID NO: 1268441 - protein, 19 aa, Mycobacterium
IALMSGELGKLNGLPVSVI

SEQ ID NO: 1268442 - protein, 22 aa, Mycobacterium
IALRATDEFKAHVKIGLNNGLT

SEQ ID NO: 1268443 - protein, 20 aa, Mycobacterium
IALRCQVRIDPLRRGYTDEE

SEQ ID NO: 1268444 - protein, 25 aa, Mycobacterium
IALSRASGCWPAMKIVADVADGVWT

SEQ ID NO: 1268445 - protein, 18 aa, Mycobacterium
IALTLAEHRGGRVGPDQL

SEQ ID NO: 1268446 - protein, 19 aa, Mycobacterium
IAMLRLWSSDAARLTAGQP

SEQ ID NO: 1268447 - protein, 25 aa, Mycobacterium
IANDSRYGLVGAVWSADEERAASVA

SEQ ID NO: 1268448 - protein, 23 aa, Mycobacterium
IANGEMFVPFLARLSEDPRARND

SEQ ID NO: 1268449 - protein, 21 aa, Mycobacterium
IANRLCAQILLLSAEDPTKDI

SEQ ID NO: 1268450 - protein, 19 aa, Mycobacterium
IANRSGVPDYGYAFWPGRT

SEQ ID NO: 1268451 - protein, 21 aa, Mycobacterium
IAPACDLRDPRQLAATVAEFA

SEQ ID NO: 1268452 - protein, 17 aa, Mycobacterium
IAPAVLGATVYVPTPAE

SEQ ID NO: 1268453 - protein, 19 aa, Mycobacterium
IAPDFADLITRHTTFTPRH

SEQ ID NO: 1268454 - protein, 19 aa, Mycobacterium
IAPELRKKAEVVFPQAQAM

SEQ ID NO: 1268455 - protein, 22 aa, Mycobacterium
IAPGLVTVGVWLATQLPPLVTP

SEQ ID NO: 1268456 - protein, 37 aa, Mycobacterium
IAPIGAPSFKEALRWGAEVYHSLKSVLKKQGLATGLG

SEQ ID NO: 1268457 - protein, 18 aa, Mycobacterium
IAPKGMRSSARYRVPPMP

SEQ ID NO: 1268458 - protein, 17 aa, Mycobacterium
IAPSGNPITASWNAATR

SEQ ID NO: 1268459 - protein, 21 aa, Mycobacterium
IAPWNFPLMLETWKVAPALAW

SEQ ID NO: 1268460 - protein, 20 aa, Mycobacterium
IAQAQRWRFDGMTAVGPDVL

SEQ ID NO: 1268461 - protein, 19 aa, Mycobacterium
IAQCARALADYGVEPRHLR

SEQ ID NO: 1268462 - protein, 26 aa, Mycobacterium
IAQFLGGRSRWLRRVAALTQQGVRRE

SEQ ID NO: 1268463 - protein, 18 aa, Mycobacterium
IAQPRFGVYQSLHTTVVG

SEQ ID NO: 1268464 - protein, 26 aa, Mycobacterium
IAQQARWGDGWVKLVGDWIDRDTGDL

SEQ ID NO: 1268465 - protein, 26 aa, Mycobacterium
IAQSALDLACRWAKDRDVFGGKLADK

SEQ ID NO: 1268466 - protein, 26 aa, Mycobacterium
IARAIPRARLVLFDGMGHELPEPLWD

SEQ ID NO: 1268467 - protein, 17 aa, Mycobacterium
IARARRVLDHLAERRVD

SEQ ID NO: 1268468 - protein, 17 aa, Mycobacterium
IAREEIFGPVLVVLTYG

SEQ ID NO: 1268469 - protein, 22 aa, Mycobacterium
IARFAFGCGDKIALEALGQKAP

SEQ ID NO: 1268470 - protein, 19 aa, Mycobacterium
IARHPGVRGLRQLRETLAL

SEQ ID NO: 1268471 - protein, 26 aa, Mycobacterium
IARIGVEWWPELSLIDRSRHRGDVTA

SEQ ID NO: 1268472 - protein, 21 aa, Mycobacterium
IARKLFSEFGLDAVAADAVKS

SEQ ID NO: 1268473 - protein, 24 aa, Mycobacterium
IARLAREAADWGVREVFLTGGEPF

SEQ ID NO: 1268474 - protein, 23 aa, Mycobacterium
IARLKTELLAAFDESARLEKVVR

SEQ ID NO: 1268475 - protein, 24 aa, Mycobacterium
IARLTGLRPDWSRTVTARRIVAAV

SEQ ID NO: 1268476 - protein, 27 aa, Mycobacterium
IARNCIEWPEISFGLAKAGLIAVPVNI

SEQ ID NO: 1268477 - protein, 17 aa, Mycobacterium
IARRAGIAYDRSHDIAG

SEQ ID NO: 1268478 - protein, 29 aa, Mycobacterium
IARRAPESLALALLRWRPLTRSDQAVREV

SEQ ID NO: 1268479 - protein, 23 aa, Mycobacterium
IARRIAEPYLRDGQIEEHLVYPV

SEQ ID NO: 1268480 - protein, 18 aa, Mycobacterium
IASACGSTGWVASIIGVH

SEQ ID NO: 1268481 - protein, 24 aa, Mycobacterium
IASIPAPVVTCLCGVINTVTNFFD

SEQ ID NO: 1268482 - protein, 24 aa, Mycobacterium
IASLNYLLSSHVWRQDHNGFSHQD

SEQ ID NO: 1268483 - protein, 18 aa, Mycobacterium
IASPAQRIMLVARDGGCT

SEQ ID NO: 1268484 - protein, 17 aa, Mycobacterium
IASPSIAAWACRNRSPR

SEQ ID NO: 1268485 - protein, 18 aa, Mycobacterium
IASTNPWLSVTPVSEYSS

SEQ ID NO: 1268486 - protein, 18 aa, Mycobacterium
IASYPVEEYFGFIWTYLG

SEQ ID NO: 1268487 - protein, 24 aa, Mycobacterium
IATDHLMRFPGKFSEQLLADHLQK

SEQ ID NO: 1268488 - protein, 18 aa, Mycobacterium
IATFARHGAAIAHNPVAN

SEQ ID NO: 1268489 - protein, 17 aa, Mycobacterium
IATMAPGGIVFALSNPD

SEQ ID NO: 1268490 - protein, 22 aa, Mycobacterium
IATRDRTGLRFDIQLQGTPDKP

SEQ ID NO: 1268491 - protein, 17 aa, Mycobacterium
IATRYALQRRQFSDPDG

SEQ ID NO: 1268492 - protein, 21 aa, Mycobacterium
IATTQCVIWNFAGLKLPTVTE

SEQ ID NO: 1268493 - protein, 25 aa, Mycobacterium
IATTWPDKRVELYFPGERALAGHHP

SEQ ID NO: 1268494 - protein, 19 aa, Mycobacterium
IAVDICKQIDSVLIPLSSP

SEQ ID NO: 1268495 - protein, 20 aa, Mycobacterium
IAVDLCENVDTIGYPMATAE

SEQ ID NO: 1268496 - protein, 17 aa, Mycobacterium
IAVLGARVVPPIAEARM

SEQ ID NO: 1268497 - protein, 25 aa, Mycobacterium
IAVLSARPRMLFDYFQQLFAQVTNP

SEQ ID NO: 1268498 - protein, 22 aa, Mycobacterium
IAVNFPLYVILSLLGLPEEDFG

SEQ ID NO: 1268499 - protein, 18 aa, Mycobacterium
IAVPDLDAAIKWYHDHLG

SEQ ID NO: 1268500 - protein, 18 aa, Mycobacterium
IAVPGCYPTAALLALWPA

SEQ ID NO: 1268501 - protein, 17 aa, Mycobacterium
IAVPRCVFADYHGASGS

SEQ ID NO: 1268502 - protein, 19 aa, Mycobacterium
IAVPRGRLASFDQADHDFL

SEQ ID NO: 1268503 - protein, 20 aa, Mycobacterium
IAVQRWGELSARRDNVVVVL

SEQ ID NO: 1268504 - protein, 18 aa, Mycobacterium
IAVRRAGIALAREIERRA

SEQ ID NO: 1268505 - protein, 18 aa, Mycobacterium
IAVRRAGIALAREVERRA

SEQ ID NO: 1268506 - protein, 27 aa, Mycobacterium
IAVSNRLRPWLPLLLALTANSAIYRNA

SEQ ID NO: 1268507 - protein, 18 aa, Mycobacterium
IAVSRWVRRHAVTQQWAG

SEQ ID NO: 1268508 - protein, 22 aa, Mycobacterium
IAWPRSTLFKVLDDLTTPTTVL

SEQ ID NO: 1268509 - protein, 18 aa, Mycobacterium
IAWQWIPFGPVLNARADW

SEQ ID NO: 1268510 - protein, 24 aa, Mycobacterium
IAYGLAGTMDFDFEADPLGQDGDG

SEQ ID NO: 1268511 - protein, 17 aa, Mycobacterium
IAYRLLSTLAQYRFVAK

SEQ ID NO: 1268512 - protein, 19 aa, Mycobacterium
ICAPVDFGRTLRRPLGNVV

SEQ ID NO: 1268513 - protein, 27 aa, Mycobacterium
ICEHPELDRGAAVLLALLDRGLGLGTH

SEQ ID NO: 1268514 - protein, 17 aa, Mycobacterium
ICGPGPFMDTVEGALAT

SEQ ID NO: 1268515 - protein, 20 aa, Mycobacterium
ICGSDLHFLEGHYPIDQPVS

SEQ ID NO: 1268516 - protein, 22 aa, Mycobacterium
ICIGSPTWWDTVSMPLRSFLKS

SEQ ID NO: 1268517 - protein, 24 aa, Mycobacterium
ICKASHVARGTFYRYFNNKEEVLS

SEQ ID NO: 1268518 - protein, 21 aa, Mycobacterium
ICLPHMPRGALPHGQPGHWTA

SEQ ID NO: 1268519 - protein, 17 aa, Mycobacterium
ICLPSTFQKDGRLQSRI

SEQ ID NO: 1268520 - protein, 18 aa, Mycobacterium
ICQFAVGLSRQLYGRTIA

SEQ ID NO: 1268521 - protein, 18 aa, Mycobacterium
ICRGCPVITECAADALDH

SEQ ID NO: 1268522 - protein, 24 aa, Mycobacterium
ICSFPRQADSYVFDALYRAGKVDL

SEQ ID NO: 1268523 - protein, 20 aa, Mycobacterium
ICSQNRLWSVFGKKRGKNGK

SEQ ID NO: 1268524 - protein, 20 aa, Mycobacterium
ICSQNRLWSVFGKKRGKSGK

SEQ ID NO: 1268525 - protein, 26 aa, Mycobacterium
ICVFLPNVRGSGGFGRAFMHADDRER

SEQ ID NO: 1268526 - protein, 21 aa, Mycobacterium
ICVSDLAAALGRSENTVSQAL

SEQ ID NO: 1268527 - protein, 18 aa, Mycobacterium
IDAAGLRITVMATPGHTA

SEQ ID NO: 1268528 - protein, 19 aa, Mycobacterium
IDAAHIWHPYSPIGDTALA

SEQ ID NO: 1268529 - protein, 18 aa, Mycobacterium
IDAAHWATEFPWCNQAAE

SEQ ID NO: 1268530 - protein, 19 aa, Mycobacterium
IDAARAAMIAAVLDKHARL

SEQ ID NO: 1268531 - protein, 24 aa, Mycobacterium
IDAARAAMIAAVLDKHARLQVGPC

SEQ ID NO: 1268532 - protein, 25 aa, Mycobacterium
IDAASLLVRCARPVLQQLQIDTADM

SEQ ID NO: 1268533 - protein, 22 aa, Mycobacterium
IDADIPAAALLDVSELRRAVGT

SEQ ID NO: 1268534 - protein, 19 aa, Mycobacterium
IDADTRFYFVHSYAAQQWE

SEQ ID NO: 1268535 - protein, 24 aa, Mycobacterium
IDAELRLAQQVGFNTVRVFLHDLL

SEQ ID NO: 1268536 - protein, 21 aa, Mycobacterium
IDAFAGAVLQYGTFDLSAQTP

SEQ ID NO: 1268537 - protein, 23 aa, Mycobacterium
IDAKAVVISDPFMAAAPVLEGLG

SEQ ID NO: 1268538 - protein, 17 aa, Mycobacterium
IDAKIGIEVFLSEDAKE

SEQ ID NO: 1268539 - protein, 22 aa, Mycobacterium
IDAKPDCAVYCAMGDVRPKEAL

SEQ ID NO: 1268540 - protein, 26 aa, Mycobacterium
IDALAALLVARPAEFDVIVAENMFGD

SEQ ID NO: 1268541 - protein, 26 aa, Mycobacterium
IDALEAGLGRPVRRVPLSPKVLLAVG

SEQ ID NO: 1268542 - protein, 19 aa, Mycobacterium
IDALNLLPLPNRLDLLEAL

SEQ ID NO: 1268543 - protein, 25 aa, Mycobacterium
IDAMQFPVAPWMFGAAGREHMKKYG

SEQ ID NO: 1268544 - protein, 18 aa, Mycobacterium
IDARHGMRHAPNSIEDLV

SEQ ID NO: 1268545 - protein, 19 aa, Mycobacterium
IDARLAFLVSGGTGAGKTT

SEQ ID NO: 1268546 - protein, 26 aa, Mycobacterium
IDASGMKVGIVASTWHSTICDALLDG

SEQ ID NO: 1268547 - protein, 18 aa, Mycobacterium
IDATGLLVTPGFVDLHTH

SEQ ID NO: 1268548 - protein, 29 aa, Mycobacterium
IDAVAGRCFPSYALRRGAKALGSFAQFEF

SEQ ID NO: 1268549 - protein, 39 aa, Mycobacterium
IDDAGLWGFTGVRSMEGLIAWKLGTSFRNAETIVAVARR

SEQ ID NO: 1268550 - protein, 19 aa, Mycobacterium
IDDAPAPLSVYGRTKLAGE

SEQ ID NO: 1268551 - protein, 24 aa, Mycobacterium
IDDARARCVAIALAAGAASGVIRW

SEQ ID NO: 1268552 - protein, 26 aa, Mycobacterium
IDDMGAAAWRRLWADAAPLPIFAEHP

SEQ ID NO: 1268553 - protein, 25 aa, Mycobacterium
IDDRLATLPARYAVSVGDAGLIRHD

SEQ ID NO: 1268554 - protein, 41 aa, Mycobacterium
IDDVPRGISFLLNRNRLNVAISRAKYAAVVVRSEALTEYLP

SEQ ID NO: 1268555 - protein, 17 aa, Mycobacterium
IDDVWNVVGLKATGSNN

SEQ ID NO: 1268556 - protein, 19 aa, Mycobacterium
IDDYAAWLQRFETALRALP

SEQ ID NO: 1268557 - protein, 24 aa, Mycobacterium
IDEAIKLGDKVAVFGRGGVLQQYD

SEQ ID NO: 1268558 - protein, 19 aa, Mycobacterium
IDEDGFVWILGRADQAIIR

SEQ ID NO: 1268559 - protein, 17 aa, Mycobacterium
IDEFSWAHIAEQTLQIY

SEQ ID NO: 1268560 - protein, 24 aa, Mycobacterium
IDEGLKLLGQFGRYVEIGNINIGR

SEQ ID NO: 1268561 - protein, 22 aa, Mycobacterium
IDEIRKSNALNRFANSVLVVNN

SEQ ID NO: 1268562 - protein, 17 aa, Mycobacterium
IDELRPHVVVTYDPNGG

SEQ ID NO: 1268563 - protein, 29 aa, Mycobacterium
IDEPTRIGFRFAPCGSGGRSLDARITDGT

SEQ ID NO: 1268564 - protein, 18 aa, Mycobacterium
IDERIRRGADVTETLVDL

SEQ ID NO: 1268565 - protein, 18 aa, Mycobacterium
IDESFGVGAGERVGLGCR

SEQ ID NO: 1268566 - protein, 18 aa, Mycobacterium
IDFAKPVSKDELRRYRMQ

SEQ ID NO: 1268567 - protein, 19 aa, Mycobacterium
IDFGKTVPRDQLRRYRAQS

SEQ ID NO: 1268568 - protein, 23 aa, Mycobacterium
IDGAGLWAITGVKSLEGLLAWKL

SEQ ID NO: 1268569 - protein, 39 aa, Mycobacterium
IDGAGLWAITGVKSMEGLIAWKLGTSFRNAETIVAVARR

SEQ ID NO: 1268570 - protein, 25 aa, Mycobacterium
IDGDPTGVFSWRPPASLIVALSDLL

SEQ ID NO: 1268571 - protein, 17 aa, Mycobacterium
IDGGLRFAGDDGNEIIV

SEQ ID NO: 1268572 - protein, 25 aa, Mycobacterium
IDGLIPAQVITVIFAQWHGTDALEL

SEQ ID NO: 1268573 - protein, 19 aa, Mycobacterium
IDGNFDWNQSLFGYNFGDP

SEQ ID NO: 1268574 - protein, 17 aa, Mycobacterium
IDGQKMWLTNGGSSTLV

SEQ ID NO: 1268575 - protein, 23 aa, Mycobacterium
IDGSCRRFGAGAGNAPVEALIGV

SEQ ID NO: 1268576 - protein, 18 aa, Mycobacterium
IDGTDWTPAINFYEVEEL

SEQ ID NO: 1268577 - protein, 17 aa, Mycobacterium
IDGTGWVRESLDGTPLT

SEQ ID NO: 1268578 - protein, 19 aa, Mycobacterium
IDGYLALNIAHPWVPPKVM

SEQ ID NO: 1268579 - protein, 21 aa, Mycobacterium
IDHAPLALAYDDLHQAIDDVL

SEQ ID NO: 1268580 - protein, 18 aa, Mycobacterium
IDHRGSYLQMHFALDGAP

SEQ ID NO: 1268581 - protein, 20 aa, Mycobacterium
IDHTVPWPAGPTCAANLKCL

SEQ ID NO: 1268582 - protein, 22 aa, Mycobacterium
IDIGLPVGCEFLEPTSPQYIAD

SEQ ID NO: 1268583 - protein, 25 aa, Mycobacterium
IDITKEVLGALGITVLAEPGFEADD

SEQ ID NO: 1268584 - protein, 23 aa, Mycobacterium
IDIVRLHGGHIVFARMAFDDLDF

SEQ ID NO: 1268585 - protein, 18 aa, Mycobacterium
IDKAAWDALPPVSGEPVI

SEQ ID NO: 1268586 - protein, 22 aa, Mycobacterium
IDKARYNSRYDYTYQPPPETKY

SEQ ID NO: 1268587 - protein, 17 aa, Mycobacterium
IDKKEWGAMKVPRVANY

SEQ ID NO: 1268588 - protein, 28 aa, Mycobacterium
IDKLGRGCVWSGEIAPCIHQNHVFAVRC

SEQ ID NO: 1268589 - protein, 19 aa, Mycobacterium
IDLAAARDLPCHTGVRLLG

SEQ ID NO: 1268590 - protein, 24 aa, Mycobacterium
IDLARFPGLNTWSAEDLNILASLI

SEQ ID NO: 1268591 - protein, 23 aa, Mycobacterium
IDLDAMPPRGSKHLLSEVGPEAF

SEQ ID NO: 1268592 - protein, 21 aa, Mycobacterium
IDLDEVDGFVWHCYLPTVTPG

SEQ ID NO: 1268593 - protein, 17 aa, Mycobacterium
IDLELLGCFAMTETGHG

SEQ ID NO: 1268594 - protein, 21 aa, Mycobacterium
IDLERRRISLSLKQANEDYSE

SEQ ID NO: 1268595 - protein, 18 aa, Mycobacterium
IDLLGVRKEDLPAVWADL

SEQ ID NO: 1268596 - protein, 18 aa, Mycobacterium
IDLLRFLLRRAPQSHLLT

SEQ ID NO: 1268597 - protein, 17 aa, Mycobacterium
IDLMLARRSVREGFAST

SEQ ID NO: 1268598 - protein, 23 aa, Mycobacterium
IDLRDPYPMFARRRAEGGVFRGS

SEQ ID NO: 1268599 - protein, 20 aa, Mycobacterium
IDLRVLRPLDTETFVGSVRK

SEQ ID NO: 1268600 - protein, 24 aa, Mycobacterium
IDLTFANWRGVLAPPGISDDAKQA

SEQ ID NO: 1268601 - protein, 21 aa, Mycobacterium
IDLYRNPLFPVRRTGSVLYIV

SEQ ID NO: 1268602 - protein, 17 aa, Mycobacterium
IDMLHALNMRHWDEADR

SEQ ID NO: 1268603 - protein, 17 aa, Mycobacterium
IDMPSLVYAGTRSHVMD

SEQ ID NO: 1268604 - protein, 24 aa, Mycobacterium
IDMPTLRDSVAWAAAALEIVDSRI

SEQ ID NO: 1268605 - protein, 19 aa, Mycobacterium
IDMQRDFLLPGGFGESLGN

SEQ ID NO: 1268606 - protein, 23 aa, Mycobacterium
IDMSPELLVRMFTDIDNVAMVKE

SEQ ID NO: 1268607 - protein, 21 aa, Mycobacterium
IDNRGKISLVLVAEESETAAD

SEQ ID NO: 1268608 - protein, 24 aa, Mycobacterium
IDNRPACRRCSGVAINVDCVSCGV

SEQ ID NO: 1268609 - protein, 17 aa, Mycobacterium
IDPDEYSGFAFGMGLER

SEQ ID NO: 1268610 - protein, 23 aa, Mycobacterium
IDPELRRPITEVGMVKNVTVDAD

SEQ ID NO: 1268611 - protein, 24 aa, Mycobacterium
IDPESEWRDLWGKPLDQRRLAKEL

SEQ ID NO: 1268612 - protein, 21 aa, Mycobacterium
IDPGSGLPWQASHIEEFGLVR

SEQ ID NO: 1268613 - protein, 18 aa, Mycobacterium
IDPGSPWQNAWIESFNGR

SEQ ID NO: 1268614 - protein, 24 aa, Mycobacterium
IDPHPELLRAWGLGTDAAGLAGFS

SEQ ID NO: 1268615 - protein, 24 aa, Mycobacterium
IDPHPELLTSWGLSVDADGLGRFC

SEQ ID NO: 1268616 - protein, 17 aa, Mycobacterium
IDPLDWVEMFGADALRF

SEQ ID NO: 1268617 - protein, 20 aa, Mycobacterium
IDPRCQEVGRVTAFVADGVT

SEQ ID NO: 1268618 - protein, 28 aa, Mycobacterium
IDPRVRTGRVDLYWRAILFRIDDKSSGT

SEQ ID NO: 1268619 - protein, 19 aa, Mycobacterium
IDPRVVSLANQIKAAQGPE

SEQ ID NO: 1268620 - protein, 23 aa, Mycobacterium
IDPSARGIFYGRLSEMTDTDFQV

SEQ ID NO: 1268621 - protein, 18 aa, Mycobacterium
IDPSIPFEVACLVGCGVT

SEQ ID NO: 1268622 - protein, 17 aa, Mycobacterium
IDPSRYSLDSVPISIRP

SEQ ID NO: 1268623 - protein, 19 aa, Mycobacterium
IDQAFLWAREFHVSTGDGR

SEQ ID NO: 1268624 - protein, 25 aa, Mycobacterium
IDQGIAPGLARWMIVELGPDSETPM

SEQ ID NO: 1268625 - protein, 23 aa, Mycobacterium
IDQRSACRHPDWTGPDDLTIKIN

SEQ ID NO: 1268626 - protein, 26 aa, Mycobacterium
IDRAHDQFRWFAGGWAVNSDLPTTAG

SEQ ID NO: 1268627 - protein, 18 aa, Mycobacterium
IDRFKRFPEIAASSASAY

SEQ ID NO: 1268628 - protein, 26 aa, Mycobacterium
IDRFNELVLRAELTWQQVAVLRAYAR

SEQ ID NO: 1268629 - protein, 20 aa, Mycobacterium
IDRFPVDMVERYFGPDPGDP

SEQ ID NO: 1268630 - protein, 17 aa, Mycobacterium
IDRIYLVLYGSAIATQF

SEQ ID NO: 1268631 - protein, 24 aa, Mycobacterium
IDRLLRPGGVVDRLTAPGGVLDRL

SEQ ID NO: 1268632 - protein, 19 aa, Mycobacterium
IDRRDWPLFRTVFTDDCAL

SEQ ID NO: 1268633 - protein, 24 aa, Mycobacterium
IDRRIDAIVPTIAWNNLTDVLFPR

SEQ ID NO: 1268634 - protein, 23 aa, Mycobacterium
IDRSGMAWCISKFGREEMLQIAI

SEQ ID NO: 1268635 - protein, 18 aa, Mycobacterium
IDSAAFPQIGRVSLWNNR

SEQ ID NO: 1268636 - protein, 23 aa, Mycobacterium
IDSAMPWSDFAAIVYGLVMEGRE

SEQ ID NO: 1268637 - protein, 36 aa, Mycobacterium
IDSFLPHDVVGIGMLRKAGYNVVTWDPRGEWHSGGR

SEQ ID NO: 1268638 - protein, 18 aa, Mycobacterium
IDSLKWKLLGKKVSAYAV

SEQ ID NO: 1268639 - protein, 18 aa, Mycobacterium
IDSNWKLGADNFVGDAYH

SEQ ID NO: 1268640 - protein, 17 aa, Mycobacterium
IDSRVIDMARQIKAAQD

SEQ ID NO: 1268641 - protein, 18 aa, Mycobacterium
IDSSGLGALISGLKVARQ

SEQ ID NO: 1268642 - protein, 18 aa, Mycobacterium
IDSWGRYAYGNQPSIAAW

SEQ ID NO: 1268643 - protein, 18 aa, Mycobacterium
IDTAHSRPRGTLFPVGSF

SEQ ID NO: 1268644 - protein, 18 aa, Mycobacterium
IDTEVWYPAEPDTDESVL

SEQ ID NO: 1268645 - protein, 25 aa, Mycobacterium
IDTNTRFCAHWGLAREGRVAYVNGY

SEQ ID NO: 1268646 - protein, 26 aa, Mycobacterium
IDTNTRFCAHWGLARGGRVAYVNGFT

SEQ ID NO: 1268647 - protein, 17 aa, Mycobacterium
IDTVLGLTVGADDYVTK

SEQ ID NO: 1268648 - protein, 31 aa, Mycobacterium
IDVAEVYVPFSWYEPMWLESLGFAPEGGGWK

SEQ ID NO: 1268649 - protein, 24 aa, Mycobacterium
IDVAQFYDCFTITVLMQLEDYGFC

SEQ ID NO: 1268650 - protein, 17 aa, Mycobacterium
IDVCLGGPVEYQTVTTG

SEQ ID NO: 1268651 - protein, 25 aa, Mycobacterium
IDVCMGPWPALSLRDACQRGDWTEA

SEQ ID NO: 1268652 - protein, 19 aa, Mycobacterium
IDVIRAEFEYAVTHEGALT

SEQ ID NO: 1268653 - protein, 19 aa, Mycobacterium
IDVLFNIAGVFPAGDGDVA

SEQ ID NO: 1268654 - protein, 21 aa, Mycobacterium
IDVLRRAYARAGDGGFTDDAS

SEQ ID NO: 1268655 - protein, 24 aa, Mycobacterium
IDVQRARHRWEFESMAAALHFLRS

SEQ ID NO: 1268656 - protein, 17 aa, Mycobacterium
IDVRGVVQGVGFRPFVY

SEQ ID NO: 1268657 - protein, 30 aa, Mycobacterium; identical to SEQ ID NO: 678329

SEQ ID NO: 1268658 - protein, 17 aa, Mycobacterium
IDYAASVRWRDDVRVAV

SEQ ID NO: 1268659 - protein, 23 aa, Mycobacterium
IDYSCAGTVEFLLDERGHHVFIE

SEQ ID NO: 1268660 - protein, 23 aa, Mycobacterium
IEACMAVSLGLANHVVVYRSVWE

SEQ ID NO: 1268661 - protein, 18 aa, Mycobacterium
IEAGEFGIRVNSIHPYSI

SEQ ID NO: 1268662 - protein, 25 aa, Mycobacterium
IEAHATRLATTWADQRFAVGEGQLF

SEQ ID NO: 1268663 - protein, 18 aa, Mycobacterium
IEALNARADECWSQIQKL

SEQ ID NO: 1268664 - protein, 17 aa, Mycobacterium
IEALNARADECWSQIQV

SEQ ID NO: 1268665 - protein, 25 aa, Mycobacterium
IEAVLECREALAVNVKPKFAVDAMV

SEQ ID NO: 1268666 - protein, 17 aa, Mycobacterium
IEAVVTSFYEWQEDNAK

SEQ ID NO: 1268667 - protein, 22 aa, Mycobacterium
IECAQACGLTLLGGPPTVRTAL

SEQ ID NO: 1268668 - protein, 24 aa, Mycobacterium
IECSGEVKSSLGWTGTARLDDFWF

SEQ ID NO: 1268669 - protein, 26 aa, Mycobacterium
IEDKARWGYKFRFGVFRIDDHDLEVI

SEQ ID NO: 1268670 - protein, 20 aa, Mycobacterium
IEDLQLRASDAIAKGAHTLV

SEQ ID NO: 1268671 - protein, 28 aa, Mycobacterium
IEDYLSIGWQEARFRDALAFMSTEVTGA

SEQ ID NO: 1268672 - protein, 21 aa, Mycobacterium
IEECLKLSVDYAKSRTLWGKE

SEQ ID NO: 1268673 - protein, 25 aa, Mycobacterium
IEECLRLCVDYAKSRTLWGKEIAQF

SEQ ID NO: 1268674 - protein, 17 aa, Mycobacterium
IEEGVRWEPPLLTITRV

SEQ ID NO: 1268675 - protein, 27 aa, Mycobacterium
IEEKGFCAVAAEADWPDAYRVNRYVRG

SEQ ID NO: 1268676 - protein, 19 aa, Mycobacterium
IEELAAGTGLRVGRLTLDI

SEQ ID NO: 1268677 - protein, 24 aa, Mycobacterium
IEELEGALVLERWGSDGWRFRHEL

SEQ ID NO: 1268678 - protein, 17 aa, Mycobacterium
IEELRVSLWAQQLGTAR

SEQ ID NO: 1268679 - protein, 19 aa, Mycobacterium
IEEMLRWTSPVKNMCRTLT

SEQ ID NO: 1268680 - protein, 24 aa, Mycobacterium
IEFAARKGAQCAFEREIEHRRGEP

SEQ ID NO: 1268681 - protein, 21 aa, Mycobacterium
IEFPDRGVVVVSGPNEAGKSS

SEQ ID NO: 1268682 - protein, 19 aa, Mycobacterium
IEFPLRGLIQGWQDGIPGM

SEQ ID NO: 1268683 - protein, 19 aa, Mycobacterium
IEGCAKADTLALMIKVHHA

SEQ ID NO: 1268684 - protein, 18 aa, Mycobacterium
IEGGDFAAWRTFLHPEQR

SEQ ID NO: 1268685 - protein, 25 aa, Mycobacterium
IEGIGRPRVEPSFIPGVVDRMISVP

SEQ ID NO: 1268686 - protein, 27 aa, Mycobacterium
IEGLKAMLAAFGSRVTVVGQAVGADRV

SEQ ID NO: 1268687 - protein, 24 aa, Mycobacterium
IEGMMALTGYYAWHRICVDRGILP

SEQ ID NO: 1268688 - protein, 31 aa, Mycobacterium
IEGMMALTGYYAWHRICVDRKVLPGMQELVR

SEQ ID NO: 1268689 - protein, 27 aa, Mycobacterium
IEGNAAARCGISMKGVDIVVGGDVGHM

SEQ ID NO: 1268690 - protein, 23 aa, Mycobacterium
IEGRLRRLDCSQLTDGGAGVVLV

SEQ ID NO: 1268691 - protein, 17 aa, Mycobacterium
IEHPDILILEGLNVLQT

SEQ ID NO: 1268692 - protein, 21 aa, Mycobacterium
IEHPDRTLSLSSMMSTTGAPE

SEQ ID NO: 1268693 - protein, 18 aa, Mycobacterium
IEIAEHWRAVHPARDREP

SEQ ID NO: 1268694 - protein, 17 aa, Mycobacterium
IEIDFGKTVPRDQLRRY

SEQ ID NO: 1268695 - protein, 24 aa, Mycobacterium
IEIDTLIAVPCRELLLTAEVRDRA

SEQ ID NO: 1268696 - protein, 17 aa, Mycobacterium
IEIEPRGSEALQSNGVL

SEQ ID NO: 1268697 - protein, 18 aa, Mycobacterium
IEIGIKHLTVYAFSTENW

SEQ ID NO: 1268698 - protein, 25 aa, Mycobacterium
IEIHSLPLYHCAQLDNFLITDVYLG

SEQ ID NO: 1268699 - protein, 19 aa, Mycobacterium
IEINEAFSAVALASTQELG

SEQ ID NO: 1268700 - protein, 19 aa, Mycobacterium
IEIQRLRLADGSPISLELA

SEQ ID NO: 1268701 - protein, 18 aa, Mycobacterium
IEKASALGEAARLDEVAA

SEQ ID NO: 1268702 - protein, 18 aa, Mycobacterium
IEKEHCTAVYGVPTMFIA

SEQ ID NO: 1268703 - protein, 19 aa, Mycobacterium
IELAEQIYPWARSISAEVD

SEQ ID NO: 1268704 - protein, 19 aa, Mycobacterium
IELAFKAAFTRLGGRIAKR

SEQ ID NO: 1268705 - protein, 27 aa, Mycobacterium
IELDGLRLITWRGAARADQGMSFAREA

SEQ ID NO: 1268706 - protein, 18 aa, Mycobacterium
IELDMKFGGLELRLPDGA

SEQ ID NO: 1268707 - protein, 22 aa, Mycobacterium
IELEPVKPFVALRHLRFHSLSA

SEQ ID NO: 1268708 - protein, 22 aa, Mycobacterium
IELLREAWLTATRARNALVLVR

SEQ ID NO: 1268709 - protein, 23 aa, Mycobacterium
IELPDGAFVRPPLFEDLSCGLVS

SEQ ID NO: 1268710 - protein, 21 aa, Mycobacterium
IELRRRLEQGLGKELPVTLAM

SEQ ID NO: 1268711 - protein, 17 aa, Mycobacterium
IELSTATLANWAAKTGN

SEQ ID NO: 1268712 - protein, 18 aa, Mycobacterium
IELTLEMAAEADLSVDEE

SEQ ID NO: 1268713 - protein, 25 aa, Mycobacterium
IEMDNLRAAFAWSRENANTDHSLLL

SEQ ID NO: 1268714 - protein, 23 aa, Mycobacterium
IEMSDMLLGKKGIDPGVIALANE

SEQ ID NO: 1268715 - protein, 17 aa, Mycobacterium
IEMSDMLLGKQGIDPRV

SEQ ID NO: 1268716 - protein, 22 aa, Mycobacterium
IENACLAQSVFAFFQNGGGKAY

SEQ ID NO: 1268717 - protein, 17 aa, Mycobacterium
IENGASWVPYLFYQFKD

SEQ ID NO: 1268718 - protein, 17 aa, Mycobacterium
IENLCYIGLTNNLWGDE

SEQ ID NO: 1268719 - protein, 19 aa, Mycobacterium
IENMTRFSLELGGKSAQVV

SEQ ID NO: 1268720 - protein, 23 aa, Mycobacterium
IENPERWAPPYAEAGAYNVTIHA

SEQ ID NO: 1268721 - protein, 18 aa, Mycobacterium
IENYLGFPDGLSGAQLAE

SEQ ID NO: 1268722 - protein, 19 aa, Mycobacterium
IEPAVSWADIVLPTRVLAQ

SEQ ID NO: 1268723 - protein, 19 aa, Mycobacterium
IEPGRPCRLLGLHFDGADG

SEQ ID NO: 1268724 - protein, 23 aa, Mycobacterium
IEPLEPGFGYTLGNSLRRTLLSS

SEQ ID NO: 1268725 - protein, 17 aa, Mycobacterium
IEPRDVSNAVVFLAGDD

SEQ ID NO: 1268726 - protein, 26 aa, Mycobacterium
IEQALRHEHLRLALQNYTAHTVPALN

SEQ ID NO: 1268727 - protein, 18 aa, Mycobacterium
IEQLRRWVGEQEEKRVAL

SEQ ID NO: 1268728 - protein, 17 aa, Mycobacterium
IEQMARLRSKHGVILTR

SEQ ID NO: 1268729 - protein, 24 aa, Mycobacterium
IEQMPLDAGHSWERERALSADVIL

SEQ ID NO: 1268730 - protein, 23 aa, Mycobacterium
IEQMQAWLTQWGMSTMPMMPGMD

SEQ ID NO: 1268731 - protein, 21 aa, Mycobacterium
IEQMQGWLQDWGVSSSTTAPS

SEQ ID NO: 1268732 - protein, 20 aa, Mycobacterium
IEQVWFRDGWVDRFALDLPR

SEQ ID NO: 1268733 - protein, 17 aa, Mycobacterium
IERALALTALLRATLTT

SEQ ID NO: 1268734 - protein, 22 aa, Mycobacterium
IERARTRLAPYGDRVHLATGSA

SEQ ID NO: 1268735 - protein, 17 aa, Mycobacterium
IERCLRAGVHVVTPSLY

SEQ ID NO: 1268736 - protein, 30 aa, Mycobacterium
IERFGALVFEVARGFIAPVVAFAQAVITAV

SEQ ID NO: 1268737 - protein, 17 aa, Mycobacterium
IERFRAMARAGDDLAGE

SEQ ID NO: 1268738 - protein, 21 aa, Mycobacterium
IERGAPVDLVFQSIAGTQGAN

SEQ ID NO: 1268739 - protein, 23 aa, Mycobacterium
IERLDPSIYWMGIHHSRLVKPES

SEQ ID NO: 1268740 - protein, 19 aa, Mycobacterium
IERREELLGRVGLEGTADR

SEQ ID NO: 1268741 - protein, 26 aa, Mycobacterium
IERVELRLLGPEYKSPRLIKPEVLAS

SEQ ID NO: 1268742 - protein, 18 aa, Mycobacterium
IESADAVVEWLRGFIDEL

SEQ ID NO: 1268743 - protein, 26 aa, Mycobacterium
IESAYLLQRMETFDGLAILATNFRAN

SEQ ID NO: 1268744 - protein, 17 aa, Mycobacterium
IESGRLVERARTIGEAM

SEQ ID NO: 1268745 - protein, 19 aa, Mycobacterium
IESGWRPNDSVILAAAGTS

SEQ ID NO: 1268746 - protein, 26 aa, Mycobacterium
IETNVEFWAAVILDFAQVPPKMMPAM

SEQ ID NO: 1268747 - protein, 23 aa, Mycobacterium
IETPAKAIELWRCELDAMRDIGG

SEQ ID NO: 1268748 - protein, 27 aa, Mycobacterium
IEVAVCSTGLIGDRLPMDKVLAGVQEI

SEQ ID NO: 1268749 - protein, 20 aa, Mycobacterium
IEVDPAQAWLGIVAVGTAYD

SEQ ID NO: 1268750 - protein, 23 aa, Mycobacterium
IEVFGVACPRFVDFVERGVTSGR

SEQ ID NO: 1268751 - protein, 22 aa, Mycobacterium
IEVKARLDGATDFFVTHNEVMV

SEQ ID NO: 1268752 - protein, 26 aa, Mycobacterium
IEVLDLAMRVPYGFVSSRHGYGALAG

SEQ ID NO: 1268753 - protein, 17 aa, Mycobacterium
IEVRIARVLGSSSLLDR

SEQ ID NO: 1268754 - protein, 25 aa, Mycobacterium
IEVVECSPPYDWAEQTALMSSRVIL

SEQ ID NO: 1268755 - protein, 21 aa, Mycobacterium
IEWAESAGLDTAWMPQVPNDF

SEQ ID NO: 1268756 - protein, 17 aa, Mycobacterium
IEWAKASLITPEGYPQA

SEQ ID NO: 1268757 - protein, 18 aa, Mycobacterium
IEWQRDFFDFGHVQKAFM

SEQ ID NO: 1268758 - protein, 26 aa, Mycobacterium
IEYAQLRVETGWRLVAAATTGVVNVL

SEQ ID NO: 1268759 - protein, 25 aa, Mycobacterium
IEYEIKDPRLAGVTITDAKVTNDLH

SEQ ID NO: 1268760 - protein, 18 aa, Mycobacterium
IEYHCARGAISVPASPHT

SEQ ID NO: 1268761 - protein, 22 aa, Mycobacterium
IEYTDSYVKLVFVGDDVDVSSL

SEQ ID NO: 1268762 - protein, 17 aa, Mycobacterium
IEYTLRMQLSDVYFIVI

SEQ ID NO: 1268763 - protein, 22 aa, Mycobacterium
IFAGYEFRTGYARKWNFYASGD

SEQ ID NO: 1268764 - protein, 23 aa, Mycobacterium
IFAGYEFRTGYARKWNFYASGDA

SEQ ID NO: 1268765 - protein, 23 aa, Mycobacterium
IFDLLKVRYVIVSAVSGAMGGSA

SEQ ID NO: 1268766 - protein, 31 aa, Mycobacterium
IFDLPVGGWKCRPDADFGYRAAAAAGTDAGI

SEQ ID NO: 1268767 - protein, 23 aa, Mycobacterium
IFEKTRCVLHPLPAADNPSAERA

SEQ ID NO: 1268768 - protein, 23 aa, Mycobacterium
IFEPRYSALVQACLAAEDPAFGV

SEQ ID NO: 1268769 - protein, 31 aa, Mycobacterium
IFETLLIRGGRPCLLDAHLGRLAHSARQVDL

SEQ ID NO: 1268770 - protein, 18 aa, Mycobacterium
IFFEGFRRLGRDLASAPV

SEQ ID NO: 1268771 - protein, 29 aa, Mycobacterium
IFGGMKLDFLITVDWDYYKKFMSVNMDGA

SEQ ID NO: 1268772 - protein, 23 aa, Mycobacterium
IFHPVGTCAMGAFDARGLPRSAA

SEQ ID NO: 1268773 - protein, 19 aa, Mycobacterium
IFRQAKANLGWGYGVHVCL

SEQ ID NO: 1268774 - protein, 22 aa, Mycobacterium
IFRYGEGTVMAIMHPDNPVAEK

SEQ ID NO: 1268775 - protein, 19 aa, Mycobacterium
IFSFLRLLLPAGLETTFRS

SEQ ID NO: 1268776 - protein, 17 aa, Mycobacterium
IFSPLGMGDTRYLPPAE

SEQ ID NO: 1268777 - protein, 20 aa, Mycobacterium
IFTAAGAEWRQAGCSMCLGM

SEQ ID NO: 1268778 - protein, 28 aa, Mycobacterium
IFTSGALEIPGKIAQNFANVVKSLTSLD

SEQ ID NO: 1268779 - protein, 17 aa, Mycobacterium
IFTVGCYQLLGAAVNTL

SEQ ID NO: 1268780 - protein, 23 aa, Mycobacterium
IFYSPQHPYTWGLLGSLARLDRP

SEQ ID NO: 1268781 - protein, 17 aa, Mycobacterium
IGAAAAWGGNPERDALY

SEQ ID NO: 1268782 - protein, 35 aa, Mycobacterium
IGAAACLRKTDWLFPQYRELGAFLVRAIAPAQLGA

SEQ ID NO: 1268783 - protein, 21 aa, Mycobacterium
IGAAATELFCTRGYEHVGMGD

SEQ ID NO: 1268784 - protein, 17 aa, Mycobacterium
IGAALLALGGRRESGAA

SEQ ID NO: 1268785 - protein, 17 aa, Mycobacterium
IGACLAIGDTADLLTPG

SEQ ID NO: 1268786 - protein, 22 aa, Mycobacterium
IGADDYWYLWRQMVSQPGAADP

SEQ ID NO: 1268787 - protein, 19 aa, Mycobacterium
IGAEVQRRIAAALGTGAWP

SEQ ID NO: 1268788 - protein, 20 aa, Mycobacterium
IGAEVVRFNGTVLVVNDAVT

SEQ ID NO: 1268789 - protein, 17 aa, Mycobacterium
IGAFLILLASAGNDTTK

SEQ ID NO: 1268790 - protein, 31 aa, Mycobacterium
IGAGMGRAVLVAAGYPFRRVIGVELSTRLAD

SEQ ID NO: 1268791 - protein, 19 aa, Mycobacterium
IGALPNLLFHTARDDATTD

SEQ ID NO: 1268792 - protein, 17 aa, Mycobacterium
IGALPVCGDDDRLHGMV

SEQ ID NO: 1268793 - protein, 17 aa, Mycobacterium
IGAPDAKNRGVLLDAAE

SEQ ID NO: 1268794 - protein, 18 aa, Mycobacterium
IGAPILVVSQFTLYGNTA

SEQ ID NO: 1268795 - protein, 19 aa, Mycobacterium
IGAPPERVFSWLADPASLT

SEQ ID NO: 1268796 - protein, 17 aa, Mycobacterium
IGAYASALAEDRRAHPG

SEQ ID NO: 1268797 - protein, 24 aa, Mycobacterium
IGDAFRAGFLTGRDAGLSLERSAQ

SEQ ID NO: 1268798 - protein, 17 aa, Mycobacterium
IGDAVGLTSTSSVAHQL

SEQ ID NO: 1268799 - protein, 24 aa, Mycobacterium
IGDGAPRFGMWLASGSGYVTEICA

SEQ ID NO: 1268800 - protein, 25 aa, Mycobacterium
IGDGTMCWLFVPRLRADGWVQIGGR

SEQ ID NO: 1268801 - protein, 22 aa, Mycobacterium
IGDGVTRWKVGDEVVGMLPMAD

SEQ ID NO: 1268802 - protein, 18 aa, Mycobacterium
IGDIAAWVSHPGGPKVME

SEQ ID NO: 1268803 - protein, 22 aa, Mycobacterium
IGDLFGGLFGRGAQQPRPSRPR

SEQ ID NO: 1268804 - protein, 18 aa, Mycobacterium
IGDLGVTVLRAVKEALDP

SEQ ID NO: 1268805 - protein, 23 aa, Mycobacterium
IGDTRYRWEFALSAGESADDFAT

SEQ ID NO: 1268806 - protein, 29 aa, Mycobacterium
IGEACRRARRNGIKVAHAQLRHLNPFPAN

SEQ ID NO: 1268807 - protein, 23 aa, Mycobacterium
IGEAHYKAARFAEAVDAFERCVK

SEQ ID NO: 1268808 - protein, 26 aa, Mycobacterium
IGEALLAGLLRAGRQVKDLVVAEKNP

SEQ ID NO: 1268809 - protein, 17 aa, Mycobacterium
IGEALRLWYELLSSSAL

SEQ ID NO: 1268810 - protein, 21 aa, Mycobacterium
IGEYPAATIAGVFDLDTAVKV

SEQ ID NO: 1268811 - protein, 25 aa, Mycobacterium
IGFASARLLGQFGASVMVTGTTERA

SEQ ID NO: 1268812 - protein, 18 aa, Mycobacterium
IGFEPMKWIRALAADEPL

SEQ ID NO: 1268813 - protein, 18 aa, Mycobacterium
IGFLEIWDAQAWQDYQEL

SEQ ID NO: 1268814 - protein, 33 aa, Mycobacterium
IGFPGVKLTERWLLADLHLDWDLDRGGTTGWIH

SEQ ID NO: 1268815 - protein, 17 aa, Mycobacterium
IGFVSIWTPQYYGHQIR

SEQ ID NO: 1268816 - protein, 17 aa, Mycobacterium
IGGACKNVIALACGMAA

SEQ ID NO: 1268817 - protein, 20 aa, Mycobacterium
IGGARRGKAIIILNPADPPM

SEQ ID NO: 1268818 - protein, 23 aa, Mycobacterium
IGGECQRAAELYARACRQGAPDP

SEQ ID NO: 1268819 - protein, 17 aa, Mycobacterium
IGGEIRRLTSLSEDELY

SEQ ID NO: 1268820 - protein, 19 aa, Mycobacterium
IGGGGRYDGLMHQLGGRDL

SEQ ID NO: 1268821 - protein, 25 aa, Mycobacterium
IGGGTSWRRFILPMADARAVAAAIL

SEQ ID NO: 1268822 - protein, 19 aa, Mycobacterium
IGGLLGFDGVPPGQLYAQG

SEQ ID NO: 1268823 - protein, 20 aa, Mycobacterium
IGGLPRGRVVEIYGPESSGK

SEQ ID NO: 1268824 - protein, 17 aa, Mycobacterium
IGGPAFDDAIRALATEG

SEQ ID NO: 1268825 - protein, 19 aa, Mycobacterium
IGGRLAASIKEQVCRGTIS

SEQ ID NO: 1268826 - protein, 24 aa, Mycobacterium
IGGRLVARVAGGWELTDLGREALA

SEQ ID NO: 1268827 - protein, 22 aa, Mycobacterium
IGGSWRRAGDGGTREIVNPADG

SEQ ID NO: 1268828 - protein, 21 aa, Mycobacterium
IGHADVGFFLQTYAHVLKNDD

SEQ ID NO: 1268829 - protein, 25 aa, Mycobacterium
IGHLAFVHAHPRWVAQAFADALGAR

SEQ ID NO: 1268830 - protein, 36 aa, Mycobacterium
IGHYVEFMTPAAFVRRPGRWIRAMARKEGDTGGTIS

SEQ ID NO: 1268831 - protein, 19 aa, Mycobacterium
IGIGKELRVRGYLPEDFTM

SEQ ID NO: 1268832 - protein, 25 aa, Mycobacterium
IGIGLLVEGRWRWRSYSLTSSPVTS

SEQ ID NO: 1268833 - protein, 17 aa, Mycobacterium
IGIRANISGHVMDRPFV

SEQ ID NO: 1268834 - protein, 20 aa, Mycobacterium
IGKDISCNLGSLNIAKAMDS

SEQ ID NO: 1268835 - protein, 18 aa, Mycobacterium
IGKGNAFSGEVASEINGI

SEQ ID NO: 1268836 - protein, 17 aa, Mycobacterium
IGLGAAIENMWLAANAL

SEQ ID NO: 1268837 - protein, 17 aa, Mycobacterium
IGLRGWIAAADGWGVAA

SEQ ID NO: 1268838 - protein, 18 aa, Mycobacterium
IGLRREVERFPFVPSDPS

SEQ ID NO: 1268839 - protein, 18 aa, Mycobacterium
IGLSRPSLDDVFLTLTGH

SEQ ID NO: 1268840 - protein, 18 aa, Mycobacterium
IGLTRARMEILPVSIGFP

SEQ ID NO: 1268841 - protein, 18 aa, Mycobacterium
IGMVFGQLEIKTVVHRLL

SEQ ID NO: 1268842 - protein, 18 aa, Mycobacterium
IGNAALFFATDEASYITG

SEQ ID NO: 1268843 - protein, 17 aa, Mycobacterium
IGPEAFATAGYDYVGID

SEQ ID NO: 1268844 - protein, 18 aa, Mycobacterium
IGPGWLTDLERLHGLEAF

SEQ ID NO: 1268845 - protein, 18 aa, Mycobacterium
IGPHTDFGTVTILDREPG

SEQ ID NO: 1268846 - protein, 17 aa, Mycobacterium
IGPHVFDRIGLAHRRPD

SEQ ID NO: 1268847 - protein, 18 aa, Mycobacterium
IGPPVIVGSVARWPHSAC

SEQ ID NO: 1268848 - protein, 17 aa, Mycobacterium
IGPWLPDPVDTGADPTL

SEQ ID NO: 1268849 - protein, 18 aa, Mycobacterium
IGPWNFPLNLVVLPAAAA

SEQ ID NO: 1268850 - protein, 20 aa, Mycobacterium
IGQAVSWLYGTAPRGLAGPL

SEQ ID NO: 1268851 - protein, 21 aa, Mycobacterium
IGQCFTGGFALAAAVDDSVLA

SEQ ID NO: 1268852 - protein, 24 aa, Mycobacterium
IGQKNVCQLWNMVARDTREGEVFR

SEQ ID NO: 1268853 - protein, 19 aa, Mycobacterium
IGQLLRRNVKLCAVPWLHR

SEQ ID NO: 1268854 - protein, 18 aa, Mycobacterium
IGQPRAGATTAWVPSPTA

SEQ ID NO: 1268855 - protein, 25 aa, Mycobacterium
IGQRHTCHLWNLVAADTREGDVFRT

SEQ ID NO: 1268856 - protein, 23 aa, Mycobacterium
IGRATAVLFAREGARLVVTDIQS

SEQ ID NO: 1268857 - protein, 24 aa, Mycobacterium
IGRGIALRLARDGADIALVDVLPE

SEQ ID NO: 1268858 - protein, 21 aa, Mycobacterium
IGRGRAADRPALLGAVKSNVG

SEQ ID NO: 1268859 - protein, 26 aa, Mycobacterium
IGRHTWKLLQVFGCTAAAVTGSGRVA

SEQ ID NO: 1268860 - protein, 18 aa, Mycobacterium
IGRIGWTSRDVWWAATQD

SEQ ID NO: 1268861 - protein, 23 aa, Mycobacterium
IGRIKDLLIVDGRNHYPDDIEAT

SEQ ID NO: 1268862 - protein, 18 aa, Mycobacterium
IGRLGVPVIAEFTTPGPR

SEQ ID NO: 1268863 - protein, 18 aa, Mycobacterium
IGRLVLVSCEAFDNFPPK

SEQ ID NO: 1268864 - protein, 28 aa, Mycobacterium
IGRPPVRTPEAWAREILEHTSVTMRMRL

SEQ ID NO: 1268865 - protein, 38 aa, Mycobacterium
IGRPSLRPDHSMVMPLSFHLGYHGLPFPGVLPGFGHVG

SEQ ID NO: 1268866 - protein, 17 aa, Mycobacterium
IGRRLAPEPVLHAALGP

SEQ ID NO: 1268867 - protein, 24 aa, Mycobacterium
IGRRLPRAEALTVLDALAAQTGVT

SEQ ID NO: 1268868 - protein, 19 aa, Mycobacterium
IGRVISLEIEMSVVGISLP

SEQ ID NO: 1268869 - protein, 17 aa, Mycobacterium
IGSAMIRTALSVGGPDT

SEQ ID NO: 1268870 - protein, 22 aa, Mycobacterium
IGSDRRYVMAISSLDPDDDASA

SEQ ID NO: 1268871 - protein, 18 aa, Mycobacterium
IGSDWLGIDVNLAARVME

SEQ ID NO: 1268872 - protein, 24 aa, Mycobacterium
IGSLRGAAAVRARQRLAIGSALFG

SEQ ID NO: 1268873 - protein, 18 aa, Mycobacterium
IGSPASWSSAVEAQQQSG

SEQ ID NO: 1268874 - protein, 17 aa, Mycobacterium
IGTDLMIKVLRVSDLLE

SEQ ID NO: 1268875 - protein, 19 aa, Mycobacterium
IGTELAALADRAGYVVGSD

SEQ ID NO: 1268876 - protein, 17 aa, Mycobacterium
IGTLISGPFAGRLLGDM

SEQ ID NO: 1268877 - protein, 19 aa, Mycobacterium
IGTSLPWLLPPALGDLQTI

SEQ ID NO: 1268878 - protein, 19 aa, Mycobacterium
IGTTCCFATQDKVWVTGPA

SEQ ID NO: 1268879 - protein, 18 aa, Mycobacterium
IGTVRFRIGGDGKLEAVD

SEQ ID NO: 1268880 - protein, 17 aa, Mycobacterium
IGVAFVVPVDAADPPTL

SEQ ID NO: 1268881 - protein, 17 aa, Mycobacterium
IGVAPSIISLTLLPKMA

SEQ ID NO: 1268882 - protein, 20 aa, Mycobacterium
IGVATGLRHTSLRYFNVVGS

SEQ ID NO: 1268883 - protein, 25 aa, Mycobacterium
IGVAYTAIMNPVFRVRRGAGGELQD

SEQ ID NO: 1268884 - protein, 18 aa, Mycobacterium
IGVDGVIERVLERVGEHP

SEQ ID NO: 1268885 - protein, 20 aa, Mycobacterium
IGVDWTRRPPYAVTRREALT

SEQ ID NO: 1268886 - protein, 17 aa, Mycobacterium
IGVFGGLELSDLGDGFD

SEQ ID NO: 1268887 - protein, 20 aa, Mycobacterium
IGVIPTRYYVNMNVADRPGV

SEQ ID NO: 1268888 - protein, 17 aa, Mycobacterium
IGVPACVAAATRAVAAL

SEQ ID NO: 1268889 - protein, 17 aa, Mycobacterium
IGVPACVASASRAVASL

SEQ ID NO: 1268890 - protein, 25 aa, Mycobacterium
IGVSGRRGLARWIFGNSAERLLPRL

SEQ ID NO: 1268891 - protein, 18 aa, Mycobacterium
IGVSRLVAVIAEQHHDEL

SEQ ID NO: 1268892 - protein, 17 aa, Mycobacterium
IGWIRAERSTLATVAVQ

SEQ ID NO: 1268893 - protein, 25 aa, Mycobacterium
IGWLAQRGYVPLGYKGDAAKTAATF

SEQ ID NO: 1268894 - protein, 23 aa, Mycobacterium
IGYLLKTRVTDVADFVDTLQRIA

SEQ ID NO: 1268895 - protein, 19 aa, Mycobacterium
IHACMQINDAMVFLNDDFP

SEQ ID NO: 1268896 - protein, 22 aa, Mycobacterium
IHAGCVWINDHIPIISEMPHGG

SEQ ID NO: 1268897 - protein, 18 aa, Mycobacterium
IHALKFFGIQAHCPAGES

SEQ ID NO: 1268898 - protein, 17 aa, Mycobacterium
IHDPICLVEVRRRIRSR

SEQ ID NO: 1268899 - protein, 30 aa, Mycobacterium
IHDYLWRWDTDWFWCSRAFGAQNPRIRRWW

SEQ ID NO: 1268900 - protein, 20 aa, Mycobacterium
IHEAAGRRQTLVVTHNANLA

SEQ ID NO: 1268901 - protein, 20 aa, Mycobacterium
IHEIALWVATLDRYATRDSL

SEQ ID NO: 1268902 - protein, 21 aa, Mycobacterium
IHEVMPRQNLGQGATLQTQAA

SEQ ID NO: 1268903 - protein, 17 aa, Mycobacterium
IHGADPWWDVAIRLLIK

SEQ ID NO: 1268904 - protein, 26 aa, Mycobacterium
IHGFPESWYSWRHQIPALAAAGYRVV

SEQ ID NO: 1268905 - protein, 17 aa, Mycobacterium
IHGRLYKLDPFRYQLID

SEQ ID NO: 1268906 - protein, 18 aa, Mycobacterium
IHGVELVRQGAAIVDVGG

SEQ ID NO: 1268907 - protein, 19 aa, Mycobacterium
IHLHGGPGFSETRLLRHFN

SEQ ID NO: 1268908 - protein, 17 aa, Mycobacterium
IHLKRAHLPLHKLPDKW

SEQ ID NO: 1268909 - protein, 18 aa, Mycobacterium
IHNMCAWMVDSFGTEEQR

SEQ ID NO: 1268910 - protein, 17 aa, Mycobacterium
IHPAESRVRMLAEQTPA

SEQ ID NO: 1268911 - protein, 25 aa, Mycobacterium
IHPPQPVCRYCHSHNMGPREVSGRA

SEQ ID NO: 1268912 - protein, 25 aa, Mycobacterium
IHQARINVMPGFTGGGFYWHSDFET

SEQ ID NO: 1268913 - protein, 18 aa, Mycobacterium
IHQLERIIHVLALENHEL

SEQ ID NO: 1268914 - protein, 26 aa, Mycobacterium
IHQNHVFAVRCSDALSGDFLVYLLDT

SEQ ID NO: 1268915 - protein, 20 aa, Mycobacterium
IHQQDIRRPLGLDFDVPEDS

SEQ ID NO: 1268916 - protein, 19 aa, Mycobacterium
IHQTREWILRNSPVPVGTV

SEQ ID NO: 1268917 - protein, 18 aa, Mycobacterium
IHRPRYDDWSLPKGKVDP

SEQ ID NO: 1268918 - protein, 25 aa, Mycobacterium
IHSHLKMDGAWVIGRVRVPSYKIRI

SEQ ID NO: 1268919 - protein, 20 aa, Mycobacterium
IHSLAFTFGAKFTVPGTGVI

SEQ ID NO: 1268920 - protein, 28 aa, Mycobacterium
IHTVSPWRLCEYRAALQDPDWSHFRIDT

SEQ ID NO: 1268921 - protein, 28 aa, Mycobacterium
IHVVPKFDFPIPVLLRRLFARVPLLQRA

SEQ ID NO: 1268922 - protein, 17 aa, Mycobacterium
IHYEAVGVVGAITPWNV

SEQ ID NO: 1268923 - protein, 26 aa, Mycobacterium
IIACTAEILANIALREGRDADIGLAV

SEQ ID NO: 1268924 - protein, 25 aa, Mycobacterium
IIADFAAPVERVWQVYADPRQLEKI

SEQ ID NO: 1268925 - protein, 19 aa, Mycobacterium
IIADHSRTAAIIIGDGVSP

SEQ ID NO: 1268926 - protein, 23 aa, Mycobacterium
IIAKRGHIPVGYFKDEKKTAETF

SEQ ID NO: 1268927 - protein, 17 aa, Mycobacterium
IIANLHLHRFNAAADGI

SEQ ID NO: 1268928 - protein, 25 aa, Mycobacterium
IIATAWDCPFDGPTPPQRVVEIVDA

SEQ ID NO: 1268929 - protein, 17 aa, Mycobacterium
IIDALGISSSTYYRRIK

SEQ ID NO: 1268930 - protein, 19 aa, Mycobacterium
IIDEYGFTAIKLKGGVFPP

SEQ ID NO: 1268931 - protein, 17 aa, Mycobacterium
IIDFASSFGTLVLTRAY

SEQ ID NO: 1268932 - protein, 17 aa, Mycobacterium
IIDKALETIPDALAVIN

SEQ ID NO: 1268933 - protein, 25 aa, Mycobacterium
IIDPIGRPIFYGRLTEMTDTDFRVL

SEQ ID NO: 1268934 - protein, 24 aa, Mycobacterium
IIDQACARATVSLDVAVETNSMRL

SEQ ID NO: 1268935 - protein, 20 aa, Mycobacterium
IIDVDGFRVDECPRETTLEK

SEQ ID NO: 1268936 - protein, 23 aa, Mycobacterium
IIELPPGYLRRLKELCAERGMLL

SEQ ID NO: 1268937 - protein, 17 aa, Mycobacterium
IIERACGSYVYDSAGTP

SEQ ID NO: 1268938 - protein, 26 aa, Mycobacterium
IIFDPNCFALATGIEEHASYGIDFIE

SEQ ID NO: 1268939 - protein, 27 aa, Mycobacterium
IIGELLPDISVPFGVNVLWDGRASIDL

SEQ ID NO: 1268940 - protein, 32 aa, Mycobacterium
IIGGYLRDQVRAFRMLPNIVFAGRAISSQTIR

SEQ ID NO: 1268941 - protein, 24 aa, Mycobacterium
IIGRIKDLLIVDGRNHYPDDIEAT

SEQ ID NO: 1268942 - protein, 17 aa, Mycobacterium
IIGSGFSGLGMGIELQR

SEQ ID NO: 1268943 - protein, 17 aa, Mycobacterium
IIKTAIDEFGKIDGVVS

SEQ ID NO: 1268944 - protein, 25 aa, Mycobacterium
IILLRRLYARELAAIEAGHPLTKFP

SEQ ID NO: 1268945 - protein, 27 aa, Mycobacterium
IINECHRLCLDYAKTRTLWGRNIGQFQ

SEQ ID NO: 1268946 - protein, 26 aa, Mycobacterium
IIQEFVKKLPAWVSWERREHYERDLV

SEQ ID NO: 1268947 - protein, 17 aa, Mycobacterium
IIQPIVQAMAFDLPAQD

SEQ ID NO: 1268948 - protein, 25 aa, Mycobacterium
IIRLGCTRAKASVLAPGIDVDDVCA

SEQ ID NO: 1268949 - protein, 18 aa, Mycobacterium
IIRLMQGVVYRTSDEDTW

SEQ ID NO: 1268950 - protein, 18 aa, Mycobacterium
IISDIWLANLVAFSGHRA

SEQ ID NO: 1268951 - protein, 26 aa, Mycobacterium
IIVEHFRANVGWRLDGKAKAMVVTSS

SEQ ID NO: 1268952 - protein, 26 aa, Mycobacterium
IIVGAGLPLLMSGLLEVPVKMAQNFT

SEQ ID NO: 1268953 - protein, 23 aa, Mycobacterium
IIVSRPDPELVLRTIEKHEVTNY

SEQ ID NO: 1268954 - protein, 18 aa, Mycobacterium
IIYRMGVKPPEPKAILNT

SEQ ID NO: 1268955 - protein, 19 aa, Mycobacterium
IKAADYALTPGRYVGAAAV

SEQ ID NO: 1268956 - protein, 22 aa, Mycobacterium
IKAGEGHAFISAGVETVSRFAK

SEQ ID NO: 1268957 - protein, 24 aa, Mycobacterium
IKAGEGSAFISAGVETVSRFGKGA

SEQ ID NO: 1268958 - protein, 19 aa, Mycobacterium
IKANAVAPIAATRMTQDIL

SEQ ID NO: 1268959 - protein, 17 aa, Mycobacterium
IKAPVMIVASGKDHGVY

SEQ ID NO: 1268960 - protein, 25 aa, Mycobacterium
IKDGDRLRGALTILTVDERFGADIV

SEQ ID NO: 1268961 - protein, 22 aa, Mycobacterium
IKDKLWNTQEVVIGGWRQGEGG

SEQ ID NO: 1268962 - protein, 21 aa, Mycobacterium
IKDMVIRGGENVYPREIEEFL

SEQ ID NO: 1268963 - protein, 18 aa, Mycobacterium
IKDRHGRSILTVRDQNTF

SEQ ID NO: 1268964 - protein, 20 aa, Mycobacterium
IKDVIRMAGHANHYLAVFDR

SEQ ID NO: 1268965 - protein, 21 aa, Mycobacterium
IKEHAVAVALAMREKGAEPDL

SEQ ID NO: 1268966 - protein, 19 aa, Mycobacterium
IKELRRGRMTDYAEARRGA

SEQ ID NO: 1268967 - protein, 31 aa, Mycobacterium
IKGCSIADVCAMQISDLAEWIRGLDEASVRP

SEQ ID NO: 1268968 - protein, 19 aa, Mycobacterium
IKGLRLTLTQAAWRVSEGL

SEQ ID NO: 1268969 - protein, 17 aa, Mycobacterium
IKHMCAEMLLRAEQVSV

SEQ ID NO: 1268970 - protein, 20 aa, Mycobacterium
IKKSFLAKDVEAMQPHIRAF

SEQ ID NO: 1268971 - protein, 18 aa, Mycobacterium
IKLHQLGLSLKDSPASFD

SEQ ID NO: 1268972 - protein, 21 aa, Mycobacterium
IKLPHEQSARFTAALQSHKDR

SEQ ID NO: 1268973 - protein, 17 aa, Mycobacterium
IKLPSIYYAHQRKVFER

SEQ ID NO: 1268974 - protein, 19 aa, Mycobacterium
IKLRPSRGTHLVFGAEAFG

SEQ ID NO: 1268975 - protein, 19 aa, Mycobacterium
IKNRACSRGILDYYRGQDF

SEQ ID NO: 1268976 - protein, 25 aa, Mycobacterium
IKNWKGNVKKAGFLPQERQWLTELL

SEQ ID NO: 1268977 - protein, 27 aa, Mycobacterium
IKPFVSILCPECDPEHPEDPTPFDGEL

SEQ ID NO: 1268978 - protein, 17 aa, Mycobacterium
IKPGWGFSFDYEPGQYI

SEQ ID NO: 1268979 - protein, 19 aa, Mycobacterium
IKPLFVLFDSCWDPMPKPG

SEQ ID NO: 1268980 - protein, 33 aa, Mycobacterium
IKPQRGRISTWPLTEAFNGITVHGVLARTVSDA

SEQ ID NO: 1268981 - protein, 18 aa, Mycobacterium
IKQAPSFFDSADLEVSQY

SEQ ID NO: 1268982 - protein, 17 aa, Mycobacterium
IKQLPGLLVVLRDGGYR

SEQ ID NO: 1268983 - protein, 18 aa, Mycobacterium
IKQLVFGLLPTFAPALAD

SEQ ID NO: 1268984 - protein, 26 aa, Mycobacterium
IKQMQGWLDQWGMPGPNAPGGDMGPH

SEQ ID NO: 1268985 - protein, 19 aa, Mycobacterium
IKSDPNWRGGDYHGTGRSP

SEQ ID NO: 1268986 - protein, 18 aa, Mycobacterium
IKSVIKIAAEVPGRDVIV

SEQ ID NO: 1268987 - protein, 18 aa, Mycobacterium
IKVALDYEGAHHRGPDRF

SEQ ID NO: 1268988 - protein, 26 aa, Mycobacterium
ILAEEILTPLGFRWTNYGVAAQDVPL

SEQ ID NO: 1268989 - protein, 20 aa, Mycobacterium
ILAPESMLDWYADSRAKLLD

SEQ ID NO: 1268990 - protein, 17 aa, Mycobacterium
ILASGVCPVPRLRAAGV

SEQ ID NO: 1268991 - protein, 20 aa, Mycobacterium
ILCACCTTSCPVYWNEGSYF

SEQ ID NO: 1268992 - protein, 17 aa, Mycobacterium
ILCDLILIRSALSPRAA

SEQ ID NO: 1268993 - protein, 23 aa, Mycobacterium
ILDAALQRGECEFVDDVAGALPS

SEQ ID NO: 1268994 - protein, 17 aa, Mycobacterium
ILDEGRIAIAALSVGAA

SEQ ID NO: 1268995 - protein, 19 aa, Mycobacterium
ILDELRRAILDGAVPPGTP

SEQ ID NO: 1268996 - protein, 19 aa, Mycobacterium
ILDSESWVACLPRDHRLAE

SEQ ID NO: 1268997 - protein, 26 aa, Mycobacterium
ILDVIRRLSTLELKRRGGVRSVVLPQ

SEQ ID NO: 1268998 - protein, 17 aa, Mycobacterium
ILEGGAPPGSPIPVNDV

SEQ ID NO: 1268999 - protein, 19 aa, Mycobacterium
ILEGISIAAFIGATNRIGI

SEQ ID NO: 1269000 - protein, 23 aa, Mycobacterium
ILFNDLTVHFALRTRGRLQQGET

SEQ ID NO: 1269001 - protein, 18 aa, Mycobacterium
ILGCDAAVLAARIAALLK

SEQ ID NO: 1269002 - protein, 19 aa, Mycobacterium
ILGFYGLSYWYAEQVTILG

SEQ ID NO: 1269003 - protein, 17 aa, Mycobacterium
ILGRLRPQIGHVYGYRL

SEQ ID NO: 1269004 - protein, 23 aa, Mycobacterium
ILGRSQWAPVIFGCQAPDTGNAE

SEQ ID NO: 1269005 - protein, 17 aa, Mycobacterium
ILGSAAWTGHEGQQAKY

SEQ ID NO: 1269006 - protein, 23 aa, Mycobacterium
ILHERGWAAPAWPVAHGGCDWSL

SEQ ID NO: 1269007 - protein, 25 aa, Mycobacterium
ILHHPIRYIMKYWKDEPTVGINPGD

SEQ ID NO: 1269008 - protein, 18 aa, Mycobacterium
ILHPGIREMTGFDWQARH

SEQ ID NO: 1269009 - protein, 23 aa, Mycobacterium
ILHPGIREMTGFRWDARHDREFA

SEQ ID NO: 1269010 - protein, 25 aa, Mycobacterium
ILHRASGPMPKWYAPVGSLFDQFLG

SEQ ID NO: 1269011 - protein, 17 aa, Mycobacterium
ILIALRATDEFKAHVKI

SEQ ID NO: 1269012 - protein, 32 aa, Mycobacterium
ILKAIWALIGYDLPLPLPRISHADAMRRFGSD

SEQ ID NO: 1269013 - protein, 17 aa, Mycobacterium
ILLGHSYYDDWTDQEMF

SEQ ID NO: 1269014 - protein, 19 aa, Mycobacterium
ILLTSGKLYYELAARKSKE

SEQ ID NO: 1269015 - protein, 20 aa, Mycobacterium
ILNGAKCWITNGGKSSWYTV

SEQ ID NO: 1269016 - protein, 18 aa, Mycobacterium
ILPALGHLHSIGLVYNDL

SEQ ID NO: 1269017 - protein, 24 aa, Mycobacterium
ILQRDTWLDILGRFLHLQVTDKID

SEQ ID NO: 1269018 - protein, 17 aa, Mycobacterium
ILRAAYRLISHGSTTGT

SEQ ID NO: 1269019 - protein, 31 aa, Mycobacterium
ILRADDLNFLWLPLAHAFGKVMLALPLLVGF

SEQ ID NO: 1269020 - protein, 18 aa, Mycobacterium
ILRDGVIPRRLITSCEHF

SEQ ID NO: 1269021 - protein, 25 aa, Mycobacterium
ILRDNRFRLPPGITLAAQGITSGPL

SEQ ID NO: 1269022 - protein, 19 aa, Mycobacterium
ILRHVAKGLTAKQIASRLS

SEQ ID NO: 1269023 - protein, 19 aa, Mycobacterium
ILRLDRRGTLRFAALESGF

SEQ ID NO: 1269024 - protein, 19 aa, Mycobacterium
ILRTNLAAVILQMAALGFG

SEQ ID NO: 1269025 - protein, 20 aa, Mycobacterium
ILRVRGRGVPKRSGGHGDLL

SEQ ID NO: 1269026 - protein, 19 aa, Mycobacterium
ILSAATTFVCPSVYEPLGI

SEQ ID NO: 1269027 - protein, 26 aa, Mycobacterium
ILSASECWDLLAGAPLGRLVTSTEGE

SEQ ID NO: 1269028 - protein, 17 aa, Mycobacterium
ILSRLGAHMGDKTKRAL

SEQ ID NO: 1269029 - protein, 29 aa, Mycobacterium
ILTLACARLRLGGLMRRWDSLGVEVDGLL

SEQ ID NO: 1269030 - protein, 18 aa, Mycobacterium
ILVDICRSLPELEYPLAT

SEQ ID NO: 1269031 - protein, 26 aa, Mycobacterium
ILVSRLRPAMAAAPARRTYVVNVSAM

SEQ ID NO: 1269032 - protein, 17 aa, Mycobacterium
ILWDIQHLFGHIPDEHL

SEQ ID NO: 1269033 - protein, 23 aa, Mycobacterium
ILYQVPEALNLVYTEYVALIDSI

SEQ ID NO: 1269034 - protein, 18 aa, Mycobacterium
IMHMWKYVGWLMGVDEDW

SEQ ID NO: 1269035 - protein, 19 aa, Mycobacterium
IMQVIALEPGFGVDFLQQI

SEQ ID NO: 1269036 - protein, 19 aa, Mycobacterium
IMRAIDALNLLPLPNRLDL

SEQ ID NO: 1269037 - protein, 20 aa, Mycobacterium
IMTGALRPGTFIRLDETAAE

SEQ ID NO: 1269038 - protein, 22 aa, Mycobacterium
INASDLLGAFPRDHRLPPEVYD

SEQ ID NO: 1269039 - protein, 24 aa, Mycobacterium
INDLELLNCLLLLFMAGLDTVSNQ

SEQ ID NO: 1269040 - protein, 19 aa, Mycobacterium
INDRWQATMADYFDNRPDH

SEQ ID NO: 1269041 - protein, 18 aa, Mycobacterium
INEAASLVQEAAHPEANI

SEQ ID NO: 1269042 - protein, 23 aa, Mycobacterium
INELAPRLHGVVDRMEGIVTRVE

SEQ ID NO: 1269043 - protein, 17 aa, Mycobacterium
INFARPIVDRPMAEQAI

SEQ ID NO: 1269044 - protein, 27 aa, Mycobacterium
INFPADYLGRWVILFSHPADFTPVCTS

SEQ ID NO: 1269045 - protein, 20 aa, Mycobacterium
INGLNLYYAVHGELDGSKVP

SEQ ID NO: 1269046 - protein, 23 aa, Mycobacterium
INGRPRLLCMTRMSTFGEDEVVT

SEQ ID NO: 1269047 - protein, 18 aa, Mycobacterium
INGSMVLTMNRDGDRLYA

SEQ ID NO: 1269048 - protein, 20 aa, Mycobacterium
INGVLLPHVIRFNAEADPEP

SEQ ID NO: 1269049 - protein, 17 aa, Mycobacterium
INIGGPDKISFADLARA

SEQ ID NO: 1269050 - protein, 22 aa, Mycobacterium
INIGGVYWAVRSAIRYLSEGAR

SEQ ID NO: 1269051 - protein, 24 aa, Mycobacterium
INLDRPAYVYPMFEQALRIAAGET

SEQ ID NO: 1269052 - protein, 21 aa, Mycobacterium
INLDSRLRVVARRDFAGMISV

SEQ ID NO: 1269053 - protein, 20 aa, Mycobacterium
INMFEFARPVMEACGEPWPT

SEQ ID NO: 1269054 - protein, 18 aa, Mycobacterium
INNAFRVPSMKPFADTTF

SEQ ID NO: 1269055 - protein, 17 aa, Mycobacterium
INPDRLDPVAAIADLTG

SEQ ID NO: 1269056 - protein, 24 aa, Mycobacterium
INPEAWRWYRNVFGDNNIPVVDTW

SEQ ID NO: 1269057 - protein, 18 aa, Mycobacterium
INPGYVRTPLVTRQIADQ

SEQ ID NO: 1269058 - protein, 25 aa, Mycobacterium
INPHSWSAAPNFAFELSVRRTSDAD

SEQ ID NO: 1269059 - protein, 20 aa, Mycobacterium
INRHIKRGGKVWINIFPDRP

SEQ ID NO: 1269060 - protein, 18 aa, Mycobacterium
INRQVYRLLGRLKLTNGI

SEQ ID NO: 1269061 - protein, 24 aa, Mycobacterium
INRRWPSKSELVFHAILGDRPDLA

SEQ ID NO: 1269062 - protein, 25 aa, Mycobacterium
IPAACCGLVGLKPGRGLTPMGPELG

SEQ ID NO: 1269063 - protein, 19 aa, Mycobacterium
IPADRLSRILPLVPGNPRL

SEQ ID NO: 1269064 - protein, 17 aa, Mycobacterium
IPAEAGGSIGRPKRTAD

SEQ ID NO: 1269065 - protein, 17 aa, Mycobacterium
IPAERAWHHAADLSTLG

SEQ ID NO: 1269066 - protein, 31 aa, Mycobacterium
IPAGERAKWATYPILAVQGWAQHHNQQLRAV

SEQ ID NO: 1269067 - protein, 18 aa, Mycobacterium
IPAGSVADHIIVRDGDDV

SEQ ID NO: 1269068 - protein, 26 aa, Mycobacterium
IPAPAARWAFCNGMTPAQRRLTMSKL

SEQ ID NO: 1269069 - protein, 27 aa, Mycobacterium
IPAPCRSTLRPTRRGWRRSGISHSGPA

SEQ ID NO: 1269070 - protein, 26 aa, Mycobacterium
IPAPITPVLVPLTWVPIVGKPLAIAL

SEQ ID NO: 1269071 - protein, 18 aa, Mycobacterium
IPCELALLAIGFEGVEHM

SEQ ID NO: 1269072 - protein, 17 aa, Mycobacterium
IPCTVTGTVVADGRTYA

SEQ ID NO: 1269073 - protein, 23 aa, Mycobacterium
IPDDRPALVIGEGLTMYLREADG

SEQ ID NO: 1269074 - protein, 27 aa, Mycobacterium
IPDFVKLSEALGCVGLRCERSEDVADV

SEQ ID NO: 1269075 - protein, 23 aa, Mycobacterium
IPDGEWFNGNMFGGAPLDGPTQA

SEQ ID NO: 1269076 - protein, 18 aa, Mycobacterium
IPDGLSFVEAAPMGCAGV

SEQ ID NO: 1269077 - protein, 26 aa, Mycobacterium
IPDGRLRCWDDFIGGQSTAFDWPEFD

SEQ ID NO: 1269078 - protein, 23 aa, Mycobacterium
IPDLETFAVLPWDTSFARVFCRL

SEQ ID NO: 1269079 - protein, 18 aa, Mycobacterium
IPDLITWWCERDGVRPDK

SEQ ID NO: 1269080 - protein, 17 aa, Mycobacterium
IPDLLAPSDTDPVYQTM

SEQ ID NO: 1269081 - protein, 22 aa, Mycobacterium
IPDLPGSFYRPTLIADVGEQSE

SEQ ID NO: 1269082 - protein, 20 aa, Mycobacterium
IPDLRFTVERVYQGIDTVVI

SEQ ID NO: 1269083 - protein, 21 aa, Mycobacterium
IPDLRGYRTVPVDDFVVDGAA

SEQ ID NO: 1269084 - protein, 22 aa, Mycobacterium
IPDLTVAEGFAIQRAQVDRWTA

SEQ ID NO: 1269085 - protein, 19 aa, Mycobacterium
IPDRTDVVWLDHIEDARSG

SEQ ID NO: 1269086 - protein, 20 aa, Mycobacterium
IPDWRAAVAEAARVLIAGGR

SEQ ID NO: 1269087 - protein, 20 aa, Mycobacterium
IPDWRAAVAEAARVLIPGGR

SEQ ID NO: 1269088 - protein, 18 aa, Mycobacterium
IPEALPMGVASEAGLQPN

SEQ ID NO: 1269089 - protein, 20 aa, Mycobacterium
IPEDARAAIVGFRGLGTAVP

SEQ ID NO: 1269090 - protein, 20 aa, Mycobacterium
IPEGARLQLDPELDLGSLDL

SEQ ID NO: 1269091 - protein, 24 aa, Mycobacterium
IPEGKLAATLERYNEHAARGEDPD

SEQ ID NO: 1269092 - protein, 25 aa, Mycobacterium
IPEGLLNYLALLGWGIADDRDVFGL

SEQ ID NO: 1269093 - protein, 25 aa, Mycobacterium
IPEGLLNYLALLGWSIADDHDIFSL

SEQ ID NO: 1269094 - protein, 25 aa, Mycobacterium
IPEPWRSKYFLTRKVGEQIYYDAPD

SEQ ID NO: 1269095 - protein, 27 aa, Mycobacterium
IPERGDMAGRSRLEVIAPGAARQLASV

SEQ ID NO: 1269096 - protein, 21 aa, Mycobacterium
IPEVKDWVWPAARESGFGTAA

SEQ ID NO: 1269097 - protein, 25 aa, Mycobacterium
IPFALSAWTIRLLTRLPQRSVTALA

SEQ ID NO: 1269098 - protein, 20 aa, Mycobacterium
IPFDDLLPVCADLLAMTRQQ

SEQ ID NO: 1269099 - protein, 17 aa, Mycobacterium
IPFGPLVAGAAFGHKPD

SEQ ID NO: 1269100 - protein, 19 aa, Mycobacterium
IPFGPVLNARADWLEETGR

SEQ ID NO: 1269101 - protein, 18 aa, Mycobacterium
IPFQDWWTNPVVTDADGS

SEQ ID NO: 1269102 - protein, 28 aa, Mycobacterium
IPFQISCGHCFMCDRKLYTQCETTQVRD

SEQ ID NO: 1269103 - protein, 21 aa, Mycobacterium
IPGDSFIGPRFSMFGPTVATW

SEQ ID NO: 1269104 - protein, 31 aa, Mycobacterium
IPGFSMEGWYGRIFNGCGFFDPDKPIRDFTA

SEQ ID NO: 1269105 - protein, 20 aa, Mycobacterium
IPGGAFVYGAGQFQLYNGSR

SEQ ID NO: 1269106 - protein, 17 aa, Mycobacterium
IPGHLSPGVRVILHSEN

SEQ ID NO: 1269107 - protein, 25 aa, Mycobacterium
IPGKRPRKYLRVTLGRRNPVVTATF

SEQ ID NO: 1269108 - protein, 21 aa, Mycobacterium
IPGLRLPWDGPTFLESLITTM

SEQ ID NO: 1269109 - protein, 17 aa, Mycobacterium
IPGMDTFGGSSLFTSRW

SEQ ID NO: 1269110 - protein, 17 aa, Mycobacterium
IPGPGLSVYGMTKGAVA

SEQ ID NO: 1269111 - protein, 18 aa, Mycobacterium
IPGQWAFVSTNSISQGQA

SEQ ID NO: 1269112 - protein, 22 aa, Mycobacterium
IPGWNVCVDFQINPGLNEFLNG

SEQ ID NO: 1269113 - protein, 21 aa, Mycobacterium
IPHEVGWIGGPGVGAVHLDKG

SEQ ID NO: 1269114 - protein, 19 aa, Mycobacterium
IPHGCLPEVIVVVDEPGDR

SEQ ID NO: 1269115 - protein, 22 aa, Mycobacterium
IPHVRARGGGSLIAVTTTGVNM

SEQ ID NO: 1269116 - protein, 17 aa, Mycobacterium
IPIPGFSSALSYYDGLR

SEQ ID NO: 1269117 - protein, 21 aa, Mycobacterium
IPKLRHGSYFPDWLLERRKRA

SEQ ID NO: 1269118 - protein, 21 aa, Mycobacterium
IPLDDGRRLYALTEIMNTRPL

SEQ ID NO: 1269119 - protein, 20 aa, Mycobacterium
IPLDDVLDAFQIVKNGEAIK

SEQ ID NO: 1269120 - protein, 17 aa, Mycobacterium
IPLDVSEGDVVIYSKYG

SEQ ID NO: 1269121 - protein, 28 aa, Mycobacterium
IPLSRACLLGCGVTTGWGSAVNTADVSP

SEQ ID NO: 1269122 - protein, 42 aa, Mycobacterium
IPMMARNLLESFTLLANVSKLFAAKCIDGLVANDDHLRELAE

SEQ ID NO: 1269123 - protein, 17 aa, Mycobacterium
IPMTLPVIWDPEACAKE

SEQ ID NO: 1269124 - protein, 25 aa, Mycobacterium
IPNPCNRCSGDGRVRARREISVKIP

SEQ ID NO: 1269125 - protein, 21 aa, Mycobacterium
IPPDRVLDSLVHVWTCAVYGE

SEQ ID NO: 1269126 - protein, 22 aa, Mycobacterium
IPPDRVLDSLVHVWTCAVYGEC

SEQ ID NO: 1269127 - protein, 17 aa, Mycobacterium
IPPFPPSAINTWSGPEV

SEQ ID NO: 1269128 - protein, 20 aa, Mycobacterium
IPPFYVMDVWLAAAERRRTH

SEQ ID NO: 1269129 - protein, 21 aa, Mycobacterium
IPPKAFPVVCEQLRRSGLARP

SEQ ID NO: 1269130 - protein, 18 aa, Mycobacterium
IPPLIRRPQSVSVALAAH

SEQ ID NO: 1269131 - protein, 18 aa, Mycobacterium
IPPTARMGSLPVGLRQIV

SEQ ID NO: 1269132 - protein, 25 aa, Mycobacterium
IPPTRFKRKPHWLEAHFTGDSSAVM

SEQ ID NO: 1269133 - protein, 27 aa, Mycobacterium
IPQRGDFGLRPAMTVKCPVSAVRPVRA

SEQ ID NO: 1269134 - protein, 20 aa, Mycobacterium
IPRARAPEVRERLTDCVDDL

SEQ ID NO: 1269135 - protein, 20 aa, Mycobacterium
IPRECDAVLYTRAGPEIGVA

SEQ ID NO: 1269136 - protein, 34 aa, Mycobacterium
IPRKDSLPLEGLRVVDMTTFWAGPSCTHLLAMLG

SEQ ID NO: 1269137 - protein, 20 aa, Mycobacterium
IPRMLELYGSGRLMLDELIT

SEQ ID NO: 1269138 - protein, 21 aa, Mycobacterium
IPRMVDWIAARTRFFDDYFNA

SEQ ID NO: 1269139 - protein, 17 aa, Mycobacterium
IPRRGVGDSVLIVPVVT

SEQ ID NO: 1269140 - protein, 21 aa, Mycobacterium
IPSAQMRRGDLIFYGPNASQH

SEQ ID NO: 1269141 - protein, 21 aa, Mycobacterium
IPSFLRYGTYPQIVVVREQSG

SEQ ID NO: 1269142 - protein, 19 aa, Mycobacterium
IPSHATVAVGGNRQGDKGF

SEQ ID NO: 1269143 - protein, 20 aa, Mycobacterium
IPSPDAFQAMNHQLQTLAQA

SEQ ID NO: 1269144 - protein, 17 aa, Mycobacterium
IPSRPEALAGLVDDATI

SEQ ID NO: 1269145 - protein, 20 aa, Mycobacterium
IPSVNRLGGLRDLAESDHVL

SEQ ID NO: 1269146 - protein, 17 aa, Mycobacterium
IPSVSYWNAERRCAAQK

SEQ ID NO: 1269147 - protein, 26 aa, Mycobacterium
IPSYPHPRLMPDFWEFPTVSMGLGPM

SEQ ID NO: 1269148 - protein, 17 aa, Mycobacterium
IPSYVRYGANPYVVVIR

SEQ ID NO: 1269149 - protein, 19 aa, Mycobacterium
IPTDQGWTLTGTVQRVVDA

SEQ ID NO: 1269150 - protein, 18 aa, Mycobacterium
IPTESFAFVGADKATAAP

SEQ ID NO: 1269151 - protein, 24 aa, Mycobacterium
IPTHGSAIGEVFSTKTPVRFDTLE

SEQ ID NO: 1269152 - protein, 20 aa, Mycobacterium
IPTLCYLRDKPCLGTCRVCS

SEQ ID NO: 1269153 - protein, 19 aa, Mycobacterium
IPTLERWTVDLADGKVRES

SEQ ID NO: 1269154 - protein, 21 aa, Mycobacterium
IPTPGAAPVGITWGGDAVWFV

SEQ ID NO: 1269155 - protein, 23 aa, Mycobacterium
IPTVDSPSGWVYIVADNFDRSGP

SEQ ID NO: 1269156 - protein, 17 aa, Mycobacterium
IPVAPDITGLLCSGVLA

SEQ ID NO: 1269157 - protein, 17 aa, Mycobacterium
IPVAPTLNDLVDVKLKW

SEQ ID NO: 1269158 - protein, 20 aa, Mycobacterium
IPVDEHWRVMSDLATYADGT

SEQ ID NO: 1269159 - protein, 17 aa, Mycobacterium
IPVDSIYSPVLKVTYKV

SEQ ID NO: 1269160 - protein, 19 aa, Mycobacterium
IPVGVGLGVRSREQAAEIA

SEQ ID NO: 1269161 - protein, 21 aa, Mycobacterium
IPVTVKFRIGIDDAHHTHLDA

SEQ ID NO: 1269162 - protein, 24 aa, Mycobacterium
IPVVPRRPGGLVLLTSGTTGIPKG

SEQ ID NO: 1269163 - protein, 19 aa, Mycobacterium
IPVYAEMSAVNPVFLLDGA

SEQ ID NO: 1269164 - protein, 18 aa, Mycobacterium
IPYGATIEATAGDGSPVV

SEQ ID NO: 1269165 - protein, 42 aa, Mycobacterium
IQAALSRIGSPYSWGGSGPGAFDCSGLVMWSFQQAGISLPHS

SEQ ID NO: 1269166 - protein, 19 aa, Mycobacterium
IQAIKGVEIGDGFETARRR

SEQ ID NO: 1269167 - protein, 28 aa, Mycobacterium
IQAQDFFFRKIVRDKGVALAHVAGQIEQ

SEQ ID NO: 1269168 - protein, 23 aa, Mycobacterium
IQASFPVECWKQPKVPDTGATSL

SEQ ID NO: 1269169 - protein, 23 aa, Mycobacterium
IQDASGAPARIPVDAGPVALEFP

SEQ ID NO: 1269170 - protein, 24 aa, Mycobacterium
IQDFVKKLPVWVSWDRREGYERDL

SEQ ID NO: 1269171 - protein, 29 aa, Mycobacterium
IQDVQWSRPGADPVWFEIHVNPLVDTENG

SEQ ID NO: 1269172 - protein, 18 aa, Mycobacterium
IQIPRFCDHPLLDPVGAC

SEQ ID NO: 1269173 - protein, 21 aa, Mycobacterium
IQLARLVWRVQGLKFTVTGVE

SEQ ID NO: 1269174 - protein, 21 aa, Mycobacterium
IQLFLSFLSVQGIDWRTATFE

SEQ ID NO: 1269175 - protein, 24 aa, Mycobacterium
IQLPVVCTVRGWAVGLGANLALAA

SEQ ID NO: 1269176 - protein, 19 aa, Mycobacterium
IQLQPALVVSKAAYLKLYP

SEQ ID NO: 1269177 - protein, 25 aa, Mycobacterium
IQLRNTATLLGWVLGQAGVDPLATV

SEQ ID NO: 1269178 - protein, 17 aa, Mycobacterium
IQMHGGIGFTWEHPAHI

SEQ ID NO: 1269179 - protein, 19 aa, Mycobacterium
IQPQFVHVFFDGRIIESGG

SEQ ID NO: 1269180 - protein, 26 aa, Mycobacterium
IQQGWLRAAVKQFLRWRHDTGHSPSG

SEQ ID NO: 1269181 - protein, 20 aa, Mycobacterium
IQQRLGAAASAFAAGAITLP

SEQ ID NO: 1269182 - protein, 24 aa, Mycobacterium
IQRALRPGGTFLMVDIKSSSRVED

SEQ ID NO: 1269183 - protein, 23 aa, Mycobacterium
IQREVVARTGLRDCRVHGRTWDL

SEQ ID NO: 1269184 - protein, 42 aa, Mycobacterium
IQRFPNVLVLRTFSKAYGLAGLRIGYAIGSWGLTAELWAMQL

SEQ ID NO: 1269185 - protein, 17 aa, Mycobacterium
IQRGDIVFPKSVTLQRI

SEQ ID NO: 1269186 - protein, 25 aa, Mycobacterium
IQSFDWRTLPLVRHLEPSIPLVALW

SEQ ID NO: 1269187 - protein, 28 aa, Mycobacterium
IQSICAAIDFGAAAGRAALTLPGPPPVP

SEQ ID NO: 1269188 - protein, 19 aa, Mycobacterium
IQSQIGLRPTPLTWPVGIA

SEQ ID NO: 1269189 - protein, 19 aa, Mycobacterium
IQYLLLRSGPMTMPPSTLG

SEQ ID NO: 1269190 - protein, 18 aa, Mycobacterium
IRAALALENALLDRLVGG

SEQ ID NO: 1269191 - protein, 19 aa, Mycobacterium
IRAALVSWERASMLADALP

SEQ ID NO: 1269192 - protein, 26 aa, Mycobacterium
IRAATLAALAPRPGELLWDVGAGSGS

SEQ ID NO: 1269193 - protein, 20 aa, Mycobacterium
IRAAWPHFRENGFGRVVVAT

SEQ ID NO: 1269194 - protein, 23 aa, Mycobacterium
IRAAWPHFREQSFGRVVVATSTS

SEQ ID NO: 1269195 - protein, 21 aa, Mycobacterium
IRADCAPVIEKFWRTSLGPGL

SEQ ID NO: 1269196 - protein, 22 aa, Mycobacterium
IRAGEINGIVAWHPDRLHRQTR

SEQ ID NO: 1269197 - protein, 29 aa, Mycobacterium
IRAGELRRLKICAAPDCHAVLVDLSRNRS

SEQ ID NO: 1269198 - protein, 20 aa, Mycobacterium
IRAGIDCIEHGFLASDETIQ

SEQ ID NO: 1269199 - protein, 18 aa, Mycobacterium
IRAGSVAINHGFDMAAPF

SEQ ID NO: 1269200 - protein, 27 aa, Mycobacterium
IRALLERDLPVYIISIGRTFRTDELDA

SEQ ID NO: 1269201 - protein, 18 aa, Mycobacterium
IRALLGWIRAEQPGAAIG

SEQ ID NO: 1269202 - protein, 20 aa, Mycobacterium
IRALTARDALADWVGFKAQL

SEQ ID NO: 1269203 - protein, 20 aa, Mycobacterium
IRALTVQFVQGFTPLPEGPS

SEQ ID NO: 1269204 - protein, 31 aa, Mycobacterium
IRARHLPPRHFKLSYLVAAWTQRPEDEHRLL

SEQ ID NO: 1269205 - protein, 17 aa, Mycobacterium
IRARNLLGTNEYGAITA

SEQ ID NO: 1269206 - protein, 17 aa, Mycobacterium
IRARRGVVLAMGSFAYN

SEQ ID NO: 1269207 - protein, 19 aa, Mycobacterium
IRASALAAHLFGRAGDVPA

SEQ ID NO: 1269208 - protein, 17 aa, Mycobacterium
IRCEAGGAPAPAVVAEP

SEQ ID NO: 1269209 - protein, 18 aa, Mycobacterium
IRCLLDKRLHGVGHALLA

SEQ ID NO: 1269210 - protein, 19 aa, Mycobacterium
IRDALEIRSARRAEGEAIE

SEQ ID NO: 1269211 - protein, 17 aa, Mycobacterium
IRDAVLMRLAAGVIDTV

SEQ ID NO: 1269212 - protein, 24 aa, Mycobacterium
IRDDARILLCSSVTGVWGGKGVGG

SEQ ID NO: 1269213 - protein, 22 aa, Mycobacterium
IRDRYATAIARIAEYDRVKGTE

SEQ ID NO: 1269214 - protein, 19 aa, Mycobacterium
IRDVIGGLVADIPFGALVG

SEQ ID NO: 1269215 - protein, 19 aa, Mycobacterium
IRDYVPLFVERNAAAELTK

SEQ ID NO: 1269216 - protein, 25 aa, Mycobacterium
IREERWCWLEDGRVRGDIEVTVTGA

SEQ ID NO: 1269217 - protein, 19 aa, Mycobacterium
IREGGEWGLDEVAELGALS

SEQ ID NO: 1269218 - protein, 29 aa, Mycobacterium
IRELGGFPDVIGPFLGRAAAAVKALTEQA

SEQ ID NO: 1269219 - protein, 22 aa, Mycobacterium
IRELRFTADYHRLYDAISDALG

SEQ ID NO: 1269220 - protein, 25 aa, Mycobacterium
IRENPRPGLVNALLQLRIDGEPAPD

SEQ ID NO: 1269221 - protein, 19 aa, Mycobacterium
IRESSRFGVDSHIDDVRWT

SEQ ID NO: 1269222 - protein, 18 aa, Mycobacterium
IREVNSFEGRRIYGRSNL

SEQ ID NO: 1269223 - protein, 17 aa, Mycobacterium
IRFAESAIQVMGKAGEH

SEQ ID NO: 1269224 - protein, 29 aa, Mycobacterium
IRFMPKPVICLVNGWAAGGGHSLHVVCDL

SEQ ID NO: 1269225 - protein, 17 aa, Mycobacterium
IRFPLGVASAGLAILSH

SEQ ID NO: 1269226 - protein, 20 aa, Mycobacterium
IRGALEHCYDAFEGLCTDLS

SEQ ID NO: 1269227 - protein, 17 aa, Mycobacterium
IRGPRIVAQLASGVVVG

SEQ ID NO: 1269228 - protein, 19 aa, Mycobacterium
IRHLGPYAAVWDVPTDMFA

SEQ ID NO: 1269229 - protein, 20 aa, Mycobacterium
IRIAGRRALELAGAGVDDMD

SEQ ID NO: 1269230 - protein, 19 aa, Mycobacterium
IRIENRLAALIPPPVRKLP

SEQ ID NO: 1269231 - protein, 18 aa, Mycobacterium
IRIGHEVEEIIPAGPVTG

SEQ ID NO: 1269232 - protein, 17 aa, Mycobacterium
IRIPVAIKPALPDTRTS

SEQ ID NO: 1269233 - protein, 17 aa, Mycobacterium
IRIVDMIGVHNAERVYG

SEQ ID NO: 1269234 - protein, 17 aa, Mycobacterium
IRKEGKIGRVYYPAPYM

SEQ ID NO: 1269235 - protein, 19 aa, Mycobacterium
IRKGRRVSAATAFLKPAMR

SEQ ID NO: 1269236 - protein, 26 aa, Mycobacterium
IRLAAGTLIRFVRPVADPALYLYAAV

SEQ ID NO: 1269237 - protein, 17 aa, Mycobacterium
IRLAVDAVEDMFRLPDL

SEQ ID NO: 1269238 - protein, 19 aa, Mycobacterium
IRLDHPGVLVIEGGPGTGK

SEQ ID NO: 1269239 - protein, 20 aa, Mycobacterium
IRLDHPGVLVIEGGPGTGKT

SEQ ID NO: 1269240 - protein, 19 aa, Mycobacterium
IRLGDYCLGLYGSRDYLAE

SEQ ID NO: 1269241 - protein, 20 aa, Mycobacterium
IRLGTNHAYAVVETGKESTM

SEQ ID NO: 1269242 - protein, 17 aa, Mycobacterium
IRLHRRFDIDAMLRHIE

SEQ ID NO: 1269243 - protein, 17 aa, Mycobacterium
IRLIPDLTTLRRVPWEP

SEQ ID NO: 1269244 - protein, 17 aa, Mycobacterium
IRLKLNPLKEVIRGKRL

SEQ ID NO: 1269245 - protein, 17 aa, Mycobacterium
IRLLAATTFFDASTYSR

SEQ ID NO: 1269246 - protein, 20 aa, Mycobacterium
IRLLIIDGRLPVGARLPSER

SEQ ID NO: 1269247 - protein, 21 aa, Mycobacterium
IRLLNRVEIRGGAGSGKTFLA

SEQ ID NO: 1269248 - protein, 24 aa, Mycobacterium
IRLLRRRSHGGFVWTDEPGGAVSL

SEQ ID NO: 1269249 - protein, 19 aa, Mycobacterium
IRLMAGHELVTEGFAPGQV

SEQ ID NO: 1269250 - protein, 22 aa, Mycobacterium
IRLPESGSICFLIRTYMLPFAD

SEQ ID NO: 1269251 - protein, 27 aa, Mycobacterium
IRLTAKLRFVTGVASLIVKANGRDTDP

SEQ ID NO: 1269252 - protein, 19 aa, Mycobacterium
IRLTCGRALSLPPLPTPTD

SEQ ID NO: 1269253 - protein, 20 aa, Mycobacterium
IRLTRPGGVVLYATCSPHLA

SEQ ID NO: 1269254 - protein, 22 aa, Mycobacterium
IRLTRPGGVVLYATCSPHLAET

SEQ ID NO: 1269255 - protein, 19 aa, Mycobacterium
IRLTYWLVTRAETLRRPEV

SEQ ID NO: 1269256 - protein, 23 aa, Mycobacterium
IRLYKRMFKPGVDDLVFIGFAQS

SEQ ID NO: 1269257 - protein, 17 aa, Mycobacterium
IRMGRLSERFAKIRAQR

SEQ ID NO: 1269258 - protein, 26 aa, Mycobacterium
IRMSQRLGIPLARIREALATLPTDRV

SEQ ID NO: 1269259 - protein, 17 aa, Mycobacterium
IRNAPGLAMTYITDRLG

SEQ ID NO: 1269260 - protein, 26 aa, Mycobacterium
IRNGVIARKGAAYGIATPISDIVVPL

SEQ ID NO: 1269261 - protein, 25 aa, Mycobacterium
IRPADLVPHRKVVPGSGWRLALYKA

SEQ ID NO: 1269262 - protein, 17 aa, Mycobacterium
IRPATSHLVVWPADSSG

SEQ ID NO: 1269263 - protein, 23 aa, Mycobacterium
IRPGTDALLLFAMLHTLDEQGWV

SEQ ID NO: 1269264 - protein, 27 aa, Mycobacterium
IRPLLLMLSHPFYWEHFGRLTDVVRTG

SEQ ID NO: 1269265 - protein, 19 aa, Mycobacterium
IRPPFVLDPSMRFYSPQAN

SEQ ID NO: 1269266 - protein, 19 aa, Mycobacterium
IRPTARPGKLFGRSRSFPL

SEQ ID NO: 1269267 - protein, 17 aa, Mycobacterium
IRQEILAGVGGVRAIRA

SEQ ID NO: 1269268 - protein, 24 aa, Mycobacterium
IRQGRKAWTGFCGISQQPIKDFAV

SEQ ID NO: 1269269 - protein, 18 aa, Mycobacterium
IRQHRFTISVARDELQSG

SEQ ID NO: 1269270 - protein, 18 aa, Mycobacterium
IRQLITRLDNFVGVLDAQ

SEQ ID NO: 1269271 - protein, 18 aa, Mycobacterium
IRQNGVVIGLEFDHPEGA

SEQ ID NO: 1269272 - protein, 23 aa, Mycobacterium
IRQRIEDIVSIALQEDVALVGLS

SEQ ID NO: 1269273 - protein, 24 aa, Mycobacterium
IRQTPRPGLIDALVRTRIDGQPAP

SEQ ID NO: 1269274 - protein, 17 aa, Mycobacterium
IRQVLGLAGVEIGSNVC

SEQ ID NO: 1269275 - protein, 18 aa, Mycobacterium
IRRAAGLPEELTPVEKAL

SEQ ID NO: 1269276 - protein, 18 aa, Mycobacterium
IRRAAGLSTELTVIETAM

SEQ ID NO: 1269277 - protein, 26 aa, Mycobacterium
IRRAMSQMGVPYSWGGGNAAGPSRGI

SEQ ID NO: 1269278 - protein, 20 aa, Mycobacterium
IRREGIRYATFVGAQLAQID

SEQ ID NO: 1269279 - protein, 17 aa, Mycobacterium
IRRELRAAGVPFDSEND

SEQ ID NO: 1269280 - protein, 20 aa, Mycobacterium
IRRGEILGLIGPNGAGKTTC

SEQ ID NO: 1269281 - protein, 17 aa, Mycobacterium
IRRGRPLPERSRLHATA

SEQ ID NO: 1269282 - protein, 17 aa, Mycobacterium
IRRNARDSYHIGVFGLK

SEQ ID NO: 1269283 - protein, 18 aa, Mycobacterium
IRRNVPPGALAVSAGSQR

SEQ ID NO: 1269284 - protein, 18 aa, Mycobacterium
IRRPLGLDFDVPEDSLRV

SEQ ID NO: 1269285 - protein, 19 aa, Mycobacterium
IRRRGLLIGAEPCVNGVED

SEQ ID NO: 1269286 - protein, 17 aa, Mycobacterium
IRRSACVDRYRLDEFSR

SEQ ID NO: 1269287 - protein, 24 aa, Mycobacterium
IRRSGRLALPVPRSVLVAVDSLWR

SEQ ID NO: 1269288 - protein, 19 aa, Mycobacterium
IRSDLLVLLRRLHRRDDVS

SEQ ID NO: 1269289 - protein, 27 aa, Mycobacterium
IRSGALRAARHWGRPLDLEWAIDGTGK

SEQ ID NO: 1269290 - protein, 20 aa, Mycobacterium
IRSRMFAPHLGIREDEATGA

SEQ ID NO: 1269291 - protein, 28 aa, Mycobacterium
IRTCDCFNIPIVLLVDVPGFLPGTDQEY

SEQ ID NO: 1269292 - protein, 23 aa, Mycobacterium
IRTCRELKDVLAYAEDPVGPEDG

SEQ ID NO: 1269293 - protein, 17 aa, Mycobacterium
IRTHGIGIIGSDEHLKG

SEQ ID NO: 1269294 - protein, 26 aa, Mycobacterium
IRTIMSKELACLTLGDAGAALLLERA

SEQ ID NO: 1269295 - protein, 36 aa, Mycobacterium
IRTNPIVLVDFWASWCGPCRSFAPVFDRSSQTHPDV

SEQ ID NO: 1269296 - protein, 28 aa, Mycobacterium
IRTRVAAALPEYMTPAAYVVVDEIPITA

SEQ ID NO: 1269297 - protein, 24 aa, Mycobacterium
IRTTAVRAGDDWILNGSKTFISAG

SEQ ID NO: 1269298 - protein, 20 aa, Mycobacterium
IRTWHEPNLRNPGGGAEYGD

SEQ ID NO: 1269299 - protein, 19 aa, Mycobacterium
IRVAPEFQSTIDVGFRGSA

SEQ ID NO: 1269300 - protein, 18 aa, Mycobacterium
IRVGRLLFNTRLDNPVVV

SEQ ID NO: 1269301 - protein, 27 aa, Mycobacterium
IRVNSVLPGYIWGGTLESYFTHQAGKY

SEQ ID NO: 1269302 - protein, 25 aa, Mycobacterium
IRVYVPFGTQWYGYFVRRLAERPAN

SEQ ID NO: 1269303 - protein, 21 aa, Mycobacterium
IRWLALHGVIRGLSKVAVRRG

SEQ ID NO: 1269304 - protein, 22 aa, Mycobacterium
IRWMGSGPLTGLGELQLPDLQP

SEQ ID NO: 1269305 - protein, 20 aa, Mycobacterium
IRYKSLIGIAGVAAERIKNA

SEQ ID NO: 1269306 - protein, 24 aa, Mycobacterium
ISAATCFPNISFVHNWPKVEDGEH

SEQ ID NO: 1269307 - protein, 25 aa, Mycobacterium
ISAATCFPNISFVHNWPKVEDGEHV

SEQ ID NO: 1269308 - protein, 27 aa, Mycobacterium
ISAEEALAMGLAWKVCEPAELMPTAFD

SEQ ID NO: 1269309 - protein, 25 aa, Mycobacterium
ISAGAADCILAFDLLTAVDAKNVGY

SEQ ID NO: 1269310 - protein, 17 aa, Mycobacterium
ISAHLLAAARRREYRRW

SEQ ID NO: 1269311 - protein, 20 aa, Mycobacterium
ISAHVPRYANRYENGMLACG

SEQ ID NO: 1269312 - protein, 21 aa, Mycobacterium
ISALKGGRLVVMPTDTVYGIG

SEQ ID NO: 1269313 - protein, 27 aa, Mycobacterium
ISALMELLGSPQLGYPSIHIGGTNGKT

SEQ ID NO: 1269314 - protein, 18 aa, Mycobacterium
ISALRSGADVLRRNADEQ

SEQ ID NO: 1269315 - protein, 17 aa, Mycobacterium
ISAPLLDANYWVANVRR

SEQ ID NO: 1269316 - protein, 27 aa, Mycobacterium
ISARPAITLCWIREAPGLGAAARPLHR

SEQ ID NO: 1269317 - protein, 24 aa, Mycobacterium
ISAVLPTLAAPLMANVTALQAKEG

SEQ ID NO: 1269318 - protein, 25 aa, Mycobacterium
ISAYTRGRFASAFGPHAALEHVPPG

SEQ ID NO: 1269319 - protein, 17 aa, Mycobacterium
ISCVSAGSILRNLDPQR

SEQ ID NO: 1269320 - protein, 24 aa, Mycobacterium
ISDELAEQRWYLATLRDEGAVAKR

SEQ ID NO: 1269321 - protein, 20 aa, Mycobacterium
ISDLQPGDIVTFYSDVSHAG

SEQ ID NO: 1269322 - protein, 18 aa, Mycobacterium
ISDMRGGANGGRIRLQPQ

SEQ ID NO: 1269323 - protein, 20 aa, Mycobacterium
ISEALLPHLRPLLEGPATWA

SEQ ID NO: 1269324 - protein, 25 aa, Mycobacterium
ISELDQGRSWGWRVAGVPATRHGVQ

SEQ ID NO: 1269325 - protein, 24 aa, Mycobacterium
ISELPRAVDLFFRGITDWIIGGIR

SEQ ID NO: 1269326 - protein, 22 aa, Mycobacterium
ISEVLFPPAPWMFGAAGREHMK

SEQ ID NO: 1269327 - protein, 33 aa, Mycobacterium
ISFMTPAAFVRRPGRWIREMARKEGETGGVISV

SEQ ID NO: 1269328 - protein, 40 aa, Mycobacterium
ISFSQRAQVALPWSMINAFCDLAQTYPWREARPGRYGSDV

SEQ ID NO: 1269329 - protein, 20 aa, Mycobacterium
ISGADALLALTQRPLTTPDT

SEQ ID NO: 1269330 - protein, 27 aa, Mycobacterium
ISGAFLAKLGCTFAVVGHSERRTYHNE

SEQ ID NO: 1269331 - protein, 18 aa, Mycobacterium
ISGARRCERGCGRQGDRP

SEQ ID NO: 1269332 - protein, 26 aa, Mycobacterium
ISGETSRFGFVFTRRGVVPESASSWF

SEQ ID NO: 1269333 - protein, 21 aa, Mycobacterium
ISGLLPLSSGSVWFDGKDISR

SEQ ID NO: 1269334 - protein, 18 aa, Mycobacterium
ISGLPGFTLYLNVEVGAD

SEQ ID NO: 1269335 - protein, 19 aa, Mycobacterium
ISGRLAAVAERGRLVVVDP

SEQ ID NO: 1269336 - protein, 19 aa, Mycobacterium
ISHIISWLSTLGEVDSVDG

SEQ ID NO: 1269337 - protein, 24 aa, Mycobacterium
ISHLTVGGFRDWLLDTASGPRSAE

SEQ ID NO: 1269338 - protein, 25 aa, Mycobacterium
ISIVEAKGYCYGWHFYQCADADLVI

SEQ ID NO: 1269339 - protein, 18 aa, Mycobacterium
ISIVLARLLFLMFGDDTE

SEQ ID NO: 1269340 - protein, 25 aa, Mycobacterium
ISLERWDFRAGGGYRYVHSDENSSY

SEQ ID NO: 1269341 - protein, 18 aa, Mycobacterium
ISLGLLVTGVTYRHPGLL

SEQ ID NO: 1269342 - protein, 17 aa, Mycobacterium
ISLLSWIMNPERGLAAS

SEQ ID NO: 1269343 - protein, 25 aa, Mycobacterium
ISMYPRMWAASGIDYPTLLATMVET

SEQ ID NO: 1269344 - protein, 18 aa, Mycobacterium
ISNDFFKLWQDPSQTYSC

SEQ ID NO: 1269345 - protein, 19 aa, Mycobacterium
ISNVLLMRGMIGKPGAGLC

SEQ ID NO: 1269346 - protein, 27 aa, Mycobacterium
ISPFNFPAMVPMWFFPIAIATGNTVVL

SEQ ID NO: 1269347 - protein, 17 aa, Mycobacterium
ISPLVVWLGSVESRDVT

SEQ ID NO: 1269348 - protein, 21 aa, Mycobacterium
ISPSGPRLAGALGTSLLSLSM

SEQ ID NO: 1269349 - protein, 21 aa, Mycobacterium
ISQLPAAKRGIGVGFESYALY

SEQ ID NO: 1269350 - protein, 24 aa, Mycobacterium
ISQNWRLSGLAGEYITPVPAQQRL

SEQ ID NO: 1269351 - protein, 19 aa, Mycobacterium
ISREWSQRWASHTAGRFTL

SEQ ID NO: 1269352 - protein, 18 aa, Mycobacterium
ISRFLRWNLEKRLQSMSP

SEQ ID NO: 1269353 - protein, 17 aa, Mycobacterium
ISRKAFWARPADEKMEI

SEQ ID NO: 1269354 - protein, 17 aa, Mycobacterium
ISSAMIVGEQFGFTSPT

SEQ ID NO: 1269355 - protein, 26 aa, Mycobacterium
ISSGEARSALMLSWIRDVPALGAAAR

SEQ ID NO: 1269356 - protein, 18 aa, Mycobacterium
ISSNPCLIRGAGTTKRVK

SEQ ID NO: 1269357 - protein, 24 aa, Mycobacterium
ISSNPPVPGKFYWMSDTQVRWRPI

SEQ ID NO: 1269358 - protein, 33 aa, Mycobacterium
ISSPGWAKHAWSCFFAPWLAEATIFVYNYGRFD

SEQ ID NO: 1269359 - protein, 24 aa, Mycobacterium
ISSRPGVRLRLDIAYDGTDFAGWA

SEQ ID NO: 1269360 - protein, 20 aa, Mycobacterium
ISSVGALSFKIGDLSNPKPA

SEQ ID NO: 1269361 - protein, 17 aa, Mycobacterium
ISTARPVTKYQRKALAG

SEQ ID NO: 1269362 - protein, 19 aa, Mycobacterium
ISTGTRVHAHWVDEPVGAV

SEQ ID NO: 1269363 - protein, 17 aa, Mycobacterium
ISTLGSDVASGFRTYHV

SEQ ID NO: 1269364 - protein, 25 aa, Mycobacterium
ISTPRWTELKSRVRDYLGTKIEFRL

SEQ ID NO: 1269365 - protein, 19 aa, Mycobacterium
ISTRPEPHAAFTATDLPVL

SEQ ID NO: 1269366 - protein, 20 aa, Mycobacterium
ISVAARILAEFSDRLTDEQK

SEQ ID NO: 1269367 - protein, 22 aa, Mycobacterium
ISVDAHLPRICHDVIAAGEKLG

SEQ ID NO: 1269368 - protein, 21 aa, Mycobacterium
ISVDSARYWLNNDRPIDKDDA

SEQ ID NO: 1269369 - protein, 18 aa, Mycobacterium
ISVFGYQAQRAMFEANNI

SEQ ID NO: 1269370 - protein, 18 aa, Mycobacterium
ISVFGYQAQYAMFEANNI

SEQ ID NO: 1269371 - protein, 19 aa, Mycobacterium
ISVKIPAGVGDGMRVRLAA

SEQ ID NO: 1269372 - protein, 19 aa, Mycobacterium
ISVSLQFTARGKIRNFIQQ

SEQ ID NO: 1269373 - protein, 21 aa, Mycobacterium
ISWGDVALLLSVPRQGLGNAA

SEQ ID NO: 1269374 - protein, 24 aa, Mycobacterium
ISYPVGHLTTMAWIGVRPGDIHLA

SEQ ID NO: 1269375 - protein, 17 aa, Mycobacterium
ITACAWPNADHERIWAD

SEQ ID NO: 1269376 - protein, 20 aa, Mycobacterium
ITADALRTVLRTVLDGHEVL

SEQ ID NO: 1269377 - protein, 23 aa, Mycobacterium
ITADAPPGLAIMVAEAREEIDQD

SEQ ID NO: 1269378 - protein, 21 aa, Mycobacterium
ITAEIGAIVDRVAPRGDEPVV

SEQ ID NO: 1269379 - protein, 17 aa, Mycobacterium
ITAGLGWVKAAETVVVM

SEQ ID NO: 1269380 - protein, 33 aa, Mycobacterium
ITAHRALTVAEGWPSRLRPGALEGATVLVAGGA

SEQ ID NO: 1269381 - protein, 18 aa, Mycobacterium
ITAIGMGMIALRAPRVGE

SEQ ID NO: 1269382 - protein, 19 aa, Mycobacterium
ITAPQAWNAITPADFRDVT

SEQ ID NO: 1269383 - protein, 17 aa, Mycobacterium
ITARAPLAVPVADALGL

SEQ ID NO: 1269384 - protein, 24 aa, Mycobacterium
ITARVCGICPVAYQVSACNAIEDA

SEQ ID NO: 1269385 - protein, 18 aa, Mycobacterium
ITCVAHHWTVAGDSATDV

SEQ ID NO: 1269386 - protein, 33 aa, Mycobacterium
ITDADFDGGPFFQRCNPAFCAMTGYTEEELIGQ

SEQ ID NO: 1269387 - protein, 24 aa, Mycobacterium
ITDEIKSRIVAMAAPDEHGNRPDV

SEQ ID NO: 1269388 - protein, 20 aa, Mycobacterium
ITDELPLLQARTVRVAGHLL

SEQ ID NO: 1269389 - protein, 27 aa, Mycobacterium
ITDLPEGRWSEFLSEPRIAERVAKART

SEQ ID NO: 1269390 - protein, 18 aa, Mycobacterium
ITEEFTKNRDCQILLATD

SEQ ID NO: 1269391 - protein, 25 aa, Mycobacterium
ITEFEPGRRWSWQVAGIPATAHGVE

SEQ ID NO: 1269392 - protein, 22 aa, Mycobacterium
ITEGRIAAWRDYFDMATVTAAW

SEQ ID NO: 1269393 - protein, 22 aa, Mycobacterium
ITEKKAGAAVALYEEPDVLVKV

SEQ ID NO: 1269394 - protein, 24 aa, Mycobacterium
ITEQLRWDADWYKLIRRAGEDDVA

SEQ ID NO: 1269395 - protein, 25 aa, Mycobacterium
ITEVLGFDVVREFRDDGGLIHAELR

SEQ ID NO: 1269396 - protein, 26 aa, Mycobacterium
ITEVSLELFGRLGYFDTSVDAIAKAA

SEQ ID NO: 1269397 - protein, 20 aa, Mycobacterium
ITFELTGPITRQLHVAVDGR

SEQ ID NO: 1269398 - protein, 17 aa, Mycobacterium
ITFGDGSSIRCMGKGRK

SEQ ID NO: 1269399 - protein, 20 aa, Mycobacterium
ITFLPWGRMDDLYAAVVQCV

SEQ ID NO: 1269400 - protein, 17 aa, Mycobacterium
ITGFGRGGGAALPGYDL

SEQ ID NO: 1269401 - protein, 17 aa, Mycobacterium
ITGIITMPWMFYSGPDA

SEQ ID NO: 1269402 - protein, 19 aa, Mycobacterium
ITGLLCSGVLAPGHHLALV

SEQ ID NO: 1269403 - protein, 34 aa, Mycobacterium
ITGRPAISLPLHWTEEGLPLGVQFVAPLGGESLL

SEQ ID NO: 1269404 - protein, 31 aa, Mycobacterium
ITGVKSLEGLLAWKLGTSFRNAETIVAVARR

SEQ ID NO: 1269405 - protein, 17 aa, Mycobacterium
ITHDGFWAAFAAEAGIE

SEQ ID NO: 1269406 - protein, 18 aa, Mycobacterium
ITHDGFWRLFASEAGLEG

SEQ ID NO: 1269407 - protein, 25 aa, Mycobacterium
ITIDGRPTVNMQVGFLPPQDMIENA

SEQ ID NO: 1269408 - protein, 24 aa, Mycobacterium
ITIFEIRTGISLLVQGRRRSALDH

SEQ ID NO: 1269409 - protein, 20 aa, Mycobacterium
ITKDHIEAIANWDPEADPSI

SEQ ID NO: 1269410 - protein, 18 aa, Mycobacterium
ITKPAALIRPQSVRFTDA

SEQ ID NO: 1269411 - protein, 17 aa, Mycobacterium
ITKVFWSELDVALHQTA

SEQ ID NO: 1269412 - protein, 20 aa, Mycobacterium
ITLADAVAVVIARAEVVDRL

SEQ ID NO: 1269413 - protein, 23 aa, Mycobacterium
ITLEAGVSLGAMPVYRFGTEAQK

SEQ ID NO: 1269414 - protein, 26 aa, Mycobacterium
ITLLIRLDQEMGRAITPIPPFPPSAI

SEQ ID NO: 1269415 - protein, 17 aa, Mycobacterium
ITLPPGAFRELAQIRNI

SEQ ID NO: 1269416 - protein, 17 aa, Mycobacterium
ITLRFGSKVPGSAMEVR

SEQ ID NO: 1269417 - protein, 18 aa, Mycobacterium
ITLVPLPRKLSADLFRLP

SEQ ID NO: 1269418 - protein, 23 aa, Mycobacterium
ITLWKDYWDMGALADHAPPTWLA

SEQ ID NO: 1269419 - protein, 17 aa, Mycobacterium
ITMDWLRQNGYQDLLGR

SEQ ID NO: 1269420 - protein, 23 aa, Mycobacterium
ITMLCMPDLMTAYQRSAIDLETV

SEQ ID NO: 1269421 - protein, 20 aa, Mycobacterium
ITMSLELGDRVGLVGHNGAG

SEQ ID NO: 1269422 - protein, 21 aa, Mycobacterium
ITNRLAAQRAISVKTDPPVEG

SEQ ID NO: 1269423 - protein, 17 aa, Mycobacterium
ITPEGSWVLTDGRPETL

SEQ ID NO: 1269424 - protein, 19 aa, Mycobacterium
ITPFNFPAMIPLWKAGPAL

SEQ ID NO: 1269425 - protein, 20 aa, Mycobacterium
ITPGEALAGITPANITGSGP

SEQ ID NO: 1269426 - protein, 17 aa, Mycobacterium
ITPRLDPGVPVLSLGRY

SEQ ID NO: 1269427 - protein, 25 aa, Mycobacterium
ITQADLEAVPAFQAYVPKQHATQKV

SEQ ID NO: 1269428 - protein, 22 aa, Mycobacterium
ITRATTKFALRRALEPVVPAHV

SEQ ID NO: 1269429 - protein, 17 aa, Mycobacterium
ITRLLHATEHIRYSTTQ

SEQ ID NO: 1269430 - protein, 23 aa, Mycobacterium
ITRLRGDLRPDWAQPAQEGGSYR

SEQ ID NO: 1269431 - protein, 22 aa, Mycobacterium
ITRSREVWLVVSGAAKADAVAA

SEQ ID NO: 1269432 - protein, 23 aa, Mycobacterium
ITSNEAHKSFLFDHATRGLEHGA

SEQ ID NO: 1269433 - protein, 25 aa, Mycobacterium
ITSNTYFDWVLDRVFVFTPAQAFVA

SEQ ID NO: 1269434 - protein, 26 aa, Mycobacterium
ITTDWSFSSGRDWGSPAIPERMDLKA

SEQ ID NO: 1269435 - protein, 19 aa, Mycobacterium
ITTLPWPGSKWTASRDMPE

SEQ ID NO: 1269436 - protein, 26 aa, Mycobacterium
ITTRGFRDAILMQRATGHWAGRELHE

SEQ ID NO: 1269437 - protein, 27 aa, Mycobacterium
ITTRTTECLCLYKFEIEVVKPDSTATL

SEQ ID NO: 1269438 - protein, 19 aa, Mycobacterium
ITTVRCFQDNALLKSVLSE

SEQ ID NO: 1269439 - protein, 19 aa, Mycobacterium
ITTVRRWRNRFVVNRLDGL

SEQ ID NO: 1269440 - protein, 19 aa, Mycobacterium
ITVCAELGLPTGRVEGRSG

SEQ ID NO: 1269441 - protein, 19 aa, Mycobacterium
ITVLLLRGADGVFSTGADM

SEQ ID NO: 1269442 - protein, 19 aa, Mycobacterium
ITVPGLLTTRVVPGTPAAQ

SEQ ID NO: 1269443 - protein, 25 aa, Mycobacterium
ITVPMFPNLFLLYGPNTNVGSGSIL

SEQ ID NO: 1269444 - protein, 25 aa, Mycobacterium
ITVPRWLPERICWALSDEYHANEGG

SEQ ID NO: 1269445 - protein, 33 aa, Mycobacterium
ITVQPAESWNVFDPVVIRWRLEVGDRTAQLVSL

SEQ ID NO: 1269446 - protein, 23 aa, Mycobacterium
ITVRGGHVMAGYWGRPEDTATAL

SEQ ID NO: 1269447 - protein, 20 aa, Mycobacterium
ITVRRWLDRTDEIHLDESVH

SEQ ID NO: 1269448 - protein, 23 aa, Mycobacterium
ITWENSCRFFSWDPFKLTPKEQA

SEQ ID NO: 1269449 - protein, 29 aa, Mycobacterium
ITYVGELGWELYVPAEFAVGVYEDLLAAG

SEQ ID NO: 1269450 - protein, 20 aa, Mycobacterium
IVAAAARLFAENGYGATTMD

SEQ ID NO: 1269451 - protein, 24 aa, Mycobacterium
IVAARAGVRVVLTRTGLVMARAGG

SEQ ID NO: 1269452 - protein, 17 aa, Mycobacterium
IVADAWHHRLLIWNQVP

SEQ ID NO: 1269453 - protein, 17 aa, Mycobacterium
IVAEILFGLGKIQRPEV

SEQ ID NO: 1269454 - protein, 24 aa, Mycobacterium
IVAELFKPLPSMVVAHYLGVPDED

SEQ ID NO: 1269455 - protein, 18 aa, Mycobacterium
IVAGLPVAVHDDADEARV

SEQ ID NO: 1269456 - protein, 22 aa, Mycobacterium
IVAGRCAHRGVLLAVGTVEGDC

SEQ ID NO: 1269457 - protein, 17 aa, Mycobacterium
IVALGGFAWQVALAMIR

SEQ ID NO: 1269458 - protein, 17 aa, Mycobacterium
IVANGVVTRSVRDTAAF

SEQ ID NO: 1269459 - protein, 19 aa, Mycobacterium
IVAPRSGLISLLVAEDQAV

SEQ ID NO: 1269460 - protein, 21 aa, Mycobacterium
IVARIDWERFLPLYQQAGRRA

SEQ ID NO: 1269461 - protein, 24 aa, Mycobacterium
IVATAWDCPFDGPTAPQRVVDIVT

SEQ ID NO: 1269462 - protein, 23 aa, Mycobacterium
IVAYRTGFDIDWSRPTDADVVTR

SEQ ID NO: 1269463 - protein, 23 aa, Mycobacterium
IVCAGRPLLEWCVRRRLDDEPRI

SEQ ID NO: 1269464 - protein, 18 aa, Mycobacterium
IVCRGDVVMSGYWQNPEA

SEQ ID NO: 1269465 - protein, 17 aa, Mycobacterium
IVCRPELAEAVLAVTAG

SEQ ID NO: 1269466 - protein, 19 aa, Mycobacterium
IVDACLRGNATLFGSGINP

SEQ ID NO: 1269467 - protein, 20 aa, Mycobacterium
IVDEIVKPVAAELVRRGSAF

SEQ ID NO: 1269468 - protein, 35 aa, Mycobacterium
IVDEPYPWPAMFGRIGEEYARRYGLDHAHLGRIAE

SEQ ID NO: 1269469 - protein, 18 aa, Mycobacterium
IVDFALRRRFAFADLAPQ

SEQ ID NO: 1269470 - protein, 18 aa, Mycobacterium
IVEAFTFELGKCYEQAVK

SEQ ID NO: 1269471 - protein, 17 aa, Mycobacterium
IVEATFIGCETEGTNWQ

SEQ ID NO: 1269472 - protein, 18 aa, Mycobacterium
IVEDVKGKAKETVGTVTG

SEQ ID NO: 1269473 - protein, 24 aa, Mycobacterium
IVEEPPEHLIFVFATTEPEKVLPT

SEQ ID NO: 1269474 - protein, 20 aa, Mycobacterium
IVEIPRPAGVVLALTPTTNP

SEQ ID NO: 1269475 - protein, 21 aa, Mycobacterium
IVEKFWSWTDCDGHPENALTR

SEQ ID NO: 1269476 - protein, 26 aa, Mycobacterium
IVELARSGVLYALWAADHADPEDRHR

SEQ ID NO: 1269477 - protein, 25 aa, Mycobacterium
IVELMFVDFFGVCMDQIYNHMAKIH

SEQ ID NO: 1269478 - protein, 17 aa, Mycobacterium
IVENMFLGRELKRRGML

SEQ ID NO: 1269479 - protein, 25 aa, Mycobacterium
IVEPKYWGGVCLNVGCIPSKALLRN

SEQ ID NO: 1269480 - protein, 23 aa, Mycobacterium
IVEQLPRKVALELIYTGEPISSA

SEQ ID NO: 1269481 - protein, 21 aa, Mycobacterium
IVFACACQRLRRCVAERVLMG

SEQ ID NO: 1269482 - protein, 19 aa, Mycobacterium
IVFSLEMSKTEIVMRLLSA

SEQ ID NO: 1269483 - protein, 21 aa, Mycobacterium
IVGAELVSWSAALTLRESGCT

SEQ ID NO: 1269484 - protein, 17 aa, Mycobacterium
IVGEGGVNPVRRTMHRM

SEQ ID NO: 1269485 - protein, 19 aa, Mycobacterium
IVGIMRVYANFLAQYSIRV

SEQ ID NO: 1269486 - protein, 23 aa, Mycobacterium
IVGRIKDLLIIRGRNHYPEDIEA

SEQ ID NO: 1269487 - protein, 26 aa, Mycobacterium
IVHSHYWLSGQVGWLAADRWAVPLVH

SEQ ID NO: 1269488 - protein, 25 aa, Mycobacterium
IVIAGAGAIGMEFAYVMKNYGVDVT

SEQ ID NO: 1269489 - protein, 27 aa, Mycobacterium
IVIDPDWTIRGWSWFPDSTRALINEQQ

SEQ ID NO: 1269490 - protein, 21 aa, Mycobacterium
IVKAGAILVNVNFRYVEGELK

SEQ ID NO: 1269491 - protein, 22 aa, Mycobacterium
IVLAQGRFDPGQVMALVERERV

SEQ ID NO: 1269492 - protein, 17 aa, Mycobacterium
IVLARDGATVGVGMGQV

SEQ ID NO: 1269493 - protein, 25 aa, Mycobacterium
IVLNAKTRRPSVCNAAESLLIDAAI

SEQ ID NO: 1269494 - protein, 17 aa, Mycobacterium
IVLNWPERANAQSSEMV

SEQ ID NO: 1269495 - protein, 17 aa, Mycobacterium
IVLQCFRGKAAERSKID

SEQ ID NO: 1269496 - protein, 17 aa, Mycobacterium
IVNARHPAPCGASTTGA

SEQ ID NO: 1269497 - protein, 17 aa, Mycobacterium
IVNSGALALILTDDISL

SEQ ID NO: 1269498 - protein, 27 aa, Mycobacterium
IVPAEGFLPTLLEWCHANGVVFIADEV

SEQ ID NO: 1269499 - protein, 24 aa, Mycobacterium
IVPELVKTAAFVKVFQRTPGWVLP

SEQ ID NO: 1269500 - protein, 17 aa, Mycobacterium
IVPPDVMPYTFGDNWLF

SEQ ID NO: 1269501 - protein, 18 aa, Mycobacterium
IVPPGNFTPFGPAGDAPT

SEQ ID NO: 1269502 - protein, 18 aa, Mycobacterium
IVRGLNFLVTGFASADEG

SEQ ID NO: 1269503 - protein, 24 aa, Mycobacterium
IVRRAMPELHFLVVTGPRIDPATL

SEQ ID NO: 1269504 - protein, 19 aa, Mycobacterium
IVRRARSVGALTVLDACQS

SEQ ID NO: 1269505 - protein, 26 aa, Mycobacterium
IVRRTCSGWFPRTLWSGKLVLTAEGG

SEQ ID NO: 1269506 - protein, 21 aa, Mycobacterium
IVSEEVFGPLLAFQRAGSLTE

SEQ ID NO: 1269507 - protein, 17 aa, Mycobacterium
IVSGIGWDKVDPDNPAY

SEQ ID NO: 1269508 - protein, 23 aa, Mycobacterium
IVSLDPWGAMVADVFAREIADGV

SEQ ID NO: 1269509 - protein, 25 aa, Mycobacterium
IVTARAALGPVLLPGVTLFVFRHEG

SEQ ID NO: 1269510 - protein, 23 aa, Mycobacterium
IVVGCGESGILAALRLQQAGVPF

SEQ ID NO: 1269511 - protein, 29 aa, Mycobacterium
IVVHCAGGWRSSVAASLMRADGLGNVSDL

SEQ ID NO: 1269512 - protein, 26 aa, Mycobacterium
IVVIASEWGVTGWPEATAYAAAKSGL

SEQ ID NO: 1269513 - protein, 23 aa, Mycobacterium
IVVNYDLPWAIIRLIQRAGRVDR

SEQ ID NO: 1269514 - protein, 17 aa, Mycobacterium
IVVPDELGDLVIAAAAR

SEQ ID NO: 1269515 - protein, 21 aa, Mycobacterium
IVVREGFSANLARALRDDLIE

SEQ ID NO: 1269516 - protein, 18 aa, Mycobacterium
IVVTHDLLDALALADKVV

SEQ ID NO: 1269517 - protein, 17 aa, Mycobacterium
IVYLRRFDPREWVRLVR

SEQ ID NO: 1269518 - protein, 24 aa, Mycobacterium
IWAAECVFVPLNYKLHVREMEQIL

SEQ ID NO: 1269519 - protein, 21 aa, Mycobacterium
IWAPNCPEWTIVQYATAKIGA

SEQ ID NO: 1269520 - protein, 17 aa, Mycobacterium
IWDDIGPRIERVLSTGQ

SEQ ID NO: 1269521 - protein, 20 aa, Mycobacterium
IWEDLFRPVLTEVITQGVRE

SEQ ID NO: 1269522 - protein, 21 aa, Mycobacterium
IWEKMPETFLAALDERFGITS

SEQ ID NO: 1269523 - protein, 20 aa, Mycobacterium
IWGGGRLDPRPAPDEVVAVY

SEQ ID NO: 1269524 - protein, 17 aa, Mycobacterium
IWGGWVVGPTVLGPEEF

SEQ ID NO: 1269525 - protein, 29 aa, Mycobacterium
IWRAAEPGVYCGAWSAFLRDPDLTYENSA

SEQ ID NO: 1269526 - protein, 18 aa, Mycobacterium
IWRSRPVNWIWDRLPMRV

SEQ ID NO: 1269527 - protein, 24 aa, Mycobacterium
IWTKGQVLEPVWSTAFGYTVTVEG

SEQ ID NO: 1269528 - protein, 21 aa, Mycobacterium
IYADMPLGPALAARGPEDIVK

SEQ ID NO: 1269529 - protein, 21 aa, Mycobacterium
IYALHCDPHLAVGRVAVKAGP

SEQ ID NO: 1269530 - protein, 17 aa, Mycobacterium
IYCESFRFVKSVDNGGL

SEQ ID NO: 1269531 - protein, 24 aa, Mycobacterium
IYCRPSCPVRPPYARNMRFYPTAA

SEQ ID NO: 1269532 - protein, 17 aa, Mycobacterium
IYDLYGYNAVVHVLSAS

SEQ ID NO: 1269533 - protein, 24 aa, Mycobacterium
IYEELELRVGTSLTDSLSDAQVEE

SEQ ID NO: 1269534 - protein, 19 aa, Mycobacterium
IYEREMFETGIAKATAGLR

SEQ ID NO: 1269535 - protein, 18 aa, Mycobacterium
IYFGGLAPVLGDLLATAG

SEQ ID NO: 1269536 - protein, 20 aa, Mycobacterium
IYHALTWGPLVREIVSAATG

SEQ ID NO: 1269537 - protein, 22 aa, Mycobacterium
IYKVGLGSVRFLMSVGDLVLGW

SEQ ID NO: 1269538 - protein, 24 aa, Mycobacterium
IYKWWPSAASIVLEGLLDAVRASI

SEQ ID NO: 1269539 - protein, 18 aa, Mycobacterium
IYLKLLFQGDQLPGYGWV

SEQ ID NO: 1269540 - protein, 20 aa, Mycobacterium
IYLLLRVTLSQVLSGGTETA

SEQ ID NO: 1269541 - protein, 25 aa, Mycobacterium
IYNKHMIFPKPGVDLSDPASFASIG

SEQ ID NO: 1269542 - protein, 26 aa, Mycobacterium
IYNPLRFVSATVKWCRKAEELGTLPD

SEQ ID NO: 1269543 - protein, 24 aa, Mycobacterium
IYPRETLWRPPVLTMSALTGDGLA

SEQ ID NO: 1269544 - protein, 23 aa, Mycobacterium
IYPRSLGALTGWGDPTYDDSEDE

SEQ ID NO: 1269545 - protein, 17 aa, Mycobacterium
IYRCPGCDHEIRPATSH

SEQ ID NO: 1269546 - protein, 24 aa, Mycobacterium
IYRLAAEGHTGWKDAIDQIETVYR

SEQ ID NO: 1269547 - protein, 18 aa, Mycobacterium
IYSNYGFTVLAEKIEAES

SEQ ID NO: 1269548 - protein, 24 aa, Mycobacterium
IYTMWRPSPLIRARRFEKALNTGA

SEQ ID NO: 1269549 - protein, 17 aa, Mycobacterium
IYTSTACLIGLKFRNQL

SEQ ID NO: 1269550 - protein, 20 aa, Mycobacterium
IYTVAPWGLYMARPAPGRAQ

SEQ ID NO: 1269551 - protein, 17 aa, Mycobacterium
IYVKDGIITWETQQTDY

SEQ ID NO: 1269552 - protein, 19 aa, Mycobacterium
IYYEGGHSFEYLKDDAKTR

SEQ ID NO: 1269553 - protein, 25 aa, Mycobacterium
KAAAPRYAEAGIRAIDLTPAAVGPG

SEQ ID NO: 1269554 - protein, 30 aa, Mycobacterium; identical to SEQ ID NO: 682504

SEQ ID NO: 1269555 - protein, 20 aa, Mycobacterium
KAADALLDLGVELAIVKQGP

SEQ ID NO: 1269556 - protein, 17 aa, Mycobacterium
KAAELLVATSRKLDKAA

SEQ ID NO: 1269557 - protein, 17 aa, Mycobacterium
KAAIDKLDFDWRELEIT

SEQ ID NO: 1269558 - protein, 32 aa, Mycobacterium
KAAIEARSGLRVMRELERAILLDCLDSKWRAH

SEQ ID NO: 1269559 - protein, 20 aa, Mycobacterium
KAAIEPVWYLPGVARRFGCS

SEQ ID NO: 1269560 - protein, 20 aa, Mycobacterium
KAAIIHYTQGLAFKLAAQGV

SEQ ID NO: 1269561 - protein, 17 aa, Mycobacterium
KAALKREAGRIGLTLDD

SEQ ID NO: 1269562 - protein, 26 aa, Mycobacterium
KAALNFAMAIPTGWDDAISYLTGDPD

SEQ ID NO: 1269563 - protein, 24 aa, Mycobacterium
KAALRYVDALIWSPSRIDAAVADG

SEQ ID NO: 1269564 - protein, 28 aa, Mycobacterium
KAAMMRARHRVMLIGWDFDTRMTFERGD

SEQ ID NO: 1269565 - protein, 27 aa, Mycobacterium
KAAMPRTVWTTGCRSWYLGKDGLPELF

SEQ ID NO: 1269566 - protein, 17 aa, Mycobacterium
KAAQGLATWDEYSAEVE

SEQ ID NO: 1269567 - protein, 17 aa, Mycobacterium
KAARAWKDGVFADEVVP

SEQ ID NO: 1269568 - protein, 17 aa, Mycobacterium
KAARFVRFCDSFNTPLV

SEQ ID NO: 1269569 - protein, 17 aa, Mycobacterium
KAARVASDITLKAVEMA

SEQ ID NO: 1269570 - protein, 18 aa, Mycobacterium
KAATEYKAYAIAQADELV

SEQ ID NO: 1269571 - protein, 18 aa, Mycobacterium
KAATTIIQGWAFYETAMT

SEQ ID NO: 1269572 - protein, 17 aa, Mycobacterium
KAAVICRHCPVIAECGA

SEQ ID NO: 1269573 - protein, 26 aa, Mycobacterium
KADIAWAGPGPQWWAERLGVDEHLAE

SEQ ID NO: 1269574 - protein, 27 aa, Mycobacterium
KADNSELGWRMEVEHDGEWSFFDDTEG

SEQ ID NO: 1269575 - protein, 17 aa, Mycobacterium
KADRLMCLCGIDDCEAA

SEQ ID NO: 1269576 - protein, 22 aa, Mycobacterium
KAEGHKWAMLTAYDYSTAAVFD

SEQ ID NO: 1269577 - protein, 24 aa, Mycobacterium
KAEHWSGFGDAEMVFAEPTKKATP

SEQ ID NO: 1269578 - protein, 19 aa, Mycobacterium
KAELAAGQPYQEWLDAGLF

SEQ ID NO: 1269579 - protein, 20 aa, Mycobacterium
KAELLDLMLDTVYRQMPRRD

SEQ ID NO: 1269580 - protein, 25 aa, Mycobacterium
KAEMQLRLPKSVYKSVVATIEKGAK

SEQ ID NO: 1269581 - protein, 24 aa, Mycobacterium
KAERTRRSFGRMRQLPSGRWQASY

SEQ ID NO: 1269582 - protein, 24 aa, Mycobacterium
KAESAMPPSVWSYVVGGAGDEHTQ

SEQ ID NO: 1269583 - protein, 17 aa, Mycobacterium
KAEVPVKGRLVVAAMAV

SEQ ID NO: 1269584 - protein, 25 aa, Mycobacterium
KAEWWDRAVEVWPDYADYQKKTDRE

SEQ ID NO: 1269585 - protein, 20 aa, Mycobacterium
KAFQRFLVKGTENLVFNEAP

SEQ ID NO: 1269586 - protein, 22 aa, Mycobacterium
KAFTCTYHGWSYDLAGNLINVP

SEQ ID NO: 1269587 - protein, 18 aa, Mycobacterium
KAFTDLRQLLAVHETAEE

SEQ ID NO: 1269588 - protein, 26 aa, Mycobacterium
KAGERLRLVKYLAYGWSSLRSRPALR

SEQ ID NO: 1269589 - protein, 19 aa, Mycobacterium
KAGFGGFGFTDHPAPTQRW

SEQ ID NO: 1269590 - protein, 18 aa, Mycobacterium
KAGFTEYVDFGDHRNQRI

SEQ ID NO: 1269591 - protein, 21 aa, Mycobacterium
KAGGLGVLGCVRFNDADDLEN

SEQ ID NO: 1269592 - protein, 24 aa, Mycobacterium
KAGRSVRVLERLGHVGGAAVSLYP

SEQ ID NO: 1269593 - protein, 25 aa, Mycobacterium
KAGSALNLLRWTSARSIKETFVPPT

SEQ ID NO: 1269594 - protein, 21 aa, Mycobacterium
KAGVGKPTIYRRWATKEELIS

SEQ ID NO: 1269595 - protein, 21 aa, Mycobacterium
KAGVRRLVYLGGLHPQGKTDL

SEQ ID NO: 1269596 - protein, 25 aa, Mycobacterium
KAIGECLSWADGWLPGDAAYRDLSA

SEQ ID NO: 1269597 - protein, 18 aa, Mycobacterium
KAKEILFTGRAMTAEEVA

SEQ ID NO: 1269598 - protein, 18 aa, Mycobacterium
KALAAFAPAARFCASGGI

SEQ ID NO: 1269599 - protein, 17 aa, Mycobacterium
KALGHAYGGGAQYFSMW

SEQ ID NO: 1269600 - protein, 18 aa, Mycobacterium
KALLRRLVEAGTRVVQYG

SEQ ID NO: 1269601 - protein, 18 aa, Mycobacterium
KALPAAGHIGVFDRSHYE

SEQ ID NO: 1269602 - protein, 17 aa, Mycobacterium
KALPEFVLAYTEPHPHR

SEQ ID NO: 1269603 - protein, 22 aa, Mycobacterium
KALRAGGVVVVFPGGDYDVYRP

SEQ ID NO: 1269604 - protein, 25 aa, Mycobacterium
KALSLPSVRGLIVGRTLLYPPDDDV

SEQ ID NO: 1269605 - protein, 18 aa, Mycobacterium
KALSYKAYLMCFGSTGMF

SEQ ID NO: 1269606 - protein, 22 aa, Mycobacterium
KALYEWDYGKQLLYTQILREKI

SEQ ID NO: 1269607 - protein, 23 aa, Mycobacterium
KAMARPTLRHRVALRPEAELEGA

SEQ ID NO: 1269608 - protein, 24 aa, Mycobacterium
KAPWRLKQNYLIDLRVIRNGKIDD

SEQ ID NO: 1269609 - protein, 19 aa, Mycobacterium
KARDRWQFLPFLGGGRPCI

SEQ ID NO: 1269610 - protein, 21 aa, Mycobacterium
KARELSGANNLLFRRNSVTGA

SEQ ID NO: 1269611 - protein, 17 aa, Mycobacterium
KARFAGLQHAAWTVIPI

SEQ ID NO: 1269612 - protein, 19 aa, Mycobacterium
KARGIKLIVFDTQRKATRG

SEQ ID NO: 1269613 - protein, 19 aa, Mycobacterium
KARGLSGVHLVISDAHAGL

SEQ ID NO: 1269614 - protein, 19 aa, Mycobacterium
KARKAMEYGKPVFTADEFF

SEQ ID NO: 1269615 - protein, 20 aa, Mycobacterium
KARMASGGTRLVHSREMKVI

SEQ ID NO: 1269616 - protein, 18 aa, Mycobacterium
KARSLRTTRPIQIVKRET

SEQ ID NO: 1269617 - protein, 25 aa, Mycobacterium
KARTGAEPVARVLIGMVAPADSQEI

SEQ ID NO: 1269618 - protein, 25 aa, Mycobacterium
KASKVARTTLYRHFHSSSHLLAATF

SEQ ID NO: 1269619 - protein, 28 aa, Mycobacterium
KASLIGELVRRCRLVMAGEPLPHPDPVD

SEQ ID NO: 1269620 - protein, 18 aa, Mycobacterium
KASLMTRLMPGASAIVVL

SEQ ID NO: 1269621 - protein, 18 aa, Mycobacterium
KASPFGGTIAHGYHSLAL

SEQ ID NO: 1269622 - protein, 17 aa, Mycobacterium
KASSVVVHILGEHQLDL

SEQ ID NO: 1269623 - protein, 21 aa, Mycobacterium
KATGCGLVPAAEASRNHHAWS

SEQ ID NO: 1269624 - protein, 17 aa, Mycobacterium
KATLKAKLGEDMEDYLI

SEQ ID NO: 1269625 - protein, 18 aa, Mycobacterium
KATLKHLLCLEYSTVAIQ

SEQ ID NO: 1269626 - protein, 17 aa, Mycobacterium
KATRDEIFVDLKERVTA

SEQ ID NO: 1269627 - protein, 21 aa, Mycobacterium
KATRSRAVLREALQHYGRTPS

SEQ ID NO: 1269628 - protein, 19 aa, Mycobacterium
KATTARRALVLNLVAEPGE

SEQ ID NO: 1269629 - protein, 20 aa, Mycobacterium
KAVADKLVAILEGFGLSGFG

SEQ ID NO: 1269630 - protein, 25 aa, Mycobacterium
KAVAELSHWAALHYPGAVQTHYWSA

SEQ ID NO: 1269631 - protein, 19 aa, Mycobacterium
KAVATQAVRGLAPVRVSAT

SEQ ID NO: 1269632 - protein, 19 aa, Mycobacterium
KAVDARGAVTATLDRSPLR

SEQ ID NO: 1269633 - protein, 20 aa, Mycobacterium
KAVIVSEPFLVAIPVLEEKG

SEQ ID NO: 1269634 - protein, 29 aa, Mycobacterium
KAVIVSEPFMPAAPLLSGLGMLVLTVADL

SEQ ID NO: 1269635 - protein, 17 aa, Mycobacterium
KAVKNRIHFDFTPDDQD

SEQ ID NO: 1269636 - protein, 24 aa, Mycobacterium
KAVPHMRRQGAGWIVNIGSVTGLA

SEQ ID NO: 1269637 - protein, 24 aa, Mycobacterium
KAVPRCAVLLRIVCQVSGVGVDPT

SEQ ID NO: 1269638 - protein, 23 aa, Mycobacterium
KAVQRSAGAIAIGPVLQGLNKPV

SEQ ID NO: 1269639 - protein, 32 aa, Mycobacterium
KAVRGVPMIGEFCYQCMHSIKVGIKDALSPQV

SEQ ID NO: 1269640 - protein, 17 aa, Mycobacterium
KAVRPARGRAPAAGADL

SEQ ID NO: 1269641 - protein, 22 aa, Mycobacterium
KAYAAGLAAWWTVLEHTGTDWR

SEQ ID NO: 1269642 - protein, 19 aa, Mycobacterium
KAYGRLALDSVFLDIKNLD

SEQ ID NO: 1269643 - protein, 35 aa, Mycobacterium
KAYGVTFPDWRPVDFKVWPAENGFVQRYRWEGTNV

SEQ ID NO: 1269644 - protein, 32 aa, Mycobacterium
KAYLDEYAEVFGLLEHIEFGNGVVHAAKDGSG

SEQ ID NO: 1269645 - protein, 25 aa, Mycobacterium
KAYRVAGYRSGWLVITGPKEHAASF

SEQ ID NO: 1269646 - protein, 17 aa, Mycobacterium
KCADACSKPVPNKTDNE

SEQ ID NO: 1269647 - protein, 23 aa, Mycobacterium
KCAELELPLCINTGLPGPPIPGE

SEQ ID NO: 1269648 - protein, 20 aa, Mycobacterium
KCCEFANARPGMLGLQTALS

SEQ ID NO: 1269649 - protein, 32 aa, Mycobacterium; identical to SEQ ID NO: 622116

SEQ ID NO: 1269650 - protein, 20 aa, Mycobacterium
KCGHLGGKVLIPTQQHIRTL

SEQ ID NO: 1269651 - protein, 20 aa, Mycobacterium
KCGLPASSIYWHFKDKDDLI

SEQ ID NO: 1269652 - protein, 29 aa, Mycobacterium
KCLEEAGKHPGTRWRYEYSPESYTGTELE

SEQ ID NO: 1269653 - protein, 26 aa, Mycobacterium
KCSARAKGAVLDPVIARLTGGQPYQH

SEQ ID NO: 1269654 - protein, 22 aa, Mycobacterium
KDADYREFLTLLGSADQPVVED

SEQ ID NO: 1269655 - protein, 20 aa, Mycobacterium
KDAFRAWRLLVTRYGAPAPG

SEQ ID NO: 1269656 - protein, 21 aa, Mycobacterium
KDAKNRLGYSKVVLAGWSGGG

SEQ ID NO: 1269657 - protein, 17 aa, Mycobacterium
KDAPWRLIIAQHFSSPE

SEQ ID NO: 1269658 - protein, 20 aa, Mycobacterium
KDASCVPVCPVDCIRPAGEA

SEQ ID NO: 1269659 - protein, 24 aa, Mycobacterium
KDEKGVLTRLWKRLGDIRYMDPAC

SEQ ID NO: 1269660 - protein, 20 aa, Mycobacterium
KDELLLALVERVMVDATERW

SEQ ID NO: 1269661 - protein, 27 aa, Mycobacterium
KDELRRYRMQSGFVFQSHNLFPHKTVL

SEQ ID NO: 1269662 - protein, 22 aa, Mycobacterium
KDESASVAVLWGDNGTFCAGAD

SEQ ID NO: 1269663 - protein, 20 aa, Mycobacterium
KDFRDAQRIPIGDAQLEENP

SEQ ID NO: 1269664 - protein, 19 aa, Mycobacterium
KDFSHLMIRTEVRSAHGDS

SEQ ID NO: 1269665 - protein, 17 aa, Mycobacterium
KDFYKVLGVASDADEKE

SEQ ID NO: 1269666 - protein, 17 aa, Mycobacterium
KDGDGVVNFDHFESEPS

SEQ ID NO: 1269667 - protein, 26 aa, Mycobacterium
KDGGWKLYGKKTWGTLCEAADIITTN

SEQ ID NO: 1269668 - protein, 20 aa, Mycobacterium
KDGQPLVWHDPVLQPEKCTD

SEQ ID NO: 1269669 - protein, 17 aa, Mycobacterium
KDGRARSIGVSNFQVDH

SEQ ID NO: 1269670 - protein, 22 aa, Mycobacterium
KDGREFIAQFLISGAGGLHIPL

SEQ ID NO: 1269671 - protein, 17 aa, Mycobacterium
KDIKGMELAEAIKDVGA

SEQ ID NO: 1269672 - protein, 23 aa, Mycobacterium
KDILPRPLLEVLFAADRESGEAL

SEQ ID NO: 1269673 - protein, 25 aa, Mycobacterium
KDIPLRVKAGAVGLLADEYHAQDVV

SEQ ID NO: 1269674 - protein, 18 aa, Mycobacterium
KDITDWRAELMSHYDQAQ

SEQ ID NO: 1269675 - protein, 17 aa, Mycobacterium
KDIVPVMVQEGSVIYDR

SEQ ID NO: 1269676 - protein, 17 aa, Mycobacterium
KDLGLALALGEELDVDL

SEQ ID NO: 1269677 - protein, 25 aa, Mycobacterium
KDLHLPWQWGARWFLEQLVDGDIAN

SEQ ID NO: 1269678 - protein, 18 aa, Mycobacterium
KDLLGREMLDQRFAGMKE

SEQ ID NO: 1269679 - protein, 26 aa, Mycobacterium
KDLNWKSRPYLAWPAYGQSKLANLLF

SEQ ID NO: 1269680 - protein, 17 aa, Mycobacterium
KDLPRLGISVLGESHDA

SEQ ID NO: 1269681 - protein, 28 aa, Mycobacterium
KDLQLWVGACLYKGVVDVHRLFVGEMDE

SEQ ID NO: 1269682 - protein, 23 aa, Mycobacterium
KDLQRLPGLVAIAYQHETSRCGD

SEQ ID NO: 1269683 - protein, 21 aa, Mycobacterium
KDLRRARAAALNIVPTSTGAA

SEQ ID NO: 1269684 - protein, 23 aa, Mycobacterium
KDLTNCFVGVSFYRSIDGQSLQT

SEQ ID NO: 1269685 - protein, 18 aa, Mycobacterium
KDLVWAPGAFRYVMMVLR

SEQ ID NO: 1269686 - protein, 17 aa, Mycobacterium
KDNPIKLVWEKDPSLPE

SEQ ID NO: 1269687 - protein, 24 aa, Mycobacterium
KDPEFRKKFGPRGVIRAWANGDGT

SEQ ID NO: 1269688 - protein, 32 aa, Mycobacterium
KDPIPRRCGPTFPEYWKMFLTALADGDASGVL

SEQ ID NO: 1269689 - protein, 25 aa, Mycobacterium
KDPLLVMRINFLGMRQFTEALIARM

SEQ ID NO: 1269690 - protein, 20 aa, Mycobacterium
KDPPRPLGEQFRDAVEQGNP

SEQ ID NO: 1269691 - protein, 21 aa, Mycobacterium
KDPRLTAQLNDIFESATDPGT

SEQ ID NO: 1269692 - protein, 26 aa, Mycobacterium
KDPSASLWLAALWKEAGLPDGVFNVL

SEQ ID NO: 1269693 - protein, 27 aa, Mycobacterium
KDPVKGFFRALDYTLPWDVEAVEDAMP

SEQ ID NO: 1269694 - protein, 23 aa, Mycobacterium
KDPVKMIGVVCGRVRLATDGYGP

SEQ ID NO: 1269695 - protein, 19 aa, Mycobacterium
KDPVRGFFRALDFTLPWDV

SEQ ID NO: 1269696 - protein, 25 aa, Mycobacterium
KDRDGFVFGEAGALMVIETEEHARA

SEQ ID NO: 1269697 - protein, 20 aa, Mycobacterium
KDRFGAEIRTHYPPELDAEV

SEQ ID NO: 1269698 - protein, 17 aa, Mycobacterium
KDRRLFHEGCQRFRDIV

SEQ ID NO: 1269699 - protein, 27 aa, Mycobacterium
KDRVDPEVLRRAVLYAIERKRAELTAV

SEQ ID NO: 1269700 - protein, 19 aa, Mycobacterium
KDSHPVLAMASNRTYGLNL

SEQ ID NO: 1269701 - protein, 21 aa, Mycobacterium
KDTDRAMGIARRLRTGTVGVN

SEQ ID NO: 1269702 - protein, 20 aa, Mycobacterium
KDVGFPYRSSLVPRRNAELD

SEQ ID NO: 1269703 - protein, 24 aa, Mycobacterium
KDVGYRFIDRLKVRRPLSTEPGPI

SEQ ID NO: 1269704 - protein, 17 aa, Mycobacterium
KDVHRAHRVAAKLRAGT

SEQ ID NO: 1269705 - protein, 20 aa, Mycobacterium
KDVKESIAFATGSGVGQPRG

SEQ ID NO: 1269706 - protein, 17 aa, Mycobacterium
KDVSGYVITLAKAENLP

SEQ ID NO: 1269707 - protein, 18 aa, Mycobacterium
KDVSGYVITLAQAENLPA

SEQ ID NO: 1269708 - protein, 20 aa, Mycobacterium
KDVSTAWQLDAYRFEIPVVA

SEQ ID NO: 1269709 - protein, 19 aa, Mycobacterium
KDVVIDMLCYRRRGHNEGD

SEQ ID NO: 1269710 - protein, 26 aa, Mycobacterium
KDVVIRGGENIYPREVEEFLYTHPDI

SEQ ID NO: 1269711 - protein, 34 aa, Mycobacterium
KDWGSGQPIVFSHGWPLSADDWDTQMLFFVGHGY

SEQ ID NO: 1269712 - protein, 21 aa, Mycobacterium
KDWTEPGFMGLGMIYTAMPVT

SEQ ID NO: 1269713 - protein, 20 aa, Mycobacterium
KEAFRLRDEHFFVPEPGPRP

SEQ ID NO: 1269714 - protein, 31 aa, Mycobacterium; identical to SEQ ID NO: 683218

SEQ ID NO: 1269715 - protein, 26 aa, Mycobacterium
KEAMSKRTLAEWSERFATLAGPWAPV

SEQ ID NO: 1269716 - protein, 18 aa, Mycobacterium
KEARRLRPDLATGLQPMR

SEQ ID NO: 1269717 - protein, 19 aa, Mycobacterium
KEAVCKGTISFLSREARKP

SEQ ID NO: 1269718 - protein, 23 aa, Mycobacterium
KECGPKSIKFVCLLTCPEGIAAM

SEQ ID NO: 1269719 - protein, 17 aa, Mycobacterium
KEDARTFLISVAAELAG

SEQ ID NO: 1269720 - protein, 20 aa, Mycobacterium
KEDHLRIAALLDDGTALSFV

SEQ ID NO: 1269721 - protein, 21 aa, Mycobacterium
KEESVGFLFNVQVERAPSAPT

SEQ ID NO: 1269722 - protein, 17 aa, Mycobacterium
KEETVELALRDHLDGAP

SEQ ID NO: 1269723 - protein, 19 aa, Mycobacterium
KEEVGGLVIGGFEPEAKPW

SEQ ID NO: 1269724 - protein, 27 aa, Mycobacterium
KEFAGAFKPPLSWGIRMTGKKFMREYP

SEQ ID NO: 1269725 - protein, 24 aa, Mycobacterium
KEGDNVFVALSWSKHPAPQNYQEA

SEQ ID NO: 1269726 - protein, 19 aa, Mycobacterium
KEGIPLVVLGGKEYGSGSS

SEQ ID NO: 1269727 - protein, 17 aa, Mycobacterium
KEGRSATPDEFRGQIDI

SEQ ID NO: 1269728 - protein, 17 aa, Mycobacterium
KEIRPVTIATYQVITRR

SEQ ID NO: 1269729 - protein, 17 aa, Mycobacterium
KEKLFLAVVDRQRQRFL

SEQ ID NO: 1269730 - protein, 27 aa, Mycobacterium
KELARLIGEGAPILWADMPTLPLYRQQ

SEQ ID NO: 1269731 - protein, 22 aa, Mycobacterium
KELARLSSPIGLDLGARTPEET

SEQ ID NO: 1269732 - protein, 22 aa, Mycobacterium
KELNVMGAIQLFAACQKAPSVR

SEQ ID NO: 1269733 - protein, 19 aa, Mycobacterium
KELPRNAILPEVAAQDLSI

SEQ ID NO: 1269734 - protein, 19 aa, Mycobacterium
KELRAVVAVDETDAVTADA

SEQ ID NO: 1269735 - protein, 17 aa, Mycobacterium
KELRLDRGPLEYDEAVA

SEQ ID NO: 1269736 - protein, 21 aa, Mycobacterium
KELTGRAGTLTPHREVTATDT

SEQ ID NO: 1269737 - protein, 17 aa, Mycobacterium
KELVWKLQHAAYVALNP

SEQ ID NO: 1269738 - protein, 21 aa, Mycobacterium
KELVWKLQHASYMAGNYLTGW

SEQ ID NO: 1269739 - protein, 20 aa, Mycobacterium
KEPDIEFADRFEIRTQLDDD

SEQ ID NO: 1269740 - protein, 25 aa, Mycobacterium
KESDPRYLPFRSLRGRDFTSMVSVP

SEQ ID NO: 1269741 - protein, 19 aa, Mycobacterium
KETFRYLYVDTDGNPIATR

SEQ ID NO: 1269742 - protein, 17 aa, Mycobacterium
KEVRAVIDVARQASMRG

SEQ ID NO: 1269743 - protein, 26 aa, Mycobacterium
KEWVPRLASMDAIASYCLTEPGAGSD

SEQ ID NO: 1269744 - protein, 20 aa, Mycobacterium
KEYGVPVAIKAAFGGGGRGM

SEQ ID NO: 1269745 - protein, 19 aa, Mycobacterium
KEYRVGSMADYRQMREDPN

SEQ ID NO: 1269746 - protein, 32 aa, Mycobacterium
KFARIIAEAIGAWRISKNISKGVKSAHDIAGV

SEQ ID NO: 1269747 - protein, 22 aa, Mycobacterium
KFDVSLPLSAIRGFAEDAAALV

SEQ ID NO: 1269748 - protein, 19 aa, Mycobacterium
KFGATHAYPDIFSAMAGVA

SEQ ID NO: 1269749 - protein, 21 aa, Mycobacterium
KFGGPIGVGALLLRRETACVP

SEQ ID NO: 1269750 - protein, 18 aa, Mycobacterium
KFGIPVLTSYAATEFGGG

SEQ ID NO: 1269751 - protein, 24 aa, Mycobacterium
KFGKSTGGGSLWLDPEMTSPYAWY

SEQ ID NO: 1269752 - protein, 17 aa, Mycobacterium
KFGLPEVERGALGAATH

SEQ ID NO: 1269753 - protein, 19 aa, Mycobacterium
KFGMTLCALGIAEEMRDAG

SEQ ID NO: 1269754 - protein, 18 aa, Mycobacterium
KFGMTLCALGIAEEMREY

SEQ ID NO: 1269755 - protein, 17 aa, Mycobacterium
KFHKDLPAWVDVDTRAH

SEQ ID NO: 1269756 - protein, 20 aa, Mycobacterium
KFIEVVAALAAFFPASVTRS

SEQ ID NO: 1269757 - protein, 23 aa, Mycobacterium
KFISCPGKAFIVGATREICAELY

SEQ ID NO: 1269758 - protein, 20 aa, Mycobacterium
KFKALMAERVPLYRQVATMR

SEQ ID NO: 1269759 - protein, 18 aa, Mycobacterium
KFPLMLSAMSTGVTFVRA

SEQ ID NO: 1269760 - protein, 24 aa, Mycobacterium
KFQTGFDQPLLVAMYVDKRLSGVA

SEQ ID NO: 1269761 - protein, 19 aa, Mycobacterium
KFSFLLLGAIVELRTVGQP

SEQ ID NO: 1269762 - protein, 17 aa, Mycobacterium
KFSVGHLGLHTVHGTLA

SEQ ID NO: 1269763 - protein, 18 aa, Mycobacterium
KFVAPIKAGDTLYCDVWV

SEQ ID NO: 1269764 - protein, 17 aa, Mycobacterium
KGAALFRTMRRLFSQSP

SEQ ID NO: 1269765 - protein, 19 aa, Mycobacterium
KGACQVFCVSRLCDFPGGC

SEQ ID NO: 1269766 - protein, 20 aa, Mycobacterium
KGADGTDRWFGTVMAAGFDS

SEQ ID NO: 1269767 - protein, 21 aa, Mycobacterium
KGAEAEAHWRRHMENASAALR

SEQ ID NO: 1269768 - protein, 26 aa, Mycobacterium
KGAEMCRRAGAEVARVEQEWRQHLGD

SEQ ID NO: 1269769 - protein, 20 aa, Mycobacterium
KGALPRAGVAAQIIEVAPGL

SEQ ID NO: 1269770 - protein, 22 aa, Mycobacterium
KGARAKVALASRIYVEGRHDAE

SEQ ID NO: 1269771 - protein, 21 aa, Mycobacterium
KGASRRARREGKVPVVLYGHG

SEQ ID NO: 1269772 - protein, 19 aa, Mycobacterium
KGASRWGADMALHVSAGIG

SEQ ID NO: 1269773 - protein, 18 aa, Mycobacterium
KGATLKMTAYRTGGGPAG

SEQ ID NO: 1269774 - protein, 25 aa, Mycobacterium
KGCAESLAGQGARVAVTEIDPINAL

SEQ ID NO: 1269775 - protein, 21 aa, Mycobacterium
KGCDICKPVVASILASTSSTH

SEQ ID NO: 1269776 - protein, 25 aa, Mycobacterium
KGDTYPTAMLMVFELDGDFDVAEAL

SEQ ID NO: 1269777 - protein, 17 aa, Mycobacterium
KGFEFLVSKGRALMPSL

SEQ ID NO: 1269778 - protein, 17 aa, Mycobacterium
KGFKSFASPTTLRFEPG

SEQ ID NO: 1269779 - protein, 18 aa, Mycobacterium
KGGFLPLGEYRWAFDNAC

SEQ ID NO: 1269780 - protein, 31 aa, Mycobacterium
KGGNGGNGGRGSLFGRGGNAGNGGNGGTGGN

SEQ ID NO: 1269781 - protein, 22 aa, Mycobacterium
KGGRTIDPWLRENIAAVDLNNL

SEQ ID NO: 1269782 - protein, 25 aa, Mycobacterium
KGHDTFCPVGPWIVTDLDPSDLEIR

SEQ ID NO: 1269783 - protein, 25 aa, Mycobacterium
KGHPEGLMSFRWFLADELPEHPATT

SEQ ID NO: 1269784 - protein, 29 aa, Mycobacterium
KGHPKKMWRPKVPISIAVGKPIEPTLPAA

SEQ ID NO: 1269785 - protein, 20 aa, Mycobacterium
KGIDRFEGRSSLRTWLFTVM

SEQ ID NO: 1269786 - protein, 23 aa, Mycobacterium
KGKRTDVFCRFSTVLGSRGSADT

SEQ ID NO: 1269787 - protein, 20 aa, Mycobacterium
KGLARAMAGFGDIMDGLSPV

SEQ ID NO: 1269788 - protein, 18 aa, Mycobacterium
KGLEKMNEVYGWEMPDVQ

SEQ ID NO: 1269789 - protein, 27 aa, Mycobacterium
KGLELIETHLLFGVDYDRIDVVVHPQS

SEQ ID NO: 1269790 - protein, 24 aa, Mycobacterium
KGLQFPVVYLPFAFNRNIQTRDVV

SEQ ID NO: 1269791 - protein, 17 aa, Mycobacterium
KGLSILIAPEGTRLDTT

SEQ ID NO: 1269792 - protein, 24 aa, Mycobacterium
KGMPNRISWTVVHYRPPEAMTLNG

SEQ ID NO: 1269793 - protein, 23 aa, Mycobacterium
KGMQRFAPLNSWPDNVSLDKARR

SEQ ID NO: 1269794 - protein, 25 aa, Mycobacterium
KGMSPVEWVRFAASFAGERVLKRTA

SEQ ID NO: 1269795 - protein, 23 aa, Mycobacterium
KGNDAIQLQLFWDYQFNLDGYPK

SEQ ID NO: 1269796 - protein, 24 aa, Mycobacterium
KGNEIACPFHDWRWGGDGRCKQIP

SEQ ID NO: 1269797 - protein, 21 aa, Mycobacterium
KGNEYFLRHLLGADSNLQATP

SEQ ID NO: 1269798 - protein, 23 aa, Mycobacterium
KGNLCRCTGYRAITDAIAGVVNT

SEQ ID NO: 1269799 - protein, 27 aa, Mycobacterium
KGNRHFSFGIGVHRCVGSNVARTLFKS

SEQ ID NO: 1269800 - protein, 21 aa, Mycobacterium
KGPDAPTLCAGWKTRDLAAHL

SEQ ID NO: 1269801 - protein, 19 aa, Mycobacterium
KGPDFPTHGLIVGSQGIED

SEQ ID NO: 1269802 - protein, 23 aa, Mycobacterium
KGPQYAAMFGWPEPFADGADKKD

SEQ ID NO: 1269803 - protein, 24 aa, Mycobacterium
KGQLTAPRASHDWAKGMRDQLLGR

SEQ ID NO: 1269804 - protein, 21 aa, Mycobacterium
KGQVFREVLDAVAPDALLASN

SEQ ID NO: 1269805 - protein, 18 aa, Mycobacterium
KGRALSVEREIFPQLLSD

SEQ ID NO: 1269806 - protein, 24 aa, Mycobacterium
KGRHCRKVRMGTGIDSPSLAMKAF

SEQ ID NO: 1269807 - protein, 18 aa, Mycobacterium
KGRSWAVLGEMAELGDDA

SEQ ID NO: 1269808 - protein, 20 aa, Mycobacterium
KGRVETYCGMIFVTFDDNAP

SEQ ID NO: 1269809 - protein, 19 aa, Mycobacterium
KGSFYWHFADMAAYRSALV

SEQ ID NO: 1269810 - protein, 22 aa, Mycobacterium
KGSNLEFALGYSHPVLITAPEG

SEQ ID NO: 1269811 - protein, 21 aa, Mycobacterium
KGTGVGGRIRKQDVLAAAEAS

SEQ ID NO: 1269812 - protein, 25 aa, Mycobacterium
KGTLFRRFGSRAGLMIVLLDEDEKA

SEQ ID NO: 1269813 - protein, 19 aa, Mycobacterium
KGVDAVVVPGGFSYGDYLR

SEQ ID NO: 1269814 - protein, 20 aa, Mycobacterium
KGVEIGDGFETARRRGSVAH

SEQ ID NO: 1269815 - protein, 21 aa, Mycobacterium
KGVKSAHDIAGVRTKLQRIKN

SEQ ID NO: 1269816 - protein, 23 aa, Mycobacterium
KGVLDRRSGTFIRFTRTAGGATA

SEQ ID NO: 1269817 - protein, 20 aa, Mycobacterium
KGVLLWPRDRLDEAQCLLRD

SEQ ID NO: 1269818 - protein, 21 aa, Mycobacterium
KGVVAEATWDRGVDKFICAMG

SEQ ID NO: 1269819 - protein, 18 aa, Mycobacterium
KGYHHWGDRFVDHLKGMF

SEQ ID NO: 1269820 - protein, 24 aa, Mycobacterium
KGYSRLTWAVLDWNENAIALYDAV

SEQ ID NO: 1269821 - protein, 18 aa, Mycobacterium
KGYWLPNSFDNHGPHQEY

SEQ ID NO: 1269822 - protein, 22 aa, Mycobacterium
KHAESVPQCALVIADVMRDAGV

SEQ ID NO: 1269823 - protein, 22 aa, Mycobacterium
KHAEVQAGVLVVERQFGYLEFH

SEQ ID NO: 1269824 - protein, 20 aa, Mycobacterium
KHALPHLRVEGGSIVNTAST

SEQ ID NO: 1269825 - protein, 27 aa, Mycobacterium
KHAYKAAGLQYYRPWILLLTDGKPNLD

SEQ ID NO: 1269826 - protein, 18 aa, Mycobacterium
KHEFRWEDVQSEVDREPT

SEQ ID NO: 1269827 - protein, 19 aa, Mycobacterium
KHESLRGFVFDVATGRLNE

SEQ ID NO: 1269828 - protein, 21 aa, Mycobacterium
KHHLPSIVFSLEMSKTEIVMR

SEQ ID NO: 1269829 - protein, 24 aa, Mycobacterium
KHIVRRLLAEVGFPVQELVRTDIG

SEQ ID NO: 1269830 - protein, 23 aa, Mycobacterium
KHLLRKGFEFKELEAAGLSREGK

SEQ ID NO: 1269831 - protein, 18 aa, Mycobacterium
KHLTVYAFSTENWKRSTE

SEQ ID NO: 1269832 - protein, 19 aa, Mycobacterium
KHNILYICDKLGALRRSDI

SEQ ID NO: 1269833 - protein, 17 aa, Mycobacterium
KHPHSMGEWSQASRTHV

SEQ ID NO: 1269834 - protein, 26 aa, Mycobacterium
KHPSLEWVPDWLWKQNLKVMQRFLLF

SEQ ID NO: 1269835 - protein, 20 aa, Mycobacterium
KHTDFRTGEVEVRRSRRLVI

SEQ ID NO: 1269836 - protein, 20 aa, Mycobacterium
KHTQVFRMWLDAVGITEDLQ

SEQ ID NO: 1269837 - protein, 25 aa, Mycobacterium
KIAAELKDSLKIVMRVYFEKPRTTI

SEQ ID NO: 1269838 - protein, 18 aa, Mycobacterium
KIAASCGSRIRRCSTELG

SEQ ID NO: 1269839 - protein, 19 aa, Mycobacterium
KIAEGFGCHGEYVEKEDEI

SEQ ID NO: 1269840 - protein, 19 aa, Mycobacterium
KIAEGMGVPARRVSTAEDL

SEQ ID NO: 1269841 - protein, 22 aa, Mycobacterium
KIALDIPEMLAEVAALSAAPAA

SEQ ID NO: 1269842 - protein, 20 aa, Mycobacterium
KIAVHWPLIDFECGPNGGAD

SEQ ID NO: 1269843 - protein, 25 aa, Mycobacterium
KIEALLRVLEPYGIREIVQSGVVSL

SEQ ID NO: 1269844 - protein, 20 aa, Mycobacterium
KIEPSLLGWLARLLPAAIAE

SEQ ID NO: 1269845 - protein, 24 aa, Mycobacterium
KIFFQIYWLGSRDDILARMERARA

SEQ ID NO: 1269846 - protein, 18 aa, Mycobacterium
KIGLEPLAAYRNFPGLMV

SEQ ID NO: 1269847 - protein, 17 aa, Mycobacterium
KIGRVYYPAPYMTNENL

SEQ ID NO: 1269848 - protein, 22 aa, Mycobacterium
KIGWACGPSDLIAGVRAAKQYL

SEQ ID NO: 1269849 - protein, 18 aa, Mycobacterium
KIKSVSFVGSTPIAQYVY

SEQ ID NO: 1269850 - protein, 17 aa, Mycobacterium
KILDLARAYGIVATEFE

SEQ ID NO: 1269851 - protein, 19 aa, Mycobacterium
KILGCDAAVLAARIAELLK

SEQ ID NO: 1269852 - protein, 24 aa, Mycobacterium
KILLTQGTGFNWPTPDHLRIVTLP

SEQ ID NO: 1269853 - protein, 21 aa, Mycobacterium
KILRGEVIWCQGFSEPDAGSD

SEQ ID NO: 1269854 - protein, 25 aa, Mycobacterium
KINEPRFPSFKGIMAAKKKEVTKLT

SEQ ID NO: 1269855 - protein, 27 aa, Mycobacterium
KIPSYKSCFLAMVRRFYEKGMTELNGH

SEQ ID NO: 1269856 - protein, 19 aa, Mycobacterium
KIQGGFLDFDAAIATPDQM

SEQ ID NO: 1269857 - protein, 19 aa, Mycobacterium
KIRQAVILASGLDTRAYRL

SEQ ID NO: 1269858 - protein, 23 aa, Mycobacterium
KITAIAARFTSPVFPGDTLTTSI

SEQ ID NO: 1269859 - protein, 24 aa, Mycobacterium
KITGPTAPSWRKGRYHIAGRGPRD

SEQ ID NO: 1269860 - protein, 27 aa, Mycobacterium
KITIDGRPTVNMAVGFLPPQDMIENAK

SEQ ID NO: 1269861 - protein, 23 aa, Mycobacterium
KIVEIPRPAGVVLALTPTTNPVS

SEQ ID NO: 1269862 - protein, 17 aa, Mycobacterium
KIVELNLLGALSVSTHA

SEQ ID NO: 1269863 - protein, 23 aa, Mycobacterium
KIVESLDGLVEWVNTHKPEIIGF

SEQ ID NO: 1269864 - protein, 18 aa, Mycobacterium
KKAPPFWTGESVVGRVAP

SEQ ID NO: 1269865 - protein, 20 aa, Mycobacterium
KKDFSHLMIRTEVRSAHGDS

SEQ ID NO: 1269866 - protein, 22 aa, Mycobacterium
KKDFSHLMLRTEVRSAHGDSHL

SEQ ID NO: 1269867 - protein, 25 aa, Mycobacterium
KKDRLFELIERMQLPTVFFAEGGGG

SEQ ID NO: 1269868 - protein, 25 aa, Mycobacterium
KKDTAFRAGDPIRIVGYSQGAGAAS

SEQ ID NO: 1269869 - protein, 20 aa, Mycobacterium
KKEAELKAAAAAWHALTGDL

SEQ ID NO: 1269870 - protein, 29 aa, Mycobacterium
KKIRTQTMLFPRYHQWDAVTRLIDRARTQ

SEQ ID NO: 1269871 - protein, 20 aa, Mycobacterium
KKLIWCDADDTVARVATRMM

SEQ ID NO: 1269872 - protein, 27 aa, Mycobacterium
KKLPSVAETIDWGRTLLALGMDTVDDE

SEQ ID NO: 1269873 - protein, 17 aa, Mycobacterium
KKLQAVIEKGHQGAAEM

SEQ ID NO: 1269874 - protein, 17 aa, Mycobacterium
KKLRTLADVVGYVEQHA

SEQ ID NO: 1269875 - protein, 22 aa, Mycobacterium
KKMIRAALRGALSDRARNDRIH

SEQ ID NO: 1269876 - protein, 19 aa, Mycobacterium
KKMRCPLLVQIADFDQYVP

SEQ ID NO: 1269877 - protein, 19 aa, Mycobacterium
KKQGELVMSVFSSKDAMEG

SEQ ID NO: 1269878 - protein, 22 aa, Mycobacterium
KKRARINAMRHVLSKFDYDNKD

SEQ ID NO: 1269879 - protein, 19 aa, Mycobacterium
KKRFFSSPVAFARTVDVYK

SEQ ID NO: 1269880 - protein, 25 aa, Mycobacterium
KKRPEFQKLTPLYPNTRLRLETSSD

SEQ ID NO: 1269881 - protein, 24 aa, Mycobacterium
KKRPFYFRALTWYMDRVMELVHDD

SEQ ID NO: 1269882 - protein, 19 aa, Mycobacterium
KKRWLPGIISGELIVAVAM

SEQ ID NO: 1269883 - protein, 20 aa, Mycobacterium
KKSFRAWLDGEWFRVGMAEE

SEQ ID NO: 1269884 - protein, 25 aa, Mycobacterium
KKSHVRIVISLRVEYEHELTGPGGL

SEQ ID NO: 1269885 - protein, 28 aa, Mycobacterium
KKSMPVPMLTFRLWRPLSHDTMEVWSWF

SEQ ID NO: 1269886 - protein, 21 aa, Mycobacterium
KKSPHLLALRHAIDRGVMVTV

SEQ ID NO: 1269887 - protein, 19 aa, Mycobacterium
KKSSAWVVLEVEFALDASG

SEQ ID NO: 1269888 - protein, 21 aa, Mycobacterium
KKTQGKYASTVDKVQEAAKKA

SEQ ID NO: 1269889 - protein, 18 aa, Mycobacterium
KKVGYRLLTKFGTKGSIN

SEQ ID NO: 1269890 - protein, 29 aa, Mycobacterium
KKVRTRLAIRREAFRLFAKQGYANTTVEQ

SEQ ID NO: 1269891 - protein, 23 aa, Mycobacterium
KKVRYWAARCVGGEFAANDEVDE

SEQ ID NO: 1269892 - protein, 23 aa, Mycobacterium
KKYLDHFGFGFVMFINGYCADDV

SEQ ID NO: 1269893 - protein, 25 aa, Mycobacterium
KLAAELRPWVPVVSLVKGLEQGTNM

SEQ ID NO: 1269894 - protein, 23 aa, Mycobacterium
KLAAPLVKARAKVELSERLVKWQ

SEQ ID NO: 1269895 - protein, 24 aa, Mycobacterium
KLADYKGRKVIVYFYPAASTPGCT

SEQ ID NO: 1269896 - protein, 20 aa, Mycobacterium
KLAEGDRWNRFEVDTMLLEL

SEQ ID NO: 1269897 - protein, 24 aa, Mycobacterium
KLAKARGLWNLFLPSESGLSNLEY

SEQ ID NO: 1269898 - protein, 17 aa, Mycobacterium
KLANLLFVHELVARGKT

SEQ ID NO: 1269899 - protein, 27 aa, Mycobacterium
KLANLMFTYTLARRLAAKGAPTIAVAA

SEQ ID NO: 1269900 - protein, 20 aa, Mycobacterium
KLAPKGTGAVLAFELAGGVE

SEQ ID NO: 1269901 - protein, 18 aa, Mycobacterium
KLARMGLANYFAAAAVLP

SEQ ID NO: 1269902 - protein, 19 aa, Mycobacterium
KLAVQCGGAVTPAIRSAAR

SEQ ID NO: 1269903 - protein, 32 aa, Mycobacterium
KLDDLAERVGWRWRLVWFRAVSELLTADYDSA

SEQ ID NO: 1269904 - protein, 26 aa, Mycobacterium
KLDIAADGTFEWRFTPKVPSQLVIRE

SEQ ID NO: 1269905 - protein, 19 aa, Mycobacterium
KLDRLCTRLGVTKGSFYWH

SEQ ID NO: 1269906 - protein, 24 aa, Mycobacterium
KLEELKALWFSEAAKYNGLPLGDL

SEQ ID NO: 1269907 - protein, 22 aa, Mycobacterium
KLEKTKRFLLGELLGRITRHLL

SEQ ID NO: 1269908 - protein, 24 aa, Mycobacterium
KLEQQAIFRKLWLHVGRVERLLKT

SEQ ID NO: 1269909 - protein, 24 aa, Mycobacterium
KLEQQAIFRKLWLHVGRVERLPKA

SEQ ID NO: 1269910 - protein, 23 aa, Mycobacterium
KLFASEVAMEIALNAVRIHGGYG

SEQ ID NO: 1269911 - protein, 24 aa, Mycobacterium
KLFASEVAMEIALNAVRIHGGYGY

SEQ ID NO: 1269912 - protein, 21 aa, Mycobacterium
KLFPGSWSQWSADASRPVATG

SEQ ID NO: 1269913 - protein, 19 aa, Mycobacterium
KLFRGLFRGTGKYYSGVKW

SEQ ID NO: 1269914 - protein, 24 aa, Mycobacterium
KLFRRGQGKLGFEVKIHRIAAEGD

SEQ ID NO: 1269915 - protein, 25 aa, Mycobacterium
KLGGLTRTWRFDRMATVCDPGSGRV

SEQ ID NO: 1269916 - protein, 24 aa, Mycobacterium
KLGLLPKYRKLFGSSTLGYFRPGY

SEQ ID NO: 1269917 - protein, 18 aa, Mycobacterium
KLGVSFAAPGPVSVEAIE

SEQ ID NO: 1269918 - protein, 19 aa, Mycobacterium
KLHPKRDALGRVLAPAEAL

SEQ ID NO: 1269919 - protein, 18 aa, Mycobacterium
KLILECPKPVLAVKPEEM

SEQ ID NO: 1269920 - protein, 19 aa, Mycobacterium
KLILGSVAWSQVARSVISI

SEQ ID NO: 1269921 - protein, 23 aa, Mycobacterium
KLINSGFTRRQVAILEPKLRAFA

SEQ ID NO: 1269922 - protein, 19 aa, Mycobacterium
KLIVRFCAEPEVFVPGAPP

SEQ ID NO: 1269923 - protein, 22 aa, Mycobacterium
KLKAITDVLDRIGISARTAVDI

SEQ ID NO: 1269924 - protein, 18 aa, Mycobacterium
KLKLRTEVLSDLRAGPLA

SEQ ID NO: 1269925 - protein, 24 aa, Mycobacterium
KLKWQRSDPEFAYSDRERDGLLEA

SEQ ID NO: 1269926 - protein, 17 aa, Mycobacterium
KLLARLGTHDDRIDWSK

SEQ ID NO: 1269927 - protein, 26 aa, Mycobacterium
KLLDGFGLACVGGFVPVVLYKDDHDP

SEQ ID NO: 1269928 - protein, 19 aa, Mycobacterium
KLLEARVGRGAVLEQVVND

SEQ ID NO: 1269929 - protein, 18 aa, Mycobacterium
KLLGKKVSAYAVDYPASW

SEQ ID NO: 1269930 - protein, 18 aa, Mycobacterium
KLLGLPMGVDVCYTNHAE

SEQ ID NO: 1269931 - protein, 18 aa, Mycobacterium
KLLGPLARLANRLGGNFR

SEQ ID NO: 1269932 - protein, 27 aa, Mycobacterium
KLLILPPLMHGAAQWAVMTALTTGQTV

SEQ ID NO: 1269933 - protein, 19 aa, Mycobacterium
KLLLPPFNGKSMRGYASIT

SEQ ID NO: 1269934 - protein, 17 aa, Mycobacterium
KLLPAGWAAEIAGQITR

SEQ ID NO: 1269935 - protein, 26 aa, Mycobacterium
KLLQGLGFSFSRQWTVAQIVRRYGDV

SEQ ID NO: 1269936 - protein, 24 aa, Mycobacterium
KLLQRPEEVAARRGLPIEDVAPAG

SEQ ID NO: 1269937 - protein, 19 aa, Mycobacterium
KLLREQTGLGLKESKDIVD

SEQ ID NO: 1269938 - protein, 23 aa, Mycobacterium
KLNIGNPAPFGFEAPDVIMRDII

SEQ ID NO: 1269939 - protein, 19 aa, Mycobacterium
KLNLLRPVSSGVCVAVTDI

SEQ ID NO: 1269940 - protein, 19 aa, Mycobacterium
KLNLLRPVSTGVCVAVTDI

SEQ ID NO: 1269941 - protein, 20 aa, Mycobacterium
KLPDGVRMVSADESIPIDER

SEQ ID NO: 1269942 - protein, 18 aa, Mycobacterium
KLPLTYGPQEGFVLENAR

SEQ ID NO: 1269943 - protein, 22 aa, Mycobacterium
KLPQSLHLYFVRGGRYGVEVEL

SEQ ID NO: 1269944 - protein, 28 aa, Mycobacterium
KLPSMGSFRGSGTWIPLLRSGPGGQAES

SEQ ID NO: 1269945 - protein, 30 aa, Mycobacterium
KLPTAGAFRGTGTWLPLLRSGPNGRAESLV

SEQ ID NO: 1269946 - protein, 24 aa, Mycobacterium
KLQKRLKDELDWVRSGAKARQAKS

SEQ ID NO: 1269947 - protein, 25 aa, Mycobacterium
KLQRSEYLEPRWMIGIDPESEGLAR

SEQ ID NO: 1269948 - protein, 30 aa, Mycobacterium
KLRDILGLLRDAYCRHIGVEYTHILEPEQQ

SEQ ID NO: 1269949 - protein, 21 aa, Mycobacterium
KLRHEIGIDIIAWECDYPHSD

SEQ ID NO: 1269950 - protein, 22 aa, Mycobacterium
KLRTEELLVFLGVIANAGTETV

SEQ ID NO: 1269951 - protein, 28 aa, Mycobacterium
KLSADLFRLPMRVLRAVRQTRRILDEVS

SEQ ID NO: 1269952 - protein, 22 aa, Mycobacterium
KLSDDEFGFFVVMLAVAGNETT

SEQ ID NO: 1269953 - protein, 27 aa, Mycobacterium
KLTDPRWRLLFPLLMETGLRLNDALHL

SEQ ID NO: 1269954 - protein, 18 aa, Mycobacterium
KLTLTRTVQVAGAFVPAV

SEQ ID NO: 1269955 - protein, 19 aa, Mycobacterium
KLTLVAFEAMNHWRPDGGF

SEQ ID NO: 1269956 - protein, 29 aa, Mycobacterium
KLTPRYAVGCKRPGFHNTYLATFNRSNVR

SEQ ID NO: 1269957 - protein, 24 aa, Mycobacterium
KLVAELRAGFGVDVEVRDIFENAT

SEQ ID NO: 1269958 - protein, 20 aa, Mycobacterium
KLVEELWEFTVGDKLWAPTF

SEQ ID NO: 1269959 - protein, 21 aa, Mycobacterium
KLVEIKDQWGIKQITEPRHMH

SEQ ID NO: 1269960 - protein, 20 aa, Mycobacterium
KLVGKLPAALGVEIPVNSEP

SEQ ID NO: 1269961 - protein, 25 aa, Mycobacterium
KLVKRTLDGWLRELTATIVAAQTDG

SEQ ID NO: 1269962 - protein, 28 aa, Mycobacterium
KLVKTIDQIACIRRACQITEQAVAEIQK

SEQ ID NO: 1269963 - protein, 23 aa, Mycobacterium
KLVPALLAKFAVRFTLMSTELRR

SEQ ID NO: 1269964 - protein, 26 aa, Mycobacterium
KLWARSGYLQPHWPKPYGRGADSVEQ

SEQ ID NO: 1269965 - protein, 18 aa, Mycobacterium
KLYDAFNVNVAILGDTAA

SEQ ID NO: 1269966 - protein, 19 aa, Mycobacterium
KLYPGELFATGTLPGGSGM

SEQ ID NO: 1269967 - protein, 31 aa, Mycobacterium
KMAAVAAKRGWPILRFSSRSGASPASQVRTA

SEQ ID NO: 1269968 - protein, 21 aa, Mycobacterium
KMAVICLIGAMLVDSGHSDDK

SEQ ID NO: 1269969 - protein, 23 aa, Mycobacterium
KMFCGCANRFGAEPNTQVCPVCL

SEQ ID NO: 1269970 - protein, 25 aa, Mycobacterium
KMFDVRHIAALFSPDGYTFPESREG

SEQ ID NO: 1269971 - protein, 24 aa, Mycobacterium
KMHTDIAFGWTVERLARTAGVSRA

SEQ ID NO: 1269972 - protein, 19 aa, Mycobacterium
KMLAYNLSPSFNWDTTGMS

SEQ ID NO: 1269973 - protein, 21 aa, Mycobacterium
KMLDERLRAFTARHPDAVVVD

SEQ ID NO: 1269974 - protein, 28 aa, Mycobacterium
KMTKDSKISTVWTWPDRPGVAGCAALDG

SEQ ID NO: 1269975 - protein, 18 aa, Mycobacterium
KMVLETKSGETIVLKPEV

SEQ ID NO: 1269976 - protein, 19 aa, Mycobacterium
KNAETLRKFGKYLVDLTPA

SEQ ID NO: 1269977 - protein, 19 aa, Mycobacterium
KNERISGALDFMKATATPE

SEQ ID NO: 1269978 - protein, 17 aa, Mycobacterium
KNGLPWASAQIEDLTGG

SEQ ID NO: 1269979 - protein, 19 aa, Mycobacterium
KNIDTGMGVERVACLLQGV

SEQ ID NO: 1269980 - protein, 27 aa, Mycobacterium
KNKSVRAWRLPMGFTAWPPWRPGVLFT

SEQ ID NO: 1269981 - protein, 19 aa, Mycobacterium
KNLFGAAIGPLLNGIAGTG

SEQ ID NO: 1269982 - protein, 18 aa, Mycobacterium
KNMFPIFTVEGGLTCSIV

SEQ ID NO: 1269983 - protein, 20 aa, Mycobacterium
KNPFLLDSHRPRIALEHYRD

SEQ ID NO: 1269984 - protein, 18 aa, Mycobacterium
KNRACSRGIVEFYRDQDY

SEQ ID NO: 1269985 - protein, 17 aa, Mycobacterium
KNRDCQILLATDAAGEG

SEQ ID NO: 1269986 - protein, 22 aa, Mycobacterium
KNVDAAAAFIAWATAAPQNLKV

SEQ ID NO: 1269987 - protein, 28 aa, Mycobacterium
KNVDLWQRLQIASAQHRVEWFWVKGHSG

SEQ ID NO: 1269988 - protein, 28 aa, Mycobacterium
KPAEAHGAFAKRIRHAFQRLTEDREMAA

SEQ ID NO: 1269989 - protein, 18 aa, Mycobacterium
KPAPRIVAGLPVAVHDDA

SEQ ID NO: 1269990 - protein, 25 aa, Mycobacterium
KPAQRVCAVDGGIRIATTVHATLAA

SEQ ID NO: 1269991 - protein, 21 aa, Mycobacterium
KPAYHALTFGWLLSGLARSIT

SEQ ID NO: 1269992 - protein, 24 aa, Mycobacterium
KPDERRLPVHPAHLSRIAPELRDR

SEQ ID NO: 1269993 - protein, 23 aa, Mycobacterium
KPDMRFGLELVECTDYFMDTPFR

SEQ ID NO: 1269994 - protein, 19 aa, Mycobacterium
KPEAGVTLCNTWDVTDYRG

SEQ ID NO: 1269995 - protein, 23 aa, Mycobacterium
KPEPSYLAGFGYTQSDLTDGLGI

SEQ ID NO: 1269996 - protein, 27 aa, Mycobacterium
KPFDYWRQHLKTMKGQWAPFQSLVDLG

SEQ ID NO: 1269997 - protein, 23 aa, Mycobacterium
KPFKEALVADGIPFTSFAVEDVQ

SEQ ID NO: 1269998 - protein, 17 aa, Mycobacterium
KPFKVVRGPVQFNHEPL

SEQ ID NO: 1269999 - protein, 32 aa, Mycobacterium
KPGDRLLDVGCGWGGMVRYAARHGVKAIGVTL

SEQ ID NO: 1270000 - protein, 17 aa, Mycobacterium
KPGGRQGRRPSRFLNGI

SEQ ID NO: 1270001 - protein, 23 aa, Mycobacterium
KPGKYADPWAAIRSRLGDPGLDR

SEQ ID NO: 1270002 - protein, 23 aa, Mycobacterium
KPGRPRTGLAALRMTTVDQLGRL

SEQ ID NO: 1270003 - protein, 18 aa, Mycobacterium
KPGRRPPDEVVTFGEYEG

SEQ ID NO: 1270004 - protein, 19 aa, Mycobacterium
KPGSAIWFKGGPRPGQPAV

SEQ ID NO: 1270005 - protein, 17 aa, Mycobacterium
KPGSMGRPLPGVHATIV

SEQ ID NO: 1270006 - protein, 27 aa, Mycobacterium
KPGVLARVASLFSRRGYNIQSLAVGAT

SEQ ID NO: 1270007 - protein, 22 aa, Mycobacterium
KPHEGPCGSGTVFVFSGQGSQW

SEQ ID NO: 1270008 - protein, 20 aa, Mycobacterium
KPHFGFGGGVHHCLGHFVAR

SEQ ID NO: 1270009 - protein, 20 aa, Mycobacterium
KPHGIEIFGTMLVVFADSQG

SEQ ID NO: 1270010 - protein, 26 aa, Mycobacterium
KPHIEKRFSMPWSKPVGRMREFVLAL

SEQ ID NO: 1270011 - protein, 19 aa, Mycobacterium
KPHLFALGIRRGNIHYGFV

SEQ ID NO: 1270012 - protein, 20 aa, Mycobacterium
KPIIDKALETIPDALAVINA

SEQ ID NO: 1270013 - protein, 19 aa, Mycobacterium
KPITAAILRGVMRVFEDFR

SEQ ID NO: 1270014 - protein, 24 aa, Mycobacterium
KPIYHRKWWDRYVEVNRRFAEATA

SEQ ID NO: 1270015 - protein, 23 aa, Mycobacterium
KPLAEVLEHAFAVYLQSNPWAAD

SEQ ID NO: 1270016 - protein, 19 aa, Mycobacterium
KPLGYRAIDVDNHYYEPID

SEQ ID NO: 1270017 - protein, 25 aa, Mycobacterium
KPLHIHRILLQRSWVDILRGDFSAA

SEQ ID NO: 1270018 - protein, 21 aa, Mycobacterium
KPLLANVDTFRCWLDDEREEV

SEQ ID NO: 1270019 - protein, 20 aa, Mycobacterium
KPLQPRADRSYLITGGLGAI

SEQ ID NO: 1270020 - protein, 17 aa, Mycobacterium
KPMAFVRALLRTDVTDL

SEQ ID NO: 1270021 - protein, 33 aa, Mycobacterium; identical to SEQ ID NO: 684649

SEQ ID NO: 1270022 - protein, 20 aa, Mycobacterium
KPNAEELAGVLGLSAQSLED

SEQ ID NO: 1270023 - protein, 17 aa, Mycobacterium
KPPLFGINPDARVTALS

SEQ ID NO: 1270024 - protein, 18 aa, Mycobacterium
KPPRMLVLLHLDGASDRP

SEQ ID NO: 1270025 - protein, 19 aa, Mycobacterium
KPQRMPLTAARRLIDDDAG

SEQ ID NO: 1270026 - protein, 22 aa, Mycobacterium
KPQSIELGGFILIRGSKEQIDG

SEQ ID NO: 1270027 - protein, 26 aa, Mycobacterium
KPRPLGKARWAGAVDCVGGATLADVL

SEQ ID NO: 1270028 - protein, 19 aa, Mycobacterium
KPRSDYSLGAFAVGLRDFL

SEQ ID NO: 1270029 - protein, 33 aa, Mycobacterium
KPRTRILHPYWEWDGTDLFGWVATVPSPVKRAH

SEQ ID NO: 1270030 - protein, 20 aa, Mycobacterium
KPRTVRVTSFDGAKIYVHFM

SEQ ID NO: 1270031 - protein, 26 aa, Mycobacterium
KPSELTPLTAIACQALLQRAAADVGA

SEQ ID NO: 1270032 - protein, 19 aa, Mycobacterium
KPSPGSIYPTLQLLVDEGL

SEQ ID NO: 1270033 - protein, 17 aa, Mycobacterium
KPSRGGSSIGVSRVTAW

SEQ ID NO: 1270034 - protein, 19 aa, Mycobacterium
KPSSTLEQQEWALSAVRKP

SEQ ID NO: 1270035 - protein, 27 aa, Mycobacterium
KPTDRRPRIALLDGLPMAGHIALSERL

SEQ ID NO: 1270036 - protein, 18 aa, Mycobacterium
KPTGWFQVAWSDEIGIGD

SEQ ID NO: 1270037 - protein, 27 aa, Mycobacterium
KPTSVPAFRPGAQFKAVVSGAQKLPAE

SEQ ID NO: 1270038 - protein, 24 aa, Mycobacterium
KPVAAICHGPWALVEADVVKDRTL

SEQ ID NO: 1270039 - protein, 20 aa, Mycobacterium
KPVEVYAIYGGQWPHSSFMV

SEQ ID NO: 1270040 - protein, 17 aa, Mycobacterium
KPVFTADEFFAWLGPAG

SEQ ID NO: 1270041 - protein, 20 aa, Mycobacterium
KPVGHFWFDIPHFIMEQKMM

SEQ ID NO: 1270042 - protein, 18 aa, Mycobacterium
KPVTCDDLVLAWASQSGR

SEQ ID NO: 1270043 - protein, 19 aa, Mycobacterium
KPWMGEVFDTAYIPDPAQR

SEQ ID NO: 1270044 - protein, 19 aa, Mycobacterium
KQAGISFLLIDMNTPGITL

SEQ ID NO: 1270045 - protein, 19 aa, Mycobacterium
KQAHLPYLVYLRHPTTGGV

SEQ ID NO: 1270046 - protein, 25 aa, Mycobacterium
KQAMIDWLGPIIWEYYSSTEVHGMT

SEQ ID NO: 1270047 - protein, 25 aa, Mycobacterium
KQANCAAEFAVLAGEQFAVFAALVT

SEQ ID NO: 1270048 - protein, 28 aa, Mycobacterium
KQAWAEGRFDREISPISAPVLDENKQPT

SEQ ID NO: 1270049 - protein, 24 aa, Mycobacterium
KQERRYQRFAAIWRSRPVNWIWDR

SEQ ID NO: 1270050 - protein, 25 aa, Mycobacterium
KQFKSYRGMGSLGAMQGRGAGGNLR

SEQ ID NO: 1270051 - protein, 25 aa, Mycobacterium
KQFTMATDMAVYFCDPASPWQRGSN

SEQ ID NO: 1270052 - protein, 25 aa, Mycobacterium
KQGAEALCGTVGFIGFAVNGALARY

SEQ ID NO: 1270053 - protein, 24 aa, Mycobacterium
KQGEASAGFMLMKPLVETATAAGA

SEQ ID NO: 1270054 - protein, 19 aa, Mycobacterium
KQGEPPLAGSLLIGGSGAA

SEQ ID NO: 1270055 - protein, 18 aa, Mycobacterium
KQHVREFAGHMATAAQTV

SEQ ID NO: 1270056 - protein, 23 aa, Mycobacterium
KQIRLPGFRPGKAPRKLLEARVG

SEQ ID NO: 1270057 - protein, 22 aa, Mycobacterium
KQIVPLREVYKFTEDEIEFFDL

SEQ ID NO: 1270058 - protein, 23 aa, Mycobacterium
KQKFVLVAPFELWRGEGTQRRAY

SEQ ID NO: 1270059 - protein, 25 aa, Mycobacterium
KQMQGWLDQWGMPGPNAPGGDMGPH

SEQ ID NO: 1270060 - protein, 25 aa, Mycobacterium
KQMRSTELMYAWHLPDVIEAMVGVG

SEQ ID NO: 1270061 - protein, 21 aa, Mycobacterium
KQRAQELLEQFDLVQAADRPV

SEQ ID NO: 1270062 - protein, 22 aa, Mycobacterium
KQRSVENLGLLAWFKETASDVV

SEQ ID NO: 1270063 - protein, 30 aa, Mycobacterium
KQRWLPKFCSGEIISAIAMTEPGTGSDLQG

SEQ ID NO: 1270064 - protein, 22 aa, Mycobacterium
KQVALHHPGNWTVGGMAKGAGM

SEQ ID NO: 1270065 - protein, 18 aa, Mycobacterium
KQVEAMMTLFMPSRPAGS

SEQ ID NO: 1270066 - protein, 18 aa, Mycobacterium
KQVKRLGVGTYRRFSTIT

SEQ ID NO: 1270067 - protein, 24 aa, Mycobacterium
KQVPADEVFRGFATELGLDVAAWE

SEQ ID NO: 1270068 - protein, 21 aa, Mycobacterium
KQVRRIQRQVAHEVVAEVDVR

SEQ ID NO: 1270069 - protein, 20 aa, Mycobacterium
KQVRRLVGFVFTDPDRQILM

SEQ ID NO: 1270070 - protein, 22 aa, Mycobacterium
KQVSLRLAERGVLVKDTHGSTL

SEQ ID NO: 1270071 - protein, 26 aa, Mycobacterium
KRAADLPPAVGVLVEYTGGDTSAAHA

SEQ ID NO: 1270072 - protein, 19 aa, Mycobacterium
KRAAIFAALADPSRLAIVD

SEQ ID NO: 1270073 - protein, 19 aa, Mycobacterium
KRAALETLYLVGRSAGREI

SEQ ID NO: 1270074 - protein, 22 aa, Mycobacterium
KRAARHIDAWLAGLSGERAPRH

SEQ ID NO: 1270075 - protein, 23 aa, Mycobacterium
KRADKELRELGRVNPLALEEFAA

SEQ ID NO: 1270076 - protein, 22 aa, Mycobacterium
KRAESGALFALLSGQHAGTALQ

SEQ ID NO: 1270077 - protein, 20 aa, Mycobacterium
KRAGNSMMACVSRAASQSLE

SEQ ID NO: 1270078 - protein, 23 aa, Mycobacterium
KRAHGSAQLFGPPREQLRRLEAQ

SEQ ID NO: 1270079 - protein, 26 aa, Mycobacterium
KRAHLPLHKLPDKWAIQLNDTHPSIA

SEQ ID NO: 1270080 - protein, 20 aa, Mycobacterium
KRAIIAEAFRVLRPGGRYAI

SEQ ID NO: 1270081 - protein, 18 aa, Mycobacterium
KRAKTLGPRRGLTGTPLP

SEQ ID NO: 1270082 - protein, 18 aa, Mycobacterium
KRALVKRVQLIRCSTEKL

SEQ ID NO: 1270083 - protein, 22 aa, Mycobacterium
KRARNGLTMAPPFAAPKTAFNA

SEQ ID NO: 1270084 - protein, 25 aa, Mycobacterium
KRCLVPMDGWYEWKGQKGAKTPYYM

SEQ ID NO: 1270085 - protein, 20 aa, Mycobacterium
KRDFSHLMIRTEVRSAHGDS

SEQ ID NO: 1270086 - protein, 20 aa, Mycobacterium
KRDQALKFGATHAYPDIFSA

SEQ ID NO: 1270087 - protein, 21 aa, Mycobacterium
KRDRKVLTFVLDKGMDGFVQS

SEQ ID NO: 1270088 - protein, 19 aa, Mycobacterium
KRELVFAGPVARPTATLVR

SEQ ID NO: 1270089 - protein, 20 aa, Mycobacterium
KRFAVFVVCRRKWRKNLAGV

SEQ ID NO: 1270090 - protein, 19 aa, Mycobacterium
KRFGDRTVLDDISLSVGSG

SEQ ID NO: 1270091 - protein, 21 aa, Mycobacterium
KRFLEKYGKATPEALVESALW

SEQ ID NO: 1270092 - protein, 21 aa, Mycobacterium
KRFPDKSIRSVYSVFARAVMV

SEQ ID NO: 1270093 - protein, 19 aa, Mycobacterium
KRFVKGIEQEAVFQKRAPE

SEQ ID NO: 1270094 - protein, 17 aa, Mycobacterium
KRGRRVLVVDGDPQANV

SEQ ID NO: 1270095 - protein, 22 aa, Mycobacterium
KRGSPIGSIAFQFNPKEVTISK

SEQ ID NO: 1270096 - protein, 24 aa, Mycobacterium
KRGTKHVRRLAALVDEYQVVEVVV

SEQ ID NO: 1270097 - protein, 21 aa, Mycobacterium
KRIASPAQRIMLIARDGGCTK

SEQ ID NO: 1270098 - protein, 20 aa, Mycobacterium
KRIEENFDLFDFELGEADVD

SEQ ID NO: 1270099 - protein, 25 aa, Mycobacterium
KRIILADDGVGFSFHETTIDANSVS

SEQ ID NO: 1270100 - protein, 19 aa, Mycobacterium
KRIRNAIFTAMDALRGILV

SEQ ID NO: 1270101 - protein, 17 aa, Mycobacterium
KRISEAGDVVFLELEER

SEQ ID NO: 1270102 - protein, 19 aa, Mycobacterium
KRKLLPGMAYLVQSALAPK

SEQ ID NO: 1270103 - protein, 26 aa, Mycobacterium
KRKLQRRYRLAWRVFHRTSIRDIASY

SEQ ID NO: 1270104 - protein, 22 aa, Mycobacterium
KRKRRYPGMHVYHYAAYEKSTL

SEQ ID NO: 1270105 - protein, 23 aa, Mycobacterium
KRLAEVQTGLTLGKSVDPAEAVD

SEQ ID NO: 1270106 - protein, 17 aa, Mycobacterium
KRLAMTVTLAERERQVS

SEQ ID NO: 1270107 - protein, 21 aa, Mycobacterium
KRLAPGPFLACTLAARVAAGC

SEQ ID NO: 1270108 - protein, 25 aa, Mycobacterium
KRLARYEIPGELVITDAIPRTASGK

SEQ ID NO: 1270109 - protein, 18 aa, Mycobacterium
KRLAVWLVSDPSAVPGIA

SEQ ID NO: 1270110 - protein, 21 aa, Mycobacterium
KRLDGCHSMLAEAPARGLEWA

SEQ ID NO: 1270111 - protein, 18 aa, Mycobacterium
KRLEEVWVPNLDGTAPDP

SEQ ID NO: 1270112 - protein, 19 aa, Mycobacterium
KRLEPQALVLPHCRTYRYG

SEQ ID NO: 1270113 - protein, 21 aa, Mycobacterium
KRLGRRVTEIALVFRRAPHLP

SEQ ID NO: 1270114 - protein, 17 aa, Mycobacterium
KRLNGMDAMLLYSETPN

SEQ ID NO: 1270115 - protein, 23 aa, Mycobacterium
KRLPRRVTEVALVFKRAPHLPFD

SEQ ID NO: 1270116 - protein, 19 aa, Mycobacterium
KRLRELTGAGMLDSKNALV

SEQ ID NO: 1270117 - protein, 21 aa, Mycobacterium
KRMEIALTYIYGIGRTRSQEI

SEQ ID NO: 1270118 - protein, 20 aa, Mycobacterium
KRNAPAAAIAEGMAMVPEDR

SEQ ID NO: 1270119 - protein, 32 aa, Mycobacterium
KRPAYPLKEIRHWLQVFAQRFYSFSQFKRSAL

SEQ ID NO: 1270120 - protein, 22 aa, Mycobacterium
KRPLPHFDDLLFLGASMSRYPL

SEQ ID NO: 1270121 - protein, 31 aa, Mycobacterium
KRPSRVVFVPAIPRLPSGKVLRRVLKEQHGC

SEQ ID NO: 1270122 - protein, 18 aa, Mycobacterium
KRQRLVANPVKFDDAEAH

SEQ ID NO: 1270123 - protein, 20 aa, Mycobacterium
KRRGMLDEARMETMAREALT

SEQ ID NO: 1270124 - protein, 41 aa, Mycobacterium
KRRILDAAAAWPLRLVTRNGTVCGFVMQLIPAQLFGTQTLP

SEQ ID NO: 1270125 - protein, 18 aa, Mycobacterium
KRRRIITTPVEHHAVLDA

SEQ ID NO: 1270126 - protein, 21 aa, Mycobacterium
KRRVPAHGFLEFAGPTLGGPG

SEQ ID NO: 1270127 - protein, 29 aa, Mycobacterium
KRRYRLLEMSQLPGRGWVEYEPYGTVLII

SEQ ID NO: 1270128 - protein, 29 aa, Mycobacterium
KRSGDGGFGWEVTSGSLFRDDGQGWTGIP

SEQ ID NO: 1270129 - protein, 27 aa, Mycobacterium
KRSPAGKPDYRWAKDVTEERPADDVHA

SEQ ID NO: 1270130 - protein, 22 aa, Mycobacterium
KRTADGYASNWLCDNAHAGMRI

SEQ ID NO: 1270131 - protein, 20 aa, Mycobacterium
KRTLTASGLRQLINFISRMT

SEQ ID NO: 1270132 - protein, 26 aa, Mycobacterium
KRTQWWGRQMLIWGVHVHVGVSSAHK

SEQ ID NO: 1270133 - protein, 23 aa, Mycobacterium
KRTRSGLERLLAAMFVYDLPPSR

SEQ ID NO: 1270134 - protein, 18 aa, Mycobacterium
KRVALVFSAYPTKHARIG

SEQ ID NO: 1270135 - protein, 19 aa, Mycobacterium
KRVGTPFASTAHYSLLAAL

SEQ ID NO: 1270136 - protein, 20 aa, Mycobacterium
KRWPGPRQIYRASGLSPMQY

SEQ ID NO: 1270137 - protein, 19 aa, Mycobacterium
KRYENWELPDPAGQGLDAV

SEQ ID NO: 1270138 - protein, 20 aa, Mycobacterium
KRYGGHGLGHLHRYVVTEEL

SEQ ID NO: 1270139 - protein, 24 aa, Mycobacterium
KRYLDVDGAWRDHLLVAITVEELS

SEQ ID NO: 1270140 - protein, 24 aa, Mycobacterium
KRYTGHVVSALGWGTHSLAPLSFR

SEQ ID NO: 1270141 - protein, 23 aa, Mycobacterium
KRYTGRGMAFLDLIQEGNLGLIR

SEQ ID NO: 1270142 - protein, 25 aa, Mycobacterium
KRYVAKYTICPAVAHGLDGEIGSVE

SEQ ID NO: 1270143 - protein, 17 aa, Mycobacterium
KSAAYRVVEDGADVVDV

SEQ ID NO: 1270144 - protein, 24 aa, Mycobacterium
KSAGIEFPGWEPTTSYLLAEVEIA

SEQ ID NO: 1270145 - protein, 18 aa, Mycobacterium
KSAGLWREVASELADSLR

SEQ ID NO: 1270146 - protein, 18 aa, Mycobacterium
KSAKWKVGEETALRELGR

SEQ ID NO: 1270147 - protein, 19 aa, Mycobacterium
KSAMRSAGTVIGREITRSI

SEQ ID NO: 1270148 - protein, 21 aa, Mycobacterium
KSDLLPYVDFDVDRCTGYARS

SEQ ID NO: 1270149 - protein, 17 aa, Mycobacterium
KSDPTYQAGDPIYVVGF

SEQ ID NO: 1270150 - protein, 18 aa, Mycobacterium
KSDVKRKVRDGGEREMRQ

SEQ ID NO: 1270151 - protein, 24 aa, Mycobacterium
KSEEARKLVAFGMAEVVDGEVLMI

SEQ ID NO: 1270152 - protein, 18 aa, Mycobacterium
KSEFEALGADFGRRGALL

SEQ ID NO: 1270153 - protein, 20 aa, Mycobacterium
KSERYGRVVLLALTDAGRTV

SEQ ID NO: 1270154 - protein, 21 aa, Mycobacterium
KSEVGSRAWAAMYLGTPTTPE

SEQ ID NO: 1270155 - protein, 21 aa, Mycobacterium
KSFGAQRIWEDVTFDLPAGEV

SEQ ID NO: 1270156 - protein, 17 aa, Mycobacterium
KSFWRIDIAPVSRTVMH

SEQ ID NO: 1270157 - protein, 17 aa, Mycobacterium
KSGEGIGSILLGLHRDD

SEQ ID NO: 1270158 - protein, 18 aa, Mycobacterium
KSGFTVGRAVDWKLAATL

SEQ ID NO: 1270159 - protein, 18 aa, Mycobacterium
KSGLELAAQIDRVLAETG

SEQ ID NO: 1270160 - protein, 21 aa, Mycobacterium
KSGLPDALFDEWFRPAVENAA

SEQ ID NO: 1270161 - protein, 18 aa, Mycobacterium
KSGVTIERRRVLAKADAF

SEQ ID NO: 1270162 - protein, 24 aa, Mycobacterium
KSHIIGLMAERWILAGYGVLVVDP

SEQ ID NO: 1270163 - protein, 17 aa, Mycobacterium
KSITFELTGPITRQLHV

SEQ ID NO: 1270164 - protein, 17 aa, Mycobacterium
KSLDWLTSREIAADGPF

SEQ ID NO: 1270165 - protein, 17 aa, Mycobacterium
KSLGVNAIELMPVHHFA

SEQ ID NO: 1270166 - protein, 26 aa, Mycobacterium
KSLPFASSLCGACFDVCPVRIDIPSM

SEQ ID NO: 1270167 - protein, 24 aa, Mycobacterium
KSLRGPRGGLVLATEEYAPAVDKG

SEQ ID NO: 1270168 - protein, 25 aa, Mycobacterium
KSMPYKHGFGPFAPEIYRAPLSYPF

SEQ ID NO: 1270169 - protein, 20 aa, Mycobacterium
KSPAEAAAGLALHDADPAGI

SEQ ID NO: 1270170 - protein, 23 aa, Mycobacterium
KSQLAGWRRAPVVLAPEHGTRPR

SEQ ID NO: 1270171 - protein, 32 aa, Mycobacterium
KSRAAAKTGAGWQPDIWRGFADELGILGATLP

SEQ ID NO: 1270172 - protein, 32 aa, Mycobacterium
KSRAAAKTGLGWQPEIWRAFAEELGILGAALP

SEQ ID NO: 1270173 - protein, 18 aa, Mycobacterium
KSREFADQGNKVYLPVVT

SEQ ID NO: 1270174 - protein, 18 aa, Mycobacterium
KSRGNGIDPLDWVEMFGA

SEQ ID NO: 1270175 - protein, 25 aa, Mycobacterium
KSRNRKGSTWVMSLSDGRLVAADHI

SEQ ID NO: 1270176 - protein, 21 aa, Mycobacterium
KSRRNDVMLLDFDDLLLHTAA

SEQ ID NO: 1270177 - protein, 18 aa, Mycobacterium
KSSLLAMLAGRRSPDSGR

SEQ ID NO: 1270178 - protein, 18 aa, Mycobacterium
KSSVALRGPVTGLLLAAV

SEQ ID NO: 1270179 - protein, 20 aa, Mycobacterium
KSTHFDWVLAPYDVVASKAH

SEQ ID NO: 1270180 - protein, 25 aa, Mycobacterium
KSTLGFLKPRAAIIGHGDVLANPVI

SEQ ID NO: 1270181 - protein, 24 aa, Mycobacterium
KSTLLFPLFAQWFVDGFLRTDPTN

SEQ ID NO: 1270182 - protein, 24 aa, Mycobacterium
KSTLLLEVAHRWASTGRRALYLSG

SEQ ID NO: 1270183 - protein, 24 aa, Mycobacterium
KSTLLLEVAHRWAVSGRRALYLTG

SEQ ID NO: 1270184 - protein, 24 aa, Mycobacterium
KSTLLRLAGRYGVGEHEVDELLRD

SEQ ID NO: 1270185 - protein, 24 aa, Mycobacterium
KSVEEALDILRWAPQSASEPVAKV

SEQ ID NO: 1270186 - protein, 17 aa, Mycobacterium
KSVERFGSPELKDEVMP

SEQ ID NO: 1270187 - protein, 17 aa, Mycobacterium
KSYAWKWAEELASRYPE

SEQ ID NO: 1270188 - protein, 18 aa, Mycobacterium
KTAAFAIPILSKIDTDSR

SEQ ID NO: 1270189 - protein, 20 aa, Mycobacterium
KTAGFAFGRPDYWEPEEDVY

SEQ ID NO: 1270190 - protein, 27 aa, Mycobacterium
KTAHFCSMCGPKFCSMRISHEVQEAMK

SEQ ID NO: 1270191 - protein, 28 aa, Mycobacterium
KTAPRIASLAGRLADWLQMPEAASVSLA

SEQ ID NO: 1270192 - protein, 24 aa, Mycobacterium
KTASSRHPQGWKTVGDIGYLDDEG

SEQ ID NO: 1270193 - protein, 20 aa, Mycobacterium
KTATVIERWVQEYLEATNTL

SEQ ID NO: 1270194 - protein, 37 aa, Mycobacterium
KTDPPVEGAFYWLSNQEVRWRPAEYWEPGTKVQVEVN

SEQ ID NO: 1270195 - protein, 19 aa, Mycobacterium
KTELRIRYSAASFADAGES

SEQ ID NO: 1270196 - protein, 22 aa, Mycobacterium
KTEVQARLWGGQAGVAFDPNYH

SEQ ID NO: 1270197 - protein, 18 aa, Mycobacterium
KTFKRSRGQVWLMPHNPA

SEQ ID NO: 1270198 - protein, 17 aa, Mycobacterium
KTFSWMPDDGVMLLHTI

SEQ ID NO: 1270199 - protein, 22 aa, Mycobacterium
KTGDVLLRYNFPAAGLTDDALR

SEQ ID NO: 1270200 - protein, 20 aa, Mycobacterium
KTGRFAANFADRGVRSGFSA

SEQ ID NO: 1270201 - protein, 17 aa, Mycobacterium
KTHKKLRDILGLLRDAY

SEQ ID NO: 1270202 - protein, 19 aa, Mycobacterium
KTHSIVVAPTLTWNVLDTE

SEQ ID NO: 1270203 - protein, 19 aa, Mycobacterium
KTIAEWHAKVADKCADIAT

SEQ ID NO: 1270204 - protein, 22 aa, Mycobacterium
KTISFAGTDAFVGARDDGQKSN

SEQ ID NO: 1270205 - protein, 19 aa, Mycobacterium
KTKRPAFNPTMRLAEDPVF

SEQ ID NO: 1270206 - protein, 24 aa, Mycobacterium
KTLRGSRTPDRIVFRDQVPTTATG

SEQ ID NO: 1270207 - protein, 21 aa, Mycobacterium
KTMLEKVRRAPALIKVESVVQ

SEQ ID NO: 1270208 - protein, 19 aa, Mycobacterium
KTMQRLVGVLKQLSPGADV

SEQ ID NO: 1270209 - protein, 23 aa, Mycobacterium
KTNRWTVRPGPVAARHWTIEPDL

SEQ ID NO: 1270210 - protein, 24 aa, Mycobacterium
KTNRWTVRPGPVAARHWTIEPDLS

SEQ ID NO: 1270211 - protein, 20 aa, Mycobacterium
KTNSISWLAHRLSVLHDDAN

SEQ ID NO: 1270212 - protein, 19 aa, Mycobacterium
KTNWLGEPEKPLTAADYSR

SEQ ID NO: 1270213 - protein, 24 aa, Mycobacterium
KTPCSISRLTLMSIRSRHHGAEEY

SEQ ID NO: 1270214 - protein, 17 aa, Mycobacterium
KTPRFAGPATFARLPRL

SEQ ID NO: 1270215 - protein, 19 aa, Mycobacterium
KTRFVEAMAHDLGRELITV

SEQ ID NO: 1270216 - protein, 26 aa, Mycobacterium
KTRIAWLDSKHSFSFGSHYEPDNTHH

SEQ ID NO: 1270217 - protein, 23 aa, Mycobacterium
KTRLEGLKERHPLVGTVHGFGLY

SEQ ID NO: 1270218 - protein, 20 aa, Mycobacterium
KTRTAHLLRFTKIVDDIVDK

SEQ ID NO: 1270219 - protein, 20 aa, Mycobacterium
KTSGSRGFHIYARIHRRWPF

SEQ ID NO: 1270220 - protein, 18 aa, Mycobacterium
KTTLMRCIVGTQIVAGGS

SEQ ID NO: 1270221 - protein, 19 aa, Mycobacterium
KTTTLRCIAGLETPDQGRV

SEQ ID NO: 1270222 - protein, 20 aa, Mycobacterium
KTTWDKLFIGGQWVAPSTSD

SEQ ID NO: 1270223 - protein, 20 aa, Mycobacterium
KTTWMSGCHSWYLTADGFNA

SEQ ID NO: 1270224 - protein, 17 aa, Mycobacterium
KTVDPYYGTSFYTIDFS

SEQ ID NO: 1270225 - protein, 18 aa, Mycobacterium
KTVESFAAKADRRSGDGK

SEQ ID NO: 1270226 - protein, 25 aa, Mycobacterium
KTVLVRPAPVPGYRGTRSPGLPEFD

SEQ ID NO: 1270227 - protein, 32 aa, Mycobacterium
KTVPIPEYLGACYDAGLAWVHFPEGLGGLGVS

SEQ ID NO: 1270228 - protein, 17 aa, Mycobacterium
KTVRAFVEREVLPHAGE

SEQ ID NO: 1270229 - protein, 18 aa, Mycobacterium
KTVWGVGIATSITTASLR

SEQ ID NO: 1270230 - protein, 18 aa, Mycobacterium
KTWEKFEVPDEGIGCGFT

SEQ ID NO: 1270231 - protein, 21 aa, Mycobacterium
KTWELGDGWAKHATVEVALGT

SEQ ID NO: 1270232 - protein, 23 aa, Mycobacterium
KTYPGMYVPNALSFRMVDVDSSP

SEQ ID NO: 1270233 - protein, 26 aa, Mycobacterium
KTYRAARLIRALVCAGQRVGVTALSH

SEQ ID NO: 1270234 - protein, 20 aa, Mycobacterium
KTYSDFRRTTALGRAATAVW

SEQ ID NO: 1270235 - protein, 22 aa, Mycobacterium
KVADGRVAGVHFLMKKNKITEI

SEQ ID NO: 1270236 - protein, 24 aa, Mycobacterium
KVADSLKEFSIRAVDGSQSTAEAF

SEQ ID NO: 1270237 - protein, 20 aa, Mycobacterium
KVAPALAAGCTMVMKPSEVT

SEQ ID NO: 1270238 - protein, 23 aa, Mycobacterium
KVARFVFGLARRYGPRFFEAGDL

SEQ ID NO: 1270239 - protein, 24 aa, Mycobacterium
KVARVGIVLMRVFAGFSESAGGTY

SEQ ID NO: 1270240 - protein, 17 aa, Mycobacterium
KVAYRFLDFSTERDGIA

SEQ ID NO: 1270241 - protein, 20 aa, Mycobacterium
KVCPSCNGAGVISRNQGAFG

SEQ ID NO: 1270242 - protein, 24 aa, Mycobacterium
KVDRSAAYAMRWVAKNVVAAGLAQ

SEQ ID NO: 1270243 - protein, 24 aa, Mycobacterium
KVDWIRRLAAKQGRQVRFGIRLHV

SEQ ID NO: 1270244 - protein, 23 aa, Mycobacterium
KVEAPQGDPLRCWSASGAGAESG

SEQ ID NO: 1270245 - protein, 24 aa, Mycobacterium
KVEELKALWFAEAAKYNGLPLGDL

SEQ ID NO: 1270246 - protein, 19 aa, Mycobacterium
KVEFFPGLFAEDVRQNATL

SEQ ID NO: 1270247 - protein, 17 aa, Mycobacterium
KVFESVLAGHVKVLVGS

SEQ ID NO: 1270248 - protein, 18 aa, Mycobacterium
KVFLELGGKSAFLVIDDA

SEQ ID NO: 1270249 - protein, 21 aa, Mycobacterium
KVFQRTPGWVLPRLDLPMPAA

SEQ ID NO: 1270250 - protein, 21 aa, Mycobacterium
KVFRRSVARPVHYVPTAAGFG

SEQ ID NO: 1270251 - protein, 19 aa, Mycobacterium
KVGDALPAHHTRLSRGDLV

SEQ ID NO: 1270252 - protein, 18 aa, Mycobacterium
KVGDRFAGVSWAELPSGG

SEQ ID NO: 1270253 - protein, 35 aa, Mycobacterium
KVGFERKYQGSGVYRCGVCGTPVITHMSSGGSPNR

SEQ ID NO: 1270254 - protein, 19 aa, Mycobacterium
KVGGPFEGATLLLLHTTGA

SEQ ID NO: 1270255 - protein, 28 aa, Mycobacterium
KVGLYCRNRIEIVIAMLGIVKAGAILVN

SEQ ID NO: 1270256 - protein, 19 aa, Mycobacterium
KVGSLAGRSAVLVGAGSMG

SEQ ID NO: 1270257 - protein, 18 aa, Mycobacterium
KVGVRRGKIVTVRPEDDH

SEQ ID NO: 1270258 - protein, 27 aa, Mycobacterium
KVGYEIPFTRHFYRYVAPRPLEEIQKD

SEQ ID NO: 1270259 - protein, 18 aa, Mycobacterium
KVIAARSSIMSRLAGQGA

SEQ ID NO: 1270260 - protein, 19 aa, Mycobacterium
KVLEDLGWYVADNLPPELI

SEQ ID NO: 1270261 - protein, 21 aa, Mycobacterium
KVLGCDAVVLAARIAALLKGI

SEQ ID NO: 1270262 - protein, 22 aa, Mycobacterium
KVLGYRNWLGLNRGDLAEEVSK

SEQ ID NO: 1270263 - protein, 25 aa, Mycobacterium
KVLHLKGAFHGRSGYTLSLTNTDPN

SEQ ID NO: 1270264 - protein, 19 aa, Mycobacterium
KVLKEFERDGLIAVGYAEI

SEQ ID NO: 1270265 - protein, 24 aa, Mycobacterium
KVLRGVGLRLMVPDQHWTKVLQFV

SEQ ID NO: 1270266 - protein, 18 aa, Mycobacterium
KVLRVVALSGGYGRDEAC

SEQ ID NO: 1270267 - protein, 19 aa, Mycobacterium
KVPGALKWIEDRRENLMSA

SEQ ID NO: 1270268 - protein, 20 aa, Mycobacterium
KVPRSITVLGELPRGSTGKI

SEQ ID NO: 1270269 - protein, 20 aa, Mycobacterium
KVPRYVEFLDELPLNATGKV

SEQ ID NO: 1270270 - protein, 36 aa, Mycobacterium
KVPYYRVLELAPWLSWPRPNFPVSNFFHGGAAPLNA

SEQ ID NO: 1270271 - protein, 19 aa, Mycobacterium
KVQEARASLSKVTPIKGDT

SEQ ID NO: 1270272 - protein, 24 aa, Mycobacterium
KVQGPKWAALVARSATAEGGTKPN

SEQ ID NO: 1270273 - protein, 23 aa, Mycobacterium
KVREGAADLVQWSSGRVAAVAPI

SEQ ID NO: 1270274 - protein, 19 aa, Mycobacterium
KVRFFGNVRRYGMVSPTVF

SEQ ID NO: 1270275 - protein, 19 aa, Mycobacterium
KVRSGWDDLVLAGGVESMS

SEQ ID NO: 1270276 - protein, 20 aa, Mycobacterium
KVVAAEGAFHGRTMGSLALT

SEQ ID NO: 1270277 - protein, 29 aa, Mycobacterium
KVVGESMIDAAICDGDWVVVRQQSVADNG

SEQ ID NO: 1270278 - protein, 25 aa, Mycobacterium
KVWTSLAHLCEWGLATVRTDPDAPK

SEQ ID NO: 1270279 - protein, 19 aa, Mycobacterium
KWDGFRALVFRDGGPGRDN

SEQ ID NO: 1270280 - protein, 30 aa, Mycobacterium
KWHLLVSSWLELPGRPSLVGSRGPDNKPYA

SEQ ID NO: 1270281 - protein, 23 aa, Mycobacterium
KWRITFDGFCVRSSYDEMRTGLL

SEQ ID NO: 1270282 - protein, 21 aa, Mycobacterium
KWSPEGWVQIAGRVVDDGQRQ

SEQ ID NO: 1270283 - protein, 24 aa, Mycobacterium
KYAADVDGVLAWAGEARDRLAALD

SEQ ID NO: 1270284 - protein, 28 aa, Mycobacterium
KYCTDPDFAGCFFVNIATEFRDPDHRAV

SEQ ID NO: 1270285 - protein, 17 aa, Mycobacterium
KYDMSFAAVQKHVAVLD

SEQ ID NO: 1270286 - protein, 26 aa, Mycobacterium
KYEALLMESMRLFNLKGYRDTSMEDI

SEQ ID NO: 1270287 - protein, 21 aa, Mycobacterium
KYGLRPRIRFATTVRSADFDE

SEQ ID NO: 1270288 - protein, 18 aa, Mycobacterium
KYLGTPYPNFTGRPEIRV

SEQ ID NO: 1270289 - protein, 19 aa, Mycobacterium
KYLRIAGAMQRENMAITSG

SEQ ID NO: 1270290 - protein, 19 aa, Mycobacterium
KYLTGCADLFRDGYTDVVQ

SEQ ID NO: 1270291 - protein, 22 aa, Mycobacterium
KYSAPPIPLWVLQADVCDALTL

SEQ ID NO: 1270292 - protein, 17 aa, Mycobacterium
KYSLSRRVARFATEHAW

SEQ ID NO: 1270293 - protein, 26 aa, Mycobacterium
KYSNVTICVGGGIGTPERAAEYLSGE

SEQ ID NO: 1270294 - protein, 22 aa, Mycobacterium
KYSTSLRRLLGIRSEQALELFH

SEQ ID NO: 1270295 - protein, 18 aa, Mycobacterium
LAAAAGAPCVPVIDCDAT

SEQ ID NO: 1270296 - protein, 21 aa, Mycobacterium
LAAACSRALISQEMSAHAIRR

SEQ ID NO: 1270297 - protein, 22 aa, Mycobacterium
LAAAEAEFWAAPDFSQTAMPQP

SEQ ID NO: 1270298 - protein, 23 aa, Mycobacterium
LAAAELRTAPAIVGLDSRRPHDV

SEQ ID NO: 1270299 - protein, 28 aa, Mycobacterium
LAAAGVVRPDLVIGWWAVPTILEHGSPE

SEQ ID NO: 1270300 - protein, 19 aa, Mycobacterium
LAAALAWTPGVDMSREVVL

SEQ ID NO: 1270301 - protein, 24 aa, Mycobacterium
LAAALEAINGWAVHQPEDWWTPQP

SEQ ID NO: 1270302 - protein, 24 aa, Mycobacterium
LAAARPDLVSGLVLLDPAVDLDGE

SEQ ID NO: 1270303 - protein, 18 aa, Mycobacterium
LAAARRYPNSSARLNTAL

SEQ ID NO: 1270304 - protein, 18 aa, Mycobacterium
LAAARTRVGDGLLSLPWD

SEQ ID NO: 1270305 - protein, 18 aa, Mycobacterium
LAACAIAPEEARSGISYA

SEQ ID NO: 1270306 - protein, 17 aa, Mycobacterium
LAADGAWVRYDGEGRPP

SEQ ID NO: 1270307 - protein, 17 aa, Mycobacterium
LAADMLGALDWAQLGPL

SEQ ID NO: 1270308 - protein, 27 aa, Mycobacterium
LAADVAELVVSLGYRCQVATKAVKGRT

SEQ ID NO: 1270309 - protein, 25 aa, Mycobacterium
LAADVKWTIVGGMVLEGADAVRRTC

SEQ ID NO: 1270310 - protein, 17 aa, Mycobacterium
LAADWRVSGDNVKFGAT

SEQ ID NO: 1270311 - protein, 20 aa, Mycobacterium
LAAECERLGVEWAPPVAALT

SEQ ID NO: 1270312 - protein, 17 aa, Mycobacterium
LAAEDGVGLHLPTLWQP

SEQ ID NO: 1270313 - protein, 18 aa, Mycobacterium
LAAEHARELFGAPYAYAQ

SEQ ID NO: 1270314 - protein, 18 aa, Mycobacterium
LAAELAGFGIRVTIVEPG

SEQ ID NO: 1270315 - protein, 18 aa, Mycobacterium
LAAEPVYKPNLTLRGMET

SEQ ID NO: 1270316 - protein, 18 aa, Mycobacterium
LAAESVFSVNAAFAGALE

SEQ ID NO: 1270317 - protein, 23 aa, Mycobacterium
LAAEYKKLVLAMLQRREAWQIVD

SEQ ID NO: 1270318 - protein, 18 aa, Mycobacterium
LAAFGDRDYWLARLAAYG

SEQ ID NO: 1270319 - protein, 27 aa, Mycobacterium
LAAFPRYHPRWAWGLTKVPGLREFLVS

SEQ ID NO: 1270320 - protein, 26 aa, Mycobacterium
LAAGALTRSALRWNYRRILPDVYVPA

SEQ ID NO: 1270321 - protein, 17 aa, Mycobacterium
LAAGCTVVLKSAPDTPL

SEQ ID NO: 1270322 - protein, 21 aa, Mycobacterium
LAAGEIKACWIICTNPVATMP

SEQ ID NO: 1270323 - protein, 17 aa, Mycobacterium
LAAGGARVVLAVRDTEK

SEQ ID NO: 1270324 - protein, 19 aa, Mycobacterium
LAAGGKCFYTTPIKALSNQ

SEQ ID NO: 1270325 - protein, 23 aa, Mycobacterium
LAAGLKLPLVLVIDTAGPALSTE

SEQ ID NO: 1270326 - protein, 19 aa, Mycobacterium
LAAHLKALIAPGTVVCAFI

SEQ ID NO: 1270327 - protein, 24 aa, Mycobacterium
LAAHLRPWVPVVSLVKGLEQGTNY

SEQ ID NO: 1270328 - protein, 19 aa, Mycobacterium
LAAHRHGAQMADAWMIACS

SEQ ID NO: 1270329 - protein, 20 aa, Mycobacterium
LAAHRRGRRVVLLSKASETA

SEQ ID NO: 1270330 - protein, 18 aa, Mycobacterium
LAAIRARGGTTLCQSPDD

SEQ ID NO: 1270331 - protein, 18 aa, Mycobacterium
LAAKYLPAGVLNVVTGDR

SEQ ID NO: 1270332 - protein, 21 aa, Mycobacterium
LAALAHHWNIPQARPHDALDD

SEQ ID NO: 1270333 - protein, 21 aa, Mycobacterium
LAALAPRPGGLLWDVGAGSGS

SEQ ID NO: 1270334 - protein, 20 aa, Mycobacterium
LAALLLSRFDIVLLDEPTND

SEQ ID NO: 1270335 - protein, 18 aa, Mycobacterium
LAALPERERTVLALRFFE

SEQ ID NO: 1270336 - protein, 18 aa, Mycobacterium
LAALRPGDIITITAGRRG

SEQ ID NO: 1270337 - protein, 32 aa, Mycobacterium
LAALSMPILFPRNAEEIIAFGMYGIALSRASG

SEQ ID NO: 1270338 - protein, 17 aa, Mycobacterium
LAALVLLHDSRRATRTD

SEQ ID NO: 1270339 - protein, 17 aa, Mycobacterium
LAALVTVLAGAGGGAAG

SEQ ID NO: 1270340 - protein, 26 aa, Mycobacterium
LAAPDKLRIANLYDYSVALVSASEIT

SEQ ID NO: 1270341 - protein, 20 aa, Mycobacterium
LAAPGSCWAVCPPRRNCTPT

SEQ ID NO: 1270342 - protein, 21 aa, Mycobacterium
LAAPYPGFLVKRAKKMVLDIA

SEQ ID NO: 1270343 - protein, 17 aa, Mycobacterium
LAAQGVRANTVSPGNTY

SEQ ID NO: 1270344 - protein, 18 aa, Mycobacterium
LAAQRGVTVRELWASASQ

SEQ ID NO: 1270345 - protein, 29 aa, Mycobacterium
LAARLPASLRRGRVRPLGLDRYGVQLRVE

SEQ ID NO: 1270346 - protein, 22 aa, Mycobacterium
LAARLRPVIERLALATGETVDL

SEQ ID NO: 1270347 - protein, 24 aa, Mycobacterium
LAARMPCAYANPGVFVAGRPLVQG

SEQ ID NO: 1270348 - protein, 23 aa, Mycobacterium
LAARNLLPVPWVEPVDVANAVCF

SEQ ID NO: 1270349 - protein, 21 aa, Mycobacterium
LAARSVGSCWIGSTIFAPDLV

SEQ ID NO: 1270350 - protein, 20 aa, Mycobacterium
LAARTSRIDLGLLVTGVTYR

SEQ ID NO: 1270351 - protein, 30 aa, Mycobacterium
LAASLAGLAWLQARMGRFAECRVNAAEARQ

SEQ ID NO: 1270352 - protein, 25 aa, Mycobacterium
LAASRWADLRPALKDQIATRIELRL

SEQ ID NO: 1270353 - protein, 26 aa, Mycobacterium
LAASSRPLYPWPLALARDTEPRRTTA

SEQ ID NO: 1270354 - protein, 23 aa, Mycobacterium
LAASSRRSAWWAGTATLGVAKIV

SEQ ID NO: 1270355 - protein, 17 aa, Mycobacterium
LAATCPPQLKTAHDGKG

SEQ ID NO: 1270356 - protein, 20 aa, Mycobacterium
LAAVAWRQPGIVFFKYLLGM

SEQ ID NO: 1270357 - protein, 17 aa, Mycobacterium
LAAVLDSGMLWITTLGR

SEQ ID NO: 1270358 - protein, 19 aa, Mycobacterium
LAAVPVERAHTWVGVAGTM

SEQ ID NO: 1270359 - protein, 20 aa, Mycobacterium
LAAVRILASRVVVLHHGRIV

SEQ ID NO: 1270360 - protein, 18 aa, Mycobacterium
LAAYELLRVEGSDPVLLL

SEQ ID NO: 1270361 - protein, 24 aa, Mycobacterium
LAAYRWPIQSEVDWVLTTAAVAGD

SEQ ID NO: 1270362 - protein, 25 aa, Mycobacterium
LACARLGAVHSVVFGGFAPHELAVR

SEQ ID NO: 1270363 - protein, 24 aa, Mycobacterium
LACGARGACRACRTCGAVSDGIRA

SEQ ID NO: 1270364 - protein, 17 aa, Mycobacterium
LACQSLRSGDSELALAA

SEQ ID NO: 1270365 - protein, 18 aa, Mycobacterium
LACYVLDPRLKSSSGPRR

SEQ ID NO: 1270366 - protein, 18 aa, Mycobacterium
LADAARKSWELNINALRQ

SEQ ID NO: 1270367 - protein, 17 aa, Mycobacterium
LADACQRGGSTLFGSGV

SEQ ID NO: 1270368 - protein, 26 aa, Mycobacterium
LADAGYLVSRRGRYGGTFIADALPAP

SEQ ID NO: 1270369 - protein, 23 aa, Mycobacterium
LADAIDRPVMWTIAALLGQHPIP

SEQ ID NO: 1270370 - protein, 21 aa, Mycobacterium
LADALVALGSGWGRGGDTGAA

SEQ ID NO: 1270371 - protein, 17 aa, Mycobacterium
LADAVAEHMSPPMPLIG

SEQ ID NO: 1270372 - protein, 17 aa, Mycobacterium
LADAVAVASRIRDEVAA

SEQ ID NO: 1270373 - protein, 18 aa, Mycobacterium
LADEVARLVAAARAGTLK

SEQ ID NO: 1270374 - protein, 19 aa, Mycobacterium
LADFTHPGLDRILQWDLRF

SEQ ID NO: 1270375 - protein, 17 aa, Mycobacterium
LADGEARVVDLIGELGL

SEQ ID NO: 1270376 - protein, 23 aa, Mycobacterium
LADGRHWDLLAGRPVTGGDRDDL

SEQ ID NO: 1270377 - protein, 18 aa, Mycobacterium
LADGRWATLMKIHHCIAD

SEQ ID NO: 1270378 - protein, 21 aa, Mycobacterium
LADGVVRPVMFMAYSGEARWR

SEQ ID NO: 1270379 - protein, 24 aa, Mycobacterium
LADIAEAPIDWAFAGPADGLNLEL

SEQ ID NO: 1270380 - protein, 20 aa, Mycobacterium
LADLAIWLEQVIRGGTHVFI

SEQ ID NO: 1270381 - protein, 20 aa, Mycobacterium
LADLCRRYGARLLLDGAHSP

SEQ ID NO: 1270382 - protein, 25 aa, Mycobacterium
LADLERRVAGFLGFTDIFTSVGQVY

SEQ ID NO: 1270383 - protein, 17 aa, Mycobacterium
LADLGARRLVLVSRSGI

SEQ ID NO: 1270384 - protein, 29 aa, Mycobacterium
LADLKDWRLRIAKEMNVPAYVVFTDNTLI

SEQ ID NO: 1270385 - protein, 17 aa, Mycobacterium
LADMGARTIVAVSRNPG

SEQ ID NO: 1270386 - protein, 17 aa, Mycobacterium
LADMPWRDADVVGAPVE

SEQ ID NO: 1270387 - protein, 19 aa, Mycobacterium
LADMRSGRMSDDDWTRLAR

SEQ ID NO: 1270388 - protein, 18 aa, Mycobacterium
LADPHFWTMTGSVRVAQL

SEQ ID NO: 1270389 - protein, 23 aa, Mycobacterium
LADPLRTRLVLVARAQRSTLAEI

SEQ ID NO: 1270390 - protein, 19 aa, Mycobacterium
LADPSHCRGVVAETVKQLG

SEQ ID NO: 1270391 - protein, 17 aa, Mycobacterium
LADRFGLGPSDVCYLSM

SEQ ID NO: 1270392 - protein, 19 aa, Mycobacterium
LADRFRIVAYDTRGAGNSG

SEQ ID NO: 1270393 - protein, 17 aa, Mycobacterium
LADRGRIAVGYKADLNV

SEQ ID NO: 1270394 - protein, 17 aa, Mycobacterium
LADRPGALLRQLILVGQ

SEQ ID NO: 1270395 - protein, 34 aa, Mycobacterium
LADRYPRWWQAPLRWAFRGALGARASLVVRNSRR

SEQ ID NO: 1270396 - protein, 18 aa, Mycobacterium
LADTGQRLQDGLSGVDLE

SEQ ID NO: 1270397 - protein, 25 aa, Mycobacterium
LADTWRERFEEMLKRAEARLNEKDS

SEQ ID NO: 1270398 - protein, 28 aa, Mycobacterium
LADVLPRRPTFALLKGRGNYLCLNKIHN

SEQ ID NO: 1270399 - protein, 18 aa, Mycobacterium
LAEAALRHQDSWEGFVWF

SEQ ID NO: 1270400 - protein, 21 aa, Mycobacterium
LAEAARLGFTTAVVPPGTTGV

SEQ ID NO: 1270401 - protein, 18 aa, Mycobacterium
LAEAERWLAPNLGYNPED

SEQ ID NO: 1270402 - protein, 18 aa, Mycobacterium
LAEAGAKWIVDLGPSDTV

SEQ ID NO: 1270403 - protein, 23 aa, Mycobacterium
LAEALDHLLTWGVLDVPVTLVPA

SEQ ID NO: 1270404 - protein, 20 aa, Mycobacterium
LAEANCLVIVPSEAEQIRTG

SEQ ID NO: 1270405 - protein, 20 aa, Mycobacterium
LAEELTRSWLSQWPALPEAM

SEQ ID NO: 1270406 - protein, 20 aa, Mycobacterium
LAEGITWQWESFPEYLDAIE

SEQ ID NO: 1270407 - protein, 25 aa, Mycobacterium
LAEGRPGPVSALFFDLDRLKAINDY

SEQ ID NO: 1270408 - protein, 21 aa, Mycobacterium
LAEGSPYHGVVSFEAPTGKRL

SEQ ID NO: 1270409 - protein, 20 aa, Mycobacterium
LAEGYPAPGVVPAHDGACGS

SEQ ID NO: 1270410 - protein, 24 aa, Mycobacterium
LAEHPRVLSSLAMGLPDDDLGQVP

SEQ ID NO: 1270411 - protein, 18 aa, Mycobacterium
LAEIDARHGGSVIDAQIA

SEQ ID NO: 1270412 - protein, 21 aa, Mycobacterium
LAELHHQWHALGLTRLSILDS

SEQ ID NO: 1270413 - protein, 23 aa, Mycobacterium
LAELLSQCCTMTLDGRGVPMDYE

SEQ ID NO: 1270414 - protein, 25 aa, Mycobacterium
LAELRKSEPVHWVDVPGGTGGFGDR

SEQ ID NO: 1270415 - protein, 20 aa, Mycobacterium
LAEPFGATTMGLIYVNPEGP

SEQ ID NO: 1270416 - protein, 21 aa, Mycobacterium
LAEQCRRLDALGVDYEIVPGV

SEQ ID NO: 1270417 - protein, 18 aa, Mycobacterium
LAERAALYRDLVMAGRSH

SEQ ID NO: 1270418 - protein, 24 aa, Mycobacterium
LAERDFPATGVRFFASARSAGKKL

SEQ ID NO: 1270419 - protein, 17 aa, Mycobacterium
LAERFARQRLHALARVE

SEQ ID NO: 1270420 - protein, 18 aa, Mycobacterium
LAERIPGAHAVPVDAGHA

SEQ ID NO: 1270421 - protein, 21 aa, Mycobacterium
LAERTAALGVRVLRYGSAGGR

SEQ ID NO: 1270422 - protein, 18 aa, Mycobacterium
LAERYLQGRVSAQVVSKI

SEQ ID NO: 1270423 - protein, 17 aa, Mycobacterium
LAETKRRLAALRDTDTG

SEQ ID NO: 1270424 - protein, 25 aa, Mycobacterium
LAETPIRSIMAFQLFIAGETLGALN

SEQ ID NO: 1270425 - protein, 24 aa, Mycobacterium
LAETVPGCIGALMHSGQGCALTTR

SEQ ID NO: 1270426 - protein, 19 aa, Mycobacterium
LAEVAELYLQVAGMDGAEV

SEQ ID NO: 1270427 - protein, 18 aa, Mycobacterium
LAEVCDRLGVTTGSFYHY

SEQ ID NO: 1270428 - protein, 26 aa, Mycobacterium
LAEVGRPDIMIVVGGVIPPGDFDELY

SEQ ID NO: 1270429 - protein, 21 aa, Mycobacterium
LAEVVARGVAEFGRLDFVLAN

SEQ ID NO: 1270430 - protein, 17 aa, Mycobacterium
LAEVVIHGWDVAVATGQ

SEQ ID NO: 1270431 - protein, 17 aa, Mycobacterium
LAFASGIHVCLGAALAR

SEQ ID NO: 1270432 - protein, 23 aa, Mycobacterium
LAFDAADVAARWPVPGPTDDKYT

SEQ ID NO: 1270433 - protein, 17 aa, Mycobacterium
LAFGCGEHSCLGAQLAR

SEQ ID NO: 1270434 - protein, 27 aa, Mycobacterium
LAFLHPLPVRRLWGVGAKTADKLRVHG

SEQ ID NO: 1270435 - protein, 33 aa, Mycobacterium
LAFTGLKVPFFTDGIPPFFLTPGLDVERSEFEG

SEQ ID NO: 1270436 - protein, 25 aa, Mycobacterium
LAGAAVGLGALWLAGPAAAQPDAPP

SEQ ID NO: 1270437 - protein, 24 aa, Mycobacterium
LAGACGRLGLVTGLLDPAPERPWL

SEQ ID NO: 1270438 - protein, 27 aa, Mycobacterium
LAGAFLRAGVIDRILAYVAPILLGGPI

SEQ ID NO: 1270439 - protein, 19 aa, Mycobacterium
LAGDLRRVTGMDRRLAEAA

SEQ ID NO: 1270440 - protein, 21 aa, Mycobacterium
LAGEIRSAFAMTEPAVASSDA

SEQ ID NO: 1270441 - protein, 21 aa, Mycobacterium
LAGELGRWVMRSACADFAGWR

SEQ ID NO: 1270442 - protein, 31 aa, Mycobacterium
LAGETGCRIVLPEGWNPFVTLFSESAGRVLV

SEQ ID NO: 1270443 - protein, 24 aa, Mycobacterium
LAGEVVKWWLPDDVVFVDELPHTA

SEQ ID NO: 1270444 - protein, 18 aa, Mycobacterium
LAGFDAWLDSWRALGRDG

SEQ ID NO: 1270445 - protein, 24 aa, Mycobacterium
LAGFSDICVAAFAGFAVVKPQVAF

SEQ ID NO: 1270446 - protein, 23 aa, Mycobacterium
LAGGLPPGVLALVHGDGVAGAAV

SEQ ID NO: 1270447 - protein, 19 aa, Mycobacterium
LAGGLPVHVVAAWHGHDPA

SEQ ID NO: 1270448 - protein, 18 aa, Mycobacterium
LAGGRWALAVKMSPVLSG

SEQ ID NO: 1270449 - protein, 28 aa, Mycobacterium
LAGGSTPAWIRACGDLRQALEQVQPALV

SEQ ID NO: 1270450 - protein, 30 aa, Mycobacterium
LAGHLRPGYDYLICRKLSVFWRHMPPGLLA

SEQ ID NO: 1270451 - protein, 22 aa, Mycobacterium
LAGIAWETGVLLGICDESPDAG

SEQ ID NO: 1270452 - protein, 24 aa, Mycobacterium
LAGIESYAPLMAYLVRSIEDGQSL

SEQ ID NO: 1270453 - protein, 17 aa, Mycobacterium
LAGIGFPGVKLTERWLL

SEQ ID NO: 1270454 - protein, 18 aa, Mycobacterium
LAGIKRISRRAMSAPSSG

SEQ ID NO: 1270455 - protein, 19 aa, Mycobacterium
LAGILAEVSAPVIVVGLGL

SEQ ID NO: 1270456 - protein, 18 aa, Mycobacterium
LAGLGVNRLIRFAATRDL

SEQ ID NO: 1270457 - protein, 21 aa, Mycobacterium
LAGNKARWGGFEGVPNTGADP

SEQ ID NO: 1270458 - protein, 17 aa, Mycobacterium
LAGPLVRSSYRAGKLYA

SEQ ID NO: 1270459 - protein, 18 aa, Mycobacterium
LAGPLVRSSYRAGKLYRQ

SEQ ID NO: 1270460 - protein, 19 aa, Mycobacterium
LAGQRCADAGMTLRIPRPR

SEQ ID NO: 1270461 - protein, 19 aa, Mycobacterium
LAGRAMRRIGAVEFATTIA

SEQ ID NO: 1270462 - protein, 23 aa, Mycobacterium
LAGRETFGGVSIHSAEWDPALSL

SEQ ID NO: 1270463 - protein, 21 aa, Mycobacterium
LAGRLPEVWPDRLAGHRHALA

SEQ ID NO: 1270464 - protein, 20 aa, Mycobacterium
LAGRLVDVTLWLAGRPDLAV

SEQ ID NO: 1270465 - protein, 21 aa, Mycobacterium
LAGRRALVTGGSRGIGAEIVR

SEQ ID NO: 1270466 - protein, 26 aa, Mycobacterium
LAGRRNACLNLKMAMLGRADEPPYFV

SEQ ID NO: 1270467 - protein, 24 aa, Mycobacterium
LAGSAKRRFWWAGTATLGVAKIIE

SEQ ID NO: 1270468 - protein, 24 aa, Mycobacterium
LAGSGREGLGWTLGELTRTRFIAL

SEQ ID NO: 1270469 - protein, 18 aa, Mycobacterium
LAGSRLLVHESVADALVE

SEQ ID NO: 1270470 - protein, 18 aa, Mycobacterium
LAGSRLYVQREIYDEFLS

SEQ ID NO: 1270471 - protein, 20 aa, Mycobacterium
LAGTGLRYGEKAKDVIATAT

SEQ ID NO: 1270472 - protein, 17 aa, Mycobacterium
LAGTPAETLPRSRRVDV

SEQ ID NO: 1270473 - protein, 18 aa, Mycobacterium
LAGTRTGVFLGLSTHEFL

SEQ ID NO: 1270474 - protein, 19 aa, Mycobacterium
LAGWGNKRIEAEAKTIAAR

SEQ ID NO: 1270475 - protein, 20 aa, Mycobacterium
LAGYACAIEAHYGRPMDMEW

SEQ ID NO: 1270476 - protein, 23 aa, Mycobacterium
LAGYEQFAPWLLVQKRGNVHVVS

SEQ ID NO: 1270477 - protein, 24 aa, Mycobacterium
LAGYKQPRRFVFREEFPLGPAGKI

SEQ ID NO: 1270478 - protein, 19 aa, Mycobacterium
LAGYVADLESAYGPDQAHD

SEQ ID NO: 1270479 - protein, 22 aa, Mycobacterium
LAHAVGAKFGIAHGRANAIFLP

SEQ ID NO: 1270480 - protein, 18 aa, Mycobacterium
LAHGYARNQMTAYVELQE

SEQ ID NO: 1270481 - protein, 17 aa, Mycobacterium
LAHIACVAILQGRAPTP

SEQ ID NO: 1270482 - protein, 28 aa, Mycobacterium
LAHLLKFDSILGRLPYDVSLEGEDTIVV

SEQ ID NO: 1270483 - protein, 17 aa, Mycobacterium
LAHLPSDRPIVVHCAGG

SEQ ID NO: 1270484 - protein, 17 aa, Mycobacterium
LAHLRSGRVQLVVVGGG

SEQ ID NO: 1270485 - protein, 24 aa, Mycobacterium
LAHRISPRPEMWVRRVQGADVIEE

SEQ ID NO: 1270486 - protein, 24 aa, Mycobacterium
LAHSLREVVTRAGVDPAEVDDVIA

SEQ ID NO: 1270487 - protein, 35 aa, Mycobacterium
LAHTEFPYVFCDATFCKARIGAHVVSQALVVATGV

SEQ ID NO: 1270488 - protein, 19 aa, Mycobacterium
LAHTFGVAEDVVFTDGVPG

SEQ ID NO: 1270489 - protein, 23 aa, Mycobacterium
LAHTVSGWVRRTLDVGDIAVDAV

SEQ ID NO: 1270490 - protein, 25 aa, Mycobacterium
LAHVGRITFGWGPRDLRKLVLTETP

SEQ ID NO: 1270491 - protein, 19 aa, Mycobacterium
LAHVPRWTDYFWSTDQTSS

SEQ ID NO: 1270492 - protein, 21 aa, Mycobacterium
LAHWREIGVTEVLFGLPDKSE

SEQ ID NO: 1270493 - protein, 21 aa, Mycobacterium
LAIACLRANGLAASYASGYLA

SEQ ID NO: 1270494 - protein, 23 aa, Mycobacterium
LAIELGRSGARVAISDVDTEGLA

SEQ ID NO: 1270495 - protein, 25 aa, Mycobacterium
LAIEPGELVALLGPSGCGKTTTLRM

SEQ ID NO: 1270496 - protein, 30 aa, Mycobacterium
LAIERRVVAELTRLTGIGVHGEEFGGESVE

SEQ ID NO: 1270497 - protein, 18 aa, Mycobacterium
LAILRPFLTRTLGTTAGS

SEQ ID NO: 1270498 - protein, 19 aa, Mycobacterium
LAIRGFEFGLAMGLTRAAQ

SEQ ID NO: 1270499 - protein, 25 aa, Mycobacterium
LAIRRPHRVAGLVLVNTGGFLPINP

SEQ ID NO: 1270500 - protein, 17 aa, Mycobacterium
LAISAAHRALATELVAL

SEQ ID NO: 1270501 - protein, 19 aa, Mycobacterium
LAISCAMWVGMGRMLRTLD

SEQ ID NO: 1270502 - protein, 18 aa, Mycobacterium
LAITSPYLDPGEREGFNE

SEQ ID NO: 1270503 - protein, 27 aa, Mycobacterium
LAIVRRLADGEARVVDLIGELGLAQST

SEQ ID NO: 1270504 - protein, 19 aa, Mycobacterium
LAKEAGVRRFLYASTCSVY

SEQ ID NO: 1270505 - protein, 18 aa, Mycobacterium
LAKLPERQRLVVTMRDVL

SEQ ID NO: 1270506 - protein, 18 aa, Mycobacterium
LAKMPKRRRTRAADTAAR

SEQ ID NO: 1270507 - protein, 18 aa, Mycobacterium
LAKMPKRRRTRAAEEAAR

SEQ ID NO: 1270508 - protein, 18 aa, Mycobacterium
LAKRSDIVLQCFRGKAAE

SEQ ID NO: 1270509 - protein, 22 aa, Mycobacterium
LAKRTSVLFRFRELLNERKGEL

SEQ ID NO: 1270510 - protein, 27 aa, Mycobacterium
LAKSIDFRPRKSFGQNFVHDANTVRRI

SEQ ID NO: 1270511 - protein, 19 aa, Mycobacterium
LALACAVIGRPELVFLDEP

SEQ ID NO: 1270512 - protein, 23 aa, Mycobacterium
LALAHEVRMAWCGPDVEVEGIIS

SEQ ID NO: 1270513 - protein, 37 aa, Mycobacterium
LALAYAMRCTACWWLGRPGWRRDFDRAVEMAGEADPI

SEQ ID NO: 1270514 - protein, 17 aa, Mycobacterium
LALCPGGSIPSADLSEA

SEQ ID NO: 1270515 - protein, 20 aa, Mycobacterium
LALELQRRGGGTGAAALCGG

SEQ ID NO: 1270516 - protein, 17 aa, Mycobacterium
LALEPAVLIADEPTTAL

SEQ ID NO: 1270517 - protein, 19 aa, Mycobacterium
LALFPRRIGGRYAAMSRSD

SEQ ID NO: 1270518 - protein, 22 aa, Mycobacterium
LALFRTATAFERAHVTELVPHD

SEQ ID NO: 1270519 - protein, 21 aa, Mycobacterium
LALGAQGVWMGSAFLTSAEYD

SEQ ID NO: 1270520 - protein, 20 aa, Mycobacterium
LALGSEWLAVTGYRQADTNS

SEQ ID NO: 1270521 - protein, 17 aa, Mycobacterium
LALGWPETDGLSIVGVA

SEQ ID NO: 1270522 - protein, 17 aa, Mycobacterium
LALGWPETEGLSIVGVA

SEQ ID NO: 1270523 - protein, 25 aa, Mycobacterium
LALGYRIAPRPVLAMVSEQLMKASG

SEQ ID NO: 1270524 - protein, 24 aa, Mycobacterium
LALHAELLPALGLSADSVDAAPVS

SEQ ID NO: 1270525 - protein, 17 aa, Mycobacterium
LALIDVREPVEWDINHI

SEQ ID NO: 1270526 - protein, 23 aa, Mycobacterium
LALKSGGALLVYPGGDYEVFRPS

SEQ ID NO: 1270527 - protein, 24 aa, Mycobacterium
LALLDALRWLGMDWDEGPEIGGPY

SEQ ID NO: 1270528 - protein, 17 aa, Mycobacterium
LALLEADVSLPVVRAFI

SEQ ID NO: 1270529 - protein, 34 aa, Mycobacterium
LALLEVRDLLFARLLQYRAFKHVAEMFAELEAAA

SEQ ID NO: 1270530 - protein, 17 aa, Mycobacterium
LALLRLLLRGDPIDLGG

SEQ ID NO: 1270531 - protein, 24 aa, Mycobacterium
LALLRMRGLLSLRRGDAAAYRQLR

SEQ ID NO: 1270532 - protein, 20 aa, Mycobacterium
LALLSERWRSIAGPLAARFP

SEQ ID NO: 1270533 - protein, 21 aa, Mycobacterium
LALNIAHPWVPPKVMAPHLWR

SEQ ID NO: 1270534 - protein, 22 aa, Mycobacterium
LALPFRPLLKFLTAGFLAPVFR

SEQ ID NO: 1270535 - protein, 27 aa, Mycobacterium
LALPGHAPSGLGFRPDGSLLITSVERR

SEQ ID NO: 1270536 - protein, 18 aa, Mycobacterium
LALPRNELLGARDVSDEL

SEQ ID NO: 1270537 - protein, 25 aa, Mycobacterium
LALQLGWRLFGPFLRAATGLDDPHA

SEQ ID NO: 1270538 - protein, 35 aa, Mycobacterium
LALRAEPALPRLLGRLVIMGGAFDYRGNTTPVAEW

SEQ ID NO: 1270539 - protein, 25 aa, Mycobacterium
LALRHPLAALGFMYSLRSTAYTEER

SEQ ID NO: 1270540 - protein, 17 aa, Mycobacterium
LALRSLGGAVVWANDET

SEQ ID NO: 1270541 - protein, 19 aa, Mycobacterium
LALSEFGHYPWSEFQQSLI

SEQ ID NO: 1270542 - protein, 19 aa, Mycobacterium
LALSLGDSLAGMFAAQGAL

SEQ ID NO: 1270543 - protein, 26 aa, Mycobacterium
LALSVCTLYPPTRVQLAIADTQNGIA

SEQ ID NO: 1270544 - protein, 18 aa, Mycobacterium
LALTALWRSYGVEPDAVI

SEQ ID NO: 1270545 - protein, 18 aa, Mycobacterium
LALTRGRAGRAYYITDGA

SEQ ID NO: 1270546 - protein, 23 aa, Mycobacterium
LALVALRRQIKFVDVTEAVHRQI

SEQ ID NO: 1270547 - protein, 27 aa, Mycobacterium
LALVLHDLSWRLARFGPAQVGLEPLPA

SEQ ID NO: 1270548 - protein, 18 aa, Mycobacterium
LALVPYELTMTFRGAQAP

SEQ ID NO: 1270549 - protein, 18 aa, Mycobacterium
LALVQAYNDWHVEEWCGA

SEQ ID NO: 1270550 - protein, 28 aa, Mycobacterium
LAMAGCHRVAVPMVEHGRGFAIDVDGLR

SEQ ID NO: 1270551 - protein, 29 aa, Mycobacterium
LAMAGCHRVAVPMVEHGRGFAIDVDGLRG

SEQ ID NO: 1270552 - protein, 29 aa, Mycobacterium
LAMAGCHRVAVPMVEHGRGFAIDVDGLRR

SEQ ID NO: 1270553 - protein, 20 aa, Mycobacterium
LAMFAIHRWGSEEQRTRWLP

SEQ ID NO: 1270554 - protein, 27 aa, Mycobacterium
LAMRGEARMCLGLGGWKEDLSTAMDSA

SEQ ID NO: 1270555 - protein, 20 aa, Mycobacterium
LAMRIHGVSAMPVIVAGEYV

SEQ ID NO: 1270556 - protein, 27 aa, Mycobacterium
LANAIARACGARVCQLPMTPARVWRAV

SEQ ID NO: 1270557 - protein, 21 aa, Mycobacterium
LANCVDHAYAGRPSPGPMTVR

SEQ ID NO: 1270558 - protein, 17 aa, Mycobacterium
LANIAITVQGGRNLARR

SEQ ID NO: 1270559 - protein, 17 aa, Mycobacterium
LANLLSHVDVCLGQHVM

SEQ ID NO: 1270560 - protein, 23 aa, Mycobacterium
LANRARLAREIAVAVRESVGDQI

SEQ ID NO: 1270561 - protein, 26 aa, Mycobacterium
LANSPPIELAQRVIAGMRLTTGSGDP

SEQ ID NO: 1270562 - protein, 20 aa, Mycobacterium
LANVVRLYRGEAVETVAGSD

SEQ ID NO: 1270563 - protein, 19 aa, Mycobacterium
LAPAEPFAAQFTDLDLTII

SEQ ID NO: 1270564 - protein, 19 aa, Mycobacterium
LAPAEPFAAQFTDLDLTVI

SEQ ID NO: 1270565 - protein, 17 aa, Mycobacterium
LAPARFRELATRAADLL

SEQ ID NO: 1270566 - protein, 17 aa, Mycobacterium
LAPDAADYFTERQAEFG

SEQ ID NO: 1270567 - protein, 18 aa, Mycobacterium
LAPEGRLLVIGFAAGGGI

SEQ ID NO: 1270568 - protein, 17 aa, Mycobacterium
LAPEHPWPAAPDDCETV

SEQ ID NO: 1270569 - protein, 17 aa, Mycobacterium
LAPEHRYPAAVDDALTG

SEQ ID NO: 1270570 - protein, 18 aa, Mycobacterium
LAPEPVLHAALGPGALIA

SEQ ID NO: 1270571 - protein, 18 aa, Mycobacterium
LAPEYPYPVPVEDCYSAL

SEQ ID NO: 1270572 - protein, 17 aa, Mycobacterium
LAPFWDAVHVIDPEAED

SEQ ID NO: 1270573 - protein, 20 aa, Mycobacterium
LAPGARLWWQAGHRSTEPAH

SEQ ID NO: 1270574 - protein, 18 aa, Mycobacterium
LAPGQRALVPTGIAVAIP

SEQ ID NO: 1270575 - protein, 18 aa, Mycobacterium
LAPGRSAFFLGDSCGKGI

SEQ ID NO: 1270576 - protein, 24 aa, Mycobacterium
LAPGSEWFAVSGYRRADDDTAPIC

SEQ ID NO: 1270577 - protein, 18 aa, Mycobacterium
LAPKTMRTLIEKIVASES

SEQ ID NO: 1270578 - protein, 24 aa, Mycobacterium
LAPLGRPILCTEYLARGMGSTVEG

SEQ ID NO: 1270579 - protein, 17 aa, Mycobacterium
LAPLKAEWLSQQLTALW

SEQ ID NO: 1270580 - protein, 27 aa, Mycobacterium
LAPLLRFIVAGGLPTTVKAGLELLGVS

SEQ ID NO: 1270581 - protein, 18 aa, Mycobacterium
LAPLRAAARDGLAAYSAA

SEQ ID NO: 1270582 - protein, 18 aa, Mycobacterium
LAPLRPAGRREVTVEFTA

SEQ ID NO: 1270583 - protein, 17 aa, Mycobacterium
LAPLTFISVFGYQAQRA

SEQ ID NO: 1270584 - protein, 17 aa, Mycobacterium
LAPRIRVNAIAPGSILT

SEQ ID NO: 1270585 - protein, 24 aa, Mycobacterium
LAPRLDYADIVALFATHLGGTPDE

SEQ ID NO: 1270586 - protein, 24 aa, Mycobacterium
LAPRRLRGGVLRECESDLDGVFDR

SEQ ID NO: 1270587 - protein, 18 aa, Mycobacterium
LAPRVAIHALKFFGIQAH

SEQ ID NO: 1270588 - protein, 25 aa, Mycobacterium
LAQAARLGSGLGFPGTPYLHAYTRS

SEQ ID NO: 1270589 - protein, 25 aa, Mycobacterium
LAQARRLGVADSVVFDATYRTPQAL

SEQ ID NO: 1270590 - protein, 18 aa, Mycobacterium
LAQCRLHGLPLLVAPPSV

SEQ ID NO: 1270591 - protein, 27 aa, Mycobacterium
LAQDFGMRMITRFDVDWQRYGYDDAAL

SEQ ID NO: 1270592 - protein, 26 aa, Mycobacterium
LAQDLARRLGAPSVRLDELRAENLTA

SEQ ID NO: 1270593 - protein, 25 aa, Mycobacterium
LAQGVAGFCGVLGTRLIQARPYDPE

SEQ ID NO: 1270594 - protein, 22 aa, Mycobacterium
LAQIPRRVAGYADALRASAVKG

SEQ ID NO: 1270595 - protein, 20 aa, Mycobacterium
LAQKERWLPELMTLEKIAAW

SEQ ID NO: 1270596 - protein, 18 aa, Mycobacterium
LAQLRARLAHLPSDRPIV

SEQ ID NO: 1270597 - protein, 18 aa, Mycobacterium
LAQRCKRLGRYVVGIGVA

SEQ ID NO: 1270598 - protein, 21 aa, Mycobacterium
LAQRIPLDAAMLADRRPATAT

SEQ ID NO: 1270599 - protein, 23 aa, Mycobacterium
LAQRLLDAYPRIDVLANNAGGMV

SEQ ID NO: 1270600 - protein, 20 aa, Mycobacterium
LAQRNWRVVVTDVNAAAASE

SEQ ID NO: 1270601 - protein, 18 aa, Mycobacterium
LAQRRRARADLDERSATV

SEQ ID NO: 1270602 - protein, 25 aa, Mycobacterium
LAQRVGWTGGHSWFAENVTRIRPEY

SEQ ID NO: 1270603 - protein, 25 aa, Mycobacterium
LAQVADLFSAFGMHPVGFYDLREAA

SEQ ID NO: 1270604 - protein, 30 aa, Mycobacterium
LAQVSFTLGSAWLSGCHQRSQTGEMRQNGE

SEQ ID NO: 1270605 - protein, 28 aa, Mycobacterium
LAQYRAAWREAVKVFGRNQVSTYLLVGL

SEQ ID NO: 1270606 - protein, 23 aa, Mycobacterium
LARAELRARYGLGERPVVVCLSR

SEQ ID NO: 1270607 - protein, 21 aa, Mycobacterium
LARAGAHVILAVRNLELGAQR

SEQ ID NO: 1270608 - protein, 26 aa, Mycobacterium
LARALPRSVALRMALMGKHERMSAER

SEQ ID NO: 1270609 - protein, 23 aa, Mycobacterium
LARAVLARRGADKTVVIDPQATY

SEQ ID NO: 1270610 - protein, 17 aa, Mycobacterium
LARKAMDLLGCDLQQRY

SEQ ID NO: 1270611 - protein, 23 aa, Mycobacterium
LARLCNTAMWIDHGTIKMEGGIE

SEQ ID NO: 1270612 - protein, 18 aa, Mycobacterium
LARLDRFGLAHAVLACAD

SEQ ID NO: 1270613 - protein, 24 aa, Mycobacterium
LARLELAEALKILSHRFRYARRTG

SEQ ID NO: 1270614 - protein, 19 aa, Mycobacterium
LARLQEVWIGRQIADVKSK

SEQ ID NO: 1270615 - protein, 24 aa, Mycobacterium
LARLTGLRPDWSRTVTARRIAAAV

SEQ ID NO: 1270616 - protein, 24 aa, Mycobacterium
LARPPRSAFAPILRARRHLLVAAG

SEQ ID NO: 1270617 - protein, 24 aa, Mycobacterium
LARPSRFCPRMLHIAVSQPLVAAV

SEQ ID NO: 1270618 - protein, 23 aa, Mycobacterium
LARRELAEALRILAGRLSNPRRS

SEQ ID NO: 1270619 - protein, 21 aa, Mycobacterium
LARRGMQMPVYFGNRNWEPYV

SEQ ID NO: 1270620 - protein, 17 aa, Mycobacterium
LARRIEPAVSWADIVLP

SEQ ID NO: 1270621 - protein, 25 aa, Mycobacterium
LARRLCAGLLDWAHGRGATRAYVQV

SEQ ID NO: 1270622 - protein, 18 aa, Mycobacterium
LARRRVIVAVPFEDQPRE

SEQ ID NO: 1270623 - protein, 21 aa, Mycobacterium
LARRTDLMFERGLVDEVVGLL

SEQ ID NO: 1270624 - protein, 17 aa, Mycobacterium
LARRTICVDESVLRMQN

SEQ ID NO: 1270625 - protein, 22 aa, Mycobacterium
LARSAHCPVALVRHNTDGYVLA

SEQ ID NO: 1270626 - protein, 21 aa, Mycobacterium
LARSCDELQFTLGEGPCLDTV

SEQ ID NO: 1270627 - protein, 24 aa, Mycobacterium
LASDVLRPLSTVVRSARLAAVDAI

SEQ ID NO: 1270628 - protein, 22 aa, Mycobacterium
LASGELIAAYAIDSGLTATRHG

SEQ ID NO: 1270629 - protein, 24 aa, Mycobacterium
LASGGRFILGLGMTHAAVTEGMWG

SEQ ID NO: 1270630 - protein, 22 aa, Mycobacterium
LASHCRAHLAGFKTPKQVYFVD

SEQ ID NO: 1270631 - protein, 18 aa, Mycobacterium
LASLAVRGTLALFGAASG

SEQ ID NO: 1270632 - protein, 17 aa, Mycobacterium
LASLAVRGTLVLFGGAS

SEQ ID NO: 1270633 - protein, 18 aa, Mycobacterium
LASLLERSGFDVVGQAGD

SEQ ID NO: 1270634 - protein, 18 aa, Mycobacterium
LASLVDRLVRDGVDGIVT

SEQ ID NO: 1270635 - protein, 18 aa, Mycobacterium
LASMFKVPMSQLYEGYTF

SEQ ID NO: 1270636 - protein, 27 aa, Mycobacterium
LASMLPSMIPTVLGAAGGLLGGAMSSM

SEQ ID NO: 1270637 - protein, 28 aa, Mycobacterium
LASQGKGAWPSCGGPLSAATPRNVVAEP

SEQ ID NO: 1270638 - protein, 23 aa, Mycobacterium
LASSEPRPARAGTRVLYVSPLKA

SEQ ID NO: 1270639 - protein, 19 aa, Mycobacterium
LASVDCRFCHVSVQVKKLG

SEQ ID NO: 1270640 - protein, 18 aa, Mycobacterium
LATAGALGCFGITRREGL

SEQ ID NO: 1270641 - protein, 17 aa, Mycobacterium
LATATRQQPDWDDTVVA

SEQ ID NO: 1270642 - protein, 19 aa, Mycobacterium
LATAVVIEAHDEWQVTRRY

SEQ ID NO: 1270643 - protein, 23 aa, Mycobacterium
LATCAIEGVPIKVALINNGNLGM

SEQ ID NO: 1270644 - protein, 24 aa, Mycobacterium
LATLKGPDWAAASAEALRGDHRRI

SEQ ID NO: 1270645 - protein, 19 aa, Mycobacterium
LATLKRPNVDLVRTPIARV

SEQ ID NO: 1270646 - protein, 18 aa, Mycobacterium
LATLRAYLTRRIRTSGLV

SEQ ID NO: 1270647 - protein, 25 aa, Mycobacterium
LATPIRMSERAVFDFGGSPQGRALS

SEQ ID NO: 1270648 - protein, 21 aa, Mycobacterium
LATRPAVPMSVSEAAAVPPAW

SEQ ID NO: 1270649 - protein, 17 aa, Mycobacterium
LATRPGVVGYVLRDRTT

SEQ ID NO: 1270650 - protein, 26 aa, Mycobacterium
LATRVPFVHFFDGFRTSHEINTIETL

SEQ ID NO: 1270651 - protein, 25 aa, Mycobacterium
LATTRFAQDWARHRNVSLADVPRVL

SEQ ID NO: 1270652 - protein, 27 aa, Mycobacterium
LATVAVDLRNDWPAALAEAGFDASAPT

SEQ ID NO: 1270653 - protein, 19 aa, Mycobacterium
LATVHHWRDVGAGLSEIHR

SEQ ID NO: 1270654 - protein, 23 aa, Mycobacterium
LAVAAPEPSRFGAYALTDVSGTQ

SEQ ID NO: 1270655 - protein, 17 aa, Mycobacterium
LAVAGRRVQEEIFNQFD

SEQ ID NO: 1270656 - protein, 31 aa, Mycobacterium
LAVARHAWRPRWLKWSLTISGKGGTHRGGIP

SEQ ID NO: 1270657 - protein, 25 aa, Mycobacterium
LAVAVRHWRAALGLTSADRMQVMTP

SEQ ID NO: 1270658 - protein, 20 aa, Mycobacterium
LAVDGSFEWRFTPNSDAQLV

SEQ ID NO: 1270659 - protein, 24 aa, Mycobacterium
LAVGKRLYERYGIDEKPTASDDGI

SEQ ID NO: 1270660 - protein, 24 aa, Mycobacterium
LAVGLPPTLPHEFPVTDTPRYRDI

SEQ ID NO: 1270661 - protein, 23 aa, Mycobacterium
LAVGRGRVTLVYANRDERSVIFA

SEQ ID NO: 1270662 - protein, 25 aa, Mycobacterium
LAVLTARHLNCWTLGTIEKGGKDGP

SEQ ID NO: 1270663 - protein, 18 aa, Mycobacterium
LAVNIAVNIEEGAEDSVG

SEQ ID NO: 1270664 - protein, 18 aa, Mycobacterium
LAVSFLLIGSGRAEVVHG

SEQ ID NO: 1270665 - protein, 20 aa, Mycobacterium
LAVTGCLIAGVPVVPVPADV

SEQ ID NO: 1270666 - protein, 27 aa, Mycobacterium
LAVVPLMPVWRNFFLGQELRKKSFPFS

SEQ ID NO: 1270667 - protein, 23 aa, Mycobacterium
LAVYRLAWARLHDCPVSSVRAAF

SEQ ID NO: 1270668 - protein, 25 aa, Mycobacterium
LAWDELKAMWRADARGLDLDRDAHF

SEQ ID NO: 1270669 - protein, 24 aa, Mycobacterium
LAWLRKLTGPQAWIVIEKILAVDE

SEQ ID NO: 1270670 - protein, 25 aa, Mycobacterium
LAWQRTQWDGGWAGIAWPTEYGGKG

SEQ ID NO: 1270671 - protein, 19 aa, Mycobacterium
LAYADPRVGAEIWADDVDT

SEQ ID NO: 1270672 - protein, 21 aa, Mycobacterium
LAYAENRFEAVRGEVESKASA

SEQ ID NO: 1270673 - protein, 25 aa, Mycobacterium
LAYDLLEPWDLLVLVDALPDRGSPG

SEQ ID NO: 1270674 - protein, 23 aa, Mycobacterium
LAYGDMGLALPILAPGGVASALT

SEQ ID NO: 1270675 - protein, 21 aa, Mycobacterium
LAYPRARLVIASRAAGLPAPI

SEQ ID NO: 1270676 - protein, 18 aa, Mycobacterium
LCADAGFGAADRALQLHG

SEQ ID NO: 1270677 - protein, 20 aa, Mycobacterium
LCADPRPLGYDDSTTFCADL

SEQ ID NO: 1270678 - protein, 19 aa, Mycobacterium
LCAELRVAIETAVRDGSLP

SEQ ID NO: 1270679 - protein, 20 aa, Mycobacterium
LCAEQERLRDVLVMEAGVPV

SEQ ID NO: 1270680 - protein, 34 aa, Mycobacterium
LCAGYDWRAKVAQPHGWMKAAVGLTNYLRSPATA

SEQ ID NO: 1270681 - protein, 24 aa, Mycobacterium
LCAKAFRTEPVIGVLTFISHGTDE

SEQ ID NO: 1270682 - protein, 17 aa, Mycobacterium
LCAKLSAAHPKLGLLVL

SEQ ID NO: 1270683 - protein, 20 aa, Mycobacterium
LCAMAKRYVTDACFEVADQA

SEQ ID NO: 1270684 - protein, 22 aa, Mycobacterium
LCAVRPDIGGVLIRGEKGTAKS

SEQ ID NO: 1270685 - protein, 18 aa, Mycobacterium
LCDEFAGLLVDVRGRGLW

SEQ ID NO: 1270686 - protein, 18 aa, Mycobacterium
LCDFPRDPLVLAADRDRM

SEQ ID NO: 1270687 - protein, 22 aa, Mycobacterium
LCDHARPGMVVGLDSVGGDFTM

SEQ ID NO: 1270688 - protein, 25 aa, Mycobacterium
LCDPPESFQLYGIVAHVLTYSAHRR

SEQ ID NO: 1270689 - protein, 23 aa, Mycobacterium
LCEIKDVQIRDGLHILGQTPTGE

SEQ ID NO: 1270690 - protein, 18 aa, Mycobacterium
LCGAELREVLQVRRALEV

SEQ ID NO: 1270691 - protein, 30 aa, Mycobacterium
LCGDLPWSQRLGEVWRMRSAEERDASLALR

SEQ ID NO: 1270692 - protein, 20 aa, Mycobacterium
LCGPGPMIEATRNWLDEHGI

SEQ ID NO: 1270693 - protein, 22 aa, Mycobacterium
LCGPSVCTRHYIWPPARSSVPC

SEQ ID NO: 1270694 - protein, 22 aa, Mycobacterium
LCGYHLSVVRPLPGLDGRFVKR

SEQ ID NO: 1270695 - protein, 24 aa, Mycobacterium
LCHISHVYPTGASLYFTVVAAQRG

SEQ ID NO: 1270696 - protein, 18 aa, Mycobacterium
LCINPFFHNFGYKAGILA

SEQ ID NO: 1270697 - protein, 17 aa, Mycobacterium
LCLHRAPGICVSDLAAA

SEQ ID NO: 1270698 - protein, 33 aa, Mycobacterium
LCMALGEWWRGAGRGAGFLLGMVVSTGIGGGLV

SEQ ID NO: 1270699 - protein, 18 aa, Mycobacterium
LCPLRLRDQSSWPLYPIR

SEQ ID NO: 1270700 - protein, 17 aa, Mycobacterium
LCPPAAATARMAMRDVE

SEQ ID NO: 1270701 - protein, 25 aa, Mycobacterium
LCRDTCHYCTFVTVPGRLRAEGKGM

SEQ ID NO: 1270702 - protein, 17 aa, Mycobacterium
LCRNLRKGGDYSVPVIL

SEQ ID NO: 1270703 - protein, 26 aa, Mycobacterium
LCRQAIPGMLRRGGGHIVNVSSLSGI

SEQ ID NO: 1270704 - protein, 22 aa, Mycobacterium
LCRQCPALSACTRWADGLSPVR

SEQ ID NO: 1270705 - protein, 17 aa, Mycobacterium
LCRRRLLLDQTVLLAKN

SEQ ID NO: 1270706 - protein, 17 aa, Mycobacterium
LCRVICRDGGITVLSVD

SEQ ID NO: 1270707 - protein, 17 aa, Mycobacterium
LCTDYAAAGLVLCDSLA

SEQ ID NO: 1270708 - protein, 18 aa, Mycobacterium
LCTQRVARRLVEVGQPGS

SEQ ID NO: 1270709 - protein, 19 aa, Mycobacterium
LCVCDMAWVVGLPQGLVSH

SEQ ID NO: 1270710 - protein, 21 aa, Mycobacterium
LCVDDSRFATLVLASVSRRDG

SEQ ID NO: 1270711 - protein, 20 aa, Mycobacterium
LCVIDPKGGMELGAGAPLFT

SEQ ID NO: 1270712 - protein, 20 aa, Mycobacterium
LCVIDPKGGMELGAGAPMFT

SEQ ID NO: 1270713 - protein, 23 aa, Mycobacterium
LDAADLFVLPSIVADDGQMEGLP

SEQ ID NO: 1270714 - protein, 22 aa, Mycobacterium
LDAAFERWGAPTVDIVLRQFEH

SEQ ID NO: 1270715 - protein, 19 aa, Mycobacterium
LDAAIKWYHDHLGMIVLHE

SEQ ID NO: 1270716 - protein, 18 aa, Mycobacterium
LDAAILFAPVGDLVLPAM

SEQ ID NO: 1270717 - protein, 17 aa, Mycobacterium
LDAAPGFGLVVSYNPGY

SEQ ID NO: 1270718 - protein, 17 aa, Mycobacterium
LDAARFCHGCGSELVNS

SEQ ID NO: 1270719 - protein, 19 aa, Mycobacterium
LDAASGWTAQDWAQVGDEY

SEQ ID NO: 1270720 - protein, 24 aa, Mycobacterium
LDAASLREAFGHFPSGVIAIAAEV

SEQ ID NO: 1270721 - protein, 23 aa, Mycobacterium
LDADCVFYTPIIMDVDTVCRLLR

SEQ ID NO: 1270722 - protein, 17 aa, Mycobacterium
LDADLLMDAGFVVVSHH

SEQ ID NO: 1270723 - protein, 19 aa, Mycobacterium
LDAEFPKFRQLLPTEHTAI

SEQ ID NO: 1270724 - protein, 18 aa, Mycobacterium
LDAFRSVEGFRSWGELDA

SEQ ID NO: 1270725 - protein, 23 aa, Mycobacterium
LDAGAARWAVRMAKEREKNARKL

SEQ ID NO: 1270726 - protein, 25 aa, Mycobacterium
LDAGATYRPGTRFGPQGIRRSTNLF

SEQ ID NO: 1270727 - protein, 24 aa, Mycobacterium
LDAGKAMRLFFEHPEKTLDELTMP

SEQ ID NO: 1270728 - protein, 26 aa, Mycobacterium
LDAGLRRLKLAAVRRTAPEVLITAKT

SEQ ID NO: 1270729 - protein, 26 aa, Mycobacterium
LDAHPVPGRWLPNGCMATSGSLIRWL

SEQ ID NO: 1270730 - protein, 25 aa, Mycobacterium
LDAKGPIRIWGRCSLRENGTLVHVD

SEQ ID NO: 1270731 - protein, 18 aa, Mycobacterium
LDALAGLDRPFGIGLVHW

SEQ ID NO: 1270732 - protein, 19 aa, Mycobacterium
LDALGVRHALLIVTKADLT

SEQ ID NO: 1270733 - protein, 21 aa, Mycobacterium
LDALKDWTARLFDAGYAGADW

SEQ ID NO: 1270734 - protein, 20 aa, Mycobacterium
LDALKRLVNEAAFQHQSDQG

SEQ ID NO: 1270735 - protein, 20 aa, Mycobacterium
LDALPDWSAVDLPRVRIAEF

SEQ ID NO: 1270736 - protein, 19 aa, Mycobacterium
LDALPLVISAADWDRLEAG

SEQ ID NO: 1270737 - protein, 23 aa, Mycobacterium
LDALPRLPRWLRPFAGFEARDHL

SEQ ID NO: 1270738 - protein, 18 aa, Mycobacterium
LDALSAVFGDRGDAAPLV

SEQ ID NO: 1270739 - protein, 18 aa, Mycobacterium
LDAMRCAGQPGVLSSRAV

SEQ ID NO: 1270740 - protein, 27 aa, Mycobacterium
LDARAYRLPWPSGSVVYEIDQPEVIEF

SEQ ID NO: 1270741 - protein, 21 aa, Mycobacterium
LDARFPLHGMPDDAKRLMHLM

SEQ ID NO: 1270742 - protein, 22 aa, Mycobacterium
LDARPAGVGLTERFGRLLDEPL

SEQ ID NO: 1270743 - protein, 21 aa, Mycobacterium
LDASLLLAVLTRFLPPDDPRI

SEQ ID NO: 1270744 - protein, 17 aa, Mycobacterium
LDASSQWLAERNAQRSI

SEQ ID NO: 1270745 - protein, 24 aa, Mycobacterium
LDAVCTELARTLRPGGRAAIGVGD

SEQ ID NO: 1270746 - protein, 24 aa, Mycobacterium
LDAVIGGAVLKHSRDFNLMRECVL

SEQ ID NO: 1270747 - protein, 23 aa, Mycobacterium
LDAWRQSGRRAADAWSDDAVLER

SEQ ID NO: 1270748 - protein, 19 aa, Mycobacterium
LDAYGREGEPCRRCGAIMR

SEQ ID NO: 1270749 - protein, 30 aa, Mycobacterium
LDDAGRLLPLLELKAGRILFGGWPTGVEVC

SEQ ID NO: 1270750 - protein, 28 aa, Mycobacterium
LDDCLLKYSRLFAALTEWERGTDIAVLP

SEQ ID NO: 1270751 - protein, 17 aa, Mycobacterium
LDDDDWPIDEADLREAL

SEQ ID NO: 1270752 - protein, 31 aa, Mycobacterium
LDDDSGRMAVEWPDGTGFHFLRGTPIDAELY

SEQ ID NO: 1270753 - protein, 20 aa, Mycobacterium
LDDEVRWVLTKGKLPTSMWI

SEQ ID NO: 1270754 - protein, 23 aa, Mycobacterium
LDDGTTWRVDIERAHMEEDTGKL

SEQ ID NO: 1270755 - protein, 18 aa, Mycobacterium
LDDHEILEGISIAAFIGA

SEQ ID NO: 1270756 - protein, 19 aa, Mycobacterium
LDDIAWQFLRSEFTGEIYA

SEQ ID NO: 1270757 - protein, 30 aa, Mycobacterium
LDDINEYLFQFALSTAWMNGIPGGRAAKLV

SEQ ID NO: 1270758 - protein, 18 aa, Mycobacterium
LDDLGYRGFWMGYVAARS

SEQ ID NO: 1270759 - protein, 25 aa, Mycobacterium
LDDLVRLVLDWNRPVKMFIETKHPV

SEQ ID NO: 1270760 - protein, 19 aa, Mycobacterium
LDDNACRFLLTRGPAEDTT

SEQ ID NO: 1270761 - protein, 35 aa, Mycobacterium
LDDNRLAFYRQLYRDSARFGAKLWVLPANMASYND

SEQ ID NO: 1270762 - protein, 18 aa, Mycobacterium
LDDPPRWHVKVTPFRVVA

SEQ ID NO: 1270763 - protein, 19 aa, Mycobacterium
LDDQWRVAFDAAVDTLVAR

SEQ ID NO: 1270764 - protein, 17 aa, Mycobacterium
LDDSCRAAMAITEQGGT

SEQ ID NO: 1270765 - protein, 19 aa, Mycobacterium
LDDSCRAAMAITEQGGTAT

SEQ ID NO: 1270766 - protein, 26 aa, Mycobacterium
LDEAEFARRLGAYFATHGHRTGLDDA

SEQ ID NO: 1270767 - protein, 18 aa, Mycobacterium
LDEAMALLDAEGSYGDAQ

SEQ ID NO: 1270768 - protein, 26 aa, Mycobacterium
LDEDVWKREYWPSGNRDAHGNPDLVW

SEQ ID NO: 1270769 - protein, 23 aa, Mycobacterium
LDEEGRPSVPVFADDSDPLGMSP

SEQ ID NO: 1270770 - protein, 19 aa, Mycobacterium
LDEEGYLFIGGRSDDTIIR

SEQ ID NO: 1270771 - protein, 20 aa, Mycobacterium
LDEFAYRLTGSADLYEHTAR

SEQ ID NO: 1270772 - protein, 24 aa, Mycobacterium
LDEFTYPLKWGWLDVDDVVSTLTA

SEQ ID NO: 1270773 - protein, 23 aa, Mycobacterium
LDEHPPVVISMLIAQVARSLCNE

SEQ ID NO: 1270774 - protein, 23 aa, Mycobacterium
LDEITARLGRGCRAELHGQVQGS

SEQ ID NO: 1270775 - protein, 22 aa, Mycobacterium
LDELGALLCRYGVTGVTDATPD

SEQ ID NO: 1270776 - protein, 23 aa, Mycobacterium
LDELHLRGQWQYDAQLVQLTDGP

SEQ ID NO: 1270777 - protein, 27 aa, Mycobacterium
LDELLNRWPEWNIDYDTARLAPTSTVR

SEQ ID NO: 1270778 - protein, 21 aa, Mycobacterium
LDELPAYCQMFYEELPASLDA

SEQ ID NO: 1270779 - protein, 18 aa, Mycobacterium
LDELTMPFLDPRKRVADY

SEQ ID NO: 1270780 - protein, 17 aa, Mycobacterium
LDELVAWMKDRHDGGTP

SEQ ID NO: 1270781 - protein, 26 aa, Mycobacterium
LDELVEFMLRTLQSFILDPGGPDRHR

SEQ ID NO: 1270782 - protein, 18 aa, Mycobacterium
LDERGYLYLVDRKKDMVV

SEQ ID NO: 1270783 - protein, 21 aa, Mycobacterium
LDERLFLERYVRIRAELVGER

SEQ ID NO: 1270784 - protein, 20 aa, Mycobacterium
LDEVELSGLLGRGGAAFPMA

SEQ ID NO: 1270785 - protein, 18 aa, Mycobacterium
LDEVGRILGVKGRVLPMC

SEQ ID NO: 1270786 - protein, 25 aa, Mycobacterium
LDEVGRLLLQRGIRSVPVVDDECRV

SEQ ID NO: 1270787 - protein, 24 aa, Mycobacterium
LDEVLGADGYRVGHRVADGTRLEA

SEQ ID NO: 1270788 - protein, 21 aa, Mycobacterium
LDFAGNADFAIAIRTALIRNG

SEQ ID NO: 1270789 - protein, 17 aa, Mycobacterium
LDFDLLGPLPAPLTTTV

SEQ ID NO: 1270790 - protein, 22 aa, Mycobacterium
LDFHRCAMLPLRDGAADTGHAD

SEQ ID NO: 1270791 - protein, 23 aa, Mycobacterium
LDFHRCAMLPLRDGAADTGHADD

SEQ ID NO: 1270792 - protein, 19 aa, Mycobacterium
LDFMRSCSIKHHLPSIVFS

SEQ ID NO: 1270793 - protein, 25 aa, Mycobacterium
LDGDHVPGLAAFIRRESGSKWVDKE

SEQ ID NO: 1270794 - protein, 18 aa, Mycobacterium
LDGELPRCRQTVHRGLVL

SEQ ID NO: 1270795 - protein, 17 aa, Mycobacterium
LDGEVCRSRTLPSTYAK

SEQ ID NO: 1270796 - protein, 20 aa, Mycobacterium
LDGFCSASLMIDRTSGRAVS

SEQ ID NO: 1270797 - protein, 25 aa, Mycobacterium
LDGGGRSELVLSYFIEQIGPKESER

SEQ ID NO: 1270798 - protein, 19 aa, Mycobacterium
LDGHCPLPREVLGNKGHGL

SEQ ID NO: 1270799 - protein, 18 aa, Mycobacterium
LDGLPEFAPPYDFLNEPG

SEQ ID NO: 1270800 - protein, 19 aa, Mycobacterium
LDGLRHWMSRKGYAAINDF

SEQ ID NO: 1270801 - protein, 17 aa, Mycobacterium
LDGLSWQQLDMLARHTR

SEQ ID NO: 1270802 - protein, 19 aa, Mycobacterium
LDGLVEFLPSRAWFDHADA

SEQ ID NO: 1270803 - protein, 19 aa, Mycobacterium
LDGNCPSFVTVELPAKNGP

SEQ ID NO: 1270804 - protein, 25 aa, Mycobacterium
LDGPEGPPLLVSRTGYTGELGYELW

SEQ ID NO: 1270805 - protein, 25 aa, Mycobacterium
LDGRADPGEIVWTWVAFEDDPTQGK

SEQ ID NO: 1270806 - protein, 18 aa, Mycobacterium
LDGRTVLDTEPWRGEPLL

SEQ ID NO: 1270807 - protein, 17 aa, Mycobacterium
LDGSRMAKVKSRALDLL

SEQ ID NO: 1270808 - protein, 23 aa, Mycobacterium
LDGTCVGCDAGGFTATRPFEVES

SEQ ID NO: 1270809 - protein, 19 aa, Mycobacterium
LDGYCRHMGGNLAQGEIKG

SEQ ID NO: 1270810 - protein, 20 aa, Mycobacterium
LDGYSAADCVALLREAALTA

SEQ ID NO: 1270811 - protein, 19 aa, Mycobacterium
LDGYWVGAFAMALPNTRVV

SEQ ID NO: 1270812 - protein, 19 aa, Mycobacterium
LDIAMGMGILVTQVLTAAG

SEQ ID NO: 1270813 - protein, 24 aa, Mycobacterium
LDIFSIRIPKPWFVLMPTPMWDQM

SEQ ID NO: 1270814 - protein, 25 aa, Mycobacterium
LDIFSIRIPKPWFVLMPTPVWDQMF

SEQ ID NO: 1270815 - protein, 25 aa, Mycobacterium
LDIFSMRIPKPWFVMMPTPLWDQIF

SEQ ID NO: 1270816 - protein, 18 aa, Mycobacterium
LDIISARQQIAFYTDLLP

SEQ ID NO: 1270817 - protein, 19 aa, Mycobacterium
LDILARCRLTTITNDNPEI

SEQ ID NO: 1270818 - protein, 19 aa, Mycobacterium
LDILLAHGGGAFLALLPRI

SEQ ID NO: 1270819 - protein, 24 aa, Mycobacterium
LDISDRILLELGVSELPEGWQEGL

SEQ ID NO: 1270820 - protein, 24 aa, Mycobacterium
LDKAKAMGAMALFGENYPDEVRVV

SEQ ID NO: 1270821 - protein, 20 aa, Mycobacterium
LDKFPLWTGQPYDIDNLSAD

SEQ ID NO: 1270822 - protein, 21 aa, Mycobacterium
LDKLESIPGFTAEISKTQIRQ

SEQ ID NO: 1270823 - protein, 17 aa, Mycobacterium
LDKMGWRSSDTAELSYT

SEQ ID NO: 1270824 - protein, 23 aa, Mycobacterium
LDKSRPLWEMYLVEGLAKNRIAI

SEQ ID NO: 1270825 - protein, 19 aa, Mycobacterium
LDLAARWLRAQGRGYYTIG

SEQ ID NO: 1270826 - protein, 17 aa, Mycobacterium
LDLAGADGLVLFNRFLQ

SEQ ID NO: 1270827 - protein, 17 aa, Mycobacterium
LDLALVFNEGPDYAAAG

SEQ ID NO: 1270828 - protein, 17 aa, Mycobacterium
LDLCTGIAGAALLAAAA

SEQ ID NO: 1270829 - protein, 17 aa, Mycobacterium
LDLDELVAWMKDRHDGG

SEQ ID NO: 1270830 - protein, 17 aa, Mycobacterium
LDLDLAIPKEMGGTGNG

SEQ ID NO: 1270831 - protein, 17 aa, Mycobacterium
LDLDMLIFAGGRERTRA

SEQ ID NO: 1270832 - protein, 22 aa, Mycobacterium
LDLDYRPMFWDSPAAATEQVQK

SEQ ID NO: 1270833 - protein, 18 aa, Mycobacterium
LDLEKAMEFCAADECVEV

SEQ ID NO: 1270834 - protein, 26 aa, Mycobacterium
LDLEPVLGFEYEFWLFQDREDPRRPL

SEQ ID NO: 1270835 - protein, 24 aa, Mycobacterium
LDLESWSAFGQRGTASGEVRLNNV

SEQ ID NO: 1270836 - protein, 20 aa, Mycobacterium
LDLFDYRASGPAGRNLLVDP

SEQ ID NO: 1270837 - protein, 23 aa, Mycobacterium
LDLGCGAGAFLRHAPADLSIELT

SEQ ID NO: 1270838 - protein, 17 aa, Mycobacterium
LDLKAARLLPAGEIHDE

SEQ ID NO: 1270839 - protein, 34 aa, Mycobacterium
LDLKLRHVMQFELKRIQREVGITFIYVTHDQEEA

SEQ ID NO: 1270840 - protein, 17 aa, Mycobacterium
LDLLMSVDFRMTSTTLL

SEQ ID NO: 1270841 - protein, 20 aa, Mycobacterium
LDLLQRVQRAMGLSREDDPD

SEQ ID NO: 1270842 - protein, 27 aa, Mycobacterium
LDLLSRLQRELGLTYLLIGHDLAVIRQ

SEQ ID NO: 1270843 - protein, 25 aa, Mycobacterium
LDLLTGWRDAWQLGSATRDRALTLL

SEQ ID NO: 1270844 - protein, 24 aa, Mycobacterium
LDLPNPPASWGWGSMAHLFVGTLA

SEQ ID NO: 1270845 - protein, 18 aa, Mycobacterium
LDLPNPPASWGWGTMAHL

SEQ ID NO: 1270846 - protein, 21 aa, Mycobacterium
LDLQDRFGLAYLFVSHDLSVV

SEQ ID NO: 1270847 - protein, 24 aa, Mycobacterium
LDLQLALYVCYELHYRGFADVDAA

SEQ ID NO: 1270848 - protein, 17 aa, Mycobacterium
LDLRGWSTMADIVDTKA

SEQ ID NO: 1270849 - protein, 25 aa, Mycobacterium
LDLRHATSLRHCIDLLTQHARTHPD

SEQ ID NO: 1270850 - protein, 24 aa, Mycobacterium
LDLRKRLKRLTGHTVPLATLLGGI

SEQ ID NO: 1270851 - protein, 19 aa, Mycobacterium
LDLRLTSERGRMSAGDLDE

SEQ ID NO: 1270852 - protein, 25 aa, Mycobacterium
LDLRRLIDRAARWLLNYRPQPLAVG

SEQ ID NO: 1270853 - protein, 26 aa, Mycobacterium
LDLSTSAGRMVARILGSVARQESEHS

SEQ ID NO: 1270854 - protein, 20 aa, Mycobacterium
LDLTEYPERVIATIQAAIRV

SEQ ID NO: 1270855 - protein, 17 aa, Mycobacterium
LDLTMGFAVAQTIYAAA

SEQ ID NO: 1270856 - protein, 20 aa, Mycobacterium
LDLVGIPVDEHWRVMSDLAT

SEQ ID NO: 1270857 - protein, 17 aa, Mycobacterium
LDLVGLSEFGAYLPRQL

SEQ ID NO: 1270858 - protein, 22 aa, Mycobacterium
LDMLNPLAWLRDKFGGADMTAD

SEQ ID NO: 1270859 - protein, 17 aa, Mycobacterium
LDMLRPFLDPDPRPVAG

SEQ ID NO: 1270860 - protein, 18 aa, Mycobacterium
LDMMAAFVDQAALAWQLA

SEQ ID NO: 1270861 - protein, 19 aa, Mycobacterium
LDMPPLRVDPATVLTDNPQ

SEQ ID NO: 1270862 - protein, 26 aa, Mycobacterium
LDNLPAFAALRPFFETRTIRVEDELH

SEQ ID NO: 1270863 - protein, 23 aa, Mycobacterium
LDNRAAAALMARLRGEGERTDPL

SEQ ID NO: 1270864 - protein, 24 aa, Mycobacterium
LDNRRATTHWAHCQTLARTYPKVM

SEQ ID NO: 1270865 - protein, 23 aa, Mycobacterium
LDNSLRRALAFGRVSAQDAAVFC

SEQ ID NO: 1270866 - protein, 18 aa, Mycobacterium
LDPAATRMILYTSGTTGR

SEQ ID NO: 1270867 - protein, 17 aa, Mycobacterium
LDPDGANWDAWRNEDSR

SEQ ID NO: 1270868 - protein, 17 aa, Mycobacterium
LDPDIAYLSGDRLPPGV

SEQ ID NO: 1270869 - protein, 18 aa, Mycobacterium
LDPDIVLCDVRMQGSSGL

SEQ ID NO: 1270870 - protein, 22 aa, Mycobacterium
LDPELTALIGKRLMHRDEVGAA

SEQ ID NO: 1270871 - protein, 21 aa, Mycobacterium
LDPEMINEVLAVMAGLATDGM

SEQ ID NO: 1270872 - protein, 19 aa, Mycobacterium
LDPEMTSPYAWYQYFINTA

SEQ ID NO: 1270873 - protein, 22 aa, Mycobacterium
LDPETRSGVVIVGAKSAGKKIF

SEQ ID NO: 1270874 - protein, 20 aa, Mycobacterium
LDPKLGYANDPAWIVFDSIH

SEQ ID NO: 1270875 - protein, 18 aa, Mycobacterium
LDPLTGTNRFDFVRDLGA

SEQ ID NO: 1270876 - protein, 17 aa, Mycobacterium
LDPMCAAAPLLLDEGGT

SEQ ID NO: 1270877 - protein, 20 aa, Mycobacterium
LDPPAIGFVSIWTPQYYGHQ

SEQ ID NO: 1270878 - protein, 20 aa, Mycobacterium
LDPPGVAVLSLWTQQSYGGD

SEQ ID NO: 1270879 - protein, 19 aa, Mycobacterium
LDPPIKSLFVYNSNPVSQG

SEQ ID NO: 1270880 - protein, 21 aa, Mycobacterium
LDPRLRAKLGVTWSPEEQRQL

SEQ ID NO: 1270881 - protein, 18 aa, Mycobacterium
LDPTSPFASFYDSLTATP

SEQ ID NO: 1270882 - protein, 18 aa, Mycobacterium
LDPVAALPGQGWDFTTGA

SEQ ID NO: 1270883 - protein, 17 aa, Mycobacterium
LDPVCYADFPTERDLAA

SEQ ID NO: 1270884 - protein, 24 aa, Mycobacterium
LDQAVRLFIDRGFHSVKLEDIAEA

SEQ ID NO: 1270885 - protein, 18 aa, Mycobacterium
LDQGRIGATLGLDATVYE

SEQ ID NO: 1270886 - protein, 20 aa, Mycobacterium
LDQLLGWRPPGHADMRTELP

SEQ ID NO: 1270887 - protein, 25 aa, Mycobacterium
LDQLPEIWAGWDFEFWEDRYEEQLA

SEQ ID NO: 1270888 - protein, 17 aa, Mycobacterium
LDQLRSAYGQQYLDSFT

SEQ ID NO: 1270889 - protein, 17 aa, Mycobacterium
LDQPYRWTGRRTVFVNS

SEQ ID NO: 1270890 - protein, 17 aa, Mycobacterium
LDQRIAVRYTLPGMTPA

SEQ ID NO: 1270891 - protein, 21 aa, Mycobacterium
LDQRIAVRYTLPGMTPADTAD

SEQ ID NO: 1270892 - protein, 21 aa, Mycobacterium
LDRAAALIVKGAFGLSGQACT

SEQ ID NO: 1270893 - protein, 18 aa, Mycobacterium
LDRAAWRRFQIRAELEPP

SEQ ID NO: 1270894 - protein, 23 aa, Mycobacterium
LDRAAWRRFQIRAELEPPSRSQA

SEQ ID NO: 1270895 - protein, 26 aa, Mycobacterium
LDRAAWRRFQVRLTLPPPSRIQATAF

SEQ ID NO: 1270896 - protein, 23 aa, Mycobacterium
LDRARIAHMAARIDKAAFTRADM

SEQ ID NO: 1270897 - protein, 21 aa, Mycobacterium
LDRDFLALLTEWNRGDETNAF

SEQ ID NO: 1270898 - protein, 25 aa, Mycobacterium
LDRDRPLWECWIIEGLADGRWATLM

SEQ ID NO: 1270899 - protein, 21 aa, Mycobacterium
LDREAREVVAVDVGYGQLAWS

SEQ ID NO: 1270900 - protein, 22 aa, Mycobacterium
LDREPYALGMVTEFAANSAEGW

SEQ ID NO: 1270901 - protein, 31 aa, Mycobacterium
LDRFLDIMLRAPFRLARDVIVHMQPGSAIIN

SEQ ID NO: 1270902 - protein, 21 aa, Mycobacterium
LDRFVVEVTFHIGRLGVPVIA

SEQ ID NO: 1270903 - protein, 25 aa, Mycobacterium
LDRGELRPDVDITWAAINGLVLALG

SEQ ID NO: 1270904 - protein, 29 aa, Mycobacterium
LDRHPALKIGWFEGGIAWVPTALQDAEHM

SEQ ID NO: 1270905 - protein, 24 aa, Mycobacterium
LDRHRPMFRCWLIDGVPGGRFAIY

SEQ ID NO: 1270906 - protein, 17 aa, Mycobacterium
LDRLEEIWTTFTKLAPK

SEQ ID NO: 1270907 - protein, 26 aa, Mycobacterium
LDRLFPRSIFYSLRLAEHNLDELLNR

SEQ ID NO: 1270908 - protein, 26 aa, Mycobacterium
LDRNKERLRRILITEVGCPVTVSGSQ

SEQ ID NO: 1270909 - protein, 30 aa, Mycobacterium
LDRNTFRWWLTVATLRWGVICRHQAERHLS

SEQ ID NO: 1270910 - protein, 22 aa, Mycobacterium
LDRPASKMQFAFIEDDEELRRV

SEQ ID NO: 1270911 - protein, 21 aa, Mycobacterium
LDRQHRVAAVFLMALLAEDLR

SEQ ID NO: 1270912 - protein, 20 aa, Mycobacterium
LDRRATFAYVMNKMGGGTTG

SEQ ID NO: 1270913 - protein, 23 aa, Mycobacterium
LDRRFTLAAGLLELADREFSAVR

SEQ ID NO: 1270914 - protein, 20 aa, Mycobacterium
LDRRGLQAAMSRDASVVRDA

SEQ ID NO: 1270915 - protein, 25 aa, Mycobacterium
LDRRLADAGFDWYEVSNWSRPGGQC

SEQ ID NO: 1270916 - protein, 18 aa, Mycobacterium
LDRRSRRALRADLQVVFQ

SEQ ID NO: 1270917 - protein, 20 aa, Mycobacterium
LDRSKPLWEMWVIEGVGETD

SEQ ID NO: 1270918 - protein, 24 aa, Mycobacterium
LDRSRPLWEMYFIEGLADGRIAVL

SEQ ID NO: 1270919 - protein, 18 aa, Mycobacterium
LDRTPWRAEQPVVIVAPM

SEQ ID NO: 1270920 - protein, 27 aa, Mycobacterium
LDRTVALWRKRFDDVHIYPVAFHGDVA

SEQ ID NO: 1270921 - protein, 18 aa, Mycobacterium
LDRVGELVIKPVEGSGGY

SEQ ID NO: 1270922 - protein, 26 aa, Mycobacterium
LDRVLSGEFRLCLGYTEPDGGSDVAT

SEQ ID NO: 1270923 - protein, 20 aa, Mycobacterium
LDRYKVAPPTTWDEYDEVAA

SEQ ID NO: 1270924 - protein, 25 aa, Mycobacterium
LDSAFLRPGRFDYIIPVGPPDDAAR

SEQ ID NO: 1270925 - protein, 18 aa, Mycobacterium
LDSFPADAGRHGMSVDRL

SEQ ID NO: 1270926 - protein, 17 aa, Mycobacterium
LDSLGPVVDKHPDYVDT

SEQ ID NO: 1270927 - protein, 24 aa, Mycobacterium
LDSRTYRLPWLPGATVYEIDQPGV

SEQ ID NO: 1270928 - protein, 18 aa, Mycobacterium
LDSRYFRLDPGPGVEWFD

SEQ ID NO: 1270929 - protein, 34 aa, Mycobacterium
LDSSSRAAIEFAVRRLRGPFGVLVTERCAPGEGA

SEQ ID NO: 1270930 - protein, 18 aa, Mycobacterium
LDSWKPDVAVVGAPFDVG

SEQ ID NO: 1270931 - protein, 17 aa, Mycobacterium
LDTGYVWINGSGSHFLG

SEQ ID NO: 1270932 - protein, 21 aa, Mycobacterium
LDTLEVRWALLVGDRLGGELA

SEQ ID NO: 1270933 - protein, 27 aa, Mycobacterium
LDTLIKEKWLTANGVIGFFPANASPGG

SEQ ID NO: 1270934 - protein, 21 aa, Mycobacterium
LDTPCAGWNLADLLTHMTAQH

SEQ ID NO: 1270935 - protein, 27 aa, Mycobacterium
LDTRAFRLPWPDGMTVFEIDQPTVLRY

SEQ ID NO: 1270936 - protein, 28 aa, Mycobacterium
LDTRAYRLPWPAGTVVYEIDQPTVIEFK

SEQ ID NO: 1270937 - protein, 17 aa, Mycobacterium
LDTSKLVIFDGDSGENL

SEQ ID NO: 1270938 - protein, 25 aa, Mycobacterium
LDTVFAGKTLEEWAEVFSGQPDLFW

SEQ ID NO: 1270939 - protein, 17 aa, Mycobacterium
LDTWTDMALRAEDPTAS

SEQ ID NO: 1270940 - protein, 23 aa, Mycobacterium
LDVAELYDPFSIVTLVLLDEYRL

SEQ ID NO: 1270941 - protein, 18 aa, Mycobacterium
LDVARMVLFGQVGRELVN

SEQ ID NO: 1270942 - protein, 26 aa, Mycobacterium
LDVATAWLRARRPLDFIPGLMHGDYQ

SEQ ID NO: 1270943 - protein, 17 aa, Mycobacterium
LDVDGFLYIDGRADDVI

SEQ ID NO: 1270944 - protein, 21 aa, Mycobacterium
LDVDPRWSALLSDTAAIEDPA

SEQ ID NO: 1270945 - protein, 18 aa, Mycobacterium
LDVEGWRGDNFPFTFNID

SEQ ID NO: 1270946 - protein, 17 aa, Mycobacterium
LDVEWPAAELIDATIID

SEQ ID NO: 1270947 - protein, 18 aa, Mycobacterium
LDVFARHFRCLVLEFPGF

SEQ ID NO: 1270948 - protein, 28 aa, Mycobacterium
LDVGGGPGFFAAAFARRGMEYVGVEPDP

SEQ ID NO: 1270949 - protein, 27 aa, Mycobacterium
LDVGHARQRCVLVALLADVNQPVPAEQ

SEQ ID NO: 1270950 - protein, 17 aa, Mycobacterium
LDVKALVREAARSRRQP

SEQ ID NO: 1270951 - protein, 22 aa, Mycobacterium
LDVLRAWAAAYDRTPVQVEKAI

SEQ ID NO: 1270952 - protein, 19 aa, Mycobacterium
LDVPGYLKSIYDPYTLLDG

SEQ ID NO: 1270953 - protein, 27 aa, Mycobacterium
LDVPILQGLCLTSSWSDWSSKDDGLSP

SEQ ID NO: 1270954 - protein, 17 aa, Mycobacterium
LDVPVVAGGVLDHRTAL

SEQ ID NO: 1270955 - protein, 23 aa, Mycobacterium
LDVRSRSLVSFDALAAAERLFGN

SEQ ID NO: 1270956 - protein, 18 aa, Mycobacterium
LDVYQWLTVLQEYLVVCL

SEQ ID NO: 1270957 - protein, 23 aa, Mycobacterium
LDVYSRRVVGWSIADHLRTELVA

SEQ ID NO: 1270958 - protein, 19 aa, Mycobacterium
LDWNVLRALCDAEAIARTE

SEQ ID NO: 1270959 - protein, 20 aa, Mycobacterium
LDYDCPRSVLERATEVTPGL

SEQ ID NO: 1270960 - protein, 24 aa, Mycobacterium
LDYLLSRLGVRRIVLTGQVTEQCI

SEQ ID NO: 1270961 - protein, 22 aa, Mycobacterium
LDYRPDLGVLLLSYIDGKTLEN

SEQ ID NO: 1270962 - protein, 17 aa, Mycobacterium
LDYRWPDRQLPSEGATR

SEQ ID NO: 1270963 - protein, 27 aa, Mycobacterium
LDYRWPEGWEVLELNPAQVAEQRRVQG

SEQ ID NO: 1270964 - protein, 18 aa, Mycobacterium
LEAAAGIAGVIKVILSLE

SEQ ID NO: 1270965 - protein, 17 aa, Mycobacterium
LEAAKLPAAPMHSTQEV

SEQ ID NO: 1270966 - protein, 23 aa, Mycobacterium
LEAANLRGQWIYDDMLESVVGGP

SEQ ID NO: 1270967 - protein, 24 aa, Mycobacterium
LEADPYRRLAFTFHTFTRQLTTVG

SEQ ID NO: 1270968 - protein, 17 aa, Mycobacterium
LEAEGHRILKLNIGNPA

SEQ ID NO: 1270969 - protein, 19 aa, Mycobacterium
LEAEGWARDMIREIQEFRR

SEQ ID NO: 1270970 - protein, 19 aa, Mycobacterium
LEAEGWRIIRVSAEILRDR

SEQ ID NO: 1270971 - protein, 22 aa, Mycobacterium
LEAFQSGLSWLIILRKRDNFRA

SEQ ID NO: 1270972 - protein, 19 aa, Mycobacterium
LEAFRRGRGTLEWAGVGLV

SEQ ID NO: 1270973 - protein, 26 aa, Mycobacterium
LEAHLISRLGVRFAEQSRGRGKRPVR

SEQ ID NO: 1270974 - protein, 25 aa, Mycobacterium
LEAIREWVVAAAASVPRNRAGELMV

SEQ ID NO: 1270975 - protein, 23 aa, Mycobacterium
LEAKRFPHIIFRSDRIAKTDDGY

SEQ ID NO: 1270976 - protein, 25 aa, Mycobacterium
LEALPRCCRQPSPPILLGAAGPRML

SEQ ID NO: 1270977 - protein, 26 aa, Mycobacterium
LEANLRLVVSLAKRYTGRGMAFLDLI

SEQ ID NO: 1270978 - protein, 19 aa, Mycobacterium
LEATFPVSIPIHGMALNIT

SEQ ID NO: 1270979 - protein, 18 aa, Mycobacterium
LEAVLLELLGEYQVSVPE

SEQ ID NO: 1270980 - protein, 22 aa, Mycobacterium
LEAVVMDCVWDYAEPVTVREVF

SEQ ID NO: 1270981 - protein, 21 aa, Mycobacterium
LEAVVMDLLWSREGASTVRSV

SEQ ID NO: 1270982 - protein, 17 aa, Mycobacterium
LEAVVMDWVWDHEEPVK

SEQ ID NO: 1270983 - protein, 19 aa, Mycobacterium
LEAWCDEFNEPLPALTSFV

SEQ ID NO: 1270984 - protein, 21 aa, Mycobacterium
LEAWPQWGPSVVRAELDGAAF

SEQ ID NO: 1270985 - protein, 25 aa, Mycobacterium
LEDAMRFYFEFHFDQGEGYLAHLHD

SEQ ID NO: 1270986 - protein, 17 aa, Mycobacterium
LEDEGAKSDVKRKVRDG

SEQ ID NO: 1270987 - protein, 17 aa, Mycobacterium
LEDFDVFHPDRMASRIL

SEQ ID NO: 1270988 - protein, 25 aa, Mycobacterium
LEDGGIKTNVSWADGTTITMTETAD

SEQ ID NO: 1270989 - protein, 18 aa, Mycobacterium
LEDGRIFTGTTFGAVGET

SEQ ID NO: 1270990 - protein, 25 aa, Mycobacterium
LEDKVGDAFARVFGGSIVPQEVESL

SEQ ID NO: 1270991 - protein, 19 aa, Mycobacterium
LEDLDVLDWPDKVKTMQRN

SEQ ID NO: 1270992 - protein, 18 aa, Mycobacterium
LEDLPVLYELAAEEGGSD

SEQ ID NO: 1270993 - protein, 18 aa, Mycobacterium
LEDLRAGGAPMIPLESDK

SEQ ID NO: 1270994 - protein, 18 aa, Mycobacterium
LEDRSFAALSLREVTREA

SEQ ID NO: 1270995 - protein, 18 aa, Mycobacterium
LEDRTFPYLFSPAANEAV

SEQ ID NO: 1270996 - protein, 18 aa, Mycobacterium
LEEALQICNQMWDPDNNG

SEQ ID NO: 1270997 - protein, 25 aa, Mycobacterium
LEEAWRAGQVEMITWLGELYGLDRL

SEQ ID NO: 1270998 - protein, 22 aa, Mycobacterium
LEECPTCLRYYGVEERVKKLIA

SEQ ID NO: 1270999 - protein, 22 aa, Mycobacterium
LEEEGFWGWALVETLRHTGIRI

SEQ ID NO: 1271000 - protein, 20 aa, Mycobacterium
LEEGMVLAVTAYVWEQGLGG

SEQ ID NO: 1271001 - protein, 19 aa, Mycobacterium
LEEICAVSPRYVVTAQVST

SEQ ID NO: 1271002 - protein, 25 aa, Mycobacterium
LEEILKRFPTWEVDWPNAVPSQTTA

SEQ ID NO: 1271003 - protein, 22 aa, Mycobacterium
LEELKSLGLRTFLLPLNPGKDD

SEQ ID NO: 1271004 - protein, 22 aa, Mycobacterium
LEELRAGLFSLGGEQSGHIVLP

SEQ ID NO: 1271005 - protein, 20 aa, Mycobacterium
LEERAADTGTEWGLGALAGA

SEQ ID NO: 1271006 - protein, 20 aa, Mycobacterium
LEERCRRWPQAAAVCDDVLR

SEQ ID NO: 1271007 - protein, 18 aa, Mycobacterium
LEESGLVAGYRPELDLAQ

SEQ ID NO: 1271008 - protein, 19 aa, Mycobacterium
LEESIRYKSLIGIAGVAAE

SEQ ID NO: 1271009 - protein, 27 aa, Mycobacterium
LEEYSRRKHIEAGYEFVNTPHITKEHL

SEQ ID NO: 1271010 - protein, 22 aa, Mycobacterium
LEFDLLMLVAPILRKLAEANPA

SEQ ID NO: 1271011 - protein, 17 aa, Mycobacterium
LEFIIRLLPDGVMSNYL

SEQ ID NO: 1271012 - protein, 17 aa, Mycobacterium
LEFLIGGVIGRFHRVGD

SEQ ID NO: 1271013 - protein, 18 aa, Mycobacterium
LEFQVGLERVLTRMPDFA

SEQ ID NO: 1271014 - protein, 23 aa, Mycobacterium
LEFRVLRDRLFDTLASADPEVEE

SEQ ID NO: 1271015 - protein, 20 aa, Mycobacterium
LEFRVLRDRLFETLAAVEPE

SEQ ID NO: 1271016 - protein, 24 aa, Mycobacterium
LEGALRPTHFAGVLTVVLKLFNTV

SEQ ID NO: 1271017 - protein, 20 aa, Mycobacterium
LEGDEKWVKSVEELMEAVDE

SEQ ID NO: 1271018 - protein, 26 aa, Mycobacterium
LEGDLHWPALCRSVGRHDWLTDDRFA

SEQ ID NO: 1271019 - protein, 24 aa, Mycobacterium
LEGFMRDVPCPECDGTRLKPEILA

SEQ ID NO: 1271020 - protein, 17 aa, Mycobacterium
LEGGGRLVVELTPEEAA

SEQ ID NO: 1271021 - protein, 26 aa, Mycobacterium
LEGILARLGHSIAFFIGTAYGSTATA

SEQ ID NO: 1271022 - protein, 21 aa, Mycobacterium
LEGLRRWVRPHLDGYEPLFAA

SEQ ID NO: 1271023 - protein, 17 aa, Mycobacterium
LEGPAPLLLYGYGAYEA

SEQ ID NO: 1271024 - protein, 18 aa, Mycobacterium
LEGPRGVAVIFEKNSTRT

SEQ ID NO: 1271025 - protein, 26 aa, Mycobacterium
LEGPSYTRPASWRGLDVPDVLLSGDH

SEQ ID NO: 1271026 - protein, 17 aa, Mycobacterium
LEGQPLDRPFAWALIKL

SEQ ID NO: 1271027 - protein, 21 aa, Mycobacterium
LEGRLLAGLLAPYGDEPTPTQ

SEQ ID NO: 1271028 - protein, 31 aa, Mycobacterium
LEGWAANRAHLFLFLTLCRDHDVVVLSGDVH

SEQ ID NO: 1271029 - protein, 17 aa, Mycobacterium
LEGYLLTGRHGLFNCYE

SEQ ID NO: 1271030 - protein, 21 aa, Mycobacterium
LEGYTTLGFLAARTSRIDLGL

SEQ ID NO: 1271031 - protein, 20 aa, Mycobacterium
LEHACALQAVVAPTVNSYKR

SEQ ID NO: 1271032 - protein, 18 aa, Mycobacterium
LEHGHRVFTSPAMAGRGP

SEQ ID NO: 1271033 - protein, 23 aa, Mycobacterium
LEHGMPMCDVFWVMHVDESDLVA

SEQ ID NO: 1271034 - protein, 26 aa, Mycobacterium
LEHLRPARDISVIRLKMDHALAYHPG

SEQ ID NO: 1271035 - protein, 18 aa, Mycobacterium
LEHQGRKLLARFDAGTYV

SEQ ID NO: 1271036 - protein, 19 aa, Mycobacterium
LEHRAAWVEAESDGTVTSM

SEQ ID NO: 1271037 - protein, 21 aa, Mycobacterium
LEHTRSLLLDAAEDVFAEKGF

SEQ ID NO: 1271038 - protein, 29 aa, Mycobacterium
LEHYEKLEGVALTFPGKVNRLATMVRGNL

SEQ ID NO: 1271039 - protein, 17 aa, Mycobacterium
LEIAHYVEHLAGFLDAI

SEQ ID NO: 1271040 - protein, 23 aa, Mycobacterium
LEIAPNLWAGVGLVRGGAGTALV

SEQ ID NO: 1271041 - protein, 28 aa, Mycobacterium
LEIARRCSRIAFGLGDFRSDTGMSDDPT

SEQ ID NO: 1271042 - protein, 26 aa, Mycobacterium
LEIGDIRFGEVFAHGAPLTHFTQIFV

SEQ ID NO: 1271043 - protein, 18 aa, Mycobacterium
LEIKKFCPNCGKHQAHKE

SEQ ID NO: 1271044 - protein, 17 aa, Mycobacterium
LEIKREMESDAAGRQSH

SEQ ID NO: 1271045 - protein, 18 aa, Mycobacterium
LEINEAFAAVALASTKEL

SEQ ID NO: 1271046 - protein, 24 aa, Mycobacterium
LEIRRLAIECLRQLVDAAPQVFSD

SEQ ID NO: 1271047 - protein, 26 aa, Mycobacterium
LEISSIPTVMAFRDGVLVYRQAGALP

SEQ ID NO: 1271048 - protein, 18 aa, Mycobacterium
LEITEKLLQPWGIVHGGV

SEQ ID NO: 1271049 - protein, 19 aa, Mycobacterium
LEITPKWAPLFTVRTALYD

SEQ ID NO: 1271050 - protein, 31 aa, Mycobacterium
LEITSIPTVMAFRDGVLVYRQPGAMHPAALE

SEQ ID NO: 1271051 - protein, 24 aa, Mycobacterium
LEITTCLRRGELEIVTRFEPRDTA

SEQ ID NO: 1271052 - protein, 19 aa, Mycobacterium
LEIVRRLHNAGGPMQCGAL

SEQ ID NO: 1271053 - protein, 19 aa, Mycobacterium
LEKGPRLGVLGVVVEVDGR

SEQ ID NO: 1271054 - protein, 17 aa, Mycobacterium
LEKLQPLLEKFSAELDA

SEQ ID NO: 1271055 - protein, 21 aa, Mycobacterium
LEKLRPGDFYKPANQLVYDAI

SEQ ID NO: 1271056 - protein, 26 aa, Mycobacterium
LEKLWEGLRQLYPVGIDHHDLIDSDA

SEQ ID NO: 1271057 - protein, 18 aa, Mycobacterium
LEKQRYVTFDSRTIGIPL

SEQ ID NO: 1271058 - protein, 19 aa, Mycobacterium
LEKVTARRHLVAGLMTIHL

SEQ ID NO: 1271059 - protein, 17 aa, Mycobacterium
LELAAALADHFPSTDDR

SEQ ID NO: 1271060 - protein, 20 aa, Mycobacterium
LELAAAVADGFPGARRTDPV

SEQ ID NO: 1271061 - protein, 17 aa, Mycobacterium
LELALACHHRIALDDPH

SEQ ID NO: 1271062 - protein, 18 aa, Mycobacterium
LELAQAYAGAPSRRLPEV

SEQ ID NO: 1271063 - protein, 26 aa, Mycobacterium
LELAREFDAAGLPPGILNVVTGDGEP

SEQ ID NO: 1271064 - protein, 26 aa, Mycobacterium
LELARRPELRAALLGDPDGIAGFVEE

SEQ ID NO: 1271065 - protein, 27 aa, Mycobacterium
LELCLEHGVAFVPFFPLGSGFVPDNPV

SEQ ID NO: 1271066 - protein, 17 aa, Mycobacterium
LELDRRLRTAGSPVTTY

SEQ ID NO: 1271067 - protein, 19 aa, Mycobacterium
LELFERIQRAMGLPRVDDA

SEQ ID NO: 1271068 - protein, 28 aa, Mycobacterium
LELGFRSSIQKEWEWRVSRGESLKNLEA

SEQ ID NO: 1271069 - protein, 20 aa, Mycobacterium
LELGLPLVAGNVVSAEGTRD

SEQ ID NO: 1271070 - protein, 19 aa, Mycobacterium
LELIWSAHESSVWSDECHP

SEQ ID NO: 1271071 - protein, 25 aa, Mycobacterium
LELLLRRDWGEQFVIGGRTTFVEEA

SEQ ID NO: 1271072 - protein, 18 aa, Mycobacterium
LELNVAFRMLYARYPDIT

SEQ ID NO: 1271073 - protein, 17 aa, Mycobacterium
LELPGTLVPSARMVLRL

SEQ ID NO: 1271074 - protein, 20 aa, Mycobacterium
LELRARTLLAERGAQSCYWD

SEQ ID NO: 1271075 - protein, 21 aa, Mycobacterium
LELRASWTATDLELGPHVEAF

SEQ ID NO: 1271076 - protein, 17 aa, Mycobacterium
LELRHVLSYVPVNEGVV

SEQ ID NO: 1271077 - protein, 17 aa, Mycobacterium
LELVGSAAINRDNAAQH

SEQ ID NO: 1271078 - protein, 18 aa, Mycobacterium
LELWLAEFPQPRPPRETW

SEQ ID NO: 1271079 - protein, 29 aa, Mycobacterium
LENMRYKWRKWLYFDCNWKVALEAFNETY

SEQ ID NO: 1271080 - protein, 24 aa, Mycobacterium
LENVPIEPIWLCPLRLRDQSSWPL

SEQ ID NO: 1271081 - protein, 22 aa, Mycobacterium
LEPDFVAAAGFSLRDVLTSGET

SEQ ID NO: 1271082 - protein, 17 aa, Mycobacterium
LEPGCLATTALVDTYHL

SEQ ID NO: 1271083 - protein, 22 aa, Mycobacterium
LEPGHDGIGWLAQRGYVPLGYK

SEQ ID NO: 1271084 - protein, 17 aa, Mycobacterium
LEPGMTFTIEPMINVGG

SEQ ID NO: 1271085 - protein, 20 aa, Mycobacterium
LEPLPRTGTVYTHTTVRIPV

SEQ ID NO: 1271086 - protein, 19 aa, Mycobacterium
LEPRHLAPGPALVLPLRAT

SEQ ID NO: 1271087 - protein, 23 aa, Mycobacterium
LEPSELRWETFDPRFDLAKTPNE

SEQ ID NO: 1271088 - protein, 27 aa, Mycobacterium
LEPSEWFPLQLALKVHQSRAGMPTGEP

SEQ ID NO: 1271089 - protein, 23 aa, Mycobacterium
LEPYWEALRKVYAPFDVAAAGPT

SEQ ID NO: 1271090 - protein, 20 aa, Mycobacterium
LEPYWEALRKVYAPFESGLP

SEQ ID NO: 1271091 - protein, 18 aa, Mycobacterium
LEQFGIVLSHGSPLTRCV

SEQ ID NO: 1271092 - protein, 18 aa, Mycobacterium
LEQNVEWIGACVTYLREH

SEQ ID NO: 1271093 - protein, 18 aa, Mycobacterium
LEQSYARRIKALPPQTQL

SEQ ID NO: 1271094 - protein, 19 aa, Mycobacterium
LERAAHYFRAHGITTIEQV

SEQ ID NO: 1271095 - protein, 25 aa, Mycobacterium
LERAEALDATADWVPQVWRDMDTTL

SEQ ID NO: 1271096 - protein, 17 aa, Mycobacterium
LERAQIQPWAWVVNNSL

SEQ ID NO: 1271097 - protein, 24 aa, Mycobacterium
LERDRCIFCQRCVEFVRDETTGQK

SEQ ID NO: 1271098 - protein, 17 aa, Mycobacterium
LERFGWRARSSLETVLH

SEQ ID NO: 1271099 - protein, 22 aa, Mycobacterium
LERGLRLSGFDVYTAVDGAEAL

SEQ ID NO: 1271100 - protein, 20 aa, Mycobacterium
LERLKGLFMASFEAIETRHA

SEQ ID NO: 1271101 - protein, 18 aa, Mycobacterium
LERLNAYLLPLLGTDGRG

SEQ ID NO: 1271102 - protein, 20 aa, Mycobacterium
LERLTPWLSPGARVILDDYS

SEQ ID NO: 1271103 - protein, 21 aa, Mycobacterium
LERLTPWLSPGARVILDDYSD

SEQ ID NO: 1271104 - protein, 26 aa, Mycobacterium
LERNKERLRRILITEVGCPVSVSGSQ

SEQ ID NO: 1271105 - protein, 18 aa, Mycobacterium
LERPSIGYGIRYEFGIFR

SEQ ID NO: 1271106 - protein, 25 aa, Mycobacterium
LERQWLHARSLAFVHPADGRRIEIT

SEQ ID NO: 1271107 - protein, 20 aa, Mycobacterium
LERRDVRVGAVDWWTCDDQV

SEQ ID NO: 1271108 - protein, 25 aa, Mycobacterium
LERRIGEYRLPAGSWVVAAGNRAQD

SEQ ID NO: 1271109 - protein, 23 aa, Mycobacterium
LERTYKWVPRVGIEHIRAVIVED

SEQ ID NO: 1271110 - protein, 25 aa, Mycobacterium
LERVLAAAVSIRLTYWLVTRAETLR

SEQ ID NO: 1271111 - protein, 17 aa, Mycobacterium
LERYEREAAQWCSRTGG

SEQ ID NO: 1271112 - protein, 17 aa, Mycobacterium
LERYLRHVGKAATTRLD

SEQ ID NO: 1271113 - protein, 26 aa, Mycobacterium
LESAKRLWCRLGDFAPSTDRISAAHL

SEQ ID NO: 1271114 - protein, 19 aa, Mycobacterium
LESESAFYAALEFWSAMHG

SEQ ID NO: 1271115 - protein, 17 aa, Mycobacterium
LESFAQWGAVSAVAVGR

SEQ ID NO: 1271116 - protein, 25 aa, Mycobacterium
LESFLRTAWPLVLARMPDAHLTVIG

SEQ ID NO: 1271117 - protein, 19 aa, Mycobacterium
LESGLPIEPVYNLGSGSGT

SEQ ID NO: 1271118 - protein, 17 aa, Mycobacterium
LESKAGQGIPALTSAEL

SEQ ID NO: 1271119 - protein, 18 aa, Mycobacterium
LESLPIRAIVRSPLLRCE

SEQ ID NO: 1271120 - protein, 23 aa, Mycobacterium
LESLPRNEIVAGMAEIVKAGFIA

SEQ ID NO: 1271121 - protein, 20 aa, Mycobacterium
LESLRLWREGFLDGLPPEVV

SEQ ID NO: 1271122 - protein, 26 aa, Mycobacterium
LESLRRLHGLGHRRVLPGHGPELDDV

SEQ ID NO: 1271123 - protein, 26 aa, Mycobacterium
LESPEFRDARFTVVMLHEGPHSLGEN

SEQ ID NO: 1271124 - protein, 31 aa, Mycobacterium
LESPTRDDALLAFPAMQAMPTPYVEASDVSN

SEQ ID NO: 1271125 - protein, 18 aa, Mycobacterium
LESTSGLIMLPDSQSALV

SEQ ID NO: 1271126 - protein, 18 aa, Mycobacterium
LETARCLESGLLRSTADA

SEQ ID NO: 1271127 - protein, 19 aa, Mycobacterium
LETEILWGSPDSELVTESH

SEQ ID NO: 1271128 - protein, 27 aa, Mycobacterium
LETGAALLPVHCWFEPDGWGMQVYPEL

SEQ ID NO: 1271129 - protein, 25 aa, Mycobacterium
LETGRARVAGFLPDFEAQAVTWEAG

SEQ ID NO: 1271130 - protein, 26 aa, Mycobacterium
LETGTWLRLHPRFDIDTMLHHVESDR

SEQ ID NO: 1271131 - protein, 23 aa, Mycobacterium
LETHLGWVAKAGWNIDVAAGTPE

SEQ ID NO: 1271132 - protein, 17 aa, Mycobacterium
LETLGPALLKFSPGLAA

SEQ ID NO: 1271133 - protein, 27 aa, Mycobacterium
LETMPPHPAHFLWLNWGPSPQRQDMAY

SEQ ID NO: 1271134 - protein, 23 aa, Mycobacterium
LETRGRFGTYVARSDPADAAMAT

SEQ ID NO: 1271135 - protein, 18 aa, Mycobacterium
LETSYSFIASIRASPELD

SEQ ID NO: 1271136 - protein, 23 aa, Mycobacterium
LEVALRLPELDYIGVMGSRRTHH

SEQ ID NO: 1271137 - protein, 21 aa, Mycobacterium
LEVDRDCFARIAPGLPSNVIR

SEQ ID NO: 1271138 - protein, 25 aa, Mycobacterium
LEVLPRPGVDLQMINAIARRAPESL

SEQ ID NO: 1271139 - protein, 19 aa, Mycobacterium
LEVPGLVYTATRKDAERYA

SEQ ID NO: 1271140 - protein, 20 aa, Mycobacterium
LEVRDGGKLIREMVSQMRSL

SEQ ID NO: 1271141 - protein, 21 aa, Mycobacterium
LEVTSRLAAPLLPLITEVIWR

SEQ ID NO: 1271142 - protein, 20 aa, Mycobacterium
LEYGINWWAWILRGVYPPPA

SEQ ID NO: 1271143 - protein, 25 aa, Mycobacterium
LEYHVRSCRVDAPGGRRELDEAVGR

SEQ ID NO: 1271144 - protein, 27 aa, Mycobacterium
LEYRDRTCVVPGCAATRGLHAHHIQHW

SEQ ID NO: 1271145 - protein, 30 aa, Mycobacterium
LFAAGLPRPVRRVPLLGARLRELLDPSARY

SEQ ID NO: 1271146 - protein, 23 aa, Mycobacterium
LFACKLKTDIAFLGRDAVERART

SEQ ID NO: 1271147 - protein, 17 aa, Mycobacterium
LFAEIGPFFADRSGGYT

SEQ ID NO: 1271148 - protein, 17 aa, Mycobacterium
LFAPIAFGSGYGGDSSW

SEQ ID NO: 1271149 - protein, 23 aa, Mycobacterium
LFARELAAAKGLRDGTHYDDELV

SEQ ID NO: 1271150 - protein, 18 aa, Mycobacterium
LFARLSVFAGGFDLAGAH

SEQ ID NO: 1271151 - protein, 19 aa, Mycobacterium
LFASCRGQEAAQIGAAACL

SEQ ID NO: 1271152 - protein, 18 aa, Mycobacterium
LFASEVAMEIALNAVRIH

SEQ ID NO: 1271153 - protein, 22 aa, Mycobacterium
LFASEVAMEIALNAVRIHGGYG

SEQ ID NO: 1271154 - protein, 26 aa, Mycobacterium
LFEFKTGLRPPVPLHEVESVDSIVTR

SEQ ID NO: 1271155 - protein, 24 aa, Mycobacterium
LFEHDARSALPVAQSLLASMSAQN

SEQ ID NO: 1271156 - protein, 20 aa, Mycobacterium
LFERAQRDGIGWRELGDRET

SEQ ID NO: 1271157 - protein, 37 aa, Mycobacterium
LFFPAGHCKGVCIGGYLLQGGYGWNSRVLGPACESVL

SEQ ID NO: 1271158 - protein, 24 aa, Mycobacterium
LFFPDGQCLFGPVLIDPPVGKAAL

SEQ ID NO: 1271159 - protein, 17 aa, Mycobacterium
LFGGAWEQTFRDIIDEG

SEQ ID NO: 1271160 - protein, 29 aa, Mycobacterium
LFGHCMGALVGFEFTRLAAQRGVTVRELW

SEQ ID NO: 1271161 - protein, 18 aa, Mycobacterium
LFGNEYFHLLQLDPIDGG

SEQ ID NO: 1271162 - protein, 17 aa, Mycobacterium
LFGPDVFDRLALITLGR

SEQ ID NO: 1271163 - protein, 25 aa, Mycobacterium
LFHARAKLRRKGCDLLVVNAVGENR

SEQ ID NO: 1271164 - protein, 19 aa, Mycobacterium
LFIAPSTVRTHLQRARAKY

SEQ ID NO: 1271165 - protein, 17 aa, Mycobacterium
LFIRHALVEGDWQTKHH

SEQ ID NO: 1271166 - protein, 18 aa, Mycobacterium
LFLALLRQECEAVIAQVD

SEQ ID NO: 1271167 - protein, 17 aa, Mycobacterium
LFLAVSDRYWRRYFENF

SEQ ID NO: 1271168 - protein, 17 aa, Mycobacterium
LFLDGRSLLRAKYTDRR

SEQ ID NO: 1271169 - protein, 17 aa, Mycobacterium
LFLDMVRRRGRIRMEAL

SEQ ID NO: 1271170 - protein, 20 aa, Mycobacterium
LFLEGCGRTDFPGGNVDDMF

SEQ ID NO: 1271171 - protein, 24 aa, Mycobacterium
LFLPLRYGQVTLRDKMPRRFYCRA

SEQ ID NO: 1271172 - protein, 21 aa, Mycobacterium
LFLRSVMSMLLLPGSHSDEVP

SEQ ID NO: 1271173 - protein, 17 aa, Mycobacterium
LFNEVFFDDVFVPDRDV

SEQ ID NO: 1271174 - protein, 26 aa, Mycobacterium
LFNSQPWRWVSEGAVVSLFLDDARAP

SEQ ID NO: 1271175 - protein, 18 aa, Mycobacterium
LFNSRGAPFAYLDMGWED

SEQ ID NO: 1271176 - protein, 22 aa, Mycobacterium
LFPEATICRFGVPPAEIAEPFD

SEQ ID NO: 1271177 - protein, 21 aa, Mycobacterium
LFPEMSLTAALARWAEDVLAD

SEQ ID NO: 1271178 - protein, 19 aa, Mycobacterium
LFPLIARSYALQFAQNELV

SEQ ID NO: 1271179 - protein, 18 aa, Mycobacterium
LFQGDLRFLIGPNGAGKT

SEQ ID NO: 1271180 - protein, 19 aa, Mycobacterium
LFREALRLILDPEVLVAAL

SEQ ID NO: 1271181 - protein, 22 aa, Mycobacterium
LFRNDPRVLGWDVWNEPDNPAR

SEQ ID NO: 1271182 - protein, 26 aa, Mycobacterium
LFRSPASAASFVMDPDGALRDAGLPN

SEQ ID NO: 1271183 - protein, 32 aa, Mycobacterium
LFSRNRLNVAVSRARCLAYLVCTDALLDTRAR

SEQ ID NO: 1271184 - protein, 18 aa, Mycobacterium
LFSVAPLLTAKMYRELGK

SEQ ID NO: 1271185 - protein, 24 aa, Mycobacterium
LFTQGAGAFTVFRPVREPRPSGRI

SEQ ID NO: 1271186 - protein, 18 aa, Mycobacterium
LFTTIPFVKDNLTKWWRG

SEQ ID NO: 1271187 - protein, 20 aa, Mycobacterium
LFVCTTLRLVDDEPWSVTMT

SEQ ID NO: 1271188 - protein, 17 aa, Mycobacterium
LFWRNIRTHSLHDPVDY

SEQ ID NO: 1271189 - protein, 17 aa, Mycobacterium
LGAAAARMQSRVALTEL

SEQ ID NO: 1271190 - protein, 25 aa, Mycobacterium
LGAAACARLALEPGTSAADAVGTWF

SEQ ID NO: 1271191 - protein, 25 aa, Mycobacterium
LGAACWDARAWLRRPGLAHGASADL

SEQ ID NO: 1271192 - protein, 21 aa, Mycobacterium
LGAAGVFRSKWGPAGGQHPDV

SEQ ID NO: 1271193 - protein, 20 aa, Mycobacterium
LGAAGWRGLFARNDVDPGAV

SEQ ID NO: 1271194 - protein, 18 aa, Mycobacterium
LGAAIGAFTGELARLDRD

SEQ ID NO: 1271195 - protein, 19 aa, Mycobacterium
LGAALARMEARIALDALLD

SEQ ID NO: 1271196 - protein, 19 aa, Mycobacterium
LGAALARMEARIALNALLD

SEQ ID NO: 1271197 - protein, 18 aa, Mycobacterium
LGAALARMEITTALRHIL

SEQ ID NO: 1271198 - protein, 23 aa, Mycobacterium
LGAANFKAGRFLGFASGNLCYQI

SEQ ID NO: 1271199 - protein, 24 aa, Mycobacterium
LGAANFRAGRLLAFASGNLCYQIE

SEQ ID NO: 1271200 - protein, 18 aa, Mycobacterium
LGACPALAMLATSREPIA

SEQ ID NO: 1271201 - protein, 19 aa, Mycobacterium
LGADFAYLGTRFIATRQSA

SEQ ID NO: 1271202 - protein, 18 aa, Mycobacterium
LGADFGVEAFEHVARWNA

SEQ ID NO: 1271203 - protein, 24 aa, Mycobacterium
LGADHLDAEFGYRRFTVTPRRGEL

SEQ ID NO: 1271204 - protein, 17 aa, Mycobacterium
LGAELCGLITPREVAAL

SEQ ID NO: 1271205 - protein, 23 aa, Mycobacterium
LGAELGRPIEWVRVPWVDMIPAV

SEQ ID NO: 1271206 - protein, 19 aa, Mycobacterium
LGAGAPLFTVFTHDATDTT

SEQ ID NO: 1271207 - protein, 18 aa, Mycobacterium
LGAGAPMFTVFTHDATDT

SEQ ID NO: 1271208 - protein, 39 aa, Mycobacterium
LGAGEAIDLLKGVLMPAIMSAVKPPAPLPAAPVAQAAGT

SEQ ID NO: 1271209 - protein, 27 aa, Mycobacterium
LGAGMHPWGKWGRDFTEYGVVAARAAL

SEQ ID NO: 1271210 - protein, 22 aa, Mycobacterium
LGAGPALRRGRLDRRTGSTIAA

SEQ ID NO: 1271211 - protein, 20 aa, Mycobacterium
LGAGSSRGGLILPEVGDEVL

SEQ ID NO: 1271212 - protein, 22 aa, Mycobacterium
LGAKTYRALGWTIASTPAGMRF

SEQ ID NO: 1271213 - protein, 20 aa, Mycobacterium
LGALDRPDAGSIRFQGAEIA

SEQ ID NO: 1271214 - protein, 18 aa, Mycobacterium
LGALGARTGLRTYPSSAN

SEQ ID NO: 1271215 - protein, 20 aa, Mycobacterium
LGALGLEVAEFLASHGAGHL

SEQ ID NO: 1271216 - protein, 18 aa, Mycobacterium
LGALQVWQALTERVSGRP

SEQ ID NO: 1271217 - protein, 17 aa, Mycobacterium
LGALSVTGARRYIAQQR

SEQ ID NO: 1271218 - protein, 23 aa, Mycobacterium
LGALTRYFAAYNLVCGPVVDEES

SEQ ID NO: 1271219 - protein, 20 aa, Mycobacterium
LGANHALTFLREVDSINMRR

SEQ ID NO: 1271220 - protein, 20 aa, Mycobacterium
LGANLARLELRVIFEEILRR

SEQ ID NO: 1271221 - protein, 24 aa, Mycobacterium
LGAPSLDIGLSWRQYTQVHEGLVG

SEQ ID NO: 1271222 - protein, 19 aa, Mycobacterium
LGAQTFVMWGGREGGEYDS

SEQ ID NO: 1271223 - protein, 21 aa, Mycobacterium
LGARAGELGALLASDDSRPEV

SEQ ID NO: 1271224 - protein, 25 aa, Mycobacterium
LGARQRLAIAGALLCRPQALLFDEP

SEQ ID NO: 1271225 - protein, 17 aa, Mycobacterium
LGARVVLCAAGQREAVA

SEQ ID NO: 1271226 - protein, 20 aa, Mycobacterium
LGASGVWMGSAFLTAAEYDL

SEQ ID NO: 1271227 - protein, 25 aa, Mycobacterium
LGASIQLLGVLLFDVNTRAVKRNEE

SEQ ID NO: 1271228 - protein, 18 aa, Mycobacterium
LGATFAMVEMRVVLREIL

SEQ ID NO: 1271229 - protein, 23 aa, Mycobacterium
LGATRLLDNIAIDIGVPSGPGRQ

SEQ ID NO: 1271230 - protein, 18 aa, Mycobacterium
LGAVPYNPGRYIKLEKEP

SEQ ID NO: 1271231 - protein, 23 aa, Mycobacterium
LGCEVKAMYPLGPIFHGSGLNMT

SEQ ID NO: 1271232 - protein, 19 aa, Mycobacterium
LGCITVWATTGHRFDSGEV

SEQ ID NO: 1271233 - protein, 23 aa, Mycobacterium
LGCKEALFTLGDRPEARWDEARQ

SEQ ID NO: 1271234 - protein, 18 aa, Mycobacterium
LGCVAVEFRTHYFNFASR

SEQ ID NO: 1271235 - protein, 23 aa, Mycobacterium
LGDEILAFAMANAARLGLQDVIW

SEQ ID NO: 1271236 - protein, 18 aa, Mycobacterium
LGDGVVRISIGLEGTEDL

SEQ ID NO: 1271237 - protein, 18 aa, Mycobacterium
LGDHLDRLLDGARKLRLD

SEQ ID NO: 1271238 - protein, 18 aa, Mycobacterium
LGDLDADFRRSVATVLDE

SEQ ID NO: 1271239 - protein, 26 aa, Mycobacterium
LGDLFAGKVTEHFGRPVWTISQGPQV

SEQ ID NO: 1271240 - protein, 23 aa, Mycobacterium
LGDLLATAGWGWHAETALHVLRL

SEQ ID NO: 1271241 - protein, 23 aa, Mycobacterium
LGDPKLTWHFPVRPIGPSQIVEQ

SEQ ID NO: 1271242 - protein, 26 aa, Mycobacterium
LGDPLLWSVPLHWAGVHAGILANSPE

SEQ ID NO: 1271243 - protein, 24 aa, Mycobacterium
LGDPYRWPGPRQIYRASGLSPMQY

SEQ ID NO: 1271244 - protein, 17 aa, Mycobacterium
LGDQLLHQFSLTDAADR

SEQ ID NO: 1271245 - protein, 25 aa, Mycobacterium
LGDQRLDLCDLYAFQSPTDNSRTVL

SEQ ID NO: 1271246 - protein, 18 aa, Mycobacterium
LGDRARLAMTEIPDLLAP

SEQ ID NO: 1271247 - protein, 17 aa, Mycobacterium
LGDTGRILLRPSGTEQV

SEQ ID NO: 1271248 - protein, 26 aa, Mycobacterium
LGDYRMLPRATFCQPQVASFGLTEQQ

SEQ ID NO: 1271249 - protein, 17 aa, Mycobacterium
LGDYWLAGLQVAARDHG

SEQ ID NO: 1271250 - protein, 25 aa, Mycobacterium
LGEAGFDWYEVSNWARFGGECRHNL

SEQ ID NO: 1271251 - protein, 18 aa, Mycobacterium
LGEATWAHLRMCLTCGHV

SEQ ID NO: 1271252 - protein, 20 aa, Mycobacterium
LGEGFARRYAVDGFDLVLVA

SEQ ID NO: 1271253 - protein, 32 aa, Mycobacterium
LGEGPARAWEHGRFNAPYLRDALLSAGALCET

SEQ ID NO: 1271254 - protein, 22 aa, Mycobacterium
LGEIAWDVVLSAVYIAVDELYL

SEQ ID NO: 1271255 - protein, 22 aa, Mycobacterium
LGEIPLLDMLVAVLFGCADAAD

SEQ ID NO: 1271256 - protein, 24 aa, Mycobacterium
LGEKPRGAGVFVVAHSNGCELALR

SEQ ID NO: 1271257 - protein, 19 aa, Mycobacterium
LGELAEWAADGVLGEITVV

SEQ ID NO: 1271258 - protein, 25 aa, Mycobacterium
LGELEAAIMDVVWRADEAVRVRDVL

SEQ ID NO: 1271259 - protein, 37 aa, Mycobacterium
LGELGWPLEPVFKIPGEIARDFGLTAVGAVLDTLLVS

SEQ ID NO: 1271260 - protein, 22 aa, Mycobacterium
LGELLWSFAPPDRVTRVRPASM

SEQ ID NO: 1271261 - protein, 24 aa, Mycobacterium
LGELPDRSLIAFLPVNVRPKGDEG

SEQ ID NO: 1271262 - protein, 18 aa, Mycobacterium
LGELQRKGARTFEVTEEA

SEQ ID NO: 1271263 - protein, 23 aa, Mycobacterium
LGEQFMQWFLKEQVEEVALMTTL

SEQ ID NO: 1271264 - protein, 19 aa, Mycobacterium
LGEQLRRARGERTLTDVAQ

SEQ ID NO: 1271265 - protein, 19 aa, Mycobacterium
LGESLGIPRQKLVEVLNRG

SEQ ID NO: 1271266 - protein, 26 aa, Mycobacterium
LGETELWQLAFRVVCAHPAALDTEKS

SEQ ID NO: 1271267 - protein, 19 aa, Mycobacterium
LGEYRWAFDNACADIGIDG

SEQ ID NO: 1271268 - protein, 17 aa, Mycobacterium
LGFAKTAQHNWALLHAL

SEQ ID NO: 1271269 - protein, 17 aa, Mycobacterium
LGFGEGHTHGFLTSLAR

SEQ ID NO: 1271270 - protein, 17 aa, Mycobacterium
LGFGNLYLGIAEGALAR

SEQ ID NO: 1271271 - protein, 17 aa, Mycobacterium
LGFGTGFISERWNVKEA

SEQ ID NO: 1271272 - protein, 20 aa, Mycobacterium
LGFHGWCLVELIESAARIDE

SEQ ID NO: 1271273 - protein, 24 aa, Mycobacterium
LGFPEKGIAVAVDWAVIPRSQWDT

SEQ ID NO: 1271274 - protein, 22 aa, Mycobacterium
LGFQLGSLWYISLDYINHQTSL

SEQ ID NO: 1271275 - protein, 17 aa, Mycobacterium
LGFSSAQLSTPVKDLSG

SEQ ID NO: 1271276 - protein, 18 aa, Mycobacterium
LGFYTGLVDGHFGLQTHN

SEQ ID NO: 1271277 - protein, 17 aa, Mycobacterium
LGGAISIFVMTRRHLKK

SEQ ID NO: 1271278 - protein, 19 aa, Mycobacterium
LGGALTLIGLHHLADRLLS

SEQ ID NO: 1271279 - protein, 19 aa, Mycobacterium
LGGDGDWLRRSVAALHDGG

SEQ ID NO: 1271280 - protein, 17 aa, Mycobacterium
LGGDRGAQIGMLGATPF

SEQ ID NO: 1271281 - protein, 24 aa, Mycobacterium
LGGFAWQVALAMIRRAGGAVGAPA

SEQ ID NO: 1271282 - protein, 21 aa, Mycobacterium
LGGFRNEVTFVLTGLEIEAKA

SEQ ID NO: 1271283 - protein, 27 aa, Mycobacterium
LGGGFARYSVDAAWVVPHFEKMLYDNA

SEQ ID NO: 1271284 - protein, 19 aa, Mycobacterium
LGGGWSVAMATLSFERGTA

SEQ ID NO: 1271285 - protein, 20 aa, Mycobacterium
LGGHPAFAITSDWGIAAWNT

SEQ ID NO: 1271286 - protein, 20 aa, Mycobacterium
LGGIAIKAALEKAGVAPSSV

SEQ ID NO: 1271287 - protein, 18 aa, Mycobacterium
LGGLARSAVGAMFREPRQ

SEQ ID NO: 1271288 - protein, 17 aa, Mycobacterium
LGGLKPAFRKDGTITAG

SEQ ID NO: 1271289 - protein, 18 aa, Mycobacterium
LGGLVTVTVAAWRPGGEN

SEQ ID NO: 1271290 - protein, 18 aa, Mycobacterium
LGGPERRMLFLVSATDAY

SEQ ID NO: 1271291 - protein, 17 aa, Mycobacterium
LGGPGHWRDSGMADTPA

SEQ ID NO: 1271292 - protein, 18 aa, Mycobacterium
LGGQWGGAFGTLPTGLDL

SEQ ID NO: 1271293 - protein, 24 aa, Mycobacterium
LGGRRRGACMGVLDVSHPDIQEFV

SEQ ID NO: 1271294 - protein, 22 aa, Mycobacterium
LGGRSMLAHALHTVAKVAPQHL

SEQ ID NO: 1271295 - protein, 20 aa, Mycobacterium
LGGRSRWLRRIADLTQQGVR

SEQ ID NO: 1271296 - protein, 18 aa, Mycobacterium
LGGSPVKVVSSVSLGDLD

SEQ ID NO: 1271297 - protein, 27 aa, Mycobacterium
LGGTGGTGGTGGFGGQGGQGGTGGTGG

SEQ ID NO: 1271298 - protein, 17 aa, Mycobacterium
LGGTIALRACLKHSDRI

SEQ ID NO: 1271299 - protein, 20 aa, Mycobacterium
LGGTLLFGVPTVWSRVVEDG

SEQ ID NO: 1271300 - protein, 17 aa, Mycobacterium
LGGTMRLGAYPAVLEED

SEQ ID NO: 1271301 - protein, 18 aa, Mycobacterium
LGGTMRLGAYPAVLEPNS

SEQ ID NO: 1271302 - protein, 25 aa, Mycobacterium
LGGTPMPRALFWAIQEHILGANPAV

SEQ ID NO: 1271303 - protein, 25 aa, Mycobacterium
LGGVGMAVVRWLVDHGAGRLVLNGR

SEQ ID NO: 1271304 - protein, 24 aa, Mycobacterium
LGGYRGREGLVVLGLARGGIPVAW

SEQ ID NO: 1271305 - protein, 19 aa, Mycobacterium
LGHAMLPIPAQHWTLETLG

SEQ ID NO: 1271306 - protein, 19 aa, Mycobacterium
LGHARRDVAIATELRSATE

SEQ ID NO: 1271307 - protein, 18 aa, Mycobacterium
LGHPGTAIVLGRPGGPAF

SEQ ID NO: 1271308 - protein, 26 aa, Mycobacterium
LGHVRWHDLRHAFAVMSLSAGEHYMS

SEQ ID NO: 1271309 - protein, 18 aa, Mycobacterium
LGIARRLQSGTVWVNDWH

SEQ ID NO: 1271310 - protein, 23 aa, Mycobacterium
LGIDAAAISLVFDGANTGTLGAS

SEQ ID NO: 1271311 - protein, 17 aa, Mycobacterium
LGIDVPLARHAISSVGA

SEQ ID NO: 1271312 - protein, 19 aa, Mycobacterium
LGIHPVFKTVDTCAAEFEA

SEQ ID NO: 1271313 - protein, 24 aa, Mycobacterium
LGILKDEHLGAITRALAHCRNDAT

SEQ ID NO: 1271314 - protein, 22 aa, Mycobacterium
LGIPELRAAIAGSYTARHGLTV

SEQ ID NO: 1271315 - protein, 24 aa, Mycobacterium
LGITTEWKSRWYADKQYADYIKED

SEQ ID NO: 1271316 - protein, 18 aa, Mycobacterium
LGKAELVVAGGFDDMTLE

SEQ ID NO: 1271317 - protein, 25 aa, Mycobacterium
LGKDGLPELFPWEASRYAELLRSPQ

SEQ ID NO: 1271318 - protein, 20 aa, Mycobacterium
LGKHPCVAEVFRAGDATSAL

SEQ ID NO: 1271319 - protein, 25 aa, Mycobacterium
LGKLELKPGMTLLDIGCGWGSVLQR

SEQ ID NO: 1271320 - protein, 27 aa, Mycobacterium
LGLCDVVLCALPARYLTPTSDKKPAPL

SEQ ID NO: 1271321 - protein, 17 aa, Mycobacterium
LGLDGFRLDITSLGDDS

SEQ ID NO: 1271322 - protein, 20 aa, Mycobacterium
LGLDGRVVLVTGGVRGVGAG

SEQ ID NO: 1271323 - protein, 26 aa, Mycobacterium
LGLEPPRFCAACGRKMIVQVRPDGWW

SEQ ID NO: 1271324 - protein, 18 aa, Mycobacterium
LGLFEINEAASLVQEAAH

SEQ ID NO: 1271325 - protein, 25 aa, Mycobacterium
LGLFLSLPGVNQWRTLQRVPIGGEA

SEQ ID NO: 1271326 - protein, 18 aa, Mycobacterium
LGLGAGYVRKEFEAAELP

SEQ ID NO: 1271327 - protein, 22 aa, Mycobacterium
LGLHWRSPRQAIIESFGVAGRL

SEQ ID NO: 1271328 - protein, 17 aa, Mycobacterium
LGLKAGDRVAIYMPMVP

SEQ ID NO: 1271329 - protein, 17 aa, Mycobacterium
LGLLDVDLLAAVGAGDD

SEQ ID NO: 1271330 - protein, 23 aa, Mycobacterium
LGLLGRYGAAVGEAFQLRDDLLG

SEQ ID NO: 1271331 - protein, 26 aa, Mycobacterium
LGLPMWDPRTGAGFDGLHADRVNLNQ

SEQ ID NO: 1271332 - protein, 18 aa, Mycobacterium
LGLPTAPFWFAGSVEELT

SEQ ID NO: 1271333 - protein, 17 aa, Mycobacterium
LGLQPDQRLCVVTVGGT

SEQ ID NO: 1271334 - protein, 17 aa, Mycobacterium
LGLRDRRLHAAATRCVQ

SEQ ID NO: 1271335 - protein, 25 aa, Mycobacterium
LGLRDVLAALEWVRDNIAAFGGDPG

SEQ ID NO: 1271336 - protein, 25 aa, Mycobacterium
LGLRKVPRYLPMVVRVDGLAGGVDP

SEQ ID NO: 1271337 - protein, 19 aa, Mycobacterium
LGLRPRWIDSTAVGGASWE

SEQ ID NO: 1271338 - protein, 18 aa, Mycobacterium
LGLRWPSTVSPFDVHVVI

SEQ ID NO: 1271339 - protein, 18 aa, Mycobacterium
LGLTGRRWGFGRTSTADR

SEQ ID NO: 1271340 - protein, 18 aa, Mycobacterium
LGLTPLVRYRAGAVTGAD

SEQ ID NO: 1271341 - protein, 20 aa, Mycobacterium
LGLVGHGFGASAVVFTAAGL

SEQ ID NO: 1271342 - protein, 18 aa, Mycobacterium
LGMPRDALMQLIRVFADA

SEQ ID NO: 1271343 - protein, 26 aa, Mycobacterium
LGMSGARIVLHLALELQRRGGGTGAA

SEQ ID NO: 1271344 - protein, 19 aa, Mycobacterium
LGMSPMFRSFIAGQLATLR

SEQ ID NO: 1271345 - protein, 17 aa, Mycobacterium
LGNAFNETIAWRHELAR

SEQ ID NO: 1271346 - protein, 21 aa, Mycobacterium
LGNALGAVAQWVGLQEGNDAY

SEQ ID NO: 1271347 - protein, 17 aa, Mycobacterium
LGNDTQYGLAAGVRTSD

SEQ ID NO: 1271348 - protein, 32 aa, Mycobacterium
LGNMGAPMAKRLTGWPGGLIVFDVRPDAMAPL

SEQ ID NO: 1271349 - protein, 18 aa, Mycobacterium
LGNTPLVGCPHLSPRWDD

SEQ ID NO: 1271350 - protein, 18 aa, Mycobacterium
LGNYRWCDESEATAEPVG

SEQ ID NO: 1271351 - protein, 21 aa, Mycobacterium
LGPALAAGCTVVLKPAPDAPL

SEQ ID NO: 1271352 - protein, 19 aa, Mycobacterium
LGPALAVGDPVLFKPSELT

SEQ ID NO: 1271353 - protein, 19 aa, Mycobacterium
LGPALLKFSPGLAAAYLPG

SEQ ID NO: 1271354 - protein, 19 aa, Mycobacterium
LGPDCVFKYTDVASRDDVT

SEQ ID NO: 1271355 - protein, 22 aa, Mycobacterium
LGPDECCRRNRGLVYTRVTGWG

SEQ ID NO: 1271356 - protein, 31 aa, Mycobacterium
LGPGDRLCIPVPFYHCFGMVMGNLGCTTHGA

SEQ ID NO: 1271357 - protein, 22 aa, Mycobacterium
LGPHLKALAGPYLFVGSGISRR

SEQ ID NO: 1271358 - protein, 20 aa, Mycobacterium
LGPHRLRRFVSRIAARIDGA

SEQ ID NO: 1271359 - protein, 19 aa, Mycobacterium
LGPQRPALIFLNSPSNPTG

SEQ ID NO: 1271360 - protein, 27 aa, Mycobacterium
LGPRLCSLCVALGAPVRDWWQISRWAT

SEQ ID NO: 1271361 - protein, 26 aa, Mycobacterium
LGPSFTLDDWRAMGLVDDGGQPIVDP

SEQ ID NO: 1271362 - protein, 18 aa, Mycobacterium
LGPTDVESFARQYSEALL

SEQ ID NO: 1271363 - protein, 21 aa, Mycobacterium
LGPVGARFLAALTEAAAAESA

SEQ ID NO: 1271364 - protein, 20 aa, Mycobacterium
LGPVRLRNRIIKAATSEGRS

SEQ ID NO: 1271365 - protein, 25 aa, Mycobacterium
LGQHGVNIMEFCKAYNAATEAQRGN

SEQ ID NO: 1271366 - protein, 18 aa, Mycobacterium
LGQLDIRLASVRALAEKE

SEQ ID NO: 1271367 - protein, 37 aa, Mycobacterium
LGQPADRAIALFVNRAYSCWATLPVPVIDRCVIDPTF

SEQ ID NO: 1271368 - protein, 21 aa, Mycobacterium
LGQPVTVRWGEPLTVSGTAWL

SEQ ID NO: 1271369 - protein, 18 aa, Mycobacterium
LGQSVLWHRLLISGDPID

SEQ ID NO: 1271370 - protein, 18 aa, Mycobacterium
LGQWPFTSGPAFGHTRNP

SEQ ID NO: 1271371 - protein, 17 aa, Mycobacterium
LGRDAKQLFVFQRTPSS

SEQ ID NO: 1271372 - protein, 20 aa, Mycobacterium
LGRGRRTVVITGTNGKSTTT

SEQ ID NO: 1271373 - protein, 25 aa, Mycobacterium
LGRKYPWALGRPASEVWAEIWDDIG

SEQ ID NO: 1271374 - protein, 26 aa, Mycobacterium
LGRMGFPVDIANAIRFLLSDEASFIT

SEQ ID NO: 1271375 - protein, 33 aa, Mycobacterium
LGRQLDLLLARRDWLWRVAESVTKLVTERKTAY

SEQ ID NO: 1271376 - protein, 17 aa, Mycobacterium
LGRQRVDPHRPHPFTDG

SEQ ID NO: 1271377 - protein, 21 aa, Mycobacterium
LGRRWPDAQVQGWDSSPEMVA

SEQ ID NO: 1271378 - protein, 18 aa, Mycobacterium
LGRTVPLATLLGGVTGAE

SEQ ID NO: 1271379 - protein, 29 aa, Mycobacterium
LGRVLRPDWTRTPTARRVVAGALVVLAGV

SEQ ID NO: 1271380 - protein, 17 aa, Mycobacterium
LGRYKRGDLVVIVAGAP

SEQ ID NO: 1271381 - protein, 24 aa, Mycobacterium
LGSDERWPHFGGRVARMAVHSALS

SEQ ID NO: 1271382 - protein, 25 aa, Mycobacterium
LGSDWPRLVAPVFDGRKAVVLDDRW

SEQ ID NO: 1271383 - protein, 20 aa, Mycobacterium
LGSGTMPWRRTVASGVNVAL

SEQ ID NO: 1271384 - protein, 21 aa, Mycobacterium
LGSRIAARFSGSGLEADIPEL

SEQ ID NO: 1271385 - protein, 25 aa, Mycobacterium
LGSRSYDVMSMIGPQPLRRGDVLTV

SEQ ID NO: 1271386 - protein, 17 aa, Mycobacterium
LGSSEGLIFDVANANFD

SEQ ID NO: 1271387 - protein, 19 aa, Mycobacterium
LGSTGVWELFWPNFPDGGL

SEQ ID NO: 1271388 - protein, 17 aa, Mycobacterium
LGSTTAFVSDIVVNPAG

SEQ ID NO: 1271389 - protein, 18 aa, Mycobacterium
LGSVSWAVAQAARVPVIV

SEQ ID NO: 1271390 - protein, 17 aa, Mycobacterium
LGTCVGRHGTLTSYLID

SEQ ID NO: 1271391 - protein, 17 aa, Mycobacterium
LGTDGRGGLTAREREVI

SEQ ID NO: 1271392 - protein, 24 aa, Mycobacterium
LGTDLRGLAGLGMADRSISNVPGR

SEQ ID NO: 1271393 - protein, 19 aa, Mycobacterium
LGTESDWDVVLDVNLRAHV

SEQ ID NO: 1271394 - protein, 24 aa, Mycobacterium
LGTFFIGQCLYQFANIYRSALRAE

SEQ ID NO: 1271395 - protein, 17 aa, Mycobacterium
LGTHVQRLATIVNGDCA

SEQ ID NO: 1271396 - protein, 19 aa, Mycobacterium
LGTNAADVMLQLSLIGGYR

SEQ ID NO: 1271397 - protein, 21 aa, Mycobacterium
LGTPYLRFTREGAFGVCTLDR

SEQ ID NO: 1271398 - protein, 18 aa, Mycobacterium
LGTRIARWRRAAGADEGL

SEQ ID NO: 1271399 - protein, 27 aa, Mycobacterium
LGTRVTIEPNLACGHCTQCRAGRYNIC

SEQ ID NO: 1271400 - protein, 22 aa, Mycobacterium
LGTRWPLPYFGAFAETNVRLYS

SEQ ID NO: 1271401 - protein, 20 aa, Mycobacterium
LGTYCGYSALRIARAAPSAR

SEQ ID NO: 1271402 - protein, 17 aa, Mycobacterium
LGVAATGAYCYSMSSRY

SEQ ID NO: 1271403 - protein, 19 aa, Mycobacterium
LGVAHCLYAGLTTDTGSFR

SEQ ID NO: 1271404 - protein, 18 aa, Mycobacterium
LGVARAALEDSLRYVQER

SEQ ID NO: 1271405 - protein, 24 aa, Mycobacterium
LGVCVGMQIMFARGVEFGVESAGC

SEQ ID NO: 1271406 - protein, 19 aa, Mycobacterium
LGVDHCFGPVMLHRVEATV

SEQ ID NO: 1271407 - protein, 28 aa, Mycobacterium
LGVDHLRKVVGWARDRGVLVASDECYLG

SEQ ID NO: 1271408 - protein, 26 aa, Mycobacterium
LGVDRPRFLGGAGRWRDSGMDGTPAR

SEQ ID NO: 1271409 - protein, 25 aa, Mycobacterium
LGVEVPRLASAVARTNELATLTDLF

SEQ ID NO: 1271410 - protein, 29 aa, Mycobacterium
LGVGPWYVIREMPQRVTYRGEPCAVTLSL

SEQ ID NO: 1271411 - protein, 19 aa, Mycobacterium
LGVGQRYRFDYDKCTGCAV

SEQ ID NO: 1271412 - protein, 26 aa, Mycobacterium
LGVRDFRFNQIISEEMFLTGSVGIGL

SEQ ID NO: 1271413 - protein, 25 aa, Mycobacterium
LGVSRPAIREALKRLAAAGLIEVRQ

SEQ ID NO: 1271414 - protein, 18 aa, Mycobacterium
LGVTAFELVVVNLYPFTQ

SEQ ID NO: 1271415 - protein, 17 aa, Mycobacterium
LGVVGVITAFNFPVAVW

SEQ ID NO: 1271416 - protein, 17 aa, Mycobacterium
LGYGPLVRAAVGFTDLW

SEQ ID NO: 1271417 - protein, 18 aa, Mycobacterium
LGYGTVWVGASPAADLAF

SEQ ID NO: 1271418 - protein, 18 aa, Mycobacterium
LGYLSEVDFYAAINRDVA

SEQ ID NO: 1271419 - protein, 27 aa, Mycobacterium
LGYRDPELLAGFWSLVEQLRISAMSAV

SEQ ID NO: 1271420 - protein, 22 aa, Mycobacterium
LGYSRWLSAILLPSRRAEDLFA

SEQ ID NO: 1271421 - protein, 17 aa, Mycobacterium
LGYYRCLVEHGPCTPAE

SEQ ID NO: 1271422 - protein, 21 aa, Mycobacterium
LHAAGGPSWIAVQGKQYEGLM

SEQ ID NO: 1271423 - protein, 20 aa, Mycobacterium
LHAARLALCAATRQVIANGL

SEQ ID NO: 1271424 - protein, 18 aa, Mycobacterium
LHAARLLADGAWLADSSS

SEQ ID NO: 1271425 - protein, 26 aa, Mycobacterium
LHAGPFDLARLGDWRDRITSFPADFS

SEQ ID NO: 1271426 - protein, 18 aa, Mycobacterium
LHAGYPVRYWDHDLGPEQ

SEQ ID NO: 1271427 - protein, 23 aa, Mycobacterium
LHAHVLLQRDVHYIVRDDAVHLI

SEQ ID NO: 1271428 - protein, 27 aa, Mycobacterium
LHAPRLWPEYHPGYYGAFVRDPDGNNV

SEQ ID NO: 1271429 - protein, 18 aa, Mycobacterium
LHAVYPLMSITHNRRIRI

SEQ ID NO: 1271430 - protein, 22 aa, Mycobacterium
LHDEPYLHYGVRAVDPPAQARQ

SEQ ID NO: 1271431 - protein, 23 aa, Mycobacterium
LHDLFAVPFDRVADILGVTPAGA

SEQ ID NO: 1271432 - protein, 19 aa, Mycobacterium
LHDPARWKYVHLGNHTLHD

SEQ ID NO: 1271433 - protein, 18 aa, Mycobacterium
LHEGLCAEQERLRDVLVM

SEQ ID NO: 1271434 - protein, 21 aa, Mycobacterium
LHELRAYLRAQLKSVRAESIP

SEQ ID NO: 1271435 - protein, 24 aa, Mycobacterium
LHEMLRHCKPLGAWGDARNALQRV

SEQ ID NO: 1271436 - protein, 27 aa, Mycobacterium
LHEQQLKHAIEWCDRATEHISGAKETV

SEQ ID NO: 1271437 - protein, 17 aa, Mycobacterium
LHFGHNYLVSSFFSPLL

SEQ ID NO: 1271438 - protein, 42 aa, Mycobacterium
LHGEAYRGHIFWDELFIFPVLNLRAPMITRSLLGYRYRRLPE

SEQ ID NO: 1271439 - protein, 17 aa, Mycobacterium
LHGGYGYMREYDVARAY

SEQ ID NO: 1271440 - protein, 26 aa, Mycobacterium
LHGHVRLTCPPGWAVEPAELPFVLPP

SEQ ID NO: 1271441 - protein, 18 aa, Mycobacterium
LHGMGFLHEACVQMWGEG

SEQ ID NO: 1271442 - protein, 18 aa, Mycobacterium
LHGPVALVHFDAHLDTWD

SEQ ID NO: 1271443 - protein, 18 aa, Mycobacterium
LHGRRSLTCRRVFSAAAA

SEQ ID NO: 1271444 - protein, 17 aa, Mycobacterium
LHGWQWNLESGRCLTTK

SEQ ID NO: 1271445 - protein, 17 aa, Mycobacterium
LHGWQWNLTNGRCLTTN

SEQ ID NO: 1271446 - protein, 21 aa, Mycobacterium
LHGYRHLPVRLGRAATATRRA

SEQ ID NO: 1271447 - protein, 21 aa, Mycobacterium
LHHEALAWYDHWLKGADTGIM

SEQ ID NO: 1271448 - protein, 25 aa, Mycobacterium
LHHPPRSGLPVIEVLDTEMVRGRTS

SEQ ID NO: 1271449 - protein, 23 aa, Mycobacterium
LHHSRVPVMVCHAAVTLGALGGP

SEQ ID NO: 1271450 - protein, 25 aa, Mycobacterium
LHHVLRTERLLSFHVDYASVTRLLS

SEQ ID NO: 1271451 - protein, 19 aa, Mycobacterium
LHIEPMKGAIDPRVRTGRV

SEQ ID NO: 1271452 - protein, 17 aa, Mycobacterium
LHIGGRLAASIKEQVCR

SEQ ID NO: 1271453 - protein, 30 aa, Mycobacterium
LHIVGFRDGKAFYRNRFVRTDAFAEENEAG

SEQ ID NO: 1271454 - protein, 24 aa, Mycobacterium
LHKKAHLPYLVYLRHPTTGGVFAS

SEQ ID NO: 1271455 - protein, 25 aa, Mycobacterium
LHLFLRRVALYRAMFGSPEDHHRAV

SEQ ID NO: 1271456 - protein, 17 aa, Mycobacterium
LHLLHGVAEHYNRSPIE

SEQ ID NO: 1271457 - protein, 19 aa, Mycobacterium
LHLTMPMSLREEGDEIGGN

SEQ ID NO: 1271458 - protein, 20 aa, Mycobacterium
LHNSQPWRWVVVDHRLDLYV

SEQ ID NO: 1271459 - protein, 23 aa, Mycobacterium
LHPADEVLWRMTHPDSDFRSVSD

SEQ ID NO: 1271460 - protein, 18 aa, Mycobacterium
LHPARPRSLRFRPRVRAP

SEQ ID NO: 1271461 - protein, 17 aa, Mycobacterium
LHPDAVYRLAIDTDGDL

SEQ ID NO: 1271462 - protein, 22 aa, Mycobacterium
LHPEYRTMPMVWYIPPLSPVVD

SEQ ID NO: 1271463 - protein, 18 aa, Mycobacterium
LHPGWPMPAGPLRVPAGV

SEQ ID NO: 1271464 - protein, 23 aa, Mycobacterium
LHPLGAPPYFAFQIILGDLGTSG

SEQ ID NO: 1271465 - protein, 17 aa, Mycobacterium
LHPLLPQRELRELHAQL

SEQ ID NO: 1271466 - protein, 20 aa, Mycobacterium
LHPMPAQAYPAILTTERVVS

SEQ ID NO: 1271467 - protein, 23 aa, Mycobacterium
LHPRDRLAAILVIVFAQQMEDVA

SEQ ID NO: 1271468 - protein, 17 aa, Mycobacterium
LHPTNLGRLVLNEPAPL

SEQ ID NO: 1271469 - protein, 29 aa, Mycobacterium
LHPYRVRHLLDRYGSLIGEVLKLASDLAA

SEQ ID NO: 1271470 - protein, 25 aa, Mycobacterium
LHPYRVRHLLDRYGSLISEVLAFAD

SEQ ID NO: 1271471 - protein, 25 aa, Mycobacterium
LHQARINMMPGFTGTGFYWHSDFET

SEQ ID NO: 1271472 - protein, 34 aa, Mycobacterium; identical to SEQ ID NO: 619530

SEQ ID NO: 1271473 - protein, 24 aa, Mycobacterium
LHQLRRAAPEIDFRAVNDRASCRF

SEQ ID NO: 1271474 - protein, 22 aa, Mycobacterium
LHRARRCEKLGIDSLWLYDHLY

SEQ ID NO: 1271475 - protein, 19 aa, Mycobacterium
LHRDALHALLPPKTREATF

SEQ ID NO: 1271476 - protein, 19 aa, Mycobacterium
LHRGPRFRGRFDMFERQPA

SEQ ID NO: 1271477 - protein, 24 aa, Mycobacterium
LHRHVKRALVLDGLLGSSRELTRR

SEQ ID NO: 1271478 - protein, 25 aa, Mycobacterium
LHRLQGLGRRTVLPGHGPDLPDLEA

SEQ ID NO: 1271479 - protein, 24 aa, Mycobacterium
LHRLSRLGEWDAMGGLIDDEVLDA

SEQ ID NO: 1271480 - protein, 24 aa, Mycobacterium
LHRRCADVRYLGSWPTGDVVGAAP

SEQ ID NO: 1271481 - protein, 17 aa, Mycobacterium
LHRRGVAAGSRVAVMSS

SEQ ID NO: 1271482 - protein, 26 aa, Mycobacterium
LHRVRFKVVPPFAGILDLTMGFAVAQ

SEQ ID NO: 1271483 - protein, 22 aa, Mycobacterium
LHRVRTRVGAVVPGEWTPKFGA

SEQ ID NO: 1271484 - protein, 27 aa, Mycobacterium
LHSAGYAVPHWPAEWGGGLSVAEQIVL

SEQ ID NO: 1271485 - protein, 18 aa, Mycobacterium
LHSSFAPLFRPGGVGRTP

SEQ ID NO: 1271486 - protein, 18 aa, Mycobacterium
LHSSLGYQSPVDYENRYR

SEQ ID NO: 1271487 - protein, 31 aa, Mycobacterium
LHSVARSHVEVGLKHPIKLIANALGSPPKDV

SEQ ID NO: 1271488 - protein, 28 aa, Mycobacterium
LHTDARIRDGLAWCYSRVQIMRFQGYRG

SEQ ID NO: 1271489 - protein, 18 aa, Mycobacterium
LHTLPPKAQQAIKEDLEN

SEQ ID NO: 1271490 - protein, 18 aa, Mycobacterium
LHTPLPVLAFTALPEVRS

SEQ ID NO: 1271491 - protein, 17 aa, Mycobacterium
LHTVIALLRQIVQGTET

SEQ ID NO: 1271492 - protein, 17 aa, Mycobacterium
LHVAGSVGLPLVLVDGV

SEQ ID NO: 1271493 - protein, 25 aa, Mycobacterium
LHVSRPALYKRLAAISDKLGVPLDD

SEQ ID NO: 1271494 - protein, 22 aa, Mycobacterium
LHWQPHLWRHLVDRVPADPPHI

SEQ ID NO: 1271495 - protein, 17 aa, Mycobacterium
LHYCLGANLARLEGRVA

SEQ ID NO: 1271496 - protein, 23 aa, Mycobacterium
LHYPDIRLVYWAGGNPFHHHQNI

SEQ ID NO: 1271497 - protein, 22 aa, Mycobacterium
LIAAALRVWPESAATPRAIPSL

SEQ ID NO: 1271498 - protein, 35 aa, Mycobacterium
LIAAGTTTKVVWFCGGHGACLSSFNDGEVVWRETM

SEQ ID NO: 1271499 - protein, 17 aa, Mycobacterium
LIAAKWNLSRTQLDEFS

SEQ ID NO: 1271500 - protein, 21 aa, Mycobacterium
LIADFYTRWFAADLSVRDLFP

SEQ ID NO: 1271501 - protein, 26 aa, Mycobacterium
LIAFARDRIGGFKLPKSVDFVDVLPR

SEQ ID NO: 1271502 - protein, 18 aa, Mycobacterium
LIAGLIATGAIDIGIACG

SEQ ID NO: 1271503 - protein, 18 aa, Mycobacterium
LIAGPGVYICDECIDLCN

SEQ ID NO: 1271504 - protein, 19 aa, Mycobacterium
LIAGTRCWTDREFLVHGER

SEQ ID NO: 1271505 - protein, 17 aa, Mycobacterium
LIAGVPVVPVPADVGAA

SEQ ID NO: 1271506 - protein, 23 aa, Mycobacterium
LIAPHYPAPWGLDATPLQQLIID

SEQ ID NO: 1271507 - protein, 17 aa, Mycobacterium
LIAPLRIGLREAGVPVR

SEQ ID NO: 1271508 - protein, 21 aa, Mycobacterium
LIARRVREARVFSEVIPHTTS

SEQ ID NO: 1271509 - protein, 18 aa, Mycobacterium
LIATVAAPPLVPRAVNAD

SEQ ID NO: 1271510 - protein, 18 aa, Mycobacterium
LIAYKDEYEVARMLTDPA

SEQ ID NO: 1271511 - protein, 21 aa, Mycobacterium
LIDAFFHRGLMLMSFDEHLMH

SEQ ID NO: 1271512 - protein, 19 aa, Mycobacterium
LIDCANAYCTVGEMVSTLK

SEQ ID NO: 1271513 - protein, 25 aa, Mycobacterium
LIDELRLGLPPQRVGGGLVPGYGSS

SEQ ID NO: 1271514 - protein, 24 aa, Mycobacterium
LIDEPWRAQRVLDHAATLASICDV

SEQ ID NO: 1271515 - protein, 23 aa, Mycobacterium
LIDERRPRYVVADAATVATDALI

SEQ ID NO: 1271516 - protein, 23 aa, Mycobacterium
LIDGLKSAGAVKIYVAESDDAES

SEQ ID NO: 1271517 - protein, 30 aa, Mycobacterium
LIDLGSCFGFFPLRLARYGIDVLATDLNDN

SEQ ID NO: 1271518 - protein, 23 aa, Mycobacterium
LIDRGRLTVAVSRTYPLEEVVAA

SEQ ID NO: 1271519 - protein, 26 aa, Mycobacterium
LIDRPLRPSFVSGLRNEIQVVVTVLS

SEQ ID NO: 1271520 - protein, 21 aa, Mycobacterium
LIDRRRGRFGGNFVAAPRFEF

SEQ ID NO: 1271521 - protein, 24 aa, Mycobacterium
LIECGAVDAVTGWHISPVRKAIAR

SEQ ID NO: 1271522 - protein, 18 aa, Mycobacterium
LIEDLRVGGMFVSSLDAD

SEQ ID NO: 1271523 - protein, 24 aa, Mycobacterium
LIEDPRFALTGVWVSSQEKVGRDA

SEQ ID NO: 1271524 - protein, 28 aa, Mycobacterium
LIEHPEQWARLAADPSLMPTAIEEMLRW

SEQ ID NO: 1271525 - protein, 18 aa, Mycobacterium
LIEKIQGGFLDFDAAIAT

SEQ ID NO: 1271526 - protein, 18 aa, Mycobacterium
LIEPGVRTGIPLLVDNPK

SEQ ID NO: 1271527 - protein, 18 aa, Mycobacterium
LIEPRDVSNAILFLLSDA

SEQ ID NO: 1271528 - protein, 17 aa, Mycobacterium
LIERCVGEFGRIDILIN

SEQ ID NO: 1271529 - protein, 18 aa, Mycobacterium
LIERGHRVAVLAVDPSST

SEQ ID NO: 1271530 - protein, 17 aa, Mycobacterium
LIERPPDLTAEWLTAVI

SEQ ID NO: 1271531 - protein, 17 aa, Mycobacterium
LIERRCGIERLSAPTER

SEQ ID NO: 1271532 - protein, 27 aa, Mycobacterium
LIEYAQLRVETGWRLVAAATTGVVNVL

SEQ ID NO: 1271533 - protein, 19 aa, Mycobacterium
LIGDECARTGMTAFNCYGP

SEQ ID NO: 1271534 - protein, 26 aa, Mycobacterium
LIGQFGIGFYASFMVADRVELLTRKA

SEQ ID NO: 1271535 - protein, 25 aa, Mycobacterium
LIGTFNISRLAAWHMSKNDPVDDEA

SEQ ID NO: 1271536 - protein, 17 aa, Mycobacterium
LIGTHGFYVDITPTDTQ

SEQ ID NO: 1271537 - protein, 24 aa, Mycobacterium
LIHKRAHGAAVVLFENRPIGLVTE

SEQ ID NO: 1271538 - protein, 22 aa, Mycobacterium
LIHQYRHAFGRRLWELPAGLLD

SEQ ID NO: 1271539 - protein, 17 aa, Mycobacterium
LIIGRRATRFRPMSDDS

SEQ ID NO: 1271540 - protein, 26 aa, Mycobacterium
LIKAILCLEHKAIPATLHYTSPNPEL

SEQ ID NO: 1271541 - protein, 23 aa, Mycobacterium
LIKDGDRIAGAFGYYRETGKFVL

SEQ ID NO: 1271542 - protein, 18 aa, Mycobacterium
LIKNIEVAARTGGGDPAG

SEQ ID NO: 1271543 - protein, 17 aa, Mycobacterium
LILAALEAWTDTHRYAA

SEQ ID NO: 1271544 - protein, 17 aa, Mycobacterium
LILAGGLAAEGLNLRSA

SEQ ID NO: 1271545 - protein, 18 aa, Mycobacterium
LILDSGGAAYAFEGLSGA

SEQ ID NO: 1271546 - protein, 17 aa, Mycobacterium
LILKPAPDTPWCAAAVG

SEQ ID NO: 1271547 - protein, 24 aa, Mycobacterium
LILLFGLGLAWAHWPDPRSVTEDA

SEQ ID NO: 1271548 - protein, 26 aa, Mycobacterium
LILVDFKGGATFLGLERTAHVSAVIT

SEQ ID NO: 1271549 - protein, 24 aa, Mycobacterium
LIMDSLRYWVLDMHVDGFRFDLAS

SEQ ID NO: 1271550 - protein, 19 aa, Mycobacterium
LIMDSLRYWVTEMHVDGFR

SEQ ID NO: 1271551 - protein, 21 aa, Mycobacterium
LIMRQRYPVPGAPYGLAGSSG

SEQ ID NO: 1271552 - protein, 25 aa, Mycobacterium
LINHARRAAQEWTVSSELAVEVAPG

SEQ ID NO: 1271553 - protein, 19 aa, Mycobacterium
LINRRLRRALEYRDRTCVV

SEQ ID NO: 1271554 - protein, 22 aa, Mycobacterium
LIPDQRAGCSLADSITADELRA

SEQ ID NO: 1271555 - protein, 22 aa, Mycobacterium
LIPEARVGFVGLVRNEETHTPT

SEQ ID NO: 1271556 - protein, 22 aa, Mycobacterium
LIPGVLAALVHRGADFATAEDA

SEQ ID NO: 1271557 - protein, 17 aa, Mycobacterium
LIPRARILATAVSGSDP

SEQ ID NO: 1271558 - protein, 18 aa, Mycobacterium
LIPTSAFPLALQDTEAFM

SEQ ID NO: 1271559 - protein, 26 aa, Mycobacterium
LIQARGLVDVVIPRGGAGLIDAVVRD

SEQ ID NO: 1271560 - protein, 18 aa, Mycobacterium
LIQKGRAIGPVEELVMSS

SEQ ID NO: 1271561 - protein, 19 aa, Mycobacterium
LIQRGTLRVGDSVVAGDAY

SEQ ID NO: 1271562 - protein, 22 aa, Mycobacterium
LIRAFWPGALSLVVRQAPSLQW

SEQ ID NO: 1271563 - protein, 19 aa, Mycobacterium
LIRESKFGKSRIVPLHPSV

SEQ ID NO: 1271564 - protein, 23 aa, Mycobacterium
LIRHGAYRPDHFVKLTDEKLQDF

SEQ ID NO: 1271565 - protein, 26 aa, Mycobacterium
LIRHYLPGMVDRGWGRVLQIASDSAI

SEQ ID NO: 1271566 - protein, 23 aa, Mycobacterium
LIRSKGVGVLFCTQLPTDVPKEV

SEQ ID NO: 1271567 - protein, 35 aa, Mycobacterium
LISEGRFTLAVGVGYLKREFTALGVDFDERAELFE

SEQ ID NO: 1271568 - protein, 20 aa, Mycobacterium
LISERPRLTAALDKLGKLGD

SEQ ID NO: 1271569 - protein, 24 aa, Mycobacterium
LISERPRLTAALDKLGKLGDTAAA

SEQ ID NO: 1271570 - protein, 24 aa, Mycobacterium
LISGGRLTVGIGVGGRHEDYEAVS

SEQ ID NO: 1271571 - protein, 17 aa, Mycobacterium
LISQTGVVPIVYSNSVI

SEQ ID NO: 1271572 - protein, 22 aa, Mycobacterium
LITAHSATVDWLTTVLAEDALG

SEQ ID NO: 1271573 - protein, 20 aa, Mycobacterium
LITLPGFQFARHRHWVEPNR

SEQ ID NO: 1271574 - protein, 21 aa, Mycobacterium
LITLPGFQFARHRHWVEPNRN

SEQ ID NO: 1271575 - protein, 18 aa, Mycobacterium
LITTAWRRFVDLVRADAA

SEQ ID NO: 1271576 - protein, 17 aa, Mycobacterium
LIVEMLYATGIRVSELC

SEQ ID NO: 1271577 - protein, 18 aa, Mycobacterium
LIYGPARTAPWRTVEDVE

SEQ ID NO: 1271578 - protein, 17 aa, Mycobacterium
LIYRAVSSWFIKVTQFR

SEQ ID NO: 1271579 - protein, 18 aa, Mycobacterium
LKAAAAAWHALTGDLTSA

SEQ ID NO: 1271580 - protein, 17 aa, Mycobacterium
LKAAELLAQEWDVAADV

SEQ ID NO: 1271581 - protein, 17 aa, Mycobacterium
LKACMRASNEWALEEIC

SEQ ID NO: 1271582 - protein, 23 aa, Mycobacterium
LKADIRPGYTGQLTAKVQRIENA

SEQ ID NO: 1271583 - protein, 23 aa, Mycobacterium
LKAEANVALSRWGMLAPDGQCKT

SEQ ID NO: 1271584 - protein, 20 aa, Mycobacterium
LKAELDQLIANRPVIAAEIN

SEQ ID NO: 1271585 - protein, 27 aa, Mycobacterium
LKAERVRKIVCSFPRQSDSFVFDELYR

SEQ ID NO: 1271586 - protein, 20 aa, Mycobacterium
LKAEWLSQQLTALWDLLLNS

SEQ ID NO: 1271587 - protein, 17 aa, Mycobacterium
LKAGDRVAIYMPMVPEA

SEQ ID NO: 1271588 - protein, 22 aa, Mycobacterium
LKAHGADHWYAKLTTVGVPAGP

SEQ ID NO: 1271589 - protein, 21 aa, Mycobacterium
LKAITLRPRRPAGCTAADYGD

SEQ ID NO: 1271590 - protein, 30 aa, Mycobacterium
LKALDFDYVDLFLIHWPLPTLYDGDFVSTW

SEQ ID NO: 1271591 - protein, 17 aa, Mycobacterium
LKALGVRTIVASDFSPG

SEQ ID NO: 1271592 - protein, 26 aa, Mycobacterium
LKALQFLRGGRRWILKSPQHLGQLPV

SEQ ID NO: 1271593 - protein, 18 aa, Mycobacterium
LKAMADVEMWKAFAEIGI

SEQ ID NO: 1271594 - protein, 24 aa, Mycobacterium
LKAPDILLRAAAKLPDVRVLVAGG

SEQ ID NO: 1271595 - protein, 26 aa, Mycobacterium
LKAPDVLLRAAALLPDVQVLIAGGPS

SEQ ID NO: 1271596 - protein, 31 aa, Mycobacterium
LKAPLSCLSEARFGIVFGAVGAARDCLQTTL

SEQ ID NO: 1271597 - protein, 24 aa, Mycobacterium
LKAVKRIPLARALNTAQRHDYLES

SEQ ID NO: 1271598 - protein, 25 aa, Mycobacterium
LKAVLKPFGGLLAFTGLKVPFFTDG

SEQ ID NO: 1271599 - protein, 20 aa, Mycobacterium
LKDAFSYPETMPDWFTEDDL

SEQ ID NO: 1271600 - protein, 17 aa, Mycobacterium
LKDGEFVGVYPEATISR

SEQ ID NO: 1271601 - protein, 18 aa, Mycobacterium
LKDICLRVHAGEVTGILG

SEQ ID NO: 1271602 - protein, 22 aa, Mycobacterium
LKDLDYRIARKIAQAATRTPGV

SEQ ID NO: 1271603 - protein, 22 aa, Mycobacterium
LKDLRLPDFREYGVDVPAPGAT

SEQ ID NO: 1271604 - protein, 23 aa, Mycobacterium
LKDPRPILDRAIATGGVVIAGVR

SEQ ID NO: 1271605 - protein, 20 aa, Mycobacterium
LKDRFRLRLIDFQILKQLQS

SEQ ID NO: 1271606 - protein, 25 aa, Mycobacterium
LKDRGKPGGIVACALAHRANRIAHA

SEQ ID NO: 1271607 - protein, 21 aa, Mycobacterium
LKDSARYNACTALRKGLLVGL

SEQ ID NO: 1271608 - protein, 17 aa, Mycobacterium
LKDVNVFRPDVEAPSLT

SEQ ID NO: 1271609 - protein, 18 aa, Mycobacterium
LKDWKEVYEDFSHDTLQV

SEQ ID NO: 1271610 - protein, 19 aa, Mycobacterium
LKEEVFGPVAPIAGFDTEE

SEQ ID NO: 1271611 - protein, 19 aa, Mycobacterium
LKEFMVRNTYIYPPKPSMR

SEQ ID NO: 1271612 - protein, 24 aa, Mycobacterium
LKEGERLWLSWAMANRDPALFQNP

SEQ ID NO: 1271613 - protein, 19 aa, Mycobacterium
LKELCAERGMLLILDEAQT

SEQ ID NO: 1271614 - protein, 22 aa, Mycobacterium
LKENIKRQWWRAVVTSRDDVVG

SEQ ID NO: 1271615 - protein, 20 aa, Mycobacterium
LKEVREMALLLAKYGPGHPE

SEQ ID NO: 1271616 - protein, 19 aa, Mycobacterium
LKFDQRWLVVDVATTADLQ

SEQ ID NO: 1271617 - protein, 18 aa, Mycobacterium
LKGAWTDMAKGGWQRVTN

SEQ ID NO: 1271618 - protein, 19 aa, Mycobacterium
LKGKSFAIIADEAHSSQAG

SEQ ID NO: 1271619 - protein, 24 aa, Mycobacterium
LKGPFRLSVLVGDRMVADGGGSII

SEQ ID NO: 1271620 - protein, 17 aa, Mycobacterium
LKGSADFHALEYRHNRI

SEQ ID NO: 1271621 - protein, 18 aa, Mycobacterium
LKGTFAVTRHACEYWRAQ

SEQ ID NO: 1271622 - protein, 17 aa, Mycobacterium
LKGTVAVRYRDRARRYV

SEQ ID NO: 1271623 - protein, 18 aa, Mycobacterium
LKHLALIAHHCYSSYDLA

SEQ ID NO: 1271624 - protein, 27 aa, Mycobacterium
LKHRLARSLFLYALCNGWIGEDTTVIE

SEQ ID NO: 1271625 - protein, 17 aa, Mycobacterium
LKIDGVALSLVYRDGRL

SEQ ID NO: 1271626 - protein, 19 aa, Mycobacterium
LKIHSHFSGLGFAMSAFEG

SEQ ID NO: 1271627 - protein, 18 aa, Mycobacterium
LKITGDWQKFKGLPGAEG

SEQ ID NO: 1271628 - protein, 27 aa, Mycobacterium
LKIVGPVGPSWRKGPYTVPGRGPRDTY

SEQ ID NO: 1271629 - protein, 22 aa, Mycobacterium
LKKAQTRLADLVERSGILVFAS

SEQ ID NO: 1271630 - protein, 17 aa, Mycobacterium
LKKDGFTNFTILEKAAD

SEQ ID NO: 1271631 - protein, 22 aa, Mycobacterium
LKKLTTGIATWIRDRTVLFDGE

SEQ ID NO: 1271632 - protein, 17 aa, Mycobacterium
LKLARKVTGRESIISFT

SEQ ID NO: 1271633 - protein, 23 aa, Mycobacterium
LKLHRRPRVCGSSLYVYPIELAE

SEQ ID NO: 1271634 - protein, 21 aa, Mycobacterium
LKLLCRRPYATAGEPFDYPLS

SEQ ID NO: 1271635 - protein, 21 aa, Mycobacterium
LKLRRDGRFALTRLGHALRVD

SEQ ID NO: 1271636 - protein, 17 aa, Mycobacterium
LKLSAGTVFEHLHQSGS

SEQ ID NO: 1271637 - protein, 20 aa, Mycobacterium
LKMGRGSVWESAYAAVYLLA

SEQ ID NO: 1271638 - protein, 19 aa, Mycobacterium
LKMLGEEALAYDPNPDVSQ

SEQ ID NO: 1271639 - protein, 17 aa, Mycobacterium
LKMLVRQYLSGVAARSQ

SEQ ID NO: 1271640 - protein, 27 aa, Mycobacterium
LKMRTREHYAWLLAEHIYPTFGAMPVG

SEQ ID NO: 1271641 - protein, 18 aa, Mycobacterium
LKMSEVGIAYGMTETSPV

SEQ ID NO: 1271642 - protein, 24 aa, Mycobacterium
LKPALGRFGVWTGAPVSPDQAVEI

SEQ ID NO: 1271643 - protein, 24 aa, Mycobacterium
LKPAPDTPWAAAVLGELIAEHTDF

SEQ ID NO: 1271644 - protein, 25 aa, Mycobacterium
LKPAPDTPWCAAAVGEIIAEHTDFP

SEQ ID NO: 1271645 - protein, 25 aa, Mycobacterium
LKPENLQAIGAFKVRGAFNAIARLD

SEQ ID NO: 1271646 - protein, 21 aa, Mycobacterium
LKPGGALAITVPRWLPERICW

SEQ ID NO: 1271647 - protein, 20 aa, Mycobacterium
LKPILGDAGLPIIGHMIEIF

SEQ ID NO: 1271648 - protein, 19 aa, Mycobacterium
LKPRKAFGPVRVAATGSSV

SEQ ID NO: 1271649 - protein, 25 aa, Mycobacterium
LKPVRCEVWEGFIFVNFDDDAEPLV

SEQ ID NO: 1271650 - protein, 25 aa, Mycobacterium
LKQARPDMFTGVLVQGGHHSDSMQS

SEQ ID NO: 1271651 - protein, 24 aa, Mycobacterium
LKQIGDEFMLMFAQPADAIAFGLA

SEQ ID NO: 1271652 - protein, 19 aa, Mycobacterium
LKQLCEYPVISLPAGTGLR

SEQ ID NO: 1271653 - protein, 17 aa, Mycobacterium
LKRARADCAEFAASGAR

SEQ ID NO: 1271654 - protein, 21 aa, Mycobacterium
LKRGDTVLMAAFAHAGDFAGA

SEQ ID NO: 1271655 - protein, 23 aa, Mycobacterium
LKRGDVATALSIRLVRTPEIVLL

SEQ ID NO: 1271656 - protein, 22 aa, Mycobacterium
LKRLLPDFYRPATEHPAGSGTA

SEQ ID NO: 1271657 - protein, 17 aa, Mycobacterium
LKRTFVFRETATWPDCR

SEQ ID NO: 1271658 - protein, 27 aa, Mycobacterium
LKRYLDVDGAWRDHLLVAITIEELNGT

SEQ ID NO: 1271659 - protein, 25 aa, Mycobacterium
LKRYLDVDGAWRDHLLVAITVEELS

SEQ ID NO: 1271660 - protein, 23 aa, Mycobacterium
LKSAAEMRALWDGQVPGACDSTL

SEQ ID NO: 1271661 - protein, 17 aa, Mycobacterium
LKSDRLIEIAVLVTDSE

SEQ ID NO: 1271662 - protein, 26 aa, Mycobacterium
LKSNWLRGELFAAPNVKVKVPYTNIP

SEQ ID NO: 1271663 - protein, 17 aa, Mycobacterium
LKSRGRDWLFNNPWELV

SEQ ID NO: 1271664 - protein, 17 aa, Mycobacterium
LKSTVVPSVQQVAGITR

SEQ ID NO: 1271665 - protein, 20 aa, Mycobacterium
LKSYGARMAGVVFPGETLRV

SEQ ID NO: 1271666 - protein, 25 aa, Mycobacterium
LKTDIAAWFSGLPIVSDVLPEMLTT

SEQ ID NO: 1271667 - protein, 17 aa, Mycobacterium
LKTLIEREALDPNEVEV

SEQ ID NO: 1271668 - protein, 24 aa, Mycobacterium
LKTRGAELGRAFVASLTMGSGQFC

SEQ ID NO: 1271669 - protein, 19 aa, Mycobacterium
LKTVAAWLSGQGHPVTLTT

SEQ ID NO: 1271670 - protein, 19 aa, Mycobacterium
LKVFEALRRSLPVISTTVG

SEQ ID NO: 1271671 - protein, 17 aa, Mycobacterium
LKVKITAVRKIMERIDK

SEQ ID NO: 1271672 - protein, 20 aa, Mycobacterium
LKVRACKFPDGGTLSLRHVA

SEQ ID NO: 1271673 - protein, 17 aa, Mycobacterium
LKVSGGWPDDPEEDVAA

SEQ ID NO: 1271674 - protein, 20 aa, Mycobacterium
LKWLTDYAVAEAAGMAVTVD

SEQ ID NO: 1271675 - protein, 21 aa, Mycobacterium
LKYAAAQARQTANWALDAIAG

SEQ ID NO: 1271676 - protein, 18 aa, Mycobacterium
LLAAEGFPVEPPRRRMRD

SEQ ID NO: 1271677 - protein, 25 aa, Mycobacterium
LLAAERSRIGLLLVDDAQHLDPQAA

SEQ ID NO: 1271678 - protein, 18 aa, Mycobacterium
LLAAHRLELPWGFAVGSG

SEQ ID NO: 1271679 - protein, 19 aa, Mycobacterium
LLAAMFVYDLPPSRRAPSD

SEQ ID NO: 1271680 - protein, 20 aa, Mycobacterium
LLAASGWWGKHFKDCETVHP

SEQ ID NO: 1271681 - protein, 25 aa, Mycobacterium
LLACRRGDNAAAWTSIRLALAGGDR

SEQ ID NO: 1271682 - protein, 17 aa, Mycobacterium
LLADGRTRLHVDMDMQA

SEQ ID NO: 1271683 - protein, 26 aa, Mycobacterium
LLAEFGIPITVERQVLYWLDPVGGNE

SEQ ID NO: 1271684 - protein, 22 aa, Mycobacterium
LLAELREKLELAKEPGGEKAVA

SEQ ID NO: 1271685 - protein, 18 aa, Mycobacterium
LLAERGMRVVAPFSRGYA

SEQ ID NO: 1271686 - protein, 18 aa, Mycobacterium
LLAESTLAYVDGDRFVDA

SEQ ID NO: 1271687 - protein, 18 aa, Mycobacterium
LLAGLGIGQTHIRPHVSN

SEQ ID NO: 1271688 - protein, 28 aa, Mycobacterium
LLAGLPAVRRQLFRRLLQFTGAQVRSVE

SEQ ID NO: 1271689 - protein, 17 aa, Mycobacterium
LLAHLAIPIPTVVTPQM

SEQ ID NO: 1271690 - protein, 19 aa, Mycobacterium
LLAHNCWQYAVLAFATARA

SEQ ID NO: 1271691 - protein, 18 aa, Mycobacterium
LLALCEPLDIHALTELAG

SEQ ID NO: 1271692 - protein, 19 aa, Mycobacterium
LLALLPLVGVWRGEGEGRA

SEQ ID NO: 1271693 - protein, 17 aa, Mycobacterium
LLAPGSRPAAIRYRSGV

SEQ ID NO: 1271694 - protein, 17 aa, Mycobacterium
LLAPGSRPAAIRYRTSI

SEQ ID NO: 1271695 - protein, 30 aa, Mycobacterium
LLAQMFGAGCRRLVLASSMVVYGQGRYVCP

SEQ ID NO: 1271696 - protein, 19 aa, Mycobacterium
LLATFLPAFRNDYRALQAY

SEQ ID NO: 1271697 - protein, 18 aa, Mycobacterium
LLATVSLDQSYAARRPHE

SEQ ID NO: 1271698 - protein, 20 aa, Mycobacterium
LLCEPRPGRPRVVGDEQIKD

SEQ ID NO: 1271699 - protein, 17 aa, Mycobacterium
LLDAAAIEIDWAETQFG

SEQ ID NO: 1271700 - protein, 17 aa, Mycobacterium
LLDALALADKVVVVDNG

SEQ ID NO: 1271701 - protein, 20 aa, Mycobacterium
LLDAMGYRPAGPDGAYAHPS

SEQ ID NO: 1271702 - protein, 18 aa, Mycobacterium
LLDEGICVFLPNVRGSGG

SEQ ID NO: 1271703 - protein, 23 aa, Mycobacterium
LLDEYRLTGGVPAGAFVRDGHTG

SEQ ID NO: 1271704 - protein, 17 aa, Mycobacterium
LLDGRRYGLPYDGDIHI

SEQ ID NO: 1271705 - protein, 23 aa, Mycobacterium
LLDHARATVRWTDAGREITAAVL

SEQ ID NO: 1271706 - protein, 23 aa, Mycobacterium
LLDIGCGWGSVLQRAVEKHDVNV

SEQ ID NO: 1271707 - protein, 20 aa, Mycobacterium
LLDKERPMQLIVAGKSHPAD

SEQ ID NO: 1271708 - protein, 20 aa, Mycobacterium
LLDKRLHGVGHALLASIDVR

SEQ ID NO: 1271709 - protein, 26 aa, Mycobacterium
LLDLARTAGLPAKRDAMFSGAHINTS

SEQ ID NO: 1271710 - protein, 21 aa, Mycobacterium
LLDLLRLGSYQLLRTRVDDHA

SEQ ID NO: 1271711 - protein, 24 aa, Mycobacterium
LLDPAVALDGRWMREVADDMYNSP

SEQ ID NO: 1271712 - protein, 18 aa, Mycobacterium
LLDQEGRDDLALRIAVQP

SEQ ID NO: 1271713 - protein, 17 aa, Mycobacterium
LLDRASSKYALVIYAAK

SEQ ID NO: 1271714 - protein, 23 aa, Mycobacterium
LLDRLGIERAHLVGLSLGGMTAM

SEQ ID NO: 1271715 - protein, 23 aa, Mycobacterium
LLDRPSYVYPMFEQAVRIAAGET

SEQ ID NO: 1271716 - protein, 20 aa, Mycobacterium
LLDRRLADQIDRSAQIVTAG

SEQ ID NO: 1271717 - protein, 23 aa, Mycobacterium
LLDRSRYVKALAVAAKDQDVEAL

SEQ ID NO: 1271718 - protein, 24 aa, Mycobacterium
LLDSGRIPGLRGLGSGPGTRGVDG

SEQ ID NO: 1271719 - protein, 18 aa, Mycobacterium
LLDSPFILLGTHEQMAQT

SEQ ID NO: 1271720 - protein, 25 aa, Mycobacterium
LLDTRAVGTGGFWPYQKAMSRLQAD

SEQ ID NO: 1271721 - protein, 18 aa, Mycobacterium
LLDVEALEGLQLETDILV

SEQ ID NO: 1271722 - protein, 24 aa, Mycobacterium
LLDVGCGWGGALRRAVEKYDVNVI

SEQ ID NO: 1271723 - protein, 18 aa, Mycobacterium
LLDVHRLDIATGHLTLIA

SEQ ID NO: 1271724 - protein, 21 aa, Mycobacterium
LLDVMRLGARIIKRSRNTHQI

SEQ ID NO: 1271725 - protein, 19 aa, Mycobacterium
LLDVRWQLAQPDGRDDYAA

SEQ ID NO: 1271726 - protein, 36 aa, Mycobacterium
LLDVSRIQWRFERLCKQIPLAAPWTAAAAHRLDDLS

SEQ ID NO: 1271727 - protein, 28 aa, Mycobacterium
LLDYEIPGLADAIRRSGLPKVPTSVLSR

SEQ ID NO: 1271728 - protein, 20 aa, Mycobacterium
LLDYFPEDFLLVIDESHVTV

SEQ ID NO: 1271729 - protein, 17 aa, Mycobacterium
LLEAVRSPEPVVLLVDE

SEQ ID NO: 1271730 - protein, 25 aa, Mycobacterium
LLEILRGFVGLNVIGADVVEVSPAY

SEQ ID NO: 1271731 - protein, 20 aa, Mycobacterium
LLEINRRFGTPIPPETGDVD

SEQ ID NO: 1271732 - protein, 25 aa, Mycobacterium
LLEIPRALGRTGLAGGFGAPGVPLT

SEQ ID NO: 1271733 - protein, 27 aa, Mycobacterium
LLENLRAGTKFGDAALRDHVAVDGLRD

SEQ ID NO: 1271734 - protein, 19 aa, Mycobacterium
LLEQGWRPEDVALLTTGTR

SEQ ID NO: 1271735 - protein, 18 aa, Mycobacterium
LLERACADVGAPAAVGRL

SEQ ID NO: 1271736 - protein, 38 aa, Mycobacterium
LLERGLLLRIRFELDHHINLRPARLYPGVQSPLAGNPE

SEQ ID NO: 1271737 - protein, 19 aa, Mycobacterium
LLERGRFDGLFIADVLGTY

SEQ ID NO: 1271738 - protein, 20 aa, Mycobacterium
LLERLVGAAVAYLPNPRAEA

SEQ ID NO: 1271739 - protein, 28 aa, Mycobacterium
LLESKWLRPTPYMMAKFGMTLCALGIAE

SEQ ID NO: 1271740 - protein, 19 aa, Mycobacterium
LLESVELLAYVVSLSDRPA

SEQ ID NO: 1271741 - protein, 24 aa, Mycobacterium
LLEVEEVYLPLARLIHLQVAARQA

SEQ ID NO: 1271742 - protein, 20 aa, Mycobacterium
LLEYRGHELSSFIGDDGTVD

SEQ ID NO: 1271743 - protein, 18 aa, Mycobacterium
LLFASARAAVPVTPLNYR

SEQ ID NO: 1271744 - protein, 17 aa, Mycobacterium
LLFGRLTGIRAIDRDDC

SEQ ID NO: 1271745 - protein, 25 aa, Mycobacterium
LLFYHLRLRCFVVIELKIGDFDPSY

SEQ ID NO: 1271746 - protein, 25 aa, Mycobacterium
LLGARRWVRMPGVHFGPDTCTYRGG

SEQ ID NO: 1271747 - protein, 32 aa, Mycobacterium
LLGDRVLQDHAWRIAAALNWPDTYQAEYIALT

SEQ ID NO: 1271748 - protein, 19 aa, Mycobacterium
LLGECGLALALDRDKLSDL

SEQ ID NO: 1271749 - protein, 23 aa, Mycobacterium
LLGGSDAWLAMWLATSSSVPDGW

SEQ ID NO: 1271750 - protein, 18 aa, Mycobacterium
LLGGTTLRNDPKYATQEL

SEQ ID NO: 1271751 - protein, 18 aa, Mycobacterium
LLGIPAQGVRVIMRDTGG

SEQ ID NO: 1271752 - protein, 17 aa, Mycobacterium
LLGKKCYSLRIASAMAH

SEQ ID NO: 1271753 - protein, 29 aa, Mycobacterium
LLGNGSRPNGGLMSRFDGAYVPILDVSFI

SEQ ID NO: 1271754 - protein, 18 aa, Mycobacterium
LLGQVGLAEKAHVKPATL

SEQ ID NO: 1271755 - protein, 30 aa, Mycobacterium
LLGREVKKLPTLRGRTVITMFYENSTRTRV

SEQ ID NO: 1271756 - protein, 18 aa, Mycobacterium
LLGRHMLPVALARRRLQR

SEQ ID NO: 1271757 - protein, 17 aa, Mycobacterium
LLGRRFDTGSVFINSHT

SEQ ID NO: 1271758 - protein, 17 aa, Mycobacterium
LLGWARVLDSLGRICDP

SEQ ID NO: 1271759 - protein, 19 aa, Mycobacterium
LLHDLHRATGLVVHLAVLD

SEQ ID NO: 1271760 - protein, 26 aa, Mycobacterium
LLHGFPESWYSWRHQIPALANAGYRV

SEQ ID NO: 1271761 - protein, 18 aa, Mycobacterium
LLHLEPICAGMCASRGDR

SEQ ID NO: 1271762 - protein, 27 aa, Mycobacterium
LLHPMSAPMTLRWLRDRFAGRPLRTHI

SEQ ID NO: 1271763 - protein, 21 aa, Mycobacterium
LLHQYPHLLALSASSPYWDGE

SEQ ID NO: 1271764 - protein, 18 aa, Mycobacterium
LLHTVRVLLEHGLDRRAA

SEQ ID NO: 1271765 - protein, 19 aa, Mycobacterium
LLIAPRLDDRYPTYGVLAS

SEQ ID NO: 1271766 - protein, 17 aa, Mycobacterium
LLIDAAPHGDHWSGAAS

SEQ ID NO: 1271767 - protein, 18 aa, Mycobacterium
LLIGLGLAACEQGRRVRY

SEQ ID NO: 1271768 - protein, 17 aa, Mycobacterium
LLIPGFYGTNSVKWLTT

SEQ ID NO: 1271769 - protein, 19 aa, Mycobacterium
LLIPIRRAFRQYVNLRPIR

SEQ ID NO: 1271770 - protein, 20 aa, Mycobacterium
LLKIGWPAEDLAGYVDGEAH

SEQ ID NO: 1271771 - protein, 23 aa, Mycobacterium
LLKPEYRGKVALNGDPTQAGAAF

SEQ ID NO: 1271772 - protein, 26 aa, Mycobacterium
LLKWLDPPAPFYDWRANEVHPDDDAH

SEQ ID NO: 1271773 - protein, 18 aa, Mycobacterium
LLLCRSKSYRGAHSQHQT

SEQ ID NO: 1271774 - protein, 17 aa, Mycobacterium
LLLGGRGVGLAAVPSDL

SEQ ID NO: 1271775 - protein, 17 aa, Mycobacterium
LLLLAALKNGMAQRDLV

SEQ ID NO: 1271776 - protein, 18 aa, Mycobacterium
LLLRDGRVIAQGEAADVL

SEQ ID NO: 1271777 - protein, 18 aa, Mycobacterium
LLLRRERTGAGGSASISQ

SEQ ID NO: 1271778 - protein, 18 aa, Mycobacterium
LLLSHFVVAQAISGLGHT

SEQ ID NO: 1271779 - protein, 18 aa, Mycobacterium
LLLTASEPLRAGVVRAWR

SEQ ID NO: 1271780 - protein, 20 aa, Mycobacterium
LLLTVLERITLAAGGSREDF

SEQ ID NO: 1271781 - protein, 18 aa, Mycobacterium
LLMGCGDAVIGINPATDS

SEQ ID NO: 1271782 - protein, 22 aa, Mycobacterium
LLMNSRSGYKYGDVTVLDHLAY

SEQ ID NO: 1271783 - protein, 20 aa, Mycobacterium
LLMPPWRVTKFESDGVELEV

SEQ ID NO: 1271784 - protein, 17 aa, Mycobacterium
LLMRERLSSLGVPVPRY

SEQ ID NO: 1271785 - protein, 18 aa, Mycobacterium
LLMRNQRKALSRTDILRK

SEQ ID NO: 1271786 - protein, 17 aa, Mycobacterium
LLNAYIGRYPKPYVAIM

SEQ ID NO: 1271787 - protein, 21 aa, Mycobacterium
LLNGGWMAAPRSEELTELAAL

SEQ ID NO: 1271788 - protein, 19 aa, Mycobacterium
LLNWLSSDRLWFAVDGAHP

SEQ ID NO: 1271789 - protein, 24 aa, Mycobacterium
LLPEALETWPLRIFGDALPRHLEL

SEQ ID NO: 1271790 - protein, 18 aa, Mycobacterium
LLPELTLAQKWDLTANEL

SEQ ID NO: 1271791 - protein, 20 aa, Mycobacterium
LLPGRDGLVHISKLGRGKRI

SEQ ID NO: 1271792 - protein, 23 aa, Mycobacterium
LLPREALNLVKMVSEPGLAGIEV

SEQ ID NO: 1271793 - protein, 18 aa, Mycobacterium
LLPRERRALRAGDFGQLA

SEQ ID NO: 1271794 - protein, 19 aa, Mycobacterium
LLPRHLARITRDVPVRQVA

SEQ ID NO: 1271795 - protein, 20 aa, Mycobacterium
LLPSLLRYQTPMWPERALTR

SEQ ID NO: 1271796 - protein, 25 aa, Mycobacterium
LLPTLEAGMVPKIEACLRAIDGGVP

SEQ ID NO: 1271797 - protein, 25 aa, Mycobacterium
LLPTLEAGMVPKIEACLRAVTEGVP

SEQ ID NO: 1271798 - protein, 17 aa, Mycobacterium
LLPYVDFDVDACTRYAQ

SEQ ID NO: 1271799 - protein, 17 aa, Mycobacterium
LLQARTVRVAGHLLEIR

SEQ ID NO: 1271800 - protein, 19 aa, Mycobacterium
LLQEAIRLFAERRYASVGI

SEQ ID NO: 1271801 - protein, 18 aa, Mycobacterium
LLQGRRVAVLTGAGMSTD

SEQ ID NO: 1271802 - protein, 24 aa, Mycobacterium
LLQIQRRLGITSVYVTHDQEEAMT

SEQ ID NO: 1271803 - protein, 19 aa, Mycobacterium
LLQMCLEYIDRVFGAGSEL

SEQ ID NO: 1271804 - protein, 24 aa, Mycobacterium
LLQPGVLSLAWGSVVRQLAAGLGI

SEQ ID NO: 1271805 - protein, 18 aa, Mycobacterium
LLQWVPVFESDVFDRLPG

SEQ ID NO: 1271806 - protein, 21 aa, Mycobacterium
LLRAAGMRRARVVDAVVVASN

SEQ ID NO: 1271807 - protein, 22 aa, Mycobacterium
LLRAEAVLSVARRAAELNWHAV

SEQ ID NO: 1271808 - protein, 19 aa, Mycobacterium
LLRAGRQVKDLVVAEKHPD

SEQ ID NO: 1271809 - protein, 25 aa, Mycobacterium
LLRDFLVERARTCLLYSEPGAGSDL

SEQ ID NO: 1271810 - protein, 20 aa, Mycobacterium
LLRDQGFRLLAMTPDPTVQT

SEQ ID NO: 1271811 - protein, 19 aa, Mycobacterium
LLRDRLPKVVTQLHPGDIE

SEQ ID NO: 1271812 - protein, 30 aa, Mycobacterium
LLREAHDLCGLPVSVFRCDMILADTTYAGQ

SEQ ID NO: 1271813 - protein, 24 aa, Mycobacterium
LLREAVLTEGWRLHPDSDPTAAMV

SEQ ID NO: 1271814 - protein, 19 aa, Mycobacterium
LLREKRPAIAGPLLRPFFE

SEQ ID NO: 1271815 - protein, 20 aa, Mycobacterium
LLRKRRGAWIGWAGIPDSPE

SEQ ID NO: 1271816 - protein, 31 aa, Mycobacterium
LLRLPVDGILFAVEWKQFWDASWGRRPARMK

SEQ ID NO: 1271817 - protein, 24 aa, Mycobacterium
LLRMFADGVGLVYERAALAERSER

SEQ ID NO: 1271818 - protein, 17 aa, Mycobacterium
LLRRAGVIEASRDNAAE

SEQ ID NO: 1271819 - protein, 20 aa, Mycobacterium
LLRRAPRMLVATGKPFEYPR

SEQ ID NO: 1271820 - protein, 19 aa, Mycobacterium
LLRRGAWARCVQTIGAFDA

SEQ ID NO: 1271821 - protein, 18 aa, Mycobacterium
LLRRGLDVVVPAALDVLA

SEQ ID NO: 1271822 - protein, 21 aa, Mycobacterium
LLRRMGRAEFVRADIRNPFIA

SEQ ID NO: 1271823 - protein, 23 aa, Mycobacterium
LLRSYRKLMQFLRAGDAVGAEAH

SEQ ID NO: 1271824 - protein, 29 aa, Mycobacterium
LLRTYARVAGVWRAPVAVYGVDIATVSKL

SEQ ID NO: 1271825 - protein, 23 aa, Mycobacterium
LLRVDGPVPFAPRVTTEEVEVAG

SEQ ID NO: 1271826 - protein, 17 aa, Mycobacterium
LLRVFFNSWFRVEVSGI

SEQ ID NO: 1271827 - protein, 27 aa, Mycobacterium
LLRVKILPISFGFPFGFSAVLPVNLPL

SEQ ID NO: 1271828 - protein, 23 aa, Mycobacterium
LLRYPLQLIAPLARVFVARQGAY

SEQ ID NO: 1271829 - protein, 17 aa, Mycobacterium
LLRYRRAGLGAGPALRR

SEQ ID NO: 1271830 - protein, 17 aa, Mycobacterium
LLSAMYVMFAGFFHGAA

SEQ ID NO: 1271831 - protein, 18 aa, Mycobacterium
LLSCGAALDHFRVAMTAA

SEQ ID NO: 1271832 - protein, 17 aa, Mycobacterium
LLSDPFPVLNQILRNQF

SEQ ID NO: 1271833 - protein, 17 aa, Mycobacterium
LLSELGWSLHTTPLPPK

SEQ ID NO: 1271834 - protein, 19 aa, Mycobacterium
LLSERIIFLGSQVDDDIAN

SEQ ID NO: 1271835 - protein, 26 aa, Mycobacterium
LLSFARRELDNLFAARSTTNAPRTTS

SEQ ID NO: 1271836 - protein, 19 aa, Mycobacterium
LLSGLHCVIDLNSMELLRV

SEQ ID NO: 1271837 - protein, 18 aa, Mycobacterium
LLSIPAWEIQAMDRLADA

SEQ ID NO: 1271838 - protein, 25 aa, Mycobacterium
LLSKHIRLLAAFDHRHIFIDPTPDA

SEQ ID NO: 1271839 - protein, 17 aa, Mycobacterium
LLSLLVAISGARRVLEI

SEQ ID NO: 1271840 - protein, 28 aa, Mycobacterium
LLSPEIVRRLCWDWKPVEGVDATAAAVD

SEQ ID NO: 1271841 - protein, 17 aa, Mycobacterium
LLSRTALMQGFNALDQW

SEQ ID NO: 1271842 - protein, 20 aa, Mycobacterium
LLSTPGIELLLPVAAAPSVV

SEQ ID NO: 1271843 - protein, 17 aa, Mycobacterium
LLSVSESWFYKWITRAE

SEQ ID NO: 1271844 - protein, 17 aa, Mycobacterium
LLTAAGVPVELHHAESL

SEQ ID NO: 1271845 - protein, 17 aa, Mycobacterium
LLTDSRAAGSMAFAARE

SEQ ID NO: 1271846 - protein, 22 aa, Mycobacterium
LLTEAARTWSDRLLGAVSAGGE

SEQ ID NO: 1271847 - protein, 22 aa, Mycobacterium
LLTEARRALREAIGIVEELRAE

SEQ ID NO: 1271848 - protein, 21 aa, Mycobacterium
LLTEGRFILGLGTQVRAQIEK

SEQ ID NO: 1271849 - protein, 18 aa, Mycobacterium
LLTGFGLAGHTLHTVPNR

SEQ ID NO: 1271850 - protein, 17 aa, Mycobacterium
LLTGMLCEMGDRGSDSA

SEQ ID NO: 1271851 - protein, 17 aa, Mycobacterium
LLTHWARDRHRGPKFSL

SEQ ID NO: 1271852 - protein, 17 aa, Mycobacterium
LLTIEGHRVRDRGEPAL

SEQ ID NO: 1271853 - protein, 18 aa, Mycobacterium
LLTLFARWQENRDAAMPF

SEQ ID NO: 1271854 - protein, 23 aa, Mycobacterium
LLTLHPRIGRWLQLGGHCEPEDE

SEQ ID NO: 1271855 - protein, 17 aa, Mycobacterium
LLTPFGTLHGGCLSAMV

SEQ ID NO: 1271856 - protein, 24 aa, Mycobacterium
LLTRAVEEFIRFAGSIHGIPRTVA

SEQ ID NO: 1271857 - protein, 19 aa, Mycobacterium
LLTRRARAGMTTWIYEQAE

SEQ ID NO: 1271858 - protein, 18 aa, Mycobacterium
LLTSHVWRQDHNGASHQD

SEQ ID NO: 1271859 - protein, 23 aa, Mycobacterium
LLTTAVPPVAGWRDTGIPKALPA

SEQ ID NO: 1271860 - protein, 20 aa, Mycobacterium
LLTTRARAVLAHAALVFTDP

SEQ ID NO: 1271861 - protein, 18 aa, Mycobacterium
LLTVHGVLHLLGYDHAEP

SEQ ID NO: 1271862 - protein, 18 aa, Mycobacterium
LLVAAALAEGWAVSVPDH

SEQ ID NO: 1271863 - protein, 26 aa, Mycobacterium
LLVAECLRAGTWEGLDAAELAAVLSS

SEQ ID NO: 1271864 - protein, 17 aa, Mycobacterium
LLVALGPLAEEAPTLRA

SEQ ID NO: 1271865 - protein, 18 aa, Mycobacterium
LLVEKGPGFEVSRDLPKL

SEQ ID NO: 1271866 - protein, 23 aa, Mycobacterium
LLVNSRSGYKYGDVTALDHMAYD

SEQ ID NO: 1271867 - protein, 18 aa, Mycobacterium
LLVPRAGGKIRRIECEAV

SEQ ID NO: 1271868 - protein, 17 aa, Mycobacterium
LLVRARRAFRAQYPRPE

SEQ ID NO: 1271869 - protein, 17 aa, Mycobacterium
LLVRARRAFRSHYPEGG

SEQ ID NO: 1271870 - protein, 22 aa, Mycobacterium
LLVRLLRYLPGGTLIDADHLGP

SEQ ID NO: 1271871 - protein, 18 aa, Mycobacterium
LLVSGDCAKFCTSVQPRL

SEQ ID NO: 1271872 - protein, 23 aa, Mycobacterium
LLVSGRASFELTQKAVMAGIPVL

SEQ ID NO: 1271873 - protein, 33 aa, Mycobacterium
LLVSPAVDADVIWAIPQLHSLVVVREDVETEVS

SEQ ID NO: 1271874 - protein, 24 aa, Mycobacterium
LLVWDMMGRPWLTRTAEAALNPLI

SEQ ID NO: 1271875 - protein, 19 aa, Mycobacterium
LLWIHGGPLASWNAWHWRW

SEQ ID NO: 1271876 - protein, 31 aa, Mycobacterium
LLWPIKRKYGNKISWADLIAYAGNAALESAG

SEQ ID NO: 1271877 - protein, 18 aa, Mycobacterium
LLWSRPIKEYPDLKIALS

SEQ ID NO: 1271878 - protein, 21 aa, Mycobacterium
LLYHACFAPRVAEVLPDLPRL

SEQ ID NO: 1271879 - protein, 23 aa, Mycobacterium
LLYHACFAPRVAEVLPDLPRLRT

SEQ ID NO: 1271880 - protein, 18 aa, Mycobacterium
LLYTLGWHEVPAPASGDA

SEQ ID NO: 1271881 - protein, 25 aa, Mycobacterium
LMAAHDGWCALTLSRPDDIAAVPAL

SEQ ID NO: 1271882 - protein, 23 aa, Mycobacterium
LMAAVRLPSGYFRQSGTDVVADV

SEQ ID NO: 1271883 - protein, 29 aa, Mycobacterium
LMAITPKSSWPWVRTLLHSVFDQPDAESV

SEQ ID NO: 1271884 - protein, 17 aa, Mycobacterium
LMARAFPNSTFVGTDVH

SEQ ID NO: 1271885 - protein, 17 aa, Mycobacterium
LMARFTGVRTCTNRLGR

SEQ ID NO: 1271886 - protein, 19 aa, Mycobacterium
LMATYWRRYILPRRRLAAA

SEQ ID NO: 1271887 - protein, 27 aa, Mycobacterium
LMAVDDWPLLRWRMQEYRHGRWGVEIV

SEQ ID NO: 1271888 - protein, 27 aa, Mycobacterium
LMAVDDWPLLRWRMREYTHGRWGTHIV

SEQ ID NO: 1271889 - protein, 29 aa, Mycobacterium
LMAVTPKSSWPWVRTLLHSVFDQPDAESV

SEQ ID NO: 1271890 - protein, 29 aa, Mycobacterium
LMAVTPKSSWPWVRTLLHSVFDQPDSESV

SEQ ID NO: 1271891 - protein, 18 aa, Mycobacterium
LMCDVRFAAAGAKFTTAF

SEQ ID NO: 1271892 - protein, 21 aa, Mycobacterium
LMDCGERWGIFTAGMGVDGEV

SEQ ID NO: 1271893 - protein, 17 aa, Mycobacterium
LMDQAWWSPGMTHPDGR

SEQ ID NO: 1271894 - protein, 17 aa, Mycobacterium
LMESASFWSGKTTRSQL

SEQ ID NO: 1271895 - protein, 20 aa, Mycobacterium
LMFMNGWLDAVGTFNRYAVG

SEQ ID NO: 1271896 - protein, 17 aa, Mycobacterium
LMGADGYFALINQTQSV

SEQ ID NO: 1271897 - protein, 28 aa, Mycobacterium
LMGLPAEVFDCARLLNARVDNRARVSVR

SEQ ID NO: 1271898 - protein, 18 aa, Mycobacterium
LMGLQLALTELWRSYDVH

SEQ ID NO: 1271899 - protein, 21 aa, Mycobacterium
LMHAAGMWTAFAALLNGQTVI

SEQ ID NO: 1271900 - protein, 17 aa, Mycobacterium
LMIRMGRLSERFAKIRA

SEQ ID NO: 1271901 - protein, 18 aa, Mycobacterium
LMKIALAACSGMSSDQPL

SEQ ID NO: 1271902 - protein, 25 aa, Mycobacterium
LMKRADFRCAATLDEFRTERRAVTR

SEQ ID NO: 1271903 - protein, 26 aa, Mycobacterium
LMLETWKVAPALAWGNTVVLKPAEDT

SEQ ID NO: 1271904 - protein, 19 aa, Mycobacterium
LMLGGAAEHRAMIAEEYRE

SEQ ID NO: 1271905 - protein, 17 aa, Mycobacterium
LMNAVGITSESVYLSPA

SEQ ID NO: 1271906 - protein, 25 aa, Mycobacterium
LMPLAVEEMIRWVTPVKEFMRTAQQ

SEQ ID NO: 1271907 - protein, 18 aa, Mycobacterium
LMPLRYEGVWWVRAHLTT

SEQ ID NO: 1271908 - protein, 17 aa, Mycobacterium
LMRAAAIASVDGFLDQL

SEQ ID NO: 1271909 - protein, 19 aa, Mycobacterium
LMRAGEPVADIGLAAARTR

SEQ ID NO: 1271910 - protein, 19 aa, Mycobacterium
LMRIEAEGLVTVPLPGARM

SEQ ID NO: 1271911 - protein, 20 aa, Mycobacterium
LMRKGETLLVFPGGGRDMLK

SEQ ID NO: 1271912 - protein, 18 aa, Mycobacterium
LMRPDLPTGELTAFSAAA

SEQ ID NO: 1271913 - protein, 21 aa, Mycobacterium
LMRRLDPRGVIVVIEAEHLCM

SEQ ID NO: 1271914 - protein, 25 aa, Mycobacterium
LMRRLGLPVPPAFCLTTDVCAQFLA

SEQ ID NO: 1271915 - protein, 19 aa, Mycobacterium
LMRSLGIEGVRRGKRVTTT

SEQ ID NO: 1271916 - protein, 18 aa, Mycobacterium
LMRWIGRLTVSSLGFGMV

SEQ ID NO: 1271917 - protein, 28 aa, Mycobacterium
LMSMFGLHRRLRGCAVGHFAATEVTSPP

SEQ ID NO: 1271918 - protein, 19 aa, Mycobacterium
LMTDEIFGPILPVVTVQNL

SEQ ID NO: 1271919 - protein, 18 aa, Mycobacterium
LMTGCPGVFAGGDMVPSE

SEQ ID NO: 1271920 - protein, 21 aa, Mycobacterium
LMTRKEPYGAVARIIPYNHPI

SEQ ID NO: 1271921 - protein, 22 aa, Mycobacterium
LMTRRRIFVPILRVTAIEPGAV

SEQ ID NO: 1271922 - protein, 19 aa, Mycobacterium
LMVEAPFLLIRAAVPHMYR

SEQ ID NO: 1271923 - protein, 30 aa, Mycobacterium
LMVLPPLMHGAAQWAVFTAMNTGQTVVFSP

SEQ ID NO: 1271924 - protein, 20 aa, Mycobacterium
LMVNYDLPWNPNRIEQRFGR

SEQ ID NO: 1271925 - protein, 26 aa, Mycobacterium
LMYARRFSVDAAEHLCATDISAAPAV

SEQ ID NO: 1271926 - protein, 18 aa, Mycobacterium
LNAALLCVDDSRFATLVL

SEQ ID NO: 1271927 - protein, 26 aa, Mycobacterium
LNADHARWFYEFSRPGDVVEVRNTGG

SEQ ID NO: 1271928 - protein, 31 aa, Mycobacterium
LNAEAVWWGKRVLGLPIHDNWWQTETGGIMI

SEQ ID NO: 1271929 - protein, 25 aa, Mycobacterium
LNALAHCIDSLWAPNANPINSALAE

SEQ ID NO: 1271930 - protein, 19 aa, Mycobacterium
LNALRLLALCEPLDIHALT

SEQ ID NO: 1271931 - protein, 25 aa, Mycobacterium
LNARGEAFMYPRIVGHLRQRLQVED

SEQ ID NO: 1271932 - protein, 25 aa, Mycobacterium
LNAVAGKPPEEWGMDPVRYEDMIPG

SEQ ID NO: 1271933 - protein, 26 aa, Mycobacterium
LNAVESMDFGFFWATGVTKDGTILVA

SEQ ID NO: 1271934 - protein, 19 aa, Mycobacterium
LNAYLLPLLGTDGRGGLSA

SEQ ID NO: 1271935 - protein, 19 aa, Mycobacterium
LNDALHLPQDCVIHDQQNA

SEQ ID NO: 1271936 - protein, 18 aa, Mycobacterium
LNDFLGWSDMVARQEDTR

SEQ ID NO: 1271937 - protein, 18 aa, Mycobacterium
LNDFLGWSHLVGGQEDPN

SEQ ID NO: 1271938 - protein, 19 aa, Mycobacterium
LNDFPLFWDTGLLEHNIHF

SEQ ID NO: 1271939 - protein, 30 aa, Mycobacterium
LNDHEYRSAAALCRYLWLTRGLTGILEVTR

SEQ ID NO: 1271940 - protein, 19 aa, Mycobacterium
LNDICRLFNDAGAYGLNGK

SEQ ID NO: 1271941 - protein, 31 aa, Mycobacterium
LNEEKAAAIAARWGDRVCSVVGDATSYADNE

SEQ ID NO: 1271942 - protein, 17 aa, Mycobacterium
LNEIWKLQSMLTNYFHP

SEQ ID NO: 1271943 - protein, 24 aa, Mycobacterium
LNFRDVLNALGLYPGDPGPIGGEL

SEQ ID NO: 1271944 - protein, 18 aa, Mycobacterium
LNGTYNLTRLVAASVAAA

SEQ ID NO: 1271945 - protein, 22 aa, Mycobacterium
LNHPGNGVAWLANRLAPHGVSL

SEQ ID NO: 1271946 - protein, 21 aa, Mycobacterium
LNIGNPAPFGFEAPDVIMRDI

SEQ ID NO: 1271947 - protein, 22 aa, Mycobacterium
LNIGNPAPFGFEAPDVIMRDII

SEQ ID NO: 1271948 - protein, 23 aa, Mycobacterium
LNIPEERIRVVSPLVGGAFGSKS

SEQ ID NO: 1271949 - protein, 22 aa, Mycobacterium
LNIPTGIPLRYDLDADLKPTVP

SEQ ID NO: 1271950 - protein, 20 aa, Mycobacterium
LNKEIKRRADVVEIFPNPAA

SEQ ID NO: 1271951 - protein, 19 aa, Mycobacterium
LNKGIDWSGPVENMQRFAD

SEQ ID NO: 1271952 - protein, 25 aa, Mycobacterium
LNKGPGYTAMFGWPEPFADGADKKD

SEQ ID NO: 1271953 - protein, 26 aa, Mycobacterium
LNLAALWKLPVVFIVEDNGWGVSVSK

SEQ ID NO: 1271954 - protein, 18 aa, Mycobacterium
LNLAGALCTQAWSSDDGG

SEQ ID NO: 1271955 - protein, 21 aa, Mycobacterium
LNLFTTIPFVKDNLTKWWRGD

SEQ ID NO: 1271956 - protein, 25 aa, Mycobacterium
LNLLTCAPGAIGDHLLTGLGVTLPA

SEQ ID NO: 1271957 - protein, 27 aa, Mycobacterium
LNLMSRVPRKGIPLVAKRLGQGIGGLL

SEQ ID NO: 1271958 - protein, 22 aa, Mycobacterium
LNLPDMFTRLIFSLVATGVAPE

SEQ ID NO: 1271959 - protein, 27 aa, Mycobacterium
LNLRGHLKVRLGIALVEYVSAVKSGEH

SEQ ID NO: 1271960 - protein, 27 aa, Mycobacterium
LNLSEGWWPMLVGISMKDAGGYRSDDM

SEQ ID NO: 1271961 - protein, 27 aa, Mycobacterium
LNLSEGWWPMLVGMSMGDAGGYESEDM

SEQ ID NO: 1271962 - protein, 25 aa, Mycobacterium
LNLWWTWTPGASWRHPVGPASSIDK

SEQ ID NO: 1271963 - protein, 24 aa, Mycobacterium
LNMNPHWLGAHPAYTLSKYGMTLL

SEQ ID NO: 1271964 - protein, 26 aa, Mycobacterium
LNNVREAIKIARQCRTLLGANGITLE

SEQ ID NO: 1271965 - protein, 19 aa, Mycobacterium
LNPDVFYWAHATFFKSTLL

SEQ ID NO: 1271966 - protein, 17 aa, Mycobacterium
LNPLAWRNALEPGSPAP

SEQ ID NO: 1271967 - protein, 36 aa, Mycobacterium
LNPNHYLAVAIDYLFTHRPEWATGTAVGKTAVSSSI

SEQ ID NO: 1271968 - protein, 22 aa, Mycobacterium
LNPRKRIGQIIGDPMDLHELAS

SEQ ID NO: 1271969 - protein, 19 aa, Mycobacterium
LNPRLGRREIESILQQADP

SEQ ID NO: 1271970 - protein, 24 aa, Mycobacterium
LNPTRRGAALASDIARADCQVVLA

SEQ ID NO: 1271971 - protein, 19 aa, Mycobacterium
LNPVYRVGDQIVEMIRAHR

SEQ ID NO: 1271972 - protein, 18 aa, Mycobacterium
LNPWDPVYSVANYLLADP

SEQ ID NO: 1271973 - protein, 18 aa, Mycobacterium
LNQCRHRGMRICRSEAGV

SEQ ID NO: 1271974 - protein, 24 aa, Mycobacterium
LNQGEVCTCPSRSLIQADIYDEFL

SEQ ID NO: 1271975 - protein, 25 aa, Mycobacterium
LNRGIRYGVKHAFSAAGASTRQFKR

SEQ ID NO: 1271976 - protein, 17 aa, Mycobacterium
LNRIAAMGVQLTCDHRV

SEQ ID NO: 1271977 - protein, 21 aa, Mycobacterium
LNRLGGWPTIKGTRVPYDAIV

SEQ ID NO: 1271978 - protein, 22 aa, Mycobacterium
LNRLSDLLFILSRVANPDGDVL

SEQ ID NO: 1271979 - protein, 17 aa, Mycobacterium
LNRMLDVAPEFTLALIR

SEQ ID NO: 1271980 - protein, 17 aa, Mycobacterium
LNRPELIDLLASAESLL

SEQ ID NO: 1271981 - protein, 22 aa, Mycobacterium
LNRPRWPELAGRETFGGVSIHS

SEQ ID NO: 1271982 - protein, 23 aa, Mycobacterium
LNRQRPRIVTAMQKLGDFSDTAT

SEQ ID NO: 1271983 - protein, 17 aa, Mycobacterium
LNRVLRGARRIATLAGR

SEQ ID NO: 1271984 - protein, 18 aa, Mycobacterium
LNRWKSILQQSVQYQVAR

SEQ ID NO: 1271985 - protein, 28 aa, Mycobacterium
LNSKAVGVAIKWMSKFNTWAYKATGGRI

SEQ ID NO: 1271986 - protein, 23 aa, Mycobacterium
LNSRAFPAWPSRNIVHRSASSPR

SEQ ID NO: 1271987 - protein, 17 aa, Mycobacterium
LNSVLHCFSDLTRVGRV

SEQ ID NO: 1271988 - protein, 23 aa, Mycobacterium
LNTAVWSGGSFIYVPKGVHVDIP

SEQ ID NO: 1271989 - protein, 25 aa, Mycobacterium
LNTDGWNRYGWPEAAGGLGGSEIHR

SEQ ID NO: 1271990 - protein, 24 aa, Mycobacterium
LNTISAILTELGWRHANGTPVTDS

SEQ ID NO: 1271991 - protein, 24 aa, Mycobacterium
LNTLERTGGRYGLQTMCEGGGTAN

SEQ ID NO: 1271992 - protein, 18 aa, Mycobacterium
LNTRVGSLVARVIESDVR

SEQ ID NO: 1271993 - protein, 23 aa, Mycobacterium
LNTYQWSVGMGRAVAFREDGADH

SEQ ID NO: 1271994 - protein, 19 aa, Mycobacterium
LNVAAPIDAAAGANVLTYG

SEQ ID NO: 1271995 - protein, 17 aa, Mycobacterium
LNVGCIPSKALLRNAEL

SEQ ID NO: 1271996 - protein, 25 aa, Mycobacterium
LNVGCIPTKMFVYAAGVAHDIRESS

SEQ ID NO: 1271997 - protein, 17 aa, Mycobacterium
LNVIARRAGVAKGSLFQ

SEQ ID NO: 1271998 - protein, 27 aa, Mycobacterium
LNVLERPRVGTLFVIPGRGDTLRINGS

SEQ ID NO: 1271999 - protein, 19 aa, Mycobacterium
LNVPRLVSFHNLVDAAAPH

SEQ ID NO: 1272000 - protein, 19 aa, Mycobacterium
LNVSDQWVVFIDPAGMSAE

SEQ ID NO: 1272001 - protein, 25 aa, Mycobacterium
LNVVADVNAVLGFAYLHSGYYKDVE

SEQ ID NO: 1272002 - protein, 20 aa, Mycobacterium
LNYEGVDVITVFKGLQLDIG

SEQ ID NO: 1272003 - protein, 18 aa, Mycobacterium
LNYFSFDNPAGAWPLIED

SEQ ID NO: 1272004 - protein, 19 aa, Mycobacterium
LPAAARLSAHHDTRVERFG

SEQ ID NO: 1272005 - protein, 17 aa, Mycobacterium
LPAAGLPTAERWFTRLH

SEQ ID NO: 1272006 - protein, 20 aa, Mycobacterium
LPAALSYRAGIHVIAGEFNT

SEQ ID NO: 1272007 - protein, 18 aa, Mycobacterium
LPAARWTLPTPAPGWTIA

SEQ ID NO: 1272008 - protein, 21 aa, Mycobacterium
LPACPGVASGRAYTDVDAALD

SEQ ID NO: 1272009 - protein, 17 aa, Mycobacterium
LPADGALPEIARARDLL

SEQ ID NO: 1272010 - protein, 23 aa, Mycobacterium
LPADGVLFAVEWGGFWGDGWGQR

SEQ ID NO: 1272011 - protein, 19 aa, Mycobacterium
LPADLPASVIAARAAGRAI

SEQ ID NO: 1272012 - protein, 20 aa, Mycobacterium
LPADPNALVFPSRKGGFLPL

SEQ ID NO: 1272013 - protein, 17 aa, Mycobacterium
LPADRPVDPATDYADIP

SEQ ID NO: 1272014 - protein, 17 aa, Mycobacterium
LPAEGRGLAQLRSDVGM

SEQ ID NO: 1272015 - protein, 17 aa, Mycobacterium
LPAELIPTSAFPLALQD

SEQ ID NO: 1272016 - protein, 17 aa, Mycobacterium
LPAEVLDAAAVTIAKLW

SEQ ID NO: 1272017 - protein, 20 aa, Mycobacterium
LPAEWEPLGAVAVGHPAEPQ

SEQ ID NO: 1272018 - protein, 19 aa, Mycobacterium
LPAGAAWAVDLVDPAPRIQ

SEQ ID NO: 1272019 - protein, 23 aa, Mycobacterium
LPAGEQRLVVELARGSEPRSVSE

SEQ ID NO: 1272020 - protein, 23 aa, Mycobacterium
LPAGSRLLLLWGAANRDPSHFDD

SEQ ID NO: 1272021 - protein, 25 aa, Mycobacterium
LPAGTELGRFGYPGGTYLAPEGTPF

SEQ ID NO: 1272022 - protein, 19 aa, Mycobacterium
LPAHVVWADLDWVARSERL

SEQ ID NO: 1272023 - protein, 19 aa, Mycobacterium
LPAKRRYEVVNALDDERLA

SEQ ID NO: 1272024 - protein, 20 aa, Mycobacterium
LPARDRLVLQLRFFDNLTQS

SEQ ID NO: 1272025 - protein, 24 aa, Mycobacterium
LPARGHAGPLGWLYSASGDSASLL

SEQ ID NO: 1272026 - protein, 22 aa, Mycobacterium
LPARLRSGVDVADFGCGSGHAV

SEQ ID NO: 1272027 - protein, 19 aa, Mycobacterium
LPARVLRHLKSQVYELVKA

SEQ ID NO: 1272028 - protein, 17 aa, Mycobacterium
LPAVLQRHLPVVVVDQP

SEQ ID NO: 1272029 - protein, 17 aa, Mycobacterium
LPAVYGYFVRRCGDRGT

SEQ ID NO: 1272030 - protein, 23 aa, Mycobacterium
LPAWDVTCGIYAALSVVTALRHR

SEQ ID NO: 1272031 - protein, 17 aa, Mycobacterium
LPAWVDVDTRAHADRQL

SEQ ID NO: 1272032 - protein, 17 aa, Mycobacterium
LPAYLAVERQVRPTGSA

SEQ ID NO: 1272033 - protein, 17 aa, Mycobacterium
LPCSVLAVKLDRLSSRA

SEQ ID NO: 1272034 - protein, 20 aa, Mycobacterium
LPDAGMMFLNRVLRGARRIA

SEQ ID NO: 1272035 - protein, 26 aa, Mycobacterium
LPDARHAPAEWVSRAGLQEFLQEIAV

SEQ ID NO: 1272036 - protein, 21 aa, Mycobacterium
LPDCPRWKVIDRTDLPKLVDK

SEQ ID NO: 1272037 - protein, 26 aa, Mycobacterium
LPDDFALPDCPRWKVIDRSDLTDIAA

SEQ ID NO: 1272038 - protein, 20 aa, Mycobacterium
LPDDLKFTLVEPLRLLFKDE

SEQ ID NO: 1272039 - protein, 18 aa, Mycobacterium
LPDDRLDDLLALAHEVRM

SEQ ID NO: 1272040 - protein, 23 aa, Mycobacterium
LPDDRWAMIMKLHHCIADGIATM

SEQ ID NO: 1272041 - protein, 25 aa, Mycobacterium
LPDEFAADCLSEWIELATVDKRHPP

SEQ ID NO: 1272042 - protein, 23 aa, Mycobacterium
LPDEFRMAVYYADVEGFPYKEIA

SEQ ID NO: 1272043 - protein, 17 aa, Mycobacterium
LPDEGRASMGASVEIGE

SEQ ID NO: 1272044 - protein, 20 aa, Mycobacterium
LPDEPSILCAEDLAPADTAG

SEQ ID NO: 1272045 - protein, 20 aa, Mycobacterium
LPDFPQLWADMLAGQTDLQA

SEQ ID NO: 1272046 - protein, 27 aa, Mycobacterium
LPDGALMRRAAFGLATAIARELGAVAG

SEQ ID NO: 1272047 - protein, 24 aa, Mycobacterium
LPDGLRPVVVIAVGRLGDYADVAP

SEQ ID NO: 1272048 - protein, 21 aa, Mycobacterium
LPDGRDLILGNWATYNDAVGE

SEQ ID NO: 1272049 - protein, 25 aa, Mycobacterium
LPDHLRVAVLLGAFVGLRVAEVAAL

SEQ ID NO: 1272050 - protein, 18 aa, Mycobacterium
LPDIGHACGHNIIAASAV

SEQ ID NO: 1272051 - protein, 20 aa, Mycobacterium
LPDMFTRMMVSLVTTGIAPK

SEQ ID NO: 1272052 - protein, 20 aa, Mycobacterium
LPDMQRLAAGRVQLRDHAGG

SEQ ID NO: 1272053 - protein, 24 aa, Mycobacterium
LPDPACRPHAITAGPDGCWFTEWA

SEQ ID NO: 1272054 - protein, 26 aa, Mycobacterium
LPDQPIRTVVPYADFGTALTLTIGVM

SEQ ID NO: 1272055 - protein, 24 aa, Mycobacterium
LPDSTRLALLLAVVADGDLGLASR

SEQ ID NO: 1272056 - protein, 25 aa, Mycobacterium
LPDTRTSVRLVLRGRELEVRWDPRN

SEQ ID NO: 1272057 - protein, 17 aa, Mycobacterium
LPDVPAWESVEISRRPD

SEQ ID NO: 1272058 - protein, 22 aa, Mycobacterium
LPDVRYFGATFFTYVGKALGYL

SEQ ID NO: 1272059 - protein, 17 aa, Mycobacterium
LPDYCPRCNPAGHHADR

SEQ ID NO: 1272060 - protein, 22 aa, Mycobacterium
LPDYNIKWTKFDSGADVNTAFI

SEQ ID NO: 1272061 - protein, 28 aa, Mycobacterium
LPEAQLDRFAIRLELKYLNESEEVTMLR

SEQ ID NO: 1272062 - protein, 17 aa, Mycobacterium
LPEAVNALVEYYRAIAG

SEQ ID NO: 1272063 - protein, 20 aa, Mycobacterium
LPEDRFDIIKGIEETIVAND

SEQ ID NO: 1272064 - protein, 19 aa, Mycobacterium
LPEDVRLVGAQCDEANAFW

SEQ ID NO: 1272065 - protein, 21 aa, Mycobacterium
LPEELVFRVNYLGGDMPTFTL

SEQ ID NO: 1272066 - protein, 20 aa, Mycobacterium
LPEGCFPAFVAAGADGAVWA

SEQ ID NO: 1272067 - protein, 20 aa, Mycobacterium
LPELRREFPGLGDVIHCGDG

SEQ ID NO: 1272068 - protein, 22 aa, Mycobacterium
LPENPAEMVVGWVGDILSEHGN

SEQ ID NO: 1272069 - protein, 25 aa, Mycobacterium
LPEPWRVEALVLLAFSAYARGDGPL

SEQ ID NO: 1272070 - protein, 17 aa, Mycobacterium
LPERAGVAAIPMSAFCD

SEQ ID NO: 1272071 - protein, 17 aa, Mycobacterium
LPERCVIDGEIIIATDH

SEQ ID NO: 1272072 - protein, 23 aa, Mycobacterium
LPERERTVLALRFFESMTQTQIA

SEQ ID NO: 1272073 - protein, 17 aa, Mycobacterium
LPERQRLVVTMRDVLDM

SEQ ID NO: 1272074 - protein, 21 aa, Mycobacterium
LPEVVRRSGVDPADIDDIIFA

SEQ ID NO: 1272075 - protein, 23 aa, Mycobacterium
LPEWPQMLLRALMFRLAVHALHP

SEQ ID NO: 1272076 - protein, 22 aa, Mycobacterium
LPFIARAVIDALKIHPNVNASY

SEQ ID NO: 1272077 - protein, 17 aa, Mycobacterium
LPFIARAVIDALKQHPN

SEQ ID NO: 1272078 - protein, 24 aa, Mycobacterium
LPFPPEPLASIGIQATRWSLDRAD

SEQ ID NO: 1272079 - protein, 18 aa, Mycobacterium
LPFYHDMGLIKGVCAPLV

SEQ ID NO: 1272080 - protein, 17 aa, Mycobacterium
LPFYHDMGLIQGVFATL

SEQ ID NO: 1272081 - protein, 22 aa, Mycobacterium
LPFYHDMGLVLGVCAPILCGRR

SEQ ID NO: 1272082 - protein, 20 aa, Mycobacterium
LPGAVVSIGHGGRVVFHQAF

SEQ ID NO: 1272083 - protein, 26 aa, Mycobacterium
LPGELFNALSQGLSQFGINLPPMPTG

SEQ ID NO: 1272084 - protein, 19 aa, Mycobacterium
LPGEMDYHALNAMLNLYDA

SEQ ID NO: 1272085 - protein, 20 aa, Mycobacterium
LPGGGFIRRLPGPAVEVDVV

SEQ ID NO: 1272086 - protein, 19 aa, Mycobacterium
LPGGHGYDLTRLGDALVGR

SEQ ID NO: 1272087 - protein, 19 aa, Mycobacterium
LPGGLRWVARHDPAEYVAG

SEQ ID NO: 1272088 - protein, 21 aa, Mycobacterium
LPGHGFYWFQLRAPDPEPEGV

SEQ ID NO: 1272089 - protein, 19 aa, Mycobacterium
LPGHGRGRRAHPFTIADLA

SEQ ID NO: 1272090 - protein, 18 aa, Mycobacterium
LPGIDGHISVVVDRVAAR

SEQ ID NO: 1272091 - protein, 23 aa, Mycobacterium
LPGISPMAAVSIFIDGTKDILPT

SEQ ID NO: 1272092 - protein, 28 aa, Mycobacterium
LPGLAARLTLPAGWTYRSRTLDAPLTVD

SEQ ID NO: 1272093 - protein, 20 aa, Mycobacterium
LPGLLTPRFTRPYSSSLITL

SEQ ID NO: 1272094 - protein, 17 aa, Mycobacterium
LPGLLVVLRDGGYRDNE

SEQ ID NO: 1272095 - protein, 26 aa, Mycobacterium
LPGLPRIAVHWPLIDFECGPSGGADD

SEQ ID NO: 1272096 - protein, 26 aa, Mycobacterium
LPGLQRLALDRVLLRAGGDGPPTDQR

SEQ ID NO: 1272097 - protein, 18 aa, Mycobacterium
LPGLRALQKYAVRVGGGT

SEQ ID NO: 1272098 - protein, 17 aa, Mycobacterium
LPGNPTRSFRTREPVRI

SEQ ID NO: 1272099 - protein, 19 aa, Mycobacterium
LPGNVRPQISEAYQREFYR

SEQ ID NO: 1272100 - protein, 20 aa, Mycobacterium
LPGPHRVASLLKRWNAGTHH

SEQ ID NO: 1272101 - protein, 19 aa, Mycobacterium
LPGPTGSAVPTSWRSQRTT

SEQ ID NO: 1272102 - protein, 21 aa, Mycobacterium
LPGQNGGLLIGNGADGAPGVL

SEQ ID NO: 1272103 - protein, 23 aa, Mycobacterium
LPGRNRYRMSMLVPDDLSTRSHG

SEQ ID NO: 1272104 - protein, 18 aa, Mycobacterium
LPGRWKAGECTLTRPLTG

SEQ ID NO: 1272105 - protein, 29 aa, Mycobacterium
LPGRYRRVESFRQLWAVSVDVSRAAATFD

SEQ ID NO: 1272106 - protein, 19 aa, Mycobacterium
LPGSIVIAGAGAIGMEFAY

SEQ ID NO: 1272107 - protein, 21 aa, Mycobacterium
LPGTARIGAPQGWLSPASTQL

SEQ ID NO: 1272108 - protein, 17 aa, Mycobacterium
LPGTGWAEIQPEEDMLL

SEQ ID NO: 1272109 - protein, 18 aa, Mycobacterium
LPGTLSLTPALLAGIVEQ

SEQ ID NO: 1272110 - protein, 34 aa, Mycobacterium
LPGTLVPSARMVLRLNGIRVRRNGCDVLDGIDLT

SEQ ID NO: 1272111 - protein, 17 aa, Mycobacterium
LPGVGEWTAAETAQRAW

SEQ ID NO: 1272112 - protein, 22 aa, Mycobacterium
LPGVMSRWLATRLPDGQVPEVL

SEQ ID NO: 1272113 - protein, 20 aa, Mycobacterium
LPGVPLDRILAFGAEDDPTK

SEQ ID NO: 1272114 - protein, 21 aa, Mycobacterium
LPHLAVKRIRAFEPFIDDTAA

SEQ ID NO: 1272115 - protein, 19 aa, Mycobacterium
LPHLRKSTSGAHVITLAPP

SEQ ID NO: 1272116 - protein, 19 aa, Mycobacterium
LPHMRRTGAGRIVVIASEW

SEQ ID NO: 1272117 - protein, 18 aa, Mycobacterium
LPHPAVRDMLAGKVADHD

SEQ ID NO: 1272118 - protein, 18 aa, Mycobacterium
LPHPEEWGGGGQPYEVYL

SEQ ID NO: 1272119 - protein, 19 aa, Mycobacterium
LPHRLRSLIAGRLGADPEQ

SEQ ID NO: 1272120 - protein, 21 aa, Mycobacterium
LPHRMEVAWNPEFLREGKAIE

SEQ ID NO: 1272121 - protein, 17 aa, Mycobacterium
LPIFKLGDSPVKVLSSA

SEQ ID NO: 1272122 - protein, 17 aa, Mycobacterium
LPIGPSLDVAAHVEEQH

SEQ ID NO: 1272123 - protein, 17 aa, Mycobacterium
LPIPKHRLVQLQRGPSE

SEQ ID NO: 1272124 - protein, 23 aa, Mycobacterium
LPKELTWDLPLERRPPLSDLTVQ

SEQ ID NO: 1272125 - protein, 19 aa, Mycobacterium
LPKHARRCVFWEVDPSTLG

SEQ ID NO: 1272126 - protein, 23 aa, Mycobacterium
LPKHARRCVYWEVDPGIVDRGDH

SEQ ID NO: 1272127 - protein, 27 aa, Mycobacterium
LPKPGDWKKYEILDQSFIIVRGKDDVL

SEQ ID NO: 1272128 - protein, 23 aa, Mycobacterium
LPKTRVTDGVGIPISMPAYARAF

SEQ ID NO: 1272129 - protein, 17 aa, Mycobacterium
LPLAAPPDWERLTDTLT

SEQ ID NO: 1272130 - protein, 23 aa, Mycobacterium
LPLEQRAAVVAVDMQGYSIAETA

SEQ ID NO: 1272131 - protein, 19 aa, Mycobacterium
LPLETDWYYFARLFPEEVT

SEQ ID NO: 1272132 - protein, 21 aa, Mycobacterium
LPLKNRPVLPWAGTTLSVVRD

SEQ ID NO: 1272133 - protein, 35 aa, Mycobacterium
LPLLDPLRYRLIDIPWRLHHPMWLEDCPVDLDYHL

SEQ ID NO: 1272134 - protein, 23 aa, Mycobacterium
LPLLRTGGSIVLLGSVTALQGHP

SEQ ID NO: 1272135 - protein, 18 aa, Mycobacterium
LPLMADQVPIEWAGDIYC

SEQ ID NO: 1272136 - protein, 24 aa, Mycobacterium
LPLMIPRRVVMELVLTGAPMSARR

SEQ ID NO: 1272137 - protein, 18 aa, Mycobacterium
LPLNPIRTRIQHCNIQVA

SEQ ID NO: 1272138 - protein, 20 aa, Mycobacterium
LPLPDERVALMFDIGTPDVG

SEQ ID NO: 1272139 - protein, 23 aa, Mycobacterium
LPLPGEAAAALFQVVSQRYMKTS

SEQ ID NO: 1272140 - protein, 25 aa, Mycobacterium
LPLTVYYHGGGWLLGSIDSHDVATR

SEQ ID NO: 1272141 - protein, 18 aa, Mycobacterium
LPLVCTLNGAPVLATVAE

SEQ ID NO: 1272142 - protein, 19 aa, Mycobacterium
LPLYHDMGLTFLLTGFLTG

SEQ ID NO: 1272143 - protein, 23 aa, Mycobacterium
LPMADEGLRRWEVATEVRDRYLG

SEQ ID NO: 1272144 - protein, 27 aa, Mycobacterium
LPMALRLERFAVWLIFELLAVTLVDAK

SEQ ID NO: 1272145 - protein, 18 aa, Mycobacterium
LPMALTLFRRQLDVWTPG

SEQ ID NO: 1272146 - protein, 18 aa, Mycobacterium
LPMLAWMTEVVAKATVAA

SEQ ID NO: 1272147 - protein, 23 aa, Mycobacterium
LPMPKRLPPWILAKLGNGFTSSV

SEQ ID NO: 1272148 - protein, 27 aa, Mycobacterium
LPMPRGRGFLFERVFPAFWQFKPTRNY

SEQ ID NO: 1272149 - protein, 22 aa, Mycobacterium
LPMPRGRGLLFEKLYPAFWEFK

SEQ ID NO: 1272150 - protein, 19 aa, Mycobacterium
LPNAAFVQAMFQAVTPQLQ

SEQ ID NO: 1272151 - protein, 20 aa, Mycobacterium
LPNAAFVQAMFQAVTPQLQG

SEQ ID NO: 1272152 - protein, 24 aa, Mycobacterium
LPNGLPPLRLIAGGAESSATSASS

SEQ ID NO: 1272153 - protein, 32 aa, Mycobacterium
LPNGRPHLVAMWYAVLDGEIWFETKAKSQKAV

SEQ ID NO: 1272154 - protein, 18 aa, Mycobacterium
LPNLTMVVTGQWIEAASG

SEQ ID NO: 1272155 - protein, 18 aa, Mycobacterium
LPNMRTVLHCLPPKDWTE

SEQ ID NO: 1272156 - protein, 26 aa, Mycobacterium
LPNPWRTEALVLLAFSAYARGDGPLA

SEQ ID NO: 1272157 - protein, 24 aa, Mycobacterium
LPNRLDLLEALGLHNEELAHWDDV

SEQ ID NO: 1272158 - protein, 29 aa, Mycobacterium
LPNSLDWAYSVLACWKLGAVPQPLSARLP

SEQ ID NO: 1272159 - protein, 18 aa, Mycobacterium
LPNTELPADFGLPDCPRW

SEQ ID NO: 1272160 - protein, 23 aa, Mycobacterium
LPNVTCWRNAPLEELITDDGRVV

SEQ ID NO: 1272161 - protein, 19 aa, Mycobacterium
LPNWVFRIARNAIIDEYRR

SEQ ID NO: 1272162 - protein, 25 aa, Mycobacterium
LPPALRLALTPGWMALRPLAGRVVT

SEQ ID NO: 1272163 - protein, 18 aa, Mycobacterium
LPPAQRDPAVLDRVAANL

SEQ ID NO: 1272164 - protein, 20 aa, Mycobacterium
LPPDLPIGYHRLHLQVGSSD

SEQ ID NO: 1272165 - protein, 21 aa, Mycobacterium
LPPDWSGGGALAPEERAAVAR

SEQ ID NO: 1272166 - protein, 19 aa, Mycobacterium
LPPEVFEKLTPEYVAPIVS

SEQ ID NO: 1272167 - protein, 23 aa, Mycobacterium
LPPEVYDDMCALATYTRDTDESK

SEQ ID NO: 1272168 - protein, 18 aa, Mycobacterium
LPPFHQRLVNSMFTLSTL

SEQ ID NO: 1272169 - protein, 17 aa, Mycobacterium
LPPFPPLPIFDAADSAP

SEQ ID NO: 1272170 - protein, 26 aa, Mycobacterium
LPPGDPWRVLEPFARAAVVHAAATGL

SEQ ID NO: 1272171 - protein, 17 aa, Mycobacterium
LPPGYAKTLRRYRYGPG

SEQ ID NO: 1272172 - protein, 18 aa, Mycobacterium
LPPLQGLHTHSFRWDHAI

SEQ ID NO: 1272173 - protein, 25 aa, Mycobacterium
LPPLSSGLVGFFAYDLVRRLERLPE

SEQ ID NO: 1272174 - protein, 38 aa, Mycobacterium
LPPLSSGLVGFFAYDMVRRLERLPSLAVDDLGLPDMLL

SEQ ID NO: 1272175 - protein, 22 aa, Mycobacterium
LPPPGPRQLAAILQRPKGSDRE

SEQ ID NO: 1272176 - protein, 26 aa, Mycobacterium
LPPRMPVPDHFTFARYLAAGLAVLQA

SEQ ID NO: 1272177 - protein, 19 aa, Mycobacterium
LPPRRPVPLRLRDWKEVYE

SEQ ID NO: 1272178 - protein, 21 aa, Mycobacterium
LPPRVLICGVHGLDAIAALAN

SEQ ID NO: 1272179 - protein, 33 aa, Mycobacterium
LPPSAFAPLVRRGFRASLRYRVPPMPFTLSPAE

SEQ ID NO: 1272180 - protein, 19 aa, Mycobacterium
LPPSIARHIAGDDALQTGA

SEQ ID NO: 1272181 - protein, 21 aa, Mycobacterium
LPPTVTVFGLPIFKLGGSPVK

SEQ ID NO: 1272182 - protein, 26 aa, Mycobacterium
LPPVARKVMPVDLVITREQHFDPFDD

SEQ ID NO: 1272183 - protein, 17 aa, Mycobacterium
LPQAVVDDIGWARYPRV

SEQ ID NO: 1272184 - protein, 17 aa, Mycobacterium
LPQHGAMPYRSISKGWR

SEQ ID NO: 1272185 - protein, 23 aa, Mycobacterium
LPQKVGVGMARRMSMTGDYLSAD

SEQ ID NO: 1272186 - protein, 21 aa, Mycobacterium
LPQLRTFVRRRIADPDRADDL

SEQ ID NO: 1272187 - protein, 19 aa, Mycobacterium
LPQQCMRSDRMSLLNQWGM

SEQ ID NO: 1272188 - protein, 17 aa, Mycobacterium
LPQVVGRLVDYVRDREV

SEQ ID NO: 1272189 - protein, 17 aa, Mycobacterium
LPRKDKFAAPRYQAIEG

SEQ ID NO: 1272190 - protein, 26 aa, Mycobacterium
LPRLKPRMFYDLVVEVALIRPGPIQG

SEQ ID NO: 1272191 - protein, 21 aa, Mycobacterium
LPRLRGWGESMSRQAGGRAGG

SEQ ID NO: 1272192 - protein, 19 aa, Mycobacterium
LPRPGETVLASALSSTPGG

SEQ ID NO: 1272193 - protein, 18 aa, Mycobacterium
LPRSLPRGTVAVLAGARS

SEQ ID NO: 1272194 - protein, 19 aa, Mycobacterium
LPRSLPRGTVAVLAGARSL

SEQ ID NO: 1272195 - protein, 25 aa, Mycobacterium
LPRVARMNFDIVYLPPIHPIGKVHR

SEQ ID NO: 1272196 - protein, 20 aa, Mycobacterium
LPRVIPRLWQDWGPAGYDTA

SEQ ID NO: 1272197 - protein, 17 aa, Mycobacterium
LPRWSMIDKALGLDTPD

SEQ ID NO: 1272198 - protein, 19 aa, Mycobacterium
LPSAVEWRGVAPDTQVLDA

SEQ ID NO: 1272199 - protein, 20 aa, Mycobacterium
LPSDDPRIWPNIVAAELGWD

SEQ ID NO: 1272200 - protein, 21 aa, Mycobacterium
LPSERLLAEVLHVSRTTVTAA

SEQ ID NO: 1272201 - protein, 17 aa, Mycobacterium
LPSGIDYATCYAAAAMI

SEQ ID NO: 1272202 - protein, 17 aa, Mycobacterium
LPSIYYAHQRKVFERDG

SEQ ID NO: 1272203 - protein, 21 aa, Mycobacterium
LPSKFMPAPGYSAYIAPDKYA

SEQ ID NO: 1272204 - protein, 17 aa, Mycobacterium
LPSKWYIQFGEPIDTAD

SEQ ID NO: 1272205 - protein, 17 aa, Mycobacterium
LPSLMVLCGVNSAEDAI

SEQ ID NO: 1272206 - protein, 18 aa, Mycobacterium
LPSLVAAAEVFAFPSTKE

SEQ ID NO: 1272207 - protein, 23 aa, Mycobacterium
LPSRLADGVLHGCGTSDMKAGDA

SEQ ID NO: 1272208 - protein, 17 aa, Mycobacterium
LPSTFQKDGRLQSRIVP

SEQ ID NO: 1272209 - protein, 20 aa, Mycobacterium
LPSVLERRGYVLIVSSLAAY

SEQ ID NO: 1272210 - protein, 26 aa, Mycobacterium
LPSYPHPRLMPDFWEFPTVSMGLGPM

SEQ ID NO: 1272211 - protein, 21 aa, Mycobacterium
LPTAGCARHSSGLSVQTFLRG

SEQ ID NO: 1272212 - protein, 20 aa, Mycobacterium
LPTAPFWFAGSAEELGTVAQ

SEQ ID NO: 1272213 - protein, 25 aa, Mycobacterium
LPTDEVKPLIGRVFVDADLSEETTV

SEQ ID NO: 1272214 - protein, 19 aa, Mycobacterium
LPTEAEWEFAARAGSTAVY

SEQ ID NO: 1272215 - protein, 21 aa, Mycobacterium
LPTLDRAVYWLTTGYEAAKGS

SEQ ID NO: 1272216 - protein, 18 aa, Mycobacterium
LPTPALRDAGVEHPPACT

SEQ ID NO: 1272217 - protein, 19 aa, Mycobacterium
LPTPGLKSLLGYYAGEGPS

SEQ ID NO: 1272218 - protein, 17 aa, Mycobacterium
LPTPVIPSFGGGGAGAG

SEQ ID NO: 1272219 - protein, 24 aa, Mycobacterium
LPTQLCAFTAGVLRAEATHEPGYY

SEQ ID NO: 1272220 - protein, 24 aa, Mycobacterium
LPTRPRATLVLRKDSDHSINRLRL

SEQ ID NO: 1272221 - protein, 26 aa, Mycobacterium
LPTSAEIPEPLWIVQNFQHGTLNFDR

SEQ ID NO: 1272222 - protein, 17 aa, Mycobacterium
LPTTVKAGLELLGVSVG

SEQ ID NO: 1272223 - protein, 21 aa, Mycobacterium
LPTTYRLLGRTPRRLLPLRPA

SEQ ID NO: 1272224 - protein, 20 aa, Mycobacterium
LPTYAAQIVDNWIPALEGVA

SEQ ID NO: 1272225 - protein, 23 aa, Mycobacterium
LPTYAVIACSPFAASAKIGSFNF

SEQ ID NO: 1272226 - protein, 38 aa, Mycobacterium
LPVATLLIERSAAWMFDYYPLRVLREFDDGSCEATMTY

SEQ ID NO: 1272227 - protein, 17 aa, Mycobacterium
LPVCADLLAMTRQQRAV

SEQ ID NO: 1272228 - protein, 21 aa, Mycobacterium
LPVHRPRVIPGHEVVGEVVAL

SEQ ID NO: 1272229 - protein, 22 aa, Mycobacterium
LPVLGLAGSVFFTAATELGLRT

SEQ ID NO: 1272230 - protein, 17 aa, Mycobacterium
LPVLKGLGVSTVVLTGV

SEQ ID NO: 1272231 - protein, 24 aa, Mycobacterium
LPVMCDFWETVLFRAGRYRRNALH

SEQ ID NO: 1272232 - protein, 19 aa, Mycobacterium
LPVPVVMSGVATWDPEWSD

SEQ ID NO: 1272233 - protein, 19 aa, Mycobacterium
LPVQCLPGPSAVTTALAVA

SEQ ID NO: 1272234 - protein, 17 aa, Mycobacterium
LPVQDLIRMAAESRHYL

SEQ ID NO: 1272235 - protein, 18 aa, Mycobacterium
LPVTGYADLVRAVKARVP

SEQ ID NO: 1272236 - protein, 20 aa, Mycobacterium
LPWLRSLTDLPLVLKGLCHP

SEQ ID NO: 1272237 - protein, 20 aa, Mycobacterium
LPYAGVVSFGHRPFLTESEQ

SEQ ID NO: 1272238 - protein, 33 aa, Mycobacterium
LPYERSTCFWQRIAYLYSRFDALVDEVKRQGQS

SEQ ID NO: 1272239 - protein, 20 aa, Mycobacterium
LPYHHPLLLADRMVLLDHLT

SEQ ID NO: 1272240 - protein, 18 aa, Mycobacterium
LPYNVAVPALLHLLAEFP

SEQ ID NO: 1272241 - protein, 17 aa, Mycobacterium
LPYSRNASVAKLVATDA

SEQ ID NO: 1272242 - protein, 27 aa, Mycobacterium
LQAAAQRLPFLPIRAGLGSDVRAFWGD

SEQ ID NO: 1272243 - protein, 18 aa, Mycobacterium
LQAATQWDAMSHVYYEDK

SEQ ID NO: 1272244 - protein, 24 aa, Mycobacterium
LQADGRGATMIFTRTKRTAQKVAD

SEQ ID NO: 1272245 - protein, 24 aa, Mycobacterium
LQAELAELLPGCDGLDVVDSACGH

SEQ ID NO: 1272246 - protein, 26 aa, Mycobacterium
LQAESLRLDIEFHLLLAQAAQNPLLT

SEQ ID NO: 1272247 - protein, 17 aa, Mycobacterium
LQAFKPLVLHVTHDLDV

SEQ ID NO: 1272248 - protein, 22 aa, Mycobacterium
LQAGRVCGLVGMNGSGKSTLFK

SEQ ID NO: 1272249 - protein, 17 aa, Mycobacterium
LQAIEVLRARVRELEGA

SEQ ID NO: 1272250 - protein, 17 aa, Mycobacterium
LQALHAFENAGGDRLVE

SEQ ID NO: 1272251 - protein, 17 aa, Mycobacterium
LQALKRQLEDGAVQMKV

SEQ ID NO: 1272252 - protein, 20 aa, Mycobacterium
LQALLAEHVELLGAGYTLVR

SEQ ID NO: 1272253 - protein, 18 aa, Mycobacterium
LQALPGQMRTAANGLDSF

SEQ ID NO: 1272254 - protein, 18 aa, Mycobacterium
LQAPGAIQGAVPGTPLNP

SEQ ID NO: 1272255 - protein, 19 aa, Mycobacterium
LQAPLITVLGCAFATSTER

SEQ ID NO: 1272256 - protein, 23 aa, Mycobacterium
LQAPYDLVVEVARAGKLPVTLFT

SEQ ID NO: 1272257 - protein, 19 aa, Mycobacterium
LQAQMMALADAWDGAGSEA

SEQ ID NO: 1272258 - protein, 17 aa, Mycobacterium
LQAVIALLKGADLDVAL

SEQ ID NO: 1272259 - protein, 25 aa, Mycobacterium
LQAYPGYPRRSALVALGSDAMFGGP

SEQ ID NO: 1272260 - protein, 18 aa, Mycobacterium
LQAYSMTMYAGWRAVVAA

SEQ ID NO: 1272261 - protein, 24 aa, Mycobacterium
LQDDRWTYRFNLFDTARALDNQVF

SEQ ID NO: 1272262 - protein, 27 aa, Mycobacterium
LQDHPGFDCVWEYSEPLAPRNNASEAT

SEQ ID NO: 1272263 - protein, 18 aa, Mycobacterium
LQEGMAFSVEPGIYFPGQ

SEQ ID NO: 1272264 - protein, 24 aa, Mycobacterium
LQESDFRAGLVIQEVMQTKPGRQD

SEQ ID NO: 1272265 - protein, 20 aa, Mycobacterium
LQESLGMSFDAQGRYGLVSG

SEQ ID NO: 1272266 - protein, 25 aa, Mycobacterium
LQEWLRFGWYFLISRRDPAGFGEWI

SEQ ID NO: 1272267 - protein, 19 aa, Mycobacterium
LQFALKRAKAGELMLGGAA

SEQ ID NO: 1272268 - protein, 19 aa, Mycobacterium
LQFGTNHLGHFALTGLLLD

SEQ ID NO: 1272269 - protein, 27 aa, Mycobacterium
LQGALRRQIPVLGICRGAQMLNVALGG

SEQ ID NO: 1272270 - protein, 22 aa, Mycobacterium
LQGESSVACLAELADVAPTVVS

SEQ ID NO: 1272271 - protein, 25 aa, Mycobacterium
LQGLGGVYPDIFLPLHGEHQAHNAV

SEQ ID NO: 1272272 - protein, 21 aa, Mycobacterium
LQGRRCGACRIEIDQGESARI

SEQ ID NO: 1272273 - protein, 17 aa, Mycobacterium
LQGRVAIVTGGASGIGR

SEQ ID NO: 1272274 - protein, 18 aa, Mycobacterium
LQHAAAIAGFLAAGRTVA

SEQ ID NO: 1272275 - protein, 28 aa, Mycobacterium
LQHASYMAGNYLTGWAVGVLRSPSGTET

SEQ ID NO: 1272276 - protein, 18 aa, Mycobacterium
LQHLRLGVAGGFVTGVDG

SEQ ID NO: 1272277 - protein, 20 aa, Mycobacterium
LQHPELWSSSVIVPTEPEPP

SEQ ID NO: 1272278 - protein, 19 aa, Mycobacterium
LQILREFDTLLVMSVEPGF

SEQ ID NO: 1272279 - protein, 26 aa, Mycobacterium
LQIPSDRWVFPYAGADSHDTYAIAER

SEQ ID NO: 1272280 - protein, 18 aa, Mycobacterium
LQIYLRYESAIAELLGPR

SEQ ID NO: 1272281 - protein, 24 aa, Mycobacterium
LQKPARWIQQLAINPHSWSAAPNF

SEQ ID NO: 1272282 - protein, 26 aa, Mycobacterium
LQKVSELYDRIGFAAVGRFNEFNNLR

SEQ ID NO: 1272283 - protein, 18 aa, Mycobacterium
LQKYHWIERIDHVHTGAN

SEQ ID NO: 1272284 - protein, 21 aa, Mycobacterium
LQLALTELWRSYDVHPDAVIG

SEQ ID NO: 1272285 - protein, 25 aa, Mycobacterium
LQLSKRGGGVALLLTNIREHGAPIK

SEQ ID NO: 1272286 - protein, 21 aa, Mycobacterium
LQMFERATAGFGWSRPSRSAL

SEQ ID NO: 1272287 - protein, 26 aa, Mycobacterium
LQMVRWGAEMRFSYTKGLYDTYVAPE

SEQ ID NO: 1272288 - protein, 23 aa, Mycobacterium
LQNRARLPLEVVDALTDEWDAAH

SEQ ID NO: 1272289 - protein, 24 aa, Mycobacterium
LQPALNRLAPLLAQSPAAGALPTL

SEQ ID NO: 1272290 - protein, 22 aa, Mycobacterium
LQPETRLAAPLLAKGLPACPGV

SEQ ID NO: 1272291 - protein, 22 aa, Mycobacterium
LQPEVRAQWDIREVPLHVLVDG

SEQ ID NO: 1272292 - protein, 17 aa, Mycobacterium
LQPGPLALVEDLGRPGM

SEQ ID NO: 1272293 - protein, 23 aa, Mycobacterium
LQPKIEAEIAFVLRADIAERITA

SEQ ID NO: 1272294 - protein, 17 aa, Mycobacterium
LQPLATLEKMFIPPSGF

SEQ ID NO: 1272295 - protein, 18 aa, Mycobacterium
LQPLPSLRLQIGAASVLR

SEQ ID NO: 1272296 - protein, 25 aa, Mycobacterium
LQPYPLPALVCLLRSLTIRLTTAPV

SEQ ID NO: 1272297 - protein, 17 aa, Mycobacterium
LQQFKRPVLVHEPTSHA

SEQ ID NO: 1272298 - protein, 19 aa, Mycobacterium
LQQLSTRLFHCLVDKESCE

SEQ ID NO: 1272299 - protein, 19 aa, Mycobacterium
LQQPHEFRPFADALMADGM

SEQ ID NO: 1272300 - protein, 26 aa, Mycobacterium
LQQRVTDLLATVGAALGDLAQKARDA

SEQ ID NO: 1272301 - protein, 17 aa, Mycobacterium
LQRAGLRTLCLDAKLYA

SEQ ID NO: 1272302 - protein, 23 aa, Mycobacterium
LQRAQRVAVDMVRPGVTAEQVDA

SEQ ID NO: 1272303 - protein, 23 aa, Mycobacterium
LQRGEAVSAVAADEGWSSAEVFS

SEQ ID NO: 1272304 - protein, 23 aa, Mycobacterium
LQRHTGPIFPLIEDLFGVSIVEV

SEQ ID NO: 1272305 - protein, 18 aa, Mycobacterium
LQRIGRAAGRPEWQAAGR

SEQ ID NO: 1272306 - protein, 20 aa, Mycobacterium
LQRRRPRATVSLDHAGVISV

SEQ ID NO: 1272307 - protein, 24 aa, Mycobacterium
LQRRTGVAPGRIQCVPPLLNIVAS

SEQ ID NO: 1272308 - protein, 20 aa, Mycobacterium
LQRYDCIPPGGGRFDLPDEL

SEQ ID NO: 1272309 - protein, 18 aa, Mycobacterium
LQSAGAFVHHLPVDQSFT

SEQ ID NO: 1272310 - protein, 25 aa, Mycobacterium
LQSARAHILAGLCDVALVIGADTTP

SEQ ID NO: 1272311 - protein, 25 aa, Mycobacterium
LQSARAQILAGLCDVALVIGADTTP

SEQ ID NO: 1272312 - protein, 20 aa, Mycobacterium
LQSDLARARLRREDARRRLA

SEQ ID NO: 1272313 - protein, 24 aa, Mycobacterium
LQSFGGGYPGVFEGRDFDPNAPFT

SEQ ID NO: 1272314 - protein, 24 aa, Mycobacterium
LQSVDGIGSMWARHIREGLSQLAE

SEQ ID NO: 1272315 - protein, 17 aa, Mycobacterium
LQTAAACNAARTTVATE

SEQ ID NO: 1272316 - protein, 19 aa, Mycobacterium
LQTGVTWKDLGLVIVDEEQ

SEQ ID NO: 1272317 - protein, 20 aa, Mycobacterium
LQTMSQWLTVAAKEYAKTDE

SEQ ID NO: 1272318 - protein, 18 aa, Mycobacterium
LQTQIAVVKSQYEALTPR

SEQ ID NO: 1272319 - protein, 22 aa, Mycobacterium
LQTVAALLRLQARRTNNPEGRE

SEQ ID NO: 1272320 - protein, 18 aa, Mycobacterium
LQTVEFFAASGFAALSNI

SEQ ID NO: 1272321 - protein, 23 aa, Mycobacterium
LQTVKELAERGVTLVSTSDGIDS

SEQ ID NO: 1272322 - protein, 26 aa, Mycobacterium
LQTVKRLAWELLYATESCRTFALWAV

SEQ ID NO: 1272323 - protein, 19 aa, Mycobacterium
LQVARRLDSGMVWVNNWHV

SEQ ID NO: 1272324 - protein, 21 aa, Mycobacterium
LQVNVRQALTLADQAVAAGDA

SEQ ID NO: 1272325 - protein, 17 aa, Mycobacterium
LQYADFGAWQSALLADD

SEQ ID NO: 1272326 - protein, 19 aa, Mycobacterium
LQYAEVYNWGTFDDHSWRF

SEQ ID NO: 1272327 - protein, 20 aa, Mycobacterium
LQYYLDEFTFRFNRRRSSAR

SEQ ID NO: 1272328 - protein, 22 aa, Mycobacterium
LRAAAARWSANAVRLADASAPF

SEQ ID NO: 1272329 - protein, 18 aa, Mycobacterium
LRAAIAADDYRLAPVNVG

SEQ ID NO: 1272330 - protein, 21 aa, Mycobacterium
LRAALPDALFGIAPTRVCKND

SEQ ID NO: 1272331 - protein, 23 aa, Mycobacterium
LRAALPGMRARRGGWIVNVSSVA

SEQ ID NO: 1272332 - protein, 25 aa, Mycobacterium
LRAALSGRLAAAGPRGVAGLQRAVG

SEQ ID NO: 1272333 - protein, 24 aa, Mycobacterium
LRAALSTLYPVVWQPDPRPHMRGL

SEQ ID NO: 1272334 - protein, 18 aa, Mycobacterium
LRAARLLMYQAAWNADLG

SEQ ID NO: 1272335 - protein, 19 aa, Mycobacterium
LRADKSWVTSAGYADIYIV

SEQ ID NO: 1272336 - protein, 22 aa, Mycobacterium
LRAEARAHFGFADDARVLLVFG

SEQ ID NO: 1272337 - protein, 22 aa, Mycobacterium
LRAELRPGDVVLVKASNSAGLG

SEQ ID NO: 1272338 - protein, 20 aa, Mycobacterium
LRAFAARLLGIPAQGVRVIM

SEQ ID NO: 1272339 - protein, 17 aa, Mycobacterium
LRAFEEFIHHNLVLRRG

SEQ ID NO: 1272340 - protein, 19 aa, Mycobacterium
LRAGGAPMIPLESDKDTAL

SEQ ID NO: 1272341 - protein, 26 aa, Mycobacterium
LRAGGGPDWLIAPAIGYGASGEHEGF

SEQ ID NO: 1272342 - protein, 18 aa, Mycobacterium
LRAGIPIWTETALQRLVT

SEQ ID NO: 1272343 - protein, 18 aa, Mycobacterium
LRAGTPMRQIPVDTVFVG

SEQ ID NO: 1272344 - protein, 23 aa, Mycobacterium
LRAGVPTLVLWVAAEQPLWGKQV

SEQ ID NO: 1272345 - protein, 17 aa, Mycobacterium
LRAHKPLDFIPGLMHGD

SEQ ID NO: 1272346 - protein, 26 aa, Mycobacterium
LRAILDEWKTITGLDRKVDDALWKRY

SEQ ID NO: 1272347 - protein, 18 aa, Mycobacterium
LRAKTILHGREIVLGMTR

SEQ ID NO: 1272348 - protein, 19 aa, Mycobacterium
LRALAQAILNRVDPAIRFA

SEQ ID NO: 1272349 - protein, 17 aa, Mycobacterium
LRALCDAVMQAARAADG

SEQ ID NO: 1272350 - protein, 18 aa, Mycobacterium
LRALSAITELVAAKPDGN

SEQ ID NO: 1272351 - protein, 19 aa, Mycobacterium
LRALTYTNICEAMKTETPG

SEQ ID NO: 1272352 - protein, 17 aa, Mycobacterium
LRALVAGRVQISLDDPD

SEQ ID NO: 1272353 - protein, 20 aa, Mycobacterium
LRANAPVSWVEVPGYNPFWA

SEQ ID NO: 1272354 - protein, 21 aa, Mycobacterium
LRAQFAAGLSQMYGAEVPAYH

SEQ ID NO: 1272355 - protein, 21 aa, Mycobacterium
LRARGAQVVHARCDITSTADL

SEQ ID NO: 1272356 - protein, 22 aa, Mycobacterium
LRARGPRAVTMQAIVDATGIAK

SEQ ID NO: 1272357 - protein, 18 aa, Mycobacterium
LRARPMFHRTRDAIEAHL

SEQ ID NO: 1272358 - protein, 18 aa, Mycobacterium
LRARRHLLVAAGIGITPM

SEQ ID NO: 1272359 - protein, 19 aa, Mycobacterium
LRARRHSIGEALALAYTDG

SEQ ID NO: 1272360 - protein, 17 aa, Mycobacterium
LRASAGSIFSIPVLSAP

SEQ ID NO: 1272361 - protein, 20 aa, Mycobacterium
LRASDLILWESGVRTRVLPE

SEQ ID NO: 1272362 - protein, 20 aa, Mycobacterium
LRASLLARGAPRCAALVEQA

SEQ ID NO: 1272363 - protein, 25 aa, Mycobacterium
LRASNRIAIERGTAFKGFEKSKYAS

SEQ ID NO: 1272364 - protein, 21 aa, Mycobacterium
LRASNRIAIERGTHFKGFERS

SEQ ID NO: 1272365 - protein, 19 aa, Mycobacterium
LRATALVDRVRLTVADTGS

SEQ ID NO: 1272366 - protein, 27 aa, Mycobacterium
LRATMTPEAWAVWEVLFAKYAAPGMCN

SEQ ID NO: 1272367 - protein, 20 aa, Mycobacterium
LRATTLHRLLGSRPDTSSRF

SEQ ID NO: 1272368 - protein, 23 aa, Mycobacterium
LRAVGRGVLRQDLTVLDGENRVG

SEQ ID NO: 1272369 - protein, 21 aa, Mycobacterium
LRAVLDMADQVIVPIETEPLS

SEQ ID NO: 1272370 - protein, 17 aa, Mycobacterium
LRAVTNWVGPVGTGAAL

SEQ ID NO: 1272371 - protein, 22 aa, Mycobacterium
LRAWKAEHPGAVVVSYVNTTAA

SEQ ID NO: 1272372 - protein, 24 aa, Mycobacterium
LRCFAVPLRYCRPAQDAISASVPV

SEQ ID NO: 1272373 - protein, 23 aa, Mycobacterium
LRCGLDRPVDFVVGVPIQVVDAV

SEQ ID NO: 1272374 - protein, 21 aa, Mycobacterium
LRCVTWGPGAADLMIAEATRM

SEQ ID NO: 1272375 - protein, 23 aa, Mycobacterium
LRDAAQWSRIRLADRGHLEPWEP

SEQ ID NO: 1272376 - protein, 21 aa, Mycobacterium
LRDDVRPSIALQLLTCPLHTF

SEQ ID NO: 1272377 - protein, 19 aa, Mycobacterium
LRDDYFWQADEHMIGVVDA

SEQ ID NO: 1272378 - protein, 26 aa, Mycobacterium
LRDEGITAMHFVPSLLGLFLSLPGVN

SEQ ID NO: 1272379 - protein, 17 aa, Mycobacterium
LRDFLGPMITDLEGYPF

SEQ ID NO: 1272380 - protein, 20 aa, Mycobacterium
LRDGAVYGVGVVVVASFDRD

SEQ ID NO: 1272381 - protein, 17 aa, Mycobacterium
LRDHAVALILTVRDGEH

SEQ ID NO: 1272382 - protein, 31 aa, Mycobacterium
LRDIDSAWLAARWERPEMLAVEEHYYYPARL

SEQ ID NO: 1272383 - protein, 24 aa, Mycobacterium
LRDIRRRVGLVFQDPDDQLFMPTL

SEQ ID NO: 1272384 - protein, 17 aa, Mycobacterium
LRDKLTWVDTAGVANPK

SEQ ID NO: 1272385 - protein, 23 aa, Mycobacterium
LRDKRIPFEMCPSSNVQTGAVAS

SEQ ID NO: 1272386 - protein, 18 aa, Mycobacterium
LRDLGWFRFLIGRLDGPE

SEQ ID NO: 1272387 - protein, 18 aa, Mycobacterium
LRDLMPALRQGGVAAVSE

SEQ ID NO: 1272388 - protein, 17 aa, Mycobacterium
LRDMGLMLGEYWDLGPL

SEQ ID NO: 1272389 - protein, 18 aa, Mycobacterium
LRDPRNWWHLRNPRRPSW

SEQ ID NO: 1272390 - protein, 20 aa, Mycobacterium
LRDRAVRLISAMAAAGVRRQ

SEQ ID NO: 1272391 - protein, 23 aa, Mycobacterium
LRDRCAEAPFLPGASYHFVATSA

SEQ ID NO: 1272392 - protein, 26 aa, Mycobacterium
LRDRGLQIFPLVGWAERGGYGANGHG

SEQ ID NO: 1272393 - protein, 18 aa, Mycobacterium
LRDRLPRVAALHAQGRLS

SEQ ID NO: 1272394 - protein, 17 aa, Mycobacterium
LRDRPTTIVSRVWLALR

SEQ ID NO: 1272395 - protein, 21 aa, Mycobacterium
LRDRRLHAAATRCVQAAADRA

SEQ ID NO: 1272396 - protein, 23 aa, Mycobacterium
LRDSDFRAGCPVVAVTVEAGDPD

SEQ ID NO: 1272397 - protein, 20 aa, Mycobacterium
LRDSGFEGIAFVGVPRTLSD

SEQ ID NO: 1272398 - protein, 22 aa, Mycobacterium
LRDTLLWAKLIDKYKGTMTAAP

SEQ ID NO: 1272399 - protein, 17 aa, Mycobacterium
LRDVLVMEAGVPVALTH

SEQ ID NO: 1272400 - protein, 18 aa, Mycobacterium
LRDWVRRTGIGSTVTGVE

SEQ ID NO: 1272401 - protein, 24 aa, Mycobacterium
LRDYPGEGLGFWTQFDTYIPAALA

SEQ ID NO: 1272402 - protein, 23 aa, Mycobacterium
LREAGCATVAMVSRYPRSEAYAG

SEQ ID NO: 1272403 - protein, 19 aa, Mycobacterium
LREATPVPAGPVWVATDGS

SEQ ID NO: 1272404 - protein, 19 aa, Mycobacterium
LREAVPLIPADQMLVETDA

SEQ ID NO: 1272405 - protein, 23 aa, Mycobacterium
LREAYRVSINRLEWMTPQTREKA

SEQ ID NO: 1272406 - protein, 18 aa, Mycobacterium
LRECAELLMTHQGRSATE

SEQ ID NO: 1272407 - protein, 24 aa, Mycobacterium
LREFPGRLTPQLSRALHRHATRFL

SEQ ID NO: 1272408 - protein, 17 aa, Mycobacterium
LREGFPVNVLNPVKAVP

SEQ ID NO: 1272409 - protein, 18 aa, Mycobacterium
LRELCAGLDMARQSVSKH

SEQ ID NO: 1272410 - protein, 19 aa, Mycobacterium
LRELERGGLRAAVANAVEA

SEQ ID NO: 1272411 - protein, 18 aa, Mycobacterium
LRELERGGLRSAVANAVE

SEQ ID NO: 1272412 - protein, 18 aa, Mycobacterium
LRELPDLRAPAATTGAAG

SEQ ID NO: 1272413 - protein, 19 aa, Mycobacterium
LRELRRSGGERPALETVGR

SEQ ID NO: 1272414 - protein, 26 aa, Mycobacterium
LRELRSELMAGFTDLVLREARLHLDI

SEQ ID NO: 1272415 - protein, 25 aa, Mycobacterium
LRELWNMRNSAEFFQSVGPGSLDPA

SEQ ID NO: 1272416 - protein, 26 aa, Mycobacterium
LREMAETFPGAQILAAFGQTEMSPVT

SEQ ID NO: 1272417 - protein, 28 aa, Mycobacterium
LREQDALERMALLGLPFLFFIDAAQGRA

SEQ ID NO: 1272418 - protein, 23 aa, Mycobacterium
LREQIPGLPLLLLTAKDSVEDRI

SEQ ID NO: 1272419 - protein, 21 aa, Mycobacterium
LRERAGGGVVAFVATGFDVLA

SEQ ID NO: 1272420 - protein, 20 aa, Mycobacterium
LRERGLRSVSPLSVQMYMPN

SEQ ID NO: 1272421 - protein, 19 aa, Mycobacterium
LRERIPWRAERRQMYDRML

SEQ ID NO: 1272422 - protein, 19 aa, Mycobacterium
LRERIPWRAERRQMYDRVL

SEQ ID NO: 1272423 - protein, 24 aa, Mycobacterium
LRERLGVRIGVVVTDTMGRAWRTG

SEQ ID NO: 1272424 - protein, 17 aa, Mycobacterium
LRERPHIGPNGGTAAGL

SEQ ID NO: 1272425 - protein, 25 aa, Mycobacterium
LRESGRMLALKGARAEAEIEENRRV

SEQ ID NO: 1272426 - protein, 18 aa, Mycobacterium
LRESPNIDLARMLITAGY

SEQ ID NO: 1272427 - protein, 18 aa, Mycobacterium
LREVFGFDYDEIAGAVGR

SEQ ID NO: 1272428 - protein, 20 aa, Mycobacterium
LREWLRRGGEHLILDCNLRF

SEQ ID NO: 1272429 - protein, 17 aa, Mycobacterium
LREWPGHDRLRFHCNPA

SEQ ID NO: 1272430 - protein, 26 aa, Mycobacterium
LREYIDWQPFFNAWEMKGRFPDILNN

SEQ ID NO: 1272431 - protein, 19 aa, Mycobacterium
LRFAFANHHVPFLWNEDNP

SEQ ID NO: 1272432 - protein, 19 aa, Mycobacterium
LRFEVLPVMFSIQLTGDCL

SEQ ID NO: 1272433 - protein, 17 aa, Mycobacterium
LRFGLRLHTVARPTEEQ

SEQ ID NO: 1272434 - protein, 17 aa, Mycobacterium
LRFGTGLSGTPGRVTAR

SEQ ID NO: 1272435 - protein, 20 aa, Mycobacterium
LRFVADFSDDILAAKALKAT

SEQ ID NO: 1272436 - protein, 18 aa, Mycobacterium
LRFYTDILGFTPKHDIPM

SEQ ID NO: 1272437 - protein, 24 aa, Mycobacterium
LRGAALRVVATWPSRYPDIHDDGA

SEQ ID NO: 1272438 - protein, 23 aa, Mycobacterium
LRGADVVIHLALAVHPVRDEHYL

SEQ ID NO: 1272439 - protein, 28 aa, Mycobacterium
LRGAEAHNCRLCKSLREGHALDAGGSED

SEQ ID NO: 1272440 - protein, 21 aa, Mycobacterium
LRGALEHCYDAFEVLCTDLSD

SEQ ID NO: 1272441 - protein, 26 aa, Mycobacterium
LRGALVRDPHGWAGYLTEAIDTFADR

SEQ ID NO: 1272442 - protein, 24 aa, Mycobacterium
LRGARRIATLAGRELPRNLRVFAD

SEQ ID NO: 1272443 - protein, 19 aa, Mycobacterium
LRGAVTLPAVEWDVPGRSA

SEQ ID NO: 1272444 - protein, 17 aa, Mycobacterium
LRGDARFVIGTRSAVFA

SEQ ID NO: 1272445 - protein, 17 aa, Mycobacterium
LRGDPAIVFIDRAAQQA

SEQ ID NO: 1272446 - protein, 19 aa, Mycobacterium
LRGEEFIVHAGHGHSVMNS

SEQ ID NO: 1272447 - protein, 24 aa, Mycobacterium
LRGEVPVDQCLRGVAATVDETSVL

SEQ ID NO: 1272448 - protein, 17 aa, Mycobacterium
LRGGDYVGVHALGDLAA

SEQ ID NO: 1272449 - protein, 20 aa, Mycobacterium
LRGGLDRESLRLSVVNAGNP

SEQ ID NO: 1272450 - protein, 17 aa, Mycobacterium
LRGILAPIGDTQRQCNV

SEQ ID NO: 1272451 - protein, 20 aa, Mycobacterium
LRGLNIRWADGARRSLGDGI

SEQ ID NO: 1272452 - protein, 26 aa, Mycobacterium
LRGLRRRVGFVFQQFNLVGRLSCLEN

SEQ ID NO: 1272453 - protein, 25 aa, Mycobacterium
LRGNELWQIALLELWLQRHGINGPA

SEQ ID NO: 1272454 - protein, 21 aa, Mycobacterium
LRGNVDLVVLARYMQILTPSF

SEQ ID NO: 1272455 - protein, 18 aa, Mycobacterium
LRGPGVTLFDVLRATEFV

SEQ ID NO: 1272456 - protein, 18 aa, Mycobacterium
LRGPVIAMLSDFSDGSSE

SEQ ID NO: 1272457 - protein, 19 aa, Mycobacterium
LRGQAALQLAAREQSDARP

SEQ ID NO: 1272458 - protein, 25 aa, Mycobacterium
LRGRARRYSSGISWSEEPPSRTRRL

SEQ ID NO: 1272459 - protein, 22 aa, Mycobacterium
LRGRELEVRWDPRNGPDRARSG

SEQ ID NO: 1272460 - protein, 25 aa, Mycobacterium
LRGRQFRFSIDREVEDDGDTDGFTQ

SEQ ID NO: 1272461 - protein, 26 aa, Mycobacterium
LRGSAPRLVRMVQAYRDAERLGLPPL

SEQ ID NO: 1272462 - protein, 17 aa, Mycobacterium
LRGSGWVALTTDGPPVV

SEQ ID NO: 1272463 - protein, 17 aa, Mycobacterium
LRGSRTGIFVGVAANEY

SEQ ID NO: 1272464 - protein, 17 aa, Mycobacterium
LRGSRTPDRVVFRDELP

SEQ ID NO: 1272465 - protein, 18 aa, Mycobacterium
LRGTYAGLCHPAIIDHLK

SEQ ID NO: 1272466 - protein, 21 aa, Mycobacterium
LRGVAEWHGFDIWRQRAAFLE

SEQ ID NO: 1272467 - protein, 24 aa, Mycobacterium
LRGWGDALWDTGIDFGTLGVAKGG

SEQ ID NO: 1272468 - protein, 20 aa, Mycobacterium
LRGWLSAPVIVLSARSDSAD

SEQ ID NO: 1272469 - protein, 23 aa, Mycobacterium
LRHEFPSLRTCFASLYDITPQAR

SEQ ID NO: 1272470 - protein, 21 aa, Mycobacterium
LRHEHKLRRFGRAAEVAGVAA

SEQ ID NO: 1272471 - protein, 17 aa, Mycobacterium
LRHELHAERGFEWQPVD

SEQ ID NO: 1272472 - protein, 21 aa, Mycobacterium
LRHFCIAYRAVVRAKVDCVRV

SEQ ID NO: 1272473 - protein, 17 aa, Mycobacterium
LRHQICVELDPLSRVRS

SEQ ID NO: 1272474 - protein, 25 aa, Mycobacterium
LRHQWAIDRLCGSQLYFEAWASLST

SEQ ID NO: 1272475 - protein, 20 aa, Mycobacterium
LRHSTKLIGPKVVLVAELRA

SEQ ID NO: 1272476 - protein, 35 aa, Mycobacterium
LRHVLLRKFPRHLLGSVPLIYSWELAGDRDDARRA

SEQ ID NO: 1272477 - protein, 18 aa, Mycobacterium
LRHVLSYVPVNEGVVELT

SEQ ID NO: 1272478 - protein, 26 aa, Mycobacterium
LRHWEPKRRGIYCGTIGLASPAAGCE

SEQ ID NO: 1272479 - protein, 19 aa, Mycobacterium
LRIARAAVEIASYSRAAED

SEQ ID NO: 1272480 - protein, 17 aa, Mycobacterium
LRIDLGVDTPQLLIRIE

SEQ ID NO: 1272481 - protein, 23 aa, Mycobacterium
LRIDVNCAGIGNAAKTLSKDGPF

SEQ ID NO: 1272482 - protein, 20 aa, Mycobacterium
LRIDYDEAQRWIVMHRGSLS

SEQ ID NO: 1272483 - protein, 19 aa, Mycobacterium
LRIGMPYPLDPQVVSRLAD

SEQ ID NO: 1272484 - protein, 17 aa, Mycobacterium
LRIGVHTGEVRLRDEGN

SEQ ID NO: 1272485 - protein, 26 aa, Mycobacterium
LRIQECGDCKALIHPPQPVCRYCHSH

SEQ ID NO: 1272486 - protein, 20 aa, Mycobacterium
LRIRCLEQFHAALVEHRDEL

SEQ ID NO: 1272487 - protein, 23 aa, Mycobacterium
LRIRMADLQARVDLLRHALTGIA

SEQ ID NO: 1272488 - protein, 18 aa, Mycobacterium
LRKARGAFFTPTPVARFL

SEQ ID NO: 1272489 - protein, 17 aa, Mycobacterium
LRKDFIVRPYQIHEARA

SEQ ID NO: 1272490 - protein, 27 aa, Mycobacterium
LRKDGYDASGVTFVLLGNGARNDGGLW

SEQ ID NO: 1272491 - protein, 17 aa, Mycobacterium
LRKEAYVLHARRYLADG

SEQ ID NO: 1272492 - protein, 20 aa, Mycobacterium
LRKEDLKLAFASGAGNKIIL

SEQ ID NO: 1272493 - protein, 23 aa, Mycobacterium
LRKGFESAIYFYGPGAINCLATR

SEQ ID NO: 1272494 - protein, 19 aa, Mycobacterium
LRKISRYGLIVIDEVGYIP

SEQ ID NO: 1272495 - protein, 21 aa, Mycobacterium
LRKLLAVPLLLGAESRSGVPA

SEQ ID NO: 1272496 - protein, 22 aa, Mycobacterium
LRKMSRGDWIVFYSPKTAYPDG

SEQ ID NO: 1272497 - protein, 22 aa, Mycobacterium
LRKNCGNTIGFYIGVTPSPQSR

SEQ ID NO: 1272498 - protein, 21 aa, Mycobacterium
LRKRAERAGVYFPSLSSRTMV

SEQ ID NO: 1272499 - protein, 22 aa, Mycobacterium
LRKRGWTISAIARHTGRDRKTI

SEQ ID NO: 1272500 - protein, 20 aa, Mycobacterium
LRKSDPYKGKGIRYEGEQIR

SEQ ID NO: 1272501 - protein, 17 aa, Mycobacterium
LRKTIVFVTHDIDEAIK

SEQ ID NO: 1272502 - protein, 20 aa, Mycobacterium
LRKVCLDAGADDVGFASVGD

SEQ ID NO: 1272503 - protein, 17 aa, Mycobacterium
LRKYCRIETVVSPRTNV

SEQ ID NO: 1272504 - protein, 18 aa, Mycobacterium
LRLAEGLVASGLIGDGGR

SEQ ID NO: 1272505 - protein, 23 aa, Mycobacterium
LRLAGMRPVPRWPARPTVDLRGK

SEQ ID NO: 1272506 - protein, 17 aa, Mycobacterium
LRLAIARALILVQPEDR

SEQ ID NO: 1272507 - protein, 17 aa, Mycobacterium
LRLARAGRRVTVVEQGA

SEQ ID NO: 1272508 - protein, 21 aa, Mycobacterium
LRLCPPAAGVGRLALRDVEVD

SEQ ID NO: 1272509 - protein, 22 aa, Mycobacterium
LRLDGDVVYSVQFRRLHGGIAF

SEQ ID NO: 1272510 - protein, 27 aa, Mycobacterium
LRLDREVPGEVLAAIGRDVNAVTLEVV

SEQ ID NO: 1272511 - protein, 21 aa, Mycobacterium
LRLDSPVQMSARFARRDVTVG

SEQ ID NO: 1272512 - protein, 18 aa, Mycobacterium
LRLEDGSVRTGLRQLENN

SEQ ID NO: 1272513 - protein, 18 aa, Mycobacterium
LRLEVELAGHGHFIHVQA

SEQ ID NO: 1272514 - protein, 17 aa, Mycobacterium
LRLFAGGNAKFWDPADI

SEQ ID NO: 1272515 - protein, 20 aa, Mycobacterium
LRLGVAGGFVTGVDGMGHVA

SEQ ID NO: 1272516 - protein, 27 aa, Mycobacterium
LRLHNGTVWRWNRPVYDVQAGRPQLRI

SEQ ID NO: 1272517 - protein, 21 aa, Mycobacterium
LRLHPPLIILMRVAQDEFEVA

SEQ ID NO: 1272518 - protein, 24 aa, Mycobacterium
LRLKAFGCTISYHNRHEVPDSPYT

SEQ ID NO: 1272519 - protein, 19 aa, Mycobacterium
LRLKKTVARLATYLQGYGD

SEQ ID NO: 1272520 - protein, 27 aa, Mycobacterium
LRLKPGNWAGATACWGLENREAAVRLI

SEQ ID NO: 1272521 - protein, 17 aa, Mycobacterium
LRLLAPTVAVSQAPIAD

SEQ ID NO: 1272522 - protein, 18 aa, Mycobacterium
LRLLCTDLAVAADQPHLE

SEQ ID NO: 1272523 - protein, 20 aa, Mycobacterium
LRLLLPAGLETTFRSSGNLL

SEQ ID NO: 1272524 - protein, 17 aa, Mycobacterium
LRLPPHVAQMIYDRAQH

SEQ ID NO: 1272525 - protein, 19 aa, Mycobacterium
LRLRDRAAAIVYAYQKGIV

SEQ ID NO: 1272526 - protein, 19 aa, Mycobacterium
LRLREILETGAARMAACRT

SEQ ID NO: 1272527 - protein, 17 aa, Mycobacterium
LRLSTERGMAYTRIGYA

SEQ ID NO: 1272528 - protein, 18 aa, Mycobacterium
LRLTWAPTSDDLWRPQGA

SEQ ID NO: 1272529 - protein, 19 aa, Mycobacterium
LRLYEEWCNLADLRQGDRY

SEQ ID NO: 1272530 - protein, 21 aa, Mycobacterium
LRMEAEWESGYLLTVRSAWQA

SEQ ID NO: 1272531 - protein, 18 aa, Mycobacterium
LRMLRSFDPRSAAHPLDV

SEQ ID NO: 1272532 - protein, 21 aa, Mycobacterium
LRMMTPLPFNFRQAIRDTDLL

SEQ ID NO: 1272533 - protein, 17 aa, Mycobacterium
LRNARKAAGERLSDARQ

SEQ ID NO: 1272534 - protein, 19 aa, Mycobacterium
LRNARMLRQAFAALHTQLV

SEQ ID NO: 1272535 - protein, 19 aa, Mycobacterium
LRNAYRCCRVLNAEHGRTF

SEQ ID NO: 1272536 - protein, 20 aa, Mycobacterium
LRNLRMVKDPAEIDALRKAG

SEQ ID NO: 1272537 - protein, 18 aa, Mycobacterium
LRNMAFYNMGLRLLRHVY

SEQ ID NO: 1272538 - protein, 21 aa, Mycobacterium
LRNPVRFARAVATAGADKAVF

SEQ ID NO: 1272539 - protein, 18 aa, Mycobacterium
LRNVSMLYLDLHVPASID

SEQ ID NO: 1272540 - protein, 25 aa, Mycobacterium
LRNVWAETILRFAYGSFRHANLMHA

SEQ ID NO: 1272541 - protein, 21 aa, Mycobacterium
LRPAIDLVAGIAPRGYGQGVH

SEQ ID NO: 1272542 - protein, 18 aa, Mycobacterium
LRPAQARVLLMAALAADV

SEQ ID NO: 1272543 - protein, 17 aa, Mycobacterium
LRPASTPEAYWRSRRFP

SEQ ID NO: 1272544 - protein, 21 aa, Mycobacterium
LRPAVLPGTREPVALTTFQEF

SEQ ID NO: 1272545 - protein, 25 aa, Mycobacterium
LRPDCALWHGAAWDRETVARFLRSG

SEQ ID NO: 1272546 - protein, 17 aa, Mycobacterium
LRPDCVVYNPMFADVDE

SEQ ID NO: 1272547 - protein, 26 aa, Mycobacterium
LRPDLATGLQPMRWGTGYMLGSKRFG

SEQ ID NO: 1272548 - protein, 17 aa, Mycobacterium
LRPEGRSGPLVRTLASY

SEQ ID NO: 1272549 - protein, 17 aa, Mycobacterium
LRPELAGEMGVRVLRQR

SEQ ID NO: 1272550 - protein, 17 aa, Mycobacterium
LRPELMPSAIPHYHSAL

SEQ ID NO: 1272551 - protein, 20 aa, Mycobacterium
LRPEQLRFGTGLSGTPGRVT

SEQ ID NO: 1272552 - protein, 20 aa, Mycobacterium
LRPGDIITITAGRRGGLAVV

SEQ ID NO: 1272553 - protein, 19 aa, Mycobacterium
LRPGGELRYLEHIAETGAR

SEQ ID NO: 1272554 - protein, 19 aa, Mycobacterium
LRPGGKLVLVDHVQSTAAP

SEQ ID NO: 1272555 - protein, 18 aa, Mycobacterium
LRPHIACPTTSGTGSEVT

SEQ ID NO: 1272556 - protein, 21 aa, Mycobacterium
LRPLDHPHLLLLVHMLDDDES

SEQ ID NO: 1272557 - protein, 21 aa, Mycobacterium
LRPLGRPIVCTEYLAREFGNT

SEQ ID NO: 1272558 - protein, 21 aa, Mycobacterium
LRPLLDGELFSCYSMTEPHAG

SEQ ID NO: 1272559 - protein, 19 aa, Mycobacterium
LRPLLEGPATWAVTPTIAR

SEQ ID NO: 1272560 - protein, 22 aa, Mycobacterium
LRPNSPGALLRGRVERMHRSCL

SEQ ID NO: 1272561 - protein, 19 aa, Mycobacterium
LRPQIGHVYGYRLEPAEQG

SEQ ID NO: 1272562 - protein, 18 aa, Mycobacterium
LRPRDKFTTVAEMENVAA

SEQ ID NO: 1272563 - protein, 18 aa, Mycobacterium
LRPSARVARGLAYVPQGQ

SEQ ID NO: 1272564 - protein, 23 aa, Mycobacterium
LRPSDTATYCPYKGQAGYFDVVA

SEQ ID NO: 1272565 - protein, 21 aa, Mycobacterium
LRPTSRVSLLSPTGAFLGLIG

SEQ ID NO: 1272566 - protein, 22 aa, Mycobacterium
LRPVDSGPFYAVKVVLSDLGTC

SEQ ID NO: 1272567 - protein, 26 aa, Mycobacterium
LRPVPWEPGHAFVLCDVVNTDGSPVP

SEQ ID NO: 1272568 - protein, 17 aa, Mycobacterium
LRQAFAALHTQLVIVTH

SEQ ID NO: 1272569 - protein, 17 aa, Mycobacterium
LRQAHVIVGDLAPTAEQ

SEQ ID NO: 1272570 - protein, 18 aa, Mycobacterium
LRQAHVIVGDLAPTAEQF

SEQ ID NO: 1272571 - protein, 21 aa, Mycobacterium
LRQALDTFGPIFIQTYAGTEQ

SEQ ID NO: 1272572 - protein, 19 aa, Mycobacterium
LRQAVEYDPRVSGVPSTKG

SEQ ID NO: 1272573 - protein, 22 aa, Mycobacterium
LRQFPATTFAPAYVSVWHRDPA

SEQ ID NO: 1272574 - protein, 21 aa, Mycobacterium
LRQGLTLALEPWFAAGTDKIV

SEQ ID NO: 1272575 - protein, 18 aa, Mycobacterium
LRQHCRATLTPYEVPARV

SEQ ID NO: 1272576 - protein, 22 aa, Mycobacterium
LRQHVPDAGGMIIASDQTTARA

SEQ ID NO: 1272577 - protein, 21 aa, Mycobacterium
LRQLEVFIAEMHRLGGAEPAL

SEQ ID NO: 1272578 - protein, 22 aa, Mycobacterium
LRQLLEKRIQPIRLTHHTTSAS

SEQ ID NO: 1272579 - protein, 17 aa, Mycobacterium
LRQLTPYATRDQEDRML

SEQ ID NO: 1272580 - protein, 18 aa, Mycobacterium
LRQRAGLRRIHLKGLRNT

SEQ ID NO: 1272581 - protein, 24 aa, Mycobacterium
LRQRGDGMLVAWFATGFDVLASRV

SEQ ID NO: 1272582 - protein, 23 aa, Mycobacterium
LRQRLGDRPVYLSVDIDVLDPAH

SEQ ID NO: 1272583 - protein, 22 aa, Mycobacterium
LRQRPEWRRQLLADIVPVATVS

SEQ ID NO: 1272584 - protein, 18 aa, Mycobacterium
LRQWSRAATEIAAALRMS

SEQ ID NO: 1272585 - protein, 17 aa, Mycobacterium
LRRAGLIQSERRGMNVY

SEQ ID NO: 1272586 - protein, 18 aa, Mycobacterium
LRRAHLVDGVAWSEMAVI

SEQ ID NO: 1272587 - protein, 18 aa, Mycobacterium
LRRAQGMGFDIGIDDAPI

SEQ ID NO: 1272588 - protein, 25 aa, Mycobacterium
LRRARTRIRLGEWVIPEGDTILAST

SEQ ID NO: 1272589 - protein, 21 aa, Mycobacterium
LRRAVRLLAQLTRQVAVVQYP

SEQ ID NO: 1272590 - protein, 23 aa, Mycobacterium
LRRDDCPRFAPGDFADRPTVSTP

SEQ ID NO: 1272591 - protein, 19 aa, Mycobacterium
LRRDGFAALTVRRVAAEAG

SEQ ID NO: 1272592 - protein, 17 aa, Mycobacterium
LRRFGADRLIDYIDYTT

SEQ ID NO: 1272593 - protein, 24 aa, Mycobacterium
LRRGFSSAHIAEFFASMRAGADLA

SEQ ID NO: 1272594 - protein, 18 aa, Mycobacterium
LRRHAVGLTVGRVDVAAL

SEQ ID NO: 1272595 - protein, 26 aa, Mycobacterium
LRRKQRLYLEEWVHLVNESRVDLTDA

SEQ ID NO: 1272596 - protein, 31 aa, Mycobacterium
LRRKWGDAVYLKFGEPIPVTSLLGFGSGMLL

SEQ ID NO: 1272597 - protein, 17 aa, Mycobacterium
LRRLLIRPIEAEIELDT

SEQ ID NO: 1272598 - protein, 21 aa, Mycobacterium
LRRLPNPTLVLWGRDDKVNRP

SEQ ID NO: 1272599 - protein, 24 aa, Mycobacterium
LRRLRELGCEYVICYFPEAAYDRS

SEQ ID NO: 1272600 - protein, 20 aa, Mycobacterium
LRRNGWKGFGPVPFAHEPNQ

SEQ ID NO: 1272601 - protein, 28 aa, Mycobacterium
LRRNVKLCAVPWLHRLGLLHLLQSELRA

SEQ ID NO: 1272602 - protein, 24 aa, Mycobacterium
LRRPEVMSLLTAWNAGAVLGADTR

SEQ ID NO: 1272603 - protein, 25 aa, Mycobacterium
LRRPSELDEQTWLHRWHHDHTRVAI

SEQ ID NO: 1272604 - protein, 19 aa, Mycobacterium
LRRPVRRPLDEGVIEFNGE

SEQ ID NO: 1272605 - protein, 24 aa, Mycobacterium
LRRRGERWYWHWDPQFIDGSAANP

SEQ ID NO: 1272606 - protein, 25 aa, Mycobacterium
LRRRPYDLSSLFAIGTGGAATNQRH

SEQ ID NO: 1272607 - protein, 24 aa, Mycobacterium
LRRRQAVVVPLLLADAYHARVDIP

SEQ ID NO: 1272608 - protein, 24 aa, Mycobacterium
LRRRSARALRNWVNREAHTVAQLR

SEQ ID NO: 1272609 - protein, 17 aa, Mycobacterium
LRRRSMTDVDAWYERAA

SEQ ID NO: 1272610 - protein, 20 aa, Mycobacterium
LRRRVMLERAAWRLQRGEAV

SEQ ID NO: 1272611 - protein, 22 aa, Mycobacterium
LRRSEYAGAITIVSDEGHLPYD

SEQ ID NO: 1272612 - protein, 26 aa, Mycobacterium
LRRSHPEVGVLVFSQWVETRYATELL

SEQ ID NO: 1272613 - protein, 25 aa, Mycobacterium
LRRSWSPDGRPIIGFVGRLAPEKHV

SEQ ID NO: 1272614 - protein, 18 aa, Mycobacterium
LRRTGAHHAHAFAALTRI

SEQ ID NO: 1272615 - protein, 18 aa, Mycobacterium
LRRVDRALGAALKLNPTP

SEQ ID NO: 1272616 - protein, 17 aa, Mycobacterium
LRRVLKPNGQLRFFEHV

SEQ ID NO: 1272617 - protein, 27 aa, Mycobacterium
LRRWCSGTSNRWCEMRVRIEGRKGGLI

SEQ ID NO: 1272618 - protein, 17 aa, Mycobacterium
LRRWRAVARSAARQSRR

SEQ ID NO: 1272619 - protein, 24 aa, Mycobacterium
LRSAPDLLDFLIGYLAHGGNVNAT

SEQ ID NO: 1272620 - protein, 18 aa, Mycobacterium
LRSAVATRGVAFVATTAV

SEQ ID NO: 1272621 - protein, 25 aa, Mycobacterium
LRSAVPHLRAARSGHIINVSSILGL

SEQ ID NO: 1272622 - protein, 19 aa, Mycobacterium
LRSAYALGAATVFAVDPVA

SEQ ID NO: 1272623 - protein, 23 aa, Mycobacterium
LRSCPPIVLKSVRLYGEGDPVDV

SEQ ID NO: 1272624 - protein, 21 aa, Mycobacterium
LRSDAYWPQLADQLVKAARIT

SEQ ID NO: 1272625 - protein, 18 aa, Mycobacterium
LRSEARKGRMLPYVIELD

SEQ ID NO: 1272626 - protein, 23 aa, Mycobacterium
LRSFDARLGWGPAVSADDELLAR

SEQ ID NO: 1272627 - protein, 18 aa, Mycobacterium
LRSLELYCTEALDGIRAE

SEQ ID NO: 1272628 - protein, 27 aa, Mycobacterium
LRSLHFALEWLRMCELIRVTSTEPGKV

SEQ ID NO: 1272629 - protein, 19 aa, Mycobacterium
LRSLPWPAGAWSGARDAPV

SEQ ID NO: 1272630 - protein, 30 aa, Mycobacterium; identical to SEQ ID NO: 696832

SEQ ID NO: 1272631 - protein, 30 aa, Mycobacterium
LRSNAVELARAWKPATLRAVNKVTAGGLVE

SEQ ID NO: 1272632 - protein, 19 aa, Mycobacterium
LRSRCRHIALVTPSVDAIT

SEQ ID NO: 1272633 - protein, 19 aa, Mycobacterium
LRSRCRHVALVTPPVDAIA

SEQ ID NO: 1272634 - protein, 19 aa, Mycobacterium
LRSRCRHVALVTPSVDAIT

SEQ ID NO: 1272635 - protein, 22 aa, Mycobacterium
LRSVVCARERFGGATVTVGALA

SEQ ID NO: 1272636 - protein, 22 aa, Mycobacterium
LRSYLREHLSGFKVPKQFHQIS

SEQ ID NO: 1272637 - protein, 17 aa, Mycobacterium
LRTALRMWCARAGERDG

SEQ ID NO: 1272638 - protein, 26 aa, Mycobacterium
LRTAPDVWEPLGFPAYLRQECEMSLR

SEQ ID NO: 1272639 - protein, 21 aa, Mycobacterium
LRTDGRWALPELSVDVASPDA

SEQ ID NO: 1272640 - protein, 21 aa, Mycobacterium
LRTEAAFEYAAKLGYDGVELM

SEQ ID NO: 1272641 - protein, 24 aa, Mycobacterium
LRTEKSVLFVIPWGTHWIIGTTDT

SEQ ID NO: 1272642 - protein, 18 aa, Mycobacterium
LRTELGVALLNGIVDDTV

SEQ ID NO: 1272643 - protein, 19 aa, Mycobacterium
LRTEMGYPLHGHELSLDIS

SEQ ID NO: 1272644 - protein, 19 aa, Mycobacterium
LRTFAHAAILSAASEHRRR

SEQ ID NO: 1272645 - protein, 35 aa, Mycobacterium
LRTFSKAYGLAGLRIGYAVADPDIIAALSKVYVPF

SEQ ID NO: 1272646 - protein, 19 aa, Mycobacterium
LRTGQPLTALDLVEDAQAK

SEQ ID NO: 1272647 - protein, 19 aa, Mycobacterium
LRTKVLFGTDFPYIQIDRW

SEQ ID NO: 1272648 - protein, 19 aa, Mycobacterium
LRTLGGISTEFARDTADLS

SEQ ID NO: 1272649 - protein, 20 aa, Mycobacterium
LRTPRGREIFLELVEQTDVI

SEQ ID NO: 1272650 - protein, 24 aa, Mycobacterium
LRTPVRRFVLFSSITGLLGSRAVA

SEQ ID NO: 1272651 - protein, 24 aa, Mycobacterium
LRTRRAGAVGLVITEPLNYSFSDP

SEQ ID NO: 1272652 - protein, 17 aa, Mycobacterium
LRTVPMGRLGDVDTDIG

SEQ ID NO: 1272653 - protein, 17 aa, Mycobacterium
LRTVRCVSGTVELVMSC

SEQ ID NO: 1272654 - protein, 17 aa, Mycobacterium
LRTVWGREYDGFLDYVA

SEQ ID NO: 1272655 - protein, 20 aa, Mycobacterium
LRTYRGVLDAGRVVEFMLLD

SEQ ID NO: 1272656 - protein, 32 aa, Mycobacterium
LRVEAAEVFQSWLTGLAAWFGRLALTEPECRR

SEQ ID NO: 1272657 - protein, 19 aa, Mycobacterium
LRVEAVPEFAYVRHRGRIR

SEQ ID NO: 1272658 - protein, 19 aa, Mycobacterium
LRVGDRFDPLVGLSPFSLV

SEQ ID NO: 1272659 - protein, 20 aa, Mycobacterium
LRVGDRFDPLVGLSPFSLVS

SEQ ID NO: 1272660 - protein, 19 aa, Mycobacterium
LRVGFNPREGLVLHEVTYN

SEQ ID NO: 1272661 - protein, 21 aa, Mycobacterium
LRVGMASAFVRCEDPALLAQA

SEQ ID NO: 1272662 - protein, 20 aa, Mycobacterium
LRVIDNVRYFAALYGTGGQA

SEQ ID NO: 1272663 - protein, 19 aa, Mycobacterium
LRVLQFLSLAHRGDRRAEC

SEQ ID NO: 1272664 - protein, 18 aa, Mycobacterium
LRVQMRGEIARLQKRLGT

SEQ ID NO: 1272665 - protein, 17 aa, Mycobacterium
LRVRMLDNLRVLRGELD

SEQ ID NO: 1272666 - protein, 27 aa, Mycobacterium
LRVRNCSTCGTDVKIFYNGHQNLTPPR

SEQ ID NO: 1272667 - protein, 23 aa, Mycobacterium
LRVSEYPYVLPLLDLTTSNPAYV

SEQ ID NO: 1272668 - protein, 22 aa, Mycobacterium
LRVSRHACELFWEKGVAATTGD

SEQ ID NO: 1272669 - protein, 23 aa, Mycobacterium
LRVTEHKYLFSGMLSGIGVRTPA

SEQ ID NO: 1272670 - protein, 23 aa, Mycobacterium
LRVVPTGGDWVRPEMVRALRKRA

SEQ ID NO: 1272671 - protein, 20 aa, Mycobacterium
LRWATVHGVPRAFLTVRARR

SEQ ID NO: 1272672 - protein, 20 aa, Mycobacterium
LRWQPELYRALLAHVDTEPP

SEQ ID NO: 1272673 - protein, 19 aa, Mycobacterium
LRWRAPEPPQAWSEPVDAG

SEQ ID NO: 1272674 - protein, 19 aa, Mycobacterium
LRYEGVWWVRAHLTTKLDG

SEQ ID NO: 1272675 - protein, 18 aa, Mycobacterium
LRYFPRKYSDAMTVRGEG

SEQ ID NO: 1272676 - protein, 21 aa, Mycobacterium
LRYGPKRIGLLTGDQAINGDA

SEQ ID NO: 1272677 - protein, 29 aa, Mycobacterium
LRYKGARGVARLKALLPYIDGGAESPRES

SEQ ID NO: 1272678 - protein, 24 aa, Mycobacterium
LRYLAGCVLAAFPNTAAAPPRVQD

SEQ ID NO: 1272679 - protein, 25 aa, Mycobacterium
LRYLRGTPLGPLRAEAFVERSEGAK

SEQ ID NO: 1272680 - protein, 19 aa, Mycobacterium
LRYPTALVDDFDWARTLSG

SEQ ID NO: 1272681 - protein, 18 aa, Mycobacterium
LRYTQTVTLWHGVERVEC

SEQ ID NO: 1272682 - protein, 21 aa, Mycobacterium
LSAAARAFKARALEATGQPTP

SEQ ID NO: 1272683 - protein, 20 aa, Mycobacterium
LSAAVVASWARYAEGVDEQG

SEQ ID NO: 1272684 - protein, 18 aa, Mycobacterium
LSACLRPMLAGLPPDQKA

SEQ ID NO: 1272685 - protein, 17 aa, Mycobacterium
LSACTRWADGLSPVRRP

SEQ ID NO: 1272686 - protein, 23 aa, Mycobacterium
LSADCAVLCPLPVIDEIDALAMT

SEQ ID NO: 1272687 - protein, 19 aa, Mycobacterium
LSADGGGIWPVAEPARSES

SEQ ID NO: 1272688 - protein, 18 aa, Mycobacterium
LSAESARIGRPAHVVAAF

SEQ ID NO: 1272689 - protein, 23 aa, Mycobacterium
LSAGHARALLSLEAGPEAQEELA

SEQ ID NO: 1272690 - protein, 17 aa, Mycobacterium
LSAGLALAEDTEMHFYD

SEQ ID NO: 1272691 - protein, 27 aa, Mycobacterium
LSAGSLVVTEVLRLLAADPDAPAADQL

SEQ ID NO: 1272692 - protein, 18 aa, Mycobacterium
LSAGTVFEHLHQSGSRGD

SEQ ID NO: 1272693 - protein, 19 aa, Mycobacterium
LSAHIRLGADLDYDKVIEE

SEQ ID NO: 1272694 - protein, 18 aa, Mycobacterium
LSAHPSLLFAVEDGIERV

SEQ ID NO: 1272695 - protein, 17 aa, Mycobacterium
LSAIRGFAEDAAALVAE

SEQ ID NO: 1272696 - protein, 17 aa, Mycobacterium
LSALLHVARTVTRRAER

SEQ ID NO: 1272697 - protein, 21 aa, Mycobacterium
LSALLPLLAPWTRHVAEADLQ

SEQ ID NO: 1272698 - protein, 26 aa, Mycobacterium
LSALPDRPAVLVPAFLSRGYHVRSDI

SEQ ID NO: 1272699 - protein, 18 aa, Mycobacterium
LSALVAHLVGADALILLS

SEQ ID NO: 1272700 - protein, 28 aa, Mycobacterium
LSANRSASDWIWSGLCLPAVRIGSRLHR

SEQ ID NO: 1272701 - protein, 19 aa, Mycobacterium
LSAPHGAQWTWGPEDAAQR

SEQ ID NO: 1272702 - protein, 24 aa, Mycobacterium
LSAPLKLAFDYTRSVGPLLGEFFT

SEQ ID NO: 1272703 - protein, 31 aa, Mycobacterium
LSAPLSCLNEARFGIVFGALGAARDSLETTI

SEQ ID NO: 1272704 - protein, 18 aa, Mycobacterium
LSAQAWRDTLDVNLTGVW

SEQ ID NO: 1272705 - protein, 17 aa, Mycobacterium
LSAQVGAYHLMRTQGGR

SEQ ID NO: 1272706 - protein, 23 aa, Mycobacterium
LSARLISEISWRTRLVDGEQVLG

SEQ ID NO: 1272707 - protein, 30 aa, Mycobacterium
LSARRRRAFGRFGIQHFVKFDLATDTSGEN

SEQ ID NO: 1272708 - protein, 23 aa, Mycobacterium
LSARWRPVLEPVLTDIAAQELVV

SEQ ID NO: 1272709 - protein, 18 aa, Mycobacterium
LSATIAVELHRLRTVPDE

SEQ ID NO: 1272710 - protein, 23 aa, Mycobacterium
LSCGNCFECDGCLGACPEDAVIK

SEQ ID NO: 1272711 - protein, 17 aa, Mycobacterium
LSDCTPARVLELRTSWR

SEQ ID NO: 1272712 - protein, 26 aa, Mycobacterium
LSDELAARNRLNWFLRDLSSGRLGAE

SEQ ID NO: 1272713 - protein, 21 aa, Mycobacterium
LSDLESYLFFNLLFSAGAETT

SEQ ID NO: 1272714 - protein, 22 aa, Mycobacterium
LSDPCARLLGMGKRNRQRRTAK

SEQ ID NO: 1272715 - protein, 23 aa, Mycobacterium
LSDPTRIKVLWALLQGESSVACL

SEQ ID NO: 1272716 - protein, 25 aa, Mycobacterium
LSDQAQRRFGLRINVRVGVHRGLVY

SEQ ID NO: 1272717 - protein, 17 aa, Mycobacterium
LSDRLGVLTRTNSESIV

SEQ ID NO: 1272718 - protein, 17 aa, Mycobacterium
LSDVCGFVTGQTIYADG

SEQ ID NO: 1272719 - protein, 17 aa, Mycobacterium
LSEAIPHSSIPDAIDTI

SEQ ID NO: 1272720 - protein, 22 aa, Mycobacterium
LSEDDWDGWVALTAAIGDKVQL

SEQ ID NO: 1272721 - protein, 29 aa, Mycobacterium
LSEEYRQAIGVSITQVWGMTETSPIAAAC

SEQ ID NO: 1272722 - protein, 24 aa, Mycobacterium
LSELCCGDLISAQRWFRESLARAA

SEQ ID NO: 1272723 - protein, 22 aa, Mycobacterium
LSELLSVPGVFVFGSNDYFAPR

SEQ ID NO: 1272724 - protein, 20 aa, Mycobacterium
LSELRLGFEPAAAALAARRA

SEQ ID NO: 1272725 - protein, 18 aa, Mycobacterium
LSELRLHNGTVYRWNRPV

SEQ ID NO: 1272726 - protein, 21 aa, Mycobacterium
LSEPFAASRPRPEYLAARDVR

SEQ ID NO: 1272727 - protein, 25 aa, Mycobacterium
LSERGAPTPVAWTRMRAPRSLMDTI

SEQ ID NO: 1272728 - protein, 23 aa, Mycobacterium
LSETRTAVMMGVYYTEYQNSSAG

SEQ ID NO: 1272729 - protein, 24 aa, Mycobacterium
LSEVPELAVPLVFRLLGETGSHAS

SEQ ID NO: 1272730 - protein, 19 aa, Mycobacterium
LSEWVIPRGYSIVVALAEI

SEQ ID NO: 1272731 - protein, 24 aa, Mycobacterium
LSEYTSAVAMARCDDKRLTRRIVA

SEQ ID NO: 1272732 - protein, 17 aa, Mycobacterium
LSFGGGPHRCLGSHLAR

SEQ ID NO: 1272733 - protein, 20 aa, Mycobacterium
LSFLPGNAFDDAPIVNPGLE

SEQ ID NO: 1272734 - protein, 27 aa, Mycobacterium
LSFSRYELLRLLAFSRSGALPITKASD

SEQ ID NO: 1272735 - protein, 17 aa, Mycobacterium
LSFSWPDDTPLFTDLSF

SEQ ID NO: 1272736 - protein, 27 aa, Mycobacterium
LSGALAFKLLYRCRALLQTGEVPTIRK

SEQ ID NO: 1272737 - protein, 19 aa, Mycobacterium
LSGAPGYLAVCDVLHAHGF

SEQ ID NO: 1272738 - protein, 34 aa, Mycobacterium
LSGGRFTLAVGVGYLKREFAALGVDFDERADLFT

SEQ ID NO: 1272739 - protein, 23 aa, Mycobacterium
LSGGRFTLGIGRGIGAIYGAFGI

SEQ ID NO: 1272740 - protein, 25 aa, Mycobacterium
LSGGRVSLGVGFGWNTDELADHNVP

SEQ ID NO: 1272741 - protein, 18 aa, Mycobacterium
LSGIGFGLGVDRTLLALR

SEQ ID NO: 1272742 - protein, 25 aa, Mycobacterium
LSGIGRWLHTLGFRGHITSKSRRYS

SEQ ID NO: 1272743 - protein, 25 aa, Mycobacterium
LSGLAMAGAEFTVGVAPLAVRADDS

SEQ ID NO: 1272744 - protein, 18 aa, Mycobacterium
LSGLGGRGTRLMSSTRPG

SEQ ID NO: 1272745 - protein, 18 aa, Mycobacterium
LSGLKRGAQVVVGTPGRV

SEQ ID NO: 1272746 - protein, 21 aa, Mycobacterium
LSGLRRLLFVNGHMGNTAALN

SEQ ID NO: 1272747 - protein, 21 aa, Mycobacterium
LSGNLGRPGLAIVESDEDVLL

SEQ ID NO: 1272748 - protein, 21 aa, Mycobacterium
LSGPTAWLFGAEAHGLAPEVA

SEQ ID NO: 1272749 - protein, 17 aa, Mycobacterium
LSGQFSKALVYAELKHH

SEQ ID NO: 1272750 - protein, 20 aa, Mycobacterium
LSGRSGGFCDARDLVRSLDH

SEQ ID NO: 1272751 - protein, 25 aa, Mycobacterium
LSGRTLRAALTYQLPPSGSVVFGVY

SEQ ID NO: 1272752 - protein, 22 aa, Mycobacterium
LSGRWRPGYHGRQWDSTSARCP

SEQ ID NO: 1272753 - protein, 24 aa, Mycobacterium
LSGSCLLLRSSAYSEIAGFDERYF

SEQ ID NO: 1272754 - protein, 18 aa, Mycobacterium
LSGVDVLVFVYAIAQAWQ

SEQ ID NO: 1272755 - protein, 17 aa, Mycobacterium
LSGVVGWTLLGYPIDDP

SEQ ID NO: 1272756 - protein, 19 aa, Mycobacterium
LSGYWTAAFAMAGPNTRIV

SEQ ID NO: 1272757 - protein, 24 aa, Mycobacterium
LSHSELRALGGIGELFDTLLVYEN

SEQ ID NO: 1272758 - protein, 20 aa, Mycobacterium
LSIAMYGTFKLARQIAPSAD

SEQ ID NO: 1272759 - protein, 17 aa, Mycobacterium
LSIYAGCLPERFDEVVR

SEQ ID NO: 1272760 - protein, 20 aa, Mycobacterium
LSKAACRRVAVAAQDGLART

SEQ ID NO: 1272761 - protein, 24 aa, Mycobacterium
LSKAGLRLQGFEVGEPRLPQIPAT

SEQ ID NO: 1272762 - protein, 17 aa, Mycobacterium
LSKRFANGVDVLDGAQV

SEQ ID NO: 1272763 - protein, 21 aa, Mycobacterium
LSKRPPRWVVVADLVETSRLF

SEQ ID NO: 1272764 - protein, 19 aa, Mycobacterium
LSLAEHLEIILAAKELCET

SEQ ID NO: 1272765 - protein, 19 aa, Mycobacterium
LSLDEARRVLARAQGELPR

SEQ ID NO: 1272766 - protein, 24 aa, Mycobacterium
LSLDIAQAVALVWEATIDATGPDS

SEQ ID NO: 1272767 - protein, 27 aa, Mycobacterium
LSLKDRIYAAWLWSRRRAVIGGLSAAA

SEQ ID NO: 1272768 - protein, 17 aa, Mycobacterium
LSLKQLCEYPVISLPAG

SEQ ID NO: 1272769 - protein, 18 aa, Mycobacterium
LSLLGPRSVFAHAVHCTD

SEQ ID NO: 1272770 - protein, 17 aa, Mycobacterium
LSLLHRILARVLPEDAK

SEQ ID NO: 1272771 - protein, 27 aa, Mycobacterium
LSLMVKAGVQWGLFGGAIENLGTERHH

SEQ ID NO: 1272772 - protein, 17 aa, Mycobacterium
LSLPLGVARVLVGDLVV

SEQ ID NO: 1272773 - protein, 19 aa, Mycobacterium
LSLTCPRDLVVNAPVKMTD

SEQ ID NO: 1272774 - protein, 17 aa, Mycobacterium
LSLVPDVHVCVVRADQI

SEQ ID NO: 1272775 - protein, 21 aa, Mycobacterium
LSMAYLGRLITDWVPQERLRT

SEQ ID NO: 1272776 - protein, 24 aa, Mycobacterium
LSMKTGQGYAEFAVSSFGTDAVVG

SEQ ID NO: 1272777 - protein, 18 aa, Mycobacterium
LSMQTFRASMLNFMRARL

SEQ ID NO: 1272778 - protein, 20 aa, Mycobacterium
LSPALVVTAGFDPLRDEGRH

SEQ ID NO: 1272779 - protein, 19 aa, Mycobacterium
LSPGLGFPSLASPGLTTPG

SEQ ID NO: 1272780 - protein, 24 aa, Mycobacterium
LSPKAWPRHVWIADALPSTATNKV

SEQ ID NO: 1272781 - protein, 23 aa, Mycobacterium
LSPLLKRMEAGGIVRRQRSETDE

SEQ ID NO: 1272782 - protein, 21 aa, Mycobacterium
LSPLRRGRGDPCFHLAPDGTI

SEQ ID NO: 1272783 - protein, 17 aa, Mycobacterium
LSPRRGRIEHMFDTVFA

SEQ ID NO: 1272784 - protein, 17 aa, Mycobacterium
LSPRRWSATEIVDLLCL

SEQ ID NO: 1272785 - protein, 17 aa, Mycobacterium
LSPRSSLLVLGDGRNNY

SEQ ID NO: 1272786 - protein, 18 aa, Mycobacterium
LSPSEHDYVLALGGYTVD

SEQ ID NO: 1272787 - protein, 17 aa, Mycobacterium
LSPSFNWDTTGMSDEEM

SEQ ID NO: 1272788 - protein, 19 aa, Mycobacterium
LSPSRVVLTEGWQAGGAGM

SEQ ID NO: 1272789 - protein, 22 aa, Mycobacterium
LSQAIARALGWDGTGNPLHEEE

SEQ ID NO: 1272790 - protein, 24 aa, Mycobacterium
LSQDARDGLGYVLPTSMQNLLLDY

SEQ ID NO: 1272791 - protein, 24 aa, Mycobacterium
LSQLNYRAAAYLNDGIEPQRHPNG

SEQ ID NO: 1272792 - protein, 22 aa, Mycobacterium
LSQQPAAVVIDFTDVEFLASAG

SEQ ID NO: 1272793 - protein, 17 aa, Mycobacterium
LSQVFVVDEIPRLPSGK

SEQ ID NO: 1272794 - protein, 25 aa, Mycobacterium
LSQWWYWTPGASWRHPIGPGSSIVN

SEQ ID NO: 1272795 - protein, 21 aa, Mycobacterium
LSRAGWLRWSDKLAAAPLKPG

SEQ ID NO: 1272796 - protein, 23 aa, Mycobacterium
LSRELALAFQRLGAFVVAVDRYA

SEQ ID NO: 1272797 - protein, 17 aa, Mycobacterium
LSRELPGSIVIAGAGAI

SEQ ID NO: 1272798 - protein, 23 aa, Mycobacterium
LSRGAQRLWGLLAPESREANGIG

SEQ ID NO: 1272799 - protein, 25 aa, Mycobacterium
LSRGRVRLAVGTGWLAEEINACGAD

SEQ ID NO: 1272800 - protein, 24 aa, Mycobacterium
LSRIDAGLFTGTRFEGHLTELELQ

SEQ ID NO: 1272801 - protein, 25 aa, Mycobacterium
LSRIDAGLFTGTRFEGHLTELELQW

SEQ ID NO: 1272802 - protein, 21 aa, Mycobacterium
LSRIDAGLFTGTRWEGDLTEL

SEQ ID NO: 1272803 - protein, 18 aa, Mycobacterium
LSRLAPVRAALPAGAGSL

SEQ ID NO: 1272804 - protein, 23 aa, Mycobacterium
LSRMVKAAAVSRGSPALYIVEDA

SEQ ID NO: 1272805 - protein, 19 aa, Mycobacterium
LSRQSAWQVLQDAADRAGI

SEQ ID NO: 1272806 - protein, 18 aa, Mycobacterium
LSRQSAWQVLQDAAERAG

SEQ ID NO: 1272807 - protein, 20 aa, Mycobacterium
LSRRGKLWSYTENRYAPPPP

SEQ ID NO: 1272808 - protein, 23 aa, Mycobacterium
LSRSWLKLGAGLHLFDPTDAREH

SEQ ID NO: 1272809 - protein, 26 aa, Mycobacterium
LSRVPGLRCLMLTSFTSDEAMLDAIL

SEQ ID NO: 1272810 - protein, 29 aa, Mycobacterium
LSSDGPASWPPRVIGGWRHTHTFADADGG

SEQ ID NO: 1272811 - protein, 22 aa, Mycobacterium
LSSERMPLAGLILNRTHPTLCS

SEQ ID NO: 1272812 - protein, 20 aa, Mycobacterium
LSSGFPFLPPSHHIVKTSSK

SEQ ID NO: 1272813 - protein, 18 aa, Mycobacterium
LSSMPATVHLIGSHGAEF

SEQ ID NO: 1272814 - protein, 18 aa, Mycobacterium
LSSPDGRGPVLIHALEGF

SEQ ID NO: 1272815 - protein, 20 aa, Mycobacterium
LSSRAVLRTALRVALVKDQR

SEQ ID NO: 1272816 - protein, 17 aa, Mycobacterium
LSSRKRGLAGMSLGLDP

SEQ ID NO: 1272817 - protein, 25 aa, Mycobacterium
LSSRSAELGRVLARCSYLCDGVAVR

SEQ ID NO: 1272818 - protein, 19 aa, Mycobacterium
LSTDLPGIPGVVPRRCLVR

SEQ ID NO: 1272819 - protein, 18 aa, Mycobacterium
LSTDTVERLVRLHAATAA

SEQ ID NO: 1272820 - protein, 17 aa, Mycobacterium
LSTERGMAYTRIGYARP

SEQ ID NO: 1272821 - protein, 21 aa, Mycobacterium
LSTHEFLGMLIAHTGYEDVDI

SEQ ID NO: 1272822 - protein, 18 aa, Mycobacterium
LSTIDVDTTLIWGLHDTV

SEQ ID NO: 1272823 - protein, 26 aa, Mycobacterium
LSTNARAKMSLLRHGFVKIFCRPATG

SEQ ID NO: 1272824 - protein, 24 aa, Mycobacterium
LSTRVQGALLWLRRVPVVPRGSDE

SEQ ID NO: 1272825 - protein, 20 aa, Mycobacterium
LSTWFAAIWLVTSQKNGAAK

SEQ ID NO: 1272826 - protein, 17 aa, Mycobacterium
LSTYPAMDAMGMGEGGV

SEQ ID NO: 1272827 - protein, 19 aa, Mycobacterium
LSVAARWGLWDQPAVLVAQ

SEQ ID NO: 1272828 - protein, 17 aa, Mycobacterium
LSVAYRLTGSVTDAEDA

SEQ ID NO: 1272829 - protein, 25 aa, Mycobacterium
LSVDLGGSWLLPRIVGLQQAKRLVL

SEQ ID NO: 1272830 - protein, 18 aa, Mycobacterium
LSVDRFVREDSPLPVDAS

SEQ ID NO: 1272831 - protein, 19 aa, Mycobacterium
LSVFWRHMPPGLLAQDLAR

SEQ ID NO: 1272832 - protein, 18 aa, Mycobacterium
LSVLDVFGMLGAGGSIVV

SEQ ID NO: 1272833 - protein, 19 aa, Mycobacterium
LSVRCAQIGRVPRGTADLW

SEQ ID NO: 1272834 - protein, 19 aa, Mycobacterium
LSVRCAQIGRVPRGTAHLW

SEQ ID NO: 1272835 - protein, 20 aa, Mycobacterium
LSVRSSVMVFLVRHERHESF

SEQ ID NO: 1272836 - protein, 19 aa, Mycobacterium
LSVSLKFQGFEVHTASNGP

SEQ ID NO: 1272837 - protein, 18 aa, Mycobacterium
LSVSVARTLAAGGDAANQ

SEQ ID NO: 1272838 - protein, 36 aa, Mycobacterium
LSVSWYLSRAGIEHVVLEAATPVHAWADSRWDNFTL

SEQ ID NO: 1272839 - protein, 23 aa, Mycobacterium
LSVVSARCEPVFVIAAPGQALPE

SEQ ID NO: 1272840 - protein, 25 aa, Mycobacterium
LSWLPRSAALAAVFPRNRETTWRLA

SEQ ID NO: 1272841 - protein, 19 aa, Mycobacterium
LSYFLDLRGPSITVDTACS

SEQ ID NO: 1272842 - protein, 17 aa, Mycobacterium
LSYGRFGDDLARSTGDE

SEQ ID NO: 1272843 - protein, 18 aa, Mycobacterium
LSYPGLRMVDVEPDQVIK

SEQ ID NO: 1272844 - protein, 20 aa, Mycobacterium
LSYWYAEQVTILGLGPIWQS

SEQ ID NO: 1272845 - protein, 26 aa, Mycobacterium
LTAAGLCARLGSTRGSFYHHFGSFDQ

SEQ ID NO: 1272846 - protein, 20 aa, Mycobacterium
LTAALRRSGALAGDDAVVAV

SEQ ID NO: 1272847 - protein, 23 aa, Mycobacterium
LTAAQRGLVRFHHRLRVDELVYT

SEQ ID NO: 1272848 - protein, 20 aa, Mycobacterium
LTADELVPLISRDSMVGTAL

SEQ ID NO: 1272849 - protein, 28 aa, Mycobacterium
LTADFNFAWPTARIAVIGAEGAAQLLVK

SEQ ID NO: 1272850 - protein, 17 aa, Mycobacterium
LTAEEALDWGMVARVVA

SEQ ID NO: 1272851 - protein, 19 aa, Mycobacterium
LTAFGESPTALVLAGGGAL

SEQ ID NO: 1272852 - protein, 19 aa, Mycobacterium
LTAGAWLEVRLPEAPAPVE

SEQ ID NO: 1272853 - protein, 18 aa, Mycobacterium
LTAGPDLLAAMVGALSAG

SEQ ID NO: 1272854 - protein, 24 aa, Mycobacterium
LTAGSRLLLLWGAANRDPARFDAP

SEQ ID NO: 1272855 - protein, 17 aa, Mycobacterium
LTAGVLLFTTRREIRGA

SEQ ID NO: 1272856 - protein, 17 aa, Mycobacterium
LTAGVLVFTTRREVRGA

SEQ ID NO: 1272857 - protein, 18 aa, Mycobacterium
LTAGYELEFYLYRETPET

SEQ ID NO: 1272858 - protein, 19 aa, Mycobacterium
LTAHRGRAAALPLRAFGAG

SEQ ID NO: 1272859 - protein, 18 aa, Mycobacterium
LTALICGADPEAVTASLS

SEQ ID NO: 1272860 - protein, 17 aa, Mycobacterium
LTALMGRIAQRRVRLLE

SEQ ID NO: 1272861 - protein, 19 aa, Mycobacterium
LTALPPYTTVQPLAFDDIA

SEQ ID NO: 1272862 - protein, 22 aa, Mycobacterium
LTALPRNGFRTVAGLTGITDLV

SEQ ID NO: 1272863 - protein, 18 aa, Mycobacterium
LTALPVLLIVVDEFSELL

SEQ ID NO: 1272864 - protein, 26 aa, Mycobacterium
LTALRRTRVGGFGLEQARTLDELAEA

SEQ ID NO: 1272865 - protein, 17 aa, Mycobacterium
LTALVARTSQVLNERAA

SEQ ID NO: 1272866 - protein, 27 aa, Mycobacterium
LTAMRRPRVGVMIARGDLAVEVGYERL

SEQ ID NO: 1272867 - protein, 22 aa, Mycobacterium
LTANAYLGAWGIVDCLDSGADV

SEQ ID NO: 1272868 - protein, 17 aa, Mycobacterium
LTAPTGHSVSMTPDALD

SEQ ID NO: 1272869 - protein, 26 aa, Mycobacterium
LTASGYFGGLWLRDSLRDNATGADTP

SEQ ID NO: 1272870 - protein, 22 aa, Mycobacterium
LTAVDAPHAFGYTLSGITGALA

SEQ ID NO: 1272871 - protein, 19 aa, Mycobacterium
LTAVELFVGAVMDLHETVT

SEQ ID NO: 1272872 - protein, 17 aa, Mycobacterium
LTAVPGWGLYCAGKFAL

SEQ ID NO: 1272873 - protein, 21 aa, Mycobacterium
LTAYPRPQWLTSRQHDGEPVV

SEQ ID NO: 1272874 - protein, 24 aa, Mycobacterium
LTAYRGRGLDSWMVDELGRVVDEL

SEQ ID NO: 1272875 - protein, 36 aa, Mycobacterium
LTCKAVAADGGYRINGAKAWITHGGIADFYNLFART

SEQ ID NO: 1272876 - protein, 19 aa, Mycobacterium
LTDAIALLIQEGHPVHVVI

SEQ ID NO: 1272877 - protein, 19 aa, Mycobacterium
LTDDEFGFFMVLLAVAGNE

SEQ ID NO: 1272878 - protein, 24 aa, Mycobacterium
LTDERIAYADGWFAEAHDDCASIT

SEQ ID NO: 1272879 - protein, 20 aa, Mycobacterium
LTDICVWDGNAFTFTKTLTT

SEQ ID NO: 1272880 - protein, 29 aa, Mycobacterium
LTDLKFRLTREDFADAVAWVARNLPSRPT

SEQ ID NO: 1272881 - protein, 17 aa, Mycobacterium
LTDLRASLARYIDADPA

SEQ ID NO: 1272882 - protein, 27 aa, Mycobacterium
LTDNILWLLKQAFYFSLTTVNEAISEH

SEQ ID NO: 1272883 - protein, 24 aa, Mycobacterium
LTDRAKSLLAKRGFDPVLGARPLR

SEQ ID NO: 1272884 - protein, 30 aa, Mycobacterium
LTDRAWRGIGVIPGSGWRLSHAYRDYDAEQ

SEQ ID NO: 1272885 - protein, 23 aa, Mycobacterium
LTDRGWRLCRDLLAAGAPPRSTG

SEQ ID NO: 1272886 - protein, 20 aa, Mycobacterium
LTEARAAFRRMQQARHVGKI

SEQ ID NO: 1272887 - protein, 18 aa, Mycobacterium
LTEELDYRHEADMITRFS

SEQ ID NO: 1272888 - protein, 27 aa, Mycobacterium
LTEFARSACRWAPRVVFVNGHGGNVEA

SEQ ID NO: 1272889 - protein, 20 aa, Mycobacterium
LTEFPNIELDIMMVPLPGLF

SEQ ID NO: 1272890 - protein, 18 aa, Mycobacterium
LTEIGRHGTISPALVTLG

SEQ ID NO: 1272891 - protein, 17 aa, Mycobacterium
LTEITWHLMMRDNERYA

SEQ ID NO: 1272892 - protein, 23 aa, Mycobacterium
LTEKGRALAVAVMRKHRLAERLL

SEQ ID NO: 1272893 - protein, 23 aa, Mycobacterium
LTELDGLLLRIALANTGRPPLLV

SEQ ID NO: 1272894 - protein, 19 aa, Mycobacterium
LTEMPSHRVLAVLRGEKEQ

SEQ ID NO: 1272895 - protein, 20 aa, Mycobacterium
LTEQLDILTGMWATPVGEMF

SEQ ID NO: 1272896 - protein, 17 aa, Mycobacterium
LTESVPVQLVWGTHDSV

SEQ ID NO: 1272897 - protein, 22 aa, Mycobacterium
LTETSARCDYVLPVTTMYERDD

SEQ ID NO: 1272898 - protein, 18 aa, Mycobacterium
LTFADLQIHPAVLQAVAD

SEQ ID NO: 1272899 - protein, 20 aa, Mycobacterium
LTFAGDAVFAPGFDNPEWHN

SEQ ID NO: 1272900 - protein, 17 aa, Mycobacterium
LTFDAPAGGRAWVTALL

SEQ ID NO: 1272901 - protein, 18 aa, Mycobacterium
LTFGKGLHYCLGANLARL

SEQ ID NO: 1272902 - protein, 25 aa, Mycobacterium
LTFLDREGWDALTINALANQLGTKG

SEQ ID NO: 1272903 - protein, 29 aa, Mycobacterium
LTGCASIYHSIRCALALADYVDDPQPEWE

SEQ ID NO: 1272904 - protein, 18 aa, Mycobacterium
LTGDWPGLRSDIDTPDDV

SEQ ID NO: 1272905 - protein, 17 aa, Mycobacterium
LTGEIDIRIGLGHIDVE

SEQ ID NO: 1272906 - protein, 23 aa, Mycobacterium
LTGEPEPLFGFPGAPMRAEHLWA

SEQ ID NO: 1272907 - protein, 23 aa, Mycobacterium
LTGEQRVFFGWAQVWRTKSREAE

SEQ ID NO: 1272908 - protein, 17 aa, Mycobacterium
LTGFRVAVTSARRAEEL

SEQ ID NO: 1272909 - protein, 20 aa, Mycobacterium
LTGHFGRFRGASVYGATKAG

SEQ ID NO: 1272910 - protein, 25 aa, Mycobacterium
LTGLDLRPATSLRHCLDLLVDFAGT

SEQ ID NO: 1272911 - protein, 17 aa, Mycobacterium
LTGLPPLRLNLPTPEEF

SEQ ID NO: 1272912 - protein, 26 aa, Mycobacterium
LTGNLDRPGGVMFPLSPVAPAPRGHR

SEQ ID NO: 1272913 - protein, 24 aa, Mycobacterium
LTGPRWRLGARDVAALWRRAVALV

SEQ ID NO: 1272914 - protein, 18 aa, Mycobacterium
LTGRHFRDLTALTGTTEA

SEQ ID NO: 1272915 - protein, 20 aa, Mycobacterium
LTGRLASAMAARGSGSVVNI

SEQ ID NO: 1272916 - protein, 25 aa, Mycobacterium
LTGRRPEHMHIWLGSGRMETLRVSD

SEQ ID NO: 1272917 - protein, 17 aa, Mycobacterium
LTGRVVLVTGGVRGVGA

SEQ ID NO: 1272918 - protein, 20 aa, Mycobacterium
LTHFTQIFVIPTFIRGGTNV

SEQ ID NO: 1272919 - protein, 22 aa, Mycobacterium
LTHLQGRFFAAAAYPQFALQHD

SEQ ID NO: 1272920 - protein, 17 aa, Mycobacterium
LTHNRVWMKAHGALPDD

SEQ ID NO: 1272921 - protein, 25 aa, Mycobacterium
LTHPEPELAAIIGRRIKAVQPEQAL

SEQ ID NO: 1272922 - protein, 17 aa, Mycobacterium
LTHPGWVSSNLAKVSDT

SEQ ID NO: 1272923 - protein, 19 aa, Mycobacterium
LTHQEWLQFSACVAETIRG

SEQ ID NO: 1272924 - protein, 23 aa, Mycobacterium
LTHREIARRVGLSRSAAAARVQR

SEQ ID NO: 1272925 - protein, 17 aa, Mycobacterium
LTIGWPAAGDGWVPVRL

SEQ ID NO: 1272926 - protein, 17 aa, Mycobacterium
LTIPILLIRGKLSDVVS

SEQ ID NO: 1272927 - protein, 18 aa, Mycobacterium
LTIPILLIRGKLSDVVSS

SEQ ID NO: 1272928 - protein, 18 aa, Mycobacterium
LTIPRLGADRADSQYPIR

SEQ ID NO: 1272929 - protein, 23 aa, Mycobacterium
LTITERRVGIVGANGSGKSTLAR

SEQ ID NO: 1272930 - protein, 24 aa, Mycobacterium
LTKAADHSKLWFAIAAGLAALGSS

SEQ ID NO: 1272931 - protein, 24 aa, Mycobacterium
LTKGDVYTLWAPRWRADGDEWEAF

SEQ ID NO: 1272932 - protein, 39 aa, Mycobacterium
LTKPQFAMPTTGVWTSGFGYRWGVLHAGIDIANAIGTPI

SEQ ID NO: 1272933 - protein, 17 aa, Mycobacterium
LTLAEGAIAPWSMGHTA

SEQ ID NO: 1272934 - protein, 17 aa, Mycobacterium
LTLAGGVLLKGECAALT

SEQ ID NO: 1272935 - protein, 18 aa, Mycobacterium
LTLAKAPARAALRTPEGK

SEQ ID NO: 1272936 - protein, 32 aa, Mycobacterium
LTLAQLRARLTSLRLADLEALLSYEESTKARA

SEQ ID NO: 1272937 - protein, 27 aa, Mycobacterium
LTLAREHPRIFPVAIAGVLFGHADPAD

SEQ ID NO: 1272938 - protein, 24 aa, Mycobacterium
LTLARLAAEAGLPAGVFNVVTGSG

SEQ ID NO: 1272939 - protein, 25 aa, Mycobacterium
LTLCYDIRFPELYVELAERGAEIIT

SEQ ID NO: 1272940 - protein, 25 aa, Mycobacterium
LTLIKSWASQGWLHRIVDPRSDQNV

SEQ ID NO: 1272941 - protein, 28 aa, Mycobacterium
LTLMLLRGMGIPSRYVSGYLHPKRNAKI

SEQ ID NO: 1272942 - protein, 26 aa, Mycobacterium
LTLSAARALGRFGVRANAIAPRARTA

SEQ ID NO: 1272943 - protein, 19 aa, Mycobacterium
LTLTLPHKIYGQFRDEART

SEQ ID NO: 1272944 - protein, 26 aa, Mycobacterium
LTLVLGYCGLRFGEAVALRRRHVGDR

SEQ ID NO: 1272945 - protein, 19 aa, Mycobacterium
LTLWSARAVESFALEAFNT

SEQ ID NO: 1272946 - protein, 19 aa, Mycobacterium
LTLYIPDPSGSVLELDPDR

SEQ ID NO: 1272947 - protein, 20 aa, Mycobacterium
LTMAHLRGTLDAFARAQFGP

SEQ ID NO: 1272948 - protein, 17 aa, Mycobacterium
LTMHASQVRDWYGTEDG

SEQ ID NO: 1272949 - protein, 17 aa, Mycobacterium
LTMPFLDPRKRVADYPT

SEQ ID NO: 1272950 - protein, 27 aa, Mycobacterium
LTNDDVLRCARLIRAGEAAWFAGHLTR

SEQ ID NO: 1272951 - protein, 18 aa, Mycobacterium
LTNFPGSVRSTGPGLGIH

SEQ ID NO: 1272952 - protein, 23 aa, Mycobacterium
LTNSRAFVSWAVNDAVARGELSA

SEQ ID NO: 1272953 - protein, 26 aa, Mycobacterium
LTNVKVPLQPGVPWVFQTTLDDPTQW

SEQ ID NO: 1272954 - protein, 18 aa, Mycobacterium
LTPALGIGAFADKTLVHE

SEQ ID NO: 1272955 - protein, 19 aa, Mycobacterium
LTPEERRAMGYKELPGSLG

SEQ ID NO: 1272956 - protein, 23 aa, Mycobacterium
LTPEHYYRALSLAVRDRMQKRWM

SEQ ID NO: 1272957 - protein, 29 aa, Mycobacterium
LTPESGCRMGICFSCTRRKTSGAVRNVIT

SEQ ID NO: 1272958 - protein, 20 aa, Mycobacterium
LTPHAGPCASQFTIATDGME

SEQ ID NO: 1272959 - protein, 25 aa, Mycobacterium
LTPLTAVACQALLERACADVGAPAA

SEQ ID NO: 1272960 - protein, 18 aa, Mycobacterium
LTPQACEGAQKFRIASEP

SEQ ID NO: 1272961 - protein, 17 aa, Mycobacterium
LTPQFPGLDTFAGEIYH

SEQ ID NO: 1272962 - protein, 17 aa, Mycobacterium
LTPRTGRTHQLRVHMSS

SEQ ID NO: 1272963 - protein, 26 aa, Mycobacterium
LTPRYAVGCKRPGFHNTYLSTFNRDN

SEQ ID NO: 1272964 - protein, 27 aa, Mycobacterium
LTPTELRLLVFLLRNAERVVSRSQILD

SEQ ID NO: 1272965 - protein, 27 aa, Mycobacterium
LTPVFATKTKLEWERELSAQDVGCVEV

SEQ ID NO: 1272966 - protein, 27 aa, Mycobacterium
LTPVQKARAAWLWSGRRGTLVGLSAAA

SEQ ID NO: 1272967 - protein, 19 aa, Mycobacterium
LTQFPALRLIGLDRDPDAL

SEQ ID NO: 1272968 - protein, 18 aa, Mycobacterium
LTQPLGMTDTGFWTDADR

SEQ ID NO: 1272969 - protein, 26 aa, Mycobacterium
LTQPRFTGTISLRYLRGTPLGPLRAE

SEQ ID NO: 1272970 - protein, 33 aa, Mycobacterium
LTQRAWAFLPERPVDARAVLLCLAGGTYDKQYW

SEQ ID NO: 1272971 - protein, 23 aa, Mycobacterium
LTQRRFVAMHLPHAGALETTVVA

SEQ ID NO: 1272972 - protein, 17 aa, Mycobacterium
LTREVLLPAAAAGLDAW

SEQ ID NO: 1272973 - protein, 20 aa, Mycobacterium
LTRFPKLRIASVENGSAWIK

SEQ ID NO: 1272974 - protein, 20 aa, Mycobacterium
LTRFPKLRIASVENGSSWIF

SEQ ID NO: 1272975 - protein, 18 aa, Mycobacterium
LTRIGYRGAGDPTLATLR

SEQ ID NO: 1272976 - protein, 20 aa, Mycobacterium
LTRILMSWRREVRRTEGTDQ

SEQ ID NO: 1272977 - protein, 27 aa, Mycobacterium
LTRPTLRGRPVLVGGVGGRGVVAGASY

SEQ ID NO: 1272978 - protein, 20 aa, Mycobacterium
LTRRELDVLTRIARGATNRQ

SEQ ID NO: 1272979 - protein, 21 aa, Mycobacterium
LTRRRGALALGALRRTGQSEA

SEQ ID NO: 1272980 - protein, 17 aa, Mycobacterium
LTRTEFDLLAALSARPG

SEQ ID NO: 1272981 - protein, 34 aa, Mycobacterium
LTRTPAYRGCASWVDLPVSPAWAAPVHTDAVLDE

SEQ ID NO: 1272982 - protein, 25 aa, Mycobacterium
LTRVTRQAAALGVEPMRLSTTLCVA

SEQ ID NO: 1272983 - protein, 17 aa, Mycobacterium
LTSALCYSARPDPSYDP

SEQ ID NO: 1272984 - protein, 29 aa, Mycobacterium
LTSDLGFRMPSLWFADGHRAVAPVYLYRF

SEQ ID NO: 1272985 - protein, 19 aa, Mycobacterium
LTSDLPLLVIWGDEDRIIP

SEQ ID NO: 1272986 - protein, 25 aa, Mycobacterium
LTSEMPGFAWPTVVVSGGRDLTTPP

SEQ ID NO: 1272987 - protein, 29 aa, Mycobacterium
LTSGLVLAGARWSLPPLVTPVGAPTYTLG

SEQ ID NO: 1272988 - protein, 18 aa, Mycobacterium
LTSRGHEALVHVERRART

SEQ ID NO: 1272989 - protein, 17 aa, Mycobacterium
LTSVPFAPGYGVEIGLL

SEQ ID NO: 1272990 - protein, 22 aa, Mycobacterium
LTTAWLHKPMFTLRGGTNEVLR

SEQ ID NO: 1272991 - protein, 19 aa, Mycobacterium
LTTFALWGGGVVDLRYADF

SEQ ID NO: 1272992 - protein, 21 aa, Mycobacterium
LTTHGRRIWLALRRTPKVNSL

SEQ ID NO: 1272993 - protein, 28 aa, Mycobacterium
LTTIAARTDVGIGIIRTMLRHAPKGEKS

SEQ ID NO: 1272994 - protein, 18 aa, Mycobacterium
LTTRLEFYFRRWKAPALV

SEQ ID NO: 1272995 - protein, 20 aa, Mycobacterium
LTTSVAWRLRGQTSYCADGQ

SEQ ID NO: 1272996 - protein, 18 aa, Mycobacterium
LTTWVYVRLQAGGGLDGP

SEQ ID NO: 1272997 - protein, 17 aa, Mycobacterium
LTVAAVPYLRAGQGKSI

SEQ ID NO: 1272998 - protein, 24 aa, Mycobacterium
LTVAAWPGLAPRLLRDGTDTESAA

SEQ ID NO: 1272999 - protein, 28 aa, Mycobacterium
LTVADARAAIRWYIDVFDAELVGDPVEM

SEQ ID NO: 1273000 - protein, 17 aa, Mycobacterium
LTVARRIVGDRIVGRST

SEQ ID NO: 1273001 - protein, 18 aa, Mycobacterium
LTVAWPGAHLGPMGLEGA

SEQ ID NO: 1273002 - protein, 17 aa, Mycobacterium
LTVDLPPMIELRRKLLP

SEQ ID NO: 1273003 - protein, 23 aa, Mycobacterium
LTVEAWACAFGPGGEAATIATEM

SEQ ID NO: 1273004 - protein, 18 aa, Mycobacterium
LTVGDLYIDYSKHRVTRE

SEQ ID NO: 1273005 - protein, 18 aa, Mycobacterium
LTVGLGRLAAEHGLRVHT

SEQ ID NO: 1273006 - protein, 31 aa, Mycobacterium
LTVKSPEFVSLWADHRVKRCEADTYDLHHPL

SEQ ID NO: 1273007 - protein, 17 aa, Mycobacterium
LTVLTAPTWSGMSTFDL

SEQ ID NO: 1273008 - protein, 24 aa, Mycobacterium
LTVMPGEFVCLMGPSGSGKSTLLN

SEQ ID NO: 1273009 - protein, 18 aa, Mycobacterium
LTVPAGTWRIIRKTEFDA

SEQ ID NO: 1273010 - protein, 17 aa, Mycobacterium
LTVPLMRAGEPVADIGL

SEQ ID NO: 1273011 - protein, 26 aa, Mycobacterium
LTVRARHGVLICRNGIPARGASPPGF

SEQ ID NO: 1273012 - protein, 17 aa, Mycobacterium
LTVRDNVAFGLKIRKKP

SEQ ID NO: 1273013 - protein, 17 aa, Mycobacterium
LTVRSAWQADNRIPNSK

SEQ ID NO: 1273014 - protein, 23 aa, Mycobacterium
LTVTEFLARHGFHGPNEGNVIGH

SEQ ID NO: 1273015 - protein, 23 aa, Mycobacterium
LTVTPGEFVCLMGPSGSGKSTLL

SEQ ID NO: 1273016 - protein, 18 aa, Mycobacterium
LTVTVGIGPHVFDRIGLA

SEQ ID NO: 1273017 - protein, 18 aa, Mycobacterium
LTVVPRLVCHPTESYGMR

SEQ ID NO: 1273018 - protein, 17 aa, Mycobacterium
LTWTSPRPFGVGTTREV

SEQ ID NO: 1273019 - protein, 17 aa, Mycobacterium
LTYDHRLIDGADAGRFV

SEQ ID NO: 1273020 - protein, 20 aa, Mycobacterium
LTYLSGLVFAFANGSTEPMT

SEQ ID NO: 1273021 - protein, 17 aa, Mycobacterium
LVAACVEHDLPVQCLPG

SEQ ID NO: 1273022 - protein, 24 aa, Mycobacterium
LVAAGVRPAGVWAYEAHRVAARRP

SEQ ID NO: 1273023 - protein, 26 aa, Mycobacterium
LVAARGIEIGHVFQLGRKYADAFGAD

SEQ ID NO: 1273024 - protein, 19 aa, Mycobacterium
LVAAWRGEPVEAMRQIDAA

SEQ ID NO: 1273025 - protein, 17 aa, Mycobacterium
LVADLGLGDSVNFVGVR

SEQ ID NO: 1273026 - protein, 18 aa, Mycobacterium
LVADRPTLRHVLVDGDPG

SEQ ID NO: 1273027 - protein, 18 aa, Mycobacterium
LVAELDRGTWTPAPVFGM

SEQ ID NO: 1273028 - protein, 18 aa, Mycobacterium
LVAELRAGLPGGLAVAGA

SEQ ID NO: 1273029 - protein, 18 aa, Mycobacterium
LVAESGLLGISVPTAHGG

SEQ ID NO: 1273030 - protein, 25 aa, Mycobacterium
LVAFKDRMGWDLPWVSSGRTTFNED

SEQ ID NO: 1273031 - protein, 18 aa, Mycobacterium
LVAGRPSDKWGQEVVAVV

SEQ ID NO: 1273032 - protein, 17 aa, Mycobacterium
LVAHIWEALGSVGFAGG

SEQ ID NO: 1273033 - protein, 18 aa, Mycobacterium
LVAHIWEALGSVGFAGGS

SEQ ID NO: 1273034 - protein, 24 aa, Mycobacterium
LVAHLRFGLRLIYGRLADEFTALG

SEQ ID NO: 1273035 - protein, 25 aa, Mycobacterium
LVALDRFEALAGFRPVARTVDLMRA

SEQ ID NO: 1273036 - protein, 21 aa, Mycobacterium
LVALHRGDLVFVWPADTGPAV

SEQ ID NO: 1273037 - protein, 21 aa, Mycobacterium
LVALMCAGGYTVAATKRVTLS

SEQ ID NO: 1273038 - protein, 19 aa, Mycobacterium
LVAMPALNLDAAFVHMNIG

SEQ ID NO: 1273039 - protein, 22 aa, Mycobacterium
LVANDKWWGAKPVTNRITVWPR

SEQ ID NO: 1273040 - protein, 22 aa, Mycobacterium
LVASAQFADWVDRGRPAPTHLG

SEQ ID NO: 1273041 - protein, 25 aa, Mycobacterium
LVAVSWPKAYGGAGLSVIEQVVLDE

SEQ ID NO: 1273042 - protein, 23 aa, Mycobacterium
LVCGGVKTANATVYMIDTVLMPP

SEQ ID NO: 1273043 - protein, 24 aa, Mycobacterium
LVCQDWGGLIGLRLVGEHPDRFAR

SEQ ID NO: 1273044 - protein, 20 aa, Mycobacterium
LVCRAMNWRAEREGPEHPPP

SEQ ID NO: 1273045 - protein, 17 aa, Mycobacterium
LVDACRLSRARVVVTPH

SEQ ID NO: 1273046 - protein, 22 aa, Mycobacterium
LVDARTIITLSGFAPPTLHAMG

SEQ ID NO: 1273047 - protein, 21 aa, Mycobacterium
LVDCGRGVQLRMAAAGIAANG

SEQ ID NO: 1273048 - protein, 21 aa, Mycobacterium
LVDGAGLRWLAAELDRDPGLR

SEQ ID NO: 1273049 - protein, 18 aa, Mycobacterium
LVDGDAFVVPRLRPPQAR

SEQ ID NO: 1273050 - protein, 19 aa, Mycobacterium
LVDLIRPVLRDYLTSRGHE

SEQ ID NO: 1273051 - protein, 17 aa, Mycobacterium
LVDLQRRLADGSGSVVV

SEQ ID NO: 1273052 - protein, 23 aa, Mycobacterium
LVDPRNWTLLKWLDEPVPFLDRH

SEQ ID NO: 1273053 - protein, 25 aa, Mycobacterium
LVDPRVVDGTAWITGADELGKHVVD

SEQ ID NO: 1273054 - protein, 19 aa, Mycobacterium
LVDRLDLAKHLTRSATEQL

SEQ ID NO: 1273055 - protein, 24 aa, Mycobacterium
LVDTARLWLSLGHHDRYGRWRIDG

SEQ ID NO: 1273056 - protein, 23 aa, Mycobacterium
LVDVRFPVQYVIRPQTREHADHR

SEQ ID NO: 1273057 - protein, 18 aa, Mycobacterium
LVEAYLRGPMRGAVSPPN

SEQ ID NO: 1273058 - protein, 18 aa, Mycobacterium
LVEFTLRTMLSFFVAPNV

SEQ ID NO: 1273059 - protein, 19 aa, Mycobacterium
LVEFVKARGIKLIVFDTQR

SEQ ID NO: 1273060 - protein, 17 aa, Mycobacterium
LVEHFILERKWGRWMGR

SEQ ID NO: 1273061 - protein, 26 aa, Mycobacterium
LVEQLRLKCALVRAIQVCSALDTILV

SEQ ID NO: 1273062 - protein, 23 aa, Mycobacterium
LVERLIPDFLWIDTEYTAKVSLD

SEQ ID NO: 1273063 - protein, 19 aa, Mycobacterium
LVEVNAWAAAEGYYQLGEV

SEQ ID NO: 1273064 - protein, 27 aa, Mycobacterium
LVEYAQLRAQWGWKLVAAATTAGVSVL

SEQ ID NO: 1273065 - protein, 23 aa, Mycobacterium
LVFAAMMACTIVTRRKFDPEATL

SEQ ID NO: 1273066 - protein, 18 aa, Mycobacterium
LVFCGSPRRYEPRWFRAP

SEQ ID NO: 1273067 - protein, 19 aa, Mycobacterium
LVFGLQCAAFIERLDPSIY

SEQ ID NO: 1273068 - protein, 20 aa, Mycobacterium
LVFPVKRLADLGFRVLATEG

SEQ ID NO: 1273069 - protein, 24 aa, Mycobacterium
LVGAFRLTQLVGRKMIERGEGSIV

SEQ ID NO: 1273070 - protein, 24 aa, Mycobacterium
LVGAYRLAGKRVAVLAVDPSSPYN

SEQ ID NO: 1273071 - protein, 17 aa, Mycobacterium
LVGCYAWSADKAGRDVG

SEQ ID NO: 1273072 - protein, 17 aa, Mycobacterium
LVGCYAWSDDKVGRDAG

SEQ ID NO: 1273073 - protein, 18 aa, Mycobacterium
LVGFNEWLGGHMDELRRN

SEQ ID NO: 1273074 - protein, 20 aa, Mycobacterium
LVGGGPSFRVENRIPGGDVN

SEQ ID NO: 1273075 - protein, 19 aa, Mycobacterium
LVGHNGGWTPVHVTVNRVK

SEQ ID NO: 1273076 - protein, 18 aa, Mycobacterium
LVGILRIVGNLITRGAAR

SEQ ID NO: 1273077 - protein, 18 aa, Mycobacterium
LVGISTRLLAGAVEVVDR

SEQ ID NO: 1273078 - protein, 17 aa, Mycobacterium
LVGLHSHIGSQIFDVAG

SEQ ID NO: 1273079 - protein, 24 aa, Mycobacterium
LVGRLSCLENVLIGGLGQLTFPRY

SEQ ID NO: 1273080 - protein, 22 aa, Mycobacterium
LVGVCTNTLCAIMGGDEILDAL

SEQ ID NO: 1273081 - protein, 18 aa, Mycobacterium
LVGVLLEVLRRAKAGKDH

SEQ ID NO: 1273082 - protein, 22 aa, Mycobacterium
LVHADLRLANLLVDGDTITVID

SEQ ID NO: 1273083 - protein, 17 aa, Mycobacterium
LVHAFAAVAGMSNRLFG

SEQ ID NO: 1273084 - protein, 18 aa, Mycobacterium
LVHGDFRMGNLIVDESGL

SEQ ID NO: 1273085 - protein, 19 aa, Mycobacterium
LVHGFALLWLNGAVNTTGD

SEQ ID NO: 1273086 - protein, 17 aa, Mycobacterium
LVHTVGFGWDPRRAWRL

SEQ ID NO: 1273087 - protein, 17 aa, Mycobacterium
LVHWKDAILQFTDPGSG

SEQ ID NO: 1273088 - protein, 19 aa, Mycobacterium
LVIAAGFSGHGFKIAPAVG

SEQ ID NO: 1273089 - protein, 18 aa, Mycobacterium
LVIARTFLADTLAGQRDQ

SEQ ID NO: 1273090 - protein, 18 aa, Mycobacterium
LVICPGAWAPQLLAEFGI

SEQ ID NO: 1273091 - protein, 31 aa, Mycobacterium
LVILLHGFASFWWSWRHQLRGLSGARVVAVD

SEQ ID NO: 1273092 - protein, 18 aa, Mycobacterium
LVIRGEVRAVPAAAQASL

SEQ ID NO: 1273093 - protein, 20 aa, Mycobacterium
LVIRPEGRLNMVAAPALRKQ

SEQ ID NO: 1273094 - protein, 21 aa, Mycobacterium
LVIRPEGRLNMVAAPALRKQI

SEQ ID NO: 1273095 - protein, 25 aa, Mycobacterium
LVISCGIVLDHFRVAMAAAGWKCNV

SEQ ID NO: 1273096 - protein, 24 aa, Mycobacterium
LVLDGLRLAARIIGARHTHVYVSD

SEQ ID NO: 1273097 - protein, 18 aa, Mycobacterium
LVLDSLRLGRPVEFGEAP

SEQ ID NO: 1273098 - protein, 24 aa, Mycobacterium
LVLGAYRFSEFRSEKTAPKDAGVR

SEQ ID NO: 1273099 - protein, 17 aa, Mycobacterium
LVLKPAPDTPWAAAVLG

SEQ ID NO: 1273100 - protein, 25 aa, Mycobacterium
LVLLDRASGQWSRHPWQEVHARAEN

SEQ ID NO: 1273101 - protein, 18 aa, Mycobacterium
LVLNRPEALNAFNQELYL

SEQ ID NO: 1273102 - protein, 17 aa, Mycobacterium
LVLPFSPVCGPDCQGLC

SEQ ID NO: 1273103 - protein, 25 aa, Mycobacterium
LVLRSLGSAGLRFERQCQNALAVAM

SEQ ID NO: 1273104 - protein, 17 aa, Mycobacterium
LVLTSFEGAIVVARASR

SEQ ID NO: 1273105 - protein, 19 aa, Mycobacterium
LVLVDGVTVMTGRYPDRSQ

SEQ ID NO: 1273106 - protein, 32 aa, Mycobacterium
LVLVSARGTERWLSQRLSHILGRGSGQDGICA

SEQ ID NO: 1273107 - protein, 17 aa, Mycobacterium
LVMHCVHRNPGVPSYFD

SEQ ID NO: 1273108 - protein, 18 aa, Mycobacterium
LVMLLRRIWNLHEGPVHH

SEQ ID NO: 1273109 - protein, 18 aa, Mycobacterium
LVNVTAWALWDSRTGEPA

SEQ ID NO: 1273110 - protein, 17 aa, Mycobacterium
LVPDLAAFWSRYLLAAR

SEQ ID NO: 1273111 - protein, 23 aa, Mycobacterium
LVPDLAAFWSRYLLAARERGEIH

SEQ ID NO: 1273112 - protein, 26 aa, Mycobacterium
LVPDQSTRVALPWRPGTDAVIADMVG

SEQ ID NO: 1273113 - protein, 21 aa, Mycobacterium
LVPDRLAARYLLAEATAEDGE

SEQ ID NO: 1273114 - protein, 18 aa, Mycobacterium
LVPEPRRLATRTDTQVLG

SEQ ID NO: 1273115 - protein, 20 aa, Mycobacterium
LVPEPRRLATRTDVQVLELA

SEQ ID NO: 1273116 - protein, 20 aa, Mycobacterium
LVPERLDRAIARGIHTIDAS

SEQ ID NO: 1273117 - protein, 23 aa, Mycobacterium
LVPERYEEVKARLTAKDSETGEA

SEQ ID NO: 1273118 - protein, 17 aa, Mycobacterium
LVPMLTKAEVERSLLDE

SEQ ID NO: 1273119 - protein, 17 aa, Mycobacterium
LVPPMTCDPAFTDLLSG

SEQ ID NO: 1273120 - protein, 23 aa, Mycobacterium
LVPRTAAVFSAFGISFSDIGKTY

SEQ ID NO: 1273121 - protein, 28 aa, Mycobacterium
LVPSCSYPLTGLRCVNRVYTDYAVFDID

SEQ ID NO: 1273122 - protein, 23 aa, Mycobacterium
LVPWTATVKNHFVRIRPLNITGR

SEQ ID NO: 1273123 - protein, 19 aa, Mycobacterium
LVQGERIFPSFEAMLEVTA

SEQ ID NO: 1273124 - protein, 25 aa, Mycobacterium
LVQQRYAAAIGRPDHLENFMIAGLL

SEQ ID NO: 1273125 - protein, 21 aa, Mycobacterium
LVQRLGWLHIRAHPQRVPQLV

SEQ ID NO: 1273126 - protein, 17 aa, Mycobacterium
LVQRVDRVKAMAAGGTR

SEQ ID NO: 1273127 - protein, 21 aa, Mycobacterium
LVQRWIDAMPQYGPGHADLVA

SEQ ID NO: 1273128 - protein, 25 aa, Mycobacterium
LVRDEGRWEVRWSATGLHPRLGENQ

SEQ ID NO: 1273129 - protein, 25 aa, Mycobacterium
LVRDPREPGGFAVLIDGAEPEGPAR

SEQ ID NO: 1273130 - protein, 18 aa, Mycobacterium
LVRGGRRTFGASFDRTRL

SEQ ID NO: 1273131 - protein, 25 aa, Mycobacterium
LVRGGRRTFGPSFDRGRLDNLSLGL

SEQ ID NO: 1273132 - protein, 24 aa, Mycobacterium
LVRGIERFGPIFAQVYGMTETTGS

SEQ ID NO: 1273133 - protein, 23 aa, Mycobacterium
LVRHQPRVLGLVIELMTRRRIFV

SEQ ID NO: 1273134 - protein, 24 aa, Mycobacterium
LVRKALDLLPQVGFVNAYGLTETS

SEQ ID NO: 1273135 - protein, 17 aa, Mycobacterium
LVRKRKRRYPGMHVYHY

SEQ ID NO: 1273136 - protein, 18 aa, Mycobacterium
LVRPTLRETIARLAPGTP

SEQ ID NO: 1273137 - protein, 17 aa, Mycobacterium
LVRQGSMSGSTWAPIFA

SEQ ID NO: 1273138 - protein, 18 aa, Mycobacterium
LVRRMHHGADFVIDPLPN

SEQ ID NO: 1273139 - protein, 17 aa, Mycobacterium
LVRRMLDRLDLSVPALW

SEQ ID NO: 1273140 - protein, 19 aa, Mycobacterium
LVRYWRLLKFKLANPHIIT

SEQ ID NO: 1273141 - protein, 18 aa, Mycobacterium
LVSDEARYVTGMQLRVDA

SEQ ID NO: 1273142 - protein, 18 aa, Mycobacterium
LVSEFFCRIINYMDANSY

SEQ ID NO: 1273143 - protein, 26 aa, Mycobacterium
LVSLDEYRHWFPTKRADLLAIALDPR

SEQ ID NO: 1273144 - protein, 18 aa, Mycobacterium
LVSNAMRPNGGILARGFE

SEQ ID NO: 1273145 - protein, 33 aa, Mycobacterium
LVSPEYLRRELLDLSAWAWDEFLTANGDPALPT

SEQ ID NO: 1273146 - protein, 21 aa, Mycobacterium
LVSYPRKMDALTRLLEVEQGD

SEQ ID NO: 1273147 - protein, 19 aa, Mycobacterium
LVTCSRLSGRFLLGVHAAV

SEQ ID NO: 1273148 - protein, 29 aa, Mycobacterium
LVTDIGRWVYTSGFRKLVIVNAHATNGPP

SEQ ID NO: 1273149 - protein, 18 aa, Mycobacterium
LVTEFALPDPACRPHAIT

SEQ ID NO: 1273150 - protein, 17 aa, Mycobacterium
LVTELQPLVTTFDGHPW

SEQ ID NO: 1273151 - protein, 21 aa, Mycobacterium
LVTFVEFSRGAFCTVQRDHPD

SEQ ID NO: 1273152 - protein, 22 aa, Mycobacterium
LVTIGFADLVGFTRLGEAVPPE

SEQ ID NO: 1273153 - protein, 18 aa, Mycobacterium
LVTRAGVLGKTLSHGIEE

SEQ ID NO: 1273154 - protein, 25 aa, Mycobacterium
LVTRPAAACSGHFYTDEEILLEEGS

SEQ ID NO: 1273155 - protein, 18 aa, Mycobacterium
LVTTFPFEQFDAAWSAAK

SEQ ID NO: 1273156 - protein, 21 aa, Mycobacterium
LVVAAGIRPNVGLAQRAGLTV

SEQ ID NO: 1273157 - protein, 18 aa, Mycobacterium
LVVDIWAGYVDRAKTIPW

SEQ ID NO: 1273158 - protein, 20 aa, Mycobacterium
LVVGSSRFAAPRRIFLGSTA

SEQ ID NO: 1273159 - protein, 18 aa, Mycobacterium
LVVIDGKVVAAALRMPAE

SEQ ID NO: 1273160 - protein, 24 aa, Mycobacterium
LVVPLPRRLLWFLPPATLQLSGHA

SEQ ID NO: 1273161 - protein, 19 aa, Mycobacterium
LVWALRFVADFSDDILAAK

SEQ ID NO: 1273162 - protein, 19 aa, Mycobacterium
LVYHLRIANVGTLESNSPV

SEQ ID NO: 1273163 - protein, 26 aa, Mycobacterium
LWAATFLRRRGAGASAVLLDPERAHR

SEQ ID NO: 1273164 - protein, 20 aa, Mycobacterium
LWADLDVAMRAAILDSAGQR

SEQ ID NO: 1273165 - protein, 20 aa, Mycobacterium
LWAKLRRTISAFLVNEWRKG

SEQ ID NO: 1273166 - protein, 18 aa, Mycobacterium
LWAQYVLDNFATVAEAVA

SEQ ID NO: 1273167 - protein, 25 aa, Mycobacterium
LWATWCGPCRMVSPALEQLAAERAG

SEQ ID NO: 1273168 - protein, 21 aa, Mycobacterium
LWAVPLHWAGVHAGILANSPD

SEQ ID NO: 1273169 - protein, 24 aa, Mycobacterium
LWCEKPAYIQLDFLVRRMAEQVGA

SEQ ID NO: 1273170 - protein, 24 aa, Mycobacterium
LWDRVWEAGQAYGLAPLGLEALEL

SEQ ID NO: 1273171 - protein, 18 aa, Mycobacterium
LWEDHGCPRMPPRPPDAH

SEQ ID NO: 1273172 - protein, 17 aa, Mycobacterium
LWGKEIGQFQLIQLKLA

SEQ ID NO: 1273173 - protein, 17 aa, Mycobacterium
LWIDVRRLLTAHTDARP

SEQ ID NO: 1273174 - protein, 25 aa, Mycobacterium
LWLCEAAHLPVIWATQVLDQLAKSG

SEQ ID NO: 1273175 - protein, 19 aa, Mycobacterium
LWLNESFATFASVLCQAEA

SEQ ID NO: 1273176 - protein, 19 aa, Mycobacterium
LWLRMLDIPAVLQARSYAA

SEQ ID NO: 1273177 - protein, 19 aa, Mycobacterium
LWMAALHSRADPRARQRLL

SEQ ID NO: 1273178 - protein, 17 aa, Mycobacterium
LWPKFSALPHSRLERAT

SEQ ID NO: 1273179 - protein, 21 aa, Mycobacterium
LWRRYVELLLEGMRCRPDQKP

SEQ ID NO: 1273180 - protein, 18 aa, Mycobacterium
LWRVCSETQMPVSLHFGS

SEQ ID NO: 1273181 - protein, 26 aa, Mycobacterium
LWRVGFCGFAPGFAYLVGGDERLAVP

SEQ ID NO: 1273182 - protein, 18 aa, Mycobacterium
LWSESWYFDFADPGQQLG

SEQ ID NO: 1273183 - protein, 18 aa, Mycobacterium
LWSSSVIVPTEPEPPYKW

SEQ ID NO: 1273184 - protein, 19 aa, Mycobacterium
LWSTLPSAVEWRGVAPDTQ

SEQ ID NO: 1273185 - protein, 18 aa, Mycobacterium
LWWDEKRTMWEVRTVAPD

SEQ ID NO: 1273186 - protein, 26 aa, Mycobacterium
LWYEIGRLPLRWEHPEASDITAEYAP

SEQ ID NO: 1273187 - protein, 24 aa, Mycobacterium
LWYIREVDPSVLLLTGLTRDGVYL

SEQ ID NO: 1273188 - protein, 18 aa, Mycobacterium
LYAAGACACNIAQDGKGY

SEQ ID NO: 1273189 - protein, 32 aa, Mycobacterium
LYARRTIERLGRWLPRVVAAFVDTPDRALGDV

SEQ ID NO: 1273190 - protein, 26 aa, Mycobacterium
LYATESCRTFALWAVGLMYSAAGDRH

SEQ ID NO: 1273191 - protein, 25 aa, Mycobacterium
LYDACEIDEILTLRIMTMTEEEKAA

SEQ ID NO: 1273192 - protein, 17 aa, Mycobacterium
LYDEVPFGLTMEEFQQY

SEQ ID NO: 1273193 - protein, 32 aa, Mycobacterium
LYDILKSGPLAGLRLGLMHGRLSGDEKDAVMT

SEQ ID NO: 1273194 - protein, 17 aa, Mycobacterium
LYDPDVLTTRFAVGSYD

SEQ ID NO: 1273195 - protein, 25 aa, Mycobacterium
LYDPPIRELMGFTWSPRQEWLHRRV

SEQ ID NO: 1273196 - protein, 22 aa, Mycobacterium
LYEAKAGFARPEMTVQAHLDLA

SEQ ID NO: 1273197 - protein, 18 aa, Mycobacterium
LYEQAGISAADIDVALLY

SEQ ID NO: 1273198 - protein, 18 aa, Mycobacterium
LYEQAIAYWRAYADTVDN

SEQ ID NO: 1273199 - protein, 19 aa, Mycobacterium
LYEREVRFYTDIAPGLGGP

SEQ ID NO: 1273200 - protein, 18 aa, Mycobacterium
LYGKPAYHALTFGWLLSG

SEQ ID NO: 1273201 - protein, 24 aa, Mycobacterium
LYGMRRTADLGARGIRINCSAPGV

SEQ ID NO: 1273202 - protein, 20 aa, Mycobacterium
LYGNEWELFKSPAGANQWRP

SEQ ID NO: 1273203 - protein, 19 aa, Mycobacterium
LYIAPSTVRTHLQRARAKY

SEQ ID NO: 1273204 - protein, 17 aa, Mycobacterium
LYIGGSVADVTTARDRI

SEQ ID NO: 1273205 - protein, 20 aa, Mycobacterium
LYIHVPFCATRCGYCDFNTY

SEQ ID NO: 1273206 - protein, 26 aa, Mycobacterium
LYIQLYLGGFGLELSDIESLRTFKSK

SEQ ID NO: 1273207 - protein, 26 aa, Mycobacterium
LYKNECVRADSPFRRGPLNTVGDVEY

SEQ ID NO: 1273208 - protein, 23 aa, Mycobacterium
LYKSAYALDTAWRTHMPHNATLV

SEQ ID NO: 1273209 - protein, 18 aa, Mycobacterium
LYKWAVKLGPLIESGLVL

SEQ ID NO: 1273210 - protein, 19 aa, Mycobacterium
LYLADRKAFMIISGGVNIY

SEQ ID NO: 1273211 - protein, 26 aa, Mycobacterium
LYLALQLKARFEGMATPVYGLQEVHH

SEQ ID NO: 1273212 - protein, 19 aa, Mycobacterium
LYLHLLSRLLLARVELSWT

SEQ ID NO: 1273213 - protein, 19 aa, Mycobacterium
LYLIHWPVPEKNLFVDTFR

SEQ ID NO: 1273214 - protein, 25 aa, Mycobacterium
LYLPIRPGTDLALLNGILHLLVENG

SEQ ID NO: 1273215 - protein, 27 aa, Mycobacterium
LYLRMDEFPARLVIVPGERDRLLVSGW

SEQ ID NO: 1273216 - protein, 24 aa, Mycobacterium
LYLRRARTGLQLFGGPRLHRERYL

SEQ ID NO: 1273217 - protein, 19 aa, Mycobacterium
LYLSTRGGYLRVDVAAGAV

SEQ ID NO: 1273218 - protein, 22 aa, Mycobacterium
LYNLDTGQFVGFREMFRQLDEA

SEQ ID NO: 1273219 - protein, 18 aa, Mycobacterium
LYPHVRWRTEAVGAVWDE

SEQ ID NO: 1273220 - protein, 25 aa, Mycobacterium
LYPRKGVSELTRFTPEAVQEKYGLT

SEQ ID NO: 1273221 - protein, 19 aa, Mycobacterium
LYPVLDRYDYVLIDCQPSL

SEQ ID NO: 1273222 - protein, 18 aa, Mycobacterium
LYQARIAAHRVVDGHGDL

SEQ ID NO: 1273223 - protein, 18 aa, Mycobacterium
LYRALRLLADCGRGEVIA

SEQ ID NO: 1273224 - protein, 31 aa, Mycobacterium
LYRETRRIGLKAGELHAVIVAPLYLTLPVWS

SEQ ID NO: 1273225 - protein, 17 aa, Mycobacterium
LYRGCMRGRTLWVVPFC

SEQ ID NO: 1273226 - protein, 30 aa, Mycobacterium
LYRGPANLFVAGFIGSPAMNFFPAALTEIG

SEQ ID NO: 1273227 - protein, 26 aa, Mycobacterium
LYRHFPRRSDLILAVIEREIDDCIEA

SEQ ID NO: 1273228 - protein, 40 aa, Mycobacterium
LYRMYPAVDGYVFLAAPLPREWPALAKALSPYVDLHADER

SEQ ID NO: 1273229 - protein, 18 aa, Mycobacterium
LYRPLGMNSTSSRFADYE

SEQ ID NO: 1273230 - protein, 25 aa, Mycobacterium
LYRSALELRPTMWRDTGDVKWLEVA

SEQ ID NO: 1273231 - protein, 18 aa, Mycobacterium
LYSHIAWLRTIKEKISYK

SEQ ID NO: 1273232 - protein, 17 aa, Mycobacterium
LYSPFKLLDPVANLAEM

SEQ ID NO: 1273233 - protein, 19 aa, Mycobacterium
LYTNAWKVMIAIPGIAAML

SEQ ID NO: 1273234 - protein, 17 aa, Mycobacterium
LYTSRFVQLNSSGTRNS

SEQ ID NO: 1273235 - protein, 18 aa, Mycobacterium
LYVGDRALRCGYVEGLAV

SEQ ID NO: 1273236 - protein, 17 aa, Mycobacterium
LYVLKAVLKPFGGLLAF

SEQ ID NO: 1273237 - protein, 18 aa, Mycobacterium
LYWIGRYVERADDTARIL

SEQ ID NO: 1273238 - protein, 23 aa, Mycobacterium
LYYIHGFLRDRMQTLQDEFAKHG

SEQ ID NO: 1273239 - protein, 26 aa, Mycobacterium
LYYNHGFLRQRMQVLQDEFAKHGKEG

SEQ ID NO: 1273240 - protein, 22 aa, Mycobacterium
MAAARPDIDYEVLALDAVMQQD

SEQ ID NO: 1273241 - protein, 17 aa, Mycobacterium
MAADAGLTSSSWARGPH

SEQ ID NO: 1273242 - protein, 20 aa, Mycobacterium
MAADMAVDFRGTGVSAVSIW

SEQ ID NO: 1273243 - protein, 22 aa, Mycobacterium
MAAGELIGCFGLTEPDFGSNPG

SEQ ID NO: 1273244 - protein, 20 aa, Mycobacterium
MAAGTPFALAHTFGQTGPFR

SEQ ID NO: 1273245 - protein, 18 aa, Mycobacterium
MAAPRALVRVVPATLGAD

SEQ ID NO: 1273246 - protein, 17 aa, Mycobacterium
MAARMAGFRDATTRAAA

SEQ ID NO: 1273247 - protein, 17 aa, Mycobacterium
MAATATNVVESCTRVLA

SEQ ID NO: 1273248 - protein, 17 aa, Mycobacterium
MAATGTAVFAEAVQLVA

SEQ ID NO: 1273249 - protein, 20 aa, Mycobacterium
MADLADFYSGVTLPELGYTY

SEQ ID NO: 1273250 - protein, 17 aa, Mycobacterium
MADLCGIDRVIFGSDWP

SEQ ID NO: 1273251 - protein, 19 aa, Mycobacterium
MADPRWLDPTVDPNERTPG

SEQ ID NO: 1273252 - protein, 21 aa, Mycobacterium
MADQVPIEWAGDIYCMVLHHC

SEQ ID NO: 1273253 - protein, 24 aa, Mycobacterium
MADWLEAFVPLRVHVLVRFGRWDE

SEQ ID NO: 1273254 - protein, 26 aa, Mycobacterium
MAEGLARAGATVAILGRSAQRLDSAA

SEQ ID NO: 1273255 - protein, 21 aa, Mycobacterium
MAELFSRSSAVVRRYGGTVDK

SEQ ID NO: 1273256 - protein, 21 aa, Mycobacterium
MAELRRVGLLGGETPDVDEVV

SEQ ID NO: 1273257 - protein, 18 aa, Mycobacterium
MAERVAVMKRVWAGEKVT

SEQ ID NO: 1273258 - protein, 17 aa, Mycobacterium
MAEVIALAPDRVFPLPD

SEQ ID NO: 1273259 - protein, 17 aa, Mycobacterium
MAFAAARCGADVVIASR

SEQ ID NO: 1273260 - protein, 19 aa, Mycobacterium
MAFLAPWKDRLNVWVQGLE

SEQ ID NO: 1273261 - protein, 24 aa, Mycobacterium
MAFTQKAIRVMKAVSRPHGFNVGL

SEQ ID NO: 1273262 - protein, 21 aa, Mycobacterium
MAFYNMGLRLLRHVQDAARSG

SEQ ID NO: 1273263 - protein, 17 aa, Mycobacterium
MAGFGDIMDGLSPVFIF

SEQ ID NO: 1273264 - protein, 18 aa, Mycobacterium
MAGLLVWALRFVADFSDD

SEQ ID NO: 1273265 - protein, 36 aa, Mycobacterium
MAGLYIKELLLRDDVRQCLIVAPGGLVEQWQDELFF

SEQ ID NO: 1273266 - protein, 19 aa, Mycobacterium
MAGNGEWSVPPVIRAALPP

SEQ ID NO: 1273267 - protein, 23 aa, Mycobacterium
MAGSVCPVEVMKRCINEMHMTEV

SEQ ID NO: 1273268 - protein, 22 aa, Mycobacterium
MAGYLPDHWTADAFCDGWYRTG

SEQ ID NO: 1273269 - protein, 25 aa, Mycobacterium
MAKRAGLPWDCVLSAEIFGHYKPDR

SEQ ID NO: 1273270 - protein, 29 aa, Mycobacterium
MAKRAGLPWDCVLSAELFRHYKPDPEAYL

SEQ ID NO: 1273271 - protein, 19 aa, Mycobacterium
MALAHLWAAGLPWADDLPP

SEQ ID NO: 1273272 - protein, 20 aa, Mycobacterium
MALDAGPAILYRLHLDLASL

SEQ ID NO: 1273273 - protein, 21 aa, Mycobacterium
MALRAAEYGRTVVVLTIDPAK

SEQ ID NO: 1273274 - protein, 18 aa, Mycobacterium
MALTHLWAAGLPWTPDLA

SEQ ID NO: 1273275 - protein, 26 aa, Mycobacterium
MANAARLGLQDVIWRGTYYTPAGPQA

SEQ ID NO: 1273276 - protein, 18 aa, Mycobacterium
MAPAARFTTLKARLGDAF

SEQ ID NO: 1273277 - protein, 24 aa, Mycobacterium
MAPGRMPTKWGAYLDDVSGFDADF

SEQ ID NO: 1273278 - protein, 19 aa, Mycobacterium
MAPMFPLVVIVHADEEVRV

SEQ ID NO: 1273279 - protein, 23 aa, Mycobacterium
MARNCAPSSLAVIKRQIYRDALR

SEQ ID NO: 1273280 - protein, 18 aa, Mycobacterium
MARNEWRTATVGKVCAAA

SEQ ID NO: 1273281 - protein, 27 aa, Mycobacterium
MARPMYRARGWVPWRGPTSVLSPGGRI

SEQ ID NO: 1273282 - protein, 23 aa, Mycobacterium
MARRMGDGLVHLHLADGSGASTD

SEQ ID NO: 1273283 - protein, 21 aa, Mycobacterium
MARRYGRDGVVAWQRALNDAV

SEQ ID NO: 1273284 - protein, 22 aa, Mycobacterium
MARTAFGDEVFDHLLASSQSEL

SEQ ID NO: 1273285 - protein, 26 aa, Mycobacterium
MARVFPNLFATHRVRAVGDYSSHLLR

SEQ ID NO: 1273286 - protein, 22 aa, Mycobacterium
MASAFPASRFVGLDFSEEGLAA

SEQ ID NO: 1273287 - protein, 33 aa, Mycobacterium
MASEPRFDPKVWARLGSELGVLGMSVPESHGGA

SEQ ID NO: 1273288 - protein, 17 aa, Mycobacterium
MASEYRALAGLPGVEEA

SEQ ID NO: 1273289 - protein, 19 aa, Mycobacterium
MASLERWEIVTAGPVGVGS

SEQ ID NO: 1273290 - protein, 30 aa, Mycobacterium
MATCEQCFGCLPEVYVLAIRGFEFGLAMGL

SEQ ID NO: 1273291 - protein, 23 aa, Mycobacterium
MATGELRATMALTEPGGGSDLQA

SEQ ID NO: 1273292 - protein, 18 aa, Mycobacterium
MATGETRGAFSMSEPELG

SEQ ID NO: 1273293 - protein, 21 aa, Mycobacterium
MAVALGDFVKMGFEQDVAIWR

SEQ ID NO: 1273294 - protein, 18 aa, Mycobacterium
MAVCRKWDVLATDIGEVT

SEQ ID NO: 1273295 - protein, 19 aa, Mycobacterium
MAVELPTAYLGAAPDVRIW

SEQ ID NO: 1273296 - protein, 23 aa, Mycobacterium
MAVERSCALTAVALSGQRRTGAY

SEQ ID NO: 1273297 - protein, 25 aa, Mycobacterium
MAVERSCALTAVALSGRRRTGAQLV

SEQ ID NO: 1273298 - protein, 29 aa, Mycobacterium
MAVIGRERFAEFLAGFHLVDEHFRSAPLE

SEQ ID NO: 1273299 - protein, 26 aa, Mycobacterium
MAVTGYRTLIAIWRGRFDDAGRLAAD

SEQ ID NO: 1273300 - protein, 19 aa, Mycobacterium
MAWDYPLGLVAPAGFALHV

SEQ ID NO: 1273301 - protein, 25 aa, Mycobacterium
MAYERVTLYGLPLVARRRVGYAQVD

SEQ ID NO: 1273302 - protein, 25 aa, Mycobacterium
MAYGSRVGFWRVHRLLTERGLVATA

SEQ ID NO: 1273303 - protein, 17 aa, Mycobacterium
MCAAAPLLLDEGGTMLV

SEQ ID NO: 1273304 - protein, 19 aa, Mycobacterium
MCGNGVRVFAHYLRASGLE

SEQ ID NO: 1273305 - protein, 17 aa, Mycobacterium
MCLPGHRTAELGHFADV

SEQ ID NO: 1273306 - protein, 17 aa, Mycobacterium
MCLPGHRTAELGHFAEV

SEQ ID NO: 1273307 - protein, 18 aa, Mycobacterium
MCMIPRQVAEELGQPLPL

SEQ ID NO: 1273308 - protein, 26 aa, Mycobacterium
MCPICRKEQLTLVSWVFGDHLGAVSG

SEQ ID NO: 1273309 - protein, 17 aa, Mycobacterium
MCTAGAFYFLNEADVVI

SEQ ID NO: 1273310 - protein, 17 aa, Mycobacterium
MCYPDGEFLVGDRDVLL

SEQ ID NO: 1273311 - protein, 20 aa, Mycobacterium
MDAELAGAITAVSGSAQPVV

SEQ ID NO: 1273312 - protein, 17 aa, Mycobacterium
MDAEVAALGRSMGTRTQ

SEQ ID NO: 1273313 - protein, 21 aa, Mycobacterium
MDARLDVYRILGLKDGEAHVI

SEQ ID NO: 1273314 - protein, 24 aa, Mycobacterium
MDFAVGRGEIFGFLGPSGAGKSTT

SEQ ID NO: 1273315 - protein, 37 aa, Mycobacterium
MDGDPCQLCRWWWRQGRVWPKAHPFQRHKGCNCQPRI

SEQ ID NO: 1273316 - protein, 20 aa, Mycobacterium
MDGNGRWATQRGLGRTEGHK

SEQ ID NO: 1273317 - protein, 25 aa, Mycobacterium
MDHLNRWETGMARAAQFAEYGDPDV

SEQ ID NO: 1273318 - protein, 17 aa, Mycobacterium
MDHMGWRSPRQTRLEQA

SEQ ID NO: 1273319 - protein, 28 aa, Mycobacterium
MDLEGPEGPDLVLRWAALLHDIGKPATR

SEQ ID NO: 1273320 - protein, 22 aa, Mycobacterium
MDLFCAGTHPFADWSVQKLTDA

SEQ ID NO: 1273321 - protein, 17 aa, Mycobacterium
MDLRGIRTPYFFVLQRD

SEQ ID NO: 1273322 - protein, 21 aa, Mycobacterium
MDLRMKRVNGIEATRRLTAAG

SEQ ID NO: 1273323 - protein, 23 aa, Mycobacterium
MDLTRRDVVVLFDYHRYHRSAAE

SEQ ID NO: 1273324 - protein, 17 aa, Mycobacterium
MDLVHGAARVIVVMEHT

SEQ ID NO: 1273325 - protein, 25 aa, Mycobacterium
MDLYWPGRLEGCAEPADQREAFAWH

SEQ ID NO: 1273326 - protein, 22 aa, Mycobacterium
MDNGEFDSMIGLFTPDAVFDRA

SEQ ID NO: 1273327 - protein, 24 aa, Mycobacterium
MDPACGCGNFIIVAFRELRDLELR

SEQ ID NO: 1273328 - protein, 20 aa, Mycobacterium
MDPASIERFVAGYGEAALHI

SEQ ID NO: 1273329 - protein, 26 aa, Mycobacterium
MDPQHRLLLETAWRAVEHSGTAPSAL

SEQ ID NO: 1273330 - protein, 26 aa, Mycobacterium
MDPQHRLLLETAWRAVEHSGTAPTAL

SEQ ID NO: 1273331 - protein, 19 aa, Mycobacterium
MDPQHRLVLETAWSAVEHA

SEQ ID NO: 1273332 - protein, 26 aa, Mycobacterium
MDPQQRLALEVSWEALEHAGIPPRSL

SEQ ID NO: 1273333 - protein, 26 aa, Mycobacterium
MDPQQRLLLEVAWEALEDAGINPRTL

SEQ ID NO: 1273334 - protein, 27 aa, Mycobacterium
MDRCASRLPLRMFCEMFGVPDHLEERT

SEQ ID NO: 1273335 - protein, 19 aa, Mycobacterium
MDSLAVEFARYGIRANTIQ

SEQ ID NO: 1273336 - protein, 20 aa, Mycobacterium
MDSPAFKSAMRSAGTVIGRE

SEQ ID NO: 1273337 - protein, 26 aa, Mycobacterium
MDSRLWRMLLAPGRGIGRLVTGAVGL

SEQ ID NO: 1273338 - protein, 25 aa, Mycobacterium
MDYQALRLLGSVGIAKAARGEVDVA

SEQ ID NO: 1273339 - protein, 17 aa, Mycobacterium
MEDAWWGPTVPLVDAPW

SEQ ID NO: 1273340 - protein, 18 aa, Mycobacterium
MEDGLRLGATEYRATSDR

SEQ ID NO: 1273341 - protein, 19 aa, Mycobacterium
MEELLRVVAQLEVDGAQQD

SEQ ID NO: 1273342 - protein, 18 aa, Mycobacterium
MEERGLALFDMFTYFNEI

SEQ ID NO: 1273343 - protein, 24 aa, Mycobacterium
MEFAARYYHRFGLAAPALNSIGES

SEQ ID NO: 1273344 - protein, 27 aa, Mycobacterium
MEFAPRQRYCFRHPLVRAVAYDSQISA

SEQ ID NO: 1273345 - protein, 23 aa, Mycobacterium
MEFIFCPWHQWGFELATGTTAVK

SEQ ID NO: 1273346 - protein, 22 aa, Mycobacterium
MEGLDLGQVLGIISGSERIHSA

SEQ ID NO: 1273347 - protein, 18 aa, Mycobacterium
MEIHRGGRAMKVLAAMAV

SEQ ID NO: 1273348 - protein, 26 aa, Mycobacterium
MELRLKPGEWYVIHSYAGYENKVKAN

SEQ ID NO: 1273349 - protein, 23 aa, Mycobacterium
MELTRRDVLVLFDYHRYQASAVD

SEQ ID NO: 1273350 - protein, 23 aa, Mycobacterium
MEMDRFPGRIWVVAHKPVAVAAG

SEQ ID NO: 1273351 - protein, 18 aa, Mycobacterium
MENMTATLAVEWAPKVRV

SEQ ID NO: 1273352 - protein, 19 aa, Mycobacterium
MENVREGLPLAYMMDDCRE

SEQ ID NO: 1273353 - protein, 18 aa, Mycobacterium
MEPWDGPAAVCFTDGTVV

SEQ ID NO: 1273354 - protein, 26 aa, Mycobacterium
MEPYPIIRKLFATFGIADMARESLNK

SEQ ID NO: 1273355 - protein, 20 aa, Mycobacterium
MEQYFARFGGVRDYLRDVVD

SEQ ID NO: 1273356 - protein, 19 aa, Mycobacterium
MERELPGSIVIAGAGAIGM

SEQ ID NO: 1273357 - protein, 18 aa, Mycobacterium
MERLRRRVAAVVEDPATA

SEQ ID NO: 1273358 - protein, 23 aa, Mycobacterium
MERRAQQAFGEIMDLAIGLGGTI

SEQ ID NO: 1273359 - protein, 17 aa, Mycobacterium
MESELLALVAQREQPSA

SEQ ID NO: 1273360 - protein, 24 aa, Mycobacterium
METGHWLRPGDRITLSIEQVGEIS

SEQ ID NO: 1273361 - protein, 17 aa, Mycobacterium
METGLRLNDALHLPQDC

SEQ ID NO: 1273362 - protein, 19 aa, Mycobacterium
MEVAERLFATRGIEAVTLR

SEQ ID NO: 1273363 - protein, 18 aa, Mycobacterium
MEVGPTCHYVMGGIEVDP

SEQ ID NO: 1273364 - protein, 18 aa, Mycobacterium
MEVWSWFFVERNAPEEFK

SEQ ID NO: 1273365 - protein, 17 aa, Mycobacterium
MEYMLPRLRGWGESMSR

SEQ ID NO: 1273366 - protein, 17 aa, Mycobacterium
MFADLGVLDEELAGEQP

SEQ ID NO: 1273367 - protein, 26 aa, Mycobacterium
MFALFTCALHEAFSGVGFDVDPTVTL

SEQ ID NO: 1273368 - protein, 18 aa, Mycobacterium
MFDPVLARMRDMGCAGLM

SEQ ID NO: 1273369 - protein, 19 aa, Mycobacterium
MFDRSRAGWDVVVLTDDPD

SEQ ID NO: 1273370 - protein, 19 aa, Mycobacterium
MFDTVRFDLNLVVAGDDGE

SEQ ID NO: 1273371 - protein, 19 aa, Mycobacterium
MFEHLCGDLPWSQRLGEVW

SEQ ID NO: 1273372 - protein, 17 aa, Mycobacterium
MFEWFKSREEEMVARIG

SEQ ID NO: 1273373 - protein, 23 aa, Mycobacterium
MFGEQRLSAALAECAGLPAEAVV

SEQ ID NO: 1273374 - protein, 18 aa, Mycobacterium
MFGNRGIYHKGWTAVTKH

SEQ ID NO: 1273375 - protein, 17 aa, Mycobacterium
MFKIKHQRTADCVVAGY

SEQ ID NO: 1273376 - protein, 19 aa, Mycobacterium
MFLEQYWGGPRTYSDQRGH

SEQ ID NO: 1273377 - protein, 24 aa, Mycobacterium
MFLFRGGAPVKEFAGAFKPPLSWG

SEQ ID NO: 1273378 - protein, 26 aa, Mycobacterium
MFNHELAHDVNHYWAHHMSASFMVDP

SEQ ID NO: 1273379 - protein, 28 aa, Mycobacterium
MFQVPIWDLITGYTFPELNNPVSDAESA

SEQ ID NO: 1273380 - protein, 23 aa, Mycobacterium
MFRESFRAFLDRHVAPHHEEWEK

SEQ ID NO: 1273381 - protein, 22 aa, Mycobacterium
MFRFGCVAGGASLYAPQAQNNL

SEQ ID NO: 1273382 - protein, 18 aa, Mycobacterium
MFSAGVPPRMMVVDCDAV

SEQ ID NO: 1273383 - protein, 17 aa, Mycobacterium
MFVEAGLPEGVLSIVPG

SEQ ID NO: 1273384 - protein, 20 aa, Mycobacterium
MFYNLGLAGRAMRRIGAVEF

SEQ ID NO: 1273385 - protein, 20 aa, Mycobacterium
MGAAHARRLAAAGATVAVND

SEQ ID NO: 1273386 - protein, 30 aa, Mycobacterium
MGADVAAWCQRAGLDIASLDLLGWDDVVQL

SEQ ID NO: 1273387 - protein, 29 aa, Mycobacterium
MGAGLPGGHGIKLRYSDPMLLDDVAADFP

SEQ ID NO: 1273388 - protein, 18 aa, Mycobacterium
MGALNWGDLFFDIEANQM

SEQ ID NO: 1273389 - protein, 25 aa, Mycobacterium
MGAQGLRSASLVAIASANYIARRLD

SEQ ID NO: 1273390 - protein, 21 aa, Mycobacterium
MGARTRIGYPLRTLLTDSDVL

SEQ ID NO: 1273391 - protein, 23 aa, Mycobacterium
MGAVPEEWIRVSADDLPLFGYSD

SEQ ID NO: 1273392 - protein, 22 aa, Mycobacterium
MGDAINRFDLDPVKNQFADIEG

SEQ ID NO: 1273393 - protein, 24 aa, Mycobacterium
MGDLSRRRWWPLAEIVTTDRLNTM

SEQ ID NO: 1273394 - protein, 24 aa, Mycobacterium
MGEGRWKSSRSWPPPAEPRTYYLS

SEQ ID NO: 1273395 - protein, 23 aa, Mycobacterium
MGEMPGMGGGHGMMSQADMAALQ

SEQ ID NO: 1273396 - protein, 20 aa, Mycobacterium
MGEVRRYFRDHGWSLKVPRR

SEQ ID NO: 1273397 - protein, 23 aa, Mycobacterium
MGFARRAANRVVFMSDGAIVEDA

SEQ ID NO: 1273398 - protein, 24 aa, Mycobacterium
MGFPEKGIAVAVDWSVLPRTEWET

SEQ ID NO: 1273399 - protein, 19 aa, Mycobacterium
MGFSSALDACFSIHQLNHA

SEQ ID NO: 1273400 - protein, 17 aa, Mycobacterium
MGGAQSFFDQQTVIETW

SEQ ID NO: 1273401 - protein, 23 aa, Mycobacterium
MGGIFRIAPPLTITEAELHSGLD

SEQ ID NO: 1273402 - protein, 20 aa, Mycobacterium
MGGLASRIVGVAAGNPYFVE

SEQ ID NO: 1273403 - protein, 31 aa, Mycobacterium
MGGWKSSGIGARFGGPEGLRKYCRIETVVSP

SEQ ID NO: 1273404 - protein, 17 aa, Mycobacterium
MGIFGLAIPQPWGEANV

SEQ ID NO: 1273405 - protein, 27 aa, Mycobacterium
MGIMLTKYPELFGALVCSVPLLDMKRF

SEQ ID NO: 1273406 - protein, 17 aa, Mycobacterium
MGIQYLLLRSGPMTMPP

SEQ ID NO: 1273407 - protein, 17 aa, Mycobacterium
MGLACVSAPIIDRSTGA

SEQ ID NO: 1273408 - protein, 17 aa, Mycobacterium
MGLAPMVISQIFRIIAE

SEQ ID NO: 1273409 - protein, 19 aa, Mycobacterium
MGLARLWQARGIEPDVVLG

SEQ ID NO: 1273410 - protein, 28 aa, Mycobacterium
MGLERRLGVVLFKDFLALHFSPTRPPAE

SEQ ID NO: 1273411 - protein, 19 aa, Mycobacterium
MGLFGEFLGAAMLRVRMLD

SEQ ID NO: 1273412 - protein, 22 aa, Mycobacterium
MGLLKPFLKGWHRAEVRGLEDF

SEQ ID NO: 1273413 - protein, 22 aa, Mycobacterium
MGMLFRKKLVMFGPREVLLTSD

SEQ ID NO: 1273414 - protein, 17 aa, Mycobacterium
MGNALPVSALEPEDIAN

SEQ ID NO: 1273415 - protein, 21 aa, Mycobacterium
MGNARKGGAIVVYDYEGKAVK

SEQ ID NO: 1273416 - protein, 20 aa, Mycobacterium
MGPAELQQAMTYGVTGGGAP

SEQ ID NO: 1273417 - protein, 25 aa, Mycobacterium
MGPEGRAAIGLGDGVVRISIGLEGT

SEQ ID NO: 1273418 - protein, 20 aa, Mycobacterium
MGPGNVDGLLAFTISGECRN

SEQ ID NO: 1273419 - protein, 23 aa, Mycobacterium
MGPKVEAACRFVRNTGRPASIGA

SEQ ID NO: 1273420 - protein, 24 aa, Mycobacterium
MGQPGGGVQYYFTQPIVDLVNAGY

SEQ ID NO: 1273421 - protein, 19 aa, Mycobacterium
MGRATSGVQGMRFNADDEL

SEQ ID NO: 1273422 - protein, 24 aa, Mycobacterium
MGRHGTRCAWPLTSPAEVRREAMA

SEQ ID NO: 1273423 - protein, 26 aa, Mycobacterium
MGRIDPRTRWLLRELVYALLVKKDHA

SEQ ID NO: 1273424 - protein, 21 aa, Mycobacterium
MGRLAGRGFAAYGTAKAALAH

SEQ ID NO: 1273425 - protein, 23 aa, Mycobacterium
MGRTPGRVLVSWVDVRADGAMAT

SEQ ID NO: 1273426 - protein, 20 aa, Mycobacterium
MGSGDIKAAWIICTNPVASV

SEQ ID NO: 1273427 - protein, 17 aa, Mycobacterium
MGTTYPGLFTFSENPGE

SEQ ID NO: 1273428 - protein, 26 aa, Mycobacterium
MGVSTCATCDGFFFRDQDIAVVGGGD

SEQ ID NO: 1273429 - protein, 18 aa, Mycobacterium
MGVTKAAVYRQFKSKDDI

SEQ ID NO: 1273430 - protein, 20 aa, Mycobacterium
MGWETWKVGVEYEGEQHWTN

SEQ ID NO: 1273431 - protein, 23 aa, Mycobacterium
MGYKELPGSLGVALTEMENSELV

SEQ ID NO: 1273432 - protein, 21 aa, Mycobacterium
MHAASGWTFAPDGEHFRRVIA

SEQ ID NO: 1273433 - protein, 17 aa, Mycobacterium
MHARTSGLADYFAVDEL

SEQ ID NO: 1273434 - protein, 26 aa, Mycobacterium
MHGVEPNMRWRTFCAELLAIAEKLNV

SEQ ID NO: 1273435 - protein, 31 aa, Mycobacterium
MHIHRLAVLWPEVYPRLLRIMDADPLCQDRI

SEQ ID NO: 1273436 - protein, 18 aa, Mycobacterium
MHKIAAPTLLTWGRDDRV

SEQ ID NO: 1273437 - protein, 25 aa, Mycobacterium
MHLARLEMRTAINLLLDRLPNLRMD

SEQ ID NO: 1273438 - protein, 25 aa, Mycobacterium
MHPAVCAAVSRLSYDGRLQSNEAVT

SEQ ID NO: 1273439 - protein, 19 aa, Mycobacterium
MHPDVCEFISTQIYDGRLH

SEQ ID NO: 1273440 - protein, 18 aa, Mycobacterium
MHPDVCRAVSRLSYDGRL

SEQ ID NO: 1273441 - protein, 24 aa, Mycobacterium
MHVPIEVAERARAVATGRHADAVV

SEQ ID NO: 1273442 - protein, 26 aa, Mycobacterium
MICDASFPTYMLTHWVRDRATGRLSV

SEQ ID NO: 1273443 - protein, 26 aa, Mycobacterium
MICDEVKMGLGRPGTLHAFEHDGVVP

SEQ ID NO: 1273444 - protein, 25 aa, Mycobacterium
MIDPSTGRCYLEWVDPAVGATHDAE

SEQ ID NO: 1273445 - protein, 19 aa, Mycobacterium
MIEIFRGGPDFILEIYRKH

SEQ ID NO: 1273446 - protein, 17 aa, Mycobacterium
MIFTTDRPIIFAYHGYP

SEQ ID NO: 1273447 - protein, 21 aa, Mycobacterium
MIMEMLDAFGIATAGAQQCEA

SEQ ID NO: 1273448 - protein, 26 aa, Mycobacterium
MIMERYRVDAVQAFELLRKLSQDSNV

SEQ ID NO: 1273449 - protein, 18 aa, Mycobacterium
MIREGRSKGLAVVLATQQ

SEQ ID NO: 1273450 - protein, 23 aa, Mycobacterium
MIRINAIHPTNCNTHLLQNEGMY

SEQ ID NO: 1273451 - protein, 24 aa, Mycobacterium
MIRLLRLPIAVQRRVAAGVLSAGH

SEQ ID NO: 1273452 - protein, 23 aa, Mycobacterium
MIRNALFRRVELFAREQWEELAA

SEQ ID NO: 1273453 - protein, 24 aa, Mycobacterium
MIRVMVRYCDVLALTHLGELDLAG

SEQ ID NO: 1273454 - protein, 17 aa, Mycobacterium
MISEPLCLYDCDVPCDG

SEQ ID NO: 1273455 - protein, 27 aa, Mycobacterium
MISLINHLEKAIAWYTMTARTIAQTKA

SEQ ID NO: 1273456 - protein, 19 aa, Mycobacterium
MISQKWGFSRTQLDEYSAL

SEQ ID NO: 1273457 - protein, 24 aa, Mycobacterium
MISRYELTHGVLLAADYGVAQRRP

SEQ ID NO: 1273458 - protein, 26 aa, Mycobacterium
MISTPRWTELRSRVRDYLGTKIEFRL

SEQ ID NO: 1273459 - protein, 23 aa, Mycobacterium
MIYALRWHIERGPGAGDDDGVAD

SEQ ID NO: 1273460 - protein, 17 aa, Mycobacterium
MKADGYTGKAITEYLGV

SEQ ID NO: 1273461 - protein, 31 aa, Mycobacterium
MKAEGTFEYQALLFIPSHAPFDLFNQNAAVG

SEQ ID NO: 1273462 - protein, 17 aa, Mycobacterium
MKDRPALHMVQRARAAG

SEQ ID NO: 1273463 - protein, 17 aa, Mycobacterium
MKFFDYVRTNGWAFART

SEQ ID NO: 1273464 - protein, 23 aa, Mycobacterium
MKGLNGFVSNAAIWRGPDSERFR

SEQ ID NO: 1273465 - protein, 21 aa, Mycobacterium
MKHIFEGNWIYLAHESQVAEP

SEQ ID NO: 1273466 - protein, 23 aa, Mycobacterium
MKIVADVADGVWTLDRDFSDFDI

SEQ ID NO: 1273467 - protein, 20 aa, Mycobacterium
MKKAVAYLLPYIEAEKEQNG

SEQ ID NO: 1273468 - protein, 18 aa, Mycobacterium
MKKYQGWDDPVRTLAVMQ

SEQ ID NO: 1273469 - protein, 17 aa, Mycobacterium
MKLARNMLTFTGFAAAC

SEQ ID NO: 1273470 - protein, 17 aa, Mycobacterium
MKLARNMLTFVGFTAAC

SEQ ID NO: 1273471 - protein, 20 aa, Mycobacterium
MKLLVDRGLVSRDQCGKWAY

SEQ ID NO: 1273472 - protein, 27 aa, Mycobacterium
MKMLRRGEGKFGFLVKFHRIAASDERL

SEQ ID NO: 1273473 - protein, 17 aa, Mycobacterium
MKPLGFTLDEMRGLLDA

SEQ ID NO: 1273474 - protein, 19 aa, Mycobacterium
MKRAWGPVRVAIAAEQAKG

SEQ ID NO: 1273475 - protein, 21 aa, Mycobacterium
MKRFHLLLAGASWVAEYGDPD

SEQ ID NO: 1273476 - protein, 17 aa, Mycobacterium
MKRIGIYGLAIPESYGG

SEQ ID NO: 1273477 - protein, 23 aa, Mycobacterium
MKRNQFARGRRRRAIALATAPLI

SEQ ID NO: 1273478 - protein, 25 aa, Mycobacterium
MKRRIDIACGLVVRPEVVFLDEPTT

SEQ ID NO: 1273479 - protein, 24 aa, Mycobacterium
MKSLPGRALAGIAGARPSMPNTAG

SEQ ID NO: 1273480 - protein, 24 aa, Mycobacterium
MKVPRVANYRGFYFGTWSEETPEF

SEQ ID NO: 1273481 - protein, 19 aa, Mycobacterium
MKYRPNYPGVFDDLNTAHA

SEQ ID NO: 1273482 - protein, 25 aa, Mycobacterium
MLACARLGAMHSVVFAGFSASALKA

SEQ ID NO: 1273483 - protein, 18 aa, Mycobacterium
MLACGEYGLFYVEATSSG

SEQ ID NO: 1273484 - protein, 18 aa, Mycobacterium
MLACNCYVLALRQGADAI

SEQ ID NO: 1273485 - protein, 24 aa, Mycobacterium
MLADATRVQILWALVSHEKSVNDL

SEQ ID NO: 1273486 - protein, 25 aa, Mycobacterium
MLADATRVQILWALVSREMSVNDLA

SEQ ID NO: 1273487 - protein, 25 aa, Mycobacterium
MLADATRVQVLWALVDREMSVNELA

SEQ ID NO: 1273488 - protein, 25 aa, Mycobacterium
MLADPIKGFGRGFLGGLARSAVGAM

SEQ ID NO: 1273489 - protein, 17 aa, Mycobacterium
MLAEIVAGSAIFRILVR

SEQ ID NO: 1273490 - protein, 24 aa, Mycobacterium
MLAIGRIALMSGDLGQLNGLPVSI

SEQ ID NO: 1273491 - protein, 20 aa, Mycobacterium
MLAKVIGFGATRADACALVA

SEQ ID NO: 1273492 - protein, 24 aa, Mycobacterium
MLARRIGLNTVRVFLHDQLWAQDR

SEQ ID NO: 1273493 - protein, 17 aa, Mycobacterium
MLARRLNAMESVRDEYN

SEQ ID NO: 1273494 - protein, 24 aa, Mycobacterium
MLCGGRLTVGIGVGGRHEDYRAVG

SEQ ID NO: 1273495 - protein, 18 aa, Mycobacterium
MLCYRRRGHNEGDDPSMT

SEQ ID NO: 1273496 - protein, 19 aa, Mycobacterium
MLDLGFLPDIERILKQIPA

SEQ ID NO: 1273497 - protein, 19 aa, Mycobacterium
MLDLVTRGGALARQHSGAH

SEQ ID NO: 1273498 - protein, 18 aa, Mycobacterium
MLEAPYTGSVVKISPVRS

SEQ ID NO: 1273499 - protein, 17 aa, Mycobacterium
MLEHWGFDYQGRVFSTP

SEQ ID NO: 1273500 - protein, 17 aa, Mycobacterium
MLELLLRELDVAPGDVV

SEQ ID NO: 1273501 - protein, 20 aa, Mycobacterium
MLERAAWRLQRGEAVSAVAA

SEQ ID NO: 1273502 - protein, 27 aa, Mycobacterium
MLEVRRGDPTYPGWETLGPTEAKNQHV

SEQ ID NO: 1273503 - protein, 18 aa, Mycobacterium
MLFAPELALARAWTTAAR

SEQ ID NO: 1273504 - protein, 24 aa, Mycobacterium
MLGAWRARVAPFNVNYRYVKSELH

SEQ ID NO: 1273505 - protein, 27 aa, Mycobacterium
MLGIAAEFADGVVLWMASVSAIAARIA

SEQ ID NO: 1273506 - protein, 25 aa, Mycobacterium
MLGRPWRDARRLTVPGIARAKDGLV

SEQ ID NO: 1273507 - protein, 18 aa, Mycobacterium
MLGWPIRTFEAAVPPGRL

SEQ ID NO: 1273508 - protein, 23 aa, Mycobacterium
MLHGRASLRPDDIAFTFTHYDRD

SEQ ID NO: 1273509 - protein, 25 aa, Mycobacterium
MLHGRASLRPDDIAFTFTHYDRDPA

SEQ ID NO: 1273510 - protein, 19 aa, Mycobacterium
MLHRAGLVYGDLSLNNVMF

SEQ ID NO: 1273511 - protein, 18 aa, Mycobacterium
MLIVDGRLPVGARLPSER

SEQ ID NO: 1273512 - protein, 17 aa, Mycobacterium
MLIYRVDDEAAFELLRW

SEQ ID NO: 1273513 - protein, 18 aa, Mycobacterium
MLKLTLPDVDNLYRELVE

SEQ ID NO: 1273514 - protein, 21 aa, Mycobacterium
MLKPDRPALRELITQHDSDIQ

SEQ ID NO: 1273515 - protein, 17 aa, Mycobacterium
MLLEFGVISRRYLHATG

SEQ ID NO: 1273516 - protein, 25 aa, Mycobacterium
MLLSEHIRLVAAFDHRHVFLDPAPD

SEQ ID NO: 1273517 - protein, 26 aa, Mycobacterium
MLMAALRLNIPTVFVSGGPMEGGTAV

SEQ ID NO: 1273518 - protein, 19 aa, Mycobacterium
MLNPGLIVLGGFLRVFPTF

SEQ ID NO: 1273519 - protein, 20 aa, Mycobacterium
MLPRRARPKLSLRIEPASGV

SEQ ID NO: 1273520 - protein, 18 aa, Mycobacterium
MLPTPKIREILSAATTFV

SEQ ID NO: 1273521 - protein, 23 aa, Mycobacterium
MLQMGFAEDVERILADTPEYKQV

SEQ ID NO: 1273522 - protein, 17 aa, Mycobacterium
MLQNVRLDRSWRVENGQ

SEQ ID NO: 1273523 - protein, 21 aa, Mycobacterium
MLRAARFVSQLGFAVAPRVRR

SEQ ID NO: 1273524 - protein, 22 aa, Mycobacterium
MLRADLLRPWANWVTPKEERTR

SEQ ID NO: 1273525 - protein, 31 aa, Mycobacterium
MLRAERFGVRLAVVPTVRWARIGDAEFALRY

SEQ ID NO: 1273526 - protein, 34 aa, Mycobacterium
MLRERWSNQAAREWKELPARELAGTTMTVLGTGN

SEQ ID NO: 1273527 - protein, 20 aa, Mycobacterium
MLRVRLRTGLPAAALSAPER

SEQ ID NO: 1273528 - protein, 23 aa, Mycobacterium
MLTELGVPPGRLRMLRSFDPRSA

SEQ ID NO: 1273529 - protein, 35 aa, Mycobacterium
MLTLPATFSLYLERAWPRHRRLSGVDDVRSAAVVE

SEQ ID NO: 1273530 - protein, 24 aa, Mycobacterium
MLTLPRGAAGWVTADDGPIQLLAA

SEQ ID NO: 1273531 - protein, 23 aa, Mycobacterium
MLTMGLGGGYVTSWVGDPAAVTE

SEQ ID NO: 1273532 - protein, 22 aa, Mycobacterium
MLTTMLDRFGSWDSTRDSKINA

SEQ ID NO: 1273533 - protein, 30 aa, Mycobacterium
MLVELRPDLDWDKGTTLAWIRDRIDPSGSL

SEQ ID NO: 1273534 - protein, 18 aa, Mycobacterium
MLVQVALLRARRHVAAVA

SEQ ID NO: 1273535 - protein, 24 aa, Mycobacterium
MLYSHPDLRPGAAVPEGVSEAARP

SEQ ID NO: 1273536 - protein, 18 aa, Mycobacterium
MMADCFDLTLDEVKFSYE

SEQ ID NO: 1273537 - protein, 19 aa, Mycobacterium
MMANAAFYYGMLRALSEED

SEQ ID NO: 1273538 - protein, 20 aa, Mycobacterium
MMCNALAGARIWRLAEPEDG

SEQ ID NO: 1273539 - protein, 20 aa, Mycobacterium
MMDERWPVLPGSTYADVKRR

SEQ ID NO: 1273540 - protein, 22 aa, Mycobacterium
MMDKLRTAGPWESQQTHDSLRR

SEQ ID NO: 1273541 - protein, 21 aa, Mycobacterium
MMDTERELFKLGIPAKTRHNE

SEQ ID NO: 1273542 - protein, 21 aa, Mycobacterium
MMGELGARLFAIWETTPYNGH

SEQ ID NO: 1273543 - protein, 23 aa, Mycobacterium
MMIARLAGNLAEFETRFGQQRRS

SEQ ID NO: 1273544 - protein, 25 aa, Mycobacterium
MMIKACPVTWPWNLLGWPSINVPAG

SEQ ID NO: 1273545 - protein, 17 aa, Mycobacterium
MMILSVLNYKYFRQLNV

SEQ ID NO: 1273546 - protein, 25 aa, Mycobacterium
MMSQMAGQMGMPFGRKNTRKAAKGK

SEQ ID NO: 1273547 - protein, 17 aa, Mycobacterium
MNAALGITEQGFSSGDA

SEQ ID NO: 1273548 - protein, 17 aa, Mycobacterium
MNCKLLVEIGPRPVLTA

SEQ ID NO: 1273549 - protein, 32 aa, Mycobacterium
MNDQCEVEWIPPPRLDTGQARLNHYHRPERLL

SEQ ID NO: 1273550 - protein, 26 aa, Mycobacterium
MNDRCEVEWIPPPALDTGQARVNNYH

SEQ ID NO: 1273551 - protein, 22 aa, Mycobacterium
MNEIRWDIRPSPHLGTIEVRIF

SEQ ID NO: 1273552 - protein, 22 aa, Mycobacterium
MNEIRWDIRPSPHLGTVEIRVF

SEQ ID NO: 1273553 - protein, 17 aa, Mycobacterium
MNESRIQGSLCYTGADF

SEQ ID NO: 1273554 - protein, 23 aa, Mycobacterium
MNFFQYHLPGVQAYHLDVTPDPG

SEQ ID NO: 1273555 - protein, 18 aa, Mycobacterium
MNGTDAWEPVPAAHDGDF

SEQ ID NO: 1273556 - protein, 18 aa, Mycobacterium
MNGVIPLRTGEYDDGGPV

SEQ ID NO: 1273557 - protein, 25 aa, Mycobacterium
MNPFAKLMWRICKIDGPPSRYRSEP

SEQ ID NO: 1273558 - protein, 19 aa, Mycobacterium
MPADGPWTVTVPGATWGWS

SEQ ID NO: 1273559 - protein, 21 aa, Mycobacterium
MPAEVCGTGKHTIRELVETQS

SEQ ID NO: 1273560 - protein, 21 aa, Mycobacterium
MPAFARLWRGFARQSLEQLSR

SEQ ID NO: 1273561 - protein, 24 aa, Mycobacterium
MPAGKRLAPMLTELVAVLRHFREL

SEQ ID NO: 1273562 - protein, 20 aa, Mycobacterium
MPALAICRGMQILNVALGGT

SEQ ID NO: 1273563 - protein, 27 aa, Mycobacterium
MPAPQRLPGALIEHGRTIPVARVAAVH

SEQ ID NO: 1273564 - protein, 17 aa, Mycobacterium
MPAVIMLTSDHQLLVNT

SEQ ID NO: 1273565 - protein, 20 aa, Mycobacterium
MPAYRFPGLVPGDRWCVTAL

SEQ ID NO: 1273566 - protein, 19 aa, Mycobacterium
MPDARLIVTMPPRTGKSVL

SEQ ID NO: 1273567 - protein, 22 aa, Mycobacterium
MPDYPSMEAWTLATALLSRTDT

SEQ ID NO: 1273568 - protein, 21 aa, Mycobacterium
MPEDFRAVGQMFVDFHQVSDD

SEQ ID NO: 1273569 - protein, 22 aa, Mycobacterium
MPELLSAALTAWIAERDGEQTF

SEQ ID NO: 1273570 - protein, 17 aa, Mycobacterium
MPERLSDAAVWPRNNET

SEQ ID NO: 1273571 - protein, 20 aa, Mycobacterium
MPFERARTQLLLGQLQRRLR

SEQ ID NO: 1273572 - protein, 23 aa, Mycobacterium
MPGARWFPGATLNYVDQVVRQAR

SEQ ID NO: 1273573 - protein, 19 aa, Mycobacterium
MPGMGDMPGMEGMMSEEDM

SEQ ID NO: 1273574 - protein, 20 aa, Mycobacterium
MPGMSGGGMGMMSEADMAAL

SEQ ID NO: 1273575 - protein, 18 aa, Mycobacterium
MPGTDWAAVCIGRPKRGT

SEQ ID NO: 1273576 - protein, 23 aa, Mycobacterium
MPGTGFPQAPAFMAPPGTPGNPI

SEQ ID NO: 1273577 - protein, 19 aa, Mycobacterium
MPGTSYWYAHTGQWRYDGY

SEQ ID NO: 1273578 - protein, 21 aa, Mycobacterium
MPGVLSARWAGRHGDDAANTA

SEQ ID NO: 1273579 - protein, 18 aa, Mycobacterium
MPHGGFGASGFGKDMSQY

SEQ ID NO: 1273580 - protein, 21 aa, Mycobacterium
MPIAFRALSRLLRAMFSADDL

SEQ ID NO: 1273581 - protein, 29 aa, Mycobacterium
MPIRRAVHAVYECCCSVSLAADLARDRPY

SEQ ID NO: 1273582 - protein, 30 aa, Mycobacterium
MPKAVEFGSKIALMPSIVRKDFGPWSPGGK

SEQ ID NO: 1273583 - protein, 26 aa, Mycobacterium
MPKVYSGHVRLCLGYTEPEGGSDVAT

SEQ ID NO: 1273584 - protein, 19 aa, Mycobacterium
MPLAARPGQPGALALDGAY

SEQ ID NO: 1273585 - protein, 20 aa, Mycobacterium
MPLGVELRGARASGRTALER

SEQ ID NO: 1273586 - protein, 21 aa, Mycobacterium
MPLKFRDGTHFAALDGGSITL

SEQ ID NO: 1273587 - protein, 28 aa, Mycobacterium
MPLLRPGDEVYVCWSPDASLVLPAADIP

SEQ ID NO: 1273588 - protein, 17 aa, Mycobacterium
MPLMNAVGITSESVYLS

SEQ ID NO: 1273589 - protein, 17 aa, Mycobacterium
MPLRRFVFTSSYVTVGR

SEQ ID NO: 1273590 - protein, 20 aa, Mycobacterium
MPMMPGMDGMPGHSGMPSAS

SEQ ID NO: 1273591 - protein, 20 aa, Mycobacterium
MPNKVFVIGVGMTKFEKPGS

SEQ ID NO: 1273592 - protein, 24 aa, Mycobacterium
MPNLRFLQDSGIAFEHLDTGIPLA

SEQ ID NO: 1273593 - protein, 20 aa, Mycobacterium
MPPDGWTMKAVAFVKKRLEP

SEQ ID NO: 1273594 - protein, 28 aa, Mycobacterium
MPPMQYLLEWRVALAKELLRTERPAIAQ

SEQ ID NO: 1273595 - protein, 25 aa, Mycobacterium
MPPTEGRAGYGYTTLVATARDPLTM

SEQ ID NO: 1273596 - protein, 30 aa, Mycobacterium
MPQTPSLVLITFRPEYRGALTRVSGAQTIA

SEQ ID NO: 1273597 - protein, 19 aa, Mycobacterium
MPRDFKRVLQAIAEAQQSG

SEQ ID NO: 1273598 - protein, 18 aa, Mycobacterium
MPREGGNGDVRWFEVEPC

SEQ ID NO: 1273599 - protein, 19 aa, Mycobacterium
MPRLADAFMDLIDTAWDAE

SEQ ID NO: 1273600 - protein, 17 aa, Mycobacterium
MPRLADAFMDLIDTGWD

SEQ ID NO: 1273601 - protein, 19 aa, Mycobacterium
MPSDLRGPRALDLQETAFD

SEQ ID NO: 1273602 - protein, 17 aa, Mycobacterium
MPSGYAYGKSFRTVKTC

SEQ ID NO: 1273603 - protein, 17 aa, Mycobacterium
MPSLVYAGTRSHVMDYL

SEQ ID NO: 1273604 - protein, 18 aa, Mycobacterium
MPTLDCWVQLLRPGQQTE

SEQ ID NO: 1273605 - protein, 19 aa, Mycobacterium
MPVARGWGSGGLQVTLSLV

SEQ ID NO: 1273606 - protein, 20 aa, Mycobacterium
MPVDGRFSGITIAINQRTEA

SEQ ID NO: 1273607 - protein, 18 aa, Mycobacterium
MPVNAFGGTHGWGYDGVL

SEQ ID NO: 1273608 - protein, 20 aa, Mycobacterium
MPVSRLRAWSVAEVIHTMLP

SEQ ID NO: 1273609 - protein, 19 aa, Mycobacterium
MPYVLKIADKGWRDACRAD

SEQ ID NO: 1273610 - protein, 18 aa, Mycobacterium
MPYVLKLADKGWRGACQA

SEQ ID NO: 1273611 - protein, 17 aa, Mycobacterium
MQARRLESAMVMNLTVS

SEQ ID NO: 1273612 - protein, 18 aa, Mycobacterium
MQAVYPVFVGNGGGSIVN

SEQ ID NO: 1273613 - protein, 19 aa, Mycobacterium
MQFASEFEWMAPSGRGLLT

SEQ ID NO: 1273614 - protein, 23 aa, Mycobacterium
MQLARPGVGYGVLESRVESGRID

SEQ ID NO: 1273615 - protein, 26 aa, Mycobacterium
MQLDDIDWRTGRIILHGKASRKDGMP

SEQ ID NO: 1273616 - protein, 20 aa, Mycobacterium
MQLDRVERGFAYSVDAPLDM

SEQ ID NO: 1273617 - protein, 18 aa, Mycobacterium
MQLSRPAVGYGVVESKVD

SEQ ID NO: 1273618 - protein, 25 aa, Mycobacterium
MQPGHWSGAYACWGTENREAADRRR

SEQ ID NO: 1273619 - protein, 19 aa, Mycobacterium
MQRFCLGIHACEIPVLDLE

SEQ ID NO: 1273620 - protein, 21 aa, Mycobacterium
MQRKRFGRIIFIGSVSGMWGI

SEQ ID NO: 1273621 - protein, 18 aa, Mycobacterium
MQVYPELDTSSGDVTVIT

SEQ ID NO: 1273622 - protein, 17 aa, Mycobacterium
MQWDRVLCSAGKRGWDV

SEQ ID NO: 1273623 - protein, 22 aa, Mycobacterium
MRAAAIAKLGFDYQTVAALNPS

SEQ ID NO: 1273624 - protein, 19 aa, Mycobacterium
MRATFARYRRSLTAVAVVG

SEQ ID NO: 1273625 - protein, 22 aa, Mycobacterium
MRAVKHWSRWCEGATIGDVAKL

SEQ ID NO: 1273626 - protein, 18 aa, Mycobacterium
MRCLLIVGSSQTQWYSDD

SEQ ID NO: 1273627 - protein, 19 aa, Mycobacterium
MRDDVTWAADVLELMADDA

SEQ ID NO: 1273628 - protein, 19 aa, Mycobacterium
MRDEGYAAATSRRVAAEAG

SEQ ID NO: 1273629 - protein, 19 aa, Mycobacterium
MRDELARLLQFVLDLLADY

SEQ ID NO: 1273630 - protein, 22 aa, Mycobacterium
MREANIGFSFCYEAQRQVPAIL

SEQ ID NO: 1273631 - protein, 19 aa, Mycobacterium
MREAVLHFAVYGGWPKASR

SEQ ID NO: 1273632 - protein, 25 aa, Mycobacterium
MRETFRAVGVNLMFDHIKESLHEFG

SEQ ID NO: 1273633 - protein, 17 aa, Mycobacterium
MRFGFEVTGELTIPGGG

SEQ ID NO: 1273634 - protein, 17 aa, Mycobacterium
MRFKDGRELPLPVAGVF

SEQ ID NO: 1273635 - protein, 23 aa, Mycobacterium
MRGAEAISAYAPIDEAEKFRIEY

SEQ ID NO: 1273636 - protein, 19 aa, Mycobacterium
MRGAGLGHALMRSRLDRCD

SEQ ID NO: 1273637 - protein, 23 aa, Mycobacterium
MRGPASGEAFTFADAEKLVDYLA

SEQ ID NO: 1273638 - protein, 18 aa, Mycobacterium
MRGPLLPPTVPGWRSRAE

SEQ ID NO: 1273639 - protein, 25 aa, Mycobacterium
MRGPSSIWYRIRINLQHVAEDARPA

SEQ ID NO: 1273640 - protein, 23 aa, Mycobacterium
MRGRTLWVVPFCMGPLDADDPKL

SEQ ID NO: 1273641 - protein, 22 aa, Mycobacterium
MRGYGDFWSYCLVAEGAVDIAV

SEQ ID NO: 1273642 - protein, 17 aa, Mycobacterium
MRHFARSLAEKNIRVNS

SEQ ID NO: 1273643 - protein, 17 aa, Mycobacterium
MRHGYMACLPRGRVRVV

SEQ ID NO: 1273644 - protein, 19 aa, Mycobacterium
MRIAIALRDRLPRLAERYL

SEQ ID NO: 1273645 - protein, 24 aa, Mycobacterium
MRIGMVCPYSFDVPGGVQSHVLQL

SEQ ID NO: 1273646 - protein, 28 aa, Mycobacterium
MRKMVEGMLPRMRRGGSVVAVASIAGIG

SEQ ID NO: 1273647 - protein, 19 aa, Mycobacterium
MRLARIGSDNVIGYLAVDG

SEQ ID NO: 1273648 - protein, 23 aa, Mycobacterium
MRLPAGRKHWYASVIRHTGRRSG

SEQ ID NO: 1273649 - protein, 21 aa, Mycobacterium
MRLRAGEALSDLTLAATALGL

SEQ ID NO: 1273650 - protein, 23 aa, Mycobacterium
MRLRPHPAMTFRDLLTQTRDTAL

SEQ ID NO: 1273651 - protein, 22 aa, Mycobacterium
MRLVGMPLDYRWPDRQLPSEGA

SEQ ID NO: 1273652 - protein, 27 aa, Mycobacterium
MRLYDARYHAELHWWTASFAEREGIPR

SEQ ID NO: 1273653 - protein, 25 aa, Mycobacterium
MRNAFLNAPWVKAVIPVRPGKERAA

SEQ ID NO: 1273654 - protein, 18 aa, Mycobacterium
MRPEFGCRIHDHLFSLTN

SEQ ID NO: 1273655 - protein, 24 aa, Mycobacterium
MRPSDPPWCRPLLGVRRAVTRLAC

SEQ ID NO: 1273656 - protein, 18 aa, Mycobacterium
MRPWLPRVTNGRYRDVTV

SEQ ID NO: 1273657 - protein, 20 aa, Mycobacterium
MRQAARFGLIERLRGFDERL

SEQ ID NO: 1273658 - protein, 18 aa, Mycobacterium
MRQARLGDFRLPQRGIGV

SEQ ID NO: 1273659 - protein, 19 aa, Mycobacterium
MRQLRSWVRRGVDYAKALP

SEQ ID NO: 1273660 - protein, 20 aa, Mycobacterium
MRQPVGYPLRMIGMREPRSE

SEQ ID NO: 1273661 - protein, 22 aa, Mycobacterium
MRQRVRCLAPGKRILHDDELDP

SEQ ID NO: 1273662 - protein, 30 aa, Mycobacterium; identical to SEQ ID NO: 701676

SEQ ID NO: 1273663 - protein, 18 aa, Mycobacterium
MRRMVKEDLLTFEGRKLF

SEQ ID NO: 1273664 - protein, 21 aa, Mycobacterium
MRRNMRFDGVPFMPVTVRRAE

SEQ ID NO: 1273665 - protein, 22 aa, Mycobacterium
MRRPHWSLARTWLLQPDLPGFP

SEQ ID NO: 1273666 - protein, 17 aa, Mycobacterium
MRRVAPVWWNEQPIGAG

SEQ ID NO: 1273667 - protein, 18 aa, Mycobacterium
MRSAEERDASLALRSGHG

SEQ ID NO: 1273668 - protein, 18 aa, Mycobacterium
MRSICDRIAGFPGPVLAA

SEQ ID NO: 1273669 - protein, 25 aa, Mycobacterium
MRSLPEKYRTAIYYADIEGRKFREI

SEQ ID NO: 1273670 - protein, 23 aa, Mycobacterium
MRSLPEYYFYYAGLADKLQGEVV

SEQ ID NO: 1273671 - protein, 20 aa, Mycobacterium
MRTAAAALKRTREVQSAVPP

SEQ ID NO: 1273672 - protein, 19 aa, Mycobacterium
MRTEAIEVIFSRAAERGEL

SEQ ID NO: 1273673 - protein, 23 aa, Mycobacterium
MRTGEILACEALVRWQHPTRGLL

SEQ ID NO: 1273674 - protein, 20 aa, Mycobacterium
MRTIRWILYDAGRLVHPREY

SEQ ID NO: 1273675 - protein, 17 aa, Mycobacterium
MRTRNATYWSRSRGEHW

SEQ ID NO: 1273676 - protein, 21 aa, Mycobacterium
MRTWFGFGVAGNFAGHLEQAG

SEQ ID NO: 1273677 - protein, 18 aa, Mycobacterium
MRVHPGTFGLAGATLSVG

SEQ ID NO: 1273678 - protein, 18 aa, Mycobacterium
MRVPLEGGGRLVVELTPE

SEQ ID NO: 1273679 - protein, 17 aa, Mycobacterium
MRVRDGLRESVFRSYTY

SEQ ID NO: 1273680 - protein, 20 aa, Mycobacterium
MRVRLAMGVVTSIDPEILLL

SEQ ID NO: 1273681 - protein, 24 aa, Mycobacterium
MRVVGRGGAVLGEVWGERPSAYLG

SEQ ID NO: 1273682 - protein, 23 aa, Mycobacterium
MRVYANFLAQYSIRVNSVHPAAV

SEQ ID NO: 1273683 - protein, 21 aa, Mycobacterium
MRWFLMASPILRGGNLIVTEQ

SEQ ID NO: 1273684 - protein, 20 aa, Mycobacterium
MRWGGARGGITVHDALARGR

SEQ ID NO: 1273685 - protein, 18 aa, Mycobacterium
MSAFKWTALGHREIADML

SEQ ID NO: 1273686 - protein, 17 aa, Mycobacterium
MSAGIPVAVEFRHPSWD

SEQ ID NO: 1273687 - protein, 26 aa, Mycobacterium
MSAHLRAAHHLSLCPECALEVDAQRQ

SEQ ID NO: 1273688 - protein, 20 aa, Mycobacterium
MSAILRYNNSVAYARNVLSW

SEQ ID NO: 1273689 - protein, 17 aa, Mycobacterium
MSARVPLQVALSAQDHA

SEQ ID NO: 1273690 - protein, 26 aa, Mycobacterium
MSEPEAFKWIQRAAMDRRTTMKRVAE

SEQ ID NO: 1273691 - protein, 23 aa, Mycobacterium
MSEVLLPRRGTLIAWTTQGFPPG

SEQ ID NO: 1273692 - protein, 20 aa, Mycobacterium
MSGGIAFVLGLDPSRVNTDM

SEQ ID NO: 1273693 - protein, 20 aa, Mycobacterium
MSGGLDLFSIKALGGTTPVG

SEQ ID NO: 1273694 - protein, 18 aa, Mycobacterium
MSGIPRLQFAHVDLLVRN

SEQ ID NO: 1273695 - protein, 23 aa, Mycobacterium
MSGRWRVRHPSLAPLHQQARDLE

SEQ ID NO: 1273696 - protein, 17 aa, Mycobacterium
MSIEAILASPVVNAPLR

SEQ ID NO: 1273697 - protein, 25 aa, Mycobacterium
MSKAFAFAGGRVGYLVAAPAVIDAM

SEQ ID NO: 1273698 - protein, 23 aa, Mycobacterium
MSMARKLYHGCDVWLNNPLRPLE

SEQ ID NO: 1273699 - protein, 19 aa, Mycobacterium
MSNFLRTAATAVRGEAPKL

SEQ ID NO: 1273700 - protein, 20 aa, Mycobacterium
MSNTEPLLRLNVEARSADEV

SEQ ID NO: 1273701 - protein, 24 aa, Mycobacterium
MSPIRPNVIWAMDFQFDTAADGRT

SEQ ID NO: 1273702 - protein, 24 aa, Mycobacterium
MSPIRPNVIWAMDFQFDTTADGRI

SEQ ID NO: 1273703 - protein, 17 aa, Mycobacterium
MSQRLGIAAALLGDPPV

SEQ ID NO: 1273704 - protein, 24 aa, Mycobacterium
MSRELGVQYARQGIRVNALCPGPV

SEQ ID NO: 1273705 - protein, 26 aa, Mycobacterium
MSRSSPRAGDGFIRLDEAGVVTFASP

SEQ ID NO: 1273706 - protein, 31 aa, Mycobacterium
MSRVSGWLTPEARAHWDLIAAKYAAPGTNRP

SEQ ID NO: 1273707 - protein, 21 aa, Mycobacterium
MSRVSGWLTPEARGHWDVIAA

SEQ ID NO: 1273708 - protein, 19 aa, Mycobacterium
MSRVTGWLTPEARAHWDLI

SEQ ID NO: 1273709 - protein, 31 aa, Mycobacterium
MSRVTGWLTPEARAHWDLIAAKYAAPGTNLP

SEQ ID NO: 1273710 - protein, 19 aa, Mycobacterium
MSSTRPGGRGPLGALDAGS

SEQ ID NO: 1273711 - protein, 22 aa, Mycobacterium
MSSYGFLRSRLDGSVEESTVGD

SEQ ID NO: 1273712 - protein, 23 aa, Mycobacterium
MSTFDLTRSWARVNLDAAIDDWT

SEQ ID NO: 1273713 - protein, 19 aa, Mycobacterium
MSTLAPPTARGWEAVVGDE

SEQ ID NO: 1273714 - protein, 25 aa, Mycobacterium
MSTVTRLQIGYSFRNGPQARSESGA

SEQ ID NO: 1273715 - protein, 24 aa, Mycobacterium
MSVHVRGSVVLQRLREKNLAGEDG

SEQ ID NO: 1273716 - protein, 18 aa, Mycobacterium
MSVSNWGSSGRWTTNYSA

SEQ ID NO: 1273717 - protein, 18 aa, Mycobacterium
MTAARYGAIGVWGTDDLL

SEQ ID NO: 1273718 - protein, 20 aa, Mycobacterium
MTAEIFGRIDGLGKGRGGHM

SEQ ID NO: 1273719 - protein, 18 aa, Mycobacterium
MTALIGGLRTLNANHGGS

SEQ ID NO: 1273720 - protein, 17 aa, Mycobacterium
MTAPGDFIELVQGIPGG

SEQ ID NO: 1273721 - protein, 21 aa, Mycobacterium
MTATAIARWTRRLGSGSRSTS

SEQ ID NO: 1273722 - protein, 21 aa, Mycobacterium
MTATLAVEWAPKVRVNSVVVG

SEQ ID NO: 1273723 - protein, 19 aa, Mycobacterium
MTCRAQRTLLVVDNTTATP

SEQ ID NO: 1273724 - protein, 19 aa, Mycobacterium
MTDEEWDAVIAVHLRGHFL

SEQ ID NO: 1273725 - protein, 20 aa, Mycobacterium
MTDGLKFHWYLPTHGDTATI

SEQ ID NO: 1273726 - protein, 25 aa, Mycobacterium
MTDPSTGRCYLEWVDPALGARHDAE

SEQ ID NO: 1273727 - protein, 18 aa, Mycobacterium
MTDPYTLSPDRSAEPELG

SEQ ID NO: 1273728 - protein, 21 aa, Mycobacterium
MTGEALPPVLPATAAAQAHGL

SEQ ID NO: 1273729 - protein, 17 aa, Mycobacterium
MTGRPGGWVPSGSTVEV

SEQ ID NO: 1273730 - protein, 24 aa, Mycobacterium
MTHPDGRSAFALWFTGGIFVNQDG

SEQ ID NO: 1273731 - protein, 29 aa, Mycobacterium
MTIAKLRAARLLWARVCEVVGAADAGAAT

SEQ ID NO: 1273732 - protein, 19 aa, Mycobacterium
MTKIAGSARTYGADLRSAA

SEQ ID NO: 1273733 - protein, 23 aa, Mycobacterium
MTKSLRTGKVFVDWSQNNANKTT

SEQ ID NO: 1273734 - protein, 22 aa, Mycobacterium
MTLAYARSRFTIAAKAAHLPSA

SEQ ID NO: 1273735 - protein, 19 aa, Mycobacterium
MTMYAGWRAVVAAFVAGRL

SEQ ID NO: 1273736 - protein, 20 aa, Mycobacterium
MTNVNFWAAGSWAGAAPCGM

SEQ ID NO: 1273737 - protein, 23 aa, Mycobacterium
MTPGCTKEACHFRDLAAEFAAVG

SEQ ID NO: 1273738 - protein, 23 aa, Mycobacterium
MTPLPGWEGNHYLGIFDTQSFAL

SEQ ID NO: 1273739 - protein, 26 aa, Mycobacterium
MTPRRLVEVLMRIGPYGDRFGLRRNG

SEQ ID NO: 1273740 - protein, 25 aa, Mycobacterium
MTQPRVVDGLDRICRGLGGVSRVWR

SEQ ID NO: 1273741 - protein, 24 aa, Mycobacterium
MTREFAVAPVRFIKTIGDEVMLVS

SEQ ID NO: 1273742 - protein, 19 aa, Mycobacterium
MTSAALRVGEGIAERLNHA

SEQ ID NO: 1273743 - protein, 23 aa, Mycobacterium
MTSRPCPVCGGVGEVIPNPCNRC

SEQ ID NO: 1273744 - protein, 19 aa, Mycobacterium
MTSTYVIKGQFVGVHPADT

SEQ ID NO: 1273745 - protein, 26 aa, Mycobacterium
MTSVPPSVWGGVAAVRFREVVDRWNG

SEQ ID NO: 1273746 - protein, 25 aa, Mycobacterium
MTVKGLVGLSRWDLMDDVLGTPDRG

SEQ ID NO: 1273747 - protein, 17 aa, Mycobacterium
MTVYRLVHNGELPAVRV

SEQ ID NO: 1273748 - protein, 24 aa, Mycobacterium
MTWLLSRWTCVFGTPACKGTVEDR

SEQ ID NO: 1273749 - protein, 24 aa, Mycobacterium
MTWLLSRWTCVFGTPACQGTVEGR

SEQ ID NO: 1273750 - protein, 19 aa, Mycobacterium
MTWQGRPDPSIGEWWTGID

SEQ ID NO: 1273751 - protein, 23 aa, Mycobacterium
MTYQNAMRWYHWDPFTHIPKEQA

SEQ ID NO: 1273752 - protein, 24 aa, Mycobacterium
MTYQNAMRWYHWDPFTHIPKEQAT

SEQ ID NO: 1273753 - protein, 17 aa, Mycobacterium
MVAGTGCELHLVEPLGF

SEQ ID NO: 1273754 - protein, 26 aa, Mycobacterium
MVAGVTCGLGRGWGLPKSVRLGIAAG

SEQ ID NO: 1273755 - protein, 20 aa, Mycobacterium
MVAREGRLRTALGELKHYDF

SEQ ID NO: 1273756 - protein, 19 aa, Mycobacterium
MVEEARLFLVSAATAMAKA

SEQ ID NO: 1273757 - protein, 17 aa, Mycobacterium
MVEHPPRHCVVVQRDRH

SEQ ID NO: 1273758 - protein, 17 aa, Mycobacterium
MVGMIIAVARHFKRSGI

SEQ ID NO: 1273759 - protein, 17 aa, Mycobacterium
MVGRPCYEVEFSDGTVI

SEQ ID NO: 1273760 - protein, 17 aa, Mycobacterium
MVGYTFRMPGAGVVNPL

SEQ ID NO: 1273761 - protein, 19 aa, Mycobacterium
MVIPRSGSAGIYGPSCEAC

SEQ ID NO: 1273762 - protein, 27 aa, Mycobacterium
MVMAGREARGWLRVRPAGITTKRQLKP

SEQ ID NO: 1273763 - protein, 22 aa, Mycobacterium
MVNGGQVCVCPDYVLVPEYLVD

SEQ ID NO: 1273764 - protein, 28 aa, Mycobacterium
MVNSLGGRGVFAVELLVRGDEVYFSDVR

SEQ ID NO: 1273765 - protein, 19 aa, Mycobacterium
MVPDQHWTKVLQFVNETNM

SEQ ID NO: 1273766 - protein, 17 aa, Mycobacterium
MVPEAIIAMLACARLGA

SEQ ID NO: 1273767 - protein, 19 aa, Mycobacterium
MVPTGWFQVARDITDLASV

SEQ ID NO: 1273768 - protein, 22 aa, Mycobacterium
MVPTNVFYQLSFHEGSRYPLDR

SEQ ID NO: 1273769 - protein, 30 aa, Mycobacterium
MVRFDRAFESARRCGATTFVELSAHPQLLF

SEQ ID NO: 1273770 - protein, 19 aa, Mycobacterium
MVRRRITFLAKSEYFTGTG

SEQ ID NO: 1273771 - protein, 21 aa, Mycobacterium
MVRVLRPGRRMAVMVPTAGPA

SEQ ID NO: 1273772 - protein, 17 aa, Mycobacterium
MVSRLRAEHPVFRRRRF

SEQ ID NO: 1273773 - protein, 18 aa, Mycobacterium
MVTEWLKRVPEFRVDTAA

SEQ ID NO: 1273774 - protein, 17 aa, Mycobacterium
MVTLKIARFNPESPDDA

SEQ ID NO: 1273775 - protein, 26 aa, Mycobacterium
MVTSLRWTLTGVRSRFAVRRGGRPTM

SEQ ID NO: 1273776 - protein, 18 aa, Mycobacterium
MVVENNVDGYHALFTHAS

SEQ ID NO: 1273777 - protein, 22 aa, Mycobacterium
MVVLRFGGHRAPRGLTGLDTVD

SEQ ID NO: 1273778 - protein, 19 aa, Mycobacterium
MVVRLLAFGLRAHRLSDVD

SEQ ID NO: 1273779 - protein, 20 aa, Mycobacterium
MVVRRTTPLTSFSALIDHAV

SEQ ID NO: 1273780 - protein, 17 aa, Mycobacterium
MVYPRVHPAPMETCGAV

SEQ ID NO: 1273781 - protein, 18 aa, Mycobacterium
MWAASGVDYPTLLAAMVD

SEQ ID NO: 1273782 - protein, 18 aa, Mycobacterium
MWEKVIFNLLSNALKFTF

SEQ ID NO: 1273783 - protein, 31 aa, Mycobacterium
MWGAYLTGMWIYRLSLAKVKWHSLTGEPLTG

SEQ ID NO: 1273784 - protein, 21 aa, Mycobacterium
MWKVHQSSAPGPVIAVNGPQA

SEQ ID NO: 1273785 - protein, 24 aa, Mycobacterium
MWPEGVMAAAAWFQGDNDLGLPMW

SEQ ID NO: 1273786 - protein, 17 aa, Mycobacterium
MWTDLVALMKVGVRRGK

SEQ ID NO: 1273787 - protein, 26 aa, Mycobacterium
MWTTYRQSPAWGFCMWAITPDQMYSV

SEQ ID NO: 1273788 - protein, 21 aa, Mycobacterium
MYAFDPCAPFGGFKNSGIGRE

SEQ ID NO: 1273789 - protein, 17 aa, Mycobacterium
MYDCNFLNKVVTRDQLE

SEQ ID NO: 1273790 - protein, 23 aa, Mycobacterium
MYGTAKLLNPVIKLVCEKRAGDT

SEQ ID NO: 1273791 - protein, 18 aa, Mycobacterium
MYPQHLVANSWRRLARSF

SEQ ID NO: 1273792 - protein, 26 aa, Mycobacterium
MYREAKARLGDPVLAWADIQADPQRR

SEQ ID NO: 1273793 - protein, 25 aa, Mycobacterium
MYVQGGRLHFCYNFLGEYEQTLASA

SEQ ID NO: 1273794 - protein, 17 aa, Mycobacterium
NAAAGRDIRDDPGAGAA

SEQ ID NO: 1273795 - protein, 20 aa, Mycobacterium
NAAAVAWGMGAHVTVFDLNV

SEQ ID NO: 1273796 - protein, 17 aa, Mycobacterium
NAAEAFETFLQTKYVGQ

SEQ ID NO: 1273797 - protein, 17 aa, Mycobacterium
NAAIWRGPDSERFRSEW

SEQ ID NO: 1273798 - protein, 17 aa, Mycobacterium
NAASFPGAMTVDQDAAT

SEQ ID NO: 1273799 - protein, 17 aa, Mycobacterium
NAATYWRSKAKQGGPGV

SEQ ID NO: 1273800 - protein, 18 aa, Mycobacterium
NACPTFRAPALKSDGTST

SEQ ID NO: 1273801 - protein, 20 aa, Mycobacterium
NACTALRKGLLVGLGTTGPL

SEQ ID NO: 1273802 - protein, 26 aa, Mycobacterium
NADARGAFHADWFLRRILAAEERIVA

SEQ ID NO: 1273803 - protein, 26 aa, Mycobacterium
NADARGAFHADWFLRRILAAEERIVS

SEQ ID NO: 1273804 - protein, 31 aa, Mycobacterium
NADEWRAEVPLIEEWFEFVGEKLPTGIKDEF

SEQ ID NO: 1273805 - protein, 17 aa, Mycobacterium
NADGEVYFELRLGDAWV

SEQ ID NO: 1273806 - protein, 22 aa, Mycobacterium
NADGLFGVLTNVVWTSHGPCAV

SEQ ID NO: 1273807 - protein, 17 aa, Mycobacterium
NADGLFTAVVQERATGQ

SEQ ID NO: 1273808 - protein, 17 aa, Mycobacterium
NADGRLIAVTGDVTSYA

SEQ ID NO: 1273809 - protein, 18 aa, Mycobacterium
NADGRLIAVTGDVTSYAD

SEQ ID NO: 1273810 - protein, 24 aa, Mycobacterium
NADLGEGFGVWTLGDDDAMLDIVT

SEQ ID NO: 1273811 - protein, 17 aa, Mycobacterium
NAEALGAEQRWGIAESR

SEQ ID NO: 1273812 - protein, 22 aa, Mycobacterium
NAEGVGYLLKDRVADIAEFDAA

SEQ ID NO: 1273813 - protein, 18 aa, Mycobacterium
NAERFFKALTYNVLIGGT

SEQ ID NO: 1273814 - protein, 23 aa, Mycobacterium
NAFGPEEGILWLDMGALGMEQQD

SEQ ID NO: 1273815 - protein, 20 aa, Mycobacterium
NAGCPAGENIQAWLAHTTAG

SEQ ID NO: 1273816 - protein, 29 aa, Mycobacterium
NAGGFLLYRHRHPTPRDMAAVLRDYAADM

SEQ ID NO: 1273817 - protein, 24 aa, Mycobacterium
NAGKDLSFVPLRPERVVEVRYDHY

SEQ ID NO: 1273818 - protein, 18 aa, Mycobacterium
NAGLLAVRILGAADGALR

SEQ ID NO: 1273819 - protein, 21 aa, Mycobacterium
NAGMYPWKLAITSPYLDPGER

SEQ ID NO: 1273820 - protein, 23 aa, Mycobacterium
NAGRSQMALGYFIHYAGDNAIAW

SEQ ID NO: 1273821 - protein, 21 aa, Mycobacterium
NAGVLSWGRLWEMSEDQWSAV

SEQ ID NO: 1273822 - protein, 26 aa, Mycobacterium
NAGVVMDMLFRVCIEEKLTVVCTLHQ

SEQ ID NO: 1273823 - protein, 18 aa, Mycobacterium
NAIADRWINHYDRLRAQT

SEQ ID NO: 1273824 - protein, 27 aa, Mycobacterium
NAIAPGLFPSRMTKVLLAAGEEAVGAA

SEQ ID NO: 1273825 - protein, 18 aa, Mycobacterium
NAIAYRGGVAAQLDPTKA

SEQ ID NO: 1273826 - protein, 25 aa, Mycobacterium
NAIDPDKLITCLQVLADIEALPPEH

SEQ ID NO: 1273827 - protein, 18 aa, Mycobacterium
NAILKTASAFFAAELDRP

SEQ ID NO: 1273828 - protein, 17 aa, Mycobacterium
NAINGALRRDLNAAWNR

SEQ ID NO: 1273829 - protein, 25 aa, Mycobacterium
NAKKHMAFGVGMHRCLGSHYAKMMF

SEQ ID NO: 1273830 - protein, 25 aa, Mycobacterium
NAKRYRLAELALRDRVPLVMLLEGA

SEQ ID NO: 1273831 - protein, 17 aa, Mycobacterium
NALAERLRQKYGVTVEV

SEQ ID NO: 1273832 - protein, 24 aa, Mycobacterium
NALAGAAVRHILAMFADLSQVPDE

SEQ ID NO: 1273833 - protein, 31 aa, Mycobacterium
NALAKLWAQACEWEPVLPTSLRFVQVGGSRM

SEQ ID NO: 1273834 - protein, 18 aa, Mycobacterium
NALARAGHHVIYCNSRFR

SEQ ID NO: 1273835 - protein, 24 aa, Mycobacterium
NALEKFPGCAVVISHDRWFLDRTC

SEQ ID NO: 1273836 - protein, 17 aa, Mycobacterium
NALIWMPPTGHRSGDVV

SEQ ID NO: 1273837 - protein, 25 aa, Mycobacterium
NALNITLPMPRGWAYIPDPNVPEAF

SEQ ID NO: 1273838 - protein, 17 aa, Mycobacterium
NALNLILITVLARGHVL

SEQ ID NO: 1273839 - protein, 22 aa, Mycobacterium
NALTLNPGDWVLVTRTDGTPYA

SEQ ID NO: 1273840 - protein, 34 aa, Mycobacterium
NAMRPNGGILARGFEGMTIPLLGVTFYGPTPTDS

SEQ ID NO: 1273841 - protein, 18 aa, Mycobacterium
NAPFKFAPANGVGYFEQL

SEQ ID NO: 1273842 - protein, 17 aa, Mycobacterium
NAPGLAMTYITDRLGTS

SEQ ID NO: 1273843 - protein, 26 aa, Mycobacterium
NAPVQEWQLADGDVIRLGHSEIIVRV

SEQ ID NO: 1273844 - protein, 30 aa, Mycobacterium
NAQFLVFCAAIIRAVHKFGGLLRVSVASAT

SEQ ID NO: 1273845 - protein, 19 aa, Mycobacterium
NAQLWRFIVLDGPEQRAAV

SEQ ID NO: 1273846 - protein, 18 aa, Mycobacterium
NARAPQALLLAVNPDTEP

SEQ ID NO: 1273847 - protein, 25 aa, Mycobacterium
NARDATQIFGGYGFMNEYPVARHYR

SEQ ID NO: 1273848 - protein, 21 aa, Mycobacterium
NARGGRLSRQSAWQVLQDAAD

SEQ ID NO: 1273849 - protein, 21 aa, Mycobacterium
NARGGRLSRQSAWQVLQDAAE

SEQ ID NO: 1273850 - protein, 17 aa, Mycobacterium
NARRLEVAFTRRDGVAE

SEQ ID NO: 1273851 - protein, 22 aa, Mycobacterium
NARVSAAVGQRVELRVDSDEAG

SEQ ID NO: 1273852 - protein, 25 aa, Mycobacterium
NARYFVVPVTNLWTVTGNYWDEQTS

SEQ ID NO: 1273853 - protein, 25 aa, Mycobacterium
NASIAPALADRMRPWLPRVTNGRYR

SEQ ID NO: 1273854 - protein, 27 aa, Mycobacterium
NATAMKWMQRWPLRPIASRLWFRTADA

SEQ ID NO: 1273855 - protein, 24 aa, Mycobacterium
NATLIKKFRGGMGAVTEHLLQMFS

SEQ ID NO: 1273856 - protein, 17 aa, Mycobacterium
NAVALGLIDIGEFEERS

SEQ ID NO: 1273857 - protein, 17 aa, Mycobacterium
NAVALLIGSQVGSPGAM

SEQ ID NO: 1273858 - protein, 17 aa, Mycobacterium
NAVAPGVTLTPMVATRL

SEQ ID NO: 1273859 - protein, 22 aa, Mycobacterium
NAVCVGIAPDLFDLDDDDYAVV

SEQ ID NO: 1273860 - protein, 26 aa, Mycobacterium
NAVESARGVTVFAVGAGPRVDYQQLG

SEQ ID NO: 1273861 - protein, 29 aa, Mycobacterium
NAVGRARKSFVCGFHGWTYGLDGTCTHIR

SEQ ID NO: 1273862 - protein, 26 aa, Mycobacterium
NAVHDRAYCLLALQAPVARDLRVVVS

SEQ ID NO: 1273863 - protein, 23 aa, Mycobacterium
NAVIARVVARYGLTGTTAPHNGH

SEQ ID NO: 1273864 - protein, 17 aa, Mycobacterium
NAVITVLREYRAALITD

SEQ ID NO: 1273865 - protein, 24 aa, Mycobacterium
NAVLALAAVEAFFGAGAQRQLDVD

SEQ ID NO: 1273866 - protein, 19 aa, Mycobacterium
NAVLSEILGFYGLSYWYAE

SEQ ID NO: 1273867 - protein, 17 aa, Mycobacterium
NAVRPANIVPVGVPPLS

SEQ ID NO: 1273868 - protein, 22 aa, Mycobacterium
NAVSDLRVLGFLADEIGVDLGV

SEQ ID NO: 1273869 - protein, 17 aa, Mycobacterium
NAVSLVVARELMAQEYS

SEQ ID NO: 1273870 - protein, 19 aa, Mycobacterium
NAYCPGVVGTDMWVEIDKR

SEQ ID NO: 1273871 - protein, 20 aa, Mycobacterium
NAYIGRYPKPYVAIMNGITM

SEQ ID NO: 1273872 - protein, 19 aa, Mycobacterium
NAYLAAKLMTIFVEHPVVF

SEQ ID NO: 1273873 - protein, 23 aa, Mycobacterium
NAYTEGFTPFWDRLFAHAKDRGA

SEQ ID NO: 1273874 - protein, 21 aa, Mycobacterium
NCAETSVLLAMRPDLVHLDRM

SEQ ID NO: 1273875 - protein, 19 aa, Mycobacterium
NCATAPLPTGRRVAEFGAS

SEQ ID NO: 1273876 - protein, 22 aa, Mycobacterium
NCDKGRWAFTYTDVGDRITTPL

SEQ ID NO: 1273877 - protein, 25 aa, Mycobacterium
NCGPPIETDRGWLLLTHGVGPMRTY

SEQ ID NO: 1273878 - protein, 21 aa, Mycobacterium
NCVAEGPGFNVCIVKDGKLAS

SEQ ID NO: 1273879 - protein, 17 aa, Mycobacterium
NDAYFCVVDLHAITVSQ

SEQ ID NO: 1273880 - protein, 18 aa, Mycobacterium
NDCPAELWTKLDTQTVAA

SEQ ID NO: 1273881 - protein, 18 aa, Mycobacterium
NDDFPEFNDGKSSTPTAL

SEQ ID NO: 1273882 - protein, 22 aa, Mycobacterium
NDDYCRAHHLLGGAPPSHPATI

SEQ ID NO: 1273883 - protein, 24 aa, Mycobacterium
NDEIKELLMQTAIYCGVPDANSAF

SEQ ID NO: 1273884 - protein, 23 aa, Mycobacterium
NDELKRYLDVEGVALHALGDAGI

SEQ ID NO: 1273885 - protein, 24 aa, Mycobacterium
NDFRAVPVAGGWEVSGASVPTLGA

SEQ ID NO: 1273886 - protein, 23 aa, Mycobacterium
NDFRHLYVPPGFLHGFQALTATA

SEQ ID NO: 1273887 - protein, 18 aa, Mycobacterium
NDHCDVEWIPPPRLDTGQ

SEQ ID NO: 1273888 - protein, 28 aa, Mycobacterium
NDHKIRASRLVAEWPVRPGVPDPDPLAL

SEQ ID NO: 1273889 - protein, 20 aa, Mycobacterium
NDIRVAAAVRCAPPGNAPTP

SEQ ID NO: 1273890 - protein, 26 aa, Mycobacterium
NDITYLCTLREGLLYALVPDRSGFEA

SEQ ID NO: 1273891 - protein, 22 aa, Mycobacterium
NDIVAVLALYRPGPMGMNAHND

SEQ ID NO: 1273892 - protein, 27 aa, Mycobacterium
NDLAWGPAWCSSLRSLWVGTGEAVGDI

SEQ ID NO: 1273893 - protein, 26 aa, Mycobacterium
NDLRADARLALRLILQERGALPVEPV

SEQ ID NO: 1273894 - protein, 20 aa, Mycobacterium
NDLRGNPTLREVLIRAREMA

SEQ ID NO: 1273895 - protein, 26 aa, Mycobacterium
NDMHLYLKRAHVFRHLFGEPTDVLAE

SEQ ID NO: 1273896 - protein, 18 aa, Mycobacterium
NDPFLDADLAEWRKIIDL

SEQ ID NO: 1273897 - protein, 18 aa, Mycobacterium
NDRCRRLRPYAELLVDGF

SEQ ID NO: 1273898 - protein, 19 aa, Mycobacterium
NDRGWRWVHARAGEIASGS

SEQ ID NO: 1273899 - protein, 17 aa, Mycobacterium
NDRLGHAVGDDVLRSVA

SEQ ID NO: 1273900 - protein, 18 aa, Mycobacterium
NDRRRLGFLEAEGGGTVL

SEQ ID NO: 1273901 - protein, 17 aa, Mycobacterium
NDSRVPPAIGYPLGAQE

SEQ ID NO: 1273902 - protein, 24 aa, Mycobacterium
NDVDRIGGVPVVMKALLDAGLLHG

SEQ ID NO: 1273903 - protein, 25 aa, Mycobacterium
NDVEFALRFPEFFDEPPTSDVLTTA

SEQ ID NO: 1273904 - protein, 23 aa, Mycobacterium
NDVFLKDIWPSAAEIQETITSSI

SEQ ID NO: 1273905 - protein, 25 aa, Mycobacterium
NDVPRSAQNFRFFADHARLSAGEAL

SEQ ID NO: 1273906 - protein, 23 aa, Mycobacterium
NDYYDDMAWLALALERAGRLTGV

SEQ ID NO: 1273907 - protein, 21 aa, Mycobacterium
NEAFAAQAVACARELQLDEDI

SEQ ID NO: 1273908 - protein, 22 aa, Mycobacterium
NEAFASVVLKFQKDLNIPDEKL

SEQ ID NO: 1273909 - protein, 22 aa, Mycobacterium
NEAFASVVLSWARVHEADMDTV

SEQ ID NO: 1273910 - protein, 19 aa, Mycobacterium
NEAGLVCGGVKTANATVYM

SEQ ID NO: 1273911 - protein, 22 aa, Mycobacterium
NEDEVDAFLDLVENELSRLIEE

SEQ ID NO: 1273912 - protein, 33 aa, Mycobacterium
NEEDARWRFGVPPANNANYAWIQHILYKLASGG

SEQ ID NO: 1273913 - protein, 30 aa, Mycobacterium; identical to SEQ ID NO: 702841

SEQ ID NO: 1273914 - protein, 22 aa, Mycobacterium
NEGKLYLCAIKDVYSNRIVGYS

SEQ ID NO: 1273915 - protein, 21 aa, Mycobacterium
NEGLRSRFTRSIDFPSYSGKE

SEQ ID NO: 1273916 - protein, 25 aa, Mycobacterium
NEILEYHWGRHWVVWDAEDTFQQRG

SEQ ID NO: 1273917 - protein, 17 aa, Mycobacterium
NEINAFKQVFGRHPESP

SEQ ID NO: 1273918 - protein, 17 aa, Mycobacterium
NEIRRRMDVELGVQSLT

SEQ ID NO: 1273919 - protein, 23 aa, Mycobacterium
NELCFVFGLRPGTAVGELADPVR

SEQ ID NO: 1273920 - protein, 22 aa, Mycobacterium
NELRLTDVSAHFGLASSTAHRL

SEQ ID NO: 1273921 - protein, 17 aa, Mycobacterium
NEMPARVLMAQAALEAG

SEQ ID NO: 1273922 - protein, 21 aa, Mycobacterium
NENRMAVGMPPDVPDWRELGA

SEQ ID NO: 1273923 - protein, 24 aa, Mycobacterium
NERCEVEWIPPPPLDTGQARINNY

SEQ ID NO: 1273924 - protein, 24 aa, Mycobacterium
NERCEVEWIPPPSLDTGQARINNY

SEQ ID NO: 1273925 - protein, 20 aa, Mycobacterium
NERCEVEWTPPPPLDTGQAR

SEQ ID NO: 1273926 - protein, 31 aa, Mycobacterium
NERELRKLLADSTIRPHIGAVYALDDVTAAL

SEQ ID NO: 1273927 - protein, 18 aa, Mycobacterium
NERIRAAAHFAVGGVAQT

SEQ ID NO: 1273928 - protein, 23 aa, Mycobacterium
NESKRASKLMARMYSALEAAYPA

SEQ ID NO: 1273929 - protein, 22 aa, Mycobacterium
NEVRSELGLAQAPRVDNYGGFV

SEQ ID NO: 1273930 - protein, 22 aa, Mycobacterium
NEYLDGLLPLLAGEPANATGET

SEQ ID NO: 1273931 - protein, 24 aa, Mycobacterium
NFAAGRLSYFLGVRGPAVVVDTAC

SEQ ID NO: 1273932 - protein, 18 aa, Mycobacterium
NFAAYPLEWVPVPEGRLV

SEQ ID NO: 1273933 - protein, 25 aa, Mycobacterium
NFASPFSPQTSWAPTFAPETDTDLL

SEQ ID NO: 1273934 - protein, 25 aa, Mycobacterium
NFDNGALAPHAWRRKPMSIEAILAS

SEQ ID NO: 1273935 - protein, 18 aa, Mycobacterium
NFDRSGPVVLYRVAPQMF

SEQ ID NO: 1273936 - protein, 18 aa, Mycobacterium
NFFLFGLTESQVEKVKAE

SEQ ID NO: 1273937 - protein, 21 aa, Mycobacterium
NFFQYHLPGVQAYHLDVTPDP

SEQ ID NO: 1273938 - protein, 18 aa, Mycobacterium
NFILVGAIIEKLTGEQLD

SEQ ID NO: 1273939 - protein, 18 aa, Mycobacterium
NFLAEWYLPDLAETTVDD

SEQ ID NO: 1273940 - protein, 23 aa, Mycobacterium
NFLNPRPGTPFGDLEVLPASEAL

SEQ ID NO: 1273941 - protein, 19 aa, Mycobacterium
NFNPLAAMAGRITIAQVEE

SEQ ID NO: 1273942 - protein, 21 aa, Mycobacterium
NFPGLSWPITLGHEIAGTVAE

SEQ ID NO: 1273943 - protein, 19 aa, Mycobacterium
NFPGYFLVVHDITRFCRDN

SEQ ID NO: 1273944 - protein, 19 aa, Mycobacterium
NFPQLRGRCLANYTSDPVF

SEQ ID NO: 1273945 - protein, 18 aa, Mycobacterium
NFPYRYPWRDVERQLQRM

SEQ ID NO: 1273946 - protein, 17 aa, Mycobacterium
NFTLAVRAFAQMFPSRR

SEQ ID NO: 1273947 - protein, 23 aa, Mycobacterium
NGAALDRPWMLAVGNRCRALLLV

SEQ ID NO: 1273948 - protein, 25 aa, Mycobacterium
NGAAPDSVFFSGYYAEAAPFVQQLR

SEQ ID NO: 1273949 - protein, 19 aa, Mycobacterium
NGCCGELVLAHSLAQRGDT

SEQ ID NO: 1273950 - protein, 25 aa, Mycobacterium
NGCMATSGSLIRWFQALIGGPEAVE

SEQ ID NO: 1273951 - protein, 23 aa, Mycobacterium
NGDRRFWMLLGVQITDDAVRHRV

SEQ ID NO: 1273952 - protein, 27 aa, Mycobacterium
NGEKFHFPTRIARPLSHDFADDDPAKL

SEQ ID NO: 1273953 - protein, 22 aa, Mycobacterium
NGEPWPFAPRVILKSLIERCSD

SEQ ID NO: 1273954 - protein, 22 aa, Mycobacterium
NGFKLPLARNAVMRALVLATGR

SEQ ID NO: 1273955 - protein, 21 aa, Mycobacterium
NGFQVLCEAGLLPGALTRNAG

SEQ ID NO: 1273956 - protein, 27 aa, Mycobacterium
NGFRRRIFVYALDWPGESPLRPSYDRV

SEQ ID NO: 1273957 - protein, 22 aa, Mycobacterium
NGGKTLPFVPFIGGSGPNPAIL

SEQ ID NO: 1273958 - protein, 26 aa, Mycobacterium
NGGPTAWWNGRIVGGWGQDADGRVVL

SEQ ID NO: 1273959 - protein, 25 aa, Mycobacterium
NGGRIRLQPQLGWESNEPDELAQVI

SEQ ID NO: 1273960 - protein, 19 aa, Mycobacterium
NGGRYLVEHFVDFWDRVLA

SEQ ID NO: 1273961 - protein, 17 aa, Mycobacterium
NGGVLLITHYTRILRYI

SEQ ID NO: 1273962 - protein, 24 aa, Mycobacterium
NGHFYGVGLINWWDPKGTRSTLEE

SEQ ID NO: 1273963 - protein, 25 aa, Mycobacterium
NGHGDHIRYSFAMASRAAAMSACAK

SEQ ID NO: 1273964 - protein, 17 aa, Mycobacterium
NGHHWDPRLPQFPGSFA

SEQ ID NO: 1273965 - protein, 20 aa, Mycobacterium
NGITKWVFGWERNGWMTAAK

SEQ ID NO: 1273966 - protein, 19 aa, Mycobacterium
NGKNQTEWLPPPDLDTGQH

SEQ ID NO: 1273967 - protein, 19 aa, Mycobacterium
NGLEPCIARAKAYAPYSDL

SEQ ID NO: 1273968 - protein, 20 aa, Mycobacterium
NGLEVLRYGGLETGAVPSPF

SEQ ID NO: 1273969 - protein, 26 aa, Mycobacterium
NGLFGGYREMVGWGHGRTPGALLDRN

SEQ ID NO: 1273970 - protein, 18 aa, Mycobacterium
NGLLPPPPVDPFAPPPAP

SEQ ID NO: 1273971 - protein, 20 aa, Mycobacterium
NGLLTTVCYQFGDAKPVYAL

SEQ ID NO: 1273972 - protein, 17 aa, Mycobacterium
NGMPGVLSARWAGRHGD

SEQ ID NO: 1273973 - protein, 30 aa, Mycobacterium
NGPIRTGLEPIEFWESFRVGHRGYAHALPV

SEQ ID NO: 1273974 - protein, 20 aa, Mycobacterium
NGPKGWMPQVWESLTDDGIA

SEQ ID NO: 1273975 - protein, 20 aa, Mycobacterium
NGPSEAWVYIDHRVEPGPPR

SEQ ID NO: 1273976 - protein, 32 aa, Mycobacterium
NGQLCAALTRILLPRSRYSEFVDALTTAVADL

SEQ ID NO: 1273977 - protein, 25 aa, Mycobacterium
NGQTLFEICARLTTKHGLGSSRQAI

SEQ ID NO: 1273978 - protein, 19 aa, Mycobacterium
NGRARPGDVVVVRYEGPKG

SEQ ID NO: 1273979 - protein, 22 aa, Mycobacterium
NGRATWDSALLLFLERSGYSEE

SEQ ID NO: 1273980 - protein, 20 aa, Mycobacterium
NGRDGSVFDSSYERGEPVDF

SEQ ID NO: 1273981 - protein, 25 aa, Mycobacterium
NGRIRFPAIVRTVARVLRAADQWAA

SEQ ID NO: 1273982 - protein, 22 aa, Mycobacterium
NGRRRALEVFSWESVAAQTVAV

SEQ ID NO: 1273983 - protein, 17 aa, Mycobacterium
NGSHRMADLIPDEYQDF

SEQ ID NO: 1273984 - protein, 21 aa, Mycobacterium
NGSSWIFPLFNDFDELAKKMP

SEQ ID NO: 1273985 - protein, 24 aa, Mycobacterium
NGTIRSSLWISMADGLPYGVMDPV

SEQ ID NO: 1273986 - protein, 18 aa, Mycobacterium
NGTVMLRMPLHPVAIELL

SEQ ID NO: 1273987 - protein, 31 aa, Mycobacterium
NGVASFPGIEAKEIWGSRLLFDLIGCTDNDG

SEQ ID NO: 1273988 - protein, 18 aa, Mycobacterium
NGVDGYFPGPARWACSAL

SEQ ID NO: 1273989 - protein, 17 aa, Mycobacterium
NGVPIRWVEMVRHTLQA

SEQ ID NO: 1273990 - protein, 25 aa, Mycobacterium
NGVRRIAEQHGYLATFMAKVATDSA

SEQ ID NO: 1273991 - protein, 27 aa, Mycobacterium
NGVVGEIQYALSFDWFPIPLPPLPPFP

SEQ ID NO: 1273992 - protein, 20 aa, Mycobacterium
NGVVIGLEFDHPEGAKFVMR

SEQ ID NO: 1273993 - protein, 18 aa, Mycobacterium
NGWPRKLIIFTEHRDTLD

SEQ ID NO: 1273994 - protein, 24 aa, Mycobacterium
NGYLPPSGFIAGIWSRNDDTRGVH

SEQ ID NO: 1273995 - protein, 25 aa, Mycobacterium
NHADRRPKWIAPYVKGPDGAPLKTD

SEQ ID NO: 1273996 - protein, 23 aa, Mycobacterium
NHARSVKIIRWFVDATVNRRYEV

SEQ ID NO: 1273997 - protein, 18 aa, Mycobacterium
NHDARFGAVEGYRGAVTR

SEQ ID NO: 1273998 - protein, 24 aa, Mycobacterium
NHDGLKALLRRLLGSGRLGSHNGL

SEQ ID NO: 1273999 - protein, 24 aa, Mycobacterium
NHEECIFDIFYLKVFPEGATIPPM

SEQ ID NO: 1274000 - protein, 25 aa, Mycobacterium
NHFFVCSTHDWILFFTTQGRVYRAK

SEQ ID NO: 1274001 - protein, 23 aa, Mycobacterium
NHGFDMAAPFGGYKRSGNGREWG

SEQ ID NO: 1274002 - protein, 24 aa, Mycobacterium
NHIYRSCAKLDLRDRAELAAAVRR

SEQ ID NO: 1274003 - protein, 20 aa, Mycobacterium
NHLIQLLALTAMEEPVNFSP

SEQ ID NO: 1274004 - protein, 18 aa, Mycobacterium
NHPACVELTFAAASLGAA

SEQ ID NO: 1274005 - protein, 19 aa, Mycobacterium
NHPGGIERWSGKHTDDNRK

SEQ ID NO: 1274006 - protein, 22 aa, Mycobacterium
NHRAIDALSHVGVRSAVKMPSQ

SEQ ID NO: 1274007 - protein, 24 aa, Mycobacterium
NHRDKALVKIRDWLEKSRMWSERN

SEQ ID NO: 1274008 - protein, 33 aa, Mycobacterium
NHRLPKGEPLLAFGSRAVVHFAVSNSEVQMTTK

SEQ ID NO: 1274009 - protein, 21 aa, Mycobacterium
NHYPIGWAMAFNTPYKLFKRY

SEQ ID NO: 1274010 - protein, 19 aa, Mycobacterium
NIAAALALQGLRTLVIDLD

SEQ ID NO: 1274011 - protein, 17 aa, Mycobacterium
NIAAQKIASGWETLVIA

SEQ ID NO: 1274012 - protein, 20 aa, Mycobacterium
NIAELPGLVADAASGLSRLR

SEQ ID NO: 1274013 - protein, 33 aa, Mycobacterium
NIAPGFVAVGVWPAIKLPPLVTPLPGLGYTIGD

SEQ ID NO: 1274014 - protein, 26 aa, Mycobacterium
NIDSRGRFPGRYRVKVLENLSRECSR

SEQ ID NO: 1274015 - protein, 25 aa, Mycobacterium
NIEIEPRGSTALEANGILPLGQTTT

SEQ ID NO: 1274016 - protein, 18 aa, Mycobacterium
NIELDIMMVPLPGLFDLP

SEQ ID NO: 1274017 - protein, 23 aa, Mycobacterium
NIGKLLTKRGSVIATALRSRPVH

SEQ ID NO: 1274018 - protein, 18 aa, Mycobacterium
NIGLPIFTSGALEIPGKI

SEQ ID NO: 1274019 - protein, 20 aa, Mycobacterium
NIGNPAPFGFEAPDVIMRDI

SEQ ID NO: 1274020 - protein, 20 aa, Mycobacterium
NIPLTAHFLGGAAIGDSAET

SEQ ID NO: 1274021 - protein, 19 aa, Mycobacterium
NIPPERYQQVNGAPPPDQT

SEQ ID NO: 1274022 - protein, 24 aa, Mycobacterium
NIQHADLLVVRRGEKVTVEVNIVI

SEQ ID NO: 1274023 - protein, 23 aa, Mycobacterium
NIQLHGGIGFTWEHDSHLYLRRA

SEQ ID NO: 1274024 - protein, 18 aa, Mycobacterium
NIVIGFGRVDGRPVGIVA

SEQ ID NO: 1274025 - protein, 17 aa, Mycobacterium
NKAGLWPYLEKLGYYLG

SEQ ID NO: 1274026 - protein, 23 aa, Mycobacterium
NKDQWFKNVWNFNTALGSAVRSV

SEQ ID NO: 1274027 - protein, 19 aa, Mycobacterium
NKGELFSSFDVSAFEVPGG

SEQ ID NO: 1274028 - protein, 31 aa, Mycobacterium
NKHVAFGYGVHFCLGAALARMEINSFFTELL

SEQ ID NO: 1274029 - protein, 27 aa, Mycobacterium
NKHVLNPVMLLLAGRRHWYAAALRHTG

SEQ ID NO: 1274030 - protein, 21 aa, Mycobacterium
NKIVMSIAIRLLSERHMVTEL

SEQ ID NO: 1274031 - protein, 22 aa, Mycobacterium
NKLCALDGITLDLKRGETLGLV

SEQ ID NO: 1274032 - protein, 20 aa, Mycobacterium
NKLFEERIIFLGVQVDDASA

SEQ ID NO: 1274033 - protein, 22 aa, Mycobacterium
NKLSGRHIPALRQVIGCVFQDF

SEQ ID NO: 1274034 - protein, 25 aa, Mycobacterium
NKPFPIASVVKLFIADDLLLQESEG

SEQ ID NO: 1274035 - protein, 23 aa, Mycobacterium
NKRDRLGSALAELGFAVHDSAGT

SEQ ID NO: 1274036 - protein, 20 aa, Mycobacterium
NKRTGVNFFTSMFGRTLLNT

SEQ ID NO: 1274037 - protein, 26 aa, Mycobacterium
NKVARFPKFDWPRIDAPVCSAGMDNE

SEQ ID NO: 1274038 - protein, 25 aa, Mycobacterium
NKVARRLVGMLARRGYNQTMAFDVV

SEQ ID NO: 1274039 - protein, 24 aa, Mycobacterium
NKVSELPAGQGFNAATLEYGDLIA

SEQ ID NO: 1274040 - protein, 19 aa, Mycobacterium
NLADGIVVLEFVDREDDHP

SEQ ID NO: 1274041 - protein, 19 aa, Mycobacterium
NLAGLSFPFLREKIHGRSN

SEQ ID NO: 1274042 - protein, 20 aa, Mycobacterium
NLAKFDGMRYGLRVGDDGTT

SEQ ID NO: 1274043 - protein, 25 aa, Mycobacterium
NLALPGVAWGDRWGRTAQCRAVSRA

SEQ ID NO: 1274044 - protein, 24 aa, Mycobacterium
NLATRGPRSLRVCTLLRKPEAVRA

SEQ ID NO: 1274045 - protein, 18 aa, Mycobacterium
NLDEVRLITGIDVTDAAS

SEQ ID NO: 1274046 - protein, 21 aa, Mycobacterium
NLDEVRLLVDIDVVDEESQRA

SEQ ID NO: 1274047 - protein, 36 aa, Mycobacterium
NLDIAAGAGRSVWTLLRRRNGVLPAIEQALHTIGLT

SEQ ID NO: 1274048 - protein, 19 aa, Mycobacterium
NLDLGELSPALTVAADGAD

SEQ ID NO: 1274049 - protein, 24 aa, Mycobacterium
NLDLPTGRGYCWFAGEAAESRAVR

SEQ ID NO: 1274050 - protein, 25 aa, Mycobacterium
NLEELLAVVCGRGLELGDVAAEFHH

SEQ ID NO: 1274051 - protein, 19 aa, Mycobacterium
NLESIALAESWDNGKPIRE

SEQ ID NO: 1274052 - protein, 27 aa, Mycobacterium
NLFLRDLVMALRWVRDNVAAFGGDPDK

SEQ ID NO: 1274053 - protein, 26 aa, Mycobacterium
NLGEVLARYRKVVVPEMNLGQLALLL

SEQ ID NO: 1274054 - protein, 26 aa, Mycobacterium
NLGGRWADSFGGLVYDATAITEPEGL

SEQ ID NO: 1274055 - protein, 23 aa, Mycobacterium
NLGHLEAAAGIAGFAKAVLALQH

SEQ ID NO: 1274056 - protein, 17 aa, Mycobacterium
NLGKWWRDNGFRTYQGV

SEQ ID NO: 1274057 - protein, 25 aa, Mycobacterium
NLGRTPAQIALAWTLSVAPNVLLIP

SEQ ID NO: 1274058 - protein, 22 aa, Mycobacterium
NLHLEYPTGVVFDSVTVGVSEG

SEQ ID NO: 1274059 - protein, 20 aa, Mycobacterium
NLHYGGSWWVYSPTNILGTD

SEQ ID NO: 1274060 - protein, 18 aa, Mycobacterium
NLIPMAAVYVGRPARKLS

SEQ ID NO: 1274061 - protein, 18 aa, Mycobacterium
NLKPAERNFFVLVEGVSS

SEQ ID NO: 1274062 - protein, 24 aa, Mycobacterium
NLLGIKAKSALLLITRITYDQHDT

SEQ ID NO: 1274063 - protein, 17 aa, Mycobacterium
NLLGRRGLKVVVIERDP

SEQ ID NO: 1274064 - protein, 25 aa, Mycobacterium
NLLGWPSINVPAGFTSDGLPIGVQL

SEQ ID NO: 1274065 - protein, 24 aa, Mycobacterium
NLLPERRYRLVVTVADLTTGQLVR

SEQ ID NO: 1274066 - protein, 25 aa, Mycobacterium
NLLPPRPMHLCLQLDYFGGDTGGGA

SEQ ID NO: 1274067 - protein, 18 aa, Mycobacterium
NLLQWTVQLQNTWATRLM

SEQ ID NO: 1274068 - protein, 22 aa, Mycobacterium
NLLRRIGAERTVVVVEHDMDFM

SEQ ID NO: 1274069 - protein, 24 aa, Mycobacterium
NLNCKRRTHHLGKTFAEGWQEQQL

SEQ ID NO: 1274070 - protein, 24 aa, Mycobacterium
NLNRRQRFLLSLNVPIIMRVLCQA

SEQ ID NO: 1274071 - protein, 26 aa, Mycobacterium
NLPRTAFKPSYGLAEATLFVSTIAPD

SEQ ID NO: 1274072 - protein, 21 aa, Mycobacterium
NLRAVNFVIDGILGRGVAYQA

SEQ ID NO: 1274073 - protein, 25 aa, Mycobacterium
NLRDLPFTLTYLFDGDGSARLAGTS

SEQ ID NO: 1274074 - protein, 17 aa, Mycobacterium
NLRELADAVYWCLENFE

SEQ ID NO: 1274075 - protein, 21 aa, Mycobacterium
NLRIVFVEHAFTWILPLMWRM

SEQ ID NO: 1274076 - protein, 19 aa, Mycobacterium
NLRRLISLFEQLRERSQLI

SEQ ID NO: 1274077 - protein, 21 aa, Mycobacterium
NLRVAPVLYDFINNEALPGTD

SEQ ID NO: 1274078 - protein, 25 aa, Mycobacterium
NLSEGWWPFLVGLAMGDAGGYKSEP

SEQ ID NO: 1274079 - protein, 20 aa, Mycobacterium
NLSIRDGWWDEWYDGENGWE

SEQ ID NO: 1274080 - protein, 18 aa, Mycobacterium
NLSPIGIVHLFRQYFFEF

SEQ ID NO: 1274081 - protein, 27 aa, Mycobacterium
NLSSFPLACAGCWINGVPMQEAVAAMF

SEQ ID NO: 1274082 - protein, 18 aa, Mycobacterium
NLTMPYVLPNEGEVVGVG

SEQ ID NO: 1274083 - protein, 21 aa, Mycobacterium
NLTNWTVCWQSPKAGSTFTAK

SEQ ID NO: 1274084 - protein, 26 aa, Mycobacterium
NLTRELAVQWARYNVRVNALAPGFFP

SEQ ID NO: 1274085 - protein, 17 aa, Mycobacterium
NLTRVYRKLGIRSRAQL

SEQ ID NO: 1274086 - protein, 17 aa, Mycobacterium
NLVICGSPGRGKSHATK

SEQ ID NO: 1274087 - protein, 22 aa, Mycobacterium
NLVKMALQYEGWEIDVAHDAAE

SEQ ID NO: 1274088 - protein, 30 aa, Mycobacterium
NLVMGSNVQVVWEKFCRYFDVEARYLPMEE

SEQ ID NO: 1274089 - protein, 18 aa, Mycobacterium
NLVRARSGVNWQATEDFS

SEQ ID NO: 1274090 - protein, 19 aa, Mycobacterium
NLWAYVVIFCGHFPDGAEK

SEQ ID NO: 1274091 - protein, 24 aa, Mycobacterium
NMAESLKWHGLEVVVYDQVESNPK

SEQ ID NO: 1274092 - protein, 24 aa, Mycobacterium
NMDEARWDSVLAVNLLAPLRLAEG

SEQ ID NO: 1274093 - protein, 28 aa, Mycobacterium
NMLAEPLLRRIDILAAQGHPGAQQLATY

SEQ ID NO: 1274094 - protein, 18 aa, Mycobacterium
NMTLAEWQRYHEVVAGAT

SEQ ID NO: 1274095 - protein, 18 aa, Mycobacterium
NNALTKWVTPARDRFRDR

SEQ ID NO: 1274096 - protein, 18 aa, Mycobacterium
NNAMVWQLPTRMKFSNIK

SEQ ID NO: 1274097 - protein, 19 aa, Mycobacterium
NNFGPEFEWAVLADPEGNA

SEQ ID NO: 1274098 - protein, 27 aa, Mycobacterium
NNGSLRGVMMFDGFSFGGVLTKSLAKL

SEQ ID NO: 1274099 - protein, 24 aa, Mycobacterium
NNIQLHGGIAFTWEHDAHLYLRRA

SEQ ID NO: 1274100 - protein, 18 aa, Mycobacterium
NNKEEVLSAVGRHFEVGI

SEQ ID NO: 1274101 - protein, 24 aa, Mycobacterium
NNMGTPFLPQWACEPEDVAAAVCW

SEQ ID NO: 1274102 - protein, 27 aa, Mycobacterium
NNNWFAAYAYWYFKLYGHQDVKLLDGG

SEQ ID NO: 1274103 - protein, 19 aa, Mycobacterium
NNPECHLMVVLVDERPEEV

SEQ ID NO: 1274104 - protein, 19 aa, Mycobacterium
NNRLWRMNLSYMGYLVPLF

SEQ ID NO: 1274105 - protein, 17 aa, Mycobacterium
NNTCTFCIVPSLRGKEV

SEQ ID NO: 1274106 - protein, 26 aa, Mycobacterium
NNVREAIAIARECRTLLGGSGITLEY

SEQ ID NO: 1274107 - protein, 24 aa, Mycobacterium
NPAEVPARFEALAALGGLDRAALH

SEQ ID NO: 1274108 - protein, 17 aa, Mycobacterium
NPATLPFVENWNLLVSQ

SEQ ID NO: 1274109 - protein, 21 aa, Mycobacterium
NPAYVSWLISQSMLADANEIS

SEQ ID NO: 1274110 - protein, 23 aa, Mycobacterium
NPDRFRFLATYIAGRSVEVTEAA

SEQ ID NO: 1274111 - protein, 24 aa, Mycobacterium
NPEDLRKADAIEIVLGQGAKPGGG

SEQ ID NO: 1274112 - protein, 24 aa, Mycobacterium
NPEILPAHLILGMFADPTGLAARL

SEQ ID NO: 1274113 - protein, 25 aa, Mycobacterium
NPENRLRTTIGLRKVDGRWMIAHEH

SEQ ID NO: 1274114 - protein, 37 aa, Mycobacterium
NPFIKDFKLRFFEDGMKRAACIPFIRNILEYTKGETD

SEQ ID NO: 1274115 - protein, 23 aa, Mycobacterium
NPFSRARIDASVAELRTERDAVA

SEQ ID NO: 1274116 - protein, 19 aa, Mycobacterium
NPFVSWVMGGIGYRDVLII

SEQ ID NO: 1274117 - protein, 20 aa, Mycobacterium
NPGDRWCVTAANWLRAHRDG

SEQ ID NO: 1274118 - protein, 23 aa, Mycobacterium
NPGLRERELIKLATLADTLAEAL

SEQ ID NO: 1274119 - protein, 18 aa, Mycobacterium
NPGPACYDRGGLKPTVTD

SEQ ID NO: 1274120 - protein, 21 aa, Mycobacterium
NPHLACVDAAMSSRELAALDV

SEQ ID NO: 1274121 - protein, 17 aa, Mycobacterium
NPHSWQDFCAKGRTAHQ

SEQ ID NO: 1274122 - protein, 17 aa, Mycobacterium
NPIKLVWEKDPSLPELQ

SEQ ID NO: 1274123 - protein, 18 aa, Mycobacterium
NPILRNAELSKLICVDPD

SEQ ID NO: 1274124 - protein, 19 aa, Mycobacterium
NPITASWNAATRTLTLAGV

SEQ ID NO: 1274125 - protein, 19 aa, Mycobacterium
NPITASWNAATRTLTLSGV

SEQ ID NO: 1274126 - protein, 25 aa, Mycobacterium
NPLAGHGGRGGWIAGDGGDGGDGLS

SEQ ID NO: 1274127 - protein, 22 aa, Mycobacterium
NPMLAQRVGVWVPLDEVPDVWE

SEQ ID NO: 1274128 - protein, 17 aa, Mycobacterium
NPMLGFRGASRYAHPAY

SEQ ID NO: 1274129 - protein, 19 aa, Mycobacterium
NPMYWPARRQETLLTTAVY

SEQ ID NO: 1274130 - protein, 25 aa, Mycobacterium
NPNDPNLLVGRYIPNLVPRPFTLDR

SEQ ID NO: 1274131 - protein, 19 aa, Mycobacterium
NPNMWRALADYNRIDDPMR

SEQ ID NO: 1274132 - protein, 20 aa, Mycobacterium
NPPFYRWFPDAELNTCANTL

SEQ ID NO: 1274133 - protein, 19 aa, Mycobacterium
NPPWPHTFNLCVSNVPGPR

SEQ ID NO: 1274134 - protein, 18 aa, Mycobacterium
NPPWVMAPMIATAEEAKS

SEQ ID NO: 1274135 - protein, 24 aa, Mycobacterium
NPRITALMCTADVLALSAMDHLRA

SEQ ID NO: 1274136 - protein, 19 aa, Mycobacterium
NPRLLPWRRALANVTFALA

SEQ ID NO: 1274137 - protein, 25 aa, Mycobacterium
NPRLREFALREGLADAAHRFAHSPT

SEQ ID NO: 1274138 - protein, 20 aa, Mycobacterium
NPRPKFVERIRLHQLAAAGR

SEQ ID NO: 1274139 - protein, 25 aa, Mycobacterium
NPRQAELFAAWAVYLLVGYEQASLP

SEQ ID NO: 1274140 - protein, 24 aa, Mycobacterium
NPRTRSGIMTLELLDTTPDWDTFR

SEQ ID NO: 1274141 - protein, 19 aa, Mycobacterium
NPRVHLFFGAKYPCELYDL

SEQ ID NO: 1274142 - protein, 17 aa, Mycobacterium
NPRVRFAHRHRVDELIV

SEQ ID NO: 1274143 - protein, 18 aa, Mycobacterium
NPSAWLTTVVTRVCLDQL

SEQ ID NO: 1274144 - protein, 21 aa, Mycobacterium
NPTFTGRQWPLADVRLLAPIL

SEQ ID NO: 1274145 - protein, 33 aa, Mycobacterium
NPTIKRVAEQLGRTPAQVALAWTLNVAPNVLLI

SEQ ID NO: 1274146 - protein, 36 aa, Mycobacterium
NPTTPLRAPMEWNLLGWMRRTFFNRPPTIDYDAGLN

SEQ ID NO: 1274147 - protein, 18 aa, Mycobacterium
NPVCTAAALAVLKVLADD

SEQ ID NO: 1274148 - protein, 18 aa, Mycobacterium
NPVCTAAALAVLKVLADE

SEQ ID NO: 1274149 - protein, 20 aa, Mycobacterium
NPVEAGLLFACKLKTDIAFL

SEQ ID NO: 1274150 - protein, 18 aa, Mycobacterium
NPVITRAATELGHTPAQI

SEQ ID NO: 1274151 - protein, 24 aa, Mycobacterium
NPVLECLRAGVPATALYVALGADS

SEQ ID NO: 1274152 - protein, 36 aa, Mycobacterium
NPVSALVSFEVFVRPALRAAMGLPHTERPRRTAMLT

SEQ ID NO: 1274153 - protein, 19 aa, Mycobacterium
NPVVPGHFDSAMTVRDSLV

SEQ ID NO: 1274154 - protein, 26 aa, Mycobacterium
NPYLRVRPTVSWSWNLSGEPLNHHKM

SEQ ID NO: 1274155 - protein, 24 aa, Mycobacterium
NQAALFNGIHVWSGGASEKAGAQV

SEQ ID NO: 1274156 - protein, 17 aa, Mycobacterium
NQFSVNLAMLYGCPLPK

SEQ ID NO: 1274157 - protein, 22 aa, Mycobacterium
NQFTVWLAIRLDMLTEVHAAVD

SEQ ID NO: 1274158 - protein, 27 aa, Mycobacterium
NQGARFLTDYHRWFLTSGIGPAIEQAR

SEQ ID NO: 1274159 - protein, 24 aa, Mycobacterium
NQGFLRCVAALARAAEAIGELPEY

SEQ ID NO: 1274160 - protein, 24 aa, Mycobacterium
NQMLRDLWEALDIADRDPHVRAVV

SEQ ID NO: 1274161 - protein, 17 aa, Mycobacterium
NQRELLRLWADYLDMPP

SEQ ID NO: 1274162 - protein, 25 aa, Mycobacterium
NQRRGRRWSMADAFLHPVTHRPNLT

SEQ ID NO: 1274163 - protein, 19 aa, Mycobacterium
NQVSLEIMPAWGGAERLAG

SEQ ID NO: 1274164 - protein, 24 aa, Mycobacterium
NQVWPRMAAKYGVENPVPPWKTSL

SEQ ID NO: 1274165 - protein, 21 aa, Mycobacterium
NRAYTPWYLVRYWRLLKFKLA

SEQ ID NO: 1274166 - protein, 19 aa, Mycobacterium
NRDAQGWVLSGTDRFVLDG

SEQ ID NO: 1274167 - protein, 19 aa, Mycobacterium
NRDELILAALEAWTDTHRY

SEQ ID NO: 1274168 - protein, 18 aa, Mycobacterium
NRDPRRFEDPDAFDPERK

SEQ ID NO: 1274169 - protein, 22 aa, Mycobacterium
NREALFYHPFHIHAVQFQILDR

SEQ ID NO: 1274170 - protein, 18 aa, Mycobacterium
NRFHTTALCSPTRQALLT

SEQ ID NO: 1274171 - protein, 21 aa, Mycobacterium
NRGACSASVLADALDDHLYAL

SEQ ID NO: 1274172 - protein, 17 aa, Mycobacterium
NRGKRSIGLDMSVPEGR

SEQ ID NO: 1274173 - protein, 28 aa, Mycobacterium
NRGVLEMVNRLKVAVGDRVEVVGGNVAT

SEQ ID NO: 1274174 - protein, 24 aa, Mycobacterium
NRGWERPYIAAGIFLYDQLGGAKS

SEQ ID NO: 1274175 - protein, 19 aa, Mycobacterium
NRHAWSASARRLHACGYTV

SEQ ID NO: 1274176 - protein, 17 aa, Mycobacterium
NRHGLYPHVRWRTEAVG

SEQ ID NO: 1274177 - protein, 20 aa, Mycobacterium
NRIRYHGGDFIELIVGGKTY

SEQ ID NO: 1274178 - protein, 17 aa, Mycobacterium
NRKLLMHRREIDNLVGK

SEQ ID NO: 1274179 - protein, 17 aa, Mycobacterium
NRLAHLFRDAGLVEGDA

SEQ ID NO: 1274180 - protein, 20 aa, Mycobacterium
NRLARAFASLGVGVGDYVTI

SEQ ID NO: 1274181 - protein, 24 aa, Mycobacterium
NRLDEFRNLVGYLRPDLILDANEF

SEQ ID NO: 1274182 - protein, 17 aa, Mycobacterium
NRLHAQKALLAWLLERA

SEQ ID NO: 1274183 - protein, 24 aa, Mycobacterium
NRLQRGKPFAAFCEEFVTPEPPKD

SEQ ID NO: 1274184 - protein, 20 aa, Mycobacterium
NRLRGHTRLHTPTTSEPLFV

SEQ ID NO: 1274185 - protein, 17 aa, Mycobacterium
NRLRNCVPYGQTCSIGY

SEQ ID NO: 1274186 - protein, 20 aa, Mycobacterium
NRLRQPSWRGLRTDKTPDEV

SEQ ID NO: 1274187 - protein, 22 aa, Mycobacterium
NRLRWKPYLRAGSREDAEHIRD

SEQ ID NO: 1274188 - protein, 17 aa, Mycobacterium
NRLTAIVAQQSAVLKNV

SEQ ID NO: 1274189 - protein, 18 aa, Mycobacterium
NRLVGILHGCLRHHSPYD

SEQ ID NO: 1274190 - protein, 23 aa, Mycobacterium
NRLVGILHGCLRHHSPYDEHKAW

SEQ ID NO: 1274191 - protein, 24 aa, Mycobacterium
NRMICDPYPRFLVARDTVNQGAAA

SEQ ID NO: 1274192 - protein, 21 aa, Mycobacterium
NRPAARNALSRDLIRASYAAL

SEQ ID NO: 1274193 - protein, 21 aa, Mycobacterium
NRPEALNALSPHMINELRAAY

SEQ ID NO: 1274194 - protein, 22 aa, Mycobacterium
NRPEARNAFNLAVAQGLADAMD

SEQ ID NO: 1274195 - protein, 23 aa, Mycobacterium
NRPEARNALSRDLIRALYASLSE

SEQ ID NO: 1274196 - protein, 27 aa, Mycobacterium
NRPEFVVALRAIWRLGASAVLLSPAWK

SEQ ID NO: 1274197 - protein, 19 aa, Mycobacterium
NRPEVLMIIGAGQTQGYRR

SEQ ID NO: 1274198 - protein, 20 aa, Mycobacterium
NRPRCPVNDMLRDGMHQTAI

SEQ ID NO: 1274199 - protein, 21 aa, Mycobacterium
NRPSDSWRTILAIITGDCPTV

SEQ ID NO: 1274200 - protein, 17 aa, Mycobacterium
NRRCKTVSLTEAGRDTL

SEQ ID NO: 1274201 - protein, 23 aa, Mycobacterium
NRRGELDMSVVMVIANHPDLADA

SEQ ID NO: 1274202 - protein, 19 aa, Mycobacterium
NRRGFLFWPTSCRITEVIP

SEQ ID NO: 1274203 - protein, 17 aa, Mycobacterium
NRRRFTVQLLKATEALS

SEQ ID NO: 1274204 - protein, 17 aa, Mycobacterium
NRRRLSAAVGLGDNIVW

SEQ ID NO: 1274205 - protein, 18 aa, Mycobacterium
NRRVAAADVAVELRGAGN

SEQ ID NO: 1274206 - protein, 21 aa, Mycobacterium
NRRVLGWSGGIPEPGQAADIV

SEQ ID NO: 1274207 - protein, 24 aa, Mycobacterium
NRRWLEHRRILALNLTSSPGSGKT

SEQ ID NO: 1274208 - protein, 25 aa, Mycobacterium
NRSDIALRFLVTMLCAPGQPMLVLV

SEQ ID NO: 1274209 - protein, 17 aa, Mycobacterium
NRSLDCVDDELATSAHF

SEQ ID NO: 1274210 - protein, 23 aa, Mycobacterium
NRSPCLVLAVLLVVGLSPQQAVE

SEQ ID NO: 1274211 - protein, 21 aa, Mycobacterium
NRSPDVFKPYVVGFVELPEGV

SEQ ID NO: 1274212 - protein, 19 aa, Mycobacterium
NRSWYRAFNAYKMAVICLI

SEQ ID NO: 1274213 - protein, 17 aa, Mycobacterium
NRTGTALGRSVQLDGTY

SEQ ID NO: 1274214 - protein, 24 aa, Mycobacterium
NRVPRWWSVRELISAFLHLRDSVV

SEQ ID NO: 1274215 - protein, 18 aa, Mycobacterium
NRVRCVRDSGVALLPGVK

SEQ ID NO: 1274216 - protein, 18 aa, Mycobacterium
NRVTACYFGEGAVAEGAF

SEQ ID NO: 1274217 - protein, 19 aa, Mycobacterium
NRWQELRADMDVNVESRAD

SEQ ID NO: 1274218 - protein, 25 aa, Mycobacterium
NRYDYTVLAARGWALRPLSVSATAE

SEQ ID NO: 1274219 - protein, 18 aa, Mycobacterium
NRYLKVVFLPNFNVKNAH

SEQ ID NO: 1274220 - protein, 19 aa, Mycobacterium
NRYPVGLPPNVPDWRTLGA

SEQ ID NO: 1274221 - protein, 18 aa, Mycobacterium
NSAIANCRIQVAGKAFER

SEQ ID NO: 1274222 - protein, 24 aa, Mycobacterium
NSARSQLAAAIWNRRSELPAASAG

SEQ ID NO: 1274223 - protein, 19 aa, Mycobacterium
NSDENWFVTDWMDTRRAQE

SEQ ID NO: 1274224 - protein, 17 aa, Mycobacterium
NSDGLYLLQRVRDEAHR

SEQ ID NO: 1274225 - protein, 17 aa, Mycobacterium
NSDYGTVFGEFVAEHSS

SEQ ID NO: 1274226 - protein, 17 aa, Mycobacterium
NSFAEFDSRVEIAFAYE

SEQ ID NO: 1274227 - protein, 29 aa, Mycobacterium
NSFSKYYAMTGWRLGWLLVPQELRRAVDR

SEQ ID NO: 1274228 - protein, 25 aa, Mycobacterium
NSGGRPEWLWTAAGIPFNRATSLKV

SEQ ID NO: 1274229 - protein, 28 aa, Mycobacterium
NSIARYKLPKAVVFRAAIQRSPAGKADY

SEQ ID NO: 1274230 - protein, 17 aa, Mycobacterium
NSKGVWNRTDYRPLEGF

SEQ ID NO: 1274231 - protein, 19 aa, Mycobacterium
NSLGGWVAFELERRGRVRS

SEQ ID NO: 1274232 - protein, 28 aa, Mycobacterium
NSLSDLLVFGRRAGLGASDYVRSLPDRP

SEQ ID NO: 1274233 - protein, 17 aa, Mycobacterium
NSLVDAIFPRQAVSSVW

SEQ ID NO: 1274234 - protein, 20 aa, Mycobacterium
NSLVNRWLINGAVYTMKTRP

SEQ ID NO: 1274235 - protein, 23 aa, Mycobacterium
NSMNCLTEALGLALPGNGSVLAT

SEQ ID NO: 1274236 - protein, 25 aa, Mycobacterium
NSMPGRSGLDIDVMTALADALGENA

SEQ ID NO: 1274237 - protein, 25 aa, Mycobacterium
NSPEGYRLEVDWATQMSYSGIYVHS

SEQ ID NO: 1274238 - protein, 25 aa, Mycobacterium
NSPNGYRTEVDWATQMSYSGIYVHS

SEQ ID NO: 1274239 - protein, 21 aa, Mycobacterium
NSPRLRLVGVAGYEAALSQTL

SEQ ID NO: 1274240 - protein, 21 aa, Mycobacterium
NSPWLPDLVGKAFCASFAATR

SEQ ID NO: 1274241 - protein, 23 aa, Mycobacterium
NSRSAPLARTWPLLIRGLVALRR

SEQ ID NO: 1274242 - protein, 17 aa, Mycobacterium
NSRVRVGDVNVGTVTKI

SEQ ID NO: 1274243 - protein, 23 aa, Mycobacterium
NSTARGAFNLGYAPTVVAAATAT

SEQ ID NO: 1274244 - protein, 24 aa, Mycobacterium
NSTRTRFSFEMGIAELGGHAVVVD

SEQ ID NO: 1274245 - protein, 19 aa, Mycobacterium
NSVLCTNESVLIVEDSVAD

SEQ ID NO: 1274246 - protein, 17 aa, Mycobacterium
NSVPAVCAAPPGIATYL

SEQ ID NO: 1274247 - protein, 17 aa, Mycobacterium
NSVRFAVAFFGLLRAGA

SEQ ID NO: 1274248 - protein, 32 aa, Mycobacterium; identical to SEQ ID NO: 619644

SEQ ID NO: 1274249 - protein, 24 aa, Mycobacterium
NSYEIYRLDAVPGTEKLPYSLKVL

SEQ ID NO: 1274250 - protein, 17 aa, Mycobacterium
NSYKRLTPKLADGTVSW

SEQ ID NO: 1274251 - protein, 24 aa, Mycobacterium
NSYPLPEATGWPVGVSLGHDGSVV

SEQ ID NO: 1274252 - protein, 17 aa, Mycobacterium
NTAGGSMARRLRLNSRM

SEQ ID NO: 1274253 - protein, 26 aa, Mycobacterium
NTCAAALPHLVDRGGSLVNISSAAGI

SEQ ID NO: 1274254 - protein, 19 aa, Mycobacterium
NTDGIPWDMRVAANRLNIA

SEQ ID NO: 1274255 - protein, 25 aa, Mycobacterium
NTDGRWDPGKDFAMVSARETGPTQK

SEQ ID NO: 1274256 - protein, 20 aa, Mycobacterium
NTFDEMPMRIDIKNRTSEHT

SEQ ID NO: 1274257 - protein, 30 aa, Mycobacterium
NTGFAGVGREMWMRCLDINLVGAYNTIDAL

SEQ ID NO: 1274258 - protein, 24 aa, Mycobacterium
NTHVPEFLDRVGVGAPEVEQDIIN

SEQ ID NO: 1274259 - protein, 24 aa, Mycobacterium
NTHVRRLLVEAAWHHKPRYRVGTV

SEQ ID NO: 1274260 - protein, 25 aa, Mycobacterium
NTHVRRLLVEAAWHHKPRYRVGTVM

SEQ ID NO: 1274261 - protein, 19 aa, Mycobacterium
NTKELFGPTADRRVWENQR

SEQ ID NO: 1274262 - protein, 19 aa, Mycobacterium
NTLCAASVIGMRFDTDLLA

SEQ ID NO: 1274263 - protein, 28 aa, Mycobacterium
NTLKAFGFDIGYRIAHHADLTTPPPVEV

SEQ ID NO: 1274264 - protein, 21 aa, Mycobacterium
NTMDTWKRLCDPVAQQISTVW

SEQ ID NO: 1274265 - protein, 26 aa, Mycobacterium
NTPVVWRGPMLHRALQQFLADVYWGD

SEQ ID NO: 1274266 - protein, 25 aa, Mycobacterium
NTPWGCISCAYGWQAAVGTLTQLRS

SEQ ID NO: 1274267 - protein, 19 aa, Mycobacterium
NTQLLWYRADLIPQPPTTW

SEQ ID NO: 1274268 - protein, 25 aa, Mycobacterium
NTQVCPVCLGLPGSLPVLNQSAVEA

SEQ ID NO: 1274269 - protein, 24 aa, Mycobacterium
NTSDPSADRYLVFSDGTRVPTDGS

SEQ ID NO: 1274270 - protein, 18 aa, Mycobacterium
NTTLRGSGWVALTTDGPP

SEQ ID NO: 1274271 - protein, 22 aa, Mycobacterium
NTTRLHSSLGYQSPVDYENRYR

SEQ ID NO: 1274272 - protein, 22 aa, Mycobacterium
NTVRYRLKRIADFTGRDPTVPR

SEQ ID NO: 1274273 - protein, 28 aa, Mycobacterium
NTVSPPTKWHLIVPFLNVLPGGMFAGAA

SEQ ID NO: 1274274 - protein, 34 aa, Mycobacterium
NTVVWKPASTVPLLALRFAEALTDAGLPPGVLNL

SEQ ID NO: 1274275 - protein, 23 aa, Mycobacterium
NTVWTEGNITYVFVPTRNLPLLT

SEQ ID NO: 1274276 - protein, 28 aa, Mycobacterium
NVALAAEICDGWLPIFYTPRMADTYNSW

SEQ ID NO: 1274277 - protein, 24 aa, Mycobacterium
NVAVPRLRESILATVRERAVDAPE

SEQ ID NO: 1274278 - protein, 18 aa, Mycobacterium
NVDAVIRTLLARGLITEA

SEQ ID NO: 1274279 - protein, 24 aa, Mycobacterium
NVDDRLRQLISWTGDHLAEVEVTD

SEQ ID NO: 1274280 - protein, 18 aa, Mycobacterium
NVDKGWLGLNAKEVIGGA

SEQ ID NO: 1274281 - protein, 22 aa, Mycobacterium
NVDLRGVAVMGAFDHSVPGQGS

SEQ ID NO: 1274282 - protein, 17 aa, Mycobacterium
NVHAFRVAVDTETGEVR

SEQ ID NO: 1274283 - protein, 24 aa, Mycobacterium
NVIAGRVSFTLGLEGPAVAVDTAC

SEQ ID NO: 1274284 - protein, 19 aa, Mycobacterium
NVIDVLRGKLEFESGEEGR

SEQ ID NO: 1274285 - protein, 17 aa, Mycobacterium
NVIEMWDAVARFLARHL

SEQ ID NO: 1274286 - protein, 24 aa, Mycobacterium
NVIHPRFGNFILLGTVLVASEISS

SEQ ID NO: 1274287 - protein, 22 aa, Mycobacterium
NVIIMLPFVRRVAEADLVLQTM

SEQ ID NO: 1274288 - protein, 26 aa, Mycobacterium
NVIPAHAALRYSMRAAESVSLRELED

SEQ ID NO: 1274289 - protein, 18 aa, Mycobacterium
NVKPGRVLFELSYPDEKI

SEQ ID NO: 1274290 - protein, 20 aa, Mycobacterium
NVKQVVPFLKVDKGLADEKD

SEQ ID NO: 1274291 - protein, 23 aa, Mycobacterium
NVLAFSAGLDWNIERVRGGSIAT

SEQ ID NO: 1274292 - protein, 24 aa, Mycobacterium
NVLSARAGQIGTLVVHPLLMTIFD

SEQ ID NO: 1274293 - protein, 26 aa, Mycobacterium
NVMAAVRLPRGLWREAHRQNLALWVC

SEQ ID NO: 1274294 - protein, 25 aa, Mycobacterium
NVNMLGCYYCNLYAAQCMERNDGDS

SEQ ID NO: 1274295 - protein, 24 aa, Mycobacterium
NVPPRPEDLAGWAGDVFDHHQRFP

SEQ ID NO: 1274296 - protein, 17 aa, Mycobacterium
NVRAARSGWLIREVNSF

SEQ ID NO: 1274297 - protein, 19 aa, Mycobacterium
NVREALRIYGPGMTTEQEL

SEQ ID NO: 1274298 - protein, 19 aa, Mycobacterium
NVSHGCINLSPANAQWFFD

SEQ ID NO: 1274299 - protein, 25 aa, Mycobacterium
NVSLKIEKGEFVFLIGPSGSGKSTF

SEQ ID NO: 1274300 - protein, 19 aa, Mycobacterium
NVSPGALYWHFANKQQLLG

SEQ ID NO: 1274301 - protein, 26 aa, Mycobacterium
NVVCARSGVRWTLLAGTHVRRLLRIC

SEQ ID NO: 1274302 - protein, 18 aa, Mycobacterium
NVVGTLLFGGMWNAPIPD

SEQ ID NO: 1274303 - protein, 18 aa, Mycobacterium
NVVRPGRDISIVTLSLSV

SEQ ID NO: 1274304 - protein, 32 aa, Mycobacterium
NVVRTPLLAARWGDRERPLWIKPENLQPIGAF

SEQ ID NO: 1274305 - protein, 22 aa, Mycobacterium
NVWSLHGYHECLTRLGRGPEAL

SEQ ID NO: 1274306 - protein, 23 aa, Mycobacterium
NWDTWCTRVEAALNERTGQSQPE

SEQ ID NO: 1274307 - protein, 18 aa, Mycobacterium
NWFGNGLRGRRYGWINDA

SEQ ID NO: 1274308 - protein, 22 aa, Mycobacterium
NWGSSGRWTTNYSAIAYSTDNG

SEQ ID NO: 1274309 - protein, 24 aa, Mycobacterium
NWMPCPNGTFATGYQKFLLWGVDP

SEQ ID NO: 1274310 - protein, 18 aa, Mycobacterium
NWMRAREALIKTDIFGGQ

SEQ ID NO: 1274311 - protein, 22 aa, Mycobacterium
NWQPTACILCECNCGIVVEVEG

SEQ ID NO: 1274312 - protein, 18 aa, Mycobacterium
NWQVCSSTPAPGEPLTVG

SEQ ID NO: 1274313 - protein, 21 aa, Mycobacterium
NWRDFPLVESFFVRTFGTGVR

SEQ ID NO: 1274314 - protein, 30 aa, Mycobacterium
NWRGKAVLVKLIWRMVRARVFGDRMAAIGQ

SEQ ID NO: 1274315 - protein, 22 aa, Mycobacterium
NWRNKLLVCKTVGGGDDPVIPE

SEQ ID NO: 1274316 - protein, 24 aa, Mycobacterium
NYAGAALARKACDEFSTPDKPRYV

SEQ ID NO: 1274317 - protein, 17 aa, Mycobacterium
NYAKEAPGWTVTTSDDG

SEQ ID NO: 1274318 - protein, 20 aa, Mycobacterium
NYAKEAPGWTVTTSDDGGEH

SEQ ID NO: 1274319 - protein, 25 aa, Mycobacterium
NYAQRMEAAWGREYRRGRYMHKLIG

SEQ ID NO: 1274320 - protein, 20 aa, Mycobacterium
NYDARFVIVTSGPIEEALAY

SEQ ID NO: 1274321 - protein, 25 aa, Mycobacterium
NYDLGARAPITFDTLFRPGTRPLDV

SEQ ID NO: 1274322 - protein, 22 aa, Mycobacterium
NYDREGLDFAGLTAEVVEATLE

SEQ ID NO: 1274323 - protein, 19 aa, Mycobacterium
NYEREFGLLGPRFVDALGQ

SEQ ID NO: 1274324 - protein, 25 aa, Mycobacterium
NYFLPRILTGEVFFCQGYSEPEAGS

SEQ ID NO: 1274325 - protein, 21 aa, Mycobacterium
NYLNNWKRLGFGDQDVAKPGS

SEQ ID NO: 1274326 - protein, 22 aa, Mycobacterium
NYLNNWKRLGFTDEDLTRPGSD

SEQ ID NO: 1274327 - protein, 19 aa, Mycobacterium
NYLPSAREKLGIDVDDVRR

SEQ ID NO: 1274328 - protein, 22 aa, Mycobacterium
NYRLTLRNGVLVYRAAAADEAS

SEQ ID NO: 1274329 - protein, 17 aa, Mycobacterium
NYRRDALAETPIRSIMA

SEQ ID NO: 1274330 - protein, 27 aa, Mycobacterium
NYRSIWMFLKDLEFRQGFVDITVNGAT

SEQ ID NO: 1274331 - protein, 20 aa, Mycobacterium
NYTQRPAIVFVTAHDDKAVA

SEQ ID NO: 1274332 - protein, 25 aa, Mycobacterium
PAAAAHPSLPRGAMMQVADEERPAL

SEQ ID NO: 1274333 - protein, 24 aa, Mycobacterium
PAAADVGEGLWITWGDGEITVGLG

SEQ ID NO: 1274334 - protein, 17 aa, Mycobacterium
PAAAEAILARFSPDDLD

SEQ ID NO: 1274335 - protein, 28 aa, Mycobacterium
PAAALTARLAFDWAQLKPGDRVLIHAAS

SEQ ID NO: 1274336 - protein, 17 aa, Mycobacterium
PAAAPSWLDGIDRPVVL

SEQ ID NO: 1274337 - protein, 18 aa, Mycobacterium
PAAAVAWLANALAPFGVA

SEQ ID NO: 1274338 - protein, 22 aa, Mycobacterium
PAACGHRGCRLKPGEVQAQLVA

SEQ ID NO: 1274339 - protein, 23 aa, Mycobacterium
PAAEAALALADRIDRLARDVGVP

SEQ ID NO: 1274340 - protein, 21 aa, Mycobacterium
PAAGAGWGLAMACDIRVAAAS

SEQ ID NO: 1274341 - protein, 28 aa, Mycobacterium
PAAGSFTWLDDRVVEWTPAQPLPAHTAI

SEQ ID NO: 1274342 - protein, 18 aa, Mycobacterium
PAAGYKFADAAARATKKW

SEQ ID NO: 1274343 - protein, 18 aa, Mycobacterium
PAAHHALATADTEFLRLT

SEQ ID NO: 1274344 - protein, 18 aa, Mycobacterium
PAAHLARPVEWTRSNRHT

SEQ ID NO: 1274345 - protein, 23 aa, Mycobacterium
PAALREARRGMALAAGLKLPLVL

SEQ ID NO: 1274346 - protein, 18 aa, Mycobacterium
PAAMLRCLIEGADEVHVD

SEQ ID NO: 1274347 - protein, 20 aa, Mycobacterium
PAAMRYCLTGDSMVRLPFGQ

SEQ ID NO: 1274348 - protein, 19 aa, Mycobacterium
PAARFCASGGITAADLTGY

SEQ ID NO: 1274349 - protein, 21 aa, Mycobacterium
PAARTLPLYGVPFGVKDSIDV

SEQ ID NO: 1274350 - protein, 26 aa, Mycobacterium
PAAVEWGAGDTMVWLRHFNAAAAARG

SEQ ID NO: 1274351 - protein, 18 aa, Mycobacterium
PAAVRMRPFSTKIAAVVG

SEQ ID NO: 1274352 - protein, 18 aa, Mycobacterium
PAAVTWLPQPEHWAEHSV

SEQ ID NO: 1274353 - protein, 21 aa, Mycobacterium
PAAWAGTLWLKPENLQAIGAF

SEQ ID NO: 1274354 - protein, 18 aa, Mycobacterium
PADAALRPLMSHYTALRR

SEQ ID NO: 1274355 - protein, 31 aa, Mycobacterium
PADDATRWYAEFARLAALMTRDVHYEVDTRR

SEQ ID NO: 1274356 - protein, 22 aa, Mycobacterium
PADDKGAGIAVFLVPADTPGVE

SEQ ID NO: 1274357 - protein, 18 aa, Mycobacterium
PADGEWPAMAPRIQALTV

SEQ ID NO: 1274358 - protein, 25 aa, Mycobacterium
PADGRPDGVIDFGDLSHTWAVSELA

SEQ ID NO: 1274359 - protein, 18 aa, Mycobacterium
PADLTADWLTTVLGAGTV

SEQ ID NO: 1274360 - protein, 25 aa, Mycobacterium
PADRHPHCAWTVIIDESYPEVDFVP

SEQ ID NO: 1274361 - protein, 17 aa, Mycobacterium
PADRPDTLLGWLQSDLG

SEQ ID NO: 1274362 - protein, 23 aa, Mycobacterium
PADRPTLLIAEGISMYLTEDEGI

SEQ ID NO: 1274363 - protein, 22 aa, Mycobacterium
PADVDARWTFGAATPREAVAAY

SEQ ID NO: 1274364 - protein, 25 aa, Mycobacterium
PADVPARRGRIWLRVTGHGTAGDRA

SEQ ID NO: 1274365 - protein, 25 aa, Mycobacterium
PADVTPEWLGAALTRDGSPVEVRAI

SEQ ID NO: 1274366 - protein, 25 aa, Mycobacterium
PADVTPEWLGAALTRDGSPVEVRAV

SEQ ID NO: 1274367 - protein, 17 aa, Mycobacterium
PADVVSEVYTEGAAAAL

SEQ ID NO: 1274368 - protein, 25 aa, Mycobacterium
PADWYETMEALLLGAFISEGFVSES

SEQ ID NO: 1274369 - protein, 26 aa, Mycobacterium
PAEARLPRTWIALLRGRVDASLAATT

SEQ ID NO: 1274370 - protein, 20 aa, Mycobacterium
PAEDSARWFVLNWIREQVER

SEQ ID NO: 1274371 - protein, 23 aa, Mycobacterium
PAEGVGLFRTELCFLNSDTEPAV

SEQ ID NO: 1274372 - protein, 20 aa, Mycobacterium
PAEIAEPFDGPWASAVRGIA

SEQ ID NO: 1274373 - protein, 24 aa, Mycobacterium
PAEIREFLEGYVIGQDTAKRTLAV

SEQ ID NO: 1274374 - protein, 22 aa, Mycobacterium
PAELKIARSRRLVRVEYRSAQG

SEQ ID NO: 1274375 - protein, 24 aa, Mycobacterium
PAEPALLEECGRWTMTAGPTTGAV

SEQ ID NO: 1274376 - protein, 24 aa, Mycobacterium
PAERELAVRFGVARETVRQALHEL

SEQ ID NO: 1274377 - protein, 23 aa, Mycobacterium
PAERIAAEFAHRFATDHIGLRED

SEQ ID NO: 1274378 - protein, 19 aa, Mycobacterium
PAEVPARMEALGAVGGLSR

SEQ ID NO: 1274379 - protein, 20 aa, Mycobacterium
PAEWELLLRLAGAMFGTQVP

SEQ ID NO: 1274380 - protein, 24 aa, Mycobacterium
PAFAPAMLRARFHLWESGSTAQMV

SEQ ID NO: 1274381 - protein, 24 aa, Mycobacterium
PAFLLNEMLVWGFTGQVISAILDV

SEQ ID NO: 1274382 - protein, 18 aa, Mycobacterium
PAFPNFLSLAGPYATSGL

SEQ ID NO: 1274383 - protein, 18 aa, Mycobacterium
PAFRLAWSQRAARLTRRW

SEQ ID NO: 1274384 - protein, 20 aa, Mycobacterium
PAFRRLLGDGAHFGVNLTYA

SEQ ID NO: 1274385 - protein, 18 aa, Mycobacterium
PAGAGVRVDSGLTRGTAV

SEQ ID NO: 1274386 - protein, 20 aa, Mycobacterium
PAGAIPARLYRPTSTDPDGP

SEQ ID NO: 1274387 - protein, 18 aa, Mycobacterium
PAGCRFHTRCPWASEVCA

SEQ ID NO: 1274388 - protein, 25 aa, Mycobacterium
PAGEPVWRPYGADDRATLVIDKQDT

SEQ ID NO: 1274389 - protein, 18 aa, Mycobacterium
PAGERCEMCAEPIADEHQ

SEQ ID NO: 1274390 - protein, 23 aa, Mycobacterium
PAGERPLGGLLVMDEAQNFAPAR

SEQ ID NO: 1274391 - protein, 23 aa, Mycobacterium
PAGPLPSFIPGGAAGGPLGTGFP

SEQ ID NO: 1274392 - protein, 19 aa, Mycobacterium
PAGPPHHFFMDRFTEAFRA

SEQ ID NO: 1274393 - protein, 18 aa, Mycobacterium
PAGPWGRGRPVEAADAFE

SEQ ID NO: 1274394 - protein, 29 aa, Mycobacterium
PAGRFGLAAGKPVMGWLFQRFLHNLRRYT

SEQ ID NO: 1274395 - protein, 27 aa, Mycobacterium
PAGRPRRAGISSFGFGGTNAHVVIEQA

SEQ ID NO: 1274396 - protein, 23 aa, Mycobacterium
PAGRPVWVGDFWDMFGPGHLLEL

SEQ ID NO: 1274397 - protein, 20 aa, Mycobacterium
PAGTALWFDCNIMHGSGSNI

SEQ ID NO: 1274398 - protein, 19 aa, Mycobacterium
PAGVLARGRIERVAPPGQG

SEQ ID NO: 1274399 - protein, 20 aa, Mycobacterium
PAGVLARGRIERVAPPGQGL

SEQ ID NO: 1274400 - protein, 23 aa, Mycobacterium
PAGVMRWPFKLLAPVVKSGFGRM

SEQ ID NO: 1274401 - protein, 30 aa, Mycobacterium
PAGVNCIRSFPGRGIRVWGARTLSSDPAWR

SEQ ID NO: 1274402 - protein, 21 aa, Mycobacterium
PAGVRRQLAAAGHRVVDQPAL

SEQ ID NO: 1274403 - protein, 25 aa, Mycobacterium
PAHAEAITRYGLRITGRRGDLVITD

SEQ ID NO: 1274404 - protein, 19 aa, Mycobacterium
PAHPRVLEALHHVNQGPAP

SEQ ID NO: 1274405 - protein, 17 aa, Mycobacterium
PAHTAANFEGLVIRVDE

SEQ ID NO: 1274406 - protein, 21 aa, Mycobacterium
PAIKGMWCVPVYSNPTGTTYA

SEQ ID NO: 1274407 - protein, 27 aa, Mycobacterium
PAILIPALVGHGGWERLQRFAVITQFT

SEQ ID NO: 1274408 - protein, 17 aa, Mycobacterium
PAIPDRTDVVWLDHIED

SEQ ID NO: 1274409 - protein, 18 aa, Mycobacterium
PAIRTARMAGVPATTHGG

SEQ ID NO: 1274410 - protein, 19 aa, Mycobacterium
PAKLRLMLRMAEATDVDGR

SEQ ID NO: 1274411 - protein, 19 aa, Mycobacterium
PAKMKLAVTGCPRNCAEAL

SEQ ID NO: 1274412 - protein, 24 aa, Mycobacterium
PAKPSLYLHRNFCQVFRNAHHSWG

SEQ ID NO: 1274413 - protein, 20 aa, Mycobacterium
PAKVKEGYANFAVAEPPLKL

SEQ ID NO: 1274414 - protein, 20 aa, Mycobacterium
PALAWRVCDGDEQMNELHRQ

SEQ ID NO: 1274415 - protein, 22 aa, Mycobacterium
PALDLLAGWLASRIDGAVTRAV

SEQ ID NO: 1274416 - protein, 19 aa, Mycobacterium
PALEAVRQFGRVVVFDQRC

SEQ ID NO: 1274417 - protein, 18 aa, Mycobacterium
PALLAAIERAACEESRAG

SEQ ID NO: 1274418 - protein, 26 aa, Mycobacterium
PALLRKLPVAVRRFWLGRAELASVFA

SEQ ID NO: 1274419 - protein, 17 aa, Mycobacterium
PALMAMTAAGLDYVSDG

SEQ ID NO: 1274420 - protein, 17 aa, Mycobacterium
PALNWVEPFVAFEGLEY

SEQ ID NO: 1274421 - protein, 26 aa, Mycobacterium
PALQRDNCKLIDWPIATLSPAGIRTS

SEQ ID NO: 1274422 - protein, 24 aa, Mycobacterium
PALREVRTTLVPDYFGGNMDTPEL

SEQ ID NO: 1274423 - protein, 19 aa, Mycobacterium
PALRRARLLARHTAGGRGD

SEQ ID NO: 1274424 - protein, 19 aa, Mycobacterium
PALRTSRPGVFAVGNLLHP

SEQ ID NO: 1274425 - protein, 20 aa, Mycobacterium
PALVGRRVELVFSPFDLQAI

SEQ ID NO: 1274426 - protein, 25 aa, Mycobacterium
PALVRLRPSPSLGLPAALTELAVRA

SEQ ID NO: 1274427 - protein, 20 aa, Mycobacterium
PAMALIAATGFGVWTQQETA

SEQ ID NO: 1274428 - protein, 24 aa, Mycobacterium
PAMHTEMWLHPATCDNVATLRRRG

SEQ ID NO: 1274429 - protein, 17 aa, Mycobacterium
PAMSGFRAAADKAAPGL

SEQ ID NO: 1274430 - protein, 24 aa, Mycobacterium
PANKRIVFRFLRSPVEVVGDGRAE

SEQ ID NO: 1274431 - protein, 26 aa, Mycobacterium
PANNVEFFFLRPKDIAIYVGSGQLDL

SEQ ID NO: 1274432 - protein, 24 aa, Mycobacterium
PANWPRVLNVWRANLLGSSSKGNE

SEQ ID NO: 1274433 - protein, 19 aa, Mycobacterium
PAPARRTGGHPAKRTFQAL

SEQ ID NO: 1274434 - protein, 18 aa, Mycobacterium
PAPAWGTVLGEPVSGTSH

SEQ ID NO: 1274435 - protein, 21 aa, Mycobacterium
PAPCEGSCVLGINQDPVTIKQ

SEQ ID NO: 1274436 - protein, 19 aa, Mycobacterium
PAPCLREQDALERMALLGL

SEQ ID NO: 1274437 - protein, 18 aa, Mycobacterium
PAPDDPFRGLYLSDEVVD

SEQ ID NO: 1274438 - protein, 26 aa, Mycobacterium
PAPDGVKLAAGWLVERAGFGKGYPDD

SEQ ID NO: 1274439 - protein, 19 aa, Mycobacterium
PAPDTPWSGTELGRIILER

SEQ ID NO: 1274440 - protein, 19 aa, Mycobacterium
PAPEGFLSAAARLGVDPEE

SEQ ID NO: 1274441 - protein, 17 aa, Mycobacterium
PAPELPPLLPGQVLRLG

SEQ ID NO: 1274442 - protein, 22 aa, Mycobacterium
PAPFLLEQWAELSAAALEDAGL

SEQ ID NO: 1274443 - protein, 20 aa, Mycobacterium
PAPGLDAWRYDGPKRIWTCD

SEQ ID NO: 1274444 - protein, 21 aa, Mycobacterium
PAPLCTRTLLSRVERAAADRG

SEQ ID NO: 1274445 - protein, 23 aa, Mycobacterium
PAPLDEIDRILARELVADGRATL

SEQ ID NO: 1274446 - protein, 33 aa, Mycobacterium
PAPLHVLRLAAMLPWAPLVPFLHDGVISSLRAY

SEQ ID NO: 1274447 - protein, 21 aa, Mycobacterium
PAPLMRWGVAAFDPTVRSPTA

SEQ ID NO: 1274448 - protein, 20 aa, Mycobacterium
PAPLYDRIADLIAENARRSD

SEQ ID NO: 1274449 - protein, 19 aa, Mycobacterium
PAPMLEAAVALMADASRPL

SEQ ID NO: 1274450 - protein, 24 aa, Mycobacterium
PAPPHLRRSRYRQRVRNVRPSPPP

SEQ ID NO: 1274451 - protein, 24 aa, Mycobacterium
PAPPPPPPMPGFENVAADGDILDP

SEQ ID NO: 1274452 - protein, 19 aa, Mycobacterium
PAPQLFAAYAMPPLAEDQE

SEQ ID NO: 1274453 - protein, 20 aa, Mycobacterium
PAPREALRFAPDARSVAGQT

SEQ ID NO: 1274454 - protein, 21 aa, Mycobacterium
PAPRLPRLVDHIAPRTAAAAR

SEQ ID NO: 1274455 - protein, 18 aa, Mycobacterium
PAPTQALLLIRAIQDGWI

SEQ ID NO: 1274456 - protein, 17 aa, Mycobacterium
PAQDTVRPWDSLSEEEK

SEQ ID NO: 1274457 - protein, 24 aa, Mycobacterium
PAQGCTYWNGPAMESTDYKDLDEV

SEQ ID NO: 1274458 - protein, 31 aa, Mycobacterium
PAQLGALWRGRWHGGLGFTDRCVAPVSIPIG

SEQ ID NO: 1274459 - protein, 28 aa, Mycobacterium
PAQVPWFDALLAWVRRQITHTFFNKTPV

SEQ ID NO: 1274460 - protein, 17 aa, Mycobacterium
PARAADCADSEAALSDD

SEQ ID NO: 1274461 - protein, 24 aa, Mycobacterium
PARADIRLWSFLTRFAANCRRSSW

SEQ ID NO: 1274462 - protein, 23 aa, Mycobacterium
PARAVLRRRGQVWALLGVTGTVR

SEQ ID NO: 1274463 - protein, 23 aa, Mycobacterium
PARFIPMTLPVIWDPVACAAEIR

SEQ ID NO: 1274464 - protein, 24 aa, Mycobacterium
PARFPDPRVPTGIPDVVLTGHDPT

SEQ ID NO: 1274465 - protein, 24 aa, Mycobacterium
PARGASKVRFADWAPVYERNTGIP

SEQ ID NO: 1274466 - protein, 18 aa, Mycobacterium
PARGRWLRAVSRFFREHL

SEQ ID NO: 1274467 - protein, 27 aa, Mycobacterium
PARKRRMFDLLVKMGYKEIEVGFPSAS

SEQ ID NO: 1274468 - protein, 20 aa, Mycobacterium
PARLQPGSFYALPQSPQLFK

SEQ ID NO: 1274469 - protein, 20 aa, Mycobacterium
PARLSTKHALALTNRGTATT

SEQ ID NO: 1274470 - protein, 18 aa, Mycobacterium
PARQEWLPDCGHLLMLER

SEQ ID NO: 1274471 - protein, 23 aa, Mycobacterium
PARREVRTSLVPDVFGGNMDTPE

SEQ ID NO: 1274472 - protein, 18 aa, Mycobacterium
PARVLELRTSWRNPPSTL

SEQ ID NO: 1274473 - protein, 17 aa, Mycobacterium
PASARLLVTAALAQAGP

SEQ ID NO: 1274474 - protein, 24 aa, Mycobacterium
PASEALKAVAAFRLALPRTMLRFA

SEQ ID NO: 1274475 - protein, 25 aa, Mycobacterium
PASEPAMRTGFYGFGFNVGTSSAAR

SEQ ID NO: 1274476 - protein, 25 aa, Mycobacterium
PASESYDCITILAATLNLADTAMAV

SEQ ID NO: 1274477 - protein, 18 aa, Mycobacterium
PASIGALGDIARIAAGQA

SEQ ID NO: 1274478 - protein, 25 aa, Mycobacterium
PASNITRLPVRYTFDNRYFNDTYEG

SEQ ID NO: 1274479 - protein, 20 aa, Mycobacterium
PASNRFGWTAYLGHPPDTSE

SEQ ID NO: 1274480 - protein, 24 aa, Mycobacterium
PASRAAENILGYTIANDVSARDQQ

SEQ ID NO: 1274481 - protein, 23 aa, Mycobacterium
PASRVVEVLGHISLLVAGEPEFA

SEQ ID NO: 1274482 - protein, 21 aa, Mycobacterium
PASVDSFVWLALYLAQRPPIE

SEQ ID NO: 1274483 - protein, 18 aa, Mycobacterium
PASWSEALGIAGAGLAAA

SEQ ID NO: 1274484 - protein, 23 aa, Mycobacterium
PATEFRRDGVLVFDEQNRRRIST

SEQ ID NO: 1274485 - protein, 24 aa, Mycobacterium
PATEIPMGFGYPIDHPDLPAITEA

SEQ ID NO: 1274486 - protein, 21 aa, Mycobacterium
PATEPLQWWLRAVAAGGQGRY

SEQ ID NO: 1274487 - protein, 17 aa, Mycobacterium
PATGWVTLLHQWMAEAE

SEQ ID NO: 1274488 - protein, 18 aa, Mycobacterium
PATITLDPGLEWVGLEIV

SEQ ID NO: 1274489 - protein, 26 aa, Mycobacterium
PATLHRFVDRFAHFNFQDHMMRPSYG

SEQ ID NO: 1274490 - protein, 19 aa, Mycobacterium
PATPLISGLRCAKTGRCRP

SEQ ID NO: 1274491 - protein, 19 aa, Mycobacterium
PATPWTAPHAAEWDAITAG

SEQ ID NO: 1274492 - protein, 25 aa, Mycobacterium
PATQQRILDTLGWDGLADLVLAPGP

SEQ ID NO: 1274493 - protein, 28 aa, Mycobacterium
PATRWLASTVGFAWRTRLSVSASVDARV

SEQ ID NO: 1274494 - protein, 23 aa, Mycobacterium
PATTEPWSPYGIRTSLDRSAFLV

SEQ ID NO: 1274495 - protein, 17 aa, Mycobacterium
PATTHWAYADAFAKRYP

SEQ ID NO: 1274496 - protein, 27 aa, Mycobacterium
PATVDDLKWWFGATLGWARQALSDVDA

SEQ ID NO: 1274497 - protein, 17 aa, Mycobacterium
PATYFSAGKVQWILDNV

SEQ ID NO: 1274498 - protein, 20 aa, Mycobacterium
PAVALSLWAQYVLDNFATVA

SEQ ID NO: 1274499 - protein, 24 aa, Mycobacterium
PAVATCLRDARLLDAVALVDEVLL

SEQ ID NO: 1274500 - protein, 20 aa, Mycobacterium
PAVAVKQRWGRSGERGADVV

SEQ ID NO: 1274501 - protein, 27 aa, Mycobacterium
PAVCDAFLAAIARWGAPFEVLTDNGKQ

SEQ ID NO: 1274502 - protein, 19 aa, Mycobacterium
PAVDAYPPLGGRPVEKIFT

SEQ ID NO: 1274503 - protein, 20 aa, Mycobacterium
PAVDLAALWATVSAVRTRES

SEQ ID NO: 1274504 - protein, 17 aa, Mycobacterium
PAVEDCAVFGVPAADGE

SEQ ID NO: 1274505 - protein, 21 aa, Mycobacterium
PAVEELLRWLSIVHTAIPRIT

SEQ ID NO: 1274506 - protein, 32 aa, Mycobacterium
PAVERTGLVAFSLHYPWSHRLTVHSLDGTTTL

SEQ ID NO: 1274507 - protein, 22 aa, Mycobacterium
PAVHRFPGSMAKRVQALAQVIV

SEQ ID NO: 1274508 - protein, 29 aa, Mycobacterium
PAVLWFRRDLRLADLPALLAASEGDGEVL

SEQ ID NO: 1274509 - protein, 23 aa, Mycobacterium
PAVRGATVVGCPDDRLGETPVAM

SEQ ID NO: 1274510 - protein, 17 aa, Mycobacterium
PAVRRLLDAGALYVGKT

SEQ ID NO: 1274511 - protein, 18 aa, Mycobacterium
PAVRRLLDAGALYVGKTN

SEQ ID NO: 1274512 - protein, 18 aa, Mycobacterium
PAVRSRLVALQRELASAP

SEQ ID NO: 1274513 - protein, 21 aa, Mycobacterium
PAVSAWNWLETVPGGWRRALE

SEQ ID NO: 1274514 - protein, 17 aa, Mycobacterium
PAVVALRPEQLRFGTGL

SEQ ID NO: 1274515 - protein, 23 aa, Mycobacterium
PAVWTASYLPAWSSRDAAAATFE

SEQ ID NO: 1274516 - protein, 19 aa, Mycobacterium
PAWALLVARVKSWVVNAWI

SEQ ID NO: 1274517 - protein, 22 aa, Mycobacterium
PAWASDRYATMAGRAADIDTVY

SEQ ID NO: 1274518 - protein, 19 aa, Mycobacterium
PAWRLLRAGNAALVLSFLG

SEQ ID NO: 1274519 - protein, 28 aa, Mycobacterium
PAYARAFEPKLRWEAAVFEERPGIDAAP

SEQ ID NO: 1274520 - protein, 17 aa, Mycobacterium
PAYNSGGPWGYTPKGGT

SEQ ID NO: 1274521 - protein, 21 aa, Mycobacterium
PAYNSGGPWGYTPKGGTGVPT

SEQ ID NO: 1274522 - protein, 24 aa, Mycobacterium
PAYRAVLELHGWSELHTELHRLSK

SEQ ID NO: 1274523 - protein, 25 aa, Mycobacterium
PAYRSVLELHGWGDLQTELHSLSRE

SEQ ID NO: 1274524 - protein, 17 aa, Mycobacterium
PAYVAAFADQLARHADE

SEQ ID NO: 1274525 - protein, 29 aa, Mycobacterium
PCALMARYAALRPGRAIDLACGDGRNARY

SEQ ID NO: 1274526 - protein, 19 aa, Mycobacterium
PCDHRMLDNTGWRTRKNGK

SEQ ID NO: 1274527 - protein, 19 aa, Mycobacterium
PCEHLHALLSGKLDDITQR

SEQ ID NO: 1274528 - protein, 19 aa, Mycobacterium
PCELYDLRTLWEIASTNPW

SEQ ID NO: 1274529 - protein, 20 aa, Mycobacterium
PCGVAAFSGALCDGLNELGA

SEQ ID NO: 1274530 - protein, 19 aa, Mycobacterium
PCGVPPMPVVDALTAAAQA

SEQ ID NO: 1274531 - protein, 18 aa, Mycobacterium
PCHEVVKMDYFIPGCPPD

SEQ ID NO: 1274532 - protein, 22 aa, Mycobacterium
PCKLTLEMFFDATLKHTDSVVD

SEQ ID NO: 1274533 - protein, 20 aa, Mycobacterium
PDAAAHSFRGPGLRNSVMFG

SEQ ID NO: 1274534 - protein, 23 aa, Mycobacterium
PDAAFGGMWWLYLPLAFDDYQLF

SEQ ID NO: 1274535 - protein, 18 aa, Mycobacterium
PDAALWRILRDVASLGSA

SEQ ID NO: 1274536 - protein, 18 aa, Mycobacterium
PDAARAWVTTVDQRNAEL

SEQ ID NO: 1274537 - protein, 18 aa, Mycobacterium
PDAARPRGFWAVGAHRDI

SEQ ID NO: 1274538 - protein, 26 aa, Mycobacterium
PDADIYRFLPGLGVILGARVLGEFGD

SEQ ID NO: 1274539 - protein, 17 aa, Mycobacterium
PDAELLIAISHREVIDR

SEQ ID NO: 1274540 - protein, 25 aa, Mycobacterium
PDAELSALLALRPPALLVGRVDPND

SEQ ID NO: 1274541 - protein, 27 aa, Mycobacterium
PDAEQRLRAVESWSVLPDFASLNWHEP

SEQ ID NO: 1274542 - protein, 26 aa, Mycobacterium
PDAGDACVLWCSAIRHAVLTGEIDIR

SEQ ID NO: 1274543 - protein, 17 aa, Mycobacterium
PDAGFSRFTPRARAVIV

SEQ ID NO: 1274544 - protein, 33 aa, Mycobacterium
PDAGWSRTDHYAWIAGLLLDLGIESIDAVDTVL

SEQ ID NO: 1274545 - protein, 18 aa, Mycobacterium
PDAHTVWVGDVLIRAEAT

SEQ ID NO: 1274546 - protein, 17 aa, Mycobacterium
PDAIALLTTDTIMYVSP

SEQ ID NO: 1274547 - protein, 29 aa, Mycobacterium
PDALLFPAAHGRHLAPATLYRQFYKARVA

SEQ ID NO: 1274548 - protein, 20 aa, Mycobacterium
PDALNSFNRAMCEEMKDVWR

SEQ ID NO: 1274549 - protein, 29 aa, Mycobacterium
PDAPTASGFWHWAVFNLPATVTDLPAGVG

SEQ ID NO: 1274550 - protein, 18 aa, Mycobacterium
PDARCFLVNSGQIGEDMP

SEQ ID NO: 1274551 - protein, 24 aa, Mycobacterium
PDARFGWPKRNGFVQPLVDAELFG

SEQ ID NO: 1274552 - protein, 20 aa, Mycobacterium
PDARLDIWYEDGLTAGTPGA

SEQ ID NO: 1274553 - protein, 17 aa, Mycobacterium
PDARPVLAAPPAAPAEI

SEQ ID NO: 1274554 - protein, 21 aa, Mycobacterium
PDARSHASAAWERRLAEWQRS

SEQ ID NO: 1274555 - protein, 32 aa, Mycobacterium
PDARYGEEICAWIRMRPGRRALDAAAVREFAA

SEQ ID NO: 1274556 - protein, 21 aa, Mycobacterium
PDARYRAGLLTSDRHPAVGWL

SEQ ID NO: 1274557 - protein, 25 aa, Mycobacterium
PDASWPDLCFTAAVGRSHLRHRAAL

SEQ ID NO: 1274558 - protein, 19 aa, Mycobacterium
PDATRVGRRLVVRSDEVSG

SEQ ID NO: 1274559 - protein, 19 aa, Mycobacterium
PDATWPAVVYTLATLLDDP

SEQ ID NO: 1274560 - protein, 31 aa, Mycobacterium
PDAVGLWTYRVDGWGDPIASWRHNVIAKLDA

SEQ ID NO: 1274561 - protein, 20 aa, Mycobacterium
PDAYRLGAVGDGWRVAMTTL

SEQ ID NO: 1274562 - protein, 17 aa, Mycobacterium
PDCRRPGATTTVVTMRV

SEQ ID NO: 1274563 - protein, 27 aa, Mycobacterium
PDCTDELKVALGRRIVVIDGAMGTAIQ

SEQ ID NO: 1274564 - protein, 24 aa, Mycobacterium
PDDARLAVLLAGWCALRKGEVFAL

SEQ ID NO: 1274565 - protein, 21 aa, Mycobacterium
PDDKPRHLLGISEPDDLFAAI

SEQ ID NO: 1274566 - protein, 22 aa, Mycobacterium
PDDLTAPAWVDRTTDILLHGVM

SEQ ID NO: 1274567 - protein, 21 aa, Mycobacterium
PDDPRGWLITTAWRRFVDLVR

SEQ ID NO: 1274568 - protein, 26 aa, Mycobacterium
PDDPRPRLLGALAMASVRIALDDWLV

SEQ ID NO: 1274569 - protein, 23 aa, Mycobacterium
PDDRFGQCVAAVIARREGATPTL

SEQ ID NO: 1274570 - protein, 18 aa, Mycobacterium
PDDSLGMRRVEVVCANCH

SEQ ID NO: 1274571 - protein, 19 aa, Mycobacterium
PDDVALISVMWANNEVGTI

SEQ ID NO: 1274572 - protein, 22 aa, Mycobacterium
PDDWEPLGAIAIGYPEAPLAPR

SEQ ID NO: 1274573 - protein, 32 aa, Mycobacterium
PDEAARLALWRTCLRPPVPVRDDLELSYYATG

SEQ ID NO: 1274574 - protein, 24 aa, Mycobacterium
PDEDKWKFTVQFARTNQPPPQQTW

SEQ ID NO: 1274575 - protein, 24 aa, Mycobacterium
PDEGAAAVIMCRGDIAHRFTDKPV

SEQ ID NO: 1274576 - protein, 20 aa, Mycobacterium
PDELYTSLLRRAITTANIAL

SEQ ID NO: 1274577 - protein, 24 aa, Mycobacterium
PDERRLPIHPAHLGRIDRAVASRV

SEQ ID NO: 1274578 - protein, 19 aa, Mycobacterium
PDESVALAVAFAVRALRNG

SEQ ID NO: 1274579 - protein, 20 aa, Mycobacterium
PDEVGLWTFRVDGWGDPIAT

SEQ ID NO: 1274580 - protein, 17 aa, Mycobacterium
PDEVKLRVRNCSTCGTD

SEQ ID NO: 1274581 - protein, 17 aa, Mycobacterium
PDEYGALAVHIVENPML

SEQ ID NO: 1274582 - protein, 20 aa, Mycobacterium
PDFAELFVAIGRLGRSLGMH

SEQ ID NO: 1274583 - protein, 26 aa, Mycobacterium
PDFAELFVAIGRVGRSLGMHLLLASQ

SEQ ID NO: 1274584 - protein, 25 aa, Mycobacterium
PDFASAAWRKLLVNAVVGLMVLTGR

SEQ ID NO: 1274585 - protein, 18 aa, Mycobacterium
PDFIEGITAFFEKRQPSF

SEQ ID NO: 1274586 - protein, 25 aa, Mycobacterium
PDFSTLRLLPWLPGSALVMADLSWT

SEQ ID NO: 1274587 - protein, 18 aa, Mycobacterium
PDGAEVRWADLTDSDQVD

SEQ ID NO: 1274588 - protein, 17 aa, Mycobacterium
PDGAWCVPSVLADVPRT

SEQ ID NO: 1274589 - protein, 18 aa, Mycobacterium
PDGDRAGDIVLIDSTHFT

SEQ ID NO: 1274590 - protein, 17 aa, Mycobacterium
PDGELRPPAGRETATAV

SEQ ID NO: 1274591 - protein, 19 aa, Mycobacterium
PDGGLPYTALVDYEVVTRA

SEQ ID NO: 1274592 - protein, 19 aa, Mycobacterium
PDGGPSFQPGYEGVTLTQP

SEQ ID NO: 1274593 - protein, 18 aa, Mycobacterium
PDGGRGYLSKIFNDAWMS

SEQ ID NO: 1274594 - protein, 17 aa, Mycobacterium
PDGGWAVSGRPHTLLLL

SEQ ID NO: 1274595 - protein, 18 aa, Mycobacterium
PDGGWLVSGTKVWTSGAH

SEQ ID NO: 1274596 - protein, 25 aa, Mycobacterium
PDGHLARLRFLRRYAEDLSGPVVIH

SEQ ID NO: 1274597 - protein, 19 aa, Mycobacterium
PDGHWWAGYIEGFHQPGDA

SEQ ID NO: 1274598 - protein, 25 aa, Mycobacterium
PDGICLDAAGGVWVAMTLAHQFERI

SEQ ID NO: 1274599 - protein, 21 aa, Mycobacterium
PDGKMGEIWVHGDQVAMGYWR

SEQ ID NO: 1274600 - protein, 27 aa, Mycobacterium
PDGLQRPWLRANFIASIDGAVTLEGSG

SEQ ID NO: 1274601 - protein, 18 aa, Mycobacterium
PDGLRVGKLTSMTQPFAA

SEQ ID NO: 1274602 - protein, 19 aa, Mycobacterium
PDGMVDLRATMTPEAWAVW

SEQ ID NO: 1274603 - protein, 17 aa, Mycobacterium
PDGPGFDKGYWVEPTIF

SEQ ID NO: 1274604 - protein, 22 aa, Mycobacterium
PDGPWLRTGDLGFIDGGELFIV

SEQ ID NO: 1274605 - protein, 17 aa, Mycobacterium
PDGQVYAGRGGDGGDAV

SEQ ID NO: 1274606 - protein, 24 aa, Mycobacterium
PDGRELLDLSATWTASGLGHGHPA

SEQ ID NO: 1274607 - protein, 18 aa, Mycobacterium
PDGRRPGVFFQRVPEGKT

SEQ ID NO: 1274608 - protein, 30 aa, Mycobacterium
PDGRSVYFSSARGLDRMDVFTALERPSLID

SEQ ID NO: 1274609 - protein, 17 aa, Mycobacterium
PDGRTGFDIATGAVDGH

SEQ ID NO: 1274610 - protein, 21 aa, Mycobacterium
PDGRWIGIRAETSYGPDGIGT

SEQ ID NO: 1274611 - protein, 17 aa, Mycobacterium
PDGRYLLAMIRGDRTYR

SEQ ID NO: 1274612 - protein, 25 aa, Mycobacterium
PDGSLLRPGDRASIFVRPGAIALCD

SEQ ID NO: 1274613 - protein, 22 aa, Mycobacterium
PDGTAVPVFLQRSPHFRPPQDS

SEQ ID NO: 1274614 - protein, 18 aa, Mycobacterium
PDGTCVRDYIHVEDVAAA

SEQ ID NO: 1274615 - protein, 27 aa, Mycobacterium
PDGTCWSEFTLGPAYEGPPGWVHGGIA

SEQ ID NO: 1274616 - protein, 20 aa, Mycobacterium
PDGTRMAFLAPWKDRLNVWV

SEQ ID NO: 1274617 - protein, 17 aa, Mycobacterium
PDGVPVFLLPANPVSAL

SEQ ID NO: 1274618 - protein, 18 aa, Mycobacterium
PDGWPQRPTYSGWLDSPD

SEQ ID NO: 1274619 - protein, 19 aa, Mycobacterium
PDHEPVGGVHFAFVSNSSP

SEQ ID NO: 1274620 - protein, 18 aa, Mycobacterium
PDHLPVVLEFAAVVAPEA

SEQ ID NO: 1274621 - protein, 17 aa, Mycobacterium
PDHPDHVMYVWVDALTN

SEQ ID NO: 1274622 - protein, 23 aa, Mycobacterium
PDHRVACIRNELVAGRSAADLYG

SEQ ID NO: 1274623 - protein, 17 aa, Mycobacterium
PDIATTQCVIWNFAGLK

SEQ ID NO: 1274624 - protein, 26 aa, Mycobacterium
PDIDLGWWLMFERFLCESLGFTRPPG

SEQ ID NO: 1274625 - protein, 17 aa, Mycobacterium
PDILILEGLNVLQTGPA

SEQ ID NO: 1274626 - protein, 19 aa, Mycobacterium
PDIPGVDSFAGTTMHTARW

SEQ ID NO: 1274627 - protein, 17 aa, Mycobacterium
PDIRLLAATTFFDASTY

SEQ ID NO: 1274628 - protein, 23 aa, Mycobacterium
PDKALRERVFRIYNEHIAELQER

SEQ ID NO: 1274629 - protein, 20 aa, Mycobacterium
PDKERTVIRLGLTGSLTVTD

SEQ ID NO: 1274630 - protein, 27 aa, Mycobacterium
PDKFFLPPRVVSLYGTRMWTEMTREQQ

SEQ ID NO: 1274631 - protein, 17 aa, Mycobacterium
PDKLRDAQKVFAATGGL

SEQ ID NO: 1274632 - protein, 19 aa, Mycobacterium
PDLAFKQLIMEAGADIAVL

SEQ ID NO: 1274633 - protein, 21 aa, Mycobacterium
PDLAIDWPLAGAIVSAQDRRA

SEQ ID NO: 1274634 - protein, 19 aa, Mycobacterium
PDLAYEFLPVVWRVIQHYG

SEQ ID NO: 1274635 - protein, 19 aa, Mycobacterium
PDLGPLFLNAMPIQMAEAV

SEQ ID NO: 1274636 - protein, 18 aa, Mycobacterium
PDLHAELERIGRRLNEPM

SEQ ID NO: 1274637 - protein, 17 aa, Mycobacterium
PDLKAFFDVTVVAPGHW

SEQ ID NO: 1274638 - protein, 21 aa, Mycobacterium
PDLLAQCLLAGFDEVLALGGD

SEQ ID NO: 1274639 - protein, 20 aa, Mycobacterium
PDLLVGRKGLDPETVATIQT

SEQ ID NO: 1274640 - protein, 19 aa, Mycobacterium
PDLQPGSSIMPGKVNPVIP

SEQ ID NO: 1274641 - protein, 20 aa, Mycobacterium
PDLRFHDLRHSGAVLAAATG

SEQ ID NO: 1274642 - protein, 20 aa, Mycobacterium
PDLRRLRTTMVAQISRGSVG

SEQ ID NO: 1274643 - protein, 18 aa, Mycobacterium
PDLSLLRAAATAGFTTIA

SEQ ID NO: 1274644 - protein, 17 aa, Mycobacterium
PDLTAEWLTAVIGQGTV

SEQ ID NO: 1274645 - protein, 21 aa, Mycobacterium
PDLTGTVLQAAKWADGMGYVV

SEQ ID NO: 1274646 - protein, 18 aa, Mycobacterium
PDLVAGLVLLDPAVALDG

SEQ ID NO: 1274647 - protein, 18 aa, Mycobacterium
PDLVTVKVPTHWYNLAAE

SEQ ID NO: 1274648 - protein, 21 aa, Mycobacterium
PDMLAAGWGRIVMISSSSAQR

SEQ ID NO: 1274649 - protein, 19 aa, Mycobacterium
PDMQVELRVPEVRTGTGAI

SEQ ID NO: 1274650 - protein, 19 aa, Mycobacterium
PDMSALLLGGELVLTTGTA

SEQ ID NO: 1274651 - protein, 24 aa, Mycobacterium
PDMVLDPAGSVGFRVIDAQLPEPA

SEQ ID NO: 1274652 - protein, 20 aa, Mycobacterium
PDNAIAVIGMAGRFPGAGSV

SEQ ID NO: 1274653 - protein, 22 aa, Mycobacterium
PDNELRRIAALCAAFDVDGMRA

SEQ ID NO: 1274654 - protein, 23 aa, Mycobacterium
PDNGIKIFGPGGHKLDDATEDRI

SEQ ID NO: 1274655 - protein, 21 aa, Mycobacterium
PDNKGPLLINARADKVTTSPA

SEQ ID NO: 1274656 - protein, 25 aa, Mycobacterium
PDNNIACSRWGMLAPDGKCKTFDAD

SEQ ID NO: 1274657 - protein, 17 aa, Mycobacterium
PDPAAKRPLFTDFAPRL

SEQ ID NO: 1274658 - protein, 18 aa, Mycobacterium
PDPALTKGYFQWSAMSWF

SEQ ID NO: 1274659 - protein, 20 aa, Mycobacterium
PDPALTKGYFQWSAMSWFAL

SEQ ID NO: 1274660 - protein, 18 aa, Mycobacterium
PDPASFTPIPFIKEGLAI

SEQ ID NO: 1274661 - protein, 17 aa, Mycobacterium
PDPAVLLEAARRIGARP

SEQ ID NO: 1274662 - protein, 21 aa, Mycobacterium
PDPDGSIAFQAAQELILSGAD

SEQ ID NO: 1274663 - protein, 23 aa, Mycobacterium
PDPEGRFDYRWHDGQQWTDQVSH

SEQ ID NO: 1274664 - protein, 18 aa, Mycobacterium
PDPEPDRAQLLERLVIAV

SEQ ID NO: 1274665 - protein, 28 aa, Mycobacterium
PDPGHAFPAIALCLRFLAAGDHPTLLTG

SEQ ID NO: 1274666 - protein, 18 aa, Mycobacterium
PDPGIVLWLGTARGPVHT

SEQ ID NO: 1274667 - protein, 25 aa, Mycobacterium
PDPGQPVVRFVCSWSTTETEVDDAL

SEQ ID NO: 1274668 - protein, 24 aa, Mycobacterium
PDPHTPWNATRLGRLIAEHTDIPA

SEQ ID NO: 1274669 - protein, 22 aa, Mycobacterium
PDPKRVGLRLVVGRDSRHGSLG

SEQ ID NO: 1274670 - protein, 20 aa, Mycobacterium
PDPKYAPGYLNEFGGHFQIT

SEQ ID NO: 1274671 - protein, 17 aa, Mycobacterium
PDPLVPLYLRRPDAKPP

SEQ ID NO: 1274672 - protein, 23 aa, Mycobacterium
PDPPPKRAVLMVWSYGNNGDTPA

SEQ ID NO: 1274673 - protein, 23 aa, Mycobacterium
PDPQWPGGAAIAVQFVLNYEEGA

SEQ ID NO: 1274674 - protein, 24 aa, Mycobacterium
PDPRATHVLETWAHILDLLERDPM

SEQ ID NO: 1274675 - protein, 22 aa, Mycobacterium
PDPRTLAALEMTFFGALVNAGS

SEQ ID NO: 1274676 - protein, 21 aa, Mycobacterium
PDPSYHGVVFAELGPPAYALK

SEQ ID NO: 1274677 - protein, 20 aa, Mycobacterium
PDPVDLVAFLSLRFAPPTLT

SEQ ID NO: 1274678 - protein, 17 aa, Mycobacterium
PDPWAGIDDTAQSIDTL

SEQ ID NO: 1274679 - protein, 18 aa, Mycobacterium
PDPWRLGNEMVRVTRPGG

SEQ ID NO: 1274680 - protein, 19 aa, Mycobacterium
PDQFNWLATRLEIARKLRN

SEQ ID NO: 1274681 - protein, 27 aa, Mycobacterium
PDQGRAHLLYGEWLRRRRRRVDARAQL

SEQ ID NO: 1274682 - protein, 27 aa, Mycobacterium
PDQPGPGWRFGRFASRVRGAPEVLGQF

SEQ ID NO: 1274683 - protein, 24 aa, Mycobacterium
PDQPMCKRMIFAGHYYRTVQRPDV

SEQ ID NO: 1274684 - protein, 26 aa, Mycobacterium
PDRAEVYRRAGYWTGRPLDSILTEAA

SEQ ID NO: 1274685 - protein, 25 aa, Mycobacterium
PDRELRTEFPFTLPRGYVDGNREIH

SEQ ID NO: 1274686 - protein, 21 aa, Mycobacterium
PDRFAPQLTPEVWAVAFDPDS

SEQ ID NO: 1274687 - protein, 27 aa, Mycobacterium
PDRFIRPRVEVELAFVLGEALRGPGVT

SEQ ID NO: 1274688 - protein, 22 aa, Mycobacterium
PDRGYCLSVRGMAREIANAYDL

SEQ ID NO: 1274689 - protein, 30 aa, Mycobacterium; identical to SEQ ID NO: 706403

SEQ ID NO: 1274690 - protein, 25 aa, Mycobacterium
PDRLRLPLVKSRTGDHLEVSWEDAF

SEQ ID NO: 1274691 - protein, 20 aa, Mycobacterium
PDRRAVVCRELTKTHEEIVR

SEQ ID NO: 1274692 - protein, 20 aa, Mycobacterium
PDRRDWRLVREVVVAETDEQ

SEQ ID NO: 1274693 - protein, 20 aa, Mycobacterium
PDRRFSLLPLSARTPAALTQ

SEQ ID NO: 1274694 - protein, 17 aa, Mycobacterium
PDRSLGAILAWFSLIHC

SEQ ID NO: 1274695 - protein, 21 aa, Mycobacterium
PDRVDPALSRLMAAWPDNPAL

SEQ ID NO: 1274696 - protein, 21 aa, Mycobacterium
PDRVDSLVFLDAVVPRDGEAC

SEQ ID NO: 1274697 - protein, 18 aa, Mycobacterium
PDRVKCLHVVIAHSLAKG

SEQ ID NO: 1274698 - protein, 18 aa, Mycobacterium
PDSADWLHRLRIVGIDLR

SEQ ID NO: 1274699 - protein, 26 aa, Mycobacterium
PDSAWGWRKFAPLLAERGMRVVAPFS

SEQ ID NO: 1274700 - protein, 23 aa, Mycobacterium
PDSDRWTYLTARDDLRGNVATHG

SEQ ID NO: 1274701 - protein, 23 aa, Mycobacterium
PDSDVTVGLVFRALFGEPDLLSR

SEQ ID NO: 1274702 - protein, 17 aa, Mycobacterium
PDSGLRDRLLFAVLAET

SEQ ID NO: 1274703 - protein, 18 aa, Mycobacterium
PDSGQAVLAGWRMLLDDG

SEQ ID NO: 1274704 - protein, 23 aa, Mycobacterium
PDSIQVRFGIEFVEQNPADATAV

SEQ ID NO: 1274705 - protein, 18 aa, Mycobacterium
PDSLWGIAARIRATVLGT

SEQ ID NO: 1274706 - protein, 36 aa, Mycobacterium
PDSRGRVRWLYKQFPGEDWAGWHVLVLVSTATPPEY

SEQ ID NO: 1274707 - protein, 23 aa, Mycobacterium
PDSRPAALPFLSIKKITVHYRPR

SEQ ID NO: 1274708 - protein, 24 aa, Mycobacterium
PDSSGNPYLAFAAMLMAGIDGIKK

SEQ ID NO: 1274709 - protein, 24 aa, Mycobacterium
PDSTWSDRCYFFAASPDGSMLLAS

SEQ ID NO: 1274710 - protein, 19 aa, Mycobacterium
PDSVPEFAGDIFDLSLSHP

SEQ ID NO: 1274711 - protein, 30 aa, Mycobacterium
PDTAFLELCPFAAWGSKFPVGGSVVVGIGV

SEQ ID NO: 1274712 - protein, 27 aa, Mycobacterium
PDTAIWRPMNRWVYEIIRRVTDARRDP

SEQ ID NO: 1274713 - protein, 21 aa, Mycobacterium
PDTANGIPVFLSEDAKEGPRA

SEQ ID NO: 1274714 - protein, 17 aa, Mycobacterium
PDTCAAASDALRLGDLE

SEQ ID NO: 1274715 - protein, 23 aa, Mycobacterium
PDTCREIAEKAAAHSVSVIDAPV

SEQ ID NO: 1274716 - protein, 23 aa, Mycobacterium
PDTDKRLAVTVKRTAEGYASNWL

SEQ ID NO: 1274717 - protein, 18 aa, Mycobacterium
PDTLLGWLQSDLGADAVR

SEQ ID NO: 1274718 - protein, 19 aa, Mycobacterium
PDTMYGFLLTLRQRGPHGG

SEQ ID NO: 1274719 - protein, 20 aa, Mycobacterium
PDTPIPFGVWQRVSVAVRNR

SEQ ID NO: 1274720 - protein, 18 aa, Mycobacterium
PDTRIWAHGDLEPARATA

SEQ ID NO: 1274721 - protein, 19 aa, Mycobacterium
PDTYRVMLRQGLYGNYFTF

SEQ ID NO: 1274722 - protein, 20 aa, Mycobacterium
PDVESLREFLLGRGVAKFKV

SEQ ID NO: 1274723 - protein, 19 aa, Mycobacterium
PDVGLVLRDVGLDVLGTAR

SEQ ID NO: 1274724 - protein, 26 aa, Mycobacterium
PDVIAHGMLTMGLGAGFVSAWSGDPG

SEQ ID NO: 1274725 - protein, 17 aa, Mycobacterium
PDVLCGYHLSVVRPLPG

SEQ ID NO: 1274726 - protein, 21 aa, Mycobacterium
PDVLPGYGRESARLVTGDGVG

SEQ ID NO: 1274727 - protein, 17 aa, Mycobacterium
PDVLTAWMDASVIDEND

SEQ ID NO: 1274728 - protein, 19 aa, Mycobacterium
PDVPDLERFGWRARSSLET

SEQ ID NO: 1274729 - protein, 39 aa, Mycobacterium
PDVPVSIEAPVQWPAPAGVRARAALRAARTVVGRADASR

SEQ ID NO: 1274730 - protein, 22 aa, Mycobacterium
PDVRTALEVAIERARAVHADQR

SEQ ID NO: 1274731 - protein, 18 aa, Mycobacterium
PDVYIAALGPQLLRVAGR

SEQ ID NO: 1274732 - protein, 21 aa, Mycobacterium
PDWAGGDALRLRQLAGAVTPP

SEQ ID NO: 1274733 - protein, 19 aa, Mycobacterium
PDYDNLRVAFDRAMADGDV

SEQ ID NO: 1274734 - protein, 23 aa, Mycobacterium
PDYPMFLTLGVFDFPDRPGPAEH

SEQ ID NO: 1274735 - protein, 20 aa, Mycobacterium
PDYRAGCKRILNSDTYYRGI

SEQ ID NO: 1274736 - protein, 20 aa, Mycobacterium
PDYRPFWAVTKHSDIMAIER

SEQ ID NO: 1274737 - protein, 18 aa, Mycobacterium
PDYSTRLWQPMLLAERNP

SEQ ID NO: 1274738 - protein, 26 aa, Mycobacterium
PDYVRLAGHYGFAPDFCHASDPHFKG

SEQ ID NO: 1274739 - protein, 20 aa, Mycobacterium
PEAAAALTRRTGGWAAGLQL

SEQ ID NO: 1274740 - protein, 20 aa, Mycobacterium
PEAARDLFIRHALVEGDWQT

SEQ ID NO: 1274741 - protein, 20 aa, Mycobacterium
PEAARTLIEYGLADSTPAVV

SEQ ID NO: 1274742 - protein, 20 aa, Mycobacterium
PEADRMRLFGAFVTAAERSR

SEQ ID NO: 1274743 - protein, 22 aa, Mycobacterium
PEAFAVVREAAWRVLNQRHFDV

SEQ ID NO: 1274744 - protein, 28 aa, Mycobacterium
PEAGDACVLWCLAIRHAVLTGDLEVRIG

SEQ ID NO: 1274745 - protein, 24 aa, Mycobacterium
PEAGGIPIPLGRKGEASDIAEAIA

SEQ ID NO: 1274746 - protein, 23 aa, Mycobacterium
PEAGHKGFSLFVVERGMEGFTRG

SEQ ID NO: 1274747 - protein, 25 aa, Mycobacterium
PEAGKRLRLLQQYFFVTCSLQDILN

SEQ ID NO: 1274748 - protein, 18 aa, Mycobacterium
PEALNAFNQELYLATATA

SEQ ID NO: 1274749 - protein, 17 aa, Mycobacterium
PEALPLAAELAELVDTL

SEQ ID NO: 1274750 - protein, 24 aa, Mycobacterium
PEAMLDRLALNPARVEGIADGLRQ

SEQ ID NO: 1274751 - protein, 22 aa, Mycobacterium
PEAPELQALLATMLEQGVDTVV

SEQ ID NO: 1274752 - protein, 17 aa, Mycobacterium
PEAPPFLVVHGTGDSVI

SEQ ID NO: 1274753 - protein, 21 aa, Mycobacterium
PEAPYLHLFVPRGEVSLEGAG

SEQ ID NO: 1274754 - protein, 21 aa, Mycobacterium
PEAQLDRFLLKLNVPLPPRDQ

SEQ ID NO: 1274755 - protein, 24 aa, Mycobacterium
PEARLEVMDGLGLDYTLMFPTLAS

SEQ ID NO: 1274756 - protein, 19 aa, Mycobacterium
PEAVAAWQSRQDPSYPVYT

SEQ ID NO: 1274757 - protein, 25 aa, Mycobacterium
PEAVGPRWRSSWPRVDTVAPDPEHA

SEQ ID NO: 1274758 - protein, 17 aa, Mycobacterium
PEAYQWVIATGYIVTAQ

SEQ ID NO: 1274759 - protein, 17 aa, Mycobacterium
PECAAVIAEVWTLLDGE

SEQ ID NO: 1274760 - protein, 17 aa, Mycobacterium
PECELVIVVGSKNSSNS

SEQ ID NO: 1274761 - protein, 24 aa, Mycobacterium
PECGLQGGVMSWWSIQPHGGVYGG

SEQ ID NO: 1274762 - protein, 25 aa, Mycobacterium
PEDCHFCSQSGLFASPVRSAWLDIP

SEQ ID NO: 1274763 - protein, 17 aa, Mycobacterium
PEDDPRTTLAYINDNRR

SEQ ID NO: 1274764 - protein, 22 aa, Mycobacterium
PEDIAAACSFLISEEAGYITGQ

SEQ ID NO: 1274765 - protein, 22 aa, Mycobacterium
PEDIANAVLFLASDEARFITGV

SEQ ID NO: 1274766 - protein, 24 aa, Mycobacterium
PEDKNIRIAPTFPALSDLREAIDG

SEQ ID NO: 1274767 - protein, 19 aa, Mycobacterium
PEDLPLFPFQVGRIGAGAN

SEQ ID NO: 1274768 - protein, 21 aa, Mycobacterium
PEDLVGMLLFLLSDQAKWITG

SEQ ID NO: 1274769 - protein, 24 aa, Mycobacterium
PEDMLDWLAAWIGLSFDGHVDAQR

SEQ ID NO: 1274770 - protein, 20 aa, Mycobacterium
PEDSRGRLFLGVQDLLEQLD

SEQ ID NO: 1274771 - protein, 28 aa, Mycobacterium
PEDWPVMPCHYTGFKLKPVGFFDGNPAL

SEQ ID NO: 1274772 - protein, 28 aa, Mycobacterium
PEDWPVMPVDIVSFWLKPFGFFDRNPAL

SEQ ID NO: 1274773 - protein, 22 aa, Mycobacterium
PEEALELALRITDFAQRRQPAR

SEQ ID NO: 1274774 - protein, 17 aa, Mycobacterium
PEEAVAALAGRGPERLV

SEQ ID NO: 1274775 - protein, 24 aa, Mycobacterium
PEEDRPEFLAALGAEQPDGARVGA

SEQ ID NO: 1274776 - protein, 23 aa, Mycobacterium
PEEFGGGGASVWEQTVVREEMWA

SEQ ID NO: 1274777 - protein, 26 aa, Mycobacterium
PEEFGVIACYRLKPVRFTSEESAMVT

SEQ ID NO: 1274778 - protein, 18 aa, Mycobacterium
PEELRLKKTVARLATYLQ

SEQ ID NO: 1274779 - protein, 22 aa, Mycobacterium
PEEPHWYLAIIGSDPTVRGAGF

SEQ ID NO: 1274780 - protein, 42 aa, Mycobacterium
PEEPKGTPVFAWKGETLEEYWWAAEQMLTWEGKPANMILDDG

SEQ ID NO: 1274781 - protein, 19 aa, Mycobacterium
PEESLLFAVGREARVDFEG

SEQ ID NO: 1274782 - protein, 17 aa, Mycobacterium
PEFAIARWAVEHLSPAQ

SEQ ID NO: 1274783 - protein, 25 aa, Mycobacterium
PEFDGRIITVPFSFKEIDDEGLISY

SEQ ID NO: 1274784 - protein, 25 aa, Mycobacterium
PEFDLATEAAMRWNAAVQLVHTEVY

SEQ ID NO: 1274785 - protein, 18 aa, Mycobacterium
PEFEYRRSDLPSHVRFVG

SEQ ID NO: 1274786 - protein, 18 aa, Mycobacterium
PEFKVCAVRLAPVPAAGA

SEQ ID NO: 1274787 - protein, 37 aa, Mycobacterium
PEFLKPGIPEWRYPFEGRMHAVTAMAIAKGAFNLDEQ

SEQ ID NO: 1274788 - protein, 17 aa, Mycobacterium
PEFPAYERSTGDVVDLI

SEQ ID NO: 1274789 - protein, 20 aa, Mycobacterium
PEFYAAQGLSSIPLDGPLAV

SEQ ID NO: 1274790 - protein, 30 aa, Mycobacterium
PEGALFPAGLRLAAKLSHRVPAIARKARVL

SEQ ID NO: 1274791 - protein, 18 aa, Mycobacterium
PEGAPPFNAEELDMMAAF

SEQ ID NO: 1274792 - protein, 24 aa, Mycobacterium
PEGEGLAGVQARAVAAVREHDRRL

SEQ ID NO: 1274793 - protein, 18 aa, Mycobacterium
PEGILVVWLDLTDQRSFT

SEQ ID NO: 1274794 - protein, 23 aa, Mycobacterium
PEGKVLPGYGWIFPLGNGEVNIG

SEQ ID NO: 1274795 - protein, 20 aa, Mycobacterium
PEGLFGVVCDVTDNEAVDRA

SEQ ID NO: 1274796 - protein, 29 aa, Mycobacterium
PEGLNAEYLFRLALPTGIYGGTLDVFRNM

SEQ ID NO: 1274797 - protein, 22 aa, Mycobacterium
PEGLTGTLYRNGSGRWNIGSSP

SEQ ID NO: 1274798 - protein, 21 aa, Mycobacterium
PEGPEIGAFFDLDGTLVAGFT

SEQ ID NO: 1274799 - protein, 21 aa, Mycobacterium
PEGPRMLGITSVASYHGPSFM

SEQ ID NO: 1274800 - protein, 19 aa, Mycobacterium
PEGQGRPGYNEFFPALLDE

SEQ ID NO: 1274801 - protein, 17 aa, Mycobacterium
PEGSQPTPSGWEVTTHG

SEQ ID NO: 1274802 - protein, 22 aa, Mycobacterium
PEGYTPPPGMTGPMPPSVADNV

SEQ ID NO: 1274803 - protein, 18 aa, Mycobacterium
PEHPYPAAVDDVWAATRW

SEQ ID NO: 1274804 - protein, 20 aa, Mycobacterium
PEHRHMRSLLNKAFTPRAIQ

SEQ ID NO: 1274805 - protein, 25 aa, Mycobacterium
PEHRPGIPYPEWNAWTESFMSDHVA

SEQ ID NO: 1274806 - protein, 17 aa, Mycobacterium
PEIEIDTLIAVPCRELL

SEQ ID NO: 1274807 - protein, 24 aa, Mycobacterium
PEIREFYDAFSPRFEEAIDYCDKF

SEQ ID NO: 1274808 - protein, 23 aa, Mycobacterium
PEIWARLMRELDVVDGAELAPLR

SEQ ID NO: 1274809 - protein, 24 aa, Mycobacterium
PEKADAVWGDALRAGYAKRDPALG

SEQ ID NO: 1274810 - protein, 32 aa, Mycobacterium
PEKIQYEFGGFRGFCELAGYEYSSIEFDYGGQ

SEQ ID NO: 1274811 - protein, 20 aa, Mycobacterium
PEKYRTFWTQFGRVLKEGLL

SEQ ID NO: 1274812 - protein, 23 aa, Mycobacterium
PELAAACADAGITFVGPSANVLE

SEQ ID NO: 1274813 - protein, 18 aa, Mycobacterium
PELAELLLSKGLGVEVGI

SEQ ID NO: 1274814 - protein, 18 aa, Mycobacterium
PELARLSLNIAATHHDSR

SEQ ID NO: 1274815 - protein, 22 aa, Mycobacterium
PELATLMAHVKLALKDDLLAGD

SEQ ID NO: 1274816 - protein, 24 aa, Mycobacterium
PELDELRSPGVRGFFNRQLRDEGL

SEQ ID NO: 1274817 - protein, 31 aa, Mycobacterium; identical to SEQ ID NO: 1120491

SEQ ID NO: 1274818 - protein, 24 aa, Mycobacterium
PELGLRPRLAVGIHLPADTRHAPR

SEQ ID NO: 1274819 - protein, 21 aa, Mycobacterium
PELHLRWLRDTSVPPPGGESF

SEQ ID NO: 1274820 - protein, 34 aa, Mycobacterium
PELHVLGSVLWRRAMGLVLGEWVRTGDCTEADAI

SEQ ID NO: 1274821 - protein, 17 aa, Mycobacterium
PELIPLLQAGRLSVDGI

SEQ ID NO: 1274822 - protein, 26 aa, Mycobacterium
PELKALCRGCPRRWQCAKDALDTPGA

SEQ ID NO: 1274823 - protein, 19 aa, Mycobacterium
PELKLCMIHGADPWWDVAI

SEQ ID NO: 1274824 - protein, 26 aa, Mycobacterium
PELLFSAGYAACFLGALRLQAKNNDV

SEQ ID NO: 1274825 - protein, 17 aa, Mycobacterium
PELMPSAIPHYHSALQL

SEQ ID NO: 1274826 - protein, 24 aa, Mycobacterium
PELMTLEKIAAWAITEPDAGSDAF

SEQ ID NO: 1274827 - protein, 20 aa, Mycobacterium
PELPHPAELLSRIGHKHASL

SEQ ID NO: 1274828 - protein, 19 aa, Mycobacterium
PELPLAHPAPRVVVEIHHA

SEQ ID NO: 1274829 - protein, 21 aa, Mycobacterium
PELPPLLPGQVLRLGPAAGTG

SEQ ID NO: 1274830 - protein, 17 aa, Mycobacterium
PELPVTGYADLVRAVKA

SEQ ID NO: 1274831 - protein, 29 aa, Mycobacterium
PELPWLARKRIQQDWGISDEVMRDLVNIG

SEQ ID NO: 1274832 - protein, 23 aa, Mycobacterium
PELPWPEPDRWLAAVGASPLADE

SEQ ID NO: 1274833 - protein, 17 aa, Mycobacterium
PELPYYSATLYDPRDPA

SEQ ID NO: 1274834 - protein, 21 aa, Mycobacterium
PELRASAKAALERRYGITGLG

SEQ ID NO: 1274835 - protein, 19 aa, Mycobacterium
PELRRAHERELLDNYRGRL

SEQ ID NO: 1274836 - protein, 23 aa, Mycobacterium
PELRRRVKAMSYGLAYGLSAYGL

SEQ ID NO: 1274837 - protein, 26 aa, Mycobacterium
PELTAEVLRDGWLRTGDIGVLGDDGN

SEQ ID NO: 1274838 - protein, 20 aa, Mycobacterium
PELTIVMAHPAVPWVDAQIS

SEQ ID NO: 1274839 - protein, 20 aa, Mycobacterium
PELVEAYLAAGGRRTSALDW

SEQ ID NO: 1274840 - protein, 19 aa, Mycobacterium
PELVRACGIQAGDRVLDVA

SEQ ID NO: 1274841 - protein, 21 aa, Mycobacterium
PELVSRWSAYFPPAPAEAMFR

SEQ ID NO: 1274842 - protein, 19 aa, Mycobacterium
PELYRLARDRFGARGRVTV

SEQ ID NO: 1274843 - protein, 19 aa, Mycobacterium
PEMDRSIRALPHADKPSVL

SEQ ID NO: 1274844 - protein, 20 aa, Mycobacterium
PEMLDRGSFGTVYRLPSYSL

SEQ ID NO: 1274845 - protein, 23 aa, Mycobacterium
PEMPGRVEGKVAFVTGAARGQGR

SEQ ID NO: 1274846 - protein, 22 aa, Mycobacterium
PEMRAVSCSIALTQNFPYNGSL

SEQ ID NO: 1274847 - protein, 18 aa, Mycobacterium
PEPAPAPEPVYEAAPTPA

SEQ ID NO: 1274848 - protein, 20 aa, Mycobacterium
PEPARGAATIDILTTSAVIE

SEQ ID NO: 1274849 - protein, 21 aa, Mycobacterium
PEPDPAQAVSTVFGADHAPVA

SEQ ID NO: 1274850 - protein, 19 aa, Mycobacterium
PEPEPDRDPGRDCDPEAES

SEQ ID NO: 1274851 - protein, 33 aa, Mycobacterium
PEPEPLPAFVSRVRRALPATSWGVRASGDPATT

SEQ ID NO: 1274852 - protein, 24 aa, Mycobacterium
PEPFRLVPPADQWESDAASVAEGL

SEQ ID NO: 1274853 - protein, 30 aa, Mycobacterium
PEPHPGLRVKPVMIGIRLKQSAAGLFTTVT

SEQ ID NO: 1274854 - protein, 17 aa, Mycobacterium
PEPLPMPLQNILVSEAH

SEQ ID NO: 1274855 - protein, 20 aa, Mycobacterium
PEPLRVRSCRQRRFGRQAYE

SEQ ID NO: 1274856 - protein, 20 aa, Mycobacterium
PEPPYKWIPIMIDPPDHAKW

SEQ ID NO: 1274857 - protein, 19 aa, Mycobacterium
PEPRIKVMDELGVDRSLMF

SEQ ID NO: 1274858 - protein, 23 aa, Mycobacterium
PEQFFPTFGSMTFDDSVQEGRDN

SEQ ID NO: 1274859 - protein, 24 aa, Mycobacterium
PEQLAEWMRFMLSDAADFLCGSVI

SEQ ID NO: 1274860 - protein, 23 aa, Mycobacterium
PEQLMRWLFDNALTRVTRQAAAL

SEQ ID NO: 1274861 - protein, 21 aa, Mycobacterium
PEQRTLFCCYAVTDLDGARAS

SEQ ID NO: 1274862 - protein, 22 aa, Mycobacterium
PEQRVAAEIALSQSLTVLTGGP

SEQ ID NO: 1274863 - protein, 19 aa, Mycobacterium
PEQVCFAITRLPAARDVAI

SEQ ID NO: 1274864 - protein, 20 aa, Mycobacterium
PERAEAIAIHAACVGRGAAD

SEQ ID NO: 1274865 - protein, 17 aa, Mycobacterium
PERARAAGAEFLIATTG

SEQ ID NO: 1274866 - protein, 24 aa, Mycobacterium
PERCARVAGLAVRHARLRSIAPAD

SEQ ID NO: 1274867 - protein, 24 aa, Mycobacterium
PERDDAWFITDWMDATRAQEALQF

SEQ ID NO: 1274868 - protein, 20 aa, Mycobacterium
PERDPAGFWLGPTLLDNVTP

SEQ ID NO: 1274869 - protein, 23 aa, Mycobacterium
PERDRTAIAMGRRGTPEEQAGAI

SEQ ID NO: 1274870 - protein, 17 aa, Mycobacterium
PERELATRLGVSRDTVR

SEQ ID NO: 1274871 - protein, 22 aa, Mycobacterium
PERIKSNLDVFDFELTADQMAA

SEQ ID NO: 1274872 - protein, 17 aa, Mycobacterium
PERLGGDGVGFAEMATA

SEQ ID NO: 1274873 - protein, 23 aa, Mycobacterium
PERLREFVVLRVARLSNCEYEWR

SEQ ID NO: 1274874 - protein, 17 aa, Mycobacterium
PERPFTVVIDEAHTLIA

SEQ ID NO: 1274875 - protein, 20 aa, Mycobacterium
PERPLHVGVLLGNNPDMLTA

SEQ ID NO: 1274876 - protein, 25 aa, Mycobacterium
PERPRLLRKWIEACYGTASAEALMA

SEQ ID NO: 1274877 - protein, 22 aa, Mycobacterium
PERREITVDFVVHGEHGVAGPW

SEQ ID NO: 1274878 - protein, 20 aa, Mycobacterium
PERRGALGAAGRTFVLENWT

SEQ ID NO: 1274879 - protein, 26 aa, Mycobacterium
PERRRRRPVWRRAPLSLTASPSTEAP

SEQ ID NO: 1274880 - protein, 22 aa, Mycobacterium
PERYVSAGLWRTADTLEELAVA

SEQ ID NO: 1274881 - protein, 18 aa, Mycobacterium
PESAFLRALEQGKLLGNR

SEQ ID NO: 1274882 - protein, 21 aa, Mycobacterium
PESIGGPSLISLRQTLVLLPE

SEQ ID NO: 1274883 - protein, 23 aa, Mycobacterium
PESPRPVVQMPLGNDLIHAPTGA

SEQ ID NO: 1274884 - protein, 24 aa, Mycobacterium
PESRRLLAALIDWFEQRGKVRLLR

SEQ ID NO: 1274885 - protein, 17 aa, Mycobacterium
PESTGRRPKALSRKDKA

SEQ ID NO: 1274886 - protein, 24 aa, Mycobacterium
PESVKRFTALLSNAKTIFWNGPMG

SEQ ID NO: 1274887 - protein, 20 aa, Mycobacterium
PETAEKWLAEAGVGAYPPVF

SEQ ID NO: 1274888 - protein, 21 aa, Mycobacterium
PETAELLDWLDKMTKRNLVIT

SEQ ID NO: 1274889 - protein, 17 aa, Mycobacterium
PETKIIVMIGEIGGDAE

SEQ ID NO: 1274890 - protein, 18 aa, Mycobacterium
PETLCLCPTAVLDASGRV

SEQ ID NO: 1274891 - protein, 18 aa, Mycobacterium
PETLTWAQLARRTMSVAR

SEQ ID NO: 1274892 - protein, 17 aa, Mycobacterium
PETMIDVVNELRAAGAE

SEQ ID NO: 1274893 - protein, 17 aa, Mycobacterium
PETNYRIGFVPQGIGAD

SEQ ID NO: 1274894 - protein, 17 aa, Mycobacterium
PETRAWEGRAHDAASAM

SEQ ID NO: 1274895 - protein, 22 aa, Mycobacterium
PETRLLIDGRLRDASTGRTADN

SEQ ID NO: 1274896 - protein, 18 aa, Mycobacterium
PETSSWAQPLSAVVVTAT

SEQ ID NO: 1274897 - protein, 21 aa, Mycobacterium
PETSVAVLLSRGPDYVVTMLG

SEQ ID NO: 1274898 - protein, 25 aa, Mycobacterium
PEVEYAREGYDMFIAMLDGMKEESV

SEQ ID NO: 1274899 - protein, 19 aa, Mycobacterium
PEVGPRHAAPEAPQTGPAP

SEQ ID NO: 1274900 - protein, 26 aa, Mycobacterium
PEVITKPRWFFSFAKHLRPPDLRVPN

SEQ ID NO: 1274901 - protein, 22 aa, Mycobacterium
PEVKQKLIQLGFAVQTLPNGKL

SEQ ID NO: 1274902 - protein, 19 aa, Mycobacterium
PEVLASARFREGLAKIPGA

SEQ ID NO: 1274903 - protein, 18 aa, Mycobacterium
PEVLRKLAADPGIQMGFS

SEQ ID NO: 1274904 - protein, 18 aa, Mycobacterium
PEVLRLCMWAQLERPEAT

SEQ ID NO: 1274905 - protein, 21 aa, Mycobacterium
PEVPPPPWLRSYRDTAQYGAG

SEQ ID NO: 1274906 - protein, 17 aa, Mycobacterium
PEVRIAFGGRIDGFADY

SEQ ID NO: 1274907 - protein, 20 aa, Mycobacterium
PEVRTGTGAIRIQLEQIHEI

SEQ ID NO: 1274908 - protein, 23 aa, Mycobacterium
PEVSGLLALFLLHHARRPARMRG

SEQ ID NO: 1274909 - protein, 21 aa, Mycobacterium
PEVSGRYLVDVGFGGQTLSSP

SEQ ID NO: 1274910 - protein, 22 aa, Mycobacterium
PEVVDATLALPVTELIADAEAI

SEQ ID NO: 1274911 - protein, 24 aa, Mycobacterium
PEVVGILCGQPFAVVAACAADLGH

SEQ ID NO: 1274912 - protein, 22 aa, Mycobacterium
PEYARRLSAMAADAGAVLETEA

SEQ ID NO: 1274913 - protein, 17 aa, Mycobacterium
PFAAEVHHVNPTCGDEV

SEQ ID NO: 1274914 - protein, 20 aa, Mycobacterium
PFAERRAALVAALADSGPSV

SEQ ID NO: 1274915 - protein, 19 aa, Mycobacterium
PFAERRAALVGALAGCGPT

SEQ ID NO: 1274916 - protein, 31 aa, Mycobacterium
PFAGHPTVGASWWLKDRGLPIKTLQVPAGIV

SEQ ID NO: 1274917 - protein, 17 aa, Mycobacterium
PFANAFSHLPLREQLTA

SEQ ID NO: 1274918 - protein, 22 aa, Mycobacterium
PFAQKRFCGAEGIENVTTASAF

SEQ ID NO: 1274919 - protein, 21 aa, Mycobacterium
PFCATRCGYCDFNTYTPAEAG

SEQ ID NO: 1274920 - protein, 21 aa, Mycobacterium
PFCAVRCGYCDFNTYTPAELG

SEQ ID NO: 1274921 - protein, 20 aa, Mycobacterium
PFDGDGMLHIVGFRDGKAFY

SEQ ID NO: 1274922 - protein, 17 aa, Mycobacterium
PFDRTWPDKVIDTAPLW

SEQ ID NO: 1274923 - protein, 19 aa, Mycobacterium
PFGGGYRLIDFVLSNLVNA

SEQ ID NO: 1274924 - protein, 19 aa, Mycobacterium
PFGGPPRKPTMLVTDVSMR

SEQ ID NO: 1274925 - protein, 18 aa, Mycobacterium
PFGPGFDFTDPDVLLQGI

SEQ ID NO: 1274926 - protein, 23 aa, Mycobacterium
PFHPTEVIARVDAVLRRTKGEEP

SEQ ID NO: 1274927 - protein, 22 aa, Mycobacterium
PFIHNGIRGVADFVVRVQDPDT

SEQ ID NO: 1274928 - protein, 21 aa, Mycobacterium
PFIPTSGCGFVIVTTTNSTGW

SEQ ID NO: 1274929 - protein, 17 aa, Mycobacterium
PFIRAASRLMWRRNDSP

SEQ ID NO: 1274930 - protein, 19 aa, Mycobacterium
PFITFRVWHPLSHDRMEVL

SEQ ID NO: 1274931 - protein, 18 aa, Mycobacterium
PFLEAGVQRIYLQLLDMS

SEQ ID NO: 1274932 - protein, 31 aa, Mycobacterium; identical to SEQ ID NO: 203982

SEQ ID NO: 1274933 - protein, 30 aa, Mycobacterium
PFLHPDVVWDFRLPRVVSINVSGHKYGLTY

SEQ ID NO: 1274934 - protein, 26 aa, Mycobacterium
PFLLAVGDLLLGWLLLHQAETALTAL

SEQ ID NO: 1274935 - protein, 19 aa, Mycobacterium
PFLVAYGARIGERLAAASS

SEQ ID NO: 1274936 - protein, 18 aa, Mycobacterium
PFNGKSMRGYASITEEEA

SEQ ID NO: 1274937 - protein, 23 aa, Mycobacterium
PFPIKEFHPFPRAMMGPGAHEMV

SEQ ID NO: 1274938 - protein, 26 aa, Mycobacterium
PFPLLRQALENVLGYGGTLVSATTGA

SEQ ID NO: 1274939 - protein, 25 aa, Mycobacterium
PFPSLFPMEEPGYWAVTRRADIAYV

SEQ ID NO: 1274940 - protein, 33 aa, Mycobacterium
PFPSTARLTGRWMRGRLPGVSDFTRGIPFVHKR

SEQ ID NO: 1274941 - protein, 23 aa, Mycobacterium
PFRGEVERLGRIVFGDSFEVDVD

SEQ ID NO: 1274942 - protein, 31 aa, Mycobacterium
PFSEWGTVFPDPRLVAAIVDRVTFNAHIIET

SEQ ID NO: 1274943 - protein, 20 aa, Mycobacterium
PFSITGSAAPPFGAAMRRST

SEQ ID NO: 1274944 - protein, 19 aa, Mycobacterium
PFTAAGLTYDVYRKGEGPG

SEQ ID NO: 1274945 - protein, 17 aa, Mycobacterium
PFVAPVLGWDAVSEEEI

SEQ ID NO: 1274946 - protein, 19 aa, Mycobacterium
PFVELNAAFYPKRDGKLPP

SEQ ID NO: 1274947 - protein, 18 aa, Mycobacterium
PFVENWNLLVSQSRGEFV

SEQ ID NO: 1274948 - protein, 25 aa, Mycobacterium
PFVLPPSVLEKMRFIHTVIDEITSN

SEQ ID NO: 1274949 - protein, 17 aa, Mycobacterium
PFYDPWFAKARTSGSIE

SEQ ID NO: 1274950 - protein, 18 aa, Mycobacterium
PGAASIALYRAFRRRAAV

SEQ ID NO: 1274951 - protein, 33 aa, Mycobacterium
PGADKPVLVGLRYRPGQTPLLAREWTSDAVEKG

SEQ ID NO: 1274952 - protein, 19 aa, Mycobacterium
PGAFCPLTASVSGYAIDYA

SEQ ID NO: 1274953 - protein, 25 aa, Mycobacterium
PGAFLGPKGHKVWKPVIAALHGIVA

SEQ ID NO: 1274954 - protein, 19 aa, Mycobacterium
PGAGGRIAVRVTMHDEGAG

SEQ ID NO: 1274955 - protein, 17 aa, Mycobacterium
PGAHAVPVDAGHASCTL

SEQ ID NO: 1274956 - protein, 18 aa, Mycobacterium
PGAINCLATRGFPTTGDS

SEQ ID NO: 1274957 - protein, 20 aa, Mycobacterium
PGAPLARAETRVGLERLLDR

SEQ ID NO: 1274958 - protein, 24 aa, Mycobacterium
PGAPPRGAPLYAPDGSPLFPGLPP

SEQ ID NO: 1274959 - protein, 18 aa, Mycobacterium
PGAPVVVLCHGFPELAFT

SEQ ID NO: 1274960 - protein, 19 aa, Mycobacterium
PGAWPETDESVFSNRASAL

SEQ ID NO: 1274961 - protein, 18 aa, Mycobacterium
PGCDAPATRCDIDHTVPW

SEQ ID NO: 1274962 - protein, 25 aa, Mycobacterium
PGCDHEIRPGTAHLVVWPADSGESA

SEQ ID NO: 1274963 - protein, 21 aa, Mycobacterium
PGCGLGCTRLRGGGPRARSRR

SEQ ID NO: 1274964 - protein, 25 aa, Mycobacterium
PGCPFAPRCPLAIDECDAAEPDLQP

SEQ ID NO: 1274965 - protein, 18 aa, Mycobacterium
PGCSAFLAPTMVARLVQT

SEQ ID NO: 1274966 - protein, 26 aa, Mycobacterium
PGDAPQPPFLWALLSFARRELDNLFA

SEQ ID NO: 1274967 - protein, 20 aa, Mycobacterium
PGDASALCGTPSGVPTATPF

SEQ ID NO: 1274968 - protein, 23 aa, Mycobacterium
PGDDAWCARLRTEVAGTLLDTGA

SEQ ID NO: 1274969 - protein, 18 aa, Mycobacterium
PGDEGYQPFNTRGANAKH

SEQ ID NO: 1274970 - protein, 20 aa, Mycobacterium
PGDPAVRAHRQFEATGDPEA

SEQ ID NO: 1274971 - protein, 21 aa, Mycobacterium
PGDPRGNCSRVIDPCLDDEGK

SEQ ID NO: 1274972 - protein, 18 aa, Mycobacterium
PGDQLVLGASNPVRDIAL

SEQ ID NO: 1274973 - protein, 20 aa, Mycobacterium
PGDRARIVADPELIPRAVEE

SEQ ID NO: 1274974 - protein, 30 aa, Mycobacterium
PGDRLLDVGCGWGGMVRYAARHGVKTVGVT

SEQ ID NO: 1274975 - protein, 19 aa, Mycobacterium
PGDRWCVTATNWLRAHRDG

SEQ ID NO: 1274976 - protein, 25 aa, Mycobacterium
PGDRWIYEQIRAVAPRTTLIAIVTK

SEQ ID NO: 1274977 - protein, 18 aa, Mycobacterium
PGDTLALHFASIEPARSW

SEQ ID NO: 1274978 - protein, 18 aa, Mycobacterium
PGDVWTAQFAQLGHVTAC

SEQ ID NO: 1274979 - protein, 22 aa, Mycobacterium
PGEADPAVYARALADRAFMDGH

SEQ ID NO: 1274980 - protein, 20 aa, Mycobacterium
PGEGATAGWLKLDRPDALER

SEQ ID NO: 1274981 - protein, 22 aa, Mycobacterium
PGEIPFVVGLGGTLRANSSTER

SEQ ID NO: 1274982 - protein, 22 aa, Mycobacterium
PGEIRRLTILFADLVDSTSLST

SEQ ID NO: 1274983 - protein, 23 aa, Mycobacterium
PGEIRRLTIMFADLVDSTVLSTE

SEQ ID NO: 1274984 - protein, 24 aa, Mycobacterium
PGEISGGMRKRAGLARSLVLDPQI

SEQ ID NO: 1274985 - protein, 20 aa, Mycobacterium
PGELRITLMRADVLAEPIAL

SEQ ID NO: 1274986 - protein, 25 aa, Mycobacterium
PGEPGYERCVPWNVAAPVTPAAVVL

SEQ ID NO: 1274987 - protein, 21 aa, Mycobacterium
PGEPLTCRHLQAILWGTSHAG

SEQ ID NO: 1274988 - protein, 18 aa, Mycobacterium
PGEPSDPSSPSFSPASPP

SEQ ID NO: 1274989 - protein, 18 aa, Mycobacterium
PGEQILVTRKPLGVVGVV

SEQ ID NO: 1274990 - protein, 19 aa, Mycobacterium
PGERTRAGLALLQACGTNV

SEQ ID NO: 1274991 - protein, 24 aa, Mycobacterium
PGESWIRPEVDLVKGESMTPLERL

SEQ ID NO: 1274992 - protein, 17 aa, Mycobacterium
PGESWPQRLAEAGAVTV

SEQ ID NO: 1274993 - protein, 18 aa, Mycobacterium
PGEVDGVDYFFVTAEQFQ

SEQ ID NO: 1274994 - protein, 20 aa, Mycobacterium
PGFTALDFIGPYESLRWLPD

SEQ ID NO: 1274995 - protein, 18 aa, Mycobacterium
PGGAGFAARGFRTMDRWW

SEQ ID NO: 1274996 - protein, 18 aa, Mycobacterium
PGGAIVVHRAALGGRAGD

SEQ ID NO: 1274997 - protein, 25 aa, Mycobacterium
PGGCAGLRYNLFFDDRSLDGDLTVD

SEQ ID NO: 1274998 - protein, 24 aa, Mycobacterium
PGGDVKRLGGWDAVLLYNETPNLH

SEQ ID NO: 1274999 - protein, 18 aa, Mycobacterium
PGGFGMAFADAALDAGDR

SEQ ID NO: 1275000 - protein, 18 aa, Mycobacterium
PGGFGMAFAEAALEAGDR

SEQ ID NO: 1275001 - protein, 19 aa, Mycobacterium
PGGFRLRPPVGCEIVDGAA

SEQ ID NO: 1275002 - protein, 27 aa, Mycobacterium
PGGGMMPMGGMPMAGMPGGAGQGGGAD

SEQ ID NO: 1275003 - protein, 24 aa, Mycobacterium
PGGGRGGGVTALFAGDSGTGKTMA

SEQ ID NO: 1275004 - protein, 18 aa, Mycobacterium
PGGLAVLSYTVWLGPFGG

SEQ ID NO: 1275005 - protein, 24 aa, Mycobacterium
PGGLTCVIQRGGAYGCSGPIPAAP

SEQ ID NO: 1275006 - protein, 17 aa, Mycobacterium
PGGQMIFDLPPTMVKKI

SEQ ID NO: 1275007 - protein, 23 aa, Mycobacterium
PGGQTQFAAPVWMPRARRTPIRD

SEQ ID NO: 1275008 - protein, 26 aa, Mycobacterium
PGGRDEIWRFTPLKRLRGLHDGSAPA

SEQ ID NO: 1275009 - protein, 27 aa, Mycobacterium
PGGRDEIWRFTPLRRLRGLHDGSAVAS

SEQ ID NO: 1275010 - protein, 20 aa, Mycobacterium
PGGRGGRRGGPRGGGRSRRG

SEQ ID NO: 1275011 - protein, 17 aa, Mycobacterium
PGGRLVVCEFSTPTNKL

SEQ ID NO: 1275012 - protein, 22 aa, Mycobacterium
PGGSIRSVFQPHLFSDLISEVV

SEQ ID NO: 1275013 - protein, 23 aa, Mycobacterium
PGGTPAKWARIWAERHPEAPLQL

SEQ ID NO: 1275014 - protein, 17 aa, Mycobacterium
PGGVVLYATCSPHLAET

SEQ ID NO: 1275015 - protein, 17 aa, Mycobacterium
PGGWYVGVVAISVDGPL

SEQ ID NO: 1275016 - protein, 21 aa, Mycobacterium
PGGYLKAAVDFALERDDYGPE

SEQ ID NO: 1275017 - protein, 22 aa, Mycobacterium
PGHCTPELTVGLGRLAAEHGLR

SEQ ID NO: 1275018 - protein, 26 aa, Mycobacterium
PGHFMDDFLLYWAFLSYALVRGGRRT

SEQ ID NO: 1275019 - protein, 18 aa, Mycobacterium
PGHGRGRRAHPFTIADLA

SEQ ID NO: 1275020 - protein, 18 aa, Mycobacterium
PGHKGGRTIDPWLRENIA

SEQ ID NO: 1275021 - protein, 24 aa, Mycobacterium
PGHRLMENWHPLGVVGVITAFNFP

SEQ ID NO: 1275022 - protein, 25 aa, Mycobacterium
PGHSQWYIDRFRAMARAGDDLVGEA

SEQ ID NO: 1275023 - protein, 22 aa, Mycobacterium
PGHSRWYIERFRAMARAGDDLA

SEQ ID NO: 1275024 - protein, 33 aa, Mycobacterium
PGHVLPVRCPHVPRNAQDLVWDRMVRIVERAGC

SEQ ID NO: 1275025 - protein, 19 aa, Mycobacterium
PGIDGHISVVVGRVAARSA

SEQ ID NO: 1275026 - protein, 18 aa, Mycobacterium
PGIIDALATMRIDGEAPP

SEQ ID NO: 1275027 - protein, 25 aa, Mycobacterium
PGIISGELIVAVAMTEPGAGSDLAG

SEQ ID NO: 1275028 - protein, 19 aa, Mycobacterium
PGIREMTGFDWQARHDREF

SEQ ID NO: 1275029 - protein, 22 aa, Mycobacterium
PGKGLRFGRVRIKIGPPMDFSR

SEQ ID NO: 1275030 - protein, 17 aa, Mycobacterium
PGKLFGRSRSFPLTNRD

SEQ ID NO: 1275031 - protein, 20 aa, Mycobacterium
PGLDKDFHARWFGWVNPAQT

SEQ ID NO: 1275032 - protein, 25 aa, Mycobacterium
PGLELSTGVAVAFPRSPFVTAASAW

SEQ ID NO: 1275033 - protein, 25 aa, Mycobacterium
PGLFDLPRLAALGLHELSINIELFN

SEQ ID NO: 1275034 - protein, 23 aa, Mycobacterium
PGLGASPVWHVFAIDQAGIVFGE

SEQ ID NO: 1275035 - protein, 18 aa, Mycobacterium
PGLGGPVAPCHHGAYDPH

SEQ ID NO: 1275036 - protein, 18 aa, Mycobacterium
PGLHPPPPVVSVTGVSHR

SEQ ID NO: 1275037 - protein, 23 aa, Mycobacterium
PGLHRPRTLLGQRLNDLVKTTYS

SEQ ID NO: 1275038 - protein, 24 aa, Mycobacterium
PGLHRPRTLLGQRLNELVKDTYSE

SEQ ID NO: 1275039 - protein, 19 aa, Mycobacterium
PGLIDELGTLTWRELDSHS

SEQ ID NO: 1275040 - protein, 19 aa, Mycobacterium
PGLISELNRLVPDLVATST

SEQ ID NO: 1275041 - protein, 19 aa, Mycobacterium
PGLLCYTQTLTLWQGIDRL

SEQ ID NO: 1275042 - protein, 23 aa, Mycobacterium
PGLLRARRPELYGELVAPQADAY

SEQ ID NO: 1275043 - protein, 18 aa, Mycobacterium
PGLLRFLPQLAETLLGET

SEQ ID NO: 1275044 - protein, 18 aa, Mycobacterium
PGLLRHFADYTSHPFEYY

SEQ ID NO: 1275045 - protein, 22 aa, Mycobacterium
PGLMHVRFGPYHVRDVKFVAAF

SEQ ID NO: 1275046 - protein, 24 aa, Mycobacterium
PGLMTLDGTNTWVLRGPGSDEMVV

SEQ ID NO: 1275047 - protein, 18 aa, Mycobacterium
PGLMTSADLPLRGFAGRF

SEQ ID NO: 1275048 - protein, 18 aa, Mycobacterium
PGLNTRGLVKLANLTVEG

SEQ ID NO: 1275049 - protein, 18 aa, Mycobacterium
PGLPGALYRAFGTAQQMA

SEQ ID NO: 1275050 - protein, 24 aa, Mycobacterium
PGLPLRLDPNAAWTPHTAVKVASG

SEQ ID NO: 1275051 - protein, 17 aa, Mycobacterium
PGLPPGDPWRVLEPFAR

SEQ ID NO: 1275052 - protein, 21 aa, Mycobacterium
PGLQRLPLWRSLRERIEEADR

SEQ ID NO: 1275053 - protein, 19 aa, Mycobacterium
PGLRRLVTHIFVRGDEYLG

SEQ ID NO: 1275054 - protein, 25 aa, Mycobacterium
PGLRWPDLSLAGGRVGFSALRDALP

SEQ ID NO: 1275055 - protein, 26 aa, Mycobacterium
PGLSFIGLPWMHTWGSGRFLGVDSDA

SEQ ID NO: 1275056 - protein, 18 aa, Mycobacterium
PGLTIPGKLDKLGYKGID

SEQ ID NO: 1275057 - protein, 31 aa, Mycobacterium
PGLVLDTDLRWRIVTALARAGVIDADGTQTP

SEQ ID NO: 1275058 - protein, 26 aa, Mycobacterium
PGLVTVGVWPALALPPLVTPVPGLGY

SEQ ID NO: 1275059 - protein, 22 aa, Mycobacterium
PGMDPAVAAAVFLATLGRMTEP

SEQ ID NO: 1275060 - protein, 19 aa, Mycobacterium
PGMLAEWLELPGAAQRIQA

SEQ ID NO: 1275061 - protein, 18 aa, Mycobacterium
PGMNGIDVCRVLRADSGV

SEQ ID NO: 1275062 - protein, 30 aa, Mycobacterium
PGMPTRPYSMRILGGSWPSTSPESWSDTAS

SEQ ID NO: 1275063 - protein, 20 aa, Mycobacterium
PGMPVFRGLTLSVTPGAVTA

SEQ ID NO: 1275064 - protein, 23 aa, Mycobacterium
PGMVMKAPIWGAALDEICSPETL

SEQ ID NO: 1275065 - protein, 18 aa, Mycobacterium
PGMWVRFQAADADARSSS

SEQ ID NO: 1275066 - protein, 23 aa, Mycobacterium
PGNLAAVCARVGAGLIHVSTDYV

SEQ ID NO: 1275067 - protein, 23 aa, Mycobacterium
PGNLRGPALEEFVRNAASTYWHP

SEQ ID NO: 1275068 - protein, 22 aa, Mycobacterium
PGNSVQVTLAFDVAPGTVPAML

SEQ ID NO: 1275069 - protein, 20 aa, Mycobacterium
PGNYRFRADGTVGFVDFGCV

SEQ ID NO: 1275070 - protein, 25 aa, Mycobacterium
PGPALVVRPFLKYQIITVAAPETAA

SEQ ID NO: 1275071 - protein, 19 aa, Mycobacterium
PGPDDVRRAVREGREGNLV

SEQ ID NO: 1275072 - protein, 21 aa, Mycobacterium
PGPDGMTLCRTLRQRGEHTVP

SEQ ID NO: 1275073 - protein, 21 aa, Mycobacterium
PGPDRVPLLALLRSTPLTEDQ

SEQ ID NO: 1275074 - protein, 17 aa, Mycobacterium
PGPFLSWAALIDSGGVA

SEQ ID NO: 1275075 - protein, 17 aa, Mycobacterium
PGPLVVIAGAGAGKTET

SEQ ID NO: 1275076 - protein, 20 aa, Mycobacterium
PGPPRPGYLERILDGARHHD

SEQ ID NO: 1275077 - protein, 19 aa, Mycobacterium
PGPPVLLGAVFGEWDEAIG

SEQ ID NO: 1275078 - protein, 19 aa, Mycobacterium
PGPQFEWVDQHGDWYSSEV

SEQ ID NO: 1275079 - protein, 22 aa, Mycobacterium
PGPQRAALLTAFGQRRSPTPDP

SEQ ID NO: 1275080 - protein, 22 aa, Mycobacterium
PGPRGSIVKLMYAELAKEIGKL

SEQ ID NO: 1275081 - protein, 22 aa, Mycobacterium
PGPVNGLRGWRSPALPEFDPFW

SEQ ID NO: 1275082 - protein, 17 aa, Mycobacterium
PGPWHLDALPLVISAAD

SEQ ID NO: 1275083 - protein, 24 aa, Mycobacterium
PGPWKESMRLLAEEVMPRLNARIA

SEQ ID NO: 1275084 - protein, 33 aa, Mycobacterium
PGPYPWKNHRNAWRPAHIHFSFFGTEFTQRMVT

SEQ ID NO: 1275085 - protein, 20 aa, Mycobacterium
PGQALKDLLVMLAAGPSAVA

SEQ ID NO: 1275086 - protein, 19 aa, Mycobacterium
PGQIRRRAPLLGEHTDEIL

SEQ ID NO: 1275087 - protein, 25 aa, Mycobacterium
PGQKRARVSFAPDRGFVDFGQLFSA

SEQ ID NO: 1275088 - protein, 26 aa, Mycobacterium
PGQNGGRGGLLFGNGGRGGDAVLPGQ

SEQ ID NO: 1275089 - protein, 19 aa, Mycobacterium
PGQPDEIGALIAFLLSDVC

SEQ ID NO: 1275090 - protein, 20 aa, Mycobacterium
PGQPRVGLAQVYGAPGTASA

SEQ ID NO: 1275091 - protein, 26 aa, Mycobacterium
PGQTRPDWQLICRIAAELGFGADFTY

SEQ ID NO: 1275092 - protein, 17 aa, Mycobacterium
PGRAALLLGDRATSMTR

SEQ ID NO: 1275093 - protein, 26 aa, Mycobacterium
PGRDAPGALCRWCGREEPALRCTRCG

SEQ ID NO: 1275094 - protein, 24 aa, Mycobacterium
PGRDPRPAFTTATFAAGVEKVADL

SEQ ID NO: 1275095 - protein, 21 aa, Mycobacterium
PGRGPALLWIHGGGYVIGDAA

SEQ ID NO: 1275096 - protein, 24 aa, Mycobacterium
PGRHWDHRWALSVLNSALGGGLSS

SEQ ID NO: 1275097 - protein, 25 aa, Mycobacterium
PGRNFLRKFLPGHWAYLQTLMSDLT

SEQ ID NO: 1275098 - protein, 23 aa, Mycobacterium
PGRPALRAGMPMRADFQTRRDGA

SEQ ID NO: 1275099 - protein, 25 aa, Mycobacterium
PGRPKAPSFLDEWIRARTDTTAQLG

SEQ ID NO: 1275100 - protein, 20 aa, Mycobacterium
PGRRRVAVLRDWLSNELSEP

SEQ ID NO: 1275101 - protein, 17 aa, Mycobacterium
PGRSDAYDRAWQFASHI

SEQ ID NO: 1275102 - protein, 28 aa, Mycobacterium
PGRYRRVESFRQLWAVSVDVSRAAATFD

SEQ ID NO: 1275103 - protein, 19 aa, Mycobacterium
PGSALLFPTLCTPTAEAPI

SEQ ID NO: 1275104 - protein, 19 aa, Mycobacterium
PGSDSFLFPVLCAPQDAAA

SEQ ID NO: 1275105 - protein, 22 aa, Mycobacterium
PGSDSLLRMRLDLEECATGVTK

SEQ ID NO: 1275106 - protein, 17 aa, Mycobacterium
PGSEVSDMFSGRPLATV

SEQ ID NO: 1275107 - protein, 22 aa, Mycobacterium
PGSGRTALLMTLAGRMRPASGS

SEQ ID NO: 1275108 - protein, 18 aa, Mycobacterium
PGSIRIGFDRIWDPDRDG

SEQ ID NO: 1275109 - protein, 20 aa, Mycobacterium
PGSQAWRLQLRQVDRMVESI

SEQ ID NO: 1275110 - protein, 22 aa, Mycobacterium
PGSRAAGIAMAYKLIDAAQARW

SEQ ID NO: 1275111 - protein, 19 aa, Mycobacterium
PGSREGWDYPDMAREAGTK

SEQ ID NO: 1275112 - protein, 31 aa, Mycobacterium
PGSRVAVLLPAHWQTAAVLFGIWWIGAEAVL

SEQ ID NO: 1275113 - protein, 24 aa, Mycobacterium
PGSRWRCVNIPAISTAGVPDALGR

SEQ ID NO: 1275114 - protein, 27 aa, Mycobacterium
PGSSPALWAVAAWVRRQATQAIDGFLA

SEQ ID NO: 1275115 - protein, 27 aa, Mycobacterium
PGSSPALWAVAAWVRRQTTQAIDGFLA

SEQ ID NO: 1275116 - protein, 20 aa, Mycobacterium
PGSVDLFFLLGVADVDALRW

SEQ ID NO: 1275117 - protein, 25 aa, Mycobacterium
PGTDRRFEVVITFDRERVATAARSL

SEQ ID NO: 1275118 - protein, 20 aa, Mycobacterium
PGTDVGWHYVASRAVRLDDV

SEQ ID NO: 1275119 - protein, 19 aa, Mycobacterium
PGTGESIYQAVDFVVGGGA

SEQ ID NO: 1275120 - protein, 23 aa, Mycobacterium
PGTICTREGGFLTGWEPDEFDAE

SEQ ID NO: 1275121 - protein, 18 aa, Mycobacterium
PGTLHAFEHDGVVPDIVT

SEQ ID NO: 1275122 - protein, 17 aa, Mycobacterium
PGTPVVIGRDVAGQREH

SEQ ID NO: 1275123 - protein, 28 aa, Mycobacterium
PGTRAAMRAGIYWLHEAVGFAMTKQPRL

SEQ ID NO: 1275124 - protein, 23 aa, Mycobacterium
PGTRLPTVRELAGQINLAVNTVA

SEQ ID NO: 1275125 - protein, 24 aa, Mycobacterium
PGTRLPTVRELAGQMGLAVNTVAR

SEQ ID NO: 1275126 - protein, 21 aa, Mycobacterium
PGTSETACHAALFSTDAQTFL

SEQ ID NO: 1275127 - protein, 29 aa, Mycobacterium
PGTVAIPHGWGHKGGWQLANRSGGANVNE

SEQ ID NO: 1275128 - protein, 20 aa, Mycobacterium
PGVADLRGPVIAMLSDFSDG

SEQ ID NO: 1275129 - protein, 25 aa, Mycobacterium
PGVDIQRSLPVFGWQDQHGHCEIVF

SEQ ID NO: 1275130 - protein, 22 aa, Mycobacterium
PGVGAKSLFLLLFTSGTTGTSK

SEQ ID NO: 1275131 - protein, 20 aa, Mycobacterium
PGVIALPHGWGHDGTGGWRL

SEQ ID NO: 1275132 - protein, 28 aa, Mycobacterium
PGVLARVASLFSRRGFNIQSLAVGATEQ

SEQ ID NO: 1275133 - protein, 17 aa, Mycobacterium
PGVLSAVSAEFSKREVS

SEQ ID NO: 1275134 - protein, 24 aa, Mycobacterium
PGVPMIFPPWFEKLQIKYINPVIR

SEQ ID NO: 1275135 - protein, 25 aa, Mycobacterium
PGVPSRKDSLTWAGFLDCNSTAFPL

SEQ ID NO: 1275136 - protein, 18 aa, Mycobacterium
PGVRAIRADVERRVRDGL

SEQ ID NO: 1275137 - protein, 22 aa, Mycobacterium
PGVTERGWAPIVRFGVAPRLRG

SEQ ID NO: 1275138 - protein, 27 aa, Mycobacterium
PGVTPQMWDWWFGWHGSDTRRYKLWHP

SEQ ID NO: 1275139 - protein, 17 aa, Mycobacterium
PGYKGQDIFARGVSPEQ

SEQ ID NO: 1275140 - protein, 18 aa, Mycobacterium
PGYNEFFPALLDEGICVF

SEQ ID NO: 1275141 - protein, 20 aa, Mycobacterium
PGYTSMWARMYASDAAAADR

SEQ ID NO: 1275142 - protein, 18 aa, Mycobacterium
PHAADIRAALALENALLD

SEQ ID NO: 1275143 - protein, 22 aa, Mycobacterium
PHAGEHGFHWIVVAVTEQPQNA

SEQ ID NO: 1275144 - protein, 24 aa, Mycobacterium
PHANACLTCPVFITTPEFLPQHRE

SEQ ID NO: 1275145 - protein, 22 aa, Mycobacterium
PHAPEPRWQAQLHVVTAGDKPS

SEQ ID NO: 1275146 - protein, 23 aa, Mycobacterium
PHAQLPPPAVLGIDMAGVVEAVG

SEQ ID NO: 1275147 - protein, 21 aa, Mycobacterium
PHATCPGGPIAEFEPPADDYV

SEQ ID NO: 1275148 - protein, 24 aa, Mycobacterium
PHCPHPWDDLWLDTMVRHPLRDSW

SEQ ID NO: 1275149 - protein, 19 aa, Mycobacterium
PHCQEMFEAVLAGATAPDI

SEQ ID NO: 1275150 - protein, 20 aa, Mycobacterium
PHCRTYRYGVDRDTVRGLNG

SEQ ID NO: 1275151 - protein, 21 aa, Mycobacterium
PHDSSLHLIELTGSAPASACK

SEQ ID NO: 1275152 - protein, 32 aa, Mycobacterium
PHDVPWFPKDVDHWSVRWVALHLIEELTRHAG

SEQ ID NO: 1275153 - protein, 18 aa, Mycobacterium
PHDYRTRADWYLPTQADG

SEQ ID NO: 1275154 - protein, 17 aa, Mycobacterium
PHEGVDFTGKRVGVIGT

SEQ ID NO: 1275155 - protein, 17 aa, Mycobacterium
PHGLTIGLVLAETLERE

SEQ ID NO: 1275156 - protein, 18 aa, Mycobacterium
PHGPAFVATFCELAATVM

SEQ ID NO: 1275157 - protein, 26 aa, Mycobacterium
PHGPVRFPGVPTWFSRTPGKVRGPAP

SEQ ID NO: 1275158 - protein, 21 aa, Mycobacterium
PHHHRLHHRGVITITGPADQL

SEQ ID NO: 1275159 - protein, 20 aa, Mycobacterium
PHHHRLHHRGVITITGPAER

SEQ ID NO: 1275160 - protein, 21 aa, Mycobacterium
PHHHRLHHRGVITITGPAERL

SEQ ID NO: 1275161 - protein, 18 aa, Mycobacterium
PHHRVVLRQQIFGYTYEE

SEQ ID NO: 1275162 - protein, 22 aa, Mycobacterium
PHHTRPVRFVWVQDASVRVGLL

SEQ ID NO: 1275163 - protein, 24 aa, Mycobacterium
PHIPTTRYIPAFKLTRSSAAYWRG

SEQ ID NO: 1275164 - protein, 17 aa, Mycobacterium
PHLAFGCGEHSCLGAQL

SEQ ID NO: 1275165 - protein, 26 aa, Mycobacterium
PHLDRRKAYLGTMVAGIQMLRSGVTT

SEQ ID NO: 1275166 - protein, 25 aa, Mycobacterium
PHLEAFKAKGYEVLLLTDPVDEVWV

SEQ ID NO: 1275167 - protein, 17 aa, Mycobacterium
PHLSVACDPDFASAAWR

SEQ ID NO: 1275168 - protein, 24 aa, Mycobacterium
PHMRPACWDAMLTLMRAMASAYPD

SEQ ID NO: 1275169 - protein, 23 aa, Mycobacterium
PHPATGLPVLGFVTYGRVKLANL

SEQ ID NO: 1275170 - protein, 19 aa, Mycobacterium
PHPRRIRAILDGRTVIDTE

SEQ ID NO: 1275171 - protein, 17 aa, Mycobacterium
PHRARMIAVGLVSISVD

SEQ ID NO: 1275172 - protein, 17 aa, Mycobacterium
PHRGGPLADGLADERVV

SEQ ID NO: 1275173 - protein, 18 aa, Mycobacterium
PHRGRLNVLANIVGKPYS

SEQ ID NO: 1275174 - protein, 19 aa, Mycobacterium
PHRGRLNVLANIVGKPYSQ

SEQ ID NO: 1275175 - protein, 20 aa, Mycobacterium
PHRRYHLLPLSARTPEALVR

SEQ ID NO: 1275176 - protein, 18 aa, Mycobacterium
PHRVCRYLEDLAGDYHRF

SEQ ID NO: 1275177 - protein, 17 aa, Mycobacterium
PHSLGENVVPAFTPPCR

SEQ ID NO: 1275178 - protein, 25 aa, Mycobacterium
PHSVGEVAATLWARRSHEPVRAAVI

SEQ ID NO: 1275179 - protein, 17 aa, Mycobacterium
PHSYSYRIVRSVPAFDH

SEQ ID NO: 1275180 - protein, 19 aa, Mycobacterium
PHTGTAVLGMFAGLEVGVW

SEQ ID NO: 1275181 - protein, 20 aa, Mycobacterium
PHTITCVLLSVSESWFYKWI

SEQ ID NO: 1275182 - protein, 24 aa, Mycobacterium
PHTKPPNFWAWLIGEVKNTDPDVL

SEQ ID NO: 1275183 - protein, 21 aa, Mycobacterium
PHVAMTVSMLRDAGVEVDDTE

SEQ ID NO: 1275184 - protein, 26 aa, Mycobacterium
PHVPADWLRMMLAFNRNQLQWFADPD

SEQ ID NO: 1275185 - protein, 20 aa, Mycobacterium
PHVRSALPDATWTIVGREPS

SEQ ID NO: 1275186 - protein, 17 aa, Mycobacterium
PHVSIGLVAAREMVRLA

SEQ ID NO: 1275187 - protein, 27 aa, Mycobacterium
PHYRPSAKLAAFVRARDLFCRFPGCDV

SEQ ID NO: 1275188 - protein, 27 aa, Mycobacterium
PIAELCARCHVTLIGLVHFGKRESRDP

SEQ ID NO: 1275189 - protein, 20 aa, Mycobacterium
PIAQGGMQWVGRAELVAAVA

SEQ ID NO: 1275190 - protein, 19 aa, Mycobacterium
PIAVIGLGLRLPGGADLDS

SEQ ID NO: 1275191 - protein, 18 aa, Mycobacterium
PIDEADLREALQESDADL

SEQ ID NO: 1275192 - protein, 21 aa, Mycobacterium
PIDTVLTARGWLREAEGRKAF

SEQ ID NO: 1275193 - protein, 17 aa, Mycobacterium
PIERLKVAIQLLFESSR

SEQ ID NO: 1275194 - protein, 25 aa, Mycobacterium
PIEWSAARYRRLMVLRDERQRVLAE

SEQ ID NO: 1275195 - protein, 19 aa, Mycobacterium
PIGASGLRQVHELVRQLRG

SEQ ID NO: 1275196 - protein, 25 aa, Mycobacterium
PIGAWPVVPVPTGFLDWQRQIGQDI

SEQ ID NO: 1275197 - protein, 18 aa, Mycobacterium
PIGDAVGYTVRFTDQASD

SEQ ID NO: 1275198 - protein, 18 aa, Mycobacterium
PIGGPAFDDAVRVLAPEG

SEQ ID NO: 1275199 - protein, 17 aa, Mycobacterium
PIGKPKINTAIHILDDA

SEQ ID NO: 1275200 - protein, 18 aa, Mycobacterium
PIHEGALLLDDAASHQAV

SEQ ID NO: 1275201 - protein, 20 aa, Mycobacterium
PILAHAPAPLPVTLGAKTIS

SEQ ID NO: 1275202 - protein, 25 aa, Mycobacterium
PILIPGRPAYLFGAGFMPAPLFDAL

SEQ ID NO: 1275203 - protein, 23 aa, Mycobacterium
PILLKLQLPMARNMREEARQHAG

SEQ ID NO: 1275204 - protein, 18 aa, Mycobacterium
PILLPRLAASLFEIEPRC

SEQ ID NO: 1275205 - protein, 25 aa, Mycobacterium
PILNARFALNAANARWGSLYDALYG

SEQ ID NO: 1275206 - protein, 19 aa, Mycobacterium
PINECQDIRGARPATTALP

SEQ ID NO: 1275207 - protein, 25 aa, Mycobacterium
PINFGRPAAGIAEFGHLCLDAPDVR

SEQ ID NO: 1275208 - protein, 23 aa, Mycobacterium
PINPEAWRWYRLAFGGDNTPVVD

SEQ ID NO: 1275209 - protein, 26 aa, Mycobacterium
PIPGGKSALGLWSWAIPANSAAPDAA

SEQ ID NO: 1275210 - protein, 31 aa, Mycobacterium
PIPGGVVANVRWADCQITRRFVDVTFVNCDF

SEQ ID NO: 1275211 - protein, 18 aa, Mycobacterium
PIPLPGMVAGELSISAGG

SEQ ID NO: 1275212 - protein, 26 aa, Mycobacterium
PIPVPMAYFSFGGWKASLFGDSHAHG

SEQ ID NO: 1275213 - protein, 20 aa, Mycobacterium
PIRARFRGVDVYEMPPPGQG

SEQ ID NO: 1275214 - protein, 17 aa, Mycobacterium
PIRARVKSVNRIPAADS

SEQ ID NO: 1275215 - protein, 17 aa, Mycobacterium
PIRDPRTSQVIGVVDVS

SEQ ID NO: 1275216 - protein, 20 aa, Mycobacterium
PIRLEPQWLTPTAYMMAKFG

SEQ ID NO: 1275217 - protein, 17 aa, Mycobacterium
PIRLRTVASATFTRPEI

SEQ ID NO: 1275218 - protein, 25 aa, Mycobacterium
PISAPRWLPTPARRRARAASSTLHK

SEQ ID NO: 1275219 - protein, 22 aa, Mycobacterium
PISEADILWDLASRLEGRMTAI

SEQ ID NO: 1275220 - protein, 24 aa, Mycobacterium
PISFRPLERTQIRALGLLKGACAQ

SEQ ID NO: 1275221 - protein, 27 aa, Mycobacterium
PISNLKLGSGIAPWRKLRDAGVNLGLG

SEQ ID NO: 1275222 - protein, 17 aa, Mycobacterium
PITAWVDVFAGAATNLG

SEQ ID NO: 1275223 - protein, 24 aa, Mycobacterium
PITESVAWGRDWRDTAVTIGADVG

SEQ ID NO: 1275224 - protein, 21 aa, Mycobacterium
PITGFPGWSHYGASKAAQMGF

SEQ ID NO: 1275225 - protein, 22 aa, Mycobacterium
PITPGHEVAGWVDGVGSAVPKS

SEQ ID NO: 1275226 - protein, 18 aa, Mycobacterium
PITRRWLDHPEEMNEAFA

SEQ ID NO: 1275227 - protein, 26 aa, Mycobacterium
PIVIRGEPFGSLYLADDRPDFAFAEA

SEQ ID NO: 1275228 - protein, 24 aa, Mycobacterium
PIVLPGMVVPIELDDAARAAVDAA

SEQ ID NO: 1275229 - protein, 20 aa, Mycobacterium
PIVLSRFGIKIVGRSRRLTL

SEQ ID NO: 1275230 - protein, 32 aa, Mycobacterium
PIVLVDFWASWCGPCRAFAPVFERSSQTHPDV

SEQ ID NO: 1275231 - protein, 27 aa, Mycobacterium
PIVRRACSGWFPRTLWSGKLVLTAEGG

SEQ ID NO: 1275232 - protein, 20 aa, Mycobacterium
PIYADYGVSGGYSILREHSL

SEQ ID NO: 1275233 - protein, 21 aa, Mycobacterium
PIYLGALGPRLTRATAEVADG

SEQ ID NO: 1275234 - protein, 19 aa, Mycobacterium
PKAAVRFADIPGRTAQVTI

SEQ ID NO: 1275235 - protein, 17 aa, Mycobacterium
PKALLANGVRYLVDPRV

SEQ ID NO: 1275236 - protein, 25 aa, Mycobacterium
PKAPALAEVMPWNQLPGAVRRVTQA

SEQ ID NO: 1275237 - protein, 24 aa, Mycobacterium
PKAPALAEVMPWNQLPGPVRRVTQ

SEQ ID NO: 1275238 - protein, 17 aa, Mycobacterium
PKAREKAFTDLRQLLAV

SEQ ID NO: 1275239 - protein, 25 aa, Mycobacterium
PKASIGNSWLGKIMGGLAGAAPSLP

SEQ ID NO: 1275240 - protein, 25 aa, Mycobacterium
PKATAEAFAGGWFHSGDLVRQDEEG

SEQ ID NO: 1275241 - protein, 23 aa, Mycobacterium
PKAVHPLVWRLVAPVFNPLAAFL

SEQ ID NO: 1275242 - protein, 25 aa, Mycobacterium
PKAVKRPGAPYADAVAQWESVESFV

SEQ ID NO: 1275243 - protein, 27 aa, Mycobacterium
PKAVSPWWIQRRLLLSGIRAISPAVDV

SEQ ID NO: 1275244 - protein, 19 aa, Mycobacterium
PKCRFWNLTLWNQYMAALD

SEQ ID NO: 1275245 - protein, 20 aa, Mycobacterium
PKDIERICHLYDSFRNEHGT

SEQ ID NO: 1275246 - protein, 26 aa, Mycobacterium
PKDILQGECTFAWPPQFELPGYKPNT

SEQ ID NO: 1275247 - protein, 19 aa, Mycobacterium
PKDRMPIFPVPEGHDQGSW

SEQ ID NO: 1275248 - protein, 18 aa, Mycobacterium
PKEARGCLGQIPAAAKPK

SEQ ID NO: 1275249 - protein, 24 aa, Mycobacterium
PKELPRGCIAAGDRAFFCDYALDY

SEQ ID NO: 1275250 - protein, 18 aa, Mycobacterium
PKGGGPGPHFHRGMSEAF

SEQ ID NO: 1275251 - protein, 23 aa, Mycobacterium
PKGPWLRTGDLGVMFDDELYIIG

SEQ ID NO: 1275252 - protein, 21 aa, Mycobacterium
PKIRLGRFADGPTMWANGETV

SEQ ID NO: 1275253 - protein, 19 aa, Mycobacterium
PKITALINLLIPFEALSEP

SEQ ID NO: 1275254 - protein, 19 aa, Mycobacterium
PKITLACEVCKHRNYITKK

SEQ ID NO: 1275255 - protein, 24 aa, Mycobacterium
PKKLLEEWLGLWSEHYQLPERLHV

SEQ ID NO: 1275256 - protein, 22 aa, Mycobacterium
PKKPTFLDDWLRQRTGETEVAG

SEQ ID NO: 1275257 - protein, 19 aa, Mycobacterium
PKLADRMLARWTERFAQWV

SEQ ID NO: 1275258 - protein, 17 aa, Mycobacterium
PKLPGTVYTAAKEIEEV

SEQ ID NO: 1275259 - protein, 19 aa, Mycobacterium
PKLPHPAELLSRIGHKHAS

SEQ ID NO: 1275260 - protein, 22 aa, Mycobacterium
PKLPTDPSLRPAAAGGGGSGGG

SEQ ID NO: 1275261 - protein, 18 aa, Mycobacterium
PKLTYELAPRLDYADIVC

SEQ ID NO: 1275262 - protein, 18 aa, Mycobacterium
PKLWNWIAVSGIFLVLNS

SEQ ID NO: 1275263 - protein, 25 aa, Mycobacterium
PKMRVVRAALHLRRERPETFLSGGY

SEQ ID NO: 1275264 - protein, 23 aa, Mycobacterium
PKPARPAALLCRFPGGGWVLSRM

SEQ ID NO: 1275265 - protein, 23 aa, Mycobacterium
PKPARPAALLCRLPGGGWVLSRM

SEQ ID NO: 1275266 - protein, 20 aa, Mycobacterium
PKPDACVQIGGDFTFSTAAW

SEQ ID NO: 1275267 - protein, 21 aa, Mycobacterium
PKPGDEFHVQAGLVMLAYAAA

SEQ ID NO: 1275268 - protein, 23 aa, Mycobacterium
PKPISSPHPTVWLGGDADAVLRR

SEQ ID NO: 1275269 - protein, 17 aa, Mycobacterium
PKPKAVHPLVWRLVAPV

SEQ ID NO: 1275270 - protein, 21 aa, Mycobacterium
PKPLTDIAFAFVGDGRNNVAN

SEQ ID NO: 1275271 - protein, 20 aa, Mycobacterium
PKPTAIWAVPSGEGLVAITQ

SEQ ID NO: 1275272 - protein, 31 aa, Mycobacterium
PKQADEFTCSSCFLVHHRSRLASEKNGVMIC

SEQ ID NO: 1275273 - protein, 21 aa, Mycobacterium
PKQQVRCVYVAIGQKGTTIAS

SEQ ID NO: 1275274 - protein, 17 aa, Mycobacterium
PKRAFAVAERRTAHVRH

SEQ ID NO: 1275275 - protein, 29 aa, Mycobacterium
PKRIPSFPDLPGIHVLRNFDESLALRQEA

SEQ ID NO: 1275276 - protein, 25 aa, Mycobacterium
PKRPGARKSAGISYFLMDMTTPGVD

SEQ ID NO: 1275277 - protein, 23 aa, Mycobacterium
PKRSQANFAYYARRALANHPDAL

SEQ ID NO: 1275278 - protein, 21 aa, Mycobacterium
PKRVAIMASREDHCLLDLLWR

SEQ ID NO: 1275279 - protein, 17 aa, Mycobacterium
PKSETRRVFDMVTRRYW

SEQ ID NO: 1275280 - protein, 19 aa, Mycobacterium
PKSPQWAAQICGLDADDLT

SEQ ID NO: 1275281 - protein, 24 aa, Mycobacterium
PKSRARGLLTGWEPHRRGIYCGTV

SEQ ID NO: 1275282 - protein, 21 aa, Mycobacterium
PKSRGHLALRSADPVDPIDIH

SEQ ID NO: 1275283 - protein, 23 aa, Mycobacterium
PKTFDYLSSLEWIRAQQNLAIIG

SEQ ID NO: 1275284 - protein, 21 aa, Mycobacterium
PKTTTGGWVFLPRTFTITCRC

SEQ ID NO: 1275285 - protein, 44 aa, Mycobacterium
PKTVPIPEFLGACFDAGLSWVHFPEGFGGLGLSRGLQAVADRIL

SEQ ID NO: 1275286 - protein, 18 aa, Mycobacterium
PKVAELFLAGRLSARLVA

SEQ ID NO: 1275287 - protein, 18 aa, Mycobacterium
PKVTATFFNPKYLKNTLV

SEQ ID NO: 1275288 - protein, 20 aa, Mycobacterium
PKWDSRYGVLHDRVSELLPM

SEQ ID NO: 1275289 - protein, 23 aa, Mycobacterium
PKWGESVLAMVVARPGEITGTEL

SEQ ID NO: 1275290 - protein, 17 aa, Mycobacterium
PKWTATAADLVFGSNSV

SEQ ID NO: 1275291 - protein, 26 aa, Mycobacterium
PKYEIVFKFVMGFPVWLTAKALGPRA

SEQ ID NO: 1275292 - protein, 19 aa, Mycobacterium
PLAAAEVVELVVFGAHLRG

SEQ ID NO: 1275293 - protein, 25 aa, Mycobacterium
PLAALKRPGSFLARQVPQFMRLLES

SEQ ID NO: 1275294 - protein, 23 aa, Mycobacterium
PLAAPPARRALAFCTPRDVIARN

SEQ ID NO: 1275295 - protein, 21 aa, Mycobacterium
PLADADAWLVAVVRDDEVVDH

SEQ ID NO: 1275296 - protein, 18 aa, Mycobacterium
PLADRGCITLAIHPAMTF

SEQ ID NO: 1275297 - protein, 19 aa, Mycobacterium
PLAHFVSCLVYLPRDRYTT

SEQ ID NO: 1275298 - protein, 18 aa, Mycobacterium
PLALARPDVHVILIEPLL

SEQ ID NO: 1275299 - protein, 19 aa, Mycobacterium
PLAPALFRAQAKRADHNRL

SEQ ID NO: 1275300 - protein, 19 aa, Mycobacterium
PLAPGMPAVIMLTSDHQLL

SEQ ID NO: 1275301 - protein, 18 aa, Mycobacterium
PLARLWSTALAGLVDIGY

SEQ ID NO: 1275302 - protein, 18 aa, Mycobacterium
PLARRLEQSYARRIKALP

SEQ ID NO: 1275303 - protein, 26 aa, Mycobacterium
PLAVGRSRLGAGLTREQERLGVDELH

SEQ ID NO: 1275304 - protein, 20 aa, Mycobacterium
PLCEAMCGLAVETVGAQVRT

SEQ ID NO: 1275305 - protein, 27 aa, Mycobacterium
PLDATHFVRWLSLWSSTIDDMYRGPVA

SEQ ID NO: 1275306 - protein, 18 aa, Mycobacterium
PLDGPWASAVRSIAERAG

SEQ ID NO: 1275307 - protein, 17 aa, Mycobacterium
PLDNRWAHYLHSRSSEM

SEQ ID NO: 1275308 - protein, 19 aa, Mycobacterium
PLDPACRIPSAQAGRAQGR

SEQ ID NO: 1275309 - protein, 21 aa, Mycobacterium
PLDRPFAWALIKLDGADTPLL

SEQ ID NO: 1275310 - protein, 25 aa, Mycobacterium
PLDRSRPLWEMYLIEGLAGGRIAVL

SEQ ID NO: 1275311 - protein, 21 aa, Mycobacterium
PLDRTRPLWEMWVIENVAGTD

SEQ ID NO: 1275312 - protein, 17 aa, Mycobacterium
PLDVEWRRRCGRGLGGV

SEQ ID NO: 1275313 - protein, 24 aa, Mycobacterium
PLEDAWRCSQVEMVGWMTELYGLG

SEQ ID NO: 1275314 - protein, 20 aa, Mycobacterium
PLEFSRPRLPSGKGDAVEFT

SEQ ID NO: 1275315 - protein, 20 aa, Mycobacterium
PLEPSIPGMDTFGGSSLFTS

SEQ ID NO: 1275316 - protein, 24 aa, Mycobacterium
PLEQSRRAALVWGHTEMGDAGFAT

SEQ ID NO: 1275317 - protein, 18 aa, Mycobacterium
PLERAFRVFTERFGDFKP

SEQ ID NO: 1275318 - protein, 19 aa, Mycobacterium
PLEVPVFHYTRRWLQKMTA

SEQ ID NO: 1275319 - protein, 22 aa, Mycobacterium
PLEVWLTARWGAHTRKAGRTWW

SEQ ID NO: 1275320 - protein, 18 aa, Mycobacterium
PLFDESLPVPDIATTQCV

SEQ ID NO: 1275321 - protein, 17 aa, Mycobacterium
PLFESLRTFVERDQAPF

SEQ ID NO: 1275322 - protein, 24 aa, Mycobacterium
PLFPDVPDDLPYVWPTSDRERRIP

SEQ ID NO: 1275323 - protein, 20 aa, Mycobacterium
PLFQSHMWDGSAVPIDENLS

SEQ ID NO: 1275324 - protein, 20 aa, Mycobacterium
PLFTDFAPRLLVSHPSEVKV

SEQ ID NO: 1275325 - protein, 24 aa, Mycobacterium
PLFVIGGSLLGGWKGADLGEAVGN

SEQ ID NO: 1275326 - protein, 18 aa, Mycobacterium
PLGATGLAQCAELTWQLR

SEQ ID NO: 1275327 - protein, 23 aa, Mycobacterium
PLGATGLAQCAELVWQLRGHAQA

SEQ ID NO: 1275328 - protein, 19 aa, Mycobacterium
PLGATGLAQCSELTWQLRG

SEQ ID NO: 1275329 - protein, 18 aa, Mycobacterium
PLGEAVGYTVRFTDQASD

SEQ ID NO: 1275330 - protein, 17 aa, Mycobacterium
PLGELLPDAFGPDDLAR

SEQ ID NO: 1275331 - protein, 18 aa, Mycobacterium
PLGQRLAKVAFDRTGSLE

SEQ ID NO: 1275332 - protein, 18 aa, Mycobacterium
PLGRHFPFDPSQAEIPDP

SEQ ID NO: 1275333 - protein, 25 aa, Mycobacterium
PLGRRIQPGVGRRMQRAWLDFARGS

SEQ ID NO: 1275334 - protein, 17 aa, Mycobacterium
PLGRWWRDMKLARVGGG

SEQ ID NO: 1275335 - protein, 18 aa, Mycobacterium
PLGSYEVGDFARLARERK

SEQ ID NO: 1275336 - protein, 22 aa, Mycobacterium
PLHHFPTKRMCNLASVTSFYFH

SEQ ID NO: 1275337 - protein, 17 aa, Mycobacterium
PLHKVLAVWANRGRIAG

SEQ ID NO: 1275338 - protein, 17 aa, Mycobacterium
PLHPALKYYHPFDGDGM

SEQ ID NO: 1275339 - protein, 17 aa, Mycobacterium
PLHRRFGIAATVRASFA

SEQ ID NO: 1275340 - protein, 18 aa, Mycobacterium
PLHWSGMGATHATELLAV

SEQ ID NO: 1275341 - protein, 26 aa, Mycobacterium
PLIEVIGGLGIRLSSYLPTRTFELAV

SEQ ID NO: 1275342 - protein, 18 aa, Mycobacterium
PLIEVLLDLTQRIYTDFT

SEQ ID NO: 1275343 - protein, 17 aa, Mycobacterium
PLIKAARAAGAQVITGA

SEQ ID NO: 1275344 - protein, 19 aa, Mycobacterium
PLINIHHSFLPAFIGASPY

SEQ ID NO: 1275345 - protein, 17 aa, Mycobacterium
PLITEALRGEGAKLIDR

SEQ ID NO: 1275346 - protein, 24 aa, Mycobacterium
PLKGKPPNVYGFALSKARVKDEFD

SEQ ID NO: 1275347 - protein, 18 aa, Mycobacterium
PLKGRYVDYNGVEIIPTP

SEQ ID NO: 1275348 - protein, 19 aa, Mycobacterium
PLKLDDVRLLPPITPTSTV

SEQ ID NO: 1275349 - protein, 17 aa, Mycobacterium
PLKRHILALNEIDAMQF

SEQ ID NO: 1275350 - protein, 17 aa, Mycobacterium
PLLAQGIRHGFRAETEL

SEQ ID NO: 1275351 - protein, 18 aa, Mycobacterium
PLLDELVDLLGRDKSAEE

SEQ ID NO: 1275352 - protein, 41 aa, Mycobacterium
PLLFVHGAWHAAWCWDEHFLDFFAGRGYRALAVSLRGHGGS

SEQ ID NO: 1275353 - protein, 18 aa, Mycobacterium
PLLGLTWLPFMGQRYTSM

SEQ ID NO: 1275354 - protein, 18 aa, Mycobacterium
PLLHEAMWAVAPPDAGLR

SEQ ID NO: 1275355 - protein, 24 aa, Mycobacterium
PLLLDWRAPAARAFYVATGANPEN

SEQ ID NO: 1275356 - protein, 21 aa, Mycobacterium
PLLQMSWKVAPALAAGCTMVM

SEQ ID NO: 1275357 - protein, 24 aa, Mycobacterium
PLLQRLRTATALYADARGHITRLI

SEQ ID NO: 1275358 - protein, 22 aa, Mycobacterium
PLLRRFPVLVPTGVGFMKNAGL

SEQ ID NO: 1275359 - protein, 25 aa, Mycobacterium
PLLTPLRLIGLGWLADELNEPLKEI

SEQ ID NO: 1275360 - protein, 17 aa, Mycobacterium
PLMPSTWGAAPTTAADS

SEQ ID NO: 1275361 - protein, 19 aa, Mycobacterium
PLNIRLMHIMSPMDHSKAV

SEQ ID NO: 1275362 - protein, 19 aa, Mycobacterium
PLPAMPVAHGLGLGFDPPV

SEQ ID NO: 1275363 - protein, 18 aa, Mycobacterium
PLPDGFGATMLEYRDWLE

SEQ ID NO: 1275364 - protein, 23 aa, Mycobacterium
PLPDNEILSFLYLEARLADEGRY

SEQ ID NO: 1275365 - protein, 22 aa, Mycobacterium
PLPGARMRYGLQLPTEAPAGTR

SEQ ID NO: 1275366 - protein, 21 aa, Mycobacterium
PLPGGEVAWWLVEDSDRSARD

SEQ ID NO: 1275367 - protein, 23 aa, Mycobacterium
PLPGHLWAQYGLAGVLEHEGFVR

SEQ ID NO: 1275368 - protein, 25 aa, Mycobacterium
PLPGPLKWDLTTGIATATTQSLANS

SEQ ID NO: 1275369 - protein, 24 aa, Mycobacterium
PLPGPRLPHDMAFTENYVILNDFP

SEQ ID NO: 1275370 - protein, 28 aa, Mycobacterium
PLPGYPRPGGTVLFLGRFDEPRKGMSVL

SEQ ID NO: 1275371 - protein, 18 aa, Mycobacterium
PLPIRWGPHTPGAVAKAP

SEQ ID NO: 1275372 - protein, 32 aa, Mycobacterium
PLPNEVPVPSDLLCVGTDWSATQGDSATTPVN

SEQ ID NO: 1275373 - protein, 23 aa, Mycobacterium
PLPPEGASAIVFRDVDHAPELAA

SEQ ID NO: 1275374 - protein, 17 aa, Mycobacterium
PLQCALSTVGIDRLIFS

SEQ ID NO: 1275375 - protein, 24 aa, Mycobacterium
PLQNLFLALTFEWGIALHGVNLDR

SEQ ID NO: 1275376 - protein, 22 aa, Mycobacterium
PLRGRFKIGVMGKGGVGKTTVS

SEQ ID NO: 1275377 - protein, 24 aa, Mycobacterium
PLRNMLLAVIFEWGIALHGIHSER

SEQ ID NO: 1275378 - protein, 24 aa, Mycobacterium
PLRQLFTVRIGLRLTEATQTTMVL

SEQ ID NO: 1275379 - protein, 21 aa, Mycobacterium
PLRRLPFGLSSTRDHLTRVAG

SEQ ID NO: 1275380 - protein, 18 aa, Mycobacterium
PLRRPSGLRTLWRMDLTR

SEQ ID NO: 1275381 - protein, 25 aa, Mycobacterium
PLRVLQSCRIRWGTVVSVDTEHVML

SEQ ID NO: 1275382 - protein, 20 aa, Mycobacterium
PLRVRPRRGAAAAHYERADG

SEQ ID NO: 1275383 - protein, 18 aa, Mycobacterium
PLRYGELAAELNAEPGER

SEQ ID NO: 1275384 - protein, 25 aa, Mycobacterium
PLSAKLELLAAIAATGVREMEATAF

SEQ ID NO: 1275385 - protein, 19 aa, Mycobacterium
PLSEIKQAPSFFDSADLEV

SEQ ID NO: 1275386 - protein, 22 aa, Mycobacterium
PLSGVLFGLVGPVIGPVLALAS

SEQ ID NO: 1275387 - protein, 17 aa, Mycobacterium
PLSKRMPGLGVIKHRGR

SEQ ID NO: 1275388 - protein, 20 aa, Mycobacterium
PLSLGRLDRGWVVASETAAL

SEQ ID NO: 1275389 - protein, 18 aa, Mycobacterium
PLSPYGFSGWVGPEPHGA

SEQ ID NO: 1275390 - protein, 18 aa, Mycobacterium
PLSREFRSLLDRVPPADT

SEQ ID NO: 1275391 - protein, 19 aa, Mycobacterium
PLSSAERRAILKFLETGVD

SEQ ID NO: 1275392 - protein, 19 aa, Mycobacterium
PLSSDDWDTQMLFFLQRGY

SEQ ID NO: 1275393 - protein, 19 aa, Mycobacterium
PLTDAVRRVCHKGLSVDDA

SEQ ID NO: 1275394 - protein, 24 aa, Mycobacterium
PLTDIGWLELLWMQPVGITSHPGA

SEQ ID NO: 1275395 - protein, 23 aa, Mycobacterium
PLTEFAPVPGMGWMFVADPDGNH

SEQ ID NO: 1275396 - protein, 23 aa, Mycobacterium
PLTELRPAPRLGEHNEALSVANW

SEQ ID NO: 1275397 - protein, 18 aa, Mycobacterium
PLTISAPDWDRWLDPDAP

SEQ ID NO: 1275398 - protein, 27 aa, Mycobacterium
PLTLKPEVCWQLPIRRTQEWITRPDGS

SEQ ID NO: 1275399 - protein, 19 aa, Mycobacterium
PLTQPRLLSDMPVDHIGYI

SEQ ID NO: 1275400 - protein, 19 aa, Mycobacterium
PLVCVVGVDHQWGLEVGVY

SEQ ID NO: 1275401 - protein, 19 aa, Mycobacterium
PLVDYLGDMAWYLDLITQK

SEQ ID NO: 1275402 - protein, 26 aa, Mycobacterium
PLVGPGCPTVLIGGRVAAVVGDLAGC

SEQ ID NO: 1275403 - protein, 32 aa, Mycobacterium
PLVILLHGFGSFWWSWRHQLAGLTGARVVAVD

SEQ ID NO: 1275404 - protein, 26 aa, Mycobacterium
PLVKDSFRKLWFGWSDPARVLVEYAQ

SEQ ID NO: 1275405 - protein, 26 aa, Mycobacterium
PLVKSLDLPGGMGQHFFFDAGNGDCV

SEQ ID NO: 1275406 - protein, 25 aa, Mycobacterium
PLVLRLGTDLLRFRGVVTAAEQVAK

SEQ ID NO: 1275407 - protein, 18 aa, Mycobacterium
PLVNRLVVEWDTPRVWHR

SEQ ID NO: 1275408 - protein, 17 aa, Mycobacterium
PLVPLYLRRPDAKPPRA

SEQ ID NO: 1275409 - protein, 24 aa, Mycobacterium
PLVRAAVGFTDLWVYPGEAETYCD

SEQ ID NO: 1275410 - protein, 17 aa, Mycobacterium
PLVSEISDLLRLGYYGS

SEQ ID NO: 1275411 - protein, 17 aa, Mycobacterium
PLVSRAHWNSVASYVPD

SEQ ID NO: 1275412 - protein, 17 aa, Mycobacterium
PLVVLIHGFPESWYSWR

SEQ ID NO: 1275413 - protein, 17 aa, Mycobacterium
PLVVWGAHRLWTKDHPK

SEQ ID NO: 1275414 - protein, 17 aa, Mycobacterium
PLWEATLVDGLDNDGAA

SEQ ID NO: 1275415 - protein, 19 aa, Mycobacterium
PLWTACTSLAGGTPVHYLC

SEQ ID NO: 1275416 - protein, 25 aa, Mycobacterium
PLYGDCAFLPDWPGVPVGNEEGEII

SEQ ID NO: 1275417 - protein, 20 aa, Mycobacterium
PMAAGHPVAMIGGGPAPFQP

SEQ ID NO: 1275418 - protein, 22 aa, Mycobacterium
PMAGRVEGKVAFITGAARGQGR

SEQ ID NO: 1275419 - protein, 18 aa, Mycobacterium
PMAVCANGAVIYDPSTDR

SEQ ID NO: 1275420 - protein, 25 aa, Mycobacterium
PMDPAASQCWAEWFEQLAAAFEALR

SEQ ID NO: 1275421 - protein, 19 aa, Mycobacterium
PMDRWTPAEIEAHVRYMED

SEQ ID NO: 1275422 - protein, 22 aa, Mycobacterium
PMEELIAAFLPVLFPGLEVVEH

SEQ ID NO: 1275423 - protein, 19 aa, Mycobacterium
PMEHKAYLHRSGRTARAGS

SEQ ID NO: 1275424 - protein, 20 aa, Mycobacterium
PMFETMAAFMLVEHANGAMF

SEQ ID NO: 1275425 - protein, 22 aa, Mycobacterium
PMGRVAAELADLVVVTDDNPRD

SEQ ID NO: 1275426 - protein, 26 aa, Mycobacterium
PMIADPFTKLHCCIRSDGGAAAVLVS

SEQ ID NO: 1275427 - protein, 18 aa, Mycobacterium
PMILGCSYINRLTGYGGN

SEQ ID NO: 1275428 - protein, 19 aa, Mycobacterium
PMINVGGLDYEIWDDDWTV

SEQ ID NO: 1275429 - protein, 26 aa, Mycobacterium
PMIRKGAMKSTEWIAAYENQNVDIGL

SEQ ID NO: 1275430 - protein, 23 aa, Mycobacterium
PMLHELHAATGLVVHLAVLDGSD

SEQ ID NO: 1275431 - protein, 17 aa, Mycobacterium
PMLPLDGGAIFAAPDAV

SEQ ID NO: 1275432 - protein, 23 aa, Mycobacterium
PMLPTAELRTEWWDMMIERVGSR

SEQ ID NO: 1275433 - protein, 22 aa, Mycobacterium
PMLQAAAGWEAFAISLETQADE

SEQ ID NO: 1275434 - protein, 17 aa, Mycobacterium
PMMPGMGGMPGMGGMAG

SEQ ID NO: 1275435 - protein, 25 aa, Mycobacterium
PMPAEVQRFASFFLTMDPPQHTTYR

SEQ ID NO: 1275436 - protein, 17 aa, Mycobacterium
PMPFILSSRTLFGPQSG

SEQ ID NO: 1275437 - protein, 22 aa, Mycobacterium
PMPLPTLFSRWYGPIAPVKAVR

SEQ ID NO: 1275438 - protein, 18 aa, Mycobacterium
PMSAMLHGAVMEGSFGSE

SEQ ID NO: 1275439 - protein, 18 aa, Mycobacterium
PMSPRYATADSVGRDELL

SEQ ID NO: 1275440 - protein, 20 aa, Mycobacterium
PMSVPAGALISGRRSIAGSM

SEQ ID NO: 1275441 - protein, 30 aa, Mycobacterium
PMTISVSFHEPVRWDGWLLYSHESTQVGAG

SEQ ID NO: 1275442 - protein, 31 aa, Mycobacterium
PMTVSVSFHEPVRWDGWLLYSHESTQVGAGM

SEQ ID NO: 1275443 - protein, 17 aa, Mycobacterium
PMVAEILVTGAIAVAAV

SEQ ID NO: 1275444 - protein, 21 aa, Mycobacterium
PMVDQIRFFAGAARVLEGKSA

SEQ ID NO: 1275445 - protein, 23 aa, Mycobacterium
PNAARLGLAGWPRAAEESIVARD

SEQ ID NO: 1275446 - protein, 20 aa, Mycobacterium
PNAFRRKEISVEEIMASPVL

SEQ ID NO: 1275447 - protein, 17 aa, Mycobacterium
PNAGLLIGNGGTGAAGV

SEQ ID NO: 1275448 - protein, 17 aa, Mycobacterium
PNALLGGDFYDFVQTPD

SEQ ID NO: 1275449 - protein, 19 aa, Mycobacterium
PNALRHIWVARGGDREPST

SEQ ID NO: 1275450 - protein, 19 aa, Mycobacterium
PNAPMLVGGGVSALAPGRF

SEQ ID NO: 1275451 - protein, 18 aa, Mycobacterium
PNAVSVRLTYWLVTRAET

SEQ ID NO: 1275452 - protein, 18 aa, Mycobacterium
PNDERFLALGGWKDKDEA

SEQ ID NO: 1275453 - protein, 22 aa, Mycobacterium
PNDPRVLSIAQFWERAARPDLI

SEQ ID NO: 1275454 - protein, 24 aa, Mycobacterium
PNDWQSVFGGPAWTRVDRGPLEGQ

SEQ ID NO: 1275455 - protein, 22 aa, Mycobacterium
PNESVCGYCYQAAKRITGICAC

SEQ ID NO: 1275456 - protein, 26 aa, Mycobacterium
PNFAAGRLSYFLGVRGPAVVSDTACS

SEQ ID NO: 1275457 - protein, 24 aa, Mycobacterium
PNFAIGAVLSMHFAQQAAKYFESV

SEQ ID NO: 1275458 - protein, 26 aa, Mycobacterium
PNFAIGAVLSMHFAQQAARFFESVEV

SEQ ID NO: 1275459 - protein, 18 aa, Mycobacterium
PNFAYALFAKRLRRQAKP

SEQ ID NO: 1275460 - protein, 22 aa, Mycobacterium
PNFPDGGLYKFRVHGADGSVTD

SEQ ID NO: 1275461 - protein, 21 aa, Mycobacterium
PNGCMATSGSLIRWLQTLIGG

SEQ ID NO: 1275462 - protein, 21 aa, Mycobacterium
PNGDPHVGHAYEYIATDAVAR

SEQ ID NO: 1275463 - protein, 20 aa, Mycobacterium
PNGRQGAAYVARVNNENILD

SEQ ID NO: 1275464 - protein, 18 aa, Mycobacterium
PNGTHTWMYWGQQLQQMK

SEQ ID NO: 1275465 - protein, 20 aa, Mycobacterium
PNHGVVVRDVITGNFIYTPT

SEQ ID NO: 1275466 - protein, 21 aa, Mycobacterium
PNHTWLRGSWEHQEIDPRLPF

SEQ ID NO: 1275467 - protein, 24 aa, Mycobacterium
PNISSTRWRTVVDHKSLRYFFESA

SEQ ID NO: 1275468 - protein, 22 aa, Mycobacterium
PNKHLSFGYGVHFCLGAALARM

SEQ ID NO: 1275469 - protein, 32 aa, Mycobacterium
PNKHLSFGYGVHFCLGAALARMEINSFFTELI

SEQ ID NO: 1275470 - protein, 19 aa, Mycobacterium
PNKRRYEVVNALDDERLAD

SEQ ID NO: 1275471 - protein, 19 aa, Mycobacterium
PNLPAAWVAALRAESGSNG

SEQ ID NO: 1275472 - protein, 23 aa, Mycobacterium
PNPAILTRGVIRAVMGLPSGAPA

SEQ ID NO: 1275473 - protein, 23 aa, Mycobacterium
PNPESPEGIALGDEILAFAMANA

SEQ ID NO: 1275474 - protein, 19 aa, Mycobacterium
PNPLILLKGLVRTLVGLPS

SEQ ID NO: 1275475 - protein, 21 aa, Mycobacterium
PNPPASWGWGTMAHLFVGSLA

SEQ ID NO: 1275476 - protein, 22 aa, Mycobacterium
PNQERHGFIWAVLTAGATIDVD

SEQ ID NO: 1275477 - protein, 20 aa, Mycobacterium
PNRDCGSFAAGGFGSAGAYR

SEQ ID NO: 1275478 - protein, 18 aa, Mycobacterium
PNRDRVWVASSCTNEVVG

SEQ ID NO: 1275479 - protein, 24 aa, Mycobacterium
PNRGFLRCVAALARAADTIGETDE

SEQ ID NO: 1275480 - protein, 22 aa, Mycobacterium
PNRGKRSVGIDVSKPGGQEVLY

SEQ ID NO: 1275481 - protein, 23 aa, Mycobacterium
PNRRLEIGNTWFVETARRTGVNT

SEQ ID NO: 1275482 - protein, 18 aa, Mycobacterium
PNSAAMKAFFVYDEPFWR

SEQ ID NO: 1275483 - protein, 34 aa, Mycobacterium
PNSFFFSTPMEWQQRLWPTEEFELARSRVPVTLP

SEQ ID NO: 1275484 - protein, 17 aa, Mycobacterium
PNSGLTWIRQAHVQAVL

SEQ ID NO: 1275485 - protein, 21 aa, Mycobacterium
PNSHMAFGFGTHFCLGNQLAR

SEQ ID NO: 1275486 - protein, 17 aa, Mycobacterium
PNVCPTLHMPLQSGSDR

SEQ ID NO: 1275487 - protein, 19 aa, Mycobacterium
PNVELFRRLARTMEFDEES

SEQ ID NO: 1275488 - protein, 25 aa, Mycobacterium
PNVPEAFAVIADRVGGDGLYSSNAQ

SEQ ID NO: 1275489 - protein, 19 aa, Mycobacterium
PNVRDVFDGFKMVDLIADL

SEQ ID NO: 1275490 - protein, 18 aa, Mycobacterium
PNVRVRLNGRWHRGTAHL

SEQ ID NO: 1275491 - protein, 18 aa, Mycobacterium
PPAALVLRSPFTSLADVG

SEQ ID NO: 1275492 - protein, 22 aa, Mycobacterium
PPAAVSVPYFWSDQYDVKIQAL

SEQ ID NO: 1275493 - protein, 18 aa, Mycobacterium
PPAGTLTGIAKRELRGVP

SEQ ID NO: 1275494 - protein, 23 aa, Mycobacterium
PPAIGEFDLPVALQKASDVLLKT

SEQ ID NO: 1275495 - protein, 24 aa, Mycobacterium
PPALERAWHARGYYGSVSHNVKAV

SEQ ID NO: 1275496 - protein, 23 aa, Mycobacterium
PPANPRVGCRLSDRRADRGQQCQ

SEQ ID NO: 1275497 - protein, 26 aa, Mycobacterium
PPAPPAPGAPIFGEAGVAAPPLPPAP

SEQ ID NO: 1275498 - protein, 19 aa, Mycobacterium
PPAPPRWEQAPDFDLDFHM

SEQ ID NO: 1275499 - protein, 18 aa, Mycobacterium
PPARARRLATLIVAAVEG

SEQ ID NO: 1275500 - protein, 19 aa, Mycobacterium
PPARLSVPALMRGYLRLGA

SEQ ID NO: 1275501 - protein, 32 aa, Mycobacterium
PPASGPVATAWARPSRGRGTSSARTPFRSSSP

SEQ ID NO: 1275502 - protein, 21 aa, Mycobacterium
PPASLMIRMGRLSDRFAKMRA

SEQ ID NO: 1275503 - protein, 21 aa, Mycobacterium
PPATYFSGGKLQWLLENVDGL

SEQ ID NO: 1275504 - protein, 23 aa, Mycobacterium
PPAWFKYPQYRARVVKEPRSVLA

SEQ ID NO: 1275505 - protein, 18 aa, Mycobacterium
PPAWIGVGTLDLFHDEDL

SEQ ID NO: 1275506 - protein, 24 aa, Mycobacterium
PPDAARWHAAVGIAVDSWLRTGGD

SEQ ID NO: 1275507 - protein, 21 aa, Mycobacterium
PPDELNLILVDFKGGATFLGL

SEQ ID NO: 1275508 - protein, 19 aa, Mycobacterium
PPDGRLVLCLHGFPDSAWG

SEQ ID NO: 1275509 - protein, 28 aa, Mycobacterium
PPDHTRLRWLVSKAFVPKVVKALEPDIV

SEQ ID NO: 1275510 - protein, 23 aa, Mycobacterium
PPDLDPADARACDGDIQWLSAAD

SEQ ID NO: 1275511 - protein, 23 aa, Mycobacterium
PPDLRIPFDPREVIARIVDGSEF

SEQ ID NO: 1275512 - protein, 20 aa, Mycobacterium
PPDSRPTRRTGGQVDGAPED

SEQ ID NO: 1275513 - protein, 24 aa, Mycobacterium
PPDVGARLAAGVREGRKYLSQLRP

SEQ ID NO: 1275514 - protein, 19 aa, Mycobacterium
PPDVGSRFTAHWKVGSVPI

SEQ ID NO: 1275515 - protein, 29 aa, Mycobacterium
PPELKLRVREILEFAIGFLDEDPRRSRLL

SEQ ID NO: 1275516 - protein, 20 aa, Mycobacterium
PPERVIGSSVGLDFADGHLR

SEQ ID NO: 1275517 - protein, 19 aa, Mycobacterium
PPEVHPFLVGTQAHPELKS

SEQ ID NO: 1275518 - protein, 27 aa, Mycobacterium
PPEVMRRLTSELPLPVNAIARPESADP

SEQ ID NO: 1275519 - protein, 18 aa, Mycobacterium
PPEVRAFDDLGGLATDRM

SEQ ID NO: 1275520 - protein, 24 aa, Mycobacterium
PPFIRADLAPGWLAQVRDPRPLLG

SEQ ID NO: 1275521 - protein, 31 aa, Mycobacterium
PPFQLPWYVPCFKYLREMGALDDDGTVKADV

SEQ ID NO: 1275522 - protein, 20 aa, Mycobacterium
PPGARWKFLAENAKGLPAAG

SEQ ID NO: 1275523 - protein, 23 aa, Mycobacterium
PPGATGVAQCYELFNQLRGEAEN

SEQ ID NO: 1275524 - protein, 19 aa, Mycobacterium
PPGDSYRYLSTVTDFYAKA

SEQ ID NO: 1275525 - protein, 17 aa, Mycobacterium
PPGGLRIRLVYVDGDPV

SEQ ID NO: 1275526 - protein, 18 aa, Mycobacterium
PPGGWTPHEILPVERALT

SEQ ID NO: 1275527 - protein, 28 aa, Mycobacterium
PPGHADMRTELPWLFLAGAGQHPGGGLS

SEQ ID NO: 1275528 - protein, 26 aa, Mycobacterium
PPGKHAASAFALWFPVETDHARYGEM

SEQ ID NO: 1275529 - protein, 26 aa, Mycobacterium
PPGKHAVSAFALWFPLSEERASYGEM

SEQ ID NO: 1275530 - protein, 26 aa, Mycobacterium
PPGKPRYADVYSWAKTRGAIDVDESH

SEQ ID NO: 1275531 - protein, 19 aa, Mycobacterium
PPGLLMSLGFAPQWVPGYL

SEQ ID NO: 1275532 - protein, 19 aa, Mycobacterium
PPGNIPLLLIAAVRDQVGA

SEQ ID NO: 1275533 - protein, 23 aa, Mycobacterium
PPGNPRGITSFGDLTRPGTQVVV

SEQ ID NO: 1275534 - protein, 17 aa, Mycobacterium
PPGPRFGVDGSLERFIR

SEQ ID NO: 1275535 - protein, 17 aa, Mycobacterium
PPGRTGGDFTFPMEFAR

SEQ ID NO: 1275536 - protein, 20 aa, Mycobacterium
PPHKVRDGYANFAIEDPPLK

SEQ ID NO: 1275537 - protein, 23 aa, Mycobacterium
PPHRLVLGGDGFDAVKAELEAAL

SEQ ID NO: 1275538 - protein, 24 aa, Mycobacterium
PPIELVGSFLRPSEYFSKYPTATD

SEQ ID NO: 1275539 - protein, 23 aa, Mycobacterium
PPIPEFYGGAVYFDGADTAAVLH

SEQ ID NO: 1275540 - protein, 17 aa, Mycobacterium
PPIWGAFPPEINTSRLQ

SEQ ID NO: 1275541 - protein, 19 aa, Mycobacterium
PPKDLPYYGSWGTWTDENQ

SEQ ID NO: 1275542 - protein, 21 aa, Mycobacterium
PPKGQHWRLLSSVKELDPAWV

SEQ ID NO: 1275543 - protein, 19 aa, Mycobacterium
PPKNLRRLLEVNVEGPFAV

SEQ ID NO: 1275544 - protein, 37 aa, Mycobacterium
PPKPIEIIGNLLPPAVKWKAFFARQAKNPKYLRHGDV

SEQ ID NO: 1275545 - protein, 18 aa, Mycobacterium
PPKVTAPGGSRCTAHGGR

SEQ ID NO: 1275546 - protein, 18 aa, Mycobacterium
PPLCIDVEAADFYVDTLD

SEQ ID NO: 1275547 - protein, 19 aa, Mycobacterium
PPLEAFEVEKVIEFDLPDG

SEQ ID NO: 1275548 - protein, 25 aa, Mycobacterium
PPLHRCDRTAVSMPRNNRGRGSFDM

SEQ ID NO: 1275549 - protein, 17 aa, Mycobacterium
PPLKLVLLENPGNGGSI

SEQ ID NO: 1275550 - protein, 17 aa, Mycobacterium
PPLKLVLLQNPGKGGTI

SEQ ID NO: 1275551 - protein, 17 aa, Mycobacterium
PPLLQRMVEAGQLGKKS

SEQ ID NO: 1275552 - protein, 17 aa, Mycobacterium
PPLPAVRTALAASLDCL

SEQ ID NO: 1275553 - protein, 24 aa, Mycobacterium
PPLREVSDAVALRRALADGVIDCV

SEQ ID NO: 1275554 - protein, 27 aa, Mycobacterium
PPLRLNLPTPEEFIASIPAPVVTCLCG

SEQ ID NO: 1275555 - protein, 25 aa, Mycobacterium
PPLRTLYRDRLLVLAALDVASTVEN

SEQ ID NO: 1275556 - protein, 19 aa, Mycobacterium
PPMPRLADAFMDLIDTAWD

SEQ ID NO: 1275557 - protein, 21 aa, Mycobacterium
PPNAGTLIRLFHAETTELEVD

SEQ ID NO: 1275558 - protein, 24 aa, Mycobacterium
PPNHPPMRTFLGVPVRIRDEVFGN

SEQ ID NO: 1275559 - protein, 17 aa, Mycobacterium
PPPAFPVSEVVSAARSG

SEQ ID NO: 1275560 - protein, 25 aa, Mycobacterium
PPPAPPRWQDCTDFDLDFHMRRVAA

SEQ ID NO: 1275561 - protein, 22 aa, Mycobacterium
PPPELKAAVITVGPDDVSGPRW

SEQ ID NO: 1275562 - protein, 23 aa, Mycobacterium
PPPHRLVLGGDGFDVAVAALEQT

SEQ ID NO: 1275563 - protein, 18 aa, Mycobacterium
PPPLSPAVEAVRPSAAEE

SEQ ID NO: 1275564 - protein, 27 aa, Mycobacterium
PPPNVFEIPGLPPIMLPWPPPPPPPAP

SEQ ID NO: 1275565 - protein, 17 aa, Mycobacterium
PPPPRSAVVFAETALRQ

SEQ ID NO: 1275566 - protein, 19 aa, Mycobacterium
PPPRPEVGVAVPVAPENVP

SEQ ID NO: 1275567 - protein, 18 aa, Mycobacterium
PPPSALLAQRDWIDHCYA

SEQ ID NO: 1275568 - protein, 18 aa, Mycobacterium
PPPSQLLAQRDWIDECYA

SEQ ID NO: 1275569 - protein, 22 aa, Mycobacterium
PPPVTVVEMFARLQRGLLSDLR

SEQ ID NO: 1275570 - protein, 18 aa, Mycobacterium
PPPWWGALDGGRPVVHVT

SEQ ID NO: 1275571 - protein, 32 aa, Mycobacterium
PPQGSLKSGLRWIRSHPWHFAKLTATGRSLPY

SEQ ID NO: 1275572 - protein, 17 aa, Mycobacterium
PPQKRGIGFVFQHYAAF

SEQ ID NO: 1275573 - protein, 25 aa, Mycobacterium
PPQPEPFTTIAWRMAHVIVGVLAAR

SEQ ID NO: 1275574 - protein, 25 aa, Mycobacterium
PPQRWLQNVARAWTTPVPQLGAALV

SEQ ID NO: 1275575 - protein, 27 aa, Mycobacterium
PPQWLPGPRELRAWTLAAGRPEDDRYL

SEQ ID NO: 1275576 - protein, 19 aa, Mycobacterium
PPRAARLFALADNAVGFMP

SEQ ID NO: 1275577 - protein, 17 aa, Mycobacterium
PPRGATRRIVFRFRTSP

SEQ ID NO: 1275578 - protein, 24 aa, Mycobacterium
PPRILRGAFAAVIMGLGLGMESKY

SEQ ID NO: 1275579 - protein, 24 aa, Mycobacterium
PPRLTRRELDVLVVLCRPLVSDDP

SEQ ID NO: 1275580 - protein, 19 aa, Mycobacterium
PPRQARGFATLSLPLQEMH

SEQ ID NO: 1275581 - protein, 18 aa, Mycobacterium
PPRQMPGTSYWYAHTGQW

SEQ ID NO: 1275582 - protein, 23 aa, Mycobacterium
PPRTAREFREFADLMPSPVVGEN

SEQ ID NO: 1275583 - protein, 18 aa, Mycobacterium
PPRVIAWEPGQRVNGELE

SEQ ID NO: 1275584 - protein, 19 aa, Mycobacterium
PPSAYECWFVSTALDDDAF

SEQ ID NO: 1275585 - protein, 28 aa, Mycobacterium
PPSGCRFAPRCAFQFDRCDQPPPLDHDG

SEQ ID NO: 1275586 - protein, 20 aa, Mycobacterium
PPSGCRFRTRCWKATDVCAT

SEQ ID NO: 1275587 - protein, 19 aa, Mycobacterium
PPSHTALAWNPADLTPQAD

SEQ ID NO: 1275588 - protein, 24 aa, Mycobacterium
PPSMPGLRIRRRACATSSPTCAHS

SEQ ID NO: 1275589 - protein, 17 aa, Mycobacterium
PPSPMTGTPGTGGDGGA

SEQ ID NO: 1275590 - protein, 18 aa, Mycobacterium
PPSQAKRGDLIFYGPGGT

SEQ ID NO: 1275591 - protein, 21 aa, Mycobacterium
PPSRPCVAAALTLYSDILSRI

SEQ ID NO: 1275592 - protein, 21 aa, Mycobacterium
PPSRWPQSLLTAASILLSSRF

SEQ ID NO: 1275593 - protein, 36 aa, Mycobacterium
PPSVATLTLRREWARKAVVAGVTRWLPRPIHEGALL

SEQ ID NO: 1275594 - protein, 22 aa, Mycobacterium
PPTASSSGQAWLRLQNAVDETW

SEQ ID NO: 1275595 - protein, 18 aa, Mycobacterium
PPTAVFCHSDEIALGALR

SEQ ID NO: 1275596 - protein, 20 aa, Mycobacterium
PPTEELEHFVDLVERIEAAA

SEQ ID NO: 1275597 - protein, 21 aa, Mycobacterium
PPTEELEHFVDLVGRIETAAS

SEQ ID NO: 1275598 - protein, 17 aa, Mycobacterium
PPTLTWYILPDNGGSVA

SEQ ID NO: 1275599 - protein, 25 aa, Mycobacterium
PPTVLRFAHSLGFEGFADLQVSLRA

SEQ ID NO: 1275600 - protein, 20 aa, Mycobacterium
PPTVLRFAQSLGYDGFTDLQ

SEQ ID NO: 1275601 - protein, 20 aa, Mycobacterium
PPTVTVFGTPIFKLGGSPVK

SEQ ID NO: 1275602 - protein, 22 aa, Mycobacterium
PPTYRYVGSTAKSRDGWESLGD

SEQ ID NO: 1275603 - protein, 24 aa, Mycobacterium
PPVARKVMPVDLVITREQHFDPFD

SEQ ID NO: 1275604 - protein, 25 aa, Mycobacterium
PPVARKVMPVDLVITREQHFDPFDD

SEQ ID NO: 1275605 - protein, 17 aa, Mycobacterium
PPVGMAGVAPMAPHAPA

SEQ ID NO: 1275606 - protein, 20 aa, Mycobacterium
PPVPKWTARLEMLVASDKQK

SEQ ID NO: 1275607 - protein, 17 aa, Mycobacterium
PPVPLDAAILFAPVGDL

SEQ ID NO: 1275608 - protein, 18 aa, Mycobacterium
PPVPSGRAGAVEFHIDGA

SEQ ID NO: 1275609 - protein, 22 aa, Mycobacterium
PPVRPEVLFVWQVAVAESARGT

SEQ ID NO: 1275610 - protein, 17 aa, Mycobacterium
PPVYIPENLYIIGTMNL

SEQ ID NO: 1275611 - protein, 21 aa, Mycobacterium
PPWDWGDTRYEIVIDGAPPTE

SEQ ID NO: 1275612 - protein, 18 aa, Mycobacterium
PPWELHVIEGLEGGRFAL

SEQ ID NO: 1275613 - protein, 21 aa, Mycobacterium
PPWWLKYVNKVMIVLNRTGLF

SEQ ID NO: 1275614 - protein, 19 aa, Mycobacterium
PPYDLTYNDVFVVPGRSEV

SEQ ID NO: 1275615 - protein, 25 aa, Mycobacterium
PQAEGNCTGCASINPIYVYEHSAPP

SEQ ID NO: 1275616 - protein, 25 aa, Mycobacterium
PQAEGSCTGCASINPIYVYEHSAPP

SEQ ID NO: 1275617 - protein, 18 aa, Mycobacterium
PQAFADLGPTYVKFGQII

SEQ ID NO: 1275618 - protein, 17 aa, Mycobacterium
PQAFARVLTGFNYHGPE

SEQ ID NO: 1275619 - protein, 24 aa, Mycobacterium
PQAKEILRNYAIRRPGVPDDVTEL

SEQ ID NO: 1275620 - protein, 26 aa, Mycobacterium
PQALVLPHCRTYRYGVDRDTVRGLNG

SEQ ID NO: 1275621 - protein, 18 aa, Mycobacterium
PQAPAPFNPVGTDPLSAA

SEQ ID NO: 1275622 - protein, 26 aa, Mycobacterium
PQARPTWSKARWIGLIDLDNCASDAD

SEQ ID NO: 1275623 - protein, 22 aa, Mycobacterium
PQARRTGLVAAHLTEQRVREMN

SEQ ID NO: 1275624 - protein, 25 aa, Mycobacterium
PQASDFLHDRWLVLRRGKRNIAGIE

SEQ ID NO: 1275625 - protein, 23 aa, Mycobacterium
PQCDALAVALLMRDGPAPERFAV

SEQ ID NO: 1275626 - protein, 17 aa, Mycobacterium
PQDGAVITGWDYPSCEA

SEQ ID NO: 1275627 - protein, 24 aa, Mycobacterium
PQDITFAQGLSFVIGDTHAEAVRR

SEQ ID NO: 1275628 - protein, 24 aa, Mycobacterium
PQDLRRRIALRQSVEMVRVTMEFF

SEQ ID NO: 1275629 - protein, 25 aa, Mycobacterium
PQEISARVLMKLKRDAESYLGEDIT

SEQ ID NO: 1275630 - protein, 21 aa, Mycobacterium
PQELAKFFILLIGAGNETTRN

SEQ ID NO: 1275631 - protein, 24 aa, Mycobacterium
PQERLRTFRVRFAAITPVHARPTC

SEQ ID NO: 1275632 - protein, 29 aa, Mycobacterium
PQEVREIYAMWRPSPLIRARRFEKALNTG

SEQ ID NO: 1275633 - protein, 18 aa, Mycobacterium
PQFDAWKHTQLVIDVVPG

SEQ ID NO: 1275634 - protein, 21 aa, Mycobacterium
PQFSFPARGILTSRFGARWGT

SEQ ID NO: 1275635 - protein, 19 aa, Mycobacterium
PQFTGGGIVHGPKPRDYSE

SEQ ID NO: 1275636 - protein, 28 aa, Mycobacterium
PQGCVYQARCPLAAEVCRTTRPALAPVG

SEQ ID NO: 1275637 - protein, 18 aa, Mycobacterium
PQGIRDARARLGDLDKEG

SEQ ID NO: 1275638 - protein, 36 aa, Mycobacterium
PQHPCRRCKQCKAGRYNLCPEMKFYATPPIDGAFCR

SEQ ID NO: 1275639 - protein, 18 aa, Mycobacterium
PQLAKFFYRQSVEERNHA

SEQ ID NO: 1275640 - protein, 18 aa, Mycobacterium
PQLASRGFFEYVQHPVNP

SEQ ID NO: 1275641 - protein, 23 aa, Mycobacterium
PQLDVPVFLAFGAALDVSPNPHA

SEQ ID NO: 1275642 - protein, 20 aa, Mycobacterium
PQLEFLPARRVDRIRVGDEW

SEQ ID NO: 1275643 - protein, 18 aa, Mycobacterium
PQLEVNLNRLGGWPTIKG

SEQ ID NO: 1275644 - protein, 20 aa, Mycobacterium
PQLIRARRGVILGSGGFEHN

SEQ ID NO: 1275645 - protein, 27 aa, Mycobacterium
PQLPGGPRYPGDAMPYVPGRVDPNTPT

SEQ ID NO: 1275646 - protein, 17 aa, Mycobacterium
PQLVGDVLVGAAAVAEA

SEQ ID NO: 1275647 - protein, 30 aa, Mycobacterium
PQLVKSFARLSLERFKRGASTRLRIDVEAL

SEQ ID NO: 1275648 - protein, 19 aa, Mycobacterium
PQMRDSVSFWVSDDRGELG

SEQ ID NO: 1275649 - protein, 27 aa, Mycobacterium
PQPEARIGWGVKRFTPTVFTRAAGIAT

SEQ ID NO: 1275650 - protein, 21 aa, Mycobacterium
PQPEWEVAVGRLGHAIAHHPD

SEQ ID NO: 1275651 - protein, 18 aa, Mycobacterium
PQPIAWPGSSDRNFYDRA

SEQ ID NO: 1275652 - protein, 18 aa, Mycobacterium
PQPLWALWRFSTAPEATR

SEQ ID NO: 1275653 - protein, 25 aa, Mycobacterium
PQPPMRPDLLATFELSELEKYYTAE

SEQ ID NO: 1275654 - protein, 20 aa, Mycobacterium
PQPRRSKPILIPGRPAYLFG

SEQ ID NO: 1275655 - protein, 24 aa, Mycobacterium
PQPVGRPTILTWGLLGPGKGIERV

SEQ ID NO: 1275656 - protein, 32 aa, Mycobacterium
PQQRAWLKLVKPLVITEGFALLSVPTPFVQNE

SEQ ID NO: 1275657 - protein, 17 aa, Mycobacterium
PQQRLLLEVTHEALENA

SEQ ID NO: 1275658 - protein, 19 aa, Mycobacterium
PQQRVALRVSWRALESAQI

SEQ ID NO: 1275659 - protein, 18 aa, Mycobacterium
PQQSACRAPAFVIGAGVT

SEQ ID NO: 1275660 - protein, 27 aa, Mycobacterium
PQRFMDDFLLYWSFLAFALVRGGRRTF

SEQ ID NO: 1275661 - protein, 28 aa, Mycobacterium
PQRIERLEGLPGWAWNVVDARWETSFAA

SEQ ID NO: 1275662 - protein, 22 aa, Mycobacterium
PQRRPVKPNPQQGAYGTPAGGS

SEQ ID NO: 1275663 - protein, 21 aa, Mycobacterium
PQRRSASVTAVAWRTSAGAAA

SEQ ID NO: 1275664 - protein, 20 aa, Mycobacterium
PQSCGIGFDALTHGRGVGKF

SEQ ID NO: 1275665 - protein, 17 aa, Mycobacterium
PQSGLVVCPRICGICGG

SEQ ID NO: 1275666 - protein, 22 aa, Mycobacterium
PQSLVWRYFGDNRMYLIGPRPA

SEQ ID NO: 1275667 - protein, 24 aa, Mycobacterium
PQSRSALLPLLHLVQAEDGYLTPA

SEQ ID NO: 1275668 - protein, 18 aa, Mycobacterium
PQTTFGFLATGPGDDALT

SEQ ID NO: 1275669 - protein, 25 aa, Mycobacterium
PQVADVPIAHGWCGVLAVPRDWEAT

SEQ ID NO: 1275670 - protein, 21 aa, Mycobacterium
PQVLSSGRWDEPIRWVHVGDV

SEQ ID NO: 1275671 - protein, 31 aa, Mycobacterium
PQVPRRARVAFRWLRAVALERMGDIESAERE

SEQ ID NO: 1275672 - protein, 26 aa, Mycobacterium
PQWLTPTAYMMAKFGMTLCALGIAEE

SEQ ID NO: 1275673 - protein, 26 aa, Mycobacterium
PQWNEEIKGCWVLARYNDGRPSQLRL

SEQ ID NO: 1275674 - protein, 19 aa, Mycobacterium
PQYRHAVVMGVNKARVPGN

SEQ ID NO: 1275675 - protein, 21 aa, Mycobacterium
PQYRIAVADARNRRDGRAIEV

SEQ ID NO: 1275676 - protein, 23 aa, Mycobacterium
PRAAIYGRLGTCVGRHGTLTSYL

SEQ ID NO: 1275677 - protein, 17 aa, Mycobacterium
PRAARIAERLGLDTDPS

SEQ ID NO: 1275678 - protein, 19 aa, Mycobacterium
PRAEPDGWVNLGSVDSIAV

SEQ ID NO: 1275679 - protein, 18 aa, Mycobacterium
PRAFLCGTAFRVGGGGAE

SEQ ID NO: 1275680 - protein, 20 aa, Mycobacterium
PRAGWADRVRLAHALGPTMI

SEQ ID NO: 1275681 - protein, 17 aa, Mycobacterium
PRAGYVEVVGRIKDVIH

SEQ ID NO: 1275682 - protein, 24 aa, Mycobacterium
PRALHPLARATARRGLRLNYLSIV

SEQ ID NO: 1275683 - protein, 19 aa, Mycobacterium
PRALLAAFRGYAKIVGRHD

SEQ ID NO: 1275684 - protein, 17 aa, Mycobacterium
PRALLLPALRMAAARRR

SEQ ID NO: 1275685 - protein, 27 aa, Mycobacterium
PRANAVDGRHIQSWRCKVGHSITARAC

SEQ ID NO: 1275686 - protein, 22 aa, Mycobacterium
PRARECDELQFILGEGPCLESV

SEQ ID NO: 1275687 - protein, 17 aa, Mycobacterium
PRARIHHISARGADPVF

SEQ ID NO: 1275688 - protein, 20 aa, Mycobacterium
PRATFDHLLLTAHQRVNRAG

SEQ ID NO: 1275689 - protein, 21 aa, Mycobacterium
PRATVSLDHAGVISVLDAECA

SEQ ID NO: 1275690 - protein, 18 aa, Mycobacterium
PRDAAGIEVECRGQVVQL

SEQ ID NO: 1275691 - protein, 18 aa, Mycobacterium
PRDAHFITSRICGICGDN

SEQ ID NO: 1275692 - protein, 17 aa, Mycobacterium
PRDAIAVADASPNDIDA

SEQ ID NO: 1275693 - protein, 23 aa, Mycobacterium
PRDALRASRAVRRYGAFGGLASF

SEQ ID NO: 1275694 - protein, 17 aa, Mycobacterium
PRDDWFVDPDVLVRTNW

SEQ ID NO: 1275695 - protein, 20 aa, Mycobacterium
PRDGLLRLLVDVQYTRNDMA

SEQ ID NO: 1275696 - protein, 18 aa, Mycobacterium
PRDGRFLLVGNHTQSSVE

SEQ ID NO: 1275697 - protein, 24 aa, Mycobacterium
PRDKRMEIALTYIYGVGRTRSQEI

SEQ ID NO: 1275698 - protein, 19 aa, Mycobacterium
PRDLRRFAERFGVTVVDGF

SEQ ID NO: 1275699 - protein, 18 aa, Mycobacterium
PRDPIGMLQEEALRDGDM

SEQ ID NO: 1275700 - protein, 18 aa, Mycobacterium
PRDPRIDAAILRATADLL

SEQ ID NO: 1275701 - protein, 20 aa, Mycobacterium
PRDRMPWFGPDMSAASAATA

SEQ ID NO: 1275702 - protein, 20 aa, Mycobacterium
PREAIALALDLERAVTEQIS

SEQ ID NO: 1275703 - protein, 31 aa, Mycobacterium
PREDWRLFSDWTEDVFRAFSFSTDVATVQDD

SEQ ID NO: 1275704 - protein, 19 aa, Mycobacterium
PREECGVFGVWAPGEEVAK

SEQ ID NO: 1275705 - protein, 25 aa, Mycobacterium
PREFARFVLRRAILAIERVELRLLG

SEQ ID NO: 1275706 - protein, 19 aa, Mycobacterium
PRELAELLVRATTTTPVSP

SEQ ID NO: 1275707 - protein, 19 aa, Mycobacterium
PRELVAFAGGSGITPIMSL

SEQ ID NO: 1275708 - protein, 20 aa, Mycobacterium
PRELVARIRAMLRRPRATPE

SEQ ID NO: 1275709 - protein, 24 aa, Mycobacterium
PRELVARIRAMLRRPRTVATPISA

SEQ ID NO: 1275710 - protein, 24 aa, Mycobacterium
PRELVARIRAMLRRPRTVATPTSA

SEQ ID NO: 1275711 - protein, 26 aa, Mycobacterium
PRERKVNAAWRLDDRGVFSDSHGDLL

SEQ ID NO: 1275712 - protein, 20 aa, Mycobacterium
PRERSLHAAASFEVDTDTRV

SEQ ID NO: 1275713 - protein, 17 aa, Mycobacterium
PRESWWRKLVIDSGFPT

SEQ ID NO: 1275714 - protein, 19 aa, Mycobacterium
PREVIALMVDILFHAQDDA

SEQ ID NO: 1275715 - protein, 20 aa, Mycobacterium
PREYGGLGLDHAYQKAFNAE

SEQ ID NO: 1275716 - protein, 20 aa, Mycobacterium
PRFAGPATFARLPRLDQVPR

SEQ ID NO: 1275717 - protein, 20 aa, Mycobacterium
PRFAVARGLIAMYAADQLSG

SEQ ID NO: 1275718 - protein, 20 aa, Mycobacterium
PRFCDHPLLDPVGACRQCLV

SEQ ID NO: 1275719 - protein, 18 aa, Mycobacterium
PRFEAFRGSITVDFGGRT

SEQ ID NO: 1275720 - protein, 26 aa, Mycobacterium
PRFHRDMPSRFAVVPRRGDTSQIKWF

SEQ ID NO: 1275721 - protein, 20 aa, Mycobacterium
PRFIRDFSQAGLFLNEVQGF

SEQ ID NO: 1275722 - protein, 21 aa, Mycobacterium
PRFITGASAFCSEWVTMVGDY

SEQ ID NO: 1275723 - protein, 21 aa, Mycobacterium
PRFLPLTGPVAMRSTALMRIA

SEQ ID NO: 1275724 - protein, 22 aa, Mycobacterium
PRFPDPAAALAHGSLLAPMPGS

SEQ ID NO: 1275725 - protein, 20 aa, Mycobacterium
PRGAEMWSAYSSLSDAQTRQ

SEQ ID NO: 1275726 - protein, 22 aa, Mycobacterium
PRGALGNIPVRFPVSPVGDDRG

SEQ ID NO: 1275727 - protein, 20 aa, Mycobacterium
PRGALPHGQPGHWTAHVTLA

SEQ ID NO: 1275728 - protein, 23 aa, Mycobacterium
PRGAQYMGVNWVGPIIMRHGTEA

SEQ ID NO: 1275729 - protein, 23 aa, Mycobacterium
PRGEYGGGEVYIWDTGTYETEKF

SEQ ID NO: 1275730 - protein, 25 aa, Mycobacterium
PRGFCGRLTRRITRWPLYVHHRHDD

SEQ ID NO: 1275731 - protein, 19 aa, Mycobacterium
PRGGGPGPHYHRAMSEAFF

SEQ ID NO: 1275732 - protein, 17 aa, Mycobacterium
PRGGYPPADQGGYPPPA

SEQ ID NO: 1275733 - protein, 27 aa, Mycobacterium
PRGMRAVAWSWLSLGPVGGAGSLLGAT

SEQ ID NO: 1275734 - protein, 18 aa, Mycobacterium
PRGMSYLVVTGRRGGSAM

SEQ ID NO: 1275735 - protein, 20 aa, Mycobacterium
PRGPISMSVMELLAERAPLR

SEQ ID NO: 1275736 - protein, 25 aa, Mycobacterium
PRGPRLTEVWEWCLVESSAPRAVKE

SEQ ID NO: 1275737 - protein, 19 aa, Mycobacterium
PRHCTCVVPEGLTVPKAIV

SEQ ID NO: 1275738 - protein, 24 aa, Mycobacterium
PRHTHLRKIISRGFTPRAVERLRE

SEQ ID NO: 1275739 - protein, 23 aa, Mycobacterium
PRIDHSRRIICRAALEEFAASGY

SEQ ID NO: 1275740 - protein, 17 aa, Mycobacterium
PRIDLLINNAGVMYPPK

SEQ ID NO: 1275741 - protein, 18 aa, Mycobacterium
PRIGTAVHIAFRRLGDVV

SEQ ID NO: 1275742 - protein, 19 aa, Mycobacterium
PRIPPNFDSVWPAAADGRV

SEQ ID NO: 1275743 - protein, 27 aa, Mycobacterium
PRIVGERSVFCPPRVLLPESPEPFCLF

SEQ ID NO: 1275744 - protein, 19 aa, Mycobacterium
PRLAASLFEIEPRCRRIMF

SEQ ID NO: 1275745 - protein, 19 aa, Mycobacterium
PRLDPGVPVLSLGRYAGPR

SEQ ID NO: 1275746 - protein, 20 aa, Mycobacterium
PRLFSCGARLPLDHPEVYLA

SEQ ID NO: 1275747 - protein, 17 aa, Mycobacterium
PRLFTAVRQEPDHPVPE

SEQ ID NO: 1275748 - protein, 19 aa, Mycobacterium
PRLGGVFTGIVEELGEVVG

SEQ ID NO: 1275749 - protein, 19 aa, Mycobacterium
PRLKELMYALVKHLHAFLR

SEQ ID NO: 1275750 - protein, 18 aa, Mycobacterium
PRLKFVDIAEMIHAAKVG

SEQ ID NO: 1275751 - protein, 18 aa, Mycobacterium
PRLKTFAVDKHWRLYVDP

SEQ ID NO: 1275752 - protein, 19 aa, Mycobacterium
PRLLAQGSPAWGTLAGEDA

SEQ ID NO: 1275753 - protein, 27 aa, Mycobacterium
PRLRDYVLAVKACFAAFRTGKLDHHGQ

SEQ ID NO: 1275754 - protein, 17 aa, Mycobacterium
PRLREMVGHAAALGADG

SEQ ID NO: 1275755 - protein, 22 aa, Mycobacterium
PRLRMRHAPFRIGYLERDAWLR

SEQ ID NO: 1275756 - protein, 17 aa, Mycobacterium
PRLRQRPGIADELAALM

SEQ ID NO: 1275757 - protein, 25 aa, Mycobacterium
PRLRVPGRLVHFVMTVWQQLHFRFG

SEQ ID NO: 1275758 - protein, 27 aa, Mycobacterium
PRLSYSLDEACLRAFARRDITEAEAES

SEQ ID NO: 1275759 - protein, 18 aa, Mycobacterium
PRLTAALDKLGKLGDTAT

SEQ ID NO: 1275760 - protein, 19 aa, Mycobacterium
PRLVCHPTESYGMRITDPS

SEQ ID NO: 1275761 - protein, 17 aa, Mycobacterium
PRLVRLAHLGGGRKGKK

SEQ ID NO: 1275762 - protein, 20 aa, Mycobacterium
PRMARTRAWPTTEVNGQLLV

SEQ ID NO: 1275763 - protein, 25 aa, Mycobacterium
PRMASGETKVVFAITEPDAGSNTHK

SEQ ID NO: 1275764 - protein, 19 aa, Mycobacterium
PRMSADELIDYLTMLSWSA

SEQ ID NO: 1275765 - protein, 20 aa, Mycobacterium
PRNRGRVATMYKLTSDDTLS

SEQ ID NO: 1275766 - protein, 21 aa, Mycobacterium
PRNRRKTAIGYVVSDKMEKTI

SEQ ID NO: 1275767 - protein, 27 aa, Mycobacterium
PRNSLFSQLGGFAIPGLGPMVTKSPLL

SEQ ID NO: 1275768 - protein, 19 aa, Mycobacterium
PRNVAKLADRIRVLANERL

SEQ ID NO: 1275769 - protein, 18 aa, Mycobacterium
PRPAATVMLVRDTPEGIK

SEQ ID NO: 1275770 - protein, 20 aa, Mycobacterium
PRPDQMFDLTGRTALVTGAS

SEQ ID NO: 1275771 - protein, 20 aa, Mycobacterium
PRPEVQFEIVDRCGQLWRAD

SEQ ID NO: 1275772 - protein, 17 aa, Mycobacterium
PRPGIIDALATMRIDGE

SEQ ID NO: 1275773 - protein, 17 aa, Mycobacterium
PRPIAAAAYVLAAQCAF

SEQ ID NO: 1275774 - protein, 17 aa, Mycobacterium
PRPLILFGASMGGMLAY

SEQ ID NO: 1275775 - protein, 25 aa, Mycobacterium
PRPLSCAIAAVSVGVVDGRIRVDLP

SEQ ID NO: 1275776 - protein, 23 aa, Mycobacterium
PRPPVVVCGVGPLTISSRDTPPF

SEQ ID NO: 1275777 - protein, 19 aa, Mycobacterium
PRPYTTYRSMLEKLDSMHS

SEQ ID NO: 1275778 - protein, 27 aa, Mycobacterium
PRQIQFYCVDMGGGGLMYIEDLPHVGG

SEQ ID NO: 1275779 - protein, 25 aa, Mycobacterium
PRQLEKIWGPPECPATVVDHDLRPG

SEQ ID NO: 1275780 - protein, 23 aa, Mycobacterium
PRQREALAALPPAPAVPAPAAAP

SEQ ID NO: 1275781 - protein, 21 aa, Mycobacterium
PRQTLREFLGPMITALDDYPF

SEQ ID NO: 1275782 - protein, 24 aa, Mycobacterium
PRRAAELAKCRDLVVKRLEGERDR

SEQ ID NO: 1275783 - protein, 22 aa, Mycobacterium
PRRAGGEVLELGIYGERDSGEE

SEQ ID NO: 1275784 - protein, 21 aa, Mycobacterium
PRRALPDDVADDWDAHGDRLH

SEQ ID NO: 1275785 - protein, 21 aa, Mycobacterium
PRRAWPTPLLPALGTLLDGGD

SEQ ID NO: 1275786 - protein, 17 aa, Mycobacterium
PRRGDWPLGATSDDTAL

SEQ ID NO: 1275787 - protein, 17 aa, Mycobacterium
PRRIEWWEQDVVVKHAV

SEQ ID NO: 1275788 - protein, 24 aa, Mycobacterium
PRRRAAFPWITPVLGTGCLSTSEF

SEQ ID NO: 1275789 - protein, 20 aa, Mycobacterium
PRRRAILGLKERGRTDLIAP

SEQ ID NO: 1275790 - protein, 21 aa, Mycobacterium
PRRRAIVGMIFFDCLTQREVA

SEQ ID NO: 1275791 - protein, 18 aa, Mycobacterium
PRRVGRSALYDDYHLSQL

SEQ ID NO: 1275792 - protein, 17 aa, Mycobacterium
PRSARFRSRLVGKPFDV

SEQ ID NO: 1275793 - protein, 21 aa, Mycobacterium
PRSEAYAGFRVPGRALMSGPV

SEQ ID NO: 1275794 - protein, 19 aa, Mycobacterium
PRSEIVTFLAAREAAHHRL

SEQ ID NO: 1275795 - protein, 23 aa, Mycobacterium
PRSFRMMEGFGVHTFRLTGPDGS

SEQ ID NO: 1275796 - protein, 26 aa, Mycobacterium
PRSGEGLSVVAPFAGMGLRGNASSPM

SEQ ID NO: 1275797 - protein, 19 aa, Mycobacterium
PRSKRVLLQGWEQFDEKVD

SEQ ID NO: 1275798 - protein, 17 aa, Mycobacterium
PRSLAMSTRASFLRQLG

SEQ ID NO: 1275799 - protein, 18 aa, Mycobacterium
PRSLRWILRHRCRHTFSS

SEQ ID NO: 1275800 - protein, 18 aa, Mycobacterium
PRSLWRSAGIPTTAPDGY

SEQ ID NO: 1275801 - protein, 20 aa, Mycobacterium
PRSNIFLVFNSVENRLLAPY

SEQ ID NO: 1275802 - protein, 18 aa, Mycobacterium
PRSRCPITAETTSTAPRR

SEQ ID NO: 1275803 - protein, 17 aa, Mycobacterium
PRSSLLVLGDGRNNYRN

SEQ ID NO: 1275804 - protein, 19 aa, Mycobacterium
PRSTAPRDPGYWVANLRGR

SEQ ID NO: 1275805 - protein, 20 aa, Mycobacterium
PRSVAFNVHAFRVAVDTETG

SEQ ID NO: 1275806 - protein, 17 aa, Mycobacterium
PRSYRVDFSRFRDTLGY

SEQ ID NO: 1275807 - protein, 17 aa, Mycobacterium
PRTDWCFTTEPDPGLAG

SEQ ID NO: 1275808 - protein, 20 aa, Mycobacterium
PRTFLGLGVDGFPNLFLVSG

SEQ ID NO: 1275809 - protein, 18 aa, Mycobacterium
PRTGRHLGNFPQAFTHLA

SEQ ID NO: 1275810 - protein, 19 aa, Mycobacterium
PRTGTTILFDLLAQDPALR

SEQ ID NO: 1275811 - protein, 20 aa, Mycobacterium
PRTHVALRLLAKAKKLRGTP

SEQ ID NO: 1275812 - protein, 18 aa, Mycobacterium
PRTMLRFAGGREITLGDL

SEQ ID NO: 1275813 - protein, 17 aa, Mycobacterium
PRVAGSFGQAPNQASAA

SEQ ID NO: 1275814 - protein, 24 aa, Mycobacterium
PRVAQDFDATVCWMADAESLEPGR

SEQ ID NO: 1275815 - protein, 18 aa, Mycobacterium
PRVARWVRNMLAPRLLRV

SEQ ID NO: 1275816 - protein, 17 aa, Mycobacterium
PRVDLWARILRRQPMPL

SEQ ID NO: 1275817 - protein, 19 aa, Mycobacterium
PRVFMLFIGGFGVYLDICA

SEQ ID NO: 1275818 - protein, 19 aa, Mycobacterium
PRVFMLFIGGFGVYLDICM

SEQ ID NO: 1275819 - protein, 18 aa, Mycobacterium
PRVLAAIAPDTGFRDTAT

SEQ ID NO: 1275820 - protein, 26 aa, Mycobacterium
PRVLAPSALVGRLRAVVCAPDGAVDD

SEQ ID NO: 1275821 - protein, 30 aa, Mycobacterium
PRVLAPSALVGRLRSVVCAAPGAVDDVERD

SEQ ID NO: 1275822 - protein, 20 aa, Mycobacterium
PRVLESMGLTYDAVRAVKPD

SEQ ID NO: 1275823 - protein, 23 aa, Mycobacterium
PRVLPWQECPGAVASAERIAGMT

SEQ ID NO: 1275824 - protein, 23 aa, Mycobacterium
PRVLQFKPGLLLNRDLCEDVLDR

SEQ ID NO: 1275825 - protein, 23 aa, Mycobacterium
PRVLQIRALVLGTAMDWLADNTA

SEQ ID NO: 1275826 - protein, 23 aa, Mycobacterium
PRVLQIRALVLGTAMDWLVDNSA

SEQ ID NO: 1275827 - protein, 19 aa, Mycobacterium
PRVLRVGWCTVVELTTTGP

SEQ ID NO: 1275828 - protein, 21 aa, Mycobacterium
PRVLVMPAEHPLAGRESVSPE

SEQ ID NO: 1275829 - protein, 18 aa, Mycobacterium
PRVRAIAGALLNFDPSQI

SEQ ID NO: 1275830 - protein, 20 aa, Mycobacterium
PRVREMILATAFVPPQGLSI

SEQ ID NO: 1275831 - protein, 20 aa, Mycobacterium
PRVSSDFRRSPLSSDRAPAE

SEQ ID NO: 1275832 - protein, 18 aa, Mycobacterium
PRVTLPYTEESWAAINAL

SEQ ID NO: 1275833 - protein, 18 aa, Mycobacterium
PRWEAQMYVVTGGDEPSL

SEQ ID NO: 1275834 - protein, 22 aa, Mycobacterium
PRWEQAPDFDLDFHMRRVTASA

SEQ ID NO: 1275835 - protein, 28 aa, Mycobacterium
PRWGKPEEMAELLAFCAGDKAGYLTGTD

SEQ ID NO: 1275836 - protein, 21 aa, Mycobacterium
PRWPTFGVTVVPYLPAPTTDQ

SEQ ID NO: 1275837 - protein, 38 aa, Mycobacterium
PRWSLELAGGALMDLGCYGLHVMRRFGTPSVLAATAVQ

SEQ ID NO: 1275838 - protein, 22 aa, Mycobacterium
PRYAELIKRTQWWGRQMLIWGV

SEQ ID NO: 1275839 - protein, 22 aa, Mycobacterium
PRYLPHMEALRRAYVAMAEASK

SEQ ID NO: 1275840 - protein, 21 aa, Mycobacterium
PRYPARVGVMPREGGNGDVRW

SEQ ID NO: 1275841 - protein, 34 aa, Mycobacterium
PRYSGHAIAGVSGFGFGGANAHLVLREVLPTDLV

SEQ ID NO: 1275842 - protein, 21 aa, Mycobacterium
PRYTASKAYLCEKAGDTEAAA

SEQ ID NO: 1275843 - protein, 25 aa, Mycobacterium
PSADEPFSGLAFKVATHPFFGKLTY

SEQ ID NO: 1275844 - protein, 17 aa, Mycobacterium
PSAGPGQVVVRVEAAAV

SEQ ID NO: 1275845 - protein, 20 aa, Mycobacterium
PSAGTEWQLLVSDLSGMPAA

SEQ ID NO: 1275846 - protein, 17 aa, Mycobacterium
PSAIRRLGLTYDSLREF

SEQ ID NO: 1275847 - protein, 18 aa, Mycobacterium
PSALRRLGLDFETLAAAN

SEQ ID NO: 1275848 - protein, 24 aa, Mycobacterium
PSANARWSNNIAILAGDYLFATAS

SEQ ID NO: 1275849 - protein, 23 aa, Mycobacterium
PSAPDLGTWSGLTVDYLETVASR

SEQ ID NO: 1275850 - protein, 23 aa, Mycobacterium
PSAPQMWRWAASRSVDQRTALTV

SEQ ID NO: 1275851 - protein, 25 aa, Mycobacterium
PSAPRAAQLEACFEELSELAGKRNA

SEQ ID NO: 1275852 - protein, 18 aa, Mycobacterium
PSAPRPFVAPVLGWDAVS

SEQ ID NO: 1275853 - protein, 24 aa, Mycobacterium
PSARAPWEIARPVGADGALATEFT

SEQ ID NO: 1275854 - protein, 19 aa, Mycobacterium
PSASINFVTCHDGFTLNDL

SEQ ID NO: 1275855 - protein, 25 aa, Mycobacterium
PSATGARPPVAFAPDDTGYGAGHGE

SEQ ID NO: 1275856 - protein, 24 aa, Mycobacterium
PSCDALRASIWAQLGRPQAAVELA

SEQ ID NO: 1275857 - protein, 19 aa, Mycobacterium
PSCEACAELAIADANSASG

SEQ ID NO: 1275858 - protein, 20 aa, Mycobacterium
PSCPEAALVRSTQQLGTPIA

SEQ ID NO: 1275859 - protein, 18 aa, Mycobacterium
PSDCVNALAALTSDPLVD

SEQ ID NO: 1275860 - protein, 24 aa, Mycobacterium
PSDLFRKHFWGCFIDDEHGLTNRH

SEQ ID NO: 1275861 - protein, 18 aa, Mycobacterium
PSDLVPQGCEVHVLAGHS

SEQ ID NO: 1275862 - protein, 33 aa, Mycobacterium; identical to SEQ ID NO: 711656

SEQ ID NO: 1275863 - protein, 19 aa, Mycobacterium
PSDVALWEINEAFASVPIA

SEQ ID NO: 1275864 - protein, 23 aa, Mycobacterium
PSELERVLARSAGILGIELGAEA

SEQ ID NO: 1275865 - protein, 17 aa, Mycobacterium
PSERVTEALCVEKAAGL

SEQ ID NO: 1275866 - protein, 25 aa, Mycobacterium
PSEVRDACSMLGLDPLYVANEGKLV

SEQ ID NO: 1275867 - protein, 20 aa, Mycobacterium
PSFTNTIVWNTLPLPEVGDE

SEQ ID NO: 1275868 - protein, 19 aa, Mycobacterium
PSGAFGTPEIMMWTMANTT

SEQ ID NO: 1275869 - protein, 26 aa, Mycobacterium
PSGALLNVCLSYRLSGEIDVARLHDA

SEQ ID NO: 1275870 - protein, 35 aa, Mycobacterium
PSGAVFKIAMVFDEPFWRADGLSGQSFAPGSAANL

SEQ ID NO: 1275871 - protein, 19 aa, Mycobacterium
PSGAVTYLLGLNGAGKTSL

SEQ ID NO: 1275872 - protein, 24 aa, Mycobacterium
PSGCGKSTLLRMIVGLEDITSGDM

SEQ ID NO: 1275873 - protein, 19 aa, Mycobacterium
PSGCGKSTSLRMLAGLETV

SEQ ID NO: 1275874 - protein, 17 aa, Mycobacterium
PSGCGKTTTLRCIAGLE

SEQ ID NO: 1275875 - protein, 24 aa, Mycobacterium
PSGEAELLMLGWGSSYGPIGEACR

SEQ ID NO: 1275876 - protein, 18 aa, Mycobacterium
PSGELQFDAFNWLGIKAQ

SEQ ID NO: 1275877 - protein, 18 aa, Mycobacterium
PSGFDAMLTASSPQGLID

SEQ ID NO: 1275878 - protein, 20 aa, Mycobacterium
PSGFTCPDCNGSLLTVADGY

SEQ ID NO: 1275879 - protein, 18 aa, Mycobacterium
PSGGRLLDDPAFARKLAD

SEQ ID NO: 1275880 - protein, 28 aa, Mycobacterium
PSGLCTSPLRRCRDGNLYGGTEPARTWY

SEQ ID NO: 1275881 - protein, 17 aa, Mycobacterium
PSGMVIVGGNIVDATGT

SEQ ID NO: 1275882 - protein, 19 aa, Mycobacterium
PSGPKRSRLAGTRSPLDRV

SEQ ID NO: 1275883 - protein, 25 aa, Mycobacterium
PSGPKTAAVIDEFLAAGGRVLPLSD

SEQ ID NO: 1275884 - protein, 17 aa, Mycobacterium
PSGQWDRSSPAPADSSG

SEQ ID NO: 1275885 - protein, 22 aa, Mycobacterium
PSGRAFGMCRYWARDGRTTLEG

SEQ ID NO: 1275886 - protein, 17 aa, Mycobacterium
PSGSVVFGVYDAGLGVA

SEQ ID NO: 1275887 - protein, 17 aa, Mycobacterium
PSGTAMRTARLIAEARK

SEQ ID NO: 1275888 - protein, 22 aa, Mycobacterium
PSGWRNLPAGFQHKSYQDHAGR

SEQ ID NO: 1275889 - protein, 18 aa, Mycobacterium
PSGWSHFDDDRWELFHIE

SEQ ID NO: 1275890 - protein, 19 aa, Mycobacterium
PSHLTELMTRAGVEILVAA

SEQ ID NO: 1275891 - protein, 17 aa, Mycobacterium
PSIARHIAGDDALQTGA

SEQ ID NO: 1275892 - protein, 17 aa, Mycobacterium
PSIEIQFTPARVLMQDF

SEQ ID NO: 1275893 - protein, 21 aa, Mycobacterium
PSIGYGIRYEFGIFRQEIVDG

SEQ ID NO: 1275894 - protein, 17 aa, Mycobacterium
PSKHEYGNGVAIFTRDG

SEQ ID NO: 1275895 - protein, 25 aa, Mycobacterium
PSKLCDWCAHRVHCPTFGGTPPPYP

SEQ ID NO: 1275896 - protein, 19 aa, Mycobacterium
PSKVFRLVADQSRLLSGAQ

SEQ ID NO: 1275897 - protein, 25 aa, Mycobacterium
PSLDLAFRICEVFDLPVEAVFSRKP

SEQ ID NO: 1275898 - protein, 26 aa, Mycobacterium
PSLHAGHLIPLLTLRRFQQAGHRPIV

SEQ ID NO: 1275899 - protein, 17 aa, Mycobacterium
PSLREAVRVLESDRLVE

SEQ ID NO: 1275900 - protein, 24 aa, Mycobacterium
PSLRRVGVGIARTLPAQTPGGEVR

SEQ ID NO: 1275901 - protein, 24 aa, Mycobacterium
PSLTIPSIPGLPVPLPNEVPVPSD

SEQ ID NO: 1275902 - protein, 19 aa, Mycobacterium
PSLWAELVRGWQLTTPPPD

SEQ ID NO: 1275903 - protein, 23 aa, Mycobacterium
PSMRSLLRMQHRILGGTRRLFRA

SEQ ID NO: 1275904 - protein, 22 aa, Mycobacterium
PSMRTLLRMQHRILNRTRRLFH

SEQ ID NO: 1275905 - protein, 34 aa, Mycobacterium
PSNLKCLCRFHHLLKTFWLGATGWHDRQHPDGTI

SEQ ID NO: 1275906 - protein, 26 aa, Mycobacterium
PSNNVEFFFLRPKDIAIYVGSGELDL

SEQ ID NO: 1275907 - protein, 31 aa, Mycobacterium
PSPADLDAFLRLLGDRGVDVLIYNVQTEGSV

SEQ ID NO: 1275908 - protein, 17 aa, Mycobacterium
PSPAVALQGVMPASGPA

SEQ ID NO: 1275909 - protein, 24 aa, Mycobacterium
PSPEARLGLISAIRSAGLSCHVMV

SEQ ID NO: 1275910 - protein, 27 aa, Mycobacterium
PSPFGPGRPGWHVECAAIALSRIGTGL

SEQ ID NO: 1275911 - protein, 25 aa, Mycobacterium
PSPHIPWDRLAVRVVAEPTPWRADG

SEQ ID NO: 1275912 - protein, 23 aa, Mycobacterium
PSPKATVALLRRVEDVLDIEVPL

SEQ ID NO: 1275913 - protein, 24 aa, Mycobacterium
PSPPALTVPWLIGVARHKLADHYR

SEQ ID NO: 1275914 - protein, 19 aa, Mycobacterium
PSPSGRHTLGLAINANGPN

SEQ ID NO: 1275915 - protein, 17 aa, Mycobacterium
PSPSPVNRVRCVRDSGV

SEQ ID NO: 1275916 - protein, 17 aa, Mycobacterium
PSPTRRAAIEVLGARTL

SEQ ID NO: 1275917 - protein, 18 aa, Mycobacterium
PSQCGRFDAPPSLPGGDS

SEQ ID NO: 1275918 - protein, 19 aa, Mycobacterium
PSQFTRFRVGATGRVGAEP

SEQ ID NO: 1275919 - protein, 23 aa, Mycobacterium
PSRAPGLHGHSDFDIAVPTPDHF

SEQ ID NO: 1275920 - protein, 34 aa, Mycobacterium
PSRQLLPAMDWMKAEYGIDRWIVIGNDYIFPRGT

SEQ ID NO: 1275921 - protein, 17 aa, Mycobacterium
PSRSVRLPLSWDDPATR

SEQ ID NO: 1275922 - protein, 17 aa, Mycobacterium
PSRWKATQYLMGNHTIA

SEQ ID NO: 1275923 - protein, 17 aa, Mycobacterium
PSSAPAILDTARTLLDE

SEQ ID NO: 1275924 - protein, 19 aa, Mycobacterium
PSSEGRIWSLYGGSATRDQ

SEQ ID NO: 1275925 - protein, 17 aa, Mycobacterium
PSSKNAQPWRLHVVQSR

SEQ ID NO: 1275926 - protein, 21 aa, Mycobacterium
PSSLPDWIVYDGPGHAGNGRR

SEQ ID NO: 1275927 - protein, 21 aa, Mycobacterium
PSSMFAWCGATASWPNRTEPG

SEQ ID NO: 1275928 - protein, 18 aa, Mycobacterium
PSSRGSRALMSLPAAEHS

SEQ ID NO: 1275929 - protein, 26 aa, Mycobacterium
PSSRLLFPIEGFSLWPCTVNNGKAVH

SEQ ID NO: 1275930 - protein, 21 aa, Mycobacterium
PSTDAILTCRLIDRPLRPSFV

SEQ ID NO: 1275931 - protein, 22 aa, Mycobacterium
PSTHLRAAAWVPDDVEDRPWEE

SEQ ID NO: 1275932 - protein, 24 aa, Mycobacterium
PSTKEGFGLAAMEALAAGRPVVAR

SEQ ID NO: 1275933 - protein, 23 aa, Mycobacterium
PSTLGAKFARWLTGVLDAAEPIA

SEQ ID NO: 1275934 - protein, 22 aa, Mycobacterium
PSTLGYKGFPKSCCTSLNEVIC

SEQ ID NO: 1275935 - protein, 21 aa, Mycobacterium
PSTPGDLLFHIRAETMDVCFE

SEQ ID NO: 1275936 - protein, 17 aa, Mycobacterium
PSTVYPHDKLPQIDLDA

SEQ ID NO: 1275937 - protein, 28 aa, Mycobacterium
PSVAAEWEFFPGVFSKDGPIDALFVQLP

SEQ ID NO: 1275938 - protein, 26 aa, Mycobacterium
PSVDSWLCGWDEAFTEALAARGYLGM

SEQ ID NO: 1275939 - protein, 18 aa, Mycobacterium
PSVGAVLGAIVWTKQVWL

SEQ ID NO: 1275940 - protein, 19 aa, Mycobacterium
PSVGRPVTWTIEALEPPDP

SEQ ID NO: 1275941 - protein, 18 aa, Mycobacterium
PSVLRLVGCDEHAGRIVD

SEQ ID NO: 1275942 - protein, 18 aa, Mycobacterium
PSVPHVLIEPGVRTGIPL

SEQ ID NO: 1275943 - protein, 20 aa, Mycobacterium
PSWFTHGVEFVMDRWQIRGR

SEQ ID NO: 1275944 - protein, 19 aa, Mycobacterium
PSWGEPYAEIAARMKRAVL

SEQ ID NO: 1275945 - protein, 18 aa, Mycobacterium
PSYGLAEATLFVSTTPSN

SEQ ID NO: 1275946 - protein, 22 aa, Mycobacterium
PSYSESFGLVAVEAQACGTPVV

SEQ ID NO: 1275947 - protein, 26 aa, Mycobacterium
PTAAPRWVVDPDFNLDFHVRRVRVPQ

SEQ ID NO: 1275948 - protein, 27 aa, Mycobacterium
PTACCFENRWNPDWLAVADKLRSGFLG

SEQ ID NO: 1275949 - protein, 23 aa, Mycobacterium
PTAESPRGWVYIVANNFDRSGPA

SEQ ID NO: 1275950 - protein, 19 aa, Mycobacterium
PTAGLPFHFQEWREFERFV

SEQ ID NO: 1275951 - protein, 18 aa, Mycobacterium
PTAGRYLLYLDFKVQDTV

SEQ ID NO: 1275952 - protein, 18 aa, Mycobacterium
PTAGRYLLYLDFQVDDTV

SEQ ID NO: 1275953 - protein, 26 aa, Mycobacterium
PTAKLPLVQLLPFLAPMEAELKEMVD

SEQ ID NO: 1275954 - protein, 22 aa, Mycobacterium
PTALQTLEWARMALASCHLTAP

SEQ ID NO: 1275955 - protein, 20 aa, Mycobacterium
PTAPFWFAGSVEELTAIVAH

SEQ ID NO: 1275956 - protein, 19 aa, Mycobacterium
PTAQLPPKNLRRLLEVNVE

SEQ ID NO: 1275957 - protein, 23 aa, Mycobacterium
PTARRAVQYAGRFLTADRAVVLT

SEQ ID NO: 1275958 - protein, 18 aa, Mycobacterium
PTATLRLVCFLRDRDGHE

SEQ ID NO: 1275959 - protein, 27 aa, Mycobacterium
PTATPCGVCDSCVALAPNGPGNVDVVE

SEQ ID NO: 1275960 - protein, 18 aa, Mycobacterium
PTAVIGMTVAGPTRRGEV

SEQ ID NO: 1275961 - protein, 17 aa, Mycobacterium
PTAYLWQEILQRDTWLD

SEQ ID NO: 1275962 - protein, 19 aa, Mycobacterium
PTCFWYMSEMRAASERAAK

SEQ ID NO: 1275963 - protein, 17 aa, Mycobacterium
PTCLGIVTSLRDAGYLV

SEQ ID NO: 1275964 - protein, 18 aa, Mycobacterium
PTDLCAAADALLAGLNSV

SEQ ID NO: 1275965 - protein, 17 aa, Mycobacterium
PTDLTFALAKGARTRGC

SEQ ID NO: 1275966 - protein, 17 aa, Mycobacterium
PTECEFFSLRGLALLTD

SEQ ID NO: 1275967 - protein, 20 aa, Mycobacterium
PTEEGYAILVGYGLQTDWLK

SEQ ID NO: 1275968 - protein, 17 aa, Mycobacterium
PTEFLREDLDAMGVVPA

SEQ ID NO: 1275969 - protein, 30 aa, Mycobacterium
PTEGEMPAWAPALAGSFWAARRARNEAEAT

SEQ ID NO: 1275970 - protein, 31 aa, Mycobacterium
PTEGEMPAWAPALAGSFWAARRARNEAEATR

SEQ ID NO: 1275971 - protein, 23 aa, Mycobacterium
PTEGLKVIAVRSRLMSRLAGQGA

SEQ ID NO: 1275972 - protein, 32 aa, Mycobacterium
PTEIAYILVLRTEFPNGFVATVRGVFTYRVDA

SEQ ID NO: 1275973 - protein, 28 aa, Mycobacterium
PTEPGLVLSGFVDRVGDPVPLVASDGSA

SEQ ID NO: 1275974 - protein, 18 aa, Mycobacterium
PTEPPAFEPAVPGWPAQA

SEQ ID NO: 1275975 - protein, 24 aa, Mycobacterium
PTETEVWRWYLIDKNAPDDVRDWL

SEQ ID NO: 1275976 - protein, 17 aa, Mycobacterium
PTEWGMLEMLVRHRGKL

SEQ ID NO: 1275977 - protein, 18 aa, Mycobacterium
PTFADVPAGWRVVFGEAT

SEQ ID NO: 1275978 - protein, 19 aa, Mycobacterium
PTFQKGLAHHVAAWRAARL

SEQ ID NO: 1275979 - protein, 21 aa, Mycobacterium
PTFRGARIRFDLGRERADALR

SEQ ID NO: 1275980 - protein, 18 aa, Mycobacterium
PTFVPVLGRIAAGGPILA

SEQ ID NO: 1275981 - protein, 19 aa, Mycobacterium
PTGPHVARWTARDFEAYGT

SEQ ID NO: 1275982 - protein, 19 aa, Mycobacterium
PTGRGACDGVRVAVKDLFD

SEQ ID NO: 1275983 - protein, 18 aa, Mycobacterium
PTGSSKYLLESDVTAGPT

SEQ ID NO: 1275984 - protein, 20 aa, Mycobacterium
PTGTPVFRPHAFDGDERTVM

SEQ ID NO: 1275985 - protein, 18 aa, Mycobacterium
PTHALVRVIRDFKPHVIT

SEQ ID NO: 1275986 - protein, 23 aa, Mycobacterium
PTHLRNHLRPVLASLEARLGTLN

SEQ ID NO: 1275987 - protein, 29 aa, Mycobacterium
PTIGAPRWDTAIIGLDWETSVLDERLAAR

SEQ ID NO: 1275988 - protein, 27 aa, Mycobacterium
PTITARLNFQLAFGARVGQRLAEAREE

SEQ ID NO: 1275989 - protein, 27 aa, Mycobacterium
PTIYRRWPDIRWVIAELLTVRITGVLE

SEQ ID NO: 1275990 - protein, 20 aa, Mycobacterium
PTKFWADVCSHMDLDELVDD

SEQ ID NO: 1275991 - protein, 24 aa, Mycobacterium
PTLLEWQVRPGGWVQVFCDADRAG

SEQ ID NO: 1275992 - protein, 17 aa, Mycobacterium
PTLLTWGQIGPGKGIER

SEQ ID NO: 1275993 - protein, 17 aa, Mycobacterium
PTLPRYTASKAYLCEKA

SEQ ID NO: 1275994 - protein, 24 aa, Mycobacterium
PTLRGEKIGALAITEPGGGSDVGH

SEQ ID NO: 1275995 - protein, 17 aa, Mycobacterium
PTLSFGWTKRALAAAAL

SEQ ID NO: 1275996 - protein, 30 aa, Mycobacterium
PTLWGHIFATGWRIKFAYRTFPWTSEAAGG

SEQ ID NO: 1275997 - protein, 17 aa, Mycobacterium
PTPANFLYLPDPVTLGS

SEQ ID NO: 1275998 - protein, 23 aa, Mycobacterium
PTPEARRSVSMSGLVELIIRHRR

SEQ ID NO: 1275999 - protein, 26 aa, Mycobacterium
PTPLTWPVGIAGDFKGVLDRRTGKFI

SEQ ID NO: 1276000 - protein, 18 aa, Mycobacterium
PTPRRPVREVLEIRGGAA

SEQ ID NO: 1276001 - protein, 20 aa, Mycobacterium
PTPSLPFAVIGAFSETVEKA

SEQ ID NO: 1276002 - protein, 19 aa, Mycobacterium
PTQLLDVWRRDDLPAEPAP

SEQ ID NO: 1276003 - protein, 29 aa, Mycobacterium
PTQYRLPDYYRWLLYDADHGPAYRYHRMF

SEQ ID NO: 1276004 - protein, 22 aa, Mycobacterium
PTRGDFKAVVSLDLRRLDELHS

SEQ ID NO: 1276005 - protein, 26 aa, Mycobacterium
PTRGILTSGYGYRWGALHSGVDIANA

SEQ ID NO: 1276006 - protein, 19 aa, Mycobacterium
PTRHARAYVLDAWLRPLPD

SEQ ID NO: 1276007 - protein, 20 aa, Mycobacterium
PTRRGDWWYYGRSFEGKQYG

SEQ ID NO: 1276008 - protein, 26 aa, Mycobacterium
PTRRGDWWYYGRSFQGKQYGVQCRCP

SEQ ID NO: 1276009 - protein, 18 aa, Mycobacterium
PTRRGEVLTDLRLLGPRI

SEQ ID NO: 1276010 - protein, 27 aa, Mycobacterium
PTRYWAPLCRLFGLFGAADDERFGSLE

SEQ ID NO: 1276011 - protein, 22 aa, Mycobacterium
PTSSYTRPVGSFSTPNAPKLPG

SEQ ID NO: 1276012 - protein, 19 aa, Mycobacterium
PTTGLAYGIWQAKYNSSTN

SEQ ID NO: 1276013 - protein, 18 aa, Mycobacterium
PTTLSCPDYAYIATATAP

SEQ ID NO: 1276014 - protein, 27 aa, Mycobacterium
PTTPGDLPLVLALFYLVVDRRTTPLLL

SEQ ID NO: 1276015 - protein, 19 aa, Mycobacterium
PTTSWRTGDRRPLADAEID

SEQ ID NO: 1276016 - protein, 17 aa, Mycobacterium
PTTSYLLAEVEIAPEDG

SEQ ID NO: 1276017 - protein, 19 aa, Mycobacterium
PTVAGREWIRACATGELPD

SEQ ID NO: 1276018 - protein, 25 aa, Mycobacterium
PTVAQAQWWFARLAPGLMNRMAMRF

SEQ ID NO: 1276019 - protein, 18 aa, Mycobacterium
PTVGEPVADVWVMVFDPS

SEQ ID NO: 1276020 - protein, 22 aa, Mycobacterium
PTVGLDPVLRVDLWHQFDELAR

SEQ ID NO: 1276021 - protein, 23 aa, Mycobacterium
PTVGLDPVLRVDLWQQFDELARG

SEQ ID NO: 1276022 - protein, 21 aa, Mycobacterium
PTVLAAFLHRARLRTIQHPGN

SEQ ID NO: 1276023 - protein, 22 aa, Mycobacterium
PTWESLHAVFAHLIADEGNRLP

SEQ ID NO: 1276024 - protein, 34 aa, Mycobacterium
PTYAVACTRVDYGLCPFAGWPVAIPDGAEPNTGS

SEQ ID NO: 1276025 - protein, 22 aa, Mycobacterium
PTYEVGALLAGAAVARADSLTQ

SEQ ID NO: 1276026 - protein, 17 aa, Mycobacterium
PTYFLGGSMGLDKEGAE

SEQ ID NO: 1276027 - protein, 26 aa, Mycobacterium
PTYLHSFAPMPFKPVAREGKPGLQEF

SEQ ID NO: 1276028 - protein, 18 aa, Mycobacterium
PTYREFYERRQLAAGDDV

SEQ ID NO: 1276029 - protein, 20 aa, Mycobacterium
PVAAALFELAERITGFMPAD

SEQ ID NO: 1276030 - protein, 17 aa, Mycobacterium
PVAAAVRTGLDAVIGLV

SEQ ID NO: 1276031 - protein, 21 aa, Mycobacterium
PVAATVCRKAFERGVLMETSG

SEQ ID NO: 1276032 - protein, 31 aa, Mycobacterium
PVADILSAKGFRCVLPDWPLGSHRIPVDSEL

SEQ ID NO: 1276033 - protein, 31 aa, Mycobacterium
PVADILSAKGFRCVLPDWPLGSHRTPVDSEL

SEQ ID NO: 1276034 - protein, 20 aa, Mycobacterium
PVAGELWVRATVVRPGRKIE

SEQ ID NO: 1276035 - protein, 18 aa, Mycobacterium
PVAIVGIGCRLAGDITTP

SEQ ID NO: 1276036 - protein, 18 aa, Mycobacterium
PVALCARTPERLERVAGR

SEQ ID NO: 1276037 - protein, 19 aa, Mycobacterium
PVAMPSSLLGLLSQIPNHT

SEQ ID NO: 1276038 - protein, 27 aa, Mycobacterium
PVAPCRRGAPGTVRLPALDRLRRSASA

SEQ ID NO: 1276039 - protein, 25 aa, Mycobacterium
PVAQLRRSGTLTGRHLDDRAAMKKS

SEQ ID NO: 1276040 - protein, 22 aa, Mycobacterium
PVARPFLGLIGFVPGPVAAAVR

SEQ ID NO: 1276041 - protein, 19 aa, Mycobacterium
PVARPSWQAAATGLIDAII

SEQ ID NO: 1276042 - protein, 19 aa, Mycobacterium
PVASRLGAQAAGFGLLMET

SEQ ID NO: 1276043 - protein, 24 aa, Mycobacterium
PVAVKEIIDVAGMPVTFGSIVFAG

SEQ ID NO: 1276044 - protein, 18 aa, Mycobacterium
PVAYAAVGPSFWGDGMYP

SEQ ID NO: 1276045 - protein, 21 aa, Mycobacterium
PVCPHLGGIVKWNDSDRAWEC

SEQ ID NO: 1276046 - protein, 19 aa, Mycobacterium
PVCTSEFITFASMQDEFAA

SEQ ID NO: 1276047 - protein, 18 aa, Mycobacterium
PVDDAQILNAVDEAGYSA

SEQ ID NO: 1276048 - protein, 24 aa, Mycobacterium
PVDEVVRSGARFEVVSEFEPAGDQ

SEQ ID NO: 1276049 - protein, 21 aa, Mycobacterium
PVDFPLDGVVPGFQKAIAGQK

SEQ ID NO: 1276050 - protein, 24 aa, Mycobacterium
PVDGGYLFNGRWQFSSGTDHCDWI

SEQ ID NO: 1276051 - protein, 24 aa, Mycobacterium
PVDGLPTIFVYDGYPGGAGFAARG

SEQ ID NO: 1276052 - protein, 25 aa, Mycobacterium
PVDIKKQMIDWWGPIVDEYYASSEA

SEQ ID NO: 1276053 - protein, 23 aa, Mycobacterium
PVDKLRYDVTSWQRTTLWERMHM

SEQ ID NO: 1276054 - protein, 24 aa, Mycobacterium
PVDKTKLRLGRYVEDSLAGKDNEE

SEQ ID NO: 1276055 - protein, 23 aa, Mycobacterium
PVDLAVFPAFLFIPISAGGTMVV

SEQ ID NO: 1276056 - protein, 21 aa, Mycobacterium
PVDLLRAVTDFALPDPTGDGA

SEQ ID NO: 1276057 - protein, 18 aa, Mycobacterium
PVDPDWLYTEYIVRQRSC

SEQ ID NO: 1276058 - protein, 18 aa, Mycobacterium
PVDRYPIAAGNHGAEASN

SEQ ID NO: 1276059 - protein, 24 aa, Mycobacterium
PVEALRYGPLCMVEGARLDDAFVW

SEQ ID NO: 1276060 - protein, 20 aa, Mycobacterium
PVEASELLFRAQGRTLAHTD

SEQ ID NO: 1276061 - protein, 23 aa, Mycobacterium
PVEHHAVLDAVEWLVEHEDAEVT

SEQ ID NO: 1276062 - protein, 25 aa, Mycobacterium
PVEIKRRMIDWWGPIIDEYYASSEA

SEQ ID NO: 1276063 - protein, 19 aa, Mycobacterium
PVELAGYRLPAGVMVIPGL

SEQ ID NO: 1276064 - protein, 19 aa, Mycobacterium
PVELAIWLVRFRADSPGWP

SEQ ID NO: 1276065 - protein, 20 aa, Mycobacterium
PVELNLGSTTAFVSDIVVNP

SEQ ID NO: 1276066 - protein, 20 aa, Mycobacterium
PVELRLGAETVVLDFPKRVV

SEQ ID NO: 1276067 - protein, 21 aa, Mycobacterium
PVEQRAAVVAVDMQGYSVAET

SEQ ID NO: 1276068 - protein, 19 aa, Mycobacterium
PVERAHTWVGVAGTMTTLA

SEQ ID NO: 1276069 - protein, 17 aa, Mycobacterium
PVEWKRDQALKFGATHA

SEQ ID NO: 1276070 - protein, 22 aa, Mycobacterium
PVFVDPVIQLPPLITPIAGPGY

SEQ ID NO: 1276071 - protein, 18 aa, Mycobacterium
PVGAIKKNGDFDFVACSV

SEQ ID NO: 1276072 - protein, 19 aa, Mycobacterium
PVGDIAAGQGFVVMANAGD

SEQ ID NO: 1276073 - protein, 22 aa, Mycobacterium
PVGEVRALYAWLGDPVTVEFES

SEQ ID NO: 1276074 - protein, 24 aa, Mycobacterium
PVGITWGGDAVWFVEIATGRIGRI

SEQ ID NO: 1276075 - protein, 27 aa, Mycobacterium
PVGLARFCTLRSWLSQWSFDDAHGDAV

SEQ ID NO: 1276076 - protein, 24 aa, Mycobacterium
PVGNAGNITAYWKGYTEYHRDGLA

SEQ ID NO: 1276077 - protein, 23 aa, Mycobacterium
PVGPGLYSWLPLGLKVLRKIENI

SEQ ID NO: 1276078 - protein, 17 aa, Mycobacterium
PVGTVLGEALGLPVSLA

SEQ ID NO: 1276079 - protein, 23 aa, Mycobacterium
PVHPARFVVEATKAFNDYAQDGI

SEQ ID NO: 1276080 - protein, 23 aa, Mycobacterium
PVHSVRLAGLVAHQEVLFGTMGE

SEQ ID NO: 1276081 - protein, 25 aa, Mycobacterium
PVHTEFRKLVARGFTPRQVEAVEPK

SEQ ID NO: 1276082 - protein, 26 aa, Mycobacterium
PVHVLAHGWGAAGVWQYLKRADAPER

SEQ ID NO: 1276083 - protein, 32 aa, Mycobacterium
PVIAMYRLAPPVYDVLMGVFLRTFGFTSESTE

SEQ ID NO: 1276084 - protein, 17 aa, Mycobacterium
PVIDDHRLVGIVSEADV

SEQ ID NO: 1276085 - protein, 24 aa, Mycobacterium
PVIDLKSDFLAGGEPFSRTVDGSD

SEQ ID NO: 1276086 - protein, 20 aa, Mycobacterium
PVIEPRLGRQLAGGVSDVGT

SEQ ID NO: 1276087 - protein, 18 aa, Mycobacterium
PVIFECVGVPGMIDGIIG

SEQ ID NO: 1276088 - protein, 20 aa, Mycobacterium
PVIKMFGEGGGRQVAESLSR

SEQ ID NO: 1276089 - protein, 22 aa, Mycobacterium
PVITWEPWLWRTDVTVAGAETI

SEQ ID NO: 1276090 - protein, 25 aa, Mycobacterium
PVKAGEAFWEPGFDVVHYQAANLRT

SEQ ID NO: 1276091 - protein, 27 aa, Mycobacterium
PVKLCLKRLTPWLSPGARVILDDYSDY

SEQ ID NO: 1276092 - protein, 23 aa, Mycobacterium
PVKTRKCVFCSKKGKNQDIDYKD

SEQ ID NO: 1276093 - protein, 19 aa, Mycobacterium
PVKYHRLHLAAWRGVPADA

SEQ ID NO: 1276094 - protein, 21 aa, Mycobacterium
PVLHELRRPLAGFISTLLTPL

SEQ ID NO: 1276095 - protein, 19 aa, Mycobacterium
PVLKALVGRIAKDEERHEE

SEQ ID NO: 1276096 - protein, 18 aa, Mycobacterium
PVLLPLDNVVAWADAPGD

SEQ ID NO: 1276097 - protein, 20 aa, Mycobacterium
PVLLPRRGTLIAWTTQGFPP

SEQ ID NO: 1276098 - protein, 23 aa, Mycobacterium
PVLLRTRMPPSFRVGESGCDTTP

SEQ ID NO: 1276099 - protein, 18 aa, Mycobacterium
PVLPEAPPAQPTAEFDGL

SEQ ID NO: 1276100 - protein, 18 aa, Mycobacterium
PVLRGQVMWCQLFSEPGA

SEQ ID NO: 1276101 - protein, 19 aa, Mycobacterium
PVLTAALRRARTRIRLGEW

SEQ ID NO: 1276102 - protein, 24 aa, Mycobacterium
PVLVIACLRLSAREGKVPYVPMPH

SEQ ID NO: 1276103 - protein, 24 aa, Mycobacterium
PVMSEAAEALAEFDVPFEVGVVSA

SEQ ID NO: 1276104 - protein, 27 aa, Mycobacterium
PVMTWLFAWCFARRGWAERAATLRREG

SEQ ID NO: 1276105 - protein, 17 aa, Mycobacterium
PVNEFKATGSYSTYTVT

SEQ ID NO: 1276106 - protein, 22 aa, Mycobacterium
PVNGYKGWRSPALPEFDPFWRE

SEQ ID NO: 1276107 - protein, 23 aa, Mycobacterium
PVNPFMFHCHLLFHEDTGMMGQF

SEQ ID NO: 1276108 - protein, 24 aa, Mycobacterium
PVPAEVEAALPLGSTDMGNVTQVV

SEQ ID NO: 1276109 - protein, 24 aa, Mycobacterium
PVPAPRSGPQVLVLSARTEETLAQ

SEQ ID NO: 1276110 - protein, 23 aa, Mycobacterium
PVPCDRCGRHYQLVANWPNESVC

SEQ ID NO: 1276111 - protein, 20 aa, Mycobacterium
PVPDARCRIEHCSLWPQAQL

SEQ ID NO: 1276112 - protein, 21 aa, Mycobacterium
PVPECQSPLFLHVDADDRAHV

SEQ ID NO: 1276113 - protein, 33 aa, Mycobacterium
PVPGQGIVKSGLFIPRDVVFNVPRDDLGDNRGF

SEQ ID NO: 1276114 - protein, 17 aa, Mycobacterium
PVPGQGVVRTNLFIPSE

SEQ ID NO: 1276115 - protein, 26 aa, Mycobacterium
PVPHRPVAEYFVWFKGDYRVDAGDRM

SEQ ID NO: 1276116 - protein, 19 aa, Mycobacterium
PVPTEAGVHGWWFRDIPGG

SEQ ID NO: 1276117 - protein, 25 aa, Mycobacterium
PVPVAYHTFGGWKRSGFGDLNQHGP

SEQ ID NO: 1276118 - protein, 26 aa, Mycobacterium
PVPYVYPVDLRYLLSPPVSATESTNP

SEQ ID NO: 1276119 - protein, 18 aa, Mycobacterium
PVQARGAATIDMLTTSAV

SEQ ID NO: 1276120 - protein, 27 aa, Mycobacterium
PVQAVVAGADWPRLADAYRMRAAVKVL

SEQ ID NO: 1276121 - protein, 20 aa, Mycobacterium
PVRAPRWLLTPARQRARSAV

SEQ ID NO: 1276122 - protein, 24 aa, Mycobacterium
PVREAIHAVFLFHAIKAGLDMGIV

SEQ ID NO: 1276123 - protein, 20 aa, Mycobacterium
PVRELMGYSWSRRDEWLHRL

SEQ ID NO: 1276124 - protein, 18 aa, Mycobacterium
PVRESLKTLIGEGLVAHR

SEQ ID NO: 1276125 - protein, 17 aa, Mycobacterium
PVRGEVGELVITKPMPS

SEQ ID NO: 1276126 - protein, 22 aa, Mycobacterium
PVRNLACRVYLTDAGLRGLPTV

SEQ ID NO: 1276127 - protein, 22 aa, Mycobacterium
PVRPAELEWTLARTDHPDATTE

SEQ ID NO: 1276128 - protein, 24 aa, Mycobacterium
PVRQIFFRLGEVILEVVGSPQTAR

SEQ ID NO: 1276129 - protein, 17 aa, Mycobacterium
PVRSTVVAADWTRLGAA

SEQ ID NO: 1276130 - protein, 24 aa, Mycobacterium
PVRTNRTNQHWLIELWQDGEIRTN

SEQ ID NO: 1276131 - protein, 27 aa, Mycobacterium
PVRVRDGCGLIGPLVFPGRTSCLSCAD

SEQ ID NO: 1276132 - protein, 21 aa, Mycobacterium
PVRVRDGTGLIGPLVIPGVTS

SEQ ID NO: 1276133 - protein, 20 aa, Mycobacterium
PVRYHSLLVAAWRGEPVEAM

SEQ ID NO: 1276134 - protein, 22 aa, Mycobacterium
PVSACIPALIHAAANDTDFRDR

SEQ ID NO: 1276135 - protein, 31 aa, Mycobacterium
PVSALVVFEVMVRPLIRLSLGKRQATRRIVP

SEQ ID NO: 1276136 - protein, 28 aa, Mycobacterium
PVSGDAKVAFYRGLDLFLFATTHPQEAQ

SEQ ID NO: 1276137 - protein, 25 aa, Mycobacterium
PVSMLIPRVVGFKLTGEIKPGVTAT

SEQ ID NO: 1276138 - protein, 24 aa, Mycobacterium
PVSPEPAAVWALAGSARRETAVES

SEQ ID NO: 1276139 - protein, 17 aa, Mycobacterium
PVSYFEMLGRPWRDARR

SEQ ID NO: 1276140 - protein, 23 aa, Mycobacterium
PVSYRKSGEVIAIRVMTPDKKTW

SEQ ID NO: 1276141 - protein, 17 aa, Mycobacterium
PVTLLDVRWQLAQPDGR

SEQ ID NO: 1276142 - protein, 19 aa, Mycobacterium
PVTLPLVGVGHSMGACLTM

SEQ ID NO: 1276143 - protein, 22 aa, Mycobacterium
PVTSGVWQGHWRDPGSRSTICG

SEQ ID NO: 1276144 - protein, 20 aa, Mycobacterium
PVVAEFGAFLSGVTLREPQI

SEQ ID NO: 1276145 - protein, 18 aa, Mycobacterium
PVVALLADRFRIVAYDTR

SEQ ID NO: 1276146 - protein, 17 aa, Mycobacterium
PVVAPCRVVYVVDEPDR

SEQ ID NO: 1276147 - protein, 26 aa, Mycobacterium
PVVARGWRTPLRLLFIDGGHTEEAAN

SEQ ID NO: 1276148 - protein, 25 aa, Mycobacterium
PVVCSVQGWAVGLGCNLALAADFTV

SEQ ID NO: 1276149 - protein, 25 aa, Mycobacterium
PVVDSFVYDFLDPVVNDPLNLNVWL

SEQ ID NO: 1276150 - protein, 17 aa, Mycobacterium
PVVEAFLTPAFEIPGVT

SEQ ID NO: 1276151 - protein, 26 aa, Mycobacterium
PVVGFIWEVLGRIGLGRKDAIVSLGG

SEQ ID NO: 1276152 - protein, 19 aa, Mycobacterium
PVVHSCQLLDPGLDVRRIE

SEQ ID NO: 1276153 - protein, 18 aa, Mycobacterium
PVVLLDGHCPLPREVLGN

SEQ ID NO: 1276154 - protein, 21 aa, Mycobacterium
PVVPIPEFLIRRACGGVLDAA

SEQ ID NO: 1276155 - protein, 26 aa, Mycobacterium
PVVRENLRTGAPIQLSAAVVASWARY

SEQ ID NO: 1276156 - protein, 25 aa, Mycobacterium
PVVVDGRLAGIVSIGDVVKTRMEEL

SEQ ID NO: 1276157 - protein, 18 aa, Mycobacterium
PVWISGPQFDAWKHTQLV

SEQ ID NO: 1276158 - protein, 19 aa, Mycobacterium
PVWRHWVRDMSLRHKFIRY

SEQ ID NO: 1276159 - protein, 24 aa, Mycobacterium
PVYERVKPAFKQWASVVVHAGEPG

SEQ ID NO: 1276160 - protein, 19 aa, Mycobacterium
PVYLTNAVKHFKFVPAERG

SEQ ID NO: 1276161 - protein, 27 aa, Mycobacterium
PWASHADRIVVVWPRGGGYLAADVVAD

SEQ ID NO: 1276162 - protein, 18 aa, Mycobacterium
PWASSPERIAWLEKVLDA

SEQ ID NO: 1276163 - protein, 18 aa, Mycobacterium
PWAVFDLSLGRAMYSGFT

SEQ ID NO: 1276164 - protein, 18 aa, Mycobacterium
PWDRAASVQKCIRTPDID

SEQ ID NO: 1276165 - protein, 21 aa, Mycobacterium
PWEPNVALVICDAYESHSDTM

SEQ ID NO: 1276166 - protein, 19 aa, Mycobacterium
PWEPWLHALPVEFETEQQV

SEQ ID NO: 1276167 - protein, 21 aa, Mycobacterium
PWFLDAYRRAWEWADTTGWRP

SEQ ID NO: 1276168 - protein, 20 aa, Mycobacterium
PWGDLSLPALQLLISSLPKF

SEQ ID NO: 1276169 - protein, 17 aa, Mycobacterium
PWHEIFCSDVAHVLVDE

SEQ ID NO: 1276170 - protein, 23 aa, Mycobacterium
PWHREFPGRLAGSVYAVPPAARA

SEQ ID NO: 1276171 - protein, 24 aa, Mycobacterium
PWKEPRPAPLGFDFHELLKARSLR

SEQ ID NO: 1276172 - protein, 21 aa, Mycobacterium
PWMKISEAIDYLRAVAPVHAV

SEQ ID NO: 1276173 - protein, 25 aa, Mycobacterium
PWPEKRLSYANAVLVEAMIAAGVAL

SEQ ID NO: 1276174 - protein, 22 aa, Mycobacterium
PWPYVRRQPPQPARWSPGRALR

SEQ ID NO: 1276175 - protein, 23 aa, Mycobacterium
PWRQRAAAVLAELPDDMADYKGI

SEQ ID NO: 1276176 - protein, 17 aa, Mycobacterium
PWRRPGVSAWQILVSEF

SEQ ID NO: 1276177 - protein, 18 aa, Mycobacterium
PWSPVSLGDYCAGSNHVL

SEQ ID NO: 1276178 - protein, 19 aa, Mycobacterium
PWTPLKLYYNHGFLRQRMQ

SEQ ID NO: 1276179 - protein, 24 aa, Mycobacterium
PWVAERLVEFGDFLTAHPDSIHPV

SEQ ID NO: 1276180 - protein, 30 aa, Mycobacterium
PWVPPKVMAPHLWRFLQYQPLVAFAGVPLQ

SEQ ID NO: 1276181 - protein, 19 aa, Mycobacterium
PWVVRTVARIAVPVQLFLY

SEQ ID NO: 1276182 - protein, 23 aa, Mycobacterium
PWYLVRYWRLLKFKLTNPHVITR

SEQ ID NO: 1276183 - protein, 18 aa, Mycobacterium
PYAARPAYDDTIQAECGL

SEQ ID NO: 1276184 - protein, 18 aa, Mycobacterium
PYAARVIAIMLGLPESEW

SEQ ID NO: 1276185 - protein, 18 aa, Mycobacterium
PYAGFDWDTYLKFWDLVA

SEQ ID NO: 1276186 - protein, 19 aa, Mycobacterium
PYAGFDWDTYLKFWDLVAR

SEQ ID NO: 1276187 - protein, 24 aa, Mycobacterium
PYAHARAFVLVPWLQVEPTATLTV

SEQ ID NO: 1276188 - protein, 17 aa, Mycobacterium
PYAPMLSAGLCRVTGFE

SEQ ID NO: 1276189 - protein, 17 aa, Mycobacterium
PYARSYAPAGFRAGPWA

SEQ ID NO: 1276190 - protein, 27 aa, Mycobacterium
PYDRALELGCGTGFFLLNLIQAGVARR

SEQ ID NO: 1276191 - protein, 23 aa, Mycobacterium
PYEFRSCDIREDDSVKGLVEGIV

SEQ ID NO: 1276192 - protein, 24 aa, Mycobacterium
PYESLRWLPDVEVRFVWHEPGPIA

SEQ ID NO: 1276193 - protein, 18 aa, Mycobacterium
PYEVELCVAEVAHHGETK

SEQ ID NO: 1276194 - protein, 23 aa, Mycobacterium
PYGEPTPYLAPPVETHGEAAPGS

SEQ ID NO: 1276195 - protein, 19 aa, Mycobacterium
PYGLAGSSGLAWVSQTATN

SEQ ID NO: 1276196 - protein, 19 aa, Mycobacterium
PYGPSVPALYGLIAQAWMH

SEQ ID NO: 1276197 - protein, 18 aa, Mycobacterium
PYGTMKAAIIHYTQGLAF

SEQ ID NO: 1276198 - protein, 19 aa, Mycobacterium
PYGTVLIIGAWNFPFALTL

SEQ ID NO: 1276199 - protein, 20 aa, Mycobacterium
PYLAAKRVRALETFAENTMH

SEQ ID NO: 1276200 - protein, 24 aa, Mycobacterium
PYLRPLQLIVGRACELTGAEQGIV

SEQ ID NO: 1276201 - protein, 19 aa, Mycobacterium
PYLTLWARVAGFDLTHLDT

SEQ ID NO: 1276202 - protein, 25 aa, Mycobacterium
PYMQKELRVLVSRSYGPGRYDRDYE

SEQ ID NO: 1276203 - protein, 23 aa, Mycobacterium
PYPDLILTALLRTGADRVQAVAA

SEQ ID NO: 1276204 - protein, 18 aa, Mycobacterium
PYPRFRAYVQQRRHGSQT

SEQ ID NO: 1276205 - protein, 20 aa, Mycobacterium
PYPSARCPEVTVDPATIDKM

SEQ ID NO: 1276206 - protein, 19 aa, Mycobacterium
PYPSRFVGRFAHLMSVGEP

SEQ ID NO: 1276207 - protein, 18 aa, Mycobacterium
PYPTMYVNQPWTIRQYAG

SEQ ID NO: 1276208 - protein, 18 aa, Mycobacterium
PYRANLRPAAPAGVPVDV

SEQ ID NO: 1276209 - protein, 19 aa, Mycobacterium
PYRELNPLAWRNALEPGSP

SEQ ID NO: 1276210 - protein, 19 aa, Mycobacterium
PYRPWRHGFGEAQMGDPVA

SEQ ID NO: 1276211 - protein, 32 aa, Mycobacterium
PYSMADRVLPELKRFNLVICDESHNLRNSSTI

SEQ ID NO: 1276212 - protein, 19 aa, Mycobacterium
PYSRGDLVARLHADGRIDA

SEQ ID NO: 1276213 - protein, 22 aa, Mycobacterium
PYTFRKVFRGMAIARENRLPII

SEQ ID NO: 1276214 - protein, 18 aa, Mycobacterium
PYVKIHGEWIPINAQVAN

SEQ ID NO: 1276215 - protein, 23 aa, Mycobacterium
PYVVGFVELPEGVLVESLIVGAT

SEQ ID NO: 1276216 - protein, 22 aa, Mycobacterium
PYWRRHAREPVRFADSAATLAD

SEQ ID NO: 1276217 - protein, 21 aa, Mycobacterium
QAAALPLGFITSWEGLVDRAG

SEQ ID NO: 1276218 - protein, 26 aa, Mycobacterium
QAAAQRLPFLPIRAGLGSDVRKFWGD

SEQ ID NO: 1276219 - protein, 20 aa, Mycobacterium
QAAGVKAVMVSMRRALQQMG

SEQ ID NO: 1276220 - protein, 26 aa, Mycobacterium
QAALMLRCGPRFVAACRRRYGSAFTL

SEQ ID NO: 1276221 - protein, 24 aa, Mycobacterium
QAALPARLRRNFDHSFGRQPQMMK

SEQ ID NO: 1276222 - protein, 44 aa, Mycobacterium
QAALSRVGSPYSWGATGPNAFDCSGLIKWAFLQNGKSLPRSSQA

SEQ ID NO: 1276223 - protein, 43 aa, Mycobacterium
QAALTRVGAPYSWGATGPDAFDCSGLIKWAFLQNGKSLPRSSQ

SEQ ID NO: 1276224 - protein, 26 aa, Mycobacterium
QAARCMDCGIPFCHNGCPLGNLIPEW

SEQ ID NO: 1276225 - protein, 25 aa, Mycobacterium
QAARLSVVVDQVWRAEGLAEMIEDA

SEQ ID NO: 1276226 - protein, 17 aa, Mycobacterium
QAAVKAGAWEQVVEDDT

SEQ ID NO: 1276227 - protein, 21 aa, Mycobacterium
QAAVLKANWQRAAKVLGSSRP

SEQ ID NO: 1276228 - protein, 23 aa, Mycobacterium
QACQALRLAECDVALAGGVNVLL

SEQ ID NO: 1276229 - protein, 18 aa, Mycobacterium
QADALMLLYLLSADELRE

SEQ ID NO: 1276230 - protein, 27 aa, Mycobacterium
QADAYRAISLLLRRPPGREAFPGDVFY

SEQ ID NO: 1276231 - protein, 22 aa, Mycobacterium
QADDLPPGWLRLLTDERLRPAV

SEQ ID NO: 1276232 - protein, 23 aa, Mycobacterium
QADDVWLPLFRPVAGDLGELPAD

SEQ ID NO: 1276233 - protein, 18 aa, Mycobacterium
QADPSVGRPVTWTIEALE

SEQ ID NO: 1276234 - protein, 25 aa, Mycobacterium
QADRFWADFCTRLGRPELIDDERFA

SEQ ID NO: 1276235 - protein, 20 aa, Mycobacterium
QAECWAKPLVDLVAGEEMTP

SEQ ID NO: 1276236 - protein, 29 aa, Mycobacterium
QAEILWRHWDHCAFHWFPGNHVLHVSQPD

SEQ ID NO: 1276237 - protein, 28 aa, Mycobacterium
QAFDGLRLAGRPVRRPDLTIATEDHNVP

SEQ ID NO: 1276238 - protein, 25 aa, Mycobacterium
QAFEKRWELGGVLFSKTFSDQMINL

SEQ ID NO: 1276239 - protein, 18 aa, Mycobacterium
QAFIARLYAVLVGDAGRE

SEQ ID NO: 1276240 - protein, 19 aa, Mycobacterium
QAFRYAVDGMMGRNMREYV

SEQ ID NO: 1276241 - protein, 24 aa, Mycobacterium
QAFVRRRLAGYKVPRRLVTVDALP

SEQ ID NO: 1276242 - protein, 17 aa, Mycobacterium
QAGALDFIPAKRVGTAE

SEQ ID NO: 1276243 - protein, 17 aa, Mycobacterium
QAGALEFIPAKRVGTAD

SEQ ID NO: 1276244 - protein, 24 aa, Mycobacterium
QAGDAEAAYAHFGRRFDDLHTEVV

SEQ ID NO: 1276245 - protein, 24 aa, Mycobacterium
QAGEIYFEGGYDFEYLNDPDKTAS

SEQ ID NO: 1276246 - protein, 24 aa, Mycobacterium
QAGGKRFRPLFTVLSAQLGPEPDA

SEQ ID NO: 1276247 - protein, 22 aa, Mycobacterium
QAGNIARLSWLAAGYPEEVPGV

SEQ ID NO: 1276248 - protein, 25 aa, Mycobacterium
QAGPELVTRLILVDVVPRYEKDGSA

SEQ ID NO: 1276249 - protein, 25 aa, Mycobacterium
QAGVSRPTLYRWFADKPALLEAFGI

SEQ ID NO: 1276250 - protein, 18 aa, Mycobacterium
QAGYAGNIVIGFGRVDGR

SEQ ID NO: 1276251 - protein, 20 aa, Mycobacterium
QAHARLSAGLALAEDTEMHF

SEQ ID NO: 1276252 - protein, 22 aa, Mycobacterium
QAHLALGFKTPQAYLQDVFRID

SEQ ID NO: 1276253 - protein, 19 aa, Mycobacterium
QAIAFKIARMEARAHAARA

SEQ ID NO: 1276254 - protein, 17 aa, Mycobacterium
QAIEMSDMLLGKQGIDP

SEQ ID NO: 1276255 - protein, 22 aa, Mycobacterium
QAIEMSDMLLGKQGVDPEVVSL

SEQ ID NO: 1276256 - protein, 29 aa, Mycobacterium
QAIEVYWRPGCPFCRRLMRALRGSGLTLR

SEQ ID NO: 1276257 - protein, 17 aa, Mycobacterium
QAILKVRSHYGIATSRQ

SEQ ID NO: 1276258 - protein, 19 aa, Mycobacterium
QAILPAWREQGWLDQHTVV

SEQ ID NO: 1276259 - protein, 17 aa, Mycobacterium
QAISRGAPVLAICAAIQ

SEQ ID NO: 1276260 - protein, 20 aa, Mycobacterium
QAKASFVAVEFDEFGAGKGA

SEQ ID NO: 1276261 - protein, 28 aa, Mycobacterium
QALAPVRFFNPLSMRFAKKATREDIAEV

SEQ ID NO: 1276262 - protein, 19 aa, Mycobacterium
QALCGFAAGIDRGETEREW

SEQ ID NO: 1276263 - protein, 18 aa, Mycobacterium
QALDALRPTAKFYEEVRV

SEQ ID NO: 1276264 - protein, 18 aa, Mycobacterium
QALIAKAWMVAARGGERT

SEQ ID NO: 1276265 - protein, 27 aa, Mycobacterium
QALINRYPRVCGMTGTALAAGEQLRQF

SEQ ID NO: 1276266 - protein, 22 aa, Mycobacterium
QALKRHLEALLALETKIVEGRE

SEQ ID NO: 1276267 - protein, 27 aa, Mycobacterium
QALLYCVVLHRFLRWRAPGYRAESHIA

SEQ ID NO: 1276268 - protein, 24 aa, Mycobacterium
QALPDHPLELLGIGSVIIEATRPD

SEQ ID NO: 1276269 - protein, 17 aa, Mycobacterium
QALREYLARHAPDAATS

SEQ ID NO: 1276270 - protein, 24 aa, Mycobacterium
QALRHEHLRLALQNYTAHTVPALN

SEQ ID NO: 1276271 - protein, 21 aa, Mycobacterium
QALRVSNRLGVAMPAHCTSTG

SEQ ID NO: 1276272 - protein, 23 aa, Mycobacterium
QALSELRLAGVDGPYSVLLSADV

SEQ ID NO: 1276273 - protein, 23 aa, Mycobacterium
QALVASALCKVSGGCTQEVVDEQ

SEQ ID NO: 1276274 - protein, 20 aa, Mycobacterium
QALVLPHCRTYRYGVDRDTV

SEQ ID NO: 1276275 - protein, 27 aa, Mycobacterium
QAMILLASWCALRFGELTELRRKDVEL

SEQ ID NO: 1276276 - protein, 22 aa, Mycobacterium
QAMLPKAIAAGVRIACGTDAPA

SEQ ID NO: 1276277 - protein, 23 aa, Mycobacterium
QAMSMVGGQSFRRGGIFERLYRD

SEQ ID NO: 1276278 - protein, 22 aa, Mycobacterium
QAMTGEALAPVLPATAAAQAHG

SEQ ID NO: 1276279 - protein, 22 aa, Mycobacterium
QAMTGEALAPVLPATATAQAHG

SEQ ID NO: 1276280 - protein, 25 aa, Mycobacterium
QANCSVSRAGVLRGVHFAQLPPSQA

SEQ ID NO: 1276281 - protein, 26 aa, Mycobacterium
QAPGFDWPGWLAGLGGTAEQAAEVVV

SEQ ID NO: 1276282 - protein, 19 aa, Mycobacterium
QAQAARYAHVNVYGRFVVP

SEQ ID NO: 1276283 - protein, 17 aa, Mycobacterium
QAQAVVRHGLQRAVVGS

SEQ ID NO: 1276284 - protein, 18 aa, Mycobacterium
QAQLLRRSVRTFNSEPVP

SEQ ID NO: 1276285 - protein, 22 aa, Mycobacterium
QAQSLCPDWKVRGVVDHVTSIE

SEQ ID NO: 1276286 - protein, 20 aa, Mycobacterium
QARASVFAMVETARGLAAID

SEQ ID NO: 1276287 - protein, 17 aa, Mycobacterium
QARAVRAMFDMMGANPR

SEQ ID NO: 1276288 - protein, 19 aa, Mycobacterium
QARGKGGLVRVTWAEATEM

SEQ ID NO: 1276289 - protein, 18 aa, Mycobacterium
QARLMAHAAFGLLNSTPH

SEQ ID NO: 1276290 - protein, 19 aa, Mycobacterium
QARPARVVIDVTIEGGQVT

SEQ ID NO: 1276291 - protein, 25 aa, Mycobacterium
QARPGQTVRLHWSRPRRPFEDDGRA

SEQ ID NO: 1276292 - protein, 18 aa, Mycobacterium
QARRIVCSGQLDPEAVVT

SEQ ID NO: 1276293 - protein, 24 aa, Mycobacterium
QARSRLLMMTNFLNLWEKSDVRAV

SEQ ID NO: 1276294 - protein, 21 aa, Mycobacterium
QARSVEFSWRQSASAMREVFD

SEQ ID NO: 1276295 - protein, 23 aa, Mycobacterium
QARVSRPTLYRWFPSKQDLLSAF

SEQ ID NO: 1276296 - protein, 23 aa, Mycobacterium
QASAAELARLCFVTRQSLQDVST

SEQ ID NO: 1276297 - protein, 29 aa, Mycobacterium
QASGQGFRSYPLFVPFGIGDADAATLAEL

SEQ ID NO: 1276298 - protein, 17 aa, Mycobacterium
QASLAFRVAARMVQLSE

SEQ ID NO: 1276299 - protein, 18 aa, Mycobacterium
QASRPGHFMPAALLESQF

SEQ ID NO: 1276300 - protein, 25 aa, Mycobacterium
QATFRKLQIGNRVELARYAIEHGLD

SEQ ID NO: 1276301 - protein, 18 aa, Mycobacterium
QATIPSYVRYGANPYVVV

SEQ ID NO: 1276302 - protein, 22 aa, Mycobacterium
QATQWLEWMTLVAPEQVLRGVL

SEQ ID NO: 1276303 - protein, 19 aa, Mycobacterium
QAVEAVVAVSPRVSLVLKA

SEQ ID NO: 1276304 - protein, 17 aa, Mycobacterium
QAVELFWGLQEHRDRFV

SEQ ID NO: 1276305 - protein, 24 aa, Mycobacterium
QAVGENGWAMPLPEELKDDLKSTV

SEQ ID NO: 1276306 - protein, 25 aa, Mycobacterium
QAVHVLDMLRYLVGEVAEVSAYANA

SEQ ID NO: 1276307 - protein, 25 aa, Mycobacterium
QAVLAADDRAVWTWLTQIRSAVPNV

SEQ ID NO: 1276308 - protein, 22 aa, Mycobacterium
QAVNIWAGTGFRQAGGGSVRDI

SEQ ID NO: 1276309 - protein, 25 aa, Mycobacterium
QAVQRIVDHWAMFDTVRFDLNLVVA

SEQ ID NO: 1276310 - protein, 18 aa, Mycobacterium
QAVRSCLIFAVQVDGQEV

SEQ ID NO: 1276311 - protein, 20 aa, Mycobacterium
QAVVDDIGWARYPRVSPDRP

SEQ ID NO: 1276312 - protein, 17 aa, Mycobacterium
QAVVISWGDPVLPDAPK

SEQ ID NO: 1276313 - protein, 25 aa, Mycobacterium
QAYQFPMGLGLVSQFFGRYYTPDEA

SEQ ID NO: 1276314 - protein, 18 aa, Mycobacterium
QCDARLVDFGSLPTPMNR

SEQ ID NO: 1276315 - protein, 21 aa, Mycobacterium
QCGWLKDRYGLSWQIVPDRLT

SEQ ID NO: 1276316 - protein, 18 aa, Mycobacterium
QCHTVGGAIHLLSNYVDC

SEQ ID NO: 1276317 - protein, 23 aa, Mycobacterium
QCLISSAGSVEWLCVPRPDSPSV

SEQ ID NO: 1276318 - protein, 17 aa, Mycobacterium
QCPRCRAGRTAKCAVVR

SEQ ID NO: 1276319 - protein, 18 aa, Mycobacterium
QCPVDYTAQCGFDVLAHA

SEQ ID NO: 1276320 - protein, 21 aa, Mycobacterium
QCRQALKAAGIDDLFGVCIDG

SEQ ID NO: 1276321 - protein, 18 aa, Mycobacterium
QCSWSVSGTGQFLPGDGA

SEQ ID NO: 1276322 - protein, 25 aa, Mycobacterium
QCVAIARAVFFGARVLILDEPTAAL

SEQ ID NO: 1276323 - protein, 17 aa, Mycobacterium
QDACVQAGIPAVTFWAA

SEQ ID NO: 1276324 - protein, 18 aa, Mycobacterium
QDAWLRWDALGEDRSGIA

SEQ ID NO: 1276325 - protein, 18 aa, Mycobacterium
QDCIQVHGGIGFTWEHDT

SEQ ID NO: 1276326 - protein, 21 aa, Mycobacterium
QDDGLGWAFVDWLEAQGRCPS

SEQ ID NO: 1276327 - protein, 23 aa, Mycobacterium
QDDLPLPVARRIIGPRPLIGRST

SEQ ID NO: 1276328 - protein, 20 aa, Mycobacterium
QDFAHLTLMLLRGMGIPSRY

SEQ ID NO: 1276329 - protein, 24 aa, Mycobacterium
QDFGPGLPDIREWTGQNFDFSGYV

SEQ ID NO: 1276330 - protein, 25 aa, Mycobacterium
QDFMGFTVTGPDEFLASGHPDPADR

SEQ ID NO: 1276331 - protein, 17 aa, Mycobacterium
QDFMPAVGIVARPFNRR

SEQ ID NO: 1276332 - protein, 21 aa, Mycobacterium
QDFSGRIVLIGGDRRLPYDKP

SEQ ID NO: 1276333 - protein, 29 aa, Mycobacterium
QDGGGFFFVVELLDAASFWESVRSGMLES

SEQ ID NO: 1276334 - protein, 20 aa, Mycobacterium
QDGKRTWAVMGGRVNTFIPN

SEQ ID NO: 1276335 - protein, 20 aa, Mycobacterium
QDGLRLFYDFHEKHRRQVDG

SEQ ID NO: 1276336 - protein, 26 aa, Mycobacterium
QDGPGWWAAREAIEWTASAQRQSGLA

SEQ ID NO: 1276337 - protein, 19 aa, Mycobacterium
QDHPGFGCVWEYRDPLPPR

SEQ ID NO: 1276338 - protein, 18 aa, Mycobacterium
QDILPPEVFEKLTPEYVA

SEQ ID NO: 1276339 - protein, 25 aa, Mycobacterium
QDILPPEVFEKLTPEYVAPVVAHLM

SEQ ID NO: 1276340 - protein, 22 aa, Mycobacterium
QDLLQFCLLLLVAGNETTRNLV

SEQ ID NO: 1276341 - protein, 24 aa, Mycobacterium
QDLQMRPGSSSGWHTHPGPEHSVI

SEQ ID NO: 1276342 - protein, 17 aa, Mycobacterium
QDLRDIMVLAGYLTADS

SEQ ID NO: 1276343 - protein, 19 aa, Mycobacterium
QDMIDRMLFAEALETQKCL

SEQ ID NO: 1276344 - protein, 17 aa, Mycobacterium
QDMLPGGIARMLPGDTK

SEQ ID NO: 1276345 - protein, 27 aa, Mycobacterium
QDPRLARLPGRFLFGIDDGRGDISGLG

SEQ ID NO: 1276346 - protein, 19 aa, Mycobacterium
QDQSMPRWLADTVTRRLGV

SEQ ID NO: 1276347 - protein, 28 aa, Mycobacterium
QDRAVELSAWIDPIGVWGDTIATTVQNL

SEQ ID NO: 1276348 - protein, 23 aa, Mycobacterium
QDRLPEKFREAGPRIVEQDGNHL

SEQ ID NO: 1276349 - protein, 23 aa, Mycobacterium
QDSSIRFLVGRTRCLPTGCESSG

SEQ ID NO: 1276350 - protein, 23 aa, Mycobacterium
QDVADRVGKVWGLGSDTPKDPGP

SEQ ID NO: 1276351 - protein, 17 aa, Mycobacterium
QDWHALLTVTLDGDVDL

SEQ ID NO: 1276352 - protein, 21 aa, Mycobacterium
QDWKHGVCEALGWRHRDQADI

SEQ ID NO: 1276353 - protein, 17 aa, Mycobacterium
QDWRVTPNLVDYEKTCA

SEQ ID NO: 1276354 - protein, 33 aa, Mycobacterium
QDWWPADFGHYGPLFIRMSWHAAGTYRVQDGRG

SEQ ID NO: 1276355 - protein, 18 aa, Mycobacterium
QEALLGWLDDETDYGGDE

SEQ ID NO: 1276356 - protein, 24 aa, Mycobacterium
QEALPRWRRIAEGLRHSKTRDADA

SEQ ID NO: 1276357 - protein, 17 aa, Mycobacterium
QEARWAASVSGGHVGRA

SEQ ID NO: 1276358 - protein, 19 aa, Mycobacterium
QEASALLRCVVRDPDPATV

SEQ ID NO: 1276359 - protein, 23 aa, Mycobacterium
QEDKRWTPQWSDGQRAEGYAGWQ

SEQ ID NO: 1276360 - protein, 18 aa, Mycobacterium
QEEIARAGASIIEAAGAY

SEQ ID NO: 1276361 - protein, 21 aa, Mycobacterium
QEELWLLRGGNPDRPGLLPPQ

SEQ ID NO: 1276362 - protein, 25 aa, Mycobacterium
QEFIQRGWGSWGFAPYTDLMAATDA

SEQ ID NO: 1276363 - protein, 19 aa, Mycobacterium
QEFLDRIAAAERLVREAPH

SEQ ID NO: 1276364 - protein, 23 aa, Mycobacterium
QEFPPPLPYKGNRSPDVFKPYVV

SEQ ID NO: 1276365 - protein, 19 aa, Mycobacterium
QEFRTSVASLRSHDLVEGI

SEQ ID NO: 1276366 - protein, 26 aa, Mycobacterium
QEGAICIRLPLPPGTLPTLWNADDRY

SEQ ID NO: 1276367 - protein, 22 aa, Mycobacterium
QEGRDDLALRIAVQPGGCAGLR

SEQ ID NO: 1276368 - protein, 22 aa, Mycobacterium
QEIARQALYWGHEASAAALVWN

SEQ ID NO: 1276369 - protein, 25 aa, Mycobacterium
QEIDLRYADALSMADNVMTFRYLVK

SEQ ID NO: 1276370 - protein, 20 aa, Mycobacterium
QEILFPALLPRAPYETTNRW

SEQ ID NO: 1276371 - protein, 20 aa, Mycobacterium
QEIMTELEIAPTRRLRGLGD

SEQ ID NO: 1276372 - protein, 19 aa, Mycobacterium
QEINRRFGTPIPPDTGEVD

SEQ ID NO: 1276373 - protein, 25 aa, Mycobacterium
QEIQSAAAWAIIDCELPAPAEDAAP

SEQ ID NO: 1276374 - protein, 18 aa, Mycobacterium
QEIREEVTATFARTGRTV

SEQ ID NO: 1276375 - protein, 23 aa, Mycobacterium
QEITRGRVAAISIPVNSTEKLVT

SEQ ID NO: 1276376 - protein, 19 aa, Mycobacterium
QEITRGRVAAVSVPVNSTE

SEQ ID NO: 1276377 - protein, 29 aa, Mycobacterium
QEITRKDPFDWPDRQEFITVEQFDKTGEE

SEQ ID NO: 1276378 - protein, 17 aa, Mycobacterium
QEIVDGWQVEKTDNWLV

SEQ ID NO: 1276379 - protein, 20 aa, Mycobacterium
QEKLLKLGFEFEDGTERTAV

SEQ ID NO: 1276380 - protein, 28 aa, Mycobacterium
QELLDRASVNGVKGWITRTRQPAANQTQ

SEQ ID NO: 1276381 - protein, 17 aa, Mycobacterium
QELPAYLAVERQVRPTG

SEQ ID NO: 1276382 - protein, 30 aa, Mycobacterium; identical to SEQ ID NO: 102427

SEQ ID NO: 1276383 - protein, 24 aa, Mycobacterium
QELRWMFLACVAAAHVWDLDRLMS

SEQ ID NO: 1276384 - protein, 18 aa, Mycobacterium
QELTGLAGLDGMPHFMRE

SEQ ID NO: 1276385 - protein, 21 aa, Mycobacterium
QELTKLAGLPGMPDFLREDDV

SEQ ID NO: 1276386 - protein, 26 aa, Mycobacterium
QELVAAFLPHVFQWTRAMNPVQPVTS

SEQ ID NO: 1276387 - protein, 22 aa, Mycobacterium
QELVLRCGFHRAVLSKVESHGW

SEQ ID NO: 1276388 - protein, 23 aa, Mycobacterium
QELYFPPCYELAVTRGAPGAQDR

SEQ ID NO: 1276389 - protein, 25 aa, Mycobacterium
QENTFAYPSIEVFKKSGLGALPVPK

SEQ ID NO: 1276390 - protein, 25 aa, Mycobacterium
QEPRAWRLAVELSREGDQIKMSKVE

SEQ ID NO: 1276391 - protein, 22 aa, Mycobacterium
QEPRAWRMRVTVQKVGNDAKVA

SEQ ID NO: 1276392 - protein, 23 aa, Mycobacterium
QEQGYRALISAPLRRPGTVVGAL

SEQ ID NO: 1276393 - protein, 23 aa, Mycobacterium
QERRKWLPVHPVSRRTWPNGRIT

SEQ ID NO: 1276394 - protein, 17 aa, Mycobacterium
QERRRLTLVEGRDDDRA

SEQ ID NO: 1276395 - protein, 18 aa, Mycobacterium
QESYLRWAEVDLAAVTDT

SEQ ID NO: 1276396 - protein, 17 aa, Mycobacterium
QETAFRFTDGSGRDAAA

SEQ ID NO: 1276397 - protein, 22 aa, Mycobacterium
QETLLRVCSFASTHSEDEPTTL

SEQ ID NO: 1276398 - protein, 20 aa, Mycobacterium
QEWIEGIPLSHIIRDGTQEQ

SEQ ID NO: 1276399 - protein, 20 aa, Mycobacterium
QEYYELRGILAPIGDTQRQC

SEQ ID NO: 1276400 - protein, 17 aa, Mycobacterium
QFAEAFCRLSREKGFFA

SEQ ID NO: 1276401 - protein, 20 aa, Mycobacterium
QFAKAMVRRFDVDWTGLGFS

SEQ ID NO: 1276402 - protein, 18 aa, Mycobacterium
QFDRARALVAEMIEKAEN

SEQ ID NO: 1276403 - protein, 17 aa, Mycobacterium
QFEKDVQAAREYFLQHV

SEQ ID NO: 1276404 - protein, 24 aa, Mycobacterium
QFELHARAILGLAVDTIMISPGAA

SEQ ID NO: 1276405 - protein, 23 aa, Mycobacterium
QFEVGRQILAAGLVPIIEPEVDI

SEQ ID NO: 1276406 - protein, 32 aa, Mycobacterium
QFGIQRFFGGLLYWEVWSKLGGPQAQAANDFQ

SEQ ID NO: 1276407 - protein, 25 aa, Mycobacterium
QFIPDVRRYGATYANYVGKPLSYIL

SEQ ID NO: 1276408 - protein, 19 aa, Mycobacterium
QFITELFLTGGRRQREALS

SEQ ID NO: 1276409 - protein, 25 aa, Mycobacterium
QFLSLPWFYRSGYDVLLYTLPFHGR

SEQ ID NO: 1276410 - protein, 18 aa, Mycobacterium
QFLYREARYLDDREFEKW

SEQ ID NO: 1276411 - protein, 18 aa, Mycobacterium
QFPVRHLVTNTGWGTGND

SEQ ID NO: 1276412 - protein, 25 aa, Mycobacterium
QFRHELSMPLILLGGITTRDTMDQA

SEQ ID NO: 1276413 - protein, 27 aa, Mycobacterium
QFSSGTDHCDWIFLGAMIGDAEGKPLM

SEQ ID NO: 1276414 - protein, 18 aa, Mycobacterium
QFTDGRARLIAWLEQVGL

SEQ ID NO: 1276415 - protein, 18 aa, Mycobacterium
QFTMATDMAVYFCDPASP

SEQ ID NO: 1276416 - protein, 28 aa, Mycobacterium
QFVHSVALAAVWRSCGIVPDLTVGHSLG

SEQ ID NO: 1276417 - protein, 23 aa, Mycobacterium
QFVSSPGYEHAWLNPDNTEVSME

SEQ ID NO: 1276418 - protein, 26 aa, Mycobacterium
QFYHPLDMFGEWNRAYGSNGFLQYQF

SEQ ID NO: 1276419 - protein, 26 aa, Mycobacterium
QGAFPYRNDGALGWSGTSPVGTFPAN

SEQ ID NO: 1276420 - protein, 17 aa, Mycobacterium
QGALAITGIPTFKAPFD

SEQ ID NO: 1276421 - protein, 17 aa, Mycobacterium
QGARTVALWEPALLTDL

SEQ ID NO: 1276422 - protein, 26 aa, Mycobacterium
QGASSEAARAWWGNFLVQKANESGVE

SEQ ID NO: 1276423 - protein, 31 aa, Mycobacterium
QGCDFVERIARVFPSTVFLTIMGMPVEDLEK

SEQ ID NO: 1276424 - protein, 21 aa, Mycobacterium
QGDARLVRVVVSWLSGELTQR

SEQ ID NO: 1276425 - protein, 19 aa, Mycobacterium
QGDVIPRERTSVPADINSL

SEQ ID NO: 1276426 - protein, 25 aa, Mycobacterium
QGERHWPALCAAVERTDWLSDERFA

SEQ ID NO: 1276427 - protein, 22 aa, Mycobacterium
QGFAEMRGKFDAAAVGQHEIVQ

SEQ ID NO: 1276428 - protein, 27 aa, Mycobacterium
QGFVPHCFAAVKKWPIAPYVVNNNPRW

SEQ ID NO: 1276429 - protein, 26 aa, Mycobacterium
QGGCPPRQFERARVVVFAGDHGVAAS

SEQ ID NO: 1276430 - protein, 23 aa, Mycobacterium
QGGFDLAAYWSRGGIGDAYSDGD

SEQ ID NO: 1276431 - protein, 18 aa, Mycobacterium
QGGFPKAFIRFEGAAPGR

SEQ ID NO: 1276432 - protein, 22 aa, Mycobacterium
QGHASPGIYARAYLEGRLSADQ

SEQ ID NO: 1276433 - protein, 28 aa, Mycobacterium
QGHPYWEAPMLMQRICGICFVSHHLCGA

SEQ ID NO: 1276434 - protein, 18 aa, Mycobacterium
QGIPLSYTRELAAYWADE

SEQ ID NO: 1276435 - protein, 26 aa, Mycobacterium
QGIPNFSLLVSHVLVPPAIAAIMESP

SEQ ID NO: 1276436 - protein, 25 aa, Mycobacterium
QGIPVVRPSPLVPRVPVRRDGFSMT

SEQ ID NO: 1276437 - protein, 27 aa, Mycobacterium
QGIVAKYGWTLWGCIQYGSSAIEFDFW

SEQ ID NO: 1276438 - protein, 18 aa, Mycobacterium
QGKEEFDIELGPVVVNFL

SEQ ID NO: 1276439 - protein, 24 aa, Mycobacterium
QGKHLWMIYLMRIVDAQVVFDKPG

SEQ ID NO: 1276440 - protein, 19 aa, Mycobacterium
QGKLADKVYAGFTSSQTAH

SEQ ID NO: 1276441 - protein, 18 aa, Mycobacterium
QGLDCLRKQGRFMEMSSW

SEQ ID NO: 1276442 - protein, 24 aa, Mycobacterium
QGLGGLECLSGIPGSAGATPVQNV

SEQ ID NO: 1276443 - protein, 17 aa, Mycobacterium
QGLGLGIDWVIEAAEDV

SEQ ID NO: 1276444 - protein, 21 aa, Mycobacterium
QGLGWKCPFGTGNAGDTVTSG

SEQ ID NO: 1276445 - protein, 19 aa, Mycobacterium
QGLSGALGFLGGFRGLGAG

SEQ ID NO: 1276446 - protein, 19 aa, Mycobacterium
QGPAPRPVVVPRYDENELI

SEQ ID NO: 1276447 - protein, 24 aa, Mycobacterium
QGPLAGSHLLVWTTTPWTLPSNQA

SEQ ID NO: 1276448 - protein, 23 aa, Mycobacterium
QGPRAEVVVALRGPSPAGLSRSV

SEQ ID NO: 1276449 - protein, 20 aa, Mycobacterium
QGQLARRSGRRFSMRRGVRA

SEQ ID NO: 1276450 - protein, 20 aa, Mycobacterium
QGRAVWALRELVVLHEIAHH

SEQ ID NO: 1276451 - protein, 23 aa, Mycobacterium
QGRFAREITVGFPVHTSILEPLR

SEQ ID NO: 1276452 - protein, 30 aa, Mycobacterium
QGRGLVRLARRVWPEQDWDGLGATPHLAVA

SEQ ID NO: 1276453 - protein, 20 aa, Mycobacterium
QGRGRLRSDGTRRLFLCGSE

SEQ ID NO: 1276454 - protein, 24 aa, Mycobacterium
QGRILGELCHFIDLAMDLVDAPLA

SEQ ID NO: 1276455 - protein, 26 aa, Mycobacterium
QGRLALGVGPSHHWIVRDMLGLPYEK

SEQ ID NO: 1276456 - protein, 18 aa, Mycobacterium
QGRPAYRSKVGATMVARA

SEQ ID NO: 1276457 - protein, 18 aa, Mycobacterium
QGRRMPGTDIPIISPEEL

SEQ ID NO: 1276458 - protein, 19 aa, Mycobacterium
QGSAASVTLPEGWLDDPDD

SEQ ID NO: 1276459 - protein, 21 aa, Mycobacterium
QGSAVFTSCRVWQLFNGSTSF

SEQ ID NO: 1276460 - protein, 18 aa, Mycobacterium
QGSQRFAPLNSWPDNANL

SEQ ID NO: 1276461 - protein, 32 aa, Mycobacterium
QGSVGEMFGRKVARLMEWVAMVGCPIIGINDS

SEQ ID NO: 1276462 - protein, 21 aa, Mycobacterium
QGVPISAILFGGRRKTTVPLI

SEQ ID NO: 1276463 - protein, 34 aa, Mycobacterium
QGVRKLEGFWGHCWQSALFPSGRAFGYIAYPPRP

SEQ ID NO: 1276464 - protein, 18 aa, Mycobacterium
QHAARLQQLLGLTGVDVD

SEQ ID NO: 1276465 - protein, 18 aa, Mycobacterium
QHAKIWYQVVLAFLAHHV

SEQ ID NO: 1276466 - protein, 21 aa, Mycobacterium
QHCAGFLGSLGNYVLLQNTDQ

SEQ ID NO: 1276467 - protein, 21 aa, Mycobacterium
QHCAGFLGSLGNYVLLQNTGQ

SEQ ID NO: 1276468 - protein, 18 aa, Mycobacterium
QHDLTFRGDFPLNTAGGQ

SEQ ID NO: 1276469 - protein, 19 aa, Mycobacterium
QHGWLRTGDMGSFDAHGFL

SEQ ID NO: 1276470 - protein, 24 aa, Mycobacterium
QHHPAMRAFIGVPIVIRGEPFGSL

SEQ ID NO: 1276471 - protein, 18 aa, Mycobacterium
QHLACLRDCGLVTSQPVG

SEQ ID NO: 1276472 - protein, 26 aa, Mycobacterium
QHLDVPLYWQCWKLDSDTVRQVTAAV

SEQ ID NO: 1276473 - protein, 23 aa, Mycobacterium
QHLGDSLVRCISMQPTDGLVRGV

SEQ ID NO: 1276474 - protein, 19 aa, Mycobacterium
QHPEVVSWADFFAAQRKHR

SEQ ID NO: 1276475 - protein, 20 aa, Mycobacterium
QHPSVSWVKYPFLESHPQYD

SEQ ID NO: 1276476 - protein, 21 aa, Mycobacterium
QHRYPGLLLGHLNMVTSTYTW

SEQ ID NO: 1276477 - protein, 17 aa, Mycobacterium
QHRYSFINVRRLVMDGE

SEQ ID NO: 1276478 - protein, 17 aa, Mycobacterium
QHVRFLDALPDWSAVDL

SEQ ID NO: 1276479 - protein, 23 aa, Mycobacterium
QHWREWELELGPGTGSEVFDRLT

SEQ ID NO: 1276480 - protein, 20 aa, Mycobacterium
QIAALRWVRDNISAFGGDPG

SEQ ID NO: 1276481 - protein, 20 aa, Mycobacterium
QIAALRWVRENIAAFGGDPD

SEQ ID NO: 1276482 - protein, 18 aa, Mycobacterium
QIAKLPGVVRYTAQGVRR

SEQ ID NO: 1276483 - protein, 18 aa, Mycobacterium
QIASKALRPLPVAHKEMS

SEQ ID NO: 1276484 - protein, 22 aa, Mycobacterium
QIATRIELRLGDPMESEMDRRR

SEQ ID NO: 1276485 - protein, 23 aa, Mycobacterium
QIDLLLEQGWRPEDLALLTTGSR

SEQ ID NO: 1276486 - protein, 25 aa, Mycobacterium
QIDWLLGNGGLDWATKRTAESSSRL

SEQ ID NO: 1276487 - protein, 23 aa, Mycobacterium
QIEAAGFCKAGEAADFVLDGCIA

SEQ ID NO: 1276488 - protein, 24 aa, Mycobacterium
QIEGLRGSVQFPLDLQRIEKVIEQ

SEQ ID NO: 1276489 - protein, 25 aa, Mycobacterium
QIEKRFGAEFDRPVARMTEMIGALR

SEQ ID NO: 1276490 - protein, 25 aa, Mycobacterium
QIEPEVGLACRVVWEGDTIVTLQPF

SEQ ID NO: 1276491 - protein, 25 aa, Mycobacterium
QIERLARLGGIVGTAFQISDDIIDI

SEQ ID NO: 1276492 - protein, 19 aa, Mycobacterium
QIGCSWCVDFGSMLMRLDG

SEQ ID NO: 1276493 - protein, 26 aa, Mycobacterium
QIGDGRKSLALALRFRAPDRTLTEDE

SEQ ID NO: 1276494 - protein, 17 aa, Mycobacterium
QIGRPTVLIGASMGGLT

SEQ ID NO: 1276495 - protein, 17 aa, Mycobacterium
QILDVAFVAREVLEDHG

SEQ ID NO: 1276496 - protein, 18 aa, Mycobacterium
QILPDPKYAPGYLNEFGG

SEQ ID NO: 1276497 - protein, 22 aa, Mycobacterium
QILRKPRNGLSYETLLATVEQR

SEQ ID NO: 1276498 - protein, 26 aa, Mycobacterium
QIMGLAMMRYVWRIEPVASMDDDELV

SEQ ID NO: 1276499 - protein, 25 aa, Mycobacterium
QIMGRKVVRMFPIPPIALGLRTGIA

SEQ ID NO: 1276500 - protein, 18 aa, Mycobacterium
QINNVLAFPGVFRGALDA

SEQ ID NO: 1276501 - protein, 20 aa, Mycobacterium
QIPAAGYGAVEVWPMVHWNA

SEQ ID NO: 1276502 - protein, 23 aa, Mycobacterium
QIPDEFKQRMVAGTVDQVAEQIK

SEQ ID NO: 1276503 - protein, 23 aa, Mycobacterium
QIPGEPKVGFAQLYGAPGTAGAT

SEQ ID NO: 1276504 - protein, 22 aa, Mycobacterium
QIPGGQWLGFAPELIARQLDWT

SEQ ID NO: 1276505 - protein, 22 aa, Mycobacterium
QIPMQLAGMAMQIPQGIMQGVQ

SEQ ID NO: 1276506 - protein, 20 aa, Mycobacterium
QIPQLIAAYEWLDAHRHSRR

SEQ ID NO: 1276507 - protein, 24 aa, Mycobacterium
QIPTGPRLGNVVVEVEHLDKGFGG

SEQ ID NO: 1276508 - protein, 21 aa, Mycobacterium
QIQDLCAWSIVEFTDVDNGGT

SEQ ID NO: 1276509 - protein, 17 aa, Mycobacterium
QIQPWAWVVNNSLAAAH

SEQ ID NO: 1276510 - protein, 17 aa, Mycobacterium
QIRACEALESGHGVLVC

SEQ ID NO: 1276511 - protein, 36 aa, Mycobacterium; identical to SEQ ID NO: 1120599

SEQ ID NO: 1276512 - protein, 19 aa, Mycobacterium
QISGLPFSGPVGGVRVALI

SEQ ID NO: 1276513 - protein, 24 aa, Mycobacterium
QIVAARWGFAHTGRFAAMYREAYG

SEQ ID NO: 1276514 - protein, 23 aa, Mycobacterium
QIYAELTLDVSFTIAVRPGTAAA

SEQ ID NO: 1276515 - protein, 23 aa, Mycobacterium
QKAFNIKTVRQFGTNKFFAFAAL

SEQ ID NO: 1276516 - protein, 19 aa, Mycobacterium
QKAKVLAICNTNGSQIPRE

SEQ ID NO: 1276517 - protein, 26 aa, Mycobacterium
QKARWLPKFVSGEYIGSIAMSEPAAG

SEQ ID NO: 1276518 - protein, 24 aa, Mycobacterium
QKDRFLRPLLRADEFWCQGFSEPG

SEQ ID NO: 1276519 - protein, 21 aa, Mycobacterium
QKEFLLRQQLNAIRKELGELG

SEQ ID NO: 1276520 - protein, 20 aa, Mycobacterium
QKEFPMAVHLLEGHMVGGLR

SEQ ID NO: 1276521 - protein, 18 aa, Mycobacterium
QKGAMSLHQYLINLVEEK

SEQ ID NO: 1276522 - protein, 17 aa, Mycobacterium
QKHHARALILVPTMLSR

SEQ ID NO: 1276523 - protein, 20 aa, Mycobacterium
QKHQWAVPVLRGERTASLGM

SEQ ID NO: 1276524 - protein, 20 aa, Mycobacterium
QKITATMLVPSMIYALMDHP

SEQ ID NO: 1276525 - protein, 20 aa, Mycobacterium
QKLDVLAAWTEAGELFGERE

SEQ ID NO: 1276526 - protein, 24 aa, Mycobacterium
QKLLHGVARLFGLAQADNVTVTVP

SEQ ID NO: 1276527 - protein, 21 aa, Mycobacterium
QKLWASGGMHADWCLLLARTD

SEQ ID NO: 1276528 - protein, 20 aa, Mycobacterium
QKLYLATVIDLYSRRLLGAA

SEQ ID NO: 1276529 - protein, 24 aa, Mycobacterium
QKMATVLGRRVWENAGSPEVDTER

SEQ ID NO: 1276530 - protein, 18 aa, Mycobacterium
QKQLVIAGYGWTILPSAG

SEQ ID NO: 1276531 - protein, 21 aa, Mycobacterium
QKRGIGFVFQHYAAFKHLTVR

SEQ ID NO: 1276532 - protein, 24 aa, Mycobacterium
QKVREVSFGLARPVWVDDREFDIT

SEQ ID NO: 1276533 - protein, 26 aa, Mycobacterium
QKVRRLRRLAGLWLAGRDERWAAVRI

SEQ ID NO: 1276534 - protein, 20 aa, Mycobacterium
QLADVCLREGVTTVVADDEF

SEQ ID NO: 1276535 - protein, 22 aa, Mycobacterium
QLAELRPGTPYLVSATASGLVR

SEQ ID NO: 1276536 - protein, 17 aa, Mycobacterium
QLAEMRSGLYSYADDPG

SEQ ID NO: 1276537 - protein, 22 aa, Mycobacterium
QLAEVRKSGFAISNQESEEGVA

SEQ ID NO: 1276538 - protein, 19 aa, Mycobacterium
QLAGGRWDIRLAAVHAAVH

SEQ ID NO: 1276539 - protein, 25 aa, Mycobacterium
QLAGHAPSGLGFRPDGSLLIVSTER

SEQ ID NO: 1276540 - protein, 25 aa, Mycobacterium
QLALDEWRLLTGAALVGLVEETMTI

SEQ ID NO: 1276541 - protein, 23 aa, Mycobacterium
QLARARALLLGRDYVIPEDVKAL

SEQ ID NO: 1276542 - protein, 24 aa, Mycobacterium
QLARASVMALSYVAQSARGIYQPA

SEQ ID NO: 1276543 - protein, 29 aa, Mycobacterium
QLARRHHITFAHLWAQFALGDSALAEGNA

SEQ ID NO: 1276544 - protein, 23 aa, Mycobacterium
QLARTAWEFRVYNMGQACNSNKR

SEQ ID NO: 1276545 - protein, 20 aa, Mycobacterium
QLCDEFDSLLIFDEVQTGCG

SEQ ID NO: 1276546 - protein, 25 aa, Mycobacterium
QLDDLKMRALDVLSRYQQHSTELQA

SEQ ID NO: 1276547 - protein, 22 aa, Mycobacterium
QLDDVRFTHRWAGAIDTNTRFC

SEQ ID NO: 1276548 - protein, 20 aa, Mycobacterium
QLDEARARLRPQDFQAQTNI

SEQ ID NO: 1276549 - protein, 24 aa, Mycobacterium
QLDVWSLTDIVAFSRETYGGCSIV

SEQ ID NO: 1276550 - protein, 18 aa, Mycobacterium
QLEGRWAELSPDLRGKVI

SEQ ID NO: 1276551 - protein, 20 aa, Mycobacterium
QLEPGFVLDYIKLVTPKLST

SEQ ID NO: 1276552 - protein, 19 aa, Mycobacterium
QLEQYWGPQVPFPKRMGRS

SEQ ID NO: 1276553 - protein, 27 aa, Mycobacterium
QLFADWTEEIFKAFNFQTDVTFDESAI

SEQ ID NO: 1276554 - protein, 25 aa, Mycobacterium
QLFERVRPTIPIVLANLVTVGDVAI

SEQ ID NO: 1276555 - protein, 19 aa, Mycobacterium
QLFGRPGVDRVLRPREPGL

SEQ ID NO: 1276556 - protein, 19 aa, Mycobacterium
QLFPTADGYLALFITHDGF

SEQ ID NO: 1276557 - protein, 20 aa, Mycobacterium
QLFPTADGYLALFITHDGFW

SEQ ID NO: 1276558 - protein, 17 aa, Mycobacterium
QLFRIAMYHDRLPDGHY

SEQ ID NO: 1276559 - protein, 17 aa, Mycobacterium
QLGAPLAALAQLPQLLT

SEQ ID NO: 1276560 - protein, 24 aa, Mycobacterium
QLGARCNIEHGCVVAEADHLRGAE

SEQ ID NO: 1276561 - protein, 23 aa, Mycobacterium
QLGKIDAVFMPGDLVNVPDRASE

SEQ ID NO: 1276562 - protein, 19 aa, Mycobacterium
QLGSMWYISLDYINHQTSL

SEQ ID NO: 1276563 - protein, 21 aa, Mycobacterium
QLGTRIELRLGDPAESEMDRK

SEQ ID NO: 1276564 - protein, 19 aa, Mycobacterium
QLHKMKHQTFTASDQTETV

SEQ ID NO: 1276565 - protein, 31 aa, Mycobacterium
QLIAGFLNRMPRWYIGSILRHVDFLASDVPG

SEQ ID NO: 1276566 - protein, 18 aa, Mycobacterium
QLIDHVFRSIGNGSLPPN

SEQ ID NO: 1276567 - protein, 19 aa, Mycobacterium
QLIEFCLLAAQYDGLAATI

SEQ ID NO: 1276568 - protein, 18 aa, Mycobacterium
QLIMEAGADIAVLEPAAY

SEQ ID NO: 1276569 - protein, 17 aa, Mycobacterium
QLLDVWRPKELPAEPAP

SEQ ID NO: 1276570 - protein, 24 aa, Mycobacterium
QLLGSPALCSRAFITEQYDRYVRG

SEQ ID NO: 1276571 - protein, 24 aa, Mycobacterium
QLLQFRLMVLYTAWEIDKYNDYKK

SEQ ID NO: 1276572 - protein, 22 aa, Mycobacterium
QLLQLRFAHKIPALHTTSTLET

SEQ ID NO: 1276573 - protein, 23 aa, Mycobacterium
QLLRAGGDAVAWLDTDDPSDALR

SEQ ID NO: 1276574 - protein, 17 aa, Mycobacterium
QLLRMVGFGLLDTPEPA

SEQ ID NO: 1276575 - protein, 24 aa, Mycobacterium
QLLTCPLHTFALYTDRSVDPGYCR

SEQ ID NO: 1276576 - protein, 21 aa, Mycobacterium
QLMARAWRNTKDELARLGQVD

SEQ ID NO: 1276577 - protein, 23 aa, Mycobacterium
QLMSVLARRHMHLYGTRREAFAE

SEQ ID NO: 1276578 - protein, 39 aa, Mycobacterium
QLPAGSCTRWAVSRDGIMPRLRAASARAGAACASSTSRS

SEQ ID NO: 1276579 - protein, 27 aa, Mycobacterium
QLPAGTELGRFGYPGGTYLAPEGTPFA

SEQ ID NO: 1276580 - protein, 22 aa, Mycobacterium
QLPGLVGRFGPEWVGVSVTMPG

SEQ ID NO: 1276581 - protein, 20 aa, Mycobacterium
QLPKVGERFLGTVVKTTDFG

SEQ ID NO: 1276582 - protein, 24 aa, Mycobacterium
QLQPLRPAILYGIDTRATAEIDSL

SEQ ID NO: 1276583 - protein, 18 aa, Mycobacterium
QLRETLALVDGGAESPYE

SEQ ID NO: 1276584 - protein, 20 aa, Mycobacterium
QLRKAGLVISDRRGMNVFHR

SEQ ID NO: 1276585 - protein, 19 aa, Mycobacterium
QLRLERVVLVGVWTEGSAA

SEQ ID NO: 1276586 - protein, 21 aa, Mycobacterium
QLRLHPAASRVRMLAEKTPAS

SEQ ID NO: 1276587 - protein, 19 aa, Mycobacterium
QLRLKRLYSGANYRATTST

SEQ ID NO: 1276588 - protein, 20 aa, Mycobacterium
QLRPRVLYHDVIEDITDQHA

SEQ ID NO: 1276589 - protein, 21 aa, Mycobacterium
QLRQRSWWTGPDVVLLVDDWH

SEQ ID NO: 1276590 - protein, 22 aa, Mycobacterium
QLRRALPGAVFVSAHTGDGLDR

SEQ ID NO: 1276591 - protein, 19 aa, Mycobacterium
QLRVGMPVTAVFRPVDDAD

SEQ ID NO: 1276592 - protein, 18 aa, Mycobacterium
QLRYAVVAHGGFGVAQRI

SEQ ID NO: 1276593 - protein, 17 aa, Mycobacterium
QLSIARDEENMWLVQEH

SEQ ID NO: 1276594 - protein, 22 aa, Mycobacterium
QLSRTAAVWHLYTPMSGVLREK

SEQ ID NO: 1276595 - protein, 26 aa, Mycobacterium
QLTEAAARAFGSWRDALNTVLRHQGV

SEQ ID NO: 1276596 - protein, 18 aa, Mycobacterium
QLTLDRRGAWLLSSVEHY

SEQ ID NO: 1276597 - protein, 24 aa, Mycobacterium
QLTNRPECAIAYQAVLLSGAVLVP

SEQ ID NO: 1276598 - protein, 18 aa, Mycobacterium
QLTRIKRGFDIDRAKMVT

SEQ ID NO: 1276599 - protein, 23 aa, Mycobacterium
QLTRTAALEGIDHGIRVNAIGVG

SEQ ID NO: 1276600 - protein, 24 aa, Mycobacterium
QLVAQRLAAFGAHITAYDPYVSHA

SEQ ID NO: 1276601 - protein, 17 aa, Mycobacterium
QLVLFPEATMCRFGVPL

SEQ ID NO: 1276602 - protein, 25 aa, Mycobacterium
QLVRLPWDYKRLYGLDPDEQSVADA

SEQ ID NO: 1276603 - protein, 17 aa, Mycobacterium
QLVVPILNARFALNAAN

SEQ ID NO: 1276604 - protein, 17 aa, Mycobacterium
QLVYPLPTLHSADLHAT

SEQ ID NO: 1276605 - protein, 23 aa, Mycobacterium
QLVYRAGIRRVARLVHALPPAPT

SEQ ID NO: 1276606 - protein, 18 aa, Mycobacterium
QLWDKGLAYEGNRVLPYC

SEQ ID NO: 1276607 - protein, 26 aa, Mycobacterium
QLYDGFSFLTVMWLEAMGFCEHGKVG

SEQ ID NO: 1276608 - protein, 19 aa, Mycobacterium
QLYFKKLTPQACEGAQKFR

SEQ ID NO: 1276609 - protein, 20 aa, Mycobacterium
QLYSSLWLYLAGVRPIVFGV

SEQ ID NO: 1276610 - protein, 23 aa, Mycobacterium
QMALPPCHAFFQFYVSGGRLSCQ

SEQ ID NO: 1276611 - protein, 26 aa, Mycobacterium
QMGIGGGWYEHEWRAYGYGFPSAGVR

SEQ ID NO: 1276612 - protein, 22 aa, Mycobacterium
QMHACGVIDVATGRATMVAAPG

SEQ ID NO: 1276613 - protein, 25 aa, Mycobacterium
QMKPELAVEASLCDFPRDPLVLAAD

SEQ ID NO: 1276614 - protein, 22 aa, Mycobacterium
QMKRAAFDGALDVDVVLSPFFN

SEQ ID NO: 1276615 - protein, 25 aa, Mycobacterium
QMPEMPLIKFIDGWETVVEMEAALG

SEQ ID NO: 1276616 - protein, 24 aa, Mycobacterium
QMPEMPLIKFVDGFETIAEIESAL

SEQ ID NO: 1276617 - protein, 26 aa, Mycobacterium
QMPIHMRLPKLKGFRNRFRTEYAPVN

SEQ ID NO: 1276618 - protein, 25 aa, Mycobacterium
QMPRRDLSGMAWRDRVSAIAGENRE

SEQ ID NO: 1276619 - protein, 17 aa, Mycobacterium
QMRDRPGQFGFVGANGG

SEQ ID NO: 1276620 - protein, 17 aa, Mycobacterium
QMRLHAYPHQLSGGQRQ

SEQ ID NO: 1276621 - protein, 17 aa, Mycobacterium
QMRRFGGLVSVELADAS

SEQ ID NO: 1276622 - protein, 23 aa, Mycobacterium
QMTRPVRWDLCTASMKDLGVTAI

SEQ ID NO: 1276623 - protein, 23 aa, Mycobacterium
QMVDARAAGVVFTADPATGRRDL

SEQ ID NO: 1276624 - protein, 20 aa, Mycobacterium
QNAKELRALVSRGMSPMQAL

SEQ ID NO: 1276625 - protein, 19 aa, Mycobacterium
QNFAPARGFTACTRSTLAL

SEQ ID NO: 1276626 - protein, 24 aa, Mycobacterium
QNGAFNLGFGDITFGDKTSNTATD

SEQ ID NO: 1276627 - protein, 18 aa, Mycobacterium
QNIGFPLTLAKLSRQEIA

SEQ ID NO: 1276628 - protein, 19 aa, Mycobacterium
QNLAKLGPEFDAIRNEQKF

SEQ ID NO: 1276629 - protein, 19 aa, Mycobacterium
QNLLGFKLSDIIDFGPGAS

SEQ ID NO: 1276630 - protein, 24 aa, Mycobacterium
QNLRPQYDFIVCGAGSAGSVIARR

SEQ ID NO: 1276631 - protein, 21 aa, Mycobacterium
QNMLMPWLWTHLRGKSVGEGR

SEQ ID NO: 1276632 - protein, 18 aa, Mycobacterium
QNRFSWKKTGQTLASQGL

SEQ ID NO: 1276633 - protein, 26 aa, Mycobacterium
QNRLALRGWQVLRFTWLDLTEYPERV

SEQ ID NO: 1276634 - protein, 24 aa, Mycobacterium
QNTWRFGIDRVLAGVAMSDDSHAW

SEQ ID NO: 1276635 - protein, 19 aa, Mycobacterium
QNVTLGYAVTVHSAQGVTV

SEQ ID NO: 1276636 - protein, 26 aa, Mycobacterium
QPAIQVCLRRDGKVILDRAIGYAWDD

SEQ ID NO: 1276637 - protein, 22 aa, Mycobacterium
QPALPERVGWLYSKAAQHALMS

SEQ ID NO: 1276638 - protein, 23 aa, Mycobacterium
QPARLTVDLLRPVALQPVQLHSS

SEQ ID NO: 1276639 - protein, 26 aa, Mycobacterium
QPAWSYARLALKWSEQYYAAERELAL

SEQ ID NO: 1276640 - protein, 27 aa, Mycobacterium
QPCVIKAADGRVVWDNDVYAFLTGDAP

SEQ ID NO: 1276641 - protein, 22 aa, Mycobacterium
QPDARWRRGREIAPELDGYWVG

SEQ ID NO: 1276642 - protein, 18 aa, Mycobacterium
QPDSAPPPTQWDSATPPS

SEQ ID NO: 1276643 - protein, 22 aa, Mycobacterium
QPELRARHLALAATVADDATLA

SEQ ID NO: 1276644 - protein, 31 aa, Mycobacterium
QPELRGAAGAARAALWAQIGLSPGDPASWTQ

SEQ ID NO: 1276645 - protein, 25 aa, Mycobacterium
QPERLAALQRLWLIEAVKYNVVPLD

SEQ ID NO: 1276646 - protein, 19 aa, Mycobacterium
QPFHKWRITFDGFCVRSSY

SEQ ID NO: 1276647 - protein, 18 aa, Mycobacterium
QPFLIAAALRVWPESAAT

SEQ ID NO: 1276648 - protein, 17 aa, Mycobacterium
QPFMIHYTASKHAVTGM

SEQ ID NO: 1276649 - protein, 17 aa, Mycobacterium
QPGCVHAGMDLYKWAVK

SEQ ID NO: 1276650 - protein, 18 aa, Mycobacterium
QPGDRVALLSATRYEWPI

SEQ ID NO: 1276651 - protein, 26 aa, Mycobacterium
QPGIVFFKYLLGMPVDDVPLCVELTD

SEQ ID NO: 1276652 - protein, 27 aa, Mycobacterium
QPGLRRVDGRWVRWGCSVAARAEAALH

SEQ ID NO: 1276653 - protein, 19 aa, Mycobacterium
QPGPTVLAGHSWSGTIVSE

SEQ ID NO: 1276654 - protein, 22 aa, Mycobacterium
QPGVEIRPIIQLTGDSEFNEVF

SEQ ID NO: 1276655 - protein, 28 aa, Mycobacterium
QPHITRRFSMPWSAPADRMREYIHALQA

SEQ ID NO: 1276656 - protein, 29 aa, Mycobacterium
QPIAPGAQWRPTWRIDQPAASLWYHPHPH

SEQ ID NO: 1276657 - protein, 20 aa, Mycobacterium
QPINRPKVLIGRKRRTQDAA

SEQ ID NO: 1276658 - protein, 21 aa, Mycobacterium
QPKPEAVVWVVAFDPDTGAAV

SEQ ID NO: 1276659 - protein, 28 aa, Mycobacterium
QPLDWSFKGIPARWWGRTPAQIVAQRPE

SEQ ID NO: 1276660 - protein, 17 aa, Mycobacterium
QPLRGAAVVDLACGTGS

SEQ ID NO: 1276661 - protein, 21 aa, Mycobacterium
QPMGRRIARMMVVDTKSHTAD

SEQ ID NO: 1276662 - protein, 17 aa, Mycobacterium
QPPAPKPAPTRPADSSI

SEQ ID NO: 1276663 - protein, 24 aa, Mycobacterium
QPPARVAERLHLLAAGLAARDSGI

SEQ ID NO: 1276664 - protein, 17 aa, Mycobacterium
QPPARYGTLEFDERRVS

SEQ ID NO: 1276665 - protein, 18 aa, Mycobacterium
QPPLGSWMQAARHTDHVI

SEQ ID NO: 1276666 - protein, 23 aa, Mycobacterium
QPQGAFWLPRRLGGGAPTPEEAR

SEQ ID NO: 1276667 - protein, 29 aa, Mycobacterium
QPQRGYKIFEEWANWLFAAGGSIYDADGK

SEQ ID NO: 1276668 - protein, 19 aa, Mycobacterium
QPRFAKLVVDLIDELRLGL

SEQ ID NO: 1276669 - protein, 24 aa, Mycobacterium
QPRLSREAVVCIWPAATRLTNRAR

SEQ ID NO: 1276670 - protein, 17 aa, Mycobacterium
QPRVLGLVVELLTRRRI

SEQ ID NO: 1276671 - protein, 18 aa, Mycobacterium
QPRVLGLVVELLTRRRIF

SEQ ID NO: 1276672 - protein, 21 aa, Mycobacterium
QPSPRLSAMSSIPTSEDVLES

SEQ ID NO: 1276673 - protein, 20 aa, Mycobacterium
QPTACILCECNCGIVVQVEG

SEQ ID NO: 1276674 - protein, 21 aa, Mycobacterium
QPTDEFSPWLDVPITAESTVA

SEQ ID NO: 1276675 - protein, 27 aa, Mycobacterium
QPTLRHRLRLGVLAALDQRIAVRYTLP

SEQ ID NO: 1276676 - protein, 29 aa, Mycobacterium
QPTPARYLYVPNLIKAALNFAMAIPTGWD

SEQ ID NO: 1276677 - protein, 25 aa, Mycobacterium
QPTRYWPEFCRLMGLDQYAEDPRFA

SEQ ID NO: 1276678 - protein, 18 aa, Mycobacterium
QPTVLGFLPHFGTISVTC

SEQ ID NO: 1276679 - protein, 18 aa, Mycobacterium
QPVLIAAALRNWPETAPV

SEQ ID NO: 1276680 - protein, 24 aa, Mycobacterium
QPYGGAWLNSWLDRDLGVSGRLSV

SEQ ID NO: 1276681 - protein, 37 aa, Mycobacterium
QPYKHGFGPFAPEVYRAPMAYPYRWPSGPQHCAEEAF

SEQ ID NO: 1276682 - protein, 19 aa, Mycobacterium
QPYQHYVGFEVDEMGRAER

SEQ ID NO: 1276683 - protein, 18 aa, Mycobacterium
QPYRFFVTATKELSIATD

SEQ ID NO: 1276684 - protein, 19 aa, Mycobacterium
QQAALRWVRDNIADFGGDP

SEQ ID NO: 1276685 - protein, 20 aa, Mycobacterium
QQAIEMSDMLLAKQGIDPRV

SEQ ID NO: 1276686 - protein, 20 aa, Mycobacterium
QQAIEMSDMLLGKQGIDPRV

SEQ ID NO: 1276687 - protein, 22 aa, Mycobacterium
QQAKYMWPYMFETVAAEYDRRY

SEQ ID NO: 1276688 - protein, 23 aa, Mycobacterium
QQFAPLIDLRWWQDRPGERTELY

SEQ ID NO: 1276689 - protein, 18 aa, Mycobacterium
QQFGVAIGTFQAVQHKAT

SEQ ID NO: 1276690 - protein, 18 aa, Mycobacterium
QQIFPEFVCLLDELLAPA

SEQ ID NO: 1276691 - protein, 25 aa, Mycobacterium
QQLCQGDRAILMWAAANRDPAMFEN

SEQ ID NO: 1276692 - protein, 21 aa, Mycobacterium
QQLGGWIRLGLIPNQDHAWIN

SEQ ID NO: 1276693 - protein, 18 aa, Mycobacterium
QQLPEARRRETLAQRRHH

SEQ ID NO: 1276694 - protein, 23 aa, Mycobacterium
QQMPAGAPVEWMAVVADRLPMTV

SEQ ID NO: 1276695 - protein, 23 aa, Mycobacterium
QQNRLLADISENINISGVKYDTT

SEQ ID NO: 1276696 - protein, 23 aa, Mycobacterium
QQPAEVWETLQLGNCGPPIETDR

SEQ ID NO: 1276697 - protein, 21 aa, Mycobacterium
QQPYDGPAIGVDWTRRPPYAV

SEQ ID NO: 1276698 - protein, 24 aa, Mycobacterium
QQQAELAVAGWLADRGFPVVPPSP

SEQ ID NO: 1276699 - protein, 21 aa, Mycobacterium
QQQRLCIARAIAVQPDVLLMD

SEQ ID NO: 1276700 - protein, 23 aa, Mycobacterium
QQRGETFDLVFIDADKENNVSYV

SEQ ID NO: 1276701 - protein, 21 aa, Mycobacterium
QQRGRAVFSIRSLPPTLSVVT

SEQ ID NO: 1276702 - protein, 19 aa, Mycobacterium
QQRIAVWKLVEAFRRQSQM

SEQ ID NO: 1276703 - protein, 21 aa, Mycobacterium
QQRRRERRGSSREQGGPNAGE

SEQ ID NO: 1276704 - protein, 22 aa, Mycobacterium
QQRVDAWLADFEAALATRDIER

SEQ ID NO: 1276705 - protein, 25 aa, Mycobacterium
QQRVTDLLATVGAALGDLAQKARDA

SEQ ID NO: 1276706 - protein, 24 aa, Mycobacterium
QQSFRIHGGYGYSKEYEIERLMRD

SEQ ID NO: 1276707 - protein, 19 aa, Mycobacterium
QQVGNLWSGVAETFTLSGS

SEQ ID NO: 1276708 - protein, 24 aa, Mycobacterium
QQVGPRVAQRFGRALLELGGNNAA

SEQ ID NO: 1276709 - protein, 17 aa, Mycobacterium
QQVLLPTLLDWLSDTPD

SEQ ID NO: 1276710 - protein, 25 aa, Mycobacterium
QQVPCAGLVIGAWPAQPGAAEIDNR

SEQ ID NO: 1276711 - protein, 19 aa, Mycobacterium
QQWEDSRRGVVPADPAIAL

SEQ ID NO: 1276712 - protein, 24 aa, Mycobacterium
QQYGIPIRLAYGATEFAGSLCAWT

SEQ ID NO: 1276713 - protein, 24 aa, Mycobacterium
QRAAGEMRGRLRALGGDEAGASTA

SEQ ID NO: 1276714 - protein, 22 aa, Mycobacterium
QRAALELPYPGVLPEPGEPAKK

SEQ ID NO: 1276715 - protein, 24 aa, Mycobacterium
QRAEGRYALMPGIIGALTDFGTPF

SEQ ID NO: 1276716 - protein, 23 aa, Mycobacterium
QRAEGVACYKLFISGLLDITDNV

SEQ ID NO: 1276717 - protein, 24 aa, Mycobacterium
QRAGAGAYELFAAMFRAQGEDRAS

SEQ ID NO: 1276718 - protein, 20 aa, Mycobacterium
QRAGGDFLYEVDWVSGAESP

SEQ ID NO: 1276719 - protein, 25 aa, Mycobacterium
QRAGLSIAEGFAFTRNEKLSALEKV

SEQ ID NO: 1276720 - protein, 28 aa, Mycobacterium
QRAKNMFALGLLSWMYGRELEHSESFIR

SEQ ID NO: 1276721 - protein, 21 aa, Mycobacterium
QRAKVATGFGKPAGVHALTDD

SEQ ID NO: 1276722 - protein, 24 aa, Mycobacterium
QRALCIGADLARRVGLTEATGETS

SEQ ID NO: 1276723 - protein, 18 aa, Mycobacterium
QRAPRVAGSFGQAPNQAS

SEQ ID NO: 1276724 - protein, 18 aa, Mycobacterium
QRAPVVVACRRLTGLNQQ

SEQ ID NO: 1276725 - protein, 24 aa, Mycobacterium
QRARIERHGVLVIGPNPAFLDHIS

SEQ ID NO: 1276726 - protein, 21 aa, Mycobacterium
QRAVELCLPDPPAVPTSGASA

SEQ ID NO: 1276727 - protein, 19 aa, Mycobacterium
QRCHGHGISAPRFLLEDCA

SEQ ID NO: 1276728 - protein, 20 aa, Mycobacterium
QRCPDRPGLIDELGTLTWRE

SEQ ID NO: 1276729 - protein, 20 aa, Mycobacterium
QRCRFCSIEESLRAGATTAV

SEQ ID NO: 1276730 - protein, 25 aa, Mycobacterium
QRDAHLRAADFFDVENHPVATFTST

SEQ ID NO: 1276731 - protein, 19 aa, Mycobacterium
QRDALSVAFGRGVGPAPDR

SEQ ID NO: 1276732 - protein, 33 aa, Mycobacterium
QRDHSWAARDWWSMDWMWSALHLDDGTHIHGVE

SEQ ID NO: 1276733 - protein, 24 aa, Mycobacterium
QRDKLCWRNAAALYGIESPVIPAV

SEQ ID NO: 1276734 - protein, 32 aa, Mycobacterium
QRDLPGLDVATAWLRARRPLDFIPGLMHGDYQ

SEQ ID NO: 1276735 - protein, 21 aa, Mycobacterium
QRDRFLFKLNVDYPTPEEERE

SEQ ID NO: 1276736 - protein, 23 aa, Mycobacterium
QREARLRRPQFAFPSRGILTSGF

SEQ ID NO: 1276737 - protein, 19 aa, Mycobacterium
QREARLRRPQFSFPARGIL

SEQ ID NO: 1276738 - protein, 20 aa, Mycobacterium
QRELRRRTGILVPIDAFDLD

SEQ ID NO: 1276739 - protein, 19 aa, Mycobacterium
QRFDIPVRLAYGATEFAGS

SEQ ID NO: 1276740 - protein, 25 aa, Mycobacterium
QRFGTDLPPLGGIYLAAFGGGPVTL

SEQ ID NO: 1276741 - protein, 21 aa, Mycobacterium
QRFLDGFADVMMSFHRLSDVD

SEQ ID NO: 1276742 - protein, 18 aa, Mycobacterium
QRFLPGMINGSERWCQGF

SEQ ID NO: 1276743 - protein, 18 aa, Mycobacterium
QRFVIAITTVRRWRNRFV

SEQ ID NO: 1276744 - protein, 22 aa, Mycobacterium
QRGCGQGPCLDAATEHRVVRAD

SEQ ID NO: 1276745 - protein, 25 aa, Mycobacterium
QRGIEVIEFAIGIPHLLKGEFTEGA

SEQ ID NO: 1276746 - protein, 17 aa, Mycobacterium
QRGRLIAEFPQQVGNTD

SEQ ID NO: 1276747 - protein, 18 aa, Mycobacterium
QRGYKCIFVCPDKVSEDK

SEQ ID NO: 1276748 - protein, 18 aa, Mycobacterium
QRGYRPDELTEWFATAYV

SEQ ID NO: 1276749 - protein, 25 aa, Mycobacterium
QRHGFDCPGCAWPEEPGGRKFAEFC

SEQ ID NO: 1276750 - protein, 18 aa, Mycobacterium
QRHKGCNCQPRIVLAENI

SEQ ID NO: 1276751 - protein, 18 aa, Mycobacterium
QRIADILRRLMGRRTDVD

SEQ ID NO: 1276752 - protein, 17 aa, Mycobacterium
QRIGDRGLPVTVYDLRD

SEQ ID NO: 1276753 - protein, 17 aa, Mycobacterium
QRLADLGARRLVLVSRS

SEQ ID NO: 1276754 - protein, 18 aa, Mycobacterium
QRLAGFGEQYPDVVVRRV

SEQ ID NO: 1276755 - protein, 18 aa, Mycobacterium
QRLAMDWYLHDTAMRSQR

SEQ ID NO: 1276756 - protein, 22 aa, Mycobacterium
QRLARIESILGRKLGTADRSTG

SEQ ID NO: 1276757 - protein, 22 aa, Mycobacterium
QRLATKHLIRYPGLQQAISRGA

SEQ ID NO: 1276758 - protein, 25 aa, Mycobacterium
QRLDDVPAGPVWVHCASGYRSSIAA

SEQ ID NO: 1276759 - protein, 17 aa, Mycobacterium
QRLIGGLSHISADRDIA

SEQ ID NO: 1276760 - protein, 17 aa, Mycobacterium
QRLIGMALARAGLSGGD

SEQ ID NO: 1276761 - protein, 18 aa, Mycobacterium
QRLLAAGLLRRIDDDTVI

SEQ ID NO: 1276762 - protein, 20 aa, Mycobacterium
QRLLRPLFDESLPVPDIATT

SEQ ID NO: 1276763 - protein, 24 aa, Mycobacterium
QRLYEVPVLLRFGGRLPPGSGALE

SEQ ID NO: 1276764 - protein, 24 aa, Mycobacterium
QRLYEVPVLLRFGGRLPPGSRALE

SEQ ID NO: 1276765 - protein, 22 aa, Mycobacterium
QRMGRTPGRLLVTWENITVDAE

SEQ ID NO: 1276766 - protein, 24 aa, Mycobacterium
QRMIDYSGLRVCRFGRGHRKAMVV

SEQ ID NO: 1276767 - protein, 19 aa, Mycobacterium
QRMTARVLAALLFSEQPSV

SEQ ID NO: 1276768 - protein, 18 aa, Mycobacterium
QRMWLPDLQRAIGDGELD

SEQ ID NO: 1276769 - protein, 19 aa, Mycobacterium
QRNIEGWVVRKRPGSAAAR

SEQ ID NO: 1276770 - protein, 18 aa, Mycobacterium
QRPDGMVDLSGHLTPEAW

SEQ ID NO: 1276771 - protein, 22 aa, Mycobacterium
QRPELFGAGAIGPVCVLRDEAL

SEQ ID NO: 1276772 - protein, 22 aa, Mycobacterium
QRPGREAAISKVVWSEFFRRYT

SEQ ID NO: 1276773 - protein, 17 aa, Mycobacterium
QRPPAGYGPPPGGYPDQ

SEQ ID NO: 1276774 - protein, 23 aa, Mycobacterium
QRPPRPGVHNSGWVQSPGAQYLG

SEQ ID NO: 1276775 - protein, 19 aa, Mycobacterium
QRPQLLIDWIDGRTGALDE

SEQ ID NO: 1276776 - protein, 18 aa, Mycobacterium
QRQYSWWSTQYGKVCVAY

SEQ ID NO: 1276777 - protein, 18 aa, Mycobacterium
QRRAEIPASDLAVSPADA

SEQ ID NO: 1276778 - protein, 17 aa, Mycobacterium
QRRAELRAQADAQLARE

SEQ ID NO: 1276779 - protein, 19 aa, Mycobacterium
QRRGALQAGETVLVLGSGG

SEQ ID NO: 1276780 - protein, 17 aa, Mycobacterium
QRRIALDTIADVDASGL

SEQ ID NO: 1276781 - protein, 20 aa, Mycobacterium
QRRLAQFVAIAARHDIRPLF

SEQ ID NO: 1276782 - protein, 18 aa, Mycobacterium
QRRLPLLVASGADVHVIT

SEQ ID NO: 1276783 - protein, 18 aa, Mycobacterium
QRRTVPLPLSQKIFDSRW

SEQ ID NO: 1276784 - protein, 22 aa, Mycobacterium
QRSIDLVKRYARVEFSGVEVYA

SEQ ID NO: 1276785 - protein, 20 aa, Mycobacterium
QRSIDLVKRYARVEFSSVEV

SEQ ID NO: 1276786 - protein, 21 aa, Mycobacterium
QRSIDLVKRYARVEFSSVEVD

SEQ ID NO: 1276787 - protein, 17 aa, Mycobacterium
QRSRLSIDLGADPLTAA

SEQ ID NO: 1276788 - protein, 18 aa, Mycobacterium
QRTADGWSGSGADSAGAF

SEQ ID NO: 1276789 - protein, 17 aa, Mycobacterium
QRTDWNYEYNKKLAQTA

SEQ ID NO: 1276790 - protein, 25 aa, Mycobacterium
QRTGIYGGIRACQWAVADGVIGRSR

SEQ ID NO: 1276791 - protein, 17 aa, Mycobacterium
QRTRALYTNAWKVMIAI

SEQ ID NO: 1276792 - protein, 19 aa, Mycobacterium
QRVAERFLDVLGARPDDLH

SEQ ID NO: 1276793 - protein, 20 aa, Mycobacterium
QRVAEWLAYVQHDWEPTPVP

SEQ ID NO: 1276794 - protein, 18 aa, Mycobacterium
QRVAFVLHDGFAMSFTEI

SEQ ID NO: 1276795 - protein, 24 aa, Mycobacterium
QRVAGMDAFRAWRLLVTEYGTPAP

SEQ ID NO: 1276796 - protein, 23 aa, Mycobacterium
QRVSAFSLLGAWAEQVAVPVGSV

SEQ ID NO: 1276797 - protein, 18 aa, Mycobacterium
QRVTLRFEGALMHVVANG

SEQ ID NO: 1276798 - protein, 22 aa, Mycobacterium
QRWPDGTPLLFPRPTKNLNGQL

SEQ ID NO: 1276799 - protein, 21 aa, Mycobacterium
QRWPHFGGRVARMGVHSALSV

SEQ ID NO: 1276800 - protein, 21 aa, Mycobacterium
QRWPLIGTFTASLWVTWAPHT

SEQ ID NO: 1276801 - protein, 24 aa, Mycobacterium
QRWSGEEHLVFACGRYEGIDQRVI

SEQ ID NO: 1276802 - protein, 20 aa, Mycobacterium
QRYEGYTVWINALVLSGGGE

SEQ ID NO: 1276803 - protein, 24 aa, Mycobacterium
QRYLEGPCLTAAWEEKTVHVRNLE

SEQ ID NO: 1276804 - protein, 17 aa, Mycobacterium
QRYPSEMMVTGWPASQR

SEQ ID NO: 1276805 - protein, 18 aa, Mycobacterium
QRYRDRYIFAGLQPGQRI

SEQ ID NO: 1276806 - protein, 20 aa, Mycobacterium
QRYTAVDAFAALQALQELKA

SEQ ID NO: 1276807 - protein, 20 aa, Mycobacterium
QRYTSYSGIEVGAIHADRGI

SEQ ID NO: 1276808 - protein, 34 aa, Mycobacterium
QSAEDYSTLVLCPKNLELMWTKHLDKYEINGRVV

SEQ ID NO: 1276809 - protein, 25 aa, Mycobacterium
QSASRLGKAVARLRASDAVVVVGTC

SEQ ID NO: 1276810 - protein, 25 aa, Mycobacterium
QSASRLGKAVARLRASGAVVVVGTC

SEQ ID NO: 1276811 - protein, 19 aa, Mycobacterium
QSAVAAWENGARIPGIDAL

SEQ ID NO: 1276812 - protein, 26 aa, Mycobacterium
QSAYSEMWFTEAYWPEFRRVDFLRAL

SEQ ID NO: 1276813 - protein, 19 aa, Mycobacterium
QSCGIGFDALTHGRGVGKF

SEQ ID NO: 1276814 - protein, 34 aa, Mycobacterium
QSCYWDYAPSFGRGPFRNVICLSVNDAVLHGLPH

SEQ ID NO: 1276815 - protein, 19 aa, Mycobacterium
QSDEPPCCPTGIGTVRFRI

SEQ ID NO: 1276816 - protein, 19 aa, Mycobacterium
QSDEVATFVVFLASDESRY

SEQ ID NO: 1276817 - protein, 17 aa, Mycobacterium
QSDSFVFDELYRTGRVE

SEQ ID NO: 1276818 - protein, 22 aa, Mycobacterium
QSEARLAQAWLHAANGSTSLAV

SEQ ID NO: 1276819 - protein, 18 aa, Mycobacterium
QSGALSHRGDDAIERLMD

SEQ ID NO: 1276820 - protein, 36 aa, Mycobacterium
QSGARPIWLTPQWDADFGVAHGLPVDRVEAALTAEA

SEQ ID NO: 1276821 - protein, 25 aa, Mycobacterium
QSGGIYAPMLHPWSPSTQGTGSDLY

SEQ ID NO: 1276822 - protein, 28 aa, Mycobacterium
QSGLARTGRTFACDHWGVVPDIYLLGKA

SEQ ID NO: 1276823 - protein, 27 aa, Mycobacterium
QSGLPFSRIRILKRLSKTPMSVKQLAE

SEQ ID NO: 1276824 - protein, 24 aa, Mycobacterium
QSGMASTIAIVWADAPLKEKSRSS

SEQ ID NO: 1276825 - protein, 18 aa, Mycobacterium
QSGPTVSVQVRWDEYMTA

SEQ ID NO: 1276826 - protein, 18 aa, Mycobacterium
QSIGPGLPEDADYTLFAK

SEQ ID NO: 1276827 - protein, 18 aa, Mycobacterium
QSIIRLTAKLRFVTGVAS

SEQ ID NO: 1276828 - protein, 22 aa, Mycobacterium
QSIPRYFYALFAIDLTNKNYAK

SEQ ID NO: 1276829 - protein, 18 aa, Mycobacterium
QSLCPDWTVRGVVDHVTS

SEQ ID NO: 1276830 - protein, 17 aa, Mycobacterium
QSLDELVEFMLRTLQSF

SEQ ID NO: 1276831 - protein, 19 aa, Mycobacterium
QSLGGGVAMQFVYQHPDYC

SEQ ID NO: 1276832 - protein, 19 aa, Mycobacterium
QSLGPDGSWAPAPDPSVLG

SEQ ID NO: 1276833 - protein, 20 aa, Mycobacterium
QSLLELLGGTTLRNDPKYAT

SEQ ID NO: 1276834 - protein, 27 aa, Mycobacterium
QSLLSGPLLVVFFFDVMRDVLRERVVD

SEQ ID NO: 1276835 - protein, 25 aa, Mycobacterium
QSLLVRALVAWFWEEPLRAPLIRHG

SEQ ID NO: 1276836 - protein, 18 aa, Mycobacterium
QSLRYLDDTGMIFEQYGD

SEQ ID NO: 1276837 - protein, 20 aa, Mycobacterium
QSLTVTIEFCNWLVAEHNTG

SEQ ID NO: 1276838 - protein, 22 aa, Mycobacterium
QSLVPMLAMRLTHFENLIDISR

SEQ ID NO: 1276839 - protein, 18 aa, Mycobacterium
QSMLCEPVIRRIDVLASQ

SEQ ID NO: 1276840 - protein, 19 aa, Mycobacterium
QSPAGCSLMVWEAENDARQ

SEQ ID NO: 1276841 - protein, 18 aa, Mycobacterium
QSQVSWKGALEAFAEGYH

SEQ ID NO: 1276842 - protein, 23 aa, Mycobacterium
QSRAAKAWATGAFERSVVPVLDA

SEQ ID NO: 1276843 - protein, 17 aa, Mycobacterium
QSRAWVDNAVRLIEADA

SEQ ID NO: 1276844 - protein, 20 aa, Mycobacterium
QSRFGFLAIHGGGLEQMTDV

SEQ ID NO: 1276845 - protein, 23 aa, Mycobacterium
QSRPLVAEALRLAERRRSERLAS

SEQ ID NO: 1276846 - protein, 18 aa, Mycobacterium
QSSMKGLNGFVSNAAIWR

SEQ ID NO: 1276847 - protein, 24 aa, Mycobacterium
QSSSRPDRGPVLAFVPDERSLHFA

SEQ ID NO: 1276848 - protein, 25 aa, Mycobacterium
QSTAEAFAALGFSADEMGRMFAQGG

SEQ ID NO: 1276849 - protein, 18 aa, Mycobacterium
QSTIARGRVTAVDTDAAR

SEQ ID NO: 1276850 - protein, 25 aa, Mycobacterium
QSVALPLRLGGWVIDTPGIRSFGLA

SEQ ID NO: 1276851 - protein, 18 aa, Mycobacterium
QSVPTLFPFVECQSRLLA

SEQ ID NO: 1276852 - protein, 23 aa, Mycobacterium
QSVSVALAAHFERLIATGEISPG

SEQ ID NO: 1276853 - protein, 27 aa, Mycobacterium
QTAGAELGRLGWWDGPRPHCAHEASAP

SEQ ID NO: 1276854 - protein, 22 aa, Mycobacterium
QTAGRGRHGRSWSAPPRSQISM

SEQ ID NO: 1276855 - protein, 23 aa, Mycobacterium
QTARALVKLAYAIRNLDGSPLRE

SEQ ID NO: 1276856 - protein, 17 aa, Mycobacterium
QTARYPADYLVKLSTLS

SEQ ID NO: 1276857 - protein, 23 aa, Mycobacterium
QTAWPPRLFSILAGFVEAGESFE

SEQ ID NO: 1276858 - protein, 23 aa, Mycobacterium
QTDRFLLKEIVRYPSPEQEVEVL

SEQ ID NO: 1276859 - protein, 33 aa, Mycobacterium
QTDVRAFRYARRIDRAGVLAGGPFVPRGARAVG

SEQ ID NO: 1276860 - protein, 21 aa, Mycobacterium
QTFARTDCRIELQYPADDNAA

SEQ ID NO: 1276861 - protein, 20 aa, Mycobacterium
QTFDFAMARLQTVAIDSGPQ

SEQ ID NO: 1276862 - protein, 18 aa, Mycobacterium
QTGAEVFVDAGARRLTAS

SEQ ID NO: 1276863 - protein, 19 aa, Mycobacterium
QTGTAVGVENVWAANGSNE

SEQ ID NO: 1276864 - protein, 19 aa, Mycobacterium
QTGVGRTGAFYAHQHDGIT

SEQ ID NO: 1276865 - protein, 19 aa, Mycobacterium
QTIARACGKSHVCHLEPDD

SEQ ID NO: 1276866 - protein, 18 aa, Mycobacterium
QTKRSVIRALDWTGEVFG

SEQ ID NO: 1276867 - protein, 22 aa, Mycobacterium
QTLDLRGAVLTRQVRFRDHAGR

SEQ ID NO: 1276868 - protein, 17 aa, Mycobacterium
QTLLSLIPGGALDYLVN

SEQ ID NO: 1276869 - protein, 18 aa, Mycobacterium
QTLRAARWSGCIRSDVDL

SEQ ID NO: 1276870 - protein, 17 aa, Mycobacterium
QTMRRNMRFDGVPFMPV

SEQ ID NO: 1276871 - protein, 18 aa, Mycobacterium
QTPKAATFCLSQRAEHIW

SEQ ID NO: 1276872 - protein, 19 aa, Mycobacterium
QTPVLRITVPFTDADRGFW

SEQ ID NO: 1276873 - protein, 17 aa, Mycobacterium
QTQCHWNLRLSVRDKEL

SEQ ID NO: 1276874 - protein, 25 aa, Mycobacterium
QTQKPAWLERAWARIAEEVKAGRQA

SEQ ID NO: 1276875 - protein, 17 aa, Mycobacterium
QTRAAAIGPQAVEEVQR

SEQ ID NO: 1276876 - protein, 28 aa, Mycobacterium
QTRNFVKANGWPLANTVIRHYKLHARAS

SEQ ID NO: 1276877 - protein, 17 aa, Mycobacterium
QTRWRTAVEKVLRGVGL

SEQ ID NO: 1276878 - protein, 29 aa, Mycobacterium
QTSFPLALECCRKALGLLGEGRWAAHLPL

SEQ ID NO: 1276879 - protein, 24 aa, Mycobacterium
QTSGWSLTAQDAFNNVARTCVEAM

SEQ ID NO: 1276880 - protein, 18 aa, Mycobacterium
QTSKPVLYRRWPDRRALL

SEQ ID NO: 1276881 - protein, 22 aa, Mycobacterium
QTSRTLLWRAAGALDENHPDKV

SEQ ID NO: 1276882 - protein, 28 aa, Mycobacterium
QTSSRYPGGMALRFARVLCYRDDKTAAE

SEQ ID NO: 1276883 - protein, 17 aa, Mycobacterium
QTTAVSILDRLLHHATV

SEQ ID NO: 1276884 - protein, 17 aa, Mycobacterium
QTVALGLGAGWRQQIDE

SEQ ID NO: 1276885 - protein, 26 aa, Mycobacterium
QTWIGRFVSTYGWRAYALPLLVALTA

SEQ ID NO: 1276886 - protein, 24 aa, Mycobacterium
QTWIPGFEPPYIVAMVELDDEPDV

SEQ ID NO: 1276887 - protein, 19 aa, Mycobacterium
QVAAIKSDPNWRGGDYHGT

SEQ ID NO: 1276888 - protein, 26 aa, Mycobacterium
QVAEELGQPLPLFIKWDDADYGLRAG

SEQ ID NO: 1276889 - protein, 27 aa, Mycobacterium
QVAEELGQPLPLFIKWDDAEYGLRAAE

SEQ ID NO: 1276890 - protein, 18 aa, Mycobacterium
QVAGLPLDGGELITRTVE

SEQ ID NO: 1276891 - protein, 18 aa, Mycobacterium
QVAIPDMLAAGWGRIVMI

SEQ ID NO: 1276892 - protein, 18 aa, Mycobacterium
QVALLTKRIVDLTEHLKQ

SEQ ID NO: 1276893 - protein, 23 aa, Mycobacterium
QVAQRYASVYGYDERAMAKIVVD

SEQ ID NO: 1276894 - protein, 21 aa, Mycobacterium
QVARLRAQMEFSRSRGDEPGA

SEQ ID NO: 1276895 - protein, 25 aa, Mycobacterium
QVARLWEHWGRPNIAWYRGGHTGFF

SEQ ID NO: 1276896 - protein, 28 aa, Mycobacterium
QVARVIGLLCRRRLGAAVGQIVNVDGGT

SEQ ID NO: 1276897 - protein, 26 aa, Mycobacterium
QVATLFRLWLRDAIRRVADGVLEVVA

SEQ ID NO: 1276898 - protein, 18 aa, Mycobacterium
QVCELTWQLKGQATGRQV

SEQ ID NO: 1276899 - protein, 21 aa, Mycobacterium
QVCSAGTRLIVEESIADDFVA

SEQ ID NO: 1276900 - protein, 19 aa, Mycobacterium
QVCVRRHGRVVLNRAIGHG

SEQ ID NO: 1276901 - protein, 24 aa, Mycobacterium
QVDDRAGLIAAARTAFGELGAAAG

SEQ ID NO: 1276902 - protein, 26 aa, Mycobacterium
QVDLALGWAHRLVGLRNGRKVLDRPA

SEQ ID NO: 1276903 - protein, 17 aa, Mycobacterium
QVDLTWRSINAGFTVIE

SEQ ID NO: 1276904 - protein, 22 aa, Mycobacterium
QVEDGLRIGQAVTNSGRQIPVQ

SEQ ID NO: 1276905 - protein, 20 aa, Mycobacterium
QVEFWLHWGPGGAKQSTKVT

SEQ ID NO: 1276906 - protein, 20 aa, Mycobacterium
QVGNFPGLWTEWNGKYRDTV

SEQ ID NO: 1276907 - protein, 23 aa, Mycobacterium
QVGWDPRRAVVVHPPAGLPAAVL

SEQ ID NO: 1276908 - protein, 20 aa, Mycobacterium
QVHTLLDFHFHPHVVAPSGK

SEQ ID NO: 1276909 - protein, 18 aa, Mycobacterium
QVIDCAFSGHATVILIGD

SEQ ID NO: 1276910 - protein, 22 aa, Mycobacterium
QVIEAVNLFRAKVVDVSNESLT

SEQ ID NO: 1276911 - protein, 26 aa, Mycobacterium
QVIGRGACSAALYRACNEQKYLACTR

SEQ ID NO: 1276912 - protein, 24 aa, Mycobacterium
QVIKRLTRVLPLMRDRLQRLCTGP

SEQ ID NO: 1276913 - protein, 24 aa, Mycobacterium
QVILAAALCSRGDLDASRRVAGNA

SEQ ID NO: 1276914 - protein, 21 aa, Mycobacterium
QVKIVGLSAGSLVVTEVLRLL

SEQ ID NO: 1276915 - protein, 24 aa, Mycobacterium
QVLAMAALRAGFYAEGLDQTGLSQ

SEQ ID NO: 1276916 - protein, 26 aa, Mycobacterium
QVLFVPLRFGIGFGLPTPQSVPAVPD

SEQ ID NO: 1276917 - protein, 25 aa, Mycobacterium
QVLIKAEAIGVNFIDTYFRSGLYPR

SEQ ID NO: 1276918 - protein, 17 aa, Mycobacterium
QVLLPLWNAYTFLALYA

SEQ ID NO: 1276919 - protein, 20 aa, Mycobacterium
QVLLPRRGTLIAWTTQGFPP

SEQ ID NO: 1276920 - protein, 23 aa, Mycobacterium
QVLSRYVDAIVWRTFAQERLTAM

SEQ ID NO: 1276921 - protein, 25 aa, Mycobacterium
QVMMVGFVLGPPVLRERLGRDPTAV

SEQ ID NO: 1276922 - protein, 22 aa, Mycobacterium
QVNIEYLARVVMVRDRAGEAGE

SEQ ID NO: 1276923 - protein, 19 aa, Mycobacterium
QVPFPKRMGRSTEYAQLAQ

SEQ ID NO: 1276924 - protein, 19 aa, Mycobacterium
QVPGSFGLVRAHPNVVVLR

SEQ ID NO: 1276925 - protein, 22 aa, Mycobacterium
QVPRLIAAGADMGRVVFVDVQI

SEQ ID NO: 1276926 - protein, 18 aa, Mycobacterium
QVQLRTGVVTDVRRGEQF

SEQ ID NO: 1276927 - protein, 23 aa, Mycobacterium
QVREALLSRGYRRRQWLLTRAAA

SEQ ID NO: 1276928 - protein, 25 aa, Mycobacterium
QVREFPVSFDAWWFRLPRPADDSIY

SEQ ID NO: 1276929 - protein, 17 aa, Mycobacterium
QVRGANIGTVFQDPMSA

SEQ ID NO: 1276930 - protein, 19 aa, Mycobacterium
QVRMEFADGVLRLSAGADD

SEQ ID NO: 1276931 - protein, 18 aa, Mycobacterium
QVRRYAAAFEALRNRSDV

SEQ ID NO: 1276932 - protein, 23 aa, Mycobacterium
QVRTCGRSCGGRARFVSEPVAAP

SEQ ID NO: 1276933 - protein, 24 aa, Mycobacterium
QVRWFDIDPCYIFHVANAHDDGRT

SEQ ID NO: 1276934 - protein, 27 aa, Mycobacterium
QVSFLPGLLRWIPFTKGDYWVLKIDDA

SEQ ID NO: 1276935 - protein, 18 aa, Mycobacterium
QVSHCTRTPIKLPPVDDP

SEQ ID NO: 1276936 - protein, 23 aa, Mycobacterium
QVSVDTFAGFIFLNPDPDAAPLR

SEQ ID NO: 1276937 - protein, 27 aa, Mycobacterium
QVTIFRLGSDPGLARFIDQVARRVGGR

SEQ ID NO: 1276938 - protein, 18 aa, Mycobacterium
QVTMWTKRVRAVDFTVGY

SEQ ID NO: 1276939 - protein, 23 aa, Mycobacterium
QVVDAWLARKERIRQIHELLSRA

SEQ ID NO: 1276940 - protein, 17 aa, Mycobacterium
QVVLCPACGANATKNAT

SEQ ID NO: 1276941 - protein, 19 aa, Mycobacterium
QVVSIPTMILFKDGKPVKR

SEQ ID NO: 1276942 - protein, 26 aa, Mycobacterium
QVVSKICWRTRLVVDSQVWALLDGEL

SEQ ID NO: 1276943 - protein, 24 aa, Mycobacterium
QVVSRPEPDLAILTMGRRDVPFDQ

SEQ ID NO: 1276944 - protein, 25 aa, Mycobacterium
QVWAMRYTLERVIRGQDTIAVTGNI

SEQ ID NO: 1276945 - protein, 19 aa, Mycobacterium
QVYGYLACSAARYPKSIVE

SEQ ID NO: 1276946 - protein, 18 aa, Mycobacterium
QWALPRGAIIVIDDPAAA

SEQ ID NO: 1276947 - protein, 18 aa, Mycobacterium
QWASLRWFERRIVDAAAD

SEQ ID NO: 1276948 - protein, 25 aa, Mycobacterium
QWFDLCAMTGHVEWIDEDSPLSITQ

SEQ ID NO: 1276949 - protein, 20 aa, Mycobacterium
QWGAYLARREKLVEDLAEEI

SEQ ID NO: 1276950 - protein, 24 aa, Mycobacterium
QWGRVAVAVPEVFRTATTDPADER

SEQ ID NO: 1276951 - protein, 18 aa, Mycobacterium
QWILAGYGVLVVDPEGDH

SEQ ID NO: 1276952 - protein, 18 aa, Mycobacterium
QWKRELVARTSLTEEEIG

SEQ ID NO: 1276953 - protein, 25 aa, Mycobacterium
QWLDRASSIAIAFVARRLSAEPVGV

SEQ ID NO: 1276954 - protein, 22 aa, Mycobacterium
QWLNLRYVTRLLVRLGATEDAA

SEQ ID NO: 1276955 - protein, 21 aa, Mycobacterium
QWMARFVLGFGSAVRVLEPVD

SEQ ID NO: 1276956 - protein, 26 aa, Mycobacterium
QWNLLECRSPAAARGRGVVTACLIRS

SEQ ID NO: 1276957 - protein, 23 aa, Mycobacterium
QWPIELMNCCVDCTIRSDLLVLL

SEQ ID NO: 1276958 - protein, 25 aa, Mycobacterium
QWPLADVRLLAPILASKVVCMGKNY

SEQ ID NO: 1276959 - protein, 24 aa, Mycobacterium
QWQNWSLRVGFNHREGMTLHTVRY

SEQ ID NO: 1276960 - protein, 23 aa, Mycobacterium
QWQRRRALVGSRIRALRLERGLS

SEQ ID NO: 1276961 - protein, 24 aa, Mycobacterium
QWQSVCALPGLAAHDLSRLRRVWW

SEQ ID NO: 1276962 - protein, 22 aa, Mycobacterium
QWQVPKFYWTVMSRSGMGDAFA

SEQ ID NO: 1276963 - protein, 22 aa, Mycobacterium
QYELMSALFRMQGQDFGTIREV

SEQ ID NO: 1276964 - protein, 22 aa, Mycobacterium
QYEPIAVVGMGCRLPGGVSDPD

SEQ ID NO: 1276965 - protein, 25 aa, Mycobacterium
QYGISREAQDEWALRSHQRAVKAID

SEQ ID NO: 1276966 - protein, 18 aa, Mycobacterium
QYGKSWRTIAKLSLPDRF

SEQ ID NO: 1276967 - protein, 18 aa, Mycobacterium
QYLRVHSGIVGFNAWLVN

SEQ ID NO: 1276968 - protein, 24 aa, Mycobacterium
QYLVIDECHYYRGIFGSNVAMVLR

SEQ ID NO: 1276969 - protein, 24 aa, Mycobacterium
QYNEYLQKYIVLYGDQFNNIVMRT

SEQ ID NO: 1276970 - protein, 21 aa, Mycobacterium
QYPFEEAYLLESARQFRHELS

SEQ ID NO: 1276971 - protein, 20 aa, Mycobacterium
QYWRRHARQPVRFAESVRTL

SEQ ID NO: 1276972 - protein, 17 aa, Mycobacterium
QYYLDEFTFRFNRRRST

SEQ ID NO: 1276973 - protein, 23 aa, Mycobacterium
RAAAAWILADLPLSLFLDEMVVP

SEQ ID NO: 1276974 - protein, 22 aa, Mycobacterium
RAAALELPQLWGGLADLADGTA

SEQ ID NO: 1276975 - protein, 19 aa, Mycobacterium
RAAALPLRAFGAGRAYRRL

SEQ ID NO: 1276976 - protein, 17 aa, Mycobacterium
RAAARVPGLEFLLEVDG

SEQ ID NO: 1276977 - protein, 18 aa, Mycobacterium
RAAARVPGLEFLLEVDGE

SEQ ID NO: 1276978 - protein, 17 aa, Mycobacterium
RAAASPARRPVDELTDP

SEQ ID NO: 1276979 - protein, 22 aa, Mycobacterium
RAACRKAGLHWVGLRKVPAKGK

SEQ ID NO: 1276980 - protein, 17 aa, Mycobacterium
RAADGVIDTSNRVREVV

SEQ ID NO: 1276981 - protein, 20 aa, Mycobacterium
RAADLGVVFERARQRGEMAE

SEQ ID NO: 1276982 - protein, 19 aa, Mycobacterium
RAAEFAVRNMPRHGSEQPV

SEQ ID NO: 1276983 - protein, 24 aa, Mycobacterium
RAAELAQRYGMQRFCLGIHACEIP

SEQ ID NO: 1276984 - protein, 18 aa, Mycobacterium
RAAELIGVQIPRFCDHPL

SEQ ID NO: 1276985 - protein, 26 aa, Mycobacterium
RAAEPWEVASTIAFLASDYSSYLTGE

SEQ ID NO: 1276986 - protein, 26 aa, Mycobacterium
RAAESTGRKCLVAMDLAGPKLRTGPI

SEQ ID NO: 1276987 - protein, 17 aa, Mycobacterium
RAAFAAAQRWRRRAEHP

SEQ ID NO: 1276988 - protein, 17 aa, Mycobacterium
RAAFAAVTRGAWRAGGT

SEQ ID NO: 1276989 - protein, 18 aa, Mycobacterium
RAAGASVVHCLVQRRADG

SEQ ID NO: 1276990 - protein, 25 aa, Mycobacterium
RAAGDAMGALGLFGVRPGALLDDDR

SEQ ID NO: 1276991 - protein, 26 aa, Mycobacterium
RAAGEAAFNIGSLFVPGGALSKTGTL

SEQ ID NO: 1276992 - protein, 17 aa, Mycobacterium
RAAGGRGPERGMNLPTG

SEQ ID NO: 1276993 - protein, 28 aa, Mycobacterium
RAAGHPDLPVPPTFLFSIELEAPDPFSY

SEQ ID NO: 1276994 - protein, 31 aa, Mycobacterium
RAAGIEFTLRAGRYLPWHPGRCAEIVVGDVV

SEQ ID NO: 1276995 - protein, 20 aa, Mycobacterium
RAAGPEVEIFRAAARRGSPV

SEQ ID NO: 1276996 - protein, 18 aa, Mycobacterium
RAAHGASPENPRTQQPSA

SEQ ID NO: 1276997 - protein, 19 aa, Mycobacterium
RAAHPRIDLLINNAGVMYP

SEQ ID NO: 1276998 - protein, 21 aa, Mycobacterium
RAAHVRPAWEARQSSRIPFRY

SEQ ID NO: 1276999 - protein, 28 aa, Mycobacterium
RAAIAAECDRRGWTIVGWHADEGVSGGK

SEQ ID NO: 1277000 - protein, 23 aa, Mycobacterium
RAAIDVESWVCPAPLRDAPNIVM

SEQ ID NO: 1277001 - protein, 18 aa, Mycobacterium
RAAIRSRFVPAAEPEPVA

SEQ ID NO: 1277002 - protein, 20 aa, Mycobacterium
RAALDAALWAVDAAVGRDTP

SEQ ID NO: 1277003 - protein, 21 aa, Mycobacterium
RAALDRSLARWLAEARVGEGR

SEQ ID NO: 1277004 - protein, 17 aa, Mycobacterium
RAALEPLVLMVAPLAPH

SEQ ID NO: 1277005 - protein, 20 aa, Mycobacterium
RAALETLAVIAYRQPVTRAR

SEQ ID NO: 1277006 - protein, 22 aa, Mycobacterium
RAALFEPATRSLVVLGSGPGGR

SEQ ID NO: 1277007 - protein, 19 aa, Mycobacterium
RAALHAALAEVRRRGYAIS

SEQ ID NO: 1277008 - protein, 20 aa, Mycobacterium
RAALKLPALLTASAAASALP

SEQ ID NO: 1277009 - protein, 23 aa, Mycobacterium
RAAMRRLAEHVIELGHREIGLLT

SEQ ID NO: 1277010 - protein, 17 aa, Mycobacterium
RAAMSPRHFTRVFSTEV

SEQ ID NO: 1277011 - protein, 19 aa, Mycobacterium
RAAPKADVYEFLIRAGHFG

SEQ ID NO: 1277012 - protein, 28 aa, Mycobacterium
RAAPPGLPWEMVWSFHLLPHWEDRCRLL

SEQ ID NO: 1277013 - protein, 19 aa, Mycobacterium
RAAQHFVALTFQLALDTLD

SEQ ID NO: 1277014 - protein, 19 aa, Mycobacterium
RAAQLGLRDRRLHAAATRC

SEQ ID NO: 1277015 - protein, 24 aa, Mycobacterium
RAAQTARVKGMWAVEMCALHTAVR

SEQ ID NO: 1277016 - protein, 22 aa, Mycobacterium
RAAQVNPRINAIVRDVPAAPAG

SEQ ID NO: 1277017 - protein, 21 aa, Mycobacterium
RAARAHPGELIGIATGPLTNL

SEQ ID NO: 1277018 - protein, 17 aa, Mycobacterium
RAARFASQLGFGVAPRV

SEQ ID NO: 1277019 - protein, 19 aa, Mycobacterium
RAARRLVHVPVGRFAEPEE

SEQ ID NO: 1277020 - protein, 23 aa, Mycobacterium
RAARSGWLIREVNSFEGRRIYGR

SEQ ID NO: 1277021 - protein, 18 aa, Mycobacterium
RAASRDSRRARQLPATKP

SEQ ID NO: 1277022 - protein, 18 aa, Mycobacterium
RAASRLGREFHVCDGKPE

SEQ ID NO: 1277023 - protein, 20 aa, Mycobacterium
RAAVEIASYSRAAEDGFRVL

SEQ ID NO: 1277024 - protein, 20 aa, Mycobacterium
RAAVIDPRLAQLSPEDRQTL

SEQ ID NO: 1277025 - protein, 19 aa, Mycobacterium
RAAVMFAAMSAADPDELRI

SEQ ID NO: 1277026 - protein, 20 aa, Mycobacterium
RACGDAASYRRWRDCYRVRA

SEQ ID NO: 1277027 - protein, 17 aa, Mycobacterium
RACISEFHYPRSEVDAP

SEQ ID NO: 1277028 - protein, 22 aa, Mycobacterium
RACLAQAVGVMRRLIEGATTPS

SEQ ID NO: 1277029 - protein, 24 aa, Mycobacterium
RACLKHSDRIRCAVVISPEDIEDD

SEQ ID NO: 1277030 - protein, 21 aa, Mycobacterium
RACQAGHRVLFATASQWVARL

SEQ ID NO: 1277031 - protein, 25 aa, Mycobacterium
RACRTCGAVSDGIRAVTTGDIAGHT

SEQ ID NO: 1277032 - protein, 24 aa, Mycobacterium
RACVVDLPTALLLRGQHPPDPAAR

SEQ ID NO: 1277033 - protein, 26 aa, Mycobacterium
RADAPIAEIGVGVFTAALREAIADGL

SEQ ID NO: 1277034 - protein, 26 aa, Mycobacterium
RADAYACAGCGTLLAVEIRAHEDEPL

SEQ ID NO: 1277035 - protein, 20 aa, Mycobacterium
RADGLLARNIRAAFAGKPLR

SEQ ID NO: 1277036 - protein, 24 aa, Mycobacterium
RADLKAGRLTFRLAGAPTGGRGQT

SEQ ID NO: 1277037 - protein, 19 aa, Mycobacterium
RADLLLGEACDKLRDAGHD

SEQ ID NO: 1277038 - protein, 19 aa, Mycobacterium
RADLLRPWANWVTPEEERT

SEQ ID NO: 1277039 - protein, 23 aa, Mycobacterium
RADPQGRRGLTFDFASLDPDDVV

SEQ ID NO: 1277040 - protein, 27 aa, Mycobacterium
RADPRMVEVFARFGLEGRLPASGLSVD

SEQ ID NO: 1277041 - protein, 28 aa, Mycobacterium
RADVAQWLTAHGWRAEAVPSQDEMRRLH

SEQ ID NO: 1277042 - protein, 17 aa, Mycobacterium
RADWYLPTQADGSVAAT

SEQ ID NO: 1277043 - protein, 19 aa, Mycobacterium
RAEAEFVRVQRRARAAELL

SEQ ID NO: 1277044 - protein, 19 aa, Mycobacterium
RAEAIRLGDYCLGLYGSRD

SEQ ID NO: 1277045 - protein, 18 aa, Mycobacterium
RAEALLALHQPGNPVILP

SEQ ID NO: 1277046 - protein, 23 aa, Mycobacterium
RAEALRLGCPDAHVLRVDVGTSG

SEQ ID NO: 1277047 - protein, 19 aa, Mycobacterium
RAEALRSVYRARPTDDFVK

SEQ ID NO: 1277048 - protein, 17 aa, Mycobacterium
RAEAPLGSYEVGDFARL

SEQ ID NO: 1277049 - protein, 18 aa, Mycobacterium
RAEGAWLYSQRAGILTGL

SEQ ID NO: 1277050 - protein, 26 aa, Mycobacterium
RAEGHCWFTAGTLWREAAQLAGVELP

SEQ ID NO: 1277051 - protein, 23 aa, Mycobacterium
RAEGLPLPGARQVTVMFADLVGF

SEQ ID NO: 1277052 - protein, 20 aa, Mycobacterium
RAEGRFYLPDGRRLGFAEFG

SEQ ID NO: 1277053 - protein, 27 aa, Mycobacterium
RAELEKAGVCVLDLNPAVVGPHCVPAV

SEQ ID NO: 1277054 - protein, 21 aa, Mycobacterium
RAELGLGAGWLAADYAALGVP

SEQ ID NO: 1277055 - protein, 20 aa, Mycobacterium
RAELPPRCVVDGEIVVATGG

SEQ ID NO: 1277056 - protein, 21 aa, Mycobacterium
RAELRPRADHVTGIVTVGLLE

SEQ ID NO: 1277057 - protein, 30 aa, Mycobacterium; identical to SEQ ID NO: 717201

SEQ ID NO: 1277058 - protein, 17 aa, Mycobacterium
RAERLQWVITQSVDVIA

SEQ ID NO: 1277059 - protein, 35 aa, Mycobacterium
RAERLRFPQGPYMHAWELFVATWLRIEAGQLARAA

SEQ ID NO: 1277060 - protein, 20 aa, Mycobacterium
RAERYLGIIDRVRAAIPHAA

SEQ ID NO: 1277061 - protein, 20 aa, Mycobacterium
RAETDLYFGNVVRDGVLGRF

SEQ ID NO: 1277062 - protein, 23 aa, Mycobacterium
RAETPRPEYLAARTSQPFSATAL

SEQ ID NO: 1277063 - protein, 25 aa, Mycobacterium
RAEVAAYLGERGWRTDSITATALLE

SEQ ID NO: 1277064 - protein, 22 aa, Mycobacterium
RAEWYLRQMLGAANFKAGRFLG

SEQ ID NO: 1277065 - protein, 25 aa, Mycobacterium
RAFDIDSGYPWPDHLPERVLTDGAG

SEQ ID NO: 1277066 - protein, 25 aa, Mycobacterium
RAFEAARPRAVWLPHYPYPLARFLP

SEQ ID NO: 1277067 - protein, 18 aa, Mycobacterium
RAFSGVKIACVGQATAER

SEQ ID NO: 1277068 - protein, 20 aa, Mycobacterium
RAGAGIPLVHATPMPYDNYF

SEQ ID NO: 1277069 - protein, 24 aa, Mycobacterium
RAGAHCRAEVLLLGQPRKTQSRFA

SEQ ID NO: 1277070 - protein, 17 aa, Mycobacterium
RAGAIAADGGMGRVVAK

SEQ ID NO: 1277071 - protein, 17 aa, Mycobacterium
RAGAIALQTRQRIAGVV

SEQ ID NO: 1277072 - protein, 20 aa, Mycobacterium
RAGALNALLIGGVELADLPD

SEQ ID NO: 1277073 - protein, 19 aa, Mycobacterium
RAGAQVQLVAALGTDAAAE

SEQ ID NO: 1277074 - protein, 25 aa, Mycobacterium
RAGCTPVAAACRLVHDSGDVLDDAA

SEQ ID NO: 1277075 - protein, 18 aa, Mycobacterium
RAGCWGEPGASSGPGDRP

SEQ ID NO: 1277076 - protein, 23 aa, Mycobacterium
RAGDARRPVHFEITRLRDGGVLS

SEQ ID NO: 1277077 - protein, 23 aa, Mycobacterium
RAGDAVSYGHTWTAQTDTTLALV

SEQ ID NO: 1277078 - protein, 26 aa, Mycobacterium
RAGDNCVRSEFAYGSFSRSLPLPDGA

SEQ ID NO: 1277079 - protein, 22 aa, Mycobacterium
RAGDSRARWLAAATTVVTGAGD

SEQ ID NO: 1277080 - protein, 21 aa, Mycobacterium
RAGEEDLFWLGTEEALALGRS

SEQ ID NO: 1277081 - protein, 21 aa, Mycobacterium
RAGELSGALLLLASGAGSFIT

SEQ ID NO: 1277082 - protein, 23 aa, Mycobacterium
RAGFRACKRCRPDASPGSPEWNV

SEQ ID NO: 1277083 - protein, 19 aa, Mycobacterium
RAGGDFLYEVDWVSGAESP

SEQ ID NO: 1277084 - protein, 19 aa, Mycobacterium
RAGGFGLVVGVDRTGQSEA

SEQ ID NO: 1277085 - protein, 32 aa, Mycobacterium
RAGGHEAAFLFAITVGGAMRIEPIEVMTFNGE

SEQ ID NO: 1277086 - protein, 27 aa, Mycobacterium
RAGGKIRRIECEAVLQFHLSNAFDDGD

SEQ ID NO: 1277087 - protein, 18 aa, Mycobacterium
RAGGMNRPVEGAHTGGFN

SEQ ID NO: 1277088 - protein, 17 aa, Mycobacterium
RAGHVLRAHGYPSSHRA

SEQ ID NO: 1277089 - protein, 18 aa, Mycobacterium
RAGIMLRNRPVHVAALLG

SEQ ID NO: 1277090 - protein, 25 aa, Mycobacterium
RAGKAGLVPAHLRDGHYSGAQKMGN

SEQ ID NO: 1277091 - protein, 17 aa, Mycobacterium
RAGKHRPVHLLGFGEGH

SEQ ID NO: 1277092 - protein, 19 aa, Mycobacterium
RAGLPGGLAVAGAYLDGIG

SEQ ID NO: 1277093 - protein, 17 aa, Mycobacterium
RAGLPLASTTYYFSSLD

SEQ ID NO: 1277094 - protein, 19 aa, Mycobacterium
RAGMGPPFSCEAGNCGTCM

SEQ ID NO: 1277095 - protein, 18 aa, Mycobacterium
RAGMPCIGCTEPEFPHFD

SEQ ID NO: 1277096 - protein, 19 aa, Mycobacterium
RAGQGLPLEGIRVLDLGVI

SEQ ID NO: 1277097 - protein, 17 aa, Mycobacterium
RAGRRFLNEAGEYNSMA

SEQ ID NO: 1277098 - protein, 20 aa, Mycobacterium
RAGSGLINMEFIQFHPTGMV

SEQ ID NO: 1277099 - protein, 19 aa, Mycobacterium
RAGVALSNLASSWAAFTVH

SEQ ID NO: 1277100 - protein, 23 aa, Mycobacterium
RAGVARSGFYFYFDSKYAVLAVI

SEQ ID NO: 1277101 - protein, 18 aa, Mycobacterium
RAGVRVLVNNAGFGTSGE

SEQ ID NO: 1277102 - protein, 19 aa, Mycobacterium
RAGYWTGRPLESLLLDAAH

SEQ ID NO: 1277103 - protein, 35 aa, Mycobacterium
RAHADDLYWMYALSSCVKWSDPVFDPTHDRPAEWE

SEQ ID NO: 1277104 - protein, 22 aa, Mycobacterium
RAHDDLLLVAGMRVSQRARLLD

SEQ ID NO: 1277105 - protein, 25 aa, Mycobacterium
RAHDVSRSWLYFGLISISVGALDDA

SEQ ID NO: 1277106 - protein, 19 aa, Mycobacterium
RAHHAFIYLRGEVVPVLRR

SEQ ID NO: 1277107 - protein, 23 aa, Mycobacterium
RAHLLRPHYARTLDMWAANLEAN

SEQ ID NO: 1277108 - protein, 21 aa, Mycobacterium
RAHSPLVERVLEVLRGVARTQ

SEQ ID NO: 1277109 - protein, 21 aa, Mycobacterium
RAHVGSLQFAPGRLGEVETMF

SEQ ID NO: 1277110 - protein, 29 aa, Mycobacterium
RAIATTLAARGWRVIVTDVNLTGAQETVA

SEQ ID NO: 1277111 - protein, 32 aa, Mycobacterium
RAIEEVFIRAGIPYKVVGGVRFYERREIRDIV

SEQ ID NO: 1277112 - protein, 17 aa, Mycobacterium
RAIENLCYIGLTNNLWG

SEQ ID NO: 1277113 - protein, 17 aa, Mycobacterium
RAIGYGMPGVRVDGNDV

SEQ ID NO: 1277114 - protein, 22 aa, Mycobacterium
RAIHFQEWWVRHRAQIPTESFA

SEQ ID NO: 1277115 - protein, 19 aa, Mycobacterium
RAILERRFAASYAATGFTP

SEQ ID NO: 1277116 - protein, 22 aa, Mycobacterium
RAIQYAFREHMVLTVSQDDDRG

SEQ ID NO: 1277117 - protein, 29 aa, Mycobacterium
RAIRLLPGRGLLVCDVWVGAPAGTAMTHF

SEQ ID NO: 1277118 - protein, 18 aa, Mycobacterium
RAITPWLPNLGTLEHVGR

SEQ ID NO: 1277119 - protein, 24 aa, Mycobacterium
RAKADARGWLALRQAEIISKAWTP

SEQ ID NO: 1277120 - protein, 18 aa, Mycobacterium
RAKALRLGDYCLGLYASR

SEQ ID NO: 1277121 - protein, 23 aa, Mycobacterium
RAKDLRSKPVWVLGAAETTSHML

SEQ ID NO: 1277122 - protein, 20 aa, Mycobacterium
RAKDSLIYSAAFVLCVGRDE

SEQ ID NO: 1277123 - protein, 21 aa, Mycobacterium
RAKEMIKVRGFQVAPAEVEAV

SEQ ID NO: 1277124 - protein, 18 aa, Mycobacterium
RAKHLCERLLSFASPLHL

SEQ ID NO: 1277125 - protein, 18 aa, Mycobacterium
RAKLPAGQIRPLLAELVV

SEQ ID NO: 1277126 - protein, 23 aa, Mycobacterium
RAKLRSSIKRLLVKYKYPPDKQP

SEQ ID NO: 1277127 - protein, 17 aa, Mycobacterium
RAKTILHGREIVLGMTR

SEQ ID NO: 1277128 - protein, 23 aa, Mycobacterium
RAKTWPPSVTFVHSRAETLAAAG

SEQ ID NO: 1277129 - protein, 18 aa, Mycobacterium
RALAGLNLAGLDLVVIEN

SEQ ID NO: 1277130 - protein, 24 aa, Mycobacterium
RALALRPGAVVSRVDLLRALPGSG

SEQ ID NO: 1277131 - protein, 19 aa, Mycobacterium
RALCTAADHVLMNTRTILD

SEQ ID NO: 1277132 - protein, 21 aa, Mycobacterium
RALDDGRCVYVNGDKVSRVAD

SEQ ID NO: 1277133 - protein, 17 aa, Mycobacterium
RALDGLVEFLPSRAWFD

SEQ ID NO: 1277134 - protein, 19 aa, Mycobacterium
RALDNQVFWVASNQSGTFG

SEQ ID NO: 1277135 - protein, 17 aa, Mycobacterium
RALDRGWLHRGIRYRGR

SEQ ID NO: 1277136 - protein, 26 aa, Mycobacterium
RALDSWERTRWTIAHEIGHLVLHRYG

SEQ ID NO: 1277137 - protein, 20 aa, Mycobacterium
RALDVGRARARRAVPVEAVP

SEQ ID NO: 1277138 - protein, 24 aa, Mycobacterium
RALEEARRGAPVLLAHTLDDQAET

SEQ ID NO: 1277139 - protein, 23 aa, Mycobacterium
RALEKHGAPIYVRHEIVHNRYVV

SEQ ID NO: 1277140 - protein, 17 aa, Mycobacterium
RALELTATYAREREQFE

SEQ ID NO: 1277141 - protein, 22 aa, Mycobacterium
RALETLGRYAFQYAIETAGGHR

SEQ ID NO: 1277142 - protein, 19 aa, Mycobacterium
RALFRRRDGLWERLIEACR

SEQ ID NO: 1277143 - protein, 26 aa, Mycobacterium
RALGLPATVLDWGLWKSWSDAQPQMK

SEQ ID NO: 1277144 - protein, 19 aa, Mycobacterium
RALIARFLAAARRYPNSSA

SEQ ID NO: 1277145 - protein, 18 aa, Mycobacterium
RALIDLGIGLWLNEPAAK

SEQ ID NO: 1277146 - protein, 23 aa, Mycobacterium
RALKEASYRLGARTLNHQFGAPM

SEQ ID NO: 1277147 - protein, 19 aa, Mycobacterium
RALLDAAARRSVRVRALDR

SEQ ID NO: 1277148 - protein, 26 aa, Mycobacterium
RALLEAFPGWGPVAALFDAEPAGPWA

SEQ ID NO: 1277149 - protein, 30 aa, Mycobacterium
RALLGADLFDRWKALGARFVAARPLTQLHW

SEQ ID NO: 1277150 - protein, 18 aa, Mycobacterium
RALLPGAIEEILRYEPPA

SEQ ID NO: 1277151 - protein, 20 aa, Mycobacterium
RALLRAELPPGGRLGIYGFG

SEQ ID NO: 1277152 - protein, 18 aa, Mycobacterium
RALPRSPGVYLFRGPTDE

SEQ ID NO: 1277153 - protein, 17 aa, Mycobacterium
RALQGWDDIAPMAAQYF

SEQ ID NO: 1277154 - protein, 22 aa, Mycobacterium
RALQYMFRKYLDMTPMEYLRRV

SEQ ID NO: 1277155 - protein, 19 aa, Mycobacterium
RALSGLPGVENAAIWEPEP

SEQ ID NO: 1277156 - protein, 19 aa, Mycobacterium
RALTPAVVWQDRRAESLCA

SEQ ID NO: 1277157 - protein, 20 aa, Mycobacterium
RALTPPSLVARVVRALEAGH

SEQ ID NO: 1277158 - protein, 26 aa, Mycobacterium
RALTVSRLLAPVVVPLVYRASISARG

SEQ ID NO: 1277159 - protein, 17 aa, Mycobacterium
RALVSFYLSSGVRASEL

SEQ ID NO: 1277160 - protein, 25 aa, Mycobacterium
RALYRRRDDLWDRLLQACRPGAPVS

SEQ ID NO: 1277161 - protein, 21 aa, Mycobacterium
RAMAARARRPVTVSTTGPADW

SEQ ID NO: 1277162 - protein, 18 aa, Mycobacterium
RAMFIGSHLRALACAGRK

SEQ ID NO: 1277163 - protein, 37 aa, Mycobacterium; identical to SEQ ID NO: 717716

SEQ ID NO: 1277164 - protein, 21 aa, Mycobacterium
RAMSPVSFSAVSLYWGILAAM

SEQ ID NO: 1277165 - protein, 21 aa, Mycobacterium
RAMSQLGVPYSWGGGNANGPA

SEQ ID NO: 1277166 - protein, 22 aa, Mycobacterium
RANAPLISWDSAFGLVKINPLA

SEQ ID NO: 1277167 - protein, 18 aa, Mycobacterium
RANASFEDAYAALIAAGR

SEQ ID NO: 1277168 - protein, 24 aa, Mycobacterium
RANGRPDDEFAFVVHGTMADPRWL

SEQ ID NO: 1277169 - protein, 24 aa, Mycobacterium
RANLLAKLGLRDRLALTRYAIRVG

SEQ ID NO: 1277170 - protein, 20 aa, Mycobacterium
RANPWLADHMSSALAMLTKD

SEQ ID NO: 1277171 - protein, 26 aa, Mycobacterium
RANRLAHLFRRAGLREGDTVAAILEN

SEQ ID NO: 1277172 - protein, 21 aa, Mycobacterium
RANRTPVEWDGYTPPVPAQGL

SEQ ID NO: 1277173 - protein, 21 aa, Mycobacterium
RANWESAGWGEVADGMVAVTS

SEQ ID NO: 1277174 - protein, 25 aa, Mycobacterium
RAPCPGLIALPWDRPLADWAAPEVP

SEQ ID NO: 1277175 - protein, 19 aa, Mycobacterium
RAPELAARLGFTRSAAAVD

SEQ ID NO: 1277176 - protein, 18 aa, Mycobacterium
RAPFEPLLDEVMFVPYDS

SEQ ID NO: 1277177 - protein, 24 aa, Mycobacterium
RAPGECPGTYAAEVAMDELAVACG

SEQ ID NO: 1277178 - protein, 23 aa, Mycobacterium
RAPLAPIRLRIGVHTGEVRLRDE

SEQ ID NO: 1277179 - protein, 26 aa, Mycobacterium
RAPLLAEEWRLLIAAMGRARSRLLVT

SEQ ID NO: 1277180 - protein, 32 aa, Mycobacterium
RAPMPLQGIAYAFARRQLVSWMARRHGPVFRI

SEQ ID NO: 1277181 - protein, 30 aa, Mycobacterium
RAPMWDLSWRTPALLAERDFLYDSSLMDAD

SEQ ID NO: 1277182 - protein, 22 aa, Mycobacterium
RAPRLRLVHKLGAGVNTIDVDA

SEQ ID NO: 1277183 - protein, 26 aa, Mycobacterium
RAPVLRKLLWLLPDRFAPQLTPEVWA

SEQ ID NO: 1277184 - protein, 19 aa, Mycobacterium
RAPVPPRKGAGRVGGQPTL

SEQ ID NO: 1277185 - protein, 18 aa, Mycobacterium
RAPYAGLAELGIFGVALP

SEQ ID NO: 1277186 - protein, 21 aa, Mycobacterium
RAQALLYYLWRLHSAGRLPGI

SEQ ID NO: 1277187 - protein, 23 aa, Mycobacterium
RAQAVGGTWLFNRYPGARCDIES

SEQ ID NO: 1277188 - protein, 19 aa, Mycobacterium
RAQEALQFQHYSWQNMLDE

SEQ ID NO: 1277189 - protein, 17 aa, Mycobacterium
RAQIQPWAWVVNNSLAA

SEQ ID NO: 1277190 - protein, 24 aa, Mycobacterium
RAQRFYAKHGFTVAGTKTFRLGGH

SEQ ID NO: 1277191 - protein, 24 aa, Mycobacterium
RAQSRLAVVSALFGLIRAGDRIPA

SEQ ID NO: 1277192 - protein, 17 aa, Mycobacterium
RAQVWRQLPVSPDDPSS

SEQ ID NO: 1277193 - protein, 23 aa, Mycobacterium
RARAGEITAEMAFIAEREGVSPE

SEQ ID NO: 1277194 - protein, 20 aa, Mycobacterium
RARAGGVVRRADGTVTYGPI

SEQ ID NO: 1277195 - protein, 17 aa, Mycobacterium
RARALGYEGQMTWAEAM

SEQ ID NO: 1277196 - protein, 20 aa, Mycobacterium
RARCPEVLPSTHVVDTLETL

SEQ ID NO: 1277197 - protein, 22 aa, Mycobacterium
RARDAGAMAYLVKPFSITDLIP

SEQ ID NO: 1277198 - protein, 17 aa, Mycobacterium
RARELLLNQVIDEAIER

SEQ ID NO: 1277199 - protein, 21 aa, Mycobacterium
RAREVLLTRVVDLAINRRRVA

SEQ ID NO: 1277200 - protein, 20 aa, Mycobacterium
RARFPRLRDRSIFVGNPEDV

SEQ ID NO: 1277201 - protein, 20 aa, Mycobacterium
RARGAALVHGLRHTFATELA

SEQ ID NO: 1277202 - protein, 30 aa, Mycobacterium
RARGLVARWLTEWACPDLILAASTVATVLI

SEQ ID NO: 1277203 - protein, 23 aa, Mycobacterium
RARGRGLDVLFANAGLAVLGPLA

SEQ ID NO: 1277204 - protein, 26 aa, Mycobacterium
RARLAEGMPAYGSCAGMILLATEIAD

SEQ ID NO: 1277205 - protein, 23 aa, Mycobacterium
RARLAMTEIPDLLAPSDTDPVYQ

SEQ ID NO: 1277206 - protein, 18 aa, Mycobacterium
RARLARRMTSQRSTINPV

SEQ ID NO: 1277207 - protein, 22 aa, Mycobacterium
RARLDARFGAGVVKVPSQRTAY

SEQ ID NO: 1277208 - protein, 22 aa, Mycobacterium
RARLLSMLRYFLRAEGMDDLQL

SEQ ID NO: 1277209 - protein, 20 aa, Mycobacterium
RARLQRFADATVWPRLLGNC

SEQ ID NO: 1277210 - protein, 18 aa, Mycobacterium
RARLRPQDFQAQTNILFG

SEQ ID NO: 1277211 - protein, 18 aa, Mycobacterium
RARMIAVGLVSISVDSAR

SEQ ID NO: 1277212 - protein, 22 aa, Mycobacterium
RARNPKIIYARGHGYGIKGDQA

SEQ ID NO: 1277213 - protein, 19 aa, Mycobacterium
RARPIAPLLDGLRALGVAI

SEQ ID NO: 1277214 - protein, 22 aa, Mycobacterium
RARQRLLTCFVRDFHVAGKGFS

SEQ ID NO: 1277215 - protein, 20 aa, Mycobacterium
RARRGEPLARLILGRGDRLA

SEQ ID NO: 1277216 - protein, 20 aa, Mycobacterium
RARRLAGFLTGRGLMPGDRV

SEQ ID NO: 1277217 - protein, 22 aa, Mycobacterium
RARRLQPHYIELAFKAAFTRLG

SEQ ID NO: 1277218 - protein, 17 aa, Mycobacterium
RARRRAAVRAELGLPDM

SEQ ID NO: 1277219 - protein, 25 aa, Mycobacterium
RARRRLWAPHRVFGARQLDMVGDAR

SEQ ID NO: 1277220 - protein, 20 aa, Mycobacterium
RARRWLPDTPILPVDEVARR

SEQ ID NO: 1277221 - protein, 17 aa, Mycobacterium
RARSGESRWFVVDHDAM

SEQ ID NO: 1277222 - protein, 18 aa, Mycobacterium
RARTTIAAGLPVGPPPGV

SEQ ID NO: 1277223 - protein, 20 aa, Mycobacterium
RARVHKMLAGLFGLCERHRH

SEQ ID NO: 1277224 - protein, 24 aa, Mycobacterium
RARVLHCAALRRLADKTQVVGPRD

SEQ ID NO: 1277225 - protein, 28 aa, Mycobacterium
RASALAARLKKVWAPQGLVQRSQGKWYP

SEQ ID NO: 1277226 - protein, 23 aa, Mycobacterium
RASAYRCGEAWSVLLRHRPTAHT

SEQ ID NO: 1277227 - protein, 20 aa, Mycobacterium
RASCRFMKMITPAAMLRCLI

SEQ ID NO: 1277228 - protein, 25 aa, Mycobacterium
RASDAVACALALQRAPLAPIRLRIG

SEQ ID NO: 1277229 - protein, 18 aa, Mycobacterium
RASEGMTRLVQYSTALYS

SEQ ID NO: 1277230 - protein, 19 aa, Mycobacterium
RASFKRTYRDIDVLLVDDI

SEQ ID NO: 1277231 - protein, 19 aa, Mycobacterium
RASGIAVIAEVKRASPSRG

SEQ ID NO: 1277232 - protein, 18 aa, Mycobacterium
RASGLIEPAHPLAFQRTL

SEQ ID NO: 1277233 - protein, 27 aa, Mycobacterium
RASLERLGLDYVDLYLIHWPAGSQGTY

SEQ ID NO: 1277234 - protein, 24 aa, Mycobacterium
RASMRPGDVAFTFTDYAVDPAGVR

SEQ ID NO: 1277235 - protein, 19 aa, Mycobacterium
RASMWLEHIRRRGWKAVAA

SEQ ID NO: 1277236 - protein, 29 aa, Mycobacterium
RASQLNGCGFCLRLHVRDALAKGETTDRL

SEQ ID NO: 1277237 - protein, 18 aa, Mycobacterium
RASRLSRIVALISEETRS

SEQ ID NO: 1277238 - protein, 20 aa, Mycobacterium
RASVSAGEWPVGTRIPTEPA

SEQ ID NO: 1277239 - protein, 20 aa, Mycobacterium
RASYESKPYRGHLIRTYGGT

SEQ ID NO: 1277240 - protein, 25 aa, Mycobacterium
RATAARWAERLGLPLRTASLGGGPD

SEQ ID NO: 1277241 - protein, 20 aa, Mycobacterium
RATEAIAFGIGVVGLLNVQY

SEQ ID NO: 1277242 - protein, 18 aa, Mycobacterium
RATGDERWLWGGPDRAGE

SEQ ID NO: 1277243 - protein, 23 aa, Mycobacterium
RATGEWAAATARLRAADEEVARC

SEQ ID NO: 1277244 - protein, 17 aa, Mycobacterium
RATLIVRGRPDELVQLA

SEQ ID NO: 1277245 - protein, 22 aa, Mycobacterium
RATMVAAPGWTSSFSEALIDYG

SEQ ID NO: 1277246 - protein, 28 aa, Mycobacterium
RATPPARLVGWTSRFLGMVLPGDEIEFR

SEQ ID NO: 1277247 - protein, 25 aa, Mycobacterium
RATRPGGRLTFVCWRDPTDNPFMST

SEQ ID NO: 1277248 - protein, 17 aa, Mycobacterium
RATSRKNQARWQFGVLG

SEQ ID NO: 1277249 - protein, 25 aa, Mycobacterium
RATTGLKMPDCCVLYTAEHHAAALA

SEQ ID NO: 1277250 - protein, 22 aa, Mycobacterium
RATTSFPNRRVAAADVAVELRG

SEQ ID NO: 1277251 - protein, 17 aa, Mycobacterium
RATVAIRSLSAAEVIAA

SEQ ID NO: 1277252 - protein, 19 aa, Mycobacterium
RAVAAGARVISREVALPEV

SEQ ID NO: 1277253 - protein, 18 aa, Mycobacterium
RAVAALRARKRRGDKPFA

SEQ ID NO: 1277254 - protein, 23 aa, Mycobacterium
RAVADAVLYEGYLLYPYRATSGK

SEQ ID NO: 1277255 - protein, 24 aa, Mycobacterium
RAVAFRRFRAADVRSILAVGTGAP

SEQ ID NO: 1277256 - protein, 27 aa, Mycobacterium
RAVALAPRLWVPDDFGLSRYLAAGLAV

SEQ ID NO: 1277257 - protein, 19 aa, Mycobacterium
RAVEEILRVYPIVQTARKA

SEQ ID NO: 1277258 - protein, 17 aa, Mycobacterium
RAVELGVDHIDTAQFYG

SEQ ID NO: 1277259 - protein, 19 aa, Mycobacterium
RAVGSFVWGPLRGVLPGRP

SEQ ID NO: 1277260 - protein, 23 aa, Mycobacterium
RAVHAGLLLRGWSDDIVVLAGDV

SEQ ID NO: 1277261 - protein, 17 aa, Mycobacterium
RAVILAMGAAARHLGVP

SEQ ID NO: 1277262 - protein, 20 aa, Mycobacterium
RAVKHNGWGVPGLSWTPGED

SEQ ID NO: 1277263 - protein, 17 aa, Mycobacterium
RAVLFGSRRRSTGVVKF

SEQ ID NO: 1277264 - protein, 23 aa, Mycobacterium
RAVLHYRTARWNDVVRMLTPLVA

SEQ ID NO: 1277265 - protein, 19 aa, Mycobacterium
RAVLPRTFDYGFATGLMTK

SEQ ID NO: 1277266 - protein, 17 aa, Mycobacterium
RAVLVALPAQAANDVAG

SEQ ID NO: 1277267 - protein, 31 aa, Mycobacterium
RAVMATMPMVMWLRMLSLQAQKRAAQASAQA

SEQ ID NO: 1277268 - protein, 26 aa, Mycobacterium
RAVNVPARVVSVYAPGLYPMDFHAVG

SEQ ID NO: 1277269 - protein, 19 aa, Mycobacterium
RAVPCLCKVAPNGHYLMED

SEQ ID NO: 1277270 - protein, 18 aa, Mycobacterium
RAVRAMFDMMGANPRLDT

SEQ ID NO: 1277271 - protein, 26 aa, Mycobacterium
RAVRQIFFRLGEVILEVIGSPGTAGD

SEQ ID NO: 1277272 - protein, 25 aa, Mycobacterium
RAVSEVRALVRWLRPQAASIAVAGV

SEQ ID NO: 1277273 - protein, 18 aa, Mycobacterium
RAVSFIHSLAFTFGAKFT

SEQ ID NO: 1277274 - protein, 23 aa, Mycobacterium
RAVSRPPIPRPLQAEGGVPDLAI

SEQ ID NO: 1277275 - protein, 18 aa, Mycobacterium
RAVVDWTFVEPKLLDLAT

SEQ ID NO: 1277276 - protein, 26 aa, Mycobacterium
RAVVLRDRLPKIGALFLQGLLSELLV

SEQ ID NO: 1277277 - protein, 17 aa, Mycobacterium
RAVYRKMAKRGGGAIVN

SEQ ID NO: 1277278 - protein, 17 aa, Mycobacterium
RAWARFERGEVVFKAEV

SEQ ID NO: 1277279 - protein, 21 aa, Mycobacterium
RAWLPDLTRLLAGADHARASG

SEQ ID NO: 1277280 - protein, 19 aa, Mycobacterium
RAYAAPSFVAGRPLIEVLL

SEQ ID NO: 1277281 - protein, 18 aa, Mycobacterium
RAYAELVHETPGFVEYFK

SEQ ID NO: 1277282 - protein, 19 aa, Mycobacterium
RAYMGSLVAGARTNPGDDI

SEQ ID NO: 1277283 - protein, 24 aa, Mycobacterium
RAYRREVLEKIDLAAVDTKGYGFQ

SEQ ID NO: 1277284 - protein, 21 aa, Mycobacterium
RAYVLDAWLRPLPDGVAGELY

SEQ ID NO: 1277285 - protein, 18 aa, Mycobacterium
RCAAPGPHRAFHVAAGGS

SEQ ID NO: 1277286 - protein, 26 aa, Mycobacterium
RCAAQALPRRDRVVLVGQAPLGEEQW

SEQ ID NO: 1277287 - protein, 19 aa, Mycobacterium
RCADEIRSRLDNFIVIGQR

SEQ ID NO: 1277288 - protein, 20 aa, Mycobacterium
RCADMLVALEGARSQILAAA

SEQ ID NO: 1277289 - protein, 18 aa, Mycobacterium
RCAPGEGATAGWLKLDRP

SEQ ID NO: 1277290 - protein, 17 aa, Mycobacterium
RCCDGPTSLSAVIRWLA

SEQ ID NO: 1277291 - protein, 25 aa, Mycobacterium
RCDCGPQLDAALAMVAREGRGVVLY

SEQ ID NO: 1277292 - protein, 19 aa, Mycobacterium
RCDGIPFYVEQVVAGLTET

SEQ ID NO: 1277293 - protein, 19 aa, Mycobacterium
RCDGVPFYIEQVVSGLGQT

SEQ ID NO: 1277294 - protein, 20 aa, Mycobacterium
RCEFVGEFGNPFAMLVIADL

SEQ ID NO: 1277295 - protein, 18 aa, Mycobacterium
RCERGCGRQGDRPTRCAD

SEQ ID NO: 1277296 - protein, 17 aa, Mycobacterium
RCFLRERLTELLTDPIS

SEQ ID NO: 1277297 - protein, 17 aa, Mycobacterium
RCGEALSAVLLDATMAG

SEQ ID NO: 1277298 - protein, 20 aa, Mycobacterium
RCGIREFVDDGAIDPDHGSP

SEQ ID NO: 1277299 - protein, 19 aa, Mycobacterium
RCGMVPAPTDVIWDNHRGQ

SEQ ID NO: 1277300 - protein, 23 aa, Mycobacterium
RCITEGIDIPALDAVFFAEPRSS

SEQ ID NO: 1277301 - protein, 26 aa, Mycobacterium
RCLDLTVEWCRSRETFGKPLITRQSV

SEQ ID NO: 1277302 - protein, 19 aa, Mycobacterium
RCLEVEGARLAATVRTAED

SEQ ID NO: 1277303 - protein, 18 aa, Mycobacterium
RCLQLHGGYGYMREYDVA

SEQ ID NO: 1277304 - protein, 18 aa, Mycobacterium
RCLVRSVFGPFALARRLS

SEQ ID NO: 1277305 - protein, 17 aa, Mycobacterium
RCMEATVQMAARHLADA

SEQ ID NO: 1277306 - protein, 25 aa, Mycobacterium
RCQGFYCGAHTQALLESSGAEDADD

SEQ ID NO: 1277307 - protein, 21 aa, Mycobacterium
RCQGHTLCAMIAPDSFELSDI

SEQ ID NO: 1277308 - protein, 20 aa, Mycobacterium
RCRNLGSQLGRFARSHGHLD

SEQ ID NO: 1277309 - protein, 26 aa, Mycobacterium
RCRQHRCFPVLAGPPGAHHLMLVSPI

SEQ ID NO: 1277310 - protein, 29 aa, Mycobacterium
RCSECRHITAKWVGRCPDCGTWGTVEEVA

SEQ ID NO: 1277311 - protein, 19 aa, Mycobacterium
RCSERFAPHLDWIVANLDK

SEQ ID NO: 1277312 - protein, 19 aa, Mycobacterium
RCSNCVGCVGCYNCSGLRN

SEQ ID NO: 1277313 - protein, 17 aa, Mycobacterium
RCSYLRDGVAVRDMRTE

SEQ ID NO: 1277314 - protein, 19 aa, Mycobacterium
RCTACPRPAEHADVNAAKN

SEQ ID NO: 1277315 - protein, 23 aa, Mycobacterium
RCTEAPWWSHDIWDLRADPRIPQ

SEQ ID NO: 1277316 - protein, 18 aa, Mycobacterium
RCTGCGACFEQCPVHAIE

SEQ ID NO: 1277317 - protein, 17 aa, Mycobacterium
RCTWLETSHAFHSELLD

SEQ ID NO: 1277318 - protein, 18 aa, Mycobacterium
RCVLPDFRYRAVAADGVV

SEQ ID NO: 1277319 - protein, 20 aa, Mycobacterium
RCVTGLRLTPVSTKSIDAAA

SEQ ID NO: 1277320 - protein, 21 aa, Mycobacterium
RCYEMPLILNVPTFTICAATI

SEQ ID NO: 1277321 - protein, 18 aa, Mycobacterium
RCYGLPGVYSYLPGLTNV

SEQ ID NO: 1277322 - protein, 22 aa, Mycobacterium
RCYGLPGVYSYLPGVTNVGAMR

SEQ ID NO: 1277323 - protein, 20 aa, Mycobacterium
RDAAEQAAAFLIGDQYGSSA

SEQ ID NO: 1277324 - protein, 33 aa, Mycobacterium
RDAAMPFGLAPLREVFSLLREVRRWGPQDRVRE

SEQ ID NO: 1277325 - protein, 26 aa, Mycobacterium
RDAAMRRIPLTLAHVLPSAATQSWIQ

SEQ ID NO: 1277326 - protein, 22 aa, Mycobacterium
RDAAQWSRIRLADRAHLEPWEP

SEQ ID NO: 1277327 - protein, 20 aa, Mycobacterium
RDADGYFWFMGRADDVIKSA

SEQ ID NO: 1277328 - protein, 19 aa, Mycobacterium
RDADSLIYVAGIRKPDIAT

SEQ ID NO: 1277329 - protein, 31 aa, Mycobacterium
RDAEFPWRREVGNARAGRLVAPDLGFGEDTE

SEQ ID NO: 1277330 - protein, 23 aa, Mycobacterium
RDAEIAREFIDVMHLQRAPKTLM

SEQ ID NO: 1277331 - protein, 19 aa, Mycobacterium
RDAFIAGMAEDQWDAVINV

SEQ ID NO: 1277332 - protein, 18 aa, Mycobacterium
RDAGIKVALTTGFSPDTQ

SEQ ID NO: 1277333 - protein, 17 aa, Mycobacterium
RDAHAGVAHAIHTPGTI

SEQ ID NO: 1277334 - protein, 17 aa, Mycobacterium
RDAHGWVTVGDVGYLDE

SEQ ID NO: 1277335 - protein, 17 aa, Mycobacterium
RDAISDVPRDRWDAEEF

SEQ ID NO: 1277336 - protein, 18 aa, Mycobacterium
RDAKQLFVFQRTPSSVDE

SEQ ID NO: 1277337 - protein, 18 aa, Mycobacterium
RDALIADPGQRWSVVLSN

SEQ ID NO: 1277338 - protein, 18 aa, Mycobacterium
RDALMQLIRVFADATDRL

SEQ ID NO: 1277339 - protein, 17 aa, Mycobacterium
RDALQCRLDAFRSVEGF

SEQ ID NO: 1277340 - protein, 17 aa, Mycobacterium
RDAMFSGAHINTSEDRA

SEQ ID NO: 1277341 - protein, 17 aa, Mycobacterium
RDAMIVFTGLSGSGKSS

SEQ ID NO: 1277342 - protein, 25 aa, Mycobacterium
RDAMPTFRQIFLAGASGMELERRAY

SEQ ID NO: 1277343 - protein, 23 aa, Mycobacterium
RDAMPTFRQVFMAGASGDPSAPR

SEQ ID NO: 1277344 - protein, 24 aa, Mycobacterium
RDAQARLWVCGRVSQRVKAAGGTV

SEQ ID NO: 1277345 - protein, 19 aa, Mycobacterium
RDARGVAFRHDLCRRAITS

SEQ ID NO: 1277346 - protein, 18 aa, Mycobacterium
RDARKVLTCQTFARTDCR

SEQ ID NO: 1277347 - protein, 18 aa, Mycobacterium
RDARRAGATVVRVGTHCT

SEQ ID NO: 1277348 - protein, 18 aa, Mycobacterium
RDASVGWLVRRLEGDREV

SEQ ID NO: 1277349 - protein, 25 aa, Mycobacterium
RDAVLRALSARSWRAGLRQRSEARV

SEQ ID NO: 1277350 - protein, 26 aa, Mycobacterium
RDAVPFSAYLFYKWAGHPNAEPDRFG

SEQ ID NO: 1277351 - protein, 24 aa, Mycobacterium
RDAVVLRFGFFYGPGAGHSETMMR

SEQ ID NO: 1277352 - protein, 17 aa, Mycobacterium
RDCKVFIAHDLDADNRR

SEQ ID NO: 1277353 - protein, 30 aa, Mycobacterium
RDCTGTACNGGRGGLLWGNGGDGANGGVGG

SEQ ID NO: 1277354 - protein, 23 aa, Mycobacterium
RDDADWQALCRVLGRQDLAGDPQ

SEQ ID NO: 1277355 - protein, 22 aa, Mycobacterium
RDDANDWVRLRLAGPGRVQLAE

SEQ ID NO: 1277356 - protein, 31 aa, Mycobacterium
RDDDSGWAGAQWTLRRGRVVLLEGDSPAGLR

SEQ ID NO: 1277357 - protein, 30 aa, Mycobacterium
RDDDWRPQWRVDLIPSYKAHRVAVPAEEAN

SEQ ID NO: 1277358 - protein, 17 aa, Mycobacterium
RDDGMLVCVAQVRPNTA

SEQ ID NO: 1277359 - protein, 21 aa, Mycobacterium
RDDGYCMIVGRIKDMVIRGGE

SEQ ID NO: 1277360 - protein, 23 aa, Mycobacterium
RDDLAAGPMRWTCVEPLKKWRLD

SEQ ID NO: 1277361 - protein, 19 aa, Mycobacterium
RDDLDLVLLTVNYAEGRPE

SEQ ID NO: 1277362 - protein, 20 aa, Mycobacterium
RDDLVAWEFERAGLGSLGDR

SEQ ID NO: 1277363 - protein, 17 aa, Mycobacterium
RDDVTWAADVLELMADD

SEQ ID NO: 1277364 - protein, 22 aa, Mycobacterium
RDDVVLATKFGRPVDDNPNHRG

SEQ ID NO: 1277365 - protein, 18 aa, Mycobacterium
RDDYFWQRDEHMIGVVDT

SEQ ID NO: 1277366 - protein, 22 aa, Mycobacterium
RDEAKEAIIARGGKAAGSVSKK

SEQ ID NO: 1277367 - protein, 18 aa, Mycobacterium
RDECRQAKERLSADTATA

SEQ ID NO: 1277368 - protein, 19 aa, Mycobacterium
RDECRQAKERLSADTATAV

SEQ ID NO: 1277369 - protein, 21 aa, Mycobacterium
RDEFTLFVAMRYLQHDDRYTP

SEQ ID NO: 1277370 - protein, 19 aa, Mycobacterium
RDEILLARNDRYWGTPATP

SEQ ID NO: 1277371 - protein, 18 aa, Mycobacterium
RDEITVWLSEAGSEYTYT

SEQ ID NO: 1277372 - protein, 19 aa, Mycobacterium
RDELGYPWLWSRATNQLMF

SEQ ID NO: 1277373 - protein, 22 aa, Mycobacterium
RDELLPRHVIRAGADAGHQQSP

SEQ ID NO: 1277374 - protein, 26 aa, Mycobacterium
RDELMAGTLEEVWRTDGYCHCMFTAL

SEQ ID NO: 1277375 - protein, 21 aa, Mycobacterium
RDERCISAIAIVHSRFSTNTF

SEQ ID NO: 1277376 - protein, 24 aa, Mycobacterium
RDEVAKAQAALRIEQLEQQVLEQF

SEQ ID NO: 1277377 - protein, 35 aa, Mycobacterium
RDEVVANIAALVRRARAKGVAVVWVQHSDADLVRG

SEQ ID NO: 1277378 - protein, 25 aa, Mycobacterium
RDEYARRLAGWTGWNDEGQVLNRVR

SEQ ID NO: 1277379 - protein, 24 aa, Mycobacterium
RDFAAEAAFVFSMIGVDLSRLAED

SEQ ID NO: 1277380 - protein, 19 aa, Mycobacterium
RDFAIVGGMCPRCEGRGAI

SEQ ID NO: 1277381 - protein, 17 aa, Mycobacterium
RDFARKTLRGSRTPDRI

SEQ ID NO: 1277382 - protein, 24 aa, Mycobacterium
RDFGAESMQGWGMTETSPLCVVGR

SEQ ID NO: 1277383 - protein, 19 aa, Mycobacterium
RDFRRVLAAIAEAERTGAD

SEQ ID NO: 1277384 - protein, 32 aa, Mycobacterium
RDFTVWVLRVRRVRWVGGYGRMDSCSGADYAA

SEQ ID NO: 1277385 - protein, 17 aa, Mycobacterium
RDFVDAAQFSKLLSERG

SEQ ID NO: 1277386 - protein, 23 aa, Mycobacterium
RDFYRAAGKDGLLTLDRHLESEE

SEQ ID NO: 1277387 - protein, 24 aa, Mycobacterium
RDGCVIGGTAWDFANGNRIPRGCL

SEQ ID NO: 1277388 - protein, 18 aa, Mycobacterium
RDGDSWVLRGQKIVSAST

SEQ ID NO: 1277389 - protein, 20 aa, Mycobacterium
RDGELCGLITAYHPPVRPEV

SEQ ID NO: 1277390 - protein, 21 aa, Mycobacterium
RDGELRQALRQAIPDGADVVV

SEQ ID NO: 1277391 - protein, 19 aa, Mycobacterium
RDGFFGRHTIGPVTGALLH

SEQ ID NO: 1277392 - protein, 25 aa, Mycobacterium
RDGFGRLDMSPFFGPGWVRDPDYLT

SEQ ID NO: 1277393 - protein, 25 aa, Mycobacterium
RDGFGRLDMSPFFGPGWVRDPDYMT

SEQ ID NO: 1277394 - protein, 18 aa, Mycobacterium
RDGFSMTFWELADVADDH

SEQ ID NO: 1277395 - protein, 26 aa, Mycobacterium
RDGFVRCGEMLSSLLLDATMAGLATC

SEQ ID NO: 1277396 - protein, 28 aa, Mycobacterium
RDGGCTKPGCAVGAYGCQGHHVEADFAK

SEQ ID NO: 1277397 - protein, 26 aa, Mycobacterium
RDGGCTKPGCTIGAYGCQAHHVDADW

SEQ ID NO: 1277398 - protein, 17 aa, Mycobacterium
RDGKPMRYFPIAAKGST

SEQ ID NO: 1277399 - protein, 19 aa, Mycobacterium
RDGQDFVIDLTVWLDLAPA

SEQ ID NO: 1277400 - protein, 22 aa, Mycobacterium
RDGRAIEVIGRYHPKEEPSVIE

SEQ ID NO: 1277401 - protein, 20 aa, Mycobacterium
RDGSDWVLSGQKVYISGVDQ

SEQ ID NO: 1277402 - protein, 22 aa, Mycobacterium
RDGTAMDCFRALVAAQGGDTTR

SEQ ID NO: 1277403 - protein, 18 aa, Mycobacterium
RDHDFRAHCLRQLHEGLC

SEQ ID NO: 1277404 - protein, 24 aa, Mycobacterium
RDHHAVGTLCVWDNTPRDWTSGHV

SEQ ID NO: 1277405 - protein, 20 aa, Mycobacterium
RDHPEIMQVIALEPGFGVDF

SEQ ID NO: 1277406 - protein, 29 aa, Mycobacterium
RDHSWGVRDWWAMDWVWNALHLDDGTHLH

SEQ ID NO: 1277407 - protein, 23 aa, Mycobacterium
RDHTAAAIDVLWRGQRLRALSAI

SEQ ID NO: 1277408 - protein, 19 aa, Mycobacterium
RDHWSEVFAGTDACVTPVL

SEQ ID NO: 1277409 - protein, 20 aa, Mycobacterium
RDILITLGYDIDRPWHKLPK

SEQ ID NO: 1277410 - protein, 17 aa, Mycobacterium
RDIPAADLFTGLWETSL

SEQ ID NO: 1277411 - protein, 17 aa, Mycobacterium
RDIPVAPDITGLLCSGV

SEQ ID NO: 1277412 - protein, 18 aa, Mycobacterium
RDIRRADCQFLITDDAHR

SEQ ID NO: 1277413 - protein, 25 aa, Mycobacterium
RDISAKKSEPEWMLDIRLKALRTFD

SEQ ID NO: 1277414 - protein, 17 aa, Mycobacterium
RDISQLLGYGAIDAERI

SEQ ID NO: 1277415 - protein, 18 aa, Mycobacterium
RDKAGMIIANLAASTPDG

SEQ ID NO: 1277416 - protein, 25 aa, Mycobacterium
RDKEFYDRLEAAGFELDWGADGSGL

SEQ ID NO: 1277417 - protein, 27 aa, Mycobacterium
RDKGCTHPGCTVPFYWTEAHHAHDYSR

SEQ ID NO: 1277418 - protein, 28 aa, Mycobacterium
RDKGCTHPQCTVPFYWTEVHHTHDYSQG

SEQ ID NO: 1277419 - protein, 20 aa, Mycobacterium
RDKRSLVFPVKRLADLGFRV

SEQ ID NO: 1277420 - protein, 21 aa, Mycobacterium
RDKTGVIVLLTFGTGIGSAVI

SEQ ID NO: 1277421 - protein, 18 aa, Mycobacterium
RDLARLMTPFAERYGVID

SEQ ID NO: 1277422 - protein, 19 aa, Mycobacterium
RDLDALIVVSSMWVDGASA

SEQ ID NO: 1277423 - protein, 18 aa, Mycobacterium
RDLDCETVVIVTDAASDE

SEQ ID NO: 1277424 - protein, 24 aa, Mycobacterium
RDLDFVLVVGHLFTLVVYGQLILE

SEQ ID NO: 1277425 - protein, 28 aa, Mycobacterium
RDLDRFARRFGVVVVDGFGSTEGGVAIA

SEQ ID NO: 1277426 - protein, 25 aa, Mycobacterium
RDLDWRMRHSLTDMVASAWSALPSR

SEQ ID NO: 1277427 - protein, 18 aa, Mycobacterium
RDLFCRYPGCDVPAEHCD

SEQ ID NO: 1277428 - protein, 26 aa, Mycobacterium
RDLGHPIEVWGWDEAYVGARVADPLA

SEQ ID NO: 1277429 - protein, 21 aa, Mycobacterium
RDLKLRFLSWGAAPASDTLLR

SEQ ID NO: 1277430 - protein, 20 aa, Mycobacterium
RDLLPPQLHRLDGIELAGGY

SEQ ID NO: 1277431 - protein, 25 aa, Mycobacterium
RDLLRPGEDDLFWLGTEEAMAQGRA

SEQ ID NO: 1277432 - protein, 19 aa, Mycobacterium
RDLLVSRLVELGREQTVVT

SEQ ID NO: 1277433 - protein, 17 aa, Mycobacterium
RDLMVIDAIAGLGEALV

SEQ ID NO: 1277434 - protein, 24 aa, Mycobacterium
RDLPRLADSLADVLPRRPTFALLK

SEQ ID NO: 1277435 - protein, 24 aa, Mycobacterium
RDLQAASLWIGWGEPAEAPLDEEE

SEQ ID NO: 1277436 - protein, 18 aa, Mycobacterium
RDLREGRLSLDQLGVIAE

SEQ ID NO: 1277437 - protein, 19 aa, Mycobacterium
RDLREGRLSLDQVGVIAER

SEQ ID NO: 1277438 - protein, 17 aa, Mycobacterium
RDLWLGDRVDFEGEYYK

SEQ ID NO: 1277439 - protein, 17 aa, Mycobacterium
RDMDLGALIAHVGGLAL

SEQ ID NO: 1277440 - protein, 18 aa, Mycobacterium
RDMGMVFQAYSLFPHLTV

SEQ ID NO: 1277441 - protein, 25 aa, Mycobacterium
RDMLLKWSDDLVCGLSSTVDEQTIQ

SEQ ID NO: 1277442 - protein, 18 aa, Mycobacterium
RDNGWAMHVPRRLKDLHV

SEQ ID NO: 1277443 - protein, 17 aa, Mycobacterium
RDNISAFGGDPGRVTVF

SEQ ID NO: 1277444 - protein, 24 aa, Mycobacterium
RDNMALRLEDCVQRGHHFAIVDEV

SEQ ID NO: 1277445 - protein, 25 aa, Mycobacterium
RDNRAVHALARIMLHGRISHIQTSW

SEQ ID NO: 1277446 - protein, 20 aa, Mycobacterium
RDPACTWTFYATTPGQQSCA

SEQ ID NO: 1277447 - protein, 24 aa, Mycobacterium
RDPAKRLSVVTSIGSRAWDRLFSG

SEQ ID NO: 1277448 - protein, 23 aa, Mycobacterium
RDPARLTEFGWYKDVSTVTLDAH

SEQ ID NO: 1277449 - protein, 23 aa, Mycobacterium
RDPASVRVWSCFATVGDHLPEEL

SEQ ID NO: 1277450 - protein, 23 aa, Mycobacterium
RDPATWRAALAGIESYAPLMAYL

SEQ ID NO: 1277451 - protein, 22 aa, Mycobacterium
RDPGRARILLAQHVGSSPLQDR

SEQ ID NO: 1277452 - protein, 20 aa, Mycobacterium
RDPMAMLPFLGYNVGDYFQH

SEQ ID NO: 1277453 - protein, 20 aa, Mycobacterium
RDPRGWVLSVAHVDVVQPAR

SEQ ID NO: 1277454 - protein, 17 aa, Mycobacterium
RDPWLALANARRLARDG

SEQ ID NO: 1277455 - protein, 22 aa, Mycobacterium
RDQLRRHCPDIEFLHLEGSVET

SEQ ID NO: 1277456 - protein, 27 aa, Mycobacterium
RDQLRRYRAQSGFVFQSHNLFPHKTVL

SEQ ID NO: 1277457 - protein, 23 aa, Mycobacterium
RDQWPRILAAWPALQRWRIVPPL

SEQ ID NO: 1277458 - protein, 18 aa, Mycobacterium
RDQYVWTFGGAEPVMEVA

SEQ ID NO: 1277459 - protein, 27 aa, Mycobacterium
RDRALHPTMWIRMWFTDGEKLHQRGYT

SEQ ID NO: 1277460 - protein, 19 aa, Mycobacterium
RDRDPAWAFNIRAHPEASV

SEQ ID NO: 1277461 - protein, 18 aa, Mycobacterium
RDREIFDVLVTYHRDAAD

SEQ ID NO: 1277462 - protein, 22 aa, Mycobacterium
RDRGPSQWLLRMLATQTERTML

SEQ ID NO: 1277463 - protein, 20 aa, Mycobacterium
RDRGTGIVGWSLRGLPERSA

SEQ ID NO: 1277464 - protein, 17 aa, Mycobacterium
RDRGVLVASDECYLGLA

SEQ ID NO: 1277465 - protein, 17 aa, Mycobacterium
RDRGVLVASDECYLGLG

SEQ ID NO: 1277466 - protein, 23 aa, Mycobacterium
RDRHAVAAIRACVVDLPTALLLR

SEQ ID NO: 1277467 - protein, 23 aa, Mycobacterium
RDRIDRLTALMLDNADAIVDAMA

SEQ ID NO: 1277468 - protein, 18 aa, Mycobacterium
RDRILAVFDAQAKYCTDP

SEQ ID NO: 1277469 - protein, 27 aa, Mycobacterium
RDRILECARELFARNGITNTSIRSIAA

SEQ ID NO: 1277470 - protein, 20 aa, Mycobacterium
RDRITLISACIAENVDRQDF

SEQ ID NO: 1277471 - protein, 19 aa, Mycobacterium
RDRLDEAQCLLRDTEGVTA

SEQ ID NO: 1277472 - protein, 24 aa, Mycobacterium
RDRLPRLQRLAVYTGDALGELEAA

SEQ ID NO: 1277473 - protein, 17 aa, Mycobacterium
RDRLVVVTLADVASRVQ

SEQ ID NO: 1277474 - protein, 17 aa, Mycobacterium
RDRMRAHRAHGLPDREK

SEQ ID NO: 1277475 - protein, 21 aa, Mycobacterium
RDRPGQFGFVGANGGIMSKYS

SEQ ID NO: 1277476 - protein, 19 aa, Mycobacterium
RDRRAVIAHCQLVDRDDLD

SEQ ID NO: 1277477 - protein, 33 aa, Mycobacterium
RDRRYLAVPVFPSRHFRLSCIFVGAHSPAVTPS

SEQ ID NO: 1277478 - protein, 24 aa, Mycobacterium
RDRVAELLAVVGLRREDAGRYPAE

SEQ ID NO: 1277479 - protein, 17 aa, Mycobacterium
RDRVPLVMLLEGAGFRP

SEQ ID NO: 1277480 - protein, 18 aa, Mycobacterium
RDRWFPGLASGTVLTAIA

SEQ ID NO: 1277481 - protein, 17 aa, Mycobacterium
RDSAWKAKRAALETLYL

SEQ ID NO: 1277482 - protein, 17 aa, Mycobacterium
RDSCPGMSIGDAATVVE

SEQ ID NO: 1277483 - protein, 24 aa, Mycobacterium
RDSMELRLPSPVGADLTWRETHGE

SEQ ID NO: 1277484 - protein, 17 aa, Mycobacterium
RDSMKLPPQLVGRPADG

SEQ ID NO: 1277485 - protein, 25 aa, Mycobacterium
RDSRRGRGIALMRALMHDVEIDIGR

SEQ ID NO: 1277486 - protein, 23 aa, Mycobacterium
RDSVLRKAPWVDVVFGTHNIGSL

SEQ ID NO: 1277487 - protein, 19 aa, Mycobacterium
RDSWPEFFEFIRSGAVLQL

SEQ ID NO: 1277488 - protein, 17 aa, Mycobacterium
RDTEIDTVLGLTVGADD

SEQ ID NO: 1277489 - protein, 17 aa, Mycobacterium
RDTLIATRDRTGLRFDI

SEQ ID NO: 1277490 - protein, 18 aa, Mycobacterium
RDTMLALFAERGGDPDRP

SEQ ID NO: 1277491 - protein, 17 aa, Mycobacterium
RDTMPKWAKQLIQHKDP

SEQ ID NO: 1277492 - protein, 25 aa, Mycobacterium
RDTPEGIKVFLMRRHSAMDFVAGVM

SEQ ID NO: 1277493 - protein, 17 aa, Mycobacterium
RDTPYSGVAAIFRSALE

SEQ ID NO: 1277494 - protein, 24 aa, Mycobacterium
RDTTSAEMLWEWEAMARDMAWDYP

SEQ ID NO: 1277495 - protein, 18 aa, Mycobacterium
RDTVPVGIRLPMTAGSGA

SEQ ID NO: 1277496 - protein, 19 aa, Mycobacterium
RDTVWAFAEGFGYAYERTV

SEQ ID NO: 1277497 - protein, 24 aa, Mycobacterium
RDTWPPTRHRSVMQPASQRVGQHA

SEQ ID NO: 1277498 - protein, 23 aa, Mycobacterium
RDVAEILCLPYFLGEKSPLHDPD

SEQ ID NO: 1277499 - protein, 18 aa, Mycobacterium
RDVDVIVGHVVFDYDTSR

SEQ ID NO: 1277500 - protein, 19 aa, Mycobacterium
RDVFKQMGALGMLGMAIPE

SEQ ID NO: 1277501 - protein, 18 aa, Mycobacterium
RDVIDARLAFLVSGGTGA

SEQ ID NO: 1277502 - protein, 24 aa, Mycobacterium
RDVNARFKSLVSEWQLKGGEPNTH

SEQ ID NO: 1277503 - protein, 21 aa, Mycobacterium
RDVPAHRLLRDRAAVGRLRDR

SEQ ID NO: 1277504 - protein, 19 aa, Mycobacterium
RDVPFNYSLGEDVEPMESL

SEQ ID NO: 1277505 - protein, 17 aa, Mycobacterium
RDVPQNHSLLFALGSGS

SEQ ID NO: 1277506 - protein, 19 aa, Mycobacterium
RDVSLRDGLQIEDPIPLSA

SEQ ID NO: 1277507 - protein, 25 aa, Mycobacterium
RDVVTAAGFTRFRVAAQTPFNHVFQ

SEQ ID NO: 1277508 - protein, 18 aa, Mycobacterium
RDVVVCAAGSMPGDLHKL

SEQ ID NO: 1277509 - protein, 20 aa, Mycobacterium
RDVWRLRRLGVTGVPGGWRL

SEQ ID NO: 1277510 - protein, 21 aa, Mycobacterium
RDYFRLGARQVKPAIADLLAA

SEQ ID NO: 1277511 - protein, 18 aa, Mycobacterium
RDYLGTKIEFRLGDVNET

SEQ ID NO: 1277512 - protein, 18 aa, Mycobacterium
RDYLSFLPGNAFDDAPIV

SEQ ID NO: 1277513 - protein, 19 aa, Mycobacterium
RDYWLARLAAYGGDSMSLD

SEQ ID NO: 1277514 - protein, 24 aa, Mycobacterium
REAAAPFSAFVFKVQAGMDSAHRD

SEQ ID NO: 1277515 - protein, 22 aa, Mycobacterium
REAAGDFLAAYTWHMQAGDWLA

SEQ ID NO: 1277516 - protein, 17 aa, Mycobacterium
REAAGLPPAAANVAAAS

SEQ ID NO: 1277517 - protein, 17 aa, Mycobacterium
REAANFVTRDEINAENL

SEQ ID NO: 1277518 - protein, 22 aa, Mycobacterium
REAAQAKATRWCNGGDAMSTQL

SEQ ID NO: 1277519 - protein, 22 aa, Mycobacterium
REAEAYDGPSLVIAYSQCIAHG

SEQ ID NO: 1277520 - protein, 17 aa, Mycobacterium
REAEAYNGPSIVIAYSH

SEQ ID NO: 1277521 - protein, 18 aa, Mycobacterium
REAFCSGPSELLDDMIEH

SEQ ID NO: 1277522 - protein, 20 aa, Mycobacterium
REAGRGGGCLTAVYNAANEE

SEQ ID NO: 1277523 - protein, 22 aa, Mycobacterium
REAHCYPLLQFRETVQDLGLLR

SEQ ID NO: 1277524 - protein, 18 aa, Mycobacterium
REAISEVPQDRWNVDEFF

SEQ ID NO: 1277525 - protein, 17 aa, Mycobacterium
REAISRLELFSTDRRLV

SEQ ID NO: 1277526 - protein, 20 aa, Mycobacterium
REALCGHTVIYLEISAAEGV

SEQ ID NO: 1277527 - protein, 24 aa, Mycobacterium
REALKSALQYPALAGPVFDALTVD

SEQ ID NO: 1277528 - protein, 24 aa, Mycobacterium
REALKSALQYPALAGPVFDSLAAE

SEQ ID NO: 1277529 - protein, 19 aa, Mycobacterium
REALLLGSSYVIVWADRFG

SEQ ID NO: 1277530 - protein, 19 aa, Mycobacterium
REALPLGGIDMTVRRNAFG

SEQ ID NO: 1277531 - protein, 19 aa, Mycobacterium
REALVPISPEMAAAINEQA

SEQ ID NO: 1277532 - protein, 21 aa, Mycobacterium
REANIRWGFDRGHRHPYGVDF

SEQ ID NO: 1277533 - protein, 19 aa, Mycobacterium
REANRYPALLDRINAEIAP

SEQ ID NO: 1277534 - protein, 22 aa, Mycobacterium
REARKPGSYFWLKGGKRQQKLA

SEQ ID NO: 1277535 - protein, 17 aa, Mycobacterium
REARLQRPLYVMPTRGI

SEQ ID NO: 1277536 - protein, 23 aa, Mycobacterium
REARLRRLPVLLLGRQPRHGDGG

SEQ ID NO: 1277537 - protein, 32 aa, Mycobacterium; identical to SEQ ID NO: 719240

SEQ ID NO: 1277538 - protein, 22 aa, Mycobacterium
REAWNTLVLPWFRGINSVVGVQ

SEQ ID NO: 1277539 - protein, 19 aa, Mycobacterium
REDFVSFAPISSVDTLITD

SEQ ID NO: 1277540 - protein, 17 aa, Mycobacterium
REDFYKFALELNVGGAR

SEQ ID NO: 1277541 - protein, 25 aa, Mycobacterium
REDGCPPGSIGKGFPGVAIYDAETL

SEQ ID NO: 1277542 - protein, 22 aa, Mycobacterium
REDGSFVYEVDWMTGEESADDN

SEQ ID NO: 1277543 - protein, 19 aa, Mycobacterium
REDQDHWGVRSQNRAEEAI

SEQ ID NO: 1277544 - protein, 26 aa, Mycobacterium
REDQEVWRYFASVAFPSESMVRNVIG

SEQ ID NO: 1277545 - protein, 17 aa, Mycobacterium
REECATLRALVGAADPD

SEQ ID NO: 1277546 - protein, 24 aa, Mycobacterium
REEFGHWLDAHFALDPVRSSDLIL

SEQ ID NO: 1277547 - protein, 25 aa, Mycobacterium
REEHYGVTMVTGWQEAVDVYNDAES

SEQ ID NO: 1277548 - protein, 28 aa, Mycobacterium
REELAEVCGHIASTLLDRTKPLWEMWVI

SEQ ID NO: 1277549 - protein, 19 aa, Mycobacterium
REERWCWLEDGRVRGDIEV

SEQ ID NO: 1277550 - protein, 18 aa, Mycobacterium
REEVSPFGIRVLAVEPGA

SEQ ID NO: 1277551 - protein, 20 aa, Mycobacterium
REFADPISYVSLWTSDAGES

SEQ ID NO: 1277552 - protein, 25 aa, Mycobacterium
REFAVGELPPALPTDHPRTGRSRRA

SEQ ID NO: 1277553 - protein, 21 aa, Mycobacterium
REFDTLLVMSVEPGFGGQKFI

SEQ ID NO: 1277554 - protein, 17 aa, Mycobacterium
REFLMKDSYSFDIDDDG

SEQ ID NO: 1277555 - protein, 21 aa, Mycobacterium
REFNPQLRLIGVDTVGSTIFG

SEQ ID NO: 1277556 - protein, 21 aa, Mycobacterium
REFTEARVLLLGATFTNEYSI

SEQ ID NO: 1277557 - protein, 24 aa, Mycobacterium
REFVLALRAIWMSWSDGSRLEFDG

SEQ ID NO: 1277558 - protein, 26 aa, Mycobacterium
REFVSRFSGAPVHMLINNAGVMALPE

SEQ ID NO: 1277559 - protein, 24 aa, Mycobacterium
REGDCGTCQCVLIDGKVEMDTHGA

SEQ ID NO: 1277560 - protein, 20 aa, Mycobacterium
REGDFLFPAPAPRFSRTTTT

SEQ ID NO: 1277561 - protein, 26 aa, Mycobacterium
REGDGQWRLGPALTELAGHVNDPLLA

SEQ ID NO: 1277562 - protein, 22 aa, Mycobacterium
REGEFWDWPAVTLKAEDMNAEA

SEQ ID NO: 1277563 - protein, 22 aa, Mycobacterium
REGEPCRRCGAIMRREKFMNRS

SEQ ID NO: 1277564 - protein, 24 aa, Mycobacterium
REGHSLDDFATWCALAEHHGADWR

SEQ ID NO: 1277565 - protein, 18 aa, Mycobacterium
REGITLGSWDEMVAHAAT

SEQ ID NO: 1277566 - protein, 21 aa, Mycobacterium
REGNCGSCAATVIDGQVDLGN

SEQ ID NO: 1277567 - protein, 21 aa, Mycobacterium
REGVNLTYLPFIARAVIDALK

SEQ ID NO: 1277568 - protein, 26 aa, Mycobacterium
REHDILAFERQWWKYAGSKEDAIKEL

SEQ ID NO: 1277569 - protein, 19 aa, Mycobacterium
REHHELYGLLSGIASARAA

SEQ ID NO: 1277570 - protein, 19 aa, Mycobacterium
REHLGYIAINARTNAGRNP

SEQ ID NO: 1277571 - protein, 20 aa, Mycobacterium
REHPCRVIVTLSGDRDAAQS

SEQ ID NO: 1277572 - protein, 20 aa, Mycobacterium
REHPQYGAIIARLRAAGRDD

SEQ ID NO: 1277573 - protein, 21 aa, Mycobacterium
REIAAELVALYAKRQASAGHA

SEQ ID NO: 1277574 - protein, 17 aa, Mycobacterium
REIAEKSAAQGISVIDA

SEQ ID NO: 1277575 - protein, 20 aa, Mycobacterium
REICDRHGIVFIADEVMAGF

SEQ ID NO: 1277576 - protein, 23 aa, Mycobacterium
REIKLGSGGLRDVEFAVQLLQLV

SEQ ID NO: 1277577 - protein, 22 aa, Mycobacterium
REILDRLPPRPVLVGASLGGIT

SEQ ID NO: 1277578 - protein, 23 aa, Mycobacterium
REIQARGAVTIVIAEEGDDTVRP

SEQ ID NO: 1277579 - protein, 27 aa, Mycobacterium
REISVALIARSAWHECHHHLGDIRRLG

SEQ ID NO: 1277580 - protein, 20 aa, Mycobacterium
REIVEDPALIPVAMEELLRL

SEQ ID NO: 1277581 - protein, 24 aa, Mycobacterium
REIVSALLAPLGMEHSVLYRRGVP

SEQ ID NO: 1277582 - protein, 20 aa, Mycobacterium
RELAALDVAAPVVFDAAQFP

SEQ ID NO: 1277583 - protein, 19 aa, Mycobacterium
RELAALLVCLLLSKMSSDT

SEQ ID NO: 1277584 - protein, 21 aa, Mycobacterium
RELAARTPLGVALSGEDHAWS

SEQ ID NO: 1277585 - protein, 22 aa, Mycobacterium
RELAEAVYWCLENYEADEEATL

SEQ ID NO: 1277586 - protein, 25 aa, Mycobacterium
RELALCQLVGPLAFARMTGIRTITH

SEQ ID NO: 1277587 - protein, 22 aa, Mycobacterium
RELAPAMAWPVVAGAYIALAQR

SEQ ID NO: 1277588 - protein, 23 aa, Mycobacterium
RELDGYGWLRRAHELEDAAGRVR

SEQ ID NO: 1277589 - protein, 19 aa, Mycobacterium
RELDHWAGEMARVQRGPLP

SEQ ID NO: 1277590 - protein, 19 aa, Mycobacterium
RELDLAVTVAERGPAPLVG

SEQ ID NO: 1277591 - protein, 17 aa, Mycobacterium
RELDRGWDRFGTDLPSL

SEQ ID NO: 1277592 - protein, 17 aa, Mycobacterium
RELEAFAAFASDLDAAS

SEQ ID NO: 1277593 - protein, 19 aa, Mycobacterium
RELEPLAGDMVREVLARLQ

SEQ ID NO: 1277594 - protein, 22 aa, Mycobacterium
RELEVRFGLTEVVIAGHGVDIS

SEQ ID NO: 1277595 - protein, 19 aa, Mycobacterium
RELFIRDGYELTSVDAIAA

SEQ ID NO: 1277596 - protein, 20 aa, Mycobacterium
RELFMAMGVDLFTNLMEIRE

SEQ ID NO: 1277597 - protein, 24 aa, Mycobacterium
RELGASFAEFGGWLMPVSYAGTVA

SEQ ID NO: 1277598 - protein, 20 aa, Mycobacterium
RELGAVAGRTVCAVVGSGDN

SEQ ID NO: 1277599 - protein, 18 aa, Mycobacterium
RELGEKNNRLWRMNLSYM

SEQ ID NO: 1277600 - protein, 18 aa, Mycobacterium
RELGRIGFEEYLQVKSLQ

SEQ ID NO: 1277601 - protein, 21 aa, Mycobacterium
RELHAQLGIATEAWSPLGQGS

SEQ ID NO: 1277602 - protein, 20 aa, Mycobacterium
RELHGGRILAPNDYVITLSV

SEQ ID NO: 1277603 - protein, 17 aa, Mycobacterium
RELHRKAAEVGLLGAGF

SEQ ID NO: 1277604 - protein, 24 aa, Mycobacterium
RELHSRYEVRLEQYALTIAVEAKL

SEQ ID NO: 1277605 - protein, 32 aa, Mycobacterium
RELIAELDWIFATRPLAEWAEIFAAEPDLFWS

SEQ ID NO: 1277606 - protein, 21 aa, Mycobacterium
RELIDRHPPMLGNLNGIPAEV

SEQ ID NO: 1277607 - protein, 20 aa, Mycobacterium
RELIRVCTIAPGLFKTPLLG

SEQ ID NO: 1277608 - protein, 17 aa, Mycobacterium
RELLALFDVALASRHLD

SEQ ID NO: 1277609 - protein, 19 aa, Mycobacterium
RELLDSAGPFASIEVAQEA

SEQ ID NO: 1277610 - protein, 17 aa, Mycobacterium
RELLLLAALKNGMAQRD

SEQ ID NO: 1277611 - protein, 17 aa, Mycobacterium
RELPHLAPVDAPSILMP

SEQ ID NO: 1277612 - protein, 26 aa, Mycobacterium
RELQHVFGRSWLFLAHDSQLPKPGSF

SEQ ID NO: 1277613 - protein, 24 aa, Mycobacterium
RELQIRGSEHFSRVVQPWSCTAAP

SEQ ID NO: 1277614 - protein, 18 aa, Mycobacterium
RELQPMWHAAVATDAVQT

SEQ ID NO: 1277615 - protein, 25 aa, Mycobacterium
RELRSELMAGFTDLVLREARLHLDI

SEQ ID NO: 1277616 - protein, 17 aa, Mycobacterium
RELSGFIARNTRAKTTA

SEQ ID NO: 1277617 - protein, 19 aa, Mycobacterium
RELSPELTTGVPLSYGSAF

SEQ ID NO: 1277618 - protein, 25 aa, Mycobacterium
RELSRYGLGVLRAWIRHGTIYGKAK

SEQ ID NO: 1277619 - protein, 19 aa, Mycobacterium
RELTEAQRARGIQQMLDAG

SEQ ID NO: 1277620 - protein, 23 aa, Mycobacterium
RELVAAGAPGWDVSAEELEQTLI

SEQ ID NO: 1277621 - protein, 17 aa, Mycobacterium
RELVARIRAMLRRPRIL

SEQ ID NO: 1277622 - protein, 19 aa, Mycobacterium
RELVARIRAMLRRPRVLHT

SEQ ID NO: 1277623 - protein, 22 aa, Mycobacterium
RELVVDPELLRHIAHRREADRL

SEQ ID NO: 1277624 - protein, 19 aa, Mycobacterium
RELYRIDGGHLLFVATDRI

SEQ ID NO: 1277625 - protein, 17 aa, Mycobacterium
REMGRAGLEEFLESKTY

SEQ ID NO: 1277626 - protein, 24 aa, Mycobacterium
REMNMRWESLIAALRNSAPDFTNI

SEQ ID NO: 1277627 - protein, 21 aa, Mycobacterium
REMPKVLAAFDSNWGDARTNL

SEQ ID NO: 1277628 - protein, 19 aa, Mycobacterium
RENIRMIGGLYGIRRKDLD

SEQ ID NO: 1277629 - protein, 20 aa, Mycobacterium
REPIHPVLLDLCTGIAGAAL

SEQ ID NO: 1277630 - protein, 20 aa, Mycobacterium
REPKELVICDLGMPRDVDPA

SEQ ID NO: 1277631 - protein, 17 aa, Mycobacterium
REPNALIGVDVDPDAFF

SEQ ID NO: 1277632 - protein, 22 aa, Mycobacterium
REPRPYPELVLAQRDSLFDYIY

SEQ ID NO: 1277633 - protein, 22 aa, Mycobacterium
REPRRGSSPATRMGMMPVTAAG

SEQ ID NO: 1277634 - protein, 26 aa, Mycobacterium
REPYQPVGWLMLRRILPPDTVTPDDV

SEQ ID NO: 1277635 - protein, 24 aa, Mycobacterium
REQALRFGADLRMEDVDAVDLTGP

SEQ ID NO: 1277636 - protein, 24 aa, Mycobacterium
REQFSMSICGRVVDELEAKPPRPF

SEQ ID NO: 1277637 - protein, 19 aa, Mycobacterium
REQHLELPPPGTPVTAPVD

SEQ ID NO: 1277638 - protein, 26 aa, Mycobacterium
REQLPGLWLLASLYFRADVRGLDRIP

SEQ ID NO: 1277639 - protein, 22 aa, Mycobacterium
REQLTLASGMFTRFGAAAFAER

SEQ ID NO: 1277640 - protein, 18 aa, Mycobacterium
REQVVRIVERFGGHVCST

SEQ ID NO: 1277641 - protein, 21 aa, Mycobacterium
REQWGGPFLLKGTVRVDDAKR

SEQ ID NO: 1277642 - protein, 19 aa, Mycobacterium
RERAEELGVPLGPYNVVNA

SEQ ID NO: 1277643 - protein, 19 aa, Mycobacterium
RERARVGGALVTEIYSVGP

SEQ ID NO: 1277644 - protein, 19 aa, Mycobacterium
RERCGLTGTHLGCEHGACG

SEQ ID NO: 1277645 - protein, 19 aa, Mycobacterium
REREIAELVAAGLSNRHIA

SEQ ID NO: 1277646 - protein, 18 aa, Mycobacterium
REREVLALLASGATNAQL

SEQ ID NO: 1277647 - protein, 20 aa, Mycobacterium
RERGLHPAAVIGHSVGEVAA

SEQ ID NO: 1277648 - protein, 25 aa, Mycobacterium
RERHGFPHWVIWDEAHLLGRQREER

SEQ ID NO: 1277649 - protein, 19 aa, Mycobacterium
RERHPAWRLLRAGNAALVL

SEQ ID NO: 1277650 - protein, 18 aa, Mycobacterium
RERILALLDEGSFVELDA

SEQ ID NO: 1277651 - protein, 24 aa, Mycobacterium
RERIPISIASLGPRMVELTAELAD

SEQ ID NO: 1277652 - protein, 25 aa, Mycobacterium
RERIPISIASLGPRMVELTAELADA

SEQ ID NO: 1277653 - protein, 18 aa, Mycobacterium
RERIPWRAERRQMYDRVL

SEQ ID NO: 1277654 - protein, 20 aa, Mycobacterium
RERKAAFLPPYVISGQGLAV

SEQ ID NO: 1277655 - protein, 27 aa, Mycobacterium
RERLASVAEHYLHFGGVSPINGINRAL

SEQ ID NO: 1277656 - protein, 27 aa, Mycobacterium
RERLHAGPILGAFEAWLVLRSLGSAGL

SEQ ID NO: 1277657 - protein, 20 aa, Mycobacterium
RERLLAAAEACYAERGPTST

SEQ ID NO: 1277658 - protein, 23 aa, Mycobacterium
RERLRDWRFYDGFRADSHAPARM

SEQ ID NO: 1277659 - protein, 24 aa, Mycobacterium
RERMAFRSAGYWDVTAELDASVSD

SEQ ID NO: 1277660 - protein, 31 aa, Mycobacterium
RERPATAVDEIVRWATPVTSFQRTALRDYEL

SEQ ID NO: 1277661 - protein, 34 aa, Mycobacterium
RERPETAIDEIIRWATPVHCFQRTALEDVEVGGV

SEQ ID NO: 1277662 - protein, 17 aa, Mycobacterium
RERRTAKELTRIENQLT

SEQ ID NO: 1277663 - protein, 19 aa, Mycobacterium
RERSCPRLTDSIRHAVAEG

SEQ ID NO: 1277664 - protein, 19 aa, Mycobacterium
RERSLIGAWCFADHYGPHD

SEQ ID NO: 1277665 - protein, 27 aa, Mycobacterium
RERSSAPLLLWIHGGPLASWNAWHWRW

SEQ ID NO: 1277666 - protein, 28 aa, Mycobacterium
RERTRARLEEILQWPPGTIARLRRGEPL

SEQ ID NO: 1277667 - protein, 25 aa, Mycobacterium
RESLRTLGLRKIRQSVVREDNAQTR

SEQ ID NO: 1277668 - protein, 38 aa, Mycobacterium
RESPMLQALCEEWARRGWLAVRYNLPYRRRRPKGPPSG

SEQ ID NO: 1277669 - protein, 23 aa, Mycobacterium
RESRLRLLLVDTWLDPVRTQIKV

SEQ ID NO: 1277670 - protein, 17 aa, Mycobacterium
RETFPGGRMGRLDIDGY

SEQ ID NO: 1277671 - protein, 22 aa, Mycobacterium
RETGCTPYAVLLAVFGTLIHRY

SEQ ID NO: 1277672 - protein, 20 aa, Mycobacterium
RETGLLERWREDVAIVGQSR

SEQ ID NO: 1277673 - protein, 20 aa, Mycobacterium
RETGLLERWREDVAVVGQSA

SEQ ID NO: 1277674 - protein, 20 aa, Mycobacterium
RETLARYAGLILEYEGVTVK

SEQ ID NO: 1277675 - protein, 17 aa, Mycobacterium
RETLLIGLLTGGHILLE

SEQ ID NO: 1277676 - protein, 21 aa, Mycobacterium
RETRSGGTVMWIGTEETREHA

SEQ ID NO: 1277677 - protein, 18 aa, Mycobacterium
RETTLEKMAGLKTLVDGG

SEQ ID NO: 1277678 - protein, 22 aa, Mycobacterium
REVAEGNAALILDLSEVNFMAF

SEQ ID NO: 1277679 - protein, 17 aa, Mycobacterium
REVARLMSPSLPNRLNV

SEQ ID NO: 1277680 - protein, 18 aa, Mycobacterium
REVDALVVATGFHVTDSP

SEQ ID NO: 1277681 - protein, 17 aa, Mycobacterium
REVDDAFLIDAGKDALF

SEQ ID NO: 1277682 - protein, 22 aa, Mycobacterium
REVDELIGPDVKREWITNLPSY

SEQ ID NO: 1277683 - protein, 21 aa, Mycobacterium
REVDEPILVGWSYGALIAVQW

SEQ ID NO: 1277684 - protein, 22 aa, Mycobacterium
REVDEPILVGWSYGALIAVQWA

SEQ ID NO: 1277685 - protein, 19 aa, Mycobacterium
REVGIDWLRSYLALPNYAN

SEQ ID NO: 1277686 - protein, 21 aa, Mycobacterium
REVIDALGTLLAETDRIRYLT

SEQ ID NO: 1277687 - protein, 17 aa, Mycobacterium
REVINGRDFRIGAHEDP

SEQ ID NO: 1277688 - protein, 24 aa, Mycobacterium
REVKDRAALRELLKDRGVDPVDWR

SEQ ID NO: 1277689 - protein, 26 aa, Mycobacterium
REVLARRFEPVLFFHPDEAFFPSDAK

SEQ ID NO: 1277690 - protein, 26 aa, Mycobacterium
REVLEDHGLVAWPKTSGSRGFHIYAR

SEQ ID NO: 1277691 - protein, 25 aa, Mycobacterium
REVLELRLQLPTPEKAAASEAALIA

SEQ ID NO: 1277692 - protein, 20 aa, Mycobacterium
REVLTGMGLDVSRLTDDQMV

SEQ ID NO: 1277693 - protein, 20 aa, Mycobacterium
REVRSLVGPGWPDGSGGAPA

SEQ ID NO: 1277694 - protein, 19 aa, Mycobacterium
REVSLGALQVWQALTERVS

SEQ ID NO: 1277695 - protein, 18 aa, Mycobacterium
REVTGFVVEGMPAMMSGM

SEQ ID NO: 1277696 - protein, 32 aa, Mycobacterium
REWLARAESFGDRFGIIAAQWTYATLLLQAGS

SEQ ID NO: 1277697 - protein, 18 aa, Mycobacterium
REWYRLRNPMTVLREARE

SEQ ID NO: 1277698 - protein, 22 aa, Mycobacterium
REWYRLRNPMTVLREAREYVVE

SEQ ID NO: 1277699 - protein, 17 aa, Mycobacterium
REYRFDAVPGQRDHSWG

SEQ ID NO: 1277700 - protein, 24 aa, Mycobacterium
REYRRKVQLCLDVFETMLAQSSFD

SEQ ID NO: 1277701 - protein, 20 aa, Mycobacterium
REYRVPVLSGLPSSSFVAEG

SEQ ID NO: 1277702 - protein, 20 aa, Mycobacterium
REYRVVAALADTAVPVARAV

SEQ ID NO: 1277703 - protein, 22 aa, Mycobacterium
RFAAALDGYGERPCIEYDGRWY

SEQ ID NO: 1277704 - protein, 19 aa, Mycobacterium
RFAAEGMRLYGTLVGGHDT

SEQ ID NO: 1277705 - protein, 20 aa, Mycobacterium
RFADEFNIPFVPLDTLTEQY

SEQ ID NO: 1277706 - protein, 27 aa, Mycobacterium
RFADTHARVGLMPTWGLSVRLPQKVGV

SEQ ID NO: 1277707 - protein, 20 aa, Mycobacterium
RFAEKGWYFAGDGARYGTDG

SEQ ID NO: 1277708 - protein, 20 aa, Mycobacterium
RFAEQGWYFAGDGARYDADG

SEQ ID NO: 1277709 - protein, 24 aa, Mycobacterium
RFAERFGVTVVDGFGSSEGGVSIA

SEQ ID NO: 1277710 - protein, 19 aa, Mycobacterium
RFAGPATFARLPRIDEVTR

SEQ ID NO: 1277711 - protein, 18 aa, Mycobacterium
RFAKAAIDKLDFDWRELE

SEQ ID NO: 1277712 - protein, 19 aa, Mycobacterium
RFARHPKCPRCRGNRTRKV

SEQ ID NO: 1277713 - protein, 20 aa, Mycobacterium
RFATDFPLSDCTPARVLELR

SEQ ID NO: 1277714 - protein, 21 aa, Mycobacterium
RFCSARRGGLLTVEHDLTPDE

SEQ ID NO: 1277715 - protein, 17 aa, Mycobacterium
RFDALVVGAGFSGLYAL

SEQ ID NO: 1277716 - protein, 23 aa, Mycobacterium
RFDEFRDSRLWDHDRVHLSTLGH

SEQ ID NO: 1277717 - protein, 26 aa, Mycobacterium
RFDFRGTDTTIAWKGEEAIEIVSSTE

SEQ ID NO: 1277718 - protein, 19 aa, Mycobacterium
RFDGRHVVVTGCASGIGAQ

SEQ ID NO: 1277719 - protein, 21 aa, Mycobacterium
RFDLADAVAKVYSGEIVNSSA

SEQ ID NO: 1277720 - protein, 24 aa, Mycobacterium
RFDSPRDALALALDLERTVTEQIT

SEQ ID NO: 1277721 - protein, 23 aa, Mycobacterium
RFDVRRLQHMAGEVVRRHPRLSA

SEQ ID NO: 1277722 - protein, 19 aa, Mycobacterium
RFDYMYKFVSSRKVQPGKD

SEQ ID NO: 1277723 - protein, 17 aa, Mycobacterium
RFEFESWCASPGREADP

SEQ ID NO: 1277724 - protein, 20 aa, Mycobacterium
RFEFLIGGVIGRFHRVGDIQ

SEQ ID NO: 1277725 - protein, 20 aa, Mycobacterium
RFEQEIVDRVLAAGVQPVPV

SEQ ID NO: 1277726 - protein, 19 aa, Mycobacterium
RFEVLEVRRDGELVDVDVA

SEQ ID NO: 1277727 - protein, 19 aa, Mycobacterium
RFFFPAYMGPFGWLGLDLA

SEQ ID NO: 1277728 - protein, 19 aa, Mycobacterium
RFGAPETLGAGGLGSVETF

SEQ ID NO: 1277729 - protein, 19 aa, Mycobacterium
RFGDLGFDVVEMVLADQDS

SEQ ID NO: 1277730 - protein, 25 aa, Mycobacterium
RFGGELRWLGSYSAHPSFCPSSGAM

SEQ ID NO: 1277731 - protein, 26 aa, Mycobacterium
RFGVSRPTLREAFRVLESESLIQVQR

SEQ ID NO: 1277732 - protein, 26 aa, Mycobacterium
RFHNHLYEVLGLDFIYKAFTTTDIVA

SEQ ID NO: 1277733 - protein, 26 aa, Mycobacterium
RFHTVYWPAFLMSAGIELPKKVFVHG

SEQ ID NO: 1277734 - protein, 20 aa, Mycobacterium
RFIGGDPYDGIWLRTQAERL

SEQ ID NO: 1277735 - protein, 21 aa, Mycobacterium
RFIGTEIFPGGQLPAVEDIEK

SEQ ID NO: 1277736 - protein, 25 aa, Mycobacterium
RFKKFERLWLSWAMANRDASVFDRP

SEQ ID NO: 1277737 - protein, 18 aa, Mycobacterium
RFLAEQLAAGAFTPTADA

SEQ ID NO: 1277738 - protein, 18 aa, Mycobacterium
RFLAPRPLLEAVRSPEPV

SEQ ID NO: 1277739 - protein, 24 aa, Mycobacterium
RFLEGSWQYRRLFRRLPPEEPKHR

SEQ ID NO: 1277740 - protein, 21 aa, Mycobacterium
RFLMTRIFPRQAEITTATELY

SEQ ID NO: 1277741 - protein, 22 aa, Mycobacterium
RFLNCLGGYTFSRHSYSLGATG

SEQ ID NO: 1277742 - protein, 17 aa, Mycobacterium
RFLPAWQHVGSTHSAGV

SEQ ID NO: 1277743 - protein, 19 aa, Mycobacterium
RFLPAWQMLGGDAVSGVDG

SEQ ID NO: 1277744 - protein, 27 aa, Mycobacterium
RFLPPTAAVDIWWCQGFSEPEAGSDLA

SEQ ID NO: 1277745 - protein, 17 aa, Mycobacterium
RFLQLGLRGYWPDEPVL

SEQ ID NO: 1277746 - protein, 25 aa, Mycobacterium
RFMSSMKRPLGVPVLHLRGEQDPYV

SEQ ID NO: 1277747 - protein, 19 aa, Mycobacterium
RFNSLRHWTSLAAEVDKAG

SEQ ID NO: 1277748 - protein, 24 aa, Mycobacterium
RFPALPLTLGEAISAFRADEVLNQ

SEQ ID NO: 1277749 - protein, 21 aa, Mycobacterium
RFPDDGSWRSVTWQQVGDRVR

SEQ ID NO: 1277750 - protein, 17 aa, Mycobacterium
RFPEIAASSASAYETEV

SEQ ID NO: 1277751 - protein, 19 aa, Mycobacterium
RFPEIRGIDSYRGHKIHSA

SEQ ID NO: 1277752 - protein, 27 aa, Mycobacterium
RFPMHRVWPEFFGMLPAQTLQRTGDIR

SEQ ID NO: 1277753 - protein, 17 aa, Mycobacterium
RFPRAWGEVTTADGRTG

SEQ ID NO: 1277754 - protein, 18 aa, Mycobacterium
RFQNRRALLDVPRLGPKA

SEQ ID NO: 1277755 - protein, 30 aa, Mycobacterium
RFRALANQLSRAWSLCAGNQALDALRPTAK

SEQ ID NO: 1277756 - protein, 20 aa, Mycobacterium
RFRGRFDMFERQPAYLATVT

SEQ ID NO: 1277757 - protein, 25 aa, Mycobacterium
RFRKDYDARFGMRVWHRDFFDAQIV

SEQ ID NO: 1277758 - protein, 20 aa, Mycobacterium
RFSEPESWSLLDTGEPVLTG

SEQ ID NO: 1277759 - protein, 30 aa, Mycobacterium; identical to SEQ ID NO: 720314

SEQ ID NO: 1277760 - protein, 30 aa, Mycobacterium; identical to SEQ ID NO: 720315

SEQ ID NO: 1277761 - protein, 19 aa, Mycobacterium
RFSLPEARRDDAESIRRRA

SEQ ID NO: 1277762 - protein, 27 aa, Mycobacterium
RFTRATRLTWALSRWGVERYTGVFSEI

SEQ ID NO: 1277763 - protein, 19 aa, Mycobacterium
RFTTLKARLGDAFEVIEIS

SEQ ID NO: 1277764 - protein, 19 aa, Mycobacterium
RFVAHLAAALGPVCGTGDV

SEQ ID NO: 1277765 - protein, 28 aa, Mycobacterium
RFVDDISRPGMLHACFVRSPFAHATING

SEQ ID NO: 1277766 - protein, 25 aa, Mycobacterium
RFVDHLKGMFAFAIVERDSGRVLLG

SEQ ID NO: 1277767 - protein, 25 aa, Mycobacterium
RFVEETGRTPMQWVTDQRVLFARRM

SEQ ID NO: 1277768 - protein, 19 aa, Mycobacterium
RFVIGGWAEVLLLAGRRDG

SEQ ID NO: 1277769 - protein, 23 aa, Mycobacterium
RFVPELLAQFGVAGPEVGQLQRA

SEQ ID NO: 1277770 - protein, 18 aa, Mycobacterium
RFVRGAGQLVRLAAAAPR

SEQ ID NO: 1277771 - protein, 24 aa, Mycobacterium
RFVSELRGGVVLVSHDREFLARTV

SEQ ID NO: 1277772 - protein, 25 aa, Mycobacterium
RFVSLRPRRLRVILGSRRTPDINIP

SEQ ID NO: 1277773 - protein, 17 aa, Mycobacterium
RFWSGGRGVILLVLIRK

SEQ ID NO: 1277774 - protein, 20 aa, Mycobacterium
RFYDSCRVLPQGDEAPGSLH

SEQ ID NO: 1277775 - protein, 25 aa, Mycobacterium
RGAAFFDSATSFGMIRGGHIDAAVL

SEQ ID NO: 1277776 - protein, 18 aa, Mycobacterium
RGAAWVFTGEGGVDAQTL

SEQ ID NO: 1277777 - protein, 19 aa, Mycobacterium
RGACQADPALAKGLSTHAG

SEQ ID NO: 1277778 - protein, 22 aa, Mycobacterium
RGADCPNIIARLGGDEFVLVPT

SEQ ID NO: 1277779 - protein, 18 aa, Mycobacterium
RGADGRVIVACFASNVDR

SEQ ID NO: 1277780 - protein, 18 aa, Mycobacterium
RGADPVFMLTGPIPATQY

SEQ ID NO: 1277781 - protein, 17 aa, Mycobacterium
RGAELLFQIITEREERA

SEQ ID NO: 1277782 - protein, 26 aa, Mycobacterium
RGAEYSVDFVPKVRVEVVVDDAAVDK

SEQ ID NO: 1277783 - protein, 20 aa, Mycobacterium
RGAFHGRSGYTLSLTNTDPN

SEQ ID NO: 1277784 - protein, 17 aa, Mycobacterium
RGAGHFRLGPYGVSVPA

SEQ ID NO: 1277785 - protein, 17 aa, Mycobacterium
RGAGLGHALMRLRLDRC

SEQ ID NO: 1277786 - protein, 17 aa, Mycobacterium
RGAGLRPRDKFTTVAEM

SEQ ID NO: 1277787 - protein, 17 aa, Mycobacterium
RGALESGLDHVDRIPQM

SEQ ID NO: 1277788 - protein, 22 aa, Mycobacterium
RGAMMRRSIAAAMGRSKREIPH

SEQ ID NO: 1277789 - protein, 26 aa, Mycobacterium
RGAPVEFPLDGVVPGFQKAIAGQNVG

SEQ ID NO: 1277790 - protein, 18 aa, Mycobacterium
RGAQIGMLGATPFSNHPA

SEQ ID NO: 1277791 - protein, 17 aa, Mycobacterium
RGARKPGSAIWFKGGPR

SEQ ID NO: 1277792 - protein, 17 aa, Mycobacterium
RGARVVVAVRNLDKGRQ

SEQ ID NO: 1277793 - protein, 19 aa, Mycobacterium
RGASAPAPDQGWFFEDGAH

SEQ ID NO: 1277794 - protein, 18 aa, Mycobacterium
RGASPAARLWQLRTVLAL

SEQ ID NO: 1277795 - protein, 24 aa, Mycobacterium
RGASQMGTPYSWGGGKPNGPSRGV

SEQ ID NO: 1277796 - protein, 18 aa, Mycobacterium
RGAVFIHGTSVWLESSIE

SEQ ID NO: 1277797 - protein, 25 aa, Mycobacterium
RGAVPGLRSAGSIASYVGSLVLTNE

SEQ ID NO: 1277798 - protein, 25 aa, Mycobacterium
RGCYNANCGPLVWTTYGAALAEPIG

SEQ ID NO: 1277799 - protein, 19 aa, Mycobacterium
RGDAIPWHVPEDMARFKEL

SEQ ID NO: 1277800 - protein, 21 aa, Mycobacterium
RGDEMFMAMIARHCQHVIDTG

SEQ ID NO: 1277801 - protein, 17 aa, Mycobacterium
RGDFSRWLGHTIADTEL

SEQ ID NO: 1277802 - protein, 20 aa, Mycobacterium
RGDGGFGYDPVFLPTGSART

SEQ ID NO: 1277803 - protein, 18 aa, Mycobacterium
RGDGLMAAMMAQLPFELT

SEQ ID NO: 1277804 - protein, 20 aa, Mycobacterium
RGDIDLRMVQIVLARTKNVE

SEQ ID NO: 1277805 - protein, 22 aa, Mycobacterium
RGDIPARVLLLGGTPFTEDLVM

SEQ ID NO: 1277806 - protein, 24 aa, Mycobacterium
RGDLALKMGLPVLAVVGYAQSFAD

SEQ ID NO: 1277807 - protein, 19 aa, Mycobacterium
RGDYMNQFIVFDFTISRLK

SEQ ID NO: 1277808 - protein, 32 aa, Mycobacterium
RGDYSLGAFAVWLRDLLDLLGIARVTLVGHSL

SEQ ID NO: 1277809 - protein, 19 aa, Mycobacterium
RGDYSVAFRGGMLEMDDPE

SEQ ID NO: 1277810 - protein, 19 aa, Mycobacterium
RGEAFVHDFIKPHDDDRLT

SEQ ID NO: 1277811 - protein, 21 aa, Mycobacterium
RGEEPFMMVFDLLDLTPYGRQ

SEQ ID NO: 1277812 - protein, 21 aa, Mycobacterium
RGEFISLLGPSGCGKTTTLRC

SEQ ID NO: 1277813 - protein, 21 aa, Mycobacterium
RGEIPMSIELTGDPARVLSLV

SEQ ID NO: 1277814 - protein, 21 aa, Mycobacterium
RGELLGAARAAALAAATNQVN

SEQ ID NO: 1277815 - protein, 20 aa, Mycobacterium
RGELPWTRLDDLHRGRLVEL

SEQ ID NO: 1277816 - protein, 20 aa, Mycobacterium
RGENGLKVYAMCEIPNNVIL

SEQ ID NO: 1277817 - protein, 22 aa, Mycobacterium
RGEPAAELLKNWERRSRRNPTE

SEQ ID NO: 1277818 - protein, 17 aa, Mycobacterium
RGEPLGCITVWATTGHR

SEQ ID NO: 1277819 - protein, 22 aa, Mycobacterium
RGEQPPGPRWSTPVRMPPVPPL

SEQ ID NO: 1277820 - protein, 20 aa, Mycobacterium
RGEVSLPRLVEAVGESRGRP

SEQ ID NO: 1277821 - protein, 25 aa, Mycobacterium
RGFADVDAAWEWNAGLLYLRGRLEE

SEQ ID NO: 1277822 - protein, 25 aa, Mycobacterium
RGFAGRFGPGLPRVSDGSLLFLMHL

SEQ ID NO: 1277823 - protein, 31 aa, Mycobacterium
RGFAIPNLCRRGVCGECRVPVSGGAITHRDL

SEQ ID NO: 1277824 - protein, 17 aa, Mycobacterium
RGFCSGLDLSAPNPEET

SEQ ID NO: 1277825 - protein, 17 aa, Mycobacterium
RGFGGMQGGGLGYAASK

SEQ ID NO: 1277826 - protein, 23 aa, Mycobacterium
RGFGYDAVTLLNLYAGCATNPRD

SEQ ID NO: 1277827 - protein, 20 aa, Mycobacterium
RGFLDWLFDRYQQIVATEPN

SEQ ID NO: 1277828 - protein, 26 aa, Mycobacterium
RGFRGRDTLFGFARHELETTFIATSA

SEQ ID NO: 1277829 - protein, 19 aa, Mycobacterium
RGFTACTRSTLALSSQARK

SEQ ID NO: 1277830 - protein, 19 aa, Mycobacterium
RGFYAGAVGWCDQRGDGRW

SEQ ID NO: 1277831 - protein, 17 aa, Mycobacterium
RGFYMCPVTPLTDEFEL

SEQ ID NO: 1277832 - protein, 17 aa, Mycobacterium
RGGFAGKLLGSVSAAVA

SEQ ID NO: 1277833 - protein, 17 aa, Mycobacterium
RGGFAGMLLGSVSAAVA

SEQ ID NO: 1277834 - protein, 18 aa, Mycobacterium
RGGFAGMLLGSVSSTVAR

SEQ ID NO: 1277835 - protein, 19 aa, Mycobacterium
RGGGHAFTLTVTDIATGWT

SEQ ID NO: 1277836 - protein, 24 aa, Mycobacterium
RGGHIPTAVSIPWAKAALDNGKFR

SEQ ID NO: 1277837 - protein, 21 aa, Mycobacterium
RGGHLDVCVLGAYQVSESGDL

SEQ ID NO: 1277838 - protein, 20 aa, Mycobacterium
RGGIEGVHISYPMSDVTSSG

SEQ ID NO: 1277839 - protein, 20 aa, Mycobacterium
RGGKYAVAALCGAGGQGDAL

SEQ ID NO: 1277840 - protein, 22 aa, Mycobacterium
RGGLDRESLRLSVVHAGNPAQR

SEQ ID NO: 1277841 - protein, 19 aa, Mycobacterium
RGGLGYLLKDRVAHVRHFL

SEQ ID NO: 1277842 - protein, 17 aa, Mycobacterium
RGGLTVRRKAGRLANLE

SEQ ID NO: 1277843 - protein, 18 aa, Mycobacterium
RGGQRGDRLRRCGTVPVQ

SEQ ID NO: 1277844 - protein, 18 aa, Mycobacterium
RGGTEFRQVSGGLLLQQR

SEQ ID NO: 1277845 - protein, 18 aa, Mycobacterium
RGGVLSGNGGDGGIGGYA

SEQ ID NO: 1277846 - protein, 18 aa, Mycobacterium
RGGVPIELGEQLLDDRDG

SEQ ID NO: 1277847 - protein, 21 aa, Mycobacterium
RGHGSWARAVEGIRVARGLGF

SEQ ID NO: 1277848 - protein, 17 aa, Mycobacterium
RGHHGPVRRRPLTDVVF

SEQ ID NO: 1277849 - protein, 19 aa, Mycobacterium
RGHLPDPAASVLLGVDGSP

SEQ ID NO: 1277850 - protein, 19 aa, Mycobacterium
RGHPRYRLMTDADRGALDA

SEQ ID NO: 1277851 - protein, 18 aa, Mycobacterium
RGHSVPVPGELGGAAMVI

SEQ ID NO: 1277852 - protein, 23 aa, Mycobacterium
RGIEVPGRHQLFLHGCDVSRGSS

SEQ ID NO: 1277853 - protein, 21 aa, Mycobacterium
RGIGAEIVRRLAADGAAVAFT

SEQ ID NO: 1277854 - protein, 26 aa, Mycobacterium
RGIGATIAEVFARDGAKVIAVDVEGA

SEQ ID NO: 1277855 - protein, 23 aa, Mycobacterium
RGIGREHALLFAAQGAAVVVNDL

SEQ ID NO: 1277856 - protein, 19 aa, Mycobacterium
RGIGVGFESYALYPPMSVR

SEQ ID NO: 1277857 - protein, 21 aa, Mycobacterium
RGIHFCLGAALARMEARIALD

SEQ ID NO: 1277858 - protein, 21 aa, Mycobacterium
RGIHFCLGAALARMEARIALN

SEQ ID NO: 1277859 - protein, 20 aa, Mycobacterium
RGIMPDRHLGTALAAAHNEM

SEQ ID NO: 1277860 - protein, 30 aa, Mycobacterium
RGIRRDIGFVFQRFHLIPRLTVVHNVVHGA

SEQ ID NO: 1277861 - protein, 21 aa, Mycobacterium
RGISSALPFFDFRAVQPEAAT

SEQ ID NO: 1277862 - protein, 20 aa, Mycobacterium
RGITEPFPIQAATLPDALAG

SEQ ID NO: 1277863 - protein, 17 aa, Mycobacterium
RGIVAVRELIPLADALA

SEQ ID NO: 1277864 - protein, 17 aa, Mycobacterium
RGIYCGTVGLASPVAGC

SEQ ID NO: 1277865 - protein, 20 aa, Mycobacterium
RGKPCAKLVPVEAVDLLSTE

SEQ ID NO: 1277866 - protein, 26 aa, Mycobacterium
RGLAAIDEICRVEGLTGIYVGPADLA

SEQ ID NO: 1277867 - protein, 20 aa, Mycobacterium
RGLAEKDLGLALALGEELDV

SEQ ID NO: 1277868 - protein, 18 aa, Mycobacterium
RGLAELGVAEDDLPRLAR

SEQ ID NO: 1277869 - protein, 20 aa, Mycobacterium
RGLAIAHRVLDELSYRRDSD

SEQ ID NO: 1277870 - protein, 18 aa, Mycobacterium
RGLALFDMFTYFNEITAA

SEQ ID NO: 1277871 - protein, 25 aa, Mycobacterium
RGLAPRPGPAYITFAYASWGAAHAA

SEQ ID NO: 1277872 - protein, 19 aa, Mycobacterium
RGLAQLRSDVGMVFQSFNL

SEQ ID NO: 1277873 - protein, 19 aa, Mycobacterium
RGLARGFARAPRVTCVAGL

SEQ ID NO: 1277874 - protein, 21 aa, Mycobacterium
RGLEMRARLMLECNTIRELAT

SEQ ID NO: 1277875 - protein, 20 aa, Mycobacterium
RGLETHLSYRVCLKTFSASE

SEQ ID NO: 1277876 - protein, 22 aa, Mycobacterium
RGLEVTGRLLLAGSAKRRFWWA

SEQ ID NO: 1277877 - protein, 18 aa, Mycobacterium
RGLGIWEWASTTTGEPDV

SEQ ID NO: 1277878 - protein, 32 aa, Mycobacterium
RGLIAEYGISWILPRIVGWSAAQDLLLSGRTF

SEQ ID NO: 1277879 - protein, 18 aa, Mycobacterium
RGLKLRQGLTLALEPWFA

SEQ ID NO: 1277880 - protein, 17 aa, Mycobacterium
RGLKLSAGTVFEHLHQS

SEQ ID NO: 1277881 - protein, 19 aa, Mycobacterium
RGLLGKFMPVKRTTFVIDT

SEQ ID NO: 1277882 - protein, 17 aa, Mycobacterium
RGLLPDREVQSITEQLS

SEQ ID NO: 1277883 - protein, 20 aa, Mycobacterium
RGLMCAFSMPSAAQRDALIA

SEQ ID NO: 1277884 - protein, 31 aa, Mycobacterium
RGLMCDDGWLSIEVHYALNLVAFGQFDTIYH

SEQ ID NO: 1277885 - protein, 19 aa, Mycobacterium
RGLPIKTLQVPAGIVQVTY

SEQ ID NO: 1277886 - protein, 39 aa, Mycobacterium
RGLRELELRKAPSISETIDWARTLAVLGVDELSAQVLSD

SEQ ID NO: 1277887 - protein, 23 aa, Mycobacterium
RGLRRERVLALALQLLDRGYFRA

SEQ ID NO: 1277888 - protein, 17 aa, Mycobacterium
RGLRSAIAAVRKRRRAK

SEQ ID NO: 1277889 - protein, 17 aa, Mycobacterium
RGLWCAIELSVDANPVV

SEQ ID NO: 1277890 - protein, 17 aa, Mycobacterium
RGLYQYKPAMPYTPGAE

SEQ ID NO: 1277891 - protein, 23 aa, Mycobacterium
RGMGLAAAHCFADDGARVALIGR

SEQ ID NO: 1277892 - protein, 26 aa, Mycobacterium
RGMPFVVRLTGCPLVRGLEVDTTTTE

SEQ ID NO: 1277893 - protein, 23 aa, Mycobacterium
RGMPRIPHPVKRVLLGGRSITID

SEQ ID NO: 1277894 - protein, 23 aa, Mycobacterium
RGMSLRSPARFLAPAERLVAQWK

SEQ ID NO: 1277895 - protein, 18 aa, Mycobacterium
RGNDVGGILGRRLRGGRA

SEQ ID NO: 1277896 - protein, 21 aa, Mycobacterium
RGNVTYRHMLAGKPAVLHTRL

SEQ ID NO: 1277897 - protein, 19 aa, Mycobacterium
RGPDWARWVETLPRETEGQ

SEQ ID NO: 1277898 - protein, 17 aa, Mycobacterium
RGPLLIRSRGRAVTAED

SEQ ID NO: 1277899 - protein, 20 aa, Mycobacterium
RGPLTVPVWYQYSPGGQPWV

SEQ ID NO: 1277900 - protein, 25 aa, Mycobacterium
RGPMDRFHRRLLWPIRTSAGEVIGF

SEQ ID NO: 1277901 - protein, 19 aa, Mycobacterium
RGPNAGSRFLLDQPTTSAG

SEQ ID NO: 1277902 - protein, 17 aa, Mycobacterium
RGPSGERADWWWYTPFQ

SEQ ID NO: 1277903 - protein, 21 aa, Mycobacterium
RGPVATVLIQRGTLRVGDSVV

SEQ ID NO: 1277904 - protein, 31 aa, Mycobacterium
RGPVIRFLLIEAPQRWRFVVTAHHILIDGWS

SEQ ID NO: 1277905 - protein, 28 aa, Mycobacterium
RGQLPVKLCYSGPFFRYERPQAGRYRQL

SEQ ID NO: 1277906 - protein, 23 aa, Mycobacterium
RGQRYWFCCKGCGPRFDRDPDKY

SEQ ID NO: 1277907 - protein, 39 aa, Mycobacterium
RGRARVEYKLRDWLFARQRYWGEPFPIVYDSDGRPHPLP

SEQ ID NO: 1277908 - protein, 19 aa, Mycobacterium
RGRDFAFLGGEDWHPEDSP

SEQ ID NO: 1277909 - protein, 21 aa, Mycobacterium
RGRGAMIAVELVKPGTLEPDP

SEQ ID NO: 1277910 - protein, 17 aa, Mycobacterium
RGRGVALMHALTDHCTI

SEQ ID NO: 1277911 - protein, 25 aa, Mycobacterium
RGRIGRGEHPSLCLLVTKLPESSKA

SEQ ID NO: 1277912 - protein, 17 aa, Mycobacterium
RGRLEAKAVLSLIVAAV

SEQ ID NO: 1277913 - protein, 21 aa, Mycobacterium
RGRNMPVPVLVGSWHTIQGLV

SEQ ID NO: 1277914 - protein, 18 aa, Mycobacterium
RGRPGWHTECVAMCESYL

SEQ ID NO: 1277915 - protein, 18 aa, Mycobacterium
RGRPHLCFDTFNAEQKMT

SEQ ID NO: 1277916 - protein, 24 aa, Mycobacterium
RGRQFRFSIDREVEDDGDTDGFTQ

SEQ ID NO: 1277917 - protein, 26 aa, Mycobacterium
RGRQPAVIDACGWRAIDAAEVARGAG

SEQ ID NO: 1277918 - protein, 20 aa, Mycobacterium
RGRRGIVAVRELLPLADARA

SEQ ID NO: 1277919 - protein, 23 aa, Mycobacterium
RGRRLGELGADGLFVGRPMWLPL

SEQ ID NO: 1277920 - protein, 21 aa, Mycobacterium
RGRSPAREVLLGSVAVATVHR

SEQ ID NO: 1277921 - protein, 19 aa, Mycobacterium
RGRTEFDLCGGRINTDAMD

SEQ ID NO: 1277922 - protein, 19 aa, Mycobacterium
RGRVPDPPGGLVGVEDAIR

SEQ ID NO: 1277923 - protein, 17 aa, Mycobacterium
RGRVVEIYGPESSGKTT

SEQ ID NO: 1277924 - protein, 19 aa, Mycobacterium
RGSAPWLSRVHDFTYGARL

SEQ ID NO: 1277925 - protein, 18 aa, Mycobacterium
RGSFGLNDFLGWSHLVGG

SEQ ID NO: 1277926 - protein, 18 aa, Mycobacterium
RGSFSLDLGYFLQGSLTT

SEQ ID NO: 1277927 - protein, 18 aa, Mycobacterium
RGSGEAMQVSFYGEGFVI

SEQ ID NO: 1277928 - protein, 17 aa, Mycobacterium
RGSGEIVDIVQRSHTDL

SEQ ID NO: 1277929 - protein, 21 aa, Mycobacterium
RGSLKGFVVSGRWPDSTKEWA

SEQ ID NO: 1277930 - protein, 17 aa, Mycobacterium
RGSLSWRQAADAFCEAV

SEQ ID NO: 1277931 - protein, 19 aa, Mycobacterium
RGSPGMAHYAASKGALISF

SEQ ID NO: 1277932 - protein, 25 aa, Mycobacterium
RGSRGVSLAEVWKTQAYAYLGITVP

SEQ ID NO: 1277933 - protein, 17 aa, Mycobacterium
RGSTGKIVRRELHALIE

SEQ ID NO: 1277934 - protein, 21 aa, Mycobacterium
RGSTRGALAMDPRGMAELFEA

SEQ ID NO: 1277935 - protein, 19 aa, Mycobacterium
RGSTWPRQLPWLTRLGRVF

SEQ ID NO: 1277936 - protein, 17 aa, Mycobacterium
RGTDWHPHRGFETVTYM

SEQ ID NO: 1277937 - protein, 17 aa, Mycobacterium
RGTGARGLRAIMEEVLL

SEQ ID NO: 1277938 - protein, 25 aa, Mycobacterium
RGTGHLRLKGDQAWTLLTALQELKG

SEQ ID NO: 1277939 - protein, 28 aa, Mycobacterium
RGTGKGLRSARRLGRRRHTPEEAVDEDV

SEQ ID NO: 1277940 - protein, 19 aa, Mycobacterium
RGTLEWAGVGLVFGPNVKP

SEQ ID NO: 1277941 - protein, 19 aa, Mycobacterium
RGTLFPVGSFGHAGFTGVT

SEQ ID NO: 1277942 - protein, 17 aa, Mycobacterium
RGTRPSNRRELIGAAAT

SEQ ID NO: 1277943 - protein, 22 aa, Mycobacterium
RGVAAHRVWLAPLGRSPRLDEV

SEQ ID NO: 1277944 - protein, 26 aa, Mycobacterium
RGVDAADRLCEACVMLLAVDAVAISL

SEQ ID NO: 1277945 - protein, 20 aa, Mycobacterium
RGVIWPTIPPDILGQSGTAW

SEQ ID NO: 1277946 - protein, 18 aa, Mycobacterium
RGVKLVGATAHYVTDDLD

SEQ ID NO: 1277947 - protein, 19 aa, Mycobacterium
RGVQLFADWTRRLGDTDSD

SEQ ID NO: 1277948 - protein, 24 aa, Mycobacterium
RGVSYRWRLWRGRRDGLADVLSAV

SEQ ID NO: 1277949 - protein, 26 aa, Mycobacterium
RGVTLATRLARNIAEFSGVEVAHGAL

SEQ ID NO: 1277950 - protein, 23 aa, Mycobacterium
RGWLAGTGLHAWVVQREFADPIS

SEQ ID NO: 1277951 - protein, 19 aa, Mycobacterium
RGWLDDPTRFFAPPPPLTD

SEQ ID NO: 1277952 - protein, 22 aa, Mycobacterium
RGWQRNRVLALALHLLDLGYFR

SEQ ID NO: 1277953 - protein, 18 aa, Mycobacterium
RGWYIGRTIPLSMAGGQR

SEQ ID NO: 1277954 - protein, 19 aa, Mycobacterium
RGYARAGLRTVLAPMVADR

SEQ ID NO: 1277955 - protein, 20 aa, Mycobacterium
RGYLPEDFTMLAYGGNGPLH

SEQ ID NO: 1277956 - protein, 20 aa, Mycobacterium
RGYRHLGEVLARSGRLPDAD

SEQ ID NO: 1277957 - protein, 20 aa, Mycobacterium
RGYVLRRLLRRIIRAAKLLG

SEQ ID NO: 1277958 - protein, 18 aa, Mycobacterium
RGYWPPQDTFEWMLEQKM

SEQ ID NO: 1277959 - protein, 21 aa, Mycobacterium
RHAHWLLPAVHWLERDDLLAF

SEQ ID NO: 1277960 - protein, 20 aa, Mycobacterium
RHALGRSAYQLGVLERALEL

SEQ ID NO: 1277961 - protein, 17 aa, Mycobacterium
RHAPTYVYRYDYAPRTL

SEQ ID NO: 1277962 - protein, 18 aa, Mycobacterium
RHAREIFSTDGALVDDQI

SEQ ID NO: 1277963 - protein, 25 aa, Mycobacterium
RHCSGRFRYQVGQFLTLRVNLDGQE

SEQ ID NO: 1277964 - protein, 25 aa, Mycobacterium
RHDDGPRPTLCLIHGFMGSAYLFNG

SEQ ID NO: 1277965 - protein, 25 aa, Mycobacterium
RHDFLGAPFWIGRGFGLNLSVVTDP

SEQ ID NO: 1277966 - protein, 20 aa, Mycobacterium
RHDGRLTIRFNRPQRHNAFS

SEQ ID NO: 1277967 - protein, 17 aa, Mycobacterium
RHDIPLTVFAVARALQR

SEQ ID NO: 1277968 - protein, 18 aa, Mycobacterium
RHDLSCAVRTSELTVPPW

SEQ ID NO: 1277969 - protein, 18 aa, Mycobacterium
RHECLRLVPRTDDVELML

SEQ ID NO: 1277970 - protein, 19 aa, Mycobacterium
RHFDYKPSRTEDAEGVWAS

SEQ ID NO: 1277971 - protein, 25 aa, Mycobacterium
RHFSFGLGVHRCIGSNVARTVFKSM

SEQ ID NO: 1277972 - protein, 17 aa, Mycobacterium
RHGETEWSKSGKHTSRT

SEQ ID NO: 1277973 - protein, 20 aa, Mycobacterium
RHGKDLTWSQVVMAANTPML

SEQ ID NO: 1277974 - protein, 21 aa, Mycobacterium
RHGKTSLARLVQRMAADSGAV

SEQ ID NO: 1277975 - protein, 24 aa, Mycobacterium
RHGLGRAALQLGVLERALELTATY

SEQ ID NO: 1277976 - protein, 20 aa, Mycobacterium
RHGLKSMLFAPELALARAWT

SEQ ID NO: 1277977 - protein, 27 aa, Mycobacterium
RHGRIKLPKLGWVKFRASRSLDGETIR

SEQ ID NO: 1277978 - protein, 19 aa, Mycobacterium
RHGRLSFRLAGTERGGPGS

SEQ ID NO: 1277979 - protein, 24 aa, Mycobacterium
RHGTGWRWRNDRLGLAQDFVIGDE

SEQ ID NO: 1277980 - protein, 25 aa, Mycobacterium
RHHDRGRLLARERIELLVDRDAPFM

SEQ ID NO: 1277981 - protein, 21 aa, Mycobacterium
RHHHELGWFARQALRLFDDLR

SEQ ID NO: 1277982 - protein, 33 aa, Mycobacterium
RHHHELGWFARQALRMFDDLRLEHGRLDQPIPV

SEQ ID NO: 1277983 - protein, 26 aa, Mycobacterium
RHHVCAEALRMARGHDVAHDVALVER

SEQ ID NO: 1277984 - protein, 18 aa, Mycobacterium
RHIITACVPIADHIAYRF

SEQ ID NO: 1277985 - protein, 18 aa, Mycobacterium
RHIKARHPATRILALSGT

SEQ ID NO: 1277986 - protein, 22 aa, Mycobacterium
RHIPFRRGAALIATDGHHVAGV

SEQ ID NO: 1277987 - protein, 28 aa, Mycobacterium
RHIWLHEGFACYAEWLWSEHCGERTVDQ

SEQ ID NO: 1277988 - protein, 20 aa, Mycobacterium
RHLEIRWDGQVALLSDLNST

SEQ ID NO: 1277989 - protein, 22 aa, Mycobacterium
RHLEPSIPLVALWDETTWVPGS

SEQ ID NO: 1277990 - protein, 21 aa, Mycobacterium
RHLHLPSVFNPLVGVLTQSPT

SEQ ID NO: 1277991 - protein, 21 aa, Mycobacterium
RHLIGRIAALLAVLRPDLDKD

SEQ ID NO: 1277992 - protein, 19 aa, Mycobacterium
RHLMAELFAPMSKVAAKNP

SEQ ID NO: 1277993 - protein, 24 aa, Mycobacterium
RHLPEIRTGRQLWCQLFSEPGAGS

SEQ ID NO: 1277994 - protein, 19 aa, Mycobacterium
RHLPPIAAGEVIWCQGFSE

SEQ ID NO: 1277995 - protein, 23 aa, Mycobacterium
RHLRAFQWFLDRAADGGIALTAA

SEQ ID NO: 1277996 - protein, 24 aa, Mycobacterium
RHLVLPMFVADGIEEPRDITSMPG

SEQ ID NO: 1277997 - protein, 18 aa, Mycobacterium
RHPAPCGASTTGATTIVQ

SEQ ID NO: 1277998 - protein, 17 aa, Mycobacterium
RHPDLDILLAHGGGAFL

SEQ ID NO: 1277999 - protein, 22 aa, Mycobacterium
RHPEIFSSALGITVGDQTPELA

SEQ ID NO: 1278000 - protein, 22 aa, Mycobacterium
RHPESPTDWKTAAALDPHSYDD

SEQ ID NO: 1278001 - protein, 26 aa, Mycobacterium
RHPGIELRLLTAYSGHLQQWLDAGDV

SEQ ID NO: 1278002 - protein, 26 aa, Mycobacterium
RHPKLARAFLRFNFQLLYGTTLPERL

SEQ ID NO: 1278003 - protein, 18 aa, Mycobacterium
RHPKVFPEELAISGDRAE

SEQ ID NO: 1278004 - protein, 19 aa, Mycobacterium
RHPRACWGALRSTILGDAL

SEQ ID NO: 1278005 - protein, 23 aa, Mycobacterium
RHPTPPSALSVHFIAGGDPALDL

SEQ ID NO: 1278006 - protein, 20 aa, Mycobacterium
RHPVKRARTTFTYLAVSTNG

SEQ ID NO: 1278007 - protein, 22 aa, Mycobacterium
RHQDSWEGFVWFVERQCLLTAT

SEQ ID NO: 1278008 - protein, 20 aa, Mycobacterium
RHQFTKDEVQAIVAALDAAG

SEQ ID NO: 1278009 - protein, 31 aa, Mycobacterium
RHRALQCRAFLLSRAGVEWASGLPGEHNIGG

SEQ ID NO: 1278010 - protein, 23 aa, Mycobacterium
RHRARTGALGVIFSSNNQAALPP

SEQ ID NO: 1278011 - protein, 27 aa, Mycobacterium
RHRDGRWYWHWDPAFLTKPGDDPFVRA

SEQ ID NO: 1278012 - protein, 24 aa, Mycobacterium
RHREALSGLFAEWFTSHTGVEVAA

SEQ ID NO: 1278013 - protein, 25 aa, Mycobacterium
RHRENLGWNAPRLHLVDLQYSDVRL

SEQ ID NO: 1278014 - protein, 23 aa, Mycobacterium
RHRGPKFSLEYVVRKQTLDTATL

SEQ ID NO: 1278015 - protein, 24 aa, Mycobacterium
RHRLSKLLLRHGIVYYGGQAWTGA

SEQ ID NO: 1278016 - protein, 20 aa, Mycobacterium
RHSHVIKQLPGLLVVLRDGG

SEQ ID NO: 1278017 - protein, 25 aa, Mycobacterium
RHTGPALSPFNAWTLLKGLETLSLR

SEQ ID NO: 1278018 - protein, 33 aa, Mycobacterium
RHTLDEVFAMLVGLGDPVLWAVPLHWAGVHAGI

SEQ ID NO: 1278019 - protein, 17 aa, Mycobacterium
RHTSLRYFNVVGSGPDG

SEQ ID NO: 1278020 - protein, 19 aa, Mycobacterium
RHVHPSTLYPGGIGTTATI

SEQ ID NO: 1278021 - protein, 17 aa, Mycobacterium
RHVNAYYGLPMSHCRYQ

SEQ ID NO: 1278022 - protein, 17 aa, Mycobacterium
RHVPVVLLTPGGRRLCT

SEQ ID NO: 1278023 - protein, 29 aa, Mycobacterium
RHVSRGKLLPRDRVDGLLDPGSPFLELAA

SEQ ID NO: 1278024 - protein, 23 aa, Mycobacterium
RHWLAALAERYDPAGVFRTGQVV

SEQ ID NO: 1278025 - protein, 17 aa, Mycobacterium
RHYDLMAGRTVGGGERS

SEQ ID NO: 1278026 - protein, 19 aa, Mycobacterium
RHYWGLPFGGWKSSGVGSE

SEQ ID NO: 1278027 - protein, 17 aa, Mycobacterium
RIAAIKAQRVDLLAGDL

SEQ ID NO: 1278028 - protein, 22 aa, Mycobacterium
RIADEYLEAMFELWHSDSPSYD

SEQ ID NO: 1278029 - protein, 20 aa, Mycobacterium
RIAEGGFETTLWARRPASLE

SEQ ID NO: 1278030 - protein, 22 aa, Mycobacterium
RIAEVDPYLAVRVIDSGLTDQT

SEQ ID NO: 1278031 - protein, 17 aa, Mycobacterium
RIAEVGVRLDALLSRLI

SEQ ID NO: 1278032 - protein, 24 aa, Mycobacterium
RIAEWKLTLCDTVADNASSGAVVL

SEQ ID NO: 1278033 - protein, 19 aa, Mycobacterium
RIAGFPGPVLAALNGHALG

SEQ ID NO: 1278034 - protein, 23 aa, Mycobacterium
RIAGSFRKGRLMLAGDAAHLMPV

SEQ ID NO: 1278035 - protein, 19 aa, Mycobacterium
RIALAGALVARPRMLILDE

SEQ ID NO: 1278036 - protein, 20 aa, Mycobacterium
RIALMSGELGKLNGLPVSVI

SEQ ID NO: 1278037 - protein, 23 aa, Mycobacterium
RIALPAALARYVVQKGSITVDGV

SEQ ID NO: 1278038 - protein, 32 aa, Mycobacterium
RIAMSTKFPFTVFRAGLHPEIRTALQNVADQL

SEQ ID NO: 1278039 - protein, 23 aa, Mycobacterium
RIAPELRDRIFLETGYGSDFGVT

SEQ ID NO: 1278040 - protein, 20 aa, Mycobacterium
RIAPSAAKLFCTEMAGKVAD

SEQ ID NO: 1278041 - protein, 24 aa, Mycobacterium
RIARAAGLPGRINIVLQTCFFAIS

SEQ ID NO: 1278042 - protein, 22 aa, Mycobacterium
RIASICAGSFALAAAGVLDGRR

SEQ ID NO: 1278043 - protein, 22 aa, Mycobacterium
RICSEDFRIHFLISDADGSNPF

SEQ ID NO: 1278044 - protein, 22 aa, Mycobacterium
RIDAKPPLLRRATAYIEGNADA

SEQ ID NO: 1278045 - protein, 18 aa, Mycobacterium
RIDDPILIAFGVHEAAAH

SEQ ID NO: 1278046 - protein, 27 aa, Mycobacterium
RIDDRLAGLPARYAVSVGDQRLVRYDL

SEQ ID NO: 1278047 - protein, 26 aa, Mycobacterium
RIDGFPLLRAGICAGAVVKRRGDVFG

SEQ ID NO: 1278048 - protein, 26 aa, Mycobacterium
RIDGRRNEYVVGWIKRGPSGVIGSNK

SEQ ID NO: 1278049 - protein, 22 aa, Mycobacterium
RIDHIIGLFRLWWIPKGALPTE

SEQ ID NO: 1278050 - protein, 22 aa, Mycobacterium
RIDHSRRIICRAALEEFAASGY

SEQ ID NO: 1278051 - protein, 18 aa, Mycobacterium
RIDRAVASRVFLEHGYGS

SEQ ID NO: 1278052 - protein, 23 aa, Mycobacterium
RIDRHPAGWCLSTSTGDLTARQV

SEQ ID NO: 1278053 - protein, 19 aa, Mycobacterium
RIDRRDWLTHMGYTDTEAR

SEQ ID NO: 1278054 - protein, 24 aa, Mycobacterium
RIDWCRLRDVTALAVRFLDDVIDV

SEQ ID NO: 1278055 - protein, 17 aa, Mycobacterium
RIDYGGMRRNYFRGMEF

SEQ ID NO: 1278056 - protein, 17 aa, Mycobacterium
RIEENFDLFDFELGEAD

SEQ ID NO: 1278057 - protein, 25 aa, Mycobacterium
RIERELPEWLAADVAILGEPSGGLI

SEQ ID NO: 1278058 - protein, 20 aa, Mycobacterium
RIESMPQFREKLADSRFNPD

SEQ ID NO: 1278059 - protein, 21 aa, Mycobacterium
RIGATGWQITRTGARVVTKLA

SEQ ID NO: 1278060 - protein, 18 aa, Mycobacterium
RIGATLGLDATVYEVNVA

SEQ ID NO: 1278061 - protein, 19 aa, Mycobacterium
RIGDAFWFVSEFGDRSQYI

SEQ ID NO: 1278062 - protein, 21 aa, Mycobacterium
RIGEPFTPSGRGFWAKLEGFN

SEQ ID NO: 1278063 - protein, 20 aa, Mycobacterium
RIGERLGLSAAGVRRHLDAL

SEQ ID NO: 1278064 - protein, 26 aa, Mycobacterium
RIGGAGRGFCSGAGISEEDHANPGAA

SEQ ID NO: 1278065 - protein, 24 aa, Mycobacterium
RIGGKWRVGAGFRKPVPTMLLEHR

SEQ ID NO: 1278066 - protein, 19 aa, Mycobacterium
RIGHSRRAILRAALAEFAA

SEQ ID NO: 1278067 - protein, 27 aa, Mycobacterium
RIGLALNCDIAPWGRFARKNYFYPDQP

SEQ ID NO: 1278068 - protein, 25 aa, Mycobacterium
RIGLDASTLRARRPGLIHCSISGYG

SEQ ID NO: 1278069 - protein, 20 aa, Mycobacterium
RIGMPATRFLGPALGSLHMF

SEQ ID NO: 1278070 - protein, 26 aa, Mycobacterium
RIGQVLAPLVTRGWELRGRPTSALLL

SEQ ID NO: 1278071 - protein, 19 aa, Mycobacterium
RIHLLRNVMILAGAGVGGG

SEQ ID NO: 1278072 - protein, 21 aa, Mycobacterium
RIHLLSALARCGVCDEPVRVG

SEQ ID NO: 1278073 - protein, 17 aa, Mycobacterium
RIHLRGLNIRWADGARR

SEQ ID NO: 1278074 - protein, 26 aa, Mycobacterium
RIHRRWPFKLVRLAAETVAREVERRA

SEQ ID NO: 1278075 - protein, 17 aa, Mycobacterium
RIIDALVELDGRTRSAH

SEQ ID NO: 1278076 - protein, 17 aa, Mycobacterium
RIIHVLALENHELRLNR

SEQ ID NO: 1278077 - protein, 22 aa, Mycobacterium
RIIPYNHPILFAAAKVGAPLIT

SEQ ID NO: 1278078 - protein, 19 aa, Mycobacterium
RIIRAASALFYRRGIHATG

SEQ ID NO: 1278079 - protein, 17 aa, Mycobacterium
RIIRAGRHLARPRRYSR

SEQ ID NO: 1278080 - protein, 20 aa, Mycobacterium
RIKAMPEFREKIADSRFNLD

SEQ ID NO: 1278081 - protein, 27 aa, Mycobacterium
RIKDMVIRGGENIYPREVEEFLHTHPD

SEQ ID NO: 1278082 - protein, 18 aa, Mycobacterium
RIKIEGICESGLGIVVGY

SEQ ID NO: 1278083 - protein, 27 aa, Mycobacterium
RIKKRVAARPHLRAALEDFERLGARPW

SEQ ID NO: 1278084 - protein, 17 aa, Mycobacterium
RIKNRVEYDFDLPPIQL

SEQ ID NO: 1278085 - protein, 17 aa, Mycobacterium
RILAAQARRQGRDVSAL

SEQ ID NO: 1278086 - protein, 23 aa, Mycobacterium
RILDRLYGYEVSPVLWKKVAPKL

SEQ ID NO: 1278087 - protein, 24 aa, Mycobacterium
RILEQWGGGGVFVLDETLRPVPVG

SEQ ID NO: 1278088 - protein, 18 aa, Mycobacterium
RILQPFFSPRVIKPLEAD

SEQ ID NO: 1278089 - protein, 17 aa, Mycobacterium
RILRVTGLLEFLTTRPA

SEQ ID NO: 1278090 - protein, 20 aa, Mycobacterium
RILSAYLWTGRKGIIAGRAA

SEQ ID NO: 1278091 - protein, 19 aa, Mycobacterium
RILSEANHPLVIQADTMDS

SEQ ID NO: 1278092 - protein, 20 aa, Mycobacterium
RIMACADVAYLQGQVALREQ

SEQ ID NO: 1278093 - protein, 25 aa, Mycobacterium
RIMREHGLEFNHDWMIDDRPVWLTT

SEQ ID NO: 1278094 - protein, 22 aa, Mycobacterium
RINGVNRLACKVLMRDMLPKNP

SEQ ID NO: 1278095 - protein, 26 aa, Mycobacterium
RINPWALTGHASFWDSMRFLTDTPTY

SEQ ID NO: 1278096 - protein, 24 aa, Mycobacterium
RIPAACCGLVGLKPGRGLTPSGPA

SEQ ID NO: 1278097 - protein, 26 aa, Mycobacterium
RIPADGRPSVMFGCRPRVQPPSQRYV

SEQ ID NO: 1278098 - protein, 27 aa, Mycobacterium
RIPHRLAGPCVRLKDYGIRGMHLAYDL

SEQ ID NO: 1278099 - protein, 19 aa, Mycobacterium
RIPLGGGRVECRAVDSAAN

SEQ ID NO: 1278100 - protein, 18 aa, Mycobacterium
RIPLLALLRRRLTDDEVK

SEQ ID NO: 1278101 - protein, 22 aa, Mycobacterium
RIQADYPDWFIGIRQNGVVIGL

SEQ ID NO: 1278102 - protein, 17 aa, Mycobacterium
RIQCTPDLLPSDIIGTQ

SEQ ID NO: 1278103 - protein, 19 aa, Mycobacterium
RIQCVPPLLNIVASSGRTY

SEQ ID NO: 1278104 - protein, 19 aa, Mycobacterium
RIQDLLTEAARTWSDRLLG

SEQ ID NO: 1278105 - protein, 18 aa, Mycobacterium
RIQGSLCYTGADFEAVIA

SEQ ID NO: 1278106 - protein, 34 aa, Mycobacterium
RIQLSYADGDIWDWAVPWEEWKSMSALSDQASPA

SEQ ID NO: 1278107 - protein, 18 aa, Mycobacterium
RIRDEVFGNLYLTEKADG

SEQ ID NO: 1278108 - protein, 21 aa, Mycobacterium
RIREVALLRAVHVRRSDYLWE

SEQ ID NO: 1278109 - protein, 18 aa, Mycobacterium
RIRGTGTFLGDRIAAELP

SEQ ID NO: 1278110 - protein, 19 aa, Mycobacterium
RIRLERFAPGDGRPRPIVT

SEQ ID NO: 1278111 - protein, 25 aa, Mycobacterium
RIRLVCFPHAGGSASYYFPLSSALT

SEQ ID NO: 1278112 - protein, 29 aa, Mycobacterium
RIRRTLTVARLLAPIAVPLVYRASVAARG

SEQ ID NO: 1278113 - protein, 20 aa, Mycobacterium
RISNDYSLIPAFIEELLRVD

SEQ ID NO: 1278114 - protein, 17 aa, Mycobacterium
RISSRIARPIFTPKVWP

SEQ ID NO: 1278115 - protein, 17 aa, Mycobacterium
RITGGLVSDARLRTYVD

SEQ ID NO: 1278116 - protein, 19 aa, Mycobacterium
RITGRIDLVHCNDSRDAAG

SEQ ID NO: 1278117 - protein, 19 aa, Mycobacterium
RITHDEFRPLKALAARMPC

SEQ ID NO: 1278118 - protein, 24 aa, Mycobacterium
RITNWQIKLCDTIADNASSAGWVL

SEQ ID NO: 1278119 - protein, 17 aa, Mycobacterium
RITVKRDPGGVVSNWIN

SEQ ID NO: 1278120 - protein, 20 aa, Mycobacterium
RITVPFTDADRGFWAKLEGF

SEQ ID NO: 1278121 - protein, 20 aa, Mycobacterium
RIVAEAGIAVPRGRLASFDQ

SEQ ID NO: 1278122 - protein, 24 aa, Mycobacterium
RIVEQLPRKVALELIFTGEPMSSA

SEQ ID NO: 1278123 - protein, 22 aa, Mycobacterium
RIVNGDLHVCFGVTEPGAGLDT

SEQ ID NO: 1278124 - protein, 26 aa, Mycobacterium
RIVTAFPFRLIEVWQSHRAPVEGDLE

SEQ ID NO: 1278125 - protein, 26 aa, Mycobacterium
RIVVLGDAWELLKFLDDASFTLDEKS

SEQ ID NO: 1278126 - protein, 21 aa, Mycobacterium
RIWGFPKIMADFTVRETPRFD

SEQ ID NO: 1278127 - protein, 18 aa, Mycobacterium
RKAFMIISGGVNIYPQEV

SEQ ID NO: 1278128 - protein, 19 aa, Mycobacterium
RKAHGTDIITTRNVITNDK

SEQ ID NO: 1278129 - protein, 24 aa, Mycobacterium
RKAKKLRVRLPLPKLTVAVTDPAQ

SEQ ID NO: 1278130 - protein, 18 aa, Mycobacterium
RKALLPHLAVKRIRAFEP

SEQ ID NO: 1278131 - protein, 18 aa, Mycobacterium
RKAMEELTRIKKDGDAGE

SEQ ID NO: 1278132 - protein, 21 aa, Mycobacterium
RKARAKSSGVRRLDDDDRVAE

SEQ ID NO: 1278133 - protein, 17 aa, Mycobacterium
RKCAVALNVLGALGLIT

SEQ ID NO: 1278134 - protein, 20 aa, Mycobacterium
RKDALPCIQLWPVSDTGYGD

SEQ ID NO: 1278135 - protein, 17 aa, Mycobacterium
RKDFQQWACQRTRFRME

SEQ ID NO: 1278136 - protein, 19 aa, Mycobacterium
RKDLLDVIADVDSRILQVF

SEQ ID NO: 1278137 - protein, 17 aa, Mycobacterium
RKDREVLEALTRAGEKI

SEQ ID NO: 1278138 - protein, 17 aa, Mycobacterium
RKEDVLFEVGVLSTQSA

SEQ ID NO: 1278139 - protein, 18 aa, Mycobacterium
RKEGRALGEVTKFLVYNA

SEQ ID NO: 1278140 - protein, 18 aa, Mycobacterium
RKEGWGLAVTEAGQHAVP

SEQ ID NO: 1278141 - protein, 17 aa, Mycobacterium
RKEGWGLSVVEAAQHGV

SEQ ID NO: 1278142 - protein, 27 aa, Mycobacterium
RKEISVEEIMASPVLNYPLRQYMFCAP

SEQ ID NO: 1278143 - protein, 25 aa, Mycobacterium
RKERMSARRFWVRYAAEASGALTLD

SEQ ID NO: 1278144 - protein, 20 aa, Mycobacterium
RKGDGPGVVLIPEMPGLHPH

SEQ ID NO: 1278145 - protein, 20 aa, Mycobacterium
RKGEGPGVVLIPEMPGLHPG

SEQ ID NO: 1278146 - protein, 18 aa, Mycobacterium
RKGIARGRSVIALAYADG

SEQ ID NO: 1278147 - protein, 17 aa, Mycobacterium
RKGNARFIPEVDGPDDL

SEQ ID NO: 1278148 - protein, 18 aa, Mycobacterium
RKGQEMALRSLAFDRAAT

SEQ ID NO: 1278149 - protein, 20 aa, Mycobacterium
RKGRMLPYVIELDGQFAGQL

SEQ ID NO: 1278150 - protein, 23 aa, Mycobacterium
RKGYHVEYGFSCMGYEIAGGIGV

SEQ ID NO: 1278151 - protein, 24 aa, Mycobacterium
RKHHLLKTFWGWRDAQDCDGTVVW

SEQ ID NO: 1278152 - protein, 21 aa, Mycobacterium
RKIVMEKLELVGLGGDENKFP

SEQ ID NO: 1278153 - protein, 21 aa, Mycobacterium
RKKDMFIVGGFNAYPAEIEGF

SEQ ID NO: 1278154 - protein, 17 aa, Mycobacterium
RKKDMVVSGGFNVFPRQ

SEQ ID NO: 1278155 - protein, 19 aa, Mycobacterium
RKKLPSVQVGDPFTEKVLI

SEQ ID NO: 1278156 - protein, 20 aa, Mycobacterium
RKKSFPFSLDADAMRATTLT

SEQ ID NO: 1278157 - protein, 25 aa, Mycobacterium
RKLAYPRLQFSPLHTWVTDTEFDFD

SEQ ID NO: 1278158 - protein, 17 aa, Mycobacterium
RKLDFVPLASMVTVVLA

SEQ ID NO: 1278159 - protein, 19 aa, Mycobacterium
RKLGAPGHEEFAMGALASG

SEQ ID NO: 1278160 - protein, 19 aa, Mycobacterium
RKLIEHLGAAGVFRSKWGP

SEQ ID NO: 1278161 - protein, 18 aa, Mycobacterium
RKLPSSAMTAFIEESMKP

SEQ ID NO: 1278162 - protein, 28 aa, Mycobacterium
RKLTAFRGDSRFTTWASRFVILEAASKI

SEQ ID NO: 1278163 - protein, 20 aa, Mycobacterium
RKLTEAIFIDPVDWVSEVEG

SEQ ID NO: 1278164 - protein, 17 aa, Mycobacterium
RKMKREALVPISPEMAA

SEQ ID NO: 1278165 - protein, 24 aa, Mycobacterium
RKMPQWSPQCRLMKPIGQLRPGAR

SEQ ID NO: 1278166 - protein, 20 aa, Mycobacterium
RKMRESGCPVAYSDHYEGFW

SEQ ID NO: 1278167 - protein, 17 aa, Mycobacterium
RKNLHVWAGECHVHAGI

SEQ ID NO: 1278168 - protein, 22 aa, Mycobacterium
RKPACGVCVLAKDCPSFGIGPT

SEQ ID NO: 1278169 - protein, 21 aa, Mycobacterium
RKPACGVCVLAKDCPSYGAGP

SEQ ID NO: 1278170 - protein, 27 aa, Mycobacterium
RKPRGPAPRCRVCNAALTSPPAIMLRR

SEQ ID NO: 1278171 - protein, 17 aa, Mycobacterium
RKPRQVFTRDVLLEQVW

SEQ ID NO: 1278172 - protein, 17 aa, Mycobacterium
RKPTMLVTDVSMREDPI

SEQ ID NO: 1278173 - protein, 23 aa, Mycobacterium
RKPVPPLTWWRGIKARKTLEDYF

SEQ ID NO: 1278174 - protein, 25 aa, Mycobacterium
RKQGRFMEMSSWAGAASLDVNRHLL

SEQ ID NO: 1278175 - protein, 25 aa, Mycobacterium
RKRATELLELVGLGHRVNHQPTKMS

SEQ ID NO: 1278176 - protein, 23 aa, Mycobacterium
RKRAVELLELVGIAQPARRARAF

SEQ ID NO: 1278177 - protein, 19 aa, Mycobacterium
RKRFRPPEVLLSAEVYDEL

SEQ ID NO: 1278178 - protein, 23 aa, Mycobacterium
RKRGEILRSVFETITARADDIAA

SEQ ID NO: 1278179 - protein, 17 aa, Mycobacterium
RKRGIRISKQHPDGTAT

SEQ ID NO: 1278180 - protein, 26 aa, Mycobacterium
RKRGKLLVRERIELMLDPDTAFLELC

SEQ ID NO: 1278181 - protein, 26 aa, Mycobacterium
RKRGMLPPRLTRVVINEAVCEGCGDC

SEQ ID NO: 1278182 - protein, 31 aa, Mycobacterium
RKRLEDLPGWSWAHRQTRQWESCFEELAAYA

SEQ ID NO: 1278183 - protein, 17 aa, Mycobacterium
RKRMLLGMERQFHSAVP

SEQ ID NO: 1278184 - protein, 29 aa, Mycobacterium
RKRQINCPGWVGVLRWLKSLLSTPIGEQQ

SEQ ID NO: 1278185 - protein, 26 aa, Mycobacterium
RKRRAGRDEAWVPARVVEQLEIASDL

SEQ ID NO: 1278186 - protein, 17 aa, Mycobacterium
RKRRGDKPFAVMVPDID

SEQ ID NO: 1278187 - protein, 20 aa, Mycobacterium
RKSAHPLVIIPGGPGAASIA

SEQ ID NO: 1278188 - protein, 25 aa, Mycobacterium
RKTAPKGAAMFVASCLTRDVRLIEE

SEQ ID NO: 1278189 - protein, 29 aa, Mycobacterium
RKTHRAVIVDEGWRTGSLAAEISTQITEQ

SEQ ID NO: 1278190 - protein, 18 aa, Mycobacterium
RKTLLMAADLMSAMVEAS

SEQ ID NO: 1278191 - protein, 18 aa, Mycobacterium
RKTPYLWERRDPTPLLEF

SEQ ID NO: 1278192 - protein, 36 aa, Mycobacterium; identical to SEQ ID NO: 17410

SEQ ID NO: 1278193 - protein, 25 aa, Mycobacterium
RKVHCIPEKLFPLTGLTPEQAIDLR

SEQ ID NO: 1278194 - protein, 17 aa, Mycobacterium
RKVKMSATLGRHVNDKM

SEQ ID NO: 1278195 - protein, 17 aa, Mycobacterium
RKVKMVLEPSGGGPALV

SEQ ID NO: 1278196 - protein, 25 aa, Mycobacterium
RKVLNPYFSPARMKALRPEIGVETD

SEQ ID NO: 1278197 - protein, 18 aa, Mycobacterium
RKVTPNFRIGCKRMLISN

SEQ ID NO: 1278198 - protein, 25 aa, Mycobacterium
RKWGQEVIKTVFGRRMHGINSVPGG

SEQ ID NO: 1278199 - protein, 17 aa, Mycobacterium
RKYLDMTPMEYLRRVRM

SEQ ID NO: 1278200 - protein, 19 aa, Mycobacterium
RKYPHVRILILSMHDNEQY

SEQ ID NO: 1278201 - protein, 20 aa, Mycobacterium
RLAAAPRSWLYGKPAYHALT

SEQ ID NO: 1278202 - protein, 20 aa, Mycobacterium
RLAAAVSRAGGLGMVGMGSA

SEQ ID NO: 1278203 - protein, 24 aa, Mycobacterium
RLAAEEWRSLRLAIKQETVAANIA

SEQ ID NO: 1278204 - protein, 25 aa, Mycobacterium
RLAAEEWRSLRLAIKQETVAANIAR

SEQ ID NO: 1278205 - protein, 19 aa, Mycobacterium
RLAAEIGLSESRFLHLFRQ

SEQ ID NO: 1278206 - protein, 26 aa, Mycobacterium
RLAAERRRAIELADLRKLLVGMEAAL

SEQ ID NO: 1278207 - protein, 19 aa, Mycobacterium
RLAALARDIVDHWEVRSQE

SEQ ID NO: 1278208 - protein, 25 aa, Mycobacterium
RLAALGVNRLIRFAAVRDLQLRRPV

SEQ ID NO: 1278209 - protein, 19 aa, Mycobacterium
RLAALSAEINGLGGQCEET

SEQ ID NO: 1278210 - protein, 17 aa, Mycobacterium
RLADAFMDLIDTAWDTE

SEQ ID NO: 1278211 - protein, 25 aa, Mycobacterium
RLADAKTRLAPIFAPHDRETVVLAM

SEQ ID NO: 1278212 - protein, 28 aa, Mycobacterium
RLADAMIGTGSWQVWGPTNVFGFDQWDP

SEQ ID NO: 1278213 - protein, 18 aa, Mycobacterium
RLADAYRMRAAVKVLDHL

SEQ ID NO: 1278214 - protein, 17 aa, Mycobacterium
RLADEFTALGFGVEVIG

SEQ ID NO: 1278215 - protein, 19 aa, Mycobacterium
RLADERARCKIRGRVGTKP

SEQ ID NO: 1278216 - protein, 20 aa, Mycobacterium
RLADGYIDIKGLRLTLTQAA

SEQ ID NO: 1278217 - protein, 24 aa, Mycobacterium
RLADPKLRLDAIIVEASGLADPVA

SEQ ID NO: 1278218 - protein, 25 aa, Mycobacterium
RLAEAARLGFTYAVVPSGVTSAPAG

SEQ ID NO: 1278219 - protein, 26 aa, Mycobacterium
RLAEAIRRFGPIFAQYYGQSEAPMVI

SEQ ID NO: 1278220 - protein, 19 aa, Mycobacterium
RLAEAMRLYDARYHAELHW

SEQ ID NO: 1278221 - protein, 17 aa, Mycobacterium
RLAEHSLDELMNRPHNR

SEQ ID NO: 1278222 - protein, 19 aa, Mycobacterium
RLAEIMGRIHDRCLSTADE

SEQ ID NO: 1278223 - protein, 17 aa, Mycobacterium
RLAELLVAAGLPIPEVS

SEQ ID NO: 1278224 - protein, 24 aa, Mycobacterium
RLAELSAAMARRGHDVTVYTRRDD

SEQ ID NO: 1278225 - protein, 19 aa, Mycobacterium
RLAETPADVITRCAVDAPS

SEQ ID NO: 1278226 - protein, 18 aa, Mycobacterium
RLAGALTDRGVKRGDVVA

SEQ ID NO: 1278227 - protein, 18 aa, Mycobacterium
RLAGATVHDATCSIGAEL

SEQ ID NO: 1278228 - protein, 26 aa, Mycobacterium
RLAGFGAPAHRVWLPPLSRAPALDAV

SEQ ID NO: 1278229 - protein, 19 aa, Mycobacterium
RLAGGIAGALARPTEIANL

SEQ ID NO: 1278230 - protein, 20 aa, Mycobacterium
RLAGWGNKRVEAEAKTIAAR

SEQ ID NO: 1278231 - protein, 23 aa, Mycobacterium
RLAIVDWRARHPAIGAAPVPRPI

SEQ ID NO: 1278232 - protein, 23 aa, Mycobacterium
RLAKGCGAARHLVAPTLAGSRNG

SEQ ID NO: 1278233 - protein, 19 aa, Mycobacterium
RLAKLPVPVVMSGVATWDP

SEQ ID NO: 1278234 - protein, 19 aa, Mycobacterium
RLALCASDNDGSRYVLTPD

SEQ ID NO: 1278235 - protein, 25 aa, Mycobacterium
RLALGHWMRRWWPASVRDGIPELGA

SEQ ID NO: 1278236 - protein, 25 aa, Mycobacterium
RLANQRVRMPVPFAQARLLSTIEDK

SEQ ID NO: 1278237 - protein, 19 aa, Mycobacterium
RLAPACAPDIGWWTGSRLV

SEQ ID NO: 1278238 - protein, 18 aa, Mycobacterium
RLAPGGAVVVGGEVNSSE

SEQ ID NO: 1278239 - protein, 18 aa, Mycobacterium
RLAPWRLRHPELEVHAVA

SEQ ID NO: 1278240 - protein, 17 aa, Mycobacterium
RLARLGILAAPGEFYGP

SEQ ID NO: 1278241 - protein, 17 aa, Mycobacterium
RLARLHTPLPVLAFTAL

SEQ ID NO: 1278242 - protein, 20 aa, Mycobacterium
RLARLRYVPLAGGDVSVLRP

SEQ ID NO: 1278243 - protein, 29 aa, Mycobacterium
RLARLTRRPGLEFGPRWVDRLIVATGRKV

SEQ ID NO: 1278244 - protein, 34 aa, Mycobacterium
RLARTRVAVHLARAHLRYGEWLRRALRRNDAREQ

SEQ ID NO: 1278245 - protein, 40 aa, Mycobacterium
RLASKRTSDDFLRPSAYADFRKRAERVLATRPSLRGKKAE

SEQ ID NO: 1278246 - protein, 20 aa, Mycobacterium
RLATKHLQRYPGLQQAASRG

SEQ ID NO: 1278247 - protein, 18 aa, Mycobacterium
RLATPSGRIEIFSADIAG

SEQ ID NO: 1278248 - protein, 20 aa, Mycobacterium
RLCDPVAQQISTVWAQALPE

SEQ ID NO: 1278249 - protein, 24 aa, Mycobacterium
RLCPQAVVVPPRMAAYSQASADVF

SEQ ID NO: 1278250 - protein, 17 aa, Mycobacterium
RLCPQPRSGDALSQASR

SEQ ID NO: 1278251 - protein, 17 aa, Mycobacterium
RLCRPLTTMACDAADVP

SEQ ID NO: 1278252 - protein, 19 aa, Mycobacterium
RLDAARRFGADTVVNSSTR

SEQ ID NO: 1278253 - protein, 19 aa, Mycobacterium
RLDEFKVWTRQVRNLLNSP

SEQ ID NO: 1278254 - protein, 17 aa, Mycobacterium
RLDEFRRSGAGQPVGHS

SEQ ID NO: 1278255 - protein, 17 aa, Mycobacterium
RLDEVFELRLAVESMAA

SEQ ID NO: 1278256 - protein, 17 aa, Mycobacterium
RLDGEVIDFVELDMPTR

SEQ ID NO: 1278257 - protein, 19 aa, Mycobacterium
RLDGMPLAIELAAARVRAL

SEQ ID NO: 1278258 - protein, 24 aa, Mycobacterium
RLDKEGRSASRVIAADTDEPARGG

SEQ ID NO: 1278259 - protein, 19 aa, Mycobacterium
RLDKTRFRSHPDLDVNTHG

SEQ ID NO: 1278260 - protein, 18 aa, Mycobacterium
RLDPEFLAAEPFEDLAKA

SEQ ID NO: 1278261 - protein, 19 aa, Mycobacterium
RLDPVKRRILDAAAAWPLR

SEQ ID NO: 1278262 - protein, 19 aa, Mycobacterium
RLDRLTAHLHDRWQRDPLL

SEQ ID NO: 1278263 - protein, 18 aa, Mycobacterium
RLDRRIVVVSGAGGGGIG

SEQ ID NO: 1278264 - protein, 19 aa, Mycobacterium
RLDSARCGPILGASGDDPA

SEQ ID NO: 1278265 - protein, 22 aa, Mycobacterium
RLDSIDAFAGHLVVSYRKDALP

SEQ ID NO: 1278266 - protein, 24 aa, Mycobacterium
RLDVIRLPIDIVLDANAVLTRVRE

SEQ ID NO: 1278267 - protein, 25 aa, Mycobacterium
RLDVPGHAGGFFVRPAVFTDTEPTM

SEQ ID NO: 1278268 - protein, 18 aa, Mycobacterium
RLDVPRMVYDLPADGRRL

SEQ ID NO: 1278269 - protein, 18 aa, Mycobacterium
RLDVSPGAPYRHFSDRED

SEQ ID NO: 1278270 - protein, 20 aa, Mycobacterium
RLDWSSPHDVGRKAIAQNAA

SEQ ID NO: 1278271 - protein, 21 aa, Mycobacterium
RLEAAVALSAVTARFPDARLA

SEQ ID NO: 1278272 - protein, 18 aa, Mycobacterium
RLEAEGHRIFKLNIGNPA

SEQ ID NO: 1278273 - protein, 18 aa, Mycobacterium
RLEAQRVLDALRVVGVTL

SEQ ID NO: 1278274 - protein, 17 aa, Mycobacterium
RLEARVCGFEVAGAGSS

SEQ ID NO: 1278275 - protein, 18 aa, Mycobacterium
RLEARVCGFEVAGAGSSG

SEQ ID NO: 1278276 - protein, 19 aa, Mycobacterium
RLEAYRRLAAAPDDAAVDA

SEQ ID NO: 1278277 - protein, 19 aa, Mycobacterium
RLEDARLVLGGRTQAPTSG

SEQ ID NO: 1278278 - protein, 20 aa, Mycobacterium
RLEDSRYGAVLAEVNAAGDD

SEQ ID NO: 1278279 - protein, 19 aa, Mycobacterium
RLEEIWTTFTKLAPKQLIV

SEQ ID NO: 1278280 - protein, 18 aa, Mycobacterium
RLEFLIGGVIGRFHRVGD

SEQ ID NO: 1278281 - protein, 19 aa, Mycobacterium
RLEFPILQTIRFVGRRIAE

SEQ ID NO: 1278282 - protein, 26 aa, Mycobacterium
RLEGACNGCSMASVTLRELVEAALLQ

SEQ ID NO: 1278283 - protein, 25 aa, Mycobacterium
RLEGDRGFYAGAVGWCDATGDGRWV

SEQ ID NO: 1278284 - protein, 19 aa, Mycobacterium
RLEIAIMVTEWLKRVPEFR

SEQ ID NO: 1278285 - protein, 25 aa, Mycobacterium
RLEIRPRLERGFLAAAMEGYQSVSV

SEQ ID NO: 1278286 - protein, 20 aa, Mycobacterium
RLEMDTHYFGTLAVTRAFVP

SEQ ID NO: 1278287 - protein, 36 aa, Mycobacterium
RLESSIALDMLLDFMPRYGVEWDGCRRVSMQNVSGW

SEQ ID NO: 1278288 - protein, 21 aa, Mycobacterium
RLFAECKMARTAFGDEVFDHL

SEQ ID NO: 1278289 - protein, 21 aa, Mycobacterium
RLFDCVAALAGVRQTVAYEAQ

SEQ ID NO: 1278290 - protein, 20 aa, Mycobacterium
RLFKALAAVMAEKGYSDTTV

SEQ ID NO: 1278291 - protein, 19 aa, Mycobacterium
RLFPDRKVILAAVRDDDRD

SEQ ID NO: 1278292 - protein, 25 aa, Mycobacterium
RLFPVIRRYALAYHVVFIPSGEVDR

SEQ ID NO: 1278293 - protein, 17 aa, Mycobacterium
RLFRFADTLLFGLSEES

SEQ ID NO: 1278294 - protein, 23 aa, Mycobacterium
RLFSETKQGFGFYHNNFGVPYAF

SEQ ID NO: 1278295 - protein, 28 aa, Mycobacterium
RLFSGPRPAELHPFIELDGGRHHAPSTP

SEQ ID NO: 1278296 - protein, 21 aa, Mycobacterium
RLFSHVPWLSSQLMSAVEAFA

SEQ ID NO: 1278297 - protein, 23 aa, Mycobacterium
RLFTETKQGFAFYHNNFGVPYAF

SEQ ID NO: 1278298 - protein, 17 aa, Mycobacterium
RLGAAVAPKEIEFADAL

SEQ ID NO: 1278299 - protein, 19 aa, Mycobacterium
RLGAAVRRLIVPRLHLIPG

SEQ ID NO: 1278300 - protein, 23 aa, Mycobacterium
RLGAEAFPTLAPDDLLAAAERLS

SEQ ID NO: 1278301 - protein, 19 aa, Mycobacterium
RLGAIAVPVNFRLAAGEIG

SEQ ID NO: 1278302 - protein, 26 aa, Mycobacterium
RLGAPDEFADAAAFLLTNGYANGEVM

SEQ ID NO: 1278303 - protein, 19 aa, Mycobacterium
RLGAYAEAGVTWITIEPAS

SEQ ID NO: 1278304 - protein, 24 aa, Mycobacterium
RLGDAIAALLSRVGVYRSDYLALA

SEQ ID NO: 1278305 - protein, 19 aa, Mycobacterium
RLGDFRLPQRGIGVIGSGH

SEQ ID NO: 1278306 - protein, 17 aa, Mycobacterium
RLGDLLPPAPADTTPPA

SEQ ID NO: 1278307 - protein, 18 aa, Mycobacterium
RLGELRATTGLKMPDCCV

SEQ ID NO: 1278308 - protein, 22 aa, Mycobacterium
RLGEPWPPVQDAFLRAWEYRPW

SEQ ID NO: 1278309 - protein, 17 aa, Mycobacterium
RLGERLFEIYAPGRALP

SEQ ID NO: 1278310 - protein, 19 aa, Mycobacterium
RLGERLQLDSGTLSPLLKR

SEQ ID NO: 1278311 - protein, 21 aa, Mycobacterium
RLGGDMALFAGLGRLLLEAQD

SEQ ID NO: 1278312 - protein, 18 aa, Mycobacterium
RLGGDSPLSLVLSQKAGG

SEQ ID NO: 1278313 - protein, 19 aa, Mycobacterium
RLGGELAWELAATPLDRFI

SEQ ID NO: 1278314 - protein, 17 aa, Mycobacterium
RLGGHPVAVVANQPKVM

SEQ ID NO: 1278315 - protein, 20 aa, Mycobacterium
RLGGLSRLWRRSTGVPAPIV

SEQ ID NO: 1278316 - protein, 17 aa, Mycobacterium
RLGHFYRGVGLTIYEGY

SEQ ID NO: 1278317 - protein, 21 aa, Mycobacterium
RLGHVAVMPLGVELRGARASG

SEQ ID NO: 1278318 - protein, 19 aa, Mycobacterium
RLGLVSSRVDAGVRSRRMY

SEQ ID NO: 1278319 - protein, 24 aa, Mycobacterium
RLGPKAFEQCAGFLRIRDGEDPLD

SEQ ID NO: 1278320 - protein, 17 aa, Mycobacterium
RLGREGYTTVMRCLSET

SEQ ID NO: 1278321 - protein, 18 aa, Mycobacterium
RLGREISRLETEASRTDS

SEQ ID NO: 1278322 - protein, 21 aa, Mycobacterium
RLGSELEVLLALGAAHGTDAL

SEQ ID NO: 1278323 - protein, 19 aa, Mycobacterium
RLGTEMYMKSADMVEHSVG

SEQ ID NO: 1278324 - protein, 20 aa, Mycobacterium
RLGTGWPQPPDGWRRSDGAR

SEQ ID NO: 1278325 - protein, 20 aa, Mycobacterium
RLGVEWAPPVAALTDAGPAD

SEQ ID NO: 1278326 - protein, 19 aa, Mycobacterium
RLGVHEVPFAALRAAAHRG

SEQ ID NO: 1278327 - protein, 18 aa, Mycobacterium
RLGVTGVPGGWRLDFRDI

SEQ ID NO: 1278328 - protein, 25 aa, Mycobacterium
RLGYHCGIVSGGFRQVIEPLAHELM

SEQ ID NO: 1278329 - protein, 24 aa, Mycobacterium
RLHAALAHLRAHAPVSYVDVPDYR

SEQ ID NO: 1278330 - protein, 20 aa, Mycobacterium
RLHAKLFYQPLLESVGQASL

SEQ ID NO: 1278331 - protein, 24 aa, Mycobacterium
RLHGIDVAVCKPVQTGTRDGDDDL

SEQ ID NO: 1278332 - protein, 21 aa, Mycobacterium
RLHGLPEKWIEIAAEWGTRDY

SEQ ID NO: 1278333 - protein, 22 aa, Mycobacterium
RLHGPDRQWAAKNWQRNGGVAV

SEQ ID NO: 1278334 - protein, 26 aa, Mycobacterium
RLHLEGPAPWKAWGTGEVVLPWPLPD

SEQ ID NO: 1278335 - protein, 17 aa, Mycobacterium
RLHLERFTVAAAPDTVT

SEQ ID NO: 1278336 - protein, 26 aa, Mycobacterium
RLHNGTVYRWNRPVYDIVNGRPHLRV

SEQ ID NO: 1278337 - protein, 23 aa, Mycobacterium
RLHRWRFNLVTGEAREEQLSDSI

SEQ ID NO: 1278338 - protein, 21 aa, Mycobacterium
RLHVDLSISSLIGYHDPNGHY

SEQ ID NO: 1278339 - protein, 18 aa, Mycobacterium
RLHVQPRVAVIVENEISY

SEQ ID NO: 1278340 - protein, 18 aa, Mycobacterium
RLHYDFRLERDGVLVSWA

SEQ ID NO: 1278341 - protein, 18 aa, Mycobacterium
RLIAEARKGMPPNPDATS

SEQ ID NO: 1278342 - protein, 17 aa, Mycobacterium
RLIEAAGHFSLMVERIE

SEQ ID NO: 1278343 - protein, 19 aa, Mycobacterium
RLIGQAAMWAGLQRRGQAA

SEQ ID NO: 1278344 - protein, 24 aa, Mycobacterium
RLILDFYRCAMLPLSDDTAQTGHD

SEQ ID NO: 1278345 - protein, 20 aa, Mycobacterium
RLKAAFAADMVFLRNCGIHP

SEQ ID NO: 1278346 - protein, 25 aa, Mycobacterium
RLKEKAIAPIRAWLGGLTADAEQRA

SEQ ID NO: 1278347 - protein, 18 aa, Mycobacterium
RLKLAKALVELVGGEDGS

SEQ ID NO: 1278348 - protein, 20 aa, Mycobacterium
RLKSGQILRSRNVTTEVNTV

SEQ ID NO: 1278349 - protein, 18 aa, Mycobacterium
RLLAAVTLAAFPSASTVA

SEQ ID NO: 1278350 - protein, 26 aa, Mycobacterium
RLLADCGRGEVIASFAREGGVESAMW

SEQ ID NO: 1278351 - protein, 18 aa, Mycobacterium
RLLADPIAMVISTRPEPH

SEQ ID NO: 1278352 - protein, 17 aa, Mycobacterium
RLLAHGKPADLVRDGEY

SEQ ID NO: 1278353 - protein, 20 aa, Mycobacterium
RLLAILHRGDEEGSVVLTGK

SEQ ID NO: 1278354 - protein, 18 aa, Mycobacterium
RLLATEADRVGHLTARLT

SEQ ID NO: 1278355 - protein, 17 aa, Mycobacterium
RLLDAGALYVGKTNLDQ

SEQ ID NO: 1278356 - protein, 20 aa, Mycobacterium
RLLDGAARYRAAVVSGAPLI

SEQ ID NO: 1278357 - protein, 25 aa, Mycobacterium
RLLDSLAVRKLWGIGPVAEDRLHRL

SEQ ID NO: 1278358 - protein, 22 aa, Mycobacterium
RLLEFYRSLIALRHTEPDMADP

SEQ ID NO: 1278359 - protein, 21 aa, Mycobacterium
RLLEHVEIKGATTIAMIQRAR

SEQ ID NO: 1278360 - protein, 17 aa, Mycobacterium
RLLELSENLATFDRPVL

SEQ ID NO: 1278361 - protein, 22 aa, Mycobacterium
RLLEQLPPFLTGGSMIETVTME

SEQ ID NO: 1278362 - protein, 17 aa, Mycobacterium
RLLFPGWDTTTAALPPM

SEQ ID NO: 1278363 - protein, 18 aa, Mycobacterium
RLLGRLKLTNGIGSVATL

SEQ ID NO: 1278364 - protein, 18 aa, Mycobacterium
RLLIAEALETARCLESGL

SEQ ID NO: 1278365 - protein, 20 aa, Mycobacterium
RLLKHPKLRQGSAAWPAHNG

SEQ ID NO: 1278366 - protein, 19 aa, Mycobacterium
RLLLVKSQFGIQRFFGGLL

SEQ ID NO: 1278367 - protein, 23 aa, Mycobacterium
RLLNRRTRCCAVPRPTCRRPICR

SEQ ID NO: 1278368 - protein, 24 aa, Mycobacterium
RLLPDLATVRAWESCDHTGPVYEG

SEQ ID NO: 1278369 - protein, 17 aa, Mycobacterium
RLLPDVRDVRRMGSCAL

SEQ ID NO: 1278370 - protein, 17 aa, Mycobacterium
RLLPVARAAGVRVVHCL

SEQ ID NO: 1278371 - protein, 27 aa, Mycobacterium
RLLRSGLPFGTCLQAVYLHPCGTEEFK

SEQ ID NO: 1278372 - protein, 17 aa, Mycobacterium
RLLSARPHRRAVLLERL

SEQ ID NO: 1278373 - protein, 20 aa, Mycobacterium
RLLSDMPVDHIGYIGNELTA

SEQ ID NO: 1278374 - protein, 19 aa, Mycobacterium
RLLSERLGVRRVIGLGSIP

SEQ ID NO: 1278375 - protein, 24 aa, Mycobacterium
RLLTLAMDIGCVFSIDTDSHAPGQ

SEQ ID NO: 1278376 - protein, 19 aa, Mycobacterium
RLLTRELFYTAVTRAKKHV

SEQ ID NO: 1278377 - protein, 19 aa, Mycobacterium
RLMAERGRLFGSLPEGGRM

SEQ ID NO: 1278378 - protein, 19 aa, Mycobacterium
RLMCLCGIDDCEAAQRTPS

SEQ ID NO: 1278379 - protein, 19 aa, Mycobacterium
RLMGPRWRHGPTVAADLVL

SEQ ID NO: 1278380 - protein, 25 aa, Mycobacterium
RLMWPSLEGEIRWCQLFSEPGAGSD

SEQ ID NO: 1278381 - protein, 24 aa, Mycobacterium
RLNELTTRELLALTLVEAGVATRW

SEQ ID NO: 1278382 - protein, 22 aa, Mycobacterium
RLNEVCCIYPITPSSPMAELAD

SEQ ID NO: 1278383 - protein, 19 aa, Mycobacterium
RLNFEPSLGNAIRAIKLTA

SEQ ID NO: 1278384 - protein, 19 aa, Mycobacterium
RLNGAAYLPACLASHLPLD

SEQ ID NO: 1278385 - protein, 27 aa, Mycobacterium
RLNGLKGRGVLAVRGRGLWAGVDIDPA

SEQ ID NO: 1278386 - protein, 18 aa, Mycobacterium
RLNGRRYLIDVVMQTPRR

SEQ ID NO: 1278387 - protein, 26 aa, Mycobacterium
RLNVAVSRAKYLAVIVRSQHLTDYLP

SEQ ID NO: 1278388 - protein, 19 aa, Mycobacterium
RLNVGIAMVTDRLPFSNPI

SEQ ID NO: 1278389 - protein, 18 aa, Mycobacterium
RLPAGVMVIPGLVAVHAD

SEQ ID NO: 1278390 - protein, 21 aa, Mycobacterium
RLPAHEWPQRALRVTAIDIAT

SEQ ID NO: 1278391 - protein, 18 aa, Mycobacterium
RLPATSSLLGIPALTAPW

SEQ ID NO: 1278392 - protein, 22 aa, Mycobacterium
RLPDRVSAAMSFHGGGLATDDP

SEQ ID NO: 1278393 - protein, 21 aa, Mycobacterium
RLPELRYVFVIDDRAGDQHTP

SEQ ID NO: 1278394 - protein, 18 aa, Mycobacterium
RLPFGVVEIKSAWVSDDP

SEQ ID NO: 1278395 - protein, 22 aa, Mycobacterium
RLPGYRCITPTLPLGAHTVPMR

SEQ ID NO: 1278396 - protein, 20 aa, Mycobacterium
RLPIEDSWTTITLREGGTPL

SEQ ID NO: 1278397 - protein, 19 aa, Mycobacterium
RLPLVGGLFTRGRLEAKAV

SEQ ID NO: 1278398 - protein, 19 aa, Mycobacterium
RLPRLAERYLQGRVSAQVV

SEQ ID NO: 1278399 - protein, 19 aa, Mycobacterium
RLQAYKVVNPLLVYRNDGA

SEQ ID NO: 1278400 - protein, 19 aa, Mycobacterium
RLQQRIAHLFATDPQFAAA

SEQ ID NO: 1278401 - protein, 23 aa, Mycobacterium
RLQRARPGLELVHDRLQAAVRTG

SEQ ID NO: 1278402 - protein, 19 aa, Mycobacterium
RLQSAVQFFPSRSATADIE

SEQ ID NO: 1278403 - protein, 20 aa, Mycobacterium
RLQSELRKTIVFVTHDIDEA

SEQ ID NO: 1278404 - protein, 22 aa, Mycobacterium
RLQSRIVPQFAAGAIITTPRHH

SEQ ID NO: 1278405 - protein, 19 aa, Mycobacterium
RLQVINWGVFDGYHDIPFS

SEQ ID NO: 1278406 - protein, 18 aa, Mycobacterium
RLQVSILDTGSWKTPRTE

SEQ ID NO: 1278407 - protein, 18 aa, Mycobacterium
RLRADPHAAALFLPAGRA

SEQ ID NO: 1278408 - protein, 29 aa, Mycobacterium
RLRAEHPVFRRRRFFSGKPVGRRGQAGLP

SEQ ID NO: 1278409 - protein, 19 aa, Mycobacterium
RLRAGVATGLAVSRAGDWF

SEQ ID NO: 1278410 - protein, 19 aa, Mycobacterium
RLRAKTILHGREIVLGMTR

SEQ ID NO: 1278411 - protein, 22 aa, Mycobacterium
RLRARSGVEFTVHMLRHTYATD

SEQ ID NO: 1278412 - protein, 17 aa, Mycobacterium
RLRDGGVLSSRRVLARQ

SEQ ID NO: 1278413 - protein, 22 aa, Mycobacterium
RLREAREALQTCYGKQESIAAI

SEQ ID NO: 1278414 - protein, 19 aa, Mycobacterium
RLREEIDRGLSYGLEAAPT

SEQ ID NO: 1278415 - protein, 22 aa, Mycobacterium
RLRELDFEFPLAGGDVRGGAPA

SEQ ID NO: 1278416 - protein, 24 aa, Mycobacterium
RLRELSKMDGAVVLSSDGSRILRA

SEQ ID NO: 1278417 - protein, 17 aa, Mycobacterium
RLRETGVITRAREFLMR

SEQ ID NO: 1278418 - protein, 23 aa, Mycobacterium
RLREYRDRYGVSYVIVQAPHEDA

SEQ ID NO: 1278419 - protein, 20 aa, Mycobacterium
RLRFVHGVTVIRSVDLGEGV

SEQ ID NO: 1278420 - protein, 28 aa, Mycobacterium
RLRGFARKLCRHAAGVMLQRGASPAARL

SEQ ID NO: 1278421 - protein, 17 aa, Mycobacterium
RLRGINLAFQQVETPTP

SEQ ID NO: 1278422 - protein, 19 aa, Mycobacterium
RLRGLLRRSAYLAPADDES

SEQ ID NO: 1278423 - protein, 21 aa, Mycobacterium
RLRGTCFGVTAGDDIGYAIAA

SEQ ID NO: 1278424 - protein, 20 aa, Mycobacterium
RLRKDIYDLYGYNAVVHVLS

SEQ ID NO: 1278425 - protein, 19 aa, Mycobacterium
RLRLDRAAAAFPEIQQIGF

SEQ ID NO: 1278426 - protein, 19 aa, Mycobacterium
RLRLPKPDWQVLLDVPTEL

SEQ ID NO: 1278427 - protein, 18 aa, Mycobacterium
RLRLREVGDSAYAACDTV

SEQ ID NO: 1278428 - protein, 19 aa, Mycobacterium
RLRNEKIAGITVPDLEVDD

SEQ ID NO: 1278429 - protein, 19 aa, Mycobacterium
RLRPDAWAMLYTGQNQTIA

SEQ ID NO: 1278430 - protein, 19 aa, Mycobacterium
RLRPSGRGADVWDELHPTP

SEQ ID NO: 1278431 - protein, 24 aa, Mycobacterium
RLRPYAELLVDGFGIPEQLRYAEM

SEQ ID NO: 1278432 - protein, 18 aa, Mycobacterium
RLRRFGADRLIDYIDYTT

SEQ ID NO: 1278433 - protein, 20 aa, Mycobacterium
RLRRLDAVCHACGLEPRLAV

SEQ ID NO: 1278434 - protein, 18 aa, Mycobacterium
RLRRLGLDDHLILEGISI

SEQ ID NO: 1278435 - protein, 25 aa, Mycobacterium
RLRRLPWLLRLVAWLPQPDPHRPPA

SEQ ID NO: 1278436 - protein, 31 aa, Mycobacterium
RLRSLEVQLDQCWDLLRQRRALRASGGDPDD

SEQ ID NO: 1278437 - protein, 18 aa, Mycobacterium
RLRSRGLHPTRSPEEYDA

SEQ ID NO: 1278438 - protein, 19 aa, Mycobacterium
RLRSTVVTVLMLDRTPDWG

SEQ ID NO: 1278439 - protein, 17 aa, Mycobacterium
RLRTGWSALGITLHHGR

SEQ ID NO: 1278440 - protein, 18 aa, Mycobacterium
RLRVILRRSGRGHEEPRT

SEQ ID NO: 1278441 - protein, 18 aa, Mycobacterium
RLRVLELEAGGTATQSEI

SEQ ID NO: 1278442 - protein, 18 aa, Mycobacterium
RLRYSTADLPGGRVPSEV

SEQ ID NO: 1278443 - protein, 19 aa, Mycobacterium
RLSAAVGLGDNIVWMNQVH

SEQ ID NO: 1278444 - protein, 24 aa, Mycobacterium
RLSARLISEISWRTRLVDGEQVLG

SEQ ID NO: 1278445 - protein, 24 aa, Mycobacterium
RLSARLVAEITWRTCLVDDEQVLA

SEQ ID NO: 1278446 - protein, 19 aa, Mycobacterium
RLSDVADYLLGEVLGLAEQ

SEQ ID NO: 1278447 - protein, 23 aa, Mycobacterium
RLSEAAVAFVGDFVRSGKPVAAI

SEQ ID NO: 1278448 - protein, 23 aa, Mycobacterium
RLSELLRTPGFVLIRERGAAAVD

SEQ ID NO: 1278449 - protein, 20 aa, Mycobacterium
RLSGGEVERAQRLCDLVLDL

SEQ ID NO: 1278450 - protein, 25 aa, Mycobacterium
RLSGGRFTLGIGRGIGAIYNAFGIP

SEQ ID NO: 1278451 - protein, 19 aa, Mycobacterium
RLSGPRNSLFSQLGGFAIP

SEQ ID NO: 1278452 - protein, 20 aa, Mycobacterium
RLSGTAVMDHMGWRSPRQTR

SEQ ID NO: 1278453 - protein, 26 aa, Mycobacterium
RLSHFNLSVGVSDSFMRAVERGDVHR

SEQ ID NO: 1278454 - protein, 20 aa, Mycobacterium
RLSIPAGATLMLYTDGLVER

SEQ ID NO: 1278455 - protein, 28 aa, Mycobacterium
RLSPDFPGERVLGMGFDRDVLIRAGIEQ

SEQ ID NO: 1278456 - protein, 26 aa, Mycobacterium
RLSPELRGRLVWAWRTDISGPAARLL

SEQ ID NO: 1278457 - protein, 18 aa, Mycobacterium
RLSPEVMEAEWLDGAAGP

SEQ ID NO: 1278458 - protein, 17 aa, Mycobacterium
RLSQRFLAYEGVMQKDK

SEQ ID NO: 1278459 - protein, 28 aa, Mycobacterium
RLSSDESGLRWVVGFNHDRDPGATYLYD

SEQ ID NO: 1278460 - protein, 24 aa, Mycobacterium
RLSWRSGGGSPHIAHPKLTMEASP

SEQ ID NO: 1278461 - protein, 26 aa, Mycobacterium
RLTAAKTRLAPMFSARTREDVVLAML

SEQ ID NO: 1278462 - protein, 21 aa, Mycobacterium
RLTAEFKASLMTRLMPGASAI

SEQ ID NO: 1278463 - protein, 17 aa, Mycobacterium
RLTALCAALTARREAVV

SEQ ID NO: 1278464 - protein, 19 aa, Mycobacterium
RLTAWVGLANIRSFRIRFT

SEQ ID NO: 1278465 - protein, 21 aa, Mycobacterium
RLTDAGAFRMFVPRQYGGEEM

SEQ ID NO: 1278466 - protein, 24 aa, Mycobacterium
RLTDPKAGPLIAVKLHILTRKSLG

SEQ ID NO: 1278467 - protein, 23 aa, Mycobacterium
RLTELPAGMPVAVVVRQLTEHVQ

SEQ ID NO: 1278468 - protein, 17 aa, Mycobacterium
RLTEVMLHSDYPLQALL

SEQ ID NO: 1278469 - protein, 24 aa, Mycobacterium
RLTKGQWAFEGKWDGYRLLVEADH

SEQ ID NO: 1278470 - protein, 17 aa, Mycobacterium
RLTMEFMGLANHRKALR

SEQ ID NO: 1278471 - protein, 17 aa, Mycobacterium
RLTMEFMGLATHRRELR

SEQ ID NO: 1278472 - protein, 24 aa, Mycobacterium
RLTMLRRRGWLHIRVINEDRPYEI

SEQ ID NO: 1278473 - protein, 20 aa, Mycobacterium
RLTPKLADGTVSWAPVWARY

SEQ ID NO: 1278474 - protein, 25 aa, Mycobacterium
RLTPREIDVLMALCRPLVSDDLFPE

SEQ ID NO: 1278475 - protein, 18 aa, Mycobacterium
RLTRDWRIPMVDVALATS

SEQ ID NO: 1278476 - protein, 18 aa, Mycobacterium
RLTRRIVAEAGIAVPRGR

SEQ ID NO: 1278477 - protein, 33 aa, Mycobacterium
RLTRSMTDACRRRVRVAIQFMAFLHTHDATPAT

SEQ ID NO: 1278478 - protein, 25 aa, Mycobacterium
RLTSARPDLDFSWLTVDFEPIIALR

SEQ ID NO: 1278479 - protein, 19 aa, Mycobacterium
RLVAFDVLGSGVGEHVLVT

SEQ ID NO: 1278480 - protein, 19 aa, Mycobacterium
RLVDAMAPRGARILDAGCG

SEQ ID NO: 1278481 - protein, 25 aa, Mycobacterium
RLVDGDIIWAPAIDGAIVLSTRGGD

SEQ ID NO: 1278482 - protein, 26 aa, Mycobacterium
RLVERHGVTVLHFMPGWLEMLAEVDG

SEQ ID NO: 1278483 - protein, 18 aa, Mycobacterium
RLVEVLLIEAMRVHTAAD

SEQ ID NO: 1278484 - protein, 20 aa, Mycobacterium
RLVGAGFDLQAFRDGLVVQR

SEQ ID NO: 1278485 - protein, 20 aa, Mycobacterium
RLVGLTGITFTNVFNACATA

SEQ ID NO: 1278486 - protein, 18 aa, Mycobacterium
RLVIASRAAGLPAPIDGP

SEQ ID NO: 1278487 - protein, 20 aa, Mycobacterium
RLVKAEAGQGGWRTVPGSER

SEQ ID NO: 1278488 - protein, 20 aa, Mycobacterium
RLVKAVAGQGNWETIVGSER

SEQ ID NO: 1278489 - protein, 20 aa, Mycobacterium
RLVLETAWEGLERAGYSAAA

SEQ ID NO: 1278490 - protein, 18 aa, Mycobacterium
RLVNEAAFQHQSDQGYLA

SEQ ID NO: 1278491 - protein, 18 aa, Mycobacterium
RLVRDGFRGPIVSTEATA

SEQ ID NO: 1278492 - protein, 19 aa, Mycobacterium
RLVVCGRIGDVLRYTQTVT

SEQ ID NO: 1278493 - protein, 18 aa, Mycobacterium
RLWADYLDMPPLRVDPAT

SEQ ID NO: 1278494 - protein, 21 aa, Mycobacterium
RLWEMSEDQWSAVIDVNLNGT

SEQ ID NO: 1278495 - protein, 18 aa, Mycobacterium
RLWYELLSSSALPAADDG

SEQ ID NO: 1278496 - protein, 19 aa, Mycobacterium
RLYDLSAHYVWIGERTRQL

SEQ ID NO: 1278497 - protein, 17 aa, Mycobacterium
RLYSWAEAASFATPFVA

SEQ ID NO: 1278498 - protein, 22 aa, Mycobacterium
RLYTPITVMGVTVWRERDLADV

SEQ ID NO: 1278499 - protein, 22 aa, Mycobacterium
RMACLKGGVVANVVVPTPDYVR

SEQ ID NO: 1278500 - protein, 17 aa, Mycobacterium
RMAHVIVGVLAARTHAH

SEQ ID NO: 1278501 - protein, 19 aa, Mycobacterium
RMALPNARILIHQPALGGV

SEQ ID NO: 1278502 - protein, 22 aa, Mycobacterium
RMASLRGLLKFREGVRPPVPLE

SEQ ID NO: 1278503 - protein, 20 aa, Mycobacterium
RMATGDIRATMALTEPGGGS

SEQ ID NO: 1278504 - protein, 21 aa, Mycobacterium
RMDAELAGAITAVSGSAQPVV

SEQ ID NO: 1278505 - protein, 25 aa, Mycobacterium
RMDIPRTAAPILRRLADTLQETVHV

SEQ ID NO: 1278506 - protein, 18 aa, Mycobacterium
RMEARVALAELFKRIRGY

SEQ ID NO: 1278507 - protein, 18 aa, Mycobacterium
RMEIKLMFNEIADQIPDI

SEQ ID NO: 1278508 - protein, 30 aa, Mycobacterium
RMEILPVSIGFPFGLSVLVPPNLPLPSKIV

SEQ ID NO: 1278509 - protein, 21 aa, Mycobacterium
RMEMQIAFPALLRRFPTLAPA

SEQ ID NO: 1278510 - protein, 25 aa, Mycobacterium
RMERARRAGAVGLIITTDWSFSSGR

SEQ ID NO: 1278511 - protein, 26 aa, Mycobacterium
RMFFEAARSGFRFNAVVNRMAVSDDR

SEQ ID NO: 1278512 - protein, 28 aa, Mycobacterium
RMGREVGPRVAARFGRALLELGGNNAAI

SEQ ID NO: 1278513 - protein, 26 aa, Mycobacterium
RMGVLDWQLVRRGSWSHDVGYALVGA

SEQ ID NO: 1278514 - protein, 17 aa, Mycobacterium
RMHHATCGRPFQPVVTC

SEQ ID NO: 1278515 - protein, 21 aa, Mycobacterium
RMIAEPLCLYDFCQETDGAVA

SEQ ID NO: 1278516 - protein, 22 aa, Mycobacterium
RMIERRIVLPLAQPDLAARYGV

SEQ ID NO: 1278517 - protein, 25 aa, Mycobacterium
RMLDRIDAKLGYPTRDPHGDPIPAA

SEQ ID NO: 1278518 - protein, 21 aa, Mycobacterium
RMLDVAPEFTLALIRDTFPNL

SEQ ID NO: 1278519 - protein, 27 aa, Mycobacterium
RMLEAMGLPELPVFILDSAVLADRVIV

SEQ ID NO: 1278520 - protein, 18 aa, Mycobacterium
RMLGRPGDGWQLAMDLLP

SEQ ID NO: 1278521 - protein, 20 aa, Mycobacterium
RMLMQRPTIILADEPVASLD

SEQ ID NO: 1278522 - protein, 19 aa, Mycobacterium
RMLSAWWSQVLGWPAENTD

SEQ ID NO: 1278523 - protein, 19 aa, Mycobacterium
RMNGGFFPSSREYSVRYGL

SEQ ID NO: 1278524 - protein, 24 aa, Mycobacterium
RMNPLPPRIVSAALVMPAPTANSG

SEQ ID NO: 1278525 - protein, 18 aa, Mycobacterium
RMNSMAFDVMVPLKTALD

SEQ ID NO: 1278526 - protein, 23 aa, Mycobacterium
RMPREVFERMGGLGILGVAIPEE

SEQ ID NO: 1278527 - protein, 24 aa, Mycobacterium
RMPRIAGPCSVVIFGVTGDLARKK

SEQ ID NO: 1278528 - protein, 24 aa, Mycobacterium
RMQAARWLRGYLRELIARRRRDPG

SEQ ID NO: 1278529 - protein, 24 aa, Mycobacterium
RMQGYEVLWLPGMDHAGIATQTVV

SEQ ID NO: 1278530 - protein, 22 aa, Mycobacterium
RMQHRWSIVMVDEFQDTDPVQW

SEQ ID NO: 1278531 - protein, 23 aa, Mycobacterium
RMRARIGDAPVYVSVDIDVLDPA

SEQ ID NO: 1278532 - protein, 19 aa, Mycobacterium
RMRDRKGYHVEYGFSCMGY

SEQ ID NO: 1278533 - protein, 25 aa, Mycobacterium
RMRLNEMLDCIPLLPRNIAHSDEQH

SEQ ID NO: 1278534 - protein, 19 aa, Mycobacterium
RMRVPAATLARVLIATNEG

SEQ ID NO: 1278535 - protein, 18 aa, Mycobacterium
RMRWPHGRMRYNLAMVAE

SEQ ID NO: 1278536 - protein, 18 aa, Mycobacterium
RMSKRAGTVITLDDLVDA

SEQ ID NO: 1278537 - protein, 20 aa, Mycobacterium
RMVVYLGGTNPRNWLVGEQA

SEQ ID NO: 1278538 - protein, 17 aa, Mycobacterium
RMWAAFLRFEPDLLDER

SEQ ID NO: 1278539 - protein, 19 aa, Mycobacterium
RMWRDGRVEQLGWPRVKIH

SEQ ID NO: 1278540 - protein, 25 aa, Mycobacterium
RMYPDSLDTMGWRVGASGFQLILSP

SEQ ID NO: 1278541 - protein, 18 aa, Mycobacterium
RNAAGKVLKGRLRDEHAT

SEQ ID NO: 1278542 - protein, 19 aa, Mycobacterium
RNAAGLGVDGVIFGSGCAD

SEQ ID NO: 1278543 - protein, 19 aa, Mycobacterium
RNAATYWRAKAKAGDGTVY

SEQ ID NO: 1278544 - protein, 19 aa, Mycobacterium
RNAGFRRLAGYIFGGNHSQ

SEQ ID NO: 1278545 - protein, 22 aa, Mycobacterium
RNAGPFGMGGAQSFFDQQTVIE

SEQ ID NO: 1278546 - protein, 20 aa, Mycobacterium
RNAKARLLRDNVVVAENLTI

SEQ ID NO: 1278547 - protein, 19 aa, Mycobacterium
RNALAIGAGHSFVIFLREG

SEQ ID NO: 1278548 - protein, 19 aa, Mycobacterium
RNAMEYARRDGFVAEDELF

SEQ ID NO: 1278549 - protein, 19 aa, Mycobacterium
RNARARIVLADLPDHPRKD

SEQ ID NO: 1278550 - protein, 25 aa, Mycobacterium
RNCVPYGQTCSIGYTAHTPADTLTD

SEQ ID NO: 1278551 - protein, 22 aa, Mycobacterium
RNDEIFGAAGAEAFKRDLPDGE

SEQ ID NO: 1278552 - protein, 18 aa, Mycobacterium
RNDREWYETAAELGVALR

SEQ ID NO: 1278553 - protein, 24 aa, Mycobacterium
RNDRPRIAGVSSFGFSGTNAHVLL

SEQ ID NO: 1278554 - protein, 38 aa, Mycobacterium
RNEAIIVVPRWWKALWYLERLSPALSMRTAAAALKRTR

SEQ ID NO: 1278555 - protein, 25 aa, Mycobacterium
RNEDSRWTVQLAWKAGLSDNVAHFR

SEQ ID NO: 1278556 - protein, 25 aa, Mycobacterium
RNEFAARLMFTFAFNRPGRKAAKLR

SEQ ID NO: 1278557 - protein, 24 aa, Mycobacterium
RNEIRVAVPVTFDLLRGSGQNVAP

SEQ ID NO: 1278558 - protein, 17 aa, Mycobacterium
RNFIRRLGVSPDHYRKT

SEQ ID NO: 1278559 - protein, 40 aa, Mycobacterium
RNFVKELLDRAYAKKFRFPTFVGAFKYYTSYTLKTFDGKR

SEQ ID NO: 1278560 - protein, 17 aa, Mycobacterium
RNFYALDRLWRDCPTVP

SEQ ID NO: 1278561 - protein, 22 aa, Mycobacterium
RNGAGVKFLCPAPGYDRHFAIT

SEQ ID NO: 1278562 - protein, 18 aa, Mycobacterium
RNGESPLAVLAPRSPSDC

SEQ ID NO: 1278563 - protein, 19 aa, Mycobacterium
RNGGRYANWYFSNGKDFDG

SEQ ID NO: 1278564 - protein, 18 aa, Mycobacterium
RNGLDYKVADLSLAEFGR

SEQ ID NO: 1278565 - protein, 19 aa, Mycobacterium
RNGPKVAAIVTHGFEDTIP

SEQ ID NO: 1278566 - protein, 22 aa, Mycobacterium
RNGRANPNFAARLDVIRLPIDI

SEQ ID NO: 1278567 - protein, 27 aa, Mycobacterium
RNGRRRISIYWTWSYPWEAQRDPAAMS

SEQ ID NO: 1278568 - protein, 18 aa, Mycobacterium
RNGVVVRALHLARVKIER

SEQ ID NO: 1278569 - protein, 17 aa, Mycobacterium
RNGYRACGIVGADEVYR

SEQ ID NO: 1278570 - protein, 18 aa, Mycobacterium
RNHAPRWRCSSRTRRPNS

SEQ ID NO: 1278571 - protein, 22 aa, Mycobacterium
RNHYIKTLGIWASRLEQHKEAA

SEQ ID NO: 1278572 - protein, 25 aa, Mycobacterium
RNIQHADLLVVRRGEKVTVEVNVVV

SEQ ID NO: 1278573 - protein, 23 aa, Mycobacterium
RNKLWKRYLEVVERANPRVFVIE

SEQ ID NO: 1278574 - protein, 19 aa, Mycobacterium
RNKTIVGWKRSMSATPVAS

SEQ ID NO: 1278575 - protein, 22 aa, Mycobacterium
RNLCLYPNVYLMDQFSTQIRHF

SEQ ID NO: 1278576 - protein, 17 aa, Mycobacterium
RNLFSAAGYFEALNTTA

SEQ ID NO: 1278577 - protein, 19 aa, Mycobacterium
RNLLKAAARDHLRQLRRLP

SEQ ID NO: 1278578 - protein, 17 aa, Mycobacterium
RNLLWLVFMDPAIRELL

SEQ ID NO: 1278579 - protein, 25 aa, Mycobacterium
RNLNWLKAWYEFAVPDIGRSSLIED

SEQ ID NO: 1278580 - protein, 17 aa, Mycobacterium
RNLPRALLVVGDAYTSA

SEQ ID NO: 1278581 - protein, 25 aa, Mycobacterium
RNLVVRLRMSIGMDALDELIDAELR

SEQ ID NO: 1278582 - protein, 25 aa, Mycobacterium
RNLWPVARRPVELVWGLVSQTPEMG

SEQ ID NO: 1278583 - protein, 17 aa, Mycobacterium
RNMAFYNMGLRLLRHVQ

SEQ ID NO: 1278584 - protein, 25 aa, Mycobacterium
RNNPKLRIGFAYGKAAVDNAAKDLF

SEQ ID NO: 1278585 - protein, 17 aa, Mycobacterium
RNNVLKLSQGEFVTVSR

SEQ ID NO: 1278586 - protein, 22 aa, Mycobacterium
RNPCAPPLVIRKEPDGSVKSDF

SEQ ID NO: 1278587 - protein, 17 aa, Mycobacterium
RNPRRPSWGEPYAEIAA

SEQ ID NO: 1278588 - protein, 20 aa, Mycobacterium
RNQGAFGFSEPCTECRGSGS

SEQ ID NO: 1278589 - protein, 25 aa, Mycobacterium
RNRAGELMVAPIVRQGLSQLAEVVT

SEQ ID NO: 1278590 - protein, 20 aa, Mycobacterium
RNRHAELRSAKALLGVRDEL

SEQ ID NO: 1278591 - protein, 18 aa, Mycobacterium
RNRLELLDKQSLMSTKPP

SEQ ID NO: 1278592 - protein, 21 aa, Mycobacterium
RNRTSPFAFTGNRFEFRAPGS

SEQ ID NO: 1278593 - protein, 21 aa, Mycobacterium
RNSLDWCLSAVIFDRPAEYLP

SEQ ID NO: 1278594 - protein, 24 aa, Mycobacterium
RNTACLRCMMGAVGSGDRGDADYG

SEQ ID NO: 1278595 - protein, 17 aa, Mycobacterium
RNTEQWIAAAAYPKYGH

SEQ ID NO: 1278596 - protein, 26 aa, Mycobacterium
RNTHGVSWLPLYHDMGLSMIGFPAVY

SEQ ID NO: 1278597 - protein, 19 aa, Mycobacterium
RNVCDEIKTLAADIRAGNG

SEQ ID NO: 1278598 - protein, 21 aa, Mycobacterium
RNVEVPDHFRSYVAEKLSRLE

SEQ ID NO: 1278599 - protein, 18 aa, Mycobacterium
RNVGFVFQHFNLVGRLSC

SEQ ID NO: 1278600 - protein, 19 aa, Mycobacterium
RNVKGPGVVPVLSETPGTI

SEQ ID NO: 1278601 - protein, 26 aa, Mycobacterium
RNVLFGRWTFQVVEEFDDSYWSVLRE

SEQ ID NO: 1278602 - protein, 24 aa, Mycobacterium
RNVLPRLTAQRGILQAVDLTAMEL

SEQ ID NO: 1278603 - protein, 19 aa, Mycobacterium
RNVPFHALVTYRDLGIEPV

SEQ ID NO: 1278604 - protein, 24 aa, Mycobacterium
RNVSRGAVDVALFAIAQVVEPTAE

SEQ ID NO: 1278605 - protein, 25 aa, Mycobacterium
RNVWANAVIFCGHFPDGAEKFTKTD

SEQ ID NO: 1278606 - protein, 17 aa, Mycobacterium
RNWDYRYAWVRDSTFAL

SEQ ID NO: 1278607 - protein, 20 aa, Mycobacterium
RNWITRAGMGIQYLLLRSGP

SEQ ID NO: 1278608 - protein, 17 aa, Mycobacterium
RNWREALELPPERHVDT

SEQ ID NO: 1278609 - protein, 24 aa, Mycobacterium
RNYLLPRGLAIVATRGAQRQADDI

SEQ ID NO: 1278610 - protein, 20 aa, Mycobacterium
RPAAALGGLDLRWAAVDLDG

SEQ ID NO: 1278611 - protein, 23 aa, Mycobacterium
RPAALERRGLGPADVPARRGRIW

SEQ ID NO: 1278612 - protein, 20 aa, Mycobacterium
RPAAYALRWSDHCPVTVHYA

SEQ ID NO: 1278613 - protein, 26 aa, Mycobacterium
RPADGAPAWLRFLGVNPRHHSLAFMP

SEQ ID NO: 1278614 - protein, 21 aa, Mycobacterium
RPAFGDSYGGLAIAAGIAAAL

SEQ ID NO: 1278615 - protein, 17 aa, Mycobacterium
RPAGVVLALTPTTNPVA

SEQ ID NO: 1278616 - protein, 22 aa, Mycobacterium
RPAIAGPLLRPFFEAYQIVADA

SEQ ID NO: 1278617 - protein, 19 aa, Mycobacterium
RPALEIIRTAPGVSTVSSI

SEQ ID NO: 1278618 - protein, 26 aa, Mycobacterium
RPALLSVSFGDDWAWVRRAHDAGCVT

SEQ ID NO: 1278619 - protein, 26 aa, Mycobacterium
RPALLSVSFGEDWSWVRRAHEVGATA

SEQ ID NO: 1278620 - protein, 17 aa, Mycobacterium
RPAPGKGGLSLWVRLPA

SEQ ID NO: 1278621 - protein, 18 aa, Mycobacterium
RPAPLLVLLAGGQEAVAV

SEQ ID NO: 1278622 - protein, 28 aa, Mycobacterium
RPAPRIVAGIPVCLCANSEIDAAKDRAN

SEQ ID NO: 1278623 - protein, 31 aa, Mycobacterium
RPARDLKFYAFYGEVLFVLEVRRQPNLEACY

SEQ ID NO: 1278624 - protein, 19 aa, Mycobacterium
RPASGEPRPLLNGGGHGEL

SEQ ID NO: 1278625 - protein, 31 aa, Mycobacterium
RPASGPGIAWPEGWSVWKSRRYGDTRLEMAA

SEQ ID NO: 1278626 - protein, 20 aa, Mycobacterium
RPATGGQFLIRLAGAPELRA

SEQ ID NO: 1278627 - protein, 19 aa, Mycobacterium
RPATITLDPGLEWVGLEIV

SEQ ID NO: 1278628 - protein, 24 aa, Mycobacterium
RPATITLDPGLEWVGLEIVDVAAG

SEQ ID NO: 1278629 - protein, 19 aa, Mycobacterium
RPAVLKLGFPDDESEHEHL

SEQ ID NO: 1278630 - protein, 17 aa, Mycobacterium
RPAWNTDRFVRDFFGPA

SEQ ID NO: 1278631 - protein, 23 aa, Mycobacterium
RPAYDVAAFWARSGLAHLLTRPG

SEQ ID NO: 1278632 - protein, 22 aa, Mycobacterium
RPDAEVSRALGLRRTDQVHRIL

SEQ ID NO: 1278633 - protein, 26 aa, Mycobacterium
RPDAFPLIITHGWPGSVVEFHKVIEP

SEQ ID NO: 1278634 - protein, 18 aa, Mycobacterium
RPDALLLLGDQVYADELT

SEQ ID NO: 1278635 - protein, 21 aa, Mycobacterium
RPDAMAVGLIRELARDPTPTN

SEQ ID NO: 1278636 - protein, 17 aa, Mycobacterium
RPDAVICATGYTRGLDA

SEQ ID NO: 1278637 - protein, 20 aa, Mycobacterium
RPDDAWLATWSRAEAAVPHP

SEQ ID NO: 1278638 - protein, 20 aa, Mycobacterium
RPDEIASLIAYLCSEAAGYV

SEQ ID NO: 1278639 - protein, 32 aa, Mycobacterium
RPDELHTAFQFDFLRTPWRAQMLREVIDDAID

SEQ ID NO: 1278640 - protein, 20 aa, Mycobacterium
RPDERWPAGEFVNQSAQDTG

SEQ ID NO: 1278641 - protein, 19 aa, Mycobacterium
RPDGAVVLRDIRRTYNGVM

SEQ ID NO: 1278642 - protein, 19 aa, Mycobacterium
RPDKHIAWRSMSMPDQPHA

SEQ ID NO: 1278643 - protein, 20 aa, Mycobacterium
RPDLIASMGARTRIGYPLRT

SEQ ID NO: 1278644 - protein, 17 aa, Mycobacterium
RPDLVIMDVKMPRRDGI

SEQ ID NO: 1278645 - protein, 18 aa, Mycobacterium
RPDLVLLDLNLPKYDGRQ

SEQ ID NO: 1278646 - protein, 18 aa, Mycobacterium
RPDLVRKVVDKVRRDGPM

SEQ ID NO: 1278647 - protein, 26 aa, Mycobacterium
RPDPSPRIRLWWRPAEPMPDDPILNS

SEQ ID NO: 1278648 - protein, 23 aa, Mycobacterium
RPDSDAWLLLSMLHVIFEEDLAD

SEQ ID NO: 1278649 - protein, 20 aa, Mycobacterium
RPDSGGRWRADFAEVEPDPV

SEQ ID NO: 1278650 - protein, 17 aa, Mycobacterium
RPDVGRNEPCWCGSGRK

SEQ ID NO: 1278651 - protein, 23 aa, Mycobacterium
RPDVIFCSFGDMLRVPGSSQDLF

SEQ ID NO: 1278652 - protein, 26 aa, Mycobacterium
RPDVKRIAVRLGPWMEPEQVCFAITR

SEQ ID NO: 1278653 - protein, 23 aa, Mycobacterium
RPDVVFCSFGDMLRVPGSEKDLF

SEQ ID NO: 1278654 - protein, 26 aa, Mycobacterium
RPDYFTHWGGAFKFAASVLGLPIGSY

SEQ ID NO: 1278655 - protein, 22 aa, Mycobacterium
RPEARNALSRDLIRALYASLSE

SEQ ID NO: 1278656 - protein, 22 aa, Mycobacterium
RPEARNALSRDLIRVLYASLSE

SEQ ID NO: 1278657 - protein, 23 aa, Mycobacterium
RPEDEHRLLAALLSCFLRHEALP

SEQ ID NO: 1278658 - protein, 21 aa, Mycobacterium
RPEGFKEWHHFVVHGPDQRLL

SEQ ID NO: 1278659 - protein, 20 aa, Mycobacterium
RPEGGWSPNIYGGRENLEAV

SEQ ID NO: 1278660 - protein, 19 aa, Mycobacterium
RPEGLRWLDSCQEALRASS

SEQ ID NO: 1278661 - protein, 18 aa, Mycobacterium
RPELDGQQLLLVEQGVRN

SEQ ID NO: 1278662 - protein, 19 aa, Mycobacterium
RPELMCLYQPLGGEYAGTR

SEQ ID NO: 1278663 - protein, 20 aa, Mycobacterium
RPELWPNAVEEILRLDSPVQ

SEQ ID NO: 1278664 - protein, 21 aa, Mycobacterium
RPETIDIPGVVPIQLDITDPE

SEQ ID NO: 1278665 - protein, 17 aa, Mycobacterium
RPEVAGVLLEGIWSAYR

SEQ ID NO: 1278666 - protein, 24 aa, Mycobacterium
RPFFLMDRVEGIVPPDVMPYTFGD

SEQ ID NO: 1278667 - protein, 23 aa, Mycobacterium
RPFGKARITLRLHDLDGGGCVIE

SEQ ID NO: 1278668 - protein, 23 aa, Mycobacterium
RPFPDGRYSTYHMGLQFDLAKDG

SEQ ID NO: 1278669 - protein, 25 aa, Mycobacterium
RPFRMMRLDEVIDLYPTLADAMGER

SEQ ID NO: 1278670 - protein, 17 aa, Mycobacterium
RPGAEPGTIRLALLDNV

SEQ ID NO: 1278671 - protein, 25 aa, Mycobacterium
RPGAPDMQSTLWIGPLGGRAAQALE

SEQ ID NO: 1278672 - protein, 18 aa, Mycobacterium
RPGAQTGVDRALRLDTTV

SEQ ID NO: 1278673 - protein, 20 aa, Mycobacterium
RPGARRVAVVRLPRISNFTD

SEQ ID NO: 1278674 - protein, 19 aa, Mycobacterium
RPGAYRFGTVGIPFPGTEV

SEQ ID NO: 1278675 - protein, 21 aa, Mycobacterium
RPGCAVAVRLEAGRSRETFAV

SEQ ID NO: 1278676 - protein, 17 aa, Mycobacterium
RPGDGWQLAMDLLPYER

SEQ ID NO: 1278677 - protein, 20 aa, Mycobacterium
RPGDVISLGATSWRITEITH

SEQ ID NO: 1278678 - protein, 22 aa, Mycobacterium
RPGEVRVGTSLVGICGSDLHAA

SEQ ID NO: 1278679 - protein, 22 aa, Mycobacterium
RPGGLELTSRVLAAAKIAGADV

SEQ ID NO: 1278680 - protein, 18 aa, Mycobacterium
RPGGQVWTTALTVGDALT

SEQ ID NO: 1278681 - protein, 17 aa, Mycobacterium
RPGHVICLIMTDGMENA

SEQ ID NO: 1278682 - protein, 24 aa, Mycobacterium
RPGIDAAPQFPPRLRVDNAGGLAA

SEQ ID NO: 1278683 - protein, 17 aa, Mycobacterium
RPGLADLMAYVRDGDTV

SEQ ID NO: 1278684 - protein, 20 aa, Mycobacterium
RPGMHLAPTHLRNHLRPVLA

SEQ ID NO: 1278685 - protein, 20 aa, Mycobacterium
RPGNGRTEWTPPKEQDTGQP

SEQ ID NO: 1278686 - protein, 17 aa, Mycobacterium
RPGNGRTQWTPPEDHDT

SEQ ID NO: 1278687 - protein, 20 aa, Mycobacterium
RPGPAELLYFGRLEYEKGVH

SEQ ID NO: 1278688 - protein, 21 aa, Mycobacterium
RPGQDVWVYGRAGLPCRRCGT

SEQ ID NO: 1278689 - protein, 22 aa, Mycobacterium
RPGQPESWPQWAHPDVVRAFVD

SEQ ID NO: 1278690 - protein, 27 aa, Mycobacterium
RPGRAPLSVPIWYGYEPGGEVLLWTEA

SEQ ID NO: 1278691 - protein, 19 aa, Mycobacterium
RPGRMWWSVPRGVTTFHTW

SEQ ID NO: 1278692 - protein, 23 aa, Mycobacterium
RPGTDAWCLAAMAAVLVQEDLCD

SEQ ID NO: 1278693 - protein, 18 aa, Mycobacterium
RPGTQVGELSRRAADETG

SEQ ID NO: 1278694 - protein, 17 aa, Mycobacterium
RPGTRPLDVVYPAVQRD

SEQ ID NO: 1278695 - protein, 21 aa, Mycobacterium
RPGYLRFDFNWQGALTDDQRS

SEQ ID NO: 1278696 - protein, 20 aa, Mycobacterium
RPHAVVKGGMIAWAAMGDAN

SEQ ID NO: 1278697 - protein, 24 aa, Mycobacterium
RPIEWRYTNDPAWIMRDKGEKLTH

SEQ ID NO: 1278698 - protein, 17 aa, Mycobacterium
RPIGLMLGLELSGNPFV

SEQ ID NO: 1278699 - protein, 19 aa, Mycobacterium
RPIHEWLEVRPLMTASGTL

SEQ ID NO: 1278700 - protein, 18 aa, Mycobacterium
RPILHGLCTYGMTCKALV

SEQ ID NO: 1278701 - protein, 24 aa, Mycobacterium
RPILRCVRHPGPTPPVLLIDEIDR

SEQ ID NO: 1278702 - protein, 20 aa, Mycobacterium
RPIPDSGDWEVIRKAGTEIR

SEQ ID NO: 1278703 - protein, 19 aa, Mycobacterium
RPIREPVFQYGPFVMNSKS

SEQ ID NO: 1278704 - protein, 19 aa, Mycobacterium
RPKRYEFVDELPKNSYGKV

SEQ ID NO: 1278705 - protein, 19 aa, Mycobacterium
RPKVMYEFRKHSGSVLSGL

SEQ ID NO: 1278706 - protein, 18 aa, Mycobacterium
RPKYVTLVDVLPRNAAGK

SEQ ID NO: 1278707 - protein, 28 aa, Mycobacterium
RPLARFSSWYEFFPRSTGGWDSAGHPVH

SEQ ID NO: 1278708 - protein, 18 aa, Mycobacterium
RPLDGIATLADWIATVNK

SEQ ID NO: 1278709 - protein, 17 aa, Mycobacterium
RPLEIGGALAGCPDATL

SEQ ID NO: 1278710 - protein, 21 aa, Mycobacterium
RPLEILGAATLDLESVLAAWE

SEQ ID NO: 1278711 - protein, 23 aa, Mycobacterium
RPLFGVPGLNRFVRASRRLARLT

SEQ ID NO: 1278712 - protein, 18 aa, Mycobacterium
RPLGELLPDAFGPDDLAR

SEQ ID NO: 1278713 - protein, 21 aa, Mycobacterium
RPLKLVGIADIVALYPNLEEA

SEQ ID NO: 1278714 - protein, 24 aa, Mycobacterium
RPLMDFTPGYVLRALDYLPKAGSR

SEQ ID NO: 1278715 - protein, 17 aa, Mycobacterium
RPLPEVRRPRIPINATV

SEQ ID NO: 1278716 - protein, 17 aa, Mycobacterium
RPLPGVDAYVVHRAADG

SEQ ID NO: 1278717 - protein, 18 aa, Mycobacterium
RPLPPFNYVPELLGAGAP

SEQ ID NO: 1278718 - protein, 18 aa, Mycobacterium
RPLQGRAAWRERLAVEAA

SEQ ID NO: 1278719 - protein, 20 aa, Mycobacterium
RPLRDCYRIAMLSQKGGVGK

SEQ ID NO: 1278720 - protein, 18 aa, Mycobacterium
RPLRIGLGIMDEPRRHRQ

SEQ ID NO: 1278721 - protein, 23 aa, Mycobacterium
RPLSHIRSATGLEIDRVERFKLG

SEQ ID NO: 1278722 - protein, 24 aa, Mycobacterium
RPLTAEYAFLVWLRQSRINTTLRV

SEQ ID NO: 1278723 - protein, 19 aa, Mycobacterium
RPLVIPMLHLRGDSDPYVL

SEQ ID NO: 1278724 - protein, 20 aa, Mycobacterium
RPMATLTFSGAQAVRLSGDG

SEQ ID NO: 1278725 - protein, 19 aa, Mycobacterium
RPMCGVLSGAARFTERLTL

SEQ ID NO: 1278726 - protein, 19 aa, Mycobacterium
RPMHEKIVGRIAVSDLARR

SEQ ID NO: 1278727 - protein, 18 aa, Mycobacterium
RPMLRRIRMSDTTMTGAD

SEQ ID NO: 1278728 - protein, 17 aa, Mycobacterium
RPNAHLLPVPTARQNFE

SEQ ID NO: 1278729 - protein, 18 aa, Mycobacterium
RPNALLGGDFYDFVQTPD

SEQ ID NO: 1278730 - protein, 18 aa, Mycobacterium
RPNTPVWHRLQTDYLDNL

SEQ ID NO: 1278731 - protein, 17 aa, Mycobacterium
RPPAPLHVLRLAAMLPW

SEQ ID NO: 1278732 - protein, 17 aa, Mycobacterium
RPPAVLWRLREQLDIEL

SEQ ID NO: 1278733 - protein, 24 aa, Mycobacterium
RPPEELRRFLTRWLGSAILAQSVK

SEQ ID NO: 1278734 - protein, 23 aa, Mycobacterium
RPPGREAFPGDVFYLHSRLLERC

SEQ ID NO: 1278735 - protein, 20 aa, Mycobacterium
RPPHKRICVAVRGEVDAANA

SEQ ID NO: 1278736 - protein, 23 aa, Mycobacterium
RPPRAGGAPRRRRRPLWVGVATG

SEQ ID NO: 1278737 - protein, 19 aa, Mycobacterium
RPPRFLDELQEAVIRGVQV

SEQ ID NO: 1278738 - protein, 24 aa, Mycobacterium
RPPRRRCAPSRPRPAGTGAAARSP

SEQ ID NO: 1278739 - protein, 24 aa, Mycobacterium
RPPRTRSGGPLPRTGDAVADITAA

SEQ ID NO: 1278740 - protein, 30 aa, Mycobacterium
RPPTLTAMVAWALLYPEGRRADDYDQRYAR

SEQ ID NO: 1278741 - protein, 21 aa, Mycobacterium
RPQEGRWSRVVIEKPFGHDLE

SEQ ID NO: 1278742 - protein, 37 aa, Mycobacterium
RPQPGLRWPWHARLGTAAVCWRLRRRHGLQVHDIAPM

SEQ ID NO: 1278743 - protein, 24 aa, Mycobacterium
RPQQWRGAMEIDRLTEAISLRDRV

SEQ ID NO: 1278744 - protein, 19 aa, Mycobacterium
RPQTVLWWLRKKPGTGPQL

SEQ ID NO: 1278745 - protein, 21 aa, Mycobacterium
RPRANVGMYVLDRLMRPVPPG

SEQ ID NO: 1278746 - protein, 18 aa, Mycobacterium
RPRGFWAVGAHRDIADIS

SEQ ID NO: 1278747 - protein, 25 aa, Mycobacterium
RPRHGLDPIRFGLAAFVVTAPTQRE

SEQ ID NO: 1278748 - protein, 19 aa, Mycobacterium
RPRLLSLAHRLLGSAHDAE

SEQ ID NO: 1278749 - protein, 19 aa, Mycobacterium
RPRLNPLDWMNGAWRATLA

SEQ ID NO: 1278750 - protein, 20 aa, Mycobacterium
RPRPADLLIAGGRIEAVAAP

SEQ ID NO: 1278751 - protein, 18 aa, Mycobacterium
RPRPARLVPGDRPDGVYT

SEQ ID NO: 1278752 - protein, 19 aa, Mycobacterium
RPRSRPMIPAKDDFYEPPA

SEQ ID NO: 1278753 - protein, 19 aa, Mycobacterium
RPRVAVLEAVHAHPHADTE

SEQ ID NO: 1278754 - protein, 19 aa, Mycobacterium
RPRWGWRRAAKMARKAGWK

SEQ ID NO: 1278755 - protein, 19 aa, Mycobacterium
RPSASRSCLGRTIRPPESM

SEQ ID NO: 1278756 - protein, 20 aa, Mycobacterium
RPSDVLALKIADFGNPSLLA

SEQ ID NO: 1278757 - protein, 18 aa, Mycobacterium
RPSGAFFPVEQLLVHAQW

SEQ ID NO: 1278758 - protein, 19 aa, Mycobacterium
RPSLDDVFLTLTGHRTEDS

SEQ ID NO: 1278759 - protein, 23 aa, Mycobacterium
RPSPGGCCPCRPGPWRAARPAAD

SEQ ID NO: 1278760 - protein, 17 aa, Mycobacterium
RPSPHLGTIEVRIFDGV

SEQ ID NO: 1278761 - protein, 20 aa, Mycobacterium
RPSRHVLPDAGYVRLACGGD

SEQ ID NO: 1278762 - protein, 27 aa, Mycobacterium
RPSSRRELAATMVLRLAIGDDNWSLKV

SEQ ID NO: 1278763 - protein, 18 aa, Mycobacterium
RPSVWGHQMVAQTPPGAL

SEQ ID NO: 1278764 - protein, 19 aa, Mycobacterium
RPTGTFTFAELLAHELAVE

SEQ ID NO: 1278765 - protein, 20 aa, Mycobacterium
RPTHEHPLVWTHRTGRKSLV

SEQ ID NO: 1278766 - protein, 17 aa, Mycobacterium
RPTHLVLDLDPPGGADF

SEQ ID NO: 1278767 - protein, 17 aa, Mycobacterium
RPTLVASILDYAARPER

SEQ ID NO: 1278768 - protein, 21 aa, Mycobacterium
RPTPELGITMEVFLARLTEYR

SEQ ID NO: 1278769 - protein, 19 aa, Mycobacterium
RPTSPYGPLVWYYDNPSRE

SEQ ID NO: 1278770 - protein, 17 aa, Mycobacterium
RPTVASVIIGARNEEQL

SEQ ID NO: 1278771 - protein, 19 aa, Mycobacterium
RPVAMLDRFTVPGWHAAVK

SEQ ID NO: 1278772 - protein, 18 aa, Mycobacterium
RPVITNMIRLLRLPIAVQ

SEQ ID NO: 1278773 - protein, 19 aa, Mycobacterium
RPVIWGRRKAAAVQEFCAG

SEQ ID NO: 1278774 - protein, 17 aa, Mycobacterium
RPVLDAHGWGDLQPELN

SEQ ID NO: 1278775 - protein, 22 aa, Mycobacterium
RPVLETHGAQALTVYVGNPVAH

SEQ ID NO: 1278776 - protein, 20 aa, Mycobacterium
RPVLVRAFNVLRQYPVEAVH

SEQ ID NO: 1278777 - protein, 19 aa, Mycobacterium
RPVNALRGFLDAVATVITR

SEQ ID NO: 1278778 - protein, 18 aa, Mycobacterium
RPVPSTPTAPTFVAQPLD

SEQ ID NO: 1278779 - protein, 18 aa, Mycobacterium
RPVRELTPTLKFCTIHGY

SEQ ID NO: 1278780 - protein, 19 aa, Mycobacterium
RPVTRTVLCKSVDDTGITF

SEQ ID NO: 1278781 - protein, 26 aa, Mycobacterium
RPWEEAVALAADWIWERSREEDLAPL

SEQ ID NO: 1278782 - protein, 19 aa, Mycobacterium
RPWSRWTPPVELFEPAVTE

SEQ ID NO: 1278783 - protein, 17 aa, Mycobacterium
RPYAVVLGGSKVSDKLA

SEQ ID NO: 1278784 - protein, 20 aa, Mycobacterium
RPYRDYIGWLAGRDEETGRA

SEQ ID NO: 1278785 - protein, 20 aa, Mycobacterium
RPYRDYIGWLAGRDQAASRA

SEQ ID NO: 1278786 - protein, 23 aa, Mycobacterium
RPYTACGYAPMAELLRYLEGHGF

SEQ ID NO: 1278787 - protein, 19 aa, Mycobacterium
RPYYNAIVWQDTRTDRIAS

SEQ ID NO: 1278788 - protein, 18 aa, Mycobacterium
RQAAVAGGIPWDVASLTI

SEQ ID NO: 1278789 - protein, 17 aa, Mycobacterium
RQAAYCASKGGLINLTR

SEQ ID NO: 1278790 - protein, 23 aa, Mycobacterium
RQADFLTLASLKWVIANRAYTPW

SEQ ID NO: 1278791 - protein, 19 aa, Mycobacterium
RQAERPILLVGHGVHTSRT

SEQ ID NO: 1278792 - protein, 29 aa, Mycobacterium
RQALTMYAGLEFLRGLRVVPAELGGDAGL

SEQ ID NO: 1278793 - protein, 20 aa, Mycobacterium
RQALVPGRIPPYVVGLVELA

SEQ ID NO: 1278794 - protein, 29 aa, Mycobacterium
RQAPELAAWPRSPEWTGAGAVATPAAPTV

SEQ ID NO: 1278795 - protein, 28 aa, Mycobacterium
RQARALCPQAIVVPPRMSAYSSASAAVF

SEQ ID NO: 1278796 - protein, 17 aa, Mycobacterium
RQARFVERFPVPVGGYG

SEQ ID NO: 1278797 - protein, 17 aa, Mycobacterium
RQARWVDFDNDYKTLDL

SEQ ID NO: 1278798 - protein, 26 aa, Mycobacterium
RQCPADRFEVVATFAGRGDQLNDLRQ

SEQ ID NO: 1278799 - protein, 25 aa, Mycobacterium
RQDGCVVGGTAWDFANDNKFTRGCL

SEQ ID NO: 1278800 - protein, 33 aa, Mycobacterium
RQDPNKAIARFIVRYTEAFKKYGITDDTVQAAT

SEQ ID NO: 1278801 - protein, 18 aa, Mycobacterium
RQECEAVIAQVDRIADAA

SEQ ID NO: 1278802 - protein, 26 aa, Mycobacterium
RQEFGEWLKRFFVIDEVRFSDVVLAI

SEQ ID NO: 1278803 - protein, 19 aa, Mycobacterium
RQELLGGRFVTAMTGSAPI

SEQ ID NO: 1278804 - protein, 23 aa, Mycobacterium
RQEPWGVWGGEIFERGTIVARKR

SEQ ID NO: 1278805 - protein, 19 aa, Mycobacterium
RQFDEWDVRIVPRDRLGVR

SEQ ID NO: 1278806 - protein, 24 aa, Mycobacterium
RQFSLGEVFTEWQVSLSADNIGAL

SEQ ID NO: 1278807 - protein, 28 aa, Mycobacterium
RQGDWIYIPKACTWRQVPSEETTLLMIQ

SEQ ID NO: 1278808 - protein, 18 aa, Mycobacterium
RQGLPEGDFFGVIVQLPG

SEQ ID NO: 1278809 - protein, 19 aa, Mycobacterium
RQHEADTPFFVWFNSTHMH

SEQ ID NO: 1278810 - protein, 20 aa, Mycobacterium
RQHLLEALVARKTRRHQIEI

SEQ ID NO: 1278811 - protein, 18 aa, Mycobacterium
RQHLMVLHIIALYHRLKT

SEQ ID NO: 1278812 - protein, 20 aa, Mycobacterium
RQIRCTRRWWDAVDDQQGMP

SEQ ID NO: 1278813 - protein, 19 aa, Mycobacterium
RQKDHSWSRVVIEKPFGHD

SEQ ID NO: 1278814 - protein, 34 aa, Mycobacterium
RQKRLMDLIHLWLIHRFKAEIVYYVTPTEDNIYQ

SEQ ID NO: 1278815 - protein, 37 aa, Mycobacterium
RQLAARHRSMWASGDYPRLAAELVAPLGPVLVEAAGI

SEQ ID NO: 1278816 - protein, 21 aa, Mycobacterium
RQLADLGARVIKVERPMVGDF

SEQ ID NO: 1278817 - protein, 18 aa, Mycobacterium
RQLAPWQKRYPGVAVERV

SEQ ID NO: 1278818 - protein, 20 aa, Mycobacterium
RQLARGWRSTDLEASKDRDR

SEQ ID NO: 1278819 - protein, 17 aa, Mycobacterium
RQLARKGAGLGPEELDE

SEQ ID NO: 1278820 - protein, 22 aa, Mycobacterium
RQLDAVASRAARIGRVTPALIK

SEQ ID NO: 1278821 - protein, 18 aa, Mycobacterium
RQLEDGAVQMKVFTEKPL

SEQ ID NO: 1278822 - protein, 19 aa, Mycobacterium
RQLKNASLVSSRRQGKLVM

SEQ ID NO: 1278823 - protein, 25 aa, Mycobacterium
RQLPWLTRLGRVFTYDAPWHRGRDV

SEQ ID NO: 1278824 - protein, 18 aa, Mycobacterium
RQLRELLAGVARDRGFIR

SEQ ID NO: 1278825 - protein, 18 aa, Mycobacterium
RQLRLTAAMFPADIVADV

SEQ ID NO: 1278826 - protein, 21 aa, Mycobacterium
RQLRNSWYILFFQLPGLPERL

SEQ ID NO: 1278827 - protein, 23 aa, Mycobacterium
RQLRRARDPVGIEAAIIEAAAGR

SEQ ID NO: 1278828 - protein, 17 aa, Mycobacterium
RQLSVSVARTLAAGGDA

SEQ ID NO: 1278829 - protein, 28 aa, Mycobacterium
RQLSYFWPRVVGTTDWQLMDSKFAVVAQ

SEQ ID NO: 1278830 - protein, 25 aa, Mycobacterium
RQMDIPPKLAIPMRVIASIVAISCQ

SEQ ID NO: 1278831 - protein, 24 aa, Mycobacterium
RQMIADRELETWLVVDVSASLDFG

SEQ ID NO: 1278832 - protein, 29 aa, Mycobacterium
RQMIRDVILPWAMGDHRLGDDVLEVGPGY

SEQ ID NO: 1278833 - protein, 19 aa, Mycobacterium
RQMLPEIRPSSSPEPHGVT

SEQ ID NO: 1278834 - protein, 45 aa, Mycobacterium
RQPDYLTAFAGLWADESLEDWKNWLRWRVIHARAFLLTDELIAED

SEQ ID NO: 1278835 - protein, 22 aa, Mycobacterium
RQPEVYGATTLAEIEARVAEVA

SEQ ID NO: 1278836 - protein, 24 aa, Mycobacterium
RQPHAKGGGAFGQFEVTQDVSGYT

SEQ ID NO: 1278837 - protein, 26 aa, Mycobacterium
RQPVTRARVSAVRGVNVDAVIRTLLA

SEQ ID NO: 1278838 - protein, 24 aa, Mycobacterium
RQPWMRWGGPCFDRVAVWRRRGSC

SEQ ID NO: 1278839 - protein, 19 aa, Mycobacterium
RQQFSRVRVFAFIDTTDEV

SEQ ID NO: 1278840 - protein, 19 aa, Mycobacterium
RQRDAIIERCLPLADHIAR

SEQ ID NO: 1278841 - protein, 29 aa, Mycobacterium
RQRHDGRWIWRWDPAFIHSNFDFLRDEST

SEQ ID NO: 1278842 - protein, 19 aa, Mycobacterium
RQRHIPLGPVAVFSASNFP

SEQ ID NO: 1278843 - protein, 27 aa, Mycobacterium
RQRIRARLGAAAEAFGADEQFFGGDTE

SEQ ID NO: 1278844 - protein, 23 aa, Mycobacterium
RQRLGAYVRWALQSRHRRSDLVM

SEQ ID NO: 1278845 - protein, 21 aa, Mycobacterium
RQRMALFFDVVCGWIAAEPDV

SEQ ID NO: 1278846 - protein, 20 aa, Mycobacterium
RQRPAVHALYGFARFADDIL

SEQ ID NO: 1278847 - protein, 18 aa, Mycobacterium
RQRSEARVGIGLPAADPG

SEQ ID NO: 1278848 - protein, 40 aa, Mycobacterium
RQRYPIIPCKDGHVRICILSRRQWHGMFALMGSPEEFADP

SEQ ID NO: 1278849 - protein, 20 aa, Mycobacterium
RQSKEAIILYGMRRTADLGA

SEQ ID NO: 1278850 - protein, 22 aa, Mycobacterium
RQSLDASAAWAACGQVTSDDRY

SEQ ID NO: 1278851 - protein, 19 aa, Mycobacterium
RQSRCRTIGPELPAGGCGR

SEQ ID NO: 1278852 - protein, 26 aa, Mycobacterium
RQSRLRLWLLDCGFPRPQTQIPVLEG

SEQ ID NO: 1278853 - protein, 19 aa, Mycobacterium
RQSTVAGTGLRWLRVDHAG

SEQ ID NO: 1278854 - protein, 19 aa, Mycobacterium
RQSYSLPVPAAPAVPPVPS

SEQ ID NO: 1278855 - protein, 23 aa, Mycobacterium
RQTAHRLVRCATAIRTADDVFHF

SEQ ID NO: 1278856 - protein, 20 aa, Mycobacterium
RQTFATGRTRSVQWRKEQLH

SEQ ID NO: 1278857 - protein, 24 aa, Mycobacterium
RQTRELVPFIDLVNEFGVTVETVT

SEQ ID NO: 1278858 - protein, 24 aa, Mycobacterium
RQTWACGPEAMLEAAERTWKAAGI

SEQ ID NO: 1278859 - protein, 19 aa, Mycobacterium
RQTWACGPEGMLNDAEKVW

SEQ ID NO: 1278860 - protein, 19 aa, Mycobacterium
RQVGGELYGSFLPGTQENL

SEQ ID NO: 1278861 - protein, 18 aa, Mycobacterium
RQVHNFGTATAFEADSLI

SEQ ID NO: 1278862 - protein, 20 aa, Mycobacterium
RQVLDLIFTVGCYQLLGAAV

SEQ ID NO: 1278863 - protein, 19 aa, Mycobacterium
RQVLLPLWNAYTFLALYAP

SEQ ID NO: 1278864 - protein, 27 aa, Mycobacterium
RQWGGTEWHIGWHLGAFDHDAGHHIGE

SEQ ID NO: 1278865 - protein, 21 aa, Mycobacterium
RQWIKSRHGVDVAEIDREVSF

SEQ ID NO: 1278866 - protein, 32 aa, Mycobacterium
RQYFFEFDTFLGPPVGHVWLSPGSMVELVEVS

SEQ ID NO: 1278867 - protein, 18 aa, Mycobacterium
RRAAIKARTAELAKQFQA

SEQ ID NO: 1278868 - protein, 17 aa, Mycobacterium
RRAAQLAVARLVESEPA

SEQ ID NO: 1278869 - protein, 35 aa, Mycobacterium; identical to SEQ ID NO: 725203

SEQ ID NO: 1278870 - protein, 26 aa, Mycobacterium
RRADDLIARLELRLAQIDRQLRMNPL

SEQ ID NO: 1278871 - protein, 24 aa, Mycobacterium
RRADDPAAHSLRHFCIAYRAVVRA

SEQ ID NO: 1278872 - protein, 18 aa, Mycobacterium
RRADPVALLAPVAVLAAL

SEQ ID NO: 1278873 - protein, 26 aa, Mycobacterium
RRAEKMVPISAFLRRNPHLMAVQTAI

SEQ ID NO: 1278874 - protein, 27 aa, Mycobacterium
RRAEKMVPISAFLRRNPHLMAVQTAIA

SEQ ID NO: 1278875 - protein, 26 aa, Mycobacterium
RRAEKMVPISAFLRRNPYLMAVQTAI

SEQ ID NO: 1278876 - protein, 19 aa, Mycobacterium
RRAFDPSIGVTERRERLDA

SEQ ID NO: 1278877 - protein, 21 aa, Mycobacterium
RRAGADPDRLLVVEVSDAYPR

SEQ ID NO: 1278878 - protein, 19 aa, Mycobacterium
RRAGIALAREVERRAPNAV

SEQ ID NO: 1278879 - protein, 19 aa, Mycobacterium
RRAGLMPGIDEFDADFFGF

SEQ ID NO: 1278880 - protein, 22 aa, Mycobacterium
RRAGLYPWIATQKERFVRITPQ

SEQ ID NO: 1278881 - protein, 18 aa, Mycobacterium
RRAGMSVTTGFALAAQRC

SEQ ID NO: 1278882 - protein, 24 aa, Mycobacterium
RRAGRTHPVWDFLFTYYSLRPRHL

SEQ ID NO: 1278883 - protein, 28 aa, Mycobacterium
RRAIEVYPHPATVVLFDLEKTLKYKRGV

SEQ ID NO: 1278884 - protein, 17 aa, Mycobacterium
RRAILRAALAEFAANGY

SEQ ID NO: 1278885 - protein, 19 aa, Mycobacterium
RRALDIPAAVIERLGVDVA

SEQ ID NO: 1278886 - protein, 17 aa, Mycobacterium
RRALDLTKAYALERTAF

SEQ ID NO: 1278887 - protein, 20 aa, Mycobacterium
RRALDTTIVRPGRLTDDPGT

SEQ ID NO: 1278888 - protein, 23 aa, Mycobacterium
RRALEPCRICGTPVNTAVLEGRN

SEQ ID NO: 1278889 - protein, 21 aa, Mycobacterium
RRALQRPGADLARTLSKATAR

SEQ ID NO: 1278890 - protein, 17 aa, Mycobacterium
RRALRAGDFGQLAERMF

SEQ ID NO: 1278891 - protein, 21 aa, Mycobacterium
RRAMSQLGVPYSWGGGNANGP

SEQ ID NO: 1278892 - protein, 25 aa, Mycobacterium
RRAMSQMGVPYSWGGGNAAGPSRGI

SEQ ID NO: 1278893 - protein, 19 aa, Mycobacterium
RRAPDCPAEVPTPRSVLAM

SEQ ID NO: 1278894 - protein, 19 aa, Mycobacterium
RRAQARGCELGKDAVGTHL

SEQ ID NO: 1278895 - protein, 27 aa, Mycobacterium
RRAQRGMAVVGGRGSGAVMVLAGPPGV

SEQ ID NO: 1278896 - protein, 17 aa, Mycobacterium
RRARFRGDVEVLDIAVD

SEQ ID NO: 1278897 - protein, 21 aa, Mycobacterium
RRARLARRHHLAPGPDGAPSV

SEQ ID NO: 1278898 - protein, 23 aa, Mycobacterium
RRARMSGMTLVFVHGNPETDAIW

SEQ ID NO: 1278899 - protein, 25 aa, Mycobacterium
RRARRDLYEALGFERYAGTRADRLS

SEQ ID NO: 1278900 - protein, 21 aa, Mycobacterium
RRARVMMKFIELVNANIDELA

SEQ ID NO: 1278901 - protein, 19 aa, Mycobacterium
RRASSPKRRRIITTPVEHH

SEQ ID NO: 1278902 - protein, 21 aa, Mycobacterium
RRATPELLDIVPRGNRQVYDM

SEQ ID NO: 1278903 - protein, 17 aa, Mycobacterium
RRATVLQAFAGDQDALR

SEQ ID NO: 1278904 - protein, 20 aa, Mycobacterium
RRAVAGPERSRVLIAAIGLG

SEQ ID NO: 1278905 - protein, 21 aa, Mycobacterium
RRAVDAGAVGHVFNLGHGVLP

SEQ ID NO: 1278906 - protein, 33 aa, Mycobacterium
RRAVFTRYELVEGFPKFDIDDVFLGNGVSELIT

SEQ ID NO: 1278907 - protein, 21 aa, Mycobacterium
RRCLGATFAMVEFKVVLREIL

SEQ ID NO: 1278908 - protein, 22 aa, Mycobacterium
RRDEFRASKIMLERAQANEKIT

SEQ ID NO: 1278909 - protein, 25 aa, Mycobacterium
RRDGFKRIHNLGGFLTGAGSFDPEF

SEQ ID NO: 1278910 - protein, 18 aa, Mycobacterium
RRDGKFVVPQMFFDRHSH

SEQ ID NO: 1278911 - protein, 21 aa, Mycobacterium
RRDGLWERLIEACRPGMTTSG

SEQ ID NO: 1278912 - protein, 20 aa, Mycobacterium
RRDHGGVIFIDLRDASGTSQ

SEQ ID NO: 1278913 - protein, 22 aa, Mycobacterium
RRDHGGVIFIDLRDASGVSQVV

SEQ ID NO: 1278914 - protein, 28 aa, Mycobacterium
RRDLGGKMVRFVVCRKGDRHVVAARDED

SEQ ID NO: 1278915 - protein, 17 aa, Mycobacterium
RRDLHALAAQLGSDVPF

SEQ ID NO: 1278916 - protein, 19 aa, Mycobacterium
RRDLSGSDYVYLWVDGIHL

SEQ ID NO: 1278917 - protein, 22 aa, Mycobacterium
RRDNRHLGFGAGVHRCLGSNLA

SEQ ID NO: 1278918 - protein, 18 aa, Mycobacterium
RRDPLFCVLPDTFDAFGG

SEQ ID NO: 1278919 - protein, 20 aa, Mycobacterium
RRDPRVAVTIVSTGGVTGVM

SEQ ID NO: 1278920 - protein, 19 aa, Mycobacterium
RRDSEAWDVRFARAQHEIL

SEQ ID NO: 1278921 - protein, 18 aa, Mycobacterium
RRDSVEYSLDHAVVGGED

SEQ ID NO: 1278922 - protein, 26 aa, Mycobacterium
RRDWWGHAVVPSWYTEASLVLDLDGV

SEQ ID NO: 1278923 - protein, 30 aa, Mycobacterium
RREADPIRLVWTLFYVAICYAALRTPEAGL

SEQ ID NO: 1278924 - protein, 21 aa, Mycobacterium
RREDKFSFGLWTVGWPGVDPF

SEQ ID NO: 1278925 - protein, 19 aa, Mycobacterium
RREFGWKPLPAFDDGVLAW

SEQ ID NO: 1278926 - protein, 20 aa, Mycobacterium
RREGKVPVVLYGHGTEPQHL

SEQ ID NO: 1278927 - protein, 29 aa, Mycobacterium
RRELDVVWRNGLRLTKLVNTLLDFSRIEA

SEQ ID NO: 1278928 - protein, 19 aa, Mycobacterium
RREPIPVYAEMSAVNPVFL

SEQ ID NO: 1278929 - protein, 19 aa, Mycobacterium
RREPLRRTTLDVAGREASR

SEQ ID NO: 1278930 - protein, 26 aa, Mycobacterium
RRERPETFLSGGYRPLLATGEAAEHL

SEQ ID NO: 1278931 - protein, 17 aa, Mycobacterium
RRERRMITEEFTKNRDC

SEQ ID NO: 1278932 - protein, 20 aa, Mycobacterium
RRETACVPLLHGGGQERDVR

SEQ ID NO: 1278933 - protein, 19 aa, Mycobacterium
RRETIMTAKGVLTIGSTGA

SEQ ID NO: 1278934 - protein, 27 aa, Mycobacterium
RREWGRTVAAIARWCGDLTVAEDAVQE

SEQ ID NO: 1278935 - protein, 20 aa, Mycobacterium
RREWTFPRWVPLPVAEFAIG

SEQ ID NO: 1278936 - protein, 24 aa, Mycobacterium
RRFAEYRRRAVPEAALAHDGEDTT

SEQ ID NO: 1278937 - protein, 22 aa, Mycobacterium
RRFAGCPICHLHLRSFATRHEE

SEQ ID NO: 1278938 - protein, 19 aa, Mycobacterium
RRFDDEYMRLKALLDGGEL

SEQ ID NO: 1278939 - protein, 21 aa, Mycobacterium
RRFDDEYRALKALIDGGELGN

SEQ ID NO: 1278940 - protein, 18 aa, Mycobacterium
RRFDVDWTGLGFSDEDLD

SEQ ID NO: 1278941 - protein, 19 aa, Mycobacterium
RRFEVEAGAQVLMATTGRP

SEQ ID NO: 1278942 - protein, 17 aa, Mycobacterium
RRFGGLVSVELADASAV

SEQ ID NO: 1278943 - protein, 20 aa, Mycobacterium
RRFLLCDATCEVWFQRHGRP

SEQ ID NO: 1278944 - protein, 20 aa, Mycobacterium
RRFPDAAVVRLERDYRSTPQ

SEQ ID NO: 1278945 - protein, 26 aa, Mycobacterium
RRFPDLKFALSEGGIGWVPYFLERID

SEQ ID NO: 1278946 - protein, 25 aa, Mycobacterium
RRFRHAVKFLRWRPDRDPASCTFDQ

SEQ ID NO: 1278947 - protein, 29 aa, Mycobacterium
RRFVEAAGFQCGFCTAGMVTTASALTADQ

SEQ ID NO: 1278948 - protein, 26 aa, Mycobacterium
RRGAAFVSACALVFGPGEAERVVVRG

SEQ ID NO: 1278949 - protein, 18 aa, Mycobacterium
RRGAAPGQELEYPEVVPH

SEQ ID NO: 1278950 - protein, 18 aa, Mycobacterium
RRGAISGAVLDAGCGAGE

SEQ ID NO: 1278951 - protein, 17 aa, Mycobacterium
RRGAKRALMTLCVGGGM

SEQ ID NO: 1278952 - protein, 17 aa, Mycobacterium
RRGAWLLSSVEHYSRDP

SEQ ID NO: 1278953 - protein, 19 aa, Mycobacterium
RRGDALARDIRRADCQFLI

SEQ ID NO: 1278954 - protein, 26 aa, Mycobacterium
RRGDLGLWHVIPLRFDDQALVQCLAR

SEQ ID NO: 1278955 - protein, 24 aa, Mycobacterium
RRGDLVDVRFNWHTMYFRYKTVDP

SEQ ID NO: 1278956 - protein, 21 aa, Mycobacterium
RRGEVSLPRLVQAVSAERGRP

SEQ ID NO: 1278957 - protein, 18 aa, Mycobacterium
RRGFAYGTLPGHAESGEE

SEQ ID NO: 1278958 - protein, 20 aa, Mycobacterium
RRGGGPFFVEFRTYRFRAHS

SEQ ID NO: 1278959 - protein, 18 aa, Mycobacterium
RRGGRGGRGRWCSRRGGL

SEQ ID NO: 1278960 - protein, 21 aa, Mycobacterium
RRGGSQLSELAEELAAGGTTL

SEQ ID NO: 1278961 - protein, 25 aa, Mycobacterium
RRGGTQIGVPYSWGGGSLTGPTRGV

SEQ ID NO: 1278962 - protein, 19 aa, Mycobacterium
RRGGYCYEQNGLLGYVLDD

SEQ ID NO: 1278963 - protein, 20 aa, Mycobacterium
RRGIALGLTGRVVLVTGGVR

SEQ ID NO: 1278964 - protein, 19 aa, Mycobacterium
RRGLAVLRRPVRRPLDEGV

SEQ ID NO: 1278965 - protein, 18 aa, Mycobacterium
RRGLTPWLAVPDRLVRLP

SEQ ID NO: 1278966 - protein, 20 aa, Mycobacterium
RRGRDCSHASTLSRTAHECY

SEQ ID NO: 1278967 - protein, 29 aa, Mycobacterium
RRGVGLVALHSWWSPGAFEMPGFDWEEIR

SEQ ID NO: 1278968 - protein, 27 aa, Mycobacterium
RRGVIGDCMSHWTLPHLVGGAVAADLL

SEQ ID NO: 1278969 - protein, 18 aa, Mycobacterium
RRGVVPADPAIALQIPSA

SEQ ID NO: 1278970 - protein, 37 aa, Mycobacterium
RRGYVPALACARCRSVARCRHCTGPLSLPGRDAPGAL

SEQ ID NO: 1278971 - protein, 21 aa, Mycobacterium
RRHARRGAGLLGRAPVGRFPH

SEQ ID NO: 1278972 - protein, 20 aa, Mycobacterium
RRHDAFAIGMFRELGGSNPS

SEQ ID NO: 1278973 - protein, 18 aa, Mycobacterium
RRHEVVYRRLVDRCAGRD

SEQ ID NO: 1278974 - protein, 17 aa, Mycobacterium
RRHGELLAAHFGEDKGM

SEQ ID NO: 1278975 - protein, 23 aa, Mycobacterium
RRHLEPSGAVAFTAPYVVVSATL

SEQ ID NO: 1278976 - protein, 27 aa, Mycobacterium
RRHLPDLKLRFVNVVDLMRLQDRTEHP

SEQ ID NO: 1278977 - protein, 20 aa, Mycobacterium
RRHLVAGLMTIHLDIDAAVA

SEQ ID NO: 1278978 - protein, 18 aa, Mycobacterium
RRHPARLAQRIAHHLSRP

SEQ ID NO: 1278979 - protein, 17 aa, Mycobacterium
RRHWPALLDALAGDVGA

SEQ ID NO: 1278980 - protein, 21 aa, Mycobacterium
RRIAAAVLVMLAAVAAVRSDP

SEQ ID NO: 1278981 - protein, 37 aa, Mycobacterium
RRIAPSAPRVDGCLARLRIGRLDAVLPVHTHFDHALD

SEQ ID NO: 1278982 - protein, 21 aa, Mycobacterium
RRIDLRGTTLSAARLRSALPR

SEQ ID NO: 1278983 - protein, 24 aa, Mycobacterium
RRIGLSVPVGFVIADASAHGALDA

SEQ ID NO: 1278984 - protein, 17 aa, Mycobacterium
RRIIRAAKLLGVDDPIM

SEQ ID NO: 1278985 - protein, 19 aa, Mycobacterium
RRIKGAVVANQLARLGNYR

SEQ ID NO: 1278986 - protein, 18 aa, Mycobacterium
RRILDRANVTLAEIIGNE

SEQ ID NO: 1278987 - protein, 20 aa, Mycobacterium
RRILEVIEVDGLFDRAAESG

SEQ ID NO: 1278988 - protein, 20 aa, Mycobacterium
RRIMAGREWQVFSEEVVHPD

SEQ ID NO: 1278989 - protein, 25 aa, Mycobacterium
RRINILRGDEMPFFNPNGMPYDNCA

SEQ ID NO: 1278990 - protein, 19 aa, Mycobacterium
RRINPAIIYVAGSGFGSEG

SEQ ID NO: 1278991 - protein, 25 aa, Mycobacterium
RRIRLMRWGLVPPWAKAGDDGSPDT

SEQ ID NO: 1278992 - protein, 20 aa, Mycobacterium
RRITAAVKRWETDTTTEAVL

SEQ ID NO: 1278993 - protein, 17 aa, Mycobacterium
RRIVCDKPARWLIDESR

SEQ ID NO: 1278994 - protein, 18 aa, Mycobacterium
RRIVDDLGARIRLARRRY

SEQ ID NO: 1278995 - protein, 34 aa, Mycobacterium
RRIVEGGYELTLWARRPASLEPYADTAAKTAGTP

SEQ ID NO: 1278996 - protein, 22 aa, Mycobacterium
RRIVPARALSPISSVAGRKGYL

SEQ ID NO: 1278997 - protein, 25 aa, Mycobacterium
RRIVTEGGDLCFIRVRPNGTVFTYA

SEQ ID NO: 1278998 - protein, 17 aa, Mycobacterium
RRIWELEKRRAHVPWVT

SEQ ID NO: 1278999 - protein, 22 aa, Mycobacterium
RRKEMLHNSALRGEHMKSHAAT

SEQ ID NO: 1279000 - protein, 19 aa, Mycobacterium
RRKLLPASDRVQMLAQSAL

SEQ ID NO: 1279001 - protein, 20 aa, Mycobacterium
RRKRQAAQNVAWVPEAVVEQ

SEQ ID NO: 1279002 - protein, 30 aa, Mycobacterium
RRKWGDDVYLKFGEPIPVTSLLGFGSGMLL

SEQ ID NO: 1279003 - protein, 18 aa, Mycobacterium
RRLAAAHKYGRSDLAIVV

SEQ ID NO: 1279004 - protein, 24 aa, Mycobacterium
RRLAELPLAFQPGTGWLYDTPVKV

SEQ ID NO: 1279005 - protein, 27 aa, Mycobacterium
RRLAIPELPDELFIRSLRELIAVDEKW

SEQ ID NO: 1279006 - protein, 21 aa, Mycobacterium
RRLAKELKRYGVESQEVRIGP

SEQ ID NO: 1279007 - protein, 21 aa, Mycobacterium
RRLAQRLALTAGRRLDEAQPW

SEQ ID NO: 1279008 - protein, 19 aa, Mycobacterium
RRLAREEALLVGGSCGMAA

SEQ ID NO: 1279009 - protein, 21 aa, Mycobacterium
RRLDSGMVWVNNWHVIHPAYP

SEQ ID NO: 1279010 - protein, 21 aa, Mycobacterium
RRLEELTGLSLARPADLLRLT

SEQ ID NO: 1279011 - protein, 18 aa, Mycobacterium
RRLEREVGTPLLTRTTRR

SEQ ID NO: 1279012 - protein, 20 aa, Mycobacterium
RRLEVAFTRRDGVAEIAAVI

SEQ ID NO: 1279013 - protein, 23 aa, Mycobacterium
RRLEVVALTPARLLLVVITDTGR

SEQ ID NO: 1279014 - protein, 22 aa, Mycobacterium
RRLFAGGGFGRGRFSGGGGGFG

SEQ ID NO: 1279015 - protein, 17 aa, Mycobacterium
RRLFEELPLAEVDFDTV

SEQ ID NO: 1279016 - protein, 21 aa, Mycobacterium
RRLGGWLAYRDGEVVPAEDRF

SEQ ID NO: 1279017 - protein, 26 aa, Mycobacterium
RRLGRIRARVILMPAVTDTYFTVTEN

SEQ ID NO: 1279018 - protein, 26 aa, Mycobacterium
RRLGRRSNVYTVEWQNVQGLTPSGLA

SEQ ID NO: 1279019 - protein, 18 aa, Mycobacterium
RRLGRTGLDLTLEAVLRA

SEQ ID NO: 1279020 - protein, 17 aa, Mycobacterium
RRLHGPPGQGVPFVSTT

SEQ ID NO: 1279021 - protein, 21 aa, Mycobacterium
RRLIPGYVVTPAIKLLSDELV

SEQ ID NO: 1279022 - protein, 26 aa, Mycobacterium
RRLIVPRLHLIPGMRGKVIDSETPAL

SEQ ID NO: 1279023 - protein, 19 aa, Mycobacterium
RRLKPRGAAAVSVVVTRLG

SEQ ID NO: 1279024 - protein, 23 aa, Mycobacterium
RRLLKRVHGGAVPLETAAFESGV

SEQ ID NO: 1279025 - protein, 17 aa, Mycobacterium
RRLLRDVAEGRELGDTS

SEQ ID NO: 1279026 - protein, 20 aa, Mycobacterium
RRLQELGVIRGFYADIDPAA

SEQ ID NO: 1279027 - protein, 20 aa, Mycobacterium
RRLQSGTVWVNDWHMINAMY

SEQ ID NO: 1279028 - protein, 20 aa, Mycobacterium
RRLRAANLAGLTGRVLEVGA

SEQ ID NO: 1279029 - protein, 22 aa, Mycobacterium
RRLRAKLGPEYEALIGTVRNVG

SEQ ID NO: 1279030 - protein, 21 aa, Mycobacterium
RRLRLPVEEILLAALGRAVAA

SEQ ID NO: 1279031 - protein, 22 aa, Mycobacterium
RRLRRAKTLGPRRGLTGTPLPP

SEQ ID NO: 1279032 - protein, 25 aa, Mycobacterium
RRLRRYGHFCFRTADGVLERLPHGV

SEQ ID NO: 1279033 - protein, 26 aa, Mycobacterium
RRLRSKARLKFLIKDWGAQKFREVLE

SEQ ID NO: 1279034 - protein, 24 aa, Mycobacterium
RRLRTTPAMRRLVAQTSLEPRHLV

SEQ ID NO: 1279035 - protein, 17 aa, Mycobacterium
RRLRVFGPVSFIRATRP

SEQ ID NO: 1279036 - protein, 20 aa, Mycobacterium
RRLSAEPVGVVFATRTVGEE

SEQ ID NO: 1279037 - protein, 17 aa, Mycobacterium
RRLSALAATVCANDPRT

SEQ ID NO: 1279038 - protein, 18 aa, Mycobacterium
RRLSEVHLAPAVTAAVTE

SEQ ID NO: 1279039 - protein, 17 aa, Mycobacterium
RRLTAPTGHSVSMTPDA

SEQ ID NO: 1279040 - protein, 23 aa, Mycobacterium
RRLTGRIARPVIWGRRKAAAVQE

SEQ ID NO: 1279041 - protein, 18 aa, Mycobacterium
RRLVGLFCQQGHFDRSKA

SEQ ID NO: 1279042 - protein, 19 aa, Mycobacterium
RRLVKAGVPAVVLNAKNDA

SEQ ID NO: 1279043 - protein, 25 aa, Mycobacterium
RRLVRWPRQVLAEFGLYLPDDIEVR

SEQ ID NO: 1279044 - protein, 19 aa, Mycobacterium
RRMAELGIGALPVCGDDDR

SEQ ID NO: 1279045 - protein, 20 aa, Mycobacterium
RRMGEAWVRAEGRILTDVMA

SEQ ID NO: 1279046 - protein, 24 aa, Mycobacterium
RRMGSCALDLCAVAAGRLDAYYED

SEQ ID NO: 1279047 - protein, 20 aa, Mycobacterium
RRMQRAWLDFARGSEDVDDE

SEQ ID NO: 1279048 - protein, 19 aa, Mycobacterium
RRMRRLQPRIAEIVDAQLD

SEQ ID NO: 1279049 - protein, 21 aa, Mycobacterium
RRMTIARGFARHMAGIDARTE

SEQ ID NO: 1279050 - protein, 27 aa, Mycobacterium
RRMVKFRKDHPAFRRRRFFEGKPQSTG

SEQ ID NO: 1279051 - protein, 18 aa, Mycobacterium
RRNAPQLDAAGWDQDLIE

SEQ ID NO: 1279052 - protein, 26 aa, Mycobacterium
RRNDPDWQRFHLIGATNTVYFALLAR

SEQ ID NO: 1279053 - protein, 27 aa, Mycobacterium
RRNDPDWQRFHLIGATNTVYFALLARR

SEQ ID NO: 1279054 - protein, 21 aa, Mycobacterium
RRNEFVTVRFCAREALGELGL

SEQ ID NO: 1279055 - protein, 20 aa, Mycobacterium
RRNHTWGSTAQVWARDPQGV

SEQ ID NO: 1279056 - protein, 21 aa, Mycobacterium
RRNRLRLLLTASEPLRAGVVR

SEQ ID NO: 1279057 - protein, 29 aa, Mycobacterium
RRNSRNPSRLVLISPWLDVSMSDPRSAEI

SEQ ID NO: 1279058 - protein, 17 aa, Mycobacterium
RRPALSPSRASDFKQCP

SEQ ID NO: 1279059 - protein, 18 aa, Mycobacterium
RRPALVAGASSGIGEATA

SEQ ID NO: 1279060 - protein, 20 aa, Mycobacterium
RRPARGIAARAVYRHHAAVV

SEQ ID NO: 1279061 - protein, 24 aa, Mycobacterium
RRPAVWEPGEYLVIDWAQAAPGLF

SEQ ID NO: 1279062 - protein, 21 aa, Mycobacterium
RRPEELDGWAREHGDRVLVVP

SEQ ID NO: 1279063 - protein, 22 aa, Mycobacterium
RRPERRRGMVVIISDFLGPINW

SEQ ID NO: 1279064 - protein, 20 aa, Mycobacterium
RRPGETITLYDTRGAKRRLV

SEQ ID NO: 1279065 - protein, 19 aa, Mycobacterium
RRPGSMMTFQETVPSPLRI

SEQ ID NO: 1279066 - protein, 19 aa, Mycobacterium
RRPGWDELTATITALPPLP

SEQ ID NO: 1279067 - protein, 17 aa, Mycobacterium
RRPLAVVVDELFEHLAP

SEQ ID NO: 1279068 - protein, 20 aa, Mycobacterium
RRPLDRLLRRERVVADPGGP

SEQ ID NO: 1279069 - protein, 21 aa, Mycobacterium
RRPQVRELPAPLAEPLWETRV

SEQ ID NO: 1279070 - protein, 19 aa, Mycobacterium
RRPRRGCDPMLGNLYDRAL

SEQ ID NO: 1279071 - protein, 24 aa, Mycobacterium
RRPRRVSAKVSRRVAVIESGSGTA

SEQ ID NO: 1279072 - protein, 22 aa, Mycobacterium
RRPRTIVIGSRVGRVDLPPPTH

SEQ ID NO: 1279073 - protein, 21 aa, Mycobacterium
RRPSADDLLVLLAVGRTGRYT

SEQ ID NO: 1279074 - protein, 17 aa, Mycobacterium
RRPSERVTEALCVEKAA

SEQ ID NO: 1279075 - protein, 19 aa, Mycobacterium
RRPSLIPIEAIELLTGDVQ

SEQ ID NO: 1279076 - protein, 28 aa, Mycobacterium
RRPVAADLRGDWAPPLRIRGFDPSLPTM

SEQ ID NO: 1279077 - protein, 31 aa, Mycobacterium
RRPVGVLLGVMPWNFPVYQVARFAAPNLVLG

SEQ ID NO: 1279078 - protein, 18 aa, Mycobacterium
RRQFHSLGRRLLRFTDEV

SEQ ID NO: 1279079 - protein, 22 aa, Mycobacterium
RRQFPLLGRRAAEKLGLRVVLL

SEQ ID NO: 1279080 - protein, 30 aa, Mycobacterium
RRQGLKISVPEEVAWRVGFIDDDALEARAK

SEQ ID NO: 1279081 - protein, 19 aa, Mycobacterium
RRQLIEIVRDGPWVGNEHL

SEQ ID NO: 1279082 - protein, 28 aa, Mycobacterium
RRQLIVTFRFYHCDYYRNVTIVAVRPAE

SEQ ID NO: 1279083 - protein, 18 aa, Mycobacterium
RRQLPIVGRRAAEKLGLR

SEQ ID NO: 1279084 - protein, 19 aa, Mycobacterium
RRQLRGFVVGQVRPHAQQM

SEQ ID NO: 1279085 - protein, 26 aa, Mycobacterium
RRQLTPHFRPGCKRMLMTSDYYPALQ

SEQ ID NO: 1279086 - protein, 24 aa, Mycobacterium
RRQQTLRASVDWSHGLLTDPERVL

SEQ ID NO: 1279087 - protein, 19 aa, Mycobacterium
RRQRLSGAPGYLAVCDVLH

SEQ ID NO: 1279088 - protein, 24 aa, Mycobacterium
RRQRSWFRRDHRITWLDGAAGGSA

SEQ ID NO: 1279089 - protein, 17 aa, Mycobacterium
RRRAAALEAGRDTVPAV

SEQ ID NO: 1279090 - protein, 17 aa, Mycobacterium
RRRALTYNVSLLLVLLR

SEQ ID NO: 1279091 - protein, 18 aa, Mycobacterium
RRRATARTRGGDRAASPV

SEQ ID NO: 1279092 - protein, 22 aa, Mycobacterium
RRRCAACDDVAAGVGGSMGSVA

SEQ ID NO: 1279093 - protein, 17 aa, Mycobacterium
RRREIVEDPALIPVAME

SEQ ID NO: 1279094 - protein, 17 aa, Mycobacterium
RRRELLQRNNLDGTLAD

SEQ ID NO: 1279095 - protein, 19 aa, Mycobacterium
RRRFPTLGNQLFQLASGTA

SEQ ID NO: 1279096 - protein, 20 aa, Mycobacterium
RRRGDAFAAVCPHADDVWLH

SEQ ID NO: 1279097 - protein, 20 aa, Mycobacterium
RRRGEAHGEFTISARGVPSS

SEQ ID NO: 1279098 - protein, 19 aa, Mycobacterium
RRRGEGIGLTTVYRTLQQM

SEQ ID NO: 1279099 - protein, 18 aa, Mycobacterium
RRRGHIINIASLSGLIPV

SEQ ID NO: 1279100 - protein, 29 aa, Mycobacterium
RRRGIPVLLRPAVLARLMAGHTTLMVTGT

SEQ ID NO: 1279101 - protein, 17 aa, Mycobacterium
RRRGPQLLPSVFNHDEV

SEQ ID NO: 1279102 - protein, 18 aa, Mycobacterium
RRRGWKAVAAIDVPDVPD

SEQ ID NO: 1279103 - protein, 17 aa, Mycobacterium
RRRGYRVLSARAGQAET

SEQ ID NO: 1279104 - protein, 19 aa, Mycobacterium
RRRHRCGPEEIGAKLGVSA

SEQ ID NO: 1279105 - protein, 25 aa, Mycobacterium
RRRIYWLSLPLDYGLAGRTPSGTWR

SEQ ID NO: 1279106 - protein, 18 aa, Mycobacterium
RRRLEAKGAALADSVADL

SEQ ID NO: 1279107 - protein, 18 aa, Mycobacterium
RRRLRMICHGLGHIEDAA

SEQ ID NO: 1279108 - protein, 25 aa, Mycobacterium
RRRLRRSVWALCASWYRTSSGEIPT

SEQ ID NO: 1279109 - protein, 18 aa, Mycobacterium
RRRPEARWRRQPGDVPPL

SEQ ID NO: 1279110 - protein, 18 aa, Mycobacterium
RRRPETKPPGGDEPPRGD

SEQ ID NO: 1279111 - protein, 22 aa, Mycobacterium
RRRPVVHLKPLLAPPLLDTVGA

SEQ ID NO: 1279112 - protein, 17 aa, Mycobacterium
RRRQLNGGGNWSRTPRR

SEQ ID NO: 1279113 - protein, 17 aa, Mycobacterium
RRRRPDRPFTVVIDEAH

SEQ ID NO: 1279114 - protein, 17 aa, Mycobacterium
RRRSGLANLAARARAAG

SEQ ID NO: 1279115 - protein, 17 aa, Mycobacterium
RRRSPAIVHDARNDPRV

SEQ ID NO: 1279116 - protein, 25 aa, Mycobacterium
RRRTMLREYLEAMRALWTQEEAEFD

SEQ ID NO: 1279117 - protein, 18 aa, Mycobacterium
RRRVDLLAELGARHPGLV

SEQ ID NO: 1279118 - protein, 20 aa, Mycobacterium
RRRVPARVLIPARTHPDARS

SEQ ID NO: 1279119 - protein, 31 aa, Mycobacterium
RRRVRLASVLRRCIVIGAQLRGSELTVRFRP

SEQ ID NO: 1279120 - protein, 24 aa, Mycobacterium
RRRYESSIAPGAWESLAAARFRRP

SEQ ID NO: 1279121 - protein, 18 aa, Mycobacterium
RRSARPGARRVAVVRLPR

SEQ ID NO: 1279122 - protein, 17 aa, Mycobacterium
RRSCAVGAIIQGQDHLP

SEQ ID NO: 1279123 - protein, 17 aa, Mycobacterium
RRSELPAASAGTHPASG

SEQ ID NO: 1279124 - protein, 21 aa, Mycobacterium
RRSGASWTEIGKCMGVTKQAA

SEQ ID NO: 1279125 - protein, 26 aa, Mycobacterium
RRSGDSGAMQKHWYSAMEVLAEYSID

SEQ ID NO: 1279126 - protein, 29 aa, Mycobacterium
RRSGGRLVDAWGGASLVRVGPRGYRDLIM

SEQ ID NO: 1279127 - protein, 24 aa, Mycobacterium
RRSGRIRTAASWLGTALALKPLLR

SEQ ID NO: 1279128 - protein, 18 aa, Mycobacterium
RRSKDLASIVGFGSPVDT

SEQ ID NO: 1279129 - protein, 24 aa, Mycobacterium
RRSKFPHRWWWVTLTDEAFPRFST

SEQ ID NO: 1279130 - protein, 18 aa, Mycobacterium
RRSLFLLRNSPWPSGPKT

SEQ ID NO: 1279131 - protein, 21 aa, Mycobacterium
RRSLLPAGITALSGRFYGGDV

SEQ ID NO: 1279132 - protein, 22 aa, Mycobacterium
RRSRLGLGVGPYRHLMAELFAP

SEQ ID NO: 1279133 - protein, 20 aa, Mycobacterium
RRSSGDYVLTGRKFYSTGAL

SEQ ID NO: 1279134 - protein, 19 aa, Mycobacterium
RRSTELGAHLHARLNGLKG

SEQ ID NO: 1279135 - protein, 29 aa, Mycobacterium
RRSTGVVKFPAERPELFDGDADIQQDIEA

SEQ ID NO: 1279136 - protein, 26 aa, Mycobacterium
RRTAGLDLLPRLLIRDGDLDLAVVRS

SEQ ID NO: 1279137 - protein, 23 aa, Mycobacterium
RRTDPTPSFSAPGRMSSGSSGTG

SEQ ID NO: 1279138 - protein, 19 aa, Mycobacterium
RRTEIPSIAIVGYTNAGKS

SEQ ID NO: 1279139 - protein, 22 aa, Mycobacterium
RRTESPVTLVLDNRPVMTTSRN

SEQ ID NO: 1279140 - protein, 24 aa, Mycobacterium
RRTFERFGIERFVRLTAAPAGHRT

SEQ ID NO: 1279141 - protein, 21 aa, Mycobacterium
RRTFGGIEMLRQATVALSSMN

SEQ ID NO: 1279142 - protein, 17 aa, Mycobacterium
RRTGILVPIDAFDLDKL

SEQ ID NO: 1279143 - protein, 23 aa, Mycobacterium
RRTPPKVPMCRRGSAVQRAGPGS

SEQ ID NO: 1279144 - protein, 20 aa, Mycobacterium
RRTPRWSSSVSKEWEPLREI

SEQ ID NO: 1279145 - protein, 22 aa, Mycobacterium
RRTQQVEWTWSMVRDTVLDRVL

SEQ ID NO: 1279146 - protein, 25 aa, Mycobacterium
RRTSAVKTFTAWAVRRGLMTEDPAA

SEQ ID NO: 1279147 - protein, 18 aa, Mycobacterium
RRTTALGRAATAVWSNVA

SEQ ID NO: 1279148 - protein, 19 aa, Mycobacterium
RRTTLLRPARLAGLRAEVE

SEQ ID NO: 1279149 - protein, 17 aa, Mycobacterium
RRTVLAVPEFDWVIDGL

SEQ ID NO: 1279150 - protein, 17 aa, Mycobacterium
RRTVRMHVVGDIIEMLN

SEQ ID NO: 1279151 - protein, 19 aa, Mycobacterium
RRVAAKSGLNRAILGKGWH

SEQ ID NO: 1279152 - protein, 17 aa, Mycobacterium
RRVARFATEHAWTEDPP

SEQ ID NO: 1279153 - protein, 20 aa, Mycobacterium
RRVDAPVVRYLDAAIVLESQ

SEQ ID NO: 1279154 - protein, 22 aa, Mycobacterium
RRVDGTVIAVEFNGTVVDHSDE

SEQ ID NO: 1279155 - protein, 22 aa, Mycobacterium
RRVDPEYDRHGGFPVFEAADPG

SEQ ID NO: 1279156 - protein, 27 aa, Mycobacterium
RRVDTTGGLYPNRYDIVAIDTSNNSVR

SEQ ID NO: 1279157 - protein, 19 aa, Mycobacterium
RRVEDLLDLVGLPTEFADR

SEQ ID NO: 1279158 - protein, 17 aa, Mycobacterium
RRVFVTIGIRNARSIRD

SEQ ID NO: 1279159 - protein, 27 aa, Mycobacterium
RRVGGPEVLDWLVTRHALGRSAYQLGV

SEQ ID NO: 1279160 - protein, 24 aa, Mycobacterium
RRVGPAPWKSVLGMTGPTTLPIEF

SEQ ID NO: 1279161 - protein, 29 aa, Mycobacterium
RRVGPKGSGAFERISWDEALAEIKQRWTA

SEQ ID NO: 1279162 - protein, 19 aa, Mycobacterium
RRVKAVRAIRRSSELEGAS

SEQ ID NO: 1279163 - protein, 20 aa, Mycobacterium
RRVLGMRATFARYRRSLTAV

SEQ ID NO: 1279164 - protein, 17 aa, Mycobacterium
RRVLPPATAYAVRPYSE

SEQ ID NO: 1279165 - protein, 20 aa, Mycobacterium
RRVLQYVDTVECGMCGGSGL

SEQ ID NO: 1279166 - protein, 22 aa, Mycobacterium
RRVPAEVLAALTAANATAAVTG

SEQ ID NO: 1279167 - protein, 18 aa, Mycobacterium
RRVPARLVLATRDGQLPG

SEQ ID NO: 1279168 - protein, 20 aa, Mycobacterium
RRVQDLLDRVGLRPEHYNRY

SEQ ID NO: 1279169 - protein, 17 aa, Mycobacterium
RRVRLCANRSRPSAHEC

SEQ ID NO: 1279170 - protein, 17 aa, Mycobacterium
RRVTLELGGKGANIILD

SEQ ID NO: 1279171 - protein, 24 aa, Mycobacterium
RRVVRKRNLLELSRHLERRTITAD

SEQ ID NO: 1279172 - protein, 21 aa, Mycobacterium
RRVVVRFVLVRFVLLCLLRWI

SEQ ID NO: 1279173 - protein, 18 aa, Mycobacterium
RRWLHAFGPATVDDLKWW

SEQ ID NO: 1279174 - protein, 19 aa, Mycobacterium
RRWLTLTGVHNYEPRHLTR

SEQ ID NO: 1279175 - protein, 20 aa, Mycobacterium
RRWMPGKATVPLAQYRAAWR

SEQ ID NO: 1279176 - protein, 18 aa, Mycobacterium
RRWQCAKDALDTPGAEGM

SEQ ID NO: 1279177 - protein, 21 aa, Mycobacterium
RRWSATEIVDLLCLPDNQVAR

SEQ ID NO: 1279178 - protein, 22 aa, Mycobacterium
RRWSERTMIALVMQHLDNSITT

SEQ ID NO: 1279179 - protein, 19 aa, Mycobacterium
RRWTEALCRGLLDGDIAAI

SEQ ID NO: 1279180 - protein, 19 aa, Mycobacterium
RRWVEMELLVPGTPEQVWD

SEQ ID NO: 1279181 - protein, 26 aa, Mycobacterium
RRWWPRRYRRSSVYWKLIGYDRRFGI

SEQ ID NO: 1279182 - protein, 19 aa, Mycobacterium
RRYAEKWRKPVELPEAGGT

SEQ ID NO: 1279183 - protein, 23 aa, Mycobacterium
RRYCVNCLDPLVGSDGFDVIAEL

SEQ ID NO: 1279184 - protein, 20 aa, Mycobacterium
RRYDHVAARFAEAGLGIYAL

SEQ ID NO: 1279185 - protein, 26 aa, Mycobacterium
RRYDKLKRFPAGFVVLGDAFCSFNPI

SEQ ID NO: 1279186 - protein, 17 aa, Mycobacterium
RRYEPRWFRAPEMHGVK

SEQ ID NO: 1279187 - protein, 26 aa, Mycobacterium
RRYERCVWRCWYLPQHTRLHRKFNGQ

SEQ ID NO: 1279188 - protein, 20 aa, Mycobacterium
RRYFPPDVRPGAKPPGPPVL

SEQ ID NO: 1279189 - protein, 26 aa, Mycobacterium
RRYILPRRRLAAALLERARELGTVAA

SEQ ID NO: 1279190 - protein, 21 aa, Mycobacterium
RRYLEHYLSVGALELRLQYGV

SEQ ID NO: 1279191 - protein, 19 aa, Mycobacterium
RRYLERDGLEVCTAPNGSE

SEQ ID NO: 1279192 - protein, 17 aa, Mycobacterium
RRYLSLLERAAEAVAIP

SEQ ID NO: 1279193 - protein, 23 aa, Mycobacterium
RRYREHFGFGFVMYVNGYCAQDV

SEQ ID NO: 1279194 - protein, 24 aa, Mycobacterium
RRYRLTVDLPPDFALNQPLSTFAL

SEQ ID NO: 1279195 - protein, 18 aa, Mycobacterium
RRYRNVVVEGGRIFNPGW

SEQ ID NO: 1279196 - protein, 26 aa, Mycobacterium
RSAARTFLRCWPDPQQWAGEPLQTRL

SEQ ID NO: 1279197 - protein, 18 aa, Mycobacterium
RSACADFAGWRARGIGTG

SEQ ID NO: 1279198 - protein, 23 aa, Mycobacterium
RSAGEAFEVLRPVFDQPGKNALE

SEQ ID NO: 1279199 - protein, 18 aa, Mycobacterium
RSAGIRTAIREALQRGLI

SEQ ID NO: 1279200 - protein, 21 aa, Mycobacterium
RSAHEACYRDELADIASEMPN

SEQ ID NO: 1279201 - protein, 18 aa, Mycobacterium
RSAIIQMLLQGPVTASAI

SEQ ID NO: 1279202 - protein, 18 aa, Mycobacterium
RSAIPPRRGGYSLDYLAG

SEQ ID NO: 1279203 - protein, 19 aa, Mycobacterium
RSAIRARRGVLLAAGGFEH

SEQ ID NO: 1279204 - protein, 24 aa, Mycobacterium
RSALEAGDVPRVFEDGGQMRDFVH

SEQ ID NO: 1279205 - protein, 17 aa, Mycobacterium
RSALPGLIADLSADADL

SEQ ID NO: 1279206 - protein, 20 aa, Mycobacterium
RSAMLVGGYYVRYPLLGRDL

SEQ ID NO: 1279207 - protein, 21 aa, Mycobacterium
RSAPVIGEIGVAFVVPVDAAD

SEQ ID NO: 1279208 - protein, 23 aa, Mycobacterium
RSARAWLFTVARNMIIDERRSAR

SEQ ID NO: 1279209 - protein, 24 aa, Mycobacterium
RSARCRPSPTRWVIRSRSCSTAES

SEQ ID NO: 1279210 - protein, 25 aa, Mycobacterium
RSATSARVSCRWCASRCLPDQDTPP

SEQ ID NO: 1279211 - protein, 33 aa, Mycobacterium
RSAVKMPSQRGWRHWLYVMTRINLGLSADELYE

SEQ ID NO: 1279212 - protein, 40 aa, Mycobacterium
RSAWPEVADFFAGFPSWANLRPMFGGHLIKVEDDIKDGKY

SEQ ID NO: 1279213 - protein, 19 aa, Mycobacterium
RSDALGRAFTDQGITFSLS

SEQ ID NO: 1279214 - protein, 21 aa, Mycobacterium
RSDAPYAGWPMCTTSEPSDRV

SEQ ID NO: 1279215 - protein, 26 aa, Mycobacterium
RSDAYDRAWQFASHIAATYGVEKLRA

SEQ ID NO: 1279216 - protein, 26 aa, Mycobacterium
RSDELVCLTQLCPQLASAGMLTLGYG

SEQ ID NO: 1279217 - protein, 20 aa, Mycobacterium
RSDEPWITSHLELRSPEGKV

SEQ ID NO: 1279218 - protein, 17 aa, Mycobacterium
RSDGWAVAVQWHPEERL

SEQ ID NO: 1279219 - protein, 17 aa, Mycobacterium
RSDILAFTLPGFATGDR

SEQ ID NO: 1279220 - protein, 26 aa, Mycobacterium
RSDLEPRWPASHSEAAIRERIAATRT

SEQ ID NO: 1279221 - protein, 19 aa, Mycobacterium
RSDLVPTLLAGYGGVIETR

SEQ ID NO: 1279222 - protein, 18 aa, Mycobacterium
RSDPMRKLLMGAPNAPEL

SEQ ID NO: 1279223 - protein, 22 aa, Mycobacterium
RSDRAEFGWEPAVDSWLGEWDE

SEQ ID NO: 1279224 - protein, 17 aa, Mycobacterium
RSEGCGILVLKRLGDAV

SEQ ID NO: 1279225 - protein, 22 aa, Mycobacterium
RSEGLAVASWHAFVSGMFSGDA

SEQ ID NO: 1279226 - protein, 32 aa, Mycobacterium
RSELPRHIAVLCDGNRRWARESGHDDVSYGYR

SEQ ID NO: 1279227 - protein, 25 aa, Mycobacterium
RSFDPCLPCGVHMYLGQGKELELLH

SEQ ID NO: 1279228 - protein, 24 aa, Mycobacterium
RSFDSCLVCTVHAYDGKTGRELSK

SEQ ID NO: 1279229 - protein, 17 aa, Mycobacterium
RSFQAFFDFLLSEQRQT

SEQ ID NO: 1279230 - protein, 20 aa, Mycobacterium
RSGAAIKTLWLPGPDPEPHY

SEQ ID NO: 1279231 - protein, 19 aa, Mycobacterium
RSGAHGMVGYTFRMPGAGV

SEQ ID NO: 1279232 - protein, 19 aa, Mycobacterium
RSGAKAVLVQQGFLGVEYA

SEQ ID NO: 1279233 - protein, 31 aa, Mycobacterium
RSGALRLSPGLKRSSLIGGIRYYDTVVDDAR

SEQ ID NO: 1279234 - protein, 23 aa, Mycobacterium
RSGAPRGSVYYHFPEGRSQIVAE

SEQ ID NO: 1279235 - protein, 19 aa, Mycobacterium
RSGARLGRGAGFYDRTLPL

SEQ ID NO: 1279236 - protein, 27 aa, Mycobacterium
RSGAVGRPRLTYELAPRLDYADIVALF

SEQ ID NO: 1279237 - protein, 21 aa, Mycobacterium
RSGCGLEERLVWQCASLLLSY

SEQ ID NO: 1279238 - protein, 18 aa, Mycobacterium
RSGDFSWKQSADAMRAVL

SEQ ID NO: 1279239 - protein, 23 aa, Mycobacterium
RSGDVLRSLWLPAHALRSPTAFR

SEQ ID NO: 1279240 - protein, 21 aa, Mycobacterium
RSGEAVVEMLRRGITARDILT

SEQ ID NO: 1279241 - protein, 27 aa, Mycobacterium
RSGEFALRRIGMMTEYWGKPDKTADAI

SEQ ID NO: 1279242 - protein, 19 aa, Mycobacterium
RSGELRAEFISGGRSNLTF

SEQ ID NO: 1279243 - protein, 18 aa, Mycobacterium
RSGESRWFVVDHDAMDGA

SEQ ID NO: 1279244 - protein, 21 aa, Mycobacterium
RSGIRILRIGMPYPLDPQVVS

SEQ ID NO: 1279245 - protein, 19 aa, Mycobacterium
RSGKFCDTGNCGNRQHVAA

SEQ ID NO: 1279246 - protein, 20 aa, Mycobacterium
RSGLAVPENAIWTSALATAG

SEQ ID NO: 1279247 - protein, 17 aa, Mycobacterium
RSGLIALLCKTDPAATP

SEQ ID NO: 1279248 - protein, 17 aa, Mycobacterium
RSGLIALLCKTDPEATP

SEQ ID NO: 1279249 - protein, 18 aa, Mycobacterium
RSGLPKVPTSVLSRGVCG

SEQ ID NO: 1279250 - protein, 23 aa, Mycobacterium
RSGLYPREVPFVVGTEVCGTIEA

SEQ ID NO: 1279251 - protein, 24 aa, Mycobacterium
RSGLYPREVPFVVGTEVCGVIEAV

SEQ ID NO: 1279252 - protein, 18 aa, Mycobacterium
RSGMGDAFAVARDVPEEW

SEQ ID NO: 1279253 - protein, 20 aa, Mycobacterium
RSGNGREWGPFAFDEFLEVK

SEQ ID NO: 1279254 - protein, 19 aa, Mycobacterium
RSGPAQLLYLGRLEYEKGV

SEQ ID NO: 1279255 - protein, 21 aa, Mycobacterium
RSGPVVLYRVAPQMFTDRDEW

SEQ ID NO: 1279256 - protein, 24 aa, Mycobacterium
RSGRTVVLRLRFDDFARATRSHTM

SEQ ID NO: 1279257 - protein, 20 aa, Mycobacterium
RSGSRALLRVAPLSVAGLLR

SEQ ID NO: 1279258 - protein, 17 aa, Mycobacterium
RSGVNWQATEDFSETIG

SEQ ID NO: 1279259 - protein, 29 aa, Mycobacterium
RSGVPALALDVWVAYELRRAGLDPDAVWP

SEQ ID NO: 1279260 - protein, 31 aa, Mycobacterium
RSGWPVAMLVGRFLPRHWVLIVNASDDEMHC

SEQ ID NO: 1279261 - protein, 23 aa, Mycobacterium
RSHLRHRAALVVDSRSSVEELLG

SEQ ID NO: 1279262 - protein, 30 aa, Mycobacterium
RSIAGMRVCDPPWYRPLLGVRRAATAAACT

SEQ ID NO: 1279263 - protein, 20 aa, Mycobacterium
RSIDELHAFLSGELRRQLQE

SEQ ID NO: 1279264 - protein, 19 aa, Mycobacterium
RSILDRFGAVWHRDDLGVV

SEQ ID NO: 1279265 - protein, 21 aa, Mycobacterium
RSIPALVAWKLGLSSKNAKTI

SEQ ID NO: 1279266 - protein, 19 aa, Mycobacterium
RSIRAGQYVTMLYGSANRD

SEQ ID NO: 1279267 - protein, 18 aa, Mycobacterium
RSKAWPDSVRFVHSRIED

SEQ ID NO: 1279268 - protein, 21 aa, Mycobacterium
RSKEMIKVRGFQVAPAEVEAV

SEQ ID NO: 1279269 - protein, 21 aa, Mycobacterium
RSKLAVMLWGLELDRRLRTAG

SEQ ID NO: 1279270 - protein, 22 aa, Mycobacterium
RSKYAPFVEKLLLDGARSKLTR

SEQ ID NO: 1279271 - protein, 21 aa, Mycobacterium
RSLAALPGRAFVHALINAVEE

SEQ ID NO: 1279272 - protein, 19 aa, Mycobacterium
RSLAASGARVAVNGRSRDR

SEQ ID NO: 1279273 - protein, 18 aa, Mycobacterium
RSLAKGFIGWQLGLCPEE

SEQ ID NO: 1279274 - protein, 17 aa, Mycobacterium
RSLARVAPTQAHRYALV

SEQ ID NO: 1279275 - protein, 20 aa, Mycobacterium
RSLEHLVDVVLHFEGDRASA

SEQ ID NO: 1279276 - protein, 20 aa, Mycobacterium
RSLEHLVDVVLHFEGDRNST

SEQ ID NO: 1279277 - protein, 18 aa, Mycobacterium
RSLGDGIRVEGFPDLDGA

SEQ ID NO: 1279278 - protein, 19 aa, Mycobacterium
RSLIRRLGVHEVPFAALRA

SEQ ID NO: 1279279 - protein, 18 aa, Mycobacterium
RSLITGGFRVRFAEPGEK

SEQ ID NO: 1279280 - protein, 19 aa, Mycobacterium
RSLKKCLLELGGSDPFIVL

SEQ ID NO: 1279281 - protein, 18 aa, Mycobacterium
RSLLRPGGVLAVHEYSVR

SEQ ID NO: 1279282 - protein, 22 aa, Mycobacterium
RSLNATKVFAWPEAEVAVMGAK

SEQ ID NO: 1279283 - protein, 25 aa, Mycobacterium
RSLNGRSGYRFGHIEGPMQVQHHDQ

SEQ ID NO: 1279284 - protein, 18 aa, Mycobacterium
RSLPGCLLVDQKGERFIN

SEQ ID NO: 1279285 - protein, 17 aa, Mycobacterium
RSLPHRMEVAWNPEFLR

SEQ ID NO: 1279286 - protein, 23 aa, Mycobacterium
RSLPHRMEVAWNPEFLREGKAIE

SEQ ID NO: 1279287 - protein, 27 aa, Mycobacterium
RSLPYWESVEPFPLPAEAGIEPDPRVG

SEQ ID NO: 1279288 - protein, 29 aa, Mycobacterium
RSLQRNGIRVGWGMATATYPGRRMPAACR

SEQ ID NO: 1279289 - protein, 19 aa, Mycobacterium
RSLRACIDLAALGENTIAI

SEQ ID NO: 1279290 - protein, 18 aa, Mycobacterium
RSLRGRLFAVLGSSLALG

SEQ ID NO: 1279291 - protein, 25 aa, Mycobacterium
RSLSKEQLDDIALYLNFDMVGSPNP

SEQ ID NO: 1279292 - protein, 25 aa, Mycobacterium
RSLTIKAMIEKVVDRMYAEIDDNRF

SEQ ID NO: 1279293 - protein, 21 aa, Mycobacterium
RSLVHLGLKHYFLVDFPQEPG

SEQ ID NO: 1279294 - protein, 24 aa, Mycobacterium
RSLWPMLTSIWEWERRWVPEHAEP

SEQ ID NO: 1279295 - protein, 19 aa, Mycobacterium
RSMLRAELRELLLRITEFE

SEQ ID NO: 1279296 - protein, 29 aa, Mycobacterium
RSMQRKRFGRIILIGSVSGMWGIGNQANY

SEQ ID NO: 1279297 - protein, 17 aa, Mycobacterium
RSMQRWIDHIAAVIEAE

SEQ ID NO: 1279298 - protein, 31 aa, Mycobacterium
RSMTKLWARMWLLRFTWQRAIDSGDLTSPAF

SEQ ID NO: 1279299 - protein, 18 aa, Mycobacterium
RSNGELVFDAPWQGRLFG

SEQ ID NO: 1279300 - protein, 20 aa, Mycobacterium
RSNPTLLLLHGFPSSSHMFR

SEQ ID NO: 1279301 - protein, 35 aa, Mycobacterium
RSNQSVRWLTRWPVVPEIRHGSLGFAAREAAQAKA

SEQ ID NO: 1279302 - protein, 23 aa, Mycobacterium
RSPDARIGVVINDFGELNVDAGL

SEQ ID NO: 1279303 - protein, 20 aa, Mycobacterium
RSPDEFSGKILAPAHLPQEQ

SEQ ID NO: 1279304 - protein, 24 aa, Mycobacterium
RSPEALTALAQRYEAWLSAHPDAD

SEQ ID NO: 1279305 - protein, 17 aa, Mycobacterium
RSPFVTAASAWELQEAT

SEQ ID NO: 1279306 - protein, 17 aa, Mycobacterium
RSPGGAGIRLDGGAHLG

SEQ ID NO: 1279307 - protein, 18 aa, Mycobacterium
RSPGTAPMDLWTIRIRAL

SEQ ID NO: 1279308 - protein, 27 aa, Mycobacterium
RSPHEPRLPYASLKAAVATFTRGIART

SEQ ID NO: 1279309 - protein, 23 aa, Mycobacterium
RSPHLRATAFAALGAAELLSVTP

SEQ ID NO: 1279310 - protein, 22 aa, Mycobacterium
RSPRDPEFELSDRFPVTDNDIA

SEQ ID NO: 1279311 - protein, 22 aa, Mycobacterium
RSPRGELAEAEFAMDGLADDPA

SEQ ID NO: 1279312 - protein, 23 aa, Mycobacterium
RSPRLRDLRTVLAAAGLAVREDG

SEQ ID NO: 1279313 - protein, 25 aa, Mycobacterium
RSQHPGWPLAVGPLRVPAGVVRLRP

SEQ ID NO: 1279314 - protein, 17 aa, Mycobacterium
RSRAADLGVVFERARQR

SEQ ID NO: 1279315 - protein, 17 aa, Mycobacterium
RSRCRHIALVTPSVDAI

SEQ ID NO: 1279316 - protein, 19 aa, Mycobacterium
RSRFVELLDAVWRMRGYGD

SEQ ID NO: 1279317 - protein, 23 aa, Mycobacterium
RSRGSMKAGVFSGAAADAPVDEL

SEQ ID NO: 1279318 - protein, 21 aa, Mycobacterium
RSRGWCGLSTDLPGIPGVVPR

SEQ ID NO: 1279319 - protein, 30 aa, Mycobacterium
RSRHARKIDCAACLVMAHSRATWRATHKKR

SEQ ID NO: 1279320 - protein, 36 aa, Mycobacterium
RSRLAPVTVCTFARFLRQWMTWLAEKDIHEFSAVTD

SEQ ID NO: 1279321 - protein, 19 aa, Mycobacterium
RSRLLPALLSGERIATLAA

SEQ ID NO: 1279322 - protein, 18 aa, Mycobacterium
RSRRVDVQRAVSLAPTVR

SEQ ID NO: 1279323 - protein, 20 aa, Mycobacterium
RSRSDALVWSVRLVGEHADE

SEQ ID NO: 1279324 - protein, 31 aa, Mycobacterium
RSRVLHPIWEWDGTDLFGWIATVPSPVKRAH

SEQ ID NO: 1279325 - protein, 19 aa, Mycobacterium
RSSIMSRLAGQGAVALLNL

SEQ ID NO: 1279326 - protein, 24 aa, Mycobacterium
RSSNPTWRRLEAALAELEGASAAL

SEQ ID NO: 1279327 - protein, 23 aa, Mycobacterium
RSSPPRIAVWLATTKPVELDGLV

SEQ ID NO: 1279328 - protein, 19 aa, Mycobacterium
RSSRAAQAFAQAGVGVGDR

SEQ ID NO: 1279329 - protein, 17 aa, Mycobacterium
RSSTLAFASLSSNLDST

SEQ ID NO: 1279330 - protein, 19 aa, Mycobacterium
RSTARGMLFYRLLQQSVNT

SEQ ID NO: 1279331 - protein, 17 aa, Mycobacterium
RSTGVVPWARKVSDDEL

SEQ ID NO: 1279332 - protein, 18 aa, Mycobacterium
RSTGWGVERIAAAWDELM

SEQ ID NO: 1279333 - protein, 17 aa, Mycobacterium
RSTIILQTFYSGRRHVP

SEQ ID NO: 1279334 - protein, 17 aa, Mycobacterium
RSTRRLADEVARLVAAA

SEQ ID NO: 1279335 - protein, 24 aa, Mycobacterium
RSTRVRVLCSAFRAGDGSVNGAVL

SEQ ID NO: 1279336 - protein, 17 aa, Mycobacterium
RSTTVAMHLLRRALTGG

SEQ ID NO: 1279337 - protein, 27 aa, Mycobacterium
RSTVVAADWTRLGAAYRTRAPMHILDD

SEQ ID NO: 1279338 - protein, 25 aa, Mycobacterium
RSTVYRHWPDRAALVADALAGLNRQ

SEQ ID NO: 1279339 - protein, 17 aa, Mycobacterium
RSVAALVAWKTGVSPAN

SEQ ID NO: 1279340 - protein, 21 aa, Mycobacterium
RSVAGAAHFLEHLLFKATPTR

SEQ ID NO: 1279341 - protein, 21 aa, Mycobacterium
RSVECSQIEWSLMIDAGAEPG

SEQ ID NO: 1279342 - protein, 20 aa, Mycobacterium
RSVIFAAELRGLVTRHPDRF

SEQ ID NO: 1279343 - protein, 24 aa, Mycobacterium
RSVKGEVIASTFDRPPSDHTQAAE

SEQ ID NO: 1279344 - protein, 31 aa, Mycobacterium
RSVLELLRRRELPVLPVPAPLALQFVHADDV

SEQ ID NO: 1279345 - protein, 18 aa, Mycobacterium
RSVLERADDLIVVGEAAS

SEQ ID NO: 1279346 - protein, 24 aa, Mycobacterium
RSVPRMGAALGRALTAAGVPLDLP

SEQ ID NO: 1279347 - protein, 22 aa, Mycobacterium
RSVTAFPGLHLAGLITSSEDKA

SEQ ID NO: 1279348 - protein, 24 aa, Mycobacterium
RSWLFPKGLATFIGLRDQSCRTPY

SEQ ID NO: 1279349 - protein, 19 aa, Mycobacterium
RSYDELARILNTFDTSFPD

SEQ ID NO: 1279350 - protein, 26 aa, Mycobacterium
RSYNCLKREGVHFIYELIDLTESDLL

SEQ ID NO: 1279351 - protein, 24 aa, Mycobacterium
RSYRAEKYLGIIDRVRAAIPDAAI

SEQ ID NO: 1279352 - protein, 18 aa, Mycobacterium
RSYYPAGVGRHFAAILGS

SEQ ID NO: 1279353 - protein, 17 aa, Mycobacterium
RTAAIIIGDGVSPGNEG

SEQ ID NO: 1279354 - protein, 18 aa, Mycobacterium
RTAATFALACAQAGVPMQ

SEQ ID NO: 1279355 - protein, 23 aa, Mycobacterium
RTACARLLVVPSMTSQALGAMVL

SEQ ID NO: 1279356 - protein, 23 aa, Mycobacterium
RTADGGWDLTLRNSKGDPHLTGT

SEQ ID NO: 1279357 - protein, 23 aa, Mycobacterium
RTADGGWDLTLRNSKGEPHLTGT

SEQ ID NO: 1279358 - protein, 19 aa, Mycobacterium
RTAEGEAVFRTEAAAPDGS

SEQ ID NO: 1279359 - protein, 20 aa, Mycobacterium
RTAEGEAVFRTEAAAPDGSG

SEQ ID NO: 1279360 - protein, 33 aa, Mycobacterium
RTAEHIGGWSRRPLPLPDMCYAAAATGDPDLRD

SEQ ID NO: 1279361 - protein, 17 aa, Mycobacterium
RTAEQMAAFYAQLLEAY

SEQ ID NO: 1279362 - protein, 21 aa, Mycobacterium
RTAFDRWGLIPRMLVGATERD

SEQ ID NO: 1279363 - protein, 19 aa, Mycobacterium
RTAFFTASWTDRTGTHHAE

SEQ ID NO: 1279364 - protein, 20 aa, Mycobacterium
RTAFGDAFVDHYLASRGWER

SEQ ID NO: 1279365 - protein, 18 aa, Mycobacterium
RTAGCPFAPPQQMLEMNQ

SEQ ID NO: 1279366 - protein, 26 aa, Mycobacterium
RTAGLDLLPRLLMRGGELDLTVVRSI

SEQ ID NO: 1279367 - protein, 26 aa, Mycobacterium
RTAGQLRLFAAVLREGSWNGVRIDTA

SEQ ID NO: 1279368 - protein, 29 aa, Mycobacterium
RTAHCECGWNATPRWLRASAVVDAGTHAA

SEQ ID NO: 1279369 - protein, 23 aa, Mycobacterium
RTAIRRAKVLAGIDEDTRVEVEN

SEQ ID NO: 1279370 - protein, 25 aa, Mycobacterium
RTAKLPQGFKVVIVGAGIAGMAAAL

SEQ ID NO: 1279371 - protein, 28 aa, Mycobacterium
RTALALELWPGKAYPLGATYDGSGTNFA

SEQ ID NO: 1279372 - protein, 17 aa, Mycobacterium
RTALILPSLGRTDRDIQ

SEQ ID NO: 1279373 - protein, 24 aa, Mycobacterium
RTALLGHGLLAWTAAVIQDPELLG

SEQ ID NO: 1279374 - protein, 20 aa, Mycobacterium
RTALMQGFNALDQWGRFQEA

SEQ ID NO: 1279375 - protein, 24 aa, Mycobacterium
RTALNAGFLWACSGYYNYDKGYSP

SEQ ID NO: 1279376 - protein, 19 aa, Mycobacterium
RTAPSRLGVVCGPIRVRVA

SEQ ID NO: 1279377 - protein, 20 aa, Mycobacterium
RTAVEKVLRGVGLRLMVPDQ

SEQ ID NO: 1279378 - protein, 17 aa, Mycobacterium
RTCCGGIGTHARNCSAV

SEQ ID NO: 1279379 - protein, 21 aa, Mycobacterium
RTCLLTPPPWYPILRGTTQQA

SEQ ID NO: 1279380 - protein, 18 aa, Mycobacterium
RTCVVPGCESTRGLHAHH

SEQ ID NO: 1279381 - protein, 18 aa, Mycobacterium
RTDAEFHLAVVRGSGNRT

SEQ ID NO: 1279382 - protein, 17 aa, Mycobacterium
RTDEAKLVFGGEALIVA

SEQ ID NO: 1279383 - protein, 20 aa, Mycobacterium
RTDEPFRWVAPQLISPNGGA

SEQ ID NO: 1279384 - protein, 26 aa, Mycobacterium
RTDGGWSLSGTKVWTSGAHRAHAFIV

SEQ ID NO: 1279385 - protein, 20 aa, Mycobacterium
RTDGTILWMADERAIAEHVA

SEQ ID NO: 1279386 - protein, 18 aa, Mycobacterium
RTDRRGPAPLSFGHGPHY

SEQ ID NO: 1279387 - protein, 23 aa, Mycobacterium
RTDVEGADGYVWFVADSGHERYE

SEQ ID NO: 1279388 - protein, 20 aa, Mycobacterium
RTDVGIGMVRTILRHAPKVE

SEQ ID NO: 1279389 - protein, 19 aa, Mycobacterium
RTEAFKHLLNIRVIDRDVF

SEQ ID NO: 1279390 - protein, 27 aa, Mycobacterium
RTEAGRRIRDGFVVGEGYADLMTADYS

SEQ ID NO: 1279391 - protein, 24 aa, Mycobacterium
RTEHLPRITVPTVFTHGTADPFGT

SEQ ID NO: 1279392 - protein, 22 aa, Mycobacterium
RTEIACVQNAFNLADRTSQPVL

SEQ ID NO: 1279393 - protein, 25 aa, Mycobacterium
RTELDGLVVAAGFSGHGFKIAPAAG

SEQ ID NO: 1279394 - protein, 18 aa, Mycobacterium
RTERGLGFSELSPGVTYF

SEQ ID NO: 1279395 - protein, 17 aa, Mycobacterium
RTERTAADWARVTRLAA

SEQ ID NO: 1279396 - protein, 22 aa, Mycobacterium
RTEVLNGLGHWWMVEDPTAGAA

SEQ ID NO: 1279397 - protein, 17 aa, Mycobacterium
RTFALLGLHGLVAVTAV

SEQ ID NO: 1279398 - protein, 18 aa, Mycobacterium
RTFARRFVEETGRTPMQW

SEQ ID NO: 1279399 - protein, 25 aa, Mycobacterium
RTFDECKRLLNAFGGQWAPVQDAWE

SEQ ID NO: 1279400 - protein, 22 aa, Mycobacterium
RTFGMDSWFPSLKIYNRNGQLY

SEQ ID NO: 1279401 - protein, 18 aa, Mycobacterium
RTFLQNHTGGLVVISHDV

SEQ ID NO: 1279402 - protein, 19 aa, Mycobacterium
RTFPLRSSFAPSYNMTINL

SEQ ID NO: 1279403 - protein, 19 aa, Mycobacterium
RTFPLRSSFAPTYNMTINL

SEQ ID NO: 1279404 - protein, 20 aa, Mycobacterium
RTFTGGHDWLADNGVDVTIV

SEQ ID NO: 1279405 - protein, 19 aa, Mycobacterium
RTGAVAVFFDPAALGEGAR

SEQ ID NO: 1279406 - protein, 17 aa, Mycobacterium
RTGAVLLGLASLVDLSK

SEQ ID NO: 1279407 - protein, 17 aa, Mycobacterium
RTGDLGFIHEGELFIVG

SEQ ID NO: 1279408 - protein, 23 aa, Mycobacterium
RTGEGSGGISCFLVEKDTDGLSF

SEQ ID NO: 1279409 - protein, 30 aa, Mycobacterium; identical to SEQ ID NO: 727380

SEQ ID NO: 1279410 - protein, 17 aa, Mycobacterium
RTGFGQRKATKRAIVTL

SEQ ID NO: 1279411 - protein, 21 aa, Mycobacterium
RTGGVPVLLRCRLLRAELTPP

SEQ ID NO: 1279412 - protein, 22 aa, Mycobacterium
RTGLSWPDLDDAASVSLLQTVR

SEQ ID NO: 1279413 - protein, 24 aa, Mycobacterium
RTGPVPWKPLLGLSGPTSLPLEFG

SEQ ID NO: 1279414 - protein, 20 aa, Mycobacterium
RTGRPHGWIHNELRRRCGGP

SEQ ID NO: 1279415 - protein, 23 aa, Mycobacterium
RTGRSYLDMFTFFASSALGMNHP

SEQ ID NO: 1279416 - protein, 24 aa, Mycobacterium
RTGTFSINGGNYFAPDSPFGGYKQ

SEQ ID NO: 1279417 - protein, 20 aa, Mycobacterium
RTGTRVAIFAGRVGPDASVL

SEQ ID NO: 1279418 - protein, 19 aa, Mycobacterium
RTGVEVFGGVATELARGFR

SEQ ID NO: 1279419 - protein, 20 aa, Mycobacterium
RTGVFLGLSTHEFLGMLIAH

SEQ ID NO: 1279420 - protein, 17 aa, Mycobacterium
RTGVPGADWPRYSAEDR

SEQ ID NO: 1279421 - protein, 20 aa, Mycobacterium
RTGWSALGITLHHGRHDTIA

SEQ ID NO: 1279422 - protein, 17 aa, Mycobacterium
RTGYSVFTFREKIASGE

SEQ ID NO: 1279423 - protein, 21 aa, Mycobacterium
RTHEPHWLLHAALAVGDSRTD

SEQ ID NO: 1279424 - protein, 23 aa, Mycobacterium
RTHISRTKWPTLLNPSTYRGMLT

SEQ ID NO: 1279425 - protein, 25 aa, Mycobacterium
RTHSILRAGGWTAVDIRPVDVTCTM

SEQ ID NO: 1279426 - protein, 18 aa, Mycobacterium
RTIAAPASEIFSVLRDPQ

SEQ ID NO: 1279427 - protein, 21 aa, Mycobacterium
RTIDPELERYLAHRMGAHTIE

SEQ ID NO: 1279428 - protein, 24 aa, Mycobacterium
RTIFKRLFDAGLIYQAERLVNWSP

SEQ ID NO: 1279429 - protein, 21 aa, Mycobacterium
RTITFPGFLKAYVESIDDLAG

SEQ ID NO: 1279430 - protein, 33 aa, Mycobacterium
RTIWGYPKVMADFTIRNGRHFGFDVSIDGLHAV

SEQ ID NO: 1279431 - protein, 17 aa, Mycobacterium
RTKGMERADLLGANAEI

SEQ ID NO: 1279432 - protein, 28 aa, Mycobacterium
RTKRPSVPGLRRHPKIAVVTVAGPIVSG

SEQ ID NO: 1279433 - protein, 25 aa, Mycobacterium
RTKSFRLSFLVAYAARIGERLSAAS

SEQ ID NO: 1279434 - protein, 26 aa, Mycobacterium
RTKVGASLGVRFTPTLAFARDTVPDT

SEQ ID NO: 1279435 - protein, 37 aa, Mycobacterium
RTLACLPGEFGPNLAIMARHGFSIKVLPVDEFGRLDV

SEQ ID NO: 1279436 - protein, 20 aa, Mycobacterium
RTLAECQVFHAIPYAAAPEG

SEQ ID NO: 1279437 - protein, 27 aa, Mycobacterium
RTLARRIVRRGGTMLGDVVGLGKTLTA

SEQ ID NO: 1279438 - protein, 18 aa, Mycobacterium
RTLITLPGYPFAKQRHWV

SEQ ID NO: 1279439 - protein, 27 aa, Mycobacterium
RTLLERELPVYVISIGRTFRTDELDAT

SEQ ID NO: 1279440 - protein, 18 aa, Mycobacterium
RTLLRIDRTLGWQPGSAA

SEQ ID NO: 1279441 - protein, 17 aa, Mycobacterium
RTLRFGLRLHTVARPTE

SEQ ID NO: 1279442 - protein, 23 aa, Mycobacterium
RTLRLDQLIRLYVNHQLDVIVRR

SEQ ID NO: 1279443 - protein, 18 aa, Mycobacterium
RTLVPFGPMADAFLVPAE

SEQ ID NO: 1279444 - protein, 18 aa, Mycobacterium
RTLVPVDGFLPAAPMPAG

SEQ ID NO: 1279445 - protein, 20 aa, Mycobacterium
RTLWGKEIAQFQLIQLKLAT

SEQ ID NO: 1279446 - protein, 17 aa, Mycobacterium
RTMDRWWEATASAIEAC

SEQ ID NO: 1279447 - protein, 19 aa, Mycobacterium
RTMEGFGVHTFRLVNAKGE

SEQ ID NO: 1279448 - protein, 21 aa, Mycobacterium
RTMLELGHRVGITVLGSEITE

SEQ ID NO: 1279449 - protein, 18 aa, Mycobacterium
RTMRAGMFHLRDRRPDVY

SEQ ID NO: 1279450 - protein, 35 aa, Mycobacterium
RTNPIVLVDFWASWCGPCRSFAPVFDRSSQTHPDV

SEQ ID NO: 1279451 - protein, 24 aa, Mycobacterium
RTPAGKPDYRWAKEQTESRPADET

SEQ ID NO: 1279452 - protein, 20 aa, Mycobacterium
RTPDDWLLIDFEGEPGQPLD

SEQ ID NO: 1279453 - protein, 20 aa, Mycobacterium
RTPELYPRLGELLTGMLCEM

SEQ ID NO: 1279454 - protein, 23 aa, Mycobacterium
RTPERLERVAGRLGIDETSTDWQ

SEQ ID NO: 1279455 - protein, 17 aa, Mycobacterium
RTPIIGAVNGAVFTGGL

SEQ ID NO: 1279456 - protein, 19 aa, Mycobacterium
RTPNIPVPYVYPVDLRYLL

SEQ ID NO: 1279457 - protein, 24 aa, Mycobacterium
RTPPPEIVDVLTFDRVSDAHPAAL

SEQ ID NO: 1279458 - protein, 23 aa, Mycobacterium
RTPREVTALVLLTDLAALASADV

SEQ ID NO: 1279459 - protein, 19 aa, Mycobacterium
RTPSGFDLEYGWDAVTVDE

SEQ ID NO: 1279460 - protein, 22 aa, Mycobacterium
RTPTGSRWELDTSLLESAEVTG

SEQ ID NO: 1279461 - protein, 20 aa, Mycobacterium
RTPWPAAPGRIYRAPWSLVA

SEQ ID NO: 1279462 - protein, 18 aa, Mycobacterium
RTQRQYRFVLPGPTLTAA

SEQ ID NO: 1279463 - protein, 19 aa, Mycobacterium
RTQWIRWRKPVIGAPTTPR

SEQ ID NO: 1279464 - protein, 24 aa, Mycobacterium
RTRAELEAALAKRGYPDDIAAAVL

SEQ ID NO: 1279465 - protein, 24 aa, Mycobacterium
RTRFACATHHSMIGLLATTGMRVG

SEQ ID NO: 1279466 - protein, 23 aa, Mycobacterium
RTRFCVWSPPWLGWLSTGCESPL

SEQ ID NO: 1279467 - protein, 18 aa, Mycobacterium
RTRFPGRTLASLYDPVTM

SEQ ID NO: 1279468 - protein, 28 aa, Mycobacterium
RTRGGKISFTHLLGYAIVQAVKKFPNMN

SEQ ID NO: 1279469 - protein, 17 aa, Mycobacterium
RTRGHGVLAGFSASALH

SEQ ID NO: 1279470 - protein, 22 aa, Mycobacterium
RTRGQLAIGVARVIAGGDGMRW

SEQ ID NO: 1279471 - protein, 21 aa, Mycobacterium
RTRLLARGCGGAAGRFWFDIP

SEQ ID NO: 1279472 - protein, 26 aa, Mycobacterium
RTRPIRIAPRKALALRALDVVAPRAL

SEQ ID NO: 1279473 - protein, 18 aa, Mycobacterium
RTRPRSFVGDRHGTGTSA

SEQ ID NO: 1279474 - protein, 24 aa, Mycobacterium
RTRRSLRAALSMSVEPDDGLLRLT

SEQ ID NO: 1279475 - protein, 23 aa, Mycobacterium
RTRTLRASLVADRLAVTVDGMRA

SEQ ID NO: 1279476 - protein, 23 aa, Mycobacterium
RTSDAPLPWAQMHKVAAPTLLTW

SEQ ID NO: 1279477 - protein, 25 aa, Mycobacterium
RTSDLVPLCHPLAITGVDIDFTIGG

SEQ ID NO: 1279478 - protein, 21 aa, Mycobacterium
RTSEFLTHPAFTRYRTETEMM

SEQ ID NO: 1279479 - protein, 18 aa, Mycobacterium
RTSGLLMVAPYIARMTPQ

SEQ ID NO: 1279480 - protein, 19 aa, Mycobacterium
RTSGVPLIIGTNSHEASMF

SEQ ID NO: 1279481 - protein, 17 aa, Mycobacterium
RTSLCNSALCWTHPTMG

SEQ ID NO: 1279482 - protein, 31 aa, Mycobacterium
RTSTAYAPWHIVPCNRKWYSRLAITELLIET

SEQ ID NO: 1279483 - protein, 18 aa, Mycobacterium
RTTARRAGDEFVVNGQKL

SEQ ID NO: 1279484 - protein, 25 aa, Mycobacterium
RTTLAPKAFGAWHLHRLTRDTELEF

SEQ ID NO: 1279485 - protein, 18 aa, Mycobacterium
RTTLYRHFHSSSHLLAAT

SEQ ID NO: 1279486 - protein, 21 aa, Mycobacterium
RTTPMKFQWAKGYSDYHPEQP

SEQ ID NO: 1279487 - protein, 17 aa, Mycobacterium
RTTPMRLFWAREYSDYH

SEQ ID NO: 1279488 - protein, 19 aa, Mycobacterium
RTTRGMAVAACRDAIEDAG

SEQ ID NO: 1279489 - protein, 26 aa, Mycobacterium
RTTSGEVRARWVINAAGLGADHLDAE

SEQ ID NO: 1279490 - protein, 24 aa, Mycobacterium
RTTTAAWRDKPSWYQVSTQDRTID

SEQ ID NO: 1279491 - protein, 19 aa, Mycobacterium
RTTVIPDLQAQMMALADAW

SEQ ID NO: 1279492 - protein, 34 aa, Mycobacterium
RTVAHRAKLNWWESRALYGWTVLVPRTKDQAGEM

SEQ ID NO: 1279493 - protein, 24 aa, Mycobacterium
RTVFAEAMTWLFGELIDQRAEEPV

SEQ ID NO: 1279494 - protein, 18 aa, Mycobacterium
RTVFDARLSDYIDETISG

SEQ ID NO: 1279495 - protein, 18 aa, Mycobacterium
RTVFRGEGEREVGFRSAL

SEQ ID NO: 1279496 - protein, 23 aa, Mycobacterium
RTVGGARRARSIFIINPADPPIL

SEQ ID NO: 1279497 - protein, 23 aa, Mycobacterium
RTVKAIMAESGWTADEVAAAHVV

SEQ ID NO: 1279498 - protein, 31 aa, Mycobacterium
RTVLDTEPWRGEPLLSFLRKMVFWADVVVEP

SEQ ID NO: 1279499 - protein, 20 aa, Mycobacterium
RTVLRSGCYLTHDHGLYANT

SEQ ID NO: 1279500 - protein, 29 aa, Mycobacterium
RTVLSRASELLGFQVPPAIRQVATAIENG

SEQ ID NO: 1279501 - protein, 19 aa, Mycobacterium
RTVLVSSHLLSEMANTADR

SEQ ID NO: 1279502 - protein, 19 aa, Mycobacterium
RTVRAAVPAMIEAGNGGSI

SEQ ID NO: 1279503 - protein, 20 aa, Mycobacterium
RTVREGDWAGAHALAEALSV

SEQ ID NO: 1279504 - protein, 24 aa, Mycobacterium
RTVVKRTVAEFGGLDIVVNNVAYQ

SEQ ID NO: 1279505 - protein, 19 aa, Mycobacterium
RTVWIKDLGCVVAVGSETD

SEQ ID NO: 1279506 - protein, 17 aa, Mycobacterium
RTVWNARTPERYPDLVA

SEQ ID NO: 1279507 - protein, 18 aa, Mycobacterium
RTVYRLHPGDSLQIDGEG

SEQ ID NO: 1279508 - protein, 17 aa, Mycobacterium
RTYARALAIVGGKAPTL

SEQ ID NO: 1279509 - protein, 17 aa, Mycobacterium
RTYECADGGFVAVGALE

SEQ ID NO: 1279510 - protein, 18 aa, Mycobacterium
RTYRGRDEITVWLSEAGS

SEQ ID NO: 1279511 - protein, 18 aa, Mycobacterium
RTYRITHRTVYRYSDVVT

SEQ ID NO: 1279512 - protein, 19 aa, Mycobacterium
RVAALEWALRGAGAQTEAA

SEQ ID NO: 1279513 - protein, 22 aa, Mycobacterium
RVAEFGASVGRFLDSIDERALV

SEQ ID NO: 1279514 - protein, 24 aa, Mycobacterium
RVAELALRIAGPALLVGEEPAVVH

SEQ ID NO: 1279515 - protein, 27 aa, Mycobacterium
RVAELRSLLRFLFVRGLTPRLLTTAVP

SEQ ID NO: 1279516 - protein, 17 aa, Mycobacterium
RVAERIVETKKAGNDVV

SEQ ID NO: 1279517 - protein, 26 aa, Mycobacterium
RVAEVLGIHYEIPWPNREMKTARPFR

SEQ ID NO: 1279518 - protein, 26 aa, Mycobacterium
RVAGEFYFNAINVMRGAEAISAYAPI

SEQ ID NO: 1279519 - protein, 19 aa, Mycobacterium
RVAGETARFLIHDLGADAM

SEQ ID NO: 1279520 - protein, 24 aa, Mycobacterium
RVAGIDVAVCKPVQTGTGPAGGTG

SEQ ID NO: 1279521 - protein, 24 aa, Mycobacterium
RVAGIDVAVCKPVQTGTGPVGGTG

SEQ ID NO: 1279522 - protein, 18 aa, Mycobacterium
RVAGLIGTVGVRIDGRQQ

SEQ ID NO: 1279523 - protein, 18 aa, Mycobacterium
RVAILGGNRIPFARADGA

SEQ ID NO: 1279524 - protein, 17 aa, Mycobacterium
RVAILRSGRLVEIDNIA

SEQ ID NO: 1279525 - protein, 27 aa, Mycobacterium
RVALASSTRYEWVLADFSVLCAGAATT

SEQ ID NO: 1279526 - protein, 20 aa, Mycobacterium
RVALDSATGRWTFTPTASTL

SEQ ID NO: 1279527 - protein, 21 aa, Mycobacterium
RVALGTALARLGMFAPALSHL

SEQ ID NO: 1279528 - protein, 24 aa, Mycobacterium
RVALLGDVPVMFGGEVHGDTLVIT

SEQ ID NO: 1279529 - protein, 20 aa, Mycobacterium
RVALLSATRYEWPIIDFAIL

SEQ ID NO: 1279530 - protein, 20 aa, Mycobacterium
RVALLSATRYEWPILDYAIL

SEQ ID NO: 1279531 - protein, 19 aa, Mycobacterium
RVALTTWKTDVALLEQLLG

SEQ ID NO: 1279532 - protein, 25 aa, Mycobacterium
RVANSLSQLGFRVVPSDANFILFGE

SEQ ID NO: 1279533 - protein, 17 aa, Mycobacterium
RVAPFNVNYRYVRDELR

SEQ ID NO: 1279534 - protein, 20 aa, Mycobacterium
RVAQRYGLSGTRPPGDGRWW

SEQ ID NO: 1279535 - protein, 19 aa, Mycobacterium
RVAQYLVRNGYRAVNVSGG

SEQ ID NO: 1279536 - protein, 28 aa, Mycobacterium
RVARYAQGWCPFRAPAVLAQTARTAALE

SEQ ID NO: 1279537 - protein, 19 aa, Mycobacterium
RVASLQARIDALSVGLDRK

SEQ ID NO: 1279538 - protein, 21 aa, Mycobacterium
RVATVLRRMFIRGEITEGTML

SEQ ID NO: 1279539 - protein, 25 aa, Mycobacterium
RVAVHAARTRLCYGEWLRRRNRRPD

SEQ ID NO: 1279540 - protein, 19 aa, Mycobacterium
RVAVLDGLGHWWMVEDPHR

SEQ ID NO: 1279541 - protein, 19 aa, Mycobacterium
RVAVRSGVPDYGYAFEPDP

SEQ ID NO: 1279542 - protein, 17 aa, Mycobacterium
RVAVYGFRSQGRRAVHL

SEQ ID NO: 1279543 - protein, 19 aa, Mycobacterium
RVCRFGRGHRKAMVVLMLM

SEQ ID NO: 1279544 - protein, 22 aa, Mycobacterium
RVDADVLLCYEVNGEDLPAEHG

SEQ ID NO: 1279545 - protein, 17 aa, Mycobacterium
RVDAGQFDRARALVAEM

SEQ ID NO: 1279546 - protein, 19 aa, Mycobacterium
RVDDAPWTPPPRTSPARVT

SEQ ID NO: 1279547 - protein, 25 aa, Mycobacterium
RVDDEAAFELLRWRSQETNVKLRLL

SEQ ID NO: 1279548 - protein, 19 aa, Mycobacterium
RVDEVYCVAKVFGVSPRYF

SEQ ID NO: 1279549 - protein, 19 aa, Mycobacterium
RVDFSRFRDTLGYEATWSV

SEQ ID NO: 1279550 - protein, 28 aa, Mycobacterium
RVDGWPNQRFALLFLAWLAAHPEVRDEY

SEQ ID NO: 1279551 - protein, 23 aa, Mycobacterium
RVDHSRRIICSAALEEFAASGYA

SEQ ID NO: 1279552 - protein, 18 aa, Mycobacterium
RVDLALLGIRGRPPVSRT

SEQ ID NO: 1279553 - protein, 17 aa, Mycobacterium
RVDLLIREGVKVASFAL

SEQ ID NO: 1279554 - protein, 20 aa, Mycobacterium
RVDLLVCRNTLMYLNADTQR

SEQ ID NO: 1279555 - protein, 19 aa, Mycobacterium
RVDLPWRHVTVAGDAELEA

SEQ ID NO: 1279556 - protein, 25 aa, Mycobacterium
RVDNIGKLPMAWVDPAAADSRTVLA

SEQ ID NO: 1279557 - protein, 21 aa, Mycobacterium
RVDRACTRWIRELRRPQDAAA

SEQ ID NO: 1279558 - protein, 17 aa, Mycobacterium
RVDRPGARISLMTAEML

SEQ ID NO: 1279559 - protein, 28 aa, Mycobacterium
RVEAAEVFQSWLGGLAAWFGQLDLTEAE

SEQ ID NO: 1279560 - protein, 25 aa, Mycobacterium
RVEAALRRCDKPVPTAGLRRLQRYR

SEQ ID NO: 1279561 - protein, 21 aa, Mycobacterium
RVEGGRCVLDLRTVDPEEDAR

SEQ ID NO: 1279562 - protein, 21 aa, Mycobacterium
RVEGHFLPGRTDYCITMIDPS

SEQ ID NO: 1279563 - protein, 27 aa, Mycobacterium
RVELLPVPGLPEFRPGDNLSAAIAEAA

SEQ ID NO: 1279564 - protein, 27 aa, Mycobacterium
RVELSWTRRWFAVAPWVALLRRHLPEL

SEQ ID NO: 1279565 - protein, 22 aa, Mycobacterium
RVEQLPEIWRRLVEGGMESGHA

SEQ ID NO: 1279566 - protein, 18 aa, Mycobacterium
RVERMLPWIEDVVAELPA

SEQ ID NO: 1279567 - protein, 25 aa, Mycobacterium
RVEYERLAALGVRFTQQPTDMGPVT

SEQ ID NO: 1279568 - protein, 36 aa, Mycobacterium
RVEYKLRDWLFARQRYWGEPFPIVYDADDRAHGLPE

SEQ ID NO: 1279569 - protein, 18 aa, Mycobacterium
RVFAQFTLPEIFDRRSEA

SEQ ID NO: 1279570 - protein, 22 aa, Mycobacterium
RVFEELSLRGCVATLDGSDVIR

SEQ ID NO: 1279571 - protein, 17 aa, Mycobacterium
RVGAEAGRLDLLVNNAA

SEQ ID NO: 1279572 - protein, 17 aa, Mycobacterium
RVGDSIVAGDAYGRVRR

SEQ ID NO: 1279573 - protein, 24 aa, Mycobacterium
RVGDYPTWLQRFTVAITALPERQR

SEQ ID NO: 1279574 - protein, 25 aa, Mycobacterium
RVGEHRVCTVFDLMLAQYGVARPGL

SEQ ID NO: 1279575 - protein, 19 aa, Mycobacterium
RVGEQVVRHALVGVVDTIP

SEQ ID NO: 1279576 - protein, 25 aa, Mycobacterium
RVGEVIKRIAASPALNGAATVANED

SEQ ID NO: 1279577 - protein, 19 aa, Mycobacterium
RVGHSLDPKADYGPLVTGA

SEQ ID NO: 1279578 - protein, 25 aa, Mycobacterium
RVGLLMPNCLEFIPVQQAVWAAGAV

SEQ ID NO: 1279579 - protein, 24 aa, Mycobacterium
RVGLRIVVEIKRDAVAKVVLNNLY

SEQ ID NO: 1279580 - protein, 22 aa, Mycobacterium
RVGPLAFRLGYTSESAFSNAFK

SEQ ID NO: 1279581 - protein, 21 aa, Mycobacterium
RVGTHLKTRLEGLKERHPLVG

SEQ ID NO: 1279582 - protein, 25 aa, Mycobacterium
RVHHEMRRLLGANLFDLTHEPWLPR

SEQ ID NO: 1279583 - protein, 19 aa, Mycobacterium
RVHHLRWPVGRNLVDTMMA

SEQ ID NO: 1279584 - protein, 31 aa, Mycobacterium
RVHLFTGDCLFPGGVGKTWREGDFEQLLGDV

SEQ ID NO: 1279585 - protein, 18 aa, Mycobacterium
RVHSGIVGFNAWLVNHLE

SEQ ID NO: 1279586 - protein, 20 aa, Mycobacterium
RVIAALAHHPACSRADGAGR

SEQ ID NO: 1279587 - protein, 17 aa, Mycobacterium
RVIAETVVEVDFEVTLL

SEQ ID NO: 1279588 - protein, 32 aa, Mycobacterium
RVIEMAGDFGGVWYWNRFPGIQCDNDAYCYIP

SEQ ID NO: 1279589 - protein, 20 aa, Mycobacterium
RVIGSRRVVLAFDPTADDPD

SEQ ID NO: 1279590 - protein, 26 aa, Mycobacterium
RVIIPARWNFLNVVRPLGVQLDNLLL

SEQ ID NO: 1279591 - protein, 20 aa, Mycobacterium
RVIMLRKWGQEVIKTVFGRR

SEQ ID NO: 1279592 - protein, 20 aa, Mycobacterium
RVIPSDANFILFGEFADAPA

SEQ ID NO: 1279593 - protein, 22 aa, Mycobacterium
RVITLRYLLSMIAAERGMIATF

SEQ ID NO: 1279594 - protein, 24 aa, Mycobacterium
RVIVPDFQLSLAIGKEGQNARLAA

SEQ ID NO: 1279595 - protein, 20 aa, Mycobacterium
RVKASLPRLGELAIGGTAVG

SEQ ID NO: 1279596 - protein, 22 aa, Mycobacterium
RVKEIVILSVGGQWGSEYELYA

SEQ ID NO: 1279597 - protein, 22 aa, Mycobacterium
RVKFTTGNGLPFKIRDIPVAPD

SEQ ID NO: 1279598 - protein, 25 aa, Mycobacterium
RVKHLAGAFFTKWLYFASATTSADD

SEQ ID NO: 1279599 - protein, 22 aa, Mycobacterium
RVKNLPVRRWLGGSGGDATFDH

SEQ ID NO: 1279600 - protein, 20 aa, Mycobacterium
RVKQHPDRFVAGWQVVALQP

SEQ ID NO: 1279601 - protein, 21 aa, Mycobacterium
RVLADHVIWLAGKQGAASGRI

SEQ ID NO: 1279602 - protein, 17 aa, Mycobacterium
RVLAGLLGGYRGREGLV

SEQ ID NO: 1279603 - protein, 18 aa, Mycobacterium
RVLAWLHPPGTDFAPALL

SEQ ID NO: 1279604 - protein, 18 aa, Mycobacterium
RVLDGGGLFGERNIRTVV

SEQ ID NO: 1279605 - protein, 18 aa, Mycobacterium
RVLEFGGRLYTAKDSRTT

SEQ ID NO: 1279606 - protein, 24 aa, Mycobacterium
RVLFRRLAVFAGGFDLDGAQAITV

SEQ ID NO: 1279607 - protein, 20 aa, Mycobacterium
RVLGEAVALLRDMLNPDDLV

SEQ ID NO: 1279608 - protein, 17 aa, Mycobacterium
RVLGPGLRELAARHRSV

SEQ ID NO: 1279609 - protein, 18 aa, Mycobacterium
RVLGRRVGPSTGTNIWGA

SEQ ID NO: 1279610 - protein, 25 aa, Mycobacterium
RVLHRYPTCQLAIPGICVGTSAEVH

SEQ ID NO: 1279611 - protein, 19 aa, Mycobacterium
RVLHVPVVVIPRDQLTPED

SEQ ID NO: 1279612 - protein, 22 aa, Mycobacterium
RVLIDGLAGWGLDVHTVAPEAD

SEQ ID NO: 1279613 - protein, 23 aa, Mycobacterium
RVLKLSRQPYYRWLADPVTDAEL

SEQ ID NO: 1279614 - protein, 17 aa, Mycobacterium
RVLKTAASLREPHRVSR

SEQ ID NO: 1279615 - protein, 20 aa, Mycobacterium
RVLLGVGVGVRAELAVTNSI

SEQ ID NO: 1279616 - protein, 23 aa, Mycobacterium
RVLMRRCPSRSFTMVGDLAQRRS

SEQ ID NO: 1279617 - protein, 20 aa, Mycobacterium
RVLPMRSEWALVSSAVNADF

SEQ ID NO: 1279618 - protein, 18 aa, Mycobacterium
RVLPYCWNDETPLSSHEL

SEQ ID NO: 1279619 - protein, 25 aa, Mycobacterium
RVLQPVRHRLGAAALSFKTHALHAI

SEQ ID NO: 1279620 - protein, 20 aa, Mycobacterium
RVLRAEITFGDTLCAEAEGL

SEQ ID NO: 1279621 - protein, 17 aa, Mycobacterium
RVLRNAFTDSWHGRESE

SEQ ID NO: 1279622 - protein, 24 aa, Mycobacterium
RVLRRARDGVALNVDEAAIALTAR

SEQ ID NO: 1279623 - protein, 17 aa, Mycobacterium
RVLRRLSGTAVMDHMGW

SEQ ID NO: 1279624 - protein, 17 aa, Mycobacterium
RVLSARSRFHAVSYGMT

SEQ ID NO: 1279625 - protein, 17 aa, Mycobacterium
RVLSHPGVRAIRADVER

SEQ ID NO: 1279626 - protein, 18 aa, Mycobacterium
RVLSRLAAEDGVGLHLPT

SEQ ID NO: 1279627 - protein, 21 aa, Mycobacterium
RVLSRVVARYGRLDLLCLDEL

SEQ ID NO: 1279628 - protein, 23 aa, Mycobacterium
RVLTMTYLDGMDWAAAQQADQDL

SEQ ID NO: 1279629 - protein, 18 aa, Mycobacterium
RVLTYAMPDVTRSGVVGR

SEQ ID NO: 1279630 - protein, 24 aa, Mycobacterium
RVMKKAVAYLLPFIEAEKAENGTS

SEQ ID NO: 1279631 - protein, 17 aa, Mycobacterium
RVMKKAVAYLLPYIEAE

SEQ ID NO: 1279632 - protein, 18 aa, Mycobacterium
RVMRELYEQAIAYWRAYA

SEQ ID NO: 1279633 - protein, 24 aa, Mycobacterium
RVNPFRWMEFYAFGAHFPDLPDED

SEQ ID NO: 1279634 - protein, 19 aa, Mycobacterium
RVPCLPSDRLLNLLHYVKW

SEQ ID NO: 1279635 - protein, 17 aa, Mycobacterium
RVPLLGGKIENFIGRQL

SEQ ID NO: 1279636 - protein, 32 aa, Mycobacterium
RVPRLEPRPLPAVPLTRLESGTSHLVIGATGN

SEQ ID NO: 1279637 - protein, 20 aa, Mycobacterium
RVPTEKGYREFVDRLQDVKP

SEQ ID NO: 1279638 - protein, 18 aa, Mycobacterium
RVPTPLRWGEYRPGRLVD

SEQ ID NO: 1279639 - protein, 28 aa, Mycobacterium
RVQAVWKPEDQWGLGIDNIEYFRPTGEP

SEQ ID NO: 1279640 - protein, 31 aa, Mycobacterium
RVQEAMANPRFREHIPLMIGGSGEKKTIPLA

SEQ ID NO: 1279641 - protein, 20 aa, Mycobacterium
RVQELFEARIPRNRAPIADV

SEQ ID NO: 1279642 - protein, 19 aa, Mycobacterium
RVQEVFFYEPIILGDKDSR

SEQ ID NO: 1279643 - protein, 22 aa, Mycobacterium
RVQLAALLIDDWDVIALDEPTN

SEQ ID NO: 1279644 - protein, 19 aa, Mycobacterium
RVQRRARAAELLRSVMGRH

SEQ ID NO: 1279645 - protein, 17 aa, Mycobacterium
RVQRVWAAIRTEVLGGQ

SEQ ID NO: 1279646 - protein, 19 aa, Mycobacterium
RVQVKSSRVPSGMNPLRYS

SEQ ID NO: 1279647 - protein, 20 aa, Mycobacterium
RVRADTGLLDGVREIGSGSV

SEQ ID NO: 1279648 - protein, 17 aa, Mycobacterium
RVRAHLDLAVTWPHSLP

SEQ ID NO: 1279649 - protein, 18 aa, Mycobacterium
RVRCGWIDQSRLSAADFE

SEQ ID NO: 1279650 - protein, 19 aa, Mycobacterium
RVRDGRVSVQIGDRAGSLV

SEQ ID NO: 1279651 - protein, 22 aa, Mycobacterium
RVRDGTGAGGCWSFVLRPERGG

SEQ ID NO: 1279652 - protein, 24 aa, Mycobacterium
RVRDRGRLRYPEWVDGGVDDAQVR

SEQ ID NO: 1279653 - protein, 22 aa, Mycobacterium
RVRELIDRYPLRGIKGPMGTAQ

SEQ ID NO: 1279654 - protein, 22 aa, Mycobacterium
RVREVATLIPGAMRGLVSERQL

SEQ ID NO: 1279655 - protein, 17 aa, Mycobacterium
RVRGRLATSPAWTAVEV

SEQ ID NO: 1279656 - protein, 19 aa, Mycobacterium
RVRLLRAAVEIALGRDALS

SEQ ID NO: 1279657 - protein, 17 aa, Mycobacterium
RVRLPLLKLTVAVEDPT

SEQ ID NO: 1279658 - protein, 17 aa, Mycobacterium
RVRRLEELTGLSLARPA

SEQ ID NO: 1279659 - protein, 18 aa, Mycobacterium
RVRRNGGVPTAWRAVPEL

SEQ ID NO: 1279660 - protein, 17 aa, Mycobacterium
RVRRRIWELEKRRHHVP

SEQ ID NO: 1279661 - protein, 17 aa, Mycobacterium
RVRRSWLERGAADAELG

SEQ ID NO: 1279662 - protein, 24 aa, Mycobacterium
RVRSRLFPVMHDIVLAHQRRGHTV

SEQ ID NO: 1279663 - protein, 22 aa, Mycobacterium
RVRWRAGRRWSPSFRFPEGSKM

SEQ ID NO: 1279664 - protein, 17 aa, Mycobacterium
RVSAIRGAVLNWSGEND

SEQ ID NO: 1279665 - protein, 17 aa, Mycobacterium
RVSDGFITPLPYGTGVD

SEQ ID NO: 1279666 - protein, 22 aa, Mycobacterium
RVSDGSLLFLMHLISKMQPVKG

SEQ ID NO: 1279667 - protein, 25 aa, Mycobacterium
RVSDHRPHLLSFLFSPDRGSPTARI

SEQ ID NO: 1279668 - protein, 17 aa, Mycobacterium
RVSDLLLVPTMVQMLVD

SEQ ID NO: 1279669 - protein, 21 aa, Mycobacterium
RVSFVGRSMVRNMGIARQLGY

SEQ ID NO: 1279670 - protein, 21 aa, Mycobacterium
RVSIYWPAEAKPYSGDTYTLG

SEQ ID NO: 1279671 - protein, 20 aa, Mycobacterium
RVSLAHALIGWTRGTGLMGH

SEQ ID NO: 1279672 - protein, 18 aa, Mycobacterium
RVSLMLPYLPVDKADPEE

SEQ ID NO: 1279673 - protein, 19 aa, Mycobacterium
RVSLTATWMRSRVLSARSR

SEQ ID NO: 1279674 - protein, 19 aa, Mycobacterium
RVSPPGGTRVNSWQAPFGA

SEQ ID NO: 1279675 - protein, 26 aa, Mycobacterium
RVSPTDFRLWVCLHEVTHRVQFRANP

SEQ ID NO: 1279676 - protein, 23 aa, Mycobacterium
RVSQALTGMGFRVIPSDANFILF

SEQ ID NO: 1279677 - protein, 17 aa, Mycobacterium
RVSRIIGSPGYPAAEER

SEQ ID NO: 1279678 - protein, 18 aa, Mycobacterium
RVSRQLGELITFAIRIPL

SEQ ID NO: 1279679 - protein, 23 aa, Mycobacterium
RVSSRPANPVAEWIARGNVRNIR

SEQ ID NO: 1279680 - protein, 21 aa, Mycobacterium
RVSVRAVIHRHYLEVLRPLVR

SEQ ID NO: 1279681 - protein, 20 aa, Mycobacterium
RVSWAGSLRPRLFSMAEPPE

SEQ ID NO: 1279682 - protein, 20 aa, Mycobacterium
RVSYAFGIGHRAEEYRHFGV

SEQ ID NO: 1279683 - protein, 33 aa, Mycobacterium
RVTDGKLNLLHFLRPDFGIPRVTIGLDVHSIQP

SEQ ID NO: 1279684 - protein, 21 aa, Mycobacterium
RVTDVRNWFVFSASERDVDTD

SEQ ID NO: 1279685 - protein, 19 aa, Mycobacterium
RVTFGRGCLAEVGDRAAAL

SEQ ID NO: 1279686 - protein, 17 aa, Mycobacterium
RVTFHGRFRDVDDLPIQ

SEQ ID NO: 1279687 - protein, 18 aa, Mycobacterium
RVTGAVVVVSIFVNPLQF

SEQ ID NO: 1279688 - protein, 17 aa, Mycobacterium
RVTGIARSDLTAHDHGD

SEQ ID NO: 1279689 - protein, 19 aa, Mycobacterium
RVTGRKNLHVWAGECHVHA

SEQ ID NO: 1279690 - protein, 19 aa, Mycobacterium
RVTTFAQALDAGWLVTTAF

SEQ ID NO: 1279691 - protein, 19 aa, Mycobacterium
RVTVIAAGFDAAGPGRKPV

SEQ ID NO: 1279692 - protein, 22 aa, Mycobacterium
RVVAKIYCGLGLLKKETVREVH

SEQ ID NO: 1279693 - protein, 24 aa, Mycobacterium
RVVAPEAYFQFPVAKYGIALDNWS

SEQ ID NO: 1279694 - protein, 24 aa, Mycobacterium
RVVAVARPLLAPAVESVEAVVDWL

SEQ ID NO: 1279695 - protein, 20 aa, Mycobacterium
RVVELAAWTFVPAAGAVLAD

SEQ ID NO: 1279696 - protein, 26 aa, Mycobacterium
RVVEVLHTWLPPRLAPAGMTTFDISE

SEQ ID NO: 1279697 - protein, 29 aa, Mycobacterium
RVVFPYFFCCHTCRNCLAGRRNACLNLKM

SEQ ID NO: 1279698 - protein, 19 aa, Mycobacterium
RVVHAAAPCPVEIKRRMID

SEQ ID NO: 1279699 - protein, 22 aa, Mycobacterium
RVVHGARIGFVFQDPGTSLNPL

SEQ ID NO: 1279700 - protein, 19 aa, Mycobacterium
RVVSIGAFEHFGFNKYDDY

SEQ ID NO: 1279701 - protein, 17 aa, Mycobacterium
RVVTARRGPAVPASPSA

SEQ ID NO: 1279702 - protein, 17 aa, Mycobacterium
RVYCDADLPFGCPAGED

SEQ ID NO: 1279703 - protein, 25 aa, Mycobacterium
RVYGTLPWHPDLWLDSEDALELQGR

SEQ ID NO: 1279704 - protein, 20 aa, Mycobacterium
RVYRWRPAPRDGDFDQLVAG

SEQ ID NO: 1279705 - protein, 19 aa, Mycobacterium
RVYSNYGFGVLAATIERAA

SEQ ID NO: 1279706 - protein, 17 aa, Mycobacterium
RVYVRCGMVPAPTDVIW

SEQ ID NO: 1279707 - protein, 26 aa, Mycobacterium
RWAEPSEIAGAFVFMASDAASYVTGQ

SEQ ID NO: 1279708 - protein, 20 aa, Mycobacterium
RWAGSTAKLHVHIGNLRRKL

SEQ ID NO: 1279709 - protein, 20 aa, Mycobacterium
RWALVDGAEVTVVFERPPSP

SEQ ID NO: 1279710 - protein, 21 aa, Mycobacterium
RWAYYPWRRTVVSILGPRAFA

SEQ ID NO: 1279711 - protein, 19 aa, Mycobacterium
RWDEPIRWVHVGDVPDMSA

SEQ ID NO: 1279712 - protein, 21 aa, Mycobacterium
RWDPDAAVALMLRHRCTHMAG

SEQ ID NO: 1279713 - protein, 23 aa, Mycobacterium
RWEPPALQIARYVTRDVEYYGQV

SEQ ID NO: 1279714 - protein, 20 aa, Mycobacterium
RWFVGRPELIGADGVHPTDA

SEQ ID NO: 1279715 - protein, 19 aa, Mycobacterium
RWGAQRIAHELALRGVDAP

SEQ ID NO: 1279716 - protein, 17 aa, Mycobacterium
RWHDVERVMQLNYYAPL

SEQ ID NO: 1279717 - protein, 21 aa, Mycobacterium
RWHGGELDLAMPGGESAQQVL

SEQ ID NO: 1279718 - protein, 17 aa, Mycobacterium
RWINGLWAGERIAADLV

SEQ ID NO: 1279719 - protein, 18 aa, Mycobacterium
RWLGPAILYPRLARAVDV

SEQ ID NO: 1279720 - protein, 25 aa, Mycobacterium
RWLSPPKPGIRRLPIPKHRLVQLQR

SEQ ID NO: 1279721 - protein, 26 aa, Mycobacterium
RWLTDRSWCRPNWTVAELEAAKKGRT

SEQ ID NO: 1279722 - protein, 19 aa, Mycobacterium
RWLWEAWTIDGLAGGRWAL

SEQ ID NO: 1279723 - protein, 19 aa, Mycobacterium
RWNDVVRMLTPLVADQSLE

SEQ ID NO: 1279724 - protein, 17 aa, Mycobacterium
RWPCPVPGARPLSEVGD

SEQ ID NO: 1279725 - protein, 26 aa, Mycobacterium
RWPEARRWLDERGYDSTLDYVRAMAI

SEQ ID NO: 1279726 - protein, 17 aa, Mycobacterium
RWPEFPIWKVIDGATQI

SEQ ID NO: 1279727 - protein, 19 aa, Mycobacterium
RWPGSDVRGQILELCAERP

SEQ ID NO: 1279728 - protein, 18 aa, Mycobacterium
RWPQAAAVCDDVLRAFDP

SEQ ID NO: 1279729 - protein, 18 aa, Mycobacterium
RWPRGATFEGWRQRLPEG

SEQ ID NO: 1279730 - protein, 17 aa, Mycobacterium
RWPVGRNLVDTMMAAGI

SEQ ID NO: 1279731 - protein, 18 aa, Mycobacterium
RWQDSGAVWTVVSRTPDR

SEQ ID NO: 1279732 - protein, 18 aa, Mycobacterium
RWRAGGAAADAVAADVDE

SEQ ID NO: 1279733 - protein, 20 aa, Mycobacterium
RWRAMLELLVGEGFPVAAPR

SEQ ID NO: 1279734 - protein, 25 aa, Mycobacterium
RWRDCYRVRARVLGFEGQLALAEAM

SEQ ID NO: 1279735 - protein, 18 aa, Mycobacterium
RWRGSRLKDPRQADFLTL

SEQ ID NO: 1279736 - protein, 19 aa, Mycobacterium
RWRIDGVTGPDEYTAVVRD

SEQ ID NO: 1279737 - protein, 25 aa, Mycobacterium
RWRLHGRLRVGTDVHELVQTQLAGL

SEQ ID NO: 1279738 - protein, 20 aa, Mycobacterium
RWRRLGLLRRPKADDRAVVE

SEQ ID NO: 1279739 - protein, 22 aa, Mycobacterium
RWRSGAPLVLCPDADDPELGAD

SEQ ID NO: 1279740 - protein, 19 aa, Mycobacterium
RWRTAYLVLSGRPIDAGTA

SEQ ID NO: 1279741 - protein, 19 aa, Mycobacterium
RWSRGNTLSGLRCHSDAGS

SEQ ID NO: 1279742 - protein, 24 aa, Mycobacterium
RWSTPVKEFMRTAAADTEVRGVPI

SEQ ID NO: 1279743 - protein, 26 aa, Mycobacterium
RWSTRAELRLAIVTWIERTYHRRRRQ

SEQ ID NO: 1279744 - protein, 26 aa, Mycobacterium
RWTIRWKPALNAFAITFADRMPGSET

SEQ ID NO: 1279745 - protein, 35 aa, Mycobacterium; identical to SEQ ID NO: 728769

SEQ ID NO: 1279746 - protein, 20 aa, Mycobacterium
RWTVRPGRVAARHWTIEPDL

SEQ ID NO: 1279747 - protein, 19 aa, Mycobacterium
RWVLFDVGSGLHFQYQGIF

SEQ ID NO: 1279748 - protein, 20 aa, Mycobacterium
RWYDVDFPQVIALREQIYPT

SEQ ID NO: 1279749 - protein, 18 aa, Mycobacterium
RWYHDHLGMIVLHEEVNE

SEQ ID NO: 1279750 - protein, 26 aa, Mycobacterium
RYAAKAFLCTEVARWIDEEGLSLDVA

SEQ ID NO: 1279751 - protein, 24 aa, Mycobacterium
RYATRDELILAALEAWMEDNRYSG

SEQ ID NO: 1279752 - protein, 23 aa, Mycobacterium
RYDKIHLYDAFGFSESKTVAPGR

SEQ ID NO: 1279753 - protein, 20 aa, Mycobacterium
RYEALRARRVLAQWRDAAAT

SEQ ID NO: 1279754 - protein, 19 aa, Mycobacterium
RYEKPWLQVGYFYGHMFLN

SEQ ID NO: 1279755 - protein, 18 aa, Mycobacterium
RYEREAAQWCSRTGGSVV

SEQ ID NO: 1279756 - protein, 25 aa, Mycobacterium
RYERWKETAFQFAWLLDAAKAGHDG

SEQ ID NO: 1279757 - protein, 21 aa, Mycobacterium
RYETAEVYEWMALAKRGLGDR

SEQ ID NO: 1279758 - protein, 19 aa, Mycobacterium
RYFGVKEALLLSDDQRSPI

SEQ ID NO: 1279759 - protein, 18 aa, Mycobacterium
RYFPPDVRPGSKPVGPPV

SEQ ID NO: 1279760 - protein, 18 aa, Mycobacterium
RYFRESRLMKIAPVSQEM

SEQ ID NO: 1279761 - protein, 21 aa, Mycobacterium
RYFRRRCYHEGISKAVVTEIA

SEQ ID NO: 1279762 - protein, 21 aa, Mycobacterium
RYGAFHRSFALPAHVTGEAVS

SEQ ID NO: 1279763 - protein, 26 aa, Mycobacterium
RYGAIAALGRRYGPTFTLNIPVFGET

SEQ ID NO: 1279764 - protein, 27 aa, Mycobacterium
RYGEEICAWIKVRAGAAPLDAHAVREF

SEQ ID NO: 1279765 - protein, 17 aa, Mycobacterium
RYGGRLSALTAKIAAGR

SEQ ID NO: 1279766 - protein, 19 aa, Mycobacterium
RYGGTFIADALPAPRTGDV

SEQ ID NO: 1279767 - protein, 17 aa, Mycobacterium
RYGLPYDGDIHILFYNA

SEQ ID NO: 1279768 - protein, 19 aa, Mycobacterium
RYHARAVALVALERESCEP

SEQ ID NO: 1279769 - protein, 21 aa, Mycobacterium
RYHPRARSGWDREAGRLPADH

SEQ ID NO: 1279770 - protein, 18 aa, Mycobacterium
RYLEFAVDNCERLRDGRN

SEQ ID NO: 1279771 - protein, 20 aa, Mycobacterium
RYLLHGTDALQHWMQELSDR

SEQ ID NO: 1279772 - protein, 17 aa, Mycobacterium
RYLNRLSDLLFILSRVA

SEQ ID NO: 1279773 - protein, 18 aa, Mycobacterium
RYLNYRKTSIYGGSNEVQ

SEQ ID NO: 1279774 - protein, 24 aa, Mycobacterium
RYLPKEFSRRGVQMYQDGKRTWAV

SEQ ID NO: 1279775 - protein, 18 aa, Mycobacterium
RYLRMGAAVRRAGMSVTT

SEQ ID NO: 1279776 - protein, 24 aa, Mycobacterium
RYLSRGASSWGLRVTEHKYLFSGM

SEQ ID NO: 1279777 - protein, 17 aa, Mycobacterium
RYMGHGLVTDWKVGSTF

SEQ ID NO: 1279778 - protein, 23 aa, Mycobacterium
RYMLDRRRALGGFLPERRTKSRA

SEQ ID NO: 1279779 - protein, 20 aa, Mycobacterium
RYPADRCLLLPPSNAPAIRT

SEQ ID NO: 1279780 - protein, 17 aa, Mycobacterium
RYPADYLVKLSTLSTSA

SEQ ID NO: 1279781 - protein, 20 aa, Mycobacterium
RYPDVRYYRDAVAPLVDDRR

SEQ ID NO: 1279782 - protein, 25 aa, Mycobacterium
RYPGDAGVLCSMLLNRLSLAPGEAL

SEQ ID NO: 1279783 - protein, 25 aa, Mycobacterium
RYPRARGLKGLRIALPLIDAGAASP

SEQ ID NO: 1279784 - protein, 17 aa, Mycobacterium
RYPRSEAYAGFRVPGRA

SEQ ID NO: 1279785 - protein, 35 aa, Mycobacterium
RYQALVNVLVPFPALSVPLGNMLAAVAASQLPMDE

SEQ ID NO: 1279786 - protein, 20 aa, Mycobacterium
RYQDVITMHECRSAKQLASV

SEQ ID NO: 1279787 - protein, 19 aa, Mycobacterium
RYREHPVLAGVAFGDGQRR

SEQ ID NO: 1279788 - protein, 20 aa, Mycobacterium
RYRKLFPHASFHEFTDSPHD

SEQ ID NO: 1279789 - protein, 23 aa, Mycobacterium
RYRLGEVNDGWTVVREPLNAEHG

SEQ ID NO: 1279790 - protein, 24 aa, Mycobacterium
RYRRGAYQKVLRWIESTAKKSHVR

SEQ ID NO: 1279791 - protein, 21 aa, Mycobacterium
RYRTETEMMRYLRALADKDIA

SEQ ID NO: 1279792 - protein, 19 aa, Mycobacterium
RYRTVRIGDHTARVLLAKN

SEQ ID NO: 1279793 - protein, 21 aa, Mycobacterium
RYSAASAEHRWAGSVKAESVD

SEQ ID NO: 1279794 - protein, 17 aa, Mycobacterium
RYSPPVLPLDGRPDEAE

SEQ ID NO: 1279795 - protein, 18 aa, Mycobacterium
RYTAGLAGEIERAWQQRW

SEQ ID NO: 1279796 - protein, 24 aa, Mycobacterium
RYTDRPVWVRGVGLGMDRVMHQHK

SEQ ID NO: 1279797 - protein, 18 aa, Mycobacterium
RYTHTCFLATPYEPYIEV

SEQ ID NO: 1279798 - protein, 19 aa, Mycobacterium
RYTLAAAPAIEAWAKPVLL

SEQ ID NO: 1279799 - protein, 29 aa, Mycobacterium
RYTSGYLCVPLAGDICDRLGLLPMYAVNQ

SEQ ID NO: 1279800 - protein, 19 aa, Mycobacterium
RYTVVDAFYHQLCPDCAAL

SEQ ID NO: 1279801 - protein, 26 aa, Mycobacterium
RYVDLVCSWGPMILGHAHPAVVEAVQ

SEQ ID NO: 1279802 - protein, 20 aa, Mycobacterium
RYVGISASKARRVIDLVRGK

SEQ ID NO: 1279803 - protein, 28 aa, Mycobacterium
RYVGVPVKWVLCRYRLQNAALEIETDPA

SEQ ID NO: 1279804 - protein, 21 aa, Mycobacterium
RYVLAEARLGAYARELGEEPT

SEQ ID NO: 1279805 - protein, 26 aa, Mycobacterium
RYVLWLRLRLAIICAHAGDDLTGAAH

SEQ ID NO: 1279806 - protein, 26 aa, Mycobacterium
RYVLWSRLRIAITLVQGGDDLTGAAH

SEQ ID NO: 1279807 - protein, 26 aa, Mycobacterium
RYVSLRAGSDIAFLGGVINYILSNEL

SEQ ID NO: 1279808 - protein, 25 aa, Mycobacterium
RYYPSRDDLLLGLVLRRVDRACTRW

SEQ ID NO: 1279809 - protein, 17 aa, Mycobacterium
SAAALVWNTPMSGLVAR

SEQ ID NO: 1279810 - protein, 17 aa, Mycobacterium
SAACVAGVFSLTDGARL

SEQ ID NO: 1279811 - protein, 19 aa, Mycobacterium
SAADFNLDGGQVYIGDAST

SEQ ID NO: 1279812 - protein, 27 aa, Mycobacterium
SAADRLGAEFPRVDWLFATASRQTVPF

SEQ ID NO: 1279813 - protein, 25 aa, Mycobacterium
SAAGARRRVVRLIDARVVRIGAVVR

SEQ ID NO: 1279814 - protein, 20 aa, Mycobacterium
SAAGCSRATLYRYFENREAL

SEQ ID NO: 1279815 - protein, 20 aa, Mycobacterium
SAAGMVWRAAAAIELGLCDV

SEQ ID NO: 1279816 - protein, 29 aa, Mycobacterium
SAAGRRSAARWLRRHGVAVLESDTVAEVR

SEQ ID NO: 1279817 - protein, 24 aa, Mycobacterium
SAAIARAAASFGISHTGGAAVALQ

SEQ ID NO: 1279818 - protein, 21 aa, Mycobacterium
SAAIGLRREAANFVTRDEINA

SEQ ID NO: 1279819 - protein, 25 aa, Mycobacterium
SAAIQCARTLLDAHLVDGRLRRSSL

SEQ ID NO: 1279820 - protein, 24 aa, Mycobacterium
SAALASSVGITWTSELLTVTSVDP

SEQ ID NO: 1279821 - protein, 25 aa, Mycobacterium
SAALQWAGGEALLFREPVTLIYAVA

SEQ ID NO: 1279822 - protein, 24 aa, Mycobacterium
SAAQLPAGVTVRWTDLTDAEQTSA

SEQ ID NO: 1279823 - protein, 21 aa, Mycobacterium
SAARHAINWDDLNFEKSYAVG

SEQ ID NO: 1279824 - protein, 22 aa, Mycobacterium
SAARRAGDRAGRRARLGGETEL

SEQ ID NO: 1279825 - protein, 24 aa, Mycobacterium
SAARRCPDATFLPSDPEAYDAASE

SEQ ID NO: 1279826 - protein, 26 aa, Mycobacterium
SAARRRGWTAGRFSFNVADGRCPTCQ

SEQ ID NO: 1279827 - protein, 18 aa, Mycobacterium
SAASFVVDPDGALRDAGL

SEQ ID NO: 1279828 - protein, 17 aa, Mycobacterium
SAASGYAPRAIVAPIVG

SEQ ID NO: 1279829 - protein, 28 aa, Mycobacterium
SAASRRWSAARAHAWYQQQGWLVGANFI

SEQ ID NO: 1279830 - protein, 20 aa, Mycobacterium
SAATTCFWNDNQINIIDTPG

SEQ ID NO: 1279831 - protein, 28 aa, Mycobacterium
SAATVRRFNEAFGPFGFQPQAIKPSYGL

SEQ ID NO: 1279832 - protein, 18 aa, Mycobacterium
SAAWDYAPTFVEAGLDVD

SEQ ID NO: 1279833 - protein, 19 aa, Mycobacterium
SADDIAYGFALFASAGVLL

SEQ ID NO: 1279834 - protein, 20 aa, Mycobacterium
SADGAMTFGAVAGAPALVFV

SEQ ID NO: 1279835 - protein, 17 aa, Mycobacterium
SADLPAELDRTVVVSGL

SEQ ID NO: 1279836 - protein, 23 aa, Mycobacterium
SADLWRRYVAILLQGMRSQQGLE

SEQ ID NO: 1279837 - protein, 26 aa, Mycobacterium
SADPERAAGIAARMRVGTVNVNGGVW

SEQ ID NO: 1279838 - protein, 29 aa, Mycobacterium
SADPRGRARFLAMAGGGGFLLYLQMHDNP

SEQ ID NO: 1279839 - protein, 22 aa, Mycobacterium
SADPRVAAVLSHPLTPVQHEVS

SEQ ID NO: 1279840 - protein, 22 aa, Mycobacterium
SADQPLGVGMLFYEDGNWNITT

SEQ ID NO: 1279841 - protein, 24 aa, Mycobacterium
SADRYRSIDGLAWAPADATAPLDY

SEQ ID NO: 1279842 - protein, 25 aa, Mycobacterium
SADVDRAFAVACRMRTGNVTINGKS

SEQ ID NO: 1279843 - protein, 17 aa, Mycobacterium
SADVILIYLIQNMPNLT

SEQ ID NO: 1279844 - protein, 18 aa, Mycobacterium
SADWEQIAALKAHVTNIP

SEQ ID NO: 1279845 - protein, 18 aa, Mycobacterium
SADWVRAWNEHDVDAVLE

SEQ ID NO: 1279846 - protein, 17 aa, Mycobacterium
SAEFGRAAAEVFAAQGF

SEQ ID NO: 1279847 - protein, 19 aa, Mycobacterium
SAELCFIAVRPRRWLSTYG

SEQ ID NO: 1279848 - protein, 23 aa, Mycobacterium
SAELPLFRYVGGPNAHILPVPMM

SEQ ID NO: 1279849 - protein, 22 aa, Mycobacterium
SAFGLAAADGVMTWLEEQNRGV

SEQ ID NO: 1279850 - protein, 25 aa, Mycobacterium
SAFGPTGPWAKRLGYGPLVRAAVGF

SEQ ID NO: 1279851 - protein, 21 aa, Mycobacterium
SAFGPTGPWAQRLGYGPLVRA

SEQ ID NO: 1279852 - protein, 27 aa, Mycobacterium
SAFLVNEWRKGALFGQTPDEAFFVKCD

SEQ ID NO: 1279853 - protein, 26 aa, Mycobacterium
SAFRNCIFRRTSLWHSTFRHCSFLGS

SEQ ID NO: 1279854 - protein, 19 aa, Mycobacterium
SAFRPDLDRPPTREEFAAA

SEQ ID NO: 1279855 - protein, 18 aa, Mycobacterium
SAFTLMGGFAERVAALPD

SEQ ID NO: 1279856 - protein, 27 aa, Mycobacterium
SAGAPLVRIRGFALWGSVGVKRKRRKA

SEQ ID NO: 1279857 - protein, 19 aa, Mycobacterium
SAGAYEFDLFYLTSQPPSM

SEQ ID NO: 1279858 - protein, 25 aa, Mycobacterium
SAGCGQWPGSVIRLDAPVIPHMGWN

SEQ ID NO: 1279859 - protein, 23 aa, Mycobacterium
SAGDRPTIREAIHYLCDKVAAKH

SEQ ID NO: 1279860 - protein, 24 aa, Mycobacterium
SAGEPLPVMFFIHGGGYILGSSAT

SEQ ID NO: 1279861 - protein, 20 aa, Mycobacterium
SAGGPVLWPDLEAIIVVPNN

SEQ ID NO: 1279862 - protein, 18 aa, Mycobacterium
SAGPPCFLDPELRGLNDD

SEQ ID NO: 1279863 - protein, 22 aa, Mycobacterium
SAGPPCFLDPELRHLNDDHGDP

SEQ ID NO: 1279864 - protein, 35 aa, Mycobacterium
SAGPYRFVYRKRFHKRPETELTVLTPRREQLTGDE

SEQ ID NO: 1279865 - protein, 21 aa, Mycobacterium
SAGRARLGLGPSGPQVVEGFH

SEQ ID NO: 1279866 - protein, 17 aa, Mycobacterium
SAGSILRNLDPQRFEVV

SEQ ID NO: 1279867 - protein, 17 aa, Mycobacterium
SAGSVRLLGHRPVSPEA

SEQ ID NO: 1279868 - protein, 21 aa, Mycobacterium
SAGTSRWLVAVRMVSEGVDVP

SEQ ID NO: 1279869 - protein, 24 aa, Mycobacterium
SAGYPVLCGSAFKNKGVQPMLDAV

SEQ ID NO: 1279870 - protein, 22 aa, Mycobacterium
SAHALLRTLVCQGWVRSDPTGT

SEQ ID NO: 1279871 - protein, 22 aa, Mycobacterium
SAHCPKGIPAVGCHSSVTECPV

SEQ ID NO: 1279872 - protein, 22 aa, Mycobacterium
SAHETLRMFADLGVLDEELAGE

SEQ ID NO: 1279873 - protein, 21 aa, Mycobacterium
SAHGYPNLFFMTGPNSGPGHN

SEQ ID NO: 1279874 - protein, 25 aa, Mycobacterium
SAHKWYRRRTEMAGFDEEVYYALVR

SEQ ID NO: 1279875 - protein, 17 aa, Mycobacterium
SAIAAAIEYTQSRKAFG

SEQ ID NO: 1279876 - protein, 22 aa, Mycobacterium
SAIGEPVAWLIQRLQERHVLNN

SEQ ID NO: 1279877 - protein, 17 aa, Mycobacterium
SAINTWSGPEVQTMMHT

SEQ ID NO: 1279878 - protein, 28 aa, Mycobacterium
SAKGTFRLAFGIGDFRRDTGFGDNPMTL

SEQ ID NO: 1279879 - protein, 18 aa, Mycobacterium
SAKRFIALANRWPAELSL

SEQ ID NO: 1279880 - protein, 25 aa, Mycobacterium
SAKSRRVVPIDGWLADDLRAYLADD

SEQ ID NO: 1279881 - protein, 19 aa, Mycobacterium
SALAEAWRVLRPGGRLHIV

SEQ ID NO: 1279882 - protein, 19 aa, Mycobacterium
SALARRLYQTAGMGPDDID

SEQ ID NO: 1279883 - protein, 25 aa, Mycobacterium
SALDGLGYRGFWMGYFAARSAPLGR

SEQ ID NO: 1279884 - protein, 34 aa, Mycobacterium
SALDWYVAMACFKLAIVIEGTWSRYLAGQASAEA

SEQ ID NO: 1279885 - protein, 27 aa, Mycobacterium
SALGEFTGIQSFSRWAAEISGNDEPTI

SEQ ID NO: 1279886 - protein, 20 aa, Mycobacterium
SALGRLPVRGSVPDGGGTLM

SEQ ID NO: 1279887 - protein, 19 aa, Mycobacterium
SALGVFKRSDLIGQTVSIA

SEQ ID NO: 1279888 - protein, 20 aa, Mycobacterium
SALHLRPGGRLGLVLPAELL

SEQ ID NO: 1279889 - protein, 21 aa, Mycobacterium
SALKKLRWDDGDLLVVGSSRF

SEQ ID NO: 1279890 - protein, 19 aa, Mycobacterium
SALLKFVTVHLVEGGEITL

SEQ ID NO: 1279891 - protein, 21 aa, Mycobacterium
SALLRLERRLVLRSEDRAARR

SEQ ID NO: 1279892 - protein, 18 aa, Mycobacterium
SALPELRAKLADSQLNLD

SEQ ID NO: 1279893 - protein, 21 aa, Mycobacterium
SALPKRRVDSSVLIVPVVSGG

SEQ ID NO: 1279894 - protein, 22 aa, Mycobacterium
SALRHLPVYEVLTNVTDQPVTW

SEQ ID NO: 1279895 - protein, 21 aa, Mycobacterium
SALRHWAHAAVADLISHTDEI

SEQ ID NO: 1279896 - protein, 23 aa, Mycobacterium
SALRTELRLAAAHLGEPPDVQTV

SEQ ID NO: 1279897 - protein, 17 aa, Mycobacterium
SALSGGQQDTWERRWPE

SEQ ID NO: 1279898 - protein, 24 aa, Mycobacterium
SALSPDCCAVVAYGALLGDALLAV

SEQ ID NO: 1279899 - protein, 20 aa, Mycobacterium
SALSPRMLGIAAEFADGVVL

SEQ ID NO: 1279900 - protein, 23 aa, Mycobacterium
SAMAELDAAFPPAEHTGPPGGRY

SEQ ID NO: 1279901 - protein, 17 aa, Mycobacterium
SAMAGYLPDHWTADAFC

SEQ ID NO: 1279902 - protein, 21 aa, Mycobacterium
SAMAKARFVRISATKARRVID

SEQ ID NO: 1279903 - protein, 33 aa, Mycobacterium
SAMVDHCLGVVFYPVIPAGSWVATTEFKLNLLR

SEQ ID NO: 1279904 - protein, 22 aa, Mycobacterium
SANAYLGGWGIAAALRGGADVV

SEQ ID NO: 1279905 - protein, 17 aa, Mycobacterium
SANRPTPELGITMEVFL

SEQ ID NO: 1279906 - protein, 24 aa, Mycobacterium
SAPATVDCEAWGPGAAEFTDTLPG

SEQ ID NO: 1279907 - protein, 25 aa, Mycobacterium
SAPAVKLLIRKAGARSADMAAVLAR

SEQ ID NO: 1279908 - protein, 19 aa, Mycobacterium
SAPDWDRWLDPDAPVDEGL

SEQ ID NO: 1279909 - protein, 25 aa, Mycobacterium
SAPGFSDESVRVFLATDISEIDRPD

SEQ ID NO: 1279910 - protein, 17 aa, Mycobacterium
SAPGTVCTPRFCSARRG

SEQ ID NO: 1279911 - protein, 25 aa, Mycobacterium
SAPGTWGGLIAPGFRERFGRAYDTE

SEQ ID NO: 1279912 - protein, 23 aa, Mycobacterium
SAPHIAMTVSMLRDAGVEVDDSA

SEQ ID NO: 1279913 - protein, 25 aa, Mycobacterium
SAPHRGHVALGHFYDTFIGPRVITY

SEQ ID NO: 1279914 - protein, 19 aa, Mycobacterium
SAPKHAGITYFLLDMKSAG

SEQ ID NO: 1279915 - protein, 19 aa, Mycobacterium
SAPLKQIAFNGGLEPGVVA

SEQ ID NO: 1279916 - protein, 19 aa, Mycobacterium
SAPRANLLLADDVGLGKTI

SEQ ID NO: 1279917 - protein, 23 aa, Mycobacterium
SAPRSYPLLGYAHRLEQIGATLK

SEQ ID NO: 1279918 - protein, 23 aa, Mycobacterium
SAPTDLRRGVAIVNSPLVHVGGV

SEQ ID NO: 1279919 - protein, 20 aa, Mycobacterium
SAQIFPRPIGLMLGLELSGN

SEQ ID NO: 1279920 - protein, 28 aa, Mycobacterium
SAQLDWPLAESLRYPAGLIDTFEWERVL

SEQ ID NO: 1279921 - protein, 17 aa, Mycobacterium
SAQRGSPGMAHYAASKG

SEQ ID NO: 1279922 - protein, 17 aa, Mycobacterium
SAQWLRHLYEKWSATLD

SEQ ID NO: 1279923 - protein, 17 aa, Mycobacterium
SAQYTFMLEGMREHGHD

SEQ ID NO: 1279924 - protein, 20 aa, Mycobacterium
SARADCHWIKSAPSPTGSHG

SEQ ID NO: 1279925 - protein, 17 aa, Mycobacterium
SARAIENLCYIGLTNNL

SEQ ID NO: 1279926 - protein, 24 aa, Mycobacterium
SARECKLAETFLRHPGQVLSREQL

SEQ ID NO: 1279927 - protein, 21 aa, Mycobacterium
SAREGFEIRGIKKFVSLSPIA

SEQ ID NO: 1279928 - protein, 25 aa, Mycobacterium
SARGRLGLLELRGFEMPPHHQMAMV

SEQ ID NO: 1279929 - protein, 19 aa, Mycobacterium
SARLRLAMKQQNIPLWLNA

SEQ ID NO: 1279930 - protein, 19 aa, Mycobacterium
SARNYPHLVAAALGLDLVD

SEQ ID NO: 1279931 - protein, 19 aa, Mycobacterium
SARPHRRAVLLERLHDRDL

SEQ ID NO: 1279932 - protein, 21 aa, Mycobacterium
SARRSALGVLERVGLDPKLAD

SEQ ID NO: 1279933 - protein, 18 aa, Mycobacterium
SARSRFHAVSYGMTSSTR

SEQ ID NO: 1279934 - protein, 27 aa, Mycobacterium
SARYDWPVRTGIIIGRLDADGSRFLAI

SEQ ID NO: 1279935 - protein, 18 aa, Mycobacterium
SARYEFDIDWNLTGTPEA

SEQ ID NO: 1279936 - protein, 21 aa, Mycobacterium
SASEFGVYWPTLVPATTVEHT

SEQ ID NO: 1279937 - protein, 22 aa, Mycobacterium
SASGATEFVDWSTMTRQQTVAE

SEQ ID NO: 1279938 - protein, 26 aa, Mycobacterium
SASHTTRCFVTFLMLAGHLRPGYDYL

SEQ ID NO: 1279939 - protein, 24 aa, Mycobacterium
SASQAIRVAREFARNAEESGGRSM

SEQ ID NO: 1279940 - protein, 17 aa, Mycobacterium
SASQVWCCSDADACHSR

SEQ ID NO: 1279941 - protein, 24 aa, Mycobacterium
SATARRLLVDPAEIGPIRLVGVGF

SEQ ID NO: 1279942 - protein, 24 aa, Mycobacterium
SATDPGTRCWELGSDGHWTASPQE

SEQ ID NO: 1279943 - protein, 22 aa, Mycobacterium
SATFRYPGPLAISVAQVDEMSG

SEQ ID NO: 1279944 - protein, 23 aa, Mycobacterium
SATGLYHALLWQFMQNDCGELKN

SEQ ID NO: 1279945 - protein, 24 aa, Mycobacterium
SATPDEFRGQIDITKEVLGALGIT

SEQ ID NO: 1279946 - protein, 17 aa, Mycobacterium
SATRKVCEGLAEHLPGG

SEQ ID NO: 1279947 - protein, 28 aa, Mycobacterium
SAVATAVWNAVCWAIIIPAGRLRTGDAS

SEQ ID NO: 1279948 - protein, 25 aa, Mycobacterium
SAVERRIRALIAHRRRYDPAPDDPF

SEQ ID NO: 1279949 - protein, 26 aa, Mycobacterium
SAVGMGRFAIGRAVEYVKTRQVWKTP

SEQ ID NO: 1279950 - protein, 28 aa, Mycobacterium
SAVIGHDRLRLALVLCAVRPDIGGVLIR

SEQ ID NO: 1279951 - protein, 17 aa, Mycobacterium
SAVMMNNYGTPPLALAG

SEQ ID NO: 1279952 - protein, 20 aa, Mycobacterium
SAVPLEWRTLLHGWPGVRAR

SEQ ID NO: 1279953 - protein, 27 aa, Mycobacterium
SAVPPEWFCGLTWPAKPLVAQDGPVDP

SEQ ID NO: 1279954 - protein, 22 aa, Mycobacterium
SAVPWHWRLTLKGWPGLNTRGL

SEQ ID NO: 1279955 - protein, 18 aa, Mycobacterium
SAVSDLMVNRDAALLHHE

SEQ ID NO: 1279956 - protein, 18 aa, Mycobacterium
SAVTGARVDLAFAATGRP

SEQ ID NO: 1279957 - protein, 18 aa, Mycobacterium
SAVVRRAAMLGGDLPAVA

SEQ ID NO: 1279958 - protein, 19 aa, Mycobacterium
SAWRAERRGGIAAAATFLE

SEQ ID NO: 1279959 - protein, 26 aa, Mycobacterium
SAWTKKETPSLCDWMIFGKEHCIVID

SEQ ID NO: 1279960 - protein, 19 aa, Mycobacterium
SAYDGALDVDVIFSPFFNA

SEQ ID NO: 1279961 - protein, 17 aa, Mycobacterium
SAYGALLGRAGNRGPTA

SEQ ID NO: 1279962 - protein, 19 aa, Mycobacterium
SAYGESKLANLLFVHELVA

SEQ ID NO: 1279963 - protein, 18 aa, Mycobacterium
SAYQLGVLERALELTASY

SEQ ID NO: 1279964 - protein, 21 aa, Mycobacterium
SCADPLAAIQSRLPAYSPGDT

SEQ ID NO: 1279965 - protein, 19 aa, Mycobacterium
SCAELVPAIVAEAVEHLQK

SEQ ID NO: 1279966 - protein, 23 aa, Mycobacterium
SCAGHPPPILIGADRSTRLLEEA

SEQ ID NO: 1279967 - protein, 19 aa, Mycobacterium
SCAVPGVWPPVTIGGRRFM

SEQ ID NO: 1279968 - protein, 21 aa, Mycobacterium
SCAVPGVWPPVTIGPRRFMDG

SEQ ID NO: 1279969 - protein, 18 aa, Mycobacterium
SCFSGRALIQLVKEIVEH

SEQ ID NO: 1279970 - protein, 25 aa, Mycobacterium
SCGKCTPCREGTYWLAQIYERLETG

SEQ ID NO: 1279971 - protein, 19 aa, Mycobacterium
SCGKTTWDGCGQHVDDVMR

SEQ ID NO: 1279972 - protein, 25 aa, Mycobacterium
SCLADGWLWHDRAILVPCDDSVVRA

SEQ ID NO: 1279973 - protein, 19 aa, Mycobacterium
SCLEEFDEYLALERGRSEH

SEQ ID NO: 1279974 - protein, 18 aa, Mycobacterium
SCLENVLIGGLGALRLPR

SEQ ID NO: 1279975 - protein, 24 aa, Mycobacterium
SCLPKDVRALQHIARVSGSSTHLI

SEQ ID NO: 1279976 - protein, 20 aa, Mycobacterium
SCLRGVNTLTGFALAVEIGD

SEQ ID NO: 1279977 - protein, 20 aa, Mycobacterium
SCNAPSRMLVPNSRMDEAIA

SEQ ID NO: 1279978 - protein, 20 aa, Mycobacterium
SCNAPSRMLVPNSRMDEAIE

SEQ ID NO: 1279979 - protein, 20 aa, Mycobacterium
SCPFVPGRIPDAAMAMVVAV

SEQ ID NO: 1279980 - protein, 21 aa, Mycobacterium
SCPFVPGRIPDAAMAMVVAVE

SEQ ID NO: 1279981 - protein, 25 aa, Mycobacterium
SCRAEGRSALIGYLPTGFPDVETSI

SEQ ID NO: 1279982 - protein, 17 aa, Mycobacterium
SCRSDPFAIDFEVLSAP

SEQ ID NO: 1279983 - protein, 19 aa, Mycobacterium
SCRSDPFAIDFEVLSAPEL

SEQ ID NO: 1279984 - protein, 25 aa, Mycobacterium
SCTALCPGPVPTEWWEIAGEKPPGG

SEQ ID NO: 1279985 - protein, 22 aa, Mycobacterium
SCVLRLDGYRPIELHAGDFMLL

SEQ ID NO: 1279986 - protein, 19 aa, Mycobacterium
SCVVFCLEDAPAPAAAPAP

SEQ ID NO: 1279987 - protein, 24 aa, Mycobacterium
SCVVREIAEEIGLTVTDVEYLGSQ

SEQ ID NO: 1279988 - protein, 24 aa, Mycobacterium
SDAAGEWTIRFFMPSKWTMDTLPT

SEQ ID NO: 1279989 - protein, 38 aa, Mycobacterium
SDADLIAAGAYLWLRAWPAPGGDLWAVPTGWRVGDHAP

SEQ ID NO: 1279990 - protein, 27 aa, Mycobacterium
SDAEQIAGLLYRYARAVDTKDWELYRS

SEQ ID NO: 1279991 - protein, 23 aa, Mycobacterium
SDAGEVYKRFGGRIDTSVLVTLP

SEQ ID NO: 1279992 - protein, 24 aa, Mycobacterium
SDAKESRGVIALRARGAEIRIGHD

SEQ ID NO: 1279993 - protein, 19 aa, Mycobacterium
SDALAAAWRADRIGITATS

SEQ ID NO: 1279994 - protein, 17 aa, Mycobacterium
SDALKYAAAQARQTANW

SEQ ID NO: 1279995 - protein, 22 aa, Mycobacterium
SDAPALRWGAPTAAERGPLVGT

SEQ ID NO: 1279996 - protein, 19 aa, Mycobacterium
SDAPIAFGDDLRRVLLGLR

SEQ ID NO: 1279997 - protein, 18 aa, Mycobacterium
SDARQLGPRYTLTGERVQ

SEQ ID NO: 1279998 - protein, 22 aa, Mycobacterium
SDCEVRRAAAYAVDEARALALW

SEQ ID NO: 1279999 - protein, 23 aa, Mycobacterium
SDCFDIAVNAARIALTYRTPVII

SEQ ID NO: 1280000 - protein, 20 aa, Mycobacterium
SDCRSGEVLQGLLKPNECPA

SEQ ID NO: 1280001 - protein, 23 aa, Mycobacterium
SDDAGRPGVAVWMLTSGTTGPPK

SEQ ID NO: 1280002 - protein, 27 aa, Mycobacterium
SDDAGRSWESLSLKGSADFHALEYRHN

SEQ ID NO: 1280003 - protein, 19 aa, Mycobacterium
SDDDCWMAVAPLFHTAGVS

SEQ ID NO: 1280004 - protein, 19 aa, Mycobacterium
SDDELPMLAEIVAGSAIFR

SEQ ID NO: 1280005 - protein, 26 aa, Mycobacterium
SDDGWRLRTRAMTFIRRSGEHDSGRP

SEQ ID NO: 1280006 - protein, 23 aa, Mycobacterium
SDDVLPFITLRQWQPISEDETEV

SEQ ID NO: 1280007 - protein, 18 aa, Mycobacterium
SDEDLRWLDPNRTPKQIA

SEQ ID NO: 1280008 - protein, 18 aa, Mycobacterium
SDEEGVVFNAEISAAIQE

SEQ ID NO: 1280009 - protein, 17 aa, Mycobacterium
SDEGPVFITFDVSPSDE

SEQ ID NO: 1280010 - protein, 29 aa, Mycobacterium
SDEQWRRTFAVNIDSFFHVTKAALQHLPD

SEQ ID NO: 1280011 - protein, 24 aa, Mycobacterium
SDERYWSARLGQFAGGTAAVESLR

SEQ ID NO: 1280012 - protein, 18 aa, Mycobacterium
SDESRYVTGLQFKVDAGA

SEQ ID NO: 1280013 - protein, 28 aa, Mycobacterium
SDEVICAYGRIGSMFACDDFGYVPDIIT

SEQ ID NO: 1280014 - protein, 17 aa, Mycobacterium
SDFARHAAIALALAAGR

SEQ ID NO: 1280015 - protein, 17 aa, Mycobacterium
SDFEAFGAIARTFSTLA

SEQ ID NO: 1280016 - protein, 20 aa, Mycobacterium
SDFIRVPLKLAKSLFDAFNP

SEQ ID NO: 1280017 - protein, 18 aa, Mycobacterium
SDFLTAPGLQMLVPCQQF

SEQ ID NO: 1280018 - protein, 20 aa, Mycobacterium
SDFRVRAHRGVVLGTGGFEW

SEQ ID NO: 1280019 - protein, 21 aa, Mycobacterium
SDFTLWEWIHTLIRPVDPHLD

SEQ ID NO: 1280020 - protein, 18 aa, Mycobacterium
SDGGLFLDRDRAVIHGVE

SEQ ID NO: 1280021 - protein, 27 aa, Mycobacterium
SDGGRAAIVLGDWPARTPATGQLPAGA

SEQ ID NO: 1280022 - protein, 24 aa, Mycobacterium
SDGGRAALVLGDWPETPVDDPPAL

SEQ ID NO: 1280023 - protein, 24 aa, Mycobacterium
SDGHRALVAAGCCHFLGPSIVTVD

SEQ ID NO: 1280024 - protein, 25 aa, Mycobacterium
SDGKAYRGAQILQHAPLYPAIGNHE

SEQ ID NO: 1280025 - protein, 18 aa, Mycobacterium
SDGKILAADIDFVQDVGS

SEQ ID NO: 1280026 - protein, 22 aa, Mycobacterium
SDGRIHGVHVWIGPPNLEPPER

SEQ ID NO: 1280027 - protein, 17 aa, Mycobacterium
SDGRIHGVQVWVGAPDE

SEQ ID NO: 1280028 - protein, 17 aa, Mycobacterium
SDGRLDLDLAIPKEMGG

SEQ ID NO: 1280029 - protein, 25 aa, Mycobacterium
SDGRVLRAGYLVGCDGGRSLIRKSA

SEQ ID NO: 1280030 - protein, 23 aa, Mycobacterium
SDGTLRFLLWAAALLSPQPPSLM

SEQ ID NO: 1280031 - protein, 20 aa, Mycobacterium
SDGTRRLFLCGSEEFSDAQT

SEQ ID NO: 1280032 - protein, 19 aa, Mycobacterium
SDGVIIPTECEFFSLRGLA

SEQ ID NO: 1280033 - protein, 22 aa, Mycobacterium
SDGVLCVPALAGLAAPWWDSGA

SEQ ID NO: 1280034 - protein, 20 aa, Mycobacterium
SDGWPLYATVMGDGPALIML

SEQ ID NO: 1280035 - protein, 18 aa, Mycobacterium
SDHPRVAGDVGMAGVAID

SEQ ID NO: 1280036 - protein, 31 aa, Mycobacterium
SDHYFPWLASQGHAPYAWSVLGAVAHATDRV

SEQ ID NO: 1280037 - protein, 20 aa, Mycobacterium
SDHYSPWLAAQGHAPNAWTT

SEQ ID NO: 1280038 - protein, 23 aa, Mycobacterium
SDIFYPRVFLRRGAPSPAGTISL

SEQ ID NO: 1280039 - protein, 26 aa, Mycobacterium
SDKVARFLLGLARRYGEQRFFGSGVL

SEQ ID NO: 1280040 - protein, 17 aa, Mycobacterium
SDLAIVVNDGVARDRIT

SEQ ID NO: 1280041 - protein, 18 aa, Mycobacterium
SDLHLYEVLGAFMNEGDI

SEQ ID NO: 1280042 - protein, 27 aa, Mycobacterium
SDLINRLLPILAPIVLAYIGRKLSGGQ

SEQ ID NO: 1280043 - protein, 24 aa, Mycobacterium
SDLKRFDEWLTIFGGWKSAVPSEI

SEQ ID NO: 1280044 - protein, 19 aa, Mycobacterium
SDLLEVAAMVGIDPDSDGL

SEQ ID NO: 1280045 - protein, 26 aa, Mycobacterium
SDLLQAIECCAFLGAERKHLAEQSAR

SEQ ID NO: 1280046 - protein, 17 aa, Mycobacterium
SDLPGYCQTASRHALTP

SEQ ID NO: 1280047 - protein, 33 aa, Mycobacterium
SDLPTRHPYGLALWQKHIERILAEWVDELAVPV

SEQ ID NO: 1280048 - protein, 17 aa, Mycobacterium
SDLREWYAQTAIEQGWS

SEQ ID NO: 1280049 - protein, 22 aa, Mycobacterium
SDLRVGGGLAPAAGARVDCGLA

SEQ ID NO: 1280050 - protein, 21 aa, Mycobacterium
SDLRVGGGLGPAAGARVDCGL

SEQ ID NO: 1280051 - protein, 19 aa, Mycobacterium
SDLTFEIELGPFVDGDMVA

SEQ ID NO: 1280052 - protein, 17 aa, Mycobacterium
SDLVCASSACPDDIDAA

SEQ ID NO: 1280053 - protein, 17 aa, Mycobacterium
SDMKAGDAVFLHLAATV

SEQ ID NO: 1280054 - protein, 24 aa, Mycobacterium
SDMSEALPLLARRMLDPHELPGAT

SEQ ID NO: 1280055 - protein, 24 aa, Mycobacterium
SDNLKRLGLDPILMEAGLLGESME

SEQ ID NO: 1280056 - protein, 21 aa, Mycobacterium
SDPAAALAFLRRLHDETRRID

SEQ ID NO: 1280057 - protein, 17 aa, Mycobacterium
SDPAGYLAWLRKLTGPQ

SEQ ID NO: 1280058 - protein, 19 aa, Mycobacterium
SDPCFDIAVAASFSPTGPR

SEQ ID NO: 1280059 - protein, 24 aa, Mycobacterium
SDPDECVRLAAAVVEQTGGLDVLV

SEQ ID NO: 1280060 - protein, 21 aa, Mycobacterium
SDPDRWAWHAANAVAGTDDAV

SEQ ID NO: 1280061 - protein, 21 aa, Mycobacterium
SDPGVHGRQTLALTTLTTLTS

SEQ ID NO: 1280062 - protein, 20 aa, Mycobacterium
SDPHFPMIVPFTTVAAEPIR

SEQ ID NO: 1280063 - protein, 18 aa, Mycobacterium
SDPPRPSGTSGPRGPSDP

SEQ ID NO: 1280064 - protein, 25 aa, Mycobacterium
SDPRYTRSRLRTEVLPLLEDVLAGG

SEQ ID NO: 1280065 - protein, 17 aa, Mycobacterium
SDPSFTNTIVWNTLPLP

SEQ ID NO: 1280066 - protein, 22 aa, Mycobacterium
SDPTAALAFLRRLHEQTRRIDG

SEQ ID NO: 1280067 - protein, 21 aa, Mycobacterium
SDPYLPLITPFLEDLRAEQDE

SEQ ID NO: 1280068 - protein, 25 aa, Mycobacterium
SDQAIGEGFRSRWIGNLDPAATLIA

SEQ ID NO: 1280069 - protein, 20 aa, Mycobacterium
SDQFLLYAFDGPVADLDRAL

SEQ ID NO: 1280070 - protein, 17 aa, Mycobacterium
SDQRWPHFGGRVARMGV

SEQ ID NO: 1280071 - protein, 19 aa, Mycobacterium
SDQVASWLRGLGVGKGDRV

SEQ ID NO: 1280072 - protein, 21 aa, Mycobacterium
SDRAWECPLHGSRFAPDGALL

SEQ ID NO: 1280073 - protein, 19 aa, Mycobacterium
SDRLRVIALDVTRPDSIAA

SEQ ID NO: 1280074 - protein, 25 aa, Mycobacterium
SDRLTLRSLGPWGRRHGVSTVMISH

SEQ ID NO: 1280075 - protein, 32 aa, Mycobacterium
SDRPDWPAAPLFGQCCAALLASFKILGSATVG

SEQ ID NO: 1280076 - protein, 19 aa, Mycobacterium
SDRPIVVHCAGGWRSSVAA

SEQ ID NO: 1280077 - protein, 20 aa, Mycobacterium
SDRRSHVVLMGRPWGHVSSS

SEQ ID NO: 1280078 - protein, 19 aa, Mycobacterium
SDRRYVMAISSLDPDDDAS

SEQ ID NO: 1280079 - protein, 26 aa, Mycobacterium
SDRYWRRYFDNFAEVMASASRVGAHE

SEQ ID NO: 1280080 - protein, 18 aa, Mycobacterium
SDSARAAARNTWYTDTDR

SEQ ID NO: 1280081 - protein, 19 aa, Mycobacterium
SDSARYVLVYGHRRRAAAL

SEQ ID NO: 1280082 - protein, 26 aa, Mycobacterium
SDSVSCPRSGEIIVRDGAHWYSTGCD

SEQ ID NO: 1280083 - protein, 24 aa, Mycobacterium
SDTHRCVVPTWPFGAQRKPVAEPV

SEQ ID NO: 1280084 - protein, 22 aa, Mycobacterium
SDTLLAPLTFISVFGYQAQYAM

SEQ ID NO: 1280085 - protein, 26 aa, Mycobacterium
SDTQVRWRPIDFWPANTTVNIDASGT

SEQ ID NO: 1280086 - protein, 17 aa, Mycobacterium
SDTWQFRDVVIPNVALN

SEQ ID NO: 1280087 - protein, 24 aa, Mycobacterium
SDTWTDWHWYTTVVDINCREIIDN

SEQ ID NO: 1280088 - protein, 17 aa, Mycobacterium
SDVAYFLGCALPVEQRR

SEQ ID NO: 1280089 - protein, 17 aa, Mycobacterium
SDVELAQGFLLTEGIIS

SEQ ID NO: 1280090 - protein, 19 aa, Mycobacterium
SDVFLTNYLPSAREKLGID

SEQ ID NO: 1280091 - protein, 29 aa, Mycobacterium
SDVLLAPTLREVWAVIAPMLAGCTPVGPG

SEQ ID NO: 1280092 - protein, 24 aa, Mycobacterium
SDVLPEMLTTLFGDQPRLQAPGAI

SEQ ID NO: 1280093 - protein, 17 aa, Mycobacterium
SDVQVVFNASGRTITFP

SEQ ID NO: 1280094 - protein, 21 aa, Mycobacterium
SDWAKVGRRLGISAEQATAWV

SEQ ID NO: 1280095 - protein, 17 aa, Mycobacterium
SDWCRFNSAGSLFIDPG

SEQ ID NO: 1280096 - protein, 20 aa, Mycobacterium
SEAAERVELCLFDADGEQTA

SEQ ID NO: 1280097 - protein, 26 aa, Mycobacterium
SEAALGIRPGQPFLLMADGRPDVEVL

SEQ ID NO: 1280098 - protein, 24 aa, Mycobacterium
SEAELEQLVGFFVNFVVLRNDLRG

SEQ ID NO: 1280099 - protein, 19 aa, Mycobacterium
SEAFYGRKLAAGKASSGRD

SEQ ID NO: 1280100 - protein, 25 aa, Mycobacterium
SEAGRICASLGLPDRVLTQPLRTLS

SEQ ID NO: 1280101 - protein, 25 aa, Mycobacterium
SEAITRNFFKLIAYKDEYEVARMLT

SEQ ID NO: 1280102 - protein, 19 aa, Mycobacterium
SEALSRSGGDMFGADQGVA

SEQ ID NO: 1280103 - protein, 19 aa, Mycobacterium
SEARAAVVAGPHLDADAVA

SEQ ID NO: 1280104 - protein, 26 aa, Mycobacterium
SEAVEPWSYMKFPFLKDLGREEGSVR

SEQ ID NO: 1280105 - protein, 39 aa, Mycobacterium
SEAVMLAGLAMKWRWRDRVGDGWKGRTPNLVMGSNVQVV

SEQ ID NO: 1280106 - protein, 25 aa, Mycobacterium
SEAVPRGVGVLVVCPAAVETPILDK

SEQ ID NO: 1280107 - protein, 19 aa, Mycobacterium
SEAWPEVTETLEFGLVGAM

SEQ ID NO: 1280108 - protein, 21 aa, Mycobacterium
SECHYIVSGAFYYDNYDNGVY

SEQ ID NO: 1280109 - protein, 23 aa, Mycobacterium
SEDAWRRMLRVHLGGLVNVARAT

SEQ ID NO: 1280110 - protein, 23 aa, Mycobacterium
SEDIDWTFPLSVRDVVLTGRYGH

SEQ ID NO: 1280111 - protein, 24 aa, Mycobacterium
SEDIRWALVPSKAVDRLLRICDPD

SEQ ID NO: 1280112 - protein, 17 aa, Mycobacterium
SEDSIRLAFSLLAAEGA

SEQ ID NO: 1280113 - protein, 20 aa, Mycobacterium
SEDVLLCRVRGGMLGGHLPG

SEQ ID NO: 1280114 - protein, 28 aa, Mycobacterium
SEEEKRLFARMAEVFAGFLSYTDAQIGR

SEQ ID NO: 1280115 - protein, 18 aa, Mycobacterium
SEEILRFERTLAKAQNRY

SEQ ID NO: 1280116 - protein, 17 aa, Mycobacterium
SEEMVLPALELYTNGLM

SEQ ID NO: 1280117 - protein, 24 aa, Mycobacterium
SEEVARSALWLGSDESSFVTGHAL

SEQ ID NO: 1280118 - protein, 21 aa, Mycobacterium
SEFHADVGLYAVRVLIERRCG

SEQ ID NO: 1280119 - protein, 21 aa, Mycobacterium
SEFLQGGSIYPAIQNFYLAAR

SEQ ID NO: 1280120 - protein, 25 aa, Mycobacterium
SEFRRHSVGFVFQFFNLLPTMTAWE

SEQ ID NO: 1280121 - protein, 24 aa, Mycobacterium
SEGACPTCNGVGVVFTDLGVMATV

SEQ ID NO: 1280122 - protein, 23 aa, Mycobacterium
SEGAMGPAGFLIADDGEIGMRNQ

SEQ ID NO: 1280123 - protein, 36 aa, Mycobacterium
SEGLDRIFIDAGAEWRQAGCSMCLGMNPDQLSPGQR

SEQ ID NO: 1280124 - protein, 22 aa, Mycobacterium
SEGPRGISAFVVEKDTPGVSFG

SEQ ID NO: 1280125 - protein, 17 aa, Mycobacterium
SEGQPFLYPDNSLTLVE

SEQ ID NO: 1280126 - protein, 20 aa, Mycobacterium
SEGQRAAAMELALEALYLAK

SEQ ID NO: 1280127 - protein, 17 aa, Mycobacterium
SEGRLGITSADPAAALR

SEQ ID NO: 1280128 - protein, 27 aa, Mycobacterium
SEGWCPHCGSAYSFLPQLNVGDIVADQ

SEQ ID NO: 1280129 - protein, 18 aa, Mycobacterium
SEHCSYKSSKVHLRYFGE

SEQ ID NO: 1280130 - protein, 21 aa, Mycobacterium
SEHKKHRYAFAPFGGGAHKCI

SEQ ID NO: 1280131 - protein, 23 aa, Mycobacterium
SEHLLRIIQSFVVDPGRPPRHGE

SEQ ID NO: 1280132 - protein, 25 aa, Mycobacterium
SEICQYLFQHGWLYSPTDKGYDQEL

SEQ ID NO: 1280133 - protein, 22 aa, Mycobacterium
SEIDFTASVRWRDEVRVSAQCA

SEQ ID NO: 1280134 - protein, 24 aa, Mycobacterium
SEIDRRLAADAALRQQQRMLEAVL

SEQ ID NO: 1280135 - protein, 23 aa, Mycobacterium
SEIESYAPLMAYLVRSMQSGSDL

SEQ ID NO: 1280136 - protein, 35 aa, Mycobacterium
SEIMAKLVMRPRIARRYAVVEGHRALFANRDLLPG

SEQ ID NO: 1280137 - protein, 25 aa, Mycobacterium
SEIRCPSHSWCWNLDGSLNEVIDPQ

SEQ ID NO: 1280138 - protein, 21 aa, Mycobacterium
SEIYRQSFATIRAEADLSRFP

SEQ ID NO: 1280139 - protein, 19 aa, Mycobacterium
SEIYWDQTAEFGRKYLSGA

SEQ ID NO: 1280140 - protein, 25 aa, Mycobacterium
SEKLWELRFRCGQVNQRITYTADPD

SEQ ID NO: 1280141 - protein, 19 aa, Mycobacterium
SELAEQFLRAFSVHTVDTL

SEQ ID NO: 1280142 - protein, 31 aa, Mycobacterium
SELCRKIVIELLAWQFASPVRWIETQDLLFI

SEQ ID NO: 1280143 - protein, 20 aa, Mycobacterium
SELFALSARGLLDMAMAVVD

SEQ ID NO: 1280144 - protein, 20 aa, Mycobacterium
SELGLSYLLPRAIGASRAFE

SEQ ID NO: 1280145 - protein, 19 aa, Mycobacterium
SELGMSPMAFVRERRLERV

SEQ ID NO: 1280146 - protein, 17 aa, Mycobacterium
SELLGGALRDYDQRRAV

SEQ ID NO: 1280147 - protein, 20 aa, Mycobacterium
SELLGRGVLIEDVYDEPLTD

SEQ ID NO: 1280148 - protein, 17 aa, Mycobacterium
SELLKGGGSVKCCTLEV

SEQ ID NO: 1280149 - protein, 20 aa, Mycobacterium
SELLSVPGVFVFGSNDYFAP

SEQ ID NO: 1280150 - protein, 21 aa, Mycobacterium
SELLSVPGVFVFGSNDYFAPR

SEQ ID NO: 1280151 - protein, 25 aa, Mycobacterium
SELPEHLVIVGGGFVAAEFAHVFSS

SEQ ID NO: 1280152 - protein, 20 aa, Mycobacterium
SELPNALASYGQLIGITSAR

SEQ ID NO: 1280153 - protein, 25 aa, Mycobacterium
SELRELNLLTAKPFLYVFNADEAVL

SEQ ID NO: 1280154 - protein, 22 aa, Mycobacterium
SELRNVLEALLLVVDTPATVDQ

SEQ ID NO: 1280155 - protein, 20 aa, Mycobacterium
SELRSRVGLSSAALSQRVPD

SEQ ID NO: 1280156 - protein, 21 aa, Mycobacterium
SELSLLFCLYQMAAAGGPSFV

SEQ ID NO: 1280157 - protein, 29 aa, Mycobacterium
SEMDARTGTDFAALGPVRTFFGGTALIPG

SEQ ID NO: 1280158 - protein, 22 aa, Mycobacterium
SEMEMKVLLWAVQRLIGGLSHI

SEQ ID NO: 1280159 - protein, 19 aa, Mycobacterium
SENHRGRRPAVWEPGEYLV

SEQ ID NO: 1280160 - protein, 24 aa, Mycobacterium
SENPSAMGYPSFHDFEHWKPMWDA

SEQ ID NO: 1280161 - protein, 19 aa, Mycobacterium
SEPALRTAYLMVHDEMERG

SEQ ID NO: 1280162 - protein, 22 aa, Mycobacterium
SEPFPHLFARPLGTRHEVLGRH

SEQ ID NO: 1280163 - protein, 23 aa, Mycobacterium
SEPLGYGVTYSWSGSAVGEDGKA

SEQ ID NO: 1280164 - protein, 21 aa, Mycobacterium
SEPPFLPSLDKFVEFLGEGQF

SEQ ID NO: 1280165 - protein, 17 aa, Mycobacterium
SEQLWPLTPAEKAKWRD

SEQ ID NO: 1280166 - protein, 23 aa, Mycobacterium
SEQTGVAPGRFFRASELSKLDDT

SEQ ID NO: 1280167 - protein, 17 aa, Mycobacterium
SERIPGAVVAIGNAPTA

SEQ ID NO: 1280168 - protein, 23 aa, Mycobacterium
SERLVKWQSVYELRNRVEKAVEL

SEQ ID NO: 1280169 - protein, 22 aa, Mycobacterium
SERRGRVLAVHCFLNDIAEWGW

SEQ ID NO: 1280170 - protein, 19 aa, Mycobacterium
SESNAMWALSIPVPFTKPV

SEQ ID NO: 1280171 - protein, 18 aa, Mycobacterium
SESPWAVVHFTVRMPEGS

SEQ ID NO: 1280172 - protein, 21 aa, Mycobacterium
SESTGKRWLGSFITTFRFNEV

SEQ ID NO: 1280173 - protein, 17 aa, Mycobacterium
SETAGGVTVTFDGDRDP

SEQ ID NO: 1280174 - protein, 20 aa, Mycobacterium
SETEAWLRAQLPDALLSVVD

SEQ ID NO: 1280175 - protein, 23 aa, Mycobacterium
SETELPVGVRLIFQAAEELMPGG

SEQ ID NO: 1280176 - protein, 24 aa, Mycobacterium
SETLFPGYYKRPDVTAEMFDEDGY

SEQ ID NO: 1280177 - protein, 23 aa, Mycobacterium
SETPKRLCALGFGEPEVSELHVD

SEQ ID NO: 1280178 - protein, 19 aa, Mycobacterium
SEVAIVCQLARTVLGPDHP

SEQ ID NO: 1280179 - protein, 19 aa, Mycobacterium
SEVAMEIALNAVRIHGGYG

SEQ ID NO: 1280180 - protein, 26 aa, Mycobacterium
SEVFEMASVRHWPHFEDPEAFNAAAV

SEQ ID NO: 1280181 - protein, 24 aa, Mycobacterium
SEVFLDRVALCFIDDEFGVENRHK

SEQ ID NO: 1280182 - protein, 27 aa, Mycobacterium
SEVIARLPFVPSILEWLHAGRTSVVMD

SEQ ID NO: 1280183 - protein, 18 aa, Mycobacterium
SEVLEAFAGNKVVIRTLD

SEQ ID NO: 1280184 - protein, 24 aa, Mycobacterium
SEVPATLAAMTWLASGPDLGPWAE

SEQ ID NO: 1280185 - protein, 17 aa, Mycobacterium
SFAAGGFGSAGAYRAWI

SEQ ID NO: 1280186 - protein, 26 aa, Mycobacterium
SFAGQGVGFGGWFSPIALHVVGESLD

SEQ ID NO: 1280187 - protein, 25 aa, Mycobacterium
SFAGQGVGFGGWYSPVALHVETDSI

SEQ ID NO: 1280188 - protein, 18 aa, Mycobacterium
SFALVGFARRDWADEDFG

SEQ ID NO: 1280189 - protein, 20 aa, Mycobacterium
SFANCSPTVFVQATEAVLAP

SEQ ID NO: 1280190 - protein, 17 aa, Mycobacterium
SFCPANTSSSWPLIREI

SEQ ID NO: 1280191 - protein, 25 aa, Mycobacterium
SFDAQGRYGLVSGSAKAAFSEKTNF

SEQ ID NO: 1280192 - protein, 24 aa, Mycobacterium
SFDGDRILGAILFEDTMDRQIEGR

SEQ ID NO: 1280193 - protein, 27 aa, Mycobacterium
SFENSVCLNCGSALGFSLDDMALLVIA

SEQ ID NO: 1280194 - protein, 22 aa, Mycobacterium
SFEWLIGAEDWFQRAADRGDVD

SEQ ID NO: 1280195 - protein, 21 aa, Mycobacterium
SFHYRSAVLFGTFDVVGAEQK

SEQ ID NO: 1280196 - protein, 17 aa, Mycobacterium
SFINRPGAYRFGTVGIP

SEQ ID NO: 1280197 - protein, 17 aa, Mycobacterium
SFKARYAQTPNQGVGAE

SEQ ID NO: 1280198 - protein, 20 aa, Mycobacterium
SFLGVPYLLATVIANTAAAV

SEQ ID NO: 1280199 - protein, 19 aa, Mycobacterium
SFNGWFRSWIPVTLQSDRS

SEQ ID NO: 1280200 - protein, 26 aa, Mycobacterium
SFNNELGHPWTVLRATRSTDYLVLEM

SEQ ID NO: 1280201 - protein, 27 aa, Mycobacterium
SFPVTAGEAVMMGRWRRLGLLRRPKAD

SEQ ID NO: 1280202 - protein, 23 aa, Mycobacterium
SFPVWTGHCGFAVQEFARRHGDF

SEQ ID NO: 1280203 - protein, 17 aa, Mycobacterium
SFQPSVTVPVDLEAARK

SEQ ID NO: 1280204 - protein, 18 aa, Mycobacterium
SFQYCPTCQTGGKVLADR

SEQ ID NO: 1280205 - protein, 23 aa, Mycobacterium
SFRKAHGALKIRGADIHNLQNVD

SEQ ID NO: 1280206 - protein, 21 aa, Mycobacterium
SFSDFLRSRLDVVELDESSTT

SEQ ID NO: 1280207 - protein, 21 aa, Mycobacterium
SFSFLNFYSYGAITVEGMSVK

SEQ ID NO: 1280208 - protein, 19 aa, Mycobacterium
SFSGLKTAVARYVESHPEA

SEQ ID NO: 1280209 - protein, 24 aa, Mycobacterium
SFSLALLLATERLKVIAAVHPGLW

SEQ ID NO: 1280210 - protein, 25 aa, Mycobacterium
SFTPKFFGHTGLRPAPADPTGTPVF

SEQ ID NO: 1280211 - protein, 19 aa, Mycobacterium
SFTSLMAMKVLKDKELSRI

SEQ ID NO: 1280212 - protein, 18 aa, Mycobacterium
SFTVPRGTATAIIGPSGS

SEQ ID NO: 1280213 - protein, 29 aa, Mycobacterium
SFVLKHSPLKLCWVPGYSDYYPETPGGKA

SEQ ID NO: 1280214 - protein, 25 aa, Mycobacterium
SFVNRRMGVALAFADDVDTARRNAA

SEQ ID NO: 1280215 - protein, 26 aa, Mycobacterium
SFVNSRPKPLAAYLFTKAKAVRERVI

SEQ ID NO: 1280216 - protein, 24 aa, Mycobacterium
SFWGDLGVFPAITLNFMPMSHVMG

SEQ ID NO: 1280217 - protein, 23 aa, Mycobacterium
SFYESTGCFRDMISTHLCQVLGF

SEQ ID NO: 1280218 - protein, 20 aa, Mycobacterium
SGAARMAIAAGVPIVPHIVW

SEQ ID NO: 1280219 - protein, 35 aa, Mycobacterium
SGADRAGSCQQVWCPVCALAALVQGEQHPLLNVVA

SEQ ID NO: 1280220 - protein, 18 aa, Mycobacterium
SGADSMWFEPLFSQDARD

SEQ ID NO: 1280221 - protein, 28 aa, Mycobacterium
SGAIGLSFARFLAARGARRIVLLSRRGA

SEQ ID NO: 1280222 - protein, 24 aa, Mycobacterium
SGAITRPALLDFVRNYKGQGVARE

SEQ ID NO: 1280223 - protein, 18 aa, Mycobacterium
SGALELDGALPINTSGGN

SEQ ID NO: 1280224 - protein, 22 aa, Mycobacterium
SGALNWLIDRVIALIQAGDAPP

SEQ ID NO: 1280225 - protein, 19 aa, Mycobacterium
SGAMLRDGAVYGVGVVVVA

SEQ ID NO: 1280226 - protein, 19 aa, Mycobacterium
SGAPLAFGSDWPVSSGAPL

SEQ ID NO: 1280227 - protein, 23 aa, Mycobacterium
SGARRRYHFLAGRGADGELPPND

SEQ ID NO: 1280228 - protein, 17 aa, Mycobacterium
SGCAAYAEQVPDGPGSV

SEQ ID NO: 1280229 - protein, 24 aa, Mycobacterium
SGCCDVPALKKCTLAGTSCGSCVP

SEQ ID NO: 1280230 - protein, 18 aa, Mycobacterium
SGCLAEWYLPDLTEELID

SEQ ID NO: 1280231 - protein, 19 aa, Mycobacterium
SGCRSHLSVTVGVAREPAE

SEQ ID NO: 1280232 - protein, 18 aa, Mycobacterium
SGDADWRLVAGHFERAER

SEQ ID NO: 1280233 - protein, 27 aa, Mycobacterium
SGDAPWRLECCAEVIAACDARGDVWGA

SEQ ID NO: 1280234 - protein, 18 aa, Mycobacterium
SGDEFECLPPAGVFSPDH

SEQ ID NO: 1280235 - protein, 23 aa, Mycobacterium
SGDHIFAPLARRLQRNGLHVIQV

SEQ ID NO: 1280236 - protein, 19 aa, Mycobacterium
SGDRATLWLDAERIHLFDP

SEQ ID NO: 1280237 - protein, 22 aa, Mycobacterium
SGDRGEVVWTREDVVPLTTSSR

SEQ ID NO: 1280238 - protein, 18 aa, Mycobacterium
SGDRLRVTATVAEDSQAR

SEQ ID NO: 1280239 - protein, 18 aa, Mycobacterium
SGDVLQFNGLAGVPISGS

SEQ ID NO: 1280240 - protein, 21 aa, Mycobacterium
SGDYVRRWVPELADVDDVHKL

SEQ ID NO: 1280241 - protein, 17 aa, Mycobacterium
SGEALLLLARSGIELGE

SEQ ID NO: 1280242 - protein, 17 aa, Mycobacterium
SGEALLLLARTGLELGV

SEQ ID NO: 1280243 - protein, 33 aa, Mycobacterium
SGEALRQFLLRHGHRGYRELCMRDPSWAQDAGG

SEQ ID NO: 1280244 - protein, 24 aa, Mycobacterium
SGEQRASNFLLWQAAYAEYVFQDK

SEQ ID NO: 1280245 - protein, 20 aa, Mycobacterium
SGERADWWWYTPFQPPPQAA

SEQ ID NO: 1280246 - protein, 18 aa, Mycobacterium
SGFDSVFVMDHFYQLPGL

SEQ ID NO: 1280247 - protein, 17 aa, Mycobacterium
SGFLVVGLNRYRLLDDG

SEQ ID NO: 1280248 - protein, 21 aa, Mycobacterium
SGFQIAPAIADKVERLEVFQR

SEQ ID NO: 1280249 - protein, 17 aa, Mycobacterium
SGFRGAKNVLLVFFPLA

SEQ ID NO: 1280250 - protein, 17 aa, Mycobacterium
SGFTGWVPFAELPNTDV

SEQ ID NO: 1280251 - protein, 17 aa, Mycobacterium
SGFVCFVGRPNTGKSTL

SEQ ID NO: 1280252 - protein, 21 aa, Mycobacterium
SGGAARAMFDPVLARMRDMGC

SEQ ID NO: 1280253 - protein, 24 aa, Mycobacterium
SGGAIALGHPFGMTGARITATLLN

SEQ ID NO: 1280254 - protein, 18 aa, Mycobacterium
SGGALWLPASQVIDGDGG

SEQ ID NO: 1280255 - protein, 20 aa, Mycobacterium
SGGARLPALIAANVKTDTGG

SEQ ID NO: 1280256 - protein, 19 aa, Mycobacterium
SGGARLPALIAANVKTNTG

SEQ ID NO: 1280257 - protein, 20 aa, Mycobacterium
SGGARLPALIAANVKTNTGG

SEQ ID NO: 1280258 - protein, 26 aa, Mycobacterium
SGGDAWQRADICLAFAQRYAAAFVDL

SEQ ID NO: 1280259 - protein, 19 aa, Mycobacterium
SGGEHPHGILVDDDGTVYV

SEQ ID NO: 1280260 - protein, 22 aa, Mycobacterium
SGGFLLTFLACFDPGDRVAIAS

SEQ ID NO: 1280261 - protein, 24 aa, Mycobacterium
SGGGFPEFPLPLGNPAESTRSCMT

SEQ ID NO: 1280262 - protein, 28 aa, Mycobacterium
SGGHYRARFTGPDGRRYKAPTTFLTKGD

SEQ ID NO: 1280263 - protein, 26 aa, Mycobacterium
SGGIFRDCAVHDFDVIRWVTGQNVVD

SEQ ID NO: 1280264 - protein, 24 aa, Mycobacterium
SGGIKARIGINLQNALGLVDLKLL

SEQ ID NO: 1280265 - protein, 17 aa, Mycobacterium
SGGLFAMDVPVFATDFY

SEQ ID NO: 1280266 - protein, 19 aa, Mycobacterium
SGGLPAAAFGGRAEVMNRL

SEQ ID NO: 1280267 - protein, 25 aa, Mycobacterium
SGGMAFGIACDLEIAGQRASLVDQV

SEQ ID NO: 1280268 - protein, 18 aa, Mycobacterium
SGGMGWLPGQLHGRWEAC

SEQ ID NO: 1280269 - protein, 25 aa, Mycobacterium
SGGQRKRAFLARCITQGADLLLLDE

SEQ ID NO: 1280270 - protein, 24 aa, Mycobacterium
SGGRCQRCVLGATAQRLLTSPDTG

SEQ ID NO: 1280271 - protein, 22 aa, Mycobacterium
SGGRGVGSAENFGIVEELADSL

SEQ ID NO: 1280272 - protein, 18 aa, Mycobacterium
SGGRIVLVALAATAAKAV

SEQ ID NO: 1280273 - protein, 21 aa, Mycobacterium
SGGRLILGLGAGWYEKDYTTY

SEQ ID NO: 1280274 - protein, 19 aa, Mycobacterium
SGGRPAALYRFTDSRYRVT

SEQ ID NO: 1280275 - protein, 25 aa, Mycobacterium
SGGWKKRFESGLTMLCQTRGFLELN

SEQ ID NO: 1280276 - protein, 18 aa, Mycobacterium
SGGWQVVFDGPLPSTDDY

SEQ ID NO: 1280277 - protein, 26 aa, Mycobacterium
SGHGEGWALYAERLMAELGWLEDAGN

SEQ ID NO: 1280278 - protein, 34 aa, Mycobacterium
SGHGNRLRKAVGWYRSHGRLHTGDPIAMAKDAGD

SEQ ID NO: 1280279 - protein, 24 aa, Mycobacterium
SGHLTELFEAAGLRDVVEDSIAVD

SEQ ID NO: 1280280 - protein, 19 aa, Mycobacterium
SGHRRWVSPAARRLASSLH

SEQ ID NO: 1280281 - protein, 25 aa, Mycobacterium
SGHYPAFCGTVGPGFADGAVVGNIF

SEQ ID NO: 1280282 - protein, 21 aa, Mycobacterium
SGHYSFLNVFKLFGPGNDAPL

SEQ ID NO: 1280283 - protein, 18 aa, Mycobacterium
SGIAGAYCTKLLADGGAR

SEQ ID NO: 1280284 - protein, 19 aa, Mycobacterium
SGIDSGARLVTGGGIPENL

SEQ ID NO: 1280285 - protein, 20 aa, Mycobacterium
SGIELPIEFEAKVRLLESFS

SEQ ID NO: 1280286 - protein, 20 aa, Mycobacterium
SGIGAALCRALDRAGAQVVC

SEQ ID NO: 1280287 - protein, 19 aa, Mycobacterium
SGIHVCLGAALARIEGATA

SEQ ID NO: 1280288 - protein, 18 aa, Mycobacterium
SGIPRIVGERSVFCPPRV

SEQ ID NO: 1280289 - protein, 17 aa, Mycobacterium
SGIYRYFSGKSDILAGA

SEQ ID NO: 1280290 - protein, 25 aa, Mycobacterium
SGKACAQYLGPALRLMNFNYLPLPF

SEQ ID NO: 1280291 - protein, 20 aa, Mycobacterium
SGKDWQVWAGDQVTDFVRLN

SEQ ID NO: 1280292 - protein, 18 aa, Mycobacterium
SGKGRFYPEFRVTAQRLD

SEQ ID NO: 1280293 - protein, 22 aa, Mycobacterium
SGKQDFGQWMFFGLGQALVGAA

SEQ ID NO: 1280294 - protein, 30 aa, Mycobacterium
SGKRRLALDHLPRLASALSVSTDELLRAPE

SEQ ID NO: 1280295 - protein, 23 aa, Mycobacterium
SGKYRRVLTMAWEKQSESNAMWA

SEQ ID NO: 1280296 - protein, 29 aa, Mycobacterium
SGLDARAYRLGWPAGTVVYELDQPAVIEF

SEQ ID NO: 1280297 - protein, 30 aa, Mycobacterium
SGLDSRAFRLPWPAGTTVFEIDQPLVLAYK

SEQ ID NO: 1280298 - protein, 19 aa, Mycobacterium
SGLFLTRLGGHHQYSSGSQ

SEQ ID NO: 1280299 - protein, 28 aa, Mycobacterium
SGLGGGLLKAGGWITAGIAAGKLFSDAV

SEQ ID NO: 1280300 - protein, 17 aa, Mycobacterium
SGLGWAVWTDGRVKFTT

SEQ ID NO: 1280301 - protein, 24 aa, Mycobacterium
SGLIREMLDWAAAEPVDDDNLALV

SEQ ID NO: 1280302 - protein, 18 aa, Mycobacterium
SGLLPREATGTAALRNSG

SEQ ID NO: 1280303 - protein, 25 aa, Mycobacterium
SGLPRLAEALAPLGSAVTVALNADV

SEQ ID NO: 1280304 - protein, 18 aa, Mycobacterium
SGLPWRVIFPDAEHPGAT

SEQ ID NO: 1280305 - protein, 18 aa, Mycobacterium
SGLRRLLFVNGHMGNTAA

SEQ ID NO: 1280306 - protein, 19 aa, Mycobacterium
SGLRRLLFVNGHMGNTAAL

SEQ ID NO: 1280307 - protein, 17 aa, Mycobacterium
SGLRRVSGTPVQIGARL

SEQ ID NO: 1280308 - protein, 22 aa, Mycobacterium
SGLTRAVLRGGDYVGVHALGDL

SEQ ID NO: 1280309 - protein, 25 aa, Mycobacterium
SGLVKRARESGDHVGCRKVVNISSL

SEQ ID NO: 1280310 - protein, 17 aa, Mycobacterium
SGMETGHWLRPGDRITL

SEQ ID NO: 1280311 - protein, 19 aa, Mycobacterium
SGMFTRFGAAAFAERTRRE

SEQ ID NO: 1280312 - protein, 26 aa, Mycobacterium
SGNCGVGFAPVRPGREQWLIELMEGV

SEQ ID NO: 1280313 - protein, 17 aa, Mycobacterium
SGNFCRCTGYQGIVNAV

SEQ ID NO: 1280314 - protein, 18 aa, Mycobacterium
SGNLLYLLLTHRDQFEAV

SEQ ID NO: 1280315 - protein, 18 aa, Mycobacterium
SGNQRLQNWWRIDKLERR

SEQ ID NO: 1280316 - protein, 17 aa, Mycobacterium
SGPAPWRRSSSPAMTPS

SEQ ID NO: 1280317 - protein, 17 aa, Mycobacterium
SGPAVLYRATPASFTDR

SEQ ID NO: 1280318 - protein, 22 aa, Mycobacterium
SGPDRYLVSLAVTTTVDQAVPA

SEQ ID NO: 1280319 - protein, 22 aa, Mycobacterium
SGPDWYPAFLTAVADRIEIGRR

SEQ ID NO: 1280320 - protein, 23 aa, Mycobacterium
SGPFDWPPGDTFEHRDKHTFVNY

SEQ ID NO: 1280321 - protein, 18 aa, Mycobacterium
SGPFYDGVIFHRVIEGFM

SEQ ID NO: 1280322 - protein, 25 aa, Mycobacterium
SGPHLARWAHDNGWAAAPDADAKDL

SEQ ID NO: 1280323 - protein, 20 aa, Mycobacterium
SGPLSAKLLRNGTLKTYAGF

SEQ ID NO: 1280324 - protein, 22 aa, Mycobacterium
SGPMVRYPIPPMIHGATQSATW

SEQ ID NO: 1280325 - protein, 21 aa, Mycobacterium
SGPRLSGKRIIIDPGRGGSDH

SEQ ID NO: 1280326 - protein, 27 aa, Mycobacterium
SGPRPEFEALASVFAVLGRAIFVSEQP

SEQ ID NO: 1280327 - protein, 26 aa, Mycobacterium
SGPTGGHAVEMTWNALGVRMRAIGAH

SEQ ID NO: 1280328 - protein, 23 aa, Mycobacterium
SGQDACSGWHFTSGGALRRVVVM

SEQ ID NO: 1280329 - protein, 17 aa, Mycobacterium
SGQFCTNPGLVIAVDGP

SEQ ID NO: 1280330 - protein, 23 aa, Mycobacterium
SGQPRESPLLFLREGDRVVLVAS

SEQ ID NO: 1280331 - protein, 18 aa, Mycobacterium
SGQYTYRSVTVIGAPTKI

SEQ ID NO: 1280332 - protein, 26 aa, Mycobacterium
SGRDLSGWGRQWLKTTGLNTLRPDFD

SEQ ID NO: 1280333 - protein, 19 aa, Mycobacterium
SGRFEFRRGPIFTNLLLGD

SEQ ID NO: 1280334 - protein, 25 aa, Mycobacterium
SGRFVDAREALKLGLVDELVAPDTV

SEQ ID NO: 1280335 - protein, 33 aa, Mycobacterium
SGRGRQQPRCRECWRPGKPTVLTSTRISPGTRE

SEQ ID NO: 1280336 - protein, 24 aa, Mycobacterium
SGRSELRLAAEAVLDALDDAGLTP

SEQ ID NO: 1280337 - protein, 25 aa, Mycobacterium
SGRTVTGLVLKWLTGESRNDSSSRF

SEQ ID NO: 1280338 - protein, 24 aa, Mycobacterium
SGRTVTGLVLKWLTGESRSDSSSR

SEQ ID NO: 1280339 - protein, 19 aa, Mycobacterium
SGRTWRVDFAWLDAKVAVE

SEQ ID NO: 1280340 - protein, 18 aa, Mycobacterium
SGRVAAVAPIEFTVGAGI

SEQ ID NO: 1280341 - protein, 32 aa, Mycobacterium
SGRVKRPQMGIAAWIIPSIVAFGTDEQKQRFL

SEQ ID NO: 1280342 - protein, 21 aa, Mycobacterium
SGRYRWSRNCTIFTYDEPLEF

SEQ ID NO: 1280343 - protein, 26 aa, Mycobacterium
SGSCGYRLTPALPRLDSYRGHPDGGT

SEQ ID NO: 1280344 - protein, 24 aa, Mycobacterium
SGSGKSTFLRCINHLETVSAGRLY

SEQ ID NO: 1280345 - protein, 24 aa, Mycobacterium
SGSGKSTFLRCLNKLEDISGGKVV

SEQ ID NO: 1280346 - protein, 23 aa, Mycobacterium
SGSKLRAAKGINVPDARLPISAL

SEQ ID NO: 1280347 - protein, 25 aa, Mycobacterium
SGSLHRDGWTFTGWGRATTDEAGRY

SEQ ID NO: 1280348 - protein, 18 aa, Mycobacterium
SGSLVVGVCAEYDALPDI

SEQ ID NO: 1280349 - protein, 18 aa, Mycobacterium
SGSMFSPIDFVWCAVCIT

SEQ ID NO: 1280350 - protein, 19 aa, Mycobacterium
SGSQCNRNLFSAAGYFEAL

SEQ ID NO: 1280351 - protein, 20 aa, Mycobacterium
SGSRFLTKVRHSAFYATPLD

SEQ ID NO: 1280352 - protein, 35 aa, Mycobacterium
SGSSFRRMCRDEFLHYLRIREWQDLVGQLRGICRD

SEQ ID NO: 1280353 - protein, 17 aa, Mycobacterium
SGSSRDWAAKGTTLLGV

SEQ ID NO: 1280354 - protein, 18 aa, Mycobacterium
SGSWSFILRREVGRTRLL

SEQ ID NO: 1280355 - protein, 26 aa, Mycobacterium
SGSYEHQWMMGSCIVLQKGAPVMTDA

SEQ ID NO: 1280356 - protein, 21 aa, Mycobacterium
SGTADPLRWSAARVENVLESP

SEQ ID NO: 1280357 - protein, 26 aa, Mycobacterium
SGTATLRYSGIFAFGTYSVTYKNYSD

SEQ ID NO: 1280358 - protein, 24 aa, Mycobacterium
SGTGRSAGAMGWLMGVNHHDGVVA

SEQ ID NO: 1280359 - protein, 24 aa, Mycobacterium
SGTRRGVLRVGYLIGTGADLLFRL

SEQ ID NO: 1280360 - protein, 28 aa, Mycobacterium
SGVCPVPRLRAAGVPVGIGTDGAASNDS

SEQ ID NO: 1280361 - protein, 27 aa, Mycobacterium
SGVEHIPCWLITDIRSFRRYVVGGHLP

SEQ ID NO: 1280362 - protein, 23 aa, Mycobacterium
SGVELIKALHCYEYQSCEHPGWR

SEQ ID NO: 1280363 - protein, 25 aa, Mycobacterium
SGVELTWPPGWSRWPSRRYGDTRLD

SEQ ID NO: 1280364 - protein, 29 aa, Mycobacterium
SGVIPRIPLNLVLIKGVHVLGFQFQDVPA

SEQ ID NO: 1280365 - protein, 18 aa, Mycobacterium
SGVLRLVGHNGGWTPVHV

SEQ ID NO: 1280366 - protein, 24 aa, Mycobacterium
SGVNVCSSAAWITGAKQSPEDLDR

SEQ ID NO: 1280367 - protein, 26 aa, Mycobacterium
SGVRYRPGGVSLRLGEHPYAAELSAL

SEQ ID NO: 1280368 - protein, 18 aa, Mycobacterium
SGVTLRRVYDRLGFLASR

SEQ ID NO: 1280369 - protein, 24 aa, Mycobacterium
SGVVLYCHSGAFVLGTLDTDHRQC

SEQ ID NO: 1280370 - protein, 17 aa, Mycobacterium
SGVWRQRADVVIVGTGV

SEQ ID NO: 1280371 - protein, 19 aa, Mycobacterium
SGWTVAPVLTFTRRRPLAV

SEQ ID NO: 1280372 - protein, 18 aa, Mycobacterium
SGYALGGGFEMALMCDIA

SEQ ID NO: 1280373 - protein, 17 aa, Mycobacterium
SGYALGGGFEMALMTDI

SEQ ID NO: 1280374 - protein, 24 aa, Mycobacterium
SGYDIKKWINWAIRFFYSSPAYSQ

SEQ ID NO: 1280375 - protein, 18 aa, Mycobacterium
SGYEFDIPNLQVLSDPVE

SEQ ID NO: 1280376 - protein, 17 aa, Mycobacterium
SGYGLPMALTLFRRQLD

SEQ ID NO: 1280377 - protein, 24 aa, Mycobacterium
SGYPLELLVRAAAAGWSVTERDVA

SEQ ID NO: 1280378 - protein, 28 aa, Mycobacterium
SGYPRLVKRWRRGQPLAEAETVFSGSES

SEQ ID NO: 1280379 - protein, 20 aa, Mycobacterium
SHADAWGWTVVSMRSDWATI

SEQ ID NO: 1280380 - protein, 18 aa, Mycobacterium
SHAHGMDGVQFFTRQKAV

SEQ ID NO: 1280381 - protein, 25 aa, Mycobacterium
SHAQAARLTEWLKLAIDQPELLEKL

SEQ ID NO: 1280382 - protein, 21 aa, Mycobacterium
SHAWIQAWTGEWWHYDPTNDA

SEQ ID NO: 1280383 - protein, 18 aa, Mycobacterium
SHDARFVLIGTMNPEEGE

SEQ ID NO: 1280384 - protein, 27 aa, Mycobacterium
SHDHLWRARVLPGERSYPVAHRVRGVE

SEQ ID NO: 1280385 - protein, 18 aa, Mycobacterium
SHDICSAVHPLALASPFF

SEQ ID NO: 1280386 - protein, 17 aa, Mycobacterium
SHDRWFLDRTCTHILAW

SEQ ID NO: 1280387 - protein, 19 aa, Mycobacterium
SHGDWPPGFPEGKRPAYPL

SEQ ID NO: 1280388 - protein, 30 aa, Mycobacterium
SHGKTAAQALIRWHMQLGNIVIPKSVNPQR

SEQ ID NO: 1280389 - protein, 21 aa, Mycobacterium
SHGQRCHRLLRASEVVSTTLL

SEQ ID NO: 1280390 - protein, 18 aa, Mycobacterium
SHILGLLNIVMALDTGAW

SEQ ID NO: 1280391 - protein, 18 aa, Mycobacterium
SHLAGGYAQTAFAFNYLG

SEQ ID NO: 1280392 - protein, 17 aa, Mycobacterium
SHLFWAMGDVERAHEVI

SEQ ID NO: 1280393 - protein, 24 aa, Mycobacterium
SHLIGLMAEQWILAGYGVLVVDPE

SEQ ID NO: 1280394 - protein, 19 aa, Mycobacterium
SHLRSARLWGRDARLLYIH

SEQ ID NO: 1280395 - protein, 21 aa, Mycobacterium
SHLSLLRRLMMDDNWYRGELI

SEQ ID NO: 1280396 - protein, 24 aa, Mycobacterium
SHLYPDSLRTMGWDVDASGFRLVL

SEQ ID NO: 1280397 - protein, 22 aa, Mycobacterium
SHPAGSVLVEFGETRVMCTASV

SEQ ID NO: 1280398 - protein, 17 aa, Mycobacterium
SHPEHFRMINWGRLEGV

SEQ ID NO: 1280399 - protein, 31 aa, Mycobacterium
SHPGSRPTLRRVRAGARIGLAAATRARGRAG

SEQ ID NO: 1280400 - protein, 19 aa, Mycobacterium
SHPSLCLLATRLPETSKAG

SEQ ID NO: 1280401 - protein, 18 aa, Mycobacterium
SHPVPLLFVHGAWHAAWC

SEQ ID NO: 1280402 - protein, 20 aa, Mycobacterium
SHRSRLWDRIAQWVPTVVPV

SEQ ID NO: 1280403 - protein, 24 aa, Mycobacterium
SHRVINLLACLRLLHEQAPELTSE

SEQ ID NO: 1280404 - protein, 18 aa, Mycobacterium
SHSAQWALPGGRLDPGET

SEQ ID NO: 1280405 - protein, 19 aa, Mycobacterium
SHTVDALLAGYGRAIADHR

SEQ ID NO: 1280406 - protein, 18 aa, Mycobacterium
SHVTRLLVDGGHEVRAMV

SEQ ID NO: 1280407 - protein, 19 aa, Mycobacterium
SHWLGRGADGWRLDAAYAV

SEQ ID NO: 1280408 - protein, 25 aa, Mycobacterium
SHYAKMMFDVMVTRILTRLPDFELA

SEQ ID NO: 1280409 - protein, 19 aa, Mycobacterium
SIAALRAEPVDVYGVGTSV

SEQ ID NO: 1280410 - protein, 23 aa, Mycobacterium
SIADARYQIRWEKSEAPGAARPT

SEQ ID NO: 1280411 - protein, 24 aa, Mycobacterium
SIADTFLMFGARIMDTGATMIDFV

SEQ ID NO: 1280412 - protein, 20 aa, Mycobacterium
SIAEACRRLDVSPGAPYRHF

SEQ ID NO: 1280413 - protein, 23 aa, Mycobacterium
SIAGREFGSRLILGTGGAANLAV

SEQ ID NO: 1280414 - protein, 24 aa, Mycobacterium
SIAHAQRWRFDGITPIGPDVLLSL

SEQ ID NO: 1280415 - protein, 17 aa, Mycobacterium
SIAHCPTSQLFLGSGTM

SEQ ID NO: 1280416 - protein, 18 aa, Mycobacterium
SIAHGIRRFEFMIHPDET

SEQ ID NO: 1280417 - protein, 18 aa, Mycobacterium
SIDAERWLAEHTEPGERS

SEQ ID NO: 1280418 - protein, 25 aa, Mycobacterium
SIDDVPRGIAFLLNRNRLNVAVSRA

SEQ ID NO: 1280419 - protein, 26 aa, Mycobacterium
SIDERARAGLFLAMQYPVEVPGVSMS

SEQ ID NO: 1280420 - protein, 17 aa, Mycobacterium
SIDLVFFVNGIPVATAE

SEQ ID NO: 1280421 - protein, 21 aa, Mycobacterium
SIDSVLRWTYGLTEAVAEGNR

SEQ ID NO: 1280422 - protein, 17 aa, Mycobacterium
SIEFRIVSKMVDTDDGP

SEQ ID NO: 1280423 - protein, 18 aa, Mycobacterium
SIGRSWWLRHVVVSAAHW

SEQ ID NO: 1280424 - protein, 25 aa, Mycobacterium
SIGYAACHWCHVMAHECFEDDEVAA

SEQ ID NO: 1280425 - protein, 18 aa, Mycobacterium
SIHLKHYGFLGVDPDGPV

SEQ ID NO: 1280426 - protein, 19 aa, Mycobacterium
SIHPARFLVGLSRKNHTFG

SEQ ID NO: 1280427 - protein, 29 aa, Mycobacterium
SIHRQWLLIELRTDWSYRFQNYPAGSLLA

SEQ ID NO: 1280428 - protein, 19 aa, Mycobacterium
SIHRVWRSKLPDVIEKGTQ

SEQ ID NO: 1280429 - protein, 25 aa, Mycobacterium
SIHSAEWDPALSLRGKKVAIIGAGC

SEQ ID NO: 1280430 - protein, 25 aa, Mycobacterium
SIIANRVSYYFDLRGPSVTVDTACS

SEQ ID NO: 1280431 - protein, 26 aa, Mycobacterium
SILCDPWLNPAYFASWFPFPDNSDLD

SEQ ID NO: 1280432 - protein, 25 aa, Mycobacterium
SILDWLRAGYPGGVPGPDRVPLLAL

SEQ ID NO: 1280433 - protein, 20 aa, Mycobacterium
SILIRGLMNYAFWVPNGSPE

SEQ ID NO: 1280434 - protein, 28 aa, Mycobacterium
SILRALALNRFAKVPTLVGGQMLNLQEP

SEQ ID NO: 1280435 - protein, 23 aa, Mycobacterium
SILRPGYESTWQWSRGFQATVLY

SEQ ID NO: 1280436 - protein, 18 aa, Mycobacterium
SINAEFSQPLSVARAKEI

SEQ ID NO: 1280437 - protein, 25 aa, Mycobacterium
SINWGARGPLQWEAPYGHTLISKYA

SEQ ID NO: 1280438 - protein, 19 aa, Mycobacterium
SIPEPFKKSFRAWLDGEWF

SEQ ID NO: 1280439 - protein, 18 aa, Mycobacterium
SIPRRGVGDSVLIVPVVT

SEQ ID NO: 1280440 - protein, 22 aa, Mycobacterium
SIRELRECVRRELGSEAEQVAA

SEQ ID NO: 1280441 - protein, 18 aa, Mycobacterium
SIRNGRRSVVITGTPEQL

SEQ ID NO: 1280442 - protein, 20 aa, Mycobacterium
SIRQNCAWPQTNSMVTPANS

SEQ ID NO: 1280443 - protein, 21 aa, Mycobacterium
SIRQNCAWPQTNSMVTPANSG

SEQ ID NO: 1280444 - protein, 25 aa, Mycobacterium
SIRTGRANPGMFNRIHVDYYGAVTP

SEQ ID NO: 1280445 - protein, 25 aa, Mycobacterium
SIRVPAAFCGLAGLRTTHGRIDTAG

SEQ ID NO: 1280446 - protein, 18 aa, Mycobacterium
SISPEFSEFLAGHQENAE

SEQ ID NO: 1280447 - protein, 17 aa, Mycobacterium
SITERWPTPTFPDDVPG

SEQ ID NO: 1280448 - protein, 20 aa, Mycobacterium
SIVREARGDGGFGYDPVFLP

SEQ ID NO: 1280449 - protein, 25 aa, Mycobacterium
SIVVLRPGTGWTRYSLLETLRAYGR

SEQ ID NO: 1280450 - protein, 19 aa, Mycobacterium
SIYQAVDFVVGGGAPEAPP

SEQ ID NO: 1280451 - protein, 18 aa, Mycobacterium
SIYRFEGQISVFWEDAPA

SEQ ID NO: 1280452 - protein, 18 aa, Mycobacterium
SKAALDAVVSRWKAETSW

SEQ ID NO: 1280453 - protein, 23 aa, Mycobacterium
SKAEAIRKFRILPVDFTVFTGEL

SEQ ID NO: 1280454 - protein, 17 aa, Mycobacterium
SKAELDALIAAEKQRIA

SEQ ID NO: 1280455 - protein, 23 aa, Mycobacterium
SKAHARVLFRAGLLTEEQRDGLL

SEQ ID NO: 1280456 - protein, 25 aa, Mycobacterium
SKAKATEVGLTWIAEIGAHGVVAGP

SEQ ID NO: 1280457 - protein, 17 aa, Mycobacterium
SKAKRILLTSGKLYYEL

SEQ ID NO: 1280458 - protein, 25 aa, Mycobacterium
SKALFYFYFPRKEDVLFEVGVLSTQ

SEQ ID NO: 1280459 - protein, 24 aa, Mycobacterium
SKALFYFYFPRKEDVLFEVGVMST

SEQ ID NO: 1280460 - protein, 22 aa, Mycobacterium
SKALRGYSAWVTGIRRVEAPTR

SEQ ID NO: 1280461 - protein, 17 aa, Mycobacterium
SKAVPRARRLIYLEDQY

SEQ ID NO: 1280462 - protein, 27 aa, Mycobacterium
SKAWKQWLRLSNWLGISDHSRVSTRTL

SEQ ID NO: 1280463 - protein, 22 aa, Mycobacterium
SKDGPFPLDAFKKVVEVNLIGT

SEQ ID NO: 1280464 - protein, 18 aa, Mycobacterium
SKDLPFAQKRFCGAEGIE

SEQ ID NO: 1280465 - protein, 23 aa, Mycobacterium
SKFGESSFCRFARIEDFEAIVTG

SEQ ID NO: 1280466 - protein, 18 aa, Mycobacterium
SKFGKSRIVPLHPSVLDA

SEQ ID NO: 1280467 - protein, 18 aa, Mycobacterium
SKGGDPRHPSWYFNVKAN

SEQ ID NO: 1280468 - protein, 30 aa, Mycobacterium; identical to SEQ ID NO: 732062

SEQ ID NO: 1280469 - protein, 22 aa, Mycobacterium
SKHPWKRARTTFQYLAVAIFGS

SEQ ID NO: 1280470 - protein, 28 aa, Mycobacterium
SKIASWTEPKGGYFISLDVLPGTAKRTV

SEQ ID NO: 1280471 - protein, 18 aa, Mycobacterium
SKIEVFRALFGSDDRAQA

SEQ ID NO: 1280472 - protein, 17 aa, Mycobacterium
SKIPSVSYWNAERRCAA

SEQ ID NO: 1280473 - protein, 25 aa, Mycobacterium
SKLEEWARENIPVLGAKRFFFAEKT

SEQ ID NO: 1280474 - protein, 25 aa, Mycobacterium
SKLIGEWLLRDIGVATGLRHTSLRY

SEQ ID NO: 1280475 - protein, 23 aa, Mycobacterium
SKLLRVRLGEPFMARQGSMVAYQ

SEQ ID NO: 1280476 - protein, 33 aa, Mycobacterium
SKLPGLPPLRLNLPTPEQFIASIPAPVVTCLCG

SEQ ID NO: 1280477 - protein, 22 aa, Mycobacterium
SKLSEMPVLWAYARDLFQTPGF

SEQ ID NO: 1280478 - protein, 20 aa, Mycobacterium
SKMDAAALLHQLSAGHPVEQ

SEQ ID NO: 1280479 - protein, 20 aa, Mycobacterium
SKMTVYRLVHNGELPAVRVG

SEQ ID NO: 1280480 - protein, 21 aa, Mycobacterium
SKNAQPWRLHVVQSRTELVDL

SEQ ID NO: 1280481 - protein, 17 aa, Mycobacterium
SKPLMPSTWGAAPTTAA

SEQ ID NO: 1280482 - protein, 23 aa, Mycobacterium
SKPRCKRCPVVLNKVRKAELNGI

SEQ ID NO: 1280483 - protein, 22 aa, Mycobacterium
SKPWHPSGLAIDIMIPNPESPE

SEQ ID NO: 1280484 - protein, 20 aa, Mycobacterium
SKPYRGHLIRTYGGTVHSSP

SEQ ID NO: 1280485 - protein, 18 aa, Mycobacterium
SKQGRWQEMATLIDDEIL

SEQ ID NO: 1280486 - protein, 24 aa, Mycobacterium
SKRDCGRVLDLLDMFRAITYSIKR

SEQ ID NO: 1280487 - protein, 23 aa, Mycobacterium
SKRELAFRFGATHFVTSMEEATA

SEQ ID NO: 1280488 - protein, 25 aa, Mycobacterium
SKSPKEHFDFFPLTIDVEERMYAAG

SEQ ID NO: 1280489 - protein, 19 aa, Mycobacterium
SKVVRCLDVSDLGHRIPNT

SEQ ID NO: 1280490 - protein, 22 aa, Mycobacterium
SLAALAHHWNIPQARPHDALDD

SEQ ID NO: 1280491 - protein, 19 aa, Mycobacterium
SLAFYRDALGFEVRKDVGH

SEQ ID NO: 1280492 - protein, 18 aa, Mycobacterium
SLAGAQPKIALFRDTKSG

SEQ ID NO: 1280493 - protein, 24 aa, Mycobacterium
SLAGPRPVVLNALAGVGADVTVEM

SEQ ID NO: 1280494 - protein, 18 aa, Mycobacterium
SLAGRPSNIGTRFHNHLY

SEQ ID NO: 1280495 - protein, 20 aa, Mycobacterium
SLAGRPSNIGTRFHNHLYEV

SEQ ID NO: 1280496 - protein, 25 aa, Mycobacterium
SLAHRAKWGLLLARTDPDVPKHKGL

SEQ ID NO: 1280497 - protein, 17 aa, Mycobacterium
SLALPLALYRAVTAFGR

SEQ ID NO: 1280498 - protein, 24 aa, Mycobacterium
SLAPEFRAAVVLCDIEGLSYEEIG

SEQ ID NO: 1280499 - protein, 17 aa, Mycobacterium
SLAPILLRRVNKRPIPA

SEQ ID NO: 1280500 - protein, 27 aa, Mycobacterium
SLAPPVSTWWPWRGRTVHVARAAVPAA

SEQ ID NO: 1280501 - protein, 18 aa, Mycobacterium
SLAPYGFSGWVGPEPHGA

SEQ ID NO: 1280502 - protein, 25 aa, Mycobacterium
SLARFPEPLAPLAAARRSGAELPTR

SEQ ID NO: 1280503 - protein, 26 aa, Mycobacterium
SLCTHCNKCMVTIFEKTRCVLHPLPA

SEQ ID NO: 1280504 - protein, 33 aa, Mycobacterium
SLDARIADRLGLRPDVRRVPLFGLGCVAGAAGI

SEQ ID NO: 1280505 - protein, 23 aa, Mycobacterium
SLDARLRELVIMRIGWITGSEYE

SEQ ID NO: 1280506 - protein, 20 aa, Mycobacterium
SLDHAMWFMRAFRADEWLLY

SEQ ID NO: 1280507 - protein, 36 aa, Mycobacterium
SLDISPLQARCGWAIGWKKDAFWGRDALLAEKAAGP

SEQ ID NO: 1280508 - protein, 18 aa, Mycobacterium
SLDKARRLLWPLKKKYGK

SEQ ID NO: 1280509 - protein, 23 aa, Mycobacterium
SLDPKDLYDVLAINAASASTQIS

SEQ ID NO: 1280510 - protein, 22 aa, Mycobacterium
SLDPRLPVFDVLAEPLQANDFD

SEQ ID NO: 1280511 - protein, 18 aa, Mycobacterium
SLDRRGAPITWPVTPYLG

SEQ ID NO: 1280512 - protein, 17 aa, Mycobacterium
SLDWMAGQIGHHIHDPY

SEQ ID NO: 1280513 - protein, 22 aa, Mycobacterium
SLEALRLLGRYLERAVTDAADR

SEQ ID NO: 1280514 - protein, 22 aa, Mycobacterium
SLEELRSGLKFASAGLLSGSKT

SEQ ID NO: 1280515 - protein, 28 aa, Mycobacterium
SLEGLAYRLARLFWWEILQINPDQKDLA

SEQ ID NO: 1280516 - protein, 19 aa, Mycobacterium
SLELGALVEPMSVAYHAAT

SEQ ID NO: 1280517 - protein, 26 aa, Mycobacterium
SLERLDAMLPKPAQRIGLSATVRPPE

SEQ ID NO: 1280518 - protein, 24 aa, Mycobacterium
SLETARPADLLVLLDSLQQREAAL

SEQ ID NO: 1280519 - protein, 24 aa, Mycobacterium
SLETVPICVGYSVDGKRTDEMPMT

SEQ ID NO: 1280520 - protein, 24 aa, Mycobacterium
SLETVPICVGYTIDGKRTDEMPMT

SEQ ID NO: 1280521 - protein, 22 aa, Mycobacterium
SLGAEVRWASCNIFSTQDHAAA

SEQ ID NO: 1280522 - protein, 21 aa, Mycobacterium
SLGALIAQLGRYWRIDPGDTF

SEQ ID NO: 1280523 - protein, 18 aa, Mycobacterium
SLGELWDALMADWYDVHE

SEQ ID NO: 1280524 - protein, 24 aa, Mycobacterium
SLGGLARAISDIAARARSGDLKPD

SEQ ID NO: 1280525 - protein, 23 aa, Mycobacterium
SLGHPRKGLFLVHTDAVDSVLGT

SEQ ID NO: 1280526 - protein, 19 aa, Mycobacterium
SLGKLGLEPGMTLLDIGCG

SEQ ID NO: 1280527 - protein, 17 aa, Mycobacterium
SLGRPARAGSWDELAKG

SEQ ID NO: 1280528 - protein, 19 aa, Mycobacterium
SLGVPYRWLTSYVAGDKVY

SEQ ID NO: 1280529 - protein, 26 aa, Mycobacterium
SLHAAKGLEWDAVFLVGLADGTLPIS

SEQ ID NO: 1280530 - protein, 17 aa, Mycobacterium
SLHPLWRARGRLQEGQA

SEQ ID NO: 1280531 - protein, 21 aa, Mycobacterium
SLIAPRLWVGAAVDGVDDRIA

SEQ ID NO: 1280532 - protein, 26 aa, Mycobacterium
SLIKVKGFRNVIHWRVTRYDEPKEIE

SEQ ID NO: 1280533 - protein, 18 aa, Mycobacterium
SLKGLPPTYVYSSSLDLL

SEQ ID NO: 1280534 - protein, 20 aa, Mycobacterium
SLLAYLFEVDYLDHFVFVLT

SEQ ID NO: 1280535 - protein, 19 aa, Mycobacterium
SLLERYRTDYGRWPESVGL

SEQ ID NO: 1280536 - protein, 23 aa, Mycobacterium
SLLGSALYRFPVSYETLEETGLL

SEQ ID NO: 1280537 - protein, 24 aa, Mycobacterium
SLLHRELSGRWALLAPPDAPAGCA

SEQ ID NO: 1280538 - protein, 18 aa, Mycobacterium
SLLHRWPLTQPRLLSDMP

SEQ ID NO: 1280539 - protein, 28 aa, Mycobacterium
SLLPMPDLIRLAARAHHYLYVYDQHSGK

SEQ ID NO: 1280540 - protein, 17 aa, Mycobacterium
SLLRPGGELRYLEHIAE

SEQ ID NO: 1280541 - protein, 17 aa, Mycobacterium
SLLRRLVEAGTRVVQYG

SEQ ID NO: 1280542 - protein, 18 aa, Mycobacterium
SLLWEGKPLLGLTWLPFM

SEQ ID NO: 1280543 - protein, 18 aa, Mycobacterium
SLMARLTLAKAPARAALR

SEQ ID NO: 1280544 - protein, 24 aa, Mycobacterium
SLMPLRYEGVWWVRAHLTTKLDGP

SEQ ID NO: 1280545 - protein, 25 aa, Mycobacterium
SLMSFKPRYDNFIGGQWVAPNAGRY

SEQ ID NO: 1280546 - protein, 41 aa, Mycobacterium
SLNGSHPIRLFIGSGMPAGLWKRVVEVFEPANVVEFFATTD

SEQ ID NO: 1280547 - protein, 26 aa, Mycobacterium
SLNHDRFAAGLTRWTRSFEVGSSEAI

SEQ ID NO: 1280548 - protein, 29 aa, Mycobacterium
SLPAELIGPALEDWAKWGQARHDYFLRAA

SEQ ID NO: 1280549 - protein, 24 aa, Mycobacterium
SLPDARTTFFGEVVPGPFKWLDLH

SEQ ID NO: 1280550 - protein, 24 aa, Mycobacterium
SLPDVDGIFRWLTVGPPGQDDVSI

SEQ ID NO: 1280551 - protein, 23 aa, Mycobacterium
SLPGFGCVAAPIGAPGEAVAALS

SEQ ID NO: 1280552 - protein, 31 aa, Mycobacterium
SLPGMLMAAARLDLASVFLYAGSILPGRVKL

SEQ ID NO: 1280553 - protein, 24 aa, Mycobacterium
SLPIADLAIAAWVLDSVGMPHAEA

SEQ ID NO: 1280554 - protein, 18 aa, Mycobacterium
SLPIPAERAWHHAADLST

SEQ ID NO: 1280555 - protein, 23 aa, Mycobacterium
SLPKSRAAMHLDTVFTFCDHDLV

SEQ ID NO: 1280556 - protein, 18 aa, Mycobacterium
SLPLTVTEWDEWGNPLED

SEQ ID NO: 1280557 - protein, 27 aa, Mycobacterium
SLPMGSEALALLRLPLVLPALQVLGRV

SEQ ID NO: 1280558 - protein, 26 aa, Mycobacterium
SLPMGSEALALLRLPLVLPTLQVAGR

SEQ ID NO: 1280559 - protein, 21 aa, Mycobacterium
SLPRRVTSFIGRRQELAHIAA

SEQ ID NO: 1280560 - protein, 21 aa, Mycobacterium
SLQLGTGVAVAFARSPMTMAT

SEQ ID NO: 1280561 - protein, 23 aa, Mycobacterium
SLQNRPPLRIALAAPTGKAAARL

SEQ ID NO: 1280562 - protein, 22 aa, Mycobacterium
SLRAGADYGAIMAMPSSLPNFR

SEQ ID NO: 1280563 - protein, 28 aa, Mycobacterium
SLRAGLAKRQWFRPAVDMLVGLLACLRG

SEQ ID NO: 1280564 - protein, 27 aa, Mycobacterium
SLRFRPRVRAPFTRRSLARDGSPTGDN

SEQ ID NO: 1280565 - protein, 25 aa, Mycobacterium
SLRHAEILCALAFSPQGRSAPQLAE

SEQ ID NO: 1280566 - protein, 24 aa, Mycobacterium
SLRQEGMLALARLQRKMRLVESPY

SEQ ID NO: 1280567 - protein, 37 aa, Mycobacterium
SLRQSRLVGLLGQRSAAKMVPEWLWNSAAAVKRAFLQ

SEQ ID NO: 1280568 - protein, 23 aa, Mycobacterium
SLRRYRLWMRLMQAGAAVSSGTN

SEQ ID NO: 1280569 - protein, 18 aa, Mycobacterium
SLSDGRLVAADHISSPLP

SEQ ID NO: 1280570 - protein, 22 aa, Mycobacterium
SLSELRLGFEPAAAALAARRAS

SEQ ID NO: 1280571 - protein, 17 aa, Mycobacterium
SLSGLPLQPVSLADSAL

SEQ ID NO: 1280572 - protein, 18 aa, Mycobacterium
SLSGRRVFADGLDGPPDG

SEQ ID NO: 1280573 - protein, 27 aa, Mycobacterium
SLSGSVREACLWSRGLSDGGVRRRATL

SEQ ID NO: 1280574 - protein, 19 aa, Mycobacterium
SLSHFPVTIAAHLADDELT

SEQ ID NO: 1280575 - protein, 18 aa, Mycobacterium
SLSTLALLAKGFDVPVTS

SEQ ID NO: 1280576 - protein, 20 aa, Mycobacterium
SLTGVRVFFPDPWPKARHHK

SEQ ID NO: 1280577 - protein, 17 aa, Mycobacterium
SLTHWGTAGLQFINADY

SEQ ID NO: 1280578 - protein, 17 aa, Mycobacterium
SLTRLVLVQAGFPPPQT

SEQ ID NO: 1280579 - protein, 24 aa, Mycobacterium
SLVEIPIQWALDDWEQYCFLPDIS

SEQ ID NO: 1280580 - protein, 19 aa, Mycobacterium
SLVEQLRISAMSAVPTVYA

SEQ ID NO: 1280581 - protein, 29 aa, Mycobacterium
SLVFRHGVQLFGAMGFTWENDLQFALKRA

SEQ ID NO: 1280582 - protein, 24 aa, Mycobacterium
SLVGTAMLRYVMRVAPLAELPTED

SEQ ID NO: 1280583 - protein, 21 aa, Mycobacterium
SLVNLPNWLALTFRVDHGDWF

SEQ ID NO: 1280584 - protein, 17 aa, Mycobacterium
SLWQIYGVDRPALKDPP

SEQ ID NO: 1280585 - protein, 23 aa, Mycobacterium
SLYAAAGRYVLDRAIFDALRRIP

SEQ ID NO: 1280586 - protein, 26 aa, Mycobacterium
SLYVYARETVGFALSIDGRVHSPTSG

SEQ ID NO: 1280587 - protein, 24 aa, Mycobacterium
SMAEERRRCPADDIVTRLVQADID

SEQ ID NO: 1280588 - protein, 18 aa, Mycobacterium
SMARGSAGLHPLRLSPEL

SEQ ID NO: 1280589 - protein, 18 aa, Mycobacterium
SMCDAGYGRIVLTSSIGG

SEQ ID NO: 1280590 - protein, 23 aa, Mycobacterium
SMDQGRLAAYHAFGEPTQGMTEL

SEQ ID NO: 1280591 - protein, 22 aa, Mycobacterium
SMDTDWPLPLYDLARIASDRGD

SEQ ID NO: 1280592 - protein, 17 aa, Mycobacterium
SMDWLNFLVGIHKRLHV

SEQ ID NO: 1280593 - protein, 24 aa, Mycobacterium
SMEKLRKIPGWSHVYRVADRLGGT

SEQ ID NO: 1280594 - protein, 25 aa, Mycobacterium
SMEMLRLVEAFGYGWSDLERFTINA

SEQ ID NO: 1280595 - protein, 30 aa, Mycobacterium
SMESLYEYGSRAGLWRVLRVFERHDIPLTV

SEQ ID NO: 1280596 - protein, 26 aa, Mycobacterium
SMGDKWMLAETLAWQAYAALMGGGDP

SEQ ID NO: 1280597 - protein, 22 aa, Mycobacterium
SMGKPRYPTPTGQFTALEKQRY

SEQ ID NO: 1280598 - protein, 18 aa, Mycobacterium
SMGLELVGSAAINRDNAA

SEQ ID NO: 1280599 - protein, 30 aa, Mycobacterium
SMGLFGYAIPQEWGGLGLDLTQDVELAMEL

SEQ ID NO: 1280600 - protein, 23 aa, Mycobacterium
SMGTICHFSWVEMLQGKPYGKIA

SEQ ID NO: 1280601 - protein, 18 aa, Mycobacterium
SMKDTARVLGRMYDAIEY

SEQ ID NO: 1280602 - protein, 24 aa, Mycobacterium
SMLRNHARWAVFLRHLQYLVIDEC

SEQ ID NO: 1280603 - protein, 25 aa, Mycobacterium
SMLSDRLGRRFSRPAIVRIAEASGG

SEQ ID NO: 1280604 - protein, 24 aa, Mycobacterium
SMLTPPDWDRIGAAVLAAATSGAS

SEQ ID NO: 1280605 - protein, 18 aa, Mycobacterium
SMMIRLGTNHAYAVVETG

SEQ ID NO: 1280606 - protein, 24 aa, Mycobacterium
SMMMQAILAFWWPDLPRCTAAMSC

SEQ ID NO: 1280607 - protein, 18 aa, Mycobacterium
SMRDEITTLFGPELADIT

SEQ ID NO: 1280608 - protein, 21 aa, Mycobacterium
SMVAPAHGLDALSVEPVGNVW

SEQ ID NO: 1280609 - protein, 25 aa, Mycobacterium
SNAQIPVPAQWQWPQSIITDPERLR

SEQ ID NO: 1280610 - protein, 18 aa, Mycobacterium
SNATLWPLYHDVIVKPIY

SEQ ID NO: 1280611 - protein, 26 aa, Mycobacterium
SNDWNRWLDQFVHLLGHTGHYTREDA

SEQ ID NO: 1280612 - protein, 19 aa, Mycobacterium
SNDYREFRDVLVLLGASAG

SEQ ID NO: 1280613 - protein, 20 aa, Mycobacterium
SNEAAFLYQLLVRSFGTNNL

SEQ ID NO: 1280614 - protein, 17 aa, Mycobacterium
SNEWALEEICAVSPRYV

SEQ ID NO: 1280615 - protein, 26 aa, Mycobacterium
SNFALPVPRPAGYVIVGDTASLPAIN

SEQ ID NO: 1280616 - protein, 17 aa, Mycobacterium
SNFCAYIATGVWHHVLV

SEQ ID NO: 1280617 - protein, 23 aa, Mycobacterium
SNGPAVVEFNCRFGDPETQAVLA

SEQ ID NO: 1280618 - protein, 17 aa, Mycobacterium
SNHVLPTAGCARHSSGL

SEQ ID NO: 1280619 - protein, 23 aa, Mycobacterium
SNICTAQVLLAVMAAMYASYHGA

SEQ ID NO: 1280620 - protein, 25 aa, Mycobacterium
SNIPGEAPSNWCFFLGADDVDKTVA

SEQ ID NO: 1280621 - protein, 25 aa, Mycobacterium
SNISHEFRTPLTLILDPVSELRRAE

SEQ ID NO: 1280622 - protein, 18 aa, Mycobacterium
SNITGICDPHIQPRIDAA

SEQ ID NO: 1280623 - protein, 24 aa, Mycobacterium
SNKLIGGLVPRFQALAAELIDGFA

SEQ ID NO: 1280624 - protein, 17 aa, Mycobacterium
SNLGLIPAFQTIWDGVT

SEQ ID NO: 1280625 - protein, 18 aa, Mycobacterium
SNLLSRRDVVVVASVSCI

SEQ ID NO: 1280626 - protein, 18 aa, Mycobacterium
SNLPDWLLDSLCYALLVN

SEQ ID NO: 1280627 - protein, 22 aa, Mycobacterium
SNLPFSRWGQVFGEATIASAMI

SEQ ID NO: 1280628 - protein, 18 aa, Mycobacterium
SNLQPWRIYVLTGEPLAR

SEQ ID NO: 1280629 - protein, 21 aa, Mycobacterium
SNLRLGSGIADTRAMLAAGLR

SEQ ID NO: 1280630 - protein, 19 aa, Mycobacterium
SNPRFSVSRVDIDRGGPTY

SEQ ID NO: 1280631 - protein, 22 aa, Mycobacterium
SNPRLDIPRLLDLYGSGRLKLD

SEQ ID NO: 1280632 - protein, 21 aa, Mycobacterium
SNPRLDIPRMLELYGSGRLML

SEQ ID NO: 1280633 - protein, 18 aa, Mycobacterium
SNRDWWPNAVNLKMLQKD

SEQ ID NO: 1280634 - protein, 21 aa, Mycobacterium
SNRMISWPYTKLMNSNNMVDQ

SEQ ID NO: 1280635 - protein, 23 aa, Mycobacterium
SNRRLAMRVLRRRFRSSLRAGAD

SEQ ID NO: 1280636 - protein, 17 aa, Mycobacterium
SNTASYCNYKGWATYWS

SEQ ID NO: 1280637 - protein, 19 aa, Mycobacterium
SNTQLLWYRKSHAAAAGVD

SEQ ID NO: 1280638 - protein, 17 aa, Mycobacterium
SNWRATGTLDDELQRQS

SEQ ID NO: 1280639 - protein, 26 aa, Mycobacterium
SNYLYPRVEVEVGFILADDLPGAGCT

SEQ ID NO: 1280640 - protein, 37 aa, Mycobacterium; identical to SEQ ID NO: 104597

SEQ ID NO: 1280641 - protein, 20 aa, Mycobacterium
SPAADDWMCLLEAFDQPHRS

SEQ ID NO: 1280642 - protein, 27 aa, Mycobacterium
SPAALTRPDLAFDMVRPGIAVYGQTPI

SEQ ID NO: 1280643 - protein, 18 aa, Mycobacterium
SPAAVLTVRGRKQTLVDY

SEQ ID NO: 1280644 - protein, 24 aa, Mycobacterium
SPADMDLACMYDCFTYTVMATMEG

SEQ ID NO: 1280645 - protein, 22 aa, Mycobacterium
SPAEVLCLPYFLGEKSPIHDPD

SEQ ID NO: 1280646 - protein, 25 aa, Mycobacterium
SPAGDDWLCLLEAFDQPHRPGLVRA

SEQ ID NO: 1280647 - protein, 20 aa, Mycobacterium
SPAKTVRWFGDKAMSTQLAD

SEQ ID NO: 1280648 - protein, 19 aa, Mycobacterium
SPAPFYRAAGPEVEIFRAA

SEQ ID NO: 1280649 - protein, 31 aa, Mycobacterium
SPASGRPLAMPRLDMVTGLYFLTTEIEGDTG

SEQ ID NO: 1280650 - protein, 19 aa, Mycobacterium
SPATWRLIGDECARTGMTA

SEQ ID NO: 1280651 - protein, 29 aa, Mycobacterium
SPAVVAMVCELRRTYPRWGAQRIAHELAL

SEQ ID NO: 1280652 - protein, 21 aa, Mycobacterium
SPCGLADLCERTNLPRATAHR

SEQ ID NO: 1280653 - protein, 20 aa, Mycobacterium
SPDAMVWPLLDVIDGCITEP

SEQ ID NO: 1280654 - protein, 17 aa, Mycobacterium
SPDGRYAYLVMTPLPGW

SEQ ID NO: 1280655 - protein, 24 aa, Mycobacterium
SPDLPVKPPIPLTRPPGDEVPSPD

SEQ ID NO: 1280656 - protein, 22 aa, Mycobacterium
SPDSECRLLASVGMLLVERALN

SEQ ID NO: 1280657 - protein, 25 aa, Mycobacterium
SPDSGSTWLLPRLAGVTRAKRMLLL

SEQ ID NO: 1280658 - protein, 25 aa, Mycobacterium
SPDWDGSPHVRLWAKLEDRNPTGSI

SEQ ID NO: 1280659 - protein, 20 aa, Mycobacterium
SPEALVVLWAALRSGLYITA

SEQ ID NO: 1280660 - protein, 19 aa, Mycobacterium
SPEAVVIFVTNPVDVVTFA

SEQ ID NO: 1280661 - protein, 27 aa, Mycobacterium
SPEGGWIRTWLDTVLDLPWNVTTEDST

SEQ ID NO: 1280662 - protein, 19 aa, Mycobacterium
SPEGWPQRPTYSGWLDSPD

SEQ ID NO: 1280663 - protein, 18 aa, Mycobacterium
SPEGYKLKVQDAVRIDNS

SEQ ID NO: 1280664 - protein, 21 aa, Mycobacterium
SPEGYRRIVALGRELTSLRGH

SEQ ID NO: 1280665 - protein, 17 aa, Mycobacterium
SPEGYSWIDANDSTNNV

SEQ ID NO: 1280666 - protein, 23 aa, Mycobacterium
SPELLERCAQSLLGSDAVLGLAG

SEQ ID NO: 1280667 - protein, 24 aa, Mycobacterium
SPELYRRAAAHFGEVLYNLYGSTE

SEQ ID NO: 1280668 - protein, 18 aa, Mycobacterium
SPEPMLWGGELILRDGAV

SEQ ID NO: 1280669 - protein, 20 aa, Mycobacterium
SPEQRFVLLGGDHTIALPAL

SEQ ID NO: 1280670 - protein, 20 aa, Mycobacterium
SPEQRWTRHASAELTTAPGG

SEQ ID NO: 1280671 - protein, 21 aa, Mycobacterium
SPEVRIPVLSFAIDNVPAERV

SEQ ID NO: 1280672 - protein, 27 aa, Mycobacterium
SPGEYRFAAAYGRRGRIVGAVTFNHGK

SEQ ID NO: 1280673 - protein, 17 aa, Mycobacterium
SPGFTLYSLSGHVTTPG

SEQ ID NO: 1280674 - protein, 17 aa, Mycobacterium
SPGLPEFDPFWDACVKA

SEQ ID NO: 1280675 - protein, 26 aa, Mycobacterium
SPGPHALRTLVPVSMRSAGDFDVTDN

SEQ ID NO: 1280676 - protein, 18 aa, Mycobacterium
SPGVPLRIDLGVDTPQLL

SEQ ID NO: 1280677 - protein, 18 aa, Mycobacterium
SPGVYLFRGPTDEVLYVG

SEQ ID NO: 1280678 - protein, 20 aa, Mycobacterium
SPHCHEMFEAVLAGATDPEI

SEQ ID NO: 1280679 - protein, 18 aa, Mycobacterium
SPHGQWNFPGFKDAHRPE

SEQ ID NO: 1280680 - protein, 24 aa, Mycobacterium
SPHIPWNRLPVRIVDDPVPWTRSG

SEQ ID NO: 1280681 - protein, 28 aa, Mycobacterium
SPHSERLYCIPATIDLAGAEIELVSMVA

SEQ ID NO: 1280682 - protein, 17 aa, Mycobacterium
SPHVVAVGFTFDPTTHI

SEQ ID NO: 1280683 - protein, 24 aa, Mycobacterium
SPHYVYKLEWLAALRDTASSWLES

SEQ ID NO: 1280684 - protein, 19 aa, Mycobacterium
SPIGVEIIDILPAGEPTRC

SEQ ID NO: 1280685 - protein, 25 aa, Mycobacterium
SPILYLRLRKAVRRHGLQVLSVAAL

SEQ ID NO: 1280686 - protein, 19 aa, Mycobacterium
SPITATWDVTTKTLTLSGL

SEQ ID NO: 1280687 - protein, 20 aa, Mycobacterium
SPIVRPGDRVLAVAVTPEVD

SEQ ID NO: 1280688 - protein, 18 aa, Mycobacterium
SPIVRRGYVAAFTVDGDA

SEQ ID NO: 1280689 - protein, 21 aa, Mycobacterium
SPKKRLALRGQTHHRWCRECL

SEQ ID NO: 1280690 - protein, 25 aa, Mycobacterium
SPLAHPGLVCDVAIGQSTLVTQRVR

SEQ ID NO: 1280691 - protein, 27 aa, Mycobacterium
SPLATPIRMFERAVFDFGGSPQGRALS

SEQ ID NO: 1280692 - protein, 19 aa, Mycobacterium
SPLAVLAPRSPSDCFDIAV

SEQ ID NO: 1280693 - protein, 17 aa, Mycobacterium
SPLLAAAVRTVALGPQR

SEQ ID NO: 1280694 - protein, 20 aa, Mycobacterium
SPLLLLTWKLAAGLAAGCTF

SEQ ID NO: 1280695 - protein, 29 aa, Mycobacterium
SPLLRRPDLLVSLLTYWQRHPSLSYLFAG

SEQ ID NO: 1280696 - protein, 19 aa, Mycobacterium
SPLNVAVGLARLGRDVDFL

SEQ ID NO: 1280697 - protein, 22 aa, Mycobacterium
SPLPEAVSPVWKSMASGGSTGR

SEQ ID NO: 1280698 - protein, 20 aa, Mycobacterium
SPLPQRSSLYSGPRPTNPKS

SEQ ID NO: 1280699 - protein, 23 aa, Mycobacterium
SPLRDLAGWPALLRGKRSVTLDL

SEQ ID NO: 1280700 - protein, 18 aa, Mycobacterium
SPLRVYVMGRRGVDREPA

SEQ ID NO: 1280701 - protein, 22 aa, Mycobacterium
SPLSCAIGMTVLDVLRDEGLQD

SEQ ID NO: 1280702 - protein, 17 aa, Mycobacterium
SPMCYPDGEFLVGDRDV

SEQ ID NO: 1280703 - protein, 20 aa, Mycobacterium
SPNDPRIAAVDWVNVDDNGY

SEQ ID NO: 1280704 - protein, 17 aa, Mycobacterium
SPNPWFQSGHCALPGLF

SEQ ID NO: 1280705 - protein, 17 aa, Mycobacterium
SPNTDLPTLVASVAEAN

SEQ ID NO: 1280706 - protein, 24 aa, Mycobacterium
SPPERPLVGPLLWDLTAGTATDTT

SEQ ID NO: 1280707 - protein, 25 aa, Mycobacterium
SPQISRPLSCFCSHVPPVASAQPAA

SEQ ID NO: 1280708 - protein, 19 aa, Mycobacterium
SPQPLWALWRFSNQPEATR

SEQ ID NO: 1280709 - protein, 24 aa, Mycobacterium
SPQPRPLTTVDVARQYDGWADFPT

SEQ ID NO: 1280710 - protein, 17 aa, Mycobacterium
SPQWAAAICGLPADEIT

SEQ ID NO: 1280711 - protein, 24 aa, Mycobacterium
SPRETWLRLLLMKDFPRPTTQIPL

SEQ ID NO: 1280712 - protein, 25 aa, Mycobacterium
SPRKQWPSGLAKLGVDLSGRITDGP

SEQ ID NO: 1280713 - protein, 18 aa, Mycobacterium
SPSAFRIAASTVSSPPPA

SEQ ID NO: 1280714 - protein, 25 aa, Mycobacterium
SPSALWKLRGAVFGGRPESSPLDLI

SEQ ID NO: 1280715 - protein, 26 aa, Mycobacterium
SPSAYRGGLVPGFPNMFISSAPNYSP

SEQ ID NO: 1280716 - protein, 21 aa, Mycobacterium
SPSDFAKRMVGYAATVYARND

SEQ ID NO: 1280717 - protein, 20 aa, Mycobacterium
SPSGRGPCGWSISRSGPPCS

SEQ ID NO: 1280718 - protein, 20 aa, Mycobacterium
SPSIAAWACRNRSPRSASAA

SEQ ID NO: 1280719 - protein, 17 aa, Mycobacterium
SPSMVPAAVRMRPFSTK

SEQ ID NO: 1280720 - protein, 18 aa, Mycobacterium
SPTALVLAGGGALDDELM

SEQ ID NO: 1280721 - protein, 29 aa, Mycobacterium
SPTGAFLGLIGPGGLLIGNGVLPGQNGGL

SEQ ID NO: 1280722 - protein, 30 aa, Mycobacterium
SPTPSGLCSYPLRQCSDGDLYGGTEPARTW

SEQ ID NO: 1280723 - protein, 22 aa, Mycobacterium
SPTRRLGGGLVEIPRVPARDPL

SEQ ID NO: 1280724 - protein, 24 aa, Mycobacterium
SPTTLRFEPGITCVVGPNGSGKSN

SEQ ID NO: 1280725 - protein, 22 aa, Mycobacterium
SPVLRFGLAFCEASGPRLVRRS

SEQ ID NO: 1280726 - protein, 17 aa, Mycobacterium
SPVRMGVELIAVAEGAP

SEQ ID NO: 1280727 - protein, 26 aa, Mycobacterium
SPWRAPEYLQTLPLRRLTTPAEVARC

SEQ ID NO: 1280728 - protein, 24 aa, Mycobacterium
SPYPNQKWPIAYNVDDITKVYFRD

SEQ ID NO: 1280729 - protein, 24 aa, Mycobacterium
SPYWPESLGVLAIPIHYRGLHLHL

SEQ ID NO: 1280730 - protein, 19 aa, Mycobacterium
SPYYLRPGGAFGGSCLPKD

SEQ ID NO: 1280731 - protein, 18 aa, Mycobacterium
SQAGFTLWDSGISGHDAL

SEQ ID NO: 1280732 - protein, 25 aa, Mycobacterium
SQAHPYIRMWLERAAHAVEAGLRKG

SEQ ID NO: 1280733 - protein, 18 aa, Mycobacterium
SQALARGGQPVSMDQMQP

SEQ ID NO: 1280734 - protein, 19 aa, Mycobacterium
SQALPAWRSTDASLAPYNG

SEQ ID NO: 1280735 - protein, 19 aa, Mycobacterium
SQAVQWMWRHYGGGDPLPE

SEQ ID NO: 1280736 - protein, 18 aa, Mycobacterium
SQDGWSFLIDAFFHRGLM

SEQ ID NO: 1280737 - protein, 19 aa, Mycobacterium
SQELWGYSAPGEIIHHPYF

SEQ ID NO: 1280738 - protein, 26 aa, Mycobacterium
SQEMLRLVEAFGYGWSDLARFTINAM

SEQ ID NO: 1280739 - protein, 24 aa, Mycobacterium
SQGGRAVFVPVDFAAGPGTITDLV

SEQ ID NO: 1280740 - protein, 18 aa, Mycobacterium
SQGLRVVEMAHLLRPQGD

SEQ ID NO: 1280741 - protein, 26 aa, Mycobacterium
SQGVLFPKHRTDLIGCAVSVQRMLAG

SEQ ID NO: 1280742 - protein, 26 aa, Mycobacterium
SQGVLFPKHRTDLIGCAVTVQRMLAG

SEQ ID NO: 1280743 - protein, 24 aa, Mycobacterium
SQHGRCLWPGRSARSSPQRDTNVP

SEQ ID NO: 1280744 - protein, 25 aa, Mycobacterium
SQHLAKLRMARLVRTRREGTSVFYS

SEQ ID NO: 1280745 - protein, 25 aa, Mycobacterium
SQHLAKLRMARLVRTRREGTTIFYS

SEQ ID NO: 1280746 - protein, 17 aa, Mycobacterium
SQIDLNLGSVFQMSKPV

SEQ ID NO: 1280747 - protein, 30 aa, Mycobacterium
SQIVRPTFVPAYVVFPTFQAKKGSLNQAWV

SEQ ID NO: 1280748 - protein, 21 aa, Mycobacterium
SQLDLLVAIDFVQRESHRHAH

SEQ ID NO: 1280749 - protein, 19 aa, Mycobacterium
SQLFLGSGTMPWRRTVASG

SEQ ID NO: 1280750 - protein, 18 aa, Mycobacterium
SQLKPVFRPNGTITAGNA

SEQ ID NO: 1280751 - protein, 22 aa, Mycobacterium
SQLLELLRRGGFLIQDVIEQSE

SEQ ID NO: 1280752 - protein, 18 aa, Mycobacterium
SQLNHCAFCLDMHTRDAR

SEQ ID NO: 1280753 - protein, 24 aa, Mycobacterium
SQLNRFALLASRGVPLAFGSDTPV

SEQ ID NO: 1280754 - protein, 23 aa, Mycobacterium
SQLNSRLLRYFVKRYTLKRGALA

SEQ ID NO: 1280755 - protein, 22 aa, Mycobacterium
SQLPKVFFVNWFRRGDDGRFLW

SEQ ID NO: 1280756 - protein, 19 aa, Mycobacterium
SQLRRAGLVESDRRGMNVY

SEQ ID NO: 1280757 - protein, 24 aa, Mycobacterium
SQLYFEAWASLSTRSLQNRFKTAM

SEQ ID NO: 1280758 - protein, 17 aa, Mycobacterium
SQPDGLCNVFVPHATAG

SEQ ID NO: 1280759 - protein, 22 aa, Mycobacterium
SQPELKARHLALASASGDDEIF

SEQ ID NO: 1280760 - protein, 17 aa, Mycobacterium
SQPHSYAAGEWTEVDGD

SEQ ID NO: 1280761 - protein, 18 aa, Mycobacterium
SQQLWKPSPGSIYPTLQL

SEQ ID NO: 1280762 - protein, 19 aa, Mycobacterium
SQQRIGWIFNLADVVLAPT

SEQ ID NO: 1280763 - protein, 27 aa, Mycobacterium
SQREAWPVLRRNLSVLALRGADPRELL

SEQ ID NO: 1280764 - protein, 21 aa, Mycobacterium
SQRGVYCGAWSAYIPGEEHVY

SEQ ID NO: 1280765 - protein, 18 aa, Mycobacterium
SQRLHVVVAGKMRFGSLT

SEQ ID NO: 1280766 - protein, 25 aa, Mycobacterium
SQSRFALRNPRVITAVATITSAAIT

SEQ ID NO: 1280767 - protein, 19 aa, Mycobacterium
SQVAELLARIRAELPPLAG

SEQ ID NO: 1280768 - protein, 18 aa, Mycobacterium
SQVPLLLDEYSRNSATGS

SEQ ID NO: 1280769 - protein, 18 aa, Mycobacterium
SQVVRIAREFARNAEESG

SEQ ID NO: 1280770 - protein, 19 aa, Mycobacterium
SQWAPIVFGCQAPDTGNAE

SEQ ID NO: 1280771 - protein, 27 aa, Mycobacterium
SQWLTYSLLEPFDWAGVEVTGVGALTG

SEQ ID NO: 1280772 - protein, 28 aa, Mycobacterium
SQWPGMGGEAYRLLPVYRAEADRLTEAF

SEQ ID NO: 1280773 - protein, 24 aa, Mycobacterium
SRAAEVRLPLTWITLLHGRIGASL

SEQ ID NO: 1280774 - protein, 24 aa, Mycobacterium
SRAAGLKAANTWHATRAIQEAREA

SEQ ID NO: 1280775 - protein, 25 aa, Mycobacterium
SRAAKARFAVYIGDLGADTAATARE

SEQ ID NO: 1280776 - protein, 19 aa, Mycobacterium
SRAAPGYAAYAAAKAGVVN

SEQ ID NO: 1280777 - protein, 18 aa, Mycobacterium
SRAAVWTGQGVEVREVAV

SEQ ID NO: 1280778 - protein, 20 aa, Mycobacterium
SRAEFTSVMYQRAGAGMQIS

SEQ ID NO: 1280779 - protein, 17 aa, Mycobacterium
SRAGNLLGLDPPEHQRL

SEQ ID NO: 1280780 - protein, 22 aa, Mycobacterium
SRAGTVSGLYVCEMVTARALVE

SEQ ID NO: 1280781 - protein, 22 aa, Mycobacterium
SRALDLLAVVGLGDRAEHRPSE

SEQ ID NO: 1280782 - protein, 17 aa, Mycobacterium
SRALLRPLGERAFARLM

SEQ ID NO: 1280783 - protein, 17 aa, Mycobacterium
SRALPFRIVGAHTDSPN

SEQ ID NO: 1280784 - protein, 32 aa, Mycobacterium; identical to SEQ ID NO: 733558

SEQ ID NO: 1280785 - protein, 21 aa, Mycobacterium
SRALTRLRLDVSYDGTDFAGW

SEQ ID NO: 1280786 - protein, 20 aa, Mycobacterium
SRAPLREALRRLAQQGLVEH

SEQ ID NO: 1280787 - protein, 25 aa, Mycobacterium
SRAPWRLKQNYLMDLQLIRRGKVDD

SEQ ID NO: 1280788 - protein, 18 aa, Mycobacterium
SRARAVAALDEVADGADV

SEQ ID NO: 1280789 - protein, 26 aa, Mycobacterium
SRARRIGADLAHRVRLARPRDETSIA

SEQ ID NO: 1280790 - protein, 21 aa, Mycobacterium
SRARSRYSWDRIATDAEVVYA

SEQ ID NO: 1280791 - protein, 20 aa, Mycobacterium
SRAYCGGRVDAARTELHPRI

SEQ ID NO: 1280792 - protein, 19 aa, Mycobacterium
SRDAISLVFSVPGEHRDRF

SEQ ID NO: 1280793 - protein, 18 aa, Mycobacterium
SRDGAWGTWVGQWTAEEG

SEQ ID NO: 1280794 - protein, 23 aa, Mycobacterium
SRDLSSLELVWWAGQLPESTARK

SEQ ID NO: 1280795 - protein, 23 aa, Mycobacterium
SREDLLRFARPVIHQLLLDPLTD

SEQ ID NO: 1280796 - protein, 24 aa, Mycobacterium
SRELLRHRCVDLLGPAPSGRETRI

SEQ ID NO: 1280797 - protein, 24 aa, Mycobacterium
SRERADAFVARFPQIAFVDVEGAG

SEQ ID NO: 1280798 - protein, 19 aa, Mycobacterium
SRESVRLAFIAALQHLPPR

SEQ ID NO: 1280799 - protein, 19 aa, Mycobacterium
SREVLRYLLDGGIAGKRIA

SEQ ID NO: 1280800 - protein, 18 aa, Mycobacterium
SREYGQFFEVLGLLDAND

SEQ ID NO: 1280801 - protein, 22 aa, Mycobacterium
SREYPWYGSFMIETLPELTAQD

SEQ ID NO: 1280802 - protein, 19 aa, Mycobacterium
SRFAAPRRIFLGSTAARIL

SEQ ID NO: 1280803 - protein, 28 aa, Mycobacterium
SRFAPPSPKGCVFEYVYLARPDSTIVGR

SEQ ID NO: 1280804 - protein, 18 aa, Mycobacterium
SRFLVSIPTPFNAVNSFA

SEQ ID NO: 1280805 - protein, 23 aa, Mycobacterium
SRFNVPAQLLAPIPDGIGAVDAA

SEQ ID NO: 1280806 - protein, 19 aa, Mycobacterium
SRFRDTLGYEATWSVADGA

SEQ ID NO: 1280807 - protein, 17 aa, Mycobacterium
SRFRRGGIESMSEYRRR

SEQ ID NO: 1280808 - protein, 17 aa, Mycobacterium
SRFSRKQLVLAMSGEDD

SEQ ID NO: 1280809 - protein, 19 aa, Mycobacterium
SRGGFHPDDWDSAEILECW

SEQ ID NO: 1280810 - protein, 26 aa, Mycobacterium
SRGGGRYSVYPWALLVMALARVGLGP

SEQ ID NO: 1280811 - protein, 28 aa, Mycobacterium
SRGGSSIGVSRVTAWDALPAAIELARRH

SEQ ID NO: 1280812 - protein, 19 aa, Mycobacterium
SRGHLCPKGASLGQLHDDP

SEQ ID NO: 1280813 - protein, 29 aa, Mycobacterium
SRGIGAEIVRRLAFEGAAVAFTYGSSVSD

SEQ ID NO: 1280814 - protein, 26 aa, Mycobacterium
SRGILTSGFGARWGTLHAGLDIANAV

SEQ ID NO: 1280815 - protein, 20 aa, Mycobacterium
SRGLGKWERRLLGSVSSGVV

SEQ ID NO: 1280816 - protein, 19 aa, Mycobacterium
SRGLGVVVSFAGAVFEALG

SEQ ID NO: 1280817 - protein, 27 aa, Mycobacterium
SRGPSAGWRKWLYWGSGRLIDVGESPK

SEQ ID NO: 1280818 - protein, 20 aa, Mycobacterium
SRGQVWLMPHNPAFEPIPGN

SEQ ID NO: 1280819 - protein, 25 aa, Mycobacterium
SRGTLQYRVLRAFRRAGIDAGRARG

SEQ ID NO: 1280820 - protein, 21 aa, Mycobacterium
SRGVLPSRLRLLYLADGQVLD

SEQ ID NO: 1280821 - protein, 25 aa, Mycobacterium
SRHLVKFVDCDGALWAVKELPPRIA

SEQ ID NO: 1280822 - protein, 18 aa, Mycobacterium
SRHPRAWRALRGVLERNL

SEQ ID NO: 1280823 - protein, 20 aa, Mycobacterium
SRHYWGLPFGGWKSSGVGSE

SEQ ID NO: 1280824 - protein, 20 aa, Mycobacterium
SRIADWRISIADTIADNASS

SEQ ID NO: 1280825 - protein, 20 aa, Mycobacterium
SRIIGSPGYPAAEERLRADA

SEQ ID NO: 1280826 - protein, 22 aa, Mycobacterium
SRIKEIVILSVGGQWGSGYEVY

SEQ ID NO: 1280827 - protein, 22 aa, Mycobacterium
SRIKLGQMCTAMSYRNPVYLAK

SEQ ID NO: 1280828 - protein, 20 aa, Mycobacterium
SRIPASDFRFSRFAEDDPLK

SEQ ID NO: 1280829 - protein, 18 aa, Mycobacterium
SRIPDFELAPGYVPEITW

SEQ ID NO: 1280830 - protein, 20 aa, Mycobacterium
SRIPIAMAARNTVWRDGEPV

SEQ ID NO: 1280831 - protein, 25 aa, Mycobacterium
SRKAAVRYKLAFDKYVAEQGYDDVA

SEQ ID NO: 1280832 - protein, 21 aa, Mycobacterium
SRKLFRVCLDDAPGQVVGVSD

SEQ ID NO: 1280833 - protein, 17 aa, Mycobacterium
SRKPPLFGINPDARVTA

SEQ ID NO: 1280834 - protein, 24 aa, Mycobacterium
SRLAEATGLFHLRVVQLSGNATLS

SEQ ID NO: 1280835 - protein, 17 aa, Mycobacterium
SRLAGPVSIGCYSTLAA

SEQ ID NO: 1280836 - protein, 21 aa, Mycobacterium
SRLCSACFDGDYPIELPGETA

SEQ ID NO: 1280837 - protein, 28 aa, Mycobacterium
SRLDIEIRDGWLIKVWPGVYSRDEPDTM

SEQ ID NO: 1280838 - protein, 17 aa, Mycobacterium
SRLERHQDWFVGERFDV

SEQ ID NO: 1280839 - protein, 18 aa, Mycobacterium
SRLFTPRAIAGMEDRLAD

SEQ ID NO: 1280840 - protein, 21 aa, Mycobacterium
SRLGLWPSDIRVLSTLVRHHL

SEQ ID NO: 1280841 - protein, 19 aa, Mycobacterium
SRLGVVCGPIRVRVAHRSR

SEQ ID NO: 1280842 - protein, 17 aa, Mycobacterium
SRLLIDGKLVAGSSGTF

SEQ ID NO: 1280843 - protein, 18 aa, Mycobacterium
SRLLLARVELSWTRRWFA

SEQ ID NO: 1280844 - protein, 20 aa, Mycobacterium
SRLPSCRALAAEFGSNSSTV

SEQ ID NO: 1280845 - protein, 17 aa, Mycobacterium
SRLRRVWWGAAPASTTL

SEQ ID NO: 1280846 - protein, 17 aa, Mycobacterium
SRLTVTVGIGPHVFDRI

SEQ ID NO: 1280847 - protein, 19 aa, Mycobacterium
SRLVPRKGQDMLIRAMPAI

SEQ ID NO: 1280848 - protein, 21 aa, Mycobacterium
SRLVRELAAIAIRRNVAVFTS

SEQ ID NO: 1280849 - protein, 25 aa, Mycobacterium
SRMNFSLDGLRVFPYKEAAERTIDH

SEQ ID NO: 1280850 - protein, 21 aa, Mycobacterium
SRMPEKLLIRLNIAHSDTCLD

SEQ ID NO: 1280851 - protein, 20 aa, Mycobacterium
SRNLARRGSIILSLHPHNDR

SEQ ID NO: 1280852 - protein, 20 aa, Mycobacterium
SRPDLWAHWEDPFGEWHEDP

SEQ ID NO: 1280853 - protein, 26 aa, Mycobacterium
SRPDRTLDCRWWRRDLGGKMVRFVVC

SEQ ID NO: 1280854 - protein, 21 aa, Mycobacterium
SRPEALAGLVDDATIRWMLDE

SEQ ID NO: 1280855 - protein, 31 aa, Mycobacterium
SRPELGFRLLQRLGADVAEYGFIETSAKQDG

SEQ ID NO: 1280856 - protein, 19 aa, Mycobacterium
SRPKPMVDIGGRPILWHIM

SEQ ID NO: 1280857 - protein, 20 aa, Mycobacterium
SRPLWTATLIEGVENGRAAL

SEQ ID NO: 1280858 - protein, 22 aa, Mycobacterium
SRPPGSGGGAVFTELMTADYSQ

SEQ ID NO: 1280859 - protein, 21 aa, Mycobacterium
SRPRAGTLVVPRPAGNTYAQD

SEQ ID NO: 1280860 - protein, 20 aa, Mycobacterium
SRPRAGTLVVPRPSTNSYAQ

SEQ ID NO: 1280861 - protein, 32 aa, Mycobacterium
SRPRIHDLRHTFAIRTLIGWYRGGEDVEARLP

SEQ ID NO: 1280862 - protein, 18 aa, Mycobacterium
SRPRSRVLHPIWEWDGTD

SEQ ID NO: 1280863 - protein, 23 aa, Mycobacterium
SRPSDFPKNGWVVQALQAAWSAI

SEQ ID NO: 1280864 - protein, 29 aa, Mycobacterium
SRPSRWFVRRSCCPPCCVVVRTGSCPVLV

SEQ ID NO: 1280865 - protein, 23 aa, Mycobacterium
SRQECLALIAAGVDDWGGVSPLT

SEQ ID NO: 1280866 - protein, 21 aa, Mycobacterium
SRQHAATAFLALPANLHRVIG

SEQ ID NO: 1280867 - protein, 21 aa, Mycobacterium
SRQLLAAQIIWTLNRAGINGP

SEQ ID NO: 1280868 - protein, 20 aa, Mycobacterium
SRQQRGKWAYYRIQRDALDR

SEQ ID NO: 1280869 - protein, 18 aa, Mycobacterium
SRQRTARMSKRDWIEVRD

SEQ ID NO: 1280870 - protein, 21 aa, Mycobacterium
SRQRVPGLLVERIDGAPVLEA

SEQ ID NO: 1280871 - protein, 23 aa, Mycobacterium
SRQRVYRQPGFVNAMRDIMALQD

SEQ ID NO: 1280872 - protein, 20 aa, Mycobacterium
SRQYEWLRWELESPEFRDAR

SEQ ID NO: 1280873 - protein, 17 aa, Mycobacterium
SRRCGMVGRGDKSPMVS

SEQ ID NO: 1280874 - protein, 27 aa, Mycobacterium
SRRCLVPMDGWYEWRPNPAEGGKKKAA

SEQ ID NO: 1280875 - protein, 17 aa, Mycobacterium
SRREALLQEAIRLFAER

SEQ ID NO: 1280876 - protein, 19 aa, Mycobacterium
SRRRALLFMRADPLAHFVS

SEQ ID NO: 1280877 - protein, 19 aa, Mycobacterium
SRRRIAFYRSLLGEIDDPA

SEQ ID NO: 1280878 - protein, 21 aa, Mycobacterium
SRRVLAKVGFREEGLLKRYLD

SEQ ID NO: 1280879 - protein, 18 aa, Mycobacterium
SRRVRARLARRMTSQRST

SEQ ID NO: 1280880 - protein, 19 aa, Mycobacterium
SRRYAIDRIVGRDGLSLFE

SEQ ID NO: 1280881 - protein, 21 aa, Mycobacterium
SRSEALIAELVREEGKTVAEA

SEQ ID NO: 1280882 - protein, 22 aa, Mycobacterium
SRSGYCTVTARYDRAAITDPDL

SEQ ID NO: 1280883 - protein, 20 aa, Mycobacterium
SRSLHGSADFHALEYRHGRV

SEQ ID NO: 1280884 - protein, 21 aa, Mycobacterium
SRSPGKVWAWQTRSWSNGQIY

SEQ ID NO: 1280885 - protein, 23 aa, Mycobacterium
SRSRIDDALSRLGVRRLDAVTPV

SEQ ID NO: 1280886 - protein, 21 aa, Mycobacterium
SRSRLGGSASRVTRTGKTLRF

SEQ ID NO: 1280887 - protein, 18 aa, Mycobacterium
SRSRPPTAVFCHSDEIAL

SEQ ID NO: 1280888 - protein, 17 aa, Mycobacterium
SRSRWRRTLGANVAANI

SEQ ID NO: 1280889 - protein, 17 aa, Mycobacterium
SRTDAWHQLGQQVGHAM

SEQ ID NO: 1280890 - protein, 21 aa, Mycobacterium
SRTFIPRAFWQTYPQHRDRLL

SEQ ID NO: 1280891 - protein, 23 aa, Mycobacterium
SRTIRLPVHLVEQVNKLARIKRE

SEQ ID NO: 1280892 - protein, 17 aa, Mycobacterium
SRTKLALMDLAPYTEWT

SEQ ID NO: 1280893 - protein, 23 aa, Mycobacterium
SRTREFRITDRMSINGKPMDHAR

SEQ ID NO: 1280894 - protein, 20 aa, Mycobacterium
SRVAKAALISAVPPLMVRTE

SEQ ID NO: 1280895 - protein, 19 aa, Mycobacterium
SRVNVPVQFLAPVPEGISA

SEQ ID NO: 1280896 - protein, 17 aa, Mycobacterium
SRVPPAIGYPLGAQEGD

SEQ ID NO: 1280897 - protein, 20 aa, Mycobacterium
SRVPSAIGLPLGAEDGDVNM

SEQ ID NO: 1280898 - protein, 19 aa, Mycobacterium
SRVQALGYLFFVGDRTRTD

SEQ ID NO: 1280899 - protein, 18 aa, Mycobacterium
SRVRLTVDLTDMAEAADG

SEQ ID NO: 1280900 - protein, 17 aa, Mycobacterium
SRVRSGDRATLWLDAER

SEQ ID NO: 1280901 - protein, 17 aa, Mycobacterium
SRVSDWAELPAAIEAAR

SEQ ID NO: 1280902 - protein, 24 aa, Mycobacterium
SRVTGDLLAGMWQLIARDIGGVPR

SEQ ID NO: 1280903 - protein, 17 aa, Mycobacterium
SRVTGWLTPEARAHWDL

SEQ ID NO: 1280904 - protein, 18 aa, Mycobacterium
SRVTRQIHRLEVQGLVSR

SEQ ID NO: 1280905 - protein, 19 aa, Mycobacterium
SRVVLINRCGHWLQTEHSD

SEQ ID NO: 1280906 - protein, 19 aa, Mycobacterium
SRVWRFDRMATVCHPESGK

SEQ ID NO: 1280907 - protein, 19 aa, Mycobacterium
SRWPELREAFTKAFAAHDR

SEQ ID NO: 1280908 - protein, 22 aa, Mycobacterium
SRWTREMFCLMEGRHVHPSTLY

SEQ ID NO: 1280909 - protein, 18 aa, Mycobacterium
SRYTVHWKVGSVPIGGVV

SEQ ID NO: 1280910 - protein, 18 aa, Mycobacterium
SRYWIIDDIRPALIDTNV

SEQ ID NO: 1280911 - protein, 26 aa, Mycobacterium
SSAAYLRATFDWHIDGCTPTGDDYPQ

SEQ ID NO: 1280912 - protein, 17 aa, Mycobacterium
SSACLRDARERYAPVSV

SEQ ID NO: 1280913 - protein, 20 aa, Mycobacterium
SSADALRWGLINQVAPDGAV

SEQ ID NO: 1280914 - protein, 20 aa, Mycobacterium
SSADALRWGLINQVVPDGTV

SEQ ID NO: 1280915 - protein, 26 aa, Mycobacterium
SSAEAFCTRVGFGGAKQHKLQKLLSD

SEQ ID NO: 1280916 - protein, 19 aa, Mycobacterium
SSAEVVASMLLEFNDRLME

SEQ ID NO: 1280917 - protein, 20 aa, Mycobacterium
SSAPALVLVSWPERGPLLGV

SEQ ID NO: 1280918 - protein, 18 aa, Mycobacterium
SSAPDWLGRGTIVHKSGT

SEQ ID NO: 1280919 - protein, 24 aa, Mycobacterium
SSAPPGDLWQSGATFPAHPDPDGS

SEQ ID NO: 1280920 - protein, 18 aa, Mycobacterium
SSARGMLFYRLLQQSVNT

SEQ ID NO: 1280921 - protein, 23 aa, Mycobacterium
SSARNRFAGLVTDVVSDTVMSQV

SEQ ID NO: 1280922 - protein, 17 aa, Mycobacterium
SSAYPQIPGGQWLGFAP

SEQ ID NO: 1280923 - protein, 19 aa, Mycobacterium
SSCNTTFAELASRMPPRGL

SEQ ID NO: 1280924 - protein, 20 aa, Mycobacterium
SSDLPWHRVIGASGRPAPHL

SEQ ID NO: 1280925 - protein, 19 aa, Mycobacterium
SSDPAWRYLNIRRLFNYLE

SEQ ID NO: 1280926 - protein, 20 aa, Mycobacterium
SSDRHVRRLAQLVTELEAVE

SEQ ID NO: 1280927 - protein, 18 aa, Mycobacterium
SSEARWVKGNPSSASAVI

SEQ ID NO: 1280928 - protein, 24 aa, Mycobacterium
SSEPGCPPKTWCVKNVSGYGGQMT

SEQ ID NO: 1280929 - protein, 29 aa, Mycobacterium
SSFGAELLAALGLHRVWDRADAVMSSAVA

SEQ ID NO: 1280930 - protein, 18 aa, Mycobacterium
SSFLSPLINRRRDEYGGD

SEQ ID NO: 1280931 - protein, 17 aa, Mycobacterium
SSFSEIAKVADWYAERG

SEQ ID NO: 1280932 - protein, 22 aa, Mycobacterium
SSFSGRLWGAPELLQSSNALEL

SEQ ID NO: 1280933 - protein, 19 aa, Mycobacterium
SSFYSDWYKPACGKAGCST

SEQ ID NO: 1280934 - protein, 17 aa, Mycobacterium
SSGASWAPRLPTYGGND

SEQ ID NO: 1280935 - protein, 22 aa, Mycobacterium
SSGDACRVPWASAAQAGQGATA

SEQ ID NO: 1280936 - protein, 21 aa, Mycobacterium
SSGEARVLVATDIAARGVHVD

SEQ ID NO: 1280937 - protein, 17 aa, Mycobacterium
SSGMAATDCVLRAVLRP

SEQ ID NO: 1280938 - protein, 24 aa, Mycobacterium
SSGPDHACSLCARLWEVNSTTISD

SEQ ID NO: 1280939 - protein, 26 aa, Mycobacterium
SSGRTYRGTKEFIFLGLLSLPHNEDG

SEQ ID NO: 1280940 - protein, 19 aa, Mycobacterium
SSHRPRALTLLGDYLDELD

SEQ ID NO: 1280941 - protein, 17 aa, Mycobacterium
SSIALRAALSGRLAAAG

SEQ ID NO: 1280942 - protein, 20 aa, Mycobacterium
SSILGLTAVPGWGLYCAGKF

SEQ ID NO: 1280943 - protein, 23 aa, Mycobacterium
SSIPTVQALIRWDPVGHAESELA

SEQ ID NO: 1280944 - protein, 27 aa, Mycobacterium
SSIRADDGWENFGLYSASKAAVRSLAR

SEQ ID NO: 1280945 - protein, 18 aa, Mycobacterium
SSIRCMGKGRKRRAVPLT

SEQ ID NO: 1280946 - protein, 19 aa, Mycobacterium
SSIVELRCTLPVAEAERRI

SEQ ID NO: 1280947 - protein, 20 aa, Mycobacterium
SSKFRFLVTPVRIVCANTQS

SEQ ID NO: 1280948 - protein, 26 aa, Mycobacterium
SSKKWGRRANVEMVRLSYGRFGDDLA

SEQ ID NO: 1280949 - protein, 18 aa, Mycobacterium
SSKPACAADIIFRYYPET

SEQ ID NO: 1280950 - protein, 28 aa, Mycobacterium
SSLASFEGQLGKWARMDAEIIAEHAEGI

SEQ ID NO: 1280951 - protein, 19 aa, Mycobacterium
SSLDFTIGRRQVVRAEASS

SEQ ID NO: 1280952 - protein, 21 aa, Mycobacterium
SSLERFGFAVADDGTVTPEQW

SEQ ID NO: 1280953 - protein, 27 aa, Mycobacterium
SSLIRPAYSRVLLKLGGEMFGGGQVGL

SEQ ID NO: 1280954 - protein, 19 aa, Mycobacterium
SSLKLELEVDFDLHGFLGL

SEQ ID NO: 1280955 - protein, 20 aa, Mycobacterium
SSLMPLRYEGGVWWVRAHLT

SEQ ID NO: 1280956 - protein, 19 aa, Mycobacterium
SSLQTSRMAFHAIKAGEGH

SEQ ID NO: 1280957 - protein, 18 aa, Mycobacterium
SSLQTTRMAFHAIKAGEG

SEQ ID NO: 1280958 - protein, 22 aa, Mycobacterium
SSLSGIVLFPGLVSYSASKAAL

SEQ ID NO: 1280959 - protein, 20 aa, Mycobacterium
SSLTALGAAQTWFAKADPKF

SEQ ID NO: 1280960 - protein, 28 aa, Mycobacterium
SSLTVYSGYRFVRHAAATGKPVAIINRG

SEQ ID NO: 1280961 - protein, 19 aa, Mycobacterium
SSLVSIHLACHSLRMRESD

SEQ ID NO: 1280962 - protein, 19 aa, Mycobacterium
SSMFMTWQRTVGGRMKSDP

SEQ ID NO: 1280963 - protein, 18 aa, Mycobacterium
SSNTHRWFGAYGPSKAAL

SEQ ID NO: 1280964 - protein, 25 aa, Mycobacterium
SSPDPLLVVFLLFDVMRDALRERVV

SEQ ID NO: 1280965 - protein, 21 aa, Mycobacterium
SSPEQVRWVLEDSGAVLAFVE

SEQ ID NO: 1280966 - protein, 17 aa, Mycobacterium
SSPRPGEQILVTRKPLG

SEQ ID NO: 1280967 - protein, 23 aa, Mycobacterium
SSPRVLSDLFWIGRYAERAEHMA

SEQ ID NO: 1280968 - protein, 17 aa, Mycobacterium
SSPSPALLARFLHEKRG

SEQ ID NO: 1280969 - protein, 17 aa, Mycobacterium
SSPTAVRVWELAGVSPP

SEQ ID NO: 1280970 - protein, 17 aa, Mycobacterium
SSPTHWNKNVFDMGEVG

SEQ ID NO: 1280971 - protein, 20 aa, Mycobacterium
SSPTLRQAAVGYRAGPVDAV

SEQ ID NO: 1280972 - protein, 23 aa, Mycobacterium
SSPYVTPLVRKLAGEHSVDLASV

SEQ ID NO: 1280973 - protein, 29 aa, Mycobacterium
SSQAGCGMACPFCATGQGGLKRNLSTAEI

SEQ ID NO: 1280974 - protein, 21 aa, Mycobacterium
SSQPALEWAAAEAKLRNIPLV

SEQ ID NO: 1280975 - protein, 20 aa, Mycobacterium
SSQPEPRPPRFLDELQEAVI

SEQ ID NO: 1280976 - protein, 22 aa, Mycobacterium
SSQYFWAPPAVKTMPAPLRPIS

SEQ ID NO: 1280977 - protein, 19 aa, Mycobacterium
SSRGYRAMSGIPRLQFAHV

SEQ ID NO: 1280978 - protein, 19 aa, Mycobacterium
SSRLGVLRLREDVFPQLTN

SEQ ID NO: 1280979 - protein, 22 aa, Mycobacterium
SSRLPEPGLRIIAPDLPGYGWS

SEQ ID NO: 1280980 - protein, 21 aa, Mycobacterium
SSSGPRLAGLIDMPEGPTRGW

SEQ ID NO: 1280981 - protein, 17 aa, Mycobacterium
SSSKGRYLKKVVVSTTT

SEQ ID NO: 1280982 - protein, 20 aa, Mycobacterium
SSSLVAIHLACQSLRSGDSE

SEQ ID NO: 1280983 - protein, 19 aa, Mycobacterium
SSSLVSIHLACQSLRRGES

SEQ ID NO: 1280984 - protein, 25 aa, Mycobacterium
SSSVNDLTKWLAMVLADGKAGGQQL

SEQ ID NO: 1280985 - protein, 18 aa, Mycobacterium
SSTIAYEAIHEYIRRNSS

SEQ ID NO: 1280986 - protein, 24 aa, Mycobacterium
SSTPRYDVAFTEPWGSDPFGNTTV

SEQ ID NO: 1280987 - protein, 28 aa, Mycobacterium
SSVARFYDRPGIVYVPICDRPPSHTALA

SEQ ID NO: 1280988 - protein, 18 aa, Mycobacterium
SSVGLDFADGHLRTTATP

SEQ ID NO: 1280989 - protein, 24 aa, Mycobacterium
SSVGQFLAWAIAKIMAGVVATARG

SEQ ID NO: 1280990 - protein, 27 aa, Mycobacterium
SSVLSMMMWAFRGMGMWSDERGTNMLD

SEQ ID NO: 1280991 - protein, 17 aa, Mycobacterium
SSVRYSTPFGGFKQSGL

SEQ ID NO: 1280992 - protein, 17 aa, Mycobacterium
SSWDAPWTIDANVAALA

SEQ ID NO: 1280993 - protein, 24 aa, Mycobacterium
SSWLYRIVVNACLDRLRRNRSRAC

SEQ ID NO: 1280994 - protein, 24 aa, Mycobacterium
SSYRYLVTQLKALQFLRGGRRWIL

SEQ ID NO: 1280995 - protein, 17 aa, Mycobacterium
STADGWVAFHLAETAPL

SEQ ID NO: 1280996 - protein, 19 aa, Mycobacterium
STADRPAVIVIDDIPDTAA

SEQ ID NO: 1280997 - protein, 24 aa, Mycobacterium
STAGLKIVPTMGVYAATKNAVRTM

SEQ ID NO: 1280998 - protein, 18 aa, Mycobacterium
STAGWVLGTAALGFAKSV

SEQ ID NO: 1280999 - protein, 23 aa, Mycobacterium
STAHRLLAMLSYRGLIRQDPKTK

SEQ ID NO: 1281000 - protein, 20 aa, Mycobacterium
STAVLLRWLTDPSSRDFDLS

SEQ ID NO: 1281001 - protein, 19 aa, Mycobacterium
STCHDRGFLFFTTHVSDPL

SEQ ID NO: 1281002 - protein, 32 aa, Mycobacterium
STDLLYKLLRSEWLEPRWMIGIDPQSEGLARA

SEQ ID NO: 1281003 - protein, 26 aa, Mycobacterium
STDPITVFPAEWIKAGRRRTREAQAA

SEQ ID NO: 1281004 - protein, 23 aa, Mycobacterium
STEDLRLLGVHIFGTSATEMVHI

SEQ ID NO: 1281005 - protein, 24 aa, Mycobacterium
STEFAELRPRIVYDRDTGTLTSRP

SEQ ID NO: 1281006 - protein, 21 aa, Mycobacterium
STEVPVVVLLWSPRSDSSVQL

SEQ ID NO: 1281007 - protein, 19 aa, Mycobacterium
STFAVGARLGRPVDATSDV

SEQ ID NO: 1281008 - protein, 18 aa, Mycobacterium
STFGARWAGFARASLFPA

SEQ ID NO: 1281009 - protein, 21 aa, Mycobacterium
STFRHCSFLGSTFTECRLRPL

SEQ ID NO: 1281010 - protein, 21 aa, Mycobacterium
STFRYAAPAGTDWTVADLAGR

SEQ ID NO: 1281011 - protein, 22 aa, Mycobacterium
STFSEALIRLAGKRRDIVAITA

SEQ ID NO: 1281012 - protein, 23 aa, Mycobacterium
STGESRLLFRPMPHLDPEQLAPM

SEQ ID NO: 1281013 - protein, 17 aa, Mycobacterium
STGGALSIIANRVSYYF

SEQ ID NO: 1281014 - protein, 23 aa, Mycobacterium
STGGRIGHRIPLPGVAPSLLLHT

SEQ ID NO: 1281015 - protein, 24 aa, Mycobacterium
STGGRPAALLSFNADAGVVLTAAV

SEQ ID NO: 1281016 - protein, 19 aa, Mycobacterium
STGSSALWLARQAIESGAA

SEQ ID NO: 1281017 - protein, 21 aa, Mycobacterium
STGWFGSSEARWVKGNPSSAS

SEQ ID NO: 1281018 - protein, 17 aa, Mycobacterium
STIALGILHRLSATAAR

SEQ ID NO: 1281019 - protein, 17 aa, Mycobacterium
STISDAQQATWDRLWPE

SEQ ID NO: 1281020 - protein, 22 aa, Mycobacterium
STKDMRDAFAFNVATAHALTTA

SEQ ID NO: 1281021 - protein, 28 aa, Mycobacterium
STKVYRNGVPFRRVNLTTGEHLDLYDTS

SEQ ID NO: 1281022 - protein, 17 aa, Mycobacterium
STLADFDYHACAEAAVD

SEQ ID NO: 1281023 - protein, 23 aa, Mycobacterium
STLAEALHALWLDASSDPSRRES

SEQ ID NO: 1281024 - protein, 18 aa, Mycobacterium
STLARPINFGRPAAGIAE

SEQ ID NO: 1281025 - protein, 23 aa, Mycobacterium
STLFPGGEGRLLLTDPSDMLTTG

SEQ ID NO: 1281026 - protein, 38 aa, Mycobacterium
STLGLDFMRSCSIKHQLPSVIFSLEMSKSEIVMRLLSA

SEQ ID NO: 1281027 - protein, 17 aa, Mycobacterium
STLGSIALHSVRLIEPQ

SEQ ID NO: 1281028 - protein, 20 aa, Mycobacterium
STLGTAWPGDVIGLANAAAL

SEQ ID NO: 1281029 - protein, 20 aa, Mycobacterium
STLHHAGWYAPMPAPGRANV

SEQ ID NO: 1281030 - protein, 29 aa, Mycobacterium
STLIPARFDPADCGVRVHGDRSLLPDAFA

SEQ ID NO: 1281031 - protein, 25 aa, Mycobacterium
STLLGFCAAVTFPTSGTVRILGEQM

SEQ ID NO: 1281032 - protein, 20 aa, Mycobacterium
STLLRLLLGRLLPDEGRASM

SEQ ID NO: 1281033 - protein, 23 aa, Mycobacterium
STLPEDVPRTWILTTRDRALSVK

SEQ ID NO: 1281034 - protein, 25 aa, Mycobacterium
STLQSGSEFARWLAERGPARVPDIS

SEQ ID NO: 1281035 - protein, 35 aa, Mycobacterium
STLRPASYCGAWGFKPSHLRLPRAGMHLLADVLDD

SEQ ID NO: 1281036 - protein, 17 aa, Mycobacterium
STLRRLKQYSGRLATQA

SEQ ID NO: 1281037 - protein, 27 aa, Mycobacterium
STLSDTRIPAVFSGPVGLTAISNPTYE

SEQ ID NO: 1281038 - protein, 20 aa, Mycobacterium
STLVKAIAGIHPIDTGTYLF

SEQ ID NO: 1281039 - protein, 18 aa, Mycobacterium
STMHCMSVSLGLGGDGLG

SEQ ID NO: 1281040 - protein, 23 aa, Mycobacterium
STNGELRKRCLLQLHEAIEGELA

SEQ ID NO: 1281041 - protein, 19 aa, Mycobacterium
STNLPRVLGGLGVAIISTS

SEQ ID NO: 1281042 - protein, 25 aa, Mycobacterium
STNRRFLLNLPMFGREQFHPDVDKL

SEQ ID NO: 1281043 - protein, 17 aa, Mycobacterium
STPEARTPTVLSPGETF

SEQ ID NO: 1281044 - protein, 26 aa, Mycobacterium
STPFAHAGYMFKLWDQLVWGVTLVIP

SEQ ID NO: 1281045 - protein, 25 aa, Mycobacterium
STPIIVGALPFDITKPAALIRPQSV

SEQ ID NO: 1281046 - protein, 17 aa, Mycobacterium
STPKALKLYGIAEDAYA

SEQ ID NO: 1281047 - protein, 28 aa, Mycobacterium
STPRKAPRITLCLLRFGEEPVELTTGWD

SEQ ID NO: 1281048 - protein, 22 aa, Mycobacterium
STPRLLQLSGIGDRSLLRGLGI

SEQ ID NO: 1281049 - protein, 18 aa, Mycobacterium
STPRMLASLVEEAVSVGD

SEQ ID NO: 1281050 - protein, 17 aa, Mycobacterium
STPRSKLLAEVARMQPV

SEQ ID NO: 1281051 - protein, 23 aa, Mycobacterium
STPSGPRWLLMDSGVLTDLTPDQ

SEQ ID NO: 1281052 - protein, 21 aa, Mycobacterium
STPWPTYPLMYRVTSAHEEGG

SEQ ID NO: 1281053 - protein, 24 aa, Mycobacterium
STPWTWNAAGTYRVFADFQPAGAG

SEQ ID NO: 1281054 - protein, 27 aa, Mycobacterium
STQFRKFGLDAGEFMTLLSQGLEGGAR

SEQ ID NO: 1281055 - protein, 26 aa, Mycobacterium
STQLRAAAVLACYRFHADAHGLAGPY

SEQ ID NO: 1281056 - protein, 17 aa, Mycobacterium
STRARIVLFRKPIERRA

SEQ ID NO: 1281057 - protein, 25 aa, Mycobacterium
STRELLDRELLGIAEALRASGLSAG

SEQ ID NO: 1281058 - protein, 21 aa, Mycobacterium
STRQLVWSRLDSARCGPILGA

SEQ ID NO: 1281059 - protein, 23 aa, Mycobacterium
STRQRFVAISLDFPAAEIETEVV

SEQ ID NO: 1281060 - protein, 24 aa, Mycobacterium
STRQRMVAIEFGFPAPEVEEGIVA

SEQ ID NO: 1281061 - protein, 25 aa, Mycobacterium
STRRHPRHVLSYGLGLDSTAVLLRW

SEQ ID NO: 1281062 - protein, 24 aa, Mycobacterium
STRVEFWAFDILFLDGRSLLRAKY

SEQ ID NO: 1281063 - protein, 24 aa, Mycobacterium
STSEIRISVLIKDTELDRAVEALH

SEQ ID NO: 1281064 - protein, 23 aa, Mycobacterium
STSLKEKFLELLPNRIITDSIGS

SEQ ID NO: 1281065 - protein, 18 aa, Mycobacterium
STSWEHLSDVAIDLFMAR

SEQ ID NO: 1281066 - protein, 19 aa, Mycobacterium
STTALPLRPAAPAPLAPTG

SEQ ID NO: 1281067 - protein, 18 aa, Mycobacterium
STTARRALLEGADVVVSD

SEQ ID NO: 1281068 - protein, 32 aa, Mycobacterium
STTVFSIAARWGFPHLPSFEELYCGSYGQNPQ

SEQ ID NO: 1281069 - protein, 20 aa, Mycobacterium
STTVHLPPSIARHIAGDDAL

SEQ ID NO: 1281070 - protein, 19 aa, Mycobacterium
STVACATVIAGIRRHGANR

SEQ ID NO: 1281071 - protein, 18 aa, Mycobacterium
STVFKAFYSGLLFWTYEP

SEQ ID NO: 1281072 - protein, 18 aa, Mycobacterium
STVPGSHLPHAWVGDSRT

SEQ ID NO: 1281073 - protein, 31 aa, Mycobacterium
STWPPAEIALAWSRDRARAMPEIEQVVERLA

SEQ ID NO: 1281074 - protein, 22 aa, Mycobacterium
STWYREGWFSSTTCVDAFEAGA

SEQ ID NO: 1281075 - protein, 24 aa, Mycobacterium
STYEPLTALPLRRAVIMLMCGKAD

SEQ ID NO: 1281076 - protein, 19 aa, Mycobacterium
STYIRSCVDAGDMVAAAEA

SEQ ID NO: 1281077 - protein, 17 aa, Mycobacterium
STYKRATLRKLGVDHVY

SEQ ID NO: 1281078 - protein, 28 aa, Mycobacterium
SVAAARRLGVPEAKWVYLRGHADQTEQD

SEQ ID NO: 1281079 - protein, 22 aa, Mycobacterium
SVAALARLDLGSVLIPMPEAGQ

SEQ ID NO: 1281080 - protein, 21 aa, Mycobacterium
SVADFAARARTWLAENMPSID

SEQ ID NO: 1281081 - protein, 23 aa, Mycobacterium
SVADYRNATGITHDYDGPVLSEG

SEQ ID NO: 1281082 - protein, 24 aa, Mycobacterium
SVAGPRKVTVRLGGHDHPEAARAI

SEQ ID NO: 1281083 - protein, 26 aa, Mycobacterium
SVAIRRLERDLGIVIVQRGHRFEGFT

SEQ ID NO: 1281084 - protein, 18 aa, Mycobacterium
SVALAEVVIHGWDVAVAT

SEQ ID NO: 1281085 - protein, 17 aa, Mycobacterium
SVARRALQDGWAVRVHR

SEQ ID NO: 1281086 - protein, 18 aa, Mycobacterium
SVCCGRFCCCGTTRRRLP

SEQ ID NO: 1281087 - protein, 26 aa, Mycobacterium
SVDHFEWLENLGFQFERSYYPGKVVV

SEQ ID NO: 1281088 - protein, 19 aa, Mycobacterium
SVDRACLDYARAVERLGLA

SEQ ID NO: 1281089 - protein, 25 aa, Mycobacterium
SVDRRPDLPSGKGLVIAEGVLVVQR

SEQ ID NO: 1281090 - protein, 18 aa, Mycobacterium
SVDSGRRDMTGWLAGKRA

SEQ ID NO: 1281091 - protein, 20 aa, Mycobacterium
SVEIAAPIEAVWKQVADPVR

SEQ ID NO: 1281092 - protein, 26 aa, Mycobacterium
SVEPGIYFPGQWGARIEDIVIVTEDG

SEQ ID NO: 1281093 - protein, 25 aa, Mycobacterium
SVEPGIYFPGQWGARIEDIVIVTGD

SEQ ID NO: 1281094 - protein, 25 aa, Mycobacterium
SVFDRPLRRVDITSGSSMVKETTVL

SEQ ID NO: 1281095 - protein, 18 aa, Mycobacterium
SVFQPHLFSEVIAEVISL

SEQ ID NO: 1281096 - protein, 19 aa, Mycobacterium
SVFRADFLNELDAPPAAGG

SEQ ID NO: 1281097 - protein, 20 aa, Mycobacterium
SVGAVALVAGWVARNSPAGA

SEQ ID NO: 1281098 - protein, 25 aa, Mycobacterium
SVGGRWEIVEGLDINPFSRARIDAS

SEQ ID NO: 1281099 - protein, 18 aa, Mycobacterium
SVHARPLLHEAMWAVAPP

SEQ ID NO: 1281100 - protein, 19 aa, Mycobacterium
SVHCARSDVDWVIVGSPAV

SEQ ID NO: 1281101 - protein, 19 aa, Mycobacterium
SVIALAYADGVLFVAENPS

SEQ ID NO: 1281102 - protein, 17 aa, Mycobacterium
SVIRNAPGLAMTYITDR

SEQ ID NO: 1281103 - protein, 23 aa, Mycobacterium
SVKLPGRIFGSFFGLPPGELHEK

SEQ ID NO: 1281104 - protein, 21 aa, Mycobacterium
SVKPEILLPGGRSLHQRPPSA

SEQ ID NO: 1281105 - protein, 18 aa, Mycobacterium
SVLAAGWPEHIPGTTVNR

SEQ ID NO: 1281106 - protein, 24 aa, Mycobacterium
SVLAKHGLTMWGYAVLSTLDRSAF

SEQ ID NO: 1281107 - protein, 17 aa, Mycobacterium
SVLARSLAKLGVGADDI

SEQ ID NO: 1281108 - protein, 17 aa, Mycobacterium
SVLCTNESVLIAEDAIA

SEQ ID NO: 1281109 - protein, 18 aa, Mycobacterium
SVLGPAGVAARCRTEGGS

SEQ ID NO: 1281110 - protein, 17 aa, Mycobacterium
SVLGRPFYLMGFVDGWS

SEQ ID NO: 1281111 - protein, 31 aa, Mycobacterium
SVLLPIGPRRELWAKLGGSLKPTHLADLSHD

SEQ ID NO: 1281112 - protein, 17 aa, Mycobacterium
SVLPEIIETAGTDNDVD

SEQ ID NO: 1281113 - protein, 21 aa, Mycobacterium
SVLSRGVCGVAGRTLIVNLPG

SEQ ID NO: 1281114 - protein, 22 aa, Mycobacterium
SVLTSQVLPVWLLSRDPDAEVI

SEQ ID NO: 1281115 - protein, 26 aa, Mycobacterium
SVNARIAANLGAPVVLAVKGKGRTPE

SEQ ID NO: 1281116 - protein, 21 aa, Mycobacterium
SVNRPTPLVVPGFALRLALGE

SEQ ID NO: 1281117 - protein, 23 aa, Mycobacterium
SVNSALLAAGWRPSRPYDGPAEL

SEQ ID NO: 1281118 - protein, 22 aa, Mycobacterium
SVPALMRGYLRLGAQVCGEPAH

SEQ ID NO: 1281119 - protein, 18 aa, Mycobacterium
SVPGFPNFFTVFGPYGYV

SEQ ID NO: 1281120 - protein, 22 aa, Mycobacterium
SVPKERVAQAFSLVDGADALLV

SEQ ID NO: 1281121 - protein, 20 aa, Mycobacterium
SVPLLAAFATVLQRYSGQHD

SEQ ID NO: 1281122 - protein, 17 aa, Mycobacterium
SVPPEWVFRAVGVPYRP

SEQ ID NO: 1281123 - protein, 18 aa, Mycobacterium
SVPPGAASFQAWQVDQLS

SEQ ID NO: 1281124 - protein, 20 aa, Mycobacterium
SVPTGLWIGGEERQGTSTFS

SEQ ID NO: 1281125 - protein, 23 aa, Mycobacterium
SVQCAVAPGAIPGRTVAQAIVDA

SEQ ID NO: 1281126 - protein, 25 aa, Mycobacterium
SVQLKWLTPRAYKRWRDVGLGGYHG

SEQ ID NO: 1281127 - protein, 25 aa, Mycobacterium
SVQQEWLRAASLGFVATVDAQGHLD

SEQ ID NO: 1281128 - protein, 17 aa, Mycobacterium
SVQVRWDEYMTAAEARQ

SEQ ID NO: 1281129 - protein, 17 aa, Mycobacterium
SVRAELLPVLAGGETVA

SEQ ID NO: 1281130 - protein, 23 aa, Mycobacterium
SVRARRCLDAGASTGGFTEVLLD

SEQ ID NO: 1281131 - protein, 18 aa, Mycobacterium
SVRCAQIGRVPRGTADLW

SEQ ID NO: 1281132 - protein, 22 aa, Mycobacterium
SVRLCPPAAGVARLVTRDFAVD

SEQ ID NO: 1281133 - protein, 20 aa, Mycobacterium
SVRLIRRLAGLGILTQTVDQ

SEQ ID NO: 1281134 - protein, 20 aa, Mycobacterium
SVRLPIVGRIAVPPPDQLAF

SEQ ID NO: 1281135 - protein, 18 aa, Mycobacterium
SVRPTVGVEWEFALVDAT

SEQ ID NO: 1281136 - protein, 22 aa, Mycobacterium
SVRRLRAAWRGAAGEGTITQAE

SEQ ID NO: 1281137 - protein, 19 aa, Mycobacterium
SVRSQPWLADHVIYGTVVV

SEQ ID NO: 1281138 - protein, 20 aa, Mycobacterium
SVRTLAEMNCKLLVEIGPRP

SEQ ID NO: 1281139 - protein, 23 aa, Mycobacterium
SVRVAQLCDAWGLTWGSHSNNHF

SEQ ID NO: 1281140 - protein, 19 aa, Mycobacterium
SVSEFWRNLRNGVESIVDL

SEQ ID NO: 1281141 - protein, 22 aa, Mycobacterium
SVSLDPPLVCFNITHTSSSIAA

SEQ ID NO: 1281142 - protein, 28 aa, Mycobacterium
SVSMAGLQARFGLDTGKWTAEQMAQVAL

SEQ ID NO: 1281143 - protein, 17 aa, Mycobacterium
SVSRSTTVISIVRQGNS

SEQ ID NO: 1281144 - protein, 21 aa, Mycobacterium
SVSYLPLTYDHRLIDGADAGR

SEQ ID NO: 1281145 - protein, 19 aa, Mycobacterium
SVTETFAAITLEVDTRRWA

SEQ ID NO: 1281146 - protein, 20 aa, Mycobacterium
SVTEVVVWEADWLCTDYAAA

SEQ ID NO: 1281147 - protein, 25 aa, Mycobacterium
SVTFLRPRFAREMVTALARVEGRPV

SEQ ID NO: 1281148 - protein, 25 aa, Mycobacterium
SVTRPMRLHLAFDVVVAGDRMTGHS

SEQ ID NO: 1281149 - protein, 26 aa, Mycobacterium
SVTVKRFRRTLAWFIYRKPGGRVALG

SEQ ID NO: 1281150 - protein, 23 aa, Mycobacterium
SVVCAIQNLWLAATVEGLGVGWV

SEQ ID NO: 1281151 - protein, 18 aa, Mycobacterium
SVVELIARVGRWMDSLTT

SEQ ID NO: 1281152 - protein, 22 aa, Mycobacterium
SVVRHLAHRVAVMHKGVIVEQG

SEQ ID NO: 1281153 - protein, 22 aa, Mycobacterium
SVVSLLPPWAIRMGARAYRKLG

SEQ ID NO: 1281154 - protein, 33 aa, Mycobacterium
SVVVRRARDAGALEALPQVLAYRAGAHLLAGEL

SEQ ID NO: 1281155 - protein, 20 aa, Mycobacterium
SVWLTLCGLTIGEVLRQISA

SEQ ID NO: 1281156 - protein, 29 aa, Mycobacterium
SVYGRLFKQVWLWKDWPGRGGKIDTGIDL

SEQ ID NO: 1281157 - protein, 21 aa, Mycobacterium
SVYVDRFGNLYVTNAGQKTVA

SEQ ID NO: 1281158 - protein, 20 aa, Mycobacterium
SWAALDMAVGYAKVREQFGR

SEQ ID NO: 1281159 - protein, 17 aa, Mycobacterium
SWAPRLPTYGGNDRTHY

SEQ ID NO: 1281160 - protein, 21 aa, Mycobacterium
SWDDLLLRRLRAAARSGRTPP

SEQ ID NO: 1281161 - protein, 19 aa, Mycobacterium
SWDITDLHSPWRGVSFKTY

SEQ ID NO: 1281162 - protein, 19 aa, Mycobacterium
SWEDGAFEYRCIEGEQKTI

SEQ ID NO: 1281163 - protein, 25 aa, Mycobacterium
SWERPAAFSRFAWDWENSLGGSPRW

SEQ ID NO: 1281164 - protein, 19 aa, Mycobacterium
SWFNATYAALAGRRKYKGR

SEQ ID NO: 1281165 - protein, 23 aa, Mycobacterium
SWFRLNDQLLIEWQRDFFDFGHV

SEQ ID NO: 1281166 - protein, 19 aa, Mycobacterium
SWGDGACRQCHEGNEQLCA

SEQ ID NO: 1281167 - protein, 28 aa, Mycobacterium
SWHTYFPPIGGFRFSMFTLPPGAAAASE

SEQ ID NO: 1281168 - protein, 23 aa, Mycobacterium
SWIRREPIGVIGQVAPWNYPMMM

SEQ ID NO: 1281169 - protein, 18 aa, Mycobacterium
SWLLRLFEVPLGAQAPAN

SEQ ID NO: 1281170 - protein, 18 aa, Mycobacterium
SWLRRGRVTTAMIRPDRT

SEQ ID NO: 1281171 - protein, 24 aa, Mycobacterium
SWNDIQFGVGGSWTVANPDAIVGM

SEQ ID NO: 1281172 - protein, 19 aa, Mycobacterium
SWNLAEARWEENFAALAAF

SEQ ID NO: 1281173 - protein, 22 aa, Mycobacterium
SWNLRKFLWAPQFGMYGIQRIH

SEQ ID NO: 1281174 - protein, 27 aa, Mycobacterium
SWPDISDLFAGLPAWANLRPVLGGHPI

SEQ ID NO: 1281175 - protein, 19 aa, Mycobacterium
SWREPPLHRCDRTAVSMPR

SEQ ID NO: 1281176 - protein, 29 aa, Mycobacterium
SWRGKAVLLKLIWRMFRARVFGDRMAAIG

SEQ ID NO: 1281177 - protein, 18 aa, Mycobacterium
SWRPDLRQPADLVEEVMR

SEQ ID NO: 1281178 - protein, 29 aa, Mycobacterium
SWSIVDSRFWKAQVAFLARHHRVVTFDGR

SEQ ID NO: 1281179 - protein, 18 aa, Mycobacterium
SWVACLPRDHRLAERREV

SEQ ID NO: 1281180 - protein, 19 aa, Mycobacterium
SWVELVVAVRPEWSAAEAR

SEQ ID NO: 1281181 - protein, 21 aa, Mycobacterium
SWVRRYPDVHVELVAAGTGRQ

SEQ ID NO: 1281182 - protein, 19 aa, Mycobacterium
SYAAFAEPVFAAFGQPGPV

SEQ ID NO: 1281183 - protein, 18 aa, Mycobacterium
SYADVFKGDERWRSLPTP

SEQ ID NO: 1281184 - protein, 19 aa, Mycobacterium
SYAPAGFRAGPWAAAPRRA

SEQ ID NO: 1281185 - protein, 25 aa, Mycobacterium
SYDLALRCVMLLERRGSLKTGAQQS

SEQ ID NO: 1281186 - protein, 23 aa, Mycobacterium
SYDRLKAELDQLIANRPVIAAEI

SEQ ID NO: 1281187 - protein, 18 aa, Mycobacterium
SYDRRGLMRFVTAIKSGA

SEQ ID NO: 1281188 - protein, 18 aa, Mycobacterium
SYDRVRDDPTWICHELDG

SEQ ID NO: 1281189 - protein, 24 aa, Mycobacterium
SYFAQRGGAVGFTVRVSDHRPHLL

SEQ ID NO: 1281190 - protein, 17 aa, Mycobacterium
SYGDPSSVVAFLSDPET

SEQ ID NO: 1281191 - protein, 25 aa, Mycobacterium
SYGIDFIEACAWIKENLPGVHISGG

SEQ ID NO: 1281192 - protein, 27 aa, Mycobacterium
SYGIGMLSHASWAWTRRLHSKADRTLA

SEQ ID NO: 1281193 - protein, 19 aa, Mycobacterium
SYGRRLSAAILGFGATARG

SEQ ID NO: 1281194 - protein, 20 aa, Mycobacterium
SYGTFVVFFRACAPCYFDFF

SEQ ID NO: 1281195 - protein, 19 aa, Mycobacterium
SYKIRIVLETARSRASGVD

SEQ ID NO: 1281196 - protein, 17 aa, Mycobacterium
SYLRDGVAVRDMRTELG

SEQ ID NO: 1281197 - protein, 26 aa, Mycobacterium
SYNRPKLPGIPGIKDFAGHVFHSARW

SEQ ID NO: 1281198 - protein, 21 aa, Mycobacterium
SYPPEAIDWLLPEHAHDVLDL

SEQ ID NO: 1281199 - protein, 18 aa, Mycobacterium
SYPTFLLTHWARDRHRGP

SEQ ID NO: 1281200 - protein, 24 aa, Mycobacterium
SYQFSFEQSSAWSRTYAHGHELKT

SEQ ID NO: 1281201 - protein, 23 aa, Mycobacterium
SYRAEKYLGIIDRVRAAIPDAAI

SEQ ID NO: 1281202 - protein, 24 aa, Mycobacterium
SYRDSLRLLIGFAQERTGKTPSRL

SEQ ID NO: 1281203 - protein, 24 aa, Mycobacterium
SYRELPLRLFEFGSVYRYEKSGVV

SEQ ID NO: 1281204 - protein, 19 aa, Mycobacterium
SYSGRLWGAPERLHSPDGL

SEQ ID NO: 1281205 - protein, 19 aa, Mycobacterium
SYTALAGPTWRNEIDSSVG

SEQ ID NO: 1281206 - protein, 30 aa, Mycobacterium
SYVGIAGRLGFKGPPTLSGRAPVACDYADA

SEQ ID NO: 1281207 - protein, 26 aa, Mycobacterium
SYVQRMAVVLGRRVWENAGSPDVDPN

SEQ ID NO: 1281208 - protein, 27 aa, Mycobacterium
SYVQRMSKLLARRLWDNAGTPEVDPDR

SEQ ID NO: 1281209 - protein, 23 aa, Mycobacterium
SYVRNALQFYGFIDYRESYAVAE

SEQ ID NO: 1281210 - protein, 17 aa, Mycobacterium
TAAAAIAIFQTRLIFIP

SEQ ID NO: 1281211 - protein, 17 aa, Mycobacterium
TAAAALRRWSLLTAVID

SEQ ID NO: 1281212 - protein, 17 aa, Mycobacterium
TAAAFGFAPAGATFERK

SEQ ID NO: 1281213 - protein, 18 aa, Mycobacterium
TAAAFPGLARTAALVRLV

SEQ ID NO: 1281214 - protein, 19 aa, Mycobacterium
TAAAGGWYFHPETGVPTLG

SEQ ID NO: 1281215 - protein, 19 aa, Mycobacterium
TAACTRDGWRVDGAVRHVL

SEQ ID NO: 1281216 - protein, 18 aa, Mycobacterium
TAAEVLQLAPNVWPQNAV

SEQ ID NO: 1281217 - protein, 19 aa, Mycobacterium
TAAGLPALAVNWGQWADVG

SEQ ID NO: 1281218 - protein, 24 aa, Mycobacterium
TAAHGCPLLLLLVSSAISGELIAR

SEQ ID NO: 1281219 - protein, 28 aa, Mycobacterium
TAAHPKSPWIFRGYRPGMHLAPTHLRNH

SEQ ID NO: 1281220 - protein, 20 aa, Mycobacterium
TAAKAYAAFASFQEGTNLVG

SEQ ID NO: 1281221 - protein, 21 aa, Mycobacterium
TAAKRICRSAVGIDAEAGPTE

SEQ ID NO: 1281222 - protein, 17 aa, Mycobacterium
TAALAGARIVSRGPKAT

SEQ ID NO: 1281223 - protein, 25 aa, Mycobacterium
TAANFIGCHQFRFLDKVDVLGRAAP

SEQ ID NO: 1281224 - protein, 24 aa, Mycobacterium
TAANRLLGAISWLAAQKPGIYDGL

SEQ ID NO: 1281225 - protein, 22 aa, Mycobacterium
TAAPGSPWLADTWRERFEEMLK

SEQ ID NO: 1281226 - protein, 25 aa, Mycobacterium
TAAQRWGTEWATCSGMSMPASIGKR

SEQ ID NO: 1281227 - protein, 19 aa, Mycobacterium
TAAQYRHWPALTDDTETLT

SEQ ID NO: 1281228 - protein, 23 aa, Mycobacterium
TAARRILPGASIVKVSVGPMDND

SEQ ID NO: 1281229 - protein, 25 aa, Mycobacterium
TAATWLRPGGHLLYLGHALENFVYG

SEQ ID NO: 1281230 - protein, 18 aa, Mycobacterium
TAAVSCRAALFGTDAVSL

SEQ ID NO: 1281231 - protein, 30 aa, Mycobacterium
TACDGGIRLSGRWSWATGVMDGNWMMVGAL

SEQ ID NO: 1281232 - protein, 25 aa, Mycobacterium
TACPSTAWACGLMAVHAHTVANYSP

SEQ ID NO: 1281233 - protein, 17 aa, Mycobacterium
TADALALQLGWRLFGPF

SEQ ID NO: 1281234 - protein, 22 aa, Mycobacterium
TADALRQISFRFAADDDQFTTI

SEQ ID NO: 1281235 - protein, 18 aa, Mycobacterium
TADAVLWAIGRVRPNTGW

SEQ ID NO: 1281236 - protein, 34 aa, Mycobacterium
TADAWLCGWDEDFTAALAERGWLGMTVPVAYGGH

SEQ ID NO: 1281237 - protein, 19 aa, Mycobacterium
TADDFWNLREELLAQATEL

SEQ ID NO: 1281238 - protein, 17 aa, Mycobacterium
TADGRRAEFDGLLSGIH

SEQ ID NO: 1281239 - protein, 26 aa, Mycobacterium
TADILLAVGVTQRWGDAGIVGNALHP

SEQ ID NO: 1281240 - protein, 25 aa, Mycobacterium
TADLALRLAEHGLRDERLATALTDL

SEQ ID NO: 1281241 - protein, 24 aa, Mycobacterium
TADPGPRVGLIVSKAVGNAVQRHR

SEQ ID NO: 1281242 - protein, 22 aa, Mycobacterium
TADPRRIVVLSGDQLDALCALG

SEQ ID NO: 1281243 - protein, 24 aa, Mycobacterium
TADVPRLLARIGRATPELVLTNRR

SEQ ID NO: 1281244 - protein, 24 aa, Mycobacterium
TAEDRARAAWLWSGRRATLTGHCA

SEQ ID NO: 1281245 - protein, 17 aa, Mycobacterium
TAEDVHLVKGFYRRPLK

SEQ ID NO: 1281246 - protein, 25 aa, Mycobacterium
TAEFEFRAGPVFTNLMLADEINRTP

SEQ ID NO: 1281247 - protein, 23 aa, Mycobacterium
TAEGYASNWLCDNVRSGDEFECL

SEQ ID NO: 1281248 - protein, 19 aa, Mycobacterium
TAEGYPFLDVVNEQTVALG

SEQ ID NO: 1281249 - protein, 20 aa, Mycobacterium
TAELGRLAPDAADYFTERQA

SEQ ID NO: 1281250 - protein, 19 aa, Mycobacterium
TAELPPGVCGQWRQYVDRD

SEQ ID NO: 1281251 - protein, 23 aa, Mycobacterium
TAEPLGSFVHRFRMWGSSDLRRW

SEQ ID NO: 1281252 - protein, 26 aa, Mycobacterium
TAEQMKMFLTRLGFGSKIVVTGDITQ

SEQ ID NO: 1281253 - protein, 26 aa, Mycobacterium
TAEQRDRWLPAFTRGECVTALGLTEP

SEQ ID NO: 1281254 - protein, 27 aa, Mycobacterium
TAEQRDRWLPAFTRGECVTALGLTEPG

SEQ ID NO: 1281255 - protein, 23 aa, Mycobacterium
TAEQRDRWLPAFTRGENVTALGL

SEQ ID NO: 1281256 - protein, 23 aa, Mycobacterium
TAERHRAILISLGLPVTYDADAL

SEQ ID NO: 1281257 - protein, 27 aa, Mycobacterium
TAERLLAMQGPGAWPNTFVPGSTGPSP

SEQ ID NO: 1281258 - protein, 19 aa, Mycobacterium
TAFAANSAEGWDMATASAR

SEQ ID NO: 1281259 - protein, 23 aa, Mycobacterium
TAFDWPEFDERSASSLCYTSGTT

SEQ ID NO: 1281260 - protein, 25 aa, Mycobacterium
TAFLRALPADGWLRVMCTATQIGQD

SEQ ID NO: 1281261 - protein, 23 aa, Mycobacterium
TAFRKLGNRFLLGVFNSLYDSDL

SEQ ID NO: 1281262 - protein, 20 aa, Mycobacterium
TAGAARWLVLSGPAGIGKTR

SEQ ID NO: 1281263 - protein, 18 aa, Mycobacterium
TAGAVCLYLEPIALYHTK

SEQ ID NO: 1281264 - protein, 20 aa, Mycobacterium
TAGCGYHFLNGELLAYCEGQ

SEQ ID NO: 1281265 - protein, 17 aa, Mycobacterium
TAGCPQFAYLPDSDAAA

SEQ ID NO: 1281266 - protein, 18 aa, Mycobacterium
TAGDGYLYLVRQVAASDS

SEQ ID NO: 1281267 - protein, 19 aa, Mycobacterium
TAGGCHLTWIMALKPNGPA

SEQ ID NO: 1281268 - protein, 20 aa, Mycobacterium
TAGGLSRFLSFRHTELAAGR

SEQ ID NO: 1281269 - protein, 22 aa, Mycobacterium
TAGGMRRVRRKSVSIPGQARNF

SEQ ID NO: 1281270 - protein, 17 aa, Mycobacterium
TAGIARRVVRKRNLLEL

SEQ ID NO: 1281271 - protein, 25 aa, Mycobacterium
TAGILRYSRDLAFAAATAYADQAEA

SEQ ID NO: 1281272 - protein, 19 aa, Mycobacterium
TAGLHPRYTLAAAPAIEAW

SEQ ID NO: 1281273 - protein, 17 aa, Mycobacterium
TAGLIVGEIALLRDAPR

SEQ ID NO: 1281274 - protein, 18 aa, Mycobacterium
TAGPGLHPPPPVVSVTGV

SEQ ID NO: 1281275 - protein, 21 aa, Mycobacterium
TAGQRWNWRGLRDGETLVEIE

SEQ ID NO: 1281276 - protein, 23 aa, Mycobacterium
TAGRCALILDYIDAHDMETKTAV

SEQ ID NO: 1281277 - protein, 17 aa, Mycobacterium
TAGRLGIDAELMAQAAA

SEQ ID NO: 1281278 - protein, 20 aa, Mycobacterium
TAGRRVALALAPAGTGKTTA

SEQ ID NO: 1281279 - protein, 17 aa, Mycobacterium
TAHAMISLVGRDMAHMI

SEQ ID NO: 1281280 - protein, 19 aa, Mycobacterium
TAHDAGWDVVHVTLRKADL

SEQ ID NO: 1281281 - protein, 22 aa, Mycobacterium
TAHELYHPQPLRGRKLDRYYGE

SEQ ID NO: 1281282 - protein, 19 aa, Mycobacterium
TAHLLRPLHLELGGNGAAI

SEQ ID NO: 1281283 - protein, 24 aa, Mycobacterium
TAHREYSEINGPDWDNLWQLHRAV

SEQ ID NO: 1281284 - protein, 19 aa, Mycobacterium
TAIAHGMLTMGLGGGYVTS

SEQ ID NO: 1281285 - protein, 23 aa, Mycobacterium
TAIDGWHWLIEWTTTSFYIKSMN

SEQ ID NO: 1281286 - protein, 18 aa, Mycobacterium
TAIGDFQLVQAMLADQQT

SEQ ID NO: 1281287 - protein, 18 aa, Mycobacterium
TAIGRLVGELGDVPLIGF

SEQ ID NO: 1281288 - protein, 18 aa, Mycobacterium
TAIGYSGAGTVEFMADDQ

SEQ ID NO: 1281289 - protein, 23 aa, Mycobacterium
TAIKALCPGARVYGVEPELAGDT

SEQ ID NO: 1281290 - protein, 24 aa, Mycobacterium
TAILNEIREGVLLGHAQEQLNARA

SEQ ID NO: 1281291 - protein, 21 aa, Mycobacterium
TAIRRGRRLLREKNNFRDRLH

SEQ ID NO: 1281292 - protein, 17 aa, Mycobacterium
TAIRSLFGFAALRHPEH

SEQ ID NO: 1281293 - protein, 17 aa, Mycobacterium
TAIVEFPPAGTLTGIAK

SEQ ID NO: 1281294 - protein, 24 aa, Mycobacterium
TAKGGIVFRVQQELGVPVKLVGLG

SEQ ID NO: 1281295 - protein, 17 aa, Mycobacterium
TAKHLGVTFNDVVLSLA

SEQ ID NO: 1281296 - protein, 18 aa, Mycobacterium
TAKIDAVAVLSNLLTRLG

SEQ ID NO: 1281297 - protein, 23 aa, Mycobacterium
TAKREIRLLSRFTGANPTVAIVG

SEQ ID NO: 1281298 - protein, 26 aa, Mycobacterium
TAKYGLRRYVEFGAHVDRALWDDDEM

SEQ ID NO: 1281299 - protein, 19 aa, Mycobacterium
TALAARIGVALGHGPTVLR

SEQ ID NO: 1281300 - protein, 34 aa, Mycobacterium
TALADARVGWRLMIAGPAAWCLKLRAEATAAGVA

SEQ ID NO: 1281301 - protein, 26 aa, Mycobacterium
TALADVPGWRVVEHVTEPSAITTLQS

SEQ ID NO: 1281302 - protein, 18 aa, Mycobacterium
TALARIPDGLSFVEAAPM

SEQ ID NO: 1281303 - protein, 19 aa, Mycobacterium
TALARLGGHPVAVVANQPK

SEQ ID NO: 1281304 - protein, 18 aa, Mycobacterium
TALCKAQGYDLVLIDSGP

SEQ ID NO: 1281305 - protein, 24 aa, Mycobacterium
TALDRSRPLWELYYAEGLANNRVA

SEQ ID NO: 1281306 - protein, 26 aa, Mycobacterium
TALHRHFGWLKNWYEFSVPDIGRSPL

SEQ ID NO: 1281307 - protein, 23 aa, Mycobacterium
TALIRRLLRLFDEIDAGTAAGIS

SEQ ID NO: 1281308 - protein, 18 aa, Mycobacterium
TALLAHVLWSMRADGRWS

SEQ ID NO: 1281309 - protein, 34 aa, Mycobacterium
TALLASAYVDFSLRLPDTFMLRFRDPGRIVVDKS

SEQ ID NO: 1281310 - protein, 27 aa, Mycobacterium
TALLGGECQCVDLAPTVTALTETELAA

SEQ ID NO: 1281311 - protein, 18 aa, Mycobacterium
TALLPGAATALVKNPDRP

SEQ ID NO: 1281312 - protein, 24 aa, Mycobacterium
TALNCHLEGLVAQWKRDHNITDHT

SEQ ID NO: 1281313 - protein, 17 aa, Mycobacterium
TALNWLRAHEDGFACPV

SEQ ID NO: 1281314 - protein, 24 aa, Mycobacterium
TALQPRLYVSPALVRTDLLRRSDT

SEQ ID NO: 1281315 - protein, 17 aa, Mycobacterium
TALRDKRIVGVRGSDGR

SEQ ID NO: 1281316 - protein, 24 aa, Mycobacterium
TALTAEVRRIFAGDSPELLEKLQP

SEQ ID NO: 1281317 - protein, 21 aa, Mycobacterium
TALYPLGPIFHGSGLNITVMS

SEQ ID NO: 1281318 - protein, 17 aa, Mycobacterium
TAMCEARGLPANRIGVV

SEQ ID NO: 1281319 - protein, 19 aa, Mycobacterium
TAMGVCVHAGQACAATSRM

SEQ ID NO: 1281320 - protein, 18 aa, Mycobacterium
TAMTHFLLPGEWRIQGHV

SEQ ID NO: 1281321 - protein, 24 aa, Mycobacterium
TANAVRFTFWGAEEVSMDGSKTYL

SEQ ID NO: 1281322 - protein, 20 aa, Mycobacterium
TANGYSRILLGVDIHDITAG

SEQ ID NO: 1281323 - protein, 17 aa, Mycobacterium
TANVRYSLQPSVVTVGT

SEQ ID NO: 1281324 - protein, 19 aa, Mycobacterium
TAPASPKIGAPGGAGAGGA

SEQ ID NO: 1281325 - protein, 19 aa, Mycobacterium
TAPEMTALIGGLRTLNANH

SEQ ID NO: 1281326 - protein, 23 aa, Mycobacterium
TAPFARRAVHRVVNLLGSERAVL

SEQ ID NO: 1281327 - protein, 23 aa, Mycobacterium
TAPISREMILNFVAQHSLKLPAS

SEQ ID NO: 1281328 - protein, 19 aa, Mycobacterium
TAPKRPVIFECVGVPGMID

SEQ ID NO: 1281329 - protein, 22 aa, Mycobacterium
TAPPRRFGALSIDVAAREVHID

SEQ ID NO: 1281330 - protein, 19 aa, Mycobacterium
TAPRLPLLQIQTRGAHQSA

SEQ ID NO: 1281331 - protein, 31 aa, Mycobacterium
TAPTELCSFPLRQCGSGNLFGGNEPARTWFT

SEQ ID NO: 1281332 - protein, 19 aa, Mycobacterium
TAPTLPAIHRYTGVLYDAL

SEQ ID NO: 1281333 - protein, 24 aa, Mycobacterium
TAPVPGEHPQLWSLGVDAPLQPAP

SEQ ID NO: 1281334 - protein, 17 aa, Mycobacterium
TAPYQWWRHHDSYDTAE

SEQ ID NO: 1281335 - protein, 24 aa, Mycobacterium
TAQQHWRTALGFAAPSVLERDFGI

SEQ ID NO: 1281336 - protein, 19 aa, Mycobacterium
TAQSRLDFLRQLHDREALL

SEQ ID NO: 1281337 - protein, 19 aa, Mycobacterium
TARAGKLGVPCRWPEDAVT

SEQ ID NO: 1281338 - protein, 29 aa, Mycobacterium
TARIKSIGLRLGVPWYAYDTITFTGEVTA

SEQ ID NO: 1281339 - protein, 31 aa, Mycobacterium
TARKRFENITVLETRAALATTDMGTAREYGP

SEQ ID NO: 1281340 - protein, 21 aa, Mycobacterium
TARLYEDIGLLTAAPDIGADL

SEQ ID NO: 1281341 - protein, 26 aa, Mycobacterium
TARMEPRDALVAWVSRFAEFVRTKHG

SEQ ID NO: 1281342 - protein, 27 aa, Mycobacterium
TARMEPRDALVAWVSRFAEFVRTKHGL

SEQ ID NO: 1281343 - protein, 18 aa, Mycobacterium
TARVQGVVFGQQYLMLDY

SEQ ID NO: 1281344 - protein, 22 aa, Mycobacterium
TASEAYRAALRVIESVEPRVAE

SEQ ID NO: 1281345 - protein, 25 aa, Mycobacterium
TASEPLRAGVVRAWREQLGGGASWI

SEQ ID NO: 1281346 - protein, 28 aa, Mycobacterium
TASEQRTRFTIRQVDPVRQWKLSPTDLA

SEQ ID NO: 1281347 - protein, 25 aa, Mycobacterium
TASGYKRPMLRAMGVDHVYDSRTTD

SEQ ID NO: 1281348 - protein, 23 aa, Mycobacterium
TASPRLRLVGVAGYEAACGQDVN

SEQ ID NO: 1281349 - protein, 21 aa, Mycobacterium
TASRRPVPLAVMIAAADDETP

SEQ ID NO: 1281350 - protein, 22 aa, Mycobacterium
TASSVLVCLSRGAEWAVRVAVD

SEQ ID NO: 1281351 - protein, 29 aa, Mycobacterium
TATAAALSHRVWLRPFRNLVYVMPPYICT

SEQ ID NO: 1281352 - protein, 25 aa, Mycobacterium
TATDGLRITKSVLFAGLAEAKQSGD

SEQ ID NO: 1281353 - protein, 27 aa, Mycobacterium
TATLLTARCPVLYAPAMHTEMWLHPAT

SEQ ID NO: 1281354 - protein, 18 aa, Mycobacterium
TATLRMLLAAIQTEEVSG

SEQ ID NO: 1281355 - protein, 19 aa, Mycobacterium
TATMPLPITGSVGYTVRVL

SEQ ID NO: 1281356 - protein, 17 aa, Mycobacterium
TATMSRWCAEQQGLKAF

SEQ ID NO: 1281357 - protein, 18 aa, Mycobacterium
TATMYVCGITPYDATHLG

SEQ ID NO: 1281358 - protein, 19 aa, Mycobacterium
TATPGWGVSTALVIGGIGT

SEQ ID NO: 1281359 - protein, 17 aa, Mycobacterium
TATPSWGVLERKAAATG

SEQ ID NO: 1281360 - protein, 28 aa, Mycobacterium
TATQRAKAAWLWSRRHGVVAGQSAAALH

SEQ ID NO: 1281361 - protein, 28 aa, Mycobacterium
TATQRAKAAWLWSRRQGVVAGQSAAALH

SEQ ID NO: 1281362 - protein, 25 aa, Mycobacterium
TATQWRNLGQGLSIFDDAVAPVKSL

SEQ ID NO: 1281363 - protein, 18 aa, Mycobacterium
TATSRLIVTAGIADAFSE

SEQ ID NO: 1281364 - protein, 29 aa, Mycobacterium
TATTGSRVPMCFGFHPYLQLPGIPRAQWT

SEQ ID NO: 1281365 - protein, 19 aa, Mycobacterium
TATVIALDQVTGWVGTHDA

SEQ ID NO: 1281366 - protein, 25 aa, Mycobacterium
TAVARLYRRRFSWLSQGSTPTASRR

SEQ ID NO: 1281367 - protein, 17 aa, Mycobacterium
TAVATFYSMYRRTPTGD

SEQ ID NO: 1281368 - protein, 17 aa, Mycobacterium
TAVDAHPGMALGTPDTA

SEQ ID NO: 1281369 - protein, 17 aa, Mycobacterium
TAVDVLTRILARDGAQV

SEQ ID NO: 1281370 - protein, 18 aa, Mycobacterium
TAVGRLFADLGAHVTALH

SEQ ID NO: 1281371 - protein, 26 aa, Mycobacterium
TAVIRRLCEPERQIIFRVPWLDDGGV

SEQ ID NO: 1281372 - protein, 24 aa, Mycobacterium
TAVKRARVATLVLPGVGTVRDLRD

SEQ ID NO: 1281373 - protein, 17 aa, Mycobacterium
TAVKVVSKRAKLMHAAP

SEQ ID NO: 1281374 - protein, 17 aa, Mycobacterium
TAVLGRYGRTSMSAKAG

SEQ ID NO: 1281375 - protein, 18 aa, Mycobacterium
TAVLTMPMSGFRNPFTES

SEQ ID NO: 1281376 - protein, 17 aa, Mycobacterium
TAVNDWVDENGEPKFGK

SEQ ID NO: 1281377 - protein, 17 aa, Mycobacterium
TAVPGIGVTTARAVLEA

SEQ ID NO: 1281378 - protein, 17 aa, Mycobacterium
TAVRVWELAGVSPPDAL

SEQ ID NO: 1281379 - protein, 25 aa, Mycobacterium
TAVSARADWAPDFSINHVASLDDLA

SEQ ID NO: 1281380 - protein, 18 aa, Mycobacterium
TAWAWLHKLRRAMVRPDR

SEQ ID NO: 1281381 - protein, 18 aa, Mycobacterium
TAWAWLHKMRRAMVRPDR

SEQ ID NO: 1281382 - protein, 18 aa, Mycobacterium
TAWLQALLPALAEYAEFI

SEQ ID NO: 1281383 - protein, 20 aa, Mycobacterium
TAWQIFPNFQIGQGLTSALC

SEQ ID NO: 1281384 - protein, 18 aa, Mycobacterium
TAWVHGRVQGVGFRWWTR

SEQ ID NO: 1281385 - protein, 20 aa, Mycobacterium
TAYLHTDFRSITPVEEELAV

SEQ ID NO: 1281386 - protein, 20 aa, Mycobacterium
TAYQRLNIMVGKLNRAMQRN

SEQ ID NO: 1281387 - protein, 19 aa, Mycobacterium
TCAFLCGSAGAAVDVGTEL

SEQ ID NO: 1281388 - protein, 18 aa, Mycobacterium
TCEVMPVVDRPAGPVSDR

SEQ ID NO: 1281389 - protein, 17 aa, Mycobacterium
TCFDILPEDGRMTIQSS

SEQ ID NO: 1281390 - protein, 18 aa, Mycobacterium
TCHYVMGGIEVDPDSGGA

SEQ ID NO: 1281391 - protein, 23 aa, Mycobacterium
TCIQCGNCGFVCPHSVIRSKFYD

SEQ ID NO: 1281392 - protein, 19 aa, Mycobacterium
TCMHSLRPTISGSLGSDQR

SEQ ID NO: 1281393 - protein, 21 aa, Mycobacterium
TCMSSSLPTLFRRAAHYQRQI

SEQ ID NO: 1281394 - protein, 18 aa, Mycobacterium
TCRHSHGILDGFVQSCRA

SEQ ID NO: 1281395 - protein, 20 aa, Mycobacterium
TCSGMSMPASIGKRDAIANA

SEQ ID NO: 1281396 - protein, 19 aa, Mycobacterium
TCSLRVWAYQIAELARDHR

SEQ ID NO: 1281397 - protein, 17 aa, Mycobacterium
TCVAGLIPSGELRTPAQ

SEQ ID NO: 1281398 - protein, 19 aa, Mycobacterium
TCVAVLLRLPPKVYGDGRS

SEQ ID NO: 1281399 - protein, 22 aa, Mycobacterium
TCVEPLKKWRLDVTPNDSGIEW

SEQ ID NO: 1281400 - protein, 23 aa, Mycobacterium
TCVGRLRYLGLVLYDVDRVLEAA

SEQ ID NO: 1281401 - protein, 23 aa, Mycobacterium
TCVGRLRYLGLVLYDVDRVTAAA

SEQ ID NO: 1281402 - protein, 24 aa, Mycobacterium
TDAARIRAAVWAFGDHAVASGLAA

SEQ ID NO: 1281403 - protein, 21 aa, Mycobacterium
TDADGGAALVEFAGRACYQSW

SEQ ID NO: 1281404 - protein, 24 aa, Mycobacterium
TDAGVEWKDIQFGFGGSYEVSNPD

SEQ ID NO: 1281405 - protein, 27 aa, Mycobacterium
TDAKHFARLGIRCFGFAPLRLPPDLDF

SEQ ID NO: 1281406 - protein, 18 aa, Mycobacterium
TDALCAQAARLIFDALPR

SEQ ID NO: 1281407 - protein, 19 aa, Mycobacterium
TDALERYGRPVLVHEPTSF

SEQ ID NO: 1281408 - protein, 19 aa, Mycobacterium
TDAMFPPKAFHALVELIEA

SEQ ID NO: 1281409 - protein, 25 aa, Mycobacterium
TDAPDRLRWVIGEAVKAIEDGIGFG

SEQ ID NO: 1281410 - protein, 17 aa, Mycobacterium
TDAPFLTPHPFRGAPNE

SEQ ID NO: 1281411 - protein, 18 aa, Mycobacterium
TDAPGLVAHRLPVGISLP

SEQ ID NO: 1281412 - protein, 18 aa, Mycobacterium
TDAPRYAELIKRTQWWGR

SEQ ID NO: 1281413 - protein, 24 aa, Mycobacterium
TDAPTCPVALAFPDGPQSPLLEEF

SEQ ID NO: 1281414 - protein, 25 aa, Mycobacterium
TDAPTCPVALAFPDGPQSPLLEEFI

SEQ ID NO: 1281415 - protein, 19 aa, Mycobacterium
TDARLMAHAAFGLLNSTPH

SEQ ID NO: 1281416 - protein, 20 aa, Mycobacterium
TDARNGAAIHEQMQSRLDPL

SEQ ID NO: 1281417 - protein, 24 aa, Mycobacterium
TDARPDQMLPFLRGWGDALWDTGI

SEQ ID NO: 1281418 - protein, 17 aa, Mycobacterium
TDARSALEHGLKNSGVV

SEQ ID NO: 1281419 - protein, 17 aa, Mycobacterium
TDAVLAFFVEQMNAEQS

SEQ ID NO: 1281420 - protein, 26 aa, Mycobacterium
TDDDFRHTFDWCVTSAFIMSQLAAPH

SEQ ID NO: 1281421 - protein, 32 aa, Mycobacterium
TDDELIAAAAYRWLRSWPVAPSSPWEVPSGWR

SEQ ID NO: 1281422 - protein, 24 aa, Mycobacterium
TDDGPSVLGAVEWIGDTDKDARNL

SEQ ID NO: 1281423 - protein, 18 aa, Mycobacterium
TDDLDFLHLAVLDALLTL

SEQ ID NO: 1281424 - protein, 21 aa, Mycobacterium
TDDLEAFAFASWRLGHIKESS

SEQ ID NO: 1281425 - protein, 26 aa, Mycobacterium
TDDLIPLRLAIPAQFRAEGDADTPRR

SEQ ID NO: 1281426 - protein, 25 aa, Mycobacterium
TDDPRPGQCLRTFLRDLGHVEVKKG

SEQ ID NO: 1281427 - protein, 20 aa, Mycobacterium
TDEARELVDLARQIADKALD

SEQ ID NO: 1281428 - protein, 26 aa, Mycobacterium
TDEKGRRFLVQSARIAYVEIGAADSR

SEQ ID NO: 1281429 - protein, 20 aa, Mycobacterium
TDELDVWLISWVSNRSTELH

SEQ ID NO: 1281430 - protein, 25 aa, Mycobacterium
TDEPSLRGIDGMERMRLIRDDIAGR

SEQ ID NO: 1281431 - protein, 19 aa, Mycobacterium
TDERLRPAVTSMHDEPGKP

SEQ ID NO: 1281432 - protein, 24 aa, Mycobacterium
TDERMRHGMFWSGDLAYRDADGWI

SEQ ID NO: 1281433 - protein, 30 aa, Mycobacterium
TDFAAARATETWRFPAFFHGLLDAGVYPPP

SEQ ID NO: 1281434 - protein, 19 aa, Mycobacterium
TDFAGPITTVRCFQDNALL

SEQ ID NO: 1281435 - protein, 25 aa, Mycobacterium
TDFRSWARADLELEPGRTVFVGPNG

SEQ ID NO: 1281436 - protein, 25 aa, Mycobacterium
TDFRSWARVELELEPGRTVFVGSNG

SEQ ID NO: 1281437 - protein, 19 aa, Mycobacterium
TDFSGSIGRLCDVAGAIGY

SEQ ID NO: 1281438 - protein, 19 aa, Mycobacterium
TDGDGRWDVRLADGDGDGA

SEQ ID NO: 1281439 - protein, 19 aa, Mycobacterium
TDGELFVCTTLRLVDDEPW

SEQ ID NO: 1281440 - protein, 17 aa, Mycobacterium
TDGEPGLLAARRLLRDG

SEQ ID NO: 1281441 - protein, 18 aa, Mycobacterium
TDGGWLLNGQKIWSSRAV

SEQ ID NO: 1281442 - protein, 23 aa, Mycobacterium
TDGGYWWAREMTPEMAAANSPHL

SEQ ID NO: 1281443 - protein, 29 aa, Mycobacterium
TDGMIRFMIRYGLVIARVYSGELDAADVA

SEQ ID NO: 1281444 - protein, 31 aa, Mycobacterium
TDGPIPAGVPFRWSWELADRALTEMCAAVSG

SEQ ID NO: 1281445 - protein, 21 aa, Mycobacterium
TDGRLGWNIVTSFNANMFRSF

SEQ ID NO: 1281446 - protein, 22 aa, Mycobacterium
TDGRTAAAFALACAQAGVNLQR

SEQ ID NO: 1281447 - protein, 25 aa, Mycobacterium
TDGTPRAGAPFGFAVTTAPHDWAWN

SEQ ID NO: 1281448 - protein, 17 aa, Mycobacterium
TDHAAAMQVVFDSLASD

SEQ ID NO: 1281449 - protein, 20 aa, Mycobacterium
TDHFDGHPSVLVRASRLGEV

SEQ ID NO: 1281450 - protein, 24 aa, Mycobacterium
TDHSPRLRIANGLSPERLREQLDV

SEQ ID NO: 1281451 - protein, 24 aa, Mycobacterium
TDIARVTLTWGRILFTFFNTQAAQ

SEQ ID NO: 1281452 - protein, 21 aa, Mycobacterium
TDIASKFVVFMPCAPEVPMMT

SEQ ID NO: 1281453 - protein, 24 aa, Mycobacterium
TDILRKVWDYDFGGRTSIVDLYVS

SEQ ID NO: 1281454 - protein, 23 aa, Mycobacterium
TDIPAWREHMLFRGETLAFLGRY

SEQ ID NO: 1281455 - protein, 17 aa, Mycobacterium
TDIPLGLVPAGTGNDHA

SEQ ID NO: 1281456 - protein, 22 aa, Mycobacterium
TDIPMDCHLMIENPERWAPPYA

SEQ ID NO: 1281457 - protein, 17 aa, Mycobacterium
TDIPVTVKFRIGIDDAH

SEQ ID NO: 1281458 - protein, 17 aa, Mycobacterium
TDIQLQPALVVSKAAYL

SEQ ID NO: 1281459 - protein, 20 aa, Mycobacterium
TDITARLAAVLRERGSGAVG

SEQ ID NO: 1281460 - protein, 17 aa, Mycobacterium
TDLAISCAMWVGMGRML

SEQ ID NO: 1281461 - protein, 21 aa, Mycobacterium
TDLALSCAMWVGMGRVLRTLD

SEQ ID NO: 1281462 - protein, 20 aa, Mycobacterium
TDLDPMVAFYEGFLELEPQG

SEQ ID NO: 1281463 - protein, 24 aa, Mycobacterium
TDLEDRLRAAAALYDNVDYQNGRD

SEQ ID NO: 1281464 - protein, 20 aa, Mycobacterium
TDLGRRAVSVGTDITDEAQV

SEQ ID NO: 1281465 - protein, 19 aa, Mycobacterium
TDLGVEFNERGNVARDSAF

SEQ ID NO: 1281466 - protein, 18 aa, Mycobacterium
TDLIETWISYKRENEIMP

SEQ ID NO: 1281467 - protein, 36 aa, Mycobacterium
TDLLDEAWWFPAICWPDGRLQFMLNERMMPSQFVVN

SEQ ID NO: 1281468 - protein, 19 aa, Mycobacterium
TDLLDVWVAYFAEHPRERS

SEQ ID NO: 1281469 - protein, 20 aa, Mycobacterium
TDLLPYVDFDVDACTRYAQS

SEQ ID NO: 1281470 - protein, 21 aa, Mycobacterium
TDLLPYVEFDVDACTRYAQSL

SEQ ID NO: 1281471 - protein, 30 aa, Mycobacterium; identical to SEQ ID NO: 736572

SEQ ID NO: 1281472 - protein, 25 aa, Mycobacterium
TDLTGRRALLTGGRAKIGMYIALRL

SEQ ID NO: 1281473 - protein, 18 aa, Mycobacterium
TDLYYDWAKLREVDEDGA

SEQ ID NO: 1281474 - protein, 17 aa, Mycobacterium
TDMAVYFCDPASPWQRG

SEQ ID NO: 1281475 - protein, 23 aa, Mycobacterium
TDMLRGEGVLKNLGEIAWDVVLS

SEQ ID NO: 1281476 - protein, 20 aa, Mycobacterium
TDMRDWVAALVCPLTDHLAA

SEQ ID NO: 1281477 - protein, 19 aa, Mycobacterium
TDMVLRLAGQLSEHLVDTA

SEQ ID NO: 1281478 - protein, 23 aa, Mycobacterium
TDPAHWAVCLTEVEGYVDTETGE

SEQ ID NO: 1281479 - protein, 24 aa, Mycobacterium
TDPERLRVLYATGLLDSPAEKVYD

SEQ ID NO: 1281480 - protein, 24 aa, Mycobacterium
TDPLCYVDPYLPIESFRIRDEARA

SEQ ID NO: 1281481 - protein, 18 aa, Mycobacterium
TDPMLYIRAIVRIVASTR

SEQ ID NO: 1281482 - protein, 23 aa, Mycobacterium
TDPPYVWEAWTEPGGWKPCEVDR

SEQ ID NO: 1281483 - protein, 20 aa, Mycobacterium
TDPRASIAIVAPTAETDPLA

SEQ ID NO: 1281484 - protein, 21 aa, Mycobacterium
TDPRIKAVGFTGSRSGGMALV

SEQ ID NO: 1281485 - protein, 21 aa, Mycobacterium
TDPSWDIKGCYITQIKGDPNI

SEQ ID NO: 1281486 - protein, 21 aa, Mycobacterium
TDPWSPRYLRVYGTAEVVGGP

SEQ ID NO: 1281487 - protein, 23 aa, Mycobacterium
TDRARRARPDFIISADDAAAVSE

SEQ ID NO: 1281488 - protein, 21 aa, Mycobacterium
TDRCTGEGLLAPEDVAAIEES

SEQ ID NO: 1281489 - protein, 33 aa, Mycobacterium
TDRLDAFWAQVMRLRDLLKFEFYFADSAGYRDH

SEQ ID NO: 1281490 - protein, 29 aa, Mycobacterium
TDRLDRRWCGGDILLQICADDRVAVAHAA

SEQ ID NO: 1281491 - protein, 24 aa, Mycobacterium
TDRLKDMYICGGFNVYPAEIEQVL

SEQ ID NO: 1281492 - protein, 24 aa, Mycobacterium
TDRLPFAAPPDWESFIAQLSSGTA

SEQ ID NO: 1281493 - protein, 32 aa, Mycobacterium
TDRQWRGIGMIPRSGWTLSPRYAEFDAERRFG

SEQ ID NO: 1281494 - protein, 19 aa, Mycobacterium
TDRSLICLPSTFQKDGRLQ

SEQ ID NO: 1281495 - protein, 23 aa, Mycobacterium
TDRWCAISTNVLGGCRGSTGPSS

SEQ ID NO: 1281496 - protein, 18 aa, Mycobacterium
TDSAAGLVGRVGAEPVLG

SEQ ID NO: 1281497 - protein, 19 aa, Mycobacterium
TDSAVRRYVTDAGPLLGQL

SEQ ID NO: 1281498 - protein, 19 aa, Mycobacterium
TDSPACLITDTFGITPALA

SEQ ID NO: 1281499 - protein, 22 aa, Mycobacterium
TDSRAAGSMAFAARELAPAMAW

SEQ ID NO: 1281500 - protein, 23 aa, Mycobacterium
TDTEAMDAFSLLCRTEGIIPAIE

SEQ ID NO: 1281501 - protein, 27 aa, Mycobacterium
TDTGSFRWASARAHRLAARLLEIGVDN

SEQ ID NO: 1281502 - protein, 25 aa, Mycobacterium
TDTPERWDWLHAHLSVGRLRELIPE

SEQ ID NO: 1281503 - protein, 22 aa, Mycobacterium
TDTWLVHRLCGAFVTDTSTASR

SEQ ID NO: 1281504 - protein, 20 aa, Mycobacterium
TDTWVLWNLTGGHRGGVHVT

SEQ ID NO: 1281505 - protein, 23 aa, Mycobacterium
TDVAETIPALAADVDYVSFDLLT

SEQ ID NO: 1281506 - protein, 26 aa, Mycobacterium
TDVAEWLVRRGVPFRVAHEAAGAAVR

SEQ ID NO: 1281507 - protein, 17 aa, Mycobacterium
TDVASFVSFLAGPESGY

SEQ ID NO: 1281508 - protein, 27 aa, Mycobacterium
TDVDALLPVPAEPVATLILTELRSAVA

SEQ ID NO: 1281509 - protein, 17 aa, Mycobacterium
TDVPILKLVAAQGDGIA

SEQ ID NO: 1281510 - protein, 21 aa, Mycobacterium
TDVRGGLLFVWHDHEGNPPQP

SEQ ID NO: 1281511 - protein, 24 aa, Mycobacterium
TDVRPCPKYAPPQGLRSQSAVVDT

SEQ ID NO: 1281512 - protein, 23 aa, Mycobacterium
TDVYWCTADIGWVTGHTYITYGP

SEQ ID NO: 1281513 - protein, 19 aa, Mycobacterium
TDWCGRWIVAGPDVDAAAL

SEQ ID NO: 1281514 - protein, 26 aa, Mycobacterium
TDWRQWWEWVPGADWRHPSGPGSSVD

SEQ ID NO: 1281515 - protein, 25 aa, Mycobacterium
TEAAELHEIYKLGVVPIPTNRPMVR

SEQ ID NO: 1281516 - protein, 22 aa, Mycobacterium
TEACGISRAGFYTYFKDKREIF

SEQ ID NO: 1281517 - protein, 24 aa, Mycobacterium
TEAEPWLRRAGARAHARGWQLAAA

SEQ ID NO: 1281518 - protein, 31 aa, Mycobacterium
TEAGADAFIAWQASRCVARWDGAAKVDKGLR

SEQ ID NO: 1281519 - protein, 21 aa, Mycobacterium
TEAGGRFGFVSAAPANDPFEI

SEQ ID NO: 1281520 - protein, 25 aa, Mycobacterium
TEAGRRAALAMVRRHRLMETFLVNE

SEQ ID NO: 1281521 - protein, 24 aa, Mycobacterium
TEAGRRIRDAFVVESRPPGSGGGA

SEQ ID NO: 1281522 - protein, 19 aa, Mycobacterium
TEAIKRVALVADRGAQVRM

SEQ ID NO: 1281523 - protein, 23 aa, Mycobacterium
TEAKEWIACLVPVFRAGQEAGLT

SEQ ID NO: 1281524 - protein, 25 aa, Mycobacterium
TEALRIAPHPGWRVEVDNVAVTLTA

SEQ ID NO: 1281525 - protein, 21 aa, Mycobacterium
TEALTNWYVRRSRSRFWEEDA

SEQ ID NO: 1281526 - protein, 30 aa, Mycobacterium; identical to SEQ ID NO: 206930

SEQ ID NO: 1281527 - protein, 18 aa, Mycobacterium
TEARRLAGRLRFACLPTP

SEQ ID NO: 1281528 - protein, 20 aa, Mycobacterium
TEARRLAGRLRFACLPTPAS

SEQ ID NO: 1281529 - protein, 22 aa, Mycobacterium
TEARTGVDVVRLVAGDPLSIDS

SEQ ID NO: 1281530 - protein, 22 aa, Mycobacterium
TECALTAARWRAVRGDSTVTVA

SEQ ID NO: 1281531 - protein, 21 aa, Mycobacterium
TECPVLAAAVRRARPGTGSGR

SEQ ID NO: 1281532 - protein, 22 aa, Mycobacterium
TECRLRPLTLVEVDFTLAVLAG

SEQ ID NO: 1281533 - protein, 19 aa, Mycobacterium
TEDELMAWALPTAANQFWM

SEQ ID NO: 1281534 - protein, 23 aa, Mycobacterium
TEDPGLVGMPSWYAENGQYLTTQ

SEQ ID NO: 1281535 - protein, 25 aa, Mycobacterium
TEDQHLRAAKVLSLAQDTADRLTSS

SEQ ID NO: 1281536 - protein, 19 aa, Mycobacterium
TEEDLRILLTPMAASGVEP

SEQ ID NO: 1281537 - protein, 23 aa, Mycobacterium
TEEEWTRAIEFLTAVGRITDDKR

SEQ ID NO: 1281538 - protein, 28 aa, Mycobacterium
TEEMPIKVPWSLPSARPCLAGSDDEPAA

SEQ ID NO: 1281539 - protein, 24 aa, Mycobacterium
TEFAGSLCAWTPELLQQYGESKRN

SEQ ID NO: 1281540 - protein, 17 aa, Mycobacterium
TEFCGDAHHVLIGDGVG

SEQ ID NO: 1281541 - protein, 21 aa, Mycobacterium
TEFSPRAAIAPAEVPAALERL

SEQ ID NO: 1281542 - protein, 22 aa, Mycobacterium
TEFSPRAAIAPAEVPAALERLG

SEQ ID NO: 1281543 - protein, 17 aa, Mycobacterium
TEGKRTFAVMGGVVNHF

SEQ ID NO: 1281544 - protein, 20 aa, Mycobacterium
TEGRMVLSGVRYRPGGVSLR

SEQ ID NO: 1281545 - protein, 25 aa, Mycobacterium
TEGRWSCVQWGKLTPPFGPEAPVVT

SEQ ID NO: 1281546 - protein, 27 aa, Mycobacterium
TEGVPRWRKGSGQGWLTAEYAMLPAAT

SEQ ID NO: 1281547 - protein, 21 aa, Mycobacterium
TEGVSALVLRVGDEAGAVAPG

SEQ ID NO: 1281548 - protein, 20 aa, Mycobacterium
TEHFARPGAQTGVDRALRLD

SEQ ID NO: 1281549 - protein, 23 aa, Mycobacterium
TEHLPSYWFVGAFFTDEEHHEGP

SEQ ID NO: 1281550 - protein, 20 aa, Mycobacterium
TEIAYILVLETTFPNGFVAT

SEQ ID NO: 1281551 - protein, 17 aa, Mycobacterium
TEIDLAIERRVVAELTR

SEQ ID NO: 1281552 - protein, 17 aa, Mycobacterium
TEIDTVLGLTVGADDYV

SEQ ID NO: 1281553 - protein, 23 aa, Mycobacterium
TEIKRGELVILHLAGANRDPEVF

SEQ ID NO: 1281554 - protein, 26 aa, Mycobacterium
TEILEYRWGPDWLVWDAQPTSQQYAQ

SEQ ID NO: 1281555 - protein, 19 aa, Mycobacterium
TEILRLQRKLGVTTVYVTH

SEQ ID NO: 1281556 - protein, 24 aa, Mycobacterium
TEIVLMELGLDWDRIEALKDSGAI

SEQ ID NO: 1281557 - protein, 24 aa, Mycobacterium
TEIWDKGKAAVIWSETTVKDPDGT

SEQ ID NO: 1281558 - protein, 21 aa, Mycobacterium
TEIYVNFMPAKGLQAGESAPT

SEQ ID NO: 1281559 - protein, 31 aa, Mycobacterium
TEKEFTGAAPWVMVSNFRIKIDGCVGQSFIR

SEQ ID NO: 1281560 - protein, 25 aa, Mycobacterium
TEKFVKRMSEFTLGKGLDEKSTLGP

SEQ ID NO: 1281561 - protein, 21 aa, Mycobacterium
TEKNFKWIAKSADGWITTPRD

SEQ ID NO: 1281562 - protein, 24 aa, Mycobacterium
TEKPRGRRKTAIGYVVSDKMQKTI

SEQ ID NO: 1281563 - protein, 17 aa, Mycobacterium
TEKRAAIFAALADPSRL

SEQ ID NO: 1281564 - protein, 22 aa, Mycobacterium
TELADWKWVLDINLWGPIHGCH

SEQ ID NO: 1281565 - protein, 22 aa, Mycobacterium
TELDVLAGHDVVFLGLPHGHSA

SEQ ID NO: 1281566 - protein, 32 aa, Mycobacterium
TELEITEGVGFDKGFLSAYFVTDFDSQEAVLE

SEQ ID NO: 1281567 - protein, 21 aa, Mycobacterium
TELGWPASRIHFEHFGAGALD

SEQ ID NO: 1281568 - protein, 39 aa, Mycobacterium
TELLARLAATVQYVPMPSWLRINFAAATVTAMARGQLYQ

SEQ ID NO: 1281569 - protein, 17 aa, Mycobacterium
TELLDADGFVRVTPTLQ

SEQ ID NO: 1281570 - protein, 25 aa, Mycobacterium
TELLRRGGRCLAELDGTTSGVDVGW

SEQ ID NO: 1281571 - protein, 19 aa, Mycobacterium
TELMTRAGVEILVAAGPEF

SEQ ID NO: 1281572 - protein, 29 aa, Mycobacterium
TELPDGHLARLRFLRRYTEGLSGPVVVHA

SEQ ID NO: 1281573 - protein, 30 aa, Mycobacterium
TELPDGHLARLRFLRRYTEGLSGPVVVHAH

SEQ ID NO: 1281574 - protein, 24 aa, Mycobacterium
TELQTSFMLSPWAARTPIDVEVPF

SEQ ID NO: 1281575 - protein, 29 aa, Mycobacterium
TELRAGAKRTHWIWFVFPQLRGLGHSATA

SEQ ID NO: 1281576 - protein, 20 aa, Mycobacterium
TELRDSLGPDRVHTIVADVR

SEQ ID NO: 1281577 - protein, 26 aa, Mycobacterium
TELRPVAEIVRQTWRGIESVLDSART

SEQ ID NO: 1281578 - protein, 17 aa, Mycobacterium
TELSKALANFLFGDDDA

SEQ ID NO: 1281579 - protein, 25 aa, Mycobacterium
TELSRAVFSKGIFPAVDPLASSSTI

SEQ ID NO: 1281580 - protein, 25 aa, Mycobacterium
TELSRSVFSKGIFPAVDPLASSSTI

SEQ ID NO: 1281581 - protein, 19 aa, Mycobacterium
TELVAEVGCPVMTTESAQL

SEQ ID NO: 1281582 - protein, 17 aa, Mycobacterium
TELVKALLFSLFEGGLR

SEQ ID NO: 1281583 - protein, 20 aa, Mycobacterium
TEMFGIPVLTSYAATEFGGG

SEQ ID NO: 1281584 - protein, 27 aa, Mycobacterium
TEMFYSLVGGTAWSIRAGRAAARDFDR

SEQ ID NO: 1281585 - protein, 24 aa, Mycobacterium
TEMGRAALDLALFRAWYLHEELGL

SEQ ID NO: 1281586 - protein, 25 aa, Mycobacterium
TEMPRRLARFDGVLLPGGADVEPRR

SEQ ID NO: 1281587 - protein, 17 aa, Mycobacterium
TEMRHWWQVPLLGHHVL

SEQ ID NO: 1281588 - protein, 25 aa, Mycobacterium
TENFVRRRVPFFVDYVRTYTDLPFL

SEQ ID NO: 1281589 - protein, 26 aa, Mycobacterium
TENLRWAASFAAPWAVRRLRRITPGA

SEQ ID NO: 1281590 - protein, 20 aa, Mycobacterium
TEPARTWYLAMKPIAEDFGP

SEQ ID NO: 1281591 - protein, 20 aa, Mycobacterium
TEPELRPGPTSSEPPPPPLP

SEQ ID NO: 1281592 - protein, 25 aa, Mycobacterium
TEPFGGRVPPIWIGASGPRMLDIVG

SEQ ID NO: 1281593 - protein, 20 aa, Mycobacterium
TEPIAVIGLGCRMPGGISDP

SEQ ID NO: 1281594 - protein, 23 aa, Mycobacterium
TEPIAVVGIGCRLPGGVDNADDF

SEQ ID NO: 1281595 - protein, 32 aa, Mycobacterium
TEPMHPVLMDLCTGVAFPAFPALLAAEQGVSD

SEQ ID NO: 1281596 - protein, 23 aa, Mycobacterium
TEPRMKRAAQVIVAMRNQDRDAF

SEQ ID NO: 1281597 - protein, 19 aa, Mycobacterium
TEPWLGLFVTDASHTARLE

SEQ ID NO: 1281598 - protein, 22 aa, Mycobacterium
TEQLEILTGLWTAAPGETFDYS

SEQ ID NO: 1281599 - protein, 17 aa, Mycobacterium
TEQLGKIDAVFMPGDLV

SEQ ID NO: 1281600 - protein, 18 aa, Mycobacterium
TEQRRAAVDFSTPYFDVT

SEQ ID NO: 1281601 - protein, 28 aa, Mycobacterium
TERAAEFAEHIAPALARVPSRRMSTPQE

SEQ ID NO: 1281602 - protein, 20 aa, Mycobacterium
TERAELVAALVPHFQQALRT

SEQ ID NO: 1281603 - protein, 22 aa, Mycobacterium
TERAMAVARRIRTGSVNVNGAI

SEQ ID NO: 1281604 - protein, 20 aa, Mycobacterium
TERARHVALMGMAVTMVGAC

SEQ ID NO: 1281605 - protein, 17 aa, Mycobacterium
TERDSWYAAGSLPDTIT

SEQ ID NO: 1281606 - protein, 24 aa, Mycobacterium
TERGIRRHIRFGADVTAARFRDGK

SEQ ID NO: 1281607 - protein, 26 aa, Mycobacterium
TERLRVTGFTGVDVWDDWLSNDMDQE

SEQ ID NO: 1281608 - protein, 18 aa, Mycobacterium
TERLWPTLTAPLMTREQI

SEQ ID NO: 1281609 - protein, 25 aa, Mycobacterium
TERLYRTSVSPFGLVTGAWIDPPSS

SEQ ID NO: 1281610 - protein, 21 aa, Mycobacterium
TERMPMATVWAAMATAGALSL

SEQ ID NO: 1281611 - protein, 18 aa, Mycobacterium
TERPRRAAQHFVALTFQL

SEQ ID NO: 1281612 - protein, 17 aa, Mycobacterium
TERRVRRGRIQFVQQEG

SEQ ID NO: 1281613 - protein, 23 aa, Mycobacterium
TERSRRILLRGWEQFDEPVDRIV

SEQ ID NO: 1281614 - protein, 20 aa, Mycobacterium
TERVELRLLAPTVAVSQAPI

SEQ ID NO: 1281615 - protein, 24 aa, Mycobacterium
TERVLPAALLLKAVGVAAQRFQEL

SEQ ID NO: 1281616 - protein, 19 aa, Mycobacterium
TESALKFVGAATFEALSGN

SEQ ID NO: 1281617 - protein, 30 aa, Mycobacterium
TESAMRVCGGAAFSKHLPIERNFRDARAGA

SEQ ID NO: 1281618 - protein, 24 aa, Mycobacterium
TESIQYTRFAQWKLDPAVAPATAP

SEQ ID NO: 1281619 - protein, 20 aa, Mycobacterium
TESLPLIASSVMSKKIAEGT

SEQ ID NO: 1281620 - protein, 23 aa, Mycobacterium
TESNRSSAFLGFTNQYAAASYIY

SEQ ID NO: 1281621 - protein, 27 aa, Mycobacterium
TETAIALEHLLDFMPRFEVDFSGLQRV

SEQ ID NO: 1281622 - protein, 18 aa, Mycobacterium
TETEKLYLAGFFAGIEEG

SEQ ID NO: 1281623 - protein, 18 aa, Mycobacterium
TETFKILKRELSAEGTDC

SEQ ID NO: 1281624 - protein, 22 aa, Mycobacterium
TETRGVYRPSWTIADVAENLDA

SEQ ID NO: 1281625 - protein, 26 aa, Mycobacterium
TETSPLCVVGRLLPKHEGLSDAEKNQ

SEQ ID NO: 1281626 - protein, 17 aa, Mycobacterium
TEVEALWWDEKRTMWEV

SEQ ID NO: 1281627 - protein, 22 aa, Mycobacterium
TEVGIGIVRTMLRHAPKDEKTT

SEQ ID NO: 1281628 - protein, 23 aa, Mycobacterium
TEVGIGIVRTMLRHAPKDEKTTP

SEQ ID NO: 1281629 - protein, 17 aa, Mycobacterium
TEVIPFNEFGALAELGH

SEQ ID NO: 1281630 - protein, 17 aa, Mycobacterium
TEVLSWFAVDADAPDEF

SEQ ID NO: 1281631 - protein, 19 aa, Mycobacterium
TEVLSWFAVDSDAPADFKA

SEQ ID NO: 1281632 - protein, 18 aa, Mycobacterium
TEVLSWFAVDSDAPEAFK

SEQ ID NO: 1281633 - protein, 20 aa, Mycobacterium
TEVSCKFRPSGVDQELASAG

SEQ ID NO: 1281634 - protein, 21 aa, Mycobacterium
TEVWYRLGKTYRGKAQNLTQF

SEQ ID NO: 1281635 - protein, 21 aa, Mycobacterium
TEVYHAGSLIQKGRAIGPVEE

SEQ ID NO: 1281636 - protein, 17 aa, Mycobacterium
TEYARYCALRDEGRTDE

SEQ ID NO: 1281637 - protein, 20 aa, Mycobacterium
TEYNVRFTAVVPVPNDGKGA

SEQ ID NO: 1281638 - protein, 28 aa, Mycobacterium
TFAADWSFGFDVGMTFLEIHGPVPRLRE

SEQ ID NO: 1281639 - protein, 18 aa, Mycobacterium
TFAAITLEVDTRRWAGVP

SEQ ID NO: 1281640 - protein, 17 aa, Mycobacterium
TFADRLALCASDNDGSR

SEQ ID NO: 1281641 - protein, 18 aa, Mycobacterium
TFAGLATVRLPTDEELRE

SEQ ID NO: 1281642 - protein, 18 aa, Mycobacterium
TFAPRAYLADLFYAGEVP

SEQ ID NO: 1281643 - protein, 26 aa, Mycobacterium
TFASLPYRIMHEFQIPLYDQMRERDK

SEQ ID NO: 1281644 - protein, 25 aa, Mycobacterium
TFASQPPPGWRVIGTVGASDGTTAV

SEQ ID NO: 1281645 - protein, 20 aa, Mycobacterium
TFCRICEPLCGMIATVEDGR

SEQ ID NO: 1281646 - protein, 25 aa, Mycobacterium
TFDNEFFWKSGADGVLRIQECGDCK

SEQ ID NO: 1281647 - protein, 26 aa, Mycobacterium
TFDVYRSRIGGVRVVARIPRVSESVT

SEQ ID NO: 1281648 - protein, 17 aa, Mycobacterium
TFEEWWEPYTFGVGPAG

SEQ ID NO: 1281649 - protein, 18 aa, Mycobacterium
TFEVEFFARHGFAEIDGT

SEQ ID NO: 1281650 - protein, 17 aa, Mycobacterium
TFFQMYWTGGRDKLVGR

SEQ ID NO: 1281651 - protein, 26 aa, Mycobacterium
TFGPKGDTLYVRRGVDYVASHRAPQS

SEQ ID NO: 1281652 - protein, 25 aa, Mycobacterium
TFGRKIIDHQGLAFLLADMAAAVDA

SEQ ID NO: 1281653 - protein, 25 aa, Mycobacterium
TFGRKIIDHQGLAFLLADMAAAVDS

SEQ ID NO: 1281654 - protein, 25 aa, Mycobacterium
TFHAVPGTWSYRATGAHTYTLTAGI

SEQ ID NO: 1281655 - protein, 26 aa, Mycobacterium
TFIGPRPAGWWIRRRVHETAVHRADA

SEQ ID NO: 1281656 - protein, 21 aa, Mycobacterium
TFKTALWELIWTGWVTGDTFA

SEQ ID NO: 1281657 - protein, 21 aa, Mycobacterium
TFLKGRLQVIDHLKRHPEVFD

SEQ ID NO: 1281658 - protein, 23 aa, Mycobacterium
TFLVDCGRGVLQRLAAVGVGANN

SEQ ID NO: 1281659 - protein, 17 aa, Mycobacterium
TFQCAYHGWVYKPDGTF

SEQ ID NO: 1281660 - protein, 25 aa, Mycobacterium
TFRFNEVIHYWALEGDWDCFENHYP

SEQ ID NO: 1281661 - protein, 17 aa, Mycobacterium
TFRIHRRKKALLQRLPF

SEQ ID NO: 1281662 - protein, 20 aa, Mycobacterium
TFRQALRLGHNYVGTEHLLL

SEQ ID NO: 1281663 - protein, 23 aa, Mycobacterium
TFSEAYKVAALDVMNKLRALSQF

SEQ ID NO: 1281664 - protein, 31 aa, Mycobacterium
TFSKAYGLAGLRVGYGFCAPALGRTLWTMQL

SEQ ID NO: 1281665 - protein, 18 aa, Mycobacterium
TFSRGTAYALTWALAHQA

SEQ ID NO: 1281666 - protein, 22 aa, Mycobacterium
TFSRIPVMASFAPYELNFDNVA

SEQ ID NO: 1281667 - protein, 18 aa, Mycobacterium
TFSRMYQEVINFCKTNGQ

SEQ ID NO: 1281668 - protein, 20 aa, Mycobacterium
TFTSAPGMQCNRRMFEEIVV

SEQ ID NO: 1281669 - protein, 20 aa, Mycobacterium
TFYWAHATFFMLIIKTAEYF

SEQ ID NO: 1281670 - protein, 17 aa, Mycobacterium
TGAAPSSCVLGRNGVQC

SEQ ID NO: 1281671 - protein, 31 aa, Mycobacterium
TGADALASILSWQNWEEMFSIARFIGVSRPG

SEQ ID NO: 1281672 - protein, 24 aa, Mycobacterium
TGADALQIANVWGSYGSLVASPDG

SEQ ID NO: 1281673 - protein, 24 aa, Mycobacterium
TGADARGPALLIFDRRRDVWRVRQ

SEQ ID NO: 1281674 - protein, 18 aa, Mycobacterium
TGADGKVYFPAREADPAT

SEQ ID NO: 1281675 - protein, 22 aa, Mycobacterium
TGADLVGPVMIKFGSPDQKERY

SEQ ID NO: 1281676 - protein, 20 aa, Mycobacterium
TGADVSIAFVPPAFSKDAII

SEQ ID NO: 1281677 - protein, 17 aa, Mycobacterium
TGAFRVVQRASRSMQRK

SEQ ID NO: 1281678 - protein, 18 aa, Mycobacterium
TGAICRPGAGPMSLTGQP

SEQ ID NO: 1281679 - protein, 23 aa, Mycobacterium
TGAIVKRPRVIVDDYGNESIGVR

SEQ ID NO: 1281680 - protein, 26 aa, Mycobacterium
TGALPDRYARGWHCLGPVKNFLDGKP

SEQ ID NO: 1281681 - protein, 28 aa, Mycobacterium
TGAMGVPDYLGWDWKTKAGIPIVCVPGC

SEQ ID NO: 1281682 - protein, 20 aa, Mycobacterium
TGAMYRIVTLGVLRAGVDPA

SEQ ID NO: 1281683 - protein, 24 aa, Mycobacterium
TGAPVCAAGQCMLTSTATGSRMTY

SEQ ID NO: 1281684 - protein, 25 aa, Mycobacterium
TGAREVFRPREWQMDIVRDVLDSGA

SEQ ID NO: 1281685 - protein, 21 aa, Mycobacterium
TGARGLRAIMEEVLLPVMYDI

SEQ ID NO: 1281686 - protein, 21 aa, Mycobacterium
TGARLTVSIAAFGSTRSINAA

SEQ ID NO: 1281687 - protein, 24 aa, Mycobacterium
TGARSIPALVAWKLGLSSKNAKTI

SEQ ID NO: 1281688 - protein, 23 aa, Mycobacterium
TGARSVAALVAWKTGCSPHNAKT

SEQ ID NO: 1281689 - protein, 18 aa, Mycobacterium
TGARSVAALVAWKTGVSP

SEQ ID NO: 1281690 - protein, 26 aa, Mycobacterium
TGASPRYLLDFSRRFPDAAVVRLERD

SEQ ID NO: 1281691 - protein, 17 aa, Mycobacterium
TGAWIRLHRRFDIDAML

SEQ ID NO: 1281692 - protein, 18 aa, Mycobacterium
TGAYFGGKGCGFVALHQL

SEQ ID NO: 1281693 - protein, 19 aa, Mycobacterium
TGCELHLVEPLGFDLSEPK

SEQ ID NO: 1281694 - protein, 25 aa, Mycobacterium
TGDARPGRDVWVYGRAGKPCRRCGT

SEQ ID NO: 1281695 - protein, 27 aa, Mycobacterium
TGDDRVASLFLWHFVEEVEHRSSALII

SEQ ID NO: 1281696 - protein, 18 aa, Mycobacterium
TGDGIMAVFGAPLALEDH

SEQ ID NO: 1281697 - protein, 21 aa, Mycobacterium
TGDLRPGVLRAIALNLRAGVR

SEQ ID NO: 1281698 - protein, 23 aa, Mycobacterium
TGDMPIRLPCIGGHEGAGVVKAV

SEQ ID NO: 1281699 - protein, 22 aa, Mycobacterium
TGDPHVRFYAGVPIVTGDGHAL

SEQ ID NO: 1281700 - protein, 19 aa, Mycobacterium
TGDPLRWSMTRIRETLGDP

SEQ ID NO: 1281701 - protein, 25 aa, Mycobacterium
TGDQRPGEAFLAWQRFSQETPDFAV

SEQ ID NO: 1281702 - protein, 20 aa, Mycobacterium
TGDSMVRLPFGQSVRIGDVV

SEQ ID NO: 1281703 - protein, 25 aa, Mycobacterium
TGDVMNFRIARDIVQDEGIETDVVV

SEQ ID NO: 1281704 - protein, 18 aa, Mycobacterium
TGDWDVPIGGMGAVSEAM

SEQ ID NO: 1281705 - protein, 22 aa, Mycobacterium
TGECARCLTPITGEVEIDLTEL

SEQ ID NO: 1281706 - protein, 18 aa, Mycobacterium
TGEDWPVTTFDLAPLTDA

SEQ ID NO: 1281707 - protein, 21 aa, Mycobacterium
TGEGCVDPAAVIDLLEAPPDG

SEQ ID NO: 1281708 - protein, 18 aa, Mycobacterium
TGEGMSEWYRWLRAFAKD

SEQ ID NO: 1281709 - protein, 26 aa, Mycobacterium
TGELYNAWGSLGFERGALGLPTSAEI

SEQ ID NO: 1281710 - protein, 17 aa, Mycobacterium
TGEVYKALAATDWCGRW

SEQ ID NO: 1281711 - protein, 20 aa, Mycobacterium
TGFGEIFLDDVFVPDQDVIG

SEQ ID NO: 1281712 - protein, 19 aa, Mycobacterium
TGFNRLRLIERILERLPSK

SEQ ID NO: 1281713 - protein, 23 aa, Mycobacterium
TGFPVTVKGLSRFTDPAESRATI

SEQ ID NO: 1281714 - protein, 20 aa, Mycobacterium
TGFVPPWRLRYRDLGPSYIG

SEQ ID NO: 1281715 - protein, 31 aa, Mycobacterium
TGGAGGVGGKGIQGGQGLQGGQGGDGGTGGT

SEQ ID NO: 1281716 - protein, 25 aa, Mycobacterium
TGGAMLPLLIFASARANVPFTPLNY

SEQ ID NO: 1281717 - protein, 17 aa, Mycobacterium
TGGASRTTWAFSAHARS

SEQ ID NO: 1281718 - protein, 21 aa, Mycobacterium
TGGAVPAIIAEYLGLPQLTHV

SEQ ID NO: 1281719 - protein, 22 aa, Mycobacterium
TGGFTEFVPLPFVHQSSPLYLA

SEQ ID NO: 1281720 - protein, 23 aa, Mycobacterium
TGGGFRINMLAAYDAADELRAAH

SEQ ID NO: 1281721 - protein, 17 aa, Mycobacterium
TGGHRWASRPVSMICAA

SEQ ID NO: 1281722 - protein, 18 aa, Mycobacterium
TGGPEVLSFVERPQPTPG

SEQ ID NO: 1281723 - protein, 23 aa, Mycobacterium
TGGQRIDMFGARVEQLPEIWRRL

SEQ ID NO: 1281724 - protein, 19 aa, Mycobacterium
TGGRWWTDDGLWKEIVSTG

SEQ ID NO: 1281725 - protein, 19 aa, Mycobacterium
TGGTVAGTAVNDWVDENGE

SEQ ID NO: 1281726 - protein, 18 aa, Mycobacterium
TGHCRSCGDDFVLADFIL

SEQ ID NO: 1281727 - protein, 25 aa, Mycobacterium
TGHGKRWETLFTRHLPDVTALAPDL

SEQ ID NO: 1281728 - protein, 23 aa, Mycobacterium
TGHLRALSFPQWGLATPAAGWGI

SEQ ID NO: 1281729 - protein, 18 aa, Mycobacterium
TGHPARAAGLARFLDHVR

SEQ ID NO: 1281730 - protein, 17 aa, Mycobacterium
TGHPKRFLLADDPGAGK

SEQ ID NO: 1281731 - protein, 23 aa, Mycobacterium
TGHPQVDAFLWVKRPGESDGSCG

SEQ ID NO: 1281732 - protein, 17 aa, Mycobacterium
TGIEELARPLGIEPADV

SEQ ID NO: 1281733 - protein, 22 aa, Mycobacterium
TGIEIAEAFAMPPALERAWHAR

SEQ ID NO: 1281734 - protein, 27 aa, Mycobacterium
TGIGSCRDSAWLLVSILRQLGLAARFV

SEQ ID NO: 1281735 - protein, 17 aa, Mycobacterium
TGILPAGGPFTEAGART

SEQ ID NO: 1281736 - protein, 25 aa, Mycobacterium
TGIMAGAVCPVEVMKRCVEEMNMSE

SEQ ID NO: 1281737 - protein, 25 aa, Mycobacterium
TGIYGHSRACAWAIADGVIGRSTTP

SEQ ID NO: 1281738 - protein, 33 aa, Mycobacterium
TGIYPSVTSLFAFGGRCGLICDGADGTEQNPNG

SEQ ID NO: 1281739 - protein, 18 aa, Mycobacterium
TGKCASWYLDAHGNNTTL

SEQ ID NO: 1281740 - protein, 23 aa, Mycobacterium
TGKIRPSMLEFMDSAAINAVEDK

SEQ ID NO: 1281741 - protein, 17 aa, Mycobacterium
TGKLWWLQARPITTLPG

SEQ ID NO: 1281742 - protein, 23 aa, Mycobacterium
TGKPVRLATEFDVPGSVDNIDFF

SEQ ID NO: 1281743 - protein, 18 aa, Mycobacterium
TGKSHLLIGLGLAACEQG

SEQ ID NO: 1281744 - protein, 27 aa, Mycobacterium
TGKTRKWLAQSAVLWPGPAVVSSSKDD

SEQ ID NO: 1281745 - protein, 18 aa, Mycobacterium
TGLAGGFGAPGVPLTHSL

SEQ ID NO: 1281746 - protein, 19 aa, Mycobacterium
TGLAQCAELTWQLRGDADK

SEQ ID NO: 1281747 - protein, 19 aa, Mycobacterium
TGLAQCSELTWQLRGTADK

SEQ ID NO: 1281748 - protein, 17 aa, Mycobacterium
TGLDLAPIIERALVKAP

SEQ ID NO: 1281749 - protein, 24 aa, Mycobacterium
TGLEHARQSWATNQAALFNGIHVW

SEQ ID NO: 1281750 - protein, 23 aa, Mycobacterium
TGLFLLQNMFGVWPVDGVVTDEL

SEQ ID NO: 1281751 - protein, 18 aa, Mycobacterium
TGLLDRRLPDFAPAPATD

SEQ ID NO: 1281752 - protein, 24 aa, Mycobacterium
TGLLKPSRLHILPTRDFHDQALEP

SEQ ID NO: 1281753 - protein, 22 aa, Mycobacterium
TGLPEGLPLIVGGADHVLSAYA

SEQ ID NO: 1281754 - protein, 24 aa, Mycobacterium
TGLPEYRNGGLLLDHGVLRLRDPE

SEQ ID NO: 1281755 - protein, 17 aa, Mycobacterium
TGLPVDAFKTTVQRFNG

SEQ ID NO: 1281756 - protein, 17 aa, Mycobacterium
TGLRYYAAAFFEVIPQV

SEQ ID NO: 1281757 - protein, 25 aa, Mycobacterium
TGLRYYRAAFFEVIPRVNAEVRSAL

SEQ ID NO: 1281758 - protein, 24 aa, Mycobacterium
TGLTPRRMACYLGDRELVCEGGSF

SEQ ID NO: 1281759 - protein, 17 aa, Mycobacterium
TGLTRSGYEFDIPNLQV

SEQ ID NO: 1281760 - protein, 29 aa, Mycobacterium
TGMDMRAYMNMFMRHGELRRSVEEIPGGV

SEQ ID NO: 1281761 - protein, 19 aa, Mycobacterium
TGMELRAAIDAGDVVVTEK

SEQ ID NO: 1281762 - protein, 26 aa, Mycobacterium
TGMGSELSLFEWADAIVAPLGMVLTR

SEQ ID NO: 1281763 - protein, 20 aa, Mycobacterium
TGMPHVTWKFATSVDGRSAA

SEQ ID NO: 1281764 - protein, 19 aa, Mycobacterium
TGMTCGHCERSVREEVGGI

SEQ ID NO: 1281765 - protein, 21 aa, Mycobacterium
TGMYELEFPGPQLSSPDGRGP

SEQ ID NO: 1281766 - protein, 17 aa, Mycobacterium
TGNAIKKLLAFRKEDTT

SEQ ID NO: 1281767 - protein, 18 aa, Mycobacterium
TGNAVLYEPAHPLISEML

SEQ ID NO: 1281768 - protein, 18 aa, Mycobacterium
TGNPLKDVNVFRPDVEAP

SEQ ID NO: 1281769 - protein, 20 aa, Mycobacterium
TGPDYRRWPTAAEVLTAGTL

SEQ ID NO: 1281770 - protein, 22 aa, Mycobacterium
TGPEVEAFLARREYLHDTGDEQ

SEQ ID NO: 1281771 - protein, 17 aa, Mycobacterium
TGPFLVQYGKTWRTIAK

SEQ ID NO: 1281772 - protein, 29 aa, Mycobacterium
TGPGRPAGHLLRQRWQPVYASEELEAGRA

SEQ ID NO: 1281773 - protein, 21 aa, Mycobacterium
TGQAICAFVILKSSAHGGEAN

SEQ ID NO: 1281774 - protein, 17 aa, Mycobacterium
TGQARVWVAEGRATALR

SEQ ID NO: 1281775 - protein, 22 aa, Mycobacterium
TGQASISLAVRFLQLQHRRAEK

SEQ ID NO: 1281776 - protein, 18 aa, Mycobacterium
TGQGGWPMTCFLTPDGRP

SEQ ID NO: 1281777 - protein, 19 aa, Mycobacterium
TGQLDFLRELWNMRNSAEF

SEQ ID NO: 1281778 - protein, 17 aa, Mycobacterium
TGQTCLAGSRLLVHESV

SEQ ID NO: 1281779 - protein, 18 aa, Mycobacterium
TGRADWARVTGLDADGTP

SEQ ID NO: 1281780 - protein, 21 aa, Mycobacterium
TGRENLLMFGRLQGLKKKVAK

SEQ ID NO: 1281781 - protein, 23 aa, Mycobacterium
TGREVDAFFARREYLHHVSDTDL

SEQ ID NO: 1281782 - protein, 23 aa, Mycobacterium
TGRFADDGPRRFIETARVFAQFT

SEQ ID NO: 1281783 - protein, 24 aa, Mycobacterium
TGRFADDGPRRFIETARVFAQFTL

SEQ ID NO: 1281784 - protein, 18 aa, Mycobacterium
TGRFPGVDITLVVDRPHL

SEQ ID NO: 1281785 - protein, 21 aa, Mycobacterium
TGRGSVKMRGVVEIEEDSRGR

SEQ ID NO: 1281786 - protein, 26 aa, Mycobacterium
TGRHGGWLPGDWPAKVLDLQPLTDEQ

SEQ ID NO: 1281787 - protein, 22 aa, Mycobacterium
TGRKVIDGRALADFARDHASPP

SEQ ID NO: 1281788 - protein, 21 aa, Mycobacterium
TGRLWERFSRELSRYGLGVLR

SEQ ID NO: 1281789 - protein, 19 aa, Mycobacterium
TGRMGAPMVTRLVQAGHDV

SEQ ID NO: 1281790 - protein, 19 aa, Mycobacterium
TGRRAHIVVADLAHAEDTA

SEQ ID NO: 1281791 - protein, 20 aa, Mycobacterium
TGRRGKYLWLTLDGGDEPLA

SEQ ID NO: 1281792 - protein, 24 aa, Mycobacterium
TGRRMSRLRILTAVTLGRLERSPL

SEQ ID NO: 1281793 - protein, 23 aa, Mycobacterium
TGRSEGRWPTLRTLDEQLDDDLA

SEQ ID NO: 1281794 - protein, 25 aa, Mycobacterium
TGRWTFTPTASTLVSAWSSDTPTPV

SEQ ID NO: 1281795 - protein, 22 aa, Mycobacterium
TGRYLGCVHLQRLLREPPAGLV

SEQ ID NO: 1281796 - protein, 21 aa, Mycobacterium
TGSAVFRMVSRRGDLTDVDLS

SEQ ID NO: 1281797 - protein, 23 aa, Mycobacterium
TGSLRVNFLRRLVAGGECRYSAT

SEQ ID NO: 1281798 - protein, 18 aa, Mycobacterium
TGSMFFTPIMDFLNNPPP

SEQ ID NO: 1281799 - protein, 22 aa, Mycobacterium
TGTGRRGKYLWLTLGDGADEPL

SEQ ID NO: 1281800 - protein, 19 aa, Mycobacterium
TGTNMLFTMRAAWAEADSC

SEQ ID NO: 1281801 - protein, 23 aa, Mycobacterium
TGTRAHSARSWLGDNAIHKLSDV

SEQ ID NO: 1281802 - protein, 18 aa, Mycobacterium
TGTRYPVKVEKVAGTMPP

SEQ ID NO: 1281803 - protein, 25 aa, Mycobacterium
TGVFAKLEAALVYTTRELPSDPSIS

SEQ ID NO: 1281804 - protein, 23 aa, Mycobacterium
TGVGRPQFSAVVECAAAARELGG

SEQ ID NO: 1281805 - protein, 19 aa, Mycobacterium
TGVKGRFLAWFYTAVGQVP

SEQ ID NO: 1281806 - protein, 27 aa, Mycobacterium
TGVPAERWGWLPLLTGLAVAHVVREDY

SEQ ID NO: 1281807 - protein, 28 aa, Mycobacterium
TGVPAICFACGYPTMHPGLCAYCRPGPM

SEQ ID NO: 1281808 - protein, 20 aa, Mycobacterium
TGVQRFGLRPVTGIDPKAVS

SEQ ID NO: 1281809 - protein, 26 aa, Mycobacterium
TGVRLWPAQPLTLLAPWDGEVRSDGA

SEQ ID NO: 1281810 - protein, 21 aa, Mycobacterium
TGVSAVSIWMGILLTDKLRSA

SEQ ID NO: 1281811 - protein, 26 aa, Mycobacterium
TGVWDVRASFLPAIYFEGVGMAGGIA

SEQ ID NO: 1281812 - protein, 20 aa, Mycobacterium
TGWANPFAFVRAVRENFDGP

SEQ ID NO: 1281813 - protein, 29 aa, Mycobacterium
TGYERRGRWNVPRRLTTFALWGGGVVDLR

SEQ ID NO: 1281814 - protein, 18 aa, Mycobacterium
TGYRCVWLGVNQENRRAQ

SEQ ID NO: 1281815 - protein, 18 aa, Mycobacterium
TGYSWGPLAWMLLAQALG

SEQ ID NO: 1281816 - protein, 19 aa, Mycobacterium
THALHAIGVATTVEECEHF

SEQ ID NO: 1281817 - protein, 23 aa, Mycobacterium
THAREANWMFALVRTTRSEKKQR

SEQ ID NO: 1281818 - protein, 22 aa, Mycobacterium
THATELLAVFDIYRTMPGALLT

SEQ ID NO: 1281819 - protein, 20 aa, Mycobacterium
THAVADLGATGWSLDPGHLD

SEQ ID NO: 1281820 - protein, 26 aa, Mycobacterium
THDRWFLDEVCTVTWEVHDRIVEPFD

SEQ ID NO: 1281821 - protein, 18 aa, Mycobacterium
THFFDAFFAAAVDAGIRQ

SEQ ID NO: 1281822 - protein, 24 aa, Mycobacterium
THGFCGAMINGLIEGRFLDDPAFA

SEQ ID NO: 1281823 - protein, 22 aa, Mycobacterium
THGGVKYCYNSAIANCRIQVAG

SEQ ID NO: 1281824 - protein, 24 aa, Mycobacterium
THHRWCRECLRAYTVQGTAGSGVA

SEQ ID NO: 1281825 - protein, 32 aa, Mycobacterium
THIGEIYEDLAWFCIRAWRFGAPETLGAGGLG

SEQ ID NO: 1281826 - protein, 20 aa, Mycobacterium
THLAGDKVVGWSGGSEPGHE

SEQ ID NO: 1281827 - protein, 19 aa, Mycobacterium
THLDPRFAPHPMVTGDPHV

SEQ ID NO: 1281828 - protein, 19 aa, Mycobacterium
THLIPRDSIGWVEAEGDYA

SEQ ID NO: 1281829 - protein, 17 aa, Mycobacterium
THLKLTSQFDVLKDLFY

SEQ ID NO: 1281830 - protein, 19 aa, Mycobacterium
THLPNLRVESGQGLIVDFV

SEQ ID NO: 1281831 - protein, 17 aa, Mycobacterium
THLRANAPVSWVEVPGY

SEQ ID NO: 1281832 - protein, 21 aa, Mycobacterium
THLRPLLFTIAYEILGSATES

SEQ ID NO: 1281833 - protein, 23 aa, Mycobacterium
THLRVPAPEAFDIAAGRIEKGTT

SEQ ID NO: 1281834 - protein, 24 aa, Mycobacterium
THLTRLRLITSLLDRGYNIAHVKE

SEQ ID NO: 1281835 - protein, 23 aa, Mycobacterium
THLYVCGPASFIDFVAATATELG

SEQ ID NO: 1281836 - protein, 17 aa, Mycobacterium
THMLAWVLAAQGDLDEM

SEQ ID NO: 1281837 - protein, 24 aa, Mycobacterium
THNTIFPNFSWLGAHSTMRVWHPR

SEQ ID NO: 1281838 - protein, 24 aa, Mycobacterium
THPDGTSAFALWFTGGIFVDDHGR

SEQ ID NO: 1281839 - protein, 31 aa, Mycobacterium
THPGLDRILQWDLRFGMHVVDELSAHVGEPA

SEQ ID NO: 1281840 - protein, 17 aa, Mycobacterium
THRARAVILAMGAAARH

SEQ ID NO: 1281841 - protein, 24 aa, Mycobacterium
THRECPSDVIGEIWVHGENVAAGY

SEQ ID NO: 1281842 - protein, 19 aa, Mycobacterium
THREHIFDGIESCVDALNG

SEQ ID NO: 1281843 - protein, 17 aa, Mycobacterium
THRELPPRRPVPLRLRD

SEQ ID NO: 1281844 - protein, 17 aa, Mycobacterium
THRLLQTGVTWKDLGLV

SEQ ID NO: 1281845 - protein, 17 aa, Mycobacterium
THRPGNGRTEWTPPKEQ

SEQ ID NO: 1281846 - protein, 28 aa, Mycobacterium
THRPPGCRFWNLVVWNQFMAVPGVSDAR

SEQ ID NO: 1281847 - protein, 17 aa, Mycobacterium
THRSAAIGLRREAANFV

SEQ ID NO: 1281848 - protein, 23 aa, Mycobacterium
THSVRLSDFVLVAPGSLPLTTSG

SEQ ID NO: 1281849 - protein, 23 aa, Mycobacterium
THVRECLKHGTVVELTHLRADAQ

SEQ ID NO: 1281850 - protein, 24 aa, Mycobacterium
THVVRRYGADFEHPGPRLRDYVLA

SEQ ID NO: 1281851 - protein, 27 aa, Mycobacterium
THYHKIHLYDAFGFRESRTVAPGSEPA

SEQ ID NO: 1281852 - protein, 18 aa, Mycobacterium
TIAAWLWSGRGAVVAGAA

SEQ ID NO: 1281853 - protein, 17 aa, Mycobacterium
TIAEQEALLGWLDDETD

SEQ ID NO: 1281854 - protein, 17 aa, Mycobacterium
TIAEWHDKCANKCADIA

SEQ ID NO: 1281855 - protein, 24 aa, Mycobacterium
TIAGAKENPGWHLLRTIAGRITTP

SEQ ID NO: 1281856 - protein, 24 aa, Mycobacterium
TIAKLRAARRLWARVAEVVGEPAA

SEQ ID NO: 1281857 - protein, 30 aa, Mycobacterium
TIEPGAQLSLPWKRDFNALVYVLSGRGAVG

SEQ ID NO: 1281858 - protein, 23 aa, Mycobacterium
TIGELKLSLFDDIFNTPAGQEFG

SEQ ID NO: 1281859 - protein, 25 aa, Mycobacterium
TIGTRRPRLVAAPLDGPAPLSSSQL

SEQ ID NO: 1281860 - protein, 30 aa, Mycobacterium
TIGVPRWLQLPARLVLSALIGRVRIPDPLA

SEQ ID NO: 1281861 - protein, 19 aa, Mycobacterium
TIIESGVRSGEFIDVSPEE

SEQ ID NO: 1281862 - protein, 19 aa, Mycobacterium
TIIGDGLVNVGIGDVTILE

SEQ ID NO: 1281863 - protein, 18 aa, Mycobacterium
TILARLALQAGMPDGVLN

SEQ ID NO: 1281864 - protein, 23 aa, Mycobacterium
TILEIVDDIFLPLATHFGTNITR

SEQ ID NO: 1281865 - protein, 28 aa, Mycobacterium
TILLPHFGAVWGRYVYDRLDIIRANLTA

SEQ ID NO: 1281866 - protein, 22 aa, Mycobacterium
TIRARFGRLDALILNASGDDPH

SEQ ID NO: 1281867 - protein, 22 aa, Mycobacterium
TIRLGKYDIGIAIGLDKHPRGA

SEQ ID NO: 1281868 - protein, 23 aa, Mycobacterium
TIRRDLKVLAGRRLLKRVHGGAV

SEQ ID NO: 1281869 - protein, 22 aa, Mycobacterium
TIRRKTRIAGLLTLLFAQPLSR

SEQ ID NO: 1281870 - protein, 24 aa, Mycobacterium
TISELLHQAALAYERGDHRGAEAI

SEQ ID NO: 1281871 - protein, 23 aa, Mycobacterium
TISGLKFKIRFLRVNERHHSVAI

SEQ ID NO: 1281872 - protein, 20 aa, Mycobacterium
TISKSAKWERKPVKGAKQAG

SEQ ID NO: 1281873 - protein, 26 aa, Mycobacterium
TITARDRFGGVGAIVLTIPIAPTNTS

SEQ ID NO: 1281874 - protein, 24 aa, Mycobacterium
TITDRLKDVIIRGGETISSAQVED

SEQ ID NO: 1281875 - protein, 26 aa, Mycobacterium
TITKVLEPRGLRYLVVINNWDPRDGT

SEQ ID NO: 1281876 - protein, 18 aa, Mycobacterium
TIVDKWRAAGVRMADERD

SEQ ID NO: 1281877 - protein, 23 aa, Mycobacterium
TKAKIAACGWTVIAVFPTAQDQG

SEQ ID NO: 1281878 - protein, 23 aa, Mycobacterium
TKALRTGYVAAFSVPANQLPDEV

SEQ ID NO: 1281879 - protein, 17 aa, Mycobacterium
TKASPWLTRHPEMPEWH

SEQ ID NO: 1281880 - protein, 27 aa, Mycobacterium
TKAVIICPIGFVADHIEVVWDLDSEVR

SEQ ID NO: 1281881 - protein, 22 aa, Mycobacterium
TKAYLARLVTRQALNALRAQSR

SEQ ID NO: 1281882 - protein, 27 aa, Mycobacterium
TKAYRAGPGLDLLAFSVLRRLDVGDRA

SEQ ID NO: 1281883 - protein, 20 aa, Mycobacterium
TKCEIADAGGVTVTQNGPGS

SEQ ID NO: 1281884 - protein, 24 aa, Mycobacterium
TKDELQPRLAPFANKNPDNGVGLH

SEQ ID NO: 1281885 - protein, 19 aa, Mycobacterium
TKDHIEAIANWDPEAEPSI

SEQ ID NO: 1281886 - protein, 23 aa, Mycobacterium
TKDLPAATGEDIVWADAVIFGSP

SEQ ID NO: 1281887 - protein, 26 aa, Mycobacterium
TKDRFAGDAQFDWGRAEAAQDAGQTL

SEQ ID NO: 1281888 - protein, 18 aa, Mycobacterium
TKEACDFRDSLGELNEAG

SEQ ID NO: 1281889 - protein, 22 aa, Mycobacterium
TKELRPQLILLDVYLPDMTGLD

SEQ ID NO: 1281890 - protein, 17 aa, Mycobacterium
TKETLGWIALNQRANAA

SEQ ID NO: 1281891 - protein, 19 aa, Mycobacterium
TKFILALFVDLRGKPCAKL

SEQ ID NO: 1281892 - protein, 17 aa, Mycobacterium
TKFPEPDTDFELMAVAL

SEQ ID NO: 1281893 - protein, 26 aa, Mycobacterium
TKGFKFSTYATWWIRQAITRGMADQS

SEQ ID NO: 1281894 - protein, 17 aa, Mycobacterium
TKGLSLFFVPKFHFDPE

SEQ ID NO: 1281895 - protein, 25 aa, Mycobacterium
TKHDLGIAIVRVMARHAPKAANPVS

SEQ ID NO: 1281896 - protein, 18 aa, Mycobacterium
TKIGGLARIVHRPILRAR

SEQ ID NO: 1281897 - protein, 17 aa, Mycobacterium
TKLHFNHFVLKLPIRPP

SEQ ID NO: 1281898 - protein, 21 aa, Mycobacterium
TKLLGSAVVEFARHPEQWQML

SEQ ID NO: 1281899 - protein, 26 aa, Mycobacterium
TKNPSRVLGLHFFNPVPVLPLVELVN

SEQ ID NO: 1281900 - protein, 20 aa, Mycobacterium
TKPEQLAWDELKAMWRADAR

SEQ ID NO: 1281901 - protein, 17 aa, Mycobacterium
TKPGTVCGPLISERQRE

SEQ ID NO: 1281902 - protein, 18 aa, Mycobacterium
TKPMPSMPVGFWNDPDGK

SEQ ID NO: 1281903 - protein, 23 aa, Mycobacterium
TKPPRIMTAALVLPVAMVDSELP

SEQ ID NO: 1281904 - protein, 17 aa, Mycobacterium
TKPRPLLFYQGQYTGIE

SEQ ID NO: 1281905 - protein, 36 aa, Mycobacterium
TKQALTEAVLWPLQHPETFQRLGVQPPRGVLLYGPP

SEQ ID NO: 1281906 - protein, 24 aa, Mycobacterium
TKQAVGPCYAITPWNFPLAMGTRK

SEQ ID NO: 1281907 - protein, 19 aa, Mycobacterium
TKRVRAVDFTVGYEVRSVG

SEQ ID NO: 1281908 - protein, 25 aa, Mycobacterium
TKSSGWRLTGQKVWTSAAHKAHWGV

SEQ ID NO: 1281909 - protein, 23 aa, Mycobacterium
TKVDGGWRIDGHKIWTSSAHTAD

SEQ ID NO: 1281910 - protein, 29 aa, Mycobacterium
TKVDPAVMLKAKFKLPFYNTSRWTFAALV

SEQ ID NO: 1281911 - protein, 19 aa, Mycobacterium
TKVKFDIAIDLSVPLPGFI

SEQ ID NO: 1281912 - protein, 18 aa, Mycobacterium
TKVPRFAGPATFARLPRI

SEQ ID NO: 1281913 - protein, 22 aa, Mycobacterium
TKVRRLRRLAGVWLAQQPGHWA

SEQ ID NO: 1281914 - protein, 17 aa, Mycobacterium
TLAALPMNLPASVAPLA

SEQ ID NO: 1281915 - protein, 20 aa, Mycobacterium
TLAAQGFHVICVARREAPIQ

SEQ ID NO: 1281916 - protein, 19 aa, Mycobacterium
TLAAVRARIDESFGVGAGE

SEQ ID NO: 1281917 - protein, 22 aa, Mycobacterium
TLACQPANLLIEKTGWTTHRPG

SEQ ID NO: 1281918 - protein, 17 aa, Mycobacterium
TLADAVEVIERLLAQPD

SEQ ID NO: 1281919 - protein, 23 aa, Mycobacterium
TLADLGCAVLMELGPQPVLIAAA

SEQ ID NO: 1281920 - protein, 20 aa, Mycobacterium
TLADLGCRLLMEIGPQPVLT

SEQ ID NO: 1281921 - protein, 19 aa, Mycobacterium
TLADLGCSVLMEIGPQPFL

SEQ ID NO: 1281922 - protein, 24 aa, Mycobacterium
TLADRTTAAWLWSHRQGVVSGLAA

SEQ ID NO: 1281923 - protein, 28 aa, Mycobacterium
TLAGTRRGWLRCRLLEPSPGQDTYSESP

SEQ ID NO: 1281924 - protein, 24 aa, Mycobacterium
TLALAREMCDAAGLDGVDPAETLR

SEQ ID NO: 1281925 - protein, 24 aa, Mycobacterium
TLAPHLVKPLPFLFPLTNRGWERP

SEQ ID NO: 1281926 - protein, 29 aa, Mycobacterium
TLAPPLNMNPHWLGAHPTYTLSKYGMTLL

SEQ ID NO: 1281927 - protein, 19 aa, Mycobacterium
TLARMVVDINVPRAEVVRL

SEQ ID NO: 1281928 - protein, 32 aa, Mycobacterium
TLARRLGLERQWLHARSLAFAHPADGRRIEIT

SEQ ID NO: 1281929 - protein, 17 aa, Mycobacterium
TLCAGWKTRDLAAHLYV

SEQ ID NO: 1281930 - protein, 24 aa, Mycobacterium
TLDCLKSYLPKLAVTYGTAMATGP

SEQ ID NO: 1281931 - protein, 18 aa, Mycobacterium
TLDEGRIARIWLNRPDAQ

SEQ ID NO: 1281932 - protein, 17 aa, Mycobacterium
TLDEVKFSYELGACTKD

SEQ ID NO: 1281933 - protein, 18 aa, Mycobacterium
TLDEVLAAVGMSRSTYYD

SEQ ID NO: 1281934 - protein, 26 aa, Mycobacterium
TLDIFSIRIPKPWFVLMPTPVWDQMF

SEQ ID NO: 1281935 - protein, 24 aa, Mycobacterium
TLDIGFMESVIWVFKQLWDKGLAY

SEQ ID NO: 1281936 - protein, 24 aa, Mycobacterium
TLDPEVFDGVVAKVAIINVDGSTL

SEQ ID NO: 1281937 - protein, 18 aa, Mycobacterium
TLDQLSLVWSGAASDTAI

SEQ ID NO: 1281938 - protein, 18 aa, Mycobacterium
TLDYRTYSAVGWTIEADE

SEQ ID NO: 1281939 - protein, 19 aa, Mycobacterium
TLEALGLRIDLGPDEVARC

SEQ ID NO: 1281940 - protein, 19 aa, Mycobacterium
TLEELAALVTVLAGAGGGA

SEQ ID NO: 1281941 - protein, 21 aa, Mycobacterium
TLEELSRKVAAAAAQYVDQDG

SEQ ID NO: 1281942 - protein, 21 aa, Mycobacterium
TLEGLAAIPGVRIIGPATAER

SEQ ID NO: 1281943 - protein, 22 aa, Mycobacterium
TLEHYRMLTSRGVTAGLTVGPW

SEQ ID NO: 1281944 - protein, 17 aa, Mycobacterium
TLELGGKSPNIFFNDVL

SEQ ID NO: 1281945 - protein, 24 aa, Mycobacterium
TLELLPALRSAGGHVVFINSGAGI

SEQ ID NO: 1281946 - protein, 21 aa, Mycobacterium
TLELRTSWRNPPEVLHLANEV

SEQ ID NO: 1281947 - protein, 18 aa, Mycobacterium
TLEQWAELGAAALDDAGL

SEQ ID NO: 1281948 - protein, 22 aa, Mycobacterium
TLERPEILVDFEVGESVTVMDG

SEQ ID NO: 1281949 - protein, 24 aa, Mycobacterium
TLESRAVVGYDRCFMAQKGESKVV

SEQ ID NO: 1281950 - protein, 23 aa, Mycobacterium
TLEVDRDCFARIAPGLPSNVIRV

SEQ ID NO: 1281951 - protein, 27 aa, Mycobacterium
TLFDALLPRYVATRVYAALLEAAASES

SEQ ID NO: 1281952 - protein, 17 aa, Mycobacterium
TLFGLVNCAGILRDSFL

SEQ ID NO: 1281953 - protein, 18 aa, Mycobacterium
TLFYRHPAAGYKFADAAA

SEQ ID NO: 1281954 - protein, 19 aa, Mycobacterium
TLGAGSRVLPMRSEWALVS

SEQ ID NO: 1281955 - protein, 19 aa, Mycobacterium
TLGALSVSWREEWRAPFEP

SEQ ID NO: 1281956 - protein, 24 aa, Mycobacterium
TLGHAAEVQRCGGGTGFAFSRLRP

SEQ ID NO: 1281957 - protein, 27 aa, Mycobacterium
TLGHRKGFLQFRWQRVSRELTPADGPT

SEQ ID NO: 1281958 - protein, 17 aa, Mycobacterium
TLGHYDGLLAWLRGLVR

SEQ ID NO: 1281959 - protein, 21 aa, Mycobacterium
TLGIPEVRFTAALTSGGGGSA

SEQ ID NO: 1281960 - protein, 25 aa, Mycobacterium
TLGLPWRTYLLHARMLRAMALLTAP

SEQ ID NO: 1281961 - protein, 18 aa, Mycobacterium
TLGQLTFRELWSDAEAQA

SEQ ID NO: 1281962 - protein, 21 aa, Mycobacterium
TLGQYADWIFCLVRTDPDAPK

SEQ ID NO: 1281963 - protein, 22 aa, Mycobacterium
TLGRHFPFDPAQVVIPEPQPID

SEQ ID NO: 1281964 - protein, 18 aa, Mycobacterium
TLGRRLSKFWLTGPQAGT

SEQ ID NO: 1281965 - protein, 27 aa, Mycobacterium
TLGSYRWLRPHGRRTAQEIAVEFSTAL

SEQ ID NO: 1281966 - protein, 24 aa, Mycobacterium
TLHLLRPLFAAGLGGRLGSGRQWL

SEQ ID NO: 1281967 - protein, 19 aa, Mycobacterium
TLHPRWSAELAEISAAAGS

SEQ ID NO: 1281968 - protein, 18 aa, Mycobacterium
TLHTNWARAIEVLHAAEL

SEQ ID NO: 1281969 - protein, 30 aa, Mycobacterium
TLIASWLNYLPPRLVPPVFRHQARRRDSSM

SEQ ID NO: 1281970 - protein, 18 aa, Mycobacterium
TLICSSVAPMGRPTKVDG

SEQ ID NO: 1281971 - protein, 17 aa, Mycobacterium
TLIDRICVLPGSDTQDR

SEQ ID NO: 1281972 - protein, 22 aa, Mycobacterium
TLIPELRSAGVRVVLATVAGST

SEQ ID NO: 1281973 - protein, 24 aa, Mycobacterium
TLIPRPQRMYLRFAEPIDTTKPAA

SEQ ID NO: 1281974 - protein, 25 aa, Mycobacterium
TLIPRPQRMYLRFAPPIDTAKPARV

SEQ ID NO: 1281975 - protein, 17 aa, Mycobacterium
TLIRRLGVLEVPRPQLR

SEQ ID NO: 1281976 - protein, 19 aa, Mycobacterium
TLIVDPYFRDAIEAAVDSW

SEQ ID NO: 1281977 - protein, 23 aa, Mycobacterium
TLKTASPDARWEGEASDAYSKAS

SEQ ID NO: 1281978 - protein, 27 aa, Mycobacterium
TLLDIGCGWGATLLRALDKYDVNVIGL

SEQ ID NO: 1281979 - protein, 27 aa, Mycobacterium
TLLDIGCGWGSTIARAVEKYDVNVIGL

SEQ ID NO: 1281980 - protein, 25 aa, Mycobacterium
TLLDRTKPLWEMWVIEGCAKADTLA

SEQ ID NO: 1281981 - protein, 27 aa, Mycobacterium
TLLDTHPFAWLPMLSRVLGSARLDADA

SEQ ID NO: 1281982 - protein, 22 aa, Mycobacterium
TLLKLLHPVMPFVTEVLWKTLT

SEQ ID NO: 1281983 - protein, 19 aa, Mycobacterium
TLLLKKRFFSSPVAFARTV

SEQ ID NO: 1281984 - protein, 23 aa, Mycobacterium
TLLLKKRFFSSPVAFARTVDVYK

SEQ ID NO: 1281985 - protein, 18 aa, Mycobacterium
TLLMTGFGFAEPTATPSW

SEQ ID NO: 1281986 - protein, 25 aa, Mycobacterium
TLLPGGLNWPLDLTVADGRLYVADG

SEQ ID NO: 1281987 - protein, 18 aa, Mycobacterium
TLLPSWLAYLPPATTPRI

SEQ ID NO: 1281988 - protein, 21 aa, Mycobacterium
TLLRHHFRRIIGVTPSDYRRR

SEQ ID NO: 1281989 - protein, 30 aa, Mycobacterium
TLLRRIGLAAAKYWVCKRATPHAAEAMECL

SEQ ID NO: 1281990 - protein, 28 aa, Mycobacterium
TLLVEGRAAVVVPALWTVRRITDGGGSA

SEQ ID NO: 1281991 - protein, 18 aa, Mycobacterium
TLMQRPALLLADEPVASL

SEQ ID NO: 1281992 - protein, 31 aa, Mycobacterium
TLNRPERMNSWGGGLAQAFYRCIDRAEADPH

SEQ ID NO: 1281993 - protein, 20 aa, Mycobacterium
TLNRSLLPAFDRQYRQVMSR

SEQ ID NO: 1281994 - protein, 19 aa, Mycobacterium
TLNSMKALWARPRDEVSDE

SEQ ID NO: 1281995 - protein, 17 aa, Mycobacterium
TLPDGAPHTDLRGIGGC

SEQ ID NO: 1281996 - protein, 18 aa, Mycobacterium
TLPDRVLLIPLARNRIEY

SEQ ID NO: 1281997 - protein, 27 aa, Mycobacterium
TLPGPHRVASLLKRWNAGTHHYRVERE

SEQ ID NO: 1281998 - protein, 19 aa, Mycobacterium
TLPLRPFKTMAVNVDGQLP

SEQ ID NO: 1281999 - protein, 20 aa, Mycobacterium
TLPSMTRSWLMTRKEPYGAV

SEQ ID NO: 1282000 - protein, 27 aa, Mycobacterium
TLPTEFADAVVEHWGPPPGELFVDRSH

SEQ ID NO: 1282001 - protein, 26 aa, Mycobacterium
TLPVWSRATLALAYASALIRAEQYAQ

SEQ ID NO: 1282002 - protein, 20 aa, Mycobacterium
TLQFDPVIIKFLASHQPFQA

SEQ ID NO: 1282003 - protein, 30 aa, Mycobacterium
TLQMLSDCPLRWLLERHGGSRGRDVRSTLG

SEQ ID NO: 1282004 - protein, 20 aa, Mycobacterium
TLQQCRDAAEAVLRTASAAD

SEQ ID NO: 1282005 - protein, 24 aa, Mycobacterium
TLQRIKDNFALFDFELGADDFAAI

SEQ ID NO: 1282006 - protein, 21 aa, Mycobacterium
TLRAETYAALLQHDAGAIVAV

SEQ ID NO: 1282007 - protein, 28 aa, Mycobacterium
TLRCYLDDQPIFLGRNGRISVFTSERAL

SEQ ID NO: 1282008 - protein, 28 aa, Mycobacterium
TLRDKMPRRFYCRATWHTSELDSETQVF

SEQ ID NO: 1282009 - protein, 26 aa, Mycobacterium
TLREYLGPMTYYWDLMFNRTRGGMTV

SEQ ID NO: 1282010 - protein, 21 aa, Mycobacterium
TLRGGWPAVAVTGALQVLRMS

SEQ ID NO: 1282011 - protein, 19 aa, Mycobacterium
TLRGLKAIANYTCPPDVTL

SEQ ID NO: 1282012 - protein, 25 aa, Mycobacterium
TLRISSQLLANWLRHGVITEEDVKA

SEQ ID NO: 1282013 - protein, 18 aa, Mycobacterium
TLRLVAQAYRAVDEASAG

SEQ ID NO: 1282014 - protein, 18 aa, Mycobacterium
TLRNWLATYVEFYDRYSG

SEQ ID NO: 1282015 - protein, 22 aa, Mycobacterium
TLRPLEAVLTLLTSAGFAGVDA

SEQ ID NO: 1282016 - protein, 18 aa, Mycobacterium
TLRRELLDSAGPFASIEV

SEQ ID NO: 1282017 - protein, 17 aa, Mycobacterium
TLRSEGVTTRFVLGTDT

SEQ ID NO: 1282018 - protein, 21 aa, Mycobacterium
TLRTEMGYPLHGHELSPEISP

SEQ ID NO: 1282019 - protein, 25 aa, Mycobacterium
TLSELARRAGLPIATTHRLAAELVA

SEQ ID NO: 1282020 - protein, 31 aa, Mycobacterium
TLSELGFEYVDLFLIHWPLPTLYDGDFVSTW

SEQ ID NO: 1282021 - protein, 21 aa, Mycobacterium
TLSLCGGEFVSVVGPSGAGKS

SEQ ID NO: 1282022 - protein, 34 aa, Mycobacterium
TLSPPVRLEARWLKPTAYMMAKFGMTLCALGIAE

SEQ ID NO: 1282023 - protein, 31 aa, Mycobacterium
TLTATARGKLLWRLGEIIARDAEQLAELEVR

SEQ ID NO: 1282024 - protein, 17 aa, Mycobacterium
TLTDPWQPAVLALVAMT

SEQ ID NO: 1282025 - protein, 18 aa, Mycobacterium
TLTGDRFAATPGESAEVA

SEQ ID NO: 1282026 - protein, 17 aa, Mycobacterium
TLTLSFRQAEDNLHRTQ

SEQ ID NO: 1282027 - protein, 17 aa, Mycobacterium
TLTTRWTATTAFATGPH

SEQ ID NO: 1282028 - protein, 17 aa, Mycobacterium
TLTYRWDFGDGNSSTEA

SEQ ID NO: 1282029 - protein, 18 aa, Mycobacterium
TLVCNRTGKVLTRQTRLD

SEQ ID NO: 1282030 - protein, 19 aa, Mycobacterium
TLVDLTARFLPPMIERRHG

SEQ ID NO: 1282031 - protein, 18 aa, Mycobacterium
TLVEEFRARVAPVRADAD

SEQ ID NO: 1282032 - protein, 18 aa, Mycobacterium
TLVIHGRADRMCDPSGGR

SEQ ID NO: 1282033 - protein, 19 aa, Mycobacterium
TLVNCVGIFDFYRRIQDIP

SEQ ID NO: 1282034 - protein, 21 aa, Mycobacterium
TLVNCVGIFDFYRRIQDIPAE

SEQ ID NO: 1282035 - protein, 23 aa, Mycobacterium
TLVNCVGIFDFYRRIQDIPAERI

SEQ ID NO: 1282036 - protein, 20 aa, Mycobacterium
TLVNPGLLTWRDVARVMSEA

SEQ ID NO: 1282037 - protein, 30 aa, Mycobacterium
TLVPDALVGLCWPAVFSAIGSALTEDGFPV

SEQ ID NO: 1282038 - protein, 19 aa, Mycobacterium
TLVQWLLERIGQLRGAGWV

SEQ ID NO: 1282039 - protein, 25 aa, Mycobacterium
TLYELLKLRVEVFVVEQATPYPELD

SEQ ID NO: 1282040 - protein, 25 aa, Mycobacterium
TLYLMPWSTMFPLGISSATIGIAEG

SEQ ID NO: 1282041 - protein, 17 aa, Mycobacterium
TMAALARELRYADVSAL

SEQ ID NO: 1282042 - protein, 18 aa, Mycobacterium
TMAALRFAIQGGPGLVTV

SEQ ID NO: 1282043 - protein, 18 aa, Mycobacterium
TMADRADWMFALVRTGPA

SEQ ID NO: 1282044 - protein, 24 aa, Mycobacterium
TMDGSECVPVLLTALGEITGTDTG

SEQ ID NO: 1282045 - protein, 17 aa, Mycobacterium
TMEKAGFIQKGQRPSTR

SEQ ID NO: 1282046 - protein, 20 aa, Mycobacterium
TMEVARKYGMIMPGEDTTKA

SEQ ID NO: 1282047 - protein, 18 aa, Mycobacterium
TMGAIVLDAIEAHATRLA

SEQ ID NO: 1282048 - protein, 24 aa, Mycobacterium
TMILPALRADTRIQLKTLVTSRGV

SEQ ID NO: 1282049 - protein, 17 aa, Mycobacterium
TMLEPGMTFTIEPMINV

SEQ ID NO: 1282050 - protein, 23 aa, Mycobacterium
TMPDRILAAAVAFQAACEPRPYR

SEQ ID NO: 1282051 - protein, 19 aa, Mycobacterium
TMPTLDCWVQLLRPGQQTE

SEQ ID NO: 1282052 - protein, 19 aa, Mycobacterium
TMPTLDCWVQLLRPGQRTE

SEQ ID NO: 1282053 - protein, 19 aa, Mycobacterium
TMQVHGFAQVRLDVSDLPT

SEQ ID NO: 1282054 - protein, 17 aa, Mycobacterium
TMRMLGGYFRFDAANAP

SEQ ID NO: 1282055 - protein, 24 aa, Mycobacterium
TMRSELPPLAGIVHAAGEIGTSPL

SEQ ID NO: 1282056 - protein, 19 aa, Mycobacterium
TMRSLKEIYTTGAAAVTDP

SEQ ID NO: 1282057 - protein, 17 aa, Mycobacterium
TMSAIRLARGFTGRAKI

SEQ ID NO: 1282058 - protein, 27 aa, Mycobacterium
TMTAQAFAGILGMAVAWFEEAVVQATA

SEQ ID NO: 1282059 - protein, 18 aa, Mycobacterium
TMVRAGVIAPMRPDKYLR

SEQ ID NO: 1282060 - protein, 20 aa, Mycobacterium
TMVVTGLHLLGGARADATKV

SEQ ID NO: 1282061 - protein, 26 aa, Mycobacterium
TNAARYVWEVPYYPQYYIPLRDVRPG

SEQ ID NO: 1282062 - protein, 25 aa, Mycobacterium
TNADGVIWGHGWDETRWPERRAPST

SEQ ID NO: 1282063 - protein, 24 aa, Mycobacterium
TNAGSLWWRTVQTVAAEYPDVEVA

SEQ ID NO: 1282064 - protein, 18 aa, Mycobacterium
TNAIFLPLLRVFFNSWFR

SEQ ID NO: 1282065 - protein, 20 aa, Mycobacterium
TNALAAYWIFQAWGNDPKVS

SEQ ID NO: 1282066 - protein, 18 aa, Mycobacterium
TNARCITEGIDIPALDAV

SEQ ID NO: 1282067 - protein, 25 aa, Mycobacterium
TNARVSAAVGQRVELRVDSDEAGQI

SEQ ID NO: 1282068 - protein, 18 aa, Mycobacterium
TNGAWVAEARPVLGTGIA

SEQ ID NO: 1282069 - protein, 21 aa, Mycobacterium
TNGEIARWTAAMVDSGERLDF

SEQ ID NO: 1282070 - protein, 19 aa, Mycobacterium
TNHLGHFALTCLLGDRIRD

SEQ ID NO: 1282071 - protein, 17 aa, Mycobacterium
TNHLGHFALTGLLLDRL

SEQ ID NO: 1282072 - protein, 19 aa, Mycobacterium
TNHLGHFQLTNGLLPALRA

SEQ ID NO: 1282073 - protein, 18 aa, Mycobacterium
TNKIARRMVVPPQRDGGQ

SEQ ID NO: 1282074 - protein, 30 aa, Mycobacterium; identical to SEQ ID NO: 739244

SEQ ID NO: 1282075 - protein, 17 aa, Mycobacterium
TNLLDEWTPVIAGAELG

SEQ ID NO: 1282076 - protein, 20 aa, Mycobacterium
TNMVHYWSLRQSDLRDLQRR

SEQ ID NO: 1282077 - protein, 24 aa, Mycobacterium
TNNMRIAREEVFGPVLVVLTYDST

SEQ ID NO: 1282078 - protein, 17 aa, Mycobacterium
TNPAARAITPWLPNLGT

SEQ ID NO: 1282079 - protein, 23 aa, Mycobacterium
TNPPTEGSWAWLPDESAGSRLHW

SEQ ID NO: 1282080 - protein, 27 aa, Mycobacterium
TNPQRSGPHLQAFVAYAKHAQELALHK

SEQ ID NO: 1282081 - protein, 21 aa, Mycobacterium
TNRGVGSWGEVLGDNTVAAAM

SEQ ID NO: 1282082 - protein, 17 aa, Mycobacterium
TNRRAQMEYLRRLRNAK

SEQ ID NO: 1282083 - protein, 21 aa, Mycobacterium
TNSPGALLRGRIERMHRSCLI

SEQ ID NO: 1282084 - protein, 20 aa, Mycobacterium
TNTLEIYWSGLGISFNGEHT

SEQ ID NO: 1282085 - protein, 18 aa, Mycobacterium
TNTPRNFARRGVRSVVLP

SEQ ID NO: 1282086 - protein, 25 aa, Mycobacterium
TNTWIKSYRRAQCRPEEVLSEDITD

SEQ ID NO: 1282087 - protein, 25 aa, Mycobacterium
TNVFNIPANLFIALANTPYNFFTAL

SEQ ID NO: 1282088 - protein, 26 aa, Mycobacterium
TNVMPQWAGSSWYELRYADPHNTEAL

SEQ ID NO: 1282089 - protein, 26 aa, Mycobacterium
TNVMPQWAGSSWYELRYTDPLNKEAL

SEQ ID NO: 1282090 - protein, 18 aa, Mycobacterium
TNYRIGFVPQGIGADLIA

SEQ ID NO: 1282091 - protein, 20 aa, Mycobacterium
TPAAAPWMKISEAIDYLRAV

SEQ ID NO: 1282092 - protein, 18 aa, Mycobacterium
TPACHGFSIIAKVKEGRE

SEQ ID NO: 1282093 - protein, 20 aa, Mycobacterium
TPADGWPPVPPPTTIRGTFH

SEQ ID NO: 1282094 - protein, 24 aa, Mycobacterium
TPAEAKRALARFIEHRLPSFGRYE

SEQ ID NO: 1282095 - protein, 23 aa, Mycobacterium
TPAEEFDRVLGINFGGVVNGCRS

SEQ ID NO: 1282096 - protein, 19 aa, Mycobacterium
TPAGIAFCAGQLGLTHAEV

SEQ ID NO: 1282097 - protein, 23 aa, Mycobacterium
TPALPAWPGMEGYTGDLLHSADY

SEQ ID NO: 1282098 - protein, 25 aa, Mycobacterium
TPAMRYQPVNAWGIPTGRVEQRPAV

SEQ ID NO: 1282099 - protein, 27 aa, Mycobacterium
TPARKLREIRMALTLDKTFTKPEILTR

SEQ ID NO: 1282100 - protein, 28 aa, Mycobacterium
TPATPTRGAPLCTFRETARTLAGLADPR

SEQ ID NO: 1282101 - protein, 21 aa, Mycobacterium
TPCEFSRDLFRGDRTRLAVTA

SEQ ID NO: 1282102 - protein, 19 aa, Mycobacterium
TPCTPEWDEGVCRHADFNA

SEQ ID NO: 1282103 - protein, 25 aa, Mycobacterium
TPDAQRAATFYGHVLGWAVDPATQM

SEQ ID NO: 1282104 - protein, 23 aa, Mycobacterium
TPDARVSTPLFWDEVADCRPEEF

SEQ ID NO: 1282105 - protein, 18 aa, Mycobacterium
TPDFAGETERAWFQAHVD

SEQ ID NO: 1282106 - protein, 22 aa, Mycobacterium
TPDHWWAWQTKAWSAGEREPRA

SEQ ID NO: 1282107 - protein, 19 aa, Mycobacterium
TPDPGIVLWLGTARGPVHT

SEQ ID NO: 1282108 - protein, 26 aa, Mycobacterium
TPDRLRSGWLNGIKHWQVDYTGPSGC

SEQ ID NO: 1282109 - protein, 24 aa, Mycobacterium
TPELMPLPIALAHRLSRKLTEVRK

SEQ ID NO: 1282110 - protein, 26 aa, Mycobacterium
TPEPGHICPISMTYAVVPALRHNPEL

SEQ ID NO: 1282111 - protein, 25 aa, Mycobacterium
TPESFRLLFDIHVMGAFNVTQAALP

SEQ ID NO: 1282112 - protein, 20 aa, Mycobacterium
TPEYRLMTIRNWATTTRMLT

SEQ ID NO: 1282113 - protein, 25 aa, Mycobacterium
TPFFAAWRTHGWRPPAGSGPASARW

SEQ ID NO: 1282114 - protein, 17 aa, Mycobacterium
TPFNWSWHMFVVADFSC

SEQ ID NO: 1282115 - protein, 24 aa, Mycobacterium
TPFTPLEHFAPWNVDDDGKPVAFG

SEQ ID NO: 1282116 - protein, 19 aa, Mycobacterium
TPGAARIGLFVGKGGVGKS

SEQ ID NO: 1282117 - protein, 25 aa, Mycobacterium
TPGALRPAAGSSWCEWKGQAAYYDV

SEQ ID NO: 1282118 - protein, 18 aa, Mycobacterium
TPGARLTAKIVMLNMANK

SEQ ID NO: 1282119 - protein, 17 aa, Mycobacterium
TPGCTKEACDFRDSLGE

SEQ ID NO: 1282120 - protein, 29 aa, Mycobacterium
TPGEIAQAVLFLASPRAGFVTGSVLHADG

SEQ ID NO: 1282121 - protein, 23 aa, Mycobacterium
TPGHPEFRHTPGVEITTGPLGQG

SEQ ID NO: 1282122 - protein, 25 aa, Mycobacterium
TPGLHAYRGPWQYETLTREMLLDSA

SEQ ID NO: 1282123 - protein, 23 aa, Mycobacterium
TPGRHTFGIAYTRTGTVEGSHTP

SEQ ID NO: 1282124 - protein, 18 aa, Mycobacterium
TPGSVALALSGPATDGRV

SEQ ID NO: 1282125 - protein, 19 aa, Mycobacterium
TPHAGEFARLAGAPPGDDR

SEQ ID NO: 1282126 - protein, 23 aa, Mycobacterium
TPHVLACIYSVFTEGYWSTAGPS

SEQ ID NO: 1282127 - protein, 24 aa, Mycobacterium
TPIDVEVPFDMMIAGRVVRGRIDA

SEQ ID NO: 1282128 - protein, 24 aa, Mycobacterium
TPITALPLFAGWRAMPFAEDAPAR

SEQ ID NO: 1282129 - protein, 35 aa, Mycobacterium
TPIVHLIHAIPFVSEILHPLIGFPIDHDAPPGTPR

SEQ ID NO: 1282130 - protein, 20 aa, Mycobacterium
TPIVSKLPWFALSDPAVTQM

SEQ ID NO: 1282131 - protein, 22 aa, Mycobacterium
TPKARARSLLRHWEPKRRGIYC

SEQ ID NO: 1282132 - protein, 17 aa, Mycobacterium
TPKIREILSAATTFVCP

SEQ ID NO: 1282133 - protein, 24 aa, Mycobacterium
TPKVAGKVLGKWARTRLSGQKTLI

SEQ ID NO: 1282134 - protein, 17 aa, Mycobacterium
TPLAEWAAGAAAINLLT

SEQ ID NO: 1282135 - protein, 17 aa, Mycobacterium
TPLAFPHGVPRLKVASV

SEQ ID NO: 1282136 - protein, 24 aa, Mycobacterium
TPLARGPWGPSLSGNYIGGLLGRA

SEQ ID NO: 1282137 - protein, 26 aa, Mycobacterium
TPLDRSRPLWEFHFAEGMADDRYALI

SEQ ID NO: 1282138 - protein, 27 aa, Mycobacterium
TPLDRSRPLWEFYFVEGMADNRFAIIG

SEQ ID NO: 1282139 - protein, 17 aa, Mycobacterium
TPLDRSVCQYAVANGSA

SEQ ID NO: 1282140 - protein, 20 aa, Mycobacterium
TPLGLAERLEKAGVPIVGTL

SEQ ID NO: 1282141 - protein, 17 aa, Mycobacterium
TPLGVALSGHDHAWSYV

SEQ ID NO: 1282142 - protein, 19 aa, Mycobacterium
TPLKYRLAYTADLEATFTP

SEQ ID NO: 1282143 - protein, 24 aa, Mycobacterium
TPLPARLILRLLNFDESRAMDWVH

SEQ ID NO: 1282144 - protein, 18 aa, Mycobacterium
TPLPRLPQYIAESRGLGV

SEQ ID NO: 1282145 - protein, 25 aa, Mycobacterium
TPLSPGGRFITGFPPFPGARSIRSL

SEQ ID NO: 1282146 - protein, 35 aa, Mycobacterium
TPLVHLAHALPFVGEFLHPLIGWPVDHDAAPGDPK

SEQ ID NO: 1282147 - protein, 22 aa, Mycobacterium
TPLWVRRARAELARAVVAPAEG

SEQ ID NO: 1282148 - protein, 22 aa, Mycobacterium
TPMERLHLVPPPGMSPDMVDGL

SEQ ID NO: 1282149 - protein, 19 aa, Mycobacterium
TPMLRKAEQRGFLGDTQKQ

SEQ ID NO: 1282150 - protein, 29 aa, Mycobacterium
TPMQRFAALLDRYLGFLALDPTTARLFLV

SEQ ID NO: 1282151 - protein, 18 aa, Mycobacterium
TPMRLFWAREYSDYHPEQ

SEQ ID NO: 1282152 - protein, 17 aa, Mycobacterium
TPMVLVLEDAHWIDAAS

SEQ ID NO: 1282153 - protein, 24 aa, Mycobacterium
TPNAPKLPGGFGGLPEPVATGPSP

SEQ ID NO: 1282154 - protein, 21 aa, Mycobacterium
TPNHLSWNWFGNGLRGRRYGW

SEQ ID NO: 1282155 - protein, 21 aa, Mycobacterium
TPNRLLLVLSDGFPYDDGYEG

SEQ ID NO: 1282156 - protein, 24 aa, Mycobacterium
TPPADNSLMLWFETMKPLMSTSAE

SEQ ID NO: 1282157 - protein, 25 aa, Mycobacterium
TPPDADGWCSLSLHAGGTVGELRRA

SEQ ID NO: 1282158 - protein, 22 aa, Mycobacterium
TPPDLKETFSLGAETATGDAEV

SEQ ID NO: 1282159 - protein, 18 aa, Mycobacterium
TPPPWSVGEPARYDADAT

SEQ ID NO: 1282160 - protein, 19 aa, Mycobacterium
TPPRGRRIAVLADMLELGP

SEQ ID NO: 1282161 - protein, 17 aa, Mycobacterium
TPPRQFGPLSIDVAARE

SEQ ID NO: 1282162 - protein, 24 aa, Mycobacterium
TPPSHLFPVEFAKRAKALGEAAGL

SEQ ID NO: 1282163 - protein, 17 aa, Mycobacterium
TPPVWTGSPSPTAGPDE

SEQ ID NO: 1282164 - protein, 19 aa, Mycobacterium
TPQGREWVLDLKVTDDHVG

SEQ ID NO: 1282165 - protein, 26 aa, Mycobacterium
TPQLARLAAMGGFRRWDRVVRNYIAD

SEQ ID NO: 1282166 - protein, 19 aa, Mycobacterium
TPQLRLVAESGLLGISVPT

SEQ ID NO: 1282167 - protein, 24 aa, Mycobacterium
TPQWICPWPNLRVSEHTKAAMRRW

SEQ ID NO: 1282168 - protein, 23 aa, Mycobacterium
TPRCAKCKNPLPWIAVAGDDDFA

SEQ ID NO: 1282169 - protein, 22 aa, Mycobacterium
TPRDLAARLARSGLAVPENAIW

SEQ ID NO: 1282170 - protein, 28 aa, Mycobacterium
TPRGQRTPERWFVVWLGSATNPVDREAA

SEQ ID NO: 1282171 - protein, 18 aa, Mycobacterium
TPRLKPPYPIQEGYLGKP

SEQ ID NO: 1282172 - protein, 20 aa, Mycobacterium
TPRMRYDISAGRDASFTRTM

SEQ ID NO: 1282173 - protein, 18 aa, Mycobacterium
TPRPEYRFPGLNPGDRWC

SEQ ID NO: 1282174 - protein, 26 aa, Mycobacterium
TPRPRKSRPAVPAWEDVLLGVRSSGG

SEQ ID NO: 1282175 - protein, 22 aa, Mycobacterium
TPRPVWRAIPDDAAGALFNALR

SEQ ID NO: 1282176 - protein, 41 aa, Mycobacterium
TPRRLADGIIRVCAGGDRFGLRRGGLTFARLTRDHPHGAVI

SEQ ID NO: 1282177 - protein, 17 aa, Mycobacterium
TPRRWPTPPSTTSTDGS

SEQ ID NO: 1282178 - protein, 21 aa, Mycobacterium
TPSAAPPWLAPLVDRPGAVKD

SEQ ID NO: 1282179 - protein, 19 aa, Mycobacterium
TPSGYRLDGVKSLVPAAAD

SEQ ID NO: 1282180 - protein, 24 aa, Mycobacterium
TPTLDLFLTPTFRGHLANYGTVLY

SEQ ID NO: 1282181 - protein, 20 aa, Mycobacterium
TPTLKFCTIHGYRRAFRVAG

SEQ ID NO: 1282182 - protein, 24 aa, Mycobacterium
TPVALAESVMRLWEQTQDEEGPSS

SEQ ID NO: 1282183 - protein, 23 aa, Mycobacterium
TPVARFLTDWAVRHPEHSVLEPS

SEQ ID NO: 1282184 - protein, 17 aa, Mycobacterium
TPVAVIVPREPTDPPTD

SEQ ID NO: 1282185 - protein, 17 aa, Mycobacterium
TPVCEAAWRDELLELAD

SEQ ID NO: 1282186 - protein, 17 aa, Mycobacterium
TPVEGGRSEIYRVNPDG

SEQ ID NO: 1282187 - protein, 17 aa, Mycobacterium
TPVGEMFDYSGTHYTVV

SEQ ID NO: 1282188 - protein, 22 aa, Mycobacterium
TPVGLVAVCRMPEVSLDEILGA

SEQ ID NO: 1282189 - protein, 33 aa, Mycobacterium
TPVPGTRARLGLLLPCTKYKPYATSREHRSVNS

SEQ ID NO: 1282190 - protein, 17 aa, Mycobacterium
TPVPPARARDIQVVSQD

SEQ ID NO: 1282191 - protein, 17 aa, Mycobacterium
TPVPQLGAALVRLMLDA

SEQ ID NO: 1282192 - protein, 26 aa, Mycobacterium
TPWNFPMTIAAWGFAPALAAGNAVLV

SEQ ID NO: 1282193 - protein, 26 aa, Mycobacterium
TPYPPARLEKLWLPGVDRLLDCVDKA

SEQ ID NO: 1282194 - protein, 18 aa, Mycobacterium
TPYPRSNIFLVFNSVENR

SEQ ID NO: 1282195 - protein, 18 aa, Mycobacterium
TQAAEHWKAHKLDLAPVL

SEQ ID NO: 1282196 - protein, 17 aa, Mycobacterium
TQAAWQRTADGWSGSGA

SEQ ID NO: 1282197 - protein, 25 aa, Mycobacterium
TQAEGLRIVPTCWMVAEYIDRHPEY

SEQ ID NO: 1282198 - protein, 24 aa, Mycobacterium
TQAFYKWRKAPLTQRDWDDAHLIN

SEQ ID NO: 1282199 - protein, 17 aa, Mycobacterium
TQALCRRWSPGARLLPA

SEQ ID NO: 1282200 - protein, 24 aa, Mycobacterium
TQASPYAWVGMSWFDTVEYQMRHM

SEQ ID NO: 1282201 - protein, 18 aa, Mycobacterium
TQAVFRPNFFDDEEDSDA

SEQ ID NO: 1282202 - protein, 19 aa, Mycobacterium
TQFAGCLDINASEKAARFI

SEQ ID NO: 1282203 - protein, 26 aa, Mycobacterium
TQFVELYGREALFLGAGVEIVSLRVQ

SEQ ID NO: 1282204 - protein, 24 aa, Mycobacterium
TQGAFFLRVIGWSGGRQRVIVEHI

SEQ ID NO: 1282205 - protein, 18 aa, Mycobacterium
TQGKVIPDLITWWCERDG

SEQ ID NO: 1282206 - protein, 24 aa, Mycobacterium
TQGREVVELAAALDLTADSLEAAI

SEQ ID NO: 1282207 - protein, 18 aa, Mycobacterium
TQITEFGRQILQMHPEEI

SEQ ID NO: 1282208 - protein, 22 aa, Mycobacterium
TQKEIFIPGGQMFRDLTRLSAA

SEQ ID NO: 1282209 - protein, 24 aa, Mycobacterium
TQKPPAFGEDIWIPGREPSDRQLL

SEQ ID NO: 1282210 - protein, 22 aa, Mycobacterium
TQLEVILPYFLHYANDEQRDRW

SEQ ID NO: 1282211 - protein, 28 aa, Mycobacterium
TQLFRSTGIPVCVWFFAKDKTAGKQGSV

SEQ ID NO: 1282212 - protein, 26 aa, Mycobacterium
TQLKTSFKAGALIGRGSGEAMQVSFY

SEQ ID NO: 1282213 - protein, 17 aa, Mycobacterium
TQLNFVHFIVFACACQR

SEQ ID NO: 1282214 - protein, 17 aa, Mycobacterium
TQLQSAGYFQLCDDQAL

SEQ ID NO: 1282215 - protein, 18 aa, Mycobacterium
TQLYRAYLAYGLNQHDFA

SEQ ID NO: 1282216 - protein, 17 aa, Mycobacterium
TQMAVALGDFVKMGFEQ

SEQ ID NO: 1282217 - protein, 24 aa, Mycobacterium
TQNFMAMSAFRWMVLGHREIADMI

SEQ ID NO: 1282218 - protein, 19 aa, Mycobacterium
TQNGLPFLSRLVHGRRTVV

SEQ ID NO: 1282219 - protein, 20 aa, Mycobacterium
TQNGVPFLARLVYGRRTAVL

SEQ ID NO: 1282220 - protein, 22 aa, Mycobacterium
TQPETFARISVKARAHAKNNPY

SEQ ID NO: 1282221 - protein, 19 aa, Mycobacterium
TQPTARMILGSQLLVSPAV

SEQ ID NO: 1282222 - protein, 24 aa, Mycobacterium
TQQSVAPTTVWLRDHEPGVYARTA

SEQ ID NO: 1282223 - protein, 23 aa, Mycobacterium
TQRAAIADWVYWQHVSVMSNDAI

SEQ ID NO: 1282224 - protein, 24 aa, Mycobacterium
TQRRAYLAWFYRIVDVPSTGPSLD

SEQ ID NO: 1282225 - protein, 17 aa, Mycobacterium
TQRWCVALSGGADSLAL

SEQ ID NO: 1282226 - protein, 17 aa, Mycobacterium
TQSVLLRPGQRAADRML

SEQ ID NO: 1282227 - protein, 20 aa, Mycobacterium
TQTRLAIRREAFRLFETQGY

SEQ ID NO: 1282228 - protein, 25 aa, Mycobacterium
TQVPRLENYGGMIFGCLDEKAEPLV

SEQ ID NO: 1282229 - protein, 24 aa, Mycobacterium
TQWLELRFVGARGAMLRGIIARDA

SEQ ID NO: 1282230 - protein, 19 aa, Mycobacterium
TQWLRGRIDYGGMRRNYFR

SEQ ID NO: 1282231 - protein, 19 aa, Mycobacterium
TQWRALRMSTPLKLTEDEL

SEQ ID NO: 1282232 - protein, 18 aa, Mycobacterium
TQWVPFADWADGRVLLDD

SEQ ID NO: 1282233 - protein, 22 aa, Mycobacterium
TRAAFIVCSHIQVVYGGVNLTT

SEQ ID NO: 1282234 - protein, 28 aa, Mycobacterium
TRAAGFGAEVKRRIMIGTYALSAGYYDA

SEQ ID NO: 1282235 - protein, 17 aa, Mycobacterium
TRAALAGVRARERRRRL

SEQ ID NO: 1282236 - protein, 25 aa, Mycobacterium
TRAALLDRFGMFGVRISIAVLRAGV

SEQ ID NO: 1282237 - protein, 19 aa, Mycobacterium
TRAASLCAKAFRTEPVIGV

SEQ ID NO: 1282238 - protein, 17 aa, Mycobacterium
TRADACALVARALTETR

SEQ ID NO: 1282239 - protein, 33 aa, Mycobacterium
TRAELLDRFGMFGIRIAIAVLRAGVGDSVALAD

SEQ ID NO: 1282240 - protein, 27 aa, Mycobacterium
TRAESRWFADQGFRLVNMTGYPESVLA

SEQ ID NO: 1282241 - protein, 18 aa, Mycobacterium
TRAGLALLQACGTNVLVL

SEQ ID NO: 1282242 - protein, 26 aa, Mycobacterium
TRAGVLRFVVLDGLGKPGRLEGPDPS

SEQ ID NO: 1282243 - protein, 21 aa, Mycobacterium
TRAKKALELTFRQALRLGHNY

SEQ ID NO: 1282244 - protein, 20 aa, Mycobacterium
TRAKYVPVRRLRAFEQSGMG

SEQ ID NO: 1282245 - protein, 25 aa, Mycobacterium
TRALARSGFHAMAAMDLQFCMATSA

SEQ ID NO: 1282246 - protein, 17 aa, Mycobacterium
TRALRIGLEKEDVEWLH

SEQ ID NO: 1282247 - protein, 23 aa, Mycobacterium
TRASWKLGQAISRAGAHSPDVIG

SEQ ID NO: 1282248 - protein, 17 aa, Mycobacterium
TRASYPGRIVAVTGSAG

SEQ ID NO: 1282249 - protein, 21 aa, Mycobacterium
TRATTKFALRRALEPVVPAHV

SEQ ID NO: 1282250 - protein, 17 aa, Mycobacterium
TRAVAWTPSEWIDHTLD

SEQ ID NO: 1282251 - protein, 19 aa, Mycobacterium
TRAYADWSVEINAGYRGQL

SEQ ID NO: 1282252 - protein, 17 aa, Mycobacterium
TRCLPLADHIAFRYHRK

SEQ ID NO: 1282253 - protein, 18 aa, Mycobacterium
TRDAELRARDFVALVIGG

SEQ ID NO: 1282254 - protein, 20 aa, Mycobacterium
TRDAFEFALLQGALRRQIPV

SEQ ID NO: 1282255 - protein, 18 aa, Mycobacterium
TRDARGAAYGAIVSGQQV

SEQ ID NO: 1282256 - protein, 18 aa, Mycobacterium
TRDARMFFNVPIPKRSRP

SEQ ID NO: 1282257 - protein, 20 aa, Mycobacterium
TRDAYPWAAVVSDPVGLADV

SEQ ID NO: 1282258 - protein, 19 aa, Mycobacterium
TRDPVFFQNGWDLLVEGCR

SEQ ID NO: 1282259 - protein, 23 aa, Mycobacterium
TRDSSFWIGPRVAITSLSMHARV

SEQ ID NO: 1282260 - protein, 18 aa, Mycobacterium
TREFFDLLLSERGVGLDW

SEQ ID NO: 1282261 - protein, 17 aa, Mycobacterium
TREGRGWPSDPTLGETV

SEQ ID NO: 1282262 - protein, 20 aa, Mycobacterium
TRELAALLVCLLLSKMSSDT

SEQ ID NO: 1282263 - protein, 27 aa, Mycobacterium
TRELALQVAEAFGRYGAHLRVNVLPIY

SEQ ID NO: 1282264 - protein, 23 aa, Mycobacterium
TRELLWQRGFDGLSIEAVAARAG

SEQ ID NO: 1282265 - protein, 27 aa, Mycobacterium
TRELVWPSMRISHCRPPGSDRDIVLMH

SEQ ID NO: 1282266 - protein, 24 aa, Mycobacterium
TREQVRLALGRRIHPELPELSYLE

SEQ ID NO: 1282267 - protein, 20 aa, Mycobacterium
TRETIEICRSVWRRETLVHE

SEQ ID NO: 1282268 - protein, 21 aa, Mycobacterium
TRETIEICRSVWRRETLVHEG

SEQ ID NO: 1282269 - protein, 22 aa, Mycobacterium
TREYEVGGTFTAAMTHPEEDEA

SEQ ID NO: 1282270 - protein, 25 aa, Mycobacterium
TRFARGWHCLGLADAFRDGRPHGVD

SEQ ID NO: 1282271 - protein, 26 aa, Mycobacterium
TRFGEPRLGLTPALSQRSGDVVPTGV

SEQ ID NO: 1282272 - protein, 21 aa, Mycobacterium
TRFLARIVAWIAAGYPEGIPG

SEQ ID NO: 1282273 - protein, 17 aa, Mycobacterium
TRFLERLAIRLGGDLGF

SEQ ID NO: 1282274 - protein, 17 aa, Mycobacterium
TRFPNSMVDRITPVTTP

SEQ ID NO: 1282275 - protein, 32 aa, Mycobacterium
TRFRRMLSKPFTFRRVEALRPVIQQVTDECID

SEQ ID NO: 1282276 - protein, 21 aa, Mycobacterium
TRFSNTRPPGFVVPGAPPIDE

SEQ ID NO: 1282277 - protein, 22 aa, Mycobacterium
TRFYEGASWHAGGRYLKYQTTT

SEQ ID NO: 1282278 - protein, 23 aa, Mycobacterium
TRGEWYLRQILGAANFRAGRLLA

SEQ ID NO: 1282279 - protein, 23 aa, Mycobacterium
TRGGRTGLRPALEVHAQVVSRPE

SEQ ID NO: 1282280 - protein, 22 aa, Mycobacterium
TRGIWHKGWFASAVHAASPSGW

SEQ ID NO: 1282281 - protein, 30 aa, Mycobacterium
TRGPKGRAKVLARYAVWLGEHRDEIERLLI

SEQ ID NO: 1282282 - protein, 21 aa, Mycobacterium
TRGRLNLVLQDLFLQHSFAGL

SEQ ID NO: 1282283 - protein, 21 aa, Mycobacterium
TRHFRGGGLLWTHTAPVVTDE

SEQ ID NO: 1282284 - protein, 25 aa, Mycobacterium
TRHGRAYLERWGRRSSDRLLDKYFG

SEQ ID NO: 1282285 - protein, 21 aa, Mycobacterium
TRHKGARGLVQLRRALELVDP

SEQ ID NO: 1282286 - protein, 17 aa, Mycobacterium
TRILDLFEFAGAHPAMC

SEQ ID NO: 1282287 - protein, 17 aa, Mycobacterium
TRIPAQRAAELGLANHI

SEQ ID NO: 1282288 - protein, 19 aa, Mycobacterium
TRISGSVTYRGRELTGLGD

SEQ ID NO: 1282289 - protein, 26 aa, Mycobacterium
TRIVRRSNALLGYAYGRRLEYSEVMS

SEQ ID NO: 1282290 - protein, 17 aa, Mycobacterium
TRKNGKNQTEWLPPPDL

SEQ ID NO: 1282291 - protein, 25 aa, Mycobacterium
TRKSFVEALKGKAKEVAGAITGNDS

SEQ ID NO: 1282292 - protein, 17 aa, Mycobacterium
TRKSRRLGVDLVGGDQS

SEQ ID NO: 1282293 - protein, 25 aa, Mycobacterium
TRKTVFEIAGAMGIEAALRDVTSHE

SEQ ID NO: 1282294 - protein, 17 aa, Mycobacterium
TRLCAEFIAGEEAVTQD

SEQ ID NO: 1282295 - protein, 18 aa, Mycobacterium
TRLFHCLVDKESCEGDPI

SEQ ID NO: 1282296 - protein, 26 aa, Mycobacterium
TRLIAMKLFSDRAIDYFRSAGPDDRR

SEQ ID NO: 1282297 - protein, 17 aa, Mycobacterium
TRLKPEILAVTMTAGNF

SEQ ID NO: 1282298 - protein, 20 aa, Mycobacterium
TRLLAARGRDHGVDVVDAPV

SEQ ID NO: 1282299 - protein, 17 aa, Mycobacterium
TRLLAPRQRPAVHALYG

SEQ ID NO: 1282300 - protein, 26 aa, Mycobacterium
TRLLIIDDLHFLRGRRERMTDLSNQF

SEQ ID NO: 1282301 - protein, 24 aa, Mycobacterium
TRLLPNLVTVLGWESCDHTGPVYE

SEQ ID NO: 1282302 - protein, 28 aa, Mycobacterium
TRLLRRILELPLPVIAAVDGHVRAGGLG

SEQ ID NO: 1282303 - protein, 17 aa, Mycobacterium
TRLPADLVVIGLGVTPS

SEQ ID NO: 1282304 - protein, 19 aa, Mycobacterium
TRLPDHIELALYRIAQECL

SEQ ID NO: 1282305 - protein, 37 aa, Mycobacterium
TRLPEAFDRIPAVVLRRMAWYWARIWIEVTPVRVLWW

SEQ ID NO: 1282306 - protein, 20 aa, Mycobacterium
TRLPSERELAASMSVSRSSL

SEQ ID NO: 1282307 - protein, 31 aa, Mycobacterium
TRLRIAADGLWRFVTLPWQLTRVIPETTAVI

SEQ ID NO: 1282308 - protein, 33 aa, Mycobacterium
TRLRLTAAVFSADWPAAMAMAAGLDFGGVVVNG

SEQ ID NO: 1282309 - protein, 18 aa, Mycobacterium
TRLRSTVIKANWKLCHEA

SEQ ID NO: 1282310 - protein, 21 aa, Mycobacterium
TRLTERFDALIVPGVTSVSAA

SEQ ID NO: 1282311 - protein, 22 aa, Mycobacterium
TRLVAIATEWTRGAVKTVPPQW

SEQ ID NO: 1282312 - protein, 32 aa, Mycobacterium
TRMCKSIPPEAPWTAPKAHKWDQVTWAKWLDG

SEQ ID NO: 1282313 - protein, 17 aa, Mycobacterium
TRMLSGLGDQLGFDVNT

SEQ ID NO: 1282314 - protein, 17 aa, Mycobacterium
TRNAVSLVVARELMAQE

SEQ ID NO: 1282315 - protein, 23 aa, Mycobacterium
TRPDEVLEMVGLTAVAGSRAGTL

SEQ ID NO: 1282316 - protein, 26 aa, Mycobacterium
TRPFMGTEVSLRWIFIHMIGEYARHN

SEQ ID NO: 1282317 - protein, 31 aa, Mycobacterium
TRPGLSYQLAEGIALLSKVDWRAKGLQDLGR

SEQ ID NO: 1282318 - protein, 21 aa, Mycobacterium
TRPGSALLFPTLCTPTADVPI

SEQ ID NO: 1282319 - protein, 21 aa, Mycobacterium
TRPHPLFAAFVGASLDYKNAE

SEQ ID NO: 1282320 - protein, 20 aa, Mycobacterium
TRPSALVAIAALSRLGAVAV

SEQ ID NO: 1282321 - protein, 23 aa, Mycobacterium
TRPSNRRELIGAAATELFCTRGY

SEQ ID NO: 1282322 - protein, 20 aa, Mycobacterium
TRPTNLGGLGFSMKWNMGWM

SEQ ID NO: 1282323 - protein, 27 aa, Mycobacterium
TRPTNLGGLGFSMKWNMGWMNDTLAFI

SEQ ID NO: 1282324 - protein, 18 aa, Mycobacterium
TRPVSLWLEELDPAERAG

SEQ ID NO: 1282325 - protein, 19 aa, Mycobacterium
TRQLTAGVYVRFTPDQLDR

SEQ ID NO: 1282326 - protein, 18 aa, Mycobacterium
TRQQMFALVGYRTPTIQR

SEQ ID NO: 1282327 - protein, 18 aa, Mycobacterium
TRQQPDWDDTVVAAAFDA

SEQ ID NO: 1282328 - protein, 25 aa, Mycobacterium
TRQRMIDLKAAYRQALDSIRGDASL

SEQ ID NO: 1282329 - protein, 20 aa, Mycobacterium
TRRDPRLINRFDYDGDFGTV

SEQ ID NO: 1282330 - protein, 19 aa, Mycobacterium
TRRGREIAVLIPVEEYRRI

SEQ ID NO: 1282331 - protein, 26 aa, Mycobacterium
TRRGRSGGSFVRRPAGPPVDKLTARL

SEQ ID NO: 1282332 - protein, 19 aa, Mycobacterium
TRRIFEITVEYLKTRIQFG

SEQ ID NO: 1282333 - protein, 17 aa, Mycobacterium
TRRMFRDGAGEYEINGS

SEQ ID NO: 1282334 - protein, 19 aa, Mycobacterium
TRRRGALALGALRRTGQSE

SEQ ID NO: 1282335 - protein, 20 aa, Mycobacterium
TRRRGALALGALRRTGQSEA

SEQ ID NO: 1282336 - protein, 18 aa, Mycobacterium
TRRVWHLSEAVVGPDDAV

SEQ ID NO: 1282337 - protein, 18 aa, Mycobacterium
TRSATCTGVDRYGLDLRL

SEQ ID NO: 1282338 - protein, 25 aa, Mycobacterium
TRSGKILRKTMRGIAAGRDEPIPST

SEQ ID NO: 1282339 - protein, 18 aa, Mycobacterium
TRSLLGYRYRRLPEARHA

SEQ ID NO: 1282340 - protein, 27 aa, Mycobacterium
TRSNARMGWLLSQNVLRKARAGEAASQ

SEQ ID NO: 1282341 - protein, 22 aa, Mycobacterium
TRSQEILEATGISRDMRTKDLT

SEQ ID NO: 1282342 - protein, 24 aa, Mycobacterium
TRSSPVFSAWTLQIYLRYESAIAE

SEQ ID NO: 1282343 - protein, 17 aa, Mycobacterium
TRSTLALSSQARKYGLG

SEQ ID NO: 1282344 - protein, 18 aa, Mycobacterium
TRSWWSGPEIYVVIDDYD

SEQ ID NO: 1282345 - protein, 20 aa, Mycobacterium
TRTDIEDIFWLQSTIAQELA

SEQ ID NO: 1282346 - protein, 18 aa, Mycobacterium
TRTFVLAPIADWQRDIYD

SEQ ID NO: 1282347 - protein, 18 aa, Mycobacterium
TRTLLDFAERNGIRLPED

SEQ ID NO: 1282348 - protein, 26 aa, Mycobacterium
TRTPRPPSGWLRLGGISSHNLRGLDV

SEQ ID NO: 1282349 - protein, 26 aa, Mycobacterium
TRTRLMKRLSGQGAMALLELDAQATE

SEQ ID NO: 1282350 - protein, 25 aa, Mycobacterium
TRTRVSFEVAGKWMSADVINVSSSG

SEQ ID NO: 1282351 - protein, 25 aa, Mycobacterium
TRVFDIALGYPWPPTIPERVLRNAF

SEQ ID NO: 1282352 - protein, 17 aa, Mycobacterium
TRVGEKLTSLPLTLYSD

SEQ ID NO: 1282353 - protein, 21 aa, Mycobacterium
TRVGRIAWTLVRHPVKSREFP

SEQ ID NO: 1282354 - protein, 18 aa, Mycobacterium
TRVHAHWVDEPVGAVTDI

SEQ ID NO: 1282355 - protein, 20 aa, Mycobacterium
TRVIPCLDVDGGRVVKGVNF

SEQ ID NO: 1282356 - protein, 19 aa, Mycobacterium
TRVLRGWSTLPITLGTARA

SEQ ID NO: 1282357 - protein, 19 aa, Mycobacterium
TRVPYDAIVDLVADGDVSY

SEQ ID NO: 1282358 - protein, 19 aa, Mycobacterium
TRVRFRHPLVRSAAYQAAD

SEQ ID NO: 1282359 - protein, 29 aa, Mycobacterium
TRVRVRRGWRARARPGRRGDCAQRLRRMS

SEQ ID NO: 1282360 - protein, 19 aa, Mycobacterium
TRVSALLRQARPVLLDLGA

SEQ ID NO: 1282361 - protein, 26 aa, Mycobacterium
TRVVRRSNALLGYAYGRRFEYAEQMS

SEQ ID NO: 1282362 - protein, 17 aa, Mycobacterium
TRVYRKLGIRSRAQLGT

SEQ ID NO: 1282363 - protein, 24 aa, Mycobacterium
TRWAELPLADGIRFAMVAASIAVC

SEQ ID NO: 1282364 - protein, 24 aa, Mycobacterium
TRYALDLFATLGLQLLIVTPLQKV

SEQ ID NO: 1282365 - protein, 18 aa, Mycobacterium
TRYGSARSLYHFHVDNAS

SEQ ID NO: 1282366 - protein, 19 aa, Mycobacterium
TRYLPPAAVEPYLEMARRE

SEQ ID NO: 1282367 - protein, 20 aa, Mycobacterium
TRYLPPAAVEPYLEMARREH

SEQ ID NO: 1282368 - protein, 21 aa, Mycobacterium
TRYLRACLGGAGVVVAEDVHW

SEQ ID NO: 1282369 - protein, 24 aa, Mycobacterium
TRYLRAVPLPGMGIVHDMALTRRY

SEQ ID NO: 1282370 - protein, 27 aa, Mycobacterium
TRYLVPAQRLPLVLLNPSLAPREAELK

SEQ ID NO: 1282371 - protein, 23 aa, Mycobacterium
TRYNAVCSVYGHLHIPRTTWYDG

SEQ ID NO: 1282372 - protein, 18 aa, Mycobacterium
TRYRLKTRFELVHRNVYA

SEQ ID NO: 1282373 - protein, 21 aa, Mycobacterium
TSADLVGRFLLKGGETVWVDG

SEQ ID NO: 1282374 - protein, 27 aa, Mycobacterium
TSAVGHHWRYSAAVGLVRDMLGDSVVR

SEQ ID NO: 1282375 - protein, 22 aa, Mycobacterium
TSAYTWMKLPVVDEMERVMEST

SEQ ID NO: 1282376 - protein, 21 aa, Mycobacterium
TSDAIYLRAFEEFIHHNLVLR

SEQ ID NO: 1282377 - protein, 19 aa, Mycobacterium
TSDDRYLCINPFFHNFGYK

SEQ ID NO: 1282378 - protein, 26 aa, Mycobacterium
TSDIKNLVPMFGQFKPTVIVSVPRVF

SEQ ID NO: 1282379 - protein, 23 aa, Mycobacterium
TSDMYRLICNDLDVNGVSVRSTE

SEQ ID NO: 1282380 - protein, 18 aa, Mycobacterium
TSDPVFRQRYWARNHLGW

SEQ ID NO: 1282381 - protein, 22 aa, Mycobacterium
TSELKRSTVVMVHQNALAAGLY

SEQ ID NO: 1282382 - protein, 34 aa, Mycobacterium
TSEPFDFMADFALPFPIAVASAWLGLSEDTAGLL

SEQ ID NO: 1282383 - protein, 26 aa, Mycobacterium
TSFDGAKIYVHFMPATGLKAGESAPT

SEQ ID NO: 1282384 - protein, 20 aa, Mycobacterium
TSFLKRAYKLAAPKLDPQTV

SEQ ID NO: 1282385 - protein, 19 aa, Mycobacterium
TSFPGVSTYSASKFALEGW

SEQ ID NO: 1282386 - protein, 25 aa, Mycobacterium
TSGDLPPWLGATFRRAAVLRYGENP

SEQ ID NO: 1282387 - protein, 20 aa, Mycobacterium
TSGIRAWELADEMRKPIEDI

SEQ ID NO: 1282388 - protein, 19 aa, Mycobacterium
TSGSLIRWLQTLIGGVDLL

SEQ ID NO: 1282389 - protein, 19 aa, Mycobacterium
TSHALLLRDGRVIAQGEAA

SEQ ID NO: 1282390 - protein, 25 aa, Mycobacterium
TSIACAAAIHLARNGKRVLLVSTDP

SEQ ID NO: 1282391 - protein, 22 aa, Mycobacterium
TSILQRRVVFRADRDEIKKIAT

SEQ ID NO: 1282392 - protein, 23 aa, Mycobacterium
TSIPALIGLCLFGDGAAAVVATG

SEQ ID NO: 1282393 - protein, 23 aa, Mycobacterium
TSIWRLDSGRAVFRTEAAGADGS

SEQ ID NO: 1282394 - protein, 21 aa, Mycobacterium
TSKPRADFHARLKTMQSAITA

SEQ ID NO: 1282395 - protein, 24 aa, Mycobacterium
TSLASRYGCPALEATAVETTTGAP

SEQ ID NO: 1282396 - protein, 17 aa, Mycobacterium
TSLAYRTGDVVTLEDIE

SEQ ID NO: 1282397 - protein, 25 aa, Mycobacterium
TSLDVMALDVVWTAEFAEAGWALPL

SEQ ID NO: 1282398 - protein, 17 aa, Mycobacterium
TSLGESVARALGREFVR

SEQ ID NO: 1282399 - protein, 30 aa, Mycobacterium; identical to SEQ ID NO: 92062

SEQ ID NO: 1282400 - protein, 17 aa, Mycobacterium
TSLGRRGLLVAVTLHQR

SEQ ID NO: 1282401 - protein, 17 aa, Mycobacterium
TSLLRLVAGLTTADSGW

SEQ ID NO: 1282402 - protein, 17 aa, Mycobacterium
TSLMAIYDTMQYVRADI

SEQ ID NO: 1282403 - protein, 23 aa, Mycobacterium
TSLPWQLPGRLLLARAYAALGRT

SEQ ID NO: 1282404 - protein, 21 aa, Mycobacterium
TSLRETEAWSGLREVDPGHLW

SEQ ID NO: 1282405 - protein, 19 aa, Mycobacterium
TSLRVGISVWERYTGPYTD

SEQ ID NO: 1282406 - protein, 19 aa, Mycobacterium
TSMLDWARQKADAKPGDAP

SEQ ID NO: 1282407 - protein, 18 aa, Mycobacterium
TSPGVRIVRCEPGYATPI

SEQ ID NO: 1282408 - protein, 21 aa, Mycobacterium
TSPRGKRQFRRGVFDQHTGEV

SEQ ID NO: 1282409 - protein, 21 aa, Mycobacterium
TSPRRALSEMLRRGTQNMPGA

SEQ ID NO: 1282410 - protein, 24 aa, Mycobacterium
TSQELRIAQMLGRGATTKEAAAAL

SEQ ID NO: 1282411 - protein, 24 aa, Mycobacterium
TSQLAERLMRWTGFPAARVARSAL

SEQ ID NO: 1282412 - protein, 24 aa, Mycobacterium
TSRFTCPYHAWSYKNTGELFTVPG

SEQ ID NO: 1282413 - protein, 23 aa, Mycobacterium
TSRLRRHARLRKKVSGTADRPRL

SEQ ID NO: 1282414 - protein, 21 aa, Mycobacterium
TSRPVALVPLARRDVPECLAE

SEQ ID NO: 1282415 - protein, 21 aa, Mycobacterium
TSSANLGDWIASRLVQPKAKA

SEQ ID NO: 1282416 - protein, 19 aa, Mycobacterium
TSSKIMCWVALDRGAKLAE

SEQ ID NO: 1282417 - protein, 24 aa, Mycobacterium
TSTISFLNFYSWGNVTVEGMSVKL

SEQ ID NO: 1282418 - protein, 17 aa, Mycobacterium
TSTLLPGGLNWPLDLTV

SEQ ID NO: 1282419 - protein, 31 aa, Mycobacterium
TSTLRLGTAVALPLERELFTFAKQVATLDQF

SEQ ID NO: 1282420 - protein, 18 aa, Mycobacterium
TSVAMGFDKARAARDTGA

SEQ ID NO: 1282421 - protein, 24 aa, Mycobacterium
TSVGSRAIERFLRQVCYQNAPAAL

SEQ ID NO: 1282422 - protein, 24 aa, Mycobacterium
TSVLPAIRAFHAVRPLSVAEADAL

SEQ ID NO: 1282423 - protein, 18 aa, Mycobacterium
TSVPGVFVAGDMGRGQSL

SEQ ID NO: 1282424 - protein, 17 aa, Mycobacterium
TSVTWPDGSNFTMSMDP

SEQ ID NO: 1282425 - protein, 17 aa, Mycobacterium
TSVTWTLVSSSLLKSLE

SEQ ID NO: 1282426 - protein, 17 aa, Mycobacterium
TSYDYPPGYKYIDGAPD

SEQ ID NO: 1282427 - protein, 25 aa, Mycobacterium
TSYLKGRGLATVCALVTDGRFSGGS

SEQ ID NO: 1282428 - protein, 23 aa, Mycobacterium
TSYSDVADWCLLLARTDKDVPKH

SEQ ID NO: 1282429 - protein, 19 aa, Mycobacterium
TTADWLALFDKLGIPASPL

SEQ ID NO: 1282430 - protein, 17 aa, Mycobacterium
TTADWLDLFRELEIPAA

SEQ ID NO: 1282431 - protein, 24 aa, Mycobacterium
TTAGLPYEDCVGVGYQQLHDDPDA

SEQ ID NO: 1282432 - protein, 26 aa, Mycobacterium
TTAGLRWPDLALRAGRVGYPALRDAL

SEQ ID NO: 1282433 - protein, 18 aa, Mycobacterium
TTAMAALAHAWRSSGGHV

SEQ ID NO: 1282434 - protein, 19 aa, Mycobacterium
TTAMSRPAFMTGGAGHPRG

SEQ ID NO: 1282435 - protein, 19 aa, Mycobacterium
TTAPALRRLLREVLRDSGR

SEQ ID NO: 1282436 - protein, 17 aa, Mycobacterium
TTAYRPVSLDAPLLTAQ

SEQ ID NO: 1282437 - protein, 19 aa, Mycobacterium
TTDSEFIEEMQFCCIRSDG

SEQ ID NO: 1282438 - protein, 19 aa, Mycobacterium
TTDSSVWFHREVRADQWNL

SEQ ID NO: 1282439 - protein, 17 aa, Mycobacterium
TTEFKLNLLRPVSSGVC

SEQ ID NO: 1282440 - protein, 17 aa, Mycobacterium
TTEFKLNLLRPVSTGVC

SEQ ID NO: 1282441 - protein, 29 aa, Mycobacterium
TTEFLADYRAHWLVARTAEHIGGWSRRPL

SEQ ID NO: 1282442 - protein, 23 aa, Mycobacterium
TTEPRLWLLGSSMYSAHLAAAKG

SEQ ID NO: 1282443 - protein, 22 aa, Mycobacterium
TTERILFYTGISYKIGEVHDGA

SEQ ID NO: 1282444 - protein, 21 aa, Mycobacterium
TTEVMLAGAIVRAVEGDTLLL

SEQ ID NO: 1282445 - protein, 26 aa, Mycobacterium
TTFAFGSTELYAWLDGNEDVAFLPVE

SEQ ID NO: 1282446 - protein, 17 aa, Mycobacterium
TTFARIVAEILFGLGKI

SEQ ID NO: 1282447 - protein, 25 aa, Mycobacterium
TTFTRKTRFGFRMLDSRQGHGEPNP

SEQ ID NO: 1282448 - protein, 21 aa, Mycobacterium
TTFVCPSVYEPLGIVNLEAMA

SEQ ID NO: 1282449 - protein, 17 aa, Mycobacterium
TTGELLAEVALRPATGD

SEQ ID NO: 1282450 - protein, 20 aa, Mycobacterium
TTGGIYFTTLQKFGLSKAER

SEQ ID NO: 1282451 - protein, 17 aa, Mycobacterium
TTGKAVLEFAVIDTDKG

SEQ ID NO: 1282452 - protein, 25 aa, Mycobacterium
TTGQLRLFASVLREGSWNGARIDTA

SEQ ID NO: 1282453 - protein, 27 aa, Mycobacterium
TTGRARRCGWFDAVIARYATRVNGITD

SEQ ID NO: 1282454 - protein, 23 aa, Mycobacterium
TTHPAGSVLVEFGQTRVMCTASV

SEQ ID NO: 1282455 - protein, 18 aa, Mycobacterium
TTIAAGVGSIFAELRQDD

SEQ ID NO: 1282456 - protein, 17 aa, Mycobacterium
TTIAARTDVGIGMVRTI

SEQ ID NO: 1282457 - protein, 25 aa, Mycobacterium
TTIKFYLTAVFNIMRLSAAAIAKTE

SEQ ID NO: 1282458 - protein, 25 aa, Mycobacterium
TTKATKVDGGWRITGQKIWTTGAQY

SEQ ID NO: 1282459 - protein, 24 aa, Mycobacterium
TTKEKILWRNAASLFNMDIAKLEK

SEQ ID NO: 1282460 - protein, 24 aa, Mycobacterium
TTKGGLPRGVSISVTDETGVQSLV

SEQ ID NO: 1282461 - protein, 23 aa, Mycobacterium
TTKWVIDCNWKFASEQFASDMYH

SEQ ID NO: 1282462 - protein, 18 aa, Mycobacterium
TTLAPQDRLDWWVDPEAA

SEQ ID NO: 1282463 - protein, 18 aa, Mycobacterium
TTLCVAVADHGRAVFGQI

SEQ ID NO: 1282464 - protein, 24 aa, Mycobacterium
TTLEFPTFDGIRIDAGFTSGSKVS

SEQ ID NO: 1282465 - protein, 29 aa, Mycobacterium
TTLEIRVVRDGRRVRSAECDVIQDERVVA

SEQ ID NO: 1282466 - protein, 23 aa, Mycobacterium
TTLEVVRIAALLSQPVMPDAAAK

SEQ ID NO: 1282467 - protein, 23 aa, Mycobacterium
TTLFRLPVRLALGPTHVAVVMGI

SEQ ID NO: 1282468 - protein, 18 aa, Mycobacterium
TTLGAPVRAVLPGGSEIV

SEQ ID NO: 1282469 - protein, 30 aa, Mycobacterium
TTLGHAVRALSLFPEQHAWLLEDFDNRIGT

SEQ ID NO: 1282470 - protein, 18 aa, Mycobacterium
TTLLDLRNARMLRQAFAA

SEQ ID NO: 1282471 - protein, 17 aa, Mycobacterium
TTLLGRMLIVQRHQQGG

SEQ ID NO: 1282472 - protein, 18 aa, Mycobacterium
TTLLRCLHLDLVPDSGSM

SEQ ID NO: 1282473 - protein, 17 aa, Mycobacterium
TTLNWGRVSRLVFTNCD

SEQ ID NO: 1282474 - protein, 25 aa, Mycobacterium
TTLRLIDELGLWPKFSALPHSRLER

SEQ ID NO: 1282475 - protein, 22 aa, Mycobacterium
TTLSAARLRSALPRGGVDVDTV

SEQ ID NO: 1282476 - protein, 25 aa, Mycobacterium
TTLSPCWYCSGLVRQFNIGAVVIGE

SEQ ID NO: 1282477 - protein, 25 aa, Mycobacterium
TTLTKLPWLDGWRRPQAELDESSRA

SEQ ID NO: 1282478 - protein, 24 aa, Mycobacterium
TTLTSRGPILGLFGDGVDAARDCT

SEQ ID NO: 1282479 - protein, 24 aa, Mycobacterium
TTLYACRAALPSMVSRGAGVIVNV

SEQ ID NO: 1282480 - protein, 18 aa, Mycobacterium
TTMLSHCDDTVCERFTDI

SEQ ID NO: 1282481 - protein, 18 aa, Mycobacterium
TTMPRGGHFAAFEQPGPF

SEQ ID NO: 1282482 - protein, 17 aa, Mycobacterium
TTMRIILGLDHPTSGTA

SEQ ID NO: 1282483 - protein, 40 aa, Mycobacterium
TTNPPVEGAFYWLNSREVRWRPAEYWKPGTKVEVAVNTYG

SEQ ID NO: 1282484 - protein, 22 aa, Mycobacterium
TTNVEFLRFLLADPDVAAGNLD

SEQ ID NO: 1282485 - protein, 36 aa, Mycobacterium
TTPARGRMVPPFEGPRLREWAAVCVPSPSGYLYTQV

SEQ ID NO: 1282486 - protein, 25 aa, Mycobacterium
TTPLKRWQLCLDVNTTGVFLVTKAV

SEQ ID NO: 1282487 - protein, 17 aa, Mycobacterium
TTPLTSFSALIDHAVWF

SEQ ID NO: 1282488 - protein, 19 aa, Mycobacterium
TTPRTALDAGFGLGISTAS

SEQ ID NO: 1282489 - protein, 19 aa, Mycobacterium
TTPSQRQKALLDFADEVER

SEQ ID NO: 1282490 - protein, 18 aa, Mycobacterium
TTRARRNAPLLAVHTGPG

SEQ ID NO: 1282491 - protein, 26 aa, Mycobacterium
TTREERLELLGAIMAEYQKRAGDLAE

SEQ ID NO: 1282492 - protein, 21 aa, Mycobacterium
TTRFDDFAKRVGITKAATSAR

SEQ ID NO: 1282493 - protein, 17 aa, Mycobacterium
TTRIVAWTDTPGDRLTV

SEQ ID NO: 1282494 - protein, 17 aa, Mycobacterium
TTRLIGWSGKLLSDHPD

SEQ ID NO: 1282495 - protein, 24 aa, Mycobacterium
TTRRRGVVINPVLETSEIPETMPD

SEQ ID NO: 1282496 - protein, 17 aa, Mycobacterium
TTRVIDLIMPIGKGQRA

SEQ ID NO: 1282497 - protein, 25 aa, Mycobacterium
TTSGRPIADFELRIGDQSEVLLRGP

SEQ ID NO: 1282498 - protein, 38 aa, Mycobacterium
TTSISDLRAIPWVLAWSQSRVMLPGWYGTGTAFEEYVG

SEQ ID NO: 1282499 - protein, 22 aa, Mycobacterium
TTSLYVYARETVGYALSIGGQV

SEQ ID NO: 1282500 - protein, 25 aa, Mycobacterium
TTSRPRWAAAGSWLGPADPVSTDQA

SEQ ID NO: 1282501 - protein, 26 aa, Mycobacterium
TTSVAWRLRGATSYCIDGQVYTAASA

SEQ ID NO: 1282502 - protein, 19 aa, Mycobacterium
TTTELLPRFETITYAELSR

SEQ ID NO: 1282503 - protein, 22 aa, Mycobacterium
TTTGLRTPIWLITRGAQRVTAT

SEQ ID NO: 1282504 - protein, 23 aa, Mycobacterium
TTTGPGFRDLIAVAVDQRPGFTL

SEQ ID NO: 1282505 - protein, 28 aa, Mycobacterium
TTTKVLWYCGGHGACLSSFNDGEKVWGE

SEQ ID NO: 1282506 - protein, 20 aa, Mycobacterium
TTTLAVEWAPKVRVNSVVVG

SEQ ID NO: 1282507 - protein, 19 aa, Mycobacterium
TTTVARLLALLAEQASLQN

SEQ ID NO: 1282508 - protein, 26 aa, Mycobacterium
TTVALRPPFIWGAGMSTLADFVAAVE

SEQ ID NO: 1282509 - protein, 24 aa, Mycobacterium
TTVGARLGIFARVDALVAQGNTTV

SEQ ID NO: 1282510 - protein, 19 aa, Mycobacterium
TTVHLPPSIARHIAGDDAL

SEQ ID NO: 1282511 - protein, 23 aa, Mycobacterium
TTVHLPPSIARHIAGDNALQTGA

SEQ ID NO: 1282512 - protein, 28 aa, Mycobacterium
TTVIDINVRWKKGTTLEPDWQLDGDGWK

SEQ ID NO: 1282513 - protein, 20 aa, Mycobacterium
TTVWPRRDSVEYSLDHAVVG

SEQ ID NO: 1282514 - protein, 18 aa, Mycobacterium
TTWATGWRHAGHRSLSVG

SEQ ID NO: 1282515 - protein, 26 aa, Mycobacterium
TTYRGLARSVVYRWFTDPTSRSVYPA

SEQ ID NO: 1282516 - protein, 20 aa, Mycobacterium
TVAAIARRAAGLDVVGGDID

SEQ ID NO: 1282517 - protein, 25 aa, Mycobacterium
TVAANRWPAVRFAVRNPIVQGPNAV

SEQ ID NO: 1282518 - protein, 18 aa, Mycobacterium
TVADLRFTREPGATLPLY

SEQ ID NO: 1282519 - protein, 18 aa, Mycobacterium
TVADMMIYLMWSMGGRGA

SEQ ID NO: 1282520 - protein, 20 aa, Mycobacterium
TVADYGRFVRAWLDGGELDG

SEQ ID NO: 1282521 - protein, 27 aa, Mycobacterium
TVAELRTRLRTILGRELGMPDNAVDFD

SEQ ID NO: 1282522 - protein, 17 aa, Mycobacterium
TVAHTIEILKGLRDRYE

SEQ ID NO: 1282523 - protein, 24 aa, Mycobacterium
TVALPEVLTRPGLPAPAPTGSGSA

SEQ ID NO: 1282524 - protein, 24 aa, Mycobacterium
TVALSRLPVDDWVGIQADSHHAAA

SEQ ID NO: 1282525 - protein, 23 aa, Mycobacterium
TVARIAVPVQLFLYGYNRGYLEF

SEQ ID NO: 1282526 - protein, 18 aa, Mycobacterium
TVARRGTAIIEARGASSA

SEQ ID NO: 1282527 - protein, 19 aa, Mycobacterium
TVASATFTRPEIAAVGIPQ

SEQ ID NO: 1282528 - protein, 18 aa, Mycobacterium
TVATWQAAVEEIRTKGTV

SEQ ID NO: 1282529 - protein, 23 aa, Mycobacterium
TVAVLLRITEVFGVDATFFASQD

SEQ ID NO: 1282530 - protein, 17 aa, Mycobacterium
TVAYLYDYVNIAHPFRE

SEQ ID NO: 1282531 - protein, 20 aa, Mycobacterium
TVCDAGWKYLSTGAYTGSLD

SEQ ID NO: 1282532 - protein, 20 aa, Mycobacterium
TVCDAGWKYLSTGAYTGSLV

SEQ ID NO: 1282533 - protein, 18 aa, Mycobacterium
TVCRTRPGEELDLADGAG

SEQ ID NO: 1282534 - protein, 18 aa, Mycobacterium
TVCTARAPRCGVCPLQRC

SEQ ID NO: 1282535 - protein, 19 aa, Mycobacterium
TVCTPRFCSARRGGLLTVE

SEQ ID NO: 1282536 - protein, 20 aa, Mycobacterium
TVDGPLRFELVDAAAGVSRG

SEQ ID NO: 1282537 - protein, 20 aa, Mycobacterium
TVDLPGAIPVQLDITDPESI

SEQ ID NO: 1282538 - protein, 18 aa, Mycobacterium
TVDTCAAEFEARTPYHYS

SEQ ID NO: 1282539 - protein, 22 aa, Mycobacterium
TVEGLGFGTLWLNGGQLDRLDR

SEQ ID NO: 1282540 - protein, 21 aa, Mycobacterium
TVEGLPLFAAFWDRPAELPTA

SEQ ID NO: 1282541 - protein, 25 aa, Mycobacterium
TVEGRPSIKSTLSFEPPPDFVAETL

SEQ ID NO: 1282542 - protein, 19 aa, Mycobacterium
TVEQIWWHWNYIASRGAWD

SEQ ID NO: 1282543 - protein, 17 aa, Mycobacterium
TVERLEHKLGIKASDTA

SEQ ID NO: 1282544 - protein, 18 aa, Mycobacterium
TVERLMAELGLRGAVRGK

SEQ ID NO: 1282545 - protein, 17 aa, Mycobacterium
TVEYLVDAVFNYPTFSE

SEQ ID NO: 1282546 - protein, 19 aa, Mycobacterium
TVFANSRFVTAFFSALDAG

SEQ ID NO: 1282547 - protein, 23 aa, Mycobacterium
TVFDGGWILPGLVDAHCHVGLGP

SEQ ID NO: 1282548 - protein, 17 aa, Mycobacterium
TVFEIDALIVHRSIGLD

SEQ ID NO: 1282549 - protein, 23 aa, Mycobacterium
TVFKAAYRQGLSLVLKGPTGCGK

SEQ ID NO: 1282550 - protein, 17 aa, Mycobacterium
TVFKSMLTAVLDRMPDF

SEQ ID NO: 1282551 - protein, 24 aa, Mycobacterium
TVFYCVANMPGAVPRTSTWALTNA

SEQ ID NO: 1282552 - protein, 24 aa, Mycobacterium
TVGDPKLDLGWMVQSWPEHTDAPE

SEQ ID NO: 1282553 - protein, 26 aa, Mycobacterium
TVGKSPAQVVLRWHIQRGDIVFPKSV

SEQ ID NO: 1282554 - protein, 22 aa, Mycobacterium
TVGKVRRVRLLPGDPPATHQAV

SEQ ID NO: 1282555 - protein, 21 aa, Mycobacterium
TVGLDPVLRVDLWHQFDELAR

SEQ ID NO: 1282556 - protein, 19 aa, Mycobacterium
TVGLLADAVTACFYMCDTA

SEQ ID NO: 1282557 - protein, 25 aa, Mycobacterium
TVGPYLRYGLPLVAACAAAGTDYAD

SEQ ID NO: 1282558 - protein, 38 aa, Mycobacterium
TVGRKALGYFSFRQREVVESWAGFSERPTYENAREIAD

SEQ ID NO: 1282559 - protein, 25 aa, Mycobacterium
TVIDPRLLTTMPEWLNAATGLDALT

SEQ ID NO: 1282560 - protein, 18 aa, Mycobacterium
TVIKANWKLCHEAFIETY

SEQ ID NO: 1282561 - protein, 23 aa, Mycobacterium
TVILPRLVGQVLRGESPGPVTLS

SEQ ID NO: 1282562 - protein, 17 aa, Mycobacterium
TVIPRQRVLVVSTGTEL

SEQ ID NO: 1282563 - protein, 17 aa, Mycobacterium
TVISVPVKISGFKAKSK

SEQ ID NO: 1282564 - protein, 23 aa, Mycobacterium
TVITRKSYGGAYCVMGSKDMGAD

SEQ ID NO: 1282565 - protein, 23 aa, Mycobacterium
TVLAAQGSYVWDGEGNKLLDFSS

SEQ ID NO: 1282566 - protein, 25 aa, Mycobacterium
TVLLAARRRLPIDVVAYVPMAENMP

SEQ ID NO: 1282567 - protein, 18 aa, Mycobacterium
TVLNRFLMQAAIGYPLTV

SEQ ID NO: 1282568 - protein, 20 aa, Mycobacterium
TVLPPALSIRNGRRSVVITG

SEQ ID NO: 1282569 - protein, 17 aa, Mycobacterium
TVLQRAGLRTVLLEANT

SEQ ID NO: 1282570 - protein, 25 aa, Mycobacterium
TVLRDPRFVIPPGIHLSAHGITSGP

SEQ ID NO: 1282571 - protein, 31 aa, Mycobacterium
TVLTLTPLWPVWPLEYALQGSLCESGGCDLI

SEQ ID NO: 1282572 - protein, 17 aa, Mycobacterium
TVLVAWKTGVSPANAKT

SEQ ID NO: 1282573 - protein, 29 aa, Mycobacterium
TVLVRPAPVPGFRGTRSFGTEEFDPFWDA

SEQ ID NO: 1282574 - protein, 26 aa, Mycobacterium
TVLVVGAPLRFGHRIYNTAVVIHRGR

SEQ ID NO: 1282575 - protein, 24 aa, Mycobacterium
TVLYKKSSVLFGLDLAKRDIAKSH

SEQ ID NO: 1282576 - protein, 18 aa, Mycobacterium
TVMTYRAAKAGVIHFTKS

SEQ ID NO: 1282577 - protein, 17 aa, Mycobacterium
TVNFRFAPDRSVEQAYA

SEQ ID NO: 1282578 - protein, 26 aa, Mycobacterium
TVNPSRPVNRFALAVHTLLKPIGKLL

SEQ ID NO: 1282579 - protein, 18 aa, Mycobacterium
TVPDNMGMLFRKKLVMFG

SEQ ID NO: 1282580 - protein, 25 aa, Mycobacterium
TVQEWTELLTASGFRVVTVDRAPMA

SEQ ID NO: 1282581 - protein, 17 aa, Mycobacterium
TVQGRLRTIGVLGNKHI

SEQ ID NO: 1282582 - protein, 18 aa, Mycobacterium
TVQPDPFAEPGWFRTDDV

SEQ ID NO: 1282583 - protein, 19 aa, Mycobacterium
TVQPDPFAEPGWFRTDDVG

SEQ ID NO: 1282584 - protein, 24 aa, Mycobacterium
TVRAICAQSGLAARYFYESFADKD

SEQ ID NO: 1282585 - protein, 24 aa, Mycobacterium
TVRARLRRRGHVAVYGVDKFPRMV

SEQ ID NO: 1282586 - protein, 17 aa, Mycobacterium
TVREHHELYGLLSGIAS

SEQ ID NO: 1282587 - protein, 18 aa, Mycobacterium
TVRLCAAAVTGAFRVVDE

SEQ ID NO: 1282588 - protein, 34 aa, Mycobacterium
TVRPAEKWNAFDPVLIRWRLDVGDRTALLVSLSE

SEQ ID NO: 1282589 - protein, 21 aa, Mycobacterium
TVRREAFRLFELNGYAQTTVD

SEQ ID NO: 1282590 - protein, 19 aa, Mycobacterium
TVRVDARFYGVKFGEDAYG

SEQ ID NO: 1282591 - protein, 24 aa, Mycobacterium
TVSAHVACLRDCGLVTGRPEGRQV

SEQ ID NO: 1282592 - protein, 27 aa, Mycobacterium
TVSCGECPRCRAGLSAKCCSVRKVGHE

SEQ ID NO: 1282593 - protein, 17 aa, Mycobacterium
TVSGAGLWGNVGQSAYG

SEQ ID NO: 1282594 - protein, 20 aa, Mycobacterium
TVSGDVLLAVGAASPAEALQ

SEQ ID NO: 1282595 - protein, 28 aa, Mycobacterium
TVSGRGRIAICGARATTSFPNRRVAAAD

SEQ ID NO: 1282596 - protein, 23 aa, Mycobacterium
TVSGRRPAPCPSILGHEAVGVVV

SEQ ID NO: 1282597 - protein, 21 aa, Mycobacterium
TVSGTAWLTAQFMIDTRTIAG

SEQ ID NO: 1282598 - protein, 23 aa, Mycobacterium
TVSRFRPTVVVQREAAWLIKSLY

SEQ ID NO: 1282599 - protein, 19 aa, Mycobacterium
TVTAMLAAFGRDIGYRIAH

SEQ ID NO: 1282600 - protein, 24 aa, Mycobacterium
TVTPWGTFTYRPSKAARHAAAATT

SEQ ID NO: 1282601 - protein, 18 aa, Mycobacterium
TVTRDGRPVMTLQPYLGA

SEQ ID NO: 1282602 - protein, 43 aa, Mycobacterium
TVTRLGAALWEAFNPFVPGSFLWKGYPYTLVTDLIKPFVSILC

SEQ ID NO: 1282603 - protein, 23 aa, Mycobacterium
TVTRLTAPVIRGLGIGIVAAATR

SEQ ID NO: 1282604 - protein, 25 aa, Mycobacterium
TVTVLRGDEIVKVFTDSVQPAGLAP

SEQ ID NO: 1282605 - protein, 19 aa, Mycobacterium
TVTVPVFVDPVIQLPPLIT

SEQ ID NO: 1282606 - protein, 28 aa, Mycobacterium
TVTVTWSLPSARAWWEMTWQGRPDPSIG

SEQ ID NO: 1282607 - protein, 24 aa, Mycobacterium
TVVAFPLMRAHGGVHLTGLSPLAP

SEQ ID NO: 1282608 - protein, 22 aa, Mycobacterium
TVVCGGCSRNLLVYYHVSRRQG

SEQ ID NO: 1282609 - protein, 25 aa, Mycobacterium
TVVLKPAQLTPWSGTEYGRIVAEET

SEQ ID NO: 1282610 - protein, 25 aa, Mycobacterium
TVVNRHVFESLAFNARIALHVRTLY

SEQ ID NO: 1282611 - protein, 17 aa, Mycobacterium
TVVPFLLADAYHARVDI

SEQ ID NO: 1282612 - protein, 18 aa, Mycobacterium
TVVSRPKLVQPLSLRSYT

SEQ ID NO: 1282613 - protein, 18 aa, Mycobacterium
TVVTAGLPIFKLGDSPVK

SEQ ID NO: 1282614 - protein, 25 aa, Mycobacterium
TVVTQVAPPHSWYGRDVEGSRILYD

SEQ ID NO: 1282615 - protein, 18 aa, Mycobacterium
TVVTVKWSVDGGSHGMET

SEQ ID NO: 1282616 - protein, 20 aa, Mycobacterium
TVVWALATVHHWRDVGAGLS

SEQ ID NO: 1282617 - protein, 25 aa, Mycobacterium
TVYFALLARRRMDLYGATVDDFAQV

SEQ ID NO: 1282618 - protein, 22 aa, Mycobacterium
TWADPWPMYRALRDHDPVHHVV

SEQ ID NO: 1282619 - protein, 21 aa, Mycobacterium
TWAHLRMCLTCGHVGCCDSSP

SEQ ID NO: 1282620 - protein, 24 aa, Mycobacterium
TWAPAEIALAWVPERVQARLTEVE

SEQ ID NO: 1282621 - protein, 29 aa, Mycobacterium
TWCGYCTRLKMALKSEGIRWNEVDIEAEP

SEQ ID NO: 1282622 - protein, 18 aa, Mycobacterium
TWDTALLLFLERSGYPEE

SEQ ID NO: 1282623 - protein, 17 aa, Mycobacterium
TWEAAFDALAAYAAEHG

SEQ ID NO: 1282624 - protein, 18 aa, Mycobacterium
TWFAAIWLVTSQKNGASA

SEQ ID NO: 1282625 - protein, 21 aa, Mycobacterium
TWGDPEIRWILSTVPTAMIFD

SEQ ID NO: 1282626 - protein, 18 aa, Mycobacterium
TWIGRSAVPPALAAELTG

SEQ ID NO: 1282627 - protein, 17 aa, Mycobacterium
TWKAAGIADRLHLERFA

SEQ ID NO: 1282628 - protein, 26 aa, Mycobacterium
TWLAEHLKQRWARGSGGLLVVTHDRW

SEQ ID NO: 1282629 - protein, 25 aa, Mycobacterium
TWLEAMSGYGRWAHSHGDVALCDQV

SEQ ID NO: 1282630 - protein, 20 aa, Mycobacterium
TWPLLIRGLVALRRTGDDGG

SEQ ID NO: 1282631 - protein, 22 aa, Mycobacterium
TWPTVAEWVRWLDSGGAMPEGV

SEQ ID NO: 1282632 - protein, 17 aa, Mycobacterium
TWQDCASAALTVDDGVV

SEQ ID NO: 1282633 - protein, 23 aa, Mycobacterium
TWSAKVGFGRRWSGGVDQPGETT

SEQ ID NO: 1282634 - protein, 23 aa, Mycobacterium
TWTTACRYDFLIPNRGVGVLLPD

SEQ ID NO: 1282635 - protein, 18 aa, Mycobacterium
TWVHADRVGHPWVSGFFA

SEQ ID NO: 1282636 - protein, 27 aa, Mycobacterium
TWVLSRPCPECGFDASAVHHSDVADMI

SEQ ID NO: 1282637 - protein, 19 aa, Mycobacterium
TYAPAKVFLPWAAFSEERS

SEQ ID NO: 1282638 - protein, 23 aa, Mycobacterium
TYDPRTAQALERFYDRRVAEWSA

SEQ ID NO: 1282639 - protein, 21 aa, Mycobacterium
TYDQRCWLRQLTPYATRDQED

SEQ ID NO: 1282640 - protein, 18 aa, Mycobacterium
TYELLKRRGTQFVVVSAA

SEQ ID NO: 1282641 - protein, 23 aa, Mycobacterium
TYELSVDLIIPMIGLLKRKAERR

SEQ ID NO: 1282642 - protein, 17 aa, Mycobacterium
TYGGCSIVEAISAAREN

SEQ ID NO: 1282643 - protein, 18 aa, Mycobacterium
TYGLIVYQEQIMFIAQKV

SEQ ID NO: 1282644 - protein, 24 aa, Mycobacterium
TYGSLEIFSGLDLAIDRGSRVVVL

SEQ ID NO: 1282645 - protein, 19 aa, Mycobacterium
TYGTGAFLLAQLGEIPARS

SEQ ID NO: 1282646 - protein, 18 aa, Mycobacterium
TYGTGAFLLAQLGSEPVR

SEQ ID NO: 1282647 - protein, 26 aa, Mycobacterium
TYHAFAGNLLREFGLLLPVEPDTRLL

SEQ ID NO: 1282648 - protein, 20 aa, Mycobacterium
TYLAECLLLGSGVPTTDRHE

SEQ ID NO: 1282649 - protein, 19 aa, Mycobacterium
TYLELVLDGLVARLASGDD

SEQ ID NO: 1282650 - protein, 19 aa, Mycobacterium
TYLIPRADFDYWNPANRQS

SEQ ID NO: 1282651 - protein, 22 aa, Mycobacterium
TYLPCWGTSLHRVAGDDEDAVT

SEQ ID NO: 1282652 - protein, 24 aa, Mycobacterium
TYLTFDLVHRLWRDSGHDVHYVQN

SEQ ID NO: 1282653 - protein, 21 aa, Mycobacterium
TYMVLECEGSIHACQNPTVKK

SEQ ID NO: 1282654 - protein, 28 aa, Mycobacterium
TYPLHLRLCESCLLLQIPALITSEDTFT

SEQ ID NO: 1282655 - protein, 20 aa, Mycobacterium
TYRITPLALWNARAAGHDAE

SEQ ID NO: 1282656 - protein, 24 aa, Mycobacterium
TYRRFTGGLIRWLRRAARGDQTWA

SEQ ID NO: 1282657 - protein, 24 aa, Mycobacterium
TYRRLAAHFFITFPQLDDVRFTHR

SEQ ID NO: 1282658 - protein, 19 aa, Mycobacterium
TYRRLCPDIENPTESDAAR

SEQ ID NO: 1282659 - protein, 20 aa, Mycobacterium
TYSDAGFRWDYDAMENVPWD

SEQ ID NO: 1282660 - protein, 18 aa, Mycobacterium
TYTVAAFVQANFGSRAEL

SEQ ID NO: 1282661 - protein, 25 aa, Mycobacterium
TYVAALLDRDWRMLIGGDRVAAGDG

SEQ ID NO: 1282662 - protein, 20 aa, Mycobacterium
TYVGALPGRIVRAVGEAGSM

SEQ ID NO: 1282663 - protein, 17 aa, Mycobacterium
TYVGRTGSDDALDDEQT

SEQ ID NO: 1282664 - protein, 17 aa, Mycobacterium
TYVLDAWLRPVPDGVAG

SEQ ID NO: 1282665 - protein, 21 aa, Mycobacterium
TYWLCCAGCVPKFDADPAKYA

SEQ ID NO: 1282666 - protein, 18 aa, Mycobacterium
VAAADQWPLNLGSERDWG

SEQ ID NO: 1282667 - protein, 26 aa, Mycobacterium
VAAALRKAPHLRLGRTGRVLEAIIPA

SEQ ID NO: 1282668 - protein, 25 aa, Mycobacterium
VAAALSLLAERSFSGLSLREVTREA

SEQ ID NO: 1282669 - protein, 17 aa, Mycobacterium
VAAALTLYSDILSRIEA

SEQ ID NO: 1282670 - protein, 18 aa, Mycobacterium
VAAARAGAQVQLVAALGT

SEQ ID NO: 1282671 - protein, 17 aa, Mycobacterium
VAAARRAFDAGVWATDT

SEQ ID NO: 1282672 - protein, 18 aa, Mycobacterium
VAAATKVLVVFDRGTDVV

SEQ ID NO: 1282673 - protein, 18 aa, Mycobacterium
VAAAVGEGSMAVMLVHRY

SEQ ID NO: 1282674 - protein, 17 aa, Mycobacterium
VAACGTGSQLLEITVPV

SEQ ID NO: 1282675 - protein, 27 aa, Mycobacterium
VAACRRRYGPVFTLRISSIGTMVYLAD

SEQ ID NO: 1282676 - protein, 17 aa, Mycobacterium
VAACTHVAFDYDRDHPF

SEQ ID NO: 1282677 - protein, 20 aa, Mycobacterium
VAADAPWLVQVRLNGQLLDS

SEQ ID NO: 1282678 - protein, 28 aa, Mycobacterium
VAADRGAALRWFGLDGVEHPAASAPADL

SEQ ID NO: 1282679 - protein, 25 aa, Mycobacterium
VAAEISRLSLFLTTPAARHITGQTL

SEQ ID NO: 1282680 - protein, 17 aa, Mycobacterium
VAAELTAALAGARIVSR

SEQ ID NO: 1282681 - protein, 20 aa, Mycobacterium
VAAEVAIEWLAAHPHVEVTA

SEQ ID NO: 1282682 - protein, 20 aa, Mycobacterium
VAAFARLWASDEHWAAADKV

SEQ ID NO: 1282683 - protein, 27 aa, Mycobacterium
VAAFTAVRPRIFGVAYRMLGSVAEAED

SEQ ID NO: 1282684 - protein, 27 aa, Mycobacterium
VAAGLAALGIRPGDRVLLQLPNSCQFA

SEQ ID NO: 1282685 - protein, 17 aa, Mycobacterium
VAAGPEFDADAWRTACE

SEQ ID NO: 1282686 - protein, 18 aa, Mycobacterium
VAAGRRGPQALSLKLIDP

SEQ ID NO: 1282687 - protein, 24 aa, Mycobacterium
VAAHSAEFSRPLLAVAGGSHEGGL

SEQ ID NO: 1282688 - protein, 34 aa, Mycobacterium
VAAIADDWFSPVFLRNATAFGFSPRLRADIVVNN

SEQ ID NO: 1282689 - protein, 33 aa, Mycobacterium
VAAILRFAATEVVPRLAGTAGEIGQILRALDGR

SEQ ID NO: 1282690 - protein, 18 aa, Mycobacterium
VAAIMARVFQAVRKTPQM

SEQ ID NO: 1282691 - protein, 18 aa, Mycobacterium
VAAKPGWENTPFDERAAV

SEQ ID NO: 1282692 - protein, 17 aa, Mycobacterium
VAALAGRGPERLVDLGI

SEQ ID NO: 1282693 - protein, 25 aa, Mycobacterium
VAALERLETLLALIEGWVQTVVTAA

SEQ ID NO: 1282694 - protein, 31 aa, Mycobacterium
VAALHAQGRLSARLIGQVTWRTRLVQDPHLL

SEQ ID NO: 1282695 - protein, 26 aa, Mycobacterium
VAALQRSDLLIALGTRFDDRVTGKLD

SEQ ID NO: 1282696 - protein, 18 aa, Mycobacterium
VAALTRIAADHGIRDVYV

SEQ ID NO: 1282697 - protein, 19 aa, Mycobacterium
VAALTRIAADHGIRDVYVP

SEQ ID NO: 1282698 - protein, 18 aa, Mycobacterium
VAALVAWKTGVSPANAKT

SEQ ID NO: 1282699 - protein, 20 aa, Mycobacterium
VAAMQGRIAMYHALGEGVSP

SEQ ID NO: 1282700 - protein, 21 aa, Mycobacterium
VAANIARCLTAFGESPTALVL

SEQ ID NO: 1282701 - protein, 17 aa, Mycobacterium
VAANLMIQGWKRDPSIV

SEQ ID NO: 1282702 - protein, 17 aa, Mycobacterium
VAAPALRKQIHELVDGG

SEQ ID NO: 1282703 - protein, 19 aa, Mycobacterium
VAAPFAGVVTVNIAEGDKV

SEQ ID NO: 1282704 - protein, 19 aa, Mycobacterium
VAAPTKYPAGFFGVFTGSY

SEQ ID NO: 1282705 - protein, 25 aa, Mycobacterium
VAAQLRSSLPLVLAGIVGEVPGAEL

SEQ ID NO: 1282706 - protein, 24 aa, Mycobacterium
VAARDLSPLGIRVVTIAPGTINTP

SEQ ID NO: 1282707 - protein, 26 aa, Mycobacterium
VAAREISLAVARGWQVVGVVAAQDDA

SEQ ID NO: 1282708 - protein, 26 aa, Mycobacterium
VAARLAECGVVYELRQPVGVDPADEL

SEQ ID NO: 1282709 - protein, 24 aa, Mycobacterium
VAARRVRTSHAFHSRLMDPVVAEF

SEQ ID NO: 1282710 - protein, 22 aa, Mycobacterium
VAARTKWFDDYFLAASSAGVSQ

SEQ ID NO: 1282711 - protein, 18 aa, Mycobacterium
VAASRWTVRLAETGWGET

SEQ ID NO: 1282712 - protein, 20 aa, Mycobacterium
VAATCRSMGLSVTLIEKSSA

SEQ ID NO: 1282713 - protein, 18 aa, Mycobacterium
VAATMLFVFFQRTAWYLV

SEQ ID NO: 1282714 - protein, 18 aa, Mycobacterium
VAATWPGLVPEFRRVLPE

SEQ ID NO: 1282715 - protein, 21 aa, Mycobacterium
VAAVARRAGMRVERRGDHLTV

SEQ ID NO: 1282716 - protein, 18 aa, Mycobacterium
VAAVFAQLITPDGETHGV

SEQ ID NO: 1282717 - protein, 20 aa, Mycobacterium
VAAWLHSVVPNFTEDPLYMA

SEQ ID NO: 1282718 - protein, 17 aa, Mycobacterium
VAAYLPHRTKPRSPEGL

SEQ ID NO: 1282719 - protein, 17 aa, Mycobacterium
VACAAALGVFEEIESGR

SEQ ID NO: 1282720 - protein, 19 aa, Mycobacterium
VACDPDFASAAWRKLLVNA

SEQ ID NO: 1282721 - protein, 18 aa, Mycobacterium
VACLRDCGLVTGRPEGRQ

SEQ ID NO: 1282722 - protein, 18 aa, Mycobacterium
VACRRPITDPEVLLTHRN

SEQ ID NO: 1282723 - protein, 18 aa, Mycobacterium
VACVSRIYTDHAVLDVHP

SEQ ID NO: 1282724 - protein, 26 aa, Mycobacterium
VADAARSRGGYTVGVIPKRLVHREVA

SEQ ID NO: 1282725 - protein, 21 aa, Mycobacterium
VADAFHLPIVFLADNPGMLPG

SEQ ID NO: 1282726 - protein, 22 aa, Mycobacterium
VADAGVPWVLMHWRSVGSDRPH

SEQ ID NO: 1282727 - protein, 20 aa, Mycobacterium
VADALRPGDQLVLGASNPVR

SEQ ID NO: 1282728 - protein, 24 aa, Mycobacterium
VADCSARLPMLTIMEMLGVPGADQ

SEQ ID NO: 1282729 - protein, 18 aa, Mycobacterium
VADFSPLRVKRVVRETSD

SEQ ID NO: 1282730 - protein, 23 aa, Mycobacterium
VADGLDFPNGMAITEDRATLIVA

SEQ ID NO: 1282731 - protein, 18 aa, Mycobacterium
VADGLRVDVLTLFSYPLH

SEQ ID NO: 1282732 - protein, 17 aa, Mycobacterium
VADGRLVKGRKIGLTSK

SEQ ID NO: 1282733 - protein, 18 aa, Mycobacterium
VADGRPATTAAWTAVEVA

SEQ ID NO: 1282734 - protein, 17 aa, Mycobacterium
VADGRRVVLGAADTFRA

SEQ ID NO: 1282735 - protein, 24 aa, Mycobacterium
VADIAAEFGTPVFVIDEADFRARC

SEQ ID NO: 1282736 - protein, 24 aa, Mycobacterium
VADKCADIATVLRETRSGQEQLVR

SEQ ID NO: 1282737 - protein, 25 aa, Mycobacterium
VADKVLKNQACSRGILDYYREQDFV

SEQ ID NO: 1282738 - protein, 22 aa, Mycobacterium
VADLGFPLSVHFESTYGVNTAA

SEQ ID NO: 1282739 - protein, 25 aa, Mycobacterium
VADLQRFPLVYFIDAMLQVDDLDLA

SEQ ID NO: 1282740 - protein, 25 aa, Mycobacterium
VADLRTSRELERHGPGLVPAGVEIH

SEQ ID NO: 1282741 - protein, 20 aa, Mycobacterium
VADRAFGTGQAWVDTDGDGR

SEQ ID NO: 1282742 - protein, 18 aa, Mycobacterium
VADRKHLELLGGHLIGPD

SEQ ID NO: 1282743 - protein, 19 aa, Mycobacterium
VADRYAYRRADILDGQAVA

SEQ ID NO: 1282744 - protein, 17 aa, Mycobacterium
VADTRAAAELDRAADEI

SEQ ID NO: 1282745 - protein, 23 aa, Mycobacterium
VADTRGDELLVFGTDPLIMRQRY

SEQ ID NO: 1282746 - protein, 25 aa, Mycobacterium
VADVALRVLAPLGLVFDENSPWLSV

SEQ ID NO: 1282747 - protein, 19 aa, Mycobacterium
VADVLKWLQDQAAFTRTGA

SEQ ID NO: 1282748 - protein, 18 aa, Mycobacterium
VADWCRFNSAGSLFIDPG

SEQ ID NO: 1282749 - protein, 19 aa, Mycobacterium
VAEAFARGDIDLRMVQIVL

SEQ ID NO: 1282750 - protein, 23 aa, Mycobacterium
VAEAGYRNAERFAAAAVAETQMG

SEQ ID NO: 1282751 - protein, 25 aa, Mycobacterium
VAEALGEHVFDFFLRNKRSEWENYR

SEQ ID NO: 1282752 - protein, 18 aa, Mycobacterium
VAEALVIGAEQPDGGYWM

SEQ ID NO: 1282753 - protein, 18 aa, Mycobacterium
VAEDVVFTDGVPGEELPA

SEQ ID NO: 1282754 - protein, 19 aa, Mycobacterium
VAEEAAKLSAKRGLHAARL

SEQ ID NO: 1282755 - protein, 18 aa, Mycobacterium
VAEFCRERGILLVADEVQ

SEQ ID NO: 1282756 - protein, 17 aa, Mycobacterium
VAEHRWLTDRSWCRPNW

SEQ ID NO: 1282757 - protein, 22 aa, Mycobacterium
VAEIHIRLAASLVQVSSDVLDV

SEQ ID NO: 1282758 - protein, 20 aa, Mycobacterium
VAELGRLDIILANAGIGNGG

SEQ ID NO: 1282759 - protein, 19 aa, Mycobacterium
VAELGRLDVIVANAGITAP

SEQ ID NO: 1282760 - protein, 20 aa, Mycobacterium
VAELTARIAALTDSLHRDEV

SEQ ID NO: 1282761 - protein, 22 aa, Mycobacterium
VAELVRRGHEVLIQSGAGDGSA

SEQ ID NO: 1282762 - protein, 27 aa, Mycobacterium
VAENISFPLAIRRERRAARDARVEELL

SEQ ID NO: 1282763 - protein, 25 aa, Mycobacterium
VAESKRFCWNCGRPVGRSTKDGRAL

SEQ ID NO: 1282764 - protein, 18 aa, Mycobacterium
VAESSGLHLVPDPGGAAF

SEQ ID NO: 1282765 - protein, 27 aa, Mycobacterium
VAETLLPWLKFRGHGLGMFIMEMPGTY

SEQ ID NO: 1282766 - protein, 22 aa, Mycobacterium
VAEVLRFCGERSIAVVPFGGGT

SEQ ID NO: 1282767 - protein, 17 aa, Mycobacterium
VAEWKTVITESLPADLE

SEQ ID NO: 1282768 - protein, 19 aa, Mycobacterium
VAEYERQWIQNATIMSSYQ

SEQ ID NO: 1282769 - protein, 17 aa, Mycobacterium
VAEYRRLPKLRAVQDGR

SEQ ID NO: 1282770 - protein, 18 aa, Mycobacterium
VAFAAAAACLDRGVRVGC

SEQ ID NO: 1282771 - protein, 19 aa, Mycobacterium
VAFAKEYGVPVAIKAAFGG

SEQ ID NO: 1282772 - protein, 35 aa, Mycobacterium
VAFKLADMKARIDAARLLVYRAGWMARNGKEFTAA

SEQ ID NO: 1282773 - protein, 22 aa, Mycobacterium
VAFLRRARRALPGDPDFGDPLS

SEQ ID NO: 1282774 - protein, 44 aa, Mycobacterium
VAFTGKKPSLAWAETYPGTLSYYLASAFGEVWMQPSGTVGLVGF

SEQ ID NO: 1282775 - protein, 17 aa, Mycobacterium
VAFYRDGLGLAIAREYA

SEQ ID NO: 1282776 - protein, 19 aa, Mycobacterium
VAGEQTWRVPPLALDDDAI

SEQ ID NO: 1282777 - protein, 23 aa, Mycobacterium
VAGESPLVRIVRALAAVGDVVVA

SEQ ID NO: 1282778 - protein, 24 aa, Mycobacterium
VAGGARLDGAVIFDGVKIGAGAVI

SEQ ID NO: 1282779 - protein, 19 aa, Mycobacterium
VAGGFAHRTLFEGVDLTVA

SEQ ID NO: 1282780 - protein, 18 aa, Mycobacterium
VAGGVDFDSAVQTLLTEI

SEQ ID NO: 1282781 - protein, 17 aa, Mycobacterium
VAGLKRRDEMGLSVRSA

SEQ ID NO: 1282782 - protein, 24 aa, Mycobacterium
VAGLRGVTGFGHYSATKFAVEAIT

SEQ ID NO: 1282783 - protein, 25 aa, Mycobacterium
VAGLSVRPGYVLSDGFRVPGLPMPS

SEQ ID NO: 1282784 - protein, 20 aa, Mycobacterium
VAGLTRLRRRYVITPLSNGN

SEQ ID NO: 1282785 - protein, 26 aa, Mycobacterium
VAGPPMFKRWCRLVGRPELFDDPRFA

SEQ ID NO: 1282786 - protein, 17 aa, Mycobacterium
VAGPVMSRMGWFVESRL

SEQ ID NO: 1282787 - protein, 24 aa, Mycobacterium
VAGRLCPNPVLADGRRLDEALGSG

SEQ ID NO: 1282788 - protein, 17 aa, Mycobacterium
VAGRLMLAASSRRSAWW

SEQ ID NO: 1282789 - protein, 17 aa, Mycobacterium
VAGRMALERARRGDHGL

SEQ ID NO: 1282790 - protein, 24 aa, Mycobacterium
VAGRRMAETVARRGGIVVLPQDLP

SEQ ID NO: 1282791 - protein, 21 aa, Mycobacterium
VAGSAIFRILVRRDAALDDAW

SEQ ID NO: 1282792 - protein, 17 aa, Mycobacterium
VAGSFAGTGLRYPGAGL

SEQ ID NO: 1282793 - protein, 20 aa, Mycobacterium
VAGSRLLPRERRALRAGDFG

SEQ ID NO: 1282794 - protein, 17 aa, Mycobacterium
VAGVPVAVCAPGDVDAA

SEQ ID NO: 1282795 - protein, 18 aa, Mycobacterium
VAGVRGREDGFYDFETKY

SEQ ID NO: 1282796 - protein, 25 aa, Mycobacterium
VAGYPKEMRRFLAANPGLASRFNFT

SEQ ID NO: 1282797 - protein, 18 aa, Mycobacterium
VAGYWIDRIDEMLSACLR

SEQ ID NO: 1282798 - protein, 25 aa, Mycobacterium
VAHELGRALAPVPFLSSTVLATGLL

SEQ ID NO: 1282799 - protein, 29 aa, Mycobacterium
VAHPGVPRFDCWRGMAIPGHATAIGKNIL

SEQ ID NO: 1282800 - protein, 30 aa, Mycobacterium
VAHRARWLVRVMTSLMLFPGHDETDERAML

SEQ ID NO: 1282801 - protein, 17 aa, Mycobacterium
VAHRLPVGISLPEKQFT

SEQ ID NO: 1282802 - protein, 26 aa, Mycobacterium
VAHSMGGLYSRAAFRMLQHTGSPLRL

SEQ ID NO: 1282803 - protein, 20 aa, Mycobacterium
VAIAEAVSMLGVPLDAITVL

SEQ ID NO: 1282804 - protein, 17 aa, Mycobacterium
VAIASPGYPCYRNILTA

SEQ ID NO: 1282805 - protein, 20 aa, Mycobacterium
VAIEAAVAQSWYKLVGDTGE

SEQ ID NO: 1282806 - protein, 17 aa, Mycobacterium
VAIETQSTFGYVQNTVV

SEQ ID NO: 1282807 - protein, 22 aa, Mycobacterium
VAIFIADFVPRVWAGCEALGLG

SEQ ID NO: 1282808 - protein, 18 aa, Mycobacterium
VAIGRIALMSGELGQLNG

SEQ ID NO: 1282809 - protein, 22 aa, Mycobacterium
VAIIESRGGTAVSDFSDVGDEE

SEQ ID NO: 1282810 - protein, 20 aa, Mycobacterium
VAILEGFGLSGFGEEGDEFD

SEQ ID NO: 1282811 - protein, 17 aa, Mycobacterium
VAISLVFDGANAGTLGS

SEQ ID NO: 1282812 - protein, 25 aa, Mycobacterium
VAISVDCARYWLDAERPISKDDAVD

SEQ ID NO: 1282813 - protein, 17 aa, Mycobacterium
VAIVGIGCRLAGDIATP

SEQ ID NO: 1282814 - protein, 17 aa, Mycobacterium
VAIVGIGCRLAGDITTP

SEQ ID NO: 1282815 - protein, 24 aa, Mycobacterium
VAKRFPARATACWSGNVACAPSPL

SEQ ID NO: 1282816 - protein, 19 aa, Mycobacterium
VAKRLDLIDPSAWAFTWVV

SEQ ID NO: 1282817 - protein, 17 aa, Mycobacterium
VALAARSVGSCWIGSTI

SEQ ID NO: 1282818 - protein, 21 aa, Mycobacterium
VALAELFKRIRGYEVDEANAV

SEQ ID NO: 1282819 - protein, 18 aa, Mycobacterium
VALCGEVFPVTRSAKPGS

SEQ ID NO: 1282820 - protein, 18 aa, Mycobacterium
VALDGARLGDARALDTLS

SEQ ID NO: 1282821 - protein, 25 aa, Mycobacterium
VALERHARAGILAPVSACASGSEGI

SEQ ID NO: 1282822 - protein, 19 aa, Mycobacterium
VALGECHRPYGTPCVHEHA

SEQ ID NO: 1282823 - protein, 18 aa, Mycobacterium
VALHKLPVTVVLDRSGVT

SEQ ID NO: 1282824 - protein, 21 aa, Mycobacterium
VALLDRAELVAALDELEALGC

SEQ ID NO: 1282825 - protein, 20 aa, Mycobacterium
VALLDRAELVAALDELEILG

SEQ ID NO: 1282826 - protein, 20 aa, Mycobacterium
VALLRAAQSIGLPVPGVVAH

SEQ ID NO: 1282827 - protein, 18 aa, Mycobacterium
VALLRRHLPELSERDAEA

SEQ ID NO: 1282828 - protein, 17 aa, Mycobacterium
VALRCQVRIEPLRRTYS

SEQ ID NO: 1282829 - protein, 22 aa, Mycobacterium
VALRGGVRVRDTFRAVEAITNA

SEQ ID NO: 1282830 - protein, 18 aa, Mycobacterium
VALRVSWRALESAQINPD

SEQ ID NO: 1282831 - protein, 17 aa, Mycobacterium
VALVTGAARGMGAAHAR

SEQ ID NO: 1282832 - protein, 17 aa, Mycobacterium
VAMCADCAAELRDPRNR

SEQ ID NO: 1282833 - protein, 25 aa, Mycobacterium
VAMILSTAMLLEWLAERHHRGALAD

SEQ ID NO: 1282834 - protein, 25 aa, Mycobacterium
VAMISLCGCWGCTLSFLDMDERILP

SEQ ID NO: 1282835 - protein, 18 aa, Mycobacterium
VAMIYSFQSPDAIARDIE

SEQ ID NO: 1282836 - protein, 27 aa, Mycobacterium
VAMVLRRLLRLCARYSATGADFSGPTV

SEQ ID NO: 1282837 - protein, 18 aa, Mycobacterium
VAMVTGKAWFSVRKEQKK

SEQ ID NO: 1282838 - protein, 18 aa, Mycobacterium
VANAGITAPQAWNAITPA

SEQ ID NO: 1282839 - protein, 18 aa, Mycobacterium
VANALYWLQEYHIDGLRV

SEQ ID NO: 1282840 - protein, 24 aa, Mycobacterium
VANERRIAEETARNEGKPEQALSK

SEQ ID NO: 1282841 - protein, 17 aa, Mycobacterium
VANGFYLLRAADRDEAA

SEQ ID NO: 1282842 - protein, 27 aa, Mycobacterium
VANLLRNLWAYVVIFCGHFPEGTQKFT

SEQ ID NO: 1282843 - protein, 34 aa, Mycobacterium
VANLPITLWPGMKIGQLCLLRLTSPAEHPYGSSS

SEQ ID NO: 1282844 - protein, 18 aa, Mycobacterium
VANPVQWATIRYGTDASR

SEQ ID NO: 1282845 - protein, 21 aa, Mycobacterium
VANRLPIDMVRRADGTTEFKR

SEQ ID NO: 1282846 - protein, 18 aa, Mycobacterium
VANSYGLAYIPAGVALPD

SEQ ID NO: 1282847 - protein, 18 aa, Mycobacterium
VAPADAFVGWLPQEHERV

SEQ ID NO: 1282848 - protein, 25 aa, Mycobacterium
VAPASRRAAVLAGLRAAHPYEEPAF

SEQ ID NO: 1282849 - protein, 19 aa, Mycobacterium
VAPAYLRRNQEDVLTELPD

SEQ ID NO: 1282850 - protein, 20 aa, Mycobacterium
VAPDGSPITATWDVTTKTLT

SEQ ID NO: 1282851 - protein, 28 aa, Mycobacterium
VAPEVIWPRARRALAALGLNLLLRHDTS

SEQ ID NO: 1282852 - protein, 26 aa, Mycobacterium
VAPKDFRMWVCLHEVTHRVQFRANPW

SEQ ID NO: 1282853 - protein, 18 aa, Mycobacterium
VAPNHLPHPSRNAEFLAT

SEQ ID NO: 1282854 - protein, 19 aa, Mycobacterium
VAPPTTWDEYDEVAAKITR

SEQ ID NO: 1282855 - protein, 22 aa, Mycobacterium
VAPRRKPLHTLNAWVVTDDAGA

SEQ ID NO: 1282856 - protein, 19 aa, Mycobacterium
VAPSITERVPLMGADGYFA

SEQ ID NO: 1282857 - protein, 34 aa, Mycobacterium
VAPSSPWEVPSGWRIAGRAATPFRLHAGERTDHV

SEQ ID NO: 1282858 - protein, 18 aa, Mycobacterium
VAPTLTWNVLDTENYPLL

SEQ ID NO: 1282859 - protein, 30 aa, Mycobacterium
VAPVRFSQEIAWWVWLCWDQQLRKIEPSLL

SEQ ID NO: 1282860 - protein, 25 aa, Mycobacterium
VAPVTVYGARCVTLSGSKLAMQSIT

SEQ ID NO: 1282861 - protein, 25 aa, Mycobacterium
VAPYPELIDLLVLDAIESPYDPWDL

SEQ ID NO: 1282862 - protein, 28 aa, Mycobacterium
VAQACARAGASLIHLSTDYVFSGSRRRP

SEQ ID NO: 1282863 - protein, 19 aa, Mycobacterium
VAQARAFLDNGDFDAALSA

SEQ ID NO: 1282864 - protein, 18 aa, Mycobacterium
VAQARRIIDEYGFTAIKL

SEQ ID NO: 1282865 - protein, 18 aa, Mycobacterium
VAQHASCPVVAWRQIGQP

SEQ ID NO: 1282866 - protein, 19 aa, Mycobacterium
VAQIARWAGCIGNRTTVVP

SEQ ID NO: 1282867 - protein, 24 aa, Mycobacterium
VAQLRSRPVLARPLAAIDARAEEI

SEQ ID NO: 1282868 - protein, 21 aa, Mycobacterium
VAQRCRPVFATYADPIVHLGP

SEQ ID NO: 1282869 - protein, 24 aa, Mycobacterium
VARAKARGLVRIDIVVPPDLQDDL

SEQ ID NO: 1282870 - protein, 26 aa, Mycobacterium
VARCNPRTAPRLADTVRLHKNPDGAV

SEQ ID NO: 1282871 - protein, 27 aa, Mycobacterium
VARCVAEVGIGFAFAPQFHPSYRHAGA

SEQ ID NO: 1282872 - protein, 24 aa, Mycobacterium
VARELGIHASFMPKPATGMMGNGC

SEQ ID NO: 1282873 - protein, 20 aa, Mycobacterium
VARHLPEYAVAQFVKAICAQ

SEQ ID NO: 1282874 - protein, 22 aa, Mycobacterium
VARHMPGRVVGPLTGSVAASQR

SEQ ID NO: 1282875 - protein, 19 aa, Mycobacterium
VARIKFPTPAPCGKTPLTA

SEQ ID NO: 1282876 - protein, 23 aa, Mycobacterium
VARLCSQERIWSIFAKKRGLNRR

SEQ ID NO: 1282877 - protein, 22 aa, Mycobacterium
VARLKSSVAMAIRRQERGLTVA

SEQ ID NO: 1282878 - protein, 25 aa, Mycobacterium
VARLRRRISAIMGYSDDNAVDTAQP

SEQ ID NO: 1282879 - protein, 22 aa, Mycobacterium
VARMPLAAGDIVFTGTTHGVGF

SEQ ID NO: 1282880 - protein, 23 aa, Mycobacterium
VARPFNRRLLALGQRVRDELTSR

SEQ ID NO: 1282881 - protein, 25 aa, Mycobacterium
VARRGAAELGLPVLHFESLDAATVS

SEQ ID NO: 1282882 - protein, 22 aa, Mycobacterium
VARRILPAFIRLYMQADNDLAR

SEQ ID NO: 1282883 - protein, 26 aa, Mycobacterium
VARRYLRAGASFVLVGADVTLLARGA

SEQ ID NO: 1282884 - protein, 29 aa, Mycobacterium
VARTACTLLGYDFCAVFLPDEQGRALTIE

SEQ ID NO: 1282885 - protein, 21 aa, Mycobacterium
VARVGLVNAVIRFDVNAGSDF

SEQ ID NO: 1282886 - protein, 20 aa, Mycobacterium
VARWIRLVCRPTQWLELRFV

SEQ ID NO: 1282887 - protein, 21 aa, Mycobacterium
VASACSFLGLDPLQVANEGKM

SEQ ID NO: 1282888 - protein, 18 aa, Mycobacterium
VASARRAFDPSIGVTERR

SEQ ID NO: 1282889 - protein, 23 aa, Mycobacterium
VASHFDWTLAMWNDDGIHGAAGD

SEQ ID NO: 1282890 - protein, 23 aa, Mycobacterium
VASICARRGPTLQWVRSAETAAD

SEQ ID NO: 1282891 - protein, 22 aa, Mycobacterium
VASLADACARAAATDPSPMWPE

SEQ ID NO: 1282892 - protein, 24 aa, Mycobacterium
VASNELLDAWAMRERLPRVAEVFA

SEQ ID NO: 1282893 - protein, 20 aa, Mycobacterium
VASRVCGRLTAQPGVRLRWP

SEQ ID NO: 1282894 - protein, 23 aa, Mycobacterium
VASSRARDALVVTWSGKKSELLG

SEQ ID NO: 1282895 - protein, 21 aa, Mycobacterium
VATAAMLRRTFEATLRLTGET

SEQ ID NO: 1282896 - protein, 18 aa, Mycobacterium
VATAFPHAVELLGTGAGI

SEQ ID NO: 1282897 - protein, 20 aa, Mycobacterium
VATAKFFARNVLPRLTAQRG

SEQ ID NO: 1282898 - protein, 18 aa, Mycobacterium
VATASAWRFQRSETAALP

SEQ ID NO: 1282899 - protein, 26 aa, Mycobacterium
VATDAHWAGLCQALGRPGWAMVDELA

SEQ ID NO: 1282900 - protein, 18 aa, Mycobacterium
VATDGFAVNGGRLAGRAG

SEQ ID NO: 1282901 - protein, 21 aa, Mycobacterium
VATGAKWVREIFTGVYASDFG

SEQ ID NO: 1282902 - protein, 21 aa, Mycobacterium
VATGRPVYRDTVLPGAVLARV

SEQ ID NO: 1282903 - protein, 18 aa, Mycobacterium
VATGVFDRLPELWVIVGH

SEQ ID NO: 1282904 - protein, 17 aa, Mycobacterium
VATLFGLFADVRQLLIA

SEQ ID NO: 1282905 - protein, 24 aa, Mycobacterium
VATLTRIAADYGIRDVYAPDFDRT

SEQ ID NO: 1282906 - protein, 18 aa, Mycobacterium
VATLWEFDLYGGTTLVAA

SEQ ID NO: 1282907 - protein, 26 aa, Mycobacterium
VATLYKREFNEYWASDPTAAPDVTFV

SEQ ID NO: 1282908 - protein, 25 aa, Mycobacterium
VATMPIEVWDDVMAVNVRSAMLTTK

SEQ ID NO: 1282909 - protein, 19 aa, Mycobacterium
VATPAGVPLLRLAAQTALL

SEQ ID NO: 1282910 - protein, 20 aa, Mycobacterium
VATPYRLIDVWQQHRAPVED

SEQ ID NO: 1282911 - protein, 21 aa, Mycobacterium
VATPYRLIDVWQQHRAPVEDH

SEQ ID NO: 1282912 - protein, 18 aa, Mycobacterium
VATVAALCQRGHAGQMVL

SEQ ID NO: 1282913 - protein, 20 aa, Mycobacterium
VATVRGRVAPVFDLGVGMDP

SEQ ID NO: 1282914 - protein, 23 aa, Mycobacterium
VAVAEIPNVIGFKDGTGNFDLVA

SEQ ID NO: 1282915 - protein, 18 aa, Mycobacterium
VAVARDFSPQQGLGQVLR

SEQ ID NO: 1282916 - protein, 19 aa, Mycobacterium
VAVARLRLLARAHGVTEIG

SEQ ID NO: 1282917 - protein, 18 aa, Mycobacterium
VAVCAPGDVDAAQRYASE

SEQ ID NO: 1282918 - protein, 21 aa, Mycobacterium
VAVDPRARWEHLYRLVNYALE

SEQ ID NO: 1282919 - protein, 17 aa, Mycobacterium
VAVELGHSAQEVLITQD

SEQ ID NO: 1282920 - protein, 17 aa, Mycobacterium
VAVEYLGLWDTFAVPGL

SEQ ID NO: 1282921 - protein, 21 aa, Mycobacterium
VAVFRLRDGSLRAVDAVCPHR

SEQ ID NO: 1282922 - protein, 22 aa, Mycobacterium
VAVGARGAWLTLVHQGREVEVL

SEQ ID NO: 1282923 - protein, 22 aa, Mycobacterium
VAVGITPDGSWVLTDGRPETLA

SEQ ID NO: 1282924 - protein, 22 aa, Mycobacterium
VAVIPFNFPVELTMEKAAAALA

SEQ ID NO: 1282925 - protein, 20 aa, Mycobacterium
VAVKMALQFWRSTGRVRKSR

SEQ ID NO: 1282926 - protein, 28 aa, Mycobacterium
VAVKQGWFCCWNGANQLHVSTGVIGPDR

SEQ ID NO: 1282927 - protein, 28 aa, Mycobacterium
VAVKQGWFCCWNGGNQLHVSTGIIGPDR

SEQ ID NO: 1282928 - protein, 25 aa, Mycobacterium
VAVKQGWMCCVGSDWMHLSTGVIGA

SEQ ID NO: 1282929 - protein, 17 aa, Mycobacterium
VAVLGVGGLGHLGVQWA

SEQ ID NO: 1282930 - protein, 17 aa, Mycobacterium
VAVLKRQPDELVLLDAD

SEQ ID NO: 1282931 - protein, 19 aa, Mycobacterium
VAVLRAMRALNIVGADVVE

SEQ ID NO: 1282932 - protein, 17 aa, Mycobacterium
VAVLSLWTQQSYGGDVR

SEQ ID NO: 1282933 - protein, 17 aa, Mycobacterium
VAVLVALGRQLAAVPYL

SEQ ID NO: 1282934 - protein, 18 aa, Mycobacterium
VAVMWGMGFYAGYVGGQQ

SEQ ID NO: 1282935 - protein, 23 aa, Mycobacterium
VAVNFPLYVILSLLGLPESDFGR

SEQ ID NO: 1282936 - protein, 19 aa, Mycobacterium
VAVNVEWGLDEILLPSTGP

SEQ ID NO: 1282937 - protein, 19 aa, Mycobacterium
VAVRPEWSAAEARFAVHAA

SEQ ID NO: 1282938 - protein, 19 aa, Mycobacterium
VAVRYEMRRQAAILESGAT

SEQ ID NO: 1282939 - protein, 18 aa, Mycobacterium
VAVSCRFPGAPDPEAFWE

SEQ ID NO: 1282940 - protein, 23 aa, Mycobacterium
VAVSETLLGRLGHLSARTALLGH

SEQ ID NO: 1282941 - protein, 24 aa, Mycobacterium
VAVTRLGITSVRFTGGEPLVVPHL

SEQ ID NO: 1282942 - protein, 17 aa, Mycobacterium
VAYFLGCALPVEDRRAH

SEQ ID NO: 1282943 - protein, 18 aa, Mycobacterium
VAYFLGCALPVEQRREHY

SEQ ID NO: 1282944 - protein, 21 aa, Mycobacterium
VAYPASPDWPRAADGVIDTSN

SEQ ID NO: 1282945 - protein, 17 aa, Mycobacterium
VAYQARFDPQAKGLGEW

SEQ ID NO: 1282946 - protein, 24 aa, Mycobacterium
VAYRLGRSAARVEAALSAPSIFGR

SEQ ID NO: 1282947 - protein, 17 aa, Mycobacterium
VAYVNGYTGLGVAATRF

SEQ ID NO: 1282948 - protein, 21 aa, Mycobacterium
VCANAGIATMSFRELTDAEDL

SEQ ID NO: 1282949 - protein, 21 aa, Mycobacterium
VCANAGIFPSGRLEELTPEDI

SEQ ID NO: 1282950 - protein, 21 aa, Mycobacterium
VCANAGIFPSGRLQDLTPEDI

SEQ ID NO: 1282951 - protein, 21 aa, Mycobacterium
VCASCAGVASIFTCSECGREE

SEQ ID NO: 1282952 - protein, 17 aa, Mycobacterium
VCCSGGVMSLTGEAGAQ

SEQ ID NO: 1282953 - protein, 24 aa, Mycobacterium
VCCTDCSQIYWPGSHHEKLLNLVE

SEQ ID NO: 1282954 - protein, 19 aa, Mycobacterium
VCDAGWKYLSTGAYAGSLD

SEQ ID NO: 1282955 - protein, 19 aa, Mycobacterium
VCDAGWKYLSTGAYTGSLV

SEQ ID NO: 1282956 - protein, 29 aa, Mycobacterium
VCDDFPLARLYSWHRAMRLFDGPDEVHMR

SEQ ID NO: 1282957 - protein, 20 aa, Mycobacterium
VCGAPRIVLDDVEFDGYLFP

SEQ ID NO: 1282958 - protein, 24 aa, Mycobacterium
VCGDPPKTAWLFTGQGSQYPGMAR

SEQ ID NO: 1282959 - protein, 17 aa, Mycobacterium
VCGWRSDLDGAHVVQID

SEQ ID NO: 1282960 - protein, 19 aa, Mycobacterium
VCILDRPRHQQLMADVREA

SEQ ID NO: 1282961 - protein, 19 aa, Mycobacterium
VCNRGRLDAAVSIHAVERF

SEQ ID NO: 1282962 - protein, 20 aa, Mycobacterium
VCPHRGGPLADGLADDCVVV

SEQ ID NO: 1282963 - protein, 17 aa, Mycobacterium
VCPTLHMPLQSGSDRIL

SEQ ID NO: 1282964 - protein, 20 aa, Mycobacterium
VCRAVSRLSYDGRLLSNEHV

SEQ ID NO: 1282965 - protein, 17 aa, Mycobacterium
VCRIGGVRIRLVGRDRG

SEQ ID NO: 1282966 - protein, 24 aa, Mycobacterium
VCSDTTSYCPYKGDAAYYHVNAAG

SEQ ID NO: 1282967 - protein, 25 aa, Mycobacterium
VCSTKGDGLLAVFGHPIAHEDDARR

SEQ ID NO: 1282968 - protein, 26 aa, Mycobacterium
VCTLCSCYPWTLLGIPPAWFKYPQYR

SEQ ID NO: 1282969 - protein, 20 aa, Mycobacterium
VCTNTLCAVMGGDAILESLE

SEQ ID NO: 1282970 - protein, 24 aa, Mycobacterium
VCTPLRAGSVGALIVGDMGSATVV

SEQ ID NO: 1282971 - protein, 20 aa, Mycobacterium
VCTQLGISAAEVHKIFVSDT

SEQ ID NO: 1282972 - protein, 25 aa, Mycobacterium
VCVCANCGAVLHLPRSYCANCRSWT

SEQ ID NO: 1282973 - protein, 18 aa, Mycobacterium
VCVDSVGVPGAREVDLSG

SEQ ID NO: 1282974 - protein, 18 aa, Mycobacterium
VCVYAAPTQSVIGGPPDQ

SEQ ID NO: 1282975 - protein, 30 aa, Mycobacterium
VCWRCGGPCLTYKGSVHGWTCTACLDAYLD

SEQ ID NO: 1282976 - protein, 19 aa, Mycobacterium
VCYADFPTERDLAAARDRL

SEQ ID NO: 1282977 - protein, 19 aa, Mycobacterium
VDAAAPGARLAWRDDARWA

SEQ ID NO: 1282978 - protein, 20 aa, Mycobacterium
VDAAGLWRPLARTSSGSTPA

SEQ ID NO: 1282979 - protein, 24 aa, Mycobacterium
VDAAGPGWWLPSLLVRRLDELPLT

SEQ ID NO: 1282980 - protein, 26 aa, Mycobacterium
VDAANRLHKTEAWVSQRRALLKLAPE

SEQ ID NO: 1282981 - protein, 23 aa, Mycobacterium
VDAAQRYVLVGGIRSTGLTSGMA

SEQ ID NO: 1282982 - protein, 18 aa, Mycobacterium
VDACRAFCADAVTRRAGK

SEQ ID NO: 1282983 - protein, 22 aa, Mycobacterium
VDAEIKRFIALHVAGEIDSPAS

SEQ ID NO: 1282984 - protein, 23 aa, Mycobacterium
VDAELGLTIAWNGCIYNYEQLRD

SEQ ID NO: 1282985 - protein, 22 aa, Mycobacterium
VDAGVPLAVFPAGTFNHFAKDI

SEQ ID NO: 1282986 - protein, 21 aa, Mycobacterium
VDAHNGAGFVISPTASFVLQP

SEQ ID NO: 1282987 - protein, 25 aa, Mycobacterium
VDAIFPRQAVSSVWGTFLSALLVGV

SEQ ID NO: 1282988 - protein, 18 aa, Mycobacterium
VDAKGRFDATVPDYAGQH

SEQ ID NO: 1282989 - protein, 19 aa, Mycobacterium
VDALIAAAVDGFGSLDIMV

SEQ ID NO: 1282990 - protein, 18 aa, Mycobacterium
VDALKLALARFATAIDDL

SEQ ID NO: 1282991 - protein, 18 aa, Mycobacterium
VDALLALRPDCVVYNPMF

SEQ ID NO: 1282992 - protein, 20 aa, Mycobacterium
VDALVSAWHGQGGVAVPSAS

SEQ ID NO: 1282993 - protein, 28 aa, Mycobacterium
VDAMCARFRISGLPVVDDRGSLVGIITN

SEQ ID NO: 1282994 - protein, 25 aa, Mycobacterium
VDANIWRRVVPKGWFYNVMVTGVKP

SEQ ID NO: 1282995 - protein, 20 aa, Mycobacterium
VDARANLVLGQPDFVTAQEW

SEQ ID NO: 1282996 - protein, 23 aa, Mycobacterium
VDARFELADALHLGPDPTYDTIV

SEQ ID NO: 1282997 - protein, 17 aa, Mycobacterium
VDARLGDIADWVPEPDT

SEQ ID NO: 1282998 - protein, 19 aa, Mycobacterium
VDASGLWPGKVVTDVSPAP

SEQ ID NO: 1282999 - protein, 19 aa, Mycobacterium
VDASGLWPGKVVTEVTPAG

SEQ ID NO: 1283000 - protein, 25 aa, Mycobacterium
VDATANSLLPQWRGQAGEAAQAALV

SEQ ID NO: 1283001 - protein, 17 aa, Mycobacterium
VDAVPVEVGATWEPVDV

SEQ ID NO: 1283002 - protein, 18 aa, Mycobacterium
VDAVRVVNLLSWRYRDPG

SEQ ID NO: 1283003 - protein, 22 aa, Mycobacterium
VDAVVGIYGRYDWEDKSTVERV

SEQ ID NO: 1283004 - protein, 19 aa, Mycobacterium
VDAYLHAGGQWEWDSAAPA

SEQ ID NO: 1283005 - protein, 19 aa, Mycobacterium
VDAYLRISALLGVPPGEDL

SEQ ID NO: 1283006 - protein, 17 aa, Mycobacterium
VDCGACRIACRVDAIYY

SEQ ID NO: 1283007 - protein, 18 aa, Mycobacterium
VDCPRAERGKAYAARVLA

SEQ ID NO: 1283008 - protein, 19 aa, Mycobacterium
VDCPVDRTMWNYAADAEIN

SEQ ID NO: 1283009 - protein, 17 aa, Mycobacterium
VDDAFLIDAGKDALFLA

SEQ ID NO: 1283010 - protein, 17 aa, Mycobacterium
VDDAGGGLIQFVPDLVA

SEQ ID NO: 1283011 - protein, 23 aa, Mycobacterium
VDDAWPGPGVVYFTRVIAEKARS

SEQ ID NO: 1283012 - protein, 27 aa, Mycobacterium
VDDDAWELDEFGLPTPVIPSFGGGGAG

SEQ ID NO: 1283013 - protein, 29 aa, Mycobacterium
VDDDAWELDEFGLPTPVIPSFGGGGAGAG

SEQ ID NO: 1283014 - protein, 17 aa, Mycobacterium
VDDFGIDTANMFGFWDW

SEQ ID NO: 1283015 - protein, 30 aa, Mycobacterium
VDDLYKSSFCDLRWSSGVGQYIEASAGAVL

SEQ ID NO: 1283016 - protein, 23 aa, Mycobacterium
VDDPVRLSARRVWIVDPLDGTRE

SEQ ID NO: 1283017 - protein, 18 aa, Mycobacterium
VDDTRLGDLLPPAPADTT

SEQ ID NO: 1283018 - protein, 17 aa, Mycobacterium
VDEDGALLVRPDKHIAW

SEQ ID NO: 1283019 - protein, 35 aa, Mycobacterium
VDEDPEIRTCILTGAGGYFCAGMDLKAASKKPPGD

SEQ ID NO: 1283020 - protein, 24 aa, Mycobacterium
VDEGVEAYGRLDVIVANAGICIPA

SEQ ID NO: 1283021 - protein, 24 aa, Mycobacterium
VDEGWPGEEIPPALLEPFSGPWGT

SEQ ID NO: 1283022 - protein, 24 aa, Mycobacterium
VDEIPRLPSGKVLRRVLRERAMSA

SEQ ID NO: 1283023 - protein, 22 aa, Mycobacterium
VDEIRKAVRYQIKHGAQLIKVC

SEQ ID NO: 1283024 - protein, 18 aa, Mycobacterium
VDELPRRGIGKVDRRELS

SEQ ID NO: 1283025 - protein, 21 aa, Mycobacterium
VDELRWLPVAQAMSMLSYPHD

SEQ ID NO: 1283026 - protein, 18 aa, Mycobacterium
VDELYAWADATFNDSAGD

SEQ ID NO: 1283027 - protein, 22 aa, Mycobacterium
VDEMCLHLAPRMIRINAIHPTN

SEQ ID NO: 1283028 - protein, 30 aa, Mycobacterium
VDESRLTFLAVRRWYGWSAGRIINIDIGGG

SEQ ID NO: 1283029 - protein, 18 aa, Mycobacterium
VDEVPRRGIGKVDRPALR

SEQ ID NO: 1283030 - protein, 17 aa, Mycobacterium
VDFALRRRFAFADLAPQ

SEQ ID NO: 1283031 - protein, 17 aa, Mycobacterium
VDFCVYPGQVTALVGDN

SEQ ID NO: 1283032 - protein, 18 aa, Mycobacterium
VDFVKARGLTAIVKGLRT

SEQ ID NO: 1283033 - protein, 28 aa, Mycobacterium
VDFWASWCGPCKAFAPTFAASSEKHPDV

SEQ ID NO: 1283034 - protein, 18 aa, Mycobacterium
VDGARWLSLEGKSTVHTD

SEQ ID NO: 1283035 - protein, 29 aa, Mycobacterium
VDGDKGLRFSFRWDLGRSRLVMVDSRNAR

SEQ ID NO: 1283036 - protein, 18 aa, Mycobacterium
VDGDRGGSIILISSAAGL

SEQ ID NO: 1283037 - protein, 20 aa, Mycobacterium
VDGGRWEIYVGGAAGAHIRK

SEQ ID NO: 1283038 - protein, 23 aa, Mycobacterium
VDGGWRLTGTKVWTSGAHLAHAF

SEQ ID NO: 1283039 - protein, 19 aa, Mycobacterium
VDGGWVVSGQKVWTSDAVN

SEQ ID NO: 1283040 - protein, 24 aa, Mycobacterium
VDGKPRLDGIRSFLGSRGIVAPDE

SEQ ID NO: 1283041 - protein, 17 aa, Mycobacterium
VDGRITNFYAMRNPEKL

SEQ ID NO: 1283042 - protein, 21 aa, Mycobacterium
VDGRYEPLYVRNADAEGPAGG

SEQ ID NO: 1283043 - protein, 26 aa, Mycobacterium
VDHARPWKGGRWVVRTEAGARLPLTL

SEQ ID NO: 1283044 - protein, 24 aa, Mycobacterium
VDHDLRPGGRVTYFMTGPDGDKFA

SEQ ID NO: 1283045 - protein, 23 aa, Mycobacterium
VDHPESMAPLIAFVGSRQHWEHW

SEQ ID NO: 1283046 - protein, 25 aa, Mycobacterium
VDIGGRPILWHIMKIYETAGITDFI

SEQ ID NO: 1283047 - protein, 17 aa, Mycobacterium
VDIPLKFHHPMWVQNAE

SEQ ID NO: 1283048 - protein, 23 aa, Mycobacterium
VDIRRFAPFNGNNRWLHDRVAEV

SEQ ID NO: 1283049 - protein, 18 aa, Mycobacterium
VDIWARYIGSLTRSVPTL

SEQ ID NO: 1283050 - protein, 24 aa, Mycobacterium
VDKLDHLVGLGVDFVEVMPVNAFG

SEQ ID NO: 1283051 - protein, 25 aa, Mycobacterium
VDKRSEATISRVLRDLAAAGATILI

SEQ ID NO: 1283052 - protein, 25 aa, Mycobacterium
VDLALGWAHRLVGLRNGRKVLDRPA

SEQ ID NO: 1283053 - protein, 24 aa, Mycobacterium
VDLAVFASGCARAVAAVDSGDWDA

SEQ ID NO: 1283054 - protein, 21 aa, Mycobacterium
VDLDLPRDAMIVFTGLSGSGK

SEQ ID NO: 1283055 - protein, 19 aa, Mycobacterium
VDLDNWKLLKWLDPPAPFY

SEQ ID NO: 1283056 - protein, 27 aa, Mycobacterium
VDLDPMPGVGWRQILDVAFVAREVLED

SEQ ID NO: 1283057 - protein, 23 aa, Mycobacterium
VDLGGRGRSVLKPDVDLQRTVGW

SEQ ID NO: 1283058 - protein, 25 aa, Mycobacterium
VDLLADVVNRVWFLDAVRGEADVYN

SEQ ID NO: 1283059 - protein, 31 aa, Mycobacterium
VDLLGAYRQGRTWRRIGLMDCGERWGIFTAG

SEQ ID NO: 1283060 - protein, 19 aa, Mycobacterium
VDLLGPVPVAGELWVRATV

SEQ ID NO: 1283061 - protein, 19 aa, Mycobacterium
VDLPEGYLTISYPDRHGAV

SEQ ID NO: 1283062 - protein, 17 aa, Mycobacterium
VDLPFVFDRTDVDVLRG

SEQ ID NO: 1283063 - protein, 24 aa, Mycobacterium
VDLPGHGRSAWREDGDYGPKLNAV

SEQ ID NO: 1283064 - protein, 17 aa, Mycobacterium
VDLRSLNPLDFDTVAAS

SEQ ID NO: 1283065 - protein, 18 aa, Mycobacterium
VDMRPRNVVVLGPGSIPK

SEQ ID NO: 1283066 - protein, 19 aa, Mycobacterium
VDNALALMWGAEDLFAVLG

SEQ ID NO: 1283067 - protein, 23 aa, Mycobacterium
VDNALRLILLLGDRSEIRLTDAS

SEQ ID NO: 1283068 - protein, 18 aa, Mycobacterium
VDNCDFFLLIGANPAVSA

SEQ ID NO: 1283069 - protein, 23 aa, Mycobacterium
VDNQPGFLGFQLLRPVKGDNRYF

SEQ ID NO: 1283070 - protein, 32 aa, Mycobacterium
VDNSFHAVKIAFANEIGRVCTQLGISAAEVHK

SEQ ID NO: 1283071 - protein, 17 aa, Mycobacterium
VDPDFLFFNGLPTAETT

SEQ ID NO: 1283072 - protein, 17 aa, Mycobacterium
VDPDGADAWALQDALAL

SEQ ID NO: 1283073 - protein, 21 aa, Mycobacterium
VDPDRFAVIIGTGLGGGEKIV

SEQ ID NO: 1283074 - protein, 19 aa, Mycobacterium
VDPGHLWWIRCQLREELIE

SEQ ID NO: 1283075 - protein, 29 aa, Mycobacterium
VDPKAVPSRLAWETGVAMADSLLERYRTD

SEQ ID NO: 1283076 - protein, 27 aa, Mycobacterium
VDPKRRVRFLPYGIAVSVLDAAAGGGE

SEQ ID NO: 1283077 - protein, 17 aa, Mycobacterium
VDPKTVIELGGHHPKVV

SEQ ID NO: 1283078 - protein, 27 aa, Mycobacterium
VDPLEKVRVIARFAGYADPHLPYMYHC

SEQ ID NO: 1283079 - protein, 25 aa, Mycobacterium
VDPLLPEVAWSWLVDALNQRAEHVT

SEQ ID NO: 1283080 - protein, 23 aa, Mycobacterium
VDPRFSGELSLHYKEHIPADVLA

SEQ ID NO: 1283081 - protein, 23 aa, Mycobacterium
VDPSRGGAVVSLLDGGRELIAPG

SEQ ID NO: 1283082 - protein, 26 aa, Mycobacterium
VDPSRLSAGMLAVFNDHYAVALSSVK

SEQ ID NO: 1283083 - protein, 29 aa, Mycobacterium
VDQDRCRGWRMCVSGCPYKKVYFNHKTGK

SEQ ID NO: 1283084 - protein, 22 aa, Mycobacterium
VDQGKCLIRLVPTRWGPVATGG

SEQ ID NO: 1283085 - protein, 34 aa, Mycobacterium
VDQQMRVVVWNRGCEELWGLRSGEVIGKPLSALD

SEQ ID NO: 1283086 - protein, 21 aa, Mycobacterium
VDQRTFGGWLLADLVTVDGTD

SEQ ID NO: 1283087 - protein, 24 aa, Mycobacterium
VDQRTFGGWMLADLVTVDGSDVPA

SEQ ID NO: 1283088 - protein, 20 aa, Mycobacterium
VDRALELAALVAGLSPFGVQ

SEQ ID NO: 1283089 - protein, 26 aa, Mycobacterium
VDRALRFPAALGRPLLTDLARWDAGD

SEQ ID NO: 1283090 - protein, 22 aa, Mycobacterium
VDRDEVLLDIGYKTEGVIPSRE

SEQ ID NO: 1283091 - protein, 21 aa, Mycobacterium
VDRGQPFLALVDYAHKPGALR

SEQ ID NO: 1283092 - protein, 30 aa, Mycobacterium
VDRGRPAPTHLGWSRYLRWVADNIGMSVIT

SEQ ID NO: 1283093 - protein, 19 aa, Mycobacterium
VDRLSCVRYGSARYSVPMR

SEQ ID NO: 1283094 - protein, 23 aa, Mycobacterium
VDRLYGLAGRFWSTAAELTDRRL

SEQ ID NO: 1283095 - protein, 24 aa, Mycobacterium
VDRPDMGITGWVALTIAQAGTDDQ

SEQ ID NO: 1283096 - protein, 25 aa, Mycobacterium
VDRPNRLSFTWSHSGWSDPTAQSIV

SEQ ID NO: 1283097 - protein, 19 aa, Mycobacterium
VDSDSWCNPPGRALGTPPT

SEQ ID NO: 1283098 - protein, 25 aa, Mycobacterium
VDSFWRDLVSFTWNIKTLEGRDQIT

SEQ ID NO: 1283099 - protein, 21 aa, Mycobacterium
VDSIRKAVDFYRARRADEEGP

SEQ ID NO: 1283100 - protein, 21 aa, Mycobacterium
VDSLRIFPATHYVAGPERMAQ

SEQ ID NO: 1283101 - protein, 21 aa, Mycobacterium
VDSPCGCTHFVALPRFPDPAA

SEQ ID NO: 1283102 - protein, 26 aa, Mycobacterium
VDSPELPPLWEVFGARLRTDGRWALP

SEQ ID NO: 1283103 - protein, 22 aa, Mycobacterium
VDSPGLTTIWARIFAATPQPPN

SEQ ID NO: 1283104 - protein, 18 aa, Mycobacterium
VDSPIIWASLANYHAPDR

SEQ ID NO: 1283105 - protein, 24 aa, Mycobacterium
VDSRRLGVPLAQELSAYLRTLDAA

SEQ ID NO: 1283106 - protein, 25 aa, Mycobacterium
VDSSRAAVLADWWSAVLGGTVDGFE

SEQ ID NO: 1283107 - protein, 17 aa, Mycobacterium
VDSYCKDLPLSRVDADV

SEQ ID NO: 1283108 - protein, 22 aa, Mycobacterium
VDTATGMPLYATQVLALDDSGG

SEQ ID NO: 1283109 - protein, 20 aa, Mycobacterium
VDTAVLCDLCHGKGTHGDST

SEQ ID NO: 1283110 - protein, 27 aa, Mycobacterium
VDTEGKPSLGWRGRRAAHKVSEAVAAA

SEQ ID NO: 1283111 - protein, 22 aa, Mycobacterium
VDTEIPSPVAGTLLSITAEEDD

SEQ ID NO: 1283112 - protein, 18 aa, Mycobacterium
VDTELKPNIEGWFESSTL

SEQ ID NO: 1283113 - protein, 20 aa, Mycobacterium
VDTHFGRLVRRWRWTAEEDP

SEQ ID NO: 1283114 - protein, 20 aa, Mycobacterium
VDTLAKAGAIFVEQTDEVPE

SEQ ID NO: 1283115 - protein, 19 aa, Mycobacterium
VDTLAKAGAVFVEQTDEVP

SEQ ID NO: 1283116 - protein, 21 aa, Mycobacterium
VDTSFSMVMENRWLPMKRTAL

SEQ ID NO: 1283117 - protein, 23 aa, Mycobacterium
VDTSIRPRAEWARLYNEKQQFAQ

SEQ ID NO: 1283118 - protein, 19 aa, Mycobacterium
VDTTIAFRCAVGDAGEIYK

SEQ ID NO: 1283119 - protein, 18 aa, Mycobacterium
VDTTLIWGLHDTVAPLRV

SEQ ID NO: 1283120 - protein, 25 aa, Mycobacterium
VDTTPRVAQMFGVQAVPTVVALAGG

SEQ ID NO: 1283121 - protein, 18 aa, Mycobacterium
VDVAEALASIGPQSYVLP

SEQ ID NO: 1283122 - protein, 32 aa, Mycobacterium
VDVDLVYRFIRDTTWVSVRWYQPGGPLTAQQV

SEQ ID NO: 1283123 - protein, 22 aa, Mycobacterium
VDVDSSLCIGNRTLSGRTVPYE

SEQ ID NO: 1283124 - protein, 24 aa, Mycobacterium
VDVEGWPAPAYLRAGQTVPRRDRG

SEQ ID NO: 1283125 - protein, 17 aa, Mycobacterium
VDVLARLGGDEFAWQVP

SEQ ID NO: 1283126 - protein, 17 aa, Mycobacterium
VDVLRRRTPGLTETDAR

SEQ ID NO: 1283127 - protein, 19 aa, Mycobacterium
VDVPELLRVLDFTPAEDVY

SEQ ID NO: 1283128 - protein, 20 aa, Mycobacterium
VDVPVLLLTGWQDLFVEQTL

SEQ ID NO: 1283129 - protein, 21 aa, Mycobacterium
VDVTLWLAGRPDLAVLPVGYF

SEQ ID NO: 1283130 - protein, 18 aa, Mycobacterium
VDVTRFLFDEEIVSIQIV

SEQ ID NO: 1283131 - protein, 17 aa, Mycobacterium
VDVWDDWLSNDMDQESA

SEQ ID NO: 1283132 - protein, 19 aa, Mycobacterium
VDVYSCFPSAVQVAARELG

SEQ ID NO: 1283133 - protein, 22 aa, Mycobacterium
VDWGAGCAAAPGAAISAGAIST

SEQ ID NO: 1283134 - protein, 17 aa, Mycobacterium
VDYAAFDEVHWVAPAEA

SEQ ID NO: 1283135 - protein, 25 aa, Mycobacterium
VDYAQRRRLKIFGHARIVTAEQDAA

SEQ ID NO: 1283136 - protein, 17 aa, Mycobacterium
VDYRLAPEHPWPAAAED

SEQ ID NO: 1283137 - protein, 18 aa, Mycobacterium
VDYTGAGTVEFIVSADRP

SEQ ID NO: 1283138 - protein, 22 aa, Mycobacterium
VEAEGVLFLSEYVAVTRRFRGA

SEQ ID NO: 1283139 - protein, 23 aa, Mycobacterium
VEAEPQFPALHIGAHSGTVLYRE

SEQ ID NO: 1283140 - protein, 18 aa, Mycobacterium
VEAFKRDVIDLINTSQDW

SEQ ID NO: 1283141 - protein, 18 aa, Mycobacterium
VEAGIGVWRGIPYAEQPT

SEQ ID NO: 1283142 - protein, 30 aa, Mycobacterium
VEAHLISPWGTWEWLGPNIVGGVVPRRGTL

SEQ ID NO: 1283143 - protein, 23 aa, Mycobacterium
VEAIPWGEDPSAVAVADPDKLTP

SEQ ID NO: 1283144 - protein, 23 aa, Mycobacterium
VEAKLALELGTTVILPAAIRYQT

SEQ ID NO: 1283145 - protein, 20 aa, Mycobacterium
VEALAAFIVEGIDRLGGALL

SEQ ID NO: 1283146 - protein, 21 aa, Mycobacterium
VEARCAEMCDAARDADVVLAE

SEQ ID NO: 1283147 - protein, 20 aa, Mycobacterium
VEARDGFAPTADRREPIRWR

SEQ ID NO: 1283148 - protein, 17 aa, Mycobacterium
VEARHLPGLSGRRDDDA

SEQ ID NO: 1283149 - protein, 17 aa, Mycobacterium
VEASRATLWAAALALDT

SEQ ID NO: 1283150 - protein, 25 aa, Mycobacterium
VEATRKLLMERGFDKLTIEAVAARA

SEQ ID NO: 1283151 - protein, 20 aa, Mycobacterium
VEAVGLPHFIRVARGEIDFD

SEQ ID NO: 1283152 - protein, 21 aa, Mycobacterium
VECGIDCIEHGFLMDDEAIQM

SEQ ID NO: 1283153 - protein, 17 aa, Mycobacterium
VEDELRITVKRDPGGVV

SEQ ID NO: 1283154 - protein, 30 aa, Mycobacterium
VEDFKPPLEWLQHIPVLGRFVVTPLVHLAH

SEQ ID NO: 1283155 - protein, 22 aa, Mycobacterium
VEDGVRIAIHYDAGVYDGSCAL

SEQ ID NO: 1283156 - protein, 23 aa, Mycobacterium
VEDLKMGLGTLVRHHSGFRRVAV

SEQ ID NO: 1283157 - protein, 23 aa, Mycobacterium
VEDPRLSTGRLCTSVVAGTDAFA

SEQ ID NO: 1283158 - protein, 18 aa, Mycobacterium
VEDVELATLSWVYWHNTA

SEQ ID NO: 1283159 - protein, 17 aa, Mycobacterium
VEDVKGKAKEGVGTVTG

SEQ ID NO: 1283160 - protein, 25 aa, Mycobacterium
VEEALKSGRLKAVVATSSLELGIDM

SEQ ID NO: 1283161 - protein, 17 aa, Mycobacterium
VEEAVALLGRLDGIAIT

SEQ ID NO: 1283162 - protein, 19 aa, Mycobacterium
VEEFKAVATQAVRGLAPVR

SEQ ID NO: 1283163 - protein, 17 aa, Mycobacterium
VEEIERWAGHPYMAQIL

SEQ ID NO: 1283164 - protein, 25 aa, Mycobacterium
VEELGIDVFLVMPFTADFMKLTPER

SEQ ID NO: 1283165 - protein, 18 aa, Mycobacterium
VEELGIDVFLVMPFTSDF

SEQ ID NO: 1283166 - protein, 29 aa, Mycobacterium
VEEMIRWATPVKEFMRTAAADTEVRGVPI

SEQ ID NO: 1283167 - protein, 30 aa, Mycobacterium
VEEMIRWATPVKEFMRTAAADTEVRGVPIK

SEQ ID NO: 1283168 - protein, 20 aa, Mycobacterium
VEEMIRWSTPVKEFMRTAAA

SEQ ID NO: 1283169 - protein, 27 aa, Mycobacterium
VEEMIRWSTPVKEFMRTAAEDTTVRGV

SEQ ID NO: 1283170 - protein, 23 aa, Mycobacterium
VEENFRLLDRAAREKIAAWDGSK

SEQ ID NO: 1283171 - protein, 24 aa, Mycobacterium
VEEPRKEWTLQFTIGEAPRSSAVV

SEQ ID NO: 1283172 - protein, 24 aa, Mycobacterium
VEEVLRWASPLVHMRRTAVQDVTL

SEQ ID NO: 1283173 - protein, 17 aa, Mycobacterium
VEEVVVIGRRGPLQATF

SEQ ID NO: 1283174 - protein, 18 aa, Mycobacterium
VEEYFGFIWTYLGESPVP

SEQ ID NO: 1283175 - protein, 19 aa, Mycobacterium
VEFGKSPDAARAWVTTVDQ

SEQ ID NO: 1283176 - protein, 20 aa, Mycobacterium
VEFIAEAISTLGSDVASGFR

SEQ ID NO: 1283177 - protein, 18 aa, Mycobacterium
VEFRDLYRGALPALTAED

SEQ ID NO: 1283178 - protein, 17 aa, Mycobacterium
VEFRYGSAVSVLERSAD

SEQ ID NO: 1283179 - protein, 17 aa, Mycobacterium
VEFSERLAALLPDPLDT

SEQ ID NO: 1283180 - protein, 17 aa, Mycobacterium
VEGLATVIPFHRAVVAD

SEQ ID NO: 1283181 - protein, 22 aa, Mycobacterium
VEGLLPRQLHVFDALDRDPRGW

SEQ ID NO: 1283182 - protein, 23 aa, Mycobacterium
VEGLLSSMAFCIDKIGDQGVAAE

SEQ ID NO: 1283183 - protein, 20 aa, Mycobacterium
VEGLPFDPVKGIVPNDRGRV

SEQ ID NO: 1283184 - protein, 21 aa, Mycobacterium
VEGLYTRWPDRDSLVSQIDSD

SEQ ID NO: 1283185 - protein, 20 aa, Mycobacterium
VEGNDLWMAALHSRADPRAR

SEQ ID NO: 1283186 - protein, 18 aa, Mycobacterium
VEGSLPFVASHAPTNAPP

SEQ ID NO: 1283187 - protein, 24 aa, Mycobacterium
VEGTRPAVELAWLSDIDGQPAATA

SEQ ID NO: 1283188 - protein, 19 aa, Mycobacterium
VEGTVQFIWGGLSHVPMTR

SEQ ID NO: 1283189 - protein, 24 aa, Mycobacterium
VEGVRLKSGRAFSVQYHPEAAAGP

SEQ ID NO: 1283190 - protein, 20 aa, Mycobacterium
VEGYACEWKGVLSDPDKLSR

SEQ ID NO: 1283191 - protein, 28 aa, Mycobacterium
VEHAFTWILPLMWRMDALYEARKSWVDI

SEQ ID NO: 1283192 - protein, 17 aa, Mycobacterium
VEHGGWTWRYDLEAVGP

SEQ ID NO: 1283193 - protein, 24 aa, Mycobacterium
VEHPLWLSTMRARSWVDEFGTTEQ

SEQ ID NO: 1283194 - protein, 23 aa, Mycobacterium
VEHRRADVVAVQWHPEDRHADSI

SEQ ID NO: 1283195 - protein, 26 aa, Mycobacterium
VEHSLRAGLFERPLIAGHGVWLTEAD

SEQ ID NO: 1283196 - protein, 18 aa, Mycobacterium
VEHVGSALPEFALTMREQ

SEQ ID NO: 1283197 - protein, 24 aa, Mycobacterium
VEIAKSLFAERGFDGTSIEEIALR

SEQ ID NO: 1283198 - protein, 23 aa, Mycobacterium
VEICLACHFILPDDWRNGHAVCI

SEQ ID NO: 1283199 - protein, 19 aa, Mycobacterium
VEIGDRVTTLFSEHPDVAT

SEQ ID NO: 1283200 - protein, 23 aa, Mycobacterium
VEINEAFAAVGIESTRALGLDPE

SEQ ID NO: 1283201 - protein, 21 aa, Mycobacterium
VEINEAFAPVVQAWLKETKAD

SEQ ID NO: 1283202 - protein, 19 aa, Mycobacterium
VEINEAFASVVLSWAQVHD

SEQ ID NO: 1283203 - protein, 25 aa, Mycobacterium
VEINSRLGTYTNFCNLFDMCAIAVP

SEQ ID NO: 1283204 - protein, 21 aa, Mycobacterium
VEIPAGSVIDVCIGSANRDES

SEQ ID NO: 1283205 - protein, 27 aa, Mycobacterium
VEIPNREDLAFLPGQYVNVAVPGTDVA

SEQ ID NO: 1283206 - protein, 21 aa, Mycobacterium
VEIPSPFAGRIAELGGAAGQT

SEQ ID NO: 1283207 - protein, 22 aa, Mycobacterium
VEKARALWHERIQPFARNLEAG

SEQ ID NO: 1283208 - protein, 24 aa, Mycobacterium
VEKARQLWFDRILPLAENIRTGEV

SEQ ID NO: 1283209 - protein, 26 aa, Mycobacterium
VEKFLLELGQGFAFVGRQVHLEIGDA

SEQ ID NO: 1283210 - protein, 24 aa, Mycobacterium
VEKLAKLRPVFGVRSGDATMTAGN

SEQ ID NO: 1283211 - protein, 17 aa, Mycobacterium
VEKRWGATMVLTEPDAG

SEQ ID NO: 1283212 - protein, 17 aa, Mycobacterium
VEKVIEFDLPDGVKVTG

SEQ ID NO: 1283213 - protein, 17 aa, Mycobacterium
VELAATCPPQLKTAHDG

SEQ ID NO: 1283214 - protein, 21 aa, Mycobacterium
VELAEALVCAAARETFEESGV

SEQ ID NO: 1283215 - protein, 20 aa, Mycobacterium
VELAEICGHIASLPLDRTRP

SEQ ID NO: 1283216 - protein, 17 aa, Mycobacterium
VELAIRLGGDRVSRRIR

SEQ ID NO: 1283217 - protein, 20 aa, Mycobacterium
VELAQGFLLTEGIISSREDI

SEQ ID NO: 1283218 - protein, 19 aa, Mycobacterium
VELDARLRNRLELLDKQSL

SEQ ID NO: 1283219 - protein, 17 aa, Mycobacterium
VELEGILARLGHSIAFF

SEQ ID NO: 1283220 - protein, 17 aa, Mycobacterium
VELFHAAPGCVRSASAF

SEQ ID NO: 1283221 - protein, 18 aa, Mycobacterium
VELFKPLAKKATRPEVRG

SEQ ID NO: 1283222 - protein, 17 aa, Mycobacterium
VELGAAPVDVWTDELFG

SEQ ID NO: 1283223 - protein, 26 aa, Mycobacterium
VELHFGHLYLPSSFLSPLINRRRDEY

SEQ ID NO: 1283224 - protein, 18 aa, Mycobacterium
VELIPETKQIVVADNSPE

SEQ ID NO: 1283225 - protein, 26 aa, Mycobacterium
VELIYKCPRPPTGIIARNERIAPDEW

SEQ ID NO: 1283226 - protein, 19 aa, Mycobacterium
VELLKWAKSQGISITAEVT

SEQ ID NO: 1283227 - protein, 20 aa, Mycobacterium
VELMPRPHLRIYRTDRTGRL

SEQ ID NO: 1283228 - protein, 22 aa, Mycobacterium
VELPEGKGLVLLTDGLFEGHIG

SEQ ID NO: 1283229 - protein, 23 aa, Mycobacterium
VELPLMEVRALLDLGDVAKATRK

SEQ ID NO: 1283230 - protein, 20 aa, Mycobacterium
VELRRRIEQGVGREIPATLA

SEQ ID NO: 1283231 - protein, 20 aa, Mycobacterium
VELRVAATLENLAVLRTLVA

SEQ ID NO: 1283232 - protein, 17 aa, Mycobacterium
VELVFSPFDLQAIEVRD

SEQ ID NO: 1283233 - protein, 19 aa, Mycobacterium
VELVRRVHEELPFQTLATG

SEQ ID NO: 1283234 - protein, 18 aa, Mycobacterium
VELWALAVSTDYGGNAAV

SEQ ID NO: 1283235 - protein, 17 aa, Mycobacterium
VELWPALTGPADLHKVE

SEQ ID NO: 1283236 - protein, 17 aa, Mycobacterium
VEMAHAIVWASVATVDA

SEQ ID NO: 1283237 - protein, 25 aa, Mycobacterium
VEMGMARLWRSWGVEPDVVLGHSVG

SEQ ID NO: 1283238 - protein, 20 aa, Mycobacterium
VEMRDGTVLYLRPVLPGDVE

SEQ ID NO: 1283239 - protein, 19 aa, Mycobacterium
VEMTRRYLAPEKVDGYLEF

SEQ ID NO: 1283240 - protein, 18 aa, Mycobacterium
VEMVCRWQGALARILTAF

SEQ ID NO: 1283241 - protein, 17 aa, Mycobacterium
VENALTLHPAVHDVAVI

SEQ ID NO: 1283242 - protein, 25 aa, Mycobacterium
VENFRPGTMERLGLGYEDLRAVRPD

SEQ ID NO: 1283243 - protein, 24 aa, Mycobacterium
VENLAASFYDWYTDTMQFLAGPAR

SEQ ID NO: 1283244 - protein, 23 aa, Mycobacterium
VENMPEIWRRLDAVGLQTTEACG

SEQ ID NO: 1283245 - protein, 24 aa, Mycobacterium
VENPAGKIGEVWLHGDHVAAGYWH

SEQ ID NO: 1283246 - protein, 19 aa, Mycobacterium
VENQGRRIIAHQADVRDAD

SEQ ID NO: 1283247 - protein, 17 aa, Mycobacterium
VEPERYVSAGLWRTADT

SEQ ID NO: 1283248 - protein, 27 aa, Mycobacterium
VEPGRYRLIVARACPWANRTIIVRRLL

SEQ ID NO: 1283249 - protein, 20 aa, Mycobacterium
VEPIWLDWIARWPTPSATAA

SEQ ID NO: 1283250 - protein, 17 aa, Mycobacterium
VEPLIFGQRVRDYQPGM

SEQ ID NO: 1283251 - protein, 19 aa, Mycobacterium
VEPPGCAPPRVGPGPEHAV

SEQ ID NO: 1283252 - protein, 30 aa, Mycobacterium
VEPRLQALKAKYCDQVQWAGPVSGDAKVAF

SEQ ID NO: 1283253 - protein, 21 aa, Mycobacterium
VEPSCPLLLVVRTSFADNGVA

SEQ ID NO: 1283254 - protein, 19 aa, Mycobacterium
VEPWGLYMARPTPGRAQFH

SEQ ID NO: 1283255 - protein, 18 aa, Mycobacterium
VEQFGRLDIVVANAGVLS

SEQ ID NO: 1283256 - protein, 27 aa, Mycobacterium
VEQFLTLRPGDRLRLTRDCSPVPTDSA

SEQ ID NO: 1283257 - protein, 17 aa, Mycobacterium
VEQYNLVVWNQRDFALA

SEQ ID NO: 1283258 - protein, 22 aa, Mycobacterium
VERAAALGYRLTAGYELEFYLY

SEQ ID NO: 1283259 - protein, 19 aa, Mycobacterium
VERAHRLLVLLGGRVAHPA

SEQ ID NO: 1283260 - protein, 20 aa, Mycobacterium
VERAWGLTIRDGFGQTETTL

SEQ ID NO: 1283261 - protein, 17 aa, Mycobacterium
VERCLPLADHIARRFDG

SEQ ID NO: 1283262 - protein, 24 aa, Mycobacterium
VERDGRVWLERGCRSHGLVRTLYD

SEQ ID NO: 1283263 - protein, 18 aa, Mycobacterium
VERFGAPGGGVWTVISTA

SEQ ID NO: 1283264 - protein, 24 aa, Mycobacterium
VERISCAAGAFAELGIEKGDRAAI

SEQ ID NO: 1283265 - protein, 24 aa, Mycobacterium
VERPEFLVSPMISKAAAEPLDAVR

SEQ ID NO: 1283266 - protein, 24 aa, Mycobacterium
VERSPLPFGRHRWVASTGPVDLDI

SEQ ID NO: 1283267 - protein, 20 aa, Mycobacterium
VERVREVTCALGRREGADLL

SEQ ID NO: 1283268 - protein, 25 aa, Mycobacterium
VESAARRWGLRRGVPTVVYDDWNRA

SEQ ID NO: 1283269 - protein, 23 aa, Mycobacterium
VESADALIRVALPGGESQSQIVT

SEQ ID NO: 1283270 - protein, 24 aa, Mycobacterium
VESAWKLAKQYFKLTGKPGKYKVV

SEQ ID NO: 1283271 - protein, 24 aa, Mycobacterium
VESAWKLAKQYYKLVGKPGKFKVI

SEQ ID NO: 1283272 - protein, 22 aa, Mycobacterium
VESFGYKYGLPMDADTVMDVRF

SEQ ID NO: 1283273 - protein, 22 aa, Mycobacterium
VESHGWKPLMLHDRSADAGDSW

SEQ ID NO: 1283274 - protein, 23 aa, Mycobacterium
VESKCSYLAPVAYPDELRAGLRV

SEQ ID NO: 1283275 - protein, 27 aa, Mycobacterium
VESKLPVPIHIGAGYGGDSDWLHGVWK

SEQ ID NO: 1283276 - protein, 19 aa, Mycobacterium
VESLERWALVDGAEVTVVF

SEQ ID NO: 1283277 - protein, 20 aa, Mycobacterium
VESYVALGISEGARLVCGGS

SEQ ID NO: 1283278 - protein, 19 aa, Mycobacterium
VETERRFYLANSVEMIPRN

SEQ ID NO: 1283279 - protein, 17 aa, Mycobacterium
VETGMHFHDAELLRARA

SEQ ID NO: 1283280 - protein, 18 aa, Mycobacterium
VETILRFEATVYAELGAG

SEQ ID NO: 1283281 - protein, 25 aa, Mycobacterium
VETKLSRFLSDWAHDGKPGLVILTG

SEQ ID NO: 1283282 - protein, 22 aa, Mycobacterium
VETLTGFKWLARADEGLDARLV

SEQ ID NO: 1283283 - protein, 30 aa, Mycobacterium
VETWAHGLWAVYHRHRWILATASFGPPLDP

SEQ ID NO: 1283284 - protein, 17 aa, Mycobacterium
VEVAVKMALQFWRSTGR

SEQ ID NO: 1283285 - protein, 23 aa, Mycobacterium
VEVCRTCSWNHLVKSYVLGAIPP

SEQ ID NO: 1283286 - protein, 26 aa, Mycobacterium
VEVDGHPSIRCQLELTAGTDQPVDSS

SEQ ID NO: 1283287 - protein, 18 aa, Mycobacterium
VEVIGHMLLVTRGSKRCF

SEQ ID NO: 1283288 - protein, 21 aa, Mycobacterium
VEVLDAMASWWTAVHGHGHPV

SEQ ID NO: 1283289 - protein, 18 aa, Mycobacterium
VEVLELGDLLAEVVATPQ

SEQ ID NO: 1283290 - protein, 23 aa, Mycobacterium
VEVLRLRIGRDIRDRLSDALGPD

SEQ ID NO: 1283291 - protein, 19 aa, Mycobacterium
VEVMSRVPLGAARATGMPY

SEQ ID NO: 1283292 - protein, 25 aa, Mycobacterium
VEVPGLLDLSSLWQIYGVDRPALKD

SEQ ID NO: 1283293 - protein, 19 aa, Mycobacterium
VEVQVAYAIGKAAPVGLFV

SEQ ID NO: 1283294 - protein, 21 aa, Mycobacterium
VEVSGPCVMRGYWRNPELTAE

SEQ ID NO: 1283295 - protein, 19 aa, Mycobacterium
VEVTGWLPRAQALAELARG

SEQ ID NO: 1283296 - protein, 19 aa, Mycobacterium
VEWRHPFGHHWRFEFEEIS

SEQ ID NO: 1283297 - protein, 24 aa, Mycobacterium
VEYEVDCVIFASGFEISTEISRRY

SEQ ID NO: 1283298 - protein, 23 aa, Mycobacterium
VEYKPMLDAAVGMVEHPPRHCVV

SEQ ID NO: 1283299 - protein, 17 aa, Mycobacterium
VEYLGLWDTFAVPGLPR

SEQ ID NO: 1283300 - protein, 25 aa, Mycobacterium
VFAEECARAGVPRQLNITGADLVGP

SEQ ID NO: 1283301 - protein, 20 aa, Mycobacterium
VFAGGFDLAGAHGVCAEDAA

SEQ ID NO: 1283302 - protein, 18 aa, Mycobacterium
VFAGVLAANWPRGADYAL

SEQ ID NO: 1283303 - protein, 26 aa, Mycobacterium
VFALSGWDVCGMLTLPPSQITELLHG

SEQ ID NO: 1283304 - protein, 17 aa, Mycobacterium
VFAPLGMTDTRYLPAAK

SEQ ID NO: 1283305 - protein, 20 aa, Mycobacterium
VFARLPHVLFDIRIEDQDHS

SEQ ID NO: 1283306 - protein, 28 aa, Mycobacterium
VFARRLPDGRRYGVTAGTARFVEALQAF

SEQ ID NO: 1283307 - protein, 23 aa, Mycobacterium
VFASGRLPLKFTAYDGSSAGPDD

SEQ ID NO: 1283308 - protein, 21 aa, Mycobacterium
VFDDCRVPVTAILGGEPGRGF

SEQ ID NO: 1283309 - protein, 26 aa, Mycobacterium
VFDGEAYPQVLIRLGWAPADGSALPV

SEQ ID NO: 1283310 - protein, 25 aa, Mycobacterium
VFDRLPELWVIVGHMGEMIPFALAR

SEQ ID NO: 1283311 - protein, 26 aa, Mycobacterium
VFDRLPGVYRLLGAVMNRIPAARTMS

SEQ ID NO: 1283312 - protein, 24 aa, Mycobacterium
VFEGLKAYRWADGSIVSFRPEANA

SEQ ID NO: 1283313 - protein, 23 aa, Mycobacterium
VFEHLGRLLIVDCGVLFPTHDEP

SEQ ID NO: 1283314 - protein, 18 aa, Mycobacterium
VFERLRENGARGAVVVGD

SEQ ID NO: 1283315 - protein, 18 aa, Mycobacterium
VFFCCKAALRHMVPAQKG

SEQ ID NO: 1283316 - protein, 24 aa, Mycobacterium
VFFRACAPCYFDFFEQCTSTDGGY

SEQ ID NO: 1283317 - protein, 26 aa, Mycobacterium
VFGLPIFKLGGSPVKVVSSVTLGDLD

SEQ ID NO: 1283318 - protein, 25 aa, Mycobacterium
VFGRRVALIACEFDFLAGSIGVAAA

SEQ ID NO: 1283319 - protein, 29 aa, Mycobacterium
VFGTGLPQWRGVSGADMLRHVHSMMTAEG

SEQ ID NO: 1283320 - protein, 18 aa, Mycobacterium
VFHGSAFRRLEVAVDTEV

SEQ ID NO: 1283321 - protein, 20 aa, Mycobacterium
VFICGPAPFMKSARSAIEGL

SEQ ID NO: 1283322 - protein, 26 aa, Mycobacterium
VFINYPREFGIMTGLGSHTYDDSKSI

SEQ ID NO: 1283323 - protein, 22 aa, Mycobacterium
VFIPAGLAHRVANTAPHDAHVV

SEQ ID NO: 1283324 - protein, 18 aa, Mycobacterium
VFKVQWNPSGGILLSHQI

SEQ ID NO: 1283325 - protein, 18 aa, Mycobacterium
VFLAERAYDVHLLKLTNS

SEQ ID NO: 1283326 - protein, 26 aa, Mycobacterium
VFLEQRAAGTLQVWLEPYTELRAPKL

SEQ ID NO: 1283327 - protein, 19 aa, Mycobacterium
VFLRRCVSLARTALDGGDE

SEQ ID NO: 1283328 - protein, 28 aa, Mycobacterium
VFMSTSARLKCPFTSLGIAPEAASTYLL

SEQ ID NO: 1283329 - protein, 23 aa, Mycobacterium
VFNDPLVECLNCHKRHRQDHMQE

SEQ ID NO: 1283330 - protein, 18 aa, Mycobacterium
VFNPLTLYWCHDSNGVLR

SEQ ID NO: 1283331 - protein, 23 aa, Mycobacterium
VFQQPRLFPWRTVGGNVDMALRY

SEQ ID NO: 1283332 - protein, 24 aa, Mycobacterium
VFQRTPIWCFPKFDVPLSKTAQTM

SEQ ID NO: 1283333 - protein, 17 aa, Mycobacterium
VFQSDFDTAILLTRYLV

SEQ ID NO: 1283334 - protein, 21 aa, Mycobacterium
VFREEFPLGPAGKILKREIAN

SEQ ID NO: 1283335 - protein, 18 aa, Mycobacterium
VFRKDLRRAVIFGRNDLV

SEQ ID NO: 1283336 - protein, 18 aa, Mycobacterium
VFRPHAFDGDERTVMTVE

SEQ ID NO: 1283337 - protein, 25 aa, Mycobacterium
VFRPSPYAVRCCERSVEILREAAEA

SEQ ID NO: 1283338 - protein, 27 aa, Mycobacterium
VFRQRYWARNHLGWRHMDQTQPNAGHR

SEQ ID NO: 1283339 - protein, 19 aa, Mycobacterium
VFRRANLEPSVALHQVAAS

SEQ ID NO: 1283340 - protein, 20 aa, Mycobacterium
VFRYPRLGPGQLWEAAAGTL

SEQ ID NO: 1283341 - protein, 23 aa, Mycobacterium
VFSEYRLDHQFEVIRLVGEKTDV

SEQ ID NO: 1283342 - protein, 19 aa, Mycobacterium
VFSQLEFGGSRTEWRRSQG

SEQ ID NO: 1283343 - protein, 25 aa, Mycobacterium
VFTLLGRCPELYVAILGALRNGSVV

SEQ ID NO: 1283344 - protein, 23 aa, Mycobacterium
VFTPDELAAWAARIRTEIGADAQ

SEQ ID NO: 1283345 - protein, 26 aa, Mycobacterium
VFTSHDIRALYLFKRTAWVPYSVTMK

SEQ ID NO: 1283346 - protein, 18 aa, Mycobacterium
VFVFHPAGGTTVVYEPLM

SEQ ID NO: 1283347 - protein, 23 aa, Mycobacterium
VFVIGDRLAVPGQWDAPEGQWNM

SEQ ID NO: 1283348 - protein, 19 aa, Mycobacterium
VFVKQLLDIGAQNLIVPMI

SEQ ID NO: 1283349 - protein, 20 aa, Mycobacterium
VFVMDHFYQLPGLGTPDQPM

SEQ ID NO: 1283350 - protein, 24 aa, Mycobacterium
VFVTAPDVPLGWWEFYSISDDDPA

SEQ ID NO: 1283351 - protein, 18 aa, Mycobacterium
VFYGHYWRSGDPRHLHDW

SEQ ID NO: 1283352 - protein, 24 aa, Mycobacterium
VFYLHSRLLERCAKLSDELGGGSM

SEQ ID NO: 1283353 - protein, 29 aa, Mycobacterium
VGAADPFQLFRIMFEVIRGGGLDPKSGVA

SEQ ID NO: 1283354 - protein, 17 aa, Mycobacterium
VGAAFANVEMDIVLRTV

SEQ ID NO: 1283355 - protein, 24 aa, Mycobacterium
VGAARAALMAALFDRTPPAPATAA

SEQ ID NO: 1283356 - protein, 17 aa, Mycobacterium
VGAAVAYLPNPRAEADE

SEQ ID NO: 1283357 - protein, 26 aa, Mycobacterium
VGADKGVSRRSVFRLFDKLANAGMAE

SEQ ID NO: 1283358 - protein, 24 aa, Mycobacterium
VGADRGYRGLQFFHATGLPLHDIR

SEQ ID NO: 1283359 - protein, 19 aa, Mycobacterium
VGAEAHWRKHLDTTRELLL

SEQ ID NO: 1283360 - protein, 26 aa, Mycobacterium
VGAFDIPGFRLAAAGVPVYRRGVLVR

SEQ ID NO: 1283361 - protein, 21 aa, Mycobacterium
VGAGGAGMRAAVEAGPRARTA

SEQ ID NO: 1283362 - protein, 26 aa, Mycobacterium
VGAGGRDAWQWMIERPLAEAITSAVG

SEQ ID NO: 1283363 - protein, 20 aa, Mycobacterium
VGAGLHRFVFTSSIGTIGLA

SEQ ID NO: 1283364 - protein, 17 aa, Mycobacterium
VGAGRTGLVAANGAGKS

SEQ ID NO: 1283365 - protein, 23 aa, Mycobacterium
VGAHRFLQRVWRLVVSEETGETV

SEQ ID NO: 1283366 - protein, 17 aa, Mycobacterium
VGAILAVGGIRGALRST

SEQ ID NO: 1283367 - protein, 26 aa, Mycobacterium
VGAIRLPERVRWADAMELLLTGRPIT

SEQ ID NO: 1283368 - protein, 17 aa, Mycobacterium
VGAKVPHLADVKPFGAY

SEQ ID NO: 1283369 - protein, 17 aa, Mycobacterium
VGALAAWLASPVAGMVT

SEQ ID NO: 1283370 - protein, 18 aa, Mycobacterium
VGALADWSDAARFITLDD

SEQ ID NO: 1283371 - protein, 18 aa, Mycobacterium
VGALGRLGFDGISDVRQG

SEQ ID NO: 1283372 - protein, 22 aa, Mycobacterium
VGALRGALRNRPNLAPHGVPAA

SEQ ID NO: 1283373 - protein, 17 aa, Mycobacterium
VGAQGVLRDVRRVEAAT

SEQ ID NO: 1283374 - protein, 19 aa, Mycobacterium
VGARLGRPVDATSDVVIAL

SEQ ID NO: 1283375 - protein, 30 aa, Mycobacterium
VGARPVWLEPRWDAEFGVAHGLDAAVVARA

SEQ ID NO: 1283376 - protein, 24 aa, Mycobacterium
VGARRTAEELGRAFPGTPVVTSGG

SEQ ID NO: 1283377 - protein, 25 aa, Mycobacterium
VGAVGDIYRSFGIDFPHAARAAMTA

SEQ ID NO: 1283378 - protein, 18 aa, Mycobacterium
VGAVHLDKGCYRGQETVA

SEQ ID NO: 1283379 - protein, 18 aa, Mycobacterium
VGAVPLFVIGGSLLGGWK

SEQ ID NO: 1283380 - protein, 23 aa, Mycobacterium
VGDCVGHGLAAAAIMGQLRSACR

SEQ ID NO: 1283381 - protein, 21 aa, Mycobacterium
VGDCVGHGLPAATVMGQVRSA

SEQ ID NO: 1283382 - protein, 24 aa, Mycobacterium
VGDDIRFGLGAVRNVGANVVSSLV

SEQ ID NO: 1283383 - protein, 20 aa, Mycobacterium
VGDELVRVVAGQGWSVNATT

SEQ ID NO: 1283384 - protein, 19 aa, Mycobacterium
VGDEWAMRAAPLGVVSGAV

SEQ ID NO: 1283385 - protein, 17 aa, Mycobacterium
VGDGFALTVDQTAAGGP

SEQ ID NO: 1283386 - protein, 25 aa, Mycobacterium
VGDGKCLRSTFAYLGWLAGAAPDDA

SEQ ID NO: 1283387 - protein, 22 aa, Mycobacterium
VGDGWPAAMTVLGFERGSQVTT

SEQ ID NO: 1283388 - protein, 25 aa, Mycobacterium
VGDHNIVSVGFNWTMGEHVTPPKPL

SEQ ID NO: 1283389 - protein, 25 aa, Mycobacterium
VGDIARPRTEIMLNLGNPDLAFKTS

SEQ ID NO: 1283390 - protein, 18 aa, Mycobacterium
VGDLYRLRLREVGDSAYA

SEQ ID NO: 1283391 - protein, 22 aa, Mycobacterium
VGDMHTCMMPPPAAHPPTPLVG

SEQ ID NO: 1283392 - protein, 23 aa, Mycobacterium
VGDPIQSIYGWRGASATNLPRFT

SEQ ID NO: 1283393 - protein, 24 aa, Mycobacterium
VGDPRYYERFGFRQATTLALPDVP

SEQ ID NO: 1283394 - protein, 17 aa, Mycobacterium
VGDQIVEMIRAHRDVSK

SEQ ID NO: 1283395 - protein, 23 aa, Mycobacterium
VGDRKTYLFAFLDDHSRLVVGHR

SEQ ID NO: 1283396 - protein, 26 aa, Mycobacterium
VGDSMVDAAICDGDWVVVRQQAVADN

SEQ ID NO: 1283397 - protein, 17 aa, Mycobacterium
VGEAEQLITGRLGEMVT

SEQ ID NO: 1283398 - protein, 32 aa, Mycobacterium
VGEAIRRRGGIALKPLIARALRMGDEVHSRNA

SEQ ID NO: 1283399 - protein, 24 aa, Mycobacterium
VGEALRSVPIVVGRADVDGVHGPR

SEQ ID NO: 1283400 - protein, 21 aa, Mycobacterium
VGEARSFALLERFELQRWADA

SEQ ID NO: 1283401 - protein, 20 aa, Mycobacterium
VGEERDWQASEADLIEQSLA

SEQ ID NO: 1283402 - protein, 18 aa, Mycobacterium
VGEEWLYQSWSACYLPLV

SEQ ID NO: 1283403 - protein, 20 aa, Mycobacterium
VGEGKLAGILAEVAAPQHVV

SEQ ID NO: 1283404 - protein, 17 aa, Mycobacterium
VGELPELAVPWKAEAAP

SEQ ID NO: 1283405 - protein, 17 aa, Mycobacterium
VGELVTSLDMAGCSLTV

SEQ ID NO: 1283406 - protein, 18 aa, Mycobacterium
VGEQKLDVLAAWTEAGEL

SEQ ID NO: 1283407 - protein, 17 aa, Mycobacterium
VGERVVWSVTAACGQCP

SEQ ID NO: 1283408 - protein, 25 aa, Mycobacterium
VGETGWPYVQFRGGPRGFVRVLDDH

SEQ ID NO: 1283409 - protein, 19 aa, Mycobacterium
VGEVPPERWQPFDDGSPEV

SEQ ID NO: 1283410 - protein, 22 aa, Mycobacterium
VGEVRRAAQILRYYGNEGDRQA

SEQ ID NO: 1283411 - protein, 21 aa, Mycobacterium
VGFACQSFAALSLDPPLVLFC

SEQ ID NO: 1283412 - protein, 23 aa, Mycobacterium
VGFFKLLQPEQWGGLQCDPTIFY

SEQ ID NO: 1283413 - protein, 20 aa, Mycobacterium
VGFQDGWRGLLEDRRIQLSN

SEQ ID NO: 1283414 - protein, 25 aa, Mycobacterium
VGGAHPQTWFKAFNYDLGARAPITF

SEQ ID NO: 1283415 - protein, 26 aa, Mycobacterium
VGGAPLTECLKDVVERFVPYFTEVIV

SEQ ID NO: 1283416 - protein, 29 aa, Mycobacterium
VGGDYPRDWPRPQHGWTLTIEGDPSMRTH

SEQ ID NO: 1283417 - protein, 23 aa, Mycobacterium
VGGESARSRVCFTMDEVRDTVAD

SEQ ID NO: 1283418 - protein, 17 aa, Mycobacterium
VGGGSEFASGTAAENAS

SEQ ID NO: 1283419 - protein, 18 aa, Mycobacterium
VGGIFAKLPLSDDGDRRV

SEQ ID NO: 1283420 - protein, 23 aa, Mycobacterium
VGGLGHLGVQWARAMGFETVAIG

SEQ ID NO: 1283421 - protein, 26 aa, Mycobacterium
VGGLGMWKVHQSSAPGPVIAVNGPQA

SEQ ID NO: 1283422 - protein, 23 aa, Mycobacterium
VGGLRGGFEYSRTGNPTRSVLEG

SEQ ID NO: 1283423 - protein, 34 aa, Mycobacterium; identical to SEQ ID NO: 745296

SEQ ID NO: 1283424 - protein, 18 aa, Mycobacterium
VGGPRYVYERKIASGSTL

SEQ ID NO: 1283425 - protein, 23 aa, Mycobacterium
VGGSAGSYGRLIVTPDMEPPDAG

SEQ ID NO: 1283426 - protein, 23 aa, Mycobacterium
VGGSIPFIAEFAAAFPDAKILVT

SEQ ID NO: 1283427 - protein, 23 aa, Mycobacterium
VGGSPAEAWRVWQRDARKHPSPN

SEQ ID NO: 1283428 - protein, 33 aa, Mycobacterium
VGGVFRVLLCVAEARPFVLLPKFELKQWADAVR

SEQ ID NO: 1283429 - protein, 23 aa, Mycobacterium
VGGVPLRAGERVAMFYPSANRDE

SEQ ID NO: 1283430 - protein, 23 aa, Mycobacterium
VGGVPTLLWKLIAEIRPSDRVVL

SEQ ID NO: 1283431 - protein, 25 aa, Mycobacterium
VGHAAIQLARWAGARVITTVSTSEK

SEQ ID NO: 1283432 - protein, 18 aa, Mycobacterium
VGHAGEWLAASAIDEPAD

SEQ ID NO: 1283433 - protein, 18 aa, Mycobacterium
VGHAIGYQRHEQCTANGE

SEQ ID NO: 1283434 - protein, 17 aa, Mycobacterium
VGHLGAPARVFFCNSGT

SEQ ID NO: 1283435 - protein, 18 aa, Mycobacterium
VGIAALLKAERVRKIVCS

SEQ ID NO: 1283436 - protein, 25 aa, Mycobacterium
VGIASSTRYEWILADLAIMCAGGAT

SEQ ID NO: 1283437 - protein, 26 aa, Mycobacterium
VGIDLREDWPAALRGAGFDPTRPTAW

SEQ ID NO: 1283438 - protein, 17 aa, Mycobacterium
VGIGAGATWAADNNTVY

SEQ ID NO: 1283439 - protein, 18 aa, Mycobacterium
VGIKDALSPQVMFTDLGL

SEQ ID NO: 1283440 - protein, 20 aa, Mycobacterium
VGILHGCLRHHSPYDEHKAW

SEQ ID NO: 1283441 - protein, 19 aa, Mycobacterium
VGILPGGGMTARLPQVVGA

SEQ ID NO: 1283442 - protein, 17 aa, Mycobacterium
VGITPEGSWVLTDGRPE

SEQ ID NO: 1283443 - protein, 17 aa, Mycobacterium
VGITVQPAESWNVFDPV

SEQ ID NO: 1283444 - protein, 17 aa, Mycobacterium
VGIVTDWLKRHDFAGTR

SEQ ID NO: 1283445 - protein, 17 aa, Mycobacterium
VGKDNPIKLVWEKDPSL

SEQ ID NO: 1283446 - protein, 18 aa, Mycobacterium
VGKHFSVNVMLDRDTVRR

SEQ ID NO: 1283447 - protein, 26 aa, Mycobacterium
VGKIRLPLGQGISGWVASNREPVVIR

SEQ ID NO: 1283448 - protein, 23 aa, Mycobacterium
VGKSDREGMTFDDVLTRVAQITA

SEQ ID NO: 1283449 - protein, 18 aa, Mycobacterium
VGLADRFGTEQAVSFSGI

SEQ ID NO: 1283450 - protein, 23 aa, Mycobacterium
VGLDHARSWYRPSAGTEWQLLVS

SEQ ID NO: 1283451 - protein, 25 aa, Mycobacterium
VGLDPVLRADLWDRFDRLARDGTTL

SEQ ID NO: 1283452 - protein, 19 aa, Mycobacterium
VGLGCNLALAADFTVAGTD

SEQ ID NO: 1283453 - protein, 20 aa, Mycobacterium
VGLGCSIALLSDLLVMGESS

SEQ ID NO: 1283454 - protein, 23 aa, Mycobacterium
VGLGCSLAALSDVVYIAENAFFA

SEQ ID NO: 1283455 - protein, 20 aa, Mycobacterium
VGLGEVIRAAGIGEVVQSRC

SEQ ID NO: 1283456 - protein, 22 aa, Mycobacterium
VGLIRTALFNWAYARHTGGTFV

SEQ ID NO: 1283457 - protein, 27 aa, Mycobacterium
VGLLACLRGEFELGCSSLEAATVGVAA

SEQ ID NO: 1283458 - protein, 18 aa, Mycobacterium
VGLMSAIGRRMWKRCGFL

SEQ ID NO: 1283459 - protein, 19 aa, Mycobacterium
VGLPDWPGLLRHFADYTSH

SEQ ID NO: 1283460 - protein, 19 aa, Mycobacterium
VGLQICYDKAFPEAARIMA

SEQ ID NO: 1283461 - protein, 23 aa, Mycobacterium
VGLQIEIEASVLYNSSVQVKDSE

SEQ ID NO: 1283462 - protein, 18 aa, Mycobacterium
VGLRDFLDELGISRVTVV

SEQ ID NO: 1283463 - protein, 19 aa, Mycobacterium
VGLRIVVELKRDAVAKVVL

SEQ ID NO: 1283464 - protein, 17 aa, Mycobacterium
VGLRRRYYRVSGADAYT

SEQ ID NO: 1283465 - protein, 20 aa, Mycobacterium
VGLVAIPWAQGDRSGVAFRA

SEQ ID NO: 1283466 - protein, 28 aa, Mycobacterium
VGLVPACKSLDCLSVMAGCIDDVDRVAD

SEQ ID NO: 1283467 - protein, 29 aa, Mycobacterium
VGLVPACKSLDCLSVMAGCIDDVDRVADV

SEQ ID NO: 1283468 - protein, 29 aa, Mycobacterium
VGLVPACKSLDCLSVMAGCIDDVDRVLDI

SEQ ID NO: 1283469 - protein, 24 aa, Mycobacterium
VGMAGRAALGFGKRLTGKSKDEVN

SEQ ID NO: 1283470 - protein, 21 aa, Mycobacterium
VGMLFSPGYPGFLRGVTAVGA

SEQ ID NO: 1283471 - protein, 18 aa, Mycobacterium
VGMNYWSHLEKLGVTERP

SEQ ID NO: 1283472 - protein, 20 aa, Mycobacterium
VGMRCRAMLLAARGDVIAAE

SEQ ID NO: 1283473 - protein, 18 aa, Mycobacterium
VGMSGVLVRTGKFRQDTL

SEQ ID NO: 1283474 - protein, 18 aa, Mycobacterium
VGMSQPWDFILVRSPQTL

SEQ ID NO: 1283475 - protein, 20 aa, Mycobacterium
VGMTWLPLYHDMGLTFLLTG

SEQ ID NO: 1283476 - protein, 19 aa, Mycobacterium
VGMYPWLPANMGNWHTIGI

SEQ ID NO: 1283477 - protein, 23 aa, Mycobacterium
VGNLVCPALFDLGEHGKVVIISV

SEQ ID NO: 1283478 - protein, 25 aa, Mycobacterium
VGNLVCPALFDLGERSKVVIISVTE

SEQ ID NO: 1283479 - protein, 26 aa, Mycobacterium
VGNNIPVFFIQDGIKFPDVIHAGKPH

SEQ ID NO: 1283480 - protein, 30 aa, Mycobacterium
VGPEALKMGFKRVLLMSSGLRGTDIVHNMA

SEQ ID NO: 1283481 - protein, 18 aa, Mycobacterium
VGPEHFSENLHLFACTGA

SEQ ID NO: 1283482 - protein, 29 aa, Mycobacterium
VGPFGQWPTGSGFEHFYGFIGGEANQYYP

SEQ ID NO: 1283483 - protein, 30 aa, Mycobacterium
VGPFKKGPFRIAMSVGIPIVPIVIRNAEVI

SEQ ID NO: 1283484 - protein, 17 aa, Mycobacterium
VGPGEILIKVTRANICG

SEQ ID NO: 1283485 - protein, 19 aa, Mycobacterium
VGPLAGMPVAVKEIIDVAG

SEQ ID NO: 1283486 - protein, 24 aa, Mycobacterium
VGPPELYAWLHYDPIPSRDDLAKA

SEQ ID NO: 1283487 - protein, 30 aa, Mycobacterium
VGPRGEVWPLKHWDGNVFTFSFVSENSPPG

SEQ ID NO: 1283488 - protein, 23 aa, Mycobacterium
VGPRPPGRLRPHRTEQLGRLTRL

SEQ ID NO: 1283489 - protein, 28 aa, Mycobacterium
VGPTIAAAVTDWFTVDWHRTIVDKWRAA

SEQ ID NO: 1283490 - protein, 18 aa, Mycobacterium
VGQAIAITEMEAWQFIAQ

SEQ ID NO: 1283491 - protein, 26 aa, Mycobacterium
VGQARPEWEIVGGLLQRLSGQSRVFA

SEQ ID NO: 1283492 - protein, 19 aa, Mycobacterium
VGQGWAVAMVTLGRERLTL

SEQ ID NO: 1283493 - protein, 29 aa, Mycobacterium
VGQIIPWNFPILMAVWKLAPALAAGNAIV

SEQ ID NO: 1283494 - protein, 25 aa, Mycobacterium
VGQPGITARPGFRGAASRARTPVGR

SEQ ID NO: 1283495 - protein, 18 aa, Mycobacterium
VGQRNLRESLLIGLLTGG

SEQ ID NO: 1283496 - protein, 30 aa, Mycobacterium; identical to SEQ ID NO: 745590

SEQ ID NO: 1283497 - protein, 20 aa, Mycobacterium
VGRARSMLMVGLEPVEDTLA

SEQ ID NO: 1283498 - protein, 26 aa, Mycobacterium
VGRAVDWKLAATLGGKLARPEPPATD

SEQ ID NO: 1283499 - protein, 22 aa, Mycobacterium
VGREALRGWLDRAGVGAEQSLD

SEQ ID NO: 1283500 - protein, 30 aa, Mycobacterium; identical to SEQ ID NO: 745607

SEQ ID NO: 1283501 - protein, 30 aa, Mycobacterium
VGRGASCARELARLLATIGVWHDRRDHLLD

SEQ ID NO: 1283502 - protein, 31 aa, Mycobacterium
VGRGASCARELARLLATIGVWRDRRDHLLDY

SEQ ID NO: 1283503 - protein, 17 aa, Mycobacterium
VGRHLLEVNPCFDRMAR

SEQ ID NO: 1283504 - protein, 19 aa, Mycobacterium
VGRLAIRRITDATSCADPL

SEQ ID NO: 1283505 - protein, 26 aa, Mycobacterium
VGRLPWLGGAEVVYWGDIDTHGFAIL

SEQ ID NO: 1283506 - protein, 19 aa, Mycobacterium
VGRLSCLENVLIGGLGALR

SEQ ID NO: 1283507 - protein, 23 aa, Mycobacterium
VGRRRWNRRGAMVTDRYQRLCHH

SEQ ID NO: 1283508 - protein, 17 aa, Mycobacterium
VGRSPVVARGWRTPLRL

SEQ ID NO: 1283509 - protein, 18 aa, Mycobacterium
VGSRAVIVGAELVSWSAA

SEQ ID NO: 1283510 - protein, 17 aa, Mycobacterium
VGSRYTVHWKVGSVPIG

SEQ ID NO: 1283511 - protein, 24 aa, Mycobacterium
VGSTDLPALFAIPVAGPEAPLGAY

SEQ ID NO: 1283512 - protein, 24 aa, Mycobacterium
VGSTDLPALFAIPVAGSEAPLGAY

SEQ ID NO: 1283513 - protein, 20 aa, Mycobacterium
VGTAELLYGTALLAEGGVLE

SEQ ID NO: 1283514 - protein, 19 aa, Mycobacterium
VGTAMGVALERAEHVVVGC

SEQ ID NO: 1283515 - protein, 24 aa, Mycobacterium
VGTAVLRYVMKVPPLATIPTEDLV

SEQ ID NO: 1283516 - protein, 18 aa, Mycobacterium
VGTDMWVEIDKRFAELTG

SEQ ID NO: 1283517 - protein, 21 aa, Mycobacterium
VGTFTGWRPAMPVTQWVVVKP

SEQ ID NO: 1283518 - protein, 25 aa, Mycobacterium
VGTGIRRRLEEAFTAAGLTPRIAFE

SEQ ID NO: 1283519 - protein, 19 aa, Mycobacterium
VGTLYRYFPAKTHLLVAAL

SEQ ID NO: 1283520 - protein, 25 aa, Mycobacterium
VGTPELKKLLSAAVAGRAKMVLVGD

SEQ ID NO: 1283521 - protein, 24 aa, Mycobacterium
VGTTMPVYAARAFGGIVEDVDGNR

SEQ ID NO: 1283522 - protein, 25 aa, Mycobacterium
VGTTNRPGARFGPRAIRATAYEPGT

SEQ ID NO: 1283523 - protein, 19 aa, Mycobacterium
VGTVCFSVALAGGASVTRA

SEQ ID NO: 1283524 - protein, 19 aa, Mycobacterium
VGVARLRLVCREYGITDVS

SEQ ID NO: 1283525 - protein, 18 aa, Mycobacterium
VGVARWQQRLDRGELRPD

SEQ ID NO: 1283526 - protein, 26 aa, Mycobacterium
VGVAYVCFIVDAFSRLIVGWRAASNM

SEQ ID NO: 1283527 - protein, 33 aa, Mycobacterium
VGVCAGMIPWNFPLLLAVWKLGPALAAGNTVVL

SEQ ID NO: 1283528 - protein, 17 aa, Mycobacterium
VGVENVWAANGSNEILQ

SEQ ID NO: 1283529 - protein, 24 aa, Mycobacterium
VGVFIPMMLGRPAVQMSPVAFMQK

SEQ ID NO: 1283530 - protein, 25 aa, Mycobacterium
VGVGISLRGGGLVAPAIHDVPGKKL

SEQ ID NO: 1283531 - protein, 26 aa, Mycobacterium
VGVGWLKEEFDAIGVPFNKRGRIADE

SEQ ID NO: 1283532 - protein, 21 aa, Mycobacterium
VGVGYAAQADWIVVTTDNGVV

SEQ ID NO: 1283533 - protein, 17 aa, Mycobacterium
VGVLASRPGLLADDTRI

SEQ ID NO: 1283534 - protein, 18 aa, Mycobacterium
VGVLPTPAVAYLTSAYDA

SEQ ID NO: 1283535 - protein, 17 aa, Mycobacterium
VGVPMNLDRAISDGQLK

SEQ ID NO: 1283536 - protein, 39 aa, Mycobacterium
VGVQPEGLPLVLVVHGGPWYRDSWGFDAGVQMLANRGYA

SEQ ID NO: 1283537 - protein, 24 aa, Mycobacterium
VGVSLALACDVVIASEKAFFMLAF

SEQ ID NO: 1283538 - protein, 17 aa, Mycobacterium
VGVSVTMPGKFAALRVA

SEQ ID NO: 1283539 - protein, 17 aa, Mycobacterium
VGVTRARSRAELVDSAR

SEQ ID NO: 1283540 - protein, 21 aa, Mycobacterium
VGVWRRAPLQAIARLHALAAA

SEQ ID NO: 1283541 - protein, 17 aa, Mycobacterium
VGYALPGVELKIIDIVD

SEQ ID NO: 1283542 - protein, 18 aa, Mycobacterium
VGYAVRFPGAADAREFWD

SEQ ID NO: 1283543 - protein, 19 aa, Mycobacterium
VHAATAFDWGMISYLTGED

SEQ ID NO: 1283544 - protein, 30 aa, Mycobacterium
VHAKVCVIDDVWACSGSDNFNRRSWTHDSE

SEQ ID NO: 1283545 - protein, 22 aa, Mycobacterium
VHARPLPTPIRFTGDEKPGAAI

SEQ ID NO: 1283546 - protein, 17 aa, Mycobacterium
VHAVEWEAVLTPRARLL

SEQ ID NO: 1283547 - protein, 24 aa, Mycobacterium
VHAVKGAELMDKWVGSSEKAVREL

SEQ ID NO: 1283548 - protein, 22 aa, Mycobacterium
VHCDVWEGFIFVNFAKQPEQSL

SEQ ID NO: 1283549 - protein, 23 aa, Mycobacterium
VHCDVWNGFVFINFDREPRQTLR

SEQ ID NO: 1283550 - protein, 22 aa, Mycobacterium
VHDFLNTRCLTIAGGTEQILLT

SEQ ID NO: 1283551 - protein, 23 aa, Mycobacterium
VHDGGDHFVVFGAVHSLSDVPKT

SEQ ID NO: 1283552 - protein, 24 aa, Mycobacterium
VHFRLPAPNGLHFHPPQSLWLDSD

SEQ ID NO: 1283553 - protein, 18 aa, Mycobacterium
VHGDRLWAVRDVERDITA

SEQ ID NO: 1283554 - protein, 21 aa, Mycobacterium
VHGESSYFVWLNRGKESVEID

SEQ ID NO: 1283555 - protein, 18 aa, Mycobacterium
VHGGGVAAALMSAALQHA

SEQ ID NO: 1283556 - protein, 26 aa, Mycobacterium
VHGLRLPRHVHRIGVLEIDHGSKPKT

SEQ ID NO: 1283557 - protein, 20 aa, Mycobacterium
VHGRMIRSFVEERGLNRELE

SEQ ID NO: 1283558 - protein, 17 aa, Mycobacterium
VHGRTALILPSLGRTDR

SEQ ID NO: 1283559 - protein, 19 aa, Mycobacterium
VHHLLRQGQLLAVRRDGKF

SEQ ID NO: 1283560 - protein, 18 aa, Mycobacterium
VHHSWRRPNRRAPKGVLL

SEQ ID NO: 1283561 - protein, 29 aa, Mycobacterium
VHHYPCDHFDVWPGHDWFDKTVSDQVAFL

SEQ ID NO: 1283562 - protein, 17 aa, Mycobacterium
VHIGGLWSLLQSLVAAR

SEQ ID NO: 1283563 - protein, 19 aa, Mycobacterium
VHIGPSDHVAWLDDRKWAY

SEQ ID NO: 1283564 - protein, 17 aa, Mycobacterium
VHKETFAPILYVMTYET

SEQ ID NO: 1283565 - protein, 28 aa, Mycobacterium
VHKKGSALVPSWVAFAVIGLLEQHFGRL

SEQ ID NO: 1283566 - protein, 18 aa, Mycobacterium
VHKLQIWVEFSHELQHDA

SEQ ID NO: 1283567 - protein, 23 aa, Mycobacterium
VHKPSAPIPLQFHDVAVTARRSR

SEQ ID NO: 1283568 - protein, 17 aa, Mycobacterium
VHLADPLEWVRLAHTGA

SEQ ID NO: 1283569 - protein, 17 aa, Mycobacterium
VHLASPALLGWGGVHAA

SEQ ID NO: 1283570 - protein, 23 aa, Mycobacterium
VHLGCGLDSRFLRVQPGDGVDWY

SEQ ID NO: 1283571 - protein, 24 aa, Mycobacterium
VHLVKGFYRRPLKVSGKEDANGGG

SEQ ID NO: 1283572 - protein, 27 aa, Mycobacterium
VHNGELPAVRVGRSFRVHAKAVHDMLE

SEQ ID NO: 1283573 - protein, 21 aa, Mycobacterium
VHNIWGLRPAVLPGTREPVAL

SEQ ID NO: 1283574 - protein, 19 aa, Mycobacterium
VHNSQPWQWRVGDHSLHLF

SEQ ID NO: 1283575 - protein, 24 aa, Mycobacterium
VHPKDAGGVLIELVEPAKDSGEGS

SEQ ID NO: 1283576 - protein, 21 aa, Mycobacterium
VHPPFRWQRRYAEGFSAQVAA

SEQ ID NO: 1283577 - protein, 23 aa, Mycobacterium
VHPVGACATAAVSVEEGVDKIRL

SEQ ID NO: 1283578 - protein, 17 aa, Mycobacterium
VHQGRLFIGECREGGRL

SEQ ID NO: 1283579 - protein, 18 aa, Mycobacterium
VHQIARRGVGRTFQTASV

SEQ ID NO: 1283580 - protein, 26 aa, Mycobacterium
VHRAYKCRVRTPWWRVPYLRPADLFL

SEQ ID NO: 1283581 - protein, 19 aa, Mycobacterium
VHRFLKMLGGYTYSRHSYS

SEQ ID NO: 1283582 - protein, 28 aa, Mycobacterium
VHRHLLRYMNWIPAEFVDALAPTTGFAG

SEQ ID NO: 1283583 - protein, 18 aa, Mycobacterium
VHRIRGFFGADGITVTPR

SEQ ID NO: 1283584 - protein, 25 aa, Mycobacterium
VHRSELKRYLLRDGDVLMTEGGDID

SEQ ID NO: 1283585 - protein, 24 aa, Mycobacterium
VHRWRFPANLRRHYDRLASAPDGL

SEQ ID NO: 1283586 - protein, 17 aa, Mycobacterium
VHSCPGGPLARVEGRVS

SEQ ID NO: 1283587 - protein, 23 aa, Mycobacterium
VHSEALFPAWSLALRQVLDDTGI

SEQ ID NO: 1283588 - protein, 20 aa, Mycobacterium
VHVAADWGGSALQSSGGPVP

SEQ ID NO: 1283589 - protein, 26 aa, Mycobacterium
VHVANAFGGLFARQGHLGAMPATVND

SEQ ID NO: 1283590 - protein, 28 aa, Mycobacterium
VHVAVRPGQDWALLLAMVKVILDGGLEH

SEQ ID NO: 1283591 - protein, 17 aa, Mycobacterium
VHVGRWDELDGLVDAAY

SEQ ID NO: 1283592 - protein, 20 aa, Mycobacterium
VHVIDCATLEPGRDPISDIE

SEQ ID NO: 1283593 - protein, 31 aa, Mycobacterium
VHVRIASPPVKWPCFYGIDFATPAELIANAS

SEQ ID NO: 1283594 - protein, 18 aa, Mycobacterium
VHVRSCRWRPDPVTESRC

SEQ ID NO: 1283595 - protein, 26 aa, Mycobacterium
VHWVAPAESVWACRTLAATHYASGGW

SEQ ID NO: 1283596 - protein, 26 aa, Mycobacterium
VHYVMECLQLMALRGAATLEVKPEAF

SEQ ID NO: 1283597 - protein, 19 aa, Mycobacterium
VIAAANWVHTELDYVPGTT

SEQ ID NO: 1283598 - protein, 19 aa, Mycobacterium
VIAAVPCGECHECRKGWMA

SEQ ID NO: 1283599 - protein, 25 aa, Mycobacterium
VIAAYPGAIAVRFDDPLAAFDTVTV

SEQ ID NO: 1283600 - protein, 18 aa, Mycobacterium
VIAEQAAQLYVFQRTPNY

SEQ ID NO: 1283601 - protein, 24 aa, Mycobacterium
VIAGHSMGGIAISSWSERLPHRVE

SEQ ID NO: 1283602 - protein, 25 aa, Mycobacterium
VIALPPDWANYGTIIDTFSKKYGIK

SEQ ID NO: 1283603 - protein, 18 aa, Mycobacterium
VIARDSLVKTALFGSDPN

SEQ ID NO: 1283604 - protein, 19 aa, Mycobacterium
VIATAFPHAVELLGTGAGT

SEQ ID NO: 1283605 - protein, 23 aa, Mycobacterium
VIATLVGRHGWTVGVVAQSHAVV

SEQ ID NO: 1283606 - protein, 27 aa, Mycobacterium
VICDKGFPAYFLIVADLINYARSVGIR

SEQ ID NO: 1283607 - protein, 33 aa, Mycobacterium; identical to SEQ ID NO: 746132

SEQ ID NO: 1283608 - protein, 18 aa, Mycobacterium
VIDALKIHPNVNASYNED

SEQ ID NO: 1283609 - protein, 18 aa, Mycobacterium
VIDDPFAAPLVQAVGVDF

SEQ ID NO: 1283610 - protein, 26 aa, Mycobacterium
VIDFGRFAWRPAVTDFCRLAAQQWRD

SEQ ID NO: 1283611 - protein, 22 aa, Mycobacterium
VIDGCVQLHGGYGYMTEYRVAR

SEQ ID NO: 1283612 - protein, 18 aa, Mycobacterium
VIDKICRYAPNFRDVQIR

SEQ ID NO: 1283613 - protein, 21 aa, Mycobacterium
VIDLIMPIGKGQRALIVSPPK

SEQ ID NO: 1283614 - protein, 18 aa, Mycobacterium
VIDLTVWLDLAPAAASDD

SEQ ID NO: 1283615 - protein, 17 aa, Mycobacterium
VIDRCVIDPTFATRDLV

SEQ ID NO: 1283616 - protein, 18 aa, Mycobacterium
VIDVCLTGAFIVTKHAGR

SEQ ID NO: 1283617 - protein, 25 aa, Mycobacterium
VIECSLHMAKFCLRTGAALTPPASA

SEQ ID NO: 1283618 - protein, 17 aa, Mycobacterium
VIEFLAPCRDWLDVRFC

SEQ ID NO: 1283619 - protein, 18 aa, Mycobacterium
VIEGHLWDPYEIKPFTDQ

SEQ ID NO: 1283620 - protein, 19 aa, Mycobacterium
VIEQLNFPGYFLVVHDITR

SEQ ID NO: 1283621 - protein, 24 aa, Mycobacterium
VIERAAAAFARWHDLLAQRLIADG

SEQ ID NO: 1283622 - protein, 23 aa, Mycobacterium
VIGACRSGAIGSFPTHNAATTRE

SEQ ID NO: 1283623 - protein, 24 aa, Mycobacterium
VIGEIAVSIGPWITRAQVDVALGR

SEQ ID NO: 1283624 - protein, 21 aa, Mycobacterium
VIGRAGGIFISHAQVQRSLTD

SEQ ID NO: 1283625 - protein, 24 aa, Mycobacterium
VIHDWPDADALTILRNIRSAAGTG

SEQ ID NO: 1283626 - protein, 18 aa, Mycobacterium
VIISDFLGPINWMRPLRA

SEQ ID NO: 1283627 - protein, 17 aa, Mycobacterium
VILHSPYGLRVHGPLAL

SEQ ID NO: 1283628 - protein, 18 aa, Mycobacterium
VIMWMGYDAPDGFTDPRI

SEQ ID NO: 1283629 - protein, 18 aa, Mycobacterium
VINGWKFFSSNAATASFL

SEQ ID NO: 1283630 - protein, 18 aa, Mycobacterium
VIPDEIHNLVALEDSVVL

SEQ ID NO: 1283631 - protein, 18 aa, Mycobacterium
VIPIKDVIRMAGHANHYL

SEQ ID NO: 1283632 - protein, 20 aa, Mycobacterium
VIPLRARIAERLDQSGPTVS

SEQ ID NO: 1283633 - protein, 24 aa, Mycobacterium
VIPPTPWSAPGMFGILRDERVTVA

SEQ ID NO: 1283634 - protein, 24 aa, Mycobacterium
VIPRASFDEQWRLIARSLASAPAG

SEQ ID NO: 1283635 - protein, 23 aa, Mycobacterium
VIQIPGLPPIVLPWPAPPPPPLP

SEQ ID NO: 1283636 - protein, 23 aa, Mycobacterium
VIQNHLLQLLALTAMEEPVSFHP

SEQ ID NO: 1283637 - protein, 23 aa, Mycobacterium
VIQRGLWFEEFETGVLYQHRPGR

SEQ ID NO: 1283638 - protein, 30 aa, Mycobacterium
VIRHLSARVAKWWLPDAVEFIDAVPKTSVG

SEQ ID NO: 1283639 - protein, 24 aa, Mycobacterium
VIRRAMSQLGVPYSWGGGNANGPA

SEQ ID NO: 1283640 - protein, 24 aa, Mycobacterium
VIRRAMSQLGVPYSWGGGNANGPS

SEQ ID NO: 1283641 - protein, 24 aa, Mycobacterium
VIRREGIRYAELVGAQLADTDPLT

SEQ ID NO: 1283642 - protein, 24 aa, Mycobacterium
VIRRRIGTASARRLRGRILDVLSN

SEQ ID NO: 1283643 - protein, 17 aa, Mycobacterium
VIRSFEPGEDWFWNFDT

SEQ ID NO: 1283644 - protein, 28 aa, Mycobacterium
VISAADWDRLEAGLVQRSRLLDAVLADL

SEQ ID NO: 1283645 - protein, 18 aa, Mycobacterium
VISAAEWTRLERGIRQRV

SEQ ID NO: 1283646 - protein, 24 aa, Mycobacterium
VISADEWRAHWPGADEPVAEEPDA

SEQ ID NO: 1283647 - protein, 25 aa, Mycobacterium
VISAPALGRRWWAGEGQGAFTSFGG

SEQ ID NO: 1283648 - protein, 18 aa, Mycobacterium
VISDIWLANLVAFISGRV

SEQ ID NO: 1283649 - protein, 17 aa, Mycobacterium
VISDIWLANLVAFSGDR

SEQ ID NO: 1283650 - protein, 22 aa, Mycobacterium
VISPKAATLLEHAQRVAEGRLL

SEQ ID NO: 1283651 - protein, 17 aa, Mycobacterium
VISRRYLHATGEHKVVI

SEQ ID NO: 1283652 - protein, 25 aa, Mycobacterium
VITAFNFPVAVWAWNTAIALVCGDT

SEQ ID NO: 1283653 - protein, 24 aa, Mycobacterium
VITRERPHRLVVCRDDDWRPQWRV

SEQ ID NO: 1283654 - protein, 27 aa, Mycobacterium
VITRGGRSCPYWNLVLAPGAAPVPLDV

SEQ ID NO: 1283655 - protein, 17 aa, Mycobacterium
VITSVGLRGEEWGRLLI

SEQ ID NO: 1283656 - protein, 18 aa, Mycobacterium
VIVAPLYLTLPVWSRATL

SEQ ID NO: 1283657 - protein, 27 aa, Mycobacterium
VIVCALCSCYPRPILGNSPEWYRTPNY

SEQ ID NO: 1283658 - protein, 23 aa, Mycobacterium
VIVDLRLLGGALVREPQHRSAFC

SEQ ID NO: 1283659 - protein, 21 aa, Mycobacterium
VIVEYQLSYPGLRMVDVEPDQ

SEQ ID NO: 1283660 - protein, 19 aa, Mycobacterium
VIVGFRIPYIQGQDTEPLD

SEQ ID NO: 1283661 - protein, 18 aa, Mycobacterium
VIVGSVARWPHSACSGRC

SEQ ID NO: 1283662 - protein, 29 aa, Mycobacterium
VIVSRKCGVPFLYRFELMGTTDDVFAVRQ

SEQ ID NO: 1283663 - protein, 23 aa, Mycobacterium
VKARHLRSGRIVTLPADYIAEHV

SEQ ID NO: 1283664 - protein, 18 aa, Mycobacterium
VKASLSFRSEPIVYDRRD

SEQ ID NO: 1283665 - protein, 20 aa, Mycobacterium
VKAYGGFHRFEDGTNVRAWL

SEQ ID NO: 1283666 - protein, 20 aa, Mycobacterium
VKCSERFAPHLDWILANLDK

SEQ ID NO: 1283667 - protein, 21 aa, Mycobacterium
VKCWEPFVDELVRACLDDHIE

SEQ ID NO: 1283668 - protein, 20 aa, Mycobacterium
VKDKMSVLVLDQLMYPAMMF

SEQ ID NO: 1283669 - protein, 25 aa, Mycobacterium
VKEAKGWSYERWTTEVTKVLVAIEN

SEQ ID NO: 1283670 - protein, 17 aa, Mycobacterium
VKEALLLSDDQRSPIVE

SEQ ID NO: 1283671 - protein, 25 aa, Mycobacterium
VKEAVLPFHRFRKADGSQIDSLLGP

SEQ ID NO: 1283672 - protein, 21 aa, Mycobacterium
VKEDLLTFEGRKLFPERRAET

SEQ ID NO: 1283673 - protein, 29 aa, Mycobacterium
VKEPIGVCGLITPWNWPINQIACKVFPAL

SEQ ID NO: 1283674 - protein, 18 aa, Mycobacterium
VKEYARKHPHSMGEWSQA

SEQ ID NO: 1283675 - protein, 24 aa, Mycobacterium
VKFPSDRGLLGLLPVQNREAKPDP

SEQ ID NO: 1283676 - protein, 27 aa, Mycobacterium
VKGEVLRLRWRRGCLPVPQRVVRARVH

SEQ ID NO: 1283677 - protein, 24 aa, Mycobacterium
VKGGRRFSFTALVIVGDGKGMVGV

SEQ ID NO: 1283678 - protein, 18 aa, Mycobacterium
VKGRTCILTDDMIDTGGT

SEQ ID NO: 1283679 - protein, 24 aa, Mycobacterium
VKGTELLETLSVFLHYRSQSAASR

SEQ ID NO: 1283680 - protein, 28 aa, Mycobacterium
VKHACADMLVAIEVSRRLVSDAVGVLAE

SEQ ID NO: 1283681 - protein, 17 aa, Mycobacterium
VKHAVNLLAAREGEGKS

SEQ ID NO: 1283682 - protein, 24 aa, Mycobacterium
VKHHLMVLWADFFTKDHFEQFPNL

SEQ ID NO: 1283683 - protein, 28 aa, Mycobacterium
VKHKCADMLVDLEWARSASQAALQALDG

SEQ ID NO: 1283684 - protein, 20 aa, Mycobacterium
VKHRLIRDAGRFAITAQDEQ

SEQ ID NO: 1283685 - protein, 19 aa, Mycobacterium
VKLCLERLTPWLSPGARVI

SEQ ID NO: 1283686 - protein, 17 aa, Mycobacterium
VKLDGAVGIIGNGAGLV

SEQ ID NO: 1283687 - protein, 18 aa, Mycobacterium
VKLIQPVAMDEGLRFAIR

SEQ ID NO: 1283688 - protein, 18 aa, Mycobacterium
VKLLGKFAAEPTRENIEK

SEQ ID NO: 1283689 - protein, 20 aa, Mycobacterium
VKMVLEPSGGGPALVLKPEV

SEQ ID NO: 1283690 - protein, 17 aa, Mycobacterium
VKNRYLVFTSHDIRALY

SEQ ID NO: 1283691 - protein, 17 aa, Mycobacterium
VKPAEWTPLTTMRLGEL

SEQ ID NO: 1283692 - protein, 17 aa, Mycobacterium
VKPARIGVKSWPVVPKG

SEQ ID NO: 1283693 - protein, 17 aa, Mycobacterium
VKPARLDIPAWPRVPRG

SEQ ID NO: 1283694 - protein, 18 aa, Mycobacterium
VKPERIDAARAWHAELVD

SEQ ID NO: 1283695 - protein, 25 aa, Mycobacterium
VKPFKDALVADGIPFTAFVVDDVRV

SEQ ID NO: 1283696 - protein, 27 aa, Mycobacterium
VKPFRFEDLLARVRLRLTAGRAASTTL

SEQ ID NO: 1283697 - protein, 27 aa, Mycobacterium
VKPRPGPARPGPRPAVPAAAPVVGTAP

SEQ ID NO: 1283698 - protein, 24 aa, Mycobacterium
VKQYSDFIAWPIRMEVERRTPAPE

SEQ ID NO: 1283699 - protein, 25 aa, Mycobacterium
VKRCDRLDIDGCDAIVALAPVLTEY

SEQ ID NO: 1283700 - protein, 22 aa, Mycobacterium
VKRFRGCPFHNAAVESAGALEG

SEQ ID NO: 1283701 - protein, 21 aa, Mycobacterium
VKRGDTVLMAAFAHAGDFAAA

SEQ ID NO: 1283702 - protein, 18 aa, Mycobacterium
VKRGLVAAGGGLLRLQKR

SEQ ID NO: 1283703 - protein, 19 aa, Mycobacterium
VKRIRNTPRVTIAKCDRRG

SEQ ID NO: 1283704 - protein, 21 aa, Mycobacterium
VKRLNGVDALMLYSETPEIHM

SEQ ID NO: 1283705 - protein, 21 aa, Mycobacterium
VKRLPGVPIVALVETARGLER

SEQ ID NO: 1283706 - protein, 24 aa, Mycobacterium
VKRPRGEGQWALGYREPLNPNERS

SEQ ID NO: 1283707 - protein, 25 aa, Mycobacterium
VKRTIGSDGLRLAQLAERLHTDVVV

SEQ ID NO: 1283708 - protein, 17 aa, Mycobacterium
VKRTRLIADRDARAKVD

SEQ ID NO: 1283709 - protein, 17 aa, Mycobacterium
VKSALDLGVPVTGIAEA

SEQ ID NO: 1283710 - protein, 25 aa, Mycobacterium
VKSHIGRIFLKLRLRDRAAAIVYAY

SEQ ID NO: 1283711 - protein, 27 aa, Mycobacterium
VKTAIPIERVAIFDWFKEKGVPYTSDS

SEQ ID NO: 1283712 - protein, 23 aa, Mycobacterium
VKTLNTAGAFVLAGVTYKVDGRR

SEQ ID NO: 1283713 - protein, 18 aa, Mycobacterium
VKTLPVRSWLGGRHADRL

SEQ ID NO: 1283714 - protein, 18 aa, Mycobacterium
VKTQWEGLVSAPWESMFV

SEQ ID NO: 1283715 - protein, 18 aa, Mycobacterium
VKTSGAKGLHVFVPVDDS

SEQ ID NO: 1283716 - protein, 17 aa, Mycobacterium
VKVMPRDFRRVLAAIAE

SEQ ID NO: 1283717 - protein, 23 aa, Mycobacterium
VKVRNLGVYLSRLGELGIPTDLL

SEQ ID NO: 1283718 - protein, 19 aa, Mycobacterium
VKVWPELDSDFPPSVIRTR

SEQ ID NO: 1283719 - protein, 24 aa, Mycobacterium
VLAAGGFDRLMSWRHKFQSELLGD

SEQ ID NO: 1283720 - protein, 17 aa, Mycobacterium
VLAALLFSEQPSVTMAE

SEQ ID NO: 1283721 - protein, 18 aa, Mycobacterium
VLAAMAVQALDFAQLSAD

SEQ ID NO: 1283722 - protein, 31 aa, Mycobacterium
VLAASRWADLRPALKDQLGTRIELRLGDPAE

SEQ ID NO: 1283723 - protein, 26 aa, Mycobacterium
VLADAKGRAALRCIRCSACLNVCPVY

SEQ ID NO: 1283724 - protein, 21 aa, Mycobacterium
VLADALPWLTALNDKIVVVKY

SEQ ID NO: 1283725 - protein, 24 aa, Mycobacterium
VLADIEALPAWSSVYRKVTVLDRH

SEQ ID NO: 1283726 - protein, 25 aa, Mycobacterium
VLAEHPRLRLVIAHMGGPEYSEFLD

SEQ ID NO: 1283727 - protein, 22 aa, Mycobacterium
VLAELVDYLGVDVSFLRYNDHK

SEQ ID NO: 1283728 - protein, 18 aa, Mycobacterium
VLAELVNEFAAVRLSLDV

SEQ ID NO: 1283729 - protein, 17 aa, Mycobacterium
VLAENRSQFVIEPLEPG

SEQ ID NO: 1283730 - protein, 20 aa, Mycobacterium
VLAFAARRLKGAVGVVATER

SEQ ID NO: 1283731 - protein, 24 aa, Mycobacterium
VLAGFPGTVASFWQQAGRAGRRGQ

SEQ ID NO: 1283732 - protein, 19 aa, Mycobacterium
VLAGHSWSGTIVSEVGGDP

SEQ ID NO: 1283733 - protein, 19 aa, Mycobacterium
VLAGLRGWLSAPVIVLSAR

SEQ ID NO: 1283734 - protein, 25 aa, Mycobacterium
VLAGRGGGGASVFATAVAKVATEAL

SEQ ID NO: 1283735 - protein, 18 aa, Mycobacterium
VLAGRIAPVPVRLADERF

SEQ ID NO: 1283736 - protein, 17 aa, Mycobacterium
VLAHGFPELAYSWRHQI

SEQ ID NO: 1283737 - protein, 24 aa, Mycobacterium
VLAISVNGPRAWDLDLAVDVTFLT

SEQ ID NO: 1283738 - protein, 17 aa, Mycobacterium
VLAKAKANIVYRLQQIG

SEQ ID NO: 1283739 - protein, 19 aa, Mycobacterium
VLAKRVVAINARIRVAAER

SEQ ID NO: 1283740 - protein, 24 aa, Mycobacterium
VLAPLRLHYLRWVLFDVGSGLHFQ

SEQ ID NO: 1283741 - protein, 21 aa, Mycobacterium
VLARAGGHPVAVRQGKMLATA

SEQ ID NO: 1283742 - protein, 18 aa, Mycobacterium
VLATGMAGNGEWSVPPVI

SEQ ID NO: 1283743 - protein, 28 aa, Mycobacterium
VLATGRPPRWVPPIVDQLGFAPMAVCAN

SEQ ID NO: 1283744 - protein, 23 aa, Mycobacterium
VLATRPGGWVSLTRLRAELDAPR

SEQ ID NO: 1283745 - protein, 28 aa, Mycobacterium
VLATVTAWCARLNVLATDMRVEQRSLED

SEQ ID NO: 1283746 - protein, 23 aa, Mycobacterium
VLCAGEGQPSLARTSTSDQQSIL

SEQ ID NO: 1283747 - protein, 17 aa, Mycobacterium
VLCSAGKRGWDVALDPR

SEQ ID NO: 1283748 - protein, 20 aa, Mycobacterium
VLCTRAHRAPIVMCEFPEWT

SEQ ID NO: 1283749 - protein, 19 aa, Mycobacterium
VLDAEGWFPTRDIATLDDD

SEQ ID NO: 1283750 - protein, 18 aa, Mycobacterium
VLDAHGWGDLQPELNAMS

SEQ ID NO: 1283751 - protein, 19 aa, Mycobacterium
VLDALAPLLPPSRSNPRDA

SEQ ID NO: 1283752 - protein, 18 aa, Mycobacterium
VLDDELNRIAAMGVQLTC

SEQ ID NO: 1283753 - protein, 22 aa, Mycobacterium
VLDELRELAAVLGVARDAEVLA

SEQ ID NO: 1283754 - protein, 21 aa, Mycobacterium
VLDFHEWREGLLRGLAAHHAG

SEQ ID NO: 1283755 - protein, 24 aa, Mycobacterium
VLDFHRCAMLPLRDGAADTGHADD

SEQ ID NO: 1283756 - protein, 29 aa, Mycobacterium
VLDGFKSVLDTGIDFSKTVNSFQGVTESS

SEQ ID NO: 1283757 - protein, 19 aa, Mycobacterium
VLDGLPGIRSWQEDFYRDL

SEQ ID NO: 1283758 - protein, 25 aa, Mycobacterium
VLDGRRATTHWRHLDTFARRYPSTR

SEQ ID NO: 1283759 - protein, 19 aa, Mycobacterium
VLDLCVERNIAFVPFFPLG

SEQ ID NO: 1283760 - protein, 24 aa, Mycobacterium
VLDLGCGAGAFLRHAPADLSIELT

SEQ ID NO: 1283761 - protein, 18 aa, Mycobacterium
VLDLHGWGELQPELHAMS

SEQ ID NO: 1283762 - protein, 19 aa, Mycobacterium
VLDLQRLAMDWYLHDTAMR

SEQ ID NO: 1283763 - protein, 24 aa, Mycobacterium
VLDLRPALASFTFGLPTVEERRRL

SEQ ID NO: 1283764 - protein, 17 aa, Mycobacterium
VLDRAVCAITHGGMGVT

SEQ ID NO: 1283765 - protein, 17 aa, Mycobacterium
VLDRIGISARTAVDIEV

SEQ ID NO: 1283766 - protein, 22 aa, Mycobacterium
VLDSLSHWAPRHSVTAYDSAAA

SEQ ID NO: 1283767 - protein, 23 aa, Mycobacterium
VLDSSRFRYLIAQQADLAVGNVH

SEQ ID NO: 1283768 - protein, 20 aa, Mycobacterium
VLDVGDGVPVWISGPQFDAW

SEQ ID NO: 1283769 - protein, 24 aa, Mycobacterium
VLDWSDAPFAKWFVGGKLNVAYNC

SEQ ID NO: 1283770 - protein, 19 aa, Mycobacterium
VLEAVPFKLTTEGGPEPAR

SEQ ID NO: 1283771 - protein, 27 aa, Mycobacterium
VLEELAPMLCCDWRIHARVELTDEGAV

SEQ ID NO: 1283772 - protein, 17 aa, Mycobacterium
VLEGLRTTYTFGAGSKA

SEQ ID NO: 1283773 - protein, 21 aa, Mycobacterium
VLELAWTTGLVKWEDDPQPGW

SEQ ID NO: 1283774 - protein, 20 aa, Mycobacterium
VLENPELLATFLPAFRNDYR

SEQ ID NO: 1283775 - protein, 17 aa, Mycobacterium
VLENWTWESHWLRLEEN

SEQ ID NO: 1283776 - protein, 29 aa, Mycobacterium
VLEPRGAGGWRFRHELLREVAAELAPPSV

SEQ ID NO: 1283777 - protein, 24 aa, Mycobacterium
VLESRPDLVPLFLNALPVVMADAV

SEQ ID NO: 1283778 - protein, 17 aa, Mycobacterium
VLETEYLHRPLLDGPAP

SEQ ID NO: 1283779 - protein, 19 aa, Mycobacterium
VLETRGTTLPTLRTLAYGG

SEQ ID NO: 1283780 - protein, 20 aa, Mycobacterium
VLEVRRCLEVEGARLAATVR

SEQ ID NO: 1283781 - protein, 18 aa, Mycobacterium
VLEWDCDHMVPLAKPAET

SEQ ID NO: 1283782 - protein, 20 aa, Mycobacterium
VLFGIWWIGAEAVLSGDADI

SEQ ID NO: 1283783 - protein, 19 aa, Mycobacterium
VLFGSRRRSTGVVKFPAER

SEQ ID NO: 1283784 - protein, 26 aa, Mycobacterium
VLFPEATMCRFGVPLAPVAEPLDGPW

SEQ ID NO: 1283785 - protein, 25 aa, Mycobacterium
VLFPFAAGVATWWRTVGPKVAGLPN

SEQ ID NO: 1283786 - protein, 17 aa, Mycobacterium
VLFVDYLTLLPATGPAP

SEQ ID NO: 1283787 - protein, 29 aa, Mycobacterium
VLGALAALGAIEWPVAAAIGVGQVVVSRH

SEQ ID NO: 1283788 - protein, 23 aa, Mycobacterium
VLGCGKCGHYLSGMQTVDRKRIT

SEQ ID NO: 1283789 - protein, 27 aa, Mycobacterium
VLGCGPVGLAVICHLKALGVRTIVASD

SEQ ID NO: 1283790 - protein, 18 aa, Mycobacterium
VLGEAWVGTAGDWLTSVS

SEQ ID NO: 1283791 - protein, 17 aa, Mycobacterium
VLGGLGVAIISTSSGLR

SEQ ID NO: 1283792 - protein, 30 aa, Mycobacterium
VLGHARGAAPDRGWEIHRLPVDAGDEKGRT

SEQ ID NO: 1283793 - protein, 27 aa, Mycobacterium
VLGICNGFQVLCEAGLLPGALTRNIGL

SEQ ID NO: 1283794 - protein, 20 aa, Mycobacterium
VLGLRLAQRLADLGARRLVL

SEQ ID NO: 1283795 - protein, 21 aa, Mycobacterium
VLGMFAGLEVGVWEMTEGVMA

SEQ ID NO: 1283796 - protein, 24 aa, Mycobacterium
VLGMLTRREVEVLRLMAAGRTNQQ

SEQ ID NO: 1283797 - protein, 19 aa, Mycobacterium
VLGPAEWAQPVPPTEFLIA

SEQ ID NO: 1283798 - protein, 19 aa, Mycobacterium
VLGPLLPDANRAALTDTSD

SEQ ID NO: 1283799 - protein, 26 aa, Mycobacterium
VLGRLAHKARVVLCGVISSYLTGEHP

SEQ ID NO: 1283800 - protein, 19 aa, Mycobacterium
VLGRLHFALAPRGVLFLGH

SEQ ID NO: 1283801 - protein, 23 aa, Mycobacterium
VLGRPFYLMGFVDGWSPMDTHAR

SEQ ID NO: 1283802 - protein, 22 aa, Mycobacterium
VLGRTWPVICDELLGHYEAVMG

SEQ ID NO: 1283803 - protein, 30 aa, Mycobacterium
VLGSDKDFWARVGIDPVRIMTSGGTFFTLR

SEQ ID NO: 1283804 - protein, 17 aa, Mycobacterium
VLGSGWAPAAAQIGDPT

SEQ ID NO: 1283805 - protein, 19 aa, Mycobacterium
VLGSPGYREAARRAGAGVA

SEQ ID NO: 1283806 - protein, 24 aa, Mycobacterium
VLGTQCNICAPFVPNPDNEPIPGP

SEQ ID NO: 1283807 - protein, 29 aa, Mycobacterium
VLGVDHLRKVVGWARDRGVLVASDECYLG

SEQ ID NO: 1283808 - protein, 18 aa, Mycobacterium
VLGWRAQHSQSHYAAAKA

SEQ ID NO: 1283809 - protein, 24 aa, Mycobacterium
VLGYSRWLSAILLPSRRAEDLFAG

SEQ ID NO: 1283810 - protein, 26 aa, Mycobacterium
VLHEPGFRTKAGWLRSAYAAYDSVAE

SEQ ID NO: 1283811 - protein, 20 aa, Mycobacterium
VLHGHSWGSLLGVLYADRHP

SEQ ID NO: 1283812 - protein, 18 aa, Mycobacterium
VLHGLGIDFDRFERELRE

SEQ ID NO: 1283813 - protein, 20 aa, Mycobacterium
VLHGVEWRLAPGERTGILGV

SEQ ID NO: 1283814 - protein, 17 aa, Mycobacterium
VLHLLGYDHAEPDEEKE

SEQ ID NO: 1283815 - protein, 24 aa, Mycobacterium
VLHTAQRLISCWDAPLRSVGVLLP

SEQ ID NO: 1283816 - protein, 24 aa, Mycobacterium
VLIKAEAIGVNFIDTYFRSGLYPR

SEQ ID NO: 1283817 - protein, 21 aa, Mycobacterium
VLITHRPDFHGALSRVPGAQT

SEQ ID NO: 1283818 - protein, 17 aa, Mycobacterium
VLKAILDRTPWRAEQPV

SEQ ID NO: 1283819 - protein, 17 aa, Mycobacterium
VLKDGALGIHRLRRRSR

SEQ ID NO: 1283820 - protein, 21 aa, Mycobacterium
VLKKCEPEQALALFDEAAQSA

SEQ ID NO: 1283821 - protein, 21 aa, Mycobacterium
VLKLSRQPYYRWLADPVTDAE

SEQ ID NO: 1283822 - protein, 24 aa, Mycobacterium
VLLARSAGFDAVFVDLEHSTITDD

SEQ ID NO: 1283823 - protein, 21 aa, Mycobacterium
VLLDRCVELLAPALTRTSTDG

SEQ ID NO: 1283824 - protein, 28 aa, Mycobacterium
VLLDRERCVLCARCTRFSDQIAGDRFID

SEQ ID NO: 1283825 - protein, 20 aa, Mycobacterium
VLLEVAWEALENAGLAPDTL

SEQ ID NO: 1283826 - protein, 36 aa, Mycobacterium
VLLGNGARNDGGLWARLPAGVYVPLIGLSFGASTNP

SEQ ID NO: 1283827 - protein, 22 aa, Mycobacterium
VLLKLLHPVMPFVTEVLWKALT

SEQ ID NO: 1283828 - protein, 29 aa, Mycobacterium
VLLMAVERIELFVKILLRGGRPADTPVLV

SEQ ID NO: 1283829 - protein, 25 aa, Mycobacterium
VLLPESPEPFCLFLDELPASSPDVQ

SEQ ID NO: 1283830 - protein, 23 aa, Mycobacterium
VLLPGSEFTLLWGGDTTPQFPDD

SEQ ID NO: 1283831 - protein, 18 aa, Mycobacterium
VLLRADMDALPVLEDTGL

SEQ ID NO: 1283832 - protein, 25 aa, Mycobacterium
VLLRARRLGFSGGELTTMVQVALER

SEQ ID NO: 1283833 - protein, 19 aa, Mycobacterium
VLLREGLASLLERSGFDVV

SEQ ID NO: 1283834 - protein, 19 aa, Mycobacterium
VLLSDPWAITRFAEHEVVV

SEQ ID NO: 1283835 - protein, 19 aa, Mycobacterium
VLLVAVGPFAAMALAVADR

SEQ ID NO: 1283836 - protein, 19 aa, Mycobacterium
VLMETRPSALVAIAALSRL

SEQ ID NO: 1283837 - protein, 20 aa, Mycobacterium
VLMPGIVRWGIYRGVRQDVS

SEQ ID NO: 1283838 - protein, 19 aa, Mycobacterium
VLMRRCPSKSFTVVGDLAQ

SEQ ID NO: 1283839 - protein, 24 aa, Mycobacterium
VLNGAGVRFRNRFVRTRHFVQSTR

SEQ ID NO: 1283840 - protein, 23 aa, Mycobacterium
VLNMMPRWYIGSMLRNIDFLCSD

SEQ ID NO: 1283841 - protein, 30 aa, Mycobacterium
VLNRPKLGFPVPIRHWLRAGELLEWAYETV

SEQ ID NO: 1283842 - protein, 31 aa, Mycobacterium
VLNRPKLGFPVPIRHWLRAGELLEWAYETVA

SEQ ID NO: 1283843 - protein, 17 aa, Mycobacterium
VLNYKYFRQLNVGASYL

SEQ ID NO: 1283844 - protein, 26 aa, Mycobacterium
VLPAIGTKELIAWLPTVLGLGAGDTV

SEQ ID NO: 1283845 - protein, 21 aa, Mycobacterium
VLPALAAGCSVVIKPAEITPL

SEQ ID NO: 1283846 - protein, 22 aa, Mycobacterium
VLPDRVKRALLGFRSVTVDGNT

SEQ ID NO: 1283847 - protein, 31 aa, Mycobacterium
VLPEAAGLRCLRMTVYIVCAPGFRELSAVAD

SEQ ID NO: 1283848 - protein, 18 aa, Mycobacterium
VLPEKLAGIKRISRRAMS

SEQ ID NO: 1283849 - protein, 21 aa, Mycobacterium
VLPELREALAYLTPAAPKIPL

SEQ ID NO: 1283850 - protein, 27 aa, Mycobacterium
VLPGGMFAGAALTWPSGNSGMMRLTAT

SEQ ID NO: 1283851 - protein, 22 aa, Mycobacterium
VLPGMVVPIELDDAARAAVEAA

SEQ ID NO: 1283852 - protein, 24 aa, Mycobacterium
VLPHMRAAGAGRIVVISSEWGLTG

SEQ ID NO: 1283853 - protein, 21 aa, Mycobacterium
VLPHRDIRVTAFGNRIQEAGA

SEQ ID NO: 1283854 - protein, 25 aa, Mycobacterium
VLPNGVCLLPPLKTCDKGNACLSCG

SEQ ID NO: 1283855 - protein, 22 aa, Mycobacterium
VLPYASEIFGVYQPLIGWSSKR

SEQ ID NO: 1283856 - protein, 19 aa, Mycobacterium
VLQAAKWADGMGYVVRGGT

SEQ ID NO: 1283857 - protein, 22 aa, Mycobacterium
VLQALRLYQRFAPDSDHHLVES

SEQ ID NO: 1283858 - protein, 17 aa, Mycobacterium
VLQLLKITGDWQKFKGL

SEQ ID NO: 1283859 - protein, 18 aa, Mycobacterium
VLQPGVIVDLPLSNMTLG

SEQ ID NO: 1283860 - protein, 25 aa, Mycobacterium
VLRAVLRPGDHLVIPDDAYGGTFRL

SEQ ID NO: 1283861 - protein, 17 aa, Mycobacterium
VLRDEWREPLRAQRDPL

SEQ ID NO: 1283862 - protein, 25 aa, Mycobacterium
VLRDGRRVAVKIQYPGVAQAIRDDL

SEQ ID NO: 1283863 - protein, 24 aa, Mycobacterium
VLRDTRFTIPPGINLAAQGITSGP

SEQ ID NO: 1283864 - protein, 18 aa, Mycobacterium
VLRECRRAGSLDSAVQPD

SEQ ID NO: 1283865 - protein, 19 aa, Mycobacterium
VLREGLACAVLRRSDHRET

SEQ ID NO: 1283866 - protein, 17 aa, Mycobacterium
VLREGRDAISDVPRDRW

SEQ ID NO: 1283867 - protein, 17 aa, Mycobacterium
VLREMPKVLAAFDSNWG

SEQ ID NO: 1283868 - protein, 22 aa, Mycobacterium
VLRMHGDLLYLDRYWREEQQVC

SEQ ID NO: 1283869 - protein, 20 aa, Mycobacterium
VLRREMEIAKAMSFQPDVAR

SEQ ID NO: 1283870 - protein, 21 aa, Mycobacterium
VLRRHCADADLVITTGGVSAG

SEQ ID NO: 1283871 - protein, 19 aa, Mycobacterium
VLRRVPLAIVPSAQIPAVN

SEQ ID NO: 1283872 - protein, 23 aa, Mycobacterium
VLRSLGSAGLRFERQCQNAAALA

SEQ ID NO: 1283873 - protein, 18 aa, Mycobacterium
VLSAPMLDPIVFGVVAVH

SEQ ID NO: 1283874 - protein, 26 aa, Mycobacterium
VLSDSKFAIAMVKRWMAGEDVLPEGY

SEQ ID NO: 1283875 - protein, 18 aa, Mycobacterium
VLSDWGMRPGGGRGGGVT

SEQ ID NO: 1283876 - protein, 22 aa, Mycobacterium
VLSGRLRLMLGDRDFTIKPGEA

SEQ ID NO: 1283877 - protein, 26 aa, Mycobacterium
VLSHGSPLTRCVSWAVDSLREDGTLA

SEQ ID NO: 1283878 - protein, 26 aa, Mycobacterium
VLSLDCLDAVFPDARFVMTHRDPTDV

SEQ ID NO: 1283879 - protein, 20 aa, Mycobacterium
VLSPVLRFWNVFQRRDFGPE

SEQ ID NO: 1283880 - protein, 28 aa, Mycobacterium
VLSQRSKLLYDYFVELFAQVTNPPLDAI

SEQ ID NO: 1283881 - protein, 23 aa, Mycobacterium
VLSRNSIEFGELVAATQLSGIIM

SEQ ID NO: 1283882 - protein, 24 aa, Mycobacterium
VLSVQYPFPIKDLVVLDNALKYGS

SEQ ID NO: 1283883 - protein, 18 aa, Mycobacterium
VLTAARRQRIIAADGPTS

SEQ ID NO: 1283884 - protein, 17 aa, Mycobacterium
VLTEHGIYLPGQEQPEW

SEQ ID NO: 1283885 - protein, 23 aa, Mycobacterium
VLTHEKLCPVLGMTTVADAQRGI

SEQ ID NO: 1283886 - protein, 17 aa, Mycobacterium
VLTNVVWTSHGPCAVDG

SEQ ID NO: 1283887 - protein, 34 aa, Mycobacterium; identical to SEQ ID NO: 747288

SEQ ID NO: 1283888 - protein, 18 aa, Mycobacterium
VLTRSRLVSIHGKDRVRK

SEQ ID NO: 1283889 - protein, 17 aa, Mycobacterium
VLTTIALMCQPVPGETS

SEQ ID NO: 1283890 - protein, 17 aa, Mycobacterium
VLVARACERVERGRSGL

SEQ ID NO: 1283891 - protein, 21 aa, Mycobacterium
VLVDGALAWFVERGGRSLLSF

SEQ ID NO: 1283892 - protein, 25 aa, Mycobacterium
VLVHHCHREQWPVAGPVMSRMGWFV

SEQ ID NO: 1283893 - protein, 18 aa, Mycobacterium
VLVPGYRYHFALDAQAAG

SEQ ID NO: 1283894 - protein, 25 aa, Mycobacterium
VLVRFVLLCLLRWIRFGCGGVIGLR

SEQ ID NO: 1283895 - protein, 24 aa, Mycobacterium
VLVSWPERGPLLGVDLEGSLYTST

SEQ ID NO: 1283896 - protein, 17 aa, Mycobacterium
VLVTPLLEWTATQIHAL

SEQ ID NO: 1283897 - protein, 19 aa, Mycobacterium
VLVTSGCRSHLSVTVGVAR

SEQ ID NO: 1283898 - protein, 17 aa, Mycobacterium
VLVYGHRRRAAALEAGR

SEQ ID NO: 1283899 - protein, 19 aa, Mycobacterium
VLWGALLSALGTRLGDTGR

SEQ ID NO: 1283900 - protein, 24 aa, Mycobacterium
VLWSMRADGRWSGERGANIFDGSA

SEQ ID NO: 1283901 - protein, 17 aa, Mycobacterium
VLWSRLRAAITRVQGGD

SEQ ID NO: 1283902 - protein, 21 aa, Mycobacterium
VMAADATAFFDYLAGRPEVRG

SEQ ID NO: 1283903 - protein, 23 aa, Mycobacterium
VMAGSGPTRAWLICDDPNHTWLR

SEQ ID NO: 1283904 - protein, 17 aa, Mycobacterium
VMDAYGIQAAAIFPNLG

SEQ ID NO: 1283905 - protein, 17 aa, Mycobacterium
VMDRSCVEECPVDCIYE

SEQ ID NO: 1283906 - protein, 23 aa, Mycobacterium
VMDRVNPVYIPRNHLVEDALTAA

SEQ ID NO: 1283907 - protein, 22 aa, Mycobacterium
VMDVRFLPNPHWVDRLRPNTGQ

SEQ ID NO: 1283908 - protein, 21 aa, Mycobacterium
VMEIECLLLDFALNESHAQEW

SEQ ID NO: 1283909 - protein, 18 aa, Mycobacterium
VMENRWLPMKRTALALNH

SEQ ID NO: 1283910 - protein, 19 aa, Mycobacterium
VMESPMLWDPIRYDETCPS

SEQ ID NO: 1283911 - protein, 19 aa, Mycobacterium
VMGLIPGVDAAGVLFVGAQ

SEQ ID NO: 1283912 - protein, 22 aa, Mycobacterium
VMGVDARLLGAVSGPPLTSVGF

SEQ ID NO: 1283913 - protein, 25 aa, Mycobacterium
VMGVFCRRWGVPLIDGGTVRLPRLI

SEQ ID NO: 1283914 - protein, 18 aa, Mycobacterium
VMGVTVWRERDLADVQPN

SEQ ID NO: 1283915 - protein, 25 aa, Mycobacterium
VMHAGRITAPRGWELVRHAGPLPSH

SEQ ID NO: 1283916 - protein, 21 aa, Mycobacterium
VMIAMALALEPAVLIADEPTT

SEQ ID NO: 1283917 - protein, 23 aa, Mycobacterium
VMIGADFAPVFGRFPQHVLDGEI

SEQ ID NO: 1283918 - protein, 19 aa, Mycobacterium
VMLQDCVQLHGGIGVTWEH

SEQ ID NO: 1283919 - protein, 24 aa, Mycobacterium
VMMAARWLDYHAAVAFSITGDTLP

SEQ ID NO: 1283920 - protein, 18 aa, Mycobacterium
VMNGRCQGFYCGAHTQAL

SEQ ID NO: 1283921 - protein, 19 aa, Mycobacterium
VMNGRCQGFYCGAHTQALL

SEQ ID NO: 1283922 - protein, 27 aa, Mycobacterium
VMNGRCQGFYCGAHTQALLEARGAEDA

SEQ ID NO: 1283923 - protein, 29 aa, Mycobacterium
VMNGRCQGFYCGAHTQALLESSGAEDADD

SEQ ID NO: 1283924 - protein, 18 aa, Mycobacterium
VMNRLAPLGPVYQAGTLS

SEQ ID NO: 1283925 - protein, 20 aa, Mycobacterium
VMPPWNRKLAYPRLQFSPLH

SEQ ID NO: 1283926 - protein, 18 aa, Mycobacterium
VMRLEGLDVIPSVLPAAP

SEQ ID NO: 1283927 - protein, 19 aa, Mycobacterium
VMRNWRFLQQNGVQILHGP

SEQ ID NO: 1283928 - protein, 23 aa, Mycobacterium
VMRPDGYCNIVGRIKDVVIRGGE

SEQ ID NO: 1283929 - protein, 21 aa, Mycobacterium
VMRRGYRVGEQVVRHALVGVV

SEQ ID NO: 1283930 - protein, 19 aa, Mycobacterium
VMRTWQTAHVMKRRRGFLP

SEQ ID NO: 1283931 - protein, 17 aa, Mycobacterium
VMSGSFTTAAFVEPGDD

SEQ ID NO: 1283932 - protein, 26 aa, Mycobacterium
VMSLRLPVRAPFAFEGLFGHLAASAV

SEQ ID NO: 1283933 - protein, 24 aa, Mycobacterium
VMSNMGLHLAMRSAGIEVRTTGVG

SEQ ID NO: 1283934 - protein, 25 aa, Mycobacterium
VMSVIRPGRDAHRIVAMADSRTYGL

SEQ ID NO: 1283935 - protein, 18 aa, Mycobacterium
VMTGFRVSRAGWYGVDPV

SEQ ID NO: 1283936 - protein, 18 aa, Mycobacterium
VMTGRPGGWVPSGSTVEV

SEQ ID NO: 1283937 - protein, 24 aa, Mycobacterium
VMTRPDAVAGRRGRPSPSPVAQLA

SEQ ID NO: 1283938 - protein, 27 aa, Mycobacterium
VMTVWQKLHFRFGLPKPLLEPLSVERI

SEQ ID NO: 1283939 - protein, 28 aa, Mycobacterium
VMTVWQKLHFRFGLPKPLLEPLSVERIY

SEQ ID NO: 1283940 - protein, 28 aa, Mycobacterium
VMTVWQQLHFRFGLPKPLLEPLGVERIY

SEQ ID NO: 1283941 - protein, 24 aa, Mycobacterium
VMTYWNPVLRWGIDAFARDLAAAG

SEQ ID NO: 1283942 - protein, 24 aa, Mycobacterium
VMVARASALFLRRSEHTVDRVWTS

SEQ ID NO: 1283943 - protein, 18 aa, Mycobacterium
VMVICKILGVPLEDEPRF

SEQ ID NO: 1283944 - protein, 26 aa, Mycobacterium
VMYPSYREIAALPLAERVAQMRKPEV

SEQ ID NO: 1283945 - protein, 30 aa, Mycobacterium
VNAAGLDCFKRFSDVNFDRWQKVIDVNLNG

SEQ ID NO: 1283946 - protein, 25 aa, Mycobacterium
VNAEIPRALVTGAAPVGDRRDRWDT

SEQ ID NO: 1283947 - protein, 29 aa, Mycobacterium
VNAEVELSWNILDPVLDYWASHGKPDPYE

SEQ ID NO: 1283948 - protein, 17 aa, Mycobacterium
VNAGYGIVTEAYGPLGV

SEQ ID NO: 1283949 - protein, 32 aa, Mycobacterium
VNALGKLWAQACDWEPVLPTSLRLVQVGGSRM

SEQ ID NO: 1283950 - protein, 17 aa, Mycobacterium
VNAPAKVLNAFLNGYQP

SEQ ID NO: 1283951 - protein, 24 aa, Mycobacterium
VNAQRWVTRLGRFDELLDGHRTAW

SEQ ID NO: 1283952 - protein, 21 aa, Mycobacterium
VNARFLRICVLTQYKSHSLDR

SEQ ID NO: 1283953 - protein, 19 aa, Mycobacterium
VNARVPVFVGASTLNTRDS

SEQ ID NO: 1283954 - protein, 23 aa, Mycobacterium
VNASWSRVRWWVPDLERSGIGML

SEQ ID NO: 1283955 - protein, 27 aa, Mycobacterium
VNAVIVCPVGFVADHIEVVWDLDNELA

SEQ ID NO: 1283956 - protein, 19 aa, Mycobacterium
VNAYLRRHDTFRSWFERTE

SEQ ID NO: 1283957 - protein, 19 aa, Mycobacterium
VNAYYGLPMSHCRYQDLGD

SEQ ID NO: 1283958 - protein, 17 aa, Mycobacterium
VNDGLWGTPAVRHEAAC

SEQ ID NO: 1283959 - protein, 18 aa, Mycobacterium
VNDLLLPIVKGVGSERAY

SEQ ID NO: 1283960 - protein, 21 aa, Mycobacterium
VNDSFVLPEDVRLVGAQCDEA

SEQ ID NO: 1283961 - protein, 19 aa, Mycobacterium
VNEAFGLAGSNAMYNTSTL

SEQ ID NO: 1283962 - protein, 17 aa, Mycobacterium
VNFEGEWFCTLTPAYFY

SEQ ID NO: 1283963 - protein, 27 aa, Mycobacterium
VNFRGSLGYGKAFLKAAVGEFAGKMHD

SEQ ID NO: 1283964 - protein, 17 aa, Mycobacterium
VNGGWTVLREPLNAEHG

SEQ ID NO: 1283965 - protein, 22 aa, Mycobacterium
VNGHLFPFCALLTEMAGRGHEI

SEQ ID NO: 1283966 - protein, 32 aa, Mycobacterium
VNGNPAVVILWDWTGEGLTTFRGVPTDGKTLT

SEQ ID NO: 1283967 - protein, 27 aa, Mycobacterium
VNGPCVGAGMALCLAADIRICSSAATF

SEQ ID NO: 1283968 - protein, 21 aa, Mycobacterium
VNGRDGSVFDSSYQRGAPVEF

SEQ ID NO: 1283969 - protein, 18 aa, Mycobacterium
VNGWLCSDNGDVFATSLT

SEQ ID NO: 1283970 - protein, 26 aa, Mycobacterium
VNGYRGCSHACRYCFARPTHEYLDFD

SEQ ID NO: 1283971 - protein, 21 aa, Mycobacterium
VNIEYLASVVMERDGVAYPDT

SEQ ID NO: 1283972 - protein, 18 aa, Mycobacterium
VNKGWLVARATLGNERIS

SEQ ID NO: 1283973 - protein, 20 aa, Mycobacterium
VNLDDAWGLRRAEKGEGLRR

SEQ ID NO: 1283974 - protein, 29 aa, Mycobacterium
VNLERAAAVNSRLGGHIVQGHVDGTGHVI

SEQ ID NO: 1283975 - protein, 25 aa, Mycobacterium
VNLERAAAVSSRLGGHIVQGHVDGT

SEQ ID NO: 1283976 - protein, 17 aa, Mycobacterium
VNLGEQWAARAVAALAA

SEQ ID NO: 1283977 - protein, 25 aa, Mycobacterium
VNLGWKLAQVVQGWSPDTLLDTYHD

SEQ ID NO: 1283978 - protein, 18 aa, Mycobacterium
VNLRWSWDKPTQDLFAAI

SEQ ID NO: 1283979 - protein, 18 aa, Mycobacterium
VNLSGVWKTVKAGVPHIL

SEQ ID NO: 1283980 - protein, 25 aa, Mycobacterium
VNNARLRAATPWRTRYPSVWDGYRA

SEQ ID NO: 1283981 - protein, 30 aa, Mycobacterium
VNPDGTGLQCLSCGLAPEITENLSKPFVFE

SEQ ID NO: 1283982 - protein, 23 aa, Mycobacterium
VNPGLLVEGSWGMGAAVFDRTGR

SEQ ID NO: 1283983 - protein, 17 aa, Mycobacterium
VNPTSFAYCREIRRDEI

SEQ ID NO: 1283984 - protein, 19 aa, Mycobacterium
VNRGRCVRDSGVALLPGVK

SEQ ID NO: 1283985 - protein, 18 aa, Mycobacterium
VNRLRLQDLITRHPEILA

SEQ ID NO: 1283986 - protein, 18 aa, Mycobacterium
VNRNGLDLVREFSVRADP

SEQ ID NO: 1283987 - protein, 25 aa, Mycobacterium
VNRRFAEATARAAAQGATVWVQDYQ

SEQ ID NO: 1283988 - protein, 17 aa, Mycobacterium
VNSAALRFIHLDDLEAQ

SEQ ID NO: 1283989 - protein, 31 aa, Mycobacterium
VNSFSKYFAMTGWRLGWLLVPDELKRAVDRL

SEQ ID NO: 1283990 - protein, 26 aa, Mycobacterium
VNSLGGRGVFAVELLVRGDEVYFSDV

SEQ ID NO: 1283991 - protein, 25 aa, Mycobacterium
VNSYKRRVPGSWSPVSAAWGVDNRT

SEQ ID NO: 1283992 - protein, 22 aa, Mycobacterium
VNTWSSAFGRYHRTVGQVLLTA

SEQ ID NO: 1283993 - protein, 17 aa, Mycobacterium
VNVEHNFEPLYIISPDK

SEQ ID NO: 1283994 - protein, 19 aa, Mycobacterium
VNVKPKFAVDAMVATVGQA

SEQ ID NO: 1283995 - protein, 18 aa, Mycobacterium
VNVKPKFAVDAMVGTVGQ

SEQ ID NO: 1283996 - protein, 23 aa, Mycobacterium
VNVLCSQGVWARHRKLAQTASAL

SEQ ID NO: 1283997 - protein, 24 aa, Mycobacterium
VNVPGDDGLTFAVKPIAAGADAPA

SEQ ID NO: 1283998 - protein, 24 aa, Mycobacterium
VNVYRVVTNLGVFDFNGPDHQMRA

SEQ ID NO: 1283999 - protein, 17 aa, Mycobacterium
VNWVGPIIMRHGTEAQQ

SEQ ID NO: 1284000 - protein, 20 aa, Mycobacterium
VNYFCVGPCWPTPTKPGRPA

SEQ ID NO: 1284001 - protein, 23 aa, Mycobacterium
VPAAIRLLSALGYDLVILETVGV

SEQ ID NO: 1284002 - protein, 17 aa, Mycobacterium
VPAALAVDSVRHAIGDA

SEQ ID NO: 1284003 - protein, 18 aa, Mycobacterium
VPAATPLRDAWVPDADLR

SEQ ID NO: 1284004 - protein, 17 aa, Mycobacterium
VPACSYPLTGVACVSRI

SEQ ID NO: 1284005 - protein, 23 aa, Mycobacterium
VPADATPAYLGFNLFGHAIARAL

SEQ ID NO: 1284006 - protein, 17 aa, Mycobacterium
VPAEFFLDSVARRGSSI

SEQ ID NO: 1284007 - protein, 20 aa, Mycobacterium
VPAEIAALWRDGLVARIDLK

SEQ ID NO: 1284008 - protein, 25 aa, Mycobacterium
VPAERLRMLRSFDPRSGAHVLDVED

SEQ ID NO: 1284009 - protein, 26 aa, Mycobacterium
VPAFALGDYEWLLAFEAPELHRIVDL

SEQ ID NO: 1284010 - protein, 18 aa, Mycobacterium
VPAGLGFDTVFAGDPSSP

SEQ ID NO: 1284011 - protein, 18 aa, Mycobacterium
VPAGWRVVFGEATRAECL

SEQ ID NO: 1284012 - protein, 28 aa, Mycobacterium
VPAHAELAWVLGCFTGFGQASRMTQFKD

SEQ ID NO: 1284013 - protein, 19 aa, Mycobacterium
VPALGACVIIDWKGGLSTG

SEQ ID NO: 1284014 - protein, 29 aa, Mycobacterium
VPALLRSCGRPYPWVQIRIVDETGADAVA

SEQ ID NO: 1284015 - protein, 17 aa, Mycobacterium
VPALPQLRTLTTWLESR

SEQ ID NO: 1284016 - protein, 23 aa, Mycobacterium
VPAPERGAALIAVRDSRLIVDVV

SEQ ID NO: 1284017 - protein, 21 aa, Mycobacterium
VPAPLLRWGVGKFNPEARSST

SEQ ID NO: 1284018 - protein, 22 aa, Mycobacterium
VPAPRLPALVADIAPRTAAAAR

SEQ ID NO: 1284019 - protein, 24 aa, Mycobacterium
VPARAAFVAGDWGAVASLSPELFL

SEQ ID NO: 1284020 - protein, 20 aa, Mycobacterium
VPAREKYAFMQWVVATMQRH

SEQ ID NO: 1284021 - protein, 19 aa, Mycobacterium
VPARVATLVEKLRAAEKEL

SEQ ID NO: 1284022 - protein, 22 aa, Mycobacterium
VPASAIGRIFSPPEFRLIPIDE

SEQ ID NO: 1284023 - protein, 18 aa, Mycobacterium
VPATGRKATRVLFVCTQN

SEQ ID NO: 1284024 - protein, 19 aa, Mycobacterium
VPDAVAALYSRSDKKRLQR

SEQ ID NO: 1284025 - protein, 19 aa, Mycobacterium
VPDDIAALAAHAERDYTAA

SEQ ID NO: 1284026 - protein, 19 aa, Mycobacterium
VPDEQRLAARLERYRRIGL

SEQ ID NO: 1284027 - protein, 17 aa, Mycobacterium
VPDGAIEAVEWPDHPFA

SEQ ID NO: 1284028 - protein, 23 aa, Mycobacterium
VPDLPSPYSLAVVQLDGSPVRVL

SEQ ID NO: 1284029 - protein, 21 aa, Mycobacterium
VPDPPGPHLLVLARGPEGYRR

SEQ ID NO: 1284030 - protein, 22 aa, Mycobacterium
VPDYLLQILARFARSLRESSSI

SEQ ID NO: 1284031 - protein, 26 aa, Mycobacterium
VPEATRYEAWSFPDFATGADALRAVA

SEQ ID NO: 1284032 - protein, 23 aa, Mycobacterium
VPEDRRLLAAFGPRALAVARDRF

SEQ ID NO: 1284033 - protein, 25 aa, Mycobacterium
VPEDSLRVSLDYARISPVIGGTRRT

SEQ ID NO: 1284034 - protein, 18 aa, Mycobacterium
VPEGAIVVFSAHGVAPTV

SEQ ID NO: 1284035 - protein, 18 aa, Mycobacterium
VPEGVYTNLFASFDQVET

SEQ ID NO: 1284036 - protein, 18 aa, Mycobacterium
VPEHRDLLVRWAGQLEPG

SEQ ID NO: 1284037 - protein, 18 aa, Mycobacterium
VPEITWPSATCTLPTLPL

SEQ ID NO: 1284038 - protein, 21 aa, Mycobacterium
VPEKLPLEIGDTWTETGPDGN

SEQ ID NO: 1284039 - protein, 18 aa, Mycobacterium
VPESACARTEPELAEELL

SEQ ID NO: 1284040 - protein, 28 aa, Mycobacterium
VPESASSWFLPRLVGLTRATDWVLSGRV

SEQ ID NO: 1284041 - protein, 20 aa, Mycobacterium
VPESFPGPVGSVVITPLPGH

SEQ ID NO: 1284042 - protein, 21 aa, Mycobacterium
VPEVPVPIAAAVSGDRSVEQF

SEQ ID NO: 1284043 - protein, 21 aa, Mycobacterium
VPFNKRGRIADEYLEAMFELW

SEQ ID NO: 1284044 - protein, 22 aa, Mycobacterium
VPFSTPRSWASLSRALDLVEQK

SEQ ID NO: 1284045 - protein, 18 aa, Mycobacterium
VPGAAEFAHPISEYEHGA

SEQ ID NO: 1284046 - protein, 17 aa, Mycobacterium
VPGDPLADIGVTKNVTF

SEQ ID NO: 1284047 - protein, 21 aa, Mycobacterium
VPGETVAAYVARRTGCAEATR

SEQ ID NO: 1284048 - protein, 22 aa, Mycobacterium
VPGFGCVAAPIGDPGEAAAAVS

SEQ ID NO: 1284049 - protein, 20 aa, Mycobacterium
VPGGAPAAPFDRTWPDKVID

SEQ ID NO: 1284050 - protein, 26 aa, Mycobacterium
VPGGPWFQWHFDRWTPPPGATEIART

SEQ ID NO: 1284051 - protein, 21 aa, Mycobacterium
VPGGRVRPAYGPGRDLADAGA

SEQ ID NO: 1284052 - protein, 22 aa, Mycobacterium
VPGIIQRLSLDRVVRPVQAYYP

SEQ ID NO: 1284053 - protein, 24 aa, Mycobacterium
VPGLEPHAQLLLWGQQVDDELARV

SEQ ID NO: 1284054 - protein, 21 aa, Mycobacterium
VPGLRTPYTLVIVELDGVAVR

SEQ ID NO: 1284055 - protein, 18 aa, Mycobacterium
VPGMAFAGGLLNARDAAA

SEQ ID NO: 1284056 - protein, 24 aa, Mycobacterium
VPGMPRLLKWLSQFIPLVAGPLPI

SEQ ID NO: 1284057 - protein, 19 aa, Mycobacterium
VPGQCDIAAMDHAVNAYLR

SEQ ID NO: 1284058 - protein, 22 aa, Mycobacterium
VPGRDLPCCHVYRTLDDLDAIR

SEQ ID NO: 1284059 - protein, 27 aa, Mycobacterium
VPGSSSGGFVNYPAPPVPPTPPNSAGV

SEQ ID NO: 1284060 - protein, 25 aa, Mycobacterium
VPGTDGGAVARCYSLASSPHTDAAP

SEQ ID NO: 1284061 - protein, 18 aa, Mycobacterium
VPHFSLTFVNTFRPSGPG

SEQ ID NO: 1284062 - protein, 19 aa, Mycobacterium
VPIAARLATVPSVSLQLLG

SEQ ID NO: 1284063 - protein, 27 aa, Mycobacterium
VPIDLREDWPAALHAAGFDASRPTAWL

SEQ ID NO: 1284064 - protein, 25 aa, Mycobacterium
VPIDLRQDWPTALTHAGFDADQPTA

SEQ ID NO: 1284065 - protein, 25 aa, Mycobacterium
VPIERTVEFLQWFLDTVPIEPIWLC

SEQ ID NO: 1284066 - protein, 24 aa, Mycobacterium
VPIGRTAEFLAWFLENVPIEPIWL

SEQ ID NO: 1284067 - protein, 25 aa, Mycobacterium
VPIQVVDAVQWFRVGEEAAPGSRPE

SEQ ID NO: 1284068 - protein, 17 aa, Mycobacterium
VPIVSPRGEPLGCITVW

SEQ ID NO: 1284069 - protein, 29 aa, Mycobacterium
VPIWGDVELAWRLDRAGWFGPPRRWLVVT

SEQ ID NO: 1284070 - protein, 17 aa, Mycobacterium
VPKEDLASLEFLISASG

SEQ ID NO: 1284071 - protein, 19 aa, Mycobacterium
VPKFPNFFMIYGPGTHLAH

SEQ ID NO: 1284072 - protein, 25 aa, Mycobacterium
VPKKLLEDWLAMWSEHYQLGEKLRV

SEQ ID NO: 1284073 - protein, 24 aa, Mycobacterium
VPKTLIQHLIRWVISSDQFDKAVN

SEQ ID NO: 1284074 - protein, 23 aa, Mycobacterium
VPKYTPEWVRTVAIWAEASHREI

SEQ ID NO: 1284075 - protein, 19 aa, Mycobacterium
VPLAEVIAGYLEREQFETI

SEQ ID NO: 1284076 - protein, 17 aa, Mycobacterium
VPLDAAILFAPVGDLVL

SEQ ID NO: 1284077 - protein, 21 aa, Mycobacterium
VPLELCTDSGDLLTFISTVTT

SEQ ID NO: 1284078 - protein, 20 aa, Mycobacterium
VPLGASWPVYDESLRDTWVG

SEQ ID NO: 1284079 - protein, 20 aa, Mycobacterium
VPLKLAKSLFDAFNPFVQNS

SEQ ID NO: 1284080 - protein, 18 aa, Mycobacterium
VPLLHRITTDTERPLTGI

SEQ ID NO: 1284081 - protein, 25 aa, Mycobacterium
VPLMRRFGLDAGERIAKLLSDSGVR

SEQ ID NO: 1284082 - protein, 22 aa, Mycobacterium
VPLPNNTCRVVGPDGRDCPDWV

SEQ ID NO: 1284083 - protein, 18 aa, Mycobacterium
VPLPRDLMRDNYILKATP

SEQ ID NO: 1284084 - protein, 17 aa, Mycobacterium
VPLPRTGTVYTETTVHI

SEQ ID NO: 1284085 - protein, 17 aa, Mycobacterium
VPLSRRGKLWSYTENRY

SEQ ID NO: 1284086 - protein, 18 aa, Mycobacterium
VPLTKLFELIGARADEGA

SEQ ID NO: 1284087 - protein, 20 aa, Mycobacterium
VPLVMLLEGAGFRPSGEHYG

SEQ ID NO: 1284088 - protein, 22 aa, Mycobacterium
VPNADGGLDFSIVGSSPEALVT

SEQ ID NO: 1284089 - protein, 17 aa, Mycobacterium
VPPAIGYPLGAQEGDVT

SEQ ID NO: 1284090 - protein, 20 aa, Mycobacterium
VPPDAPTLCEGWDVRDLTAH

SEQ ID NO: 1284091 - protein, 27 aa, Mycobacterium
VPPEIVRALDPLLRAIIETGYDRPTDG

SEQ ID NO: 1284092 - protein, 23 aa, Mycobacterium
VPPELLFATTLADLGHRDGIRLS

SEQ ID NO: 1284093 - protein, 21 aa, Mycobacterium
VPPGSLGFRYGDEGVGKWNLD

SEQ ID NO: 1284094 - protein, 22 aa, Mycobacterium
VPPPLRPAVEAVRPSAAEEART

SEQ ID NO: 1284095 - protein, 24 aa, Mycobacterium
VPPQRLQMAVAYGSAAAALPGTTL

SEQ ID NO: 1284096 - protein, 19 aa, Mycobacterium
VPPQVGWRNSTRLARDHYV

SEQ ID NO: 1284097 - protein, 20 aa, Mycobacterium
VPPRAMQPMIAMLGREGLAE

SEQ ID NO: 1284098 - protein, 18 aa, Mycobacterium
VPPTVLRTVFGWTSRRRA

SEQ ID NO: 1284099 - protein, 32 aa, Mycobacterium
VPPVGDARPDWELICGVARHLGFGDAFDYKSS

SEQ ID NO: 1284100 - protein, 18 aa, Mycobacterium
VPQGWGLGFHLYLIDLPG

SEQ ID NO: 1284101 - protein, 29 aa, Mycobacterium
VPQLDAKVLWQLKRALPGPFTRTLGLVER

SEQ ID NO: 1284102 - protein, 21 aa, Mycobacterium
VPQLGAALVRLMLDAWADEEI

SEQ ID NO: 1284103 - protein, 18 aa, Mycobacterium
VPQPPSGYPFQLANRRNR

SEQ ID NO: 1284104 - protein, 20 aa, Mycobacterium
VPQWPRRWRYLSPAIPADPQ

SEQ ID NO: 1284105 - protein, 20 aa, Mycobacterium
VPRDELIAFFVAADVMLVTP

SEQ ID NO: 1284106 - protein, 25 aa, Mycobacterium
VPREIAGRTRLDWESLSQRIHPAES

SEQ ID NO: 1284107 - protein, 24 aa, Mycobacterium
VPREQAVAAIVDWVTRRENATPTA

SEQ ID NO: 1284108 - protein, 24 aa, Mycobacterium
VPRKRVVPPIPRKDSLPLEGLRVV

SEQ ID NO: 1284109 - protein, 21 aa, Mycobacterium
VPRLWRIADGLGVEIPRDRGY

SEQ ID NO: 1284110 - protein, 18 aa, Mycobacterium
VPRPDWPADAVVVGPLHF

SEQ ID NO: 1284111 - protein, 24 aa, Mycobacterium
VPRQDRYPLVQAVERLREPGDPFY

SEQ ID NO: 1284112 - protein, 17 aa, Mycobacterium
VPSAGAVLADWGADVVK

SEQ ID NO: 1284113 - protein, 23 aa, Mycobacterium
VPSDMKGLWGFVPACSTPDAADV

SEQ ID NO: 1284114 - protein, 25 aa, Mycobacterium
VPSDMKGLWGFVPACSTPDAADVNA

SEQ ID NO: 1284115 - protein, 24 aa, Mycobacterium
VPSEFRAAPRADRRPSGRAYRDSH

SEQ ID NO: 1284116 - protein, 20 aa, Mycobacterium
VPSEVRLDLQVPVVAADAPW

SEQ ID NO: 1284117 - protein, 17 aa, Mycobacterium
VPSLLGLFLSLPGVNQW

SEQ ID NO: 1284118 - protein, 19 aa, Mycobacterium
VPSPIDPPSGCRFRTRCWK

SEQ ID NO: 1284119 - protein, 37 aa, Mycobacterium
VPSYVKPVFKLGWSRRLAPLMRRWALRHGSPELTVNW

SEQ ID NO: 1284120 - protein, 18 aa, Mycobacterium
VPTAWRAVPELADLREGE

SEQ ID NO: 1284121 - protein, 18 aa, Mycobacterium
VPTDVAWPYLERAALASE

SEQ ID NO: 1284122 - protein, 18 aa, Mycobacterium
VPTLTALMGRIAQRRVRL

SEQ ID NO: 1284123 - protein, 20 aa, Mycobacterium
VPTMFSRILKLPNEIRVKYD

SEQ ID NO: 1284124 - protein, 19 aa, Mycobacterium
VPTPVVVDAGVPGVGGTGG

SEQ ID NO: 1284125 - protein, 17 aa, Mycobacterium
VPTSRRVVAALGPKVLQ

SEQ ID NO: 1284126 - protein, 22 aa, Mycobacterium
VPTSRYVLRDPFPAAAPPDDAA

SEQ ID NO: 1284127 - protein, 20 aa, Mycobacterium
VPTVHTGLMPGWAEHDLSEL

SEQ ID NO: 1284128 - protein, 25 aa, Mycobacterium
VPVDELHALWVPGTRIVYIGKANAG

SEQ ID NO: 1284129 - protein, 18 aa, Mycobacterium
VPVDIGWFVHQVRSTSAG

SEQ ID NO: 1284130 - protein, 23 aa, Mycobacterium
VPVETWLTAIADLLARFHSRAER

SEQ ID NO: 1284131 - protein, 20 aa, Mycobacterium
VPVEVGATWEPVDVTHDTIA

SEQ ID NO: 1284132 - protein, 25 aa, Mycobacterium
VPVFGRVRLPIRWLADMAAMSTDPR

SEQ ID NO: 1284133 - protein, 17 aa, Mycobacterium
VPVGITPEGSWVLTDGR

SEQ ID NO: 1284134 - protein, 17 aa, Mycobacterium
VPVIAFLASDAAQWING

SEQ ID NO: 1284135 - protein, 17 aa, Mycobacterium
VPVIERNGGGAILNVLS

SEQ ID NO: 1284136 - protein, 21 aa, Mycobacterium
VPVLAAVPMRGGLPTAVPTDP

SEQ ID NO: 1284137 - protein, 25 aa, Mycobacterium
VPVLAEAAADVFLLPVGDDLVLVQA

SEQ ID NO: 1284138 - protein, 20 aa, Mycobacterium
VPVLPRLDGELPRCRQTVHR

SEQ ID NO: 1284139 - protein, 18 aa, Mycobacterium
VPVLRGERTASLGMSEPS

SEQ ID NO: 1284140 - protein, 17 aa, Mycobacterium
VPVMFDRIMDLPDEVLD

SEQ ID NO: 1284141 - protein, 19 aa, Mycobacterium
VPVNFRLAAGEIGYVLSDS

SEQ ID NO: 1284142 - protein, 20 aa, Mycobacterium
VPVPAGHRVTVRIYRGGPPG

SEQ ID NO: 1284143 - protein, 18 aa, Mycobacterium
VPVPRYTAVGSVDDAVAF

SEQ ID NO: 1284144 - protein, 20 aa, Mycobacterium
VPVQLIWGDCDAVIPVSHGE

SEQ ID NO: 1284145 - protein, 22 aa, Mycobacterium
VPVRGVCSLDAIAAGSTGDVLV

SEQ ID NO: 1284146 - protein, 26 aa, Mycobacterium
VPVRLAELFLEAGLPAGVFQVVHGDK

SEQ ID NO: 1284147 - protein, 23 aa, Mycobacterium
VPVSDREEMRWVLAGDDPAEILR

SEQ ID NO: 1284148 - protein, 20 aa, Mycobacterium
VPVSFDFSRDRISGNYFTGV

SEQ ID NO: 1284149 - protein, 19 aa, Mycobacterium
VPVYPTCHYVMGGIPTTVN

SEQ ID NO: 1284150 - protein, 24 aa, Mycobacterium
VPWAAYAGRVVAIWSDGDSHRVAD

SEQ ID NO: 1284151 - protein, 25 aa, Mycobacterium
VPWEPICAPDLLLAQALLRTKSIKL

SEQ ID NO: 1284152 - protein, 22 aa, Mycobacterium
VPWSSLRLRTARLCRPGIAPCT

SEQ ID NO: 1284153 - protein, 24 aa, Mycobacterium
VPYRANMWALRALGVRRVFGPCAV

SEQ ID NO: 1284154 - protein, 17 aa, Mycobacterium
VPYRFASRIDRDGRVPE

SEQ ID NO: 1284155 - protein, 19 aa, Mycobacterium
VPYTYWGVGCVDPDAYRSA

SEQ ID NO: 1284156 - protein, 18 aa, Mycobacterium
VQAECAGLTYLVDDLDGH

SEQ ID NO: 1284157 - protein, 25 aa, Mycobacterium
VQALTRTAGFQWARHNICVNAIAPI

SEQ ID NO: 1284158 - protein, 22 aa, Mycobacterium
VQAPRFAGAGAVVIDNSSAWRK

SEQ ID NO: 1284159 - protein, 18 aa, Mycobacterium
VQAQRYEGYTVWINALVL

SEQ ID NO: 1284160 - protein, 27 aa, Mycobacterium
VQASRCMDCGIPFCHNGCPLGNLIPEW

SEQ ID NO: 1284161 - protein, 20 aa, Mycobacterium
VQATLRWATAHRIAVVPRGM

SEQ ID NO: 1284162 - protein, 26 aa, Mycobacterium
VQAVWFRHGPPVLALCVHHLSTDVVS

SEQ ID NO: 1284163 - protein, 20 aa, Mycobacterium
VQCDLWFPGQLVPGHGGGLR

SEQ ID NO: 1284164 - protein, 22 aa, Mycobacterium
VQEFLARFWYHYDQGKFDVLAT

SEQ ID NO: 1284165 - protein, 20 aa, Mycobacterium
VQFHYDISNDFFKLWQDPSQ

SEQ ID NO: 1284166 - protein, 31 aa, Mycobacterium
VQFRLLPVGDPFRFLVNLAKSVPVGIDDGLQ

SEQ ID NO: 1284167 - protein, 17 aa, Mycobacterium
VQFVQGFTPLPEGPSNG

SEQ ID NO: 1284168 - protein, 17 aa, Mycobacterium
VQGDTAAVTVEWDPEKV

SEQ ID NO: 1284169 - protein, 23 aa, Mycobacterium
VQGGMGRSGRWFAHQHTDVRPDI

SEQ ID NO: 1284170 - protein, 23 aa, Mycobacterium
VQGHPIYGLVVLFAAFTGLRAGE

SEQ ID NO: 1284171 - protein, 21 aa, Mycobacterium
VQGMCTAGAFYFVNEADVVIC

SEQ ID NO: 1284172 - protein, 26 aa, Mycobacterium
VQGPQRWRVKANWKIAAENFAGDMYH

SEQ ID NO: 1284173 - protein, 25 aa, Mycobacterium
VQHGPRPAIGLVVLDRAPASIVAAA

SEQ ID NO: 1284174 - protein, 25 aa, Mycobacterium
VQHTRLRPAVNLGLDVLNTALRELV

SEQ ID NO: 1284175 - protein, 24 aa, Mycobacterium
VQIPKLRVGSFFPSLLERRRRIDK

SEQ ID NO: 1284176 - protein, 23 aa, Mycobacterium
VQIPRFCDHPLLDPVGACRQCLV

SEQ ID NO: 1284177 - protein, 17 aa, Mycobacterium
VQIRLGGDMALFAGLGR

SEQ ID NO: 1284178 - protein, 17 aa, Mycobacterium
VQIRRAGAGSVLIDPVS

SEQ ID NO: 1284179 - protein, 24 aa, Mycobacterium
VQKAQKQARRWSRDSVAQALRLVA

SEQ ID NO: 1284180 - protein, 17 aa, Mycobacterium
VQLAVLVDRGHRELPIR

SEQ ID NO: 1284181 - protein, 19 aa, Mycobacterium
VQLDHAWVGLGAEFGAALR

SEQ ID NO: 1284182 - protein, 27 aa, Mycobacterium
VQLGDDWPSHILVPAIHRNRAEVREIF

SEQ ID NO: 1284183 - protein, 24 aa, Mycobacterium
VQLPLECTYDFEVRAAKYLLALDA

SEQ ID NO: 1284184 - protein, 25 aa, Mycobacterium
VQLPLRKGDAVFFNPALYHAAGANV

SEQ ID NO: 1284185 - protein, 17 aa, Mycobacterium
VQLRWLRRSGRDYELGM

SEQ ID NO: 1284186 - protein, 25 aa, Mycobacterium
VQLTRKKLGTGLIEAFSTTCSHCAG

SEQ ID NO: 1284187 - protein, 17 aa, Mycobacterium
VQLVLCAGAPDTPEIAA

SEQ ID NO: 1284188 - protein, 17 aa, Mycobacterium
VQLVLCAGAPDTPEIAE

SEQ ID NO: 1284189 - protein, 25 aa, Mycobacterium
VQMGCGRTGPFFSFEEAGIVPDIVT

SEQ ID NO: 1284190 - protein, 26 aa, Mycobacterium
VQNDREWKALCERVINRPELVEDERF

SEQ ID NO: 1284191 - protein, 21 aa, Mycobacterium
VQNRCFLYHLIGGGTGDWDVP

SEQ ID NO: 1284192 - protein, 23 aa, Mycobacterium
VQPELRKGRYPDRKVARRVSEVV

SEQ ID NO: 1284193 - protein, 17 aa, Mycobacterium
VQPGCGVRRGRWPEYPS

SEQ ID NO: 1284194 - protein, 20 aa, Mycobacterium
VQPLKGARISGSLHMTVQTA

SEQ ID NO: 1284195 - protein, 24 aa, Mycobacterium
VQRARARGELRPDARIVESTSGTL

SEQ ID NO: 1284196 - protein, 21 aa, Mycobacterium
VQRARRIERFLSQNMMAAEQF

SEQ ID NO: 1284197 - protein, 22 aa, Mycobacterium
VQRAVDLVQLFPAAAYGKNGAD

SEQ ID NO: 1284198 - protein, 23 aa, Mycobacterium
VQRGPLPALERLHAALRDSMPAG

SEQ ID NO: 1284199 - protein, 19 aa, Mycobacterium
VQRMGRSMAVGQRFRKLLG

SEQ ID NO: 1284200 - protein, 23 aa, Mycobacterium
VQRSWAQRIACAPEFPPPDPRPV

SEQ ID NO: 1284201 - protein, 24 aa, Mycobacterium
VQRVKTWLQFPQWFYNDTQPNSMV

SEQ ID NO: 1284202 - protein, 18 aa, Mycobacterium
VQSGDKEGWLALMADDVV

SEQ ID NO: 1284203 - protein, 17 aa, Mycobacterium
VQSGDREGWLALMADDV

SEQ ID NO: 1284204 - protein, 19 aa, Mycobacterium
VQSGSPCGAVDVWADAPAD

SEQ ID NO: 1284205 - protein, 27 aa, Mycobacterium
VQSHPRVWLARRIEIAEHWRAVHPARD

SEQ ID NO: 1284206 - protein, 26 aa, Mycobacterium
VQSLSMTPLVNWRIPGPELKFEERWM

SEQ ID NO: 1284207 - protein, 24 aa, Mycobacterium
VQTDPWCRPAPLVGHPELGQRVPN

SEQ ID NO: 1284208 - protein, 25 aa, Mycobacterium
VQTGFARTGAMFACEHEGIVPDLIV

SEQ ID NO: 1284209 - protein, 19 aa, Mycobacterium
VQTGNRWGIAVAKDRPDTL

SEQ ID NO: 1284210 - protein, 19 aa, Mycobacterium
VQTMKDRLGANVVPIQLPI

SEQ ID NO: 1284211 - protein, 17 aa, Mycobacterium
VQTRIVVLGDAWELLKF

SEQ ID NO: 1284212 - protein, 29 aa, Mycobacterium
VQTRIVVLGDAWGLLKFLDEGAFVLDERA

SEQ ID NO: 1284213 - protein, 23 aa, Mycobacterium
VQTVLLMRSWSRFVAACRRRYGP

SEQ ID NO: 1284214 - protein, 21 aa, Mycobacterium
VQVDQVLKFVAPIKAGDTLYC

SEQ ID NO: 1284215 - protein, 25 aa, Mycobacterium
VQVLGFREHASWALASDTLEFVDLE

SEQ ID NO: 1284216 - protein, 17 aa, Mycobacterium
VQVLLRLSFALNSIGDL

SEQ ID NO: 1284217 - protein, 20 aa, Mycobacterium
VQVPGFRAAQGFEPVALCAR

SEQ ID NO: 1284218 - protein, 18 aa, Mycobacterium
VQYFEMFGNRGIYHKGWT

SEQ ID NO: 1284219 - protein, 24 aa, Mycobacterium
VQYHLSKVFAKLGIRSRSQLEHSL

SEQ ID NO: 1284220 - protein, 33 aa, Mycobacterium
VRAAAAEVRYRRVCAAVDELHRLAAETRDDGLA

SEQ ID NO: 1284221 - protein, 18 aa, Mycobacterium
VRAAATTMFFGRTAEELA

SEQ ID NO: 1284222 - protein, 19 aa, Mycobacterium
VRAALELIGNLGSVAGPRK

SEQ ID NO: 1284223 - protein, 20 aa, Mycobacterium
VRAALQDVLIRFDGRHRDLT

SEQ ID NO: 1284224 - protein, 20 aa, Mycobacterium
VRAEAFARAFGLGVASSDPR

SEQ ID NO: 1284225 - protein, 20 aa, Mycobacterium
VRAEAGAVWDDVVAASLTQG

SEQ ID NO: 1284226 - protein, 25 aa, Mycobacterium
VRAEFEDILAFWFDRGVDGFRIDVA

SEQ ID NO: 1284227 - protein, 18 aa, Mycobacterium
VRAGARTLLSIEGSALRV

SEQ ID NO: 1284228 - protein, 18 aa, Mycobacterium
VRAGDEITGPFLAGLSTV

SEQ ID NO: 1284229 - protein, 19 aa, Mycobacterium
VRAGIRAAAALAQVAIEET

SEQ ID NO: 1284230 - protein, 17 aa, Mycobacterium
VRAHFGDKVLRTVIPRS

SEQ ID NO: 1284231 - protein, 23 aa, Mycobacterium
VRAKRGGSVLCAIEVDREDISAY

SEQ ID NO: 1284232 - protein, 19 aa, Mycobacterium
VRALVPRRDVNAIMDELAA

SEQ ID NO: 1284233 - protein, 24 aa, Mycobacterium
VRANLFYRGLAFHRYPVLGDSLFT

SEQ ID NO: 1284234 - protein, 21 aa, Mycobacterium
VRAQSWDLVRDGVFVGYQLDR

SEQ ID NO: 1284235 - protein, 21 aa, Mycobacterium
VRARLAAQGWPLDDPRDAEED

SEQ ID NO: 1284236 - protein, 19 aa, Mycobacterium
VRASELLGLRHGDLDAGRY

SEQ ID NO: 1284237 - protein, 19 aa, Mycobacterium
VRATFPLPARETITYEVVT

SEQ ID NO: 1284238 - protein, 21 aa, Mycobacterium
VRATSRFTLNLVHGLQDLFTQ

SEQ ID NO: 1284239 - protein, 20 aa, Mycobacterium
VRDAFTAFFGDRCMDMPQGA

SEQ ID NO: 1284240 - protein, 20 aa, Mycobacterium
VRDAMPPRAVLLLVETVIPP

SEQ ID NO: 1284241 - protein, 22 aa, Mycobacterium
VRDELPHSLAVVIDEVEERPGR

SEQ ID NO: 1284242 - protein, 18 aa, Mycobacterium
VRDGETWTTAFGAVNSLH

SEQ ID NO: 1284243 - protein, 25 aa, Mycobacterium
VRDGGVGIHSIFGGAFTVEAEAVGD

SEQ ID NO: 1284244 - protein, 26 aa, Mycobacterium
VRDGLRVIAIRSRLMSRLAGQGAVAL

SEQ ID NO: 1284245 - protein, 25 aa, Mycobacterium
VRDLRGFKGPRMLLGDLNMSPPTPA

SEQ ID NO: 1284246 - protein, 21 aa, Mycobacterium
VRDPRALAAVRELWTTRDQIA

SEQ ID NO: 1284247 - protein, 18 aa, Mycobacterium
VRDVRRMGSCALDLCAVA

SEQ ID NO: 1284248 - protein, 17 aa, Mycobacterium
VREAERFMAADGSDCGI

SEQ ID NO: 1284249 - protein, 24 aa, Mycobacterium
VREFLRGAVRLHILHHAAEMDIHG

SEQ ID NO: 1284250 - protein, 20 aa, Mycobacterium
VREFPVFAPVALAGLAGKMP

SEQ ID NO: 1284251 - protein, 20 aa, Mycobacterium
VREGVLPLTAWSEADSPDLR

SEQ ID NO: 1284252 - protein, 18 aa, Mycobacterium
VREHARRGGFPADVVVPV

SEQ ID NO: 1284253 - protein, 19 aa, Mycobacterium
VRELPAGSTEVSWLVFTDK

SEQ ID NO: 1284254 - protein, 24 aa, Mycobacterium
VREPQHRSAFCHRDAAFSLAVIGA

SEQ ID NO: 1284255 - protein, 21 aa, Mycobacterium
VREQGRIAARVVLGGLGDGDA

SEQ ID NO: 1284256 - protein, 24 aa, Mycobacterium
VRERRLDAAPGIMIPALAGYTERV

SEQ ID NO: 1284257 - protein, 21 aa, Mycobacterium
VRETGLLERWREDVAIVGQSR

SEQ ID NO: 1284258 - protein, 29 aa, Mycobacterium
VRETLKAVPHYGIGYGLLRYLYAPTARVL

SEQ ID NO: 1284259 - protein, 19 aa, Mycobacterium
VREVCLDGGLLDAMAPGSV

SEQ ID NO: 1284260 - protein, 24 aa, Mycobacterium
VREVKRLTKVTGIDERRLALILEV

SEQ ID NO: 1284261 - protein, 17 aa, Mycobacterium
VRFAVAFFGLLRAGAVP

SEQ ID NO: 1284262 - protein, 18 aa, Mycobacterium
VRFCDSFNTPLVFVVDTP

SEQ ID NO: 1284263 - protein, 29 aa, Mycobacterium
VRFDHAFESARRCGATTFVELSAHPQLLF

SEQ ID NO: 1284264 - protein, 29 aa, Mycobacterium
VRFDRAFESARRCGATTFVELSAHPQLLF

SEQ ID NO: 1284265 - protein, 18 aa, Mycobacterium
VRFLPMEELIAAFLPVLF

SEQ ID NO: 1284266 - protein, 25 aa, Mycobacterium
VRFTDALPVWPPREMSTAQITGTTP

SEQ ID NO: 1284267 - protein, 17 aa, Mycobacterium
VRFTSPHPAEFTDDVIE

SEQ ID NO: 1284268 - protein, 20 aa, Mycobacterium
VRFVGQRVAAVVADSVAVAE

SEQ ID NO: 1284269 - protein, 22 aa, Mycobacterium
VRGEGCGILVLKRLSDAVRDGD

SEQ ID NO: 1284270 - protein, 28 aa, Mycobacterium
VRGELALRPGWPSMFRGYLRQDQRYRDS

SEQ ID NO: 1284271 - protein, 18 aa, Mycobacterium
VRGGEGFFSRQEIRQALL

SEQ ID NO: 1284272 - protein, 18 aa, Mycobacterium
VRGGIPYAIAKSLAAAPF

SEQ ID NO: 1284273 - protein, 18 aa, Mycobacterium
VRGHLIKYANALETSGQR

SEQ ID NO: 1284274 - protein, 25 aa, Mycobacterium
VRGMLEVRIPLVGGQIERFVADLIA

SEQ ID NO: 1284275 - protein, 18 aa, Mycobacterium
VRGPERIALTGPNGAGKT

SEQ ID NO: 1284276 - protein, 28 aa, Mycobacterium
VRGPRWGVPLKIMYALGFAGDLAAAMLR

SEQ ID NO: 1284277 - protein, 25 aa, Mycobacterium
VRGRRPEVVDSQGWRAIDAAEIARG

SEQ ID NO: 1284278 - protein, 17 aa, Mycobacterium
VRGTRLAIHKTLDLPLL

SEQ ID NO: 1284279 - protein, 17 aa, Mycobacterium
VRGVFYAGWDPAAVPIK

SEQ ID NO: 1284280 - protein, 17 aa, Mycobacterium
VRHCLKSDVVLAAALCS

SEQ ID NO: 1284281 - protein, 24 aa, Mycobacterium
VRHLEMLSTFLRWREGTRGELTEV

SEQ ID NO: 1284282 - protein, 19 aa, Mycobacterium
VRHLMVSKVRGTFDDYSGT

SEQ ID NO: 1284283 - protein, 21 aa, Mycobacterium
VRIAEHTGRGSIPRADVAAVL

SEQ ID NO: 1284284 - protein, 20 aa, Mycobacterium
VRIAFGGRIDGFADYESTLA

SEQ ID NO: 1284285 - protein, 19 aa, Mycobacterium
VRIDRFEVLEVRRDGELVD

SEQ ID NO: 1284286 - protein, 17 aa, Mycobacterium
VRIEGRYTPAPAGTGRI

SEQ ID NO: 1284287 - protein, 21 aa, Mycobacterium
VRIHGGYGYSTEFDVERYFRD

SEQ ID NO: 1284288 - protein, 25 aa, Mycobacterium
VRIHHPRSGIPVAVVELPITEVEVV

SEQ ID NO: 1284289 - protein, 19 aa, Mycobacterium
VRIKNRVEYDFDLPPIQLT

SEQ ID NO: 1284290 - protein, 33 aa, Mycobacterium
VRIPEIPEWSSGEWTDWKWNTLLIEGSNCREII

SEQ ID NO: 1284291 - protein, 29 aa, Mycobacterium
VRKALNLRPAPEFEAWLARLGMADGDGRV

SEQ ID NO: 1284292 - protein, 18 aa, Mycobacterium
VRKSRLMTWRGGYHGDTF

SEQ ID NO: 1284293 - protein, 19 aa, Mycobacterium
VRLAETWLDGVTPLPAGTT

SEQ ID NO: 1284294 - protein, 21 aa, Mycobacterium
VRLALHLGRRQRLSGAPGYLA

SEQ ID NO: 1284295 - protein, 24 aa, Mycobacterium
VRLALSVDVPPGWVSQPDHLRHGA

SEQ ID NO: 1284296 - protein, 19 aa, Mycobacterium
VRLCRVVGDGRWWRRWAAR

SEQ ID NO: 1284297 - protein, 32 aa, Mycobacterium
VRLGFDGRAGVLARRLAMLDARTFAEHPDAAV

SEQ ID NO: 1284298 - protein, 25 aa, Mycobacterium
VRLGGPRLKDVAGLSLTKLFVGSEG

SEQ ID NO: 1284299 - protein, 19 aa, Mycobacterium
VRLGNHVRLSAPLDTVLTL

SEQ ID NO: 1284300 - protein, 27 aa, Mycobacterium
VRLHPEAIAALGIREWDAVSLTGARTT

SEQ ID NO: 1284301 - protein, 18 aa, Mycobacterium
VRLISAMAAAGVRRQDRI

SEQ ID NO: 1284302 - protein, 21 aa, Mycobacterium
VRLKGAEAMREAWVQDGVDPT

SEQ ID NO: 1284303 - protein, 20 aa, Mycobacterium
VRLKGGDPFVFARGYEEVIA

SEQ ID NO: 1284304 - protein, 22 aa, Mycobacterium
VRLLKCGPWHNGGWDPIPDRES

SEQ ID NO: 1284305 - protein, 18 aa, Mycobacterium
VRLLRPGGAIVVHRAALG

SEQ ID NO: 1284306 - protein, 17 aa, Mycobacterium
VRLLTIDPESEWRDLWG

SEQ ID NO: 1284307 - protein, 22 aa, Mycobacterium
VRLLVGHSFGGAAVIAAAHGCS

SEQ ID NO: 1284308 - protein, 31 aa, Mycobacterium
VRLMRPGRGPRRYVCGGVMLTFDEMIDALEA

SEQ ID NO: 1284309 - protein, 19 aa, Mycobacterium
VRLNGRWHRGTAHLLPEDD

SEQ ID NO: 1284310 - protein, 17 aa, Mycobacterium
VRLPFAHPVDDVTGLSQ

SEQ ID NO: 1284311 - protein, 17 aa, Mycobacterium
VRLRDAAQWSRIRLADR

SEQ ID NO: 1284312 - protein, 17 aa, Mycobacterium
VRLRGIEPAWLREGLRF

SEQ ID NO: 1284313 - protein, 17 aa, Mycobacterium
VRLRTPVPPGRARDIQV

SEQ ID NO: 1284314 - protein, 25 aa, Mycobacterium
VRLSADGDLSWVLGNLGAIPAVTLD

SEQ ID NO: 1284315 - protein, 17 aa, Mycobacterium
VRLSEALGPGWAELDGE

SEQ ID NO: 1284316 - protein, 29 aa, Mycobacterium
VRLSPEAQRVIARYSWPRNISQLREALVH

SEQ ID NO: 1284317 - protein, 24 aa, Mycobacterium
VRLYRPFPTAAFLESLPATVRAVG

SEQ ID NO: 1284318 - protein, 19 aa, Mycobacterium
VRMAAWRAIRDAVVAGDDD

SEQ ID NO: 1284319 - protein, 20 aa, Mycobacterium
VRNGNRWRVAGIDEKTNRVA

SEQ ID NO: 1284320 - protein, 19 aa, Mycobacterium
VRNRFTFDCAEWDVASEEL

SEQ ID NO: 1284321 - protein, 18 aa, Mycobacterium
VRNTQPWRWHVDQRGVQL

SEQ ID NO: 1284322 - protein, 19 aa, Mycobacterium
VRPDARLAERAGIHTQGGR

SEQ ID NO: 1284323 - protein, 20 aa, Mycobacterium
VRPFRPFQVNADMLAHADSE

SEQ ID NO: 1284324 - protein, 26 aa, Mycobacterium
VRPGTDAWCLAALAGVLVQEKLCDET

SEQ ID NO: 1284325 - protein, 20 aa, Mycobacterium
VRPGVDVLFLDTGYHFVETI

SEQ ID NO: 1284326 - protein, 22 aa, Mycobacterium
VRPHSPLARAAREVLAVLSQSP

SEQ ID NO: 1284327 - protein, 19 aa, Mycobacterium
VRPLPGLDGRFVKRLFDSH

SEQ ID NO: 1284328 - protein, 18 aa, Mycobacterium
VRPLSRVRIWDGSTPWLI

SEQ ID NO: 1284329 - protein, 19 aa, Mycobacterium
VRPPLVLQESYEFRVTGEG

SEQ ID NO: 1284330 - protein, 19 aa, Mycobacterium
VRPQFRRRGLARKLLSTLA

SEQ ID NO: 1284331 - protein, 19 aa, Mycobacterium
VRPSPPPRRREHSAVATRA

SEQ ID NO: 1284332 - protein, 23 aa, Mycobacterium
VRQALRMRPDRIVIGEVRGAEVV

SEQ ID NO: 1284333 - protein, 17 aa, Mycobacterium
VRQGGRWRLHGRLRVGT

SEQ ID NO: 1284334 - protein, 23 aa, Mycobacterium
VRQLFTVRIGLRLTEATQTTMVL

SEQ ID NO: 1284335 - protein, 28 aa, Mycobacterium
VRQLRLRDIGGIVVIDFIDMVLESNRDL

SEQ ID NO: 1284336 - protein, 17 aa, Mycobacterium
VRRASRMLVAGAALCVP

SEQ ID NO: 1284337 - protein, 18 aa, Mycobacterium
VRRHCRDGVAVAVSTRVA

SEQ ID NO: 1284338 - protein, 32 aa, Mycobacterium
VRRHRRTVYVPARLRPVSWAYGLLPGAARTQV

SEQ ID NO: 1284339 - protein, 18 aa, Mycobacterium
VRRIVKEQLIDHVFRSIG

SEQ ID NO: 1284340 - protein, 26 aa, Mycobacterium
VRRLGHVPLAIAMAASYFRNADEDVA

SEQ ID NO: 1284341 - protein, 23 aa, Mycobacterium
VRRLHERGAELLRCPVSEIMTSV

SEQ ID NO: 1284342 - protein, 21 aa, Mycobacterium
VRRLQELGVIRGFYTDINPSA

SEQ ID NO: 1284343 - protein, 17 aa, Mycobacterium
VRRMRRLTLSFHVTVAN

SEQ ID NO: 1284344 - protein, 20 aa, Mycobacterium
VRRNGCDVLDGIDLTVRGPE

SEQ ID NO: 1284345 - protein, 20 aa, Mycobacterium
VRRPTRRGADLTAGLDVTVV

SEQ ID NO: 1284346 - protein, 23 aa, Mycobacterium
VRRRLPALVLDAGHEPRVHRPLV

SEQ ID NO: 1284347 - protein, 21 aa, Mycobacterium
VRRVKGGWVATGRPWAYDEQR

SEQ ID NO: 1284348 - protein, 31 aa, Mycobacterium
VRRVLDAGSVSGEFADLLGLAGSQASVVTGA

SEQ ID NO: 1284349 - protein, 27 aa, Mycobacterium
VRRVLLRPRYAALVVHQGKVVGPGSWT

SEQ ID NO: 1284350 - protein, 18 aa, Mycobacterium
VRRYGMVSPTVFWPIPRV

SEQ ID NO: 1284351 - protein, 18 aa, Mycobacterium
VRSAAAWADGLAGITMDL

SEQ ID NO: 1284352 - protein, 20 aa, Mycobacterium
VRSAELWLYHSGGPLQLEVG

SEQ ID NO: 1284353 - protein, 29 aa, Mycobacterium
VRSAVPAWPVGPSVRIYPLLKELTLDIAT

SEQ ID NO: 1284354 - protein, 19 aa, Mycobacterium
VRSEGAGVVVLKRLTDALR

SEQ ID NO: 1284355 - protein, 19 aa, Mycobacterium
VRSLVLICGGGEIQRNEHV

SEQ ID NO: 1284356 - protein, 19 aa, Mycobacterium
VRSLVWIQGRLRDVPIGEV

SEQ ID NO: 1284357 - protein, 23 aa, Mycobacterium
VRSRLERCDAHGRALVEALAVLG

SEQ ID NO: 1284358 - protein, 20 aa, Mycobacterium
VRSRRPGETASIFLPSVPNL

SEQ ID NO: 1284359 - protein, 30 aa, Mycobacterium
VRSTGRPFATFRPGQYVSVGVTLPDGARQL

SEQ ID NO: 1284360 - protein, 18 aa, Mycobacterium
VRSTVIPVAHWRYEISPT

SEQ ID NO: 1284361 - protein, 28 aa, Mycobacterium
VRSYAFDLLRWFRFLHDRLISWERAERV

SEQ ID NO: 1284362 - protein, 24 aa, Mycobacterium
VRSYKLRGAYNLLMQLSAEEKAAG

SEQ ID NO: 1284363 - protein, 17 aa, Mycobacterium
VRTELRRAQGMGFDIGI

SEQ ID NO: 1284364 - protein, 24 aa, Mycobacterium
VRTFARRRIDTILSGVAQGADGVE

SEQ ID NO: 1284365 - protein, 18 aa, Mycobacterium
VRTGRLDLAIASVGSGEV

SEQ ID NO: 1284366 - protein, 19 aa, Mycobacterium
VRTGSFGVNGGMFYGADAP

SEQ ID NO: 1284367 - protein, 20 aa, Mycobacterium
VRTLKLLWRTPGEARTSRGP

SEQ ID NO: 1284368 - protein, 18 aa, Mycobacterium
VRTPLPVQLPEPMAAQLA

SEQ ID NO: 1284369 - protein, 21 aa, Mycobacterium
VRTPSGFDIEYGWDAVTVDEE

SEQ ID NO: 1284370 - protein, 22 aa, Mycobacterium
VRTRLIELFDLFDPADPEVVAG

SEQ ID NO: 1284371 - protein, 23 aa, Mycobacterium
VRTRWERRLAEIGVAALHHELAD

SEQ ID NO: 1284372 - protein, 18 aa, Mycobacterium
VRTWIWKTMTSFPGSYMT

SEQ ID NO: 1284373 - protein, 18 aa, Mycobacterium
VRVADEIDFWLWLDAGFE

SEQ ID NO: 1284374 - protein, 26 aa, Mycobacterium
VRVDGRPGQQFALLFVAWLNANPAVR

SEQ ID NO: 1284375 - protein, 17 aa, Mycobacterium
VRVEVPPGWRVDVTEMP

SEQ ID NO: 1284376 - protein, 17 aa, Mycobacterium
VRVEVVVDDAAVDKVVD

SEQ ID NO: 1284377 - protein, 19 aa, Mycobacterium
VRVGAKLRARAEITAVAQL

SEQ ID NO: 1284378 - protein, 24 aa, Mycobacterium
VRVGKSRLIFWMVREAADGRRDEE

SEQ ID NO: 1284379 - protein, 19 aa, Mycobacterium
VRVIPKQADEFTCSSCFLV

SEQ ID NO: 1284380 - protein, 22 aa, Mycobacterium
VRVLRQRLGIHPVFKTVDTCAA

SEQ ID NO: 1284381 - protein, 18 aa, Mycobacterium
VRVLVVGTPEWKELTGRA

SEQ ID NO: 1284382 - protein, 17 aa, Mycobacterium
VRVPVFTGHSLSINAEF

SEQ ID NO: 1284383 - protein, 24 aa, Mycobacterium
VRVRKGELIRVWHGVYAATEPDYL

SEQ ID NO: 1284384 - protein, 19 aa, Mycobacterium
VRVSCGFGGPMDETPMMLL

SEQ ID NO: 1284385 - protein, 18 aa, Mycobacterium
VRVSSLPYLVPVVEHGDQ

SEQ ID NO: 1284386 - protein, 23 aa, Mycobacterium
VRVTRPGGTIGLINWTPEGFIGN

SEQ ID NO: 1284387 - protein, 29 aa, Mycobacterium
VRWANRVAPRLARQWLLPVCAETWDGYLN

SEQ ID NO: 1284388 - protein, 18 aa, Mycobacterium
VRWRSGRRWSPSFRFPEG

SEQ ID NO: 1284389 - protein, 22 aa, Mycobacterium
VRYENAPTWLVSVMGKSGLFQD

SEQ ID NO: 1284390 - protein, 17 aa, Mycobacterium
VRYFPSLLPQLSDEDPV

SEQ ID NO: 1284391 - protein, 18 aa, Mycobacterium
VRYPELWRENGGFDADGV

SEQ ID NO: 1284392 - protein, 17 aa, Mycobacterium
VRYPWGEIVTGRRHRNV

SEQ ID NO: 1284393 - protein, 24 aa, Mycobacterium
VRYPYARGVLVEMYREAKARLGDP

SEQ ID NO: 1284394 - protein, 17 aa, Mycobacterium
VRYRIRRVEKLLSTSLE

SEQ ID NO: 1284395 - protein, 25 aa, Mycobacterium
VRYTGVSNFSGWQLMKSLAVADDAH

SEQ ID NO: 1284396 - protein, 17 aa, Mycobacterium
VRYTMPFPESSTHPVDD

SEQ ID NO: 1284397 - protein, 18 aa, Mycobacterium
VSAADVRTLLPAGVGTVS

SEQ ID NO: 1284398 - protein, 24 aa, Mycobacterium
VSAAELAGGFGYTIARPSAGHIEE

SEQ ID NO: 1284399 - protein, 21 aa, Mycobacterium
VSAALERWGRIDFLVNNAGIG

SEQ ID NO: 1284400 - protein, 19 aa, Mycobacterium
VSAATRLADTGQRLQDGLS

SEQ ID NO: 1284401 - protein, 20 aa, Mycobacterium
VSACTGSPGCERSVADVRAD

SEQ ID NO: 1284402 - protein, 21 aa, Mycobacterium
VSADAFCWSMVRSLVGALIAV

SEQ ID NO: 1284403 - protein, 25 aa, Mycobacterium
VSADLTWRGLYPAALERPHEMLTER

SEQ ID NO: 1284404 - protein, 25 aa, Mycobacterium
VSADVALTRGWCLRELGDPDAALAA

SEQ ID NO: 1284405 - protein, 23 aa, Mycobacterium
VSAEMSLRYGRLFDATVRTEYER

SEQ ID NO: 1284406 - protein, 17 aa, Mycobacterium
VSAESAAIWARLADFGS

SEQ ID NO: 1284407 - protein, 24 aa, Mycobacterium
VSAESLGGGWFWPAAAAHPSLPRG

SEQ ID NO: 1284408 - protein, 17 aa, Mycobacterium
VSAHVACLRDCGLVTGR

SEQ ID NO: 1284409 - protein, 17 aa, Mycobacterium
VSAHVGCLRDCGLVIGR

SEQ ID NO: 1284410 - protein, 21 aa, Mycobacterium
VSAKQLATVSVWRDTELFDER

SEQ ID NO: 1284411 - protein, 20 aa, Mycobacterium
VSALKALEGDEKWVKSVEEL

SEQ ID NO: 1284412 - protein, 25 aa, Mycobacterium
VSALLADPAVPVFALTTGPRWPDVS

SEQ ID NO: 1284413 - protein, 17 aa, Mycobacterium
VSALLRYGTTDRVLLSG

SEQ ID NO: 1284414 - protein, 23 aa, Mycobacterium
VSALLVRAAERCAPRDDVRLSRV

SEQ ID NO: 1284415 - protein, 25 aa, Mycobacterium
VSALNRLHFTLGLPTLLIWGDQDRL

SEQ ID NO: 1284416 - protein, 24 aa, Mycobacterium
VSALRRPVAMMARMTLRKAPARVV

SEQ ID NO: 1284417 - protein, 17 aa, Mycobacterium
VSAPRFTVFPGSDADVV

SEQ ID NO: 1284418 - protein, 17 aa, Mycobacterium
VSARAFALLRAKPLRPD

SEQ ID NO: 1284419 - protein, 20 aa, Mycobacterium
VSARELLPERALLGDATAGA

SEQ ID NO: 1284420 - protein, 17 aa, Mycobacterium
VSASLARDVRAAAREFF

SEQ ID NO: 1284421 - protein, 29 aa, Mycobacterium
VSCDVGMGFSWARPTSFARPVVTLPNDVL

SEQ ID NO: 1284422 - protein, 23 aa, Mycobacterium
VSCGHVARSQWCVIVDENGDELQ

SEQ ID NO: 1284423 - protein, 17 aa, Mycobacterium
VSDEAKFITGVAWPLDA

SEQ ID NO: 1284424 - protein, 17 aa, Mycobacterium
VSDMFSGRPLATVDDLH

SEQ ID NO: 1284425 - protein, 21 aa, Mycobacterium
VSDMFYSIWWPKLPGETSDVP

SEQ ID NO: 1284426 - protein, 23 aa, Mycobacterium
VSDPGCLGAIYGAEAPVYADSGW

SEQ ID NO: 1284427 - protein, 18 aa, Mycobacterium
VSDPPPYRQSQIFRGPRH

SEQ ID NO: 1284428 - protein, 24 aa, Mycobacterium
VSDPRPGESVSYWHSDQLRRRLSD

SEQ ID NO: 1284429 - protein, 20 aa, Mycobacterium
VSDPSGLFLDQRPKPVSGTA

SEQ ID NO: 1284430 - protein, 23 aa, Mycobacterium
VSDRLFDALIAWGDEDAVRRRVQ

SEQ ID NO: 1284431 - protein, 25 aa, Mycobacterium
VSDWPRLADGLLQLSVQALEYPRGD

SEQ ID NO: 1284432 - protein, 17 aa, Mycobacterium
VSDWTNAWVPAKDGHQP

SEQ ID NO: 1284433 - protein, 23 aa, Mycobacterium
VSEAFAHPVVVGFDEGRWTARAK

SEQ ID NO: 1284434 - protein, 22 aa, Mycobacterium
VSEAGNAYWGRHGAAGLLLRAP

SEQ ID NO: 1284435 - protein, 23 aa, Mycobacterium
VSEDEFDAIYGRIREWGLQHWAD

SEQ ID NO: 1284436 - protein, 17 aa, Mycobacterium
VSEEFARRHGLRVEVAI

SEQ ID NO: 1284437 - protein, 23 aa, Mycobacterium
VSEFGVPVVPGISRPGLTDQDLI

SEQ ID NO: 1284438 - protein, 21 aa, Mycobacterium
VSEGTWWKHLPIFNQEDPGAF

SEQ ID NO: 1284439 - protein, 24 aa, Mycobacterium
VSEPADYLPLFVAPQPVRFDEHDH

SEQ ID NO: 1284440 - protein, 17 aa, Mycobacterium
VSFPDSPVPLGLPSFHS

SEQ ID NO: 1284441 - protein, 22 aa, Mycobacterium
VSGDWYVGLGVASATYPAMQMP

SEQ ID NO: 1284442 - protein, 25 aa, Mycobacterium
VSGEAVASWAVYRPGRGWAPHDPGV

SEQ ID NO: 1284443 - protein, 20 aa, Mycobacterium
VSGENVFFCATGVTDGDLLK

SEQ ID NO: 1284444 - protein, 24 aa, Mycobacterium
VSGGAAFFLCRRASRLSSHSAQWA

SEQ ID NO: 1284445 - protein, 18 aa, Mycobacterium
VSGGIVWIPAHPRSGDGE

SEQ ID NO: 1284446 - protein, 23 aa, Mycobacterium
VSGKPHPFHLYSMQQAIEEGFIL

SEQ ID NO: 1284447 - protein, 18 aa, Mycobacterium
VSGPLTWAARIGGDGNPN

SEQ ID NO: 1284448 - protein, 21 aa, Mycobacterium
VSGPPWRLRATSVVDGVQRTV

SEQ ID NO: 1284449 - protein, 18 aa, Mycobacterium
VSGQKVWTSDAVNCQRGL

SEQ ID NO: 1284450 - protein, 23 aa, Mycobacterium
VSGREGTTVFSLGNFVFNSPGRY

SEQ ID NO: 1284451 - protein, 21 aa, Mycobacterium
VSGRRALYLTGEESAGQVRLR

SEQ ID NO: 1284452 - protein, 17 aa, Mycobacterium
VSGTPVQIGARLRERVR

SEQ ID NO: 1284453 - protein, 19 aa, Mycobacterium
VSGVRWKAPLHRTCVLLIY

SEQ ID NO: 1284454 - protein, 18 aa, Mycobacterium
VSHAGIYIGEGMMVHAST

SEQ ID NO: 1284455 - protein, 24 aa, Mycobacterium
VSHGCPNLSPANAQWFYDNFGSGD

SEQ ID NO: 1284456 - protein, 17 aa, Mycobacterium
VSHIISWLSTLDAVQKV

SEQ ID NO: 1284457 - protein, 30 aa, Mycobacterium
VSHMGTSAPGGWRANICRVPPNLANTNVVE

SEQ ID NO: 1284458 - protein, 23 aa, Mycobacterium
VSHWPEVIATLGHATAGRVQAWA

SEQ ID NO: 1284459 - protein, 19 aa, Mycobacterium
VSISARLARGVVHQLKPHD

SEQ ID NO: 1284460 - protein, 18 aa, Mycobacterium
VSIYVDYENGLVIARQNP

SEQ ID NO: 1284461 - protein, 25 aa, Mycobacterium
VSKAGEAWDRLATVYQTTTVAEGLG

SEQ ID NO: 1284462 - protein, 21 aa, Mycobacterium
VSKLLWANWHRELGEIAMDVQ

SEQ ID NO: 1284463 - protein, 20 aa, Mycobacterium
VSKLPRCYAAIIEISKGRRY

SEQ ID NO: 1284464 - protein, 26 aa, Mycobacterium
VSLELPKRRLTVFTGVSGSGKSSLVF

SEQ ID NO: 1284465 - protein, 22 aa, Mycobacterium
VSLGKRKGKIVVEFGSVDDLQR

SEQ ID NO: 1284466 - protein, 21 aa, Mycobacterium
VSLLGSGLWALGHTVALTNHL

SEQ ID NO: 1284467 - protein, 35 aa, Mycobacterium
VSLNLRPETQLALAKWGMLSPHGKCFAFDSRADGF

SEQ ID NO: 1284468 - protein, 19 aa, Mycobacterium
VSLPHGWGHGVPGTRLDLA

SEQ ID NO: 1284469 - protein, 25 aa, Mycobacterium
VSLRRFSQRPGEVLVLGQVIETRVR

SEQ ID NO: 1284470 - protein, 19 aa, Mycobacterium
VSLTKLWFSVTASEQRTRF

SEQ ID NO: 1284471 - protein, 23 aa, Mycobacterium
VSLVGPRARNMWVSTFHSTCVRI

SEQ ID NO: 1284472 - protein, 19 aa, Mycobacterium
VSMAAQWWLDVREPKKEVV

SEQ ID NO: 1284473 - protein, 17 aa, Mycobacterium
VSMLGEFGDDAKILAGG

SEQ ID NO: 1284474 - protein, 19 aa, Mycobacterium
VSMLPARYLNRLSDLLFIL

SEQ ID NO: 1284475 - protein, 21 aa, Mycobacterium
VSMQTPPGWHPYQNSNLAPGT

SEQ ID NO: 1284476 - protein, 18 aa, Mycobacterium
VSNAILFLLSDAGRSFTG

SEQ ID NO: 1284477 - protein, 25 aa, Mycobacterium
VSNALCAAAVALECGATPEQVAAAL

SEQ ID NO: 1284478 - protein, 21 aa, Mycobacterium
VSNTFYEWVLGPSMTYTCACY

SEQ ID NO: 1284479 - protein, 19 aa, Mycobacterium
VSNVPGPREPLYFNGSRLE

SEQ ID NO: 1284480 - protein, 29 aa, Mycobacterium
VSPAEQRTRFAIRLVDPLRHWKFSDMDIE

SEQ ID NO: 1284481 - protein, 19 aa, Mycobacterium
VSPALAIERVIDLALREVP

SEQ ID NO: 1284482 - protein, 18 aa, Mycobacterium
VSPETWQALSAHLTKPQL

SEQ ID NO: 1284483 - protein, 18 aa, Mycobacterium
VSPLAVARHAWRPRWLKW

SEQ ID NO: 1284484 - protein, 31 aa, Mycobacterium
VSPLSRHGRFVGRVGGLAVALGIGIAIANSP

SEQ ID NO: 1284485 - protein, 24 aa, Mycobacterium
VSPNNPFGLLAHVGRDAAGAVQIL

SEQ ID NO: 1284486 - protein, 18 aa, Mycobacterium
VSPRKVLLAVSEYMLKAN

SEQ ID NO: 1284487 - protein, 18 aa, Mycobacterium
VSQLRAAYEKVYTDEPFV

SEQ ID NO: 1284488 - protein, 24 aa, Mycobacterium
VSRAFTPRRVAGLQGAITQMAAEL

SEQ ID NO: 1284489 - protein, 24 aa, Mycobacterium
VSRAFTPRRVAGLQGTITQMAAEL

SEQ ID NO: 1284490 - protein, 18 aa, Mycobacterium
VSRAGDWFGSPVNLASRV

SEQ ID NO: 1284491 - protein, 26 aa, Mycobacterium
VSRCGNEPMILLIGSLELIWSAHESS

SEQ ID NO: 1284492 - protein, 29 aa, Mycobacterium
VSRGQEVVEFACGIPHLLKGGFTENASTK

SEQ ID NO: 1284493 - protein, 18 aa, Mycobacterium
VSRIIRFSGVDGVRPGGV

SEQ ID NO: 1284494 - protein, 23 aa, Mycobacterium
VSSARPRTLIIGADLAPAGAAAI

SEQ ID NO: 1284495 - protein, 22 aa, Mycobacterium
VSSIFLMCLAHEVLAYGDCAIV

SEQ ID NO: 1284496 - protein, 18 aa, Mycobacterium
VSSLGFGMVGGRRILAQG

SEQ ID NO: 1284497 - protein, 17 aa, Mycobacterium
VSTALFAVLHLTREGGA

SEQ ID NO: 1284498 - protein, 24 aa, Mycobacterium
VSTAWKAASSFRISDMRGGANGGR

SEQ ID NO: 1284499 - protein, 20 aa, Mycobacterium
VSTPDGWEVSGVSPVVLGLR

SEQ ID NO: 1284500 - protein, 19 aa, Mycobacterium
VSTRGILEFEIGLPSPESV

SEQ ID NO: 1284501 - protein, 25 aa, Mycobacterium
VSTYHAFAGMLLRDHGLLLPIEPET

SEQ ID NO: 1284502 - protein, 24 aa, Mycobacterium
VSTYLFERARVGMVVGLDSVAGDF

SEQ ID NO: 1284503 - protein, 20 aa, Mycobacterium
VSVADRLDTGYVWINGSGSH

SEQ ID NO: 1284504 - protein, 29 aa, Mycobacterium
VSVDGVVCVGVLVSVDLVGGVVRSGIELP

SEQ ID NO: 1284505 - protein, 23 aa, Mycobacterium
VSVFLDKDFRFVVSSEADARAFV

SEQ ID NO: 1284506 - protein, 18 aa, Mycobacterium
VSVGRLRNCMAELDSRDP

SEQ ID NO: 1284507 - protein, 20 aa, Mycobacterium
VSVGYPREWRRRKPYRWLRQ

SEQ ID NO: 1284508 - protein, 20 aa, Mycobacterium
VSVGYPREWRRRRPYRWLRQ

SEQ ID NO: 1284509 - protein, 26 aa, Mycobacterium
VSVHAFNLWLDEDWGFNRPDHRILAA

SEQ ID NO: 1284510 - protein, 19 aa, Mycobacterium
VSVLCVSKDLPFAQKRFCG

SEQ ID NO: 1284511 - protein, 23 aa, Mycobacterium
VSVPDFWAADLPRSFIVCEQDRS

SEQ ID NO: 1284512 - protein, 21 aa, Mycobacterium
VSVPPPLRFTAQAAQMLPPRG

SEQ ID NO: 1284513 - protein, 18 aa, Mycobacterium
VSVRYCRGAPVPVPESLR

SEQ ID NO: 1284514 - protein, 30 aa, Mycobacterium
VSVTLSVPLSDIWIDIRFTLPAATVDGGAP

SEQ ID NO: 1284515 - protein, 20 aa, Mycobacterium
VSVTMPGKFAALRVADEATD

SEQ ID NO: 1284516 - protein, 32 aa, Mycobacterium
VSWPARDIPSLGWRAYRRCPGAAGSWQPVDGV

SEQ ID NO: 1284517 - protein, 19 aa, Mycobacterium
VSWPDSGPLIGADAQGTLY

SEQ ID NO: 1284518 - protein, 20 aa, Mycobacterium
VSWREEWRAPFEPLLDEVMF

SEQ ID NO: 1284519 - protein, 19 aa, Mycobacterium
VSYDASWSGQRFMVQDTGG

SEQ ID NO: 1284520 - protein, 26 aa, Mycobacterium
VSYGCSLGHTAHWPGTLSLSVSTMTA

SEQ ID NO: 1284521 - protein, 21 aa, Mycobacterium
VSYRPVELRAYLEQAKVERRS

SEQ ID NO: 1284522 - protein, 18 aa, Mycobacterium
VTAASAWEIAVKTRLGRL

SEQ ID NO: 1284523 - protein, 18 aa, Mycobacterium
VTAECMASGCPREPEFEM

SEQ ID NO: 1284524 - protein, 23 aa, Mycobacterium
VTAEDLARLWAINVDGVLWGIQA

SEQ ID NO: 1284525 - protein, 19 aa, Mycobacterium
VTAGLPFLLRPALTAVGDG

SEQ ID NO: 1284526 - protein, 20 aa, Mycobacterium
VTAGSALEVYVLRPCIVAGP

SEQ ID NO: 1284527 - protein, 23 aa, Mycobacterium
VTAGSRASHIVVWATLDKSKGRA

SEQ ID NO: 1284528 - protein, 22 aa, Mycobacterium
VTAGWLRASLRTVDEAASRAGA

SEQ ID NO: 1284529 - protein, 25 aa, Mycobacterium
VTAKLRAAGIPILGKTNMDEFAMGS

SEQ ID NO: 1284530 - protein, 25 aa, Mycobacterium
VTALARRIGADLVVIGPEVPLVLGV

SEQ ID NO: 1284531 - protein, 23 aa, Mycobacterium
VTALCAEAGFVPLGRHEVEETST

SEQ ID NO: 1284532 - protein, 21 aa, Mycobacterium
VTANWARRDFPAIAADVRVPV

SEQ ID NO: 1284533 - protein, 17 aa, Mycobacterium
VTAPRLAVLSALEQAPH

SEQ ID NO: 1284534 - protein, 17 aa, Mycobacterium
VTARGGRQGIWRDEESE

SEQ ID NO: 1284535 - protein, 17 aa, Mycobacterium
VTASRIGERLGLSAAGV

SEQ ID NO: 1284536 - protein, 19 aa, Mycobacterium
VTCGACGARVLARKSSWEQ

SEQ ID NO: 1284537 - protein, 25 aa, Mycobacterium
VTCMSSSLPTLFRRAADYQRQITLT

SEQ ID NO: 1284538 - protein, 25 aa, Mycobacterium
VTDARRREVYWARYRDGLRVDGPAV

SEQ ID NO: 1284539 - protein, 18 aa, Mycobacterium
VTDGWSFRVLLGDLGRTY

SEQ ID NO: 1284540 - protein, 19 aa, Mycobacterium
VTDLIKPFVSILCPECDPE

SEQ ID NO: 1284541 - protein, 19 aa, Mycobacterium
VTDLVSLVRYATGVEDELV

SEQ ID NO: 1284542 - protein, 23 aa, Mycobacterium
VTDMAHFFYIHFGLPTYFKNVFE

SEQ ID NO: 1284543 - protein, 22 aa, Mycobacterium
VTDRFDAVIADALFLGTLPLLL

SEQ ID NO: 1284544 - protein, 19 aa, Mycobacterium
VTDSGRLEITWHGETVVDV

SEQ ID NO: 1284545 - protein, 18 aa, Mycobacterium
VTDVHGRTGVAGLFAAGE

SEQ ID NO: 1284546 - protein, 21 aa, Mycobacterium
VTDWGRLVFCGSPRRYEPRWF

SEQ ID NO: 1284547 - protein, 24 aa, Mycobacterium
VTEAGGTLGLRVGPRGEVWPLKHW

SEQ ID NO: 1284548 - protein, 18 aa, Mycobacterium
VTEALPGVPVVIYDNPAA

SEQ ID NO: 1284549 - protein, 17 aa, Mycobacterium
VTEALVIGAEQPDGGYW

SEQ ID NO: 1284550 - protein, 17 aa, Mycobacterium
VTECAVFLGAEDMTLRA

SEQ ID NO: 1284551 - protein, 25 aa, Mycobacterium
VTECLKRIGDCLQIYRDIEAGLRPD

SEQ ID NO: 1284552 - protein, 23 aa, Mycobacterium
VTEDKWWERSPIFSGLNTNKRGI

SEQ ID NO: 1284553 - protein, 20 aa, Mycobacterium
VTEECRPQWATLAEADKKFR

SEQ ID NO: 1284554 - protein, 23 aa, Mycobacterium
VTEGTVTRWLKKVGDSVDVDEPL

SEQ ID NO: 1284555 - protein, 20 aa, Mycobacterium
VTEIFPGGRLPSIPMVEERA

SEQ ID NO: 1284556 - protein, 17 aa, Mycobacterium
VTELLYRYAELIDAGDF

SEQ ID NO: 1284557 - protein, 21 aa, Mycobacterium
VTEPRLWLLGSSMYSAQLAAA

SEQ ID NO: 1284558 - protein, 22 aa, Mycobacterium
VTESGHGLGHWVSDQRKKRRAG

SEQ ID NO: 1284559 - protein, 17 aa, Mycobacterium
VTETELIAFARERLAAY

SEQ ID NO: 1284560 - protein, 18 aa, Mycobacterium
VTETLEFGLVGAMVQASA

SEQ ID NO: 1284561 - protein, 28 aa, Mycobacterium
VTEYCWGAVWGRDGLPLKTRSMLNLAMI

SEQ ID NO: 1284562 - protein, 17 aa, Mycobacterium
VTFAEYVAHYGLAWNRR

SEQ ID NO: 1284563 - protein, 32 aa, Mycobacterium
VTFAQPYPAWREMFNDILPAHIVKDVPGGFGA

SEQ ID NO: 1284564 - protein, 18 aa, Mycobacterium
VTFASEFGAALSAADEVF

SEQ ID NO: 1284565 - protein, 27 aa, Mycobacterium
VTFDDVRDGWVWDSWAATACELGAALN

SEQ ID NO: 1284566 - protein, 24 aa, Mycobacterium
VTGANRWGKYLGLQAGELHLITHL

SEQ ID NO: 1284567 - protein, 19 aa, Mycobacterium
VTGEMFVALAGRVATAAVT

SEQ ID NO: 1284568 - protein, 17 aa, Mycobacterium
VTGFGYYSATKFALEGL

SEQ ID NO: 1284569 - protein, 25 aa, Mycobacterium
VTGFPPRIPLPYDVAGACVLLIDGL

SEQ ID NO: 1284570 - protein, 19 aa, Mycobacterium
VTGGRRWTYAELDREIDTV

SEQ ID NO: 1284571 - protein, 19 aa, Mycobacterium
VTGLGEVRSDLALLHALTD

SEQ ID NO: 1284572 - protein, 21 aa, Mycobacterium
VTGMTCSHCVAAVSAELGALA

SEQ ID NO: 1284573 - protein, 22 aa, Mycobacterium
VTGPFPGFPVPLVGDDVSGLIA

SEQ ID NO: 1284574 - protein, 23 aa, Mycobacterium
VTGPHRPHGWALAKGVDIERMTA

SEQ ID NO: 1284575 - protein, 17 aa, Mycobacterium
VTGSRAGWMAGTAALAF

SEQ ID NO: 1284576 - protein, 21 aa, Mycobacterium
VTGTLMLPLGVRLLSAHASMR

SEQ ID NO: 1284577 - protein, 19 aa, Mycobacterium
VTGVIHIAGFKYAGVSVQR

SEQ ID NO: 1284578 - protein, 18 aa, Mycobacterium
VTGWFMIGWSAEYEVGEV

SEQ ID NO: 1284579 - protein, 18 aa, Mycobacterium
VTGWRIHDVYRSCSAGSD

SEQ ID NO: 1284580 - protein, 28 aa, Mycobacterium
VTGYDILFFWVARMMMFGTFVGDDPAIT

SEQ ID NO: 1284581 - protein, 17 aa, Mycobacterium
VTHCAAYYQLLVKALLL

SEQ ID NO: 1284582 - protein, 21 aa, Mycobacterium
VTHGQFVPAMFVRMLKLPEAV

SEQ ID NO: 1284583 - protein, 23 aa, Mycobacterium
VTHIPCWLITDIRSFHRYVVAGH

SEQ ID NO: 1284584 - protein, 38 aa, Mycobacterium
VTICGTDLHILRGHVPTVDRGRILGHEAVGTVTAIGSG

SEQ ID NO: 1284585 - protein, 25 aa, Mycobacterium
VTILEEARIPFLREPFGEEITTIGL

SEQ ID NO: 1284586 - protein, 18 aa, Mycobacterium
VTKGSLYYHFRAREDLLR

SEQ ID NO: 1284587 - protein, 24 aa, Mycobacterium
VTKHAAVGFAEWLAITYGDDGIGV

SEQ ID NO: 1284588 - protein, 26 aa, Mycobacterium
VTKIERRGWHALLTLALNGDVDLPAN

SEQ ID NO: 1284589 - protein, 17 aa, Mycobacterium
VTKRFGNTLALDDVSLE

SEQ ID NO: 1284590 - protein, 18 aa, Mycobacterium
VTLACARLGWPVQDTEVI

SEQ ID NO: 1284591 - protein, 18 aa, Mycobacterium
VTLCKKPGKPVNFVPVID

SEQ ID NO: 1284592 - protein, 19 aa, Mycobacterium
VTLGARFVTVAARHADKAS

SEQ ID NO: 1284593 - protein, 26 aa, Mycobacterium
VTLGPRGRHVVLAKSWGGPTVTNDGV

SEQ ID NO: 1284594 - protein, 23 aa, Mycobacterium
VTLKRFSPGSAERFRDAAIAMTD

SEQ ID NO: 1284595 - protein, 24 aa, Mycobacterium
VTLLWDVLAAKGFEKNTYFYQVTR

SEQ ID NO: 1284596 - protein, 24 aa, Mycobacterium
VTLNEEYPRLKVYRGPRRKGVRYF

SEQ ID NO: 1284597 - protein, 23 aa, Mycobacterium
VTLPGAAIWHMAWSDKDDAIDWQ

SEQ ID NO: 1284598 - protein, 28 aa, Mycobacterium
VTLPGPHRVASLLKRWNAGTHHYRVERE

SEQ ID NO: 1284599 - protein, 26 aa, Mycobacterium
VTLPKGAEVRLCLGAINRDGADEHSG

SEQ ID NO: 1284600 - protein, 29 aa, Mycobacterium
VTLPNGRSGWRISIPAMMSYWSELARPVT

SEQ ID NO: 1284601 - protein, 19 aa, Mycobacterium
VTLRSALSLANRAPSVHNS

SEQ ID NO: 1284602 - protein, 24 aa, Mycobacterium
VTLSENGWKTFFRGLANDGVQGPS

SEQ ID NO: 1284603 - protein, 26 aa, Mycobacterium
VTLVDPRSNLPIEWVNEILSLTVRLR

SEQ ID NO: 1284604 - protein, 23 aa, Mycobacterium
VTMPNFAGLSPWRSPAGPVPAYP

SEQ ID NO: 1284605 - protein, 23 aa, Mycobacterium
VTNLEFAEFVAATGYVTAAERPV

SEQ ID NO: 1284606 - protein, 18 aa, Mycobacterium
VTNLPARIVDGLLNGRVD

SEQ ID NO: 1284607 - protein, 33 aa, Mycobacterium
VTNRARLNWWESRALYGWTVLVPRTKDQAGEMS

SEQ ID NO: 1284608 - protein, 17 aa, Mycobacterium
VTPDFAPYGKRIIRDPG

SEQ ID NO: 1284609 - protein, 24 aa, Mycobacterium
VTPDPFAEPGWFRTDDLGVIDDSG

SEQ ID NO: 1284610 - protein, 17 aa, Mycobacterium
VTPDPSPELLARWRSRP

SEQ ID NO: 1284611 - protein, 17 aa, Mycobacterium
VTPEQWLVGQFLDSLAD

SEQ ID NO: 1284612 - protein, 25 aa, Mycobacterium
VTPEVWPGKAYPLGATYDGFGTNFA

SEQ ID NO: 1284613 - protein, 21 aa, Mycobacterium
VTPGEVFGFLGPNGAGKSTTI

SEQ ID NO: 1284614 - protein, 24 aa, Mycobacterium
VTPLEMIDRALAIAARPDVIFCSF

SEQ ID NO: 1284615 - protein, 24 aa, Mycobacterium
VTPNRWFINGADFIALRKLKEAPT

SEQ ID NO: 1284616 - protein, 17 aa, Mycobacterium
VTPRHADGWLREPLEQA

SEQ ID NO: 1284617 - protein, 18 aa, Mycobacterium
VTPSIVFCADEFAPVVAD

SEQ ID NO: 1284618 - protein, 22 aa, Mycobacterium
VTPYRKGTVLAIGLAHGKTNWV

SEQ ID NO: 1284619 - protein, 19 aa, Mycobacterium
VTQYELWKAIWSSLNDGNF

SEQ ID NO: 1284620 - protein, 23 aa, Mycobacterium
VTRCATPLKWVRLDSAPFTDRLV

SEQ ID NO: 1284621 - protein, 19 aa, Mycobacterium
VTRDAKWKPFNLGNVLYNA

SEQ ID NO: 1284622 - protein, 22 aa, Mycobacterium
VTRFLVGGFMEVLRSWMEDPHA

SEQ ID NO: 1284623 - protein, 26 aa, Mycobacterium
VTRLRDDLCPDWPQPAQHGGSYRIEI

SEQ ID NO: 1284624 - protein, 25 aa, Mycobacterium
VTRRRHLLAQFLFRGDAVERPVRVL

SEQ ID NO: 1284625 - protein, 21 aa, Mycobacterium
VTRRTGVEWVAAYGTTELPVI

SEQ ID NO: 1284626 - protein, 22 aa, Mycobacterium
VTRRYWWHAWWWVPQAILRGGV

SEQ ID NO: 1284627 - protein, 20 aa, Mycobacterium
VTRWLPRPIHEGALLLDDAA

SEQ ID NO: 1284628 - protein, 27 aa, Mycobacterium
VTSCLRCGDLHRSDRDPAWPAVAAQLC

SEQ ID NO: 1284629 - protein, 33 aa, Mycobacterium
VTSDIALRFGRDMVGRLDVDWAAAGFDDADLDQ

SEQ ID NO: 1284630 - protein, 22 aa, Mycobacterium
VTSPEDCRRVVATATERNGGLD

SEQ ID NO: 1284631 - protein, 18 aa, Mycobacterium
VTSPRGRIVRTYVGGKGG

SEQ ID NO: 1284632 - protein, 24 aa, Mycobacterium
VTSWPEVFDGTGLQVRHYAGGGVR

SEQ ID NO: 1284633 - protein, 19 aa, Mycobacterium
VTTAEIFDRAGFIGTSAQT

SEQ ID NO: 1284634 - protein, 17 aa, Mycobacterium
VTTEAYLVYGVAHALPQ

SEQ ID NO: 1284635 - protein, 20 aa, Mycobacterium
VTTGLFLWQNMFGVWPTDGV

SEQ ID NO: 1284636 - protein, 18 aa, Mycobacterium
VTTQNAWFAARPSGTEDV

SEQ ID NO: 1284637 - protein, 22 aa, Mycobacterium
VTTRRVLLATGMEYCPPELPGL

SEQ ID NO: 1284638 - protein, 18 aa, Mycobacterium
VTTSWRLAAELTDVDIAH

SEQ ID NO: 1284639 - protein, 20 aa, Mycobacterium
VTVACGFSGHGFKFVPVVGE

SEQ ID NO: 1284640 - protein, 27 aa, Mycobacterium
VTVDEAWRPDTVWRHRLGSGLPAERVH

SEQ ID NO: 1284641 - protein, 25 aa, Mycobacterium
VTVDRGRWGCVLGRDPDRRVTAMRA

SEQ ID NO: 1284642 - protein, 18 aa, Mycobacterium
VTVEVAWNPEFLREGFAV

SEQ ID NO: 1284643 - protein, 18 aa, Mycobacterium
VTVGRIAYLLGLKGPAVA

SEQ ID NO: 1284644 - protein, 18 aa, Mycobacterium
VTVIERVGPWEALSREDS

SEQ ID NO: 1284645 - protein, 22 aa, Mycobacterium
VTVKVPTHWYNLAAELDEPIPP

SEQ ID NO: 1284646 - protein, 19 aa, Mycobacterium
VTVLNNWIRQGVVRRGLVV

SEQ ID NO: 1284647 - protein, 23 aa, Mycobacterium
VTVLRYAIRTEIRLITSELAIDL

SEQ ID NO: 1284648 - protein, 17 aa, Mycobacterium
VTVRGGVRIGVLDQADT

SEQ ID NO: 1284649 - protein, 29 aa, Mycobacterium
VTVRVGVDTWVLGRPGALNVDGATLNPPY

SEQ ID NO: 1284650 - protein, 18 aa, Mycobacterium
VTVTPEFGGAYKTWMDAE

SEQ ID NO: 1284651 - protein, 26 aa, Mycobacterium
VTVTWSLPSARAWWEMTWKARPDPAV

SEQ ID NO: 1284652 - protein, 17 aa, Mycobacterium
VTVTYRLGIAGFLDIAG

SEQ ID NO: 1284653 - protein, 24 aa, Mycobacterium
VTVVDPRWVLPVPEEIATLATRHK

SEQ ID NO: 1284654 - protein, 18 aa, Mycobacterium
VTVVEARCAEMCDAARDA

SEQ ID NO: 1284655 - protein, 23 aa, Mycobacterium
VVAALKFYGRRGWLDDPEGFFRP

SEQ ID NO: 1284656 - protein, 17 aa, Mycobacterium
VVAALPLSAAGKVLKRE

SEQ ID NO: 1284657 - protein, 18 aa, Mycobacterium
VVAAPWPDRVEDLPPPHD

SEQ ID NO: 1284658 - protein, 18 aa, Mycobacterium
VVAATFTLGGQRFIGING

SEQ ID NO: 1284659 - protein, 17 aa, Mycobacterium
VVACSGLDVLSHALESY

SEQ ID NO: 1284660 - protein, 23 aa, Mycobacterium
VVADPGGGFACMVRDPDGQLLEL

SEQ ID NO: 1284661 - protein, 18 aa, Mycobacterium
VVADTYLELAARLLTERQ

SEQ ID NO: 1284662 - protein, 23 aa, Mycobacterium
VVAEAPPWIGTLDVVILAGDDAG

SEQ ID NO: 1284663 - protein, 22 aa, Mycobacterium
VVAEVADRVVVMYAGQIVEDGT

SEQ ID NO: 1284664 - protein, 25 aa, Mycobacterium
VVAGGQHWSGFRPDRIAEVSKSHPL

SEQ ID NO: 1284665 - protein, 18 aa, Mycobacterium
VVAHGGFGVAQRIVQRDG

SEQ ID NO: 1284666 - protein, 18 aa, Mycobacterium
VVAINARIRVAAERHGFR

SEQ ID NO: 1284667 - protein, 18 aa, Mycobacterium
VVAKGSNLEFALGYSHPV

SEQ ID NO: 1284668 - protein, 21 aa, Mycobacterium
VVALERLGRWNVPGPVAESVA

SEQ ID NO: 1284669 - protein, 20 aa, Mycobacterium
VVALSGGYGRDEACEKLAAN

SEQ ID NO: 1284670 - protein, 24 aa, Mycobacterium
VVAMREAYHGWTYGTDAVSTSTAD

SEQ ID NO: 1284671 - protein, 17 aa, Mycobacterium
VVAPLTFTSAPGMQCNR

SEQ ID NO: 1284672 - protein, 23 aa, Mycobacterium
VVARASALMLRRGEQPPGPRWST

SEQ ID NO: 1284673 - protein, 18 aa, Mycobacterium
VVARDRITAVLGAIEGRD

SEQ ID NO: 1284674 - protein, 18 aa, Mycobacterium
VVARGVSRLVTITSGLDP

SEQ ID NO: 1284675 - protein, 24 aa, Mycobacterium
VVARIDWATFLPVYQLQRRRAFLS

SEQ ID NO: 1284676 - protein, 25 aa, Mycobacterium
VVARPTMRLTCAFDHRVADGAQVAA

SEQ ID NO: 1284677 - protein, 25 aa, Mycobacterium
VVARSVLVPPRLVHHLDTHGGRLVS

SEQ ID NO: 1284678 - protein, 24 aa, Mycobacterium
VVARTGRLDLIFNNAGIVWGGDTE

SEQ ID NO: 1284679 - protein, 18 aa, Mycobacterium
VVASFALTEPGAGSNPSG

SEQ ID NO: 1284680 - protein, 19 aa, Mycobacterium
VVASMLLEFNDRLMERHTL

SEQ ID NO: 1284681 - protein, 24 aa, Mycobacterium
VVAVREAYHGWTYGTDAVSTSTAD

SEQ ID NO: 1284682 - protein, 19 aa, Mycobacterium
VVAVSPRVSLVLKADIRPG

SEQ ID NO: 1284683 - protein, 18 aa, Mycobacterium
VVCEDSLGLAEEFEAAIA

SEQ ID NO: 1284684 - protein, 25 aa, Mycobacterium
VVCPRICGICGGSHLYKSAYALDTA

SEQ ID NO: 1284685 - protein, 28 aa, Mycobacterium
VVCSEMWTPEIARIVALRGAEIILSPAG

SEQ ID NO: 1284686 - protein, 17 aa, Mycobacterium
VVCTPLPPLAAEPPDEV

SEQ ID NO: 1284687 - protein, 23 aa, Mycobacterium
VVCVSRLVPRKGQDMLIRALPAI

SEQ ID NO: 1284688 - protein, 18 aa, Mycobacterium
VVDACLQLHGGYGYMNEY

SEQ ID NO: 1284689 - protein, 21 aa, Mycobacterium
VVDALSRPQAWSATTAAGQYG

SEQ ID NO: 1284690 - protein, 19 aa, Mycobacterium
VVDALTWVMGEQGAKTLRG

SEQ ID NO: 1284691 - protein, 27 aa, Mycobacterium
VVDARPWLRDPAPMWRTNVDGLRNVLD

SEQ ID NO: 1284692 - protein, 18 aa, Mycobacterium
VVDDRGSLVGIITNRDMR

SEQ ID NO: 1284693 - protein, 19 aa, Mycobacterium
VVDEVPRRGIGKVDRRALS

SEQ ID NO: 1284694 - protein, 23 aa, Mycobacterium
VVDGHPAGVFSWQPPAALIEALS

SEQ ID NO: 1284695 - protein, 17 aa, Mycobacterium
VVDGLERYMAWWQRNND

SEQ ID NO: 1284696 - protein, 18 aa, Mycobacterium
VVDGRPLAIWTPSGEAAD

SEQ ID NO: 1284697 - protein, 26 aa, Mycobacterium
VVDIISMHMGWGWGGYGVGPLKFAHQ

SEQ ID NO: 1284698 - protein, 24 aa, Mycobacterium
VVDKAAAAAAEFRKLDQAQVDAIV

SEQ ID NO: 1284699 - protein, 27 aa, Mycobacterium
VVDLCEGWAAGVILTAMALRDGTALEA

SEQ ID NO: 1284700 - protein, 24 aa, Mycobacterium
VVDPACGTGGFLLVAHEHVAEEAG

SEQ ID NO: 1284701 - protein, 22 aa, Mycobacterium
VVDRAGGALAAILGDAGDATPA

SEQ ID NO: 1284702 - protein, 18 aa, Mycobacterium
VVDRDVLAFIRSVPKNAG

SEQ ID NO: 1284703 - protein, 17 aa, Mycobacterium
VVDRPAGPVSDREPGYA

SEQ ID NO: 1284704 - protein, 23 aa, Mycobacterium
VVDRSGLAAADFDDLVLAESLQG

SEQ ID NO: 1284705 - protein, 20 aa, Mycobacterium
VVDYEPRPAVFDPDTARRPG

SEQ ID NO: 1284706 - protein, 22 aa, Mycobacterium
VVDYPASFWPFSDGYFVDPTYD

SEQ ID NO: 1284707 - protein, 17 aa, Mycobacterium
VVEAALALAERIAVNAP

SEQ ID NO: 1284708 - protein, 25 aa, Mycobacterium
VVEAVWRTSATFGVLQREIQLAPGA

SEQ ID NO: 1284709 - protein, 26 aa, Mycobacterium
VVEGVKGKAKEVVGVVTGRDDLQREG

SEQ ID NO: 1284710 - protein, 23 aa, Mycobacterium
VVEHAGRLYALWEGGPPHEIDPD

SEQ ID NO: 1284711 - protein, 25 aa, Mycobacterium
VVEIIPDVLRHRLVLTYDALADEIS

SEQ ID NO: 1284712 - protein, 18 aa, Mycobacterium
VVEKRAAVDEVLLVLDAT

SEQ ID NO: 1284713 - protein, 18 aa, Mycobacterium
VVELGVWVAGPAAGGILA

SEQ ID NO: 1284714 - protein, 17 aa, Mycobacterium
VVEPSAIRSFVMSRGFT

SEQ ID NO: 1284715 - protein, 21 aa, Mycobacterium
VVERFGDLVFDTVVTRTVRFP

SEQ ID NO: 1284716 - protein, 23 aa, Mycobacterium
VVERGRMLGGVCVNTGTIPSKTL

SEQ ID NO: 1284717 - protein, 18 aa, Mycobacterium
VVFEALAGMAARRRDAAD

SEQ ID NO: 1284718 - protein, 21 aa, Mycobacterium
VVFMDLPIVFNVDIAVSGRGD

SEQ ID NO: 1284719 - protein, 17 aa, Mycobacterium
VVFNGHYLTWFDEACTG

SEQ ID NO: 1284720 - protein, 18 aa, Mycobacterium
VVFRRLHGPPGQGVPFVS

SEQ ID NO: 1284721 - protein, 18 aa, Mycobacterium
VVFSRAYCGGRVDAARTE

SEQ ID NO: 1284722 - protein, 24 aa, Mycobacterium
VVGAWGDALAVVSMTLRGRTLHDV

SEQ ID NO: 1284723 - protein, 26 aa, Mycobacterium
VVGDCIECPFHGWRWGPEGDNTYIPY

SEQ ID NO: 1284724 - protein, 26 aa, Mycobacterium
VVGDGRWWRRWAARHAPTHPPTVLRA

SEQ ID NO: 1284725 - protein, 34 aa, Mycobacterium
VVGEWQLLADLSFADYLMWVRRDDGMLVCVAQVR

SEQ ID NO: 1284726 - protein, 20 aa, Mycobacterium
VVGFGGYVAVPAYLAARSLR

SEQ ID NO: 1284727 - protein, 25 aa, Mycobacterium
VVGGAEALAWLTLRHGLGRAALQLG

SEQ ID NO: 1284728 - protein, 18 aa, Mycobacterium
VVGGRFVYRDRGFPHLDV

SEQ ID NO: 1284729 - protein, 28 aa, Mycobacterium
VVGHDWGAPVAWTFAWLHPQRCAGVAGI

SEQ ID NO: 1284730 - protein, 23 aa, Mycobacterium
VVGHPFIDIWEAVKPARIGVKSW

SEQ ID NO: 1284731 - protein, 25 aa, Mycobacterium
VVGLIGPRARSMWVATFHSTCVRIL

SEQ ID NO: 1284732 - protein, 24 aa, Mycobacterium
VVGLLRRSGVELVLDLAAANKAGV

SEQ ID NO: 1284733 - protein, 24 aa, Mycobacterium
VVGQLMHTLPIGWVEPEDIANAVL

SEQ ID NO: 1284734 - protein, 21 aa, Mycobacterium
VVGRCRRLFGTRKVGHAGTLD

SEQ ID NO: 1284735 - protein, 25 aa, Mycobacterium
VVGSSPGFLAYPWGVIPDRAIERVE

SEQ ID NO: 1284736 - protein, 28 aa, Mycobacterium
VVGTPAEYGRLVLRNTISLLAQVVSVAD

SEQ ID NO: 1284737 - protein, 22 aa, Mycobacterium
VVGTPEWKELTGRAGTLTPHRE

SEQ ID NO: 1284738 - protein, 25 aa, Mycobacterium
VVGTRLGMCGVEFFGHPWEFGPRKA

SEQ ID NO: 1284739 - protein, 18 aa, Mycobacterium
VVGTVMRRGYRVGEQVVR

SEQ ID NO: 1284740 - protein, 20 aa, Mycobacterium
VVGVPAFLASQGYVAGTRVL

SEQ ID NO: 1284741 - protein, 23 aa, Mycobacterium
VVHAETFAPILYVLTYDDDLGEA

SEQ ID NO: 1284742 - protein, 23 aa, Mycobacterium
VVHDYLFSRCLTIAGGTSEIVRN

SEQ ID NO: 1284743 - protein, 23 aa, Mycobacterium
VVHQGLRKLCAWQLGHPLASSAL

SEQ ID NO: 1284744 - protein, 18 aa, Mycobacterium
VVHYGRIKALHSVSLTVH

SEQ ID NO: 1284745 - protein, 28 aa, Mycobacterium
VVIGHDWGAPVAWTFAWLHPQRCRGVVG

SEQ ID NO: 1284746 - protein, 19 aa, Mycobacterium
VVIGRIALMSGELGQLNGL

SEQ ID NO: 1284747 - protein, 24 aa, Mycobacterium
VVIKRSVLTAHPWVANNLVDAFER

SEQ ID NO: 1284748 - protein, 21 aa, Mycobacterium
VVINGCRRLAAAHKYGRSDLA

SEQ ID NO: 1284749 - protein, 18 aa, Mycobacterium
VVIQEWIEGIPLSHIIRD

SEQ ID NO: 1284750 - protein, 17 aa, Mycobacterium
VVIVGAGIAGMAAALEC

SEQ ID NO: 1284751 - protein, 18 aa, Mycobacterium
VVKAAALLHKVTGPDYRR

SEQ ID NO: 1284752 - protein, 17 aa, Mycobacterium
VVKASSEDLHWIDPTRN

SEQ ID NO: 1284753 - protein, 18 aa, Mycobacterium
VVKLKMGRGSVWESAYAA

SEQ ID NO: 1284754 - protein, 20 aa, Mycobacterium
VVKVARIAGQYAKPRSSDTD

SEQ ID NO: 1284755 - protein, 29 aa, Mycobacterium
VVLDRPGVYEVRPGLELVAAPWSSKAPTT

SEQ ID NO: 1284756 - protein, 25 aa, Mycobacterium
VVLELGWGRLIFGQTFADPEKLADV

SEQ ID NO: 1284757 - protein, 19 aa, Mycobacterium
VVLESFPPGVVNIISGSGA

SEQ ID NO: 1284758 - protein, 19 aa, Mycobacterium
VVLGPWLPFTDDIDLASAR

SEQ ID NO: 1284759 - protein, 29 aa, Mycobacterium
VVLKIRSSVWLGEDGWVIDRFLGANEPLV

SEQ ID NO: 1284760 - protein, 26 aa, Mycobacterium
VVLKPAPDAPLGFGVLMEAIEEAAIP

SEQ ID NO: 1284761 - protein, 17 aa, Mycobacterium
VVLLGLRARRPLSDPEA

SEQ ID NO: 1284762 - protein, 42 aa, Mycobacterium
VVLPALDVPAMFDFYTGVLGFKSRGAFRVPVPPEFGPVRVRF

SEQ ID NO: 1284763 - protein, 18 aa, Mycobacterium
VVLPGGWGADTARRDQVL

SEQ ID NO: 1284764 - protein, 23 aa, Mycobacterium
VVLREILRRVELETTTARGEHRR

SEQ ID NO: 1284765 - protein, 18 aa, Mycobacterium
VVLSKAVGVRNPFIKDFK

SEQ ID NO: 1284766 - protein, 18 aa, Mycobacterium
VVLTEGWQAGGAGMQIPP

SEQ ID NO: 1284767 - protein, 17 aa, Mycobacterium
VVMGQRLGYYRCLVEHG

SEQ ID NO: 1284768 - protein, 18 aa, Mycobacterium
VVMHRPELVRSWVSDVVG

SEQ ID NO: 1284769 - protein, 24 aa, Mycobacterium
VVMKRMGIEGVYLGGWATSAKGSI

SEQ ID NO: 1284770 - protein, 25 aa, Mycobacterium
VVMPTVLHDIAWRAMQVHGALGVTN

SEQ ID NO: 1284771 - protein, 26 aa, Mycobacterium
VVMSFSAAAVWRIRRAAPLLPTVLLG

SEQ ID NO: 1284772 - protein, 19 aa, Mycobacterium
VVMTGRPGGWVPSGSTVEV

SEQ ID NO: 1284773 - protein, 17 aa, Mycobacterium
VVNGQWPLASGSYEHQW

SEQ ID NO: 1284774 - protein, 18 aa, Mycobacterium
VVNRCDPILLVDVAEALA

SEQ ID NO: 1284775 - protein, 24 aa, Mycobacterium
VVNSRSAAMGVGFIALAAADCARS

SEQ ID NO: 1284776 - protein, 22 aa, Mycobacterium
VVPELPKTRSGKIMRRLLRDVA

SEQ ID NO: 1284777 - protein, 18 aa, Mycobacterium
VVPEVLEALAGIGSSTPV

SEQ ID NO: 1284778 - protein, 20 aa, Mycobacterium
VVPGSGWRLALYKASFGLIN

SEQ ID NO: 1284779 - protein, 22 aa, Mycobacterium
VVPMREDMCILLAARKMPTATS

SEQ ID NO: 1284780 - protein, 18 aa, Mycobacterium
VVPPGHWQRARPRDGQPC

SEQ ID NO: 1284781 - protein, 21 aa, Mycobacterium
VVPSARVGHIGLYRDPKTLVA

SEQ ID NO: 1284782 - protein, 17 aa, Mycobacterium
VVPSSLGGHAFWNEADP

SEQ ID NO: 1284783 - protein, 21 aa, Mycobacterium
VVPVLTARGAYQSSYAPGTLR

SEQ ID NO: 1284784 - protein, 26 aa, Mycobacterium
VVQAAVKVLAAWDWQVRPTAVMALDS

SEQ ID NO: 1284785 - protein, 26 aa, Mycobacterium
VVQARRVLLAMGMRYEAPSLPGLAEL

SEQ ID NO: 1284786 - protein, 25 aa, Mycobacterium
VVQRLEMVRRISLEIDSDVVELGTD

SEQ ID NO: 1284787 - protein, 19 aa, Mycobacterium
VVQTCIRYSPDQRCRFCSI

SEQ ID NO: 1284788 - protein, 33 aa, Mycobacterium
VVRAAIDVLAAWNWQQRPVAVLAMDSETHPILI

SEQ ID NO: 1284789 - protein, 22 aa, Mycobacterium
VVRAELCAALGLTPDDLPYAGE

SEQ ID NO: 1284790 - protein, 24 aa, Mycobacterium
VVRALHLARVKIERILGAQQAAPE

SEQ ID NO: 1284791 - protein, 19 aa, Mycobacterium
VVRGEACADSFYAAFEAAV

SEQ ID NO: 1284792 - protein, 19 aa, Mycobacterium
VVRGEACADSFYAALESAV

SEQ ID NO: 1284793 - protein, 17 aa, Mycobacterium
VVRGVCRVVPDAEAPAL

SEQ ID NO: 1284794 - protein, 24 aa, Mycobacterium
VVRICLPARLIPYTGGYRAVHPGP

SEQ ID NO: 1284795 - protein, 19 aa, Mycobacterium
VVRILAPCRLLDDDIGAGA

SEQ ID NO: 1284796 - protein, 18 aa, Mycobacterium
VVRKLRQTFATGRTRSVQ

SEQ ID NO: 1284797 - protein, 24 aa, Mycobacterium
VVRLLRRLGCHVEFPAAQTCCGQM

SEQ ID NO: 1284798 - protein, 26 aa, Mycobacterium
VVRLPRIPVPFPMYLPGPNRVQIVNE

SEQ ID NO: 1284799 - protein, 18 aa, Mycobacterium
VVRNRLTAIVAQQSAVLK

SEQ ID NO: 1284800 - protein, 17 aa, Mycobacterium
VVRPGRKIELIGAEMLA

SEQ ID NO: 1284801 - protein, 26 aa, Mycobacterium
VVRRRGNVTLARFVPHSLVLDRAVCV

SEQ ID NO: 1284802 - protein, 26 aa, Mycobacterium
VVSALRYLRSHRAFTYVRTHEPHWLL

SEQ ID NO: 1284803 - protein, 31 aa, Mycobacterium
VVSAPALHRRWWAADGLGAFVTVSGESPRRL

SEQ ID NO: 1284804 - protein, 17 aa, Mycobacterium
VVSASIYDGDWVTAVSE

SEQ ID NO: 1284805 - protein, 19 aa, Mycobacterium
VVSELALRGTLGILDRTVR

SEQ ID NO: 1284806 - protein, 18 aa, Mycobacterium
VVSIADWADDVVHVTMHH

SEQ ID NO: 1284807 - protein, 19 aa, Mycobacterium
VVSLDLPAGSARRLGELRA

SEQ ID NO: 1284808 - protein, 27 aa, Mycobacterium
VVSLLRFCLEHGYQLRVIEQMPLDAGH

SEQ ID NO: 1284809 - protein, 17 aa, Mycobacterium
VVSLQLNAAAPLSHPDL

SEQ ID NO: 1284810 - protein, 17 aa, Mycobacterium
VVSPRFGSPPAAELLRQ

SEQ ID NO: 1284811 - protein, 34 aa, Mycobacterium
VVTPFNFPIAIPAWKIAPALVYGNTVVWKPASTV

SEQ ID NO: 1284812 - protein, 18 aa, Mycobacterium
VVTPFRLYDCAPQSDGAA

SEQ ID NO: 1284813 - protein, 17 aa, Mycobacterium
VVTWSPDAGHLFRPTPN

SEQ ID NO: 1284814 - protein, 25 aa, Mycobacterium
VVVACGAISQASRRRAQRRLPDSAV

SEQ ID NO: 1284815 - protein, 18 aa, Mycobacterium
VVVACRRLTGLNQQTPLA

SEQ ID NO: 1284816 - protein, 18 aa, Mycobacterium
VVVAGEIFSCLTAEEQRQ

SEQ ID NO: 1284817 - protein, 24 aa, Mycobacterium
VVVAGRPSDRWGQEVVAVVALADG

SEQ ID NO: 1284818 - protein, 23 aa, Mycobacterium
VVVDPKFAWGQPVIERNKVPIRA

SEQ ID NO: 1284819 - protein, 22 aa, Mycobacterium
VVVGCGPGPFTGLRVGMATAAA

SEQ ID NO: 1284820 - protein, 20 aa, Mycobacterium
VVVGHDWGSPVVTNFALLYP

SEQ ID NO: 1284821 - protein, 26 aa, Mycobacterium
VVVGRPRWPVPGSRFGGSLHATLHRA

SEQ ID NO: 1284822 - protein, 18 aa, Mycobacterium
VVVHLAFIIMGSREESAR

SEQ ID NO: 1284823 - protein, 25 aa, Mycobacterium
VVVHRGVALTSHYQCGDLYRIDPRT

SEQ ID NO: 1284824 - protein, 17 aa, Mycobacterium
VVVNLDGTFSYTASDSA

SEQ ID NO: 1284825 - protein, 19 aa, Mycobacterium
VVVPAGLELLADVDDSFID

SEQ ID NO: 1284826 - protein, 17 aa, Mycobacterium
VVVPGFDFADFALGAAT

SEQ ID NO: 1284827 - protein, 32 aa, Mycobacterium
VVVRRTGIDIAWTQGRDVLWEEVVPKASTEHT

SEQ ID NO: 1284828 - protein, 18 aa, Mycobacterium
VVVSADWYFPPGNTPPKG

SEQ ID NO: 1284829 - protein, 18 aa, Mycobacterium
VVWRALCSPDCGPNRVRL

SEQ ID NO: 1284830 - protein, 17 aa, Mycobacterium
VVYDNKGNGLVFYKPLA

SEQ ID NO: 1284831 - protein, 23 aa, Mycobacterium
VVYSFAVVHGFPGMPDLVLVPAV

SEQ ID NO: 1284832 - protein, 17 aa, Mycobacterium
VWAEAELLLKVKEPIEA

SEQ ID NO: 1284833 - protein, 22 aa, Mycobacterium
VWASGIARRPIRGHDDTARQAV

SEQ ID NO: 1284834 - protein, 20 aa, Mycobacterium
VWDGAPGVRPFLLFGDAPAG

SEQ ID NO: 1284835 - protein, 24 aa, Mycobacterium
VWDGPTGALAPFWDAVHVVDPEAE

SEQ ID NO: 1284836 - protein, 18 aa, Mycobacterium
VWDTIGWQGRETLGDTAH

SEQ ID NO: 1284837 - protein, 21 aa, Mycobacterium
VWFELHEELILAAGLTRDQEA

SEQ ID NO: 1284838 - protein, 21 aa, Mycobacterium
VWGDSRIGNVIYQDFSPVAVL

SEQ ID NO: 1284839 - protein, 19 aa, Mycobacterium
VWGNPEFSYRGEFYDIDKA

SEQ ID NO: 1284840 - protein, 19 aa, Mycobacterium
VWGPAYAKETHYLRVYLAQ

SEQ ID NO: 1284841 - protein, 18 aa, Mycobacterium
VWHEPVGVVGAIVPWNFP

SEQ ID NO: 1284842 - protein, 27 aa, Mycobacterium
VWKRERPSRLLVPLARQTRRHPTSNSL

SEQ ID NO: 1284843 - protein, 25 aa, Mycobacterium
VWLEAGKQGFLGMAVPEEYGGGGVD

SEQ ID NO: 1284844 - protein, 20 aa, Mycobacterium
VWLSNLLAWLTRRASATDVA

SEQ ID NO: 1284845 - protein, 22 aa, Mycobacterium
VWMPRARRTPIRDVQEAVEAEP

SEQ ID NO: 1284846 - protein, 17 aa, Mycobacterium
VWQGFPIVSRVASLTGL

SEQ ID NO: 1284847 - protein, 19 aa, Mycobacterium
VWRALRASMRSVLEQTSVA

SEQ ID NO: 1284848 - protein, 21 aa, Mycobacterium
VWSADRERALGIARRLQSGTV

SEQ ID NO: 1284849 - protein, 23 aa, Mycobacterium
VWTAEFAEAGWALPLSDDPAGLA

SEQ ID NO: 1284850 - protein, 20 aa, Mycobacterium
VWTAQFAQLGHVTACFAEGQ

SEQ ID NO: 1284851 - protein, 32 aa, Mycobacterium
VWTFLGPRPAGWWIRRRVHEVAVHRADAALAL

SEQ ID NO: 1284852 - protein, 23 aa, Mycobacterium
VWTRDGEGWYWLGRLDGPYFYDA

SEQ ID NO: 1284853 - protein, 28 aa, Mycobacterium
VWTSAAQKAHWGVCLARTDPDAPKHKGI

SEQ ID NO: 1284854 - protein, 22 aa, Mycobacterium
VWVACASPLVGDRRRALADGAH

SEQ ID NO: 1284855 - protein, 20 aa, Mycobacterium
VWVAKLAVDFRQKFKKDVVI

SEQ ID NO: 1284856 - protein, 18 aa, Mycobacterium
VWVAPCPVPRALSRAAAK

SEQ ID NO: 1284857 - protein, 28 aa, Mycobacterium
VWVHCASGYRSSIAASYLDRAGISVVLI

SEQ ID NO: 1284858 - protein, 18 aa, Mycobacterium
VYANELCFVFGLRPGTAV

SEQ ID NO: 1284859 - protein, 27 aa, Mycobacterium
VYAPTFELGEWVIPQGYSIVVAIGQVH

SEQ ID NO: 1284860 - protein, 21 aa, Mycobacterium
VYAPTFELSEWVIPRGYSIVV

SEQ ID NO: 1284861 - protein, 23 aa, Mycobacterium
VYATGYGSMNGWAADLIGQDVAD

SEQ ID NO: 1284862 - protein, 23 aa, Mycobacterium
VYDAALAWAGRFADYPPEVLAAA

SEQ ID NO: 1284863 - protein, 25 aa, Mycobacterium
VYDMPARAKEAFGIQKRQRQMDRCR

SEQ ID NO: 1284864 - protein, 23 aa, Mycobacterium
VYEVNEAFAPVPLAWLADTGADA

SEQ ID NO: 1284865 - protein, 24 aa, Mycobacterium
VYFALLARRRMDLYGATVDDFAQV

SEQ ID NO: 1284866 - protein, 30 aa, Mycobacterium
VYGPAMLDMRIRGVFAMPVLIAGEYVGALD

SEQ ID NO: 1284867 - protein, 18 aa, Mycobacterium
VYHRKRRMLYFTATKGLK

SEQ ID NO: 1284868 - protein, 24 aa, Mycobacterium
VYIYAIPYLWAFPPAEQIFGTTAV

SEQ ID NO: 1284869 - protein, 22 aa, Mycobacterium
VYKFLLKRNRRLYGVAYTLDNV

SEQ ID NO: 1284870 - protein, 18 aa, Mycobacterium
VYLKRATLNRALFGSPAA

SEQ ID NO: 1284871 - protein, 23 aa, Mycobacterium
VYMFHKGIMGLSWMSKTSRALGP

SEQ ID NO: 1284872 - protein, 18 aa, Mycobacterium
VYPIPEPFLVIATQNPVD

SEQ ID NO: 1284873 - protein, 23 aa, Mycobacterium
VYPQRFGIPEGLYAVPVAVKQGW

SEQ ID NO: 1284874 - protein, 23 aa, Mycobacterium
VYPTHGFGSFCSATPASGDESTI

SEQ ID NO: 1284875 - protein, 27 aa, Mycobacterium
VYQAAMFDGRFAGFADFLILEDSPDGP

SEQ ID NO: 1284876 - protein, 18 aa, Mycobacterium
VYQVARFAAPNLVLGNTI

SEQ ID NO: 1284877 - protein, 18 aa, Mycobacterium
VYRAEESHTWVLSRHADV

SEQ ID NO: 1284878 - protein, 26 aa, Mycobacterium
VYRARQRLRIALAHKAVGRGAELDDE

SEQ ID NO: 1284879 - protein, 24 aa, Mycobacterium
VYRGPRRKGVRYFGPYSHAWAIRE

SEQ ID NO: 1284880 - protein, 21 aa, Mycobacterium
VYRSELLYRHRIDPYRLGTNL

SEQ ID NO: 1284881 - protein, 19 aa, Mycobacterium
VYSCGALVHADTLVIPYGI

SEQ ID NO: 1284882 - protein, 20 aa, Mycobacterium
VYSISRYWANYVSLELGPWL

SEQ ID NO: 1284883 - protein, 17 aa, Mycobacterium
VYSPLVWYVVDGTRVAY

SEQ ID NO: 1284884 - protein, 26 aa, Mycobacterium
VYSVQFRRLHGGIAFGHTTVALPPAV

SEQ ID NO: 1284885 - protein, 22 aa, Mycobacterium
VYTEDCTGCGLCVEACPVVIPG

SEQ ID NO: 1284886 - protein, 26 aa, Mycobacterium
VYTKSRLPLRIREAARIVIAYANECV

SEQ ID NO: 1284887 - protein, 18 aa, Mycobacterium
VYVDARIEDIENWYISRF

SEQ ID NO: 1284888 - protein, 25 aa, Mycobacterium
VYVSELRPGADFDFKPVTRGYADAL

SEQ ID NO: 1284889 - protein, 18 aa, Mycobacterium
VYWTARQIGCSWCVDFGS

SEQ ID NO: 1284890 - protein, 19 aa, Mycobacterium
VYYCVVDARGWLRDPAPLF

SEQ ID NO: 1284891 - protein, 18 aa, Mycobacterium
WAAAEALALDASLRLVHA

SEQ ID NO: 1284892 - protein, 19 aa, Mycobacterium
WAADELFEILGGKDTFDDV

SEQ ID NO: 1284893 - protein, 20 aa, Mycobacterium
WAAENGWPAFGDALLDLARE

SEQ ID NO: 1284894 - protein, 18 aa, Mycobacterium
WAAGSWAGAAPCGMVGLA

SEQ ID NO: 1284895 - protein, 24 aa, Mycobacterium
WAAHARGAVAVRRGDFGVALESLQ

SEQ ID NO: 1284896 - protein, 17 aa, Mycobacterium
WAALPRAGAVIFATSGM

SEQ ID NO: 1284897 - protein, 18 aa, Mycobacterium
WAALPRAGAVVFATGGMD

SEQ ID NO: 1284898 - protein, 18 aa, Mycobacterium
WADAIVAPLGMVLTREDA

SEQ ID NO: 1284899 - protein, 19 aa, Mycobacterium
WADGIVELRDRFGGDKHEI

SEQ ID NO: 1284900 - protein, 20 aa, Mycobacterium
WAEEDYDMFVAKPLAAEPDP

SEQ ID NO: 1284901 - protein, 19 aa, Mycobacterium
WAEGAGMFVLQRKSAAVRD

SEQ ID NO: 1284902 - protein, 18 aa, Mycobacterium
WAEGPALDSAFRSGLRNA

SEQ ID NO: 1284903 - protein, 18 aa, Mycobacterium
WAELLGRAAAFAERLRAA

SEQ ID NO: 1284904 - protein, 23 aa, Mycobacterium
WAESRRYLGLDVLSKSRAVNDTP

SEQ ID NO: 1284905 - protein, 19 aa, Mycobacterium
WAEVLARRLRISVGEAKRR

SEQ ID NO: 1284906 - protein, 22 aa, Mycobacterium
WAFAEGFGYAYERTVLLERMRR

SEQ ID NO: 1284907 - protein, 22 aa, Mycobacterium
WAGAAPCGMVGLAVNAICSGQA

SEQ ID NO: 1284908 - protein, 19 aa, Mycobacterium
WAGACKPGDGLGIAGDEVV

SEQ ID NO: 1284909 - protein, 20 aa, Mycobacterium
WAGACRPGDGLGISGDEVLI

SEQ ID NO: 1284910 - protein, 24 aa, Mycobacterium
WAGFARASLFPALARALDDGGADQ

SEQ ID NO: 1284911 - protein, 17 aa, Mycobacterium
WAGLEALGLGHPGRDVP

SEQ ID NO: 1284912 - protein, 19 aa, Mycobacterium
WAGMGRRLLADEPAFAAAV

SEQ ID NO: 1284913 - protein, 18 aa, Mycobacterium
WAGPDGHSCSFDWCRCRW

SEQ ID NO: 1284914 - protein, 19 aa, Mycobacterium
WAGPTARIKSIGLRLGVPW

SEQ ID NO: 1284915 - protein, 26 aa, Mycobacterium
WAGSYPDRFIPIAILPTWNVEAMCAE

SEQ ID NO: 1284916 - protein, 28 aa, Mycobacterium
WAGVAVPIPEGYRIQLDPSIDVDAIPGM

SEQ ID NO: 1284917 - protein, 20 aa, Mycobacterium
WAHLRMCLTCGHVGCCDSSP

SEQ ID NO: 1284918 - protein, 17 aa, Mycobacterium
WAIGRVRPNTGWLPTEL

SEQ ID NO: 1284919 - protein, 17 aa, Mycobacterium
WAIIRLIQRAGRVDRVG

SEQ ID NO: 1284920 - protein, 17 aa, Mycobacterium
WAISPWAAEQVPLLDAA

SEQ ID NO: 1284921 - protein, 28 aa, Mycobacterium
WAKANLPMNAGCTGTAPPTCEDANAILS

SEQ ID NO: 1284922 - protein, 18 aa, Mycobacterium
WALPGGRLDPGETVVDAA

SEQ ID NO: 1284923 - protein, 30 aa, Mycobacterium
WAMEHLPYYARWYRFLLMWPGADKGLDAAR

SEQ ID NO: 1284924 - protein, 21 aa, Mycobacterium
WANQRIKPIGWRRSHDSDPAS

SEQ ID NO: 1284925 - protein, 25 aa, Mycobacterium
WANRPLPLPDMCYAAAATGDPDLRD

SEQ ID NO: 1284926 - protein, 22 aa, Mycobacterium
WAPELRFPYLGLAKTFIAGNVM

SEQ ID NO: 1284927 - protein, 21 aa, Mycobacterium
WAPGARCGTSPCGSAVCGSAV

SEQ ID NO: 1284928 - protein, 20 aa, Mycobacterium
WAPPGVRVSVGFDRKRLLHG

SEQ ID NO: 1284929 - protein, 17 aa, Mycobacterium
WAREHGDRVLVVPLDVT

SEQ ID NO: 1284930 - protein, 23 aa, Mycobacterium
WARQIRATVRFADELDALLAAPD

SEQ ID NO: 1284931 - protein, 18 aa, Mycobacterium
WASEYIQVLQLLWDSWED

SEQ ID NO: 1284932 - protein, 18 aa, Mycobacterium
WASRTGLDRELTRKLTEA

SEQ ID NO: 1284933 - protein, 23 aa, Mycobacterium
WASTGRRALYLSGEESAGQIRLR

SEQ ID NO: 1284934 - protein, 17 aa, Mycobacterium
WATAHRIAVVPRGMGTG

SEQ ID NO: 1284935 - protein, 19 aa, Mycobacterium
WATRLCAQFIAGEEAVTQD

SEQ ID NO: 1284936 - protein, 17 aa, Mycobacterium
WAVELGLVPAADQIDSA

SEQ ID NO: 1284937 - protein, 21 aa, Mycobacterium
WAVIPRSQWDTALTDGAKVEV

SEQ ID NO: 1284938 - protein, 25 aa, Mycobacterium
WAVLRSRYGVELARSTAVLESIVLD

SEQ ID NO: 1284939 - protein, 18 aa, Mycobacterium
WAVPTGWRVGDHAPTTHR

SEQ ID NO: 1284940 - protein, 18 aa, Mycobacterium
WAVQRLIGGLSHISADRD

SEQ ID NO: 1284941 - protein, 19 aa, Mycobacterium
WAVTLGRPGTVIVVDNIAR

SEQ ID NO: 1284942 - protein, 19 aa, Mycobacterium
WCAGRFWWDGARPVDAEVT

SEQ ID NO: 1284943 - protein, 20 aa, Mycobacterium
WCALRKGEVFALRRCDIAAD

SEQ ID NO: 1284944 - protein, 18 aa, Mycobacterium
WCASRCLPDQDTPPEAGS

SEQ ID NO: 1284945 - protein, 19 aa, Mycobacterium
WCGQPHPSGRPGWNVTTER

SEQ ID NO: 1284946 - protein, 19 aa, Mycobacterium
WCQKRRITFTRSRPGNKND

SEQ ID NO: 1284947 - protein, 19 aa, Mycobacterium
WDAGIPRTGVEVFGGVATE

SEQ ID NO: 1284948 - protein, 17 aa, Mycobacterium
WDAHINGSMVLTMNRDG

SEQ ID NO: 1284949 - protein, 25 aa, Mycobacterium
WDALYRSNLRHVLLCTQRVARRLVE

SEQ ID NO: 1284950 - protein, 27 aa, Mycobacterium
WDAPEGQWNMYGNLWMVDLENDRAVSR

SEQ ID NO: 1284951 - protein, 17 aa, Mycobacterium
WDAPLFDETYAFGGLPT

SEQ ID NO: 1284952 - protein, 21 aa, Mycobacterium
WDARRAVEIIRDFEVTSTAGV

SEQ ID NO: 1284953 - protein, 17 aa, Mycobacterium
WDARVAALLADGAAMTV

SEQ ID NO: 1284954 - protein, 17 aa, Mycobacterium
WDASVIFASYPHFWELK

SEQ ID NO: 1284955 - protein, 17 aa, Mycobacterium
WDATRLAGQAALQTTDP

SEQ ID NO: 1284956 - protein, 21 aa, Mycobacterium
WDDMIGVNLSGVWKTVKAGVP

SEQ ID NO: 1284957 - protein, 25 aa, Mycobacterium
WDDMPDVLKPVLARQMEIYAGFLEQ

SEQ ID NO: 1284958 - protein, 25 aa, Mycobacterium
WDDTPEGFGRIAATTARQVILQRLR

SEQ ID NO: 1284959 - protein, 17 aa, Mycobacterium
WDEGVCRHADFNAAAGE

SEQ ID NO: 1284960 - protein, 27 aa, Mycobacterium
WDEIKEQLTRLAAELGPASGVSGTSLG

SEQ ID NO: 1284961 - protein, 17 aa, Mycobacterium
WDERVCLAPNGDLFKTI

SEQ ID NO: 1284962 - protein, 24 aa, Mycobacterium
WDETRWPERRAPSTAEVDAAVGGR

SEQ ID NO: 1284963 - protein, 20 aa, Mycobacterium
WDFRDNRIAVRFQYECRDAT

SEQ ID NO: 1284964 - protein, 27 aa, Mycobacterium
WDGADLAPRMRRLAADGVLRSEDVLLA

SEQ ID NO: 1284965 - protein, 20 aa, Mycobacterium
WDGPAAVCFTDGTVVGAVLD

SEQ ID NO: 1284966 - protein, 17 aa, Mycobacterium
WDGPGLGEWDLRALVGH

SEQ ID NO: 1284967 - protein, 17 aa, Mycobacterium
WDGRASIDLAVATGAKW

SEQ ID NO: 1284968 - protein, 17 aa, Mycobacterium
WDGRDHYLAGIYRTALH

SEQ ID NO: 1284969 - protein, 19 aa, Mycobacterium
WDGTFWRRCECTASIDAPG

SEQ ID NO: 1284970 - protein, 17 aa, Mycobacterium
WDGTRLCVGGQSAGGNL

SEQ ID NO: 1284971 - protein, 17 aa, Mycobacterium
WDIGPTWQVEADLERTS

SEQ ID NO: 1284972 - protein, 17 aa, Mycobacterium
WDIQHLFGHIPDEHLPQ

SEQ ID NO: 1284973 - protein, 19 aa, Mycobacterium
WDIYACVRQMLAVLDPVPE

SEQ ID NO: 1284974 - protein, 24 aa, Mycobacterium
WDLKPRRWTSGHLQLMEDFVAMLR

SEQ ID NO: 1284975 - protein, 17 aa, Mycobacterium
WDPAAPDFDEYVGDFHY

SEQ ID NO: 1284976 - protein, 24 aa, Mycobacterium
WDPITRIVGSLGIYTKIDFENREV

SEQ ID NO: 1284977 - protein, 20 aa, Mycobacterium
WDPPEEKLYPVIDALVDAWR

SEQ ID NO: 1284978 - protein, 27 aa, Mycobacterium
WDRAWAEFVPFLAFPVEIRKIIYTTNA

SEQ ID NO: 1284979 - protein, 17 aa, Mycobacterium
WDRNYVHSLDWRWLTRP

SEQ ID NO: 1284980 - protein, 18 aa, Mycobacterium
WDRWPTSVTWSADGSSVI

SEQ ID NO: 1284981 - protein, 24 aa, Mycobacterium
WDSAFGLVKINPLAAWSDDDMQDY

SEQ ID NO: 1284982 - protein, 34 aa, Mycobacterium
WDSFLRVNLYGVLHCTRAVLPTMIANTWGRILTV

SEQ ID NO: 1284983 - protein, 28 aa, Mycobacterium
WDSLPAELRGRWIGMLTHCRRARLLAYR

SEQ ID NO: 1284984 - protein, 18 aa, Mycobacterium
WDSMPLKLFAGGNAKFWD

SEQ ID NO: 1284985 - protein, 17 aa, Mycobacterium
WDSVIAVHLKGTFAVTR

SEQ ID NO: 1284986 - protein, 17 aa, Mycobacterium
WDTRPVTTHGLAKLFDE

SEQ ID NO: 1284987 - protein, 22 aa, Mycobacterium
WDVLRHCRRAGSLDSAVEPDSM

SEQ ID NO: 1284988 - protein, 17 aa, Mycobacterium
WDVPIGGMGAVSEAMAA

SEQ ID NO: 1284989 - protein, 18 aa, Mycobacterium
WDYHTVWCNSAALQRAGI

SEQ ID NO: 1284990 - protein, 17 aa, Mycobacterium
WDYPLGLVAPANFALHV

SEQ ID NO: 1284991 - protein, 18 aa, Mycobacterium
WDYPRPPRFEAFRGSITV

SEQ ID NO: 1284992 - protein, 18 aa, Mycobacterium
WDYVRQFTEFTGYQHRVF

SEQ ID NO: 1284993 - protein, 19 aa, Mycobacterium
WEAADRYGPGGAWKELADR

SEQ ID NO: 1284994 - protein, 17 aa, Mycobacterium
WEADWLCTDYAAAGLVL

SEQ ID NO: 1284995 - protein, 17 aa, Mycobacterium
WEAFLGKDEDLYVLESV

SEQ ID NO: 1284996 - protein, 20 aa, Mycobacterium
WEALEDARIPASSLRGENVG

SEQ ID NO: 1284997 - protein, 19 aa, Mycobacterium
WEALFRARLDNLPLEHWML

SEQ ID NO: 1284998 - protein, 19 aa, Mycobacterium
WEAVLTPRARLLLPGDQQF

SEQ ID NO: 1284999 - protein, 19 aa, Mycobacterium
WEDRCRLLIRSRLGLRHPG

SEQ ID NO: 1285000 - protein, 24 aa, Mycobacterium
WEFDEKYGGLGVRDFRFNQIISEE

SEQ ID NO: 1285001 - protein, 19 aa, Mycobacterium
WEFNQPWTIEEIEIGDPVK

SEQ ID NO: 1285002 - protein, 20 aa, Mycobacterium
WEGLERAGLAPADLRGSRTG

SEQ ID NO: 1285003 - protein, 17 aa, Mycobacterium
WEHPAHIFLRRARTGLH

SEQ ID NO: 1285004 - protein, 17 aa, Mycobacterium
WEHPAHLLLRRAQANAV

SEQ ID NO: 1285005 - protein, 17 aa, Mycobacterium
WEHRDYDKFAAYGASKT

SEQ ID NO: 1285006 - protein, 22 aa, Mycobacterium
WEINEAFASVPIAACKEYGIDE

SEQ ID NO: 1285007 - protein, 18 aa, Mycobacterium
WEIYVGGAAGAHIRKGDL

SEQ ID NO: 1285008 - protein, 20 aa, Mycobacterium
WEKMPEQFLAALDARFGIAS

SEQ ID NO: 1285009 - protein, 22 aa, Mycobacterium
WEKSRLSHHLSRMERSSPGTWC

SEQ ID NO: 1285010 - protein, 18 aa, Mycobacterium
WELDTSLLESAEVTGEDP

SEQ ID NO: 1285011 - protein, 20 aa, Mycobacterium
WELEDLSFAILHPKKYDEIV

SEQ ID NO: 1285012 - protein, 19 aa, Mycobacterium
WELEDLSFAILHPKKYEEI

SEQ ID NO: 1285013 - protein, 19 aa, Mycobacterium
WELRGRPTSALLLTRGQGA

SEQ ID NO: 1285014 - protein, 18 aa, Mycobacterium
WELSFPKRPGMPDHGHTV

SEQ ID NO: 1285015 - protein, 19 aa, Mycobacterium
WEMLADFGAIGQWLDGVDH

SEQ ID NO: 1285016 - protein, 25 aa, Mycobacterium
WEPENQLLGALLWMPYTRARTFCDL

SEQ ID NO: 1285017 - protein, 27 aa, Mycobacterium
WEPEPLRWLGVRGMYLAYKAADWHEAR

SEQ ID NO: 1285018 - protein, 18 aa, Mycobacterium
WEPIDIKDIYQLQVDNPR

SEQ ID NO: 1285019 - protein, 18 aa, Mycobacterium
WEPRRVFVTIGIRNARSI

SEQ ID NO: 1285020 - protein, 17 aa, Mycobacterium
WEPTTSYLLAEVEIAPE

SEQ ID NO: 1285021 - protein, 19 aa, Mycobacterium
WEPWVHALPVEFATADEVY

SEQ ID NO: 1285022 - protein, 20 aa, Mycobacterium
WEQIAALKAHVTNIPVLGNG

SEQ ID NO: 1285023 - protein, 19 aa, Mycobacterium
WERGFKAVMADAVAEALAK

SEQ ID NO: 1285024 - protein, 17 aa, Mycobacterium
WERLCAMDATTMALPES

SEQ ID NO: 1285025 - protein, 18 aa, Mycobacterium
WERLDAPIRWVHTSEVLD

SEQ ID NO: 1285026 - protein, 19 aa, Mycobacterium
WERLQRFAVITQFTTLTDA

SEQ ID NO: 1285027 - protein, 18 aa, Mycobacterium
WERLTGNFWLPEKVPVSN

SEQ ID NO: 1285028 - protein, 22 aa, Mycobacterium
WESDWPGAHPIDTAGPLADSVA

SEQ ID NO: 1285029 - protein, 18 aa, Mycobacterium
WESGYLLTVRSAWQADNR

SEQ ID NO: 1285030 - protein, 19 aa, Mycobacterium
WETLMLRLGYQRYGAQGGD

SEQ ID NO: 1285031 - protein, 18 aa, Mycobacterium
WEVSPVGPFGQWPTGSGF

SEQ ID NO: 1285032 - protein, 28 aa, Mycobacterium
WEWPENPRFLMCTPLSHAGAAFFTPVIV

SEQ ID NO: 1285033 - protein, 21 aa, Mycobacterium
WEYRARPTWEAAFDALAAYAA

SEQ ID NO: 1285034 - protein, 25 aa, Mycobacterium
WEYRPWRAEALYAVARWYRDEQRYQ

SEQ ID NO: 1285035 - protein, 18 aa, Mycobacterium
WFATAYVDGFRWVMPTNV

SEQ ID NO: 1285036 - protein, 18 aa, Mycobacterium
WFDAEGIAGVGMGMVTLR

SEQ ID NO: 1285037 - protein, 18 aa, Mycobacterium
WFETMKPLMSTSAERGAA

SEQ ID NO: 1285038 - protein, 21 aa, Mycobacterium
WFHAAADLSDWLLYEQSSPSS

SEQ ID NO: 1285039 - protein, 26 aa, Mycobacterium
WFHVYSAVVWCCVFMRTGARRVHFGE

SEQ ID NO: 1285040 - protein, 19 aa, Mycobacterium
WFLDRTCTHILAWEGDADN

SEQ ID NO: 1285041 - protein, 19 aa, Mycobacterium
WFMRAFRADEWLLYDQSSP

SEQ ID NO: 1285042 - protein, 18 aa, Mycobacterium
WFPIPLPPLPPFPPLPIF

SEQ ID NO: 1285043 - protein, 30 aa, Mycobacterium
WFPNKKGGPGWVEWGGCGMVNPNVLRACGI

SEQ ID NO: 1285044 - protein, 17 aa, Mycobacterium
WFPSLKIYNRNGQLYTA

SEQ ID NO: 1285045 - protein, 17 aa, Mycobacterium
WFQRVALMNAQGKPVAG

SEQ ID NO: 1285046 - protein, 17 aa, Mycobacterium
WFSIGMVQPGWEDERTD

SEQ ID NO: 1285047 - protein, 30 aa, Mycobacterium
WFSPPPSPRRLRGVRSFSRYITMRDGVRIA

SEQ ID NO: 1285048 - protein, 20 aa, Mycobacterium
WFSSALWPFSTMGWPDHTAE

SEQ ID NO: 1285049 - protein, 19 aa, Mycobacterium
WFSYVCPGAGHAPHHVFKE

SEQ ID NO: 1285050 - protein, 17 aa, Mycobacterium
WFTAMTPIATAFGDVTL

SEQ ID NO: 1285051 - protein, 17 aa, Mycobacterium
WFTAQEALEYGFVDHII

SEQ ID NO: 1285052 - protein, 19 aa, Mycobacterium
WGAACSLIQSIYDGFGSGV

SEQ ID NO: 1285053 - protein, 17 aa, Mycobacterium
WGAGLHSGIVAHYILQY

SEQ ID NO: 1285054 - protein, 33 aa, Mycobacterium
WGALEAVGGQSTWRLGGAFNCGKAQPGQVAAVS

SEQ ID NO: 1285055 - protein, 17 aa, Mycobacterium
WGAVYLCEEVADMGLDF

SEQ ID NO: 1285056 - protein, 17 aa, Mycobacterium
WGCALDRDPEHVVTAMR

SEQ ID NO: 1285057 - protein, 17 aa, Mycobacterium
WGCGRLGNRFDRYTLCG

SEQ ID NO: 1285058 - protein, 27 aa, Mycobacterium
WGDAVFHCPFCHGWEVRDAPVAVLADG

SEQ ID NO: 1285059 - protein, 20 aa, Mycobacterium
WGDCDAVIPVSHGEMAHAAM

SEQ ID NO: 1285060 - protein, 18 aa, Mycobacterium
WGDDEPRVVFLHGGGQNA

SEQ ID NO: 1285061 - protein, 19 aa, Mycobacterium
WGDTEAWRQSRQRTARMSK

SEQ ID NO: 1285062 - protein, 18 aa, Mycobacterium
WGEAVKAVVVAARGAQLT

SEQ ID NO: 1285063 - protein, 18 aa, Mycobacterium
WGEDGARHGFPLPNTLVH

SEQ ID NO: 1285064 - protein, 17 aa, Mycobacterium
WGELSARRDNVVVVLHA

SEQ ID NO: 1285065 - protein, 17 aa, Mycobacterium
WGELVYDGLWFSPLKTA

SEQ ID NO: 1285066 - protein, 22 aa, Mycobacterium
WGEPPAAVADKVDWIRRLAAKQ

SEQ ID NO: 1285067 - protein, 17 aa, Mycobacterium
WGESMSRQAGGRAGGAG

SEQ ID NO: 1285068 - protein, 30 aa, Mycobacterium; identical to SEQ ID NO: 752523

SEQ ID NO: 1285069 - protein, 17 aa, Mycobacterium
WGGFEGVPNTGADPSES

SEQ ID NO: 1285070 - protein, 39 aa, Mycobacterium
WGGGRQWCFERLFLVVAFVNRFIPGFIRQGGSHVLLADV

SEQ ID NO: 1285071 - protein, 30 aa, Mycobacterium
WGGLQRSRLLAGICDTFGLGLSMHSNSHLG

SEQ ID NO: 1285072 - protein, 22 aa, Mycobacterium
WGGTALLRPGVLAFTGSIGTTD

SEQ ID NO: 1285073 - protein, 25 aa, Mycobacterium
WGGYLIAAEVVEFWQGRENRVHNRI

SEQ ID NO: 1285074 - protein, 19 aa, Mycobacterium
WGIAAAMTRGDISVTGVDP

SEQ ID NO: 1285075 - protein, 17 aa, Mycobacterium
WGIAAWNTAYAALYPNI

SEQ ID NO: 1285076 - protein, 17 aa, Mycobacterium
WGKLGYPRRAKRLHECA

SEQ ID NO: 1285077 - protein, 18 aa, Mycobacterium
WGLARLLRIAPVSREMIL

SEQ ID NO: 1285078 - protein, 19 aa, Mycobacterium
WGLGWEELHAANPRLIMLR

SEQ ID NO: 1285079 - protein, 17 aa, Mycobacterium
WGLTEGYGLMVGGSDAD

SEQ ID NO: 1285080 - protein, 20 aa, Mycobacterium
WGLVGVELPAPVVSEESRTA

SEQ ID NO: 1285081 - protein, 18 aa, Mycobacterium
WGLWDQPAVLVAQTYLEA

SEQ ID NO: 1285082 - protein, 21 aa, Mycobacterium
WGPGKARAVQEFAAANDIDLS

SEQ ID NO: 1285083 - protein, 19 aa, Mycobacterium
WGPGPGRGKWAGAGWDRDV

SEQ ID NO: 1285084 - protein, 24 aa, Mycobacterium
WGPIHGCHVFAPILREAGRPAGII

SEQ ID NO: 1285085 - protein, 18 aa, Mycobacterium
WGPLAWMLLAQALGRLDQ

SEQ ID NO: 1285086 - protein, 23 aa, Mycobacterium
WGPQWRRDITIVLAGSAEQFATL

SEQ ID NO: 1285087 - protein, 23 aa, Mycobacterium
WGPRYYQRIGVSFELPNHYLKLT

SEQ ID NO: 1285088 - protein, 29 aa, Mycobacterium
WGPTWSGSLKSLWLGEGEAIGDILVGEEL

SEQ ID NO: 1285089 - protein, 28 aa, Mycobacterium
WGQDSFEFFPNFTLLLWAPGWYLTYNYW

SEQ ID NO: 1285090 - protein, 18 aa, Mycobacterium
WGQIIVAVVVAQPGTEPD

SEQ ID NO: 1285091 - protein, 22 aa, Mycobacterium
WGRFQEAFAALRSWDEQGLLVH

SEQ ID NO: 1285092 - protein, 19 aa, Mycobacterium
WGRQWPRSRPVWLRPGRLR

SEQ ID NO: 1285093 - protein, 25 aa, Mycobacterium
WGSDGWRFRHELLREVAAELAPESV

SEQ ID NO: 1285094 - protein, 26 aa, Mycobacterium
WGSEEQRTRWLPGMAAGELIGCFGLT

SEQ ID NO: 1285095 - protein, 21 aa, Mycobacterium
WGSGFECVSVFLNGDAIPSPD

SEQ ID NO: 1285096 - protein, 18 aa, Mycobacterium
WGSLLGVLYADRHPERVA

SEQ ID NO: 1285097 - protein, 20 aa, Mycobacterium
WGSSDFRRWLPLDMYRPLRS

SEQ ID NO: 1285098 - protein, 19 aa, Mycobacterium
WGSSYGPIGEACRRARRNG

SEQ ID NO: 1285099 - protein, 17 aa, Mycobacterium
WGTFTCRRHVAADDANW

SEQ ID NO: 1285100 - protein, 19 aa, Mycobacterium
WGTGSLLEYLSRNGMLPSQ

SEQ ID NO: 1285101 - protein, 31 aa, Mycobacterium
WGTHSLAPLSFRGAAYSGVFTLMPLLTGRGR

SEQ ID NO: 1285102 - protein, 18 aa, Mycobacterium
WGTLHAGLDIANAVGTPI

SEQ ID NO: 1285103 - protein, 19 aa, Mycobacterium
WGTPRASHLFWAMGDVERA

SEQ ID NO: 1285104 - protein, 28 aa, Mycobacterium
WGYAAGWRLVRAAPEFLARNAFGAGARW

SEQ ID NO: 1285105 - protein, 17 aa, Mycobacterium
WHAAIAVGAQRVMALPE

SEQ ID NO: 1285106 - protein, 21 aa, Mycobacterium
WHAAVKEHRPAVAGLPPAAIR

SEQ ID NO: 1285107 - protein, 30 aa, Mycobacterium
WHAKPVAGVGMGWDPGWRADGGPFAPNISP

SEQ ID NO: 1285108 - protein, 22 aa, Mycobacterium
WHETICDALLDGARKVAVGAGI

SEQ ID NO: 1285109 - protein, 17 aa, Mycobacterium
WHGFCYDAESGECLSAP

SEQ ID NO: 1285110 - protein, 20 aa, Mycobacterium
WHGNIFRLGDHLDRLLDGAR

SEQ ID NO: 1285111 - protein, 17 aa, Mycobacterium
WHLRKVFVKLGITSRRQ

SEQ ID NO: 1285112 - protein, 18 aa, Mycobacterium
WHLRKVFVKLGITSRRQL

SEQ ID NO: 1285113 - protein, 25 aa, Mycobacterium
WHPRGPGQIEVWAWTYVPKDAPPKV

SEQ ID NO: 1285114 - protein, 19 aa, Mycobacterium
WHQHCPVSESVIIAGNPPF

SEQ ID NO: 1285115 - protein, 17 aa, Mycobacterium
WHRDPACTWTFYATTPG

SEQ ID NO: 1285116 - protein, 24 aa, Mycobacterium
WHRKEWEPFWAAAEEAGMVIAFHI

SEQ ID NO: 1285117 - protein, 17 aa, Mycobacterium
WHRSGLQKRWLAASERG

SEQ ID NO: 1285118 - protein, 19 aa, Mycobacterium
WHSLIPTKVRVGGQRRPFS

SEQ ID NO: 1285119 - protein, 20 aa, Mycobacterium
WHTRCPKAASGHPGRNLDSP

SEQ ID NO: 1285120 - protein, 20 aa, Mycobacterium
WHTSACWPPAATHLEWALRA

SEQ ID NO: 1285121 - protein, 25 aa, Mycobacterium
WHTTFPLPAPSAWPAERDRRELTGQ

SEQ ID NO: 1285122 - protein, 21 aa, Mycobacterium
WHVGADRLDLFAVPRLHLRHI

SEQ ID NO: 1285123 - protein, 20 aa, Mycobacterium
WHVQRGDIIFPKSVTPKRIE

SEQ ID NO: 1285124 - protein, 17 aa, Mycobacterium
WHWNYIASRGAWDAPLP

SEQ ID NO: 1285125 - protein, 23 aa, Mycobacterium
WIAEPAVKFLCPAPGYDRHFALT

SEQ ID NO: 1285126 - protein, 20 aa, Mycobacterium
WIAKSADGWITTPRDFTIDE

SEQ ID NO: 1285127 - protein, 17 aa, Mycobacterium
WIAMGRAAIEGRKNDLR

SEQ ID NO: 1285128 - protein, 19 aa, Mycobacterium
WIATQKERFVRITPQSMTG

SEQ ID NO: 1285129 - protein, 18 aa, Mycobacterium
WIDDLRNGAGVKFLCPAP

SEQ ID NO: 1285130 - protein, 25 aa, Mycobacterium
WIDGTSLYSTHRWAPNTAICSSSEY

SEQ ID NO: 1285131 - protein, 20 aa, Mycobacterium
WIDHICAARLLARLGSVEAD

SEQ ID NO: 1285132 - protein, 18 aa, Mycobacterium
WIDQLAVDAGDAAWTPAT

SEQ ID NO: 1285133 - protein, 22 aa, Mycobacterium
WIDTRLQWYVDLGIDRDNLRLF

SEQ ID NO: 1285134 - protein, 24 aa, Mycobacterium
WIEQPVYEGIRFAMPAASIAVCGF

SEQ ID NO: 1285135 - protein, 20 aa, Mycobacterium
WINEPRPLLTTAATDDLSQA

SEQ ID NO: 1285136 - protein, 17 aa, Mycobacterium
WIPPPQLDTGQARINYH

SEQ ID NO: 1285137 - protein, 20 aa, Mycobacterium
WIRHAMHALGWMVPGELKLF

SEQ ID NO: 1285138 - protein, 18 aa, Mycobacterium
WISGIPMSVIIREGTTEQ

SEQ ID NO: 1285139 - protein, 18 aa, Mycobacterium
WITMASAMCTFADPATLV

SEQ ID NO: 1285140 - protein, 20 aa, Mycobacterium
WIVDLDPDYQWAVVTDPTGL

SEQ ID NO: 1285141 - protein, 21 aa, Mycobacterium
WIVYEEEYFRAGAPGRASANG

SEQ ID NO: 1285142 - protein, 18 aa, Mycobacterium
WKAARRGGHDVGRDQVAR

SEQ ID NO: 1285143 - protein, 19 aa, Mycobacterium
WKAAVISLLDSRSPYRPWR

SEQ ID NO: 1285144 - protein, 28 aa, Mycobacterium
WKAGLEASGFRAGCPVLAVAVETNDDAP

SEQ ID NO: 1285145 - protein, 26 aa, Mycobacterium
WKAGPALACGNAFILKPSERDPSVPV

SEQ ID NO: 1285146 - protein, 20 aa, Mycobacterium
WKAYMRRATNTVNYSTELPL

SEQ ID NO: 1285147 - protein, 19 aa, Mycobacterium
WKFIFIGANIDEGGDRRRP

SEQ ID NO: 1285148 - protein, 17 aa, Mycobacterium
WKFRQLRPINTAAAKIG

SEQ ID NO: 1285149 - protein, 24 aa, Mycobacterium
WKKLPAKARRAILEGCDEQVHVRY

SEQ ID NO: 1285150 - protein, 17 aa, Mycobacterium
WKLAMTVVSHEREPSTL

SEQ ID NO: 1285151 - protein, 20 aa, Mycobacterium
WKLGAVPQPLSARLPDAELA

SEQ ID NO: 1285152 - protein, 19 aa, Mycobacterium
WKLLCDGESGVIRVPADRW

SEQ ID NO: 1285153 - protein, 17 aa, Mycobacterium
WKLLKWLDPPAPFYDWR

SEQ ID NO: 1285154 - protein, 17 aa, Mycobacterium
WKMVGHLYKDGIVAVRK

SEQ ID NO: 1285155 - protein, 19 aa, Mycobacterium
WKPDVAVVGAPFDVGTTNR

SEQ ID NO: 1285156 - protein, 18 aa, Mycobacterium
WKPMLGMTGPTVLELEFD

SEQ ID NO: 1285157 - protein, 27 aa, Mycobacterium
WKPSELTPLTAIACQALLQRAAADVGA

SEQ ID NO: 1285158 - protein, 28 aa, Mycobacterium
WKPSELTPLTAIACQALLQRAAADVGAP

SEQ ID NO: 1285159 - protein, 18 aa, Mycobacterium
WKPVAGVHSLVWEEAQLA

SEQ ID NO: 1285160 - protein, 21 aa, Mycobacterium
WKPVGGFPVTVGWIHAIRRAQ

SEQ ID NO: 1285161 - protein, 25 aa, Mycobacterium
WKQNLKVMQRFLLFMTVGLYDPPIR

SEQ ID NO: 1285162 - protein, 17 aa, Mycobacterium
WKRAVVEQSGLPFSRIR

SEQ ID NO: 1285163 - protein, 20 aa, Mycobacterium
WKRVVQIAVDLGVNVINTEF

SEQ ID NO: 1285164 - protein, 24 aa, Mycobacterium
WKSKGLDLSPIFAVPSNAHTGEPA

SEQ ID NO: 1285165 - protein, 21 aa, Mycobacterium
WKSKVEGSGRAAHTGGTKAEQ

SEQ ID NO: 1285166 - protein, 22 aa, Mycobacterium
WKVEIGTNLWVLPRGIRRAGQA

SEQ ID NO: 1285167 - protein, 17 aa, Mycobacterium
WKVKRIRNTPRVTIAKC

SEQ ID NO: 1285168 - protein, 17 aa, Mycobacterium
WKVMIAIPGIAAMLQQR

SEQ ID NO: 1285169 - protein, 22 aa, Mycobacterium
WKYHADCLAQRGLLDGAGELTA

SEQ ID NO: 1285170 - protein, 20 aa, Mycobacterium
WKYLMALFSSKVDEYADPKV

SEQ ID NO: 1285171 - protein, 18 aa, Mycobacterium
WLAADRWAVPLVHTAHTL

SEQ ID NO: 1285172 - protein, 19 aa, Mycobacterium
WLAAELDRDPGLRFVCWVD

SEQ ID NO: 1285173 - protein, 20 aa, Mycobacterium
WLADHIVHGLAVMPGAGFAE

SEQ ID NO: 1285174 - protein, 17 aa, Mycobacterium
WLADTGLHAWVVQRELA

SEQ ID NO: 1285175 - protein, 23 aa, Mycobacterium
WLAEHLKRRWSPSAGGLLVVTHD

SEQ ID NO: 1285176 - protein, 17 aa, Mycobacterium
WLANLVAFSGHRATAAD

SEQ ID NO: 1285177 - protein, 19 aa, Mycobacterium
WLAPQPHPSKIVGVAVNNS

SEQ ID NO: 1285178 - protein, 29 aa, Mycobacterium
WLAPTAAFAASPFRWLTWLSDSRASLTAA

SEQ ID NO: 1285179 - protein, 20 aa, Mycobacterium
WLASGPDLGPWAEARDPEAG

SEQ ID NO: 1285180 - protein, 18 aa, Mycobacterium
WLASRIDGAVTRAVGTLK

SEQ ID NO: 1285181 - protein, 17 aa, Mycobacterium
WLASRQGAGTWVVSSQA

SEQ ID NO: 1285182 - protein, 18 aa, Mycobacterium
WLATYGMWSRELPADLPA

SEQ ID NO: 1285183 - protein, 26 aa, Mycobacterium
WLCVPRPDSPSVFGAILDRGAGHFRL

SEQ ID NO: 1285184 - protein, 17 aa, Mycobacterium
WLDAGLFHLDELPQGDY

SEQ ID NO: 1285185 - protein, 24 aa, Mycobacterium
WLDDAGLATGFWGVACDAGCRAFD

SEQ ID NO: 1285186 - protein, 25 aa, Mycobacterium
WLDDRKWAYVRLEGRAFGDVPLNLE

SEQ ID NO: 1285187 - protein, 17 aa, Mycobacterium
WLDEFGLTALRHRSVGE

SEQ ID NO: 1285188 - protein, 17 aa, Mycobacterium
WLDHPQLGEKFRGTLRV

SEQ ID NO: 1285189 - protein, 18 aa, Mycobacterium
WLDLCAGPGGKTALLAAL

SEQ ID NO: 1285190 - protein, 19 aa, Mycobacterium
WLEGLFHGIQTALFAQQMA

SEQ ID NO: 1285191 - protein, 17 aa, Mycobacterium
WLEQVIRGGTHVFIPSF

SEQ ID NO: 1285192 - protein, 17 aa, Mycobacterium
WLERPEFAGNDMLPSDY

SEQ ID NO: 1285193 - protein, 25 aa, Mycobacterium
WLESVPGGWRRALARQQQGATLVVV

SEQ ID NO: 1285194 - protein, 20 aa, Mycobacterium
WLEVNSPFRPDRRWGGDNTD

SEQ ID NO: 1285195 - protein, 27 aa, Mycobacterium
WLGCEGCPFNLGGCPMRSNAEQLRRVD

SEQ ID NO: 1285196 - protein, 25 aa, Mycobacterium
WLHRLRIVGIDLRDPAQVVALADAV

SEQ ID NO: 1285197 - protein, 17 aa, Mycobacterium
WLHRYGDQEISQFRGAE

SEQ ID NO: 1285198 - protein, 21 aa, Mycobacterium
WLIERLQRPTLVMAPNKTLAA

SEQ ID NO: 1285199 - protein, 19 aa, Mycobacterium
WLKAFRESPEAVVALYADD

SEQ ID NO: 1285200 - protein, 23 aa, Mycobacterium
WLKEVLPNFPAYYHLVGNVDIRI

SEQ ID NO: 1285201 - protein, 21 aa, Mycobacterium
WLKKHREGLESIGAHHVVLYE

SEQ ID NO: 1285202 - protein, 18 aa, Mycobacterium
WLKNRLLLTDLLARHPEI

SEQ ID NO: 1285203 - protein, 21 aa, Mycobacterium
WLLDGHRAWVRISAAATSDWA

SEQ ID NO: 1285204 - protein, 20 aa, Mycobacterium
WLLDPSIPLTEVYQGYAESL

SEQ ID NO: 1285205 - protein, 28 aa, Mycobacterium
WLLERIGQLRGAGWVAHVPMDGFHLADD

SEQ ID NO: 1285206 - protein, 17 aa, Mycobacterium
WLLHAGDSFYHPGTLAG

SEQ ID NO: 1285207 - protein, 29 aa, Mycobacterium
WLLNGQKIWSSRAVFGERAFGLFRSDPEA

SEQ ID NO: 1285208 - protein, 24 aa, Mycobacterium
WLLQCGELPLRLRELAILRIAHTR

SEQ ID NO: 1285209 - protein, 17 aa, Mycobacterium
WLLTPARQRARSAVNAM

SEQ ID NO: 1285210 - protein, 19 aa, Mycobacterium
WLNLPDWPPAMPDVVLHPQ

SEQ ID NO: 1285211 - protein, 32 aa, Mycobacterium
WLNPQVSPSTRFVSWVTGKYVYLDDDTLANTL

SEQ ID NO: 1285212 - protein, 20 aa, Mycobacterium
WLNRLVMELADKAGLSPDRY

SEQ ID NO: 1285213 - protein, 19 aa, Mycobacterium
WLPAHALRSPTAFRKLAPS

SEQ ID NO: 1285214 - protein, 20 aa, Mycobacterium
WLPCFHDMGMVGFLTIPMYF

SEQ ID NO: 1285215 - protein, 20 aa, Mycobacterium
WLPDCGHLLMLERPDEVASI

SEQ ID NO: 1285216 - protein, 27 aa, Mycobacterium
WLPDRSASWVVPWLWRQWSPGYHAAED

SEQ ID NO: 1285217 - protein, 17 aa, Mycobacterium
WLPQLGVPQGFAARPMV

SEQ ID NO: 1285218 - protein, 19 aa, Mycobacterium
WLQEHGVTIWDEWASPTGD

SEQ ID NO: 1285219 - protein, 18 aa, Mycobacterium
WLQFSACVAETIRGRAPF

SEQ ID NO: 1285220 - protein, 21 aa, Mycobacterium
WLQTLAGKWTQLAAEAEKLAA

SEQ ID NO: 1285221 - protein, 20 aa, Mycobacterium
WLRDGIVCPAQLGTAGYLFE

SEQ ID NO: 1285222 - protein, 26 aa, Mycobacterium
WLRHTCGTCRYCLRGQENLCPESRYT

SEQ ID NO: 1285223 - protein, 19 aa, Mycobacterium
WLRPLPDGVAGELYLSGAQ

SEQ ID NO: 1285224 - protein, 19 aa, Mycobacterium
WLRPVPDGVAGELYLSGRQ

SEQ ID NO: 1285225 - protein, 23 aa, Mycobacterium
WLRRAARGDQTWAIARIGVEWWP

SEQ ID NO: 1285226 - protein, 26 aa, Mycobacterium
WLRRRRRRVDARAQLRSAHHLFDSIG

SEQ ID NO: 1285227 - protein, 19 aa, Mycobacterium
WLRRWSMVAPWQPRIPARS

SEQ ID NO: 1285228 - protein, 26 aa, Mycobacterium
WLSLVRLAKCGPWHRGGWDPIPERPD

SEQ ID NO: 1285229 - protein, 19 aa, Mycobacterium
WLSSQLMSAVEAFARGMKV

SEQ ID NO: 1285230 - protein, 17 aa, Mycobacterium
WLSTYGIGMSALDIVRH

SEQ ID NO: 1285231 - protein, 33 aa, Mycobacterium
WLSVSVTRAMNWRLFPAVGQSFFSTGYRALLTF

SEQ ID NO: 1285232 - protein, 23 aa, Mycobacterium
WLTATRARNALVLVRGKPTDQLP

SEQ ID NO: 1285233 - protein, 18 aa, Mycobacterium
WLTEGVADFVGRPPAAEP

SEQ ID NO: 1285234 - protein, 21 aa, Mycobacterium
WLTWHIDYWWSAALASMRARP

SEQ ID NO: 1285235 - protein, 17 aa, Mycobacterium
WLVGRGVGIDQIRGNPA

SEQ ID NO: 1285236 - protein, 20 aa, Mycobacterium
WLVGSARAMLSLARQHALDR

SEQ ID NO: 1285237 - protein, 17 aa, Mycobacterium
WLWTHLRGKSVGEGRAP

SEQ ID NO: 1285238 - protein, 17 aa, Mycobacterium
WMAVAPLFHTAGVSGML

SEQ ID NO: 1285239 - protein, 24 aa, Mycobacterium
WMCPRPSRCVAITIEARVGGRVRF

SEQ ID NO: 1285240 - protein, 26 aa, Mycobacterium
WMLDEPRRPFSWCQGADPSVAELVGD

SEQ ID NO: 1285241 - protein, 25 aa, Mycobacterium
WMPAEFDWVVGCSYTGQPTELAEVR

SEQ ID NO: 1285242 - protein, 25 aa, Mycobacterium
WMPYTRARTFCDLIPDTAIWRPMNR

SEQ ID NO: 1285243 - protein, 21 aa, Mycobacterium
WMRAREALIRTDVFGTQADLD

SEQ ID NO: 1285244 - protein, 17 aa, Mycobacterium
WMSRARRLLAAAEESQA

SEQ ID NO: 1285245 - protein, 18 aa, Mycobacterium
WMSRKGYAAINDFRGLLA

SEQ ID NO: 1285246 - protein, 19 aa, Mycobacterium
WMTCFPGFGMLTAGGVGAA

SEQ ID NO: 1285247 - protein, 26 aa, Mycobacterium
WNAAISVNLWGVIYGCETFVPRLRSN

SEQ ID NO: 1285248 - protein, 19 aa, Mycobacterium
WNADFPFHARKRLAGTRLV

SEQ ID NO: 1285249 - protein, 18 aa, Mycobacterium
WNAGLLYLRGRLEELFLE

SEQ ID NO: 1285250 - protein, 19 aa, Mycobacterium
WNAIRHAKPIAVGLNCALG

SEQ ID NO: 1285251 - protein, 18 aa, Mycobacterium
WNAPDAWTVYLHTADIEA

SEQ ID NO: 1285252 - protein, 31 aa, Mycobacterium
WNARYTWPRFVCALPCEFFAAVRAELDAAGA

SEQ ID NO: 1285253 - protein, 24 aa, Mycobacterium
WNCDKGRWAFTYATVGDRITTPLV

SEQ ID NO: 1285254 - protein, 19 aa, Mycobacterium
WNCPQHITPRFTLEELEPA

SEQ ID NO: 1285255 - protein, 17 aa, Mycobacterium
WNDLVFKDRWRDAIERL

SEQ ID NO: 1285256 - protein, 21 aa, Mycobacterium
WNDRVRRLAGALTDRGVKRGD

SEQ ID NO: 1285257 - protein, 22 aa, Mycobacterium
WNERRYFDLPSIVMPKPGDEAA

SEQ ID NO: 1285258 - protein, 19 aa, Mycobacterium
WNFEKFLLAPGGKVVKRIR

SEQ ID NO: 1285259 - protein, 17 aa, Mycobacterium
WNIERVKGGSMVAGGLF

SEQ ID NO: 1285260 - protein, 19 aa, Mycobacterium
WNKLPSADAITHFAFGCGD

SEQ ID NO: 1285261 - protein, 25 aa, Mycobacterium
WNMIRPELPGIKGLCTQVTAFMDEA

SEQ ID NO: 1285262 - protein, 22 aa, Mycobacterium
WNPNRIEQRFGRIHRIGQEEVC

SEQ ID NO: 1285263 - protein, 21 aa, Mycobacterium
WNPNRIEQRFGRIHRIGQKNV

SEQ ID NO: 1285264 - protein, 23 aa, Mycobacterium
WNPNRLEQRFGRIHRIGQRHTCH

SEQ ID NO: 1285265 - protein, 17 aa, Mycobacterium
WNPSGGILLSHQIGGGT

SEQ ID NO: 1285266 - protein, 22 aa, Mycobacterium
WNRAGSARAWWVLTAAGIGGVR

SEQ ID NO: 1285267 - protein, 19 aa, Mycobacterium
WNRMGAALRRNDAELLGIS

SEQ ID NO: 1285268 - protein, 17 aa, Mycobacterium
WNVLCNQVGVAAIALPE

SEQ ID NO: 1285269 - protein, 17 aa, Mycobacterium
WNWLESVPGGWRRALAR

SEQ ID NO: 1285270 - protein, 22 aa, Mycobacterium
WNYPLPLNIFKVAAALAAGCTV

SEQ ID NO: 1285271 - protein, 19 aa, Mycobacterium
WPAAELIDATIIDTPGTSS

SEQ ID NO: 1285272 - protein, 19 aa, Mycobacterium
WPADAVVVGPLHFEPTTHV

SEQ ID NO: 1285273 - protein, 20 aa, Mycobacterium
WPAFADVPAGWRVVFGESTR

SEQ ID NO: 1285274 - protein, 19 aa, Mycobacterium
WPAFGDALLDLARESAPGS

SEQ ID NO: 1285275 - protein, 20 aa, Mycobacterium
WPALQRWRIVPPLWAAARIL

SEQ ID NO: 1285276 - protein, 25 aa, Mycobacterium
WPALTRPRRAAVSGFGVSGTNAHIV

SEQ ID NO: 1285277 - protein, 20 aa, Mycobacterium
WPAMGRLLADRFRQYPRDHW

SEQ ID NO: 1285278 - protein, 17 aa, Mycobacterium
WPARTPATGQLPAGAAW

SEQ ID NO: 1285279 - protein, 19 aa, Mycobacterium
WPDGARLAVNIAVNIEEGA

SEQ ID NO: 1285280 - protein, 26 aa, Mycobacterium
WPDHGCVGCSLMADHIGNLAHLNARD

SEQ ID NO: 1285281 - protein, 19 aa, Mycobacterium
WPDPEAWLTAVRASPLTGT

SEQ ID NO: 1285282 - protein, 25 aa, Mycobacterium
WPDRPGVAGCAALDGTVLVNLVNTK

SEQ ID NO: 1285283 - protein, 18 aa, Mycobacterium
WPDSADWVGDDGLTASQL

SEQ ID NO: 1285284 - protein, 20 aa, Mycobacterium
WPDSAWWNWNTAFDAIEVDD

SEQ ID NO: 1285285 - protein, 19 aa, Mycobacterium
WPDVDVRVVPAMTAAQAVA

SEQ ID NO: 1285286 - protein, 17 aa, Mycobacterium
WPEGGVDLTGLRVGVIG

SEQ ID NO: 1285287 - protein, 22 aa, Mycobacterium
WPEHAGGLGGPAILRAIVGEEV

SEQ ID NO: 1285288 - protein, 25 aa, Mycobacterium
WPEHGCVGCSLMADHIPNLSHLNAR

SEQ ID NO: 1285289 - protein, 17 aa, Mycobacterium
WPEHIPGTTVNRACGSS

SEQ ID NO: 1285290 - protein, 17 aa, Mycobacterium
WPELDELSAAAMCYTSG

SEQ ID NO: 1285291 - protein, 19 aa, Mycobacterium
WPEPLRSKALAGRAPAKPQ

SEQ ID NO: 1285292 - protein, 17 aa, Mycobacterium
WPEPSGFVADVAAAQRI

SEQ ID NO: 1285293 - protein, 20 aa, Mycobacterium
WPERARAACRYFVLEVRADE

SEQ ID NO: 1285294 - protein, 21 aa, Mycobacterium
WPGATARLEARVCGFEVAGAG

SEQ ID NO: 1285295 - protein, 19 aa, Mycobacterium
WPGESPLRPSYDRVRDDPT

SEQ ID NO: 1285296 - protein, 17 aa, Mycobacterium
WPGILGFEDTVIPQLER

SEQ ID NO: 1285297 - protein, 19 aa, Mycobacterium
WPGLHGVAVTAATPRFEFE

SEQ ID NO: 1285298 - protein, 20 aa, Mycobacterium
WPGLVPEFRRVLPELAPADT

SEQ ID NO: 1285299 - protein, 17 aa, Mycobacterium
WPGRGGKIDTGIDLVAE

SEQ ID NO: 1285300 - protein, 19 aa, Mycobacterium
WPHWASVITKVTWTSPEPR

SEQ ID NO: 1285301 - protein, 25 aa, Mycobacterium
WPIDRRLDAFLLHRGHRRLHDDGSA

SEQ ID NO: 1285302 - protein, 17 aa, Mycobacterium
WPIEAVVTSFYEWQEDN

SEQ ID NO: 1285303 - protein, 25 aa, Mycobacterium
WPINQIACKVFPALATGNTMVLKPS

SEQ ID NO: 1285304 - protein, 24 aa, Mycobacterium
WPKSEHPRRAAVSSFGMGGTNAHI

SEQ ID NO: 1285305 - protein, 17 aa, Mycobacterium
WPLAGAIVSAQDRRAPR

SEQ ID NO: 1285306 - protein, 20 aa, Mycobacterium
WPLGARVVHRLRRIGLEALL

SEQ ID NO: 1285307 - protein, 18 aa, Mycobacterium
WPLSVKGILVTEGVRGDG

SEQ ID NO: 1285308 - protein, 20 aa, Mycobacterium
WPNLTGMQAIDFLAALRGDG

SEQ ID NO: 1285309 - protein, 26 aa, Mycobacterium
WPNREMKTARPFRRSPVHHLLDAAGA

SEQ ID NO: 1285310 - protein, 22 aa, Mycobacterium
WPNVAALCMPFQFPDGTPSAFL

SEQ ID NO: 1285311 - protein, 19 aa, Mycobacterium
WPNVSPRGGVLATQQLVDV

SEQ ID NO: 1285312 - protein, 17 aa, Mycobacterium
WPNWRGEGRRSLAKRLQ

SEQ ID NO: 1285313 - protein, 21 aa, Mycobacterium
WPPGTIARLRRGEPLRAAPPP

SEQ ID NO: 1285314 - protein, 18 aa, Mycobacterium
WPPPHGRAAGPAEQLLID

SEQ ID NO: 1285315 - protein, 19 aa, Mycobacterium
WPQHHWVYRSLLADPPTSA

SEQ ID NO: 1285316 - protein, 20 aa, Mycobacterium
WPQVVKEVAPVPVLAAGGIG

SEQ ID NO: 1285317 - protein, 17 aa, Mycobacterium
WPQWAHPDVVRAFVDRG

SEQ ID NO: 1285318 - protein, 24 aa, Mycobacterium
WPRETLRLGEKYPLKAGLVTSLGF

SEQ ID NO: 1285319 - protein, 22 aa, Mycobacterium
WPRLRNQPRLGLSVLAEDHTAA

SEQ ID NO: 1285320 - protein, 21 aa, Mycobacterium
WPRVLDVWRANLLGSSSKGNE

SEQ ID NO: 1285321 - protein, 19 aa, Mycobacterium
WPSGPQHCAEEAFAHFAQL

SEQ ID NO: 1285322 - protein, 24 aa, Mycobacterium
WPSRLTKARLHFVSGKGGTGKSTI

SEQ ID NO: 1285323 - protein, 20 aa, Mycobacterium
WPTDVKLAAPPVPVIAIPDE

SEQ ID NO: 1285324 - protein, 17 aa, Mycobacterium
WPTKEDLLIGLIGRGFL

SEQ ID NO: 1285325 - protein, 19 aa, Mycobacterium
WPTSVTWSADGSSVIITAD

SEQ ID NO: 1285326 - protein, 18 aa, Mycobacterium
WPVAHGGCDWSLTQHYIF

SEQ ID NO: 1285327 - protein, 19 aa, Mycobacterium
WPVGEVFPVAPKMSEITLE

SEQ ID NO: 1285328 - protein, 18 aa, Mycobacterium
WPVPGDSVVNLVIEQADL

SEQ ID NO: 1285329 - protein, 19 aa, Mycobacterium
WQADWAIEIDRGRLALDGS

SEQ ID NO: 1285330 - protein, 23 aa, Mycobacterium
WQAGVHSRGYRGPVWGRPDGNVS

SEQ ID NO: 1285331 - protein, 18 aa, Mycobacterium
WQDFCAKGRTAHQVVEHP

SEQ ID NO: 1285332 - protein, 20 aa, Mycobacterium
WQDQHGHCEIVFDNVRVPAS

SEQ ID NO: 1285333 - protein, 24 aa, Mycobacterium
WQEDKRWSPTWSDDQRAAGYAGWR

SEQ ID NO: 1285334 - protein, 29 aa, Mycobacterium
WQFLRSEFTGEIYAQWPIDRRLDAFLLHR

SEQ ID NO: 1285335 - protein, 28 aa, Mycobacterium
WQFLRSEFTGSIYADWPIDRRWLHDDGS

SEQ ID NO: 1285336 - protein, 17 aa, Mycobacterium
WQGRSGFALLCVENDYP

SEQ ID NO: 1285337 - protein, 17 aa, Mycobacterium
WQHMRAAAEFGWAISPW

SEQ ID NO: 1285338 - protein, 20 aa, Mycobacterium
WQKRYPGVAVERVVVSDEPA

SEQ ID NO: 1285339 - protein, 19 aa, Mycobacterium
WQLPTRMKFSNIKLSRPVG

SEQ ID NO: 1285340 - protein, 18 aa, Mycobacterium
WQLRDYQQMAADSFWDGG

SEQ ID NO: 1285341 - protein, 24 aa, Mycobacterium
WQNELREKFSLQFEVFENSLLGDS

SEQ ID NO: 1285342 - protein, 22 aa, Mycobacterium
WQPPPSPQRIPATLSPPESVSA

SEQ ID NO: 1285343 - protein, 19 aa, Mycobacterium
WQRRFPDVAVRRVAVLDQP

SEQ ID NO: 1285344 - protein, 18 aa, Mycobacterium
WQRSHVFEYLAGRGIEPN

SEQ ID NO: 1285345 - protein, 19 aa, Mycobacterium
WQRYPECVADLPSTPIPDE

SEQ ID NO: 1285346 - protein, 17 aa, Mycobacterium
WQSTRQLVWSRLDSARC

SEQ ID NO: 1285347 - protein, 25 aa, Mycobacterium
WQTAHVMKRRRGFLPGDTKADNARA

SEQ ID NO: 1285348 - protein, 18 aa, Mycobacterium
WQTPFGVEDIYDWAKATS

SEQ ID NO: 1285349 - protein, 24 aa, Mycobacterium
WQTYPQHRDRLLPSYEAELAAVRA

SEQ ID NO: 1285350 - protein, 28 aa, Mycobacterium
WQVRASYESKPYRGHLMRTYGGTVHSSP

SEQ ID NO: 1285351 - protein, 17 aa, Mycobacterium
WRAAANHFRLRRIDDRW

SEQ ID NO: 1285352 - protein, 19 aa, Mycobacterium
WRAEEVTVIVAPMFHAWGF

SEQ ID NO: 1285353 - protein, 20 aa, Mycobacterium
WRAGPDGCRLSAVLIGTPPP

SEQ ID NO: 1285354 - protein, 30 aa, Mycobacterium
WRANPEKVWAWYLWRHYMMDAVQPNNGHHA

SEQ ID NO: 1285355 - protein, 17 aa, Mycobacterium
WRAQGRRVRLELKHFQR

SEQ ID NO: 1285356 - protein, 17 aa, Mycobacterium
WRATVDLPDDPLLHTLI

SEQ ID NO: 1285357 - protein, 18 aa, Mycobacterium
WRAVSAVDEVFARCGGNG

SEQ ID NO: 1285358 - protein, 19 aa, Mycobacterium
WRCKVGHSITARACGASSR

SEQ ID NO: 1285359 - protein, 17 aa, Mycobacterium
WRDAHRMSIVLGELGDV

SEQ ID NO: 1285360 - protein, 18 aa, Mycobacterium
WRDATVHRLAERFDKAVA

SEQ ID NO: 1285361 - protein, 17 aa, Mycobacterium
WRDGKFRSEVLDAGCGH

SEQ ID NO: 1285362 - protein, 21 aa, Mycobacterium
WRDLAALVLDHRDGWKRAVVE

SEQ ID NO: 1285363 - protein, 18 aa, Mycobacterium
WRDLEVLLQVLPRSSTGE

SEQ ID NO: 1285364 - protein, 18 aa, Mycobacterium
WRDNGFRTYQGVAVPAFP

SEQ ID NO: 1285365 - protein, 26 aa, Mycobacterium
WRDVYKLRQRVLLIWGREDRVNPLDG

SEQ ID NO: 1285366 - protein, 18 aa, Mycobacterium
WREGAEMGLLTLGLDEES

SEQ ID NO: 1285367 - protein, 17 aa, Mycobacterium
WRELTFRAVAERAGVGE

SEQ ID NO: 1285368 - protein, 18 aa, Mycobacterium
WRERFGYTDSFDVLELRA

SEQ ID NO: 1285369 - protein, 17 aa, Mycobacterium
WRETYWAQYWDRKLDDT

SEQ ID NO: 1285370 - protein, 17 aa, Mycobacterium
WREVAGFRTELSKRDCG

SEQ ID NO: 1285371 - protein, 18 aa, Mycobacterium
WRFDGMTAVGPDVLLSLT

SEQ ID NO: 1285372 - protein, 17 aa, Mycobacterium
WRGAAPVQAALAAGDEV

SEQ ID NO: 1285373 - protein, 17 aa, Mycobacterium
WRGHIAHAIAGLPTSAR

SEQ ID NO: 1285374 - protein, 18 aa, Mycobacterium
WRGQRLRALSAITELVAA

SEQ ID NO: 1285375 - protein, 19 aa, Mycobacterium
WRGVGAIRLPAPAARALTE

SEQ ID NO: 1285376 - protein, 18 aa, Mycobacterium
WRHGPTVAADLVLVGRFY

SEQ ID NO: 1285377 - protein, 17 aa, Mycobacterium
WRHRWPEVVVQRRTDEA

SEQ ID NO: 1285378 - protein, 17 aa, Mycobacterium
WRIALPHEEAATFDTAL

SEQ ID NO: 1285379 - protein, 20 aa, Mycobacterium
WRIDPGDTFLVPSPIAHIGG

SEQ ID NO: 1285380 - protein, 25 aa, Mycobacterium
WRIDRLPNGVFLDWQQFQSTYKRNT

SEQ ID NO: 1285381 - protein, 19 aa, Mycobacterium
WRIILHSPYGLRVHGPLAL

SEQ ID NO: 1285382 - protein, 22 aa, Mycobacterium
WRIPGPELKFEERWMPPTHVET

SEQ ID NO: 1285383 - protein, 20 aa, Mycobacterium
WRKVIPRLPGYRCITPTLPL

SEQ ID NO: 1285384 - protein, 20 aa, Mycobacterium
WRLALYKASFGLINLGPSPE

SEQ ID NO: 1285385 - protein, 17 aa, Mycobacterium
WRLANRAGGANVNQLTS

SEQ ID NO: 1285386 - protein, 17 aa, Mycobacterium
WRLARPDDWARHNWIPF

SEQ ID NO: 1285387 - protein, 22 aa, Mycobacterium
WRLGASAVLLSPAWKQAEVGHA

SEQ ID NO: 1285388 - protein, 17 aa, Mycobacterium
WRLHVVQSRTELVDLAA

SEQ ID NO: 1285389 - protein, 24 aa, Mycobacterium
WRMAHVIVGVFAMRSHSHFGGPPA

SEQ ID NO: 1285390 - protein, 17 aa, Mycobacterium
WRMSCEAVVRHSDFGVK

SEQ ID NO: 1285391 - protein, 20 aa, Mycobacterium
WRNHIRDGAALAAALRDRLD

SEQ ID NO: 1285392 - protein, 23 aa, Mycobacterium
WRNRPRVRGELVPFPEAVSRRDG

SEQ ID NO: 1285393 - protein, 19 aa, Mycobacterium
WRNSTRLARDHYVRLDSND

SEQ ID NO: 1285394 - protein, 18 aa, Mycobacterium
WRPAEPMPDDPILNSCLL

SEQ ID NO: 1285395 - protein, 18 aa, Mycobacterium
WRPGESVAAFVERIDAAM

SEQ ID NO: 1285396 - protein, 17 aa, Mycobacterium
WRPWRAYATQHLWTALD

SEQ ID NO: 1285397 - protein, 25 aa, Mycobacterium
WRQADKYDVPRICFVNKMDKLGADF

SEQ ID NO: 1285398 - protein, 17 aa, Mycobacterium
WRQHDIFMTSFGGRSLY

SEQ ID NO: 1285399 - protein, 22 aa, Mycobacterium
WRRAESVGFCAHPIQLIGADEY

SEQ ID NO: 1285400 - protein, 17 aa, Mycobacterium
WRRAFEAARPRAVWLPH

SEQ ID NO: 1285401 - protein, 18 aa, Mycobacterium
WRRCECTASIDAPGYPVT

SEQ ID NO: 1285402 - protein, 18 aa, Mycobacterium
WRRFQIRAELEPPSRSQA

SEQ ID NO: 1285403 - protein, 20 aa, Mycobacterium
WRRHIITACVPIADHIAYRF

SEQ ID NO: 1285404 - protein, 18 aa, Mycobacterium
WRRIPSWEFHRANVDPRR

SEQ ID NO: 1285405 - protein, 19 aa, Mycobacterium
WRRPNRRAPKGVLLPTLRA

SEQ ID NO: 1285406 - protein, 23 aa, Mycobacterium
WRRPNRRAPKGVLLPTLRAPKIA

SEQ ID NO: 1285407 - protein, 20 aa, Mycobacterium
WRRRRPYRWLRQILPDPKYA

SEQ ID NO: 1285408 - protein, 25 aa, Mycobacterium
WRRTFAVNIDSFFRVTKAALEHLPD

SEQ ID NO: 1285409 - protein, 17 aa, Mycobacterium
WRRTSGIHKVRDPRALA

SEQ ID NO: 1285410 - protein, 20 aa, Mycobacterium
WRRTVVSILGPRAFARVRAD

SEQ ID NO: 1285411 - protein, 27 aa, Mycobacterium
WRRVIPLLPGYRCITPTLPMGAHTVPM

SEQ ID NO: 1285412 - protein, 19 aa, Mycobacterium
WRSGSIFLLGDAAHLTPPF

SEQ ID NO: 1285413 - protein, 17 aa, Mycobacterium
WRSIAGPLAARFPESDV

SEQ ID NO: 1285414 - protein, 17 aa, Mycobacterium
WRSPALPEFDPFWRDVE

SEQ ID NO: 1285415 - protein, 19 aa, Mycobacterium
WRSPALPEFDPFWREVEAA

SEQ ID NO: 1285416 - protein, 20 aa, Mycobacterium
WRSRRLREDNVWFVNAPGVP

SEQ ID NO: 1285417 - protein, 17 aa, Mycobacterium
WRTDGYCHCMFTALDTL

SEQ ID NO: 1285418 - protein, 21 aa, Mycobacterium
WRTEIGWPVFRLAAGEPSAQK

SEQ ID NO: 1285419 - protein, 18 aa, Mycobacterium
WRTFAQERLTAMASGSTV

SEQ ID NO: 1285420 - protein, 20 aa, Mycobacterium
WRTIAKLSLPDRFLTDTADD

SEQ ID NO: 1285421 - protein, 17 aa, Mycobacterium
WRTIARSLAGRPAGEIK

SEQ ID NO: 1285422 - protein, 17 aa, Mycobacterium
WRTILAIITGDCPTVRR

SEQ ID NO: 1285423 - protein, 17 aa, Mycobacterium
WRTLRSQDQVVAFTAGD

SEQ ID NO: 1285424 - protein, 26 aa, Mycobacterium
WRTRKYKGACIFLNRPGWPKGIGCAL

SEQ ID NO: 1285425 - protein, 20 aa, Mycobacterium
WRTRYPSVWDGYRAMVGAQG

SEQ ID NO: 1285426 - protein, 22 aa, Mycobacterium
WRTTPAPVRGALVARLGQLLVE

SEQ ID NO: 1285427 - protein, 17 aa, Mycobacterium
WRTYPVDRRRNLLHRHV

SEQ ID NO: 1285428 - protein, 18 aa, Mycobacterium
WRVAGHRGGMLAGGILSS

SEQ ID NO: 1285429 - protein, 18 aa, Mycobacterium
WRVPLAGPDGRQILLEDI

SEQ ID NO: 1285430 - protein, 20 aa, Mycobacterium
WRWVHARAGEIASGSWVDES

SEQ ID NO: 1285431 - protein, 17 aa, Mycobacterium
WRYPDPLAPVAAAERAG

SEQ ID NO: 1285432 - protein, 22 aa, Mycobacterium
WSAAEARFAVHAAMALVVDLGR

SEQ ID NO: 1285433 - protein, 25 aa, Mycobacterium
WSADRAADFLDRWRRAAEMTLAQHD

SEQ ID NO: 1285434 - protein, 17 aa, Mycobacterium
WSAEQQLDHWARVGRAV

SEQ ID NO: 1285435 - protein, 19 aa, Mycobacterium
WSAWAIHWLTRVPCGIEGH

SEQ ID NO: 1285436 - protein, 17 aa, Mycobacterium
WSDLPAHTRERITALRD

SEQ ID NO: 1285437 - protein, 18 aa, Mycobacterium
WSDPARVLVEYAQQRAEW

SEQ ID NO: 1285438 - protein, 18 aa, Mycobacterium
WSDPEIRWIMSTVPTAMI

SEQ ID NO: 1285439 - protein, 24 aa, Mycobacterium
WSDVNAFVLPKLVKVGDWPMAGSP

SEQ ID NO: 1285440 - protein, 18 aa, Mycobacterium
WSEAGKLGFIGVNLPEEY

SEQ ID NO: 1285441 - protein, 25 aa, Mycobacterium
WSGCVTNPVNIRWSAAEIAYALRDS

SEQ ID NO: 1285442 - protein, 24 aa, Mycobacterium
WSGGWRFRHELLREVAAELAPPSV

SEQ ID NO: 1285443 - protein, 21 aa, Mycobacterium
WSGLFNSFFWIDRKAGIGAVI

SEQ ID NO: 1285444 - protein, 19 aa, Mycobacterium
WSGPLPAGSCTCLHHADGH

SEQ ID NO: 1285445 - protein, 21 aa, Mycobacterium
WSGPRAVVILDDLHEIADTPA

SEQ ID NO: 1285446 - protein, 19 aa, Mycobacterium
WSHECRRVRFLDGTTSAGL

SEQ ID NO: 1285447 - protein, 17 aa, Mycobacterium
WSICTSARHRVWSSPRS

SEQ ID NO: 1285448 - protein, 24 aa, Mycobacterium
WSLVGDRPDHEWAGDARIRDVIGG

SEQ ID NO: 1285449 - protein, 27 aa, Mycobacterium
WSMDLLGAGRRARLAGIGTDALTTAVR

SEQ ID NO: 1285450 - protein, 26 aa, Mycobacterium
WSNYAPPALTEWGFRRIAASDSPNKL

SEQ ID NO: 1285451 - protein, 18 aa, Mycobacterium
WSPDEIRDGAQIVDWIVS

SEQ ID NO: 1285452 - protein, 24 aa, Mycobacterium
WSPKRLPDSLLHFMRTRGKNKVIF

SEQ ID NO: 1285453 - protein, 24 aa, Mycobacterium
WSPKRLPDSLLHYMRTRGKGKVIF

SEQ ID NO: 1285454 - protein, 25 aa, Mycobacterium
WSPLQLAYFAGYAMWTYLSEPYSLT

SEQ ID NO: 1285455 - protein, 21 aa, Mycobacterium
WSPVCRACWWDDGAGPQVGAW

SEQ ID NO: 1285456 - protein, 31 aa, Mycobacterium
WSQRAARLTRRWARHTGSPALPMSWRNLSGP

SEQ ID NO: 1285457 - protein, 17 aa, Mycobacterium
WSQWNDRVRRLAGALTD

SEQ ID NO: 1285458 - protein, 18 aa, Mycobacterium
WSRDLDFRYHCLTQLHEA

SEQ ID NO: 1285459 - protein, 19 aa, Mycobacterium
WSRFVAACRRRYGPVFTLR

SEQ ID NO: 1285460 - protein, 18 aa, Mycobacterium
WSRRLGELTRTTARDVTV

SEQ ID NO: 1285461 - protein, 19 aa, Mycobacterium
WSSPLLRVGGRMLAIKGER

SEQ ID NO: 1285462 - protein, 20 aa, Mycobacterium
WSTALLPRIAPTARDGDTPG

SEQ ID NO: 1285463 - protein, 18 aa, Mycobacterium
WSTLTSVVLRVELTGSGR

SEQ ID NO: 1285464 - protein, 17 aa, Mycobacterium
WSTTLAAPGSCWAVCPP

SEQ ID NO: 1285465 - protein, 19 aa, Mycobacterium
WSVGAPVLANAGYKVYTFN

SEQ ID NO: 1285466 - protein, 17 aa, Mycobacterium
WSVSGTGQFLPGDGATP

SEQ ID NO: 1285467 - protein, 24 aa, Mycobacterium
WSYLREVQSTYPLSYGPQSDGSLS

SEQ ID NO: 1285468 - protein, 19 aa, Mycobacterium
WTAGQARFAVYAALAVTTD

SEQ ID NO: 1285469 - protein, 18 aa, Mycobacterium
WTDAGWMYTADQLQFAVQ

SEQ ID NO: 1285470 - protein, 19 aa, Mycobacterium
WTDDPRWLIYLQDTNGDEN

SEQ ID NO: 1285471 - protein, 19 aa, Mycobacterium
WTDTEAAPWTVVKSNDKKR

SEQ ID NO: 1285472 - protein, 17 aa, Mycobacterium
WTEEWFNGHGLHRLRGT

SEQ ID NO: 1285473 - protein, 17 aa, Mycobacterium
WTEVYIPGAGWIGLDPT

SEQ ID NO: 1285474 - protein, 17 aa, Mycobacterium
WTFGAATPREAVAAYRA

SEQ ID NO: 1285475 - protein, 23 aa, Mycobacterium
WTFLSNHAHVLLCLADDPHQTLS

SEQ ID NO: 1285476 - protein, 21 aa, Mycobacterium
WTFPAGSRIRLLIAGGSHPRF

SEQ ID NO: 1285477 - protein, 26 aa, Mycobacterium
WTFRVDGWGDPIATWRRHVIAKLDAG

SEQ ID NO: 1285478 - protein, 18 aa, Mycobacterium
WTGENGWRDEQFADGTIV

SEQ ID NO: 1285479 - protein, 17 aa, Mycobacterium
WTHLRGKSVGEGRAPRR

SEQ ID NO: 1285480 - protein, 21 aa, Mycobacterium
WTIGPGCVAGIDVRWIGSIDG

SEQ ID NO: 1285481 - protein, 18 aa, Mycobacterium
WTKLALEAARARRSAEGA

SEQ ID NO: 1285482 - protein, 17 aa, Mycobacterium
WTKMSFAAAEANFVAAA

SEQ ID NO: 1285483 - protein, 23 aa, Mycobacterium
WTLDPDCRIVLPVLGSDSDVADL

SEQ ID NO: 1285484 - protein, 19 aa, Mycobacterium
WTPEGFIGNLFATMKPYAP

SEQ ID NO: 1285485 - protein, 21 aa, Mycobacterium
WTPEGHIGRLFATMKPYMPPP

SEQ ID NO: 1285486 - protein, 18 aa, Mycobacterium
WTPLTTMRLGELAVESGL

SEQ ID NO: 1285487 - protein, 17 aa, Mycobacterium
WTQPVLWAADLTGDGPC

SEQ ID NO: 1285488 - protein, 17 aa, Mycobacterium
WTQPVVWAADMTGVGPF

SEQ ID NO: 1285489 - protein, 21 aa, Mycobacterium
WTRVGECPHLVIPHTFSNNDN

SEQ ID NO: 1285490 - protein, 24 aa, Mycobacterium
WTRVPYEVLERISTRITNEVREVN

SEQ ID NO: 1285491 - protein, 20 aa, Mycobacterium
WTSLGHRADWCQLFVRTDPD

SEQ ID NO: 1285492 - protein, 17 aa, Mycobacterium
WTSRDVWWAATQDPRSW

SEQ ID NO: 1285493 - protein, 27 aa, Mycobacterium
WTSRMSKSRWGNLIPEVKWVEEKQGEY

SEQ ID NO: 1285494 - protein, 25 aa, Mycobacterium
WTSSPLRPWPGFTPMVYERYSQPFF

SEQ ID NO: 1285495 - protein, 18 aa, Mycobacterium
WTTLSWVDANIWRRVVPK

SEQ ID NO: 1285496 - protein, 22 aa, Mycobacterium
WTVPARLRLVTRMCSTTLDFTS

SEQ ID NO: 1285497 - protein, 17 aa, Mycobacterium
WTYAELNAEIDSLARAL

SEQ ID NO: 1285498 - protein, 39 aa, Mycobacterium
WTYTEFARAGSLPFDGLWLTAPGRPECEICGMERVSDTQ

SEQ ID NO: 1285499 - protein, 19 aa, Mycobacterium
WVAEALWSAGVLTTATRVG

SEQ ID NO: 1285500 - protein, 18 aa, Mycobacterium
WVAEDEVADLPLHPGFAA

SEQ ID NO: 1285501 - protein, 18 aa, Mycobacterium
WVASRKPPLFGINPDARV

SEQ ID NO: 1285502 - protein, 22 aa, Mycobacterium
WVCPAPLRDAPNIVMGHGGGGA

SEQ ID NO: 1285503 - protein, 17 aa, Mycobacterium
WVDRLIVATGRKVNGRR

SEQ ID NO: 1285504 - protein, 36 aa, Mycobacterium
WVDVCSREVIGLVARRLDCQVGLLLTELSEEPGHHT

SEQ ID NO: 1285505 - protein, 18 aa, Mycobacterium
WVEMFGADALRFTLARGA

SEQ ID NO: 1285506 - protein, 18 aa, Mycobacterium
WVERIERGLVRMSTVTRL

SEQ ID NO: 1285507 - protein, 19 aa, Mycobacterium
WVEVYMRPVTFQIVDLAAY

SEQ ID NO: 1285508 - protein, 18 aa, Mycobacterium
WVEYEPYGTVLIIGAWNF

SEQ ID NO: 1285509 - protein, 17 aa, Mycobacterium
WVFKQLWDKGLAYEGNR

SEQ ID NO: 1285510 - protein, 29 aa, Mycobacterium
WVFNYNWQWECFRGADVPTEYAAARSLVF

SEQ ID NO: 1285511 - protein, 25 aa, Mycobacterium
WVGLEVPEYLGGAGATFAETAVICR

SEQ ID NO: 1285512 - protein, 19 aa, Mycobacterium
WVIANRAYTPWYLVRYWRL

SEQ ID NO: 1285513 - protein, 31 aa, Mycobacterium
WVKLAVTRARLSGMPAVFWLDDERPHENELR

SEQ ID NO: 1285514 - protein, 17 aa, Mycobacterium
WVLGPSMTYTCACYPHP

SEQ ID NO: 1285515 - protein, 19 aa, Mycobacterium
WVLSGRDAPPDWAFGGTAS

SEQ ID NO: 1285516 - protein, 20 aa, Mycobacterium
WVLTKGKLPTSMWIEVVTTA

SEQ ID NO: 1285517 - protein, 22 aa, Mycobacterium
WVNDWHMINAMYPFGGVKQSGL

SEQ ID NO: 1285518 - protein, 18 aa, Mycobacterium
WVNLPRKDKFAAPRYQAI

SEQ ID NO: 1285519 - protein, 24 aa, Mycobacterium
WVNPDFLQFGYRTSILKKSSAWVV

SEQ ID NO: 1285520 - protein, 21 aa, Mycobacterium
WVNPIIWNAFLGWTGVDQYDE

SEQ ID NO: 1285521 - protein, 25 aa, Mycobacterium
WVNTHKPEIIGFVAAIGSAGASIAD

SEQ ID NO: 1285522 - protein, 17 aa, Mycobacterium
WVNYLAAPDKLRIANLY

SEQ ID NO: 1285523 - protein, 19 aa, Mycobacterium
WVPAATPLRDAWVPDADLR

SEQ ID NO: 1285524 - protein, 22 aa, Mycobacterium
WVPAATPLRDAWVPDADLRGVR

SEQ ID NO: 1285525 - protein, 24 aa, Mycobacterium
WVPAHFPKDAWALGRFDGTALYEH

SEQ ID NO: 1285526 - protein, 24 aa, Mycobacterium
WVPRGPEHFELFHWSLVERDAPQE

SEQ ID NO: 1285527 - protein, 24 aa, Mycobacterium
WVQPDMRIQPAWCVSVDEAEREFE

SEQ ID NO: 1285528 - protein, 19 aa, Mycobacterium
WVRDYLRDRGLFGTSILWF

SEQ ID NO: 1285529 - protein, 18 aa, Mycobacterium
WVREIFTGVYASDFGLWD

SEQ ID NO: 1285530 - protein, 24 aa, Mycobacterium
WVRNMLAPRLLRVPMIRDGVAGSF

SEQ ID NO: 1285531 - protein, 19 aa, Mycobacterium
WVRSNAWRLDDADYLTMVE

SEQ ID NO: 1285532 - protein, 24 aa, Mycobacterium
WVSQRRALLKLAPELQTALRRGEL

SEQ ID NO: 1285533 - protein, 20 aa, Mycobacterium
WVTGDTFAPVRAILSGSRRS

SEQ ID NO: 1285534 - protein, 19 aa, Mycobacterium
WVTICAAYDRLLGIADSPV

SEQ ID NO: 1285535 - protein, 17 aa, Mycobacterium
WVVACLAIHHAGGVLVP

SEQ ID NO: 1285536 - protein, 24 aa, Mycobacterium
WVVTGAWPRPVMPFDTAYAQPAWS

SEQ ID NO: 1285537 - protein, 17 aa, Mycobacterium
WVVVADLVETSRLFGRT

SEQ ID NO: 1285538 - protein, 18 aa, Mycobacterium
WWAVPTILEHGSPEQVEQ

SEQ ID NO: 1285539 - protein, 24 aa, Mycobacterium
WWDVAIRLLIKYANLRIMTSAWSP

SEQ ID NO: 1285540 - protein, 22 aa, Mycobacterium
WWEMTWKARPDPAVGAWWDGVA

SEQ ID NO: 1285541 - protein, 17 aa, Mycobacterium
WWEMTWQGRPDPSIGEW

SEQ ID NO: 1285542 - protein, 19 aa, Mycobacterium
WWHTARPLPVGSFTDDQAT

SEQ ID NO: 1285543 - protein, 25 aa, Mycobacterium
WWITGAADPRCKILIVMGRTNPDGP

SEQ ID NO: 1285544 - protein, 22 aa, Mycobacterium
WWKEERGARLFVDYNQNARDRT

SEQ ID NO: 1285545 - protein, 20 aa, Mycobacterium
WWLRHVVVSAAHWQRFSKAI

SEQ ID NO: 1285546 - protein, 24 aa, Mycobacterium
WWPHSAAMAMELPDLVGALHPQLG

SEQ ID NO: 1285547 - protein, 25 aa, Mycobacterium
WWPIDELPRDCDFGLTQLAAAAAGS

SEQ ID NO: 1285548 - protein, 19 aa, Mycobacterium
WWRGTGCRGFLPQRSVGPG

SEQ ID NO: 1285549 - protein, 17 aa, Mycobacterium
WWRKQRHRTPDLLTLTR

SEQ ID NO: 1285550 - protein, 28 aa, Mycobacterium
WWRNPPGALDFAAQVGFARRSFDDDRTV

SEQ ID NO: 1285551 - protein, 18 aa, Mycobacterium
WWSDAGWAHRRQAGLTAP

SEQ ID NO: 1285552 - protein, 21 aa, Mycobacterium
WWSVPRGVTTFHTWQETTTVF

SEQ ID NO: 1285553 - protein, 17 aa, Mycobacterium
WWVPDLERSGIGMLEHG

SEQ ID NO: 1285554 - protein, 21 aa, Mycobacterium
WYDNRRLGPTDVESFARQYSE

SEQ ID NO: 1285555 - protein, 19 aa, Mycobacterium
WYEGPVWLERVLRALPAAG

SEQ ID NO: 1285556 - protein, 25 aa, Mycobacterium
WYISRFLSMRAGAFADPASHFHHYS

SEQ ID NO: 1285557 - protein, 18 aa, Mycobacterium
WYNLAAELDEPIPPHLHP

SEQ ID NO: 1285558 - protein, 20 aa, Mycobacterium
WYQVVLAFLAHHVLGQDSEL

SEQ ID NO: 1285559 - protein, 18 aa, Mycobacterium
WYRCTRWDTFAWHTAADW

SEQ ID NO: 1285560 - protein, 27 aa, Mycobacterium
WYRMRVAPSVFAHVWAALKIACAGFNV

SEQ ID NO: 1285561 - protein, 41 aa, Mycobacterium
WYSAMEVLAEYSIDVFTVLPLGELWVAAARMRQVERLRHTL

SEQ ID NO: 1285562 - protein, 24 aa, Mycobacterium
WYSVDLPAVIALREALLPVRDRDR

SEQ ID NO: 1285563 - protein, 17 aa, Mycobacterium
WYTEASLVLDLDGVPQP

SEQ ID NO: 1285564 - protein, 20 aa, Mycobacterium
WYTLFFAGYVRKTWLAEPAD

SEQ ID NO: 1285565 - protein, 18 aa, Mycobacterium
WYVETLRETPGFGAQVKT

SEQ ID NO: 1285566 - protein, 23 aa, Mycobacterium
YAAAARAFKEWKKTTPSQRQKAL

SEQ ID NO: 1285567 - protein, 26 aa, Mycobacterium
YAAACKGRGGAVLVCGESGAGKTSFV

SEQ ID NO: 1285568 - protein, 33 aa, Mycobacterium
YAAACNIYADLGWRGVIPVDPRDKGGVPAGFTG

SEQ ID NO: 1285569 - protein, 20 aa, Mycobacterium
YAAADRILGRLVKVTPSSKV

SEQ ID NO: 1285570 - protein, 20 aa, Mycobacterium
YAAATSRRVAAEAGVKQALV

SEQ ID NO: 1285571 - protein, 28 aa, Mycobacterium
YAADIERLEFLAARGWLIVRVSATQLRY

SEQ ID NO: 1285572 - protein, 24 aa, Mycobacterium
YAAEATRAAGMTFPAAGDTMVYTV

SEQ ID NO: 1285573 - protein, 19 aa, Mycobacterium
YAAINDFRGLLAVPIGTDE

SEQ ID NO: 1285574 - protein, 25 aa, Mycobacterium
YAALEFWSAMHGFVLLEMTGVMSGI

SEQ ID NO: 1285575 - protein, 21 aa, Mycobacterium
YAARGFPGIDACFVGNSHAGP

SEQ ID NO: 1285576 - protein, 22 aa, Mycobacterium
YAATGKPGWFLFDGLVRHDLHT

SEQ ID NO: 1285577 - protein, 17 aa, Mycobacterium
YAAYLWACEHAAELGAD

SEQ ID NO: 1285578 - protein, 18 aa, Mycobacterium
YADAAAYARWAGRRLPTE

SEQ ID NO: 1285579 - protein, 19 aa, Mycobacterium
YADDLPYWVRVHDTEHLVV

SEQ ID NO: 1285580 - protein, 33 aa, Mycobacterium
YADLVFMSATARLKCPFTSLGVAPEAASSYLLP

SEQ ID NO: 1285581 - protein, 18 aa, Mycobacterium
YADPAWAAENGWPAFGDA

SEQ ID NO: 1285582 - protein, 24 aa, Mycobacterium
YADRTHPGLSEWIGANTRFPNSMV

SEQ ID NO: 1285583 - protein, 18 aa, Mycobacterium
YADTFARDAGGWYFTSRA

SEQ ID NO: 1285584 - protein, 34 aa, Mycobacterium
YADVTGLQFGDTVPLTYPFALTFPTVMALVTGFD

SEQ ID NO: 1285585 - protein, 35 aa, Mycobacterium
YADVTGLQFGDTVPLTYPFALTFPTVMALVTGFDF

SEQ ID NO: 1285586 - protein, 19 aa, Mycobacterium
YAEASRVLLRDSILDGMRE

SEQ ID NO: 1285587 - protein, 19 aa, Mycobacterium
YAEFFDIDWTLDPDCRIVL

SEQ ID NO: 1285588 - protein, 21 aa, Mycobacterium
YAEGLRALYLYTAAHQDPAAA

SEQ ID NO: 1285589 - protein, 21 aa, Mycobacterium
YAEGLRALYLYTATFQDTAVA

SEQ ID NO: 1285590 - protein, 19 aa, Mycobacterium
YAEGMDVRRTYDFMGDNAR

SEQ ID NO: 1285591 - protein, 23 aa, Mycobacterium
YAELTPDHWLAAVVRDEMERVGR

SEQ ID NO: 1285592 - protein, 18 aa, Mycobacterium
YAEMLGRAKEHSFAFPAI

SEQ ID NO: 1285593 - protein, 18 aa, Mycobacterium
YAERHGWTVTMLGETTSD

SEQ ID NO: 1285594 - protein, 19 aa, Mycobacterium
YAEYPRFHTLMAEESGEVF

SEQ ID NO: 1285595 - protein, 17 aa, Mycobacterium
YAFADVCVHQDRSLFKG

SEQ ID NO: 1285596 - protein, 19 aa, Mycobacterium
YAFAVLRLAAQRNGDAPPR

SEQ ID NO: 1285597 - protein, 18 aa, Mycobacterium
YAFAVLRLAAQRNGSPPP

SEQ ID NO: 1285598 - protein, 18 aa, Mycobacterium
YAFLPVVRTFASAAGIDV

SEQ ID NO: 1285599 - protein, 17 aa, Mycobacterium
YAFSLMLTFLKGRLQVI

SEQ ID NO: 1285600 - protein, 17 aa, Mycobacterium
YAGADSHDTYAIAERAE

SEQ ID NO: 1285601 - protein, 22 aa, Mycobacterium
YAGAFPAWLAPVQVVGIPVADD

SEQ ID NO: 1285602 - protein, 18 aa, Mycobacterium
YAGLLAIKAFHDANGAPE

SEQ ID NO: 1285603 - protein, 17 aa, Mycobacterium
YAGLTTDTGSFRWASAR

SEQ ID NO: 1285604 - protein, 17 aa, Mycobacterium
YAGNIVIGFGRVDGRPV

SEQ ID NO: 1285605 - protein, 20 aa, Mycobacterium
YAGPRRKAIVALKEHGRTDL

SEQ ID NO: 1285606 - protein, 20 aa, Mycobacterium
YAGRTIVYLRRFDPREWVRL

SEQ ID NO: 1285607 - protein, 18 aa, Mycobacterium
YAGWRKAVQRTMDWVDVD

SEQ ID NO: 1285608 - protein, 29 aa, Mycobacterium
YAHWARRTGAPLARRVAGETARFLIHDLG

SEQ ID NO: 1285609 - protein, 26 aa, Mycobacterium
YAHWARRTGNPLAHRVVDETVRFLIE

SEQ ID NO: 1285610 - protein, 18 aa, Mycobacterium
YAIAASGPVYDAARSAFR

SEQ ID NO: 1285611 - protein, 23 aa, Mycobacterium
YAIPEARGLVYTEYVRLIDLIAD

SEQ ID NO: 1285612 - protein, 22 aa, Mycobacterium
YALAPRRRFPAAPQQIYDIVCW

SEQ ID NO: 1285613 - protein, 17 aa, Mycobacterium
YALDGELTFIQQEDEFF

SEQ ID NO: 1285614 - protein, 28 aa, Mycobacterium
YALNEARPGCRLEILAGVGHFPHVEKPT

SEQ ID NO: 1285615 - protein, 22 aa, Mycobacterium
YALRWPIDRRAGAVHDEAAADA

SEQ ID NO: 1285616 - protein, 38 aa, Mycobacterium
YALTYPRRLGFGLGETVVSLAWRTGDDIVVSRKDPQHP

SEQ ID NO: 1285617 - protein, 25 aa, Mycobacterium
YANAIKVLAVREVMRLLDGQAAGPA

SEQ ID NO: 1285618 - protein, 18 aa, Mycobacterium
YANLRTMVRFDHAFESAR

SEQ ID NO: 1285619 - protein, 17 aa, Mycobacterium
YAPGLYPMDFHAVGEAF

SEQ ID NO: 1285620 - protein, 18 aa, Mycobacterium
YAPTHGRDELVAGLMVDA

SEQ ID NO: 1285621 - protein, 19 aa, Mycobacterium
YAPTVCGLATFSAALAGGL

SEQ ID NO: 1285622 - protein, 31 aa, Mycobacterium; identical to SEQ ID NO: 754913

SEQ ID NO: 1285623 - protein, 23 aa, Mycobacterium
YAQRLAAKNIRVMAIAPTGVNTA

SEQ ID NO: 1285624 - protein, 30 aa, Mycobacterium
YARAMGPMQFLPGTWARYASDGDGDGRADV

SEQ ID NO: 1285625 - protein, 17 aa, Mycobacterium
YARICVSAAVAAEVAAG

SEQ ID NO: 1285626 - protein, 17 aa, Mycobacterium
YARIGFTEIASFATVLL

SEQ ID NO: 1285627 - protein, 25 aa, Mycobacterium
YARMSGKPAAVLLHLGPGLGNGLAN

SEQ ID NO: 1285628 - protein, 18 aa, Mycobacterium
YARNVLSWAGGYATGVVP

SEQ ID NO: 1285629 - protein, 23 aa, Mycobacterium
YARPADTFVAAFVGSPKMNLIDG

SEQ ID NO: 1285630 - protein, 24 aa, Mycobacterium
YARQRPGLLVDWLAGDPADLDDDL

SEQ ID NO: 1285631 - protein, 18 aa, Mycobacterium
YARRFLDGAVPLASGSWS

SEQ ID NO: 1285632 - protein, 23 aa, Mycobacterium
YARSEGGGMLVLKRLADARRDGD

SEQ ID NO: 1285633 - protein, 24 aa, Mycobacterium
YASATFPWYLVGRQVHVHGAVTKV

SEQ ID NO: 1285634 - protein, 19 aa, Mycobacterium
YATATAWLDRQGVLNLIDE

SEQ ID NO: 1285635 - protein, 18 aa, Mycobacterium
YATLRKLLAVPLLLGAES

SEQ ID NO: 1285636 - protein, 17 aa, Mycobacterium
YATPRLVSVGGETADVT

SEQ ID NO: 1285637 - protein, 20 aa, Mycobacterium
YAVCDDRRTLLWLANQRAIE

SEQ ID NO: 1285638 - protein, 18 aa, Mycobacterium
YAVGLPWDSYESCAHNLG

SEQ ID NO: 1285639 - protein, 17 aa, Mycobacterium
YAVHWRPGAVEFSIDGV

SEQ ID NO: 1285640 - protein, 17 aa, Mycobacterium
YAVLAVIVAEAMAELDQ

SEQ ID NO: 1285641 - protein, 28 aa, Mycobacterium
YAVSGIVGGAAWDGLKAIGRRISQADQS

SEQ ID NO: 1285642 - protein, 25 aa, Mycobacterium
YAVTPSGFEWEVGWNPIVVDEATWE

SEQ ID NO: 1285643 - protein, 18 aa, Mycobacterium
YAVTVFAEMSALAARIGA

SEQ ID NO: 1285644 - protein, 21 aa, Mycobacterium
YAWGTIWTRPGLDLRSRSMIT

SEQ ID NO: 1285645 - protein, 20 aa, Mycobacterium
YAYEGIVPAWEWARRTGDDD

SEQ ID NO: 1285646 - protein, 20 aa, Mycobacterium
YAYEGIVPAWEWARRTGNED

SEQ ID NO: 1285647 - protein, 17 aa, Mycobacterium
YCAAKSGLISLVKTLGR

SEQ ID NO: 1285648 - protein, 19 aa, Mycobacterium
YCDHMDFGFVANTAAISDV

SEQ ID NO: 1285649 - protein, 17 aa, Mycobacterium
YCEPKSILLPFGYTPAT

SEQ ID NO: 1285650 - protein, 22 aa, Mycobacterium
YCGFPKALNAIFVAKRVFAERD

SEQ ID NO: 1285651 - protein, 17 aa, Mycobacterium
YCKERLGLDKALGSIDR

SEQ ID NO: 1285652 - protein, 21 aa, Mycobacterium
YCMGGRTSLVLAGRLPDRVSA

SEQ ID NO: 1285653 - protein, 20 aa, Mycobacterium
YCRICEALCGLIATVEDGRL

SEQ ID NO: 1285654 - protein, 25 aa, Mycobacterium
YCVRLKKALQVEGIAWTEVDIERDP

SEQ ID NO: 1285655 - protein, 17 aa, Mycobacterium
YCVVDARAWLRDPAPLF

SEQ ID NO: 1285656 - protein, 29 aa, Mycobacterium
YCYQAAKRITGICACGHQGVLPGIIDNRP

SEQ ID NO: 1285657 - protein, 26 aa, Mycobacterium
YDAAPLGRICLCRVHEGCIEEDFIGE

SEQ ID NO: 1285658 - protein, 19 aa, Mycobacterium
YDAGLHWFRSALAARSPEE

SEQ ID NO: 1285659 - protein, 19 aa, Mycobacterium
YDALDDFGGCLLVVSHDRV

SEQ ID NO: 1285660 - protein, 18 aa, Mycobacterium
YDAMKAVVDRGVAELGRL

SEQ ID NO: 1285661 - protein, 24 aa, Mycobacterium
YDATEIDEILTLRVMTMTDEEKAQ

SEQ ID NO: 1285662 - protein, 17 aa, Mycobacterium
YDAVLIGAGVRMVAGNT

SEQ ID NO: 1285663 - protein, 20 aa, Mycobacterium
YDCTSTRKLRDWLVCRAIDC

SEQ ID NO: 1285664 - protein, 26 aa, Mycobacterium
YDEALWKMLCEQVGAAALVVPEELGG

SEQ ID NO: 1285665 - protein, 19 aa, Mycobacterium
YDEDPRLGSAVVNEPGLVI

SEQ ID NO: 1285666 - protein, 23 aa, Mycobacterium
YDELRLDFHMSYDAAPLGRICLC

SEQ ID NO: 1285667 - protein, 18 aa, Mycobacterium
YDEPWGWMQPTRHALGAL

SEQ ID NO: 1285668 - protein, 24 aa, Mycobacterium
YDERGCGLSDWEVGAFTFDDWVTD

SEQ ID NO: 1285669 - protein, 25 aa, Mycobacterium
YDFGCKRPTLSNVYYRTFTKPHVHL

SEQ ID NO: 1285670 - protein, 19 aa, Mycobacterium
YDFVREIIEQGAIPDDVTI

SEQ ID NO: 1285671 - protein, 18 aa, Mycobacterium
YDGFPIRPLYTGADELAE

SEQ ID NO: 1285672 - protein, 19 aa, Mycobacterium
YDGIVLPVTRVVHGRDDDG

SEQ ID NO: 1285673 - protein, 18 aa, Mycobacterium
YDGMSASVSRLWRRDIKT

SEQ ID NO: 1285674 - protein, 17 aa, Mycobacterium
YDGPRHFDYKPSRTEDA

SEQ ID NO: 1285675 - protein, 27 aa, Mycobacterium
YDGVLGRLWLARGGTYVLANIRGGGEY

SEQ ID NO: 1285676 - protein, 27 aa, Mycobacterium
YDIIQPEHGWVFRDLITGRFVYTPDEL

SEQ ID NO: 1285677 - protein, 25 aa, Mycobacterium
YDIPPRSVVPIEWETIRALAGHPNI

SEQ ID NO: 1285678 - protein, 18 aa, Mycobacterium
YDIVNGRPHLRVENRVLP

SEQ ID NO: 1285679 - protein, 27 aa, Mycobacterium
YDKAFPEAARIMALRGAQVIASLSAWP

SEQ ID NO: 1285680 - protein, 17 aa, Mycobacterium
YDLANRGLLPASFSLVG

SEQ ID NO: 1285681 - protein, 20 aa, Mycobacterium
YDLNAGFPLITTKKVHTKSI

SEQ ID NO: 1285682 - protein, 28 aa, Mycobacterium
YDLPPSQANFVWLPLVGRAQQFAADAAN

SEQ ID NO: 1285683 - protein, 19 aa, Mycobacterium
YDLSMYLRPSRYAEADKFY

SEQ ID NO: 1285684 - protein, 19 aa, Mycobacterium
YDLTARTAVKIMEDDDITG

SEQ ID NO: 1285685 - protein, 18 aa, Mycobacterium
YDNAFALSNFNSDDMDDF

SEQ ID NO: 1285686 - protein, 24 aa, Mycobacterium
YDPDIAVRLIVWFPDDEHAVIALF

SEQ ID NO: 1285687 - protein, 18 aa, Mycobacterium
YDPLGGLDEDVWKREYWP

SEQ ID NO: 1285688 - protein, 25 aa, Mycobacterium
YDPSVGSALSWLLTLAHRRAVDRVR

SEQ ID NO: 1285689 - protein, 22 aa, Mycobacterium
YDPWFAKARTSGSIEAREMDEG

SEQ ID NO: 1285690 - protein, 17 aa, Mycobacterium
YDRAGQRAGNSFTSGLR

SEQ ID NO: 1285691 - protein, 17 aa, Mycobacterium
YDRLCAQLVEAGTFKKL

SEQ ID NO: 1285692 - protein, 24 aa, Mycobacterium
YDRMLDVPRLLSFHNLVEDEAPHP

SEQ ID NO: 1285693 - protein, 17 aa, Mycobacterium
YDRPATVFVASFIGQAN

SEQ ID NO: 1285694 - protein, 26 aa, Mycobacterium
YDRWHSLARLAIRDDIYGSLRALCFD

SEQ ID NO: 1285695 - protein, 26 aa, Mycobacterium
YDSTRRFSVAVGHRLTPDSEPVLTKP

SEQ ID NO: 1285696 - protein, 20 aa, Mycobacterium
YDTAPELLLLNEIWKLQSML

SEQ ID NO: 1285697 - protein, 19 aa, Mycobacterium
YEAANGFAPPGAELSGHVV

SEQ ID NO: 1285698 - protein, 18 aa, Mycobacterium
YEAFCGVVSDAAADAAAD

SEQ ID NO: 1285699 - protein, 17 aa, Mycobacterium
YEAFCGVVSDAAAEAAA

SEQ ID NO: 1285700 - protein, 23 aa, Mycobacterium
YEALPGYDRVGLRRTLLGCWGSF

SEQ ID NO: 1285701 - protein, 22 aa, Mycobacterium
YEALQLALLSARDELIVALREQ

SEQ ID NO: 1285702 - protein, 19 aa, Mycobacterium
YEALRARRVLAQWRDAAAT

SEQ ID NO: 1285703 - protein, 20 aa, Mycobacterium
YEALVGYSRAVRIGNQVLVA

SEQ ID NO: 1285704 - protein, 19 aa, Mycobacterium
YEAQFATNHLGHFQLTNGL

SEQ ID NO: 1285705 - protein, 17 aa, Mycobacterium
YEARKRVVEFLTQRLVE

SEQ ID NO: 1285706 - protein, 19 aa, Mycobacterium
YEDAGRIAADPAYGRIVCF

SEQ ID NO: 1285707 - protein, 26 aa, Mycobacterium
YEDVTGRLRVRWVPQRVLQGVSYDTP

SEQ ID NO: 1285708 - protein, 17 aa, Mycobacterium
YEEPRVLVMPAEHPLAG

SEQ ID NO: 1285709 - protein, 17 aa, Mycobacterium
YEEVLGLEVIQPSSRSM

SEQ ID NO: 1285710 - protein, 18 aa, Mycobacterium
YEFFYDVVHVERMAWRYD

SEQ ID NO: 1285711 - protein, 24 aa, Mycobacterium
YEGFMRDVPCPECDGTRLKPEILA

SEQ ID NO: 1285712 - protein, 23 aa, Mycobacterium
YEGLPVDGYTAWLEKMAADDRIE

SEQ ID NO: 1285713 - protein, 17 aa, Mycobacterium
YEGPKGGPGMREMLAIT

SEQ ID NO: 1285714 - protein, 24 aa, Mycobacterium
YEGRAEAVLAWLRRYPAAEFTPPD

SEQ ID NO: 1285715 - protein, 17 aa, Mycobacterium
YEGYLLYPYRATSGKNQ

SEQ ID NO: 1285716 - protein, 21 aa, Mycobacterium
YEHACAADLGPLVNPVPAQRA

SEQ ID NO: 1285717 - protein, 29 aa, Mycobacterium
YEHSYPHCWRCRNPLIYRAVSSWFIKVTQ

SEQ ID NO: 1285718 - protein, 19 aa, Mycobacterium
YEINEAFAVQVLGSARELG

SEQ ID NO: 1285719 - protein, 30 aa, Mycobacterium
YEIRGPGGVVWRVDLAWPDQRVVAEYESVD

SEQ ID NO: 1285720 - protein, 24 aa, Mycobacterium
YEKLEAFANFGFPESHSLSFASLV

SEQ ID NO: 1285721 - protein, 20 aa, Mycobacterium
YEKSATFPMPGVKPPIGPPD

SEQ ID NO: 1285722 - protein, 22 aa, Mycobacterium
YEKTCATFDWAAAPNLCAEMGP

SEQ ID NO: 1285723 - protein, 18 aa, Mycobacterium
YELAPKIRVNGVAPGGTV

SEQ ID NO: 1285724 - protein, 19 aa, Mycobacterium
YELEIRPTLGDGRTPDVDD

SEQ ID NO: 1285725 - protein, 26 aa, Mycobacterium
YELERKAVFRRAWLNVGRVEQIPRKG

SEQ ID NO: 1285726 - protein, 35 aa, Mycobacterium
YELMHASRVYGCIDWCVGMFKTPSGPQAWVVSSEG

SEQ ID NO: 1285727 - protein, 17 aa, Mycobacterium
YELPALLEVVFHRGSKM

SEQ ID NO: 1285728 - protein, 17 aa, Mycobacterium
YELPVLGVDVVEVAPPY

SEQ ID NO: 1285729 - protein, 24 aa, Mycobacterium
YELQRRLAPRGKTIAVAAHPGTSS

SEQ ID NO: 1285730 - protein, 17 aa, Mycobacterium
YELWIAGAHEEARAIHY

SEQ ID NO: 1285731 - protein, 17 aa, Mycobacterium
YEMARAVLRDTRFTIPP

SEQ ID NO: 1285732 - protein, 22 aa, Mycobacterium
YEPDLLTILAVALREVDTIEVA

SEQ ID NO: 1285733 - protein, 25 aa, Mycobacterium
YEPKWDGFRSICFRDGEEVELGSRH

SEQ ID NO: 1285734 - protein, 19 aa, Mycobacterium
YEPLMKRLPADTPVYGIER

SEQ ID NO: 1285735 - protein, 29 aa, Mycobacterium
YEQALRAVTFWANQGGWTTRTIAVTVTDN

SEQ ID NO: 1285736 - protein, 18 aa, Mycobacterium
YERGDHRGAEAIRTAADQ

SEQ ID NO: 1285737 - protein, 17 aa, Mycobacterium
YERISGLRFDDWIGVSA

SEQ ID NO: 1285738 - protein, 24 aa, Mycobacterium
YESEGFVRVGIRKRYYRVSGADAY

SEQ ID NO: 1285739 - protein, 17 aa, Mycobacterium
YESRPGDVISLGATSWR

SEQ ID NO: 1285740 - protein, 18 aa, Mycobacterium
YESWWRRAESVGFCAHPI

SEQ ID NO: 1285741 - protein, 24 aa, Mycobacterium
YETPEFEAANFLQGIAGTLELFHR

SEQ ID NO: 1285742 - protein, 17 aa, Mycobacterium
YETSSPEQVRWVLEDSG

SEQ ID NO: 1285743 - protein, 26 aa, Mycobacterium
YEVAELQGRVTPLAQWGYGENWSAQP

SEQ ID NO: 1285744 - protein, 23 aa, Mycobacterium
YEVEIGLVIGRDIPVGTTLTDAN

SEQ ID NO: 1285745 - protein, 22 aa, Mycobacterium
YEVGSVKQFFSIGLVNTKAVYS

SEQ ID NO: 1285746 - protein, 19 aa, Mycobacterium
YEVPEAMAAEVEQALPGSR

SEQ ID NO: 1285747 - protein, 19 aa, Mycobacterium
YEYGFFWYLYNDASIEMEV

SEQ ID NO: 1285748 - protein, 18 aa, Mycobacterium
YFAAYNLVCGPVVDEENH

SEQ ID NO: 1285749 - protein, 20 aa, Mycobacterium
YFAESFVKRGLVVDGGGCYL

SEQ ID NO: 1285750 - protein, 19 aa, Mycobacterium
YFAFWNKWDPGAISSQHGH

SEQ ID NO: 1285751 - protein, 18 aa, Mycobacterium
YFALTMLPGGRRAASVTG

SEQ ID NO: 1285752 - protein, 17 aa, Mycobacterium
YFDHLRSKCPVVREPHY

SEQ ID NO: 1285753 - protein, 18 aa, Mycobacterium
YFEKPRTTIGWKGLINDP

SEQ ID NO: 1285754 - protein, 17 aa, Mycobacterium
YFEMLGRPWRDARRLTV

SEQ ID NO: 1285755 - protein, 19 aa, Mycobacterium
YFFSARSFHRADFPTVTLT

SEQ ID NO: 1285756 - protein, 19 aa, Mycobacterium
YFGDNRMYLIGPRPAVLQN

SEQ ID NO: 1285757 - protein, 22 aa, Mycobacterium
YFHLPAELIGGGTREIQLNIIA

SEQ ID NO: 1285758 - protein, 17 aa, Mycobacterium
YFLGSSEGLIFDVANAN

SEQ ID NO: 1285759 - protein, 18 aa, Mycobacterium
YFLTAAVVPAMLLRGRGA

SEQ ID NO: 1285760 - protein, 21 aa, Mycobacterium
YFMAKRIIKMITAVGDTVNAD

SEQ ID NO: 1285761 - protein, 25 aa, Mycobacterium
YFQAYSAACALHFVEKALVEIRAGR

SEQ ID NO: 1285762 - protein, 24 aa, Mycobacterium
YFQMPLVPGLGFAGGETMIEPWVF

SEQ ID NO: 1285763 - protein, 32 aa, Mycobacterium
YFRDHGWSLKVPRRLKELNVRLNSARSELTHQ

SEQ ID NO: 1285764 - protein, 27 aa, Mycobacterium
YFRFLKSKLRPGGLLLNHCITRHNNRT

SEQ ID NO: 1285765 - protein, 23 aa, Mycobacterium
YFSAPKMAWIRSHLTRAGVVTTT

SEQ ID NO: 1285766 - protein, 24 aa, Mycobacterium
YFSAPKMAWLRAGLTRSGVVTTTD

SEQ ID NO: 1285767 - protein, 21 aa, Mycobacterium
YFTFYLCDLLLKVNGKGGQPV

SEQ ID NO: 1285768 - protein, 18 aa, Mycobacterium
YFTSTGRATGEWAAATAR

SEQ ID NO: 1285769 - protein, 20 aa, Mycobacterium
YFTTLQKFGLSKAERESGAD

SEQ ID NO: 1285770 - protein, 19 aa, Mycobacterium
YFVYRLIKRLKKSANNAPY

SEQ ID NO: 1285771 - protein, 23 aa, Mycobacterium
YGAALDFYRTVFGWTTETVSDTD

SEQ ID NO: 1285772 - protein, 18 aa, Mycobacterium
YGAALPWPSRGGEDSAHR

SEQ ID NO: 1285773 - protein, 23 aa, Mycobacterium
YGACPECTGLGIRKEVDPDLVVP

SEQ ID NO: 1285774 - protein, 19 aa, Mycobacterium
YGAEWLRIVRRLLAGERTT

SEQ ID NO: 1285775 - protein, 20 aa, Mycobacterium
YGAGHGEEPGPLPWYKRPPV

SEQ ID NO: 1285776 - protein, 24 aa, Mycobacterium
YGAHLRVNVLPIYGGASYVPQLSG

SEQ ID NO: 1285777 - protein, 19 aa, Mycobacterium
YGAISAPTLVVWTSDDPTA

SEQ ID NO: 1285778 - protein, 17 aa, Mycobacterium
YGALGIRGADGTWASFV

SEQ ID NO: 1285779 - protein, 26 aa, Mycobacterium
YGAPKELSIQFVFAYDGGEFAETLRA

SEQ ID NO: 1285780 - protein, 22 aa, Mycobacterium
YGASPRASLGIIAASRALALVR

SEQ ID NO: 1285781 - protein, 17 aa, Mycobacterium
YGDFAALDNVDFVVPAG

SEQ ID NO: 1285782 - protein, 23 aa, Mycobacterium
YGDPSGPVVLWFHGTPGGRRQLP

SEQ ID NO: 1285783 - protein, 24 aa, Mycobacterium
YGDRKAADVARAFEFGALATSALL

SEQ ID NO: 1285784 - protein, 19 aa, Mycobacterium
YGDRLPVVLLDGAEHSYWE

SEQ ID NO: 1285785 - protein, 18 aa, Mycobacterium
YGEDLVFTAEVDVRPEIT

SEQ ID NO: 1285786 - protein, 23 aa, Mycobacterium
YGETKLIGEWLLRDAGRASGLRH

SEQ ID NO: 1285787 - protein, 19 aa, Mycobacterium
YGEVLLVYVGENGPQATVY

SEQ ID NO: 1285788 - protein, 20 aa, Mycobacterium
YGEVMRWALLGSEERMTAAT

SEQ ID NO: 1285789 - protein, 18 aa, Mycobacterium
YGEYRIVDLLGRRNAADS

SEQ ID NO: 1285790 - protein, 21 aa, Mycobacterium
YGFCACLRMLASHRPSRLHHV

SEQ ID NO: 1285791 - protein, 22 aa, Mycobacterium
YGFCACLRMLASHRPSRLHHVA

SEQ ID NO: 1285792 - protein, 19 aa, Mycobacterium
YGGAIYIGDPYLRTYGDYI

SEQ ID NO: 1285793 - protein, 22 aa, Mycobacterium
YGGRPGAAALRLLILHDDADRE

SEQ ID NO: 1285794 - protein, 17 aa, Mycobacterium
YGGWARHGGGAFSGKDP

SEQ ID NO: 1285795 - protein, 36 aa, Mycobacterium
YGICALSAKHSIMFLCAAHMWLGASAINADNPSDLI

SEQ ID NO: 1285796 - protein, 18 aa, Mycobacterium
YGIPEYKLEKSILNQRLA

SEQ ID NO: 1285797 - protein, 25 aa, Mycobacterium
YGKHHRIGFPFNWVTNLADDASGSW

SEQ ID NO: 1285798 - protein, 18 aa, Mycobacterium
YGKPQYWPLWEAAVDAGW

SEQ ID NO: 1285799 - protein, 26 aa, Mycobacterium
YGKVIPGREGEAWFLDEFGGFGKVAL

SEQ ID NO: 1285800 - protein, 20 aa, Mycobacterium
YGLAWNRRNWPTVSVAKEVV

SEQ ID NO: 1285801 - protein, 17 aa, Mycobacterium
YGLRTDWLKNVLAGGPT

SEQ ID NO: 1285802 - protein, 30 aa, Mycobacterium
YGMVSPTVFWPIPRVYSGLVRIDRYETSPW

SEQ ID NO: 1285803 - protein, 25 aa, Mycobacterium
YGPEVIAALTVCWTVLGMPAGKRLA

SEQ ID NO: 1285804 - protein, 19 aa, Mycobacterium
YGPGGAWKELADRGADARP

SEQ ID NO: 1285805 - protein, 17 aa, Mycobacterium
YGPGVAKVDFVLSGEIP

SEQ ID NO: 1285806 - protein, 18 aa, Mycobacterium
YGPIWDWQRSHVFEYLAG

SEQ ID NO: 1285807 - protein, 19 aa, Mycobacterium
YGPLPSQLLDVWRPKELPA

SEQ ID NO: 1285808 - protein, 17 aa, Mycobacterium
YGPTFTLNIPVFGETVV

SEQ ID NO: 1285809 - protein, 19 aa, Mycobacterium
YGQIRTWWKATADAIEACE

SEQ ID NO: 1285810 - protein, 19 aa, Mycobacterium
YGRDGFLPTRLTVDLFKAA

SEQ ID NO: 1285811 - protein, 17 aa, Mycobacterium
YGRGFLAPRDSLRQRCL

SEQ ID NO: 1285812 - protein, 20 aa, Mycobacterium
YGRIGRAVARRARAFDMTVL

SEQ ID NO: 1285813 - protein, 21 aa, Mycobacterium
YGRRLYELMSAYWPTADKTPD

SEQ ID NO: 1285814 - protein, 17 aa, Mycobacterium
YGSAGFAVLERTIAELR

SEQ ID NO: 1285815 - protein, 23 aa, Mycobacterium
YGSASILPITWAYIRMMGAQGLR

SEQ ID NO: 1285816 - protein, 25 aa, Mycobacterium
YGSDGARAWYARSGVVLESLGDLRS

SEQ ID NO: 1285817 - protein, 20 aa, Mycobacterium
YGSLVHGFANFFPLGGASAT

SEQ ID NO: 1285818 - protein, 19 aa, Mycobacterium
YGSSVVGFQDGWRGLLEDR

SEQ ID NO: 1285819 - protein, 17 aa, Mycobacterium
YGSVGFAQYQFVVPTEA

SEQ ID NO: 1285820 - protein, 18 aa, Mycobacterium
YGTHPTMRAFEQDFPSVQ

SEQ ID NO: 1285821 - protein, 27 aa, Mycobacterium
YGTRPRPGALFTEIMGALPVIEHTRSH

SEQ ID NO: 1285822 - protein, 23 aa, Mycobacterium
YGVHFCLGAALARMEINSLFSEL

SEQ ID NO: 1285823 - protein, 25 aa, Mycobacterium
YGVRRSRRITALVGRYRDVDLVGLQ

SEQ ID NO: 1285824 - protein, 19 aa, Mycobacterium
YGVSTDWLGMVVEAVSGQT

SEQ ID NO: 1285825 - protein, 25 aa, Mycobacterium
YGYDALVASLTFLAVAGRRVQEEIF

SEQ ID NO: 1285826 - protein, 17 aa, Mycobacterium
YGYDYGYGYGRDSNNPW

SEQ ID NO: 1285827 - protein, 18 aa, Mycobacterium
YHALRASNRIAIERGTAF

SEQ ID NO: 1285828 - protein, 18 aa, Mycobacterium
YHALRASNRIAIERGTHF

SEQ ID NO: 1285829 - protein, 17 aa, Mycobacterium
YHEPRLFSCGARLPLDH

SEQ ID NO: 1285830 - protein, 23 aa, Mycobacterium
YHGADGLRAIALRVHAQASALAA

SEQ ID NO: 1285831 - protein, 19 aa, Mycobacterium
YHGGLQFSPGTWSGHGGGE

SEQ ID NO: 1285832 - protein, 23 aa, Mycobacterium
YHGVTWGPLMREIISAATGRSIR

SEQ ID NO: 1285833 - protein, 31 aa, Mycobacterium
YHLTTLFPPVRPRGFLEVRYLDSVPDATWPA

SEQ ID NO: 1285834 - protein, 18 aa, Mycobacterium
YHPKGLFERTGNLWRAQG

SEQ ID NO: 1285835 - protein, 18 aa, Mycobacterium
YHPQGLDVLACFNDEPAT

SEQ ID NO: 1285836 - protein, 31 aa, Mycobacterium
YHREIAMNFTMDGPWGFWVNRWTAEENRHGI

SEQ ID NO: 1285837 - protein, 17 aa, Mycobacterium
YHRELVEHFILERKWGR

SEQ ID NO: 1285838 - protein, 27 aa, Mycobacterium
YHRFPTRAALCGELWVRTEERFQGELI

SEQ ID NO: 1285839 - protein, 17 aa, Mycobacterium
YHRHPWILHATVIGPPA

SEQ ID NO: 1285840 - protein, 19 aa, Mycobacterium
YHRLLPRFVAVLDDAGLPT

SEQ ID NO: 1285841 - protein, 32 aa, Mycobacterium
YHRPVLDHLWPDGWEVLELNPAHVAEQRRVQG

SEQ ID NO: 1285842 - protein, 18 aa, Mycobacterium
YIAAQAFNSGGLGIIHSI

SEQ ID NO: 1285843 - protein, 26 aa, Mycobacterium
YIADERLRRIFTFQALYAGVPPHKAL

SEQ ID NO: 1285844 - protein, 18 aa, Mycobacterium
YIAGRPGDTFWRTSPYLP

SEQ ID NO: 1285845 - protein, 24 aa, Mycobacterium
YIANEFPLTVLLIGIGLHERNALL

SEQ ID NO: 1285846 - protein, 35 aa, Mycobacterium
YIAQLDWPLADAIRWPAQHISEFAWERQLDVDAKM

SEQ ID NO: 1285847 - protein, 23 aa, Mycobacterium
YIDGKRVGLWEGLAETFGAGSGH

SEQ ID NO: 1285848 - protein, 25 aa, Mycobacterium
YIERLDPSIFWMGMHHSRLVERDES

SEQ ID NO: 1285849 - protein, 28 aa, Mycobacterium
YIGFDIPNEFVVGYGLDYAERYRDLPYI

SEQ ID NO: 1285850 - protein, 17 aa, Mycobacterium
YIHRLRKYVGAYLATLG

SEQ ID NO: 1285851 - protein, 18 aa, Mycobacterium
YIHSVGWVVVRVVAKTKP

SEQ ID NO: 1285852 - protein, 27 aa, Mycobacterium
YILAGWSLGGALAYACAVGLKSQGADV

SEQ ID NO: 1285853 - protein, 20 aa, Mycobacterium
YILECAGGVAACGTGSQLLE

SEQ ID NO: 1285854 - protein, 18 aa, Mycobacterium
YILPSFIEHSSFGVKESN

SEQ ID NO: 1285855 - protein, 32 aa, Mycobacterium
YIMKADHGLALPRRLQIEFSQAIQQITDGEGG

SEQ ID NO: 1285856 - protein, 20 aa, Mycobacterium
YIPAGVFVPRSVRVLATDPL

SEQ ID NO: 1285857 - protein, 23 aa, Mycobacterium
YIQSLDWRWLNDILHSAQAECWA

SEQ ID NO: 1285858 - protein, 18 aa, Mycobacterium
YIRLDLAQDLARRLGAPS

SEQ ID NO: 1285859 - protein, 20 aa, Mycobacterium
YIRRTIRFQRMLEVVARVGI

SEQ ID NO: 1285860 - protein, 25 aa, Mycobacterium
YIVEKRFNLSWAIEGTRSRTGKMLP

SEQ ID NO: 1285861 - protein, 17 aa, Mycobacterium
YKAASTGWFGSSEARWV

SEQ ID NO: 1285862 - protein, 21 aa, Mycobacterium
YKAGGVPWRMTRDNKDLTNCF

SEQ ID NO: 1285863 - protein, 18 aa, Mycobacterium
YKALAATDWCGRWIVAGP

SEQ ID NO: 1285864 - protein, 31 aa, Mycobacterium
YKDWGSGQPIVFSHGWPLSSDDWDTQMLFFL

SEQ ID NO: 1285865 - protein, 29 aa, Mycobacterium
YKFAAAWPGWTPQRLKAHAQSRRLCDVLT

SEQ ID NO: 1285866 - protein, 19 aa, Mycobacterium
YKFADEFHPELQFDKPYLL

SEQ ID NO: 1285867 - protein, 19 aa, Mycobacterium
YKGMRDVEVTFPLIDDVTM

SEQ ID NO: 1285868 - protein, 21 aa, Mycobacterium
YKGVESCELVFDDCRVPVTAI

SEQ ID NO: 1285869 - protein, 18 aa, Mycobacterium
YKIPRYVHMTDDFPMTVT

SEQ ID NO: 1285870 - protein, 18 aa, Mycobacterium
YKIPRYVHVVDEFPMTVT

SEQ ID NO: 1285871 - protein, 21 aa, Mycobacterium
YKISVPHAVRISPDGIYLHER

SEQ ID NO: 1285872 - protein, 26 aa, Mycobacterium
YKLVPTGAIPPMFDPGSPVLQRASVI

SEQ ID NO: 1285873 - protein, 22 aa, Mycobacterium
YKMVFGHRGINIPVIDHATGRV

SEQ ID NO: 1285874 - protein, 17 aa, Mycobacterium
YKNKYAIIQYLKEMSEE

SEQ ID NO: 1285875 - protein, 26 aa, Mycobacterium
YKPACGKAGCSTYKWETFLTQELPSY

SEQ ID NO: 1285876 - protein, 17 aa, Mycobacterium
YKPLNWMSPPCWIVEPT

SEQ ID NO: 1285877 - protein, 20 aa, Mycobacterium
YKPNPRWSRRYAEQPEILKY

SEQ ID NO: 1285878 - protein, 20 aa, Mycobacterium
YKRATLRKLGVDHVYDSRTT

SEQ ID NO: 1285879 - protein, 23 aa, Mycobacterium
YKSPRLIKPEVLASARFREGLAK

SEQ ID NO: 1285880 - protein, 17 aa, Mycobacterium
YKTNWLGDPARPLTAAD

SEQ ID NO: 1285881 - protein, 24 aa, Mycobacterium
YKVPRKIWWADEIQRTPAGKPDYR

SEQ ID NO: 1285882 - protein, 17 aa, Mycobacterium
YKVVHEVTKTSGVEENL

SEQ ID NO: 1285883 - protein, 18 aa, Mycobacterium
YLAALIAGPYARWDDVYS

SEQ ID NO: 1285884 - protein, 17 aa, Mycobacterium
YLAEIAWVGDSAAYLLT

SEQ ID NO: 1285885 - protein, 22 aa, Mycobacterium
YLAELTMLILWKARQKDPETGY

SEQ ID NO: 1285886 - protein, 19 aa, Mycobacterium
YLAGIYRTALHTVVAALLD

SEQ ID NO: 1285887 - protein, 18 aa, Mycobacterium
YLAGLCGALRLYHEAKGV

SEQ ID NO: 1285888 - protein, 24 aa, Mycobacterium
YLAQWRMALAKEMLRTEDVSMAEV

SEQ ID NO: 1285889 - protein, 24 aa, Mycobacterium
YLATAEEFLRIVIARGEDLADLAV

SEQ ID NO: 1285890 - protein, 22 aa, Mycobacterium
YLAVDGEGSFPVELADLVQSAS

SEQ ID NO: 1285891 - protein, 17 aa, Mycobacterium
YLDDTGMIFEQYGDHGM

SEQ ID NO: 1285892 - protein, 21 aa, Mycobacterium
YLDMPPLRVDPATVLTDNPQG

SEQ ID NO: 1285893 - protein, 25 aa, Mycobacterium
YLDRPLKGALLMQTLARVNRTFREK

SEQ ID NO: 1285894 - protein, 19 aa, Mycobacterium
YLDTLLFILGITRGEIEAA

SEQ ID NO: 1285895 - protein, 26 aa, Mycobacterium
YLEAWCRSAEAVRLFRFDRIVDARVL

SEQ ID NO: 1285896 - protein, 19 aa, Mycobacterium
YLERDWRAGQDGGFTAVQR

SEQ ID NO: 1285897 - protein, 21 aa, Mycobacterium
YLESWLLPPLGLRVTVFHFNP

SEQ ID NO: 1285898 - protein, 23 aa, Mycobacterium
YLGDFKFYLDFYTRQSSSGIELH

SEQ ID NO: 1285899 - protein, 23 aa, Mycobacterium
YLGDFRFYLDFYTRQGPNGLEVQ

SEQ ID NO: 1285900 - protein, 21 aa, Mycobacterium
YLGEKICAAVVFRGKPITLAE

SEQ ID NO: 1285901 - protein, 18 aa, Mycobacterium
YLGGIGMSAVEEHEHRLV

SEQ ID NO: 1285902 - protein, 25 aa, Mycobacterium
YLGRAVSPVDFWQYPTVDALAKFLT

SEQ ID NO: 1285903 - protein, 18 aa, Mycobacterium
YLHFNAHLLLASTLSPRI

SEQ ID NO: 1285904 - protein, 19 aa, Mycobacterium
YLHHLFKAKEMLSATLCTI

SEQ ID NO: 1285905 - protein, 20 aa, Mycobacterium
YLHLCEPDWAEGPALDSAFR

SEQ ID NO: 1285906 - protein, 18 aa, Mycobacterium
YLHLMDAWNALSTEEQER

SEQ ID NO: 1285907 - protein, 26 aa, Mycobacterium
YLIGGKCHQCGTYVFPPRANNCPNPA

SEQ ID NO: 1285908 - protein, 19 aa, Mycobacterium
YLIYPYDTPGRMDVTNDPN

SEQ ID NO: 1285909 - protein, 17 aa, Mycobacterium
YLKEIWHAIQTQEISGA

SEQ ID NO: 1285910 - protein, 20 aa, Mycobacterium
YLKVRDRRRYAFALVSVAAV

SEQ ID NO: 1285911 - protein, 32 aa, Mycobacterium
YLLAAELFPRMPIPQAWFDAGIAYRSTDLPGL

SEQ ID NO: 1285912 - protein, 18 aa, Mycobacterium
YLLEETYELFDAVHGGDL

SEQ ID NO: 1285913 - protein, 25 aa, Mycobacterium
YLLKDRVADVPAFLDAVEVVGSGGT

SEQ ID NO: 1285914 - protein, 18 aa, Mycobacterium
YLLYLDFKVQDTVHTASF

SEQ ID NO: 1285915 - protein, 17 aa, Mycobacterium
YLMSRQTPFSAIIAGLT

SEQ ID NO: 1285916 - protein, 17 aa, Mycobacterium
YLPGGTLIDADHLGPAA

SEQ ID NO: 1285917 - protein, 17 aa, Mycobacterium
YLPKGLAGHASRAMALM

SEQ ID NO: 1285918 - protein, 18 aa, Mycobacterium
YLPPPLAPALFRAQAKRA

SEQ ID NO: 1285919 - protein, 24 aa, Mycobacterium
YLPSHPDEVLWGWLPNAQTRPALS

SEQ ID NO: 1285920 - protein, 24 aa, Mycobacterium
YLPVGFGSIRVFGDIGRRAKCRAE

SEQ ID NO: 1285921 - protein, 22 aa, Mycobacterium
YLPVNYRYLIKIPGGGELSPDN

SEQ ID NO: 1285922 - protein, 24 aa, Mycobacterium
YLQLTSLLHWKSDTAAITHQQLDS

SEQ ID NO: 1285923 - protein, 22 aa, Mycobacterium
YLQRGPEMLSFVLKHSPLKLCW

SEQ ID NO: 1285924 - protein, 19 aa, Mycobacterium
YLRAELMKRADFRCAATLD

SEQ ID NO: 1285925 - protein, 17 aa, Mycobacterium
YLRAQLKSVRAESIPER

SEQ ID NO: 1285926 - protein, 27 aa, Mycobacterium
YLRASAPDRIEWILAHPTGITEIQEGQ

SEQ ID NO: 1285927 - protein, 18 aa, Mycobacterium
YLRDHPKATVVALAEGLQ

SEQ ID NO: 1285928 - protein, 18 aa, Mycobacterium
YLTDWAGPSARIKSIGLR

SEQ ID NO: 1285929 - protein, 18 aa, Mycobacterium
YLTDWAGPTARIKSIGLR

SEQ ID NO: 1285930 - protein, 18 aa, Mycobacterium
YLTGCADLFRDGYTDICQ

SEQ ID NO: 1285931 - protein, 24 aa, Mycobacterium
YLTIRGLKTLPLRMQRHSENAAAI

SEQ ID NO: 1285932 - protein, 18 aa, Mycobacterium
YLTQSVPVQLIWGDCDAV

SEQ ID NO: 1285933 - protein, 17 aa, Mycobacterium
YLTRRIRTSGLVTASLA

SEQ ID NO: 1285934 - protein, 20 aa, Mycobacterium
YLTVPMYFGAELVKVTPMDF

SEQ ID NO: 1285935 - protein, 22 aa, Mycobacterium
YLVAGAGGQVWLAGPDRVTMVE

SEQ ID NO: 1285936 - protein, 17 aa, Mycobacterium
YLVEHFVDFWDRVLAES

SEQ ID NO: 1285937 - protein, 20 aa, Mycobacterium
YLVGVDFEGAQHWTDPKQRS

SEQ ID NO: 1285938 - protein, 22 aa, Mycobacterium
YLVHQRRLFPLIARSYALQFAQ

SEQ ID NO: 1285939 - protein, 25 aa, Mycobacterium
YLVLAKWKLAIVLEQGFQRAGDDEK

SEQ ID NO: 1285940 - protein, 22 aa, Mycobacterium
YLVSLLPRRIVDDLGARIRLAR

SEQ ID NO: 1285941 - protein, 20 aa, Mycobacterium
YLVTCSRTGETLLIDAANDS

SEQ ID NO: 1285942 - protein, 17 aa, Mycobacterium
YLWNVKQVVPFLKVDKG

SEQ ID NO: 1285943 - protein, 20 aa, Mycobacterium
YMACLPRGRVRVVRHDLPDT

SEQ ID NO: 1285944 - protein, 17 aa, Mycobacterium
YMAQILIKAEPRPSWGN

SEQ ID NO: 1285945 - protein, 18 aa, Mycobacterium
YMGPFGWLGLDLAAAKVD

SEQ ID NO: 1285946 - protein, 19 aa, Mycobacterium
YMRFGFEVTGELTIPGGGP

SEQ ID NO: 1285947 - protein, 24 aa, Mycobacterium
YMTSKRLLSQYVHDLATELAVRGI

SEQ ID NO: 1285948 - protein, 24 aa, Mycobacterium
YMVPPQWFAMWARRHQHEYGSTCE

SEQ ID NO: 1285949 - protein, 24 aa, Mycobacterium
YMYAMGAGFADIFYHLGTDEQKKW

SEQ ID NO: 1285950 - protein, 23 aa, Mycobacterium
YNAEHAYRFGLARVLDGLAPVIG

SEQ ID NO: 1285951 - protein, 26 aa, Mycobacterium
YNDYRHSCGYPRLRSFEDLSAKRDVR

SEQ ID NO: 1285952 - protein, 20 aa, Mycobacterium
YNGKCLRASAGSIFGVSVVE

SEQ ID NO: 1285953 - protein, 20 aa, Mycobacterium
YNGKCLRASAGSIFSIPVLS

SEQ ID NO: 1285954 - protein, 19 aa, Mycobacterium
YNGSLMVMPGSHRVFYPCV

SEQ ID NO: 1285955 - protein, 24 aa, Mycobacterium
YNHLLKNYVCLAAIASAAPGKGFA

SEQ ID NO: 1285956 - protein, 18 aa, Mycobacterium
YNHYAVGWAHALCGPYQW

SEQ ID NO: 1285957 - protein, 17 aa, Mycobacterium
YNLQWKPVGGFPVTVGW

SEQ ID NO: 1285958 - protein, 17 aa, Mycobacterium
YNLVPYLTGEVARSPRR

SEQ ID NO: 1285959 - protein, 19 aa, Mycobacterium
YNNSVAYARNVLSWAGGYA

SEQ ID NO: 1285960 - protein, 18 aa, Mycobacterium
YNPGHLMVVPYRRVAELE

SEQ ID NO: 1285961 - protein, 18 aa, Mycobacterium
YNPLWPSVDELVRLLESG

SEQ ID NO: 1285962 - protein, 18 aa, Mycobacterium
YNPWDERVCLAPNGDLFK

SEQ ID NO: 1285963 - protein, 24 aa, Mycobacterium
YNQQRLMHRLGRIPPAEAEARYYS

SEQ ID NO: 1285964 - protein, 18 aa, Mycobacterium
YNSGGPWGYTPKGGTGVP

SEQ ID NO: 1285965 - protein, 17 aa, Mycobacterium
YNTFGFFAPHYQYAANR

SEQ ID NO: 1285966 - protein, 20 aa, Mycobacterium
YNWGITPGDMATIWRGGCII

SEQ ID NO: 1285967 - protein, 19 aa, Mycobacterium
YNYGRFDAAALLQQMRRAG

SEQ ID NO: 1285968 - protein, 26 aa, Mycobacterium
YPAAVDDVWAATRWVAENAAELGADP

SEQ ID NO: 1285969 - protein, 20 aa, Mycobacterium
YPAISRGSGEIVDIVQRSHT

SEQ ID NO: 1285970 - protein, 20 aa, Mycobacterium
YPAMMFGAAGAWSIDVCMGP

SEQ ID NO: 1285971 - protein, 26 aa, Mycobacterium
YPARVKCALLGWTAFKAALAQAHGPE

SEQ ID NO: 1285972 - protein, 19 aa, Mycobacterium
YPAVGAIAGHVAFYPDTAD

SEQ ID NO: 1285973 - protein, 19 aa, Mycobacterium
YPAVSAPLLPPGPLGPPPS

SEQ ID NO: 1285974 - protein, 21 aa, Mycobacterium
YPCEPDAPLPIAKRTRSYLGS

SEQ ID NO: 1285975 - protein, 21 aa, Mycobacterium
YPDAEVFVFPGAVQMADGSIQ

SEQ ID NO: 1285976 - protein, 18 aa, Mycobacterium
YPDFPVVLEAVRECLQDV

SEQ ID NO: 1285977 - protein, 17 aa, Mycobacterium
YPDGEFLVGDRDVLLAV

SEQ ID NO: 1285978 - protein, 23 aa, Mycobacterium
YPDGRFTGAACFTMLHHVEPSQR

SEQ ID NO: 1285979 - protein, 23 aa, Mycobacterium
YPDMAEFLVRIGIDSMSLNPDTV

SEQ ID NO: 1285980 - protein, 19 aa, Mycobacterium
YPDRSQLAAWAGIDTPDGK

SEQ ID NO: 1285981 - protein, 17 aa, Mycobacterium
YPDVAIRRRIVCDKPAR

SEQ ID NO: 1285982 - protein, 18 aa, Mycobacterium
YPERVIATIQAAIRVSLV

SEQ ID NO: 1285983 - protein, 21 aa, Mycobacterium
YPEVVVHRLVRFGKPARQLLA

SEQ ID NO: 1285984 - protein, 19 aa, Mycobacterium
YPFATWRVYLHPTQRAVVQ

SEQ ID NO: 1285985 - protein, 22 aa, Mycobacterium
YPFEHRAYWFPTTKVHTLPAGG

SEQ ID NO: 1285986 - protein, 17 aa, Mycobacterium
YPFPLPVADQLQRIADG

SEQ ID NO: 1285987 - protein, 26 aa, Mycobacterium
YPGHWPKPRHGWTLTIEGDPSMQTHF

SEQ ID NO: 1285988 - protein, 19 aa, Mycobacterium
YPIVLAHGITCSLRVWAYQ

SEQ ID NO: 1285989 - protein, 17 aa, Mycobacterium
YPIVPGIDLTGEVVASQ

SEQ ID NO: 1285990 - protein, 25 aa, Mycobacterium
YPKTARLVLDAAVLKDTMVLAYQWA

SEQ ID NO: 1285991 - protein, 24 aa, Mycobacterium
YPKVVLVTGACRFLGGYLTARLAQ

SEQ ID NO: 1285992 - protein, 17 aa, Mycobacterium
YPLAVLTAARAEGHCWF

SEQ ID NO: 1285993 - protein, 18 aa, Mycobacterium
YPLDRGAAGIALLASMPP

SEQ ID NO: 1285994 - protein, 21 aa, Mycobacterium
YPLGLVAPAGFALHVRRYLHE

SEQ ID NO: 1285995 - protein, 17 aa, Mycobacterium
YPLGLVAPANFALHVMR

SEQ ID NO: 1285996 - protein, 17 aa, Mycobacterium
YPLIPGIDVAGTVTSSR

SEQ ID NO: 1285997 - protein, 19 aa, Mycobacterium
YPMFDRIREQAPLYYNADH

SEQ ID NO: 1285998 - protein, 17 aa, Mycobacterium
YPMVYDMPARAKEAFGI

SEQ ID NO: 1285999 - protein, 19 aa, Mycobacterium
YPNKWRDYSALVIARDDLY

SEQ ID NO: 1286000 - protein, 19 aa, Mycobacterium
YPNVGRICMDQFVVDLGPG

SEQ ID NO: 1286001 - protein, 20 aa, Mycobacterium
YPPEVYGGAGVHVTELVAQL

SEQ ID NO: 1286002 - protein, 18 aa, Mycobacterium
YPPIPSFSPEHFSVARGT

SEQ ID NO: 1286003 - protein, 21 aa, Mycobacterium
YPPKPSMRIISDIFGYTSAKM

SEQ ID NO: 1286004 - protein, 18 aa, Mycobacterium
YPPLCDKYGIPIVVTGFE

SEQ ID NO: 1286005 - protein, 18 aa, Mycobacterium
YPPLRIGQSYIDRLEKWC

SEQ ID NO: 1286006 - protein, 24 aa, Mycobacterium
YPPMGPELVAPVVGYLAHETCAVT

SEQ ID NO: 1286007 - protein, 24 aa, Mycobacterium
YPQLNPRYLFLGLKNQYRGQRPRP

SEQ ID NO: 1286008 - protein, 18 aa, Mycobacterium
YPQSPSGLNEMWKQLEDT

SEQ ID NO: 1286009 - protein, 23 aa, Mycobacterium
YPQTTVRFAVRFNSYSDPVNPFM

SEQ ID NO: 1286010 - protein, 27 aa, Mycobacterium
YPRESPGGWQLIGRTSAVMWDVHRKDP

SEQ ID NO: 1286011 - protein, 20 aa, Mycobacterium
YPRLGELLTGMLCEMGDRGS

SEQ ID NO: 1286012 - protein, 19 aa, Mycobacterium
YPRVRAELLPTYQQEATAI

SEQ ID NO: 1286013 - protein, 25 aa, Mycobacterium
YPSKSALPWGDFDAHLEHMRELLDE

SEQ ID NO: 1286014 - protein, 22 aa, Mycobacterium
YPTHGFGSFCSATPASGDASTI

SEQ ID NO: 1286015 - protein, 19 aa, Mycobacterium
YPTPGHAVGLSFSVAPDVR

SEQ ID NO: 1286016 - protein, 17 aa, Mycobacterium
YPTYYAHMGVINREGPA

SEQ ID NO: 1286017 - protein, 22 aa, Mycobacterium
YPVAERNASIYIWHDIENREPF

SEQ ID NO: 1286018 - protein, 37 aa, Mycobacterium
YPVPDAVAFGKHWVTECLRAAYPLGHGHGPVSALFRL

SEQ ID NO: 1286019 - protein, 19 aa, Mycobacterium
YPVVRRILDRANVTLAEII

SEQ ID NO: 1286020 - protein, 25 aa, Mycobacterium
YPWLWSRATNQLMFIYAKTVPEDGF

SEQ ID NO: 1286021 - protein, 26 aa, Mycobacterium
YPWPRQEGRRKFGFYGDDMAAAQWVR

SEQ ID NO: 1286022 - protein, 20 aa, Mycobacterium
YPWREARPGRYGSDVQVLRE

SEQ ID NO: 1286023 - protein, 17 aa, Mycobacterium
YPYVGKLVHDLTLAQIR

SEQ ID NO: 1286024 - protein, 35 aa, Mycobacterium
YQAEIDAPCELVDFWRFNVAFARQILAQQPLNSKG

SEQ ID NO: 1286025 - protein, 17 aa, Mycobacterium
YQCAIDAVAGRCFPSYA

SEQ ID NO: 1286026 - protein, 23 aa, Mycobacterium
YQDFAAPIMESFGSPAAVTTPDD

SEQ ID NO: 1286027 - protein, 18 aa, Mycobacterium
YQDVPAPLLPSAIAEGNP

SEQ ID NO: 1286028 - protein, 20 aa, Mycobacterium
YQICSIGAEIAFRLQKAEWT

SEQ ID NO: 1286029 - protein, 17 aa, Mycobacterium
YQLAPVKARGGMFEHLC

SEQ ID NO: 1286030 - protein, 18 aa, Mycobacterium
YQPGMLSAAWGVGVRQLA

SEQ ID NO: 1286031 - protein, 19 aa, Mycobacterium
YQPRGVGLMHTRHNPGNAH

SEQ ID NO: 1286032 - protein, 25 aa, Mycobacterium
YQPRLGDGRALLMGEFVDSTGRLRD

SEQ ID NO: 1286033 - protein, 20 aa, Mycobacterium
YQQAGFRLTRVVPTVAPISL

SEQ ID NO: 1286034 - protein, 22 aa, Mycobacterium
YQRFRVGPARRSDRSGNGGGPN

SEQ ID NO: 1286035 - protein, 18 aa, Mycobacterium
YQRTAPWILPKWDSRYGV

SEQ ID NO: 1286036 - protein, 24 aa, Mycobacterium
YQRTAPWLLPRFDRPFTRAEKWAF

SEQ ID NO: 1286037 - protein, 19 aa, Mycobacterium
YQRYADWKKVQRPLINPSD

SEQ ID NO: 1286038 - protein, 23 aa, Mycobacterium
YQSWSACYLPLVRVLRTLAAENR

SEQ ID NO: 1286039 - protein, 19 aa, Mycobacterium
YQVALPLHPEYRTMPMVWY

SEQ ID NO: 1286040 - protein, 24 aa, Mycobacterium
YQYRMSPRYEIPCTVTGTVVADGR

SEQ ID NO: 1286041 - protein, 20 aa, Mycobacterium
YRAAVATVRADLVAEVVRTV

SEQ ID NO: 1286042 - protein, 22 aa, Mycobacterium
YRAEKYLGIIDRVRAAIPDAAI

SEQ ID NO: 1286043 - protein, 21 aa, Mycobacterium
YRAFNAYKMAVICLIGAMLVD

SEQ ID NO: 1286044 - protein, 20 aa, Mycobacterium
YRAGLFSADTCAIVHPAKLA

SEQ ID NO: 1286045 - protein, 26 aa, Mycobacterium
YRAGRDIKAGRVWTNCYHQYPAHAAF

SEQ ID NO: 1286046 - protein, 19 aa, Mycobacterium
YRALAAALLKHWKNGKDMP

SEQ ID NO: 1286047 - protein, 18 aa, Mycobacterium
YRALKALIDGGELGNPLV

SEQ ID NO: 1286048 - protein, 19 aa, Mycobacterium
YRALPSGPFYGFNRQGVEP

SEQ ID NO: 1286049 - protein, 19 aa, Mycobacterium
YRARRMPYTAGLLGSVPRL

SEQ ID NO: 1286050 - protein, 24 aa, Mycobacterium
YRATSGKNQSRWQFGVLGPPGAEQ

SEQ ID NO: 1286051 - protein, 19 aa, Mycobacterium
YRAVSSWFIKVTQFRDRMV

SEQ ID NO: 1286052 - protein, 18 aa, Mycobacterium
YRDAAAGGDSAWFRRRGG

SEQ ID NO: 1286053 - protein, 17 aa, Mycobacterium
YRDFRFTLPDVVADNAS

SEQ ID NO: 1286054 - protein, 17 aa, Mycobacterium
YRDGLLAQARRLGVADS

SEQ ID NO: 1286055 - protein, 27 aa, Mycobacterium
YRDHPFIRIPEVVPELSGDRVLTMTHL

SEQ ID NO: 1286056 - protein, 24 aa, Mycobacterium
YRDLPVEVPVPFAMPVLHRDDNIV

SEQ ID NO: 1286057 - protein, 18 aa, Mycobacterium
YRDTVLPGAVLARVASSH

SEQ ID NO: 1286058 - protein, 18 aa, Mycobacterium
YREWLSIHRVWRSKLPDV

SEQ ID NO: 1286059 - protein, 20 aa, Mycobacterium
YRFDAVPGQRDHSWGVRDWW

SEQ ID NO: 1286060 - protein, 22 aa, Mycobacterium
YRFDSGEQLKVWREMDHADEAP

SEQ ID NO: 1286061 - protein, 21 aa, Mycobacterium
YRFRPYDPWTAYGQSKTADIL

SEQ ID NO: 1286062 - protein, 29 aa, Mycobacterium
YRGEAVGSFTGWRPAMPVTQWSVTKPDTT

SEQ ID NO: 1286063 - protein, 21 aa, Mycobacterium
YRGEIKVSLINLDPHAPIVIR

SEQ ID NO: 1286064 - protein, 24 aa, Mycobacterium
YRGNGAIIPPTFLTSAACWAPPGV

SEQ ID NO: 1286065 - protein, 24 aa, Mycobacterium
YRGTLEHLASWGIVAGAPNTETGL

SEQ ID NO: 1286066 - protein, 22 aa, Mycobacterium
YRHLVELADALFGMLDTFGTAP

SEQ ID NO: 1286067 - protein, 17 aa, Mycobacterium
YRHRWWVGGHWRQQACG

SEQ ID NO: 1286068 - protein, 24 aa, Mycobacterium
YRIAELTAALAALGVDAPHFLGGP

SEQ ID NO: 1286069 - protein, 17 aa, Mycobacterium
YRIKELVGDIVGVIDAY

SEQ ID NO: 1286070 - protein, 17 aa, Mycobacterium
YRILGLKDGEAHVIRNA

SEQ ID NO: 1286071 - protein, 17 aa, Mycobacterium
YRIVDLLGRRNAADSTA

SEQ ID NO: 1286072 - protein, 19 aa, Mycobacterium
YRKLGIRSRAQLGTQLAQL

SEQ ID NO: 1286073 - protein, 19 aa, Mycobacterium
YRKRFHKRAETELTILAPH

SEQ ID NO: 1286074 - protein, 21 aa, Mycobacterium
YRLAPEHPWPAAAEDVYAVTR

SEQ ID NO: 1286075 - protein, 20 aa, Mycobacterium
YRLDGVKSLVPAAADAEVFI

SEQ ID NO: 1286076 - protein, 27 aa, Mycobacterium
YRLDRACLLGCGFITGWGSSVYAAEVR

SEQ ID NO: 1286077 - protein, 18 aa, Mycobacterium
YRLGERLFELGARALEPR

SEQ ID NO: 1286078 - protein, 18 aa, Mycobacterium
YRLGEVNGGWTVLREPLN

SEQ ID NO: 1286079 - protein, 20 aa, Mycobacterium
YRLGPSLITLGHRAQESMRV

SEQ ID NO: 1286080 - protein, 17 aa, Mycobacterium
YRLLRMLETAWNLTEPV

SEQ ID NO: 1286081 - protein, 19 aa, Mycobacterium
YRLLSTLAQYRFVAKGEDG

SEQ ID NO: 1286082 - protein, 20 aa, Mycobacterium
YRLSADGLRALLDRLPDPLV

SEQ ID NO: 1286083 - protein, 20 aa, Mycobacterium
YRLTPRTGRTHQLRVHMASL

SEQ ID NO: 1286084 - protein, 19 aa, Mycobacterium
YRLTPRTGRTHQLRVHMSS

SEQ ID NO: 1286085 - protein, 23 aa, Mycobacterium
YRLYELRLRQGLTASRSELPRHI

SEQ ID NO: 1286086 - protein, 17 aa, Mycobacterium
YRLYVEMTDQITSIADP

SEQ ID NO: 1286087 - protein, 18 aa, Mycobacterium
YRNLPAHPAFDWYSERIS

SEQ ID NO: 1286088 - protein, 24 aa, Mycobacterium
YRPAEGLWPSEWIPAKREAARAKY

SEQ ID NO: 1286089 - protein, 19 aa, Mycobacterium
YRPAGKYLYAALGMQTEVY

SEQ ID NO: 1286090 - protein, 22 aa, Mycobacterium
YRPAPAGLRANMIFSADGAAGF

SEQ ID NO: 1286091 - protein, 20 aa, Mycobacterium
YRPDELTEWFATAYVDGFRW

SEQ ID NO: 1286092 - protein, 19 aa, Mycobacterium
YRPLINPLRAAGVPRPSRR

SEQ ID NO: 1286093 - protein, 24 aa, Mycobacterium
YRPLRGEPGGDRWATYTANRRGYG

SEQ ID NO: 1286094 - protein, 19 aa, Mycobacterium
YRPPARPDVIAALDREGLL

SEQ ID NO: 1286095 - protein, 17 aa, Mycobacterium
YRPRRAALQRLLDEHFA

SEQ ID NO: 1286096 - protein, 24 aa, Mycobacterium
YRPSTKLAAFVRARDLFCRYPGCD

SEQ ID NO: 1286097 - protein, 24 aa, Mycobacterium
YRPWAGEIRARHTGSLVSDRSGQI

SEQ ID NO: 1286098 - protein, 17 aa, Mycobacterium
YRQATILEIQRSRTVID

SEQ ID NO: 1286099 - protein, 21 aa, Mycobacterium
YRQHVEPAYFLKPPSALTGHG

SEQ ID NO: 1286100 - protein, 19 aa, Mycobacterium
YRQIEAMVAGTLFEPLGYD

SEQ ID NO: 1286101 - protein, 20 aa, Mycobacterium
YRQLDYWARTSLVVPSIRGA

SEQ ID NO: 1286102 - protein, 19 aa, Mycobacterium
YRQSQIFRGPRHVLVDVEA

SEQ ID NO: 1286103 - protein, 22 aa, Mycobacterium
YRRAEVVAVLALDVRRRRVHHV

SEQ ID NO: 1286104 - protein, 21 aa, Mycobacterium
YRRDLRRYAEHLASRGVTDLA

SEQ ID NO: 1286105 - protein, 18 aa, Mycobacterium
YRRGHAKLRRVGSTILGG

SEQ ID NO: 1286106 - protein, 26 aa, Mycobacterium
YRRGLRGLSSLAWSRLKRNFRLNDRD

SEQ ID NO: 1286107 - protein, 17 aa, Mycobacterium
YRRGYAAALPDYTSADN

SEQ ID NO: 1286108 - protein, 17 aa, Mycobacterium
YRRLRDAGGPVFVRTNR

SEQ ID NO: 1286109 - protein, 17 aa, Mycobacterium
YRRLTPLGRLRSEARVT

SEQ ID NO: 1286110 - protein, 17 aa, Mycobacterium
YRRPRSGALVAMESRSR

SEQ ID NO: 1286111 - protein, 19 aa, Mycobacterium
YRRRRSRIGGFRAVIGSEP

SEQ ID NO: 1286112 - protein, 26 aa, Mycobacterium
YRRRSSCRTTSAWQPRTSRSPRANAV

SEQ ID NO: 1286113 - protein, 18 aa, Mycobacterium
YRRVEFRLDPPPGDIGLR

SEQ ID NO: 1286114 - protein, 21 aa, Mycobacterium
YRRVKELGFEMALSVGQHTND

SEQ ID NO: 1286115 - protein, 24 aa, Mycobacterium
YRRWPDRRALLRDTLLGIATSAFP

SEQ ID NO: 1286116 - protein, 19 aa, Mycobacterium
YRSLPGLGVILGARVLGEF

SEQ ID NO: 1286117 - protein, 18 aa, Mycobacterium
YRSVTVIGAPTKITKDTA

SEQ ID NO: 1286118 - protein, 20 aa, Mycobacterium
YRTALHRLAHTFGVAEDVVF

SEQ ID NO: 1286119 - protein, 20 aa, Mycobacterium
YRTASGMALGHWVSNQRAAY

SEQ ID NO: 1286120 - protein, 19 aa, Mycobacterium
YRTIHHTLLTLADHVTVLP

SEQ ID NO: 1286121 - protein, 18 aa, Mycobacterium
YRTNSWRTAQRAHAPQEV

SEQ ID NO: 1286122 - protein, 21 aa, Mycobacterium
YRTRRWPDLLGATAVSPPPEA

SEQ ID NO: 1286123 - protein, 18 aa, Mycobacterium
YRTSILKKSSAWVVLEVE

SEQ ID NO: 1286124 - protein, 21 aa, Mycobacterium
YRVAALRGAWESPDPDAISAA

SEQ ID NO: 1286125 - protein, 20 aa, Mycobacterium
YRWPADRNSVTWSLVSSTLL

SEQ ID NO: 1286126 - protein, 21 aa, Mycobacterium
YRYFPEPDLEPVAPSAELVEQ

SEQ ID NO: 1286127 - protein, 18 aa, Mycobacterium
YRYLRALDTKDWAAFTDT

SEQ ID NO: 1286128 - protein, 18 aa, Mycobacterium
YRYSDINYILLGALIEKV

SEQ ID NO: 1286129 - protein, 27 aa, Mycobacterium
YSADDLRWWAARIGEWDAQGRDVYVYF

SEQ ID NO: 1286130 - protein, 23 aa, Mycobacterium
YSALDPHLWNWIAVSGLFVVLNS

SEQ ID NO: 1286131 - protein, 23 aa, Mycobacterium
YSDGRLVRSATWIVEGDLSTGHV

SEQ ID NO: 1286132 - protein, 17 aa, Mycobacterium
YSDINFILVGAIIEKLT

SEQ ID NO: 1286133 - protein, 18 aa, Mycobacterium
YSDYVEWRAANPSDDLMT

SEQ ID NO: 1286134 - protein, 17 aa, Mycobacterium
YSEAIALSRLGWAALAV

SEQ ID NO: 1286135 - protein, 19 aa, Mycobacterium
YSERVDVVLAARTRRELDT

SEQ ID NO: 1286136 - protein, 18 aa, Mycobacterium
YSFLRLLLPAGVETTYRS

SEQ ID NO: 1286137 - protein, 24 aa, Mycobacterium
YSFSQFKRSALPNGPKVSAGGSLS

SEQ ID NO: 1286138 - protein, 17 aa, Mycobacterium
YSGAGTVEFMADDQGAF

SEQ ID NO: 1286139 - protein, 18 aa, Mycobacterium
YSGGLGILAGDHLKSASD

SEQ ID NO: 1286140 - protein, 20 aa, Mycobacterium
YSGKELVEIATRMAEKRDSR

SEQ ID NO: 1286141 - protein, 17 aa, Mycobacterium
YSGLGRQSLAGKNIALI

SEQ ID NO: 1286142 - protein, 20 aa, Mycobacterium
YSGMVSRPLVDLATTLTATL

SEQ ID NO: 1286143 - protein, 18 aa, Mycobacterium
YSGWYSVRDERFFTEAET

SEQ ID NO: 1286144 - protein, 24 aa, Mycobacterium
YSHHWAVGDTVIWDNRGVLHRAAR

SEQ ID NO: 1286145 - protein, 29 aa, Mycobacterium
YSIPVGRGRFRGAGLIDCGPSRPPYTDAP

SEQ ID NO: 1286146 - protein, 19 aa, Mycobacterium
YSKTDLWDFEANLQGSEAA

SEQ ID NO: 1286147 - protein, 17 aa, Mycobacterium
YSLIPAFIEELLRVDGP

SEQ ID NO: 1286148 - protein, 17 aa, Mycobacterium
YSLTFPGVYTEELGEWR

SEQ ID NO: 1286149 - protein, 24 aa, Mycobacterium
YSMPGRADWAVHIALWQRAPRTGA

SEQ ID NO: 1286150 - protein, 20 aa, Mycobacterium
YSPRMRVGVHTGRPQRIGSD

SEQ ID NO: 1286151 - protein, 36 aa, Mycobacterium; identical to SEQ ID NO: 624746

SEQ ID NO: 1286152 - protein, 17 aa, Mycobacterium
YSPVIAMAGCHRRAVPM

SEQ ID NO: 1286153 - protein, 25 aa, Mycobacterium
YSPWPVPRGDIALMGARAARAGVML

SEQ ID NO: 1286154 - protein, 23 aa, Mycobacterium
YSQCIAHGIDMRLGMDQQYRAVA

SEQ ID NO: 1286155 - protein, 24 aa, Mycobacterium
YSRGFAVELEDEWQLPDAIAQQAR

SEQ ID NO: 1286156 - protein, 17 aa, Mycobacterium
YSRIGACTQEFGTLATW

SEQ ID NO: 1286157 - protein, 23 aa, Mycobacterium
YSRMREGQTLFTYLHLAASRSCT

SEQ ID NO: 1286158 - protein, 17 aa, Mycobacterium
YSRTVTFASEFGAALSA

SEQ ID NO: 1286159 - protein, 19 aa, Mycobacterium
YSRVRVDGVVHPLTDPPKL

SEQ ID NO: 1286160 - protein, 17 aa, Mycobacterium
YSSIKDLTRLLGGPSHR

SEQ ID NO: 1286161 - protein, 18 aa, Mycobacterium
YSSVNFKDALAVTTKGGV

SEQ ID NO: 1286162 - protein, 18 aa, Mycobacterium
YSTGCDFKRPTPDWWFDD

SEQ ID NO: 1286163 - protein, 26 aa, Mycobacterium
YSTLQSGPEFGRWLAERGPAQVPETA

SEQ ID NO: 1286164 - protein, 17 aa, Mycobacterium
YSTPPGMFVDLAPVHVM

SEQ ID NO: 1286165 - protein, 18 aa, Mycobacterium
YSTVLRKLLHTFEAVDEA

SEQ ID NO: 1286166 - protein, 19 aa, Mycobacterium
YSVDSGRRDMTGWLAGKRA

SEQ ID NO: 1286167 - protein, 17 aa, Mycobacterium
YSVGLGMLEKVNHSQTM

SEQ ID NO: 1286168 - protein, 20 aa, Mycobacterium
YSVPMARFVDTFARVLGDPD

SEQ ID NO: 1286169 - protein, 27 aa, Mycobacterium
YSVRHDWPVRTGIIVGRLDADGSRFMA

SEQ ID NO: 1286170 - protein, 19 aa, Mycobacterium
YTAQCGFDVLAHASEPYVS

SEQ ID NO: 1286171 - protein, 18 aa, Mycobacterium
YTDLLFYHLRLRCFVVIE

SEQ ID NO: 1286172 - protein, 22 aa, Mycobacterium
YTEARLTPLAMEMLREIDEETV

SEQ ID NO: 1286173 - protein, 21 aa, Mycobacterium
YTEFLTAWATSSDWECSFKRI

SEQ ID NO: 1286174 - protein, 20 aa, Mycobacterium
YTIANPRTDWCFTTEPDPGL

SEQ ID NO: 1286175 - protein, 30 aa, Mycobacterium
YTILAASLAYQFGLEWGVERSRDFRFAVID

SEQ ID NO: 1286176 - protein, 17 aa, Mycobacterium
YTILTVPDFVAGRPDPW

SEQ ID NO: 1286177 - protein, 25 aa, Mycobacterium
YTIVHATQFYEFVKGIADAATDGDI

SEQ ID NO: 1286178 - protein, 20 aa, Mycobacterium
YTKGRLPLRVRELARVVIAN

SEQ ID NO: 1286179 - protein, 17 aa, Mycobacterium
YTKRMQKALKYEGVDVI

SEQ ID NO: 1286180 - protein, 26 aa, Mycobacterium
YTLRFKDLRTGQRYDDEIVGIGAGAT

SEQ ID NO: 1286181 - protein, 17 aa, Mycobacterium
YTNKPVFVRAVEVRTRK

SEQ ID NO: 1286182 - protein, 18 aa, Mycobacterium
YTPDLEWAQVGGTDAFRV

SEQ ID NO: 1286183 - protein, 22 aa, Mycobacterium
YTPRMRVGIHTGRPQRIGSDWL

SEQ ID NO: 1286184 - protein, 25 aa, Mycobacterium
YTQLRFPKNRGMRIDFILGSPALAE

SEQ ID NO: 1286185 - protein, 24 aa, Mycobacterium
YTRAGFHPDDWDSAEILERWTKEL

SEQ ID NO: 1286186 - protein, 20 aa, Mycobacterium
YTRKWLQRMTAVNMDRSVAQ

SEQ ID NO: 1286187 - protein, 18 aa, Mycobacterium
YTRSLMRALHVPVHNIWG

SEQ ID NO: 1286188 - protein, 23 aa, Mycobacterium
YTSEWKIRELVKQYSDFIAWPIR

SEQ ID NO: 1286189 - protein, 17 aa, Mycobacterium
YTSGSVRRVDFPQLADQ

SEQ ID NO: 1286190 - protein, 17 aa, Mycobacterium
YTYRSVTVIGAPTKITK

SEQ ID NO: 1286191 - protein, 20 aa, Mycobacterium
YVAGMCPDTKIVLGGMSQGA

SEQ ID NO: 1286192 - protein, 19 aa, Mycobacterium
YVAHYGLAWNRRNWPTVSV

SEQ ID NO: 1286193 - protein, 18 aa, Mycobacterium
YVATALKLLERKVVQTPP

SEQ ID NO: 1286194 - protein, 23 aa, Mycobacterium
YVATASIFHWWTYADMARDTGAT

SEQ ID NO: 1286195 - protein, 21 aa, Mycobacterium
YVERYMKLLAPKWQMMSDPAL

SEQ ID NO: 1286196 - protein, 21 aa, Mycobacterium
YVFDALGALFTRSDLDERLER

SEQ ID NO: 1286197 - protein, 27 aa, Mycobacterium
YVFPHLRQAILDAYRRAGCSGPADLDA

SEQ ID NO: 1286198 - protein, 18 aa, Mycobacterium
YVGDLCRALLQIADGGVR

SEQ ID NO: 1286199 - protein, 19 aa, Mycobacterium
YVGISASKARRVIDLVRGK

SEQ ID NO: 1286200 - protein, 24 aa, Mycobacterium
YVGQKRFSLEGAETVIPMMDAAID

SEQ ID NO: 1286201 - protein, 17 aa, Mycobacterium
YVGWLMGVDEDWLCDTE

SEQ ID NO: 1286202 - protein, 21 aa, Mycobacterium
YVHAVPVFYGHYWRSGDPRHL

SEQ ID NO: 1286203 - protein, 20 aa, Mycobacterium
YVHRWEEIPDISLWQEDGPV

SEQ ID NO: 1286204 - protein, 19 aa, Mycobacterium
YVHVPFCAVRCGYCDFNTY

SEQ ID NO: 1286205 - protein, 17 aa, Mycobacterium
YVIDGEFTLKGVTKPIT

SEQ ID NO: 1286206 - protein, 18 aa, Mycobacterium
YVKSELHYLLADSGATAL

SEQ ID NO: 1286207 - protein, 24 aa, Mycobacterium
YVLPGELPASVTLDPTAPIACDWR

SEQ ID NO: 1286208 - protein, 17 aa, Mycobacterium
YVLRASDLILWESGVRT

SEQ ID NO: 1286209 - protein, 25 aa, Mycobacterium
YVLWSRLRLAVMRVQAGDDLTGAAH

SEQ ID NO: 1286210 - protein, 25 aa, Mycobacterium
YVLWSRLRVAITLVQGGDDLTGAAH

SEQ ID NO: 1286211 - protein, 26 aa, Mycobacterium
YVNHPRLGWSDAPVGTVLGEALGLPV

SEQ ID NO: 1286212 - protein, 18 aa, Mycobacterium
YVPCEVCQGARYNRETLE

SEQ ID NO: 1286213 - protein, 23 aa, Mycobacterium
YVPELLGAGAPHFREAESWDPHY

SEQ ID NO: 1286214 - protein, 18 aa, Mycobacterium
YVPGMCDYAVLVDKQAKV

SEQ ID NO: 1286215 - protein, 20 aa, Mycobacterium
YVPGYRLKQRVQFETFTATD

SEQ ID NO: 1286216 - protein, 27 aa, Mycobacterium
YVPPWTQPHCSRRCWHGADPAEPGPSG

SEQ ID NO: 1286217 - protein, 17 aa, Mycobacterium
YVPWSESTGKRWLGSFI

SEQ ID NO: 1286218 - protein, 17 aa, Mycobacterium
YVRCLQSGYAANVEAVV

SEQ ID NO: 1286219 - protein, 18 aa, Mycobacterium
YVRDRVFAPLGMTDTRYL

SEQ ID NO: 1286220 - protein, 18 aa, Mycobacterium
YVRKGSLWPATFGLACCA

SEQ ID NO: 1286221 - protein, 33 aa, Mycobacterium
YVRRLRARPPLARRYLALEAHRVLAELAQRVPL

SEQ ID NO: 1286222 - protein, 24 aa, Mycobacterium
YVRSEGCGILLLKRLSDAVRDGDR

SEQ ID NO: 1286223 - protein, 18 aa, Mycobacterium
YVSYLRKKIDAGRDPMIH

SEQ ID NO: 1286224 - protein, 18 aa, Mycobacterium
YVTDAGVELGQWVHDLRR

SEQ ID NO: 1286225 - protein, 18 aa, Mycobacterium
YVVAGWRADTFVAGTPEP

SEQ ID NO: 1286226 - protein, 19 aa, Mycobacterium
YVVGAAVMLRRDFLTQDAR

SEQ ID NO: 1286227 - protein, 23 aa, Mycobacterium
YVVGRLIWNAGLLAPVEGQLRQV

SEQ ID NO: 1286228 - protein, 21 aa, Mycobacterium
YVVSMPCVEWFESQPKEYRDS

SEQ ID NO: 1286229 - protein, 32 aa, Mycobacterium
YWANYVSLELGPWLINWIPFGYLISDQIYIWY

SEQ ID NO: 1286230 - protein, 18 aa, Mycobacterium
YWARNHVGWRHMAATLPN

SEQ ID NO: 1286231 - protein, 26 aa, Mycobacterium
YWDEDWTYEGTMKWSDGSTIVSVDVD

SEQ ID NO: 1286232 - protein, 24 aa, Mycobacterium
YWDRGCPEPAPIRPELLHEMMQWL

SEQ ID NO: 1286233 - protein, 25 aa, Mycobacterium
YWEGLKDGKLMLCRCDDTGKWIHPP

SEQ ID NO: 1286234 - protein, 22 aa, Mycobacterium
YWFRRHEVVYARLADRCAGRDV

SEQ ID NO: 1286235 - protein, 17 aa, Mycobacterium
YWGIIKADIGIRDGRIT

SEQ ID NO: 1286236 - protein, 17 aa, Mycobacterium
YWGRPAPGFGSPRPRIF

SEQ ID NO: 1286237 - protein, 19 aa, Mycobacterium
YWLSQQGRLTHPVVLRPGD

SEQ ID NO: 1286238 - protein, 26 aa, Mycobacterium
YWLVEPQHFVCFAGLIDPDEPVTPNA

SEQ ID NO: 1286239 - protein, 20 aa, Mycobacterium
YWMMARTLIELERNLYAEAG

SEQ ID NO: 1286240 - protein, 21 aa, Mycobacterium
YWNHYQLTFALYSVSDRAIPS

SEQ ID NO: 1286241 - protein, 21 aa, Mycobacterium
YWPKLDAMYPDFANYRSYTDR

SEQ ID NO: 1286242 - protein, 17 aa, Mycobacterium
YWREAFRLPSMDHEELG

SEQ ID NO: 1286243 - protein, 19 aa, Mycobacterium
YWRRQLFRDGLPWRYVGVL

SEQ ID NO: 1286244 - protein, 18 aa, Mycobacterium
YWSRFAEKGWYFAGDGAR

SEQ ID NO: 1286245 - protein, 24 aa, Mycobacterium
YWTMFKQNIGIMIAVAQLAATQSR

SEQ ID NO: 1286246 - protein, 19 aa, Mycobacterium
YWYHAELIDTARLTRLATR

SEQ ID NO: 1286247 - protein, 18 aa, Mycobacterium
YYAAAFFEVIPQVNAEVR

SEQ ID NO: 1286248 - protein, 18 aa, Mycobacterium
YYASKSLILYDIYKGAAD

SEQ ID NO: 1286249 - protein, 25 aa, Mycobacterium
YYAYSFRPNPEWSHMMPPGPEVFRY

SEQ ID NO: 1286250 - protein, 18 aa, Mycobacterium
YYCVVDARPWLRDPAPMW

SEQ ID NO: 1286251 - protein, 24 aa, Mycobacterium
YYEAVMRRQLLPTGRVTYLPMTEY

SEQ ID NO: 1286252 - protein, 17 aa, Mycobacterium
YYGLPMAKCRYEDLGDG

SEQ ID NO: 1286253 - protein, 37 aa, Mycobacterium
YYIDYSDFSLWLLRVSRVRWVGGYGRMDSTSGADYTA

SEQ ID NO: 1286254 - protein, 20 aa, Mycobacterium
YYIGYKFQKGLALESEATRQ

SEQ ID NO: 1286255 - protein, 20 aa, Mycobacterium
YYIPLRDVRPGLLRDDGRPQ

SEQ ID NO: 1286256 - protein, 19 aa, Mycobacterium
YYLDMGWEDLELAVEYDGD

SEQ ID NO: 1286257 - protein, 17 aa, Mycobacterium
YYLSRGVTWVQDAWVEP

SEQ ID NO: 1286258 - protein, 24 aa, Mycobacterium
YYMHFSDGSLIVGIGSPPRTPDVE

SEQ ID NO: 1286259 - protein, 18 aa, Mycobacterium
YYQWGSMTWFAFATAGHA

SEQ ID NO: 1286260 - protein, 17 aa, Mycobacterium
YYSDRVAIVDGDRSLTY

SEQ ID NO: 1286261 - protein, 19 aa, Mycobacterium
RTCAVPGCGATRGLHAHHI

SEQ ID NO: 1286262 - protein, 18 aa, Mycobacterium
DGALGFWKAVREVFPATK

SEQ ID NO: 1286263 - protein, 17 aa, Mycobacterium
KQLRQTLTWDRGKELAA

SEQ ID NO: 1286264 - protein, 17 aa, Mycobacterium
LNNRPRKVLGWKTPAEV

SEQ ID NO: 1286265 - protein, 18 aa, Mycobacterium
PRKVLGWKTPAEVFAQQL

SEQ ID NO: 1286266 - protein, 17 aa, Mycobacterium
SRSVMLVHLPRLEGWGL

SEQ ID NO: 1286267 - protein, 17 aa, Mycobacterium
YDLCMSRNIPLSMTLGR

SEQ ID NO: 1286268 - protein, 19 aa, Mycobacterium
FGVPIFKLGGAPVKVVSSV

SEQ ID NO: 1286269 - protein, 18 aa, Mycobacterium
LALTELWRSYGVTPDAVI

SEQ ID NO: 1286270 - protein, 24 aa, Mycobacterium
LPFSRIRILLRLSRGSMTVKEVAH

SEQ ID NO: 1286271 - protein, 20 aa, Mycobacterium
AAGFMTVWARMYAPDGAAFE

SEQ ID NO: 1286272 - protein, 23 aa, Mycobacterium
GHTWKCLADGLGAITHIATPKKG

SEQ ID NO: 1286273 - protein, 23 aa, Mycobacterium
ITPWNFPVVLAFMKLAPALVAGN

SEQ ID NO: 1286274 - protein, 19 aa, Mycobacterium
KAHEVRAYLTLAIITCEAM

SEQ ID NO: 1286275 - protein, 21 aa, Mycobacterium
KRFSSAILPAWARKSPQMSEV

SEQ ID NO: 1286276 - protein, 25 aa, Mycobacterium
LDSIFKRSWLFVGHESMIPKPGDFR

SEQ ID NO: 1286277 - protein, 19 aa, Mycobacterium
LVITHGWPGSIVEFHNVIE

SEQ ID NO: 1286278 - protein, 19 aa, Mycobacterium
MGTAFYGRGFIMWQPRGPR

SEQ ID NO: 1286279 - protein, 20 aa, Mycobacterium
MSEVLPLLYLHGLSTSDFTP

SEQ ID NO: 1286280 - protein, 20 aa, Mycobacterium
NDEWLKWLLVRRGSGGEFDL

SEQ ID NO: 1286281 - protein, 17 aa, Mycobacterium
PPTHFGFSLGDVTTGIM

SEQ ID NO: 1286282 - protein, 18 aa, Mycobacterium
QEDFIGIHFFSPVDKMPL

SEQ ID NO: 1286283 - protein, 23 aa, Mycobacterium
RELHVVEAWGLIFVSMAAQPPPF

SEQ ID NO: 1286284 - protein, 17 aa, Mycobacterium
TEVWEWCLVESSAPRAV

SEQ ID NO: 1286285 - protein, 19 aa, Mycobacterium
WLLRACAKLGIRLVHSAPG

SEQ ID NO: 1286286 - protein, 21 aa, Mycobacterium
AHLRGSLTWDQGCEMAGHKQF

SEQ ID NO: 1286287 - protein, 20 aa, Mycobacterium
ANEILKRAASFFGAELDRQH

SEQ ID NO: 1286288 - protein, 19 aa, Mycobacterium
ANLKCLCRKHHLLKTFWTG

SEQ ID NO: 1286289 - protein, 19 aa, Mycobacterium
GCTKPCCTVGAYGCQVHHV

SEQ ID NO: 1286290 - protein, 23 aa, Mycobacterium
KEIQLRMVFGYDMFDDFPAVLAL

SEQ ID NO: 1286291 - protein, 21 aa, Mycobacterium
KKPRSAWRRFVYPAPNACWQL

SEQ ID NO: 1286292 - protein, 19 aa, Mycobacterium
LRHRLRLGVLAALDQRIAV

SEQ ID NO: 1286293 - protein, 21 aa, Mycobacterium
LRLAPTPPWHTTRWQVTRIGD

SEQ ID NO: 1286294 - protein, 18 aa, Mycobacterium
LTEAFLWSEFRVVTKTAT

SEQ ID NO: 1286295 - protein, 24 aa, Mycobacterium
RLCIPVPFYHCFGMVMGNLGCTTH

SEQ ID NO: 1286296 - protein, 22 aa, Mycobacterium
SAYRSYAWRDACTQLHITPKRT

SEQ ID NO: 1286297 - protein, 22 aa, Mycobacterium
SCSYPLTGLRCVNRVYTDYAVF

SEQ ID NO: 1286298 - protein, 18 aa, Mycobacterium
TCVVPGCGATRGLHAHHI

SEQ ID NO: 1286299 - protein, 17 aa, Mycobacterium
VCACLRMLAGHRPSRLH

SEQ ID NO: 1286300 - protein, 19 aa, Mycobacterium
VGVNVRTARDWRKGIRHTN

SEQ ID NO: 1286301 - protein, 19 aa, Mycobacterium
VRTARDWRKGIRHTNNTRV

SEQ ID NO: 1286302 - protein, 20 aa, Mycobacterium
AADEIVRWATPVSAFQRTAL

SEQ ID NO: 1286303 - protein, 21 aa, Mycobacterium
AENGRSWSRWSFIGAGAPSAL

SEQ ID NO: 1286304 - protein, 18 aa, Mycobacterium
AETGIIYIDEVDKIARKS

SEQ ID NO: 1286305 - protein, 18 aa, Mycobacterium
AGGFGVLGAVGFTPEQLE

SEQ ID NO: 1286306 - protein, 26 aa, Mycobacterium
AILIRPAPVPGFRGPRSFALPEFDPF

SEQ ID NO: 1286307 - protein, 23 aa, Mycobacterium
AIRAFRAAYEMGIATVAVYPYED

SEQ ID NO: 1286308 - protein, 19 aa, Mycobacterium
AIRRLVKRGGPITFQAVQR

SEQ ID NO: 1286309 - protein, 19 aa, Mycobacterium
AKTTFGRIGVKVWIYKGDI

SEQ ID NO: 1286310 - protein, 19 aa, Mycobacterium
ANLRLVVSLAKRYTGRGMA

SEQ ID NO: 1286311 - protein, 20 aa, Mycobacterium
APARAYNPLFIWGESGLGKT

SEQ ID NO: 1286312 - protein, 22 aa, Mycobacterium
APWNYPMMMAIWKICPAIAAGN

SEQ ID NO: 1286313 - protein, 19 aa, Mycobacterium
AQPLWRVLVALSIRHVGPT

SEQ ID NO: 1286314 - protein, 21 aa, Mycobacterium
ARVAMKWGFGHLGRFSAEYRR

SEQ ID NO: 1286315 - protein, 17 aa, Mycobacterium
ASTIWDDVRECVGGYTC

SEQ ID NO: 1286316 - protein, 23 aa, Mycobacterium
AYFPRGIKPVSVWLSHEYVRASP

SEQ ID NO: 1286317 - protein, 25 aa, Mycobacterium
CGKYKRVRFKGIICERCGVEVTRAK

SEQ ID NO: 1286318 - protein, 18 aa, Mycobacterium
CREALAVNVKPKFAVDAM

SEQ ID NO: 1286319 - protein, 17 aa, Mycobacterium
DATQIFGGYGFMNEYPV

SEQ ID NO: 1286320 - protein, 19 aa, Mycobacterium
DAVIAVHLRGHFLLTRNAA

SEQ ID NO: 1286321 - protein, 21 aa, Mycobacterium
DAVKLRLGIGYVIQSAGLMPH

SEQ ID NO: 1286322 - protein, 19 aa, Mycobacterium
DCARLRFILTAQRDQYLPL

SEQ ID NO: 1286323 - protein, 18 aa, Mycobacterium
DEAIKLGDKVAVFGRGGV

SEQ ID NO: 1286324 - protein, 19 aa, Mycobacterium
DIRSIPTLMAFKKGKLVFN

SEQ ID NO: 1286325 - protein, 22 aa, Mycobacterium
DKALEGFTMFALNQGEVCTCPS

SEQ ID NO: 1286326 - protein, 19 aa, Mycobacterium
DLLKCSFCGKSQKQVKKLI

SEQ ID NO: 1286327 - protein, 17 aa, Mycobacterium
DLLLKRAADLGVQIRYE

SEQ ID NO: 1286328 - protein, 23 aa, Mycobacterium
DPYRLAGELGMPPWRVQKAQKQA

SEQ ID NO: 1286329 - protein, 24 aa, Mycobacterium
DRIRRAHLLLAMFNALQPGVFALS

SEQ ID NO: 1286330 - protein, 28 aa, Mycobacterium
DSADGVWSRLKFEGGVHRVQRVPVTESQ

SEQ ID NO: 1286331 - protein, 23 aa, Mycobacterium
DVFGLRAPWNGNWRKAVEGGIQV

SEQ ID NO: 1286332 - protein, 17 aa, Mycobacterium
DYFKKGAIEFAWTLLTN

SEQ ID NO: 1286333 - protein, 18 aa, Mycobacterium
EAIGVNFIDTYFRSGLYP

SEQ ID NO: 1286334 - protein, 17 aa, Mycobacterium
EAMLFGEYIRLMALVEY

SEQ ID NO: 1286335 - protein, 19 aa, Mycobacterium
EEVTACWSGNVACGPAPVT

SEQ ID NO: 1286336 - protein, 18 aa, Mycobacterium
EGVVSLGLYSRIFHNNIK

SEQ ID NO: 1286337 - protein, 21 aa, Mycobacterium
EIASPRLGFRIQLDPLELESL

SEQ ID NO: 1286338 - protein, 17 aa, Mycobacterium
EIYRAPLSYPFRDAEFG

SEQ ID NO: 1286339 - protein, 19 aa, Mycobacterium
ELKGKLDGYALRVPIPTGS

SEQ ID NO: 1286340 - protein, 20 aa, Mycobacterium
ELRIAQAQLVGWLEGLFHGI

SEQ ID NO: 1286341 - protein, 19 aa, Mycobacterium
EPEAFKWIQRAAMDRRTTM

SEQ ID NO: 1286342 - protein, 18 aa, Mycobacterium
FAAAAGFPRPILHGLCTY

SEQ ID NO: 1286343 - protein, 17 aa, Mycobacterium
FAFSHCRDVVAAVTNAG

SEQ ID NO: 1286344 - protein, 18 aa, Mycobacterium
FAFTHCRDVVVAVSKAGG

SEQ ID NO: 1286345 - protein, 17 aa, Mycobacterium
FFHRLGPVLARRLLLTG

SEQ ID NO: 1286346 - protein, 19 aa, Mycobacterium
FKDAELLGVPWIVVVGRGW

SEQ ID NO: 1286347 - protein, 21 aa, Mycobacterium
FLFYSGFYLPMYWSSRAKLTN

SEQ ID NO: 1286348 - protein, 20 aa, Mycobacterium
FPPVELFMQMPWRTEIIEGL

SEQ ID NO: 1286349 - protein, 19 aa, Mycobacterium
FRECAARALLLPRRHPGKR

SEQ ID NO: 1286350 - protein, 20 aa, Mycobacterium
FRGPRSFALPEFDPFWERVV

SEQ ID NO: 1286351 - protein, 18 aa, Mycobacterium
FVSSPGYEHAWLNPDNTE

SEQ ID NO: 1286352 - protein, 18 aa, Mycobacterium
GAFPAWLAPVQVVGIPVA

SEQ ID NO: 1286353 - protein, 23 aa, Mycobacterium
GAKMVTAVACARVPKLTVVIGGS

SEQ ID NO: 1286354 - protein, 21 aa, Mycobacterium
GDARGGAALSVREVTGVPILF

SEQ ID NO: 1286355 - protein, 20 aa, Mycobacterium
GDGFARFWLHNGWVTMGGEK

SEQ ID NO: 1286356 - protein, 17 aa, Mycobacterium
GEPFPYPVTVGYMYILK

SEQ ID NO: 1286357 - protein, 25 aa, Mycobacterium
GHIELAAPVTHIWYFKGVPSRLGYL

SEQ ID NO: 1286358 - protein, 24 aa, Mycobacterium
GHRKGFLQFRWQRVSRELTPADGP

SEQ ID NO: 1286359 - protein, 21 aa, Mycobacterium
GKAEKCTLCYPRIEVGLPTVC

SEQ ID NO: 1286360 - protein, 19 aa, Mycobacterium
GLEFPVVFVTGWEDGMFPH

SEQ ID NO: 1286361 - protein, 19 aa, Mycobacterium
GMPDAKAWIAYGASPRASL

SEQ ID NO: 1286362 - protein, 18 aa, Mycobacterium
GPCKMVAPVLEEIASEKA

SEQ ID NO: 1286363 - protein, 17 aa, Mycobacterium
GPTRDWECYCGKYKRVR

SEQ ID NO: 1286364 - protein, 21 aa, Mycobacterium
GRGPTPFRWSLTAGPAEPATV

SEQ ID NO: 1286365 - protein, 23 aa, Mycobacterium
GRWGRATLEVCFAILQSAYEDRE

SEQ ID NO: 1286366 - protein, 18 aa, Mycobacterium
GSAKRITAILPFYPYARQ

SEQ ID NO: 1286367 - protein, 19 aa, Mycobacterium
GSMSLSFSDPRFDEVKAPV

SEQ ID NO: 1286368 - protein, 18 aa, Mycobacterium
GTNLKAWLYRILTNTYIN

SEQ ID NO: 1286369 - protein, 20 aa, Mycobacterium
GVHVFLRIATDWDFIAVRRA

SEQ ID NO: 1286370 - protein, 19 aa, Mycobacterium
GVTDFSLAMIDPWPAGYYG

SEQ ID NO: 1286371 - protein, 22 aa, Mycobacterium
HSAFKLLNWQGGSGNVLVSKPY

SEQ ID NO: 1286372 - protein, 21 aa, Mycobacterium
HSVKVIPGRGAWLEFDVDKRD

SEQ ID NO: 1286373 - protein, 23 aa, Mycobacterium
IFRARPSPFYVMDEVEAALDDVN

SEQ ID NO: 1286374 - protein, 18 aa, Mycobacterium
IGGNWAFGNPNGHSSAYR

SEQ ID NO: 1286375 - protein, 22 aa, Mycobacterium
IIEPGCLDLLFRGEIPEGVDPA

SEQ ID NO: 1286376 - protein, 18 aa, Mycobacterium
ILRVAVWELLHAEDVPEP

SEQ ID NO: 1286377 - protein, 19 aa, Mycobacterium
ILVELGLDWDRIIELKTAG

SEQ ID NO: 1286378 - protein, 23 aa, Mycobacterium
INYLRCIGCGLCIEACPTRALTM

SEQ ID NO: 1286379 - protein, 20 aa, Mycobacterium
IPSRAYVSAFGFKGPDQQKP

SEQ ID NO: 1286380 - protein, 19 aa, Mycobacterium
IPTLMAFKKGKLVFNQAGA

SEQ ID NO: 1286381 - protein, 19 aa, Mycobacterium
IQSRLGFLLDVGLDYLSLS

SEQ ID NO: 1286382 - protein, 19 aa, Mycobacterium
IRAGAGLVLAGLVADGDTE

SEQ ID NO: 1286383 - protein, 20 aa, Mycobacterium
ISRQLWWGHRIPIWHGPNGE

SEQ ID NO: 1286384 - protein, 18 aa, Mycobacterium
ITAILPFYPYARQDKKHR

SEQ ID NO: 1286385 - protein, 18 aa, Mycobacterium
IYHFTRRLLVGIANDIER

SEQ ID NO: 1286386 - protein, 24 aa, Mycobacterium
IYPDGRFSYQLTIYIFRYGEGTVM

SEQ ID NO: 1286387 - protein, 23 aa, Mycobacterium
KAGPALACGNAFILKPSERDPSV

SEQ ID NO: 1286388 - protein, 23 aa, Mycobacterium
KDPKRPSGSFIFAGPSGVGKTEL

SEQ ID NO: 1286389 - protein, 21 aa, Mycobacterium
KEGPAALPWGDLGVDVVVEST

SEQ ID NO: 1286390 - protein, 19 aa, Mycobacterium
KGNACLTCSVFVTDHTHRD

SEQ ID NO: 1286391 - protein, 19 aa, Mycobacterium
KNHRNAWRPAHIHFSLFGT

SEQ ID NO: 1286392 - protein, 23 aa, Mycobacterium
KPVRCEVWEGFIFVNFDDDAEPL

SEQ ID NO: 1286393 - protein, 17 aa, Mycobacterium
KRGFLCQYHLWSYDLEG

SEQ ID NO: 1286394 - protein, 17 aa, Mycobacterium
LCRRRLLLDQTVLLAKN

SEQ ID NO: 1286395 - protein, 17 aa, Mycobacterium
LEDWAKWGQARHDYFLR

SEQ ID NO: 1286396 - protein, 20 aa, Mycobacterium
LEVEEVYLPLARLIHLQVAA

SEQ ID NO: 1286397 - protein, 18 aa, Mycobacterium
LEYLFPRSWLFVGHASQV

SEQ ID NO: 1286398 - protein, 19 aa, Mycobacterium
LFDPRFQKLGIHPGGGATW

SEQ ID NO: 1286399 - protein, 23 aa, Mycobacterium
LFFKEKRYDLARVGRYKVNKKLG

SEQ ID NO: 1286400 - protein, 18 aa, Mycobacterium
LIDRAARWLLNYRPQPLA

SEQ ID NO: 1286401 - protein, 21 aa, Mycobacterium
LKLVKPLVITEGFALLSVPTP

SEQ ID NO: 1286402 - protein, 21 aa, Mycobacterium
LKNVYAIAVGMGYSLGIGENT

SEQ ID NO: 1286403 - protein, 18 aa, Mycobacterium
LKRPIPFLPGTIGLITGR

SEQ ID NO: 1286404 - protein, 24 aa, Mycobacterium
LLDTCRRCFASLFTDRAIHYRIDQ

SEQ ID NO: 1286405 - protein, 18 aa, Mycobacterium
LLESFLFYSGFYLPMYWS

SEQ ID NO: 1286406 - protein, 18 aa, Mycobacterium
LMDLCTGVAFPAFPALLA

SEQ ID NO: 1286407 - protein, 22 aa, Mycobacterium
LMRAALPLGLWVPVLPGTRQVT

SEQ ID NO: 1286408 - protein, 24 aa, Mycobacterium
LMRSCTGWPSGTWIDPPRRTAPDG

SEQ ID NO: 1286409 - protein, 17 aa, Mycobacterium
LPHAVLMMIPEAWENNT

SEQ ID NO: 1286410 - protein, 17 aa, Mycobacterium
LPHAVLMMIPEAWERHE

SEQ ID NO: 1286411 - protein, 24 aa, Mycobacterium
LRALKRLKVVAAFQTNRNSPMGMV

SEQ ID NO: 1286412 - protein, 20 aa, Mycobacterium
LRFLSSPLWRAYTSTYVEGY

SEQ ID NO: 1286413 - protein, 23 aa, Mycobacterium
LRLGEYDVLVGINLLREGLDLPE

SEQ ID NO: 1286414 - protein, 24 aa, Mycobacterium
LRMLRPDLTIGFFLHIPFPPVELF

SEQ ID NO: 1286415 - protein, 18 aa, Mycobacterium
LRPWVPVVSLVKGLEQGT

SEQ ID NO: 1286416 - protein, 23 aa, Mycobacterium
LSHDTMEVWSWFLVEKDADEEFK

SEQ ID NO: 1286417 - protein, 17 aa, Mycobacterium
LVITEGFALLSVPTPFV

SEQ ID NO: 1286418 - protein, 19 aa, Mycobacterium
LVVSLAKRYTGRGMAFLDL

SEQ ID NO: 1286419 - protein, 19 aa, Mycobacterium
LYEGFSLPAVEAMASGTPI

SEQ ID NO: 1286420 - protein, 23 aa, Mycobacterium
LYPECPRVYGVAVMGDLSRRRWW

SEQ ID NO: 1286421 - protein, 18 aa, Mycobacterium
MDNLKFLIDNGIHAVVGT

SEQ ID NO: 1286422 - protein, 20 aa, Mycobacterium
MKLDFLITVDWDYYKKFMSV

SEQ ID NO: 1286423 - protein, 19 aa, Mycobacterium
MPAMIRLGGKMYGADGRTK

SEQ ID NO: 1286424 - protein, 17 aa, Mycobacterium
MSIFAVMIQNHFFQHVD

SEQ ID NO: 1286425 - protein, 17 aa, Mycobacterium
NHAAGWVRMDFIVPSRG

SEQ ID NO: 1286426 - protein, 23 aa, Mycobacterium
NRKVLPGYILVRMELNDESWGAV

SEQ ID NO: 1286427 - protein, 18 aa, Mycobacterium
PDERGMRTVMCILNGQLR

SEQ ID NO: 1286428 - protein, 17 aa, Mycobacterium
PDHPWAREHPEWFTVLP

SEQ ID NO: 1286429 - protein, 20 aa, Mycobacterium
PEFRAAVVLCDIEGLSYEEI

SEQ ID NO: 1286430 - protein, 18 aa, Mycobacterium
PELRPMVQLDGGRFATSD

SEQ ID NO: 1286431 - protein, 18 aa, Mycobacterium
PENPRFLMCTPLSHAGAA

SEQ ID NO: 1286432 - protein, 18 aa, Mycobacterium
PGALIGFLGPRVYEHLYG

SEQ ID NO: 1286433 - protein, 17 aa, Mycobacterium
PGTEYVWFNNVETRPGQ

SEQ ID NO: 1286434 - protein, 18 aa, Mycobacterium
PGYPCYRNILTALGCEVV

SEQ ID NO: 1286435 - protein, 25 aa, Mycobacterium
PIAKELPMEYALELNRLIELQMEGA

SEQ ID NO: 1286436 - protein, 18 aa, Mycobacterium
PICEFVRATGEIHLNSTW

SEQ ID NO: 1286437 - protein, 18 aa, Mycobacterium
PLGVPRPRMVGVLRGFDP

SEQ ID NO: 1286438 - protein, 21 aa, Mycobacterium
PLPQTRFVLRKALAAHLPVIL

SEQ ID NO: 1286439 - protein, 19 aa, Mycobacterium
PMGPLRLSDLIGLDTMKLI

SEQ ID NO: 1286440 - protein, 18 aa, Mycobacterium
PRIDPAVICLVHDGHDRA

SEQ ID NO: 1286441 - protein, 20 aa, Mycobacterium
PRLSLQWWVKVESLAKAAGD

SEQ ID NO: 1286442 - protein, 19 aa, Mycobacterium
QADKYDVPRICFVNKMDKL

SEQ ID NO: 1286443 - protein, 26 aa, Mycobacterium
QCGLPKLMALELFKPFVMKRLVDLNH

SEQ ID NO: 1286444 - protein, 23 aa, Mycobacterium
QHTRLRPAVNLGLDVLNTALREL

SEQ ID NO: 1286445 - protein, 19 aa, Mycobacterium
QLFKQLLMVAGMERYYQIA

SEQ ID NO: 1286446 - protein, 23 aa, Mycobacterium
QMGKDGWLTLSWPKEFGGQARPP

SEQ ID NO: 1286447 - protein, 23 aa, Mycobacterium
QRGEPVSCFLLRIEDNMESIGRS

SEQ ID NO: 1286448 - protein, 17 aa, Mycobacterium
QVLKEIQSRLGFLLDVG

SEQ ID NO: 1286449 - protein, 18 aa, Mycobacterium
RAHRGIVAVNELPDLAER

SEQ ID NO: 1286450 - protein, 23 aa, Mycobacterium
RAYFRGECLRRFGADIAAASWDS

SEQ ID NO: 1286451 - protein, 19 aa, Mycobacterium
RAYSPRFLWMWPNARISVM

SEQ ID NO: 1286452 - protein, 23 aa, Mycobacterium
RDVLIRIGDEFAIQVRALTELAE

SEQ ID NO: 1286453 - protein, 20 aa, Mycobacterium
REMLPHNAVEYFVSYYDYYQ

SEQ ID NO: 1286454 - protein, 19 aa, Mycobacterium
RFLWMWPNARISVMGGEQA

SEQ ID NO: 1286455 - protein, 23 aa, Mycobacterium
RGQEVVEFACGIPHLLKGGFTEN

SEQ ID NO: 1286456 - protein, 18 aa, Mycobacterium
RIGVKVWIYKGDIVGGKR

SEQ ID NO: 1286457 - protein, 18 aa, Mycobacterium
RIKSNWKFVSENFLGDTY

SEQ ID NO: 1286458 - protein, 18 aa, Mycobacterium
RILTGEVFFCQGYSEPEA

SEQ ID NO: 1286459 - protein, 17 aa, Mycobacterium
RKIAERRVFPAVDVNPS

SEQ ID NO: 1286460 - protein, 18 aa, Mycobacterium
RKSFVCGFHGWTYGLDGT

SEQ ID NO: 1286461 - protein, 17 aa, Mycobacterium
RLLFKDEVRAVGRELGL

SEQ ID NO: 1286462 - protein, 21 aa, Mycobacterium
RLPDLRCLMLTSFTSDEAMLD

SEQ ID NO: 1286463 - protein, 19 aa, Mycobacterium
RLVDFAAGLAFALRGSFDK

SEQ ID NO: 1286464 - protein, 18 aa, Mycobacterium
RPETAADEIVRWATPVSA

SEQ ID NO: 1286465 - protein, 20 aa, Mycobacterium
RPKHYWSIYQKMIVKGRDFD

SEQ ID NO: 1286466 - protein, 18 aa, Mycobacterium
RPRGRLMVVAIWEAPAGI

SEQ ID NO: 1286467 - protein, 19 aa, Mycobacterium
RQAAHDWHEFIAFRGRELC

SEQ ID NO: 1286468 - protein, 17 aa, Mycobacterium
RRCGWFDAVIARYATRV

SEQ ID NO: 1286469 - protein, 25 aa, Mycobacterium
RRFLERRLRETFGFEGSPIRINVRV

SEQ ID NO: 1286470 - protein, 22 aa, Mycobacterium
RRRIGELWAQFSAVAADNPHAW

SEQ ID NO: 1286471 - protein, 22 aa, Mycobacterium
RSYNCLKREGVHTVGELVARTE

SEQ ID NO: 1286472 - protein, 18 aa, Mycobacterium
RTLAVAVYNHYKRIQAGE

SEQ ID NO: 1286473 - protein, 17 aa, Mycobacterium
RYLPIWIGQSEAAAIAL

SEQ ID NO: 1286474 - protein, 19 aa, Mycobacterium
RYRGLRAPHKIKMGVSGCA

SEQ ID NO: 1286475 - protein, 19 aa, Mycobacterium
RYSGHAIAGVSGFGFGGAN

SEQ ID NO: 1286476 - protein, 23 aa, Mycobacterium
SGEQRLSGFLLWQSAYSEMWFTE

SEQ ID NO: 1286477 - protein, 18 aa, Mycobacterium
SMCFPTFTGFSARHLNMH

SEQ ID NO: 1286478 - protein, 21 aa, Mycobacterium
SRAQLLELVWGYDFAADTNVV

SEQ ID NO: 1286479 - protein, 23 aa, Mycobacterium
SRKRNLVDFGFRLPSAVDNRPLT

SEQ ID NO: 1286480 - protein, 19 aa, Mycobacterium
SRMAIAMARAGGMGVLHRN

SEQ ID NO: 1286481 - protein, 20 aa, Mycobacterium
SRRAKRLIVFDVDSTLIQGE

SEQ ID NO: 1286482 - protein, 17 aa, Mycobacterium
TALVAALCRQLRDELSL

SEQ ID NO: 1286483 - protein, 20 aa, Mycobacterium
TEFLRLTLRTTLELGVDPAS

SEQ ID NO: 1286484 - protein, 19 aa, Mycobacterium
TIDQIACIRRACQITEQAV

SEQ ID NO: 1286485 - protein, 17 aa, Mycobacterium
TLKAVAVKAPFFGDRRK

SEQ ID NO: 1286486 - protein, 26 aa, Mycobacterium
TNTFPSWPLAHPFRFVAHNGEINTVR

SEQ ID NO: 1286487 - protein, 25 aa, Mycobacterium
TNTFPSWPLAHPFRRVAHNGEINTV

SEQ ID NO: 1286488 - protein, 20 aa, Mycobacterium
TRPFGPICEFVRATGEIHLN

SEQ ID NO: 1286489 - protein, 22 aa, Mycobacterium
TVFWPIPRVYSGLVRIDRYETS

SEQ ID NO: 1286490 - protein, 19 aa, Mycobacterium
VAGDWQLCRRRLLLDQTVL

SEQ ID NO: 1286491 - protein, 17 aa, Mycobacterium
VAIRLGVDPRKADQMVR

SEQ ID NO: 1286492 - protein, 18 aa, Mycobacterium
VDIQRSLPVFGWQDQHGH

SEQ ID NO: 1286493 - protein, 19 aa, Mycobacterium
VDVAFNWDHFFPLYGDPDG

SEQ ID NO: 1286494 - protein, 19 aa, Mycobacterium
VECQSRLLAAYAVGRYALP

SEQ ID NO: 1286495 - protein, 20 aa, Mycobacterium
VEIGGPFSLELCGGTHVRSS

SEQ ID NO: 1286496 - protein, 17 aa, Mycobacterium
VFGRRAGIAAANYALGH

SEQ ID NO: 1286497 - protein, 24 aa, Mycobacterium
VGGICIGCTMPGFPDKFMPFMDEP

SEQ ID NO: 1286498 - protein, 18 aa, Mycobacterium
VHLRGHFLLTRNAATYWR

SEQ ID NO: 1286499 - protein, 24 aa, Mycobacterium
VIQRELDRYLPFLATTRILIAAVR

SEQ ID NO: 1286500 - protein, 22 aa, Mycobacterium
VLDRNGLRPGRWWRTIDDRIIL

SEQ ID NO: 1286501 - protein, 19 aa, Mycobacterium
VLGNWTGIPVFKLTEEETT

SEQ ID NO: 1286502 - protein, 21 aa, Mycobacterium
VMPTHCPECGTELAPAKEGDA

SEQ ID NO: 1286503 - protein, 17 aa, Mycobacterium
VQKWRIKSNWKFVSENF

SEQ ID NO: 1286504 - protein, 18 aa, Mycobacterium
VRAAVKWHLGTMLESGAL

SEQ ID NO: 1286505 - protein, 17 aa, Mycobacterium
VSTCATCDGFFFRDQDI

SEQ ID NO: 1286506 - protein, 20 aa, Mycobacterium
VTFDLRWKAACGLPVTAGAF

SEQ ID NO: 1286507 - protein, 19 aa, Mycobacterium
VVGRLVWNAGLLAPVEGQL

SEQ ID NO: 1286508 - protein, 18 aa, Mycobacterium
VVRLRFGLTDGQPRTLDE

SEQ ID NO: 1286509 - protein, 19 aa, Mycobacterium
WAREHPEWFTVLPDGTIAY

SEQ ID NO: 1286510 - protein, 18 aa, Mycobacterium
WKAACGLPVTAGAFHSTT

SEQ ID NO: 1286511 - protein, 17 aa, Mycobacterium
WTNRPGTEYVWFNNVET

SEQ ID NO: 1286512 - protein, 20 aa, Mycobacterium
YRAPLSYPFRDAEFGKELAT

SEQ ID NO: 1286513 - protein, 22 aa, Mycobacterium
YRGCSHACRYCFARPTHEYLDF

SEQ ID NO: 1286514 - protein, 23 aa, Mycobacterium
YVICEVLAWRGIWLSEERRRIGN

SEQ ID NO: 1286515 - protein, 19 aa, Mycobacterium
AAACARLALEPSLTPAEAV

SEQ ID NO: 1286516 - protein, 18 aa, Mycobacterium
AAACPFAPPPRMLEMGAV

SEQ ID NO: 1286517 - protein, 24 aa, Mycobacterium
AAALKARIFDPLGLRNTMLPAAAD

SEQ ID NO: 1286518 - protein, 20 aa, Mycobacterium
AAALSCARMGRFLEVDALAE

SEQ ID NO: 1286519 - protein, 26 aa, Mycobacterium
AAAREFKPLILVGGYSAYPRRVNFAK

SEQ ID NO: 1286520 - protein, 18 aa, Mycobacterium
AAARLAANLMKWTGISPQ

SEQ ID NO: 1286521 - protein, 17 aa, Mycobacterium
AAAVWRIRRAAPMLPTV

SEQ ID NO: 1286522 - protein, 21 aa, Mycobacterium
AACAEAGITFIGPRAELLELT

SEQ ID NO: 1286523 - protein, 17 aa, Mycobacterium
AADGLTWHHPLSSLFPM

SEQ ID NO: 1286524 - protein, 20 aa, Mycobacterium
AAENFRFFADLVVAQADDAY

SEQ ID NO: 1286525 - protein, 18 aa, Mycobacterium
AAFCDRLKAAGAQAFKDH

SEQ ID NO: 1286526 - protein, 17 aa, Mycobacterium
AAFDHEEICVAIIKHAN

SEQ ID NO: 1286527 - protein, 21 aa, Mycobacterium
AAFPRYHPRWAWWTNAVPGLR

SEQ ID NO: 1286528 - protein, 17 aa, Mycobacterium
AAGLPILGKTNMDEFAM

SEQ ID NO: 1286529 - protein, 25 aa, Mycobacterium
AAGVCFPDLLLLRGEYQLKLEPPFI

SEQ ID NO: 1286530 - protein, 19 aa, Mycobacterium
AAHKAHWGVCLARTDPDAP

SEQ ID NO: 1286531 - protein, 19 aa, Mycobacterium
AAIDAVLIGSAWQRCRVHF

SEQ ID NO: 1286532 - protein, 18 aa, Mycobacterium
AAIKRPGSFLARQVPQFL

SEQ ID NO: 1286533 - protein, 18 aa, Mycobacterium
AAILASIAFHTRVTADDV

SEQ ID NO: 1286534 - protein, 18 aa, Mycobacterium
AAILPCYWIYARVGEELI

SEQ ID NO: 1286535 - protein, 19 aa, Mycobacterium
AAKWREIFGPQNFFLELMD

SEQ ID NO: 1286536 - protein, 25 aa, Mycobacterium
AALARDFLLTWFVYTAWELDDAKRV

SEQ ID NO: 1286537 - protein, 19 aa, Mycobacterium
AALDECFDQIAAIQRAARL

SEQ ID NO: 1286538 - protein, 22 aa, Mycobacterium
AALERLETLLALIEGWVQTVVT

SEQ ID NO: 1286539 - protein, 19 aa, Mycobacterium
AALGRYGGKWAHDESRKSF

SEQ ID NO: 1286540 - protein, 22 aa, Mycobacterium
AALRFELCLGVSGVHYPGDAGR

SEQ ID NO: 1286541 - protein, 23 aa, Mycobacterium
AALTARLAFDWAQLEPGDRVLIH

SEQ ID NO: 1286542 - protein, 19 aa, Mycobacterium
AAMFDGRFAGFADFLILEG

SEQ ID NO: 1286543 - protein, 18 aa, Mycobacterium
AANLMKWTGISPQHVART

SEQ ID NO: 1286544 - protein, 24 aa, Mycobacterium
AAPFDLARLGPWRDRITSFPADFS

SEQ ID NO: 1286545 - protein, 25 aa, Mycobacterium
AAPLKELICRGTVWSLRREARKPGS

SEQ ID NO: 1286546 - protein, 19 aa, Mycobacterium
AAQSWPLERIRSVKRATGA

SEQ ID NO: 1286547 - protein, 17 aa, Mycobacterium
AAREFCARTGIFILAES

SEQ ID NO: 1286548 - protein, 18 aa, Mycobacterium
AARLGVDVVLPWDGRDHY

SEQ ID NO: 1286549 - protein, 18 aa, Mycobacterium
AARLPRYFPSTLRDQFAA

SEQ ID NO: 1286550 - protein, 18 aa, Mycobacterium
AASAVRWAIDLGLVPAAD

SEQ ID NO: 1286551 - protein, 19 aa, Mycobacterium
AAVGFAEWLAVTYGDDGIG

SEQ ID NO: 1286552 - protein, 21 aa, Mycobacterium
AAVPPAWRVGDDVAHPELGHG

SEQ ID NO: 1286553 - protein, 17 aa, Mycobacterium
AAYAMRWVAKNVVAAGL

SEQ ID NO: 1286554 - protein, 20 aa, Mycobacterium
ACARLGVLHSVVFAGFSASA

SEQ ID NO: 1286555 - protein, 18 aa, Mycobacterium
ACTTRLRLGVGVLVSSLH

SEQ ID NO: 1286556 - protein, 17 aa, Mycobacterium
ACVPVLLTAIGKLTGTD

SEQ ID NO: 1286557 - protein, 17 aa, Mycobacterium
ADAFCWSMVRSLVGALI

SEQ ID NO: 1286558 - protein, 24 aa, Mycobacterium
ADAGRPWWEWAATYERAFSAAYDA

SEQ ID NO: 1286559 - protein, 25 aa, Mycobacterium
ADALALAICHCWRAPMIARMAAAEA

SEQ ID NO: 1286560 - protein, 17 aa, Mycobacterium
ADALRWGLINDVVPDGT

SEQ ID NO: 1286561 - protein, 17 aa, Mycobacterium
ADDLAYWRRVMADPPEP

SEQ ID NO: 1286562 - protein, 19 aa, Mycobacterium
ADEIVRWATPVTSFQRTAL

SEQ ID NO: 1286563 - protein, 17 aa, Mycobacterium
ADEVIDVVLLWWRDDDG

SEQ ID NO: 1286564 - protein, 21 aa, Mycobacterium
ADGWKLAALRLTRLIMEFENA

SEQ ID NO: 1286565 - protein, 17 aa, Mycobacterium
ADGWVALLRRWLADAEA

SEQ ID NO: 1286566 - protein, 17 aa, Mycobacterium
ADHSKLWFAIAAGLMAS

SEQ ID NO: 1286567 - protein, 19 aa, Mycobacterium
ADIRRALSMLGRISAEGMR

SEQ ID NO: 1286568 - protein, 19 aa, Mycobacterium
ADIRRRVGLVFQDPDDQLF

SEQ ID NO: 1286569 - protein, 19 aa, Mycobacterium
ADKFFGFAATEFGDFTDSE

SEQ ID NO: 1286570 - protein, 18 aa, Mycobacterium
ADLAEWRKIIDLNMSRML

SEQ ID NO: 1286571 - protein, 21 aa, Mycobacterium
ADLPPAVGVLVEYTGDGENGT

SEQ ID NO: 1286572 - protein, 17 aa, Mycobacterium
ADMKARIDATRMLVWRA

SEQ ID NO: 1286573 - protein, 21 aa, Mycobacterium
ADNCKLISWPIATLSPNGVRT

SEQ ID NO: 1286574 - protein, 25 aa, Mycobacterium
ADPFPEFKEGLGLMLELPAPTTLGS

SEQ ID NO: 1286575 - protein, 23 aa, Mycobacterium
ADRGCWLHMLALYRAGRVTDALD

SEQ ID NO: 1286576 - protein, 23 aa, Mycobacterium
ADTHARVGLLPTWGLSVRLPQKV

SEQ ID NO: 1286577 - protein, 20 aa, Mycobacterium
ADYRTRWRIPLGVRESDLSV

SEQ ID NO: 1286578 - protein, 23 aa, Mycobacterium
AEAGYLVSRRGRYGGTFLAEELP

SEQ ID NO: 1286579 - protein, 20 aa, Mycobacterium
AEALAAVNLMSMFGLHRALR

SEQ ID NO: 1286580 - protein, 17 aa, Mycobacterium
AEALCGAVGFIGFAVNG

SEQ ID NO: 1286581 - protein, 23 aa, Mycobacterium
AEALRLVHRLVLPVGEMARQMFA

SEQ ID NO: 1286582 - protein, 17 aa, Mycobacterium
AEALRWAMLSGEPQVVL

SEQ ID NO: 1286583 - protein, 20 aa, Mycobacterium
AEARADELLTAFDLQHAANR

SEQ ID NO: 1286584 - protein, 21 aa, Mycobacterium
AEARYGRKVAWGVEIGSGADA

SEQ ID NO: 1286585 - protein, 22 aa, Mycobacterium
AEAYRAISLLLRRPPGREAFPG

SEQ ID NO: 1286586 - protein, 18 aa, Mycobacterium
AECACDVSDLWIVGAPAA

SEQ ID NO: 1286587 - protein, 17 aa, Mycobacterium
AEDIILWSTTEFGYVTL

SEQ ID NO: 1286588 - protein, 19 aa, Mycobacterium
AEEMIRWVTPVKAFMRTAA

SEQ ID NO: 1286589 - protein, 19 aa, Mycobacterium
AEEMLYLAMEDFRVDVVVG

SEQ ID NO: 1286590 - protein, 21 aa, Mycobacterium
AEFRFPVVVEDAAAQWLSEGE

SEQ ID NO: 1286591 - protein, 22 aa, Mycobacterium
AEGFPSLSSIILNGGLELHPSI

SEQ ID NO: 1286592 - protein, 21 aa, Mycobacterium
AEGIEPFGFYYEKFALAAPAA

SEQ ID NO: 1286593 - protein, 20 aa, Mycobacterium
AEGRGATMIFTRTKRTAQKV

SEQ ID NO: 1286594 - protein, 25 aa, Mycobacterium
AEHSFPYEVVRGMADMGLFGLPFPE

SEQ ID NO: 1286595 - protein, 17 aa, Mycobacterium
AEHYLHFGGVSPINGIN

SEQ ID NO: 1286596 - protein, 17 aa, Mycobacterium
AEILCLPYFLGEKSPLH

SEQ ID NO: 1286597 - protein, 21 aa, Mycobacterium
AEIYVPFSWFEPMWLENLGFA

SEQ ID NO: 1286598 - protein, 19 aa, Mycobacterium
AELPARCVIDGEIVIATAD

SEQ ID NO: 1286599 - protein, 17 aa, Mycobacterium
AELRKNWNVEFDDAGAI

SEQ ID NO: 1286600 - protein, 19 aa, Mycobacterium
AELSGAGWRVQYVELAADH

SEQ ID NO: 1286601 - protein, 17 aa, Mycobacterium
AEMGMSYHLPRIVGTSV

SEQ ID NO: 1286602 - protein, 21 aa, Mycobacterium
AENAFRFALVISHENQHDETM

SEQ ID NO: 1286603 - protein, 17 aa, Mycobacterium
AENILGYTIANDVSARD

SEQ ID NO: 1286604 - protein, 21 aa, Mycobacterium
AEPRKEWTLQFTIGAAPRSSS

SEQ ID NO: 1286605 - protein, 19 aa, Mycobacterium
AEPRTDWLDGIVVRDDHGF

SEQ ID NO: 1286606 - protein, 18 aa, Mycobacterium
AEQCRRLDALGVDYEIVP

SEQ ID NO: 1286607 - protein, 18 aa, Mycobacterium
AEQMLTWPGEPANMILDD

SEQ ID NO: 1286608 - protein, 22 aa, Mycobacterium
AEQRTRFAIRLVDPLRHWKFSD

SEQ ID NO: 1286609 - protein, 20 aa, Mycobacterium
AEVKAGILVVERQFGYLEFH

SEQ ID NO: 1286610 - protein, 21 aa, Mycobacterium
AEVLRRLKALPGFGEQKAKIF

SEQ ID NO: 1286611 - protein, 22 aa, Mycobacterium
AEYVYRFAPLVGIYGGTLEVFR

SEQ ID NO: 1286612 - protein, 17 aa, Mycobacterium
AFAKQWVTECLRAAYPL

SEQ ID NO: 1286613 - protein, 18 aa, Mycobacterium
AFGTSRWSSKLVHGGLRY

SEQ ID NO: 1286614 - protein, 19 aa, Mycobacterium
AFLELCPFAAWGSKFPVGG

SEQ ID NO: 1286615 - protein, 19 aa, Mycobacterium
AFPAIALCQKFAAAGDEPT

SEQ ID NO: 1286616 - protein, 18 aa, Mycobacterium
AFRAELLPACADIAEEAA

SEQ ID NO: 1286617 - protein, 21 aa, Mycobacterium
AFTLDGLGGWFLDGVDGDPSN

SEQ ID NO: 1286618 - protein, 22 aa, Mycobacterium
AGAELGRLGWWDGPRPHCAHEA

SEQ ID NO: 1286619 - protein, 22 aa, Mycobacterium
AGCEWAFVCAVDMPYLTMDFVD

SEQ ID NO: 1286620 - protein, 21 aa, Mycobacterium
AGCGMACPFCATGQGGLQRNL

SEQ ID NO: 1286621 - protein, 22 aa, Mycobacterium
AGDLDHAIAFARRVQTGQLDLN

SEQ ID NO: 1286622 - protein, 26 aa, Mycobacterium
AGDVTIPFLIDWEALEAAEWAALTEL

SEQ ID NO: 1286623 - protein, 18 aa, Mycobacterium
AGILRYSRDLAFAAASAY

SEQ ID NO: 1286624 - protein, 19 aa, Mycobacterium
AGLARAIADIAARARSGDL

SEQ ID NO: 1286625 - protein, 19 aa, Mycobacterium
AGLCRLLARKGVRVAPFKA

SEQ ID NO: 1286626 - protein, 17 aa, Mycobacterium
AGLKTVWAPQGLVQRGQ

SEQ ID NO: 1286627 - protein, 17 aa, Mycobacterium
AGLPEEWSPDSESSREV

SEQ ID NO: 1286628 - protein, 19 aa, Mycobacterium
AGLRPRRFVVLPWLTPTLA

SEQ ID NO: 1286629 - protein, 24 aa, Mycobacterium
AGLRPRTGVGLGIPGVGAPAPAPV

SEQ ID NO: 1286630 - protein, 20 aa, Mycobacterium
AGPVLRPAATLVRRGGQYAE

SEQ ID NO: 1286631 - protein, 24 aa, Mycobacterium
AGRICASLGLAERVLTQPLRTLSG

SEQ ID NO: 1286632 - protein, 23 aa, Mycobacterium
AGRPLLGICGGFQMLCRHIDDAV

SEQ ID NO: 1286633 - protein, 24 aa, Mycobacterium
AGRVDLRLLGPMAAYDFVVTSNPE

SEQ ID NO: 1286634 - protein, 17 aa, Mycobacterium
AGVDCFVAGSAVYSAQD

SEQ ID NO: 1286635 - protein, 17 aa, Mycobacterium
AGVKRYVVISSMGANTE

SEQ ID NO: 1286636 - protein, 23 aa, Mycobacterium
AHEGRLKYCYNFLGIEYYYVTAE

SEQ ID NO: 1286637 - protein, 18 aa, Mycobacterium
AHEQFRWFAGGWAVNADL

SEQ ID NO: 1286638 - protein, 30 aa, Mycobacterium
AHFDWLVECGVPFKAEFFGEPGWEPMGDQG

SEQ ID NO: 1286639 - protein, 19 aa, Mycobacterium
AHSGLRFSVAEGFPDYKPE

SEQ ID NO: 1286640 - protein, 21 aa, Mycobacterium
AIANLRYFASLARSYAFQTSG

SEQ ID NO: 1286641 - protein, 17 aa, Mycobacterium
AIDAGWIDGPRVIPAGH

SEQ ID NO: 1286642 - protein, 24 aa, Mycobacterium
AIDLLKGVVVPAITGAIKSAAPPA

SEQ ID NO: 1286643 - protein, 19 aa, Mycobacterium
AIPAVEAKGALLLEDVGVP

SEQ ID NO: 1286644 - protein, 19 aa, Mycobacterium
AIQLARWAGARVITTVSTS

SEQ ID NO: 1286645 - protein, 19 aa, Mycobacterium
AIVHLGFGFGIVFINPALE

SEQ ID NO: 1286646 - protein, 24 aa, Mycobacterium
AIVKGLRSSTDFEYELQMAQMNKH

SEQ ID NO: 1286647 - protein, 18 aa, Mycobacterium
AIVPWNFPFEVTVNKLGP

SEQ ID NO: 1286648 - protein, 18 aa, Mycobacterium
AKAPRLADTAMFARHSAE

SEQ ID NO: 1286649 - protein, 20 aa, Mycobacterium
AKFATSFARRGLIAEYGISW

SEQ ID NO: 1286650 - protein, 18 aa, Mycobacterium
AKLGCSFAVVGHSERRTY

SEQ ID NO: 1286651 - protein, 19 aa, Mycobacterium
AKTRLAVTVGFEMAAVIAS

SEQ ID NO: 1286652 - protein, 17 aa, Mycobacterium
AKVLMLRCVEYARRYDL

SEQ ID NO: 1286653 - protein, 20 aa, Mycobacterium
AKYTICPAVAHGLDGEIGSV

SEQ ID NO: 1286654 - protein, 21 aa, Mycobacterium
ALAEIKQRWTAIIDEYGSQAI

SEQ ID NO: 1286655 - protein, 20 aa, Mycobacterium
ALAELCRRREILLIVDDVQM

SEQ ID NO: 1286656 - protein, 23 aa, Mycobacterium
ALAESFAAAGARLVLGDVDDAGL

SEQ ID NO: 1286657 - protein, 24 aa, Mycobacterium
ALEEVFIRAGIPYKVVGGVRFYER

SEQ ID NO: 1286658 - protein, 19 aa, Mycobacterium
ALFARSLFDSVIYVSFQEL

SEQ ID NO: 1286659 - protein, 18 aa, Mycobacterium
ALGDMGLRPAMTLRCPVA

SEQ ID NO: 1286660 - protein, 18 aa, Mycobacterium
ALHSPFWWLKCAVGTSNN

SEQ ID NO: 1286661 - protein, 17 aa, Mycobacterium
ALLDRFGMFGVRISIAV

SEQ ID NO: 1286662 - protein, 20 aa, Mycobacterium
ALRGFPPVPSRWLDPAALPE

SEQ ID NO: 1286663 - protein, 19 aa, Mycobacterium
ALTEWRLLTAAALVGLVEE

SEQ ID NO: 1286664 - protein, 23 aa, Mycobacterium
ALVGRCWPAVFAAIGSAATDSGF

SEQ ID NO: 1286665 - protein, 20 aa, Mycobacterium
ALVSFEVFLRAPLRAAMGAD

SEQ ID NO: 1286666 - protein, 23 aa, Mycobacterium
AMCARFRISGLPVVDERGSLVGI

SEQ ID NO: 1286667 - protein, 19 aa, Mycobacterium
AMHTEMWFHPATVDNVATL

SEQ ID NO: 1286668 - protein, 18 aa, Mycobacterium
AMILSTAMLLEWLAERHH

SEQ ID NO: 1286669 - protein, 22 aa, Mycobacterium
AMPAAEFARAWLPVINTADDDD

SEQ ID NO: 1286670 - protein, 17 aa, Mycobacterium
ANARWGNNIAILAGDYL

SEQ ID NO: 1286671 - protein, 17 aa, Mycobacterium
ANIGFSFCYEAQRQVPA

SEQ ID NO: 1286672 - protein, 26 aa, Mycobacterium
ANNEFRPEILLSFGFVPKVESRVGLI

SEQ ID NO: 1286673 - protein, 25 aa, Mycobacterium
ANPEKVWAWYLWRHYMMDAVQPNNG

SEQ ID NO: 1286674 - protein, 24 aa, Mycobacterium
ANRAWRLYRRLGFSDVIRGYHFAG

SEQ ID NO: 1286675 - protein, 19 aa, Mycobacterium
ANSLLPQWRGQAGEAAQAA

SEQ ID NO: 1286676 - protein, 17 aa, Mycobacterium
APAEALFRWLANKDGQN

SEQ ID NO: 1286677 - protein, 18 aa, Mycobacterium
APDGVKLAAGWLVEHAGF

SEQ ID NO: 1286678 - protein, 26 aa, Mycobacterium
APFEAGSPWLLRFFDRISWYPVSAEE

SEQ ID NO: 1286679 - protein, 18 aa, Mycobacterium
APGAMVFPHDSHASQLLG

SEQ ID NO: 1286680 - protein, 17 aa, Mycobacterium
APLGYPAVHHLTSPLRK

SEQ ID NO: 1286681 - protein, 18 aa, Mycobacterium
APMTLRWLRDRFAGRPLS

SEQ ID NO: 1286682 - protein, 19 aa, Mycobacterium
APPDGWRTIGRVLAGPADV

SEQ ID NO: 1286683 - protein, 17 aa, Mycobacterium
APQEHRARVASAVRALN

SEQ ID NO: 1286684 - protein, 23 aa, Mycobacterium
APRIVAGIPVCLCANSEIDAAKE

SEQ ID NO: 1286685 - protein, 22 aa, Mycobacterium
APRPRMLVFGAIDFAAAVAQQG

SEQ ID NO: 1286686 - protein, 18 aa, Mycobacterium
APTAFRWQSEHATHNRIM

SEQ ID NO: 1286687 - protein, 20 aa, Mycobacterium
APTLREVWAVIAPMLAGCTP

SEQ ID NO: 1286688 - protein, 20 aa, Mycobacterium
APVRVGFRLGPPGAGELGVH

SEQ ID NO: 1286689 - protein, 24 aa, Mycobacterium
APVYRLPWQPVFALNFSAVNLGAS

SEQ ID NO: 1286690 - protein, 17 aa, Mycobacterium
AQEFARNKIRSIVEDAQ

SEQ ID NO: 1286691 - protein, 25 aa, Mycobacterium
AQFTHAVALAHVWRSYGVLPDITVG

SEQ ID NO: 1286692 - protein, 18 aa, Mycobacterium
AQILAGFCDVALVIGADT

SEQ ID NO: 1286693 - protein, 18 aa, Mycobacterium
AQLKPLVFEGSQFGGALM

SEQ ID NO: 1286694 - protein, 23 aa, Mycobacterium
AQPVCCPHCGPTLTFRDADGRHT

SEQ ID NO: 1286695 - protein, 20 aa, Mycobacterium
AQRRLPLLIANGADVHVIAR

SEQ ID NO: 1286696 - protein, 18 aa, Mycobacterium
AQRTWFRLSALAERVNAT

SEQ ID NO: 1286697 - protein, 19 aa, Mycobacterium
AQTVARWLVMYLRRPGGQT

SEQ ID NO: 1286698 - protein, 25 aa, Mycobacterium
AQVQRPDLVIGWWAAPTILEHGSPE

SEQ ID NO: 1286699 - protein, 18 aa, Mycobacterium
ARAFKAQALAAVNDIEAA

SEQ ID NO: 1286700 - protein, 17 aa, Mycobacterium
ARAPWEIARPVGADGAL

SEQ ID NO: 1286701 - protein, 25 aa, Mycobacterium
ARARAVAFGDGWCPFPAPAVLAQTA

SEQ ID NO: 1286702 - protein, 19 aa, Mycobacterium
ARARYLLLRLLERSGEQRV

SEQ ID NO: 1286703 - protein, 19 aa, Mycobacterium
ARCALAWSVETAKLAREHN

SEQ ID NO: 1286704 - protein, 20 aa, Mycobacterium
ARDHARSWGGLVVVESAGAA

SEQ ID NO: 1286705 - protein, 23 aa, Mycobacterium
AREAGRRGGSLTAVYNAANEEAA

SEQ ID NO: 1286706 - protein, 17 aa, Mycobacterium
ARFLFYPAVKELTLDIA

SEQ ID NO: 1286707 - protein, 17 aa, Mycobacterium
ARGEAVAAMKAEGIEYD

SEQ ID NO: 1286708 - protein, 20 aa, Mycobacterium
ARGNAVCHPSRLVVIDLSEV

SEQ ID NO: 1286709 - protein, 25 aa, Mycobacterium
ARIEPRWPFKFVRLAAQTIAREVER

SEQ ID NO: 1286710 - protein, 24 aa, Mycobacterium
ARLARRVWPGHDWTALGRAPHLPV

SEQ ID NO: 1286711 - protein, 17 aa, Mycobacterium
ARLEVLDGLGLDYSIMF

SEQ ID NO: 1286712 - protein, 17 aa, Mycobacterium
ARLGAVHSVVFGGFAAH

SEQ ID NO: 1286713 - protein, 25 aa, Mycobacterium
ARLTGEVLRCPRCDAGFDVVHAGAG

SEQ ID NO: 1286714 - protein, 20 aa, Mycobacterium
ARNILGMVCDLYALSVIEED

SEQ ID NO: 1286715 - protein, 20 aa, Mycobacterium
ARPSDSVAIALRVGVPIYVE

SEQ ID NO: 1286716 - protein, 19 aa, Mycobacterium
ARPTVPGWEDVLLGVRSSG

SEQ ID NO: 1286717 - protein, 19 aa, Mycobacterium
ARRALAEFRVRGVSTNIPF

SEQ ID NO: 1286718 - protein, 17 aa, Mycobacterium
ARRVLGGAIAFGGKSTE

SEQ ID NO: 1286719 - protein, 18 aa, Mycobacterium
ARSGLSMAPPFVAPQTAW

SEQ ID NO: 1286720 - protein, 19 aa, Mycobacterium
ARTAFQHCRRLLPGDPIAP

SEQ ID NO: 1286721 - protein, 22 aa, Mycobacterium
ARVKCALLGWMAFKDAVAQASH

SEQ ID NO: 1286722 - protein, 18 aa, Mycobacterium
ARVPWILMHWRSVAAERP

SEQ ID NO: 1286723 - protein, 18 aa, Mycobacterium
ARYLRICVLTQYKSHSLD

SEQ ID NO: 1286724 - protein, 21 aa, Mycobacterium
ASAFLGRLALIRIYKGRIRKG

SEQ ID NO: 1286725 - protein, 19 aa, Mycobacterium
ASAGPRCRDIWLVTAGAER

SEQ ID NO: 1286726 - protein, 26 aa, Mycobacterium
ASALLRASGGWPWLAPGHDPGGVLAL

SEQ ID NO: 1286727 - protein, 17 aa, Mycobacterium
ASGLPWYPGQAVVETAE

SEQ ID NO: 1286728 - protein, 20 aa, Mycobacterium
ASILPITWMYIRMMGAPGLR

SEQ ID NO: 1286729 - protein, 17 aa, Mycobacterium
ASPYAFLGLNFFNTMEY

SEQ ID NO: 1286730 - protein, 19 aa, Mycobacterium
ASQEWLQRRLASLEPEQRK

SEQ ID NO: 1286731 - protein, 22 aa, Mycobacterium
ASVMTHYRWLRALAGFGGLGVR

SEQ ID NO: 1286732 - protein, 19 aa, Mycobacterium
ATAFTRWTALIADRMTADG

SEQ ID NO: 1286733 - protein, 19 aa, Mycobacterium
ATCAPWLDAEWRLVSGDVR

SEQ ID NO: 1286734 - protein, 18 aa, Mycobacterium
ATFEMMKPFLALYMGGMG

SEQ ID NO: 1286735 - protein, 22 aa, Mycobacterium
ATLLTARCPVLFAPAMHTEMWF

SEQ ID NO: 1286736 - protein, 18 aa, Mycobacterium
ATPELVAFMVRYTSGYLC

SEQ ID NO: 1286737 - protein, 19 aa, Mycobacterium
ATPRYLLDFSRRFPDAAVI

SEQ ID NO: 1286738 - protein, 29 aa, Mycobacterium
ATPWLATTVRLAWRVKLMVSAAVAARVRL

SEQ ID NO: 1286739 - protein, 23 aa, Mycobacterium
ATRLDRFIGLVVIDRGHPRVPDP

SEQ ID NO: 1286740 - protein, 18 aa, Mycobacterium
ATRRWELRASQGRPICGV

SEQ ID NO: 1286741 - protein, 17 aa, Mycobacterium
ATVRLVLVGGGPGTGKT

SEQ ID NO: 1286742 - protein, 23 aa, Mycobacterium
ATWPRWAAGLARGGLRQGPQGWV

SEQ ID NO: 1286743 - protein, 17 aa, Mycobacterium
AVDGEGWLATGDIGRID

SEQ ID NO: 1286744 - protein, 23 aa, Mycobacterium
AVEDAWAALTWVAGHGAELSVDT

SEQ ID NO: 1286745 - protein, 21 aa, Mycobacterium
AVELARAWKPATLRAVNKVTA

SEQ ID NO: 1286746 - protein, 18 aa, Mycobacterium
AVGHHWRYSAAVGLVRDM

SEQ ID NO: 1286747 - protein, 24 aa, Mycobacterium
AVGIAAYHCGDWAQALAELRAARR

SEQ ID NO: 1286748 - protein, 19 aa, Mycobacterium
AVLDRLAAYQARSIDIDGC

SEQ ID NO: 1286749 - protein, 17 aa, Mycobacterium
AVLECREALAVNVKPKF

SEQ ID NO: 1286750 - protein, 19 aa, Mycobacterium
AVLRFQYQIARIPLQVIED

SEQ ID NO: 1286751 - protein, 18 aa, Mycobacterium
AVMQCVWVYEHAVDFEGL

SEQ ID NO: 1286752 - protein, 19 aa, Mycobacterium
AVMSCREGLEFATSIASDT

SEQ ID NO: 1286753 - protein, 24 aa, Mycobacterium
AVPPGRLGWNWAKFAFGSWTTLSW

SEQ ID NO: 1286754 - protein, 25 aa, Mycobacterium
AVPPHGWINLHFSLLPAWRGAAPVQ

SEQ ID NO: 1286755 - protein, 18 aa, Mycobacterium
AVPSPGWSLRIDPVGWMS

SEQ ID NO: 1286756 - protein, 18 aa, Mycobacterium
AVPTRWLIRTEPLPTLAG

SEQ ID NO: 1286757 - protein, 23 aa, Mycobacterium
AVRFPVWSGRCGFAVEEFARRHG

SEQ ID NO: 1286758 - protein, 19 aa, Mycobacterium
AVRRRIWELEIGRAHTPWF

SEQ ID NO: 1286759 - protein, 17 aa, Mycobacterium
AVTFSHRYEAAWHFGGG

SEQ ID NO: 1286760 - protein, 19 aa, Mycobacterium
AVVPWNMPQFLIVTKLIPA

SEQ ID NO: 1286761 - protein, 22 aa, Mycobacterium
AWCRSAEGVRLFRFDRIVDARV

SEQ ID NO: 1286762 - protein, 17 aa, Mycobacterium
AWHWRWNPWLMVAQGYA

SEQ ID NO: 1286763 - protein, 17 aa, Mycobacterium
AWLKLVKPLVITEGFAL

SEQ ID NO: 1286764 - protein, 17 aa, Mycobacterium
AWWKIAIDTAGYGRAGA

SEQ ID NO: 1286765 - protein, 18 aa, Mycobacterium
AYAAFRWASEHAAELGVA

SEQ ID NO: 1286766 - protein, 17 aa, Mycobacterium
AYDCARLRFILTAQRDQ

SEQ ID NO: 1286767 - protein, 18 aa, Mycobacterium
AYFPLGWQMACHVHGDAG

SEQ ID NO: 1286768 - protein, 23 aa, Mycobacterium
AYLGHVIVLWSWALKQPNDGRPA

SEQ ID NO: 1286769 - protein, 18 aa, Mycobacterium
AYPQLLFRVGWAPVNADP

SEQ ID NO: 1286770 - protein, 24 aa, Mycobacterium
AYRGHIFWDELFIFPVLNLRLPMI

SEQ ID NO: 1286771 - protein, 17 aa, Mycobacterium
AYRWADGSVVSFRPESN

SEQ ID NO: 1286772 - protein, 23 aa, Mycobacterium
AYSHCIAHGFDLRHGLDQQYRAV

SEQ ID NO: 1286773 - protein, 18 aa, Mycobacterium
CAHLPLPRLVWPSDVVGT

SEQ ID NO: 1286774 - protein, 19 aa, Mycobacterium
CAMCLPAYAVGGDFYDHYR

SEQ ID NO: 1286775 - protein, 18 aa, Mycobacterium
CARMGRFLEVDALAERAA

SEQ ID NO: 1286776 - protein, 17 aa, Mycobacterium
CAVDMPYLTMDFVDDLA

SEQ ID NO: 1286777 - protein, 20 aa, Mycobacterium
CAWPLHRRFGITATARASFA

SEQ ID NO: 1286778 - protein, 18 aa, Mycobacterium
CDICKPTVASILASTSSE

SEQ ID NO: 1286779 - protein, 24 aa, Mycobacterium
CDKGFPSYFLIVADLINYAKSVDI

SEQ ID NO: 1286780 - protein, 23 aa, Mycobacterium
CDPPESFQLYGIVAHVLTFSAHR

SEQ ID NO: 1286781 - protein, 22 aa, Mycobacterium
CDRCWYCEHDLYSCCDTTNPNA

SEQ ID NO: 1286782 - protein, 17 aa, Mycobacterium
CFRCPECSIEVRAQDDL

SEQ ID NO: 1286783 - protein, 24 aa, Mycobacterium
CGADFRLTDAAAWERFYGSAHAGS

SEQ ID NO: 1286784 - protein, 19 aa, Mycobacterium
CGAEVPVPYAKHLEQAALP

SEQ ID NO: 1286785 - protein, 17 aa, Mycobacterium
CGALRPGATIVESTSGT

SEQ ID NO: 1286786 - protein, 22 aa, Mycobacterium
CGAPLLSLRTDRDWIADVVRFV

SEQ ID NO: 1286787 - protein, 25 aa, Mycobacterium
CGLAGTVLRFLPPVAALSTETVEFD

SEQ ID NO: 1286788 - protein, 17 aa, Mycobacterium
CGQRLAFENSLCLNCGS

SEQ ID NO: 1286789 - protein, 18 aa, Mycobacterium
CGTANWYGGTIIDDIVPG

SEQ ID NO: 1286790 - protein, 18 aa, Mycobacterium
CGWFDAVIARYATRVNGI

SEQ ID NO: 1286791 - protein, 23 aa, Mycobacterium
CHGLQCGFCTPGFVTSITALLAD

SEQ ID NO: 1286792 - protein, 23 aa, Mycobacterium
CLSEARFGIVFGSVGAARDCLET

SEQ ID NO: 1286793 - protein, 20 aa, Mycobacterium
CMDCGIPFCHNGCPLGNLIP

SEQ ID NO: 1286794 - protein, 22 aa, Mycobacterium
CMPKSVVINPYFDWGTDRPPNH

SEQ ID NO: 1286795 - protein, 17 aa, Mycobacterium
CNFSYKDMEAWGRKMFV

SEQ ID NO: 1286796 - protein, 18 aa, Mycobacterium
CPDHFLRTKVKPLVLDLP

SEQ ID NO: 1286797 - protein, 20 aa, Mycobacterium
CPDWVPGELWVGGRGIARGY

SEQ ID NO: 1286798 - protein, 17 aa, Mycobacterium
CPFAPRCPLAIDECRAA

SEQ ID NO: 1286799 - protein, 20 aa, Mycobacterium
CQGYRRFATEMARFGLDPSA

SEQ ID NO: 1286800 - protein, 17 aa, Mycobacterium
CRDGACGTCKALCESGT

SEQ ID NO: 1286801 - protein, 18 aa, Mycobacterium
CRPWRYGFGEARRGDPVA

SEQ ID NO: 1286802 - protein, 19 aa, Mycobacterium
CSMRPRSDLVLQIASSSKV

SEQ ID NO: 1286803 - protein, 21 aa, Mycobacterium
CSSCFLVFHRSRLARDSNGTM

SEQ ID NO: 1286804 - protein, 19 aa, Mycobacterium
CTGVAFPAFPALLAAEQGV

SEQ ID NO: 1286805 - protein, 18 aa, Mycobacterium
CTKPCCTVGAYGCQVHHV

SEQ ID NO: 1286806 - protein, 18 aa, Mycobacterium
CTPLPRFGEVTDIANLSV

SEQ ID NO: 1286807 - protein, 18 aa, Mycobacterium
CVIDDVWACSGSDNFNRR

SEQ ID NO: 1286808 - protein, 18 aa, Mycobacterium
CWRPELPEDWPGVLCRRC

SEQ ID NO: 1286809 - protein, 18 aa, Mycobacterium
CWTMLAAWAEQTSRIEIG

SEQ ID NO: 1286810 - protein, 20 aa, Mycobacterium
CYAVPMLLDNFGWLQELVDY

SEQ ID NO: 1286811 - protein, 24 aa, Mycobacterium
DAAFARGVWWPALRATDRAAPQQQ

SEQ ID NO: 1286812 - protein, 20 aa, Mycobacterium
DAALKLAERITCNAPLAVQA

SEQ ID NO: 1286813 - protein, 23 aa, Mycobacterium
DADGRWRLGPALTELAGQVNDPL

SEQ ID NO: 1286814 - protein, 24 aa, Mycobacterium
DAENLWWREVCQISAALMAQLPSG

SEQ ID NO: 1286815 - protein, 20 aa, Mycobacterium
DAFRPGVIDAMFAYQLAELE

SEQ ID NO: 1286816 - protein, 17 aa, Mycobacterium
DAGKPAIEIVKFDEQDA

SEQ ID NO: 1286817 - protein, 19 aa, Mycobacterium
DAKLEWKDIQFGFGGSYEV

SEQ ID NO: 1286818 - protein, 19 aa, Mycobacterium
DAPFAKWFVGGKINVAYNC

SEQ ID NO: 1286819 - protein, 17 aa, Mycobacterium
DAPLLVRFCDEWAGRGW

SEQ ID NO: 1286820 - protein, 18 aa, Mycobacterium
DAPLRAGDRLALKQGTRT

SEQ ID NO: 1286821 - protein, 24 aa, Mycobacterium
DARARLEVHLGWEPGTIAAVRAGS

SEQ ID NO: 1286822 - protein, 24 aa, Mycobacterium
DAVAIPYLIDWEALESAEWELLTS

SEQ ID NO: 1286823 - protein, 17 aa, Mycobacterium
DAVGVLAGFPVEIAPTA

SEQ ID NO: 1286824 - protein, 17 aa, Mycobacterium
DAVRFAGGWLYDRSMAG

SEQ ID NO: 1286825 - protein, 20 aa, Mycobacterium
DCVECPFHGWRWGPQGDNTY

SEQ ID NO: 1286826 - protein, 17 aa, Mycobacterium
DDIRFGLGAVRNVGANV

SEQ ID NO: 1286827 - protein, 23 aa, Mycobacterium
DDIRWFDLYSCFPSAIEMAAEAL

SEQ ID NO: 1286828 - protein, 25 aa, Mycobacterium
DDMPDRLKPVLARQMEIYAGFMEQT

SEQ ID NO: 1286829 - protein, 23 aa, Mycobacterium
DDPRFAGTMTMTWSVTAVDAGTR

SEQ ID NO: 1286830 - protein, 23 aa, Mycobacterium
DDPRLGALLEWRQRLIDSGAVSA

SEQ ID NO: 1286831 - protein, 18 aa, Mycobacterium
DEALPLAAVRTGAALVRT

SEQ ID NO: 1286832 - protein, 18 aa, Mycobacterium
DEGLRRWGVAAEVRDRYL

SEQ ID NO: 1286833 - protein, 17 aa, Mycobacterium
DEIKRYLDLEGVALHAL

SEQ ID NO: 1286834 - protein, 20 aa, Mycobacterium
DEIMASPVLNYPLRQYMFCA

SEQ ID NO: 1286835 - protein, 18 aa, Mycobacterium
DEIRHWLQVFAQRFYSFS

SEQ ID NO: 1286836 - protein, 24 aa, Mycobacterium
DEKRLRRRISLVFQDPFSSLNSRM

SEQ ID NO: 1286837 - protein, 23 aa, Mycobacterium
DELGRRCAWVLLDAVGPVSFTLA

SEQ ID NO: 1286838 - protein, 20 aa, Mycobacterium
DEPFPRFSVVRAPRHGSAVG

SEQ ID NO: 1286839 - protein, 18 aa, Mycobacterium
DEPKGWLITTAWRRFLDL

SEQ ID NO: 1286840 - protein, 21 aa, Mycobacterium
DEQKHRWAVPVLRGELTASLG

SEQ ID NO: 1286841 - protein, 24 aa, Mycobacterium
DESKMPAVFFVNWFRRGDDGRFLW

SEQ ID NO: 1286842 - protein, 18 aa, Mycobacterium
DEVHLLPAPVFRMTADLQ

SEQ ID NO: 1286843 - protein, 20 aa, Mycobacterium
DEWPLLNFLKFTGVDTQKRP

SEQ ID NO: 1286844 - protein, 18 aa, Mycobacterium
DFAALLIYRLGRLPCDRS

SEQ ID NO: 1286845 - protein, 20 aa, Mycobacterium
DFGGVWYWNRFPGIQCDNDA

SEQ ID NO: 1286846 - protein, 17 aa, Mycobacterium
DFHFERWDSFRAQAPRG

SEQ ID NO: 1286847 - protein, 18 aa, Mycobacterium
DFRFLVGVVSVMGDKDVD

SEQ ID NO: 1286848 - protein, 18 aa, Mycobacterium
DGALGFWKAMREVFPATR

SEQ ID NO: 1286849 - protein, 17 aa, Mycobacterium
DGGLRWLPARSRPGDAV

SEQ ID NO: 1286850 - protein, 23 aa, Mycobacterium
DGGTSYRPGARFGPMGVRQAART

SEQ ID NO: 1286851 - protein, 17 aa, Mycobacterium
DGGWRLDGTKVWTSGAH

SEQ ID NO: 1286852 - protein, 22 aa, Mycobacterium
DGIGLDEFVDWLVEAGYRIDRI

SEQ ID NO: 1286853 - protein, 18 aa, Mycobacterium
DGKWRLSPKAMRQLGQAA

SEQ ID NO: 1286854 - protein, 24 aa, Mycobacterium
DGLCALALRFSKDWMSPAERFETL

SEQ ID NO: 1286855 - protein, 17 aa, Mycobacterium
DGLDFLRLAVLDALLVL

SEQ ID NO: 1286856 - protein, 18 aa, Mycobacterium
DGLTGWPRRKINQLVMSL

SEQ ID NO: 1286857 - protein, 17 aa, Mycobacterium
DGPPANFAVVFQDYARS

SEQ ID NO: 1286858 - protein, 21 aa, Mycobacterium
DGQLSRWTSFEAHPLDAMDLT

SEQ ID NO: 1286859 - protein, 18 aa, Mycobacterium
DGSTWRVEIERAHMEEDT

SEQ ID NO: 1286860 - protein, 18 aa, Mycobacterium
DGTFDWGQPLFSYNFGDP

SEQ ID NO: 1286861 - protein, 18 aa, Mycobacterium
DGTLLRVRARWCIGADGA

SEQ ID NO: 1286862 - protein, 18 aa, Mycobacterium
DGTLRFLLWTAALLSPEP

SEQ ID NO: 1286863 - protein, 21 aa, Mycobacterium
DGTLSPGFHGLHIHEFGRCEP

SEQ ID NO: 1286864 - protein, 17 aa, Mycobacterium
DGTMCWLFVPRLRADGW

SEQ ID NO: 1286865 - protein, 18 aa, Mycobacterium
DGVVRPVIFLAYSGEARW

SEQ ID NO: 1286866 - protein, 18 aa, Mycobacterium
DGWLCPYGPLAVGAAALP

SEQ ID NO: 1286867 - protein, 24 aa, Mycobacterium
DHCLDLPGLFVWRRYHPSPAPDRG

SEQ ID NO: 1286868 - protein, 19 aa, Mycobacterium
DHKCTYAFIAPPVAVALAK

SEQ ID NO: 1286869 - protein, 21 aa, Mycobacterium
DIAEVLALLGVRPVWDDASRR

SEQ ID NO: 1286870 - protein, 21 aa, Mycobacterium
DIARPRTEIMINLGNPELAFK

SEQ ID NO: 1286871 - protein, 21 aa, Mycobacterium
DIRALYLFKRTMWWPYSVAMR

SEQ ID NO: 1286872 - protein, 18 aa, Mycobacterium
DIRIAFSAVEIFQTPVGT

SEQ ID NO: 1286873 - protein, 18 aa, Mycobacterium
DKPFWWSHFDRLNNPVDE

SEQ ID NO: 1286874 - protein, 17 aa, Mycobacterium
DKYPGYWKVIAVDEPRS

SEQ ID NO: 1286875 - protein, 18 aa, Mycobacterium
DLDARLALTPAVVSALCD

SEQ ID NO: 1286876 - protein, 18 aa, Mycobacterium
DLDLPRDALIVFTGLSGS

SEQ ID NO: 1286877 - protein, 17 aa, Mycobacterium
DLERRVAEFLGFRDVFT

SEQ ID NO: 1286878 - protein, 19 aa, Mycobacterium
DLFDRWKALGARFVAARPL

SEQ ID NO: 1286879 - protein, 20 aa, Mycobacterium
DLGLEIFDWLEVVDFGDAYC

SEQ ID NO: 1286880 - protein, 17 aa, Mycobacterium
DLGRRAVSVGTDITDEA

SEQ ID NO: 1286881 - protein, 17 aa, Mycobacterium
DMCGMMIAVARHFKREG

SEQ ID NO: 1286882 - protein, 22 aa, Mycobacterium
DMLEMLPTPWGLVRSGVAPDHP

SEQ ID NO: 1286883 - protein, 20 aa, Mycobacterium
DPDARPALVSQWELAVTEGP

SEQ ID NO: 1286884 - protein, 23 aa, Mycobacterium
DPDAWRLATLFGLLDAVAAALDG

SEQ ID NO: 1286885 - protein, 21 aa, Mycobacterium
DPDSVRVWSCFATVGDHLPEE

SEQ ID NO: 1286886 - protein, 24 aa, Mycobacterium
DPGESRFYLSLGDELMRRFNGATL

SEQ ID NO: 1286887 - protein, 22 aa, Mycobacterium
DPGSVSYLFSRKGVITLEKNGL

SEQ ID NO: 1286888 - protein, 22 aa, Mycobacterium
DPITRIVGSLGIYTKVDFENRE

SEQ ID NO: 1286889 - protein, 24 aa, Mycobacterium
DPLLPEVAWSWLVEALDSKSDQVT

SEQ ID NO: 1286890 - protein, 23 aa, Mycobacterium
DPQHRLLLETAWRAVEHSGTAPT

SEQ ID NO: 1286891 - protein, 18 aa, Mycobacterium
DPQQRLLLEVAWEALEHA

SEQ ID NO: 1286892 - protein, 18 aa, Mycobacterium
DPRFGHVVTQDFATYHIS

SEQ ID NO: 1286893 - protein, 25 aa, Mycobacterium
DPRRFAVDLLERFRDLIVLQAVPDA

SEQ ID NO: 1286894 - protein, 21 aa, Mycobacterium
DPRWPEFPGDFAGESIHSHHY

SEQ ID NO: 1286895 - protein, 24 aa, Mycobacterium
DPSASLWLARLWKEAGLPDGVFNV

SEQ ID NO: 1286896 - protein, 18 aa, Mycobacterium
DPSLRIAILEARFAGFGA

SEQ ID NO: 1286897 - protein, 24 aa, Mycobacterium
DQARTIRIPVHMVEVINKLGRIQR

SEQ ID NO: 1286898 - protein, 25 aa, Mycobacterium
DQYLWSVDVARIFAAALRRSPDLHL

SEQ ID NO: 1286899 - protein, 18 aa, Mycobacterium
DRALELGCGTGFFLLNLI

SEQ ID NO: 1286900 - protein, 19 aa, Mycobacterium
DRARLAYLRLKGCVAQNHL

SEQ ID NO: 1286901 - protein, 19 aa, Mycobacterium
DRCRGWRMCVSGCPYKKMY

SEQ ID NO: 1286902 - protein, 19 aa, Mycobacterium
DRDRTAIAMGRRGTPVEQA

SEQ ID NO: 1286903 - protein, 27 aa, Mycobacterium
DRFLRSRRPWIWGPRMLTGLDVSAGAT

SEQ ID NO: 1286904 - protein, 21 aa, Mycobacterium
DRGVSWLPFFHDMGLITIMIS

SEQ ID NO: 1286905 - protein, 26 aa, Mycobacterium
DRILPDRPAFFFAIDGHSLWANSTAL

SEQ ID NO: 1286906 - protein, 21 aa, Mycobacterium
DRLYGMFAFAIVERDSGRVLL

SEQ ID NO: 1286907 - protein, 17 aa, Mycobacterium
DRMWEFLDRLVAIALPR

SEQ ID NO: 1286908 - protein, 20 aa, Mycobacterium
DRPFLMPVEDVFTITGRGTV

SEQ ID NO: 1286909 - protein, 23 aa, Mycobacterium
DRPIADVCPVEWARMANRSVLQW

SEQ ID NO: 1286910 - protein, 18 aa, Mycobacterium
DRPRPALRAGEHLFAQTA

SEQ ID NO: 1286911 - protein, 22 aa, Mycobacterium
DRRPDLPSGKGLVIAEGVLVVQ

SEQ ID NO: 1286912 - protein, 19 aa, Mycobacterium
DRVGVAWLRHTCGRCRFCE

SEQ ID NO: 1286913 - protein, 19 aa, Mycobacterium
DRVILMLGNQVELWEAMLA

SEQ ID NO: 1286914 - protein, 24 aa, Mycobacterium
DRVRRLAGALSRFGVGHGDAVAFL

SEQ ID NO: 1286915 - protein, 18 aa, Mycobacterium
DRWTLLIVRELLDRPRRY

SEQ ID NO: 1286916 - protein, 18 aa, Mycobacterium
DRYPRRWQAPLRGAMKGA

SEQ ID NO: 1286917 - protein, 23 aa, Mycobacterium
DSGFRAGSVISHYYDSLLAKVIA

SEQ ID NO: 1286918 - protein, 23 aa, Mycobacterium
DSLAVRCTMRIDFAFPHPQSVVR

SEQ ID NO: 1286919 - protein, 18 aa, Mycobacterium
DSLWVYDHFHTVPVPTDE

SEQ ID NO: 1286920 - protein, 19 aa, Mycobacterium
DSPDLPPLWQVFGAHRRPD

SEQ ID NO: 1286921 - protein, 24 aa, Mycobacterium
DSRGRFPGRWRMALLENLSRKCNR

SEQ ID NO: 1286922 - protein, 17 aa, Mycobacterium
DSWTFRTGRDGDFATLA

SEQ ID NO: 1286923 - protein, 17 aa, Mycobacterium
DTALLRWACAFEATGAR

SEQ ID NO: 1286924 - protein, 24 aa, Mycobacterium
DTGSFRWASARAHRLAARLVEIGV

SEQ ID NO: 1286925 - protein, 20 aa, Mycobacterium
DTLRLGDLVFPIAPGTADGA

SEQ ID NO: 1286926 - protein, 21 aa, Mycobacterium
DTPRWRWFIARAVVGGEALYA

SEQ ID NO: 1286927 - protein, 21 aa, Mycobacterium
DTRIACGVISPASAETSVSTS

SEQ ID NO: 1286928 - protein, 22 aa, Mycobacterium
DVARLEAALARFAAVADAAHAE

SEQ ID NO: 1286929 - protein, 17 aa, Mycobacterium
DVCYLAMPLFHSNAVYA

SEQ ID NO: 1286930 - protein, 24 aa, Mycobacterium
DVELPKRRLTVFTGVSGSGKSSLV

SEQ ID NO: 1286931 - protein, 18 aa, Mycobacterium
DVGCSWLPLYHDMGLSFL

SEQ ID NO: 1286932 - protein, 21 aa, Mycobacterium
DVKPRLWGTGHVRILSDLAQL

SEQ ID NO: 1286933 - protein, 17 aa, Mycobacterium
DVLHWFGIRKIHRLVSM

SEQ ID NO: 1286934 - protein, 17 aa, Mycobacterium
DVLPRAGVEVMISIDDG

SEQ ID NO: 1286935 - protein, 24 aa, Mycobacterium
DVPHLDAALDWAKRNPAAAFGAVE

SEQ ID NO: 1286936 - protein, 18 aa, Mycobacterium
DVRFDYRWAGAIDTNTRF

SEQ ID NO: 1286937 - protein, 20 aa, Mycobacterium
DVSCAIISVGAWSPGASQVY

SEQ ID NO: 1286938 - protein, 19 aa, Mycobacterium
DVTRIVVQLAPWLEPEPVC

SEQ ID NO: 1286939 - protein, 20 aa, Mycobacterium
DVWAAKWARAYVEWAAGEKR

SEQ ID NO: 1286940 - protein, 17 aa, Mycobacterium
DWADAFASWSPHELSGI

SEQ ID NO: 1286941 - protein, 24 aa, Mycobacterium
DWAEMLMRMYIRWAEQHDYPVEVF

SEQ ID NO: 1286942 - protein, 23 aa, Mycobacterium
DWDDELLSFFGIPRQMMPEIKPS

SEQ ID NO: 1286943 - protein, 18 aa, Mycobacterium
DWDSAAVLEHWSKELFDQ

SEQ ID NO: 1286944 - protein, 23 aa, Mycobacterium
DWQRLLFDNGWLLPAQPPEFGGR

SEQ ID NO: 1286945 - protein, 25 aa, Mycobacterium
DYGNYAGLFIRMSWHAAGTYRIFDG

SEQ ID NO: 1286946 - protein, 22 aa, Mycobacterium
DYHAELAWWTGWLAVSDGIPHG

SEQ ID NO: 1286947 - protein, 17 aa, Mycobacterium
DYLEIWDAAAWQEYQQA

SEQ ID NO: 1286948 - protein, 20 aa, Mycobacterium
DYLLELGIRVRYLHSEVDTL

SEQ ID NO: 1286949 - protein, 18 aa, Mycobacterium
DYRLGVRMNHSIDIAAGA

SEQ ID NO: 1286950 - protein, 17 aa, Mycobacterium
EAARWAASWGGRQPVRF

SEQ ID NO: 1286951 - protein, 17 aa, Mycobacterium
EACARELAARGATVTVA

SEQ ID NO: 1286952 - protein, 24 aa, Mycobacterium
EAFGHVVIAWMWLEQFLAAEGRTG

SEQ ID NO: 1286953 - protein, 26 aa, Mycobacterium
EAFKGRSGRKRWAEIEAVIARSWDGV

SEQ ID NO: 1286954 - protein, 23 aa, Mycobacterium
EAGEWHWPVPHLVITRGARGASY

SEQ ID NO: 1286955 - protein, 23 aa, Mycobacterium
EAICALVSREFRWATGERLEVSG

SEQ ID NO: 1286956 - protein, 20 aa, Mycobacterium
EAIRRFGPIFAQYYGQSEAP

SEQ ID NO: 1286957 - protein, 19 aa, Mycobacterium
EAKELFNGFWILDVSSKEE

SEQ ID NO: 1286958 - protein, 20 aa, Mycobacterium
EALDTWPLNVVLLGKGNTVS

SEQ ID NO: 1286959 - protein, 21 aa, Mycobacterium
EALERSRRALAEFKVEGLATV

SEQ ID NO: 1286960 - protein, 24 aa, Mycobacterium
EALKRLGIGGGFFSFGIMHYYLTG

SEQ ID NO: 1286961 - protein, 18 aa, Mycobacterium
EALRAGGVVIVFPGGDYD

SEQ ID NO: 1286962 - protein, 20 aa, Mycobacterium
EARTRVALALAESGWGGQLR

SEQ ID NO: 1286963 - protein, 23 aa, Mycobacterium
EASDIAEAIAFLASDRAAWITAS

SEQ ID NO: 1286964 - protein, 23 aa, Mycobacterium
EASLRGAPLIAVHAWADHSMSAA

SEQ ID NO: 1286965 - protein, 24 aa, Mycobacterium
EAVMLAGLAMKWRWRQRLGGDAWK

SEQ ID NO: 1286966 - protein, 20 aa, Mycobacterium
EAWRAGQVEMITWLGELHGL

SEQ ID NO: 1286967 - protein, 22 aa, Mycobacterium
ECAFWNLCLWNPFLHTYDYTYE

SEQ ID NO: 1286968 - protein, 35 aa, Mycobacterium; identical to SEQ ID NO: 763603

SEQ ID NO: 1286969 - protein, 22 aa, Mycobacterium
EDDIPGLVLIPAAASKIDIPMI

SEQ ID NO: 1286970 - protein, 17 aa, Mycobacterium
EDFRMAVYYADVEGFPY

SEQ ID NO: 1286971 - protein, 22 aa, Mycobacterium
EDFWLKVGIDPVRLMTRSGTFY

SEQ ID NO: 1286972 - protein, 17 aa, Mycobacterium
EDFYLRYNCDTYVMGIA

SEQ ID NO: 1286973 - protein, 17 aa, Mycobacterium
EDGPRPTLCVIHGFMGS

SEQ ID NO: 1286974 - protein, 21 aa, Mycobacterium
EDGRYRPAAGLALLGSSFDNN

SEQ ID NO: 1286975 - protein, 25 aa, Mycobacterium
EDKFPSRFLLGIGIGHPEATQEYRK

SEQ ID NO: 1286976 - protein, 24 aa, Mycobacterium
EDQEVWRYFASVAFPSEAMVRNVI

SEQ ID NO: 1286977 - protein, 19 aa, Mycobacterium
EDRLRTRFEWGLITDVQPP

SEQ ID NO: 1286978 - protein, 21 aa, Mycobacterium
EDSWLRHLVMLGARNRYGPPE

SEQ ID NO: 1286979 - protein, 24 aa, Mycobacterium
EDTYRLPVTVWRDLIALHYPNTGW

SEQ ID NO: 1286980 - protein, 17 aa, Mycobacterium
EDWRARIALRQKQIGER

SEQ ID NO: 1286981 - protein, 21 aa, Mycobacterium
EEARMAADFTRFLGGAHDLAT

SEQ ID NO: 1286982 - protein, 25 aa, Mycobacterium
EEFARAAGMPGVFGMGLLHGGVLAQ

SEQ ID NO: 1286983 - protein, 17 aa, Mycobacterium
EEFVSFAPISSVDTLIT

SEQ ID NO: 1286984 - protein, 19 aa, Mycobacterium
EEGAICVKLPLPPGTLPTL

SEQ ID NO: 1286985 - protein, 17 aa, Mycobacterium
EEIVRWASPIIFMRRNL

SEQ ID NO: 1286986 - protein, 17 aa, Mycobacterium
EELKQQWLPGIASGETI

SEQ ID NO: 1286987 - protein, 23 aa, Mycobacterium
EELRRTAARLADWVDAQSDGDLR

SEQ ID NO: 1286988 - protein, 17 aa, Mycobacterium
EEMIRWTTPVKEFMRTA

SEQ ID NO: 1286989 - protein, 21 aa, Mycobacterium
EEMLRFPLPVIAAVNGPAVGL

SEQ ID NO: 1286990 - protein, 17 aa, Mycobacterium
EEMPIKVPWSLPAARPC

SEQ ID NO: 1286991 - protein, 19 aa, Mycobacterium
EEPKGTPVFAWKGETLEEY

SEQ ID NO: 1286992 - protein, 21 aa, Mycobacterium
EERATRLVACWGNNDGDELRR

SEQ ID NO: 1286993 - protein, 17 aa, Mycobacterium
EEVLARWTDWDVDYANA

SEQ ID NO: 1286994 - protein, 20 aa, Mycobacterium
EEWRFLTGWPDPRSDDPDKM

SEQ ID NO: 1286995 - protein, 25 aa, Mycobacterium
EFAGAFKPPLSWGIRMTGKKFFREY

SEQ ID NO: 1286996 - protein, 19 aa, Mycobacterium
EFDILAFERQWWKYAGSKE

SEQ ID NO: 1286997 - protein, 19 aa, Mycobacterium
EFRFPRIGAAVFDGVEIEL

SEQ ID NO: 1286998 - protein, 20 aa, Mycobacterium
EFTNRFGIDRVCEFYAASEG

SEQ ID NO: 1286999 - protein, 22 aa, Mycobacterium
EGACPACKGAGVIYTELGVMAT

SEQ ID NO: 1287000 - protein, 18 aa, Mycobacterium
EGDCARWVAAQLEEVGYE

SEQ ID NO: 1287001 - protein, 19 aa, Mycobacterium
EGFLPTLLDWCRRNDVVFI

SEQ ID NO: 1287002 - protein, 18 aa, Mycobacterium
EGGEGRPAIVIEHITRLR

SEQ ID NO: 1287003 - protein, 23 aa, Mycobacterium
EGGWIRTWLDTVLDLPWNVRTED

SEQ ID NO: 1287004 - protein, 19 aa, Mycobacterium
EGLLNYLALLGWGIADDRD

SEQ ID NO: 1287005 - protein, 18 aa, Mycobacterium
EGRDMWPGILGFEDTVIP

SEQ ID NO: 1287006 - protein, 25 aa, Mycobacterium
EGVPRWRKGTGQGWLTAEYAMLPAA

SEQ ID NO: 1287007 - protein, 17 aa, Mycobacterium
EHPEIWDAVIDLDELVP

SEQ ID NO: 1287008 - protein, 21 aa, Mycobacterium
EIARLLYRYARAVDSKDWELY

SEQ ID NO: 1287009 - protein, 17 aa, Mycobacterium
EICAWIRMRPGRPPLTA

SEQ ID NO: 1287010 - protein, 19 aa, Mycobacterium
EICDGWLPIFYTPRMADTY

SEQ ID NO: 1287011 - protein, 20 aa, Mycobacterium
EIDARLRLLVGRRGGVANQE

SEQ ID NO: 1287012 - protein, 19 aa, Mycobacterium
EINEAFAPVVIAWLKELKA

SEQ ID NO: 1287013 - protein, 19 aa, Mycobacterium
EIPEFASDEWTDWRWNSIL

SEQ ID NO: 1287014 - protein, 24 aa, Mycobacterium
EIRRLAIACLRELVAVAPAVFADF

SEQ ID NO: 1287015 - protein, 21 aa, Mycobacterium
EKEAWLSMVMLEWGSCGQVAV

SEQ ID NO: 1287016 - protein, 17 aa, Mycobacterium
EKFRYGFEIAPELVRTV

SEQ ID NO: 1287017 - protein, 27 aa, Mycobacterium
EKRTLRITARWAQHWNYVGGPPEEFAR

SEQ ID NO: 1287018 - protein, 18 aa, Mycobacterium
EKVAMGWTEVLSADATTI

SEQ ID NO: 1287019 - protein, 24 aa, Mycobacterium
ELARRADVFLTSFLPGHRQKFGID

SEQ ID NO: 1287020 - protein, 23 aa, Mycobacterium
ELDGLRLITWRGASRAEQGLPYA

SEQ ID NO: 1287021 - protein, 17 aa, Mycobacterium
ELGCVAAIKTLEITTRP

SEQ ID NO: 1287022 - protein, 20 aa, Mycobacterium
ELGQPLPLFIKWDDAEYGLR

SEQ ID NO: 1287023 - protein, 17 aa, Mycobacterium
ELGRSAAGYGLWHNGIE

SEQ ID NO: 1287024 - protein, 19 aa, Mycobacterium
ELHEIYKLGVVPIPTNRDM

SEQ ID NO: 1287025 - protein, 17 aa, Mycobacterium
ELIPKLMSAGVIEVAPL

SEQ ID NO: 1287026 - protein, 17 aa, Mycobacterium
ELLAAKFMGRWRSGAPL

SEQ ID NO: 1287027 - protein, 34 aa, Mycobacterium
ELLDEAWWFPAMCWPDGRLQFMLNERMMPAQFVV

SEQ ID NO: 1287028 - protein, 22 aa, Mycobacterium
ELLPTVRGAFCLTFMDENTLYA

SEQ ID NO: 1287029 - protein, 22 aa, Mycobacterium
ELLRLQRRLGITSLYVTHDQEE

SEQ ID NO: 1287030 - protein, 18 aa, Mycobacterium
ELLWRPDLQQLKRSQSGQ

SEQ ID NO: 1287031 - protein, 18 aa, Mycobacterium
ELQRRYGLEHAYAVACDT

SEQ ID NO: 1287032 - protein, 25 aa, Mycobacterium
ELREGQRLWLSWAMANRDPAVFTEP

SEQ ID NO: 1287033 - protein, 21 aa, Mycobacterium
ELRRLKALLRRSGRVLQSAPD

SEQ ID NO: 1287034 - protein, 21 aa, Mycobacterium
ELRSATPLADRGCWLHMLALY

SEQ ID NO: 1287035 - protein, 24 aa, Mycobacterium
ELSGSFVSYFGWLYEWGAPVTLIG

SEQ ID NO: 1287036 - protein, 23 aa, Mycobacterium
ELSRAGAAFTEISGIYAAVDAAN

SEQ ID NO: 1287037 - protein, 19 aa, Mycobacterium
ELTPDHWLAAVVRDEMERV

SEQ ID NO: 1287038 - protein, 17 aa, Mycobacterium
ELVAEGWLASRQGAGTW

SEQ ID NO: 1287039 - protein, 18 aa, Mycobacterium
ELVIPFLVPDGAHDYPDD

SEQ ID NO: 1287040 - protein, 18 aa, Mycobacterium
ELVVPLVVFLASRACEST

SEQ ID NO: 1287041 - protein, 19 aa, Mycobacterium
ELYDGFTFNCLSWIEALGF

SEQ ID NO: 1287042 - protein, 17 aa, Mycobacterium
ELYEIRTLFGVMFQDGA

SEQ ID NO: 1287043 - protein, 22 aa, Mycobacterium
ELYPVLCGSAFKNKGVQPMLDA

SEQ ID NO: 1287044 - protein, 24 aa, Mycobacterium
EMGLARLWQSWGFEPDVVLGHSVG

SEQ ID NO: 1287045 - protein, 17 aa, Mycobacterium
EMRIAFPALLRRFPTLT

SEQ ID NO: 1287046 - protein, 18 aa, Mycobacterium
ENGLKIYAMCEIPNNVIL

SEQ ID NO: 1287047 - protein, 17 aa, Mycobacterium
ENSCRFFGWDPFALTPK

SEQ ID NO: 1287048 - protein, 17 aa, Mycobacterium
EPAELAAAVAFLASDDA

SEQ ID NO: 1287049 - protein, 22 aa, Mycobacterium
EPEMLRRSLLYAIERKRSELTA

SEQ ID NO: 1287050 - protein, 24 aa, Mycobacterium
EPGCPPKTWCVRNVSGFAGQLNVT

SEQ ID NO: 1287051 - protein, 21 aa, Mycobacterium
EPHYRPSAALQDFVRCRDLTC

SEQ ID NO: 1287052 - protein, 17 aa, Mycobacterium
EPIWLSWIERWPTPSAT

SEQ ID NO: 1287053 - protein, 20 aa, Mycobacterium
EPLGALAAMGVWGYRQMPEL

SEQ ID NO: 1287054 - protein, 21 aa, Mycobacterium
EPLPRTLAWSAAWEMTREAEL

SEQ ID NO: 1287055 - protein, 23 aa, Mycobacterium
EPNKLRLPVQWVSRPTAEQRRRY

SEQ ID NO: 1287056 - protein, 22 aa, Mycobacterium
EPPRRLRMAVAYGSAAAALPGS

SEQ ID NO: 1287057 - protein, 18 aa, Mycobacterium
EPRFRDHIPLMIGGSGEK

SEQ ID NO: 1287058 - protein, 18 aa, Mycobacterium
EQALRAWLTSGRPALATA

SEQ ID NO: 1287059 - protein, 27 aa, Mycobacterium
EQEKLMAFCLAGALSFNLASPDSTDNR

SEQ ID NO: 1287060 - protein, 20 aa, Mycobacterium
EQGWDRLALGGAALVTFHVP

SEQ ID NO: 1287061 - protein, 24 aa, Mycobacterium
EQLGPRPASPWAQALRLALIDAAP

SEQ ID NO: 1287062 - protein, 22 aa, Mycobacterium
EQMKMFLTRLGFNSKIVVTGDI

SEQ ID NO: 1287063 - protein, 18 aa, Mycobacterium
EQRFPYVFLDATYCKARV

SEQ ID NO: 1287064 - protein, 17 aa, Mycobacterium
ERAEVYASLGLRLDYDP

SEQ ID NO: 1287065 - protein, 17 aa, Mycobacterium
ERCAAGLDLVHTVMPEF

SEQ ID NO: 1287066 - protein, 17 aa, Mycobacterium
ERERMVLLLRFFENLTQ

SEQ ID NO: 1287067 - protein, 18 aa, Mycobacterium
ERFLVGLAVLSLVAAAVH

SEQ ID NO: 1287068 - protein, 23 aa, Mycobacterium
ERKDVAALARWLADGHFILIGCQ

SEQ ID NO: 1287069 - protein, 19 aa, Mycobacterium
ERLFLFVAFVNRFLPPFVR

SEQ ID NO: 1287070 - protein, 17 aa, Mycobacterium
ERLPLLMPFEQAGVPAP

SEQ ID NO: 1287071 - protein, 20 aa, Mycobacterium
ERSAAAIAWMLGRTDGRPAE

SEQ ID NO: 1287072 - protein, 22 aa, Mycobacterium
ERSRLMLDIARWRRRRRDELAA

SEQ ID NO: 1287073 - protein, 20 aa, Mycobacterium
ERTFPLFARRPLRGDSPAAR

SEQ ID NO: 1287074 - protein, 18 aa, Mycobacterium
ERYVREWLGGTVAARVVD

SEQ ID NO: 1287075 - protein, 28 aa, Mycobacterium
ESAIALPDKEVVSILDLNADVDVAIDAA

SEQ ID NO: 1287076 - protein, 28 aa, Mycobacterium
ESFFRGAGWNVIKVVWGREWDALLHADR

SEQ ID NO: 1287077 - protein, 19 aa, Mycobacterium
ESGFAWAFLGAALATTDLP

SEQ ID NO: 1287078 - protein, 17 aa, Mycobacterium
ESLRRSLSFNGYSVELA

SEQ ID NO: 1287079 - protein, 25 aa, Mycobacterium
ESLYEYGSRAGLWRVLRVFERRGLP

SEQ ID NO: 1287080 - protein, 18 aa, Mycobacterium
ESMLPRMRPGSSIVSVSS

SEQ ID NO: 1287081 - protein, 24 aa, Mycobacterium
ESPKETWLRLLLIRHDFPRPRTQI

SEQ ID NO: 1287082 - protein, 25 aa, Mycobacterium
ESQRPTPPCGLPFVTASAAGIAAGS

SEQ ID NO: 1287083 - protein, 26 aa, Mycobacterium
ESRLTFLAVRRWYGWSAGRIINIDIG

SEQ ID NO: 1287084 - protein, 17 aa, Mycobacterium
ESRRPRCLLAFGQFEFV

SEQ ID NO: 1287085 - protein, 18 aa, Mycobacterium
ESVWWRCHRRLVADVAVL

SEQ ID NO: 1287086 - protein, 18 aa, Mycobacterium
ETEQRLALVAAWEEAGDL

SEQ ID NO: 1287087 - protein, 23 aa, Mycobacterium
ETRIARVFLDYCIDLHLAGQLDV

SEQ ID NO: 1287088 - protein, 21 aa, Mycobacterium
ETRPLYSRVLLKLGGEMFGGG

SEQ ID NO: 1287089 - protein, 23 aa, Mycobacterium
ETVTRIAAQWGFAHTGRFAVMYR

SEQ ID NO: 1287090 - protein, 30 aa, Mycobacterium
EVAEMWPFADLEPFAAFGWEPRGGYGDAYR

SEQ ID NO: 1287091 - protein, 24 aa, Mycobacterium
EVAPWLDLVRKLGLLAGTLATEPT

SEQ ID NO: 1287092 - protein, 18 aa, Mycobacterium
EVEGLYSIVRRLREQGVA

SEQ ID NO: 1287093 - protein, 18 aa, Mycobacterium
EVEIIWRAPDDAWSYDDA

SEQ ID NO: 1287094 - protein, 17 aa, Mycobacterium
EVGRWLPSLLVRRLERL

SEQ ID NO: 1287095 - protein, 18 aa, Mycobacterium
EVKALYPLGPIFHGSGLN

SEQ ID NO: 1287096 - protein, 23 aa, Mycobacterium
EVKKAVAEYGLWYPPDPSSYEIC

SEQ ID NO: 1287097 - protein, 23 aa, Mycobacterium
EVLRPGTRISLMAAEMLASRPDG

SEQ ID NO: 1287098 - protein, 19 aa, Mycobacterium
EVLVALGIAVLAEPGFEAD

SEQ ID NO: 1287099 - protein, 25 aa, Mycobacterium
EVMAGFGRSGKWFSIDHFDVTPDLL

SEQ ID NO: 1287100 - protein, 24 aa, Mycobacterium
EVQRAGGVTLTLGFAVSRDLSSRR

SEQ ID NO: 1287101 - protein, 18 aa, Mycobacterium
EVRDACGLLGLDPMYVAN

SEQ ID NO: 1287102 - protein, 20 aa, Mycobacterium
EVSARAGVEVLVFETTDALV

SEQ ID NO: 1287103 - protein, 17 aa, Mycobacterium
EVSDMFTGHAFATVDDL

SEQ ID NO: 1287104 - protein, 18 aa, Mycobacterium
EWFLAGHLVVGWPRGSHG

SEQ ID NO: 1287105 - protein, 21 aa, Mycobacterium
EWGEIVVAFIVGRVSPTDLDA

SEQ ID NO: 1287106 - protein, 26 aa, Mycobacterium
EWNRYGIRVIAMWPLYVQTAMTDNIK

SEQ ID NO: 1287107 - protein, 18 aa, Mycobacterium
EWYAPSLCAGWTVKDVVA

SEQ ID NO: 1287108 - protein, 20 aa, Mycobacterium
EYDLPGSPAFVLVNNPTRIP

SEQ ID NO: 1287109 - protein, 21 aa, Mycobacterium
EYEVDCVIFASGFEISTEIHR

SEQ ID NO: 1287110 - protein, 24 aa, Mycobacterium
EYRREMAELFAPFSAVAAKNPYSS

SEQ ID NO: 1287111 - protein, 18 aa, Mycobacterium
EYSVDLFALLPLGELWVA

SEQ ID NO: 1287112 - protein, 26 aa, Mycobacterium
FAAELFPRMAVPKAWYDAGIAHRSES

SEQ ID NO: 1287113 - protein, 22 aa, Mycobacterium
FAAGRLSYFLGVRGPAVVVDTA

SEQ ID NO: 1287114 - protein, 18 aa, Mycobacterium
FAEEAVRIGGRYTPSPAG

SEQ ID NO: 1287115 - protein, 19 aa, Mycobacterium
FAGALWWRTVQEVGAEYPD

SEQ ID NO: 1287116 - protein, 18 aa, Mycobacterium
FAGPDFELGMMWREVYKL

SEQ ID NO: 1287117 - protein, 23 aa, Mycobacterium
FAHEFGLPVVEVISGGDISEAAY

SEQ ID NO: 1287118 - protein, 20 aa, Mycobacterium
FAPRCPLAIDECRAAEPELI

SEQ ID NO: 1287119 - protein, 21 aa, Mycobacterium
FASDEWTDWRWNSILIEGANC

SEQ ID NO: 1287120 - protein, 19 aa, Mycobacterium
FATEMARFGLDPSALVPAY

SEQ ID NO: 1287121 - protein, 17 aa, Mycobacterium
FCTAYALAPEWGTHTKG

SEQ ID NO: 1287122 - protein, 25 aa, Mycobacterium
FDLPPSWFAWWARQGMRTSLRYKVP

SEQ ID NO: 1287123 - protein, 21 aa, Mycobacterium
FDLPVGGWACRPTAEFGYAAA

SEQ ID NO: 1287124 - protein, 20 aa, Mycobacterium
FDLYSCFPFPVFAVCDEFGL

SEQ ID NO: 1287125 - protein, 26 aa, Mycobacterium
FDPLIFFRPRVERLFGFHYRIEIYVP

SEQ ID NO: 1287126 - protein, 17 aa, Mycobacterium
FDRVLELSVAIAQCAVT

SEQ ID NO: 1287127 - protein, 18 aa, Mycobacterium
FDTLLVMSVEPGFGGQKF

SEQ ID NO: 1287128 - protein, 17 aa, Mycobacterium
FDTLRLLPWLPGTALVM

SEQ ID NO: 1287129 - protein, 24 aa, Mycobacterium
FDVARRIAVAMARMTDPGRLILLT

SEQ ID NO: 1287130 - protein, 18 aa, Mycobacterium
FDVYRWVTVNAELVGGDA

SEQ ID NO: 1287131 - protein, 19 aa, Mycobacterium
FEGLRRFHHNFGYGLAGRR

SEQ ID NO: 1287132 - protein, 17 aa, Mycobacterium
FEVAWRILQVTPINATA

SEQ ID NO: 1287133 - protein, 21 aa, Mycobacterium
FFFAAPLEWQERLWPTEEFEL

SEQ ID NO: 1287134 - protein, 17 aa, Mycobacterium
FFIRKAIGWALRQYART

SEQ ID NO: 1287135 - protein, 18 aa, Mycobacterium
FFPNGVDWIVWWLAVSRI

SEQ ID NO: 1287136 - protein, 19 aa, Mycobacterium
FGDDRIAVRFAYEFHDDAG

SEQ ID NO: 1287137 - protein, 18 aa, Mycobacterium
FGGLRYAPRADLATREEQ

SEQ ID NO: 1287138 - protein, 17 aa, Mycobacterium
FGLELVECKEFFADTTF

SEQ ID NO: 1287139 - protein, 22 aa, Mycobacterium
FGRRFGCTVWDGFGSTETAVII

SEQ ID NO: 1287140 - protein, 17 aa, Mycobacterium
FGTCLRATYLHPCGTDE

SEQ ID NO: 1287141 - protein, 19 aa, Mycobacterium
FGWLYEWGAPVTLIGESQD

SEQ ID NO: 1287142 - protein, 17 aa, Mycobacterium
FHELLCAAAADGHAAQD

SEQ ID NO: 1287143 - protein, 20 aa, Mycobacterium
FHKRGRGHLVLIGSLLGTAA

SEQ ID NO: 1287144 - protein, 17 aa, Mycobacterium
FHPQSFRAFASPLSSGV

SEQ ID NO: 1287145 - protein, 23 aa, Mycobacterium
FIEPRWLRFLPVLPLDRGLVVPI

SEQ ID NO: 1287146 - protein, 18 aa, Mycobacterium
FIPLRLPPELDFAALFHG

SEQ ID NO: 1287147 - protein, 19 aa, Mycobacterium
FIVVDECHYYRGIFGSNVA

SEQ ID NO: 1287148 - protein, 18 aa, Mycobacterium
FKVSLSIGVMKMVRSDIA

SEQ ID NO: 1287149 - protein, 17 aa, Mycobacterium
FKYPGIRSDSDMYTLGF

SEQ ID NO: 1287150 - protein, 20 aa, Mycobacterium
FLDREGWDALTINALATQLG

SEQ ID NO: 1287151 - protein, 21 aa, Mycobacterium
FLHPLPVRRLWGVGEKTAAKL

SEQ ID NO: 1287152 - protein, 17 aa, Mycobacterium
FLLTIGLLPLQTAYALN

SEQ ID NO: 1287153 - protein, 26 aa, Mycobacterium
FLPSCGRCSYCARGMGNLCELGAALM

SEQ ID NO: 1287154 - protein, 17 aa, Mycobacterium
FLQRGSQWLAYKHQVAS

SEQ ID NO: 1287155 - protein, 22 aa, Mycobacterium
FLREVQDTWTWLRPYFDERATA

SEQ ID NO: 1287156 - protein, 22 aa, Mycobacterium
FLRPWADALWDTGIEFGTVGVG

SEQ ID NO: 1287157 - protein, 24 aa, Mycobacterium
FMIFPPRVPYGIGAFVDLVVPELQ

SEQ ID NO: 1287158 - protein, 17 aa, Mycobacterium
FMRAIRAELVVPLVVFL

SEQ ID NO: 1287159 - protein, 18 aa, Mycobacterium
FNCLSWIEALGFCGIGEA

SEQ ID NO: 1287160 - protein, 23 aa, Mycobacterium
FNISCGTCWMCDHGLQSQCETTQ

SEQ ID NO: 1287161 - protein, 17 aa, Mycobacterium
FNLSWSIEGTRSRTGKM

SEQ ID NO: 1287162 - protein, 17 aa, Mycobacterium
FNVPAQLLAPIPDGVGA

SEQ ID NO: 1287163 - protein, 20 aa, Mycobacterium
FPEGRFDLVSAQFFHSPLDV

SEQ ID NO: 1287164 - protein, 18 aa, Mycobacterium
FPEKGIAVAVDWSVLPRT

SEQ ID NO: 1287165 - protein, 19 aa, Mycobacterium
FPHAVRWQGVIYLEDGLHR

SEQ ID NO: 1287166 - protein, 22 aa, Mycobacterium
FPLARLYAWHRAMRLFDGPDEV

SEQ ID NO: 1287167 - protein, 19 aa, Mycobacterium
FPNLFATHRVRAVDDYASH

SEQ ID NO: 1287168 - protein, 17 aa, Mycobacterium
FPTRMFTVLFALGRLPG

SEQ ID NO: 1287169 - protein, 17 aa, Mycobacterium
FPVECWKQPKVPDSGAT

SEQ ID NO: 1287170 - protein, 19 aa, Mycobacterium
FPVEMIKRYFGGSHLLPGV

SEQ ID NO: 1287171 - protein, 23 aa, Mycobacterium
FQAYAAACALHFAEKALTEIRAG

SEQ ID NO: 1287172 - protein, 21 aa, Mycobacterium
FQCRGRGSALALALRLLRPQG

SEQ ID NO: 1287173 - protein, 17 aa, Mycobacterium
FQRTPIWCFPKFDVPLP

SEQ ID NO: 1287174 - protein, 23 aa, Mycobacterium
FQRWPTDWTDHWRALTMPAVAVR

SEQ ID NO: 1287175 - protein, 18 aa, Mycobacterium
FRAHFWFVEERLRTADDP

SEQ ID NO: 1287176 - protein, 19 aa, Mycobacterium
FRASVCVLGPLVGRCKRAR

SEQ ID NO: 1287177 - protein, 18 aa, Mycobacterium
FRDRMGWDLPWVSSGAST

SEQ ID NO: 1287178 - protein, 17 aa, Mycobacterium
FREFYGRVLSWTFEPGR

SEQ ID NO: 1287179 - protein, 22 aa, Mycobacterium
FREYPYREAFLLDKARKFRAEL

SEQ ID NO: 1287180 - protein, 24 aa, Mycobacterium
FRFFPAYYLHIWDLFQRIPVYERI

SEQ ID NO: 1287181 - protein, 19 aa, Mycobacterium
FRFSFLVAYAGRIGERLTA

SEQ ID NO: 1287182 - protein, 19 aa, Mycobacterium
FRFSQWKGLDYTASIADDP

SEQ ID NO: 1287183 - protein, 20 aa, Mycobacterium
FRHTFDWCVTSAFIMSQLTA

SEQ ID NO: 1287184 - protein, 17 aa, Mycobacterium
FRPGCKRMLMTSDYYPA

SEQ ID NO: 1287185 - protein, 23 aa, Mycobacterium
FRPRVKSPFTRRSVAQDGPARAD

SEQ ID NO: 1287186 - protein, 17 aa, Mycobacterium
FRRAFSWLPAQFASQSN

SEQ ID NO: 1287187 - protein, 17 aa, Mycobacterium
FRSKFDIFLAVYQDGMR

SEQ ID NO: 1287188 - protein, 17 aa, Mycobacterium
FRTPLTLILGPLAEMLR

SEQ ID NO: 1287189 - protein, 17 aa, Mycobacterium
FRYGFEIAPELVRTVLR

SEQ ID NO: 1287190 - protein, 19 aa, Mycobacterium
FRYPLGLRRWEFPQGTAPG

SEQ ID NO: 1287191 - protein, 18 aa, Mycobacterium
FSALCWGERIAFDNPESL

SEQ ID NO: 1287192 - protein, 18 aa, Mycobacterium
FSITGGMCPRCEGRGSVS

SEQ ID NO: 1287193 - protein, 17 aa, Mycobacterium
FSLHYPWSQGLPVHTLD

SEQ ID NO: 1287194 - protein, 19 aa, Mycobacterium
FSLLPAWRGAAPVQAAIAA

SEQ ID NO: 1287195 - protein, 17 aa, Mycobacterium
FSQRAQVALPWSMINAF

SEQ ID NO: 1287196 - protein, 20 aa, Mycobacterium
FSRFELLRLLAFSRSGALPI

SEQ ID NO: 1287197 - protein, 20 aa, Mycobacterium
FSRVRILTALMLGRLERSPL

SEQ ID NO: 1287198 - protein, 19 aa, Mycobacterium
FTGGWLLRFMSGNLCHQIE

SEQ ID NO: 1287199 - protein, 19 aa, Mycobacterium
FTGVQGFARWAAESSGHSE

SEQ ID NO: 1287200 - protein, 17 aa, Mycobacterium
FTLAVGVGYLKREFAAL

SEQ ID NO: 1287201 - protein, 17 aa, Mycobacterium
FTQRIRFGAVSLLLRRL

SEQ ID NO: 1287202 - protein, 17 aa, Mycobacterium
FVDRLYGMFAFAIVERD

SEQ ID NO: 1287203 - protein, 18 aa, Mycobacterium
FVERFSRFGLNAASVKPS

SEQ ID NO: 1287204 - protein, 20 aa, Mycobacterium
FVESFWKPVWDFHARQVPET

SEQ ID NO: 1287205 - protein, 18 aa, Mycobacterium
FVVLDGLAKPGRLEGPDP

SEQ ID NO: 1287206 - protein, 24 aa, Mycobacterium
FWASWCGPCRAFAPTFAASSEKHP

SEQ ID NO: 1287207 - protein, 27 aa, Mycobacterium
FWFDPLCPWCWITSRWILEVEKVRDID

SEQ ID NO: 1287208 - protein, 18 aa, Mycobacterium
FWGGLRIGWIRADPSTLA

SEQ ID NO: 1287209 - protein, 17 aa, Mycobacterium
FYCYSFEPSDRWTHFFA

SEQ ID NO: 1287210 - protein, 17 aa, Mycobacterium
FYLPMYWSSRAKLTNTA

SEQ ID NO: 1287211 - protein, 19 aa, Mycobacterium
GADAYRVDGRLVFDEPTRT

SEQ ID NO: 1287212 - protein, 22 aa, Mycobacterium
GAEVWRWLERGAHLYVCGDAAR

SEQ ID NO: 1287213 - protein, 18 aa, Mycobacterium
GAGLDWKSSLQELTAARG

SEQ ID NO: 1287214 - protein, 18 aa, Mycobacterium
GAHYECWTMLAAWAEQTS

SEQ ID NO: 1287215 - protein, 19 aa, Mycobacterium
GAIANWRLFSILLRSLNIP

SEQ ID NO: 1287216 - protein, 17 aa, Mycobacterium
GAIAVRFDDPLAAFDTV

SEQ ID NO: 1287217 - protein, 20 aa, Mycobacterium
GAIVKRPRVIVDEFGNESIG

SEQ ID NO: 1287218 - protein, 24 aa, Mycobacterium
GALSEWRATLIVKQSACLSVEHRR

SEQ ID NO: 1287219 - protein, 24 aa, Mycobacterium
GALSEWRATLIVRESACLSVEDRR

SEQ ID NO: 1287220 - protein, 19 aa, Mycobacterium
GAPMAKRLTGWPGGLIVFD

SEQ ID NO: 1287221 - protein, 20 aa, Mycobacterium
GARCTTVWCAVLSPETGELV

SEQ ID NO: 1287222 - protein, 22 aa, Mycobacterium
GARDWDWSTGRYWKIANPSKRN

SEQ ID NO: 1287223 - protein, 19 aa, Mycobacterium
GASPQSVFFSGYYAEAAPF

SEQ ID NO: 1287224 - protein, 21 aa, Mycobacterium
GAVRLNHEFHRAINVAADSPK

SEQ ID NO: 1287225 - protein, 19 aa, Mycobacterium
GAVSFRFGDRTQINGVPRD

SEQ ID NO: 1287226 - protein, 18 aa, Mycobacterium
GAVTLVWQAGRVVQVNEL

SEQ ID NO: 1287227 - protein, 18 aa, Mycobacterium
GAVYWDPLATLGFLAACT

SEQ ID NO: 1287228 - protein, 17 aa, Mycobacterium
GAYRWLRPQGRRTAQEI

SEQ ID NO: 1287229 - protein, 21 aa, Mycobacterium
GCAGLRYNLFFDDRALDGDLT

SEQ ID NO: 1287230 - protein, 20 aa, Mycobacterium
GCGGLGSWIAEFIARAGASE

SEQ ID NO: 1287231 - protein, 17 aa, Mycobacterium
GCGTGFFLLNLIQAGVA

SEQ ID NO: 1287232 - protein, 18 aa, Mycobacterium
GCRMGICHSCTRRKTSGV

SEQ ID NO: 1287233 - protein, 20 aa, Mycobacterium
GCVGCSLMADHIGNLAHLNA

SEQ ID NO: 1287234 - protein, 20 aa, Mycobacterium
GDAEGALTFMSGWMGVDLAR

SEQ ID NO: 1287235 - protein, 17 aa, Mycobacterium
GDALRPAPVGAYPAGAS

SEQ ID NO: 1287236 - protein, 19 aa, Mycobacterium
GDARIAVQFVLNYEEGAEN

SEQ ID NO: 1287237 - protein, 24 aa, Mycobacterium
GDDRVASLFLWHFVEEVEHRSSAL

SEQ ID NO: 1287238 - protein, 17 aa, Mycobacterium
GDGFVPFIIPINDRTLE

SEQ ID NO: 1287239 - protein, 23 aa, Mycobacterium
GDGVRLSGRWSWATGVMHGNWIM

SEQ ID NO: 1287240 - protein, 17 aa, Mycobacterium
GDISWQRALLDGGVSVS

SEQ ID NO: 1287241 - protein, 20 aa, Mycobacterium
GDLPLFVALIVRVMVSAHFG

SEQ ID NO: 1287242 - protein, 17 aa, Mycobacterium
GDLPPHVRYVGAVHPAR

SEQ ID NO: 1287243 - protein, 19 aa, Mycobacterium
GDPRFSDVSSRVFGTPHDV

SEQ ID NO: 1287244 - protein, 21 aa, Mycobacterium
GDVDRAFAIACRMRTGNVTIN

SEQ ID NO: 1287245 - protein, 19 aa, Mycobacterium
GDVELAWRLDRAGWFGPPR

SEQ ID NO: 1287246 - protein, 17 aa, Mycobacterium
GDVGLMLSVPRQGLGNA

SEQ ID NO: 1287247 - protein, 25 aa, Mycobacterium
GDVGRPDLLASIGFTREELAEKLYD

SEQ ID NO: 1287248 - protein, 24 aa, Mycobacterium
GDWVSRIGLIPAHRAVATQALQSG

SEQ ID NO: 1287249 - protein, 24 aa, Mycobacterium
GDWVYIPKACTFRQIPDTESTLLM

SEQ ID NO: 1287250 - protein, 17 aa, Mycobacterium
GEFDAVICWHTDRLYRS

SEQ ID NO: 1287251 - protein, 17 aa, Mycobacterium
GEFRPDLTAAWLTEALY

SEQ ID NO: 1287252 - protein, 17 aa, Mycobacterium
GEGAVRLNHEFHRAINV

SEQ ID NO: 1287253 - protein, 23 aa, Mycobacterium
GEGRRLAPTMAWPVVSASYLRLA

SEQ ID NO: 1287254 - protein, 18 aa, Mycobacterium
GEHGRYLLAATFGNVHGV

SEQ ID NO: 1287255 - protein, 23 aa, Mycobacterium
GEIRAVWRINELLNWQVAAAGET

SEQ ID NO: 1287256 - protein, 18 aa, Mycobacterium
GELLGCAVPDGWPEFPES

SEQ ID NO: 1287257 - protein, 17 aa, Mycobacterium
GEPFVLHPGEFVLGSTL

SEQ ID NO: 1287258 - protein, 17 aa, Mycobacterium
GEPGDLCIVEGSPDEVL

SEQ ID NO: 1287259 - protein, 17 aa, Mycobacterium
GEPPPWWAAQRDPVVGD

SEQ ID NO: 1287260 - protein, 18 aa, Mycobacterium
GEPVDCQGYRRFATEMAR

SEQ ID NO: 1287261 - protein, 17 aa, Mycobacterium
GEQRASNFLLWQSAYAE

SEQ ID NO: 1287262 - protein, 17 aa, Mycobacterium
GETLEEYWWAAEQMLTW

SEQ ID NO: 1287263 - protein, 20 aa, Mycobacterium
GETMVRGRIDAVFADDDGGA

SEQ ID NO: 1287264 - protein, 25 aa, Mycobacterium
GEVTYGAEFFRWFAEEAVRIGGRYT

SEQ ID NO: 1287265 - protein, 18 aa, Mycobacterium
GFAARLGLLLGRTDDAGL

SEQ ID NO: 1287266 - protein, 17 aa, Mycobacterium
GFDRVTYSWIPRAANAR

SEQ ID NO: 1287267 - protein, 18 aa, Mycobacterium
GFYRRPLKVSGREDANGG

SEQ ID NO: 1287268 - protein, 20 aa, Mycobacterium
GGGLLRLPRRIPYQKALELA

SEQ ID NO: 1287269 - protein, 24 aa, Mycobacterium
GGNCNKCIPCRRGLFMQCVNMQVP

SEQ ID NO: 1287270 - protein, 19 aa, Mycobacterium
GGPCARTVLDTALLHQVIA

SEQ ID NO: 1287271 - protein, 23 aa, Mycobacterium
GGPDLRTATGLSVGGGQTARGQQ

SEQ ID NO: 1287272 - protein, 20 aa, Mycobacterium
GGRPEYWLSQQGRLTHPVVL

SEQ ID NO: 1287273 - protein, 18 aa, Mycobacterium
GGRYAGLVTLEMLIDTIT

SEQ ID NO: 1287274 - protein, 25 aa, Mycobacterium
GGSPIAIAVPAHWGPGTVGALRGAL

SEQ ID NO: 1287275 - protein, 22 aa, Mycobacterium
GGTWFLPRAVGYARAAEMTLTG

SEQ ID NO: 1287276 - protein, 23 aa, Mycobacterium
GHDTFCPVGPWIVTDVDPSDLEL

SEQ ID NO: 1287277 - protein, 17 aa, Mycobacterium
GHIPGAVKIDWHVDLND

SEQ ID NO: 1287278 - protein, 18 aa, Mycobacterium
GHKWAMLTAYDFSTARAF

SEQ ID NO: 1287279 - protein, 17 aa, Mycobacterium
GHLSTMGWIGVRPGDVH

SEQ ID NO: 1287280 - protein, 22 aa, Mycobacterium
GHRIRAAIHFDDLQWERSYSRV

SEQ ID NO: 1287281 - protein, 17 aa, Mycobacterium
GHVRLCLGYTEPEGGSD

SEQ ID NO: 1287282 - protein, 18 aa, Mycobacterium
GIDTVVVGWGYGRADFAE

SEQ ID NO: 1287283 - protein, 18 aa, Mycobacterium
GIEAWTGIGTSLCGIANR

SEQ ID NO: 1287284 - protein, 24 aa, Mycobacterium
GIPSPLEWACFTFGIIQNDGHFTF

SEQ ID NO: 1287285 - protein, 17 aa, Mycobacterium
GISRPTFYFYFGSKEAV

SEQ ID NO: 1287286 - protein, 23 aa, Mycobacterium
GKATCPPLSIAMAGALNGPDAAL

SEQ ID NO: 1287287 - protein, 18 aa, Mycobacterium
GKAWTGGDFGRVLMQYDD

SEQ ID NO: 1287288 - protein, 20 aa, Mycobacterium
GKFLNNWRMAELHAKEAPDR

SEQ ID NO: 1287289 - protein, 17 aa, Mycobacterium
GKIRVAEGWAHGPQVDK

SEQ ID NO: 1287290 - protein, 25 aa, Mycobacterium
GKLIAAAGWHAWRPAHLHVKVSAPG

SEQ ID NO: 1287291 - protein, 18 aa, Mycobacterium
GKLYLCAIKDAFSNRIVG

SEQ ID NO: 1287292 - protein, 18 aa, Mycobacterium
GKPSLGWRSRRAAHKVTA

SEQ ID NO: 1287293 - protein, 17 aa, Mycobacterium
GKYRRVLAMAWEKQSES

SEQ ID NO: 1287294 - protein, 19 aa, Mycobacterium
GLAEMLARLGIPYDSEEAL

SEQ ID NO: 1287295 - protein, 17 aa, Mycobacterium
GLARLWQSWGVTPDVVL

SEQ ID NO: 1287296 - protein, 20 aa, Mycobacterium
GLCSYPLRQCSDGDLYGGTE

SEQ ID NO: 1287297 - protein, 24 aa, Mycobacterium
GLELARRLAREWLNYEFDPASKSA

SEQ ID NO: 1287298 - protein, 19 aa, Mycobacterium
GLELPRKVFAHGWLLNRGE

SEQ ID NO: 1287299 - protein, 20 aa, Mycobacterium
GLHTWPALGFGYAEVGTVTA

SEQ ID NO: 1287300 - protein, 17 aa, Mycobacterium
GLIGLGVERGERVGIWA

SEQ ID NO: 1287301 - protein, 20 aa, Mycobacterium
GLLAPHWPKPFGRAASAAEQ

SEQ ID NO: 1287302 - protein, 18 aa, Mycobacterium
GLLFCAACGRRMQGAARP

SEQ ID NO: 1287303 - protein, 20 aa, Mycobacterium
GLPWDCVLSAELFRHYKPDP

SEQ ID NO: 1287304 - protein, 19 aa, Mycobacterium
GLQARLGLDAGKWTAEQMA

SEQ ID NO: 1287305 - protein, 20 aa, Mycobacterium
GLTRAVLRGGRFIGVHGLGD

SEQ ID NO: 1287306 - protein, 24 aa, Mycobacterium
GLVKDIKINWVWNPPWGPDKITED

SEQ ID NO: 1287307 - protein, 25 aa, Mycobacterium
GLVPACKSLDCLSVMAGCIDDVDRV

SEQ ID NO: 1287308 - protein, 24 aa, Mycobacterium
GLWMSLRVARRLERLHIGARIVDL

SEQ ID NO: 1287309 - protein, 26 aa, Mycobacterium
GMARHVLCFRTLWEATFGQLLKEGKM

SEQ ID NO: 1287310 - protein, 20 aa, Mycobacterium
GMSYHLPRIVGTSVAADWML

SEQ ID NO: 1287311 - protein, 17 aa, Mycobacterium
GMVRFIGVDGYRWMIRC

SEQ ID NO: 1287312 - protein, 23 aa, Mycobacterium
GNDLPLEVGMAFSVEPGIYFPGQ

SEQ ID NO: 1287313 - protein, 17 aa, Mycobacterium
GPAPWKSVLGMTGPTTL

SEQ ID NO: 1287314 - protein, 17 aa, Mycobacterium
GPDYGRFVEAVRELQDL

SEQ ID NO: 1287315 - protein, 19 aa, Mycobacterium
GPFPLQIICDMMGIPEEDE

SEQ ID NO: 1287316 - protein, 25 aa, Mycobacterium
GPLPWYKRPPVLFGAAAAAALAALS

SEQ ID NO: 1287317 - protein, 17 aa, Mycobacterium
GPLTWPLHISLLLAKEF

SEQ ID NO: 1287318 - protein, 17 aa, Mycobacterium
GPPPERFLVGLAVLSLV

SEQ ID NO: 1287319 - protein, 17 aa, Mycobacterium
GPPPMVESVRKHVAAEG

SEQ ID NO: 1287320 - protein, 18 aa, Mycobacterium
GPQALSFVRQRHDLPRGD

SEQ ID NO: 1287321 - protein, 19 aa, Mycobacterium
GPQEWRWDKDAGITRLADA

SEQ ID NO: 1287322 - protein, 22 aa, Mycobacterium
GPRMWTWIQMMGLRAFQEMVFT

SEQ ID NO: 1287323 - protein, 22 aa, Mycobacterium
GPVRFPGVPTWFSRTPGHVRGP

SEQ ID NO: 1287324 - protein, 24 aa, Mycobacterium
GQALAVRVFTRFVFGFGLDDRDMQ

SEQ ID NO: 1287325 - protein, 24 aa, Mycobacterium
GQDSFEFFPNFTLLLWVPGWYLTY

SEQ ID NO: 1287326 - protein, 17 aa, Mycobacterium
GQIGTACAVAFGSAFAA

SEQ ID NO: 1287327 - protein, 17 aa, Mycobacterium
GQMGMPFGRGKNTRKNA

SEQ ID NO: 1287328 - protein, 23 aa, Mycobacterium
GQRNRFLLVTNFEYVDPVFMFPG

SEQ ID NO: 1287329 - protein, 18 aa, Mycobacterium
GQTLDWLAARGMTGLLQR

SEQ ID NO: 1287330 - protein, 23 aa, Mycobacterium
GRADPGEIVWTWVVYEDDPTRGK

SEQ ID NO: 1287331 - protein, 24 aa, Mycobacterium
GRERCIAEFSWAHIAEQTMEIYRK

SEQ ID NO: 1287332 - protein, 17 aa, Mycobacterium
GRFAVNVVSGWFKDEFT

SEQ ID NO: 1287333 - protein, 17 aa, Mycobacterium
GRFAVYVKFHHALIDGV

SEQ ID NO: 1287334 - protein, 19 aa, Mycobacterium
GRFLLGIGVGHPEAHQAYR

SEQ ID NO: 1287335 - protein, 20 aa, Mycobacterium
GRGSPWAAPLSWLVPPRVAM

SEQ ID NO: 1287336 - protein, 21 aa, Mycobacterium
GRHRFPLVLSDTVQQFLTAVA

SEQ ID NO: 1287337 - protein, 17 aa, Mycobacterium
GRIRKGQQVAWMREVDG

SEQ ID NO: 1287338 - protein, 19 aa, Mycobacterium
GRLSGKFWKLLGAATEKNQ

SEQ ID NO: 1287339 - protein, 19 aa, Mycobacterium
GRLTLPAKFRDALAGGLMV

SEQ ID NO: 1287340 - protein, 18 aa, Mycobacterium
GRLVDAWAGAALVRVGPR

SEQ ID NO: 1287341 - protein, 19 aa, Mycobacterium
GRLWLSRGGTYVLANIRGG

SEQ ID NO: 1287342 - protein, 20 aa, Mycobacterium
GRMGAPMVRRLVGAGHTVTA

SEQ ID NO: 1287343 - protein, 18 aa, Mycobacterium
GRMHPYFAARAVVEACPP

SEQ ID NO: 1287344 - protein, 17 aa, Mycobacterium
GRMLWSLPKGHIEMGET

SEQ ID NO: 1287345 - protein, 20 aa, Mycobacterium
GRPDALLPLARREARDCLAE

SEQ ID NO: 1287346 - protein, 19 aa, Mycobacterium
GRPGRWRGWDWARGTPAGW

SEQ ID NO: 1287347 - protein, 18 aa, Mycobacterium
GRPIAGFELRIGDSGEVL

SEQ ID NO: 1287348 - protein, 17 aa, Mycobacterium
GRPVLVGGLGGRGVVAG

SEQ ID NO: 1287349 - protein, 18 aa, Mycobacterium
GRRRGVVINPVLETSDIP

SEQ ID NO: 1287350 - protein, 24 aa, Mycobacterium
GRRYRLTVDLPRDFALNQPLSTFA

SEQ ID NO: 1287351 - protein, 19 aa, Mycobacterium
GRSGVPFILAGWSLGGVLA

SEQ ID NO: 1287352 - protein, 26 aa, Mycobacterium
GRSLTRPRMDWVYEVSAGNPLYALEL

SEQ ID NO: 1287353 - protein, 19 aa, Mycobacterium
GRSVSKWGAFLDDVAGFDA

SEQ ID NO: 1287354 - protein, 21 aa, Mycobacterium
GRTAIRLARGIPVVGNRFGAP

SEQ ID NO: 1287355 - protein, 17 aa, Mycobacterium
GRTFACDHWDVVPDLYL

SEQ ID NO: 1287356 - protein, 18 aa, Mycobacterium
GRTHPVWDFLFTYYSLRP

SEQ ID NO: 1287357 - protein, 17 aa, Mycobacterium
GRVFPIGSFGHTGFTGT

SEQ ID NO: 1287358 - protein, 18 aa, Mycobacterium
GRVRLAVGTGWLAEEINA

SEQ ID NO: 1287359 - protein, 19 aa, Mycobacterium
GRWVPDFLSLPIAVENSLK

SEQ ID NO: 1287360 - protein, 19 aa, Mycobacterium
GRYNLCPEMKFYATPPIDG

SEQ ID NO: 1287361 - protein, 19 aa, Mycobacterium
GSDRIPVFVFHPAGGSTVV

SEQ ID NO: 1287362 - protein, 18 aa, Mycobacterium
GSFFPVIPVCSSSGVGTM

SEQ ID NO: 1287363 - protein, 25 aa, Mycobacterium
GSGQPIVFSHGWPLSADDWDTQMLF

SEQ ID NO: 1287364 - protein, 22 aa, Mycobacterium
GSHLIDFTRWLFGSEIVDCGGV

SEQ ID NO: 1287365 - protein, 17 aa, Mycobacterium
GSIPFIAEFAAAFPQAT

SEQ ID NO: 1287366 - protein, 18 aa, Mycobacterium
GSIQRGWGLTGFAQDDDG

SEQ ID NO: 1287367 - protein, 23 aa, Mycobacterium
GSLPRRPQFALLKGRGNYLCLNK

SEQ ID NO: 1287368 - protein, 20 aa, Mycobacterium
GSRGISCFLIPGGQPGLSFG

SEQ ID NO: 1287369 - protein, 20 aa, Mycobacterium
GSTLRFAPPLVITADEIDWA

SEQ ID NO: 1287370 - protein, 23 aa, Mycobacterium
GSTQRFGVPMGFGGPHAGYLAVH

SEQ ID NO: 1287371 - protein, 26 aa, Mycobacterium
GSTRYPGGMALRFARVLRYRDDKSPA

SEQ ID NO: 1287372 - protein, 18 aa, Mycobacterium
GTAGFRAWAAHARGAVHV

SEQ ID NO: 1287373 - protein, 20 aa, Mycobacterium
GTGRQWLSWIGLDDLLDVYY

SEQ ID NO: 1287374 - protein, 21 aa, Mycobacterium
GTHMAGLLFELFARYTEVVTT

SEQ ID NO: 1287375 - protein, 19 aa, Mycobacterium
GTLGLRLGDRIQITPPLGS

SEQ ID NO: 1287376 - protein, 17 aa, Mycobacterium
GTPLKWVRLDSAPFTDR

SEQ ID NO: 1287377 - protein, 17 aa, Mycobacterium
GTVSGLYVCEMVTARAL

SEQ ID NO: 1287378 - protein, 21 aa, Mycobacterium
GVALRIGWRALTFAGLRGNER

SEQ ID NO: 1287379 - protein, 18 aa, Mycobacterium
GVARHVLIPAGWCGYSGP

SEQ ID NO: 1287380 - protein, 18 aa, Mycobacterium
GVDGYRWMIRCVVNGVAE

SEQ ID NO: 1287381 - protein, 20 aa, Mycobacterium
GVGLRAFELAVRYAQQRHTF

SEQ ID NO: 1287382 - protein, 19 aa, Mycobacterium
GVHDVVLCPGSRNAPLAFA

SEQ ID NO: 1287383 - protein, 17 aa, Mycobacterium
GVIDAMFAYQLAELERL

SEQ ID NO: 1287384 - protein, 18 aa, Mycobacterium
GVIPLQFLFSGTLFTRGE

SEQ ID NO: 1287385 - protein, 18 aa, Mycobacterium
GVLPLMFDSMFGMVIHAT

SEQ ID NO: 1287386 - protein, 19 aa, Mycobacterium
GVLSARWAGTHGQDAANSA

SEQ ID NO: 1287387 - protein, 23 aa, Mycobacterium
GVLSGRLRLCLGYTEPEGGSDVA

SEQ ID NO: 1287388 - protein, 19 aa, Mycobacterium
GVVIGRGCLGRPWLFAELS

SEQ ID NO: 1287389 - protein, 25 aa, Mycobacterium
GWERWREIGAHYGLGVIEAMLAQAI

SEQ ID NO: 1287390 - protein, 19 aa, Mycobacterium
GWTEGRSGVPFILAGWSLG

SEQ ID NO: 1287391 - protein, 18 aa, Mycobacterium
GYELTLWARRPASLEPYA

SEQ ID NO: 1287392 - protein, 17 aa, Mycobacterium
GYLKWNRTRGWRGQRAA

SEQ ID NO: 1287393 - protein, 23 aa, Mycobacterium
GYYQLRGGIPYAIAKQLAAAPFA

SEQ ID NO: 1287394 - protein, 18 aa, Mycobacterium
HAHWLLPAAHWLERDDLL

SEQ ID NO: 1287395 - protein, 18 aa, Mycobacterium
HCAKAFLRSGAWNPESWT

SEQ ID NO: 1287396 - protein, 22 aa, Mycobacterium
HCPMCAAAHAWVGLGRIVYATS

SEQ ID NO: 1287397 - protein, 20 aa, Mycobacterium
HDRIPVLYCKTGVRSAEALA

SEQ ID NO: 1287398 - protein, 22 aa, Mycobacterium
HERETYDFFGIIFDGHPSLTRI

SEQ ID NO: 1287399 - protein, 20 aa, Mycobacterium
HERTMLWLSYADRLQDLIDD

SEQ ID NO: 1287400 - protein, 17 aa, Mycobacterium
HFPKDAWALGRFDGTAL

SEQ ID NO: 1287401 - protein, 17 aa, Mycobacterium
HHAHIRMLLQSAGTTGD

SEQ ID NO: 1287402 - protein, 17 aa, Mycobacterium
HIRARMFAPDLGVPEDE

SEQ ID NO: 1287403 - protein, 18 aa, Mycobacterium
HIYARIEPRWPFKFVRLA

SEQ ID NO: 1287404 - protein, 18 aa, Mycobacterium
HKEWLEKLAESYEFLGTE

SEQ ID NO: 1287405 - protein, 24 aa, Mycobacterium
HKKGSALVPSWVAFAVIGLLEQHF

SEQ ID NO: 1287406 - protein, 22 aa, Mycobacterium
HKYGVGNGHLWRRHRLAPHRLA

SEQ ID NO: 1287407 - protein, 24 aa, Mycobacterium
HLISPWGTWEWMGPAAIGADLPAC

SEQ ID NO: 1287408 - protein, 20 aa, Mycobacterium
HLLGSILWRRAMGLVLGDWV

SEQ ID NO: 1287409 - protein, 18 aa, Mycobacterium
HMWFGDLVTMTWWDDLWL

SEQ ID NO: 1287410 - protein, 24 aa, Mycobacterium
HNGCPLGNLIPEWNDLVFKDRWRD

SEQ ID NO: 1287411 - protein, 18 aa, Mycobacterium
HPDARIVLCSSVSGLWGG

SEQ ID NO: 1287412 - protein, 24 aa, Mycobacterium
HPFLGMPFWLGRGFGLNLSVVTDP

SEQ ID NO: 1287413 - protein, 18 aa, Mycobacterium
HPHCCSVGYLIRDDNDQW

SEQ ID NO: 1287414 - protein, 17 aa, Mycobacterium
HPIDLVLLDLGLPDATG

SEQ ID NO: 1287415 - protein, 18 aa, Mycobacterium
HPRFGRWLQLGGHCEPDD

SEQ ID NO: 1287416 - protein, 22 aa, Mycobacterium
HPSLKIGWFEGGIAWVPTALQD

SEQ ID NO: 1287417 - protein, 17 aa, Mycobacterium
HPVPGRWLPNGCMATSG

SEQ ID NO: 1287418 - protein, 22 aa, Mycobacterium
HQALCYFGYLAGYRLVHDAAAD

SEQ ID NO: 1287419 - protein, 22 aa, Mycobacterium
HREHFNLPALRDWLRTQREERS

SEQ ID NO: 1287420 - protein, 17 aa, Mycobacterium
HRFPGSMAKRIQALAQL

SEQ ID NO: 1287421 - protein, 17 aa, Mycobacterium
HRNGLRLAKLVNTLLDF

SEQ ID NO: 1287422 - protein, 22 aa, Mycobacterium
HRVLRHRLILGFEAANADVTAD

SEQ ID NO: 1287423 - protein, 22 aa, Mycobacterium
HRVLRTERLLSFNVDYASVTRL

SEQ ID NO: 1287424 - protein, 19 aa, Mycobacterium
HRVRFKVVPPFAGILDLTM

SEQ ID NO: 1287425 - protein, 23 aa, Mycobacterium
HSIWLPDHMVSFWPDSIWTPEFT

SEQ ID NO: 1287426 - protein, 18 aa, Mycobacterium
HSQWYIDRFRAMARAGDD

SEQ ID NO: 1287427 - protein, 22 aa, Mycobacterium
HSVCPFCAVGCAQKVYVKDEKV

SEQ ID NO: 1287428 - protein, 24 aa, Mycobacterium
HSYPHCWRCRNPLIYRAVSSWFIK

SEQ ID NO: 1287429 - protein, 23 aa, Mycobacterium
HTELAWVLGCFTGFGQASRMTQF

SEQ ID NO: 1287430 - protein, 17 aa, Mycobacterium
HTGRAVGILADLQGPKI

SEQ ID NO: 1287431 - protein, 17 aa, Mycobacterium
HTPWFHWGTTAMVAHTV

SEQ ID NO: 1287432 - protein, 19 aa, Mycobacterium
HTRRVPGYHILKAHMSSSI

SEQ ID NO: 1287433 - protein, 18 aa, Mycobacterium
HVKPRLLGHWGTTPGLNL

SEQ ID NO: 1287434 - protein, 21 aa, Mycobacterium
HVRSGVAFDVLRRWLTAKGLD

SEQ ID NO: 1287435 - protein, 18 aa, Mycobacterium
HWMAVPLLKPFGVTPVGD

SEQ ID NO: 1287436 - protein, 17 aa, Mycobacterium
HWVRWRLIHARAFLLTD

SEQ ID NO: 1287437 - protein, 22 aa, Mycobacterium
HYEKLEGVALTFAGKVNRLATM

SEQ ID NO: 1287438 - protein, 17 aa, Mycobacterium
IAAAAARYMTEEYARIA

SEQ ID NO: 1287439 - protein, 18 aa, Mycobacterium
IACGLVVRPEVVFLDEPT

SEQ ID NO: 1287440 - protein, 24 aa, Mycobacterium
IAFGWDRITALLARMDSIREVIAF

SEQ ID NO: 1287441 - protein, 17 aa, Mycobacterium
IAFNCLWPETYIATSAV

SEQ ID NO: 1287442 - protein, 17 aa, Mycobacterium
IAGAGAIGMEFGYVMKN

SEQ ID NO: 1287443 - protein, 17 aa, Mycobacterium
IAGALAIVAVDPVKFKR

SEQ ID NO: 1287444 - protein, 17 aa, Mycobacterium
IAKEVLVALGIAVLAEP

SEQ ID NO: 1287445 - protein, 25 aa, Mycobacterium
IAQARLGPGRIHHCMRALGAAERAL

SEQ ID NO: 1287446 - protein, 23 aa, Mycobacterium
IARIDWARFLPLYQQAGRRAFLT

SEQ ID NO: 1287447 - protein, 20 aa, Mycobacterium
IASGDLHVCFGVTEPGAGLD

SEQ ID NO: 1287448 - protein, 23 aa, Mycobacterium
IAVRYGDCSWTWREHLAEASRQA

SEQ ID NO: 1287449 - protein, 19 aa, Mycobacterium
ICAYGRIGSMFACDDFGYV

SEQ ID NO: 1287450 - protein, 24 aa, Mycobacterium
ICGLRPGQRLRIVKYLAYGWSSLR

SEQ ID NO: 1287451 - protein, 18 aa, Mycobacterium
ICRRSRLMARIAGSGAMA

SEQ ID NO: 1287452 - protein, 21 aa, Mycobacterium
IDAEIPLLVVITEGIPVQDTA

SEQ ID NO: 1287453 - protein, 17 aa, Mycobacterium
IDALLPLPGSRNQLTDG

SEQ ID NO: 1287454 - protein, 24 aa, Mycobacterium
IDGLRRFHCNLGHGLLGRLVERSP

SEQ ID NO: 1287455 - protein, 19 aa, Mycobacterium
IDHFRYFAGAIRAQEGALS

SEQ ID NO: 1287456 - protein, 27 aa, Mycobacterium
IDKFAPRLSFFWGIGMNFFMEVAKLRA

SEQ ID NO: 1287457 - protein, 18 aa, Mycobacterium
IDNWRWAGVPIYLRTGKK

SEQ ID NO: 1287458 - protein, 19 aa, Mycobacterium
IDPWGGSYYVEWLTHQLAT

SEQ ID NO: 1287459 - protein, 18 aa, Mycobacterium
IDRFPVEMIKRYFGGSHL

SEQ ID NO: 1287460 - protein, 18 aa, Mycobacterium
IDVAYRFFSTANRSYILA

SEQ ID NO: 1287461 - protein, 18 aa, Mycobacterium
IDVYSCFPSAVQVAATEL

SEQ ID NO: 1287462 - protein, 18 aa, Mycobacterium
IEAFRLLTLQTAWKIDQY

SEQ ID NO: 1287463 - protein, 22 aa, Mycobacterium
IEDLKAPLLAAVGAADLALATV

SEQ ID NO: 1287464 - protein, 23 aa, Mycobacterium
IEFPARIGVWWASETWSITDAQD

SEQ ID NO: 1287465 - protein, 19 aa, Mycobacterium
IEGKPSAAFLWEDKGVVPF

SEQ ID NO: 1287466 - protein, 18 aa, Mycobacterium
IEHWRWMWESNVLGTLLV

SEQ ID NO: 1287467 - protein, 20 aa, Mycobacterium
IEHWTRLPVEIELASEFRYR

SEQ ID NO: 1287468 - protein, 17 aa, Mycobacterium
IEILKLVLAGGMVEFHG

SEQ ID NO: 1287469 - protein, 23 aa, Mycobacterium
IEPEVGLACRVVWYGDTVVRLDP

SEQ ID NO: 1287470 - protein, 18 aa, Mycobacterium
IETLPLVTGWSMGAGQTY

SEQ ID NO: 1287471 - protein, 17 aa, Mycobacterium
IEVDAAPDARYGFVLDD

SEQ ID NO: 1287472 - protein, 23 aa, Mycobacterium
IFKRIRPAFRYERSLAVLTAARD

SEQ ID NO: 1287473 - protein, 17 aa, Mycobacterium
IFLMCLADRVLAYGDCA

SEQ ID NO: 1287474 - protein, 18 aa, Mycobacterium
IFVPGGPPLSIPLGNVRL

SEQ ID NO: 1287475 - protein, 19 aa, Mycobacterium
IGAEIVRRLAFEGAAVAFT

SEQ ID NO: 1287476 - protein, 27 aa, Mycobacterium
IGAPSFKEALRWGAEVYHSLKSVLKKQ

SEQ ID NO: 1287477 - protein, 17 aa, Mycobacterium
IGDVASWLDTIGNQVRV

SEQ ID NO: 1287478 - protein, 23 aa, Mycobacterium
IGEGRKSLALALRFRAADRTLTE

SEQ ID NO: 1287479 - protein, 22 aa, Mycobacterium
IGGCLYALLAKCWPEDVSEPAQ

SEQ ID NO: 1287480 - protein, 21 aa, Mycobacterium
IGGGMCFTFLASQGVSVGKSL

SEQ ID NO: 1287481 - protein, 19 aa, Mycobacterium
IGIPDEWFLAGHLVVGWPR

SEQ ID NO: 1287482 - protein, 20 aa, Mycobacterium
IGQLCLLRLTSPAEHPYGSA

SEQ ID NO: 1287483 - protein, 21 aa, Mycobacterium
IGRERFAEFLAGFHLVDEHFR

SEQ ID NO: 1287484 - protein, 23 aa, Mycobacterium
IGRERPSRLVVCRDDDWRPQWRV

SEQ ID NO: 1287485 - protein, 21 aa, Mycobacterium
IGYAACHWCHVMAHESFEDDE

SEQ ID NO: 1287486 - protein, 19 aa, Mycobacterium
IHALGGWWAEVLGYAQEVT

SEQ ID NO: 1287487 - protein, 20 aa, Mycobacterium
IHPGLPVSFGYDVTDGSGGR

SEQ ID NO: 1287488 - protein, 19 aa, Mycobacterium
IIPWNFPILMATWKLAPAL

SEQ ID NO: 1287489 - protein, 18 aa, Mycobacterium
IISCFSMTEPHGGADPKV

SEQ ID NO: 1287490 - protein, 17 aa, Mycobacterium
IISVGAWSPGASQVYQS

SEQ ID NO: 1287491 - protein, 20 aa, Mycobacterium
IKDGDRIAGAFGYWRESGSF

SEQ ID NO: 1287492 - protein, 18 aa, Mycobacterium
ILAVLPFFHIYGMTVLLN

SEQ ID NO: 1287493 - protein, 17 aa, Mycobacterium
ILDEWRTITGLDRKTDD

SEQ ID NO: 1287494 - protein, 18 aa, Mycobacterium
ILDRARFEAVAARLRAEY

SEQ ID NO: 1287495 - protein, 18 aa, Mycobacterium
ILGALPFDLTAPTALFRP

SEQ ID NO: 1287496 - protein, 17 aa, Mycobacterium
ILKGDKGEPCWPDGVVG

SEQ ID NO: 1287497 - protein, 17 aa, Mycobacterium
ILLALAVQRQGRSAPEL

SEQ ID NO: 1287498 - protein, 17 aa, Mycobacterium
ILLPRSRYDEGLEILKT

SEQ ID NO: 1287499 - protein, 23 aa, Mycobacterium
ILLYRCGLGFMLGDRFLMLEHVG

SEQ ID NO: 1287500 - protein, 17 aa, Mycobacterium
ILRAEMTAALGMSEPGA

SEQ ID NO: 1287501 - protein, 24 aa, Mycobacterium
ILSRLSARHDIMWLMTSDLSPLGG

SEQ ID NO: 1287502 - protein, 21 aa, Mycobacterium
IMRRLGFGAARTIGHREYAGG

SEQ ID NO: 1287503 - protein, 17 aa, Mycobacterium
INELLNWQVAAAGETIA

SEQ ID NO: 1287504 - protein, 23 aa, Mycobacterium
INEPRFPSFKGIMAAKKKEVTTL

SEQ ID NO: 1287505 - protein, 24 aa, Mycobacterium
INLPGVAFGHDWLASGMRYNGTLE

SEQ ID NO: 1287506 - protein, 17 aa, Mycobacterium
INRRRVASVLQFDPVIV

SEQ ID NO: 1287507 - protein, 21 aa, Mycobacterium
INSRPAPLVAYWFGPDDQDFR

SEQ ID NO: 1287508 - protein, 23 aa, Mycobacterium
IPACGQCQPCLKGYRSLCDRGAL

SEQ ID NO: 1287509 - protein, 25 aa, Mycobacterium
IPACGRCTECARGRSNLCVYGAAIV

SEQ ID NO: 1287510 - protein, 19 aa, Mycobacterium
IPDRVDVVWLDHEGGGAGS

SEQ ID NO: 1287511 - protein, 20 aa, Mycobacterium
IPEVLPKVGIVRRLVDSGEL

SEQ ID NO: 1287512 - protein, 19 aa, Mycobacterium
IPGVLRWRVDITATPTTRA

SEQ ID NO: 1287513 - protein, 17 aa, Mycobacterium
IPLNLVLIKGVTVQGFQ

SEQ ID NO: 1287514 - protein, 20 aa, Mycobacterium
IPLRVKAGAVGLTADEYHAQ

SEQ ID NO: 1287515 - protein, 17 aa, Mycobacterium
IPLSLGVTVTRIDRDGD

SEQ ID NO: 1287516 - protein, 17 aa, Mycobacterium
IPPRSVVPIAWDTIRTL

SEQ ID NO: 1287517 - protein, 18 aa, Mycobacterium
IPQSGWRLSPAYRDFDAE

SEQ ID NO: 1287518 - protein, 19 aa, Mycobacterium
IPSPVAGTLLEIIAEEDDT

SEQ ID NO: 1287519 - protein, 26 aa, Mycobacterium
IPTYPLPLLMPLTWIPVIGPIAVDML

SEQ ID NO: 1287520 - protein, 17 aa, Mycobacterium
IQFKDLTPLLADAEGLM

SEQ ID NO: 1287521 - protein, 19 aa, Mycobacterium
IRALLRFLLGEGFDEAELD

SEQ ID NO: 1287522 - protein, 20 aa, Mycobacterium
IRPDGYLGFAAHRLDTEVFE

SEQ ID NO: 1287523 - protein, 17 aa, Mycobacterium
IRPPVVTVMGHVDHGKT

SEQ ID NO: 1287524 - protein, 22 aa, Mycobacterium
IRWRSRELLTRIGSVFQNPEHQ

SEQ ID NO: 1287525 - protein, 17 aa, Mycobacterium
ISERPRLTAALDKLGKL

SEQ ID NO: 1287526 - protein, 20 aa, Mycobacterium
ISEVLPLLYLHGLSSGDFGP

SEQ ID NO: 1287527 - protein, 22 aa, Mycobacterium
ISSARTAAQFGIEPRVAMLSYS

SEQ ID NO: 1287528 - protein, 21 aa, Mycobacterium
ISTRTPRGWVARTYSQREGLQ

SEQ ID NO: 1287529 - protein, 17 aa, Mycobacterium
ISVGFPFGVSAVVPINL

SEQ ID NO: 1287530 - protein, 19 aa, Mycobacterium
ISYLLGHSGVRGFLVEADL

SEQ ID NO: 1287531 - protein, 18 aa, Mycobacterium
ITDWKIKLCDTIADNASS

SEQ ID NO: 1287532 - protein, 18 aa, Mycobacterium
ITLHAALELARRGSGYAV

SEQ ID NO: 1287533 - protein, 17 aa, Mycobacterium
ITLLPLFFELDGTFPNH

SEQ ID NO: 1287534 - protein, 18 aa, Mycobacterium
ITTRYEIACTVSGTVTAD

SEQ ID NO: 1287535 - protein, 20 aa, Mycobacterium
IVAERRLWLAVLRAQIELGM

SEQ ID NO: 1287536 - protein, 18 aa, Mycobacterium
IVDARPVAMFQMTDEAGG

SEQ ID NO: 1287537 - protein, 17 aa, Mycobacterium
IVEGGYELTLWARRPAS

SEQ ID NO: 1287538 - protein, 18 aa, Mycobacterium
IVESLASVSGHVWLTEHG

SEQ ID NO: 1287539 - protein, 24 aa, Mycobacterium
IVGDAAGVGVIWLADWADDMVNVS

SEQ ID NO: 1287540 - protein, 17 aa, Mycobacterium
IVHGGVYCAIVESLASV

SEQ ID NO: 1287541 - protein, 18 aa, Mycobacterium
IVKYLAYGWSSLRSRPAL

SEQ ID NO: 1287542 - protein, 18 aa, Mycobacterium
IVPHLNLADGREVIVNRD

SEQ ID NO: 1287543 - protein, 19 aa, Mycobacterium
IVSIEAFEHFGFERYDDFF

SEQ ID NO: 1287544 - protein, 18 aa, Mycobacterium
IWMPYHWGNAGLIDGDVV

SEQ ID NO: 1287545 - protein, 18 aa, Mycobacterium
IWRRPRWAVRLQPEPVGG

SEQ ID NO: 1287546 - protein, 19 aa, Mycobacterium
IYADLGWRGVIPVDPRDKG

SEQ ID NO: 1287547 - protein, 26 aa, Mycobacterium
IYEDLAWFCIRAWRFGASERLGAGGL

SEQ ID NO: 1287548 - protein, 21 aa, Mycobacterium
KACGICGSDLHFAAHGDDALA

SEQ ID NO: 1287549 - protein, 18 aa, Mycobacterium
KADAQWRWLAHTLTVDLL

SEQ ID NO: 1287550 - protein, 18 aa, Mycobacterium
KAFTELRQLLAVHETAEE

SEQ ID NO: 1287551 - protein, 19 aa, Mycobacterium
KAGVMAQLLPILDDLDRAR

SEQ ID NO: 1287552 - protein, 23 aa, Mycobacterium
KALYGSSLVTGWARLHGYPIGIL

SEQ ID NO: 1287553 - protein, 20 aa, Mycobacterium
KAQGIPAQFLVDILSDLRTD

SEQ ID NO: 1287554 - protein, 17 aa, Mycobacterium
KAVELALAWLTRGDLNI

SEQ ID NO: 1287555 - protein, 22 aa, Mycobacterium
KAVPSRLAWETGVAMADSLLDR

SEQ ID NO: 1287556 - protein, 19 aa, Mycobacterium
KCPMAWSDTYGGHWVAADS

SEQ ID NO: 1287557 - protein, 18 aa, Mycobacterium
KCTPCREGTYWLAQIYAR

SEQ ID NO: 1287558 - protein, 23 aa, Mycobacterium
KCYSLRIASAMAHDEGWLAEHML

SEQ ID NO: 1287559 - protein, 19 aa, Mycobacterium
KDLQDIIAILGIDELAEED

SEQ ID NO: 1287560 - protein, 19 aa, Mycobacterium
KDRWLLRHRPHLVLDGLRL

SEQ ID NO: 1287561 - protein, 17 aa, Mycobacterium
KDYPPILAMTSLNDTRV

SEQ ID NO: 1287562 - protein, 22 aa, Mycobacterium
KEGDNVFVALSWSKHPAPQNYE

SEQ ID NO: 1287563 - protein, 20 aa, Mycobacterium
KEIAGRLAARIGSGVLTDVI

SEQ ID NO: 1287564 - protein, 17 aa, Mycobacterium
KEIKRRTDVVGVFPNPA

SEQ ID NO: 1287565 - protein, 20 aa, Mycobacterium
KELCRRWYPRIYFGQPEKGL

SEQ ID NO: 1287566 - protein, 18 aa, Mycobacterium
KFMGRWRSGAPLVLAPDQ

SEQ ID NO: 1287567 - protein, 19 aa, Mycobacterium
KFYAQCCIDAGVAFVNALP

SEQ ID NO: 1287568 - protein, 20 aa, Mycobacterium
KGDKGEPCWPDGVVGSLTHC

SEQ ID NO: 1287569 - protein, 17 aa, Mycobacterium
KGMWCVPVFGNPTGVTY

SEQ ID NO: 1287570 - protein, 24 aa, Mycobacterium
KGTFRLAFGIGDFRRDTGFGDNPA

SEQ ID NO: 1287571 - protein, 18 aa, Mycobacterium
KGVERWLSQRLSHVLGRG

SEQ ID NO: 1287572 - protein, 23 aa, Mycobacterium
KIELLRLAMDWAVAGDDADVPVS

SEQ ID NO: 1287573 - protein, 19 aa, Mycobacterium
KIIECFRHGGGLPYSAYPR

SEQ ID NO: 1287574 - protein, 19 aa, Mycobacterium
KILHERGWAAPAWPVEYGG

SEQ ID NO: 1287575 - protein, 22 aa, Mycobacterium
KIRLPLGQGISGWVASHREPVV

SEQ ID NO: 1287576 - protein, 25 aa, Mycobacterium
KKFRFPTFLGAFKYYTSYTLKTFDG

SEQ ID NO: 1287577 - protein, 17 aa, Mycobacterium
KKTIEFYLTAVFNVMRL

SEQ ID NO: 1287578 - protein, 19 aa, Mycobacterium
KLAKLKPVFGVRHGDATMT

SEQ ID NO: 1287579 - protein, 21 aa, Mycobacterium
KLARPTSTWTYMVHDNPLADD

SEQ ID NO: 1287580 - protein, 19 aa, Mycobacterium
KLGQLRPGDTVRFVPIRVA

SEQ ID NO: 1287581 - protein, 20 aa, Mycobacterium
KLIDCAKAYCTVGEMVSALK

SEQ ID NO: 1287582 - protein, 23 aa, Mycobacterium
KLLPQEWVRFGWYFLVSRRDPAG

SEQ ID NO: 1287583 - protein, 24 aa, Mycobacterium
KLQKRLKEELAWVRSGAKARQAKN

SEQ ID NO: 1287584 - protein, 18 aa, Mycobacterium
KLRHAMQFELKRIQREVG

SEQ ID NO: 1287585 - protein, 20 aa, Mycobacterium
KLTFELARFVKFMITEIFPG

SEQ ID NO: 1287586 - protein, 17 aa, Mycobacterium
KLVAGLGLRLPIVATGY

SEQ ID NO: 1287587 - protein, 23 aa, Mycobacterium
KLVWKAQIFLSHRSWESTITEQV

SEQ ID NO: 1287588 - protein, 21 aa, Mycobacterium
KMPRRFYCRAKWHHSELDSET

SEQ ID NO: 1287589 - protein, 21 aa, Mycobacterium
KNKLRGGAVFAPAFDPVQVEV

SEQ ID NO: 1287590 - protein, 23 aa, Mycobacterium
KNMFALGLLSWMYGRELHQSEAF

SEQ ID NO: 1287591 - protein, 25 aa, Mycobacterium
KPFDYWRLHLKTMKGQWAPFQSLVD

SEQ ID NO: 1287592 - protein, 19 aa, Mycobacterium
KPGAGLCPVRGHSNVQGDR

SEQ ID NO: 1287593 - protein, 18 aa, Mycobacterium
KPGMTLLEVGCGWGMTMK

SEQ ID NO: 1287594 - protein, 17 aa, Mycobacterium
KPPGIAETIDWVAALVT

SEQ ID NO: 1287595 - protein, 19 aa, Mycobacterium
KRFPAGFVVLGDAFCSFNP

SEQ ID NO: 1287596 - protein, 19 aa, Mycobacterium
KRFSMPWSHPVGRMREFVA

SEQ ID NO: 1287597 - protein, 20 aa, Mycobacterium
KRFSSAILPAWARKSPQMSE

SEQ ID NO: 1287598 - protein, 19 aa, Mycobacterium
KRFVKGITEEAVFQKRAPA

SEQ ID NO: 1287599 - protein, 22 aa, Mycobacterium
KRLFCRMAEVFAGFLSYTDAQI

SEQ ID NO: 1287600 - protein, 20 aa, Mycobacterium
KRLLPTVAVYDGIHAELRSA

SEQ ID NO: 1287601 - protein, 17 aa, Mycobacterium
KRRSWAVLGEMAELGDD

SEQ ID NO: 1287602 - protein, 19 aa, Mycobacterium
KRRYSGFIGTEFDIVLRGL

SEQ ID NO: 1287603 - protein, 21 aa, Mycobacterium
KRTGLWPGLRETFGVGSADIP

SEQ ID NO: 1287604 - protein, 17 aa, Mycobacterium
KRTSVLFNFRELLNARK

SEQ ID NO: 1287605 - protein, 20 aa, Mycobacterium
KRYALPHARILMHQPLGGIT

SEQ ID NO: 1287606 - protein, 18 aa, Mycobacterium
KSSGWRLTGQKVWTSAAH

SEQ ID NO: 1287607 - protein, 19 aa, Mycobacterium
KVPGARCALAWSVETAKLA

SEQ ID NO: 1287608 - protein, 17 aa, Mycobacterium
KVSPLAVQMIMPNGAAA

SEQ ID NO: 1287609 - protein, 19 aa, Mycobacterium
KVVVFRPLYAVGGQDLGYL

SEQ ID NO: 1287610 - protein, 21 aa, Mycobacterium
KWKFTVPFVCGATNLGEALRR

SEQ ID NO: 1287611 - protein, 17 aa, Mycobacterium
KYERLWLSWAMANRDPS

SEQ ID NO: 1287612 - protein, 18 aa, Mycobacterium
KYLWNFLVDHWFRMEFDG

SEQ ID NO: 1287613 - protein, 19 aa, Mycobacterium
KYWGGVCLNVGCIPSKALL

SEQ ID NO: 1287614 - protein, 18 aa, Mycobacterium
LAAVEAFFGAGAERQLDI

SEQ ID NO: 1287615 - protein, 19 aa, Mycobacterium
LADCRRLGITVLPPDVNES

SEQ ID NO: 1287616 - protein, 17 aa, Mycobacterium
LADGIDIVGRWAEAVGL

SEQ ID NO: 1287617 - protein, 21 aa, Mycobacterium
LAEFPELQWRDGAAVTVVVAA

SEQ ID NO: 1287618 - protein, 19 aa, Mycobacterium
LAEGMPAYGSCAGMILLAT

SEQ ID NO: 1287619 - protein, 20 aa, Mycobacterium
LAEHEMPGLMALRREYAEVA

SEQ ID NO: 1287620 - protein, 19 aa, Mycobacterium
LAFERQWWKYAGSKEDAIK

SEQ ID NO: 1287621 - protein, 19 aa, Mycobacterium
LAGACSMAAFTAAMHAGQG

SEQ ID NO: 1287622 - protein, 20 aa, Mycobacterium
LAGLRIGYAIGSWGLTAELW

SEQ ID NO: 1287623 - protein, 23 aa, Mycobacterium
LAGPRPVVLHGFDLAHRSRAEVT

SEQ ID NO: 1287624 - protein, 18 aa, Mycobacterium
LAGTLSYFECTPWAEYDA

SEQ ID NO: 1287625 - protein, 23 aa, Mycobacterium
LAHRARWGLLLARTNPDVPKHKG

SEQ ID NO: 1287626 - protein, 17 aa, Mycobacterium
LAKRTSVLFNFRELLNA

SEQ ID NO: 1287627 - protein, 23 aa, Mycobacterium
LALAEGFALAGARVVVASRKPDA

SEQ ID NO: 1287628 - protein, 24 aa, Mycobacterium
LAMGLPLFGVRGMNGFVRATRRAA

SEQ ID NO: 1287629 - protein, 17 aa, Mycobacterium
LAMIDPWPAGYYGRQDH

SEQ ID NO: 1287630 - protein, 23 aa, Mycobacterium
LAMPRLDMVTGLYFLTTMIEGDK

SEQ ID NO: 1287631 - protein, 25 aa, Mycobacterium
LANLKFAWRSCRAVKSNAIVVVADG

SEQ ID NO: 1287632 - protein, 18 aa, Mycobacterium
LAQRLALAAGRRLDEAQP

SEQ ID NO: 1287633 - protein, 19 aa, Mycobacterium
LATQLRAGLFGVLYVLDEP

SEQ ID NO: 1287634 - protein, 17 aa, Mycobacterium
LAVARWGIAYSVGPNYN

SEQ ID NO: 1287635 - protein, 18 aa, Mycobacterium
LAVKACFAAFRTGTLDHH

SEQ ID NO: 1287636 - protein, 21 aa, Mycobacterium
LAVRAEERFGPERVIRAATLP

SEQ ID NO: 1287637 - protein, 17 aa, Mycobacterium
LAVRLDVSRLVVVGTGR

SEQ ID NO: 1287638 - protein, 17 aa, Mycobacterium
LAVTVGFEMAAVIASAA

SEQ ID NO: 1287639 - protein, 17 aa, Mycobacterium
LAWHAWRDADSGNWPTG

SEQ ID NO: 1287640 - protein, 21 aa, Mycobacterium
LCEAAHLPVIWATQVLESLAK

SEQ ID NO: 1287641 - protein, 18 aa, Mycobacterium
LDAALIRLSAARGLNAVV

SEQ ID NO: 1287642 - protein, 21 aa, Mycobacterium
LDALCGVGGWQPRGALGNIPV

SEQ ID NO: 1287643 - protein, 29 aa, Mycobacterium
LDDLATRVGWRWRLVWFRAVAELLSADYE

SEQ ID NO: 1287644 - protein, 17 aa, Mycobacterium
LDFAVPTFEQFWRDGSL

SEQ ID NO: 1287645 - protein, 19 aa, Mycobacterium
LDGPLPRRARTFVLTTEAE

SEQ ID NO: 1287646 - protein, 24 aa, Mycobacterium
LDGYPRPGRTVLFLGRYDEPRKGM

SEQ ID NO: 1287647 - protein, 23 aa, Mycobacterium
LDIGCGWGATIMRAVEKYDVNVI

SEQ ID NO: 1287648 - protein, 25 aa, Mycobacterium
LDIPGRFAVRVPMQWTSDDNGGFSR

SEQ ID NO: 1287649 - protein, 20 aa, Mycobacterium
LDLCPRIRVNAIAPGSILTS

SEQ ID NO: 1287650 - protein, 18 aa, Mycobacterium
LDLCRELGAEVAINYRDE

SEQ ID NO: 1287651 - protein, 25 aa, Mycobacterium
LDLSLPANVPFRFLCIPQYETERIL

SEQ ID NO: 1287652 - protein, 28 aa, Mycobacterium
LDPERGRLWSALWLRPAHGPGVLVVTAH

SEQ ID NO: 1287653 - protein, 18 aa, Mycobacterium
LDQLVGFFINILVLRNDL

SEQ ID NO: 1287654 - protein, 24 aa, Mycobacterium
LDRERCVLCARCTRFSQQIAGDPF

SEQ ID NO: 1287655 - protein, 18 aa, Mycobacterium
LDRGWCEHLAYLADIRES

SEQ ID NO: 1287656 - protein, 18 aa, Mycobacterium
LDRIFIDAGAEWRQAGCS

SEQ ID NO: 1287657 - protein, 19 aa, Mycobacterium
LDRVLQLFGGYGYMEEYPI

SEQ ID NO: 1287658 - protein, 21 aa, Mycobacterium
LDTDLRWRIVTALAASGDIDA

SEQ ID NO: 1287659 - protein, 19 aa, Mycobacterium
LDVGCGWGSTMMRAIERHD

SEQ ID NO: 1287660 - protein, 24 aa, Mycobacterium
LDVLRFWLDLGIDGFRLDAVPYLF

SEQ ID NO: 1287661 - protein, 18 aa, Mycobacterium
LDVWSLTDIVAFNRDSAD

SEQ ID NO: 1287662 - protein, 18 aa, Mycobacterium
LEAMGAPIPRYTAVDTVD

SEQ ID NO: 1287663 - protein, 24 aa, Mycobacterium
LEDALRFYFEFHFDQGEGYLAHLH

SEQ ID NO: 1287664 - protein, 22 aa, Mycobacterium
LEEYWWAAEQMLTWPGEPANMI

SEQ ID NO: 1287665 - protein, 18 aa, Mycobacterium
LEFFRPMVEQVFARQPWA

SEQ ID NO: 1287666 - protein, 18 aa, Mycobacterium
LEHPELWGKVVDVDELVP

SEQ ID NO: 1287667 - protein, 21 aa, Mycobacterium
LEIGRAHTPWFHWGTTAMVAH

SEQ ID NO: 1287668 - protein, 17 aa, Mycobacterium
LEIRPPVVTVMGHVDHG

SEQ ID NO: 1287669 - protein, 24 aa, Mycobacterium
LEKTLRFWLDRGVDGFRIDVAHGM

SEQ ID NO: 1287670 - protein, 20 aa, Mycobacterium
LELSQLPGLGWVEYEPFGTV

SEQ ID NO: 1287671 - protein, 25 aa, Mycobacterium
LENLSPWFEFVWKPGYADYYPELPG

SEQ ID NO: 1287672 - protein, 18 aa, Mycobacterium
LENTRFWAPLSLTAEQKH

SEQ ID NO: 1287673 - protein, 19 aa, Mycobacterium
LEPEPVCWAIENIAVHVGP

SEQ ID NO: 1287674 - protein, 17 aa, Mycobacterium
LERICRLIMLYHLDRGW

SEQ ID NO: 1287675 - protein, 20 aa, Mycobacterium
LETRGRFGTFVSRVDPADTA

SEQ ID NO: 1287676 - protein, 19 aa, Mycobacterium
LEVYPGLWAGPSLLRDGAG

SEQ ID NO: 1287677 - protein, 19 aa, Mycobacterium
LEYHWGRHWVVWDAEDTFQ

SEQ ID NO: 1287678 - protein, 19 aa, Mycobacterium
LFAERCIDGLVANEEHMRE

SEQ ID NO: 1287679 - protein, 23 aa, Mycobacterium
LFALGRLPGWIAHWREMHSEPGK

SEQ ID NO: 1287680 - protein, 18 aa, Mycobacterium
LFALLAYGEVAAFYRLTE

SEQ ID NO: 1287681 - protein, 18 aa, Mycobacterium
LFAWCFARRGWAERARVL

SEQ ID NO: 1287682 - protein, 24 aa, Mycobacterium
LFENGWKPGLAWTAETTLGRVMFN

SEQ ID NO: 1287683 - protein, 17 aa, Mycobacterium
LFFQIYWLGGREAILER

SEQ ID NO: 1287684 - protein, 17 aa, Mycobacterium
LFIFPVLNLRLPMITRS

SEQ ID NO: 1287685 - protein, 18 aa, Mycobacterium
LFLGDSFEGIVTVEIVDG

SEQ ID NO: 1287686 - protein, 18 aa, Mycobacterium
LFLRDLVMALRWVRDNIA

SEQ ID NO: 1287687 - protein, 18 aa, Mycobacterium
LFNGFWILDVSSKEEAKQ

SEQ ID NO: 1287688 - protein, 17 aa, Mycobacterium
LGAVKAWASVGVDPAFT

SEQ ID NO: 1287689 - protein, 22 aa, Mycobacterium
LGDLRPLYRPGLVHIYHALTWG

SEQ ID NO: 1287690 - protein, 18 aa, Mycobacterium
LGDPDFLLTIGLLPLQTA

SEQ ID NO: 1287691 - protein, 18 aa, Mycobacterium
LGEALGLIDMERGAKVAG

SEQ ID NO: 1287692 - protein, 20 aa, Mycobacterium
LGEIWLRYRASVAHGLTLWM

SEQ ID NO: 1287693 - protein, 17 aa, Mycobacterium
LGELWVAAARLRQVERL

SEQ ID NO: 1287694 - protein, 19 aa, Mycobacterium
LGEQCAFGLALIAPKLPPF

SEQ ID NO: 1287695 - protein, 17 aa, Mycobacterium
LGEWDLRALVGHTSRSL

SEQ ID NO: 1287696 - protein, 23 aa, Mycobacterium
LGGFAWKAALHMLRRGGASVPVP

SEQ ID NO: 1287697 - protein, 23 aa, Mycobacterium
LGHLRGAVNIGLAGRYAEFAGSV

SEQ ID NO: 1287698 - protein, 18 aa, Mycobacterium
LGIRGCSVSMPFKQDVLD

SEQ ID NO: 1287699 - protein, 18 aa, Mycobacterium
LGITNVRFTGGEPLVVRH

SEQ ID NO: 1287700 - protein, 24 aa, Mycobacterium
LGLDGAGLGTCWGRQLATSMLADA

SEQ ID NO: 1287701 - protein, 17 aa, Mycobacterium
LGNLIPEWNDLVRRGRW

SEQ ID NO: 1287702 - protein, 22 aa, Mycobacterium
LGNVRLPIVIAFGLGSLATGMA

SEQ ID NO: 1287703 - protein, 22 aa, Mycobacterium
LGPARLPGGFAVRYHPATRPLQ

SEQ ID NO: 1287704 - protein, 24 aa, Mycobacterium
LGPRGRNVVLAKSWGGPTVTNDGV

SEQ ID NO: 1287705 - protein, 17 aa, Mycobacterium
LGPSLSDPGRRSVAKTL

SEQ ID NO: 1287706 - protein, 26 aa, Mycobacterium
LGRPLRIAHAWSFTFDAAWQPLVALF

SEQ ID NO: 1287707 - protein, 24 aa, Mycobacterium
LGSLTLPVLRAWLSAQAAAGTART

SEQ ID NO: 1287708 - protein, 21 aa, Mycobacterium
LGTAAVCWRLRRRHGLPVHDI

SEQ ID NO: 1287709 - protein, 20 aa, Mycobacterium
LGTFSWPGAYGTWWQADPTN

SEQ ID NO: 1287710 - protein, 18 aa, Mycobacterium
LGVDVVLPWDGRDHYLAG

SEQ ID NO: 1287711 - protein, 24 aa, Mycobacterium
LGVGWPKEFGGLGFGPVEQSIFVN

SEQ ID NO: 1287712 - protein, 17 aa, Mycobacterium
LGWSAPRLHLVDLQYSD

SEQ ID NO: 1287713 - protein, 19 aa, Mycobacterium
LHDPVRWKLQHIGRYTLSG

SEQ ID NO: 1287714 - protein, 23 aa, Mycobacterium
LHGECGWEYFAPVFVGDELTETR

SEQ ID NO: 1287715 - protein, 24 aa, Mycobacterium
LIDFWRFNVAFARGILTQQPVSAR

SEQ ID NO: 1287716 - protein, 26 aa, Mycobacterium
LIERRPGWPQARWLRVAIHHRTQRWS

SEQ ID NO: 1287717 - protein, 23 aa, Mycobacterium
LIEVIGGLGIRLSNYLPTRTFEL

SEQ ID NO: 1287718 - protein, 18 aa, Mycobacterium
LILADAIVRACEDNPDYL

SEQ ID NO: 1287719 - protein, 19 aa, Mycobacterium
LIQHLIRWVILSKQFDDTV

SEQ ID NO: 1287720 - protein, 21 aa, Mycobacterium
LKASFKAGALIGRGSGEALQV

SEQ ID NO: 1287721 - protein, 18 aa, Mycobacterium
LKGANLWKEVKDRLDQPG

SEQ ID NO: 1287722 - protein, 20 aa, Mycobacterium
LKGEVKDVLLLDVTPLSLGI

SEQ ID NO: 1287723 - protein, 17 aa, Mycobacterium
LKIALAAAEQARIAVPL

SEQ ID NO: 1287724 - protein, 19 aa, Mycobacterium
LKIPRLQDAYFKRFTDYPK

SEQ ID NO: 1287725 - protein, 20 aa, Mycobacterium
LKIPSERWIFPYAGTDSHDT

SEQ ID NO: 1287726 - protein, 19 aa, Mycobacterium
LKPAEWTPLTSIRLGELAV

SEQ ID NO: 1287727 - protein, 20 aa, Mycobacterium
LKPLFLAAAHWKRTGRFPGV

SEQ ID NO: 1287728 - protein, 19 aa, Mycobacterium
LKVLIRFTNELLRQSVIGL

SEQ ID NO: 1287729 - protein, 23 aa, Mycobacterium
LKYPARLIDEFTWETDLGDKVVS

SEQ ID NO: 1287730 - protein, 20 aa, Mycobacterium
LKYPHMFAAAGLIIVNKTDL

SEQ ID NO: 1287731 - protein, 17 aa, Mycobacterium
LLAALAFDLIILETVGV

SEQ ID NO: 1287732 - protein, 18 aa, Mycobacterium
LLAPIAVPLVYRASVAAR

SEQ ID NO: 1287733 - protein, 18 aa, Mycobacterium
LLCNGAVGIAEGWATKVP

SEQ ID NO: 1287734 - protein, 18 aa, Mycobacterium
LLDALAPLGDWATRHIDL

SEQ ID NO: 1287735 - protein, 17 aa, Mycobacterium
LLDLFGLAGESLPAIVD

SEQ ID NO: 1287736 - protein, 18 aa, Mycobacterium
LLDQCRRHGLPVLIASPS

SEQ ID NO: 1287737 - protein, 17 aa, Mycobacterium
LLEMMWADEFVDERDAR

SEQ ID NO: 1287738 - protein, 17 aa, Mycobacterium
LLGLDCVIYMGAVDTAR

SEQ ID NO: 1287739 - protein, 20 aa, Mycobacterium
LLGPRGRRWLNKKLGLDNVF

SEQ ID NO: 1287740 - protein, 20 aa, Mycobacterium
LLGRCPVCLYAGSIMPEDLL

SEQ ID NO: 1287741 - protein, 25 aa, Mycobacterium
LLGRRGACLNLKMAMLGRADEPPYF

SEQ ID NO: 1287742 - protein, 23 aa, Mycobacterium
LLGSLRIGNRFVHTGRPTPEAYA

SEQ ID NO: 1287743 - protein, 18 aa, Mycobacterium
LLHHVAWQPVAWPDADLP

SEQ ID NO: 1287744 - protein, 19 aa, Mycobacterium
LLHYVKWYLDGTLTFRRSC

SEQ ID NO: 1287745 - protein, 22 aa, Mycobacterium
LLLEVVCARLLLPSASDTESAL

SEQ ID NO: 1287746 - protein, 17 aa, Mycobacterium
LLLPGSDLDEAWVDQTA

SEQ ID NO: 1287747 - protein, 23 aa, Mycobacterium
LLLRPRYAGLRVYRGKVVGKGDW

SEQ ID NO: 1287748 - protein, 18 aa, Mycobacterium
LLMFNRILPAAGMHHMSR

SEQ ID NO: 1287749 - protein, 23 aa, Mycobacterium
LLNAKTRRPSVCNAAESVLIDAA

SEQ ID NO: 1287750 - protein, 17 aa, Mycobacterium
LLPRYVRTIHSWQLSRV

SEQ ID NO: 1287751 - protein, 20 aa, Mycobacterium
LLPVHCWFDGDGWGMRVFAP

SEQ ID NO: 1287752 - protein, 17 aa, Mycobacterium
LLQLRWLALEGRPDRVD

SEQ ID NO: 1287753 - protein, 19 aa, Mycobacterium
LLQPWGIVHGGVYCAIVES

SEQ ID NO: 1287754 - protein, 24 aa, Mycobacterium
LLSSRFPMWMAWGPELTFFCNAAY

SEQ ID NO: 1287755 - protein, 17 aa, Mycobacterium
LLVLGALCHDIGKGRGG

SEQ ID NO: 1287756 - protein, 17 aa, Mycobacterium
LLVRALVAWFWDEPLRA

SEQ ID NO: 1287757 - protein, 19 aa, Mycobacterium
LMAAARLDLASVFLYNGSI

SEQ ID NO: 1287758 - protein, 19 aa, Mycobacterium
LMAALTMKLEKHWQQRTPA

SEQ ID NO: 1287759 - protein, 18 aa, Mycobacterium
LMHGAAQWAVMTALTTGQ

SEQ ID NO: 1287760 - protein, 18 aa, Mycobacterium
LMPDVLHWFGIRKIHRLV

SEQ ID NO: 1287761 - protein, 22 aa, Mycobacterium
LMTRSGTFYTLRCYLGDDPVFL

SEQ ID NO: 1287762 - protein, 26 aa, Mycobacterium
LMVAECALIFGCDWLNIPIDAPGSSL

SEQ ID NO: 1287763 - protein, 19 aa, Mycobacterium
LNGNGGLDWAVKRTADSSQ

SEQ ID NO: 1287764 - protein, 17 aa, Mycobacterium
LNLVFGHVLEQLRAADV

SEQ ID NO: 1287765 - protein, 18 aa, Mycobacterium
LNMMPRWYIGSILRNVDF

SEQ ID NO: 1287766 - protein, 23 aa, Mycobacterium
LNSPAADFFIKWMSRGNTLVYKL

SEQ ID NO: 1287767 - protein, 19 aa, Mycobacterium
LNYLPPRLVPPVFRHQARR

SEQ ID NO: 1287768 - protein, 18 aa, Mycobacterium
LPAGFSFVPGHEIVGIVE

SEQ ID NO: 1287769 - protein, 17 aa, Mycobacterium
LPAGMPVAVVVRQLTEH

SEQ ID NO: 1287770 - protein, 17 aa, Mycobacterium
LPARFGIAVDHLNGQGM

SEQ ID NO: 1287771 - protein, 17 aa, Mycobacterium
LPAWMFRLARGESDVLA

SEQ ID NO: 1287772 - protein, 23 aa, Mycobacterium
LPDKRVDEVLGMVGLADVAGKPA

SEQ ID NO: 1287773 - protein, 19 aa, Mycobacterium
LPEGRWEEFLGEPRIAERV

SEQ ID NO: 1287774 - protein, 23 aa, Mycobacterium
LPERDFPTLISLYLQGRLPLDKF

SEQ ID NO: 1287775 - protein, 23 aa, Mycobacterium
LPGSEHWPAMVFLRSPAPSSNHH

SEQ ID NO: 1287776 - protein, 17 aa, Mycobacterium
LPICAAIAVLRTRTTRE

SEQ ID NO: 1287777 - protein, 22 aa, Mycobacterium
LPITLWPGMKIGQLCLLRLTSP

SEQ ID NO: 1287778 - protein, 19 aa, Mycobacterium
LPKEFKRRGVQMLTEGKRT

SEQ ID NO: 1287779 - protein, 17 aa, Mycobacterium
LPLRPFRTMAVNVDGEL

SEQ ID NO: 1287780 - protein, 23 aa, Mycobacterium
LPMPDLIRLAARAHHYLYVYDQH

SEQ ID NO: 1287781 - protein, 22 aa, Mycobacterium
LPNGRSGWRISIPAMMSYWSEL

SEQ ID NO: 1287782 - protein, 18 aa, Mycobacterium
LPPELDFAALFHGIDERV

SEQ ID NO: 1287783 - protein, 17 aa, Mycobacterium
LPPGIAVQGQRGGPAHP

SEQ ID NO: 1287784 - protein, 19 aa, Mycobacterium
LPPGVPGTIWFRGGNSSFE

SEQ ID NO: 1287785 - protein, 17 aa, Mycobacterium
LPPLWQVFGAHRRPDGH

SEQ ID NO: 1287786 - protein, 18 aa, Mycobacterium
LPPWLRLVVVDAANAVFT

SEQ ID NO: 1287787 - protein, 17 aa, Mycobacterium
LPRARLTGELGRTAGQL

SEQ ID NO: 1287788 - protein, 23 aa, Mycobacterium
LPVKLCYAGPFFRYERPQAGRYR

SEQ ID NO: 1287789 - protein, 23 aa, Mycobacterium
LPVYRPPLDMARLFGEPAVGDHR

SEQ ID NO: 1287790 - protein, 23 aa, Mycobacterium
LPYPGDDVLLCLGIHGQMIYVNR

SEQ ID NO: 1287791 - protein, 18 aa, Mycobacterium
LQHPDTFERLGIEPPRGV

SEQ ID NO: 1287792 - protein, 17 aa, Mycobacterium
LQLPFGAPKTMFNVPIG

SEQ ID NO: 1287793 - protein, 17 aa, Mycobacterium
LQMSWKVAPALAAGCTM

SEQ ID NO: 1287794 - protein, 23 aa, Mycobacterium
LQPLRPPVSFGFASAPAAPQLVA

SEQ ID NO: 1287795 - protein, 20 aa, Mycobacterium
LQRREAWQIIDFVNQLTDPS

SEQ ID NO: 1287796 - protein, 18 aa, Mycobacterium
LQTEFDFRFLVGVVSVMG

SEQ ID NO: 1287797 - protein, 18 aa, Mycobacterium
LQTWLQRRVVIDGEMLAR

SEQ ID NO: 1287798 - protein, 18 aa, Mycobacterium
LQVAEAFGRYGAHLPVNV

SEQ ID NO: 1287799 - protein, 17 aa, Mycobacterium
LQVANRVELARYAIEHG

SEQ ID NO: 1287800 - protein, 18 aa, Mycobacterium
LQWLGVDCLWLPPFYDSP

SEQ ID NO: 1287801 - protein, 24 aa, Mycobacterium
LRAAARVYAGWGFSQAFYWQQEYK

SEQ ID NO: 1287802 - protein, 19 aa, Mycobacterium
LRAGLFGVLYVLDEPSAGL

SEQ ID NO: 1287803 - protein, 18 aa, Mycobacterium
LRALFPDAIEVTAADAHV

SEQ ID NO: 1287804 - protein, 20 aa, Mycobacterium
LRDAWFWAHEVMAVGMVWNT

SEQ ID NO: 1287805 - protein, 19 aa, Mycobacterium
LRDEIGCSIVLITHDLGVA

SEQ ID NO: 1287806 - protein, 22 aa, Mycobacterium
LRFAVNRLRMFAADPAERTPRP

SEQ ID NO: 1287807 - protein, 21 aa, Mycobacterium
LRGAFHVVRPAFPVMCDAGYG

SEQ ID NO: 1287808 - protein, 22 aa, Mycobacterium
LRGDCPRFAPGDFAVRPTVGTP

SEQ ID NO: 1287809 - protein, 27 aa, Mycobacterium
LRGFQRFPAWMWRNVVVRDFAEWLQAH

SEQ ID NO: 1287810 - protein, 21 aa, Mycobacterium
LRGGVFSAILPVLAHDIPWNS

SEQ ID NO: 1287811 - protein, 17 aa, Mycobacterium
LRHDWPAALRGAGFDPS

SEQ ID NO: 1287812 - protein, 17 aa, Mycobacterium
LRIDDRFRAAARGDRAA

SEQ ID NO: 1287813 - protein, 17 aa, Mycobacterium
LRIGLATADDIRQWSYG

SEQ ID NO: 1287814 - protein, 18 aa, Mycobacterium
LRIGRLCDRLHVTKGSFY

SEQ ID NO: 1287815 - protein, 23 aa, Mycobacterium
LRIPKLRSGSFFPALLERRRRVD

SEQ ID NO: 1287816 - protein, 20 aa, Mycobacterium
LRLADAWVWDMYRPARFVKQ

SEQ ID NO: 1287817 - protein, 17 aa, Mycobacterium
LRLGDRIQITPPLGSAL

SEQ ID NO: 1287818 - protein, 17 aa, Mycobacterium
LRLPPELDFAALFHGID

SEQ ID NO: 1287819 - protein, 19 aa, Mycobacterium
LRLPVLRAQLRWMEAVLAV

SEQ ID NO: 1287820 - protein, 24 aa, Mycobacterium
LRLRDIGGIIVIDFIDMVLESNRD

SEQ ID NO: 1287821 - protein, 17 aa, Mycobacterium
LRLRGMSAMLTRIKRRL

SEQ ID NO: 1287822 - protein, 18 aa, Mycobacterium
LRLRGWQVDFLGAQVPTP

SEQ ID NO: 1287823 - protein, 20 aa, Mycobacterium
LRLSHPLPLRVGDVGLLRDP

SEQ ID NO: 1287824 - protein, 17 aa, Mycobacterium
LRLVEAFGYGWSDLARF

SEQ ID NO: 1287825 - protein, 23 aa, Mycobacterium
LRMDEFPARLVIVPGERDRLLQS

SEQ ID NO: 1287826 - protein, 18 aa, Mycobacterium
LRNWRFYDGFRVDATAPA

SEQ ID NO: 1287827 - protein, 26 aa, Mycobacterium
LRPDLATGLMPLRWGTGYMLGSKRFG

SEQ ID NO: 1287828 - protein, 22 aa, Mycobacterium
LRPGGRLGLVWNTRDERLGWVK

SEQ ID NO: 1287829 - protein, 19 aa, Mycobacterium
LRRACVAGALATLVPGAGD

SEQ ID NO: 1287830 - protein, 19 aa, Mycobacterium
LRRAGGCWVLTNHPFLTGR

SEQ ID NO: 1287831 - protein, 17 aa, Mycobacterium
LRRCGAPLLSLRTDRDW

SEQ ID NO: 1287832 - protein, 22 aa, Mycobacterium
LRRELLDLSAWAWDEFLTANGD

SEQ ID NO: 1287833 - protein, 18 aa, Mycobacterium
LRRLKTCAAPDCEAVLVD

SEQ ID NO: 1287834 - protein, 20 aa, Mycobacterium
LRRLVIMGGAFDYRGNTTAV

SEQ ID NO: 1287835 - protein, 18 aa, Mycobacterium
LRRLWGLPGTQLGVVAWP

SEQ ID NO: 1287836 - protein, 19 aa, Mycobacterium
LRRYDCSQLTDGGAGIVLV

SEQ ID NO: 1287837 - protein, 18 aa, Mycobacterium
LRSLGGWGRRHGVATVMI

SEQ ID NO: 1287838 - protein, 23 aa, Mycobacterium
LRSRRARIAPEMTGLPAYGGRRR

SEQ ID NO: 1287839 - protein, 20 aa, Mycobacterium
LRSWFGFGVAGNFAGHLEQA

SEQ ID NO: 1287840 - protein, 19 aa, Mycobacterium
LRTDRDWIADVVRFVASRR

SEQ ID NO: 1287841 - protein, 17 aa, Mycobacterium
LRTGWSVTIVGTAHPIS

SEQ ID NO: 1287842 - protein, 20 aa, Mycobacterium
LRVIFPAGFAERIGPRAVNE

SEQ ID NO: 1287843 - protein, 20 aa, Mycobacterium
LRWLASANCLLEIPEDVSEL

SEQ ID NO: 1287844 - protein, 20 aa, Mycobacterium
LRYTMPLGEIIFDFFDSLKS

SEQ ID NO: 1287845 - protein, 17 aa, Mycobacterium
LSARLGLTARVAHVEGD

SEQ ID NO: 1287846 - protein, 17 aa, Mycobacterium
LSARPGVVLSRRQLLDI

SEQ ID NO: 1287847 - protein, 22 aa, Mycobacterium
LSFSSLSGWAKRGLRDRFIDLT

SEQ ID NO: 1287848 - protein, 17 aa, Mycobacterium
LSKRGGGVALLLSNIRE

SEQ ID NO: 1287849 - protein, 18 aa, Mycobacterium
LSRHRWAVLMKVHHCLAD

SEQ ID NO: 1287850 - protein, 22 aa, Mycobacterium
LSSSQLRSWFAYRVDGPSVVNN

SEQ ID NO: 1287851 - protein, 20 aa, Mycobacterium
LSTAMLLEWLAERHHRGALA

SEQ ID NO: 1287852 - protein, 18 aa, Mycobacterium
LSVSCPRDLVANAPVPLS

SEQ ID NO: 1287853 - protein, 17 aa, Mycobacterium
LTAQDVFNNVARTCIEA

SEQ ID NO: 1287854 - protein, 24 aa, Mycobacterium
LTCSIRPSGIWGRGDQTMFRKVFE

SEQ ID NO: 1287855 - protein, 24 aa, Mycobacterium
LTEAWGLSTAQGWQGVGHTRMATE

SEQ ID NO: 1287856 - protein, 18 aa, Mycobacterium
LTGARYVGWQGLLDAQRE

SEQ ID NO: 1287857 - protein, 17 aa, Mycobacterium
LTGELRQGALIGVMADA

SEQ ID NO: 1287858 - protein, 17 aa, Mycobacterium
LTRDLAQQWGIRKGIRV

SEQ ID NO: 1287859 - protein, 19 aa, Mycobacterium
LTSELPLPVNAIGIPDQDD

SEQ ID NO: 1287860 - protein, 18 aa, Mycobacterium
LTSIPLWAAIEAFCADKT

SEQ ID NO: 1287861 - protein, 19 aa, Mycobacterium
LTTALARHGIVLSLQFETD

SEQ ID NO: 1287862 - protein, 17 aa, Mycobacterium
LTVDLLRPVAMAPVHTR

SEQ ID NO: 1287863 - protein, 23 aa, Mycobacterium
LVARRLDCQVGLLLTELSEEPGH

SEQ ID NO: 1287864 - protein, 17 aa, Mycobacterium
LVEAFGYGWSDLARFTI

SEQ ID NO: 1287865 - protein, 19 aa, Mycobacterium
LVFGRRAGLGASDYVRALG

SEQ ID NO: 1287866 - protein, 24 aa, Mycobacterium
LVIKEALRLLAPVPLVMRKTVRDV

SEQ ID NO: 1287867 - protein, 17 aa, Mycobacterium
LVLCGAYAKGRAVRAAN

SEQ ID NO: 1287868 - protein, 24 aa, Mycobacterium
LVLHDLSWRLARFGPAQVGLEPLP

SEQ ID NO: 1287869 - protein, 22 aa, Mycobacterium
LVLPRRLQIEFSQAIQKITDGE

SEQ ID NO: 1287870 - protein, 17 aa, Mycobacterium
LVLRPGLTLALEPWFAR

SEQ ID NO: 1287871 - protein, 17 aa, Mycobacterium
LVRWPRQVLAEFGLYLP

SEQ ID NO: 1287872 - protein, 17 aa, Mycobacterium
LVTPLPFNVRQTVRDTE

SEQ ID NO: 1287873 - protein, 21 aa, Mycobacterium
LVTRAGFIGCHHWRFLETADV

SEQ ID NO: 1287874 - protein, 18 aa, Mycobacterium
LVVRINFLGTRHFTESML

SEQ ID NO: 1287875 - protein, 18 aa, Mycobacterium
LWARRPASLEPYADTAAK

SEQ ID NO: 1287876 - protein, 17 aa, Mycobacterium
LWAYVVIFCGHFPDGAD

SEQ ID NO: 1287877 - protein, 26 aa, Mycobacterium
LWEHWERCAFHWFPGNHLLHVSQPDY

SEQ ID NO: 1287878 - protein, 18 aa, Mycobacterium
LWPHARCALMGVGAPPLM

SEQ ID NO: 1287879 - protein, 25 aa, Mycobacterium
LYAIPRFVNRWAVSLAYLTDVFFAR

SEQ ID NO: 1287880 - protein, 17 aa, Mycobacterium
LYDAGWMRYGWPESAGG

SEQ ID NO: 1287881 - protein, 24 aa, Mycobacterium
LYEQRRWEVPSNRIANTMKLAIIS

SEQ ID NO: 1287882 - protein, 18 aa, Mycobacterium
LYIALGISGAIQHRAGMQ

SEQ ID NO: 1287883 - protein, 17 aa, Mycobacterium
LYLDWPRKARAVVGNLR

SEQ ID NO: 1287884 - protein, 17 aa, Mycobacterium
LYRLCGDRNPLHSDPDF

SEQ ID NO: 1287885 - protein, 19 aa, Mycobacterium
LYRRWPFFRTVLSNMAQVL

SEQ ID NO: 1287886 - protein, 19 aa, Mycobacterium
LYSRFWHKVLYDLGHVSSR

SEQ ID NO: 1287887 - protein, 18 aa, Mycobacterium
LYWQCWKLDSPLVARLTG

SEQ ID NO: 1287888 - protein, 18 aa, Mycobacterium
MAAAPAWESFEQWMRTRL

SEQ ID NO: 1287889 - protein, 17 aa, Mycobacterium
MAGDFGGVWYWNRFPGI

SEQ ID NO: 1287890 - protein, 17 aa, Mycobacterium
MAHFFYIHFGLPTYFKN

SEQ ID NO: 1287891 - protein, 18 aa, Mycobacterium
MALELTWEALEHARIPAS

SEQ ID NO: 1287892 - protein, 17 aa, Mycobacterium
MARLLCHKAAWTIDQEG

SEQ ID NO: 1287893 - protein, 19 aa, Mycobacterium
MCGWLKDRFGVSWQIVPDR

SEQ ID NO: 1287894 - protein, 18 aa, Mycobacterium
MDPWGASVADVFTAELAA

SEQ ID NO: 1287895 - protein, 21 aa, Mycobacterium
MDRKVWLPSGGTLVIDRTEAM

SEQ ID NO: 1287896 - protein, 17 aa, Mycobacterium
MEFCTAYALAPEWGTHT

SEQ ID NO: 1287897 - protein, 20 aa, Mycobacterium
MELGCDAVLLASAVTRAADP

SEQ ID NO: 1287898 - protein, 20 aa, Mycobacterium
MEPDLRWERFITAVRLLAEQ

SEQ ID NO: 1287899 - protein, 24 aa, Mycobacterium
MFADLPPDFGIRFADLVSARAKRI

SEQ ID NO: 1287900 - protein, 17 aa, Mycobacterium
MFRCERDVWLVAAGTLG

SEQ ID NO: 1287901 - protein, 22 aa, Mycobacterium
MGCGRTGAFFSFEEAGIVPDIV

SEQ ID NO: 1287902 - protein, 18 aa, Mycobacterium
MGGLLAFDIARRLERDGD

SEQ ID NO: 1287903 - protein, 17 aa, Mycobacterium
MGGRTALIVAGRVPERV

SEQ ID NO: 1287904 - protein, 17 aa, Mycobacterium
MHPWGKWGRDFTEYGVV

SEQ ID NO: 1287905 - protein, 19 aa, Mycobacterium
MHRRWSIVMVDEFQDTDPV

SEQ ID NO: 1287906 - protein, 19 aa, Mycobacterium
MHVVPRWGGDANFITIIGG

SEQ ID NO: 1287907 - protein, 24 aa, Mycobacterium
MIAEAGDWVTCWAVGMNQSTHGTA

SEQ ID NO: 1287908 - protein, 22 aa, Mycobacterium
MIRYCAPAQWFARTVRRPFTIH

SEQ ID NO: 1287909 - protein, 18 aa, Mycobacterium
MKLSDAWEGGGAVAAAGE

SEQ ID NO: 1287910 - protein, 20 aa, Mycobacterium
MKPDVCWQLPIRRTQDWVTR

SEQ ID NO: 1287911 - protein, 17 aa, Mycobacterium
MLESWKLAPALASGCTV

SEQ ID NO: 1287912 - protein, 17 aa, Mycobacterium
MLRSTFVYRHRQLADDL

SEQ ID NO: 1287913 - protein, 18 aa, Mycobacterium
MLVRPEFRAMFLDDLLNG

SEQ ID NO: 1287914 - protein, 18 aa, Mycobacterium
MMHLATFLARAQVAEAEA

SEQ ID NO: 1287915 - protein, 19 aa, Mycobacterium
MPALKFVWADGAADLLTPF

SEQ ID NO: 1287916 - protein, 20 aa, Mycobacterium
MPGYRGWQWAVVVAAYPGAE

SEQ ID NO: 1287917 - protein, 22 aa, Mycobacterium
MPIKVPWSLPAARPCFAGDPED

SEQ ID NO: 1287918 - protein, 19 aa, Mycobacterium
MPLPLLRQALKAWPDTDFI

SEQ ID NO: 1287919 - protein, 17 aa, Mycobacterium
MPMPRALQWALIEHVLG

SEQ ID NO: 1287920 - protein, 17 aa, Mycobacterium
MPNRVNWTIVHYKPPQA

SEQ ID NO: 1287921 - protein, 17 aa, Mycobacterium
MPPQILHMILPRSDYEI

SEQ ID NO: 1287922 - protein, 20 aa, Mycobacterium
MPSQRGWRHVLYLLTRINLG

SEQ ID NO: 1287923 - protein, 24 aa, Mycobacterium
MQPGHWSGAYICWGTENREAAVRF

SEQ ID NO: 1287924 - protein, 18 aa, Mycobacterium
MRGGKFLNNWRMAELHAK

SEQ ID NO: 1287925 - protein, 17 aa, Mycobacterium
MRISHCRPPGADRDIVL

SEQ ID NO: 1287926 - protein, 17 aa, Mycobacterium
MRMTWWPLGVLVFLEVS

SEQ ID NO: 1287927 - protein, 17 aa, Mycobacterium
MRTVMCILNGQLRPVLV

SEQ ID NO: 1287928 - protein, 19 aa, Mycobacterium
MSEVLPLLYLHGLSTSDFT

SEQ ID NO: 1287929 - protein, 22 aa, Mycobacterium
MSTPEMFGRVAIAQTMRDVSPD

SEQ ID NO: 1287930 - protein, 19 aa, Mycobacterium
MTEVLPLLYLHGLSTSDFG

SEQ ID NO: 1287931 - protein, 21 aa, Mycobacterium
MTGPEIARWTAAMVASGQRFD

SEQ ID NO: 1287932 - protein, 26 aa, Mycobacterium
MTISVSFHEPVRWDGWLLYSHESTQV

SEQ ID NO: 1287933 - protein, 23 aa, Mycobacterium
MTLTCPFHGWTFRNDGTLLKVKD

SEQ ID NO: 1287934 - protein, 18 aa, Mycobacterium
MTVQWAFDRHSFGRPLAS

SEQ ID NO: 1287935 - protein, 21 aa, Mycobacterium
MYCPRLTQRFTRCSDRLGFPV

SEQ ID NO: 1287936 - protein, 18 aa, Mycobacterium
MYELEFPAPQLSAADGRG

SEQ ID NO: 1287937 - protein, 19 aa, Mycobacterium
NAGPFGMGGAQSFFDQQTV

SEQ ID NO: 1287938 - protein, 20 aa, Mycobacterium
NARTVFWNGPMGVFEFPAFA

SEQ ID NO: 1287939 - protein, 17 aa, Mycobacterium
NAVIFCGHFPDGAEKFT

SEQ ID NO: 1287940 - protein, 21 aa, Mycobacterium
NCLVNACAHRGAMVCRRKTDN

SEQ ID NO: 1287941 - protein, 19 aa, Mycobacterium
NCSGRIPFDTALISEVLAE

SEQ ID NO: 1287942 - protein, 19 aa, Mycobacterium
NELGHPWTVLRADRSTDFL

SEQ ID NO: 1287943 - protein, 21 aa, Mycobacterium
NFPMTIAAWGFAPALAAGNAV

SEQ ID NO: 1287944 - protein, 24 aa, Mycobacterium
NFVFGEVWLRPGLGMRERRLITVT

SEQ ID NO: 1287945 - protein, 17 aa, Mycobacterium
NGIKIFGPGGHKLDDAT

SEQ ID NO: 1287946 - protein, 21 aa, Mycobacterium
NGRLRPGVGRICMDQFVVDLG

SEQ ID NO: 1287947 - protein, 21 aa, Mycobacterium
NGRPRIAGVSSFGFAGTNAHV

SEQ ID NO: 1287948 - protein, 21 aa, Mycobacterium
NGVDWIVWWLAVSRIGALAVP

SEQ ID NO: 1287949 - protein, 18 aa, Mycobacterium
NGVFEFYTGVLGFRSRGA

SEQ ID NO: 1287950 - protein, 17 aa, Mycobacterium
NHARWAVFLRHLKFIVV

SEQ ID NO: 1287951 - protein, 19 aa, Mycobacterium
NHISFGFGVHRCMGNRLAE

SEQ ID NO: 1287952 - protein, 17 aa, Mycobacterium
NHLKAATVRLVLVGGGP

SEQ ID NO: 1287953 - protein, 17 aa, Mycobacterium
NIPAWLIFDQQYRDRYI

SEQ ID NO: 1287954 - protein, 19 aa, Mycobacterium
NISHEFRTPLTLILGPLAE

SEQ ID NO: 1287955 - protein, 17 aa, Mycobacterium
NITAYWKGYSEYHRDGL

SEQ ID NO: 1287956 - protein, 20 aa, Mycobacterium
NLDGVFGVLANVVWTNFGPC

SEQ ID NO: 1287957 - protein, 19 aa, Mycobacterium
NLENLDWLGVKARAHDAVV

SEQ ID NO: 1287958 - protein, 17 aa, Mycobacterium
NLFSVSGPYGYVGSSYF

SEQ ID NO: 1287959 - protein, 17 aa, Mycobacterium
NLHGWPFLLEARKNNGA

SEQ ID NO: 1287960 - protein, 24 aa, Mycobacterium
NLMLRAPFRLSRDVIPHMQPGSAI

SEQ ID NO: 1287961 - protein, 18 aa, Mycobacterium
NNIPVFFIQDGIKFPDVV

SEQ ID NO: 1287962 - protein, 19 aa, Mycobacterium
NPEAWRWYRNVFGDNNIPV

SEQ ID NO: 1287963 - protein, 21 aa, Mycobacterium
NPKNPRPVMLWGYQPLADNGQ

SEQ ID NO: 1287964 - protein, 18 aa, Mycobacterium
NQAVDCLLYSAADTAIRY

SEQ ID NO: 1287965 - protein, 23 aa, Mycobacterium
NQIWQCPVVLLADVRSVGVQGDG

SEQ ID NO: 1287966 - protein, 23 aa, Mycobacterium
NRAKLSEMPALWGYARDLFQTPG

SEQ ID NO: 1287967 - protein, 18 aa, Mycobacterium
NRDEMRWARADEFDVFRD

SEQ ID NO: 1287968 - protein, 19 aa, Mycobacterium
NREDLAFLPGQYVNVAVPG

SEQ ID NO: 1287969 - protein, 17 aa, Mycobacterium
NRTDYRPLEGFVYAITP

SEQ ID NO: 1287970 - protein, 19 aa, Mycobacterium
NRTPIEWDGYTPPVPAQGV

SEQ ID NO: 1287971 - protein, 17 aa, Mycobacterium
NRYGLVPGRADERIEAV

SEQ ID NO: 1287972 - protein, 18 aa, Mycobacterium
NSALPLAAMMACVMSGQS

SEQ ID NO: 1287973 - protein, 19 aa, Mycobacterium
NSLVIPPAWKKVWICPYPN

SEQ ID NO: 1287974 - protein, 17 aa, Mycobacterium
NTISFAGAEAFRDAEDG

SEQ ID NO: 1287975 - protein, 18 aa, Mycobacterium
NTYWDWVIDRIYLVLYGS

SEQ ID NO: 1287976 - protein, 19 aa, Mycobacterium
NVMPPRGVGVIELRGECVT

SEQ ID NO: 1287977 - protein, 18 aa, Mycobacterium
NVVVPGWIATAAQLPSEV

SEQ ID NO: 1287978 - protein, 17 aa, Mycobacterium
NVWDWAAGALVAAEAGA

SEQ ID NO: 1287979 - protein, 23 aa, Mycobacterium
NVYYRRALVLAAAFGRRADYPQH

SEQ ID NO: 1287980 - protein, 19 aa, Mycobacterium
NWFAAYAYWYFKLYGHENV

SEQ ID NO: 1287981 - protein, 19 aa, Mycobacterium
NWYSEFARLAPLMEKDVHY

SEQ ID NO: 1287982 - protein, 18 aa, Mycobacterium
PAADISIADVLRCIDGPL

SEQ ID NO: 1287983 - protein, 20 aa, Mycobacterium
PAAIRLLAALAFDLIILETV

SEQ ID NO: 1287984 - protein, 20 aa, Mycobacterium
PAAVCPHVEWALSSTLSARA

SEQ ID NO: 1287985 - protein, 20 aa, Mycobacterium
PACRSYDCVTVFARDLDTAD

SEQ ID NO: 1287986 - protein, 20 aa, Mycobacterium
PAENGVVMKTRWEGHTTDGV

SEQ ID NO: 1287987 - protein, 17 aa, Mycobacterium
PAERLPLLMPFEQAGVP

SEQ ID NO: 1287988 - protein, 20 aa, Mycobacterium
PAEVQRFASFFLTMDPPEHT

SEQ ID NO: 1287989 - protein, 20 aa, Mycobacterium
PAGEMQLDFWSRFGSRAQQK

SEQ ID NO: 1287990 - protein, 19 aa, Mycobacterium
PAGLRVIALRARLGEERHA

SEQ ID NO: 1287991 - protein, 17 aa, Mycobacterium
PAIPDRVDVVWLDHEGG

SEQ ID NO: 1287992 - protein, 20 aa, Mycobacterium
PAISAFNAWTLLKGLETLAV

SEQ ID NO: 1287993 - protein, 24 aa, Mycobacterium
PALTRPSLGIAEWIVPSLISAAGQ

SEQ ID NO: 1287994 - protein, 17 aa, Mycobacterium
PAPEVVRLLTAVTAGLP

SEQ ID NO: 1287995 - protein, 18 aa, Mycobacterium
PAPLCPRSLLARVEQRAA

SEQ ID NO: 1287996 - protein, 21 aa, Mycobacterium
PAPLHVVRLLAMLPLAPLVPF

SEQ ID NO: 1287997 - protein, 21 aa, Mycobacterium
PASARGSLRLSLGHTSTDADV

SEQ ID NO: 1287998 - protein, 19 aa, Mycobacterium
PAYTAVRWKAILQAMSQYQ

SEQ ID NO: 1287999 - protein, 18 aa, Mycobacterium
PCFAELYEDLGITKADIG

SEQ ID NO: 1288000 - protein, 19 aa, Mycobacterium
PCLECKLCVAACPVGAIGK

SEQ ID NO: 1288001 - protein, 18 aa, Mycobacterium
PCLPCGVHMYLGGGKSLE

SEQ ID NO: 1288002 - protein, 24 aa, Mycobacterium
PDAFPLIITHGWPGSVVEFDKVIE

SEQ ID NO: 1288003 - protein, 17 aa, Mycobacterium
PDARISVSPLGFVAEGR

SEQ ID NO: 1288004 - protein, 24 aa, Mycobacterium
PDFVKLAEALGCVGLRCEREEDVV

SEQ ID NO: 1288005 - protein, 20 aa, Mycobacterium
PDGKRCAVAFTFDVDAESPL

SEQ ID NO: 1288006 - protein, 25 aa, Mycobacterium
PDGLSCLRFRLRWRDFRLTVHARHD

SEQ ID NO: 1288007 - protein, 17 aa, Mycobacterium
PDGPGWWWQTWHLYPGG

SEQ ID NO: 1288008 - protein, 22 aa, Mycobacterium
PDIDIRFGIGWGQVTVLDTETG

SEQ ID NO: 1288009 - protein, 18 aa, Mycobacterium
PDLEVCVYAAPTQTVIGG

SEQ ID NO: 1288010 - protein, 20 aa, Mycobacterium
PDLRLWNFYGQTEMAPLASA

SEQ ID NO: 1288011 - protein, 19 aa, Mycobacterium
PDLTLPYGVNVLWDGRASI

SEQ ID NO: 1288012 - protein, 24 aa, Mycobacterium
PDLVWDFRLPRVVSINVSGHKYGL

SEQ ID NO: 1288013 - protein, 23 aa, Mycobacterium
PDMKLPIALALGWPDRIPGAALA

SEQ ID NO: 1288014 - protein, 25 aa, Mycobacterium
PDRSVTLALRWLVSFSKARREKTMV

SEQ ID NO: 1288015 - protein, 17 aa, Mycobacterium
PDSWARLIAEHSVTVLH

SEQ ID NO: 1288016 - protein, 24 aa, Mycobacterium
PDVAGPYSWWSWRGRAFDNDAGWR

SEQ ID NO: 1288017 - protein, 23 aa, Mycobacterium
PDWDELRARFDLVSRKVPMLRQR

SEQ ID NO: 1288018 - protein, 19 aa, Mycobacterium
PDWLRWNYATVVWGIATAH

SEQ ID NO: 1288019 - protein, 23 aa, Mycobacterium
PDWTRYSGALALRIGPVAVTGFA

SEQ ID NO: 1288020 - protein, 20 aa, Mycobacterium
PDYLGWDWKSKAGIPIVCVP

SEQ ID NO: 1288021 - protein, 21 aa, Mycobacterium
PEAIKLAPLVPALRAQGMTPV

SEQ ID NO: 1288022 - protein, 17 aa, Mycobacterium
PEAMGAVAVAFRANAQL

SEQ ID NO: 1288023 - protein, 20 aa, Mycobacterium
PEFIGRLPVVASVTNLDKES

SEQ ID NO: 1288024 - protein, 19 aa, Mycobacterium
PEGFGRIAATTARQVILQR

SEQ ID NO: 1288025 - protein, 17 aa, Mycobacterium
PEIKGCWILARYDDGRP

SEQ ID NO: 1288026 - protein, 17 aa, Mycobacterium
PELDQLVGFFINILVLR

SEQ ID NO: 1288027 - protein, 20 aa, Mycobacterium
PELMPLPIALAHRLARRLTE

SEQ ID NO: 1288028 - protein, 17 aa, Mycobacterium
PELRRPITELGMVKNVT

SEQ ID NO: 1288029 - protein, 21 aa, Mycobacterium
PENTIACSRWGMLAPDGQCKT

SEQ ID NO: 1288030 - protein, 23 aa, Mycobacterium
PERLRSGWLNGIKHWQVDYTGSA

SEQ ID NO: 1288031 - protein, 24 aa, Mycobacterium
PESECWRLLDSVALGRLVTCAGGQ

SEQ ID NO: 1288032 - protein, 22 aa, Mycobacterium
PETSVALGFGFRCGFLGLLHME

SEQ ID NO: 1288033 - protein, 21 aa, Mycobacterium
PEVRVPWNLPPKRRTREPESK

SEQ ID NO: 1288034 - protein, 17 aa, Mycobacterium
PEWCAGLLSATRRSSEF

SEQ ID NO: 1288035 - protein, 23 aa, Mycobacterium
PEYRRYLGRHLPYYANWHRLKSY

SEQ ID NO: 1288036 - protein, 24 aa, Mycobacterium
PFEALTIDCPEEFVGAITQLMAAR

SEQ ID NO: 1288037 - protein, 19 aa, Mycobacterium
PFFPFLVDLLDAWVAYFAE

SEQ ID NO: 1288038 - protein, 17 aa, Mycobacterium
PFHSRWRHFEAGNVNRA

SEQ ID NO: 1288039 - protein, 22 aa, Mycobacterium
PFILRGAALLGIDSVLLPIGPR

SEQ ID NO: 1288040 - protein, 24 aa, Mycobacterium
PFNFPAMVPMWFFPVAIATGNTVV

SEQ ID NO: 1288041 - protein, 23 aa, Mycobacterium
PFPEPVLMWWNFVGRSHEEIAAF

SEQ ID NO: 1288042 - protein, 19 aa, Mycobacterium
PFSALAFKIAVHPFFGKLT

SEQ ID NO: 1288043 - protein, 21 aa, Mycobacterium
PGLGRYGVWTGGAPKPEQAAQ

SEQ ID NO: 1288044 - protein, 19 aa, Mycobacterium
PGLSYQLAEGIALLSKVDW

SEQ ID NO: 1288045 - protein, 20 aa, Mycobacterium
PGLVLSGFVDRVGDPVPLVA

SEQ ID NO: 1288046 - protein, 19 aa, Mycobacterium
PGMVLTVRFDQTGDEETFL

SEQ ID NO: 1288047 - protein, 22 aa, Mycobacterium
PGRLVPNFLRRAIAYMEDNATA

SEQ ID NO: 1288048 - protein, 17 aa, Mycobacterium
PGSAAARAAERASGEAA

SEQ ID NO: 1288049 - protein, 21 aa, Mycobacterium
PGVAWPDQWSRAYFTPVTLIG

SEQ ID NO: 1288050 - protein, 26 aa, Mycobacterium
PGVLARVASLFSRRGFNIQSLAVGAT

SEQ ID NO: 1288051 - protein, 21 aa, Mycobacterium
PHFNLSIGVGDAFMRAVESGG

SEQ ID NO: 1288052 - protein, 18 aa, Mycobacterium
PHGKQLWCSMSHDHGDER

SEQ ID NO: 1288053 - protein, 18 aa, Mycobacterium
PHLATSFWFALGDRDEAR

SEQ ID NO: 1288054 - protein, 18 aa, Mycobacterium
PHVWAIGDVASWLDTIGN

SEQ ID NO: 1288055 - protein, 17 aa, Mycobacterium
PIAARLAGMPSVNLQLL

SEQ ID NO: 1288056 - protein, 17 aa, Mycobacterium
PIEWRYTNDPAWVMRDK

SEQ ID NO: 1288057 - protein, 18 aa, Mycobacterium
PIIFRFSQWKGLDYTASI

SEQ ID NO: 1288058 - protein, 18 aa, Mycobacterium
PIRIETRLTPGRTQLKVR

SEQ ID NO: 1288059 - protein, 19 aa, Mycobacterium
PIWCFPKFDVPLPRALRGA

SEQ ID NO: 1288060 - protein, 24 aa, Mycobacterium
PIWEWDGTDLFGWIATVPSPVKRA

SEQ ID NO: 1288061 - protein, 18 aa, Mycobacterium
PKGVLWRQHDIFLSSMGG

SEQ ID NO: 1288062 - protein, 18 aa, Mycobacterium
PKGVLWRQHDIFMTAFGG

SEQ ID NO: 1288063 - protein, 19 aa, Mycobacterium
PKIVKFSGCYHGHSDALLA

SEQ ID NO: 1288064 - protein, 19 aa, Mycobacterium
PKLDLGWMVQSWPDDTDAP

SEQ ID NO: 1288065 - protein, 19 aa, Mycobacterium
PKLLEMNGWTEGRSGVPFI

SEQ ID NO: 1288066 - protein, 19 aa, Mycobacterium
PKPLGMPLQYMVSGMAVAA

SEQ ID NO: 1288067 - protein, 19 aa, Mycobacterium
PKVVICLVNGWAAGGGHSL

SEQ ID NO: 1288068 - protein, 23 aa, Mycobacterium
PKYTPEWVKTVAIWAESSHREVR

SEQ ID NO: 1288069 - protein, 19 aa, Mycobacterium
PLAGLRLGLMHGRLSGDEK

SEQ ID NO: 1288070 - protein, 22 aa, Mycobacterium
PLARACLLGCGVTTGWGSAVNT

SEQ ID NO: 1288071 - protein, 19 aa, Mycobacterium
PLDMFGEWNRAYGSNGFLQ

SEQ ID NO: 1288072 - protein, 22 aa, Mycobacterium
PLGGCYRIAVLSLKGGVGKTTI

SEQ ID NO: 1288073 - protein, 23 aa, Mycobacterium
PLIEALGLTVGWITAESTAEERR

SEQ ID NO: 1288074 - protein, 20 aa, Mycobacterium
PLKLCWVPGYSDYYPETPGG

SEQ ID NO: 1288075 - protein, 18 aa, Mycobacterium
PLLDLGWMLICWPHDPNP

SEQ ID NO: 1288076 - protein, 26 aa, Mycobacterium
PLLRPGDEVYVCWSPDASLVLPAADI

SEQ ID NO: 1288077 - protein, 24 aa, Mycobacterium
PLLRRPDLLVSMLTYWQRHPALSY

SEQ ID NO: 1288078 - protein, 20 aa, Mycobacterium
PLLRRSGVIFIRRNVAGDPL

SEQ ID NO: 1288079 - protein, 21 aa, Mycobacterium
PLPEGAGFEFVDKVVGGAVPR

SEQ ID NO: 1288080 - protein, 19 aa, Mycobacterium
PLPYAGNSWVVWDRVGTAP

SEQ ID NO: 1288081 - protein, 25 aa, Mycobacterium
PLRYRLIDIPFRFHHPMWLENCDVD

SEQ ID NO: 1288082 - protein, 17 aa, Mycobacterium
PLSPGWRTEYPRFLAEL

SEQ ID NO: 1288083 - protein, 18 aa, Mycobacterium
PLSRGFERFYGFMGGETD

SEQ ID NO: 1288084 - protein, 18 aa, Mycobacterium
PLTRLRVDGGLTRSTVLM

SEQ ID NO: 1288085 - protein, 17 aa, Mycobacterium
PLWKAPGAMVFPHDSHA

SEQ ID NO: 1288086 - protein, 24 aa, Mycobacterium
PLYNFLLTVLFEWGVALHDTDVEA

SEQ ID NO: 1288087 - protein, 26 aa, Mycobacterium
PMWDLSWRTPALLAERGFLYDSSLMD

SEQ ID NO: 1288088 - protein, 17 aa, Mycobacterium
PNFWAWLIGEIKNEDPD

SEQ ID NO: 1288089 - protein, 20 aa, Mycobacterium
PNGHLCLWTWAANPEDRPLW

SEQ ID NO: 1288090 - protein, 20 aa, Mycobacterium
PNHYLAVAIDYLFTHRPDWP

SEQ ID NO: 1288091 - protein, 21 aa, Mycobacterium
PNKNIRLVIEWLDRYAEALPL

SEQ ID NO: 1288092 - protein, 18 aa, Mycobacterium
PNNLLAMLWTWQNGNVGA

SEQ ID NO: 1288093 - protein, 18 aa, Mycobacterium
PNSFFFAAPLEWQERLWP

SEQ ID NO: 1288094 - protein, 17 aa, Mycobacterium
PPAEIALAWSRDRARAM

SEQ ID NO: 1288095 - protein, 18 aa, Mycobacterium
PPLPGALLIAGEGRVVEP

SEQ ID NO: 1288096 - protein, 18 aa, Mycobacterium
PPPAGWRLLDTAVEQAQI

SEQ ID NO: 1288097 - protein, 17 aa, Mycobacterium
PPPRVFGPLSIDVAARE

SEQ ID NO: 1288098 - protein, 18 aa, Mycobacterium
PPRSDWAVHIALWQRTGG

SEQ ID NO: 1288099 - protein, 17 aa, Mycobacterium
PQQRLLLEVAWEALEHA

SEQ ID NO: 1288100 - protein, 23 aa, Mycobacterium
PQQRVALRLAWRALENSGINPDD

SEQ ID NO: 1288101 - protein, 20 aa, Mycobacterium
PRARGVVVGLTLRHGRGHLF

SEQ ID NO: 1288102 - protein, 19 aa, Mycobacterium
PRFLMCTPLSHAGAAFFTP

SEQ ID NO: 1288103 - protein, 18 aa, Mycobacterium
PRGMAYLVVTGRRGGSAM

SEQ ID NO: 1288104 - protein, 17 aa, Mycobacterium
PRHAWFPIDRSMVLYYC

SEQ ID NO: 1288105 - protein, 17 aa, Mycobacterium
PRIGCTLPEVFDHARPG

SEQ ID NO: 1288106 - protein, 17 aa, Mycobacterium
PRKGLFLIHTDAVDSVL

SEQ ID NO: 1288107 - protein, 19 aa, Mycobacterium
PRKVFAHGWLLNRGEKMSK

SEQ ID NO: 1288108 - protein, 22 aa, Mycobacterium
PRLRECTRLVLAIEGRSIGEAF

SEQ ID NO: 1288109 - protein, 24 aa, Mycobacterium
PRLSLLRLGARLGFTMIALDRPGY

SEQ ID NO: 1288110 - protein, 17 aa, Mycobacterium
PRPAFSTATFAAGVEKV

SEQ ID NO: 1288111 - protein, 19 aa, Mycobacterium
PRRYAGWSSCFRREAGSYG

SEQ ID NO: 1288112 - protein, 19 aa, Mycobacterium
PRSVVPIAWDTIRTLAEHP

SEQ ID NO: 1288113 - protein, 21 aa, Mycobacterium
PRWLPPGRWWALIRVAAAGRL

SEQ ID NO: 1288114 - protein, 17 aa, Mycobacterium
PRYVALVQDCLAMTDPA

SEQ ID NO: 1288115 - protein, 19 aa, Mycobacterium
PSGGLACFGEAIPAQAIAQ

SEQ ID NO: 1288116 - protein, 18 aa, Mycobacterium
PSSIWYRIRINLRHVPEE

SEQ ID NO: 1288117 - protein, 18 aa, Mycobacterium
PTAQRILAHFGLDGFFEV

SEQ ID NO: 1288118 - protein, 21 aa, Mycobacterium
PTFTGRSWPLADVRLLAPILA

SEQ ID NO: 1288119 - protein, 27 aa, Mycobacterium
PTKGVWTSGFGYRWGVLHGGIDIAGPI

SEQ ID NO: 1288120 - protein, 19 aa, Mycobacterium
PTLMGRLLLEAGVTPWITL

SEQ ID NO: 1288121 - protein, 20 aa, Mycobacterium
PTRPEVLFVWQVAVTSAARG

SEQ ID NO: 1288122 - protein, 18 aa, Mycobacterium
PTRRLCNLASVTSFYFHG

SEQ ID NO: 1288123 - protein, 20 aa, Mycobacterium
PTSVPAFRPGAQFKAIVSGA

SEQ ID NO: 1288124 - protein, 17 aa, Mycobacterium
PTVRELAGQMGLAVNTV

SEQ ID NO: 1288125 - protein, 24 aa, Mycobacterium
PTWSGSLKSLWLGDGEAIGDVLVG

SEQ ID NO: 1288126 - protein, 19 aa, Mycobacterium
PVGACATAAVSVEEGVDKI

SEQ ID NO: 1288127 - protein, 19 aa, Mycobacterium
PVHSIRLAGLVAHQEVLFG

SEQ ID NO: 1288128 - protein, 23 aa, Mycobacterium
PVIGSKELIAWLPTLLGAGSDDL

SEQ ID NO: 1288129 - protein, 19 aa, Mycobacterium
PVIRLKLGPKWMIPEIVVV

SEQ ID NO: 1288130 - protein, 22 aa, Mycobacterium
PVLPLRFGAVMTDAESVAEELL

SEQ ID NO: 1288131 - protein, 22 aa, Mycobacterium
PVPELRSGGLGVRDLKRLVKAT

SEQ ID NO: 1288132 - protein, 18 aa, Mycobacterium
PVPMAYYSFGGWKNSLFG

SEQ ID NO: 1288133 - protein, 21 aa, Mycobacterium
PVSEWPDLLILLGDQVYADEL

SEQ ID NO: 1288134 - protein, 20 aa, Mycobacterium
PVSVDTFAGFLFLNPDPDAE

SEQ ID NO: 1288135 - protein, 19 aa, Mycobacterium
PWLRRNRIQQEWGISDEVM

SEQ ID NO: 1288136 - protein, 23 aa, Mycobacterium
PYENEWGWTWPMNRRVLYNRASA

SEQ ID NO: 1288137 - protein, 17 aa, Mycobacterium
QAACARHRVEWFWVKGH

SEQ ID NO: 1288138 - protein, 20 aa, Mycobacterium
QAARFFYRYELPKVGPQLDL

SEQ ID NO: 1288139 - protein, 23 aa, Mycobacterium
QAARPVLFSTFLMWVLADLFTTL

SEQ ID NO: 1288140 - protein, 24 aa, Mycobacterium
QAVRIIRMFVEFWDRTRLAEQEAI

SEQ ID NO: 1288141 - protein, 23 aa, Mycobacterium
QCAPFCAVQAWPALARQRLSATA

SEQ ID NO: 1288142 - protein, 18 aa, Mycobacterium
QCGSCFNGTAAMAAVAVA

SEQ ID NO: 1288143 - protein, 20 aa, Mycobacterium
QCPCGGLIRPNVVWFGEALP

SEQ ID NO: 1288144 - protein, 22 aa, Mycobacterium
QCTRLAQRSALAVSRIGGSGEQ

SEQ ID NO: 1288145 - protein, 18 aa, Mycobacterium
QDARLVAVTVAWLSGELP

SEQ ID NO: 1288146 - protein, 19 aa, Mycobacterium
QEGGRFACGGGRPADRDTG

SEQ ID NO: 1288147 - protein, 17 aa, Mycobacterium
QELRRCYSMSSAPVEEE

SEQ ID NO: 1288148 - protein, 23 aa, Mycobacterium
QEVRWCPGCGDYVILNTIRNFLP

SEQ ID NO: 1288149 - protein, 17 aa, Mycobacterium
QFTCKYHGWRYGLDGAL

SEQ ID NO: 1288150 - protein, 21 aa, Mycobacterium
QGCALTSRLLVPARHKDEIVE

SEQ ID NO: 1288151 - protein, 24 aa, Mycobacterium
QGKLLASRLLHWARSGHLTVPRST

SEQ ID NO: 1288152 - protein, 21 aa, Mycobacterium
QGLKISVPEEVAWRVGFIDDE

SEQ ID NO: 1288153 - protein, 30 aa, Mycobacterium
QGRCISGGLMLCWPCDLILAADDALFSDPV

SEQ ID NO: 1288154 - protein, 25 aa, Mycobacterium
QGVLCGSLLSGLRMQPGHWSGAYIC

SEQ ID NO: 1288155 - protein, 20 aa, Mycobacterium
QGWFCCWNGANQLHVSTGVI

SEQ ID NO: 1288156 - protein, 18 aa, Mycobacterium
QKGFCAVAAEADWPDAYR

SEQ ID NO: 1288157 - protein, 20 aa, Mycobacterium
QLAEGIALLSKVDWRARGLA

SEQ ID NO: 1288158 - protein, 24 aa, Mycobacterium
QLARARTGVFWVREMLPIGKIREI

SEQ ID NO: 1288159 - protein, 24 aa, Mycobacterium
QLQWFADPDMMAWVDGARLNILHH

SEQ ID NO: 1288160 - protein, 17 aa, Mycobacterium
QLREWKAEYPGAVVVSY

SEQ ID NO: 1288161 - protein, 18 aa, Mycobacterium
QLRGELLRLIGLVETLIR

SEQ ID NO: 1288162 - protein, 18 aa, Mycobacterium
QLTPHFRPGCKRMLMTSD

SEQ ID NO: 1288163 - protein, 21 aa, Mycobacterium
QLWMCGLPGYGPGDLIDFEFS

SEQ ID NO: 1288164 - protein, 20 aa, Mycobacterium
QMSECYRVSLTYADAATAGP

SEQ ID NO: 1288165 - protein, 17 aa, Mycobacterium
QPLRPAILYGIDTRATA

SEQ ID NO: 1288166 - protein, 20 aa, Mycobacterium
QQMLDWWGPVIYEYYGGTEA

SEQ ID NO: 1288167 - protein, 23 aa, Mycobacterium
QRAGKWPQIWRIAGEYSNFSVFD

SEQ ID NO: 1288168 - protein, 18 aa, Mycobacterium
QRALRPGGVFLMVDIKAS

SEQ ID NO: 1288169 - protein, 19 aa, Mycobacterium
QRASNFLLWQSAYAEYVFQ

SEQ ID NO: 1288170 - protein, 19 aa, Mycobacterium
QRCGATWGVGLTGVAGPEP

SEQ ID NO: 1288171 - protein, 18 aa, Mycobacterium
QRIFARLGVHYVIVSAVS

SEQ ID NO: 1288172 - protein, 20 aa, Mycobacterium
QRLGIRCFGFIPLRLPPELD

SEQ ID NO: 1288173 - protein, 17 aa, Mycobacterium
QRLPFLPIRAGLGSDVR

SEQ ID NO: 1288174 - protein, 17 aa, Mycobacterium
QRPNPFPTMSIRDNVVA

SEQ ID NO: 1288175 - protein, 18 aa, Mycobacterium
QRWGYKFRFGVFRIDDHD

SEQ ID NO: 1288176 - protein, 18 aa, Mycobacterium
QRYWGEPFPIVYDSDGRP

SEQ ID NO: 1288177 - protein, 28 aa, Mycobacterium
QSFEWPRLEGAFNWATDWFDVIARDPIT

SEQ ID NO: 1288178 - protein, 26 aa, Mycobacterium
QSGGKRLRPRFAYWAWRVGAPADAAP

SEQ ID NO: 1288179 - protein, 22 aa, Mycobacterium
QSLRARFGTLTGVDRPAKDGDF

SEQ ID NO: 1288180 - protein, 17 aa, Mycobacterium
QSNFVWLPLAERTLDFV

SEQ ID NO: 1288181 - protein, 18 aa, Mycobacterium
QSQVVAWWAPSWDEPNGG

SEQ ID NO: 1288182 - protein, 18 aa, Mycobacterium
QTARARAVLAGRGHVLPE

SEQ ID NO: 1288183 - protein, 20 aa, Mycobacterium
QTEVRPILLWHAFEESEHKA

SEQ ID NO: 1288184 - protein, 25 aa, Mycobacterium
QTVFGGSVGEMFGRKVSRLMEWVAM

SEQ ID NO: 1288185 - protein, 27 aa, Mycobacterium
QVSGRGKYRLGFAIARLARASSGHLDL

SEQ ID NO: 1288186 - protein, 19 aa, Mycobacterium
QWLPGPRELRAWTLASGTR

SEQ ID NO: 1288187 - protein, 23 aa, Mycobacterium
QWVTECLRAAYPLGHGHGPVSAL

SEQ ID NO: 1288188 - protein, 17 aa, Mycobacterium
QYSQWGALLARTDPNAP

SEQ ID NO: 1288189 - protein, 19 aa, Mycobacterium
RAAADLGWHGLAVAEQFGG

SEQ ID NO: 1288190 - protein, 20 aa, Mycobacterium
RAAASFDLLHVFALLQDDVM

SEQ ID NO: 1288191 - protein, 21 aa, Mycobacterium
RAAGLKAANTWHASRAIQESR

SEQ ID NO: 1288192 - protein, 17 aa, Mycobacterium
RAALVIMPRFDLTEFLA

SEQ ID NO: 1288193 - protein, 19 aa, Mycobacterium
RAAMRAELKQLGAMSNTTT

SEQ ID NO: 1288194 - protein, 20 aa, Mycobacterium
RAAWYRNRWVRTESFEQHFP

SEQ ID NO: 1288195 - protein, 21 aa, Mycobacterium
RADELHLGFNFRLVRADFDAD

SEQ ID NO: 1288196 - protein, 22 aa, Mycobacterium
RAEGRYALMPGIIAALRDSGTP

SEQ ID NO: 1288197 - protein, 19 aa, Mycobacterium
RAESKWFASQGFSLVNMTG

SEQ ID NO: 1288198 - protein, 22 aa, Mycobacterium
RAEVLRPGLLVMAVRGAARYFG

SEQ ID NO: 1288199 - protein, 18 aa, Mycobacterium
RAEVVAVSGGVTWVDDSK

SEQ ID NO: 1288200 - protein, 19 aa, Mycobacterium
RAGLPRGVAVAGGYLDGIG

SEQ ID NO: 1288201 - protein, 19 aa, Mycobacterium
RALAGFGGLGVRLSSKDTM

SEQ ID NO: 1288202 - protein, 20 aa, Mycobacterium
RALDDFAVWCALAEKYGNDW

SEQ ID NO: 1288203 - protein, 18 aa, Mycobacterium
RALIAVRGLHRFATAEGL

SEQ ID NO: 1288204 - protein, 19 aa, Mycobacterium
RALPIGWAVADDGLRRTVT

SEQ ID NO: 1288205 - protein, 19 aa, Mycobacterium
RALRFPAALGRPLLTDLAR

SEQ ID NO: 1288206 - protein, 17 aa, Mycobacterium
RANLKWTPQPAMPGQLR

SEQ ID NO: 1288207 - protein, 19 aa, Mycobacterium
RAPLAVPIWYGYQPGGEVL

SEQ ID NO: 1288208 - protein, 20 aa, Mycobacterium
RAQGLSNIWCRVMNGQDLDL

SEQ ID NO: 1288209 - protein, 20 aa, Mycobacterium
RAQVALPWSMINAFCDLAQT

SEQ ID NO: 1288210 - protein, 21 aa, Mycobacterium
RARCFPKGLAAFIDLRDQTCR

SEQ ID NO: 1288211 - protein, 21 aa, Mycobacterium
RARPLWECWVIEGLSRHRWAV

SEQ ID NO: 1288212 - protein, 18 aa, Mycobacterium
RARQAWIAATRDIATEML

SEQ ID NO: 1288213 - protein, 17 aa, Mycobacterium
RARSDWAPEFAIHDLSS

SEQ ID NO: 1288214 - protein, 26 aa, Mycobacterium
RAVFTRYELVDGFPRFDVDDVFLGNG

SEQ ID NO: 1288215 - protein, 23 aa, Mycobacterium
RAVILGTGGFEWDRALVEAFLRG

SEQ ID NO: 1288216 - protein, 21 aa, Mycobacterium
RAVNVPARLVSVYAPGCSPMD

SEQ ID NO: 1288217 - protein, 18 aa, Mycobacterium
RAYRLDWPSGTTVYEIDQ

SEQ ID NO: 1288218 - protein, 20 aa, Mycobacterium
RAYRLPWPDGTVVYELDQPR

SEQ ID NO: 1288219 - protein, 24 aa, Mycobacterium
RCAVGVPTPDGWRMLSGDETGWLL

SEQ ID NO: 1288220 - protein, 18 aa, Mycobacterium
RCERDVWLVAAGTLGPIR

SEQ ID NO: 1288221 - protein, 17 aa, Mycobacterium
RCGLCPLGTCTWRSLGY

SEQ ID NO: 1288222 - protein, 19 aa, Mycobacterium
RCLTFPKPVIMAATGPAIA

SEQ ID NO: 1288223 - protein, 20 aa, Mycobacterium
RCMDCGIPFCHSGSAGCPLG

SEQ ID NO: 1288224 - protein, 21 aa, Mycobacterium
RCVSVRWGLWRSDSGEGIVGA

SEQ ID NO: 1288225 - protein, 19 aa, Mycobacterium
RDAEGWIYLAGRTGDWMRV

SEQ ID NO: 1288226 - protein, 17 aa, Mycobacterium
RDFPVHWPVSTRWTDND

SEQ ID NO: 1288227 - protein, 18 aa, Mycobacterium
RDGLAYVLRSDRRYGGSI

SEQ ID NO: 1288228 - protein, 20 aa, Mycobacterium
RDGLRVIGIRSRLMSRLAGQ

SEQ ID NO: 1288229 - protein, 23 aa, Mycobacterium
RDGQPRWTPIIAHLSDGQRVVAR

SEQ ID NO: 1288230 - protein, 17 aa, Mycobacterium
RDGVKFCEVCGNVSDAD

SEQ ID NO: 1288231 - protein, 20 aa, Mycobacterium
RDLDFLLFEWLRVDELTQRP

SEQ ID NO: 1288232 - protein, 25 aa, Mycobacterium
RDLGGKMVRFVVCRKGDRHVVAARD

SEQ ID NO: 1288233 - protein, 17 aa, Mycobacterium
RDLLKFDFYFADSAAFR

SEQ ID NO: 1288234 - protein, 17 aa, Mycobacterium
RDLSGWGRQWLKTTGLN

SEQ ID NO: 1288235 - protein, 19 aa, Mycobacterium
RDLSPLGIRVCTIAPGTIN

SEQ ID NO: 1288236 - protein, 17 aa, Mycobacterium
RDLSREFIRVCTIAPGL

SEQ ID NO: 1288237 - protein, 24 aa, Mycobacterium
RDMVLFIGHPIRWADWGNLEHSVR

SEQ ID NO: 1288238 - protein, 19 aa, Mycobacterium
RDRAFFCAYAMEYLARAGL

SEQ ID NO: 1288239 - protein, 19 aa, Mycobacterium
RDREGCWWHESLSGTTAPA

SEQ ID NO: 1288240 - protein, 17 aa, Mycobacterium
RDVFAIKLDPGLIDELP

SEQ ID NO: 1288241 - protein, 18 aa, Mycobacterium
REALKDLLVMLGAGPAVV

SEQ ID NO: 1288242 - protein, 20 aa, Mycobacterium
REARQMRPLYVMPTKGVWTS

SEQ ID NO: 1288243 - protein, 19 aa, Mycobacterium
REFCARTGIFILAESLGGV

SEQ ID NO: 1288244 - protein, 18 aa, Mycobacterium
REGLLEIGQKLGIPPLAT

SEQ ID NO: 1288245 - protein, 18 aa, Mycobacterium
REGSCDRCAVDLYDVRRP

SEQ ID NO: 1288246 - protein, 18 aa, Mycobacterium
REHFGFGFVMYVNGYCAQ

SEQ ID NO: 1288247 - protein, 21 aa, Mycobacterium
REIVERLGLRDPLMVVGNFDR

SEQ ID NO: 1288248 - protein, 22 aa, Mycobacterium
REIWSGKATFVFTRTTSGEIGI

SEQ ID NO: 1288249 - protein, 20 aa, Mycobacterium
RELCARFGVSPIEFDGRSDA

SEQ ID NO: 1288250 - protein, 18 aa, Mycobacterium
RENLGWSAPRLHLVDLQY

SEQ ID NO: 1288251 - protein, 17 aa, Mycobacterium
RENPAWITGFEHRIETP

SEQ ID NO: 1288252 - protein, 21 aa, Mycobacterium
REPRGVLEIAYRCPNGEPGVV

SEQ ID NO: 1288253 - protein, 18 aa, Mycobacterium
RERMAGFKVPRYVEFLDE

SEQ ID NO: 1288254 - protein, 21 aa, Mycobacterium
RETFRAIGVDLMFDHIKISLH

SEQ ID NO: 1288255 - protein, 20 aa, Mycobacterium
REVAELLLLGMPYRDIGAQL

SEQ ID NO: 1288256 - protein, 19 aa, Mycobacterium
REVFARDGILLAVSQYAQP

SEQ ID NO: 1288257 - protein, 17 aa, Mycobacterium
RFGWPKRNGFVQPMVDA

SEQ ID NO: 1288258 - protein, 21 aa, Mycobacterium
RFIRDTTWVSVRWYQPGGPLT

SEQ ID NO: 1288259 - protein, 19 aa, Mycobacterium
RFLSSEGWIAWSGPAISEL

SEQ ID NO: 1288260 - protein, 25 aa, Mycobacterium
RFNELVLRAGLSWQQVMVLRAYAKY

SEQ ID NO: 1288261 - protein, 18 aa, Mycobacterium
RFPYRNDGALGWVGTSPV

SEQ ID NO: 1288262 - protein, 20 aa, Mycobacterium
RFSSAILPAWARKSPQISEV

SEQ ID NO: 1288263 - protein, 18 aa, Mycobacterium
RGAAFPWRTIRGEECSAY

SEQ ID NO: 1288264 - protein, 21 aa, Mycobacterium
RGAAPDRGWEIHRLPVDAGDE

SEQ ID NO: 1288265 - protein, 18 aa, Mycobacterium
RGALPFRVVASYSVRSAP

SEQ ID NO: 1288266 - protein, 17 aa, Mycobacterium
RGAWYLRQMLGSANFHA

SEQ ID NO: 1288267 - protein, 20 aa, Mycobacterium
RGCLGRPWLFAELSAKFTGR

SEQ ID NO: 1288268 - protein, 23 aa, Mycobacterium
RGCTHPGCTVPFYWAEAHHTDDY

SEQ ID NO: 1288269 - protein, 23 aa, Mycobacterium
RGCTHPGCTVPFYWTEAHHTHDY

SEQ ID NO: 1288270 - protein, 20 aa, Mycobacterium
RGDIKIALFGNHAPKTVSNF

SEQ ID NO: 1288271 - protein, 18 aa, Mycobacterium
RGEVSVPILKLVAAQGEG

SEQ ID NO: 1288272 - protein, 18 aa, Mycobacterium
RGGFPGMLLGSVSSEVVQ

SEQ ID NO: 1288273 - protein, 20 aa, Mycobacterium
RGGKISFTHLIGYAIVAAVK

SEQ ID NO: 1288274 - protein, 18 aa, Mycobacterium
RGGLRWSDRREDFRTEVL

SEQ ID NO: 1288275 - protein, 19 aa, Mycobacterium
RGKLLPRDRVDGLLDAGSP

SEQ ID NO: 1288276 - protein, 18 aa, Mycobacterium
RGMLRLAVISAKVIAGQR

SEQ ID NO: 1288277 - protein, 23 aa, Mycobacterium
RGPARLQIHLSWAASDDEAMAIA

SEQ ID NO: 1288278 - protein, 18 aa, Mycobacterium
RGPMLHRALQQFLADVFW

SEQ ID NO: 1288279 - protein, 18 aa, Mycobacterium
RGRFRWWGLYTQRKPGFD

SEQ ID NO: 1288280 - protein, 18 aa, Mycobacterium
RGRLGLLELRGFEMPPHF

SEQ ID NO: 1288281 - protein, 18 aa, Mycobacterium
RGRTVWFTGLSGSGKSSV

SEQ ID NO: 1288282 - protein, 19 aa, Mycobacterium
RGSAGLVPFSHRLAAEEWR

SEQ ID NO: 1288283 - protein, 20 aa, Mycobacterium
RHDLPFTLTYLFGDDGDAVL

SEQ ID NO: 1288284 - protein, 19 aa, Mycobacterium
RHLFRLAGLAPRLDVAKTP

SEQ ID NO: 1288285 - protein, 19 aa, Mycobacterium
RHLLAQFLFRGDRIHLPVS

SEQ ID NO: 1288286 - protein, 23 aa, Mycobacterium
RHLRCWHPGFGMVLSGDAARPYL

SEQ ID NO: 1288287 - protein, 18 aa, Mycobacterium
RHPLGWKTVGDIGYLDEE

SEQ ID NO: 1288288 - protein, 25 aa, Mycobacterium
RHPRLTRAFLRFNVHLLFRSTLPAR

SEQ ID NO: 1288289 - protein, 19 aa, Mycobacterium
RHWDHRWALAVLNTALGGG

SEQ ID NO: 1288290 - protein, 20 aa, Mycobacterium
RIAILEARFAGFGASGRNGG

SEQ ID NO: 1288291 - protein, 20 aa, Mycobacterium
RIALWALGWLARVQFLTGDW

SEQ ID NO: 1288292 - protein, 21 aa, Mycobacterium
RIERFLQLWAEGSMTIALPST

SEQ ID NO: 1288293 - protein, 17 aa, Mycobacterium
RIFRGCGYFDPDKPIRK

SEQ ID NO: 1288294 - protein, 20 aa, Mycobacterium
RIGSCALDLCMVAAGQLDAY

SEQ ID NO: 1288295 - protein, 21 aa, Mycobacterium
RIKELFKTSGGKYVAPPAIEG

SEQ ID NO: 1288296 - protein, 20 aa, Mycobacterium
RINFRIALWAAHNMGMSDGA

SEQ ID NO: 1288297 - protein, 19 aa, Mycobacterium
RINVMPGFTGGGFYWHSDF

SEQ ID NO: 1288298 - protein, 17 aa, Mycobacterium
RIPDLRLATSLDEIEFK

SEQ ID NO: 1288299 - protein, 25 aa, Mycobacterium
RIREVALMRAVLWRRCDYLWDHHVV

SEQ ID NO: 1288300 - protein, 17 aa, Mycobacterium
RIRGHAVEARLCAEDPA

SEQ ID NO: 1288301 - protein, 17 aa, Mycobacterium
RIRVNAIAPGSILTSAL

SEQ ID NO: 1288302 - protein, 20 aa, Mycobacterium
RITLCCLHFGGEVRELTAHW

SEQ ID NO: 1288303 - protein, 18 aa, Mycobacterium
RIVDLRWLAPLPVEDMLR

SEQ ID NO: 1288304 - protein, 21 aa, Mycobacterium
RKAVFKRAWLNVGRVEQLPRK

SEQ ID NO: 1288305 - protein, 18 aa, Mycobacterium
RKLFPGLYRLAAAGRLPE

SEQ ID NO: 1288306 - protein, 23 aa, Mycobacterium
RKLREIRAALAMDAALPKAEILA

SEQ ID NO: 1288307 - protein, 20 aa, Mycobacterium
RKLVGGTCVNYGCIPTKTLV

SEQ ID NO: 1288308 - protein, 22 aa, Mycobacterium
RKPARVPVWFMRQAGRSLPEYR

SEQ ID NO: 1288309 - protein, 17 aa, Mycobacterium
RKPLRLPYFPPLEATAV

SEQ ID NO: 1288310 - protein, 22 aa, Mycobacterium
RKRPLPEWSERFATLAGPWAPV

SEQ ID NO: 1288311 - protein, 18 aa, Mycobacterium
RKRWFPGLADGTLLTAIA

SEQ ID NO: 1288312 - protein, 19 aa, Mycobacterium
RKSEPVHWVDVPGGTGGFG

SEQ ID NO: 1288313 - protein, 17 aa, Mycobacterium
RLAEDWDSVGLVCGDPD

SEQ ID NO: 1288314 - protein, 23 aa, Mycobacterium
RLALGVGPSHHWIVRDMLGLPYE

SEQ ID NO: 1288315 - protein, 19 aa, Mycobacterium
RLALPNARILIHQPALSGV

SEQ ID NO: 1288316 - protein, 21 aa, Mycobacterium
RLAPGLKRSSLIGGIRYFDTV

SEQ ID NO: 1288317 - protein, 17 aa, Mycobacterium
RLCEPERQILFRVPWVD

SEQ ID NO: 1288318 - protein, 24 aa, Mycobacterium
RLDDARLAFYKTLYRDNARYDAKL

SEQ ID NO: 1288319 - protein, 18 aa, Mycobacterium
RLECLEVTLSEKSRTYPL

SEQ ID NO: 1288320 - protein, 18 aa, Mycobacterium
RLEKLWLPGVDRLLDCVQ

SEQ ID NO: 1288321 - protein, 18 aa, Mycobacterium
RLELRLMLTKVLDRLPDL

SEQ ID NO: 1288322 - protein, 24 aa, Mycobacterium
RLGRRSNIHVVEWAHVQGLTPSGL

SEQ ID NO: 1288323 - protein, 17 aa, Mycobacterium
RLGRWCVPGPVVESVAV

SEQ ID NO: 1288324 - protein, 19 aa, Mycobacterium
RLHERGAELLRCPVSEIMT

SEQ ID NO: 1288325 - protein, 24 aa, Mycobacterium
RLHPEVIAALGIREWDAVSLTGAR

SEQ ID NO: 1288326 - protein, 18 aa, Mycobacterium
RLHWYVPNSIRWLDRLKA

SEQ ID NO: 1288327 - protein, 20 aa, Mycobacterium
RLKSGWLNGIKHWQVDYTGA

SEQ ID NO: 1288328 - protein, 20 aa, Mycobacterium
RLLAEVLRLRGWQVDFLGAQ

SEQ ID NO: 1288329 - protein, 20 aa, Mycobacterium
RLLLEVAWEALEHAGIPAAS

SEQ ID NO: 1288330 - protein, 20 aa, Mycobacterium
RLLMEVSWEALEHAGIPAQN

SEQ ID NO: 1288331 - protein, 19 aa, Mycobacterium
RLLPFRLRFDGGEEVRTDL

SEQ ID NO: 1288332 - protein, 20 aa, Mycobacterium
RLPDALTRFPIARLVSSPQR

SEQ ID NO: 1288333 - protein, 21 aa, Mycobacterium
RLPDLRCLMLTSFTSDEAMID

SEQ ID NO: 1288334 - protein, 23 aa, Mycobacterium
RLPRIPVPFPMYLPGPNRVQIVN

SEQ ID NO: 1288335 - protein, 18 aa, Mycobacterium
RLRLELEQGLGWKADVEA

SEQ ID NO: 1288336 - protein, 18 aa, Mycobacterium
RLRYPRPALVLSLHAAAL

SEQ ID NO: 1288337 - protein, 23 aa, Mycobacterium
RLSKFEVLTAMAFAAFADAPVDV

SEQ ID NO: 1288338 - protein, 20 aa, Mycobacterium
RLTGFKRPRHVLFVDALPLT

SEQ ID NO: 1288339 - protein, 18 aa, Mycobacterium
RLTPGASADLVWLSADPR

SEQ ID NO: 1288340 - protein, 20 aa, Mycobacterium
RLVDWPEWLPPDWFDDRRVE

SEQ ID NO: 1288341 - protein, 20 aa, Mycobacterium
RMAGEFNAPIALEPLPYTVA

SEQ ID NO: 1288342 - protein, 17 aa, Mycobacterium
RMFDLLVRMGYKEIEVG

SEQ ID NO: 1288343 - protein, 28 aa, Mycobacterium
RMIPAPLRWSSRHLLQFLTVGFLAPIFR

SEQ ID NO: 1288344 - protein, 23 aa, Mycobacterium
RNAGIRLGWRSSWVETVLGECLA

SEQ ID NO: 1288345 - protein, 17 aa, Mycobacterium
RPAFPVMCDAGYGRIVL

SEQ ID NO: 1288346 - protein, 21 aa, Mycobacterium
RPAIWDEFTNRFGIDRVCEFY

SEQ ID NO: 1288347 - protein, 18 aa, Mycobacterium
RPAWDLDRWVRDFFGPAA

SEQ ID NO: 1288348 - protein, 18 aa, Mycobacterium
RPDIDWDKGTTLRWIRDR

SEQ ID NO: 1288349 - protein, 17 aa, Mycobacterium
RPDLAILDVRMPPTFTD

SEQ ID NO: 1288350 - protein, 24 aa, Mycobacterium
RPDPFCAMESCWLQHMESAHRDVV

SEQ ID NO: 1288351 - protein, 20 aa, Mycobacterium
RPEHRRLVICDLGMPRDVEP

SEQ ID NO: 1288352 - protein, 21 aa, Mycobacterium
RPETEALFEWVVRQALPDEPL

SEQ ID NO: 1288353 - protein, 19 aa, Mycobacterium
RPLHRPLRALPYVADDLDA

SEQ ID NO: 1288354 - protein, 19 aa, Mycobacterium
RPQGSWSRERAVLAVVDGP

SEQ ID NO: 1288355 - protein, 20 aa, Mycobacterium
RPQMGIAAWLIPSIVAFGTD

SEQ ID NO: 1288356 - protein, 20 aa, Mycobacterium
RPRGEGQWALGYREPLNANE

SEQ ID NO: 1288357 - protein, 20 aa, Mycobacterium
RPRISALIEVDRVHGWGAQK

SEQ ID NO: 1288358 - protein, 18 aa, Mycobacterium
RPRRAGVSSFGFTGTNAH

SEQ ID NO: 1288359 - protein, 22 aa, Mycobacterium
RPRSSADLPDWARRWQRLLFDN

SEQ ID NO: 1288360 - protein, 21 aa, Mycobacterium
RPSKVAFLAWHAWRDADSGNW

SEQ ID NO: 1288361 - protein, 40 aa, Mycobacterium
RPTPNPIARFFKFLSDLFWRVVHFFEDLVSRFVDVLFGGG

SEQ ID NO: 1288362 - protein, 23 aa, Mycobacterium
RPVPRVSIFLSIFDAHVQRIPIS

SEQ ID NO: 1288363 - protein, 18 aa, Mycobacterium
RPYPRAVPSPGWSLRIDP

SEQ ID NO: 1288364 - protein, 19 aa, Mycobacterium
RQELPLIEEWFEFVGEKLP

SEQ ID NO: 1288365 - protein, 22 aa, Mycobacterium
RQFSRPRVVVFAGDHGVAGAGV

SEQ ID NO: 1288366 - protein, 19 aa, Mycobacterium
RQFTCKYHAWRYALNGDLT

SEQ ID NO: 1288367 - protein, 17 aa, Mycobacterium
RQWHGMFEWMGRPEEFA

SEQ ID NO: 1288368 - protein, 19 aa, Mycobacterium
RRAKLYYLRELRGKKAKIK

SEQ ID NO: 1288369 - protein, 19 aa, Mycobacterium
RRALAEFKVEGLATVIPFH

SEQ ID NO: 1288370 - protein, 17 aa, Mycobacterium
RRAMGLVLGDWVRTGDC

SEQ ID NO: 1288371 - protein, 19 aa, Mycobacterium
RRDHRVCWLDGGSPDNVDR

SEQ ID NO: 1288372 - protein, 19 aa, Mycobacterium
RRDVWTWADERAAMPIDPE

SEQ ID NO: 1288373 - protein, 25 aa, Mycobacterium
RREMAYEGKVDWAFAELLALGTMIS

SEQ ID NO: 1288374 - protein, 22 aa, Mycobacterium
RRFGEQRLRPHVGEWFEAGEVP

SEQ ID NO: 1288375 - protein, 20 aa, Mycobacterium
RRGQRISGVLAYVAVCDVLR

SEQ ID NO: 1288376 - protein, 24 aa, Mycobacterium
RRGSLPPGRLGWRKAQELRDQAAA

SEQ ID NO: 1288377 - protein, 19 aa, Mycobacterium
RRGVDCFVVDPLPDPPQYA

SEQ ID NO: 1288378 - protein, 17 aa, Mycobacterium
RRIDIACGLVVRPEVVF

SEQ ID NO: 1288379 - protein, 18 aa, Mycobacterium
RRIIPPWVTLGSRLAVIP

SEQ ID NO: 1288380 - protein, 18 aa, Mycobacterium
RRKIGYSIQQAGLFPHMT

SEQ ID NO: 1288381 - protein, 23 aa, Mycobacterium
RRLALDHLPRLAAALAVTTDELL

SEQ ID NO: 1288382 - protein, 20 aa, Mycobacterium
RRLGAEIERPLSFALIQVDA

SEQ ID NO: 1288383 - protein, 19 aa, Mycobacterium
RRLLRLCARYSADPGGPTV

SEQ ID NO: 1288384 - protein, 21 aa, Mycobacterium
RRPRCLLAFGQFEFVSRQWFR

SEQ ID NO: 1288385 - protein, 20 aa, Mycobacterium
RRRAHGYFPVPGLDPHPAVD

SEQ ID NO: 1288386 - protein, 17 aa, Mycobacterium
RRRFWPKTSSITVDGPA

SEQ ID NO: 1288387 - protein, 19 aa, Mycobacterium
RRRICADAVAFAREIGYSY

SEQ ID NO: 1288388 - protein, 21 aa, Mycobacterium
RRRRGRRGRGRGRGEQSDDNG

SEQ ID NO: 1288389 - protein, 17 aa, Mycobacterium
RRRVQAVLDAAGDICGA

SEQ ID NO: 1288390 - protein, 18 aa, Mycobacterium
RRRVRSFGEHLRVTVRAY

SEQ ID NO: 1288391 - protein, 19 aa, Mycobacterium
RRTFAVNIDSFFRVTKAAL

SEQ ID NO: 1288392 - protein, 28 aa, Mycobacterium
RRTPPAHGWRRWVYRLSFGRINPGQSPE

SEQ ID NO: 1288393 - protein, 24 aa, Mycobacterium
RRVSAAWQLPLEWLNVPVGGVALD

SEQ ID NO: 1288394 - protein, 19 aa, Mycobacterium
RRWPNVWALVVDAFLEDVS

SEQ ID NO: 1288395 - protein, 25 aa, Mycobacterium
RRWQRLLFDNGWLLPGHPPEFGGRN

SEQ ID NO: 1288396 - protein, 18 aa, Mycobacterium
RSEPYVVVLVRLDEGPQL

SEQ ID NO: 1288397 - protein, 23 aa, Mycobacterium
RSFKEAHLRLVLRSGRTDVEQIR

SEQ ID NO: 1288398 - protein, 19 aa, Mycobacterium
RSGDSGAMQMHWYSAMEVL

SEQ ID NO: 1288399 - protein, 20 aa, Mycobacterium
RSGLPFGTCLRATYLHPCGT

SEQ ID NO: 1288400 - protein, 19 aa, Mycobacterium
RSGVLRFVVLDGLAKPGRL

SEQ ID NO: 1288401 - protein, 24 aa, Mycobacterium
RSLGCTIKLLAICERLTTDDGQQR

SEQ ID NO: 1288402 - protein, 19 aa, Mycobacterium
RSQMALGFFTHLAGDAAVA

SEQ ID NO: 1288403 - protein, 18 aa, Mycobacterium
RSRFGFLAIHGGGLEQMT

SEQ ID NO: 1288404 - protein, 20 aa, Mycobacterium
RSSPRVGDGFIRLDGAGNVV

SEQ ID NO: 1288405 - protein, 20 aa, Mycobacterium
RSTEEVRFLMGFNREVVRRR

SEQ ID NO: 1288406 - protein, 17 aa, Mycobacterium
RSTFHWVLAFAYKGLST

SEQ ID NO: 1288407 - protein, 17 aa, Mycobacterium
RSVWWNWNTGFDGIRVD

SEQ ID NO: 1288408 - protein, 17 aa, Mycobacterium
RSWFRRDHRVCWLDGGS

SEQ ID NO: 1288409 - protein, 17 aa, Mycobacterium
RTAVLAWLFARSTGRRF

SEQ ID NO: 1288410 - protein, 20 aa, Mycobacterium
RTAWEMPFRSGAHMCTMVTS

SEQ ID NO: 1288411 - protein, 17 aa, Mycobacterium
RTERVVFDGCDFSGVDM

SEQ ID NO: 1288412 - protein, 17 aa, Mycobacterium
RTGLVAFSLHYPWSQGL

SEQ ID NO: 1288413 - protein, 20 aa, Mycobacterium
RTGRANPGMFSRINVDYYGA

SEQ ID NO: 1288414 - protein, 20 aa, Mycobacterium
RTKACPRLADSIKHAVAEGC

SEQ ID NO: 1288415 - protein, 24 aa, Mycobacterium
RTLREVPVGFKWFVDGLIGGTIGF

SEQ ID NO: 1288416 - protein, 22 aa, Mycobacterium
RTPRLTGTITMRYLRTTRLGRL

SEQ ID NO: 1288417 - protein, 21 aa, Mycobacterium
RTRLLEMRDFYAFLLDEMPAV

SEQ ID NO: 1288418 - protein, 21 aa, Mycobacterium
RTRRAGAVGLMITEPLNYSFS

SEQ ID NO: 1288419 - protein, 22 aa, Mycobacterium
RTSAVKTFTAWAVRRGLMASDP

SEQ ID NO: 1288420 - protein, 22 aa, Mycobacterium
RTTEGWLLIDFEGEPGQPLDER

SEQ ID NO: 1288421 - protein, 26 aa, Mycobacterium
RTTLNLKACIKAAADRVVFINTGFLD

SEQ ID NO: 1288422 - protein, 18 aa, Mycobacterium
RTVALWRKRFDDVHIYPV

SEQ ID NO: 1288423 - protein, 17 aa, Mycobacterium
RTVVLRLRFDDFSRVTR

SEQ ID NO: 1288424 - protein, 18 aa, Mycobacterium
RVAKVLPGHVEIVRELLF

SEQ ID NO: 1288425 - protein, 17 aa, Mycobacterium
RVDEMIEILKLVLAGGM

SEQ ID NO: 1288426 - protein, 26 aa, Mycobacterium
RVEAVWKPREEWGLGIDNISHFRPTG

SEQ ID NO: 1288427 - protein, 17 aa, Mycobacterium
RVEYKLRDWLFARQRYW

SEQ ID NO: 1288428 - protein, 17 aa, Mycobacterium
RVFRTCRDLGIATVAVY

SEQ ID NO: 1288429 - protein, 19 aa, Mycobacterium
RVFSGHVRLCLGYTEPEGG

SEQ ID NO: 1288430 - protein, 17 aa, Mycobacterium
RVIWAMQDRVMWENGPA

SEQ ID NO: 1288431 - protein, 20 aa, Mycobacterium
RVKARMGWDIPWFTITDDFD

SEQ ID NO: 1288432 - protein, 18 aa, Mycobacterium
RVKRPQMGIAAWLIPSIV

SEQ ID NO: 1288433 - protein, 20 aa, Mycobacterium
RVLGTFPYRDLYMLDAARQF

SEQ ID NO: 1288434 - protein, 19 aa, Mycobacterium
RVRRICTDRGVLLIADEIQ

SEQ ID NO: 1288435 - protein, 24 aa, Mycobacterium
RVSAALDFGCVWINTHIPLVAEMP

SEQ ID NO: 1288436 - protein, 20 aa, Mycobacterium
RVSPENSWDCVQFVCAANDL

SEQ ID NO: 1288437 - protein, 19 aa, Mycobacterium
RVSYFYDFRGPSMAIDTAC

SEQ ID NO: 1288438 - protein, 17 aa, Mycobacterium
RVTELLDRVGLRDRSGY

SEQ ID NO: 1288439 - protein, 18 aa, Mycobacterium
RVTLYGLPLVARRRVNYS

SEQ ID NO: 1288440 - protein, 18 aa, Mycobacterium
RWALDLLRKRFAKVIWVP

SEQ ID NO: 1288441 - protein, 21 aa, Mycobacterium
RWCPMRRWIDIGAFDDGAPTR

SEQ ID NO: 1288442 - protein, 17 aa, Mycobacterium
RWIFPYAGTDSHDTYAI

SEQ ID NO: 1288443 - protein, 25 aa, Mycobacterium
RWMHWASCFEFDFTFVHEGSTRQTA

SEQ ID NO: 1288444 - protein, 17 aa, Mycobacterium
RWPNGVGELEFFEKQLA

SEQ ID NO: 1288445 - protein, 17 aa, Mycobacterium
RWSLREFLGPMITALDD

SEQ ID NO: 1288446 - protein, 18 aa, Mycobacterium
RYDLAVQEIFVFTPKGDV

SEQ ID NO: 1288447 - protein, 17 aa, Mycobacterium
RYFWPRVVGDTSWQLLD

SEQ ID NO: 1288448 - protein, 24 aa, Mycobacterium
RYHGREFIELIAVGTTYDLAAAAA

SEQ ID NO: 1288449 - protein, 17 aa, Mycobacterium
RYLAIIFDGLRPEGAHP

SEQ ID NO: 1288450 - protein, 18 aa, Mycobacterium
RYLLVPGLRSSRVHVFDT

SEQ ID NO: 1288451 - protein, 17 aa, Mycobacterium
RYMGHAMVSTWQRGAPY

SEQ ID NO: 1288452 - protein, 21 aa, Mycobacterium
RYPLCDDRRTLLWLANQRAVE

SEQ ID NO: 1288453 - protein, 19 aa, Mycobacterium
RYQSGWKRSLIAMRSQRYF

SEQ ID NO: 1288454 - protein, 22 aa, Mycobacterium
RYREGPCLTAAWEERTVHVPDL

SEQ ID NO: 1288455 - protein, 19 aa, Mycobacterium
RYRLAELALRNKIPLVMLL

SEQ ID NO: 1288456 - protein, 18 aa, Mycobacterium
RYVMMVLRHIPRPIFRKL

SEQ ID NO: 1288457 - protein, 18 aa, Mycobacterium
SAAGYGLWHNGIEEFEEL

SEQ ID NO: 1288458 - protein, 18 aa, Mycobacterium
SAALAAWLFGRPAPVDAV

SEQ ID NO: 1288459 - protein, 21 aa, Mycobacterium
SADILKRWKRGVMSTVGDVTA

SEQ ID NO: 1288460 - protein, 23 aa, Mycobacterium
SAEVARWLLGRGVGKGVRVGLFF

SEQ ID NO: 1288461 - protein, 17 aa, Mycobacterium
SAGAAGWPVVWSGGEEG

SEQ ID NO: 1288462 - protein, 17 aa, Mycobacterium
SAGIPVIHIQHSDGPDS

SEQ ID NO: 1288463 - protein, 17 aa, Mycobacterium
SAIPWGDFDAHLEHMRH

SEQ ID NO: 1288464 - protein, 23 aa, Mycobacterium
SALAREFLPEFGLSTECGLGRHS

SEQ ID NO: 1288465 - protein, 17 aa, Mycobacterium
SANRDEMRWARADEFDV

SEQ ID NO: 1288466 - protein, 23 aa, Mycobacterium
SAPRAAQLEACFEELAELTGQRN

SEQ ID NO: 1288467 - protein, 22 aa, Mycobacterium
SASDFPPSLGIRLNIPQPDLRK

SEQ ID NO: 1288468 - protein, 18 aa, Mycobacterium
SASLSFSSLSGWAKRGLR

SEQ ID NO: 1288469 - protein, 19 aa, Mycobacterium
SASSWFLPRLVGLTRATDW

SEQ ID NO: 1288470 - protein, 23 aa, Mycobacterium
SDARRFDVSPAWFSALGAGLTLP

SEQ ID NO: 1288471 - protein, 24 aa, Mycobacterium
SDATFPGAMAIQFHFVDYVVHGWD

SEQ ID NO: 1288472 - protein, 23 aa, Mycobacterium
SDFNFLWPTARIAVIGAEGAAQL

SEQ ID NO: 1288473 - protein, 17 aa, Mycobacterium
SDGRFAVYVKFHHALID

SEQ ID NO: 1288474 - protein, 23 aa, Mycobacterium
SDGRWDPGKDFAFVTGRATSPTG

SEQ ID NO: 1288475 - protein, 25 aa, Mycobacterium
SDLRAIPWVLSWSQSRVMLPGWYGT

SEQ ID NO: 1288476 - protein, 20 aa, Mycobacterium
SDSAGFKWLAPYTGSAIAQH

SEQ ID NO: 1288477 - protein, 23 aa, Mycobacterium
SEDVWRPGIKVFFDTFGAHRGVT

SEQ ID NO: 1288478 - protein, 18 aa, Mycobacterium
SEEWLIKLMEGVEDIPGS

SEQ ID NO: 1288479 - protein, 20 aa, Mycobacterium
SEFTSAVAMARCDDKRQTRR

SEQ ID NO: 1288480 - protein, 20 aa, Mycobacterium
SEGYPEWWLSGRPVQTGVST

SEQ ID NO: 1288481 - protein, 18 aa, Mycobacterium
SEKGWRTFFRGLANDGVQ

SEQ ID NO: 1288482 - protein, 27 aa, Mycobacterium
SELRAAHPVFRRRRFFSGRPVRQRGAP

SEQ ID NO: 1288483 - protein, 20 aa, Mycobacterium
SETWRFPPFFHALLDAGVYP

SEQ ID NO: 1288484 - protein, 20 aa, Mycobacterium
SEVRALVRWLLPQSTTVVVS

SEQ ID NO: 1288485 - protein, 18 aa, Mycobacterium
SFRKGDGFEGLWDDVPAI

SEQ ID NO: 1288486 - protein, 18 aa, Mycobacterium
SGADFPAGWQKLNGPQAL

SEQ ID NO: 1288487 - protein, 17 aa, Mycobacterium
SGAFLAKLGCSFAVVGH

SEQ ID NO: 1288488 - protein, 26 aa, Mycobacterium
SGELRARLALGYALGWQGRGREADEV

SEQ ID NO: 1288489 - protein, 19 aa, Mycobacterium
SGIGARFGGPEGLRKYCRV

SEQ ID NO: 1288490 - protein, 22 aa, Mycobacterium
SGPECAWLSVFVERVQGAVDEL

SEQ ID NO: 1288491 - protein, 17 aa, Mycobacterium
SGVLAYVAVCDVLRRHG

SEQ ID NO: 1288492 - protein, 17 aa, Mycobacterium
SGVSYRPGARFGPAHIR

SEQ ID NO: 1288493 - protein, 18 aa, Mycobacterium
SHHWPTWGRDRITEYLSL

SEQ ID NO: 1288494 - protein, 22 aa, Mycobacterium
SHLFRPGHRIRLALAGADASHF

SEQ ID NO: 1288495 - protein, 17 aa, Mycobacterium
SHPAGSVLVEFGETRVM

SEQ ID NO: 1288496 - protein, 17 aa, Mycobacterium
SHPIVFGHAVKVFYKDA

SEQ ID NO: 1288497 - protein, 20 aa, Mycobacterium
SIQREWEWRVSRGESLKNLR

SEQ ID NO: 1288498 - protein, 18 aa, Mycobacterium
SKELGVPAFVVFTDNTLI

SEQ ID NO: 1288499 - protein, 20 aa, Mycobacterium
SKREIPHYYLADEVLMDPAL

SEQ ID NO: 1288500 - protein, 20 aa, Mycobacterium
SKVALPLVRRALELLPGVGF

SEQ ID NO: 1288501 - protein, 23 aa, Mycobacterium
SLAPKMPWPWGAVDFACRALRPA

SEQ ID NO: 1288502 - protein, 23 aa, Mycobacterium
SLFSRLQPMLAIDGGAMFADPSA

SEQ ID NO: 1288503 - protein, 17 aa, Mycobacterium
SLLRPAVALSWRARLQP

SEQ ID NO: 1288504 - protein, 19 aa, Mycobacterium
SLRGPRGGLVLAQPEYSDA

SEQ ID NO: 1288505 - protein, 24 aa, Mycobacterium
SLYHFAWDEFCDWYVELAKVQLGE

SEQ ID NO: 1288506 - protein, 22 aa, Mycobacterium
SMMPMRVIGMLLGIPESEQVSV

SEQ ID NO: 1288507 - protein, 21 aa, Mycobacterium
SNALCAAAVALECGATLDQVA

SEQ ID NO: 1288508 - protein, 17 aa, Mycobacterium
SNIFLVFNSVENRLSEP

SEQ ID NO: 1288509 - protein, 17 aa, Mycobacterium
SNVPIARRSSGPADERG

SEQ ID NO: 1288510 - protein, 19 aa, Mycobacterium
SNVQVVWEKFCRYFDVEPR

SEQ ID NO: 1288511 - protein, 22 aa, Mycobacterium
SNWLRGELFAAPNVKVKVPYTN

SEQ ID NO: 1288512 - protein, 22 aa, Mycobacterium
SPAWRQAFGEARSRLEGQGAAV

SEQ ID NO: 1288513 - protein, 29 aa, Mycobacterium
SPGWAKHAWSCFFAPWIAEATIFVYNYRR

SEQ ID NO: 1288514 - protein, 17 aa, Mycobacterium
SPIGLAFRKRTPVRVDR

SEQ ID NO: 1288515 - protein, 18 aa, Mycobacterium
SPRLRLVGVAGYEAACGQ

SEQ ID NO: 1288516 - protein, 17 aa, Mycobacterium
SQNRFARRVNMEVASHT

SEQ ID NO: 1288517 - protein, 20 aa, Mycobacterium
SRARRAGVSSFGFGGTNAHV

SEQ ID NO: 1288518 - protein, 25 aa, Mycobacterium
SRAYRLPWPAGTVVFEIDQPGVITF

SEQ ID NO: 1288519 - protein, 19 aa, Mycobacterium
SRDLKVWLADGTNYPGQGD

SEQ ID NO: 1288520 - protein, 18 aa, Mycobacterium
SREPVKHVLVWVSTLGST

SEQ ID NO: 1288521 - protein, 20 aa, Mycobacterium
SRGPAVVEFNCRFGDPETQS

SEQ ID NO: 1288522 - protein, 20 aa, Mycobacterium
SRIDPVLARSWLLVNGAHGD

SEQ ID NO: 1288523 - protein, 18 aa, Mycobacterium
SRIQWRFERLCKQIPLAA

SEQ ID NO: 1288524 - protein, 18 aa, Mycobacterium
SRIYRDFTYRSGSTTVST

SEQ ID NO: 1288525 - protein, 18 aa, Mycobacterium
SRKCRCARLVYANSMHVD

SEQ ID NO: 1288526 - protein, 19 aa, Mycobacterium
SRKSFGIAGARVIDDLELS

SEQ ID NO: 1288527 - protein, 19 aa, Mycobacterium
SRLWRMLLAPGRGIGKLVT

SEQ ID NO: 1288528 - protein, 17 aa, Mycobacterium
SRRAPGFALLGEKGQVR

SEQ ID NO: 1288529 - protein, 18 aa, Mycobacterium
SRRGLRIVAEVSIAQTAQ

SEQ ID NO: 1288530 - protein, 18 aa, Mycobacterium
SRTLGFWLQLGVSGFRVD

SEQ ID NO: 1288531 - protein, 18 aa, Mycobacterium
SRWPELRAVLTKAFAEHD

SEQ ID NO: 1288532 - protein, 20 aa, Mycobacterium
SSDIAAVWWQAALDAYDRLP

SEQ ID NO: 1288533 - protein, 21 aa, Mycobacterium
SSEAARAWWGNFLVQKANESG

SEQ ID NO: 1288534 - protein, 17 aa, Mycobacterium
STARLTGRWLRGRLPVV

SEQ ID NO: 1288535 - protein, 22 aa, Mycobacterium
STLLLTLLFRFMKPLIENGHVF

SEQ ID NO: 1288536 - protein, 17 aa, Mycobacterium
STRLPRYLVPHHIAVLD

SEQ ID NO: 1288537 - protein, 19 aa, Mycobacterium
SVDCLRALFPDAIEVTAAD

SEQ ID NO: 1288538 - protein, 19 aa, Mycobacterium
SVFGGPAWTRIVEPDGQPG

SEQ ID NO: 1288539 - protein, 17 aa, Mycobacterium
SVLCPRPSGDRAYVAHA

SEQ ID NO: 1288540 - protein, 17 aa, Mycobacterium
SVRCVDHNLLPGVEADM

SEQ ID NO: 1288541 - protein, 18 aa, Mycobacterium
SVSGEFADLLGLAGSQAS

SEQ ID NO: 1288542 - protein, 17 aa, Mycobacterium
SVSMPFKQDVLDLVDEV

SEQ ID NO: 1288543 - protein, 19 aa, Mycobacterium
SVWRWFRDGDEWKAEKVIT

SEQ ID NO: 1288544 - protein, 21 aa, Mycobacterium
SWLDSKHSFSFADHYDPANTH

SEQ ID NO: 1288545 - protein, 22 aa, Mycobacterium
SWQDPRFVVLVLHNADLTEVSW

SEQ ID NO: 1288546 - protein, 17 aa, Mycobacterium
SYLREVQSTYPLSYGPQ

SEQ ID NO: 1288547 - protein, 19 aa, Mycobacterium
SYTRPPSWRGLDVPAVLLS

SEQ ID NO: 1288548 - protein, 21 aa, Mycobacterium
TAAQALIRWHMQLGNIVIPKS

SEQ ID NO: 1288549 - protein, 17 aa, Mycobacterium
TACLRKTDWLFPQYREI

SEQ ID NO: 1288550 - protein, 23 aa, Mycobacterium
TAEFAAPVERVWQIYADPRQLEK

SEQ ID NO: 1288551 - protein, 19 aa, Mycobacterium
TAFTEAWVLAGAAFRLLGT

SEQ ID NO: 1288552 - protein, 18 aa, Mycobacterium
TAGLAAWGYASGISLGDG

SEQ ID NO: 1288553 - protein, 24 aa, Mycobacterium
TALPEVRSQLALTWGTETFIVPQI

SEQ ID NO: 1288554 - protein, 18 aa, Mycobacterium
TALRRWLTKAGVGPDQAM

SEQ ID NO: 1288555 - protein, 23 aa, Mycobacterium
TALWPITWAPLFDRVMAPTVTGS

SEQ ID NO: 1288556 - protein, 18 aa, Mycobacterium
TAMAARFLANPALLAVSN

SEQ ID NO: 1288557 - protein, 20 aa, Mycobacterium
TARSHLRWIAASNRLPDKRV

SEQ ID NO: 1288558 - protein, 22 aa, Mycobacterium
TAWPPWRPGVLFTGDSLGAGKP

SEQ ID NO: 1288559 - protein, 18 aa, Mycobacterium
TCHYCTFVTVPGRLRAQG

SEQ ID NO: 1288560 - protein, 17 aa, Mycobacterium
TDACDWIILGAMVGDAD

SEQ ID NO: 1288561 - protein, 21 aa, Mycobacterium
TDCPLRWLLERHGGRDGRDVR

SEQ ID NO: 1288562 - protein, 23 aa, Mycobacterium
TDELRFLVHWSAEVFSDYDELKK

SEQ ID NO: 1288563 - protein, 17 aa, Mycobacterium
TDFANLFTGGAFGFTNP

SEQ ID NO: 1288564 - protein, 18 aa, Mycobacterium
TDGWRLERLTAPSRLFGA

SEQ ID NO: 1288565 - protein, 19 aa, Mycobacterium
TDLAWSRITYWRALLTSAV

SEQ ID NO: 1288566 - protein, 24 aa, Mycobacterium
TDLPGELMSALSQGLSSFGINLPP

SEQ ID NO: 1288567 - protein, 17 aa, Mycobacterium
TDMAHFFYIHFGLPTYF

SEQ ID NO: 1288568 - protein, 19 aa, Mycobacterium
TDVKWWFGHTLTWARRTLQ

SEQ ID NO: 1288569 - protein, 20 aa, Mycobacterium
TDVRAAAAYARMFEANSEQD

SEQ ID NO: 1288570 - protein, 23 aa, Mycobacterium
TEALRAGGFFHHAKVEMRWVASD

SEQ ID NO: 1288571 - protein, 18 aa, Mycobacterium
TEGCVREVLVLAAALSIP

SEQ ID NO: 1288572 - protein, 21 aa, Mycobacterium
TEHLPRIGVPTVFVHGTADPF

SEQ ID NO: 1288573 - protein, 23 aa, Mycobacterium
TEIGTRTTVLWVFGGADPSTPTA

SEQ ID NO: 1288574 - protein, 17 aa, Mycobacterium
TEKRMFGGLAFLLDGNM

SEQ ID NO: 1288575 - protein, 26 aa, Mycobacterium
TELFGLPAAREFGPFLAVELEHGVSL

SEQ ID NO: 1288576 - protein, 17 aa, Mycobacterium
TELMRWVHPSLVASTQG

SEQ ID NO: 1288577 - protein, 19 aa, Mycobacterium
TETEVWRWYLIDKNAPDDV

SEQ ID NO: 1288578 - protein, 19 aa, Mycobacterium
TFEWAFRWLAAHRPPPSPH

SEQ ID NO: 1288579 - protein, 24 aa, Mycobacterium
TFTQLPFKLAWAITIHKSQGQTLE

SEQ ID NO: 1288580 - protein, 22 aa, Mycobacterium
TGAGVSGLWLLSGMREDGVLTT

SEQ ID NO: 1288581 - protein, 20 aa, Mycobacterium
TGARFSPAWLTRLVNKKLAH

SEQ ID NO: 1288582 - protein, 20 aa, Mycobacterium
TGDCLFPGGVGKTWQEGDFE

SEQ ID NO: 1288583 - protein, 25 aa, Mycobacterium
TGEIRVPRMLGVFSIGRAINARTLR

SEQ ID NO: 1288584 - protein, 24 aa, Mycobacterium
TGHRGVWRFGEFVLDTARYELRCG

SEQ ID NO: 1288585 - protein, 21 aa, Mycobacterium
TGNDHPACFIVANPRRDESFV

SEQ ID NO: 1288586 - protein, 17 aa, Mycobacterium
TGPWFQWHFDRWTVPPG

SEQ ID NO: 1288587 - protein, 19 aa, Mycobacterium
TGRPPRWVAPVVDGLGLAP

SEQ ID NO: 1288588 - protein, 17 aa, Mycobacterium
TGVFSWRPPASLIVALS

SEQ ID NO: 1288589 - protein, 18 aa, Mycobacterium
THEIRWPRNAKLLDVLLD

SEQ ID NO: 1288590 - protein, 17 aa, Mycobacterium
THLLRYPLPSAWGEDCD

SEQ ID NO: 1288591 - protein, 18 aa, Mycobacterium
THLVPRDSIGWVEAEGDY

SEQ ID NO: 1288592 - protein, 25 aa, Mycobacterium
THNRFGFGVGIGWAPEEFEWCGVPF

SEQ ID NO: 1288593 - protein, 23 aa, Mycobacterium
THPDGVLWGHGWDESGWPERTAP

SEQ ID NO: 1288594 - protein, 20 aa, Mycobacterium
THPFAWLPMLSRVLASARLL

SEQ ID NO: 1288595 - protein, 17 aa, Mycobacterium
THRPDWPSATAVGKTAV

SEQ ID NO: 1288596 - protein, 23 aa, Mycobacterium
THVVRRYGVEFAHPGPRLRDYVL

SEQ ID NO: 1288597 - protein, 27 aa, Mycobacterium
TIAKLRAARLLWARVCEVVGAADAGAA

SEQ ID NO: 1288598 - protein, 19 aa, Mycobacterium
TIHAGEAFGLPSIHEAIAF

SEQ ID NO: 1288599 - protein, 20 aa, Mycobacterium
TKLVPFGAFVRVEEGIEGLV

SEQ ID NO: 1288600 - protein, 17 aa, Mycobacterium
TLHGELIGSLAITEPGG

SEQ ID NO: 1288601 - protein, 23 aa, Mycobacterium
TLIKEKWLTANGVIGFFPANAVG

SEQ ID NO: 1288602 - protein, 19 aa, Mycobacterium
TLLDWCRRNDVVFIADEVQ

SEQ ID NO: 1288603 - protein, 23 aa, Mycobacterium
TLMRRIGLRPSLFRELVEPGSVL

SEQ ID NO: 1288604 - protein, 22 aa, Mycobacterium
TLPAPARWALRKALRPVFAATY

SEQ ID NO: 1288605 - protein, 18 aa, Mycobacterium
TLPCRKWFDDHGVSFGRH

SEQ ID NO: 1288606 - protein, 24 aa, Mycobacterium
TLPGTLALYLERAWPRHRRLSRSA

SEQ ID NO: 1288607 - protein, 18 aa, Mycobacterium
TLPLSYRFEPGAADDGIT

SEQ ID NO: 1288608 - protein, 22 aa, Mycobacterium
TLSILKFRGHRILNGMLAEDPG

SEQ ID NO: 1288609 - protein, 23 aa, Mycobacterium
TLSPCWYCSGLVRQFNIGAVIVG

SEQ ID NO: 1288610 - protein, 20 aa, Mycobacterium
TLWPERLFSILAGFVEAGES

SEQ ID NO: 1288611 - protein, 25 aa, Mycobacterium
TMNTRGRFAMRLARPPERFTDGLVK

SEQ ID NO: 1288612 - protein, 22 aa, Mycobacterium
TNTRFCAHWGLARGGRVAYVNG

SEQ ID NO: 1288613 - protein, 18 aa, Mycobacterium
TPACYGFSIIAKVKEGRE

SEQ ID NO: 1288614 - protein, 18 aa, Mycobacterium
TPAGWRIARRRFTTVRVS

SEQ ID NO: 1288615 - protein, 18 aa, Mycobacterium
TPLLWQRYLAIIFDGLRP

SEQ ID NO: 1288616 - protein, 18 aa, Mycobacterium
TPLVNWRIPGPELKFEER

SEQ ID NO: 1288617 - protein, 21 aa, Mycobacterium
TPPLPLLCGGLFAAPTAEVVG

SEQ ID NO: 1288618 - protein, 18 aa, Mycobacterium
TPVAAACRLVHDSGDVLD

SEQ ID NO: 1288619 - protein, 17 aa, Mycobacterium
TQHWRIATLLGVPEHDL

SEQ ID NO: 1288620 - protein, 17 aa, Mycobacterium
TQMLFFVGHGYRVIAHD

SEQ ID NO: 1288621 - protein, 20 aa, Mycobacterium
TRAAAGLGLLPCFMADRHDD

SEQ ID NO: 1288622 - protein, 23 aa, Mycobacterium
TRAFRLPWPDGMTVFEIDQPTVL

SEQ ID NO: 1288623 - protein, 18 aa, Mycobacterium
TRASPWLTRHPEMPEWHL

SEQ ID NO: 1288624 - protein, 19 aa, Mycobacterium
TRGGPPIAFQLLWYPVTMW

SEQ ID NO: 1288625 - protein, 18 aa, Mycobacterium
TRIDVDWVIVPGGEVRRL

SEQ ID NO: 1288626 - protein, 20 aa, Mycobacterium
TRILAPRSRYDEVVEKLANF

SEQ ID NO: 1288627 - protein, 18 aa, Mycobacterium
TRKCVFCSKKGQDIDYKD

SEQ ID NO: 1288628 - protein, 17 aa, Mycobacterium
TRLAAKLSYTNIGFALT

SEQ ID NO: 1288629 - protein, 18 aa, Mycobacterium
TRLEEFLMMPAFVRAFGK

SEQ ID NO: 1288630 - protein, 20 aa, Mycobacterium
TRMLVWRAGWMHRNNKAFTS

SEQ ID NO: 1288631 - protein, 19 aa, Mycobacterium
TRPHRRWVSPAARRVAATL

SEQ ID NO: 1288632 - protein, 22 aa, Mycobacterium
TRTPDEFSWRAGEVLDAIAKGA

SEQ ID NO: 1288633 - protein, 30 aa, Mycobacterium
TRVEFWAFDILRLDGRWLLKAKYRDRRKLL

SEQ ID NO: 1288634 - protein, 18 aa, Mycobacterium
TRVPVLHFFDGFRTSHEL

SEQ ID NO: 1288635 - protein, 25 aa, Mycobacterium
TRVSFGFRGPDRFGFAPAGVHCERA

SEQ ID NO: 1288636 - protein, 18 aa, Mycobacterium
TRYDAVIVDAMFLGILPF

SEQ ID NO: 1288637 - protein, 23 aa, Mycobacterium
TSGDPRFRFFGNIAVGEHVHPEE

SEQ ID NO: 1288638 - protein, 18 aa, Mycobacterium
TSGWSLTAQDVFNNVART

SEQ ID NO: 1288639 - protein, 29 aa, Mycobacterium
TSLVKFHWKPRLGVHSLVWEEAQIAAGMD

SEQ ID NO: 1288640 - protein, 18 aa, Mycobacterium
TSVLPRWGAVIAASTAHI

SEQ ID NO: 1288641 - protein, 20 aa, Mycobacterium
TTLAGGLNWPLDLAVGDDGR

SEQ ID NO: 1288642 - protein, 18 aa, Mycobacterium
TTMSGCWIYSGVYADEVN

SEQ ID NO: 1288643 - protein, 22 aa, Mycobacterium
TTPRVAQMFGVQAVPTVVALAG

SEQ ID NO: 1288644 - protein, 18 aa, Mycobacterium
TVADLQWLRTAGLAEPIA

SEQ ID NO: 1288645 - protein, 18 aa, Mycobacterium
TVAEGWPSRLRPGALEGA

SEQ ID NO: 1288646 - protein, 25 aa, Mycobacterium
TVEPGARLNIPWNRDFNALVYVLSG

SEQ ID NO: 1288647 - protein, 21 aa, Mycobacterium
TVEPWGVVTHRGRWYLVGHDR

SEQ ID NO: 1288648 - protein, 23 aa, Mycobacterium
TVESWRVHRCIGMDGSTLLDNLV

SEQ ID NO: 1288649 - protein, 17 aa, Mycobacterium
TVNRFVERFSRFGLNAA

SEQ ID NO: 1288650 - protein, 21 aa, Mycobacterium
TVPEHPFMLFGQMTTADPTRS

SEQ ID NO: 1288651 - protein, 20 aa, Mycobacterium
TWDDELLDLFGLAGESLPAI

SEQ ID NO: 1288652 - protein, 17 aa, Mycobacterium
TYEERFPQIGWEITAGN

SEQ ID NO: 1288653 - protein, 22 aa, Mycobacterium
TYPDIRCVYWAGGNPFHHHQNI

SEQ ID NO: 1288654 - protein, 27 aa, Mycobacterium
TYPRLKKTLLLGTRWGDENAKLIPAPG

SEQ ID NO: 1288655 - protein, 19 aa, Mycobacterium
VAAALPEYMVPAAYVVLDE

SEQ ID NO: 1288656 - protein, 23 aa, Mycobacterium
VAAIAVGLTRGWSPTKSVQFGVA

SEQ ID NO: 1288657 - protein, 23 aa, Mycobacterium
VAAKRGWPVLRFSSRSGSSPLSQ

SEQ ID NO: 1288658 - protein, 17 aa, Mycobacterium
VAATIAFLASDYSSYLT

SEQ ID NO: 1288659 - protein, 17 aa, Mycobacterium
VAATMPMVLWLRTTSAQ

SEQ ID NO: 1288660 - protein, 17 aa, Mycobacterium
VADPANWRRWWPDLRLT

SEQ ID NO: 1288661 - protein, 19 aa, Mycobacterium
VADRLGLRFTLRDVADALE

SEQ ID NO: 1288662 - protein, 19 aa, Mycobacterium
VAETIDWGRTVLALGMDTI

SEQ ID NO: 1288663 - protein, 17 aa, Mycobacterium
VAIAAEWTRGAVKTVPP

SEQ ID NO: 1288664 - protein, 18 aa, Mycobacterium
VAKRLGLYVAEFDTVELN

SEQ ID NO: 1288665 - protein, 20 aa, Mycobacterium
VALKRAARCDGWMHGGGDPE

SEQ ID NO: 1288666 - protein, 19 aa, Mycobacterium
VAMLPGWARKPLRLPYFPP

SEQ ID NO: 1288667 - protein, 20 aa, Mycobacterium
VAMPSFAGIDPWRSPAGPVP

SEQ ID NO: 1288668 - protein, 17 aa, Mycobacterium
VAPEAYFQFPVAKYGIA

SEQ ID NO: 1288669 - protein, 18 aa, Mycobacterium
VARFDSYRGFLFGSLNPD

SEQ ID NO: 1288670 - protein, 23 aa, Mycobacterium
VARRAAVCSYGYGGTIAHVLLEE

SEQ ID NO: 1288671 - protein, 24 aa, Mycobacterium
VARYLFRRVVSWGRSSNVFLRNGA

SEQ ID NO: 1288672 - protein, 17 aa, Mycobacterium
VAVKAPFFGDRRKAFLD

SEQ ID NO: 1288673 - protein, 18 aa, Mycobacterium
VAYGWAMEDTEAFAKLIV

SEQ ID NO: 1288674 - protein, 23 aa, Mycobacterium
VAYRLGRGIARMEAAMSTPEMFG

SEQ ID NO: 1288675 - protein, 29 aa, Mycobacterium
VCAGIIPWNFPLLLAVWKLGPALAAGNTV

SEQ ID NO: 1288676 - protein, 18 aa, Mycobacterium
VCAVPGLSGLYVGPADLA

SEQ ID NO: 1288677 - protein, 18 aa, Mycobacterium
VCELHIRLAASLVQVSTP

SEQ ID NO: 1288678 - protein, 22 aa, Mycobacterium
VCGCGRCQWCLEGQAQVCPDQT

SEQ ID NO: 1288679 - protein, 18 aa, Mycobacterium
VCRACGAAVEIQGGQVET

SEQ ID NO: 1288680 - protein, 23 aa, Mycobacterium
VCSEILPRWGVETVFVDGDDLSQ

SEQ ID NO: 1288681 - protein, 17 aa, Mycobacterium
VDAQNLWMSAKMPDDQF

SEQ ID NO: 1288682 - protein, 19 aa, Mycobacterium
VDAVPFLFARDGVPGDPGV

SEQ ID NO: 1288683 - protein, 24 aa, Mycobacterium
VDDAWRPDTVWRHRLGAGLPAERV

SEQ ID NO: 1288684 - protein, 20 aa, Mycobacterium
VDDWPLLRWRMREYTHGRWG

SEQ ID NO: 1288685 - protein, 26 aa, Mycobacterium
VDEIVRWATPVHCFQRTALADVELGG

SEQ ID NO: 1288686 - protein, 18 aa, Mycobacterium
VDELMRFCPVIFTTIRTA

SEQ ID NO: 1288687 - protein, 24 aa, Mycobacterium
VDERARAGLFLAMQYPVEVPGVSM

SEQ ID NO: 1288688 - protein, 19 aa, Mycobacterium
VDGGIRLTGDFSWSSGSEH

SEQ ID NO: 1288689 - protein, 19 aa, Mycobacterium
VDIPFKFHHPMWRENCEVD

SEQ ID NO: 1288690 - protein, 17 aa, Mycobacterium
VDIRFCDLPGVVQHFSI

SEQ ID NO: 1288691 - protein, 23 aa, Mycobacterium
VDLVCSWGPMILGHAHPAVVEAV

SEQ ID NO: 1288692 - protein, 17 aa, Mycobacterium
VDLVPSYKAHRVAEPQA

SEQ ID NO: 1288693 - protein, 17 aa, Mycobacterium
VDLVQLFPAAAYGKNGA

SEQ ID NO: 1288694 - protein, 24 aa, Mycobacterium
VDRHGRLRIAAAVGINGDVGAKAR

SEQ ID NO: 1288695 - protein, 25 aa, Mycobacterium
VDRVFAGKVWGAWHLSEAAVDLQLD

SEQ ID NO: 1288696 - protein, 17 aa, Mycobacterium
VDSFDQWGVELGKTQAK

SEQ ID NO: 1288697 - protein, 18 aa, Mycobacterium
VEALAVRAEERFGPERVI

SEQ ID NO: 1288698 - protein, 17 aa, Mycobacterium
VEAYRPLALELQAQLGH

SEQ ID NO: 1288699 - protein, 17 aa, Mycobacterium
VEEELLRLGARPGCAVT

SEQ ID NO: 1288700 - protein, 18 aa, Mycobacterium
VELLRWAKEQGIAITAEV

SEQ ID NO: 1288701 - protein, 17 aa, Mycobacterium
VEMAGDFGGVWYWNRFP

SEQ ID NO: 1288702 - protein, 22 aa, Mycobacterium
VENALKVAFDWKSRLNESRGLD

SEQ ID NO: 1288703 - protein, 21 aa, Mycobacterium
VEVLRLSALRGLFSTVTDQQV

SEQ ID NO: 1288704 - protein, 18 aa, Mycobacterium
VFGSCRYPKTGVEEIDEK

SEQ ID NO: 1288705 - protein, 25 aa, Mycobacterium
VFRHGLQLFGAMGFTWENDLQFALK

SEQ ID NO: 1288706 - protein, 19 aa, Mycobacterium
VFSGYRFVRHAAAHGMPVA

SEQ ID NO: 1288707 - protein, 17 aa, Mycobacterium
VGACARGLMSREDVDII

SEQ ID NO: 1288708 - protein, 18 aa, Mycobacterium
VGAKTLWLQQGLWDEQIA

SEQ ID NO: 1288709 - protein, 19 aa, Mycobacterium
VGDRFGWAGGDLVLIGTVG

SEQ ID NO: 1288710 - protein, 17 aa, Mycobacterium
VGDTVIWDNRGVLHRAA

SEQ ID NO: 1288711 - protein, 24 aa, Mycobacterium
VGFDIPNEFVVGYGLDYAERYRDL

SEQ ID NO: 1288712 - protein, 17 aa, Mycobacterium
VGFSVAIGEHLAAGVQQ

SEQ ID NO: 1288713 - protein, 21 aa, Mycobacterium
VGGPSTWRLGGAFNCGKAQPG

SEQ ID NO: 1288714 - protein, 21 aa, Mycobacterium
VGPAAWWHAWARADWDRLAGA

SEQ ID NO: 1288715 - protein, 26 aa, Mycobacterium
VGPEVARAALLFGMRFDAEAAVRHGL

SEQ ID NO: 1288716 - protein, 22 aa, Mycobacterium
VGRKALSYYSFRNWDVTESWSG

SEQ ID NO: 1288717 - protein, 22 aa, Mycobacterium
VGSRGLGAWGRRLLGSVSTAVV

SEQ ID NO: 1288718 - protein, 21 aa, Mycobacterium
VGVRLLRHWAVSLGAAEDTFD

SEQ ID NO: 1288719 - protein, 19 aa, Mycobacterium
VGYAACFHSALRLVARQEK

SEQ ID NO: 1288720 - protein, 19 aa, Mycobacterium
VHASFLPAIYFQGVNLAGG

SEQ ID NO: 1288721 - protein, 18 aa, Mycobacterium
VHIWGCGGLGSWIAEFIA

SEQ ID NO: 1288722 - protein, 26 aa, Mycobacterium
VHVRIASPPVRWPCFYGIDFATPAEL

SEQ ID NO: 1288723 - protein, 18 aa, Mycobacterium
VIEKLSFPGYFLVVHDIT

SEQ ID NO: 1288724 - protein, 17 aa, Mycobacterium
VIFAWRSFEIYPLQVRT

SEQ ID NO: 1288725 - protein, 18 aa, Mycobacterium
VIGIRSRLMSRLAGQGAV

SEQ ID NO: 1288726 - protein, 29 aa, Mycobacterium
VIGRAVPRGGVYLLPFPMCHIAGYNMLVQ

SEQ ID NO: 1288727 - protein, 20 aa, Mycobacterium
VIHPRFGNFILLATVLVDAE

SEQ ID NO: 1288728 - protein, 18 aa, Mycobacterium
VINRHVFESLAFNARIAL

SEQ ID NO: 1288729 - protein, 17 aa, Mycobacterium
VIWACVFMRTSARRVHF

SEQ ID NO: 1288730 - protein, 18 aa, Mycobacterium
VKDLRTWHGTVLAAVAFV

SEQ ID NO: 1288731 - protein, 23 aa, Mycobacterium
VKGPFRLAALIGERMVADGGGTI

SEQ ID NO: 1288732 - protein, 23 aa, Mycobacterium
VKKLPTLRGRTVITMFYENSTRT

SEQ ID NO: 1288733 - protein, 18 aa, Mycobacterium
VKLLGRFAAEPTRENIEK

SEQ ID NO: 1288734 - protein, 18 aa, Mycobacterium
VKVPRRLKELHLRLGSAT

SEQ ID NO: 1288735 - protein, 18 aa, Mycobacterium
VLCPGSRNAPLAFALADA

SEQ ID NO: 1288736 - protein, 18 aa, Mycobacterium
VLENRYGLVPGRADERIE

SEQ ID NO: 1288737 - protein, 18 aa, Mycobacterium
VLIGSAWQRCRVHFLRNV

SEQ ID NO: 1288738 - protein, 17 aa, Mycobacterium
VLLARFGDTVAIPLMRR

SEQ ID NO: 1288739 - protein, 18 aa, Mycobacterium
VLNRFLLQAAIGYPLTVH

SEQ ID NO: 1288740 - protein, 23 aa, Mycobacterium
VLQRPRVGTVFVIPGRGDTLRIN

SEQ ID NO: 1288741 - protein, 29 aa, Mycobacterium
VLRGGKRLRPAFAYWGWRAVADRPADSGV

SEQ ID NO: 1288742 - protein, 18 aa, Mycobacterium
VLRRHGFHSATAYLGVDG

SEQ ID NO: 1288743 - protein, 21 aa, Mycobacterium
VLRVRRVRWVGGYGRMDSCSG

SEQ ID NO: 1288744 - protein, 19 aa, Mycobacterium
VLTGWRMLLDLGRMQDGEP

SEQ ID NO: 1288745 - protein, 25 aa, Mycobacterium
VLTKPRWLWDFGKTFSPPDLRVPNQ

SEQ ID NO: 1288746 - protein, 19 aa, Mycobacterium
VLVHPRPRLSVMSVGGELV

SEQ ID NO: 1288747 - protein, 17 aa, Mycobacterium
VMALRWVRDNIAVFGGD

SEQ ID NO: 1288748 - protein, 25 aa, Mycobacterium
VMLRVRLRSGLPLDMLTADERSRVG

SEQ ID NO: 1288749 - protein, 18 aa, Mycobacterium
VMMPELFLADAVGATNKP

SEQ ID NO: 1288750 - protein, 21 aa, Mycobacterium
VMPYKHGFGPFAPEIYRAPLS

SEQ ID NO: 1288751 - protein, 17 aa, Mycobacterium
VMREWKFTAADMERTNV

SEQ ID NO: 1288752 - protein, 17 aa, Mycobacterium
VMRRAPLTLAHVVAAVA

SEQ ID NO: 1288753 - protein, 18 aa, Mycobacterium
VNASWRLDDRGVFSDSHG

SEQ ID NO: 1288754 - protein, 22 aa, Mycobacterium
VNGELEFGGWTWRYDLVSLGPA

SEQ ID NO: 1288755 - protein, 18 aa, Mycobacterium
VNGFCVGGGIGLVGNADV

SEQ ID NO: 1288756 - protein, 17 aa, Mycobacterium
VNLPLTWTTRGVDRTVE

SEQ ID NO: 1288757 - protein, 21 aa, Mycobacterium
VNQRWLGGMLTNFSTVHKRLQ

SEQ ID NO: 1288758 - protein, 19 aa, Mycobacterium
VNVARALTLARLDAVALLP

SEQ ID NO: 1288759 - protein, 22 aa, Mycobacterium
VPADWLRMMLAFNRNQLQWFAD

SEQ ID NO: 1288760 - protein, 19 aa, Mycobacterium
VPARVAGLVERLKAAEKEL

SEQ ID NO: 1288761 - protein, 17 aa, Mycobacterium
VPCWECRFCKRGQYHMC

SEQ ID NO: 1288762 - protein, 19 aa, Mycobacterium
VPDVEAAFVLKMLARTVRD

SEQ ID NO: 1288763 - protein, 20 aa, Mycobacterium
VPEEVAWRVGFIDDEQLAAR

SEQ ID NO: 1288764 - protein, 17 aa, Mycobacterium
VPGLRWPWHARLGTAAV

SEQ ID NO: 1288765 - protein, 19 aa, Mycobacterium
VPISIVHRAGLQFPAPTLL

SEQ ID NO: 1288766 - protein, 20 aa, Mycobacterium
VPMLTFRLWRPLSHDTMEVW

SEQ ID NO: 1288767 - protein, 19 aa, Mycobacterium
VPMRCVFALTAMGFLPQSS

SEQ ID NO: 1288768 - protein, 17 aa, Mycobacterium
VPNSIRWLDRLKAVSPE

SEQ ID NO: 1288769 - protein, 17 aa, Mycobacterium
VPPALRFTAQAAQLLGP

SEQ ID NO: 1288770 - protein, 25 aa, Mycobacterium
VPPARLVGWTARFLGMVLPGDEIDF

SEQ ID NO: 1288771 - protein, 18 aa, Mycobacterium
VPPHPAGEHPMFKAMAAA

SEQ ID NO: 1288772 - protein, 23 aa, Mycobacterium
VPPKDYFPLLALLKRSLTEEEVV

SEQ ID NO: 1288773 - protein, 17 aa, Mycobacterium
VPPRVAMQILLTGDPIT

SEQ ID NO: 1288774 - protein, 17 aa, Mycobacterium
VPRVHRWARGVDITGFA

SEQ ID NO: 1288775 - protein, 22 aa, Mycobacterium
VPRWLPERICWLLSDEYHANEG

SEQ ID NO: 1288776 - protein, 20 aa, Mycobacterium
VPSIAASLFARFESRQEDSP

SEQ ID NO: 1288777 - protein, 18 aa, Mycobacterium
VPWRRPGFQLGLDIAEIK

SEQ ID NO: 1288778 - protein, 23 aa, Mycobacterium
VQRLEMVRRISLEIDADVVELGT

SEQ ID NO: 1288779 - protein, 24 aa, Mycobacterium
VQVLGFREHASWALASDTLEFVDL

SEQ ID NO: 1288780 - protein, 18 aa, Mycobacterium
VRALVAWFWDEPLRAPLI

SEQ ID NO: 1288781 - protein, 19 aa, Mycobacterium
VREACLWSAGLTPAGVTRR

SEQ ID NO: 1288782 - protein, 17 aa, Mycobacterium
VRIDRFEVLAIRRVDGF

SEQ ID NO: 1288783 - protein, 21 aa, Mycobacterium
VRILCAMPFFWIGGLLAATGA

SEQ ID NO: 1288784 - protein, 18 aa, Mycobacterium
VRLAELFIEAGLPAGVFQ

SEQ ID NO: 1288785 - protein, 24 aa, Mycobacterium
VRRALELLPGVGFVNAYGLTETSS

SEQ ID NO: 1288786 - protein, 22 aa, Mycobacterium
VRRCGICGSDLHAKDHADELTE

SEQ ID NO: 1288787 - protein, 22 aa, Mycobacterium
VRRLWWRVTVDLPDDALLHTLI

SEQ ID NO: 1288788 - protein, 19 aa, Mycobacterium
VRVGLFFPNGVDWIVWWLA

SEQ ID NO: 1288789 - protein, 18 aa, Mycobacterium
VRVGYTLGSTGTCLQVDD

SEQ ID NO: 1288790 - protein, 23 aa, Mycobacterium
VSARGIEIGHIFQLGRKYTEAFS

SEQ ID NO: 1288791 - protein, 23 aa, Mycobacterium
VSCVKPAGALYAFPRLDPEVYEI

SEQ ID NO: 1288792 - protein, 19 aa, Mycobacterium
VSCYWDYAPSFGRGPFRNV

SEQ ID NO: 1288793 - protein, 19 aa, Mycobacterium
VSDLPRGGLIIANSDEFTK

SEQ ID NO: 1288794 - protein, 18 aa, Mycobacterium
VSEIIRWQTPLAYMRRVA

SEQ ID NO: 1288795 - protein, 19 aa, Mycobacterium
VSGAWQWSSGCDHATWAFL

SEQ ID NO: 1288796 - protein, 24 aa, Mycobacterium
VSGGYRLSGSWSFGSGTGHSQYVA

SEQ ID NO: 1288797 - protein, 25 aa, Mycobacterium
VSLLRYCLDHGYQLRIIEQMPLDAE

SEQ ID NO: 1288798 - protein, 19 aa, Mycobacterium
VSQPARWALLYGSPVPGYR

SEQ ID NO: 1288799 - protein, 21 aa, Mycobacterium
VSVPVDWRRLRMGAEAITAEG

SEQ ID NO: 1288800 - protein, 19 aa, Mycobacterium
VTAIGARFTSPVFPGETLT

SEQ ID NO: 1288801 - protein, 17 aa, Mycobacterium
VTDGRWSCVQWGSRTPP

SEQ ID NO: 1288802 - protein, 24 aa, Mycobacterium
VTDRSWRGIGMIPQSGWRLSPAYR

SEQ ID NO: 1288803 - protein, 17 aa, Mycobacterium
VTERGWAPIVRFGVAPR

SEQ ID NO: 1288804 - protein, 22 aa, Mycobacterium
VTKAAVEPVWWLPGVAQRFGCS

SEQ ID NO: 1288805 - protein, 20 aa, Mycobacterium
VTLRGAVSIARRLQDPLAEL

SEQ ID NO: 1288806 - protein, 24 aa, Mycobacterium
VTRARASGMTAVFWLDTERPHEAE

SEQ ID NO: 1288807 - protein, 22 aa, Mycobacterium
VTYRHRLLLGWTHMQDGQLQAA

SEQ ID NO: 1288808 - protein, 19 aa, Mycobacterium
VVAADWPRLAAAYRTRAAL

SEQ ID NO: 1288809 - protein, 18 aa, Mycobacterium
VVAADWTRLGAAYRTRAP

SEQ ID NO: 1288810 - protein, 24 aa, Mycobacterium
VVARLPFVPSLLEWLHAGRTSVVM

SEQ ID NO: 1288811 - protein, 17 aa, Mycobacterium
VVARTGLRDCRTHGRTW

SEQ ID NO: 1288812 - protein, 24 aa, Mycobacterium
VVDTRVGTVIARYPLAFTATAMTI

SEQ ID NO: 1288813 - protein, 17 aa, Mycobacterium
VVFYPVIPLGSWVATTE

SEQ ID NO: 1288814 - protein, 17 aa, Mycobacterium
VVKRLYGLAARVPMGQA

SEQ ID NO: 1288815 - protein, 19 aa, Mycobacterium
VVLSDGWDIMDFVDQLQKL

SEQ ID NO: 1288816 - protein, 19 aa, Mycobacterium
VVVDEAWKTGSLAAEISAQ

SEQ ID NO: 1288817 - protein, 19 aa, Mycobacterium
VYFELRLADAWVWDMYRPA

SEQ ID NO: 1288818 - protein, 17 aa, Mycobacterium
WAKEQGIAITAEVTPHH

SEQ ID NO: 1288819 - protein, 26 aa, Mycobacterium
WARFSAWADDIFKIFNWNVAEDADDI

SEQ ID NO: 1288820 - protein, 25 aa, Mycobacterium
WARVPKARFARWAPDGALLVSVPST

SEQ ID NO: 1288821 - protein, 19 aa, Mycobacterium
WAVNECRPMTGIGGGSDRS

SEQ ID NO: 1288822 - protein, 18 aa, Mycobacterium
WCMGEAHAAVVLDALSRR

SEQ ID NO: 1288823 - protein, 19 aa, Mycobacterium
WDALCAAIGAADWASDPAL

SEQ ID NO: 1288824 - protein, 18 aa, Mycobacterium
WDDAYRLIADELRALADP

SEQ ID NO: 1288825 - protein, 26 aa, Mycobacterium
WDLKRFAASVALMCWQKALSDGEITN

SEQ ID NO: 1288826 - protein, 18 aa, Mycobacterium
WEHGRFGAPYLRDSLLSA

SEQ ID NO: 1288827 - protein, 17 aa, Mycobacterium
WELGAGWAKHVTVEVAL

SEQ ID NO: 1288828 - protein, 25 aa, Mycobacterium
WEPEPLRWLGVRGLYLAYRLADRHE

SEQ ID NO: 1288829 - protein, 17 aa, Mycobacterium
WEPGDLLLLGSGAAGPA

SEQ ID NO: 1288830 - protein, 22 aa, Mycobacterium
WESLPAILFQSGFRQLLSPELR

SEQ ID NO: 1288831 - protein, 18 aa, Mycobacterium
WETIKKWAILDHDLSIEN

SEQ ID NO: 1288832 - protein, 17 aa, Mycobacterium
WEYVADFDLDFHMRRVT

SEQ ID NO: 1288833 - protein, 18 aa, Mycobacterium
WFKDEFTHLGEPWLEHDE

SEQ ID NO: 1288834 - protein, 21 aa, Mycobacterium
WFLRRFSLLDSLYMVPSPRLV

SEQ ID NO: 1288835 - protein, 17 aa, Mycobacterium
WGITPGDMATIWRGGCI

SEQ ID NO: 1288836 - protein, 17 aa, Mycobacterium
WGKIGGMGPRIVGSGVS

SEQ ID NO: 1288837 - protein, 24 aa, Mycobacterium
WGKPEEMAELLAFCAGDRAGYLTG

SEQ ID NO: 1288838 - protein, 25 aa, Mycobacterium
WGRFRWGGDFGWTWGTLLPRDPDDP

SEQ ID NO: 1288839 - protein, 18 aa, Mycobacterium
WHALPAMIIDCALRADGW

SEQ ID NO: 1288840 - protein, 20 aa, Mycobacterium
WHSLARLAIRDDIYGSIRSL

SEQ ID NO: 1288841 - protein, 18 aa, Mycobacterium
WITLSCRDRNRIVLEQEL

SEQ ID NO: 1288842 - protein, 18 aa, Mycobacterium
WIVRVVVSLAYWPDPDPR

SEQ ID NO: 1288843 - protein, 20 aa, Mycobacterium
WKAIEASGRFCVNVLHEKQK

SEQ ID NO: 1288844 - protein, 23 aa, Mycobacterium
WKDGEALFLRCNIWREAAENVAE

SEQ ID NO: 1288845 - protein, 19 aa, Mycobacterium
WLDAEWRLVSGDVRVVIAL

SEQ ID NO: 1288846 - protein, 20 aa, Mycobacterium
WLDAFTHWRRAQGLPASAIA

SEQ ID NO: 1288847 - protein, 17 aa, Mycobacterium
WLLKQAFYFSLTTVNEA

SEQ ID NO: 1288848 - protein, 19 aa, Mycobacterium
WLPPRGMRGEFERFDGRAG

SEQ ID NO: 1288849 - protein, 17 aa, Mycobacterium
WLRAASLGFVATVDAQG

SEQ ID NO: 1288850 - protein, 17 aa, Mycobacterium
WMAEYRREFGLVDPPAD

SEQ ID NO: 1288851 - protein, 19 aa, Mycobacterium
WMARFVLGFGSAVRVLEPQ

SEQ ID NO: 1288852 - protein, 22 aa, Mycobacterium
WMDAEWWRLRVLPELGGTDAPN

SEQ ID NO: 1288853 - protein, 19 aa, Mycobacterium
WMGRVHRFLGLDVGVILSG

SEQ ID NO: 1288854 - protein, 17 aa, Mycobacterium
WMIRCVVNGVAESIEAL

SEQ ID NO: 1288855 - protein, 21 aa, Mycobacterium
WMLDIRLRALRTFDKKPMPNW

SEQ ID NO: 1288856 - protein, 18 aa, Mycobacterium
WNPKMKRFIFTDRNGIYI

SEQ ID NO: 1288857 - protein, 17 aa, Mycobacterium
WPAKLRLLEGFRHRENL

SEQ ID NO: 1288858 - protein, 18 aa, Mycobacterium
WPLADVRLLAPILASKVV

SEQ ID NO: 1288859 - protein, 18 aa, Mycobacterium
WPPVRRIDGAYGDRNLMC

SEQ ID NO: 1288860 - protein, 20 aa, Mycobacterium
WPRLAAAYRTRAALRIVDEL

SEQ ID NO: 1288861 - protein, 17 aa, Mycobacterium
WPSQWCLEANSLAIQVH

SEQ ID NO: 1288862 - protein, 18 aa, Mycobacterium
WQECDAVSMPRAVAITKL

SEQ ID NO: 1288863 - protein, 18 aa, Mycobacterium
WQERLWPTEEFELARSRI

SEQ ID NO: 1288864 - protein, 18 aa, Mycobacterium
WQKLNGPQALSFVRQRHD

SEQ ID NO: 1288865 - protein, 18 aa, Mycobacterium
WQLAMAVRPRRWVFTSVG

SEQ ID NO: 1288866 - protein, 23 aa, Mycobacterium
WQPCPGGGGLALWVRLPTPMSSA

SEQ ID NO: 1288867 - protein, 21 aa, Mycobacterium
WRGGCIIRAKFLNRIKDAFDN

SEQ ID NO: 1288868 - protein, 19 aa, Mycobacterium
WRHNEHWLAPDFLDPAADV

SEQ ID NO: 1288869 - protein, 17 aa, Mycobacterium
WRIVTALAASGDIDADG

SEQ ID NO: 1288870 - protein, 19 aa, Mycobacterium
WRKPLVRRWYGFAEMQKQV

SEQ ID NO: 1288871 - protein, 21 aa, Mycobacterium
WRWDTDWFWCSRAFGAQNPKI

SEQ ID NO: 1288872 - protein, 17 aa, Mycobacterium
WRWRQRLGGDAWKGRTP

SEQ ID NO: 1288873 - protein, 20 aa, Mycobacterium
WRYGFGEARRGDPVAIVLNT

SEQ ID NO: 1288874 - protein, 17 aa, Mycobacterium
WSAPRLHLVDLQYSDVR

SEQ ID NO: 1288875 - protein, 17 aa, Mycobacterium
WSCRRFERDGAMMPADG

SEQ ID NO: 1288876 - protein, 17 aa, Mycobacterium
WSIQLGNVVIARSANPD

SEQ ID NO: 1288877 - protein, 20 aa, Mycobacterium
WSPQCRVMKPLGPVRPGTKT

SEQ ID NO: 1288878 - protein, 21 aa, Mycobacterium
WTADIRYRWAVCEPTTGELLA

SEQ ID NO: 1288879 - protein, 17 aa, Mycobacterium
WTSFEAHPLDAMDLTRR

SEQ ID NO: 1288880 - protein, 24 aa, Mycobacterium
WTTSTLRPWPGFTPMIYDRYSQPF

SEQ ID NO: 1288881 - protein, 17 aa, Mycobacterium
WVLAGAAFRLLGTSRAA

SEQ ID NO: 1288882 - protein, 17 aa, Mycobacterium
WVNTIFLSTRFRAWRVG

SEQ ID NO: 1288883 - protein, 18 aa, Mycobacterium
WWFGHTLTWARRTLQALG

SEQ ID NO: 1288884 - protein, 17 aa, Mycobacterium
YAELIKRTQWWGRQMLI

SEQ ID NO: 1288885 - protein, 17 aa, Mycobacterium
YAFARRQLVSWMARRHG

SEQ ID NO: 1288886 - protein, 17 aa, Mycobacterium
YASLGLRLDYDPHLRRV

SEQ ID NO: 1288887 - protein, 22 aa, Mycobacterium
YAVPRLLARNGLTLQDFDFYEI

SEQ ID NO: 1288888 - protein, 20 aa, Mycobacterium
YDAAVAWARRFTDYPPQVLA

SEQ ID NO: 1288889 - protein, 23 aa, Mycobacterium
YDHLTLSWVYDWMARGVPVVAMH

SEQ ID NO: 1288890 - protein, 21 aa, Mycobacterium
YDILFFWVARMMMFGTFVADD

SEQ ID NO: 1288891 - protein, 19 aa, Mycobacterium
YDKLKRFPAGFVVLGDAFC

SEQ ID NO: 1288892 - protein, 23 aa, Mycobacterium
YEDRTGPPIVEWLTGRGVDTPDP

SEQ ID NO: 1288893 - protein, 17 aa, Mycobacterium
YEFTRPGADITLFRRTM

SEQ ID NO: 1288894 - protein, 23 aa, Mycobacterium
YEIKGCIAHGGLGWVYLAFDHNV

SEQ ID NO: 1288895 - protein, 17 aa, Mycobacterium
YEIYRLDAVPGTDKLPY

SEQ ID NO: 1288896 - protein, 17 aa, Mycobacterium
YELARPAADISIADVLR

SEQ ID NO: 1288897 - protein, 21 aa, Mycobacterium
YEWAYEYLDVVYKLWEGSWDE

SEQ ID NO: 1288898 - protein, 18 aa, Mycobacterium
YFYSCHRCRNCLLGRRGA

SEQ ID NO: 1288899 - protein, 18 aa, Mycobacterium
YGEMLARIDAFAGALADR

SEQ ID NO: 1288900 - protein, 21 aa, Mycobacterium
YGISWILPRLVGFGAAMDLLL

SEQ ID NO: 1288901 - protein, 22 aa, Mycobacterium
YGLAGLRIGYAVADADIVTALG

SEQ ID NO: 1288902 - protein, 23 aa, Mycobacterium
YGNVLRFLPPLAISDELLDEGLD

SEQ ID NO: 1288903 - protein, 18 aa, Mycobacterium
YGRPVVVMAHGFGGTMDS

SEQ ID NO: 1288904 - protein, 18 aa, Mycobacterium
YGRRLRAAVIGFGATARG

SEQ ID NO: 1288905 - protein, 17 aa, Mycobacterium
YGVGLINWWDPKGTRST

SEQ ID NO: 1288906 - protein, 17 aa, Mycobacterium
YHAWRYALNGDLTFIQQ

SEQ ID NO: 1288907 - protein, 17 aa, Mycobacterium
YHGWRYGLDGALKFVQQ

SEQ ID NO: 1288908 - protein, 23 aa, Mycobacterium
YHKIHLYDAFGFRESRTVAPGSE

SEQ ID NO: 1288909 - protein, 19 aa, Mycobacterium
YILELEPFASLPVEQIAET

SEQ ID NO: 1288910 - protein, 17 aa, Mycobacterium
YIMECLQLMASRRATTI

SEQ ID NO: 1288911 - protein, 18 aa, Mycobacterium
YKDMEAWGRKMFVTPGVV

SEQ ID NO: 1288912 - protein, 17 aa, Mycobacterium
YKGACIFLNRPGFAGGI

SEQ ID NO: 1288913 - protein, 24 aa, Mycobacterium
YKSEPWARLGVDVEHDFEPLYIIS

SEQ ID NO: 1288914 - protein, 19 aa, Mycobacterium
YKVPTRWAVVGADQLPVLA

SEQ ID NO: 1288915 - protein, 21 aa, Mycobacterium
YKWRKWLYFDCNWKVAMEAFN

SEQ ID NO: 1288916 - protein, 17 aa, Mycobacterium
YLERDGLEVAIARDGTE

SEQ ID NO: 1288917 - protein, 18 aa, Mycobacterium
YLLDFSRRFPDAAVIRLE

SEQ ID NO: 1288918 - protein, 20 aa, Mycobacterium
YLPALACARCRAIARCRHCT

SEQ ID NO: 1288919 - protein, 19 aa, Mycobacterium
YLPPFAPTAFRWQSEHATH

SEQ ID NO: 1288920 - protein, 22 aa, Mycobacterium
YLRIAPELFLKRALVGGFEKVF

SEQ ID NO: 1288921 - protein, 20 aa, Mycobacterium
YLRPRAVVFHRSLGAKFADV

SEQ ID NO: 1288922 - protein, 19 aa, Mycobacterium
YLVPHWPKPWGRAAGTLEQ

SEQ ID NO: 1288923 - protein, 23 aa, Mycobacterium
YLWSKRVAALFARALRANPDLHL

SEQ ID NO: 1288924 - protein, 22 aa, Mycobacterium
YLYPRVEVEVGFILADDLPGAG

SEQ ID NO: 1288925 - protein, 21 aa, Mycobacterium
YPCDHFDVWPGHDWHDRAATD

SEQ ID NO: 1288926 - protein, 18 aa, Mycobacterium
YPDLAIPFHSRWRHFEAG

SEQ ID NO: 1288927 - protein, 17 aa, Mycobacterium
YPGDVFAGFGLGAAVSV

SEQ ID NO: 1288928 - protein, 20 aa, Mycobacterium
YPPEAIDWLLPRGAHTVLDL

SEQ ID NO: 1288929 - protein, 17 aa, Mycobacterium
YPPILAMTSLNDTRVYY

SEQ ID NO: 1288930 - protein, 19 aa, Mycobacterium
YPQILLRVGWAPVNADPLP

SEQ ID NO: 1288931 - protein, 18 aa, Mycobacterium
YRCGIAWRDVPEVFGPWQ

SEQ ID NO: 1288932 - protein, 18 aa, Mycobacterium
YREYSLRPPKGVLLYGPP

SEQ ID NO: 1288933 - protein, 18 aa, Mycobacterium
YRGDLAWWAGPWPVDERW

SEQ ID NO: 1288934 - protein, 19 aa, Mycobacterium
YRIPLTIIRICSTYGPEGG

SEQ ID NO: 1288935 - protein, 18 aa, Mycobacterium
YRNGGLLLDAGVLALRTP

SEQ ID NO: 1288936 - protein, 18 aa, Mycobacterium
YRPGARFGPAHIRASSKL

SEQ ID NO: 1288937 - protein, 19 aa, Mycobacterium
YRRVLAMAWEKQSESNAMW

SEQ ID NO: 1288938 - protein, 19 aa, Mycobacterium
YRTGAGWSRGFGASRQNGP

SEQ ID NO: 1288939 - protein, 19 aa, Mycobacterium
YRTMRGYKVERRFGWDTHG

SEQ ID NO: 1288940 - protein, 18 aa, Mycobacterium
YRVAGYRSGWLVITGPKE

SEQ ID NO: 1288941 - protein, 19 aa, Mycobacterium
YRVDAVAAFELLKWRAAEA

SEQ ID NO: 1288942 - protein, 19 aa, Mycobacterium
YRVSWPRHCVVGTDGAEFH

SEQ ID NO: 1288943 - protein, 20 aa, Mycobacterium
YSALRLAPRFVDPSTLNPPG

SEQ ID NO: 1288944 - protein, 23 aa, Mycobacterium
YSDARAAFQVGMWVNRTERETTV

SEQ ID NO: 1288945 - protein, 20 aa, Mycobacterium
YSDIADWCLVLARTDKEVPR

SEQ ID NO: 1288946 - protein, 18 aa, Mycobacterium
YSIRGVIGPDEFHSGYPD

SEQ ID NO: 1288947 - protein, 17 aa, Mycobacterium
YSPACVERGVLSGLSFK

SEQ ID NO: 1288948 - protein, 29 aa, Mycobacterium
YSPRLRPGTPVSFPLDWSELSAVTPGDFT

SEQ ID NO: 1288949 - protein, 23 aa, Mycobacterium
YSYYGEVLLDWVVERLANQKGSA

SEQ ID NO: 1288950 - protein, 17 aa, Mycobacterium
YTGVLGFRSRGAFRVPV

SEQ ID NO: 1288951 - protein, 23 aa, Mycobacterium
YTKCAELGLPLCINTGLPGPPIP

SEQ ID NO: 1288952 - protein, 23 aa, Mycobacterium
YTVPEFRRKAVIIAVGGVYDPRI

SEQ ID NO: 1288953 - protein, 17 aa, Mycobacterium
YVAKYTICPAVAHGLDG

SEQ ID NO: 1288954 - protein, 18 aa, Mycobacterium
YVKPVFKLGWSRRLAPLM

SEQ ID NO: 1288955 - protein, 18 aa, Mycobacterium
YVLAEARLAAYAREIGEE

SEQ ID NO: 1288956 - protein, 19 aa, Mycobacterium
YYAMTGWRLGWLLVPQELR

SEQ ID NO: 1288957 - protein, 19 aa, Mycobacterium
YYLASAFREVWMQPSGTVG

SEQ ID NO: 1288958 - protein, 17 aa, Mycobacterium
AAALCFPSYPQFCGQYF

SEQ ID NO: 1288959 - protein, 17 aa, Mycobacterium
AAALREFAHQAGVPMDQ

SEQ ID NO: 1288960 - protein, 17 aa, Mycobacterium
AACNIYADLGWRGVIPV

SEQ ID NO: 1288961 - protein, 17 aa, Mycobacterium
AACRAVWNTGLEQRREY

SEQ ID NO: 1288962 - protein, 21 aa, Mycobacterium
AACRRWRVAEIIADPFRWTRT

SEQ ID NO: 1288963 - protein, 24 aa, Mycobacterium
AAGEPRLAAAVPFYGPTPENPDFS

SEQ ID NO: 1288964 - protein, 17 aa, Mycobacterium
AAGPVWWDPQMRTTSDY

SEQ ID NO: 1288965 - protein, 17 aa, Mycobacterium
AAIPHLLEHGGSLVNIS

SEQ ID NO: 1288966 - protein, 18 aa, Mycobacterium
AAKGLPYVFAHHFSGQGT

SEQ ID NO: 1288967 - protein, 22 aa, Mycobacterium
AAMKLFWERGFDGVSISDVTAA

SEQ ID NO: 1288968 - protein, 21 aa, Mycobacterium
AANRWPAVRFAVRNTIVQGPN

SEQ ID NO: 1288969 - protein, 19 aa, Mycobacterium
AAQALPRRDRVVLIGQAPL

SEQ ID NO: 1288970 - protein, 24 aa, Mycobacterium
AARKAGKPEPEWGIKPFDFVLATS

SEQ ID NO: 1288971 - protein, 20 aa, Mycobacterium
AARLRAQMAFVRSRVGESGA

SEQ ID NO: 1288972 - protein, 19 aa, Mycobacterium
AARTWIREQCSFLPTRIDP

SEQ ID NO: 1288973 - protein, 17 aa, Mycobacterium
AASLFGYVNEWCPRHGY

SEQ ID NO: 1288974 - protein, 19 aa, Mycobacterium
AAVKLLWLAICNIEDKRAA

SEQ ID NO: 1288975 - protein, 18 aa, Mycobacterium
AAVSRLSYDGRLQSNDAV

SEQ ID NO: 1288976 - protein, 17 aa, Mycobacterium
ACGLEPRLAVPLLAPVL

SEQ ID NO: 1288977 - protein, 17 aa, Mycobacterium
ACHFCLFLSETSCERTN

SEQ ID NO: 1288978 - protein, 18 aa, Mycobacterium
ADALWRYALKLTGDAATA

SEQ ID NO: 1288979 - protein, 18 aa, Mycobacterium
ADDRAVWTWLTQIRSAVP

SEQ ID NO: 1288980 - protein, 19 aa, Mycobacterium
ADEYWPTLAAQLAEAAPTN

SEQ ID NO: 1288981 - protein, 18 aa, Mycobacterium
ADGSFEWRFTPEVPSQLV

SEQ ID NO: 1288982 - protein, 17 aa, Mycobacterium
ADGSGWLARNLVGGTHV

SEQ ID NO: 1288983 - protein, 19 aa, Mycobacterium
ADGWSRLASALALTGVDVG

SEQ ID NO: 1288984 - protein, 19 aa, Mycobacterium
ADIERLEFLAARGWLIVRV

SEQ ID NO: 1288985 - protein, 19 aa, Mycobacterium
ADIRLRWAESMADAAREIR

SEQ ID NO: 1288986 - protein, 19 aa, Mycobacterium
ADLGLPHPVWQRLADTVDL

SEQ ID NO: 1288987 - protein, 18 aa, Mycobacterium
ADLWRAAADLGWHGLAVA

SEQ ID NO: 1288988 - protein, 21 aa, Mycobacterium
ADNSLMLWFEVMKPLMSTSAE

SEQ ID NO: 1288989 - protein, 21 aa, Mycobacterium
AEALRALGIRVWSDVPVGAST

SEQ ID NO: 1288990 - protein, 18 aa, Mycobacterium
AEAPVPMPDPSNRQTDPA

SEQ ID NO: 1288991 - protein, 24 aa, Mycobacterium
AEEVKYPVEWAVGIFRSPSGTETV

SEQ ID NO: 1288992 - protein, 27 aa, Mycobacterium
AEGLPRLAGVPGWFACDVIQLVEAADH

SEQ ID NO: 1288993 - protein, 18 aa, Mycobacterium
AEHFPRLDIAVEVVDEPA

SEQ ID NO: 1288994 - protein, 19 aa, Mycobacterium
AEHWSGFGDAEMVFAEPPK

SEQ ID NO: 1288995 - protein, 21 aa, Mycobacterium
AEIALAWSRDRARAMPEIEQA

SEQ ID NO: 1288996 - protein, 20 aa, Mycobacterium
AEIYADLGLRFDGARAEAVS

SEQ ID NO: 1288997 - protein, 18 aa, Mycobacterium
AEKYLGIIDRVRAAIPDA

SEQ ID NO: 1288998 - protein, 17 aa, Mycobacterium
AEMPPFLTGGSMIETVT

SEQ ID NO: 1288999 - protein, 19 aa, Mycobacterium
AENRVDAVVGWHQAGGDLA

SEQ ID NO: 1289000 - protein, 22 aa, Mycobacterium
AEPGRAHAYLRLGGQEPVVETV

SEQ ID NO: 1289001 - protein, 21 aa, Mycobacterium
AEPLLRRIDVLAAQGHPGAQQ

SEQ ID NO: 1289002 - protein, 17 aa, Mycobacterium
AEQSVWRRAFEAARPRA

SEQ ID NO: 1289003 - protein, 17 aa, Mycobacterium
AEQVMEWAGLDLLILRI

SEQ ID NO: 1289004 - protein, 17 aa, Mycobacterium
AETFPGAQILAAFGQTE

SEQ ID NO: 1289005 - protein, 20 aa, Mycobacterium
AEVVRTWLLDHERTWVAVDF

SEQ ID NO: 1289006 - protein, 24 aa, Mycobacterium
AFHPDRFRYAGSMSGFMTPSATTL

SEQ ID NO: 1289007 - protein, 17 aa, Mycobacterium
AFIPRSVWQRMGDDFLA

SEQ ID NO: 1289008 - protein, 18 aa, Mycobacterium
AFRIPELIRWPGKIEPRS

SEQ ID NO: 1289009 - protein, 19 aa, Mycobacterium
AGDDWLCLLEAFDQPHRSG

SEQ ID NO: 1289010 - protein, 20 aa, Mycobacterium
AGDITVFWRLAATSGGSVGS

SEQ ID NO: 1289011 - protein, 18 aa, Mycobacterium
AGGAVGWIAVQLAREAGA

SEQ ID NO: 1289012 - protein, 17 aa, Mycobacterium
AGGMGVLGCVRFNDSDD

SEQ ID NO: 1289013 - protein, 24 aa, Mycobacterium
AGHLRAGVIVRVWHGVYSLGPPDT

SEQ ID NO: 1289014 - protein, 19 aa, Mycobacterium
AGLKSPLPHPWRPADSSNE

SEQ ID NO: 1289015 - protein, 17 aa, Mycobacterium
AGNRVRYALVVSVETAE

SEQ ID NO: 1289016 - protein, 17 aa, Mycobacterium
AGPRLRTLITYDPDLSR

SEQ ID NO: 1289017 - protein, 23 aa, Mycobacterium
AGSLRPGDLAVWDGHVAMIVGDG

SEQ ID NO: 1289018 - protein, 17 aa, Mycobacterium
AHPGLEAKLVRGIAWTE

SEQ ID NO: 1289019 - protein, 18 aa, Mycobacterium
AKGAWLWSGRDAVAVGLS

SEQ ID NO: 1289020 - protein, 22 aa, Mycobacterium
AKLAELQRLWLIEAVKYDVLPI

SEQ ID NO: 1289021 - protein, 20 aa, Mycobacterium
AKLRCERCSWVVALNRGTVE

SEQ ID NO: 1289022 - protein, 17 aa, Mycobacterium
AKLRMARLVRTRREGTT

SEQ ID NO: 1289023 - protein, 20 aa, Mycobacterium
AKWKLAIVLEQGFQRAGDDE

SEQ ID NO: 1289024 - protein, 19 aa, Mycobacterium
ALAALVFWRLIALGKPVSA

SEQ ID NO: 1289025 - protein, 17 aa, Mycobacterium
ALAHHWNIPQARPHDAL

SEQ ID NO: 1289026 - protein, 17 aa, Mycobacterium
ALARAAFQLGVLERALE

SEQ ID NO: 1289027 - protein, 17 aa, Mycobacterium
ALARAGLDLADIDLIEL

SEQ ID NO: 1289028 - protein, 17 aa, Mycobacterium
ALARFTLQVGRPVGPML

SEQ ID NO: 1289029 - protein, 18 aa, Mycobacterium
ALHFPWKINAGVTAVDLM

SEQ ID NO: 1289030 - protein, 20 aa, Mycobacterium
ALHRRWWAADGLGAFVTVSG

SEQ ID NO: 1289031 - protein, 20 aa, Mycobacterium
ALLRFPARFFTTAPVSRVAA

SEQ ID NO: 1289032 - protein, 18 aa, Mycobacterium
ALNAGFLWACSGYYNYDK

SEQ ID NO: 1289033 - protein, 23 aa, Mycobacterium
ALPRLEPGVALPCCRQTVHRGVV

SEQ ID NO: 1289034 - protein, 19 aa, Mycobacterium
ALRRAGLDPADWDVTGITA

SEQ ID NO: 1289035 - protein, 23 aa, Mycobacterium
ALSALRPGPIHFLRRMKEDLVDY

SEQ ID NO: 1289036 - protein, 18 aa, Mycobacterium
ALSARPGIVLSRRQLLEI

SEQ ID NO: 1289037 - protein, 17 aa, Mycobacterium
ALVLGDWPETPAGDLPA

SEQ ID NO: 1289038 - protein, 19 aa, Mycobacterium
ALWELPRAAAILMKLYRNA

SEQ ID NO: 1289039 - protein, 17 aa, Mycobacterium
ALYPEWDVFNDRYKPDW

SEQ ID NO: 1289040 - protein, 20 aa, Mycobacterium
ANLKCLCRKHHLLKTFWTGE

SEQ ID NO: 1289041 - protein, 17 aa, Mycobacterium
APDRLRWVIGEAGKAIE

SEQ ID NO: 1289042 - protein, 19 aa, Mycobacterium
APGHPMLRVDRLYSDDADR

SEQ ID NO: 1289043 - protein, 23 aa, Mycobacterium
APIRRGVVVAGRIGIDDVAPVVS

SEQ ID NO: 1289044 - protein, 17 aa, Mycobacterium
APPRFAEEIAWWVWWCW

SEQ ID NO: 1289045 - protein, 17 aa, Mycobacterium
APQLKPEVWAVAFDPDS

SEQ ID NO: 1289046 - protein, 23 aa, Mycobacterium
APRWDTAIIGLDWETTVLDERLA

SEQ ID NO: 1289047 - protein, 19 aa, Mycobacterium
AQFMAVFGLYAQRIDQVLD

SEQ ID NO: 1289048 - protein, 18 aa, Mycobacterium
AQIPHPWFDLIFAGGHEK

SEQ ID NO: 1289049 - protein, 25 aa, Mycobacterium
AQLDRFAIRLELRYLSGPDEVTMLR

SEQ ID NO: 1289050 - protein, 17 aa, Mycobacterium
AQLRRSGTLTGRHLDDR

SEQ ID NO: 1289051 - protein, 19 aa, Mycobacterium
AQRAGLMGAFVIGLATTRY

SEQ ID NO: 1289052 - protein, 18 aa, Mycobacterium
ARAAMPVPAGWSGTEHLD

SEQ ID NO: 1289053 - protein, 18 aa, Mycobacterium
ARAAVRIVRRVTGRRYTI

SEQ ID NO: 1289054 - protein, 24 aa, Mycobacterium
ARDYPRLVAELGLDDTVLAELVGG

SEQ ID NO: 1289055 - protein, 22 aa, Mycobacterium
ARFPELSTWRCNLRELREWPPE

SEQ ID NO: 1289056 - protein, 21 aa, Mycobacterium
ARGAFHADWFLRRILAAEERI

SEQ ID NO: 1289057 - protein, 17 aa, Mycobacterium
ARIVLCSSVSGLWGGHG

SEQ ID NO: 1289058 - protein, 17 aa, Mycobacterium
ARLGHSVAFFIGTAYGS

SEQ ID NO: 1289059 - protein, 17 aa, Mycobacterium
ARNHVFQLYAYVQSQHG

SEQ ID NO: 1289060 - protein, 17 aa, Mycobacterium
ARQLWFDRILPLAENIR

SEQ ID NO: 1289061 - protein, 21 aa, Mycobacterium
ARQRTGVGISRLISAGNEATI

SEQ ID NO: 1289062 - protein, 17 aa, Mycobacterium
ARRELRLYLNVEVGTHL

SEQ ID NO: 1289063 - protein, 19 aa, Mycobacterium
ARRRWLMQHVRAGVVQTSD

SEQ ID NO: 1289064 - protein, 18 aa, Mycobacterium
ARSALMLSATRDLPALGA

SEQ ID NO: 1289065 - protein, 24 aa, Mycobacterium
ARVRLRGGAVLVELADRFGEAVAA

SEQ ID NO: 1289066 - protein, 19 aa, Mycobacterium
ARVSAGHRCPGWLTRSWTS

SEQ ID NO: 1289067 - protein, 25 aa, Mycobacterium
ARYTWPRFVCGLPREFFAAVRAEMS

SEQ ID NO: 1289068 - protein, 19 aa, Mycobacterium
ASDLFYVWIKRALAGSWPE

SEQ ID NO: 1289069 - protein, 33 aa, Mycobacterium
ASLAHRCAVAMPWEWRQANAFSEQERLKVAARH

SEQ ID NO: 1289070 - protein, 20 aa, Mycobacterium
ASLPGLQTGEAWVWSPAFLR

SEQ ID NO: 1289071 - protein, 17 aa, Mycobacterium
ASLTPWLSVGELIAERL

SEQ ID NO: 1289072 - protein, 23 aa, Mycobacterium
ASPKETWLRLLLIDNGYDSLTTQ

SEQ ID NO: 1289073 - protein, 17 aa, Mycobacterium
ASVVLKFQKDLGIPDEK

SEQ ID NO: 1289074 - protein, 18 aa, Mycobacterium
ASYWRRWSTLTSVVLQVE

SEQ ID NO: 1289075 - protein, 18 aa, Mycobacterium
ATPVKEFMRTAAADTEVR

SEQ ID NO: 1289076 - protein, 17 aa, Mycobacterium
ATQRAKAAWLWSRRHGV

SEQ ID NO: 1289077 - protein, 17 aa, Mycobacterium
ATRGDGRIVFWFTPSTH

SEQ ID NO: 1289078 - protein, 23 aa, Mycobacterium
AVERQGLPYGWALTSSGRLSGVT

SEQ ID NO: 1289079 - protein, 17 aa, Mycobacterium
AVIIQFVVKTVVGMLDW

SEQ ID NO: 1289080 - protein, 19 aa, Mycobacterium
AVLARLDGIRGWQEDCYRD

SEQ ID NO: 1289081 - protein, 22 aa, Mycobacterium
AVNLYERFLWRLFSKDYSLFER

SEQ ID NO: 1289082 - protein, 23 aa, Mycobacterium
AVQRIVDHWAMFDTVRFGLNLVV

SEQ ID NO: 1289083 - protein, 17 aa, Mycobacterium
AVRLGLRKELEAIADDA

SEQ ID NO: 1289084 - protein, 24 aa, Mycobacterium
AVVHPSWWSRRRVQAVLDAAGDIC

SEQ ID NO: 1289085 - protein, 18 aa, Mycobacterium
AWGWLPLLTGVAVRDAVA

SEQ ID NO: 1289086 - protein, 18 aa, Mycobacterium
AYGRLTVVTIHFAAQTPL

SEQ ID NO: 1289087 - protein, 22 aa, Mycobacterium
AYLRATFDWHIDGCTPTGDEYP

SEQ ID NO: 1289088 - protein, 24 aa, Mycobacterium
CAAPTRMLLPRSRYDEGVALLKAL

SEQ ID NO: 1289089 - protein, 17 aa, Mycobacterium
CAQYLGPALRLLNFNNI

SEQ ID NO: 1289090 - protein, 19 aa, Mycobacterium
CAWTPEMVEQFGPAKRDSV

SEQ ID NO: 1289091 - protein, 19 aa, Mycobacterium
CDAYHDFLFAVPWADGVAV

SEQ ID NO: 1289092 - protein, 20 aa, Mycobacterium
CDPPWYRPLLGVRRAATAAA

SEQ ID NO: 1289093 - protein, 19 aa, Mycobacterium
CDVRRGSAVSLPFRDRSIS

SEQ ID NO: 1289094 - protein, 24 aa, Mycobacterium
CFACARCVACLGCARCSNCVGCVG

SEQ ID NO: 1289095 - protein, 17 aa, Mycobacterium
CGDCPRVVLGSPLAGES

SEQ ID NO: 1289096 - protein, 19 aa, Mycobacterium
CGDCPRVVLGSPLAGESLD

SEQ ID NO: 1289097 - protein, 20 aa, Mycobacterium
CGHCAFCDRGRYAACEPRYA

SEQ ID NO: 1289098 - protein, 20 aa, Mycobacterium
CGSTSRLLLHEAIADEVIDL

SEQ ID NO: 1289099 - protein, 18 aa, Mycobacterium
CIACGAIRTPGLEADAKR

SEQ ID NO: 1289100 - protein, 18 aa, Mycobacterium
CIWYFLRPGGAPVVVVAD

SEQ ID NO: 1289101 - protein, 19 aa, Mycobacterium
CLCRLHHLLKTFGGWKDQQ

SEQ ID NO: 1289102 - protein, 22 aa, Mycobacterium
CLVEKLRTAFGLEIPGLAVPVE

SEQ ID NO: 1289103 - protein, 20 aa, Mycobacterium
CMGGGMVWRLLAAGEPRLAA

SEQ ID NO: 1289104 - protein, 22 aa, Mycobacterium
CQECSRPFPLIGRLNLRQPSTR

SEQ ID NO: 1289105 - protein, 17 aa, Mycobacterium
CRSFALWAVGLMYSATG

SEQ ID NO: 1289106 - protein, 23 aa, Mycobacterium
CSEFLPGGMIFHWLSPVDLTGQW

SEQ ID NO: 1289107 - protein, 17 aa, Mycobacterium
CTASGPALRVSHSTTVC

SEQ ID NO: 1289108 - protein, 18 aa, Mycobacterium
DAAASWRPFQLAFILLQI

SEQ ID NO: 1289109 - protein, 17 aa, Mycobacterium
DAGLSWVHFPEGLGGLG

SEQ ID NO: 1289110 - protein, 22 aa, Mycobacterium
DAKWASSISGYWRRGRTEETFR

SEQ ID NO: 1289111 - protein, 17 aa, Mycobacterium
DALLRVLEPYGVRELVQ

SEQ ID NO: 1289112 - protein, 24 aa, Mycobacterium
DARFRDALFPVWRYHPFFTNTDLP

SEQ ID NO: 1289113 - protein, 20 aa, Mycobacterium
DATHFVRWLSLWSATIDDMY

SEQ ID NO: 1289114 - protein, 23 aa, Mycobacterium
DAYACAGCGTLLAVEIRAHEDEP

SEQ ID NO: 1289115 - protein, 17 aa, Mycobacterium
DCPRVVLGSPLAGESLD

SEQ ID NO: 1289116 - protein, 19 aa, Mycobacterium
DDVWLPLFRPVAGDPGELP

SEQ ID NO: 1289117 - protein, 24 aa, Mycobacterium
DEARRVSIPAGWTMAVWARVPKAR

SEQ ID NO: 1289118 - protein, 20 aa, Mycobacterium
DEIKSRILAMAAPDEHGNRP

SEQ ID NO: 1289119 - protein, 24 aa, Mycobacterium
DELRRYQMQSGFVFQSHNLFPHKT

SEQ ID NO: 1289120 - protein, 17 aa, Mycobacterium
DEPFKWVAPQLISPNGG

SEQ ID NO: 1289121 - protein, 17 aa, Mycobacterium
DERAKWATFPMLALHGW

SEQ ID NO: 1289122 - protein, 18 aa, Mycobacterium
DESVRVFLATGISEIDRP

SEQ ID NO: 1289123 - protein, 20 aa, Mycobacterium
DEVAACYPFHPMLMALAKDE

SEQ ID NO: 1289124 - protein, 23 aa, Mycobacterium
DEVLRLAPNVWPRNAVRGADGVV

SEQ ID NO: 1289125 - protein, 19 aa, Mycobacterium
DFIEACAWIKENLPGVHIS

SEQ ID NO: 1289126 - protein, 18 aa, Mycobacterium
DGGRAALVLGDWPETPAG

SEQ ID NO: 1289127 - protein, 22 aa, Mycobacterium
DGKCLRSTFAYLGWLAGAAPDD

SEQ ID NO: 1289128 - protein, 21 aa, Mycobacterium
DGKRAGLWPGLKETFNSGSTE

SEQ ID NO: 1289129 - protein, 19 aa, Mycobacterium
DGLCERLREQGVRLIYDEP

SEQ ID NO: 1289130 - protein, 17 aa, Mycobacterium
DGLGYRGFWMGYFAARS

SEQ ID NO: 1289131 - protein, 17 aa, Mycobacterium
DGLRAGQWVDVYDLAVG

SEQ ID NO: 1289132 - protein, 24 aa, Mycobacterium
DGLRRFGDRWVRWGDTIADKIEAA

SEQ ID NO: 1289133 - protein, 20 aa, Mycobacterium
DGRLDEWLGLLAPDVRYTMP

SEQ ID NO: 1289134 - protein, 20 aa, Mycobacterium
DGRWYWHWDPAFLTKPGDDP

SEQ ID NO: 1289135 - protein, 20 aa, Mycobacterium
DGSVSWAPVWARYGTNNRSC

SEQ ID NO: 1289136 - protein, 21 aa, Mycobacterium
DGTRLAEHWQLLPSGVAGFHE

SEQ ID NO: 1289137 - protein, 23 aa, Mycobacterium
DGWPNQRFALLFPAWLAAHPEVR

SEQ ID NO: 1289138 - protein, 18 aa, Mycobacterium
DHTVPWPAGPTCAANLKC

SEQ ID NO: 1289139 - protein, 22 aa, Mycobacterium
DHVAGRPYGLWVHGNNDTVGAV

SEQ ID NO: 1289140 - protein, 22 aa, Mycobacterium
DIFSIRIPKPWFVLMPTPVWDQ

SEQ ID NO: 1289141 - protein, 19 aa, Mycobacterium
DIHPSMRLRIEHYLQHRDS

SEQ ID NO: 1289142 - protein, 19 aa, Mycobacterium
DKLDLRSGITFNTKVTSAV

SEQ ID NO: 1289143 - protein, 17 aa, Mycobacterium
DKLSLPFTERWSTQGRQ

SEQ ID NO: 1289144 - protein, 22 aa, Mycobacterium
DLGKRFRRVLGRTVPLATLLGG

SEQ ID NO: 1289145 - protein, 19 aa, Mycobacterium
DLIPLRLAIPAQFRAEGDP

SEQ ID NO: 1289146 - protein, 18 aa, Mycobacterium
DLLVASLHRWLSACETDA

SEQ ID NO: 1289147 - protein, 18 aa, Mycobacterium
DLMDLHFFGPAALVRAAL

SEQ ID NO: 1289148 - protein, 18 aa, Mycobacterium
DLREDWPAALRVAGFDSA

SEQ ID NO: 1289149 - protein, 23 aa, Mycobacterium
DLRVGPHPGWRIEVDGADVTVHA

SEQ ID NO: 1289150 - protein, 18 aa, Mycobacterium
DPDECVRLAAAVVEQTGR

SEQ ID NO: 1289151 - protein, 29 aa, Mycobacterium
DPDTGLPRLGWRTPPLGGFRADPDAPIVF

SEQ ID NO: 1289152 - protein, 23 aa, Mycobacterium
DPQHRLFLQTAWHAMEDAGCDPA

SEQ ID NO: 1289153 - protein, 20 aa, Mycobacterium
DPRAAAIVDRCESMSPEAML

SEQ ID NO: 1289154 - protein, 18 aa, Mycobacterium
DPRMMVAVLLYGYTVGVC

SEQ ID NO: 1289155 - protein, 18 aa, Mycobacterium
DPVKGFFRALDFTLPWDV

SEQ ID NO: 1289156 - protein, 19 aa, Mycobacterium
DRHRFGCTVSRAAWNPTQS

SEQ ID NO: 1289157 - protein, 17 aa, Mycobacterium
DRLKAELDQLIANRPVI

SEQ ID NO: 1289158 - protein, 21 aa, Mycobacterium
DSEPGRPLWPMIILRTPKGWT

SEQ ID NO: 1289159 - protein, 24 aa, Mycobacterium
DSERRIALALARMVPGAREVRIGA

SEQ ID NO: 1289160 - protein, 19 aa, Mycobacterium
DSFQLFPNFVVLFWGQGWY

SEQ ID NO: 1289161 - protein, 22 aa, Mycobacterium
DSRAYRLPWPDGTVVYEIDQPA

SEQ ID NO: 1289162 - protein, 20 aa, Mycobacterium
DSRGRTGIVITELPYQVNHD

SEQ ID NO: 1289163 - protein, 18 aa, Mycobacterium
DSTHWWKHICTRTDVAIG

SEQ ID NO: 1289164 - protein, 18 aa, Mycobacterium
DTPWWAHDIWDLRADPRI

SEQ ID NO: 1289165 - protein, 22 aa, Mycobacterium
DVPWFPKDVDHWSVRWVALHLT

SEQ ID NO: 1289166 - protein, 19 aa, Mycobacterium
DVVNYLRWFTFLEAGELAE

SEQ ID NO: 1289167 - protein, 18 aa, Mycobacterium
DYLRLADAFAQFGNGAPV

SEQ ID NO: 1289168 - protein, 19 aa, Mycobacterium
EAGLHWRQIQLVAGADTIR

SEQ ID NO: 1289169 - protein, 18 aa, Mycobacterium
EAMVAAWVAGVDREIVAT

SEQ ID NO: 1289170 - protein, 19 aa, Mycobacterium
EANVALSRWGMLAPDGQCK

SEQ ID NO: 1289171 - protein, 19 aa, Mycobacterium
EARIKLADMRSGRMSDDDW

SEQ ID NO: 1289172 - protein, 18 aa, Mycobacterium
EASKLYLTQMVKHHEGAI

SEQ ID NO: 1289173 - protein, 22 aa, Mycobacterium
EASRLFLTQMIEHHKGAITMAQ

SEQ ID NO: 1289174 - protein, 18 aa, Mycobacterium
EASWLPGQVQVFIHGEAQ

SEQ ID NO: 1289175 - protein, 18 aa, Mycobacterium
EAVLSHFVAQIDAEESAD

SEQ ID NO: 1289176 - protein, 20 aa, Mycobacterium
EAYPQVLIRLGWAPADGTAL

SEQ ID NO: 1289177 - protein, 21 aa, Mycobacterium
EDYREAIALSRLGWAALAVGT

SEQ ID NO: 1289178 - protein, 24 aa, Mycobacterium
EFGFDPRGGFGFGPGPRGRRGGGR

SEQ ID NO: 1289179 - protein, 18 aa, Mycobacterium
EFLALKVEGVLDCAELLV

SEQ ID NO: 1289180 - protein, 18 aa, Mycobacterium
EGGGRYWGRHGAAGLLLR

SEQ ID NO: 1289181 - protein, 18 aa, Mycobacterium
EGLEIPLLIGGATTSRAH

SEQ ID NO: 1289182 - protein, 20 aa, Mycobacterium
EGLIAWSRERMAGFKVPRYV

SEQ ID NO: 1289183 - protein, 19 aa, Mycobacterium
EGSWKKVLITALRVSGAEA

SEQ ID NO: 1289184 - protein, 17 aa, Mycobacterium
EGYWRLQGPNLWPAQPP

SEQ ID NO: 1289185 - protein, 20 aa, Mycobacterium
EHHPHLLPLAGRVLEATDAE

SEQ ID NO: 1289186 - protein, 20 aa, Mycobacterium
EHIPCWLITDIRSFHRYVVG

SEQ ID NO: 1289187 - protein, 18 aa, Mycobacterium
EHPRPGWVGQRLPYQQAR

SEQ ID NO: 1289188 - protein, 20 aa, Mycobacterium
EIAEGWQPVFFYPEKADAVW

SEQ ID NO: 1289189 - protein, 19 aa, Mycobacterium
EIDAACELIDFWRFNVAFA

SEQ ID NO: 1289190 - protein, 17 aa, Mycobacterium
ELADRFATIAARVLGPG

SEQ ID NO: 1289191 - protein, 18 aa, Mycobacterium
ELAYREASGWGHPVQPGL

SEQ ID NO: 1289192 - protein, 18 aa, Mycobacterium
ELDWPATWLDRAGRDRAP

SEQ ID NO: 1289193 - protein, 19 aa, Mycobacterium
ELFVTCAQAAFAHRYDPLL

SEQ ID NO: 1289194 - protein, 19 aa, Mycobacterium
ELIGPALEDWAKWGQARHD

SEQ ID NO: 1289195 - protein, 20 aa, Mycobacterium
ELNPRLQTFRDWLAGHRDEI

SEQ ID NO: 1289196 - protein, 21 aa, Mycobacterium
ELRQRIGMVFQQFNLFPHRSV

SEQ ID NO: 1289197 - protein, 21 aa, Mycobacterium
ELRVLRLDTEYAWAEDPPSRI

SEQ ID NO: 1289198 - protein, 17 aa, Mycobacterium
EMEREGLEIPLLIGGAT

SEQ ID NO: 1289199 - protein, 23 aa, Mycobacterium
EPFDAVVCSLVLCSVDDPDGVLR

SEQ ID NO: 1289200 - protein, 21 aa, Mycobacterium
EPRLWNMWTVLPILQDTTIVA

SEQ ID NO: 1289201 - protein, 17 aa, Mycobacterium
EPTVLPAQWPVLLCNGA

SEQ ID NO: 1289202 - protein, 19 aa, Mycobacterium
EQFFPAFGSMTFDDSVQEG

SEQ ID NO: 1289203 - protein, 19 aa, Mycobacterium
EQPRLLIKWVEACYGATSV

SEQ ID NO: 1289204 - protein, 21 aa, Mycobacterium
ERARYRAHWLVARTAEHIGGW

SEQ ID NO: 1289205 - protein, 20 aa, Mycobacterium
EREGLEIPLLIGGATTSRAH

SEQ ID NO: 1289206 - protein, 17 aa, Mycobacterium
ERLREQGVRLIYDEPRR

SEQ ID NO: 1289207 - protein, 23 aa, Mycobacterium
ERNRPLLELSWDYVMDGDEPSGE

SEQ ID NO: 1289208 - protein, 23 aa, Mycobacterium
ERTPEDWLFKACVGDDFVIDVLH

SEQ ID NO: 1289209 - protein, 17 aa, Mycobacterium
ERWDFRTGGGYRYVHSD

SEQ ID NO: 1289210 - protein, 19 aa, Mycobacterium
ERYGQCVAAVIARREGATL

SEQ ID NO: 1289211 - protein, 24 aa, Mycobacterium
ESPKETWLRLLIVRAGFPRPETQL

SEQ ID NO: 1289212 - protein, 18 aa, Mycobacterium
ETEVWRWYLIDKNAPDDV

SEQ ID NO: 1289213 - protein, 22 aa, Mycobacterium
ETNVEFWAAVILDFAQVPASMM

SEQ ID NO: 1289214 - protein, 20 aa, Mycobacterium
ETPCAVVAFASWPEEIVLRG

SEQ ID NO: 1289215 - protein, 20 aa, Mycobacterium
ETRSIAGFFSFDPVRAEVSA

SEQ ID NO: 1289216 - protein, 18 aa, Mycobacterium
ETWLRLLLIDAGFPRPTT

SEQ ID NO: 1289217 - protein, 20 aa, Mycobacterium
EVALKHPIKLIANALGSPPK

SEQ ID NO: 1289218 - protein, 21 aa, Mycobacterium
EVLGFCALLLVAGYETTTNLL

SEQ ID NO: 1289219 - protein, 22 aa, Mycobacterium
EVPLKRFDLMNGIQVRGTYAVT

SEQ ID NO: 1289220 - protein, 20 aa, Mycobacterium
EVPRIAAALADFDEVEIDTD

SEQ ID NO: 1289221 - protein, 19 aa, Mycobacterium
EVVHRIRCAAGAFADLGIG

SEQ ID NO: 1289222 - protein, 24 aa, Mycobacterium
EWLARGGVMLPIYQREAMWLSFDA

SEQ ID NO: 1289223 - protein, 21 aa, Mycobacterium
EWPDHPFALGVHWHPEDPLMH

SEQ ID NO: 1289224 - protein, 17 aa, Mycobacterium
EYLEPRWMIGIDPESEG

SEQ ID NO: 1289225 - protein, 23 aa, Mycobacterium
EYRSWPVWAHDAAMIYTPGRDDT

SEQ ID NO: 1289226 - protein, 21 aa, Mycobacterium
EYYTPFGWLRGFPFLAVQVVW

SEQ ID NO: 1289227 - protein, 20 aa, Mycobacterium
FAAGRLSYFLGVRGPAVVVD

SEQ ID NO: 1289228 - protein, 17 aa, Mycobacterium
FADKGWSKNVWDTIGAT

SEQ ID NO: 1289229 - protein, 17 aa, Mycobacterium
FAGIDPWRSPAGPVPEY

SEQ ID NO: 1289230 - protein, 17 aa, Mycobacterium
FALSEGGIGWVPYFLER

SEQ ID NO: 1289231 - protein, 19 aa, Mycobacterium
FAREKWTRILIPWRHESSH

SEQ ID NO: 1289232 - protein, 21 aa, Mycobacterium
FARRFGVTVVDGFGSTEGGVA

SEQ ID NO: 1289233 - protein, 24 aa, Mycobacterium
FDARTRFALWWVRLYGRGVQAKSE

SEQ ID NO: 1289234 - protein, 19 aa, Mycobacterium
FDEVARLGAQVTIFRLGTD

SEQ ID NO: 1289235 - protein, 18 aa, Mycobacterium
FDGRIITVPFSFKEIDSE

SEQ ID NO: 1289236 - protein, 18 aa, Mycobacterium
FDSPGRWGGPPGTPFPRQ

SEQ ID NO: 1289237 - protein, 18 aa, Mycobacterium
FDYYPLRVVRELPDGACE

SEQ ID NO: 1289238 - protein, 18 aa, Mycobacterium
FEALAGFRPVARTVDLMR

SEQ ID NO: 1289239 - protein, 21 aa, Mycobacterium
FEFRAGPVFTNLLLADEINRT

SEQ ID NO: 1289240 - protein, 21 aa, Mycobacterium
FEIKDTWFAMGLKGTGSQDIS

SEQ ID NO: 1289241 - protein, 20 aa, Mycobacterium
FEIPGLPPIMLPWPPPPPPP

SEQ ID NO: 1289242 - protein, 17 aa, Mycobacterium
FEPRLPAGYADLAAHWP

SEQ ID NO: 1289243 - protein, 20 aa, Mycobacterium
FERLCKQIPLAAPWTAPAAH

SEQ ID NO: 1289244 - protein, 18 aa, Mycobacterium
FESARRCGATTFVELSAH

SEQ ID NO: 1289245 - protein, 20 aa, Mycobacterium
FEVNEAFAPVVLAWAQDTGA

SEQ ID NO: 1289246 - protein, 21 aa, Mycobacterium
FEVNEAFAPVVLAWARDTGAD

SEQ ID NO: 1289247 - protein, 17 aa, Mycobacterium
FFMRDVRSAQYFEQMKG

SEQ ID NO: 1289248 - protein, 17 aa, Mycobacterium
FGADLPPLAGIYLAAFG

SEQ ID NO: 1289249 - protein, 17 aa, Mycobacterium
FGAEIRTHYPLQLDAEV

SEQ ID NO: 1289250 - protein, 17 aa, Mycobacterium
FGDRELRSPLVLVPVRL

SEQ ID NO: 1289251 - protein, 17 aa, Mycobacterium
FGTEWEKWHSGAGQVVR

SEQ ID NO: 1289252 - protein, 18 aa, Mycobacterium
FGYNVVRDFTGHGIGTTF

SEQ ID NO: 1289253 - protein, 17 aa, Mycobacterium
FKACVGDDFVIDVLHAL

SEQ ID NO: 1289254 - protein, 19 aa, Mycobacterium
FKLGWSRRLAPLMRRWALR

SEQ ID NO: 1289255 - protein, 17 aa, Mycobacterium
FLQRLFAGIKPRHRQQL

SEQ ID NO: 1289256 - protein, 18 aa, Mycobacterium
FLVDCGRGVQLRMAAAGI

SEQ ID NO: 1289257 - protein, 25 aa, Mycobacterium
FNDRYKPDWCRVINFPLTVAADVSD

SEQ ID NO: 1289258 - protein, 17 aa, Mycobacterium
FPPEPLASIGINATRWS

SEQ ID NO: 1289259 - protein, 18 aa, Mycobacterium
FPPFPFNVVFAMLRGQVS

SEQ ID NO: 1289260 - protein, 17 aa, Mycobacterium
FQLFRIMFEVIRGGGLD

SEQ ID NO: 1289261 - protein, 17 aa, Mycobacterium
FRFVEEMIRLGADARTD

SEQ ID NO: 1289262 - protein, 17 aa, Mycobacterium
FRNPFRLTFTPDGKLLV

SEQ ID NO: 1289263 - protein, 18 aa, Mycobacterium
FRNTIHWRVTRYDEPKEI

SEQ ID NO: 1289264 - protein, 21 aa, Mycobacterium
FSDPRIVRVWWRLTPREQEIL

SEQ ID NO: 1289265 - protein, 19 aa, Mycobacterium
FSTYATWWIRQAITRAMAD

SEQ ID NO: 1289266 - protein, 25 aa, Mycobacterium
FTLFPRIIVSMAWLPGPRAQRQLRD

SEQ ID NO: 1289267 - protein, 19 aa, Mycobacterium
FTRVVFNWIAKVTGVGGAE

SEQ ID NO: 1289268 - protein, 17 aa, Mycobacterium
FTTIAWRMAHVIVGVFA

SEQ ID NO: 1289269 - protein, 17 aa, Mycobacterium
FVACDGALWAVKELPPR

SEQ ID NO: 1289270 - protein, 25 aa, Mycobacterium
FWASWCGPCRSFAPVFDRSSQTHPD

SEQ ID NO: 1289271 - protein, 17 aa, Mycobacterium
FWISHGVKVFRVDNPHT

SEQ ID NO: 1289272 - protein, 19 aa, Mycobacterium
FWPDFPVDGLYKFRIHGAD

SEQ ID NO: 1289273 - protein, 17 aa, Mycobacterium
GAAFARLVADGATQIVI

SEQ ID NO: 1289274 - protein, 19 aa, Mycobacterium
GADGLKELFVTCAQAAFAH

SEQ ID NO: 1289275 - protein, 20 aa, Mycobacterium
GALSEWRATLIVRESACLSV

SEQ ID NO: 1289276 - protein, 24 aa, Mycobacterium
GALSEWRATLIVRESACLSVEHRR

SEQ ID NO: 1289277 - protein, 19 aa, Mycobacterium
GAPAWLRFFGVNPRHHSLA

SEQ ID NO: 1289278 - protein, 21 aa, Mycobacterium
GARRWVRMPGVHFGPDSCRFR

SEQ ID NO: 1289279 - protein, 17 aa, Mycobacterium
GAVLFKDFLALHFSQTR

SEQ ID NO: 1289280 - protein, 17 aa, Mycobacterium
GAWRPVDGVAIANERYA

SEQ ID NO: 1289281 - protein, 23 aa, Mycobacterium
GCTHPHCTVPFYWTEAHHTRDYA

SEQ ID NO: 1289282 - protein, 20 aa, Mycobacterium
GDAIKGCFDCRGVGHRFVKV

SEQ ID NO: 1289283 - protein, 21 aa, Mycobacterium
GDLARAFWRRMIDNVEQYLDE

SEQ ID NO: 1289284 - protein, 17 aa, Mycobacterium
GDPPKTAWLFTGQGSQY

SEQ ID NO: 1289285 - protein, 25 aa, Mycobacterium
GDVGRPDLLASIGFTREELADKLYD

SEQ ID NO: 1289286 - protein, 17 aa, Mycobacterium
GDVMAGWDGASTGAADT

SEQ ID NO: 1289287 - protein, 19 aa, Mycobacterium
GDVRGRWIVNAAGLGADAL

SEQ ID NO: 1289288 - protein, 22 aa, Mycobacterium
GEASRFGFVFTRRGVVPESASS

SEQ ID NO: 1289289 - protein, 18 aa, Mycobacterium
GEGGFGYDPVFLPEDSDR

SEQ ID NO: 1289290 - protein, 19 aa, Mycobacterium
GEGPRWFEGLLWFSDMFGE

SEQ ID NO: 1289291 - protein, 17 aa, Mycobacterium
GELGLDCQIIRNRGALM

SEQ ID NO: 1289292 - protein, 20 aa, Mycobacterium
GELSVGGWAARVDHIVDVSE

SEQ ID NO: 1289293 - protein, 18 aa, Mycobacterium
GEPYRIAPTVAFEDLDDG

SEQ ID NO: 1289294 - protein, 17 aa, Mycobacterium
GEWLDWFAAERITAIGM

SEQ ID NO: 1289295 - protein, 17 aa, Mycobacterium
GEWTIRFFMPSKWTMDT

SEQ ID NO: 1289296 - protein, 23 aa, Mycobacterium
GFDVSPRLAAAISDSRAELSGDT

SEQ ID NO: 1289297 - protein, 18 aa, Mycobacterium
GFVLMPWLAAEPEATLTV

SEQ ID NO: 1289298 - protein, 18 aa, Mycobacterium
GFYCGAHTQALLESSGAE

SEQ ID NO: 1289299 - protein, 19 aa, Mycobacterium
GGPAMPPPPMPLGPPPTPS

SEQ ID NO: 1289300 - protein, 24 aa, Mycobacterium
GGPDRWDFVAAYGRDGRVIAVLST

SEQ ID NO: 1289301 - protein, 23 aa, Mycobacterium
GGPRPCVVMCPGFGGTQDTPALV

SEQ ID NO: 1289302 - protein, 21 aa, Mycobacterium
GGRARCYGCGFQFAGTDDTAE

SEQ ID NO: 1289303 - protein, 20 aa, Mycobacterium
GGTPAKWARNWAERHPDVPL

SEQ ID NO: 1289304 - protein, 18 aa, Mycobacterium
GHCMGAVVAFEFARVAER

SEQ ID NO: 1289305 - protein, 22 aa, Mycobacterium
GHFEWLENLGFQFERSYYPGKV

SEQ ID NO: 1289306 - protein, 23 aa, Mycobacterium
GHFMDDFLLYWAFLSFALVRGGR

SEQ ID NO: 1289307 - protein, 18 aa, Mycobacterium
GHRCPGWLTRSWTSSTPP

SEQ ID NO: 1289308 - protein, 22 aa, Mycobacterium
GIPEQLRYAAMMDHKELLTAEP

SEQ ID NO: 1289309 - protein, 18 aa, Mycobacterium
GKALRPALSIAVCLGLGG

SEQ ID NO: 1289310 - protein, 18 aa, Mycobacterium
GKGDRVILMLGNQVELWE

SEQ ID NO: 1289311 - protein, 21 aa, Mycobacterium
GKHAASAFALWFPVETDHARY

SEQ ID NO: 1289312 - protein, 19 aa, Mycobacterium
GKHSLRWPRQATLVDAMIA

SEQ ID NO: 1289313 - protein, 21 aa, Mycobacterium
GKLGVPCRWPADAVTVCSFGD

SEQ ID NO: 1289314 - protein, 18 aa, Mycobacterium
GLADGIALWPWQRDFVDR

SEQ ID NO: 1289315 - protein, 24 aa, Mycobacterium
GLAPRIAVVKGRCFAGNAVIAGCA

SEQ ID NO: 1289316 - protein, 19 aa, Mycobacterium
GLASYLERICETWPRRQQP

SEQ ID NO: 1289317 - protein, 19 aa, Mycobacterium
GLLDVLTALAWVRDNIAAF

SEQ ID NO: 1289318 - protein, 32 aa, Mycobacterium
GLLRGGDSWMFVGWCRLREGIRGFHLDRIRHL

SEQ ID NO: 1289319 - protein, 23 aa, Mycobacterium
GLPDHGVVVLVDLGGSGSSISLA

SEQ ID NO: 1289320 - protein, 21 aa, Mycobacterium
GLQCGFCTPGMMITARALLDR

SEQ ID NO: 1289321 - protein, 18 aa, Mycobacterium
GLRSARRLGRRRPAPEEA

SEQ ID NO: 1289322 - protein, 18 aa, Mycobacterium
GLVPLHWALASLLADIGS

SEQ ID NO: 1289323 - protein, 21 aa, Mycobacterium
GMGGMSPFGQQGMGASPFGDP

SEQ ID NO: 1289324 - protein, 18 aa, Mycobacterium
GMPGRLKAVAALFPTVSR

SEQ ID NO: 1289325 - protein, 17 aa, Mycobacterium
GMTCGHCEMSVREEVSD

SEQ ID NO: 1289326 - protein, 20 aa, Mycobacterium
GMVWKYPDTFVVGREQIRQY

SEQ ID NO: 1289327 - protein, 18 aa, Mycobacterium
GNGLRPAIWDEFTNRFGI

SEQ ID NO: 1289328 - protein, 23 aa, Mycobacterium
GNLMKWPAVERVWLPEWLNHRDE

SEQ ID NO: 1289329 - protein, 23 aa, Mycobacterium
GPCVDCYRTGLPVSVADLTGAGQ

SEQ ID NO: 1289330 - protein, 24 aa, Mycobacterium
GPDGLRLAPHPGIGPGLALLDAPD

SEQ ID NO: 1289331 - protein, 24 aa, Mycobacterium
GPEFPEYWKMFLSAVADGDATGVL

SEQ ID NO: 1289332 - protein, 20 aa, Mycobacterium
GPKGRAGFVMANSAGDAGHS

SEQ ID NO: 1289333 - protein, 23 aa, Mycobacterium
GPRPRIALLDGLPMAGHIALSER

SEQ ID NO: 1289334 - protein, 19 aa, Mycobacterium
GPRPTLCVIHGFMGSAYLF

SEQ ID NO: 1289335 - protein, 18 aa, Mycobacterium
GPSATWRTLKTGYQTSVE

SEQ ID NO: 1289336 - protein, 18 aa, Mycobacterium
GPTAPSWRKGRYHIAGRG

SEQ ID NO: 1289337 - protein, 18 aa, Mycobacterium
GQGKLGFEVKIHRIAAEG

SEQ ID NO: 1289338 - protein, 17 aa, Mycobacterium
GQIPICWDPDREAAVAR

SEQ ID NO: 1289339 - protein, 24 aa, Mycobacterium
GRAKVLARYAVWLGEHRAEIEDLL

SEQ ID NO: 1289340 - protein, 17 aa, Mycobacterium
GRGGVRAALQGCRVPTI

SEQ ID NO: 1289341 - protein, 17 aa, Mycobacterium
GRIPLGYFDDAEATRRT

SEQ ID NO: 1289342 - protein, 20 aa, Mycobacterium
GRLKPGIIMCREKGDATSAN

SEQ ID NO: 1289343 - protein, 19 aa, Mycobacterium
GRMRIPWVPVDNARIARRH

SEQ ID NO: 1289344 - protein, 18 aa, Mycobacterium
GRPRTGLAALRMTTVDQL

SEQ ID NO: 1289345 - protein, 20 aa, Mycobacterium
GRPTVNMAVGFLPPQDMIEN

SEQ ID NO: 1289346 - protein, 28 aa, Mycobacterium
GRQQPRCRECWRPGKPTVLTSTRISPGT

SEQ ID NO: 1289347 - protein, 23 aa, Mycobacterium
GRRRISIYWTWSYPWEAQRNPAE

SEQ ID NO: 1289348 - protein, 24 aa, Mycobacterium
GRRTGLIWLRWFLPEATPARPQCR

SEQ ID NO: 1289349 - protein, 18 aa, Mycobacterium
GRVPPIWIGASGPRMLDL

SEQ ID NO: 1289350 - protein, 19 aa, Mycobacterium
GRVSYAFGIGHRAEEYRHF

SEQ ID NO: 1289351 - protein, 18 aa, Mycobacterium
GRVWTNCYHMYPAHAAFG

SEQ ID NO: 1289352 - protein, 23 aa, Mycobacterium
GRWGRATLEVCFAILQSAHEARE

SEQ ID NO: 1289353 - protein, 18 aa, Mycobacterium
GSELRRFLARWLGPAILY

SEQ ID NO: 1289354 - protein, 22 aa, Mycobacterium
GSEMPMRVIGMLVGMPDSLQRS

SEQ ID NO: 1289355 - protein, 18 aa, Mycobacterium
GTAYKWTVVFHHNEHTHP

SEQ ID NO: 1289356 - protein, 17 aa, Mycobacterium
GTHARIWAHGNLEAARA

SEQ ID NO: 1289357 - protein, 23 aa, Mycobacterium
GTYGRFLAIRVFDFWVHERDITT

SEQ ID NO: 1289358 - protein, 17 aa, Mycobacterium
GVDHLRKVVGWARDRGV

SEQ ID NO: 1289359 - protein, 17 aa, Mycobacterium
GVFCRRWGVPLIDGGTV

SEQ ID NO: 1289360 - protein, 17 aa, Mycobacterium
GVGWACLDMAVEYAKVR

SEQ ID NO: 1289361 - protein, 17 aa, Mycobacterium
GVMIARGLLQAGASVYL

SEQ ID NO: 1289362 - protein, 24 aa, Mycobacterium
GVPYRKFIRRYPALTLLVLVGHAA

SEQ ID NO: 1289363 - protein, 18 aa, Mycobacterium
GVRVWSLYVPNGRFVGSP

SEQ ID NO: 1289364 - protein, 19 aa, Mycobacterium
GVVFYPVIPAGSWVATTEF

SEQ ID NO: 1289365 - protein, 21 aa, Mycobacterium
GWLRGFPFLAVQVVWAPGSEM

SEQ ID NO: 1289366 - protein, 20 aa, Mycobacterium
GWQPDIWRGFAEELGILGAT

SEQ ID NO: 1289367 - protein, 18 aa, Mycobacterium
GWSKRIVMEYVDEMCLHL

SEQ ID NO: 1289368 - protein, 19 aa, Mycobacterium
GWYEHEWRAYGYGFPSAGA

SEQ ID NO: 1289369 - protein, 18 aa, Mycobacterium
HAMCFPKPAARVPIHIGG

SEQ ID NO: 1289370 - protein, 18 aa, Mycobacterium
HCSHWRFTLTADEPADGA

SEQ ID NO: 1289371 - protein, 23 aa, Mycobacterium
HDPARCLYCRQPLGDDARALVSK

SEQ ID NO: 1289372 - protein, 22 aa, Mycobacterium
HEQRMRDAISWCEKAAESITTA

SEQ ID NO: 1289373 - protein, 19 aa, Mycobacterium
HGEPEVWQRLLTAIRDAGL

SEQ ID NO: 1289374 - protein, 22 aa, Mycobacterium
HGFASFWWSWRHQLRGLGGARV

SEQ ID NO: 1289375 - protein, 17 aa, Mycobacterium
HGFKIAPAVGRLVADIV

SEQ ID NO: 1289376 - protein, 22 aa, Mycobacterium
HGISFLPTVGWAERGDLTATGH

SEQ ID NO: 1289377 - protein, 26 aa, Mycobacterium
HGKTPAQVLLRWSIQLGNVVIARSAN

SEQ ID NO: 1289378 - protein, 18 aa, Mycobacterium
HGVPRLKVASVRNALTNL

SEQ ID NO: 1289379 - protein, 17 aa, Mycobacterium
HGVPRVHRWARGVDITG

SEQ ID NO: 1289380 - protein, 17 aa, Mycobacterium
HHRCFPVLAGGPGDRDL

SEQ ID NO: 1289381 - protein, 23 aa, Mycobacterium
HLMPVKLKWGISLGALIMHLRES

SEQ ID NO: 1289382 - protein, 19 aa, Mycobacterium
HLRGSLTWDQGCEMAGHKQ

SEQ ID NO: 1289383 - protein, 21 aa, Mycobacterium
HNGVRRWLALDGQPLHRVIVA

SEQ ID NO: 1289384 - protein, 22 aa, Mycobacterium
HPEPELAAIIGRRIKAAQPEQA

SEQ ID NO: 1289385 - protein, 24 aa, Mycobacterium
HRGKEWLFRHLLHLVDPAIYPDPG

SEQ ID NO: 1289386 - protein, 24 aa, Mycobacterium
HRLARSLFLYGLCNGWICEGTTVI

SEQ ID NO: 1289387 - protein, 17 aa, Mycobacterium
HRMEVAWNPEFLREGKA

SEQ ID NO: 1289388 - protein, 17 aa, Mycobacterium
HRTAVTFSHRYEAAWHF

SEQ ID NO: 1289389 - protein, 24 aa, Mycobacterium
HRVQRGGNMLSVFFTAEPVGDFAT

SEQ ID NO: 1289390 - protein, 25 aa, Mycobacterium
HTIKATKLVAEWPIRDYIPDPDPIG

SEQ ID NO: 1289391 - protein, 17 aa, Mycobacterium
HTYELPLPPSLRARAEW

SEQ ID NO: 1289392 - protein, 18 aa, Mycobacterium
HVLAAFGLVGVRPVPLGS

SEQ ID NO: 1289393 - protein, 23 aa, Mycobacterium
HVPCAGLVIGAWPAQPGAAEIDN

SEQ ID NO: 1289394 - protein, 23 aa, Mycobacterium
HVPSRSPIAIGIITGAAARTRAT

SEQ ID NO: 1289395 - protein, 20 aa, Mycobacterium
IAAEFADGVVLWMASASAIA

SEQ ID NO: 1289396 - protein, 19 aa, Mycobacterium
IAAVRCFHGSPAALVELLE

SEQ ID NO: 1289397 - protein, 17 aa, Mycobacterium
IAGPCGVVIFGVTGDLS

SEQ ID NO: 1289398 - protein, 17 aa, Mycobacterium
IAIPADFAPIIDLKAEI

SEQ ID NO: 1289399 - protein, 18 aa, Mycobacterium
IAPGLVVRCRNDIPHSRG

SEQ ID NO: 1289400 - protein, 18 aa, Mycobacterium
IAPRPVLAMVSEQLMKAR

SEQ ID NO: 1289401 - protein, 23 aa, Mycobacterium
IATDHLMRFPGRFADQLLAEHLQ

SEQ ID NO: 1289402 - protein, 24 aa, Mycobacterium
IATTLAARGWRIIVTDVNLTGAQE

SEQ ID NO: 1289403 - protein, 18 aa, Mycobacterium
IATYPGAIAVRFDDPLAA

SEQ ID NO: 1289404 - protein, 17 aa, Mycobacterium
ICVEAFAGFAIVKPQVA

SEQ ID NO: 1289405 - protein, 17 aa, Mycobacterium
IDAGAEWRQAGCSMCLG

SEQ ID NO: 1289406 - protein, 23 aa, Mycobacterium
IDDRLAGLAARYAVSVGDQRLVR

SEQ ID NO: 1289407 - protein, 20 aa, Mycobacterium
IDFIEACAWIKENLPGVHIS

SEQ ID NO: 1289408 - protein, 21 aa, Mycobacterium
IDPELRFRKRPLLSLEQPVKV

SEQ ID NO: 1289409 - protein, 18 aa, Mycobacterium
IEAVEWPDHPFALGVHWH

SEQ ID NO: 1289410 - protein, 25 aa, Mycobacterium
IEFIVAQLLRLGRLGSFDFNSRFYA

SEQ ID NO: 1289411 - protein, 19 aa, Mycobacterium
IEKMRVAGRIAAGALAEAG

SEQ ID NO: 1289412 - protein, 24 aa, Mycobacterium
IFKRIRPGFRYERSLSVLTMARDY

SEQ ID NO: 1289413 - protein, 18 aa, Mycobacterium
IFTAALTRLGVDAADAVM

SEQ ID NO: 1289414 - protein, 22 aa, Mycobacterium
IGCKRPTFSNSYFRTFTKPHVH

SEQ ID NO: 1289415 - protein, 19 aa, Mycobacterium
IGLAAAKYWVCKRATPHAA

SEQ ID NO: 1289416 - protein, 23 aa, Mycobacterium
IGRWRPSLSGARDAYVYYPGTAD

SEQ ID NO: 1289417 - protein, 17 aa, Mycobacterium
IHFQEWWVRYRAKVPTH

SEQ ID NO: 1289418 - protein, 21 aa, Mycobacterium
IKDLRFGACLDDDWAEADPDE

SEQ ID NO: 1289419 - protein, 17 aa, Mycobacterium
IKDRGSLIVGVNVPYAP

SEQ ID NO: 1289420 - protein, 20 aa, Mycobacterium
IKVKGFRNTIHWRVTRYDEP

SEQ ID NO: 1289421 - protein, 17 aa, Mycobacterium
ILRRFDIIVLPLVNPDG

SEQ ID NO: 1289422 - protein, 17 aa, Mycobacterium
IMSRWLATRLPDGQAPE

SEQ ID NO: 1289423 - protein, 20 aa, Mycobacterium
IPPPVHWAGGVFVCPAGARD

SEQ ID NO: 1289424 - protein, 19 aa, Mycobacterium
IQSAAAWAIIDCDLPAPAE

SEQ ID NO: 1289425 - protein, 17 aa, Mycobacterium
IRPNVIWAMDFQFDTTA

SEQ ID NO: 1289426 - protein, 25 aa, Mycobacterium
IRRRYPDWERWGLAPADMLMAAAGP

SEQ ID NO: 1289427 - protein, 19 aa, Mycobacterium
IRTRRLGVMGGTFDPIHHG

SEQ ID NO: 1289428 - protein, 21 aa, Mycobacterium
IRVSNRLRPWLPVLLALTANS

SEQ ID NO: 1289429 - protein, 19 aa, Mycobacterium
ITAFNFPVAVWSWNTAVAL

SEQ ID NO: 1289430 - protein, 18 aa, Mycobacterium
IVLPGMVVPIELDDAARA

SEQ ID NO: 1289431 - protein, 18 aa, Mycobacterium
IVPCQDGYIRICLLAKRQ

SEQ ID NO: 1289432 - protein, 17 aa, Mycobacterium
IWVAIAVATDAQWDALC

SEQ ID NO: 1289433 - protein, 18 aa, Mycobacterium
IYTFMDLWFYHCNPRHHS

SEQ ID NO: 1289434 - protein, 20 aa, Mycobacterium
KAFAFAGGRLGYLVAAPAVI

SEQ ID NO: 1289435 - protein, 19 aa, Mycobacterium
KAFRAVALPARYMIACVNG

SEQ ID NO: 1289436 - protein, 17 aa, Mycobacterium
KAMIPRAKGSIVNIGSY

SEQ ID NO: 1289437 - protein, 17 aa, Mycobacterium
KAQGGIFGWVAGSAAVI

SEQ ID NO: 1289438 - protein, 17 aa, Mycobacterium
KAVLAMQYECGFTNEPE

SEQ ID NO: 1289439 - protein, 19 aa, Mycobacterium
KAWLIGVGEDGEWPLFLDV

SEQ ID NO: 1289440 - protein, 20 aa, Mycobacterium
KAYIEVMSFDGLVNAATERN

SEQ ID NO: 1289441 - protein, 18 aa, Mycobacterium
KDDLDWLSDWGHSYEARP

SEQ ID NO: 1289442 - protein, 18 aa, Mycobacterium
KDVHIGPSDHVGWLDDRK

SEQ ID NO: 1289443 - protein, 22 aa, Mycobacterium
KGCTHPGCTVPFYWTEAHHTHD

SEQ ID NO: 1289444 - protein, 20 aa, Mycobacterium
KGGAASAFGTEWEKWHSGAG

SEQ ID NO: 1289445 - protein, 17 aa, Mycobacterium
KLCAQYLGPALRLLNFN

SEQ ID NO: 1289446 - protein, 19 aa, Mycobacterium
KLGFPVPIRHWLRAGELLE

SEQ ID NO: 1289447 - protein, 17 aa, Mycobacterium
KLHLRPIFMKSYSQLTQ

SEQ ID NO: 1289448 - protein, 17 aa, Mycobacterium
KLVDWMMKFQFANDCDY

SEQ ID NO: 1289449 - protein, 17 aa, Mycobacterium
KLYLCAIKDVFSNRIVG

SEQ ID NO: 1289450 - protein, 18 aa, Mycobacterium
KPLYGTSLVTGWASIHGF

SEQ ID NO: 1289451 - protein, 20 aa, Mycobacterium
KRFGADFDRPVARMTEMIGA

SEQ ID NO: 1289452 - protein, 20 aa, Mycobacterium
KRLLVDNGWFATLRRPNVEL

SEQ ID NO: 1289453 - protein, 18 aa, Mycobacterium
KRLRPVIDSGYKRNDPKS

SEQ ID NO: 1289454 - protein, 17 aa, Mycobacterium
KRPRKYLRVTLGRRNPV

SEQ ID NO: 1289455 - protein, 19 aa, Mycobacterium
KSRLPRYGRRPQDQLIIPG

SEQ ID NO: 1289456 - protein, 24 aa, Mycobacterium
KTTLKWRFPYGFLDQGQSTPIRMP

SEQ ID NO: 1289457 - protein, 19 aa, Mycobacterium
KVAKWWIPERWSFVSDIPR

SEQ ID NO: 1289458 - protein, 18 aa, Mycobacterium
KVLVWCHGGGYVLGSARG

SEQ ID NO: 1289459 - protein, 18 aa, Mycobacterium
KVVRMFPIPPIALGLRTG

SEQ ID NO: 1289460 - protein, 20 aa, Mycobacterium
KWATFPMLALHGWAQHHDVP

SEQ ID NO: 1289461 - protein, 18 aa, Mycobacterium
KWTRILIPWRHESSHLHP

SEQ ID NO: 1289462 - protein, 19 aa, Mycobacterium
LAAAGYRVWAINPMAAARY

SEQ ID NO: 1289463 - protein, 20 aa, Mycobacterium
LAAHFFLTFPQLHDVRFDYR

SEQ ID NO: 1289464 - protein, 18 aa, Mycobacterium
LAAVNLRLFARDGGDVPA

SEQ ID NO: 1289465 - protein, 19 aa, Mycobacterium
LADLLWRMGIRTIGQFSAL

SEQ ID NO: 1289466 - protein, 18 aa, Mycobacterium
LADLSFADYLMWVRRDDG

SEQ ID NO: 1289467 - protein, 23 aa, Mycobacterium
LAEEILEPLGFRWTNFGVAESDV

SEQ ID NO: 1289468 - protein, 19 aa, Mycobacterium
LAELLPGCTGLDVVDSVYG

SEQ ID NO: 1289469 - protein, 17 aa, Mycobacterium
LAFTPVFLSEEWRQVVL

SEQ ID NO: 1289470 - protein, 25 aa, Mycobacterium
LAGAWPSQSVMAWSGYSMQFKAAAN

SEQ ID NO: 1289471 - protein, 22 aa, Mycobacterium
LAGDKRFPFGIPKPDNANYLWI

SEQ ID NO: 1289472 - protein, 17 aa, Mycobacterium
LAHPALVCDVAIGQSTL

SEQ ID NO: 1289473 - protein, 25 aa, Mycobacterium
LAKAWKRLETVTGMTAPQLNDWGGG

SEQ ID NO: 1289474 - protein, 20 aa, Mycobacterium
LAKLRMARLVRTRREGTTIY

SEQ ID NO: 1289475 - protein, 20 aa, Mycobacterium
LALLRLNALLARACGDAASY

SEQ ID NO: 1289476 - protein, 26 aa, Mycobacterium
LALQRTCGWSSLPLKGWLATAYQRYA

SEQ ID NO: 1289477 - protein, 18 aa, Mycobacterium
LAPGSFSWHVLSSLTDEV

SEQ ID NO: 1289478 - protein, 21 aa, Mycobacterium
LARARRMGIGTVDTGVQGLIE

SEQ ID NO: 1289479 - protein, 17 aa, Mycobacterium
LARLGGIVGTAFQISDD

SEQ ID NO: 1289480 - protein, 19 aa, Mycobacterium
LARSLRCRPEDLIALLRRR

SEQ ID NO: 1289481 - protein, 17 aa, Mycobacterium
LASFPAPLRANAPSVSG

SEQ ID NO: 1289482 - protein, 26 aa, Mycobacterium
LATARAAEVIECLRHYDTAEGCADLL

SEQ ID NO: 1289483 - protein, 17 aa, Mycobacterium
LAWELLYATETCRSFAL

SEQ ID NO: 1289484 - protein, 19 aa, Mycobacterium
LCRPYRGKEICGMPPPSSG

SEQ ID NO: 1289485 - protein, 21 aa, Mycobacterium
LCTGCGQLTAADAARCATTNC

SEQ ID NO: 1289486 - protein, 18 aa, Mycobacterium
LDAAHVWHPYSTIGAGAL

SEQ ID NO: 1289487 - protein, 20 aa, Mycobacterium
LDALPDWPAVGLPRVRIAEF

SEQ ID NO: 1289488 - protein, 19 aa, Mycobacterium
LDCFKRFSDVTFDRWQKVI

SEQ ID NO: 1289489 - protein, 19 aa, Mycobacterium
LDFAAVWGLAGGVQSDLSP

SEQ ID NO: 1289490 - protein, 25 aa, Mycobacterium
LDFMRSCSIKHGMASVIFSLEMSKS

SEQ ID NO: 1289491 - protein, 18 aa, Mycobacterium
LDGIRGWQEDCYRDLHRH

SEQ ID NO: 1289492 - protein, 18 aa, Mycobacterium
LDHVVAWAEAPGTLVDHR

SEQ ID NO: 1289493 - protein, 17 aa, Mycobacterium
LDIPGVVVGGVLNGFGF

SEQ ID NO: 1289494 - protein, 18 aa, Mycobacterium
LDLLPRLLIRGGELDLTV

SEQ ID NO: 1289495 - protein, 28 aa, Mycobacterium
LDRSAFRWWLTVATLRWGVICRFQAERH

SEQ ID NO: 1289496 - protein, 17 aa, Mycobacterium
LDTEYAWAEDPPSRIRH

SEQ ID NO: 1289497 - protein, 19 aa, Mycobacterium
LDVGCGWGGMVRYAARHGV

SEQ ID NO: 1289498 - protein, 23 aa, Mycobacterium
LDWMLVCTLREWFDRPNGEPPPW

SEQ ID NO: 1289499 - protein, 17 aa, Mycobacterium
LEFAVGRTTSVNWDEPT

SEQ ID NO: 1289500 - protein, 17 aa, Mycobacterium
LEGLDLLHGGAWKAELR

SEQ ID NO: 1289501 - protein, 19 aa, Mycobacterium
LEMIKAQGGIFGWVAGSAA

SEQ ID NO: 1289502 - protein, 17 aa, Mycobacterium
LEQWYGWIEFLANPSKN

SEQ ID NO: 1289503 - protein, 19 aa, Mycobacterium
LERPWLASRIELMETTDMA

SEQ ID NO: 1289504 - protein, 19 aa, Mycobacterium
LESRLAWEPTSLAAAVERT

SEQ ID NO: 1289505 - protein, 17 aa, Mycobacterium
LEVGQLLGSGWKGGAAS

SEQ ID NO: 1289506 - protein, 17 aa, Mycobacterium
LEVLDGLGLDYSIMFPT

SEQ ID NO: 1289507 - protein, 19 aa, Mycobacterium
LEYDRLGLPAADWQILLDV

SEQ ID NO: 1289508 - protein, 18 aa, Mycobacterium
LFATHGLPWCDGARELLE

SEQ ID NO: 1289509 - protein, 17 aa, Mycobacterium
LFLKVSLLRRANPDRPH

SEQ ID NO: 1289510 - protein, 18 aa, Mycobacterium
LGAPEFASRIGVGVDEFQ

SEQ ID NO: 1289511 - protein, 22 aa, Mycobacterium
LGDVFVGWLLLRSAHIALTALA

SEQ ID NO: 1289512 - protein, 25 aa, Mycobacterium
LGETELWQWAHRVVCEHPGPLEIDK

SEQ ID NO: 1289513 - protein, 20 aa, Mycobacterium
LGHFDAWAAQFVRYKVLIET

SEQ ID NO: 1289514 - protein, 22 aa, Mycobacterium
LGHLRGAVNIGLEGRYAEFAGS

SEQ ID NO: 1289515 - protein, 17 aa, Mycobacterium
LGLDCQIIRNRGALMVL

SEQ ID NO: 1289516 - protein, 17 aa, Mycobacterium
LGLMLVVGQPKNTAEYI

SEQ ID NO: 1289517 - protein, 24 aa, Mycobacterium
LGQMWAAGVDLDWSRLSKDKPGLI

SEQ ID NO: 1289518 - protein, 25 aa, Mycobacterium
LGQSRPRTRWRWRAIVTDLAAPQRV

SEQ ID NO: 1289519 - protein, 19 aa, Mycobacterium
LGVPEGKWVYLRGHADQTE

SEQ ID NO: 1289520 - protein, 25 aa, Mycobacterium
LGVQRLRLVAGWSLGGMQSLEFASR

SEQ ID NO: 1289521 - protein, 17 aa, Mycobacterium
LGWRAYRRCPGSAGAWR

SEQ ID NO: 1289522 - protein, 18 aa, Mycobacterium
LHPLSAPMTLRWLRDRFT

SEQ ID NO: 1289523 - protein, 18 aa, Mycobacterium
LIGEWLLRDMGRASGLRH

SEQ ID NO: 1289524 - protein, 17 aa, Mycobacterium
LIGQITWRTRLVQDPHL

SEQ ID NO: 1289525 - protein, 22 aa, Mycobacterium
LIRGEWRPLYLFADRPQPLIDL

SEQ ID NO: 1289526 - protein, 19 aa, Mycobacterium
LKGFHGFRLTEFFAGYPDA

SEQ ID NO: 1289527 - protein, 23 aa, Mycobacterium
LKVKRRLAGMLARRGYSQSMALD

SEQ ID NO: 1289528 - protein, 20 aa, Mycobacterium
LKYEGVDVITIFKGLQLDIG

SEQ ID NO: 1289529 - protein, 19 aa, Mycobacterium
LLADLSFADYLMWVRRDDG

SEQ ID NO: 1289530 - protein, 19 aa, Mycobacterium
LLAEAVWRLGALGWACDLV

SEQ ID NO: 1289531 - protein, 18 aa, Mycobacterium
LLCRRRLGAAVGQIVNVD

SEQ ID NO: 1289532 - protein, 17 aa, Mycobacterium
LLDAGCRTTVWNRTAAR

SEQ ID NO: 1289533 - protein, 17 aa, Mycobacterium
LLELVGLGHRIHHQPTK

SEQ ID NO: 1289534 - protein, 17 aa, Mycobacterium
LLESGGFLVAESDRVLG

SEQ ID NO: 1289535 - protein, 20 aa, Mycobacterium
LLGSGWKGGAASAFGTEWEK

SEQ ID NO: 1289536 - protein, 20 aa, Mycobacterium
LLKYSRLFAALTEWERSTDI

SEQ ID NO: 1289537 - protein, 21 aa, Mycobacterium
LLPIPEFYGGTVYFDGADAPA

SEQ ID NO: 1289538 - protein, 18 aa, Mycobacterium
LLTDFPFRNWEDEPALPF

SEQ ID NO: 1289539 - protein, 17 aa, Mycobacterium
LLVEAAWHHKPRYRVGT

SEQ ID NO: 1289540 - protein, 17 aa, Mycobacterium
LLVRERIELMLDPDTAF

SEQ ID NO: 1289541 - protein, 18 aa, Mycobacterium
LLWQRGFDGLSIEAVAAR

SEQ ID NO: 1289542 - protein, 18 aa, Mycobacterium
LNALLARACGDAASYRRW

SEQ ID NO: 1289543 - protein, 19 aa, Mycobacterium
LNDPCWKQLLSLVPPMTCD

SEQ ID NO: 1289544 - protein, 18 aa, Mycobacterium
LNDPELQAAIGLFSTPEE

SEQ ID NO: 1289545 - protein, 18 aa, Mycobacterium
LPADFGLPDCPRWKVVDR

SEQ ID NO: 1289546 - protein, 17 aa, Mycobacterium
LPAQWPVLLCNGAVGIA

SEQ ID NO: 1289547 - protein, 26 aa, Mycobacterium
LPDEMPAAALWWRITETLAPTAAVPE

SEQ ID NO: 1289548 - protein, 19 aa, Mycobacterium
LPDLVAVLSRLIGPIRRVV

SEQ ID NO: 1289549 - protein, 17 aa, Mycobacterium
LPDSLLHYMRTRGKDKV

SEQ ID NO: 1289550 - protein, 26 aa, Mycobacterium
LPGFVERVLEAWPRHDLGYAITDLIA

SEQ ID NO: 1289551 - protein, 22 aa, Mycobacterium
LPGHAPSGLGFRPDGSLLITSV

SEQ ID NO: 1289552 - protein, 20 aa, Mycobacterium
LPGPLKWDLTTGIATATTQS

SEQ ID NO: 1289553 - protein, 20 aa, Mycobacterium
LPHGLPPVRLIAGAQLDGWQ

SEQ ID NO: 1289554 - protein, 19 aa, Mycobacterium
LPLTPSRVWEAMQGRPTPP

SEQ ID NO: 1289555 - protein, 20 aa, Mycobacterium
LPQQRWYGGRSREFSSATPD

SEQ ID NO: 1289556 - protein, 18 aa, Mycobacterium
LPRAAAILMKLYRNATHG

SEQ ID NO: 1289557 - protein, 19 aa, Mycobacterium
LPRLRPGVMEVKIPMPTTG

SEQ ID NO: 1289558 - protein, 18 aa, Mycobacterium
LPVSSVLCTLELAGRLHL

SEQ ID NO: 1289559 - protein, 17 aa, Mycobacterium
LPWPWPRVVGAHFVAGD

SEQ ID NO: 1289560 - protein, 17 aa, Mycobacterium
LQAARWAGAVAAACGAP

SEQ ID NO: 1289561 - protein, 17 aa, Mycobacterium
LQAHGWSRLLPRTVVAL

SEQ ID NO: 1289562 - protein, 24 aa, Mycobacterium
LQDHAWRIAAKLNWPDTYQAEYIA

SEQ ID NO: 1289563 - protein, 21 aa, Mycobacterium
LQRCPWCGTKIDPKRDLHVDR

SEQ ID NO: 1289564 - protein, 19 aa, Mycobacterium
LQTAFMLSPWAARTPIDVE

SEQ ID NO: 1289565 - protein, 19 aa, Mycobacterium
LQYRHRLEFAVGRTTSVNW

SEQ ID NO: 1289566 - protein, 17 aa, Mycobacterium
LRDALGLTPGSKVDISA

SEQ ID NO: 1289567 - protein, 23 aa, Mycobacterium
LRDHPGEGLGFWTQFDTYIPAAL

SEQ ID NO: 1289568 - protein, 26 aa, Mycobacterium
LRERWSNQAAREWKELPARELADTTM

SEQ ID NO: 1289569 - protein, 21 aa, Mycobacterium
LRGGAYFFLPGLRGLRYLATL

SEQ ID NO: 1289570 - protein, 17 aa, Mycobacterium
LRHSFAMRTLEYLVTGH

SEQ ID NO: 1289571 - protein, 20 aa, Mycobacterium
LRKVVGWARDRGVLVASDEC

SEQ ID NO: 1289572 - protein, 22 aa, Mycobacterium
LRLDELTRFFAWITDRGVTSLA

SEQ ID NO: 1289573 - protein, 18 aa, Mycobacterium
LRLVFVCAMWMTGFDAPS

SEQ ID NO: 1289574 - protein, 17 aa, Mycobacterium
LRPAILYGIDTRATAEI

SEQ ID NO: 1289575 - protein, 19 aa, Mycobacterium
LRPALSIAVCLGLGGQLDA

SEQ ID NO: 1289576 - protein, 18 aa, Mycobacterium
LRPDLRVHLAAREAEFWT

SEQ ID NO: 1289577 - protein, 19 aa, Mycobacterium
LRPGLTLALEPWFARGTDR

SEQ ID NO: 1289578 - protein, 19 aa, Mycobacterium
LRRAGHVVAPFKVGPDFID

SEQ ID NO: 1289579 - protein, 21 aa, Mycobacterium
LRREFDALWSAIRFDEPARPA

SEQ ID NO: 1289580 - protein, 17 aa, Mycobacterium
LRSGITFNTKVTSAVLD

SEQ ID NO: 1289581 - protein, 17 aa, Mycobacterium
LRSPAIFEWFDIAGVDD

SEQ ID NO: 1289582 - protein, 18 aa, Mycobacterium
LRSPLVLVPVRLSTANRG

SEQ ID NO: 1289583 - protein, 19 aa, Mycobacterium
LRSQLGWRTLGVYAVNYPA

SEQ ID NO: 1289584 - protein, 19 aa, Mycobacterium
LRTEFPNGFVATVRGVFTY

SEQ ID NO: 1289585 - protein, 17 aa, Mycobacterium
LRTGAPIRLSAAVVASW

SEQ ID NO: 1289586 - protein, 17 aa, Mycobacterium
LRTPGFVLIRERGAAVV

SEQ ID NO: 1289587 - protein, 21 aa, Mycobacterium
LRVHPDIHLFPAIPQQRSSTA

SEQ ID NO: 1289588 - protein, 26 aa, Mycobacterium
LRYLLATSVPAWWAPYVPRLMRTPQL

SEQ ID NO: 1289589 - protein, 21 aa, Mycobacterium
LSAPMTLRWLRDRFTDRPVYE

SEQ ID NO: 1289590 - protein, 21 aa, Mycobacterium
LSGQVGWLARDRWAVPLVHTA

SEQ ID NO: 1289591 - protein, 17 aa, Mycobacterium
LSIQFVFAYDVGEFAET

SEQ ID NO: 1289592 - protein, 20 aa, Mycobacterium
LSKPFTFKRVEGLRPVIQQV

SEQ ID NO: 1289593 - protein, 23 aa, Mycobacterium
LSLDIAQAVALVWEATIDATGPD

SEQ ID NO: 1289594 - protein, 24 aa, Mycobacterium
LSNPTLLCYYLFFPAHEESVGAGA

SEQ ID NO: 1289595 - protein, 23 aa, Mycobacterium
LSRLRGMFAFALWDTVTGELFCA

SEQ ID NO: 1289596 - protein, 17 aa, Mycobacterium
LSYFLGVRGPAVVVDTA

SEQ ID NO: 1289597 - protein, 25 aa, Mycobacterium
LTAMRWPRVGVMIARGDLAVEVGYE

SEQ ID NO: 1289598 - protein, 18 aa, Mycobacterium
LTCPMFLTTPEFLPHHRA

SEQ ID NO: 1289599 - protein, 34 aa, Mycobacterium
LTECPQCSGRLRKLFGKVGVVFKGSGFYRTDSRE

SEQ ID NO: 1289600 - protein, 17 aa, Mycobacterium
LTESLRYPAALVDDFDW

SEQ ID NO: 1289601 - protein, 21 aa, Mycobacterium
LTEWLGYAWVCLADVPPSFEE

SEQ ID NO: 1289602 - protein, 23 aa, Mycobacterium
LTWPGTRVELCFPGDRPLPQHHT

SEQ ID NO: 1289603 - protein, 17 aa, Mycobacterium
LVAARVGRPPVIRRAIL

SEQ ID NO: 1289604 - protein, 19 aa, Mycobacterium
LVDLLDAWVAYFAEHPRER

SEQ ID NO: 1289605 - protein, 24 aa, Mycobacterium
LVEGRAGVVVPALWTVRRITDGGG

SEQ ID NO: 1289606 - protein, 19 aa, Mycobacterium
LVEQCGRRSLLLPGDLAEA

SEQ ID NO: 1289607 - protein, 17 aa, Mycobacterium
LVTDGRWWGIVWAEEGT

SEQ ID NO: 1289608 - protein, 20 aa, Mycobacterium
LVVRPFLKYQIITVAAPETA

SEQ ID NO: 1289609 - protein, 18 aa, Mycobacterium
LWRMGIRTIGQFSALSRT

SEQ ID NO: 1289610 - protein, 17 aa, Mycobacterium
LWWPDKRPYAPGSVLPA

SEQ ID NO: 1289611 - protein, 21 aa, Mycobacterium
LYCRNRIEIVIGMVGIVKAGA

SEQ ID NO: 1289612 - protein, 17 aa, Mycobacterium
LYRHFPDKVSLLGAAIV

SEQ ID NO: 1289613 - protein, 20 aa, Mycobacterium
MAALVLRPGAEFAVEKFQAF

SEQ ID NO: 1289614 - protein, 20 aa, Mycobacterium
MAEPKWVLAMGVCASSGGMF

SEQ ID NO: 1289615 - protein, 18 aa, Mycobacterium
MDGWYEWRPNPAEGGKKK

SEQ ID NO: 1289616 - protein, 22 aa, Mycobacterium
MGLARLWQSWGIEPDVVLGHSV

SEQ ID NO: 1289617 - protein, 19 aa, Mycobacterium
MKVEAWRAGSPTAQIQPEV

SEQ ID NO: 1289618 - protein, 19 aa, Mycobacterium
MLALHGWAQHHDVPLRAVV

SEQ ID NO: 1289619 - protein, 21 aa, Mycobacterium
MPEMPLIKFIDGWETVAEMEA

SEQ ID NO: 1289620 - protein, 18 aa, Mycobacterium
MPRIAGPCGVVIFGVTGD

SEQ ID NO: 1289621 - protein, 18 aa, Mycobacterium
MQCGIAWCGHCQLGPLLL

SEQ ID NO: 1289622 - protein, 17 aa, Mycobacterium
MRGRLALHHVRARVYGA

SEQ ID NO: 1289623 - protein, 19 aa, Mycobacterium
MRPDVVIKFMDRFGDVIYN

SEQ ID NO: 1289624 - protein, 17 aa, Mycobacterium
MSLSGRWRKQGIDVRFA

SEQ ID NO: 1289625 - protein, 17 aa, Mycobacterium
MSMFGLHRALRGAAVGH

SEQ ID NO: 1289626 - protein, 18 aa, Mycobacterium
MTPAAFVRRPGRWIREMA

SEQ ID NO: 1289627 - protein, 25 aa, Mycobacterium
MTPRRMMALLLRFGPYGDRFGLRRG

SEQ ID NO: 1289628 - protein, 25 aa, Mycobacterium
MTRPRWSMDPLRIFPADIGVDKAVD

SEQ ID NO: 1289629 - protein, 22 aa, Mycobacterium
MTVWQKLHFRFGLPKPLLEPLS

SEQ ID NO: 1289630 - protein, 18 aa, Mycobacterium
MVDAAICDGDWVVVRQQA

SEQ ID NO: 1289631 - protein, 22 aa, Mycobacterium
MVKAGVQWGLFGGAVENLGTER

SEQ ID NO: 1289632 - protein, 23 aa, Mycobacterium
MVRCVRAALPLLRSASWARIVNF

SEQ ID NO: 1289633 - protein, 20 aa, Mycobacterium
MWCFPDLSYGIGMVIRVVEG

SEQ ID NO: 1289634 - protein, 18 aa, Mycobacterium
NAGRRVALLVGRGAAGAA

SEQ ID NO: 1289635 - protein, 18 aa, Mycobacterium
NAMGRPGLTLGLGPSHEP

SEQ ID NO: 1289636 - protein, 19 aa, Mycobacterium
NCYHMYPAHAAFGGYKQSG

SEQ ID NO: 1289637 - protein, 18 aa, Mycobacterium
NDGALGWVGTSPVGTFPA

SEQ ID NO: 1289638 - protein, 19 aa, Mycobacterium
NDIRSGAALTTLAQELGGL

SEQ ID NO: 1289639 - protein, 20 aa, Mycobacterium
NGELRKRCVLQLHEAIEGEL

SEQ ID NO: 1289640 - protein, 17 aa, Mycobacterium
NGFFYKVMPPFCVGTSA

SEQ ID NO: 1289641 - protein, 28 aa, Mycobacterium
NKAIARFIVRYTEAFKRYGITDDTVQAA

SEQ ID NO: 1289642 - protein, 26 aa, Mycobacterium
NKGVRFSYRWDFGRNRFIMMDSRNGR

SEQ ID NO: 1289643 - protein, 17 aa, Mycobacterium
NLLPVPWVDPVDVANAV

SEQ ID NO: 1289644 - protein, 23 aa, Mycobacterium
NLLRLKAFFGRQWQQMPAAQFMA

SEQ ID NO: 1289645 - protein, 18 aa, Mycobacterium
NLREAFELIVGGNPAEGI

SEQ ID NO: 1289646 - protein, 25 aa, Mycobacterium
NNLYLAFGMLNWRFGDRELRSPLVL

SEQ ID NO: 1289647 - protein, 18 aa, Mycobacterium
NPFRLTFTPDGKLLVADV

SEQ ID NO: 1289648 - protein, 25 aa, Mycobacterium
NREVRWRPAEYWKPGTTVEVDVNAY

SEQ ID NO: 1289649 - protein, 17 aa, Mycobacterium
NVKKSGFLPSERQWLTD

SEQ ID NO: 1289650 - protein, 17 aa, Mycobacterium
PAECPGRNLALFTTSTL

SEQ ID NO: 1289651 - protein, 20 aa, Mycobacterium
PAGDGRLSLVDGLFLDIIKK

SEQ ID NO: 1289652 - protein, 21 aa, Mycobacterium
PAGWRLAAAATTWSEVAALMT

SEQ ID NO: 1289653 - protein, 17 aa, Mycobacterium
PAILYGIDTRATAEIHS

SEQ ID NO: 1289654 - protein, 21 aa, Mycobacterium
PAIRSRLGLALSRATDRGSLV

SEQ ID NO: 1289655 - protein, 17 aa, Mycobacterium
PAISLPLHWTADGLPLG

SEQ ID NO: 1289656 - protein, 17 aa, Mycobacterium
PALVVRPFLKYQIITVA

SEQ ID NO: 1289657 - protein, 19 aa, Mycobacterium
PANLQPGSTVAFDQFTLTR

SEQ ID NO: 1289658 - protein, 18 aa, Mycobacterium
PATIWRDYIRTVGRTPNG

SEQ ID NO: 1289659 - protein, 24 aa, Mycobacterium
PATRPRIRLAYRLTPRRVTGATRA

SEQ ID NO: 1289660 - protein, 19 aa, Mycobacterium
PAWAYGRVALQWAERYYAA

SEQ ID NO: 1289661 - protein, 28 aa, Mycobacterium
PCQLCRWWWRQGRTWPKAHPFQRHKGCN

SEQ ID NO: 1289662 - protein, 20 aa, Mycobacterium
PDFELIAGQVIANFEAAAAV

SEQ ID NO: 1289663 - protein, 18 aa, Mycobacterium
PDGQCLFGPVLIDPPVGE

SEQ ID NO: 1289664 - protein, 17 aa, Mycobacterium
PDVLDWPLNVVVVRSGD

SEQ ID NO: 1289665 - protein, 17 aa, Mycobacterium
PDVYPRLLRVMTADPIF

SEQ ID NO: 1289666 - protein, 18 aa, Mycobacterium
PEATMCRFGVPLAPVAEP

SEQ ID NO: 1289667 - protein, 20 aa, Mycobacterium
PEFVALWADHRVKRCEADTY

SEQ ID NO: 1289668 - protein, 18 aa, Mycobacterium
PELPDCWVVSAGETVIVT

SEQ ID NO: 1289669 - protein, 18 aa, Mycobacterium
PEMTARYAATLAATAEAE

SEQ ID NO: 1289670 - protein, 22 aa, Mycobacterium
PEPHYRPSAALQDFVRCRDLTC

SEQ ID NO: 1289671 - protein, 19 aa, Mycobacterium
PEPLASIGINATRWSLDRA

SEQ ID NO: 1289672 - protein, 22 aa, Mycobacterium
PEVIWPRARRALAAVGLNLPLR

SEQ ID NO: 1289673 - protein, 19 aa, Mycobacterium
PEYRLETLISLNIGTATGF

SEQ ID NO: 1289674 - protein, 18 aa, Mycobacterium
PFGKRLLVDNGWFATLRR

SEQ ID NO: 1289675 - protein, 23 aa, Mycobacterium
PFLPPELAPLIAFTTTSLSGVLL

SEQ ID NO: 1289676 - protein, 20 aa, Mycobacterium
PGAMARLGVWSGRGPQLDLH

SEQ ID NO: 1289677 - protein, 21 aa, Mycobacterium
PGAMARLGVWSGRGPQLDLHQ

SEQ ID NO: 1289678 - protein, 23 aa, Mycobacterium
PGDGWRLAMDLLPYERSTCFWQR

SEQ ID NO: 1289679 - protein, 23 aa, Mycobacterium
PGEPLPRWQIGLYWRADGAPLWT

SEQ ID NO: 1289680 - protein, 19 aa, Mycobacterium
PGEQGGAVARCYSLASSPH

SEQ ID NO: 1289681 - protein, 24 aa, Mycobacterium
PGGERRLNVAVTRARREVVLYASF

SEQ ID NO: 1289682 - protein, 18 aa, Mycobacterium
PGKELVRHKYRVCPTCGR

SEQ ID NO: 1289683 - protein, 17 aa, Mycobacterium
PGLLRWDRKRIASRVDE

SEQ ID NO: 1289684 - protein, 25 aa, Mycobacterium
PGQRLELAFDYRVLWAEPLPGKVRR

SEQ ID NO: 1289685 - protein, 20 aa, Mycobacterium
PGVVVGGVLNGFGFDGGLLT

SEQ ID NO: 1289686 - protein, 18 aa, Mycobacterium
PGWGCGRALALRNNIIID

SEQ ID NO: 1289687 - protein, 20 aa, Mycobacterium
PGWWAAREAIEWTASAQRQP

SEQ ID NO: 1289688 - protein, 18 aa, Mycobacterium
PGWYRPNPGLARDLAFIA

SEQ ID NO: 1289689 - protein, 20 aa, Mycobacterium
PHYRPSAALQDFVRCRDLTC

SEQ ID NO: 1289690 - protein, 21 aa, Mycobacterium
PIDVPYPVLWRNLTQVVADVL

SEQ ID NO: 1289691 - protein, 18 aa, Mycobacterium
PILFPSLALLMPVQGIIT

SEQ ID NO: 1289692 - protein, 20 aa, Mycobacterium
PILQGLCLTSSWSDWSSNDD

SEQ ID NO: 1289693 - protein, 23 aa, Mycobacterium
PKNTWPAVLTWRAHDVARMESVR

SEQ ID NO: 1289694 - protein, 17 aa, Mycobacterium
PKSFDFIDEMPRLPTGK

SEQ ID NO: 1289695 - protein, 21 aa, Mycobacterium
PLADIPLDWVLDGAVRAGVRL

SEQ ID NO: 1289696 - protein, 26 aa, Mycobacterium
PLDGFPDKRVRLMLEMHLLAPLHLSQ

SEQ ID NO: 1289697 - protein, 19 aa, Mycobacterium
PLFMAGLWTTWRPKDAPKE

SEQ ID NO: 1289698 - protein, 17 aa, Mycobacterium
PLPLLPLCGGVPTDVAW

SEQ ID NO: 1289699 - protein, 19 aa, Mycobacterium
PLPPGLGRFPLRRVSDYPD

SEQ ID NO: 1289700 - protein, 17 aa, Mycobacterium
PLRWCSMVHALGGTVVL

SEQ ID NO: 1289701 - protein, 18 aa, Mycobacterium
PMFHAWGFSQLLFAGLLA

SEQ ID NO: 1289702 - protein, 19 aa, Mycobacterium
PPAPVREWYFYTSRLTVWR

SEQ ID NO: 1289703 - protein, 18 aa, Mycobacterium
PPCVIAWEPGQRVNGELE

SEQ ID NO: 1289704 - protein, 17 aa, Mycobacterium
PPFGFKRSGQWLWWDNT

SEQ ID NO: 1289705 - protein, 22 aa, Mycobacterium
PPGVPWTVVWSFHLMPRGTDRC

SEQ ID NO: 1289706 - protein, 21 aa, Mycobacterium
PPKRWVLKGFHGFRLTEFFAG

SEQ ID NO: 1289707 - protein, 18 aa, Mycobacterium
PPSFADGFADGWFNTEEG

SEQ ID NO: 1289708 - protein, 18 aa, Mycobacterium
PQMWRWAASRSVDHRTAL

SEQ ID NO: 1289709 - protein, 18 aa, Mycobacterium
PQVVGAAMARRLSMTGEV

SEQ ID NO: 1289710 - protein, 19 aa, Mycobacterium
PRDWPRPQHGWTLTIEGDP

SEQ ID NO: 1289711 - protein, 27 aa, Mycobacterium
PRFAEEIAWWVWWCWDQQLRKIEPSLL

SEQ ID NO: 1289712 - protein, 18 aa, Mycobacterium
PRGISFLLNRNRLNVAIS

SEQ ID NO: 1289713 - protein, 18 aa, Mycobacterium
PRLPAGYADLAAHWPQGR

SEQ ID NO: 1289714 - protein, 17 aa, Mycobacterium
PRTLTWWAVQSLTKTAI

SEQ ID NO: 1289715 - protein, 18 aa, Mycobacterium
PRWPDIPGRDTFAGISVH

SEQ ID NO: 1289716 - protein, 20 aa, Mycobacterium
PRWTQGRLRWDHVVVLPNTE

SEQ ID NO: 1289717 - protein, 17 aa, Mycobacterium
PRYARAGAAFGFGPAGG

SEQ ID NO: 1289718 - protein, 23 aa, Mycobacterium
PSSMGLRFQVPFDCGVLAVKASW

SEQ ID NO: 1289719 - protein, 24 aa, Mycobacterium
PSTGSFRGSGTWIPLLRSGPGGQA

SEQ ID NO: 1289720 - protein, 18 aa, Mycobacterium
PTAGPVLDWVRAQLRVPV

SEQ ID NO: 1289721 - protein, 20 aa, Mycobacterium
PTCQGEGFVSVELLFLPGTY

SEQ ID NO: 1289722 - protein, 18 aa, Mycobacterium
PTDWGIAAVRCFHGSPAA

SEQ ID NO: 1289723 - protein, 19 aa, Mycobacterium
PTQLCAFTAGVLRAEATHE

SEQ ID NO: 1289724 - protein, 22 aa, Mycobacterium
PTRAAIEAMWEWVTASSDTLKT

SEQ ID NO: 1289725 - protein, 19 aa, Mycobacterium
PVCRACWWDDPDAGPVAGA

SEQ ID NO: 1289726 - protein, 17 aa, Mycobacterium
PVDGILFAVEWKQFCGT

SEQ ID NO: 1289727 - protein, 18 aa, Mycobacterium
PVRLIAGAQLDGWQSYPD

SEQ ID NO: 1289728 - protein, 23 aa, Mycobacterium
PVRRWEDIPGWFGWRQAQEEAVA

SEQ ID NO: 1289729 - protein, 17 aa, Mycobacterium
PVVPRPLIREVTERIDY

SEQ ID NO: 1289730 - protein, 17 aa, Mycobacterium
QAARLAKQLTWQQLADA

SEQ ID NO: 1289731 - protein, 17 aa, Mycobacterium
QAFPHVYCELDFTNPLE

SEQ ID NO: 1289732 - protein, 20 aa, Mycobacterium
QAIAVCLLWSFREPSHEQRV

SEQ ID NO: 1289733 - protein, 18 aa, Mycobacterium
QAIGEGFRSRWTGNLDPA

SEQ ID NO: 1289734 - protein, 19 aa, Mycobacterium
QAQCCVAVLRRGARPAPNG

SEQ ID NO: 1289735 - protein, 18 aa, Mycobacterium
QARVKMGLSQNIAQVTAS

SEQ ID NO: 1289736 - protein, 25 aa, Mycobacterium
QDAGRWRVPLLLAIRPEVGVDDVRA

SEQ ID NO: 1289737 - protein, 23 aa, Mycobacterium
QDVPLNYGRYSLDDSWYEYASVD

SEQ ID NO: 1289738 - protein, 22 aa, Mycobacterium
QIPKLRAGSFFPSLLERRRRID

SEQ ID NO: 1289739 - protein, 21 aa, Mycobacterium
QKVLRHVRGKWTFVMVTDRTE

SEQ ID NO: 1289740 - protein, 18 aa, Mycobacterium
QLALYVCYELHYRGFAGV

SEQ ID NO: 1289741 - protein, 18 aa, Mycobacterium
QLCRRRLLLDQAVLLAKN

SEQ ID NO: 1289742 - protein, 24 aa, Mycobacterium
QLTRKRLGTGLIEAFSTPCPHCAG

SEQ ID NO: 1289743 - protein, 20 aa, Mycobacterium
QMVKRLAWELLYATETCRSF

SEQ ID NO: 1289744 - protein, 24 aa, Mycobacterium
QNRVRRYVCLKGPDHGGCGRLTVV

SEQ ID NO: 1289745 - protein, 20 aa, Mycobacterium
QPFSGFRPGQYVSVGVTLPD

SEQ ID NO: 1289746 - protein, 18 aa, Mycobacterium
QRALQCRAFLLSRAGAEW

SEQ ID NO: 1289747 - protein, 22 aa, Mycobacterium
QRDCVYYATLIMWIGCHADSHE

SEQ ID NO: 1289748 - protein, 21 aa, Mycobacterium
QRFSSAILPAWARKSPQMTEV

SEQ ID NO: 1289749 - protein, 21 aa, Mycobacterium
QRLLLEVAWEALEHAGITPDR

SEQ ID NO: 1289750 - protein, 22 aa, Mycobacterium
QRLPWHPGRCAEVLIGDTVVGH

SEQ ID NO: 1289751 - protein, 19 aa, Mycobacterium
QRRLHLPSRIDAIRHALKA

SEQ ID NO: 1289752 - protein, 21 aa, Mycobacterium
QSGSIGLGFAIPVDQAKRIAD

SEQ ID NO: 1289753 - protein, 17 aa, Mycobacterium
QTRWRIAVEKVLRGAGL

SEQ ID NO: 1289754 - protein, 18 aa, Mycobacterium
QVSFPVECWKQPKVPDSG

SEQ ID NO: 1289755 - protein, 22 aa, Mycobacterium
QWLRCTGCGLLAPVSHNRFIYR

SEQ ID NO: 1289756 - protein, 19 aa, Mycobacterium
QYLGPALRLLNFNNIPLPI

SEQ ID NO: 1289757 - protein, 17 aa, Mycobacterium
RAAENILGYTIANDVSA

SEQ ID NO: 1289758 - protein, 19 aa, Mycobacterium
RAAKARFAVYIGDLGADTA

SEQ ID NO: 1289759 - protein, 26 aa, Mycobacterium
RAALIRTGYDWIRAWCEVFTETELLQ

SEQ ID NO: 1289760 - protein, 24 aa, Mycobacterium
RAATDVLAAWTWQQRPVAVLAMDS

SEQ ID NO: 1289761 - protein, 19 aa, Mycobacterium
RAAVPFRRIVDWAESRRAA

SEQ ID NO: 1289762 - protein, 20 aa, Mycobacterium
RAGELGLVPLHWALASLLAD

SEQ ID NO: 1289763 - protein, 18 aa, Mycobacterium
RAKYAAVIVRSEALTEYL

SEQ ID NO: 1289764 - protein, 17 aa, Mycobacterium
RALREGRLSLDQVGAIA

SEQ ID NO: 1289765 - protein, 19 aa, Mycobacterium
RAMEWPDLVPGSGAVAGGT

SEQ ID NO: 1289766 - protein, 23 aa, Mycobacterium
RAMSQMGVPYSWGGGNAAGPSRG

SEQ ID NO: 1289767 - protein, 19 aa, Mycobacterium
RAPHGAALIEWLEEPGKEH

SEQ ID NO: 1289768 - protein, 19 aa, Mycobacterium
RAREKLGWVPTVHGQTLAR

SEQ ID NO: 1289769 - protein, 28 aa, Mycobacterium
RARLNWWESRALYGWTVLVPRTKDQAGE

SEQ ID NO: 1289770 - protein, 18 aa, Mycobacterium
RARRDLYEALGFERYAGT

SEQ ID NO: 1289771 - protein, 24 aa, Mycobacterium
RAVLPAVVCDRVMPGNCFAPFHFN

SEQ ID NO: 1289772 - protein, 21 aa, Mycobacterium
RAVLRRFSPDWTHTDVTAALY

SEQ ID NO: 1289773 - protein, 22 aa, Mycobacterium
RDEVWRFTPLRRLRGLHDGSAV

SEQ ID NO: 1289774 - protein, 24 aa, Mycobacterium
RDGLRVIAIRSRLMSRLAGQGAVA

SEQ ID NO: 1289775 - protein, 22 aa, Mycobacterium
RDIGFRMPSVWFAEGHNAVAPV

SEQ ID NO: 1289776 - protein, 20 aa, Mycobacterium
RDRCAEAPFLPGASYHFVAT

SEQ ID NO: 1289777 - protein, 17 aa, Mycobacterium
REALRRLSLIGIGTAGA

SEQ ID NO: 1289778 - protein, 17 aa, Mycobacterium
REAYGLFAVNGILFNHE

SEQ ID NO: 1289779 - protein, 18 aa, Mycobacterium
REIGGRTRLDWESLSQRI

SEQ ID NO: 1289780 - protein, 20 aa, Mycobacterium
RELFNNILPAHIVKDVPGGF

SEQ ID NO: 1289781 - protein, 17 aa, Mycobacterium
RELKAGGVHVVRGPRGH

SEQ ID NO: 1289782 - protein, 22 aa, Mycobacterium
REPRPMVYSGLYPVDGSDYPVL

SEQ ID NO: 1289783 - protein, 18 aa, Mycobacterium
RERCLLFVACTRAREELL

SEQ ID NO: 1289784 - protein, 20 aa, Mycobacterium
RERGLRPAAVIGHSVGEVAA

SEQ ID NO: 1289785 - protein, 22 aa, Mycobacterium
RFEFPRLRFVASVGEPLNAEAV

SEQ ID NO: 1289786 - protein, 23 aa, Mycobacterium
RFGEPRLGLAPALSQRSGDVVPT

SEQ ID NO: 1289787 - protein, 19 aa, Mycobacterium
RFPKFDWPRIDAPFIRPGA

SEQ ID NO: 1289788 - protein, 19 aa, Mycobacterium
RFRGRRAAMRLSREYRSWP

SEQ ID NO: 1289789 - protein, 19 aa, Mycobacterium
RFVKFMITEIFPGGRIPTT

SEQ ID NO: 1289790 - protein, 22 aa, Mycobacterium
RGCTHPGCTVPFYWTEAHHTHD

SEQ ID NO: 1289791 - protein, 25 aa, Mycobacterium
RGDFIPEYLCSLSLKVNGKGGQPVY

SEQ ID NO: 1289792 - protein, 20 aa, Mycobacterium
RGDGRIVFWFTPSTHSSHMQ

SEQ ID NO: 1289793 - protein, 25 aa, Mycobacterium
RGPGGVVWRVDFAWPDRRVVAEYES

SEQ ID NO: 1289794 - protein, 20 aa, Mycobacterium
RGRHVVWAGPLGYRDPELLA

SEQ ID NO: 1289795 - protein, 21 aa, Mycobacterium
RGSGPLRWLPAIPTVLADNPH

SEQ ID NO: 1289796 - protein, 20 aa, Mycobacterium
RGTMPAGLARWAAAQLAPAV

SEQ ID NO: 1289797 - protein, 25 aa, Mycobacterium
RGVGRLLWLKAFDRVSVRSTYEDET

SEQ ID NO: 1289798 - protein, 17 aa, Mycobacterium
RGWVPWRGPTSVLSPGG

SEQ ID NO: 1289799 - protein, 22 aa, Mycobacterium
RHKYRVCPTCGRFQRGQELDPA

SEQ ID NO: 1289800 - protein, 19 aa, Mycobacterium
RHLFTVLMDREWKHGVTAA

SEQ ID NO: 1289801 - protein, 17 aa, Mycobacterium
RHLVAGLMLIHLDIDAA

SEQ ID NO: 1289802 - protein, 18 aa, Mycobacterium
RHLVKFVACDGALWAVKE

SEQ ID NO: 1289803 - protein, 18 aa, Mycobacterium
RIAGRCAGIGGLARAGEV

SEQ ID NO: 1289804 - protein, 17 aa, Mycobacterium
RIALPVTFDTLRGSGQS

SEQ ID NO: 1289805 - protein, 20 aa, Mycobacterium
RIDYYAAWLQRFETALRALP

SEQ ID NO: 1289806 - protein, 20 aa, Mycobacterium
RIGLAAAKYWVCKRATPHAA

SEQ ID NO: 1289807 - protein, 17 aa, Mycobacterium
RIGTAVEEFVRWSTPVL

SEQ ID NO: 1289808 - protein, 25 aa, Mycobacterium
RIKSIGLRLGVPWYAYDTITFTGEV

SEQ ID NO: 1289809 - protein, 23 aa, Mycobacterium
RILEKWGGGGVFVLDETLRPVPV

SEQ ID NO: 1289810 - protein, 19 aa, Mycobacterium
RIRPPVCARASDLRAMGLP

SEQ ID NO: 1289811 - protein, 25 aa, Mycobacterium
RIRSIGLRLGVPWYAYDTITFTGEV

SEQ ID NO: 1289812 - protein, 20 aa, Mycobacterium
RITLWRDYFDTVDFLKATVR

SEQ ID NO: 1289813 - protein, 20 aa, Mycobacterium
RIVDCPACGGMLKPDIVYFG

SEQ ID NO: 1289814 - protein, 17 aa, Mycobacterium
RKIVRRLLDAGSVSGEF

SEQ ID NO: 1289815 - protein, 22 aa, Mycobacterium
RKQWPSGLTKLGLDLSGRIHDG

SEQ ID NO: 1289816 - protein, 18 aa, Mycobacterium
RKVIPLLPGYRCITPTLP

SEQ ID NO: 1289817 - protein, 19 aa, Mycobacterium
RKVVGWARDRGVLVASDEC

SEQ ID NO: 1289818 - protein, 18 aa, Mycobacterium
RLAAELVAPLGPVLVEAA

SEQ ID NO: 1289819 - protein, 24 aa, Mycobacterium
RLAALKLIDGRDVWAAGAKLADLL

SEQ ID NO: 1289820 - protein, 17 aa, Mycobacterium
RLAGLVAHQEVLFGTQG

SEQ ID NO: 1289821 - protein, 17 aa, Mycobacterium
RLDQMIRYYVEHQLDVI

SEQ ID NO: 1289822 - protein, 17 aa, Mycobacterium
RLEEAFTAAGLMPRIAF

SEQ ID NO: 1289823 - protein, 18 aa, Mycobacterium
RLKKTLLQGTRWGDENAK

SEQ ID NO: 1289824 - protein, 19 aa, Mycobacterium
RLLLQRGIRSVPVVDDECR

SEQ ID NO: 1289825 - protein, 17 aa, Mycobacterium
RLREFALREGLADAGQR

SEQ ID NO: 1289826 - protein, 18 aa, Mycobacterium
RLRVGLAVGQAVSRAGDW

SEQ ID NO: 1289827 - protein, 22 aa, Mycobacterium
RLRVLARRDFAGLITVAVDSPE

SEQ ID NO: 1289828 - protein, 23 aa, Mycobacterium
RLVWQCASLLLSYPDHSRFDTAE

SEQ ID NO: 1289829 - protein, 19 aa, Mycobacterium
RMYRPFPVEALAAALPETV

SEQ ID NO: 1289830 - protein, 17 aa, Mycobacterium
RNRYRMSMLVPDHLSTR

SEQ ID NO: 1289831 - protein, 21 aa, Mycobacterium
RPAAEIVRMLLERIVGSLEAP

SEQ ID NO: 1289832 - protein, 18 aa, Mycobacterium
RPAALPFLSIKKITVHYR

SEQ ID NO: 1289833 - protein, 22 aa, Mycobacterium
RPAGWWIRRRVHEVAVHRADAA

SEQ ID NO: 1289834 - protein, 18 aa, Mycobacterium
RPDIGVTILRLANMIGPA

SEQ ID NO: 1289835 - protein, 19 aa, Mycobacterium
RPEDLAGWAGDVFDHHQRF

SEQ ID NO: 1289836 - protein, 17 aa, Mycobacterium
RPGPGRRLGVLVDHLVT

SEQ ID NO: 1289837 - protein, 24 aa, Mycobacterium
RPIAVEAYGLFIFRDAIRALGGST

SEQ ID NO: 1289838 - protein, 20 aa, Mycobacterium
RPMYRARGWVPWRGPTSVLS

SEQ ID NO: 1289839 - protein, 20 aa, Mycobacterium
RPNLPPGFDFTDPDIYAERL

SEQ ID NO: 1289840 - protein, 18 aa, Mycobacterium
RPRALVVVSHDRWFLDAV

SEQ ID NO: 1289841 - protein, 20 aa, Mycobacterium
RPSAELRTLIGLRDAAVALV

SEQ ID NO: 1289842 - protein, 19 aa, Mycobacterium
RPSMRGVPFSFVRVDRAGN

SEQ ID NO: 1289843 - protein, 18 aa, Mycobacterium
RPSTWWCEPCAATLTVRA

SEQ ID NO: 1289844 - protein, 24 aa, Mycobacterium
RPWVCLLCPLAVFAPRHAANLLRL

SEQ ID NO: 1289845 - protein, 19 aa, Mycobacterium
RPYAELLVDGFGIPEQLRY

SEQ ID NO: 1289846 - protein, 20 aa, Mycobacterium
RRAAVFGCASGALRLTDGGA

SEQ ID NO: 1289847 - protein, 19 aa, Mycobacterium
RRDDLWDRLIEACRPGMTT

SEQ ID NO: 1289848 - protein, 22 aa, Mycobacterium
RRELWARLGGALKPPHLADLSH

SEQ ID NO: 1289849 - protein, 18 aa, Mycobacterium
RRGECPFGSEGNADGPLP

SEQ ID NO: 1289850 - protein, 18 aa, Mycobacterium
RRGGEWLDWFAAERITAI

SEQ ID NO: 1289851 - protein, 23 aa, Mycobacterium
RRGLTIDLGFAWADIGGREMAFV

SEQ ID NO: 1289852 - protein, 17 aa, Mycobacterium
RRLCTGCGQLTAADAAR

SEQ ID NO: 1289853 - protein, 26 aa, Mycobacterium
RRLLDRISLGGAWDMVKGVFTGEADD

SEQ ID NO: 1289854 - protein, 19 aa, Mycobacterium
RRLPDLKVRVVNVVDIMRL

SEQ ID NO: 1289855 - protein, 26 aa, Mycobacterium
RRPSYRPAAPPARRAAGAAPQFEVMY

SEQ ID NO: 1289856 - protein, 17 aa, Mycobacterium
RRSRRITALAGRYRDVD

SEQ ID NO: 1289857 - protein, 22 aa, Mycobacterium
RRYILDCALRWMRDFHADGLRL

SEQ ID NO: 1289858 - protein, 17 aa, Mycobacterium
RSAELGRVLARCSYLCD

SEQ ID NO: 1289859 - protein, 19 aa, Mycobacterium
RSHVFFDWFDAVGVADLPA

SEQ ID NO: 1289860 - protein, 20 aa, Mycobacterium
RSKFPQRWWWVVLTDEPFPR

SEQ ID NO: 1289861 - protein, 20 aa, Mycobacterium
RSLRVAWTLADLAGRQVPGV

SEQ ID NO: 1289862 - protein, 24 aa, Mycobacterium
RSNNCLDCSLSALSSFRGDPTVSA

SEQ ID NO: 1289863 - protein, 23 aa, Mycobacterium
RSYSPRFLFAWPNSKSAVMGPAQ

SEQ ID NO: 1289864 - protein, 20 aa, Mycobacterium
RTIRLPVHLVEQVNKLARIK

SEQ ID NO: 1289865 - protein, 17 aa, Mycobacterium
RTLRLDQMIRYYVEHQL

SEQ ID NO: 1289866 - protein, 17 aa, Mycobacterium
RTPLRLLFIDGGHTEEA

SEQ ID NO: 1289867 - protein, 23 aa, Mycobacterium
RTPRPPSGWLRMGGISSHNLRDL

SEQ ID NO: 1289868 - protein, 19 aa, Mycobacterium
RTRAIELLELVGLGHRIHH

SEQ ID NO: 1289869 - protein, 18 aa, Mycobacterium
RWADKEWLRKHNVDRISR

SEQ ID NO: 1289870 - protein, 19 aa, Mycobacterium
RWIRLRLSRGLGLEAGGGR

SEQ ID NO: 1289871 - protein, 20 aa, Mycobacterium
RWVRRGGYVLSSFVAAALPA

SEQ ID NO: 1289872 - protein, 24 aa, Mycobacterium
RYGLDMWLRVGATWLSAVDALAAL

SEQ ID NO: 1289873 - protein, 18 aa, Mycobacterium
SAEARSALMLSATRDLPA

SEQ ID NO: 1289874 - protein, 18 aa, Mycobacterium
SAEPLINVARDFMSTEKL

SEQ ID NO: 1289875 - protein, 20 aa, Mycobacterium
SAKLCVQYLAPIIKNRQYNF

SEQ ID NO: 1289876 - protein, 22 aa, Mycobacterium
SAKRLWCRLGDFAPSTDRISAA

SEQ ID NO: 1289877 - protein, 23 aa, Mycobacterium
SAPRAARLEACFEELAELTGQRN

SEQ ID NO: 1289878 - protein, 17 aa, Mycobacterium
SAWCKAAGVAIRHRNPS

SEQ ID NO: 1289879 - protein, 27 aa, Mycobacterium
SCQQVWCPVCALAALVQGEQHPLLNVV

SEQ ID NO: 1289880 - protein, 17 aa, Mycobacterium
SDGGFGLHVFHKNNELA

SEQ ID NO: 1289881 - protein, 18 aa, Mycobacterium
SDILPISVGFPFGVSAVV

SEQ ID NO: 1289882 - protein, 19 aa, Mycobacterium
SDPGFRLVADRAFTDRAHA

SEQ ID NO: 1289883 - protein, 21 aa, Mycobacterium
SDWRMPYVLNPRGIQFTEPKW

SEQ ID NO: 1289884 - protein, 18 aa, Mycobacterium
SEALALLRLPLVLPTLQV

SEQ ID NO: 1289885 - protein, 21 aa, Mycobacterium
SEGWWPFLVGLSMGDAGGYKS

SEQ ID NO: 1289886 - protein, 23 aa, Mycobacterium
SELGFDYVDLFLIHWPLPTLYDG

SEQ ID NO: 1289887 - protein, 24 aa, Mycobacterium
SFRRYRWVLPMARLIGNAARMSAD

SEQ ID NO: 1289888 - protein, 17 aa, Mycobacterium
SGEWKDGEALFLRCNIW

SEQ ID NO: 1289889 - protein, 25 aa, Mycobacterium
SGGRFAVNIVNAWWVPDLERSGIGM

SEQ ID NO: 1289890 - protein, 18 aa, Mycobacterium
SGPMPKWYAPVGSLFDQF

SEQ ID NO: 1289891 - protein, 22 aa, Mycobacterium
SGRIKLAWFLLHVARYLPPLLY

SEQ ID NO: 1289892 - protein, 17 aa, Mycobacterium
SGWPCRRHLDGSVVSVE

SEQ ID NO: 1289893 - protein, 17 aa, Mycobacterium
SLLVSHVLVPPAISAIM

SEQ ID NO: 1289894 - protein, 29 aa, Mycobacterium
SLQWIPDWMWRLNLKVLGPFAVWVTVGLY

SEQ ID NO: 1289895 - protein, 20 aa, Mycobacterium
SPRIRLWWRPAEPMPDDPIL

SEQ ID NO: 1289896 - protein, 21 aa, Mycobacterium
SRGGWKPFLHHVSNRMPRSRR

SEQ ID NO: 1289897 - protein, 21 aa, Mycobacterium
SRIAGPAIRRGWLDDGPGPSR

SEQ ID NO: 1289898 - protein, 20 aa, Mycobacterium
SRIDIPGWLARTGFQMLDPV

SEQ ID NO: 1289899 - protein, 21 aa, Mycobacterium
SRIDIPGWLARTGFQMLDPVK

SEQ ID NO: 1289900 - protein, 19 aa, Mycobacterium
SRPDMFAHYGRPFPTGEAV

SEQ ID NO: 1289901 - protein, 20 aa, Mycobacterium
SRPLPLPDMCYAAAATGELP

SEQ ID NO: 1289902 - protein, 22 aa, Mycobacterium
SRQRLKLALSRYAEHRATGPLP

SEQ ID NO: 1289903 - protein, 22 aa, Mycobacterium
SRRLWTVLIFMLWHAIFVEGSV

SEQ ID NO: 1289904 - protein, 19 aa, Mycobacterium
SRRSYLWGMLHARRRRLEP

SEQ ID NO: 1289905 - protein, 17 aa, Mycobacterium
SRWHDVRRVLAPLIQQV

SEQ ID NO: 1289906 - protein, 20 aa, Mycobacterium
SRYGLVGVHCDVWEGFIFVN

SEQ ID NO: 1289907 - protein, 18 aa, Mycobacterium
SSERYGLFVPRLYGDDFT

SEQ ID NO: 1289908 - protein, 19 aa, Mycobacterium
SSGELHLDWWYDTRRVPQE

SEQ ID NO: 1289909 - protein, 18 aa, Mycobacterium
STAWACGLMAVHAHTVAN

SEQ ID NO: 1289910 - protein, 19 aa, Mycobacterium
STFRYAAPAGRDWAPEDLA

SEQ ID NO: 1289911 - protein, 19 aa, Mycobacterium
SVDCARYWLDADRPISKDD

SEQ ID NO: 1289912 - protein, 17 aa, Mycobacterium
SVGYRLAPEHPWPAAAE

SEQ ID NO: 1289913 - protein, 17 aa, Mycobacterium
SVSCPRSGEVIVRDGAD

SEQ ID NO: 1289914 - protein, 18 aa, Mycobacterium
SWAAEIYADLGLRFDGAR

SEQ ID NO: 1289915 - protein, 18 aa, Mycobacterium
SWLPLYHDMGLAFLLTNA

SEQ ID NO: 1289916 - protein, 24 aa, Mycobacterium
SWLPTGAVPLDFDPCPKLRKLTLA

SEQ ID NO: 1289917 - protein, 22 aa, Mycobacterium
SWTTEIAPPWARPLIAANANPT

SEQ ID NO: 1289918 - protein, 18 aa, Mycobacterium
TAAALWILHPTYFGTTAD

SEQ ID NO: 1289919 - protein, 18 aa, Mycobacterium
TACAVAFGSAFAATTRHA

SEQ ID NO: 1289920 - protein, 20 aa, Mycobacterium
TADEAFALLIERSQRENVKL

SEQ ID NO: 1289921 - protein, 19 aa, Mycobacterium
TADMTVHFLAPVVVGPARA

SEQ ID NO: 1289922 - protein, 25 aa, Mycobacterium
TAEGCADLLYATRLVGVPLNPAAAV

SEQ ID NO: 1289923 - protein, 23 aa, Mycobacterium
TALRAAAVLACYRYHADAHGLVG

SEQ ID NO: 1289924 - protein, 22 aa, Mycobacterium
TAMMIRPQWRFRRGRAAAGGPG

SEQ ID NO: 1289925 - protein, 18 aa, Mycobacterium
TARSWAWLSGRNYVTPDD

SEQ ID NO: 1289926 - protein, 19 aa, Mycobacterium
TCTAWPVLRRSLAMRALSG

SEQ ID NO: 1289927 - protein, 17 aa, Mycobacterium
TDFPNAWIRAGRRRSRE

SEQ ID NO: 1289928 - protein, 22 aa, Mycobacterium
TEFEPGRRWSWQVAGIPATAHG

SEQ ID NO: 1289929 - protein, 17 aa, Mycobacterium
TEFPYVFCDATFCKVRI

SEQ ID NO: 1289930 - protein, 21 aa, Mycobacterium
TEGLRVIAVRSRLMSRLAGQG

SEQ ID NO: 1289931 - protein, 17 aa, Mycobacterium
TELPDWLAANKGLAPGG

SEQ ID NO: 1289932 - protein, 17 aa, Mycobacterium
TELRRKIGYSIQQAGLF

SEQ ID NO: 1289933 - protein, 23 aa, Mycobacterium
TERFAGAVGLNWYTTDPTLQFTL

SEQ ID NO: 1289934 - protein, 20 aa, Mycobacterium
TETEVWRWYLVDKNAPDDVR

SEQ ID NO: 1289935 - protein, 30 aa, Mycobacterium
TEYRAQWLICRALEVVLGWIADGNSGAVPA

SEQ ID NO: 1289936 - protein, 18 aa, Mycobacterium
TFPRPKVTASLERIGRAL

SEQ ID NO: 1289937 - protein, 17 aa, Mycobacterium
TGARPPVAFAPDDTGYG

SEQ ID NO: 1289938 - protein, 26 aa, Mycobacterium
TGEAWVWSPAFLRLLQRVRITMSDTF

SEQ ID NO: 1289939 - protein, 18 aa, Mycobacterium
TGPRSIKAAADWISVNAT

SEQ ID NO: 1289940 - protein, 20 aa, Mycobacterium
TGVSNFSGWQLMKSLAVADG

SEQ ID NO: 1289941 - protein, 18 aa, Mycobacterium
TICSRLGFRPDVKRIPLF

SEQ ID NO: 1289942 - protein, 19 aa, Mycobacterium
TIRLPVHLVEQVNKLARIK

SEQ ID NO: 1289943 - protein, 21 aa, Mycobacterium
TIYRWWPSRPALVADVLLEDA

SEQ ID NO: 1289944 - protein, 18 aa, Mycobacterium
TLFRRFGSRAGLMVVLLD

SEQ ID NO: 1289945 - protein, 18 aa, Mycobacterium
TLIELLRLFAPLPTQLEG

SEQ ID NO: 1289946 - protein, 26 aa, Mycobacterium
TLLDVGCGWGYTMMRAVEKYDVNVIG

SEQ ID NO: 1289947 - protein, 25 aa, Mycobacterium
TLPQWLRRRLALLLDLCYGAGARPP

SEQ ID NO: 1289948 - protein, 23 aa, Mycobacterium
TLQSGPEFGRWLAERGSAQAPET

SEQ ID NO: 1289949 - protein, 23 aa, Mycobacterium
TLTALNGTIVWKGLADRDKVFDA

SEQ ID NO: 1289950 - protein, 17 aa, Mycobacterium
TLTRLAGVLGYADSSAL

SEQ ID NO: 1289951 - protein, 24 aa, Mycobacterium
TLVDPRSSLPIEWVNEILSLTVRL

SEQ ID NO: 1289952 - protein, 17 aa, Mycobacterium
TPPPVRGALVARLGELL

SEQ ID NO: 1289953 - protein, 18 aa, Mycobacterium
TQLCAFTAGVLRAEATHE

SEQ ID NO: 1289954 - protein, 23 aa, Mycobacterium
TQSYRLLKHGGFERILFLVDRNN

SEQ ID NO: 1289955 - protein, 18 aa, Mycobacterium
TRGAPLCTFRETARTLAG

SEQ ID NO: 1289956 - protein, 18 aa, Mycobacterium
TRVQILWALVSHEKSVND

SEQ ID NO: 1289957 - protein, 24 aa, Mycobacterium
TTDWRRLTVTLAWLSPVNTATRRH

SEQ ID NO: 1289958 - protein, 21 aa, Mycobacterium
TTKTRFVIVDAIGVTEHDFVE

SEQ ID NO: 1289959 - protein, 17 aa, Mycobacterium
TTRGGPDYGRFVEAVRE

SEQ ID NO: 1289960 - protein, 18 aa, Mycobacterium
TVTWSLRSARAWWEMTWQ

SEQ ID NO: 1289961 - protein, 18 aa, Mycobacterium
TYAPWDFFSDWKVIDAFG

SEQ ID NO: 1289962 - protein, 18 aa, Mycobacterium
TYRLPWPSGSVVYEIDQP

SEQ ID NO: 1289963 - protein, 17 aa, Mycobacterium
VAAEGIEPFGFYYEKFA

SEQ ID NO: 1289964 - protein, 22 aa, Mycobacterium
VAGSLRASRQWGLPHEVLDADE

SEQ ID NO: 1289965 - protein, 20 aa, Mycobacterium
VAPMRLCHHFAPAMAARGRG

SEQ ID NO: 1289966 - protein, 26 aa, Mycobacterium
VARHAWRPRWLKWSLTISGKGGTHRG

SEQ ID NO: 1289967 - protein, 17 aa, Mycobacterium
VARYPARFQLVMAANPC

SEQ ID NO: 1289968 - protein, 18 aa, Mycobacterium
VAVARPLLAPAIESADAV

SEQ ID NO: 1289969 - protein, 17 aa, Mycobacterium
VCLGLPGSLPVLNQQAV

SEQ ID NO: 1289970 - protein, 24 aa, Mycobacterium
VDAADLPGGIAIRPTLKEAVAYLE

SEQ ID NO: 1289971 - protein, 18 aa, Mycobacterium
VDCTHCWELANPALDDFL

SEQ ID NO: 1289972 - protein, 18 aa, Mycobacterium
VDGIWAEFVPPNANVPSP

SEQ ID NO: 1289973 - protein, 19 aa, Mycobacterium
VDRLLALGARRVDIGQGEQ

SEQ ID NO: 1289974 - protein, 20 aa, Mycobacterium
VDVPRLGLMLVVGQPKNTAE

SEQ ID NO: 1289975 - protein, 21 aa, Mycobacterium
VEEARALAALLTKHADKLESS

SEQ ID NO: 1289976 - protein, 18 aa, Mycobacterium
VEEFVRWSTPVLQFARFA

SEQ ID NO: 1289977 - protein, 21 aa, Mycobacterium
VEGAFYWLSNREVRWRPAEYW

SEQ ID NO: 1289978 - protein, 17 aa, Mycobacterium
VEIPDHFRTYVAEKLTR

SEQ ID NO: 1289979 - protein, 18 aa, Mycobacterium
VELSWNILDPVLDYWASH

SEQ ID NO: 1289980 - protein, 23 aa, Mycobacterium
VERMHRSCLILTFGGGTNEIQRD

SEQ ID NO: 1289981 - protein, 18 aa, Mycobacterium
VFDGCDFSGVDMSESEHV

SEQ ID NO: 1289982 - protein, 18 aa, Mycobacterium
VFLDRVALCFIDDEFGVE

SEQ ID NO: 1289983 - protein, 19 aa, Mycobacterium
VFLSEEWRQVVLARRISTA

SEQ ID NO: 1289984 - protein, 17 aa, Mycobacterium
VGAYFPLGWQMACHVHG

SEQ ID NO: 1289985 - protein, 19 aa, Mycobacterium
VGEDGEWPLFLDVWVEHAV

SEQ ID NO: 1289986 - protein, 17 aa, Mycobacterium
VGFAHRWSGSQSIGRTS

SEQ ID NO: 1289987 - protein, 23 aa, Mycobacterium
VGLRRIGPSAARVDGCLARLRVD

SEQ ID NO: 1289988 - protein, 17 aa, Mycobacterium
VGQLLGSGWKGGAASAF

SEQ ID NO: 1289989 - protein, 18 aa, Mycobacterium
VGRPPVIRRAILTLFADR

SEQ ID NO: 1289990 - protein, 25 aa, Mycobacterium
VHLAIRPGQDWALLLAMVKVVLDEG

SEQ ID NO: 1289991 - protein, 21 aa, Mycobacterium
VHLRRCAACGHIGCCDDSLAR

SEQ ID NO: 1289992 - protein, 19 aa, Mycobacterium
VHVLDMLRYLVGEVAEVSA

SEQ ID NO: 1289993 - protein, 18 aa, Mycobacterium
VHVVLQFGSTVRDTAARI

SEQ ID NO: 1289994 - protein, 22 aa, Mycobacterium
VHYRPRPVVGIIAPWNYPVANA

SEQ ID NO: 1289995 - protein, 18 aa, Mycobacterium
VHYTRTPDEFSWRAGEVL

SEQ ID NO: 1289996 - protein, 20 aa, Mycobacterium
VKAWAEAMVAAWVAGVDREI

SEQ ID NO: 1289997 - protein, 17 aa, Mycobacterium
VKGGWLSTGAPWSYDEP

SEQ ID NO: 1289998 - protein, 18 aa, Mycobacterium
VLASRLLTDFPFRNWEDE

SEQ ID NO: 1289999 - protein, 18 aa, Mycobacterium
VLDGLGLDYSIMFPTLAS

SEQ ID NO: 1290000 - protein, 23 aa, Mycobacterium
VLESWAGGWSFRHELLREVAAEL

SEQ ID NO: 1290001 - protein, 22 aa, Mycobacterium
VLGGGALPFGIFAGGLLTGPEL

SEQ ID NO: 1290002 - protein, 18 aa, Mycobacterium
VLIPAGWCGYSGPRARGM

SEQ ID NO: 1290003 - protein, 19 aa, Mycobacterium
VLMDREWKHGVTAAVDVTL

SEQ ID NO: 1290004 - protein, 19 aa, Mycobacterium
VLPVRCPHVPRNAQDLVWD

SEQ ID NO: 1290005 - protein, 19 aa, Mycobacterium
VLRELRAGLHFNALSLSGI

SEQ ID NO: 1290006 - protein, 21 aa, Mycobacterium
VLRVVRFWISHGVKVFRVDNP

SEQ ID NO: 1290007 - protein, 23 aa, Mycobacterium
VLSRPCPDCGFDASAVHHSDVAD

SEQ ID NO: 1290008 - protein, 19 aa, Mycobacterium
VLTALAWVRDNIAAFGGDP

SEQ ID NO: 1290009 - protein, 18 aa, Mycobacterium
VMAGTGFLGAHADEVYRL

SEQ ID NO: 1290010 - protein, 17 aa, Mycobacterium
VMVRPLIRLSLGKRAPM

SEQ ID NO: 1290011 - protein, 24 aa, Mycobacterium
VNPIDWKIVAGFMREQIPLQLPAG

SEQ ID NO: 1290012 - protein, 17 aa, Mycobacterium
VPAEALAAVNLMSMFGL

SEQ ID NO: 1290013 - protein, 18 aa, Mycobacterium
VPAIPRLPSGKVLRRVLK

SEQ ID NO: 1290014 - protein, 17 aa, Mycobacterium
VPCLEMVQQFAASPPDF

SEQ ID NO: 1290015 - protein, 17 aa, Mycobacterium
VPEAVGVLAARRFDDDT

SEQ ID NO: 1290016 - protein, 19 aa, Mycobacterium
VPICRTAEFLAWFLENVPI

SEQ ID NO: 1290017 - protein, 23 aa, Mycobacterium
VPRHMLETWAFRTFTVHPRENRF

SEQ ID NO: 1290018 - protein, 19 aa, Mycobacterium
VPRKGIPLVAKRLGQGIGG

SEQ ID NO: 1290019 - protein, 22 aa, Mycobacterium
VPYYRVLELAPWLNWPQPNFPV

SEQ ID NO: 1290020 - protein, 17 aa, Mycobacterium
VQLAPWLEPEPVCWAIE

SEQ ID NO: 1290021 - protein, 19 aa, Mycobacterium
VQLDQCWDLLRQRRALRDS

SEQ ID NO: 1290022 - protein, 17 aa, Mycobacterium
VRCARVGALPGLTATLA

SEQ ID NO: 1290023 - protein, 19 aa, Mycobacterium
VRCTWLRNWVNGASGQRLG

SEQ ID NO: 1290024 - protein, 19 aa, Mycobacterium
VRLLAMLPLAPLVPFAHDG

SEQ ID NO: 1290025 - protein, 22 aa, Mycobacterium
VRPEPFGALLYHFGTRKLSFLK

SEQ ID NO: 1290026 - protein, 19 aa, Mycobacterium
VRQRVRWLALHGFVRGMSR

SEQ ID NO: 1290027 - protein, 17 aa, Mycobacterium
VRVPIDFSLDDCDLSDG

SEQ ID NO: 1290028 - protein, 24 aa, Mycobacterium
VRYDWPVRTGIIIGRLDADGSRFL

SEQ ID NO: 1290029 - protein, 23 aa, Mycobacterium
VSFLPELLRWVPFTKGDYWVLKI

SEQ ID NO: 1290030 - protein, 18 aa, Mycobacterium
VSGDAWPGVSVVSVTWTR

SEQ ID NO: 1290031 - protein, 22 aa, Mycobacterium
VSLLRARLGAVFAGGPKALPPM

SEQ ID NO: 1290032 - protein, 17 aa, Mycobacterium
VSLRAGSDIALLGGVIN

SEQ ID NO: 1290033 - protein, 24 aa, Mycobacterium
VSPPTKWHLIVPFLNVLPGGMFAG

SEQ ID NO: 1290034 - protein, 17 aa, Mycobacterium
VSVSWIYRGGRADLVPE

SEQ ID NO: 1290035 - protein, 18 aa, Mycobacterium
VTLGIALARLGMFAPAMS

SEQ ID NO: 1290036 - protein, 19 aa, Mycobacterium
VTLNEEFPRLKVYRGPRKK

SEQ ID NO: 1290037 - protein, 23 aa, Mycobacterium
VTNCARTAFDLGRRLPRDDAVAR

SEQ ID NO: 1290038 - protein, 21 aa, Mycobacterium
VTPKSSWPWVRTLLHSVFDQP

SEQ ID NO: 1290039 - protein, 18 aa, Mycobacterium
VTVGLVFRALFGQPDLLS

SEQ ID NO: 1290040 - protein, 17 aa, Mycobacterium
VTVRVPIDFSLDDCDLS

SEQ ID NO: 1290041 - protein, 17 aa, Mycobacterium
VVDRTWAALKYVAGTTT

SEQ ID NO: 1290042 - protein, 19 aa, Mycobacterium
VVLAPRLWVPDDFGLSRYL

SEQ ID NO: 1290043 - protein, 19 aa, Mycobacterium
VVLGDAWGLLKFLDEGAFV

SEQ ID NO: 1290044 - protein, 17 aa, Mycobacterium
VVSGWFKDEFTHLGEPW

SEQ ID NO: 1290045 - protein, 27 aa, Mycobacterium
VWFPGKKGGPGWVEWGGCGMVNPNVLR

SEQ ID NO: 1290046 - protein, 21 aa, Mycobacterium
VWRDNGRWSRFFMVPGGHIHR

SEQ ID NO: 1290047 - protein, 25 aa, Mycobacterium
VYNAGGPDLLVWVAPPPAAPAGSGA

SEQ ID NO: 1290048 - protein, 23 aa, Mycobacterium
WADLVVTLRPEWTAGQARFAVYA

SEQ ID NO: 1290049 - protein, 18 aa, Mycobacterium
WALAVKMSPVLSGASAVR

SEQ ID NO: 1290050 - protein, 24 aa, Mycobacterium
WAPWCGPCRAFAPVFERSSQTHPD

SEQ ID NO: 1290051 - protein, 18 aa, Mycobacterium
WATWCGPCKMVAPVLEEI

SEQ ID NO: 1290052 - protein, 19 aa, Mycobacterium
WATWCGPCKMVAPVLEEIA

SEQ ID NO: 1290053 - protein, 20 aa, Mycobacterium
WAVGEWAHWRVLKQAEDEQR

SEQ ID NO: 1290054 - protein, 22 aa, Mycobacterium
WCGYCVRLKKALQVEGIAWTEV

SEQ ID NO: 1290055 - protein, 17 aa, Mycobacterium
WCKAAGVAIRHRNPSAT

SEQ ID NO: 1290056 - protein, 19 aa, Mycobacterium
WDFFSDWKVIDAFGARSEI

SEQ ID NO: 1290057 - protein, 24 aa, Mycobacterium
WEALQIPVGLAFFFRNSALGRVVA

SEQ ID NO: 1290058 - protein, 18 aa, Mycobacterium
WEQFIPFLAFPPELRRVI

SEQ ID NO: 1290059 - protein, 17 aa, Mycobacterium
WFEGLLWFSDMFGEAVH

SEQ ID NO: 1290060 - protein, 18 aa, Mycobacterium
WFLNGADFIALRKLKETT

SEQ ID NO: 1290061 - protein, 18 aa, Mycobacterium
WFTCALSRLDVVRATAAL

SEQ ID NO: 1290062 - protein, 17 aa, Mycobacterium
WGALTALVFDNRDSWRR

SEQ ID NO: 1290063 - protein, 20 aa, Mycobacterium
WGETPFTIGLWVGTAVSPKR

SEQ ID NO: 1290064 - protein, 18 aa, Mycobacterium
WHQACWKVAGAPMDYRGA

SEQ ID NO: 1290065 - protein, 17 aa, Mycobacterium
WIREQCSFLPTRIDPPN

SEQ ID NO: 1290066 - protein, 20 aa, Mycobacterium
WKHGVCAALGWPHDTQADIA

SEQ ID NO: 1290067 - protein, 19 aa, Mycobacterium
WKVPKAWLDSGVVKEAHSW

SEQ ID NO: 1290068 - protein, 19 aa, Mycobacterium
WLAARGMTGLLQRTVVVLN

SEQ ID NO: 1290069 - protein, 17 aa, Mycobacterium
WLALDGQPLHRVIVAAS

SEQ ID NO: 1290070 - protein, 19 aa, Mycobacterium
WLARDRWAVPLVHTAHTLA

SEQ ID NO: 1290071 - protein, 18 aa, Mycobacterium
WLARTGFQMLDPVKTAQA

SEQ ID NO: 1290072 - protein, 31 aa, Mycobacterium
WLFRHVPFYRAWFRFRLYWIYTERNYPALRV

SEQ ID NO: 1290073 - protein, 17 aa, Mycobacterium
WLMQHVRAGVVQTSDAA

SEQ ID NO: 1290074 - protein, 25 aa, Mycobacterium
WLRAWPVPGGDLWAVPTGWRVGDHA

SEQ ID NO: 1290075 - protein, 27 aa, Mycobacterium
WLREGLRFWLRSALTYDLLTWSSVVDR

SEQ ID NO: 1290076 - protein, 17 aa, Mycobacterium
WLSLWSATIDDMYRGPV

SEQ ID NO: 1290077 - protein, 18 aa, Mycobacterium
WLTPQWDADFGVAHGLPV

SEQ ID NO: 1290078 - protein, 17 aa, Mycobacterium
WNAVCWAIIIPAGRLRT

SEQ ID NO: 1290079 - protein, 20 aa, Mycobacterium
WNLDTGYDWAHRFDDAAREV

SEQ ID NO: 1290080 - protein, 17 aa, Mycobacterium
WNQAGDVMAGWDGASTG

SEQ ID NO: 1290081 - protein, 17 aa, Mycobacterium
WNRYLAVNLTGTFLSIR

SEQ ID NO: 1290082 - protein, 17 aa, Mycobacterium
WPDFTFRFRNQTRRFDL

SEQ ID NO: 1290083 - protein, 17 aa, Mycobacterium
WPDKRPYAPGSVLPASA

SEQ ID NO: 1290084 - protein, 18 aa, Mycobacterium
WPSRRSWEAMARVLAHLR

SEQ ID NO: 1290085 - protein, 26 aa, Mycobacterium
WRGKAVLVKLIWRMVRARVFGDRMAA

SEQ ID NO: 1290086 - protein, 17 aa, Mycobacterium
WRITETLAPTAAVPEPQ

SEQ ID NO: 1290087 - protein, 25 aa, Mycobacterium
WRKAGFRFSLDWLLRNATAVATGRA

SEQ ID NO: 1290088 - protein, 17 aa, Mycobacterium
WRMLLDLGRMQDGEPHL

SEQ ID NO: 1290089 - protein, 19 aa, Mycobacterium
WRPVDGVAIANERYALSVD

SEQ ID NO: 1290090 - protein, 19 aa, Mycobacterium
WRQWWTWSPGACWRHPLGP

SEQ ID NO: 1290091 - protein, 18 aa, Mycobacterium
WRTLTWLQAHGWSRLLPR

SEQ ID NO: 1290092 - protein, 18 aa, Mycobacterium
WRTPLRLLFIDGGHTEEA

SEQ ID NO: 1290093 - protein, 21 aa, Mycobacterium
WSLRSARAWWEMTWQGRPDPS

SEQ ID NO: 1290094 - protein, 18 aa, Mycobacterium
WSPQEWKEVVFAPSTTSP

SEQ ID NO: 1290095 - protein, 18 aa, Mycobacterium
WSRLLPRTVVALNRTASH

SEQ ID NO: 1290096 - protein, 17 aa, Mycobacterium
WSWRHQLRGLGGARVVA

SEQ ID NO: 1290097 - protein, 25 aa, Mycobacterium
WTDKPRLLATFPFPHVLTMSVTLAD

SEQ ID NO: 1290098 - protein, 21 aa, Mycobacterium
WTEEVFKAFNFQTELTFDESE

SEQ ID NO: 1290099 - protein, 17 aa, Mycobacterium
WTNCYHMYPAHAAFGGY

SEQ ID NO: 1290100 - protein, 18 aa, Mycobacterium
WTPGASWRHPIGPGSSIV

SEQ ID NO: 1290101 - protein, 22 aa, Mycobacterium
WTSLAHLCQWGLATVRTDPDAP

SEQ ID NO: 1290102 - protein, 18 aa, Mycobacterium
WVNARYQFLVLYTVGDDA

SEQ ID NO: 1290103 - protein, 23 aa, Mycobacterium
WYRCDTCRLLTAFSIRDVCPNSR

SEQ ID NO: 1290104 - protein, 19 aa, Mycobacterium
YANRFGYNVVRDFTGHGIG

SEQ ID NO: 1290105 - protein, 22 aa, Mycobacterium
YANRFGYNVVRDFTGHGIGTTF

SEQ ID NO: 1290106 - protein, 23 aa, Mycobacterium
YARPTQEALYRWYKTVAEEYPDL

SEQ ID NO: 1290107 - protein, 20 aa, Mycobacterium
YATETCRSFALWAVGLMYSA

SEQ ID NO: 1290108 - protein, 18 aa, Mycobacterium
YATLLGRWVDEHNLGRRD

SEQ ID NO: 1290109 - protein, 21 aa, Mycobacterium
YCPPELPGLEPLWGKSVFQCP

SEQ ID NO: 1290110 - protein, 18 aa, Mycobacterium
YDLLEPWELLVLVDALPD

SEQ ID NO: 1290111 - protein, 17 aa, Mycobacterium
YDVMMQLCRPLTVFEID

SEQ ID NO: 1290112 - protein, 17 aa, Mycobacterium
YDYIPTYILRGLTELHL

SEQ ID NO: 1290113 - protein, 21 aa, Mycobacterium
YEIKDPRLAGVTITDSKVTND

SEQ ID NO: 1290114 - protein, 26 aa, Mycobacterium
YELPLPPSLRARAEWHRFTITLAYMA

SEQ ID NO: 1290115 - protein, 27 aa, Mycobacterium
YERSTCFWQRIAYLYSRFDALVEEVKR

SEQ ID NO: 1290116 - protein, 23 aa, Mycobacterium
YFKVMLVNLAPYWILQPYVDAAF

SEQ ID NO: 1290117 - protein, 18 aa, Mycobacterium
YGALIAVQWAARHPSRVA

SEQ ID NO: 1290118 - protein, 17 aa, Mycobacterium
YGYGLAISHKRVWRCMT

SEQ ID NO: 1290119 - protein, 17 aa, Mycobacterium
YILVLRTEFPNGFVATV

SEQ ID NO: 1290120 - protein, 21 aa, Mycobacterium
YIYAYGFRNPFRLTFTPDGKL

SEQ ID NO: 1290121 - protein, 18 aa, Mycobacterium
YKKLARLGSRGDFIPEYL

SEQ ID NO: 1290122 - protein, 28 aa, Mycobacterium
YLAMACFKLAVVIEGTWSRYLAGRATRE

SEQ ID NO: 1290123 - protein, 20 aa, Mycobacterium
YLCTLREGLLYALVPDRSGF

SEQ ID NO: 1290124 - protein, 18 aa, Mycobacterium
YLGDRGWRTDSITATALL

SEQ ID NO: 1290125 - protein, 18 aa, Mycobacterium
YLSGRWSQVYGFPVMPVD

SEQ ID NO: 1290126 - protein, 18 aa, Mycobacterium
YPAWRELFNNILPAHIVK

SEQ ID NO: 1290127 - protein, 17 aa, Mycobacterium
YPRKGVSDLTRFTPDAV

SEQ ID NO: 1290128 - protein, 19 aa, Mycobacterium
YQNAMRWYHWDPFTHIPKE

SEQ ID NO: 1290129 - protein, 18 aa, Mycobacterium
YQRFAAFWRSRPVNWVWD

SEQ ID NO: 1290130 - protein, 18 aa, Mycobacterium
YRAALVAAWGRLRDEDCR

SEQ ID NO: 1290131 - protein, 19 aa, Mycobacterium
YREASGWGHPVQPGLALLR

SEQ ID NO: 1290132 - protein, 18 aa, Mycobacterium
YRFDDFRVPELVSDQTRM

SEQ ID NO: 1290133 - protein, 17 aa, Mycobacterium
YRLSADNRIVWGGYDAV

SEQ ID NO: 1290134 - protein, 20 aa, Mycobacterium
YRPNPGLARDLAFIAFSTLG

SEQ ID NO: 1290135 - protein, 19 aa, Mycobacterium
YRTEVEWATQMSYSGIYVH

SEQ ID NO: 1290136 - protein, 17 aa, Mycobacterium
YTGRGMAFLDLIQEGNL

SEQ ID NO: 1290137 - protein, 24 aa, Mycobacterium
YTNYRPVPLYGYRAKDVNGDYEKV

SEQ ID NO: 1290138 - protein, 21 aa, Mycobacterium
YWYARHLRLPPGVPAHHSGYL

SEQ ID NO: 1290139 - protein, 18 aa, Mycobacterium
AAAALWILHPTYFGTTAD

SEQ ID NO: 1290140 - protein, 17 aa, Mycobacterium
AAACARLALEPGTSAAD

SEQ ID NO: 1290141 - protein, 18 aa, Mycobacterium
AAACLRKTDWLFPQYREL

SEQ ID NO: 1290142 - protein, 19 aa, Mycobacterium
AAAGLEWEGSALLDLATGI

SEQ ID NO: 1290143 - protein, 18 aa, Mycobacterium
AAAIPHLLEHGGSLVNIS

SEQ ID NO: 1290144 - protein, 19 aa, Mycobacterium
AAALPEYMTPAAYVVVDEI

SEQ ID NO: 1290145 - protein, 17 aa, Mycobacterium
AAAMEWARDDIRVNVVC

SEQ ID NO: 1290146 - protein, 17 aa, Mycobacterium
AAARLGHRSALISGVGD

SEQ ID NO: 1290147 - protein, 24 aa, Mycobacterium
AAASARFGATFARMGLGPDYGLSK

SEQ ID NO: 1290148 - protein, 17 aa, Mycobacterium
AAAVWRIRRAAPLLPTV

SEQ ID NO: 1290149 - protein, 18 aa, Mycobacterium
AAAWPLRLVTRNGTVCGF

SEQ ID NO: 1290150 - protein, 22 aa, Mycobacterium
AACKGRGGAVLVCGESGAGKTS

SEQ ID NO: 1290151 - protein, 18 aa, Mycobacterium
AACSGHFYTDEEILLEEG

SEQ ID NO: 1290152 - protein, 17 aa, Mycobacterium
AADAAGFDAVWASEFYS

SEQ ID NO: 1290153 - protein, 25 aa, Mycobacterium
AADAGRPWWEWAATYERAFTAAYDA

SEQ ID NO: 1290154 - protein, 19 aa, Mycobacterium
AAEHIGGWANRPLPLPDMC

SEQ ID NO: 1290155 - protein, 17 aa, Mycobacterium
AAELQWLLAGAKTLSYA

SEQ ID NO: 1290156 - protein, 18 aa, Mycobacterium
AAEQSVWRRAFEAARPRA

SEQ ID NO: 1290157 - protein, 18 aa, Mycobacterium
AAERSRIGLLLVDDAQHL

SEQ ID NO: 1290158 - protein, 17 aa, Mycobacterium
AAFDHEDICVAIIKHAN

SEQ ID NO: 1290159 - protein, 21 aa, Mycobacterium
AAFSRGLWWSALRATDRADAG

SEQ ID NO: 1290160 - protein, 18 aa, Mycobacterium
AAFTRLGGRIAKRERGRY

SEQ ID NO: 1290161 - protein, 17 aa, Mycobacterium
AAGAPGWDVSAEELEQT

SEQ ID NO: 1290162 - protein, 17 aa, Mycobacterium
AAGELIGAIAMSEPGAG

SEQ ID NO: 1290163 - protein, 19 aa, Mycobacterium
AAGFMTVWARMYAPDGAAF

SEQ ID NO: 1290164 - protein, 18 aa, Mycobacterium
AAGFPFRTLHDAYRALQA

SEQ ID NO: 1290165 - protein, 20 aa, Mycobacterium
AAGLCARLGSTRGSFYHHFG

SEQ ID NO: 1290166 - protein, 22 aa, Mycobacterium
AAGLPRPVRRVPLLGARLRELL

SEQ ID NO: 1290167 - protein, 19 aa, Mycobacterium
AAGLRCLRMTVYIVCAPGF

SEQ ID NO: 1290168 - protein, 17 aa, Mycobacterium
AAGPGWWLPSLLVRRLD

SEQ ID NO: 1290169 - protein, 27 aa, Mycobacterium
AAGSPNYLGTTGFPYTNVVVDNAITGN

SEQ ID NO: 1290170 - protein, 24 aa, Mycobacterium
AAGVCFPDLLMLRGEYQMKVPAPF

SEQ ID NO: 1290171 - protein, 24 aa, Mycobacterium
AAGVVRPDLVIGWWAVPTILEHGS

SEQ ID NO: 1290172 - protein, 17 aa, Mycobacterium
AAGWLRYGLPSQFGGRD

SEQ ID NO: 1290173 - protein, 17 aa, Mycobacterium
AAHDGWCALTLSRPDDI

SEQ ID NO: 1290174 - protein, 20 aa, Mycobacterium
AAHGCPLLLLLVSSAISGEL

SEQ ID NO: 1290175 - protein, 20 aa, Mycobacterium
AAHPKLGLLVLTTFLDEDLV

SEQ ID NO: 1290176 - protein, 25 aa, Mycobacterium
AAHPKSPWIFRGYRPGMHLAPTHLR

SEQ ID NO: 1290177 - protein, 17 aa, Mycobacterium
AAIEGWRILGMLRGGDG

SEQ ID NO: 1290178 - protein, 18 aa, Mycobacterium
AAIGRISYRLGLQGPAVA

SEQ ID NO: 1290179 - protein, 17 aa, Mycobacterium
AAILASIAFHTRVTADD

SEQ ID NO: 1290180 - protein, 18 aa, Mycobacterium
AAKARFAVYIGDLGADTA

SEQ ID NO: 1290181 - protein, 17 aa, Mycobacterium
AAKRIRRRVGLVFQDPF

SEQ ID NO: 1290182 - protein, 24 aa, Mycobacterium
AALAREFLLTWFVYTAWELADAKR

SEQ ID NO: 1290183 - protein, 17 aa, Mycobacterium
AALGWPGTEHQWLDGWL

SEQ ID NO: 1290184 - protein, 18 aa, Mycobacterium
AALKRPGSFLARQVPQFM

SEQ ID NO: 1290185 - protein, 17 aa, Mycobacterium
AALLDRYLGFLALDPTT

SEQ ID NO: 1290186 - protein, 17 aa, Mycobacterium
AALLPVHCWFEPDGWGM

SEQ ID NO: 1290187 - protein, 24 aa, Mycobacterium
AALNFAMAIPTGWDDAISYLTGDP

SEQ ID NO: 1290188 - protein, 25 aa, Mycobacterium
AALSRVGSPYSWGATGPNAFDCSGL

SEQ ID NO: 1290189 - protein, 20 aa, Mycobacterium
AALSSRPAVVFSRRQLLEAV

SEQ ID NO: 1290190 - protein, 25 aa, Mycobacterium
AALTARLAFDWAQLKPGDRVLIHAA

SEQ ID NO: 1290191 - protein, 24 aa, Mycobacterium
AALTRVGAPYSWGATGPDAFDCSG

SEQ ID NO: 1290192 - protein, 18 aa, Mycobacterium
AAMDRLGFHEAWVGEHHS

SEQ ID NO: 1290193 - protein, 20 aa, Mycobacterium
AAMFDGRFAGFADFLILEDS

SEQ ID NO: 1290194 - protein, 23 aa, Mycobacterium
AAMMPMRVIGMLLGIPESEQVSV

SEQ ID NO: 1290195 - protein, 20 aa, Mycobacterium
AAMRRIPLTLAHVLPSAATQ

SEQ ID NO: 1290196 - protein, 21 aa, Mycobacterium
AANRWPAVRFAVRNPIVQGPN

SEQ ID NO: 1290197 - protein, 17 aa, Mycobacterium
AAPEMRHIIADSGAKIV

SEQ ID NO: 1290198 - protein, 24 aa, Mycobacterium
AAPNLRPQPCLDLYTAVRDGERSR

SEQ ID NO: 1290199 - protein, 18 aa, Mycobacterium
AAQALPRRDRVVLVGQAP

SEQ ID NO: 1290200 - protein, 19 aa, Mycobacterium
AAQDWPLLVADASQPSTLN

SEQ ID NO: 1290201 - protein, 20 aa, Mycobacterium
AAQKAHWGVCLARTDPDAPK

SEQ ID NO: 1290202 - protein, 18 aa, Mycobacterium
AAQLPAGVTVRWTDLTDA

SEQ ID NO: 1290203 - protein, 19 aa, Mycobacterium
AAQQRWFRLSALAERVSAT

SEQ ID NO: 1290204 - protein, 23 aa, Mycobacterium
AAQRLGLVPLQWAVASLLADIGA

SEQ ID NO: 1290205 - protein, 24 aa, Mycobacterium
AARARYGFADFKLKGGVLPAADEA

SEQ ID NO: 1290206 - protein, 19 aa, Mycobacterium
AARDWWSMDWMWSALHLDD

SEQ ID NO: 1290207 - protein, 18 aa, Mycobacterium
AARLSVVVDQVWRAEGLA

SEQ ID NO: 1290208 - protein, 19 aa, Mycobacterium
AARRARAKVLAISREDQLA

SEQ ID NO: 1290209 - protein, 19 aa, Mycobacterium
AARRWGLRRGVPTVVYDDW

SEQ ID NO: 1290210 - protein, 21 aa, Mycobacterium
AARTWIREQCSFLPTRIDPPN

SEQ ID NO: 1290211 - protein, 24 aa, Mycobacterium
AASLAYQFGLEWGVERSRDFRFAV

SEQ ID NO: 1290212 - protein, 24 aa, Mycobacterium
AASSRPLYPWPLALARDTEPRRTT

SEQ ID NO: 1290213 - protein, 17 aa, Mycobacterium
AAVAVEWALAHPTQVVA

SEQ ID NO: 1290214 - protein, 17 aa, Mycobacterium
AAVCPHVEWALSSTLNA

SEQ ID NO: 1290215 - protein, 19 aa, Mycobacterium
AAVEWGAGDTMVWLRHFNA

SEQ ID NO: 1290216 - protein, 19 aa, Mycobacterium
AAVLADWWSAVLGGTVDGF

SEQ ID NO: 1290217 - protein, 18 aa, Mycobacterium
AAVPFRRIVDWAESRRAA

SEQ ID NO: 1290218 - protein, 18 aa, Mycobacterium
AAVSRLSYDGRLQSNEAV

SEQ ID NO: 1290219 - protein, 19 aa, Mycobacterium
AAVVRFIGVDGYRWMVRCV

SEQ ID NO: 1290220 - protein, 18 aa, Mycobacterium
AAWREAVKVFGRNQVSTY

SEQ ID NO: 1290221 - protein, 17 aa, Mycobacterium
AAYEWHMRAAAWSQQRD

SEQ ID NO: 1290222 - protein, 23 aa, Mycobacterium
AAYLRATFDWHIDGCTPTGDEYP

SEQ ID NO: 1290223 - protein, 17 aa, Mycobacterium
ACAELRSPAGFAQHPQL

SEQ ID NO: 1290224 - protein, 25 aa, Mycobacterium
ACDGGIRLSGRWSWATGVMDGNWMM

SEQ ID NO: 1290225 - protein, 24 aa, Mycobacterium
ACGGRFTLGLGLSHDWIINGQLGI

SEQ ID NO: 1290226 - protein, 20 aa, Mycobacterium
ACLLGCGFITGWGSSVYAAE

SEQ ID NO: 1290227 - protein, 17 aa, Mycobacterium
ACLRSLEALGMLDTEVM

SEQ ID NO: 1290228 - protein, 17 aa, Mycobacterium
ACLTCPVFITTPEFLPQ

SEQ ID NO: 1290229 - protein, 18 aa, Mycobacterium
ADAKAVIVAQNLVAERFV

SEQ ID NO: 1290230 - protein, 25 aa, Mycobacterium
ADALALAICHCWRAPMLGRMAAAEE

SEQ ID NO: 1290231 - protein, 23 aa, Mycobacterium
ADALWPMLVLRTAVLIVSGAQQS

SEQ ID NO: 1290232 - protein, 17 aa, Mycobacterium
ADAMSWFGLFADAEDAE

SEQ ID NO: 1290233 - protein, 20 aa, Mycobacterium
ADAPIGWRRPLSPQPGRDLV

SEQ ID NO: 1290234 - protein, 19 aa, Mycobacterium
ADAVVEHWGPPPGELFVDR

SEQ ID NO: 1290235 - protein, 21 aa, Mycobacterium
ADAYRAISLLLRRPPGREAFP

SEQ ID NO: 1290236 - protein, 17 aa, Mycobacterium
ADCARWVADQLAEVGYV

SEQ ID NO: 1290237 - protein, 21 aa, Mycobacterium
ADDLRWWAARIGEWDAQGRDV

SEQ ID NO: 1290238 - protein, 24 aa, Mycobacterium
ADDSARLWFEVAKPLMSTNPQRSG

SEQ ID NO: 1290239 - protein, 21 aa, Mycobacterium
ADERLRRIFTFQALYAGVPPH

SEQ ID NO: 1290240 - protein, 17 aa, Mycobacterium
ADFIGLHFFSPVERMDL

SEQ ID NO: 1290241 - protein, 17 aa, Mycobacterium
ADFLDRWRRAAEMTLAQ

SEQ ID NO: 1290242 - protein, 19 aa, Mycobacterium
ADFNFAWPTARIAVIGAEG

SEQ ID NO: 1290243 - protein, 18 aa, Mycobacterium
ADGAEFFAAVSLRPDSVP

SEQ ID NO: 1290244 - protein, 18 aa, Mycobacterium
ADGIAFIPWFPLAAGPLA

SEQ ID NO: 1290245 - protein, 17 aa, Mycobacterium
ADGLGLLRMVLGGRLEV

SEQ ID NO: 1290246 - protein, 20 aa, Mycobacterium
ADGRGATMIFTRTKRTAQKV

SEQ ID NO: 1290247 - protein, 19 aa, Mycobacterium
ADGTFEWRFTPKVPSQLVI

SEQ ID NO: 1290248 - protein, 23 aa, Mycobacterium
ADIERLEFLAARGWLIVRVSATQ

SEQ ID NO: 1290249 - protein, 20 aa, Mycobacterium
ADIRLRWAESMADAAREIRS

SEQ ID NO: 1290250 - protein, 22 aa, Mycobacterium
ADIYRFLPGLGVILGARVLGEF

SEQ ID NO: 1290251 - protein, 23 aa, Mycobacterium
ADKGVSRRSVFRLFDKLANAGMA

SEQ ID NO: 1290252 - protein, 20 aa, Mycobacterium
ADKLTAPALIVWGSRDTAIP

SEQ ID NO: 1290253 - protein, 26 aa, Mycobacterium
ADLDAFLRLLGDRGVDVLIYNVQTEG

SEQ ID NO: 1290254 - protein, 23 aa, Mycobacterium
ADLEPLKQFGFTVASYQSASFVR

SEQ ID NO: 1290255 - protein, 19 aa, Mycobacterium
ADLERRVAGFLGFTDIFTS

SEQ ID NO: 1290256 - protein, 21 aa, Mycobacterium
ADLPPAVGVLVEYTGGDTSAA

SEQ ID NO: 1290257 - protein, 18 aa, Mycobacterium
ADLRGDWAPPLRIRGFDP

SEQ ID NO: 1290258 - protein, 19 aa, Mycobacterium
ADLWRAAADLGWHGLAVAE

SEQ ID NO: 1290259 - protein, 18 aa, Mycobacterium
ADMTVHFLAPVVVGPARA

SEQ ID NO: 1290260 - protein, 17 aa, Mycobacterium
ADNRIVWGGYDAVYHFG

SEQ ID NO: 1290261 - protein, 18 aa, Mycobacterium
ADNRIVWGGYDAVYHFGR

SEQ ID NO: 1290262 - protein, 32 aa, Mycobacterium
ADRAGSCQQVWCPVCALAALVQGEQHPLLNVV

SEQ ID NO: 1290263 - protein, 19 aa, Mycobacterium
ADRAKWRLVGPMHLAETRE

SEQ ID NO: 1290264 - protein, 24 aa, Mycobacterium
ADRLGAEFPRVDWLFATASRQTVP

SEQ ID NO: 1290265 - protein, 29 aa, Mycobacterium
ADRYPRWWQAPLRWAFRGALGARASLVVR

SEQ ID NO: 1290266 - protein, 18 aa, Mycobacterium
ADSLKEFSIRAVDGSQST

SEQ ID NO: 1290267 - protein, 18 aa, Mycobacterium
ADSYKAYLMCFGSTGMFE

SEQ ID NO: 1290268 - protein, 17 aa, Mycobacterium
ADVKWTIVGGMVLEGAD

SEQ ID NO: 1290269 - protein, 18 aa, Mycobacterium
ADVVVAWPTAQIAVMGAS

SEQ ID NO: 1290270 - protein, 17 aa, Mycobacterium
ADYIYAYGFRNPFRLTF

SEQ ID NO: 1290271 - protein, 21 aa, Mycobacterium
ADYLGRWVILFSHPADFTPVC

SEQ ID NO: 1290272 - protein, 24 aa, Mycobacterium
ADYQCISCGLVPNATKAKALYDNQ

SEQ ID NO: 1290273 - protein, 18 aa, Mycobacterium
AEAARLGFTYAVVPSGVT

SEQ ID NO: 1290274 - protein, 21 aa, Mycobacterium
AEAIRRFGPIFAQYYGQSEAP

SEQ ID NO: 1290275 - protein, 18 aa, Mycobacterium
AEALRMARGHDVAHDVAL

SEQ ID NO: 1290276 - protein, 18 aa, Mycobacterium
AEAVWACRTLAATHYASG

SEQ ID NO: 1290277 - protein, 23 aa, Mycobacterium
AEDPRVAGLIARVQIDAAPPGPV

SEQ ID NO: 1290278 - protein, 22 aa, Mycobacterium
AEEALAMGLAWKVCEPAELMPT

SEQ ID NO: 1290279 - protein, 17 aa, Mycobacterium
AEECARAGVPRQLNITG

SEQ ID NO: 1290280 - protein, 22 aa, Mycobacterium
AEEILEPLGFRWTNFGVAESDV

SEQ ID NO: 1290281 - protein, 18 aa, Mycobacterium
AEEMLYLAMEDFRVDVVV

SEQ ID NO: 1290282 - protein, 20 aa, Mycobacterium
AEGCVREMLVLAAALSIPDP

SEQ ID NO: 1290283 - protein, 18 aa, Mycobacterium
AEGGRFACGGGRPADRDT

SEQ ID NO: 1290284 - protein, 24 aa, Mycobacterium
AEGHCWFTAGTLWREAAQLAGVEL

SEQ ID NO: 1290285 - protein, 17 aa, Mycobacterium
AEGMPAYGSCAGMILLA

SEQ ID NO: 1290286 - protein, 17 aa, Mycobacterium
AEGPGFNVCIVKDGKLA

SEQ ID NO: 1290287 - protein, 17 aa, Mycobacterium
AEHFPRLDIAVEVVDEP

SEQ ID NO: 1290288 - protein, 17 aa, Mycobacterium
AEHIGGWSRRPLPLPDM

SEQ ID NO: 1290289 - protein, 18 aa, Mycobacterium
AEHLKQRWARGSGGLLVV

SEQ ID NO: 1290290 - protein, 20 aa, Mycobacterium
AEHPRLRLVIAHMGGPEYSE

SEQ ID NO: 1290291 - protein, 19 aa, Mycobacterium
AEHWSGFGDAEMVFAEPTK

SEQ ID NO: 1290292 - protein, 21 aa, Mycobacterium
AEIALAWSRDRARAMPEIEQV

SEQ ID NO: 1290293 - protein, 22 aa, Mycobacterium
AEIDAPCELVDFWRFNVAFARQ

SEQ ID NO: 1290294 - protein, 22 aa, Mycobacterium
AEIPKRLAAMLTEHLVLDAPVQ

SEQ ID NO: 1290295 - protein, 17 aa, Mycobacterium
AEIPLLVVITEGIPVQD

SEQ ID NO: 1290296 - protein, 21 aa, Mycobacterium
AELAWVLGCFTGFGQASRMTQ

SEQ ID NO: 1290297 - protein, 25 aa, Mycobacterium
AELEKAGVCVLDLNPAVVGPHCVPA

SEQ ID NO: 1290298 - protein, 20 aa, Mycobacterium
AELFAAWAVYLLVGYEQASL

SEQ ID NO: 1290299 - protein, 17 aa, Mycobacterium
AELFKPLPSMVVAHYLG

SEQ ID NO: 1290300 - protein, 25 aa, Mycobacterium
AELFPRMPIPQAWFDAGIAYRSTDL

SEQ ID NO: 1290301 - protein, 21 aa, Mycobacterium
AELGEQCAFGLALIAPQLPPF

SEQ ID NO: 1290302 - protein, 20 aa, Mycobacterium
AELIGPALEDWAKWGQARHD

SEQ ID NO: 1290303 - protein, 22 aa, Mycobacterium
AELLDRFGMFGIRIAIAVLRAG

SEQ ID NO: 1290304 - protein, 20 aa, Mycobacterium
AELRGRWIGMLTHCRRARLL

SEQ ID NO: 1290305 - protein, 17 aa, Mycobacterium
AELRSPAGFAQHPQLAA

SEQ ID NO: 1290306 - protein, 23 aa, Mycobacterium
AELRTRLRTILGRELGMPDNAVD

SEQ ID NO: 1290307 - protein, 17 aa, Mycobacterium
AEMSLRYGRLFDATVRT

SEQ ID NO: 1290308 - protein, 26 aa, Mycobacterium
AEPALPRLLGRLVIMGGAFDYRGNTT

SEQ ID NO: 1290309 - protein, 19 aa, Mycobacterium
AEPKWVLAMGVCASSGGMF

SEQ ID NO: 1290310 - protein, 22 aa, Mycobacterium
AEPLLRRIDILAAQGHPGAQQL

SEQ ID NO: 1290311 - protein, 22 aa, Mycobacterium
AEQIAGLLYRYARAVDTKDWEL

SEQ ID NO: 1290312 - protein, 23 aa, Mycobacterium
AEQMKMFLTRLGFGSKIVVTGDI

SEQ ID NO: 1290313 - protein, 23 aa, Mycobacterium
AEQRLRAVESWSVLPDFASLNWH

SEQ ID NO: 1290314 - protein, 17 aa, Mycobacterium
AEQVMEWAGLDLLILRV

SEQ ID NO: 1290315 - protein, 19 aa, Mycobacterium
AERVRKIVCSFPRQSDSFV

SEQ ID NO: 1290316 - protein, 18 aa, Mycobacterium
AESLAGQGARVAVTEIDP

SEQ ID NO: 1290317 - protein, 19 aa, Mycobacterium
AESLKWHGLEVVVYDQVES

SEQ ID NO: 1290318 - protein, 18 aa, Mycobacterium
AESVWACRTLAATHYASG

SEQ ID NO: 1290319 - protein, 25 aa, Mycobacterium
AESWNVFDPVVIRWRLEVGDRTAQL

SEQ ID NO: 1290320 - protein, 19 aa, Mycobacterium
AETFARAGVNVVITGRTQA

SEQ ID NO: 1290321 - protein, 17 aa, Mycobacterium
AETGLSCSVGISDNKQR

SEQ ID NO: 1290322 - protein, 18 aa, Mycobacterium
AETILRFAYGSFRHANLM

SEQ ID NO: 1290323 - protein, 31 aa, Mycobacterium
AETVKTWPVRLMKFVLSVGWLATAHREYSEI

SEQ ID NO: 1290324 - protein, 23 aa, Mycobacterium
AEVEGRPGLALGWGATLGTVERR

SEQ ID NO: 1290325 - protein, 19 aa, Mycobacterium
AEVFDCARLLNARVDNRAR

SEQ ID NO: 1290326 - protein, 18 aa, Mycobacterium
AEVLGIHYEIPWPNREMK

SEQ ID NO: 1290327 - protein, 20 aa, Mycobacterium
AEVLRRLKALPGFGEQKAKI

SEQ ID NO: 1290328 - protein, 19 aa, Mycobacterium
AEVPARFEALAALGGLDRA

SEQ ID NO: 1290329 - protein, 20 aa, Mycobacterium
AEVRLPLTWITLLHGRIGAS

SEQ ID NO: 1290330 - protein, 20 aa, Mycobacterium
AEVVHRIRCAAGAFADLGIG

SEQ ID NO: 1290331 - protein, 21 aa, Mycobacterium
AEVYVPFSWYEPMWLESLGFA

SEQ ID NO: 1290332 - protein, 17 aa, Mycobacterium
AEWAHLVAGTSSIREGS

SEQ ID NO: 1290333 - protein, 17 aa, Mycobacterium
AEWKVFLSLVREGFEKD

SEQ ID NO: 1290334 - protein, 19 aa, Mycobacterium
AEYGRLVLRNTISLLAQVV

SEQ ID NO: 1290335 - protein, 21 aa, Mycobacterium
AEYLFRLALPTGIYGGTLDVF

SEQ ID NO: 1290336 - protein, 30 aa, Mycobacterium
AEYRGQWLICRALEVVLGWIADDNCGAMQA

SEQ ID NO: 1290337 - protein, 18 aa, Mycobacterium
AFAALGFSADEMGRMFAQ

SEQ ID NO: 1290338 - protein, 18 aa, Mycobacterium
AFCTRVGFGGAKQHKLQK

SEQ ID NO: 1290339 - protein, 22 aa, Mycobacterium
AFDWPVSLFAERTWHIARPLPE

SEQ ID NO: 1290340 - protein, 21 aa, Mycobacterium
AFEPKLRWEAAVFEERPGIDA

SEQ ID NO: 1290341 - protein, 18 aa, Mycobacterium
AFERQWWKYAGSKEDAIK

SEQ ID NO: 1290342 - protein, 19 aa, Mycobacterium
AFGTEWDKWHSGAGQVVRG

SEQ ID NO: 1290343 - protein, 17 aa, Mycobacterium
AFNLGFGDITFGDKTSN

SEQ ID NO: 1290344 - protein, 18 aa, Mycobacterium
AFPAIALCLRFLAAGDHP

SEQ ID NO: 1290345 - protein, 18 aa, Mycobacterium
AFTALAARFLGPTLDGVR

SEQ ID NO: 1290346 - protein, 17 aa, Mycobacterium
AFTGKKPSLAWAETYPG

SEQ ID NO: 1290347 - protein, 18 aa, Mycobacterium
AFVLMPWLAAEPEATLTV

SEQ ID NO: 1290348 - protein, 18 aa, Mycobacterium
AGAAERWFAPGFVDREPG

SEQ ID NO: 1290349 - protein, 18 aa, Mycobacterium
AGAARWAVRMAKEREKNA

SEQ ID NO: 1290350 - protein, 17 aa, Mycobacterium
AGACSMAAFTASMHAGQ

SEQ ID NO: 1290351 - protein, 18 aa, Mycobacterium
AGADWPRLADAYRMRAAV

SEQ ID NO: 1290352 - protein, 17 aa, Mycobacterium
AGAKRTHWIWFVFPQLR

SEQ ID NO: 1290353 - protein, 18 aa, Mycobacterium
AGAPFGFAVTTAPHDWAW

SEQ ID NO: 1290354 - protein, 22 aa, Mycobacterium
AGATARRGPLCLGIDPHPELLR

SEQ ID NO: 1290355 - protein, 17 aa, Mycobacterium
AGATYRPGTRFGPQGIR

SEQ ID NO: 1290356 - protein, 22 aa, Mycobacterium
AGCGMACPFCATGQGGLKRNLS

SEQ ID NO: 1290357 - protein, 19 aa, Mycobacterium
AGDDWLCLLEAFDQPHRPG

SEQ ID NO: 1290358 - protein, 26 aa, Mycobacterium
AGDESRPSWPMIVFRTPKGWTGPAYI

SEQ ID NO: 1290359 - protein, 22 aa, Mycobacterium
AGDRLGSVALTWEAGGDSGTLT

SEQ ID NO: 1290360 - protein, 17 aa, Mycobacterium
AGFDAVWASEFYSRSGS

SEQ ID NO: 1290361 - protein, 18 aa, Mycobacterium
AGFDAVWASEFYSRSGSI

SEQ ID NO: 1290362 - protein, 17 aa, Mycobacterium
AGFDVIRAGAGVGGDGH

SEQ ID NO: 1290363 - protein, 18 aa, Mycobacterium
AGFMTVWARMYAPDGAAF

SEQ ID NO: 1290364 - protein, 19 aa, Mycobacterium
AGFQCGFCTAGMVTTASAL

SEQ ID NO: 1290365 - protein, 17 aa, Mycobacterium
AGGDRFGLRRGGLTFAR

SEQ ID NO: 1290366 - protein, 19 aa, Mycobacterium
AGGGPDWLIAPAIGYGASG

SEQ ID NO: 1290367 - protein, 24 aa, Mycobacterium
AGGIPAILGELWRGGHLHETVHSV

SEQ ID NO: 1290368 - protein, 18 aa, Mycobacterium
AGGISGWELTPSVDGHFD

SEQ ID NO: 1290369 - protein, 21 aa, Mycobacterium
AGGLRPVLCLTKSDLAPAEPF

SEQ ID NO: 1290370 - protein, 24 aa, Mycobacterium
AGGPGGATRPAWSPTGAPGAGGAG

SEQ ID NO: 1290371 - protein, 27 aa, Mycobacterium
AGGVGGKGIQGGQGLQGGQGGDGGTGG

SEQ ID NO: 1290372 - protein, 20 aa, Mycobacterium
AGHGGRGGWIAGDGGDGGDG

SEQ ID NO: 1290373 - protein, 17 aa, Mycobacterium
AGHLLRQRWQPVYASEE

SEQ ID NO: 1290374 - protein, 23 aa, Mycobacterium
AGHPRWVAADVMAGRLNQVGVAK

SEQ ID NO: 1290375 - protein, 18 aa, Mycobacterium
AGILRYSRDLAFAAATAY

SEQ ID NO: 1290376 - protein, 17 aa, Mycobacterium
AGLARYAAADAMQKGAM

SEQ ID NO: 1290377 - protein, 22 aa, Mycobacterium
AGLAWLQARMGRFAECRVNAAE

SEQ ID NO: 1290378 - protein, 17 aa, Mycobacterium
AGLDFGLKYGDQAQEFA

SEQ ID NO: 1290379 - protein, 25 aa, Mycobacterium
AGLEASGFRAGCPVLAVAVETNDDA

SEQ ID NO: 1290380 - protein, 19 aa, Mycobacterium
AGLKIVPTMGVYAATKNAV

SEQ ID NO: 1290381 - protein, 23 aa, Mycobacterium
AGLLAGAVTLVWQAGEVRQVNEL

SEQ ID NO: 1290382 - protein, 17 aa, Mycobacterium
AGLPEEWSPESESSREL

SEQ ID NO: 1290383 - protein, 20 aa, Mycobacterium
AGLQARFGLDTGKWTAEQMA

SEQ ID NO: 1290384 - protein, 19 aa, Mycobacterium
AGLRRLKLAAVRRTAPEVL

SEQ ID NO: 1290385 - protein, 22 aa, Mycobacterium
AGLSLRPGYVLSDGFRVPGLPM

SEQ ID NO: 1290386 - protein, 17 aa, Mycobacterium
AGMDGYAGRLWLPMLEA

SEQ ID NO: 1290387 - protein, 19 aa, Mycobacterium
AGMPGRLKAVAALFPTVSR

SEQ ID NO: 1290388 - protein, 19 aa, Mycobacterium
AGNGLRPAIWDEFTNRFGI

SEQ ID NO: 1290389 - protein, 17 aa, Mycobacterium
AGPGWYGGGPLSVRPDR

SEQ ID NO: 1290390 - protein, 36 aa, Mycobacterium
AGPIGALLLWRAGLADSIRTIFGFGRAAAESQVSDL

SEQ ID NO: 1290391 - protein, 25 aa, Mycobacterium
AGRRTGLIWLRWFLPEATPARPQCR

SEQ ID NO: 1290392 - protein, 17 aa, Mycobacterium
AGRRVALLVGRGAAGAA

SEQ ID NO: 1290393 - protein, 17 aa, Mycobacterium
AGSLIPLTSAGAYPSTE

SEQ ID NO: 1290394 - protein, 19 aa, Mycobacterium
AGSLPAEWWGADAPGSPPS

SEQ ID NO: 1290395 - protein, 18 aa, Mycobacterium
AGSLRPGDLAVWDGHVAM

SEQ ID NO: 1290396 - protein, 18 aa, Mycobacterium
AGSLWWRTVQTVAAEYPD

SEQ ID NO: 1290397 - protein, 26 aa, Mycobacterium
AGTFYWPFGFAILGDRFWVADTGNRR

SEQ ID NO: 1290398 - protein, 18 aa, Mycobacterium
AGTKFGDAALRDHVAVDG

SEQ ID NO: 1290399 - protein, 25 aa, Mycobacterium
AGTRRGWLRCRLLEPSPGQDTYSES

SEQ ID NO: 1290400 - protein, 17 aa, Mycobacterium
AGVATWWRTVGPKVAGL

SEQ ID NO: 1290401 - protein, 19 aa, Mycobacterium
AGVEWKDIQFGFGGSYEVS

SEQ ID NO: 1290402 - protein, 18 aa, Mycobacterium
AGVGWACLDMAVEYAKVR

SEQ ID NO: 1290403 - protein, 18 aa, Mycobacterium
AGVRRIVYLGGFVPDDDS

SEQ ID NO: 1290404 - protein, 23 aa, Mycobacterium
AGVTCGLGRGWGLPKSVRLGIAA

SEQ ID NO: 1290405 - protein, 20 aa, Mycobacterium
AGWRLAAAATTWSDVTALMT

SEQ ID NO: 1290406 - protein, 21 aa, Mycobacterium
AGYLVSRRGRYGGTFIADALP

SEQ ID NO: 1290407 - protein, 23 aa, Mycobacterium
AGYPKEMRRFLAANPGLASRFNF

SEQ ID NO: 1290408 - protein, 23 aa, Mycobacterium
AGYRFPRLRFVASVGEPLNAEAV

SEQ ID NO: 1290409 - protein, 17 aa, Mycobacterium
AGYRPELDLAQAGIATQ

SEQ ID NO: 1290410 - protein, 19 aa, Mycobacterium
AHDQFRWFAGGWAVNSDLP

SEQ ID NO: 1290411 - protein, 17 aa, Mycobacterium
AHLDRIALLYAEDPDLC

SEQ ID NO: 1290412 - protein, 27 aa, Mycobacterium
AHPGVPRFDCWRGMAIPGHATAIGKNI

SEQ ID NO: 1290413 - protein, 20 aa, Mycobacterium
AHRAKWGLLLARTDPDVPKH

SEQ ID NO: 1290414 - protein, 17 aa, Mycobacterium
AHRWLRWDEAVECEVAI

SEQ ID NO: 1290415 - protein, 17 aa, Mycobacterium
AHSLGFEGFADLQVSLR

SEQ ID NO: 1290416 - protein, 17 aa, Mycobacterium
AHWAQWCFVVARTEKGS

SEQ ID NO: 1290417 - protein, 26 aa, Mycobacterium
AIAQARLGPGRIHHCMRAIGAAERAL

SEQ ID NO: 1290418 - protein, 26 aa, Mycobacterium
AIDEIIRWATPVHCFQRTALEDVEVG

SEQ ID NO: 1290419 - protein, 21 aa, Mycobacterium
AIDSELGWSRDVWKQLAEVGV

SEQ ID NO: 1290420 - protein, 22 aa, Mycobacterium
AIEAWAKPVLLAWGDADKMFPM

SEQ ID NO: 1290421 - protein, 24 aa, Mycobacterium
AIEEVFIRAGIPYKVVGGVRFYER

SEQ ID NO: 1290422 - protein, 19 aa, Mycobacterium
AIGAWRISKNISKGVKSAH

SEQ ID NO: 1290423 - protein, 17 aa, Mycobacterium
AIIARVVARYGLTGTTA

SEQ ID NO: 1290424 - protein, 17 aa, Mycobacterium
AIIPPTFLTSAACWAPP

SEQ ID NO: 1290425 - protein, 25 aa, Mycobacterium
AILAKAIVMRAWLAGWNPVVDQYAV

SEQ ID NO: 1290426 - protein, 18 aa, Mycobacterium
AILDEWKTITGLDRKVDD

SEQ ID NO: 1290427 - protein, 17 aa, Mycobacterium
AIMDVVWRADEAVRVRD

SEQ ID NO: 1290428 - protein, 18 aa, Mycobacterium
AIMSVREGIDFGTVVTTD

SEQ ID NO: 1290429 - protein, 21 aa, Mycobacterium
AIPAWKIAPALVYGNTVVWKP

SEQ ID NO: 1290430 - protein, 19 aa, Mycobacterium
AIQCARTLLDAHLVDGRLR

SEQ ID NO: 1290431 - protein, 23 aa, Mycobacterium
AIRFPELRAVLTYVTPSPVSREV

SEQ ID NO: 1290432 - protein, 23 aa, Mycobacterium
AIRRLERDLGIVIVQRGHRFEGF

SEQ ID NO: 1290433 - protein, 17 aa, Mycobacterium
AIVKGRCFAGNAVIAGA

SEQ ID NO: 1290434 - protein, 18 aa, Mycobacterium
AIVLGDWPARTPATGQLP

SEQ ID NO: 1290435 - protein, 17 aa, Mycobacterium
AIWPDLFIVGGGISRKA

SEQ ID NO: 1290436 - protein, 18 aa, Mycobacterium
AKAFGTPGFRAWAAHARG

SEQ ID NO: 1290437 - protein, 19 aa, Mycobacterium
AKARGLWNLFLPSESGLSN

SEQ ID NO: 1290438 - protein, 17 aa, Mycobacterium
AKFGWPVFEISTVAREG

SEQ ID NO: 1290439 - protein, 17 aa, Mycobacterium
AKGAWLWSGRDAVAAGL

SEQ ID NO: 1290440 - protein, 18 aa, Mycobacterium
AKGPIRIWGRCSLRENGT

SEQ ID NO: 1290441 - protein, 19 aa, Mycobacterium
AKIGMYIALRLLRDGAHTT

SEQ ID NO: 1290442 - protein, 22 aa, Mycobacterium
AKKFRFPTFVGAFKYYTSYTLK

SEQ ID NO: 1290443 - protein, 19 aa, Mycobacterium
AKLEAALVYTTRELPSDPS

SEQ ID NO: 1290444 - protein, 19 aa, Mycobacterium
AKLGCTFAVVGHSERRTYH

SEQ ID NO: 1290445 - protein, 18 aa, Mycobacterium
AKLMERWSSRRAAIKART

SEQ ID NO: 1290446 - protein, 19 aa, Mycobacterium
AKLRLAGLVKGRREGTFVF

SEQ ID NO: 1290447 - protein, 19 aa, Mycobacterium
AKMQGWPGIMEGINNTIGE

SEQ ID NO: 1290448 - protein, 20 aa, Mycobacterium
AKRPRLIPIWDSFVEQATGL

SEQ ID NO: 1290449 - protein, 19 aa, Mycobacterium
AKTRLAPMFSARTREDVVL

SEQ ID NO: 1290450 - protein, 22 aa, Mycobacterium
ALAARLKKVWAPQGLVQRSQGK

SEQ ID NO: 1290451 - protein, 22 aa, Mycobacterium
ALACKATAVADGYRINGAKAWI

SEQ ID NO: 1290452 - protein, 19 aa, Mycobacterium
ALAPSRRTAWVDLIAADSA

SEQ ID NO: 1290453 - protein, 20 aa, Mycobacterium
ALARRVPLGLARTGTTGSHF

SEQ ID NO: 1290454 - protein, 24 aa, Mycobacterium
ALASRARKAPGFALLGEKGESRDL

SEQ ID NO: 1290455 - protein, 18 aa, Mycobacterium
ALDHLPRLASALSVSTDE

SEQ ID NO: 1290456 - protein, 24 aa, Mycobacterium
ALDLRKRFRRVLGRTVPLATLLGG

SEQ ID NO: 1290457 - protein, 23 aa, Mycobacterium
ALDTRAWRLPWLNDTVIYEVEQP

SEQ ID NO: 1290458 - protein, 18 aa, Mycobacterium
ALDTWPLNIALLGKGNTV

SEQ ID NO: 1290459 - protein, 22 aa, Mycobacterium
ALEIPGKIAQNFANVVKSLTSL

SEQ ID NO: 1290460 - protein, 17 aa, Mycobacterium
ALELTWEALEDARIPAS

SEQ ID NO: 1290461 - protein, 17 aa, Mycobacterium
ALFEPATRSLVVLGSGP

SEQ ID NO: 1290462 - protein, 20 aa, Mycobacterium
ALGAIEWPVAAAIGVGQVVV

SEQ ID NO: 1290463 - protein, 23 aa, Mycobacterium
ALGCTIKLLAICERLTTGKGKQQ

SEQ ID NO: 1290464 - protein, 18 aa, Mycobacterium
ALGIRPGDRVLLQLPNSC

SEQ ID NO: 1290465 - protein, 24 aa, Mycobacterium
ALHVRLGPFLAYWPAGLMLRCALQ

SEQ ID NO: 1290466 - protein, 20 aa, Mycobacterium
ALKAIGRQGVRVHDLRHFAG

SEQ ID NO: 1290467 - protein, 19 aa, Mycobacterium
ALKIGWFEGGIAWVPTALQ

SEQ ID NO: 1290468 - protein, 22 aa, Mycobacterium
ALKRRCLHLFLDYPAAERELEI

SEQ ID NO: 1290469 - protein, 17 aa, Mycobacterium
ALLPHLATRYRVIAPDL

SEQ ID NO: 1290470 - protein, 22 aa, Mycobacterium
ALLSVSFGDDWAWVRRAHDAGC

SEQ ID NO: 1290471 - protein, 18 aa, Mycobacterium
ALMAIGIEKGDRVGIWAP

SEQ ID NO: 1290472 - protein, 19 aa, Mycobacterium
ALMGLECVIYMGAVDTARQ

SEQ ID NO: 1290473 - protein, 17 aa, Mycobacterium
ALMILPVSYWKLTDREI

SEQ ID NO: 1290474 - protein, 26 aa, Mycobacterium
ALNEARPGCRLEILAGVGHFPHVEKP

SEQ ID NO: 1290475 - protein, 17 aa, Mycobacterium
ALNEVNWRMLSVVSDDV

SEQ ID NO: 1290476 - protein, 19 aa, Mycobacterium
ALNLLRWTSARSIKETFVP

SEQ ID NO: 1290477 - protein, 24 aa, Mycobacterium
ALPGHAPSGLGFRPDGSLLITSVE

SEQ ID NO: 1290478 - protein, 17 aa, Mycobacterium
ALPLLARRMLDPHELPG

SEQ ID NO: 1290479 - protein, 18 aa, Mycobacterium
ALPPDWANYGTIIDTFSK

SEQ ID NO: 1290480 - protein, 17 aa, Mycobacterium
ALPRLEPGVALPCCRQT

SEQ ID NO: 1290481 - protein, 18 aa, Mycobacterium
ALPRRLQIEFSQAIQQIT

SEQ ID NO: 1290482 - protein, 21 aa, Mycobacterium
ALQFLRGGRRWILKSPQHLGQ

SEQ ID NO: 1290483 - protein, 18 aa, Mycobacterium
ALQPRLYVSPALVRTDLL

SEQ ID NO: 1290484 - protein, 17 aa, Mycobacterium
ALQRLWLIEAVKYNVVP

SEQ ID NO: 1290485 - protein, 18 aa, Mycobacterium
ALQTLEWARMALASCHLT

SEQ ID NO: 1290486 - protein, 20 aa, Mycobacterium
ALRAVTFWANQGGWTTRTIA

SEQ ID NO: 1290487 - protein, 17 aa, Mycobacterium
ALREVRTTLVPDYFGGN

SEQ ID NO: 1290488 - protein, 21 aa, Mycobacterium
ALRGFPPVPSRWIDPASVPGW

SEQ ID NO: 1290489 - protein, 20 aa, Mycobacterium
ALRRRMPWTLVEREYRFEGP

SEQ ID NO: 1290490 - protein, 20 aa, Mycobacterium
ALRRSVKFPAFLDGIEAVRR

SEQ ID NO: 1290491 - protein, 17 aa, Mycobacterium
ALRSVPIVVGRADVDGV

SEQ ID NO: 1290492 - protein, 19 aa, Mycobacterium
ALSSRPAVVFSRRQLLEAV

SEQ ID NO: 1290493 - protein, 18 aa, Mycobacterium
ALTALARRYESWLTAHPD

SEQ ID NO: 1290494 - protein, 24 aa, Mycobacterium
ALTWPGTRVELCFPGDRPLPQHHT

SEQ ID NO: 1290495 - protein, 28 aa, Mycobacterium
ALTYPRRLGFGLGETVVSLAWRTGDDIV

SEQ ID NO: 1290496 - protein, 17 aa, Mycobacterium
ALVPGRIPPYVVGLVEL

SEQ ID NO: 1290497 - protein, 19 aa, Mycobacterium
ALVRFGFAAGDGLRRLAGT

SEQ ID NO: 1290498 - protein, 24 aa, Mycobacterium
AMARACIDEGWLLSLSGTVSFKNA

SEQ ID NO: 1290499 - protein, 24 aa, Mycobacterium
AMCARFRISGLPVVDDRGSLVGII

SEQ ID NO: 1290500 - protein, 22 aa, Mycobacterium
AMDRKVWLPSGGTLVIDRTEAM

SEQ ID NO: 1290501 - protein, 18 aa, Mycobacterium
AMGALGLFGVRPGALLDD

SEQ ID NO: 1290502 - protein, 17 aa, Mycobacterium
AMGPAFWAELPVVFHEL

SEQ ID NO: 1290503 - protein, 21 aa, Mycobacterium
AMIDWLGPIIWEYYSSTEVHG

SEQ ID NO: 1290504 - protein, 21 aa, Mycobacterium
AMLDMRIRGVFAMPVLIAGEY

SEQ ID NO: 1290505 - protein, 18 aa, Mycobacterium
AMLVGLGDPVLWAVPLHW

SEQ ID NO: 1290506 - protein, 18 aa, Mycobacterium
AMQKHWYSAMEVLAEYSI

SEQ ID NO: 1290507 - protein, 17 aa, Mycobacterium
AMREAYHGWTYGTDAVS

SEQ ID NO: 1290508 - protein, 23 aa, Mycobacterium
AMRRPRVGVMIARGDLAVEVGYE

SEQ ID NO: 1290509 - protein, 23 aa, Mycobacterium
ANAARLGLQDVIWRGTYYTPAGP

SEQ ID NO: 1290510 - protein, 17 aa, Mycobacterium
ANAFKSVGFMLEATGHN

SEQ ID NO: 1290511 - protein, 23 aa, Mycobacterium
ANDSRYGLVGAVWSADEERAASV

SEQ ID NO: 1290512 - protein, 19 aa, Mycobacterium
ANLRPMFGGHLIKVEDDIK

SEQ ID NO: 1290513 - protein, 20 aa, Mycobacterium
ANRAHLFLFLTLCRDHDVVV

SEQ ID NO: 1290514 - protein, 17 aa, Mycobacterium
ANVALSRWGMLAPDGQC

SEQ ID NO: 1290515 - protein, 17 aa, Mycobacterium
ANWARRDFPAIAADVRV

SEQ ID NO: 1290516 - protein, 20 aa, Mycobacterium
APAARWAFCNGMTPAQRRLT

SEQ ID NO: 1290517 - protein, 17 aa, Mycobacterium
APAGLRANMIFSADGAA

SEQ ID NO: 1290518 - protein, 21 aa, Mycobacterium
APAGTRKAYFIGIDDPIETPV

SEQ ID NO: 1290519 - protein, 20 aa, Mycobacterium
APAQAWLRRCAEANRHAVDA

SEQ ID NO: 1290520 - protein, 21 aa, Mycobacterium
APARLRAAATFNLPIPTDTRP

SEQ ID NO: 1290521 - protein, 18 aa, Mycobacterium
APCRDWLDVRFCAEDDDD

SEQ ID NO: 1290522 - protein, 18 aa, Mycobacterium
APDKLRIANLYDYSVALV

SEQ ID NO: 1290523 - protein, 19 aa, Mycobacterium
APDRLRWVIGEAVKAIEDG

SEQ ID NO: 1290524 - protein, 17 aa, Mycobacterium
APFGYPEVHYLTSPLRA

SEQ ID NO: 1290525 - protein, 18 aa, Mycobacterium
APGADWGVVYARTGEGRD

SEQ ID NO: 1290526 - protein, 23 aa, Mycobacterium
APGLFPSRMTKVLLAAGEEAVGA

SEQ ID NO: 1290527 - protein, 17 aa, Mycobacterium
APGSFSWHVLSSLTDEV

SEQ ID NO: 1290528 - protein, 20 aa, Mycobacterium
APHRGHVALGHFYDTFIGPR

SEQ ID NO: 1290529 - protein, 23 aa, Mycobacterium
APITPVLVPLTWVPIVGKPLAIA

SEQ ID NO: 1290530 - protein, 18 aa, Mycobacterium
APLISWDSAFGLVKINPL

SEQ ID NO: 1290531 - protein, 19 aa, Mycobacterium
APLKLAFDYTRSVGPLLGE

SEQ ID NO: 1290532 - protein, 17 aa, Mycobacterium
APLPWAQMHKVAAPTLL

SEQ ID NO: 1290533 - protein, 17 aa, Mycobacterium
APLSALLPMGGAVSGVA

SEQ ID NO: 1290534 - protein, 17 aa, Mycobacterium
APLSFRGAAYSGVFTLM

SEQ ID NO: 1290535 - protein, 20 aa, Mycobacterium
APMFHAWGFGQLVFAAMMAC

SEQ ID NO: 1290536 - protein, 19 aa, Mycobacterium
APMFHAWGFSQLAFAASMS

SEQ ID NO: 1290537 - protein, 20 aa, Mycobacterium
APMLCCDWRIHARVELTDEG

SEQ ID NO: 1290538 - protein, 19 aa, Mycobacterium
APMTLRWLRDRFAGRPLRT

SEQ ID NO: 1290539 - protein, 24 aa, Mycobacterium
APPGLPWEMVWSFHLLPHWEDRCR

SEQ ID NO: 1290540 - protein, 19 aa, Mycobacterium
APQMWRWAASRSVDQRTAL

SEQ ID NO: 1290541 - protein, 19 aa, Mycobacterium
APQRVGWFRFYFADERWEW

SEQ ID NO: 1290542 - protein, 23 aa, Mycobacterium
APRFTCSKVFCRLNIAVIALSIS

SEQ ID NO: 1290543 - protein, 23 aa, Mycobacterium
APRIVAGIPVCLCANSEIDAAKD

SEQ ID NO: 1290544 - protein, 18 aa, Mycobacterium
APRMRRLAADGVLRSEDV

SEQ ID NO: 1290545 - protein, 20 aa, Mycobacterium
APRPKMLVFGAIDFASALAR

SEQ ID NO: 1290546 - protein, 17 aa, Mycobacterium
APRTVLILVEWESREAF

SEQ ID NO: 1290547 - protein, 24 aa, Mycobacterium
APRWDTAIIGLDWETSVLDERLAA

SEQ ID NO: 1290548 - protein, 21 aa, Mycobacterium
APTLREAWAVIAPMLAGCTPV

SEQ ID NO: 1290549 - protein, 19 aa, Mycobacterium
APVKPAEFVIFRLAQYSGG

SEQ ID NO: 1290550 - protein, 18 aa, Mycobacterium
APVLPARSLVALCGGGTI

SEQ ID NO: 1290551 - protein, 22 aa, Mycobacterium
APYPELIDLLVLDAIESPYDPW

SEQ ID NO: 1290552 - protein, 17 aa, Mycobacterium
AQAIWYLQDRVIAPDFN

SEQ ID NO: 1290553 - protein, 19 aa, Mycobacterium
AQAWPHWADPDVVRAFHDR

SEQ ID NO: 1290554 - protein, 20 aa, Mycobacterium
AQGWCPFRAPAVLAQTARTA

SEQ ID NO: 1290555 - protein, 19 aa, Mycobacterium
AQIPHPWFDLIFAGGHEKT

SEQ ID NO: 1290556 - protein, 21 aa, Mycobacterium
AQIPVPAQWQWPQSIITDPER

SEQ ID NO: 1290557 - protein, 20 aa, Mycobacterium
AQLDRFAIRLELKYLNESEE

SEQ ID NO: 1290558 - protein, 17 aa, Mycobacterium
AQLEACFEELSELAGKR

SEQ ID NO: 1290559 - protein, 19 aa, Mycobacterium
AQLEAGFGLRTLIHMDDPH

SEQ ID NO: 1290560 - protein, 17 aa, Mycobacterium
AQLYLKRLLSFSRFMGG

SEQ ID NO: 1290561 - protein, 20 aa, Mycobacterium
AQRAGLMGAFVIGLATTRYV

SEQ ID NO: 1290562 - protein, 23 aa, Mycobacterium
AQRDCVYYATLIMWIGCHADSHE

SEQ ID NO: 1290563 - protein, 17 aa, Mycobacterium
AQRGMAVVGGRGSGAVM

SEQ ID NO: 1290564 - protein, 17 aa, Mycobacterium
AQSGFVFQSHNLFPHKT

SEQ ID NO: 1290565 - protein, 17 aa, Mycobacterium
AQVRRWLAAHLPEAEVV

SEQ ID NO: 1290566 - protein, 19 aa, Mycobacterium
AQYLGPALRLMNFNYLPLP

SEQ ID NO: 1290567 - protein, 17 aa, Mycobacterium
AQYSEWGALLARTDPSA

SEQ ID NO: 1290568 - protein, 18 aa, Mycobacterium
ARAAFEWSRTQQRPDGTW

SEQ ID NO: 1290569 - protein, 17 aa, Mycobacterium
ARAAMPVPAGWSGTEHL

SEQ ID NO: 1290570 - protein, 22 aa, Mycobacterium
ARAEPFPVFTFFRDYNRYLSRG

SEQ ID NO: 1290571 - protein, 22 aa, Mycobacterium
ARAGELLGELGLRPERHNDALM

SEQ ID NO: 1290572 - protein, 19 aa, Mycobacterium
ARAKEAFGIQKRQRQMDRC

SEQ ID NO: 1290573 - protein, 18 aa, Mycobacterium
ARAKGAVLDPVIARLTGG

SEQ ID NO: 1290574 - protein, 19 aa, Mycobacterium
ARALGRFGVRANAIAPRAR

SEQ ID NO: 1290575 - protein, 19 aa, Mycobacterium
ARAPSGLGLREPPGVRPRA

SEQ ID NO: 1290576 - protein, 19 aa, Mycobacterium
ARAPWEIARPVGADGALAT

SEQ ID NO: 1290577 - protein, 21 aa, Mycobacterium
ARARGRFAKELAMSFPAHTTA

SEQ ID NO: 1290578 - protein, 24 aa, Mycobacterium
ARATETWRFPAFFHGLLDAGVYPP

SEQ ID NO: 1290579 - protein, 17 aa, Mycobacterium
ARCLLSLAISYIAVATD

SEQ ID NO: 1290580 - protein, 17 aa, Mycobacterium
ARCRPSPTRWVIRSRSC

SEQ ID NO: 1290581 - protein, 25 aa, Mycobacterium
ARCRRLEALPGWSWEYRARPTWEAA

SEQ ID NO: 1290582 - protein, 23 aa, Mycobacterium
ARDIPSLGWRAYRRCPGAAGSWQ

SEQ ID NO: 1290583 - protein, 18 aa, Mycobacterium
ARDLKFYAFYGEVLFVLE

SEQ ID NO: 1290584 - protein, 23 aa, Mycobacterium
ARDRFAGAMPMLFTAQRTAEVRR

SEQ ID NO: 1290585 - protein, 23 aa, Mycobacterium
AREFKPLVLVAGYSAYPRRVNFA

SEQ ID NO: 1290586 - protein, 23 aa, Mycobacterium
AREISLAVARGWQVVGVVAAQDD

SEQ ID NO: 1290587 - protein, 19 aa, Mycobacterium
ARFGDLRLRLRVNGDERQN

SEQ ID NO: 1290588 - protein, 18 aa, Mycobacterium
ARFGWPKRNGFVQPLVDA

SEQ ID NO: 1290589 - protein, 20 aa, Mycobacterium
ARFKGVRQFARWMADEGEID

SEQ ID NO: 1290590 - protein, 21 aa, Mycobacterium
ARFPEPLAPLAAARRSGAELP

SEQ ID NO: 1290591 - protein, 17 aa, Mycobacterium
ARGATPLARVMGASITS

SEQ ID NO: 1290592 - protein, 19 aa, Mycobacterium
ARGGLRWSDRREDFRTEIL

SEQ ID NO: 1290593 - protein, 19 aa, Mycobacterium
ARGKRGGVIACALAHRATR

SEQ ID NO: 1290594 - protein, 24 aa, Mycobacterium
ARIGVEWWPELSLIDRSRHRGDVT

SEQ ID NO: 1290595 - protein, 17 aa, Mycobacterium
ARKAVVAGVTRWLPRPI

SEQ ID NO: 1290596 - protein, 21 aa, Mycobacterium
ARKLCRHAAGVMLQRGASPAA

SEQ ID NO: 1290597 - protein, 17 aa, Mycobacterium
ARLAHRGGFELVLAGPV

SEQ ID NO: 1290598 - protein, 17 aa, Mycobacterium
ARLALKWSEQYYAAERE

SEQ ID NO: 1290599 - protein, 18 aa, Mycobacterium
ARLEACFEELAELTGQRN

SEQ ID NO: 1290600 - protein, 17 aa, Mycobacterium
ARLGFTYAVVPSGVTSA

SEQ ID NO: 1290601 - protein, 18 aa, Mycobacterium
ARLGIRCFGFAPLRLPPD

SEQ ID NO: 1290602 - protein, 20 aa, Mycobacterium
ARLGSELGVLGMSVPESHGG

SEQ ID NO: 1290603 - protein, 17 aa, Mycobacterium
ARLIEWVAFTPLQNATG

SEQ ID NO: 1290604 - protein, 22 aa, Mycobacterium
ARLIGEGAPILWADMPTLPLYR

SEQ ID NO: 1290605 - protein, 17 aa, Mycobacterium
ARLKCPFTSLGIAPEAA

SEQ ID NO: 1290606 - protein, 18 aa, Mycobacterium
ARLLGPLAAYLVVNVSSP

SEQ ID NO: 1290607 - protein, 27 aa, Mycobacterium
ARLNWWESRALYGWTVLVPRTKDQAGE

SEQ ID NO: 1290608 - protein, 20 aa, Mycobacterium
ARLPVRLQWVRAELAMVRGD

SEQ ID NO: 1290609 - protein, 17 aa, Mycobacterium
ARLPVRLQWVSAELAMV

SEQ ID NO: 1290610 - protein, 19 aa, Mycobacterium
ARLRAQMAFVSSRVGESGA

SEQ ID NO: 1290611 - protein, 17 aa, Mycobacterium
ARLRAQMEFTRRRGGDT

SEQ ID NO: 1290612 - protein, 17 aa, Mycobacterium
ARMAEVFAGFLSYTDAQ

SEQ ID NO: 1290613 - protein, 17 aa, Mycobacterium
ARMGWLLSQNVLRKARA

SEQ ID NO: 1290614 - protein, 19 aa, Mycobacterium
ARMPSLRIPDFHMSSVSQA

SEQ ID NO: 1290615 - protein, 19 aa, Mycobacterium
ARMVLRLNGIRVRRNGCDV

SEQ ID NO: 1290616 - protein, 18 aa, Mycobacterium
ARNARAWHHAVAAAELHT

SEQ ID NO: 1290617 - protein, 19 aa, Mycobacterium
ARNDGGLWARLPAGVYVPL
